United States Patent 10,706,955 (BIOINFORMATIC PROCESSES FOR DETERMINATION OF PEPTIDE BINDING) - sequence listing, part 33

SEQ ID NO: 1287226 - protein, 18 aa, Mycobacterium
GAVTLVWQAGRVVQVNEL

SEQ ID NO: 1287227 - protein, 18 aa, Mycobacterium
GAVYWDPLATLGFLAACT

SEQ ID NO: 1287228 - protein, 17 aa, Mycobacterium
GAYRWLRPQGRRTAQEI

SEQ ID NO: 1287229 - protein, 21 aa, Mycobacterium
GCAGLRYNLFFDDRALDGDLT

SEQ ID NO: 1287230 - protein, 20 aa, Mycobacterium
GCGGLGSWIAEFIARAGASE

SEQ ID NO: 1287231 - protein, 17 aa, Mycobacterium
GCGTGFFLLNLIQAGVA

SEQ ID NO: 1287232 - protein, 18 aa, Mycobacterium
GCRMGICHSCTRRKTSGV

SEQ ID NO: 1287233 - protein, 20 aa, Mycobacterium
GCVGCSLMADHIGNLAHLNA

SEQ ID NO: 1287234 - protein, 20 aa, Mycobacterium
GDAEGALTFMSGWMGVDLAR

SEQ ID NO: 1287235 - protein, 17 aa, Mycobacterium
GDALRPAPVGAYPAGAS

SEQ ID NO: 1287236 - protein, 19 aa, Mycobacterium
GDARIAVQFVLNYEEGAEN

SEQ ID NO: 1287237 - protein, 24 aa, Mycobacterium
GDDRVASLFLWHFVEEVEHRSSAL

SEQ ID NO: 1287238 - protein, 17 aa, Mycobacterium
GDGFVPFIIPINDRTLE

SEQ ID NO: 1287239 - protein, 23 aa, Mycobacterium
GDGVRLSGRWSWATGVMHGNWIM

SEQ ID NO: 1287240 - protein, 17 aa, Mycobacterium
GDISWQRALLDGGVSVS

SEQ ID NO: 1287241 - protein, 20 aa, Mycobacterium
GDLPLFVALIVRVMVSAHFG

SEQ ID NO: 1287242 - protein, 17 aa, Mycobacterium
GDLPPHVRYVGAVHPAR

SEQ ID NO: 1287243 - protein, 19 aa, Mycobacterium
GDPRFSDVSSRVFGTPHDV

SEQ ID NO: 1287244 - protein, 21 aa, Mycobacterium
GDVDRAFAIACRMRTGNVTIN

SEQ ID NO: 1287245 - protein, 19 aa, Mycobacterium
GDVELAWRLDRAGWFGPPR

SEQ ID NO: 1287246 - protein, 17 aa, Mycobacterium
GDVGLMLSVPRQGLGNA

SEQ ID NO: 1287247 - protein, 25 aa, Mycobacterium
GDVGRPDLLASIGFTREELAEKLYD

SEQ ID NO: 1287248 - protein, 24 aa, Mycobacterium
GDWVSRIGLIPAHRAVATQALQSG

SEQ ID NO: 1287249 - protein, 24 aa, Mycobacterium
GDWVYIPKACTFRQIPDTESTLLM

SEQ ID NO: 1287250 - protein, 17 aa, Mycobacterium
GEFDAVICWHTDRLYRS

SEQ ID NO: 1287251 - protein, 17 aa, Mycobacterium
GEFRPDLTAAWLTEALY

SEQ ID NO: 1287252 - protein, 17 aa, Mycobacterium
GEGAVRLNHEFHRAINV

SEQ ID NO: 1287253 - protein, 23 aa, Mycobacterium
GEGRRLAPTMAWPVVSASYLRLA

SEQ ID NO: 1287254 - protein, 18 aa, Mycobacterium
GEHGRYLLAATFGNVHGV

SEQ ID NO: 1287255 - protein, 23 aa, Mycobacterium
GEIRAVWRINELLNWQVAAAGET

SEQ ID NO: 1287256 - protein, 18 aa, Mycobacterium
GELLGCAVPDGWPEFPES

SEQ ID NO: 1287257 - protein, 17 aa, Mycobacterium
GEPFVLHPGEFVLGSTL

SEQ ID NO: 1287258 - protein, 17 aa, Mycobacterium
GEPGDLCIVEGSPDEVL

SEQ ID NO: 1287259 - protein, 17 aa, Mycobacterium
GEPPPWWAAQRDPVVGD

SEQ ID NO: 1287260 - protein, 18 aa, Mycobacterium
GEPVDCQGYRRFATEMAR

SEQ ID NO: 1287261 - protein, 17 aa, Mycobacterium
GEQRASNFLLWQSAYAE

SEQ ID NO: 1287262 - protein, 17 aa, Mycobacterium
GETLEEYWWAAEQMLTW

SEQ ID NO: 1287263 - protein, 20 aa, Mycobacterium
GETMVRGRIDAVFADDDGGA

SEQ ID NO: 1287264 - protein, 25 aa, Mycobacterium
GEVTYGAEFFRWFAEEAVRIGGRYT

SEQ ID NO: 1287265 - protein, 18 aa, Mycobacterium
GFAARLGLLLGRTDDAGL

SEQ ID NO: 1287266 - protein, 17 aa, Mycobacterium
GFDRVTYSWIPRAANAR

SEQ ID NO: 1287267 - protein, 18 aa, Mycobacterium
GFYRRPLKVSGREDANGG

SEQ ID NO: 1287268 - protein, 20 aa, Mycobacterium
GGGLLRLPRRIPYQKALELA

SEQ ID NO: 1287269 - protein, 24 aa, Mycobacterium
GGNCNKCIPCRRGLFMQCVNMQVP

SEQ ID NO: 1287270 - protein, 19 aa, Mycobacterium
GGPCARTVLDTALLHQVIA

SEQ ID NO: 1287271 - protein, 23 aa, Mycobacterium
GGPDLRTATGLSVGGGQTARGQQ

SEQ ID NO: 1287272 - protein, 20 aa, Mycobacterium
GGRPEYWLSQQGRLTHPVVL

SEQ ID NO: 1287273 - protein, 18 aa, Mycobacterium
GGRYAGLVTLEMLIDTIT

SEQ ID NO: 1287274 - protein, 25 aa, Mycobacterium
GGSPIAIAVPAHWGPGTVGALRGAL

SEQ ID NO: 1287275 - protein, 22 aa, Mycobacterium
GGTWFLPRAVGYARAAEMTLTG

SEQ ID NO: 1287276 - protein, 23 aa, Mycobacterium
GHDTFCPVGPWIVTDVDPSDLEL

SEQ ID NO: 1287277 - protein, 17 aa, Mycobacterium
GHIPGAVKIDWHVDLND

SEQ ID NO: 1287278 - protein, 18 aa, Mycobacterium
GHKWAMLTAYDFSTARAF

SEQ ID NO: 1287279 - protein, 17 aa, Mycobacterium
GHLSTMGWIGVRPGDVH

SEQ ID NO: 1287280 - protein, 22 aa, Mycobacterium
GHRIRAAIHFDDLQWERSYSRV

SEQ ID NO: 1287281 - protein, 17 aa, Mycobacterium
GHVRLCLGYTEPEGGSD

SEQ ID NO: 1287282 - protein, 18 aa, Mycobacterium
GIDTVVVGWGYGRADFAE

SEQ ID NO: 1287283 - protein, 18 aa, Mycobacterium
GIEAWTGIGTSLCGIANR

SEQ ID NO: 1287284 - protein, 24 aa, Mycobacterium
GIPSPLEWACFTFGIIQNDGHFTF

SEQ ID NO: 1287285 - protein, 17 aa, Mycobacterium
GISRPTFYFYFGSKEAV

SEQ ID NO: 1287286 - protein, 23 aa, Mycobacterium
GKATCPPLSIAMAGALNGPDAAL

SEQ ID NO: 1287287 - protein, 18 aa, Mycobacterium
GKAWTGGDFGRVLMQYDD

SEQ ID NO: 1287288 - protein, 20 aa, Mycobacterium
GKFLNNWRMAELHAKEAPDR

SEQ ID NO: 1287289 - protein, 17 aa, Mycobacterium
GKIRVAEGWAHGPQVDK

SEQ ID NO: 1287290 - protein, 25 aa, Mycobacterium
GKLIAAAGWHAWRPAHLHVKVSAPG

SEQ ID NO: 1287291 - protein, 18 aa, Mycobacterium
GKLYLCAIKDAFSNRIVG

SEQ ID NO: 1287292 - protein, 18 aa, Mycobacterium
GKPSLGWRSRRAAHKVTA

SEQ ID NO: 1287293 - protein, 17 aa, Mycobacterium
GKYRRVLAMAWEKQSES

SEQ ID NO: 1287294 - protein, 19 aa, Mycobacterium
GLAEMLARLGIPYDSEEAL

SEQ ID NO: 1287295 - protein, 17 aa, Mycobacterium
GLARLWQSWGVTPDVVL

SEQ ID NO: 1287296 - protein, 20 aa, Mycobacterium
GLCSYPLRQCSDGDLYGGTE

SEQ ID NO: 1287297 - protein, 24 aa, Mycobacterium
GLELARRLAREWLNYEFDPASKSA

SEQ ID NO: 1287298 - protein, 19 aa, Mycobacterium
GLELPRKVFAHGWLLNRGE

SEQ ID NO: 1287299 - protein, 20 aa, Mycobacterium
GLHTWPALGFGYAEVGTVTA

SEQ ID NO: 1287300 - protein, 17 aa, Mycobacterium
GLIGLGVERGERVGIWA

SEQ ID NO: 1287301 - protein, 20 aa, Mycobacterium
GLLAPHWPKPFGRAASAAEQ

SEQ ID NO: 1287302 - protein, 18 aa, Mycobacterium
GLLFCAACGRRMQGAARP

SEQ ID NO: 1287303 - protein, 20 aa, Mycobacterium
GLPWDCVLSAELFRHYKPDP

SEQ ID NO: 1287304 - protein, 19 aa, Mycobacterium
GLQARLGLDAGKWTAEQMA

SEQ ID NO: 1287305 - protein, 20 aa, Mycobacterium
GLTRAVLRGGRFIGVHGLGD

SEQ ID NO: 1287306 - protein, 24 aa, Mycobacterium
GLVKDIKINWVWNPPWGPDKITED

SEQ ID NO: 1287307 - protein, 25 aa, Mycobacterium
GLVPACKSLDCLSVMAGCIDDVDRV

SEQ ID NO: 1287308 - protein, 24 aa, Mycobacterium
GLWMSLRVARRLERLHIGARIVDL

SEQ ID NO: 1287309 - protein, 26 aa, Mycobacterium
GMARHVLCFRTLWEATFGQLLKEGKM

SEQ ID NO: 1287310 - protein, 20 aa, Mycobacterium
GMSYHLPRIVGTSVAADWML

SEQ ID NO: 1287311 - protein, 17 aa, Mycobacterium
GMVRFIGVDGYRWMIRC

SEQ ID NO: 1287312 - protein, 23 aa, Mycobacterium
GNDLPLEVGMAFSVEPGIYFPGQ

SEQ ID NO: 1287313 - protein, 17 aa, Mycobacterium
GPAPWKSVLGMTGPTTL

SEQ ID NO: 1287314 - protein, 17 aa, Mycobacterium
GPDYGRFVEAVRELQDL

SEQ ID NO: 1287315 - protein, 19 aa, Mycobacterium
GPFPLQIICDMMGIPEEDE

SEQ ID NO: 1287316 - protein, 25 aa, Mycobacterium
GPLPWYKRPPVLFGAAAAAALAALS

SEQ ID NO: 1287317 - protein, 17 aa, Mycobacterium
GPLTWPLHISLLLAKEF

SEQ ID NO: 1287318 - protein, 17 aa, Mycobacterium
GPPPERFLVGLAVLSLV

SEQ ID NO: 1287319 - protein, 17 aa, Mycobacterium
GPPPMVESVRKHVAAEG

SEQ ID NO: 1287320 - protein, 18 aa, Mycobacterium
GPQALSFVRQRHDLPRGD

SEQ ID NO: 1287321 - protein, 19 aa, Mycobacterium
GPQEWRWDKDAGITRLADA

SEQ ID NO: 1287322 - protein, 22 aa, Mycobacterium
GPRMWTWIQMMGLRAFQEMVFT

SEQ ID NO: 1287323 - protein, 22 aa, Mycobacterium
GPVRFPGVPTWFSRTPGHVRGP

SEQ ID NO: 1287324 - protein, 24 aa, Mycobacterium
GQALAVRVFTRFVFGFGLDDRDMQ

SEQ ID NO: 1287325 - protein, 24 aa, Mycobacterium
GQDSFEFFPNFTLLLWVPGWYLTY

SEQ ID NO: 1287326 - protein, 17 aa, Mycobacterium
GQIGTACAVAFGSAFAA

SEQ ID NO: 1287327 - protein, 17 aa, Mycobacterium
GQMGMPFGRGKNTRKNA

SEQ ID NO: 1287328 - protein, 23 aa, Mycobacterium
GQRNRFLLVTNFEYVDPVFMFPG

SEQ ID NO: 1287329 - protein, 18 aa, Mycobacterium
GQTLDWLAARGMTGLLQR

SEQ ID NO: 1287330 - protein, 23 aa, Mycobacterium
GRADPGEIVWTWVVYEDDPTRGK

SEQ ID NO: 1287331 - protein, 24 aa, Mycobacterium
GRERCIAEFSWAHIAEQTMEIYRK

SEQ ID NO: 1287332 - protein, 17 aa, Mycobacterium
GRFAVNVVSGWFKDEFT

SEQ ID NO: 1287333 - protein, 17 aa, Mycobacterium
GRFAVYVKFHHALIDGV

SEQ ID NO: 1287334 - protein, 19 aa, Mycobacterium
GRFLLGIGVGHPEAHQAYR

SEQ ID NO: 1287335 - protein, 20 aa, Mycobacterium
GRGSPWAAPLSWLVPPRVAM

SEQ ID NO: 1287336 - protein, 21 aa, Mycobacterium
GRHRFPLVLSDTVQQFLTAVA

SEQ ID NO: 1287337 - protein, 17 aa, Mycobacterium
GRIRKGQQVAWMREVDG

SEQ ID NO: 1287338 - protein, 19 aa, Mycobacterium
GRLSGKFWKLLGAATEKNQ

SEQ ID NO: 1287339 - protein, 19 aa, Mycobacterium
GRLTLPAKFRDALAGGLMV

SEQ ID NO: 1287340 - protein, 18 aa, Mycobacterium
GRLVDAWAGAALVRVGPR

SEQ ID NO: 1287341 - protein, 19 aa, Mycobacterium
GRLWLSRGGTYVLANIRGG

SEQ ID NO: 1287342 - protein, 20 aa, Mycobacterium
GRMGAPMVRRLVGAGHTVTA

SEQ ID NO: 1287343 - protein, 18 aa, Mycobacterium
GRMHPYFAARAVVEACPP

SEQ ID NO: 1287344 - protein, 17 aa, Mycobacterium
GRMLWSLPKGHIEMGET

SEQ ID NO: 1287345 - protein, 20 aa, Mycobacterium
GRPDALLPLARREARDCLAE

SEQ ID NO: 1287346 - protein, 19 aa, Mycobacterium
GRPGRWRGWDWARGTPAGW

SEQ ID NO: 1287347 - protein, 18 aa, Mycobacterium
GRPIAGFELRIGDSGEVL

SEQ ID NO: 1287348 - protein, 17 aa, Mycobacterium
GRPVLVGGLGGRGVVAG

SEQ ID NO: 1287349 - protein, 18 aa, Mycobacterium
GRRRGVVINPVLETSDIP

SEQ ID NO: 1287350 - protein, 24 aa, Mycobacterium
GRRYRLTVDLPRDFALNQPLSTFA

SEQ ID NO: 1287351 - protein, 19 aa, Mycobacterium
GRSGVPFILAGWSLGGVLA

SEQ ID NO: 1287352 - protein, 26 aa, Mycobacterium
GRSLTRPRMDWVYEVSAGNPLYALEL

SEQ ID NO: 1287353 - protein, 19 aa, Mycobacterium
GRSVSKWGAFLDDVAGFDA

SEQ ID NO: 1287354 - protein, 21 aa, Mycobacterium
GRTAIRLARGIPVVGNRFGAP

SEQ ID NO: 1287355 - protein, 17 aa, Mycobacterium
GRTFACDHWDVVPDLYL

SEQ ID NO: 1287356 - protein, 18 aa, Mycobacterium
GRTHPVWDFLFTYYSLRP

SEQ ID NO: 1287357 - protein, 17 aa, Mycobacterium
GRVFPIGSFGHTGFTGT

SEQ ID NO: 1287358 - protein, 18 aa, Mycobacterium
GRVRLAVGTGWLAEEINA

SEQ ID NO: 1287359 - protein, 19 aa, Mycobacterium
GRWVPDFLSLPIAVENSLK

SEQ ID NO: 1287360 - protein, 19 aa, Mycobacterium
GRYNLCPEMKFYATPPIDG

SEQ ID NO: 1287361 - protein, 19 aa, Mycobacterium
GSDRIPVFVFHPAGGSTVV

SEQ ID NO: 1287362 - protein, 18 aa, Mycobacterium
GSFFPVIPVCSSSGVGTM

SEQ ID NO: 1287363 - protein, 25 aa, Mycobacterium
GSGQPIVFSHGWPLSADDWDTQMLF

SEQ ID NO: 1287364 - protein, 22 aa, Mycobacterium
GSHLIDFTRWLFGSEIVDCGGV

SEQ ID NO: 1287365 - protein, 17 aa, Mycobacterium
GSIPFIAEFAAAFPQAT

SEQ ID NO: 1287366 - protein, 18 aa, Mycobacterium
GSIQRGWGLTGFAQDDDG

SEQ ID NO: 1287367 - protein, 23 aa, Mycobacterium
GSLPRRPQFALLKGRGNYLCLNK

SEQ ID NO: 1287368 - protein, 20 aa, Mycobacterium
GSRGISCFLIPGGQPGLSFG

SEQ ID NO: 1287369 - protein, 20 aa, Mycobacterium
GSTLRFAPPLVITADEIDWA

SEQ ID NO: 1287370 - protein, 23 aa, Mycobacterium
GSTQRFGVPMGFGGPHAGYLAVH

SEQ ID NO: 1287371 - protein, 26 aa, Mycobacterium
GSTRYPGGMALRFARVLRYRDDKSPA

SEQ ID NO: 1287372 - protein, 18 aa, Mycobacterium
GTAGFRAWAAHARGAVHV

SEQ ID NO: 1287373 - protein, 20 aa, Mycobacterium
GTGRQWLSWIGLDDLLDVYY

SEQ ID NO: 1287374 - protein, 21 aa, Mycobacterium
GTHMAGLLFELFARYTEVVTT

SEQ ID NO: 1287375 - protein, 19 aa, Mycobacterium
GTLGLRLGDRIQITPPLGS

SEQ ID NO: 1287376 - protein, 17 aa, Mycobacterium
GTPLKWVRLDSAPFTDR

SEQ ID NO: 1287377 - protein, 17 aa, Mycobacterium
GTVSGLYVCEMVTARAL

SEQ ID NO: 1287378 - protein, 21 aa, Mycobacterium
GVALRIGWRALTFAGLRGNER

SEQ ID NO: 1287379 - protein, 18 aa, Mycobacterium
GVARHVLIPAGWCGYSGP

SEQ ID NO: 1287380 - protein, 18 aa, Mycobacterium
GVDGYRWMIRCVVNGVAE

SEQ ID NO: 1287381 - protein, 20 aa, Mycobacterium
GVGLRAFELAVRYAQQRHTF

SEQ ID NO: 1287382 - protein, 19 aa, Mycobacterium
GVHDVVLCPGSRNAPLAFA

SEQ ID NO: 1287383 - protein, 17 aa, Mycobacterium
GVIDAMFAYQLAELERL

SEQ ID NO: 1287384 - protein, 18 aa, Mycobacterium
GVIPLQFLFSGTLFTRGE

SEQ ID NO: 1287385 - protein, 18 aa, Mycobacterium
GVLPLMFDSMFGMVIHAT

SEQ ID NO: 1287386 - protein, 19 aa, Mycobacterium
GVLSARWAGTHGQDAANSA

SEQ ID NO: 1287387 - protein, 23 aa, Mycobacterium
GVLSGRLRLCLGYTEPEGGSDVA

SEQ ID NO: 1287388 - protein, 19 aa, Mycobacterium
GVVIGRGCLGRPWLFAELS

SEQ ID NO: 1287389 - protein, 25 aa, Mycobacterium
GWERWREIGAHYGLGVIEAMLAQAI

SEQ ID NO: 1287390 - protein, 19 aa, Mycobacterium
GWTEGRSGVPFILAGWSLG

SEQ ID NO: 1287391 - protein, 18 aa, Mycobacterium
GYELTLWARRPASLEPYA

SEQ ID NO: 1287392 - protein, 17 aa, Mycobacterium
GYLKWNRTRGWRGQRAA

SEQ ID NO: 1287393 - protein, 23 aa, Mycobacterium
GYYQLRGGIPYAIAKQLAAAPFA

SEQ ID NO: 1287394 - protein, 18 aa, Mycobacterium
HAHWLLPAAHWLERDDLL

SEQ ID NO: 1287395 - protein, 18 aa, Mycobacterium
HCAKAFLRSGAWNPESWT

SEQ ID NO: 1287396 - protein, 22 aa, Mycobacterium
HCPMCAAAHAWVGLGRIVYATS

SEQ ID NO: 1287397 - protein, 20 aa, Mycobacterium
HDRIPVLYCKTGVRSAEALA

SEQ ID NO: 1287398 - protein, 22 aa, Mycobacterium
HERETYDFFGIIFDGHPSLTRI

SEQ ID NO: 1287399 - protein, 20 aa, Mycobacterium
HERTMLWLSYADRLQDLIDD

SEQ ID NO: 1287400 - protein, 17 aa, Mycobacterium
HFPKDAWALGRFDGTAL

SEQ ID NO: 1287401 - protein, 17 aa, Mycobacterium
HHAHIRMLLQSAGTTGD

SEQ ID NO: 1287402 - protein, 17 aa, Mycobacterium
HIRARMFAPDLGVPEDE

SEQ ID NO: 1287403 - protein, 18 aa, Mycobacterium
HIYARIEPRWPFKFVRLA

SEQ ID NO: 1287404 - protein, 18 aa, Mycobacterium
HKEWLEKLAESYEFLGTE

SEQ ID NO: 1287405 - protein, 24 aa, Mycobacterium
HKKGSALVPSWVAFAVIGLLEQHF

SEQ ID NO: 1287406 - protein, 22 aa, Mycobacterium
HKYGVGNGHLWRRHRLAPHRLA

SEQ ID NO: 1287407 - protein, 24 aa, Mycobacterium
HLISPWGTWEWMGPAAIGADLPAC

SEQ ID NO: 1287408 - protein, 20 aa, Mycobacterium
HLLGSILWRRAMGLVLGDWV

SEQ ID NO: 1287409 - protein, 18 aa, Mycobacterium
HMWFGDLVTMTWWDDLWL

SEQ ID NO: 1287410 - protein, 24 aa, Mycobacterium
HNGCPLGNLIPEWNDLVFKDRWRD

SEQ ID NO: 1287411 - protein, 18 aa, Mycobacterium
HPDARIVLCSSVSGLWGG

SEQ ID NO: 1287412 - protein, 24 aa, Mycobacterium
HPFLGMPFWLGRGFGLNLSVVTDP

SEQ ID NO: 1287413 - protein, 18 aa, Mycobacterium
HPHCCSVGYLIRDDNDQW

SEQ ID NO: 1287414 - protein, 17 aa, Mycobacterium
HPIDLVLLDLGLPDATG

SEQ ID NO: 1287415 - protein, 18 aa, Mycobacterium
HPRFGRWLQLGGHCEPDD

SEQ ID NO: 1287416 - protein, 22 aa, Mycobacterium
HPSLKIGWFEGGIAWVPTALQD

SEQ ID NO: 1287417 - protein, 17 aa, Mycobacterium
HPVPGRWLPNGCMATSG

SEQ ID NO: 1287418 - protein, 22 aa, Mycobacterium
HQALCYFGYLAGYRLVHDAAAD

SEQ ID NO: 1287419 - protein, 22 aa, Mycobacterium
HREHFNLPALRDWLRTQREERS

SEQ ID NO: 1287420 - protein, 17 aa, Mycobacterium
HRFPGSMAKRIQALAQL

SEQ ID NO: 1287421 - protein, 17 aa, Mycobacterium
HRNGLRLAKLVNTLLDF

SEQ ID NO: 1287422 - protein, 22 aa, Mycobacterium
HRVLRHRLILGFEAANADVTAD

SEQ ID NO: 1287423 - protein, 22 aa, Mycobacterium
HRVLRTERLLSFNVDYASVTRL

SEQ ID NO: 1287424 - protein, 19 aa, Mycobacterium
HRVRFKVVPPFAGILDLTM

SEQ ID NO: 1287425 - protein, 23 aa, Mycobacterium
HSIWLPDHMVSFWPDSIWTPEFT

SEQ ID NO: 1287426 - protein, 18 aa, Mycobacterium
HSQWYIDRFRAMARAGDD

SEQ ID NO: 1287427 - protein, 22 aa, Mycobacterium
HSVCPFCAVGCAQKVYVKDEKV

SEQ ID NO: 1287428 - protein, 24 aa, Mycobacterium
HSYPHCWRCRNPLIYRAVSSWFIK

SEQ ID NO: 1287429 - protein, 23 aa, Mycobacterium
HTELAWVLGCFTGFGQASRMTQF

SEQ ID NO: 1287430 - protein, 17 aa, Mycobacterium
HTGRAVGILADLQGPKI

SEQ ID NO: 1287431 - protein, 17 aa, Mycobacterium
HTPWFHWGTTAMVAHTV

SEQ ID NO: 1287432 - protein, 19 aa, Mycobacterium
HTRRVPGYHILKAHMSSSI

SEQ ID NO: 1287433 - protein, 18 aa, Mycobacterium
HVKPRLLGHWGTTPGLNL

SEQ ID NO: 1287434 - protein, 21 aa, Mycobacterium
HVRSGVAFDVLRRWLTAKGLD

SEQ ID NO: 1287435 - protein, 18 aa, Mycobacterium
HWMAVPLLKPFGVTPVGD

SEQ ID NO: 1287436 - protein, 17 aa, Mycobacterium
HWVRWRLIHARAFLLTD

SEQ ID NO: 1287437 - protein, 22 aa, Mycobacterium
HYEKLEGVALTFAGKVNRLATM

SEQ ID NO: 1287438 - protein, 17 aa, Mycobacterium
IAAAAARYMTEEYARIA

SEQ ID NO: 1287439 - protein, 18 aa, Mycobacterium
IACGLVVRPEVVFLDEPT

SEQ ID NO: 1287440 - protein, 24 aa, Mycobacterium
IAFGWDRITALLARMDSIREVIAF

SEQ ID NO: 1287441 - protein, 17 aa, Mycobacterium
IAFNCLWPETYIATSAV

SEQ ID NO: 1287442 - protein, 17 aa, Mycobacterium
IAGAGAIGMEFGYVMKN

SEQ ID NO: 1287443 - protein, 17 aa, Mycobacterium
IAGALAIVAVDPVKFKR

SEQ ID NO: 1287444 - protein, 17 aa, Mycobacterium
IAKEVLVALGIAVLAEP

SEQ ID NO: 1287445 - protein, 25 aa, Mycobacterium
IAQARLGPGRIHHCMRALGAAERAL

SEQ ID NO: 1287446 - protein, 23 aa, Mycobacterium
IARIDWARFLPLYQQAGRRAFLT

SEQ ID NO: 1287447 - protein, 20 aa, Mycobacterium
IASGDLHVCFGVTEPGAGLD

SEQ ID NO: 1287448 - protein, 23 aa, Mycobacterium
IAVRYGDCSWTWREHLAEASRQA

SEQ ID NO: 1287449 - protein, 19 aa, Mycobacterium
ICAYGRIGSMFACDDFGYV

SEQ ID NO: 1287450 - protein, 24 aa, Mycobacterium
ICGLRPGQRLRIVKYLAYGWSSLR

SEQ ID NO: 1287451 - protein, 18 aa, Mycobacterium
ICRRSRLMARIAGSGAMA

SEQ ID NO: 1287452 - protein, 21 aa, Mycobacterium
IDAEIPLLVVITEGIPVQDTA

SEQ ID NO: 1287453 - protein, 17 aa, Mycobacterium
IDALLPLPGSRNQLTDG

SEQ ID NO: 1287454 - protein, 24 aa, Mycobacterium
IDGLRRFHCNLGHGLLGRLVERSP

SEQ ID NO: 1287455 - protein, 19 aa, Mycobacterium
IDHFRYFAGAIRAQEGALS

SEQ ID NO: 1287456 - protein, 27 aa, Mycobacterium
IDKFAPRLSFFWGIGMNFFMEVAKLRA

SEQ ID NO: 1287457 - protein, 18 aa, Mycobacterium
IDNWRWAGVPIYLRTGKK

SEQ ID NO: 1287458 - protein, 19 aa, Mycobacterium
IDPWGGSYYVEWLTHQLAT

SEQ ID NO: 1287459 - protein, 18 aa, Mycobacterium
IDRFPVEMIKRYFGGSHL

SEQ ID NO: 1287460 - protein, 18 aa, Mycobacterium
IDVAYRFFSTANRSYILA

SEQ ID NO: 1287461 - protein, 18 aa, Mycobacterium
IDVYSCFPSAVQVAATEL

SEQ ID NO: 1287462 - protein, 18 aa, Mycobacterium
IEAFRLLTLQTAWKIDQY

SEQ ID NO: 1287463 - protein, 22 aa, Mycobacterium
IEDLKAPLLAAVGAADLALATV

SEQ ID NO: 1287464 - protein, 23 aa, Mycobacterium
IEFPARIGVWWASETWSITDAQD

SEQ ID NO: 1287465 - protein, 19 aa, Mycobacterium
IEGKPSAAFLWEDKGVVPF

SEQ ID NO: 1287466 - protein, 18 aa, Mycobacterium
IEHWRWMWESNVLGTLLV

SEQ ID NO: 1287467 - protein, 20 aa, Mycobacterium
IEHWTRLPVEIELASEFRYR

SEQ ID NO: 1287468 - protein, 17 aa, Mycobacterium
IEILKLVLAGGMVEFHG

SEQ ID NO: 1287469 - protein, 23 aa, Mycobacterium
IEPEVGLACRVVWYGDTVVRLDP

SEQ ID NO: 1287470 - protein, 18 aa, Mycobacterium
IETLPLVTGWSMGAGQTY

SEQ ID NO: 1287471 - protein, 17 aa, Mycobacterium
IEVDAAPDARYGFVLDD

SEQ ID NO: 1287472 - protein, 23 aa, Mycobacterium
IFKRIRPAFRYERSLAVLTAARD

SEQ ID NO: 1287473 - protein, 17 aa, Mycobacterium
IFLMCLADRVLAYGDCA

SEQ ID NO: 1287474 - protein, 18 aa, Mycobacterium
IFVPGGPPLSIPLGNVRL

SEQ ID NO: 1287475 - protein, 19 aa, Mycobacterium
IGAEIVRRLAFEGAAVAFT

SEQ ID NO: 1287476 - protein, 27 aa, Mycobacterium
IGAPSFKEALRWGAEVYHSLKSVLKKQ

SEQ ID NO: 1287477 - protein, 17 aa, Mycobacterium
IGDVASWLDTIGNQVRV

SEQ ID NO: 1287478 - protein, 23 aa, Mycobacterium
IGEGRKSLALALRFRAADRTLTE

SEQ ID NO: 1287479 - protein, 22 aa, Mycobacterium
IGGCLYALLAKCWPEDVSEPAQ

SEQ ID NO: 1287480 - protein, 21 aa, Mycobacterium
IGGGMCFTFLASQGVSVGKSL

SEQ ID NO: 1287481 - protein, 19 aa, Mycobacterium
IGIPDEWFLAGHLVVGWPR

SEQ ID NO: 1287482 - protein, 20 aa, Mycobacterium
IGQLCLLRLTSPAEHPYGSA

SEQ ID NO: 1287483 - protein, 21 aa, Mycobacterium
IGRERFAEFLAGFHLVDEHFR

SEQ ID NO: 1287484 - protein, 23 aa, Mycobacterium
IGRERPSRLVVCRDDDWRPQWRV

SEQ ID NO: 1287485 - protein, 21 aa, Mycobacterium
IGYAACHWCHVMAHESFEDDE

SEQ ID NO: 1287486 - protein, 19 aa, Mycobacterium
IHALGGWWAEVLGYAQEVT

SEQ ID NO: 1287487 - protein, 20 aa, Mycobacterium
IHPGLPVSFGYDVTDGSGGR

SEQ ID NO: 1287488 - protein, 19 aa, Mycobacterium
IIPWNFPILMATWKLAPAL

SEQ ID NO: 1287489 - protein, 18 aa, Mycobacterium
IISCFSMTEPHGGADPKV

SEQ ID NO: 1287490 - protein, 17 aa, Mycobacterium
IISVGAWSPGASQVYQS

SEQ ID NO: 1287491 - protein, 20 aa, Mycobacterium
IKDGDRIAGAFGYWRESGSF

SEQ ID NO: 1287492 - protein, 18 aa, Mycobacterium
ILAVLPFFHIYGMTVLLN

SEQ ID NO: 1287493 - protein, 17 aa, Mycobacterium
ILDEWRTITGLDRKTDD

SEQ ID NO: 1287494 - protein, 18 aa, Mycobacterium
ILDRARFEAVAARLRAEY

SEQ ID NO: 1287495 - protein, 18 aa, Mycobacterium
ILGALPFDLTAPTALFRP

SEQ ID NO: 1287496 - protein, 17 aa, Mycobacterium
ILKGDKGEPCWPDGVVG

SEQ ID NO: 1287497 - protein, 17 aa, Mycobacterium
ILLALAVQRQGRSAPEL

SEQ ID NO: 1287498 - protein, 17 aa, Mycobacterium
ILLPRSRYDEGLEILKT

SEQ ID NO: 1287499 - protein, 23 aa, Mycobacterium
ILLYRCGLGFMLGDRFLMLEHVG

SEQ ID NO: 1287500 - protein, 17 aa, Mycobacterium
ILRAEMTAALGMSEPGA

SEQ ID NO: 1287501 - protein, 24 aa, Mycobacterium
ILSRLSARHDIMWLMTSDLSPLGG

SEQ ID NO: 1287502 - protein, 21 aa, Mycobacterium
IMRRLGFGAARTIGHREYAGG

SEQ ID NO: 1287503 - protein, 17 aa, Mycobacterium
INELLNWQVAAAGETIA

SEQ ID NO: 1287504 - protein, 23 aa, Mycobacterium
INEPRFPSFKGIMAAKKKEVTTL

SEQ ID NO: 1287505 - protein, 24 aa, Mycobacterium
INLPGVAFGHDWLASGMRYNGTLE

SEQ ID NO: 1287506 - protein, 17 aa, Mycobacterium
INRRRVASVLQFDPVIV

SEQ ID NO: 1287507 - protein, 21 aa, Mycobacterium
INSRPAPLVAYWFGPDDQDFR

SEQ ID NO: 1287508 - protein, 23 aa, Mycobacterium
IPACGQCQPCLKGYRSLCDRGAL

SEQ ID NO: 1287509 - protein, 25 aa, Mycobacterium
IPACGRCTECARGRSNLCVYGAAIV

SEQ ID NO: 1287510 - protein, 19 aa, Mycobacterium
IPDRVDVVWLDHEGGGAGS

SEQ ID NO: 1287511 - protein, 20 aa, Mycobacterium
IPEVLPKVGIVRRLVDSGEL

SEQ ID NO: 1287512 - protein, 19 aa, Mycobacterium
IPGVLRWRVDITATPTTRA

SEQ ID NO: 1287513 - protein, 17 aa, Mycobacterium
IPLNLVLIKGVTVQGFQ

SEQ ID NO: 1287514 - protein, 20 aa, Mycobacterium
IPLRVKAGAVGLTADEYHAQ

SEQ ID NO: 1287515 - protein, 17 aa, Mycobacterium
IPLSLGVTVTRIDRDGD

SEQ ID NO: 1287516 - protein, 17 aa, Mycobacterium
IPPRSVVPIAWDTIRTL

SEQ ID NO: 1287517 - protein, 18 aa, Mycobacterium
IPQSGWRLSPAYRDFDAE

SEQ ID NO: 1287518 - protein, 19 aa, Mycobacterium
IPSPVAGTLLEIIAEEDDT

SEQ ID NO: 1287519 - protein, 26 aa, Mycobacterium
IPTYPLPLLMPLTWIPVIGPIAVDML

SEQ ID NO: 1287520 - protein, 17 aa, Mycobacterium
IQFKDLTPLLADAEGLM

SEQ ID NO: 1287521 - protein, 19 aa, Mycobacterium
IRALLRFLLGEGFDEAELD

SEQ ID NO: 1287522 - protein, 20 aa, Mycobacterium
IRPDGYLGFAAHRLDTEVFE

SEQ ID NO: 1287523 - protein, 17 aa, Mycobacterium
IRPPVVTVMGHVDHGKT

SEQ ID NO: 1287524 - protein, 22 aa, Mycobacterium
IRWRSRELLTRIGSVFQNPEHQ

SEQ ID NO: 1287525 - protein, 17 aa, Mycobacterium
ISERPRLTAALDKLGKL

SEQ ID NO: 1287526 - protein, 20 aa, Mycobacterium
ISEVLPLLYLHGLSSGDFGP

SEQ ID NO: 1287527 - protein, 22 aa, Mycobacterium
ISSARTAAQFGIEPRVAMLSYS

SEQ ID NO: 1287528 - protein, 21 aa, Mycobacterium
ISTRTPRGWVARTYSQREGLQ

SEQ ID NO: 1287529 - protein, 17 aa, Mycobacterium
ISVGFPFGVSAVVPINL

SEQ ID NO: 1287530 - protein, 19 aa, Mycobacterium
ISYLLGHSGVRGFLVEADL

SEQ ID NO: 1287531 - protein, 18 aa, Mycobacterium
ITDWKIKLCDTIADNASS

SEQ ID NO: 1287532 - protein, 18 aa, Mycobacterium
ITLHAALELARRGSGYAV

SEQ ID NO: 1287533 - protein, 17 aa, Mycobacterium
ITLLPLFFELDGTFPNH

SEQ ID NO: 1287534 - protein, 18 aa, Mycobacterium
ITTRYEIACTVSGTVTAD

SEQ ID NO: 1287535 - protein, 20 aa, Mycobacterium
IVAERRLWLAVLRAQIELGM

SEQ ID NO: 1287536 - protein, 18 aa, Mycobacterium
IVDARPVAMFQMTDEAGG

SEQ ID NO: 1287537 - protein, 17 aa, Mycobacterium
IVEGGYELTLWARRPAS

SEQ ID NO: 1287538 - protein, 18 aa, Mycobacterium
IVESLASVSGHVWLTEHG

SEQ ID NO: 1287539 - protein, 24 aa, Mycobacterium
IVGDAAGVGVIWLADWADDMVNVS

SEQ ID NO: 1287540 - protein, 17 aa, Mycobacterium
IVHGGVYCAIVESLASV

SEQ ID NO: 1287541 - protein, 18 aa, Mycobacterium
IVKYLAYGWSSLRSRPAL

SEQ ID NO: 1287542 - protein, 18 aa, Mycobacterium
IVPHLNLADGREVIVNRD

SEQ ID NO: 1287543 - protein, 19 aa, Mycobacterium
IVSIEAFEHFGFERYDDFF

SEQ ID NO: 1287544 - protein, 18 aa, Mycobacterium
IWMPYHWGNAGLIDGDVV

SEQ ID NO: 1287545 - protein, 18 aa, Mycobacterium
IWRRPRWAVRLQPEPVGG

SEQ ID NO: 1287546 - protein, 19 aa, Mycobacterium
IYADLGWRGVIPVDPRDKG

SEQ ID NO: 1287547 - protein, 26 aa, Mycobacterium
IYEDLAWFCIRAWRFGASERLGAGGL

SEQ ID NO: 1287548 - protein, 21 aa, Mycobacterium
KACGICGSDLHFAAHGDDALA

SEQ ID NO: 1287549 - protein, 18 aa, Mycobacterium
KADAQWRWLAHTLTVDLL

SEQ ID NO: 1287550 - protein, 18 aa, Mycobacterium
KAFTELRQLLAVHETAEE

SEQ ID NO: 1287551 - protein, 19 aa, Mycobacterium
KAGVMAQLLPILDDLDRAR

SEQ ID NO: 1287552 - protein, 23 aa, Mycobacterium
KALYGSSLVTGWARLHGYPIGIL

SEQ ID NO: 1287553 - protein, 20 aa, Mycobacterium
KAQGIPAQFLVDILSDLRTD

SEQ ID NO: 1287554 - protein, 17 aa, Mycobacterium
KAVELALAWLTRGDLNI

SEQ ID NO: 1287555 - protein, 22 aa, Mycobacterium
KAVPSRLAWETGVAMADSLLDR

SEQ ID NO: 1287556 - protein, 19 aa, Mycobacterium
KCPMAWSDTYGGHWVAADS

SEQ ID NO: 1287557 - protein, 18 aa, Mycobacterium
KCTPCREGTYWLAQIYAR

SEQ ID NO: 1287558 - protein, 23 aa, Mycobacterium
KCYSLRIASAMAHDEGWLAEHML

SEQ ID NO: 1287559 - protein, 19 aa, Mycobacterium
KDLQDIIAILGIDELAEED

SEQ ID NO: 1287560 - protein, 19 aa, Mycobacterium
KDRWLLRHRPHLVLDGLRL

SEQ ID NO: 1287561 - protein, 17 aa, Mycobacterium
KDYPPILAMTSLNDTRV

SEQ ID NO: 1287562 - protein, 22 aa, Mycobacterium
KEGDNVFVALSWSKHPAPQNYE

SEQ ID NO: 1287563 - protein, 20 aa, Mycobacterium
KEIAGRLAARIGSGVLTDVI

SEQ ID NO: 1287564 - protein, 17 aa, Mycobacterium
KEIKRRTDVVGVFPNPA

SEQ ID NO: 1287565 - protein, 20 aa, Mycobacterium
KELCRRWYPRIYFGQPEKGL

SEQ ID NO: 1287566 - protein, 18 aa, Mycobacterium
KFMGRWRSGAPLVLAPDQ

SEQ ID NO: 1287567 - protein, 19 aa, Mycobacterium
KFYAQCCIDAGVAFVNALP

SEQ ID NO: 1287568 - protein, 20 aa, Mycobacterium
KGDKGEPCWPDGVVGSLTHC

SEQ ID NO: 1287569 - protein, 17 aa, Mycobacterium
KGMWCVPVFGNPTGVTY

SEQ ID NO: 1287570 - protein, 24 aa, Mycobacterium
KGTFRLAFGIGDFRRDTGFGDNPA

SEQ ID NO: 1287571 - protein, 18 aa, Mycobacterium
KGVERWLSQRLSHVLGRG

SEQ ID NO: 1287572 - protein, 23 aa, Mycobacterium
KIELLRLAMDWAVAGDDADVPVS

SEQ ID NO: 1287573 - protein, 19 aa, Mycobacterium
KIIECFRHGGGLPYSAYPR

SEQ ID NO: 1287574 - protein, 19 aa, Mycobacterium
KILHERGWAAPAWPVEYGG

SEQ ID NO: 1287575 - protein, 22 aa, Mycobacterium
KIRLPLGQGISGWVASHREPVV

SEQ ID NO: 1287576 - protein, 25 aa, Mycobacterium
KKFRFPTFLGAFKYYTSYTLKTFDG

SEQ ID NO: 1287577 - protein, 17 aa, Mycobacterium
KKTIEFYLTAVFNVMRL

SEQ ID NO: 1287578 - protein, 19 aa, Mycobacterium
KLAKLKPVFGVRHGDATMT

SEQ ID NO: 1287579 - protein, 21 aa, Mycobacterium
KLARPTSTWTYMVHDNPLADD

SEQ ID NO: 1287580 - protein, 19 aa, Mycobacterium
KLGQLRPGDTVRFVPIRVA

SEQ ID NO: 1287581 - protein, 20 aa, Mycobacterium
KLIDCAKAYCTVGEMVSALK

SEQ ID NO: 1287582 - protein, 23 aa, Mycobacterium
KLLPQEWVRFGWYFLVSRRDPAG

SEQ ID NO: 1287583 - protein, 24 aa, Mycobacterium
KLQKRLKEELAWVRSGAKARQAKN

SEQ ID NO: 1287584 - protein, 18 aa, Mycobacterium
KLRHAMQFELKRIQREVG

SEQ ID NO: 1287585 - protein, 20 aa, Mycobacterium
KLTFELARFVKFMITEIFPG

SEQ ID NO: 1287586 - protein, 17 aa, Mycobacterium
KLVAGLGLRLPIVATGY

SEQ ID NO: 1287587 - protein, 23 aa, Mycobacterium
KLVWKAQIFLSHRSWESTITEQV

SEQ ID NO: 1287588 - protein, 21 aa, Mycobacterium
KMPRRFYCRAKWHHSELDSET

SEQ ID NO: 1287589 - protein, 21 aa, Mycobacterium
KNKLRGGAVFAPAFDPVQVEV

SEQ ID NO: 1287590 - protein, 23 aa, Mycobacterium
KNMFALGLLSWMYGRELHQSEAF

SEQ ID NO: 1287591 - protein, 25 aa, Mycobacterium
KPFDYWRLHLKTMKGQWAPFQSLVD

SEQ ID NO: 1287592 - protein, 19 aa, Mycobacterium
KPGAGLCPVRGHSNVQGDR

SEQ ID NO: 1287593 - protein, 18 aa, Mycobacterium
KPGMTLLEVGCGWGMTMK

SEQ ID NO: 1287594 - protein, 17 aa, Mycobacterium
KPPGIAETIDWVAALVT

SEQ ID NO: 1287595 - protein, 19 aa, Mycobacterium
KRFPAGFVVLGDAFCSFNP

SEQ ID NO: 1287596 - protein, 19 aa, Mycobacterium
KRFSMPWSHPVGRMREFVA

SEQ ID NO: 1287597 - protein, 20 aa, Mycobacterium
KRFSSAILPAWARKSPQMSE

SEQ ID NO: 1287598 - protein, 19 aa, Mycobacterium
KRFVKGITEEAVFQKRAPA

SEQ ID NO: 1287599 - protein, 22 aa, Mycobacterium
KRLFCRMAEVFAGFLSYTDAQI

SEQ ID NO: 1287600 - protein, 20 aa, Mycobacterium
KRLLPTVAVYDGIHAELRSA

SEQ ID NO: 1287601 - protein, 17 aa, Mycobacterium
KRRSWAVLGEMAELGDD

SEQ ID NO: 1287602 - protein, 19 aa, Mycobacterium
KRRYSGFIGTEFDIVLRGL

SEQ ID NO: 1287603 - protein, 21 aa, Mycobacterium
KRTGLWPGLRETFGVGSADIP

SEQ ID NO: 1287604 - protein, 17 aa, Mycobacterium
KRTSVLFNFRELLNARK

SEQ ID NO: 1287605 - protein, 20 aa, Mycobacterium
KRYALPHARILMHQPLGGIT

SEQ ID NO: 1287606 - protein, 18 aa, Mycobacterium
KSSGWRLTGQKVWTSAAH

SEQ ID NO: 1287607 - protein, 19 aa, Mycobacterium
KVPGARCALAWSVETAKLA

SEQ ID NO: 1287608 - protein, 17 aa, Mycobacterium
KVSPLAVQMIMPNGAAA

SEQ ID NO: 1287609 - protein, 19 aa, Mycobacterium
KVVVFRPLYAVGGQDLGYL

SEQ ID NO: 1287610 - protein, 21 aa, Mycobacterium
KWKFTVPFVCGATNLGEALRR

SEQ ID NO: 1287611 - protein, 17 aa, Mycobacterium
KYERLWLSWAMANRDPS

SEQ ID NO: 1287612 - protein, 18 aa, Mycobacterium
KYLWNFLVDHWFRMEFDG

SEQ ID NO: 1287613 - protein, 19 aa, Mycobacterium
KYWGGVCLNVGCIPSKALL

SEQ ID NO: 1287614 - protein, 18 aa, Mycobacterium
LAAVEAFFGAGAERQLDI

SEQ ID NO: 1287615 - protein, 19 aa, Mycobacterium
LADCRRLGITVLPPDVNES

SEQ ID NO: 1287616 - protein, 17 aa, Mycobacterium
LADGIDIVGRWAEAVGL

SEQ ID NO: 1287617 - protein, 21 aa, Mycobacterium
LAEFPELQWRDGAAVTVVVAA

SEQ ID NO: 1287618 - protein, 19 aa, Mycobacterium
LAEGMPAYGSCAGMILLAT

SEQ ID NO: 1287619 - protein, 20 aa, Mycobacterium
LAEHEMPGLMALRREYAEVA

SEQ ID NO: 1287620 - protein, 19 aa, Mycobacterium
LAFERQWWKYAGSKEDAIK

SEQ ID NO: 1287621 - protein, 19 aa, Mycobacterium
LAGACSMAAFTAAMHAGQG

SEQ ID NO: 1287622 - protein, 20 aa, Mycobacterium
LAGLRIGYAIGSWGLTAELW

SEQ ID NO: 1287623 - protein, 23 aa, Mycobacterium
LAGPRPVVLHGFDLAHRSRAEVT

SEQ ID NO: 1287624 - protein, 18 aa, Mycobacterium
LAGTLSYFECTPWAEYDA

SEQ ID NO: 1287625 - protein, 23 aa, Mycobacterium
LAHRARWGLLLARTNPDVPKHKG

SEQ ID NO: 1287626 - protein, 17 aa, Mycobacterium
LAKRTSVLFNFRELLNA

SEQ ID NO: 1287627 - protein, 23 aa, Mycobacterium
LALAEGFALAGARVVVASRKPDA

SEQ ID NO: 1287628 - protein, 24 aa, Mycobacterium
LAMGLPLFGVRGMNGFVRATRRAA

SEQ ID NO: 1287629 - protein, 17 aa, Mycobacterium
LAMIDPWPAGYYGRQDH

SEQ ID NO: 1287630 - protein, 23 aa, Mycobacterium
LAMPRLDMVTGLYFLTTMIEGDK

SEQ ID NO: 1287631 - protein, 25 aa, Mycobacterium
LANLKFAWRSCRAVKSNAIVVVADG

SEQ ID NO: 1287632 - protein, 18 aa, Mycobacterium
LAQRLALAAGRRLDEAQP

SEQ ID NO: 1287633 - protein, 19 aa, Mycobacterium
LATQLRAGLFGVLYVLDEP

SEQ ID NO: 1287634 - protein, 17 aa, Mycobacterium
LAVARWGIAYSVGPNYN

SEQ ID NO: 1287635 - protein, 18 aa, Mycobacterium
LAVKACFAAFRTGTLDHH

SEQ ID NO: 1287636 - protein, 21 aa, Mycobacterium
LAVRAEERFGPERVIRAATLP

SEQ ID NO: 1287637 - protein, 17 aa, Mycobacterium
LAVRLDVSRLVVVGTGR

SEQ ID NO: 1287638 - protein, 17 aa, Mycobacterium
LAVTVGFEMAAVIASAA

SEQ ID NO: 1287639 - protein, 17 aa, Mycobacterium
LAWHAWRDADSGNWPTG

SEQ ID NO: 1287640 - protein, 21 aa, Mycobacterium
LCEAAHLPVIWATQVLESLAK

SEQ ID NO: 1287641 - protein, 18 aa, Mycobacterium
LDAALIRLSAARGLNAVV

SEQ ID NO: 1287642 - protein, 21 aa, Mycobacterium
LDALCGVGGWQPRGALGNIPV

SEQ ID NO: 1287643 - protein, 29 aa, Mycobacterium
LDDLATRVGWRWRLVWFRAVAELLSADYE

SEQ ID NO: 1287644 - protein, 17 aa, Mycobacterium
LDFAVPTFEQFWRDGSL

SEQ ID NO: 1287645 - protein, 19 aa, Mycobacterium
LDGPLPRRARTFVLTTEAE

SEQ ID NO: 1287646 - protein, 24 aa, Mycobacterium
LDGYPRPGRTVLFLGRYDEPRKGM

SEQ ID NO: 1287647 - protein, 23 aa, Mycobacterium
LDIGCGWGATIMRAVEKYDVNVI

SEQ ID NO: 1287648 - protein, 25 aa, Mycobacterium
LDIPGRFAVRVPMQWTSDDNGGFSR

SEQ ID NO: 1287649 - protein, 20 aa, Mycobacterium
LDLCPRIRVNAIAPGSILTS

SEQ ID NO: 1287650 - protein, 18 aa, Mycobacterium
LDLCRELGAEVAINYRDE

SEQ ID NO: 1287651 - protein, 25 aa, Mycobacterium
LDLSLPANVPFRFLCIPQYETERIL

SEQ ID NO: 1287652 - protein, 28 aa, Mycobacterium
LDPERGRLWSALWLRPAHGPGVLVVTAH

SEQ ID NO: 1287653 - protein, 18 aa, Mycobacterium
LDQLVGFFINILVLRNDL

SEQ ID NO: 1287654 - protein, 24 aa, Mycobacterium
LDRERCVLCARCTRFSQQIAGDPF

SEQ ID NO: 1287655 - protein, 18 aa, Mycobacterium
LDRGWCEHLAYLADIRES

SEQ ID NO: 1287656 - protein, 18 aa, Mycobacterium
LDRIFIDAGAEWRQAGCS

SEQ ID NO: 1287657 - protein, 19 aa, Mycobacterium
LDRVLQLFGGYGYMEEYPI

SEQ ID NO: 1287658 - protein, 21 aa, Mycobacterium
LDTDLRWRIVTALAASGDIDA

SEQ ID NO: 1287659 - protein, 19 aa, Mycobacterium
LDVGCGWGSTMMRAIERHD

SEQ ID NO: 1287660 - protein, 24 aa, Mycobacterium
LDVLRFWLDLGIDGFRLDAVPYLF

SEQ ID NO: 1287661 - protein, 18 aa, Mycobacterium
LDVWSLTDIVAFNRDSAD

SEQ ID NO: 1287662 - protein, 18 aa, Mycobacterium
LEAMGAPIPRYTAVDTVD

SEQ ID NO: 1287663 - protein, 24 aa, Mycobacterium
LEDALRFYFEFHFDQGEGYLAHLH

SEQ ID NO: 1287664 - protein, 22 aa, Mycobacterium
LEEYWWAAEQMLTWPGEPANMI

SEQ ID NO: 1287665 - protein, 18 aa, Mycobacterium
LEFFRPMVEQVFARQPWA

SEQ ID NO: 1287666 - protein, 18 aa, Mycobacterium
LEHPELWGKVVDVDELVP

SEQ ID NO: 1287667 - protein, 21 aa, Mycobacterium
LEIGRAHTPWFHWGTTAMVAH

SEQ ID NO: 1287668 - protein, 17 aa, Mycobacterium
LEIRPPVVTVMGHVDHG

SEQ ID NO: 1287669 - protein, 24 aa, Mycobacterium
LEKTLRFWLDRGVDGFRIDVAHGM

SEQ ID NO: 1287670 - protein, 20 aa, Mycobacterium
LELSQLPGLGWVEYEPFGTV

SEQ ID NO: 1287671 - protein, 25 aa, Mycobacterium
LENLSPWFEFVWKPGYADYYPELPG

SEQ ID NO: 1287672 - protein, 18 aa, Mycobacterium
LENTRFWAPLSLTAEQKH

SEQ ID NO: 1287673 - protein, 19 aa, Mycobacterium
LEPEPVCWAIENIAVHVGP

SEQ ID NO: 1287674 - protein, 17 aa, Mycobacterium
LERICRLIMLYHLDRGW

SEQ ID NO: 1287675 - protein, 20 aa, Mycobacterium
LETRGRFGTFVSRVDPADTA

SEQ ID NO: 1287676 - protein, 19 aa, Mycobacterium
LEVYPGLWAGPSLLRDGAG

SEQ ID NO: 1287677 - protein, 19 aa, Mycobacterium
LEYHWGRHWVVWDAEDTFQ

SEQ ID NO: 1287678 - protein, 19 aa, Mycobacterium
LFAERCIDGLVANEEHMRE

SEQ ID NO: 1287679 - protein, 23 aa, Mycobacterium
LFALGRLPGWIAHWREMHSEPGK

SEQ ID NO: 1287680 - protein, 18 aa, Mycobacterium
LFALLAYGEVAAFYRLTE

SEQ ID NO: 1287681 - protein, 18 aa, Mycobacterium
LFAWCFARRGWAERARVL

SEQ ID NO: 1287682 - protein, 24 aa, Mycobacterium
LFENGWKPGLAWTAETTLGRVMFN

SEQ ID NO: 1287683 - protein, 17 aa, Mycobacterium
LFFQIYWLGGREAILER

SEQ ID NO: 1287684 - protein, 17 aa, Mycobacterium
LFIFPVLNLRLPMITRS

SEQ ID NO: 1287685 - protein, 18 aa, Mycobacterium
LFLGDSFEGIVTVEIVDG

SEQ ID NO: 1287686 - protein, 18 aa, Mycobacterium
LFLRDLVMALRWVRDNIA

SEQ ID NO: 1287687 - protein, 18 aa, Mycobacterium
LFNGFWILDVSSKEEAKQ

SEQ ID NO: 1287688 - protein, 17 aa, Mycobacterium
LGAVKAWASVGVDPAFT

SEQ ID NO: 1287689 - protein, 22 aa, Mycobacterium
LGDLRPLYRPGLVHIYHALTWG

SEQ ID NO: 1287690 - protein, 18 aa, Mycobacterium
LGDPDFLLTIGLLPLQTA

SEQ ID NO: 1287691 - protein, 18 aa, Mycobacterium
LGEALGLIDMERGAKVAG

SEQ ID NO: 1287692 - protein, 20 aa, Mycobacterium
LGEIWLRYRASVAHGLTLWM

SEQ ID NO: 1287693 - protein, 17 aa, Mycobacterium
LGELWVAAARLRQVERL

SEQ ID NO: 1287694 - protein, 19 aa, Mycobacterium
LGEQCAFGLALIAPKLPPF

SEQ ID NO: 1287695 - protein, 17 aa, Mycobacterium
LGEWDLRALVGHTSRSL

SEQ ID NO: 1287696 - protein, 23 aa, Mycobacterium
LGGFAWKAALHMLRRGGASVPVP

SEQ ID NO: 1287697 - protein, 23 aa, Mycobacterium
LGHLRGAVNIGLAGRYAEFAGSV

SEQ ID NO: 1287698 - protein, 18 aa, Mycobacterium
LGIRGCSVSMPFKQDVLD

SEQ ID NO: 1287699 - protein, 18 aa, Mycobacterium
LGITNVRFTGGEPLVVRH

SEQ ID NO: 1287700 - protein, 24 aa, Mycobacterium
LGLDGAGLGTCWGRQLATSMLADA

SEQ ID NO: 1287701 - protein, 17 aa, Mycobacterium
LGNLIPEWNDLVRRGRW

SEQ ID NO: 1287702 - protein, 22 aa, Mycobacterium
LGNVRLPIVIAFGLGSLATGMA

SEQ ID NO: 1287703 - protein, 22 aa, Mycobacterium
LGPARLPGGFAVRYHPATRPLQ

SEQ ID NO: 1287704 - protein, 24 aa, Mycobacterium
LGPRGRNVVLAKSWGGPTVTNDGV

SEQ ID NO: 1287705 - protein, 17 aa, Mycobacterium
LGPSLSDPGRRSVAKTL

SEQ ID NO: 1287706 - protein, 26 aa, Mycobacterium
LGRPLRIAHAWSFTFDAAWQPLVALF

SEQ ID NO: 1287707 - protein, 24 aa, Mycobacterium
LGSLTLPVLRAWLSAQAAAGTART

SEQ ID NO: 1287708 - protein, 21 aa, Mycobacterium
LGTAAVCWRLRRRHGLPVHDI

SEQ ID NO: 1287709 - protein, 20 aa, Mycobacterium
LGTFSWPGAYGTWWQADPTN

SEQ ID NO: 1287710 - protein, 18 aa, Mycobacterium
LGVDVVLPWDGRDHYLAG

SEQ ID NO: 1287711 - protein, 24 aa, Mycobacterium
LGVGWPKEFGGLGFGPVEQSIFVN

SEQ ID NO: 1287712 - protein, 17 aa, Mycobacterium
LGWSAPRLHLVDLQYSD

SEQ ID NO: 1287713 - protein, 19 aa, Mycobacterium
LHDPVRWKLQHIGRYTLSG

SEQ ID NO: 1287714 - protein, 23 aa, Mycobacterium
LHGECGWEYFAPVFVGDELTETR

SEQ ID NO: 1287715 - protein, 24 aa, Mycobacterium
LIDFWRFNVAFARGILTQQPVSAR

SEQ ID NO: 1287716 - protein, 26 aa, Mycobacterium
LIERRPGWPQARWLRVAIHHRTQRWS

SEQ ID NO: 1287717 - protein, 23 aa, Mycobacterium
LIEVIGGLGIRLSNYLPTRTFEL

SEQ ID NO: 1287718 - protein, 18 aa, Mycobacterium
LILADAIVRACEDNPDYL

SEQ ID NO: 1287719 - protein, 19 aa, Mycobacterium
LIQHLIRWVILSKQFDDTV

SEQ ID NO: 1287720 - protein, 21 aa, Mycobacterium
LKASFKAGALIGRGSGEALQV

SEQ ID NO: 1287721 - protein, 18 aa, Mycobacterium
LKGANLWKEVKDRLDQPG

SEQ ID NO: 1287722 - protein, 20 aa, Mycobacterium
LKGEVKDVLLLDVTPLSLGI

SEQ ID NO: 1287723 - protein, 17 aa, Mycobacterium
LKIALAAAEQARIAVPL

SEQ ID NO: 1287724 - protein, 19 aa, Mycobacterium
LKIPRLQDAYFKRFTDYPK

SEQ ID NO: 1287725 - protein, 20 aa, Mycobacterium
LKIPSERWIFPYAGTDSHDT

SEQ ID NO: 1287726 - protein, 19 aa, Mycobacterium
LKPAEWTPLTSIRLGELAV

SEQ ID NO: 1287727 - protein, 20 aa, Mycobacterium
LKPLFLAAAHWKRTGRFPGV

SEQ ID NO: 1287728 - protein, 19 aa, Mycobacterium
LKVLIRFTNELLRQSVIGL

SEQ ID NO: 1287729 - protein, 23 aa, Mycobacterium
LKYPARLIDEFTWETDLGDKVVS

SEQ ID NO: 1287730 - protein, 20 aa, Mycobacterium
LKYPHMFAAAGLIIVNKTDL

SEQ ID NO: 1287731 - protein, 17 aa, Mycobacterium
LLAALAFDLIILETVGV

SEQ ID NO: 1287732 - protein, 18 aa, Mycobacterium
LLAPIAVPLVYRASVAAR

SEQ ID NO: 1287733 - protein, 18 aa, Mycobacterium
LLCNGAVGIAEGWATKVP

SEQ ID NO: 1287734 - protein, 18 aa, Mycobacterium
LLDALAPLGDWATRHIDL

SEQ ID NO: 1287735 - protein, 17 aa, Mycobacterium
LLDLFGLAGESLPAIVD

SEQ ID NO: 1287736 - protein, 18 aa, Mycobacterium
LLDQCRRHGLPVLIASPS

SEQ ID NO: 1287737 - protein, 17 aa, Mycobacterium
LLEMMWADEFVDERDAR

SEQ ID NO: 1287738 - protein, 17 aa, Mycobacterium
LLGLDCVIYMGAVDTAR

SEQ ID NO: 1287739 - protein, 20 aa, Mycobacterium
LLGPRGRRWLNKKLGLDNVF

SEQ ID NO: 1287740 - protein, 20 aa, Mycobacterium
LLGRCPVCLYAGSIMPEDLL

SEQ ID NO: 1287741 - protein, 25 aa, Mycobacterium
LLGRRGACLNLKMAMLGRADEPPYF

SEQ ID NO: 1287742 - protein, 23 aa, Mycobacterium
LLGSLRIGNRFVHTGRPTPEAYA

SEQ ID NO: 1287743 - protein, 18 aa, Mycobacterium
LLHHVAWQPVAWPDADLP

SEQ ID NO: 1287744 - protein, 19 aa, Mycobacterium
LLHYVKWYLDGTLTFRRSC

SEQ ID NO: 1287745 - protein, 22 aa, Mycobacterium
LLLEVVCARLLLPSASDTESAL

SEQ ID NO: 1287746 - protein, 17 aa, Mycobacterium
LLLPGSDLDEAWVDQTA

SEQ ID NO: 1287747 - protein, 23 aa, Mycobacterium
LLLRPRYAGLRVYRGKVVGKGDW

SEQ ID NO: 1287748 - protein, 18 aa, Mycobacterium
LLMFNRILPAAGMHHMSR

SEQ ID NO: 1287749 - protein, 23 aa, Mycobacterium
LLNAKTRRPSVCNAAESVLIDAA

SEQ ID NO: 1287750 - protein, 17 aa, Mycobacterium
LLPRYVRTIHSWQLSRV

SEQ ID NO: 1287751 - protein, 20 aa, Mycobacterium
LLPVHCWFDGDGWGMRVFAP

SEQ ID NO: 1287752 - protein, 17 aa, Mycobacterium
LLQLRWLALEGRPDRVD

SEQ ID NO: 1287753 - protein, 19 aa, Mycobacterium
LLQPWGIVHGGVYCAIVES

SEQ ID NO: 1287754 - protein, 24 aa, Mycobacterium
LLSSRFPMWMAWGPELTFFCNAAY

SEQ ID NO: 1287755 - protein, 17 aa, Mycobacterium
LLVLGALCHDIGKGRGG

SEQ ID NO: 1287756 - protein, 17 aa, Mycobacterium
LLVRALVAWFWDEPLRA

SEQ ID NO: 1287757 - protein, 19 aa, Mycobacterium
LMAAARLDLASVFLYNGSI

SEQ ID NO: 1287758 - protein, 19 aa, Mycobacterium
LMAALTMKLEKHWQQRTPA

SEQ ID NO: 1287759 - protein, 18 aa, Mycobacterium
LMHGAAQWAVMTALTTGQ

SEQ ID NO: 1287760 - protein, 18 aa, Mycobacterium
LMPDVLHWFGIRKIHRLV

SEQ ID NO: 1287761 - protein, 22 aa, Mycobacterium
LMTRSGTFYTLRCYLGDDPVFL

SEQ ID NO: 1287762 - protein, 26 aa, Mycobacterium
LMVAECALIFGCDWLNIPIDAPGSSL

SEQ ID NO: 1287763 - protein, 19 aa, Mycobacterium
LNGNGGLDWAVKRTADSSQ

SEQ ID NO: 1287764 - protein, 17 aa, Mycobacterium
LNLVFGHVLEQLRAADV

SEQ ID NO: 1287765 - protein, 18 aa, Mycobacterium
LNMMPRWYIGSILRNVDF

SEQ ID NO: 1287766 - protein, 23 aa, Mycobacterium
LNSPAADFFIKWMSRGNTLVYKL

SEQ ID NO: 1287767 - protein, 19 aa, Mycobacterium
LNYLPPRLVPPVFRHQARR

SEQ ID NO: 1287768 - protein, 18 aa, Mycobacterium
LPAGFSFVPGHEIVGIVE

SEQ ID NO: 1287769 - protein, 17 aa, Mycobacterium
LPAGMPVAVVVRQLTEH

SEQ ID NO: 1287770 - protein, 17 aa, Mycobacterium
LPARFGIAVDHLNGQGM

SEQ ID NO: 1287771 - protein, 17 aa, Mycobacterium
LPAWMFRLARGESDVLA

SEQ ID NO: 1287772 - protein, 23 aa, Mycobacterium
LPDKRVDEVLGMVGLADVAGKPA

SEQ ID NO: 1287773 - protein, 19 aa, Mycobacterium
LPEGRWEEFLGEPRIAERV

SEQ ID NO: 1287774 - protein, 23 aa, Mycobacterium
LPERDFPTLISLYLQGRLPLDKF

SEQ ID NO: 1287775 - protein, 23 aa, Mycobacterium
LPGSEHWPAMVFLRSPAPSSNHH

SEQ ID NO: 1287776 - protein, 17 aa, Mycobacterium
LPICAAIAVLRTRTTRE

SEQ ID NO: 1287777 - protein, 22 aa, Mycobacterium
LPITLWPGMKIGQLCLLRLTSP

SEQ ID NO: 1287778 - protein, 19 aa, Mycobacterium
LPKEFKRRGVQMLTEGKRT

SEQ ID NO: 1287779 - protein, 17 aa, Mycobacterium
LPLRPFRTMAVNVDGEL

SEQ ID NO: 1287780 - protein, 23 aa, Mycobacterium
LPMPDLIRLAARAHHYLYVYDQH

SEQ ID NO: 1287781 - protein, 22 aa, Mycobacterium
LPNGRSGWRISIPAMMSYWSEL

SEQ ID NO: 1287782 - protein, 18 aa, Mycobacterium
LPPELDFAALFHGIDERV

SEQ ID NO: 1287783 - protein, 17 aa, Mycobacterium
LPPGIAVQGQRGGPAHP

SEQ ID NO: 1287784 - protein, 19 aa, Mycobacterium
LPPGVPGTIWFRGGNSSFE

SEQ ID NO: 1287785 - protein, 17 aa, Mycobacterium
LPPLWQVFGAHRRPDGH

SEQ ID NO: 1287786 - protein, 18 aa, Mycobacterium
LPPWLRLVVVDAANAVFT

SEQ ID NO: 1287787 - protein, 17 aa, Mycobacterium
LPRARLTGELGRTAGQL

SEQ ID NO: 1287788 - protein, 23 aa, Mycobacterium
LPVKLCYAGPFFRYERPQAGRYR

SEQ ID NO: 1287789 - protein, 23 aa, Mycobacterium
LPVYRPPLDMARLFGEPAVGDHR

SEQ ID NO: 1287790 - protein, 23 aa, Mycobacterium
LPYPGDDVLLCLGIHGQMIYVNR

SEQ ID NO: 1287791 - protein, 18 aa, Mycobacterium
LQHPDTFERLGIEPPRGV

SEQ ID NO: 1287792 - protein, 17 aa, Mycobacterium
LQLPFGAPKTMFNVPIG

SEQ ID NO: 1287793 - protein, 17 aa, Mycobacterium
LQMSWKVAPALAAGCTM

SEQ ID NO: 1287794 - protein, 23 aa, Mycobacterium
LQPLRPPVSFGFASAPAAPQLVA

SEQ ID NO: 1287795 - protein, 20 aa, Mycobacterium
LQRREAWQIIDFVNQLTDPS

SEQ ID NO: 1287796 - protein, 18 aa, Mycobacterium
LQTEFDFRFLVGVVSVMG

SEQ ID NO: 1287797 - protein, 18 aa, Mycobacterium
LQTWLQRRVVIDGEMLAR

SEQ ID NO: 1287798 - protein, 18 aa, Mycobacterium
LQVAEAFGRYGAHLPVNV

SEQ ID NO: 1287799 - protein, 17 aa, Mycobacterium
LQVANRVELARYAIEHG

SEQ ID NO: 1287800 - protein, 18 aa, Mycobacterium
LQWLGVDCLWLPPFYDSP

SEQ ID NO: 1287801 - protein, 24 aa, Mycobacterium
LRAAARVYAGWGFSQAFYWQQEYK

SEQ ID NO: 1287802 - protein, 19 aa, Mycobacterium
LRAGLFGVLYVLDEPSAGL

SEQ ID NO: 1287803 - protein, 18 aa, Mycobacterium
LRALFPDAIEVTAADAHV

SEQ ID NO: 1287804 - protein, 20 aa, Mycobacterium
LRDAWFWAHEVMAVGMVWNT

SEQ ID NO: 1287805 - protein, 19 aa, Mycobacterium
LRDEIGCSIVLITHDLGVA

SEQ ID NO: 1287806 - protein, 22 aa, Mycobacterium
LRFAVNRLRMFAADPAERTPRP

SEQ ID NO: 1287807 - protein, 21 aa, Mycobacterium
LRGAFHVVRPAFPVMCDAGYG

SEQ ID NO: 1287808 - protein, 22 aa, Mycobacterium
LRGDCPRFAPGDFAVRPTVGTP

SEQ ID NO: 1287809 - protein, 27 aa, Mycobacterium
LRGFQRFPAWMWRNVVVRDFAEWLQAH

SEQ ID NO: 1287810 - protein, 21 aa, Mycobacterium
LRGGVFSAILPVLAHDIPWNS

SEQ ID NO: 1287811 - protein, 17 aa, Mycobacterium
LRHDWPAALRGAGFDPS

SEQ ID NO: 1287812 - protein, 17 aa, Mycobacterium
LRIDDRFRAAARGDRAA

SEQ ID NO: 1287813 - protein, 17 aa, Mycobacterium
LRIGLATADDIRQWSYG

SEQ ID NO: 1287814 - protein, 18 aa, Mycobacterium
LRIGRLCDRLHVTKGSFY

SEQ ID NO: 1287815 - protein, 23 aa, Mycobacterium
LRIPKLRSGSFFPALLERRRRVD

SEQ ID NO: 1287816 - protein, 20 aa, Mycobacterium
LRLADAWVWDMYRPARFVKQ

SEQ ID NO: 1287817 - protein, 17 aa, Mycobacterium
LRLGDRIQITPPLGSAL

SEQ ID NO: 1287818 - protein, 17 aa, Mycobacterium
LRLPPELDFAALFHGID

SEQ ID NO: 1287819 - protein, 19 aa, Mycobacterium
LRLPVLRAQLRWMEAVLAV

SEQ ID NO: 1287820 - protein, 24 aa, Mycobacterium
LRLRDIGGIIVIDFIDMVLESNRD

SEQ ID NO: 1287821 - protein, 17 aa, Mycobacterium
LRLRGMSAMLTRIKRRL

SEQ ID NO: 1287822 - protein, 18 aa, Mycobacterium
LRLRGWQVDFLGAQVPTP

SEQ ID NO: 1287823 - protein, 20 aa, Mycobacterium
LRLSHPLPLRVGDVGLLRDP

SEQ ID NO: 1287824 - protein, 17 aa, Mycobacterium
LRLVEAFGYGWSDLARF

SEQ ID NO: 1287825 - protein, 23 aa, Mycobacterium
LRMDEFPARLVIVPGERDRLLQS

SEQ ID NO: 1287826 - protein, 18 aa, Mycobacterium
LRNWRFYDGFRVDATAPA

SEQ ID NO: 1287827 - protein, 26 aa, Mycobacterium
LRPDLATGLMPLRWGTGYMLGSKRFG

SEQ ID NO: 1287828 - protein, 22 aa, Mycobacterium
LRPGGRLGLVWNTRDERLGWVK

SEQ ID NO: 1287829 - protein, 19 aa, Mycobacterium
LRRACVAGALATLVPGAGD

SEQ ID NO: 1287830 - protein, 19 aa, Mycobacterium
LRRAGGCWVLTNHPFLTGR

SEQ ID NO: 1287831 - protein, 17 aa, Mycobacterium
LRRCGAPLLSLRTDRDW

SEQ ID NO: 1287832 - protein, 22 aa, Mycobacterium
LRRELLDLSAWAWDEFLTANGD

SEQ ID NO: 1287833 - protein, 18 aa, Mycobacterium
LRRLKTCAAPDCEAVLVD

SEQ ID NO: 1287834 - protein, 20 aa, Mycobacterium
LRRLVIMGGAFDYRGNTTAV

SEQ ID NO: 1287835 - protein, 18 aa, Mycobacterium
LRRLWGLPGTQLGVVAWP

SEQ ID NO: 1287836 - protein, 19 aa, Mycobacterium
LRRYDCSQLTDGGAGIVLV

SEQ ID NO: 1287837 - protein, 18 aa, Mycobacterium
LRSLGGWGRRHGVATVMI

SEQ ID NO: 1287838 - protein, 23 aa, Mycobacterium
LRSRRARIAPEMTGLPAYGGRRR

SEQ ID NO: 1287839 - protein, 20 aa, Mycobacterium
LRSWFGFGVAGNFAGHLEQA

SEQ ID NO: 1287840 - protein, 19 aa, Mycobacterium
LRTDRDWIADVVRFVASRR

SEQ ID NO: 1287841 - protein, 17 aa, Mycobacterium
LRTGWSVTIVGTAHPIS

SEQ ID NO: 1287842 - protein, 20 aa, Mycobacterium
LRVIFPAGFAERIGPRAVNE

SEQ ID NO: 1287843 - protein, 20 aa, Mycobacterium
LRWLASANCLLEIPEDVSEL

SEQ ID NO: 1287844 - protein, 20 aa, Mycobacterium
LRYTMPLGEIIFDFFDSLKS

SEQ ID NO: 1287845 - protein, 17 aa, Mycobacterium
LSARLGLTARVAHVEGD

SEQ ID NO: 1287846 - protein, 17 aa, Mycobacterium
LSARPGVVLSRRQLLDI

SEQ ID NO: 1287847 - protein, 22 aa, Mycobacterium
LSFSSLSGWAKRGLRDRFIDLT

SEQ ID NO: 1287848 - protein, 17 aa, Mycobacterium
LSKRGGGVALLLSNIRE

SEQ ID NO: 1287849 - protein, 18 aa, Mycobacterium
LSRHRWAVLMKVHHCLAD

SEQ ID NO: 1287850 - protein, 22 aa, Mycobacterium
LSSSQLRSWFAYRVDGPSVVNN

SEQ ID NO: 1287851 - protein, 20 aa, Mycobacterium
LSTAMLLEWLAERHHRGALA

SEQ ID NO: 1287852 - protein, 18 aa, Mycobacterium
LSVSCPRDLVANAPVPLS

SEQ ID NO: 1287853 - protein, 17 aa, Mycobacterium
LTAQDVFNNVARTCIEA

SEQ ID NO: 1287854 - protein, 24 aa, Mycobacterium
LTCSIRPSGIWGRGDQTMFRKVFE

SEQ ID NO: 1287855 - protein, 24 aa, Mycobacterium
LTEAWGLSTAQGWQGVGHTRMATE

SEQ ID NO: 1287856 - protein, 18 aa, Mycobacterium
LTGARYVGWQGLLDAQRE

SEQ ID NO: 1287857 - protein, 17 aa, Mycobacterium
LTGELRQGALIGVMADA

SEQ ID NO: 1287858 - protein, 17 aa, Mycobacterium
LTRDLAQQWGIRKGIRV

SEQ ID NO: 1287859 - protein, 19 aa, Mycobacterium
LTSELPLPVNAIGIPDQDD

SEQ ID NO: 1287860 - protein, 18 aa, Mycobacterium
LTSIPLWAAIEAFCADKT

SEQ ID NO: 1287861 - protein, 19 aa, Mycobacterium
LTTALARHGIVLSLQFETD

SEQ ID NO: 1287862 - protein, 17 aa, Mycobacterium
LTVDLLRPVAMAPVHTR

SEQ ID NO: 1287863 - protein, 23 aa, Mycobacterium
LVARRLDCQVGLLLTELSEEPGH

SEQ ID NO: 1287864 - protein, 17 aa, Mycobacterium
LVEAFGYGWSDLARFTI

SEQ ID NO: 1287865 - protein, 19 aa, Mycobacterium
LVFGRRAGLGASDYVRALG

SEQ ID NO: 1287866 - protein, 24 aa, Mycobacterium
LVIKEALRLLAPVPLVMRKTVRDV

SEQ ID NO: 1287867 - protein, 17 aa, Mycobacterium
LVLCGAYAKGRAVRAAN

SEQ ID NO: 1287868 - protein, 24 aa, Mycobacterium
LVLHDLSWRLARFGPAQVGLEPLP

SEQ ID NO: 1287869 - protein, 22 aa, Mycobacterium
LVLPRRLQIEFSQAIQKITDGE

SEQ ID NO: 1287870 - protein, 17 aa, Mycobacterium
LVLRPGLTLALEPWFAR

SEQ ID NO: 1287871 - protein, 17 aa, Mycobacterium
LVRWPRQVLAEFGLYLP

SEQ ID NO: 1287872 - protein, 17 aa, Mycobacterium
LVTPLPFNVRQTVRDTE

SEQ ID NO: 1287873 - protein, 21 aa, Mycobacterium
LVTRAGFIGCHHWRFLETADV

SEQ ID NO: 1287874 - protein, 18 aa, Mycobacterium
LVVRINFLGTRHFTESML

SEQ ID NO: 1287875 - protein, 18 aa, Mycobacterium
LWARRPASLEPYADTAAK

SEQ ID NO: 1287876 - protein, 17 aa, Mycobacterium
LWAYVVIFCGHFPDGAD

SEQ ID NO: 1287877 - protein, 26 aa, Mycobacterium
LWEHWERCAFHWFPGNHLLHVSQPDY

SEQ ID NO: 1287878 - protein, 18 aa, Mycobacterium
LWPHARCALMGVGAPPLM

SEQ ID NO: 1287879 - protein, 25 aa, Mycobacterium
LYAIPRFVNRWAVSLAYLTDVFFAR

SEQ ID NO: 1287880 - protein, 17 aa, Mycobacterium
LYDAGWMRYGWPESAGG

SEQ ID NO: 1287881 - protein, 24 aa, Mycobacterium
LYEQRRWEVPSNRIANTMKLAIIS

SEQ ID NO: 1287882 - protein, 18 aa, Mycobacterium
LYIALGISGAIQHRAGMQ

SEQ ID NO: 1287883 - protein, 17 aa, Mycobacterium
LYLDWPRKARAVVGNLR

SEQ ID NO: 1287884 - protein, 17 aa, Mycobacterium
LYRLCGDRNPLHSDPDF

SEQ ID NO: 1287885 - protein, 19 aa, Mycobacterium
LYRRWPFFRTVLSNMAQVL

SEQ ID NO: 1287886 - protein, 19 aa, Mycobacterium
LYSRFWHKVLYDLGHVSSR

SEQ ID NO: 1287887 - protein, 18 aa, Mycobacterium
LYWQCWKLDSPLVARLTG

SEQ ID NO: 1287888 - protein, 18 aa, Mycobacterium
MAAAPAWESFEQWMRTRL

SEQ ID NO: 1287889 - protein, 17 aa, Mycobacterium
MAGDFGGVWYWNRFPGI

SEQ ID NO: 1287890 - protein, 17 aa, Mycobacterium
MAHFFYIHFGLPTYFKN

SEQ ID NO: 1287891 - protein, 18 aa, Mycobacterium
MALELTWEALEHARIPAS

SEQ ID NO: 1287892 - protein, 17 aa, Mycobacterium
MARLLCHKAAWTIDQEG

SEQ ID NO: 1287893 - protein, 19 aa, Mycobacterium
MCGWLKDRFGVSWQIVPDR

SEQ ID NO: 1287894 - protein, 18 aa, Mycobacterium
MDPWGASVADVFTAELAA

SEQ ID NO: 1287895 - protein, 21 aa, Mycobacterium
MDRKVWLPSGGTLVIDRTEAM

SEQ ID NO: 1287896 - protein, 17 aa, Mycobacterium
MEFCTAYALAPEWGTHT

SEQ ID NO: 1287897 - protein, 20 aa, Mycobacterium
MELGCDAVLLASAVTRAADP

SEQ ID NO: 1287898 - protein, 20 aa, Mycobacterium
MEPDLRWERFITAVRLLAEQ

SEQ ID NO: 1287899 - protein, 24 aa, Mycobacterium
MFADLPPDFGIRFADLVSARAKRI

SEQ ID NO: 1287900 - protein, 17 aa, Mycobacterium
MFRCERDVWLVAAGTLG

SEQ ID NO: 1287901 - protein, 22 aa, Mycobacterium
MGCGRTGAFFSFEEAGIVPDIV

SEQ ID NO: 1287902 - protein, 18 aa, Mycobacterium
MGGLLAFDIARRLERDGD

SEQ ID NO: 1287903 - protein, 17 aa, Mycobacterium
MGGRTALIVAGRVPERV

SEQ ID NO: 1287904 - protein, 17 aa, Mycobacterium
MHPWGKWGRDFTEYGVV

SEQ ID NO: 1287905 - protein, 19 aa, Mycobacterium
MHRRWSIVMVDEFQDTDPV

SEQ ID NO: 1287906 - protein, 19 aa, Mycobacterium
MHVVPRWGGDANFITIIGG

SEQ ID NO: 1287907 - protein, 24 aa, Mycobacterium
MIAEAGDWVTCWAVGMNQSTHGTA

SEQ ID NO: 1287908 - protein, 22 aa, Mycobacterium
MIRYCAPAQWFARTVRRPFTIH

SEQ ID NO: 1287909 - protein, 18 aa, Mycobacterium
MKLSDAWEGGGAVAAAGE

SEQ ID NO: 1287910 - protein, 20 aa, Mycobacterium
MKPDVCWQLPIRRTQDWVTR

SEQ ID NO: 1287911 - protein, 17 aa, Mycobacterium
MLESWKLAPALASGCTV

SEQ ID NO: 1287912 - protein, 17 aa, Mycobacterium
MLRSTFVYRHRQLADDL

SEQ ID NO: 1287913 - protein, 18 aa, Mycobacterium
MLVRPEFRAMFLDDLLNG

SEQ ID NO: 1287914 - protein, 18 aa, Mycobacterium
MMHLATFLARAQVAEAEA

SEQ ID NO: 1287915 - protein, 19 aa, Mycobacterium
MPALKFVWADGAADLLTPF

SEQ ID NO: 1287916 - protein, 20 aa, Mycobacterium
MPGYRGWQWAVVVAAYPGAE

SEQ ID NO: 1287917 - protein, 22 aa, Mycobacterium
MPIKVPWSLPAARPCFAGDPED

SEQ ID NO: 1287918 - protein, 19 aa, Mycobacterium
MPLPLLRQALKAWPDTDFI

SEQ ID NO: 1287919 - protein, 17 aa, Mycobacterium
MPMPRALQWALIEHVLG

SEQ ID NO: 1287920 - protein, 17 aa, Mycobacterium
MPNRVNWTIVHYKPPQA

SEQ ID NO: 1287921 - protein, 17 aa, Mycobacterium
MPPQILHMILPRSDYEI

SEQ ID NO: 1287922 - protein, 20 aa, Mycobacterium
MPSQRGWRHVLYLLTRINLG

SEQ ID NO: 1287923 - protein, 24 aa, Mycobacterium
MQPGHWSGAYICWGTENREAAVRF

SEQ ID NO: 1287924 - protein, 18 aa, Mycobacterium
MRGGKFLNNWRMAELHAK

SEQ ID NO: 1287925 - protein, 17 aa, Mycobacterium
MRISHCRPPGADRDIVL

SEQ ID NO: 1287926 - protein, 17 aa, Mycobacterium
MRMTWWPLGVLVFLEVS

SEQ ID NO: 1287927 - protein, 17 aa, Mycobacterium
MRTVMCILNGQLRPVLV

SEQ ID NO: 1287928 - protein, 19 aa, Mycobacterium
MSEVLPLLYLHGLSTSDFT

SEQ ID NO: 1287929 - protein, 22 aa, Mycobacterium
MSTPEMFGRVAIAQTMRDVSPD

SEQ ID NO: 1287930 - protein, 19 aa, Mycobacterium
MTEVLPLLYLHGLSTSDFG

SEQ ID NO: 1287931 - protein, 21 aa, Mycobacterium
MTGPEIARWTAAMVASGQRFD

SEQ ID NO: 1287932 - protein, 26 aa, Mycobacterium
MTISVSFHEPVRWDGWLLYSHESTQV

SEQ ID NO: 1287933 - protein, 23 aa, Mycobacterium
MTLTCPFHGWTFRNDGTLLKVKD

SEQ ID NO: 1287934 - protein, 18 aa, Mycobacterium
MTVQWAFDRHSFGRPLAS

SEQ ID NO: 1287935 - protein, 21 aa, Mycobacterium
MYCPRLTQRFTRCSDRLGFPV

SEQ ID NO: 1287936 - protein, 18 aa, Mycobacterium
MYELEFPAPQLSAADGRG

SEQ ID NO: 1287937 - protein, 19 aa, Mycobacterium
NAGPFGMGGAQSFFDQQTV

SEQ ID NO: 1287938 - protein, 20 aa, Mycobacterium
NARTVFWNGPMGVFEFPAFA

SEQ ID NO: 1287939 - protein, 17 aa, Mycobacterium
NAVIFCGHFPDGAEKFT

SEQ ID NO: 1287940 - protein, 21 aa, Mycobacterium
NCLVNACAHRGAMVCRRKTDN

SEQ ID NO: 1287941 - protein, 19 aa, Mycobacterium
NCSGRIPFDTALISEVLAE

SEQ ID NO: 1287942 - protein, 19 aa, Mycobacterium
NELGHPWTVLRADRSTDFL

SEQ ID NO: 1287943 - protein, 21 aa, Mycobacterium
NFPMTIAAWGFAPALAAGNAV

SEQ ID NO: 1287944 - protein, 24 aa, Mycobacterium
NFVFGEVWLRPGLGMRERRLITVT

SEQ ID NO: 1287945 - protein, 17 aa, Mycobacterium
NGIKIFGPGGHKLDDAT

SEQ ID NO: 1287946 - protein, 21 aa, Mycobacterium
NGRLRPGVGRICMDQFVVDLG

SEQ ID NO: 1287947 - protein, 21 aa, Mycobacterium
NGRPRIAGVSSFGFAGTNAHV

SEQ ID NO: 1287948 - protein, 21 aa, Mycobacterium
NGVDWIVWWLAVSRIGALAVP

SEQ ID NO: 1287949 - protein, 18 aa, Mycobacterium
NGVFEFYTGVLGFRSRGA

SEQ ID NO: 1287950 - protein, 17 aa, Mycobacterium
NHARWAVFLRHLKFIVV

SEQ ID NO: 1287951 - protein, 19 aa, Mycobacterium
NHISFGFGVHRCMGNRLAE

SEQ ID NO: 1287952 - protein, 17 aa, Mycobacterium
NHLKAATVRLVLVGGGP

SEQ ID NO: 1287953 - protein, 17 aa, Mycobacterium
NIPAWLIFDQQYRDRYI

SEQ ID NO: 1287954 - protein, 19 aa, Mycobacterium
NISHEFRTPLTLILGPLAE

SEQ ID NO: 1287955 - protein, 17 aa, Mycobacterium
NITAYWKGYSEYHRDGL

SEQ ID NO: 1287956 - protein, 20 aa, Mycobacterium
NLDGVFGVLANVVWTNFGPC

SEQ ID NO: 1287957 - protein, 19 aa, Mycobacterium
NLENLDWLGVKARAHDAVV

SEQ ID NO: 1287958 - protein, 17 aa, Mycobacterium
NLFSVSGPYGYVGSSYF

SEQ ID NO: 1287959 - protein, 17 aa, Mycobacterium
NLHGWPFLLEARKNNGA

SEQ ID NO: 1287960 - protein, 24 aa, Mycobacterium
NLMLRAPFRLSRDVIPHMQPGSAI

SEQ ID NO: 1287961 - protein, 18 aa, Mycobacterium
NNIPVFFIQDGIKFPDVV

SEQ ID NO: 1287962 - protein, 19 aa, Mycobacterium
NPEAWRWYRNVFGDNNIPV

SEQ ID NO: 1287963 - protein, 21 aa, Mycobacterium
NPKNPRPVMLWGYQPLADNGQ

SEQ ID NO: 1287964 - protein, 18 aa, Mycobacterium
NQAVDCLLYSAADTAIRY

SEQ ID NO: 1287965 - protein, 23 aa, Mycobacterium
NQIWQCPVVLLADVRSVGVQGDG

SEQ ID NO: 1287966 - protein, 23 aa, Mycobacterium
NRAKLSEMPALWGYARDLFQTPG

SEQ ID NO: 1287967 - protein, 18 aa, Mycobacterium
NRDEMRWARADEFDVFRD

SEQ ID NO: 1287968 - protein, 19 aa, Mycobacterium
NREDLAFLPGQYVNVAVPG

SEQ ID NO: 1287969 - protein, 17 aa, Mycobacterium
NRTDYRPLEGFVYAITP

SEQ ID NO: 1287970 - protein, 19 aa, Mycobacterium
NRTPIEWDGYTPPVPAQGV

SEQ ID NO: 1287971 - protein, 17 aa, Mycobacterium
NRYGLVPGRADERIEAV

SEQ ID NO: 1287972 - protein, 18 aa, Mycobacterium
NSALPLAAMMACVMSGQS

SEQ ID NO: 1287973 - protein, 19 aa, Mycobacterium
NSLVIPPAWKKVWICPYPN

SEQ ID NO: 1287974 - protein, 17 aa, Mycobacterium
NTISFAGAEAFRDAEDG

SEQ ID NO: 1287975 - protein, 18 aa, Mycobacterium
NTYWDWVIDRIYLVLYGS

SEQ ID NO: 1287976 - protein, 19 aa, Mycobacterium
NVMPPRGVGVIELRGECVT

SEQ ID NO: 1287977 - protein, 18 aa, Mycobacterium
NVVVPGWIATAAQLPSEV

SEQ ID NO: 1287978 - protein, 17 aa, Mycobacterium
NVWDWAAGALVAAEAGA

SEQ ID NO: 1287979 - protein, 23 aa, Mycobacterium
NVYYRRALVLAAAFGRRADYPQH

SEQ ID NO: 1287980 - protein, 19 aa, Mycobacterium
NWFAAYAYWYFKLYGHENV

SEQ ID NO: 1287981 - protein, 19 aa, Mycobacterium
NWYSEFARLAPLMEKDVHY

SEQ ID NO: 1287982 - protein, 18 aa, Mycobacterium
PAADISIADVLRCIDGPL

SEQ ID NO: 1287983 - protein, 20 aa, Mycobacterium
PAAIRLLAALAFDLIILETV

SEQ ID NO: 1287984 - protein, 20 aa, Mycobacterium
PAAVCPHVEWALSSTLSARA

SEQ ID NO: 1287985 - protein, 20 aa, Mycobacterium
PACRSYDCVTVFARDLDTAD

SEQ ID NO: 1287986 - protein, 20 aa, Mycobacterium
PAENGVVMKTRWEGHTTDGV

SEQ ID NO: 1287987 - protein, 17 aa, Mycobacterium
PAERLPLLMPFEQAGVP

SEQ ID NO: 1287988 - protein, 20 aa, Mycobacterium
PAEVQRFASFFLTMDPPEHT

SEQ ID NO: 1287989 - protein, 20 aa, Mycobacterium
PAGEMQLDFWSRFGSRAQQK

SEQ ID NO: 1287990 - protein, 19 aa, Mycobacterium
PAGLRVIALRARLGEERHA

SEQ ID NO: 1287991 - protein, 17 aa, Mycobacterium
PAIPDRVDVVWLDHEGG

SEQ ID NO: 1287992 - protein, 20 aa, Mycobacterium
PAISAFNAWTLLKGLETLAV

SEQ ID NO: 1287993 - protein, 24 aa, Mycobacterium
PALTRPSLGIAEWIVPSLISAAGQ

SEQ ID NO: 1287994 - protein, 17 aa, Mycobacterium
PAPEVVRLLTAVTAGLP

SEQ ID NO: 1287995 - protein, 18 aa, Mycobacterium
PAPLCPRSLLARVEQRAA

SEQ ID NO: 1287996 - protein, 21 aa, Mycobacterium
PAPLHVVRLLAMLPLAPLVPF

SEQ ID NO: 1287997 - protein, 21 aa, Mycobacterium
PASARGSLRLSLGHTSTDADV

SEQ ID NO: 1287998 - protein, 19 aa, Mycobacterium
PAYTAVRWKAILQAMSQYQ

SEQ ID NO: 1287999 - protein, 18 aa, Mycobacterium
PCFAELYEDLGITKADIG

SEQ ID NO: 1288000 - protein, 19 aa, Mycobacterium
PCLECKLCVAACPVGAIGK

SEQ ID NO: 1288001 - protein, 18 aa, Mycobacterium
PCLPCGVHMYLGGGKSLE

SEQ ID NO: 1288002 - protein, 24 aa, Mycobacterium
PDAFPLIITHGWPGSVVEFDKVIE

SEQ ID NO: 1288003 - protein, 17 aa, Mycobacterium
PDARISVSPLGFVAEGR

SEQ ID NO: 1288004 - protein, 24 aa, Mycobacterium
PDFVKLAEALGCVGLRCEREEDVV

SEQ ID NO: 1288005 - protein, 20 aa, Mycobacterium
PDGKRCAVAFTFDVDAESPL

SEQ ID NO: 1288006 - protein, 25 aa, Mycobacterium
PDGLSCLRFRLRWRDFRLTVHARHD

SEQ ID NO: 1288007 - protein, 17 aa, Mycobacterium
PDGPGWWWQTWHLYPGG

SEQ ID NO: 1288008 - protein, 22 aa, Mycobacterium
PDIDIRFGIGWGQVTVLDTETG

SEQ ID NO: 1288009 - protein, 18 aa, Mycobacterium
PDLEVCVYAAPTQTVIGG

SEQ ID NO: 1288010 - protein, 20 aa, Mycobacterium
PDLRLWNFYGQTEMAPLASA

SEQ ID NO: 1288011 - protein, 19 aa, Mycobacterium
PDLTLPYGVNVLWDGRASI

SEQ ID NO: 1288012 - protein, 24 aa, Mycobacterium
PDLVWDFRLPRVVSINVSGHKYGL

SEQ ID NO: 1288013 - protein, 23 aa, Mycobacterium
PDMKLPIALALGWPDRIPGAALA

SEQ ID NO: 1288014 - protein, 25 aa, Mycobacterium
PDRSVTLALRWLVSFSKARREKTMV

SEQ ID NO: 1288015 - protein, 17 aa, Mycobacterium
PDSWARLIAEHSVTVLH

SEQ ID NO: 1288016 - protein, 24 aa, Mycobacterium
PDVAGPYSWWSWRGRAFDNDAGWR

SEQ ID NO: 1288017 - protein, 23 aa, Mycobacterium
PDWDELRARFDLVSRKVPMLRQR

SEQ ID NO: 1288018 - protein, 19 aa, Mycobacterium
PDWLRWNYATVVWGIATAH

SEQ ID NO: 1288019 - protein, 23 aa, Mycobacterium
PDWTRYSGALALRIGPVAVTGFA

SEQ ID NO: 1288020 - protein, 20 aa, Mycobacterium
PDYLGWDWKSKAGIPIVCVP

SEQ ID NO: 1288021 - protein, 21 aa, Mycobacterium
PEAIKLAPLVPALRAQGMTPV

SEQ ID NO: 1288022 - protein, 17 aa, Mycobacterium
PEAMGAVAVAFRANAQL

SEQ ID NO: 1288023 - protein, 20 aa, Mycobacterium
PEFIGRLPVVASVTNLDKES

SEQ ID NO: 1288024 - protein, 19 aa, Mycobacterium
PEGFGRIAATTARQVILQR

SEQ ID NO: 1288025 - protein, 17 aa, Mycobacterium
PEIKGCWILARYDDGRP

SEQ ID NO: 1288026 - protein, 17 aa, Mycobacterium
PELDQLVGFFINILVLR

SEQ ID NO: 1288027 - protein, 20 aa, Mycobacterium
PELMPLPIALAHRLARRLTE

SEQ ID NO: 1288028 - protein, 17 aa, Mycobacterium
PELRRPITELGMVKNVT

SEQ ID NO: 1288029 - protein, 21 aa, Mycobacterium
PENTIACSRWGMLAPDGQCKT

SEQ ID NO: 1288030 - protein, 23 aa, Mycobacterium
PERLRSGWLNGIKHWQVDYTGSA

SEQ ID NO: 1288031 - protein, 24 aa, Mycobacterium
PESECWRLLDSVALGRLVTCAGGQ

SEQ ID NO: 1288032 - protein, 22 aa, Mycobacterium
PETSVALGFGFRCGFLGLLHME

SEQ ID NO: 1288033 - protein, 21 aa, Mycobacterium
PEVRVPWNLPPKRRTREPESK

SEQ ID NO: 1288034 - protein, 17 aa, Mycobacterium
PEWCAGLLSATRRSSEF

SEQ ID NO: 1288035 - protein, 23 aa, Mycobacterium
PEYRRYLGRHLPYYANWHRLKSY

SEQ ID NO: 1288036 - protein, 24 aa, Mycobacterium
PFEALTIDCPEEFVGAITQLMAAR

SEQ ID NO: 1288037 - protein, 19 aa, Mycobacterium
PFFPFLVDLLDAWVAYFAE

SEQ ID NO: 1288038 - protein, 17 aa, Mycobacterium
PFHSRWRHFEAGNVNRA

SEQ ID NO: 1288039 - protein, 22 aa, Mycobacterium
PFILRGAALLGIDSVLLPIGPR

SEQ ID NO: 1288040 - protein, 24 aa, Mycobacterium
PFNFPAMVPMWFFPVAIATGNTVV

SEQ ID NO: 1288041 - protein, 23 aa, Mycobacterium
PFPEPVLMWWNFVGRSHEEIAAF

SEQ ID NO: 1288042 - protein, 19 aa, Mycobacterium
PFSALAFKIAVHPFFGKLT

SEQ ID NO: 1288043 - protein, 21 aa, Mycobacterium
PGLGRYGVWTGGAPKPEQAAQ

SEQ ID NO: 1288044 - protein, 19 aa, Mycobacterium
PGLSYQLAEGIALLSKVDW

SEQ ID NO: 1288045 - protein, 20 aa, Mycobacterium
PGLVLSGFVDRVGDPVPLVA

SEQ ID NO: 1288046 - protein, 19 aa, Mycobacterium
PGMVLTVRFDQTGDEETFL

SEQ ID NO: 1288047 - protein, 22 aa, Mycobacterium
PGRLVPNFLRRAIAYMEDNATA

SEQ ID NO: 1288048 - protein, 17 aa, Mycobacterium
PGSAAARAAERASGEAA

SEQ ID NO: 1288049 - protein, 21 aa, Mycobacterium
PGVAWPDQWSRAYFTPVTLIG

SEQ ID NO: 1288050 - protein, 26 aa, Mycobacterium
PGVLARVASLFSRRGFNIQSLAVGAT

SEQ ID NO: 1288051 - protein, 21 aa, Mycobacterium
PHFNLSIGVGDAFMRAVESGG

SEQ ID NO: 1288052 - protein, 18 aa, Mycobacterium
PHGKQLWCSMSHDHGDER

SEQ ID NO: 1288053 - protein, 18 aa, Mycobacterium
PHLATSFWFALGDRDEAR

SEQ ID NO: 1288054 - protein, 18 aa, Mycobacterium
PHVWAIGDVASWLDTIGN

SEQ ID NO: 1288055 - protein, 17 aa, Mycobacterium
PIAARLAGMPSVNLQLL

SEQ ID NO: 1288056 - protein, 17 aa, Mycobacterium
PIEWRYTNDPAWVMRDK

SEQ ID NO: 1288057 - protein, 18 aa, Mycobacterium
PIIFRFSQWKGLDYTASI

SEQ ID NO: 1288058 - protein, 18 aa, Mycobacterium
PIRIETRLTPGRTQLKVR

SEQ ID NO: 1288059 - protein, 19 aa, Mycobacterium
PIWCFPKFDVPLPRALRGA

SEQ ID NO: 1288060 - protein, 24 aa, Mycobacterium
PIWEWDGTDLFGWIATVPSPVKRA

SEQ ID NO: 1288061 - protein, 18 aa, Mycobacterium
PKGVLWRQHDIFLSSMGG

SEQ ID NO: 1288062 - protein, 18 aa, Mycobacterium
PKGVLWRQHDIFMTAFGG

SEQ ID NO: 1288063 - protein, 19 aa, Mycobacterium
PKIVKFSGCYHGHSDALLA

SEQ ID NO: 1288064 - protein, 19 aa, Mycobacterium
PKLDLGWMVQSWPDDTDAP

SEQ ID NO: 1288065 - protein, 19 aa, Mycobacterium
PKLLEMNGWTEGRSGVPFI

SEQ ID NO: 1288066 - protein, 19 aa, Mycobacterium
PKPLGMPLQYMVSGMAVAA

SEQ ID NO: 1288067 - protein, 19 aa, Mycobacterium
PKVVICLVNGWAAGGGHSL

SEQ ID NO: 1288068 - protein, 23 aa, Mycobacterium
PKYTPEWVKTVAIWAESSHREVR

SEQ ID NO: 1288069 - protein, 19 aa, Mycobacterium
PLAGLRLGLMHGRLSGDEK

SEQ ID NO: 1288070 - protein, 22 aa, Mycobacterium
PLARACLLGCGVTTGWGSAVNT

SEQ ID NO: 1288071 - protein, 19 aa, Mycobacterium
PLDMFGEWNRAYGSNGFLQ

SEQ ID NO: 1288072 - protein, 22 aa, Mycobacterium
PLGGCYRIAVLSLKGGVGKTTI

SEQ ID NO: 1288073 - protein, 23 aa, Mycobacterium
PLIEALGLTVGWITAESTAEERR

SEQ ID NO: 1288074 - protein, 20 aa, Mycobacterium
PLKLCWVPGYSDYYPETPGG

SEQ ID NO: 1288075 - protein, 18 aa, Mycobacterium
PLLDLGWMLICWPHDPNP

SEQ ID NO: 1288076 - protein, 26 aa, Mycobacterium
PLLRPGDEVYVCWSPDASLVLPAADI

SEQ ID NO: 1288077 - protein, 24 aa, Mycobacterium
PLLRRPDLLVSMLTYWQRHPALSY

SEQ ID NO: 1288078 - protein, 20 aa, Mycobacterium
PLLRRSGVIFIRRNVAGDPL

SEQ ID NO: 1288079 - protein, 21 aa, Mycobacterium
PLPEGAGFEFVDKVVGGAVPR

SEQ ID NO: 1288080 - protein, 19 aa, Mycobacterium
PLPYAGNSWVVWDRVGTAP

SEQ ID NO: 1288081 - protein, 25 aa, Mycobacterium
PLRYRLIDIPFRFHHPMWLENCDVD

SEQ ID NO: 1288082 - protein, 17 aa, Mycobacterium
PLSPGWRTEYPRFLAEL

SEQ ID NO: 1288083 - protein, 18 aa, Mycobacterium
PLSRGFERFYGFMGGETD

SEQ ID NO: 1288084 - protein, 18 aa, Mycobacterium
PLTRLRVDGGLTRSTVLM

SEQ ID NO: 1288085 - protein, 17 aa, Mycobacterium
PLWKAPGAMVFPHDSHA

SEQ ID NO: 1288086 - protein, 24 aa, Mycobacterium
PLYNFLLTVLFEWGVALHDTDVEA

SEQ ID NO: 1288087 - protein, 26 aa, Mycobacterium
PMWDLSWRTPALLAERGFLYDSSLMD

SEQ ID NO: 1288088 - protein, 17 aa, Mycobacterium
PNFWAWLIGEIKNEDPD

SEQ ID NO: 1288089 - protein, 20 aa, Mycobacterium
PNGHLCLWTWAANPEDRPLW

SEQ ID NO: 1288090 - protein, 20 aa, Mycobacterium
PNHYLAVAIDYLFTHRPDWP

SEQ ID NO: 1288091 - protein, 21 aa, Mycobacterium
PNKNIRLVIEWLDRYAEALPL

SEQ ID NO: 1288092 - protein, 18 aa, Mycobacterium
PNNLLAMLWTWQNGNVGA

SEQ ID NO: 1288093 - protein, 18 aa, Mycobacterium
PNSFFFAAPLEWQERLWP

SEQ ID NO: 1288094 - protein, 17 aa, Mycobacterium
PPAEIALAWSRDRARAM

SEQ ID NO: 1288095 - protein, 18 aa, Mycobacterium
PPLPGALLIAGEGRVVEP

SEQ ID NO: 1288096 - protein, 18 aa, Mycobacterium
PPPAGWRLLDTAVEQAQI

SEQ ID NO: 1288097 - protein, 17 aa, Mycobacterium
PPPRVFGPLSIDVAARE

SEQ ID NO: 1288098 - protein, 18 aa, Mycobacterium
PPRSDWAVHIALWQRTGG

SEQ ID NO: 1288099 - protein, 17 aa, Mycobacterium
PQQRLLLEVAWEALEHA

SEQ ID NO: 1288100 - protein, 23 aa, Mycobacterium
PQQRVALRLAWRALENSGINPDD

SEQ ID NO: 1288101 - protein, 20 aa, Mycobacterium
PRARGVVVGLTLRHGRGHLF

SEQ ID NO: 1288102 - protein, 19 aa, Mycobacterium
PRFLMCTPLSHAGAAFFTP

SEQ ID NO: 1288103 - protein, 18 aa, Mycobacterium
PRGMAYLVVTGRRGGSAM

SEQ ID NO: 1288104 - protein, 17 aa, Mycobacterium
PRHAWFPIDRSMVLYYC

SEQ ID NO: 1288105 - protein, 17 aa, Mycobacterium
PRIGCTLPEVFDHARPG

SEQ ID NO: 1288106 - protein, 17 aa, Mycobacterium
PRKGLFLIHTDAVDSVL

SEQ ID NO: 1288107 - protein, 19 aa, Mycobacterium
PRKVFAHGWLLNRGEKMSK

SEQ ID NO: 1288108 - protein, 22 aa, Mycobacterium
PRLRECTRLVLAIEGRSIGEAF

SEQ ID NO: 1288109 - protein, 24 aa, Mycobacterium
PRLSLLRLGARLGFTMIALDRPGY

SEQ ID NO: 1288110 - protein, 17 aa, Mycobacterium
PRPAFSTATFAAGVEKV

SEQ ID NO: 1288111 - protein, 19 aa, Mycobacterium
PRRYAGWSSCFRREAGSYG

SEQ ID NO: 1288112 - protein, 19 aa, Mycobacterium
PRSVVPIAWDTIRTLAEHP

SEQ ID NO: 1288113 - protein, 21 aa, Mycobacterium
PRWLPPGRWWALIRVAAAGRL

SEQ ID NO: 1288114 - protein, 17 aa, Mycobacterium
PRYVALVQDCLAMTDPA

SEQ ID NO: 1288115 - protein, 19 aa, Mycobacterium
PSGGLACFGEAIPAQAIAQ

SEQ ID NO: 1288116 - protein, 18 aa, Mycobacterium
PSSIWYRIRINLRHVPEE

SEQ ID NO: 1288117 - protein, 18 aa, Mycobacterium
PTAQRILAHFGLDGFFEV

SEQ ID NO: 1288118 - protein, 21 aa, Mycobacterium
PTFTGRSWPLADVRLLAPILA

SEQ ID NO: 1288119 - protein, 27 aa, Mycobacterium
PTKGVWTSGFGYRWGVLHGGIDIAGPI

SEQ ID NO: 1288120 - protein, 19 aa, Mycobacterium
PTLMGRLLLEAGVTPWITL

SEQ ID NO: 1288121 - protein, 20 aa, Mycobacterium
PTRPEVLFVWQVAVTSAARG

SEQ ID NO: 1288122 - protein, 18 aa, Mycobacterium
PTRRLCNLASVTSFYFHG

SEQ ID NO: 1288123 - protein, 20 aa, Mycobacterium
PTSVPAFRPGAQFKAIVSGA

SEQ ID NO: 1288124 - protein, 17 aa, Mycobacterium
PTVRELAGQMGLAVNTV

SEQ ID NO: 1288125 - protein, 24 aa, Mycobacterium
PTWSGSLKSLWLGDGEAIGDVLVG

SEQ ID NO: 1288126 - protein, 19 aa, Mycobacterium
PVGACATAAVSVEEGVDKI

SEQ ID NO: 1288127 - protein, 19 aa, Mycobacterium
PVHSIRLAGLVAHQEVLFG

SEQ ID NO: 1288128 - protein, 23 aa, Mycobacterium
PVIGSKELIAWLPTLLGAGSDDL

SEQ ID NO: 1288129 - protein, 19 aa, Mycobacterium
PVIRLKLGPKWMIPEIVVV

SEQ ID NO: 1288130 - protein, 22 aa, Mycobacterium
PVLPLRFGAVMTDAESVAEELL

SEQ ID NO: 1288131 - protein, 22 aa, Mycobacterium
PVPELRSGGLGVRDLKRLVKAT

SEQ ID NO: 1288132 - protein, 18 aa, Mycobacterium
PVPMAYYSFGGWKNSLFG

SEQ ID NO: 1288133 - protein, 21 aa, Mycobacterium
PVSEWPDLLILLGDQVYADEL

SEQ ID NO: 1288134 - protein, 20 aa, Mycobacterium
PVSVDTFAGFLFLNPDPDAE

SEQ ID NO: 1288135 - protein, 19 aa, Mycobacterium
PWLRRNRIQQEWGISDEVM

SEQ ID NO: 1288136 - protein, 23 aa, Mycobacterium
PYENEWGWTWPMNRRVLYNRASA

SEQ ID NO: 1288137 - protein, 17 aa, Mycobacterium
QAACARHRVEWFWVKGH

SEQ ID NO: 1288138 - protein, 20 aa, Mycobacterium
QAARFFYRYELPKVGPQLDL

SEQ ID NO: 1288139 - protein, 23 aa, Mycobacterium
QAARPVLFSTFLMWVLADLFTTL

SEQ ID NO: 1288140 - protein, 24 aa, Mycobacterium
QAVRIIRMFVEFWDRTRLAEQEAI

SEQ ID NO: 1288141 - protein, 23 aa, Mycobacterium
QCAPFCAVQAWPALARQRLSATA

SEQ ID NO: 1288142 - protein, 18 aa, Mycobacterium
QCGSCFNGTAAMAAVAVA

SEQ ID NO: 1288143 - protein, 20 aa, Mycobacterium
QCPCGGLIRPNVVWFGEALP

SEQ ID NO: 1288144 - protein, 22 aa, Mycobacterium
QCTRLAQRSALAVSRIGGSGEQ

SEQ ID NO: 1288145 - protein, 18 aa, Mycobacterium
QDARLVAVTVAWLSGELP

SEQ ID NO: 1288146 - protein, 19 aa, Mycobacterium
QEGGRFACGGGRPADRDTG

SEQ ID NO: 1288147 - protein, 17 aa, Mycobacterium
QELRRCYSMSSAPVEEE

SEQ ID NO: 1288148 - protein, 23 aa, Mycobacterium
QEVRWCPGCGDYVILNTIRNFLP

SEQ ID NO: 1288149 - protein, 17 aa, Mycobacterium
QFTCKYHGWRYGLDGAL

SEQ ID NO: 1288150 - protein, 21 aa, Mycobacterium
QGCALTSRLLVPARHKDEIVE

SEQ ID NO: 1288151 - protein, 24 aa, Mycobacterium
QGKLLASRLLHWARSGHLTVPRST

SEQ ID NO: 1288152 - protein, 21 aa, Mycobacterium
QGLKISVPEEVAWRVGFIDDE

SEQ ID NO: 1288153 - protein, 30 aa, Mycobacterium
QGRCISGGLMLCWPCDLILAADDALFSDPV

SEQ ID NO: 1288154 - protein, 25 aa, Mycobacterium
QGVLCGSLLSGLRMQPGHWSGAYIC

SEQ ID NO: 1288155 - protein, 20 aa, Mycobacterium
QGWFCCWNGANQLHVSTGVI

SEQ ID NO: 1288156 - protein, 18 aa, Mycobacterium
QKGFCAVAAEADWPDAYR

SEQ ID NO: 1288157 - protein, 20 aa, Mycobacterium
QLAEGIALLSKVDWRARGLA

SEQ ID NO: 1288158 - protein, 24 aa, Mycobacterium
QLARARTGVFWVREMLPIGKIREI

SEQ ID NO: 1288159 - protein, 24 aa, Mycobacterium
QLQWFADPDMMAWVDGARLNILHH

SEQ ID NO: 1288160 - protein, 17 aa, Mycobacterium
QLREWKAEYPGAVVVSY

SEQ ID NO: 1288161 - protein, 18 aa, Mycobacterium
QLRGELLRLIGLVETLIR

SEQ ID NO: 1288162 - protein, 18 aa, Mycobacterium
QLTPHFRPGCKRMLMTSD

SEQ ID NO: 1288163 - protein, 21 aa, Mycobacterium
QLWMCGLPGYGPGDLIDFEFS

SEQ ID NO: 1288164 - protein, 20 aa, Mycobacterium
QMSECYRVSLTYADAATAGP

SEQ ID NO: 1288165 - protein, 17 aa, Mycobacterium
QPLRPAILYGIDTRATA

SEQ ID NO: 1288166 - protein, 20 aa, Mycobacterium
QQMLDWWGPVIYEYYGGTEA

SEQ ID NO: 1288167 - protein, 23 aa, Mycobacterium
QRAGKWPQIWRIAGEYSNFSVFD

SEQ ID NO: 1288168 - protein, 18 aa, Mycobacterium
QRALRPGGVFLMVDIKAS

SEQ ID NO: 1288169 - protein, 19 aa, Mycobacterium
QRASNFLLWQSAYAEYVFQ

SEQ ID NO: 1288170 - protein, 19 aa, Mycobacterium
QRCGATWGVGLTGVAGPEP

SEQ ID NO: 1288171 - protein, 18 aa, Mycobacterium
QRIFARLGVHYVIVSAVS

SEQ ID NO: 1288172 - protein, 20 aa, Mycobacterium
QRLGIRCFGFIPLRLPPELD

SEQ ID NO: 1288173 - protein, 17 aa, Mycobacterium
QRLPFLPIRAGLGSDVR

SEQ ID NO: 1288174 - protein, 17 aa, Mycobacterium
QRPNPFPTMSIRDNVVA

SEQ ID NO: 1288175 - protein, 18 aa, Mycobacterium
QRWGYKFRFGVFRIDDHD

SEQ ID NO: 1288176 - protein, 18 aa, Mycobacterium
QRYWGEPFPIVYDSDGRP

SEQ ID NO: 1288177 - protein, 28 aa, Mycobacterium
QSFEWPRLEGAFNWATDWFDVIARDPIT

SEQ ID NO: 1288178 - protein, 26 aa, Mycobacterium
QSGGKRLRPRFAYWAWRVGAPADAAP

SEQ ID NO: 1288179 - protein, 22 aa, Mycobacterium
QSLRARFGTLTGVDRPAKDGDF

SEQ ID NO: 1288180 - protein, 17 aa, Mycobacterium
QSNFVWLPLAERTLDFV

SEQ ID NO: 1288181 - protein, 18 aa, Mycobacterium
QSQVVAWWAPSWDEPNGG

SEQ ID NO: 1288182 - protein, 18 aa, Mycobacterium
QTARARAVLAGRGHVLPE

SEQ ID NO: 1288183 - protein, 20 aa, Mycobacterium
QTEVRPILLWHAFEESEHKA

SEQ ID NO: 1288184 - protein, 25 aa, Mycobacterium
QTVFGGSVGEMFGRKVSRLMEWVAM

SEQ ID NO: 1288185 - protein, 27 aa, Mycobacterium
QVSGRGKYRLGFAIARLARASSGHLDL

SEQ ID NO: 1288186 - protein, 19 aa, Mycobacterium
QWLPGPRELRAWTLASGTR

SEQ ID NO: 1288187 - protein, 23 aa, Mycobacterium
QWVTECLRAAYPLGHGHGPVSAL

SEQ ID NO: 1288188 - protein, 17 aa, Mycobacterium
QYSQWGALLARTDPNAP

SEQ ID NO: 1288189 - protein, 19 aa, Mycobacterium
RAAADLGWHGLAVAEQFGG

SEQ ID NO: 1288190 - protein, 20 aa, Mycobacterium
RAAASFDLLHVFALLQDDVM

SEQ ID NO: 1288191 - protein, 21 aa, Mycobacterium
RAAGLKAANTWHASRAIQESR

SEQ ID NO: 1288192 - protein, 17 aa, Mycobacterium
RAALVIMPRFDLTEFLA

SEQ ID NO: 1288193 - protein, 19 aa, Mycobacterium
RAAMRAELKQLGAMSNTTT

SEQ ID NO: 1288194 - protein, 20 aa, Mycobacterium
RAAWYRNRWVRTESFEQHFP

SEQ ID NO: 1288195 - protein, 21 aa, Mycobacterium
RADELHLGFNFRLVRADFDAD

SEQ ID NO: 1288196 - protein, 22 aa, Mycobacterium
RAEGRYALMPGIIAALRDSGTP

SEQ ID NO: 1288197 - protein, 19 aa, Mycobacterium
RAESKWFASQGFSLVNMTG

SEQ ID NO: 1288198 - protein, 22 aa, Mycobacterium
RAEVLRPGLLVMAVRGAARYFG

SEQ ID NO: 1288199 - protein, 18 aa, Mycobacterium
RAEVVAVSGGVTWVDDSK

SEQ ID NO: 1288200 - protein, 19 aa, Mycobacterium
RAGLPRGVAVAGGYLDGIG

SEQ ID NO: 1288201 - protein, 19 aa, Mycobacterium
RALAGFGGLGVRLSSKDTM

SEQ ID NO: 1288202 - protein, 20 aa, Mycobacterium
RALDDFAVWCALAEKYGNDW

SEQ ID NO: 1288203 - protein, 18 aa, Mycobacterium
RALIAVRGLHRFATAEGL

SEQ ID NO: 1288204 - protein, 19 aa, Mycobacterium
RALPIGWAVADDGLRRTVT

SEQ ID NO: 1288205 - protein, 19 aa, Mycobacterium
RALRFPAALGRPLLTDLAR

SEQ ID NO: 1288206 - protein, 17 aa, Mycobacterium
RANLKWTPQPAMPGQLR

SEQ ID NO: 1288207 - protein, 19 aa, Mycobacterium
RAPLAVPIWYGYQPGGEVL

SEQ ID NO: 1288208 - protein, 20 aa, Mycobacterium
RAQGLSNIWCRVMNGQDLDL

SEQ ID NO: 1288209 - protein, 20 aa, Mycobacterium
RAQVALPWSMINAFCDLAQT

SEQ ID NO: 1288210 - protein, 21 aa, Mycobacterium
RARCFPKGLAAFIDLRDQTCR

SEQ ID NO: 1288211 - protein, 21 aa, Mycobacterium
RARPLWECWVIEGLSRHRWAV

SEQ ID NO: 1288212 - protein, 18 aa, Mycobacterium
RARQAWIAATRDIATEML

SEQ ID NO: 1288213 - protein, 17 aa, Mycobacterium
RARSDWAPEFAIHDLSS

SEQ ID NO: 1288214 - protein, 26 aa, Mycobacterium
RAVFTRYELVDGFPRFDVDDVFLGNG

SEQ ID NO: 1288215 - protein, 23 aa, Mycobacterium
RAVILGTGGFEWDRALVEAFLRG

SEQ ID NO: 1288216 - protein, 21 aa, Mycobacterium
RAVNVPARLVSVYAPGCSPMD

SEQ ID NO: 1288217 - protein, 18 aa, Mycobacterium
RAYRLDWPSGTTVYEIDQ

SEQ ID NO: 1288218 - protein, 20 aa, Mycobacterium
RAYRLPWPDGTVVYELDQPR

SEQ ID NO: 1288219 - protein, 24 aa, Mycobacterium
RCAVGVPTPDGWRMLSGDETGWLL

SEQ ID NO: 1288220 - protein, 18 aa, Mycobacterium
RCERDVWLVAAGTLGPIR

SEQ ID NO: 1288221 - protein, 17 aa, Mycobacterium
RCGLCPLGTCTWRSLGY

SEQ ID NO: 1288222 - protein, 19 aa, Mycobacterium
RCLTFPKPVIMAATGPAIA

SEQ ID NO: 1288223 - protein, 20 aa, Mycobacterium
RCMDCGIPFCHSGSAGCPLG

SEQ ID NO: 1288224 - protein, 21 aa, Mycobacterium
RCVSVRWGLWRSDSGEGIVGA

SEQ ID NO: 1288225 - protein, 19 aa, Mycobacterium
RDAEGWIYLAGRTGDWMRV

SEQ ID NO: 1288226 - protein, 17 aa, Mycobacterium
RDFPVHWPVSTRWTDND

SEQ ID NO: 1288227 - protein, 18 aa, Mycobacterium
RDGLAYVLRSDRRYGGSI

SEQ ID NO: 1288228 - protein, 20 aa, Mycobacterium
RDGLRVIGIRSRLMSRLAGQ

SEQ ID NO: 1288229 - protein, 23 aa, Mycobacterium
RDGQPRWTPIIAHLSDGQRVVAR

SEQ ID NO: 1288230 - protein, 17 aa, Mycobacterium
RDGVKFCEVCGNVSDAD

SEQ ID NO: 1288231 - protein, 20 aa, Mycobacterium
RDLDFLLFEWLRVDELTQRP

SEQ ID NO: 1288232 - protein, 25 aa, Mycobacterium
RDLGGKMVRFVVCRKGDRHVVAARD

SEQ ID NO: 1288233 - protein, 17 aa, Mycobacterium
RDLLKFDFYFADSAAFR

SEQ ID NO: 1288234 - protein, 17 aa, Mycobacterium
RDLSGWGRQWLKTTGLN

SEQ ID NO: 1288235 - protein, 19 aa, Mycobacterium
RDLSPLGIRVCTIAPGTIN

SEQ ID NO: 1288236 - protein, 17 aa, Mycobacterium
RDLSREFIRVCTIAPGL

SEQ ID NO: 1288237 - protein, 24 aa, Mycobacterium
RDMVLFIGHPIRWADWGNLEHSVR

SEQ ID NO: 1288238 - protein, 19 aa, Mycobacterium
RDRAFFCAYAMEYLARAGL

SEQ ID NO: 1288239 - protein, 19 aa, Mycobacterium
RDREGCWWHESLSGTTAPA

SEQ ID NO: 1288240 - protein, 17 aa, Mycobacterium
RDVFAIKLDPGLIDELP

SEQ ID NO: 1288241 - protein, 18 aa, Mycobacterium
REALKDLLVMLGAGPAVV

SEQ ID NO: 1288242 - protein, 20 aa, Mycobacterium
REARQMRPLYVMPTKGVWTS

SEQ ID NO: 1288243 - protein, 19 aa, Mycobacterium
REFCARTGIFILAESLGGV

SEQ ID NO: 1288244 - protein, 18 aa, Mycobacterium
REGLLEIGQKLGIPPLAT

SEQ ID NO: 1288245 - protein, 18 aa, Mycobacterium
REGSCDRCAVDLYDVRRP

SEQ ID NO: 1288246 - protein, 18 aa, Mycobacterium
REHFGFGFVMYVNGYCAQ

SEQ ID NO: 1288247 - protein, 21 aa, Mycobacterium
REIVERLGLRDPLMVVGNFDR

SEQ ID NO: 1288248 - protein, 22 aa, Mycobacterium
REIWSGKATFVFTRTTSGEIGI

SEQ ID NO: 1288249 - protein, 20 aa, Mycobacterium
RELCARFGVSPIEFDGRSDA

SEQ ID NO: 1288250 - protein, 18 aa, Mycobacterium
RENLGWSAPRLHLVDLQY

SEQ ID NO: 1288251 - protein, 17 aa, Mycobacterium
RENPAWITGFEHRIETP

SEQ ID NO: 1288252 - protein, 21 aa, Mycobacterium
REPRGVLEIAYRCPNGEPGVV

SEQ ID NO: 1288253 - protein, 18 aa, Mycobacterium
RERMAGFKVPRYVEFLDE

SEQ ID NO: 1288254 - protein, 21 aa, Mycobacterium
RETFRAIGVDLMFDHIKISLH

SEQ ID NO: 1288255 - protein, 20 aa, Mycobacterium
REVAELLLLGMPYRDIGAQL

SEQ ID NO: 1288256 - protein, 19 aa, Mycobacterium
REVFARDGILLAVSQYAQP

SEQ ID NO: 1288257 - protein, 17 aa, Mycobacterium
RFGWPKRNGFVQPMVDA

SEQ ID NO: 1288258 - protein, 21 aa, Mycobacterium
RFIRDTTWVSVRWYQPGGPLT

SEQ ID NO: 1288259 - protein, 19 aa, Mycobacterium
RFLSSEGWIAWSGPAISEL

SEQ ID NO: 1288260 - protein, 25 aa, Mycobacterium
RFNELVLRAGLSWQQVMVLRAYAKY

SEQ ID NO: 1288261 - protein, 18 aa, Mycobacterium
RFPYRNDGALGWVGTSPV

SEQ ID NO: 1288262 - protein, 20 aa, Mycobacterium
RFSSAILPAWARKSPQISEV

SEQ ID NO: 1288263 - protein, 18 aa, Mycobacterium
RGAAFPWRTIRGEECSAY

SEQ ID NO: 1288264 - protein, 21 aa, Mycobacterium
RGAAPDRGWEIHRLPVDAGDE

SEQ ID NO: 1288265 - protein, 18 aa, Mycobacterium
RGALPFRVVASYSVRSAP

SEQ ID NO: 1288266 - protein, 17 aa, Mycobacterium
RGAWYLRQMLGSANFHA

SEQ ID NO: 1288267 - protein, 20 aa, Mycobacterium
RGCLGRPWLFAELSAKFTGR

SEQ ID NO: 1288268 - protein, 23 aa, Mycobacterium
RGCTHPGCTVPFYWAEAHHTDDY

SEQ ID NO: 1288269 - protein, 23 aa, Mycobacterium
RGCTHPGCTVPFYWTEAHHTHDY

SEQ ID NO: 1288270 - protein, 20 aa, Mycobacterium
RGDIKIALFGNHAPKTVSNF

SEQ ID NO: 1288271 - protein, 18 aa, Mycobacterium
RGEVSVPILKLVAAQGEG

SEQ ID NO: 1288272 - protein, 18 aa, Mycobacterium
RGGFPGMLLGSVSSEVVQ

SEQ ID NO: 1288273 - protein, 20 aa, Mycobacterium
RGGKISFTHLIGYAIVAAVK

SEQ ID NO: 1288274 - protein, 18 aa, Mycobacterium
RGGLRWSDRREDFRTEVL

SEQ ID NO: 1288275 - protein, 19 aa, Mycobacterium
RGKLLPRDRVDGLLDAGSP

SEQ ID NO: 1288276 - protein, 18 aa, Mycobacterium
RGMLRLAVISAKVIAGQR

SEQ ID NO: 1288277 - protein, 23 aa, Mycobacterium
RGPARLQIHLSWAASDDEAMAIA

SEQ ID NO: 1288278 - protein, 18 aa, Mycobacterium
RGPMLHRALQQFLADVFW

SEQ ID NO: 1288279 - protein, 18 aa, Mycobacterium
RGRFRWWGLYTQRKPGFD

SEQ ID NO: 1288280 - protein, 18 aa, Mycobacterium
RGRLGLLELRGFEMPPHF

SEQ ID NO: 1288281 - protein, 18 aa, Mycobacterium
RGRTVWFTGLSGSGKSSV

SEQ ID NO: 1288282 - protein, 19 aa, Mycobacterium
RGSAGLVPFSHRLAAEEWR

SEQ ID NO: 1288283 - protein, 20 aa, Mycobacterium
RHDLPFTLTYLFGDDGDAVL

SEQ ID NO: 1288284 - protein, 19 aa, Mycobacterium
RHLFRLAGLAPRLDVAKTP

SEQ ID NO: 1288285 - protein, 19 aa, Mycobacterium
RHLLAQFLFRGDRIHLPVS

SEQ ID NO: 1288286 - protein, 23 aa, Mycobacterium
RHLRCWHPGFGMVLSGDAARPYL

SEQ ID NO: 1288287 - protein, 18 aa, Mycobacterium
RHPLGWKTVGDIGYLDEE

SEQ ID NO: 1288288 - protein, 25 aa, Mycobacterium
RHPRLTRAFLRFNVHLLFRSTLPAR

SEQ ID NO: 1288289 - protein, 19 aa, Mycobacterium
RHWDHRWALAVLNTALGGG

SEQ ID NO: 1288290 - protein, 20 aa, Mycobacterium
RIAILEARFAGFGASGRNGG

SEQ ID NO: 1288291 - protein, 20 aa, Mycobacterium
RIALWALGWLARVQFLTGDW

SEQ ID NO: 1288292 - protein, 21 aa, Mycobacterium
RIERFLQLWAEGSMTIALPST

SEQ ID NO: 1288293 - protein, 17 aa, Mycobacterium
RIFRGCGYFDPDKPIRK

SEQ ID NO: 1288294 - protein, 20 aa, Mycobacterium
RIGSCALDLCMVAAGQLDAY

SEQ ID NO: 1288295 - protein, 21 aa, Mycobacterium
RIKELFKTSGGKYVAPPAIEG

SEQ ID NO: 1288296 - protein, 20 aa, Mycobacterium
RINFRIALWAAHNMGMSDGA

SEQ ID NO: 1288297 - protein, 19 aa, Mycobacterium
RINVMPGFTGGGFYWHSDF

SEQ ID NO: 1288298 - protein, 17 aa, Mycobacterium
RIPDLRLATSLDEIEFK

SEQ ID NO: 1288299 - protein, 25 aa, Mycobacterium
RIREVALMRAVLWRRCDYLWDHHVV

SEQ ID NO: 1288300 - protein, 17 aa, Mycobacterium
RIRGHAVEARLCAEDPA

SEQ ID NO: 1288301 - protein, 17 aa, Mycobacterium
RIRVNAIAPGSILTSAL

SEQ ID NO: 1288302 - protein, 20 aa, Mycobacterium
RITLCCLHFGGEVRELTAHW

SEQ ID NO: 1288303 - protein, 18 aa, Mycobacterium
RIVDLRWLAPLPVEDMLR

SEQ ID NO: 1288304 - protein, 21 aa, Mycobacterium
RKAVFKRAWLNVGRVEQLPRK

SEQ ID NO: 1288305 - protein, 18 aa, Mycobacterium
RKLFPGLYRLAAAGRLPE

SEQ ID NO: 1288306 - protein, 23 aa, Mycobacterium
RKLREIRAALAMDAALPKAEILA

SEQ ID NO: 1288307 - protein, 20 aa, Mycobacterium
RKLVGGTCVNYGCIPTKTLV

SEQ ID NO: 1288308 - protein, 22 aa, Mycobacterium
RKPARVPVWFMRQAGRSLPEYR

SEQ ID NO: 1288309 - protein, 17 aa, Mycobacterium
RKPLRLPYFPPLEATAV

SEQ ID NO: 1288310 - protein, 22 aa, Mycobacterium
RKRPLPEWSERFATLAGPWAPV

SEQ ID NO: 1288311 - protein, 18 aa, Mycobacterium
RKRWFPGLADGTLLTAIA

SEQ ID NO: 1288312 - protein, 19 aa, Mycobacterium
RKSEPVHWVDVPGGTGGFG

SEQ ID NO: 1288313 - protein, 17 aa, Mycobacterium
RLAEDWDSVGLVCGDPD

SEQ ID NO: 1288314 - protein, 23 aa, Mycobacterium
RLALGVGPSHHWIVRDMLGLPYE

SEQ ID NO: 1288315 - protein, 19 aa, Mycobacterium
RLALPNARILIHQPALSGV

SEQ ID NO: 1288316 - protein, 21 aa, Mycobacterium
RLAPGLKRSSLIGGIRYFDTV

SEQ ID NO: 1288317 - protein, 17 aa, Mycobacterium
RLCEPERQILFRVPWVD

SEQ ID NO: 1288318 - protein, 24 aa, Mycobacterium
RLDDARLAFYKTLYRDNARYDAKL

SEQ ID NO: 1288319 - protein, 18 aa, Mycobacterium
RLECLEVTLSEKSRTYPL

SEQ ID NO: 1288320 - protein, 18 aa, Mycobacterium
RLEKLWLPGVDRLLDCVQ

SEQ ID NO: 1288321 - protein, 18 aa, Mycobacterium
RLELRLMLTKVLDRLPDL

SEQ ID NO: 1288322 - protein, 24 aa, Mycobacterium
RLGRRSNIHVVEWAHVQGLTPSGL

SEQ ID NO: 1288323 - protein, 17 aa, Mycobacterium
RLGRWCVPGPVVESVAV

SEQ ID NO: 1288324 - protein, 19 aa, Mycobacterium
RLHERGAELLRCPVSEIMT

SEQ ID NO: 1288325 - protein, 24 aa, Mycobacterium
RLHPEVIAALGIREWDAVSLTGAR

SEQ ID NO: 1288326 - protein, 18 aa, Mycobacterium
RLHWYVPNSIRWLDRLKA

SEQ ID NO: 1288327 - protein, 20 aa, Mycobacterium
RLKSGWLNGIKHWQVDYTGA

SEQ ID NO: 1288328 - protein, 20 aa, Mycobacterium
RLLAEVLRLRGWQVDFLGAQ

SEQ ID NO: 1288329 - protein, 20 aa, Mycobacterium
RLLLEVAWEALEHAGIPAAS

SEQ ID NO: 1288330 - protein, 20 aa, Mycobacterium
RLLMEVSWEALEHAGIPAQN

SEQ ID NO: 1288331 - protein, 19 aa, Mycobacterium
RLLPFRLRFDGGEEVRTDL

SEQ ID NO: 1288332 - protein, 20 aa, Mycobacterium
RLPDALTRFPIARLVSSPQR

SEQ ID NO: 1288333 - protein, 21 aa, Mycobacterium
RLPDLRCLMLTSFTSDEAMID

SEQ ID NO: 1288334 - protein, 23 aa, Mycobacterium
RLPRIPVPFPMYLPGPNRVQIVN

SEQ ID NO: 1288335 - protein, 18 aa, Mycobacterium
RLRLELEQGLGWKADVEA

SEQ ID NO: 1288336 - protein, 18 aa, Mycobacterium
RLRYPRPALVLSLHAAAL

SEQ ID NO: 1288337 - protein, 23 aa, Mycobacterium
RLSKFEVLTAMAFAAFADAPVDV

SEQ ID NO: 1288338 - protein, 20 aa, Mycobacterium
RLTGFKRPRHVLFVDALPLT

SEQ ID NO: 1288339 - protein, 18 aa, Mycobacterium
RLTPGASADLVWLSADPR

SEQ ID NO: 1288340 - protein, 20 aa, Mycobacterium
RLVDWPEWLPPDWFDDRRVE

SEQ ID NO: 1288341 - protein, 20 aa, Mycobacterium
RMAGEFNAPIALEPLPYTVA

SEQ ID NO: 1288342 - protein, 17 aa, Mycobacterium
RMFDLLVRMGYKEIEVG

SEQ ID NO: 1288343 - protein, 28 aa, Mycobacterium
RMIPAPLRWSSRHLLQFLTVGFLAPIFR

SEQ ID NO: 1288344 - protein, 23 aa, Mycobacterium
RNAGIRLGWRSSWVETVLGECLA

SEQ ID NO: 1288345 - protein, 17 aa, Mycobacterium
RPAFPVMCDAGYGRIVL

SEQ ID NO: 1288346 - protein, 21 aa, Mycobacterium
RPAIWDEFTNRFGIDRVCEFY

SEQ ID NO: 1288347 - protein, 18 aa, Mycobacterium
RPAWDLDRWVRDFFGPAA

SEQ ID NO: 1288348 - protein, 18 aa, Mycobacterium
RPDIDWDKGTTLRWIRDR

SEQ ID NO: 1288349 - protein, 17 aa, Mycobacterium
RPDLAILDVRMPPTFTD

SEQ ID NO: 1288350 - protein, 24 aa, Mycobacterium
RPDPFCAMESCWLQHMESAHRDVV

SEQ ID NO: 1288351 - protein, 20 aa, Mycobacterium
RPEHRRLVICDLGMPRDVEP

SEQ ID NO: 1288352 - protein, 21 aa, Mycobacterium
RPETEALFEWVVRQALPDEPL

SEQ ID NO: 1288353 - protein, 19 aa, Mycobacterium
RPLHRPLRALPYVADDLDA

SEQ ID NO: 1288354 - protein, 19 aa, Mycobacterium
RPQGSWSRERAVLAVVDGP

SEQ ID NO: 1288355 - protein, 20 aa, Mycobacterium
RPQMGIAAWLIPSIVAFGTD

SEQ ID NO: 1288356 - protein, 20 aa, Mycobacterium
RPRGEGQWALGYREPLNANE

SEQ ID NO: 1288357 - protein, 20 aa, Mycobacterium
RPRISALIEVDRVHGWGAQK

SEQ ID NO: 1288358 - protein, 18 aa, Mycobacterium
RPRRAGVSSFGFTGTNAH

SEQ ID NO: 1288359 - protein, 22 aa, Mycobacterium
RPRSSADLPDWARRWQRLLFDN

SEQ ID NO: 1288360 - protein, 21 aa, Mycobacterium
RPSKVAFLAWHAWRDADSGNW

SEQ ID NO: 1288361 - protein, 40 aa, Mycobacterium
RPTPNPIARFFKFLSDLFWRVVHFFEDLVSRFVDVLFGGG

SEQ ID NO: 1288362 - protein, 23 aa, Mycobacterium
RPVPRVSIFLSIFDAHVQRIPIS

SEQ ID NO: 1288363 - protein, 18 aa, Mycobacterium
RPYPRAVPSPGWSLRIDP

SEQ ID NO: 1288364 - protein, 19 aa, Mycobacterium
RQELPLIEEWFEFVGEKLP

SEQ ID NO: 1288365 - protein, 22 aa, Mycobacterium
RQFSRPRVVVFAGDHGVAGAGV

SEQ ID NO: 1288366 - protein, 19 aa, Mycobacterium
RQFTCKYHAWRYALNGDLT

SEQ ID NO: 1288367 - protein, 17 aa, Mycobacterium
RQWHGMFEWMGRPEEFA

SEQ ID NO: 1288368 - protein, 19 aa, Mycobacterium
RRAKLYYLRELRGKKAKIK

SEQ ID NO: 1288369 - protein, 19 aa, Mycobacterium
RRALAEFKVEGLATVIPFH

SEQ ID NO: 1288370 - protein, 17 aa, Mycobacterium
RRAMGLVLGDWVRTGDC

SEQ ID NO: 1288371 - protein, 19 aa, Mycobacterium
RRDHRVCWLDGGSPDNVDR

SEQ ID NO: 1288372 - protein, 19 aa, Mycobacterium
RRDVWTWADERAAMPIDPE

SEQ ID NO: 1288373 - protein, 25 aa, Mycobacterium
RREMAYEGKVDWAFAELLALGTMIS

SEQ ID NO: 1288374 - protein, 22 aa, Mycobacterium
RRFGEQRLRPHVGEWFEAGEVP

SEQ ID NO: 1288375 - protein, 20 aa, Mycobacterium
RRGQRISGVLAYVAVCDVLR

SEQ ID NO: 1288376 - protein, 24 aa, Mycobacterium
RRGSLPPGRLGWRKAQELRDQAAA

SEQ ID NO: 1288377 - protein, 19 aa, Mycobacterium
RRGVDCFVVDPLPDPPQYA

SEQ ID NO: 1288378 - protein, 17 aa, Mycobacterium
RRIDIACGLVVRPEVVF

SEQ ID NO: 1288379 - protein, 18 aa, Mycobacterium
RRIIPPWVTLGSRLAVIP

SEQ ID NO: 1288380 - protein, 18 aa, Mycobacterium
RRKIGYSIQQAGLFPHMT

SEQ ID NO: 1288381 - protein, 23 aa, Mycobacterium
RRLALDHLPRLAAALAVTTDELL

SEQ ID NO: 1288382 - protein, 20 aa, Mycobacterium
RRLGAEIERPLSFALIQVDA

SEQ ID NO: 1288383 - protein, 19 aa, Mycobacterium
RRLLRLCARYSADPGGPTV

SEQ ID NO: 1288384 - protein, 21 aa, Mycobacterium
RRPRCLLAFGQFEFVSRQWFR

SEQ ID NO: 1288385 - protein, 20 aa, Mycobacterium
RRRAHGYFPVPGLDPHPAVD

SEQ ID NO: 1288386 - protein, 17 aa, Mycobacterium
RRRFWPKTSSITVDGPA

SEQ ID NO: 1288387 - protein, 19 aa, Mycobacterium
RRRICADAVAFAREIGYSY

SEQ ID NO: 1288388 - protein, 21 aa, Mycobacterium
RRRRGRRGRGRGRGEQSDDNG

SEQ ID NO: 1288389 - protein, 17 aa, Mycobacterium
RRRVQAVLDAAGDICGA

SEQ ID NO: 1288390 - protein, 18 aa, Mycobacterium
RRRVRSFGEHLRVTVRAY

SEQ ID NO: 1288391 - protein, 19 aa, Mycobacterium
RRTFAVNIDSFFRVTKAAL

SEQ ID NO: 1288392 - protein, 28 aa, Mycobacterium
RRTPPAHGWRRWVYRLSFGRINPGQSPE

SEQ ID NO: 1288393 - protein, 24 aa, Mycobacterium
RRVSAAWQLPLEWLNVPVGGVALD

SEQ ID NO: 1288394 - protein, 19 aa, Mycobacterium
RRWPNVWALVVDAFLEDVS

SEQ ID NO: 1288395 - protein, 25 aa, Mycobacterium
RRWQRLLFDNGWLLPGHPPEFGGRN

SEQ ID NO: 1288396 - protein, 18 aa, Mycobacterium
RSEPYVVVLVRLDEGPQL

SEQ ID NO: 1288397 - protein, 23 aa, Mycobacterium
RSFKEAHLRLVLRSGRTDVEQIR

SEQ ID NO: 1288398 - protein, 19 aa, Mycobacterium
RSGDSGAMQMHWYSAMEVL

SEQ ID NO: 1288399 - protein, 20 aa, Mycobacterium
RSGLPFGTCLRATYLHPCGT

SEQ ID NO: 1288400 - protein, 19 aa, Mycobacterium
RSGVLRFVVLDGLAKPGRL

SEQ ID NO: 1288401 - protein, 24 aa, Mycobacterium
RSLGCTIKLLAICERLTTDDGQQR

SEQ ID NO: 1288402 - protein, 19 aa, Mycobacterium
RSQMALGFFTHLAGDAAVA

SEQ ID NO: 1288403 - protein, 18 aa, Mycobacterium
RSRFGFLAIHGGGLEQMT

SEQ ID NO: 1288404 - protein, 20 aa, Mycobacterium
RSSPRVGDGFIRLDGAGNVV

SEQ ID NO: 1288405 - protein, 20 aa, Mycobacterium
RSTEEVRFLMGFNREVVRRR

SEQ ID NO: 1288406 - protein, 17 aa, Mycobacterium
RSTFHWVLAFAYKGLST

SEQ ID NO: 1288407 - protein, 17 aa, Mycobacterium
RSVWWNWNTGFDGIRVD

SEQ ID NO: 1288408 - protein, 17 aa, Mycobacterium
RSWFRRDHRVCWLDGGS

SEQ ID NO: 1288409 - protein, 17 aa, Mycobacterium
RTAVLAWLFARSTGRRF

SEQ ID NO: 1288410 - protein, 20 aa, Mycobacterium
RTAWEMPFRSGAHMCTMVTS

SEQ ID NO: 1288411 - protein, 17 aa, Mycobacterium
RTERVVFDGCDFSGVDM

SEQ ID NO: 1288412 - protein, 17 aa, Mycobacterium
RTGLVAFSLHYPWSQGL

SEQ ID NO: 1288413 - protein, 20 aa, Mycobacterium
RTGRANPGMFSRINVDYYGA

SEQ ID NO: 1288414 - protein, 20 aa, Mycobacterium
RTKACPRLADSIKHAVAEGC

SEQ ID NO: 1288415 - protein, 24 aa, Mycobacterium
RTLREVPVGFKWFVDGLIGGTIGF

SEQ ID NO: 1288416 - protein, 22 aa, Mycobacterium
RTPRLTGTITMRYLRTTRLGRL

SEQ ID NO: 1288417 - protein, 21 aa, Mycobacterium
RTRLLEMRDFYAFLLDEMPAV

SEQ ID NO: 1288418 - protein, 21 aa, Mycobacterium
RTRRAGAVGLMITEPLNYSFS

SEQ ID NO: 1288419 - protein, 22 aa, Mycobacterium
RTSAVKTFTAWAVRRGLMASDP

SEQ ID NO: 1288420 - protein, 22 aa, Mycobacterium
RTTEGWLLIDFEGEPGQPLDER

SEQ ID NO: 1288421 - protein, 26 aa, Mycobacterium
RTTLNLKACIKAAADRVVFINTGFLD

SEQ ID NO: 1288422 - protein, 18 aa, Mycobacterium
RTVALWRKRFDDVHIYPV

SEQ ID NO: 1288423 - protein, 17 aa, Mycobacterium
RTVVLRLRFDDFSRVTR

SEQ ID NO: 1288424 - protein, 18 aa, Mycobacterium
RVAKVLPGHVEIVRELLF

SEQ ID NO: 1288425 - protein, 17 aa, Mycobacterium
RVDEMIEILKLVLAGGM

SEQ ID NO: 1288426 - protein, 26 aa, Mycobacterium
RVEAVWKPREEWGLGIDNISHFRPTG

SEQ ID NO: 1288427 - protein, 17 aa, Mycobacterium
RVEYKLRDWLFARQRYW

SEQ ID NO: 1288428 - protein, 17 aa, Mycobacterium
RVFRTCRDLGIATVAVY

SEQ ID NO: 1288429 - protein, 19 aa, Mycobacterium
RVFSGHVRLCLGYTEPEGG

SEQ ID NO: 1288430 - protein, 17 aa, Mycobacterium
RVIWAMQDRVMWENGPA

SEQ ID NO: 1288431 - protein, 20 aa, Mycobacterium
RVKARMGWDIPWFTITDDFD

SEQ ID NO: 1288432 - protein, 18 aa, Mycobacterium
RVKRPQMGIAAWLIPSIV

SEQ ID NO: 1288433 - protein, 20 aa, Mycobacterium
RVLGTFPYRDLYMLDAARQF

SEQ ID NO: 1288434 - protein, 19 aa, Mycobacterium
RVRRICTDRGVLLIADEIQ

SEQ ID NO: 1288435 - protein, 24 aa, Mycobacterium
RVSAALDFGCVWINTHIPLVAEMP

SEQ ID NO: 1288436 - protein, 20 aa, Mycobacterium
RVSPENSWDCVQFVCAANDL

SEQ ID NO: 1288437 - protein, 19 aa, Mycobacterium
RVSYFYDFRGPSMAIDTAC

SEQ ID NO: 1288438 - protein, 17 aa, Mycobacterium
RVTELLDRVGLRDRSGY

SEQ ID NO: 1288439 - protein, 18 aa, Mycobacterium
RVTLYGLPLVARRRVNYS

SEQ ID NO: 1288440 - protein, 18 aa, Mycobacterium
RWALDLLRKRFAKVIWVP

SEQ ID NO: 1288441 - protein, 21 aa, Mycobacterium
RWCPMRRWIDIGAFDDGAPTR

SEQ ID NO: 1288442 - protein, 17 aa, Mycobacterium
RWIFPYAGTDSHDTYAI

SEQ ID NO: 1288443 - protein, 25 aa, Mycobacterium
RWMHWASCFEFDFTFVHEGSTRQTA

SEQ ID NO: 1288444 - protein, 17 aa, Mycobacterium
RWPNGVGELEFFEKQLA

SEQ ID NO: 1288445 - protein, 17 aa, Mycobacterium
RWSLREFLGPMITALDD

SEQ ID NO: 1288446 - protein, 18 aa, Mycobacterium
RYDLAVQEIFVFTPKGDV

SEQ ID NO: 1288447 - protein, 17 aa, Mycobacterium
RYFWPRVVGDTSWQLLD

SEQ ID NO: 1288448 - protein, 24 aa, Mycobacterium
RYHGREFIELIAVGTTYDLAAAAA

SEQ ID NO: 1288449 - protein, 17 aa, Mycobacterium
RYLAIIFDGLRPEGAHP

SEQ ID NO: 1288450 - protein, 18 aa, Mycobacterium
RYLLVPGLRSSRVHVFDT

SEQ ID NO: 1288451 - protein, 17 aa, Mycobacterium
RYMGHAMVSTWQRGAPY

SEQ ID NO: 1288452 - protein, 21 aa, Mycobacterium
RYPLCDDRRTLLWLANQRAVE

SEQ ID NO: 1288453 - protein, 19 aa, Mycobacterium
RYQSGWKRSLIAMRSQRYF

SEQ ID NO: 1288454 - protein, 22 aa, Mycobacterium
RYREGPCLTAAWEERTVHVPDL

SEQ ID NO: 1288455 - protein, 19 aa, Mycobacterium
RYRLAELALRNKIPLVMLL

SEQ ID NO: 1288456 - protein, 18 aa, Mycobacterium
RYVMMVLRHIPRPIFRKL

SEQ ID NO: 1288457 - protein, 18 aa, Mycobacterium
SAAGYGLWHNGIEEFEEL

SEQ ID NO: 1288458 - protein, 18 aa, Mycobacterium
SAALAAWLFGRPAPVDAV

SEQ ID NO: 1288459 - protein, 21 aa, Mycobacterium
SADILKRWKRGVMSTVGDVTA

SEQ ID NO: 1288460 - protein, 23 aa, Mycobacterium
SAEVARWLLGRGVGKGVRVGLFF

SEQ ID NO: 1288461 - protein, 17 aa, Mycobacterium
SAGAAGWPVVWSGGEEG

SEQ ID NO: 1288462 - protein, 17 aa, Mycobacterium
SAGIPVIHIQHSDGPDS

SEQ ID NO: 1288463 - protein, 17 aa, Mycobacterium
SAIPWGDFDAHLEHMRH

SEQ ID NO: 1288464 - protein, 23 aa, Mycobacterium
SALAREFLPEFGLSTECGLGRHS

SEQ ID NO: 1288465 - protein, 17 aa, Mycobacterium
SANRDEMRWARADEFDV

SEQ ID NO: 1288466 - protein, 23 aa, Mycobacterium
SAPRAAQLEACFEELAELTGQRN

SEQ ID NO: 1288467 - protein, 22 aa, Mycobacterium
SASDFPPSLGIRLNIPQPDLRK

SEQ ID NO: 1288468 - protein, 18 aa, Mycobacterium
SASLSFSSLSGWAKRGLR

SEQ ID NO: 1288469 - protein, 19 aa, Mycobacterium
SASSWFLPRLVGLTRATDW

SEQ ID NO: 1288470 - protein, 23 aa, Mycobacterium
SDARRFDVSPAWFSALGAGLTLP

SEQ ID NO: 1288471 - protein, 24 aa, Mycobacterium
SDATFPGAMAIQFHFVDYVVHGWD

SEQ ID NO: 1288472 - protein, 23 aa, Mycobacterium
SDFNFLWPTARIAVIGAEGAAQL

SEQ ID NO: 1288473 - protein, 17 aa, Mycobacterium
SDGRFAVYVKFHHALID

SEQ ID NO: 1288474 - protein, 23 aa, Mycobacterium
SDGRWDPGKDFAFVTGRATSPTG

SEQ ID NO: 1288475 - protein, 25 aa, Mycobacterium
SDLRAIPWVLSWSQSRVMLPGWYGT

SEQ ID NO: 1288476 - protein, 20 aa, Mycobacterium
SDSAGFKWLAPYTGSAIAQH

SEQ ID NO: 1288477 - protein, 23 aa, Mycobacterium
SEDVWRPGIKVFFDTFGAHRGVT

SEQ ID NO: 1288478 - protein, 18 aa, Mycobacterium
SEEWLIKLMEGVEDIPGS

SEQ ID NO: 1288479 - protein, 20 aa, Mycobacterium
SEFTSAVAMARCDDKRQTRR

SEQ ID NO: 1288480 - protein, 20 aa, Mycobacterium
SEGYPEWWLSGRPVQTGVST

SEQ ID NO: 1288481 - protein, 18 aa, Mycobacterium
SEKGWRTFFRGLANDGVQ

SEQ ID NO: 1288482 - protein, 27 aa, Mycobacterium
SELRAAHPVFRRRRFFSGRPVRQRGAP

SEQ ID NO: 1288483 - protein, 20 aa, Mycobacterium
SETWRFPPFFHALLDAGVYP

SEQ ID NO: 1288484 - protein, 20 aa, Mycobacterium
SEVRALVRWLLPQSTTVVVS

SEQ ID NO: 1288485 - protein, 18 aa, Mycobacterium
SFRKGDGFEGLWDDVPAI

SEQ ID NO: 1288486 - protein, 18 aa, Mycobacterium
SGADFPAGWQKLNGPQAL

SEQ ID NO: 1288487 - protein, 17 aa, Mycobacterium
SGAFLAKLGCSFAVVGH

SEQ ID NO: 1288488 - protein, 26 aa, Mycobacterium
SGELRARLALGYALGWQGRGREADEV

SEQ ID NO: 1288489 - protein, 19 aa, Mycobacterium
SGIGARFGGPEGLRKYCRV

SEQ ID NO: 1288490 - protein, 22 aa, Mycobacterium
SGPECAWLSVFVERVQGAVDEL

SEQ ID NO: 1288491 - protein, 17 aa, Mycobacterium
SGVLAYVAVCDVLRRHG

SEQ ID NO: 1288492 - protein, 17 aa, Mycobacterium
SGVSYRPGARFGPAHIR

SEQ ID NO: 1288493 - protein, 18 aa, Mycobacterium
SHHWPTWGRDRITEYLSL

SEQ ID NO: 1288494 - protein, 22 aa, Mycobacterium
SHLFRPGHRIRLALAGADASHF

SEQ ID NO: 1288495 - protein, 17 aa, Mycobacterium
SHPAGSVLVEFGETRVM

SEQ ID NO: 1288496 - protein, 17 aa, Mycobacterium
SHPIVFGHAVKVFYKDA

SEQ ID NO: 1288497 - protein, 20 aa, Mycobacterium
SIQREWEWRVSRGESLKNLR

SEQ ID NO: 1288498 - protein, 18 aa, Mycobacterium
SKELGVPAFVVFTDNTLI

SEQ ID NO: 1288499 - protein, 20 aa, Mycobacterium
SKREIPHYYLADEVLMDPAL

SEQ ID NO: 1288500 - protein, 20 aa, Mycobacterium
SKVALPLVRRALELLPGVGF

SEQ ID NO: 1288501 - protein, 23 aa, Mycobacterium
SLAPKMPWPWGAVDFACRALRPA

SEQ ID NO: 1288502 - protein, 23 aa, Mycobacterium
SLFSRLQPMLAIDGGAMFADPSA

SEQ ID NO: 1288503 - protein, 17 aa, Mycobacterium
SLLRPAVALSWRARLQP

SEQ ID NO: 1288504 - protein, 19 aa, Mycobacterium
SLRGPRGGLVLAQPEYSDA

SEQ ID NO: 1288505 - protein, 24 aa, Mycobacterium
SLYHFAWDEFCDWYVELAKVQLGE

SEQ ID NO: 1288506 - protein, 22 aa, Mycobacterium
SMMPMRVIGMLLGIPESEQVSV

SEQ ID NO: 1288507 - protein, 21 aa, Mycobacterium
SNALCAAAVALECGATLDQVA

SEQ ID NO: 1288508 - protein, 17 aa, Mycobacterium
SNIFLVFNSVENRLSEP

SEQ ID NO: 1288509 - protein, 17 aa, Mycobacterium
SNVPIARRSSGPADERG

SEQ ID NO: 1288510 - protein, 19 aa, Mycobacterium
SNVQVVWEKFCRYFDVEPR

SEQ ID NO: 1288511 - protein, 22 aa, Mycobacterium
SNWLRGELFAAPNVKVKVPYTN

SEQ ID NO: 1288512 - protein, 22 aa, Mycobacterium
SPAWRQAFGEARSRLEGQGAAV

SEQ ID NO: 1288513 - protein, 29 aa, Mycobacterium
SPGWAKHAWSCFFAPWIAEATIFVYNYRR

SEQ ID NO: 1288514 - protein, 17 aa, Mycobacterium
SPIGLAFRKRTPVRVDR

SEQ ID NO: 1288515 - protein, 18 aa, Mycobacterium
SPRLRLVGVAGYEAACGQ

SEQ ID NO: 1288516 - protein, 17 aa, Mycobacterium
SQNRFARRVNMEVASHT

SEQ ID NO: 1288517 - protein, 20 aa, Mycobacterium
SRARRAGVSSFGFGGTNAHV

SEQ ID NO: 1288518 - protein, 25 aa, Mycobacterium
SRAYRLPWPAGTVVFEIDQPGVITF

SEQ ID NO: 1288519 - protein, 19 aa, Mycobacterium
SRDLKVWLADGTNYPGQGD

SEQ ID NO: 1288520 - protein, 18 aa, Mycobacterium
SREPVKHVLVWVSTLGST

SEQ ID NO: 1288521 - protein, 20 aa, Mycobacterium
SRGPAVVEFNCRFGDPETQS

SEQ ID NO: 1288522 - protein, 20 aa, Mycobacterium
SRIDPVLARSWLLVNGAHGD

SEQ ID NO: 1288523 - protein, 18 aa, Mycobacterium
SRIQWRFERLCKQIPLAA

SEQ ID NO: 1288524 - protein, 18 aa, Mycobacterium
SRIYRDFTYRSGSTTVST

SEQ ID NO: 1288525 - protein, 18 aa, Mycobacterium
SRKCRCARLVYANSMHVD

SEQ ID NO: 1288526 - protein, 19 aa, Mycobacterium
SRKSFGIAGARVIDDLELS

SEQ ID NO: 1288527 - protein, 19 aa, Mycobacterium
SRLWRMLLAPGRGIGKLVT

SEQ ID NO: 1288528 - protein, 17 aa, Mycobacterium
SRRAPGFALLGEKGQVR

SEQ ID NO: 1288529 - protein, 18 aa, Mycobacterium
SRRGLRIVAEVSIAQTAQ

SEQ ID NO: 1288530 - protein, 18 aa, Mycobacterium
SRTLGFWLQLGVSGFRVD

SEQ ID NO: 1288531 - protein, 18 aa, Mycobacterium
SRWPELRAVLTKAFAEHD

SEQ ID NO: 1288532 - protein, 20 aa, Mycobacterium
SSDIAAVWWQAALDAYDRLP

SEQ ID NO: 1288533 - protein, 21 aa, Mycobacterium
SSEAARAWWGNFLVQKANESG

SEQ ID NO: 1288534 - protein, 17 aa, Mycobacterium
STARLTGRWLRGRLPVV

SEQ ID NO: 1288535 - protein, 22 aa, Mycobacterium
STLLLTLLFRFMKPLIENGHVF

SEQ ID NO: 1288536 - protein, 17 aa, Mycobacterium
STRLPRYLVPHHIAVLD

SEQ ID NO: 1288537 - protein, 19 aa, Mycobacterium
SVDCLRALFPDAIEVTAAD

SEQ ID NO: 1288538 - protein, 19 aa, Mycobacterium
SVFGGPAWTRIVEPDGQPG

SEQ ID NO: 1288539 - protein, 17 aa, Mycobacterium
SVLCPRPSGDRAYVAHA

SEQ ID NO: 1288540 - protein, 17 aa, Mycobacterium
SVRCVDHNLLPGVEADM

SEQ ID NO: 1288541 - protein, 18 aa, Mycobacterium
SVSGEFADLLGLAGSQAS

SEQ ID NO: 1288542 - protein, 17 aa, Mycobacterium
SVSMPFKQDVLDLVDEV

SEQ ID NO: 1288543 - protein, 19 aa, Mycobacterium
SVWRWFRDGDEWKAEKVIT

SEQ ID NO: 1288544 - protein, 21 aa, Mycobacterium
SWLDSKHSFSFADHYDPANTH

SEQ ID NO: 1288545 - protein, 22 aa, Mycobacterium
SWQDPRFVVLVLHNADLTEVSW

SEQ ID NO: 1288546 - protein, 17 aa, Mycobacterium
SYLREVQSTYPLSYGPQ

SEQ ID NO: 1288547 - protein, 19 aa, Mycobacterium
SYTRPPSWRGLDVPAVLLS

SEQ ID NO: 1288548 - protein, 21 aa, Mycobacterium
TAAQALIRWHMQLGNIVIPKS

SEQ ID NO: 1288549 - protein, 17 aa, Mycobacterium
TACLRKTDWLFPQYREI

SEQ ID NO: 1288550 - protein, 23 aa, Mycobacterium
TAEFAAPVERVWQIYADPRQLEK

SEQ ID NO: 1288551 - protein, 19 aa, Mycobacterium
TAFTEAWVLAGAAFRLLGT

SEQ ID NO: 1288552 - protein, 18 aa, Mycobacterium
TAGLAAWGYASGISLGDG

SEQ ID NO: 1288553 - protein, 24 aa, Mycobacterium
TALPEVRSQLALTWGTETFIVPQI

SEQ ID NO: 1288554 - protein, 18 aa, Mycobacterium
TALRRWLTKAGVGPDQAM

SEQ ID NO: 1288555 - protein, 23 aa, Mycobacterium
TALWPITWAPLFDRVMAPTVTGS

SEQ ID NO: 1288556 - protein, 18 aa, Mycobacterium
TAMAARFLANPALLAVSN

SEQ ID NO: 1288557 - protein, 20 aa, Mycobacterium
TARSHLRWIAASNRLPDKRV

SEQ ID NO: 1288558 - protein, 22 aa, Mycobacterium
TAWPPWRPGVLFTGDSLGAGKP

SEQ ID NO: 1288559 - protein, 18 aa, Mycobacterium
TCHYCTFVTVPGRLRAQG

SEQ ID NO: 1288560 - protein, 17 aa, Mycobacterium
TDACDWIILGAMVGDAD

SEQ ID NO: 1288561 - protein, 21 aa, Mycobacterium
TDCPLRWLLERHGGRDGRDVR

SEQ ID NO: 1288562 - protein, 23 aa, Mycobacterium
TDELRFLVHWSAEVFSDYDELKK

SEQ ID NO: 1288563 - protein, 17 aa, Mycobacterium
TDFANLFTGGAFGFTNP

SEQ ID NO: 1288564 - protein, 18 aa, Mycobacterium
TDGWRLERLTAPSRLFGA

SEQ ID NO: 1288565 - protein, 19 aa, Mycobacterium
TDLAWSRITYWRALLTSAV

SEQ ID NO: 1288566 - protein, 24 aa, Mycobacterium
TDLPGELMSALSQGLSSFGINLPP

SEQ ID NO: 1288567 - protein, 17 aa, Mycobacterium
TDMAHFFYIHFGLPTYF

SEQ ID NO: 1288568 - protein, 19 aa, Mycobacterium
TDVKWWFGHTLTWARRTLQ

SEQ ID NO: 1288569 - protein, 20 aa, Mycobacterium
TDVRAAAAYARMFEANSEQD

SEQ ID NO: 1288570 - protein, 23 aa, Mycobacterium
TEALRAGGFFHHAKVEMRWVASD

SEQ ID NO: 1288571 - protein, 18 aa, Mycobacterium
TEGCVREVLVLAAALSIP

SEQ ID NO: 1288572 - protein, 21 aa, Mycobacterium
TEHLPRIGVPTVFVHGTADPF

SEQ ID NO: 1288573 - protein, 23 aa, Mycobacterium
TEIGTRTTVLWVFGGADPSTPTA

SEQ ID NO: 1288574 - protein, 17 aa, Mycobacterium
TEKRMFGGLAFLLDGNM

SEQ ID NO: 1288575 - protein, 26 aa, Mycobacterium
TELFGLPAAREFGPFLAVELEHGVSL

SEQ ID NO: 1288576 - protein, 17 aa, Mycobacterium
TELMRWVHPSLVASTQG

SEQ ID NO: 1288577 - protein, 19 aa, Mycobacterium
TETEVWRWYLIDKNAPDDV

SEQ ID NO: 1288578 - protein, 19 aa, Mycobacterium
TFEWAFRWLAAHRPPPSPH

SEQ ID NO: 1288579 - protein, 24 aa, Mycobacterium
TFTQLPFKLAWAITIHKSQGQTLE

SEQ ID NO: 1288580 - protein, 22 aa, Mycobacterium
TGAGVSGLWLLSGMREDGVLTT

SEQ ID NO: 1288581 - protein, 20 aa, Mycobacterium
TGARFSPAWLTRLVNKKLAH

SEQ ID NO: 1288582 - protein, 20 aa, Mycobacterium
TGDCLFPGGVGKTWQEGDFE

SEQ ID NO: 1288583 - protein, 25 aa, Mycobacterium
TGEIRVPRMLGVFSIGRAINARTLR

SEQ ID NO: 1288584 - protein, 24 aa, Mycobacterium
TGHRGVWRFGEFVLDTARYELRCG

SEQ ID NO: 1288585 - protein, 21 aa, Mycobacterium
TGNDHPACFIVANPRRDESFV

SEQ ID NO: 1288586 - protein, 17 aa, Mycobacterium
TGPWFQWHFDRWTVPPG

SEQ ID NO: 1288587 - protein, 19 aa, Mycobacterium
TGRPPRWVAPVVDGLGLAP

SEQ ID NO: 1288588 - protein, 17 aa, Mycobacterium
TGVFSWRPPASLIVALS

SEQ ID NO: 1288589 - protein, 18 aa, Mycobacterium
THEIRWPRNAKLLDVLLD

SEQ ID NO: 1288590 - protein, 17 aa, Mycobacterium
THLLRYPLPSAWGEDCD

SEQ ID NO: 1288591 - protein, 18 aa, Mycobacterium
THLVPRDSIGWVEAEGDY

SEQ ID NO: 1288592 - protein, 25 aa, Mycobacterium
THNRFGFGVGIGWAPEEFEWCGVPF

SEQ ID NO: 1288593 - protein, 23 aa, Mycobacterium
THPDGVLWGHGWDESGWPERTAP

SEQ ID NO: 1288594 - protein, 20 aa, Mycobacterium
THPFAWLPMLSRVLASARLL

SEQ ID NO: 1288595 - protein, 17 aa, Mycobacterium
THRPDWPSATAVGKTAV

SEQ ID NO: 1288596 - protein, 23 aa, Mycobacterium
THVVRRYGVEFAHPGPRLRDYVL

SEQ ID NO: 1288597 - protein, 27 aa, Mycobacterium
TIAKLRAARLLWARVCEVVGAADAGAA

SEQ ID NO: 1288598 - protein, 19 aa, Mycobacterium
TIHAGEAFGLPSIHEAIAF

SEQ ID NO: 1288599 - protein, 20 aa, Mycobacterium
TKLVPFGAFVRVEEGIEGLV

SEQ ID NO: 1288600 - protein, 17 aa, Mycobacterium
TLHGELIGSLAITEPGG

SEQ ID NO: 1288601 - protein, 23 aa, Mycobacterium
TLIKEKWLTANGVIGFFPANAVG

SEQ ID NO: 1288602 - protein, 19 aa, Mycobacterium
TLLDWCRRNDVVFIADEVQ

SEQ ID NO: 1288603 - protein, 23 aa, Mycobacterium
TLMRRIGLRPSLFRELVEPGSVL

SEQ ID NO: 1288604 - protein, 22 aa, Mycobacterium
TLPAPARWALRKALRPVFAATY

SEQ ID NO: 1288605 - protein, 18 aa, Mycobacterium
TLPCRKWFDDHGVSFGRH

SEQ ID NO: 1288606 - protein, 24 aa, Mycobacterium
TLPGTLALYLERAWPRHRRLSRSA

SEQ ID NO: 1288607 - protein, 18 aa, Mycobacterium
TLPLSYRFEPGAADDGIT

SEQ ID NO: 1288608 - protein, 22 aa, Mycobacterium
TLSILKFRGHRILNGMLAEDPG

SEQ ID NO: 1288609 - protein, 23 aa, Mycobacterium
TLSPCWYCSGLVRQFNIGAVIVG

SEQ ID NO: 1288610 - protein, 20 aa, Mycobacterium
TLWPERLFSILAGFVEAGES

SEQ ID NO: 1288611 - protein, 25 aa, Mycobacterium
TMNTRGRFAMRLARPPERFTDGLVK

SEQ ID NO: 1288612 - protein, 22 aa, Mycobacterium
TNTRFCAHWGLARGGRVAYVNG

SEQ ID NO: 1288613 - protein, 18 aa, Mycobacterium
TPACYGFSIIAKVKEGRE

SEQ ID NO: 1288614 - protein, 18 aa, Mycobacterium
TPAGWRIARRRFTTVRVS

SEQ ID NO: 1288615 - protein, 18 aa, Mycobacterium
TPLLWQRYLAIIFDGLRP

SEQ ID NO: 1288616 - protein, 18 aa, Mycobacterium
TPLVNWRIPGPELKFEER

SEQ ID NO: 1288617 - protein, 21 aa, Mycobacterium
TPPLPLLCGGLFAAPTAEVVG

SEQ ID NO: 1288618 - protein, 18 aa, Mycobacterium
TPVAAACRLVHDSGDVLD

SEQ ID NO: 1288619 - protein, 17 aa, Mycobacterium
TQHWRIATLLGVPEHDL

SEQ ID NO: 1288620 - protein, 17 aa, Mycobacterium
TQMLFFVGHGYRVIAHD

SEQ ID NO: 1288621 - protein, 20 aa, Mycobacterium
TRAAAGLGLLPCFMADRHDD

SEQ ID NO: 1288622 - protein, 23 aa, Mycobacterium
TRAFRLPWPDGMTVFEIDQPTVL

SEQ ID NO: 1288623 - protein, 18 aa, Mycobacterium
TRASPWLTRHPEMPEWHL

SEQ ID NO: 1288624 - protein, 19 aa, Mycobacterium
TRGGPPIAFQLLWYPVTMW

SEQ ID NO: 1288625 - protein, 18 aa, Mycobacterium
TRIDVDWVIVPGGEVRRL

SEQ ID NO: 1288626 - protein, 20 aa, Mycobacterium
TRILAPRSRYDEVVEKLANF

SEQ ID NO: 1288627 - protein, 18 aa, Mycobacterium
TRKCVFCSKKGQDIDYKD

SEQ ID NO: 1288628 - protein, 17 aa, Mycobacterium
TRLAAKLSYTNIGFALT

SEQ ID NO: 1288629 - protein, 18 aa, Mycobacterium
TRLEEFLMMPAFVRAFGK

SEQ ID NO: 1288630 - protein, 20 aa, Mycobacterium
TRMLVWRAGWMHRNNKAFTS

SEQ ID NO: 1288631 - protein, 19 aa, Mycobacterium
TRPHRRWVSPAARRVAATL

SEQ ID NO: 1288632 - protein, 22 aa, Mycobacterium
TRTPDEFSWRAGEVLDAIAKGA

SEQ ID NO: 1288633 - protein, 30 aa, Mycobacterium
TRVEFWAFDILRLDGRWLLKAKYRDRRKLL

SEQ ID NO: 1288634 - protein, 18 aa, Mycobacterium
TRVPVLHFFDGFRTSHEL

SEQ ID NO: 1288635 - protein, 25 aa, Mycobacterium
TRVSFGFRGPDRFGFAPAGVHCERA

SEQ ID NO: 1288636 - protein, 18 aa, Mycobacterium
TRYDAVIVDAMFLGILPF

SEQ ID NO: 1288637 - protein, 23 aa, Mycobacterium
TSGDPRFRFFGNIAVGEHVHPEE

SEQ ID NO: 1288638 - protein, 18 aa, Mycobacterium
TSGWSLTAQDVFNNVART

SEQ ID NO: 1288639 - protein, 29 aa, Mycobacterium
TSLVKFHWKPRLGVHSLVWEEAQIAAGMD

SEQ ID NO: 1288640 - protein, 18 aa, Mycobacterium
TSVLPRWGAVIAASTAHI

SEQ ID NO: 1288641 - protein, 20 aa, Mycobacterium
TTLAGGLNWPLDLAVGDDGR

SEQ ID NO: 1288642 - protein, 18 aa, Mycobacterium
TTMSGCWIYSGVYADEVN

SEQ ID NO: 1288643 - protein, 22 aa, Mycobacterium
TTPRVAQMFGVQAVPTVVALAG

SEQ ID NO: 1288644 - protein, 18 aa, Mycobacterium
TVADLQWLRTAGLAEPIA

SEQ ID NO: 1288645 - protein, 18 aa, Mycobacterium
TVAEGWPSRLRPGALEGA

SEQ ID NO: 1288646 - protein, 25 aa, Mycobacterium
TVEPGARLNIPWNRDFNALVYVLSG

SEQ ID NO: 1288647 - protein, 21 aa, Mycobacterium
TVEPWGVVTHRGRWYLVGHDR

SEQ ID NO: 1288648 - protein, 23 aa, Mycobacterium
TVESWRVHRCIGMDGSTLLDNLV

SEQ ID NO: 1288649 - protein, 17 aa, Mycobacterium
TVNRFVERFSRFGLNAA

SEQ ID NO: 1288650 - protein, 21 aa, Mycobacterium
TVPEHPFMLFGQMTTADPTRS

SEQ ID NO: 1288651 - protein, 20 aa, Mycobacterium
TWDDELLDLFGLAGESLPAI

SEQ ID NO: 1288652 - protein, 17 aa, Mycobacterium
TYEERFPQIGWEITAGN

SEQ ID NO: 1288653 - protein, 22 aa, Mycobacterium
TYPDIRCVYWAGGNPFHHHQNI

SEQ ID NO: 1288654 - protein, 27 aa, Mycobacterium
TYPRLKKTLLLGTRWGDENAKLIPAPG

SEQ ID NO: 1288655 - protein, 19 aa, Mycobacterium
VAAALPEYMVPAAYVVLDE

SEQ ID NO: 1288656 - protein, 23 aa, Mycobacterium
VAAIAVGLTRGWSPTKSVQFGVA

SEQ ID NO: 1288657 - protein, 23 aa, Mycobacterium
VAAKRGWPVLRFSSRSGSSPLSQ

SEQ ID NO: 1288658 - protein, 17 aa, Mycobacterium
VAATIAFLASDYSSYLT

SEQ ID NO: 1288659 - protein, 17 aa, Mycobacterium
VAATMPMVLWLRTTSAQ

SEQ ID NO: 1288660 - protein, 17 aa, Mycobacterium
VADPANWRRWWPDLRLT

SEQ ID NO: 1288661 - protein, 19 aa, Mycobacterium
VADRLGLRFTLRDVADALE

SEQ ID NO: 1288662 - protein, 19 aa, Mycobacterium
VAETIDWGRTVLALGMDTI

SEQ ID NO: 1288663 - protein, 17 aa, Mycobacterium
VAIAAEWTRGAVKTVPP

SEQ ID NO: 1288664 - protein, 18 aa, Mycobacterium
VAKRLGLYVAEFDTVELN

SEQ ID NO: 1288665 - protein, 20 aa, Mycobacterium
VALKRAARCDGWMHGGGDPE

SEQ ID NO: 1288666 - protein, 19 aa, Mycobacterium
VAMLPGWARKPLRLPYFPP

SEQ ID NO: 1288667 - protein, 20 aa, Mycobacterium
VAMPSFAGIDPWRSPAGPVP

SEQ ID NO: 1288668 - protein, 17 aa, Mycobacterium
VAPEAYFQFPVAKYGIA

SEQ ID NO: 1288669 - protein, 18 aa, Mycobacterium
VARFDSYRGFLFGSLNPD

SEQ ID NO: 1288670 - protein, 23 aa, Mycobacterium
VARRAAVCSYGYGGTIAHVLLEE

SEQ ID NO: 1288671 - protein, 24 aa, Mycobacterium
VARYLFRRVVSWGRSSNVFLRNGA

SEQ ID NO: 1288672 - protein, 17 aa, Mycobacterium
VAVKAPFFGDRRKAFLD

SEQ ID NO: 1288673 - protein, 18 aa, Mycobacterium
VAYGWAMEDTEAFAKLIV

SEQ ID NO: 1288674 - protein, 23 aa, Mycobacterium
VAYRLGRGIARMEAAMSTPEMFG

SEQ ID NO: 1288675 - protein, 29 aa, Mycobacterium
VCAGIIPWNFPLLLAVWKLGPALAAGNTV

SEQ ID NO: 1288676 - protein, 18 aa, Mycobacterium
VCAVPGLSGLYVGPADLA

SEQ ID NO: 1288677 - protein, 18 aa, Mycobacterium
VCELHIRLAASLVQVSTP

SEQ ID NO: 1288678 - protein, 22 aa, Mycobacterium
VCGCGRCQWCLEGQAQVCPDQT

SEQ ID NO: 1288679 - protein, 18 aa, Mycobacterium
VCRACGAAVEIQGGQVET

SEQ ID NO: 1288680 - protein, 23 aa, Mycobacterium
VCSEILPRWGVETVFVDGDDLSQ

SEQ ID NO: 1288681 - protein, 17 aa, Mycobacterium
VDAQNLWMSAKMPDDQF

SEQ ID NO: 1288682 - protein, 19 aa, Mycobacterium
VDAVPFLFARDGVPGDPGV

SEQ ID NO: 1288683 - protein, 24 aa, Mycobacterium
VDDAWRPDTVWRHRLGAGLPAERV

SEQ ID NO: 1288684 - protein, 20 aa, Mycobacterium
VDDWPLLRWRMREYTHGRWG

SEQ ID NO: 1288685 - protein, 26 aa, Mycobacterium
VDEIVRWATPVHCFQRTALADVELGG

SEQ ID NO: 1288686 - protein, 18 aa, Mycobacterium
VDELMRFCPVIFTTIRTA

SEQ ID NO: 1288687 - protein, 24 aa, Mycobacterium
VDERARAGLFLAMQYPVEVPGVSM

SEQ ID NO: 1288688 - protein, 19 aa, Mycobacterium
VDGGIRLTGDFSWSSGSEH

SEQ ID NO: 1288689 - protein, 19 aa, Mycobacterium
VDIPFKFHHPMWRENCEVD

SEQ ID NO: 1288690 - protein, 17 aa, Mycobacterium
VDIRFCDLPGVVQHFSI

SEQ ID NO: 1288691 - protein, 23 aa, Mycobacterium
VDLVCSWGPMILGHAHPAVVEAV

SEQ ID NO: 1288692 - protein, 17 aa, Mycobacterium
VDLVPSYKAHRVAEPQA

SEQ ID NO: 1288693 - protein, 17 aa, Mycobacterium
VDLVQLFPAAAYGKNGA

SEQ ID NO: 1288694 - protein, 24 aa, Mycobacterium
VDRHGRLRIAAAVGINGDVGAKAR

SEQ ID NO: 1288695 - protein, 25 aa, Mycobacterium
VDRVFAGKVWGAWHLSEAAVDLQLD

SEQ ID NO: 1288696 - protein, 17 aa, Mycobacterium
VDSFDQWGVELGKTQAK

SEQ ID NO: 1288697 - protein, 18 aa, Mycobacterium
VEALAVRAEERFGPERVI

SEQ ID NO: 1288698 - protein, 17 aa, Mycobacterium
VEAYRPLALELQAQLGH

SEQ ID NO: 1288699 - protein, 17 aa, Mycobacterium
VEEELLRLGARPGCAVT

SEQ ID NO: 1288700 - protein, 18 aa, Mycobacterium
VELLRWAKEQGIAITAEV

SEQ ID NO: 1288701 - protein, 17 aa, Mycobacterium
VEMAGDFGGVWYWNRFP

SEQ ID NO: 1288702 - protein, 22 aa, Mycobacterium
VENALKVAFDWKSRLNESRGLD

SEQ ID NO: 1288703 - protein, 21 aa, Mycobacterium
VEVLRLSALRGLFSTVTDQQV

SEQ ID NO: 1288704 - protein, 18 aa, Mycobacterium
VFGSCRYPKTGVEEIDEK

SEQ ID NO: 1288705 - protein, 25 aa, Mycobacterium
VFRHGLQLFGAMGFTWENDLQFALK

SEQ ID NO: 1288706 - protein, 19 aa, Mycobacterium
VFSGYRFVRHAAAHGMPVA

SEQ ID NO: 1288707 - protein, 17 aa, Mycobacterium
VGACARGLMSREDVDII

SEQ ID NO: 1288708 - protein, 18 aa, Mycobacterium
VGAKTLWLQQGLWDEQIA

SEQ ID NO: 1288709 - protein, 19 aa, Mycobacterium
VGDRFGWAGGDLVLIGTVG

SEQ ID NO: 1288710 - protein, 17 aa, Mycobacterium
VGDTVIWDNRGVLHRAA

SEQ ID NO: 1288711 - protein, 24 aa, Mycobacterium
VGFDIPNEFVVGYGLDYAERYRDL

SEQ ID NO: 1288712 - protein, 17 aa, Mycobacterium
VGFSVAIGEHLAAGVQQ

SEQ ID NO: 1288713 - protein, 21 aa, Mycobacterium
VGGPSTWRLGGAFNCGKAQPG

SEQ ID NO: 1288714 - protein, 21 aa, Mycobacterium
VGPAAWWHAWARADWDRLAGA

SEQ ID NO: 1288715 - protein, 26 aa, Mycobacterium
VGPEVARAALLFGMRFDAEAAVRHGL

SEQ ID NO: 1288716 - protein, 22 aa, Mycobacterium
VGRKALSYYSFRNWDVTESWSG

SEQ ID NO: 1288717 - protein, 22 aa, Mycobacterium
VGSRGLGAWGRRLLGSVSTAVV

SEQ ID NO: 1288718 - protein, 21 aa, Mycobacterium
VGVRLLRHWAVSLGAAEDTFD

SEQ ID NO: 1288719 - protein, 19 aa, Mycobacterium
VGYAACFHSALRLVARQEK

SEQ ID NO: 1288720 - protein, 19 aa, Mycobacterium
VHASFLPAIYFQGVNLAGG

SEQ ID NO: 1288721 - protein, 18 aa, Mycobacterium
VHIWGCGGLGSWIAEFIA

SEQ ID NO: 1288722 - protein, 26 aa, Mycobacterium
VHVRIASPPVRWPCFYGIDFATPAEL

SEQ ID NO: 1288723 - protein, 18 aa, Mycobacterium
VIEKLSFPGYFLVVHDIT

SEQ ID NO: 1288724 - protein, 17 aa, Mycobacterium
VIFAWRSFEIYPLQVRT

SEQ ID NO: 1288725 - protein, 18 aa, Mycobacterium
VIGIRSRLMSRLAGQGAV

SEQ ID NO: 1288726 - protein, 29 aa, Mycobacterium
VIGRAVPRGGVYLLPFPMCHIAGYNMLVQ

SEQ ID NO: 1288727 - protein, 20 aa, Mycobacterium
VIHPRFGNFILLATVLVDAE

SEQ ID NO: 1288728 - protein, 18 aa, Mycobacterium
VINRHVFESLAFNARIAL

SEQ ID NO: 1288729 - protein, 17 aa, Mycobacterium
VIWACVFMRTSARRVHF

SEQ ID NO: 1288730 - protein, 18 aa, Mycobacterium
VKDLRTWHGTVLAAVAFV

SEQ ID NO: 1288731 - protein, 23 aa, Mycobacterium
VKGPFRLAALIGERMVADGGGTI

SEQ ID NO: 1288732 - protein, 23 aa, Mycobacterium
VKKLPTLRGRTVITMFYENSTRT

SEQ ID NO: 1288733 - protein, 18 aa, Mycobacterium
VKLLGRFAAEPTRENIEK

SEQ ID NO: 1288734 - protein, 18 aa, Mycobacterium
VKVPRRLKELHLRLGSAT

SEQ ID NO: 1288735 - protein, 18 aa, Mycobacterium
VLCPGSRNAPLAFALADA

SEQ ID NO: 1288736 - protein, 18 aa, Mycobacterium
VLENRYGLVPGRADERIE

SEQ ID NO: 1288737 - protein, 18 aa, Mycobacterium
VLIGSAWQRCRVHFLRNV

SEQ ID NO: 1288738 - protein, 17 aa, Mycobacterium
VLLARFGDTVAIPLMRR

SEQ ID NO: 1288739 - protein, 18 aa, Mycobacterium
VLNRFLLQAAIGYPLTVH

SEQ ID NO: 1288740 - protein, 23 aa, Mycobacterium
VLQRPRVGTVFVIPGRGDTLRIN

SEQ ID NO: 1288741 - protein, 29 aa, Mycobacterium
VLRGGKRLRPAFAYWGWRAVADRPADSGV

SEQ ID NO: 1288742 - protein, 18 aa, Mycobacterium
VLRRHGFHSATAYLGVDG

SEQ ID NO: 1288743 - protein, 21 aa, Mycobacterium
VLRVRRVRWVGGYGRMDSCSG

SEQ ID NO: 1288744 - protein, 19 aa, Mycobacterium
VLTGWRMLLDLGRMQDGEP

SEQ ID NO: 1288745 - protein, 25 aa, Mycobacterium
VLTKPRWLWDFGKTFSPPDLRVPNQ

SEQ ID NO: 1288746 - protein, 19 aa, Mycobacterium
VLVHPRPRLSVMSVGGELV

SEQ ID NO: 1288747 - protein, 17 aa, Mycobacterium
VMALRWVRDNIAVFGGD

SEQ ID NO: 1288748 - protein, 25 aa, Mycobacterium
VMLRVRLRSGLPLDMLTADERSRVG

SEQ ID NO: 1288749 - protein, 18 aa, Mycobacterium
VMMPELFLADAVGATNKP

SEQ ID NO: 1288750 - protein, 21 aa, Mycobacterium
VMPYKHGFGPFAPEIYRAPLS

SEQ ID NO: 1288751 - protein, 17 aa, Mycobacterium
VMREWKFTAADMERTNV

SEQ ID NO: 1288752 - protein, 17 aa, Mycobacterium
VMRRAPLTLAHVVAAVA

SEQ ID NO: 1288753 - protein, 18 aa, Mycobacterium
VNASWRLDDRGVFSDSHG

SEQ ID NO: 1288754 - protein, 22 aa, Mycobacterium
VNGELEFGGWTWRYDLVSLGPA

SEQ ID NO: 1288755 - protein, 18 aa, Mycobacterium
VNGFCVGGGIGLVGNADV

SEQ ID NO: 1288756 - protein, 17 aa, Mycobacterium
VNLPLTWTTRGVDRTVE

SEQ ID NO: 1288757 - protein, 21 aa, Mycobacterium
VNQRWLGGMLTNFSTVHKRLQ

SEQ ID NO: 1288758 - protein, 19 aa, Mycobacterium
VNVARALTLARLDAVALLP

SEQ ID NO: 1288759 - protein, 22 aa, Mycobacterium
VPADWLRMMLAFNRNQLQWFAD

SEQ ID NO: 1288760 - protein, 19 aa, Mycobacterium
VPARVAGLVERLKAAEKEL

SEQ ID NO: 1288761 - protein, 17 aa, Mycobacterium
VPCWECRFCKRGQYHMC

SEQ ID NO: 1288762 - protein, 19 aa, Mycobacterium
VPDVEAAFVLKMLARTVRD

SEQ ID NO: 1288763 - protein, 20 aa, Mycobacterium
VPEEVAWRVGFIDDEQLAAR

SEQ ID NO: 1288764 - protein, 17 aa, Mycobacterium
VPGLRWPWHARLGTAAV

SEQ ID NO: 1288765 - protein, 19 aa, Mycobacterium
VPISIVHRAGLQFPAPTLL

SEQ ID NO: 1288766 - protein, 20 aa, Mycobacterium
VPMLTFRLWRPLSHDTMEVW

SEQ ID NO: 1288767 - protein, 19 aa, Mycobacterium
VPMRCVFALTAMGFLPQSS

SEQ ID NO: 1288768 - protein, 17 aa, Mycobacterium
VPNSIRWLDRLKAVSPE

SEQ ID NO: 1288769 - protein, 17 aa, Mycobacterium
VPPALRFTAQAAQLLGP

SEQ ID NO: 1288770 - protein, 25 aa, Mycobacterium
VPPARLVGWTARFLGMVLPGDEIDF

SEQ ID NO: 1288771 - protein, 18 aa, Mycobacterium
VPPHPAGEHPMFKAMAAA

SEQ ID NO: 1288772 - protein, 23 aa, Mycobacterium
VPPKDYFPLLALLKRSLTEEEVV

SEQ ID NO: 1288773 - protein, 17 aa, Mycobacterium
VPPRVAMQILLTGDPIT

SEQ ID NO: 1288774 - protein, 17 aa, Mycobacterium
VPRVHRWARGVDITGFA

SEQ ID NO: 1288775 - protein, 22 aa, Mycobacterium
VPRWLPERICWLLSDEYHANEG

SEQ ID NO: 1288776 - protein, 20 aa, Mycobacterium
VPSIAASLFARFESRQEDSP

SEQ ID NO: 1288777 - protein, 18 aa, Mycobacterium
VPWRRPGFQLGLDIAEIK

SEQ ID NO: 1288778 - protein, 23 aa, Mycobacterium
VQRLEMVRRISLEIDADVVELGT

SEQ ID NO: 1288779 - protein, 24 aa, Mycobacterium
VQVLGFREHASWALASDTLEFVDL

SEQ ID NO: 1288780 - protein, 18 aa, Mycobacterium
VRALVAWFWDEPLRAPLI

SEQ ID NO: 1288781 - protein, 19 aa, Mycobacterium
VREACLWSAGLTPAGVTRR

SEQ ID NO: 1288782 - protein, 17 aa, Mycobacterium
VRIDRFEVLAIRRVDGF

SEQ ID NO: 1288783 - protein, 21 aa, Mycobacterium
VRILCAMPFFWIGGLLAATGA

SEQ ID NO: 1288784 - protein, 18 aa, Mycobacterium
VRLAELFIEAGLPAGVFQ

SEQ ID NO: 1288785 - protein, 24 aa, Mycobacterium
VRRALELLPGVGFVNAYGLTETSS

SEQ ID NO: 1288786 - protein, 22 aa, Mycobacterium
VRRCGICGSDLHAKDHADELTE

SEQ ID NO: 1288787 - protein, 22 aa, Mycobacterium
VRRLWWRVTVDLPDDALLHTLI

SEQ ID NO: 1288788 - protein, 19 aa, Mycobacterium
VRVGLFFPNGVDWIVWWLA

SEQ ID NO: 1288789 - protein, 18 aa, Mycobacterium
VRVGYTLGSTGTCLQVDD

SEQ ID NO: 1288790 - protein, 23 aa, Mycobacterium
VSARGIEIGHIFQLGRKYTEAFS

SEQ ID NO: 1288791 - protein, 23 aa, Mycobacterium
VSCVKPAGALYAFPRLDPEVYEI

SEQ ID NO: 1288792 - protein, 19 aa, Mycobacterium
VSCYWDYAPSFGRGPFRNV

SEQ ID NO: 1288793 - protein, 19 aa, Mycobacterium
VSDLPRGGLIIANSDEFTK

SEQ ID NO: 1288794 - protein, 18 aa, Mycobacterium
VSEIIRWQTPLAYMRRVA

SEQ ID NO: 1288795 - protein, 19 aa, Mycobacterium
VSGAWQWSSGCDHATWAFL

SEQ ID NO: 1288796 - protein, 24 aa, Mycobacterium
VSGGYRLSGSWSFGSGTGHSQYVA

SEQ ID NO: 1288797 - protein, 25 aa, Mycobacterium
VSLLRYCLDHGYQLRIIEQMPLDAE

SEQ ID NO: 1288798 - protein, 19 aa, Mycobacterium
VSQPARWALLYGSPVPGYR

SEQ ID NO: 1288799 - protein, 21 aa, Mycobacterium
VSVPVDWRRLRMGAEAITAEG

SEQ ID NO: 1288800 - protein, 19 aa, Mycobacterium
VTAIGARFTSPVFPGETLT

SEQ ID NO: 1288801 - protein, 17 aa, Mycobacterium
VTDGRWSCVQWGSRTPP

SEQ ID NO: 1288802 - protein, 24 aa, Mycobacterium
VTDRSWRGIGMIPQSGWRLSPAYR

SEQ ID NO: 1288803 - protein, 17 aa, Mycobacterium
VTERGWAPIVRFGVAPR

SEQ ID NO: 1288804 - protein, 22 aa, Mycobacterium
VTKAAVEPVWWLPGVAQRFGCS

SEQ ID NO: 1288805 - protein, 20 aa, Mycobacterium
VTLRGAVSIARRLQDPLAEL

SEQ ID NO: 1288806 - protein, 24 aa, Mycobacterium
VTRARASGMTAVFWLDTERPHEAE

SEQ ID NO: 1288807 - protein, 22 aa, Mycobacterium
VTYRHRLLLGWTHMQDGQLQAA

SEQ ID NO: 1288808 - protein, 19 aa, Mycobacterium
VVAADWPRLAAAYRTRAAL

SEQ ID NO: 1288809 - protein, 18 aa, Mycobacterium
VVAADWTRLGAAYRTRAP

SEQ ID NO: 1288810 - protein, 24 aa, Mycobacterium
VVARLPFVPSLLEWLHAGRTSVVM

SEQ ID NO: 1288811 - protein, 17 aa, Mycobacterium
VVARTGLRDCRTHGRTW

SEQ ID NO: 1288812 - protein, 24 aa, Mycobacterium
VVDTRVGTVIARYPLAFTATAMTI

SEQ ID NO: 1288813 - protein, 17 aa, Mycobacterium
VVFYPVIPLGSWVATTE

SEQ ID NO: 1288814 - protein, 17 aa, Mycobacterium
VVKRLYGLAARVPMGQA

SEQ ID NO: 1288815 - protein, 19 aa, Mycobacterium
VVLSDGWDIMDFVDQLQKL

SEQ ID NO: 1288816 - protein, 19 aa, Mycobacterium
VVVDEAWKTGSLAAEISAQ

SEQ ID NO: 1288817 - protein, 19 aa, Mycobacterium
VYFELRLADAWVWDMYRPA

SEQ ID NO: 1288818 - protein, 17 aa, Mycobacterium
WAKEQGIAITAEVTPHH

SEQ ID NO: 1288819 - protein, 26 aa, Mycobacterium
WARFSAWADDIFKIFNWNVAEDADDI

SEQ ID NO: 1288820 - protein, 25 aa, Mycobacterium
WARVPKARFARWAPDGALLVSVPST

SEQ ID NO: 1288821 - protein, 19 aa, Mycobacterium
WAVNECRPMTGIGGGSDRS

SEQ ID NO: 1288822 - protein, 18 aa, Mycobacterium
WCMGEAHAAVVLDALSRR

SEQ ID NO: 1288823 - protein, 19 aa, Mycobacterium
WDALCAAIGAADWASDPAL

SEQ ID NO: 1288824 - protein, 18 aa, Mycobacterium
WDDAYRLIADELRALADP

SEQ ID NO: 1288825 - protein, 26 aa, Mycobacterium
WDLKRFAASVALMCWQKALSDGEITN

SEQ ID NO: 1288826 - protein, 18 aa, Mycobacterium
WEHGRFGAPYLRDSLLSA

SEQ ID NO: 1288827 - protein, 17 aa, Mycobacterium
WELGAGWAKHVTVEVAL

SEQ ID NO: 1288828 - protein, 25 aa, Mycobacterium
WEPEPLRWLGVRGLYLAYRLADRHE

SEQ ID NO: 1288829 - protein, 17 aa, Mycobacterium
WEPGDLLLLGSGAAGPA

SEQ ID NO: 1288830 - protein, 22 aa, Mycobacterium
WESLPAILFQSGFRQLLSPELR

SEQ ID NO: 1288831 - protein, 18 aa, Mycobacterium
WETIKKWAILDHDLSIEN

SEQ ID NO: 1288832 - protein, 17 aa, Mycobacterium
WEYVADFDLDFHMRRVT

SEQ ID NO: 1288833 - protein, 18 aa, Mycobacterium
WFKDEFTHLGEPWLEHDE

SEQ ID NO: 1288834 - protein, 21 aa, Mycobacterium
WFLRRFSLLDSLYMVPSPRLV

SEQ ID NO: 1288835 - protein, 17 aa, Mycobacterium
WGITPGDMATIWRGGCI

SEQ ID NO: 1288836 - protein, 17 aa, Mycobacterium
WGKIGGMGPRIVGSGVS

SEQ ID NO: 1288837 - protein, 24 aa, Mycobacterium
WGKPEEMAELLAFCAGDRAGYLTG

SEQ ID NO: 1288838 - protein, 25 aa, Mycobacterium
WGRFRWGGDFGWTWGTLLPRDPDDP

SEQ ID NO: 1288839 - protein, 18 aa, Mycobacterium
WHALPAMIIDCALRADGW

SEQ ID NO: 1288840 - protein, 20 aa, Mycobacterium
WHSLARLAIRDDIYGSIRSL

SEQ ID NO: 1288841 - protein, 18 aa, Mycobacterium
WITLSCRDRNRIVLEQEL

SEQ ID NO: 1288842 - protein, 18 aa, Mycobacterium
WIVRVVVSLAYWPDPDPR

SEQ ID NO: 1288843 - protein, 20 aa, Mycobacterium
WKAIEASGRFCVNVLHEKQK

SEQ ID NO: 1288844 - protein, 23 aa, Mycobacterium
WKDGEALFLRCNIWREAAENVAE

SEQ ID NO: 1288845 - protein, 19 aa, Mycobacterium
WLDAEWRLVSGDVRVVIAL

SEQ ID NO: 1288846 - protein, 20 aa, Mycobacterium
WLDAFTHWRRAQGLPASAIA

SEQ ID NO: 1288847 - protein, 17 aa, Mycobacterium
WLLKQAFYFSLTTVNEA

SEQ ID NO: 1288848 - protein, 19 aa, Mycobacterium
WLPPRGMRGEFERFDGRAG

SEQ ID NO: 1288849 - protein, 17 aa, Mycobacterium
WLRAASLGFVATVDAQG

SEQ ID NO: 1288850 - protein, 17 aa, Mycobacterium
WMAEYRREFGLVDPPAD

SEQ ID NO: 1288851 - protein, 19 aa, Mycobacterium
WMARFVLGFGSAVRVLEPQ

SEQ ID NO: 1288852 - protein, 22 aa, Mycobacterium
WMDAEWWRLRVLPELGGTDAPN

SEQ ID NO: 1288853 - protein, 19 aa, Mycobacterium
WMGRVHRFLGLDVGVILSG

SEQ ID NO: 1288854 - protein, 17 aa, Mycobacterium
WMIRCVVNGVAESIEAL

SEQ ID NO: 1288855 - protein, 21 aa, Mycobacterium
WMLDIRLRALRTFDKKPMPNW

SEQ ID NO: 1288856 - protein, 18 aa, Mycobacterium
WNPKMKRFIFTDRNGIYI

SEQ ID NO: 1288857 - protein, 17 aa, Mycobacterium
WPAKLRLLEGFRHRENL

SEQ ID NO: 1288858 - protein, 18 aa, Mycobacterium
WPLADVRLLAPILASKVV

SEQ ID NO: 1288859 - protein, 18 aa, Mycobacterium
WPPVRRIDGAYGDRNLMC

SEQ ID NO: 1288860 - protein, 20 aa, Mycobacterium
WPRLAAAYRTRAALRIVDEL

SEQ ID NO: 1288861 - protein, 17 aa, Mycobacterium
WPSQWCLEANSLAIQVH

SEQ ID NO: 1288862 - protein, 18 aa, Mycobacterium
WQECDAVSMPRAVAITKL

SEQ ID NO: 1288863 - protein, 18 aa, Mycobacterium
WQERLWPTEEFELARSRI

SEQ ID NO: 1288864 - protein, 18 aa, Mycobacterium
WQKLNGPQALSFVRQRHD

SEQ ID NO: 1288865 - protein, 18 aa, Mycobacterium
WQLAMAVRPRRWVFTSVG

SEQ ID NO: 1288866 - protein, 23 aa, Mycobacterium
WQPCPGGGGLALWVRLPTPMSSA

SEQ ID NO: 1288867 - protein, 21 aa, Mycobacterium
WRGGCIIRAKFLNRIKDAFDN

SEQ ID NO: 1288868 - protein, 19 aa, Mycobacterium
WRHNEHWLAPDFLDPAADV

SEQ ID NO: 1288869 - protein, 17 aa, Mycobacterium
WRIVTALAASGDIDADG

SEQ ID NO: 1288870 - protein, 19 aa, Mycobacterium
WRKPLVRRWYGFAEMQKQV

SEQ ID NO: 1288871 - protein, 21 aa, Mycobacterium
WRWDTDWFWCSRAFGAQNPKI

SEQ ID NO: 1288872 - protein, 17 aa, Mycobacterium
WRWRQRLGGDAWKGRTP

SEQ ID NO: 1288873 - protein, 20 aa, Mycobacterium
WRYGFGEARRGDPVAIVLNT

SEQ ID NO: 1288874 - protein, 17 aa, Mycobacterium
WSAPRLHLVDLQYSDVR

SEQ ID NO: 1288875 - protein, 17 aa, Mycobacterium
WSCRRFERDGAMMPADG

SEQ ID NO: 1288876 - protein, 17 aa, Mycobacterium
WSIQLGNVVIARSANPD

SEQ ID NO: 1288877 - protein, 20 aa, Mycobacterium
WSPQCRVMKPLGPVRPGTKT

SEQ ID NO: 1288878 - protein, 21 aa, Mycobacterium
WTADIRYRWAVCEPTTGELLA

SEQ ID NO: 1288879 - protein, 17 aa, Mycobacterium
WTSFEAHPLDAMDLTRR

SEQ ID NO: 1288880 - protein, 24 aa, Mycobacterium
WTTSTLRPWPGFTPMIYDRYSQPF

SEQ ID NO: 1288881 - protein, 17 aa, Mycobacterium
WVLAGAAFRLLGTSRAA

SEQ ID NO: 1288882 - protein, 17 aa, Mycobacterium
WVNTIFLSTRFRAWRVG

SEQ ID NO: 1288883 - protein, 18 aa, Mycobacterium
WWFGHTLTWARRTLQALG

SEQ ID NO: 1288884 - protein, 17 aa, Mycobacterium
YAELIKRTQWWGRQMLI

SEQ ID NO: 1288885 - protein, 17 aa, Mycobacterium
YAFARRQLVSWMARRHG

SEQ ID NO: 1288886 - protein, 17 aa, Mycobacterium
YASLGLRLDYDPHLRRV

SEQ ID NO: 1288887 - protein, 22 aa, Mycobacterium
YAVPRLLARNGLTLQDFDFYEI

SEQ ID NO: 1288888 - protein, 20 aa, Mycobacterium
YDAAVAWARRFTDYPPQVLA

SEQ ID NO: 1288889 - protein, 23 aa, Mycobacterium
YDHLTLSWVYDWMARGVPVVAMH

SEQ ID NO: 1288890 - protein, 21 aa, Mycobacterium
YDILFFWVARMMMFGTFVADD

SEQ ID NO: 1288891 - protein, 19 aa, Mycobacterium
YDKLKRFPAGFVVLGDAFC

SEQ ID NO: 1288892 - protein, 23 aa, Mycobacterium
YEDRTGPPIVEWLTGRGVDTPDP

SEQ ID NO: 1288893 - protein, 17 aa, Mycobacterium
YEFTRPGADITLFRRTM

SEQ ID NO: 1288894 - protein, 23 aa, Mycobacterium
YEIKGCIAHGGLGWVYLAFDHNV

SEQ ID NO: 1288895 - protein, 17 aa, Mycobacterium
YEIYRLDAVPGTDKLPY

SEQ ID NO: 1288896 - protein, 17 aa, Mycobacterium
YELARPAADISIADVLR

SEQ ID NO: 1288897 - protein, 21 aa, Mycobacterium
YEWAYEYLDVVYKLWEGSWDE

SEQ ID NO: 1288898 - protein, 18 aa, Mycobacterium
YFYSCHRCRNCLLGRRGA

SEQ ID NO: 1288899 - protein, 18 aa, Mycobacterium
YGEMLARIDAFAGALADR

SEQ ID NO: 1288900 - protein, 21 aa, Mycobacterium
YGISWILPRLVGFGAAMDLLL

SEQ ID NO: 1288901 - protein, 22 aa, Mycobacterium
YGLAGLRIGYAVADADIVTALG

SEQ ID NO: 1288902 - protein, 23 aa, Mycobacterium
YGNVLRFLPPLAISDELLDEGLD

SEQ ID NO: 1288903 - protein, 18 aa, Mycobacterium
YGRPVVVMAHGFGGTMDS

SEQ ID NO: 1288904 - protein, 18 aa, Mycobacterium
YGRRLRAAVIGFGATARG

SEQ ID NO: 1288905 - protein, 17 aa, Mycobacterium
YGVGLINWWDPKGTRST

SEQ ID NO: 1288906 - protein, 17 aa, Mycobacterium
YHAWRYALNGDLTFIQQ

SEQ ID NO: 1288907 - protein, 17 aa, Mycobacterium
YHGWRYGLDGALKFVQQ

SEQ ID NO: 1288908 - protein, 23 aa, Mycobacterium
YHKIHLYDAFGFRESRTVAPGSE

SEQ ID NO: 1288909 - protein, 19 aa, Mycobacterium
YILELEPFASLPVEQIAET

SEQ ID NO: 1288910 - protein, 17 aa, Mycobacterium
YIMECLQLMASRRATTI

SEQ ID NO: 1288911 - protein, 18 aa, Mycobacterium
YKDMEAWGRKMFVTPGVV

SEQ ID NO: 1288912 - protein, 17 aa, Mycobacterium
YKGACIFLNRPGFAGGI

SEQ ID NO: 1288913 - protein, 24 aa, Mycobacterium
YKSEPWARLGVDVEHDFEPLYIIS

SEQ ID NO: 1288914 - protein, 19 aa, Mycobacterium
YKVPTRWAVVGADQLPVLA

SEQ ID NO: 1288915 - protein, 21 aa, Mycobacterium
YKWRKWLYFDCNWKVAMEAFN

SEQ ID NO: 1288916 - protein, 17 aa, Mycobacterium
YLERDGLEVAIARDGTE

SEQ ID NO: 1288917 - protein, 18 aa, Mycobacterium
YLLDFSRRFPDAAVIRLE

SEQ ID NO: 1288918 - protein, 20 aa, Mycobacterium
YLPALACARCRAIARCRHCT

SEQ ID NO: 1288919 - protein, 19 aa, Mycobacterium
YLPPFAPTAFRWQSEHATH

SEQ ID NO: 1288920 - protein, 22 aa, Mycobacterium
YLRIAPELFLKRALVGGFEKVF

SEQ ID NO: 1288921 - protein, 20 aa, Mycobacterium
YLRPRAVVFHRSLGAKFADV

SEQ ID NO: 1288922 - protein, 19 aa, Mycobacterium
YLVPHWPKPWGRAAGTLEQ

SEQ ID NO: 1288923 - protein, 23 aa, Mycobacterium
YLWSKRVAALFARALRANPDLHL

SEQ ID NO: 1288924 - protein, 22 aa, Mycobacterium
YLYPRVEVEVGFILADDLPGAG

SEQ ID NO: 1288925 - protein, 21 aa, Mycobacterium
YPCDHFDVWPGHDWHDRAATD

SEQ ID NO: 1288926 - protein, 18 aa, Mycobacterium
YPDLAIPFHSRWRHFEAG

SEQ ID NO: 1288927 - protein, 17 aa, Mycobacterium
YPGDVFAGFGLGAAVSV

SEQ ID NO: 1288928 - protein, 20 aa, Mycobacterium
YPPEAIDWLLPRGAHTVLDL

SEQ ID NO: 1288929 - protein, 17 aa, Mycobacterium
YPPILAMTSLNDTRVYY

SEQ ID NO: 1288930 - protein, 19 aa, Mycobacterium
YPQILLRVGWAPVNADPLP

SEQ ID NO: 1288931 - protein, 18 aa, Mycobacterium
YRCGIAWRDVPEVFGPWQ

SEQ ID NO: 1288932 - protein, 18 aa, Mycobacterium
YREYSLRPPKGVLLYGPP

SEQ ID NO: 1288933 - protein, 18 aa, Mycobacterium
YRGDLAWWAGPWPVDERW

SEQ ID NO: 1288934 - protein, 19 aa, Mycobacterium
YRIPLTIIRICSTYGPEGG

SEQ ID NO: 1288935 - protein, 18 aa, Mycobacterium
YRNGGLLLDAGVLALRTP

SEQ ID NO: 1288936 - protein, 18 aa, Mycobacterium
YRPGARFGPAHIRASSKL

SEQ ID NO: 1288937 - protein, 19 aa, Mycobacterium
YRRVLAMAWEKQSESNAMW

SEQ ID NO: 1288938 - protein, 19 aa, Mycobacterium
YRTGAGWSRGFGASRQNGP

SEQ ID NO: 1288939 - protein, 19 aa, Mycobacterium
YRTMRGYKVERRFGWDTHG

SEQ ID NO: 1288940 - protein, 18 aa, Mycobacterium
YRVAGYRSGWLVITGPKE

SEQ ID NO: 1288941 - protein, 19 aa, Mycobacterium
YRVDAVAAFELLKWRAAEA

SEQ ID NO: 1288942 - protein, 19 aa, Mycobacterium
YRVSWPRHCVVGTDGAEFH

SEQ ID NO: 1288943 - protein, 20 aa, Mycobacterium
YSALRLAPRFVDPSTLNPPG

SEQ ID NO: 1288944 - protein, 23 aa, Mycobacterium
YSDARAAFQVGMWVNRTERETTV

SEQ ID NO: 1288945 - protein, 20 aa, Mycobacterium
YSDIADWCLVLARTDKEVPR

SEQ ID NO: 1288946 - protein, 18 aa, Mycobacterium
YSIRGVIGPDEFHSGYPD

SEQ ID NO: 1288947 - protein, 17 aa, Mycobacterium
YSPACVERGVLSGLSFK

SEQ ID NO: 1288948 - protein, 29 aa, Mycobacterium
YSPRLRPGTPVSFPLDWSELSAVTPGDFT

SEQ ID NO: 1288949 - protein, 23 aa, Mycobacterium
YSYYGEVLLDWVVERLANQKGSA

SEQ ID NO: 1288950 - protein, 17 aa, Mycobacterium
YTGVLGFRSRGAFRVPV

SEQ ID NO: 1288951 - protein, 23 aa, Mycobacterium
YTKCAELGLPLCINTGLPGPPIP

SEQ ID NO: 1288952 - protein, 23 aa, Mycobacterium
YTVPEFRRKAVIIAVGGVYDPRI

SEQ ID NO: 1288953 - protein, 17 aa, Mycobacterium
YVAKYTICPAVAHGLDG

SEQ ID NO: 1288954 - protein, 18 aa, Mycobacterium
YVKPVFKLGWSRRLAPLM

SEQ ID NO: 1288955 - protein, 18 aa, Mycobacterium
YVLAEARLAAYAREIGEE

SEQ ID NO: 1288956 - protein, 19 aa, Mycobacterium
YYAMTGWRLGWLLVPQELR

SEQ ID NO: 1288957 - protein, 19 aa, Mycobacterium
YYLASAFREVWMQPSGTVG

SEQ ID NO: 1288958 - protein, 17 aa, Mycobacterium
AAALCFPSYPQFCGQYF

SEQ ID NO: 1288959 - protein, 17 aa, Mycobacterium
AAALREFAHQAGVPMDQ

SEQ ID NO: 1288960 - protein, 17 aa, Mycobacterium
AACNIYADLGWRGVIPV

SEQ ID NO: 1288961 - protein, 17 aa, Mycobacterium
AACRAVWNTGLEQRREY

SEQ ID NO: 1288962 - protein, 21 aa, Mycobacterium
AACRRWRVAEIIADPFRWTRT

SEQ ID NO: 1288963 - protein, 24 aa, Mycobacterium
AAGEPRLAAAVPFYGPTPENPDFS

SEQ ID NO: 1288964 - protein, 17 aa, Mycobacterium
AAGPVWWDPQMRTTSDY

SEQ ID NO: 1288965 - protein, 17 aa, Mycobacterium
AAIPHLLEHGGSLVNIS

SEQ ID NO: 1288966 - protein, 18 aa, Mycobacterium
AAKGLPYVFAHHFSGQGT

SEQ ID NO: 1288967 - protein, 22 aa, Mycobacterium
AAMKLFWERGFDGVSISDVTAA

SEQ ID NO: 1288968 - protein, 21 aa, Mycobacterium
AANRWPAVRFAVRNTIVQGPN

SEQ ID NO: 1288969 - protein, 19 aa, Mycobacterium
AAQALPRRDRVVLIGQAPL

SEQ ID NO: 1288970 - protein, 24 aa, Mycobacterium
AARKAGKPEPEWGIKPFDFVLATS

SEQ ID NO: 1288971 - protein, 20 aa, Mycobacterium
AARLRAQMAFVRSRVGESGA

SEQ ID NO: 1288972 - protein, 19 aa, Mycobacterium
AARTWIREQCSFLPTRIDP

SEQ ID NO: 1288973 - protein, 17 aa, Mycobacterium
AASLFGYVNEWCPRHGY

SEQ ID NO: 1288974 - protein, 19 aa, Mycobacterium
AAVKLLWLAICNIEDKRAA

SEQ ID NO: 1288975 - protein, 18 aa, Mycobacterium
AAVSRLSYDGRLQSNDAV

SEQ ID NO: 1288976 - protein, 17 aa, Mycobacterium
ACGLEPRLAVPLLAPVL

SEQ ID NO: 1288977 - protein, 17 aa, Mycobacterium
ACHFCLFLSETSCERTN

SEQ ID NO: 1288978 - protein, 18 aa, Mycobacterium
ADALWRYALKLTGDAATA

SEQ ID NO: 1288979 - protein, 18 aa, Mycobacterium
ADDRAVWTWLTQIRSAVP

SEQ ID NO: 1288980 - protein, 19 aa, Mycobacterium
ADEYWPTLAAQLAEAAPTN

SEQ ID NO: 1288981 - protein, 18 aa, Mycobacterium
ADGSFEWRFTPEVPSQLV

SEQ ID NO: 1288982 - protein, 17 aa, Mycobacterium
ADGSGWLARNLVGGTHV

SEQ ID NO: 1288983 - protein, 19 aa, Mycobacterium
ADGWSRLASALALTGVDVG

SEQ ID NO: 1288984 - protein, 19 aa, Mycobacterium
ADIERLEFLAARGWLIVRV

SEQ ID NO: 1288985 - protein, 19 aa, Mycobacterium
ADIRLRWAESMADAAREIR

SEQ ID NO: 1288986 - protein, 19 aa, Mycobacterium
ADLGLPHPVWQRLADTVDL

SEQ ID NO: 1288987 - protein, 18 aa, Mycobacterium
ADLWRAAADLGWHGLAVA

SEQ ID NO: 1288988 - protein, 21 aa, Mycobacterium
ADNSLMLWFEVMKPLMSTSAE

SEQ ID NO: 1288989 - protein, 21 aa, Mycobacterium
AEALRALGIRVWSDVPVGAST

SEQ ID NO: 1288990 - protein, 18 aa, Mycobacterium
AEAPVPMPDPSNRQTDPA

SEQ ID NO: 1288991 - protein, 24 aa, Mycobacterium
AEEVKYPVEWAVGIFRSPSGTETV

SEQ ID NO: 1288992 - protein, 27 aa, Mycobacterium
AEGLPRLAGVPGWFACDVIQLVEAADH

SEQ ID NO: 1288993 - protein, 18 aa, Mycobacterium
AEHFPRLDIAVEVVDEPA

SEQ ID NO: 1288994 - protein, 19 aa, Mycobacterium
AEHWSGFGDAEMVFAEPPK

SEQ ID NO: 1288995 - protein, 21 aa, Mycobacterium
AEIALAWSRDRARAMPEIEQA

SEQ ID NO: 1288996 - protein, 20 aa, Mycobacterium
AEIYADLGLRFDGARAEAVS

SEQ ID NO: 1288997 - protein, 18 aa, Mycobacterium
AEKYLGIIDRVRAAIPDA

SEQ ID NO: 1288998 - protein, 17 aa, Mycobacterium
AEMPPFLTGGSMIETVT

SEQ ID NO: 1288999 - protein, 19 aa, Mycobacterium
AENRVDAVVGWHQAGGDLA

SEQ ID NO: 1289000 - protein, 22 aa, Mycobacterium
AEPGRAHAYLRLGGQEPVVETV

SEQ ID NO: 1289001 - protein, 21 aa, Mycobacterium
AEPLLRRIDVLAAQGHPGAQQ

SEQ ID NO: 1289002 - protein, 17 aa, Mycobacterium
AEQSVWRRAFEAARPRA

SEQ ID NO: 1289003 - protein, 17 aa, Mycobacterium
AEQVMEWAGLDLLILRI

SEQ ID NO: 1289004 - protein, 17 aa, Mycobacterium
AETFPGAQILAAFGQTE

SEQ ID NO: 1289005 - protein, 20 aa, Mycobacterium
AEVVRTWLLDHERTWVAVDF

SEQ ID NO: 1289006 - protein, 24 aa, Mycobacterium
AFHPDRFRYAGSMSGFMTPSATTL

SEQ ID NO: 1289007 - protein, 17 aa, Mycobacterium
AFIPRSVWQRMGDDFLA

SEQ ID NO: 1289008 - protein, 18 aa, Mycobacterium
AFRIPELIRWPGKIEPRS

SEQ ID NO: 1289009 - protein, 19 aa, Mycobacterium
AGDDWLCLLEAFDQPHRSG

SEQ ID NO: 1289010 - protein, 20 aa, Mycobacterium
AGDITVFWRLAATSGGSVGS

SEQ ID NO: 1289011 - protein, 18 aa, Mycobacterium
AGGAVGWIAVQLAREAGA

SEQ ID NO: 1289012 - protein, 17 aa, Mycobacterium
AGGMGVLGCVRFNDSDD

SEQ ID NO: 1289013 - protein, 24 aa, Mycobacterium
AGHLRAGVIVRVWHGVYSLGPPDT

SEQ ID NO: 1289014 - protein, 19 aa, Mycobacterium
AGLKSPLPHPWRPADSSNE

SEQ ID NO: 1289015 - protein, 17 aa, Mycobacterium
AGNRVRYALVVSVETAE

SEQ ID NO: 1289016 - protein, 17 aa, Mycobacterium
AGPRLRTLITYDPDLSR

SEQ ID NO: 1289017 - protein, 23 aa, Mycobacterium
AGSLRPGDLAVWDGHVAMIVGDG

SEQ ID NO: 1289018 - protein, 17 aa, Mycobacterium
AHPGLEAKLVRGIAWTE

SEQ ID NO: 1289019 - protein, 18 aa, Mycobacterium
AKGAWLWSGRDAVAVGLS

SEQ ID NO: 1289020 - protein, 22 aa, Mycobacterium
AKLAELQRLWLIEAVKYDVLPI

SEQ ID NO: 1289021 - protein, 20 aa, Mycobacterium
AKLRCERCSWVVALNRGTVE

SEQ ID NO: 1289022 - protein, 17 aa, Mycobacterium
AKLRMARLVRTRREGTT

SEQ ID NO: 1289023 - protein, 20 aa, Mycobacterium
AKWKLAIVLEQGFQRAGDDE

SEQ ID NO: 1289024 - protein, 19 aa, Mycobacterium
ALAALVFWRLIALGKPVSA

SEQ ID NO: 1289025 - protein, 17 aa, Mycobacterium
ALAHHWNIPQARPHDAL

SEQ ID NO: 1289026 - protein, 17 aa, Mycobacterium
ALARAAFQLGVLERALE

SEQ ID NO: 1289027 - protein, 17 aa, Mycobacterium
ALARAGLDLADIDLIEL

SEQ ID NO: 1289028 - protein, 17 aa, Mycobacterium
ALARFTLQVGRPVGPML

SEQ ID NO: 1289029 - protein, 18 aa, Mycobacterium
ALHFPWKINAGVTAVDLM

SEQ ID NO: 1289030 - protein, 20 aa, Mycobacterium
ALHRRWWAADGLGAFVTVSG

SEQ ID NO: 1289031 - protein, 20 aa, Mycobacterium
ALLRFPARFFTTAPVSRVAA

SEQ ID NO: 1289032 - protein, 18 aa, Mycobacterium
ALNAGFLWACSGYYNYDK

SEQ ID NO: 1289033 - protein, 23 aa, Mycobacterium
ALPRLEPGVALPCCRQTVHRGVV

SEQ ID NO: 1289034 - protein, 19 aa, Mycobacterium
ALRRAGLDPADWDVTGITA

SEQ ID NO: 1289035 - protein, 23 aa, Mycobacterium
ALSALRPGPIHFLRRMKEDLVDY

SEQ ID NO: 1289036 - protein, 18 aa, Mycobacterium
ALSARPGIVLSRRQLLEI

SEQ ID NO: 1289037 - protein, 17 aa, Mycobacterium
ALVLGDWPETPAGDLPA

SEQ ID NO: 1289038 - protein, 19 aa, Mycobacterium
ALWELPRAAAILMKLYRNA

SEQ ID NO: 1289039 - protein, 17 aa, Mycobacterium
ALYPEWDVFNDRYKPDW

SEQ ID NO: 1289040 - protein, 20 aa, Mycobacterium
ANLKCLCRKHHLLKTFWTGE

SEQ ID NO: 1289041 - protein, 17 aa, Mycobacterium
APDRLRWVIGEAGKAIE

SEQ ID NO: 1289042 - protein, 19 aa, Mycobacterium
APGHPMLRVDRLYSDDADR

SEQ ID NO: 1289043 - protein, 23 aa, Mycobacterium
APIRRGVVVAGRIGIDDVAPVVS

SEQ ID NO: 1289044 - protein, 17 aa, Mycobacterium
APPRFAEEIAWWVWWCW

SEQ ID NO: 1289045 - protein, 17 aa, Mycobacterium
APQLKPEVWAVAFDPDS

SEQ ID NO: 1289046 - protein, 23 aa, Mycobacterium
APRWDTAIIGLDWETTVLDERLA

SEQ ID NO: 1289047 - protein, 19 aa, Mycobacterium
AQFMAVFGLYAQRIDQVLD

SEQ ID NO: 1289048 - protein, 18 aa, Mycobacterium
AQIPHPWFDLIFAGGHEK

SEQ ID NO: 1289049 - protein, 25 aa, Mycobacterium
AQLDRFAIRLELRYLSGPDEVTMLR

SEQ ID NO: 1289050 - protein, 17 aa, Mycobacterium
AQLRRSGTLTGRHLDDR

SEQ ID NO: 1289051 - protein, 19 aa, Mycobacterium
AQRAGLMGAFVIGLATTRY

SEQ ID NO: 1289052 - protein, 18 aa, Mycobacterium
ARAAMPVPAGWSGTEHLD

SEQ ID NO: 1289053 - protein, 18 aa, Mycobacterium
ARAAVRIVRRVTGRRYTI

SEQ ID NO: 1289054 - protein, 24 aa, Mycobacterium
ARDYPRLVAELGLDDTVLAELVGG

SEQ ID NO: 1289055 - protein, 22 aa, Mycobacterium
ARFPELSTWRCNLRELREWPPE

SEQ ID NO: 1289056 - protein, 21 aa, Mycobacterium
ARGAFHADWFLRRILAAEERI

SEQ ID NO: 1289057 - protein, 17 aa, Mycobacterium
ARIVLCSSVSGLWGGHG

SEQ ID NO: 1289058 - protein, 17 aa, Mycobacterium
ARLGHSVAFFIGTAYGS

SEQ ID NO: 1289059 - protein, 17 aa, Mycobacterium
ARNHVFQLYAYVQSQHG

SEQ ID NO: 1289060 - protein, 17 aa, Mycobacterium
ARQLWFDRILPLAENIR

SEQ ID NO: 1289061 - protein, 21 aa, Mycobacterium
ARQRTGVGISRLISAGNEATI

SEQ ID NO: 1289062 - protein, 17 aa, Mycobacterium
ARRELRLYLNVEVGTHL

SEQ ID NO: 1289063 - protein, 19 aa, Mycobacterium
ARRRWLMQHVRAGVVQTSD

SEQ ID NO: 1289064 - protein, 18 aa, Mycobacterium
ARSALMLSATRDLPALGA

SEQ ID NO: 1289065 - protein, 24 aa, Mycobacterium
ARVRLRGGAVLVELADRFGEAVAA

SEQ ID NO: 1289066 - protein, 19 aa, Mycobacterium
ARVSAGHRCPGWLTRSWTS

SEQ ID NO: 1289067 - protein, 25 aa, Mycobacterium
ARYTWPRFVCGLPREFFAAVRAEMS

SEQ ID NO: 1289068 - protein, 19 aa, Mycobacterium
ASDLFYVWIKRALAGSWPE

SEQ ID NO: 1289069 - protein, 33 aa, Mycobacterium
ASLAHRCAVAMPWEWRQANAFSEQERLKVAARH

SEQ ID NO: 1289070 - protein, 20 aa, Mycobacterium
ASLPGLQTGEAWVWSPAFLR

SEQ ID NO: 1289071 - protein, 17 aa, Mycobacterium
ASLTPWLSVGELIAERL

SEQ ID NO: 1289072 - protein, 23 aa, Mycobacterium
ASPKETWLRLLLIDNGYDSLTTQ

SEQ ID NO: 1289073 - protein, 17 aa, Mycobacterium
ASVVLKFQKDLGIPDEK

SEQ ID NO: 1289074 - protein, 18 aa, Mycobacterium
ASYWRRWSTLTSVVLQVE

SEQ ID NO: 1289075 - protein, 18 aa, Mycobacterium
ATPVKEFMRTAAADTEVR

SEQ ID NO: 1289076 - protein, 17 aa, Mycobacterium
ATQRAKAAWLWSRRHGV

SEQ ID NO: 1289077 - protein, 17 aa, Mycobacterium
ATRGDGRIVFWFTPSTH

SEQ ID NO: 1289078 - protein, 23 aa, Mycobacterium
AVERQGLPYGWALTSSGRLSGVT

SEQ ID NO: 1289079 - protein, 17 aa, Mycobacterium
AVIIQFVVKTVVGMLDW

SEQ ID NO: 1289080 - protein, 19 aa, Mycobacterium
AVLARLDGIRGWQEDCYRD

SEQ ID NO: 1289081 - protein, 22 aa, Mycobacterium
AVNLYERFLWRLFSKDYSLFER

SEQ ID NO: 1289082 - protein, 23 aa, Mycobacterium
AVQRIVDHWAMFDTVRFGLNLVV

SEQ ID NO: 1289083 - protein, 17 aa, Mycobacterium
AVRLGLRKELEAIADDA

SEQ ID NO: 1289084 - protein, 24 aa, Mycobacterium
AVVHPSWWSRRRVQAVLDAAGDIC

SEQ ID NO: 1289085 - protein, 18 aa, Mycobacterium
AWGWLPLLTGVAVRDAVA

SEQ ID NO: 1289086 - protein, 18 aa, Mycobacterium
AYGRLTVVTIHFAAQTPL

SEQ ID NO: 1289087 - protein, 22 aa, Mycobacterium
AYLRATFDWHIDGCTPTGDEYP

SEQ ID NO: 1289088 - protein, 24 aa, Mycobacterium
CAAPTRMLLPRSRYDEGVALLKAL

SEQ ID NO: 1289089 - protein, 17 aa, Mycobacterium
CAQYLGPALRLLNFNNI

SEQ ID NO: 1289090 - protein, 19 aa, Mycobacterium
CAWTPEMVEQFGPAKRDSV

SEQ ID NO: 1289091 - protein, 19 aa, Mycobacterium
CDAYHDFLFAVPWADGVAV

SEQ ID NO: 1289092 - protein, 20 aa, Mycobacterium
CDPPWYRPLLGVRRAATAAA

SEQ ID NO: 1289093 - protein, 19 aa, Mycobacterium
CDVRRGSAVSLPFRDRSIS

SEQ ID NO: 1289094 - protein, 24 aa, Mycobacterium
CFACARCVACLGCARCSNCVGCVG

SEQ ID NO: 1289095 - protein, 17 aa, Mycobacterium
CGDCPRVVLGSPLAGES

SEQ ID NO: 1289096 - protein, 19 aa, Mycobacterium
CGDCPRVVLGSPLAGESLD

SEQ ID NO: 1289097 - protein, 20 aa, Mycobacterium
CGHCAFCDRGRYAACEPRYA

SEQ ID NO: 1289098 - protein, 20 aa, Mycobacterium
CGSTSRLLLHEAIADEVIDL

SEQ ID NO: 1289099 - protein, 18 aa, Mycobacterium
CIACGAIRTPGLEADAKR

SEQ ID NO: 1289100 - protein, 18 aa, Mycobacterium
CIWYFLRPGGAPVVVVAD

SEQ ID NO: 1289101 - protein, 19 aa, Mycobacterium
CLCRLHHLLKTFGGWKDQQ

SEQ ID NO: 1289102 - protein, 22 aa, Mycobacterium
CLVEKLRTAFGLEIPGLAVPVE

SEQ ID NO: 1289103 - protein, 20 aa, Mycobacterium
CMGGGMVWRLLAAGEPRLAA

SEQ ID NO: 1289104 - protein, 22 aa, Mycobacterium
CQECSRPFPLIGRLNLRQPSTR

SEQ ID NO: 1289105 - protein, 17 aa, Mycobacterium
CRSFALWAVGLMYSATG

SEQ ID NO: 1289106 - protein, 23 aa, Mycobacterium
CSEFLPGGMIFHWLSPVDLTGQW

SEQ ID NO: 1289107 - protein, 17 aa, Mycobacterium
CTASGPALRVSHSTTVC

SEQ ID NO: 1289108 - protein, 18 aa, Mycobacterium
DAAASWRPFQLAFILLQI

SEQ ID NO: 1289109 - protein, 17 aa, Mycobacterium
DAGLSWVHFPEGLGGLG

SEQ ID NO: 1289110 - protein, 22 aa, Mycobacterium
DAKWASSISGYWRRGRTEETFR

SEQ ID NO: 1289111 - protein, 17 aa, Mycobacterium
DALLRVLEPYGVRELVQ

SEQ ID NO: 1289112 - protein, 24 aa, Mycobacterium
DARFRDALFPVWRYHPFFTNTDLP

SEQ ID NO: 1289113 - protein, 20 aa, Mycobacterium
DATHFVRWLSLWSATIDDMY

SEQ ID NO: 1289114 - protein, 23 aa, Mycobacterium
DAYACAGCGTLLAVEIRAHEDEP

SEQ ID NO: 1289115 - protein, 17 aa, Mycobacterium
DCPRVVLGSPLAGESLD

SEQ ID NO: 1289116 - protein, 19 aa, Mycobacterium
DDVWLPLFRPVAGDPGELP

SEQ ID NO: 1289117 - protein, 24 aa, Mycobacterium
DEARRVSIPAGWTMAVWARVPKAR

SEQ ID NO: 1289118 - protein, 20 aa, Mycobacterium
DEIKSRILAMAAPDEHGNRP

SEQ ID NO: 1289119 - protein, 24 aa, Mycobacterium
DELRRYQMQSGFVFQSHNLFPHKT

SEQ ID NO: 1289120 - protein, 17 aa, Mycobacterium
DEPFKWVAPQLISPNGG

SEQ ID NO: 1289121 - protein, 17 aa, Mycobacterium
DERAKWATFPMLALHGW

SEQ ID NO: 1289122 - protein, 18 aa, Mycobacterium
DESVRVFLATGISEIDRP

SEQ ID NO: 1289123 - protein, 20 aa, Mycobacterium
DEVAACYPFHPMLMALAKDE

SEQ ID NO: 1289124 - protein, 23 aa, Mycobacterium
DEVLRLAPNVWPRNAVRGADGVV

SEQ ID NO: 1289125 - protein, 19 aa, Mycobacterium
DFIEACAWIKENLPGVHIS

SEQ ID NO: 1289126 - protein, 18 aa, Mycobacterium
DGGRAALVLGDWPETPAG

SEQ ID NO: 1289127 - protein, 22 aa, Mycobacterium
DGKCLRSTFAYLGWLAGAAPDD

SEQ ID NO: 1289128 - protein, 21 aa, Mycobacterium
DGKRAGLWPGLKETFNSGSTE

SEQ ID NO: 1289129 - protein, 19 aa, Mycobacterium
DGLCERLREQGVRLIYDEP

SEQ ID NO: 1289130 - protein, 17 aa, Mycobacterium
DGLGYRGFWMGYFAARS

SEQ ID NO: 1289131 - protein, 17 aa, Mycobacterium
DGLRAGQWVDVYDLAVG

SEQ ID NO: 1289132 - protein, 24 aa, Mycobacterium
DGLRRFGDRWVRWGDTIADKIEAA

SEQ ID NO: 1289133 - protein, 20 aa, Mycobacterium
DGRLDEWLGLLAPDVRYTMP

SEQ ID NO: 1289134 - protein, 20 aa, Mycobacterium
DGRWYWHWDPAFLTKPGDDP

SEQ ID NO: 1289135 - protein, 20 aa, Mycobacterium
DGSVSWAPVWARYGTNNRSC

SEQ ID NO: 1289136 - protein, 21 aa, Mycobacterium
DGTRLAEHWQLLPSGVAGFHE

SEQ ID NO: 1289137 - protein, 23 aa, Mycobacterium
DGWPNQRFALLFPAWLAAHPEVR

SEQ ID NO: 1289138 - protein, 18 aa, Mycobacterium
DHTVPWPAGPTCAANLKC

SEQ ID NO: 1289139 - protein, 22 aa, Mycobacterium
DHVAGRPYGLWVHGNNDTVGAV

SEQ ID NO: 1289140 - protein, 22 aa, Mycobacterium
DIFSIRIPKPWFVLMPTPVWDQ

SEQ ID NO: 1289141 - protein, 19 aa, Mycobacterium
DIHPSMRLRIEHYLQHRDS

SEQ ID NO: 1289142 - protein, 19 aa, Mycobacterium
DKLDLRSGITFNTKVTSAV

SEQ ID NO: 1289143 - protein, 17 aa, Mycobacterium
DKLSLPFTERWSTQGRQ

SEQ ID NO: 1289144 - protein, 22 aa, Mycobacterium
DLGKRFRRVLGRTVPLATLLGG

SEQ ID NO: 1289145 - protein, 19 aa, Mycobacterium
DLIPLRLAIPAQFRAEGDP

SEQ ID NO: 1289146 - protein, 18 aa, Mycobacterium
DLLVASLHRWLSACETDA

SEQ ID NO: 1289147 - protein, 18 aa, Mycobacterium
DLMDLHFFGPAALVRAAL

SEQ ID NO: 1289148 - protein, 18 aa, Mycobacterium
DLREDWPAALRVAGFDSA

SEQ ID NO: 1289149 - protein, 23 aa, Mycobacterium
DLRVGPHPGWRIEVDGADVTVHA

SEQ ID NO: 1289150 - protein, 18 aa, Mycobacterium
DPDECVRLAAAVVEQTGR

SEQ ID NO: 1289151 - protein, 29 aa, Mycobacterium
DPDTGLPRLGWRTPPLGGFRADPDAPIVF

SEQ ID NO: 1289152 - protein, 23 aa, Mycobacterium
DPQHRLFLQTAWHAMEDAGCDPA

SEQ ID NO: 1289153 - protein, 20 aa, Mycobacterium
DPRAAAIVDRCESMSPEAML

SEQ ID NO: 1289154 - protein, 18 aa, Mycobacterium
DPRMMVAVLLYGYTVGVC

SEQ ID NO: 1289155 - protein, 18 aa, Mycobacterium
DPVKGFFRALDFTLPWDV

SEQ ID NO: 1289156 - protein, 19 aa, Mycobacterium
DRHRFGCTVSRAAWNPTQS

SEQ ID NO: 1289157 - protein, 17 aa, Mycobacterium
DRLKAELDQLIANRPVI

SEQ ID NO: 1289158 - protein, 21 aa, Mycobacterium
DSEPGRPLWPMIILRTPKGWT

SEQ ID NO: 1289159 - protein, 24 aa, Mycobacterium
DSERRIALALARMVPGAREVRIGA

SEQ ID NO: 1289160 - protein, 19 aa, Mycobacterium
DSFQLFPNFVVLFWGQGWY

SEQ ID NO: 1289161 - protein, 22 aa, Mycobacterium
DSRAYRLPWPDGTVVYEIDQPA

SEQ ID NO: 1289162 - protein, 20 aa, Mycobacterium
DSRGRTGIVITELPYQVNHD

SEQ ID NO: 1289163 - protein, 18 aa, Mycobacterium
DSTHWWKHICTRTDVAIG

SEQ ID NO: 1289164 - protein, 18 aa, Mycobacterium
DTPWWAHDIWDLRADPRI

SEQ ID NO: 1289165 - protein, 22 aa, Mycobacterium
DVPWFPKDVDHWSVRWVALHLT

SEQ ID NO: 1289166 - protein, 19 aa, Mycobacterium
DVVNYLRWFTFLEAGELAE

SEQ ID NO: 1289167 - protein, 18 aa, Mycobacterium
DYLRLADAFAQFGNGAPV

SEQ ID NO: 1289168 - protein, 19 aa, Mycobacterium
EAGLHWRQIQLVAGADTIR

SEQ ID NO: 1289169 - protein, 18 aa, Mycobacterium
EAMVAAWVAGVDREIVAT

SEQ ID NO: 1289170 - protein, 19 aa, Mycobacterium
EANVALSRWGMLAPDGQCK

SEQ ID NO: 1289171 - protein, 19 aa, Mycobacterium
EARIKLADMRSGRMSDDDW

SEQ ID NO: 1289172 - protein, 18 aa, Mycobacterium
EASKLYLTQMVKHHEGAI

SEQ ID NO: 1289173 - protein, 22 aa, Mycobacterium
EASRLFLTQMIEHHKGAITMAQ

SEQ ID NO: 1289174 - protein, 18 aa, Mycobacterium
EASWLPGQVQVFIHGEAQ

SEQ ID NO: 1289175 - protein, 18 aa, Mycobacterium
EAVLSHFVAQIDAEESAD

SEQ ID NO: 1289176 - protein, 20 aa, Mycobacterium
EAYPQVLIRLGWAPADGTAL

SEQ ID NO: 1289177 - protein, 21 aa, Mycobacterium
EDYREAIALSRLGWAALAVGT

SEQ ID NO: 1289178 - protein, 24 aa, Mycobacterium
EFGFDPRGGFGFGPGPRGRRGGGR

SEQ ID NO: 1289179 - protein, 18 aa, Mycobacterium
EFLALKVEGVLDCAELLV

SEQ ID NO: 1289180 - protein, 18 aa, Mycobacterium
EGGGRYWGRHGAAGLLLR

SEQ ID NO: 1289181 - protein, 18 aa, Mycobacterium
EGLEIPLLIGGATTSRAH

SEQ ID NO: 1289182 - protein, 20 aa, Mycobacterium
EGLIAWSRERMAGFKVPRYV

SEQ ID NO: 1289183 - protein, 19 aa, Mycobacterium
EGSWKKVLITALRVSGAEA

SEQ ID NO: 1289184 - protein, 17 aa, Mycobacterium
EGYWRLQGPNLWPAQPP

SEQ ID NO: 1289185 - protein, 20 aa, Mycobacterium
EHHPHLLPLAGRVLEATDAE

SEQ ID NO: 1289186 - protein, 20 aa, Mycobacterium
EHIPCWLITDIRSFHRYVVG

SEQ ID NO: 1289187 - protein, 18 aa, Mycobacterium
EHPRPGWVGQRLPYQQAR

SEQ ID NO: 1289188 - protein, 20 aa, Mycobacterium
EIAEGWQPVFFYPEKADAVW

SEQ ID NO: 1289189 - protein, 19 aa, Mycobacterium
EIDAACELIDFWRFNVAFA

SEQ ID NO: 1289190 - protein, 17 aa, Mycobacterium
ELADRFATIAARVLGPG

SEQ ID NO: 1289191 - protein, 18 aa, Mycobacterium
ELAYREASGWGHPVQPGL

SEQ ID NO: 1289192 - protein, 18 aa, Mycobacterium
ELDWPATWLDRAGRDRAP

SEQ ID NO: 1289193 - protein, 19 aa, Mycobacterium
ELFVTCAQAAFAHRYDPLL

SEQ ID NO: 1289194 - protein, 19 aa, Mycobacterium
ELIGPALEDWAKWGQARHD

SEQ ID NO: 1289195 - protein, 20 aa, Mycobacterium
ELNPRLQTFRDWLAGHRDEI

SEQ ID NO: 1289196 - protein, 21 aa, Mycobacterium
ELRQRIGMVFQQFNLFPHRSV

SEQ ID NO: 1289197 - protein, 21 aa, Mycobacterium
ELRVLRLDTEYAWAEDPPSRI

SEQ ID NO: 1289198 - protein, 17 aa, Mycobacterium
EMEREGLEIPLLIGGAT

SEQ ID NO: 1289199 - protein, 23 aa, Mycobacterium
EPFDAVVCSLVLCSVDDPDGVLR

SEQ ID NO: 1289200 - protein, 21 aa, Mycobacterium
EPRLWNMWTVLPILQDTTIVA

SEQ ID NO: 1289201 - protein, 17 aa, Mycobacterium
EPTVLPAQWPVLLCNGA

SEQ ID NO: 1289202 - protein, 19 aa, Mycobacterium
EQFFPAFGSMTFDDSVQEG

SEQ ID NO: 1289203 - protein, 19 aa, Mycobacterium
EQPRLLIKWVEACYGATSV

SEQ ID NO: 1289204 - protein, 21 aa, Mycobacterium
ERARYRAHWLVARTAEHIGGW

SEQ ID NO: 1289205 - protein, 20 aa, Mycobacterium
EREGLEIPLLIGGATTSRAH

SEQ ID NO: 1289206 - protein, 17 aa, Mycobacterium
ERLREQGVRLIYDEPRR

SEQ ID NO: 1289207 - protein, 23 aa, Mycobacterium
ERNRPLLELSWDYVMDGDEPSGE

SEQ ID NO: 1289208 - protein, 23 aa, Mycobacterium
ERTPEDWLFKACVGDDFVIDVLH

SEQ ID NO: 1289209 - protein, 17 aa, Mycobacterium
ERWDFRTGGGYRYVHSD

SEQ ID NO: 1289210 - protein, 19 aa, Mycobacterium
ERYGQCVAAVIARREGATL

SEQ ID NO: 1289211 - protein, 24 aa, Mycobacterium
ESPKETWLRLLIVRAGFPRPETQL

SEQ ID NO: 1289212 - protein, 18 aa, Mycobacterium
ETEVWRWYLIDKNAPDDV

SEQ ID NO: 1289213 - protein, 22 aa, Mycobacterium
ETNVEFWAAVILDFAQVPASMM

SEQ ID NO: 1289214 - protein, 20 aa, Mycobacterium
ETPCAVVAFASWPEEIVLRG

SEQ ID NO: 1289215 - protein, 20 aa, Mycobacterium
ETRSIAGFFSFDPVRAEVSA

SEQ ID NO: 1289216 - protein, 18 aa, Mycobacterium
ETWLRLLLIDAGFPRPTT

SEQ ID NO: 1289217 - protein, 20 aa, Mycobacterium
EVALKHPIKLIANALGSPPK

SEQ ID NO: 1289218 - protein, 21 aa, Mycobacterium
EVLGFCALLLVAGYETTTNLL

SEQ ID NO: 1289219 - protein, 22 aa, Mycobacterium
EVPLKRFDLMNGIQVRGTYAVT

SEQ ID NO: 1289220 - protein, 20 aa, Mycobacterium
EVPRIAAALADFDEVEIDTD

SEQ ID NO: 1289221 - protein, 19 aa, Mycobacterium
EVVHRIRCAAGAFADLGIG

SEQ ID NO: 1289222 - protein, 24 aa, Mycobacterium
EWLARGGVMLPIYQREAMWLSFDA

SEQ ID NO: 1289223 - protein, 21 aa, Mycobacterium
EWPDHPFALGVHWHPEDPLMH

SEQ ID NO: 1289224 - protein, 17 aa, Mycobacterium
EYLEPRWMIGIDPESEG

SEQ ID NO: 1289225 - protein, 23 aa, Mycobacterium
EYRSWPVWAHDAAMIYTPGRDDT

SEQ ID NO: 1289226 - protein, 21 aa, Mycobacterium
EYYTPFGWLRGFPFLAVQVVW

SEQ ID NO: 1289227 - protein, 20 aa, Mycobacterium
FAAGRLSYFLGVRGPAVVVD

SEQ ID NO: 1289228 - protein, 17 aa, Mycobacterium
FADKGWSKNVWDTIGAT

SEQ ID NO: 1289229 - protein, 17 aa, Mycobacterium
FAGIDPWRSPAGPVPEY

SEQ ID NO: 1289230 - protein, 17 aa, Mycobacterium
FALSEGGIGWVPYFLER

SEQ ID NO: 1289231 - protein, 19 aa, Mycobacterium
FAREKWTRILIPWRHESSH

SEQ ID NO: 1289232 - protein, 21 aa, Mycobacterium
FARRFGVTVVDGFGSTEGGVA

SEQ ID NO: 1289233 - protein, 24 aa, Mycobacterium
FDARTRFALWWVRLYGRGVQAKSE

SEQ ID NO: 1289234 - protein, 19 aa, Mycobacterium
FDEVARLGAQVTIFRLGTD

SEQ ID NO: 1289235 - protein, 18 aa, Mycobacterium
FDGRIITVPFSFKEIDSE

SEQ ID NO: 1289236 - protein, 18 aa, Mycobacterium
FDSPGRWGGPPGTPFPRQ

SEQ ID NO: 1289237 - protein, 18 aa, Mycobacterium
FDYYPLRVVRELPDGACE

SEQ ID NO: 1289238 - protein, 18 aa, Mycobacterium
FEALAGFRPVARTVDLMR

SEQ ID NO: 1289239 - protein, 21 aa, Mycobacterium
FEFRAGPVFTNLLLADEINRT

SEQ ID NO: 1289240 - protein, 21 aa, Mycobacterium
FEIKDTWFAMGLKGTGSQDIS

SEQ ID NO: 1289241 - protein, 20 aa, Mycobacterium
FEIPGLPPIMLPWPPPPPPP

SEQ ID NO: 1289242 - protein, 17 aa, Mycobacterium
FEPRLPAGYADLAAHWP

SEQ ID NO: 1289243 - protein, 20 aa, Mycobacterium
FERLCKQIPLAAPWTAPAAH

SEQ ID NO: 1289244 - protein, 18 aa, Mycobacterium
FESARRCGATTFVELSAH

SEQ ID NO: 1289245 - protein, 20 aa, Mycobacterium
FEVNEAFAPVVLAWAQDTGA

SEQ ID NO: 1289246 - protein, 21 aa, Mycobacterium
FEVNEAFAPVVLAWARDTGAD

SEQ ID NO: 1289247 - protein, 17 aa, Mycobacterium
FFMRDVRSAQYFEQMKG

SEQ ID NO: 1289248 - protein, 17 aa, Mycobacterium
FGADLPPLAGIYLAAFG

SEQ ID NO: 1289249 - protein, 17 aa, Mycobacterium
FGAEIRTHYPLQLDAEV

SEQ ID NO: 1289250 - protein, 17 aa, Mycobacterium
FGDRELRSPLVLVPVRL

SEQ ID NO: 1289251 - protein, 17 aa, Mycobacterium
FGTEWEKWHSGAGQVVR

SEQ ID NO: 1289252 - protein, 18 aa, Mycobacterium
FGYNVVRDFTGHGIGTTF

SEQ ID NO: 1289253 - protein, 17 aa, Mycobacterium
FKACVGDDFVIDVLHAL

SEQ ID NO: 1289254 - protein, 19 aa, Mycobacterium
FKLGWSRRLAPLMRRWALR

SEQ ID NO: 1289255 - protein, 17 aa, Mycobacterium
FLQRLFAGIKPRHRQQL

SEQ ID NO: 1289256 - protein, 18 aa, Mycobacterium
FLVDCGRGVQLRMAAAGI

SEQ ID NO: 1289257 - protein, 25 aa, Mycobacterium
FNDRYKPDWCRVINFPLTVAADVSD

SEQ ID NO: 1289258 - protein, 17 aa, Mycobacterium
FPPEPLASIGINATRWS

SEQ ID NO: 1289259 - protein, 18 aa, Mycobacterium
FPPFPFNVVFAMLRGQVS

SEQ ID NO: 1289260 - protein, 17 aa, Mycobacterium
FQLFRIMFEVIRGGGLD

SEQ ID NO: 1289261 - protein, 17 aa, Mycobacterium
FRFVEEMIRLGADARTD

SEQ ID NO: 1289262 - protein, 17 aa, Mycobacterium
FRNPFRLTFTPDGKLLV

SEQ ID NO: 1289263 - protein, 18 aa, Mycobacterium
FRNTIHWRVTRYDEPKEI

SEQ ID NO: 1289264 - protein, 21 aa, Mycobacterium
FSDPRIVRVWWRLTPREQEIL

SEQ ID NO: 1289265 - protein, 19 aa, Mycobacterium
FSTYATWWIRQAITRAMAD

SEQ ID NO: 1289266 - protein, 25 aa, Mycobacterium
FTLFPRIIVSMAWLPGPRAQRQLRD

SEQ ID NO: 1289267 - protein, 19 aa, Mycobacterium
FTRVVFNWIAKVTGVGGAE

SEQ ID NO: 1289268 - protein, 17 aa, Mycobacterium
FTTIAWRMAHVIVGVFA

SEQ ID NO: 1289269 - protein, 17 aa, Mycobacterium
FVACDGALWAVKELPPR

SEQ ID NO: 1289270 - protein, 25 aa, Mycobacterium
FWASWCGPCRSFAPVFDRSSQTHPD

SEQ ID NO: 1289271 - protein, 17 aa, Mycobacterium
FWISHGVKVFRVDNPHT

SEQ ID NO: 1289272 - protein, 19 aa, Mycobacterium
FWPDFPVDGLYKFRIHGAD

SEQ ID NO: 1289273 - protein, 17 aa, Mycobacterium
GAAFARLVADGATQIVI

SEQ ID NO: 1289274 - protein, 19 aa, Mycobacterium
GADGLKELFVTCAQAAFAH

SEQ ID NO: 1289275 - protein, 20 aa, Mycobacterium
GALSEWRATLIVRESACLSV

SEQ ID NO: 1289276 - protein, 24 aa, Mycobacterium
GALSEWRATLIVRESACLSVEHRR

SEQ ID NO: 1289277 - protein, 19 aa, Mycobacterium
GAPAWLRFFGVNPRHHSLA

SEQ ID NO: 1289278 - protein, 21 aa, Mycobacterium
GARRWVRMPGVHFGPDSCRFR

SEQ ID NO: 1289279 - protein, 17 aa, Mycobacterium
GAVLFKDFLALHFSQTR

SEQ ID NO: 1289280 - protein, 17 aa, Mycobacterium
GAWRPVDGVAIANERYA

SEQ ID NO: 1289281 - protein, 23 aa, Mycobacterium
GCTHPHCTVPFYWTEAHHTRDYA

SEQ ID NO: 1289282 - protein, 20 aa, Mycobacterium
GDAIKGCFDCRGVGHRFVKV

SEQ ID NO: 1289283 - protein, 21 aa, Mycobacterium
GDLARAFWRRMIDNVEQYLDE

SEQ ID NO: 1289284 - protein, 17 aa, Mycobacterium
GDPPKTAWLFTGQGSQY

SEQ ID NO: 1289285 - protein, 25 aa, Mycobacterium
GDVGRPDLLASIGFTREELADKLYD

SEQ ID NO: 1289286 - protein, 17 aa, Mycobacterium
GDVMAGWDGASTGAADT

SEQ ID NO: 1289287 - protein, 19 aa, Mycobacterium
GDVRGRWIVNAAGLGADAL

SEQ ID NO: 1289288 - protein, 22 aa, Mycobacterium
GEASRFGFVFTRRGVVPESASS

SEQ ID NO: 1289289 - protein, 18 aa, Mycobacterium
GEGGFGYDPVFLPEDSDR

SEQ ID NO: 1289290 - protein, 19 aa, Mycobacterium
GEGPRWFEGLLWFSDMFGE

SEQ ID NO: 1289291 - protein, 17 aa, Mycobacterium
GELGLDCQIIRNRGALM

SEQ ID NO: 1289292 - protein, 20 aa, Mycobacterium
GELSVGGWAARVDHIVDVSE

SEQ ID NO: 1289293 - protein, 18 aa, Mycobacterium
GEPYRIAPTVAFEDLDDG

SEQ ID NO: 1289294 - protein, 17 aa, Mycobacterium
GEWLDWFAAERITAIGM

SEQ ID NO: 1289295 - protein, 17 aa, Mycobacterium
GEWTIRFFMPSKWTMDT

SEQ ID NO: 1289296 - protein, 23 aa, Mycobacterium
GFDVSPRLAAAISDSRAELSGDT

SEQ ID NO: 1289297 - protein, 18 aa, Mycobacterium
GFVLMPWLAAEPEATLTV

SEQ ID NO: 1289298 - protein, 18 aa, Mycobacterium
GFYCGAHTQALLESSGAE

SEQ ID NO: 1289299 - protein, 19 aa, Mycobacterium
GGPAMPPPPMPLGPPPTPS

SEQ ID NO: 1289300 - protein, 24 aa, Mycobacterium
GGPDRWDFVAAYGRDGRVIAVLST

SEQ ID NO: 1289301 - protein, 23 aa, Mycobacterium
GGPRPCVVMCPGFGGTQDTPALV

SEQ ID NO: 1289302 - protein, 21 aa, Mycobacterium
GGRARCYGCGFQFAGTDDTAE

SEQ ID NO: 1289303 - protein, 20 aa, Mycobacterium
GGTPAKWARNWAERHPDVPL

SEQ ID NO: 1289304 - protein, 18 aa, Mycobacterium
GHCMGAVVAFEFARVAER

SEQ ID NO: 1289305 - protein, 22 aa, Mycobacterium
GHFEWLENLGFQFERSYYPGKV

SEQ ID NO: 1289306 - protein, 23 aa, Mycobacterium
GHFMDDFLLYWAFLSFALVRGGR

SEQ ID NO: 1289307 - protein, 18 aa, Mycobacterium
GHRCPGWLTRSWTSSTPP

SEQ ID NO: 1289308 - protein, 22 aa, Mycobacterium
GIPEQLRYAAMMDHKELLTAEP

SEQ ID NO: 1289309 - protein, 18 aa, Mycobacterium
GKALRPALSIAVCLGLGG

SEQ ID NO: 1289310 - protein, 18 aa, Mycobacterium
GKGDRVILMLGNQVELWE

SEQ ID NO: 1289311 - protein, 21 aa, Mycobacterium
GKHAASAFALWFPVETDHARY

SEQ ID NO: 1289312 - protein, 19 aa, Mycobacterium
GKHSLRWPRQATLVDAMIA

SEQ ID NO: 1289313 - protein, 21 aa, Mycobacterium
GKLGVPCRWPADAVTVCSFGD

SEQ ID NO: 1289314 - protein, 18 aa, Mycobacterium
GLADGIALWPWQRDFVDR

SEQ ID NO: 1289315 - protein, 24 aa, Mycobacterium
GLAPRIAVVKGRCFAGNAVIAGCA

SEQ ID NO: 1289316 - protein, 19 aa, Mycobacterium
GLASYLERICETWPRRQQP

SEQ ID NO: 1289317 - protein, 19 aa, Mycobacterium
GLLDVLTALAWVRDNIAAF

SEQ ID NO: 1289318 - protein, 32 aa, Mycobacterium
GLLRGGDSWMFVGWCRLREGIRGFHLDRIRHL

SEQ ID NO: 1289319 - protein, 23 aa, Mycobacterium
GLPDHGVVVLVDLGGSGSSISLA

SEQ ID NO: 1289320 - protein, 21 aa, Mycobacterium
GLQCGFCTPGMMITARALLDR

SEQ ID NO: 1289321 - protein, 18 aa, Mycobacterium
GLRSARRLGRRRPAPEEA

SEQ ID NO: 1289322 - protein, 18 aa, Mycobacterium
GLVPLHWALASLLADIGS

SEQ ID NO: 1289323 - protein, 21 aa, Mycobacterium
GMGGMSPFGQQGMGASPFGDP

SEQ ID NO: 1289324 - protein, 18 aa, Mycobacterium
GMPGRLKAVAALFPTVSR

SEQ ID NO: 1289325 - protein, 17 aa, Mycobacterium
GMTCGHCEMSVREEVSD

SEQ ID NO: 1289326 - protein, 20 aa, Mycobacterium
GMVWKYPDTFVVGREQIRQY

SEQ ID NO: 1289327 - protein, 18 aa, Mycobacterium
GNGLRPAIWDEFTNRFGI

SEQ ID NO: 1289328 - protein, 23 aa, Mycobacterium
GNLMKWPAVERVWLPEWLNHRDE

SEQ ID NO: 1289329 - protein, 23 aa, Mycobacterium
GPCVDCYRTGLPVSVADLTGAGQ

SEQ ID NO: 1289330 - protein, 24 aa, Mycobacterium
GPDGLRLAPHPGIGPGLALLDAPD

SEQ ID NO: 1289331 - protein, 24 aa, Mycobacterium
GPEFPEYWKMFLSAVADGDATGVL

SEQ ID NO: 1289332 - protein, 20 aa, Mycobacterium
GPKGRAGFVMANSAGDAGHS

SEQ ID NO: 1289333 - protein, 23 aa, Mycobacterium
GPRPRIALLDGLPMAGHIALSER

SEQ ID NO: 1289334 - protein, 19 aa, Mycobacterium
GPRPTLCVIHGFMGSAYLF

SEQ ID NO: 1289335 - protein, 18 aa, Mycobacterium
GPSATWRTLKTGYQTSVE

SEQ ID NO: 1289336 - protein, 18 aa, Mycobacterium
GPTAPSWRKGRYHIAGRG

SEQ ID NO: 1289337 - protein, 18 aa, Mycobacterium
GQGKLGFEVKIHRIAAEG

SEQ ID NO: 1289338 - protein, 17 aa, Mycobacterium
GQIPICWDPDREAAVAR

SEQ ID NO: 1289339 - protein, 24 aa, Mycobacterium
GRAKVLARYAVWLGEHRAEIEDLL

SEQ ID NO: 1289340 - protein, 17 aa, Mycobacterium
GRGGVRAALQGCRVPTI

SEQ ID NO: 1289341 - protein, 17 aa, Mycobacterium
GRIPLGYFDDAEATRRT

SEQ ID NO: 1289342 - protein, 20 aa, Mycobacterium
GRLKPGIIMCREKGDATSAN

SEQ ID NO: 1289343 - protein, 19 aa, Mycobacterium
GRMRIPWVPVDNARIARRH

SEQ ID NO: 1289344 - protein, 18 aa, Mycobacterium
GRPRTGLAALRMTTVDQL

SEQ ID NO: 1289345 - protein, 20 aa, Mycobacterium
GRPTVNMAVGFLPPQDMIEN

SEQ ID NO: 1289346 - protein, 28 aa, Mycobacterium
GRQQPRCRECWRPGKPTVLTSTRISPGT

SEQ ID NO: 1289347 - protein, 23 aa, Mycobacterium
GRRRISIYWTWSYPWEAQRNPAE

SEQ ID NO: 1289348 - protein, 24 aa, Mycobacterium
GRRTGLIWLRWFLPEATPARPQCR

SEQ ID NO: 1289349 - protein, 18 aa, Mycobacterium
GRVPPIWIGASGPRMLDL

SEQ ID NO: 1289350 - protein, 19 aa, Mycobacterium
GRVSYAFGIGHRAEEYRHF

SEQ ID NO: 1289351 - protein, 18 aa, Mycobacterium
GRVWTNCYHMYPAHAAFG

SEQ ID NO: 1289352 - protein, 23 aa, Mycobacterium
GRWGRATLEVCFAILQSAHEARE

SEQ ID NO: 1289353 - protein, 18 aa, Mycobacterium
GSELRRFLARWLGPAILY

SEQ ID NO: 1289354 - protein, 22 aa, Mycobacterium
GSEMPMRVIGMLVGMPDSLQRS

SEQ ID NO: 1289355 - protein, 18 aa, Mycobacterium
GTAYKWTVVFHHNEHTHP

SEQ ID NO: 1289356 - protein, 17 aa, Mycobacterium
GTHARIWAHGNLEAARA

SEQ ID NO: 1289357 - protein, 23 aa, Mycobacterium
GTYGRFLAIRVFDFWVHERDITT

SEQ ID NO: 1289358 - protein, 17 aa, Mycobacterium
GVDHLRKVVGWARDRGV

SEQ ID NO: 1289359 - protein, 17 aa, Mycobacterium
GVFCRRWGVPLIDGGTV

SEQ ID NO: 1289360 - protein, 17 aa, Mycobacterium
GVGWACLDMAVEYAKVR

SEQ ID NO: 1289361 - protein, 17 aa, Mycobacterium
GVMIARGLLQAGASVYL

SEQ ID NO: 1289362 - protein, 24 aa, Mycobacterium
GVPYRKFIRRYPALTLLVLVGHAA

SEQ ID NO: 1289363 - protein, 18 aa, Mycobacterium
GVRVWSLYVPNGRFVGSP

SEQ ID NO: 1289364 - protein, 19 aa, Mycobacterium
GVVFYPVIPAGSWVATTEF

SEQ ID NO: 1289365 - protein, 21 aa, Mycobacterium
GWLRGFPFLAVQVVWAPGSEM

SEQ ID NO: 1289366 - protein, 20 aa, Mycobacterium
GWQPDIWRGFAEELGILGAT

SEQ ID NO: 1289367 - protein, 18 aa, Mycobacterium
GWSKRIVMEYVDEMCLHL

SEQ ID NO: 1289368 - protein, 19 aa, Mycobacterium
GWYEHEWRAYGYGFPSAGA

SEQ ID NO: 1289369 - protein, 18 aa, Mycobacterium
HAMCFPKPAARVPIHIGG

SEQ ID NO: 1289370 - protein, 18 aa, Mycobacterium
HCSHWRFTLTADEPADGA

SEQ ID NO: 1289371 - protein, 23 aa, Mycobacterium
HDPARCLYCRQPLGDDARALVSK

SEQ ID NO: 1289372 - protein, 22 aa, Mycobacterium
HEQRMRDAISWCEKAAESITTA

SEQ ID NO: 1289373 - protein, 19 aa, Mycobacterium
HGEPEVWQRLLTAIRDAGL

SEQ ID NO: 1289374 - protein, 22 aa, Mycobacterium
HGFASFWWSWRHQLRGLGGARV

SEQ ID NO: 1289375 - protein, 17 aa, Mycobacterium
HGFKIAPAVGRLVADIV

SEQ ID NO: 1289376 - protein, 22 aa, Mycobacterium
HGISFLPTVGWAERGDLTATGH

SEQ ID NO: 1289377 - protein, 26 aa, Mycobacterium
HGKTPAQVLLRWSIQLGNVVIARSAN

SEQ ID NO: 1289378 - protein, 18 aa, Mycobacterium
HGVPRLKVASVRNALTNL

SEQ ID NO: 1289379 - protein, 17 aa, Mycobacterium
HGVPRVHRWARGVDITG

SEQ ID NO: 1289380 - protein, 17 aa, Mycobacterium
HHRCFPVLAGGPGDRDL

SEQ ID NO: 1289381 - protein, 23 aa, Mycobacterium
HLMPVKLKWGISLGALIMHLRES

SEQ ID NO: 1289382 - protein, 19 aa, Mycobacterium
HLRGSLTWDQGCEMAGHKQ

SEQ ID NO: 1289383 - protein, 21 aa, Mycobacterium
HNGVRRWLALDGQPLHRVIVA

SEQ ID NO: 1289384 - protein, 22 aa, Mycobacterium
HPEPELAAIIGRRIKAAQPEQA

SEQ ID NO: 1289385 - protein, 24 aa, Mycobacterium
HRGKEWLFRHLLHLVDPAIYPDPG

SEQ ID NO: 1289386 - protein, 24 aa, Mycobacterium
HRLARSLFLYGLCNGWICEGTTVI

SEQ ID NO: 1289387 - protein, 17 aa, Mycobacterium
HRMEVAWNPEFLREGKA

SEQ ID NO: 1289388 - protein, 17 aa, Mycobacterium
HRTAVTFSHRYEAAWHF

SEQ ID NO: 1289389 - protein, 24 aa, Mycobacterium
HRVQRGGNMLSVFFTAEPVGDFAT

SEQ ID NO: 1289390 - protein, 25 aa, Mycobacterium
HTIKATKLVAEWPIRDYIPDPDPIG

SEQ ID NO: 1289391 - protein, 17 aa, Mycobacterium
HTYELPLPPSLRARAEW

SEQ ID NO: 1289392 - protein, 18 aa, Mycobacterium
HVLAAFGLVGVRPVPLGS

SEQ ID NO: 1289393 - protein, 23 aa, Mycobacterium
HVPCAGLVIGAWPAQPGAAEIDN

SEQ ID NO: 1289394 - protein, 23 aa, Mycobacterium
HVPSRSPIAIGIITGAAARTRAT

SEQ ID NO: 1289395 - protein, 20 aa, Mycobacterium
IAAEFADGVVLWMASASAIA

SEQ ID NO: 1289396 - protein, 19 aa, Mycobacterium
IAAVRCFHGSPAALVELLE

SEQ ID NO: 1289397 - protein, 17 aa, Mycobacterium
IAGPCGVVIFGVTGDLS

SEQ ID NO: 1289398 - protein, 17 aa, Mycobacterium
IAIPADFAPIIDLKAEI

SEQ ID NO: 1289399 - protein, 18 aa, Mycobacterium
IAPGLVVRCRNDIPHSRG

SEQ ID NO: 1289400 - protein, 18 aa, Mycobacterium
IAPRPVLAMVSEQLMKAR

SEQ ID NO: 1289401 - protein, 23 aa, Mycobacterium
IATDHLMRFPGRFADQLLAEHLQ

SEQ ID NO: 1289402 - protein, 24 aa, Mycobacterium
IATTLAARGWRIIVTDVNLTGAQE

SEQ ID NO: 1289403 - protein, 18 aa, Mycobacterium
IATYPGAIAVRFDDPLAA

SEQ ID NO: 1289404 - protein, 17 aa, Mycobacterium
ICVEAFAGFAIVKPQVA

SEQ ID NO: 1289405 - protein, 17 aa, Mycobacterium
IDAGAEWRQAGCSMCLG

SEQ ID NO: 1289406 - protein, 23 aa, Mycobacterium
IDDRLAGLAARYAVSVGDQRLVR

SEQ ID NO: 1289407 - protein, 20 aa, Mycobacterium
IDFIEACAWIKENLPGVHIS

SEQ ID NO: 1289408 - protein, 21 aa, Mycobacterium
IDPELRFRKRPLLSLEQPVKV

SEQ ID NO: 1289409 - protein, 18 aa, Mycobacterium
IEAVEWPDHPFALGVHWH

SEQ ID NO: 1289410 - protein, 25 aa, Mycobacterium
IEFIVAQLLRLGRLGSFDFNSRFYA

SEQ ID NO: 1289411 - protein, 19 aa, Mycobacterium
IEKMRVAGRIAAGALAEAG

SEQ ID NO: 1289412 - protein, 24 aa, Mycobacterium
IFKRIRPGFRYERSLSVLTMARDY

SEQ ID NO: 1289413 - protein, 18 aa, Mycobacterium
IFTAALTRLGVDAADAVM

SEQ ID NO: 1289414 - protein, 22 aa, Mycobacterium
IGCKRPTFSNSYFRTFTKPHVH

SEQ ID NO: 1289415 - protein, 19 aa, Mycobacterium
IGLAAAKYWVCKRATPHAA

SEQ ID NO: 1289416 - protein, 23 aa, Mycobacterium
IGRWRPSLSGARDAYVYYPGTAD

SEQ ID NO: 1289417 - protein, 17 aa, Mycobacterium
IHFQEWWVRYRAKVPTH

SEQ ID NO: 1289418 - protein, 21 aa, Mycobacterium
IKDLRFGACLDDDWAEADPDE

SEQ ID NO: 1289419 - protein, 17 aa, Mycobacterium
IKDRGSLIVGVNVPYAP

SEQ ID NO: 1289420 - protein, 20 aa, Mycobacterium
IKVKGFRNTIHWRVTRYDEP

SEQ ID NO: 1289421 - protein, 17 aa, Mycobacterium
ILRRFDIIVLPLVNPDG

SEQ ID NO: 1289422 - protein, 17 aa, Mycobacterium
IMSRWLATRLPDGQAPE

SEQ ID NO: 1289423 - protein, 20 aa, Mycobacterium
IPPPVHWAGGVFVCPAGARD

SEQ ID NO: 1289424 - protein, 19 aa, Mycobacterium
IQSAAAWAIIDCDLPAPAE

SEQ ID NO: 1289425 - protein, 17 aa, Mycobacterium
IRPNVIWAMDFQFDTTA

SEQ ID NO: 1289426 - protein, 25 aa, Mycobacterium
IRRRYPDWERWGLAPADMLMAAAGP

SEQ ID NO: 1289427 - protein, 19 aa, Mycobacterium
IRTRRLGVMGGTFDPIHHG

SEQ ID NO: 1289428 - protein, 21 aa, Mycobacterium
IRVSNRLRPWLPVLLALTANS

SEQ ID NO: 1289429 - protein, 19 aa, Mycobacterium
ITAFNFPVAVWSWNTAVAL

SEQ ID NO: 1289430 - protein, 18 aa, Mycobacterium
IVLPGMVVPIELDDAARA

SEQ ID NO: 1289431 - protein, 18 aa, Mycobacterium
IVPCQDGYIRICLLAKRQ

SEQ ID NO: 1289432 - protein, 17 aa, Mycobacterium
IWVAIAVATDAQWDALC

SEQ ID NO: 1289433 - protein, 18 aa, Mycobacterium
IYTFMDLWFYHCNPRHHS

SEQ ID NO: 1289434 - protein, 20 aa, Mycobacterium
KAFAFAGGRLGYLVAAPAVI

SEQ ID NO: 1289435 - protein, 19 aa, Mycobacterium
KAFRAVALPARYMIACVNG

SEQ ID NO: 1289436 - protein, 17 aa, Mycobacterium
KAMIPRAKGSIVNIGSY

SEQ ID NO: 1289437 - protein, 17 aa, Mycobacterium
KAQGGIFGWVAGSAAVI

SEQ ID NO: 1289438 - protein, 17 aa, Mycobacterium
KAVLAMQYECGFTNEPE

SEQ ID NO: 1289439 - protein, 19 aa, Mycobacterium
KAWLIGVGEDGEWPLFLDV

SEQ ID NO: 1289440 - protein, 20 aa, Mycobacterium
KAYIEVMSFDGLVNAATERN

SEQ ID NO: 1289441 - protein, 18 aa, Mycobacterium
KDDLDWLSDWGHSYEARP

SEQ ID NO: 1289442 - protein, 18 aa, Mycobacterium
KDVHIGPSDHVGWLDDRK

SEQ ID NO: 1289443 - protein, 22 aa, Mycobacterium
KGCTHPGCTVPFYWTEAHHTHD

SEQ ID NO: 1289444 - protein, 20 aa, Mycobacterium
KGGAASAFGTEWEKWHSGAG

SEQ ID NO: 1289445 - protein, 17 aa, Mycobacterium
KLCAQYLGPALRLLNFN

SEQ ID NO: 1289446 - protein, 19 aa, Mycobacterium
KLGFPVPIRHWLRAGELLE

SEQ ID NO: 1289447 - protein, 17 aa, Mycobacterium
KLHLRPIFMKSYSQLTQ

SEQ ID NO: 1289448 - protein, 17 aa, Mycobacterium
KLVDWMMKFQFANDCDY

SEQ ID NO: 1289449 - protein, 17 aa, Mycobacterium
KLYLCAIKDVFSNRIVG

SEQ ID NO: 1289450 - protein, 18 aa, Mycobacterium
KPLYGTSLVTGWASIHGF

SEQ ID NO: 1289451 - protein, 20 aa, Mycobacterium
KRFGADFDRPVARMTEMIGA

SEQ ID NO: 1289452 - protein, 20 aa, Mycobacterium
KRLLVDNGWFATLRRPNVEL

SEQ ID NO: 1289453 - protein, 18 aa, Mycobacterium
KRLRPVIDSGYKRNDPKS

SEQ ID NO: 1289454 - protein, 17 aa, Mycobacterium
KRPRKYLRVTLGRRNPV

SEQ ID NO: 1289455 - protein, 19 aa, Mycobacterium
KSRLPRYGRRPQDQLIIPG

SEQ ID NO: 1289456 - protein, 24 aa, Mycobacterium
KTTLKWRFPYGFLDQGQSTPIRMP

SEQ ID NO: 1289457 - protein, 19 aa, Mycobacterium
KVAKWWIPERWSFVSDIPR

SEQ ID NO: 1289458 - protein, 18 aa, Mycobacterium
KVLVWCHGGGYVLGSARG

SEQ ID NO: 1289459 - protein, 18 aa, Mycobacterium
KVVRMFPIPPIALGLRTG

SEQ ID NO: 1289460 - protein, 20 aa, Mycobacterium
KWATFPMLALHGWAQHHDVP

SEQ ID NO: 1289461 - protein, 18 aa, Mycobacterium
KWTRILIPWRHESSHLHP

SEQ ID NO: 1289462 - protein, 19 aa, Mycobacterium
LAAAGYRVWAINPMAAARY

SEQ ID NO: 1289463 - protein, 20 aa, Mycobacterium
LAAHFFLTFPQLHDVRFDYR

SEQ ID NO: 1289464 - protein, 18 aa, Mycobacterium
LAAVNLRLFARDGGDVPA

SEQ ID NO: 1289465 - protein, 19 aa, Mycobacterium
LADLLWRMGIRTIGQFSAL

SEQ ID NO: 1289466 - protein, 18 aa, Mycobacterium
LADLSFADYLMWVRRDDG

SEQ ID NO: 1289467 - protein, 23 aa, Mycobacterium
LAEEILEPLGFRWTNFGVAESDV

SEQ ID NO: 1289468 - protein, 19 aa, Mycobacterium
LAELLPGCTGLDVVDSVYG

SEQ ID NO: 1289469 - protein, 17 aa, Mycobacterium
LAFTPVFLSEEWRQVVL

SEQ ID NO: 1289470 - protein, 25 aa, Mycobacterium
LAGAWPSQSVMAWSGYSMQFKAAAN

SEQ ID NO: 1289471 - protein, 22 aa, Mycobacterium
LAGDKRFPFGIPKPDNANYLWI

SEQ ID NO: 1289472 - protein, 17 aa, Mycobacterium
LAHPALVCDVAIGQSTL

SEQ ID NO: 1289473 - protein, 25 aa, Mycobacterium
LAKAWKRLETVTGMTAPQLNDWGGG

SEQ ID NO: 1289474 - protein, 20 aa, Mycobacterium
LAKLRMARLVRTRREGTTIY

SEQ ID NO: 1289475 - protein, 20 aa, Mycobacterium
LALLRLNALLARACGDAASY

SEQ ID NO: 1289476 - protein, 26 aa, Mycobacterium
LALQRTCGWSSLPLKGWLATAYQRYA

SEQ ID NO: 1289477 - protein, 18 aa, Mycobacterium
LAPGSFSWHVLSSLTDEV

SEQ ID NO: 1289478 - protein, 21 aa, Mycobacterium
LARARRMGIGTVDTGVQGLIE

SEQ ID NO: 1289479 - protein, 17 aa, Mycobacterium
LARLGGIVGTAFQISDD

SEQ ID NO: 1289480 - protein, 19 aa, Mycobacterium
LARSLRCRPEDLIALLRRR

SEQ ID NO: 1289481 - protein, 17 aa, Mycobacterium
LASFPAPLRANAPSVSG

SEQ ID NO: 1289482 - protein, 26 aa, Mycobacterium
LATARAAEVIECLRHYDTAEGCADLL

SEQ ID NO: 1289483 - protein, 17 aa, Mycobacterium
LAWELLYATETCRSFAL

SEQ ID NO: 1289484 - protein, 19 aa, Mycobacterium
LCRPYRGKEICGMPPPSSG

SEQ ID NO: 1289485 - protein, 21 aa, Mycobacterium
LCTGCGQLTAADAARCATTNC

SEQ ID NO: 1289486 - protein, 18 aa, Mycobacterium
LDAAHVWHPYSTIGAGAL

SEQ ID NO: 1289487 - protein, 20 aa, Mycobacterium
LDALPDWPAVGLPRVRIAEF

SEQ ID NO: 1289488 - protein, 19 aa, Mycobacterium
LDCFKRFSDVTFDRWQKVI

SEQ ID NO: 1289489 - protein, 19 aa, Mycobacterium
LDFAAVWGLAGGVQSDLSP

SEQ ID NO: 1289490 - protein, 25 aa, Mycobacterium
LDFMRSCSIKHGMASVIFSLEMSKS

SEQ ID NO: 1289491 - protein, 18 aa, Mycobacterium
LDGIRGWQEDCYRDLHRH

SEQ ID NO: 1289492 - protein, 18 aa, Mycobacterium
LDHVVAWAEAPGTLVDHR

SEQ ID NO: 1289493 - protein, 17 aa, Mycobacterium
LDIPGVVVGGVLNGFGF

SEQ ID NO: 1289494 - protein, 18 aa, Mycobacterium
LDLLPRLLIRGGELDLTV

SEQ ID NO: 1289495 - protein, 28 aa, Mycobacterium
LDRSAFRWWLTVATLRWGVICRFQAERH

SEQ ID NO: 1289496 - protein, 17 aa, Mycobacterium
LDTEYAWAEDPPSRIRH

SEQ ID NO: 1289497 - protein, 19 aa, Mycobacterium
LDVGCGWGGMVRYAARHGV

SEQ ID NO: 1289498 - protein, 23 aa, Mycobacterium
LDWMLVCTLREWFDRPNGEPPPW

SEQ ID NO: 1289499 - protein, 17 aa, Mycobacterium
LEFAVGRTTSVNWDEPT

SEQ ID NO: 1289500 - protein, 17 aa, Mycobacterium
LEGLDLLHGGAWKAELR

SEQ ID NO: 1289501 - protein, 19 aa, Mycobacterium
LEMIKAQGGIFGWVAGSAA

SEQ ID NO: 1289502 - protein, 17 aa, Mycobacterium
LEQWYGWIEFLANPSKN

SEQ ID NO: 1289503 - protein, 19 aa, Mycobacterium
LERPWLASRIELMETTDMA

SEQ ID NO: 1289504 - protein, 19 aa, Mycobacterium
LESRLAWEPTSLAAAVERT

SEQ ID NO: 1289505 - protein, 17 aa, Mycobacterium
LEVGQLLGSGWKGGAAS

SEQ ID NO: 1289506 - protein, 17 aa, Mycobacterium
LEVLDGLGLDYSIMFPT

SEQ ID NO: 1289507 - protein, 19 aa, Mycobacterium
LEYDRLGLPAADWQILLDV

SEQ ID NO: 1289508 - protein, 18 aa, Mycobacterium
LFATHGLPWCDGARELLE

SEQ ID NO: 1289509 - protein, 17 aa, Mycobacterium
LFLKVSLLRRANPDRPH

SEQ ID NO: 1289510 - protein, 18 aa, Mycobacterium
LGAPEFASRIGVGVDEFQ

SEQ ID NO: 1289511 - protein, 22 aa, Mycobacterium
LGDVFVGWLLLRSAHIALTALA

SEQ ID NO: 1289512 - protein, 25 aa, Mycobacterium
LGETELWQWAHRVVCEHPGPLEIDK

SEQ ID NO: 1289513 - protein, 20 aa, Mycobacterium
LGHFDAWAAQFVRYKVLIET

SEQ ID NO: 1289514 - protein, 22 aa, Mycobacterium
LGHLRGAVNIGLEGRYAEFAGS

SEQ ID NO: 1289515 - protein, 17 aa, Mycobacterium
LGLDCQIIRNRGALMVL

SEQ ID NO: 1289516 - protein, 17 aa, Mycobacterium
LGLMLVVGQPKNTAEYI

SEQ ID NO: 1289517 - protein, 24 aa, Mycobacterium
LGQMWAAGVDLDWSRLSKDKPGLI

SEQ ID NO: 1289518 - protein, 25 aa, Mycobacterium
LGQSRPRTRWRWRAIVTDLAAPQRV

SEQ ID NO: 1289519 - protein, 19 aa, Mycobacterium
LGVPEGKWVYLRGHADQTE

SEQ ID NO: 1289520 - protein, 25 aa, Mycobacterium
LGVQRLRLVAGWSLGGMQSLEFASR

SEQ ID NO: 1289521 - protein, 17 aa, Mycobacterium
LGWRAYRRCPGSAGAWR

SEQ ID NO: 1289522 - protein, 18 aa, Mycobacterium
LHPLSAPMTLRWLRDRFT

SEQ ID NO: 1289523 - protein, 18 aa, Mycobacterium
LIGEWLLRDMGRASGLRH

SEQ ID NO: 1289524 - protein, 17 aa, Mycobacterium
LIGQITWRTRLVQDPHL

SEQ ID NO: 1289525 - protein, 22 aa, Mycobacterium
LIRGEWRPLYLFADRPQPLIDL

SEQ ID NO: 1289526 - protein, 19 aa, Mycobacterium
LKGFHGFRLTEFFAGYPDA

SEQ ID NO: 1289527 - protein, 23 aa, Mycobacterium
LKVKRRLAGMLARRGYSQSMALD

SEQ ID NO: 1289528 - protein, 20 aa, Mycobacterium
LKYEGVDVITIFKGLQLDIG

SEQ ID NO: 1289529 - protein, 19 aa, Mycobacterium
LLADLSFADYLMWVRRDDG

SEQ ID NO: 1289530 - protein, 19 aa, Mycobacterium
LLAEAVWRLGALGWACDLV

SEQ ID NO: 1289531 - protein, 18 aa, Mycobacterium
LLCRRRLGAAVGQIVNVD

SEQ ID NO: 1289532 - protein, 17 aa, Mycobacterium
LLDAGCRTTVWNRTAAR

SEQ ID NO: 1289533 - protein, 17 aa, Mycobacterium
LLELVGLGHRIHHQPTK

SEQ ID NO: 1289534 - protein, 17 aa, Mycobacterium
LLESGGFLVAESDRVLG

SEQ ID NO: 1289535 - protein, 20 aa, Mycobacterium
LLGSGWKGGAASAFGTEWEK

SEQ ID NO: 1289536 - protein, 20 aa, Mycobacterium
LLKYSRLFAALTEWERSTDI

SEQ ID NO: 1289537 - protein, 21 aa, Mycobacterium
LLPIPEFYGGTVYFDGADAPA

SEQ ID NO: 1289538 - protein, 18 aa, Mycobacterium
LLTDFPFRNWEDEPALPF

SEQ ID NO: 1289539 - protein, 17 aa, Mycobacterium
LLVEAAWHHKPRYRVGT

SEQ ID NO: 1289540 - protein, 17 aa, Mycobacterium
LLVRERIELMLDPDTAF

SEQ ID NO: 1289541 - protein, 18 aa, Mycobacterium
LLWQRGFDGLSIEAVAAR

SEQ ID NO: 1289542 - protein, 18 aa, Mycobacterium
LNALLARACGDAASYRRW

SEQ ID NO: 1289543 - protein, 19 aa, Mycobacterium
LNDPCWKQLLSLVPPMTCD

SEQ ID NO: 1289544 - protein, 18 aa, Mycobacterium
LNDPELQAAIGLFSTPEE

SEQ ID NO: 1289545 - protein, 18 aa, Mycobacterium
LPADFGLPDCPRWKVVDR

SEQ ID NO: 1289546 - protein, 17 aa, Mycobacterium
LPAQWPVLLCNGAVGIA

SEQ ID NO: 1289547 - protein, 26 aa, Mycobacterium
LPDEMPAAALWWRITETLAPTAAVPE

SEQ ID NO: 1289548 - protein, 19 aa, Mycobacterium
LPDLVAVLSRLIGPIRRVV

SEQ ID NO: 1289549 - protein, 17 aa, Mycobacterium
LPDSLLHYMRTRGKDKV

SEQ ID NO: 1289550 - protein, 26 aa, Mycobacterium
LPGFVERVLEAWPRHDLGYAITDLIA

SEQ ID NO: 1289551 - protein, 22 aa, Mycobacterium
LPGHAPSGLGFRPDGSLLITSV

SEQ ID NO: 1289552 - protein, 20 aa, Mycobacterium
LPGPLKWDLTTGIATATTQS

SEQ ID NO: 1289553 - protein, 20 aa, Mycobacterium
LPHGLPPVRLIAGAQLDGWQ

SEQ ID NO: 1289554 - protein, 19 aa, Mycobacterium
LPLTPSRVWEAMQGRPTPP

SEQ ID NO: 1289555 - protein, 20 aa, Mycobacterium
LPQQRWYGGRSREFSSATPD

SEQ ID NO: 1289556 - protein, 18 aa, Mycobacterium
LPRAAAILMKLYRNATHG

SEQ ID NO: 1289557 - protein, 19 aa, Mycobacterium
LPRLRPGVMEVKIPMPTTG

SEQ ID NO: 1289558 - protein, 18 aa, Mycobacterium
LPVSSVLCTLELAGRLHL

SEQ ID NO: 1289559 - protein, 17 aa, Mycobacterium
LPWPWPRVVGAHFVAGD

SEQ ID NO: 1289560 - protein, 17 aa, Mycobacterium
LQAARWAGAVAAACGAP

SEQ ID NO: 1289561 - protein, 17 aa, Mycobacterium
LQAHGWSRLLPRTVVAL

SEQ ID NO: 1289562 - protein, 24 aa, Mycobacterium
LQDHAWRIAAKLNWPDTYQAEYIA

SEQ ID NO: 1289563 - protein, 21 aa, Mycobacterium
LQRCPWCGTKIDPKRDLHVDR

SEQ ID NO: 1289564 - protein, 19 aa, Mycobacterium
LQTAFMLSPWAARTPIDVE

SEQ ID NO: 1289565 - protein, 19 aa, Mycobacterium
LQYRHRLEFAVGRTTSVNW

SEQ ID NO: 1289566 - protein, 17 aa, Mycobacterium
LRDALGLTPGSKVDISA

SEQ ID NO: 1289567 - protein, 23 aa, Mycobacterium
LRDHPGEGLGFWTQFDTYIPAAL

SEQ ID NO: 1289568 - protein, 26 aa, Mycobacterium
LRERWSNQAAREWKELPARELADTTM

SEQ ID NO: 1289569 - protein, 21 aa, Mycobacterium
LRGGAYFFLPGLRGLRYLATL

SEQ ID NO: 1289570 - protein, 17 aa, Mycobacterium
LRHSFAMRTLEYLVTGH

SEQ ID NO: 1289571 - protein, 20 aa, Mycobacterium
LRKVVGWARDRGVLVASDEC

SEQ ID NO: 1289572 - protein, 22 aa, Mycobacterium
LRLDELTRFFAWITDRGVTSLA

SEQ ID NO: 1289573 - protein, 18 aa, Mycobacterium
LRLVFVCAMWMTGFDAPS

SEQ ID NO: 1289574 - protein, 17 aa, Mycobacterium
LRPAILYGIDTRATAEI

SEQ ID NO: 1289575 - protein, 19 aa, Mycobacterium
LRPALSIAVCLGLGGQLDA

SEQ ID NO: 1289576 - protein, 18 aa, Mycobacterium
LRPDLRVHLAAREAEFWT

SEQ ID NO: 1289577 - protein, 19 aa, Mycobacterium
LRPGLTLALEPWFARGTDR

SEQ ID NO: 1289578 - protein, 19 aa, Mycobacterium
LRRAGHVVAPFKVGPDFID

SEQ ID NO: 1289579 - protein, 21 aa, Mycobacterium
LRREFDALWSAIRFDEPARPA

SEQ ID NO: 1289580 - protein, 17 aa, Mycobacterium
LRSGITFNTKVTSAVLD

SEQ ID NO: 1289581 - protein, 17 aa, Mycobacterium
LRSPAIFEWFDIAGVDD

SEQ ID NO: 1289582 - protein, 18 aa, Mycobacterium
LRSPLVLVPVRLSTANRG

SEQ ID NO: 1289583 - protein, 19 aa, Mycobacterium
LRSQLGWRTLGVYAVNYPA

SEQ ID NO: 1289584 - protein, 19 aa, Mycobacterium
LRTEFPNGFVATVRGVFTY

SEQ ID NO: 1289585 - protein, 17 aa, Mycobacterium
LRTGAPIRLSAAVVASW

SEQ ID NO: 1289586 - protein, 17 aa, Mycobacterium
LRTPGFVLIRERGAAVV

SEQ ID NO: 1289587 - protein, 21 aa, Mycobacterium
LRVHPDIHLFPAIPQQRSSTA

SEQ ID NO: 1289588 - protein, 26 aa, Mycobacterium
LRYLLATSVPAWWAPYVPRLMRTPQL

SEQ ID NO: 1289589 - protein, 21 aa, Mycobacterium
LSAPMTLRWLRDRFTDRPVYE

SEQ ID NO: 1289590 - protein, 21 aa, Mycobacterium
LSGQVGWLARDRWAVPLVHTA

SEQ ID NO: 1289591 - protein, 17 aa, Mycobacterium
LSIQFVFAYDVGEFAET

SEQ ID NO: 1289592 - protein, 20 aa, Mycobacterium
LSKPFTFKRVEGLRPVIQQV

SEQ ID NO: 1289593 - protein, 23 aa, Mycobacterium
LSLDIAQAVALVWEATIDATGPD

SEQ ID NO: 1289594 - protein, 24 aa, Mycobacterium
LSNPTLLCYYLFFPAHEESVGAGA

SEQ ID NO: 1289595 - protein, 23 aa, Mycobacterium
LSRLRGMFAFALWDTVTGELFCA

SEQ ID NO: 1289596 - protein, 17 aa, Mycobacterium
LSYFLGVRGPAVVVDTA

SEQ ID NO: 1289597 - protein, 25 aa, Mycobacterium
LTAMRWPRVGVMIARGDLAVEVGYE

SEQ ID NO: 1289598 - protein, 18 aa, Mycobacterium
LTCPMFLTTPEFLPHHRA

SEQ ID NO: 1289599 - protein, 34 aa, Mycobacterium
LTECPQCSGRLRKLFGKVGVVFKGSGFYRTDSRE

SEQ ID NO: 1289600 - protein, 17 aa, Mycobacterium
LTESLRYPAALVDDFDW

SEQ ID NO: 1289601 - protein, 21 aa, Mycobacterium
LTEWLGYAWVCLADVPPSFEE

SEQ ID NO: 1289602 - protein, 23 aa, Mycobacterium
LTWPGTRVELCFPGDRPLPQHHT

SEQ ID NO: 1289603 - protein, 17 aa, Mycobacterium
LVAARVGRPPVIRRAIL

SEQ ID NO: 1289604 - protein, 19 aa, Mycobacterium
LVDLLDAWVAYFAEHPRER

SEQ ID NO: 1289605 - protein, 24 aa, Mycobacterium
LVEGRAGVVVPALWTVRRITDGGG

SEQ ID NO: 1289606 - protein, 19 aa, Mycobacterium
LVEQCGRRSLLLPGDLAEA

SEQ ID NO: 1289607 - protein, 17 aa, Mycobacterium
LVTDGRWWGIVWAEEGT

SEQ ID NO: 1289608 - protein, 20 aa, Mycobacterium
LVVRPFLKYQIITVAAPETA

SEQ ID NO: 1289609 - protein, 18 aa, Mycobacterium
LWRMGIRTIGQFSALSRT

SEQ ID NO: 1289610 - protein, 17 aa, Mycobacterium
LWWPDKRPYAPGSVLPA

SEQ ID NO: 1289611 - protein, 21 aa, Mycobacterium
LYCRNRIEIVIGMVGIVKAGA

SEQ ID NO: 1289612 - protein, 17 aa, Mycobacterium
LYRHFPDKVSLLGAAIV

SEQ ID NO: 1289613 - protein, 20 aa, Mycobacterium
MAALVLRPGAEFAVEKFQAF

SEQ ID NO: 1289614 - protein, 20 aa, Mycobacterium
MAEPKWVLAMGVCASSGGMF

SEQ ID NO: 1289615 - protein, 18 aa, Mycobacterium
MDGWYEWRPNPAEGGKKK

SEQ ID NO: 1289616 - protein, 22 aa, Mycobacterium
MGLARLWQSWGIEPDVVLGHSV

SEQ ID NO: 1289617 - protein, 19 aa, Mycobacterium
MKVEAWRAGSPTAQIQPEV

SEQ ID NO: 1289618 - protein, 19 aa, Mycobacterium
MLALHGWAQHHDVPLRAVV

SEQ ID NO: 1289619 - protein, 21 aa, Mycobacterium
MPEMPLIKFIDGWETVAEMEA

SEQ ID NO: 1289620 - protein, 18 aa, Mycobacterium
MPRIAGPCGVVIFGVTGD

SEQ ID NO: 1289621 - protein, 18 aa, Mycobacterium
MQCGIAWCGHCQLGPLLL

SEQ ID NO: 1289622 - protein, 17 aa, Mycobacterium
MRGRLALHHVRARVYGA

SEQ ID NO: 1289623 - protein, 19 aa, Mycobacterium
MRPDVVIKFMDRFGDVIYN

SEQ ID NO: 1289624 - protein, 17 aa, Mycobacterium
MSLSGRWRKQGIDVRFA

SEQ ID NO: 1289625 - protein, 17 aa, Mycobacterium
MSMFGLHRALRGAAVGH

SEQ ID NO: 1289626 - protein, 18 aa, Mycobacterium
MTPAAFVRRPGRWIREMA

SEQ ID NO: 1289627 - protein, 25 aa, Mycobacterium
MTPRRMMALLLRFGPYGDRFGLRRG

SEQ ID NO: 1289628 - protein, 25 aa, Mycobacterium
MTRPRWSMDPLRIFPADIGVDKAVD

SEQ ID NO: 1289629 - protein, 22 aa, Mycobacterium
MTVWQKLHFRFGLPKPLLEPLS

SEQ ID NO: 1289630 - protein, 18 aa, Mycobacterium
MVDAAICDGDWVVVRQQA

SEQ ID NO: 1289631 - protein, 22 aa, Mycobacterium
MVKAGVQWGLFGGAVENLGTER

SEQ ID NO: 1289632 - protein, 23 aa, Mycobacterium
MVRCVRAALPLLRSASWARIVNF

SEQ ID NO: 1289633 - protein, 20 aa, Mycobacterium
MWCFPDLSYGIGMVIRVVEG

SEQ ID NO: 1289634 - protein, 18 aa, Mycobacterium
NAGRRVALLVGRGAAGAA

SEQ ID NO: 1289635 - protein, 18 aa, Mycobacterium
NAMGRPGLTLGLGPSHEP

SEQ ID NO: 1289636 - protein, 19 aa, Mycobacterium
NCYHMYPAHAAFGGYKQSG

SEQ ID NO: 1289637 - protein, 18 aa, Mycobacterium
NDGALGWVGTSPVGTFPA

SEQ ID NO: 1289638 - protein, 19 aa, Mycobacterium
NDIRSGAALTTLAQELGGL

SEQ ID NO: 1289639 - protein, 20 aa, Mycobacterium
NGELRKRCVLQLHEAIEGEL

SEQ ID NO: 1289640 - protein, 17 aa, Mycobacterium
NGFFYKVMPPFCVGTSA

SEQ ID NO: 1289641 - protein, 28 aa, Mycobacterium
NKAIARFIVRYTEAFKRYGITDDTVQAA

SEQ ID NO: 1289642 - protein, 26 aa, Mycobacterium
NKGVRFSYRWDFGRNRFIMMDSRNGR

SEQ ID NO: 1289643 - protein, 17 aa, Mycobacterium
NLLPVPWVDPVDVANAV

SEQ ID NO: 1289644 - protein, 23 aa, Mycobacterium
NLLRLKAFFGRQWQQMPAAQFMA

SEQ ID NO: 1289645 - protein, 18 aa, Mycobacterium
NLREAFELIVGGNPAEGI

SEQ ID NO: 1289646 - protein, 25 aa, Mycobacterium
NNLYLAFGMLNWRFGDRELRSPLVL

SEQ ID NO: 1289647 - protein, 18 aa, Mycobacterium
NPFRLTFTPDGKLLVADV

SEQ ID NO: 1289648 - protein, 25 aa, Mycobacterium
NREVRWRPAEYWKPGTTVEVDVNAY

SEQ ID NO: 1289649 - protein, 17 aa, Mycobacterium
NVKKSGFLPSERQWLTD

SEQ ID NO: 1289650 - protein, 17 aa, Mycobacterium
PAECPGRNLALFTTSTL

SEQ ID NO: 1289651 - protein, 20 aa, Mycobacterium
PAGDGRLSLVDGLFLDIIKK

SEQ ID NO: 1289652 - protein, 21 aa, Mycobacterium
PAGWRLAAAATTWSEVAALMT

SEQ ID NO: 1289653 - protein, 17 aa, Mycobacterium
PAILYGIDTRATAEIHS

SEQ ID NO: 1289654 - protein, 21 aa, Mycobacterium
PAIRSRLGLALSRATDRGSLV

SEQ ID NO: 1289655 - protein, 17 aa, Mycobacterium
PAISLPLHWTADGLPLG

SEQ ID NO: 1289656 - protein, 17 aa, Mycobacterium
PALVVRPFLKYQIITVA

SEQ ID NO: 1289657 - protein, 19 aa, Mycobacterium
PANLQPGSTVAFDQFTLTR

SEQ ID NO: 1289658 - protein, 18 aa, Mycobacterium
PATIWRDYIRTVGRTPNG

SEQ ID NO: 1289659 - protein, 24 aa, Mycobacterium
PATRPRIRLAYRLTPRRVTGATRA

SEQ ID NO: 1289660 - protein, 19 aa, Mycobacterium
PAWAYGRVALQWAERYYAA

SEQ ID NO: 1289661 - protein, 28 aa, Mycobacterium
PCQLCRWWWRQGRTWPKAHPFQRHKGCN

SEQ ID NO: 1289662 - protein, 20 aa, Mycobacterium
PDFELIAGQVIANFEAAAAV

SEQ ID NO: 1289663 - protein, 18 aa, Mycobacterium
PDGQCLFGPVLIDPPVGE

SEQ ID NO: 1289664 - protein, 17 aa, Mycobacterium
PDVLDWPLNVVVVRSGD

SEQ ID NO: 1289665 - protein, 17 aa, Mycobacterium
PDVYPRLLRVMTADPIF

SEQ ID NO: 1289666 - protein, 18 aa, Mycobacterium
PEATMCRFGVPLAPVAEP

SEQ ID NO: 1289667 - protein, 20 aa, Mycobacterium
PEFVALWADHRVKRCEADTY

SEQ ID NO: 1289668 - protein, 18 aa, Mycobacterium
PELPDCWVVSAGETVIVT

SEQ ID NO: 1289669 - protein, 18 aa, Mycobacterium
PEMTARYAATLAATAEAE

SEQ ID NO: 1289670 - protein, 22 aa, Mycobacterium
PEPHYRPSAALQDFVRCRDLTC

SEQ ID NO: 1289671 - protein, 19 aa, Mycobacterium
PEPLASIGINATRWSLDRA

SEQ ID NO: 1289672 - protein, 22 aa, Mycobacterium
PEVIWPRARRALAAVGLNLPLR

SEQ ID NO: 1289673 - protein, 19 aa, Mycobacterium
PEYRLETLISLNIGTATGF

SEQ ID NO: 1289674 - protein, 18 aa, Mycobacterium
PFGKRLLVDNGWFATLRR

SEQ ID NO: 1289675 - protein, 23 aa, Mycobacterium
PFLPPELAPLIAFTTTSLSGVLL

SEQ ID NO: 1289676 - protein, 20 aa, Mycobacterium
PGAMARLGVWSGRGPQLDLH

SEQ ID NO: 1289677 - protein, 21 aa, Mycobacterium
PGAMARLGVWSGRGPQLDLHQ

SEQ ID NO: 1289678 - protein, 23 aa, Mycobacterium
PGDGWRLAMDLLPYERSTCFWQR

SEQ ID NO: 1289679 - protein, 23 aa, Mycobacterium
PGEPLPRWQIGLYWRADGAPLWT

SEQ ID NO: 1289680 - protein, 19 aa, Mycobacterium
PGEQGGAVARCYSLASSPH

SEQ ID NO: 1289681 - protein, 24 aa, Mycobacterium
PGGERRLNVAVTRARREVVLYASF

SEQ ID NO: 1289682 - protein, 18 aa, Mycobacterium
PGKELVRHKYRVCPTCGR

SEQ ID NO: 1289683 - protein, 17 aa, Mycobacterium
PGLLRWDRKRIASRVDE

SEQ ID NO: 1289684 - protein, 25 aa, Mycobacterium
PGQRLELAFDYRVLWAEPLPGKVRR

SEQ ID NO: 1289685 - protein, 20 aa, Mycobacterium
PGVVVGGVLNGFGFDGGLLT

SEQ ID NO: 1289686 - protein, 18 aa, Mycobacterium
PGWGCGRALALRNNIIID

SEQ ID NO: 1289687 - protein, 20 aa, Mycobacterium
PGWWAAREAIEWTASAQRQP

SEQ ID NO: 1289688 - protein, 18 aa, Mycobacterium
PGWYRPNPGLARDLAFIA

SEQ ID NO: 1289689 - protein, 20 aa, Mycobacterium
PHYRPSAALQDFVRCRDLTC

SEQ ID NO: 1289690 - protein, 21 aa, Mycobacterium
PIDVPYPVLWRNLTQVVADVL

SEQ ID NO: 1289691 - protein, 18 aa, Mycobacterium
PILFPSLALLMPVQGIIT

SEQ ID NO: 1289692 - protein, 20 aa, Mycobacterium
PILQGLCLTSSWSDWSSNDD

SEQ ID NO: 1289693 - protein, 23 aa, Mycobacterium
PKNTWPAVLTWRAHDVARMESVR

SEQ ID NO: 1289694 - protein, 17 aa, Mycobacterium
PKSFDFIDEMPRLPTGK

SEQ ID NO: 1289695 - protein, 21 aa, Mycobacterium
PLADIPLDWVLDGAVRAGVRL

SEQ ID NO: 1289696 - protein, 26 aa, Mycobacterium
PLDGFPDKRVRLMLEMHLLAPLHLSQ

SEQ ID NO: 1289697 - protein, 19 aa, Mycobacterium
PLFMAGLWTTWRPKDAPKE

SEQ ID NO: 1289698 - protein, 17 aa, Mycobacterium
PLPLLPLCGGVPTDVAW

SEQ ID NO: 1289699 - protein, 19 aa, Mycobacterium
PLPPGLGRFPLRRVSDYPD

SEQ ID NO: 1289700 - protein, 17 aa, Mycobacterium
PLRWCSMVHALGGTVVL

SEQ ID NO: 1289701 - protein, 18 aa, Mycobacterium
PMFHAWGFSQLLFAGLLA

SEQ ID NO: 1289702 - protein, 19 aa, Mycobacterium
PPAPVREWYFYTSRLTVWR

SEQ ID NO: 1289703 - protein, 18 aa, Mycobacterium
PPCVIAWEPGQRVNGELE

SEQ ID NO: 1289704 - protein, 17 aa, Mycobacterium
PPFGFKRSGQWLWWDNT

SEQ ID NO: 1289705 - protein, 22 aa, Mycobacterium
PPGVPWTVVWSFHLMPRGTDRC

SEQ ID NO: 1289706 - protein, 21 aa, Mycobacterium
PPKRWVLKGFHGFRLTEFFAG

SEQ ID NO: 1289707 - protein, 18 aa, Mycobacterium
PPSFADGFADGWFNTEEG

SEQ ID NO: 1289708 - protein, 18 aa, Mycobacterium
PQMWRWAASRSVDHRTAL

SEQ ID NO: 1289709 - protein, 18 aa, Mycobacterium
PQVVGAAMARRLSMTGEV

SEQ ID NO: 1289710 - protein, 19 aa, Mycobacterium
PRDWPRPQHGWTLTIEGDP

SEQ ID NO: 1289711 - protein, 27 aa, Mycobacterium
PRFAEEIAWWVWWCWDQQLRKIEPSLL

SEQ ID NO: 1289712 - protein, 18 aa, Mycobacterium
PRGISFLLNRNRLNVAIS

SEQ ID NO: 1289713 - protein, 18 aa, Mycobacterium
PRLPAGYADLAAHWPQGR

SEQ ID NO: 1289714 - protein, 17 aa, Mycobacterium
PRTLTWWAVQSLTKTAI

SEQ ID NO: 1289715 - protein, 18 aa, Mycobacterium
PRWPDIPGRDTFAGISVH

SEQ ID NO: 1289716 - protein, 20 aa, Mycobacterium
PRWTQGRLRWDHVVVLPNTE

SEQ ID NO: 1289717 - protein, 17 aa, Mycobacterium
PRYARAGAAFGFGPAGG

SEQ ID NO: 1289718 - protein, 23 aa, Mycobacterium
PSSMGLRFQVPFDCGVLAVKASW

SEQ ID NO: 1289719 - protein, 24 aa, Mycobacterium
PSTGSFRGSGTWIPLLRSGPGGQA

SEQ ID NO: 1289720 - protein, 18 aa, Mycobacterium
PTAGPVLDWVRAQLRVPV

SEQ ID NO: 1289721 - protein, 20 aa, Mycobacterium
PTCQGEGFVSVELLFLPGTY

SEQ ID NO: 1289722 - protein, 18 aa, Mycobacterium
PTDWGIAAVRCFHGSPAA

SEQ ID NO: 1289723 - protein, 19 aa, Mycobacterium
PTQLCAFTAGVLRAEATHE

SEQ ID NO: 1289724 - protein, 22 aa, Mycobacterium
PTRAAIEAMWEWVTASSDTLKT

SEQ ID NO: 1289725 - protein, 19 aa, Mycobacterium
PVCRACWWDDPDAGPVAGA

SEQ ID NO: 1289726 - protein, 17 aa, Mycobacterium
PVDGILFAVEWKQFCGT

SEQ ID NO: 1289727 - protein, 18 aa, Mycobacterium
PVRLIAGAQLDGWQSYPD

SEQ ID NO: 1289728 - protein, 23 aa, Mycobacterium
PVRRWEDIPGWFGWRQAQEEAVA

SEQ ID NO: 1289729 - protein, 17 aa, Mycobacterium
PVVPRPLIREVTERIDY

SEQ ID NO: 1289730 - protein, 17 aa, Mycobacterium
QAARLAKQLTWQQLADA

SEQ ID NO: 1289731 - protein, 17 aa, Mycobacterium
QAFPHVYCELDFTNPLE

SEQ ID NO: 1289732 - protein, 20 aa, Mycobacterium
QAIAVCLLWSFREPSHEQRV

SEQ ID NO: 1289733 - protein, 18 aa, Mycobacterium
QAIGEGFRSRWTGNLDPA

SEQ ID NO: 1289734 - protein, 19 aa, Mycobacterium
QAQCCVAVLRRGARPAPNG

SEQ ID NO: 1289735 - protein, 18 aa, Mycobacterium
QARVKMGLSQNIAQVTAS

SEQ ID NO: 1289736 - protein, 25 aa, Mycobacterium
QDAGRWRVPLLLAIRPEVGVDDVRA

SEQ ID NO: 1289737 - protein, 23 aa, Mycobacterium
QDVPLNYGRYSLDDSWYEYASVD

SEQ ID NO: 1289738 - protein, 22 aa, Mycobacterium
QIPKLRAGSFFPSLLERRRRID

SEQ ID NO: 1289739 - protein, 21 aa, Mycobacterium
QKVLRHVRGKWTFVMVTDRTE

SEQ ID NO: 1289740 - protein, 18 aa, Mycobacterium
QLALYVCYELHYRGFAGV

SEQ ID NO: 1289741 - protein, 18 aa, Mycobacterium
QLCRRRLLLDQAVLLAKN

SEQ ID NO: 1289742 - protein, 24 aa, Mycobacterium
QLTRKRLGTGLIEAFSTPCPHCAG

SEQ ID NO: 1289743 - protein, 20 aa, Mycobacterium
QMVKRLAWELLYATETCRSF

SEQ ID NO: 1289744 - protein, 24 aa, Mycobacterium
QNRVRRYVCLKGPDHGGCGRLTVV

SEQ ID NO: 1289745 - protein, 20 aa, Mycobacterium
QPFSGFRPGQYVSVGVTLPD

SEQ ID NO: 1289746 - protein, 18 aa, Mycobacterium
QRALQCRAFLLSRAGAEW

SEQ ID NO: 1289747 - protein, 22 aa, Mycobacterium
QRDCVYYATLIMWIGCHADSHE

SEQ ID NO: 1289748 - protein, 21 aa, Mycobacterium
QRFSSAILPAWARKSPQMTEV

SEQ ID NO: 1289749 - protein, 21 aa, Mycobacterium
QRLLLEVAWEALEHAGITPDR

SEQ ID NO: 1289750 - protein, 22 aa, Mycobacterium
QRLPWHPGRCAEVLIGDTVVGH

SEQ ID NO: 1289751 - protein, 19 aa, Mycobacterium
QRRLHLPSRIDAIRHALKA

SEQ ID NO: 1289752 - protein, 21 aa, Mycobacterium
QSGSIGLGFAIPVDQAKRIAD

SEQ ID NO: 1289753 - protein, 17 aa, Mycobacterium
QTRWRIAVEKVLRGAGL

SEQ ID NO: 1289754 - protein, 18 aa, Mycobacterium
QVSFPVECWKQPKVPDSG

SEQ ID NO: 1289755 - protein, 22 aa, Mycobacterium
QWLRCTGCGLLAPVSHNRFIYR

SEQ ID NO: 1289756 - protein, 19 aa, Mycobacterium
QYLGPALRLLNFNNIPLPI

SEQ ID NO: 1289757 - protein, 17 aa, Mycobacterium
RAAENILGYTIANDVSA

SEQ ID NO: 1289758 - protein, 19 aa, Mycobacterium
RAAKARFAVYIGDLGADTA

SEQ ID NO: 1289759 - protein, 26 aa, Mycobacterium
RAALIRTGYDWIRAWCEVFTETELLQ

SEQ ID NO: 1289760 - protein, 24 aa, Mycobacterium
RAATDVLAAWTWQQRPVAVLAMDS

SEQ ID NO: 1289761 - protein, 19 aa, Mycobacterium
RAAVPFRRIVDWAESRRAA

SEQ ID NO: 1289762 - protein, 20 aa, Mycobacterium
RAGELGLVPLHWALASLLAD

SEQ ID NO: 1289763 - protein, 18 aa, Mycobacterium
RAKYAAVIVRSEALTEYL

SEQ ID NO: 1289764 - protein, 17 aa, Mycobacterium
RALREGRLSLDQVGAIA

SEQ ID NO: 1289765 - protein, 19 aa, Mycobacterium
RAMEWPDLVPGSGAVAGGT

SEQ ID NO: 1289766 - protein, 23 aa, Mycobacterium
RAMSQMGVPYSWGGGNAAGPSRG

SEQ ID NO: 1289767 - protein, 19 aa, Mycobacterium
RAPHGAALIEWLEEPGKEH

SEQ ID NO: 1289768 - protein, 19 aa, Mycobacterium
RAREKLGWVPTVHGQTLAR

SEQ ID NO: 1289769 - protein, 28 aa, Mycobacterium
RARLNWWESRALYGWTVLVPRTKDQAGE

SEQ ID NO: 1289770 - protein, 18 aa, Mycobacterium
RARRDLYEALGFERYAGT

SEQ ID NO: 1289771 - protein, 24 aa, Mycobacterium
RAVLPAVVCDRVMPGNCFAPFHFN

SEQ ID NO: 1289772 - protein, 21 aa, Mycobacterium
RAVLRRFSPDWTHTDVTAALY

SEQ ID NO: 1289773 - protein, 22 aa, Mycobacterium
RDEVWRFTPLRRLRGLHDGSAV

SEQ ID NO: 1289774 - protein, 24 aa, Mycobacterium
RDGLRVIAIRSRLMSRLAGQGAVA

SEQ ID NO: 1289775 - protein, 22 aa, Mycobacterium
RDIGFRMPSVWFAEGHNAVAPV

SEQ ID NO: 1289776 - protein, 20 aa, Mycobacterium
RDRCAEAPFLPGASYHFVAT

SEQ ID NO: 1289777 - protein, 17 aa, Mycobacterium
REALRRLSLIGIGTAGA

SEQ ID NO: 1289778 - protein, 17 aa, Mycobacterium
REAYGLFAVNGILFNHE

SEQ ID NO: 1289779 - protein, 18 aa, Mycobacterium
REIGGRTRLDWESLSQRI

SEQ ID NO: 1289780 - protein, 20 aa, Mycobacterium
RELFNNILPAHIVKDVPGGF

SEQ ID NO: 1289781 - protein, 17 aa, Mycobacterium
RELKAGGVHVVRGPRGH

SEQ ID NO: 1289782 - protein, 22 aa, Mycobacterium
REPRPMVYSGLYPVDGSDYPVL

SEQ ID NO: 1289783 - protein, 18 aa, Mycobacterium
RERCLLFVACTRAREELL

SEQ ID NO: 1289784 - protein, 20 aa, Mycobacterium
RERGLRPAAVIGHSVGEVAA

SEQ ID NO: 1289785 - protein, 22 aa, Mycobacterium
RFEFPRLRFVASVGEPLNAEAV

SEQ ID NO: 1289786 - protein, 23 aa, Mycobacterium
RFGEPRLGLAPALSQRSGDVVPT

SEQ ID NO: 1289787 - protein, 19 aa, Mycobacterium
RFPKFDWPRIDAPFIRPGA

SEQ ID NO: 1289788 - protein, 19 aa, Mycobacterium
RFRGRRAAMRLSREYRSWP

SEQ ID NO: 1289789 - protein, 19 aa, Mycobacterium
RFVKFMITEIFPGGRIPTT

SEQ ID NO: 1289790 - protein, 22 aa, Mycobacterium
RGCTHPGCTVPFYWTEAHHTHD

SEQ ID NO: 1289791 - protein, 25 aa, Mycobacterium
RGDFIPEYLCSLSLKVNGKGGQPVY

SEQ ID NO: 1289792 - protein, 20 aa, Mycobacterium
RGDGRIVFWFTPSTHSSHMQ

SEQ ID NO: 1289793 - protein, 25 aa, Mycobacterium
RGPGGVVWRVDFAWPDRRVVAEYES

SEQ ID NO: 1289794 - protein, 20 aa, Mycobacterium
RGRHVVWAGPLGYRDPELLA

SEQ ID NO: 1289795 - protein, 21 aa, Mycobacterium
RGSGPLRWLPAIPTVLADNPH

SEQ ID NO: 1289796 - protein, 20 aa, Mycobacterium
RGTMPAGLARWAAAQLAPAV

SEQ ID NO: 1289797 - protein, 25 aa, Mycobacterium
RGVGRLLWLKAFDRVSVRSTYEDET

SEQ ID NO: 1289798 - protein, 17 aa, Mycobacterium
RGWVPWRGPTSVLSPGG

SEQ ID NO: 1289799 - protein, 22 aa, Mycobacterium
RHKYRVCPTCGRFQRGQELDPA

SEQ ID NO: 1289800 - protein, 19 aa, Mycobacterium
RHLFTVLMDREWKHGVTAA

SEQ ID NO: 1289801 - protein, 17 aa, Mycobacterium
RHLVAGLMLIHLDIDAA

SEQ ID NO: 1289802 - protein, 18 aa, Mycobacterium
RHLVKFVACDGALWAVKE

SEQ ID NO: 1289803 - protein, 18 aa, Mycobacterium
RIAGRCAGIGGLARAGEV

SEQ ID NO: 1289804 - protein, 17 aa, Mycobacterium
RIALPVTFDTLRGSGQS

SEQ ID NO: 1289805 - protein, 20 aa, Mycobacterium
RIDYYAAWLQRFETALRALP

SEQ ID NO: 1289806 - protein, 20 aa, Mycobacterium
RIGLAAAKYWVCKRATPHAA

SEQ ID NO: 1289807 - protein, 17 aa, Mycobacterium
RIGTAVEEFVRWSTPVL

SEQ ID NO: 1289808 - protein, 25 aa, Mycobacterium
RIKSIGLRLGVPWYAYDTITFTGEV

SEQ ID NO: 1289809 - protein, 23 aa, Mycobacterium
RILEKWGGGGVFVLDETLRPVPV

SEQ ID NO: 1289810 - protein, 19 aa, Mycobacterium
RIRPPVCARASDLRAMGLP

SEQ ID NO: 1289811 - protein, 25 aa, Mycobacterium
RIRSIGLRLGVPWYAYDTITFTGEV

SEQ ID NO: 1289812 - protein, 20 aa, Mycobacterium
RITLWRDYFDTVDFLKATVR

SEQ ID NO: 1289813 - protein, 20 aa, Mycobacterium
RIVDCPACGGMLKPDIVYFG

SEQ ID NO: 1289814 - protein, 17 aa, Mycobacterium
RKIVRRLLDAGSVSGEF

SEQ ID NO: 1289815 - protein, 22 aa, Mycobacterium
RKQWPSGLTKLGLDLSGRIHDG

SEQ ID NO: 1289816 - protein, 18 aa, Mycobacterium
RKVIPLLPGYRCITPTLP

SEQ ID NO: 1289817 - protein, 19 aa, Mycobacterium
RKVVGWARDRGVLVASDEC

SEQ ID NO: 1289818 - protein, 18 aa, Mycobacterium
RLAAELVAPLGPVLVEAA

SEQ ID NO: 1289819 - protein, 24 aa, Mycobacterium
RLAALKLIDGRDVWAAGAKLADLL

SEQ ID NO: 1289820 - protein, 17 aa, Mycobacterium
RLAGLVAHQEVLFGTQG

SEQ ID NO: 1289821 - protein, 17 aa, Mycobacterium
RLDQMIRYYVEHQLDVI

SEQ ID NO: 1289822 - protein, 17 aa, Mycobacterium
RLEEAFTAAGLMPRIAF

SEQ ID NO: 1289823 - protein, 18 aa, Mycobacterium
RLKKTLLQGTRWGDENAK

SEQ ID NO: 1289824 - protein, 19 aa, Mycobacterium
RLLLQRGIRSVPVVDDECR

SEQ ID NO: 1289825 - protein, 17 aa, Mycobacterium
RLREFALREGLADAGQR

SEQ ID NO: 1289826 - protein, 18 aa, Mycobacterium
RLRVGLAVGQAVSRAGDW

SEQ ID NO: 1289827 - protein, 22 aa, Mycobacterium
RLRVLARRDFAGLITVAVDSPE

SEQ ID NO: 1289828 - protein, 23 aa, Mycobacterium
RLVWQCASLLLSYPDHSRFDTAE

SEQ ID NO: 1289829 - protein, 19 aa, Mycobacterium
RMYRPFPVEALAAALPETV

SEQ ID NO: 1289830 - protein, 17 aa, Mycobacterium
RNRYRMSMLVPDHLSTR

SEQ ID NO: 1289831 - protein, 21 aa, Mycobacterium
RPAAEIVRMLLERIVGSLEAP

SEQ ID NO: 1289832 - protein, 18 aa, Mycobacterium
RPAALPFLSIKKITVHYR

SEQ ID NO: 1289833 - protein, 22 aa, Mycobacterium
RPAGWWIRRRVHEVAVHRADAA

SEQ ID NO: 1289834 - protein, 18 aa, Mycobacterium
RPDIGVTILRLANMIGPA

SEQ ID NO: 1289835 - protein, 19 aa, Mycobacterium
RPEDLAGWAGDVFDHHQRF

SEQ ID NO: 1289836 - protein, 17 aa, Mycobacterium
RPGPGRRLGVLVDHLVT

SEQ ID NO: 1289837 - protein, 24 aa, Mycobacterium
RPIAVEAYGLFIFRDAIRALGGST

SEQ ID NO: 1289838 - protein, 20 aa, Mycobacterium
RPMYRARGWVPWRGPTSVLS

SEQ ID NO: 1289839 - protein, 20 aa, Mycobacterium
RPNLPPGFDFTDPDIYAERL

SEQ ID NO: 1289840 - protein, 18 aa, Mycobacterium
RPRALVVVSHDRWFLDAV

SEQ ID NO: 1289841 - protein, 20 aa, Mycobacterium
RPSAELRTLIGLRDAAVALV

SEQ ID NO: 1289842 - protein, 19 aa, Mycobacterium
RPSMRGVPFSFVRVDRAGN

SEQ ID NO: 1289843 - protein, 18 aa, Mycobacterium
RPSTWWCEPCAATLTVRA

SEQ ID NO: 1289844 - protein, 24 aa, Mycobacterium
RPWVCLLCPLAVFAPRHAANLLRL

SEQ ID NO: 1289845 - protein, 19 aa, Mycobacterium
RPYAELLVDGFGIPEQLRY

SEQ ID NO: 1289846 - protein, 20 aa, Mycobacterium
RRAAVFGCASGALRLTDGGA

SEQ ID NO: 1289847 - protein, 19 aa, Mycobacterium
RRDDLWDRLIEACRPGMTT

SEQ ID NO: 1289848 - protein, 22 aa, Mycobacterium
RRELWARLGGALKPPHLADLSH

SEQ ID NO: 1289849 - protein, 18 aa, Mycobacterium
RRGECPFGSEGNADGPLP

SEQ ID NO: 1289850 - protein, 18 aa, Mycobacterium
RRGGEWLDWFAAERITAI

SEQ ID NO: 1289851 - protein, 23 aa, Mycobacterium
RRGLTIDLGFAWADIGGREMAFV

SEQ ID NO: 1289852 - protein, 17 aa, Mycobacterium
RRLCTGCGQLTAADAAR

SEQ ID NO: 1289853 - protein, 26 aa, Mycobacterium
RRLLDRISLGGAWDMVKGVFTGEADD

SEQ ID NO: 1289854 - protein, 19 aa, Mycobacterium
RRLPDLKVRVVNVVDIMRL

SEQ ID NO: 1289855 - protein, 26 aa, Mycobacterium
RRPSYRPAAPPARRAAGAAPQFEVMY

SEQ ID NO: 1289856 - protein, 17 aa, Mycobacterium
RRSRRITALAGRYRDVD

SEQ ID NO: 1289857 - protein, 22 aa, Mycobacterium
RRYILDCALRWMRDFHADGLRL

SEQ ID NO: 1289858 - protein, 17 aa, Mycobacterium
RSAELGRVLARCSYLCD

SEQ ID NO: 1289859 - protein, 19 aa, Mycobacterium
RSHVFFDWFDAVGVADLPA

SEQ ID NO: 1289860 - protein, 20 aa, Mycobacterium
RSKFPQRWWWVVLTDEPFPR

SEQ ID NO: 1289861 - protein, 20 aa, Mycobacterium
RSLRVAWTLADLAGRQVPGV

SEQ ID NO: 1289862 - protein, 24 aa, Mycobacterium
RSNNCLDCSLSALSSFRGDPTVSA

SEQ ID NO: 1289863 - protein, 23 aa, Mycobacterium
RSYSPRFLFAWPNSKSAVMGPAQ

SEQ ID NO: 1289864 - protein, 20 aa, Mycobacterium
RTIRLPVHLVEQVNKLARIK

SEQ ID NO: 1289865 - protein, 17 aa, Mycobacterium
RTLRLDQMIRYYVEHQL

SEQ ID NO: 1289866 - protein, 17 aa, Mycobacterium
RTPLRLLFIDGGHTEEA

SEQ ID NO: 1289867 - protein, 23 aa, Mycobacterium
RTPRPPSGWLRMGGISSHNLRDL

SEQ ID NO: 1289868 - protein, 19 aa, Mycobacterium
RTRAIELLELVGLGHRIHH

SEQ ID NO: 1289869 - protein, 18 aa, Mycobacterium
RWADKEWLRKHNVDRISR

SEQ ID NO: 1289870 - protein, 19 aa, Mycobacterium
RWIRLRLSRGLGLEAGGGR

SEQ ID NO: 1289871 - protein, 20 aa, Mycobacterium
RWVRRGGYVLSSFVAAALPA

SEQ ID NO: 1289872 - protein, 24 aa, Mycobacterium
RYGLDMWLRVGATWLSAVDALAAL

SEQ ID NO: 1289873 - protein, 18 aa, Mycobacterium
SAEARSALMLSATRDLPA

SEQ ID NO: 1289874 - protein, 18 aa, Mycobacterium
SAEPLINVARDFMSTEKL

SEQ ID NO: 1289875 - protein, 20 aa, Mycobacterium
SAKLCVQYLAPIIKNRQYNF

SEQ ID NO: 1289876 - protein, 22 aa, Mycobacterium
SAKRLWCRLGDFAPSTDRISAA

SEQ ID NO: 1289877 - protein, 23 aa, Mycobacterium
SAPRAARLEACFEELAELTGQRN

SEQ ID NO: 1289878 - protein, 17 aa, Mycobacterium
SAWCKAAGVAIRHRNPS

SEQ ID NO: 1289879 - protein, 27 aa, Mycobacterium
SCQQVWCPVCALAALVQGEQHPLLNVV

SEQ ID NO: 1289880 - protein, 17 aa, Mycobacterium
SDGGFGLHVFHKNNELA

SEQ ID NO: 1289881 - protein, 18 aa, Mycobacterium
SDILPISVGFPFGVSAVV

SEQ ID NO: 1289882 - protein, 19 aa, Mycobacterium
SDPGFRLVADRAFTDRAHA

SEQ ID NO: 1289883 - protein, 21 aa, Mycobacterium
SDWRMPYVLNPRGIQFTEPKW

SEQ ID NO: 1289884 - protein, 18 aa, Mycobacterium
SEALALLRLPLVLPTLQV

SEQ ID NO: 1289885 - protein, 21 aa, Mycobacterium
SEGWWPFLVGLSMGDAGGYKS

SEQ ID NO: 1289886 - protein, 23 aa, Mycobacterium
SELGFDYVDLFLIHWPLPTLYDG

SEQ ID NO: 1289887 - protein, 24 aa, Mycobacterium
SFRRYRWVLPMARLIGNAARMSAD

SEQ ID NO: 1289888 - protein, 17 aa, Mycobacterium
SGEWKDGEALFLRCNIW

SEQ ID NO: 1289889 - protein, 25 aa, Mycobacterium
SGGRFAVNIVNAWWVPDLERSGIGM

SEQ ID NO: 1289890 - protein, 18 aa, Mycobacterium
SGPMPKWYAPVGSLFDQF

SEQ ID NO: 1289891 - protein, 22 aa, Mycobacterium
SGRIKLAWFLLHVARYLPPLLY

SEQ ID NO: 1289892 - protein, 17 aa, Mycobacterium
SGWPCRRHLDGSVVSVE

SEQ ID NO: 1289893 - protein, 17 aa, Mycobacterium
SLLVSHVLVPPAISAIM

SEQ ID NO: 1289894 - protein, 29 aa, Mycobacterium
SLQWIPDWMWRLNLKVLGPFAVWVTVGLY

SEQ ID NO: 1289895 - protein, 20 aa, Mycobacterium
SPRIRLWWRPAEPMPDDPIL

SEQ ID NO: 1289896 - protein, 21 aa, Mycobacterium
SRGGWKPFLHHVSNRMPRSRR

SEQ ID NO: 1289897 - protein, 21 aa, Mycobacterium
SRIAGPAIRRGWLDDGPGPSR

SEQ ID NO: 1289898 - protein, 20 aa, Mycobacterium
SRIDIPGWLARTGFQMLDPV

SEQ ID NO: 1289899 - protein, 21 aa, Mycobacterium
SRIDIPGWLARTGFQMLDPVK

SEQ ID NO: 1289900 - protein, 19 aa, Mycobacterium
SRPDMFAHYGRPFPTGEAV

SEQ ID NO: 1289901 - protein, 20 aa, Mycobacterium
SRPLPLPDMCYAAAATGELP

SEQ ID NO: 1289902 - protein, 22 aa, Mycobacterium
SRQRLKLALSRYAEHRATGPLP

SEQ ID NO: 1289903 - protein, 22 aa, Mycobacterium
SRRLWTVLIFMLWHAIFVEGSV

SEQ ID NO: 1289904 - protein, 19 aa, Mycobacterium
SRRSYLWGMLHARRRRLEP

SEQ ID NO: 1289905 - protein, 17 aa, Mycobacterium
SRWHDVRRVLAPLIQQV

SEQ ID NO: 1289906 - protein, 20 aa, Mycobacterium
SRYGLVGVHCDVWEGFIFVN

SEQ ID NO: 1289907 - protein, 18 aa, Mycobacterium
SSERYGLFVPRLYGDDFT

SEQ ID NO: 1289908 - protein, 19 aa, Mycobacterium
SSGELHLDWWYDTRRVPQE

SEQ ID NO: 1289909 - protein, 18 aa, Mycobacterium
STAWACGLMAVHAHTVAN

SEQ ID NO: 1289910 - protein, 19 aa, Mycobacterium
STFRYAAPAGRDWAPEDLA

SEQ ID NO: 1289911 - protein, 19 aa, Mycobacterium
SVDCARYWLDADRPISKDD

SEQ ID NO: 1289912 - protein, 17 aa, Mycobacterium
SVGYRLAPEHPWPAAAE

SEQ ID NO: 1289913 - protein, 17 aa, Mycobacterium
SVSCPRSGEVIVRDGAD

SEQ ID NO: 1289914 - protein, 18 aa, Mycobacterium
SWAAEIYADLGLRFDGAR

SEQ ID NO: 1289915 - protein, 18 aa, Mycobacterium
SWLPLYHDMGLAFLLTNA

SEQ ID NO: 1289916 - protein, 24 aa, Mycobacterium
SWLPTGAVPLDFDPCPKLRKLTLA

SEQ ID NO: 1289917 - protein, 22 aa, Mycobacterium
SWTTEIAPPWARPLIAANANPT

SEQ ID NO: 1289918 - protein, 18 aa, Mycobacterium
TAAALWILHPTYFGTTAD

SEQ ID NO: 1289919 - protein, 18 aa, Mycobacterium
TACAVAFGSAFAATTRHA

SEQ ID NO: 1289920 - protein, 20 aa, Mycobacterium
TADEAFALLIERSQRENVKL

SEQ ID NO: 1289921 - protein, 19 aa, Mycobacterium
TADMTVHFLAPVVVGPARA

SEQ ID NO: 1289922 - protein, 25 aa, Mycobacterium
TAEGCADLLYATRLVGVPLNPAAAV

SEQ ID NO: 1289923 - protein, 23 aa, Mycobacterium
TALRAAAVLACYRYHADAHGLVG

SEQ ID NO: 1289924 - protein, 22 aa, Mycobacterium
TAMMIRPQWRFRRGRAAAGGPG

SEQ ID NO: 1289925 - protein, 18 aa, Mycobacterium
TARSWAWLSGRNYVTPDD

SEQ ID NO: 1289926 - protein, 19 aa, Mycobacterium
TCTAWPVLRRSLAMRALSG

SEQ ID NO: 1289927 - protein, 17 aa, Mycobacterium
TDFPNAWIRAGRRRSRE

SEQ ID NO: 1289928 - protein, 22 aa, Mycobacterium
TEFEPGRRWSWQVAGIPATAHG

SEQ ID NO: 1289929 - protein, 17 aa, Mycobacterium
TEFPYVFCDATFCKVRI

SEQ ID NO: 1289930 - protein, 21 aa, Mycobacterium
TEGLRVIAVRSRLMSRLAGQG

SEQ ID NO: 1289931 - protein, 17 aa, Mycobacterium
TELPDWLAANKGLAPGG

SEQ ID NO: 1289932 - protein, 17 aa, Mycobacterium
TELRRKIGYSIQQAGLF

SEQ ID NO: 1289933 - protein, 23 aa, Mycobacterium
TERFAGAVGLNWYTTDPTLQFTL

SEQ ID NO: 1289934 - protein, 20 aa, Mycobacterium
TETEVWRWYLVDKNAPDDVR

SEQ ID NO: 1289935 - protein, 30 aa, Mycobacterium
TEYRAQWLICRALEVVLGWIADGNSGAVPA

SEQ ID NO: 1289936 - protein, 18 aa, Mycobacterium
TFPRPKVTASLERIGRAL

SEQ ID NO: 1289937 - protein, 17 aa, Mycobacterium
TGARPPVAFAPDDTGYG

SEQ ID NO: 1289938 - protein, 26 aa, Mycobacterium
TGEAWVWSPAFLRLLQRVRITMSDTF

SEQ ID NO: 1289939 - protein, 18 aa, Mycobacterium
TGPRSIKAAADWISVNAT

SEQ ID NO: 1289940 - protein, 20 aa, Mycobacterium
TGVSNFSGWQLMKSLAVADG

SEQ ID NO: 1289941 - protein, 18 aa, Mycobacterium
TICSRLGFRPDVKRIPLF

SEQ ID NO: 1289942 - protein, 19 aa, Mycobacterium
TIRLPVHLVEQVNKLARIK

SEQ ID NO: 1289943 - protein, 21 aa, Mycobacterium
TIYRWWPSRPALVADVLLEDA

SEQ ID NO: 1289944 - protein, 18 aa, Mycobacterium
TLFRRFGSRAGLMVVLLD

SEQ ID NO: 1289945 - protein, 18 aa, Mycobacterium
TLIELLRLFAPLPTQLEG

SEQ ID NO: 1289946 - protein, 26 aa, Mycobacterium
TLLDVGCGWGYTMMRAVEKYDVNVIG

SEQ ID NO: 1289947 - protein, 25 aa, Mycobacterium
TLPQWLRRRLALLLDLCYGAGARPP

SEQ ID NO: 1289948 - protein, 23 aa, Mycobacterium
TLQSGPEFGRWLAERGSAQAPET

SEQ ID NO: 1289949 - protein, 23 aa, Mycobacterium
TLTALNGTIVWKGLADRDKVFDA

SEQ ID NO: 1289950 - protein, 17 aa, Mycobacterium
TLTRLAGVLGYADSSAL

SEQ ID NO: 1289951 - protein, 24 aa, Mycobacterium
TLVDPRSSLPIEWVNEILSLTVRL

SEQ ID NO: 1289952 - protein, 17 aa, Mycobacterium
TPPPVRGALVARLGELL

SEQ ID NO: 1289953 - protein, 18 aa, Mycobacterium
TQLCAFTAGVLRAEATHE

SEQ ID NO: 1289954 - protein, 23 aa, Mycobacterium
TQSYRLLKHGGFERILFLVDRNN

SEQ ID NO: 1289955 - protein, 18 aa, Mycobacterium
TRGAPLCTFRETARTLAG

SEQ ID NO: 1289956 - protein, 18 aa, Mycobacterium
TRVQILWALVSHEKSVND

SEQ ID NO: 1289957 - protein, 24 aa, Mycobacterium
TTDWRRLTVTLAWLSPVNTATRRH

SEQ ID NO: 1289958 - protein, 21 aa, Mycobacterium
TTKTRFVIVDAIGVTEHDFVE

SEQ ID NO: 1289959 - protein, 17 aa, Mycobacterium
TTRGGPDYGRFVEAVRE

SEQ ID NO: 1289960 - protein, 18 aa, Mycobacterium
TVTWSLRSARAWWEMTWQ

SEQ ID NO: 1289961 - protein, 18 aa, Mycobacterium
TYAPWDFFSDWKVIDAFG

SEQ ID NO: 1289962 - protein, 18 aa, Mycobacterium
TYRLPWPSGSVVYEIDQP

SEQ ID NO: 1289963 - protein, 17 aa, Mycobacterium
VAAEGIEPFGFYYEKFA

SEQ ID NO: 1289964 - protein, 22 aa, Mycobacterium
VAGSLRASRQWGLPHEVLDADE

SEQ ID NO: 1289965 - protein, 20 aa, Mycobacterium
VAPMRLCHHFAPAMAARGRG

SEQ ID NO: 1289966 - protein, 26 aa, Mycobacterium
VARHAWRPRWLKWSLTISGKGGTHRG

SEQ ID NO: 1289967 - protein, 17 aa, Mycobacterium
VARYPARFQLVMAANPC

SEQ ID NO: 1289968 - protein, 18 aa, Mycobacterium
VAVARPLLAPAIESADAV

SEQ ID NO: 1289969 - protein, 17 aa, Mycobacterium
VCLGLPGSLPVLNQQAV

SEQ ID NO: 1289970 - protein, 24 aa, Mycobacterium
VDAADLPGGIAIRPTLKEAVAYLE

SEQ ID NO: 1289971 - protein, 18 aa, Mycobacterium
VDCTHCWELANPALDDFL

SEQ ID NO: 1289972 - protein, 18 aa, Mycobacterium
VDGIWAEFVPPNANVPSP

SEQ ID NO: 1289973 - protein, 19 aa, Mycobacterium
VDRLLALGARRVDIGQGEQ

SEQ ID NO: 1289974 - protein, 20 aa, Mycobacterium
VDVPRLGLMLVVGQPKNTAE

SEQ ID NO: 1289975 - protein, 21 aa, Mycobacterium
VEEARALAALLTKHADKLESS

SEQ ID NO: 1289976 - protein, 18 aa, Mycobacterium
VEEFVRWSTPVLQFARFA

SEQ ID NO: 1289977 - protein, 21 aa, Mycobacterium
VEGAFYWLSNREVRWRPAEYW

SEQ ID NO: 1289978 - protein, 17 aa, Mycobacterium
VEIPDHFRTYVAEKLTR

SEQ ID NO: 1289979 - protein, 18 aa, Mycobacterium
VELSWNILDPVLDYWASH

SEQ ID NO: 1289980 - protein, 23 aa, Mycobacterium
VERMHRSCLILTFGGGTNEIQRD

SEQ ID NO: 1289981 - protein, 18 aa, Mycobacterium
VFDGCDFSGVDMSESEHV

SEQ ID NO: 1289982 - protein, 18 aa, Mycobacterium
VFLDRVALCFIDDEFGVE

SEQ ID NO: 1289983 - protein, 19 aa, Mycobacterium
VFLSEEWRQVVLARRISTA

SEQ ID NO: 1289984 - protein, 17 aa, Mycobacterium
VGAYFPLGWQMACHVHG

SEQ ID NO: 1289985 - protein, 19 aa, Mycobacterium
VGEDGEWPLFLDVWVEHAV

SEQ ID NO: 1289986 - protein, 17 aa, Mycobacterium
VGFAHRWSGSQSIGRTS

SEQ ID NO: 1289987 - protein, 23 aa, Mycobacterium
VGLRRIGPSAARVDGCLARLRVD

SEQ ID NO: 1289988 - protein, 17 aa, Mycobacterium
VGQLLGSGWKGGAASAF

SEQ ID NO: 1289989 - protein, 18 aa, Mycobacterium
VGRPPVIRRAILTLFADR

SEQ ID NO: 1289990 - protein, 25 aa, Mycobacterium
VHLAIRPGQDWALLLAMVKVVLDEG

SEQ ID NO: 1289991 - protein, 21 aa, Mycobacterium
VHLRRCAACGHIGCCDDSLAR

SEQ ID NO: 1289992 - protein, 19 aa, Mycobacterium
VHVLDMLRYLVGEVAEVSA

SEQ ID NO: 1289993 - protein, 18 aa, Mycobacterium
VHVVLQFGSTVRDTAARI

SEQ ID NO: 1289994 - protein, 22 aa, Mycobacterium
VHYRPRPVVGIIAPWNYPVANA

SEQ ID NO: 1289995 - protein, 18 aa, Mycobacterium
VHYTRTPDEFSWRAGEVL

SEQ ID NO: 1289996 - protein, 20 aa, Mycobacterium
VKAWAEAMVAAWVAGVDREI

SEQ ID NO: 1289997 - protein, 17 aa, Mycobacterium
VKGGWLSTGAPWSYDEP

SEQ ID NO: 1289998 - protein, 18 aa, Mycobacterium
VLASRLLTDFPFRNWEDE

SEQ ID NO: 1289999 - protein, 18 aa, Mycobacterium
VLDGLGLDYSIMFPTLAS

SEQ ID NO: 1290000 - protein, 23 aa, Mycobacterium
VLESWAGGWSFRHELLREVAAEL

SEQ ID NO: 1290001 - protein, 22 aa, Mycobacterium
VLGGGALPFGIFAGGLLTGPEL

SEQ ID NO: 1290002 - protein, 18 aa, Mycobacterium
VLIPAGWCGYSGPRARGM

SEQ ID NO: 1290003 - protein, 19 aa, Mycobacterium
VLMDREWKHGVTAAVDVTL

SEQ ID NO: 1290004 - protein, 19 aa, Mycobacterium
VLPVRCPHVPRNAQDLVWD

SEQ ID NO: 1290005 - protein, 19 aa, Mycobacterium
VLRELRAGLHFNALSLSGI

SEQ ID NO: 1290006 - protein, 21 aa, Mycobacterium
VLRVVRFWISHGVKVFRVDNP

SEQ ID NO: 1290007 - protein, 23 aa, Mycobacterium
VLSRPCPDCGFDASAVHHSDVAD

SEQ ID NO: 1290008 - protein, 19 aa, Mycobacterium
VLTALAWVRDNIAAFGGDP

SEQ ID NO: 1290009 - protein, 18 aa, Mycobacterium
VMAGTGFLGAHADEVYRL

SEQ ID NO: 1290010 - protein, 17 aa, Mycobacterium
VMVRPLIRLSLGKRAPM

SEQ ID NO: 1290011 - protein, 24 aa, Mycobacterium
VNPIDWKIVAGFMREQIPLQLPAG

SEQ ID NO: 1290012 - protein, 17 aa, Mycobacterium
VPAEALAAVNLMSMFGL

SEQ ID NO: 1290013 - protein, 18 aa, Mycobacterium
VPAIPRLPSGKVLRRVLK

SEQ ID NO: 1290014 - protein, 17 aa, Mycobacterium
VPCLEMVQQFAASPPDF

SEQ ID NO: 1290015 - protein, 17 aa, Mycobacterium
VPEAVGVLAARRFDDDT

SEQ ID NO: 1290016 - protein, 19 aa, Mycobacterium
VPICRTAEFLAWFLENVPI

SEQ ID NO: 1290017 - protein, 23 aa, Mycobacterium
VPRHMLETWAFRTFTVHPRENRF

SEQ ID NO: 1290018 - protein, 19 aa, Mycobacterium
VPRKGIPLVAKRLGQGIGG

SEQ ID NO: 1290019 - protein, 22 aa, Mycobacterium
VPYYRVLELAPWLNWPQPNFPV

SEQ ID NO: 1290020 - protein, 17 aa, Mycobacterium
VQLAPWLEPEPVCWAIE

SEQ ID NO: 1290021 - protein, 19 aa, Mycobacterium
VQLDQCWDLLRQRRALRDS

SEQ ID NO: 1290022 - protein, 17 aa, Mycobacterium
VRCARVGALPGLTATLA

SEQ ID NO: 1290023 - protein, 19 aa, Mycobacterium
VRCTWLRNWVNGASGQRLG

SEQ ID NO: 1290024 - protein, 19 aa, Mycobacterium
VRLLAMLPLAPLVPFAHDG

SEQ ID NO: 1290025 - protein, 22 aa, Mycobacterium
VRPEPFGALLYHFGTRKLSFLK

SEQ ID NO: 1290026 - protein, 19 aa, Mycobacterium
VRQRVRWLALHGFVRGMSR

SEQ ID NO: 1290027 - protein, 17 aa, Mycobacterium
VRVPIDFSLDDCDLSDG

SEQ ID NO: 1290028 - protein, 24 aa, Mycobacterium
VRYDWPVRTGIIIGRLDADGSRFL

SEQ ID NO: 1290029 - protein, 23 aa, Mycobacterium
VSFLPELLRWVPFTKGDYWVLKI

SEQ ID NO: 1290030 - protein, 18 aa, Mycobacterium
VSGDAWPGVSVVSVTWTR

SEQ ID NO: 1290031 - protein, 22 aa, Mycobacterium
VSLLRARLGAVFAGGPKALPPM

SEQ ID NO: 1290032 - protein, 17 aa, Mycobacterium
VSLRAGSDIALLGGVIN

SEQ ID NO: 1290033 - protein, 24 aa, Mycobacterium
VSPPTKWHLIVPFLNVLPGGMFAG

SEQ ID NO: 1290034 - protein, 17 aa, Mycobacterium
VSVSWIYRGGRADLVPE

SEQ ID NO: 1290035 - protein, 18 aa, Mycobacterium
VTLGIALARLGMFAPAMS

SEQ ID NO: 1290036 - protein, 19 aa, Mycobacterium
VTLNEEFPRLKVYRGPRKK

SEQ ID NO: 1290037 - protein, 23 aa, Mycobacterium
VTNCARTAFDLGRRLPRDDAVAR

SEQ ID NO: 1290038 - protein, 21 aa, Mycobacterium
VTPKSSWPWVRTLLHSVFDQP

SEQ ID NO: 1290039 - protein, 18 aa, Mycobacterium
VTVGLVFRALFGQPDLLS

SEQ ID NO: 1290040 - protein, 17 aa, Mycobacterium
VTVRVPIDFSLDDCDLS

SEQ ID NO: 1290041 - protein, 17 aa, Mycobacterium
VVDRTWAALKYVAGTTT

SEQ ID NO: 1290042 - protein, 19 aa, Mycobacterium
VVLAPRLWVPDDFGLSRYL

SEQ ID NO: 1290043 - protein, 19 aa, Mycobacterium
VVLGDAWGLLKFLDEGAFV

SEQ ID NO: 1290044 - protein, 17 aa, Mycobacterium
VVSGWFKDEFTHLGEPW

SEQ ID NO: 1290045 - protein, 27 aa, Mycobacterium
VWFPGKKGGPGWVEWGGCGMVNPNVLR

SEQ ID NO: 1290046 - protein, 21 aa, Mycobacterium
VWRDNGRWSRFFMVPGGHIHR

SEQ ID NO: 1290047 - protein, 25 aa, Mycobacterium
VYNAGGPDLLVWVAPPPAAPAGSGA

SEQ ID NO: 1290048 - protein, 23 aa, Mycobacterium
WADLVVTLRPEWTAGQARFAVYA

SEQ ID NO: 1290049 - protein, 18 aa, Mycobacterium
WALAVKMSPVLSGASAVR

SEQ ID NO: 1290050 - protein, 24 aa, Mycobacterium
WAPWCGPCRAFAPVFERSSQTHPD

SEQ ID NO: 1290051 - protein, 18 aa, Mycobacterium
WATWCGPCKMVAPVLEEI

SEQ ID NO: 1290052 - protein, 19 aa, Mycobacterium
WATWCGPCKMVAPVLEEIA

SEQ ID NO: 1290053 - protein, 20 aa, Mycobacterium
WAVGEWAHWRVLKQAEDEQR

SEQ ID NO: 1290054 - protein, 22 aa, Mycobacterium
WCGYCVRLKKALQVEGIAWTEV

SEQ ID NO: 1290055 - protein, 17 aa, Mycobacterium
WCKAAGVAIRHRNPSAT

SEQ ID NO: 1290056 - protein, 19 aa, Mycobacterium
WDFFSDWKVIDAFGARSEI

SEQ ID NO: 1290057 - protein, 24 aa, Mycobacterium
WEALQIPVGLAFFFRNSALGRVVA

SEQ ID NO: 1290058 - protein, 18 aa, Mycobacterium
WEQFIPFLAFPPELRRVI

SEQ ID NO: 1290059 - protein, 17 aa, Mycobacterium
WFEGLLWFSDMFGEAVH

SEQ ID NO: 1290060 - protein, 18 aa, Mycobacterium
WFLNGADFIALRKLKETT

SEQ ID NO: 1290061 - protein, 18 aa, Mycobacterium
WFTCALSRLDVVRATAAL

SEQ ID NO: 1290062 - protein, 17 aa, Mycobacterium
WGALTALVFDNRDSWRR

SEQ ID NO: 1290063 - protein, 20 aa, Mycobacterium
WGETPFTIGLWVGTAVSPKR

SEQ ID NO: 1290064 - protein, 18 aa, Mycobacterium
WHQACWKVAGAPMDYRGA

SEQ ID NO: 1290065 - protein, 17 aa, Mycobacterium
WIREQCSFLPTRIDPPN

SEQ ID NO: 1290066 - protein, 20 aa, Mycobacterium
WKHGVCAALGWPHDTQADIA

SEQ ID NO: 1290067 - protein, 19 aa, Mycobacterium
WKVPKAWLDSGVVKEAHSW

SEQ ID NO: 1290068 - protein, 19 aa, Mycobacterium
WLAARGMTGLLQRTVVVLN

SEQ ID NO: 1290069 - protein, 17 aa, Mycobacterium
WLALDGQPLHRVIVAAS

SEQ ID NO: 1290070 - protein, 19 aa, Mycobacterium
WLARDRWAVPLVHTAHTLA

SEQ ID NO: 1290071 - protein, 18 aa, Mycobacterium
WLARTGFQMLDPVKTAQA

SEQ ID NO: 1290072 - protein, 31 aa, Mycobacterium
WLFRHVPFYRAWFRFRLYWIYTERNYPALRV

SEQ ID NO: 1290073 - protein, 17 aa, Mycobacterium
WLMQHVRAGVVQTSDAA

SEQ ID NO: 1290074 - protein, 25 aa, Mycobacterium
WLRAWPVPGGDLWAVPTGWRVGDHA

SEQ ID NO: 1290075 - protein, 27 aa, Mycobacterium
WLREGLRFWLRSALTYDLLTWSSVVDR

SEQ ID NO: 1290076 - protein, 17 aa, Mycobacterium
WLSLWSATIDDMYRGPV

SEQ ID NO: 1290077 - protein, 18 aa, Mycobacterium
WLTPQWDADFGVAHGLPV

SEQ ID NO: 1290078 - protein, 17 aa, Mycobacterium
WNAVCWAIIIPAGRLRT

SEQ ID NO: 1290079 - protein, 20 aa, Mycobacterium
WNLDTGYDWAHRFDDAAREV

SEQ ID NO: 1290080 - protein, 17 aa, Mycobacterium
WNQAGDVMAGWDGASTG

SEQ ID NO: 1290081 - protein, 17 aa, Mycobacterium
WNRYLAVNLTGTFLSIR

SEQ ID NO: 1290082 - protein, 17 aa, Mycobacterium
WPDFTFRFRNQTRRFDL

SEQ ID NO: 1290083 - protein, 17 aa, Mycobacterium
WPDKRPYAPGSVLPASA

SEQ ID NO: 1290084 - protein, 18 aa, Mycobacterium
WPSRRSWEAMARVLAHLR

SEQ ID NO: 1290085 - protein, 26 aa, Mycobacterium
WRGKAVLVKLIWRMVRARVFGDRMAA

SEQ ID NO: 1290086 - protein, 17 aa, Mycobacterium
WRITETLAPTAAVPEPQ

SEQ ID NO: 1290087 - protein, 25 aa, Mycobacterium
WRKAGFRFSLDWLLRNATAVATGRA

SEQ ID NO: 1290088 - protein, 17 aa, Mycobacterium
WRMLLDLGRMQDGEPHL

SEQ ID NO: 1290089 - protein, 19 aa, Mycobacterium
WRPVDGVAIANERYALSVD

SEQ ID NO: 1290090 - protein, 19 aa, Mycobacterium
WRQWWTWSPGACWRHPLGP

SEQ ID NO: 1290091 - protein, 18 aa, Mycobacterium
WRTLTWLQAHGWSRLLPR

SEQ ID NO: 1290092 - protein, 18 aa, Mycobacterium
WRTPLRLLFIDGGHTEEA

SEQ ID NO: 1290093 - protein, 21 aa, Mycobacterium
WSLRSARAWWEMTWQGRPDPS

SEQ ID NO: 1290094 - protein, 18 aa, Mycobacterium
WSPQEWKEVVFAPSTTSP

SEQ ID NO: 1290095 - protein, 18 aa, Mycobacterium
WSRLLPRTVVALNRTASH

SEQ ID NO: 1290096 - protein, 17 aa, Mycobacterium
WSWRHQLRGLGGARVVA

SEQ ID NO: 1290097 - protein, 25 aa, Mycobacterium
WTDKPRLLATFPFPHVLTMSVTLAD

SEQ ID NO: 1290098 - protein, 21 aa, Mycobacterium
WTEEVFKAFNFQTELTFDESE

SEQ ID NO: 1290099 - protein, 17 aa, Mycobacterium
WTNCYHMYPAHAAFGGY

SEQ ID NO: 1290100 - protein, 18 aa, Mycobacterium
WTPGASWRHPIGPGSSIV

SEQ ID NO: 1290101 - protein, 22 aa, Mycobacterium
WTSLAHLCQWGLATVRTDPDAP

SEQ ID NO: 1290102 - protein, 18 aa, Mycobacterium
WVNARYQFLVLYTVGDDA

SEQ ID NO: 1290103 - protein, 23 aa, Mycobacterium
WYRCDTCRLLTAFSIRDVCPNSR

SEQ ID NO: 1290104 - protein, 19 aa, Mycobacterium
YANRFGYNVVRDFTGHGIG

SEQ ID NO: 1290105 - protein, 22 aa, Mycobacterium
YANRFGYNVVRDFTGHGIGTTF

SEQ ID NO: 1290106 - protein, 23 aa, Mycobacterium
YARPTQEALYRWYKTVAEEYPDL

SEQ ID NO: 1290107 - protein, 20 aa, Mycobacterium
YATETCRSFALWAVGLMYSA

SEQ ID NO: 1290108 - protein, 18 aa, Mycobacterium
YATLLGRWVDEHNLGRRD

SEQ ID NO: 1290109 - protein, 21 aa, Mycobacterium
YCPPELPGLEPLWGKSVFQCP

SEQ ID NO: 1290110 - protein, 18 aa, Mycobacterium
YDLLEPWELLVLVDALPD

SEQ ID NO: 1290111 - protein, 17 aa, Mycobacterium
YDVMMQLCRPLTVFEID

SEQ ID NO: 1290112 - protein, 17 aa, Mycobacterium
YDYIPTYILRGLTELHL

SEQ ID NO: 1290113 - protein, 21 aa, Mycobacterium
YEIKDPRLAGVTITDSKVTND

SEQ ID NO: 1290114 - protein, 26 aa, Mycobacterium
YELPLPPSLRARAEWHRFTITLAYMA

SEQ ID NO: 1290115 - protein, 27 aa, Mycobacterium
YERSTCFWQRIAYLYSRFDALVEEVKR

SEQ ID NO: 1290116 - protein, 23 aa, Mycobacterium
YFKVMLVNLAPYWILQPYVDAAF

SEQ ID NO: 1290117 - protein, 18 aa, Mycobacterium
YGALIAVQWAARHPSRVA

SEQ ID NO: 1290118 - protein, 17 aa, Mycobacterium
YGYGLAISHKRVWRCMT

SEQ ID NO: 1290119 - protein, 17 aa, Mycobacterium
YILVLRTEFPNGFVATV

SEQ ID NO: 1290120 - protein, 21 aa, Mycobacterium
YIYAYGFRNPFRLTFTPDGKL

SEQ ID NO: 1290121 - protein, 18 aa, Mycobacterium
YKKLARLGSRGDFIPEYL

SEQ ID NO: 1290122 - protein, 28 aa, Mycobacterium
YLAMACFKLAVVIEGTWSRYLAGRATRE

SEQ ID NO: 1290123 - protein, 20 aa, Mycobacterium
YLCTLREGLLYALVPDRSGF

SEQ ID NO: 1290124 - protein, 18 aa, Mycobacterium
YLGDRGWRTDSITATALL

SEQ ID NO: 1290125 - protein, 18 aa, Mycobacterium
YLSGRWSQVYGFPVMPVD

SEQ ID NO: 1290126 - protein, 18 aa, Mycobacterium
YPAWRELFNNILPAHIVK

SEQ ID NO: 1290127 - protein, 17 aa, Mycobacterium
YPRKGVSDLTRFTPDAV

SEQ ID NO: 1290128 - protein, 19 aa, Mycobacterium
YQNAMRWYHWDPFTHIPKE

SEQ ID NO: 1290129 - protein, 18 aa, Mycobacterium
YQRFAAFWRSRPVNWVWD

SEQ ID NO: 1290130 - protein, 18 aa, Mycobacterium
YRAALVAAWGRLRDEDCR

SEQ ID NO: 1290131 - protein, 19 aa, Mycobacterium
YREASGWGHPVQPGLALLR

SEQ ID NO: 1290132 - protein, 18 aa, Mycobacterium
YRFDDFRVPELVSDQTRM

SEQ ID NO: 1290133 - protein, 17 aa, Mycobacterium
YRLSADNRIVWGGYDAV

SEQ ID NO: 1290134 - protein, 20 aa, Mycobacterium
YRPNPGLARDLAFIAFSTLG

SEQ ID NO: 1290135 - protein, 19 aa, Mycobacterium
YRTEVEWATQMSYSGIYVH

SEQ ID NO: 1290136 - protein, 17 aa, Mycobacterium
YTGRGMAFLDLIQEGNL

SEQ ID NO: 1290137 - protein, 24 aa, Mycobacterium
YTNYRPVPLYGYRAKDVNGDYEKV

SEQ ID NO: 1290138 - protein, 21 aa, Mycobacterium
YWYARHLRLPPGVPAHHSGYL

SEQ ID NO: 1290139 - protein, 18 aa, Mycobacterium
AAAALWILHPTYFGTTAD

SEQ ID NO: 1290140 - protein, 17 aa, Mycobacterium
AAACARLALEPGTSAAD

SEQ ID NO: 1290141 - protein, 18 aa, Mycobacterium
AAACLRKTDWLFPQYREL

SEQ ID NO: 1290142 - protein, 19 aa, Mycobacterium
AAAGLEWEGSALLDLATGI

SEQ ID NO: 1290143 - protein, 18 aa, Mycobacterium
AAAIPHLLEHGGSLVNIS

SEQ ID NO: 1290144 - protein, 19 aa, Mycobacterium
AAALPEYMTPAAYVVVDEI

SEQ ID NO: 1290145 - protein, 17 aa, Mycobacterium
AAAMEWARDDIRVNVVC

SEQ ID NO: 1290146 - protein, 17 aa, Mycobacterium
AAARLGHRSALISGVGD

SEQ ID NO: 1290147 - protein, 24 aa, Mycobacterium
AAASARFGATFARMGLGPDYGLSK

SEQ ID NO: 1290148 - protein, 17 aa, Mycobacterium
AAAVWRIRRAAPLLPTV

SEQ ID NO: 1290149 - protein, 18 aa, Mycobacterium
AAAWPLRLVTRNGTVCGF

SEQ ID NO: 1290150 - protein, 22 aa, Mycobacterium
AACKGRGGAVLVCGESGAGKTS

SEQ ID NO: 1290151 - protein, 18 aa, Mycobacterium
AACSGHFYTDEEILLEEG

SEQ ID NO: 1290152 - protein, 17 aa, Mycobacterium
AADAAGFDAVWASEFYS

SEQ ID NO: 1290153 - protein, 25 aa, Mycobacterium
AADAGRPWWEWAATYERAFTAAYDA

SEQ ID NO: 1290154 - protein, 19 aa, Mycobacterium
AAEHIGGWANRPLPLPDMC

SEQ ID NO: 1290155 - protein, 17 aa, Mycobacterium
AAELQWLLAGAKTLSYA

SEQ ID NO: 1290156 - protein, 18 aa, Mycobacterium
AAEQSVWRRAFEAARPRA

SEQ ID NO: 1290157 - protein, 18 aa, Mycobacterium
AAERSRIGLLLVDDAQHL

SEQ ID NO: 1290158 - protein, 17 aa, Mycobacterium
AAFDHEDICVAIIKHAN

SEQ ID NO: 1290159 - protein, 21 aa, Mycobacterium
AAFSRGLWWSALRATDRADAG

SEQ ID NO: 1290160 - protein, 18 aa, Mycobacterium
AAFTRLGGRIAKRERGRY

SEQ ID NO: 1290161 - protein, 17 aa, Mycobacterium
AAGAPGWDVSAEELEQT

SEQ ID NO: 1290162 - protein, 17 aa, Mycobacterium
AAGELIGAIAMSEPGAG

SEQ ID NO: 1290163 - protein, 19 aa, Mycobacterium
AAGFMTVWARMYAPDGAAF

SEQ ID NO: 1290164 - protein, 18 aa, Mycobacterium
AAGFPFRTLHDAYRALQA

SEQ ID NO: 1290165 - protein, 20 aa, Mycobacterium
AAGLCARLGSTRGSFYHHFG

SEQ ID NO: 1290166 - protein, 22 aa, Mycobacterium
AAGLPRPVRRVPLLGARLRELL

SEQ ID NO: 1290167 - protein, 19 aa, Mycobacterium
AAGLRCLRMTVYIVCAPGF

SEQ ID NO: 1290168 - protein, 17 aa, Mycobacterium
AAGPGWWLPSLLVRRLD

SEQ ID NO: 1290169 - protein, 27 aa, Mycobacterium
AAGSPNYLGTTGFPYTNVVVDNAITGN

SEQ ID NO: 1290170 - protein, 24 aa, Mycobacterium
AAGVCFPDLLMLRGEYQMKVPAPF

SEQ ID NO: 1290171 - protein, 24 aa, Mycobacterium
AAGVVRPDLVIGWWAVPTILEHGS

SEQ ID NO: 1290172 - protein, 17 aa, Mycobacterium
AAGWLRYGLPSQFGGRD

SEQ ID NO: 1290173 - protein, 17 aa, Mycobacterium
AAHDGWCALTLSRPDDI

SEQ ID NO: 1290174 - protein, 20 aa, Mycobacterium
AAHGCPLLLLLVSSAISGEL

SEQ ID NO: 1290175 - protein, 20 aa, Mycobacterium
AAHPKLGLLVLTTFLDEDLV

SEQ ID NO: 1290176 - protein, 25 aa, Mycobacterium
AAHPKSPWIFRGYRPGMHLAPTHLR

SEQ ID NO: 1290177 - protein, 17 aa, Mycobacterium
AAIEGWRILGMLRGGDG

SEQ ID NO: 1290178 - protein, 18 aa, Mycobacterium
AAIGRISYRLGLQGPAVA

SEQ ID NO: 1290179 - protein, 17 aa, Mycobacterium
AAILASIAFHTRVTADD

SEQ ID NO: 1290180 - protein, 18 aa, Mycobacterium
AAKARFAVYIGDLGADTA

SEQ ID NO: 1290181 - protein, 17 aa, Mycobacterium
AAKRIRRRVGLVFQDPF

SEQ ID NO: 1290182 - protein, 24 aa, Mycobacterium
AALAREFLLTWFVYTAWELADAKR

SEQ ID NO: 1290183 - protein, 17 aa, Mycobacterium
AALGWPGTEHQWLDGWL

SEQ ID NO: 1290184 - protein, 18 aa, Mycobacterium
AALKRPGSFLARQVPQFM

SEQ ID NO: 1290185 - protein, 17 aa, Mycobacterium
AALLDRYLGFLALDPTT

SEQ ID NO: 1290186 - protein, 17 aa, Mycobacterium
AALLPVHCWFEPDGWGM

SEQ ID NO: 1290187 - protein, 24 aa, Mycobacterium
AALNFAMAIPTGWDDAISYLTGDP

SEQ ID NO: 1290188 - protein, 25 aa, Mycobacterium
AALSRVGSPYSWGATGPNAFDCSGL

SEQ ID NO: 1290189 - protein, 20 aa, Mycobacterium
AALSSRPAVVFSRRQLLEAV

SEQ ID NO: 1290190 - protein, 25 aa, Mycobacterium
AALTARLAFDWAQLKPGDRVLIHAA

SEQ ID NO: 1290191 - protein, 24 aa, Mycobacterium
AALTRVGAPYSWGATGPDAFDCSG

SEQ ID NO: 1290192 - protein, 18 aa, Mycobacterium
AAMDRLGFHEAWVGEHHS

SEQ ID NO: 1290193 - protein, 20 aa, Mycobacterium
AAMFDGRFAGFADFLILEDS

SEQ ID NO: 1290194 - protein, 23 aa, Mycobacterium
AAMMPMRVIGMLLGIPESEQVSV

SEQ ID NO: 1290195 - protein, 20 aa, Mycobacterium
AAMRRIPLTLAHVLPSAATQ

SEQ ID NO: 1290196 - protein, 21 aa, Mycobacterium
AANRWPAVRFAVRNPIVQGPN

SEQ ID NO: 1290197 - protein, 17 aa, Mycobacterium
AAPEMRHIIADSGAKIV

SEQ ID NO: 1290198 - protein, 24 aa, Mycobacterium
AAPNLRPQPCLDLYTAVRDGERSR

SEQ ID NO: 1290199 - protein, 18 aa, Mycobacterium
AAQALPRRDRVVLVGQAP

SEQ ID NO: 1290200 - protein, 19 aa, Mycobacterium
AAQDWPLLVADASQPSTLN

SEQ ID NO: 1290201 - protein, 20 aa, Mycobacterium
AAQKAHWGVCLARTDPDAPK

SEQ ID NO: 1290202 - protein, 18 aa, Mycobacterium
AAQLPAGVTVRWTDLTDA

SEQ ID NO: 1290203 - protein, 19 aa, Mycobacterium
AAQQRWFRLSALAERVSAT

SEQ ID NO: 1290204 - protein, 23 aa, Mycobacterium
AAQRLGLVPLQWAVASLLADIGA

SEQ ID NO: 1290205 - protein, 24 aa, Mycobacterium
AARARYGFADFKLKGGVLPAADEA

SEQ ID NO: 1290206 - protein, 19 aa, Mycobacterium
AARDWWSMDWMWSALHLDD

SEQ ID NO: 1290207 - protein, 18 aa, Mycobacterium
AARLSVVVDQVWRAEGLA

SEQ ID NO: 1290208 - protein, 19 aa, Mycobacterium
AARRARAKVLAISREDQLA

SEQ ID NO: 1290209 - protein, 19 aa, Mycobacterium
AARRWGLRRGVPTVVYDDW

SEQ ID NO: 1290210 - protein, 21 aa, Mycobacterium
AARTWIREQCSFLPTRIDPPN

SEQ ID NO: 1290211 - protein, 24 aa, Mycobacterium
AASLAYQFGLEWGVERSRDFRFAV

SEQ ID NO: 1290212 - protein, 24 aa, Mycobacterium
AASSRPLYPWPLALARDTEPRRTT

SEQ ID NO: 1290213 - protein, 17 aa, Mycobacterium
AAVAVEWALAHPTQVVA

SEQ ID NO: 1290214 - protein, 17 aa, Mycobacterium
AAVCPHVEWALSSTLNA

SEQ ID NO: 1290215 - protein, 19 aa, Mycobacterium
AAVEWGAGDTMVWLRHFNA

SEQ ID NO: 1290216 - protein, 19 aa, Mycobacterium
AAVLADWWSAVLGGTVDGF

SEQ ID NO: 1290217 - protein, 18 aa, Mycobacterium
AAVPFRRIVDWAESRRAA

SEQ ID NO: 1290218 - protein, 18 aa, Mycobacterium
AAVSRLSYDGRLQSNEAV

SEQ ID NO: 1290219 - protein, 19 aa, Mycobacterium
AAVVRFIGVDGYRWMVRCV

SEQ ID NO: 1290220 - protein, 18 aa, Mycobacterium
AAWREAVKVFGRNQVSTY

SEQ ID NO: 1290221 - protein, 17 aa, Mycobacterium
AAYEWHMRAAAWSQQRD

SEQ ID NO: 1290222 - protein, 23 aa, Mycobacterium
AAYLRATFDWHIDGCTPTGDEYP

SEQ ID NO: 1290223 - protein, 17 aa, Mycobacterium
ACAELRSPAGFAQHPQL

SEQ ID NO: 1290224 - protein, 25 aa, Mycobacterium
ACDGGIRLSGRWSWATGVMDGNWMM

SEQ ID NO: 1290225 - protein, 24 aa, Mycobacterium
ACGGRFTLGLGLSHDWIINGQLGI

SEQ ID NO: 1290226 - protein, 20 aa, Mycobacterium
ACLLGCGFITGWGSSVYAAE

SEQ ID NO: 1290227 - protein, 17 aa, Mycobacterium
ACLRSLEALGMLDTEVM

SEQ ID NO: 1290228 - protein, 17 aa, Mycobacterium
ACLTCPVFITTPEFLPQ

SEQ ID NO: 1290229 - protein, 18 aa, Mycobacterium
ADAKAVIVAQNLVAERFV

SEQ ID NO: 1290230 - protein, 25 aa, Mycobacterium
ADALALAICHCWRAPMLGRMAAAEE

SEQ ID NO: 1290231 - protein, 23 aa, Mycobacterium
ADALWPMLVLRTAVLIVSGAQQS

SEQ ID NO: 1290232 - protein, 17 aa, Mycobacterium
ADAMSWFGLFADAEDAE

SEQ ID NO: 1290233 - protein, 20 aa, Mycobacterium
ADAPIGWRRPLSPQPGRDLV

SEQ ID NO: 1290234 - protein, 19 aa, Mycobacterium
ADAVVEHWGPPPGELFVDR

SEQ ID NO: 1290235 - protein, 21 aa, Mycobacterium
ADAYRAISLLLRRPPGREAFP

SEQ ID NO: 1290236 - protein, 17 aa, Mycobacterium
ADCARWVADQLAEVGYV

SEQ ID NO: 1290237 - protein, 21 aa, Mycobacterium
ADDLRWWAARIGEWDAQGRDV

SEQ ID NO: 1290238 - protein, 24 aa, Mycobacterium
ADDSARLWFEVAKPLMSTNPQRSG

SEQ ID NO: 1290239 - protein, 21 aa, Mycobacterium
ADERLRRIFTFQALYAGVPPH

SEQ ID NO: 1290240 - protein, 17 aa, Mycobacterium
ADFIGLHFFSPVERMDL

SEQ ID NO: 1290241 - protein, 17 aa, Mycobacterium
ADFLDRWRRAAEMTLAQ

SEQ ID NO: 1290242 - protein, 19 aa, Mycobacterium
ADFNFAWPTARIAVIGAEG

SEQ ID NO: 1290243 - protein, 18 aa, Mycobacterium
ADGAEFFAAVSLRPDSVP

SEQ ID NO: 1290244 - protein, 18 aa, Mycobacterium
ADGIAFIPWFPLAAGPLA

SEQ ID NO: 1290245 - protein, 17 aa, Mycobacterium
ADGLGLLRMVLGGRLEV

SEQ ID NO: 1290246 - protein, 20 aa, Mycobacterium
ADGRGATMIFTRTKRTAQKV

SEQ ID NO: 1290247 - protein, 19 aa, Mycobacterium
ADGTFEWRFTPKVPSQLVI

SEQ ID NO: 1290248 - protein, 23 aa, Mycobacterium
ADIERLEFLAARGWLIVRVSATQ

SEQ ID NO: 1290249 - protein, 20 aa, Mycobacterium
ADIRLRWAESMADAAREIRS

SEQ ID NO: 1290250 - protein, 22 aa, Mycobacterium
ADIYRFLPGLGVILGARVLGEF

SEQ ID NO: 1290251 - protein, 23 aa, Mycobacterium
ADKGVSRRSVFRLFDKLANAGMA

SEQ ID NO: 1290252 - protein, 20 aa, Mycobacterium
ADKLTAPALIVWGSRDTAIP

SEQ ID NO: 1290253 - protein, 26 aa, Mycobacterium
ADLDAFLRLLGDRGVDVLIYNVQTEG

SEQ ID NO: 1290254 - protein, 23 aa, Mycobacterium
ADLEPLKQFGFTVASYQSASFVR

SEQ ID NO: 1290255 - protein, 19 aa, Mycobacterium
ADLERRVAGFLGFTDIFTS

SEQ ID NO: 1290256 - protein, 21 aa, Mycobacterium
ADLPPAVGVLVEYTGGDTSAA

SEQ ID NO: 1290257 - protein, 18 aa, Mycobacterium
ADLRGDWAPPLRIRGFDP

SEQ ID NO: 1290258 - protein, 19 aa, Mycobacterium
ADLWRAAADLGWHGLAVAE

SEQ ID NO: 1290259 - protein, 18 aa, Mycobacterium
ADMTVHFLAPVVVGPARA

SEQ ID NO: 1290260 - protein, 17 aa, Mycobacterium
ADNRIVWGGYDAVYHFG

SEQ ID NO: 1290261 - protein, 18 aa, Mycobacterium
ADNRIVWGGYDAVYHFGR

SEQ ID NO: 1290262 - protein, 32 aa, Mycobacterium
ADRAGSCQQVWCPVCALAALVQGEQHPLLNVV

SEQ ID NO: 1290263 - protein, 19 aa, Mycobacterium
ADRAKWRLVGPMHLAETRE

SEQ ID NO: 1290264 - protein, 24 aa, Mycobacterium
ADRLGAEFPRVDWLFATASRQTVP

SEQ ID NO: 1290265 - protein, 29 aa, Mycobacterium
ADRYPRWWQAPLRWAFRGALGARASLVVR

SEQ ID NO: 1290266 - protein, 18 aa, Mycobacterium
ADSLKEFSIRAVDGSQST

SEQ ID NO: 1290267 - protein, 18 aa, Mycobacterium
ADSYKAYLMCFGSTGMFE

SEQ ID NO: 1290268 - protein, 17 aa, Mycobacterium
ADVKWTIVGGMVLEGAD

SEQ ID NO: 1290269 - protein, 18 aa, Mycobacterium
ADVVVAWPTAQIAVMGAS

SEQ ID NO: 1290270 - protein, 17 aa, Mycobacterium
ADYIYAYGFRNPFRLTF

SEQ ID NO: 1290271 - protein, 21 aa, Mycobacterium
ADYLGRWVILFSHPADFTPVC

SEQ ID NO: 1290272 - protein, 24 aa, Mycobacterium
ADYQCISCGLVPNATKAKALYDNQ

SEQ ID NO: 1290273 - protein, 18 aa, Mycobacterium
AEAARLGFTYAVVPSGVT

SEQ ID NO: 1290274 - protein, 21 aa, Mycobacterium
AEAIRRFGPIFAQYYGQSEAP

SEQ ID NO: 1290275 - protein, 18 aa, Mycobacterium
AEALRMARGHDVAHDVAL

SEQ ID NO: 1290276 - protein, 18 aa, Mycobacterium
AEAVWACRTLAATHYASG

SEQ ID NO: 1290277 - protein, 23 aa, Mycobacterium
AEDPRVAGLIARVQIDAAPPGPV

SEQ ID NO: 1290278 - protein, 22 aa, Mycobacterium
AEEALAMGLAWKVCEPAELMPT

SEQ ID NO: 1290279 - protein, 17 aa, Mycobacterium
AEECARAGVPRQLNITG

SEQ ID NO: 1290280 - protein, 22 aa, Mycobacterium
AEEILEPLGFRWTNFGVAESDV

SEQ ID NO: 1290281 - protein, 18 aa, Mycobacterium
AEEMLYLAMEDFRVDVVV

SEQ ID NO: 1290282 - protein, 20 aa, Mycobacterium
AEGCVREMLVLAAALSIPDP

SEQ ID NO: 1290283 - protein, 18 aa, Mycobacterium
AEGGRFACGGGRPADRDT

SEQ ID NO: 1290284 - protein, 24 aa, Mycobacterium
AEGHCWFTAGTLWREAAQLAGVEL

SEQ ID NO: 1290285 - protein, 17 aa, Mycobacterium
AEGMPAYGSCAGMILLA

SEQ ID NO: 1290286 - protein, 17 aa, Mycobacterium
AEGPGFNVCIVKDGKLA

SEQ ID NO: 1290287 - protein, 17 aa, Mycobacterium
AEHFPRLDIAVEVVDEP

SEQ ID NO: 1290288 - protein, 17 aa, Mycobacterium
AEHIGGWSRRPLPLPDM

SEQ ID NO: 1290289 - protein, 18 aa, Mycobacterium
AEHLKQRWARGSGGLLVV

SEQ ID NO: 1290290 - protein, 20 aa, Mycobacterium
AEHPRLRLVIAHMGGPEYSE

SEQ ID NO: 1290291 - protein, 19 aa, Mycobacterium
AEHWSGFGDAEMVFAEPTK

SEQ ID NO: 1290292 - protein, 21 aa, Mycobacterium
AEIALAWSRDRARAMPEIEQV

SEQ ID NO: 1290293 - protein, 22 aa, Mycobacterium
AEIDAPCELVDFWRFNVAFARQ

SEQ ID NO: 1290294 - protein, 22 aa, Mycobacterium
AEIPKRLAAMLTEHLVLDAPVQ

SEQ ID NO: 1290295 - protein, 17 aa, Mycobacterium
AEIPLLVVITEGIPVQD

SEQ ID NO: 1290296 - protein, 21 aa, Mycobacterium
AELAWVLGCFTGFGQASRMTQ

SEQ ID NO: 1290297 - protein, 25 aa, Mycobacterium
AELEKAGVCVLDLNPAVVGPHCVPA

SEQ ID NO: 1290298 - protein, 20 aa, Mycobacterium
AELFAAWAVYLLVGYEQASL

SEQ ID NO: 1290299 - protein, 17 aa, Mycobacterium
AELFKPLPSMVVAHYLG

SEQ ID NO: 1290300 - protein, 25 aa, Mycobacterium
AELFPRMPIPQAWFDAGIAYRSTDL

SEQ ID NO: 1290301 - protein, 21 aa, Mycobacterium
AELGEQCAFGLALIAPQLPPF

SEQ ID NO: 1290302 - protein, 20 aa, Mycobacterium
AELIGPALEDWAKWGQARHD

SEQ ID NO: 1290303 - protein, 22 aa, Mycobacterium
AELLDRFGMFGIRIAIAVLRAG

SEQ ID NO: 1290304 - protein, 20 aa, Mycobacterium
AELRGRWIGMLTHCRRARLL

SEQ ID NO: 1290305 - protein, 17 aa, Mycobacterium
AELRSPAGFAQHPQLAA

SEQ ID NO: 1290306 - protein, 23 aa, Mycobacterium
AELRTRLRTILGRELGMPDNAVD

SEQ ID NO: 1290307 - protein, 17 aa, Mycobacterium
AEMSLRYGRLFDATVRT

SEQ ID NO: 1290308 - protein, 26 aa, Mycobacterium
AEPALPRLLGRLVIMGGAFDYRGNTT

SEQ ID NO: 1290309 - protein, 19 aa, Mycobacterium
AEPKWVLAMGVCASSGGMF

SEQ ID NO: 1290310 - protein, 22 aa, Mycobacterium
AEPLLRRIDILAAQGHPGAQQL

SEQ ID NO: 1290311 - protein, 22 aa, Mycobacterium
AEQIAGLLYRYARAVDTKDWEL

SEQ ID NO: 1290312 - protein, 23 aa, Mycobacterium
AEQMKMFLTRLGFGSKIVVTGDI

SEQ ID NO: 1290313 - protein, 23 aa, Mycobacterium
AEQRLRAVESWSVLPDFASLNWH

SEQ ID NO: 1290314 - protein, 17 aa, Mycobacterium
AEQVMEWAGLDLLILRV

SEQ ID NO: 1290315 - protein, 19 aa, Mycobacterium
AERVRKIVCSFPRQSDSFV

SEQ ID NO: 1290316 - protein, 18 aa, Mycobacterium
AESLAGQGARVAVTEIDP

SEQ ID NO: 1290317 - protein, 19 aa, Mycobacterium
AESLKWHGLEVVVYDQVES

SEQ ID NO: 1290318 - protein, 18 aa, Mycobacterium
AESVWACRTLAATHYASG

SEQ ID NO: 1290319 - protein, 25 aa, Mycobacterium
AESWNVFDPVVIRWRLEVGDRTAQL

SEQ ID NO: 1290320 - protein, 19 aa, Mycobacterium
AETFARAGVNVVITGRTQA

SEQ ID NO: 1290321 - protein, 17 aa, Mycobacterium
AETGLSCSVGISDNKQR

SEQ ID NO: 1290322 - protein, 18 aa, Mycobacterium
AETILRFAYGSFRHANLM

SEQ ID NO: 1290323 - protein, 31 aa, Mycobacterium
AETVKTWPVRLMKFVLSVGWLATAHREYSEI

SEQ ID NO: 1290324 - protein, 23 aa, Mycobacterium
AEVEGRPGLALGWGATLGTVERR

SEQ ID NO: 1290325 - protein, 19 aa, Mycobacterium
AEVFDCARLLNARVDNRAR

SEQ ID NO: 1290326 - protein, 18 aa, Mycobacterium
AEVLGIHYEIPWPNREMK

SEQ ID NO: 1290327 - protein, 20 aa, Mycobacterium
AEVLRRLKALPGFGEQKAKI

SEQ ID NO: 1290328 - protein, 19 aa, Mycobacterium
AEVPARFEALAALGGLDRA

SEQ ID NO: 1290329 - protein, 20 aa, Mycobacterium
AEVRLPLTWITLLHGRIGAS

SEQ ID NO: 1290330 - protein, 20 aa, Mycobacterium
AEVVHRIRCAAGAFADLGIG

SEQ ID NO: 1290331 - protein, 21 aa, Mycobacterium
AEVYVPFSWYEPMWLESLGFA

SEQ ID NO: 1290332 - protein, 17 aa, Mycobacterium
AEWAHLVAGTSSIREGS

SEQ ID NO: 1290333 - protein, 17 aa, Mycobacterium
AEWKVFLSLVREGFEKD

SEQ ID NO: 1290334 - protein, 19 aa, Mycobacterium
AEYGRLVLRNTISLLAQVV

SEQ ID NO: 1290335 - protein, 21 aa, Mycobacterium
AEYLFRLALPTGIYGGTLDVF

SEQ ID NO: 1290336 - protein, 30 aa, Mycobacterium
AEYRGQWLICRALEVVLGWIADDNCGAMQA

SEQ ID NO: 1290337 - protein, 18 aa, Mycobacterium
AFAALGFSADEMGRMFAQ

SEQ ID NO: 1290338 - protein, 18 aa, Mycobacterium
AFCTRVGFGGAKQHKLQK

SEQ ID NO: 1290339 - protein, 22 aa, Mycobacterium
AFDWPVSLFAERTWHIARPLPE

SEQ ID NO: 1290340 - protein, 21 aa, Mycobacterium
AFEPKLRWEAAVFEERPGIDA

SEQ ID NO: 1290341 - protein, 18 aa, Mycobacterium
AFERQWWKYAGSKEDAIK

SEQ ID NO: 1290342 - protein, 19 aa, Mycobacterium
AFGTEWDKWHSGAGQVVRG

SEQ ID NO: 1290343 - protein, 17 aa, Mycobacterium
AFNLGFGDITFGDKTSN

SEQ ID NO: 1290344 - protein, 18 aa, Mycobacterium
AFPAIALCLRFLAAGDHP

SEQ ID NO: 1290345 - protein, 18 aa, Mycobacterium
AFTALAARFLGPTLDGVR

SEQ ID NO: 1290346 - protein, 17 aa, Mycobacterium
AFTGKKPSLAWAETYPG

SEQ ID NO: 1290347 - protein, 18 aa, Mycobacterium
AFVLMPWLAAEPEATLTV

SEQ ID NO: 1290348 - protein, 18 aa, Mycobacterium
AGAAERWFAPGFVDREPG

SEQ ID NO: 1290349 - protein, 18 aa, Mycobacterium
AGAARWAVRMAKEREKNA

SEQ ID NO: 1290350 - protein, 17 aa, Mycobacterium
AGACSMAAFTASMHAGQ

SEQ ID NO: 1290351 - protein, 18 aa, Mycobacterium
AGADWPRLADAYRMRAAV

SEQ ID NO: 1290352 - protein, 17 aa, Mycobacterium
AGAKRTHWIWFVFPQLR

SEQ ID NO: 1290353 - protein, 18 aa, Mycobacterium
AGAPFGFAVTTAPHDWAW

SEQ ID NO: 1290354 - protein, 22 aa, Mycobacterium
AGATARRGPLCLGIDPHPELLR

SEQ ID NO: 1290355 - protein, 17 aa, Mycobacterium
AGATYRPGTRFGPQGIR

SEQ ID NO: 1290356 - protein, 22 aa, Mycobacterium
AGCGMACPFCATGQGGLKRNLS

SEQ ID NO: 1290357 - protein, 19 aa, Mycobacterium
AGDDWLCLLEAFDQPHRPG

SEQ ID NO: 1290358 - protein, 26 aa, Mycobacterium
AGDESRPSWPMIVFRTPKGWTGPAYI

SEQ ID NO: 1290359 - protein, 22 aa, Mycobacterium
AGDRLGSVALTWEAGGDSGTLT

SEQ ID NO: 1290360 - protein, 17 aa, Mycobacterium
AGFDAVWASEFYSRSGS

SEQ ID NO: 1290361 - protein, 18 aa, Mycobacterium
AGFDAVWASEFYSRSGSI

SEQ ID NO: 1290362 - protein, 17 aa, Mycobacterium
AGFDVIRAGAGVGGDGH

SEQ ID NO: 1290363 - protein, 18 aa, Mycobacterium
AGFMTVWARMYAPDGAAF

SEQ ID NO: 1290364 - protein, 19 aa, Mycobacterium
AGFQCGFCTAGMVTTASAL

SEQ ID NO: 1290365 - protein, 17 aa, Mycobacterium
AGGDRFGLRRGGLTFAR

SEQ ID NO: 1290366 - protein, 19 aa, Mycobacterium
AGGGPDWLIAPAIGYGASG

SEQ ID NO: 1290367 - protein, 24 aa, Mycobacterium
AGGIPAILGELWRGGHLHETVHSV

SEQ ID NO: 1290368 - protein, 18 aa, Mycobacterium
AGGISGWELTPSVDGHFD

SEQ ID NO: 1290369 - protein, 21 aa, Mycobacterium
AGGLRPVLCLTKSDLAPAEPF

SEQ ID NO: 1290370 - protein, 24 aa, Mycobacterium
AGGPGGATRPAWSPTGAPGAGGAG

SEQ ID NO: 1290371 - protein, 27 aa, Mycobacterium
AGGVGGKGIQGGQGLQGGQGGDGGTGG

SEQ ID NO: 1290372 - protein, 20 aa, Mycobacterium
AGHGGRGGWIAGDGGDGGDG

SEQ ID NO: 1290373 - protein, 17 aa, Mycobacterium
AGHLLRQRWQPVYASEE

SEQ ID NO: 1290374 - protein, 23 aa, Mycobacterium
AGHPRWVAADVMAGRLNQVGVAK

SEQ ID NO: 1290375 - protein, 18 aa, Mycobacterium
AGILRYSRDLAFAAATAY

SEQ ID NO: 1290376 - protein, 17 aa, Mycobacterium
AGLARYAAADAMQKGAM

SEQ ID NO: 1290377 - protein, 22 aa, Mycobacterium
AGLAWLQARMGRFAECRVNAAE

SEQ ID NO: 1290378 - protein, 17 aa, Mycobacterium
AGLDFGLKYGDQAQEFA

SEQ ID NO: 1290379 - protein, 25 aa, Mycobacterium
AGLEASGFRAGCPVLAVAVETNDDA

SEQ ID NO: 1290380 - protein, 19 aa, Mycobacterium
AGLKIVPTMGVYAATKNAV

SEQ ID NO: 1290381 - protein, 23 aa, Mycobacterium
AGLLAGAVTLVWQAGEVRQVNEL

SEQ ID NO: 1290382 - protein, 17 aa, Mycobacterium
AGLPEEWSPESESSREL

SEQ ID NO: 1290383 - protein, 20 aa, Mycobacterium
AGLQARFGLDTGKWTAEQMA

SEQ ID NO: 1290384 - protein, 19 aa, Mycobacterium
AGLRRLKLAAVRRTAPEVL

SEQ ID NO: 1290385 - protein, 22 aa, Mycobacterium
AGLSLRPGYVLSDGFRVPGLPM

SEQ ID NO: 1290386 - protein, 17 aa, Mycobacterium
AGMDGYAGRLWLPMLEA

SEQ ID NO: 1290387 - protein, 19 aa, Mycobacterium
AGMPGRLKAVAALFPTVSR

SEQ ID NO: 1290388 - protein, 19 aa, Mycobacterium
AGNGLRPAIWDEFTNRFGI

SEQ ID NO: 1290389 - protein, 17 aa, Mycobacterium
AGPGWYGGGPLSVRPDR

SEQ ID NO: 1290390 - protein, 36 aa, Mycobacterium
AGPIGALLLWRAGLADSIRTIFGFGRAAAESQVSDL

SEQ ID NO: 1290391 - protein, 25 aa, Mycobacterium
AGRRTGLIWLRWFLPEATPARPQCR

SEQ ID NO: 1290392 - protein, 17 aa, Mycobacterium
AGRRVALLVGRGAAGAA

SEQ ID NO: 1290393 - protein, 17 aa, Mycobacterium
AGSLIPLTSAGAYPSTE

SEQ ID NO: 1290394 - protein, 19 aa, Mycobacterium
AGSLPAEWWGADAPGSPPS

SEQ ID NO: 1290395 - protein, 18 aa, Mycobacterium
AGSLRPGDLAVWDGHVAM

SEQ ID NO: 1290396 - protein, 18 aa, Mycobacterium
AGSLWWRTVQTVAAEYPD

SEQ ID NO: 1290397 - protein, 26 aa, Mycobacterium
AGTFYWPFGFAILGDRFWVADTGNRR

SEQ ID NO: 1290398 - protein, 18 aa, Mycobacterium
AGTKFGDAALRDHVAVDG

SEQ ID NO: 1290399 - protein, 25 aa, Mycobacterium
AGTRRGWLRCRLLEPSPGQDTYSES

SEQ ID NO: 1290400 - protein, 17 aa, Mycobacterium
AGVATWWRTVGPKVAGL

SEQ ID NO: 1290401 - protein, 19 aa, Mycobacterium
AGVEWKDIQFGFGGSYEVS

SEQ ID NO: 1290402 - protein, 18 aa, Mycobacterium
AGVGWACLDMAVEYAKVR

SEQ ID NO: 1290403 - protein, 18 aa, Mycobacterium
AGVRRIVYLGGFVPDDDS

SEQ ID NO: 1290404 - protein, 23 aa, Mycobacterium
AGVTCGLGRGWGLPKSVRLGIAA

SEQ ID NO: 1290405 - protein, 20 aa, Mycobacterium
AGWRLAAAATTWSDVTALMT

SEQ ID NO: 1290406 - protein, 21 aa, Mycobacterium
AGYLVSRRGRYGGTFIADALP

SEQ ID NO: 1290407 - protein, 23 aa, Mycobacterium
AGYPKEMRRFLAANPGLASRFNF

SEQ ID NO: 1290408 - protein, 23 aa, Mycobacterium
AGYRFPRLRFVASVGEPLNAEAV

SEQ ID NO: 1290409 - protein, 17 aa, Mycobacterium
AGYRPELDLAQAGIATQ

SEQ ID NO: 1290410 - protein, 19 aa, Mycobacterium
AHDQFRWFAGGWAVNSDLP

SEQ ID NO: 1290411 - protein, 17 aa, Mycobacterium
AHLDRIALLYAEDPDLC

SEQ ID NO: 1290412 - protein, 27 aa, Mycobacterium
AHPGVPRFDCWRGMAIPGHATAIGKNI

SEQ ID NO: 1290413 - protein, 20 aa, Mycobacterium
AHRAKWGLLLARTDPDVPKH

SEQ ID NO: 1290414 - protein, 17 aa, Mycobacterium
AHRWLRWDEAVECEVAI

SEQ ID NO: 1290415 - protein, 17 aa, Mycobacterium
AHSLGFEGFADLQVSLR

SEQ ID NO: 1290416 - protein, 17 aa, Mycobacterium
AHWAQWCFVVARTEKGS

SEQ ID NO: 1290417 - protein, 26 aa, Mycobacterium
AIAQARLGPGRIHHCMRAIGAAERAL

SEQ ID NO: 1290418 - protein, 26 aa, Mycobacterium
AIDEIIRWATPVHCFQRTALEDVEVG

SEQ ID NO: 1290419 - protein, 21 aa, Mycobacterium
AIDSELGWSRDVWKQLAEVGV

SEQ ID NO: 1290420 - protein, 22 aa, Mycobacterium
AIEAWAKPVLLAWGDADKMFPM

SEQ ID NO: 1290421 - protein, 24 aa, Mycobacterium
AIEEVFIRAGIPYKVVGGVRFYER

SEQ ID NO: 1290422 - protein, 19 aa, Mycobacterium
AIGAWRISKNISKGVKSAH

SEQ ID NO: 1290423 - protein, 17 aa, Mycobacterium
AIIARVVARYGLTGTTA

SEQ ID NO: 1290424 - protein, 17 aa, Mycobacterium
AIIPPTFLTSAACWAPP

SEQ ID NO: 1290425 - protein, 25 aa, Mycobacterium
AILAKAIVMRAWLAGWNPVVDQYAV

SEQ ID NO: 1290426 - protein, 18 aa, Mycobacterium
AILDEWKTITGLDRKVDD

SEQ ID NO: 1290427 - protein, 17 aa, Mycobacterium
AIMDVVWRADEAVRVRD

SEQ ID NO: 1290428 - protein, 18 aa, Mycobacterium
AIMSVREGIDFGTVVTTD

SEQ ID NO: 1290429 - protein, 21 aa, Mycobacterium
AIPAWKIAPALVYGNTVVWKP

SEQ ID NO: 1290430 - protein, 19 aa, Mycobacterium
AIQCARTLLDAHLVDGRLR

SEQ ID NO: 1290431 - protein, 23 aa, Mycobacterium
AIRFPELRAVLTYVTPSPVSREV

SEQ ID NO: 1290432 - protein, 23 aa, Mycobacterium
AIRRLERDLGIVIVQRGHRFEGF

SEQ ID NO: 1290433 - protein, 17 aa, Mycobacterium
AIVKGRCFAGNAVIAGA

SEQ ID NO: 1290434 - protein, 18 aa, Mycobacterium
AIVLGDWPARTPATGQLP

SEQ ID NO: 1290435 - protein, 17 aa, Mycobacterium
AIWPDLFIVGGGISRKA

SEQ ID NO: 1290436 - protein, 18 aa, Mycobacterium
AKAFGTPGFRAWAAHARG

SEQ ID NO: 1290437 - protein, 19 aa, Mycobacterium
AKARGLWNLFLPSESGLSN

SEQ ID NO: 1290438 - protein, 17 aa, Mycobacterium
AKFGWPVFEISTVAREG

SEQ ID NO: 1290439 - protein, 17 aa, Mycobacterium
AKGAWLWSGRDAVAAGL

SEQ ID NO: 1290440 - protein, 18 aa, Mycobacterium
AKGPIRIWGRCSLRENGT

SEQ ID NO: 1290441 - protein, 19 aa, Mycobacterium
AKIGMYIALRLLRDGAHTT

SEQ ID NO: 1290442 - protein, 22 aa, Mycobacterium
AKKFRFPTFVGAFKYYTSYTLK

SEQ ID NO: 1290443 - protein, 19 aa, Mycobacterium
AKLEAALVYTTRELPSDPS

SEQ ID NO: 1290444 - protein, 19 aa, Mycobacterium
AKLGCTFAVVGHSERRTYH

SEQ ID NO: 1290445 - protein, 18 aa, Mycobacterium
AKLMERWSSRRAAIKART

SEQ ID NO: 1290446 - protein, 19 aa, Mycobacterium
AKLRLAGLVKGRREGTFVF

SEQ ID NO: 1290447 - protein, 19 aa, Mycobacterium
AKMQGWPGIMEGINNTIGE

SEQ ID NO: 1290448 - protein, 20 aa, Mycobacterium
AKRPRLIPIWDSFVEQATGL

SEQ ID NO: 1290449 - protein, 19 aa, Mycobacterium
AKTRLAPMFSARTREDVVL

SEQ ID NO: 1290450 - protein, 22 aa, Mycobacterium
ALAARLKKVWAPQGLVQRSQGK

SEQ ID NO: 1290451 - protein, 22 aa, Mycobacterium
ALACKATAVADGYRINGAKAWI

SEQ ID NO: 1290452 - protein, 19 aa, Mycobacterium
ALAPSRRTAWVDLIAADSA

SEQ ID NO: 1290453 - protein, 20 aa, Mycobacterium
ALARRVPLGLARTGTTGSHF

SEQ ID NO: 1290454 - protein, 24 aa, Mycobacterium
ALASRARKAPGFALLGEKGESRDL

SEQ ID NO: 1290455 - protein, 18 aa, Mycobacterium
ALDHLPRLASALSVSTDE

SEQ ID NO: 1290456 - protein, 24 aa, Mycobacterium
ALDLRKRFRRVLGRTVPLATLLGG

SEQ ID NO: 1290457 - protein, 23 aa, Mycobacterium
ALDTRAWRLPWLNDTVIYEVEQP

SEQ ID NO: 1290458 - protein, 18 aa, Mycobacterium
ALDTWPLNIALLGKGNTV

SEQ ID NO: 1290459 - protein, 22 aa, Mycobacterium
ALEIPGKIAQNFANVVKSLTSL

SEQ ID NO: 1290460 - protein, 17 aa, Mycobacterium
ALELTWEALEDARIPAS

SEQ ID NO: 1290461 - protein, 17 aa, Mycobacterium
ALFEPATRSLVVLGSGP

SEQ ID NO: 1290462 - protein, 20 aa, Mycobacterium
ALGAIEWPVAAAIGVGQVVV

SEQ ID NO: 1290463 - protein, 23 aa, Mycobacterium
ALGCTIKLLAICERLTTGKGKQQ

SEQ ID NO: 1290464 - protein, 18 aa, Mycobacterium
ALGIRPGDRVLLQLPNSC

SEQ ID NO: 1290465 - protein, 24 aa, Mycobacterium
ALHVRLGPFLAYWPAGLMLRCALQ

SEQ ID NO: 1290466 - protein, 20 aa, Mycobacterium
ALKAIGRQGVRVHDLRHFAG

SEQ ID NO: 1290467 - protein, 19 aa, Mycobacterium
ALKIGWFEGGIAWVPTALQ

SEQ ID NO: 1290468 - protein, 22 aa, Mycobacterium
ALKRRCLHLFLDYPAAERELEI

SEQ ID NO: 1290469 - protein, 17 aa, Mycobacterium
ALLPHLATRYRVIAPDL

SEQ ID NO: 1290470 - protein, 22 aa, Mycobacterium
ALLSVSFGDDWAWVRRAHDAGC

SEQ ID NO: 1290471 - protein, 18 aa, Mycobacterium
ALMAIGIEKGDRVGIWAP

SEQ ID NO: 1290472 - protein, 19 aa, Mycobacterium
ALMGLECVIYMGAVDTARQ

SEQ ID NO: 1290473 - protein, 17 aa, Mycobacterium
ALMILPVSYWKLTDREI

SEQ ID NO: 1290474 - protein, 26 aa, Mycobacterium
ALNEARPGCRLEILAGVGHFPHVEKP

SEQ ID NO: 1290475 - protein, 17 aa, Mycobacterium
ALNEVNWRMLSVVSDDV

SEQ ID NO: 1290476 - protein, 19 aa, Mycobacterium
ALNLLRWTSARSIKETFVP

SEQ ID NO: 1290477 - protein, 24 aa, Mycobacterium
ALPGHAPSGLGFRPDGSLLITSVE

SEQ ID NO: 1290478 - protein, 17 aa, Mycobacterium
ALPLLARRMLDPHELPG

SEQ ID NO: 1290479 - protein, 18 aa, Mycobacterium
ALPPDWANYGTIIDTFSK

SEQ ID NO: 1290480 - protein, 17 aa, Mycobacterium
ALPRLEPGVALPCCRQT

SEQ ID NO: 1290481 - protein, 18 aa, Mycobacterium
ALPRRLQIEFSQAIQQIT

SEQ ID NO: 1290482 - protein, 21 aa, Mycobacterium
ALQFLRGGRRWILKSPQHLGQ

SEQ ID NO: 1290483 - protein, 18 aa, Mycobacterium
ALQPRLYVSPALVRTDLL

SEQ ID NO: 1290484 - protein, 17 aa, Mycobacterium
ALQRLWLIEAVKYNVVP

SEQ ID NO: 1290485 - protein, 18 aa, Mycobacterium
ALQTLEWARMALASCHLT

SEQ ID NO: 1290486 - protein, 20 aa, Mycobacterium
ALRAVTFWANQGGWTTRTIA

SEQ ID NO: 1290487 - protein, 17 aa, Mycobacterium
ALREVRTTLVPDYFGGN

SEQ ID NO: 1290488 - protein, 21 aa, Mycobacterium
ALRGFPPVPSRWIDPASVPGW

SEQ ID NO: 1290489 - protein, 20 aa, Mycobacterium
ALRRRMPWTLVEREYRFEGP

SEQ ID NO: 1290490 - protein, 20 aa, Mycobacterium
ALRRSVKFPAFLDGIEAVRR

SEQ ID NO: 1290491 - protein, 17 aa, Mycobacterium
ALRSVPIVVGRADVDGV

SEQ ID NO: 1290492 - protein, 19 aa, Mycobacterium
ALSSRPAVVFSRRQLLEAV

SEQ ID NO: 1290493 - protein, 18 aa, Mycobacterium
ALTALARRYESWLTAHPD

SEQ ID NO: 1290494 - protein, 24 aa, Mycobacterium
ALTWPGTRVELCFPGDRPLPQHHT

SEQ ID NO: 1290495 - protein, 28 aa, Mycobacterium
ALTYPRRLGFGLGETVVSLAWRTGDDIV

SEQ ID NO: 1290496 - protein, 17 aa, Mycobacterium
ALVPGRIPPYVVGLVEL

SEQ ID NO: 1290497 - protein, 19 aa, Mycobacterium
ALVRFGFAAGDGLRRLAGT

SEQ ID NO: 1290498 - protein, 24 aa, Mycobacterium
AMARACIDEGWLLSLSGTVSFKNA

SEQ ID NO: 1290499 - protein, 24 aa, Mycobacterium
AMCARFRISGLPVVDDRGSLVGII

SEQ ID NO: 1290500 - protein, 22 aa, Mycobacterium
AMDRKVWLPSGGTLVIDRTEAM

SEQ ID NO: 1290501 - protein, 18 aa, Mycobacterium
AMGALGLFGVRPGALLDD

SEQ ID NO: 1290502 - protein, 17 aa, Mycobacterium
AMGPAFWAELPVVFHEL

SEQ ID NO: 1290503 - protein, 21 aa, Mycobacterium
AMIDWLGPIIWEYYSSTEVHG

SEQ ID NO: 1290504 - protein, 21 aa, Mycobacterium
AMLDMRIRGVFAMPVLIAGEY

SEQ ID NO: 1290505 - protein, 18 aa, Mycobacterium
AMLVGLGDPVLWAVPLHW

SEQ ID NO: 1290506 - protein, 18 aa, Mycobacterium
AMQKHWYSAMEVLAEYSI

SEQ ID NO: 1290507 - protein, 17 aa, Mycobacterium
AMREAYHGWTYGTDAVS

SEQ ID NO: 1290508 - protein, 23 aa, Mycobacterium
AMRRPRVGVMIARGDLAVEVGYE

SEQ ID NO: 1290509 - protein, 23 aa, Mycobacterium
ANAARLGLQDVIWRGTYYTPAGP

SEQ ID NO: 1290510 - protein, 17 aa, Mycobacterium
ANAFKSVGFMLEATGHN

SEQ ID NO: 1290511 - protein, 23 aa, Mycobacterium
ANDSRYGLVGAVWSADEERAASV

SEQ ID NO: 1290512 - protein, 19 aa, Mycobacterium
ANLRPMFGGHLIKVEDDIK

SEQ ID NO: 1290513 - protein, 20 aa, Mycobacterium
ANRAHLFLFLTLCRDHDVVV

SEQ ID NO: 1290514 - protein, 17 aa, Mycobacterium
ANVALSRWGMLAPDGQC

SEQ ID NO: 1290515 - protein, 17 aa, Mycobacterium
ANWARRDFPAIAADVRV

SEQ ID NO: 1290516 - protein, 20 aa, Mycobacterium
APAARWAFCNGMTPAQRRLT

SEQ ID NO: 1290517 - protein, 17 aa, Mycobacterium
APAGLRANMIFSADGAA

SEQ ID NO: 1290518 - protein, 21 aa, Mycobacterium
APAGTRKAYFIGIDDPIETPV

SEQ ID NO: 1290519 - protein, 20 aa, Mycobacterium
APAQAWLRRCAEANRHAVDA

SEQ ID NO: 1290520 - protein, 21 aa, Mycobacterium
APARLRAAATFNLPIPTDTRP

SEQ ID NO: 1290521 - protein, 18 aa, Mycobacterium
APCRDWLDVRFCAEDDDD

SEQ ID NO: 1290522 - protein, 18 aa, Mycobacterium
APDKLRIANLYDYSVALV

SEQ ID NO: 1290523 - protein, 19 aa, Mycobacterium
APDRLRWVIGEAVKAIEDG

SEQ ID NO: 1290524 - protein, 17 aa, Mycobacterium
APFGYPEVHYLTSPLRA

SEQ ID NO: 1290525 - protein, 18 aa, Mycobacterium
APGADWGVVYARTGEGRD

SEQ ID NO: 1290526 - protein, 23 aa, Mycobacterium
APGLFPSRMTKVLLAAGEEAVGA

SEQ ID NO: 1290527 - protein, 17 aa, Mycobacterium
APGSFSWHVLSSLTDEV

SEQ ID NO: 1290528 - protein, 20 aa, Mycobacterium
APHRGHVALGHFYDTFIGPR

SEQ ID NO: 1290529 - protein, 23 aa, Mycobacterium
APITPVLVPLTWVPIVGKPLAIA

SEQ ID NO: 1290530 - protein, 18 aa, Mycobacterium
APLISWDSAFGLVKINPL

SEQ ID NO: 1290531 - protein, 19 aa, Mycobacterium
APLKLAFDYTRSVGPLLGE

SEQ ID NO: 1290532 - protein, 17 aa, Mycobacterium
APLPWAQMHKVAAPTLL

SEQ ID NO: 1290533 - protein, 17 aa, Mycobacterium
APLSALLPMGGAVSGVA

SEQ ID NO: 1290534 - protein, 17 aa, Mycobacterium
APLSFRGAAYSGVFTLM

SEQ ID NO: 1290535 - protein, 20 aa, Mycobacterium
APMFHAWGFGQLVFAAMMAC

SEQ ID NO: 1290536 - protein, 19 aa, Mycobacterium
APMFHAWGFSQLAFAASMS

SEQ ID NO: 1290537 - protein, 20 aa, Mycobacterium
APMLCCDWRIHARVELTDEG

SEQ ID NO: 1290538 - protein, 19 aa, Mycobacterium
APMTLRWLRDRFAGRPLRT

SEQ ID NO: 1290539 - protein, 24 aa, Mycobacterium
APPGLPWEMVWSFHLLPHWEDRCR

SEQ ID NO: 1290540 - protein, 19 aa, Mycobacterium
APQMWRWAASRSVDQRTAL

SEQ ID NO: 1290541 - protein, 19 aa, Mycobacterium
APQRVGWFRFYFADERWEW

SEQ ID NO: 1290542 - protein, 23 aa, Mycobacterium
APRFTCSKVFCRLNIAVIALSIS

SEQ ID NO: 1290543 - protein, 23 aa, Mycobacterium
APRIVAGIPVCLCANSEIDAAKD

SEQ ID NO: 1290544 - protein, 18 aa, Mycobacterium
APRMRRLAADGVLRSEDV

SEQ ID NO: 1290545 - protein, 20 aa, Mycobacterium
APRPKMLVFGAIDFASALAR

SEQ ID NO: 1290546 - protein, 17 aa, Mycobacterium
APRTVLILVEWESREAF

SEQ ID NO: 1290547 - protein, 24 aa, Mycobacterium
APRWDTAIIGLDWETSVLDERLAA

SEQ ID NO: 1290548 - protein, 21 aa, Mycobacterium
APTLREAWAVIAPMLAGCTPV

SEQ ID NO: 1290549 - protein, 19 aa, Mycobacterium
APVKPAEFVIFRLAQYSGG

SEQ ID NO: 1290550 - protein, 18 aa, Mycobacterium
APVLPARSLVALCGGGTI

SEQ ID NO: 1290551 - protein, 22 aa, Mycobacterium
APYPELIDLLVLDAIESPYDPW

SEQ ID NO: 1290552 - protein, 17 aa, Mycobacterium
AQAIWYLQDRVIAPDFN

SEQ ID NO: 1290553 - protein, 19 aa, Mycobacterium
AQAWPHWADPDVVRAFHDR

SEQ ID NO: 1290554 - protein, 20 aa, Mycobacterium
AQGWCPFRAPAVLAQTARTA

SEQ ID NO: 1290555 - protein, 19 aa, Mycobacterium
AQIPHPWFDLIFAGGHEKT

SEQ ID NO: 1290556 - protein, 21 aa, Mycobacterium
AQIPVPAQWQWPQSIITDPER

SEQ ID NO: 1290557 - protein, 20 aa, Mycobacterium
AQLDRFAIRLELKYLNESEE

SEQ ID NO: 1290558 - protein, 17 aa, Mycobacterium
AQLEACFEELSELAGKR

SEQ ID NO: 1290559 - protein, 19 aa, Mycobacterium
AQLEAGFGLRTLIHMDDPH

SEQ ID NO: 1290560 - protein, 17 aa, Mycobacterium
AQLYLKRLLSFSRFMGG

SEQ ID NO: 1290561 - protein, 20 aa, Mycobacterium
AQRAGLMGAFVIGLATTRYV

SEQ ID NO: 1290562 - protein, 23 aa, Mycobacterium
AQRDCVYYATLIMWIGCHADSHE

SEQ ID NO: 1290563 - protein, 17 aa, Mycobacterium
AQRGMAVVGGRGSGAVM

SEQ ID NO: 1290564 - protein, 17 aa, Mycobacterium
AQSGFVFQSHNLFPHKT

SEQ ID NO: 1290565 - protein, 17 aa, Mycobacterium
AQVRRWLAAHLPEAEVV

SEQ ID NO: 1290566 - protein, 19 aa, Mycobacterium
AQYLGPALRLMNFNYLPLP

SEQ ID NO: 1290567 - protein, 17 aa, Mycobacterium
AQYSEWGALLARTDPSA

SEQ ID NO: 1290568 - protein, 18 aa, Mycobacterium
ARAAFEWSRTQQRPDGTW

SEQ ID NO: 1290569 - protein, 17 aa, Mycobacterium
ARAAMPVPAGWSGTEHL

SEQ ID NO: 1290570 - protein, 22 aa, Mycobacterium
ARAEPFPVFTFFRDYNRYLSRG

SEQ ID NO: 1290571 - protein, 22 aa, Mycobacterium
ARAGELLGELGLRPERHNDALM

SEQ ID NO: 1290572 - protein, 19 aa, Mycobacterium
ARAKEAFGIQKRQRQMDRC

SEQ ID NO: 1290573 - protein, 18 aa, Mycobacterium
ARAKGAVLDPVIARLTGG

SEQ ID NO: 1290574 - protein, 19 aa, Mycobacterium
ARALGRFGVRANAIAPRAR

SEQ ID NO: 1290575 - protein, 19 aa, Mycobacterium
ARAPSGLGLREPPGVRPRA

SEQ ID NO: 1290576 - protein, 19 aa, Mycobacterium
ARAPWEIARPVGADGALAT

SEQ ID NO: 1290577 - protein, 21 aa, Mycobacterium
ARARGRFAKELAMSFPAHTTA

SEQ ID NO: 1290578 - protein, 24 aa, Mycobacterium
ARATETWRFPAFFHGLLDAGVYPP

SEQ ID NO: 1290579 - protein, 17 aa, Mycobacterium
ARCLLSLAISYIAVATD

SEQ ID NO: 1290580 - protein, 17 aa, Mycobacterium
ARCRPSPTRWVIRSRSC

SEQ ID NO: 1290581 - protein, 25 aa, Mycobacterium
ARCRRLEALPGWSWEYRARPTWEAA

SEQ ID NO: 1290582 - protein, 23 aa, Mycobacterium
ARDIPSLGWRAYRRCPGAAGSWQ

SEQ ID NO: 1290583 - protein, 18 aa, Mycobacterium
ARDLKFYAFYGEVLFVLE

SEQ ID NO: 1290584 - protein, 23 aa, Mycobacterium
ARDRFAGAMPMLFTAQRTAEVRR

SEQ ID NO: 1290585 - protein, 23 aa, Mycobacterium
AREFKPLVLVAGYSAYPRRVNFA

SEQ ID NO: 1290586 - protein, 23 aa, Mycobacterium
AREISLAVARGWQVVGVVAAQDD

SEQ ID NO: 1290587 - protein, 19 aa, Mycobacterium
ARFGDLRLRLRVNGDERQN

SEQ ID NO: 1290588 - protein, 18 aa, Mycobacterium
ARFGWPKRNGFVQPLVDA

SEQ ID NO: 1290589 - protein, 20 aa, Mycobacterium
ARFKGVRQFARWMADEGEID

SEQ ID NO: 1290590 - protein, 21 aa, Mycobacterium
ARFPEPLAPLAAARRSGAELP

SEQ ID NO: 1290591 - protein, 17 aa, Mycobacterium
ARGATPLARVMGASITS

SEQ ID NO: 1290592 - protein, 19 aa, Mycobacterium
ARGGLRWSDRREDFRTEIL

SEQ ID NO: 1290593 - protein, 19 aa, Mycobacterium
ARGKRGGVIACALAHRATR

SEQ ID NO: 1290594 - protein, 24 aa, Mycobacterium
ARIGVEWWPELSLIDRSRHRGDVT

SEQ ID NO: 1290595 - protein, 17 aa, Mycobacterium
ARKAVVAGVTRWLPRPI

SEQ ID NO: 1290596 - protein, 21 aa, Mycobacterium
ARKLCRHAAGVMLQRGASPAA

SEQ ID NO: 1290597 - protein, 17 aa, Mycobacterium
ARLAHRGGFELVLAGPV

SEQ ID NO: 1290598 - protein, 17 aa, Mycobacterium
ARLALKWSEQYYAAERE

SEQ ID NO: 1290599 - protein, 18 aa, Mycobacterium
ARLEACFEELAELTGQRN

SEQ ID NO: 1290600 - protein, 17 aa, Mycobacterium
ARLGFTYAVVPSGVTSA

SEQ ID NO: 1290601 - protein, 18 aa, Mycobacterium
ARLGIRCFGFAPLRLPPD

SEQ ID NO: 1290602 - protein, 20 aa, Mycobacterium
ARLGSELGVLGMSVPESHGG

SEQ ID NO: 1290603 - protein, 17 aa, Mycobacterium
ARLIEWVAFTPLQNATG

SEQ ID NO: 1290604 - protein, 22 aa, Mycobacterium
ARLIGEGAPILWADMPTLPLYR

SEQ ID NO: 1290605 - protein, 17 aa, Mycobacterium
ARLKCPFTSLGIAPEAA

SEQ ID NO: 1290606 - protein, 18 aa, Mycobacterium
ARLLGPLAAYLVVNVSSP

SEQ ID NO: 1290607 - protein, 27 aa, Mycobacterium
ARLNWWESRALYGWTVLVPRTKDQAGE

SEQ ID NO: 1290608 - protein, 20 aa, Mycobacterium
ARLPVRLQWVRAELAMVRGD

SEQ ID NO: 1290609 - protein, 17 aa, Mycobacterium
ARLPVRLQWVSAELAMV

SEQ ID NO: 1290610 - protein, 19 aa, Mycobacterium
ARLRAQMAFVSSRVGESGA

SEQ ID NO: 1290611 - protein, 17 aa, Mycobacterium
ARLRAQMEFTRRRGGDT

SEQ ID NO: 1290612 - protein, 17 aa, Mycobacterium
ARMAEVFAGFLSYTDAQ

SEQ ID NO: 1290613 - protein, 17 aa, Mycobacterium
ARMGWLLSQNVLRKARA

SEQ ID NO: 1290614 - protein, 19 aa, Mycobacterium
ARMPSLRIPDFHMSSVSQA

SEQ ID NO: 1290615 - protein, 19 aa, Mycobacterium
ARMVLRLNGIRVRRNGCDV

SEQ ID NO: 1290616 - protein, 18 aa, Mycobacterium
ARNARAWHHAVAAAELHT

SEQ ID NO: 1290617 - protein, 19 aa, Mycobacterium
ARNDGGLWARLPAGVYVPL

SEQ ID NO: 1290618 - protein, 17 aa, Mycobacterium
ARPPVAFAPDDTGYGAG

SEQ ID NO: 1290619 - protein, 26 aa, Mycobacterium
ARPQIAVTFRRGWEWATVEGRAELAG

SEQ ID NO: 1290620 - protein, 20 aa, Mycobacterium
ARPRVLAGWERLDAPIRWVH

SEQ ID NO: 1290621 - protein, 19 aa, Mycobacterium
ARQEWRIFVDLALAMNRPL

SEQ ID NO: 1290622 - protein, 19 aa, Mycobacterium
ARRAREILGDIDIIVNNAG

SEQ ID NO: 1290623 - protein, 21 aa, Mycobacterium
ARRFGCQVWDGFGSTENAVTV

SEQ ID NO: 1290624 - protein, 18 aa, Mycobacterium
ARRFSVDAAEHLCATDIS

SEQ ID NO: 1290625 - protein, 23 aa, Mycobacterium
ARRIGADLAHRVRLARPRDETSI

SEQ ID NO: 1290626 - protein, 20 aa, Mycobacterium
ARRIGLNTVRVFLHDQLWAQ

SEQ ID NO: 1290627 - protein, 19 aa, Mycobacterium
ARRLRLNSRMGLLADDARV

SEQ ID NO: 1290628 - protein, 27 aa, Mycobacterium
ARRPSYRPAAPPARRAAGAAPQFEVMY

SEQ ID NO: 1290629 - protein, 17 aa, Mycobacterium
ARRRYHFLAGRGADGEL

SEQ ID NO: 1290630 - protein, 22 aa, Mycobacterium
ARRVSIPAGWTMAVWARVPKAR

SEQ ID NO: 1290631 - protein, 22 aa, Mycobacterium
ARRWCPPRRWVDIGVFDDHTPA

SEQ ID NO: 1290632 - protein, 19 aa, Mycobacterium
ARSACRWAPRVVFVNGHGG

SEQ ID NO: 1290633 - protein, 18 aa, Mycobacterium
ARSGLRVMRELERAILLD

SEQ ID NO: 1290634 - protein, 17 aa, Mycobacterium
ARTAAQFGIEPKVAMLS

SEQ ID NO: 1290635 - protein, 20 aa, Mycobacterium
ARVDASMVLYLFGSKEQLFR

SEQ ID NO: 1290636 - protein, 23 aa, Mycobacterium
ARVIAGGDGMRWLRIAVETLNNE

SEQ ID NO: 1290637 - protein, 17 aa, Mycobacterium
ARVKMGLSQNIAQVTAS

SEQ ID NO: 1290638 - protein, 18 aa, Mycobacterium
ARVLLVWDAPNLDMGLGS

SEQ ID NO: 1290639 - protein, 18 aa, Mycobacterium
ARVLPGERSYPVAHRVRG

SEQ ID NO: 1290640 - protein, 19 aa, Mycobacterium
ARVSCRWCASRCLPDQDTP

SEQ ID NO: 1290641 - protein, 21 aa, Mycobacterium
ARVTLGLALARLGMFAPAMSY

SEQ ID NO: 1290642 - protein, 19 aa, Mycobacterium
ARVWPGITIPDGGIRFSTD

SEQ ID NO: 1290643 - protein, 19 aa, Mycobacterium
ARWGYKFRFGVFRIDDHDL

SEQ ID NO: 1290644 - protein, 20 aa, Mycobacterium
ARWKLAIVLEQGFQRAGDDE

SEQ ID NO: 1290645 - protein, 17 aa, Mycobacterium
ARWLDYHAAVAFSITGD

SEQ ID NO: 1290646 - protein, 22 aa, Mycobacterium
ARWLKPTAYMMAKFGMTLCALG

SEQ ID NO: 1290647 - protein, 17 aa, Mycobacterium
ARWRFGVPPANNANYAW

SEQ ID NO: 1290648 - protein, 25 aa, Mycobacterium
ARYTWPRFVCGLPREFFAAVRAEMY

SEQ ID NO: 1290649 - protein, 18 aa, Mycobacterium
ASAAWRKLLVNAVVGLMV

SEQ ID NO: 1290650 - protein, 19 aa, Mycobacterium
ASAEAFSALGYYGVSMEMI

SEQ ID NO: 1290651 - protein, 20 aa, Mycobacterium
ASAFKAELVKGVPIGRLGRP

SEQ ID NO: 1290652 - protein, 21 aa, Mycobacterium
ASAFLGRLALIRIYKGRIKKG

SEQ ID NO: 1290653 - protein, 18 aa, Mycobacterium
ASAGFMLMKPLVETATAA

SEQ ID NO: 1290654 - protein, 17 aa, Mycobacterium
ASAVRWAVELGLVPAAD

SEQ ID NO: 1290655 - protein, 19 aa, Mycobacterium
ASFDEQWRLIARSLASAPA

SEQ ID NO: 1290656 - protein, 17 aa, Mycobacterium
ASFFACFTCTNAVITPT

SEQ ID NO: 1290657 - protein, 17 aa, Mycobacterium
ASGETKVVFAITEPDAG

SEQ ID NO: 1290658 - protein, 23 aa, Mycobacterium
ASGRIKLAWFLLHVARYLPPLLY

SEQ ID NO: 1290659 - protein, 19 aa, Mycobacterium
ASHVARGTFYRYFNNKEEV

SEQ ID NO: 1290660 - protein, 17 aa, Mycobacterium
ASLLYRRYDGAYGLITP

SEQ ID NO: 1290661 - protein, 19 aa, Mycobacterium
ASLPYRIMHEFQIPLYDQM

SEQ ID NO: 1290662 - protein, 17 aa, Mycobacterium
ASMDAIASYCLTEPGAG

SEQ ID NO: 1290663 - protein, 22 aa, Mycobacterium
ASPRYLLDFSRRFPDAAVVRLE

SEQ ID NO: 1290664 - protein, 20 aa, Mycobacterium
ASRLPLRMFCEMFGVPDHLE

SEQ ID NO: 1290665 - protein, 17 aa, Mycobacterium
ASSLEWVVLRLGGVLSV

SEQ ID NO: 1290666 - protein, 18 aa, Mycobacterium
ASYWRRWSTLTSVVLRVE

SEQ ID NO: 1290667 - protein, 21 aa, Mycobacterium
ATAPAWRVGDDVAHTDHGHGW

SEQ ID NO: 1290668 - protein, 25 aa, Mycobacterium
ATARGKLLWRLGEIIARDAEQLAEL

SEQ ID NO: 1290669 - protein, 20 aa, Mycobacterium
ATDFRLMWDNAYAVHTLTHD

SEQ ID NO: 1290670 - protein, 21 aa, Mycobacterium
ATGRWPAVRFAVRNTVVQGPN

SEQ ID NO: 1290671 - protein, 17 aa, Mycobacterium
ATIAEVFARDGAKVIAV

SEQ ID NO: 1290672 - protein, 19 aa, Mycobacterium
ATICSRLGFRPDVKRIPLF

SEQ ID NO: 1290673 - protein, 17 aa, Mycobacterium
ATLAVEWAPKVRVNSVV

SEQ ID NO: 1290674 - protein, 18 aa, Mycobacterium
ATLTRIAADYGIRDVYAP

SEQ ID NO: 1290675 - protein, 23 aa, Mycobacterium
ATPCGVCDSCVALAPNGPGNVDV

SEQ ID NO: 1290676 - protein, 17 aa, Mycobacterium
ATPLKWVRLDSAPFTDR

SEQ ID NO: 1290677 - protein, 17 aa, Mycobacterium
ATQRAKAAWLWSRRQGV

SEQ ID NO: 1290678 - protein, 25 aa, Mycobacterium
ATRWLASTVGFAWRTRLSVSASVDA

SEQ ID NO: 1290679 - protein, 18 aa, Mycobacterium
ATTEPWSPYGIRTSLDRS

SEQ ID NO: 1290680 - protein, 18 aa, Mycobacterium
ATVAHGFLTLSLIPALSK

SEQ ID NO: 1290681 - protein, 18 aa, Mycobacterium
ATVLDWGLWKSWSDAQPQ

SEQ ID NO: 1290682 - protein, 18 aa, Mycobacterium
ATVSLFWPLSSTNGAKLA

SEQ ID NO: 1290683 - protein, 21 aa, Mycobacterium
ATWCGPCRMVSPALEQLAAER

SEQ ID NO: 1290684 - protein, 23 aa, Mycobacterium
ATWPDCRPLVQWLVGRLPDGGDL

SEQ ID NO: 1290685 - protein, 17 aa, Mycobacterium
ATYFSGGKLQWLLENVD

SEQ ID NO: 1290686 - protein, 19 aa, Mycobacterium
AVADKACWSRWWPDLRLVV

SEQ ID NO: 1290687 - protein, 18 aa, Mycobacterium
AVCARITRRARYLAEIAW

SEQ ID NO: 1290688 - protein, 17 aa, Mycobacterium
AVDDVWAATRWVAENAA

SEQ ID NO: 1290689 - protein, 17 aa, Mycobacterium
AVDGGIRIATTVHATLA

SEQ ID NO: 1290690 - protein, 22 aa, Mycobacterium
AVELDRRWADDGVRGYSLHPGG

SEQ ID NO: 1290691 - protein, 18 aa, Mycobacterium
AVFRRAWLNVGRVEQIPR

SEQ ID NO: 1290692 - protein, 22 aa, Mycobacterium
AVGEILASLGLRLHPDKTKVVD

SEQ ID NO: 1290693 - protein, 18 aa, Mycobacterium
AVGFAEWLAITYGDDGIG

SEQ ID NO: 1290694 - protein, 18 aa, Mycobacterium
AVGRPRLTYELAPRLDYA

SEQ ID NO: 1290695 - protein, 21 aa, Mycobacterium
AVGRSRLGAGLTREQERLGVD

SEQ ID NO: 1290696 - protein, 24 aa, Mycobacterium
AVKFANLPFTWSTRGAERVAEAIR

SEQ ID NO: 1290697 - protein, 26 aa, Mycobacterium
AVKMPSQRGWRHWLYVMTRINLGLSA

SEQ ID NO: 1290698 - protein, 17 aa, Mycobacterium
AVLAEWGADVIKVEHAV

SEQ ID NO: 1290699 - protein, 24 aa, Mycobacterium
AVLAFSRWRFVRFAANERASTTLA

SEQ ID NO: 1290700 - protein, 18 aa, Mycobacterium
AVLARLDGVRGWQEDCYR

SEQ ID NO: 1290701 - protein, 17 aa, Mycobacterium
AVLARRGADKTVVIDPQ

SEQ ID NO: 1290702 - protein, 25 aa, Mycobacterium
AVLEKRAKLPVGMNDIYLSTVGGMR

SEQ ID NO: 1290703 - protein, 19 aa, Mycobacterium
AVLRFQYRLARTPLQLIER

SEQ ID NO: 1290704 - protein, 26 aa, Mycobacterium
AVMATMPMVMWLRMLSLQAQKRAAQA

SEQ ID NO: 1290705 - protein, 20 aa, Mycobacterium
AVNFPLYVIMSLLGIPESDF

SEQ ID NO: 1290706 - protein, 25 aa, Mycobacterium
AVPAHGWVNLHFSVLPAWRGAAPVQ

SEQ ID NO: 1290707 - protein, 17 aa, Mycobacterium
AVPEEWIRVSADDLPLF

SEQ ID NO: 1290708 - protein, 20 aa, Mycobacterium
AVPFSAYLFYKWAGHPNAEP

SEQ ID NO: 1290709 - protein, 21 aa, Mycobacterium
AVPGRAGVCGSVIDAVAPGAV

SEQ ID NO: 1290710 - protein, 20 aa, Mycobacterium
AVPPEWFCGLTWPAKPLVAQ

SEQ ID NO: 1290711 - protein, 23 aa, Mycobacterium
AVQRIVDHWAMFDTVRFDLNLVV

SEQ ID NO: 1290712 - protein, 19 aa, Mycobacterium
AVRPRIFGVAYRMLGSVAE

SEQ ID NO: 1290713 - protein, 25 aa, Mycobacterium
AVSNRLRPWLPLLLALTANSAIYRN

SEQ ID NO: 1290714 - protein, 24 aa, Mycobacterium
AVTRARLSGMPAVFWLDDERPHEN

SEQ ID NO: 1290715 - protein, 18 aa, Mycobacterium
AVVLLMWAGILAYLDHSG

SEQ ID NO: 1290716 - protein, 24 aa, Mycobacterium
AVVLRRMAWYWARIWIEVTPVRVL

SEQ ID NO: 1290717 - protein, 18 aa, Mycobacterium
AVWWGKRVLGLPIHDNWW

SEQ ID NO: 1290718 - protein, 17 aa, Mycobacterium
AVYYRGRYGVHPETTLA

SEQ ID NO: 1290719 - protein, 18 aa, Mycobacterium
AWEAIQFIPKEHWQDYLV

SEQ ID NO: 1290720 - protein, 18 aa, Mycobacterium
AWGERQKRILAWLQVLDA

SEQ ID NO: 1290721 - protein, 24 aa, Mycobacterium
AWKQWLRLSNWLGISDHSRVSTRT

SEQ ID NO: 1290722 - protein, 21 aa, Mycobacterium
AWPVLRRNLSVLALRGADPRE

SEQ ID NO: 1290723 - protein, 19 aa, Mycobacterium
AWSYARLALKWSEQYYAAE

SEQ ID NO: 1290724 - protein, 18 aa, Mycobacterium
AWWFPAFAPLPGGDPTVM

SEQ ID NO: 1290725 - protein, 31 aa, Mycobacterium
AYAMRCTACWWLGRPGWRRDFDRAVEMAGEA

SEQ ID NO: 1290726 - protein, 24 aa, Mycobacterium
AYLARLRWPGGFRCPSCDHDRAWQ

SEQ ID NO: 1290727 - protein, 18 aa, Mycobacterium
AYLARLVTRQALNALRAQ

SEQ ID NO: 1290728 - protein, 17 aa, Mycobacterium
AYLFYKWAGHPNAEPDR

SEQ ID NO: 1290729 - protein, 22 aa, Mycobacterium
AYLRATFDWHIDGCTPTGDDYP

SEQ ID NO: 1290730 - protein, 19 aa, Mycobacterium
AYPSIEVFKKSGLGALPVP

SEQ ID NO: 1290731 - protein, 31 aa, Mycobacterium
AYRGHIFWDELFIFPVLNLRAPMITRSLLGY

SEQ ID NO: 1290732 - protein, 19 aa, Mycobacterium
AYRLPWPSGSVVYEIDQPE

SEQ ID NO: 1290733 - protein, 24 aa, Mycobacterium
AYTQLPFKLAWAITIHKSQGQTLE

SEQ ID NO: 1290734 - protein, 17 aa, Mycobacterium
AYTRGRFASAFGPHAAL

SEQ ID NO: 1290735 - protein, 19 aa, Mycobacterium
CAAIDFGAAAGRAALTLPG

SEQ ID NO: 1290736 - protein, 20 aa, Mycobacterium
CAALTRILLPRSRYSEFVDA

SEQ ID NO: 1290737 - protein, 25 aa, Mycobacterium
CAAPTRMLLPRSRYDEGVALLKALY

SEQ ID NO: 1290738 - protein, 18 aa, Mycobacterium
CAAVDELHRLAAETRDDG

SEQ ID NO: 1290739 - protein, 19 aa, Mycobacterium
CADMLVAIEVSRRLVSDAV

SEQ ID NO: 1290740 - protein, 25 aa, Mycobacterium
CAEAFRAEWLLAFLAADLRGGIPEG

SEQ ID NO: 1290741 - protein, 19 aa, Mycobacterium
CAECAAAFGDHLRQTNGPP

SEQ ID NO: 1290742 - protein, 20 aa, Mycobacterium
CAEMGPGLCNIAYAAVDRHA

SEQ ID NO: 1290743 - protein, 28 aa, Mycobacterium
CAGMIPWNFPLLLAVWKLGPALAAGNTV

SEQ ID NO: 1290744 - protein, 18 aa, Mycobacterium
CAIIARMSRDLGKANQLA

SEQ ID NO: 1290745 - protein, 17 aa, Mycobacterium
CALGILDVFTRAGVDVP

SEQ ID NO: 1290746 - protein, 18 aa, Mycobacterium
CALHEAFSGVGFDVDPTV

SEQ ID NO: 1290747 - protein, 17 aa, Mycobacterium
CALWHGAAWDRETVARF

SEQ ID NO: 1290748 - protein, 18 aa, Mycobacterium
CAMTGELLAPLWEATAAA

SEQ ID NO: 1290749 - protein, 17 aa, Mycobacterium
CANGITVHRGRLFVGEC

SEQ ID NO: 1290750 - protein, 18 aa, Mycobacterium
CAPGSSWLTGEVLDINGG

SEQ ID NO: 1290751 - protein, 17 aa, Mycobacterium
CAQPGCPELQTETRCTE

SEQ ID NO: 1290752 - protein, 17 aa, Mycobacterium
CASWVDLPVSPAWAAPV

SEQ ID NO: 1290753 - protein, 18 aa, Mycobacterium
CAYLNPGRFIAGRPLVKG

SEQ ID NO: 1290754 - protein, 19 aa, Mycobacterium
CCFENRWNPDWLAVADKLR

SEQ ID NO: 1290755 - protein, 22 aa, Mycobacterium
CDAFLAAIARWGAPFEVLTDNG

SEQ ID NO: 1290756 - protein, 23 aa, Mycobacterium
CDGKPEFARRLAVSFRDHNAEVG

SEQ ID NO: 1290757 - protein, 21 aa, Mycobacterium
CDLRAGLLAFVRRVATEAFPS

SEQ ID NO: 1290758 - protein, 23 aa, Mycobacterium
CDPPESFQLYGIVAHVLTYSAHR

SEQ ID NO: 1290759 - protein, 23 aa, Mycobacterium
CDVVLCALPARYLTPTSDKKPAP

SEQ ID NO: 1290760 - protein, 17 aa, Mycobacterium
CELRRTYPRWGAQRIAH

SEQ ID NO: 1290761 - protein, 18 aa, Mycobacterium
CFACGYPTMHPGLCAYCR

SEQ ID NO: 1290762 - protein, 20 aa, Mycobacterium
CFGFFPLRLARYGIDVLATD

SEQ ID NO: 1290763 - protein, 20 aa, Mycobacterium
CGECGGLIRPNVVWFGEPLP

SEQ ID NO: 1290764 - protein, 22 aa, Mycobacterium
CGECPRCRAGLSAKCCSVRKVG

SEQ ID NO: 1290765 - protein, 18 aa, Mycobacterium
CGFCTPGMMITARALLDR

SEQ ID NO: 1290766 - protein, 18 aa, Mycobacterium
CGHVARSQWCVIVDENGD

SEQ ID NO: 1290767 - protein, 20 aa, Mycobacterium
CGISMPIAREVDGVVNHGST

SEQ ID NO: 1290768 - protein, 18 aa, Mycobacterium
CGPVGLAVICHLKALGVR

SEQ ID NO: 1290769 - protein, 17 aa, Mycobacterium
CGVPFLYRFELMGTTDD

SEQ ID NO: 1290770 - protein, 17 aa, Mycobacterium
CGVVYELRQPVGVDPAD

SEQ ID NO: 1290771 - protein, 18 aa, Mycobacterium
CGWDEDFTAALAERGWLG

SEQ ID NO: 1290772 - protein, 17 aa, Mycobacterium
CGWFDAVIARYATRVNG

SEQ ID NO: 1290773 - protein, 23 aa, Mycobacterium
CGYCTRLKMALKSEGIRWNEVDI

SEQ ID NO: 1290774 - protein, 23 aa, Mycobacterium
CHNGCPLGNLIPEWNDLVRTGRW

SEQ ID NO: 1290775 - protein, 23 aa, Mycobacterium
CLNEARFGIVFGALGAARDSLET

SEQ ID NO: 1290776 - protein, 23 aa, Mycobacterium
CLSEARFGIVFGAVGAARDCLQT

SEQ ID NO: 1290777 - protein, 17 aa, Mycobacterium
CMAAKFFTGLPMDGPDP

SEQ ID NO: 1290778 - protein, 19 aa, Mycobacterium
CNPDHEIGALVMLDPEATR

SEQ ID NO: 1290779 - protein, 17 aa, Mycobacterium
CNRCVPCRRGFFMQCER

SEQ ID NO: 1290780 - protein, 19 aa, Mycobacterium
CPDMSMLLASMFKVPMSQL

SEQ ID NO: 1290781 - protein, 17 aa, Mycobacterium
CPEWEPITAALNTELGN

SEQ ID NO: 1290782 - protein, 18 aa, Mycobacterium
CPKSFDFIDEMPRLPTGK

SEQ ID NO: 1290783 - protein, 21 aa, Mycobacterium
CPMCAAAHAWVGLGRVVYAAS

SEQ ID NO: 1290784 - protein, 17 aa, Mycobacterium
CPTCNGVGVVFTDLGVM

SEQ ID NO: 1290785 - protein, 19 aa, Mycobacterium
CPVCLGLPGSLPVLNQQAV

SEQ ID NO: 1290786 - protein, 19 aa, Mycobacterium
CPVCLGLPGSLPVLNQSAV

SEQ ID NO: 1290787 - protein, 19 aa, Mycobacterium
CPYHGWSYRNDGRIVGLPF

SEQ ID NO: 1290788 - protein, 18 aa, Mycobacterium
CRAEGRSALIGYLPTGFP

SEQ ID NO: 1290789 - protein, 18 aa, Mycobacterium
CRAMNWRSVREGASLQHD

SEQ ID NO: 1290790 - protein, 17 aa, Mycobacterium
CRSTLRPTRRGWRRSGI

SEQ ID NO: 1290791 - protein, 18 aa, Mycobacterium
CRTCGAVSDGIRAVTTGD

SEQ ID NO: 1290792 - protein, 21 aa, Mycobacterium
CRYRRWLAMAARDGNEMVVDA

SEQ ID NO: 1290793 - protein, 17 aa, Mycobacterium
CSDRPKTAWLFGGQGNQ

SEQ ID NO: 1290794 - protein, 17 aa, Mycobacterium
CSGEVKSSLGWTGTARL

SEQ ID NO: 1290795 - protein, 20 aa, Mycobacterium
CSGLIKWAFLQNGKSLPRSS

SEQ ID NO: 1290796 - protein, 17 aa, Mycobacterium
CSRWGMLAPDGKCKTFD

SEQ ID NO: 1290797 - protein, 19 aa, Mycobacterium
CSSSGFDWLAAGFVRSGSS

SEQ ID NO: 1290798 - protein, 23 aa, Mycobacterium
CSTKGDGLLAVFGHPIAHEDDAR

SEQ ID NO: 1290799 - protein, 18 aa, Mycobacterium
CSVSMPFKEDVLHLVDHV

SEQ ID NO: 1290800 - protein, 24 aa, Mycobacterium
CTDPDFAGCFFVNIATEFRDPDHR

SEQ ID NO: 1290801 - protein, 21 aa, Mycobacterium
CTLLGYDFCAVFLPDEQGRAL

SEQ ID NO: 1290802 - protein, 17 aa, Mycobacterium
CTLREWFDRPNGEPPPW

SEQ ID NO: 1290803 - protein, 21 aa, Mycobacterium
CVAPMRLCHHFAPAMAARGRG

SEQ ID NO: 1290804 - protein, 22 aa, Mycobacterium
CVAVDAGHRWLLHAGDSFYHPG

SEQ ID NO: 1290805 - protein, 23 aa, Mycobacterium
CVIDELRGLFLFDGLTDAQLTAL

SEQ ID NO: 1290806 - protein, 18 aa, Mycobacterium
CVLCPPRRMWSVPRIYAA

SEQ ID NO: 1290807 - protein, 17 aa, Mycobacterium
CVLWCLAIRHAVLTGDL

SEQ ID NO: 1290808 - protein, 21 aa, Mycobacterium
CVVLHRFLRWRAPGYRAESHI

SEQ ID NO: 1290809 - protein, 17 aa, Mycobacterium
CVVYPWVRFLDRDPATP

SEQ ID NO: 1290810 - protein, 18 aa, Mycobacterium
CWDLLAGAPLGRLVTSTE

SEQ ID NO: 1290811 - protein, 18 aa, Mycobacterium
CWTMLGAWAEQTSRIEIG

SEQ ID NO: 1290812 - protein, 18 aa, Mycobacterium
CYHMYPAHAAFGGYKQSG

SEQ ID NO: 1290813 - protein, 21 aa, Mycobacterium
CYSLRIASAMAHDEGWLAEHM

SEQ ID NO: 1290814 - protein, 18 aa, Mycobacterium
DAAGFKWLAPYTGSAIGQ

SEQ ID NO: 1290815 - protein, 17 aa, Mycobacterium
DAAHVWHPYSTIGAGAL

SEQ ID NO: 1290816 - protein, 22 aa, Mycobacterium
DAARIRAAVWAFGDHAVASGLA

SEQ ID NO: 1290817 - protein, 17 aa, Mycobacterium
DAAVSIHAVERFLGDLA

SEQ ID NO: 1290818 - protein, 20 aa, Mycobacterium
DADGWCSLSLHAGGTVGELR

SEQ ID NO: 1290819 - protein, 31 aa, Mycobacterium
DADRVAAIGFCFGGLCVLDLARAGHPLVGVA

SEQ ID NO: 1290820 - protein, 17 aa, Mycobacterium
DAEDSWEGFAWFVWQLC

SEQ ID NO: 1290821 - protein, 17 aa, Mycobacterium
DAEKFLLSWLGFDLERA

SEQ ID NO: 1290822 - protein, 18 aa, Mycobacterium
DAGLSWVHFPEGFGGLGL

SEQ ID NO: 1290823 - protein, 26 aa, Mycobacterium
DAGLWGFTGVRSMEGLIAWKLGTSFR

SEQ ID NO: 1290824 - protein, 20 aa, Mycobacterium
DAGPVALEFPGPIAELQLSR

SEQ ID NO: 1290825 - protein, 31 aa, Mycobacterium
DAGWSRTDHYAWIAGLLLDLGIESIDAVDTV

SEQ ID NO: 1290826 - protein, 17 aa, Mycobacterium
DAIPVLFGHVGEGNLHL

SEQ ID NO: 1290827 - protein, 17 aa, Mycobacterium
DAKAVIVAQNLVAERFV

SEQ ID NO: 1290828 - protein, 23 aa, Mycobacterium
DAKWASSISGYWRRGRTEETFRQ

SEQ ID NO: 1290829 - protein, 18 aa, Mycobacterium
DALARLASRYALGDSGLD

SEQ ID NO: 1290830 - protein, 20 aa, Mycobacterium
DALLPRYVATRVYAALLEAA

SEQ ID NO: 1290831 - protein, 17 aa, Mycobacterium
DALPVWPPREMSTAQIT

SEQ ID NO: 1290832 - protein, 24 aa, Mycobacterium
DALVGLCWPAVFSAIGSALTEDGF

SEQ ID NO: 1290833 - protein, 17 aa, Mycobacterium
DALWPMVVLRTAVLIVS

SEQ ID NO: 1290834 - protein, 17 aa, Mycobacterium
DAPGALCRWCGREEPAL

SEQ ID NO: 1290835 - protein, 20 aa, Mycobacterium
DAPPRFLFFTGKGGVGKTSI

SEQ ID NO: 1290836 - protein, 21 aa, Mycobacterium
DARARCVAIALAAGAASGVIR

SEQ ID NO: 1290837 - protein, 23 aa, Mycobacterium
DARIRDGLAWCYSRVQIMRFQGY

SEQ ID NO: 1290838 - protein, 20 aa, Mycobacterium
DARTRFGITVSDVLLAPTLR

SEQ ID NO: 1290839 - protein, 21 aa, Mycobacterium
DARYALDMAPRLVAFSEDVDR

SEQ ID NO: 1290840 - protein, 18 aa, Mycobacterium
DASFKSFVALDWALCLAS

SEQ ID NO: 1290841 - protein, 19 aa, Mycobacterium
DASRGSLFNGIRIGAIDAA

SEQ ID NO: 1290842 - protein, 22 aa, Mycobacterium
DASRLFLTQMIQHHRGAIMMAQ

SEQ ID NO: 1290843 - protein, 17 aa, Mycobacterium
DASRLFLTQMIRHHEGA

SEQ ID NO: 1290844 - protein, 19 aa, Mycobacterium
DATHFVRWLSLWSSTIDDM

SEQ ID NO: 1290845 - protein, 17 aa, Mycobacterium
DATRTEWLQALRADDFG

SEQ ID NO: 1290846 - protein, 20 aa, Mycobacterium
DAVFHCPFCHGWEVRDAPVA

SEQ ID NO: 1290847 - protein, 19 aa, Mycobacterium
DAVYLKFGEPIPVTSLLGF

SEQ ID NO: 1290848 - protein, 19 aa, Mycobacterium
DAWLCGWDEDFTAALAERG

SEQ ID NO: 1290849 - protein, 24 aa, Mycobacterium
DAYACAGCGTLLAVEIRAHEDEPL

SEQ ID NO: 1290850 - protein, 19 aa, Mycobacterium
DCAFLPDWPGVPVGNEEGE

SEQ ID NO: 1290851 - protein, 23 aa, Mycobacterium
DCGDPGALAGFWAHVLGYVLQPP

SEQ ID NO: 1290852 - protein, 21 aa, Mycobacterium
DCGFGWYFYDFGTAVSFFEDH

SEQ ID NO: 1290853 - protein, 20 aa, Mycobacterium
DCIECPFHGWRWGPEGDNTY

SEQ ID NO: 1290854 - protein, 24 aa, Mycobacterium
DCTDELKVALGRRIVVIDGAMGTA

SEQ ID NO: 1290855 - protein, 19 aa, Mycobacterium
DCVRYMVLVNVSFLQRNLR

SEQ ID NO: 1290856 - protein, 18 aa, Mycobacterium
DDAGRSWESLSLKGSADF

SEQ ID NO: 1290857 - protein, 17 aa, Mycobacterium
DDARLPVRLQWVSAELA

SEQ ID NO: 1290858 - protein, 27 aa, Mycobacterium
DDATRWYAEFARLAALMTRDVHYEVDT

SEQ ID NO: 1290859 - protein, 17 aa, Mycobacterium
DDAWFITDWMDATRAQE

SEQ ID NO: 1290860 - protein, 17 aa, Mycobacterium
DDEFAFVVHGTMADPRW

SEQ ID NO: 1290861 - protein, 24 aa, Mycobacterium
DDELIAAAAYRWLRSWPVAPSSPW

SEQ ID NO: 1290862 - protein, 22 aa, Mycobacterium
DDFRHTFDWCVTSAFIMSQLAA

SEQ ID NO: 1290863 - protein, 21 aa, Mycobacterium
DDGRSVLIISHFVADEHRFDR

SEQ ID NO: 1290864 - protein, 22 aa, Mycobacterium
DDGRSVLIISHFVADEHRFDRI

SEQ ID NO: 1290865 - protein, 18 aa, Mycobacterium
DDIDWRTGRIILHGKASR

SEQ ID NO: 1290866 - protein, 18 aa, Mycobacterium
DDLNFLWLPLAHAFGKVM

SEQ ID NO: 1290867 - protein, 26 aa, Mycobacterium
DDLYKSSFCDLRWSSGVGQYIEASAG

SEQ ID NO: 1290868 - protein, 27 aa, Mycobacterium
DDLYWMYALSSCVKWSDPVFDPTHDRP

SEQ ID NO: 1290869 - protein, 17 aa, Mycobacterium
DDMIGVNLSGVWKTVKA

SEQ ID NO: 1290870 - protein, 21 aa, Mycobacterium
DDPFWSGLRLRDALADVDVPV

SEQ ID NO: 1290871 - protein, 24 aa, Mycobacterium
DDPRPRLLGALAMASVRIALDDWL

SEQ ID NO: 1290872 - protein, 17 aa, Mycobacterium
DDQWTWLVHTLTVEKVR

SEQ ID NO: 1290873 - protein, 23 aa, Mycobacterium
DDRLAGLPARYAVSVGDQRLVRY

SEQ ID NO: 1290874 - protein, 17 aa, Mycobacterium
DDRVVEWTPAQPLPAHT

SEQ ID NO: 1290875 - protein, 19 aa, Mycobacterium
DDVWLPLFRPVAGDLGELP

SEQ ID NO: 1290876 - protein, 18 aa, Mycobacterium
DDWPLLRWRMQEYRHGRW

SEQ ID NO: 1290877 - protein, 23 aa, Mycobacterium
DEALWKMLCEQVGAAALVVPEEL

SEQ ID NO: 1290878 - protein, 19 aa, Mycobacterium
DEFTCSSCFLVHHRSRLAS

SEQ ID NO: 1290879 - protein, 20 aa, Mycobacterium
DEGLCALGLRFSEDPMAPAA

SEQ ID NO: 1290880 - protein, 23 aa, Mycobacterium
DEHRRRIGMALARLRDPDDALQK

SEQ ID NO: 1290881 - protein, 17 aa, Mycobacterium
DEIRWALDLLRKRFAKV

SEQ ID NO: 1290882 - protein, 23 aa, Mycobacterium
DELAARNRLNWFLRDLSSGRLGA

SEQ ID NO: 1290883 - protein, 17 aa, Mycobacterium
DELGLWPKFSALPHSRL

SEQ ID NO: 1290884 - protein, 20 aa, Mycobacterium
DELGRLCCWILLDAAAPVSL

SEQ ID NO: 1290885 - protein, 17 aa, Mycobacterium
DELHTAFQFDFLRTPWR

SEQ ID NO: 1290886 - protein, 21 aa, Mycobacterium
DELQPRLAPFANKNPDNGVGL

SEQ ID NO: 1290887 - protein, 22 aa, Mycobacterium
DELRQRIGMVFQQFNLFPHRSV

SEQ ID NO: 1290888 - protein, 24 aa, Mycobacterium
DELRRYRMQSGFVFQSHNLFPHKT

SEQ ID NO: 1290889 - protein, 18 aa, Mycobacterium
DELRVVWELEPGRRLKPP

SEQ ID NO: 1290890 - protein, 19 aa, Mycobacterium
DELRVVWELEPGRRLKPPQ

SEQ ID NO: 1290891 - protein, 17 aa, Mycobacterium
DEPFSGLAFKVATHPFF

SEQ ID NO: 1290892 - protein, 25 aa, Mycobacterium
DEPYPWPAMFGRIGEEYARRYGLDH

SEQ ID NO: 1290893 - protein, 17 aa, Mycobacterium
DERRPRYVVADAATVAT

SEQ ID NO: 1290894 - protein, 21 aa, Mycobacterium
DESGLRWVVGFNHDRDPGATY

SEQ ID NO: 1290895 - protein, 18 aa, Mycobacterium
DEVARLGAQVTIFRLGTD

SEQ ID NO: 1290896 - protein, 17 aa, Mycobacterium
DEYEVFSSIVLIRSRYD

SEQ ID NO: 1290897 - protein, 19 aa, Mycobacterium
DFAALLIYRLGRLPSDRSS

SEQ ID NO: 1290898 - protein, 23 aa, Mycobacterium
DFGCKRPTLSNVYYRTFTKPHVH

SEQ ID NO: 1290899 - protein, 21 aa, Mycobacterium
DFGRFAWRPAVTDFCRLAAQQ

SEQ ID NO: 1290900 - protein, 19 aa, Mycobacterium
DFKLRFFEDGMKRAACIPF

SEQ ID NO: 1290901 - protein, 26 aa, Mycobacterium
DFKPPLEWLQHIPVLGRFVVTPLVHL

SEQ ID NO: 1290902 - protein, 24 aa, Mycobacterium
DFPLARLYSWHRAMRLFDGPDEVH

SEQ ID NO: 1290903 - protein, 19 aa, Mycobacterium
DFRAVPVAGGWEVSGASVP

SEQ ID NO: 1290904 - protein, 19 aa, Mycobacterium
DFRLILLTHNFDFFRTLES

SEQ ID NO: 1290905 - protein, 23 aa, Mycobacterium
DFVKLSEALGCVGLRCERSEDVA

SEQ ID NO: 1290906 - protein, 20 aa, Mycobacterium
DFYLKWFWTQPLWLDLGDIR

SEQ ID NO: 1290907 - protein, 17 aa, Mycobacterium
DGAMTFGAVAGAPALVF

SEQ ID NO: 1290908 - protein, 25 aa, Mycobacterium
DGDIWDWAVPWEEWKSMSALSDQAS

SEQ ID NO: 1290909 - protein, 27 aa, Mycobacterium
DGDKGLRFSFRWDLGRSRLVMVDSRNA

SEQ ID NO: 1290910 - protein, 18 aa, Mycobacterium
DGFADGWFNTEEGIKDLI

SEQ ID NO: 1290911 - protein, 23 aa, Mycobacterium
DGGCTKPGCAVGAYGCQGHHVEA

SEQ ID NO: 1290912 - protein, 22 aa, Mycobacterium
DGGCTKPGCPVGAYGCQGHHVE

SEQ ID NO: 1290913 - protein, 23 aa, Mycobacterium
DGGCTKPGCTIGAYGCQAHHVDA

SEQ ID NO: 1290914 - protein, 18 aa, Mycobacterium
DGGILERFVGAYIPLLGI

SEQ ID NO: 1290915 - protein, 17 aa, Mycobacterium
DGGRAAIVLGDWPARTP

SEQ ID NO: 1290916 - protein, 18 aa, Mycobacterium
DGGRAALVLGDWPETPVD

SEQ ID NO: 1290917 - protein, 18 aa, Mycobacterium
DGGWGRFVADLEVVPIGG

SEQ ID NO: 1290918 - protein, 19 aa, Mycobacterium
DGICLDAAGGVWVAMTLAH

SEQ ID NO: 1290919 - protein, 23 aa, Mycobacterium
DGIGLDEYVDWLIDAGHPIRRVG

SEQ ID NO: 1290920 - protein, 19 aa, Mycobacterium
DGIQCPFHGWVWNGEGRNV

SEQ ID NO: 1290921 - protein, 21 aa, Mycobacterium
DGLCERLREQGVRLIYDEPRR

SEQ ID NO: 1290922 - protein, 18 aa, Mycobacterium
DGLFGVLTNVVWTSHGPC

SEQ ID NO: 1290923 - protein, 17 aa, Mycobacterium
DGLRRAGGCWVLTNHPF

SEQ ID NO: 1290924 - protein, 18 aa, Mycobacterium
DGMLVAWFATGFDVLASR

SEQ ID NO: 1290925 - protein, 26 aa, Mycobacterium
DGPIPAGVPFRWSWELADRALTEMCA

SEQ ID NO: 1290926 - protein, 23 aa, Mycobacterium
DGPQLRTSWRWSTALSTSTEVDR

SEQ ID NO: 1290927 - protein, 17 aa, Mycobacterium
DGPSVLGAVEWIGDTDK

SEQ ID NO: 1290928 - protein, 24 aa, Mycobacterium
DGPVAGLVKFEWDALTWFEEDEPI

SEQ ID NO: 1290929 - protein, 24 aa, Mycobacterium
DGRCPTCQGEGFVSVELLFLPGTY

SEQ ID NO: 1290930 - protein, 20 aa, Mycobacterium
DGRKAVVFDDRWASAREDLV

SEQ ID NO: 1290931 - protein, 22 aa, Mycobacterium
DGRKAVVFDDRWASAREDLVKI

SEQ ID NO: 1290932 - protein, 22 aa, Mycobacterium
DGRKAVVLDDRWASAREDLARI

SEQ ID NO: 1290933 - protein, 21 aa, Mycobacterium
DGRLDEWLGLLAPDVRYTMPF

SEQ ID NO: 1290934 - protein, 21 aa, Mycobacterium
DGRPTVNMAVGFLPPQDMIEN

SEQ ID NO: 1290935 - protein, 19 aa, Mycobacterium
DGRVLRAGYLVGCDGGRSL

SEQ ID NO: 1290936 - protein, 21 aa, Mycobacterium
DGRWIWRWDPAFIHSNFDFLR

SEQ ID NO: 1290937 - protein, 19 aa, Mycobacterium
DGRWWRRWAARHAPTHPPT

SEQ ID NO: 1290938 - protein, 21 aa, Mycobacterium
DGRWYWHWDPAFLTKPGDDPF

SEQ ID NO: 1290939 - protein, 20 aa, Mycobacterium
DGRYRLGDQLTFVAQLESRA

SEQ ID NO: 1290940 - protein, 17 aa, Mycobacterium
DGSFEWRFTPEVPSQLV

SEQ ID NO: 1290941 - protein, 26 aa, Mycobacterium
DGTGLQCLSCGLAPEITENLSKPFVF

SEQ ID NO: 1290942 - protein, 20 aa, Mycobacterium
DGTPRAGAPFGFAVTTAPHD

SEQ ID NO: 1290943 - protein, 23 aa, Mycobacterium
DGTTWRPKVPLGYGRTYTLEAVG

SEQ ID NO: 1290944 - protein, 19 aa, Mycobacterium
DGTVSWAPVWARYGTNNRS

SEQ ID NO: 1290945 - protein, 18 aa, Mycobacterium
DGVIFHRVIEGFMIQGGD

SEQ ID NO: 1290946 - protein, 17 aa, Mycobacterium
DGVRGWQEDCYRDLHRH

SEQ ID NO: 1290947 - protein, 23 aa, Mycobacterium
DGWPNQRFALLFLAWLAAHPEVR

SEQ ID NO: 1290948 - protein, 17 aa, Mycobacterium
DGWYEWRPNPAEGGKKK

SEQ ID NO: 1290949 - protein, 19 aa, Mycobacterium
DHACSLCARLWEVNSTTIS

SEQ ID NO: 1290950 - protein, 18 aa, Mycobacterium
DHDRLCAFAADWNKRTWN

SEQ ID NO: 1290951 - protein, 27 aa, Mycobacterium
DHFRREFAPRILVCGAAFKGDPPTRDT

SEQ ID NO: 1290952 - protein, 17 aa, Mycobacterium
DHIPYQSSTGWREPDYG

SEQ ID NO: 1290953 - protein, 21 aa, Mycobacterium
DHLRVAVLLGAFVGLRVAEVA

SEQ ID NO: 1290954 - protein, 19 aa, Mycobacterium
DHPRLGWSHAPVGPVLAES

SEQ ID NO: 1290955 - protein, 23 aa, Mycobacterium
DHTRLRWLVSKAFVPKVVKALEP

SEQ ID NO: 1290956 - protein, 17 aa, Mycobacterium
DHTVPWPAGPTCAANLK

SEQ ID NO: 1290957 - protein, 18 aa, Mycobacterium
DHYFPWLASQGHAPYAWS

SEQ ID NO: 1290958 - protein, 22 aa, Mycobacterium
DIAEVLALLGVRPIWDDASRRV

SEQ ID NO: 1290959 - protein, 22 aa, Mycobacterium
DIARPRTEIMLNLGNPDLAFKT

SEQ ID NO: 1290960 - protein, 18 aa, Mycobacterium
DIAWAGPGPQWWAERLGV

SEQ ID NO: 1290961 - protein, 18 aa, Mycobacterium
DICVAAFAGFAVVKPQVA

SEQ ID NO: 1290962 - protein, 22 aa, Mycobacterium
DIDRGGVFAAFFGTVALLSPED

SEQ ID NO: 1290963 - protein, 22 aa, Mycobacterium
DIFSIRIPKPWFVLMPTPMWDQ

SEQ ID NO: 1290964 - protein, 22 aa, Mycobacterium
DIFSMRIPKPWFVMMPTPLWDQ

SEQ ID NO: 1290965 - protein, 21 aa, Mycobacterium
DIGFRMPSVWFAEGHNAVAPV

SEQ ID NO: 1290966 - protein, 17 aa, Mycobacterium
DIISMHMGWGWGGYGVG

SEQ ID NO: 1290967 - protein, 20 aa, Mycobacterium
DILLAVGVTQRWGDAGIVGN

SEQ ID NO: 1290968 - protein, 22 aa, Mycobacterium
DIPRTAAPILRRLADTLQETVH

SEQ ID NO: 1290969 - protein, 18 aa, Mycobacterium
DISAKKSEPEWMLDIRLK

SEQ ID NO: 1290970 - protein, 26 aa, Mycobacterium
DKFAPRLSFFWGIGMNFFMEVAKLRA

SEQ ID NO: 1290971 - protein, 21 aa, Mycobacterium
DKFRVVFELTERGLLANPQAM

SEQ ID NO: 1290972 - protein, 22 aa, Mycobacterium
DKLDLRSGITFNTRVVSTVLDE

SEQ ID NO: 1290973 - protein, 19 aa, Mycobacterium
DKLDLRSGVTFNTKVTSAV

SEQ ID NO: 1290974 - protein, 19 aa, Mycobacterium
DKLITCLQVLADIEALPPE

SEQ ID NO: 1290975 - protein, 23 aa, Mycobacterium
DKMPRRFYCRATWHTSELDSETQ

SEQ ID NO: 1290976 - protein, 19 aa, Mycobacterium
DKPFLMPVEDVFTITGRGT

SEQ ID NO: 1290977 - protein, 18 aa, Mycobacterium
DKPYWWGHFDRVNNPVDE

SEQ ID NO: 1290978 - protein, 22 aa, Mycobacterium
DKRSEATISRVLRDLAAAGATI

SEQ ID NO: 1290979 - protein, 18 aa, Mycobacterium
DLALRCVMLLERRGSLKT

SEQ ID NO: 1290980 - protein, 19 aa, Mycobacterium
DLAMARWGIAYAIGPNYNK

SEQ ID NO: 1290981 - protein, 17 aa, Mycobacterium
DLCEGRLSLDQVGVIAE

SEQ ID NO: 1290982 - protein, 20 aa, Mycobacterium
DLEPVLGFEYEFWLFQDRED

SEQ ID NO: 1290983 - protein, 17 aa, Mycobacterium
DLFAGKVTEHFGRPVWT

SEQ ID NO: 1290984 - protein, 23 aa, Mycobacterium
DLFRLPMRVLRAVRQTRRILDEV

SEQ ID NO: 1290985 - protein, 24 aa, Mycobacterium
DLGFRMPSLWFADGHRAVAPVYLY

SEQ ID NO: 1290986 - protein, 23 aa, Mycobacterium
DLGGKMVRFVVCRKGDRHVVAAR

SEQ ID NO: 1290987 - protein, 19 aa, Mycobacterium
DLGLEIFDWLEVVDFGDAY

SEQ ID NO: 1290988 - protein, 17 aa, Mycobacterium
DLHILRGHVPTVDRGRI

SEQ ID NO: 1290989 - protein, 18 aa, Mycobacterium
DLHWPALCRSVGRHDWLT

SEQ ID NO: 1290990 - protein, 18 aa, Mycobacterium
DLIPLRLAIPAQFRAEGD

SEQ ID NO: 1290991 - protein, 20 aa, Mycobacterium
DLLVASLHRWLSACETDARA

SEQ ID NO: 1290992 - protein, 19 aa, Mycobacterium
DLMDLHLFGPAALVRAALP

SEQ ID NO: 1290993 - protein, 18 aa, Mycobacterium
DLQDIIAILGIDELAEED

SEQ ID NO: 1290994 - protein, 21 aa, Mycobacterium
DLQRFPLVYFIDAMLQVDDLD

SEQ ID NO: 1290995 - protein, 21 aa, Mycobacterium
DLRGFKGPRMLLGDLNMSPPT

SEQ ID NO: 1290996 - protein, 20 aa, Mycobacterium
DLRGRITAVLADGERMDAEL

SEQ ID NO: 1290997 - protein, 23 aa, Mycobacterium
DLRVGPHPGWRIEVDDTDVTVHA

SEQ ID NO: 1290998 - protein, 22 aa, Mycobacterium
DMRTELPWLFLAGAGQHPGGGL

SEQ ID NO: 1290999 - protein, 20 aa, Mycobacterium
DMRTLFPLPADRPVDPATDY

SEQ ID NO: 1291000 - protein, 20 aa, Mycobacterium
DNNIACSRWGMLAPDGKCKT

SEQ ID NO: 1291001 - protein, 23 aa, Mycobacterium
DNPALLCYYLFFPAHEESVGDGA

SEQ ID NO: 1291002 - protein, 21 aa, Mycobacterium
DNSELGWRMEVEHDGEWSFFD

SEQ ID NO: 1291003 - protein, 18 aa, Mycobacterium
DNSLMLWFETMKPLMSTS

SEQ ID NO: 1291004 - protein, 22 aa, Mycobacterium
DPAHAVSILRVWAATQPHLHAL

SEQ ID NO: 1291005 - protein, 18 aa, Mycobacterium
DPALLRFAAARTDLSADT

SEQ ID NO: 1291006 - protein, 18 aa, Mycobacterium
DPALLRFAAARTDLSAET

SEQ ID NO: 1291007 - protein, 17 aa, Mycobacterium
DPARFAGLLADRLTRTV

SEQ ID NO: 1291008 - protein, 24 aa, Mycobacterium
DPASGEAFISGWRQVAGSARDASA

SEQ ID NO: 1291009 - protein, 17 aa, Mycobacterium
DPCPLVAACRLRKALSD

SEQ ID NO: 1291010 - protein, 18 aa, Mycobacterium
DPDECVRLAAAVVEQTGG

SEQ ID NO: 1291011 - protein, 23 aa, Mycobacterium
DPDLRFELCLGVSGVHYPDDADR

SEQ ID NO: 1291012 - protein, 18 aa, Mycobacterium
DPERAAGIAARMRVGTVN

SEQ ID NO: 1291013 - protein, 22 aa, Mycobacterium
DPERALECIERYGVTHGQFVPA

SEQ ID NO: 1291014 - protein, 17 aa, Mycobacterium
DPESEWRDLWGKPLDQR

SEQ ID NO: 1291015 - protein, 24 aa, Mycobacterium
DPGESRFYLSLADELMRRFNGATL

SEQ ID NO: 1291016 - protein, 22 aa, Mycobacterium
DPGSVAYLFTRKGVITLEKNDL

SEQ ID NO: 1291017 - protein, 22 aa, Mycobacterium
DPIGRPIFYGRLTEMTDTDFRV

SEQ ID NO: 1291018 - protein, 19 aa, Mycobacterium
DPIRLVWTLFYVAICYAAL

SEQ ID NO: 1291019 - protein, 20 aa, Mycobacterium
DPKVWARLGSELGVLGMSVP

SEQ ID NO: 1291020 - protein, 23 aa, Mycobacterium
DPLLPEVAWSWLVDALNQRAEHV

SEQ ID NO: 1291021 - protein, 19 aa, Mycobacterium
DPLPRTLAWSAAWEMTRDA

SEQ ID NO: 1291022 - protein, 23 aa, Mycobacterium
DPPIWRRIDLRSDVTLDFVHQVL

SEQ ID NO: 1291023 - protein, 18 aa, Mycobacterium
DPQQRLALEVSWEALEHA

SEQ ID NO: 1291024 - protein, 23 aa, Mycobacterium
DPQQRLALEVSWEALEHAGIPPR

SEQ ID NO: 1291025 - protein, 23 aa, Mycobacterium
DPQQRLALEVSWEALEHAGVPPR

SEQ ID NO: 1291026 - protein, 24 aa, Mycobacterium
DPRDRPRFWIAIEPFGNPRIQYTD

SEQ ID NO: 1291027 - protein, 19 aa, Mycobacterium
DPRLRFLRCDLADRTSIES

SEQ ID NO: 1291028 - protein, 19 aa, Mycobacterium
DPRMMVAVLLYGYAVGVCS

SEQ ID NO: 1291029 - protein, 21 aa, Mycobacterium
DPRPGQCLRTFLRDLGHVEVK

SEQ ID NO: 1291030 - protein, 18 aa, Mycobacterium
DPRYLPFRSLRGRDFTSM

SEQ ID NO: 1291031 - protein, 17 aa, Mycobacterium
DPSTGRCYLEWVDPAVG

SEQ ID NO: 1291032 - protein, 19 aa, Mycobacterium
DPTAGPVLDWVRAQLRVPV

SEQ ID NO: 1291033 - protein, 18 aa, Mycobacterium
DPTPSFSAPGRMSSGSSG

SEQ ID NO: 1291034 - protein, 19 aa, Mycobacterium
DPVLAEWFLRRFSLLDSLY

SEQ ID NO: 1291035 - protein, 18 aa, Mycobacterium
DPVYRTAFEWMTDYRREY

SEQ ID NO: 1291036 - protein, 17 aa, Mycobacterium
DQACARATVSLDVAVET

SEQ ID NO: 1291037 - protein, 17 aa, Mycobacterium
DQARAWWGNFLVQKANE

SEQ ID NO: 1291038 - protein, 22 aa, Mycobacterium
DQGIAPGLARWMIVELGPDSET

SEQ ID NO: 1291039 - protein, 24 aa, Mycobacterium
DQGRAHLLYGEWLRRRRRRVDARA

SEQ ID NO: 1291040 - protein, 18 aa, Mycobacterium
DQHLRAAKVLSLAQDTAD

SEQ ID NO: 1291041 - protein, 22 aa, Mycobacterium
DQLMPPYLRFVKGVVDAQDMSL

SEQ ID NO: 1291042 - protein, 17 aa, Mycobacterium
DQRCWLRQLTPYATRDQ

SEQ ID NO: 1291043 - protein, 25 aa, Mycobacterium
DQRLAIADWVYWQHLEVLLTDAVST

SEQ ID NO: 1291044 - protein, 17 aa, Mycobacterium
DRAEFGWEPAVDSWLGE

SEQ ID NO: 1291045 - protein, 18 aa, Mycobacterium
DRALELLEAVGLPEPQMR

SEQ ID NO: 1291046 - protein, 18 aa, Mycobacterium
DRAYCLLALQAPVARDLR

SEQ ID NO: 1291047 - protein, 19 aa, Mycobacterium
DRCRGWRMCVSGCPYKKVY

SEQ ID NO: 1291048 - protein, 23 aa, Mycobacterium
DRDPRLAAAVVYRAWELGAVVYY

SEQ ID NO: 1291049 - protein, 18 aa, Mycobacterium
DREEMRWVLAGDDPAEIL

SEQ ID NO: 1291050 - protein, 22 aa, Mycobacterium
DREFAYGVLRGWLHTLRDRLTV

SEQ ID NO: 1291051 - protein, 18 aa, Mycobacterium
DRFIGLVVIDRGHPRVAD

SEQ ID NO: 1291052 - protein, 20 aa, Mycobacterium
DRFRFLAGFLAGRPVGVAEV

SEQ ID NO: 1291053 - protein, 20 aa, Mycobacterium
DRFRFPYAIDLDGDCVVVAD

SEQ ID NO: 1291054 - protein, 23 aa, Mycobacterium
DRGAALRWFGLDGVEHPAASAPA

SEQ ID NO: 1291055 - protein, 21 aa, Mycobacterium
DRGVSWLPFFHDMGLITVLLP

SEQ ID NO: 1291056 - protein, 21 aa, Mycobacterium
DRHPHCAWTVIIDESYPEVDF

SEQ ID NO: 1291057 - protein, 18 aa, Mycobacterium
DRIGGFKLPKSVDFVDVL

SEQ ID NO: 1291058 - protein, 25 aa, Mycobacterium
DRIGRLEALPGWAWNTFDAQWDRGF

SEQ ID NO: 1291059 - protein, 21 aa, Mycobacterium
DRILECARELFARNGITNTSI

SEQ ID NO: 1291060 - protein, 20 aa, Mycobacterium
DRLGFDEAWFGEHHSGGYEL

SEQ ID NO: 1291061 - protein, 21 aa, Mycobacterium
DRLGFDEAWFGEHHSGGYELI

SEQ ID NO: 1291062 - protein, 20 aa, Mycobacterium
DRLPELWVIVGHMGEMIPFA

SEQ ID NO: 1291063 - protein, 19 aa, Mycobacterium
DRLRLALVLCAVRPDIGGV

SEQ ID NO: 1291064 - protein, 17 aa, Mycobacterium
DRLRQLISWTGDHLAEV

SEQ ID NO: 1291065 - protein, 17 aa, Mycobacterium
DRLRRLVTIGGIGTNVF

SEQ ID NO: 1291066 - protein, 17 aa, Mycobacterium
DRPFGIGLVHWVAEARP

SEQ ID NO: 1291067 - protein, 20 aa, Mycobacterium
DRPIADVCPVEWARMENRSV

SEQ ID NO: 1291068 - protein, 20 aa, Mycobacterium
DRQLLFGAFGEWITRPTAQA

SEQ ID NO: 1291069 - protein, 19 aa, Mycobacterium
DRRAVREVHALWSGLTAYR

SEQ ID NO: 1291070 - protein, 17 aa, Mycobacterium
DRRYVMAISSLDPDDDA

SEQ ID NO: 1291071 - protein, 27 aa, Mycobacterium
DRSAFRWWLTVATLRWGVICRFQAERH

SEQ ID NO: 1291072 - protein, 21 aa, Mycobacterium
DRSRPLWEFYFVEGMADNRFA

SEQ ID NO: 1291073 - protein, 19 aa, Mycobacterium
DRTCVVPGCAATCGLHAHH

SEQ ID NO: 1291074 - protein, 20 aa, Mycobacterium
DRTCVVPGCAATRGLHAHHI

SEQ ID NO: 1291075 - protein, 22 aa, Mycobacterium
DRWFLDEVCTVTWEVHDRIVEP

SEQ ID NO: 1291076 - protein, 20 aa, Mycobacterium
DRWTYRFNLFDTARALDNQV

SEQ ID NO: 1291077 - protein, 23 aa, Mycobacterium
DSAWLAARWERPEMLAVEEHYYY

SEQ ID NO: 1291078 - protein, 21 aa, Mycobacterium
DSDELFAGFALWAESNGTPLY

SEQ ID NO: 1291079 - protein, 21 aa, Mycobacterium
DSEPGRPLWPMVILRTPKGWT

SEQ ID NO: 1291080 - protein, 17 aa, Mycobacterium
DSGYPWPDHLPERVLTD

SEQ ID NO: 1291081 - protein, 19 aa, Mycobacterium
DSKFAIAMVKRWMAGEDVL

SEQ ID NO: 1291082 - protein, 20 aa, Mycobacterium
DSLRVSLDYARISPVIGGTR

SEQ ID NO: 1291083 - protein, 23 aa, Mycobacterium
DSPELPPLWEVFGARLRTDGRWA

SEQ ID NO: 1291084 - protein, 17 aa, Mycobacterium
DSRARWLAAATTVVTGA

SEQ ID NO: 1291085 - protein, 21 aa, Mycobacterium
DSRGRTGIVITELPYQVNHDN

SEQ ID NO: 1291086 - protein, 21 aa, Mycobacterium
DSSSRAAIEFAVRRLRGPFGV

SEQ ID NO: 1291087 - protein, 17 aa, Mycobacterium
DSTRLALLLAVVADGDL

SEQ ID NO: 1291088 - protein, 24 aa, Mycobacterium
DSTRRFSVAVGHRLTPDSEPVLTK

SEQ ID NO: 1291089 - protein, 18 aa, Mycobacterium
DSVLHFFRRALRLRRDRC

SEQ ID NO: 1291090 - protein, 19 aa, Mycobacterium
DSVSCPRSGEIIVRDGAHW

SEQ ID NO: 1291091 - protein, 25 aa, Mycobacterium
DTDCPRLPVRFAWVSAELAMFRGEG

SEQ ID NO: 1291092 - protein, 23 aa, Mycobacterium
DTFGPRCRDVWLVTVGAENVTAE

SEQ ID NO: 1291093 - protein, 18 aa, Mycobacterium
DTFLGPPVGHVWLSPGSM

SEQ ID NO: 1291094 - protein, 24 aa, Mycobacterium
DTGSFRWASARAHRLAARLLEIGV

SEQ ID NO: 1291095 - protein, 19 aa, Mycobacterium
DTHARVGLMPTWGLSVRLP

SEQ ID NO: 1291096 - protein, 18 aa, Mycobacterium
DTLYVRRGVDYVASHRAP

SEQ ID NO: 1291097 - protein, 22 aa, Mycobacterium
DTQLRWRPIDFWPANTTVNIDA

SEQ ID NO: 1291098 - protein, 23 aa, Mycobacterium
DTQLRWRPIDFWPANTTVNIDAS

SEQ ID NO: 1291099 - protein, 17 aa, Mycobacterium
DTVRRWIDDGSLAASAD

SEQ ID NO: 1291100 - protein, 20 aa, Mycobacterium
DVACALDWLLYDWLMAHRDG

SEQ ID NO: 1291101 - protein, 24 aa, Mycobacterium
DVAQWLTAHGWRAEAVPSQDEMRR

SEQ ID NO: 1291102 - protein, 25 aa, Mycobacterium
DVASIRRLRCANGEPLALMTNYLPA

SEQ ID NO: 1291103 - protein, 17 aa, Mycobacterium
DVCNRWAAGRFDTGVFK

SEQ ID NO: 1291104 - protein, 19 aa, Mycobacterium
DVCNRWAAGRFDTGVFKED

SEQ ID NO: 1291105 - protein, 17 aa, Mycobacterium
DVCPVEWARMENRSVLQ

SEQ ID NO: 1291106 - protein, 17 aa, Mycobacterium
DVGCGWGGALRRAVEKY

SEQ ID NO: 1291107 - protein, 23 aa, Mycobacterium
DVGRLRRFAVRFSKMVLPGDDLE

SEQ ID NO: 1291108 - protein, 19 aa, Mycobacterium
DVIGGLLGDLAWDAVLGTL

SEQ ID NO: 1291109 - protein, 19 aa, Mycobacterium
DVLDNLRWLEHETARTFGQ

SEQ ID NO: 1291110 - protein, 22 aa, Mycobacterium
DVLIRIGDEFAIQVRALTELAE

SEQ ID NO: 1291111 - protein, 24 aa, Mycobacterium
DVLPRRPTFALLKGRGNYLCLNKI

SEQ ID NO: 1291112 - protein, 19 aa, Mycobacterium
DVLPYLRWFTFLSADELVE

SEQ ID NO: 1291113 - protein, 20 aa, Mycobacterium
DVPRGIAFLLNRNRLNVAVS

SEQ ID NO: 1291114 - protein, 22 aa, Mycobacterium
DVPWFPKDVDHWSVRWVALHLI

SEQ ID NO: 1291115 - protein, 25 aa, Mycobacterium
DVQWSRPGADPVWFEIHVNPLVDTE

SEQ ID NO: 1291116 - protein, 19 aa, Mycobacterium
DVRASFLPAIYFEGVGMAG

SEQ ID NO: 1291117 - protein, 18 aa, Mycobacterium
DVRGRWIVNAAGLGADAL

SEQ ID NO: 1291118 - protein, 22 aa, Mycobacterium
DVTLRGAVSIARRLQDPLAELV

SEQ ID NO: 1291119 - protein, 21 aa, Mycobacterium
DVVLCAIPARYLTPTSPKKPK

SEQ ID NO: 1291120 - protein, 19 aa, Mycobacterium
DVVNYLRWFTFLEAGELGE

SEQ ID NO: 1291121 - protein, 21 aa, Mycobacterium
DVVWRNGLRLTKLVNTLLDFS

SEQ ID NO: 1291122 - protein, 24 aa, Mycobacterium
DWAEMLMRMYIRWAEQHKYPVEVF

SEQ ID NO: 1291123 - protein, 23 aa, Mycobacterium
DWIYIPKACTWRQVPSEETTLLM

SEQ ID NO: 1291124 - protein, 24 aa, Mycobacterium
DWPVMPVDIVSFWLKPFGFFDRNP

SEQ ID NO: 1291125 - protein, 21 aa, Mycobacterium
DWRPRLERLLADLRRRRDEAA

SEQ ID NO: 1291126 - protein, 22 aa, Mycobacterium
DYHLRMSWNFLSRSTSGIPEWM

SEQ ID NO: 1291127 - protein, 19 aa, Mycobacterium
EAAGLVWLPIGPSLDVAAH

SEQ ID NO: 1291128 - protein, 17 aa, Mycobacterium
EAAIMDVVWRADEAVRV

SEQ ID NO: 1291129 - protein, 18 aa, Mycobacterium
EAARLALWRTCLRPPVPV

SEQ ID NO: 1291130 - protein, 17 aa, Mycobacterium
EAAVALSAVTARFPDAR

SEQ ID NO: 1291131 - protein, 21 aa, Mycobacterium
EADLCTRTELVAALDELETVG

SEQ ID NO: 1291132 - protein, 20 aa, Mycobacterium
EAFDRIPAVVLRRMAWYWAR

SEQ ID NO: 1291133 - protein, 18 aa, Mycobacterium
EAFDRWKGLGARFVEARP

SEQ ID NO: 1291134 - protein, 21 aa, Mycobacterium
EAGGIPIPLGRKGEASDIAEA

SEQ ID NO: 1291135 - protein, 17 aa, Mycobacterium
EAGRRIRDGFVVGEGYA

SEQ ID NO: 1291136 - protein, 18 aa, Mycobacterium
EAGVDCFVAGSAVYSAQD

SEQ ID NO: 1291137 - protein, 17 aa, Mycobacterium
EAIRRRGGIALKPLIAR

SEQ ID NO: 1291138 - protein, 17 aa, Mycobacterium
EALALLRLPLVLPTLQV

SEQ ID NO: 1291139 - protein, 19 aa, Mycobacterium
EALARGWIRRCLIVVPGSL

SEQ ID NO: 1291140 - protein, 22 aa, Mycobacterium
EALKMGFKRVLLMSSGLRGTDI

SEQ ID NO: 1291141 - protein, 23 aa, Mycobacterium
EALQIPVGLAFFFRNSALGRVVA

SEQ ID NO: 1291142 - protein, 23 aa, Mycobacterium
EALRIAPHPGWRVEVDNVAVTLT

SEQ ID NO: 1291143 - protein, 19 aa, Mycobacterium
EAMNHWRPDGGFSLHVFHK

SEQ ID NO: 1291144 - protein, 22 aa, Mycobacterium
EAPECRNFFVGAGFNSVGIATA

SEQ ID NO: 1291145 - protein, 20 aa, Mycobacterium
EAPFSPADIRVWVGHYFDYM

SEQ ID NO: 1291146 - protein, 19 aa, Mycobacterium
EAPWLPGQVQVFIHGEAQA

SEQ ID NO: 1291147 - protein, 18 aa, Mycobacterium
EAQRVIARYSWPRNISQL

SEQ ID NO: 1291148 - protein, 23 aa, Mycobacterium
EASDIAEAIAFLASDRAAWITGS

SEQ ID NO: 1291149 - protein, 17 aa, Mycobacterium
EASRLFLTQMIEHHKGA

SEQ ID NO: 1291150 - protein, 17 aa, Mycobacterium
EASWLPGQVQVFIHGEA

SEQ ID NO: 1291151 - protein, 22 aa, Mycobacterium
EATPTAAAFGGRGGNGGTGGTG

SEQ ID NO: 1291152 - protein, 26 aa, Mycobacterium
EAVGIAAYQCGDWAQALAELRAARRM

SEQ ID NO: 1291153 - protein, 19 aa, Mycobacterium
EAVGPRWRSSWPRVDTVAP

SEQ ID NO: 1291154 - protein, 18 aa, Mycobacterium
EAVLECREALAVNVKPKF

SEQ ID NO: 1291155 - protein, 18 aa, Mycobacterium
EAVLWPLQHPETFQRLGV

SEQ ID NO: 1291156 - protein, 23 aa, Mycobacterium
EAVMLAGLAMKWRWRDRVGDGWK

SEQ ID NO: 1291157 - protein, 17 aa, Mycobacterium
EAWACAFGPGGEAATIA

SEQ ID NO: 1291158 - protein, 20 aa, Mycobacterium
EAWRAGQVEMITWLGELYGL

SEQ ID NO: 1291159 - protein, 20 aa, Mycobacterium
EAYPQVLIRLGWAPADGSAL

SEQ ID NO: 1291160 - protein, 19 aa, Mycobacterium
ECDRRGWTIVGWHADEGVS

SEQ ID NO: 1291161 - protein, 22 aa, Mycobacterium
ECIYRGYRFAVVWPSTNPDAGG

SEQ ID NO: 1291162 - protein, 17 aa, Mycobacterium
ECLKRIGDCLQIYRDIE

SEQ ID NO: 1291163 - protein, 17 aa, Mycobacterium
ECRHITAKWVGRCPDCG

SEQ ID NO: 1291164 - protein, 17 aa, Mycobacterium
ECTYDFEVRAAKYLLAL

SEQ ID NO: 1291165 - protein, 20 aa, Mycobacterium
ECVPASAALQMFLGDPGRPA

SEQ ID NO: 1291166 - protein, 17 aa, Mycobacterium
EDGSFVYEVDWMTGEES

SEQ ID NO: 1291167 - protein, 23 aa, Mycobacterium
EDHGADCPHCWELANPALDDFLH

SEQ ID NO: 1291168 - protein, 18 aa, Mycobacterium
EDKWKFTVQFARTNQPPP

SEQ ID NO: 1291169 - protein, 24 aa, Mycobacterium
EDQEVWRYFASVAFPSESMVRNVI

SEQ ID NO: 1291170 - protein, 18 aa, Mycobacterium
EDRIAKQLVRFAGSDHDL

SEQ ID NO: 1291171 - protein, 18 aa, Mycobacterium
EDRLRTRFEWGLITDVQP

SEQ ID NO: 1291172 - protein, 23 aa, Mycobacterium
EDSGRLLGFHWTKVHSATLGEVY

SEQ ID NO: 1291173 - protein, 17 aa, Mycobacterium
EDVPRTWILTTRDRALS

SEQ ID NO: 1291174 - protein, 21 aa, Mycobacterium
EEFRCGRMFIFIGAEPRTEWL

SEQ ID NO: 1291175 - protein, 20 aa, Mycobacterium
EEGVACYRLFIAGLLDITDN

SEQ ID NO: 1291176 - protein, 20 aa, Mycobacterium
EEICAWIKVRAGAAPLDAHA

SEQ ID NO: 1291177 - protein, 20 aa, Mycobacterium
EEICAWIRMRPGRRALDAAA

SEQ ID NO: 1291178 - protein, 17 aa, Mycobacterium
EELELRVGTSLTDSLSD

SEQ ID NO: 1291179 - protein, 32 aa, Mycobacterium
EELLAESALALPDKEVVSILDLNADVDVAIDA

SEQ ID NO: 1291180 - protein, 18 aa, Mycobacterium
EEMLRWTSPVNVFTRTAT

SEQ ID NO: 1291181 - protein, 20 aa, Mycobacterium
EEPKGTPVFAWKGETLEEYW

SEQ ID NO: 1291182 - protein, 21 aa, Mycobacterium
EEQRHWAALMIERNWGATMVL

SEQ ID NO: 1291183 - protein, 21 aa, Mycobacterium
EEVLRWASPLVHMRRTAVQDV

SEQ ID NO: 1291184 - protein, 22 aa, Mycobacterium
EFAARYYHRFGLAAPALNSIGE

SEQ ID NO: 1291185 - protein, 18 aa, Mycobacterium
EFAEAGWALPLSDDPAGL

SEQ ID NO: 1291186 - protein, 17 aa, Mycobacterium
EFAEHIAPALARVPSRR

SEQ ID NO: 1291187 - protein, 25 aa, Mycobacterium
EFAGAFKPPLSWGIRMTGKKFMREY

SEQ ID NO: 1291188 - protein, 25 aa, Mycobacterium
EFGFDPRGGFGFGPGPRGRRGGGRG

SEQ ID NO: 1291189 - protein, 19 aa, Mycobacterium
EFIGRLPVVASVTNLDKES

SEQ ID NO: 1291190 - protein, 18 aa, Mycobacterium
EFIQRGWGSWGFAPYTDL

SEQ ID NO: 1291191 - protein, 24 aa, Mycobacterium
EFLADYRAHWLVARTAEHIGGWSR

SEQ ID NO: 1291192 - protein, 18 aa, Mycobacterium
EFRLRKNLIHDWFTFPFL

SEQ ID NO: 1291193 - protein, 18 aa, Mycobacterium
EFTDPLAGVRLRFTSERT

SEQ ID NO: 1291194 - protein, 17 aa, Mycobacterium
EFWRAVRDGETWTTAFG

SEQ ID NO: 1291195 - protein, 20 aa, Mycobacterium
EGADWLWKPIATNPVLATNS

SEQ ID NO: 1291196 - protein, 19 aa, Mycobacterium
EGDNVFVALSWSKHPAPQN

SEQ ID NO: 1291197 - protein, 20 aa, Mycobacterium
EGFLPTLLEWCHANGVVFIA

SEQ ID NO: 1291198 - protein, 17 aa, Mycobacterium
EGFTLRTNRTFQEQYLA

SEQ ID NO: 1291199 - protein, 17 aa, Mycobacterium
EGGRFALYMKIHHALVD

SEQ ID NO: 1291200 - protein, 23 aa, Mycobacterium
EGGWIRTWLDTVLDLPWNVTTED

SEQ ID NO: 1291201 - protein, 23 aa, Mycobacterium
EGLAYRLARLFWWEILQINPDQK

SEQ ID NO: 1291202 - protein, 23 aa, Mycobacterium
EGLEAAKPFIAVLCDAQAALAGA

SEQ ID NO: 1291203 - protein, 19 aa, Mycobacterium
EGLLNYLALLGWSIADDHD

SEQ ID NO: 1291204 - protein, 19 aa, Mycobacterium
EGLMSFRWFLADELPEHPA

SEQ ID NO: 1291205 - protein, 21 aa, Mycobacterium
EGMLPRMRRGGSVVAVASIAG

SEQ ID NO: 1291206 - protein, 19 aa, Mycobacterium
EGPARAWEHGRFNAPYLRD

SEQ ID NO: 1291207 - protein, 18 aa, Mycobacterium
EGRIPLGYFDDAEATRRT

SEQ ID NO: 1291208 - protein, 19 aa, Mycobacterium
EGRIPLGYFDDAEATRRTF

SEQ ID NO: 1291209 - protein, 17 aa, Mycobacterium
EGTRPAVELAWLSDIDG

SEQ ID NO: 1291210 - protein, 20 aa, Mycobacterium
EGVPRWRKGSGQGWLTAEYA

SEQ ID NO: 1291211 - protein, 19 aa, Mycobacterium
EGVRLKSGRAFSVQYHPEA

SEQ ID NO: 1291212 - protein, 21 aa, Mycobacterium
EHFNWLEALGFQFERSYYPGK

SEQ ID NO: 1291213 - protein, 21 aa, Mycobacterium
EHFRANVGWRLDGKAKAMVVT

SEQ ID NO: 1291214 - protein, 21 aa, Mycobacterium
EHIPCWLITDIRSFRRYVVGG

SEQ ID NO: 1291215 - protein, 19 aa, Mycobacterium
EHLRLPHYAGFTAYLSQAA

SEQ ID NO: 1291216 - protein, 23 aa, Mycobacterium
EHRRIVLDFCDFLAGKTDRLIRE

SEQ ID NO: 1291217 - protein, 20 aa, Mycobacterium
EHVLPFISIRVWQPISENET

SEQ ID NO: 1291218 - protein, 17 aa, Mycobacterium
EHYGVTMVTGWQEAVDV

SEQ ID NO: 1291219 - protein, 18 aa, Mycobacterium
EIARCLAELVTLDTPTVS

SEQ ID NO: 1291220 - protein, 18 aa, Mycobacterium
EICDGWLPIFYSPRIAAM

SEQ ID NO: 1291221 - protein, 20 aa, Mycobacterium
EIDARLRLLVGRRGGMANQE

SEQ ID NO: 1291222 - protein, 22 aa, Mycobacterium
EIGRAHTPWFHWGTTSMVARAL

SEQ ID NO: 1291223 - protein, 31 aa, Mycobacterium
EIIGNLLPPAVKWKAFFARQAKNPKYLRHGD

SEQ ID NO: 1291224 - protein, 19 aa, Mycobacterium
EIKSRIVAMAAPDEHGNRP

SEQ ID NO: 1291225 - protein, 23 aa, Mycobacterium
EILEYRWGPDWLVWDAQPTSQQY

SEQ ID NO: 1291226 - protein, 20 aa, Mycobacterium
EIQLRMVFGYDMFDDFPAVL

SEQ ID NO: 1291227 - protein, 17 aa, Mycobacterium
EIREFLEGYVIGQDTAK

SEQ ID NO: 1291228 - protein, 20 aa, Mycobacterium
EIRVAVPVTFDLLRGSGQNV

SEQ ID NO: 1291229 - protein, 19 aa, Mycobacterium
EIVSALLAPLGMEHSVLYR

SEQ ID NO: 1291230 - protein, 21 aa, Mycobacterium
EKEAWLSMVMLEWGSCGQLVV

SEQ ID NO: 1291231 - protein, 24 aa, Mycobacterium
EKFLLELGQGFAFVGRQVHLEIGD

SEQ ID NO: 1291232 - protein, 19 aa, Mycobacterium
EKFLLSWLGFDLERAEARP

SEQ ID NO: 1291233 - protein, 18 aa, Mycobacterium
EKGFCAVAAEADWPDAYR

SEQ ID NO: 1291234 - protein, 17 aa, Mycobacterium
EKGRRFLVQSARIAYVE

SEQ ID NO: 1291235 - protein, 24 aa, Mycobacterium
EKLSPWLEFVWKPGYADYYPELPG

SEQ ID NO: 1291236 - protein, 18 aa, Mycobacterium
EKMRVAGRIAAGALAEAG

SEQ ID NO: 1291237 - protein, 17 aa, Mycobacterium
EKMVPISAFLRRNPHLM

SEQ ID NO: 1291238 - protein, 19 aa, Mycobacterium
EKPRGAGVFVVAHSNGCEL

SEQ ID NO: 1291239 - protein, 21 aa, Mycobacterium
EKSLKGANLWNEVKDRLDKPG

SEQ ID NO: 1291240 - protein, 17 aa, Mycobacterium
EKYLGIIDRVRAAIPDA

SEQ ID NO: 1291241 - protein, 20 aa, Mycobacterium
ELAAAAPFDYYPRVVSRSLA

SEQ ID NO: 1291242 - protein, 21 aa, Mycobacterium
ELANYRAHWLVARAAEHIGGW

SEQ ID NO: 1291243 - protein, 19 aa, Mycobacterium
ELAPRLHGVVDRMEGIVTR

SEQ ID NO: 1291244 - protein, 18 aa, Mycobacterium
ELAVQWARYNVRVNALAP

SEQ ID NO: 1291245 - protein, 22 aa, Mycobacterium
ELAYREASGWGHPVQPGLALLR

SEQ ID NO: 1291246 - protein, 21 aa, Mycobacterium
ELCARCHVTLIGLVHFGKRES

SEQ ID NO: 1291247 - protein, 21 aa, Mycobacterium
ELCGILARYDVTFSLGDGLRP

SEQ ID NO: 1291248 - protein, 23 aa, Mycobacterium
ELCSFPLRQCGSGNLFGGNEPAR

SEQ ID NO: 1291249 - protein, 23 aa, Mycobacterium
ELDGLRLITWRGAARADQGMSFA

SEQ ID NO: 1291250 - protein, 19 aa, Mycobacterium
ELDRGAAVLLALLDRGLGL

SEQ ID NO: 1291251 - protein, 17 aa, Mycobacterium
ELDRLRLAGARSAAVNA

SEQ ID NO: 1291252 - protein, 17 aa, Mycobacterium
ELEAAIMDVVWRADEAV

SEQ ID NO: 1291253 - protein, 19 aa, Mycobacterium
ELGCVAALKTLEISSRPEV

SEQ ID NO: 1291254 - protein, 20 aa, Mycobacterium
ELGQPLPLFIKWDDADYGLR

SEQ ID NO: 1291255 - protein, 18 aa, Mycobacterium
ELIETHLLFGVDYDRIDV

SEQ ID NO: 1291256 - protein, 18 aa, Mycobacterium
ELIGPALEDWAKWGQARH

SEQ ID NO: 1291257 - protein, 19 aa, Mycobacterium
ELIKPAAVEVFERYGVFSE

SEQ ID NO: 1291258 - protein, 19 aa, Mycobacterium
ELIRRAVVVKAEVVAADEK

SEQ ID NO: 1291259 - protein, 18 aa, Mycobacterium
ELIWRCGRPPPGVVVRNE

SEQ ID NO: 1291260 - protein, 20 aa, Mycobacterium
ELKALCRGCPRRWQCAKDAL

SEQ ID NO: 1291261 - protein, 24 aa, Mycobacterium
ELLAAGVEECRRAGWGVHTHLAEV

SEQ ID NO: 1291262 - protein, 18 aa, Mycobacterium
ELLAGFWSLVEQLQISAM

SEQ ID NO: 1291263 - protein, 19 aa, Mycobacterium
ELLAGFWSLVEQLRISAMS

SEQ ID NO: 1291264 - protein, 19 aa, Mycobacterium
ELLARLAATVQYVPMPSWL

SEQ ID NO: 1291265 - protein, 18 aa, Mycobacterium
ELLMLGWGSSYGPIGEAC

SEQ ID NO: 1291266 - protein, 23 aa, Mycobacterium
ELLNRWPEWNIDYDTARLAPTST

SEQ ID NO: 1291267 - protein, 19 aa, Mycobacterium
ELLPVPGLPEFRPGDNLSA

SEQ ID NO: 1291268 - protein, 18 aa, Mycobacterium
ELLWSFAPPDRVTRVRPA

SEQ ID NO: 1291269 - protein, 28 aa, Mycobacterium
ELMHASRVYGCIDWCVGMFKTPSGPQAW

SEQ ID NO: 1291270 - protein, 18 aa, Mycobacterium
ELMPDVLHWLGIRKIHRF

SEQ ID NO: 1291271 - protein, 20 aa, Mycobacterium
ELMPLPIALAHRLSRKLTEV

SEQ ID NO: 1291272 - protein, 21 aa, Mycobacterium
ELNPRLQTFRDWLAGHRDEIE

SEQ ID NO: 1291273 - protein, 22 aa, Mycobacterium
ELPAAALWWRISGALSPTATLA

SEQ ID NO: 1291274 - protein, 25 aa, Mycobacterium
ELPGWYRPNPGLARDLAFIGFSTIS

SEQ ID NO: 1291275 - protein, 21 aa, Mycobacterium
ELPRGLPPVRLIAGAQLDGWQ

SEQ ID NO: 1291276 - protein, 19 aa, Mycobacterium
ELQAAFALSPWAARTPIDV

SEQ ID NO: 1291277 - protein, 17 aa, Mycobacterium
ELQALLLDWGFAPMTVG

SEQ ID NO: 1291278 - protein, 17 aa, Mycobacterium
ELRAAVSDTEWRRVDVV

SEQ ID NO: 1291279 - protein, 19 aa, Mycobacterium
ELRDLAGRVAVWADRFTAP

SEQ ID NO: 1291280 - protein, 20 aa, Mycobacterium
ELRRLKSLLRRSGRVLQSGP

SEQ ID NO: 1291281 - protein, 20 aa, Mycobacterium
ELRSLLRFLFVRGLTPRLLT

SEQ ID NO: 1291282 - protein, 18 aa, Mycobacterium
ELRTLFLFEALTDEQLAT

SEQ ID NO: 1291283 - protein, 17 aa, Mycobacterium
ELRTSWRNPPEVLHLAN

SEQ ID NO: 1291284 - protein, 19 aa, Mycobacterium
ELSVGGWAARVDHIVDVSE

SEQ ID NO: 1291285 - protein, 25 aa, Mycobacterium
ELVDFWRFNVAFARQILAQQPLNSK

SEQ ID NO: 1291286 - protein, 19 aa, Mycobacterium
ELVKTAAFVKVFQRTPGWV

SEQ ID NO: 1291287 - protein, 17 aa, Mycobacterium
ELVSVPGAEVIRLDITD

SEQ ID NO: 1291288 - protein, 20 aa, Mycobacterium
ELVVLLAWRVLTGVELAGTN

SEQ ID NO: 1291289 - protein, 20 aa, Mycobacterium
ELVVSLGYRCQVATKAVKGR

SEQ ID NO: 1291290 - protein, 19 aa, Mycobacterium
ELYEIRTLFGVMFQDGALF

SEQ ID NO: 1291291 - protein, 18 aa, Mycobacterium
ELYFPGSPVLSVHGTFGE

SEQ ID NO: 1291292 - protein, 21 aa, Mycobacterium
EMAAELATVWARVRDDDDIRV

SEQ ID NO: 1291293 - protein, 18 aa, Mycobacterium
EMCRRAGAEVARVEQEWR

SEQ ID NO: 1291294 - protein, 22 aa, Mycobacterium
EMDNLRAAFAWSRENANTDHSL

SEQ ID NO: 1291295 - protein, 19 aa, Mycobacterium
EMFNDILPAHIVKDVPGGF

SEQ ID NO: 1291296 - protein, 18 aa, Mycobacterium
EMFTKLGGLMAERVTDLR

SEQ ID NO: 1291297 - protein, 19 aa, Mycobacterium
EMLRLVEAFGYGWSDLERF

SEQ ID NO: 1291298 - protein, 18 aa, Mycobacterium
EMLTTLFGDQPRLQAPGA

SEQ ID NO: 1291299 - protein, 19 aa, Mycobacterium
EMSDRLVGHGALPIEVPTI

SEQ ID NO: 1291300 - protein, 17 aa, Mycobacterium
ENLRTGAPIQLSAAVVA

SEQ ID NO: 1291301 - protein, 17 aa, Mycobacterium
ENLSARCLLSLAISYIA

SEQ ID NO: 1291302 - protein, 24 aa, Mycobacterium
ENSMPWRLVARLLLVRAYAALGDT

SEQ ID NO: 1291303 - protein, 23 aa, Mycobacterium
ENSVCLNCGSALGFSLDDMALLV

SEQ ID NO: 1291304 - protein, 18 aa, Mycobacterium
ENTFAYPSIEVFKKSGLG

SEQ ID NO: 1291305 - protein, 17 aa, Mycobacterium
ENTRFWAPLSLTAEQKH

SEQ ID NO: 1291306 - protein, 19 aa, Mycobacterium
EPAAVWALAGSARRETAVE

SEQ ID NO: 1291307 - protein, 20 aa, Mycobacterium
EPAWAYGRVALQWAERYYAA

SEQ ID NO: 1291308 - protein, 24 aa, Mycobacterium
EPEPLRWLGVRGMYLAYKAADWHE

SEQ ID NO: 1291309 - protein, 21 aa, Mycobacterium
EPEVGLACRVVWEGDTIVTLQ

SEQ ID NO: 1291310 - protein, 19 aa, Mycobacterium
EPFRLVPPADQWESDAASV

SEQ ID NO: 1291311 - protein, 21 aa, Mycobacterium
EPGRAHAYLRLGGQEPVVETV

SEQ ID NO: 1291312 - protein, 17 aa, Mycobacterium
EPLRAGVVRAWREQLGG

SEQ ID NO: 1291313 - protein, 19 aa, Mycobacterium
EPNMRWRTFCAELLAIAEK

SEQ ID NO: 1291314 - protein, 23 aa, Mycobacterium
EPRAWRLAVELSREGDQIKMSKV

SEQ ID NO: 1291315 - protein, 23 aa, Mycobacterium
EPTRIGFRFAPCGSGGRSLDARI

SEQ ID NO: 1291316 - protein, 19 aa, Mycobacterium
EPWRSKYFLTRKVGEQIYY

SEQ ID NO: 1291317 - protein, 18 aa, Mycobacterium
EQDWRARIALRQKQIGER

SEQ ID NO: 1291318 - protein, 19 aa, Mycobacterium
EQELLAAKFMGRWRSGAPL

SEQ ID NO: 1291319 - protein, 22 aa, Mycobacterium
EQIEALRLVLERGWTAQRAAER

SEQ ID NO: 1291320 - protein, 23 aa, Mycobacterium
EQQLKHAIEWCDRATEHISGAKE

SEQ ID NO: 1291321 - protein, 20 aa, Mycobacterium
EQRAAGTLQVWLEPYTELRA

SEQ ID NO: 1291322 - protein, 18 aa, Mycobacterium
EQRVFFGWAQVWRTKSRE

SEQ ID NO: 1291323 - protein, 17 aa, Mycobacterium
ERADWWWYTPFQPPPPT

SEQ ID NO: 1291324 - protein, 18 aa, Mycobacterium
ERAFEVLDKLQIVDISNN

SEQ ID NO: 1291325 - protein, 19 aa, Mycobacterium
ERARRAGAVGLIITTDWSF

SEQ ID NO: 1291326 - protein, 25 aa, Mycobacterium
ERCRRLEALPGWSWNLAEARWEENF

SEQ ID NO: 1291327 - protein, 23 aa, Mycobacterium
ERDRPLLELSWDYVMDGDEPSGE

SEQ ID NO: 1291328 - protein, 18 aa, Mycobacterium
EREVAPCPAVRGADAEAY

SEQ ID NO: 1291329 - protein, 17 aa, Mycobacterium
ERGWVCLSIDYRVAPHN

SEQ ID NO: 1291330 - protein, 22 aa, Mycobacterium
ERHGFPHWVIWDEAHLLGRQRE

SEQ ID NO: 1291331 - protein, 17 aa, Mycobacterium
ERIELFVKILLRGGRPA

SEQ ID NO: 1291332 - protein, 17 aa, Mycobacterium
ERIGQLRGAGWVAHVPM

SEQ ID NO: 1291333 - protein, 19 aa, Mycobacterium
ERIMLCAKLAHVFGMLHRA

SEQ ID NO: 1291334 - protein, 17 aa, Mycobacterium
ERIPRAIGFSGSPSDPD

SEQ ID NO: 1291335 - protein, 23 aa, Mycobacterium
ERISAREAYDWGLVSSVHPAEEF

SEQ ID NO: 1291336 - protein, 25 aa, Mycobacterium
ERLGLRTVWLSERWGTKDLGVIAGA

SEQ ID NO: 1291337 - protein, 22 aa, Mycobacterium
ERLRALPLAPFRDSYAYTNFGL

SEQ ID NO: 1291338 - protein, 17 aa, Mycobacterium
ERLRRIAVFDVLVNNAD

SEQ ID NO: 1291339 - protein, 22 aa, Mycobacterium
ERMHRSCLILTFGGGTNEIQRD

SEQ ID NO: 1291340 - protein, 20 aa, Mycobacterium
ERPSRLLVPLARQTRRHPTS

SEQ ID NO: 1291341 - protein, 22 aa, Mycobacterium
ERSRLMLDIAQWRRRRRDELAA

SEQ ID NO: 1291342 - protein, 25 aa, Mycobacterium
ERTPEDWLFKACVGDDFVIDVLHAL

SEQ ID NO: 1291343 - protein, 18 aa, Mycobacterium
ERWDFRAGGGYRYVHSDE

SEQ ID NO: 1291344 - protein, 17 aa, Mycobacterium
ERWGFHHLGSFAVEYRK

SEQ ID NO: 1291345 - protein, 17 aa, Mycobacterium
ERWWLDRMVSVIASSAG

SEQ ID NO: 1291346 - protein, 18 aa, Mycobacterium
ERYVREWLGGMVAGRIVD

SEQ ID NO: 1291347 - protein, 20 aa, Mycobacterium
ESAMPPSVWSYVVGGAGDEH

SEQ ID NO: 1291348 - protein, 17 aa, Mycobacterium
ESARLLALESFEILDTV

SEQ ID NO: 1291349 - protein, 29 aa, Mycobacterium
ESFFRGAGWNVIKVVWGREWDALLHADRD

SEQ ID NO: 1291350 - protein, 20 aa, Mycobacterium
ESFRLLFDIHVMGAFNVTQA

SEQ ID NO: 1291351 - protein, 18 aa, Mycobacterium
ESGIKVARKWGVDVKGVK

SEQ ID NO: 1291352 - protein, 26 aa, Mycobacterium
ESLYEYGSRAGLWRVLRVFERHDIPL

SEQ ID NO: 1291353 - protein, 17 aa, Mycobacterium
ESMRLLAEEVMPRLNAR

SEQ ID NO: 1291354 - protein, 17 aa, Mycobacterium
ESPGADVLFAFTGTAAN

SEQ ID NO: 1291355 - protein, 24 aa, Mycobacterium
ESPKETWLRLVIIRAGFPRPETQV

SEQ ID NO: 1291356 - protein, 19 aa, Mycobacterium
ESRAVVGYDRCFMAQKGES

SEQ ID NO: 1291357 - protein, 22 aa, Mycobacterium
ESRGLGVSLCFAAQAGEQLDAI

SEQ ID NO: 1291358 - protein, 27 aa, Mycobacterium
ESRLTFLAVRRWYGWSAGRIINIDIGG

SEQ ID NO: 1291359 - protein, 18 aa, Mycobacterium
ESSIALDMLLDFMPRYGV

SEQ ID NO: 1291360 - protein, 17 aa, Mycobacterium
ESVCGYCYQAAKRITGI

SEQ ID NO: 1291361 - protein, 18 aa, Mycobacterium
ETGCRIVLPEGWNPFVTL

SEQ ID NO: 1291362 - protein, 19 aa, Mycobacterium
ETIDWARTLAVLGVDELSA

SEQ ID NO: 1291363 - protein, 18 aa, Mycobacterium
ETLLPWLKFRGHGLGMFI

SEQ ID NO: 1291364 - protein, 23 aa, Mycobacterium
ETNVEFWAAVILDFAQVPASMMP

SEQ ID NO: 1291365 - protein, 20 aa, Mycobacterium
ETNVEFWAAVILDFAQVPPK

SEQ ID NO: 1291366 - protein, 18 aa, Mycobacterium
ETPRPEYLAARTSQPFSA

SEQ ID NO: 1291367 - protein, 18 aa, Mycobacterium
ETRLQWYVDLGINRDNLR

SEQ ID NO: 1291368 - protein, 23 aa, Mycobacterium
ETTDRLAVLPAWRETDYFTPAER

SEQ ID NO: 1291369 - protein, 18 aa, Mycobacterium
ETWLRLLLMKDFPRPTTQ

SEQ ID NO: 1291370 - protein, 24 aa, Mycobacterium
EVAPWLDLVRKLGLLVGVLSSEPP

SEQ ID NO: 1291371 - protein, 24 aa, Mycobacterium
EVDGHPSIRCQLELTAGTDQPVDS

SEQ ID NO: 1291372 - protein, 20 aa, Mycobacterium
EVGLKHPIKLIANALGSPPK

SEQ ID NO: 1291373 - protein, 22 aa, Mycobacterium
EVGPRVAARFGRALLELGGNNA

SEQ ID NO: 1291374 - protein, 24 aa, Mycobacterium
EVIARLPFVPSILEWLHAGRTSVV

SEQ ID NO: 1291375 - protein, 23 aa, Mycobacterium
EVKKAVAEYGLWYPPDPSSFEIC

SEQ ID NO: 1291376 - protein, 19 aa, Mycobacterium
EVLPRPGVDLQMINAIARR

SEQ ID NO: 1291377 - protein, 20 aa, Mycobacterium
EVLTDLRLLGPRIAEAAAGP

SEQ ID NO: 1291378 - protein, 26 aa, Mycobacterium
EVMAGFGRSGKWFSINHFDVVPDLLT

SEQ ID NO: 1291379 - protein, 26 aa, Mycobacterium
EVMAGFGRTGTWFAIENFDVVPDLIT

SEQ ID NO: 1291380 - protein, 21 aa, Mycobacterium
EVPELAVPLVFRLLGETGSHA

SEQ ID NO: 1291381 - protein, 22 aa, Mycobacterium
EVPLKRFDLMNGIQVRGTYAVS

SEQ ID NO: 1291382 - protein, 23 aa, Mycobacterium
EVPLKRFDLMNGIQVRGTYAVTQ

SEQ ID NO: 1291383 - protein, 22 aa, Mycobacterium
EVPLKRFDLMNGIQVRGTYTVS

SEQ ID NO: 1291384 - protein, 20 aa, Mycobacterium
EVQLDQCWDLLRQRRALRDS

SEQ ID NO: 1291385 - protein, 19 aa, Mycobacterium
EVRPWIWKTMESFPGSYMT

SEQ ID NO: 1291386 - protein, 18 aa, Mycobacterium
EVRRGDPTYPGWETLGPT

SEQ ID NO: 1291387 - protein, 22 aa, Mycobacterium
EVRWCPGCGDYVILNTIRNFLP

SEQ ID NO: 1291388 - protein, 24 aa, Mycobacterium
EVTYGAEFFRWFAEEAVRIEGRYT

SEQ ID NO: 1291389 - protein, 17 aa, Mycobacterium
EVVKWWLPDDVVFVDEL

SEQ ID NO: 1291390 - protein, 20 aa, Mycobacterium
EVVNWPRRRLVLSRTANGYS

SEQ ID NO: 1291391 - protein, 18 aa, Mycobacterium
EVVRRSGVDPADIDDIIF

SEQ ID NO: 1291392 - protein, 18 aa, Mycobacterium
EVYLCGGNGFVQAVRAQL

SEQ ID NO: 1291393 - protein, 22 aa, Mycobacterium
EVYPHPATVVLFDLEKTLKYKR

SEQ ID NO: 1291394 - protein, 23 aa, Mycobacterium
EVYRAPMAYPYRWPSGPQHCAEE

SEQ ID NO: 1291395 - protein, 19 aa, Mycobacterium
EWDEFKAHLIAAIEDSGVG

SEQ ID NO: 1291396 - protein, 22 aa, Mycobacterium
EWFEARWTDRFSLPITAEIIQL

SEQ ID NO: 1291397 - protein, 19 aa, Mycobacterium
EWLRFGWYFLISRRDPAGF

SEQ ID NO: 1291398 - protein, 23 aa, Mycobacterium
EWQRLLFDNGWLLPAQPPEFGGR

SEQ ID NO: 1291399 - protein, 21 aa, Mycobacterium
EWRTEIGWPVFRLAPVTEGWP

SEQ ID NO: 1291400 - protein, 27 aa, Mycobacterium
EWTEPTWLPARWPVLLCNGAVGIAEGW

SEQ ID NO: 1291401 - protein, 17 aa, Mycobacterium
EYARRLAGWTGWNDEGQ

SEQ ID NO: 1291402 - protein, 18 aa, Mycobacterium
EYDRLGLPAADWQILLDV

SEQ ID NO: 1291403 - protein, 24 aa, Mycobacterium
EYGISWILPRIVGWSAAQDLLLSG

SEQ ID NO: 1291404 - protein, 18 aa, Mycobacterium
EYLEPRWMIGIDPESEGL

SEQ ID NO: 1291405 - protein, 19 aa, Mycobacterium
EYRNGGLLLDHGVLRLRDP

SEQ ID NO: 1291406 - protein, 22 aa, Mycobacterium
EYWWAAEQMLTWEGKPANMILD

SEQ ID NO: 1291407 - protein, 18 aa, Mycobacterium
FAAALGRLGADVQTGVFG

SEQ ID NO: 1291408 - protein, 20 aa, Mycobacterium
FAADCLSEWIELATVDKRHP

SEQ ID NO: 1291409 - protein, 18 aa, Mycobacterium
FAAGRLSYFLGVRGPAVV

SEQ ID NO: 1291410 - protein, 20 aa, Mycobacterium
FAAGRLSYFLGVRGPAVVSD

SEQ ID NO: 1291411 - protein, 18 aa, Mycobacterium
FAARGFRTMDRWWEATAS

SEQ ID NO: 1291412 - protein, 17 aa, Mycobacterium
FAARKGAQCAFEREIEH

SEQ ID NO: 1291413 - protein, 20 aa, Mycobacterium
FAASPFRWLTWLSDSRASLT

SEQ ID NO: 1291414 - protein, 17 aa, Mycobacterium
FADGVVLWMASVSAIAA

SEQ ID NO: 1291415 - protein, 18 aa, Mycobacterium
FADRFAHFDFHDHMLRPS

SEQ ID NO: 1291416 - protein, 17 aa, Mycobacterium
FAEQYAKLRAHKGVTVE

SEQ ID NO: 1291417 - protein, 19 aa, Mycobacterium
FAERFGVTVVDGFGSSEGG

SEQ ID NO: 1291418 - protein, 22 aa, Mycobacterium
FAGAGFRTGFVVARNPESGHAL

SEQ ID NO: 1291419 - protein, 17 aa, Mycobacterium
FAGCPICHLHLRSFATR

SEQ ID NO: 1291420 - protein, 18 aa, Mycobacterium
FAGIDPWRSPAGPVPEYP

SEQ ID NO: 1291421 - protein, 20 aa, Mycobacterium
FAHDGCGPWNAKLPTPTATR

SEQ ID NO: 1291422 - protein, 17 aa, Mycobacterium
FAIPNLCRRGVCGECRV

SEQ ID NO: 1291423 - protein, 17 aa, Mycobacterium
FAKELAMSFPAHTTAME

SEQ ID NO: 1291424 - protein, 17 aa, Mycobacterium
FALGRAVDYVKTRQVWK

SEQ ID NO: 1291425 - protein, 19 aa, Mycobacterium
FALLARRRMDLYGATVDDF

SEQ ID NO: 1291426 - protein, 20 aa, Mycobacterium
FALLARRRMDLYGATVDDFA

SEQ ID NO: 1291427 - protein, 17 aa, Mycobacterium
FALLASRGVPLAFGSDT

SEQ ID NO: 1291428 - protein, 19 aa, Mycobacterium
FALPFPIAVASAWLGLSED

SEQ ID NO: 1291429 - protein, 20 aa, Mycobacterium
FAMGLARGYSLAVVEGSTPL

SEQ ID NO: 1291430 - protein, 18 aa, Mycobacterium
FAPLRLPPDLDFAALFHG

SEQ ID NO: 1291431 - protein, 17 aa, Mycobacterium
FAPMPFKPVAREGKPGL

SEQ ID NO: 1291432 - protein, 19 aa, Mycobacterium
FAPRCPLAIDECDAAEPDL

SEQ ID NO: 1291433 - protein, 17 aa, Mycobacterium
FAPVRPGREQWLIELME

SEQ ID NO: 1291434 - protein, 17 aa, Mycobacterium
FARERSRWIFSNPDMIH

SEQ ID NO: 1291435 - protein, 24 aa, Mycobacterium
FARLRAGDGLSWHAPFPSLFPMEE

SEQ ID NO: 1291436 - protein, 21 aa, Mycobacterium
FARRFGVVVVDGFGSTEGGVA

SEQ ID NO: 1291437 - protein, 17 aa, Mycobacterium
FASLVFYSSWFKLHHPA

SEQ ID NO: 1291438 - protein, 17 aa, Mycobacterium
FATEFGLPIIEVVRPVA

SEQ ID NO: 1291439 - protein, 17 aa, Mycobacterium
FATGWRIKFAYRTFPWT

SEQ ID NO: 1291440 - protein, 18 aa, Mycobacterium
FATITSWSIFGLGELGWP

SEQ ID NO: 1291441 - protein, 21 aa, Mycobacterium
FATKTKLEWERELSAQDVGCV

SEQ ID NO: 1291442 - protein, 17 aa, Mycobacterium
FAVGPFASMLDRARDAI

SEQ ID NO: 1291443 - protein, 17 aa, Mycobacterium
FAWQVALAMIRRAGGAV

SEQ ID NO: 1291444 - protein, 19 aa, Mycobacterium
FDAQGRYGLVSGSAKAAFS

SEQ ID NO: 1291445 - protein, 20 aa, Mycobacterium
FDAVVCSLVLCSVDDPDGVL

SEQ ID NO: 1291446 - protein, 19 aa, Mycobacterium
FDCVWEYSEPLAPRNNASE

SEQ ID NO: 1291447 - protein, 27 aa, Mycobacterium
FDFTISRLKSGIFLGTRWGEPGASMVP

SEQ ID NO: 1291448 - protein, 18 aa, Mycobacterium
FDGLRLAGRPVRRPDLTI

SEQ ID NO: 1291449 - protein, 18 aa, Mycobacterium
FDGRIITMPFSFKEIDSE

SEQ ID NO: 1291450 - protein, 18 aa, Mycobacterium
FDGRIITVPFSFKEIDDE

SEQ ID NO: 1291451 - protein, 23 aa, Mycobacterium
FDGRKAVVFDDRWASAREDLVKI

SEQ ID NO: 1291452 - protein, 24 aa, Mycobacterium
FDICGRARARVCADIAELVGRPVT

SEQ ID NO: 1291453 - protein, 18 aa, Mycobacterium
FDIDPCYIFHVANAHDDG

SEQ ID NO: 1291454 - protein, 18 aa, Mycobacterium
FDIPAGTAIRFEPGVAQH

SEQ ID NO: 1291455 - protein, 21 aa, Mycobacterium
FDIPNEFVVGYGLDYAERYRD

SEQ ID NO: 1291456 - protein, 18 aa, Mycobacterium
FDLARLGDWRDRITSFPA

SEQ ID NO: 1291457 - protein, 17 aa, Mycobacterium
FDLCTLPLNLAGHCGMS

SEQ ID NO: 1291458 - protein, 24 aa, Mycobacterium
FDLYSCFPFPVFVICEALGLSADD

SEQ ID NO: 1291459 - protein, 20 aa, Mycobacterium
FDPLIFFRPRVERLFGGFHY

SEQ ID NO: 1291460 - protein, 24 aa, Mycobacterium
FDRGDIDAGYSWLPTLDQLRRNGK

SEQ ID NO: 1291461 - protein, 18 aa, Mycobacterium
FDVLRRWLTAKGFDVAFI

SEQ ID NO: 1291462 - protein, 20 aa, Mycobacterium
FDYYPLRVVRELADGACEAA

SEQ ID NO: 1291463 - protein, 17 aa, Mycobacterium
FEALAGFRPVARTVDLM

SEQ ID NO: 1291464 - protein, 19 aa, Mycobacterium
FEDILAFWFDRGVDGFRID

SEQ ID NO: 1291465 - protein, 20 aa, Mycobacterium
FEFRAGPVFTNLMLADEINR

SEQ ID NO: 1291466 - protein, 19 aa, Mycobacterium
FEFWREFLASLKARGLSGV

SEQ ID NO: 1291467 - protein, 18 aa, Mycobacterium
FEGGPLLRFMSGNLSQQI

SEQ ID NO: 1291468 - protein, 20 aa, Mycobacterium
FEIKDTWFAMGLKGTGSQDI

SEQ ID NO: 1291469 - protein, 21 aa, Mycobacterium
FEIPGLPPIMLPWPPPPPPPA

SEQ ID NO: 1291470 - protein, 19 aa, Mycobacterium
FEKTRCVLHPLPAADNPSA

SEQ ID NO: 1291471 - protein, 20 aa, Mycobacterium
FEPKPDWTHMWSFQPEIQDY

SEQ ID NO: 1291472 - protein, 20 aa, Mycobacterium
FERLCKQIPLAAPWTAAAAH

SEQ ID NO: 1291473 - protein, 19 aa, Mycobacterium
FEVVTAMAFAAFADAPVDV

SEQ ID NO: 1291474 - protein, 21 aa, Mycobacterium
FFRPRVERLFGGFHYRIEIYT

SEQ ID NO: 1291475 - protein, 18 aa, Mycobacterium
FFVCSTHDWILFFTTQGR

SEQ ID NO: 1291476 - protein, 19 aa, Mycobacterium
FGADLPPLAGIYLAAFGGG

SEQ ID NO: 1291477 - protein, 23 aa, Mycobacterium
FGAELLAALGLHRVWDRADAVMS

SEQ ID NO: 1291478 - protein, 22 aa, Mycobacterium
FGAGGWPRGWLSPGMNQTDESL

SEQ ID NO: 1291479 - protein, 17 aa, Mycobacterium
FGDPSWRRLFFEARTSD

SEQ ID NO: 1291480 - protein, 17 aa, Mycobacterium
FGDRLARLFKAGVPVKE

SEQ ID NO: 1291481 - protein, 18 aa, Mycobacterium
FGELTARLYALEALLARG

SEQ ID NO: 1291482 - protein, 21 aa, Mycobacterium
FGERGRPGFLFDRLAADGTVH

SEQ ID NO: 1291483 - protein, 29 aa, Mycobacterium
FGGAGFRTGLKWRLCRAAPGEDKYVICNA

SEQ ID NO: 1291484 - protein, 23 aa, Mycobacterium
FGGFRGFCELAGYEYSSIEFDYG

SEQ ID NO: 1291485 - protein, 19 aa, Mycobacterium
FGGVWYWNRFPGIQCDNDA

SEQ ID NO: 1291486 - protein, 17 aa, Mycobacterium
FGIRIAIAVLRAGVGDS

SEQ ID NO: 1291487 - protein, 17 aa, Mycobacterium
FGLAAGKPVMGWLFQRF

SEQ ID NO: 1291488 - protein, 19 aa, Mycobacterium
FGLDAGEFMTLLSQGLEGG

SEQ ID NO: 1291489 - protein, 17 aa, Mycobacterium
FGLDAGERIAKLLSDSG

SEQ ID NO: 1291490 - protein, 17 aa, Mycobacterium
FGMCLRAFVVPAAGADI

SEQ ID NO: 1291491 - protein, 23 aa, Mycobacterium
FGNVLRFLPPLAISDELLLEGLD

SEQ ID NO: 1291492 - protein, 17 aa, Mycobacterium
FGPSWAWPKPVQAHIPV

SEQ ID NO: 1291493 - protein, 23 aa, Mycobacterium
FGSRGGLLGQVWLRAARRFLSEQ

SEQ ID NO: 1291494 - protein, 19 aa, Mycobacterium
FGTDLPPLGGIYLAAFGGG

SEQ ID NO: 1291495 - protein, 19 aa, Mycobacterium
FGTPGFRAWAAHARGAVAV

SEQ ID NO: 1291496 - protein, 17 aa, Mycobacterium
FGTSRWSSKLVHGGLRY

SEQ ID NO: 1291497 - protein, 19 aa, Mycobacterium
FGVRLAVVPTVRWARIGDA

SEQ ID NO: 1291498 - protein, 17 aa, Mycobacterium
FGVRVLVIRPGQVRTTT

SEQ ID NO: 1291499 - protein, 19 aa, Mycobacterium
FGWLYEWGAPVTLIGESPD

SEQ ID NO: 1291500 - protein, 23 aa, Mycobacterium
FHRDMPSRFAVVPRRGDTSQIKW

SEQ ID NO: 1291501 - protein, 19 aa, Mycobacterium
FIAGGAIEIGGRLPINTHG

SEQ ID NO: 1291502 - protein, 18 aa, Mycobacterium
FIDAGAEWRQAGCSMCLG

SEQ ID NO: 1291503 - protein, 18 aa, Mycobacterium
FIGPRPAGWWIRRRVHET

SEQ ID NO: 1291504 - protein, 26 aa, Mycobacterium
FIPACGRCTECARGRSNLCVYGAAIV

SEQ ID NO: 1291505 - protein, 22 aa, Mycobacterium
FIVAQLLRLGRLGSFDFNSRFY

SEQ ID NO: 1291506 - protein, 19 aa, Mycobacterium
FKDRMGWDLPWVSSGRTTF

SEQ ID NO: 1291507 - protein, 17 aa, Mycobacterium
FKSRGAFRVPVPPEFGP

SEQ ID NO: 1291508 - protein, 24 aa, Mycobacterium
FKVRGPESFSAPVLPAAPSPVPAS

SEQ ID NO: 1291509 - protein, 17 aa, Mycobacterium
FKVSLSIGVMKMVRSDI

SEQ ID NO: 1291510 - protein, 18 aa, Mycobacterium
FKYPGIRSDSDMFTLGFR

SEQ ID NO: 1291511 - protein, 23 aa, Mycobacterium
FLAWEPFTRMAFRFNESSTGSIS

SEQ ID NO: 1291512 - protein, 20 aa, Mycobacterium
FLCAAHMWLGASAINADNPS

SEQ ID NO: 1291513 - protein, 20 aa, Mycobacterium
FLDREGWDALTINALANQLG

SEQ ID NO: 1291514 - protein, 17 aa, Mycobacterium
FLDRVGVGAPEVEQDII

SEQ ID NO: 1291515 - protein, 18 aa, Mycobacterium
FLHKELYREYSLRPPKGV

SEQ ID NO: 1291516 - protein, 24 aa, Mycobacterium
FLHPLPVRRLWGVGAKTADKLRVH

SEQ ID NO: 1291517 - protein, 21 aa, Mycobacterium
FLNRMPRWYIGSILRHVDFLA

SEQ ID NO: 1291518 - protein, 17 aa, Mycobacterium
FLRCWPDPQQWAGEPLQ

SEQ ID NO: 1291519 - protein, 21 aa, Mycobacterium
FLRSNGFSIIRMFLELPYKQA

SEQ ID NO: 1291520 - protein, 21 aa, Mycobacterium
FLTDYHRWFLTSGIGPAIEQA

SEQ ID NO: 1291521 - protein, 25 aa, Mycobacterium
FLVFCAAIIRAVHKFGGLLRVSVAS

SEQ ID NO: 1291522 - protein, 17 aa, Mycobacterium
FLVHWSAEVFSDYDELK

SEQ ID NO: 1291523 - protein, 23 aa, Mycobacterium
FLVNEWRKGALFGQTPDEAFFVK

SEQ ID NO: 1291524 - protein, 19 aa, Mycobacterium
FLYRRGAYTDAPRPDLVLL

SEQ ID NO: 1291525 - protein, 17 aa, Mycobacterium
FMITEIFPGGRIPTTQM

SEQ ID NO: 1291526 - protein, 18 aa, Mycobacterium
FMITEIFPGGRLPTTQMM

SEQ ID NO: 1291527 - protein, 20 aa, Mycobacterium
FMTPAAFVRRPGRWIRAMAR

SEQ ID NO: 1291528 - protein, 19 aa, Mycobacterium
FNAALPLAAMMACVMSGQS

SEQ ID NO: 1291529 - protein, 25 aa, Mycobacterium
FNDRYKPDWCRVIDFPLTVAADVSD

SEQ ID NO: 1291530 - protein, 27 aa, Mycobacterium
FNGLVSLVLSLPVLRQLYIGLSEAFAP

SEQ ID NO: 1291531 - protein, 19 aa, Mycobacterium
FPADPFNLLAMLNIGAGIL

SEQ ID NO: 1291532 - protein, 23 aa, Mycobacterium
FPAEEFDRLVAINIGGVYWAVRS

SEQ ID NO: 1291533 - protein, 25 aa, Mycobacterium
FPASYWRRWSILEAVVLRVELTGSA

SEQ ID NO: 1291534 - protein, 22 aa, Mycobacterium
FPDMRIPWHSRWRHFEAGGVDR

SEQ ID NO: 1291535 - protein, 19 aa, Mycobacterium
FPEATMCRFGVPLAPVAEP

SEQ ID NO: 1291536 - protein, 18 aa, Mycobacterium
FPEILALAAEALRIKSET

SEQ ID NO: 1291537 - protein, 18 aa, Mycobacterium
FPEKGIAVAVDWAVIPRS

SEQ ID NO: 1291538 - protein, 17 aa, Mycobacterium
FPGRLTPQLSRALHRHA

SEQ ID NO: 1291539 - protein, 18 aa, Mycobacterium
FPGVPTWFSRTPGKVRGP

SEQ ID NO: 1291540 - protein, 17 aa, Mycobacterium
FPIKSGIVIEREVGRVR

SEQ ID NO: 1291541 - protein, 17 aa, Mycobacterium
FPKGLAAFIDLRDQTCR

SEQ ID NO: 1291542 - protein, 21 aa, Mycobacterium
FPLACAGCWINGVPMQEAVAA

SEQ ID NO: 1291543 - protein, 23 aa, Mycobacterium
FPLLRQALENVLGYGGTLVSATT

SEQ ID NO: 1291544 - protein, 17 aa, Mycobacterium
FPNFSWLGAHSTMRVWH

SEQ ID NO: 1291545 - protein, 25 aa, Mycobacterium
FPNKKGGPGWVEWGGCGMVNPNVLR

SEQ ID NO: 1291546 - protein, 19 aa, Mycobacterium
FPNLFATHRVRAVGDYSSH

SEQ ID NO: 1291547 - protein, 21 aa, Mycobacterium
FPPEPLASIGINATRWSLDRA

SEQ ID NO: 1291548 - protein, 21 aa, Mycobacterium
FPPEPLASIGIQATRWSLDRA

SEQ ID NO: 1291549 - protein, 17 aa, Mycobacterium
FPTKEAVLFQDYETQVE

SEQ ID NO: 1291550 - protein, 21 aa, Mycobacterium
FPTKESVLFFGEYDFIDAVGG

SEQ ID NO: 1291551 - protein, 17 aa, Mycobacterium
FPTPVTFCEIFPPDDFP

SEQ ID NO: 1291552 - protein, 21 aa, Mycobacterium
FPYFFCCHTCRNCLAGRRNAC

SEQ ID NO: 1291553 - protein, 24 aa, Mycobacterium
FQAYSAACALHFVEKALVEIRAGR

SEQ ID NO: 1291554 - protein, 23 aa, Mycobacterium
FQIGFRGGHQWKGRDGLQVYLNQ

SEQ ID NO: 1291555 - protein, 19 aa, Mycobacterium
FRASVCVLGPLVGRCKKAK

SEQ ID NO: 1291556 - protein, 18 aa, Mycobacterium
FRFVEEMIRLGADARTDG

SEQ ID NO: 1291557 - protein, 18 aa, Mycobacterium
FRGPGLRNSVMFGPPGRL

SEQ ID NO: 1291558 - protein, 20 aa, Mycobacterium
FRHAVKFLRWRPDRDPASCT

SEQ ID NO: 1291559 - protein, 17 aa, Mycobacterium
FRHAVKFRRWRPDRDPA

SEQ ID NO: 1291560 - protein, 18 aa, Mycobacterium
FRHFPTKEAVLFQDYETQ

SEQ ID NO: 1291561 - protein, 17 aa, Mycobacterium
FRIARDIVQDEGIETDV

SEQ ID NO: 1291562 - protein, 17 aa, Mycobacterium
FRIPELIRWPGKIEPRS

SEQ ID NO: 1291563 - protein, 17 aa, Mycobacterium
FRKFGLDAGEFMTLLSQ

SEQ ID NO: 1291564 - protein, 20 aa, Mycobacterium
FRKLQIGNRVELARYAIEHG

SEQ ID NO: 1291565 - protein, 17 aa, Mycobacterium
FRLIEVWQSHRAPVEGD

SEQ ID NO: 1291566 - protein, 17 aa, Mycobacterium
FRLPVRLALGPTHVAVV

SEQ ID NO: 1291567 - protein, 20 aa, Mycobacterium
FRLSFLVAYAARIGERLSAA

SEQ ID NO: 1291568 - protein, 17 aa, Mycobacterium
FRNLVGYLRPDLILDAN

SEQ ID NO: 1291569 - protein, 20 aa, Mycobacterium
FRPELTAAWLTEMFYSLVGG

SEQ ID NO: 1291570 - protein, 18 aa, Mycobacterium
FRPNPEWSHMMPPGPEVF

SEQ ID NO: 1291571 - protein, 17 aa, Mycobacterium
FRPREWQMDIVRDVLDS

SEQ ID NO: 1291572 - protein, 19 aa, Mycobacterium
FRRDLRLADLPALLAASEG

SEQ ID NO: 1291573 - protein, 18 aa, Mycobacterium
FRRHSVGFVFQFFNLLPT

SEQ ID NO: 1291574 - protein, 18 aa, Mycobacterium
FRRRIFVYALDWPGESPL

SEQ ID NO: 1291575 - protein, 22 aa, Mycobacterium
FRRWMLDYVRFHRSYRGVIRAW

SEQ ID NO: 1291576 - protein, 17 aa, Mycobacterium
FRSVLFFPVTPMTPSGA

SEQ ID NO: 1291577 - protein, 17 aa, Mycobacterium
FRTKAGWLRSAYAAYDS

SEQ ID NO: 1291578 - protein, 18 aa, Mycobacterium
FRTPLTLILDPVSELRRA

SEQ ID NO: 1291579 - protein, 17 aa, Mycobacterium
FRYHGWGPRMWTWVQMM

SEQ ID NO: 1291580 - protein, 17 aa, Mycobacterium
FRYPIGMRRWEFPQGTA

SEQ ID NO: 1291581 - protein, 18 aa, Mycobacterium
FSHVPWLPGQLLNAVEAF

SEQ ID NO: 1291582 - protein, 17 aa, Mycobacterium
FSHVPWLSSQLMSAVEA

SEQ ID NO: 1291583 - protein, 17 aa, Mycobacterium
FSLPELTDWSNADFTVE

SEQ ID NO: 1291584 - protein, 17 aa, Mycobacterium
FSLWCGTTATADWHTRY

SEQ ID NO: 1291585 - protein, 17 aa, Mycobacterium
FSPQTSWAPTFAPETDT

SEQ ID NO: 1291586 - protein, 18 aa, Mycobacterium
FSQRPGEVLVLGQVIETR

SEQ ID NO: 1291587 - protein, 17 aa, Mycobacterium
FSRPGVHYLSGFYGPLE

SEQ ID NO: 1291588 - protein, 18 aa, Mycobacterium
FSSAILPAWARKSPQMTE

SEQ ID NO: 1291589 - protein, 21 aa, Mycobacterium
FSSDFFAGWGKFAATRTPTIA

SEQ ID NO: 1291590 - protein, 18 aa, Mycobacterium
FSSLCWGERIAFDNPESL

SEQ ID NO: 1291591 - protein, 21 aa, Mycobacterium
FSTLRLLPWLPGSALVMADLS

SEQ ID NO: 1291592 - protein, 18 aa, Mycobacterium
FSTPMEWQQRLWPTEEFE

SEQ ID NO: 1291593 - protein, 18 aa, Mycobacterium
FSTYATWWIRQAITRAMA

SEQ ID NO: 1291594 - protein, 17 aa, Mycobacterium
FSVDAAEHLCATDISAA

SEQ ID NO: 1291595 - protein, 19 aa, Mycobacterium
FSVLPAWRGAAPVQAALAA

SEQ ID NO: 1291596 - protein, 19 aa, Mycobacterium
FTAALARREVTVWASDRSI

SEQ ID NO: 1291597 - protein, 20 aa, Mycobacterium
FTGAAPWVMVSNFRIKIDGC

SEQ ID NO: 1291598 - protein, 21 aa, Mycobacterium
FTGDCLFPGGVGKTWREGDFE

SEQ ID NO: 1291599 - protein, 17 aa, Mycobacterium
FTLAVGVGYLKREFTAL

SEQ ID NO: 1291600 - protein, 19 aa, Mycobacterium
FTLGSAWLSGCHQRSQTGE

SEQ ID NO: 1291601 - protein, 17 aa, Mycobacterium
FTLRTNRTFQEQYLAGG

SEQ ID NO: 1291602 - protein, 17 aa, Mycobacterium
FTLWEWIHTLIRPVDPH

SEQ ID NO: 1291603 - protein, 17 aa, Mycobacterium
FTPTASTLVSAWSSDTP

SEQ ID NO: 1291604 - protein, 21 aa, Mycobacterium
FTRAELTAAFATFEETVAHAA

SEQ ID NO: 1291605 - protein, 21 aa, Mycobacterium
FTRKTRFGFRMLDSRQGHGEP

SEQ ID NO: 1291606 - protein, 17 aa, Mycobacterium
FTTIAWRMAHVIVGVLA

SEQ ID NO: 1291607 - protein, 17 aa, Mycobacterium
FVALPIFPSRLFRHSSV

SEQ ID NO: 1291608 - protein, 18 aa, Mycobacterium
FVCPSVYEPLGIVNLEAM

SEQ ID NO: 1291609 - protein, 17 aa, Mycobacterium
FVDAWLLRACAKLGIRL

SEQ ID NO: 1291610 - protein, 23 aa, Mycobacterium
FVEAARRAGFRWVEDLSGLDADV

SEQ ID NO: 1291611 - protein, 24 aa, Mycobacterium
FVEAARRAGFRWVEDLSGLDADVP

SEQ ID NO: 1291612 - protein, 18 aa, Mycobacterium
FVEETGRTPMQWVTDQRV

SEQ ID NO: 1291613 - protein, 17 aa, Mycobacterium
FVEQRWGLPPGTIRTDA

SEQ ID NO: 1291614 - protein, 19 aa, Mycobacterium
FVERIARVFPSTVFLTIMG

SEQ ID NO: 1291615 - protein, 18 aa, Mycobacterium
FVGRVGGLAVALGIGIAI

SEQ ID NO: 1291616 - protein, 17 aa, Mycobacterium
FVLQGQFTKAFATITSW

SEQ ID NO: 1291617 - protein, 23 aa, Mycobacterium
FVNRRMGVALAFADDVDTARRNA

SEQ ID NO: 1291618 - protein, 18 aa, Mycobacterium
FVRRSCCPPCCVVVRTGS

SEQ ID NO: 1291619 - protein, 17 aa, Mycobacterium
FVSACALVFGPGEAERV

SEQ ID NO: 1291620 - protein, 19 aa, Mycobacterium
FVSEILHPLIGFPIDHDAP

SEQ ID NO: 1291621 - protein, 18 aa, Mycobacterium
FVVLDGLGKPGRLEGPDP

SEQ ID NO: 1291622 - protein, 18 aa, Mycobacterium
FWAAVILDFAQVPPKMMP

SEQ ID NO: 1291623 - protein, 25 aa, Mycobacterium
FWASWCGPCRAFAPVFERSSQTHPD

SEQ ID NO: 1291624 - protein, 24 aa, Mycobacterium
FWFDPLCPWAWITSRWVLEVEKVR

SEQ ID NO: 1291625 - protein, 19 aa, Mycobacterium
FWGGLRIGWIRAERSTLAT

SEQ ID NO: 1291626 - protein, 18 aa, Mycobacterium
FYSPRIAAMYNEWLDEGF

SEQ ID NO: 1291627 - protein, 18 aa, Mycobacterium
GAAAWRRLWADAAPLPIF

SEQ ID NO: 1291628 - protein, 19 aa, Mycobacterium
GAAELGLPVLHFESLDAAT

SEQ ID NO: 1291629 - protein, 18 aa, Mycobacterium
GAAFARLVADVATQIVIG

SEQ ID NO: 1291630 - protein, 17 aa, Mycobacterium
GAAGLLWGSGGDGGAGG

SEQ ID NO: 1291631 - protein, 17 aa, Mycobacterium
GACGRLGLVTGLLDPAP

SEQ ID NO: 1291632 - protein, 21 aa, Mycobacterium
GACNGCSMASVTLRELVEAAL

SEQ ID NO: 1291633 - protein, 18 aa, Mycobacterium
GADAVWPGILGFEDTVIP

SEQ ID NO: 1291634 - protein, 18 aa, Mycobacterium
GAEVRWASCNIFSTQDHA

SEQ ID NO: 1291635 - protein, 18 aa, Mycobacterium
GAFFEWFTDAGFTAITGH

SEQ ID NO: 1291636 - protein, 17 aa, Mycobacterium
GAFHVVRPAFPSMCDAG

SEQ ID NO: 1291637 - protein, 18 aa, Mycobacterium
GAGAYELFAAMFRAQGED

SEQ ID NO: 1291638 - protein, 30 aa, Mycobacterium
GAGEAIDLLKGVLMPAIMSAVKPPAPLPAA

SEQ ID NO: 1291639 - protein, 19 aa, Mycobacterium
GAGLWAITGVKSMEGLIAW

SEQ ID NO: 1291640 - protein, 19 aa, Mycobacterium
GAGRGFCSGAGISEEDHAN

SEQ ID NO: 1291641 - protein, 20 aa, Mycobacterium
GAGVSGLWLLSGMREDGVLT

SEQ ID NO: 1291642 - protein, 18 aa, Mycobacterium
GAGWQPDIWRGFADELGI

SEQ ID NO: 1291643 - protein, 18 aa, Mycobacterium
GAHFECWTMLGAWAEQTS

SEQ ID NO: 1291644 - protein, 24 aa, Mycobacterium
GAHVGMALWRDGRLVFSRNPSGAH

SEQ ID NO: 1291645 - protein, 19 aa, Mycobacterium
GAIHAKWEALGGMNSYLGR

SEQ ID NO: 1291646 - protein, 18 aa, Mycobacterium
GAIVKRPRVIVDDYGNES

SEQ ID NO: 1291647 - protein, 17 aa, Mycobacterium
GALDFAAQVGFARRSFD

SEQ ID NO: 1291648 - protein, 19 aa, Mycobacterium
GALHSWCLAAARPELVAGV

SEQ ID NO: 1291649 - protein, 18 aa, Mycobacterium
GALMGGYFAGLVDRRILG

SEQ ID NO: 1291650 - protein, 17 aa, Mycobacterium
GALRMRFNLALYADPRH

SEQ ID NO: 1291651 - protein, 23 aa, Mycobacterium
GALSEWRATLIVRESACLSVEDR

SEQ ID NO: 1291652 - protein, 24 aa, Mycobacterium
GALSEWRATLIVRESACLSVQHRR

SEQ ID NO: 1291653 - protein, 25 aa, Mycobacterium
GALWRGRWHGGLGFTDRCVAPVSIP

SEQ ID NO: 1291654 - protein, 19 aa, Mycobacterium
GAMEIDRLNVAIGLRERVN

SEQ ID NO: 1291655 - protein, 19 aa, Mycobacterium
GANPLEWLDEKFIGYLEDR

SEQ ID NO: 1291656 - protein, 18 aa, Mycobacterium
GAPAWLRFFGVNPRHHSL

SEQ ID NO: 1291657 - protein, 19 aa, Mycobacterium
GAPAWLRFLGVNPRHHSLA

SEQ ID NO: 1291658 - protein, 18 aa, Mycobacterium
GAPPRGAPLYAPDGSPLF

SEQ ID NO: 1291659 - protein, 17 aa, Mycobacterium
GAQGAWTGSQWVMVEES

SEQ ID NO: 1291660 - protein, 21 aa, Mycobacterium
GARLPLTLSMLLYDSSGTNKD

SEQ ID NO: 1291661 - protein, 22 aa, Mycobacterium
GARLTVGYSLAWQGRGREADAV

SEQ ID NO: 1291662 - protein, 19 aa, Mycobacterium
GASFLRRDGSVWTTDKDGI

SEQ ID NO: 1291663 - protein, 24 aa, Mycobacterium
GAYLGHVIVLWSWALKQPNEHEAP

SEQ ID NO: 1291664 - protein, 23 aa, Mycobacterium
GAYPRPGLFGKFFDSRARPLVEV

SEQ ID NO: 1291665 - protein, 21 aa, Mycobacterium
GCAGLRYNLFFDDRSLDGDLT

SEQ ID NO: 1291666 - protein, 26 aa, Mycobacterium
GCFACARCVACLGCARCSNCVGCVGC

SEQ ID NO: 1291667 - protein, 20 aa, Mycobacterium
GCTKPGCTVGAYGCQGHHVE

SEQ ID NO: 1291668 - protein, 21 aa, Mycobacterium
GCWLRVVLRFLPPGGAEPDSL

SEQ ID NO: 1291669 - protein, 26 aa, Mycobacterium
GDAGDPGSEAVDINGGAGGAGGAGGE

SEQ ID NO: 1291670 - protein, 19 aa, Mycobacterium
GDAINRFDLDPVKNQFADI

SEQ ID NO: 1291671 - protein, 17 aa, Mycobacterium
GDAPKVWIGDTGFSTDH

SEQ ID NO: 1291672 - protein, 21 aa, Mycobacterium
GDAPSGPGFWFPPTVLTPQRD

SEQ ID NO: 1291673 - protein, 25 aa, Mycobacterium
GDAPWRLECCAEVIAACDARGDVWG

SEQ ID NO: 1291674 - protein, 25 aa, Mycobacterium
GDARPDWELICGVARHLGFGDAFDY

SEQ ID NO: 1291675 - protein, 17 aa, Mycobacterium
GDASALCGTPSGVPTAT

SEQ ID NO: 1291676 - protein, 25 aa, Mycobacterium
GDDRVASLFLWHFVEEVEHRSSALI

SEQ ID NO: 1291677 - protein, 17 aa, Mycobacterium
GDFRFYLDFYTRQGPNG

SEQ ID NO: 1291678 - protein, 26 aa, Mycobacterium
GDGGLGGLGGFGGVGGTGGQGGQGGP

SEQ ID NO: 1291679 - protein, 23 aa, Mycobacterium
GDGKCLRSTFAYLGWLAGAAPDD

SEQ ID NO: 1291680 - protein, 21 aa, Mycobacterium
GDGQWRLGPALTELAGHVNDP

SEQ ID NO: 1291681 - protein, 23 aa, Mycobacterium
GDGRKSLALALRFRAPDRTLTED

SEQ ID NO: 1291682 - protein, 17 aa, Mycobacterium
GDGRSAVFFDYPPHPRT

SEQ ID NO: 1291683 - protein, 18 aa, Mycobacterium
GDIKIALFGNHAPKTVSN

SEQ ID NO: 1291684 - protein, 18 aa, Mycobacterium
GDILDVWRTYPVDRRRNL

SEQ ID NO: 1291685 - protein, 20 aa, Mycobacterium
GDLPPWLGATFRRAAVLRYG

SEQ ID NO: 1291686 - protein, 24 aa, Mycobacterium
GDLPQRYAFNASWLAHRKIYSKIR

SEQ ID NO: 1291687 - protein, 19 aa, Mycobacterium
GDLPWSQRLGEVWRMRSAE

SEQ ID NO: 1291688 - protein, 30 aa, Mycobacterium
GDPCQLCRWWWRQGRVWPKAHPFQRHKGCN

SEQ ID NO: 1291689 - protein, 17 aa, Mycobacterium
GDPFRFLVNLAKSVPVG

SEQ ID NO: 1291690 - protein, 17 aa, Mycobacterium
GDPRFSDVSSRIFGTPH

SEQ ID NO: 1291691 - protein, 17 aa, Mycobacterium
GDSRAAYEWHMRAAAWS

SEQ ID NO: 1291692 - protein, 17 aa, Mycobacterium
GDVAFTFTDYAVDPAGV

SEQ ID NO: 1291693 - protein, 18 aa, Mycobacterium
GDYVRRWVPELADVDDVH

SEQ ID NO: 1291694 - protein, 19 aa, Mycobacterium
GEAPGLFALEMAMDELAYA

SEQ ID NO: 1291695 - protein, 17 aa, Mycobacterium
GEGGFGYDPVFLPEDSD

SEQ ID NO: 1291696 - protein, 18 aa, Mycobacterium
GEGLGFWTQFDTYIPAAL

SEQ ID NO: 1291697 - protein, 17 aa, Mycobacterium
GEIAVSIGPWITRAQVD

SEQ ID NO: 1291698 - protein, 19 aa, Mycobacterium
GEIIYRLAVQAAQAINRFG

SEQ ID NO: 1291699 - protein, 17 aa, Mycobacterium
GEIPFVVGLGGTLRANS

SEQ ID NO: 1291700 - protein, 19 aa, Mycobacterium
GELALRPGWPSMFRGYLRQ

SEQ ID NO: 1291701 - protein, 34 aa, Mycobacterium
GELGWPLEPVFKIPGEIARDFGLTAVGAVLDTLL

SEQ ID NO: 1291702 - protein, 17 aa, Mycobacterium
GELIVAVAMTEPGAGSD

SEQ ID NO: 1291703 - protein, 22 aa, Mycobacterium
GELPAVRVGRSFRVHAKAVHDM

SEQ ID NO: 1291704 - protein, 17 aa, Mycobacterium
GELRKRCLLQLHEAIEG

SEQ ID NO: 1291705 - protein, 22 aa, Mycobacterium
GELRRLKICAAPDCHAVLVDLS

SEQ ID NO: 1291706 - protein, 24 aa, Mycobacterium
GELTSWAAWRRWRDAVVDRYRRQG

SEQ ID NO: 1291707 - protein, 23 aa, Mycobacterium
GELYNAWGSLGFERGALGLPTSA

SEQ ID NO: 1291708 - protein, 19 aa, Mycobacterium
GEMLCRWARDYLVTGTGVD

SEQ ID NO: 1291709 - protein, 23 aa, Mycobacterium
GEPGYERCVPWNVAAPVTPAAVV

SEQ ID NO: 1291710 - protein, 20 aa, Mycobacterium
GEPVPLWPDRVGEMSVRQID

SEQ ID NO: 1291711 - protein, 28 aa, Mycobacterium
GEQEKLMAFCLAGALSFNLASPDSTDNR

SEQ ID NO: 1291712 - protein, 21 aa, Mycobacterium
GEQRASNFLLWQAAYAEYVFQ

SEQ ID NO: 1291713 - protein, 18 aa, Mycobacterium
GEQRLRPQIAEWFEAGQV

SEQ ID NO: 1291714 - protein, 18 aa, Mycobacterium
GERARLGLWAGDRAPSPR

SEQ ID NO: 1291715 - protein, 17 aa, Mycobacterium
GERLICRAMNWRSVREG

SEQ ID NO: 1291716 - protein, 17 aa, Mycobacterium
GESLPVMPPWHVQENKW

SEQ ID NO: 1291717 - protein, 19 aa, Mycobacterium
GETGWPYVQFRGGPRGFVR

SEQ ID NO: 1291718 - protein, 22 aa, Mycobacterium
GETSRFGFVFTRRGVVPESASS

SEQ ID NO: 1291719 - protein, 18 aa, Mycobacterium
GEVGRAWPSIARARDEGA

SEQ ID NO: 1291720 - protein, 24 aa, Mycobacterium
GEVLRLRWRRGCLPVPQRVVRARV

SEQ ID NO: 1291721 - protein, 17 aa, Mycobacterium
GFADGWFNTEEGIKDLI

SEQ ID NO: 1291722 - protein, 17 aa, Mycobacterium
GFCGRLTRRITRWPLYV

SEQ ID NO: 1291723 - protein, 17 aa, Mycobacterium
GFIGISLPEEFGGGGAG

SEQ ID NO: 1291724 - protein, 17 aa, Mycobacterium
GFLGRYLALEWLERMAL

SEQ ID NO: 1291725 - protein, 18 aa, Mycobacterium
GFPESWYSWRHQIPALAA

SEQ ID NO: 1291726 - protein, 19 aa, Mycobacterium
GFRSYPLFVPFGIGDADAA

SEQ ID NO: 1291727 - protein, 27 aa, Mycobacterium
GFVAVGVWPAIKLPPLVTPLPGLGYTI

SEQ ID NO: 1291728 - protein, 25 aa, Mycobacterium
GFVERVLEAWPRHDLGYAITDLIAR

SEQ ID NO: 1291729 - protein, 25 aa, Mycobacterium
GFVSRICGWLLGIAHHFQGDLDAAL

SEQ ID NO: 1291730 - protein, 18 aa, Mycobacterium
GFYCGAHTQALLEARGAE

SEQ ID NO: 1291731 - protein, 17 aa, Mycobacterium
GGARGCPPATWCVQNAG

SEQ ID NO: 1291732 - protein, 19 aa, Mycobacterium
GGAVARCYSLASSPHTDAA

SEQ ID NO: 1291733 - protein, 17 aa, Mycobacterium
GGAYFFLPGLTALRYLT

SEQ ID NO: 1291734 - protein, 18 aa, Mycobacterium
GGDFTFPMEFARTPDGGW

SEQ ID NO: 1291735 - protein, 18 aa, Mycobacterium
GGFPEFPLPLGNPAESTR

SEQ ID NO: 1291736 - protein, 18 aa, Mycobacterium
GGGELVFLSGEVRARTDV

SEQ ID NO: 1291737 - protein, 19 aa, Mycobacterium
GGGMSATFGSFVAGQLTHA

SEQ ID NO: 1291738 - protein, 20 aa, Mycobacterium
GGIAFGWDRIVALLAGLDSI

SEQ ID NO: 1291739 - protein, 18 aa, Mycobacterium
GGIALKPLIARALRMGDE

SEQ ID NO: 1291740 - protein, 18 aa, Mycobacterium
GGKIRRIECEAVLQFHLS

SEQ ID NO: 1291741 - protein, 20 aa, Mycobacterium
GGLRPILCLTKSDLAPAEPF

SEQ ID NO: 1291742 - protein, 19 aa, Mycobacterium
GGMMPMGGMPMAGMPGGAG

SEQ ID NO: 1291743 - protein, 29 aa, Mycobacterium
GGNGGNGGRGSLFGRGGNAGNGGNGGTGG

SEQ ID NO: 1291744 - protein, 20 aa, Mycobacterium
GGPAMPPPPMPLGPPPTPSP

SEQ ID NO: 1291745 - protein, 28 aa, Mycobacterium
GGPKPAGVPFLWRWHDVYAKLLKSCDVM

SEQ ID NO: 1291746 - protein, 29 aa, Mycobacterium
GGPKPAGVPFLWRWHDVYAKLLKSCDVMP

SEQ ID NO: 1291747 - protein, 28 aa, Mycobacterium
GGPKPAGVPFLWRWQDVHAKLLKSCDVM

SEQ ID NO: 1291748 - protein, 17 aa, Mycobacterium
GGPRLFAQVLMYPGLDR

SEQ ID NO: 1291749 - protein, 24 aa, Mycobacterium
GGPSCGLRLCQSCRNAVGTVQGRL

SEQ ID NO: 1291750 - protein, 19 aa, Mycobacterium
GGQSTWRLGGAFNCGKAQP

SEQ ID NO: 1291751 - protein, 18 aa, Mycobacterium
GGRFAVNVVSGWFKDEFT

SEQ ID NO: 1291752 - protein, 17 aa, Mycobacterium
GGRGVHVFLRIATDWDF

SEQ ID NO: 1291753 - protein, 20 aa, Mycobacterium
GGRIKLAWFLLHAARYLPPQ

SEQ ID NO: 1291754 - protein, 26 aa, Mycobacterium
GGRQWCFERLFLVVAFVNRFIPGFIR

SEQ ID NO: 1291755 - protein, 17 aa, Mycobacterium
GGRRWILKSPQHLGQLP

SEQ ID NO: 1291756 - protein, 17 aa, Mycobacterium
GGRSEAVLSHFVAQIDA

SEQ ID NO: 1291757 - protein, 18 aa, Mycobacterium
GGRSEAVLSHFVAQIDAE

SEQ ID NO: 1291758 - protein, 24 aa, Mycobacterium
GGSVDIGQTVGFGGHGGNGGAGGT

SEQ ID NO: 1291759 - protein, 21 aa, Mycobacterium
GGTEWHIGWHLGAFDHDAGHH

SEQ ID NO: 1291760 - protein, 20 aa, Mycobacterium
GGVPPPIGVPAGTPGTGGAG

SEQ ID NO: 1291761 - protein, 17 aa, Mycobacterium
GGVSLRLGEHPYAAELS

SEQ ID NO: 1291762 - protein, 22 aa, Mycobacterium
GGWKCRPDADFGYRAAAAAGTD

SEQ ID NO: 1291763 - protein, 18 aa, Mycobacterium
GGWKSSGIGARFGGPEGL

SEQ ID NO: 1291764 - protein, 20 aa, Mycobacterium
GGWLPGDWPAKVLDLQPLTD

SEQ ID NO: 1291765 - protein, 24 aa, Mycobacterium
GHCMGALVGFEFTRLAAQRGVTVR

SEQ ID NO: 1291766 - protein, 18 aa, Mycobacterium
GHDWKFAVVEGGRHSVTH

SEQ ID NO: 1291767 - protein, 23 aa, Mycobacterium
GHFMDDFLLYWAFLSYALVRGGR

SEQ ID NO: 1291768 - protein, 20 aa, Mycobacterium
GHGDHIRYSFAMASRAAAMS

SEQ ID NO: 1291769 - protein, 23 aa, Mycobacterium
GHGISFLPTVGWAERGDLTATGH

SEQ ID NO: 1291770 - protein, 17 aa, Mycobacterium
GHIPGAVKIDWHIDLND

SEQ ID NO: 1291771 - protein, 17 aa, Mycobacterium
GHLRLKGDQAWTLLTAL

SEQ ID NO: 1291772 - protein, 18 aa, Mycobacterium
GHLYRIFAKLSIEDREQL

SEQ ID NO: 1291773 - protein, 23 aa, Mycobacterium
GHPDLPVPPTFLFSIELEAPDPF

SEQ ID NO: 1291774 - protein, 20 aa, Mycobacterium
GHYRARFTGPDGRRYKAPTT

SEQ ID NO: 1291775 - protein, 17 aa, Mycobacterium
GIDELPRRGDWPLGATS

SEQ ID NO: 1291776 - protein, 20 aa, Mycobacterium
GIDLSLPWRNFTGFKSYWLQ

SEQ ID NO: 1291777 - protein, 20 aa, Mycobacterium
GIDPEVYSGFAFGMGLERTL

SEQ ID NO: 1291778 - protein, 19 aa, Mycobacterium
GIEAKEIWGSRLLFDLIGC

SEQ ID NO: 1291779 - protein, 19 aa, Mycobacterium
GIELLCLPLLALGGTGFLS

SEQ ID NO: 1291780 - protein, 20 aa, Mycobacterium
GIELLCLPLLALGGTGFLSA

SEQ ID NO: 1291781 - protein, 22 aa, Mycobacterium
GILARLGHSIAFFIGTAYGSTA

SEQ ID NO: 1291782 - protein, 23 aa, Mycobacterium
GILTSRFGARWGTLHAGLDIANA

SEQ ID NO: 1291783 - protein, 19 aa, Mycobacterium
GIPEWRYPFEGRMHAVTAM

SEQ ID NO: 1291784 - protein, 17 aa, Mycobacterium
GIPVCVWFFAKDKTAGK

SEQ ID NO: 1291785 - protein, 17 aa, Mycobacterium
GISPMAAVSIFIDGTKD

SEQ ID NO: 1291786 - protein, 17 aa, Mycobacterium
GISRPTFYFYFASKDAV

SEQ ID NO: 1291787 - protein, 18 aa, Mycobacterium
GITFGGLLSPGGSIFNAL

SEQ ID NO: 1291788 - protein, 18 aa, Mycobacterium
GIVFFKYLLGMPVDDVPL

SEQ ID NO: 1291789 - protein, 23 aa, Mycobacterium
GKALRPALSIAVCLGLGGQLDAI

SEQ ID NO: 1291790 - protein, 25 aa, Mycobacterium
GKAVKRYKITAAWPKSLEISSLKAG

SEQ ID NO: 1291791 - protein, 17 aa, Mycobacterium
GKAWTGGDFGRVLMQYD

SEQ ID NO: 1291792 - protein, 22 aa, Mycobacterium
GKEFPRATYWRFIPDTTGTGDP

SEQ ID NO: 1291793 - protein, 19 aa, Mycobacterium
GKFLNNWRMAELHAQEAPD

SEQ ID NO: 1291794 - protein, 22 aa, Mycobacterium
GKGDRVILMLGNQVELWESMLA

SEQ ID NO: 1291795 - protein, 23 aa, Mycobacterium
GKGLRLAIVASTWHETICDALLD

SEQ ID NO: 1291796 - protein, 18 aa, Mycobacterium
GKGMLLAIHLGRIKDAEG

SEQ ID NO: 1291797 - protein, 22 aa, Mycobacterium
GKHAASAFALWFPVETDHARYG

SEQ ID NO: 1291798 - protein, 18 aa, Mycobacterium
GKIGEVWLHGDHVAAGYW

SEQ ID NO: 1291799 - protein, 17 aa, Mycobacterium
GKIRVAEGWAHGPEIDK

SEQ ID NO: 1291800 - protein, 18 aa, Mycobacterium
GKLYLCAIKDVFSNRIVG

SEQ ID NO: 1291801 - protein, 19 aa, Mycobacterium
GKLYLCAIKDVFSNRIVGY

SEQ ID NO: 1291802 - protein, 18 aa, Mycobacterium
GKNQSRWQFGVLGPPGAE

SEQ ID NO: 1291803 - protein, 19 aa, Mycobacterium
GKPDYRWAKDVTEERPADD

SEQ ID NO: 1291804 - protein, 17 aa, Mycobacterium
GKPFAAFCEEFVTPEPP

SEQ ID NO: 1291805 - protein, 20 aa, Mycobacterium
GKPGAGLCPVRGHSNVQGDR

SEQ ID NO: 1291806 - protein, 18 aa, Mycobacterium
GKRSVGIDVSKPGGQEVL

SEQ ID NO: 1291807 - protein, 20 aa, Mycobacterium
GKRVLGLPIHDNWWQTETGG

SEQ ID NO: 1291808 - protein, 19 aa, Mycobacterium
GKSTLALDFMRSCSIKHGM

SEQ ID NO: 1291809 - protein, 19 aa, Mycobacterium
GKTFPLPSPFLVMATQNPI

SEQ ID NO: 1291810 - protein, 18 aa, Mycobacterium
GKTTLLRLVAGFENPDGG

SEQ ID NO: 1291811 - protein, 17 aa, Mycobacterium
GKVTEHFGRPVWTISQG

SEQ ID NO: 1291812 - protein, 19 aa, Mycobacterium
GKYADPWAAIRSRLGDPGL

SEQ ID NO: 1291813 - protein, 25 aa, Mycobacterium
GLAARLTLPAGWTYRSRTLDAPLTV

SEQ ID NO: 1291814 - protein, 21 aa, Mycobacterium
GLADFPDRWWNLTAVANALAG

SEQ ID NO: 1291815 - protein, 19 aa, Mycobacterium
GLAGLRIGYAVADPDIIAA

SEQ ID NO: 1291816 - protein, 24 aa, Mycobacterium
GLAGTVLRFVPPVAALTTETVTFD

SEQ ID NO: 1291817 - protein, 23 aa, Mycobacterium
GLARFCTLRSWLSQWSFDDAHGD

SEQ ID NO: 1291818 - protein, 18 aa, Mycobacterium
GLDLRPATSLRHCLDLLV

SEQ ID NO: 1291819 - protein, 20 aa, Mycobacterium
GLEWARGELGMWLRRIGAAD

SEQ ID NO: 1291820 - protein, 17 aa, Mycobacterium
GLFDAGLVASVLTVQVL

SEQ ID NO: 1291821 - protein, 18 aa, Mycobacterium
GLFIKEALARGWIRRCLI

SEQ ID NO: 1291822 - protein, 20 aa, Mycobacterium
GLFIPRDVVFNVPRDDLGDN

SEQ ID NO: 1291823 - protein, 18 aa, Mycobacterium
GLGIRPGDRVLLQLPNSV

SEQ ID NO: 1291824 - protein, 18 aa, Mycobacterium
GLGLRLPVIETRLGTFET

SEQ ID NO: 1291825 - protein, 20 aa, Mycobacterium
GLIAPHWPRPWGVDATQLQQ

SEQ ID NO: 1291826 - protein, 19 aa, Mycobacterium
GLIAWSRERMAGFKVPRYV

SEQ ID NO: 1291827 - protein, 18 aa, Mycobacterium
GLIKAAWIDTWRLPAAPP

SEQ ID NO: 1291828 - protein, 21 aa, Mycobacterium
GLIREMLDWAAAEPVDDDNLA

SEQ ID NO: 1291829 - protein, 23 aa, Mycobacterium
GLLDVLTALAWVRDNIAAFGGDP

SEQ ID NO: 1291830 - protein, 17 aa, Mycobacterium
GLLSGAVTLVWQAGRVV

SEQ ID NO: 1291831 - protein, 19 aa, Mycobacterium
GLLSLPYPEEWGGGGQPYE

SEQ ID NO: 1291832 - protein, 19 aa, Mycobacterium
GLPLPYRTWEAIFSTANDR

SEQ ID NO: 1291833 - protein, 21 aa, Mycobacterium
GLPLVLVVHGGPWYRDSWGFD

SEQ ID NO: 1291834 - protein, 21 aa, Mycobacterium
GLPRRPRVLLISGDAPGPDEW

SEQ ID NO: 1291835 - protein, 19 aa, Mycobacterium
GLRLAAKLTPWPAVNGART

SEQ ID NO: 1291836 - protein, 23 aa, Mycobacterium
GLRRVDGRWVRWGCSVAARAEAA

SEQ ID NO: 1291837 - protein, 19 aa, Mycobacterium
GLRVGYGFCAPALGRTLWT

SEQ ID NO: 1291838 - protein, 19 aa, Mycobacterium
GLRVKPVMIGIRLKQSAAG

SEQ ID NO: 1291839 - protein, 17 aa, Mycobacterium
GLSRLGRRVDFLTHIAD

SEQ ID NO: 1291840 - protein, 18 aa, Mycobacterium
GLSYQLAEGIALLSKVDW

SEQ ID NO: 1291841 - protein, 18 aa, Mycobacterium
GLTAWLLLSCRALHEGAR

SEQ ID NO: 1291842 - protein, 21 aa, Mycobacterium
GLTPRRMACYLGDRELVCEGG

SEQ ID NO: 1291843 - protein, 19 aa, Mycobacterium
GLVLADWRPDIVHAHDWLV

SEQ ID NO: 1291844 - protein, 23 aa, Mycobacterium
GMAAVLPCYWIYAEVGAELLQRG

SEQ ID NO: 1291845 - protein, 25 aa, Mycobacterium
GMARHVLCFRTLWEATFNQLMKEGR

SEQ ID NO: 1291846 - protein, 20 aa, Mycobacterium
GMGGEAYRLLPVYRAEADRL

SEQ ID NO: 1291847 - protein, 18 aa, Mycobacterium
GMHPWGKWGRDFTEYGVV

SEQ ID NO: 1291848 - protein, 18 aa, Mycobacterium
GMIDACWERLGPGGRLVA

SEQ ID NO: 1291849 - protein, 25 aa, Mycobacterium
GMIRFMIRYGLVIARVYSGELDAAD

SEQ ID NO: 1291850 - protein, 22 aa, Mycobacterium
GMSCAGCANSVRAELTHIPGVR

SEQ ID NO: 1291851 - protein, 25 aa, Mycobacterium
GMVHCVRAALPLLRAAEWARIVNFS

SEQ ID NO: 1291852 - protein, 19 aa, Mycobacterium
GMVWKYPDTFVVGREQIRQ

SEQ ID NO: 1291853 - protein, 18 aa, Mycobacterium
GMWIYRLSLAKVKWHSLT

SEQ ID NO: 1291854 - protein, 17 aa, Mycobacterium
GMYPWKLAITSPYLDPG

SEQ ID NO: 1291855 - protein, 17 aa, Mycobacterium
GNKARWGGFEGVPNTGA

SEQ ID NO: 1291856 - protein, 20 aa, Mycobacterium
GNLDRPGGVMFPLSPVAPAP

SEQ ID NO: 1291857 - protein, 17 aa, Mycobacterium
GNLGRPGLAIVESDEDV

SEQ ID NO: 1291858 - protein, 19 aa, Mycobacterium
GNLLREFGLLLPVEPDTRL

SEQ ID NO: 1291859 - protein, 18 aa, Mycobacterium
GNLNGPVMAMAWRASDLI

SEQ ID NO: 1291860 - protein, 21 aa, Mycobacterium
GNLRTAVLAWLFARSTGRRFL

SEQ ID NO: 1291861 - protein, 24 aa, Mycobacterium
GNMPMAWAAAWIFLHINGISLGEF

SEQ ID NO: 1291862 - protein, 18 aa, Mycobacterium
GNPIAWLYEQRRWVVPGN

SEQ ID NO: 1291863 - protein, 24 aa, Mycobacterium
GNRAWRLYRRLGFTDVIRGYHFAG

SEQ ID NO: 1291864 - protein, 18 aa, Mycobacterium
GNVIAWLYNQRRFEVPSD

SEQ ID NO: 1291865 - protein, 19 aa, Mycobacterium
GNYLTGWAVGVLRSPSGTE

SEQ ID NO: 1291866 - protein, 21 aa, Mycobacterium
GPASWPPRVIGGWRHTHTFAD

SEQ ID NO: 1291867 - protein, 24 aa, Mycobacterium
GPCVDCYRTGLPVSVADLTGAGQR

SEQ ID NO: 1291868 - protein, 18 aa, Mycobacterium
GPDRSIIRASSWDIDMPN

SEQ ID NO: 1291869 - protein, 21 aa, Mycobacterium
GPEGPDLVLRWAALLHDIGKP

SEQ ID NO: 1291870 - protein, 26 aa, Mycobacterium
GPFFTARVLPGWSFRLTAAGDLLLND

SEQ ID NO: 1291871 - protein, 18 aa, Mycobacterium
GPFLWLRERMPGINRQVY

SEQ ID NO: 1291872 - protein, 17 aa, Mycobacterium
GPGCPTVLIGGRVAAVV

SEQ ID NO: 1291873 - protein, 21 aa, Mycobacterium
GPGGVVWRVDLAWPDQRVVAE

SEQ ID NO: 1291874 - protein, 18 aa, Mycobacterium
GPGWKLTGQKVWTSAAQK

SEQ ID NO: 1291875 - protein, 19 aa, Mycobacterium
GPHLARWAHDNGWAAAPDA

SEQ ID NO: 1291876 - protein, 17 aa, Mycobacterium
GPLAGSHLLVWTTTPWT

SEQ ID NO: 1291877 - protein, 17 aa, Mycobacterium
GPLTVPIWYQYTPGGDL

SEQ ID NO: 1291878 - protein, 18 aa, Mycobacterium
GPMQFLPGTWARYASDGD

SEQ ID NO: 1291879 - protein, 23 aa, Mycobacterium
GPPMFKRWCRLVGRPELFDDPRF

SEQ ID NO: 1291880 - protein, 20 aa, Mycobacterium
GPRMWTWVQMMGLRKFQEMV

SEQ ID NO: 1291881 - protein, 17 aa, Mycobacterium
GPVALALVKRGLPADTP

SEQ ID NO: 1291882 - protein, 18 aa, Mycobacterium
GPWLRTGDLGVMFDDELY

SEQ ID NO: 1291883 - protein, 28 aa, Mycobacterium
GQAGVAGKGGLFGGSGSAGTAGVTGASG

SEQ ID NO: 1291884 - protein, 18 aa, Mycobacterium
GQCCAALLASFKILGSAT

SEQ ID NO: 1291885 - protein, 17 aa, Mycobacterium
GQGKLGFEVKIHRIAAE

SEQ ID NO: 1291886 - protein, 20 aa, Mycobacterium
GQPGRFLLVTNFEYATPQFM

SEQ ID NO: 1291887 - protein, 20 aa, Mycobacterium
GRAAFPYQVHVGRWDELDGL

SEQ ID NO: 1291888 - protein, 18 aa, Mycobacterium
GRAALRCIRCSACLNVCP

SEQ ID NO: 1291889 - protein, 17 aa, Mycobacterium
GRAAVILDGERGALLFF

SEQ ID NO: 1291890 - protein, 17 aa, Mycobacterium
GRADWAVHIALWQRAPR

SEQ ID NO: 1291891 - protein, 17 aa, Mycobacterium
GRAGYGYTTLVATARDP

SEQ ID NO: 1291892 - protein, 23 aa, Mycobacterium
GRAKVLARYAVWLGEHRAEIEDL

SEQ ID NO: 1291893 - protein, 18 aa, Mycobacterium
GRALWRRHLAGVDGPTLL

SEQ ID NO: 1291894 - protein, 21 aa, Mycobacterium
GRAPLSVPIWYGYEPGGEVLL

SEQ ID NO: 1291895 - protein, 22 aa, Mycobacterium
GRDEIWRFTPLKRLRGLHDGSA

SEQ ID NO: 1291896 - protein, 23 aa, Mycobacterium
GRDEIWRFTPLRRLRGLHDGSAV

SEQ ID NO: 1291897 - protein, 23 aa, Mycobacterium
GRDILDPELLEWAAGTHDDAADV

SEQ ID NO: 1291898 - protein, 19 aa, Mycobacterium
GRDLSGWGRQWLKTTGLNT

SEQ ID NO: 1291899 - protein, 18 aa, Mycobacterium
GREGLGWTLGELTRTRFI

SEQ ID NO: 1291900 - protein, 17 aa, Mycobacterium
GRFALYMKIHHALVDGY

SEQ ID NO: 1291901 - protein, 17 aa, Mycobacterium
GRFDYRWHDGQQWTDQV

SEQ ID NO: 1291902 - protein, 17 aa, Mycobacterium
GRFILGLGMTHAAVTEG

SEQ ID NO: 1291903 - protein, 19 aa, Mycobacterium
GRFLLGIGVGHPEAHQEYV

SEQ ID NO: 1291904 - protein, 17 aa, Mycobacterium
GRFLPRHWVLIVNASDD

SEQ ID NO: 1291905 - protein, 17 aa, Mycobacterium
GRFTLAVGVGYLKREFT

SEQ ID NO: 1291906 - protein, 20 aa, Mycobacterium
GRGPRRYVCGGVMLTFDEMI

SEQ ID NO: 1291907 - protein, 18 aa, Mycobacterium
GRGRFRGAGLIDCGPSRP

SEQ ID NO: 1291908 - protein, 19 aa, Mycobacterium
GRGVLAVRGRGLWAGVDID

SEQ ID NO: 1291909 - protein, 19 aa, Mycobacterium
GRHVVWAGPLGYRDPELLA

SEQ ID NO: 1291910 - protein, 18 aa, Mycobacterium
GRICLCRVHEGCIEEDFI

SEQ ID NO: 1291911 - protein, 19 aa, Mycobacterium
GRIGAAVEEFVRWSSPVLQ

SEQ ID NO: 1291912 - protein, 17 aa, Mycobacterium
GRIPGLRGLGSGPGTRG

SEQ ID NO: 1291913 - protein, 19 aa, Mycobacterium
GRITFGWGPRDLRKLVLTE

SEQ ID NO: 1291914 - protein, 23 aa, Mycobacterium
GRLFKQVWLWKDWPGRGGKIDTG

SEQ ID NO: 1291915 - protein, 18 aa, Mycobacterium
GRLGEWFWGFQQQDAVPD

SEQ ID NO: 1291916 - protein, 18 aa, Mycobacterium
GRLLARERIELLVDRDAP

SEQ ID NO: 1291917 - protein, 17 aa, Mycobacterium
GRLRCWDDFIGGQSTAF

SEQ ID NO: 1291918 - protein, 20 aa, Mycobacterium
GRLRIAAAVGINGDVGAKAR

SEQ ID NO: 1291919 - protein, 19 aa, Mycobacterium
GRLSARLIGQVTWRTRLVQ

SEQ ID NO: 1291920 - protein, 17 aa, Mycobacterium
GRLVWAWRTDISGPAAR

SEQ ID NO: 1291921 - protein, 20 aa, Mycobacterium
GRLWLARGGTYVLANIRGGG

SEQ ID NO: 1291922 - protein, 18 aa, Mycobacterium
GRMLWSLPKGHIEMGETA

SEQ ID NO: 1291923 - protein, 18 aa, Mycobacterium
GRPHLVAMWYAVLDGEIW

SEQ ID NO: 1291924 - protein, 17 aa, Mycobacterium
GRPRTGLAALRMTTVDQ

SEQ ID NO: 1291925 - protein, 17 aa, Mycobacterium
GRPSIKSTLSFEPPPDF

SEQ ID NO: 1291926 - protein, 23 aa, Mycobacterium
GRQPAVIDACGWRAIDAAEVARG

SEQ ID NO: 1291927 - protein, 21 aa, Mycobacterium
GRRNACLNLKMAMLGRADEPP

SEQ ID NO: 1291928 - protein, 23 aa, Mycobacterium
GRRRISIYWTWSYPWEAQRDPAA

SEQ ID NO: 1291929 - protein, 18 aa, Mycobacterium
GRRYLGLDILARCRLTTI

SEQ ID NO: 1291930 - protein, 17 aa, Mycobacterium
GRSAVFFDYPPHPRTIA

SEQ ID NO: 1291931 - protein, 19 aa, Mycobacterium
GRSGYRFGHIEGPMQVQHH

SEQ ID NO: 1291932 - protein, 22 aa, Mycobacterium
GRSSPWLSWSELVPCDEYVRPE

SEQ ID NO: 1291933 - protein, 25 aa, Mycobacterium
GRTLVEVPVGFKWFVDGLIGGSIGF

SEQ ID NO: 1291934 - protein, 20 aa, Mycobacterium
GRTRFRPHFFPFTEPSAEVD

SEQ ID NO: 1291935 - protein, 17 aa, Mycobacterium
GRTRLDWESLSQRIHPA

SEQ ID NO: 1291936 - protein, 18 aa, Mycobacterium
GRVPPIWIGASGPRMLDI

SEQ ID NO: 1291937 - protein, 20 aa, Mycobacterium
GRVWTNCYHMYPAHAAFGGY

SEQ ID NO: 1291938 - protein, 19 aa, Mycobacterium
GRWYWHWDPAFLTKPNEDP

SEQ ID NO: 1291939 - protein, 21 aa, Mycobacterium
GRYLALEWLERMALVGGKLIC

SEQ ID NO: 1291940 - protein, 21 aa, Mycobacterium
GRYRLKCVIGERIRVLEWLPD

SEQ ID NO: 1291941 - protein, 18 aa, Mycobacterium
GSALYRFPVSYETLEETG

SEQ ID NO: 1291942 - protein, 23 aa, Mycobacterium
GSASCCWRWIAPWSRCSRRRGVS

SEQ ID NO: 1291943 - protein, 17 aa, Mycobacterium
GSDIAFLGGVINYILSN

SEQ ID NO: 1291944 - protein, 25 aa, Mycobacterium
GSDKDFWARVGIDPVRIMTSGGTFF

SEQ ID NO: 1291945 - protein, 19 aa, Mycobacterium
GSEFARWLAERGPARVPDI

SEQ ID NO: 1291946 - protein, 17 aa, Mycobacterium
GSELRRFLARWLGPAIL

SEQ ID NO: 1291947 - protein, 18 aa, Mycobacterium
GSGGLYRWEGRYLRGDDQ

SEQ ID NO: 1291948 - protein, 25 aa, Mycobacterium
GSGQPIVFSHGWPLSSDDWDTQMLF

SEQ ID NO: 1291949 - protein, 19 aa, Mycobacterium
GSIGIEWCRSGPGCRAIAF

SEQ ID NO: 1291950 - protein, 18 aa, Mycobacterium
GSILSWQNWEEMFSIARF

SEQ ID NO: 1291951 - protein, 19 aa, Mycobacterium
GSISIEWCRSGPGCRAIAF

SEQ ID NO: 1291952 - protein, 17 aa, Mycobacterium
GSLKGFVVSGRWPDSTK

SEQ ID NO: 1291953 - protein, 24 aa, Mycobacterium
GSPDRWDFVAAYGRDGRVIAVLST

SEQ ID NO: 1291954 - protein, 24 aa, Mycobacterium
GSSPALWAVAAWVRRQATQAIDGF

SEQ ID NO: 1291955 - protein, 23 aa, Mycobacterium
GSSPALWAVAAWVRRQTTQAIDG

SEQ ID NO: 1291956 - protein, 22 aa, Mycobacterium
GSTDLPALFAIPVAGPEAPLGA

SEQ ID NO: 1291957 - protein, 22 aa, Mycobacterium
GSTDLPALFAIPVAGSEAPLGA

SEQ ID NO: 1291958 - protein, 19 aa, Mycobacterium
GSTLRFAPPLVITADEIDW

SEQ ID NO: 1291959 - protein, 22 aa, Mycobacterium
GSTPAWIRACGDLRQALEQVQP

SEQ ID NO: 1291960 - protein, 21 aa, Mycobacterium
GSTRLQQDWARPAIAGEKVLT

SEQ ID NO: 1291961 - protein, 19 aa, Mycobacterium
GSVTYRYTWHLPKNRTWTY

SEQ ID NO: 1291962 - protein, 17 aa, Mycobacterium
GSWLPLVAVFGYHPAPG

SEQ ID NO: 1291963 - protein, 24 aa, Mycobacterium
GTATLRYSGIFAFGTYSVTYKNYS

SEQ ID NO: 1291964 - protein, 19 aa, Mycobacterium
GTCWSEFTLGPAYEGPPGW

SEQ ID NO: 1291965 - protein, 18 aa, Mycobacterium
GTDGGAVARCYSLASSPH

SEQ ID NO: 1291966 - protein, 18 aa, Mycobacterium
GTEPGLRYVLGRNEQAMV

SEQ ID NO: 1291967 - protein, 21 aa, Mycobacterium
GTFNISRLAAWHMSKNDPVDD

SEQ ID NO: 1291968 - protein, 19 aa, Mycobacterium
GTFTDCFFVWDDIYVDAKA

SEQ ID NO: 1291969 - protein, 18 aa, Mycobacterium
GTGIPAFFTPAGVGTPVA

SEQ ID NO: 1291970 - protein, 32 aa, Mycobacterium
GTGQGVTGFLALPHRYNISGDGGDGGNGAGGG

SEQ ID NO: 1291971 - protein, 18 aa, Mycobacterium
GTHARIWAHGNLEAARAT

SEQ ID NO: 1291972 - protein, 18 aa, Mycobacterium
GTLEEVWRTDGYCHCMFT

SEQ ID NO: 1291973 - protein, 18 aa, Mycobacterium
GTLFRRFGSRAGLMIVLL

SEQ ID NO: 1291974 - protein, 19 aa, Mycobacterium
GTLFRRFGSRAGLMVVLLD

SEQ ID NO: 1291975 - protein, 20 aa, Mycobacterium
GTPFLPQWACEPEDVAAAVC

SEQ ID NO: 1291976 - protein, 18 aa, Mycobacterium
GTTQRFGVPMGFGGPHAG

SEQ ID NO: 1291977 - protein, 24 aa, Mycobacterium
GTVFPDPRLVAAIVDRVTFNAHII

SEQ ID NO: 1291978 - protein, 19 aa, Mycobacterium
GTVIVGLDWDTTVLDERLA

SEQ ID NO: 1291979 - protein, 18 aa, Mycobacterium
GTVSGLYVCEMVTARALV

SEQ ID NO: 1291980 - protein, 17 aa, Mycobacterium
GTWGGLIAPGFRERFGR

SEQ ID NO: 1291981 - protein, 24 aa, Mycobacterium
GTYGRFLAIRVFDFWVHERDITTP

SEQ ID NO: 1291982 - protein, 17 aa, Mycobacterium
GVCGSVIDAVAPGAVAG

SEQ ID NO: 1291983 - protein, 23 aa, Mycobacterium
GVDARTAAAFGVAHRTAYHALRS

SEQ ID NO: 1291984 - protein, 23 aa, Mycobacterium
GVEVPRLASAVARTNELATLTDL

SEQ ID NO: 1291985 - protein, 20 aa, Mycobacterium
GVGIRAFELAVRYAQQRSTF

SEQ ID NO: 1291986 - protein, 23 aa, Mycobacterium
GVGREMWMRCLDINLVGAYNTID

SEQ ID NO: 1291987 - protein, 23 aa, Mycobacterium
GVGWPKEYGGLGFGPVEQQIFVN

SEQ ID NO: 1291988 - protein, 19 aa, Mycobacterium
GVIWGHGWDETRWPERRAP

SEQ ID NO: 1291989 - protein, 17 aa, Mycobacterium
GVKSMEGLIAWKLGTSF

SEQ ID NO: 1291990 - protein, 24 aa, Mycobacterium
GVLARVASLFSRRGYNIQSLAVGA

SEQ ID NO: 1291991 - protein, 19 aa, Mycobacterium
GVMRWPFKLLAPVVKSGFG

SEQ ID NO: 1291992 - protein, 24 aa, Mycobacterium
GVPKGFRVSNRWNLEPRAHGATTV

SEQ ID NO: 1291993 - protein, 24 aa, Mycobacterium
GVQSALCFPSFPGFGGGTFIRAQD

SEQ ID NO: 1291994 - protein, 18 aa, Mycobacterium
GVRDVVLCPGSRNAPLAF

SEQ ID NO: 1291995 - protein, 17 aa, Mycobacterium
GVRVWSLYVPNGRFVGS

SEQ ID NO: 1291996 - protein, 22 aa, Mycobacterium
GVSGRRGLARWIFGNSAERLLP

SEQ ID NO: 1291997 - protein, 20 aa, Mycobacterium
GVSLAEVWKTQAYAYLGITV

SEQ ID NO: 1291998 - protein, 21 aa, Mycobacterium
GVTPQMWDWWFGWHGSDTRRY

SEQ ID NO: 1291999 - protein, 25 aa, Mycobacterium
GVVGEIQYALSFDWFPIPLPPLPPF

SEQ ID NO: 1292000 - protein, 24 aa, Mycobacterium
GVVKFPAERPELFDGDADIQQDIE

SEQ ID NO: 1292001 - protein, 17 aa, Mycobacterium
GVVLVPINFMLTAEEIS

SEQ ID NO: 1292002 - protein, 24 aa, Mycobacterium
GVVPRRGTLALAFDVAPPVWAEPG

SEQ ID NO: 1292003 - protein, 23 aa, Mycobacterium
GWAGAQWTLRRGRVVLLEGDSPA

SEQ ID NO: 1292004 - protein, 24 aa, Mycobacterium
GWCPHCGSAYSFLPQLNVGDIVAD

SEQ ID NO: 1292005 - protein, 19 aa, Mycobacterium
GWFRFYFADERWEWSEQVQ

SEQ ID NO: 1292006 - protein, 19 aa, Mycobacterium
GWGVPGLSWMPGEDPDPFG

SEQ ID NO: 1292007 - protein, 19 aa, Mycobacterium
GWLARTGFQMLDPVKTAQA

SEQ ID NO: 1292008 - protein, 19 aa, Mycobacterium
GWLARTGFQMLDPVKTAQS

SEQ ID NO: 1292009 - protein, 19 aa, Mycobacterium
GWQEARFRDALAFMSTEVT

SEQ ID NO: 1292010 - protein, 23 aa, Mycobacterium
GWSPDRYQEWLAHALPQLLLRAE

SEQ ID NO: 1292011 - protein, 18 aa, Mycobacterium
GWYEHEWRAYGYGFPSAG

SEQ ID NO: 1292012 - protein, 19 aa, Mycobacterium
GWYEHEWRAYGYGFPSAGV

SEQ ID NO: 1292013 - protein, 19 aa, Mycobacterium
GYAACHWCHVMAHECFEDD

SEQ ID NO: 1292014 - protein, 17 aa, Mycobacterium
GYEIPFTRHFYRYVAPR

SEQ ID NO: 1292015 - protein, 17 aa, Mycobacterium
GYGYRWGALHSGVDIAN

SEQ ID NO: 1292016 - protein, 18 aa, Mycobacterium
GYPGKLPFLAPFNDGLPD

SEQ ID NO: 1292017 - protein, 19 aa, Mycobacterium
GYRFDDFRVPELVSDQTRM

SEQ ID NO: 1292018 - protein, 18 aa, Mycobacterium
GYRLGRSIARLEAALSTP

SEQ ID NO: 1292019 - protein, 20 aa, Mycobacterium
HAAKGLEWDAVFLVGLADGT

SEQ ID NO: 1292020 - protein, 19 aa, Mycobacterium
HACGLEPRLAVPLLAPVLG

SEQ ID NO: 1292021 - protein, 17 aa, Mycobacterium
HAERILALFGHDNLQKV

SEQ ID NO: 1292022 - protein, 19 aa, Mycobacterium
HAFNLWLDEDWGFNRPDHR

SEQ ID NO: 1292023 - protein, 20 aa, Mycobacterium
HAGYMFKLWDQLVWGVTLVI

SEQ ID NO: 1292024 - protein, 18 aa, Mycobacterium
HANACLTCPVFITTPEFL

SEQ ID NO: 1292025 - protein, 19 aa, Mycobacterium
HAPSGLGFRPDGSLLIVST

SEQ ID NO: 1292026 - protein, 24 aa, Mycobacterium
HARKVFRETVGWVLTERAVSRIGR

SEQ ID NO: 1292027 - protein, 18 aa, Mycobacterium
HARLRLSYNVDHDKISTI

SEQ ID NO: 1292028 - protein, 19 aa, Mycobacterium
HARLRLSYNVDHDKISTIP

SEQ ID NO: 1292029 - protein, 20 aa, Mycobacterium
HARLRLSYNVDHDKISTIPH

SEQ ID NO: 1292030 - protein, 22 aa, Mycobacterium
HARPWKGGRWVVRTEAGARLPL

SEQ ID NO: 1292031 - protein, 17 aa, Mycobacterium
HATRLATTWADQRFAVG

SEQ ID NO: 1292032 - protein, 17 aa, Mycobacterium
HAYRFGLARVLDGLAPV

SEQ ID NO: 1292033 - protein, 19 aa, Mycobacterium
HCIDSLWAPNANPINSALA

SEQ ID NO: 1292034 - protein, 21 aa, Mycobacterium
HCKGVCIGGYLLQGGYGWNSR

SEQ ID NO: 1292035 - protein, 23 aa, Mycobacterium
HCLDMPGLFVWRRYHPTPAPERG

SEQ ID NO: 1292036 - protein, 17 aa, Mycobacterium
HCMGAVVAFEFARVAER

SEQ ID NO: 1292037 - protein, 17 aa, Mycobacterium
HCSHWRFTLTADEPADG

SEQ ID NO: 1292038 - protein, 17 aa, Mycobacterium
HCTPELTVGLGRLAAEH

SEQ ID NO: 1292039 - protein, 21 aa, Mycobacterium
HDCRPGFLLPGFIDTHIHYPQ

SEQ ID NO: 1292040 - protein, 18 aa, Mycobacterium
HDDPVRWGVWVAPCPVPR

SEQ ID NO: 1292041 - protein, 17 aa, Mycobacterium
HDILAFERQWWKYAGSK

SEQ ID NO: 1292042 - protein, 26 aa, Mycobacterium
HDKTPAQVLLRWSIQLGNVVIARSAN

SEQ ID NO: 1292043 - protein, 17 aa, Mycobacterium
HDLGIAIVRVMARHAPK

SEQ ID NO: 1292044 - protein, 21 aa, Mycobacterium
HDTFCPVGPWIVTDLDPSDLE

SEQ ID NO: 1292045 - protein, 20 aa, Mycobacterium
HDVSRSWLYFGLISISVGAL

SEQ ID NO: 1292046 - protein, 21 aa, Mycobacterium
HELGAIPVLLGHQVSGRKGEY

SEQ ID NO: 1292047 - protein, 17 aa, Mycobacterium
HEPGFRTKAGWLRSAYA

SEQ ID NO: 1292048 - protein, 17 aa, Mycobacterium
HETLRMFADLGVLDEEL

SEQ ID NO: 1292049 - protein, 19 aa, Mycobacterium
HFNLSVGVSDSFMRAVERG

SEQ ID NO: 1292050 - protein, 20 aa, Mycobacterium
HFPRRSDLILAVIEREIDDC

SEQ ID NO: 1292051 - protein, 18 aa, Mycobacterium
HGAFAKRIRHAFQRLTED

SEQ ID NO: 1292052 - protein, 18 aa, Mycobacterium
HGALTRLQAVWTGDGQMA

SEQ ID NO: 1292053 - protein, 17 aa, Mycobacterium
HGDDAWEAIQFIPKEHW

SEQ ID NO: 1292054 - protein, 21 aa, Mycobacterium
HGFASFWWSWRHQLRGLSGAR

SEQ ID NO: 1292055 - protein, 22 aa, Mycobacterium
HGFGSFWWSWRHQLAGLTGARV

SEQ ID NO: 1292056 - protein, 19 aa, Mycobacterium
HGFPESWYSWRHQIPALAN

SEQ ID NO: 1292057 - protein, 18 aa, Mycobacterium
HGGPWYRDSWGFDAGVQM

SEQ ID NO: 1292058 - protein, 21 aa, Mycobacterium
HGLQCGFCTPGFVTSITALLR

SEQ ID NO: 1292059 - protein, 20 aa, Mycobacterium
HGPVRFPGVPTWFSRTPGKV

SEQ ID NO: 1292060 - protein, 20 aa, Mycobacterium
HGRSGFLLAPWTAESIAAEL

SEQ ID NO: 1292061 - protein, 18 aa, Mycobacterium
HGVARAGYLEVPRDPDLA

SEQ ID NO: 1292062 - protein, 19 aa, Mycobacterium
HHHRCFPVLAGAPGDRDLM

SEQ ID NO: 1292063 - protein, 18 aa, Mycobacterium
HHPHLLPLAGRVLEATDA

SEQ ID NO: 1292064 - protein, 18 aa, Mycobacterium
HHRVWYRYHHLFGDVLRG

SEQ ID NO: 1292065 - protein, 23 aa, Mycobacterium
HIDKWRFTVPFVCGATNLGEALR

SEQ ID NO: 1292066 - protein, 17 aa, Mycobacterium
HIPLCLDTGHLLIGGTD

SEQ ID NO: 1292067 - protein, 17 aa, Mycobacterium
HITFAHLWAQFALGDSA

SEQ ID NO: 1292068 - protein, 21 aa, Mycobacterium
HKCADMLVDLEWARSASQAAL

SEQ ID NO: 1292069 - protein, 19 aa, Mycobacterium
HKFFAGCLGIFGHGNVAGI

SEQ ID NO: 1292070 - protein, 25 aa, Mycobacterium
HKIRASRLVAEWPVRPGVPDPDPLA

SEQ ID NO: 1292071 - protein, 17 aa, Mycobacterium
HKKGSALVPSWVAFAVI

SEQ ID NO: 1292072 - protein, 17 aa, Mycobacterium
HKTEAWVSQRRALLKLA

SEQ ID NO: 1292073 - protein, 24 aa, Mycobacterium
HLARAHLRYGEWLRRALRRNDARE

SEQ ID NO: 1292074 - protein, 24 aa, Mycobacterium
HLAVRPGQDWALLLAMVKVVLDEG

SEQ ID NO: 1292075 - protein, 19 aa, Mycobacterium
HLDAPMVHRALAGLNLAGL

SEQ ID NO: 1292076 - protein, 18 aa, Mycobacterium
HLEMLSTFLRWREGTRGE

SEQ ID NO: 1292077 - protein, 20 aa, Mycobacterium
HLKVRLGIALVEYVSAVKSG

SEQ ID NO: 1292078 - protein, 18 aa, Mycobacterium
HLRDEFGLSIILITHEME

SEQ ID NO: 1292079 - protein, 18 aa, Mycobacterium
HLRRRVMVVLPFLTPTIA

SEQ ID NO: 1292080 - protein, 23 aa, Mycobacterium
HLRSSMKIGEHWKMLDVNNSDWA

SEQ ID NO: 1292081 - protein, 17 aa, Mycobacterium
HLVDFPLSLGIRPNIPY

SEQ ID NO: 1292082 - protein, 18 aa, Mycobacterium
HLWVRLLGCGDFYGIPAT

SEQ ID NO: 1292083 - protein, 17 aa, Mycobacterium
HMAKFCLRTGAALTPPA

SEQ ID NO: 1292084 - protein, 24 aa, Mycobacterium
HNVARAAELLSWWRSTTPDYVEIA

SEQ ID NO: 1292085 - protein, 22 aa, Mycobacterium
HPEPELAAIIGRRIKAVQPEQA

SEQ ID NO: 1292086 - protein, 17 aa, Mycobacterium
HPGRFLLGIGVGHPEAH

SEQ ID NO: 1292087 - protein, 19 aa, Mycobacterium
HPLAALGFMYSLRSTAYTE

SEQ ID NO: 1292088 - protein, 18 aa, Mycobacterium
HPLWLSTMRARSWVDEFG

SEQ ID NO: 1292089 - protein, 18 aa, Mycobacterium
HPRHVLSYGLGLDSTAVL

SEQ ID NO: 1292090 - protein, 19 aa, Mycobacterium
HPRIFPVAIAGVLFGHADP

SEQ ID NO: 1292091 - protein, 17 aa, Mycobacterium
HPRPGWVGQRLPYQQAR

SEQ ID NO: 1292092 - protein, 23 aa, Mycobacterium
HQESRAGAVLSRILALTDDEVRA

SEQ ID NO: 1292093 - protein, 25 aa, Mycobacterium
HQIPRAGNMFSVFFGAEPVTDFAAA

SEQ ID NO: 1292094 - protein, 23 aa, Mycobacterium
HQIWQCPVVLLADVRSVGVQGDG

SEQ ID NO: 1292095 - protein, 19 aa, Mycobacterium
HRAKLNWWESRALYGWTVL

SEQ ID NO: 1292096 - protein, 18 aa, Mycobacterium
HRALAEFRVRGVSTNIPF

SEQ ID NO: 1292097 - protein, 18 aa, Mycobacterium
HRALQCRAFLLSRAGVEW

SEQ ID NO: 1292098 - protein, 24 aa, Mycobacterium
HREHFSLPALRDWLRGQRDERSGA

SEQ ID NO: 1292099 - protein, 19 aa, Mycobacterium
HRHVKRALVLDGLLGSSRE

SEQ ID NO: 1292100 - protein, 24 aa, Mycobacterium
HRLARSLFLYALCNGWIGEDTTVI

SEQ ID NO: 1292101 - protein, 18 aa, Mycobacterium
HRLDCAQLPAGLLDGLAD

SEQ ID NO: 1292102 - protein, 19 aa, Mycobacterium
HRVWPEFFGMLPAQTLQRT

SEQ ID NO: 1292103 - protein, 18 aa, Mycobacterium
HRWRFNLVTGEAREEQLS

SEQ ID NO: 1292104 - protein, 17 aa, Mycobacterium
HRYPTCQLAIPGICVGT

SEQ ID NO: 1292105 - protein, 17 aa, Mycobacterium
HSAEFSRPLLAVAGGSH

SEQ ID NO: 1292106 - protein, 20 aa, Mycobacterium
HSAFKLLNWQGGSGNVLVSE

SEQ ID NO: 1292107 - protein, 22 aa, Mycobacterium
HSAFKLLNWQGGSGNVLVSEPY

SEQ ID NO: 1292108 - protein, 17 aa, Mycobacterium
HSDRIRCAVVISPEDIE

SEQ ID NO: 1292109 - protein, 22 aa, Mycobacterium
HSMGGLYSRAAFRMLQHTGSPL

SEQ ID NO: 1292110 - protein, 21 aa, Mycobacterium
HSPLKLCWVPGYSDYYPETPG

SEQ ID NO: 1292111 - protein, 17 aa, Mycobacterium
HSRWYIERFRAMARAGD

SEQ ID NO: 1292112 - protein, 25 aa, Mycobacterium
HSYPHCWRCRNPLIYRAVSSWFIKV

SEQ ID NO: 1292113 - protein, 20 aa, Mycobacterium
HTEFPYVFCDATFCKARIGA

SEQ ID NO: 1292114 - protein, 17 aa, Mycobacterium
HTFSLPELTDWSNADFT

SEQ ID NO: 1292115 - protein, 22 aa, Mycobacterium
HTGPALSPFNAWTLLKGLETLS

SEQ ID NO: 1292116 - protein, 25 aa, Mycobacterium
HTIKATKLVAEWPIRDHIPDPDPIG

SEQ ID NO: 1292117 - protein, 17 aa, Mycobacterium
HTMLRLPTGIFYAQGVK

SEQ ID NO: 1292118 - protein, 18 aa, Mycobacterium
HTMLRLPTGIFYAQGVKA

SEQ ID NO: 1292119 - protein, 22 aa, Mycobacterium
HTTRCFVTFLMLAGHLRPGYDY

SEQ ID NO: 1292120 - protein, 18 aa, Mycobacterium
HVALGHFYDTFIGPRVIT

SEQ ID NO: 1292121 - protein, 17 aa, Mycobacterium
HVDLSISSLIGYHDPNG

SEQ ID NO: 1292122 - protein, 23 aa, Mycobacterium
HVGIRLSPMIKFGGLDDADGMEM

SEQ ID NO: 1292123 - protein, 17 aa, Mycobacterium
HVGRITFGWGPRDLRKL

SEQ ID NO: 1292124 - protein, 29 aa, Mycobacterium
HVLLRKFPRHLLGSVPLIYSWELAGDRDD

SEQ ID NO: 1292125 - protein, 19 aa, Mycobacterium
HVLPFISIRVWQPISENET

SEQ ID NO: 1292126 - protein, 24 aa, Mycobacterium
HVLPVRCPHVPRNAQDLVWDRMVR

SEQ ID NO: 1292127 - protein, 20 aa, Mycobacterium
HVRIVISLRVEYEHELTGPG

SEQ ID NO: 1292128 - protein, 20 aa, Mycobacterium
HVRSGVAFDVLRRWLTAKGF

SEQ ID NO: 1292129 - protein, 22 aa, Mycobacterium
HVRWHDLRHAFAVMSLSAGEHY

SEQ ID NO: 1292130 - protein, 17 aa, Mycobacterium
HVWAIGDVASWRDNVGG

SEQ ID NO: 1292131 - protein, 17 aa, Mycobacterium
HWADPDVVRAFHDRGVE

SEQ ID NO: 1292132 - protein, 24 aa, Mycobacterium
HWARRTGAPLARRVAGETARFLIH

SEQ ID NO: 1292133 - protein, 17 aa, Mycobacterium
HWPAFLTSFLRLSALIR

SEQ ID NO: 1292134 - protein, 19 aa, Mycobacterium
HWPKPRHGWTLTIEGDPSM

SEQ ID NO: 1292135 - protein, 18 aa, Mycobacterium
HWVAPAEAVWACRTLAAT

SEQ ID NO: 1292136 - protein, 24 aa, Mycobacterium
HWVTECLRAAYPLGHGHGPVSALF

SEQ ID NO: 1292137 - protein, 17 aa, Mycobacterium
HYTRTPDEFSWRAGEVL

SEQ ID NO: 1292138 - protein, 17 aa, Mycobacterium
IAAALNWPDTYQAEYIA

SEQ ID NO: 1292139 - protein, 19 aa, Mycobacterium
IAADGLWRFVTLPWQLTRV

SEQ ID NO: 1292140 - protein, 18 aa, Mycobacterium
IAAEIGYPVLVRPSYVLG

SEQ ID NO: 1292141 - protein, 21 aa, Mycobacterium
IAAGWRRARPQDVLTLAPQSD

SEQ ID NO: 1292142 - protein, 17 aa, Mycobacterium
IAAKRPRLIPIWDSFVE

SEQ ID NO: 1292143 - protein, 22 aa, Mycobacterium
IAAKRPRLIPIWDSFVEQATGL

SEQ ID NO: 1292144 - protein, 26 aa, Mycobacterium
IAARWGFGVVEAFAVYYRGRYGVHPE

SEQ ID NO: 1292145 - protein, 18 aa, Mycobacterium
IAAYPGAIAVRFDDPLAA

SEQ ID NO: 1292146 - protein, 18 aa, Mycobacterium
IACAAAIHLARNGKRVLL

SEQ ID NO: 1292147 - protein, 21 aa, Mycobacterium
IACTAEILANIALREGRDADI

SEQ ID NO: 1292148 - protein, 17 aa, Mycobacterium
IACYRLKPVRFTSEESA

SEQ ID NO: 1292149 - protein, 17 aa, Mycobacterium
IADDWFSPVFLRNATAF

SEQ ID NO: 1292150 - protein, 23 aa, Mycobacterium
IADFAAPVERVWQVYADPRQLEK

SEQ ID NO: 1292151 - protein, 23 aa, Mycobacterium
IAEAGDWLSCWTMGLNQSTHGTW

SEQ ID NO: 1292152 - protein, 19 aa, Mycobacterium
IAEGWQPVFFYPEKADDVW

SEQ ID NO: 1292153 - protein, 18 aa, Mycobacterium
IAEWKLTLCDTVADNASS

SEQ ID NO: 1292154 - protein, 17 aa, Mycobacterium
IAGAFVFMASDAASYVT

SEQ ID NO: 1292155 - protein, 17 aa, Mycobacterium
IAGRCAGIGGLARAGEV

SEQ ID NO: 1292156 - protein, 18 aa, Mycobacterium
IALGYPWPPTIPERVLRN

SEQ ID NO: 1292157 - protein, 18 aa, Mycobacterium
IALMPSIVRKDFGPWSPG

SEQ ID NO: 1292158 - protein, 17 aa, Mycobacterium
IAPALVYGNTVVWKPAS

SEQ ID NO: 1292159 - protein, 25 aa, Mycobacterium
IAPEEARSGISYAISKSFVRWYSSS

SEQ ID NO: 1292160 - protein, 23 aa, Mycobacterium
IAPGAQWRPTWRIDQPAASLWYH

SEQ ID NO: 1292161 - protein, 18 aa, Mycobacterium
IAPRPVLAMVSEQLMKAS

SEQ ID NO: 1292162 - protein, 19 aa, Mycobacterium
IAQAVLFLASPRAGFVTGS

SEQ ID NO: 1292163 - protein, 25 aa, Mycobacterium
IAQLDWPLADAIRWPAQHISEFAWE

SEQ ID NO: 1292164 - protein, 23 aa, Mycobacterium
IARDRATVCLVGITGTEFPYRPY

SEQ ID NO: 1292165 - protein, 25 aa, Mycobacterium
IARRCSRIAFGLGDFRSDTGMSDDP

SEQ ID NO: 1292166 - protein, 19 aa, Mycobacterium
IASAVVLKANWQRAAKLLG

SEQ ID NO: 1292167 - protein, 17 aa, Mycobacterium
IASGEFFSMLGPSGCGK

SEQ ID NO: 1292168 - protein, 24 aa, Mycobacterium
IASPPVKWPCFYGIDFATPAELIA

SEQ ID NO: 1292169 - protein, 24 aa, Mycobacterium
IATTLAARGWRVIVTDVNLTGAQE

SEQ ID NO: 1292170 - protein, 17 aa, Mycobacterium
IAVASAWLGLSEDTAGL

SEQ ID NO: 1292171 - protein, 18 aa, Mycobacterium
IAVHWPLIDFECGPSGGA

SEQ ID NO: 1292172 - protein, 19 aa, Mycobacterium
ICAFGRIGSMFACDDFGYV

SEQ ID NO: 1292173 - protein, 25 aa, Mycobacterium
ICALSAKHSIMFLCAAHMWLGASAI

SEQ ID NO: 1292174 - protein, 25 aa, Mycobacterium
ICDKGFPAYFLIVADLINYARSVGI

SEQ ID NO: 1292175 - protein, 18 aa, Mycobacterium
ICGICGGSHLYKSAYALD

SEQ ID NO: 1292176 - protein, 17 aa, Mycobacterium
ICVSGPLLSGGYWNLPE

SEQ ID NO: 1292177 - protein, 17 aa, Mycobacterium
IDAACELIDFWRFNVAF

SEQ ID NO: 1292178 - protein, 22 aa, Mycobacterium
IDAALPGLHGWVDERLADREQV

SEQ ID NO: 1292179 - protein, 17 aa, Mycobacterium
IDAEIPLLVVITEGIPV

SEQ ID NO: 1292180 - protein, 17 aa, Mycobacterium
IDAKLGYPTRDPHGDPI

SEQ ID NO: 1292181 - protein, 19 aa, Mycobacterium
IDAPTLWPGLPVRPVKGEV

SEQ ID NO: 1292182 - protein, 24 aa, Mycobacterium
IDARKELLPLIGLIDQSAPVLDSQ

SEQ ID NO: 1292183 - protein, 22 aa, Mycobacterium
IDDLKAPLLAAVGAADLALERV

SEQ ID NO: 1292184 - protein, 18 aa, Mycobacterium
IDERAKWATFPMLALHGW

SEQ ID NO: 1292185 - protein, 24 aa, Mycobacterium
IDERARAGLFLAMQYPVEVPGVSM

SEQ ID NO: 1292186 - protein, 18 aa, Mycobacterium
IDGTSLYSTHRWAPNTAI

SEQ ID NO: 1292187 - protein, 18 aa, Mycobacterium
IDLGFAWADIGGREMAFV

SEQ ID NO: 1292188 - protein, 19 aa, Mycobacterium
IDLGWWLMFERFLCESLGF

SEQ ID NO: 1292189 - protein, 18 aa, Mycobacterium
IDNLRMALNYGVNKARFP

SEQ ID NO: 1292190 - protein, 24 aa, Mycobacterium
IDPDWTIRGWSWFPDSTRALINEQ

SEQ ID NO: 1292191 - protein, 17 aa, Mycobacterium
IDPRLLTTMPEWLNAAT

SEQ ID NO: 1292192 - protein, 22 aa, Mycobacterium
IDPSAWAFTWVVDWPLFEPADD

SEQ ID NO: 1292193 - protein, 17 aa, Mycobacterium
IDRLPNGVFLDWQQFQS

SEQ ID NO: 1292194 - protein, 20 aa, Mycobacterium
IDVPYPVLWRNLTQVVADVL

SEQ ID NO: 1292195 - protein, 19 aa, Mycobacterium
IEAGRPCWLLCLLFDDADG

SEQ ID NO: 1292196 - protein, 17 aa, Mycobacterium
IEAGYEFVNTPHITKEH

SEQ ID NO: 1292197 - protein, 19 aa, Mycobacterium
IEALLRVLEPYGIREIVQS

SEQ ID NO: 1292198 - protein, 17 aa, Mycobacterium
IEAVEWPDHPFALGVHW

SEQ ID NO: 1292199 - protein, 17 aa, Mycobacterium
IEFIVAQLLRLGRLGSF

SEQ ID NO: 1292200 - protein, 25 aa, Mycobacterium
IEFTLRAGRYLPWHPGRCAEIVVGD

SEQ ID NO: 1292201 - protein, 17 aa, Mycobacterium
IEGLITLAGREFAPVDI

SEQ ID NO: 1292202 - protein, 26 aa, Mycobacterium
IEKAFPGRFLLGIGVGHPEHTQEYVK

SEQ ID NO: 1292203 - protein, 20 aa, Mycobacterium
IEKMRVAGRIAAGALAEAGK

SEQ ID NO: 1292204 - protein, 17 aa, Mycobacterium
IELGRSGARVAISDVDT

SEQ ID NO: 1292205 - protein, 18 aa, Mycobacterium
IELLCLPLLALGGTGFLS

SEQ ID NO: 1292206 - protein, 22 aa, Mycobacterium
IEPRPDQSFEFTVDVPGQVDIE

SEQ ID NO: 1292207 - protein, 22 aa, Mycobacterium
IEPRPDQTFEFTVDVPGQVDIE

SEQ ID NO: 1292208 - protein, 17 aa, Mycobacterium
IEQVEWEKLAQIALAAA

SEQ ID NO: 1292209 - protein, 21 aa, Mycobacterium
IETLPAFGRRAAVVELRGHGH

SEQ ID NO: 1292210 - protein, 22 aa, Mycobacterium
IEVIGGLGIRLSSYLPTRTFEL

SEQ ID NO: 1292211 - protein, 24 aa, Mycobacterium
IEVYWRPGCPFCRRLMRALRGSGL

SEQ ID NO: 1292212 - protein, 18 aa, Mycobacterium
IFATLGPLRRGDGFVLFC

SEQ ID NO: 1292213 - protein, 17 aa, Mycobacterium
IFSGLDLAIDRGSRVVV

SEQ ID NO: 1292214 - protein, 19 aa, Mycobacterium
IFTAALTRLGVDAADAVMV

SEQ ID NO: 1292215 - protein, 17 aa, Mycobacterium
IFVWRVEVRNHRELPER

SEQ ID NO: 1292216 - protein, 18 aa, Mycobacterium
IGCKRPTFSNSYFRTFTK

SEQ ID NO: 1292217 - protein, 22 aa, Mycobacterium
IGDGAPRFGMWLASGSGYVTEI

SEQ ID NO: 1292218 - protein, 22 aa, Mycobacterium
IGDIRFGEVFAHGAPLTHFTQI

SEQ ID NO: 1292219 - protein, 20 aa, Mycobacterium
IGGAWYPEWDVYRGGYRQDW

SEQ ID NO: 1292220 - protein, 17 aa, Mycobacterium
IGGFALWGSVAVKRKKR

SEQ ID NO: 1292221 - protein, 20 aa, Mycobacterium
IGGGMCFTFLAAQGLSVGSS

SEQ ID NO: 1292222 - protein, 22 aa, Mycobacterium
IGGRPILWHIMKIYETAGITDF

SEQ ID NO: 1292223 - protein, 19 aa, Mycobacterium
IGKGDRVILMLGNQVELWE

SEQ ID NO: 1292224 - protein, 17 aa, Mycobacterium
IGLSFARFLAARGARRI

SEQ ID NO: 1292225 - protein, 19 aa, Mycobacterium
IGMVRCRIPVVAAVNGPAV

SEQ ID NO: 1292226 - protein, 20 aa, Mycobacterium
IGQLCLLRLTSPAEHPYGSS

SEQ ID NO: 1292227 - protein, 17 aa, Mycobacterium
IGRRGTISPALATVGLG

SEQ ID NO: 1292228 - protein, 19 aa, Mycobacterium
IGVDGYRWMVRCVVNGPYE

SEQ ID NO: 1292229 - protein, 18 aa, Mycobacterium
IGWSDSWVKAAPGANPYA

SEQ ID NO: 1292230 - protein, 21 aa, Mycobacterium
IGYRPDYRWIEASAFDGGGRP

SEQ ID NO: 1292231 - protein, 18 aa, Mycobacterium
IHAGEAFGLPSIHEAIAF

SEQ ID NO: 1292232 - protein, 18 aa, Mycobacterium
IHFQEWWVRYRAKVPTHS

SEQ ID NO: 1292233 - protein, 23 aa, Mycobacterium
IHRRWPFKLVRLAAETVAREVER

SEQ ID NO: 1292234 - protein, 18 aa, Mycobacterium
IHYEIPWPNREMKTARPF

SEQ ID NO: 1292235 - protein, 18 aa, Mycobacterium
IIDRVAPVELIRLVNSGT

SEQ ID NO: 1292236 - protein, 17 aa, Mycobacterium
IITTSSLYSEIASAVFN

SEQ ID NO: 1292237 - protein, 17 aa, Mycobacterium
IKVARKWGVDVKGVKTP

SEQ ID NO: 1292238 - protein, 23 aa, Mycobacterium
IKVKGFRNTIHWRVTRYDEPKEI

SEQ ID NO: 1292239 - protein, 18 aa, Mycobacterium
IKVKGFRNVIHWRVTRYD

SEQ ID NO: 1292240 - protein, 19 aa, Mycobacterium
IKVLAVREVMRLLDGQAAG

SEQ ID NO: 1292241 - protein, 17 aa, Mycobacterium
ILANIALREGRDADIGL

SEQ ID NO: 1292242 - protein, 17 aa, Mycobacterium
ILAVQGWAQHHNQQLRA

SEQ ID NO: 1292243 - protein, 18 aa, Mycobacterium
ILDFYRCAMLPLSDDTAQ

SEQ ID NO: 1292244 - protein, 17 aa, Mycobacterium
ILDGHWVRFVIHPETVR

SEQ ID NO: 1292245 - protein, 22 aa, Mycobacterium
ILEQWGGGGVFVLDETLRPVPV

SEQ ID NO: 1292246 - protein, 24 aa, Mycobacterium
ILGSMCFPSFPGFAGRLFATEDAE

SEQ ID NO: 1292247 - protein, 25 aa, Mycobacterium
ILGSMCFPSFPGFAGRLFATEDAEF

SEQ ID NO: 1292248 - protein, 17 aa, Mycobacterium
ILGVKGRVLPMCPVGLG

SEQ ID NO: 1292249 - protein, 18 aa, Mycobacterium
ILIPALVGHGGWERLQRF

SEQ ID NO: 1292250 - protein, 24 aa, Mycobacterium
ILLPHFGAVWGRYVYDRLDIIRAN

SEQ ID NO: 1292251 - protein, 17 aa, Mycobacterium
ILLPRSRYDEGIEILKT

SEQ ID NO: 1292252 - protein, 17 aa, Mycobacterium
ILLPRSRYSEFVDALTT

SEQ ID NO: 1292253 - protein, 25 aa, Mycobacterium
ILLSSRFPMWMAWGPELTFFCNDAY

SEQ ID NO: 1292254 - protein, 23 aa, Mycobacterium
ILQWDLRFGMHVVDELSAHVGEP

SEQ ID NO: 1292255 - protein, 18 aa, Mycobacterium
ILRAGGWTAVDIRPVDVT

SEQ ID NO: 1292256 - protein, 23 aa, Mycobacterium
IMLRAPFRLARDVIVHMQPGSAI

SEQ ID NO: 1292257 - protein, 18 aa, Mycobacterium
IMSAVKPPAPLPAAPVAQ

SEQ ID NO: 1292258 - protein, 22 aa, Mycobacterium
INDEFPFLLGHEAAGTVESVGA

SEQ ID NO: 1292259 - protein, 25 aa, Mycobacterium
INEAFASVVLRFMKDLGLPHDIVNV

SEQ ID NO: 1292260 - protein, 23 aa, Mycobacterium
INEPRFPSFKGIMAAKKKEVTKL

SEQ ID NO: 1292261 - protein, 26 aa, Mycobacterium
INEYLFQFALSTAWMNGIPGGRAAKL

SEQ ID NO: 1292262 - protein, 17 aa, Mycobacterium
INFGRPAAGIAEFGHLC

SEQ ID NO: 1292263 - protein, 18 aa, Mycobacterium
INGAKAWITHGGIADFYS

SEQ ID NO: 1292264 - protein, 19 aa, Mycobacterium
INGLWCAPGGPTIAVLDFE

SEQ ID NO: 1292265 - protein, 17 aa, Mycobacterium
INSRLGTYTNFCNLFDM

SEQ ID NO: 1292266 - protein, 23 aa, Mycobacterium
INYPREFGIMTGLGSHTYDDSKS

SEQ ID NO: 1292267 - protein, 24 aa, Mycobacterium
IPADGRPSVMFGCRPRVQPPSQRY

SEQ ID NO: 1292268 - protein, 20 aa, Mycobacterium
IPAHAALRYSMRAAESVSLR

SEQ ID NO: 1292269 - protein, 17 aa, Mycobacterium
IPANLFIALANTPYNFF

SEQ ID NO: 1292270 - protein, 17 aa, Mycobacterium
IPCKDGHVRICILSRRQ

SEQ ID NO: 1292271 - protein, 24 aa, Mycobacterium
IPDEKFRYGFAIAPELVRTVVRDR

SEQ ID NO: 1292272 - protein, 21 aa, Mycobacterium
IPDVRRFGATYANYVGKPLSY

SEQ ID NO: 1292273 - protein, 21 aa, Mycobacterium
IPDVRRYGATYANYVGKPLSY

SEQ ID NO: 1292274 - protein, 18 aa, Mycobacterium
IPEGYRIQLDPSIDVDAI

SEQ ID NO: 1292275 - protein, 19 aa, Mycobacterium
IPEQLRYAAMMDPKELLTA

SEQ ID NO: 1292276 - protein, 20 aa, Mycobacterium
IPFTRHFYRYVAPRPLEEIQ

SEQ ID NO: 1292277 - protein, 17 aa, Mycobacterium
IPFVVGLGGTLRANSST

SEQ ID NO: 1292278 - protein, 22 aa, Mycobacterium
IPGEAPSNWCFFLGADDVDKTV

SEQ ID NO: 1292279 - protein, 21 aa, Mycobacterium
IPGREGEAWFLDEFGGFGKVA

SEQ ID NO: 1292280 - protein, 17 aa, Mycobacterium
IPLLVVITEGIPVQDTA

SEQ ID NO: 1292281 - protein, 17 aa, Mycobacterium
IPLNLVLIKGVHVLGFQ

SEQ ID NO: 1292282 - protein, 21 aa, Mycobacterium
IPLRVKAGAVGLLADEYHAQD

SEQ ID NO: 1292283 - protein, 17 aa, Mycobacterium
IPLTLAHVLPSAATQSW

SEQ ID NO: 1292284 - protein, 18 aa, Mycobacterium
IPMGFGYPIDHPDLPAIT

SEQ ID NO: 1292285 - protein, 17 aa, Mycobacterium
IPRARLVLFDGMGHELP

SEQ ID NO: 1292286 - protein, 19 aa, Mycobacterium
IPRMVDWIAARTRFFDDYF

SEQ ID NO: 1292287 - protein, 20 aa, Mycobacterium
IPSFPDLPGIHVLRNFDESL

SEQ ID NO: 1292288 - protein, 18 aa, Mycobacterium
IPSPLEWGCFTFGVIQHD

SEQ ID NO: 1292289 - protein, 19 aa, Mycobacterium
IQLARLVWRVQGLKFTVTG

SEQ ID NO: 1292290 - protein, 17 aa, Mycobacterium
IQQDWGISDEVMRDLVN

SEQ ID NO: 1292291 - protein, 18 aa, Mycobacterium
IQQRLGAAASAFAAGAIT

SEQ ID NO: 1292292 - protein, 20 aa, Mycobacterium
IQSAAAWAIIDCELPAPAED

SEQ ID NO: 1292293 - protein, 23 aa, Mycobacterium
IRADDGWENFGLYSASKAAVRSL

SEQ ID NO: 1292294 - protein, 18 aa, Mycobacterium
IRALCPAAKIFGVEPELA

SEQ ID NO: 1292295 - protein, 19 aa, Mycobacterium
IRALYLFKRTAWVPYSVTM

SEQ ID NO: 1292296 - protein, 19 aa, Mycobacterium
IRDGWLIKVWPGVYSRDEP

SEQ ID NO: 1292297 - protein, 17 aa, Mycobacterium
IRELMGFTWSPRQEWLH

SEQ ID NO: 1292298 - protein, 25 aa, Mycobacterium
IRFLLIEAPQRWRFVVTAHHILIDG

SEQ ID NO: 1292299 - protein, 17 aa, Mycobacterium
IRIAIAVLRAGVGDSVA

SEQ ID NO: 1292300 - protein, 17 aa, Mycobacterium
IRLLAAFDHRHIFIDPT

SEQ ID NO: 1292301 - protein, 20 aa, Mycobacterium
IRLMRWGLVPPWAKAGDDGS

SEQ ID NO: 1292302 - protein, 17 aa, Mycobacterium
IRLPIDIVLDANAVLTR

SEQ ID NO: 1292303 - protein, 18 aa, Mycobacterium
IRMADLQARVDLLRHALT

SEQ ID NO: 1292304 - protein, 18 aa, Mycobacterium
IRPDGLIYTIWESPGPIE

SEQ ID NO: 1292305 - protein, 21 aa, Mycobacterium
IRPRVEVELAFVLGEALRGPG

SEQ ID NO: 1292306 - protein, 19 aa, Mycobacterium
IRRPRWLLEFARSGRVPDL

SEQ ID NO: 1292307 - protein, 19 aa, Mycobacterium
IRRRVGLVFQDPFSSLNPR

SEQ ID NO: 1292308 - protein, 19 aa, Mycobacterium
IRRYLSYFPSSAWSYPPSS

SEQ ID NO: 1292309 - protein, 17 aa, Mycobacterium
IRTLFGVMFQDGALFGS

SEQ ID NO: 1292310 - protein, 21 aa, Mycobacterium
IRVNPGIGFPGWANYFPVTRA

SEQ ID NO: 1292311 - protein, 20 aa, Mycobacterium
IRWALDLLRKRFAKVIWVPG

SEQ ID NO: 1292312 - protein, 23 aa, Mycobacterium
IRYFRVPAGLTFRGQVAADIECI

SEQ ID NO: 1292313 - protein, 19 aa, Mycobacterium
IRYGVKHAFSAAGASTRQF

SEQ ID NO: 1292314 - protein, 17 aa, Mycobacterium
IRYSFAMASRAAAMSAC

SEQ ID NO: 1292315 - protein, 17 aa, Mycobacterium
ISARHLRRLWGLPRTQL

SEQ ID NO: 1292316 - protein, 27 aa, Mycobacterium
ISDLRAIPWVLAWSQSRVMLPGWYGTG

SEQ ID NO: 1292317 - protein, 17 aa, Mycobacterium
ISGELIVAVAMTEPGAG

SEQ ID NO: 1292318 - protein, 21 aa, Mycobacterium
ISLCGCWGCTLSFLDMDERIL

SEQ ID NO: 1292319 - protein, 21 aa, Mycobacterium
ISMHMGWGWGGYGVGPLKFAH

SEQ ID NO: 1292320 - protein, 23 aa, Mycobacterium
ISPLQARCGWAIGWKKDAFWGRD

SEQ ID NO: 1292321 - protein, 20 aa, Mycobacterium
ISPWGTWEWLGPNIVGGVVP

SEQ ID NO: 1292322 - protein, 18 aa, Mycobacterium
ISSARTAAQFGIEPKVAM

SEQ ID NO: 1292323 - protein, 18 aa, Mycobacterium
ISVALIARSAWHECHHHL

SEQ ID NO: 1292324 - protein, 21 aa, Mycobacterium
ISVDCARYWLDAERPISKDDA

SEQ ID NO: 1292325 - protein, 25 aa, Mycobacterium
ITAQMQARCPLAWTDTYGGHWVAAG

SEQ ID NO: 1292326 - protein, 18 aa, Mycobacterium
ITARPGFRGAASRARTPV

SEQ ID NO: 1292327 - protein, 17 aa, Mycobacterium
ITFDGFCVRSSYDEMRT

SEQ ID NO: 1292328 - protein, 17 aa, Mycobacterium
ITGICACGHQGVLPGII

SEQ ID NO: 1292329 - protein, 18 aa, Mycobacterium
ITLHAALELARRGGKYAV

SEQ ID NO: 1292330 - protein, 17 aa, Mycobacterium
ITLWPGMKIGQLCLLRL

SEQ ID NO: 1292331 - protein, 21 aa, Mycobacterium
ITPKSSWPWVRTLLHSVFDQP

SEQ ID NO: 1292332 - protein, 19 aa, Mycobacterium
IVAERRLWLAVLKAQAELG

SEQ ID NO: 1292333 - protein, 17 aa, Mycobacterium
IVDDIFLPLATHFGTNI

SEQ ID NO: 1292334 - protein, 19 aa, Mycobacterium
IVDHWDMFETIRFDLNLVV

SEQ ID NO: 1292335 - protein, 19 aa, Mycobacterium
IVGERSVFCPPRVLLPESP

SEQ ID NO: 1292336 - protein, 18 aa, Mycobacterium
IVGGAAWDGLKAIGRRIS

SEQ ID NO: 1292337 - protein, 18 aa, Mycobacterium
IVKFSGCYHGHSDALLAD

SEQ ID NO: 1292338 - protein, 23 aa, Mycobacterium
IVKGLRTGTDFEYELQMAQMNNH

SEQ ID NO: 1292339 - protein, 19 aa, Mycobacterium
IVPCQDGYIRICLLAKRQW

SEQ ID NO: 1292340 - protein, 21 aa, Mycobacterium
IVRRLCWDWKPVEGVDATAAA

SEQ ID NO: 1292341 - protein, 18 aa, Mycobacterium
IVSIEAFEHFGFERYDDF

SEQ ID NO: 1292342 - protein, 23 aa, Mycobacterium
IVSRGGSIMAAWCLAHHRESFLY

SEQ ID NO: 1292343 - protein, 19 aa, Mycobacterium
IVTAFPFRLIEVWQSHRAP

SEQ ID NO: 1292344 - protein, 19 aa, Mycobacterium
IVVLEARFAGFGASGRNGG

SEQ ID NO: 1292345 - protein, 20 aa, Mycobacterium
IVVLGDAWGLLKFLDEGAFV

SEQ ID NO: 1292346 - protein, 19 aa, Mycobacterium
IVVPRWWKALWYLERLSPA

SEQ ID NO: 1292347 - protein, 17 aa, Mycobacterium
IWHKGWFASAVHAASPS

SEQ ID NO: 1292348 - protein, 19 aa, Mycobacterium
IWLTPQWDADFGVAHGLPV

SEQ ID NO: 1292349 - protein, 18 aa, Mycobacterium
IWVAIAVATDAQWDALCA

SEQ ID NO: 1292350 - protein, 18 aa, Mycobacterium
IYADLGLRFDGERAETIA

SEQ ID NO: 1292351 - protein, 26 aa, Mycobacterium
IYEDLAWFCIRAWRFGAPETLGAGGL

SEQ ID NO: 1292352 - protein, 24 aa, Mycobacterium
IYRRWPDIRWVIAELLTVRITGVL

SEQ ID NO: 1292353 - protein, 18 aa, Mycobacterium
IYVAEWLGRLGSLPIALI

SEQ ID NO: 1292354 - protein, 20 aa, Mycobacterium
IYWLSLPLDYGLAGRTPSGT

SEQ ID NO: 1292355 - protein, 21 aa, Mycobacterium
KACPVTWPWNLLGWPSINVPA

SEQ ID NO: 1292356 - protein, 19 aa, Mycobacterium
KADDSLVRWRHLERAHIVS

SEQ ID NO: 1292357 - protein, 21 aa, Mycobacterium
KAFAFAGGRLGYLVAAPAVIE

SEQ ID NO: 1292358 - protein, 20 aa, Mycobacterium
KAGDIGAAFTTLASTVITGP

SEQ ID NO: 1292359 - protein, 19 aa, Mycobacterium
KAGEAWDRLATVYQTTTVA

SEQ ID NO: 1292360 - protein, 20 aa, Mycobacterium
KAGVIGLTIAAARDLSSVGI

SEQ ID NO: 1292361 - protein, 17 aa, Mycobacterium
KAICRSCPRRWLCAREA

SEQ ID NO: 1292362 - protein, 23 aa, Mycobacterium
KAIWRVNELLNWQVAASGETIAV

SEQ ID NO: 1292363 - protein, 17 aa, Mycobacterium
KALGFYCDCAVLRDSPL

SEQ ID NO: 1292364 - protein, 18 aa, Mycobacterium
KAMIPRAKGSIVNIGSYA

SEQ ID NO: 1292365 - protein, 17 aa, Mycobacterium
KANELALAWLVRGDINI

SEQ ID NO: 1292366 - protein, 21 aa, Mycobacterium
KAPRPALQLLLYPVTHYDAET

SEQ ID NO: 1292367 - protein, 26 aa, Mycobacterium
KARFGDGVWWCELAALADDAAVGHAV

SEQ ID NO: 1292368 - protein, 22 aa, Mycobacterium
KARLRPDLRIHLAAAEAEFWAA

SEQ ID NO: 1292369 - protein, 19 aa, Mycobacterium
KARNARAWHHAVAAAELHT

SEQ ID NO: 1292370 - protein, 20 aa, Mycobacterium
KARYAFGYGDFRRVHRTGLI

SEQ ID NO: 1292371 - protein, 17 aa, Mycobacterium
KATCPPVSIAMAGALNG

SEQ ID NO: 1292372 - protein, 21 aa, Mycobacterium
KATEVGLTWIAEIGAHGVVAG

SEQ ID NO: 1292373 - protein, 20 aa, Mycobacterium
KAVGVAIKWMSKFNTWAYKA

SEQ ID NO: 1292374 - protein, 23 aa, Mycobacterium
KAVPSRLAWETGVAMADSLLERY

SEQ ID NO: 1292375 - protein, 19 aa, Mycobacterium
KAWLIGVGEDGEWPLFLDA

SEQ ID NO: 1292376 - protein, 17 aa, Mycobacterium
KCTPCREGTYWLAQIYE

SEQ ID NO: 1292377 - protein, 18 aa, Mycobacterium
KDFRMWVCLHEVTHRVQF

SEQ ID NO: 1292378 - protein, 19 aa, Mycobacterium
KDGDRIAGAFGYYRETGKF

SEQ ID NO: 1292379 - protein, 20 aa, Mycobacterium
KDGYDASGVTFVLLGNGARN

SEQ ID NO: 1292380 - protein, 18 aa, Mycobacterium
KDIKGARVLALLGDSVTT

SEQ ID NO: 1292381 - protein, 18 aa, Mycobacterium
KDILQGECTFAWPPQFEL

SEQ ID NO: 1292382 - protein, 24 aa, Mycobacterium
KDRFAGDAQFDWGRAEAAQDAGQT

SEQ ID NO: 1292383 - protein, 19 aa, Mycobacterium
KDRWSMEWYYPVLGGALRG

SEQ ID NO: 1292384 - protein, 22 aa, Mycobacterium
KDSKISTVWTWPDRPGVAGCAA

SEQ ID NO: 1292385 - protein, 17 aa, Mycobacterium
KDVFVGAVFDWVVADIA

SEQ ID NO: 1292386 - protein, 19 aa, Mycobacterium
KDVHIGPSDHVGWLDDRKW

SEQ ID NO: 1292387 - protein, 22 aa, Mycobacterium
KDWRLRIAKEMNVPAYVVFTDN

SEQ ID NO: 1292388 - protein, 20 aa, Mycobacterium
KDYALWPALSLRRWRRTLKA

SEQ ID NO: 1292389 - protein, 17 aa, Mycobacterium
KEEFDAIGVPFNKRGRI

SEQ ID NO: 1292390 - protein, 20 aa, Mycobacterium
KEIAGRLAARIGSGILSDVV

SEQ ID NO: 1292391 - protein, 19 aa, Mycobacterium
KEIRHWLQVFAQRFYSFSQ

SEQ ID NO: 1292392 - protein, 21 aa, Mycobacterium
KELCRRWYPRIYFGQPEKGLA

SEQ ID NO: 1292393 - protein, 19 aa, Mycobacterium
KELHLRLGAATAELSQRLG

SEQ ID NO: 1292394 - protein, 25 aa, Mycobacterium
KELRLRPGDWYVIHSYAGYENKVKA

SEQ ID NO: 1292395 - protein, 19 aa, Mycobacterium
KELVIPPAWKDVWISPKPS

SEQ ID NO: 1292396 - protein, 20 aa, Mycobacterium
KEQLTRLAAELGPASGVSGT

SEQ ID NO: 1292397 - protein, 19 aa, Mycobacterium
KFKSFGGWLQTLAGKWTQL

SEQ ID NO: 1292398 - protein, 18 aa, Mycobacterium
KFMGRWRSGAPLVLCPDA

SEQ ID NO: 1292399 - protein, 18 aa, Mycobacterium
KFPDFFRKQLLTMAKHRL

SEQ ID NO: 1292400 - protein, 19 aa, Mycobacterium
KFPGCAVVISHDRWFLDRT

SEQ ID NO: 1292401 - protein, 19 aa, Mycobacterium
KFPPFPFNVVFAMLRGQVS

SEQ ID NO: 1292402 - protein, 20 aa, Mycobacterium
KFTAALARREVTVWASDRSI

SEQ ID NO: 1292403 - protein, 17 aa, Mycobacterium
KGAAYGIATPISDIVVP

SEQ ID NO: 1292404 - protein, 22 aa, Mycobacterium
KGCTHPGCTVPFYWTEAHHAHD

SEQ ID NO: 1292405 - protein, 25 aa, Mycobacterium
KGCTHPQCTVPFYWTEVHHTHDYSQ

SEQ ID NO: 1292406 - protein, 20 aa, Mycobacterium
KGDGLLVVFGYPIAHENDVR

SEQ ID NO: 1292407 - protein, 18 aa, Mycobacterium
KGEVKDVLLLDVTPLSLG

SEQ ID NO: 1292408 - protein, 18 aa, Mycobacterium
KGFHGFRLTEFFAGYPDA

SEQ ID NO: 1292409 - protein, 19 aa, Mycobacterium
KGGLPRGVSISVTDETGVQ

SEQ ID NO: 1292410 - protein, 22 aa, Mycobacterium
KGIRKWVWERLAGTLFAQKATD

SEQ ID NO: 1292411 - protein, 22 aa, Mycobacterium
KGKRYALPHARILMHQPLGGIT

SEQ ID NO: 1292412 - protein, 23 aa, Mycobacterium
KGPFRIAMSVGIPIVPIVIRNAE

SEQ ID NO: 1292413 - protein, 22 aa, Mycobacterium
KGSALVPSWVAFAVIGLLEQHF

SEQ ID NO: 1292414 - protein, 18 aa, Mycobacterium
KGSGQGWLTAEYAMLPAA

SEQ ID NO: 1292415 - protein, 18 aa, Mycobacterium
KGSVLWSLIAGIAPAVKT

SEQ ID NO: 1292416 - protein, 24 aa, Mycobacterium
KGTFRLAFGIGDFRRDTGFGDNPM

SEQ ID NO: 1292417 - protein, 17 aa, Mycobacterium
KGVRFSYRWDFGRNRFI

SEQ ID NO: 1292418 - protein, 17 aa, Mycobacterium
KGWTLAEAERWLAPNLG

SEQ ID NO: 1292419 - protein, 22 aa, Mycobacterium
KHHRIGFPFNWVTNLADDASGS

SEQ ID NO: 1292420 - protein, 20 aa, Mycobacterium
KHQKYPLGYVRWTEHENLRE

SEQ ID NO: 1292421 - protein, 25 aa, Mycobacterium
KHRLARSLFLYGLCNGWICEGTTVI

SEQ ID NO: 1292422 - protein, 23 aa, Mycobacterium
KHWSARIAMGWEWARVGVSFDPG

SEQ ID NO: 1292423 - protein, 21 aa, Mycobacterium
KHYGVAVAICPARRGNRKGVV

SEQ ID NO: 1292424 - protein, 20 aa, Mycobacterium
KHYGVSVAICPPRSGHRKGG

SEQ ID NO: 1292425 - protein, 17 aa, Mycobacterium
KIAGRWGAVSLPVGGAN

SEQ ID NO: 1292426 - protein, 17 aa, Mycobacterium
KIDAVFMPGDLVNVPDR

SEQ ID NO: 1292427 - protein, 20 aa, Mycobacterium
KIEKGEFVFLIGPSGSGKST

SEQ ID NO: 1292428 - protein, 21 aa, Mycobacterium
KIERRGWHALLTLALNGDVDL

SEQ ID NO: 1292429 - protein, 23 aa, Mycobacterium
KIRLPLGQGISGWVASNREPVVI

SEQ ID NO: 1292430 - protein, 17 aa, Mycobacterium
KIYVHFMPATGLKAGES

SEQ ID NO: 1292431 - protein, 18 aa, Mycobacterium
KKFERLWLSWAMANRDAS

SEQ ID NO: 1292432 - protein, 18 aa, Mycobacterium
KKHMAFGVGMHRCLGSHY

SEQ ID NO: 1292433 - protein, 21 aa, Mycobacterium
KKLPSWKVVVPPGQAVAGYYY

SEQ ID NO: 1292434 - protein, 20 aa, Mycobacterium
KKPRSAWRRFVYPAPNACWQ

SEQ ID NO: 1292435 - protein, 19 aa, Mycobacterium
KKPSLAWAETYPGTLSYYL

SEQ ID NO: 1292436 - protein, 18 aa, Mycobacterium
KKSEPEWMLDIRLKALRT

SEQ ID NO: 1292437 - protein, 17 aa, Mycobacterium
KKWLAEVLPNFPAYSHL

SEQ ID NO: 1292438 - protein, 21 aa, Mycobacterium
KLAELQRLWLIEAVKYDVLPI

SEQ ID NO: 1292439 - protein, 18 aa, Mycobacterium
KLFRVCLDDAPGQVVGVS

SEQ ID NO: 1292440 - protein, 22 aa, Mycobacterium
KLGRGCVWSGEIAPCIHQNHVF

SEQ ID NO: 1292441 - protein, 17 aa, Mycobacterium
KLGTSFRNAETIVAVAR

SEQ ID NO: 1292442 - protein, 18 aa, Mycobacterium
KLGWSRRLAPLMRRWALR

SEQ ID NO: 1292443 - protein, 18 aa, Mycobacterium
KLHHPAAFCAALLRAQPM

SEQ ID NO: 1292444 - protein, 18 aa, Mycobacterium
KLLTAVAVAAGWPGGDGG

SEQ ID NO: 1292445 - protein, 19 aa, Mycobacterium
KLMWRICKIDGPPSRYRSE

SEQ ID NO: 1292446 - protein, 20 aa, Mycobacterium
KLREAVGIVTDWLKRHDFAG

SEQ ID NO: 1292447 - protein, 20 aa, Mycobacterium
KLREIRMALTLDKTFTKPEI

SEQ ID NO: 1292448 - protein, 21 aa, Mycobacterium
KLRVREILEFAIGFLDEDPRR

SEQ ID NO: 1292449 - protein, 20 aa, Mycobacterium
KLTFELARFIKFMITEIFPG

SEQ ID NO: 1292450 - protein, 19 aa, Mycobacterium
KLVGGTCVNYGCIPTKTLV

SEQ ID NO: 1292451 - protein, 19 aa, Mycobacterium
KLVPFGAFVRVEEGIEGLV

SEQ ID NO: 1292452 - protein, 24 aa, Mycobacterium
KLVPTGAIPPMFDPGSPVLQRASV

SEQ ID NO: 1292453 - protein, 20 aa, Mycobacterium
KLWEGLRQLYPVGIDHHDLI

SEQ ID NO: 1292454 - protein, 24 aa, Mycobacterium
KLWPFADLTPFAAFGWEARGGYGD

SEQ ID NO: 1292455 - protein, 18 aa, Mycobacterium
KMARRFLTFNGWLLQCGE

SEQ ID NO: 1292456 - protein, 18 aa, Mycobacterium
KMGLGRPGTLHAFEHDGV

SEQ ID NO: 1292457 - protein, 18 aa, Mycobacterium
KNLIHDWFTFPFLPEAHE

SEQ ID NO: 1292458 - protein, 23 aa, Mycobacterium
KNLPGVAFAHDWITSADRYRGTL

SEQ ID NO: 1292459 - protein, 24 aa, Mycobacterium
KPAFEWLQQIPVLGRFVVTPIVHL

SEQ ID NO: 1292460 - protein, 18 aa, Mycobacterium
KPFVAGPVATDWLTAVQQ

SEQ ID NO: 1292461 - protein, 17 aa, Mycobacterium
KPGMTLLDIGCGWGSVL

SEQ ID NO: 1292462 - protein, 19 aa, Mycobacterium
KPKSLFGIIGGYLRDQVRA

SEQ ID NO: 1292463 - protein, 18 aa, Mycobacterium
KPLGMPLQYMVSGMAVAA

SEQ ID NO: 1292464 - protein, 17 aa, Mycobacterium
KPLKYPHMFAAAGLIIV

SEQ ID NO: 1292465 - protein, 17 aa, Mycobacterium
KPLKYPHMFAAAGLVLI

SEQ ID NO: 1292466 - protein, 20 aa, Mycobacterium
KPLRVPVWMMRQAGRSLPEY

SEQ ID NO: 1292467 - protein, 18 aa, Mycobacterium
KPLYGGSLVTGWATLHGY

SEQ ID NO: 1292468 - protein, 18 aa, Mycobacterium
KPVGGFPVTVGWIHAIRR

SEQ ID NO: 1292469 - protein, 18 aa, Mycobacterium
KPVICLVNGWAAGGGHSL

SEQ ID NO: 1292470 - protein, 20 aa, Mycobacterium
KQLYIGFNFGESLVASLVFN

SEQ ID NO: 1292471 - protein, 18 aa, Mycobacterium
KREIPHYYLANEILLDAS

SEQ ID NO: 1292472 - protein, 19 aa, Mycobacterium
KRFGAEFDRPVARMTEMIG

SEQ ID NO: 1292473 - protein, 20 aa, Mycobacterium
KRFNLSWAIEGTRSRTGKML

SEQ ID NO: 1292474 - protein, 21 aa, Mycobacterium
KRIFGSGAMEFSAKRTSADAV

SEQ ID NO: 1292475 - protein, 19 aa, Mycobacterium
KRIQREVGITFIYVTHDQE

SEQ ID NO: 1292476 - protein, 19 aa, Mycobacterium
KRLGLDPILMEAGLLGESM

SEQ ID NO: 1292477 - protein, 19 aa, Mycobacterium
KRPTFSNSYFRTFTKPHVH

SEQ ID NO: 1292478 - protein, 19 aa, Mycobacterium
KRRMFDLLVKMGYKEIEVG

SEQ ID NO: 1292479 - protein, 18 aa, Mycobacterium
KRYGAAFDRPVERMKEMV

SEQ ID NO: 1292480 - protein, 19 aa, Mycobacterium
KSALPWGDFDAHLEHMREL

SEQ ID NO: 1292481 - protein, 17 aa, Mycobacterium
KSEPVHWVDVPGGTGGF

SEQ ID NO: 1292482 - protein, 18 aa, Mycobacterium
KSRRVVPIDGWLADDLRA

SEQ ID NO: 1292483 - protein, 21 aa, Mycobacterium
KSSGIGARFGGPEGLRKYCRI

SEQ ID NO: 1292484 - protein, 18 aa, Mycobacterium
KSTLALDFMRSCSIKHGM

SEQ ID NO: 1292485 - protein, 19 aa, Mycobacterium
KTHCKTCLVVRREGSTIRR

SEQ ID NO: 1292486 - protein, 25 aa, Mycobacterium
KTHRAVIVDEGWRTGSLAAEISTQI

SEQ ID NO: 1292487 - protein, 19 aa, Mycobacterium
KTKSPGAVAVWDRAWAEFV

SEQ ID NO: 1292488 - protein, 18 aa, Mycobacterium
KTNVSWADGTTITMTETA

SEQ ID NO: 1292489 - protein, 19 aa, Mycobacterium
KTRKCVFCSKKGKNQDIDY

SEQ ID NO: 1292490 - protein, 23 aa, Mycobacterium
KTTARLGWDWPHPSSIVKINLDV

SEQ ID NO: 1292491 - protein, 25 aa, Mycobacterium
KTTLKWRFPYGFLDQGQSTPIRMPT

SEQ ID NO: 1292492 - protein, 21 aa, Mycobacterium
KVARFLLGLARRYGEQRFFGS

SEQ ID NO: 1292493 - protein, 17 aa, Mycobacterium
KVIPGREGEAWFLDEFG

SEQ ID NO: 1292494 - protein, 25 aa, Mycobacterium
KVPFFTDGIPPFFLTPGLDVERSEF

SEQ ID NO: 1292495 - protein, 19 aa, Mycobacterium
KVPGARCALAWSPETASLA

SEQ ID NO: 1292496 - protein, 18 aa, Mycobacterium
KVPRRLKELHLRLGAATA

SEQ ID NO: 1292497 - protein, 21 aa, Mycobacterium
KVRGGAIFRPVFNQLNVEVGF

SEQ ID NO: 1292498 - protein, 17 aa, Mycobacterium
KVSELYDRIGFAAVGRF

SEQ ID NO: 1292499 - protein, 20 aa, Mycobacterium
KVVVFRPLYAVGGQDLGYLP

SEQ ID NO: 1292500 - protein, 25 aa, Mycobacterium
KWATFPMLALHGWAQHHDVPLRAVV

SEQ ID NO: 1292501 - protein, 21 aa, Mycobacterium
KWATYPILAVQGWAQHHNQQL

SEQ ID NO: 1292502 - protein, 19 aa, Mycobacterium
KWKLAIVLEQGFQRAGDDE

SEQ ID NO: 1292503 - protein, 20 aa, Mycobacterium
KWRKWLYFDCNWKVALEAFN

SEQ ID NO: 1292504 - protein, 24 aa, Mycobacterium
KYAIEHWTRLPVEVELASEFRYRD

SEQ ID NO: 1292505 - protein, 21 aa, Mycobacterium
KYEHELCAFDGLGLSDLDMDS

SEQ ID NO: 1292506 - protein, 19 aa, Mycobacterium
KYGLRRYVEFGAHVDRALW

SEQ ID NO: 1292507 - protein, 19 aa, Mycobacterium
KYHAWRYALDGELTFIQQE

SEQ ID NO: 1292508 - protein, 17 aa, Mycobacterium
KYPELFGALVCSVPLLD

SEQ ID NO: 1292509 - protein, 18 aa, Mycobacterium
KYRRLHVIVGDSNMCEST

SEQ ID NO: 1292510 - protein, 18 aa, Mycobacterium
LAAEAGLPAGVFNVVTGS

SEQ ID NO: 1292511 - protein, 17 aa, Mycobacterium
LAAELVAPLGPVLVEAA

SEQ ID NO: 1292512 - protein, 20 aa, Mycobacterium
LAAFRRAGGRIVEMVPHTTD

SEQ ID NO: 1292513 - protein, 19 aa, Mycobacterium
LAAHFFLTFPQLHDVRFDY

SEQ ID NO: 1292514 - protein, 17 aa, Mycobacterium
LAALSILIGAVGATGPG

SEQ ID NO: 1292515 - protein, 23 aa, Mycobacterium
LAALWKLPVVFIVEDNGWGVSVS

SEQ ID NO: 1292516 - protein, 18 aa, Mycobacterium
LAARLGIDPFEFRRRNVV

SEQ ID NO: 1292517 - protein, 24 aa, Mycobacterium
LAARWGDRERPLWIKPENLQPIGA

SEQ ID NO: 1292518 - protein, 18 aa, Mycobacterium
LAAVEAFFGAGAQRQLDV

SEQ ID NO: 1292519 - protein, 17 aa, Mycobacterium
LAAVLGYADSSALNPAV

SEQ ID NO: 1292520 - protein, 18 aa, Mycobacterium
LACPCGPATGSFAEEYTA

SEQ ID NO: 1292521 - protein, 18 aa, Mycobacterium
LACVGGFVPVVLYKDDHD

SEQ ID NO: 1292522 - protein, 18 aa, Mycobacterium
LADCRRLGITVLPPDVNE

SEQ ID NO: 1292523 - protein, 22 aa, Mycobacterium
LADLLWRMGIRTIGQFSALSRT

SEQ ID NO: 1292524 - protein, 18 aa, Mycobacterium
LADMKARIDAARLLVYRA

SEQ ID NO: 1292525 - protein, 21 aa, Mycobacterium
LAEAAADVFLLPVGDDLVLVQ

SEQ ID NO: 1292526 - protein, 19 aa, Mycobacterium
LAEAMIPLAMWGARHQMSH

SEQ ID NO: 1292527 - protein, 22 aa, Mycobacterium
LAEDRPGPGLARGECGDPPKTA

SEQ ID NO: 1292528 - protein, 17 aa, Mycobacterium
LAEEAGLAAEHWRTLID

SEQ ID NO: 1292529 - protein, 24 aa, Mycobacterium
LAEEILTPLGFRWTNYGVAAQDVP

SEQ ID NO: 1292530 - protein, 19 aa, Mycobacterium
LAEHEMPGLMALRHEYAEV

SEQ ID NO: 1292531 - protein, 18 aa, Mycobacterium
LAELLPGCTGLDVVDSVY

SEQ ID NO: 1292532 - protein, 18 aa, Mycobacterium
LAEMPPFLTGGSMIETVT

SEQ ID NO: 1292533 - protein, 26 aa, Mycobacterium
LAERVGWRWRLVWFRAVSELLTADYD

SEQ ID NO: 1292534 - protein, 18 aa, Mycobacterium
LAEVMPWNQLPGAVRRVT

SEQ ID NO: 1292535 - protein, 24 aa, Mycobacterium
LAGFGAPAHRVWLPPLSRAPALDA

SEQ ID NO: 1292536 - protein, 37 aa, Mycobacterium
LAGPIGALLLWRAGLADSIRTIFGFGRAAAESQVSDL

SEQ ID NO: 1292537 - protein, 18 aa, Mycobacterium
LAGRRALVTGGSRGIGAE

SEQ ID NO: 1292538 - protein, 17 aa, Mycobacterium
LAGVFGFLECIDLLSDY

SEQ ID NO: 1292539 - protein, 18 aa, Mycobacterium
LAHPGLVCDVAIGQSTLV

SEQ ID NO: 1292540 - protein, 17 aa, Mycobacterium
LAIECLRQLVDAAPQVF

SEQ ID NO: 1292541 - protein, 18 aa, Mycobacterium
LAIPELPDELFIRSLREL

SEQ ID NO: 1292542 - protein, 19 aa, Mycobacterium
LAKACARIMLGATIAQLRE

SEQ ID NO: 1292543 - protein, 20 aa, Mycobacterium
LALAWLLKRSPVMLPIPGTS

SEQ ID NO: 1292544 - protein, 20 aa, Mycobacterium
LALDEWRLLTGAALVGLVEE

SEQ ID NO: 1292545 - protein, 18 aa, Mycobacterium
LALDVWVAYELRRAGLDP

SEQ ID NO: 1292546 - protein, 24 aa, Mycobacterium
LALELWPGKAYPLGATYDGSGTNF

SEQ ID NO: 1292547 - protein, 18 aa, Mycobacterium
LALEVSWEALEHAGVPPR

SEQ ID NO: 1292548 - protein, 24 aa, Mycobacterium
LALLRLNALLARACGDAASYRRWR

SEQ ID NO: 1292549 - protein, 22 aa, Mycobacterium
LALNCDIAPWGRFARKNYFYPD

SEQ ID NO: 1292550 - protein, 17 aa, Mycobacterium
LALWQKHIERILAEWVD

SEQ ID NO: 1292551 - protein, 25 aa, Mycobacterium
LALWRTCLRPPVPVRDDLELSYYAT

SEQ ID NO: 1292552 - protein, 23 aa, Mycobacterium
LAMGHAMIRAGLAIKDHGRPWRP

SEQ ID NO: 1292553 - protein, 25 aa, Mycobacterium
LAMGHAMIRAGLVLADWRPDIVHAH

SEQ ID NO: 1292554 - protein, 17 aa, Mycobacterium
LAMIDPWPAGYYGAQDH

SEQ ID NO: 1292555 - protein, 23 aa, Mycobacterium
LAMPRLDMVTGLYFLTTEIEGDT

SEQ ID NO: 1292556 - protein, 18 aa, Mycobacterium
LAMTEIPDLLAPSDTDPV

SEQ ID NO: 1292557 - protein, 25 aa, Mycobacterium
LANLRRWLHEWADVYDAHAAVFAEF

SEQ ID NO: 1292558 - protein, 18 aa, Mycobacterium
LAPLALAPRGIWFAPKDL

SEQ ID NO: 1292559 - protein, 17 aa, Mycobacterium
LAPVTVCTFARFLRQWM

SEQ ID NO: 1292560 - protein, 17 aa, Mycobacterium
LAQAYSLVVSAEVTAEL

SEQ ID NO: 1292561 - protein, 18 aa, Mycobacterium
LARLGKRVLRPGGLELTS

SEQ ID NO: 1292562 - protein, 23 aa, Mycobacterium
LARRADVFLTSFLPGHRQKFGID

SEQ ID NO: 1292563 - protein, 22 aa, Mycobacterium
LARRPELRAALLGDPDGIAGFV

SEQ ID NO: 1292564 - protein, 17 aa, Mycobacterium
LARSRRALAEFNVEGLA

SEQ ID NO: 1292565 - protein, 21 aa, Mycobacterium
LASDMGEFFMPFPGTRVNQST

SEQ ID NO: 1292566 - protein, 19 aa, Mycobacterium
LASILSWQNWEEMFSIARF

SEQ ID NO: 1292567 - protein, 17 aa, Mycobacterium
LASRAAGAAVVWANDEL

SEQ ID NO: 1292568 - protein, 20 aa, Mycobacterium
LASYLERIAETWPRRQQPAY

SEQ ID NO: 1292569 - protein, 17 aa, Mycobacterium
LATELARAMSPVSFSAV

SEQ ID NO: 1292570 - protein, 18 aa, Mycobacterium
LATLPARYAVSVGDAGLI

SEQ ID NO: 1292571 - protein, 19 aa, Mycobacterium
LATPIRMFERAVFDFGGSP

SEQ ID NO: 1292572 - protein, 17 aa, Mycobacterium
LATRLIVDAGILITNVA

SEQ ID NO: 1292573 - protein, 18 aa, Mycobacterium
LAVKACFAAFRTGKLDHH

SEQ ID NO: 1292574 - protein, 18 aa, Mycobacterium
LAVMLRRRMAQAGMDTGG

SEQ ID NO: 1292575 - protein, 25 aa, Mycobacterium
LAVVHPGWWSRRRVQAVLDAAGDIC

SEQ ID NO: 1292576 - protein, 20 aa, Mycobacterium
LAVVLRATWAVARVLTDRGL

SEQ ID NO: 1292577 - protein, 18 aa, Mycobacterium
LAYPRLQFSPLHTWVTDT

SEQ ID NO: 1292578 - protein, 19 aa, Mycobacterium
LCAERGWTVVEVFCDNDRS

SEQ ID NO: 1292579 - protein, 20 aa, Mycobacterium
LCDRVRAGWKVTVLVPPGHD

SEQ ID NO: 1292580 - protein, 18 aa, Mycobacterium
LCRLHHLLKTFGGWKDQQ

SEQ ID NO: 1292581 - protein, 20 aa, Mycobacterium
LCRRGVCGECRVPVSGGAIT

SEQ ID NO: 1292582 - protein, 19 aa, Mycobacterium
LCSCYPWTLLGIPPAWFKY

SEQ ID NO: 1292583 - protein, 17 aa, Mycobacterium
LCTLELAGRLHLDLASL

SEQ ID NO: 1292584 - protein, 19 aa, Mycobacterium
LCTLREGLLYALVPDRSGF

SEQ ID NO: 1292585 - protein, 22 aa, Mycobacterium
LCTSPLRRCRDGNLYGGTEPAR

SEQ ID NO: 1292586 - protein, 17 aa, Mycobacterium
LDAALAYVRFALANPGH

SEQ ID NO: 1292587 - protein, 17 aa, Mycobacterium
LDAFWAQVMRLRDLLKF

SEQ ID NO: 1292588 - protein, 18 aa, Mycobacterium
LDCALRWMRDFHADGLRL

SEQ ID NO: 1292589 - protein, 20 aa, Mycobacterium
LDCFKRFSDVNFDRWQKVID

SEQ ID NO: 1292590 - protein, 23 aa, Mycobacterium
LDDLKMRALDVLSRYQQHSTELQ

SEQ ID NO: 1292591 - protein, 23 aa, Mycobacterium
LDEPRRPFSWCQGADPSVAELVG

SEQ ID NO: 1292592 - protein, 26 aa, Mycobacterium
LDFAARPGLLASFPFPHLLTLDVTLL

SEQ ID NO: 1292593 - protein, 17 aa, Mycobacterium
LDFDYVDLFLIHWPLPT

SEQ ID NO: 1292594 - protein, 17 aa, Mycobacterium
LDFGLKYGDQAQEFASA

SEQ ID NO: 1292595 - protein, 25 aa, Mycobacterium
LDGFPDKRVRLMLEMHLLAPLHLSQ

SEQ ID NO: 1292596 - protein, 25 aa, Mycobacterium
LDGICGPGGWVPRGALGNVPVRFPV

SEQ ID NO: 1292597 - protein, 18 aa, Mycobacterium
LDGLGYRGFWMGYFAARS

SEQ ID NO: 1292598 - protein, 19 aa, Mycobacterium
LDGWLLRHGQGVTRRANSA

SEQ ID NO: 1292599 - protein, 17 aa, Mycobacterium
LDGWLRELTATIVAAQT

SEQ ID NO: 1292600 - protein, 21 aa, Mycobacterium
LDIGCGWGSTIARAVEKYDVN

SEQ ID NO: 1292601 - protein, 18 aa, Mycobacterium
LDIGCGWGSVLQRAVEKH

SEQ ID NO: 1292602 - protein, 19 aa, Mycobacterium
LDLACRWAKDRDVFGGKLA

SEQ ID NO: 1292603 - protein, 19 aa, Mycobacterium
LDLAFRICEVFDLPVEAVF

SEQ ID NO: 1292604 - protein, 17 aa, Mycobacterium
LDLAMRVPYGFVSSRHG

SEQ ID NO: 1292605 - protein, 22 aa, Mycobacterium
LDMLLDFMPRYGVEWDGCRRVS

SEQ ID NO: 1292606 - protein, 17 aa, Mycobacterium
LDMTVCYAGQREQFGTP

SEQ ID NO: 1292607 - protein, 18 aa, Mycobacterium
LDPWGAMVADVFAREIAD

SEQ ID NO: 1292608 - protein, 17 aa, Mycobacterium
LDRACLLGCGFITGWGS

SEQ ID NO: 1292609 - protein, 22 aa, Mycobacterium
LDRERCVLCARCTRFSDQIAGD

SEQ ID NO: 1292610 - protein, 17 aa, Mycobacterium
LDRGGLLHWARPIAPLI

SEQ ID NO: 1292611 - protein, 20 aa, Mycobacterium
LDRHRFGCTVSRAAWNPTES

SEQ ID NO: 1292612 - protein, 23 aa, Mycobacterium
LDRLTARHDVMWAMIADMPAVEA

SEQ ID NO: 1292613 - protein, 18 aa, Mycobacterium
LDRPFGIGLVHWVVEARP

SEQ ID NO: 1292614 - protein, 17 aa, Mycobacterium
LDSGMVWVNNWHVIHPA

SEQ ID NO: 1292615 - protein, 18 aa, Mycobacterium
LDSKHSFSFGSHYEPDNT

SEQ ID NO: 1292616 - protein, 26 aa, Mycobacterium
LDTDLRWRIVTALARAGVIDADGTQT

SEQ ID NO: 1292617 - protein, 26 aa, Mycobacterium
LDTEPWRGEPLLSFLRKMVFWADVVV

SEQ ID NO: 1292618 - protein, 17 aa, Mycobacterium
LDTMGWRVGASGFQLIL

SEQ ID NO: 1292619 - protein, 18 aa, Mycobacterium
LDVDLRWVAALLLRNGAI

SEQ ID NO: 1292620 - protein, 19 aa, Mycobacterium
LDWAYSVLACWKLGAVPQP

SEQ ID NO: 1292621 - protein, 21 aa, Mycobacterium
LDWMLVCTLREWFDRPNGEPP

SEQ ID NO: 1292622 - protein, 20 aa, Mycobacterium
LDWPANLWLGVSVENTDHLD

SEQ ID NO: 1292623 - protein, 21 aa, Mycobacterium
LDWRMRHSLTDMVASAWSALP

SEQ ID NO: 1292624 - protein, 18 aa, Mycobacterium
LEAMSGYGRWAHSHGDVA

SEQ ID NO: 1292625 - protein, 18 aa, Mycobacterium
LEAVPAFQAYVPKQHATQ

SEQ ID NO: 1292626 - protein, 18 aa, Mycobacterium
LECALRWMRDFHADGLRL

SEQ ID NO: 1292627 - protein, 20 aa, Mycobacterium
LECRSPAAARGRGVVTACLI

SEQ ID NO: 1292628 - protein, 21 aa, Mycobacterium
LEEDWPIRAAVFTVGAVSPAS

SEQ ID NO: 1292629 - protein, 18 aa, Mycobacterium
LEFLAARGWLIVRVSATQ

SEQ ID NO: 1292630 - protein, 17 aa, Mycobacterium
LEGEIRWCQLFSEPGAG

SEQ ID NO: 1292631 - protein, 23 aa, Mycobacterium
LEGFWGHCWQSALFPSGRAFGYI

SEQ ID NO: 1292632 - protein, 20 aa, Mycobacterium
LEGLLAWKLGTSFRNAETIV

SEQ ID NO: 1292633 - protein, 18 aa, Mycobacterium
LEGPRPPGALPFDDPGLF

SEQ ID NO: 1292634 - protein, 22 aa, Mycobacterium
LEGRARRLVACWGNNDGAELRR

SEQ ID NO: 1292635 - protein, 18 aa, Mycobacterium
LEGVLARGAQRAREVSGV

SEQ ID NO: 1292636 - protein, 19 aa, Mycobacterium
LEIRPPVVTVMGHVDHGKT

SEQ ID NO: 1292637 - protein, 21 aa, Mycobacterium
LEMIKAQGGIFGWVADTSSVI

SEQ ID NO: 1292638 - protein, 19 aa, Mycobacterium
LENYGGMIFGCLDEKAEPL

SEQ ID NO: 1292639 - protein, 20 aa, Mycobacterium
LEPDLRWERFITAVRLLSER

SEQ ID NO: 1292640 - protein, 19 aa, Mycobacterium
LEPEPLCWDINNVDVVVGP

SEQ ID NO: 1292641 - protein, 20 aa, Mycobacterium
LEPPRFCAACGRKMIVQVRP

SEQ ID NO: 1292642 - protein, 18 aa, Mycobacterium
LEPRGLRYLVVINNWDPR

SEQ ID NO: 1292643 - protein, 18 aa, Mycobacterium
LEQWYGWIEFLANPSKNP

SEQ ID NO: 1292644 - protein, 19 aa, Mycobacterium
LERFVGAYIPLLGITFNGS

SEQ ID NO: 1292645 - protein, 19 aa, Mycobacterium
LERKAVFRRAWLNVGRVEQ

SEQ ID NO: 1292646 - protein, 21 aa, Mycobacterium
LERRLGVVLFKDFLALHFSPT

SEQ ID NO: 1292647 - protein, 18 aa, Mycobacterium
LESRLAWEPTSLAATVER

SEQ ID NO: 1292648 - protein, 19 aa, Mycobacterium
LEVGQLLGSGWKGGAATAF

SEQ ID NO: 1292649 - protein, 20 aa, Mycobacterium
LEVLDGLGLDYSIMFPTLAS

SEQ ID NO: 1292650 - protein, 18 aa, Mycobacterium
LEVLRRLYARVGDRLVLI

SEQ ID NO: 1292651 - protein, 18 aa, Mycobacterium
LEVPVKMAQNFTDAVAAL

SEQ ID NO: 1292652 - protein, 22 aa, Mycobacterium
LEVQLDQCWDLLRQRRALRASG

SEQ ID NO: 1292653 - protein, 17 aa, Mycobacterium
LEWDAVFLVGLADGTLP

SEQ ID NO: 1292654 - protein, 19 aa, Mycobacterium
LEYRHGRVYGHDSQSGTVM

SEQ ID NO: 1292655 - protein, 18 aa, Mycobacterium
LFAAKCIDGLVANDDHLR

SEQ ID NO: 1292656 - protein, 23 aa, Mycobacterium
LFALGRLPGWIAHWREMHGEPNK

SEQ ID NO: 1292657 - protein, 19 aa, Mycobacterium
LFATHGLPWCDGARELLEA

SEQ ID NO: 1292658 - protein, 17 aa, Mycobacterium
LFAVEWKQFWDASWGRR

SEQ ID NO: 1292659 - protein, 19 aa, Mycobacterium
LFAWCFARRGWAERAATLR

SEQ ID NO: 1292660 - protein, 18 aa, Mycobacterium
LFELPRLAPVYPTAAGLV

SEQ ID NO: 1292661 - protein, 17 aa, Mycobacterium
LFGGGAWSGAAANAAET

SEQ ID NO: 1292662 - protein, 21 aa, Mycobacterium
LFGRWTFQVVEEFDDSYWSVL

SEQ ID NO: 1292663 - protein, 18 aa, Mycobacterium
LFLFLTLCRDHDVVVLSG

SEQ ID NO: 1292664 - protein, 17 aa, Mycobacterium
LFLPLRYGRVEVRERMP

SEQ ID NO: 1292665 - protein, 17 aa, Mycobacterium
LFLSFLSVQGIDWRTAT

SEQ ID NO: 1292666 - protein, 22 aa, Mycobacterium
LFPAGLRLAAKLSHRVPAIARK

SEQ ID NO: 1292667 - protein, 17 aa, Mycobacterium
LFPAWSLALRQVLDDTG

SEQ ID NO: 1292668 - protein, 23 aa, Mycobacterium
LFRRAGATNVRWMWSPDAICGGE

SEQ ID NO: 1292669 - protein, 22 aa, Mycobacterium
LFVPLRFGIGFGLPTPQSVPAV

SEQ ID NO: 1292670 - protein, 33 aa, Mycobacterium
LGAALWEAFNPFVPGSFLWKGYPYTLVTDLIKP

SEQ ID NO: 1292671 - protein, 23 aa, Mycobacterium
LGAEQRWGIAESRRLAETLRLVA

SEQ ID NO: 1292672 - protein, 19 aa, Mycobacterium
LGAGLDWKSSLQELTASRG

SEQ ID NO: 1292673 - protein, 17 aa, Mycobacterium
LGAPEFASRIGVEVDEF

SEQ ID NO: 1292674 - protein, 23 aa, Mycobacterium
LGARRWVRMPGVHFGPDSCRFRG

SEQ ID NO: 1292675 - protein, 23 aa, Mycobacterium
LGARRWVRMPGVHFGPDTCTYRG

SEQ ID NO: 1292676 - protein, 18 aa, Mycobacterium
LGASAVLLSPAWKQAEVG

SEQ ID NO: 1292677 - protein, 18 aa, Mycobacterium
LGAVLFKDFLALHFSQTR

SEQ ID NO: 1292678 - protein, 18 aa, Mycobacterium
LGAYRFSEFRSEKTAPKD

SEQ ID NO: 1292679 - protein, 18 aa, Mycobacterium
LGDPVLWAVPLHWAGVHA

SEQ ID NO: 1292680 - protein, 18 aa, Mycobacterium
LGDRPVYLSVDIDVLDPA

SEQ ID NO: 1292681 - protein, 23 aa, Mycobacterium
LGEKDLRLALGLGESTGVELPLA

SEQ ID NO: 1292682 - protein, 18 aa, Mycobacterium
LGFHEAWVGEHHSAGFEI

SEQ ID NO: 1292683 - protein, 21 aa, Mycobacterium
LGGECQCVDLAPTVTALTETE

SEQ ID NO: 1292684 - protein, 22 aa, Mycobacterium
LGGGLLKAGGWITAGIAAGKLF

SEQ ID NO: 1292685 - protein, 18 aa, Mycobacterium
LGGPGRWLLALPAYHVAG

SEQ ID NO: 1292686 - protein, 18 aa, Mycobacterium
LGGWLAYRDGEVVPAEDR

SEQ ID NO: 1292687 - protein, 18 aa, Mycobacterium
LGICGGFQMLGRVIRDPH

SEQ ID NO: 1292688 - protein, 18 aa, Mycobacterium
LGIHVHLDWDRGIELISP

SEQ ID NO: 1292689 - protein, 17 aa, Mycobacterium
LGIHYEIPWPNREMKTA

SEQ ID NO: 1292690 - protein, 18 aa, Mycobacterium
LGIRGCSVSMPFKEDVLH

SEQ ID NO: 1292691 - protein, 17 aa, Mycobacterium
LGKQLYIGFNFGESLVA

SEQ ID NO: 1292692 - protein, 17 aa, Mycobacterium
LGKVRFLYFSPREYLVV

SEQ ID NO: 1292693 - protein, 17 aa, Mycobacterium
LGLWHVIPLRFDDQALV

SEQ ID NO: 1292694 - protein, 17 aa, Mycobacterium
LGNFSFAYLVTVGDDYR

SEQ ID NO: 1292695 - protein, 20 aa, Mycobacterium
LGPRGRHVVLAKSWGGPTVT

SEQ ID NO: 1292696 - protein, 17 aa, Mycobacterium
LGPSDVCYLSMPLFHSN

SEQ ID NO: 1292697 - protein, 19 aa, Mycobacterium
LGRLCVYLATRDCYATNSI

SEQ ID NO: 1292698 - protein, 20 aa, Mycobacterium
LGRRSNVYTVEWQNVQGLTP

SEQ ID NO: 1292699 - protein, 21 aa, Mycobacterium
LGRSNGWSGLIINGAVRDAST

SEQ ID NO: 1292700 - protein, 17 aa, Mycobacterium
LGSDPGLARFIDQVARR

SEQ ID NO: 1292701 - protein, 21 aa, Mycobacterium
LGSLRVGNRFVHTGKPKPAAY

SEQ ID NO: 1292702 - protein, 17 aa, Mycobacterium
LGTAVALPLERELFTFA

SEQ ID NO: 1292703 - protein, 22 aa, Mycobacterium
LGVALRIAWRALTFAGLRGSDR

SEQ ID NO: 1292704 - protein, 19 aa, Mycobacterium
LGVPEAKWVYLRGHADQTE

SEQ ID NO: 1292705 - protein, 17 aa, Mycobacterium
LGVPLAQELSAYLRTLD

SEQ ID NO: 1292706 - protein, 24 aa, Mycobacterium
LGVQRLRMVAGWSLGGMQSLEFAS

SEQ ID NO: 1292707 - protein, 18 aa, Mycobacterium
LGVQYARQGIRVNALCPG

SEQ ID NO: 1292708 - protein, 18 aa, Mycobacterium
LGVSIGRVPSRFVDNPIL

SEQ ID NO: 1292709 - protein, 24 aa, Mycobacterium
LGWADPRSGLSFGYVHNRLLTPLV

SEQ ID NO: 1292710 - protein, 22 aa, Mycobacterium
LGWKLAQVVQGWSPDTLLDTYH

SEQ ID NO: 1292711 - protein, 18 aa, Mycobacterium
LHALWVPGTRIVYIGKAN

SEQ ID NO: 1292712 - protein, 17 aa, Mycobacterium
LHEIYKLGVVPIPTNRP

SEQ ID NO: 1292713 - protein, 20 aa, Mycobacterium
LHFALEWLRMCELIRVTSTE

SEQ ID NO: 1292714 - protein, 22 aa, Mycobacterium
LHGGRFSVLLAHHLGAHLEQLR

SEQ ID NO: 1292715 - protein, 18 aa, Mycobacterium
LHKHWGFGGGPHRCLGSH

SEQ ID NO: 1292716 - protein, 17 aa, Mycobacterium
LHLIPGMRGKVIDSETP

SEQ ID NO: 1292717 - protein, 17 aa, Mycobacterium
LHLRWLRDTSVPPPGGE

SEQ ID NO: 1292718 - protein, 26 aa, Mycobacterium
LHPDVVWDFRLPRVVSINVSGHKYGL

SEQ ID NO: 1292719 - protein, 23 aa, Mycobacterium
LHPEAIAALGIREWDAVSLTGAR

SEQ ID NO: 1292720 - protein, 17 aa, Mycobacterium
LHPGEFVLGATLERCTL

SEQ ID NO: 1292721 - protein, 19 aa, Mycobacterium
LHRCDRTAVSMPRNNRGRG

SEQ ID NO: 1292722 - protein, 18 aa, Mycobacterium
LHVLRLAAMLPWAPLVPF

SEQ ID NO: 1292723 - protein, 18 aa, Mycobacterium
LHYVKWYLDGTLTFRRSC

SEQ ID NO: 1292724 - protein, 19 aa, Mycobacterium
LIAAGAYLWLRAWPAPGGD

SEQ ID NO: 1292725 - protein, 23 aa, Mycobacterium
LIAWCRDRMAGFKVPRYVEFLDE

SEQ ID NO: 1292726 - protein, 27 aa, Mycobacterium
LIDDRFWLHLGMGWQFFAPDDYIRRLT

SEQ ID NO: 1292727 - protein, 20 aa, Mycobacterium
LIDIPFKFHHPMWRENAEVD

SEQ ID NO: 1292728 - protein, 20 aa, Mycobacterium
LIDIPWRLHHPMWLEDCPVD

SEQ ID NO: 1292729 - protein, 18 aa, Mycobacterium
LIGALPRLEGTVHVNVAQ

SEQ ID NO: 1292730 - protein, 17 aa, Mycobacterium
LIGCAWADLAEVMAGVF

SEQ ID NO: 1292731 - protein, 18 aa, Mycobacterium
LIGPGGLLIGNGVLPGQN

SEQ ID NO: 1292732 - protein, 23 aa, Mycobacterium
LINRLLPILAPIVLAYIGRKLSG

SEQ ID NO: 1292733 - protein, 23 aa, Mycobacterium
LIRGEWRPLYLFADRPQPLIDLE

SEQ ID NO: 1292734 - protein, 18 aa, Mycobacterium
LIVPRLHLIPGMRGKVID

SEQ ID NO: 1292735 - protein, 19 aa, Mycobacterium
LIYKCPRPPTGIIARNERI

SEQ ID NO: 1292736 - protein, 17 aa, Mycobacterium
LKAANTWHATRAIQEAR

SEQ ID NO: 1292737 - protein, 20 aa, Mycobacterium
LKACIKAAADRVVFINTGFL

SEQ ID NO: 1292738 - protein, 24 aa, Mycobacterium
LKAFGFDIGYRIAHHADLTTPPPV

SEQ ID NO: 1292739 - protein, 17 aa, Mycobacterium
LKCLCRFHHLLKTFWLG

SEQ ID NO: 1292740 - protein, 21 aa, Mycobacterium
LKEAICKGTLWGLRRGARKPG

SEQ ID NO: 1292741 - protein, 21 aa, Mycobacterium
LKEKAIAPIRAWLGGLTADAE

SEQ ID NO: 1292742 - protein, 22 aa, Mycobacterium
LKEKAIAPIRAWLGGLTADAEQ

SEQ ID NO: 1292743 - protein, 17 aa, Mycobacterium
LKGAGFYSYIDGKRVGL

SEQ ID NO: 1292744 - protein, 19 aa, Mycobacterium
LKGMFAFAIVERDSGRVLL

SEQ ID NO: 1292745 - protein, 25 aa, Mycobacterium
LKLRHVMQFELKRIQREVGITFIYV

SEQ ID NO: 1292746 - protein, 18 aa, Mycobacterium
LKLSALRGLFSAVIEHPV

SEQ ID NO: 1292747 - protein, 22 aa, Mycobacterium
LKPALGRFGVWTGAPVSPDQAV

SEQ ID NO: 1292748 - protein, 18 aa, Mycobacterium
LKPRRWTSGHLQLMEDFV

SEQ ID NO: 1292749 - protein, 19 aa, Mycobacterium
LKRFPTWEVDWPNAVPSQT

SEQ ID NO: 1292750 - protein, 23 aa, Mycobacterium
LKRFSFAWLTDFVGWLPMPDGGP

SEQ ID NO: 1292751 - protein, 19 aa, Mycobacterium
LKRQGEWVVPSRLALHRRM

SEQ ID NO: 1292752 - protein, 18 aa, Mycobacterium
LKSGLRWIRSHPWHFAKL

SEQ ID NO: 1292753 - protein, 17 aa, Mycobacterium
LKSGRAFSVQYHPEAAA

SEQ ID NO: 1292754 - protein, 17 aa, Mycobacterium
LKSGWLNGIKHWQVDYT

SEQ ID NO: 1292755 - protein, 21 aa, Mycobacterium
LKSKLRPGGLLLNHCITRHNN

SEQ ID NO: 1292756 - protein, 21 aa, Mycobacterium
LKTSFKAGALIGRGSGEAMQV

SEQ ID NO: 1292757 - protein, 21 aa, Mycobacterium
LKTVMGMQVLCGWTNPPDRGE

SEQ ID NO: 1292758 - protein, 18 aa, Mycobacterium
LKVAFDWKSRLNEARGLD

SEQ ID NO: 1292759 - protein, 21 aa, Mycobacterium
LKVKRRMAGMLARRGYSQSMA

SEQ ID NO: 1292760 - protein, 18 aa, Mycobacterium
LKWWTSEVQWEIIDRCLQ

SEQ ID NO: 1292761 - protein, 20 aa, Mycobacterium
LKYPHMFAAAGLVLINKSDL

SEQ ID NO: 1292762 - protein, 17 aa, Mycobacterium
LLACEPVGIPALEALAG

SEQ ID NO: 1292763 - protein, 17 aa, Mycobacterium
LLAGLLRAGRQVKDLVV

SEQ ID NO: 1292764 - protein, 18 aa, Mycobacterium
LLAKRPGPDLGLMPLDLS

SEQ ID NO: 1292765 - protein, 18 aa, Mycobacterium
LLALESFEILDTVPETPF

SEQ ID NO: 1292766 - protein, 17 aa, Mycobacterium
LLAPLGMEHSVLYRRGV

SEQ ID NO: 1292767 - protein, 22 aa, Mycobacterium
LLASWCALRFGELTELRRKDVE

SEQ ID NO: 1292768 - protein, 27 aa, Mycobacterium
LLCAEEVDRACAPWGLLGEDRQATVIA

SEQ ID NO: 1292769 - protein, 19 aa, Mycobacterium
LLCRRRLGAAVGQIVNVDG

SEQ ID NO: 1292770 - protein, 33 aa, Mycobacterium
LLDEAWWFPAICWPDGRLQFMLNERMMPSQFVV

SEQ ID NO: 1292771 - protein, 21 aa, Mycobacterium
LLDGFGLACVGGFVPVVLYKD

SEQ ID NO: 1292772 - protein, 24 aa, Mycobacterium
LLDIGCGWGATLLRALDKYDVNVI

SEQ ID NO: 1292773 - protein, 21 aa, Mycobacterium
LLDRASVNGVKGWITRTRQPA

SEQ ID NO: 1292774 - protein, 19 aa, Mycobacterium
LLDRDWRMLIGGDRVAAGD

SEQ ID NO: 1292775 - protein, 18 aa, Mycobacterium
LLDRVDLAPGFSYAESTM

SEQ ID NO: 1292776 - protein, 24 aa, Mycobacterium
LLDVGCGWGYTMMRAVEKYDVNVI

SEQ ID NO: 1292777 - protein, 26 aa, Mycobacterium
LLEAARWAPTWGRRQPVRFVVGLRGD

SEQ ID NO: 1292778 - protein, 21 aa, Mycobacterium
LLEAFPGWGPVAALFDAEPAG

SEQ ID NO: 1292779 - protein, 23 aa, Mycobacterium
LLELRRPALLVGRPDPTGVTPDV

SEQ ID NO: 1292780 - protein, 17 aa, Mycobacterium
LLELVGLGHRIDHQPTK

SEQ ID NO: 1292781 - protein, 19 aa, Mycobacterium
LLEMSQLPGRGWVEYEPYG

SEQ ID NO: 1292782 - protein, 19 aa, Mycobacterium
LLEPARAAFEWSRTQQRPD

SEQ ID NO: 1292783 - protein, 23 aa, Mycobacterium
LLEVGCGWGLTLQRAMEKYDVNV

SEQ ID NO: 1292784 - protein, 18 aa, Mycobacterium
LLFARLLQYRAFKHVAEM

SEQ ID NO: 1292785 - protein, 17 aa, Mycobacterium
LLFGAAMPDVFAASIRD

SEQ ID NO: 1292786 - protein, 17 aa, Mycobacterium
LLGDLAWDAVLGTLSGG

SEQ ID NO: 1292787 - protein, 27 aa, Mycobacterium
LLGSGWKGGAATAFGTEWDKWHSGAGQ

SEQ ID NO: 1292788 - protein, 18 aa, Mycobacterium
LLHAGCRTTVWNRTAARA

SEQ ID NO: 1292789 - protein, 17 aa, Mycobacterium
LLHWARPIAPLILNASS

SEQ ID NO: 1292790 - protein, 17 aa, Mycobacterium
LLKLRGATLLAHNYQLP

SEQ ID NO: 1292791 - protein, 21 aa, Mycobacterium
LLKYSRLFAALTEWERGTDIA

SEQ ID NO: 1292792 - protein, 18 aa, Mycobacterium
LLLEVAWEALEDAGINPR

SEQ ID NO: 1292793 - protein, 19 aa, Mycobacterium
LLLEVAWEALEHAGITPDR

SEQ ID NO: 1292794 - protein, 17 aa, Mycobacterium
LLPAEEWVAVARRSAML

SEQ ID NO: 1292795 - protein, 22 aa, Mycobacterium
LLPERRYRLVVTVADLTTGQLV

SEQ ID NO: 1292796 - protein, 21 aa, Mycobacterium
LLPIPEFYGGAVYFDGADAPA

SEQ ID NO: 1292797 - protein, 25 aa, Mycobacterium
LLPMPDLIRLAARAHHYLYVYDQHS

SEQ ID NO: 1292798 - protein, 20 aa, Mycobacterium
LLPTVRGAFCLTFMDENTLY

SEQ ID NO: 1292799 - protein, 17 aa, Mycobacterium
LLQLRWLGLEGRSDPVD

SEQ ID NO: 1292800 - protein, 17 aa, Mycobacterium
LLQRGFDGLSIEAVAAR

SEQ ID NO: 1292801 - protein, 17 aa, Mycobacterium
LLQRILHAVPIVRRAMP

SEQ ID NO: 1292802 - protein, 17 aa, Mycobacterium
LLREAWLTATRARNALV

SEQ ID NO: 1292803 - protein, 18 aa, Mycobacterium
LLRPRACYICKNRYTVVD

SEQ ID NO: 1292804 - protein, 24 aa, Mycobacterium
LLRSCGRPYPWVQIRIVDETGADA

SEQ ID NO: 1292805 - protein, 17 aa, Mycobacterium
LLRTAVLAFLKYIDANR

SEQ ID NO: 1292806 - protein, 18 aa, Mycobacterium
LLRTPGFVLIRERGAAAV

SEQ ID NO: 1292807 - protein, 22 aa, Mycobacterium
LLSDLRLGLMHGRLSGDEKAAV

SEQ ID NO: 1292808 - protein, 19 aa, Mycobacterium
LLTCPLHTFALYTDRSVDP

SEQ ID NO: 1292809 - protein, 19 aa, Mycobacterium
LLVRGGVVFNGYWRNEKAT

SEQ ID NO: 1292810 - protein, 18 aa, Mycobacterium
LMAAARLDLASVFLYAGS

SEQ ID NO: 1292811 - protein, 19 aa, Mycobacterium
LMAQLGFRTVNEMVGQVGA

SEQ ID NO: 1292812 - protein, 18 aa, Mycobacterium
LMDLGCYGLHVMRRFGTP

SEQ ID NO: 1292813 - protein, 18 aa, Mycobacterium
LMKARGGGRIINFYSIDA

SEQ ID NO: 1292814 - protein, 17 aa, Mycobacterium
LMPLDLSLGVADEDSDD

SEQ ID NO: 1292815 - protein, 17 aa, Mycobacterium
LMSAQLWDTNGAWVAEA

SEQ ID NO: 1292816 - protein, 23 aa, Mycobacterium
LMVKAGVQWGLFGGAVENLGTER

SEQ ID NO: 1292817 - protein, 18 aa, Mycobacterium
LNAFKVRGPESFSAPVLP

SEQ ID NO: 1292818 - protein, 17 aa, Mycobacterium
LNAGFLWACSGYYNYDK

SEQ ID NO: 1292819 - protein, 18 aa, Mycobacterium
LNDPCWKQLLSLVPPMTC

SEQ ID NO: 1292820 - protein, 23 aa, Mycobacterium
LNGPRYWLMSGIEKPGGTESERR

SEQ ID NO: 1292821 - protein, 17 aa, Mycobacterium
LNGRSGYRFGHIEGPMQ

SEQ ID NO: 1292822 - protein, 22 aa, Mycobacterium
LNITLPMPRGWAYIPDPNVPEA

SEQ ID NO: 1292823 - protein, 25 aa, Mycobacterium
LNLLHFLRPDFGIPRVTIGLDVHSI

SEQ ID NO: 1292824 - protein, 17 aa, Mycobacterium
LNLLTAKPFLYVFNADE

SEQ ID NO: 1292825 - protein, 17 aa, Mycobacterium
LNLPTPEEFIASIPAPV

SEQ ID NO: 1292826 - protein, 17 aa, Mycobacterium
LNLPTPEQFIASIPAPV

SEQ ID NO: 1292827 - protein, 19 aa, Mycobacterium
LNMAVLWRLPVLFCCENNL

SEQ ID NO: 1292828 - protein, 18 aa, Mycobacterium
LNNWKRLGFTDEDLTRPG

SEQ ID NO: 1292829 - protein, 19 aa, Mycobacterium
LNPAAGWAVGVFRSPSGTE

SEQ ID NO: 1292830 - protein, 17 aa, Mycobacterium
LNRPRWPDIPGRDTFAG

SEQ ID NO: 1292831 - protein, 21 aa, Mycobacterium
LNVADAGLCFGRLDSLTGERL

SEQ ID NO: 1292832 - protein, 20 aa, Mycobacterium
LNVAVSRARCLAYLVCTDAL

SEQ ID NO: 1292833 - protein, 23 aa, Mycobacterium
LNWKSRPYLAWPAYGQSKLANLL

SEQ ID NO: 1292834 - protein, 18 aa, Mycobacterium
LNWLKAWYEFAVPDIGRS

SEQ ID NO: 1292835 - protein, 25 aa, Mycobacterium
LNWWESRALYGWTVLVPRTKDQAGE

SEQ ID NO: 1292836 - protein, 18 aa, Mycobacterium
LPAFPAFEHSSGDVVDLV

SEQ ID NO: 1292837 - protein, 24 aa, Mycobacterium
LPAIGTKELIAWLPTVLGLGAGDT

SEQ ID NO: 1292838 - protein, 18 aa, Mycobacterium
LPANLGLDLKAMIAANNH

SEQ ID NO: 1292839 - protein, 26 aa, Mycobacterium
LPATFSLYLERAWPRHRRLSGVDDVR

SEQ ID NO: 1292840 - protein, 18 aa, Mycobacterium
LPDLKVFICGGASVPPSL

SEQ ID NO: 1292841 - protein, 20 aa, Mycobacterium
LPDQGVVVLVDLGGSGSSIS

SEQ ID NO: 1292842 - protein, 17 aa, Mycobacterium
LPDSLLHFMRTRGKNKV

SEQ ID NO: 1292843 - protein, 17 aa, Mycobacterium
LPDSLLHYMRTRGKGKV

SEQ ID NO: 1292844 - protein, 20 aa, Mycobacterium
LPDYYRWLLYDADHGPAYRY

SEQ ID NO: 1292845 - protein, 24 aa, Mycobacterium
LPECKVEVWAGFVFINMDPDAVPL

SEQ ID NO: 1292846 - protein, 20 aa, Mycobacterium
LPELRAGLHFNALSLSGITP

SEQ ID NO: 1292847 - protein, 17 aa, Mycobacterium
LPELTDWSNADFTVENV

SEQ ID NO: 1292848 - protein, 23 aa, Mycobacterium
LPERDFPTLISLYLQGRFPLDKF

SEQ ID NO: 1292849 - protein, 17 aa, Mycobacterium
LPFEHWLSALAEIGEAV

SEQ ID NO: 1292850 - protein, 22 aa, Mycobacterium
LPGELFNALSQGLSQFGINLPP

SEQ ID NO: 1292851 - protein, 19 aa, Mycobacterium
LPGGLNWPLDLTVADGRLY

SEQ ID NO: 1292852 - protein, 20 aa, Mycobacterium
LPGLWLLASLYFRADVRGLD

SEQ ID NO: 1292853 - protein, 18 aa, Mycobacterium
LPGYIWGGTLESYFTHQA

SEQ ID NO: 1292854 - protein, 19 aa, Mycobacterium
LPHDVVGIGMLRKAGYNVV

SEQ ID NO: 1292855 - protein, 17 aa, Mycobacterium
LPHMPRGALPHGQPGHW

SEQ ID NO: 1292856 - protein, 17 aa, Mycobacterium
LPHYAGFTAYLSQAASK

SEQ ID NO: 1292857 - protein, 17 aa, Mycobacterium
LPITLWPGMKIGQLCLL

SEQ ID NO: 1292858 - protein, 24 aa, Mycobacterium
LPKAVVFRPVIERSPAGKADYRWA

SEQ ID NO: 1292859 - protein, 21 aa, Mycobacterium
LPLPYAGNGWVVWDRGGASEA

SEQ ID NO: 1292860 - protein, 20 aa, Mycobacterium
LPLTRPLLDLGVPPEIVRAL

SEQ ID NO: 1292861 - protein, 24 aa, Mycobacterium
LPMPDLIRLAARAHHYLYVYDQHS

SEQ ID NO: 1292862 - protein, 17 aa, Mycobacterium
LPPEFRAAVVLCDIEGL

SEQ ID NO: 1292863 - protein, 17 aa, Mycobacterium
LPPRARMLLGLPWTDKQ

SEQ ID NO: 1292864 - protein, 19 aa, Mycobacterium
LPQGFKVVIVGAGIAGMAA

SEQ ID NO: 1292865 - protein, 20 aa, Mycobacterium
LPQQRWYGGRSREFSSATAD

SEQ ID NO: 1292866 - protein, 19 aa, Mycobacterium
LPQVVGAAMARRLSMTGEV

SEQ ID NO: 1292867 - protein, 19 aa, Mycobacterium
LPRIRDFRGLSGKQFDGTG

SEQ ID NO: 1292868 - protein, 17 aa, Mycobacterium
LPRLRPGVMEVKIPMPT

SEQ ID NO: 1292869 - protein, 25 aa, Mycobacterium
LPSMGSFRGSGTWIPLLRSGPGGQA

SEQ ID NO: 1292870 - protein, 25 aa, Mycobacterium
LPTAGAFRGTGTWLPLLRSGPNGRA

SEQ ID NO: 1292871 - protein, 19 aa, Mycobacterium
LPTPEEFIASIPAPVVTCL

SEQ ID NO: 1292872 - protein, 19 aa, Mycobacterium
LPVAEAIGFMLEILPALGH

SEQ ID NO: 1292873 - protein, 18 aa, Mycobacterium
LPVDGILFAVEWKQFWDA

SEQ ID NO: 1292874 - protein, 18 aa, Mycobacterium
LPVHCWFEPDGWGMQVYP

SEQ ID NO: 1292875 - protein, 22 aa, Mycobacterium
LPVKLCYSGPFFRYERPQAGRY

SEQ ID NO: 1292876 - protein, 17 aa, Mycobacterium
LPVRLQWVSAELAMVQG

SEQ ID NO: 1292877 - protein, 18 aa, Mycobacterium
LPVRLQWVSAELAMVQGD

SEQ ID NO: 1292878 - protein, 24 aa, Mycobacterium
LPVYRPPLDMARLFGEPAIGARGE

SEQ ID NO: 1292879 - protein, 18 aa, Mycobacterium
LPYPEEWGGGGQPYEVYL

SEQ ID NO: 1292880 - protein, 17 aa, Mycobacterium
LQAARWAGAVAATCGAP

SEQ ID NO: 1292881 - protein, 21 aa, Mycobacterium
LQDHAWRIAAALNWPDTYQAE

SEQ ID NO: 1292882 - protein, 18 aa, Mycobacterium
LQGLGFSFSRQWTVAQIV

SEQ ID NO: 1292883 - protein, 17 aa, Mycobacterium
LQIASAQHRVEWFWVKG

SEQ ID NO: 1292884 - protein, 18 aa, Mycobacterium
LQLCDAFGFPVVSLIDCP

SEQ ID NO: 1292885 - protein, 18 aa, Mycobacterium
LQLGWRLFGPFLRAATGL

SEQ ID NO: 1292886 - protein, 24 aa, Mycobacterium
LQMLSDCPLRWLLERHGGSRGRDV

SEQ ID NO: 1292887 - protein, 19 aa, Mycobacterium
LQRDNCKLIDWPIATLSPA

SEQ ID NO: 1292888 - protein, 18 aa, Mycobacterium
LQRELGLTYLLIGHDLAV

SEQ ID NO: 1292889 - protein, 18 aa, Mycobacterium
LQRMETFDGLAILATNFR

SEQ ID NO: 1292890 - protein, 20 aa, Mycobacterium
LQSCRIRWGTVVSVDTEHVM

SEQ ID NO: 1292891 - protein, 19 aa, Mycobacterium
LQVAEAFGRYGAHLRVNVL

SEQ ID NO: 1292892 - protein, 19 aa, Mycobacterium
LQWGTNHLGHFALTARLLP

SEQ ID NO: 1292893 - protein, 27 aa, Mycobacterium
LQWIPDWMWRLNLKVLGPFAVWVTVGL

SEQ ID NO: 1292894 - protein, 19 aa, Mycobacterium
LRAALKYPLIAQIMRSPTA

SEQ ID NO: 1292895 - protein, 18 aa, Mycobacterium
LRAAWKDIPEVVSAATVT

SEQ ID NO: 1292896 - protein, 23 aa, Mycobacterium
LRADARLALRLILQERGALPVEP

SEQ ID NO: 1292897 - protein, 18 aa, Mycobacterium
LRAGDTWAAAVGTATGID

SEQ ID NO: 1292898 - protein, 17 aa, Mycobacterium
LRAGSLIPLTSAGAYPS

SEQ ID NO: 1292899 - protein, 17 aa, Mycobacterium
LRAGYLVGCDGGRSLIR

SEQ ID NO: 1292900 - protein, 18 aa, Mycobacterium
LRAWPTPLGVAINSADPV

SEQ ID NO: 1292901 - protein, 19 aa, Mycobacterium
LRCARLIRAGEAAWFAGHL

SEQ ID NO: 1292902 - protein, 17 aa, Mycobacterium
LRDAFATDEYQVMLVAN

SEQ ID NO: 1292903 - protein, 23 aa, Mycobacterium
LRDEFDFRYLVGVVSVMGDKDVD

SEQ ID NO: 1292904 - protein, 17 aa, Mycobacterium
LRDIEWRIAPGERTGIL

SEQ ID NO: 1292905 - protein, 26 aa, Mycobacterium
LRDIGRWRIPVILGLRSDVGEDDVRA

SEQ ID NO: 1292906 - protein, 22 aa, Mycobacterium
LRDLPFTLTYLFDGDGSARLAG

SEQ ID NO: 1292907 - protein, 18 aa, Mycobacterium
LRDNRFRLPPGITLAAQG

SEQ ID NO: 1292908 - protein, 18 aa, Mycobacterium
LRDPRFVIPPGIHLSAHG

SEQ ID NO: 1292909 - protein, 26 aa, Mycobacterium
LREGLRFWLRSALTYDLLTWSSVTDR

SEQ ID NO: 1292910 - protein, 18 aa, Mycobacterium
LREKFSLQFEVFENSLLG

SEQ ID NO: 1292911 - protein, 24 aa, Mycobacterium
LRELELRKAPSISETIDWARTLAV

SEQ ID NO: 1292912 - protein, 21 aa, Mycobacterium
LRERPAWITGFEHRIETPVLG

SEQ ID NO: 1292913 - protein, 26 aa, Mycobacterium
LRERWSNQAAREWKELPARELAGTTM

SEQ ID NO: 1292914 - protein, 18 aa, Mycobacterium
LRESMAFHRWLIERALSE

SEQ ID NO: 1292915 - protein, 18 aa, Mycobacterium
LRFKDLRTGQRYDDEIVG

SEQ ID NO: 1292916 - protein, 18 aa, Mycobacterium
LRFQLLWYPSTTFDTSLP

SEQ ID NO: 1292917 - protein, 17 aa, Mycobacterium
LRFVNVVDLMRLQDRTE

SEQ ID NO: 1292918 - protein, 17 aa, Mycobacterium
LRFVSVESAVGWIPFLL

SEQ ID NO: 1292919 - protein, 20 aa, Mycobacterium
LRGGAYFFLPGLRGLRYLAT

SEQ ID NO: 1292920 - protein, 29 aa, Mycobacterium
LRGGDSWMFVGWCRLREGIRGFHLDRILH

SEQ ID NO: 1292921 - protein, 17 aa, Mycobacterium
LRGGVVLVSHDREFLAR

SEQ ID NO: 1292922 - protein, 24 aa, Mycobacterium
LRGLTLPVLRSWLAAQATAGAARS

SEQ ID NO: 1292923 - protein, 19 aa, Mycobacterium
LRGWQVLRFTWLDLTEYPE

SEQ ID NO: 1292924 - protein, 23 aa, Mycobacterium
LRHAEILCALAFSPQGRSAPQLA

SEQ ID NO: 1292925 - protein, 18 aa, Mycobacterium
LRHGHRGYRELCMRDPSW

SEQ ID NO: 1292926 - protein, 20 aa, Mycobacterium
LRHRLRLGVLAALDQRIAVR

SEQ ID NO: 1292927 - protein, 17 aa, Mycobacterium
LRHVYRGLAGMFLIDDD

SEQ ID NO: 1292928 - protein, 19 aa, Mycobacterium
LRIAPNVWPRNAVRGADGV

SEQ ID NO: 1292929 - protein, 17 aa, Mycobacterium
LRIGLATADDIRNWSFG

SEQ ID NO: 1292930 - protein, 17 aa, Mycobacterium
LRIGYAVADPDIIAALS

SEQ ID NO: 1292931 - protein, 17 aa, Mycobacterium
LRITKSVLFAGLAEAKQ

SEQ ID NO: 1292932 - protein, 18 aa, Mycobacterium
LRKAVGWYRSHGRLHTGD

SEQ ID NO: 1292933 - protein, 19 aa, Mycobacterium
LRKLPVAVRRFWLGRAELA

SEQ ID NO: 1292934 - protein, 17 aa, Mycobacterium
LRLAEHGLRDERLATAL

SEQ ID NO: 1292935 - protein, 20 aa, Mycobacterium
LRLCESCLLLQIPALITSED

SEQ ID NO: 1292936 - protein, 17 aa, Mycobacterium
LRLFAGLVSAAGDYAWH

SEQ ID NO: 1292937 - protein, 17 aa, Mycobacterium
LRLGAPVRYEFSRTDEF

SEQ ID NO: 1292938 - protein, 19 aa, Mycobacterium
LRLGLPPQRVGGGLVPGYG

SEQ ID NO: 1292939 - protein, 17 aa, Mycobacterium
LRLLGPRIAEAAAGPDA

SEQ ID NO: 1292940 - protein, 17 aa, Mycobacterium
LRLLPWLPGTALVMADL

SEQ ID NO: 1292941 - protein, 17 aa, Mycobacterium
LRLLTARARTRAELEAA

SEQ ID NO: 1292942 - protein, 20 aa, Mycobacterium
LRLPLVKSRTGDHLEVSWED

SEQ ID NO: 1292943 - protein, 18 aa, Mycobacterium
LRLPRHVHRIGVLEIDHG

SEQ ID NO: 1292944 - protein, 17 aa, Mycobacterium
LRLPVRAPFAFEGLFGH

SEQ ID NO: 1292945 - protein, 19 aa, Mycobacterium
LRLQFWVCGTFELNDAGQV

SEQ ID NO: 1292946 - protein, 17 aa, Mycobacterium
LRLRCFVVIELKIGDFD

SEQ ID NO: 1292947 - protein, 23 aa, Mycobacterium
LRLRDIGGIVVIDFIDMVLESNR

SEQ ID NO: 1292948 - protein, 22 aa, Mycobacterium
LRMDEFPARLVIVPGERDRLLV

SEQ ID NO: 1292949 - protein, 17 aa, Mycobacterium
LRNATAFGFSPRLRADI

SEQ ID NO: 1292950 - protein, 19 aa, Mycobacterium
LRNDIAFNFVFSDPSAGLS

SEQ ID NO: 1292951 - protein, 18 aa, Mycobacterium
LRNSLPLMLAGILDEVPG

SEQ ID NO: 1292952 - protein, 17 aa, Mycobacterium
LRNWLGMWSLRHAQTRA

SEQ ID NO: 1292953 - protein, 19 aa, Mycobacterium
LRPAILYGIDTRATAEIDS

SEQ ID NO: 1292954 - protein, 18 aa, Mycobacterium
LRPAMAIGKEIDLRFVFG

SEQ ID NO: 1292955 - protein, 21 aa, Mycobacterium
LRPAPEFEAWLARLGMADGDG

SEQ ID NO: 1292956 - protein, 20 aa, Mycobacterium
LRPARDISVIRLKMDHALAY

SEQ ID NO: 1292957 - protein, 21 aa, Mycobacterium
LRPDLDWDKGTTLAWIRDRID

SEQ ID NO: 1292958 - protein, 17 aa, Mycobacterium
LRPDLRVHLAAREAEFW

SEQ ID NO: 1292959 - protein, 17 aa, Mycobacterium
LRPGDLAVWDGHVAMVV

SEQ ID NO: 1292960 - protein, 22 aa, Mycobacterium
LRPGGRLGLVWNNRDERLGWVK

SEQ ID NO: 1292961 - protein, 17 aa, Mycobacterium
LRPGLTLALEPWFARGT

SEQ ID NO: 1292962 - protein, 20 aa, Mycobacterium
LRPGTGWTRYSLLETLRAYG

SEQ ID NO: 1292963 - protein, 19 aa, Mycobacterium
LRPGWPSMFRGYLRQDQRY

SEQ ID NO: 1292964 - protein, 20 aa, Mycobacterium
LRPGYDYLICRKLSVFWRHM

SEQ ID NO: 1292965 - protein, 18 aa, Mycobacterium
LRPHPAMTFRDLLTQTRD

SEQ ID NO: 1292966 - protein, 17 aa, Mycobacterium
LRPILCLTKSDLAPAEP

SEQ ID NO: 1292967 - protein, 18 aa, Mycobacterium
LRPTSRVSLLSPTGAFLG

SEQ ID NO: 1292968 - protein, 20 aa, Mycobacterium
LRPYAELLVDGFGIPEQLRY

SEQ ID NO: 1292969 - protein, 18 aa, Mycobacterium
LRQLISWTGDHLAEVEVT

SEQ ID NO: 1292970 - protein, 18 aa, Mycobacterium
LRRACGLARATAVESAMP

SEQ ID NO: 1292971 - protein, 18 aa, Mycobacterium
LRRAKALGPRRGLTGTPL

SEQ ID NO: 1292972 - protein, 17 aa, Mycobacterium
LRRIGMMTEYWGKPDKT

SEQ ID NO: 1292973 - protein, 17 aa, Mycobacterium
LRRPCGRIHWAGTESSA

SEQ ID NO: 1292974 - protein, 21 aa, Mycobacterium
LRRQIPVLGICRGAQMLNVAL

SEQ ID NO: 1292975 - protein, 21 aa, Mycobacterium
LRRRVGFVFQQFNLVGRLSCL

SEQ ID NO: 1292976 - protein, 17 aa, Mycobacterium
LRRVVVMAHGFGGTKDS

SEQ ID NO: 1292977 - protein, 22 aa, Mycobacterium
LRSCPPIVLKSVRLYGEGDPVD

SEQ ID NO: 1292978 - protein, 17 aa, Mycobacterium
LRSKPVWVLGAAETTSH

SEQ ID NO: 1292979 - protein, 20 aa, Mycobacterium
LRSRLDGLIAQWKRDHGDTD

SEQ ID NO: 1292980 - protein, 19 aa, Mycobacterium
LRSSLPLVLAGIVGEVPGA

SEQ ID NO: 1292981 - protein, 18 aa, Mycobacterium
LRTEFPNGFVATVRGVFT

SEQ ID NO: 1292982 - protein, 17 aa, Mycobacterium
LRTGAPIQLSAAVVASW

SEQ ID NO: 1292983 - protein, 20 aa, Mycobacterium
LRTLCLDAKLYAGGMASTVE

SEQ ID NO: 1292984 - protein, 17 aa, Mycobacterium
LRVGSFFPSLLERRRRI

SEQ ID NO: 1292985 - protein, 21 aa, Mycobacterium
LRVLARRDFAGLITVAVDSPE

SEQ ID NO: 1292986 - protein, 20 aa, Mycobacterium
LRVTGFTGVDVWDDWLSNDM

SEQ ID NO: 1292987 - protein, 24 aa, Mycobacterium
LRVVKFWVSHGVKVFRVDNPHTKP

SEQ ID NO: 1292988 - protein, 19 aa, Mycobacterium
LRWAASFAAPWAVRRLRRI

SEQ ID NO: 1292989 - protein, 19 aa, Mycobacterium
LRWLASANCLLELDEDTAE

SEQ ID NO: 1292990 - protein, 17 aa, Mycobacterium
LRYILCGGSAVPKALSE

SEQ ID NO: 1292991 - protein, 20 aa, Mycobacterium
LRYLLATSVPAWWVPYVPRL

SEQ ID NO: 1292992 - protein, 21 aa, Mycobacterium
LRYPLPASWSADVALYLKDET

SEQ ID NO: 1292993 - protein, 17 aa, Mycobacterium
LSAAMARRGHDVTVYTR

SEQ ID NO: 1292994 - protein, 17 aa, Mycobacterium
LSAAMCLRAYAVTRTRG

SEQ ID NO: 1292995 - protein, 17 aa, Mycobacterium
LSARAGQIGTLVVHPLL

SEQ ID NO: 1292996 - protein, 17 aa, Mycobacterium
LSARPGVVLSRRQLLET

SEQ ID NO: 1292997 - protein, 19 aa, Mycobacterium
LSASECWDLLAGAPLGRLV

SEQ ID NO: 1292998 - protein, 22 aa, Mycobacterium
LSAWCKAAGVAIRHRNPSATTA

SEQ ID NO: 1292999 - protein, 22 aa, Mycobacterium
LSFIGLPWMHTWGSGRFLGVDS

SEQ ID NO: 1293000 - protein, 17 aa, Mycobacterium
LSFSGGRHFCLGAALAR

SEQ ID NO: 1293001 - protein, 22 aa, Mycobacterium
LSGPLLVVFFFDVMRDVLRERV

SEQ ID NO: 1293002 - protein, 25 aa, Mycobacterium
LSGQVGWLARDRWAVPLVHTAHTLA

SEQ ID NO: 1293003 - protein, 23 aa, Mycobacterium
LSGSFVSYFGWLYEWGAPVTLIG

SEQ ID NO: 1293004 - protein, 17 aa, Mycobacterium
LSGTKVWTSGAHRAHAF

SEQ ID NO: 1293005 - protein, 17 aa, Mycobacterium
LSHCVSHAVTVGGSEAD

SEQ ID NO: 1293006 - protein, 19 aa, Mycobacterium
LSKPFTFKRVEGLRPVIQQ

SEQ ID NO: 1293007 - protein, 21 aa, Mycobacterium
LSKPFTFRRVEALRPVIQQVT

SEQ ID NO: 1293008 - protein, 17 aa, Mycobacterium
LSKRGGGVALLLTNIRE

SEQ ID NO: 1293009 - protein, 17 aa, Mycobacterium
LSLHGGLVLDFDDYNEI

SEQ ID NO: 1293010 - protein, 17 aa, Mycobacterium
LSPLAYLTVDGRMLIVG

SEQ ID NO: 1293011 - protein, 17 aa, Mycobacterium
LSRACLLGCGVTTGWGS

SEQ ID NO: 1293012 - protein, 17 aa, Mycobacterium
LSRGFERFYGFMGGETD

SEQ ID NO: 1293013 - protein, 20 aa, Mycobacterium
LSRHGRFVGRVGGLAVALGI

SEQ ID NO: 1293014 - protein, 22 aa, Mycobacterium
LSRYGLGVLRAWIRHGTIYGKA

SEQ ID NO: 1293015 - protein, 17 aa, Mycobacterium
LSSPRIVGWIMRTDSSD

SEQ ID NO: 1293016 - protein, 24 aa, Mycobacterium
LSSSQLRSWFGYRIEGRSPVNNIP

SEQ ID NO: 1293017 - protein, 18 aa, Mycobacterium
LSWQNWEEMFSIARFIGV

SEQ ID NO: 1293018 - protein, 17 aa, Mycobacterium
LSYFLGVRGPAVVSDTA

SEQ ID NO: 1293019 - protein, 17 aa, Mycobacterium
LSYLRPRAVVFHRSLGA

SEQ ID NO: 1293020 - protein, 21 aa, Mycobacterium
LTAGLAFDWAALRAGDRVLIH

SEQ ID NO: 1293021 - protein, 18 aa, Mycobacterium
LTALCWDGGAALPFVDDD

SEQ ID NO: 1293022 - protein, 17 aa, Mycobacterium
LTAWLLLSCRALHEGAR

SEQ ID NO: 1293023 - protein, 17 aa, Mycobacterium
LTCPMFLTTPEFLPHHR

SEQ ID NO: 1293024 - protein, 17 aa, Mycobacterium
LTCPVFITTPEFLPQHR

SEQ ID NO: 1293025 - protein, 18 aa, Mycobacterium
LTDAGAFRMFVPRQYGGE

SEQ ID NO: 1293026 - protein, 17 aa, Mycobacterium
LTDEIRLGGAFILGNLE

SEQ ID NO: 1293027 - protein, 19 aa, Mycobacterium
LTDRSWCRPNWTVAELEAA

SEQ ID NO: 1293028 - protein, 22 aa, Mycobacterium
LTELCGVISHLLPEAHRDPGRE

SEQ ID NO: 1293029 - protein, 17 aa, Mycobacterium
LTGYGLGRIEGWPDDQT

SEQ ID NO: 1293030 - protein, 19 aa, Mycobacterium
LTIAMAWQATVRWADEPVS

SEQ ID NO: 1293031 - protein, 17 aa, Mycobacterium
LTIKAMIEKVVDRMYAE

SEQ ID NO: 1293032 - protein, 17 aa, Mycobacterium
LTLCDTVADNASSGAVV

SEQ ID NO: 1293033 - protein, 17 aa, Mycobacterium
LTMGHEFSGTIAAVGDG

SEQ ID NO: 1293034 - protein, 24 aa, Mycobacterium
LTPLWPVWPLEYALQGSLCESGGC

SEQ ID NO: 1293035 - protein, 18 aa, Mycobacterium
LTRPDLAFDMVRPGIAVY

SEQ ID NO: 1293036 - protein, 17 aa, Mycobacterium
LTRPRRAAVSGFGVSGT

SEQ ID NO: 1293037 - protein, 20 aa, Mycobacterium
LTRRPGLEFGPRWVDRLIVA

SEQ ID NO: 1293038 - protein, 21 aa, Mycobacterium
LTRTAGFQWARHNICVNAIAP

SEQ ID NO: 1293039 - protein, 22 aa, Mycobacterium
LTRTRFIALRGLRPAGVVPACC

SEQ ID NO: 1293040 - protein, 18 aa, Mycobacterium
LTSARPDLDFSWLTVDFE

SEQ ID NO: 1293041 - protein, 18 aa, Mycobacterium
LTSLRLADLEALLSYEES

SEQ ID NO: 1293042 - protein, 20 aa, Mycobacterium
LTYSLLEPFDWAGVEVTGVG

SEQ ID NO: 1293043 - protein, 18 aa, Mycobacterium
LVAARVGRPPVIRRAILT

SEQ ID NO: 1293044 - protein, 17 aa, Mycobacterium
LVARAAEHIGGWANRPL

SEQ ID NO: 1293045 - protein, 18 aa, Mycobacterium
LVDCGRGVQLRMAAAGIA

SEQ ID NO: 1293046 - protein, 22 aa, Mycobacterium
LVDFKGGATFLGLERTAHVSAV

SEQ ID NO: 1293047 - protein, 17 aa, Mycobacterium
LVDLGIRLGPWGDDLGR

SEQ ID NO: 1293048 - protein, 23 aa, Mycobacterium
LVEGRAAVVVPALWTVRRITDGG

SEQ ID NO: 1293049 - protein, 18 aa, Mycobacterium
LVEHMGLLLGRPVVTISC

SEQ ID NO: 1293050 - protein, 19 aa, Mycobacterium
LVERCGRRSLLLPGDLAEA

SEQ ID NO: 1293051 - protein, 17 aa, Mycobacterium
LVFEGSQFGGALMTTTE

SEQ ID NO: 1293052 - protein, 21 aa, Mycobacterium
LVFEVARGFIAPVVAFAQAVI

SEQ ID NO: 1293053 - protein, 17 aa, Mycobacterium
LVGVDFEGAQHWTDPKQ

SEQ ID NO: 1293054 - protein, 17 aa, Mycobacterium
LVKRAKPGLLMLSVCNS

SEQ ID NO: 1293055 - protein, 18 aa, Mycobacterium
LVKYLAYGWSSLRSRPAL

SEQ ID NO: 1293056 - protein, 17 aa, Mycobacterium
LVLCGAYARGRVVRAMN

SEQ ID NO: 1293057 - protein, 23 aa, Mycobacterium
LVLRLGTDLLRFRGVVTAAEQVA

SEQ ID NO: 1293058 - protein, 19 aa, Mycobacterium
LVMALRWVRDNVAAFGGDP

SEQ ID NO: 1293059 - protein, 17 aa, Mycobacterium
LVPAHLRDGHYSGAQKM

SEQ ID NO: 1293060 - protein, 18 aa, Mycobacterium
LVRLRPSPSLGLPAALTE

SEQ ID NO: 1293061 - protein, 27 aa, Mycobacterium
LVRMVRPWNEWLIVWGYDINDEPPALD

SEQ ID NO: 1293062 - protein, 17 aa, Mycobacterium
LVRPSLGISEWILPTLI

SEQ ID NO: 1293063 - protein, 19 aa, Mycobacterium
LVRRGFRASLRYRVPPMPF

SEQ ID NO: 1293064 - protein, 18 aa, Mycobacterium
LVRWPRQVLAEFGLYLPD

SEQ ID NO: 1293065 - protein, 23 aa, Mycobacterium
LVTDWKVGSTFDWRDGDLNISNP

SEQ ID NO: 1293066 - protein, 18 aa, Mycobacterium
LVTRLILVDVVPRYEKDG

SEQ ID NO: 1293067 - protein, 20 aa, Mycobacterium
LVTVGVWPALALPPLVTPVP

SEQ ID NO: 1293068 - protein, 21 aa, Mycobacterium
LVVGAPLRFGHRIYNTAVVIH

SEQ ID NO: 1293069 - protein, 17 aa, Mycobacterium
LVVSLGYRCRSTTKHVK

SEQ ID NO: 1293070 - protein, 18 aa, Mycobacterium
LVVSLGYRCRSTTKHVKG

SEQ ID NO: 1293071 - protein, 18 aa, Mycobacterium
LWARLPAGVYVPLIGLSF

SEQ ID NO: 1293072 - protein, 19 aa, Mycobacterium
LWPDGWEVLELNPAHVAEQ

SEQ ID NO: 1293073 - protein, 20 aa, Mycobacterium
LWQKHIERILAEWVDELAVP

SEQ ID NO: 1293074 - protein, 18 aa, Mycobacterium
LWQWSVDDVEAFWGALWD

SEQ ID NO: 1293075 - protein, 18 aa, Mycobacterium
LWRARRVLAVTFPTHGDS

SEQ ID NO: 1293076 - protein, 21 aa, Mycobacterium
LWRRLCTELELPGLHLSQECG

SEQ ID NO: 1293077 - protein, 21 aa, Mycobacterium
LWSRLRVAITLVQGGDDLTGA

SEQ ID NO: 1293078 - protein, 23 aa, Mycobacterium
LYCRNRIEIVIAMLGIVKAGAIL

SEQ ID NO: 1293079 - protein, 22 aa, Mycobacterium
LYCRNRIEIVIGMVGIVKAGAI

SEQ ID NO: 1293080 - protein, 18 aa, Mycobacterium
LYDGFTFNCLSWLEALGF

SEQ ID NO: 1293081 - protein, 19 aa, Mycobacterium
LYDRIGFAAVGRFNEFNNL

SEQ ID NO: 1293082 - protein, 18 aa, Mycobacterium
LYEVLGLDFIYKAFTTTD

SEQ ID NO: 1293083 - protein, 23 aa, Mycobacterium
LYGPRWAMVRAFNAANDIDRIEV

SEQ ID NO: 1293084 - protein, 17 aa, Mycobacterium
LYIALGISGAIQHRAGM

SEQ ID NO: 1293085 - protein, 18 aa, Mycobacterium
LYKREFNEYWASDPTAAP

SEQ ID NO: 1293086 - protein, 22 aa, Mycobacterium
LYLHVPGLPPIVVLPDRAPADA

SEQ ID NO: 1293087 - protein, 25 aa, Mycobacterium
LYLRIAPELFLKRCVVGGFDRVFEL

SEQ ID NO: 1293088 - protein, 17 aa, Mycobacterium
LYPHMWSWDAAFVAIGL

SEQ ID NO: 1293089 - protein, 21 aa, Mycobacterium
LYPRVEVEVGFILSDDLPGAG

SEQ ID NO: 1293090 - protein, 19 aa, Mycobacterium
LYREYSLRPPKGVLLYGPP

SEQ ID NO: 1293091 - protein, 18 aa, Mycobacterium
LYRHFPDKVSLLGAAIVR

SEQ ID NO: 1293092 - protein, 22 aa, Mycobacterium
LYRIDPRTGAALGKEDWHGTFP

SEQ ID NO: 1293093 - protein, 18 aa, Mycobacterium
LYRRAAAHFGEVLYNLYG

SEQ ID NO: 1293094 - protein, 18 aa, Mycobacterium
LYSRFWHKVLYDLGHVSS

SEQ ID NO: 1293095 - protein, 18 aa, Mycobacterium
LYSTHRWAPNTAICSSSE

SEQ ID NO: 1293096 - protein, 17 aa, Mycobacterium
LYVSPALVRTDLLRRSD

SEQ ID NO: 1293097 - protein, 19 aa, Mycobacterium
LYWQCWKLDSDTVRQVTAA

SEQ ID NO: 1293098 - protein, 17 aa, Mycobacterium
MAAAVWLRGILQDHYGL

SEQ ID NO: 1293099 - protein, 21 aa, Mycobacterium
MADFPDRWWNFVAVANAMAGG

SEQ ID NO: 1293100 - protein, 17 aa, Mycobacterium
MAEKLWQLRILDDEKSA

SEQ ID NO: 1293101 - protein, 21 aa, Mycobacterium
MAEPKWVLAMGVCASSGGMFN

SEQ ID NO: 1293102 - protein, 19 aa, Mycobacterium
MAETFPGAQILAAFGQTEM

SEQ ID NO: 1293103 - protein, 17 aa, Mycobacterium
MAFRSAGYWDVTAELDA

SEQ ID NO: 1293104 - protein, 22 aa, Mycobacterium
MALRLERFAVWLIFELLAVTLV

SEQ ID NO: 1293105 - protein, 19 aa, Mycobacterium
MAPHLWRFLQYQPLVAFAG

SEQ ID NO: 1293106 - protein, 17 aa, Mycobacterium
MARAGGMLSRLRPLFSL

SEQ ID NO: 1293107 - protein, 18 aa, Mycobacterium
MARLGHSVAFFIGTAYGS

SEQ ID NO: 1293108 - protein, 23 aa, Mycobacterium
MARRLRLNSRMGLLADDARVVDT

SEQ ID NO: 1293109 - protein, 24 aa, Mycobacterium
MARRLRLNSRMGLLADDVRVVDTL

SEQ ID NO: 1293110 - protein, 24 aa, Mycobacterium
MATSQRIVVCWAMGLTQHKHAVPS

SEQ ID NO: 1293111 - protein, 18 aa, Mycobacterium
MAVICLIGAMLVDSGHSD

SEQ ID NO: 1293112 - protein, 18 aa, Mycobacterium
MAVVRWLVDHGAGRLVLN

SEQ ID NO: 1293113 - protein, 19 aa, Mycobacterium
MDCGIPFCHNGCPLGNLIP

SEQ ID NO: 1293114 - protein, 18 aa, Mycobacterium
MDGWYEWKGQKGAKTPYY

SEQ ID NO: 1293115 - protein, 20 aa, Mycobacterium
MDLIHLWLIHRFKAEIVYYV

SEQ ID NO: 1293116 - protein, 17 aa, Mycobacterium
MDWMWSALHLDDGTHIH

SEQ ID NO: 1293117 - protein, 20 aa, Mycobacterium
MEGLIAWKLGTSFRNAETIV

SEQ ID NO: 1293118 - protein, 21 aa, Mycobacterium
MEGLIAWKLGTSFRNAETIVA

SEQ ID NO: 1293119 - protein, 20 aa, Mycobacterium
MELGCDAVLLASAVTRSADP

SEQ ID NO: 1293120 - protein, 24 aa, Mycobacterium
MFDRLPPLFLEMALSFLAMDPPRH

SEQ ID NO: 1293121 - protein, 19 aa, Mycobacterium
MFETIRFDLNLVVAGDDGE

SEQ ID NO: 1293122 - protein, 21 aa, Mycobacterium
MFGAGCRRLVLASSMVVYGQG

SEQ ID NO: 1293123 - protein, 17 aa, Mycobacterium
MFGRVAIAQTLRDITPD

SEQ ID NO: 1293124 - protein, 17 aa, Mycobacterium
MFHAWGFSQLLFAGLLA

SEQ ID NO: 1293125 - protein, 24 aa, Mycobacterium
MFSRAVCLKAPYFRTIHPAIEELR

SEQ ID NO: 1293126 - protein, 24 aa, Mycobacterium
MGDKWMLAETLAWQAYAALMGGGD

SEQ ID NO: 1293127 - protein, 18 aa, Mycobacterium
MGGLLAFEVARRFEEAGR

SEQ ID NO: 1293128 - protein, 17 aa, Mycobacterium
MGHVILAEFFVRQRVPF

SEQ ID NO: 1293129 - protein, 17 aa, Mycobacterium
MGIPLLYPWANRLSSSK

SEQ ID NO: 1293130 - protein, 23 aa, Mycobacterium
MGLARLWQSWGFEPDVVLGHSVG

SEQ ID NO: 1293131 - protein, 18 aa, Mycobacterium
MGMARLWRSWGVEPDVVL

SEQ ID NO: 1293132 - protein, 19 aa, Mycobacterium
MGPGCRRLLLTAGPSVTKG

SEQ ID NO: 1293133 - protein, 17 aa, Mycobacterium
MHLPARFDGGPHQPIAP

SEQ ID NO: 1293134 - protein, 23 aa, Mycobacterium
MHLYLKRAHVFRHLFGEPTDVLA

SEQ ID NO: 1293135 - protein, 20 aa, Mycobacterium
MIRVAEWLRDSGIAVDDIGL

SEQ ID NO: 1293136 - protein, 22 aa, Mycobacterium
MIRYCAPAQWFARTLRRPFTLH

SEQ ID NO: 1293137 - protein, 20 aa, Mycobacterium
MKLFWERGFGGVSISDVTAA

SEQ ID NO: 1293138 - protein, 19 aa, Mycobacterium
MKNPEFAAAILPTLRGLKA

SEQ ID NO: 1293139 - protein, 20 aa, Mycobacterium
MLAVMLRRRMVSAGMDTGGA

SEQ ID NO: 1293140 - protein, 18 aa, Mycobacterium
MLDIRLKALRTFDKKPMP

SEQ ID NO: 1293141 - protein, 24 aa, Mycobacterium
MLETWKVAPALAWGNTVVLKPAED

SEQ ID NO: 1293142 - protein, 17 aa, Mycobacterium
MLHRGCRAIRELASIDL

SEQ ID NO: 1293143 - protein, 17 aa, Mycobacterium
MLLRGMGIPSRYVSGYL

SEQ ID NO: 1293144 - protein, 21 aa, Mycobacterium
MLQALCEEWARRGWLAVRYNL

SEQ ID NO: 1293145 - protein, 24 aa, Mycobacterium
MLRRGEGKFGFLVKFHRIAASDER

SEQ ID NO: 1293146 - protein, 25 aa, Mycobacterium
MLTCSIRPSGIWGRGDQTMFRKVFE

SEQ ID NO: 1293147 - protein, 19 aa, Mycobacterium
MLTPFIWRMDCFGRPHLEQ

SEQ ID NO: 1293148 - protein, 28 aa, Mycobacterium
MLYFVSPEWWRPRMHASHQALGKAPASA

SEQ ID NO: 1293149 - protein, 18 aa, Mycobacterium
MLYGAYRSGAPFGGRVTE

SEQ ID NO: 1293150 - protein, 17 aa, Mycobacterium
MNFDIVYLPPIHPIGKV

SEQ ID NO: 1293151 - protein, 19 aa, Mycobacterium
MNMRWESLIAALRNSAPDF

SEQ ID NO: 1293152 - protein, 17 aa, Mycobacterium
MNSWGGGLAQAFYRCID

SEQ ID NO: 1293153 - protein, 18 aa, Mycobacterium
MPAGLWKRVVEVFEPANV

SEQ ID NO: 1293154 - protein, 18 aa, Mycobacterium
MPALKFVWADGAADMLTP

SEQ ID NO: 1293155 - protein, 17 aa, Mycobacterium
MPARAKEAFGIQKRQRQ

SEQ ID NO: 1293156 - protein, 21 aa, Mycobacterium
MPEMPLIKFIDGWETVVEMEA

SEQ ID NO: 1293157 - protein, 21 aa, Mycobacterium
MPEMPLIKFVDGFETIAEIES

SEQ ID NO: 1293158 - protein, 20 aa, Mycobacterium
MPGARLWMYTNFHCNLACDY

SEQ ID NO: 1293159 - protein, 20 aa, Mycobacterium
MPGRSGLDIDVMTALADALG

SEQ ID NO: 1293160 - protein, 21 aa, Mycobacterium
MPIKVPWSLPSARPCLAGSDD

SEQ ID NO: 1293161 - protein, 19 aa, Mycobacterium
MPLGTGWVVAIAWPENDTD

SEQ ID NO: 1293162 - protein, 19 aa, Mycobacterium
MPLPLLRQALQAWPNTDFM

SEQ ID NO: 1293163 - protein, 19 aa, Mycobacterium
MPMRVIGMLLGIPEEDQRR

SEQ ID NO: 1293164 - protein, 19 aa, Mycobacterium
MPNRISWTVVHYRPPEAMT

SEQ ID NO: 1293165 - protein, 19 aa, Mycobacterium
MPYKHGFGPFAPEIYRAPL

SEQ ID NO: 1293166 - protein, 17 aa, Mycobacterium
MQVLCGWTNPPDRGEGY

SEQ ID NO: 1293167 - protein, 22 aa, Mycobacterium
MRASLDALCRFVEDARSPSGGF

SEQ ID NO: 1293168 - protein, 18 aa, Mycobacterium
MREHGLEFNHDWMIDDRP

SEQ ID NO: 1293169 - protein, 18 aa, Mycobacterium
MRGGKFLNNWRMAELHAQ

SEQ ID NO: 1293170 - protein, 17 aa, Mycobacterium
MRGRLALHHVRARLYGA

SEQ ID NO: 1293171 - protein, 17 aa, Mycobacterium
MRISHCRPPGSDRDIVL

SEQ ID NO: 1293172 - protein, 22 aa, Mycobacterium
MRLNEMLDCIPLLPRNIAHSDE

SEQ ID NO: 1293173 - protein, 17 aa, Mycobacterium
MRLTCAFDHRVADGAQV

SEQ ID NO: 1293174 - protein, 20 aa, Mycobacterium
MRPACWDAMLTLMRAMASAY

SEQ ID NO: 1293175 - protein, 18 aa, Mycobacterium
MRSLLRMQHRILGGTRRL

SEQ ID NO: 1293176 - protein, 21 aa, Mycobacterium
MRSTELMYAWHLPDVIEAMVG

SEQ ID NO: 1293177 - protein, 17 aa, Mycobacterium
MRTVMCILNGQLRPVVV

SEQ ID NO: 1293178 - protein, 20 aa, Mycobacterium
MRTWFGFGVAGNFAGHLEQA

SEQ ID NO: 1293179 - protein, 17 aa, Mycobacterium
MRVPYGFVSSRHGYGAL

SEQ ID NO: 1293180 - protein, 17 aa, Mycobacterium
MSAKLMERWSSRRAAIK

SEQ ID NO: 1293181 - protein, 18 aa, Mycobacterium
MSGARIVLHLALELQRRG

SEQ ID NO: 1293182 - protein, 17 aa, Mycobacterium
MSGLRGGVFSAILPVLA

SEQ ID NO: 1293183 - protein, 17 aa, Mycobacterium
MSHWTLPHLVGGAVAAD

SEQ ID NO: 1293184 - protein, 17 aa, Mycobacterium
MSICGRVVDELEAKPPR

SEQ ID NO: 1293185 - protein, 18 aa, Mycobacterium
MSLSGRWRKQGIDVRFAA

SEQ ID NO: 1293186 - protein, 24 aa, Mycobacterium
MSTKFPFTVFRAGLHPEIRTALQN

SEQ ID NO: 1293187 - protein, 18 aa, Mycobacterium
MSTVERFAGIGVSQALSY

SEQ ID NO: 1293188 - protein, 22 aa, Mycobacterium
MTIWQFLHFRFGLPKPLLEPLA

SEQ ID NO: 1293189 - protein, 27 aa, Mycobacterium
MTKLWARMWLLRFTWQRAIDSGDLTSP

SEQ ID NO: 1293190 - protein, 19 aa, Mycobacterium
MTPAAFVRRPGRWIREMAR

SEQ ID NO: 1293191 - protein, 24 aa, Mycobacterium
MTPRRMMALLLRFGPYGDRFGLRR

SEQ ID NO: 1293192 - protein, 22 aa, Mycobacterium
MTSKRLLSQYVHDLATELAVRG

SEQ ID NO: 1293193 - protein, 27 aa, Mycobacterium
MTVSVSFHEPVRWDGWLLYSHESTQVG

SEQ ID NO: 1293194 - protein, 18 aa, Mycobacterium
MVCPYSFDVPGGVQSHVL

SEQ ID NO: 1293195 - protein, 19 aa, Mycobacterium
MVDAAICDGDWVVVRQQAV

SEQ ID NO: 1293196 - protein, 18 aa, Mycobacterium
MVFGHRGINIPVIDHATG

SEQ ID NO: 1293197 - protein, 17 aa, Mycobacterium
MVLDPAGSVGFRVIDAQ

SEQ ID NO: 1293198 - protein, 17 aa, Mycobacterium
MVRRRITFLAKSEYFTG

SEQ ID NO: 1293199 - protein, 20 aa, Mycobacterium
MWTPEIARIVALRGAEIILS

SEQ ID NO: 1293200 - protein, 25 aa, Mycobacterium
MWTTYRQSPAWGFCMWAITPDQMYS

SEQ ID NO: 1293201 - protein, 20 aa, Mycobacterium
MYAGLEFLRGLRVVPAELGG

SEQ ID NO: 1293202 - protein, 18 aa, Mycobacterium
MYRPFPVEALAAALPETV

SEQ ID NO: 1293203 - protein, 18 aa, Mycobacterium
NAASRALVRFGFAAGDGL

SEQ ID NO: 1293204 - protein, 24 aa, Mycobacterium
NADHARWFYEFSRPGDVVEVRNTG

SEQ ID NO: 1293205 - protein, 17 aa, Mycobacterium
NAGCTGTAPPTCEDANA

SEQ ID NO: 1293206 - protein, 17 aa, Mycobacterium
NAIKVLAVREVMRLLDG

SEQ ID NO: 1293207 - protein, 19 aa, Mycobacterium
NALAHCIDSLWAPNANPIN

SEQ ID NO: 1293208 - protein, 17 aa, Mycobacterium
NALKVAFDWKSRLNEAR

SEQ ID NO: 1293209 - protein, 20 aa, Mycobacterium
NAMGRPGLTLGLGPSHEPIV

SEQ ID NO: 1293210 - protein, 17 aa, Mycobacterium
NATAFGFSPRLRADIVV

SEQ ID NO: 1293211 - protein, 22 aa, Mycobacterium
NAVELARAWKPATLRATSKTKS

SEQ ID NO: 1293212 - protein, 18 aa, Mycobacterium
NAVIFCGHFPDGAEKFTK

SEQ ID NO: 1293213 - protein, 17 aa, Mycobacterium
NCGPRFTIIAALPYDRS

SEQ ID NO: 1293214 - protein, 21 aa, Mycobacterium
NCGVSWNLLAGIGRIESGHAS

SEQ ID NO: 1293215 - protein, 22 aa, Mycobacterium
NCIRSFPGRGIRVWGARTLSSD

SEQ ID NO: 1293216 - protein, 19 aa, Mycobacterium
NDDVLRCARLIRAGEAAWF

SEQ ID NO: 1293217 - protein, 18 aa, Mycobacterium
NDGALGWSGTSPVGTFPA

SEQ ID NO: 1293218 - protein, 17 aa, Mycobacterium
NDGALGWVGTSPVGTFP

SEQ ID NO: 1293219 - protein, 25 aa, Mycobacterium
NDGEVVWRETMEWLDRHVKGDESID

SEQ ID NO: 1293220 - protein, 24 aa, Mycobacterium
NDHEYRSAAALCRYLWLTRGLTGI

SEQ ID NO: 1293221 - protein, 23 aa, Mycobacterium
NDHYRLSVDLARGGGVSSLVAGG

SEQ ID NO: 1293222 - protein, 18 aa, Mycobacterium
NDPDWQRFHLIGATNTVY

SEQ ID NO: 1293223 - protein, 19 aa, Mycobacterium
NDPDWQRFHLIGATNTVYF

SEQ ID NO: 1293224 - protein, 17 aa, Mycobacterium
NDPRFLFHPAIKELTLD

SEQ ID NO: 1293225 - protein, 19 aa, Mycobacterium
NDREWKALCERVINRPELV

SEQ ID NO: 1293226 - protein, 19 aa, Mycobacterium
NECHRLCLDYAKTRTLWGR

SEQ ID NO: 1293227 - protein, 19 aa, Mycobacterium
NEDSRWTVQLAWKAGLSDN

SEQ ID NO: 1293228 - protein, 21 aa, Mycobacterium
NEEIKGCWVLARYNDGRPSQL

SEQ ID NO: 1293229 - protein, 24 aa, Mycobacterium
NEEKAAAIAARWGDRVCSVVGDAT

SEQ ID NO: 1293230 - protein, 23 aa, Mycobacterium
NEFAARLMFTFAFNRPGRKAAKL

SEQ ID NO: 1293231 - protein, 20 aa, Mycobacterium
NEIRINWVWNPPWGPDKITD

SEQ ID NO: 1293232 - protein, 17 aa, Mycobacterium
NELALAWLVRGDINIGQ

SEQ ID NO: 1293233 - protein, 19 aa, Mycobacterium
NELGHPWTVLRATRSTDYL

SEQ ID NO: 1293234 - protein, 22 aa, Mycobacterium
NFTMDGPWGFWVNRWTAEENRH

SEQ ID NO: 1293235 - protein, 25 aa, Mycobacterium
NFVFGEMWLRPALGMRERRLITVAC

SEQ ID NO: 1293236 - protein, 21 aa, Mycobacterium
NGCRTRWAMGWSDDATESALR

SEQ ID NO: 1293237 - protein, 18 aa, Mycobacterium
NGDCPKRLIDLIGAAVHS

SEQ ID NO: 1293238 - protein, 22 aa, Mycobacterium
NGGRGGLLFGNGGRGGDAVLPG

SEQ ID NO: 1293239 - protein, 19 aa, Mycobacterium
NGIKSAFMSYGLVDGRRMS

SEQ ID NO: 1293240 - protein, 17 aa, Mycobacterium
NGLKGRGVLAVRGRGLW

SEQ ID NO: 1293241 - protein, 23 aa, Mycobacterium
NGNPAVVILWDWTGEGLTTFRGV

SEQ ID NO: 1293242 - protein, 18 aa, Mycobacterium
NGPFLYRSAFHAETEEQE

SEQ ID NO: 1293243 - protein, 24 aa, Mycobacterium
NGSLRGVMMFDGFSFGGVLTKSLA

SEQ ID NO: 1293244 - protein, 19 aa, Mycobacterium
NGVIARKGAAYGIATPISD

SEQ ID NO: 1293245 - protein, 20 aa, Mycobacterium
NGVRRWLALDGQPLHRVTVA

SEQ ID NO: 1293246 - protein, 19 aa, Mycobacterium
NGYCGLPLQQTCPHANACL

SEQ ID NO: 1293247 - protein, 22 aa, Mycobacterium
NHDRFAAGLTRWTRSFEVGSSE

SEQ ID NO: 1293248 - protein, 18 aa, Mycobacterium
NHELAHDVNHYWAHHMSA

SEQ ID NO: 1293249 - protein, 21 aa, Mycobacterium
NHNTWGVAMLGNFDVVPPTPI

SEQ ID NO: 1293250 - protein, 21 aa, Mycobacterium
NHRNAWRPAHIHFSFFGTEFT

SEQ ID NO: 1293251 - protein, 22 aa, Mycobacterium
NILWLLKQAFYFSLTTVNEAIS

SEQ ID NO: 1293252 - protein, 19 aa, Mycobacterium
NISHEFRTPLTLILDPVSE

SEQ ID NO: 1293253 - protein, 27 aa, Mycobacterium
NKAIARFIVRYTEAFKKYGITDDTVQA

SEQ ID NO: 1293254 - protein, 21 aa, Mycobacterium
NKRLPAKVAYVLNRWKSILQQ

SEQ ID NO: 1293255 - protein, 20 aa, Mycobacterium
NLAGRPMLERAIAGLRDSGV

SEQ ID NO: 1293256 - protein, 20 aa, Mycobacterium
NLAGRPMLERAIAGLRNSGV

SEQ ID NO: 1293257 - protein, 17 aa, Mycobacterium
NLLECRSPAAARGRGVV

SEQ ID NO: 1293258 - protein, 23 aa, Mycobacterium
NLREIDVAFPLGVLTSVTGVSGS

SEQ ID NO: 1293259 - protein, 31 aa, Mycobacterium
NLRPETQLALAKWGMLSPHGKCFAFDSRADG

SEQ ID NO: 1293260 - protein, 22 aa, Mycobacterium
NMFALGLLSWMYGRELEHSESF

SEQ ID NO: 1293261 - protein, 20 aa, Mycobacterium
NMLGCYYCNLYAAQCMERND

SEQ ID NO: 1293262 - protein, 18 aa, Mycobacterium
NMNPHWLGAHPTYTLSKY

SEQ ID NO: 1293263 - protein, 18 aa, Mycobacterium
NPEAWRWYRLAFGGDNTP

SEQ ID NO: 1293264 - protein, 19 aa, Mycobacterium
NPGRFEGRWSLAGAQPKIA

SEQ ID NO: 1293265 - protein, 18 aa, Mycobacterium
NPIDWKIVAGFMREQIPL

SEQ ID NO: 1293266 - protein, 17 aa, Mycobacterium
NPLRFVSATVKWCRKAE

SEQ ID NO: 1293267 - protein, 21 aa, Mycobacterium
NPRELAGWLAAALVAKDGIAA

SEQ ID NO: 1293268 - protein, 18 aa, Mycobacterium
NPVNIRWSAAEIAYALRD

SEQ ID NO: 1293269 - protein, 21 aa, Mycobacterium
NQLRAFLWWLLRLRPDLEIYL

SEQ ID NO: 1293270 - protein, 21 aa, Mycobacterium
NQLRFRAPRMLDLSLLVAALP

SEQ ID NO: 1293271 - protein, 21 aa, Mycobacterium
NQLWMCGLPGYGPGDLIDFEF

SEQ ID NO: 1293272 - protein, 18 aa, Mycobacterium
NRAYSCWATLPVPVIDRC

SEQ ID NO: 1293273 - protein, 20 aa, Mycobacterium
NRLLGAISWLAAQKPGIYDG

SEQ ID NO: 1293274 - protein, 23 aa, Mycobacterium
NRTHTKWRLKLVLSGANPVTGTF

SEQ ID NO: 1293275 - protein, 20 aa, Mycobacterium
NRVSYFYDFRGPSMAIDTAC

SEQ ID NO: 1293276 - protein, 20 aa, Mycobacterium
NRYPRVCGMTGTALAAGEQL

SEQ ID NO: 1293277 - protein, 17 aa, Mycobacterium
NSVLPGYIWGGTLESYF

SEQ ID NO: 1293278 - protein, 22 aa, Mycobacterium
NTHKPEIIGFVAAIGSAGASIA

SEQ ID NO: 1293279 - protein, 18 aa, Mycobacterium
NVKKAGFLPQERQWLTEL

SEQ ID NO: 1293280 - protein, 23 aa, Mycobacterium
NVKVPLQPGVPWVFQTTLDDPTQ

SEQ ID NO: 1293281 - protein, 22 aa, Mycobacterium
NVPEAFAVIADRVGGDGLYSSN

SEQ ID NO: 1293282 - protein, 19 aa, Mycobacterium
NVREAIKIARQCRTLLGAN

SEQ ID NO: 1293283 - protein, 18 aa, Mycobacterium
NVTLARFVPHSLVLDRAV

SEQ ID NO: 1293284 - protein, 18 aa, Mycobacterium
NVVADVNAVLGFAYLHSG

SEQ ID NO: 1293285 - protein, 18 aa, Mycobacterium
NVVSGWFKDEFTHLGEPW

SEQ ID NO: 1293286 - protein, 19 aa, Mycobacterium
NVVSGWFKDEFTHLGEPWL

SEQ ID NO: 1293287 - protein, 18 aa, Mycobacterium
NVYTVEWQNVQGLTPSGL

SEQ ID NO: 1293288 - protein, 21 aa, Mycobacterium
NWYTEFARLAPLMKPDVHYEV

SEQ ID NO: 1293289 - protein, 18 aa, Mycobacterium
PAAGIAEFGHLCLDAPDV

SEQ ID NO: 1293290 - protein, 17 aa, Mycobacterium
PAALPFLSIKKITVHYR

SEQ ID NO: 1293291 - protein, 18 aa, Mycobacterium
PAAPLFGQCCAALLASFK

SEQ ID NO: 1293292 - protein, 18 aa, Mycobacterium
PAAWEIITTSSLYSEIAS

SEQ ID NO: 1293293 - protein, 19 aa, Mycobacterium
PACPKHWTLLISLKRLAEV

SEQ ID NO: 1293294 - protein, 17 aa, Mycobacterium
PADFGLPDCPRWKVIDR

SEQ ID NO: 1293295 - protein, 18 aa, Mycobacterium
PADIRVWVGHYFDYMDHH

SEQ ID NO: 1293296 - protein, 18 aa, Mycobacterium
PADRFEVVATFAGRGDQL

SEQ ID NO: 1293297 - protein, 23 aa, Mycobacterium
PADRLQIVVDVMLRFWLENPATV

SEQ ID NO: 1293298 - protein, 18 aa, Mycobacterium
PADYFALLAELGFITEDD

SEQ ID NO: 1293299 - protein, 21 aa, Mycobacterium
PAEAKRALARFIEHRLPSFGR

SEQ ID NO: 1293300 - protein, 19 aa, Mycobacterium
PAELHPFIELDGGRHHAPS

SEQ ID NO: 1293301 - protein, 20 aa, Mycobacterium
PAEVQRFASFFLTMDPPQHT

SEQ ID NO: 1293302 - protein, 19 aa, Mycobacterium
PAFTGWHRLEYLLFSQNTT

SEQ ID NO: 1293303 - protein, 19 aa, Mycobacterium
PAGEQRLVVELARGSEPRS

SEQ ID NO: 1293304 - protein, 19 aa, Mycobacterium
PAGKLRAGSLIPLTSAGAY

SEQ ID NO: 1293305 - protein, 24 aa, Mycobacterium
PAGSCTRWAVSRDGIMPRLRAASA

SEQ ID NO: 1293306 - protein, 17 aa, Mycobacterium
PAGSVLVEFGETRVMCT

SEQ ID NO: 1293307 - protein, 18 aa, Mycobacterium
PAISLPLHWTADGLPLGV

SEQ ID NO: 1293308 - protein, 19 aa, Mycobacterium
PAISLPLHWTEEGLPLGVQ

SEQ ID NO: 1293309 - protein, 22 aa, Mycobacterium
PALHRRWWAADGLGAFVTVSGE

SEQ ID NO: 1293310 - protein, 23 aa, Mycobacterium
PALLSVSFGEDWSWVRRAHEVGA

SEQ ID NO: 1293311 - protein, 24 aa, Mycobacterium
PALLSVSFGEDWSWVRRAHEVGAT

SEQ ID NO: 1293312 - protein, 20 aa, Mycobacterium
PALVCVHGFPTSGIDYSALA

SEQ ID NO: 1293313 - protein, 21 aa, Mycobacterium
PALVGHGGWERLQRFAVITQF

SEQ ID NO: 1293314 - protein, 18 aa, Mycobacterium
PAMRTGFYGFGFNVGTSS

SEQ ID NO: 1293315 - protein, 24 aa, Mycobacterium
PANARIADWIPYSALLPHVDVMIT

SEQ ID NO: 1293316 - protein, 19 aa, Mycobacterium
PAPGAPIFGEAGVAAPPLP

SEQ ID NO: 1293317 - protein, 19 aa, Mycobacterium
PAPVPGFRGTRSFGTEEFD

SEQ ID NO: 1293318 - protein, 17 aa, Mycobacterium
PAQRLPLVLLNPSLAPR

SEQ ID NO: 1293319 - protein, 27 aa, Mycobacterium
PAQSAMAWSLLGWVRRNFFNQAPVVDY

SEQ ID NO: 1293320 - protein, 17 aa, Mycobacterium
PASTVPLLALRFAEALT

SEQ ID NO: 1293321 - protein, 18 aa, Mycobacterium
PASYCGAWGFKPSHLRLP

SEQ ID NO: 1293322 - protein, 24 aa, Mycobacterium
PATRPRIRLAYRLTPRRVTGAARA

SEQ ID NO: 1293323 - protein, 17 aa, Mycobacterium
PAVARRVARWMVVFLQR

SEQ ID NO: 1293324 - protein, 17 aa, Mycobacterium
PAVDGYVFLAAPLPREW

SEQ ID NO: 1293325 - protein, 17 aa, Mycobacterium
PAVRVGRSFRVHAKAVH

SEQ ID NO: 1293326 - protein, 19 aa, Mycobacterium
PAWLERAWARIAEEVKAGR

SEQ ID NO: 1293327 - protein, 17 aa, Mycobacterium
PAWPRFEHDDALITVGS

SEQ ID NO: 1293328 - protein, 23 aa, Mycobacterium
PAYPQDRLEFILGDCDAKVVVRE

SEQ ID NO: 1293329 - protein, 20 aa, Mycobacterium
PCLECKLCVAACPVGAIKKN

SEQ ID NO: 1293330 - protein, 18 aa, Mycobacterium
PCLPCGVHMYLGQGKELE

SEQ ID NO: 1293331 - protein, 17 aa, Mycobacterium
PCLTAAWEEKTVHVRNL

SEQ ID NO: 1293332 - protein, 19 aa, Mycobacterium
PCPECGFDASAVHHSDVAD

SEQ ID NO: 1293333 - protein, 18 aa, Mycobacterium
PDAAVAVCGWRSDLDGAH

SEQ ID NO: 1293334 - protein, 19 aa, Mycobacterium
PDAAVAVCGWRSDLDGAHV

SEQ ID NO: 1293335 - protein, 24 aa, Mycobacterium
PDAFPLIITHGWPGSVVEFHKVIE

SEQ ID NO: 1293336 - protein, 19 aa, Mycobacterium
PDAPLGFGVLMEAIEEAAI

SEQ ID NO: 1293337 - protein, 17 aa, Mycobacterium
PDCALWHGAAWDRETVA

SEQ ID NO: 1293338 - protein, 18 aa, Mycobacterium
PDCCAVVAYGALLGDALL

SEQ ID NO: 1293339 - protein, 19 aa, Mycobacterium
PDEVLEMVGLTAVAGSRAG

SEQ ID NO: 1293340 - protein, 22 aa, Mycobacterium
PDFLRLGLMLALERRPVEPKAR

SEQ ID NO: 1293341 - protein, 18 aa, Mycobacterium
PDGQCLFGPVLIDPPAGE

SEQ ID NO: 1293342 - protein, 19 aa, Mycobacterium
PDGQCLFGPVLIDPPVGKA

SEQ ID NO: 1293343 - protein, 24 aa, Mycobacterium
PDGRDCPDWVPGELWVGGRGVARG

SEQ ID NO: 1293344 - protein, 18 aa, Mycobacterium
PDISDLFAGLPAWANLRP

SEQ ID NO: 1293345 - protein, 19 aa, Mycobacterium
PDISVPFGVNVLWDGRASI

SEQ ID NO: 1293346 - protein, 18 aa, Mycobacterium
PDLATGLQPMRWGTGYML

SEQ ID NO: 1293347 - protein, 18 aa, Mycobacterium
PDLDFSWLTVDFEPIIAL

SEQ ID NO: 1293348 - protein, 18 aa, Mycobacterium
PDLFAGFSVDAFPTTSMA

SEQ ID NO: 1293349 - protein, 23 aa, Mycobacterium
PDLLRTVLMLLRTAALAASTRRG

SEQ ID NO: 1293350 - protein, 21 aa, Mycobacterium
PDLPATVLPFILRGVTLAGID

SEQ ID NO: 1293351 - protein, 19 aa, Mycobacterium
PDLTIPRRFLPGLSDDQLL

SEQ ID NO: 1293352 - protein, 19 aa, Mycobacterium
PDMFTGVLVQGGHHSDSMQ

SEQ ID NO: 1293353 - protein, 25 aa, Mycobacterium
PDMKLPIALALGWPSRVPGAAPACD

SEQ ID NO: 1293354 - protein, 18 aa, Mycobacterium
PDQFWLAIEALRLRHAAV

SEQ ID NO: 1293355 - protein, 23 aa, Mycobacterium
PDRLRSGWLNGIKHWQVDYTGPS

SEQ ID NO: 1293356 - protein, 19 aa, Mycobacterium
PDRQRYLVQFTVTGFADKA

SEQ ID NO: 1293357 - protein, 23 aa, Mycobacterium
PDVAGPYAWWSWRGKAFDNDAGW

SEQ ID NO: 1293358 - protein, 23 aa, Mycobacterium
PDVKRIAVRLGPWMEPEQVCFAI

SEQ ID NO: 1293359 - protein, 21 aa, Mycobacterium
PDVLHWLGIRKIHRFVSMSNM

SEQ ID NO: 1293360 - protein, 19 aa, Mycobacterium
PDVLLRAAALLPDVQVLIA

SEQ ID NO: 1293361 - protein, 18 aa, Mycobacterium
PDVPLGWWEFYSISDDDP

SEQ ID NO: 1293362 - protein, 20 aa, Mycobacterium
PDYLGWDWKTKAGIPIVCVP

SEQ ID NO: 1293363 - protein, 17 aa, Mycobacterium
PEDCRRVVATATERNGG

SEQ ID NO: 1293364 - protein, 18 aa, Mycobacterium
PEDLAGWAGDVFDHHQRF

SEQ ID NO: 1293365 - protein, 22 aa, Mycobacterium
PEDLPFAVLMALHLPEQGPSVL

SEQ ID NO: 1293366 - protein, 17 aa, Mycobacterium
PEFFGMLPAQTLQRTGD

SEQ ID NO: 1293367 - protein, 23 aa, Mycobacterium
PEFVSLWADHRVKRCEADTYDLH

SEQ ID NO: 1293368 - protein, 17 aa, Mycobacterium
PEGFGRIAATTARQVIL

SEQ ID NO: 1293369 - protein, 18 aa, Mycobacterium
PEGYRLVLYYAEVEGYTY

SEQ ID NO: 1293370 - protein, 17 aa, Mycobacterium
PEHMHIWLGSGRMETLR

SEQ ID NO: 1293371 - protein, 21 aa, Mycobacterium
PEILPAHLILGMFADPTGLAA

SEQ ID NO: 1293372 - protein, 26 aa, Mycobacterium
PEIPEWSSGEWTDWKWNTLLIEGSNC

SEQ ID NO: 1293373 - protein, 20 aa, Mycobacterium
PEIWAGWDFEFWEDRYEEQL

SEQ ID NO: 1293374 - protein, 18 aa, Mycobacterium
PEKFRSMMRLMVEAPFLL

SEQ ID NO: 1293375 - protein, 17 aa, Mycobacterium
PELKARHLALASASGDD

SEQ ID NO: 1293376 - protein, 19 aa, Mycobacterium
PELLAGFWSLVEQLQISAM

SEQ ID NO: 1293377 - protein, 17 aa, Mycobacterium
PELRRPITEVGMVKNVT

SEQ ID NO: 1293378 - protein, 18 aa, Mycobacterium
PEMLRYFDAVGINLDSRL

SEQ ID NO: 1293379 - protein, 17 aa, Mycobacterium
PENRLRTTIGLRKVDGR

SEQ ID NO: 1293380 - protein, 19 aa, Mycobacterium
PEQQLALLALRLEMAAVYQ

SEQ ID NO: 1293381 - protein, 20 aa, Mycobacterium
PEQWARLAADPSLMPTAIEE

SEQ ID NO: 1293382 - protein, 30 aa, Mycobacterium
PEQYQAMILLAAWCALRFGELTELRRKDIV

SEQ ID NO: 1293383 - protein, 22 aa, Mycobacterium
PEVIAALTVCWTVLGMPAGKRL

SEQ ID NO: 1293384 - protein, 24 aa, Mycobacterium
PEVIWPRARRALAALGLNLLLRHD

SEQ ID NO: 1293385 - protein, 20 aa, Mycobacterium
PEVLRRAVLYAIERKRAELT

SEQ ID NO: 1293386 - protein, 19 aa, Mycobacterium
PEWLRWNYATVVWGIATAH

SEQ ID NO: 1293387 - protein, 21 aa, Mycobacterium
PEYGADCPVVVVYRASQPQEL

SEQ ID NO: 1293388 - protein, 17 aa, Mycobacterium
PEYRLETLISLNIGTAT

SEQ ID NO: 1293389 - protein, 25 aa, Mycobacterium
PEYSHLTLSWVYDWMAQGVPVVAMH

SEQ ID NO: 1293390 - protein, 19 aa, Mycobacterium
PFATFRPGQYVSVGVTLPD

SEQ ID NO: 1293391 - protein, 22 aa, Mycobacterium
PFDAVVCSLVLCSVDKPEDVVA

SEQ ID NO: 1293392 - protein, 17 aa, Mycobacterium
PFEIKIQNWEGVAAEAA

SEQ ID NO: 1293393 - protein, 19 aa, Mycobacterium
PFFPEFRRNEAGQYVPVNA

SEQ ID NO: 1293394 - protein, 17 aa, Mycobacterium
PFGRVFETLAWGRRHVV

SEQ ID NO: 1293395 - protein, 17 aa, Mycobacterium
PFLVAYGARIGERLAAA

SEQ ID NO: 1293396 - protein, 24 aa, Mycobacterium
PFNFPAMVPMWFFPIAIATGNTVV

SEQ ID NO: 1293397 - protein, 18 aa, Mycobacterium
PFPIIGATLENYAQAFED

SEQ ID NO: 1293398 - protein, 21 aa, Mycobacterium
PFPIKEFHPFPRAMMGPGAHE

SEQ ID NO: 1293399 - protein, 18 aa, Mycobacterium
PFSGLAFKVATHPFFGKL

SEQ ID NO: 1293400 - protein, 22 aa, Mycobacterium
PGAFADIRWRLDVWNASAQVAN

SEQ ID NO: 1293401 - protein, 19 aa, Mycobacterium
PGALFTEIMGALPVIEHTR

SEQ ID NO: 1293402 - protein, 18 aa, Mycobacterium
PGAPALVCVHGFPTSGID

SEQ ID NO: 1293403 - protein, 17 aa, Mycobacterium
PGAPYADAVAQWESVES

SEQ ID NO: 1293404 - protein, 20 aa, Mycobacterium
PGDAGVLCSMLLNRLSLAPG

SEQ ID NO: 1293405 - protein, 17 aa, Mycobacterium
PGDDVFVSWAPDASLVL

SEQ ID NO: 1293406 - protein, 18 aa, Mycobacterium
PGDLAVWDGHVAMVVGDG

SEQ ID NO: 1293407 - protein, 23 aa, Mycobacterium
PGEPLPRWQIGLYWRTDGAPLWT

SEQ ID NO: 1293408 - protein, 18 aa, Mycobacterium
PGFDWPGWLAGLGGTAEQ

SEQ ID NO: 1293409 - protein, 18 aa, Mycobacterium
PGGGRWELGQAYPPGPGG

SEQ ID NO: 1293410 - protein, 23 aa, Mycobacterium
PGGKSALGLWSWAIPANSAAPDA

SEQ ID NO: 1293411 - protein, 17 aa, Mycobacterium
PGGQWLGFAPELIARQL

SEQ ID NO: 1293412 - protein, 19 aa, Mycobacterium
PGHAGGFFVRPAVFTDTEP

SEQ ID NO: 1293413 - protein, 18 aa, Mycobacterium
PGHPEFRHTPGVEITTGP

SEQ ID NO: 1293414 - protein, 19 aa, Mycobacterium
PGIELRLLTAYSGHLQQWL

SEQ ID NO: 1293415 - protein, 24 aa, Mycobacterium
PGKHAVSAFALWFPLSEERASYGE

SEQ ID NO: 1293416 - protein, 23 aa, Mycobacterium
PGKPRYADVYSWAKTRGAIDVDE

SEQ ID NO: 1293417 - protein, 18 aa, Mycobacterium
PGLPWRPAVTEPNPEQPE

SEQ ID NO: 1293418 - protein, 17 aa, Mycobacterium
PGLTLALEPWFARGTDR

SEQ ID NO: 1293419 - protein, 17 aa, Mycobacterium
PGLTLGLGPSHEPIVRD

SEQ ID NO: 1293420 - protein, 18 aa, Mycobacterium
PGMPVFRGLTLSVTPGAV

SEQ ID NO: 1293421 - protein, 18 aa, Mycobacterium
PGMTLLEVGCGWGLTLQR

SEQ ID NO: 1293422 - protein, 18 aa, Mycobacterium
PGNWAGATACWGLENREA

SEQ ID NO: 1293423 - protein, 20 aa, Mycobacterium
PGPARPGPRPAVPAAAPVVG

SEQ ID NO: 1293424 - protein, 19 aa, Mycobacterium
PGPLKWDLTTGIATATTQS

SEQ ID NO: 1293425 - protein, 18 aa, Mycobacterium
PGPVSALFFDLDRLKAIN

SEQ ID NO: 1293426 - protein, 17 aa, Mycobacterium
PGRRDICIYARESHVLV

SEQ ID NO: 1293427 - protein, 18 aa, Mycobacterium
PGRRWSWQVAGIPATAHG

SEQ ID NO: 1293428 - protein, 22 aa, Mycobacterium
PGSQLPGFAWLAGLVTNSPAVG

SEQ ID NO: 1293429 - protein, 24 aa, Mycobacterium
PGTRARLGLLLPCTKYKPYATSRE

SEQ ID NO: 1293430 - protein, 19 aa, Mycobacterium
PGVRARELVKLSGRIARRG

SEQ ID NO: 1293431 - protein, 17 aa, Mycobacterium
PGVRLRLDIAYDGTDFA

SEQ ID NO: 1293432 - protein, 17 aa, Mycobacterium
PGVYEVRPGLELVAAPW

SEQ ID NO: 1293433 - protein, 28 aa, Mycobacterium
PGWAKHAWSCFFAPWLAEATIFVYNYGR

SEQ ID NO: 1293434 - protein, 20 aa, Mycobacterium
PGWWAAREAIEWTASAQRQS

SEQ ID NO: 1293435 - protein, 23 aa, Mycobacterium
PGWYRPNPGLARDLAFIAFSTLG

SEQ ID NO: 1293436 - protein, 24 aa, Mycobacterium
PGYPRPGGTVLFLGRFDEPRKGMS

SEQ ID NO: 1293437 - protein, 19 aa, Mycobacterium
PGYRGWQWAVVVAACPGAA

SEQ ID NO: 1293438 - protein, 18 aa, Mycobacterium
PHAKGGGAFGQFEVTQDV

SEQ ID NO: 1293439 - protein, 18 aa, Mycobacterium
PHGPRAATISQFFSPPAA

SEQ ID NO: 1293440 - protein, 18 aa, Mycobacterium
PHLPYMYHCHILEHEDMG

SEQ ID NO: 1293441 - protein, 18 aa, Mycobacterium
PHMLRHSFALRMLVTLIY

SEQ ID NO: 1293442 - protein, 17 aa, Mycobacterium
PHPELLRAWGLGTDAAG

SEQ ID NO: 1293443 - protein, 17 aa, Mycobacterium
PHRLVVCRDDDWRPQWR

SEQ ID NO: 1293444 - protein, 25 aa, Mycobacterium
PHSERLYCIPATIDLAGAEIELVSM

SEQ ID NO: 1293445 - protein, 20 aa, Mycobacterium
PICAPDLLLAQALLRTKSIK

SEQ ID NO: 1293446 - protein, 19 aa, Mycobacterium
PICCPGCGPTLRYRDGDGR

SEQ ID NO: 1293447 - protein, 17 aa, Mycobacterium
PIDELPRDCDFGLTQLA

SEQ ID NO: 1293448 - protein, 18 aa, Mycobacterium
PIERTVEFLQWFLDTVPI

SEQ ID NO: 1293449 - protein, 27 aa, Mycobacterium
PIGAPSFKEALRWGAEVYHSLKSVLKK

SEQ ID NO: 1293450 - protein, 22 aa, Mycobacterium
PIGRTAEFLAWFLENVPIEPIW

SEQ ID NO: 1293451 - protein, 18 aa, Mycobacterium
PIIRKLFATFGIADMARE

SEQ ID NO: 1293452 - protein, 20 aa, Mycobacterium
PILQGLCLTSSWSDWSSKDD

SEQ ID NO: 1293453 - protein, 20 aa, Mycobacterium
PITVFPAEWIKAGRRRTREA

SEQ ID NO: 1293454 - protein, 19 aa, Mycobacterium
PIVLPGMVVPIELDDAARA

SEQ ID NO: 1293455 - protein, 18 aa, Mycobacterium
PIWCFPKFDVPLSKTAQT

SEQ ID NO: 1293456 - protein, 17 aa, Mycobacterium
PIYRCMAAHVIRDQASV

SEQ ID NO: 1293457 - protein, 20 aa, Mycobacterium
PKACPAPGVMQGCLESTSGL

SEQ ID NO: 1293458 - protein, 19 aa, Mycobacterium
PKAGPLIAVKLHILTRKSL

SEQ ID NO: 1293459 - protein, 19 aa, Mycobacterium
PKDAGGVLIELVEPAKDSG

SEQ ID NO: 1293460 - protein, 19 aa, Mycobacterium
PKEFSRRGVQMYQDGKRTW

SEQ ID NO: 1293461 - protein, 22 aa, Mycobacterium
PKFCSGEIISAIAMTEPGTGSD

SEQ ID NO: 1293462 - protein, 18 aa, Mycobacterium
PKGGLRRLRVGARDSAVL

SEQ ID NO: 1293463 - protein, 18 aa, Mycobacterium
PKGVLWRQHDIFMTSFGG

SEQ ID NO: 1293464 - protein, 24 aa, Mycobacterium
PKKMWRPKVPISIAVGKPIEPTLP

SEQ ID NO: 1293465 - protein, 23 aa, Mycobacterium
PKLARAFLRFNFQLLYGTTLPER

SEQ ID NO: 1293466 - protein, 19 aa, Mycobacterium
PKLDLGWMVQSWPEHTDAP

SEQ ID NO: 1293467 - protein, 18 aa, Mycobacterium
PKLDVLDFWNMIRPELPG

SEQ ID NO: 1293468 - protein, 20 aa, Mycobacterium
PKLRIGFAYGKAAVDNAAKD

SEQ ID NO: 1293469 - protein, 19 aa, Mycobacterium
PKPKRIFEIGPIRTLVEHG

SEQ ID NO: 1293470 - protein, 18 aa, Mycobacterium
PKPPPRRITLTLPAITRS

SEQ ID NO: 1293471 - protein, 23 aa, Mycobacterium
PKTGRLSGRFWKLLGASTDKDQA

SEQ ID NO: 1293472 - protein, 18 aa, Mycobacterium
PKVARLVLDAAVLKDSMV

SEQ ID NO: 1293473 - protein, 23 aa, Mycobacterium
PKVYSGHVRLCLGYTEPEGGSDV

SEQ ID NO: 1293474 - protein, 20 aa, Mycobacterium
PLADIPLDWVLDGAVRAGVR

SEQ ID NO: 1293475 - protein, 19 aa, Mycobacterium
PLAESLRYPAGLIDTFEWE

SEQ ID NO: 1293476 - protein, 19 aa, Mycobacterium
PLAHPALVCDVAIGQSTLA

SEQ ID NO: 1293477 - protein, 18 aa, Mycobacterium
PLCEAMCGLAVETVGAQV

SEQ ID NO: 1293478 - protein, 25 aa, Mycobacterium
PLEGLRVVDMTTFWAGPSCTHLLAM

SEQ ID NO: 1293479 - protein, 20 aa, Mycobacterium
PLEKVRVIARFAGYADPHLP

SEQ ID NO: 1293480 - protein, 19 aa, Mycobacterium
PLFMAGLWSTWRPKGADKD

SEQ ID NO: 1293481 - protein, 19 aa, Mycobacterium
PLFMAGLWTTWRPRDAPKE

SEQ ID NO: 1293482 - protein, 17 aa, Mycobacterium
PLGERAFARLMARRSDS

SEQ ID NO: 1293483 - protein, 21 aa, Mycobacterium
PLKRWQLCLDVNTTGVFLVTK

SEQ ID NO: 1293484 - protein, 19 aa, Mycobacterium
PLLAEEWRLLIAAMGRARS

SEQ ID NO: 1293485 - protein, 17 aa, Mycobacterium
PLLDLGVPPEIVRALDP

SEQ ID NO: 1293486 - protein, 18 aa, Mycobacterium
PLLDLGWMLICWPDGPNP

SEQ ID NO: 1293487 - protein, 20 aa, Mycobacterium
PLLRKLVWRLPSRVQPKPEA

SEQ ID NO: 1293488 - protein, 17 aa, Mycobacterium
PLLVVFLLFDVMRDALR

SEQ ID NO: 1293489 - protein, 22 aa, Mycobacterium
PLMHGAAQWAVFTAMNTGQTVV

SEQ ID NO: 1293490 - protein, 26 aa, Mycobacterium
PLMPPQMLHMILPRKDYEIVEDSWDV

SEQ ID NO: 1293491 - protein, 20 aa, Mycobacterium
PLMRRFGLDAGERIAKLLSD

SEQ ID NO: 1293492 - protein, 19 aa, Mycobacterium
PLMRRSGVIFLRRKLDDPL

SEQ ID NO: 1293493 - protein, 18 aa, Mycobacterium
PLNIPYKVAFVLDVAGDN

SEQ ID NO: 1293494 - protein, 18 aa, Mycobacterium
PLPKRRLAATLDEYPNAE

SEQ ID NO: 1293495 - protein, 19 aa, Mycobacterium
PLPREWPALAKALSPYVDL

SEQ ID NO: 1293496 - protein, 21 aa, Mycobacterium
PLQHPETFQRLGVQPPRGVLL

SEQ ID NO: 1293497 - protein, 18 aa, Mycobacterium
PLRLRGMSAMLARIKNRL

SEQ ID NO: 1293498 - protein, 17 aa, Mycobacterium
PLRPWPGFTPMVYERYS

SEQ ID NO: 1293499 - protein, 18 aa, Mycobacterium
PLRTRLVLVARAQRSTLA

SEQ ID NO: 1293500 - protein, 18 aa, Mycobacterium
PLTRLRVDGGLTRSTALM

SEQ ID NO: 1293501 - protein, 17 aa, Mycobacterium
PLVNWRIPGPELKFEER

SEQ ID NO: 1293502 - protein, 18 aa, Mycobacterium
PLVVFKWGNVTSFPAFVT

SEQ ID NO: 1293503 - protein, 17 aa, Mycobacterium
PLWECWIIEGLADGRWA

SEQ ID NO: 1293504 - protein, 18 aa, Mycobacterium
PLWWDQFVANGFHAVHLP

SEQ ID NO: 1293505 - protein, 17 aa, Mycobacterium
PMEFARTPDGGWQLTRD

SEQ ID NO: 1293506 - protein, 18 aa, Mycobacterium
PMGLGLVSQFFGRYYTPD

SEQ ID NO: 1293507 - protein, 17 aa, Mycobacterium
PMHLCLQLDYFGGDTGG

SEQ ID NO: 1293508 - protein, 18 aa, Mycobacterium
PMNLLAIPWIDPVDVANA

SEQ ID NO: 1293509 - protein, 25 aa, Mycobacterium
PMWDLSWRTPALLAERDFLYDSSLM

SEQ ID NO: 1293510 - protein, 19 aa, Mycobacterium
PMYRARGWVPWRGPTSVLS

SEQ ID NO: 1293511 - protein, 20 aa, Mycobacterium
PNCSGRIPFDTALISEVLAE

SEQ ID NO: 1293512 - protein, 17 aa, Mycobacterium
PNFWAWLIGEVKNTDPD

SEQ ID NO: 1293513 - protein, 20 aa, Mycobacterium
PNGLPPLRLIAGGAESSATS

SEQ ID NO: 1293514 - protein, 21 aa, Mycobacterium
PNHYLAVAIDYLFTHRPEWAT

SEQ ID NO: 1293515 - protein, 19 aa, Mycobacterium
PNLRFLQDSGIAFEHLDTG

SEQ ID NO: 1293516 - protein, 20 aa, Mycobacterium
PNLRLWNFYGQTEMAPLASA

SEQ ID NO: 1293517 - protein, 23 aa, Mycobacterium
PPADAPPGFLTRIRIDKVGGVGP

SEQ ID NO: 1293518 - protein, 22 aa, Mycobacterium
PPALRLALTPGWMALRPLAGRV

SEQ ID NO: 1293519 - protein, 19 aa, Mycobacterium
PPDVLDWPLNVVVVRTGGQ

SEQ ID NO: 1293520 - protein, 20 aa, Mycobacterium
PPGRLGWGWAKFAFGSWTTL

SEQ ID NO: 1293521 - protein, 18 aa, Mycobacterium
PPGVPWTVVWSFHLMPRG

SEQ ID NO: 1293522 - protein, 19 aa, Mycobacterium
PPHPCPLSFIVAPTLIAHG

SEQ ID NO: 1293523 - protein, 20 aa, Mycobacterium
PPIETDRGWLLLTHGVGPMR

SEQ ID NO: 1293524 - protein, 17 aa, Mycobacterium
PPPEIVDVLTFDRVSDA

SEQ ID NO: 1293525 - protein, 18 aa, Mycobacterium
PPPPMPGFENVAADGDIL

SEQ ID NO: 1293526 - protein, 24 aa, Mycobacterium
PPRHFKLSYLVAAWTQRPEDEHRL

SEQ ID NO: 1293527 - protein, 18 aa, Mycobacterium
PPRRLVFRSDIPKLPRAL

SEQ ID NO: 1293528 - protein, 19 aa, Mycobacterium
PPVGHVWLSPGSMVELVEV

SEQ ID NO: 1293529 - protein, 19 aa, Mycobacterium
PPWWLKYVNKVMIVLNRTG

SEQ ID NO: 1293530 - protein, 17 aa, Mycobacterium
PPYDLTYNDVFVVPGRS

SEQ ID NO: 1293531 - protein, 24 aa, Mycobacterium
PQAARAALLFGMRFDAESAVRHGL

SEQ ID NO: 1293532 - protein, 19 aa, Mycobacterium
PQHFVCFAGLIDPDEPVTP

SEQ ID NO: 1293533 - protein, 17 aa, Mycobacterium
PQHRLLLETAWRAVEHS

SEQ ID NO: 1293534 - protein, 22 aa, Mycobacterium
PQHRLLLETAWRAVEHSGTAPT

SEQ ID NO: 1293535 - protein, 23 aa, Mycobacterium
PQLARLAAMGGFRRWDRVVRNYI

SEQ ID NO: 1293536 - protein, 17 aa, Mycobacterium
PQQRLLLEVAWEALEDA

SEQ ID NO: 1293537 - protein, 21 aa, Mycobacterium
PQRGDFGLRPAMTVKCPVSAV

SEQ ID NO: 1293538 - protein, 27 aa, Mycobacterium
PQRGYKIFEEWANWLFAAGGSIYDADG

SEQ ID NO: 1293539 - protein, 18 aa, Mycobacterium
PQRLKGIHDPICLVEVRR

SEQ ID NO: 1293540 - protein, 23 aa, Mycobacterium
PQRSGPHLQAFVAYAKHAQELAL

SEQ ID NO: 1293541 - protein, 17 aa, Mycobacterium
PQTWFKAFNYDLGARAP

SEQ ID NO: 1293542 - protein, 21 aa, Mycobacterium
PQWICPWPNLRVSEHTKAAMR

SEQ ID NO: 1293543 - protein, 19 aa, Mycobacterium
PRAAAIVDRCESMSPEAML

SEQ ID NO: 1293544 - protein, 18 aa, Mycobacterium
PRALYSFQDLVALRTFAR

SEQ ID NO: 1293545 - protein, 25 aa, Mycobacterium
PRARRLLVGAAIRFDEDLMLRGIES

SEQ ID NO: 1293546 - protein, 18 aa, Mycobacterium
PRAVVWLLVRPMANSIAN

SEQ ID NO: 1293547 - protein, 18 aa, Mycobacterium
PRAWRMRVTVQKVGNDAK

SEQ ID NO: 1293548 - protein, 20 aa, Mycobacterium
PREIAGRTRLDWESLSQRIH

SEQ ID NO: 1293549 - protein, 20 aa, Mycobacterium
PREIGGRTRLDWESLSQRIH

SEQ ID NO: 1293550 - protein, 20 aa, Mycobacterium
PRFLFHPAIKELTLDIASEV

SEQ ID NO: 1293551 - protein, 20 aa, Mycobacterium
PRFLMCTPLSHAGAAFFTPV

SEQ ID NO: 1293552 - protein, 17 aa, Mycobacterium
PRFSDVSSRIFGTPHDV

SEQ ID NO: 1293553 - protein, 17 aa, Mycobacterium
PRFSIARLSLLDRGMIF

SEQ ID NO: 1293554 - protein, 20 aa, Mycobacterium
PRGRGFLFERVFPAFWQFKP

SEQ ID NO: 1293555 - protein, 20 aa, Mycobacterium
PRIHDLRHTFAIRTLIGWYR

SEQ ID NO: 1293556 - protein, 19 aa, Mycobacterium
PRIRLWWRPAEPMPDDPIL

SEQ ID NO: 1293557 - protein, 25 aa, Mycobacterium
PRKAPRITLCLLRFGEEPVELTTGW

SEQ ID NO: 1293558 - protein, 23 aa, Mycobacterium
PRLARLPGRFLFGIDDGRGDISG

SEQ ID NO: 1293559 - protein, 21 aa, Mycobacterium
PRLEPGVALPCCRQTVHRGVV

SEQ ID NO: 1293560 - protein, 24 aa, Mycobacterium
PRLEPRPLPAVPLTRLESGTSHLV

SEQ ID NO: 1293561 - protein, 20 aa, Mycobacterium
PRLKKTLLQGTRWGDENAKL

SEQ ID NO: 1293562 - protein, 19 aa, Mycobacterium
PRLLARNGLTLQDFDFYEI

SEQ ID NO: 1293563 - protein, 17 aa, Mycobacterium
PRLLGHWGTTPGLNLVY

SEQ ID NO: 1293564 - protein, 19 aa, Mycobacterium
PRLLTTMPEWLNAATGLDA

SEQ ID NO: 1293565 - protein, 17 aa, Mycobacterium
PRLPAGYADLAAHWPQG

SEQ ID NO: 1293566 - protein, 18 aa, Mycobacterium
PRLREFALREGLADAGQR

SEQ ID NO: 1293567 - protein, 18 aa, Mycobacterium
PRLREWAAVCVPSPSGYL

SEQ ID NO: 1293568 - protein, 19 aa, Mycobacterium
PRLRVGLAVGQAVSRAGDW

SEQ ID NO: 1293569 - protein, 20 aa, Mycobacterium
PRLWEMSTVLPILQDTTIVA

SEQ ID NO: 1293570 - protein, 19 aa, Mycobacterium
PRPGESVSYWHSDQLRRRL

SEQ ID NO: 1293571 - protein, 20 aa, Mycobacterium
PRPMVYSGLYPVDGSDYPVL

SEQ ID NO: 1293572 - protein, 21 aa, Mycobacterium
PRPPGALPFDDPGLFARVAPL

SEQ ID NO: 1293573 - protein, 21 aa, Mycobacterium
PRPPSGWLRLGGISSHNLRGL

SEQ ID NO: 1293574 - protein, 24 aa, Mycobacterium
PRPRKSRPAVPAWEDVLLGVRSSG

SEQ ID NO: 1293575 - protein, 18 aa, Mycobacterium
PRPTLCVIHGFMGSAYLF

SEQ ID NO: 1293576 - protein, 17 aa, Mycobacterium
PRPVVGIIAPWNYPVAN

SEQ ID NO: 1293577 - protein, 17 aa, Mycobacterium
PRRAGISSFGFGGTNAH

SEQ ID NO: 1293578 - protein, 17 aa, Mycobacterium
PRRAGVSSFGFTGTNAH

SEQ ID NO: 1293579 - protein, 17 aa, Mycobacterium
PRRGNGSSVRRLVIVES

SEQ ID NO: 1293580 - protein, 21 aa, Mycobacterium
PRRLVEVLMRIGPYGDRFGLR

SEQ ID NO: 1293581 - protein, 17 aa, Mycobacterium
PRRVTEVALVFKRAPHL

SEQ ID NO: 1293582 - protein, 18 aa, Mycobacterium
PRSAALAAVFPRNRETTW

SEQ ID NO: 1293583 - protein, 19 aa, Mycobacterium
PRSNLPIEWVNEILSLTVR

SEQ ID NO: 1293584 - protein, 20 aa, Mycobacterium
PRTRSGIMTLELLDTTPDWD

SEQ ID NO: 1293585 - protein, 19 aa, Mycobacterium
PRVAQMFGVQAVPTVVALA

SEQ ID NO: 1293586 - protein, 24 aa, Mycobacterium
PRVRTGRVDLYWRAILFRIDDKSS

SEQ ID NO: 1293587 - protein, 20 aa, Mycobacterium
PRVWLARRIEIAEHWRAVHP

SEQ ID NO: 1293588 - protein, 19 aa, Mycobacterium
PRWPDIPGRDTFAGISVHS

SEQ ID NO: 1293589 - protein, 22 aa, Mycobacterium
PRWSQGRLRWDHVVVLPNTDLP

SEQ ID NO: 1293590 - protein, 21 aa, Mycobacterium
PRWTQGRLRWDHVIVLPNTEL

SEQ ID NO: 1293591 - protein, 21 aa, Mycobacterium
PRYARFGWAAARFDDLLNLAP

SEQ ID NO: 1293592 - protein, 17 aa, Mycobacterium
PRYDNFIGGQWVAPNAG

SEQ ID NO: 1293593 - protein, 17 aa, Mycobacterium
PRYSALVQACLAAEDPA

SEQ ID NO: 1293594 - protein, 23 aa, Mycobacterium
PSALWKLRGAVFGGRPESSPLDL

SEQ ID NO: 1293595 - protein, 20 aa, Mycobacterium
PSASLWLAALWKEAGLPDGV

SEQ ID NO: 1293596 - protein, 17 aa, Mycobacterium
PSAYARCFHNVARAAEL

SEQ ID NO: 1293597 - protein, 18 aa, Mycobacterium
PSDSVAIALRVGVPIYVE

SEQ ID NO: 1293598 - protein, 21 aa, Mycobacterium
PSDVCYLSMPLFHSNAVMAGW

SEQ ID NO: 1293599 - protein, 20 aa, Mycobacterium
PSEWFPLQLALKVHQSRAGM

SEQ ID NO: 1293600 - protein, 22 aa, Mycobacterium
PSFTLDDWRAMGLVDDGGQPIV

SEQ ID NO: 1293601 - protein, 17 aa, Mycobacterium
PSHLFPVEFAKRAKALG

SEQ ID NO: 1293602 - protein, 22 aa, Mycobacterium
PSIREIYCLMVLLVCERGFNLS

SEQ ID NO: 1293603 - protein, 17 aa, Mycobacterium
PSITLPTVPGFPVQLPS

SEQ ID NO: 1293604 - protein, 17 aa, Mycobacterium
PSMRGVPFSFVRVDRAG

SEQ ID NO: 1293605 - protein, 19 aa, Mycobacterium
PSPHIPWERLPVRVVAEAT

SEQ ID NO: 1293606 - protein, 18 aa, Mycobacterium
PSPKGCVFEYVYLARPDS

SEQ ID NO: 1293607 - protein, 20 aa, Mycobacterium
PSPRRLRGVRSFSRYITMRD

SEQ ID NO: 1293608 - protein, 17 aa, Mycobacterium
PSPYAVRCCERSVEILR

SEQ ID NO: 1293609 - protein, 18 aa, Mycobacterium
PSSIWYRIRINLQHVAED

SEQ ID NO: 1293610 - protein, 17 aa, Mycobacterium
PSSPWEVPSGWRIAGRA

SEQ ID NO: 1293611 - protein, 21 aa, Mycobacterium
PSTARLTGRWMRGRLPGVSDF

SEQ ID NO: 1293612 - protein, 22 aa, Mycobacterium
PSTRFVSWVTGKYVYLDDDTLA

SEQ ID NO: 1293613 - protein, 22 aa, Mycobacterium
PSVSGLPQWYGDQGMFLTTHYF

SEQ ID NO: 1293614 - protein, 20 aa, Mycobacterium
PSYTRPASWRGLDVPDVLLS

SEQ ID NO: 1293615 - protein, 17 aa, Mycobacterium
PTAPSWRKGRYHIAGRG

SEQ ID NO: 1293616 - protein, 18 aa, Mycobacterium
PTAQRILAHFGLDGHFEV

SEQ ID NO: 1293617 - protein, 24 aa, Mycobacterium
PTDEVKPLIGRVFVDADLSEETTV

SEQ ID NO: 1293618 - protein, 18 aa, Mycobacterium
PTDFRLWVCLHEVTHRVQ

SEQ ID NO: 1293619 - protein, 23 aa, Mycobacterium
PTELRLLVFLLRNAERVVSRSQI

SEQ ID NO: 1293620 - protein, 21 aa, Mycobacterium
PTGLIGRLLVPPVVPAGPPTP

SEQ ID NO: 1293621 - protein, 17 aa, Mycobacterium
PTIDRWLVSVPMVHLDT

SEQ ID NO: 1293622 - protein, 19 aa, Mycobacterium
PTLLFPFAAPRVGGDLSDA

SEQ ID NO: 1293623 - protein, 18 aa, Mycobacterium
PTLYCLTEPIPPGSYVGI

SEQ ID NO: 1293624 - protein, 17 aa, Mycobacterium
PTPARFMLKSAWEECHR

SEQ ID NO: 1293625 - protein, 23 aa, Mycobacterium
PTPARYLYVPNLIKAALNFAMAI

SEQ ID NO: 1293626 - protein, 23 aa, Mycobacterium
PTRYWPEFCRLMGLDQYAEDPRF

SEQ ID NO: 1293627 - protein, 17 aa, Mycobacterium
PTTDIPLPWVRNEVTVL

SEQ ID NO: 1293628 - protein, 27 aa, Mycobacterium
PTTGVWTSGFGYRWGVLHAGIDIANAI

SEQ ID NO: 1293629 - protein, 27 aa, Mycobacterium
PTTPLRAPMEWNLLGWMRRTFFNRPPT

SEQ ID NO: 1293630 - protein, 19 aa, Mycobacterium
PTVMAFRDGVLVYRQPGAM

SEQ ID NO: 1293631 - protein, 18 aa, Mycobacterium
PTVVPGFNSVVPQLVPPA

SEQ ID NO: 1293632 - protein, 23 aa, Mycobacterium
PTWSGSLKSLWLGEGEAIGDILV

SEQ ID NO: 1293633 - protein, 20 aa, Mycobacterium
PTYRYEFGWRSTGVGGELGA

SEQ ID NO: 1293634 - protein, 18 aa, Mycobacterium
PVDFKVWPAENGFVQRYR

SEQ ID NO: 1293635 - protein, 18 aa, Mycobacterium
PVDSGPFYAVKVVLSDLG

SEQ ID NO: 1293636 - protein, 17 aa, Mycobacterium
PVFCAPKMFAMYGGSVK

SEQ ID NO: 1293637 - protein, 18 aa, Mycobacterium
PVGLPDWRELLAKLADKA

SEQ ID NO: 1293638 - protein, 17 aa, Mycobacterium
PVLPARSLVALCGGGTI

SEQ ID NO: 1293639 - protein, 17 aa, Mycobacterium
PVLREMYAPLLAAGVPF

SEQ ID NO: 1293640 - protein, 18 aa, Mycobacterium
PVMPCHYTGFKLKPVGFF

SEQ ID NO: 1293641 - protein, 24 aa, Mycobacterium
PVMRIRPGTVLTLWTEDAYGGRIT

SEQ ID NO: 1293642 - protein, 22 aa, Mycobacterium
PVPELRSGGLGVREVKRLTKVT

SEQ ID NO: 1293643 - protein, 19 aa, Mycobacterium
PVPGVPDCSSSGFDWLAAG

SEQ ID NO: 1293644 - protein, 19 aa, Mycobacterium
PVPPLTWWRGIKARKTLED

SEQ ID NO: 1293645 - protein, 22 aa, Mycobacterium
PVPRLRAAGVPVGIGTDGAASN

SEQ ID NO: 1293646 - protein, 22 aa, Mycobacterium
PVSARGSLRLSLGHTSTDADID

SEQ ID NO: 1293647 - protein, 19 aa, Mycobacterium
PVSIGFPFGLSVLVPPNLP

SEQ ID NO: 1293648 - protein, 21 aa, Mycobacterium
PVTPRAAGAIAHLNADHADSL

SEQ ID NO: 1293649 - protein, 24 aa, Mycobacterium
PVTRPRIRLAYRLTPRRVLGEERA

SEQ ID NO: 1293650 - protein, 18 aa, Mycobacterium
PVVPRPLIREVTERIDYK

SEQ ID NO: 1293651 - protein, 17 aa, Mycobacterium
PVVWRVIQHYGIDVGGR

SEQ ID NO: 1293652 - protein, 24 aa, Mycobacterium
PVWLEPRWDAEFGVAHGLDAAVVA

SEQ ID NO: 1293653 - protein, 18 aa, Mycobacterium
PVWSRATLALAYASALIR

SEQ ID NO: 1293654 - protein, 23 aa, Mycobacterium
PWFDALLAWVRRQITHTFFNKTP

SEQ ID NO: 1293655 - protein, 17 aa, Mycobacterium
PWFDLIFAGGHEKTAAL

SEQ ID NO: 1293656 - protein, 17 aa, Mycobacterium
PWLDGWRRPQAELDESS

SEQ ID NO: 1293657 - protein, 23 aa, Mycobacterium
PWPTFRVSGRLVWFAMTIWQFLH

SEQ ID NO: 1293658 - protein, 22 aa, Mycobacterium
PWQREMEDAFGFTETVDQLTAI

SEQ ID NO: 1293659 - protein, 21 aa, Mycobacterium
PWRLALWRLRHNVVGAGPRLR

SEQ ID NO: 1293660 - protein, 24 aa, Mycobacterium
PWSGSKWAVGLAVTLDDDRRLAIT

SEQ ID NO: 1293661 - protein, 17 aa, Mycobacterium
PWSYMKFPFLKDLGREE

SEQ ID NO: 1293662 - protein, 22 aa, Mycobacterium
PWTQPHCSRRCWHGADPAEPGP

SEQ ID NO: 1293663 - protein, 29 aa, Mycobacterium
PWYLAMACFKLAVVIEGTWSRYLAGRATR

SEQ ID NO: 1293664 - protein, 19 aa, Mycobacterium
PYAHLRAFVLMPWLAAEPE

SEQ ID NO: 1293665 - protein, 19 aa, Mycobacterium
PYAHLRGFVLMPWLAAEPE

SEQ ID NO: 1293666 - protein, 19 aa, Mycobacterium
PYCSSGVNMFAHWSYPWNG

SEQ ID NO: 1293667 - protein, 23 aa, Mycobacterium
PYFPRIDLRWALRGVSGAERRRR

SEQ ID NO: 1293668 - protein, 18 aa, Mycobacterium
PYGPARRWQKKKDPDQDT

SEQ ID NO: 1293669 - protein, 18 aa, Mycobacterium
PYIRMWLERAAHAVEAGL

SEQ ID NO: 1293670 - protein, 19 aa, Mycobacterium
PYPAWREMFNDILPAHIVK

SEQ ID NO: 1293671 - protein, 17 aa, Mycobacterium
PYVSISIAHGIRRFEFM

SEQ ID NO: 1293672 - protein, 24 aa, Mycobacterium
PYWEWDGTDLFGWVATVPSPVKRA

SEQ ID NO: 1293673 - protein, 24 aa, Mycobacterium
PYYRVLELAPWLSWPRPNFPVSNF

SEQ ID NO: 1293674 - protein, 36 aa, Mycobacterium
QAALSRIGSPYSWGGSGPGAFDCSGLVMWSFQQAGI

SEQ ID NO: 1293675 - protein, 35 aa, Mycobacterium
QAALSRIGSPYSWGGSGPNAFDCSGLVMWAFQQEG

SEQ ID NO: 1293676 - protein, 23 aa, Mycobacterium
QACARAGASLIHLSTDYVFSGSR

SEQ ID NO: 1293677 - protein, 24 aa, Mycobacterium
QAESLRLDIEFHLLLAQAAQNPLL

SEQ ID NO: 1293678 - protein, 20 aa, Mycobacterium
QAFAGILGMAVAWFEEAVVQ

SEQ ID NO: 1293679 - protein, 18 aa, Mycobacterium
QAFPHVYCELDFTDPLEL

SEQ ID NO: 1293680 - protein, 18 aa, Mycobacterium
QAGAPTWRDTRAIRGPRT

SEQ ID NO: 1293681 - protein, 17 aa, Mycobacterium
QAGDVMAGWDGASTGAA

SEQ ID NO: 1293682 - protein, 19 aa, Mycobacterium
QAIGEGFRSRWIGNLDPAA

SEQ ID NO: 1293683 - protein, 18 aa, Mycobacterium
QAILDAYRRAGCSGPADL

SEQ ID NO: 1293684 - protein, 17 aa, Mycobacterium
QAQMMALADAWDGAGSE

SEQ ID NO: 1293685 - protein, 17 aa, Mycobacterium
QARLAALSILIGAVGAT

SEQ ID NO: 1293686 - protein, 18 aa, Mycobacterium
QARPEWEIVGGLLQRLSG

SEQ ID NO: 1293687 - protein, 23 aa, Mycobacterium
QARTIRIPVHMVEVINKLGRIQR

SEQ ID NO: 1293688 - protein, 20 aa, Mycobacterium
QAVREVFRLLALAEDTTRPP

SEQ ID NO: 1293689 - protein, 18 aa, Mycobacterium
QCGSCFNGTAAMSAAATA

SEQ ID NO: 1293690 - protein, 19 aa, Mycobacterium
QDAPLAWRTALWFWTTQKA

SEQ ID NO: 1293691 - protein, 17 aa, Mycobacterium
QDDRWTYRFNLFDTARA

SEQ ID NO: 1293692 - protein, 25 aa, Mycobacterium
QDPALRPPLTWEVDNPFPPPEPETY

SEQ ID NO: 1293693 - protein, 20 aa, Mycobacterium
QDPYRYPRNLPIVGAKGGPG

SEQ ID NO: 1293694 - protein, 24 aa, Mycobacterium
QDRAVELSAWIDPIGVWGDTIATT

SEQ ID NO: 1293695 - protein, 29 aa, Mycobacterium
QDRTPAQVLIRWSLQLGNVVISRSSSPER

SEQ ID NO: 1293696 - protein, 23 aa, Mycobacterium
QDSFEFFPNFTLLLWAPGWYLTY

SEQ ID NO: 1293697 - protein, 21 aa, Mycobacterium
QECGDCKALIHPPQPVCRYCH

SEQ ID NO: 1293698 - protein, 20 aa, Mycobacterium
QEFGEWLKRFFVIDEVRFSD

SEQ ID NO: 1293699 - protein, 18 aa, Mycobacterium
QELLLRHRARTVIIVCPA

SEQ ID NO: 1293700 - protein, 21 aa, Mycobacterium
QEPRLFPWRDVRTNVVYGLTR

SEQ ID NO: 1293701 - protein, 22 aa, Mycobacterium
QESDFRAGLVIQEVMQTKPGRQ

SEQ ID NO: 1293702 - protein, 23 aa, Mycobacterium
QFLTLRPGDRLRLTRDCSPVPTD

SEQ ID NO: 1293703 - protein, 21 aa, Mycobacterium
QFPAWVRQLERIFGVSASTYA

SEQ ID NO: 1293704 - protein, 18 aa, Mycobacterium
QFTKAFATITSWSIFGLG

SEQ ID NO: 1293705 - protein, 18 aa, Mycobacterium
QGALLWLRRVPVVPRGSD

SEQ ID NO: 1293706 - protein, 19 aa, Mycobacterium
QGCALTSRLLVPKKHKDEL

SEQ ID NO: 1293707 - protein, 20 aa, Mycobacterium
QGCALTTRMLVPRQHYEAAV

SEQ ID NO: 1293708 - protein, 17 aa, Mycobacterium
QGGLRYCINSAALRFIH

SEQ ID NO: 1293709 - protein, 18 aa, Mycobacterium
QGGLRYCINSAALRFIHL

SEQ ID NO: 1293710 - protein, 20 aa, Mycobacterium
QGGPCARTVLDTALLHQVIA

SEQ ID NO: 1293711 - protein, 18 aa, Mycobacterium
QGGRAVFVPVDFAAGPGT

SEQ ID NO: 1293712 - protein, 17 aa, Mycobacterium
QGKGAWPSCGGPLSGAT

SEQ ID NO: 1293713 - protein, 21 aa, Mycobacterium
QGLKISVPEEVAWRVGFIDDD

SEQ ID NO: 1293714 - protein, 31 aa, Mycobacterium
QGSKELFLWPTLRYWEFPKPMIAQVHGYAIG

SEQ ID NO: 1293715 - protein, 23 aa, Mycobacterium
QGVSMPLWLSRLVSVLIPTHDDR

SEQ ID NO: 1293716 - protein, 19 aa, Mycobacterium
QGWFCCWNGGNQLHVSTGI

SEQ ID NO: 1293717 - protein, 19 aa, Mycobacterium
QHRICWARTAGVCALPVWF

SEQ ID NO: 1293718 - protein, 23 aa, Mycobacterium
QHSQCLWGTFAHLPGMKVVVPSS

SEQ ID NO: 1293719 - protein, 18 aa, Mycobacterium
QHSRRLKFLVAFRPGVLS

SEQ ID NO: 1293720 - protein, 20 aa, Mycobacterium
QIEALRLVLERGWTAQRAAE

SEQ ID NO: 1293721 - protein, 25 aa, Mycobacterium
QIIPWNFPILMAVWKLAPALAAGNA

SEQ ID NO: 1293722 - protein, 18 aa, Mycobacterium
QINCPGWVGVLRWLKSLL

SEQ ID NO: 1293723 - protein, 23 aa, Mycobacterium
QISCGHCFMCDRKLYTQCETTQV

SEQ ID NO: 1293724 - protein, 22 aa, Mycobacterium
QIYEMYRLLALAKYDERYVIPT

SEQ ID NO: 1293725 - protein, 19 aa, Mycobacterium
QKKRWIPGIADGSLTMAFA

SEQ ID NO: 1293726 - protein, 17 aa, Mycobacterium
QKPARWIQQLAINPHSW

SEQ ID NO: 1293727 - protein, 17 aa, Mycobacterium
QKPRTGVGLGMPAVGAP

SEQ ID NO: 1293728 - protein, 20 aa, Mycobacterium
QLAEGIALLSKVDWRAKGLQ

SEQ ID NO: 1293729 - protein, 20 aa, Mycobacterium
QLAERLMRWTGFPAARVARS

SEQ ID NO: 1293730 - protein, 24 aa, Mycobacterium
QLDRFAIRLELRYLSGPDEVTMLR

SEQ ID NO: 1293731 - protein, 25 aa, Mycobacterium
QLLARRREFGIGYWTVFDELPGRES

SEQ ID NO: 1293732 - protein, 20 aa, Mycobacterium
QLLERARFAAAAYADYDQAA

SEQ ID NO: 1293733 - protein, 17 aa, Mycobacterium
QLNGCGFCLRLHVRDAL

SEQ ID NO: 1293734 - protein, 28 aa, Mycobacterium
QLPGGISRLRFRLRWRGFRVTVDADHDA

SEQ ID NO: 1293735 - protein, 18 aa, Mycobacterium
QLPPWPSAGEAFMELVEA

SEQ ID NO: 1293736 - protein, 22 aa, Mycobacterium
QLPRALPWAVLPVFARNTVRYQ

SEQ ID NO: 1293737 - protein, 26 aa, Mycobacterium
QLRPEYRLDGAPLWQLRTDDLDTEHP

SEQ ID NO: 1293738 - protein, 21 aa, Mycobacterium
QLRQRIGMVFQHFQLFPHRTV

SEQ ID NO: 1293739 - protein, 19 aa, Mycobacterium
QLSLPWKRDFNALVYVLSG

SEQ ID NO: 1293740 - protein, 23 aa, Mycobacterium
QMGCGRTGPFFSFEEAGIVPDIV

SEQ ID NO: 1293741 - protein, 21 aa, Mycobacterium
QMLPPRGRRWLSRKLGLDRVF

SEQ ID NO: 1293742 - protein, 18 aa, Mycobacterium
QMLRDLWEALDIADRDPH

SEQ ID NO: 1293743 - protein, 23 aa, Mycobacterium
QMSECYRVALSYADDGAGPATVV

SEQ ID NO: 1293744 - protein, 17 aa, Mycobacterium
QNVARAWTTPVPQLGAA

SEQ ID NO: 1293745 - protein, 23 aa, Mycobacterium
QPADRAIALFVNRAYSCWATLPV

SEQ ID NO: 1293746 - protein, 21 aa, Mycobacterium
QPGPGWRFGRFASRVRGAPEV

SEQ ID NO: 1293747 - protein, 24 aa, Mycobacterium
QPLDHWDFYMALAYFKLAIIGAGI

SEQ ID NO: 1293748 - protein, 24 aa, Mycobacterium
QPLVRLRVPFSLKRIDIDDVERGS

SEQ ID NO: 1293749 - protein, 19 aa, Mycobacterium
QPPFLWALLSFARRELDNL

SEQ ID NO: 1293750 - protein, 17 aa, Mycobacterium
QPPGPRWSTPVRMPPVP

SEQ ID NO: 1293751 - protein, 17 aa, Mycobacterium
QPRVVDGLDRICRGLGG

SEQ ID NO: 1293752 - protein, 23 aa, Mycobacterium
QQRAEWGWRLVAAASTLPTPALR

SEQ ID NO: 1293753 - protein, 21 aa, Mycobacterium
QRAKAAWLWSRRHGVVAGQSA

SEQ ID NO: 1293754 - protein, 21 aa, Mycobacterium
QRAKAAWLWSRRQGVVAGQSA

SEQ ID NO: 1293755 - protein, 17 aa, Mycobacterium
QRDCLALDAAVRASQDA

SEQ ID NO: 1293756 - protein, 25 aa, Mycobacterium
QRFFGGLLYWEVWSKLGGPQAQAAN

SEQ ID NO: 1293757 - protein, 20 aa, Mycobacterium
QRFGVPMGFGGPHAGYLAVH

SEQ ID NO: 1293758 - protein, 19 aa, Mycobacterium
QRGGAVGFTVRVSDHRPHL

SEQ ID NO: 1293759 - protein, 20 aa, Mycobacterium
QRIDPVLARSWLLVNGSHYD

SEQ ID NO: 1293760 - protein, 17 aa, Mycobacterium
QRLALEVSWEALEHAGV

SEQ ID NO: 1293761 - protein, 17 aa, Mycobacterium
QRLLLEVAWEALEDAGI

SEQ ID NO: 1293762 - protein, 17 aa, Mycobacterium
QRLPLVLLNPSLAPREA

SEQ ID NO: 1293763 - protein, 23 aa, Mycobacterium
QRLPWHPGRCAEVLIGDTVVGHA

SEQ ID NO: 1293764 - protein, 18 aa, Mycobacterium
QRLVEMRDFYAFLMAEIP

SEQ ID NO: 1293765 - protein, 20 aa, Mycobacterium
QRMEAAWGREYRRGRYMHKL

SEQ ID NO: 1293766 - protein, 21 aa, Mycobacterium
QRMSKLLARRLWDNAGTPEVD

SEQ ID NO: 1293767 - protein, 19 aa, Mycobacterium
QRNGIRVGWGMATATYPGR

SEQ ID NO: 1293768 - protein, 17 aa, Mycobacterium
QRPVLTFVLDSGMAGLT

SEQ ID NO: 1293769 - protein, 17 aa, Mycobacterium
QRPWLRANFIASIDGAV

SEQ ID NO: 1293770 - protein, 21 aa, Mycobacterium
QRRFLASEGWIAWSGPAISEL

SEQ ID NO: 1293771 - protein, 19 aa, Mycobacterium
QRRLAPRGKTIAVAAHPGT

SEQ ID NO: 1293772 - protein, 17 aa, Mycobacterium
QRRRFWPKTSGITTDGP

SEQ ID NO: 1293773 - protein, 17 aa, Mycobacterium
QRSDLLIALGTRFDDRV

SEQ ID NO: 1293774 - protein, 20 aa, Mycobacterium
QRTPERWFVVWLGSATNPVD

SEQ ID NO: 1293775 - protein, 18 aa, Mycobacterium
QRYWGEPFPIVYDADDRA

SEQ ID NO: 1293776 - protein, 21 aa, Mycobacterium
QSDLGGLIAMFAKILDADPAY

SEQ ID NO: 1293777 - protein, 24 aa, Mycobacterium
QSGMASTIAIVWADAPLKEKSRSS

SEQ ID NO: 1293778 - protein, 23 aa, Mycobacterium
QSPKETWLRLLLIDAGFPRPTTQ

SEQ ID NO: 1293779 - protein, 22 aa, Mycobacterium
QTDGRVGWRISIPATLSYWSEL

SEQ ID NO: 1293780 - protein, 18 aa, Mycobacterium
QTFASWRLHELRGVPTAL

SEQ ID NO: 1293781 - protein, 18 aa, Mycobacterium
QTFVTWLGIPGWIKTFTA

SEQ ID NO: 1293782 - protein, 18 aa, Mycobacterium
QTGFARTGAMFACEHEGI

SEQ ID NO: 1293783 - protein, 17 aa, Mycobacterium
QTLREFLGPMITALDDY

SEQ ID NO: 1293784 - protein, 17 aa, Mycobacterium
QTSFMLSPWAARTPIDV

SEQ ID NO: 1293785 - protein, 19 aa, Mycobacterium
QTWIPGFEPPYIVAMVELD

SEQ ID NO: 1293786 - protein, 18 aa, Mycobacterium
QVFRNAHHSWGWDRDTEV

SEQ ID NO: 1293787 - protein, 17 aa, Mycobacterium
QVLAPLVTRGWELRGRP

SEQ ID NO: 1293788 - protein, 23 aa, Mycobacterium
QVLGFREHASWALASDTLEFVDL

SEQ ID NO: 1293789 - protein, 23 aa, Mycobacterium
QVPCAGLVIGAWPAQPGAAEIDN

SEQ ID NO: 1293790 - protein, 25 aa, Mycobacterium
QVPIWDLITGYTFPELNNPVSDAES

SEQ ID NO: 1293791 - protein, 21 aa, Mycobacterium
QVPLRLLGPVVRRPAGLRHRP

SEQ ID NO: 1293792 - protein, 25 aa, Mycobacterium
QVPRRARVAFRWLRAVALERMGDIE

SEQ ID NO: 1293793 - protein, 17 aa, Mycobacterium
QVVGAAMARRLSMTGEV

SEQ ID NO: 1293794 - protein, 24 aa, Mycobacterium
QWLLIELRTDWSYRFQNYPAGSLL

SEQ ID NO: 1293795 - protein, 22 aa, Mycobacterium
QYKDVILGLVFLKYVSDAYDER

SEQ ID NO: 1293796 - protein, 19 aa, Mycobacterium
QYLLEWRVALAKELLRTER

SEQ ID NO: 1293797 - protein, 17 aa, Mycobacterium
QYMGVNWVGPIIMRHGT

SEQ ID NO: 1293798 - protein, 22 aa, Mycobacterium
QYVPMPSWLRINFAAATVTAMA

SEQ ID NO: 1293799 - protein, 19 aa, Mycobacterium
RAAGLPGRINIVLQTCFFA

SEQ ID NO: 1293800 - protein, 18 aa, Mycobacterium
RAAGPLMRTPVVWATADY

SEQ ID NO: 1293801 - protein, 17 aa, Mycobacterium
RAAIGLGDGVVRISIGL

SEQ ID NO: 1293802 - protein, 20 aa, Mycobacterium
RAAKARFAVYIGDLGADTAA

SEQ ID NO: 1293803 - protein, 21 aa, Mycobacterium
RAALDEFEWRGAGARDVLDAA

SEQ ID NO: 1293804 - protein, 19 aa, Mycobacterium
RAALDLALFRAWYLHEELG

SEQ ID NO: 1293805 - protein, 22 aa, Mycobacterium
RAARLTRRWARHTGSPALPMSW

SEQ ID NO: 1293806 - protein, 22 aa, Mycobacterium
RAARRFGRCLLLNSGETAQLQR

SEQ ID NO: 1293807 - protein, 23 aa, Mycobacterium
RAASRLPFFTAWLRDHRWLPDAR

SEQ ID NO: 1293808 - protein, 20 aa, Mycobacterium
RAAWYRNRWVRTDSFVDPFP

SEQ ID NO: 1293809 - protein, 20 aa, Mycobacterium
RACLLGCGVTTGWGSAVNTA

SEQ ID NO: 1293810 - protein, 18 aa, Mycobacterium
RADAVLVLTEWREFVELD

SEQ ID NO: 1293811 - protein, 17 aa, Mycobacterium
RADGRWSGERGANIFDG

SEQ ID NO: 1293812 - protein, 20 aa, Mycobacterium
RADPGEIVWTWVAFEDDPTQ

SEQ ID NO: 1293813 - protein, 25 aa, Mycobacterium
RADPRMVEVFARFGLEGRLPASGLS

SEQ ID NO: 1293814 - protein, 22 aa, Mycobacterium
RAEGRYALMPGIIGALTDFGTP

SEQ ID NO: 1293815 - protein, 19 aa, Mycobacterium
RAEVPLIEEWFEFVGEKLP

SEQ ID NO: 1293816 - protein, 20 aa, Mycobacterium
RAFGRFGIQHFVKFDLATDT

SEQ ID NO: 1293817 - protein, 18 aa, Mycobacterium
RAFLLSRAGVEWASGLPG

SEQ ID NO: 1293818 - protein, 17 aa, Mycobacterium
RAGAVGLIITTDWSFSS

SEQ ID NO: 1293819 - protein, 24 aa, Mycobacterium
RAGELGLVPLRWALASLLADIGSA

SEQ ID NO: 1293820 - protein, 26 aa, Mycobacterium
RAGGMLSRLRPLFSLGLGARLGNGRQ

SEQ ID NO: 1293821 - protein, 20 aa, Mycobacterium
RAGLSIAEGFAFTRNEKLSA

SEQ ID NO: 1293822 - protein, 17 aa, Mycobacterium
RAGVIDRILAYVAPILL

SEQ ID NO: 1293823 - protein, 19 aa, Mycobacterium
RAGVLRFVVLDGLGKPGRL

SEQ ID NO: 1293824 - protein, 26 aa, Mycobacterium
RAHPDRVWAWYLWRHHMMSAVAPNNA

SEQ ID NO: 1293825 - protein, 20 aa, Mycobacterium
RAKAAWLWSRRHGVVAGQSA

SEQ ID NO: 1293826 - protein, 17 aa, Mycobacterium
RAKGVAVVWVQHSDADL

SEQ ID NO: 1293827 - protein, 17 aa, Mycobacterium
RAKLRRKGCDLLVVNAV

SEQ ID NO: 1293828 - protein, 23 aa, Mycobacterium
RAKVLARYAVWLGEHRDEIERLL

SEQ ID NO: 1293829 - protein, 19 aa, Mycobacterium
RALAAWVVFDPGEIFHYSD

SEQ ID NO: 1293830 - protein, 23 aa, Mycobacterium
RALANQLSRAWSLCAGNQALDAL

SEQ ID NO: 1293831 - protein, 17 aa, Mycobacterium
RALEVLRRLYARVGDRL

SEQ ID NO: 1293832 - protein, 24 aa, Mycobacterium
RALHPTMWIRMWFTDGEKLHQRGY

SEQ ID NO: 1293833 - protein, 17 aa, Mycobacterium
RALPGAVFVSAHTGDGL

SEQ ID NO: 1293834 - protein, 17 aa, Mycobacterium
RALRPGGTFLMVDIKSS

SEQ ID NO: 1293835 - protein, 17 aa, Mycobacterium
RALSLFPEQHAWLLEDF

SEQ ID NO: 1293836 - protein, 19 aa, Mycobacterium
RAPCPGLIALPWDRPLADW

SEQ ID NO: 1293837 - protein, 24 aa, Mycobacterium
RAPESLALALLRWRPLTRSDQAVR

SEQ ID NO: 1293838 - protein, 25 aa, Mycobacterium
RAPRKSWPRIMLRAAQGIGGLALRR

SEQ ID NO: 1293839 - protein, 19 aa, Mycobacterium
RAQRVAVDMVRPGVTAEQV

SEQ ID NO: 1293840 - protein, 17 aa, Mycobacterium
RARHRVMLIGWDFDTRM

SEQ ID NO: 1293841 - protein, 21 aa, Mycobacterium
RARPLWKITLIEGLPEGEAAV

SEQ ID NO: 1293842 - protein, 18 aa, Mycobacterium
RARQRLRIALAHKAVGRG

SEQ ID NO: 1293843 - protein, 24 aa, Mycobacterium
RASAPDRIEWILAHPTGITEIQEG

SEQ ID NO: 1293844 - protein, 20 aa, Mycobacterium
RASELLGFQVPPAIRQVATA

SEQ ID NO: 1293845 - protein, 17 aa, Mycobacterium
RATELLELVGLGHRVNH

SEQ ID NO: 1293846 - protein, 17 aa, Mycobacterium
RATHVLETWAHILDLLE

SEQ ID NO: 1293847 - protein, 22 aa, Mycobacterium
RATRLTWALSRWGVERYTGVFS

SEQ ID NO: 1293848 - protein, 17 aa, Mycobacterium
RAVDAGAVGHVFNLGHG

SEQ ID NO: 1293849 - protein, 22 aa, Mycobacterium
RAVEIVERLWLSSLWGGDSLET

SEQ ID NO: 1293850 - protein, 26 aa, Mycobacterium
RAVFTRYELVEGFPKFDIDDVFLGNG

SEQ ID NO: 1293851 - protein, 20 aa, Mycobacterium
RAVIAVRGLHRFAAAEGITT

SEQ ID NO: 1293852 - protein, 24 aa, Mycobacterium
RAWAEFVPFLAFPVEIRKIIYTTN

SEQ ID NO: 1293853 - protein, 22 aa, Mycobacterium
RAWTEPEYREWLLSDATAAIAD

SEQ ID NO: 1293854 - protein, 19 aa, Mycobacterium
RAYRLGWPAGTVVYELDQP

SEQ ID NO: 1293855 - protein, 22 aa, Mycobacterium
RAYRLPWPAGTVVYEIDQPTVI

SEQ ID NO: 1293856 - protein, 19 aa, Mycobacterium
RCAACTGSLAGTRLTGSVL

SEQ ID NO: 1293857 - protein, 22 aa, Mycobacterium
RCAIGVPTPAGWRMLSGDETGW

SEQ ID NO: 1293858 - protein, 18 aa, Mycobacterium
RCEVEWIPPPALDTGQAR

SEQ ID NO: 1293859 - protein, 17 aa, Mycobacterium
RCGRCGNRLFSQARHNN

SEQ ID NO: 1293860 - protein, 17 aa, Mycobacterium
RCLRPTLDARIAFCEQS

SEQ ID NO: 1293861 - protein, 18 aa, Mycobacterium
RCLVLWAALVGAISLEVF

SEQ ID NO: 1293862 - protein, 21 aa, Mycobacterium
RCPRCGAGFDVIRAGAGVGGD

SEQ ID NO: 1293863 - protein, 27 aa, Mycobacterium
RCQQVWCPVCALAALISGEQHPLLSVV

SEQ ID NO: 1293864 - protein, 21 aa, Mycobacterium
RCTRALRMGRLSLDQVGAIAD

SEQ ID NO: 1293865 - protein, 23 aa, Mycobacterium
RDAHLRAADFFDVENHPVATFTS

SEQ ID NO: 1293866 - protein, 18 aa, Mycobacterium
RDAWQWMIERPLAEAITS

SEQ ID NO: 1293867 - protein, 19 aa, Mycobacterium
RDCYRVRARVLGFEGQLAL

SEQ ID NO: 1293868 - protein, 21 aa, Mycobacterium
RDDALLAFPAMQAMPTPYVEA

SEQ ID NO: 1293869 - protein, 17 aa, Mycobacterium
RDDCPRFAPGDFADRPT

SEQ ID NO: 1293870 - protein, 17 aa, Mycobacterium
RDGEGWYWLGRLDGPYF

SEQ ID NO: 1293871 - protein, 20 aa, Mycobacterium
RDGIMPRLRAASARAGAACA

SEQ ID NO: 1293872 - protein, 18 aa, Mycobacterium
RDGLPWRYVGVLHEYAEC

SEQ ID NO: 1293873 - protein, 20 aa, Mycobacterium
RDGLRVIAIRSRLMSRLAGQ

SEQ ID NO: 1293874 - protein, 19 aa, Mycobacterium
RDIGFVFQRFHLIPRLTVV

SEQ ID NO: 1293875 - protein, 17 aa, Mycobacterium
RDIPLRLVHAVTPTDGA

SEQ ID NO: 1293876 - protein, 19 aa, Mycobacterium
RDIRRRVGLVFQDPDDQLF

SEQ ID NO: 1293877 - protein, 17 aa, Mycobacterium
RDKLCWRNAAALYGIES

SEQ ID NO: 1293878 - protein, 25 aa, Mycobacterium
RDQVRAFRMLPNIVFAGRAISSQTI

SEQ ID NO: 1293879 - protein, 19 aa, Mycobacterium
RDTLFGFARHELETTFIAT

SEQ ID NO: 1293880 - protein, 23 aa, Mycobacterium
RDWWGHAVVPSWYTEASLVLDLD

SEQ ID NO: 1293881 - protein, 17 aa, Mycobacterium
REFGVRVLVIRPGQVRT

SEQ ID NO: 1293882 - protein, 22 aa, Mycobacterium
REFPMAFRFAVLNVISDGLTAR

SEQ ID NO: 1293883 - protein, 18 aa, Mycobacterium
REHYAWLLAEHIYPTFGA

SEQ ID NO: 1293884 - protein, 20 aa, Mycobacterium
REILDRLGYRFLPEQVPKMV

SEQ ID NO: 1293885 - protein, 17 aa, Mycobacterium
RELFVKFSRDFDDPARD

SEQ ID NO: 1293886 - protein, 18 aa, Mycobacterium
RELLCASGADVVEFDPLC

SEQ ID NO: 1293887 - protein, 20 aa, Mycobacterium
RELPEWLAADVAILGEPSGG

SEQ ID NO: 1293888 - protein, 22 aa, Mycobacterium
RELWSGDATFVFTRTTAGEIGI

SEQ ID NO: 1293889 - protein, 17 aa, Mycobacterium
REPRPMVYSGLYPVDGS

SEQ ID NO: 1293890 - protein, 20 aa, Mycobacterium
REPYRVISVLGDRFVVSETF

SEQ ID NO: 1293891 - protein, 19 aa, Mycobacterium
REQAVAAIVDWVTRRENAT

SEQ ID NO: 1293892 - protein, 19 aa, Mycobacterium
RERFAEFLAGFHLVDEHFR

SEQ ID NO: 1293893 - protein, 23 aa, Mycobacterium
RETFRAVGVNLMFDHIKESLHEF

SEQ ID NO: 1293894 - protein, 21 aa, Mycobacterium
REVPGEVLAAIGRDVNAVTLE

SEQ ID NO: 1293895 - protein, 20 aa, Mycobacterium
REVRAAGSMRVLERVSGQAG

SEQ ID NO: 1293896 - protein, 17 aa, Mycobacterium
REVSFGLARPVWVDDRE

SEQ ID NO: 1293897 - protein, 23 aa, Mycobacterium
RFGEPRLGLTPALSQRSGDVVPT

SEQ ID NO: 1293898 - protein, 20 aa, Mycobacterium
RFGVPPANNANYAWIQHILY

SEQ ID NO: 1293899 - protein, 18 aa, Mycobacterium
RFHPKYAVAPLAALATVM

SEQ ID NO: 1293900 - protein, 18 aa, Mycobacterium
RFLVQSARIAYVEIGAAD

SEQ ID NO: 1293901 - protein, 23 aa, Mycobacterium
RFMDDFLLYWSFLAFALVRGGRR

SEQ ID NO: 1293902 - protein, 19 aa, Mycobacterium
RFNELVLRAELTWQQVAVL

SEQ ID NO: 1293903 - protein, 20 aa, Mycobacterium
RFPKFDWPRIDAPFIRPGAD

SEQ ID NO: 1293904 - protein, 20 aa, Mycobacterium
RFPKFDWPRIDAPVCSAGMD

SEQ ID NO: 1293905 - protein, 19 aa, Mycobacterium
RFQRVSYRWVPRAQNSRAD

SEQ ID NO: 1293906 - protein, 18 aa, Mycobacterium
RFRAARVVIDIGVHCGLV

SEQ ID NO: 1293907 - protein, 19 aa, Mycobacterium
RFRFVEEMIRLGADARTDG

SEQ ID NO: 1293908 - protein, 23 aa, Mycobacterium
RFRPRVRAPFTRRSLARDGSPTG

SEQ ID NO: 1293909 - protein, 17 aa, Mycobacterium
RFSMPWSAPADRMREYI

SEQ ID NO: 1293910 - protein, 18 aa, Mycobacterium
RFSMPWSKPVGRMREFVL

SEQ ID NO: 1293911 - protein, 19 aa, Mycobacterium
RFSVYGTDVGVMWDNGMVD

SEQ ID NO: 1293912 - protein, 23 aa, Mycobacterium
RFTAEFLGDCVLLPCTVTGGIAT

SEQ ID NO: 1293913 - protein, 18 aa, Mycobacterium
RFVKFMITEIFPGGRVPT

SEQ ID NO: 1293914 - protein, 19 aa, Mycobacterium
RFVMMVLRHIPRPIFRKLP

SEQ ID NO: 1293915 - protein, 19 aa, Mycobacterium
RGAAFVSACALVFGPGEAE

SEQ ID NO: 1293916 - protein, 22 aa, Mycobacterium
RGAGGWRFRHELLREVAAELAP

SEQ ID NO: 1293917 - protein, 17 aa, Mycobacterium
RGAGIGFSGQPGPLNAL

SEQ ID NO: 1293918 - protein, 18 aa, Mycobacterium
RGALPHGQPGHWTAHVTL

SEQ ID NO: 1293919 - protein, 21 aa, Mycobacterium
RGAWLLRPFHESLLWYDARKE

SEQ ID NO: 1293920 - protein, 21 aa, Mycobacterium
RGCLGRPWLFAELSAAFNGTA

SEQ ID NO: 1293921 - protein, 23 aa, Mycobacterium
RGDLSLVRKEIWTPVSEQRASAV

SEQ ID NO: 1293922 - protein, 17 aa, Mycobacterium
RGDMAGRSRLEVIAPGA

SEQ ID NO: 1293923 - protein, 21 aa, Mycobacterium
RGDPTYPGWETLGPTEAKNQH

SEQ ID NO: 1293924 - protein, 19 aa, Mycobacterium
RGELGMWLRRIGAADSPVS

SEQ ID NO: 1293925 - protein, 18 aa, Mycobacterium
RGEPQWRNAFGYLPDGSR

SEQ ID NO: 1293926 - protein, 18 aa, Mycobacterium
RGEPVGTFTGWRPAMPVT

SEQ ID NO: 1293927 - protein, 20 aa, Mycobacterium
RGGCIIRAKFLNRIKDAFDN

SEQ ID NO: 1293928 - protein, 17 aa, Mycobacterium
RGGLPLQRLMNAESMAS

SEQ ID NO: 1293929 - protein, 23 aa, Mycobacterium
RGGRSCPYWNLVLAPGAAPVPLD

SEQ ID NO: 1293930 - protein, 20 aa, Mycobacterium
RGGWKPFLHHVSNRMPRSRR

SEQ ID NO: 1293931 - protein, 23 aa, Mycobacterium
RGGYRQDWCRVIDFPVTAAAGAT

SEQ ID NO: 1293932 - protein, 17 aa, Mycobacterium
RGISKAAAMEWARDDIR

SEQ ID NO: 1293933 - protein, 25 aa, Mycobacterium
RGKAVLVKLIWRMVRARVFGDRMAA

SEQ ID NO: 1293934 - protein, 19 aa, Mycobacterium
RGKLLPRDRVDGLLDPGSP

SEQ ID NO: 1293935 - protein, 17 aa, Mycobacterium
RGLRRRVGFVFQQFNLV

SEQ ID NO: 1293936 - protein, 19 aa, Mycobacterium
RGLVARWLTEWACPDLILA

SEQ ID NO: 1293937 - protein, 20 aa, Mycobacterium
RGNLAFRWFLADQVPARPEV

SEQ ID NO: 1293938 - protein, 18 aa, Mycobacterium
RGPGEAPGLFALEMAMDE

SEQ ID NO: 1293939 - protein, 17 aa, Mycobacterium
RGPLQWEAPYGHTLISK

SEQ ID NO: 1293940 - protein, 18 aa, Mycobacterium
RGPMLHRALQQFLADVYW

SEQ ID NO: 1293941 - protein, 18 aa, Mycobacterium
RGQLAIGVARVIAGGDGM

SEQ ID NO: 1293942 - protein, 20 aa, Mycobacterium
RGRARFLAMAGGGGFLLYLQ

SEQ ID NO: 1293943 - protein, 18 aa, Mycobacterium
RGRFRWWGLYTQRKPGYD

SEQ ID NO: 1293944 - protein, 18 aa, Mycobacterium
RGRLGLLELRGFEMPPHH

SEQ ID NO: 1293945 - protein, 19 aa, Mycobacterium
RGSIIFTVSNAGFWPGGGG

SEQ ID NO: 1293946 - protein, 19 aa, Mycobacterium
RGTERWLSQRLSHILGRGS

SEQ ID NO: 1293947 - protein, 18 aa, Mycobacterium
RGVARLKALLPYIDGGAE

SEQ ID NO: 1293948 - protein, 17 aa, Mycobacterium
RGVCSLDAIAAGSTGDV

SEQ ID NO: 1293949 - protein, 18 aa, Mycobacterium
RHGMFWSGDLAYRDADGW

SEQ ID NO: 1293950 - protein, 22 aa, Mycobacterium
RHGVQLFGAMGFTWENDLQFAL

SEQ ID NO: 1293951 - protein, 24 aa, Mycobacterium
RHLFTVLMDREWKHGVAAAVDVTL

SEQ ID NO: 1293952 - protein, 26 aa, Mycobacterium
RHLSARVAKWWLPDAVEFIDAVPKTS

SEQ ID NO: 1293953 - protein, 18 aa, Mycobacterium
RHLVAGLMLIHLDIDAAV

SEQ ID NO: 1293954 - protein, 18 aa, Mycobacterium
RHRFPIVLTESVEQFLTA

SEQ ID NO: 1293955 - protein, 19 aa, Mycobacterium
RHSCGYPRLRSFEDLSAKR

SEQ ID NO: 1293956 - protein, 17 aa, Mycobacterium
RHTFAIRTLIGWYRGGE

SEQ ID NO: 1293957 - protein, 19 aa, Mycobacterium
RHWDHRWALSVLNSALGGG

SEQ ID NO: 1293958 - protein, 22 aa, Mycobacterium
RHYLPGMVDRGWGRVLQIASDS

SEQ ID NO: 1293959 - protein, 17 aa, Mycobacterium
RIAALLLEINRRFGTPI

SEQ ID NO: 1293960 - protein, 18 aa, Mycobacterium
RIAGRAATPFRLHAGERT

SEQ ID NO: 1293961 - protein, 27 aa, Mycobacterium
RIALEWLTPRFGARVGWLAGAHVAAKR

SEQ ID NO: 1293962 - protein, 19 aa, Mycobacterium
RIAPRKALALRALDVVAPR

SEQ ID NO: 1293963 - protein, 17 aa, Mycobacterium
RIDAGLFTGTRFEGHLT

SEQ ID NO: 1293964 - protein, 18 aa, Mycobacterium
RIDDALSRLGVRRLDAVT

SEQ ID NO: 1293965 - protein, 24 aa, Mycobacterium
RIERLEGLPGWAWNVVDARWETSF

SEQ ID NO: 1293966 - protein, 22 aa, Mycobacterium
RIFPVYGRKAWKSRLRAHPDVA

SEQ ID NO: 1293967 - protein, 17 aa, Mycobacterium
RIFVLTFEVEFFGRHGF

SEQ ID NO: 1293968 - protein, 19 aa, Mycobacterium
RIGGFALWGSVAVKRKKRK

SEQ ID NO: 1293969 - protein, 21 aa, Mycobacterium
RIGLKAGELHAVIVAPLYLTL

SEQ ID NO: 1293970 - protein, 27 aa, Mycobacterium
RIGRPLRVGHAWSFTFDAAWQPLAALL

SEQ ID NO: 1293971 - protein, 19 aa, Mycobacterium
RINGAKAWITHGGIADFYN

SEQ ID NO: 1293972 - protein, 19 aa, Mycobacterium
RINMMPGFTGTGFYWHSDF

SEQ ID NO: 1293973 - protein, 17 aa, Mycobacterium
RIRALIAHRRRYDPAPD

SEQ ID NO: 1293974 - protein, 19 aa, Mycobacterium
RIRFPAIVRTVARVLRAAD

SEQ ID NO: 1293975 - protein, 18 aa, Mycobacterium
RIRILKRLSKTPMSVKQL

SEQ ID NO: 1293976 - protein, 18 aa, Mycobacterium
RIRPPVCARASDLRAMGL

SEQ ID NO: 1293977 - protein, 18 aa, Mycobacterium
RITALMCTADVLALSAMD

SEQ ID NO: 1293978 - protein, 19 aa, Mycobacterium
RITLWRDYFDTVDFLKATV

SEQ ID NO: 1293979 - protein, 19 aa, Mycobacterium
RIVDCPACGGMLKPDIVYF

SEQ ID NO: 1293980 - protein, 17 aa, Mycobacterium
RIVPTCWMVAEYIDRHP

SEQ ID NO: 1293981 - protein, 20 aa, Mycobacterium
RIVTEGGDLCFIRVRPNGTV

SEQ ID NO: 1293982 - protein, 20 aa, Mycobacterium
RIYAAWLWSRRRAVIGGLSA

SEQ ID NO: 1293983 - protein, 17 aa, Mycobacterium
RKDHPAFRRRRFFEGKP

SEQ ID NO: 1293984 - protein, 20 aa, Mycobacterium
RKDPFDWPDRQEFITVEQFD

SEQ ID NO: 1293985 - protein, 18 aa, Mycobacterium
RKDSLTWAGFLDCNSTAF

SEQ ID NO: 1293986 - protein, 18 aa, Mycobacterium
RKGAMKSTEWIAAYENQN

SEQ ID NO: 1293987 - protein, 20 aa, Mycobacterium
RKIDCAACLVMAHSRATWRA

SEQ ID NO: 1293988 - protein, 19 aa, Mycobacterium
RKKLGTGLIEAFSTTCSHC

SEQ ID NO: 1293989 - protein, 20 aa, Mycobacterium
RKLDEEFIWYGRIPRAKLAG

SEQ ID NO: 1293990 - protein, 23 aa, Mycobacterium
RKLREIRAALAMDAALPKAEILT

SEQ ID NO: 1293991 - protein, 23 aa, Mycobacterium
RKQWPSGLAKLGLDLSGRIHDGP

SEQ ID NO: 1293992 - protein, 20 aa, Mycobacterium
RKQWPSGLAKLGVDLSGRIT

SEQ ID NO: 1293993 - protein, 17 aa, Mycobacterium
RKRFDDVHIYPVAFHGD

SEQ ID NO: 1293994 - protein, 17 aa, Mycobacterium
RKVDAFAARDVFRYPRL

SEQ ID NO: 1293995 - protein, 20 aa, Mycobacterium
RLAAMLPWAPLVPFLHDGVI

SEQ ID NO: 1293996 - protein, 17 aa, Mycobacterium
RLADGLLQLSVQALEYP

SEQ ID NO: 1293997 - protein, 17 aa, Mycobacterium
RLAECGVVYELRQPVGV

SEQ ID NO: 1293998 - protein, 19 aa, Mycobacterium
RLAEELVRIIGVLRGMALK

SEQ ID NO: 1293999 - protein, 20 aa, Mycobacterium
RLALDRVLLRAGGDGPPTDQ

SEQ ID NO: 1294000 - protein, 22 aa, Mycobacterium
RLALGVGPSHHWIVRDMLGLPY

SEQ ID NO: 1294001 - protein, 18 aa, Mycobacterium
RLALRGWQVLRFTWLDLT

SEQ ID NO: 1294002 - protein, 18 aa, Mycobacterium
RLASALALTGVDVGQRVA

SEQ ID NO: 1294003 - protein, 17 aa, Mycobacterium
RLCPNPVLADGRRLDEA

SEQ ID NO: 1294004 - protein, 20 aa, Mycobacterium
RLCSLCVALGAPVRDWWQIS

SEQ ID NO: 1294005 - protein, 18 aa, Mycobacterium
RLCVPCAWAYSRQPTTQP

SEQ ID NO: 1294006 - protein, 21 aa, Mycobacterium
RLDEWWSLACIRVLRTDTEAA

SEQ ID NO: 1294007 - protein, 17 aa, Mycobacterium
RLDRLGFDEAWFGEHHS

SEQ ID NO: 1294008 - protein, 20 aa, Mycobacterium
RLDVPLEVSVGYGRSWDSAA

SEQ ID NO: 1294009 - protein, 24 aa, Mycobacterium
RLEDLPGWSWAHRQTRQWESCFEE

SEQ ID NO: 1294010 - protein, 19 aa, Mycobacterium
RLEFLAARGWLIVRVSATQ

SEQ ID NO: 1294011 - protein, 18 aa, Mycobacterium
RLEKLWLPGVDRLLDCVD

SEQ ID NO: 1294012 - protein, 17 aa, Mycobacterium
RLERVAGRLGIDETSTD

SEQ ID NO: 1294013 - protein, 18 aa, Mycobacterium
RLGEVWRMRSAEERDASL

SEQ ID NO: 1294014 - protein, 19 aa, Mycobacterium
RLGFDEAWFGEHHSGGYEL

SEQ ID NO: 1294015 - protein, 18 aa, Mycobacterium
RLGRRFSRPAIVRIAEAS

SEQ ID NO: 1294016 - protein, 23 aa, Mycobacterium
RLGSGRQWLSWIGLDDLVEVYHR

SEQ ID NO: 1294017 - protein, 23 aa, Mycobacterium
RLGTAAVCWRLRRRHGLQVHDIA

SEQ ID NO: 1294018 - protein, 25 aa, Mycobacterium
RLLAEVLRLRGWHVDFLGAQVPTPH

SEQ ID NO: 1294019 - protein, 23 aa, Mycobacterium
RLLFPALCRPTAPVVVSSADLAP

SEQ ID NO: 1294020 - protein, 19 aa, Mycobacterium
RLLLETAWRAVEHSGTAPS

SEQ ID NO: 1294021 - protein, 23 aa, Mycobacterium
RLLLEVVCARLLLPSASDTEAAL

SEQ ID NO: 1294022 - protein, 23 aa, Mycobacterium
RLLPGRGLLVCDVWVGAPAGTAM

SEQ ID NO: 1294023 - protein, 18 aa, Mycobacterium
RLLPLLELKAGRILFGGW

SEQ ID NO: 1294024 - protein, 18 aa, Mycobacterium
RLNIPTVFVSGGPMEGGT

SEQ ID NO: 1294025 - protein, 20 aa, Mycobacterium
RLPDALARFPITRLVSSPQV

SEQ ID NO: 1294026 - protein, 18 aa, Mycobacterium
RLPDLKVRVVNVVDIMRL

SEQ ID NO: 1294027 - protein, 25 aa, Mycobacterium
RLPKGEPLLAFGSRAVVHFAVSNSE

SEQ ID NO: 1294028 - protein, 18 aa, Mycobacterium
RLPLRWEHPEASDITAEY

SEQ ID NO: 1294029 - protein, 19 aa, Mycobacterium
RLPRLQRLAVYTGDALGEL

SEQ ID NO: 1294030 - protein, 18 aa, Mycobacterium
RLPWDYKRLYGLDPDEQS

SEQ ID NO: 1294031 - protein, 22 aa, Mycobacterium
RLPWLGGAEVVYWGDIDTHGFA

SEQ ID NO: 1294032 - protein, 19 aa, Mycobacterium
RLPWLLRLVAWLPQPDPHR

SEQ ID NO: 1294033 - protein, 19 aa, Mycobacterium
RLPYLARLGVDAMWINPWY

SEQ ID NO: 1294034 - protein, 17 aa, Mycobacterium
RLQPHYIELAFKAAFTR

SEQ ID NO: 1294035 - protein, 19 aa, Mycobacterium
RLRAASARAGAACASSTSR

SEQ ID NO: 1294036 - protein, 17 aa, Mycobacterium
RLRKVWEEWLPTLDYPF

SEQ ID NO: 1294037 - protein, 18 aa, Mycobacterium
RLRLELEQGLGWKAGVEA

SEQ ID NO: 1294038 - protein, 21 aa, Mycobacterium
RLRMLEALGWIVIRVIAEDRP

SEQ ID NO: 1294039 - protein, 17 aa, Mycobacterium
RLRPGVMEVKIPMPTTG

SEQ ID NO: 1294040 - protein, 18 aa, Mycobacterium
RLRRRISAIMGYSDDNAV

SEQ ID NO: 1294041 - protein, 17 aa, Mycobacterium
RLRVHRILADGYTMRLL

SEQ ID NO: 1294042 - protein, 21 aa, Mycobacterium
RLSPGLKRSSLIGGIRYYDTV

SEQ ID NO: 1294043 - protein, 18 aa, Mycobacterium
RLTLPAKFRDALAGGLMV

SEQ ID NO: 1294044 - protein, 23 aa, Mycobacterium
RLTRSWAGLKAMRSYALATMDVE

SEQ ID NO: 1294045 - protein, 18 aa, Mycobacterium
RLTSELPLPVNAIARPES

SEQ ID NO: 1294046 - protein, 19 aa, Mycobacterium
RLVLISPWLDVSMSDPRSA

SEQ ID NO: 1294047 - protein, 22 aa, Mycobacterium
RLVWQCASLLLSYPDHSRFDTA

SEQ ID NO: 1294048 - protein, 19 aa, Mycobacterium
RLWEHWGRPNIAWYRGGHT

SEQ ID NO: 1294049 - protein, 19 aa, Mycobacterium
RLYRTSVSPFGLVTGAWID

SEQ ID NO: 1294050 - protein, 17 aa, Mycobacterium
RMAVEWPDGTGFHFLRG

SEQ ID NO: 1294051 - protein, 19 aa, Mycobacterium
RMFADGVGLVYERAALAER

SEQ ID NO: 1294052 - protein, 18 aa, Mycobacterium
RMGFPVDIANAIRFLLSD

SEQ ID NO: 1294053 - protein, 23 aa, Mycobacterium
RMNFSLDGLRVFPYKEAAERTID

SEQ ID NO: 1294054 - protein, 19 aa, Mycobacterium
RMSKFEVVTAMAFAAFADA

SEQ ID NO: 1294055 - protein, 22 aa, Mycobacterium
RMSKSRWGNLIPEVKWVEEKQG

SEQ ID NO: 1294056 - protein, 20 aa, Mycobacterium
RNAHHSWGWDRDTEVPVDLA

SEQ ID NO: 1294057 - protein, 23 aa, Mycobacterium
RNALTGLIGWEWMHRDEFVTELK

SEQ ID NO: 1294058 - protein, 23 aa, Mycobacterium
RNFVKANGWPLANTVIRHYKLHA

SEQ ID NO: 1294059 - protein, 24 aa, Mycobacterium
RNGDLRAAGLLSRALLWQGRAAEA

SEQ ID NO: 1294060 - protein, 18 aa, Mycobacterium
RNGWYWSGDLGYLDGAGF

SEQ ID NO: 1294061 - protein, 17 aa, Mycobacterium
RNLECLDLPATDLTAPQ

SEQ ID NO: 1294062 - protein, 17 aa, Mycobacterium
RNTFHWVLAFSPGGLST

SEQ ID NO: 1294063 - protein, 19 aa, Mycobacterium
RPAAEIVRMLLERILGSLE

SEQ ID NO: 1294064 - protein, 18 aa, Mycobacterium
RPACRRCSGVAINVDCVS

SEQ ID NO: 1294065 - protein, 18 aa, Mycobacterium
RPAEYWKPGTKVEVAVNT

SEQ ID NO: 1294066 - protein, 20 aa, Mycobacterium
RPAGWWIRRRVHETAVHRAD

SEQ ID NO: 1294067 - protein, 19 aa, Mycobacterium
RPALEVLLLGGRPIREPVF

SEQ ID NO: 1294068 - protein, 21 aa, Mycobacterium
RPALLSVSFGEDWSWVRRAQE

SEQ ID NO: 1294069 - protein, 19 aa, Mycobacterium
RPAPWRGAMEIDRLNVAIG

SEQ ID NO: 1294070 - protein, 17 aa, Mycobacterium
RPATAVDEIVRWATPVT

SEQ ID NO: 1294071 - protein, 19 aa, Mycobacterium
RPAVELAWLSDIDGQPAAT

SEQ ID NO: 1294072 - protein, 17 aa, Mycobacterium
RPDIGVTILRLANMIGP

SEQ ID NO: 1294073 - protein, 18 aa, Mycobacterium
RPDMFAHYGRPFPTGEAV

SEQ ID NO: 1294074 - protein, 23 aa, Mycobacterium
RPDPFCGMESCWLQHMESAHRDV

SEQ ID NO: 1294075 - protein, 22 aa, Mycobacterium
RPETPCAVVAFASWPEEIVLRG

SEQ ID NO: 1294076 - protein, 19 aa, Mycobacterium
RPEWLWTAAGIPFNRATSL

SEQ ID NO: 1294077 - protein, 19 aa, Mycobacterium
RPFHESLLWYDARKESANR

SEQ ID NO: 1294078 - protein, 17 aa, Mycobacterium
RPGDVAFTFTDYAVDPA

SEQ ID NO: 1294079 - protein, 17 aa, Mycobacterium
RPGEAFLAWQRFSQETP

SEQ ID NO: 1294080 - protein, 21 aa, Mycobacterium
RPGTLEKWGLGYDVLRERNRG

SEQ ID NO: 1294081 - protein, 22 aa, Mycobacterium
RPIAVEAYGLFIFRDAIGALGG

SEQ ID NO: 1294082 - protein, 18 aa, Mycobacterium
RPLPLLPLCGGVPTDVAW

SEQ ID NO: 1294083 - protein, 17 aa, Mycobacterium
RPLRPSFVSGLRNEIQV

SEQ ID NO: 1294084 - protein, 19 aa, Mycobacterium
RPLRRVDITSGSSMVKETT

SEQ ID NO: 1294085 - protein, 17 aa, Mycobacterium
RPLVGPLLWDLTAGTAT

SEQ ID NO: 1294086 - protein, 18 aa, Mycobacterium
RPLWEMYLIEGLAGGRIA

SEQ ID NO: 1294087 - protein, 19 aa, Mycobacterium
RPNLPPGFDFTDPDIYAER

SEQ ID NO: 1294088 - protein, 21 aa, Mycobacterium
RPNRLSFTWSHSGWSDPTAQS

SEQ ID NO: 1294089 - protein, 20 aa, Mycobacterium
RPPGCRFWNLVVWNQFMAVP

SEQ ID NO: 1294090 - protein, 17 aa, Mycobacterium
RPPIPRPLQAEGGVPDL

SEQ ID NO: 1294091 - protein, 23 aa, Mycobacterium
RPQWRVDLIPSYKAHRVAVPAEE

SEQ ID NO: 1294092 - protein, 17 aa, Mycobacterium
RPRAVVVGGGIAGLTAA

SEQ ID NO: 1294093 - protein, 20 aa, Mycobacterium
RPRGEGQWALGYREPLNPNE

SEQ ID NO: 1294094 - protein, 22 aa, Mycobacterium
RPRKRWVLKGFHGFRLTEFFAG

SEQ ID NO: 1294095 - protein, 19 aa, Mycobacterium
RPRLLRKWIEACYGTASAE

SEQ ID NO: 1294096 - protein, 18 aa, Mycobacterium
RPRMAVLHAVGRHPHADT

SEQ ID NO: 1294097 - protein, 20 aa, Mycobacterium
RPSKVAFLAFHAWSDASHGD

SEQ ID NO: 1294098 - protein, 18 aa, Mycobacterium
RPSMRGVPFSFVRVDRAG

SEQ ID NO: 1294099 - protein, 22 aa, Mycobacterium
RPTFVPAYVVFPTFQAKKGSLN

SEQ ID NO: 1294100 - protein, 23 aa, Mycobacterium
RPVPWEPGHAFVLCDVVNTDGSP

SEQ ID NO: 1294101 - protein, 17 aa, Mycobacterium
RPYDLSSLFAIGTGGAA

SEQ ID NO: 1294102 - protein, 17 aa, Mycobacterium
RQAELFAAWAVYLLVGY

SEQ ID NO: 1294103 - protein, 19 aa, Mycobacterium
RQFTCKYHAWRYALDGELT

SEQ ID NO: 1294104 - protein, 23 aa, Mycobacterium
RQLDLLLARRDWLWRVAESVTKL

SEQ ID NO: 1294105 - protein, 19 aa, Mycobacterium
RQLFTVRIGLRLTEATQTT

SEQ ID NO: 1294106 - protein, 17 aa, Mycobacterium
RQLLDLMIHSVYSNKDS

SEQ ID NO: 1294107 - protein, 22 aa, Mycobacterium
RQQTLRASVDWSHGLLTDPERV

SEQ ID NO: 1294108 - protein, 21 aa, Mycobacterium
RQRLDAALARPALQQPSWDAG

SEQ ID NO: 1294109 - protein, 19 aa, Mycobacterium
RQRYCFRHPLVRAVAYDSQ

SEQ ID NO: 1294110 - protein, 22 aa, Mycobacterium
RQSSRIPFRYAWSEVRAALDTH

SEQ ID NO: 1294111 - protein, 18 aa, Mycobacterium
RQWWTWSPGACWRHPFGP

SEQ ID NO: 1294112 - protein, 18 aa, Mycobacterium
RRAETRPGVAVRMLTSGT

SEQ ID NO: 1294113 - protein, 22 aa, Mycobacterium
RRARMSGMTLVFVHGNPETDAI

SEQ ID NO: 1294114 - protein, 25 aa, Mycobacterium
RRDKNWRPTMLWAYDPQAFDGKGRA

SEQ ID NO: 1294115 - protein, 17 aa, Mycobacterium
RRDVLVLFDYHRYQASA

SEQ ID NO: 1294116 - protein, 25 aa, Mycobacterium
RREMAYEGKVDWAFAELLALGTFLA

SEQ ID NO: 1294117 - protein, 19 aa, Mycobacterium
RREVGNARAGRLVAPDLGF

SEQ ID NO: 1294118 - protein, 27 aa, Mycobacterium
RRFAIPAVEARGALLLEDVGVPLPALA

SEQ ID NO: 1294119 - protein, 23 aa, Mycobacterium
RRFAWEVNHGWAYWGYEMAAEDG

SEQ ID NO: 1294120 - protein, 19 aa, Mycobacterium
RRFLTFNGWLLQCGELPLR

SEQ ID NO: 1294121 - protein, 20 aa, Mycobacterium
RRFNEAFGPFGFQPQAIKPS

SEQ ID NO: 1294122 - protein, 17 aa, Mycobacterium
RRFYCRARWQTGGIDSE

SEQ ID NO: 1294123 - protein, 20 aa, Mycobacterium
RRGGEWLDWFAAARITAIGM

SEQ ID NO: 1294124 - protein, 18 aa, Mycobacterium
RRGGLRLLLNVPEGGGGA

SEQ ID NO: 1294125 - protein, 18 aa, Mycobacterium
RRGLAVGERVVWSVTAAC

SEQ ID NO: 1294126 - protein, 18 aa, Mycobacterium
RRGLTIDLGFAWADIGGR

SEQ ID NO: 1294127 - protein, 17 aa, Mycobacterium
RRGRMLWSLPKGHIEMG

SEQ ID NO: 1294128 - protein, 24 aa, Mycobacterium
RRGSLPPGRLGWRKAQEIASRSAA

SEQ ID NO: 1294129 - protein, 17 aa, Mycobacterium
RRHLSCTPKEYLRKVRL

SEQ ID NO: 1294130 - protein, 17 aa, Mycobacterium
RRIDMGWPDAMVGIEYD

SEQ ID NO: 1294131 - protein, 18 aa, Mycobacterium
RRIDMGWPDAMVGIEYDG

SEQ ID NO: 1294132 - protein, 20 aa, Mycobacterium
RRIGARPQRCVVVENSAAGV

SEQ ID NO: 1294133 - protein, 18 aa, Mycobacterium
RRIIPPWVTLGSRLAVLP

SEQ ID NO: 1294134 - protein, 19 aa, Mycobacterium
RRIRDGFVVGEGYADLMTA

SEQ ID NO: 1294135 - protein, 22 aa, Mycobacterium
RRIRTWLSFPQWFYLNVPVNTL

SEQ ID NO: 1294136 - protein, 17 aa, Mycobacterium
RRISAIMGYSDDNAVDT

SEQ ID NO: 1294137 - protein, 17 aa, Mycobacterium
RRLAAALLERARELGTV

SEQ ID NO: 1294138 - protein, 20 aa, Mycobacterium
RRLDREFGWQATVPRPNQQF

SEQ ID NO: 1294139 - protein, 18 aa, Mycobacterium
RRLEQIEALRLVLERGWT

SEQ ID NO: 1294140 - protein, 19 aa, Mycobacterium
RRLGAPSVRLDELRAENLT

SEQ ID NO: 1294141 - protein, 21 aa, Mycobacterium
RRLGLPVPPAFCLTTDVCAQF

SEQ ID NO: 1294142 - protein, 17 aa, Mycobacterium
RRLKFLVAFRPGVLSPT

SEQ ID NO: 1294143 - protein, 23 aa, Mycobacterium
RRLLAEPIAMVFAARDTGAEALS

SEQ ID NO: 1294144 - protein, 20 aa, Mycobacterium
RRLLAEPVVMVFAVRDNADV

SEQ ID NO: 1294145 - protein, 25 aa, Mycobacterium
RRLLDRISLGGAWDMVKGVFTGEAD

SEQ ID NO: 1294146 - protein, 19 aa, Mycobacterium
RRLLRLCARYSATGADFSG

SEQ ID NO: 1294147 - protein, 17 aa, Mycobacterium
RRLQIEFSQAIQQITDG

SEQ ID NO: 1294148 - protein, 23 aa, Mycobacterium
RRLRARPPLARRYLALEAHRVLA

SEQ ID NO: 1294149 - protein, 18 aa, Mycobacterium
RRLVTIGGIGTNVFSPGP

SEQ ID NO: 1294150 - protein, 18 aa, Mycobacterium
RRMSRLRILTAVTLGRLE

SEQ ID NO: 1294151 - protein, 19 aa, Mycobacterium
RRPAHFDGIHFVQKQIGHL

SEQ ID NO: 1294152 - protein, 21 aa, Mycobacterium
RRPDLLVSLLTYWQRHPSLSY

SEQ ID NO: 1294153 - protein, 21 aa, Mycobacterium
RRPDLPSGKGLVIAEGVLVVQ

SEQ ID NO: 1294154 - protein, 17 aa, Mycobacterium
RRPEVVDSQGWRAIDAA

SEQ ID NO: 1294155 - protein, 17 aa, Mycobacterium
RRPHRVAGLVLVNTGGF

SEQ ID NO: 1294156 - protein, 20 aa, Mycobacterium
RRPLPLPDMCYAAAATGDPD

SEQ ID NO: 1294157 - protein, 18 aa, Mycobacterium
RRPRYVVADAATVATDAL

SEQ ID NO: 1294158 - protein, 18 aa, Mycobacterium
RRRFDWGVPLGVEVPRLA

SEQ ID NO: 1294159 - protein, 17 aa, Mycobacterium
RRRGVVINPVLETSEIP

SEQ ID NO: 1294160 - protein, 20 aa, Mycobacterium
RRRHLLAQFLFRGDAVERPV

SEQ ID NO: 1294161 - protein, 18 aa, Mycobacterium
RRRIDTILSGVAQGADGV

SEQ ID NO: 1294162 - protein, 18 aa, Mycobacterium
RRRIIMLLGGLRELTAST

SEQ ID NO: 1294163 - protein, 21 aa, Mycobacterium
RRRLWAPHRVFGARQLDMVGD

SEQ ID NO: 1294164 - protein, 17 aa, Mycobacterium
RRRNGVLPAIEQALHTI

SEQ ID NO: 1294165 - protein, 17 aa, Mycobacterium
RRRPWRAVRDAIAEADR

SEQ ID NO: 1294166 - protein, 21 aa, Mycobacterium
RRRRGRRGRGRGRGEQNGDES

SEQ ID NO: 1294167 - protein, 23 aa, Mycobacterium
RRRRRPVWRRAPLSLTASPSTEA

SEQ ID NO: 1294168 - protein, 17 aa, Mycobacterium
RRSWWRIAAVIDQSLRP

SEQ ID NO: 1294169 - protein, 18 aa, Mycobacterium
RRTFAVNIDSFFHVTKAA

SEQ ID NO: 1294170 - protein, 19 aa, Mycobacterium
RRVCRDCGFYLPLGGALGV

SEQ ID NO: 1294171 - protein, 18 aa, Mycobacterium
RRVDRIRVGDEWKLAART

SEQ ID NO: 1294172 - protein, 20 aa, Mycobacterium
RRVRVAIQFMAFLHTHDATP

SEQ ID NO: 1294173 - protein, 21 aa, Mycobacterium
RRWLPEFAEPAVLREVTGPLS

SEQ ID NO: 1294174 - protein, 18 aa, Mycobacterium
RRYESSIAPGAWESLAAA

SEQ ID NO: 1294175 - protein, 19 aa, Mycobacterium
RRYILDCALRWMRDFHADG

SEQ ID NO: 1294176 - protein, 18 aa, Mycobacterium
RRYLRAGASFVLVGADVT

SEQ ID NO: 1294177 - protein, 19 aa, Mycobacterium
RRYRAQSGFVFQSHNLFPH

SEQ ID NO: 1294178 - protein, 18 aa, Mycobacterium
RSAARWLRRHGVAVLESD

SEQ ID NO: 1294179 - protein, 19 aa, Mycobacterium
RSAAYAMRWVAKNVVAAGL

SEQ ID NO: 1294180 - protein, 18 aa, Mycobacterium
RSAELGRVLARCSYLCDG

SEQ ID NO: 1294181 - protein, 19 aa, Mycobacterium
RSAGFDAVFVDLEHSTITD

SEQ ID NO: 1294182 - protein, 21 aa, Mycobacterium
RSELKRYLLRDGDVLMTEGGD

SEQ ID NO: 1294183 - protein, 18 aa, Mycobacterium
RSGCGLEERLVWQCASLL

SEQ ID NO: 1294184 - protein, 19 aa, Mycobacterium
RSGDSGAMQKHWYSAMEVL

SEQ ID NO: 1294185 - protein, 20 aa, Mycobacterium
RSGLPFGTCLQAVYLHPCGT

SEQ ID NO: 1294186 - protein, 18 aa, Mycobacterium
RSGLSLSDIDLFEVNEAF

SEQ ID NO: 1294187 - protein, 23 aa, Mycobacterium
RSHPEVGVLVFSQWVETRYATEL

SEQ ID NO: 1294188 - protein, 19 aa, Mycobacterium
RSHVFFDWFDAVGVEDLPA

SEQ ID NO: 1294189 - protein, 19 aa, Mycobacterium
RSKFPQRWWWVVLTDEPFP

SEQ ID NO: 1294190 - protein, 19 aa, Mycobacterium
RSKLLYDYFVELFAQVTNP

SEQ ID NO: 1294191 - protein, 17 aa, Mycobacterium
RSLEVQLDQCWDLLRQR

SEQ ID NO: 1294192 - protein, 17 aa, Mycobacterium
RSLRAALSMSVEPDDGL

SEQ ID NO: 1294193 - protein, 17 aa, Mycobacterium
RSLVALCGGGTIQRNEH

SEQ ID NO: 1294194 - protein, 22 aa, Mycobacterium
RSPWPTWRAHPLLSPFLHGHHD

SEQ ID NO: 1294195 - protein, 20 aa, Mycobacterium
RSQLAAAIWNRRSELPAASA

SEQ ID NO: 1294196 - protein, 19 aa, Mycobacterium
RSQMALGYFIHYAGDNAIA

SEQ ID NO: 1294197 - protein, 17 aa, Mycobacterium
RSQWGWKRKAFAAASRP

SEQ ID NO: 1294198 - protein, 19 aa, Mycobacterium
RSRCFPKGLAAFIDLRDQT

SEQ ID NO: 1294199 - protein, 21 aa, Mycobacterium
RSRCFPKGLAAFIDLRDQTCR

SEQ ID NO: 1294200 - protein, 18 aa, Mycobacterium
RSRFAVRAGRWFYVDGDL

SEQ ID NO: 1294201 - protein, 20 aa, Mycobacterium
RSRIPIFVEEALRMDAPVKS

SEQ ID NO: 1294202 - protein, 19 aa, Mycobacterium
RSRLFPVMHDIVLAHQRRG

SEQ ID NO: 1294203 - protein, 17 aa, Mycobacterium
RSRPRWLEVNSPFRPDR

SEQ ID NO: 1294204 - protein, 21 aa, Mycobacterium
RSVLVPPRLVHHLDTHGGRLV

SEQ ID NO: 1294205 - protein, 22 aa, Mycobacterium
RSVTLALRWLVSFSKARREKTM

SEQ ID NO: 1294206 - protein, 18 aa, Mycobacterium
RSVVYRWFTDPTSRSVYP

SEQ ID NO: 1294207 - protein, 17 aa, Mycobacterium
RSYDVMSMIGPQPLRRG

SEQ ID NO: 1294208 - protein, 17 aa, Mycobacterium
RTAGVCALPVWFDATTV

SEQ ID NO: 1294209 - protein, 24 aa, Mycobacterium
RTAPDVWEPLGFPAYLRQECEMSL

SEQ ID NO: 1294210 - protein, 17 aa, Mycobacterium
RTARDWRKGIRHTNNTR

SEQ ID NO: 1294211 - protein, 21 aa, Mycobacterium
RTARNHLRWIAATNGIGATRP

SEQ ID NO: 1294212 - protein, 19 aa, Mycobacterium
RTCAVPGCAATRGLHAHHI

SEQ ID NO: 1294213 - protein, 19 aa, Mycobacterium
RTCVVPGCGATRGLHAHHI

SEQ ID NO: 1294214 - protein, 19 aa, Mycobacterium
RTCVVPGCGATRGLHAHHL

SEQ ID NO: 1294215 - protein, 18 aa, Mycobacterium
RTEFPFTLPRGYVDGNRE

SEQ ID NO: 1294216 - protein, 19 aa, Mycobacterium
RTFARRRIDTILSGVAQGA

SEQ ID NO: 1294217 - protein, 19 aa, Mycobacterium
RTFARRRIDTILSGVEHVD

SEQ ID NO: 1294218 - protein, 19 aa, Mycobacterium
RTGIYGGIRACQWAVADGV

SEQ ID NO: 1294219 - protein, 17 aa, Mycobacterium
RTGLHLFGGPRLHRERY

SEQ ID NO: 1294220 - protein, 24 aa, Mycobacterium
RTLALEHPEFWGGIIDVDETLPPE

SEQ ID NO: 1294221 - protein, 17 aa, Mycobacterium
RTLAWSAAWEMTRDAEL

SEQ ID NO: 1294222 - protein, 18 aa, Mycobacterium
RTLIAIWRGRFDDAGRLA

SEQ ID NO: 1294223 - protein, 21 aa, Mycobacterium
RTLRLDQMIRYYVEHQLDVIV

SEQ ID NO: 1294224 - protein, 19 aa, Mycobacterium
RTLTRLAAVLGYADSSALN

SEQ ID NO: 1294225 - protein, 21 aa, Mycobacterium
RTLWSGMTWQYWLATRRFNKS

SEQ ID NO: 1294226 - protein, 18 aa, Mycobacterium
RTLYRDRLLVLAALDVAS

SEQ ID NO: 1294227 - protein, 17 aa, Mycobacterium
RTMMWLGFADRIANCIA

SEQ ID NO: 1294228 - protein, 18 aa, Mycobacterium
RTMRGYKVERRFGWDTHG

SEQ ID NO: 1294229 - protein, 19 aa, Mycobacterium
RTPTIASVHGWCIGGGVDL

SEQ ID NO: 1294230 - protein, 19 aa, Mycobacterium
RTRAIELLELVGLGHRIDH

SEQ ID NO: 1294231 - protein, 20 aa, Mycobacterium
RTRELLPWGNLRRLLRTAHH

SEQ ID NO: 1294232 - protein, 21 aa, Mycobacterium
RTRLPLPWAQARLLSTIEDQG

SEQ ID NO: 1294233 - protein, 20 aa, Mycobacterium
RTRRAGAVGLVITEPLNYSF

SEQ ID NO: 1294234 - protein, 22 aa, Mycobacterium
RTSAVKTFTAWAVRRGLMTEDP

SEQ ID NO: 1294235 - protein, 19 aa, Mycobacterium
RTSLLATIVRPGLLTDDEP

SEQ ID NO: 1294236 - protein, 20 aa, Mycobacterium
RTTLNLKACIKAAADRVVFI

SEQ ID NO: 1294237 - protein, 18 aa, Mycobacterium
RTVVLRLRFDDFARATRS

SEQ ID NO: 1294238 - protein, 21 aa, Mycobacterium
RTYRGTKEFIFLGLLSLPHNE

SEQ ID NO: 1294239 - protein, 17 aa, Mycobacterium
RVACIRNELVAGRSAAD

SEQ ID NO: 1294240 - protein, 17 aa, Mycobacterium
RVAELLAVVGLRREDAG

SEQ ID NO: 1294241 - protein, 17 aa, Mycobacterium
RVAGFLPDFEAQAVTWE

SEQ ID NO: 1294242 - protein, 17 aa, Mycobacterium
RVAGVWRAPVAVYGVDI

SEQ ID NO: 1294243 - protein, 22 aa, Mycobacterium
RVAPRLARQWLLPVCAETWDGY

SEQ ID NO: 1294244 - protein, 17 aa, Mycobacterium
RVARWMVVFLQRPGGQA

SEQ ID NO: 1294245 - protein, 18 aa, Mycobacterium
RVDECPRETTLEKMAGLK

SEQ ID NO: 1294246 - protein, 19 aa, Mycobacterium
RVEGVHLRFGFVARGGLRW

SEQ ID NO: 1294247 - protein, 20 aa, Mycobacterium
RVFPRPLNWALLTAGRFFLR

SEQ ID NO: 1294248 - protein, 19 aa, Mycobacterium
RVGRPPVIRRAILTLFADR

SEQ ID NO: 1294249 - protein, 17 aa, Mycobacterium
RVHLPGVFVQRVVHTGP

SEQ ID NO: 1294250 - protein, 17 aa, Mycobacterium
RVIESWTPVPGRFPSYL

SEQ ID NO: 1294251 - protein, 23 aa, Mycobacterium
RVKRPQMGIAAWIIPSIVAFGTD

SEQ ID NO: 1294252 - protein, 20 aa, Mycobacterium
RVLADHVIWLAGKQGAASGR

SEQ ID NO: 1294253 - protein, 17 aa, Mycobacterium
RVLGGAIAFGGKSTEPS

SEQ ID NO: 1294254 - protein, 18 aa, Mycobacterium
RVLGLHFFNPVPVLPLVE

SEQ ID NO: 1294255 - protein, 23 aa, Mycobacterium
RVLLRPRYAALVVHQGKVVGPGS

SEQ ID NO: 1294256 - protein, 18 aa, Mycobacterium
RVLPMCPVGLGIEADVVG

SEQ ID NO: 1294257 - protein, 19 aa, Mycobacterium
RVLRPDWTRTPTARRVVAG

SEQ ID NO: 1294258 - protein, 23 aa, Mycobacterium
RVLVHPRPRLSVMCVGGELVDIS

SEQ ID NO: 1294259 - protein, 23 aa, Mycobacterium
RVNLYGVLHCTRAVLPTMIANTW

SEQ ID NO: 1294260 - protein, 18 aa, Mycobacterium
RVPDARIQPIAADDVAAE

SEQ ID NO: 1294261 - protein, 18 aa, Mycobacterium
RVQILWALVSREMSVNDL

SEQ ID NO: 1294262 - protein, 23 aa, Mycobacterium
RVQRGGNMLSVFFTAEPVGDFAT

SEQ ID NO: 1294263 - protein, 18 aa, Mycobacterium
RVQVLWALVDREMSVNEL

SEQ ID NO: 1294264 - protein, 24 aa, Mycobacterium
RVSFGFRSRDRFGFTPPGVTCERA

SEQ ID NO: 1294265 - protein, 24 aa, Mycobacterium
RVSNALDFGCVWINTHIPLVAEMP

SEQ ID NO: 1294266 - protein, 18 aa, Mycobacterium
RVSRVRWVGGYGRMDSTS

SEQ ID NO: 1294267 - protein, 18 aa, Mycobacterium
RVSYAFGIGHRAEEYRHF

SEQ ID NO: 1294268 - protein, 17 aa, Mycobacterium
RVSYYFDLRGPSVTVDT

SEQ ID NO: 1294269 - protein, 17 aa, Mycobacterium
RVVVMAHGFGGTKDSGL

SEQ ID NO: 1294270 - protein, 23 aa, Mycobacterium
RVYRAAGVLHLDWWYDNRRLGPT

SEQ ID NO: 1294271 - protein, 19 aa, Mycobacterium
RWCRECLRAYTVQGTAGSG

SEQ ID NO: 1294272 - protein, 20 aa, Mycobacterium
RWGFPHLPSFEELYCGSYGQ

SEQ ID NO: 1294273 - protein, 17 aa, Mycobacterium
RWGTVIVGLDWDTTVLD

SEQ ID NO: 1294274 - protein, 24 aa, Mycobacterium
RWHLRAADWLRMRDLLAARNQWEI

SEQ ID NO: 1294275 - protein, 18 aa, Mycobacterium
RWHRARVIGGFEPEDYKQ

SEQ ID NO: 1294276 - protein, 18 aa, Mycobacterium
RWIRLRLSRGLGLEAGGG

SEQ ID NO: 1294277 - protein, 19 aa, Mycobacterium
RWKETAFQFAWLLDAAKAG

SEQ ID NO: 1294278 - protein, 19 aa, Mycobacterium
RWLEHRRILALNLTSSPGS

SEQ ID NO: 1294279 - protein, 20 aa, Mycobacterium
RWLQLPARLVLSALIGRVRI

SEQ ID NO: 1294280 - protein, 21 aa, Mycobacterium
RWPEGWEVLELNPAQVAEQRR

SEQ ID NO: 1294281 - protein, 17 aa, Mycobacterium
RWQEHQILWGPPNPTAD

SEQ ID NO: 1294282 - protein, 19 aa, Mycobacterium
RWTWLNSFGYWFWGGFVRS

SEQ ID NO: 1294283 - protein, 17 aa, Mycobacterium
RWVFPYAGADSHDTYAI

SEQ ID NO: 1294284 - protein, 20 aa, Mycobacterium
RWVTVAFTWTGLRALGVPPH

SEQ ID NO: 1294285 - protein, 24 aa, Mycobacterium
RYDCRSTRRLRDWLMARAIECGVP

SEQ ID NO: 1294286 - protein, 17 aa, Mycobacterium
RYDLAVQEIFVFTPKGD

SEQ ID NO: 1294287 - protein, 23 aa, Mycobacterium
RYDWPVRTGIIIGRLDADGSRFL

SEQ ID NO: 1294288 - protein, 23 aa, Mycobacterium
RYDYTVLAARGWALRPLSVSATA

SEQ ID NO: 1294289 - protein, 19 aa, Mycobacterium
RYGHFCFRTADGVLERLPH

SEQ ID NO: 1294290 - protein, 18 aa, Mycobacterium
RYGIPILVVYGATEFSGA

SEQ ID NO: 1294291 - protein, 24 aa, Mycobacterium
RYGLDMWLRVGATWLSAVAALAAL

SEQ ID NO: 1294292 - protein, 19 aa, Mycobacterium
RYGLVGVHCDVWEGFIFVN

SEQ ID NO: 1294293 - protein, 18 aa, Mycobacterium
RYGLVPVHCDVWEGFIFV

SEQ ID NO: 1294294 - protein, 17 aa, Mycobacterium
RYGPLCMVEGARLDDAF

SEQ ID NO: 1294295 - protein, 20 aa, Mycobacterium
RYKYLPTFILRGLTRLHIEF

SEQ ID NO: 1294296 - protein, 18 aa, Mycobacterium
RYLEYTLRWRNVPKPSIA

SEQ ID NO: 1294297 - protein, 18 aa, Mycobacterium
RYLHSWEAARPCPPPSTV

SEQ ID NO: 1294298 - protein, 19 aa, Mycobacterium
RYLPGVAFVTSFDLELEMA

SEQ ID NO: 1294299 - protein, 19 aa, Mycobacterium
RYQRFAAFWRSRPVNWVWD

SEQ ID NO: 1294300 - protein, 20 aa, Mycobacterium
RYRIDGASMPTEWATGQLAT

SEQ ID NO: 1294301 - protein, 20 aa, Mycobacterium
RYRRVCAAVDELHRLAAETR

SEQ ID NO: 1294302 - protein, 22 aa, Mycobacterium
RYRRVESFRQLWAVSVDVSRAA

SEQ ID NO: 1294303 - protein, 18 aa, Mycobacterium
RYRSIDGLAWAPADATAP

SEQ ID NO: 1294304 - protein, 18 aa, Mycobacterium
RYRVGTVMRSRWDRASAA

SEQ ID NO: 1294305 - protein, 23 aa, Mycobacterium
RYVAKYTICPAVAHGLDGEIGSV

SEQ ID NO: 1294306 - protein, 18 aa, Mycobacterium
RYVCGGVMLTFDEMIDAL

SEQ ID NO: 1294307 - protein, 19 aa, Mycobacterium
RYVVLPFWLVCDVSASMGP

SEQ ID NO: 1294308 - protein, 17 aa, Mycobacterium
SAAPNFAFELSVRRTSD

SEQ ID NO: 1294309 - protein, 18 aa, Mycobacterium
SAASWTRSSTLAFASLSS

SEQ ID NO: 1294310 - protein, 17 aa, Mycobacterium
SAATCFPNISFVHNWPK

SEQ ID NO: 1294311 - protein, 20 aa, Mycobacterium
SAAVKSVMNWVKLHPTNISQ

SEQ ID NO: 1294312 - protein, 18 aa, Mycobacterium
SACALVFGPGEAERVVVR

SEQ ID NO: 1294313 - protein, 21 aa, Mycobacterium
SAEARSALMLSATRDLPALGA

SEQ ID NO: 1294314 - protein, 19 aa, Mycobacterium
SAFLSWRVWVPRGPEHFEL

SEQ ID NO: 1294315 - protein, 17 aa, Mycobacterium
SAGMLAVFNDHYAVALS

SEQ ID NO: 1294316 - protein, 20 aa, Mycobacterium
SAKGFRCVLPDWPLGSHRIP

SEQ ID NO: 1294317 - protein, 20 aa, Mycobacterium
SAKGFRCVLPDWPLGSHRTP

SEQ ID NO: 1294318 - protein, 18 aa, Mycobacterium
SAMAKARFVRISATKARR

SEQ ID NO: 1294319 - protein, 19 aa, Mycobacterium
SAMRVCGGAAFSKHLPIER

SEQ ID NO: 1294320 - protein, 18 aa, Mycobacterium
SAPRAAQLEACFEELSEL

SEQ ID NO: 1294321 - protein, 20 aa, Mycobacterium
SAPRAARLEACFEELAELTG

SEQ ID NO: 1294322 - protein, 18 aa, Mycobacterium
SAPRLVRMVQAYRDAERL

SEQ ID NO: 1294323 - protein, 19 aa, Mycobacterium
SARFCTQFIKLGLGGCDIG

SEQ ID NO: 1294324 - protein, 21 aa, Mycobacterium
SASEAMLWRRPRWSVRLQTGP

SEQ ID NO: 1294325 - protein, 19 aa, Mycobacterium
SATGARPPVAFAPDDTGYG

SEQ ID NO: 1294326 - protein, 18 aa, Mycobacterium
SAYIASWHAAPLLTAQQR

SEQ ID NO: 1294327 - protein, 17 aa, Mycobacterium
SCFLVHHRSRLASEKNG

SEQ ID NO: 1294328 - protein, 17 aa, Mycobacterium
SCYWDYAPSFGRGPFRN

SEQ ID NO: 1294329 - protein, 21 aa, Mycobacterium
SDFSLWLLRVSRVRWVGGYGR

SEQ ID NO: 1294330 - protein, 19 aa, Mycobacterium
SDFYLGAAFEGPPGHVHGG

SEQ ID NO: 1294331 - protein, 17 aa, Mycobacterium
SDGWPLYATVMGDGPAL

SEQ ID NO: 1294332 - protein, 19 aa, Mycobacterium
SDIALRFLVTMLCAPGQPM

SEQ ID NO: 1294333 - protein, 17 aa, Mycobacterium
SDILPISVGFPFGVSAV

SEQ ID NO: 1294334 - protein, 17 aa, Mycobacterium
SDLDWWVGFSSIVSLLG

SEQ ID NO: 1294335 - protein, 17 aa, Mycobacterium
SDLPSHVRFVGPVSPLP

SEQ ID NO: 1294336 - protein, 18 aa, Mycobacterium
SDLVPLCHPLAITGVDID

SEQ ID NO: 1294337 - protein, 18 aa, Mycobacterium
SDMKGLWGFVPACSTPDA

SEQ ID NO: 1294338 - protein, 23 aa, Mycobacterium
SDPSGPCLEGWVTLTALAQATTR

SEQ ID NO: 1294339 - protein, 21 aa, Mycobacterium
SDTRIPAVFSGPVGLTAISNP

SEQ ID NO: 1294340 - protein, 21 aa, Mycobacterium
SDWTEDVFRAFSFSTDVATVQ

SEQ ID NO: 1294341 - protein, 18 aa, Mycobacterium
SEAFRAILVAYRRQAIDA

SEQ ID NO: 1294342 - protein, 23 aa, Mycobacterium
SEEQRTRWLPGMAAGELIGCFGL

SEQ ID NO: 1294343 - protein, 21 aa, Mycobacterium
SEGWWPFLVGLAMGDAGGYKS

SEQ ID NO: 1294344 - protein, 21 aa, Mycobacterium
SEGWWPMLVGISMKDAGGYRS

SEQ ID NO: 1294345 - protein, 21 aa, Mycobacterium
SEGWWPMLVGMSMGDAGGYES

SEQ ID NO: 1294346 - protein, 28 aa, Mycobacterium
SEIELPFATIPLRDEWRGVVEDGKLYIA

SEQ ID NO: 1294347 - protein, 19 aa, Mycobacterium
SEKRLKRWASRRYPVSILD

SEQ ID NO: 1294348 - protein, 24 aa, Mycobacterium
SELGFEYVDLFLIHWPLPTLYDGD

SEQ ID NO: 1294349 - protein, 17 aa, Mycobacterium
SELRAALVSARREAASA

SEQ ID NO: 1294350 - protein, 21 aa, Mycobacterium
SEMPMRVIGMLVGMPDSLQRS

SEQ ID NO: 1294351 - protein, 19 aa, Mycobacterium
SENGWKTFFRGLANDGVQG

SEQ ID NO: 1294352 - protein, 20 aa, Mycobacterium
SEPRFDPKVWARLGSELGVL

SEQ ID NO: 1294353 - protein, 24 aa, Mycobacterium
SEQRLRIGEAWGRLPHEWVEQYEA

SEQ ID NO: 1294354 - protein, 23 aa, Mycobacterium
SERRIALALARMVPGAREVRIGA

SEQ ID NO: 1294355 - protein, 18 aa, Mycobacterium
SESWPAPVPARMLPRYAQ

SEQ ID NO: 1294356 - protein, 17 aa, Mycobacterium
SESYDCITILAATLNLA

SEQ ID NO: 1294357 - protein, 18 aa, Mycobacterium
SETLYSWAVCEPTTGELL

SEQ ID NO: 1294358 - protein, 20 aa, Mycobacterium
SEVWNRISPMVAEILVTGAI

SEQ ID NO: 1294359 - protein, 23 aa, Mycobacterium
SEYIYRFAPLVGIYGGTLEVFRN

SEQ ID NO: 1294360 - protein, 22 aa, Mycobacterium
SFARRELDNLFAARSTTNAPRT

SEQ ID NO: 1294361 - protein, 22 aa, Mycobacterium
SFLPELLRWVPFTKGDYWVLKI

SEQ ID NO: 1294362 - protein, 18 aa, Mycobacterium
SFQLFPNFVMLFWGQGWY

SEQ ID NO: 1294363 - protein, 18 aa, Mycobacterium
SFQLFPNFVVLFWGQGWY

SEQ ID NO: 1294364 - protein, 17 aa, Mycobacterium
SFRCPYHGWTFNNTGAL

SEQ ID NO: 1294365 - protein, 25 aa, Mycobacterium
SFRRYRWVLPMARLIGNAARMSADQ

SEQ ID NO: 1294366 - protein, 24 aa, Mycobacterium
SFSRYELLRLLAFSRSGALPITKA

SEQ ID NO: 1294367 - protein, 19 aa, Mycobacterium
SFSSGRDWGSPAIPERMDL

SEQ ID NO: 1294368 - protein, 20 aa, Mycobacterium
SFTWLDDRVVEWTPAQPLPA

SEQ ID NO: 1294369 - protein, 19 aa, Mycobacterium
SFVALDWALCLASGTPWQG

SEQ ID NO: 1294370 - protein, 20 aa, Mycobacterium
SFYYRTRVALLQGVADHLAR

SEQ ID NO: 1294371 - protein, 18 aa, Mycobacterium
SGAFLAKLGCTFAVVGHS

SEQ ID NO: 1294372 - protein, 17 aa, Mycobacterium
SGAWQWSSGCDHATWAF

SEQ ID NO: 1294373 - protein, 25 aa, Mycobacterium
SGCRFAPRCAFQFDRCDQPPPLDHD

SEQ ID NO: 1294374 - protein, 19 aa, Mycobacterium
SGCRMGICFSCTRRKTSGA

SEQ ID NO: 1294375 - protein, 17 aa, Mycobacterium
SGCWPAMKIVADVADGV

SEQ ID NO: 1294376 - protein, 21 aa, Mycobacterium
SGEVRARWVINAAGLGADHLD

SEQ ID NO: 1294377 - protein, 26 aa, Mycobacterium
SGFERFPAWMWRNTVVRDFVDWLHAR

SEQ ID NO: 1294378 - protein, 17 aa, Mycobacterium
SGGRFILGLGMTHAAVT

SEQ ID NO: 1294379 - protein, 23 aa, Mycobacterium
SGGRVSLGVGFGWNTDELADHNV

SEQ ID NO: 1294380 - protein, 18 aa, Mycobacterium
SGGSFVRRPAGPPVDKLT

SEQ ID NO: 1294381 - protein, 19 aa, Mycobacterium
SGLIKWAFLQNGKSLPRSS

SEQ ID NO: 1294382 - protein, 25 aa, Mycobacterium
SGLVPRIAVVKGRCFAGNAVIAGCA

SEQ ID NO: 1294383 - protein, 24 aa, Mycobacterium
SGPGIAWPEGWSVWKSRRYGDTRL

SEQ ID NO: 1294384 - protein, 17 aa, Mycobacterium
SGPMPKWYAPVGSLFDQ

SEQ ID NO: 1294385 - protein, 22 aa, Mycobacterium
SGRGRIAICGARATTSFPNRRV

SEQ ID NO: 1294386 - protein, 25 aa, Mycobacterium
SGRIERFLLLWAEGSMTIAMPSTPA

SEQ ID NO: 1294387 - protein, 18 aa, Mycobacterium
SGVSYRPGARFGPTHVRE

SEQ ID NO: 1294388 - protein, 19 aa, Mycobacterium
SGVVPRIAIVKGRCFAGNA

SEQ ID NO: 1294389 - protein, 18 aa, Mycobacterium
SGWPCRRHLDGSVVSVEV

SEQ ID NO: 1294390 - protein, 21 aa, Mycobacterium
SGYFGGLWLRDSLRDNATGAD

SEQ ID NO: 1294391 - protein, 21 aa, Mycobacterium
SGYLCVPLAGDICDRLGLLPM

SEQ ID NO: 1294392 - protein, 19 aa, Mycobacterium
SHHWPTWGKDRIVEFLSLQ

SEQ ID NO: 1294393 - protein, 17 aa, Mycobacterium
SISLPRIRDFRGLSGKQ

SEQ ID NO: 1294394 - protein, 18 aa, Mycobacterium
SKGLDLSPIFAVPSNAHT

SEQ ID NO: 1294395 - protein, 18 aa, Mycobacterium
SKHIRLLAAFDHRHIFID

SEQ ID NO: 1294396 - protein, 22 aa, Mycobacterium
SKLARPTSTWTYMVHDNPLADD

SEQ ID NO: 1294397 - protein, 17 aa, Mycobacterium
SKLPVPIHVGGGYGGDS

SEQ ID NO: 1294398 - protein, 17 aa, Mycobacterium
SKVELYLAVLQRHVDNL

SEQ ID NO: 1294399 - protein, 17 aa, Mycobacterium
SKVPLPLVRKALSLLPA

SEQ ID NO: 1294400 - protein, 20 aa, Mycobacterium
SLADARAWIEYGLKRTFVFR

SEQ ID NO: 1294401 - protein, 24 aa, Mycobacterium
SLAQWLRRWDIRGGSASPEAVELF

SEQ ID NO: 1294402 - protein, 18 aa, Mycobacterium
SLDLPGGMGQHFFFDAGN

SEQ ID NO: 1294403 - protein, 26 aa, Mycobacterium
SLEDWKNWLRWRVIHARAFLLTDELI

SEQ ID NO: 1294404 - protein, 23 aa, Mycobacterium
SLELGPWLINWIPFGYLISDQIY

SEQ ID NO: 1294405 - protein, 24 aa, Mycobacterium
SLELPKRRLTVFTGVSGSGKSSLV

SEQ ID NO: 1294406 - protein, 17 aa, Mycobacterium
SLFNGIRIGAIDAAATG

SEQ ID NO: 1294407 - protein, 18 aa, Mycobacterium
SLGLGEWVVPTLLQHGSA

SEQ ID NO: 1294408 - protein, 18 aa, Mycobacterium
SLHFAMGLARGYSLAVVE

SEQ ID NO: 1294409 - protein, 17 aa, Mycobacterium
SLIPGFVEEALRFESPI

SEQ ID NO: 1294410 - protein, 19 aa, Mycobacterium
SLKVPRRLKELNVRLNSAR

SEQ ID NO: 1294411 - protein, 23 aa, Mycobacterium
SLLRFCLEHGYQLRVIEQMPLDA

SEQ ID NO: 1294412 - protein, 17 aa, Mycobacterium
SLLVSHVLVPPAIAAIM

SEQ ID NO: 1294413 - protein, 21 aa, Mycobacterium
SLPEKYRTAIYYADIEGRKFR

SEQ ID NO: 1294414 - protein, 19 aa, Mycobacterium
SLPRIRSWGSPYRLPQRLS

SEQ ID NO: 1294415 - protein, 22 aa, Mycobacterium
SLQEVFGALAIQSVLGIADRTQ

SEQ ID NO: 1294416 - protein, 19 aa, Mycobacterium
SLRGPRGGLVLATEEYAPA

SEQ ID NO: 1294417 - protein, 18 aa, Mycobacterium
SLRTGKVFVDWSQNNANK

SEQ ID NO: 1294418 - protein, 17 aa, Mycobacterium
SLVGDRPDHEWAGDARI

SEQ ID NO: 1294419 - protein, 19 aa, Mycobacterium
SLVKFHWKPVAGVHSLVWE

SEQ ID NO: 1294420 - protein, 25 aa, Mycobacterium
SLYHFAWDEFCDWYLELAKVQLGQE

SEQ ID NO: 1294421 - protein, 25 aa, Mycobacterium
SMARRLRLNSRMGLLADDARVVDTL

SEQ ID NO: 1294422 - protein, 19 aa, Mycobacterium
SMIDAAICDGDWVVVRQQS

SEQ ID NO: 1294423 - protein, 17 aa, Mycobacterium
SMITDGLAMRHGKDLTW

SEQ ID NO: 1294424 - protein, 23 aa, Mycobacterium
SMPKSVVINPFFDWGVDRPPNHE

SEQ ID NO: 1294425 - protein, 22 aa, Mycobacterium
SMQAQCCVAVLRRGARPAPNGS

SEQ ID NO: 1294426 - protein, 17 aa, Mycobacterium
SMRPGDVAFTFTDYAVD

SEQ ID NO: 1294427 - protein, 21 aa, Mycobacterium
SNALCAAAVALECGATPEQVA

SEQ ID NO: 1294428 - protein, 19 aa, Mycobacterium
SNALLGYAYGRRFEYAEQM

SEQ ID NO: 1294429 - protein, 19 aa, Mycobacterium
SNALLGYAYGRRLEYSEVM

SEQ ID NO: 1294430 - protein, 18 aa, Mycobacterium
SNITRLPVRYTFDNRYFN

SEQ ID NO: 1294431 - protein, 21 aa, Mycobacterium
SNLKLGSGIAPWRKLRDAGVN

SEQ ID NO: 1294432 - protein, 24 aa, Mycobacterium
SNMADCHPILYLRMADRLKAGAKL

SEQ ID NO: 1294433 - protein, 24 aa, Mycobacterium
SNQSVRWLTRWPVVPEIRHGSLGF

SEQ ID NO: 1294434 - protein, 20 aa, Mycobacterium
SNTYFDWVLDRVFVFTPAQA

SEQ ID NO: 1294435 - protein, 19 aa, Mycobacterium
SNVQVVWEKFCRYFDVEAR

SEQ ID NO: 1294436 - protein, 17 aa, Mycobacterium
SPADYIYAYGFRNPFRL

SEQ ID NO: 1294437 - protein, 19 aa, Mycobacterium
SPADYIYAYGFRNPFRLTF

SEQ ID NO: 1294438 - protein, 24 aa, Mycobacterium
SPDFPGERVLGMGFDRDVLIRAGI

SEQ ID NO: 1294439 - protein, 20 aa, Mycobacterium
SPEARLGLISAIRSAGLSCH

SEQ ID NO: 1294440 - protein, 18 aa, Mycobacterium
SPEQVRWVLEDSGAVLAF

SEQ ID NO: 1294441 - protein, 25 aa, Mycobacterium
SPGEYRFAAAYGRRGRIVGAVTFNH

SEQ ID NO: 1294442 - protein, 20 aa, Mycobacterium
SPLTRCVSWAVDSLREDGTL

SEQ ID NO: 1294443 - protein, 24 aa, Mycobacterium
SPRLRPGTPVSFPVAWSDLDRVRP

SEQ ID NO: 1294444 - protein, 24 aa, Mycobacterium
SQAARPVMFSTFLMWVLADLFTTL

SEQ ID NO: 1294445 - protein, 18 aa, Mycobacterium
SQAIRVAREFARNAEESG

SEQ ID NO: 1294446 - protein, 17 aa, Mycobacterium
SQANFAYYARRALANHP

SEQ ID NO: 1294447 - protein, 18 aa, Mycobacterium
SQANFVWLPLVGRAQQFA

SEQ ID NO: 1294448 - protein, 21 aa, Mycobacterium
SQARTGVFWVREMLPTPKIRE

SEQ ID NO: 1294449 - protein, 18 aa, Mycobacterium
SQCWAEWFEQLAAAFEAL

SEQ ID NO: 1294450 - protein, 22 aa, Mycobacterium
SQELRIAQMLGRGATTKEAAAA

SEQ ID NO: 1294451 - protein, 20 aa, Mycobacterium
SQPPPGWRVIGTVGASDGTT

SEQ ID NO: 1294452 - protein, 21 aa, Mycobacterium
SRAFRLPWPAGTTVFEIDQPL

SEQ ID NO: 1294453 - protein, 17 aa, Mycobacterium
SRAMIWRRPRWAVRLQP

SEQ ID NO: 1294454 - protein, 17 aa, Mycobacterium
SRARTKLAASLDCFTAT

SEQ ID NO: 1294455 - protein, 20 aa, Mycobacterium
SREVRWRPAEYWKPGTKVEV

SEQ ID NO: 1294456 - protein, 17 aa, Mycobacterium
SRFLSDWAHDGKPGLVI

SEQ ID NO: 1294457 - protein, 20 aa, Mycobacterium
SRGAAAIGAWARMENAAAAR

SEQ ID NO: 1294458 - protein, 20 aa, Mycobacterium
SRGASSWGLRVTEHKYLFSG

SEQ ID NO: 1294459 - protein, 20 aa, Mycobacterium
SRIAGPAIRRGWLDDGPGPS

SEQ ID NO: 1294460 - protein, 19 aa, Mycobacterium
SRIDAGLFTGTRFEGHLTE

SEQ ID NO: 1294461 - protein, 17 aa, Mycobacterium
SRIGGVRVVARIPRVSE

SEQ ID NO: 1294462 - protein, 19 aa, Mycobacterium
SRLASALALTGVDVGQRVA

SEQ ID NO: 1294463 - protein, 18 aa, Mycobacterium
SRLPRYGRRPQDQLIIPG

SEQ ID NO: 1294464 - protein, 23 aa, Mycobacterium
SRLPWERIEPLAGLVEEIDGKVD

SEQ ID NO: 1294465 - protein, 17 aa, Mycobacterium
SRLRLLLVDTWLDPVRT

SEQ ID NO: 1294466 - protein, 21 aa, Mycobacterium
SRLRLWLLDCGFPRPQTQIPV

SEQ ID NO: 1294467 - protein, 20 aa, Mycobacterium
SRLWRMLLAPGRGIGRLVTG

SEQ ID NO: 1294468 - protein, 19 aa, Mycobacterium
SRNSIEFGELVAATQLSGI

SEQ ID NO: 1294469 - protein, 17 aa, Mycobacterium
SRPCPECGFDASAVHHS

SEQ ID NO: 1294470 - protein, 20 aa, Mycobacterium
SRRKHIEAGYEFVNTPHITK

SEQ ID NO: 1294471 - protein, 23 aa, Mycobacterium
SRRWSAARAHAWYQQQGWLVGAN

SEQ ID NO: 1294472 - protein, 18 aa, Mycobacterium
SRRYLGLDVLSKSRADQN

SEQ ID NO: 1294473 - protein, 18 aa, Mycobacterium
SRRYLGLDVLSKSRAVND

SEQ ID NO: 1294474 - protein, 21 aa, Mycobacterium
SRSSPRAGDGFIRLDEAGVVT

SEQ ID NO: 1294475 - protein, 27 aa, Mycobacterium
SRVAVLLPAHWQTAAVLFGIWWIGAEA

SEQ ID NO: 1294476 - protein, 23 aa, Mycobacterium
SSGEARSALMLSWIRDVPALGAA

SEQ ID NO: 1294477 - protein, 23 aa, Mycobacterium
SSGIGVLRWLPAVPEALADDPQW

SEQ ID NO: 1294478 - protein, 18 aa, Mycobacterium
SSLTWKALLPHLATRYRV

SEQ ID NO: 1294479 - protein, 21 aa, Mycobacterium
SSMPICIWHMTQLAGHSARAA

SEQ ID NO: 1294480 - protein, 18 aa, Mycobacterium
SSRELLCELIWSPPGQPA

SEQ ID NO: 1294481 - protein, 20 aa, Mycobacterium
SSRRELAATMVLRLAIGDDN

SEQ ID NO: 1294482 - protein, 18 aa, Mycobacterium
SSTRYEWILADLAIMCAG

SEQ ID NO: 1294483 - protein, 17 aa, Mycobacterium
SSWFKLHHPAAFCAALL

SEQ ID NO: 1294484 - protein, 17 aa, Mycobacterium
STAWACGLMAVHAHTVA

SEQ ID NO: 1294485 - protein, 18 aa, Mycobacterium
STCAPWLDAEWRLTAGHV

SEQ ID NO: 1294486 - protein, 25 aa, Mycobacterium
STDHRPEILLSFGFVPKVENRVGLI

SEQ ID NO: 1294487 - protein, 18 aa, Mycobacterium
STEEVRFLMGFNREVVRR

SEQ ID NO: 1294488 - protein, 18 aa, Mycobacterium
STELYAWLDGNEDVAFLP

SEQ ID NO: 1294489 - protein, 20 aa, Mycobacterium
STFRYAAPAGRDWAPEDLAG

SEQ ID NO: 1294490 - protein, 17 aa, Mycobacterium
STGRCYLEWVDPAVGAT

SEQ ID NO: 1294491 - protein, 22 aa, Mycobacterium
STLLLTLLFRFMKPLVENGHIF

SEQ ID NO: 1294492 - protein, 17 aa, Mycobacterium
STLLRCLVRLAEPTSGT

SEQ ID NO: 1294493 - protein, 18 aa, Mycobacterium
STLLRLAGRYGVGEHEVD

SEQ ID NO: 1294494 - protein, 24 aa, Mycobacterium
STLQSGPEFGRWLAERGPAQVPET

SEQ ID NO: 1294495 - protein, 18 aa, Mycobacterium
STPVKEFMRTAAADTEVR

SEQ ID NO: 1294496 - protein, 17 aa, Mycobacterium
STPVKEFMRTAAEDTTV

SEQ ID NO: 1294497 - protein, 23 aa, Mycobacterium
STVTRLQIGYSFRNGPQARSESG

SEQ ID NO: 1294498 - protein, 25 aa, Mycobacterium
SVAAEWEFFPGVFSKDGPIDALFVQ

SEQ ID NO: 1294499 - protein, 18 aa, Mycobacterium
SVEPFPLPAEAGIEPDPR

SEQ ID NO: 1294500 - protein, 19 aa, Mycobacterium
SVFHCPFCHGWEVRDRPLA

SEQ ID NO: 1294501 - protein, 23 aa, Mycobacterium
SVGIPMRCVFALTAMGFLPQSPD

SEQ ID NO: 1294502 - protein, 18 aa, Mycobacterium
SVGRLAYLLGEVGGNIPI

SEQ ID NO: 1294503 - protein, 17 aa, Mycobacterium
SVIRPGRDAHRIVAMAD

SEQ ID NO: 1294504 - protein, 19 aa, Mycobacterium
SVKDLRTWHGTVLAAAAFA

SEQ ID NO: 1294505 - protein, 20 aa, Mycobacterium
SVKWQLVRRLVTFVEFSRGA

SEQ ID NO: 1294506 - protein, 21 aa, Mycobacterium
SVLDTGIDFSKTVNSFQGVTE

SEQ ID NO: 1294507 - protein, 21 aa, Mycobacterium
SVNDLTKWLAMVLADGKAGGQ

SEQ ID NO: 1294508 - protein, 17 aa, Mycobacterium
SVPGLRRHPKIAVVTVA

SEQ ID NO: 1294509 - protein, 22 aa, Mycobacterium
SVPKPRVEQAFAMVDDADVLLV

SEQ ID NO: 1294510 - protein, 19 aa, Mycobacterium
SVPTAWLFGPEAHGLPADV

SEQ ID NO: 1294511 - protein, 21 aa, Mycobacterium
SVQFRRLHGGIAFGHTTVALP

SEQ ID NO: 1294512 - protein, 26 aa, Mycobacterium
SVSHFDWLVGCGVPFKAEFFGEPGWE

SEQ ID NO: 1294513 - protein, 21 aa, Mycobacterium
SVTSLFAFGGRCGLICDGADG

SEQ ID NO: 1294514 - protein, 18 aa, Mycobacterium
SWEGFAWFVWQLCEMTAT

SEQ ID NO: 1294515 - protein, 17 aa, Mycobacterium
SWLALQCAAVELRADNA

SEQ ID NO: 1294516 - protein, 17 aa, Mycobacterium
SWLPLYHDMGLAFLLTN

SEQ ID NO: 1294517 - protein, 24 aa, Mycobacterium
SWMFVGWCRLREGIRGFHLDRIRH

SEQ ID NO: 1294518 - protein, 21 aa, Mycobacterium
SWRGADLLALHVCKDADAPAS

SEQ ID NO: 1294519 - protein, 21 aa, Mycobacterium
SWTEPKGGYFISLDVLPGTAK

SEQ ID NO: 1294520 - protein, 18 aa, Mycobacterium
SWTRRWFAVAPWVALLRR

SEQ ID NO: 1294521 - protein, 24 aa, Mycobacterium
SYAPKLPWPWGLLDFAARVLKPAP

SEQ ID NO: 1294522 - protein, 22 aa, Mycobacterium
SYKSCFLAMVRRFYEKGMTELN

SEQ ID NO: 1294523 - protein, 19 aa, Mycobacterium
SYPLTGVACVSRIYTDHAV

SEQ ID NO: 1294524 - protein, 24 aa, Mycobacterium
SYREARIALGIARRLGHTGAVSYQ

SEQ ID NO: 1294525 - protein, 24 aa, Mycobacterium
TAAALRAGAAWLRTMFAILPLAVG

SEQ ID NO: 1294526 - protein, 18 aa, Mycobacterium
TACAVAFGSAFAATARHA

SEQ ID NO: 1294527 - protein, 23 aa, Mycobacterium
TACNGGRGGLLWGNGGDGANGGV

SEQ ID NO: 1294528 - protein, 24 aa, Mycobacterium
TAEGLRLGHRVDWPVGDRNRTIAD

SEQ ID NO: 1294529 - protein, 19 aa, Mycobacterium
TAEGPMLLDCLEFDDRLRY

SEQ ID NO: 1294530 - protein, 19 aa, Mycobacterium
TAFDASRPVFGFAPYPGVQ

SEQ ID NO: 1294531 - protein, 18 aa, Mycobacterium
TAFNFPVAVWSWNTAVAL

SEQ ID NO: 1294532 - protein, 24 aa, Mycobacterium
TAHFCSMCGPKFCSMRISHEVQEA

SEQ ID NO: 1294533 - protein, 18 aa, Mycobacterium
TAIAARFTSPVFPGDTLT

SEQ ID NO: 1294534 - protein, 24 aa, Mycobacterium
TALPEVRSQLALTWGTETFIVPHI

SEQ ID NO: 1294535 - protein, 23 aa, Mycobacterium
TAMMIRPQWRFRRGRAAAGGPGG

SEQ ID NO: 1294536 - protein, 18 aa, Mycobacterium
TAPAGWAVGEGMAVAMIA

SEQ ID NO: 1294537 - protein, 20 aa, Mycobacterium
TARAEWWYSRAATVMGGTAE

SEQ ID NO: 1294538 - protein, 19 aa, Mycobacterium
TARDRFGGVGAIVLTIPIA

SEQ ID NO: 1294539 - protein, 18 aa, Mycobacterium
TARLGAAGAQVWIADRQF

SEQ ID NO: 1294540 - protein, 18 aa, Mycobacterium
TARSWAWLSGRGYVTPDD

SEQ ID NO: 1294541 - protein, 22 aa, Mycobacterium
TARTELMASFGIPADIGAAIAE

SEQ ID NO: 1294542 - protein, 19 aa, Mycobacterium
TAWCARLNVLATDMRVEQR

SEQ ID NO: 1294543 - protein, 21 aa, Mycobacterium
TAWPPWRPGVLFTGDSLGAGK

SEQ ID NO: 1294544 - protein, 18 aa, Mycobacterium
TCAVPGCAATRGLHAHHI

SEQ ID NO: 1294545 - protein, 17 aa, Mycobacterium
TCDSCVALAPNGPGNMD

SEQ ID NO: 1294546 - protein, 18 aa, Mycobacterium
TCHYCTFVTVPGRLRAEG

SEQ ID NO: 1294547 - protein, 20 aa, Mycobacterium
TDACRRRVRVAIQFMAFLHT

SEQ ID NO: 1294548 - protein, 17 aa, Mycobacterium
TDCRVFRVAGLRVADAS

SEQ ID NO: 1294549 - protein, 20 aa, Mycobacterium
TDELRFLVHWSAEVFSDYDE

SEQ ID NO: 1294550 - protein, 17 aa, Mycobacterium
TDFRLWVCLHEVTHRVQ

SEQ ID NO: 1294551 - protein, 19 aa, Mycobacterium
TDFRSWARVELELEPGRTV

SEQ ID NO: 1294552 - protein, 19 aa, Mycobacterium
TDGGWSLSGTKVWTSGAHR

SEQ ID NO: 1294553 - protein, 17 aa, Mycobacterium
TDHCDWIFLGAMIGDAE

SEQ ID NO: 1294554 - protein, 19 aa, Mycobacterium
TDHLMRFPGKFSEQLLADH

SEQ ID NO: 1294555 - protein, 20 aa, Mycobacterium
TDIGRWVYTSGFRKLVIVNA

SEQ ID NO: 1294556 - protein, 18 aa, Mycobacterium
TDIPLPWVRNEVTVLNLT

SEQ ID NO: 1294557 - protein, 22 aa, Mycobacterium
TDISWSRITYWRALLASAIDDP

SEQ ID NO: 1294558 - protein, 17 aa, Mycobacterium
TDLERLHGLEAFVDDPA

SEQ ID NO: 1294559 - protein, 22 aa, Mycobacterium
TDLPEGRWSEFLSEPRIAERVA

SEQ ID NO: 1294560 - protein, 21 aa, Mycobacterium
TDLRGRITAVLADGERMDAEL

SEQ ID NO: 1294561 - protein, 24 aa, Mycobacterium
TDPPVEGAFYWLSNQEVRWRPAEY

SEQ ID NO: 1294562 - protein, 24 aa, Mycobacterium
TDRRPRIALLDGLPMAGHIALSER

SEQ ID NO: 1294563 - protein, 18 aa, Mycobacterium
TDVGIGIIRTMLRHAPKG

SEQ ID NO: 1294564 - protein, 19 aa, Mycobacterium
TEAAARAFGSWRDALNTVL

SEQ ID NO: 1294565 - protein, 22 aa, Mycobacterium
TEDFRSSWLCRYLEDAHNAGED

SEQ ID NO: 1294566 - protein, 17 aa, Mycobacterium
TEFEPGRRWSWQVAGIP

SEQ ID NO: 1294567 - protein, 21 aa, Mycobacterium
TEGKPSLGWRGRRAAHKVSEA

SEQ ID NO: 1294568 - protein, 17 aa, Mycobacterium
TEGRAGYGYTTLVATAR

SEQ ID NO: 1294569 - protein, 19 aa, Mycobacterium
TEHLPRITVPTVFTHGTAD

SEQ ID NO: 1294570 - protein, 17 aa, Mycobacterium
TEIPMGFGYPIDHPDLP

SEQ ID NO: 1294571 - protein, 17 aa, Mycobacterium
TEIVRWLFTPDASLTIR

SEQ ID NO: 1294572 - protein, 18 aa, Mycobacterium
TELPFVWGNLVAGRRDPT

SEQ ID NO: 1294573 - protein, 17 aa, Mycobacterium
TELPVGVRLIFQAAEEL

SEQ ID NO: 1294574 - protein, 18 aa, Mycobacterium
TEPTVLPAQWPVLLCNGA

SEQ ID NO: 1294575 - protein, 19 aa, Mycobacterium
TERWGLAKAQGWQGVGHTR

SEQ ID NO: 1294576 - protein, 18 aa, Mycobacterium
TFARFLRQWMTWLAEKDI

SEQ ID NO: 1294577 - protein, 23 aa, Mycobacterium
TFDECKRLLNAFGGQWAPVQDAW

SEQ ID NO: 1294578 - protein, 17 aa, Mycobacterium
TFDRFGPGFGQFGSPVG

SEQ ID NO: 1294579 - protein, 23 aa, Mycobacterium
TFKELRGRFDLILNTVSANLNLE

SEQ ID NO: 1294580 - protein, 27 aa, Mycobacterium
TFLGPRPAGWWIRRRVHEVAVHRADAA

SEQ ID NO: 1294581 - protein, 24 aa, Mycobacterium
TFNCLSWLEALGFCGIGEAKDFLD

SEQ ID NO: 1294582 - protein, 19 aa, Mycobacterium
TFPDWRPVDFKVWPAENGF

SEQ ID NO: 1294583 - protein, 19 aa, Mycobacterium
TFQWPRITGTFNWATDWFD

SEQ ID NO: 1294584 - protein, 18 aa, Mycobacterium
TFRPEYRGALTRVSGAQT

SEQ ID NO: 1294585 - protein, 24 aa, Mycobacterium
TFRWWLTVATLRWGVICRHQAERH

SEQ ID NO: 1294586 - protein, 20 aa, Mycobacterium
TGAEPWVMVKGFRIKIDGCV

SEQ ID NO: 1294587 - protein, 23 aa, Mycobacterium
TGASRPDAPWGLFPAQGDDRWVA

SEQ ID NO: 1294588 - protein, 26 aa, Mycobacterium
TGEVLSVPVGDAFLGRVINPLGQPID

SEQ ID NO: 1294589 - protein, 18 aa, Mycobacterium
TGIARTGLMYAFERDGVA

SEQ ID NO: 1294590 - protein, 19 aa, Mycobacterium
TGIDIAWTQGRDVLWEEVV

SEQ ID NO: 1294591 - protein, 23 aa, Mycobacterium
TGKDAWRGSGWGHYVGAAELLRF

SEQ ID NO: 1294592 - protein, 17 aa, Mycobacterium
TGKKPSLAWAETYPGTL

SEQ ID NO: 1294593 - protein, 20 aa, Mycobacterium
TGLEPIEFWESFRVGHRGYA

SEQ ID NO: 1294594 - protein, 17 aa, Mycobacterium
TGLMYAFERDGVAPDLL

SEQ ID NO: 1294595 - protein, 17 aa, Mycobacterium
TGLPCPVCGDTVREVSF

SEQ ID NO: 1294596 - protein, 22 aa, Mycobacterium
TGLPQWRGVSGADMLRHVHSMM

SEQ ID NO: 1294597 - protein, 19 aa, Mycobacterium
TGMTCSHCIAAVSAELGAL

SEQ ID NO: 1294598 - protein, 23 aa, Mycobacterium
TGSDLYWNLSLWSDYNVMLMKTD

SEQ ID NO: 1294599 - protein, 18 aa, Mycobacterium
TGTFSINGGNYFAPDSPF

SEQ ID NO: 1294600 - protein, 19 aa, Mycobacterium
TGTWLRLHPRFDIDTMLHH

SEQ ID NO: 1294601 - protein, 18 aa, Mycobacterium
TGVAFPAFPALLAAEQGV

SEQ ID NO: 1294602 - protein, 22 aa, Mycobacterium
TGVPRPGLSTVFSRSRSTFGVD

SEQ ID NO: 1294603 - protein, 20 aa, Mycobacterium
TGVSNFSGWQLMKSLAVADD

SEQ ID NO: 1294604 - protein, 21 aa, Mycobacterium
THGAGAFAVFRPVRNPKPAGR

SEQ ID NO: 1294605 - protein, 18 aa, Mycobacterium
THLLRYPLPASWSADVAL

SEQ ID NO: 1294606 - protein, 20 aa, Mycobacterium
THPFAWLPMLSRVLGSARLD

SEQ ID NO: 1294607 - protein, 17 aa, Mycobacterium
THRCVVPTWPFGAQRKP

SEQ ID NO: 1294608 - protein, 24 aa, Mycobacterium
THSRLRPPWVTDIDVVFGTALAEI

SEQ ID NO: 1294609 - protein, 18 aa, Mycobacterium
THVPEFLDRVGVGAPEVE

SEQ ID NO: 1294610 - protein, 24 aa, Mycobacterium
TIGRWRPSLSGARDAYVYYPGTAD

SEQ ID NO: 1294611 - protein, 17 aa, Mycobacterium
TIRRRWRAESRRRSMSE

SEQ ID NO: 1294612 - protein, 24 aa, Mycobacterium
TITARLNFQLAFGARVGQRLAEAR

SEQ ID NO: 1294613 - protein, 21 aa, Mycobacterium
TIYRWWPSRHALVADVTLEDA

SEQ ID NO: 1294614 - protein, 22 aa, Mycobacterium
TIYRWWPSRPALVADVLLEDAH

SEQ ID NO: 1294615 - protein, 20 aa, Mycobacterium
TKCPMAWSDTYGGHWVAADS

SEQ ID NO: 1294616 - protein, 17 aa, Mycobacterium
TKHAAVGFAEWLAITYG

SEQ ID NO: 1294617 - protein, 21 aa, Mycobacterium
TKKETPSLCDWMIFGKEHCIV

SEQ ID NO: 1294618 - protein, 18 aa, Mycobacterium
TKLSRFLSDWAHDGKPGL

SEQ ID NO: 1294619 - protein, 18 aa, Mycobacterium
TKPGCTVGAYGCQGHHVE

SEQ ID NO: 1294620 - protein, 19 aa, Mycobacterium
TKVDGGWRITGQKIWTTGA

SEQ ID NO: 1294621 - protein, 19 aa, Mycobacterium
TKVMPPLLRPGVRILGKGV

SEQ ID NO: 1294622 - protein, 26 aa, Mycobacterium
TLACARLRLGGLMRRWDSLGVEVDGL

SEQ ID NO: 1294623 - protein, 26 aa, Mycobacterium
TLADLAFAWRTCRAVKSNAIVLARDG

SEQ ID NO: 1294624 - protein, 22 aa, Mycobacterium
TLALEHPDIWGALIDTDESVPA

SEQ ID NO: 1294625 - protein, 23 aa, Mycobacterium
TLCSCFPWPVLGLPPYWYKDPVF

SEQ ID NO: 1294626 - protein, 24 aa, Mycobacterium
TLHDAYRALQAWGLPVSPHTAQVT

SEQ ID NO: 1294627 - protein, 23 aa, Mycobacterium
TLIKEKWLTANGVIGFFPANASP

SEQ ID NO: 1294628 - protein, 22 aa, Mycobacterium
TLKPEVCWQLPIRRTQEWITRP

SEQ ID NO: 1294629 - protein, 25 aa, Mycobacterium
TLLAGLPVRRLWGIGPVAEDRLHRL

SEQ ID NO: 1294630 - protein, 18 aa, Mycobacterium
TLLGFCAAVTFPTSGTVR

SEQ ID NO: 1294631 - protein, 17 aa, Mycobacterium
TLPEWFVREHNLMSEDE

SEQ ID NO: 1294632 - protein, 24 aa, Mycobacterium
TLPKGAEVRLCLGAINRDGADEHS

SEQ ID NO: 1294633 - protein, 17 aa, Mycobacterium
TLQRGGSLISNYRTQVQ

SEQ ID NO: 1294634 - protein, 17 aa, Mycobacterium
TLRCLRNGLDTATSTGR

SEQ ID NO: 1294635 - protein, 17 aa, Mycobacterium
TLREAFRVLESESLIQV

SEQ ID NO: 1294636 - protein, 19 aa, Mycobacterium
TLSGRWRRQGVDVGFAALA

SEQ ID NO: 1294637 - protein, 23 aa, Mycobacterium
TLSPCWYCSGLVRQFNIGAVVIG

SEQ ID NO: 1294638 - protein, 18 aa, Mycobacterium
TMGIPILYPWANRLSSNG

SEQ ID NO: 1294639 - protein, 21 aa, Mycobacterium
TMPIEVWDDVMAVNVRSAMLT

SEQ ID NO: 1294640 - protein, 22 aa, Mycobacterium
TMPPHPAHFLWLNWGPSPQRQD

SEQ ID NO: 1294641 - protein, 21 aa, Mycobacterium
TNTRFCAHWGLAREGRVAYVN

SEQ ID NO: 1294642 - protein, 19 aa, Mycobacterium
TNYGGGLFDVLGVTRTLSV

SEQ ID NO: 1294643 - protein, 22 aa, Mycobacterium
TPAGRPASMWNFASIRNLRTAS

SEQ ID NO: 1294644 - protein, 24 aa, Mycobacterium
TPDEFSWRAGELLTAIADGTLDVT

SEQ ID NO: 1294645 - protein, 19 aa, Mycobacterium
TPEGIKVFLMRRHSAMDFV

SEQ ID NO: 1294646 - protein, 17 aa, Mycobacterium
TPELVAFMVRYTSGYLC

SEQ ID NO: 1294647 - protein, 17 aa, Mycobacterium
TPEQFIASIPAPVVTCL

SEQ ID NO: 1294648 - protein, 23 aa, Mycobacterium
TPEVWPGKAYPLGATYDGFGTNF

SEQ ID NO: 1294649 - protein, 17 aa, Mycobacterium
TPFLPAGIFDQWGLDAD

SEQ ID NO: 1294650 - protein, 17 aa, Mycobacterium
TPFLPAGVFDVWGLADD

SEQ ID NO: 1294651 - protein, 18 aa, Mycobacterium
TPGACPDMSMLLASMFKV

SEQ ID NO: 1294652 - protein, 17 aa, Mycobacterium
TPGASWRHPIGPGSSIV

SEQ ID NO: 1294653 - protein, 24 aa, Mycobacterium
TPPARLVGWTSRFLGMVLPGDEIE

SEQ ID NO: 1294654 - protein, 18 aa, Mycobacterium
TPPDWDRIGAAVLAAATS

SEQ ID NO: 1294655 - protein, 21 aa, Mycobacterium
TPSRSGALCTFRETARILAGL

SEQ ID NO: 1294656 - protein, 24 aa, Mycobacterium
TPVQKARAAWLWSGRRGTLVGLSA

SEQ ID NO: 1294657 - protein, 22 aa, Mycobacterium
TPWSVLRWGRIIAEKTDIPPGV

SEQ ID NO: 1294658 - protein, 23 aa, Mycobacterium
TQLRAAAVLACYRFHADAHGLAG

SEQ ID NO: 1294659 - protein, 18 aa, Mycobacterium
TQMLFFLQRGYRVIAHDR

SEQ ID NO: 1294660 - protein, 22 aa, Mycobacterium
TQPRFTGTISLRYLRGTPLGPL

SEQ ID NO: 1294661 - protein, 24 aa, Mycobacterium
TQTMLFPRYHQWDAVTRLIDRART

SEQ ID NO: 1294662 - protein, 22 aa, Mycobacterium
TQVRWRPIDFWPANTTVNIDAS

SEQ ID NO: 1294663 - protein, 18 aa, Mycobacterium
TQWDGGWAGIAWPTEYGG

SEQ ID NO: 1294664 - protein, 21 aa, Mycobacterium
TRAELRLAIVTWIERTYHRRR

SEQ ID NO: 1294665 - protein, 23 aa, Mycobacterium
TREFGDAIAPVLARVPSHRMSTV

SEQ ID NO: 1294666 - protein, 18 aa, Mycobacterium
TRERPHRLVVCRDDDWRP

SEQ ID NO: 1294667 - protein, 21 aa, Mycobacterium
TRFAQDWARHRNVSLADVPRV

SEQ ID NO: 1294668 - protein, 19 aa, Mycobacterium
TRFRAEVPGADMIDPSDHS

SEQ ID NO: 1294669 - protein, 19 aa, Mycobacterium
TRFYVSLCDELMRRSATFD

SEQ ID NO: 1294670 - protein, 17 aa, Mycobacterium
TRGFRDAILMQRATGHW

SEQ ID NO: 1294671 - protein, 19 aa, Mycobacterium
TRILAPRSRYDEVVEKLAA

SEQ ID NO: 1294672 - protein, 20 aa, Mycobacterium
TRLLLRKCMHLLRDKQINRV

SEQ ID NO: 1294673 - protein, 19 aa, Mycobacterium
TRLPLPWAQARLLSTIEDQ

SEQ ID NO: 1294674 - protein, 20 aa, Mycobacterium
TRLPLPWAQARLLSTIEDQG

SEQ ID NO: 1294675 - protein, 19 aa, Mycobacterium
TRLRLLIIRSGLPRPVTQI

SEQ ID NO: 1294676 - protein, 20 aa, Mycobacterium
TRLTGSVLRCPRCGAGFDVI

SEQ ID NO: 1294677 - protein, 19 aa, Mycobacterium
TRPASLPFLSIKKITVHYR

SEQ ID NO: 1294678 - protein, 21 aa, Mycobacterium
TRPGGRLTFVCWRDPTDNPFM

SEQ ID NO: 1294679 - protein, 18 aa, Mycobacterium
TRPGVAVRMLTSGTTGPP

SEQ ID NO: 1294680 - protein, 18 aa, Mycobacterium
TRPKEFAKVLAPLHRLVA

SEQ ID NO: 1294681 - protein, 19 aa, Mycobacterium
TRPYSMRILGGSWPSTSPE

SEQ ID NO: 1294682 - protein, 19 aa, Mycobacterium
TRSIAGFFSFDPVRAEVSA

SEQ ID NO: 1294683 - protein, 17 aa, Mycobacterium
TRTPAYRGCASWVDLPV

SEQ ID NO: 1294684 - protein, 19 aa, Mycobacterium
TRVALPWRPGTDAVIADMV

SEQ ID NO: 1294685 - protein, 26 aa, Mycobacterium
TRVDYGLCPFAGWPVAIPDGAEPNTG

SEQ ID NO: 1294686 - protein, 17 aa, Mycobacterium
TRVLPLMRDRLQRLCTG

SEQ ID NO: 1294687 - protein, 18 aa, Mycobacterium
TRVRAHVTFARYHLGGNG

SEQ ID NO: 1294688 - protein, 23 aa, Mycobacterium
TSAEIPEPLWIVQNFQHGTLNFD

SEQ ID NO: 1294689 - protein, 20 aa, Mycobacterium
TSAEMLWEWEAMARDMAWDY

SEQ ID NO: 1294690 - protein, 17 aa, Mycobacterium
TSAFALWFTGGIFVDDH

SEQ ID NO: 1294691 - protein, 19 aa, Mycobacterium
TSAHFVWPRETLRLGEKYP

SEQ ID NO: 1294692 - protein, 20 aa, Mycobacterium
TSAPGGWRANICRVPPNLAN

SEQ ID NO: 1294693 - protein, 18 aa, Mycobacterium
TSDPSADRYLVFSDGTRV

SEQ ID NO: 1294694 - protein, 17 aa, Mycobacterium
TSFRDVLAPAWQQATGG

SEQ ID NO: 1294695 - protein, 21 aa, Mycobacterium
TSLAHLCEWGLATVRTDPDAP

SEQ ID NO: 1294696 - protein, 17 aa, Mycobacterium
TSLRWTLTGVRSRFAVR

SEQ ID NO: 1294697 - protein, 18 aa, Mycobacterium
TSRPRWAAAGSWLGPADP

SEQ ID NO: 1294698 - protein, 26 aa, Mycobacterium
TSSRYPGGMALRFARVLCYRDDKTAA

SEQ ID NO: 1294699 - protein, 19 aa, Mycobacterium
TSVPAWWVPYVPRLMRTPQ

SEQ ID NO: 1294700 - protein, 17 aa, Mycobacterium
TTAAWLWSHRQGVVSGL

SEQ ID NO: 1294701 - protein, 17 aa, Mycobacterium
TTAFGVSVATPFLLTGL

SEQ ID NO: 1294702 - protein, 24 aa, Mycobacterium
TTDWRRLTITLAWLSPVNTATRRH

SEQ ID NO: 1294703 - protein, 17 aa, Mycobacterium
TTGLKMPDCCVLYTAEH

SEQ ID NO: 1294704 - protein, 26 aa, Mycobacterium
TTGSRVPMCFGFHPYLQLPGIPRAQW

SEQ ID NO: 1294705 - protein, 17 aa, Mycobacterium
TTHWAHCQTLARTYPKV

SEQ ID NO: 1294706 - protein, 17 aa, Mycobacterium
TTNRPGARFGPRAIRAT

SEQ ID NO: 1294707 - protein, 18 aa, Mycobacterium
TTPAPVRGALVARLGELL

SEQ ID NO: 1294708 - protein, 25 aa, Mycobacterium
TTPGDLPLVLALFYLVVDRRTTPLL

SEQ ID NO: 1294709 - protein, 17 aa, Mycobacterium
TTPRVAQMFGVQAVPTV

SEQ ID NO: 1294710 - protein, 25 aa, Mycobacterium
TTRTTECLCLYKFEIEVVKPDSTAT

SEQ ID NO: 1294711 - protein, 19 aa, Mycobacterium
TTSECWRQWINVGDFPDHP

SEQ ID NO: 1294712 - protein, 17 aa, Mycobacterium
TVADMMIYLTWTMDGRG

SEQ ID NO: 1294713 - protein, 22 aa, Mycobacterium
TVAGSLRASRQWGLDHEVLDAD

SEQ ID NO: 1294714 - protein, 24 aa, Mycobacterium
TVEPRSGQEFQFRTEVPGNVEIEL

SEQ ID NO: 1294715 - protein, 18 aa, Mycobacterium
TVLCRHFGDRDGLVAAVL

SEQ ID NO: 1294716 - protein, 17 aa, Mycobacterium
TVLRFAHSLGFEGFADL

SEQ ID NO: 1294717 - protein, 21 aa, Mycobacterium
TVLRGDEIVKVFTDSVQPAGL

SEQ ID NO: 1294718 - protein, 19 aa, Mycobacterium
TVLRHELFHYAARADTAAD

SEQ ID NO: 1294719 - protein, 17 aa, Mycobacterium
TVTPWGTFTYRPSKAAR

SEQ ID NO: 1294720 - protein, 18 aa, Mycobacterium
TVTRWVAVMDCGRVLNPK

SEQ ID NO: 1294721 - protein, 17 aa, Mycobacterium
TVVCTFGLCAIPDHAQA

SEQ ID NO: 1294722 - protein, 20 aa, Mycobacterium
TVVSLAWRTGDDIVVSRKDP

SEQ ID NO: 1294723 - protein, 20 aa, Mycobacterium
TVWQQLHFRFGLPKPLLEPL

SEQ ID NO: 1294724 - protein, 19 aa, Mycobacterium
TVYRHWKNKGALIVDALRT

SEQ ID NO: 1294725 - protein, 18 aa, Mycobacterium
TVYRHWPDRAALVADALA

SEQ ID NO: 1294726 - protein, 24 aa, Mycobacterium
TWADLVVTLRPEWTAGQARFAVYA

SEQ ID NO: 1294727 - protein, 24 aa, Mycobacterium
TWIGRFVSTYGWRAYALPLLVALT

SEQ ID NO: 1294728 - protein, 18 aa, Mycobacterium
TWLRLFLIEEEFPRPSTQ

SEQ ID NO: 1294729 - protein, 19 aa, Mycobacterium
TWPAYRPLLNWLIGLMPEG

SEQ ID NO: 1294730 - protein, 25 aa, Mycobacterium
TWPRFVCALPCEFFAAVRAELDAAG

SEQ ID NO: 1294731 - protein, 17 aa, Mycobacterium
TWSKARWIGLIDLDNCA

SEQ ID NO: 1294732 - protein, 18 aa, Mycobacterium
TYCATAFLYDGRGGRGGC

SEQ ID NO: 1294733 - protein, 17 aa, Mycobacterium
TYLPCWGTSLHRVAGDD

SEQ ID NO: 1294734 - protein, 18 aa, Mycobacterium
TYRLPWLPGATVYEIDQP

SEQ ID NO: 1294735 - protein, 18 aa, Mycobacterium
TYRYEFGWRSTGVGGELG

SEQ ID NO: 1294736 - protein, 21 aa, Mycobacterium
VAAFLPHVFQWTRAMNPVQPV

SEQ ID NO: 1294737 - protein, 26 aa, Mycobacterium
VAAHAWQPRWLKWSLTLIRKGGLDRT

SEQ ID NO: 1294738 - protein, 23 aa, Mycobacterium
VAAKLRAGTVWVNAYRVVAPHVP

SEQ ID NO: 1294739 - protein, 25 aa, Mycobacterium
VAAKRGWPILRFSSRSGASPASQVR

SEQ ID NO: 1294740 - protein, 18 aa, Mycobacterium
VAALKFYGRRGWLDDPEG

SEQ ID NO: 1294741 - protein, 18 aa, Mycobacterium
VAALLRWLADGHFVLLGY

SEQ ID NO: 1294742 - protein, 23 aa, Mycobacterium
VAARGIEIGHVFQLGRKYADAFG

SEQ ID NO: 1294743 - protein, 17 aa, Mycobacterium
VACANILLAKGIPDVTV

SEQ ID NO: 1294744 - protein, 23 aa, Mycobacterium
VADARAAIRWYIDVFDAELVGDP

SEQ ID NO: 1294745 - protein, 19 aa, Mycobacterium
VAEARPVLGTGIAERIRAA

SEQ ID NO: 1294746 - protein, 20 aa, Mycobacterium
VAEAWLPFHVPMSYHGTFTS

SEQ ID NO: 1294747 - protein, 19 aa, Mycobacterium
VAECLRAGVWEGLDSAELA

SEQ ID NO: 1294748 - protein, 21 aa, Mycobacterium
VAELRAGFGVDVEVRDIFENA

SEQ ID NO: 1294749 - protein, 17 aa, Mycobacterium
VAEWLAYVQHDWEPTPV

SEQ ID NO: 1294750 - protein, 19 aa, Mycobacterium
VAFGKHWVTECLRAAYPLG

SEQ ID NO: 1294751 - protein, 21 aa, Mycobacterium
VAGRLGWPFVEIFPSRLATPD

SEQ ID NO: 1294752 - protein, 20 aa, Mycobacterium
VAGVGMGWDPGWRADGGPFA

SEQ ID NO: 1294753 - protein, 23 aa, Mycobacterium
VAKSLRASLRFAQDMYALIPLIL

SEQ ID NO: 1294754 - protein, 18 aa, Mycobacterium
VAKWWIPERWSFVSDIPR

SEQ ID NO: 1294755 - protein, 20 aa, Mycobacterium
VALAPRLWVPDDFGLSRYLA

SEQ ID NO: 1294756 - protein, 17 aa, Mycobacterium
VALKHPIKLIANALGSP

SEQ ID NO: 1294757 - protein, 20 aa, Mycobacterium
VALPLRLGGWVIDTPGIRSF

SEQ ID NO: 1294758 - protein, 28 aa, Mycobacterium
VALQEARRALKLSWRYVEAFEQEAAALY

SEQ ID NO: 1294759 - protein, 26 aa, Mycobacterium
VAMACFKLAIVIEGTWSRYLAGQASA

SEQ ID NO: 1294760 - protein, 17 aa, Mycobacterium
VAMKLFWERGFGGVSIS

SEQ ID NO: 1294761 - protein, 22 aa, Mycobacterium
VANAFGGLFARQGHLGAMPATV

SEQ ID NO: 1294762 - protein, 17 aa, Mycobacterium
VANVRWADCQITRRFVD

SEQ ID NO: 1294763 - protein, 21 aa, Mycobacterium
VAPDQSCLWGFGRAAALELPQ

SEQ ID NO: 1294764 - protein, 18 aa, Mycobacterium
VAQAQWWFARLAPGLMNR

SEQ ID NO: 1294765 - protein, 24 aa, Mycobacterium
VARFKRLDGFDVRFLTGTDVHGLK

SEQ ID NO: 1294766 - protein, 17 aa, Mycobacterium
VARGWRTPLRLLFIDGG

SEQ ID NO: 1294767 - protein, 27 aa, Mycobacterium
VARHAWRPRWLKWSLTISGKGGTHRGG

SEQ ID NO: 1294768 - protein, 17 aa, Mycobacterium
VASRGRPDLSWDGTTQL

SEQ ID NO: 1294769 - protein, 18 aa, Mycobacterium
VASTIAFLASDYSSYLTG

SEQ ID NO: 1294770 - protein, 17 aa, Mycobacterium
VATAVWNAVCWAIIIPA

SEQ ID NO: 1294771 - protein, 18 aa, Mycobacterium
VAVAPVLRFKAFTRDSVG

SEQ ID NO: 1294772 - protein, 20 aa, Mycobacterium
VAVARPLLAPAIESADAVVE

SEQ ID NO: 1294773 - protein, 18 aa, Mycobacterium
VAVKAPFFGDRRKAFLDD

SEQ ID NO: 1294774 - protein, 24 aa, Mycobacterium
VAVLSCREGLEFGTAVASDTAPLH

SEQ ID NO: 1294775 - protein, 23 aa, Mycobacterium
VAVRPGQDWALLLAMVKVILDGG

SEQ ID NO: 1294776 - protein, 21 aa, Mycobacterium
VCDPPWYRPLLGVRRAATAAA

SEQ ID NO: 1294777 - protein, 24 aa, Mycobacterium
VCNEILPRWGVETVFVDGDDLSQW

SEQ ID NO: 1294778 - protein, 20 aa, Mycobacterium
VCSAEVPIPYARHLEQAALP

SEQ ID NO: 1294779 - protein, 20 aa, Mycobacterium
VCTLYPPTRVQLAIADTQNG

SEQ ID NO: 1294780 - protein, 22 aa, Mycobacterium
VCWRDLLCWERLSGDLLCGRVM

SEQ ID NO: 1294781 - protein, 17 aa, Mycobacterium
VDADVIWAIPQLHSLVV

SEQ ID NO: 1294782 - protein, 21 aa, Mycobacterium
VDALGALVFWRLIALGKPVSA

SEQ ID NO: 1294783 - protein, 17 aa, Mycobacterium
VDARVLATVLLEFNDRM

SEQ ID NO: 1294784 - protein, 23 aa, Mycobacterium
VDARVRLRLRAEQDAVTVFAKNL

SEQ ID NO: 1294785 - protein, 24 aa, Mycobacterium
VDARWASSISGYWRRGRTEETFRQ

SEQ ID NO: 1294786 - protein, 19 aa, Mycobacterium
VDASRLFLTQMIRHHEGAI

SEQ ID NO: 1294787 - protein, 22 aa, Mycobacterium
VDCSATLPGAIGWLKYTIDNEL

SEQ ID NO: 1294788 - protein, 17 aa, Mycobacterium
VDDRLRQLISWTGDHLA

SEQ ID NO: 1294789 - protein, 18 aa, Mycobacterium
VDEALGWVDALDIADRRL

SEQ ID NO: 1294790 - protein, 23 aa, Mycobacterium
VDEAWRPDTVWRHRLGSGLPAER

SEQ ID NO: 1294791 - protein, 19 aa, Mycobacterium
VDEIVRWATPVTSFQRTAL

SEQ ID NO: 1294792 - protein, 17 aa, Mycobacterium
VDFVPKVRVEVVVDDAA

SEQ ID NO: 1294793 - protein, 24 aa, Mycobacterium
VDGGYRLTGSWSFGSGTGHAEYVA

SEQ ID NO: 1294794 - protein, 22 aa, Mycobacterium
VDGHVRAGGLGLVGACDIAVAG

SEQ ID NO: 1294795 - protein, 18 aa, Mycobacterium
VDGIFRWLTVGPPGQDDV

SEQ ID NO: 1294796 - protein, 23 aa, Mycobacterium
VDGRPGQQFALLFVAWLNANPAV

SEQ ID NO: 1294797 - protein, 20 aa, Mycobacterium
VDHFEWLENLGFQFERSYYP

SEQ ID NO: 1294798 - protein, 18 aa, Mycobacterium
VDHFRYFAGAIRAQEGSL

SEQ ID NO: 1294799 - protein, 23 aa, Mycobacterium
VDKFPRMVDYVLPSGVRIADADR

SEQ ID NO: 1294800 - protein, 18 aa, Mycobacterium
VDLAACLGATWIGGGVAG

SEQ ID NO: 1294801 - protein, 18 aa, Mycobacterium
VDLLDAWVAYFAEHPRER

SEQ ID NO: 1294802 - protein, 17 aa, Mycobacterium
VDLLRAVTDFALPDPTG

SEQ ID NO: 1294803 - protein, 18 aa, Mycobacterium
VDLRNDWPAALAEAGFDA

SEQ ID NO: 1294804 - protein, 22 aa, Mycobacterium
VDLRVAVKLSPFFSATAEMALR

SEQ ID NO: 1294805 - protein, 24 aa, Mycobacterium
VDPAVMLKAKFKLPFYNTSRWTFA

SEQ ID NO: 1294806 - protein, 18 aa, Mycobacterium
VDRLLALGARRVDIGQGE

SEQ ID NO: 1294807 - protein, 20 aa, Mycobacterium
VDRLYGLAGRFWSTAAELTD

SEQ ID NO: 1294808 - protein, 20 aa, Mycobacterium
VDRPRFLGGAGRWRDSGMDG

SEQ ID NO: 1294809 - protein, 25 aa, Mycobacterium
VDRVFAGKVWGAWHLSEAAADLQLD

SEQ ID NO: 1294810 - protein, 18 aa, Mycobacterium
VDSWLCGWDEAFTEALAA

SEQ ID NO: 1294811 - protein, 24 aa, Mycobacterium
VDVHLALPVIRAFTHFALLANVAE

SEQ ID NO: 1294812 - protein, 18 aa, Mycobacterium
VDVLERFYSVVLTDCGTG

SEQ ID NO: 1294813 - protein, 19 aa, Mycobacterium
VECSPPYDWAEQTALMSSR

SEQ ID NO: 1294814 - protein, 17 aa, Mycobacterium
VEEFIRFAGSIHGIPRT

SEQ ID NO: 1294815 - protein, 18 aa, Mycobacterium
VEEFVRWSSPVLQFARFA

SEQ ID NO: 1294816 - protein, 19 aa, Mycobacterium
VEEFVRWSTPVLQFARFAT

SEQ ID NO: 1294817 - protein, 18 aa, Mycobacterium
VEEMIRWVTPVKEFMRTA

SEQ ID NO: 1294818 - protein, 19 aa, Mycobacterium
VEFALRFPEFFDEPPTSDV

SEQ ID NO: 1294819 - protein, 17 aa, Mycobacterium
VEFLQWFLDTVPIEPIW

SEQ ID NO: 1294820 - protein, 18 aa, Mycobacterium
VEGSWYWLDDHTAHWRPR

SEQ ID NO: 1294821 - protein, 18 aa, Mycobacterium
VEHWRWMWEANVLGTLHV

SEQ ID NO: 1294822 - protein, 20 aa, Mycobacterium
VEITDLIGLRVITYLREDVA

SEQ ID NO: 1294823 - protein, 17 aa, Mycobacterium
VEKRFNLSWAIEGTRSR

SEQ ID NO: 1294824 - protein, 24 aa, Mycobacterium
VELARSGVLYALWAADHADPEDRH

SEQ ID NO: 1294825 - protein, 19 aa, Mycobacterium
VELSWNILDPVLDYWASHG

SEQ ID NO: 1294826 - protein, 17 aa, Mycobacterium
VENALKVAFDWKSRLNE

SEQ ID NO: 1294827 - protein, 22 aa, Mycobacterium
VERMHRSCLILTFGGGTNEIQR

SEQ ID NO: 1294828 - protein, 25 aa, Mycobacterium
VEYAQLRAQWGWKLVAAATTAGVSV

SEQ ID NO: 1294829 - protein, 22 aa, Mycobacterium
VEYERLAALGVRFTQQPTDMGP

SEQ ID NO: 1294830 - protein, 17 aa, Mycobacterium
VFCPPRVLLPESPEPFC

SEQ ID NO: 1294831 - protein, 17 aa, Mycobacterium
VFDGCDFSGVDMSESEH

SEQ ID NO: 1294832 - protein, 17 aa, Mycobacterium
VFDSFPLTHHVECVAVL

SEQ ID NO: 1294833 - protein, 18 aa, Mycobacterium
VFETLAWGRRHVVMGANQ

SEQ ID NO: 1294834 - protein, 18 aa, Mycobacterium
VFGRRAGLGASDYVRSLP

SEQ ID NO: 1294835 - protein, 24 aa, Mycobacterium
VFMSATARLKCPFTSLGVAPEAAS

SEQ ID NO: 1294836 - protein, 22 aa, Mycobacterium
VFPSRHFRLSCIFVGAHSPAVT

SEQ ID NO: 1294837 - protein, 19 aa, Mycobacterium
VFRCANLYLRYEVANCHSS

SEQ ID NO: 1294838 - protein, 17 aa, Mycobacterium
VFRLLALAEDTTRPPSL

SEQ ID NO: 1294839 - protein, 18 aa, Mycobacterium
VFRRRRFFSGKPVGRRGQ

SEQ ID NO: 1294840 - protein, 18 aa, Mycobacterium
VFSADWPAAMAMAAGLDF

SEQ ID NO: 1294841 - protein, 19 aa, Mycobacterium
VFTPGLAGLVLGEFRRIER

SEQ ID NO: 1294842 - protein, 19 aa, Mycobacterium
VFVGAVFDWVVADIAATTQ

SEQ ID NO: 1294843 - protein, 17 aa, Mycobacterium
VGACATAAVSVEEGVDK

SEQ ID NO: 1294844 - protein, 18 aa, Mycobacterium
VGALPFDITKPAALIRPQ

SEQ ID NO: 1294845 - protein, 26 aa, Mycobacterium
VGARRPRFGVPMAVVYGFAWLADAVG

SEQ ID NO: 1294846 - protein, 19 aa, Mycobacterium
VGEDGEWPLFLDAWVEHAV

SEQ ID NO: 1294847 - protein, 21 aa, Mycobacterium
VGEHRVCTVFDLMLAQYGVAR

SEQ ID NO: 1294848 - protein, 17 aa, Mycobacterium
VGEMFGRKVARLMEWVA

SEQ ID NO: 1294849 - protein, 18 aa, Mycobacterium
VGFGGWFSPIALHVVGES

SEQ ID NO: 1294850 - protein, 19 aa, Mycobacterium
VGGDAGWPLYLRRFGELID

SEQ ID NO: 1294851 - protein, 19 aa, Mycobacterium
VGGLGMWKVHQSSAPGPVI

SEQ ID NO: 1294852 - protein, 22 aa, Mycobacterium
VGGNIPIVALFVRNGSAEDPNA

SEQ ID NO: 1294853 - protein, 23 aa, Mycobacterium
VGGRWEIVEGLDINPFSRARIDA

SEQ ID NO: 1294854 - protein, 17 aa, Mycobacterium
VGIGFAFAPQFHPSYRH

SEQ ID NO: 1294855 - protein, 17 aa, Mycobacterium
VGILCGQPFAVVAACAA

SEQ ID NO: 1294856 - protein, 19 aa, Mycobacterium
VGIPDEWFLAGHIVVGWPR

SEQ ID NO: 1294857 - protein, 19 aa, Mycobacterium
VGITFGGLLSPGGSIFNAL

SEQ ID NO: 1294858 - protein, 17 aa, Mycobacterium
VGLMPTWGLSVRLPQKV

SEQ ID NO: 1294859 - protein, 17 aa, Mycobacterium
VGMSAKLMERWSSRRAA

SEQ ID NO: 1294860 - protein, 17 aa, Mycobacterium
VGPKRVWLVSDTTATVH

SEQ ID NO: 1294861 - protein, 23 aa, Mycobacterium
VGQLCAQFARLAGARVIVLDFNT

SEQ ID NO: 1294862 - protein, 19 aa, Mycobacterium
VGRPRWPVPGSRFGGSLHA

SEQ ID NO: 1294863 - protein, 19 aa, Mycobacterium
VGSALSWLLTLAHRRAVDR

SEQ ID NO: 1294864 - protein, 17 aa, Mycobacterium
VGSLQFAPGRLGEVETM

SEQ ID NO: 1294865 - protein, 25 aa, Mycobacterium
VGSRALAMAVGWACEREQFGRPIGS

SEQ ID NO: 1294866 - protein, 20 aa, Mycobacterium
VGTFSWPGAYGTWWQADPSA

SEQ ID NO: 1294867 - protein, 17 aa, Mycobacterium
VGWLKEEFDAIGVPFNK

SEQ ID NO: 1294868 - protein, 19 aa, Mycobacterium
VGWTGGHSWFAENVTRIRP

SEQ ID NO: 1294869 - protein, 19 aa, Mycobacterium
VGYAACFHSALRLVGRQEK

SEQ ID NO: 1294870 - protein, 17 aa, Mycobacterium
VGYRPGQFLTLRVPSER

SEQ ID NO: 1294871 - protein, 20 aa, Mycobacterium
VHHPARWALLYGSPVPGYHA

SEQ ID NO: 1294872 - protein, 26 aa, Mycobacterium
VHLAHALPFVGEFLHPLIGWPVDHDA

SEQ ID NO: 1294873 - protein, 18 aa, Mycobacterium
VHPLRPGTMYLLNGHERH

SEQ ID NO: 1294874 - protein, 19 aa, Mycobacterium
VHRYEVVDLLTLLVDKSLL

SEQ ID NO: 1294875 - protein, 20 aa, Mycobacterium
VHVLDMLRYLVGEVAEVSAY

SEQ ID NO: 1294876 - protein, 17 aa, Mycobacterium
VHYRPRPVVGIIAPWNY

SEQ ID NO: 1294877 - protein, 21 aa, Mycobacterium
VHYRPRPVVGIIAPWNYPVAN

SEQ ID NO: 1294878 - protein, 18 aa, Mycobacterium
VIAIRSRLMSRLAGQGAV

SEQ ID NO: 1294879 - protein, 17 aa, Mycobacterium
VIASEWGVTGWPEATAY

SEQ ID NO: 1294880 - protein, 17 aa, Mycobacterium
VIASPKPKRIFEIGPIR

SEQ ID NO: 1294881 - protein, 19 aa, Mycobacterium
VIGDCMSHWTLPHLVGGAV

SEQ ID NO: 1294882 - protein, 20 aa, Mycobacterium
VIHPRFGNFILLGTVLVASE

SEQ ID NO: 1294883 - protein, 18 aa, Mycobacterium
VILPWAMGDHRLGDDVLE

SEQ ID NO: 1294884 - protein, 21 aa, Mycobacterium
VITKPRWFFSFAKHLRPPDLR

SEQ ID NO: 1294885 - protein, 19 aa, Mycobacterium
VKAFLPRMIAAGAPAWVWN

SEQ ID NO: 1294886 - protein, 22 aa, Mycobacterium
VKAGEAFWEPGFDVVHYQAANL

SEQ ID NO: 1294887 - protein, 20 aa, Mycobacterium
VKAGVQWGLFGGAIENLGTE

SEQ ID NO: 1294888 - protein, 18 aa, Mycobacterium
VKATMKWCRKAAELGTLT

SEQ ID NO: 1294889 - protein, 19 aa, Mycobacterium
VKATMKWCRKAAELGTLTD

SEQ ID NO: 1294890 - protein, 17 aa, Mycobacterium
VKDACLEYALANDERFG

SEQ ID NO: 1294891 - protein, 22 aa, Mycobacterium
VKDSFRKLWFGWSDPARVLVEY

SEQ ID NO: 1294892 - protein, 18 aa, Mycobacterium
VKHFPIKSGIVIEREVGR

SEQ ID NO: 1294893 - protein, 23 aa, Mycobacterium
VKKLPTLRGRTIITMFYENSTRT

SEQ ID NO: 1294894 - protein, 20 aa, Mycobacterium
VKLLRLAQAYSLVVSAEVTA

SEQ ID NO: 1294895 - protein, 21 aa, Mycobacterium
VKQGWMCCVGSDWMHLSTGVI

SEQ ID NO: 1294896 - protein, 20 aa, Mycobacterium
VKRYARVRFDGVEVGESAAV

SEQ ID NO: 1294897 - protein, 17 aa, Mycobacterium
VKSDFYLGAAFEGPPGH

SEQ ID NO: 1294898 - protein, 19 aa, Mycobacterium
VKSHGWGVPGLSWMPGEDP

SEQ ID NO: 1294899 - protein, 18 aa, Mycobacterium
VKVPTHWYNLAAELDEPI

SEQ ID NO: 1294900 - protein, 17 aa, Mycobacterium
VLAEARLGAYARELGEE

SEQ ID NO: 1294901 - protein, 18 aa, Mycobacterium
VLASLRWDEQFGDRHISL

SEQ ID NO: 1294902 - protein, 18 aa, Mycobacterium
VLCGSAFKNKGVQPMLDA

SEQ ID NO: 1294903 - protein, 18 aa, Mycobacterium
VLCTLELAGRLHLDLASL

SEQ ID NO: 1294904 - protein, 20 aa, Mycobacterium
VLDRALALFLERGYENVSLN

SEQ ID NO: 1294905 - protein, 18 aa, Mycobacterium
VLELHGWGDLQTELHSLS

SEQ ID NO: 1294906 - protein, 18 aa, Mycobacterium
VLELHGWSELHTELHRLS

SEQ ID NO: 1294907 - protein, 22 aa, Mycobacterium
VLEMVNRLKVAVGDRVEVVGGN

SEQ ID NO: 1294908 - protein, 23 aa, Mycobacterium
VLERPRVGTLFVIPGRGDTLRIN

SEQ ID NO: 1294909 - protein, 17 aa, Mycobacterium
VLFAVELDRRWADDGVR

SEQ ID NO: 1294910 - protein, 19 aa, Mycobacterium
VLGSLKRQGEWVVPSRLAL

SEQ ID NO: 1294911 - protein, 19 aa, Mycobacterium
VLIPAGWCGYSGPRARGMA

SEQ ID NO: 1294912 - protein, 19 aa, Mycobacterium
VLLCNGAVGIAEGWATKVP

SEQ ID NO: 1294913 - protein, 18 aa, Mycobacterium
VLLCVAEARPFVLLPKFE

SEQ ID NO: 1294914 - protein, 23 aa, Mycobacterium
VLNAKTRRPSVCNAAESLLIDAA

SEQ ID NO: 1294915 - protein, 19 aa, Mycobacterium
VLPAQWPVLLCNGAVGIAE

SEQ ID NO: 1294916 - protein, 18 aa, Mycobacterium
VLPELKRFNLVICDESHN

SEQ ID NO: 1294917 - protein, 17 aa, Mycobacterium
VLPGMVVPIELDDAARA

SEQ ID NO: 1294918 - protein, 19 aa, Mycobacterium
VLRELRAGLHFNALSLSGL

SEQ ID NO: 1294919 - protein, 28 aa, Mycobacterium
VLRGGKRLRPAFAYWGWRAVAGTEPGPE

SEQ ID NO: 1294920 - protein, 18 aa, Mycobacterium
VLRRAGLPAPRFGMATSF

SEQ ID NO: 1294921 - protein, 21 aa, Mycobacterium
VLRSRLDGLIAQWKRDHGDTD

SEQ ID NO: 1294922 - protein, 23 aa, Mycobacterium
VLRVVRFWISHGVKVFRVDNPHT

SEQ ID NO: 1294923 - protein, 17 aa, Mycobacterium
VLTAHPWVANNLVDAFE

SEQ ID NO: 1294924 - protein, 17 aa, Mycobacterium
VLVMVAAYSRFIAAIMI

SEQ ID NO: 1294925 - protein, 22 aa, Mycobacterium
VLWLRLRLAIICAHAGDDLTGA

SEQ ID NO: 1294926 - protein, 22 aa, Mycobacterium
VLWSRLRIAITLVQGGDDLTGA

SEQ ID NO: 1294927 - protein, 17 aa, Mycobacterium
VMASILLTELVRRGVLR

SEQ ID NO: 1294928 - protein, 18 aa, Mycobacterium
VMLCDKWSPPRTFEAADL

SEQ ID NO: 1294929 - protein, 22 aa, Mycobacterium
VMRPRIARRYAVVEGHRALFAN

SEQ ID NO: 1294930 - protein, 19 aa, Mycobacterium
VMVKGFRIKIDGCVGESFI

SEQ ID NO: 1294931 - protein, 18 aa, Mycobacterium
VMVRPLIRLSLGKRQATR

SEQ ID NO: 1294932 - protein, 18 aa, Mycobacterium
VNAAWRLDDRGVFSDSHG

SEQ ID NO: 1294933 - protein, 17 aa, Mycobacterium
VNAFLHPTMERFLYSAE

SEQ ID NO: 1294934 - protein, 18 aa, Mycobacterium
VNDLRPGWVTALDLPLIA

SEQ ID NO: 1294935 - protein, 17 aa, Mycobacterium
VNFPDVLLIAGRYQVSV

SEQ ID NO: 1294936 - protein, 18 aa, Mycobacterium
VNGFCVGGGIGLVGNSDV

SEQ ID NO: 1294937 - protein, 17 aa, Mycobacterium
VNMFAHWSYPWNGMVNE

SEQ ID NO: 1294938 - protein, 24 aa, Mycobacterium
VNPSRPVNRFALAVHTLLKPIGKL

SEQ ID NO: 1294939 - protein, 20 aa, Mycobacterium
VNQRWLGGMLTNFSTVHKRL

SEQ ID NO: 1294940 - protein, 19 aa, Mycobacterium
VNVCSSAAWITGAKQSPED

SEQ ID NO: 1294941 - protein, 17 aa, Mycobacterium
VPAIPRLPSGKVLRRVL

SEQ ID NO: 1294942 - protein, 20 aa, Mycobacterium
VPALACARCRSVARCRHCTG

SEQ ID NO: 1294943 - protein, 18 aa, Mycobacterium
VPCDRKWYSRLAITELLI

SEQ ID NO: 1294944 - protein, 18 aa, Mycobacterium
VPCRRGFFMQCERMQVPS

SEQ ID NO: 1294945 - protein, 24 aa, Mycobacterium
VPDGKVCWWGGWGGSLVVMDLDRR

SEQ ID NO: 1294946 - protein, 18 aa, Mycobacterium
VPDQSTRVALPWRPGTDA

SEQ ID NO: 1294947 - protein, 20 aa, Mycobacterium
VPEEVAWRVGFIDDDALEAR

SEQ ID NO: 1294948 - protein, 19 aa, Mycobacterium
VPFKAEFFGEPGWEPMGDQ

SEQ ID NO: 1294949 - protein, 18 aa, Mycobacterium
VPGLRCLMLTSFTSDEAM

SEQ ID NO: 1294950 - protein, 18 aa, Mycobacterium
VPIAHGWCGVLAVPRDWE

SEQ ID NO: 1294951 - protein, 19 aa, Mycobacterium
VPIEPIWLCPLRLRDDRDW

SEQ ID NO: 1294952 - protein, 17 aa, Mycobacterium
VPLAIAMAASYFRNADE

SEQ ID NO: 1294953 - protein, 18 aa, Mycobacterium
VPLLRLAAQTALLQAEAL

SEQ ID NO: 1294954 - protein, 17 aa, Mycobacterium
VPMAYFSFGGWKASLFG

SEQ ID NO: 1294955 - protein, 21 aa, Mycobacterium
VPMFPNLFLLYGPNTNVGSGS

SEQ ID NO: 1294956 - protein, 20 aa, Mycobacterium
VPMIGEFCYQCMHSIKVGIK

SEQ ID NO: 1294957 - protein, 18 aa, Mycobacterium
VPMSQLYEGYTFPEAGEQ

SEQ ID NO: 1294958 - protein, 19 aa, Mycobacterium
VPRGISFLLNRNRLNVAIS

SEQ ID NO: 1294959 - protein, 18 aa, Mycobacterium
VPRKGIPLVAKRLGQGIG

SEQ ID NO: 1294960 - protein, 17 aa, Mycobacterium
VPRVIGLKIDAARKKLE

SEQ ID NO: 1294961 - protein, 24 aa, Mycobacterium
VPSDLLCVGTDWSATQGDSATTPV

SEQ ID NO: 1294962 - protein, 22 aa, Mycobacterium
VPSDMKGLWGFVPACSTPDAAD

SEQ ID NO: 1294963 - protein, 17 aa, Mycobacterium
VPVAGGWEVSGASVPTL

SEQ ID NO: 1294964 - protein, 24 aa, Mycobacterium
VPVDSWRIHRCIGMDGTTLVRALA

SEQ ID NO: 1294965 - protein, 17 aa, Mycobacterium
VPVKEYKPMMGRQDTRV

SEQ ID NO: 1294966 - protein, 18 aa, Mycobacterium
VPVNWRLAAPEMRHIIAD

SEQ ID NO: 1294967 - protein, 17 aa, Mycobacterium
VPVPADWLARRRPGETI

SEQ ID NO: 1294968 - protein, 22 aa, Mycobacterium
VPVPGIAASLFARFLSRQDESP

SEQ ID NO: 1294969 - protein, 17 aa, Mycobacterium
VPVSIEAPVQWPAPAGV

SEQ ID NO: 1294970 - protein, 19 aa, Mycobacterium
VPWTVVWSFHLMPRGTDRC

SEQ ID NO: 1294971 - protein, 21 aa, Mycobacterium
VPYYRVLELAPWLNWPQPNFP

SEQ ID NO: 1294972 - protein, 24 aa, Mycobacterium
VQAAVKVLAAWDWQVRPTAVMALD

SEQ ID NO: 1294973 - protein, 22 aa, Mycobacterium
VQAIAVCLLWSFREPSHEQRVA

SEQ ID NO: 1294974 - protein, 26 aa, Mycobacterium
VQAVWKPEDQWGLGIDNIEYFRPTGE

SEQ ID NO: 1294975 - protein, 21 aa, Mycobacterium
VQGGRLHFCYNFLGEYEQTLA

SEQ ID NO: 1294976 - protein, 31 aa, Mycobacterium; identical to SEQ ID NO: 780704

SEQ ID NO: 1294977 - protein, 20 aa, Mycobacterium
VQIGKFRLVFLTGPKGADGG

SEQ ID NO: 1294978 - protein, 25 aa, Mycobacterium
VQLTRKRLGTGLIEAFSTPCPHCAG

SEQ ID NO: 1294979 - protein, 23 aa, Mycobacterium
VQRLEMVRRISLEIDSDVVELGT

SEQ ID NO: 1294980 - protein, 20 aa, Mycobacterium
VQTGIARTGAWFACEHDGIV

SEQ ID NO: 1294981 - protein, 19 aa, Mycobacterium
VQYPFPIKDLVVLDNALKY

SEQ ID NO: 1294982 - protein, 25 aa, Mycobacterium
VRAAIDVLAAWNWQQRPVAVLAMDS

SEQ ID NO: 1294983 - protein, 18 aa, Mycobacterium
VRAPIIAWIGIQIDSMHE

SEQ ID NO: 1294984 - protein, 18 aa, Mycobacterium
VRAPWLMRAGLLPRGSRQ

SEQ ID NO: 1294985 - protein, 19 aa, Mycobacterium
VRDACSMLGLDPLYVANEG

SEQ ID NO: 1294986 - protein, 17 aa, Mycobacterium
VRDPHGWAGYLTEAIDT

SEQ ID NO: 1294987 - protein, 23 aa, Mycobacterium
VRDPREPGGFAVLIDGAEPEGPA

SEQ ID NO: 1294988 - protein, 20 aa, Mycobacterium
VREACLWSRGLSDGGVRRRA

SEQ ID NO: 1294989 - protein, 26 aa, Mycobacterium
VRFSQEIAWWVWLCWDQQLRKIEPSL

SEQ ID NO: 1294990 - protein, 23 aa, Mycobacterium
VRFSYRWDFGRNRFIMMDSRNGR

SEQ ID NO: 1294991 - protein, 17 aa, Mycobacterium
VRFTFWGAEEVSMDGSK

SEQ ID NO: 1294992 - protein, 17 aa, Mycobacterium
VRGLHRFAAAEGITTVD

SEQ ID NO: 1294993 - protein, 22 aa, Mycobacterium
VRGRGGASLGRFWAEEGPLSYL

SEQ ID NO: 1294994 - protein, 23 aa, Mycobacterium
VRHDWPVRTGIIVGRLDADGSRF

SEQ ID NO: 1294995 - protein, 23 aa, Mycobacterium
VRILPEHIRRGWIAMGRAAIEGR

SEQ ID NO: 1294996 - protein, 18 aa, Mycobacterium
VRLAELFLEAGLPAGVFQ

SEQ ID NO: 1294997 - protein, 19 aa, Mycobacterium
VRLEARWLKPTAYMMAKFG

SEQ ID NO: 1294998 - protein, 17 aa, Mycobacterium
VRLIAGAQLDGWQSYPD

SEQ ID NO: 1294999 - protein, 19 aa, Mycobacterium
VRLITLFATRVWRSDRADA

SEQ ID NO: 1295000 - protein, 20 aa, Mycobacterium
VRLLAMLPLAPLVPFAHDGV

SEQ ID NO: 1295001 - protein, 18 aa, Mycobacterium
VRLNHEFHRGVNVAAGSP

SEQ ID NO: 1295002 - protein, 18 aa, Mycobacterium
VRLVLDWNRPVKMFIETK

SEQ ID NO: 1295003 - protein, 18 aa, Mycobacterium
VRMGMRVQAVWKPEDQWG

SEQ ID NO: 1295004 - protein, 18 aa, Mycobacterium
VRNSLGLRCRWYVSAMET

SEQ ID NO: 1295005 - protein, 23 aa, Mycobacterium
VRPEPFGALLYHFGTRKLSFLKN

SEQ ID NO: 1295006 - protein, 18 aa, Mycobacterium
VRPILLWHALEECEHKAV

SEQ ID NO: 1295007 - protein, 18 aa, Mycobacterium
VRPRGFLEVRYLDSVPDA

SEQ ID NO: 1295008 - protein, 20 aa, Mycobacterium
VRQRIGMVFQHFNLFPHMTV

SEQ ID NO: 1295009 - protein, 20 aa, Mycobacterium
VRRAKLYYLRELRGKKAKIK

SEQ ID NO: 1295010 - protein, 19 aa, Mycobacterium
VRRARAKGVAVVWVQHSDA

SEQ ID NO: 1295011 - protein, 19 aa, Mycobacterium
VRRSRRITALVGRYRDVDL

SEQ ID NO: 1295012 - protein, 19 aa, Mycobacterium
VRSRIQLARFMTCSDAEPD

SEQ ID NO: 1295013 - protein, 18 aa, Mycobacterium
VRTARDWRKGIRHTNNTR

SEQ ID NO: 1295014 - protein, 19 aa, Mycobacterium
VRVFWPLMSAQLWDTNGAW

SEQ ID NO: 1295015 - protein, 17 aa, Mycobacterium
VRVGRSFRVHAKAVHDM

SEQ ID NO: 1295016 - protein, 19 aa, Mycobacterium
VRWLYKQFPGEDWAGWHVL

SEQ ID NO: 1295017 - protein, 18 aa, Mycobacterium
VRWPGRIPAGTVLNGIVS

SEQ ID NO: 1295018 - protein, 19 aa, Mycobacterium
VSARADWAPDFSINHVASL

SEQ ID NO: 1295019 - protein, 17 aa, Mycobacterium
VSCHRWKAPLNPRPNGP

SEQ ID NO: 1295020 - protein, 20 aa, Mycobacterium
VSDLIGMVRPRIVDIPLGAH

SEQ ID NO: 1295021 - protein, 18 aa, Mycobacterium
VSDLPRGGLIIANSDEFT

SEQ ID NO: 1295022 - protein, 17 aa, Mycobacterium
VSFDAWWFRLPRPADDS

SEQ ID NO: 1295023 - protein, 18 aa, Mycobacterium
VSFGEDWSWVRRAQEVGA

SEQ ID NO: 1295024 - protein, 17 aa, Mycobacterium
VSFPVECWKQPKVPDSG

SEQ ID NO: 1295025 - protein, 17 aa, Mycobacterium
VSGPLLSGGYWNLPEAT

SEQ ID NO: 1295026 - protein, 21 aa, Mycobacterium
VSIEAPVQWPAPAGVRARAAL

SEQ ID NO: 1295027 - protein, 22 aa, Mycobacterium
VSKICWRTRLVVDSQVWALLDG

SEQ ID NO: 1295028 - protein, 21 aa, Mycobacterium
VSLELFGRLGYFDTSVDAIAK

SEQ ID NO: 1295029 - protein, 17 aa, Mycobacterium
VSLRAGSDIAFLGGVIN

SEQ ID NO: 1295030 - protein, 17 aa, Mycobacterium
VSNAGFWPGGGGPLYTA

SEQ ID NO: 1295031 - protein, 17 aa, Mycobacterium
VSPEPAAVWALAGSARR

SEQ ID NO: 1295032 - protein, 25 aa, Mycobacterium
VSPPTKWHLIVPFLNVLPGGMFAGA

SEQ ID NO: 1295033 - protein, 20 aa, Mycobacterium
VSPPYYRLVLGMPPLAAEAV

SEQ ID NO: 1295034 - protein, 17 aa, Mycobacterium
VSPSTRFVSWVTGKYVY

SEQ ID NO: 1295035 - protein, 18 aa, Mycobacterium
VSPVDFWQYPTVDALAKF

SEQ ID NO: 1295036 - protein, 22 aa, Mycobacterium
VSPWRLCEYRAALQDPDWSHFR

SEQ ID NO: 1295037 - protein, 20 aa, Mycobacterium
VSTWWPWRGRTVHVARAAVP

SEQ ID NO: 1295038 - protein, 18 aa, Mycobacterium
VSVATPFLLTGLIAPAMV

SEQ ID NO: 1295039 - protein, 17 aa, Mycobacterium
VSVGFNWTMGEHVTPPK

SEQ ID NO: 1295040 - protein, 18 aa, Mycobacterium
VTEVLRLLAADPDAPAAD

SEQ ID NO: 1295041 - protein, 19 aa, Mycobacterium
VTGRTALPGFGRHLQLARP

SEQ ID NO: 1295042 - protein, 18 aa, Mycobacterium
VTLNEEFPRLKVYRGPRK

SEQ ID NO: 1295043 - protein, 24 aa, Mycobacterium
VTLSVPLSDIWIDIRFTLPAATVD

SEQ ID NO: 1295044 - protein, 17 aa, Mycobacterium
VTLTWGRILFTFFNTQA

SEQ ID NO: 1295045 - protein, 17 aa, Mycobacterium
VTLYGLPLVARRRVGYA

SEQ ID NO: 1295046 - protein, 22 aa, Mycobacterium
VTNCARTAFDLGRRLPRDDAVA

SEQ ID NO: 1295047 - protein, 17 aa, Mycobacterium
VTNGIPWRRPIASLNYL

SEQ ID NO: 1295048 - protein, 17 aa, Mycobacterium
VTPGGLFLALPGARSDG

SEQ ID NO: 1295049 - protein, 21 aa, Mycobacterium
VTRISEFLTHPAFTRYRTETE

SEQ ID NO: 1295050 - protein, 25 aa, Mycobacterium
VTRNGTVCGFVMQLIPAQLFGTQTL

SEQ ID NO: 1295051 - protein, 17 aa, Mycobacterium
VTTCLTFAVAADGAHIT

SEQ ID NO: 1295052 - protein, 18 aa, Mycobacterium
VTVGLVFRALFGEPDLLS

SEQ ID NO: 1295053 - protein, 24 aa, Mycobacterium
VTVKRFRRTLAWFIYRKPGGRVAL

SEQ ID NO: 1295054 - protein, 25 aa, Mycobacterium
VTVTWSLPSARAWWEMTWQGRPDPS

SEQ ID NO: 1295055 - protein, 17 aa, Mycobacterium
VTWSLPSARAWWEMTWK

SEQ ID NO: 1295056 - protein, 25 aa, Mycobacterium
VVAADWPRLAAAYHTRAQLHILDDL

SEQ ID NO: 1295057 - protein, 18 aa, Mycobacterium
VVASGAWPSAELIEGGPT

SEQ ID NO: 1295058 - protein, 23 aa, Mycobacterium
VVCARSGVRWTLLAGTHVRRLLR

SEQ ID NO: 1295059 - protein, 18 aa, Mycobacterium
VVCVGVLVSVDLVGGVVR

SEQ ID NO: 1295060 - protein, 17 aa, Mycobacterium
VVFDDRWASAREDLVKI

SEQ ID NO: 1295061 - protein, 17 aa, Mycobacterium
VVGHSFGGAIALNLAAV

SEQ ID NO: 1295062 - protein, 17 aa, Mycobacterium
VVHGGPWYRDSWGFDAG

SEQ ID NO: 1295063 - protein, 17 aa, Mycobacterium
VVIGRGCLGRPWLFAEL

SEQ ID NO: 1295064 - protein, 18 aa, Mycobacterium
VVIPEMWRDPATGEVLED

SEQ ID NO: 1295065 - protein, 19 aa, Mycobacterium
VVLGDAWELLKFLDDASFT

SEQ ID NO: 1295066 - protein, 17 aa, Mycobacterium
VVLRPGTGWTRYSLLET

SEQ ID NO: 1295067 - protein, 17 aa, Mycobacterium
VVMAHGFGGTKDSGLEP

SEQ ID NO: 1295068 - protein, 23 aa, Mycobacterium
VVPLMPVWRNFFLGQELRKKSFP

SEQ ID NO: 1295069 - protein, 17 aa, Mycobacterium
VVRMFPIPPIALGLRTG

SEQ ID NO: 1295070 - protein, 19 aa, Mycobacterium
VVRPFLKYQIITVAAPETA

SEQ ID NO: 1295071 - protein, 19 aa, Mycobacterium
VVVALRYAQMVTFTPLQLT

SEQ ID NO: 1295072 - protein, 20 aa, Mycobacterium
VWAEPGRWWALVRVACAGEL

SEQ ID NO: 1295073 - protein, 19 aa, Mycobacterium
VWAMFEWGRSHLPNNGRLR

SEQ ID NO: 1295074 - protein, 23 aa, Mycobacterium
VWRAGAFGVLEWASLMFASIYLG

SEQ ID NO: 1295075 - protein, 23 aa, Mycobacterium
VWTSLAHLCQWGLATVRTDPDAP

SEQ ID NO: 1295076 - protein, 17 aa, Mycobacterium
VYALDWPGESPLRPSYD

SEQ ID NO: 1295077 - protein, 17 aa, Mycobacterium
VYCELDFTDPLELAVAT

SEQ ID NO: 1295078 - protein, 17 aa, Mycobacterium
VYCELDFTDPLELTVAT

SEQ ID NO: 1295079 - protein, 24 aa, Mycobacterium
VYFELRLGDAWVWDMYRPARFVKQ

SEQ ID NO: 1295080 - protein, 19 aa, Mycobacterium
VYFPRGGMRAVPDAMAAAA

SEQ ID NO: 1295081 - protein, 18 aa, Mycobacterium
VYGTLPWHPDLWLDSEDA

SEQ ID NO: 1295082 - protein, 18 aa, Mycobacterium
VYHRHRWILATASFGPPL

SEQ ID NO: 1295083 - protein, 17 aa, Mycobacterium
VYLGCDWENVPLHLPST

SEQ ID NO: 1295084 - protein, 17 aa, Mycobacterium
VYRHWKNKGALIVDALR

SEQ ID NO: 1295085 - protein, 18 aa, Mycobacterium
VYRHWKNKGALIVDALRT

SEQ ID NO: 1295086 - protein, 18 aa, Mycobacterium
VYSGFAFGMGLERTLQFR

SEQ ID NO: 1295087 - protein, 19 aa, Mycobacterium
VYSGYRFVRHAAATGKPVA

SEQ ID NO: 1295088 - protein, 20 aa, Mycobacterium
VYYRRALVLAASFGRASDYP

SEQ ID NO: 1295089 - protein, 17 aa, Mycobacterium
WAAAGSWLGPADPVSTD

SEQ ID NO: 1295090 - protein, 22 aa, Mycobacterium
WAAEIYADLGLRFDGARAEAVS

SEQ ID NO: 1295091 - protein, 19 aa, Mycobacterium
WAAYAGRVVAIWSDGDSHR

SEQ ID NO: 1295092 - protein, 19 aa, Mycobacterium
WADDGVRGYSLHPGGIVST

SEQ ID NO: 1295093 - protein, 25 aa, Mycobacterium
WADKPRLLATFPFPHVLTMSVTLAD

SEQ ID NO: 1295094 - protein, 18 aa, Mycobacterium
WADSFGGLVYDATAITEP

SEQ ID NO: 1295095 - protein, 18 aa, Mycobacterium
WAEDIFKIVSFDCDLAEE

SEQ ID NO: 1295096 - protein, 19 aa, Mycobacterium
WAEPSEIAGAFVFMASDAA

SEQ ID NO: 1295097 - protein, 17 aa, Mycobacterium
WAIGYRPDYRWIEASAF

SEQ ID NO: 1295098 - protein, 17 aa, Mycobacterium
WALAVKMSPVLSGASAV

SEQ ID NO: 1295099 - protein, 17 aa, Mycobacterium
WALCLASGTPWQGKAVD

SEQ ID NO: 1295100 - protein, 18 aa, Mycobacterium
WALKELPPRIAGREYDVL

SEQ ID NO: 1295101 - protein, 17 aa, Mycobacterium
WARRPASLEPYADTPAK

SEQ ID NO: 1295102 - protein, 23 aa, Mycobacterium
WARSGYLQPHWPKPYGRGADSVE

SEQ ID NO: 1295103 - protein, 23 aa, Mycobacterium
WASWCGPCKAFAPTFAASSEKHP

SEQ ID NO: 1295104 - protein, 17 aa, Mycobacterium
WCFELPRAPILHVQGKQ

SEQ ID NO: 1295105 - protein, 20 aa, Mycobacterium
WCRSAEAVRLFRFDRIVDAR

SEQ ID NO: 1295106 - protein, 19 aa, Mycobacterium
WDGFRSICFRDGEEVELGS

SEQ ID NO: 1295107 - protein, 20 aa, Mycobacterium
WDHAIAFARWALGDACPTDI

SEQ ID NO: 1295108 - protein, 18 aa, Mycobacterium
WDPALSLRGKKVAIIGAG

SEQ ID NO: 1295109 - protein, 17 aa, Mycobacterium
WDPGKDFAMVSARETGP

SEQ ID NO: 1295110 - protein, 22 aa, Mycobacterium
WDPPKLKAFVDMLVPFKPFSSV

SEQ ID NO: 1295111 - protein, 19 aa, Mycobacterium
WDSLWVYDHFHTVPVPTAE

SEQ ID NO: 1295112 - protein, 19 aa, Mycobacterium
WEALAWLAATSLEYGAPLR

SEQ ID NO: 1295113 - protein, 17 aa, Mycobacterium
WEALGGMNSYLGRPTSP

SEQ ID NO: 1295114 - protein, 23 aa, Mycobacterium
WEEAVALAADWIWERSREEDLAP

SEQ ID NO: 1295115 - protein, 19 aa, Mycobacterium
WEHGRFNAPYLRDALLSAG

SEQ ID NO: 1295116 - protein, 21 aa, Mycobacterium
WELGIGVLLTGVWNTLQIASA

SEQ ID NO: 1295117 - protein, 22 aa, Mycobacterium
WERHPAMLAAYFRARTGPSGKR

SEQ ID NO: 1295118 - protein, 18 aa, Mycobacterium
WESLSLKGSADFHALEYR

SEQ ID NO: 1295119 - protein, 19 aa, Mycobacterium
WEVPSGWRIAGRAATPFRL

SEQ ID NO: 1295120 - protein, 17 aa, Mycobacterium
WFAAYAYWYFKLYGHQD

SEQ ID NO: 1295121 - protein, 18 aa, Mycobacterium
WFCGLTWPAKPLVAQDGP

SEQ ID NO: 1295122 - protein, 21 aa, Mycobacterium
WFDLCAMTGHVEWIDEDSPLS

SEQ ID NO: 1295123 - protein, 17 aa, Mycobacterium
WFKDEFTHLGEPWLEHD

SEQ ID NO: 1295124 - protein, 26 aa, Mycobacterium
WFPGKKGGPGWVEWGGCGMVNPNVLR

SEQ ID NO: 1295125 - protein, 22 aa, Mycobacterium
WFPKDVPAWSVRWVFFHMIEEL

SEQ ID NO: 1295126 - protein, 20 aa, Mycobacterium
WFQWHFDRWTPPPGATEIAR

SEQ ID NO: 1295127 - protein, 21 aa, Mycobacterium
WFSPVFLRNATAFGFSPRLRA

SEQ ID NO: 1295128 - protein, 20 aa, Mycobacterium
WGAGDTMVWLRHFNAAAAAR

SEQ ID NO: 1295129 - protein, 20 aa, Mycobacterium
WGAPVAWTFAWLHPQRCAGV

SEQ ID NO: 1295130 - protein, 20 aa, Mycobacterium
WGAPVAWTFAWLHPQRCRGV

SEQ ID NO: 1295131 - protein, 19 aa, Mycobacterium
WGAVWGRDGLPLKTRSMLN

SEQ ID NO: 1295132 - protein, 17 aa, Mycobacterium
WGDGWVKLVGDWIDRDT

SEQ ID NO: 1295133 - protein, 21 aa, Mycobacterium
WGEVIFPSLGMWASTFRTPEL

SEQ ID NO: 1295134 - protein, 17 aa, Mycobacterium
WGFHHLGSFAVEYRKRW

SEQ ID NO: 1295135 - protein, 17 aa, Mycobacterium
WGHKGGWQLANRSGGAN

SEQ ID NO: 1295136 - protein, 24 aa, Mycobacterium
WGKPEEMAELLAFCAGDKAGYLTG

SEQ ID NO: 1295137 - protein, 18 aa, Mycobacterium
WGTFTYRPSKAARHAAAA

SEQ ID NO: 1295138 - protein, 20 aa, Mycobacterium
WGVPLKIMYALGFAGDLAAA

SEQ ID NO: 1295139 - protein, 17 aa, Mycobacterium
WGWLPLLTGVAVRDAVA

SEQ ID NO: 1295140 - protein, 17 aa, Mycobacterium
WHARLGTAAVCWRLRRR

SEQ ID NO: 1295141 - protein, 23 aa, Mycobacterium
WHERETYDFFGLIFDGHPALTRI

SEQ ID NO: 1295142 - protein, 20 aa, Mycobacterium
WHSLARLAIRDDIYGSLRAL

SEQ ID NO: 1295143 - protein, 17 aa, Mycobacterium
WIDGPRVIPAGHAITPT

SEQ ID NO: 1295144 - protein, 18 aa, Mycobacterium
WIEYGLKRTFVFRETATW

SEQ ID NO: 1295145 - protein, 19 aa, Mycobacterium
WIPPPRLDTGQARLNHYHR

SEQ ID NO: 1295146 - protein, 20 aa, Mycobacterium
WIQRDGSWYQAQWIDYELEA

SEQ ID NO: 1295147 - protein, 17 aa, Mycobacterium
WIRRCLIVVPGSLVEQW

SEQ ID NO: 1295148 - protein, 21 aa, Mycobacterium
WITPRFGPRVGWLAGAHVSAK

SEQ ID NO: 1295149 - protein, 19 aa, Mycobacterium
WKALCERVINRPELVEDER

SEQ ID NO: 1295150 - protein, 22 aa, Mycobacterium
WKDGEALFLRCNIWREAAENVA

SEQ ID NO: 1295151 - protein, 21 aa, Mycobacterium
WKHGVCAALGWPHDTQADIAR

SEQ ID NO: 1295152 - protein, 19 aa, Mycobacterium
WKIVAGFMREQIPLQLPAG

SEQ ID NO: 1295153 - protein, 20 aa, Mycobacterium
WKLYGKKTWGTLCEAADIIT

SEQ ID NO: 1295154 - protein, 17 aa, Mycobacterium
WKSMITDGLAMRHGKDL

SEQ ID NO: 1295155 - protein, 17 aa, Mycobacterium
WKVFLSLVREGFEKDKT

SEQ ID NO: 1295156 - protein, 18 aa, Mycobacterium
WKVPRAWLDSGVVKEAHS

SEQ ID NO: 1295157 - protein, 18 aa, Mycobacterium
WLAARGMTGLLQRTVVVL

SEQ ID NO: 1295158 - protein, 19 aa, Mycobacterium
WLAQSAVLWPGPAVVSSSK

SEQ ID NO: 1295159 - protein, 19 aa, Mycobacterium
WLARKRIQQDWGISDEVMR

SEQ ID NO: 1295160 - protein, 19 aa, Mycobacterium
WLASQGHAPYAWSVLGAVA

SEQ ID NO: 1295161 - protein, 23 aa, Mycobacterium
WLCEAAHLPVIWATQVLDQLAKS

SEQ ID NO: 1295162 - protein, 20 aa, Mycobacterium
WLDAEWRLTAGHVRVIVALG

SEQ ID NO: 1295163 - protein, 23 aa, Mycobacterium
WLDRASSIAIAFVARRLSAEPVG

SEQ ID NO: 1295164 - protein, 18 aa, Mycobacterium
WLDSWRALGRDGAAMDRV

SEQ ID NO: 1295165 - protein, 18 aa, Mycobacterium
WLENLGFQFERSYYPGKV

SEQ ID NO: 1295166 - protein, 17 aa, Mycobacterium
WLFFPGWDTTTAELPPM

SEQ ID NO: 1295167 - protein, 17 aa, Mycobacterium
WLKAFRESPEAVVALYA

SEQ ID NO: 1295168 - protein, 20 aa, Mycobacterium
WLLGNGGLDWATKRTAESSS

SEQ ID NO: 1295169 - protein, 18 aa, Mycobacterium
WLPGPRELRAWTLAAGRP

SEQ ID NO: 1295170 - protein, 17 aa, Mycobacterium
WLQREGTCLLLAPHHDV

SEQ ID NO: 1295171 - protein, 25 aa, Mycobacterium
WLRAWPAPGGDLWAVPTGWRVGDHA

SEQ ID NO: 1295172 - protein, 18 aa, Mycobacterium
WLRSWPVAPSSPWEVPSG

SEQ ID NO: 1295173 - protein, 22 aa, Mycobacterium
WLTPEPRYSWGLGSCELPAYAE

SEQ ID NO: 1295174 - protein, 24 aa, Mycobacterium
WMFDYYPLRVLREFDDGSCEATMT

SEQ ID NO: 1295175 - protein, 17 aa, Mycobacterium
WMWESNVLGTLLVTRAL

SEQ ID NO: 1295176 - protein, 18 aa, Mycobacterium
WNATPRWLRASAVVDAGT

SEQ ID NO: 1295177 - protein, 20 aa, Mycobacterium
WNEICSLPIALITSLVKQAQ

SEQ ID NO: 1295178 - protein, 17 aa, Mycobacterium
WNFLNVVRPLGVQLDNL

SEQ ID NO: 1295179 - protein, 22 aa, Mycobacterium
WNFPMTIAAWGFAPALAAGNAV

SEQ ID NO: 1295180 - protein, 19 aa, Mycobacterium
WNLDTGYDWAHRFDDAARE

SEQ ID NO: 1295181 - protein, 18 aa, Mycobacterium
WNRTDYRPLEGFVYAITP

SEQ ID NO: 1295182 - protein, 19 aa, Mycobacterium
WPAAMAMAAGLDFGGVVVN

SEQ ID NO: 1295183 - protein, 18 aa, Mycobacterium
WPDFPVDGLYKFRIHGAD

SEQ ID NO: 1295184 - protein, 20 aa, Mycobacterium
WPDHPFALGVHWHPEDPLMH

SEQ ID NO: 1295185 - protein, 17 aa, Mycobacterium
WPDLALRAGRVGYPALR

SEQ ID NO: 1295186 - protein, 19 aa, Mycobacterium
WPDLCFTAAVGRSHLRHRA

SEQ ID NO: 1295187 - protein, 19 aa, Mycobacterium
WPERLRPALSTVGFATELR

SEQ ID NO: 1295188 - protein, 18 aa, Mycobacterium
WPEVYPRLLRVMDADPIC

SEQ ID NO: 1295189 - protein, 20 aa, Mycobacterium
WPKALMMCRRMIGAGTTVAD

SEQ ID NO: 1295190 - protein, 17 aa, Mycobacterium
WPLMSAQLWDTNGAWVA

SEQ ID NO: 1295191 - protein, 18 aa, Mycobacterium
WPPVRRIDGAYGDRNLVC

SEQ ID NO: 1295192 - protein, 20 aa, Mycobacterium
WPRQEGRRKFGFYGDDMAAA

SEQ ID NO: 1295193 - protein, 19 aa, Mycobacterium
WPSHILVPAIHRNRAEVRE

SEQ ID NO: 1295194 - protein, 20 aa, Mycobacterium
WPVGPSVRIYPLLKELTLDI

SEQ ID NO: 1295195 - protein, 24 aa, Mycobacterium
WQDELFFKFGLRFDLLTNQLIDAN

SEQ ID NO: 1295196 - protein, 18 aa, Mycobacterium
WQPDIWRGFADELGILGA

SEQ ID NO: 1295197 - protein, 22 aa, Mycobacterium
WQQQQARLFGGGAWSGAAANAA

SEQ ID NO: 1295198 - protein, 18 aa, Mycobacterium
WQSALFPSGRAFGYIAYP

SEQ ID NO: 1295199 - protein, 22 aa, Mycobacterium
WRAKVAQPHGWMKAAVGLTNYL

SEQ ID NO: 1295200 - protein, 18 aa, Mycobacterium
WRATLIVRESACLSVEDR

SEQ ID NO: 1295201 - protein, 19 aa, Mycobacterium
WRATLIVRESACLSVEHRR

SEQ ID NO: 1295202 - protein, 21 aa, Mycobacterium
WRGAAERVLRGFALSLLVPQR

SEQ ID NO: 1295203 - protein, 21 aa, Mycobacterium
WRGHGGLERFFLAMSRTWSAF

SEQ ID NO: 1295204 - protein, 17 aa, Mycobacterium
WRGKAFDNDAGWRIDYQ

SEQ ID NO: 1295205 - protein, 25 aa, Mycobacterium
WRGKAVLLKLIWRMFRARVFGDRMA

SEQ ID NO: 1295206 - protein, 19 aa, Mycobacterium
WRGSQPTLWRAFAPGGERR

SEQ ID NO: 1295207 - protein, 17 aa, Mycobacterium
WRIFVDLALAMNRPLFG

SEQ ID NO: 1295208 - protein, 20 aa, Mycobacterium
WRKPLVRRWYGFAEMQKQVA

SEQ ID NO: 1295209 - protein, 17 aa, Mycobacterium
WRLFPAVGQSFFSTGYR

SEQ ID NO: 1295210 - protein, 19 aa, Mycobacterium
WRLLFPLLMETGLRLNDAL

SEQ ID NO: 1295211 - protein, 20 aa, Mycobacterium
WRPDGGFSLHVFHKNNELAG

SEQ ID NO: 1295212 - protein, 17 aa, Mycobacterium
WRQAGCSMCLGMNPDQL

SEQ ID NO: 1295213 - protein, 17 aa, Mycobacterium
WRRLGVRYPDTIATHSA

SEQ ID NO: 1295214 - protein, 17 aa, Mycobacterium
WRRPRWSVRLQTGPIGD

SEQ ID NO: 1295215 - protein, 17 aa, Mycobacterium
WRSVLWARWPSAGPPPH

SEQ ID NO: 1295216 - protein, 21 aa, Mycobacterium
WRWDTDWFWCSRAFGAQNPRI

SEQ ID NO: 1295217 - protein, 20 aa, Mycobacterium
WRWMWEANVLGTLHVTRALL

SEQ ID NO: 1295218 - protein, 18 aa, Mycobacterium
WRWNPWVMAARGYAVLLP

SEQ ID NO: 1295219 - protein, 18 aa, Mycobacterium
WRWRDRVGDGWKGRTPNL

SEQ ID NO: 1295220 - protein, 19 aa, Mycobacterium
WRYPFEGRMHAVTAMAIAK

SEQ ID NO: 1295221 - protein, 19 aa, Mycobacterium
WSAGDSFVVPNWMWHAHMN

SEQ ID NO: 1295222 - protein, 24 aa, Mycobacterium
WSHLCDRLWLIAAIEHYTAVMGDF

SEQ ID NO: 1295223 - protein, 17 aa, Mycobacterium
WSKRIVMEYVDEMCLHL

SEQ ID NO: 1295224 - protein, 20 aa, Mycobacterium
WSLPSARAWWEMTWKARPDP

SEQ ID NO: 1295225 - protein, 19 aa, Mycobacterium
WSRDVWKQLAEVGVLGLGF

SEQ ID NO: 1295226 - protein, 20 aa, Mycobacterium
WSRFSVDLIPAMGRAIFSRG

SEQ ID NO: 1295227 - protein, 17 aa, Mycobacterium
WSRWWPDLRLVVVEDRG

SEQ ID NO: 1295228 - protein, 21 aa, Mycobacterium
WSVDDVEAFWGALWDYFDLGE

SEQ ID NO: 1295229 - protein, 21 aa, Mycobacterium
WSVELDERWVIIGPNGAGKTS

SEQ ID NO: 1295230 - protein, 17 aa, Mycobacterium
WSVPLHWAGVHAGILAN

SEQ ID NO: 1295231 - protein, 19 aa, Mycobacterium
WTEEIFKAFNFQTDVTFDE

SEQ ID NO: 1295232 - protein, 17 aa, Mycobacterium
WTELLTASGFRVVTVDR

SEQ ID NO: 1295233 - protein, 17 aa, Mycobacterium
WTEWSLRFFYGSPAYSQ

SEQ ID NO: 1295234 - protein, 19 aa, Mycobacterium
WTLLRRRNGVLPAIEQALH

SEQ ID NO: 1295235 - protein, 18 aa, Mycobacterium
WTMFKQNIGIMIAVAQLA

SEQ ID NO: 1295236 - protein, 21 aa, Mycobacterium
WTNATAPAWARPLITVNPVLT

SEQ ID NO: 1295237 - protein, 19 aa, Mycobacterium
WTQWIFLQIYNAWFDTAQN

SEQ ID NO: 1295238 - protein, 18 aa, Mycobacterium
WTVQLAWKAGLSDNVAHF

SEQ ID NO: 1295239 - protein, 18 aa, Mycobacterium
WTVTKWVAADAERLRFDP

SEQ ID NO: 1295240 - protein, 17 aa, Mycobacterium
WVAPAESVWACRTLAAT

SEQ ID NO: 1295241 - protein, 19 aa, Mycobacterium
WVAVMDCGRVLNPKLATNQ

SEQ ID NO: 1295242 - protein, 21 aa, Mycobacterium
WVHFPEGFGGLGLSRGLQAVA

SEQ ID NO: 1295243 - protein, 17 aa, Mycobacterium
WVPEFLSLPIAIENSLK

SEQ ID NO: 1295244 - protein, 18 aa, Mycobacterium
WVRRGGYVLSSFAPATLP

SEQ ID NO: 1295245 - protein, 20 aa, Mycobacterium
WVYTSGFRKLVIVNAHATNG

SEQ ID NO: 1295246 - protein, 17 aa, Mycobacterium
WWLDRMVSVIASSAGIR

SEQ ID NO: 1295247 - protein, 19 aa, Mycobacterium
WWPQLGVAGIGLWAENVLH

SEQ ID NO: 1295248 - protein, 19 aa, Mycobacterium
WYCGGHGACLSSFNDGEKV

SEQ ID NO: 1295249 - protein, 17 aa, Mycobacterium
WYIGSILRHVDFLASDV

SEQ ID NO: 1295250 - protein, 19 aa, Mycobacterium
WYRAMLWDRYHQVPDHVPA

SEQ ID NO: 1295251 - protein, 19 aa, Mycobacterium
WYVIREMPQRVTYRGEPCA

SEQ ID NO: 1295252 - protein, 17 aa, Mycobacterium
YAAVYGYDERAMAKIVV

SEQ ID NO: 1295253 - protein, 27 aa, Mycobacterium
YADAGIGFSCLWPETYIATSAVSNLAD

SEQ ID NO: 1295254 - protein, 21 aa, Mycobacterium
YAEGRLGWRTLDFELEVLQTG

SEQ ID NO: 1295255 - protein, 17 aa, Mycobacterium
YAFPNLKALNFVIVGYL

SEQ ID NO: 1295256 - protein, 19 aa, Mycobacterium
YAFYGEVLFVLEVRRQPNL

SEQ ID NO: 1295257 - protein, 18 aa, Mycobacterium
YAHLRGFVLMPWLAAEPE

SEQ ID NO: 1295258 - protein, 24 aa, Mycobacterium
YAIAHLRYFAGLARTYAFQSSGPL

SEQ ID NO: 1295259 - protein, 18 aa, Mycobacterium
YAKMMFDVMVTRILTRLP

SEQ ID NO: 1295260 - protein, 24 aa, Mycobacterium
YARPTQEALYRWYKTVAEEYPDLP

SEQ ID NO: 1295261 - protein, 18 aa, Mycobacterium
YARRTIERLGRWLPRVVA

SEQ ID NO: 1295262 - protein, 19 aa, Mycobacterium
YARWYRFLLMWPGADKGLD

SEQ ID NO: 1295263 - protein, 17 aa, Mycobacterium
YASVYGYDERAMAKIVV

SEQ ID NO: 1295264 - protein, 18 aa, Mycobacterium
YAVPRLLARNGLTLQDFD

SEQ ID NO: 1295265 - protein, 17 aa, Mycobacterium
YAVTVFAEMSALAARIG

SEQ ID NO: 1295266 - protein, 22 aa, Mycobacterium
YCPPELPGLEPLWGKSVFQCPF

SEQ ID NO: 1295267 - protein, 19 aa, Mycobacterium
YCVRLKKALQVEGIAWTEV

SEQ ID NO: 1295268 - protein, 17 aa, Mycobacterium
YDACEIDEILTLRIMTM

SEQ ID NO: 1295269 - protein, 19 aa, Mycobacterium
YDAGLAWVHFPEGLGGLGV

SEQ ID NO: 1295270 - protein, 19 aa, Mycobacterium
YDFGGGFAHWGEAMNTDGR

SEQ ID NO: 1295271 - protein, 17 aa, Mycobacterium
YDGFSFLTVMWLEAMGF

SEQ ID NO: 1295272 - protein, 17 aa, Mycobacterium
YDIKKWINWAIRFFYSS

SEQ ID NO: 1295273 - protein, 20 aa, Mycobacterium
YDILFFWVARMMMFGTFVGD

SEQ ID NO: 1295274 - protein, 18 aa, Mycobacterium
YDLLEPWDLLVLVDALPD

SEQ ID NO: 1295275 - protein, 18 aa, Mycobacterium
YDMNAIPWSQLRVLAPTS

SEQ ID NO: 1295276 - protein, 17 aa, Mycobacterium
YDVMSMIGPQPLRRGDV

SEQ ID NO: 1295277 - protein, 18 aa, Mycobacterium
YDYIPTYILRGLTELHLE

SEQ ID NO: 1295278 - protein, 20 aa, Mycobacterium
YEALARWPALNGMNPEEVFD

SEQ ID NO: 1295279 - protein, 24 aa, Mycobacterium
YEDVTGRLRVRWVPQRVLQGVSYD

SEQ ID NO: 1295280 - protein, 21 aa, Mycobacterium
YEIKDPRLAGVTITDAKVTND

SEQ ID NO: 1295281 - protein, 22 aa, Mycobacterium
YEIKDPRLAGVTITDSKVTNDL

SEQ ID NO: 1295282 - protein, 23 aa, Mycobacterium
YEIKGCIAHGGLGWVYLAFDKNV

SEQ ID NO: 1295283 - protein, 21 aa, Mycobacterium
YEIVFKFVMGFPVWLTAKALG

SEQ ID NO: 1295284 - protein, 18 aa, Mycobacterium
YERCVWRCWYLPQHTRLH

SEQ ID NO: 1295285 - protein, 19 aa, Mycobacterium
YERRSLAIGSHWPFEQWGR

SEQ ID NO: 1295286 - protein, 27 aa, Mycobacterium
YERSTCFWQRIAYLYSRFDALVDEVKR

SEQ ID NO: 1295287 - protein, 28 aa, Mycobacterium
YERSTCFWQRIAYLYSRFDALVEEVKRV

SEQ ID NO: 1295288 - protein, 20 aa, Mycobacterium
YETMEALLLGAFISEGFVSE

SEQ ID NO: 1295289 - protein, 19 aa, Mycobacterium
YEVDCVIFASGFEISTEIS

SEQ ID NO: 1295290 - protein, 19 aa, Mycobacterium
YFAMTGWRLGWLLVPDELK

SEQ ID NO: 1295291 - protein, 19 aa, Mycobacterium
YFFESALSPNTFWVDLKNL

SEQ ID NO: 1295292 - protein, 19 aa, Mycobacterium
YFSEPFPIIGATLENYAQA

SEQ ID NO: 1295293 - protein, 17 aa, Mycobacterium
YGALIAVQWAARHPSRV

SEQ ID NO: 1295294 - protein, 18 aa, Mycobacterium
YGDVFSMTLPVFGPTVMV

SEQ ID NO: 1295295 - protein, 18 aa, Mycobacterium
YGEVLLVYVGENGPQATV

SEQ ID NO: 1295296 - protein, 23 aa, Mycobacterium
YGGFLAIRVFDFWVHERDITTPL

SEQ ID NO: 1295297 - protein, 21 aa, Mycobacterium
YGHSRACAWAIADGVIGRSTT

SEQ ID NO: 1295298 - protein, 17 aa, Mycobacterium
YGIDRWIVIGNDYIFPR

SEQ ID NO: 1295299 - protein, 20 aa, Mycobacterium
YGSLEIFSGLDLAIDRGSRV

SEQ ID NO: 1295300 - protein, 24 aa, Mycobacterium
YGSYAGLFIRMSWHAAGTYRIFDG

SEQ ID NO: 1295301 - protein, 18 aa, Mycobacterium
YHAELHWWTASFAEREGI

SEQ ID NO: 1295302 - protein, 24 aa, Mycobacterium
YHRYEVVRPVPIWQGSIAPAMGQP

SEQ ID NO: 1295303 - protein, 18 aa, Mycobacterium
YHTFGGWKRSGFGDLNQH

SEQ ID NO: 1295304 - protein, 18 aa, Mycobacterium
YILPRRRLAAALLERARE

SEQ ID NO: 1295305 - protein, 18 aa, Mycobacterium
YKAAGLQYYRPWILLLTD

SEQ ID NO: 1295306 - protein, 17 aa, Mycobacterium
YKGACIFLNRPGWPKGI

SEQ ID NO: 1295307 - protein, 24 aa, Mycobacterium
YKLLRSEWLEPRWMIGIDPESEGL

SEQ ID NO: 1295308 - protein, 25 aa, Mycobacterium
YKLLRSEWLEPRWMIGIDPQSEGLA

SEQ ID NO: 1295309 - protein, 23 aa, Mycobacterium
YKPRWGTSLATGWASIHGFPVGI

SEQ ID NO: 1295310 - protein, 20 aa, Mycobacterium
YKQFPGEDWAGWHVLVLVST

SEQ ID NO: 1295311 - protein, 23 aa, Mycobacterium
YKSEPWARLGVNVEHNFEPLYII

SEQ ID NO: 1295312 - protein, 17 aa, Mycobacterium
YLDEYAEVFGLLEHIEF

SEQ ID NO: 1295313 - protein, 19 aa, Mycobacterium
YLEGPCLTAAWEEKTVHVR

SEQ ID NO: 1295314 - protein, 17 aa, Mycobacterium
YLGERGWRTDSITATAL

SEQ ID NO: 1295315 - protein, 17 aa, Mycobacterium
YLHRNFCQVFRNAHHSW

SEQ ID NO: 1295316 - protein, 18 aa, Mycobacterium
YLPPSGFIAGIWSRNDDT

SEQ ID NO: 1295317 - protein, 17 aa, Mycobacterium
YLREFPMAFRFAVLNVI

SEQ ID NO: 1295318 - protein, 21 aa, Mycobacterium
YLRPRAVVFHRSLGAKFADVL

SEQ ID NO: 1295319 - protein, 19 aa, Mycobacterium
YLVLARWKLAIVLEQGFQR

SEQ ID NO: 1295320 - protein, 18 aa, Mycobacterium
YLVPHWPQPWGRAANVLE

SEQ ID NO: 1295321 - protein, 21 aa, Mycobacterium
YNCLKREGVHFIYELIDLTES

SEQ ID NO: 1295322 - protein, 17 aa, Mycobacterium
YNHGFLRQRMQVLQDEF

SEQ ID NO: 1295323 - protein, 20 aa, Mycobacterium
YNPLRFVKATMKWCRKAAEL

SEQ ID NO: 1295324 - protein, 21 aa, Mycobacterium
YNPLRFVKATMKWCRKAAELG

SEQ ID NO: 1295325 - protein, 25 aa, Mycobacterium
YNPLRFVKATMKWCRKAAELGTLTD

SEQ ID NO: 1295326 - protein, 23 aa, Mycobacterium
YNSDCGFFIRYCLDVGLDKYGQG

SEQ ID NO: 1295327 - protein, 22 aa, Mycobacterium
YNWQWECFRGADVPTEYAAARS

SEQ ID NO: 1295328 - protein, 22 aa, Mycobacterium
YPCDHFDVWPGHDWFDKTVSDQ

SEQ ID NO: 1295329 - protein, 26 aa, Mycobacterium
YPGEPLPRWQIGLFWRTDGEPLWADE

SEQ ID NO: 1295330 - protein, 18 aa, Mycobacterium
YPLKWGWLDVDDVVSTLT

SEQ ID NO: 1295331 - protein, 17 aa, Mycobacterium
YPNQKWPIAYNVDDITK

SEQ ID NO: 1295332 - protein, 20 aa, Mycobacterium
YPRDWPRPQHGWTLTIEGDP

SEQ ID NO: 1295333 - protein, 18 aa, Mycobacterium
YPWLESIGEWLARHPQGG

SEQ ID NO: 1295334 - protein, 17 aa, Mycobacterium
YQARCPLAAEVCRTTRP

SEQ ID NO: 1295335 - protein, 19 aa, Mycobacterium
YQPVNAWGIPTGRVEQRPA

SEQ ID NO: 1295336 - protein, 21 aa, Mycobacterium
YQRFRVGPARRSDRSGNGGGP

SEQ ID NO: 1295337 - protein, 17 aa, Mycobacterium
YQTGWKRSLTAMRSQRY

SEQ ID NO: 1295338 - protein, 19 aa, Mycobacterium
YRAALVAAWGRLRDDDCRR

SEQ ID NO: 1295339 - protein, 18 aa, Mycobacterium
YRCGEAWSTLVHHRPTGV

SEQ ID NO: 1295340 - protein, 17 aa, Mycobacterium
YRCGEAWSVLLRHRPTA

SEQ ID NO: 1295341 - protein, 20 aa, Mycobacterium
YRDADGWIYLAGRTADWMRV

SEQ ID NO: 1295342 - protein, 20 aa, Mycobacterium
YRDLAGFGRRFIDVSAEDLV

SEQ ID NO: 1295343 - protein, 22 aa, Mycobacterium
YRFIRDTTWVSVRWYQPGGPLT

SEQ ID NO: 1295344 - protein, 17 aa, Mycobacterium
YRFSEFRSEKTAPKDAG

SEQ ID NO: 1295345 - protein, 20 aa, Mycobacterium
YRGLARSVVYRWFTDPTSRS

SEQ ID NO: 1295346 - protein, 23 aa, Mycobacterium
YRHFPRRSDLILAVIEREIDDCI

SEQ ID NO: 1295347 - protein, 17 aa, Mycobacterium
YRIMHEFQIPLYDQMRE

SEQ ID NO: 1295348 - protein, 17 aa, Mycobacterium
YRLAELALRDRVPLVML

SEQ ID NO: 1295349 - protein, 17 aa, Mycobacterium
YRLAWARLHDCPVSSVR

SEQ ID NO: 1295350 - protein, 17 aa, Mycobacterium
YRLETLISLNIGTATGF

SEQ ID NO: 1295351 - protein, 19 aa, Mycobacterium
YRLEVDWATQMSYSGIYVH

SEQ ID NO: 1295352 - protein, 21 aa, Mycobacterium
YRLGLESVPFLLAVGDLLLGW

SEQ ID NO: 1295353 - protein, 17 aa, Mycobacterium
YRLGRSVARLEASLSAP

SEQ ID NO: 1295354 - protein, 19 aa, Mycobacterium
YRMRVAPSIFKHVMGIIRM

SEQ ID NO: 1295355 - protein, 19 aa, Mycobacterium
YRPGARFGPTHVREASRLL

SEQ ID NO: 1295356 - protein, 17 aa, Mycobacterium
YRPRPVVGIIAPWNYPV

SEQ ID NO: 1295357 - protein, 21 aa, Mycobacterium
YRQAIGVSITQVWGMTETSPI

SEQ ID NO: 1295358 - protein, 17 aa, Mycobacterium
YRQGPCLEAALDSLIVR

SEQ ID NO: 1295359 - protein, 17 aa, Mycobacterium
YRREVLEKIDLAAVDTK

SEQ ID NO: 1295360 - protein, 21 aa, Mycobacterium
YRRTAFDIGEWGLGFMTTSLE

SEQ ID NO: 1295361 - protein, 21 aa, Mycobacterium
YRRVESFRQLWAVSVDVSRAA

SEQ ID NO: 1295362 - protein, 18 aa, Mycobacterium
YRRYPNWPAMDMTSFTQD

SEQ ID NO: 1295363 - protein, 25 aa, Mycobacterium
YRSIWMFLKDLEFRQGFVDITVNGA

SEQ ID NO: 1295364 - protein, 19 aa, Mycobacterium
YRTEVDWATQMSYSGIYVH

SEQ ID NO: 1295365 - protein, 19 aa, Mycobacterium
YRVAGYRSGWLVITGPKEH

SEQ ID NO: 1295366 - protein, 17 aa, Mycobacterium
YRVDAVQAFELLRKLSQ

SEQ ID NO: 1295367 - protein, 17 aa, Mycobacterium
YRVGTVMRSRWDRASAA

SEQ ID NO: 1295368 - protein, 17 aa, Mycobacterium
YRYEFGWRSTGVGGELG

SEQ ID NO: 1295369 - protein, 18 aa, Mycobacterium
YRYHHLFGDVLRGRLRDL

SEQ ID NO: 1295370 - protein, 20 aa, Mycobacterium
YSHPDLRPGAAVPEGVSEAA

SEQ ID NO: 1295371 - protein, 20 aa, Mycobacterium
YSLVGGTAWSIRAGRAAARD

SEQ ID NO: 1295372 - protein, 17 aa, Mycobacterium
YSRLSWAVLDWNVNAIA

SEQ ID NO: 1295373 - protein, 23 aa, Mycobacterium
YSYYGEVLLDWIVERLANQKGSP

SEQ ID NO: 1295374 - protein, 22 aa, Mycobacterium
YTELRAPKLFNLRTDPYERADI

SEQ ID NO: 1295375 - protein, 17 aa, Mycobacterium
YTGHVVSALGWGTHSLA

SEQ ID NO: 1295376 - protein, 17 aa, Mycobacterium
YTPEWVRTVAIWAEASH

SEQ ID NO: 1295377 - protein, 17 aa, Mycobacterium
YTPITVMGVTVWRERDL

SEQ ID NO: 1295378 - protein, 18 aa, Mycobacterium
YTSAVAMARCDDKRLTRR

SEQ ID NO: 1295379 - protein, 24 aa, Mycobacterium
YVDFSLRLPDTFMLRFRDPGRIVV

SEQ ID NO: 1295380 - protein, 18 aa, Mycobacterium
YVDKRLSGVAAVQTLSRL

SEQ ID NO: 1295381 - protein, 24 aa, Mycobacterium
YVDLVCSWGPMILGHAHPAVVEAV

SEQ ID NO: 1295382 - protein, 24 aa, Mycobacterium
YVFCDATFCKARIGAHVVSQALVV

SEQ ID NO: 1295383 - protein, 20 aa, Mycobacterium
YVMECLQLMALRGAATLEVK

SEQ ID NO: 1295384 - protein, 22 aa, Mycobacterium
YVNARPAPLVAYWFGPDDTDFR

SEQ ID NO: 1295385 - protein, 21 aa, Mycobacterium
YVPCFKYLREMGALDDDGTVK

SEQ ID NO: 1295386 - protein, 23 aa, Mycobacterium
YVQRMAVVLGRRVWENAGSPDVD

SEQ ID NO: 1295387 - protein, 23 aa, Mycobacterium
YVSELRPGADFDFKPVTRGYADA

SEQ ID NO: 1295388 - protein, 17 aa, Mycobacterium
YVVFPTFQAKKGSLNQA

SEQ ID NO: 1295389 - protein, 21 aa, Mycobacterium
YWAPLCRLFGLFGAADDERFG

SEQ ID NO: 1295390 - protein, 18 aa, Mycobacterium
YWGGVCLNVGCIPSKALL

SEQ ID NO: 1295391 - protein, 19 aa, Mycobacterium
YWLDEWRAYIAPKKVKLAA

SEQ ID NO: 1295392 - protein, 21 aa, Mycobacterium
YWYARHLRLPPGVPAHLSGYL

SEQ ID NO: 1295393 - protein, 24 aa, Mycobacterium
TESTWHRWIAQYGGMKANEAKRLK

SEQ ID NO: 1295394 - protein, 30 aa, Mycobacterium; identical to SEQ ID NO: 782646

SEQ ID NO: 1295395 - protein, 25 aa, Mycobacterium
GRLRDELLNLWRFDSLLEARVIIED

SEQ ID NO: 1295396 - protein, 24 aa, Mycobacterium
MSPIRPNVIWAMDFQFDTTADGRT

SEQ ID NO: 1295397 - protein, 24 aa, Mycobacterium
ITSMPGIGFRLGAEFLAAVGDPAL

SEQ ID NO: 1295398 - protein, 26 aa, Mycobacterium
QPSQDRGWVILLARYQRPKAIRQSGV

SEQ ID NO: 1295399 - protein, 21 aa, Mycobacterium
SGERADWWWYTPFQPPPPTTN

SEQ ID NO: 1295400 - protein, 26 aa, Mycobacterium
DGGQFREWLGLLDPDIRYVVPVRTTR

SEQ ID NO: 1295401 - protein, 22 aa, Mycobacterium
EFKRDAVALYRDTEGATIAQIA

SEQ ID NO: 1295402 - protein, 22 aa, Mycobacterium
GRLHTPKRYSRRLRRVMYMSAL

SEQ ID NO: 1295403 - protein, 22 aa, Mycobacterium
ICRREVFRWLARYNTTRRHSYC

SEQ ID NO: 1295404 - protein, 22 aa, Mycobacterium
LARRRTNVLYALIRDNRTWQPD

SEQ ID NO: 1295405 - protein, 20 aa, Mycobacterium
NLVLLCPYHHRAHHRGVITI

SEQ ID NO: 1295406 - protein, 17 aa, Mycobacterium
RDFANLCRDLGVVQSMG

SEQ ID NO: 1295407 - protein, 25 aa, Mycobacterium
RYSRRLRRVMYMSALTAIRCDPDSK

SEQ ID NO: 1295408 - protein, 27 aa, Mycobacterium
TRYVGDITYLPLATGANLYLATVIDCC

SEQ ID NO: 1295409 - protein, 25 aa, Mycobacterium
GLAMAYKLIDAAAARWRAVNAPHLV

SEQ ID NO: 1295410 - protein, 20 aa, Mycobacterium
GSDYVYLWVDGIHLKVRLDQ

SEQ ID NO: 1295411 - protein, 18 aa, Mycobacterium
HKQANVLAALPKSAHASA

SEQ ID NO: 1295412 - protein, 23 aa, Mycobacterium
RLDQEKLCLLVMLGVRADGRKEL

SEQ ID NO: 1295413 - protein, 17 aa, Mycobacterium
DLSGSDYVYLWVDGIHL

SEQ ID NO: 1295414 - protein, 27 aa, Mycobacterium
ERKSRSVMLVHLPRLEGWGLAPPVKNG

SEQ ID NO: 1295415 - protein, 25 aa, Mycobacterium
GNKIPIRDLIRMAAHSRHYLAVFDD

SEQ ID NO: 1295416 - protein, 20 aa, Mycobacterium
IAHRLPLDFPDDESMRISHE

SEQ ID NO: 1295417 - protein, 23 aa, Mycobacterium
LNNRPRKVLGWKTPAEVFAQQLH

SEQ ID NO: 1295418 - protein, 22 aa, Mycobacterium
LPKQLRQTLTWDRGKELAAHAQ

SEQ ID NO: 1295419 - protein, 21 aa, Mycobacterium
NGVLRQYFPKGTDLSRWSAQD

SEQ ID NO: 1295420 - protein, 22 aa, Mycobacterium
AQRIMLIARDGGCTKPCCTVGA

SEQ ID NO: 1295421 - protein, 17 aa, Mycobacterium
CLELFEQGWSTGAAARE

SEQ ID NO: 1295422 - protein, 18 aa, Mycobacterium
DRVGRIFDQGRLDAVWTS

SEQ ID NO: 1295423 - protein, 22 aa, Mycobacterium
GRPRKTLGWDTPAERLRDLLLT

SEQ ID NO: 1295424 - protein, 28 aa, Mycobacterium
GVALLPGVKLLPIVALAEAIRGGAAIKP

SEQ ID NO: 1295425 - protein, 20 aa, Mycobacterium
IFDQGRLDAVWTSDITYLTC

SEQ ID NO: 1295426 - protein, 28 aa, Mycobacterium
IGLPPTVTVFGVPIFKLGGAPVKVVSSV

SEQ ID NO: 1295427 - protein, 26 aa, Mycobacterium
LTELLGVSRSGYYAWEARQRRTEPTA

SEQ ID NO: 1295428 - protein, 19 aa, Mycobacterium
LVLVCPYHHRLHHRGIITI

SEQ ID NO: 1295429 - protein, 23 aa, Mycobacterium
RARSIDGRYLPYHADRAAASARA

SEQ ID NO: 1295430 - protein, 24 aa, Mycobacterium
RDRLPKVAALYLQGRLSARLISEI

SEQ ID NO: 1295431 - protein, 17 aa, Mycobacterium
RHAFTTYANLTAGLDNY

SEQ ID NO: 1295432 - protein, 18 aa, Mycobacterium
RLDAVWTSDITYLTCGEG

SEQ ID NO: 1295433 - protein, 24 aa, Mycobacterium
SDEQYTYWRIALPHVEAAVFDAAL

SEQ ID NO: 1295434 - protein, 24 aa, Mycobacterium
AGSVILNTGPWYPKLHYAFADHCS

SEQ ID NO: 1295435 - protein, 18 aa, Mycobacterium
ALECGALSEWRATLIVRE

SEQ ID NO: 1295436 - protein, 17 aa, Mycobacterium
APMRRLRQVRPVDVWKA

SEQ ID NO: 1295437 - protein, 29 aa, Mycobacterium
ARKSPQMSEVLPLLYLHGLSTSDFTPALE

SEQ ID NO: 1295438 - protein, 19 aa, Mycobacterium
AVARIFQQYPDMSTLPYRV

SEQ ID NO: 1295439 - protein, 19 aa, Mycobacterium
AVKERMVFVLSQRQSAAGL

SEQ ID NO: 1295440 - protein, 22 aa, Mycobacterium
DENLHMIFYRDVSEAGFDIAPD

SEQ ID NO: 1295441 - protein, 18 aa, Mycobacterium
DPIWGDKGGLFTIARAIM

SEQ ID NO: 1295442 - protein, 33 aa, Mycobacterium; identical to SEQ ID NO: 1138192

SEQ ID NO: 1295443 - protein, 27 aa, Mycobacterium
DVYREELTRIFYGPYWHPIAHRAELAE

SEQ ID NO: 1295444 - protein, 34 aa, Mycobacterium; identical to SEQ ID NO: 784149

SEQ ID NO: 1295445 - protein, 22 aa, Mycobacterium
EFGRLDTLFNVVGGSLARNVEE

SEQ ID NO: 1295446 - protein, 19 aa, Mycobacterium
FLSPSKLRRRRGADVGFFR

SEQ ID NO: 1295447 - protein, 17 aa, Mycobacterium
FWKAVREVFPATKEQRC

SEQ ID NO: 1295448 - protein, 26 aa, Mycobacterium
GKNERFHQTLFRYLDKQPIAESLAEL

SEQ ID NO: 1295449 - protein, 27 aa, Mycobacterium
GLQVVPGLHRYLMPVNWKLLAENFGGD

SEQ ID NO: 1295450 - protein, 28 aa, Mycobacterium
GMEFGQFAAWSYFNRSFFTPGQAKIQGI

SEQ ID NO: 1295451 - protein, 26 aa, Mycobacterium
GSAFVDAWLLRACAKLGIRLVHSAPG

SEQ ID NO: 1295452 - protein, 20 aa, Mycobacterium
IGAPHRWVMSANWKTAADNF

SEQ ID NO: 1295453 - protein, 28 aa, Mycobacterium
LAERNAFRTRWLADVPLLMVRDGDDRIR

SEQ ID NO: 1295454 - protein, 22 aa, Mycobacterium
LGLGFLGIGQAVARIFQQYPDM

SEQ ID NO: 1295455 - protein, 18 aa, Mycobacterium
PAWARKSPQMSEVLPLLY

SEQ ID NO: 1295456 - protein, 32 aa, Mycobacterium
PPLEEYLGEGLLWYLDNFLLDCDPNGLQVVPG

SEQ ID NO: 1295457 - protein, 24 aa, Mycobacterium
PSESTLLRHFHRCELMGPAAGQSA

SEQ ID NO: 1295458 - protein, 19 aa, Mycobacterium
PYHAPLLHSAFKLLNWQGG

SEQ ID NO: 1295459 - protein, 21 aa, Mycobacterium
RFSSAILPAWARKSPQMSEVL

SEQ ID NO: 1295460 - protein, 20 aa, Mycobacterium
RKPHRKEGERYQRFTDPMVM

SEQ ID NO: 1295461 - protein, 19 aa, Mycobacterium
RQTIPTNRRYKVVSLTDAG

SEQ ID NO: 1295462 - protein, 24 aa, Mycobacterium
SPVGQMAWIVEKFAAWMDCDGHPE

SEQ ID NO: 1295463 - protein, 24 aa, Mycobacterium
TEDRPVQHDGRWGRATLEVCFAIL

SEQ ID NO: 1295464 - protein, 30 aa, Mycobacterium; identical to SEQ ID NO: 869140

SEQ ID NO: 1295465 - protein, 26 aa, Mycobacterium
VFQMSKPVIPLLRQGGGGSIVNVAST

SEQ ID NO: 1295466 - protein, 25 aa, Mycobacterium
VGDRKTYLFAFLDDHSRLVVGHRFG

SEQ ID NO: 1295467 - protein, 21 aa, Mycobacterium
VMPVLKKWRIFEREDFTGEAA

SEQ ID NO: 1295468 - protein, 21 aa, Mycobacterium
YFMDRYDPIWGDKGGLFTIAR

SEQ ID NO: 1295469 - protein, 18 aa, Mycobacterium
YLAVFDDHTEEILYFGRA

SEQ ID NO: 1295470 - protein, 24 aa, Mycobacterium
YRIRDRVLRYVFAPDYQELKKAHE

SEQ ID NO: 1295471 - protein, 17 aa, Mycobacterium
YTELQTISRRIGPPGPP

SEQ ID NO: 1295472 - protein, 17 aa, Mycobacterium
AALFTSFGAVYGYRRIH

SEQ ID NO: 1295473 - protein, 23 aa, Mycobacterium
AGRLPLFTIILDHSAYQAIEKMR

SEQ ID NO: 1295474 - protein, 25 aa, Mycobacterium
AGTEPAHLLRWQDGIWAECGNVLGV

SEQ ID NO: 1295475 - protein, 22 aa, Mycobacterium
AKSVLVMMTLFAKDGTAKLVPS

SEQ ID NO: 1295476 - protein, 21 aa, Mycobacterium
APDTMTYVTALLPVAQGVAVY

SEQ ID NO: 1295477 - protein, 21 aa, Mycobacterium
ARGMLFYRLLQQSVNTDPHPL

SEQ ID NO: 1295478 - protein, 18 aa, Mycobacterium
ATLDRWIRRYRGGGFEAL

SEQ ID NO: 1295479 - protein, 23 aa, Mycobacterium
DDRGLFDMVWALEGELTEGGELL

SEQ ID NO: 1295480 - protein, 28 aa, Mycobacterium
DEIYTFMDLWFYHCNPRHHSIALTPMPG

SEQ ID NO: 1295481 - protein, 19 aa, Mycobacterium
DGMSRVSGWLTPEARAHWD

SEQ ID NO: 1295482 - protein, 26 aa, Mycobacterium
DHDPSSLALPLALYRAVTAFGRVAVD

SEQ ID NO: 1295483 - protein, 24 aa, Mycobacterium
DIARYIELFYNRRRLHSALGYRTP

SEQ ID NO: 1295484 - protein, 20 aa, Mycobacterium
DRMEILSWFLVERDAPEWLR

SEQ ID NO: 1295485 - protein, 23 aa, Mycobacterium
DTTYGGRWVVNPSGGLISKGHPL

SEQ ID NO: 1295486 - protein, 22 aa, Mycobacterium
EALIGVFDKIGVKTGIDFFDIA

SEQ ID NO: 1295487 - protein, 25 aa, Mycobacterium
EIRELKRANEILKRAASFFGAELDR

SEQ ID NO: 1295488 - protein, 26 aa, Mycobacterium
ENTNGLLRQYFPKGTDLSIYGPEDLE

SEQ ID NO: 1295489 - protein, 29 aa, Mycobacterium
EPKKKPRSAWRRFVYPAPNACWQLDATEY

SEQ ID NO: 1295490 - protein, 23 aa, Mycobacterium
FAAGRLSYFLGVRGPAVVVDTAC

SEQ ID NO: 1295491 - protein, 18 aa, Mycobacterium
FDGLTILELGHVIAAPFA

SEQ ID NO: 1295492 - protein, 17 aa, Mycobacterium
GDSYHTLFAHRSMVELG

SEQ ID NO: 1295493 - protein, 24 aa, Mycobacterium
GMAPTIVQMLKWLGVSKSGFYEWW

SEQ ID NO: 1295494 - protein, 28 aa, Mycobacterium
HAADRGGLSLLLYDVTTLYFEAENEDDL

SEQ ID NO: 1295495 - protein, 24 aa, Mycobacterium
HVADQVGNLLYRKTARNFGPVMAT

SEQ ID NO: 1295496 - protein, 22 aa, Mycobacterium
ILYFGRAKRCATTAQRLALFAR

SEQ ID NO: 1295497 - protein, 23 aa, Mycobacterium
IMPAGEVIAHYHELWRVERSFRM

SEQ ID NO: 1295498 - protein, 25 aa, Mycobacterium
ITYIRTWAGWLYLATVIDCFNKEVI

SEQ ID NO: 1295499 - protein, 26 aa, Mycobacterium
KNNPVRSVLIRRAALTAGPLGSILHT

SEQ ID NO: 1295500 - protein, 25 aa, Mycobacterium
LDTLLEFYHYPAEHWIHLRTTNPIE

SEQ ID NO: 1295501 - protein, 25 aa, Mycobacterium
MGLDNLAPDPTWLGPGRPLASGYAE

SEQ ID NO: 1295502 - protein, 26 aa, Mycobacterium
PDEHTNAWRAIWAYSAKRARRDQKTL

SEQ ID NO: 1295503 - protein, 24 aa, Mycobacterium
PEAKRWSFPIRPGIAHVRTIAVHP

SEQ ID NO: 1295504 - protein, 24 aa, Mycobacterium
PEAWAVWEVIFAKYAAPGMCNPDD

SEQ ID NO: 1295505 - protein, 24 aa, Mycobacterium
QADGMSRVTGWLTPEARAHWDLIA

SEQ ID NO: 1295506 - protein, 19 aa, Mycobacterium
RAELLLGETVMVLGAGALG

SEQ ID NO: 1295507 - protein, 18 aa, Mycobacterium
RFTTIKPGPYPWKNHRNA

SEQ ID NO: 1295508 - protein, 33 aa, Mycobacterium
RIDYPYADNDEWLKWLLVRRGSGGEFDLQFSER

SEQ ID NO: 1295509 - protein, 19 aa, Mycobacterium
RLAAALKPALAARGVPAGI

SEQ ID NO: 1295510 - protein, 33 aa, Mycobacterium; identical to SEQ ID NO: 785787

SEQ ID NO: 1295511 - protein, 24 aa, Mycobacterium
RQQFSLLFATTVLGGTLAIDHEST

SEQ ID NO: 1295512 - protein, 17 aa, Mycobacterium
RRLLADEPVFAAAVAEL

SEQ ID NO: 1295513 - protein, 24 aa, Mycobacterium
RTGLAIANVVKQLRPLRSATIAIN

SEQ ID NO: 1295514 - protein, 21 aa, Mycobacterium
SDLRARPMFHRTRDAIEAHLT

SEQ ID NO: 1295515 - protein, 33 aa, Mycobacterium; identical to SEQ ID NO: 785956

SEQ ID NO: 1295516 - protein, 24 aa, Mycobacterium
SNAHRAAALAPWLKHYNTQRRHSA

SEQ ID NO: 1295517 - protein, 19 aa, Mycobacterium
SYEQIVAELDRIKAAVWAV

SEQ ID NO: 1295518 - protein, 22 aa, Mycobacterium
TALPDWLHFYNHHRAHSAIGGQ

SEQ ID NO: 1295519 - protein, 22 aa, Mycobacterium
TLADGWAYAHFYESTEQRNTAL

SEQ ID NO: 1295520 - protein, 33 aa, Mycobacterium; identical to SEQ ID NO: 868085

SEQ ID NO: 1295521 - protein, 29 aa, Mycobacterium
VAAMPYLKAWFELLGLRAGPVRPPVKARL

SEQ ID NO: 1295522 - protein, 33 aa, Mycobacterium
VAAPFISITVFARGLLNRLFTRAYIPGKQLEND

SEQ ID NO: 1295523 - protein, 30 aa, Mycobacterium
VIGLPPTVTVFGIPIFKLGGAPVKVVSSVT

SEQ ID NO: 1295524 - protein, 21 aa, Mycobacterium
VVDYFDFVAPATGLALVLYRT

SEQ ID NO: 1295525 - protein, 18 aa, Mycobacterium
VYDARAFFDVAELHSWVA

SEQ ID NO: 1295526 - protein, 18 aa, Mycobacterium
WDRLGALPALPTAADLTE

SEQ ID NO: 1295527 - protein, 31 aa, Mycobacterium; identical to SEQ ID NO: 786485

SEQ ID NO: 1295528 - protein, 17 aa, Mycobacterium
YEMGMDLTPLTDWPGPG

SEQ ID NO: 1295529 - protein, 21 aa, Mycobacterium
AAAGRISYRLGLQGPAVAVDT

SEQ ID NO: 1295530 - protein, 24 aa, Mycobacterium
AAAVLQSWFYLSRGKRLPSARGRG

SEQ ID NO: 1295531 - protein, 17 aa, Mycobacterium
AAELAWMAHWQASDGTR

SEQ ID NO: 1295532 - protein, 19 aa, Mycobacterium
AAKRIAWTKLINSGQICIA

SEQ ID NO: 1295533 - protein, 28 aa, Mycobacterium
ADGLFVGRPMWLPLDDAGIVRFYRDVAE

SEQ ID NO: 1295534 - protein, 25 aa, Mycobacterium
ADGQYVVGRLVWNAGLLAPVEGQLR

SEQ ID NO: 1295535 - protein, 22 aa, Mycobacterium
ADVFVHYTEIQGSGFRTLEENQ

SEQ ID NO: 1295536 - protein, 26 aa, Mycobacterium
AEAAGDGFARFWLHNGWVTMGGEKMS

SEQ ID NO: 1295537 - protein, 24 aa, Mycobacterium
AEDQALIITLPVTDAPYLGFQLGS

SEQ ID NO: 1295538 - protein, 17 aa, Mycobacterium
AEQAIRRLVKRGGPITF

SEQ ID NO: 1295539 - protein, 24 aa, Mycobacterium
AEQDAIIRLDHPGVLVIEGGPGTG

SEQ ID NO: 1295540 - protein, 18 aa, Mycobacterium
AERGRMFGSLPEGGRMVA

SEQ ID NO: 1295541 - protein, 19 aa, Mycobacterium
AERVTFATWAIVTGKSPGG

SEQ ID NO: 1295542 - protein, 30 aa, Mycobacterium; identical to SEQ ID NO: 113110

SEQ ID NO: 1295543 - protein, 24 aa, Mycobacterium
AFGIPLVVVVDVPGYLPGVDQEWG

SEQ ID NO: 1295544 - protein, 17 aa, Mycobacterium
AFPAFPALLAAEQGVSD

SEQ ID NO: 1295545 - protein, 21 aa, Mycobacterium
AGALPGLTRPAAAALVEAAGG

SEQ ID NO: 1295546 - protein, 18 aa, Mycobacterium
AGDYLFATASRLVSRLGP

SEQ ID NO: 1295547 - protein, 21 aa, Mycobacterium
AGPALACGNAFILKPSERDPS

SEQ ID NO: 1295548 - protein, 27 aa, Mycobacterium
AGPDHPTPGWWDGVAGPGAPIDTDRWC

SEQ ID NO: 1295549 - protein, 18 aa, Mycobacterium
AGRLMFYGQGAGGAPTAS

SEQ ID NO: 1295550 - protein, 28 aa, Mycobacterium
AHVRIIQDFVRKLPAWVSWERRDHYERD

SEQ ID NO: 1295551 - protein, 23 aa, Mycobacterium
AIYDTMVLAPCDVATYAMGMAAS

SEQ ID NO: 1295552 - protein, 20 aa, Mycobacterium
AKSWREVLTVRWRISGSEAN

SEQ ID NO: 1295553 - protein, 23 aa, Mycobacterium
AKWGQLSDVVLLLPHGHEGQGPD

SEQ ID NO: 1295554 - protein, 24 aa, Mycobacterium
ALEALRIPIEYLAGLFTAGDTAVV

SEQ ID NO: 1295555 - protein, 19 aa, Mycobacterium
ALENTRFWAPLSLTAEQKH

SEQ ID NO: 1295556 - protein, 29 aa, Mycobacterium
ALFAVEMGLARLWQSWGFEPDVVLGHSVG

SEQ ID NO: 1295557 - protein, 18 aa, Mycobacterium
ALHHPCCGDLTYGADPTL

SEQ ID NO: 1295558 - protein, 19 aa, Mycobacterium
ALLDEAGVTVTRFVRFEVG

SEQ ID NO: 1295559 - protein, 17 aa, Mycobacterium
ALLLPRRHPGKRSPLWH

SEQ ID NO: 1295560 - protein, 22 aa, Mycobacterium
ALNAISGRVAFALGLEGPAVAV

SEQ ID NO: 1295561 - protein, 32 aa, Mycobacterium; identical to SEQ ID NO: 793149

SEQ ID NO: 1295562 - protein, 17 aa, Mycobacterium
AMGTRFLLTSDSTVPDA

SEQ ID NO: 1295563 - protein, 21 aa, Mycobacterium
ANVEAWLVTIAHRRALDVGRA

SEQ ID NO: 1295564 - protein, 22 aa, Mycobacterium
ANVPVPFLTINSVAPTIMAFGT

SEQ ID NO: 1295565 - protein, 18 aa, Mycobacterium
APFSLAWMTAVGERTKRL

SEQ ID NO: 1295566 - protein, 17 aa, Mycobacterium
APSLVFLDEIDALAPRR

SEQ ID NO: 1295567 - protein, 29 aa, Mycobacterium
ARAHGADMLLLIVAALEQPVLESLLERTE

SEQ ID NO: 1295568 - protein, 17 aa, Mycobacterium
ARAILIRPAPVPGFRGP

SEQ ID NO: 1295569 - protein, 23 aa, Mycobacterium
ARALAADPPILLMDEPFSAVDPV

SEQ ID NO: 1295570 - protein, 18 aa, Mycobacterium
ARGPMGLPELTSTKWIVW

SEQ ID NO: 1295571 - protein, 33 aa, Mycobacterium
ARVQPVIVGLQLALTELWRSYGVTPDAVIGHSM

SEQ ID NO: 1295572 - protein, 22 aa, Mycobacterium
ASGCVLLPGLPHLGLEHRAAWV

SEQ ID NO: 1295573 - protein, 32 aa, Mycobacterium; identical to SEQ ID NO: 795836

SEQ ID NO: 1295574 - protein, 26 aa, Mycobacterium
ASYEFLRLLEHRLQLQRLKRTHMLPE

SEQ ID NO: 1295575 - protein, 19 aa, Mycobacterium
ATGVNFGPWAQGGMASSEA

SEQ ID NO: 1295576 - protein, 29 aa, Mycobacterium
ATHSRLLYDVLGTVYDWLGFDVVDDAVFR

SEQ ID NO: 1295577 - protein, 18 aa, Mycobacterium
ATRSPIGKRNGWLSGLHA

SEQ ID NO: 1295578 - protein, 29 aa, Mycobacterium
AVALADRLPHVAALFTAGLITDLLVRAIV

SEQ ID NO: 1295579 - protein, 19 aa, Mycobacterium
AVKAALALGSPYTAMLFMG

SEQ ID NO: 1295580 - protein, 23 aa, Mycobacterium
AVKLRLGIGYVIQSAGLMPHLRV

SEQ ID NO: 1295581 - protein, 17 aa, Mycobacterium
AVMRKHRLAERLLVDVI

SEQ ID NO: 1295582 - protein, 18 aa, Mycobacterium
AVRGGILDVFPPTAEHPV

SEQ ID NO: 1295583 - protein, 18 aa, Mycobacterium
AWCEDAFITAALLARETT

SEQ ID NO: 1295584 - protein, 20 aa, Mycobacterium
AYYRLLDGDLRLYKDFTGTG

SEQ ID NO: 1295585 - protein, 25 aa, Mycobacterium
CEEDGPVYQLRRWYEQFYVDIADVT

SEQ ID NO: 1295586 - protein, 21 aa, Mycobacterium
CGAEPLFLQDYIAVGRTVPER

SEQ ID NO: 1295587 - protein, 26 aa, Mycobacterium
CGKTYLAQTLAKMLNVPFAIADATAL

SEQ ID NO: 1295588 - protein, 23 aa, Mycobacterium
CGPETLRSLYFLGSRVTGGSPHA

SEQ ID NO: 1295589 - protein, 17 aa, Mycobacterium
CIARAIAVQPDVLLMDE

SEQ ID NO: 1295590 - protein, 27 aa, Mycobacterium
CMDNGMPILVFNLLVDGNIARAVAGEK

SEQ ID NO: 1295591 - protein, 21 aa, Mycobacterium
DAGIKPIIGIEAYIAPASRFE

SEQ ID NO: 1295592 - protein, 24 aa, Mycobacterium
DAHRGASLIVWAIAEGRSAAHAVD

SEQ ID NO: 1295593 - protein, 25 aa, Mycobacterium
DAPKHKGITYFLIDMKSPGIVIRPL

SEQ ID NO: 1295594 - protein, 26 aa, Mycobacterium
DAVGRPETWKQAFYARDLAGTVVLVG

SEQ ID NO: 1295595 - protein, 19 aa, Mycobacterium
DDEFGFFVVMLAVAGNETT

SEQ ID NO: 1295596 - protein, 22 aa, Mycobacterium
DDELKAFFTLLAVAANDTTRHA

SEQ ID NO: 1295597 - protein, 18 aa, Mycobacterium
DDGRLLARIYSESDLLVA

SEQ ID NO: 1295598 - protein, 20 aa, Mycobacterium
DEDAILARFKQFADAGVTDL

SEQ ID NO: 1295599 - protein, 32 aa, Mycobacterium; identical to SEQ ID NO: 783962

SEQ ID NO: 1295600 - protein, 17 aa, Mycobacterium
DELVGIAGLLLLAGHET

SEQ ID NO: 1295601 - protein, 25 aa, Mycobacterium
DETPLGRWWRDMKLARVGGGTDEVL

SEQ ID NO: 1295602 - protein, 19 aa, Mycobacterium
DFLEWFFRADRGELEPFVL

SEQ ID NO: 1295603 - protein, 24 aa, Mycobacterium
DGKHELLLALFEDALSRSADQIRA

SEQ ID NO: 1295604 - protein, 24 aa, Mycobacterium
DGRTYGHPIVLRPVSSEDAMTADW

SEQ ID NO: 1295605 - protein, 18 aa, Mycobacterium
DGSRRYLFARRLGNRRGD

SEQ ID NO: 1295606 - protein, 27 aa, Mycobacterium
DHHSRRGLLLLVGRRRRLLKYVAQVDV

SEQ ID NO: 1295607 - protein, 20 aa, Mycobacterium
DHMSPPTPFITFRVWHPLSH

SEQ ID NO: 1295608 - protein, 27 aa, Mycobacterium
DIAEEYYISFLLDRANRTYLAMCSVEG

SEQ ID NO: 1295609 - protein, 24 aa, Mycobacterium
DIANRLCAQILLLSAEDPTKDIHL

SEQ ID NO: 1295610 - protein, 18 aa, Mycobacterium
DIFYERFPEELKGAAPRI

SEQ ID NO: 1295611 - protein, 17 aa, Mycobacterium
DIIAWECDYPHSDCFWP

SEQ ID NO: 1295612 - protein, 24 aa, Mycobacterium
DKEGRLILSKKRAQYERAWGTIEE

SEQ ID NO: 1295613 - protein, 20 aa, Mycobacterium
DKELAFPNAVLALFHYPDKA

SEQ ID NO: 1295614 - protein, 22 aa, Mycobacterium
DKGCPMVLGGPLSHVMAAKAVA

SEQ ID NO: 1295615 - protein, 23 aa, Mycobacterium
DKNPLFLDEQLTRAEFQRITQDL

SEQ ID NO: 1295616 - protein, 21 aa, Mycobacterium
DLGDSILLPGLMDMEVNLLMG

SEQ ID NO: 1295617 - protein, 19 aa, Mycobacterium
DLLEYWSGRRWPSGRHRVL

SEQ ID NO: 1295618 - protein, 32 aa, Mycobacterium; identical to SEQ ID NO: 802453

SEQ ID NO: 1295619 - protein, 33 aa, Mycobacterium; identical to SEQ ID NO: 784051

SEQ ID NO: 1295620 - protein, 29 aa, Mycobacterium
DNQPTLGMMMFTLFQKRLLGSLYGEANPR

SEQ ID NO: 1295621 - protein, 18 aa, Mycobacterium
DPEILRTNLAAVILQMAA

SEQ ID NO: 1295622 - protein, 23 aa, Mycobacterium
DPPGGWPEPLRSKALAGRAPAKP

SEQ ID NO: 1295623 - protein, 25 aa, Mycobacterium
DPQAMRMILLQILTGRRASEIRTCD

SEQ ID NO: 1295624 - protein, 24 aa, Mycobacterium
DPSLPLLERAKFLAIFASNLDEFY

SEQ ID NO: 1295625 - protein, 18 aa, Mycobacterium
DPVLGARPLRRTIQREIE

SEQ ID NO: 1295626 - protein, 20 aa, Mycobacterium
DRFTASRLFGAPPGYVGYEE

SEQ ID NO: 1295627 - protein, 24 aa, Mycobacterium
DRLRTRFEWGLITDVQPPELETRI

SEQ ID NO: 1295628 - protein, 23 aa, Mycobacterium
DRYINDRFLPDKAIDLIDEAGAR

SEQ ID NO: 1295629 - protein, 24 aa, Mycobacterium
DTLLSAQWRNGMIPHIVFANGVDG

SEQ ID NO: 1295630 - protein, 25 aa, Mycobacterium
DVAVGTLYRYFPSKVHLLVSALGRE

SEQ ID NO: 1295631 - protein, 24 aa, Mycobacterium
DVSELLPELTLAQKWDLTANELAR

SEQ ID NO: 1295632 - protein, 22 aa, Mycobacterium
EAELMAHFGVSRPTLREAVRVL

SEQ ID NO: 1295633 - protein, 26 aa, Mycobacterium
EAIGLLKMDFLGLRNLTIIGDCIENI

SEQ ID NO: 1295634 - protein, 32 aa, Mycobacterium; identical to SEQ ID NO: 784135

SEQ ID NO: 1295635 - protein, 18 aa, Mycobacterium
EALPIAAFSMMRAMSTRN

SEQ ID NO: 1295636 - protein, 19 aa, Mycobacterium
EAPLYRNEELGFWALSRHA

SEQ ID NO: 1295637 - protein, 23 aa, Mycobacterium
EARDYVMALGYLQAPVVVAGNDH

SEQ ID NO: 1295638 - protein, 19 aa, Mycobacterium
ECWAMQAYGAAYTLQELLT

SEQ ID NO: 1295639 - protein, 24 aa, Mycobacterium
EDYTNRGRIITPLKDRFGAEIRTH

SEQ ID NO: 1295640 - protein, 17 aa, Mycobacterium
EELMRYLSIIQNGQRRV

SEQ ID NO: 1295641 - protein, 25 aa, Mycobacterium
EEPPEHLIFVFATTEPEKVLPTIRS

SEQ ID NO: 1295642 - protein, 23 aa, Mycobacterium
EFDISKLRYHKIVLMADADVDGQ

SEQ ID NO: 1295643 - protein, 18 aa, Mycobacterium
EGQRRYVESLSAYARQFL

SEQ ID NO: 1295644 - protein, 24 aa, Mycobacterium
EGVRKFFRTRPANQRPRVIAVDAV

SEQ ID NO: 1295645 - protein, 18 aa, Mycobacterium
EHCDLDHVVPYPYGPTHP

SEQ ID NO: 1295646 - protein, 18 aa, Mycobacterium
EHEQILPRAGWVEHNPVE

SEQ ID NO: 1295647 - protein, 24 aa, Mycobacterium
EINTRGDIILFIDELHTLVGAGAA

SEQ ID NO: 1295648 - protein, 21 aa, Mycobacterium
EIPGTWLCRNGLEGTLIEGDV

SEQ ID NO: 1295649 - protein, 24 aa, Mycobacterium
EKEQTILVFDLGGGTFDVSLLEIG

SEQ ID NO: 1295650 - protein, 24 aa, Mycobacterium
EKVRRKPFSVVLFDEIEKAHQEIY

SEQ ID NO: 1295651 - protein, 20 aa, Mycobacterium
ELDMLLTAGERISNALVAMA

SEQ ID NO: 1295652 - protein, 26 aa, Mycobacterium
ELFPEEMFADLFPSQRGRPSIPAEVM

SEQ ID NO: 1295653 - protein, 34 aa, Mycobacterium
ELSNVANLPITLWPGMKIGQLCLLRLTSPAEHPY

SEQ ID NO: 1295654 - protein, 21 aa, Mycobacterium
ELSVRVIPKQADEFTCSSCFL

SEQ ID NO: 1295655 - protein, 27 aa, Mycobacterium
ELTLEDFLEQMLAIRKMGPIGNLLGML

SEQ ID NO: 1295656 - protein, 24 aa, Mycobacterium
EMAGDFGGVWYWNRFPGIQCDNDA

SEQ ID NO: 1295657 - protein, 24 aa, Mycobacterium
ENCFFLHCSLVPYMAPSGELKTKP

SEQ ID NO: 1295658 - protein, 25 aa, Mycobacterium
ENGASWVPYLFYQFKDVYSKMPQEF

SEQ ID NO: 1295659 - protein, 21 aa, Mycobacterium
EPGIYFPGQWGARIEDIVIVT

SEQ ID NO: 1295660 - protein, 25 aa, Mycobacterium
EQDLRGLLGAFMFTGPQLDQPAGTL

SEQ ID NO: 1295661 - protein, 22 aa, Mycobacterium
EQGIVHIIGPQLGLTQPGMTVV

SEQ ID NO: 1295662 - protein, 25 aa, Mycobacterium
ERARAGLFLAMQYPVEVPGVSMSNF

SEQ ID NO: 1295663 - protein, 25 aa, Mycobacterium
EREYRTRLKTYLESQLEELGQRGSA

SEQ ID NO: 1295664 - protein, 25 aa, Mycobacterium
ERNGERYQFLRWGQGAFDDFKVVPP

SEQ ID NO: 1295665 - protein, 22 aa, Mycobacterium
ERNQREFWGRLLELLTDSGDDA

SEQ ID NO: 1295666 - protein, 24 aa, Mycobacterium
ERYGVPAHQLLHRAGQRKLIGGQE

SEQ ID NO: 1295667 - protein, 26 aa, Mycobacterium
ESAQTLLENLFFKEKRYDLARVGRYK

SEQ ID NO: 1295668 - protein, 27 aa, Mycobacterium
ESCDTLIVIPNDRLLQMGDAAVSLMDA

SEQ ID NO: 1295669 - protein, 17 aa, Mycobacterium
ESMTFPDPVIEVAIEPK

SEQ ID NO: 1295670 - protein, 17 aa, Mycobacterium
ETLGWIALNQRANAALN

SEQ ID NO: 1295671 - protein, 25 aa, Mycobacterium
ETTSLAFLVAFRPGLVSPTLSAQMA

SEQ ID NO: 1295672 - protein, 23 aa, Mycobacterium
EVEALQLEYNWIKEFDPRFNIRY

SEQ ID NO: 1295673 - protein, 18 aa, Mycobacterium
EVIRILQRYKDLQDIIAI

SEQ ID NO: 1295674 - protein, 19 aa, Mycobacterium
EVLAGLRGWLSAPVIVLSA

SEQ ID NO: 1295675 - protein, 24 aa, Mycobacterium
EVRLAALISFYRWHQAVSGVVVAG

SEQ ID NO: 1295676 - protein, 26 aa, Mycobacterium
EVTLNGRVLPIGGVKQKLLAAQRAGL

SEQ ID NO: 1295677 - protein, 27 aa, Mycobacterium
EWKDGEALFLRCNIWREAAENVAESLT

SEQ ID NO: 1295678 - protein, 24 aa, Mycobacterium
EWPENPRFLMCTPLSHAGAAFFTP

SEQ ID NO: 1295679 - protein, 18 aa, Mycobacterium
EYDVLVGINLLREGLDLP

SEQ ID NO: 1295680 - protein, 20 aa, Mycobacterium
EYGRTVVVLTIDPAKRLAQA

SEQ ID NO: 1295681 - protein, 18 aa, Mycobacterium
FAAVRQFRASVCVLGPLV

SEQ ID NO: 1295682 - protein, 25 aa, Mycobacterium
FADEFHPELQFDKPYLLAMANAGPG

SEQ ID NO: 1295683 - protein, 23 aa, Mycobacterium
FAESLHRRVATLAGLPASVLDDV

SEQ ID NO: 1295684 - protein, 19 aa, Mycobacterium
FDLPPIQLTAVRDANLYAV

SEQ ID NO: 1295685 - protein, 25 aa, Mycobacterium
FERDAIPLLDQLYGGALRMTRNPAD

SEQ ID NO: 1295686 - protein, 17 aa, Mycobacterium
FFDVAELHSWVAEDGGR

SEQ ID NO: 1295687 - protein, 24 aa, Mycobacterium
FLGPRVYEHLYGEPFPAGIQTAEN

SEQ ID NO: 1295688 - protein, 17 aa, Mycobacterium
FNIRYRDDKSYPVLAVT

SEQ ID NO: 1295689 - protein, 25 aa, Mycobacterium
FPKGVMWRHEDIYRVLFGGTDFATG

SEQ ID NO: 1295690 - protein, 17 aa, Mycobacterium
FPLPRPWSEDDEHQLFQ

SEQ ID NO: 1295691 - protein, 22 aa, Mycobacterium
FPQAFTHLALINAVVHVIRAEE

SEQ ID NO: 1295692 - protein, 17 aa, Mycobacterium
FPTLASLIEERLSDDPV

SEQ ID NO: 1295693 - protein, 25 aa, Mycobacterium
FQAYSLFPHLTVLDNVAFGLKMRGK

SEQ ID NO: 1295694 - protein, 20 aa, Mycobacterium
FQVIELHDCFSANELLLYEA

SEQ ID NO: 1295695 - protein, 25 aa, Mycobacterium
FRSDALQIVAFGRYARTVTAAELTG

SEQ ID NO: 1295696 - protein, 21 aa, Mycobacterium
FRTDFLTLTRGTGIANAVFDG

SEQ ID NO: 1295697 - protein, 17 aa, Mycobacterium
FVERLSEGIGTIAAAFW

SEQ ID NO: 1295698 - protein, 26 aa, Mycobacterium
FVGNAGIFDYFAPLVGFDGADLSSAF

SEQ ID NO: 1295699 - protein, 29 aa, Mycobacterium
FVTEIAVNFPLYVILSLLGLPEEDFGRMH

SEQ ID NO: 1295700 - protein, 20 aa, Mycobacterium
GAIALGHPLGATGAKLFATM

SEQ ID NO: 1295701 - protein, 25 aa, Mycobacterium
GAMVADAAVPRWGKPEEMAELLAFC

SEQ ID NO: 1295702 - protein, 26 aa, Mycobacterium
GARDFLVPARLQPGSFYALPQSPQLF

SEQ ID NO: 1295703 - protein, 26 aa, Mycobacterium
GAWSIDVCMGPWPALSLRDACQRGDW

SEQ ID NO: 1295704 - protein, 25 aa, Mycobacterium
GCTHPGCTVPFYWTEAHHTHDYSRG

SEQ ID NO: 1295705 - protein, 37 aa, Mycobacterium; identical to SEQ ID NO: 815378

SEQ ID NO: 1295706 - protein, 19 aa, Mycobacterium
GEFRKLWISRINAAARAND

SEQ ID NO: 1295707 - protein, 32 aa, Mycobacterium; identical to SEQ ID NO: 114674

SEQ ID NO: 1295708 - protein, 17 aa, Mycobacterium
GETERHIRLIFQRAREK

SEQ ID NO: 1295709 - protein, 18 aa, Mycobacterium
GFRFDLASTLAREFYDVD

SEQ ID NO: 1295710 - protein, 19 aa, Mycobacterium
GFRFDLASTLAREFYDVDR

SEQ ID NO: 1295711 - protein, 19 aa, Mycobacterium
GGCFPPPPGYFERVREICD

SEQ ID NO: 1295712 - protein, 23 aa, Mycobacterium
GGEDFSWYLEEVPGAMARLGVWS

SEQ ID NO: 1295713 - protein, 26 aa, Mycobacterium
GGGSLLPMPDLIRLAARAHHYLYVYD

SEQ ID NO: 1295714 - protein, 25 aa, Mycobacterium
GGMGGDYFALCLALEELGKVDQSVA

SEQ ID NO: 1295715 - protein, 24 aa, Mycobacterium
GGRGVHVFLRIATDWDFIAVRRAG

SEQ ID NO: 1295716 - protein, 31 aa, Mycobacterium; identical to SEQ ID NO: 114747

SEQ ID NO: 1295717 - protein, 24 aa, Mycobacterium
GGTHGWGYDGVLWYAVHEPYGGPD

SEQ ID NO: 1295718 - protein, 32 aa, Mycobacterium; identical to SEQ ID NO: 817006

SEQ ID NO: 1295719 - protein, 22 aa, Mycobacterium
GHPVAWIHATALRTEPLAYAGR

SEQ ID NO: 1295720 - protein, 17 aa, Mycobacterium
GHRRLKIIDLSEAGAQP

SEQ ID NO: 1295721 - protein, 25 aa, Mycobacterium
GHTGPIATTLLLPSVLDAVADTGMP

SEQ ID NO: 1295722 - protein, 23 aa, Mycobacterium
GIGREMHVIVGQGKLSEILESRP

SEQ ID NO: 1295723 - protein, 31 aa, Mycobacterium; identical to SEQ ID NO: 817711

SEQ ID NO: 1295724 - protein, 19 aa, Mycobacterium
GKMLPPKLGLLAYVADAYL

SEQ ID NO: 1295725 - protein, 27 aa, Mycobacterium
GLKPVHRRVLYAMFDSGFRPDRGHAKS

SEQ ID NO: 1295726 - protein, 17 aa, Mycobacterium
GLPDPFAAELAWMAHWQ

SEQ ID NO: 1295727 - protein, 21 aa, Mycobacterium
GLQIMAPALADDRLYRVGAAY

SEQ ID NO: 1295728 - protein, 19 aa, Mycobacterium
GMPATRFLGPALGSLHMFF

SEQ ID NO: 1295729 - protein, 30 aa, Mycobacterium
GNINSSLISMFLDFYRPLVEAGMVYVTLPP

SEQ ID NO: 1295730 - protein, 28 aa, Mycobacterium
GPSLSLVLIDRIPFPRPDDPLLTARQRA

SEQ ID NO: 1295731 - protein, 26 aa, Mycobacterium
GPVNTPLLQELFAKDPERAARRLVHV

SEQ ID NO: 1295732 - protein, 24 aa, Mycobacterium
GQGGWPMTCFLTPDGRPFFCGTYY

SEQ ID NO: 1295733 - protein, 18 aa, Mycobacterium
GQKVVPGSFRPGRAMSGF

SEQ ID NO: 1295734 - protein, 26 aa, Mycobacterium
GQLRVLHTFGLSIAALEERMRMALSC

SEQ ID NO: 1295735 - protein, 24 aa, Mycobacterium
GRATLEVCFAILQSAYEDREVVLS

SEQ ID NO: 1295736 - protein, 23 aa, Mycobacterium
GRLLRGTPRRRPARGLLAHLDAR

SEQ ID NO: 1295737 - protein, 34 aa, Mycobacterium; identical to SEQ ID NO: 783190

SEQ ID NO: 1295738 - protein, 20 aa, Mycobacterium
GRYRLIVARACPWANRTIIV

SEQ ID NO: 1295739 - protein, 28 aa, Mycobacterium
GSAKRITAILPFYPYARQDKKHRGREPI

SEQ ID NO: 1295740 - protein, 25 aa, Mycobacterium
GSIERFFGVLTEHYAGAFPAWLAPV

SEQ ID NO: 1295741 - protein, 22 aa, Mycobacterium
GTKFILALFVDLRGKPCAKLVP

SEQ ID NO: 1295742 - protein, 20 aa, Mycobacterium
GVAMPLRLTSPAPCTNCHGS

SEQ ID NO: 1295743 - protein, 27 aa, Mycobacterium
GVDFTNIYFYTVLYHALRASNRIAIER

SEQ ID NO: 1295744 - protein, 19 aa, Mycobacterium
GVDPALVDDVIWGCVMQAG

SEQ ID NO: 1295745 - protein, 26 aa, Mycobacterium
GVSRRHLEIRWDGQVALLSDLNSTNG

SEQ ID NO: 1295746 - protein, 22 aa, Mycobacterium
GYPPTRVWGVPAAGMWAHRLGD

SEQ ID NO: 1295747 - protein, 25 aa, Mycobacterium
GYVDATYWRDMGTPEDFVRGSADLV

SEQ ID NO: 1295748 - protein, 30 aa, Mycobacterium; identical to SEQ ID NO: 822180

SEQ ID NO: 1295749 - protein, 19 aa, Mycobacterium
HALFGFARHALIAASHDRP

SEQ ID NO: 1295750 - protein, 19 aa, Mycobacterium
HALVIPDPFLPGVEPLDGS

SEQ ID NO: 1295751 - protein, 18 aa, Mycobacterium
HARELFGAPYAYAQPHSG

SEQ ID NO: 1295752 - protein, 23 aa, Mycobacterium
HASMMVDLCAMQRFAGPDEIAAP

SEQ ID NO: 1295753 - protein, 26 aa, Mycobacterium
HEDPGELLSPKWQKMWKPVVCAVQGM

SEQ ID NO: 1295754 - protein, 17 aa, Mycobacterium
HELFYGQKVVPGSFRPG

SEQ ID NO: 1295755 - protein, 22 aa, Mycobacterium
HEVITDFFRYFTALTAERRANP

SEQ ID NO: 1295756 - protein, 23 aa, Mycobacterium
HEVPLNFLNPRPGTPFGDLEVLP

SEQ ID NO: 1295757 - protein, 25 aa, Mycobacterium
HGALRGMLAFLAVNTTYRGPATPGS

SEQ ID NO: 1295758 - protein, 23 aa, Mycobacterium
HICPSCSDLYARDTWQLVHAGAA

SEQ ID NO: 1295759 - protein, 33 aa, Mycobacterium; identical to SEQ ID NO: 219115

SEQ ID NO: 1295760 - protein, 21 aa, Mycobacterium
HIRLIFQRAREKASEGTPVIV

SEQ ID NO: 1295761 - protein, 17 aa, Mycobacterium
HLFRRADRFLPNGWCML

SEQ ID NO: 1295762 - protein, 27 aa, Mycobacterium
HLGPSGNYLPKFGPYLSSGSNPWGESI

SEQ ID NO: 1295763 - protein, 24 aa, Mycobacterium
HNAVEYFVSYYDYYQPEAYIAQTD

SEQ ID NO: 1295764 - protein, 25 aa, Mycobacterium
HNNFGVPYAFGKYDQLFVPEFNAGA

SEQ ID NO: 1295765 - protein, 17 aa, Mycobacterium
HNVAFSKPPIGKRGYNE

SEQ ID NO: 1295766 - protein, 21 aa, Mycobacterium
HPTLRLTTNLRIGLEGREARA

SEQ ID NO: 1295767 - protein, 18 aa, Mycobacterium
HRDMEIVTWVLRGSLVHQ

SEQ ID NO: 1295768 - protein, 20 aa, Mycobacterium
HRLAERLLVDVIGLPWEEVH

SEQ ID NO: 1295769 - protein, 30 aa, Mycobacterium; identical to SEQ ID NO: 784741

SEQ ID NO: 1295770 - protein, 21 aa, Mycobacterium
HVRNLIRRFVEAGVPGYHIED

SEQ ID NO: 1295771 - protein, 30 aa, Mycobacterium; identical to SEQ ID NO: 824893

SEQ ID NO: 1295772 - protein, 18 aa, Mycobacterium
IAMAYKLIDAAQARWRAV

SEQ ID NO: 1295773 - protein, 20 aa, Mycobacterium
IAVQPDVLLMDEPCSALDPI

SEQ ID NO: 1295774 - protein, 25 aa, Mycobacterium
IDAMAVGLAVWRLGAGRSAPGEQVQ

SEQ ID NO: 1295775 - protein, 27 aa, Mycobacterium
IDGRDYVLEYPIFGDVALIGAHVADQV

SEQ ID NO: 1295776 - protein, 25 aa, Mycobacterium
IDTANMFGFWDWVGGRYSVDSAIGL

SEQ ID NO: 1295777 - protein, 26 aa, Mycobacterium
IEEQSPIVGIWHSGGARLAEGVKALH

SEQ ID NO: 1295778 - protein, 23 aa, Mycobacterium
IEPRLSLQWWVKVESLAKAAGDA

SEQ ID NO: 1295779 - protein, 27 aa, Mycobacterium
IEVVKGGLILDIGLRGFLPASLVEMRR

SEQ ID NO: 1295780 - protein, 20 aa, Mycobacterium
IFLVNTPQCLMAEGLADLAL

SEQ ID NO: 1295781 - protein, 26 aa, Mycobacterium
IGGQEILFPALLPRAPYETTNRWTEY

SEQ ID NO: 1295782 - protein, 35 aa, Mycobacterium
IGRSRPVITNMIRLLRLPIAVQRRVAAGVLSAGHA

SEQ ID NO: 1295783 - protein, 23 aa, Mycobacterium
IKDLLGREMLDQRFAGMKEALEN

SEQ ID NO: 1295784 - protein, 28 aa, Mycobacterium
IKELCRRWYPRIYFGQPEKGLAHRALAD

SEQ ID NO: 1295785 - protein, 19 aa, Mycobacterium
IPHGLLFERFLNPERPSAP

SEQ ID NO: 1295786 - protein, 18 aa, Mycobacterium
IQIDTTNVLFIVAGAFAG

SEQ ID NO: 1295787 - protein, 19 aa, Mycobacterium
IQRHTLLHEDLKRFFDGFP

SEQ ID NO: 1295788 - protein, 24 aa, Mycobacterium
IRANIRTLLQMAVVLTYGASMPVV

SEQ ID NO: 1295789 - protein, 30 aa, Mycobacterium
IRIENRLAALIPPPVRKLPILIGGTGPKRS

SEQ ID NO: 1295790 - protein, 19 aa, Mycobacterium
KAAEIAINSPLLEASMEGA

SEQ ID NO: 1295791 - protein, 20 aa, Mycobacterium
KAALRHMVPAQKGSIINTAS

SEQ ID NO: 1295792 - protein, 26 aa, Mycobacterium
KAKGLGTNLSLPPKLLPSRETGRGSG

SEQ ID NO: 1295793 - protein, 20 aa, Mycobacterium
KAPFVVFDDADLDAAIQGAV

SEQ ID NO: 1295794 - protein, 26 aa, Mycobacterium
KATELGIPIPGFSSALSYYDGLRTER

SEQ ID NO: 1295795 - protein, 20 aa, Mycobacterium
KEAKIAFLMLPGVGTKEDIK

SEQ ID NO: 1295796 - protein, 17 aa, Mycobacterium
KELFAKHNVPTTPGRVT

SEQ ID NO: 1295797 - protein, 34 aa, Mycobacterium; identical to SEQ ID NO: 782833

SEQ ID NO: 1295798 - protein, 25 aa, Mycobacterium
KGEVKDVLLLDVTPLSLGIETKGGV

SEQ ID NO: 1295799 - protein, 22 aa, Mycobacterium
KGGELIVLTKFDPAEVLRVIEE

SEQ ID NO: 1295800 - protein, 23 aa, Mycobacterium
KGPKIRIHKFKNKTGYHKRQGHR

SEQ ID NO: 1295801 - protein, 26 aa, Mycobacterium
KGVIGKILPVEDMPFLPDGTPVDIIL

SEQ ID NO: 1295802 - protein, 24 aa, Mycobacterium
KIAQAWETLMLRLGYQRYGAQGGD

SEQ ID NO: 1295803 - protein, 17 aa, Mycobacterium
KLIVDLMYEGGIARMNY

SEQ ID NO: 1295804 - protein, 19 aa, Mycobacterium
KLKVLVSIFGRETPVELTF

SEQ ID NO: 1295805 - protein, 41 aa, Mycobacterium; identical to SEQ ID NO: 219708

SEQ ID NO: 1295806 - protein, 18 aa, Mycobacterium
KNDFGLVAIDTLLARMEN

SEQ ID NO: 1295807 - protein, 31 aa, Mycobacterium; identical to SEQ ID NO: 829399

SEQ ID NO: 1295808 - protein, 25 aa, Mycobacterium
KPGEPSWPTPWGRGRPGWHTECVAM

SEQ ID NO: 1295809 - protein, 20 aa, Mycobacterium
KPGTYGAGLLQLIDSRNWRD

SEQ ID NO: 1295810 - protein, 21 aa, Mycobacterium
KPRTTIGWKGLINDPGMDGTF

SEQ ID NO: 1295811 - protein, 25 aa, Mycobacterium
KQVNRKVLPGYILVRMELNDESWGA

SEQ ID NO: 1295812 - protein, 28 aa, Mycobacterium
KRQEDFIGIHFFSPVDKMPLVEIIKGEK

SEQ ID NO: 1295813 - protein, 28 aa, Mycobacterium
KRYTGRGMAFLDLIQEGNLGLIRAVEKF

SEQ ID NO: 1295814 - protein, 29 aa, Mycobacterium
KSGRDSMFQAILPLRGKIINVEKARIDRV

SEQ ID NO: 1295815 - protein, 23 aa, Mycobacterium
KSSLAFDTIFAEGQRRYVESLSA

SEQ ID NO: 1295816 - protein, 19 aa, Mycobacterium
KSWREVLTVRWRISGSEAN

SEQ ID NO: 1295817 - protein, 31 aa, Mycobacterium; identical to SEQ ID NO: 830026

SEQ ID NO: 1295818 - protein, 24 aa, Mycobacterium
KTGHPFLQHLLAHRDATRLKVTVD

SEQ ID NO: 1295819 - protein, 24 aa, Mycobacterium
KVESQYLAQLYATIGIRASDAAQQ

SEQ ID NO: 1295820 - protein, 19 aa, Mycobacterium
KVSALLEALPKVGKVKAQE

SEQ ID NO: 1295821 - protein, 20 aa, Mycobacterium
KVVDLLTPYVRGGKIALFGG

SEQ ID NO: 1295822 - protein, 24 aa, Mycobacterium
KYFDKVDVTVIPPFTDLRSVQTLV

SEQ ID NO: 1295823 - protein, 18 aa, Mycobacterium
LACPCDHRMLDNTGWRTR

SEQ ID NO: 1295824 - protein, 26 aa, Mycobacterium
LADFAHRGWIRLEGKSVLISDSERLA

SEQ ID NO: 1295825 - protein, 31 aa, Mycobacterium; identical to SEQ ID NO: 830766

SEQ ID NO: 1295826 - protein, 26 aa, Mycobacterium
LARSVFNRFPYLEPLNHLQVELLRRY

SEQ ID NO: 1295827 - protein, 26 aa, Mycobacterium
LDDVNLRRLISLFEQLRERSQLIVIT

SEQ ID NO: 1295828 - protein, 27 aa, Mycobacterium
LDIDDEFFVIVRPAPSGTRLLLSDATA

SEQ ID NO: 1295829 - protein, 20 aa, Mycobacterium
LDILVDRMRREFKVEANVGK

SEQ ID NO: 1295830 - protein, 19 aa, Mycobacterium
LDPARHVIIYLANPTIGVR

SEQ ID NO: 1295831 - protein, 21 aa, Mycobacterium
LDVVPPGDLRMALAALASDSP

SEQ ID NO: 1295832 - protein, 18 aa, Mycobacterium
LEQYWGPQVPFPKRMGRS

SEQ ID NO: 1295833 - protein, 25 aa, Mycobacterium
LESLRYDLAVQEIFVFTPKGDVITL

SEQ ID NO: 1295834 - protein, 25 aa, Mycobacterium
LFEDRGRRWPVIISGTITDASGRTL

SEQ ID NO: 1295835 - protein, 30 aa, Mycobacterium
LGELLMVNTWNFNDFNRRPWPTSELRSTSG

SEQ ID NO: 1295836 - protein, 18 aa, Mycobacterium
LGGPRLKDVAGLSLTKLF

SEQ ID NO: 1295837 - protein, 22 aa, Mycobacterium
LGIEFPIFAFTHCRDVVVAVSK

SEQ ID NO: 1295838 - protein, 22 aa, Mycobacterium
LGRAEIRAIFRSSKVGNIAGCL

SEQ ID NO: 1295839 - protein, 29 aa, Mycobacterium
LHDCFSANELLLYEALGLCGEGEAPKLID

SEQ ID NO: 1295840 - protein, 25 aa, Mycobacterium
LHNMRTMRFLPPEKQARKARETLEV

SEQ ID NO: 1295841 - protein, 20 aa, Mycobacterium
LIAAERITMLPGPPTLYHSL

SEQ ID NO: 1295842 - protein, 26 aa, Mycobacterium
LIAASHDRPWWQLDFWHPRCDPRIPL

SEQ ID NO: 1295843 - protein, 18 aa, Mycobacterium
LIIYDEVHLLPAPVFRMT

SEQ ID NO: 1295844 - protein, 21 aa, Mycobacterium
LKDKQLYTLDLGSLVAGSRYR

SEQ ID NO: 1295845 - protein, 21 aa, Mycobacterium
LKRANAILKAASVFFAAELDR

SEQ ID NO: 1295846 - protein, 20 aa, Mycobacterium
LLELNRLFMAWVETEYHRRT

SEQ ID NO: 1295847 - protein, 17 aa, Mycobacterium
LLLLDEPTNHLDAESVL

SEQ ID NO: 1295848 - protein, 20 aa, Mycobacterium
LLVDVIGLPWEEVHAEACRW

SEQ ID NO: 1295849 - protein, 22 aa, Mycobacterium
LNGLPVSIIIRTTLEDLESRAG

SEQ ID NO: 1295850 - protein, 19 aa, Mycobacterium
LNRAPTLHRLGIQAFEPQL

SEQ ID NO: 1295851 - protein, 18 aa, Mycobacterium
LPAQWRGPVLGPGIQNWA

SEQ ID NO: 1295852 - protein, 30 aa, Mycobacterium; identical to SEQ ID NO: 835649

SEQ ID NO: 1295853 - protein, 50 aa, Mycobacterium
LQLVPKMLRMLRPDLTIGFFLHIPFPPVELFMQMPWRTEIIEGLLGADLV

SEQ ID NO: 1295854 - protein, 19 aa, Mycobacterium
LQNAASIAALFLTTEAVVA

SEQ ID NO: 1295855 - protein, 21 aa, Mycobacterium
LRDRAFYAPAQSRYRIFIVDE

SEQ ID NO: 1295856 - protein, 19 aa, Mycobacterium
LRGFYMCPVTPLTDEFELD

SEQ ID NO: 1295857 - protein, 27 aa, Mycobacterium
LSGGKRSFILVPGIDVPFHSSVLRVGV

SEQ ID NO: 1295858 - protein, 20 aa, Mycobacterium
LSYEQIVAELDRIKAAVWAV

SEQ ID NO: 1295859 - protein, 18 aa, Mycobacterium
LTAAHWLSEENVPVVGVP

SEQ ID NO: 1295860 - protein, 19 aa, Mycobacterium
LTEGMRFDKGYISGYFVTD

SEQ ID NO: 1295861 - protein, 26 aa, Mycobacterium
LTLRNRALLELLYSTGARISEAVGLD

SEQ ID NO: 1295862 - protein, 18 aa, Mycobacterium
LVAIDTLLARMENDRDRL

SEQ ID NO: 1295863 - protein, 18 aa, Mycobacterium
LVERAGVDPALVDDVIWG

SEQ ID NO: 1295864 - protein, 21 aa, Mycobacterium
MDDFLVLQRDWGADGGLRTVS

SEQ ID NO: 1295865 - protein, 24 aa, Mycobacterium
MEAPAIGRVIALDAGLPVTVPGMQ

SEQ ID NO: 1295866 - protein, 28 aa, Mycobacterium
MKNYGVDVTIVEFLPRALPNEDAEVSKE

SEQ ID NO: 1295867 - protein, 18 aa, Mycobacterium
MPAMIRLGGKMYGADGRT

SEQ ID NO: 1295868 - protein, 18 aa, Mycobacterium
MPVNWKLLAENFGGDQYH

SEQ ID NO: 1295869 - protein, 17 aa, Mycobacterium
MVDMAHFAGLVAGKVFT

SEQ ID NO: 1295870 - protein, 23 aa, Mycobacterium
NDSRGFFTSRVIGTFVNEALAML

SEQ ID NO: 1295871 - protein, 23 aa, Mycobacterium
NDVAPKLPELWGGSADLAGSNNT

SEQ ID NO: 1295872 - protein, 23 aa, Mycobacterium
NEKINEPRFPSFKGIMAAKKKEV

SEQ ID NO: 1295873 - protein, 24 aa, Mycobacterium
NGERLEIASPRLGFRIQLDPLELE

SEQ ID NO: 1295874 - protein, 17 aa, Mycobacterium
NGGMFYGADAPFGGYKS

SEQ ID NO: 1295875 - protein, 27 aa, Mycobacterium
NGQKMWTSLIAYADYVWLAVRTNPEAK

SEQ ID NO: 1295876 - protein, 24 aa, Mycobacterium
NIARNALLGAGFPESVPGTTVDRQ

SEQ ID NO: 1295877 - protein, 19 aa, Mycobacterium
NKLFEERIIFLGVQVDDAS

SEQ ID NO: 1295878 - protein, 26 aa, Mycobacterium
NKLLGSFELTGIPPAPRGVPQIEVTF

SEQ ID NO: 1295879 - protein, 27 aa, Mycobacterium
NLELRYRGLRAPHKIKMGVSGCARECA

SEQ ID NO: 1295880 - protein, 19 aa, Mycobacterium
NLRDRFVFALLAETGMRLG

SEQ ID NO: 1295881 - protein, 19 aa, Mycobacterium
NNIAILAGDYLFATASRLV

SEQ ID NO: 1295882 - protein, 29 aa, Mycobacterium
NPDGENLDPLFDVLLEHIPPPQGDPEAPL

SEQ ID NO: 1295883 - protein, 22 aa, Mycobacterium
NPKPLGMPLQYMVSGMAVAATH

SEQ ID NO: 1295884 - protein, 18 aa, Mycobacterium
NPMLGFRGASRYAHPAYA

SEQ ID NO: 1295885 - protein, 18 aa, Mycobacterium
NSLLDINVFGRRAGIAAA

SEQ ID NO: 1295886 - protein, 24 aa, Mycobacterium
NTVRGYATSLAQWWSFLEQRGQSD

SEQ ID NO: 1295887 - protein, 17 aa, Mycobacterium
NWVLRTLSDLVQITDAK

SEQ ID NO: 1295888 - protein, 18 aa, Mycobacterium
PAFRQVFAAQFLPDGTRA

SEQ ID NO: 1295889 - protein, 26 aa, Mycobacterium
PAFSLDGLICTLEMYKGKVKVNFAKG

SEQ ID NO: 1295890 - protein, 18 aa, Mycobacterium
PALVAWKLGLSSKNAKTI

SEQ ID NO: 1295891 - protein, 35 aa, Mycobacterium
PAPNNMVYVTLRLPLTRGVGIYAACKRAADTTFDG

SEQ ID NO: 1295892 - protein, 17 aa, Mycobacterium
PASFLVAPRLKGGYRLD

SEQ ID NO: 1295893 - protein, 21 aa, Mycobacterium
PENLPVGYYTQPTLLADVDPD

SEQ ID NO: 1295894 - protein, 20 aa, Mycobacterium
PGEIIHHPYFGLTVVSCERG

SEQ ID NO: 1295895 - protein, 25 aa, Mycobacterium
PGMNEIVFPAAILQPPFFDADADDA

SEQ ID NO: 1295896 - protein, 19 aa, Mycobacterium
PGPHLLVLARGPEGYRRLS

SEQ ID NO: 1295897 - protein, 17 aa, Mycobacterium
PGSFYALPQSPQLFKQL

SEQ ID NO: 1295898 - protein, 18 aa, Mycobacterium
PHAVFRKFGLCRICLREM

SEQ ID NO: 1295899 - protein, 25 aa, Mycobacterium
PLDLTYKEFELLKYLAQHAGRVFTR

SEQ ID NO: 1295900 - protein, 17 aa, Mycobacterium
PLSLGRLDRGWVVASET

SEQ ID NO: 1295901 - protein, 18 aa, Mycobacterium
PPMVDQIRFFAGAARVLE

SEQ ID NO: 1295902 - protein, 25 aa, Mycobacterium
PPTDTRAYFRGECLRRFGADIAAAS

SEQ ID NO: 1295903 - protein, 32 aa, Mycobacterium; identical to SEQ ID NO: 846897

SEQ ID NO: 1295904 - protein, 25 aa, Mycobacterium
PSTPSHWRRNLMACTGIEFCKLSFA

SEQ ID NO: 1295905 - protein, 23 aa, Mycobacterium
PTDPTIYRFYEVLQVYGGAIKEL

SEQ ID NO: 1295906 - protein, 26 aa, Mycobacterium
PTMYVNQPWTIRQYAGFSTAAESNAF

SEQ ID NO: 1295907 - protein, 29 aa, Mycobacterium
PVNFVPVIDKDVRRWWRSDSLWQAHDARY

SEQ ID NO: 1295908 - protein, 17 aa, Mycobacterium
PVVASIARKLGALTVGV

SEQ ID NO: 1295909 - protein, 19 aa, Mycobacterium
PVYKMPWGTMHPTTISAPI

SEQ ID NO: 1295910 - protein, 18 aa, Mycobacterium
PYSARELIARIRAVLRRG

SEQ ID NO: 1295911 - protein, 24 aa, Mycobacterium
QAGLRTDYLFRLANQRGGIVLGTG

SEQ ID NO: 1295912 - protein, 21 aa, Mycobacterium
QAIRRLVKRGGPITFQAVQRE

SEQ ID NO: 1295913 - protein, 27 aa, Mycobacterium
QEIMTELEIAPTRRLRGLGDRQRKALL

SEQ ID NO: 1295914 - protein, 18 aa, Mycobacterium
QFTCPYHGWSYSMDGSLV

SEQ ID NO: 1295915 - protein, 25 aa, Mycobacterium
QKQWLEIGMLLVQNADVLLLDEPVA

SEQ ID NO: 1295916 - protein, 25 aa, Mycobacterium
QKVKHRVFHYPGGLVDFVKHINRTK

SEQ ID NO: 1295917 - protein, 25 aa, Mycobacterium
QLAKAMDRKVWLPSGGTLVIDRTEA

SEQ ID NO: 1295918 - protein, 21 aa, Mycobacterium
QLEMRLNRQLADIEKLQVNVR

SEQ ID NO: 1295919 - protein, 32 aa, Mycobacterium; identical to SEQ ID NO: 116847

SEQ ID NO: 1295920 - protein, 18 aa, Mycobacterium
QLLQEVWGYDFFGGTRTV

SEQ ID NO: 1295921 - protein, 20 aa, Mycobacterium
QLTMRVFTGLTLLDTIQGTV

SEQ ID NO: 1295922 - protein, 25 aa, Mycobacterium
QMEYMLPRLRGWGESMSRQAGGRAG

SEQ ID NO: 1295923 - protein, 19 aa, Mycobacterium
QMLAIGRALMARPKVLLLD

SEQ ID NO: 1295924 - protein, 18 aa, Mycobacterium
QMVSVATAMIPFLEHDDA

SEQ ID NO: 1295925 - protein, 20 aa, Mycobacterium
QRDFTLWKGAKPGEPSWPTP

SEQ ID NO: 1295926 - protein, 24 aa, Mycobacterium
QRRLEIARALATEPKLLCLDEPAA

SEQ ID NO: 1295927 - protein, 31 aa, Mycobacterium; identical to SEQ ID NO: 850419

SEQ ID NO: 1295928 - protein, 18 aa, Mycobacterium
QVATGIVNIWTAAAGPVA

SEQ ID NO: 1295929 - protein, 23 aa, Mycobacterium
QVELSTIRLLAKLPTIAAYAYKK

SEQ ID NO: 1295930 - protein, 17 aa, Mycobacterium
QVLQLPDDRLDDLLALA

SEQ ID NO: 1295931 - protein, 24 aa, Mycobacterium
QVRAGLKAIYLSGWQVAGDANLSG

SEQ ID NO: 1295932 - protein, 24 aa, Mycobacterium
QVSLAGRYLVYVPGASSTGISRKL

SEQ ID NO: 1295933 - protein, 19 aa, Mycobacterium
QYEAPLGITLRELLEYAGG

SEQ ID NO: 1295934 - protein, 24 aa, Mycobacterium
RADIPRLLSLYREGKLLLDETVTH

SEQ ID NO: 1295935 - protein, 20 aa, Mycobacterium
RADRFLPNGWCMLPPLQSCD

SEQ ID NO: 1295936 - protein, 18 aa, Mycobacterium
RAFTFREYVSVYGLTRSE

SEQ ID NO: 1295937 - protein, 26 aa, Mycobacterium
RAIIREPSVFLFDEPLSNLDAKLRVE

SEQ ID NO: 1295938 - protein, 22 aa, Mycobacterium
RAIMEEVLLPVMYDIPSRDDVA

SEQ ID NO: 1295939 - protein, 25 aa, Mycobacterium
RALAVDPQVLLLDEPFGALDAKVRE

SEQ ID NO: 1295940 - protein, 25 aa, Mycobacterium
RAPLPDTVAAFWALVKAGWDVEVAR

SEQ ID NO: 1295941 - protein, 18 aa, Mycobacterium
RAPRSWCEPIYNITHWTT

SEQ ID NO: 1295942 - protein, 24 aa, Mycobacterium
RDDEARGVIWPTIPPDILGQSGTA

SEQ ID NO: 1295943 - protein, 23 aa, Mycobacterium
RDPNVDWAALAAAPGPLILHATA

SEQ ID NO: 1295944 - protein, 17 aa, Mycobacterium
RDRIVSEVAIILRTEKS

SEQ ID NO: 1295945 - protein, 24 aa, Mycobacterium
RDSAWLLVSILRQLGLAARFVSGY

SEQ ID NO: 1295946 - protein, 22 aa, Mycobacterium
REAKSYFLNIKGPELLNKFVGE

SEQ ID NO: 1295947 - protein, 30 aa, Mycobacterium
REQAAYPLGKGFRPKVWPPVRRIDGAYGDR

SEQ ID NO: 1295948 - protein, 26 aa, Mycobacterium
RERANAIGLFRYQLICPALEDGLSTR

SEQ ID NO: 1295949 - protein, 24 aa, Mycobacterium
REVQADIRRKIEIGCYQGLRHRRG

SEQ ID NO: 1295950 - protein, 28 aa, Mycobacterium
RFSTNTFPSWPLAHPFRFVAHNGEINTV

SEQ ID NO: 1295951 - protein, 29 aa, Mycobacterium
RFSTNTFPSWPLAHPFRRVAHNGEINTVT

SEQ ID NO: 1295952 - protein, 30 aa, Mycobacterium; identical to SEQ ID NO: 785720

SEQ ID NO: 1295953 - protein, 24 aa, Mycobacterium
RHDPSDVHWLGRDRFVLSCGHSSL

SEQ ID NO: 1295954 - protein, 26 aa, Mycobacterium
RIDVTVRISGFFRDAFPHVVAMLDDA

SEQ ID NO: 1295955 - protein, 17 aa, Mycobacterium
RIFGSKPGTYGAGLLQL

SEQ ID NO: 1295956 - protein, 36 aa, Mycobacterium; identical to SEQ ID NO: 17410

SEQ ID NO: 1295957 - protein, 19 aa, Mycobacterium
RKVSPLAVQMIMPNGAAAV

SEQ ID NO: 1295958 - protein, 17 aa, Mycobacterium
RLILGLGAGWYEKDYTT

SEQ ID NO: 1295959 - protein, 17 aa, Mycobacterium
RLLARIYSESDLLVAEC

SEQ ID NO: 1295960 - protein, 19 aa, Mycobacterium
RLMILASEDIGMADPTALP

SEQ ID NO: 1295961 - protein, 26 aa, Mycobacterium
RLPAVDRAILRVAVWELLHAEDVPEP

SEQ ID NO: 1295962 - protein, 18 aa, Mycobacterium
RLPDLRCLMLTSFTSDEA

SEQ ID NO: 1295963 - protein, 19 aa, Mycobacterium
RLRDEAPLYRNEELGFWAL

SEQ ID NO: 1295964 - protein, 24 aa, Mycobacterium
RLREAVRVFGFHLSGLDMRQNSDV

SEQ ID NO: 1295965 - protein, 18 aa, Mycobacterium
RLRTLVSKGFTPRRIREL

SEQ ID NO: 1295966 - protein, 19 aa, Mycobacterium
RLTGRSPILLAGMTPTTVD

SEQ ID NO: 1295967 - protein, 17 aa, Mycobacterium
RMFLVDTAQGRIVSDEE

SEQ ID NO: 1295968 - protein, 19 aa, Mycobacterium
RNPLLTEAMTRAFVFADAS

SEQ ID NO: 1295969 - protein, 17 aa, Mycobacterium
RNVVLEKKWGAPTITND

SEQ ID NO: 1295970 - protein, 27 aa, Mycobacterium
RPEIAEQLLRVLARRLRRTNNNLADLI

SEQ ID NO: 1295971 - protein, 17 aa, Mycobacterium
RQIFIRPHCPWQNGKVE

SEQ ID NO: 1295972 - protein, 19 aa, Mycobacterium
RQMLRRVTIIDSGATEFLP

SEQ ID NO: 1295973 - protein, 18 aa, Mycobacterium
RRCFASLFTDRAIHYRID

SEQ ID NO: 1295974 - protein, 24 aa, Mycobacterium
RREIRDIVAYLRVLDNPGDSVSMR

SEQ ID NO: 1295975 - protein, 17 aa, Mycobacterium
RRFGDAFIPMDETLAHA

SEQ ID NO: 1295976 - protein, 25 aa, Mycobacterium
RRGQPRLRPPFPAVAGLYACPTVVN

SEQ ID NO: 1295977 - protein, 22 aa, Mycobacterium
RRLREKFPTLQDPPSDDICYAT

SEQ ID NO: 1295978 - protein, 24 aa, Mycobacterium
RRRDRPPLLLPEQIQAILDGCAVF

SEQ ID NO: 1295979 - protein, 17 aa, Mycobacterium
RRRLGLTATLIREDGRE

SEQ ID NO: 1295980 - protein, 24 aa, Mycobacterium
RRSRGTPRIANRLLRRVRDYAEVR

SEQ ID NO: 1295981 - protein, 24 aa, Mycobacterium
RTELGPVHILVTSAGLVDFAPFLE

SEQ ID NO: 1295982 - protein, 24 aa, Mycobacterium
RTKNWRPIIGTAFVHTVIDDHSRM

SEQ ID NO: 1295983 - protein, 20 aa, Mycobacterium
RTQIRALGLLKGACAQVNKD

SEQ ID NO: 1295984 - protein, 25 aa, Mycobacterium
RVDAVVFLLRTLNAADIALLKQIGE

SEQ ID NO: 1295985 - protein, 20 aa, Mycobacterium
RVEQLPEIWRRLVEGGMESG

SEQ ID NO: 1295986 - protein, 20 aa, Mycobacterium
RVYAKSTNLPRVLGGLGVAI

SEQ ID NO: 1295987 - protein, 18 aa, Mycobacterium
RYFLDNVAEWILELDRGR

SEQ ID NO: 1295988 - protein, 20 aa, Mycobacterium
RYRIFIVDEAHMVTTAGFNA

SEQ ID NO: 1295989 - protein, 17 aa, Mycobacterium
RYSAFTRMPLGGDDPEF

SEQ ID NO: 1295990 - protein, 26 aa, Mycobacterium
RYTGRGMPLLDLIQEGNLGLIRAMEK

SEQ ID NO: 1295991 - protein, 26 aa, Mycobacterium
SAEHLDPIWRLWDELPAQWRGPVLGP

SEQ ID NO: 1295992 - protein, 17 aa, Mycobacterium
SAEVACIPSLYEGFSLP

SEQ ID NO: 1295993 - protein, 20 aa, Mycobacterium
SAGHIYAVIGLKDTTTGDTL

SEQ ID NO: 1295994 - protein, 23 aa, Mycobacterium
SAPRKWIFSPTRSRNSSAAAIAP

SEQ ID NO: 1295995 - protein, 19 aa, Mycobacterium
SATPIPRTLEMSLAGIREM

SEQ ID NO: 1295996 - protein, 25 aa, Mycobacterium
SDGLAATLRLAPTPPWHTTRWQVTR

SEQ ID NO: 1295997 - protein, 23 aa, Mycobacterium
SDMFGELSIFDPGPRTSSATTIT

SEQ ID NO: 1295998 - protein, 17 aa, Mycobacterium
SDYLAGRAFSFISAIDS

SEQ ID NO: 1295999 - protein, 25 aa, Mycobacterium
SEGGIGWIPFYLDRSDRHYTNQKWL

SEQ ID NO: 1296000 - protein, 20 aa, Mycobacterium
SEGIGTIAAAFWPKPVVVRM

SEQ ID NO: 1296001 - protein, 29 aa, Mycobacterium
SGGVDSTALYPPKRFLGAARNIEEGGSLT

SEQ ID NO: 1296002 - protein, 23 aa, Mycobacterium
SGLDPVRTAYLSQLLIDINAQID

SEQ ID NO: 1296003 - protein, 25 aa, Mycobacterium
SGQAGALRLAIARALILVQPEDRPA

SEQ ID NO: 1296004 - protein, 26 aa, Mycobacterium
SGSRFAGMLVAGTYLREFVADGVEWA

SEQ ID NO: 1296005 - protein, 38 aa, Mycobacterium; identical to SEQ ID NO: 785984

SEQ ID NO: 1296006 - protein, 24 aa, Mycobacterium
SIIANRVSYFYDFRGPSMAIDTAC

SEQ ID NO: 1296007 - protein, 20 aa, Mycobacterium
SITPRDALASAGKTLVELFG

SEQ ID NO: 1296008 - protein, 23 aa, Mycobacterium
SLGLLDEFPPYDDIFDPVNRVLL

SEQ ID NO: 1296009 - protein, 19 aa, Mycobacterium
SLPHAVLMMIPEAWERHES

SEQ ID NO: 1296010 - protein, 24 aa, Mycobacterium
SLSMTPLVNWRIPGPELKFEERWM

SEQ ID NO: 1296011 - protein, 21 aa, Mycobacterium
SPIGKRNGWLSGLHATELLGA

SEQ ID NO: 1296012 - protein, 21 aa, Mycobacterium
SPNWLSVLPQDFSNMAAVQQG

SEQ ID NO: 1296013 - protein, 26 aa, Mycobacterium
SPTETEVWRWYLIDKNAPDDVRDWLR

SEQ ID NO: 1296014 - protein, 18 aa, Mycobacterium
SQVKLIAEPWDIGEGGYQ

SEQ ID NO: 1296015 - protein, 24 aa, Mycobacterium
SRAGWLRWSDKLAAAPLKPGKGPI

SEQ ID NO: 1296016 - protein, 18 aa, Mycobacterium
SRCTSLAGLVLKRPVLPK

SEQ ID NO: 1296017 - protein, 25 aa, Mycobacterium
SRQSLRSFYLQFDGKHELLLALFED

SEQ ID NO: 1296018 - protein, 18 aa, Mycobacterium
STDLLEVTPFIVLGTSST

SEQ ID NO: 1296019 - protein, 19 aa, Mycobacterium
TAGLITDLLVRAIVTRTAL

SEQ ID NO: 1296020 - protein, 20 aa, Mycobacterium
TAGLITDLLVRAIVTRTALI

SEQ ID NO: 1296021 - protein, 19 aa, Mycobacterium
TALMLCTRDVLIRIGDEFA

SEQ ID NO: 1296022 - protein, 17 aa, Mycobacterium
TARFERDAIPLLDQLYG

SEQ ID NO: 1296023 - protein, 22 aa, Mycobacterium
TDFGAFVSLLPGRDGLVHISKL

SEQ ID NO: 1296024 - protein, 28 aa, Mycobacterium
TDYRPLEGFVYAITPFNFTAIAGNLPTA

SEQ ID NO: 1296025 - protein, 31 aa, Mycobacterium
TETRIVVTGNYRAWRHFIAMRASEHADLEIR

SEQ ID NO: 1296026 - protein, 21 aa, Mycobacterium
TGAKEILCIRVLGGSSRRYAG

SEQ ID NO: 1296027 - protein, 25 aa, Mycobacterium
TGKSVFLKSLIGLLRPERGKIIVDG

SEQ ID NO: 1296028 - protein, 21 aa, Mycobacterium
TGLSAFRDRFPDRFFDVGIAE

SEQ ID NO: 1296029 - protein, 19 aa, Mycobacterium
TGPIHIGGTRWAAVGDALG

SEQ ID NO: 1296030 - protein, 27 aa, Mycobacterium
TGRARRCGWFDAVIARYATRVNGITDY

SEQ ID NO: 1296031 - protein, 21 aa, Mycobacterium
TGWDYPSCEAIGLLKMDFLGL

SEQ ID NO: 1296032 - protein, 23 aa, Mycobacterium
THQPIEHLAALRAIPNLSVVRPG

SEQ ID NO: 1296033 - protein, 24 aa, Mycobacterium
THTNHRALLMRLITPKRLKENEDA

SEQ ID NO: 1296034 - protein, 24 aa, Mycobacterium
TIEDHQNSRWIAEPLRLLDCCQET

SEQ ID NO: 1296035 - protein, 17 aa, Mycobacterium
TKGVAMPLRLTSPAPCT

SEQ ID NO: 1296036 - protein, 40 aa, Mycobacterium; identical to SEQ ID NO: 786163

SEQ ID NO: 1296037 - protein, 22 aa, Mycobacterium
TLTATVAFRHPTIESLATVIIE

SEQ ID NO: 1296038 - protein, 24 aa, Mycobacterium
TLVENFLRMTFGFPAEPYEVDPEI

SEQ ID NO: 1296039 - protein, 18 aa, Mycobacterium
TMSFLAMDDPAHLRLRTL

SEQ ID NO: 1296040 - protein, 29 aa, Mycobacterium
TNHAAGWVRMDFIVPSRGLIGFRTDFLTL

SEQ ID NO: 1296041 - protein, 17 aa, Mycobacterium
TNLPRVLGGLGVAIIST

SEQ ID NO: 1296042 - protein, 24 aa, Mycobacterium
TPEARAHWDLIAAKYAAPGTNLPH

SEQ ID NO: 1296043 - protein, 19 aa, Mycobacterium
TPQTLINIRPVVAAIKEFF

SEQ ID NO: 1296044 - protein, 18 aa, Mycobacterium
TRITTVLGILKAYTTRVG

SEQ ID NO: 1296045 - protein, 27 aa, Mycobacterium
TSDEALARVFDYTLAIGKTPIVVNDSR

SEQ ID NO: 1296046 - protein, 23 aa, Mycobacterium
TSIKEVLANHLRISRKAAGERLT

SEQ ID NO: 1296047 - protein, 27 aa, Mycobacterium
TSKRYMHHYNFPPYSTGETGRVGSPKR

SEQ ID NO: 1296048 - protein, 22 aa, Mycobacterium
TSVLTPTFRYNPAVIAQAFATM

SEQ ID NO: 1296049 - protein, 27 aa, Mycobacterium
TTAAPLLYPHMWSWDAAFVAIGLAPLS

SEQ ID NO: 1296050 - protein, 23 aa, Mycobacterium
TTGRLIMQYASQNLIPVTLELGG

SEQ ID NO: 1296051 - protein, 29 aa, Mycobacterium
TTRVIDLIMPIGKGQRALIVSPPKAGKTT

SEQ ID NO: 1296052 - protein, 26 aa, Mycobacterium
TVDAVTFDLRWKAACGLPVTAGAFHS

SEQ ID NO: 1296053 - protein, 20 aa, Mycobacterium
TVLHDIAWRAMQVHGALGVT

SEQ ID NO: 1296054 - protein, 27 aa, Mycobacterium
TVYHYYASKSLILYDIYKGAADFTVDA

SEQ ID NO: 1296055 - protein, 25 aa, Mycobacterium
VADGRKLPWFGPPMSAASMATARLM

SEQ ID NO: 1296056 - protein, 20 aa, Mycobacterium
VAEPYIPLRAVRHLEKGRVV

SEQ ID NO: 1296057 - protein, 21 aa, Mycobacterium
VAGILALPETFPGTVAVIPRF

SEQ ID NO: 1296058 - protein, 18 aa, Mycobacterium
VAGWIKRGPTGFIGTNKS

SEQ ID NO: 1296059 - protein, 24 aa, Mycobacterium
VAHGTFFFHFPTKEHVLLELERRE

SEQ ID NO: 1296060 - protein, 27 aa, Mycobacterium
VARAGKLPVTLFTAGGIATPADAAMMM

SEQ ID NO: 1296061 - protein, 19 aa, Mycobacterium
VDASMPAMIRLGGKMYGAD

SEQ ID NO: 1296062 - protein, 24 aa, Mycobacterium
VDMSLFDLTLYEKQVRGCLFGSSN

SEQ ID NO: 1296063 - protein, 19 aa, Mycobacterium
VDRFFEARKMMSQMAGQMG

SEQ ID NO: 1296064 - protein, 18 aa, Mycobacterium
VEALDRHRLLSDVTRVLA

SEQ ID NO: 1296065 - protein, 19 aa, Mycobacterium
VELDLFSFPDELGSGLPVF

SEQ ID NO: 1296066 - protein, 18 aa, Mycobacterium
VEMFRKLLDQGQAGDNVG

SEQ ID NO: 1296067 - protein, 18 aa, Mycobacterium
VFAQLMLDEAFSKSDPQF

SEQ ID NO: 1296068 - protein, 27 aa, Mycobacterium
VGMRLVGMPLDYRWPDRQLPSEGATRG

SEQ ID NO: 1296069 - protein, 32 aa, Mycobacterium
VIGQVAPWNYPMMMAIWKICPAIAAGNTVVIK

SEQ ID NO: 1296070 - protein, 18 aa, Mycobacterium
VIKVVREIVSGLGLKEAK

SEQ ID NO: 1296071 - protein, 19 aa, Mycobacterium
VIPPELRPMVQLDGGRFAT

SEQ ID NO: 1296072 - protein, 19 aa, Mycobacterium
VKNYVSRLLAKLGMERRTQ

SEQ ID NO: 1296073 - protein, 23 aa, Mycobacterium
VLEETGLLPHLNPGVMSWSELSR

SEQ ID NO: 1296074 - protein, 18 aa, Mycobacterium
VLFGLDLAKRDIAKSHRA

SEQ ID NO: 1296075 - protein, 17 aa, Mycobacterium
VMSLVRDPDAAARYAAD

SEQ ID NO: 1296076 - protein, 17 aa, Mycobacterium
VPAYFNDAQRQATKEAG

SEQ ID NO: 1296077 - protein, 17 aa, Mycobacterium
VPGMQIDRRCGSGLQAV

SEQ ID NO: 1296078 - protein, 30 aa, Mycobacterium; identical to SEQ ID NO: 874480

SEQ ID NO: 1296079 - protein, 18 aa, Mycobacterium
VRAYANASAAMNLVRALT

SEQ ID NO: 1296080 - protein, 21 aa, Mycobacterium
VRDGYECGLTLTYSDIKEGDV

SEQ ID NO: 1296081 - protein, 27 aa, Mycobacterium
VRPDRSVTLALRWLVSFSKARREKTMV

SEQ ID NO: 1296082 - protein, 20 aa, Mycobacterium
VRRSNFVYGSTKAGLDGFYL

SEQ ID NO: 1296083 - protein, 19 aa, Mycobacterium
VRTPSGFDIEYGWDAVTVD

SEQ ID NO: 1296084 - protein, 32 aa, Mycobacterium
VSGRVRLLPLETDWYYFARLFPEEVTACWSGN

SEQ ID NO: 1296085 - protein, 23 aa, Mycobacterium
VSHAFLYNHPELRKRIEHLRGAR

SEQ ID NO: 1296086 - protein, 24 aa, Mycobacterium
VSHETIYQALYFQARGGLKKEVQQ

SEQ ID NO: 1296087 - protein, 26 aa, Mycobacterium
VSIPVLRKDFIVRPYQIHEARAHGAD

SEQ ID NO: 1296088 - protein, 30 aa, Mycobacterium; identical to SEQ ID NO: 786404

SEQ ID NO: 1296089 - protein, 17 aa, Mycobacterium
VSVWLSHEYVRASPGGT

SEQ ID NO: 1296090 - protein, 28 aa, Mycobacterium
VTDMAHFFYIHFGLPTYFKNVFEGHIAS

SEQ ID NO: 1296091 - protein, 32 aa, Mycobacterium; identical to SEQ ID NO: 118480

SEQ ID NO: 1296092 - protein, 24 aa, Mycobacterium
VTVARVAMKWGFGHLGRFSAEYRR

SEQ ID NO: 1296093 - protein, 32 aa, Mycobacterium; identical to SEQ ID NO: 786423

SEQ ID NO: 1296094 - protein, 26 aa, Mycobacterium
VVDLDHYLLKPWDPPEEKLYPVIDAL

SEQ ID NO: 1296095 - protein, 20 aa, Mycobacterium
VVRELAYELAPKIRVNGVAP

SEQ ID NO: 1296096 - protein, 21 aa, Mycobacterium
WKYLMALFSSKVDEYADPKVQ

SEQ ID NO: 1296097 - protein, 25 aa, Mycobacterium
WMECEKILLFSSDYPHWTFDDPRWL

SEQ ID NO: 1296098 - protein, 20 aa, Mycobacterium
WPHLDLSGLPDPFAAELAWM

SEQ ID NO: 1296099 - protein, 19 aa, Mycobacterium
WTSLAHWAQWCFVVARTEK

SEQ ID NO: 1296100 - protein, 26 aa, Mycobacterium
WTTDKDGIILALLASEILAVTGSTPS

SEQ ID NO: 1296101 - protein, 17 aa, Mycobacterium
WVPAHFPKDAWALGRFD

SEQ ID NO: 1296102 - protein, 27 aa, Mycobacterium
WVVGHSYIVYAPLLLGATTVLYEGKPV

SEQ ID NO: 1296103 - protein, 24 aa, Mycobacterium
YEIRTLFGVMFQDGALFGSMSLYD

SEQ ID NO: 1296104 - protein, 23 aa, Mycobacterium
YFEVLHELKLIVDLMYEGGIARM

SEQ ID NO: 1296105 - protein, 19 aa, Mycobacterium
YFVGKPNPMMFRSALNRIE

SEQ ID NO: 1296106 - protein, 25 aa, Mycobacterium
YGAAKLGLVGLINTLAQEGAKYNIK

SEQ ID NO: 1296107 - protein, 32 aa, Mycobacterium
YLAVFDDHTEEILYFGRARRTASTAQRLALFA

SEQ ID NO: 1296108 - protein, 25 aa, Mycobacterium
YLNRELSWLDFNARVLALAADPSLP

SEQ ID NO: 1296109 - protein, 21 aa, Mycobacterium
YPAGTYNWVLRTLSDLVQITD

SEQ ID NO: 1296110 - protein, 32 aa, Mycobacterium; identical to SEQ ID NO: 123357

SEQ ID NO: 1296111 - protein, 20 aa, Mycobacterium
YTLARFPELVDAAPKGLFMT

SEQ ID NO: 1296112 - protein, 28 aa, Mycobacterium
YTTRPGSALLFPTLCTPTADAPIQPTKD

SEQ ID NO: 1296113 - protein, 18 aa, Mycobacterium
YVAKYTICPAVAHGLDGE

SEQ ID NO: 1296114 - protein, 29 aa, Mycobacterium
AAADLGYSGLVAPLTFTSAPGMSCNRRMF

SEQ ID NO: 1296115 - protein, 24 aa, Mycobacterium
AAADPIVAHIFRAHFWFVEERLRT

SEQ ID NO: 1296116 - protein, 20 aa, Mycobacterium
AAAERFHRALLAGATDGKRK

SEQ ID NO: 1296117 - protein, 24 aa, Mycobacterium
AAAGALWFYNFSTWDGVAGIYLED

SEQ ID NO: 1296118 - protein, 22 aa, Mycobacterium
AAAGAMVPWLSAINPNVGLVVR

SEQ ID NO: 1296119 - protein, 19 aa, Mycobacterium
AAAGCPLLMTVVSPTICGT

SEQ ID NO: 1296120 - protein, 26 aa, Mycobacterium
AAAGGTLRLFRPLFGAGLGGRLGTGR

SEQ ID NO: 1296121 - protein, 17 aa, Mycobacterium
AAALALSSSILGGRMDW

SEQ ID NO: 1296122 - protein, 17 aa, Mycobacterium
AAALFRRERTGEPSVVD

SEQ ID NO: 1296123 - protein, 17 aa, Mycobacterium
AAALRRELLRDGQAFYI

SEQ ID NO: 1296124 - protein, 19 aa, Mycobacterium
AAALRVLDALDESSPTVGG

SEQ ID NO: 1296125 - protein, 29 aa, Mycobacterium
AAANPGTKLLILPPLMHGAAQWAVMTALT

SEQ ID NO: 1296126 - protein, 27 aa, Mycobacterium
AAANSWLDAFTHWRRAQGLPASAIAWG

SEQ ID NO: 1296127 - protein, 26 aa, Mycobacterium
AAAPGAQLFILVFAKGAFPPDLEVKP

SEQ ID NO: 1296128 - protein, 25 aa, Mycobacterium
AAAPLPALQLLIYPVVDVGSETRSK

SEQ ID NO: 1296129 - protein, 28 aa, Mycobacterium
AAARAHALGLRRSARYLPLVVRVDRGAV

SEQ ID NO: 1296130 - protein, 18 aa, Mycobacterium
AAARERAPVALGAHGPEV

SEQ ID NO: 1296131 - protein, 25 aa, Mycobacterium
AAARHGMKISFSPVPFADAAGNGAH

SEQ ID NO: 1296132 - protein, 30 aa, Mycobacterium
AAARRDALRIRFNLALYADPRHFDAQLPQF

SEQ ID NO: 1296133 - protein, 30 aa, Mycobacterium
AAARRQLRYFWPRVVGDTSWQLLDSKFSVV

SEQ ID NO: 1296134 - protein, 26 aa, Mycobacterium
AAASGLIDLLLLSGGELVTVLTGHGA

SEQ ID NO: 1296135 - protein, 25 aa, Mycobacterium
AAAVHQSILGDRLRLALDGELAAAV

SEQ ID NO: 1296136 - protein, 24 aa, Mycobacterium
AACNIYADLGWRGVIPVDPRDKGG

SEQ ID NO: 1296137 - protein, 17 aa, Mycobacterium
AADAGVPVLLAAAADAA

SEQ ID NO: 1296138 - protein, 25 aa, Mycobacterium
AADDLEVLGYWLTSQAPPVMQTCHH

SEQ ID NO: 1296139 - protein, 20 aa, Mycobacterium
AADLALGLTLPCWTLLGMLD

SEQ ID NO: 1296140 - protein, 17 aa, Mycobacterium
AADLARRRRARGLRLNH

SEQ ID NO: 1296141 - protein, 23 aa, Mycobacterium
AADPATWPRWAAGLARGGLRQGP

SEQ ID NO: 1296142 - protein, 26 aa, Mycobacterium
AADPFGDVFLVIDGWPAFVAEFPDLE

SEQ ID NO: 1296143 - protein, 28 aa, Mycobacterium
AADPLDPQWLLDTLGLTDVARTTYRRLS

SEQ ID NO: 1296144 - protein, 23 aa, Mycobacterium
AADPLFAELLRRYMDSEATPTLR

SEQ ID NO: 1296145 - protein, 19 aa, Mycobacterium
AADVLLRYNFPAAGLTDDA

SEQ ID NO: 1296146 - protein, 33 aa, Mycobacterium
AADVQRHLLPRPLGDLPGYSVCAMCLPAYAVGG

SEQ ID NO: 1296147 - protein, 28 aa, Mycobacterium
AADYKKLLLAMLQRREAWQIIDFVNQLT

SEQ ID NO: 1296148 - protein, 19 aa, Mycobacterium
AAEAIDVLRAIPGLQMLTV

SEQ ID NO: 1296149 - protein, 24 aa, Mycobacterium
AAEALRWAMLSGEPQVVLADALAE

SEQ ID NO: 1296150 - protein, 24 aa, Mycobacterium
AAEAVMMGRWRRLGLLRRPTRADH

SEQ ID NO: 1296151 - protein, 25 aa, Mycobacterium
AAEDGLCALALRFSKDWMSPAERFE

SEQ ID NO: 1296152 - protein, 23 aa, Mycobacterium
AAEIARMALFLSTPAARHITGQT

SEQ ID NO: 1296153 - protein, 25 aa, Mycobacterium
AAEICDGWLPIFYTPRMADTYNSWL

SEQ ID NO: 1296154 - protein, 19 aa, Mycobacterium
AAELAGCPVLVVPNDVVVP

SEQ ID NO: 1296155 - protein, 21 aa, Mycobacterium
AAELAMLLLTSFEGGIVVARA

SEQ ID NO: 1296156 - protein, 24 aa, Mycobacterium
AAELATMFHIYFLGSSEGLVFDVA

SEQ ID NO: 1296157 - protein, 34 aa, Mycobacterium
AAELPRQMLRSWYIFYFQLPWLPDRSASWVVPWL

SEQ ID NO: 1296158 - protein, 23 aa, Mycobacterium
AAELVRLYLDGRLDNRYLRGRTS

SEQ ID NO: 1296159 - protein, 18 aa, Mycobacterium
AAEMLRPISRKYDLREHD

SEQ ID NO: 1296160 - protein, 24 aa, Mycobacterium
AAERVGITALLDRKPRQLSGGQQQ

SEQ ID NO: 1296161 - protein, 20 aa, Mycobacterium
AAESFGFTGALIPTGAWCED

SEQ ID NO: 1296162 - protein, 32 aa, Mycobacterium
AAEVAEMWPFADLEPFAAFGWEPRGGYGDAYR

SEQ ID NO: 1296163 - protein, 24 aa, Mycobacterium
AAEVGLGRRQVLSRWGRIDAAQRW

SEQ ID NO: 1296164 - protein, 27 aa, Mycobacterium
AAFNTALWPITWAPLFDRVMAPTVTGS

SEQ ID NO: 1296165 - protein, 18 aa, Mycobacterium
AAFVLPLHRRDDDSAWAS

SEQ ID NO: 1296166 - protein, 19 aa, Mycobacterium
AAFYGHVLGWTYDPATRQV

SEQ ID NO: 1296167 - protein, 20 aa, Mycobacterium
AAGEGLRRLGFESHVVTVDG

SEQ ID NO: 1296168 - protein, 19 aa, Mycobacterium
AAGFPRPILHGLCTYGIAC

SEQ ID NO: 1296169 - protein, 24 aa, Mycobacterium
AAGGLGFALLEFLGATSRPGVEVV

SEQ ID NO: 1296170 - protein, 27 aa, Mycobacterium
AAGGQKPWLPHFYLGHGIGTSAAEMPM

SEQ ID NO: 1296171 - protein, 21 aa, Mycobacterium
AAGIEPLRLSKRPTDLATKQA

SEQ ID NO: 1296172 - protein, 27 aa, Mycobacterium
AAGLDTRAFRLPWPDGMTVFEIDQPTV

SEQ ID NO: 1296173 - protein, 23 aa, Mycobacterium
AAGLIEKVTGLLAPYRADEWTSP

SEQ ID NO: 1296174 - protein, 17 aa, Mycobacterium
AAGLRRNVMAAIERMTG

SEQ ID NO: 1296175 - protein, 24 aa, Mycobacterium
AAGSGVLSWWVQYRGQKSGDPCVD

SEQ ID NO: 1296176 - protein, 24 aa, Mycobacterium
AAGTPLRLVSLVALDPTFGVLRGD

SEQ ID NO: 1296177 - protein, 32 aa, Mycobacterium
AAGVAFPDALLTRGLYQYKPDLPFTPGAEIAG

SEQ ID NO: 1296178 - protein, 23 aa, Mycobacterium
AAGVGVIWLADWADDMVNVSAHH

SEQ ID NO: 1296179 - protein, 29 aa, Mycobacterium
AAGVSKALFYFYFPRKEDVLFEVGVMSTR

SEQ ID NO: 1296180 - protein, 24 aa, Mycobacterium
AAGVVALPWHAAYSASKYGLRGLS

SEQ ID NO: 1296181 - protein, 27 aa, Mycobacterium
AAHTGTLWRVGFGGFAPGFAYLVGGDE

SEQ ID NO: 1296182 - protein, 18 aa, Mycobacterium
AAHWKKIWSTNPLERLNK

SEQ ID NO: 1296183 - protein, 28 aa, Mycobacterium
AAIADLRFVNRGFAPLLLPRVVASVFEI

SEQ ID NO: 1296184 - protein, 24 aa, Mycobacterium
AAIAGLTRDLAQQWGIRKGIRVNA

SEQ ID NO: 1296185 - protein, 29 aa, Mycobacterium
AAIIAYNYPNQLALAKLAPALAAGCTVVL

SEQ ID NO: 1296186 - protein, 17 aa, Mycobacterium
AAILEYCGAQRIAVVPF

SEQ ID NO: 1296187 - protein, 18 aa, Mycobacterium
AAILFAPVGDLVLPALEG

SEQ ID NO: 1296188 - protein, 17 aa, Mycobacterium
AAIPGGPGGVAGPDGAA

SEQ ID NO: 1296189 - protein, 30 aa, Mycobacterium
AAIVEFPPAGTLVGIAKRELRGVPTHPVKS

SEQ ID NO: 1296190 - protein, 26 aa, Mycobacterium
AAKHGIVGIMRVYANILATHSIRVNS

SEQ ID NO: 1296191 - protein, 19 aa, Mycobacterium
AAKPFIKVLCEAQQELAGR

SEQ ID NO: 1296192 - protein, 27 aa, Mycobacterium
AAKWREIFGPQNFFLELMDHGLDIERR

SEQ ID NO: 1296193 - protein, 38 aa, Mycobacterium
AALEEFVLRGGKRLRPAFAYWGWRAVADRPADSGVLLL

SEQ ID NO: 1296194 - protein, 30 aa, Mycobacterium
AALFLDRGQWLARLLMVDKLARLKSVPILL

SEQ ID NO: 1296195 - protein, 25 aa, Mycobacterium
AALGDLPLIYPFLVNDPGEGTQAKR

SEQ ID NO: 1296196 - protein, 19 aa, Mycobacterium
AALGVRVLRYGSAGGRDLA

SEQ ID NO: 1296197 - protein, 23 aa, Mycobacterium
AALISPLRLRGMSAMLTRIKRRL

SEQ ID NO: 1296198 - protein, 20 aa, Mycobacterium
AALKEWRLRTSKELGVPAFV

SEQ ID NO: 1296199 - protein, 19 aa, Mycobacterium
AALLRICGGADLAAMAGFC

SEQ ID NO: 1296200 - protein, 24 aa, Mycobacterium
AALMPERFWVLVHQFEWKVKAGAR

SEQ ID NO: 1296201 - protein, 18 aa, Mycobacterium
AALPPDRRRDFLVDSGYL

SEQ ID NO: 1296202 - protein, 26 aa, Mycobacterium
AALQVPLIAVVLRRGYGLGAQAMTGG

SEQ ID NO: 1296203 - protein, 25 aa, Mycobacterium
AALRDSIHGYVLAGVPLLDDWPVVA

SEQ ID NO: 1296204 - protein, 17 aa, Mycobacterium
AALRLTRLIMEFENADH

SEQ ID NO: 1296205 - protein, 17 aa, Mycobacterium
AALVCHGALTRNPDLRI

SEQ ID NO: 1296206 - protein, 24 aa, Mycobacterium
AAMRADLDRFWARALADFKEIVEQ

SEQ ID NO: 1296207 - protein, 26 aa, Mycobacterium
AAMRTVTGPRWRLGGRDIAALWRRAV

SEQ ID NO: 1296208 - protein, 37 aa, Mycobacterium
AANPLHPMALRLLRPKQVIMLGRPTLHRPVSALLADP

SEQ ID NO: 1296209 - protein, 24 aa, Mycobacterium
AANSIARYKLPKAVVFRAAIQRSP

SEQ ID NO: 1296210 - protein, 19 aa, Mycobacterium
AANYLSVGQIYLLDNPLLR

SEQ ID NO: 1296211 - protein, 23 aa, Mycobacterium
AAPAWPVEYGGCDWSLTQHYIFS

SEQ ID NO: 1296212 - protein, 26 aa, Mycobacterium
AAPGLRFVGFLSRPGLISYVAKQSQH

SEQ ID NO: 1296213 - protein, 17 aa, Mycobacterium
AAPVMRITPPTVLTLWT

SEQ ID NO: 1296214 - protein, 25 aa, Mycobacterium
AAQEVPLILMITSYYVRTMEKALAP

SEQ ID NO: 1296215 - protein, 27 aa, Mycobacterium
AAQPRTLHALLMLWTDRLDEAADQFNA

SEQ ID NO: 1296216 - protein, 24 aa, Mycobacterium
AAQRPLFTDFAPRLLVSHPAEVKV

SEQ ID NO: 1296217 - protein, 20 aa, Mycobacterium
AAQSWHWRHAGRSSWAVRDL

SEQ ID NO: 1296218 - protein, 17 aa, Mycobacterium
AAQTIRGGLADCTIALG

SEQ ID NO: 1296219 - protein, 24 aa, Mycobacterium
AAQTQVPIHPDLAARWSPRAFDPA

SEQ ID NO: 1296220 - protein, 24 aa, Mycobacterium
AARAAITRWLIEQKGFCAVAAEAD

SEQ ID NO: 1296221 - protein, 24 aa, Mycobacterium
AARALATARLLVSGSAPLPVPVFD

SEQ ID NO: 1296222 - protein, 24 aa, Mycobacterium
AARDRAFFCAYAMEYLARAGLSKE

SEQ ID NO: 1296223 - protein, 19 aa, Mycobacterium
AARILIHRSRGKVGWVLGT

SEQ ID NO: 1296224 - protein, 34 aa, Mycobacterium
AARIVTRYPQARSALLPLLHLVQAEDGCLTSAGI

SEQ ID NO: 1296225 - protein, 21 aa, Mycobacterium
AARKAVELALAWLTRGDLNIA

SEQ ID NO: 1296226 - protein, 29 aa, Mycobacterium
AARPVLFSTFLMWVLADLFTTLPEVGDLD

SEQ ID NO: 1296227 - protein, 17 aa, Mycobacterium
AARRKFLELAAALADHF

SEQ ID NO: 1296228 - protein, 22 aa, Mycobacterium
AARRLVHVPMGRFAEPAELAAA

SEQ ID NO: 1296229 - protein, 25 aa, Mycobacterium
AARRRDLGLPYSTQASVAKLIATDA

SEQ ID NO: 1296230 - protein, 20 aa, Mycobacterium
AARVDLYFEAAVAGAIPVIR

SEQ ID NO: 1296231 - protein, 24 aa, Mycobacterium
AARVRIRLLRELAATGESLVATHL

SEQ ID NO: 1296232 - protein, 21 aa, Mycobacterium
AASFRFDSAVSSWLYRIVVNA

SEQ ID NO: 1296233 - protein, 26 aa, Mycobacterium
AASKHGIVGLMRTLANALAPHSIRVN

SEQ ID NO: 1296234 - protein, 24 aa, Mycobacterium
AASRFSSAFTFQYSKRPGTPAADM

SEQ ID NO: 1296235 - protein, 19 aa, Mycobacterium
AASWDRLRTVTAAFPLLVS

SEQ ID NO: 1296236 - protein, 17 aa, Mycobacterium
AASYAGTLARWSTSRHF

SEQ ID NO: 1296237 - protein, 26 aa, Mycobacterium
AATAGWADALLLRVDRRNQVLIAGGQ

SEQ ID NO: 1296238 - protein, 24 aa, Mycobacterium
AATDLMDQAWWSPGLTHPDGRSAF

SEQ ID NO: 1296239 - protein, 18 aa, Mycobacterium
AATGARLAWIPRRAGERG

SEQ ID NO: 1296240 - protein, 25 aa, Mycobacterium
AATIKKVFLELGGKSAFLVLDDADL

SEQ ID NO: 1296241 - protein, 19 aa, Mycobacterium
AATILPRVITRLRHEYPTT

SEQ ID NO: 1296242 - protein, 25 aa, Mycobacterium
AATKPYGFMPFRPGPGVGGHCIPCD

SEQ ID NO: 1296243 - protein, 19 aa, Mycobacterium
AATLPYGLAPLVVPQLKTI

SEQ ID NO: 1296244 - protein, 23 aa, Mycobacterium
AATPLRYPGMPADRFWEFEDAKV

SEQ ID NO: 1296245 - protein, 19 aa, Mycobacterium
AATVLPYRQFHDVAENFRY

SEQ ID NO: 1296246 - protein, 26 aa, Mycobacterium
AAVCLPHDWLTWRLSGSDDIGDLHTD

SEQ ID NO: 1296247 - protein, 21 aa, Mycobacterium
AAVCWRLRRRHGLPVHDIAPM

SEQ ID NO: 1296248 - protein, 35 aa, Mycobacterium
AAVEGFIRQILGWREYMWHLYWHFGERYVDSNELD

SEQ ID NO: 1296249 - protein, 17 aa, Mycobacterium
AAVIGRVKLSAKASVWY

SEQ ID NO: 1296250 - protein, 21 aa, Mycobacterium
AAVLAALARLAAAVAAELVDG

SEQ ID NO: 1296251 - protein, 21 aa, Mycobacterium
AAVLNRLRRAQGQLTGVISMI

SEQ ID NO: 1296252 - protein, 23 aa, Mycobacterium
AAVPDHLLQILARFARNLRESSS

SEQ ID NO: 1296253 - protein, 22 aa, Mycobacterium
AAVSRYWEIDDVRPAFIHANAL

SEQ ID NO: 1296254 - protein, 20 aa, Mycobacterium
AAYAPRPRMLVFGAIDFAAA

SEQ ID NO: 1296255 - protein, 21 aa, Mycobacterium
AAYARFLPAWQHVGSTHSAGV

SEQ ID NO: 1296256 - protein, 18 aa, Mycobacterium
AAYEWCRITQRPDGSWPI

SEQ ID NO: 1296257 - protein, 24 aa, Mycobacterium
AAYHKLLVWDMISAPWLTRRGEKL

SEQ ID NO: 1296258 - protein, 19 aa, Mycobacterium
ACAIEQHYGRPMDMEWAKD

SEQ ID NO: 1296259 - protein, 36 aa, Mycobacterium
ACARQLFVHPNTVRYRLKRIADFTGRDPTLPRDAYV

SEQ ID NO: 1296260 - protein, 20 aa, Mycobacterium
ACPLPVTVSAVPGALRILVP

SEQ ID NO: 1296261 - protein, 24 aa, Mycobacterium
ACQGVCPPRQFSRPRVVVFAGDHG

SEQ ID NO: 1296262 - protein, 29 aa, Mycobacterium
ACQIAGITYRQLDYWARTSLVVPSIRGAA

SEQ ID NO: 1296263 - protein, 28 aa, Mycobacterium
ADAAFARGVWWPALRATDRAAPQQQALA

SEQ ID NO: 1296264 - protein, 30 aa, Mycobacterium
ADAALRGFQRFPAWMWRNVVVRDFAEWLQA

SEQ ID NO: 1296265 - protein, 21 aa, Mycobacterium
ADAFFHALADRTRRDILRRVL

SEQ ID NO: 1296266 - protein, 27 aa, Mycobacterium
ADAGRPWWEWAATYERAFSAAYDALGV

SEQ ID NO: 1296267 - protein, 17 aa, Mycobacterium
ADALWDTGIEFGTVGVG

SEQ ID NO: 1296268 - protein, 24 aa, Mycobacterium
ADARRKGWSWQAIADALGVSRQAV

SEQ ID NO: 1296269 - protein, 26 aa, Mycobacterium
ADARVPWILMHWRSVAAERPHQVPVY

SEQ ID NO: 1296270 - protein, 19 aa, Mycobacterium
ADCLDARITALLGLGRVPQ

SEQ ID NO: 1296271 - protein, 27 aa, Mycobacterium
ADDLAYWRRVMADPPEPLELPGPTGSA

SEQ ID NO: 1296272 - protein, 25 aa, Mycobacterium
ADDPEPRLYDLSAHYVWIGERTRQL

SEQ ID NO: 1296273 - protein, 23 aa, Mycobacterium
ADDPNLFTRLLPVALGSDVEDEF

SEQ ID NO: 1296274 - protein, 25 aa, Mycobacterium
ADDRYISFVMMQPTKFWADVCKHMD

SEQ ID NO: 1296275 - protein, 28 aa, Mycobacterium
ADDSTYVRKPPYFDGMPAEPQPVSDITG

SEQ ID NO: 1296276 - protein, 20 aa, Mycobacterium
ADDVWLEHIPVSELNAGKAP

SEQ ID NO: 1296277 - protein, 25 aa, Mycobacterium
ADDWDTQMLFFVGHGYRVIAHDRRG

SEQ ID NO: 1296278 - protein, 18 aa, Mycobacterium
ADDYLRFARMLLAGGEVD

SEQ ID NO: 1296279 - protein, 23 aa, Mycobacterium
ADDYRKWFATLPAELTDAVVEHW

SEQ ID NO: 1296280 - protein, 26 aa, Mycobacterium
ADDYWNHYQLTFALYSVSDRAIPSAF

SEQ ID NO: 1296281 - protein, 22 aa, Mycobacterium
ADEERIVWLAEPLVSVEHLPDN

SEQ ID NO: 1296282 - protein, 22 aa, Mycobacterium
ADELDALLWRAERPGEPSWPSP

SEQ ID NO: 1296283 - protein, 26 aa, Mycobacterium
ADELIDYLTMLSWSALCGIVEVGGSL

SEQ ID NO: 1296284 - protein, 23 aa, Mycobacterium
ADELRAELGDVLLQVLFHARIAE

SEQ ID NO: 1296285 - protein, 30 aa, Mycobacterium
ADEPPYFVGGYGDYYLLPAGAVVYTVPDVV

SEQ ID NO: 1296286 - protein, 25 aa, Mycobacterium
ADEQIQVLRTLWADSPLGASFHGEF

SEQ ID NO: 1296287 - protein, 27 aa, Mycobacterium
ADERRAFLTDVSLIGGLIIAAVDTEGK

SEQ ID NO: 1296288 - protein, 23 aa, Mycobacterium
ADEVDFHRWLQWQLDEQLTAAHA

SEQ ID NO: 1296289 - protein, 33 aa, Mycobacterium; identical to SEQ ID NO: 788523

SEQ ID NO: 1296290 - protein, 25 aa, Mycobacterium
ADFIFSGFGSIPRYDNAFALSNFNA

SEQ ID NO: 1296291 - protein, 19 aa, Mycobacterium
ADFPILQRVMRGGNQLAYL

SEQ ID NO: 1296292 - protein, 28 aa, Mycobacterium
ADGAAQFRRVLVAPAIRVGAAVLSCDHL

SEQ ID NO: 1296293 - protein, 21 aa, Mycobacterium
ADGALPLLAPMSEVAGRLSAQ

SEQ ID NO: 1296294 - protein, 25 aa, Mycobacterium
ADGAPAWLRFFGVNPRHHSLAFMPG

SEQ ID NO: 1296295 - protein, 25 aa, Mycobacterium
ADGDPWASFVTYGLLHGAPVLCVSN

SEQ ID NO: 1296296 - protein, 34 aa, Mycobacterium
ADGELADEPIRWAYFPWRRTVVSVLGPRAHSRLR

SEQ ID NO: 1296297 - protein, 21 aa, Mycobacterium
ADGHWLACQVAPDGSDRFQIW

SEQ ID NO: 1296298 - protein, 25 aa, Mycobacterium
ADGLAAILPCYWIYARVGEELIGRG

SEQ ID NO: 1296299 - protein, 28 aa, Mycobacterium
ADGLRSAALAAWLFGRPAPVDAVTVAPW

SEQ ID NO: 1296300 - protein, 17 aa, Mycobacterium
ADGRTFFPFRRVFVVAR

SEQ ID NO: 1296301 - protein, 33 aa, Mycobacterium
ADGSLQTVGMLFTPGYPGFLRGLTPVGGGEFVV

SEQ ID NO: 1296302 - protein, 19 aa, Mycobacterium
ADGSWEPGNSLFVSVSCWG

SEQ ID NO: 1296303 - protein, 17 aa, Mycobacterium
ADGVFGFRTLDDCLGMI

SEQ ID NO: 1296304 - protein, 22 aa, Mycobacterium
ADGVVRPVIFLAYSGEARWRSS

SEQ ID NO: 1296305 - protein, 25 aa, Mycobacterium
ADGVYAAWFTVLGHGPVMGTVVPGE

SEQ ID NO: 1296306 - protein, 29 aa, Mycobacterium
ADHCLDLPGLFVWRRYHPSPAPDRGVLYG

SEQ ID NO: 1296307 - protein, 26 aa, Mycobacterium
ADHGGLPHPTILAAAALLGVDEVWAV

SEQ ID NO: 1296308 - protein, 23 aa, Mycobacterium
ADHSGILVLPPGTAAPGTPAAEV

SEQ ID NO: 1296309 - protein, 25 aa, Mycobacterium
ADIPLAIDHFRYFAGAIRAQEGALS

SEQ ID NO: 1296310 - protein, 23 aa, Mycobacterium
ADKYRRLHVIIGDANLAETSTYL

SEQ ID NO: 1296311 - protein, 23 aa, Mycobacterium
ADKYSIPMIKLTGGQRIDLLGVR

SEQ ID NO: 1296312 - protein, 19 aa, Mycobacterium
ADLAGACSMAAFTAAMHAG

SEQ ID NO: 1296313 - protein, 24 aa, Mycobacterium
ADLCEISLVMRPSNSRALVESVRS

SEQ ID NO: 1296314 - protein, 24 aa, Mycobacterium
ADLDRSALPALRHIVRVPIETADG

SEQ ID NO: 1296315 - protein, 25 aa, Mycobacterium
ADLERRVAEFLGFRDVFTSVGQVYP

SEQ ID NO: 1296316 - protein, 20 aa, Mycobacterium
ADLPSFRTMLDSLPGPLSKT

SEQ ID NO: 1296317 - protein, 21 aa, Mycobacterium
ADLVLPDRYLQAEPLVSIIED

SEQ ID NO: 1296318 - protein, 24 aa, Mycobacterium
ADMGAEFIALDKWSGDHPGRAAGE

SEQ ID NO: 1296319 - protein, 20 aa, Mycobacterium
ADMTVHFLAPVVVGPARAEA

SEQ ID NO: 1296320 - protein, 23 aa, Mycobacterium
ADNCKLISWPIATLSPNGVRTAD

SEQ ID NO: 1296321 - protein, 18 aa, Mycobacterium
ADNDFCFDYLPRISGDHG

SEQ ID NO: 1296322 - protein, 40 aa, Mycobacterium
ADNRSRFVIEPLEPGFGYTLGNSLRRTLLSSIPGAAVTSI

SEQ ID NO: 1296323 - protein, 25 aa, Mycobacterium
ADNSTAYARLYYAVPRAGRVLTLVN

SEQ ID NO: 1296324 - protein, 23 aa, Mycobacterium
ADPANWRRWWPDLRLTVVEDRGP

SEQ ID NO: 1296325 - protein, 28 aa, Mycobacterium
ADPASMSVIRYTTLRPFVVHINHTGAEL

SEQ ID NO: 1296326 - protein, 21 aa, Mycobacterium
ADPATLANLKFAWRSCRAVKS

SEQ ID NO: 1296327 - protein, 22 aa, Mycobacterium
ADPGSVSYLFSRKGVITLEKNG

SEQ ID NO: 1296328 - protein, 24 aa, Mycobacterium
ADPINMMTLFDKQVTLRMGQANVK

SEQ ID NO: 1296329 - protein, 29 aa, Mycobacterium
ADPKFEGLLDRLTSIPLWAAIEAFCADKT

SEQ ID NO: 1296330 - protein, 26 aa, Mycobacterium
ADPQVQPRYAGWTTFARLPRLEDVSH

SEQ ID NO: 1296331 - protein, 22 aa, Mycobacterium
ADPSRRRLLDSLNLRDGQTLRE

SEQ ID NO: 1296332 - protein, 25 aa, Mycobacterium
ADPWWDVAIRLMIKYRNLRLMTSAW

SEQ ID NO: 1296333 - protein, 25 aa, Mycobacterium
ADQWRRHVLLTPDPLQWNCFGFGII

SEQ ID NO: 1296334 - protein, 25 aa, Mycobacterium
ADRAENLRRLAHIATLMADSGLTVL

SEQ ID NO: 1296335 - protein, 24 aa, Mycobacterium
ADRFPEFNGFWRDDAFVGADGVHV

SEQ ID NO: 1296336 - protein, 19 aa, Mycobacterium
ADRHRYLVTCNGHPIPMLA

SEQ ID NO: 1296337 - protein, 17 aa, Mycobacterium
ADRLRITPPPLSKQIKL

SEQ ID NO: 1296338 - protein, 18 aa, Mycobacterium
ADRVLMDAHLIIAGNERD

SEQ ID NO: 1296339 - protein, 22 aa, Mycobacterium
ADRWKLGQLRPGDTVRFVPIRV

SEQ ID NO: 1296340 - protein, 17 aa, Mycobacterium
ADSAACREAFSALELLV

SEQ ID NO: 1296341 - protein, 23 aa, Mycobacterium
ADSFLPGALRGFVAANPEVVWHR

SEQ ID NO: 1296342 - protein, 26 aa, Mycobacterium
ADSLVIGGGMCFTFLASQGVSVGKSL

SEQ ID NO: 1296343 - protein, 22 aa, Mycobacterium
ADSTPWPTYPLMFRVSSAHEEG

SEQ ID NO: 1296344 - protein, 27 aa, Mycobacterium
ADSWMEIEAFRLLTLQTAWKIDQYNDY

SEQ ID NO: 1296345 - protein, 22 aa, Mycobacterium
ADSWQIISKALRPLPVAHKEMS

SEQ ID NO: 1296346 - protein, 24 aa, Mycobacterium
ADTAAWLREQPWFTGSFATVGLSY

SEQ ID NO: 1296347 - protein, 17 aa, Mycobacterium
ADTLIVSAALPDGGAGL

SEQ ID NO: 1296348 - protein, 25 aa, Mycobacterium
ADTVKVPWQAYLGKGHPLLSGFGRV

SEQ ID NO: 1296349 - protein, 25 aa, Mycobacterium
ADVDIALLYDAFASNPAMILEEAGF

SEQ ID NO: 1296350 - protein, 27 aa, Mycobacterium
ADVEPRMLLVHFLRDELRLTGTHWGCD

SEQ ID NO: 1296351 - protein, 24 aa, Mycobacterium
ADVGLGYLSLGQPLTTLSGGERQR

SEQ ID NO: 1296352 - protein, 20 aa, Mycobacterium
ADVLAALRNAGLAPAAEDSS

SEQ ID NO: 1296353 - protein, 20 aa, Mycobacterium
ADVVAVARPLLAPAIESADA

SEQ ID NO: 1296354 - protein, 27 aa, Mycobacterium
ADVVDTILDKGLVLDAYVRVSVVGIEI

SEQ ID NO: 1296355 - protein, 28 aa, Mycobacterium
ADVVGLFGPPLKFDVSLPLSQIGAFAEE

SEQ ID NO: 1296356 - protein, 30 aa, Mycobacterium
ADWLEAFVPLRVHVLVRFGRWDDLIAEPLP

SEQ ID NO: 1296357 - protein, 17 aa, Mycobacterium
ADYDAGLQWFRAALAGR

SEQ ID NO: 1296358 - protein, 41 aa, Mycobacterium
ADYGLLLARTDWDVPKHKGLSFFILPMKQPGIEVRPLVQIT

SEQ ID NO: 1296359 - protein, 19 aa, Mycobacterium
ADYREMLRARAAPLLARHG

SEQ ID NO: 1296360 - protein, 25 aa, Mycobacterium
AEAALRWGPLSEARLARALDAVIHR

SEQ ID NO: 1296361 - protein, 27 aa, Mycobacterium
AEAAQPLYARYWLHNRGPAPMGGLPAV

SEQ ID NO: 1296362 - protein, 23 aa, Mycobacterium
AEAAVEHLFAVASGLDSAVIGEQ

SEQ ID NO: 1296363 - protein, 24 aa, Mycobacterium
AEADHIASFALPIDDLDLTVRSYN

SEQ ID NO: 1296364 - protein, 25 aa, Mycobacterium
AEADLVLQTMADLGLRRGENGLKIY

SEQ ID NO: 1296365 - protein, 24 aa, Mycobacterium
AEADVRLRRAWGIVNADRDPEAAA

SEQ ID NO: 1296366 - protein, 24 aa, Mycobacterium
AEAFADRPFLAPAPLAPTGRGRPD

SEQ ID NO: 1296367 - protein, 26 aa, Mycobacterium
AEAGLIAPHYPAPWGLDATPLQQLII

SEQ ID NO: 1296368 - protein, 29 aa, Mycobacterium
AEALAYGDMGLALPILAPGGVAAALTHWG

SEQ ID NO: 1296369 - protein, 28 aa, Mycobacterium
AEAVRHALTQLGVPYQWGGTTPGVGLDC

SEQ ID NO: 1296370 - protein, 23 aa, Mycobacterium
AEDAYAAWFRLADGATAAQDTGF

SEQ ID NO: 1296371 - protein, 24 aa, Mycobacterium
AEDFESARSLGCTIKLLAICERLT

SEQ ID NO: 1296372 - protein, 17 aa, Mycobacterium
AEDKLRTVLWGWAGKPI

SEQ ID NO: 1296373 - protein, 26 aa, Mycobacterium
AEDRLEAGLWLRGYLRELIAKRRVEP

SEQ ID NO: 1296374 - protein, 34 aa, Mycobacterium
AEDTLVHGLPLYHVHGLVLGLLGSLRIGNRFVHT

SEQ ID NO: 1296375 - protein, 24 aa, Mycobacterium
AEDTVAHNPLMWLDEKFASYVIDR

SEQ ID NO: 1296376 - protein, 22 aa, Mycobacterium
AEDYGELLDLLRSARPDAVVHF

SEQ ID NO: 1296377 - protein, 25 aa, Mycobacterium
AEEIATLAQLLLVRGDALPYDLAGV

SEQ ID NO: 1296378 - protein, 23 aa, Mycobacterium
AEEMIRWVTPVKAFMRTAAQDTE

SEQ ID NO: 1296379 - protein, 25 aa, Mycobacterium
AEFAPALLERLLPFVDRIAEIGQVG

SEQ ID NO: 1296380 - protein, 27 aa, Mycobacterium
AEGALKLKELTYRWAEHYPAGELKHGP

SEQ ID NO: 1296381 - protein, 26 aa, Mycobacterium
AEGARILEIFLDRLVWAASTESELAT

SEQ ID NO: 1296382 - protein, 24 aa, Mycobacterium
AEGFLPTLLDWCRRNDVVFIADEV

SEQ ID NO: 1296383 - protein, 25 aa, Mycobacterium
AEGGRIFMQLWHVGRMGHPDISGVH

SEQ ID NO: 1296384 - protein, 22 aa, Mycobacterium
AEGHKWAMLTAYDFSTARAFDD

SEQ ID NO: 1296385 - protein, 24 aa, Mycobacterium
AEGKSRKFAYPPNLFVVDGGAPQV

SEQ ID NO: 1296386 - protein, 31 aa, Mycobacterium
AEGLFDPRLKRPIPFLPGTIGLITGRASHAE

SEQ ID NO: 1296387 - protein, 23 aa, Mycobacterium
AEGRDMWPGILGFEDTVIPQLER

SEQ ID NO: 1296388 - protein, 28 aa, Mycobacterium
AEGTRVVFPYFYSCHRCRNCLLGRRGAC

SEQ ID NO: 1296389 - protein, 28 aa, Mycobacterium
AEHLSNIIDLSFFTPAINQIELHPLLNQ

SEQ ID NO: 1296390 - protein, 33 aa, Mycobacterium
AEHSVTVLHWMPGWLEMLLEVGGALPSVRVVPT

SEQ ID NO: 1296391 - protein, 18 aa, Mycobacterium
AEILAATDRIRYLTPRLH

SEQ ID NO: 1296392 - protein, 20 aa, Mycobacterium
AEILARFKAVPAQEVTLPYI

SEQ ID NO: 1296393 - protein, 23 aa, Mycobacterium
AEILFDGIPLDKISTSFTINGTA

SEQ ID NO: 1296394 - protein, 20 aa, Mycobacterium
AEIPLLVVITEGIPVQDTAY

SEQ ID NO: 1296395 - protein, 24 aa, Mycobacterium
AEIYAPFTHQHLILKEAIGLSDST

SEQ ID NO: 1296396 - protein, 25 aa, Mycobacterium
AEKPLHRVRWWDGSTPWLVTGPAEL

SEQ ID NO: 1296397 - protein, 21 aa, Mycobacterium
AELAGLFDGIGVRAAIPVIRA

SEQ ID NO: 1296398 - protein, 21 aa, Mycobacterium
AELAIRFRDRGVVGFDIAGAE

SEQ ID NO: 1296399 - protein, 30 aa, Mycobacterium
AELALRNKIPLVMLLEGAGFRPSGEHYGRT

SEQ ID NO: 1296400 - protein, 20 aa, Mycobacterium
AELDAYLALPRVAGLAVSPD

SEQ ID NO: 1296401 - protein, 30 aa, Mycobacterium
AELLGLPWVELNPHPLYRPSKGLPPIGSGL

SEQ ID NO: 1296402 - protein, 18 aa, Mycobacterium
AELMLRKATWLYDNGKSC

SEQ ID NO: 1296403 - protein, 26 aa, Mycobacterium
AELNCKVLLEIGPRPVLTAAALSAWP

SEQ ID NO: 1296404 - protein, 17 aa, Mycobacterium
AELPPAEFSWTSSDVQL

SEQ ID NO: 1296405 - protein, 21 aa, Mycobacterium
AELQRAVRRWGITAGTSVVVY

SEQ ID NO: 1296406 - protein, 25 aa, Mycobacterium
AELRERIFSAAKRLGYPGPDPVARS

SEQ ID NO: 1296407 - protein, 17 aa, Mycobacterium
AENAAIVEFPPAGTLVG

SEQ ID NO: 1296408 - protein, 23 aa, Mycobacterium
AENKRFCWNCGRPVGRSTSDGKA

SEQ ID NO: 1296409 - protein, 23 aa, Mycobacterium
AENPRSLVYQFDRLRDGLRALPG

SEQ ID NO: 1296410 - protein, 24 aa, Mycobacterium
AENQDFMWRLVDRQIDKFLERGSC

SEQ ID NO: 1296411 - protein, 31 aa, Mycobacterium
AENQLRFSAPPRLDLSLLMTALPESYKATET

SEQ ID NO: 1296412 - protein, 24 aa, Mycobacterium
AENRMVCLPYPKLLNSIMSVDMAA

SEQ ID NO: 1296413 - protein, 26 aa, Mycobacterium
AEPEEIAQAVLFLASPRSSFVTGAVL

SEQ ID NO: 1296414 - protein, 28 aa, Mycobacterium
AEPQPTVQFAFLQLFIHAVVAGILENVV

SEQ ID NO: 1296415 - protein, 26 aa, Mycobacterium
AEPQRRALDQLLVLGTLLEGHADHVM

SEQ ID NO: 1296416 - protein, 26 aa, Mycobacterium
AEPRKEWTLQFTIGAAPRSSSVVASL

SEQ ID NO: 1296417 - protein, 17 aa, Mycobacterium
AEQALDPALYPGVPPAD

SEQ ID NO: 1296418 - protein, 18 aa, Mycobacterium
AEQFTWPRAAEGMLGAMC

SEQ ID NO: 1296419 - protein, 24 aa, Mycobacterium
AEQIREQLLALTPLESTFAASLVA

SEQ ID NO: 1296420 - protein, 24 aa, Mycobacterium
AEQMKMFLTRLGFNSKIVVTGDIT

SEQ ID NO: 1296421 - protein, 27 aa, Mycobacterium
AEQRAAMGPGIRRLLRLSAPSPVKNVE

SEQ ID NO: 1296422 - protein, 24 aa, Mycobacterium
AEQWVRSRHLYAGKGKRALAAELR

SEQ ID NO: 1296423 - protein, 24 aa, Mycobacterium
AERDKLWRRVWQQVGRVEEIPEVG

SEQ ID NO: 1296424 - protein, 26 aa, Mycobacterium
AERGMPLSFQFARFVRFIVTEIFPGG

SEQ ID NO: 1296425 - protein, 26 aa, Mycobacterium
AERHAPYQRPPLSKKLLSGAVHRAGA

SEQ ID NO: 1296426 - protein, 22 aa, Mycobacterium
AERILFTHIAVPVMTRLRQPER

SEQ ID NO: 1296427 - protein, 23 aa, Mycobacterium
AERLSWDTPFTEVLDWSDAPFAK

SEQ ID NO: 1296428 - protein, 17 aa, Mycobacterium
AERLYPGAGVAETIRRL

SEQ ID NO: 1296429 - protein, 23 aa, Mycobacterium
AERPVPLFYSYATTPMHETIGDL

SEQ ID NO: 1296430 - protein, 20 aa, Mycobacterium
AERTLIALPVGTGIRRRLEE

SEQ ID NO: 1296431 - protein, 17 aa, Mycobacterium
AERVLAALLAAGFGVDD

SEQ ID NO: 1296432 - protein, 24 aa, Mycobacterium
AESDYLVIAAPLTPATRGLIDAKA

SEQ ID NO: 1296433 - protein, 26 aa, Mycobacterium
AESGYRLFSGIRRLTSVLAAMAAPPR

SEQ ID NO: 1296434 - protein, 23 aa, Mycobacterium
AESWPHWATVITKVTWTSPEPRG

SEQ ID NO: 1296435 - protein, 19 aa, Mycobacterium
AETGAFDLLLGDAAPAVVG

SEQ ID NO: 1296436 - protein, 18 aa, Mycobacterium
AETIDWGRTVLALGMDTI

SEQ ID NO: 1296437 - protein, 22 aa, Mycobacterium
AETILLNAKTRRPSVCNAAESV

SEQ ID NO: 1296438 - protein, 23 aa, Mycobacterium
AEVADVVAMLRLVADPTAGAAAM

SEQ ID NO: 1296439 - protein, 21 aa, Mycobacterium
AEVAKVALFLASDLSSYMTGT

SEQ ID NO: 1296440 - protein, 24 aa, Mycobacterium
AEVELSWNILDPVLDYWASHGKPD

SEQ ID NO: 1296441 - protein, 23 aa, Mycobacterium
AEVFQSWLGGLAAWFGQLDLTEA

SEQ ID NO: 1296442 - protein, 17 aa, Mycobacterium
AEVLPDLPRLRTLIQVA

SEQ ID NO: 1296443 - protein, 17 aa, Mycobacterium
AEVLPNFPAYSHLVGNF

SEQ ID NO: 1296444 - protein, 28 aa, Mycobacterium
AEVRNFLVANALYWLQEFHVDGLRVDAV

SEQ ID NO: 1296445 - protein, 21 aa, Mycobacterium
AEVWRWLERGAHLYVCGDAAR

SEQ ID NO: 1296446 - protein, 19 aa, Mycobacterium
AEYDLTSLRFAVTGAAVVP

SEQ ID NO: 1296447 - protein, 25 aa, Mycobacterium
AEYDRDLPHYIPIEQIAKENPQELE

SEQ ID NO: 1296448 - protein, 20 aa, Mycobacterium
AEYDVRLVSRVSDADPALSR

SEQ ID NO: 1296449 - protein, 26 aa, Mycobacterium
AEYGRRVLLVDLDPQGALSAGLGVPH

SEQ ID NO: 1296450 - protein, 18 aa, Mycobacterium
AEYPALLQRLAKAQAEDA

SEQ ID NO: 1296451 - protein, 17 aa, Mycobacterium
AFAKEHKALVIKGGYME

SEQ ID NO: 1296452 - protein, 19 aa, Mycobacterium
AFCDALGAIGFDISVLDYS

SEQ ID NO: 1296453 - protein, 24 aa, Mycobacterium
AFDDVILHTYFTPETLQRCVKTVK

SEQ ID NO: 1296454 - protein, 28 aa, Mycobacterium
AFDFRVMTPTAWWRVPMQTVVGGLPTDP

SEQ ID NO: 1296455 - protein, 17 aa, Mycobacterium
AFDLLLGDAAPAVVGDE

SEQ ID NO: 1296456 - protein, 25 aa, Mycobacterium
AFDSEHPLFLLYTSGTTGKPKGIVH

SEQ ID NO: 1296457 - protein, 29 aa, Mycobacterium
AFDTATGLPWMAEYRREFGLVDPPADQIA

SEQ ID NO: 1296458 - protein, 17 aa, Mycobacterium
AFEDEAQHDRWLRDNIP

SEQ ID NO: 1296459 - protein, 17 aa, Mycobacterium
AFEERLAWNRHLAAAGL

SEQ ID NO: 1296460 - protein, 17 aa, Mycobacterium
AFEGVFEGFPTPAEFFA

SEQ ID NO: 1296461 - protein, 35 aa, Mycobacterium
AFELNVYIPMMARNLLESFKLLTNVSRLFAERCID

SEQ ID NO: 1296462 - protein, 18 aa, Mycobacterium
AFGTIYAEAQRRYFESVA

SEQ ID NO: 1296463 - protein, 20 aa, Mycobacterium
AFHTRYMASALDGYEAAARE

SEQ ID NO: 1296464 - protein, 18 aa, Mycobacterium
AFHYVRPNQTLRPAGLPD

SEQ ID NO: 1296465 - protein, 18 aa, Mycobacterium
AFLARRSTTGVACSATAA

SEQ ID NO: 1296466 - protein, 20 aa, Mycobacterium
AFMVRYTSGYLCVPLDGAIC

SEQ ID NO: 1296467 - protein, 18 aa, Mycobacterium
AFNAAIAGVLPGLNAFAE

SEQ ID NO: 1296468 - protein, 20 aa, Mycobacterium
AFNARIALHVRTIYGRDPHH

SEQ ID NO: 1296469 - protein, 22 aa, Mycobacterium
AFPAWRDTSLAKRTSVLFNFRE

SEQ ID NO: 1296470 - protein, 26 aa, Mycobacterium
AFQKRRGMRIDFILGSPAFADRVTHA

SEQ ID NO: 1296471 - protein, 18 aa, Mycobacterium
AFQMAGALALREAAAATT

SEQ ID NO: 1296472 - protein, 24 aa, Mycobacterium
AFRDHLRQIGKLPATWRYTAEGLQ

SEQ ID NO: 1296473 - protein, 20 aa, Mycobacterium
AFRDRMGWDLPWVSSGASTF

SEQ ID NO: 1296474 - protein, 19 aa, Mycobacterium
AFRPEAVGGLPYTPAPEAP

SEQ ID NO: 1296475 - protein, 19 aa, Mycobacterium
AFRTGPWPNMQARSRSRVL

SEQ ID NO: 1296476 - protein, 25 aa, Mycobacterium
AFSDQRYWLARLADSGADHATLDGM

SEQ ID NO: 1296477 - protein, 17 aa, Mycobacterium
AFSLGMSQRLGIAAALL

SEQ ID NO: 1296478 - protein, 21 aa, Mycobacterium
AFTVYTDFQVGLTTGLINTVA

SEQ ID NO: 1296479 - protein, 17 aa, Mycobacterium
AFVRDFVRSGKPVAAIC

SEQ ID NO: 1296480 - protein, 24 aa, Mycobacterium
AFWELPGMVGQFLRSGPRAVPVGG

SEQ ID NO: 1296481 - protein, 25 aa, Mycobacterium
AFYGRGFIMWQPRGPRLTEVWEWCL

SEQ ID NO: 1296482 - protein, 24 aa, Mycobacterium
AGAAALCFALDTDLPVIVDADGLT

SEQ ID NO: 1296483 - protein, 30 aa, Mycobacterium
AGAALGLPPPAALLGDWFGSTAVIAPSVTI

SEQ ID NO: 1296484 - protein, 23 aa, Mycobacterium
AGADPVLMLTGPIPATEKVLHKA

SEQ ID NO: 1296485 - protein, 25 aa, Mycobacterium
AGAEGLTLVPYFDGERSPNLPDAAG

SEQ ID NO: 1296486 - protein, 20 aa, Mycobacterium
AGAETLPLGDYRMMPRATFC

SEQ ID NO: 1296487 - protein, 26 aa, Mycobacterium
AGAHRSAWTLLRRRHGVSPAIEEALE

SEQ ID NO: 1296488 - protein, 27 aa, Mycobacterium
AGAMAYLVKPFNVNDLIPAIEVAVSRF

SEQ ID NO: 1296489 - protein, 28 aa, Mycobacterium
AGAMGLLMIPPFMHGAAQWAAYNAVTMG

SEQ ID NO: 1296490 - protein, 26 aa, Mycobacterium
AGATVGPFTYLRPGTALGAEGKLGAF

SEQ ID NO: 1296491 - protein, 39 aa, Mycobacterium
AGCDKSIPGMLMAAARLDLASVFLYNGSIMPGVAKLTDG

SEQ ID NO: 1296492 - protein, 21 aa, Mycobacterium
AGDKLLVITQEKSWKVKRIRN

SEQ ID NO: 1296493 - protein, 17 aa, Mycobacterium
AGDKVVLWYSSANRDED

SEQ ID NO: 1296494 - protein, 25 aa, Mycobacterium
AGDQAAFPLGWVHDVVWAPDTTTGP

SEQ ID NO: 1296495 - protein, 18 aa, Mycobacterium
AGDQGLMFGYAIKDTPEL

SEQ ID NO: 1296496 - protein, 24 aa, Mycobacterium
AGDRAMIMAIVNRTPDSFYDRGAT

SEQ ID NO: 1296497 - protein, 25 aa, Mycobacterium
AGDVASWWHPRYERYLRIEHWEHAE

SEQ ID NO: 1296498 - protein, 26 aa, Mycobacterium
AGEAELDLVLAILRARQLFGGEQTLP

SEQ ID NO: 1296499 - protein, 25 aa, Mycobacterium
AGEDTFTYGLLYQMEFDAAEQSRAQ

SEQ ID NO: 1296500 - protein, 25 aa, Mycobacterium
AGEGILYRLHLDLASLSIAEFYPDG

SEQ ID NO: 1296501 - protein, 24 aa, Mycobacterium
AGEQRIEMWLRATDPQQVRVGALD

SEQ ID NO: 1296502 - protein, 18 aa, Mycobacterium
AGERAGGTILWMADERAI

SEQ ID NO: 1296503 - protein, 24 aa, Mycobacterium
AGERLPAMPVAHGLGLGFDPPVVS

SEQ ID NO: 1296504 - protein, 29 aa, Mycobacterium
AGFEVKLVQPLRLHYAKTLDIWAAALESR

SEQ ID NO: 1296505 - protein, 19 aa, Mycobacterium
AGFLAGDGLRRLAGTPAST

SEQ ID NO: 1296506 - protein, 21 aa, Mycobacterium
AGFVESFWKPVWDFHARQVPE

SEQ ID NO: 1296507 - protein, 31 aa, Mycobacterium
AGGAIIRTGLPPFKWWRGLQARKVLDNYFEQ

SEQ ID NO: 1296508 - protein, 19 aa, Mycobacterium
AGGFAHRTLFEGLDLTVAP

SEQ ID NO: 1296509 - protein, 20 aa, Mycobacterium
AGGFRKKYLRATSRLLALTA

SEQ ID NO: 1296510 - protein, 22 aa, Mycobacterium
AGGGPIHLLPDEEWDRVVDVNL

SEQ ID NO: 1296511 - protein, 24 aa, Mycobacterium
AGGRLCVLVTRDGERQVFVYDDDS

SEQ ID NO: 1296512 - protein, 27 aa, Mycobacterium
AGGRWVSMIYSFQSPEAIARDIEQLRP

SEQ ID NO: 1296513 - protein, 24 aa, Mycobacterium
AGGSDALLLLQHPSVYTAGKRTEP

SEQ ID NO: 1296514 - protein, 24 aa, Mycobacterium
AGGSGITPVLSMLRTLRAEGSDRE

SEQ ID NO: 1296515 - protein, 18 aa, Mycobacterium
AGHGALVAPVCDFTIMSA

SEQ ID NO: 1296516 - protein, 24 aa, Mycobacterium
AGHPGIVAPPAMIQVWTMGGLGQG

SEQ ID NO: 1296517 - protein, 27 aa, Mycobacterium
AGHTDVAILAYAAKFASAFYGPFREAV

SEQ ID NO: 1296518 - protein, 24 aa, Mycobacterium
AGIATTVAYFEHLLEFGLATSTVN

SEQ ID NO: 1296519 - protein, 26 aa, Mycobacterium
AGIDARGFLLGAAVALRLGTGVLAVR

SEQ ID NO: 1296520 - protein, 24 aa, Mycobacterium
AGIDPFVTAYPVRMVYEGSVRGTG

SEQ ID NO: 1296521 - protein, 19 aa, Mycobacterium
AGIERVKATLPRLGELAIG

SEQ ID NO: 1296522 - protein, 17 aa, Mycobacterium
AGISWLTGYPDRNPNEP

SEQ ID NO: 1296523 - protein, 19 aa, Mycobacterium
AGITALTLSAARALDRFGV

SEQ ID NO: 1296524 - protein, 25 aa, Mycobacterium
AGITCAVLIPQGKIAMGKLAQAVMH

SEQ ID NO: 1296525 - protein, 25 aa, Mycobacterium
AGKDLPVVGFIWEVLGRIGVGRKDA

SEQ ID NO: 1296526 - protein, 25 aa, Mycobacterium
AGKSLPKVLDPPPGAAPVPPISSNG

SEQ ID NO: 1296527 - protein, 25 aa, Mycobacterium
AGLAGDWLRTHLTPLDAVLCSTATR

SEQ ID NO: 1296528 - protein, 25 aa, Mycobacterium
AGLDSRAYRLPWPDGTVVYELDQPR

SEQ ID NO: 1296529 - protein, 19 aa, Mycobacterium
AGLFPHMTIRQNVGLVPGL

SEQ ID NO: 1296530 - protein, 19 aa, Mycobacterium
AGLGCRFATAYRALSARAR

SEQ ID NO: 1296531 - protein, 24 aa, Mycobacterium
AGLKPAFYHPTYEERFPQIGWEIT

SEQ ID NO: 1296532 - protein, 21 aa, Mycobacterium
AGLMLIWACDLIVASDDAKFS

SEQ ID NO: 1296533 - protein, 23 aa, Mycobacterium
AGLPADLFQVLPGRGSVVGERFV

SEQ ID NO: 1296534 - protein, 19 aa, Mycobacterium
AGLPGIPLALARPDVHVTL

SEQ ID NO: 1296535 - protein, 23 aa, Mycobacterium
AGLPTYTILIEGFNQALDNDVVL

SEQ ID NO: 1296536 - protein, 17 aa, Mycobacterium
AGLRDYFRDHAFGNATF

SEQ ID NO: 1296537 - protein, 19 aa, Mycobacterium
AGLRLPLDAISWQPPRPGY

SEQ ID NO: 1296538 - protein, 21 aa, Mycobacterium
AGLRRTHFWTDPAGDFGLSLA

SEQ ID NO: 1296539 - protein, 19 aa, Mycobacterium
AGLTPLLKMHTLGMDFVPD

SEQ ID NO: 1296540 - protein, 19 aa, Mycobacterium
AGLWRRTLLIEADGSRDTG

SEQ ID NO: 1296541 - protein, 19 aa, Mycobacterium
AGMLPVFRHTVEELFTAGL

SEQ ID NO: 1296542 - protein, 32 aa, Mycobacterium
AGMTKTLYKMPWSTMFPLGISSATIGICEGAL

SEQ ID NO: 1296543 - protein, 23 aa, Mycobacterium
AGNKIILFGARTGLDGIGGVSVL

SEQ ID NO: 1296544 - protein, 35 aa, Mycobacterium
AGNVVRVYVPFGTQWYGYFVRRLAERPANMAFFLR

SEQ ID NO: 1296545 - protein, 23 aa, Mycobacterium
AGPALILPMRTTEAVAGVVVLLR

SEQ ID NO: 1296546 - protein, 30 aa, Mycobacterium
AGPEYDHLTLSWVYDWMARGVPVVAMHRST

SEQ ID NO: 1296547 - protein, 19 aa, Mycobacterium
AGPFPLQIICDMMGIPEED

SEQ ID NO: 1296548 - protein, 32 aa, Mycobacterium
AGPQKIPVPSLLRSLLSEHLDPGYAAAAAARR

SEQ ID NO: 1296549 - protein, 23 aa, Mycobacterium
AGPRYQLVMGERRWRAAQEAGLA

SEQ ID NO: 1296550 - protein, 20 aa, Mycobacterium
AGQLLRRVRTRLARLSGAGL

SEQ ID NO: 1296551 - protein, 23 aa, Mycobacterium
AGQLTWVLDPIDGTVNFVYGIEA

SEQ ID NO: 1296552 - protein, 24 aa, Mycobacterium
AGQPLVWLEAMKMEHILTAPGDGV

SEQ ID NO: 1296553 - protein, 24 aa, Mycobacterium
AGQSGLTLVAFLRGQSMNVYTRPD

SEQ ID NO: 1296554 - protein, 21 aa, Mycobacterium
AGRELLLLAALKNGMAQRDLV

SEQ ID NO: 1296555 - protein, 28 aa, Mycobacterium
AGRIRSAGAIFVGPYAPVSLGDYCAGSN

SEQ ID NO: 1296556 - protein, 17 aa, Mycobacterium
AGRKVPVPIGMPSIRPL

SEQ ID NO: 1296557 - protein, 24 aa, Mycobacterium
AGRPFGLYIHVPFCATRCGYCDFN

SEQ ID NO: 1296558 - protein, 25 aa, Mycobacterium
AGRPLLGICGGFQMLCRHIDDAVES

SEQ ID NO: 1296559 - protein, 25 aa, Mycobacterium
AGRPVLVQVPRRGYLPALACARCRA

SEQ ID NO: 1296560 - protein, 28 aa, Mycobacterium
AGRRTGLIWLRWFLPEATPARPQCRVVD

SEQ ID NO: 1296561 - protein, 29 aa, Mycobacterium
AGRTHPVWDFLFTYYSLRPRHLRCWHPGF

SEQ ID NO: 1296562 - protein, 22 aa, Mycobacterium
AGRVISPPYCPHPEHFSPRCIP

SEQ ID NO: 1296563 - protein, 17 aa, Mycobacterium
AGRYFLEAFDRTATGWR

SEQ ID NO: 1296564 - protein, 24 aa, Mycobacterium
AGSEYILLTTFTRDGRPKPTAVWA

SEQ ID NO: 1296565 - protein, 27 aa, Mycobacterium
AGSLNRPGYLRFDFNWQGALTDDQRTQ

SEQ ID NO: 1296566 - protein, 24 aa, Mycobacterium
AGSLRLDLSQYRELESFAAFASDL

SEQ ID NO: 1296567 - protein, 23 aa, Mycobacterium
AGTGIAMIIRPPLDAGIAPGVYD

SEQ ID NO: 1296568 - protein, 27 aa, Mycobacterium
AGTGWLHGWRLTFGGEDIGWEGALATV

SEQ ID NO: 1296569 - protein, 24 aa, Mycobacterium
AGTKLLETYAVPPLLHNQVLAIGV

SEQ ID NO: 1296570 - protein, 19 aa, Mycobacterium
AGTPDIDPRRLMVSIGLAL

SEQ ID NO: 1296571 - protein, 27 aa, Mycobacterium
AGVGKQTIYRWWPSRPALVADVLLEDA

SEQ ID NO: 1296572 - protein, 21 aa, Mycobacterium
AGVLELAWTTGMIKWEDDPKP

SEQ ID NO: 1296573 - protein, 24 aa, Mycobacterium
AGVPAPILAVLDAPLRVIVEAGYD

SEQ ID NO: 1296574 - protein, 17 aa, Mycobacterium
AGVPLLDDWPVVATTLC

SEQ ID NO: 1296575 - protein, 20 aa, Mycobacterium
AGVSGLWLLSGMREDGVLTT

SEQ ID NO: 1296576 - protein, 25 aa, Mycobacterium
AGVVHFFGPFLYRSQFHATTEAEES

SEQ ID NO: 1296577 - protein, 24 aa, Mycobacterium
AGYDPPYRFVDALSSRGVMSLPPR

SEQ ID NO: 1296578 - protein, 18 aa, Mycobacterium
AGYPAPFRDALSPGGTIR

SEQ ID NO: 1296579 - protein, 36 aa, Mycobacterium
AHAPPYNRRSKFPQRWWWVVLTDEPFPRFSVVRAPR

SEQ ID NO: 1296580 - protein, 26 aa, Mycobacterium
AHARFIEVSAKINALLDIAQVNLGDA

SEQ ID NO: 1296581 - protein, 30 aa, Mycobacterium
AHASSVVLPFLLPDTPVVAWWPGVAPDVPA

SEQ ID NO: 1296582 - protein, 26 aa, Mycobacterium
AHDEGWLAEHMLILKLISPENKAYFI

SEQ ID NO: 1296583 - protein, 23 aa, Mycobacterium
AHDPALWARLGSELGVLGLSVSE

SEQ ID NO: 1296584 - protein, 23 aa, Mycobacterium
AHGTFFFHFPSKEHVLLELERRE

SEQ ID NO: 1296585 - protein, 19 aa, Mycobacterium
AHGVPVRRALLQNDARATA

SEQ ID NO: 1296586 - protein, 18 aa, Mycobacterium
AHLAALDVPILQGLCLTS

SEQ ID NO: 1296587 - protein, 18 aa, Mycobacterium
AHLGVDFSFLRHNDHTIK

SEQ ID NO: 1296588 - protein, 18 aa, Mycobacterium
AHLLSVCGTPAVYLPAMD

SEQ ID NO: 1296589 - protein, 18 aa, Mycobacterium
AHLNADHAESLLAMARVL

SEQ ID NO: 1296590 - protein, 23 aa, Mycobacterium
AHLRTGLAERLGVTVGIVITDTM

SEQ ID NO: 1296591 - protein, 20 aa, Mycobacterium
AHLVIAMLRAVNVPARLVSV

SEQ ID NO: 1296592 - protein, 18 aa, Mycobacterium
AHLYFKRATTDATLLGTA

SEQ ID NO: 1296593 - protein, 17 aa, Mycobacterium
AHNLDQVLDGDLDPLFD

SEQ ID NO: 1296594 - protein, 19 aa, Mycobacterium
AHNPLPVVIPCHRVVRSDG

SEQ ID NO: 1296595 - protein, 34 aa, Mycobacterium
AHNPVAWVDSPPYRPFWAITKHADIMAIERANDL

SEQ ID NO: 1296596 - protein, 19 aa, Mycobacterium
AHQGAAEMLRPISRKYDLR

SEQ ID NO: 1296597 - protein, 17 aa, Mycobacterium
AHRALTVAEGWPSRLRP

SEQ ID NO: 1296598 - protein, 24 aa, Mycobacterium
AHRITLRRRTGGTDAGWHLKLPAG

SEQ ID NO: 1296599 - protein, 22 aa, Mycobacterium
AHRLLSMLQYRGFVRQDPASKA

SEQ ID NO: 1296600 - protein, 24 aa, Mycobacterium
AHRRRADAILLRRTDRLPMAAAPA

SEQ ID NO: 1296601 - protein, 23 aa, Mycobacterium
AHRSHRALAPLFAKLAAISDGAM

SEQ ID NO: 1296602 - protein, 24 aa, Mycobacterium
AHSFYVPAQLFPTADGYLALFITH

SEQ ID NO: 1296603 - protein, 31 aa, Mycobacterium
AHVRIIQEFVKKLPAWVSWERRDHYERDLVG

SEQ ID NO: 1296604 - protein, 18 aa, Mycobacterium
AHYGVFVPPLGSLLRRAG

SEQ ID NO: 1296605 - protein, 20 aa, Mycobacterium
AIAAAALEYLPGSGASVLLD

SEQ ID NO: 1296606 - protein, 17 aa, Mycobacterium
AIAARRLPGAVVSIGHG

SEQ ID NO: 1296607 - protein, 18 aa, Mycobacterium
AIAHRVLDELSYRRDSDG

SEQ ID NO: 1296608 - protein, 17 aa, Mycobacterium
AIALAVRDALGGTLVEM

SEQ ID NO: 1296609 - protein, 18 aa, Mycobacterium
AIANLPRERLSIAVAAVA

SEQ ID NO: 1296610 - protein, 23 aa, Mycobacterium
AIARAFVNRPLVLLADEPTGNLD

SEQ ID NO: 1296611 - protein, 21 aa, Mycobacterium
AIARALAMNPKLMLFDEPTSA

SEQ ID NO: 1296612 - protein, 25 aa, Mycobacterium
AIAVCLLWSFREPSHEQRVAAIIRE

SEQ ID NO: 1296613 - protein, 20 aa, Mycobacterium
AIDKAPFPVIAAINGPAIGA

SEQ ID NO: 1296614 - protein, 20 aa, Mycobacterium
AIDLLKGVVVPAITGAIKSA

SEQ ID NO: 1296615 - protein, 24 aa, Mycobacterium
AIDQLMRFDFDGRTGWGVFEILMG

SEQ ID NO: 1296616 - protein, 23 aa, Mycobacterium
AIEKLVAQLTRPVRWDLCTATMR

SEQ ID NO: 1296617 - protein, 17 aa, Mycobacterium
AIELPSWAFGNSGTRFK

SEQ ID NO: 1296618 - protein, 19 aa, Mycobacterium
AIEPLVLMVAPLAPHLAEE

SEQ ID NO: 1296619 - protein, 30 aa, Mycobacterium
AIFGGMKLDFLITVDWDYYKKFMSVNLDGA

SEQ ID NO: 1296620 - protein, 25 aa, Mycobacterium
AIGATLLQDWTTFAAPAVFGMAMRV

SEQ ID NO: 1296621 - protein, 20 aa, Mycobacterium
AIGLHARPAAIIAEAVVNAG

SEQ ID NO: 1296622 - protein, 31 aa, Mycobacterium
AIGNAPTALFRLLELIDQGAPVPAAVLGGPV

SEQ ID NO: 1296623 - protein, 19 aa, Mycobacterium
AIGVIYLPATERQSHYYHV

SEQ ID NO: 1296624 - protein, 27 aa, Mycobacterium
AIGVNFIDTYFRSGLYPREVPFVVGTE

SEQ ID NO: 1296625 - protein, 23 aa, Mycobacterium
AIHVIIHALNEWLHEVWGFNYQN

SEQ ID NO: 1296626 - protein, 19 aa, Mycobacterium
AIIRGGFKILPETVRQVLL

SEQ ID NO: 1296627 - protein, 17 aa, Mycobacterium
AILTARHIDCWTLGTVK

SEQ ID NO: 1296628 - protein, 25 aa, Mycobacterium
AIPDLRYVPEILLADARIVACRLFF

SEQ ID NO: 1296629 - protein, 18 aa, Mycobacterium
AIQLARWAGARVITTVST

SEQ ID NO: 1296630 - protein, 19 aa, Mycobacterium
AIQLAYYEGLTYVQVSERL

SEQ ID NO: 1296631 - protein, 40 aa, Mycobacterium
AIQLWQEVAGLPLERIQRRGMADNYWSMGIPGPCGPSSEI

SEQ ID NO: 1296632 - protein, 29 aa, Mycobacterium
AIRGGAAIKPLWLPGPDPEPHYRPSATLA

SEQ ID NO: 1296633 - protein, 20 aa, Mycobacterium
AIRRPVLGAKKVAALIAGFF

SEQ ID NO: 1296634 - protein, 24 aa, Mycobacterium
AIRTPPLPLLCGGLFAAPTAEVVG

SEQ ID NO: 1296635 - protein, 31 aa, Mycobacterium
AISDLDPRRRAIVGMIFFDCLTQREVARRLH

SEQ ID NO: 1296636 - protein, 21 aa, Mycobacterium
AISLRAAFAAATRGAWRAAGV

SEQ ID NO: 1296637 - protein, 21 aa, Mycobacterium
AISLRGGGLVAPAIHDVPDRS

SEQ ID NO: 1296638 - protein, 45 aa, Mycobacterium
AISSPGWAKHAWSCFFAPWIAEATIFVYNYRRFDAAALLRQLNRA

SEQ ID NO: 1296639 - protein, 30 aa, Mycobacterium
AITMARIIGELLPDLTLPYGVNVLWDGRAS

SEQ ID NO: 1296640 - protein, 23 aa, Mycobacterium
AITQIEMLAMSDLSLMVKAGVQW

SEQ ID NO: 1296641 - protein, 25 aa, Mycobacterium
AIVFPRGMTGPRDDPFAFSFSGLKT

SEQ ID NO: 1296642 - protein, 19 aa, Mycobacterium
AIVYPTWYSGRHWDNEWLI

SEQ ID NO: 1296643 - protein, 27 aa, Mycobacterium
AKALAPVRFFNPLSMRFAKKATREDIA

SEQ ID NO: 1296644 - protein, 23 aa, Mycobacterium
AKDAAMLDWFPPTHPDRADAPNM

SEQ ID NO: 1296645 - protein, 27 aa, Mycobacterium
AKEIDLRFVFAYTPLEFRDTLYMLAEG

SEQ ID NO: 1296646 - protein, 18 aa, Mycobacterium
AKFHKDLPAWVDVDTRAH

SEQ ID NO: 1296647 - protein, 22 aa, Mycobacterium
AKGKDLVWAPGAFRYVMMVLRH

SEQ ID NO: 1296648 - protein, 19 aa, Mycobacterium
AKGQLLLEVRRCGICGSDL

SEQ ID NO: 1296649 - protein, 24 aa, Mycobacterium
AKHAVFDRLVYGKLRAALGGECRA

SEQ ID NO: 1296650 - protein, 24 aa, Mycobacterium
AKHPDTLWRFEYSPESYTGTELEY

SEQ ID NO: 1296651 - protein, 19 aa, Mycobacterium
AKIDLALGKLGLQPGMTLL

SEQ ID NO: 1296652 - protein, 27 aa, Mycobacterium
AKILVDEAFRHFKALGVLPQGTDLLAS

SEQ ID NO: 1296653 - protein, 19 aa, Mycobacterium
AKNGFILDGYPRSVEQAEA

SEQ ID NO: 1296654 - protein, 25 aa, Mycobacterium
AKPPLDVMAALREPGIGVIAEVKRA

SEQ ID NO: 1296655 - protein, 24 aa, Mycobacterium
AKPRDLKLRVLSWGAAPASDTLLR

SEQ ID NO: 1296656 - protein, 25 aa, Mycobacterium
AKQGRVPFLTDYVASKFAVLGLTQA

SEQ ID NO: 1296657 - protein, 24 aa, Mycobacterium
AKRAERVWYAACLVLATTRADVNG

SEQ ID NO: 1296658 - protein, 19 aa, Mycobacterium
AKRGFDPVLGARPLRRTIQ

SEQ ID NO: 1296659 - protein, 22 aa, Mycobacterium
AKRLGLRPLARIHTAVAVGSDP

SEQ ID NO: 1296660 - protein, 17 aa, Mycobacterium
AKRTPRLARTRAWTTDV

SEQ ID NO: 1296661 - protein, 26 aa, Mycobacterium
AKVGRIARILGPRGLMPNPKTGTVTA

SEQ ID NO: 1296662 - protein, 18 aa, Mycobacterium
AKYALWSIATGRPEAIDD

SEQ ID NO: 1296663 - protein, 24 aa, Mycobacterium
ALAAETPLFLLDEPFAALDALTRE

SEQ ID NO: 1296664 - protein, 22 aa, Mycobacterium
ALAAMRRRMPWMAVDKPYAFEG

SEQ ID NO: 1296665 - protein, 17 aa, Mycobacterium
ALAAPPERRQWWIDRVA

SEQ ID NO: 1296666 - protein, 19 aa, Mycobacterium
ALAAQLFEAGPWDRLGPLD

SEQ ID NO: 1296667 - protein, 18 aa, Mycobacterium
ALAAVWGGSGSEAYQAVQ

SEQ ID NO: 1296668 - protein, 30 aa, Mycobacterium
ALAAWSLVHGFIMLWLNDLIATEGDPLAQI

SEQ ID NO: 1296669 - protein, 21 aa, Mycobacterium
ALAEQIAAMPPFALRQAKRAV

SEQ ID NO: 1296670 - protein, 18 aa, Mycobacterium
ALAIDDLHWADRDSLLLL

SEQ ID NO: 1296671 - protein, 27 aa, Mycobacterium
ALAKLGIAPFDLVVVNLYPFSETVESG

SEQ ID NO: 1296672 - protein, 20 aa, Mycobacterium
ALALQGLKVLVIDLDPQGNA

SEQ ID NO: 1296673 - protein, 29 aa, Mycobacterium
ALAPKGIWFAPKDLRLFYQVRQNWRGKAV

SEQ ID NO: 1296674 - protein, 31 aa, Mycobacterium
ALAPTGYSWGPLAWMLLAQALGERGAAVEAG

SEQ ID NO: 1296675 - protein, 24 aa, Mycobacterium
ALAQGRYIGLGFSAYIEPTGAATG

SEQ ID NO: 1296676 - protein, 28 aa, Mycobacterium
ALARGAVYWDPLATLGFLAACTSRIRLA

SEQ ID NO: 1296677 - protein, 20 aa, Mycobacterium
ALARHGIVLSLQFETDDDRN

SEQ ID NO: 1296678 - protein, 21 aa, Mycobacterium
ALARRYDSWLGAHPDADLAGV

SEQ ID NO: 1296679 - protein, 18 aa, Mycobacterium
ALASTLVVGAWGDALAVV

SEQ ID NO: 1296680 - protein, 19 aa, Mycobacterium
ALASWFAPTARPIGGEWAE

SEQ ID NO: 1296681 - protein, 26 aa, Mycobacterium
ALATRHLRRHPNAQPVILVVTDGEPT

SEQ ID NO: 1296682 - protein, 26 aa, Mycobacterium
ALATVGLGLVPLLDLASDEQQDRYLA

SEQ ID NO: 1296683 - protein, 18 aa, Mycobacterium
ALAVLRTEQGWDRLALGG

SEQ ID NO: 1296684 - protein, 19 aa, Mycobacterium
ALAVVVRLFLLGAEEPRDR

SEQ ID NO: 1296685 - protein, 17 aa, Mycobacterium
ALCLAADIRICSSAATF

SEQ ID NO: 1296686 - protein, 28 aa, Mycobacterium
ALDASLLLVPLVRFLPPDDPRVRATVLA

SEQ ID NO: 1296687 - protein, 24 aa, Mycobacterium
ALDDFAGTLLLVSHDRVLLDRMDR

SEQ ID NO: 1296688 - protein, 25 aa, Mycobacterium
ALDDPPRWHVKVTPFRVVAGADVHG

SEQ ID NO: 1296689 - protein, 34 aa, Mycobacterium
ALDENRVPRWWSVRELIAAFLSLRDKVVLHRSEY

SEQ ID NO: 1296690 - protein, 19 aa, Mycobacterium
ALDGADMFLGLSAGVVAEE

SEQ ID NO: 1296691 - protein, 24 aa, Mycobacterium
ALDGLTLHMQPGELVALLGPSGCG

SEQ ID NO: 1296692 - protein, 20 aa, Mycobacterium
ALDGLVDFLPSKTWFDHSDA

SEQ ID NO: 1296693 - protein, 22 aa, Mycobacterium
ALDLLPLPNRLDLLETLGLTSG

SEQ ID NO: 1296694 - protein, 25 aa, Mycobacterium
ALDRLTLDNPLVISSPRLRALDTAK

SEQ ID NO: 1296695 - protein, 30 aa, Mycobacterium
ALDRSAFRWWLTVATLRWGVICRFQAERHL

SEQ ID NO: 1296696 - protein, 18 aa, Mycobacterium
ALDTGLRASTRKAVAGLL

SEQ ID NO: 1296697 - protein, 20 aa, Mycobacterium
ALEALTGIRRAGADIVLTYW

SEQ ID NO: 1296698 - protein, 20 aa, Mycobacterium
ALEDQLLDRSRYLKALAVAT

SEQ ID NO: 1296699 - protein, 29 aa, Mycobacterium
ALEEAKLQRMPKPKPLATRIALVTGAASG

SEQ ID NO: 1296700 - protein, 24 aa, Mycobacterium
ALEEFATLWRHGGSPLLRELVDAG

SEQ ID NO: 1296701 - protein, 25 aa, Mycobacterium
ALEPIGLMRRVGLGDTLRIALMGND

SEQ ID NO: 1296702 - protein, 19 aa, Mycobacterium
ALEPQRVVLLPDGTEDYWS

SEQ ID NO: 1296703 - protein, 20 aa, Mycobacterium
ALERLSINLRWSWDKPTQDL

SEQ ID NO: 1296704 - protein, 28 aa, Mycobacterium
ALESILTVLALRDGVIPPTLNYETPDPE

SEQ ID NO: 1296705 - protein, 18 aa, Mycobacterium
ALFAFLHADGYALYRVHG

SEQ ID NO: 1296706 - protein, 19 aa, Mycobacterium
ALFAVEMGLARLWQSWGVT

SEQ ID NO: 1296707 - protein, 31 aa, Mycobacterium
ALFDTSPHNLFPLVFDMLYRGDTPRINGDDY

SEQ ID NO: 1296708 - protein, 21 aa, Mycobacterium
ALFEWVVRQALPDEPLIVDLC

SEQ ID NO: 1296709 - protein, 18 aa, Mycobacterium
ALFEYLVMTGVCTDNPVP

SEQ ID NO: 1296710 - protein, 17 aa, Mycobacterium
ALFLASDLSSYMTGTVL

SEQ ID NO: 1296711 - protein, 26 aa, Mycobacterium
ALGALAQFEFLLIAAALAEGWAVSVP

SEQ ID NO: 1296712 - protein, 20 aa, Mycobacterium
ALGAPEMRPYIAEMARIADT

SEQ ID NO: 1296713 - protein, 24 aa, Mycobacterium
ALGDYEWILAFEAPELHRIVDLMR

SEQ ID NO: 1296714 - protein, 23 aa, Mycobacterium
ALGEGYFINQLITWTVDGGETVA

SEQ ID NO: 1296715 - protein, 20 aa, Mycobacterium
ALGFWRAVREVFPATREQRC

SEQ ID NO: 1296716 - protein, 19 aa, Mycobacterium
ALGGFDLPLRGSDAEVLDA

SEQ ID NO: 1296717 - protein, 17 aa, Mycobacterium
ALGHKRKTKHHGEVEPY

SEQ ID NO: 1296718 - protein, 21 aa, Mycobacterium
ALGLEFNLYLLRNPEARERVA

SEQ ID NO: 1296719 - protein, 27 aa, Mycobacterium
ALGPHQPILAILAADLIYLPEKAQEAI

SEQ ID NO: 1296720 - protein, 25 aa, Mycobacterium
ALGRDGLAYVLRSDRRYGGSIDVID

SEQ ID NO: 1296721 - protein, 22 aa, Mycobacterium
ALGTYPILGDPLMASVPTAPAS

SEQ ID NO: 1296722 - protein, 19 aa, Mycobacterium
ALGWNTEAYVLVFCHGTIA

SEQ ID NO: 1296723 - protein, 20 aa, Mycobacterium
ALHEAIRWRRTVHIDEIATL

SEQ ID NO: 1296724 - protein, 26 aa, Mycobacterium
ALHEAKLAMHDLAGRGWKLAGVTSDT

SEQ ID NO: 1296725 - protein, 23 aa, Mycobacterium
ALHPNRFVLGLGVSHAPLVEHGM

SEQ ID NO: 1296726 - protein, 19 aa, Mycobacterium
ALIALYRNIAGEHPDWDDY

SEQ ID NO: 1296727 - protein, 23 aa, Mycobacterium
ALIDHAVWFHRPADFSDWVLSDA

SEQ ID NO: 1296728 - protein, 18 aa, Mycobacterium
ALIRDYLHRARSGDELPD

SEQ ID NO: 1296729 - protein, 22 aa, Mycobacterium
ALKARIFDPLGLRNTMLPAAAD

SEQ ID NO: 1296730 - protein, 19 aa, Mycobacterium
ALKTALMDGVERLGGRLDV

SEQ ID NO: 1296731 - protein, 18 aa, Mycobacterium
ALLEDLGHRVTPIDNPIP

SEQ ID NO: 1296732 - protein, 29 aa, Mycobacterium
ALLEVRDLLFARLLQYRAFKHVAVMFAEL

SEQ ID NO: 1296733 - protein, 25 aa, Mycobacterium
ALLHTLIAVYVTDLYMIDPALQVHG

SEQ ID NO: 1296734 - protein, 22 aa, Mycobacterium
ALLLCDWELPADHRPVPIAPRS

SEQ ID NO: 1296735 - protein, 21 aa, Mycobacterium
ALLLEDVGVPVPRLADLCAGI

SEQ ID NO: 1296736 - protein, 29 aa, Mycobacterium
ALLRSRGVLPTRLRLLYLADSQVLDYSPD

SEQ ID NO: 1296737 - protein, 24 aa, Mycobacterium
ALMDLFRTIFEPWEQHPGMLTAYY

SEQ ID NO: 1296738 - protein, 26 aa, Mycobacterium
ALMPGPVDTAFFTRAKMRNTPVGGPL

SEQ ID NO: 1296739 - protein, 28 aa, Mycobacterium
ALNCEIVPWCRFARKNYFYPDQPKNYQI

SEQ ID NO: 1296740 - protein, 32 aa, Mycobacterium
ALNPDTFYWAHATFFMLIIKTAEYFCGGLTEA

SEQ ID NO: 1296741 - protein, 26 aa, Mycobacterium
ALNPDVFYWAHSTFFMGTILTAERFG

SEQ ID NO: 1296742 - protein, 17 aa, Mycobacterium
ALPAPLTRGAVQRVTSV

SEQ ID NO: 1296743 - protein, 19 aa, Mycobacterium
ALPDIGHACGHNIIAASAV

SEQ ID NO: 1296744 - protein, 19 aa, Mycobacterium
ALPEGLAGAAALWGLAQKT

SEQ ID NO: 1296745 - protein, 20 aa, Mycobacterium
ALPHAYPRSARPDEPEFLPL

SEQ ID NO: 1296746 - protein, 18 aa, Mycobacterium
ALPKLLEYMAGDKKTRSG

SEQ ID NO: 1296747 - protein, 30 aa, Mycobacterium
ALPTLTPQQRAWLKLVKPLVITEGFALLSV

SEQ ID NO: 1296748 - protein, 18 aa, Mycobacterium
ALPTVLGPHDVAGRTASG

SEQ ID NO: 1296749 - protein, 18 aa, Mycobacterium
ALPTWVGAPFRGKPPEQP

SEQ ID NO: 1296750 - protein, 27 aa, Mycobacterium
ALPVKLCYAGPFFRYERPQAGRYRQLQ

SEQ ID NO: 1296751 - protein, 26 aa, Mycobacterium
ALQDMLIRRAFRRAITRPVHYVPTAE

SEQ ID NO: 1296752 - protein, 26 aa, Mycobacterium
ALQQLPPLPGVPEPLAGRLTVAVRFA

SEQ ID NO: 1296753 - protein, 29 aa, Mycobacterium
ALQSPLDISRPLWTATLVEGLEGGRAATM

SEQ ID NO: 1296754 - protein, 18 aa, Mycobacterium
ALRALDRALAQTAVLGVD

SEQ ID NO: 1296755 - protein, 39 aa, Mycobacterium
ALREKPNELLAPLPLTPLTPRLLVRRLESMIVERGAPIG

SEQ ID NO: 1296756 - protein, 23 aa, Mycobacterium
ALRELLLRYDGHADAPLIAGVPI

SEQ ID NO: 1296757 - protein, 23 aa, Mycobacterium
ALRHARLRRIPVQDKRIAVVFSA

SEQ ID NO: 1296758 - protein, 19 aa, Mycobacterium
ALRHRALITVGVALRERVD

SEQ ID NO: 1296759 - protein, 18 aa, Mycobacterium
ALRKTLGVPLFQEQLMQL

SEQ ID NO: 1296760 - protein, 17 aa, Mycobacterium
ALRLYATLNKTLVEQHH

SEQ ID NO: 1296761 - protein, 25 aa, Mycobacterium
ALRQDGMLALARLQRKMRLVESPYR

SEQ ID NO: 1296762 - protein, 27 aa, Mycobacterium
ALRRMARGDWIIFYSPRVTYPDGAQLQ

SEQ ID NO: 1296763 - protein, 20 aa, Mycobacterium
ALSDIVYMAPTAYFADPHVQ

SEQ ID NO: 1296764 - protein, 28 aa, Mycobacterium
ALSGYVEILPTPFLPAGVFDVWGLADDD

SEQ ID NO: 1296765 - protein, 27 aa, Mycobacterium
ALSIIANRLSYFLDLRGPSITVDTACS

SEQ ID NO: 1296766 - protein, 31 aa, Mycobacterium
ALSIPGYSMEGWYGRIFRGCGYFDPDKPIRK

SEQ ID NO: 1296767 - protein, 20 aa, Mycobacterium
ALSLTLIDPPPSLSKTRREA

SEQ ID NO: 1296768 - protein, 18 aa, Mycobacterium
ALSVAAWRIGEAKEAVRI

SEQ ID NO: 1296769 - protein, 22 aa, Mycobacterium
ALTAGILRYSRDLAFAAASAYA

SEQ ID NO: 1296770 - protein, 21 aa, Mycobacterium
ALTGRDPFWQKPVELGDILDV

SEQ ID NO: 1296771 - protein, 18 aa, Mycobacterium
ALTMAEYFRDEKQQDVLL

SEQ ID NO: 1296772 - protein, 23 aa, Mycobacterium
ALTMPAVAVRAMRPLNGAVLIGD

SEQ ID NO: 1296773 - protein, 31 aa, Mycobacterium
ALTRRPALAFGPQWLNRILVATSRKVNGRKL

SEQ ID NO: 1296774 - protein, 20 aa, Mycobacterium
ALVAARLLARDSLVKTALFG

SEQ ID NO: 1296775 - protein, 17 aa, Mycobacterium
ALVALHRQIKFVAVTEV

SEQ ID NO: 1296776 - protein, 23 aa, Mycobacterium
ALVDTLESLAPLAPLHNPPAVLG

SEQ ID NO: 1296777 - protein, 20 aa, Mycobacterium
ALVLCHISHVYPTGASLYFT

SEQ ID NO: 1296778 - protein, 23 aa, Mycobacterium
ALVLLERFPVPVLAIAEDGAILF

SEQ ID NO: 1296779 - protein, 24 aa, Mycobacterium
ALVNPIELFVPIFEKAFADTGALG

SEQ ID NO: 1296780 - protein, 25 aa, Mycobacterium
ALVNYPSALLLDEPLGALDLKLRHA

SEQ ID NO: 1296781 - protein, 25 aa, Mycobacterium
ALVRCCAAIMRRLGFGAARTIGHRE

SEQ ID NO: 1296782 - protein, 18 aa, Mycobacterium
ALVWTKEVWLATIEGRDF

SEQ ID NO: 1296783 - protein, 28 aa, Mycobacterium
AMAEIDEFAMPVAPWMFGAAGREHMRRH

SEQ ID NO: 1296784 - protein, 31 aa, Mycobacterium
AMAGIPRLQFAHVDLLVRSFGSLQGLLAASA

SEQ ID NO: 1296785 - protein, 22 aa, Mycobacterium
AMARKYFGPRLIRGQSAVPPRK

SEQ ID NO: 1296786 - protein, 24 aa, Mycobacterium
AMARLGHSVAFFIGTAYGSTETAE

SEQ ID NO: 1296787 - protein, 25 aa, Mycobacterium
AMDSETHPILIRSLARRLAELGRLI

SEQ ID NO: 1296788 - protein, 19 aa, Mycobacterium
AMIARRYMHEFGATSADFG

SEQ ID NO: 1296789 - protein, 19 aa, Mycobacterium
AMIDLAVVSVLLDAGAGPG

SEQ ID NO: 1296790 - protein, 24 aa, Mycobacterium
AMLDRLALNPQRIDGVAAGLRQVA

SEQ ID NO: 1296791 - protein, 27 aa, Mycobacterium
AMLGQPVSMLIPRVVGFKLTGERRAGV

SEQ ID NO: 1296792 - protein, 19 aa, Mycobacterium
AMMRIGIAPTLIGTRGSRP

SEQ ID NO: 1296793 - protein, 23 aa, Mycobacterium
AMNGLGRALYSPVLADPRRPANT

SEQ ID NO: 1296794 - protein, 21 aa, Mycobacterium
AMPQHIWDQKLAEIPMGRAGE

SEQ ID NO: 1296795 - protein, 24 aa, Mycobacterium
AMPSRPVQVIGFTSVPGAGDNLLV

SEQ ID NO: 1296796 - protein, 18 aa, Mycobacterium
AMPVLKPLHDEAGLVRMI

SEQ ID NO: 1296797 - protein, 19 aa, Mycobacterium
AMPVPFIEPEDISNAVLWL

SEQ ID NO: 1296798 - protein, 25 aa, Mycobacterium
AMQYGVLAGYPLVNVKVTLLDGAYH

SEQ ID NO: 1296799 - protein, 24 aa, Mycobacterium
AMRALPIGWAVADDGLRRTVTTGL

SEQ ID NO: 1296800 - protein, 31 aa, Mycobacterium
AMRDIRKHIAWYLHGFPAGSDLRRALALVKT

SEQ ID NO: 1296801 - protein, 20 aa, Mycobacterium
AMREMGLFGLMIPEEYGGLG

SEQ ID NO: 1296802 - protein, 25 aa, Mycobacterium
AMRKRPLPEWSERFATLAGPWAPVQ

SEQ ID NO: 1296803 - protein, 21 aa, Mycobacterium
AMRWYHFEPFKHIPKEQATVG

SEQ ID NO: 1296804 - protein, 27 aa, Mycobacterium
AMSGELIEHLFLPAFGPAADAAMGDSA

SEQ ID NO: 1296805 - protein, 21 aa, Mycobacterium
AMSLAPLAYTLFQRTMRHDPS

SEQ ID NO: 1296806 - protein, 18 aa, Mycobacterium
AMVAAIAVGLTRGWSPTK

SEQ ID NO: 1296807 - protein, 27 aa, Mycobacterium
AMVAELSKLRLLPFRLRFDGGEEVRTD

SEQ ID NO: 1296808 - protein, 21 aa, Mycobacterium
AMVIDLLLKRAADLGVQIRYE

SEQ ID NO: 1296809 - protein, 21 aa, Mycobacterium
AMYPIGPVFHGSGLNITVMSL

SEQ ID NO: 1296810 - protein, 26 aa, Mycobacterium
ANADHRITTLPWPGSKWTASRDMPEP

SEQ ID NO: 1296811 - protein, 22 aa, Mycobacterium
ANAFKSVGFMLEATGHNYANAD

SEQ ID NO: 1296812 - protein, 24 aa, Mycobacterium
ANAQLWRFVVLDAPDQRAAVAKAA

SEQ ID NO: 1296813 - protein, 32 aa, Mycobacterium; identical to SEQ ID NO: 783777

SEQ ID NO: 1296814 - protein, 40 aa, Mycobacterium
ANDDTVILYGGNNNWFAAYAYWYFKLYGHENVKLLDGGRK

SEQ ID NO: 1296815 - protein, 21 aa, Mycobacterium
ANHVPAPPRVLWSSGPSPSEV

SEQ ID NO: 1296816 - protein, 20 aa, Mycobacterium
ANLAQLRRSLGESATYTVAK

SEQ ID NO: 1296817 - protein, 32 aa, Mycobacterium
ANLGKAKAQPLWRVLVALSIRHVGPTAARALA

SEQ ID NO: 1296818 - protein, 21 aa, Mycobacterium
ANLGLWARDDPGYAWAREYLS

SEQ ID NO: 1296819 - protein, 26 aa, Mycobacterium
ANLHGRYLLPHFLIHDIADVAADLRA

SEQ ID NO: 1296820 - protein, 23 aa, Mycobacterium
ANLTAFTYLADRLAGPDRRVVAF

SEQ ID NO: 1296821 - protein, 28 aa, Mycobacterium
ANQQLLAFLQAWRQLLEQWTALLSGAGT

SEQ ID NO: 1296822 - protein, 26 aa, Mycobacterium
ANRIGANALLLNTSFAGPALAEVAER

SEQ ID NO: 1296823 - protein, 22 aa, Mycobacterium
ANRLPMMIVGRIIGVPDADVDK

SEQ ID NO: 1296824 - protein, 17 aa, Mycobacterium
ANRRRRELLKRNNLDGT

SEQ ID NO: 1296825 - protein, 19 aa, Mycobacterium
ANRTIIVRRLLGLEDALSI

SEQ ID NO: 1296826 - protein, 20 aa, Mycobacterium
ANSALLLAQLRDVPDERRGA

SEQ ID NO: 1296827 - protein, 20 aa, Mycobacterium
ANTQLVLGTYPITPASDILH

SEQ ID NO: 1296828 - protein, 22 aa, Mycobacterium
ANVATAMQVLNAVPAVCAAPVG

SEQ ID NO: 1296829 - protein, 26 aa, Mycobacterium
ANVKRWVPDILPLLTADDPLGVENFA

SEQ ID NO: 1296830 - protein, 23 aa, Mycobacterium
ANYARVPLIVLSANRPYELLGTG

SEQ ID NO: 1296831 - protein, 17 aa, Mycobacterium
ANYFAAATVLPYRQFHD

SEQ ID NO: 1296832 - protein, 21 aa, Mycobacterium
APAAGGGLPGGLPGGGPDGLP

SEQ ID NO: 1296833 - protein, 17 aa, Mycobacterium
APAPMLADEYDALAGGP

SEQ ID NO: 1296834 - protein, 18 aa, Mycobacterium
APAQLWRVDGGTATVGVI

SEQ ID NO: 1296835 - protein, 17 aa, Mycobacterium
APARPLTELPAPAISPA

SEQ ID NO: 1296836 - protein, 20 aa, Mycobacterium
APAVEALATDLGRPIDVAIQ

SEQ ID NO: 1296837 - protein, 28 aa, Mycobacterium
APAVIEAMLLVRLPYHLSSLTQAAARAA

SEQ ID NO: 1296838 - protein, 21 aa, Mycobacterium
APAYIAGDLAYFLDKRQRGFD

SEQ ID NO: 1296839 - protein, 18 aa, Mycobacterium
APCRWRSAAPLWGDASFA

SEQ ID NO: 1296840 - protein, 23 aa, Mycobacterium
APDDPWPVLDPFARAAVVAAAAH

SEQ ID NO: 1296841 - protein, 19 aa, Mycobacterium
APDSRFLVSIPTPFNAVNS

SEQ ID NO: 1296842 - protein, 25 aa, Mycobacterium
APEEDLVSLIYFYEANHDAVVTPLG

SEQ ID NO: 1296843 - protein, 26 aa, Mycobacterium
APEHIHTYRITPLALWNARAAGHDAE

SEQ ID NO: 1296844 - protein, 19 aa, Mycobacterium
APEIRYMLDRRRALGGFVP

SEQ ID NO: 1296845 - protein, 17 aa, Mycobacterium
APELLVVNKIDAADGLS

SEQ ID NO: 1296846 - protein, 18 aa, Mycobacterium
APEMFLAAASQRTKDIRL

SEQ ID NO: 1296847 - protein, 42 aa, Mycobacterium
APENFRMLMTLMVEAPFLLIRAALPYMYAQKFGRVINISSVH

SEQ ID NO: 1296848 - protein, 17 aa, Mycobacterium
APENYAAPWELLEGVWA

SEQ ID NO: 1296849 - protein, 24 aa, Mycobacterium
APERLRAAWVDIPEVVSAATVTGT

SEQ ID NO: 1296850 - protein, 24 aa, Mycobacterium
APEVSFYPWRDGGLGDQQTLVGGF

SEQ ID NO: 1296851 - protein, 21 aa, Mycobacterium
APGALGFHYDSGLYLQFRATD

SEQ ID NO: 1296852 - protein, 24 aa, Mycobacterium
APGFGDRRKAMLQDMAILTGGQVI

SEQ ID NO: 1296853 - protein, 23 aa, Mycobacterium
APGGTWYWNTYPGIAVDIPSFSY

SEQ ID NO: 1296854 - protein, 21 aa, Mycobacterium
APGIDLFRRLIEDYERDNNVP

SEQ ID NO: 1296855 - protein, 19 aa, Mycobacterium
APGLDQLHDLTGRPTYGVI

SEQ ID NO: 1296856 - protein, 26 aa, Mycobacterium
APGPCDTPLLPPDSWERAEGFTSGLP

SEQ ID NO: 1296857 - protein, 18 aa, Mycobacterium
APGVKLVDVPTPLAAAGI

SEQ ID NO: 1296858 - protein, 26 aa, Mycobacterium
APHEQRLTFLVKLTPGGAMSTYLAER

SEQ ID NO: 1296859 - protein, 18 aa, Mycobacterium
APHNDPFRLRIVSRDTFG

SEQ ID NO: 1296860 - protein, 17 aa, Mycobacterium
APIALGDDLRKTLLGLR

SEQ ID NO: 1296861 - protein, 20 aa, Mycobacterium
APKVVIAEWISGIPMSVIIR

SEQ ID NO: 1296862 - protein, 17 aa, Mycobacterium
APLAPPLPDVKIASPSV

SEQ ID NO: 1296863 - protein, 17 aa, Mycobacterium
APLLVVHGEKDRLIPVE

SEQ ID NO: 1296864 - protein, 21 aa, Mycobacterium
APLQIFAELTLAVSFSIVVRP

SEQ ID NO: 1296865 - protein, 25 aa, Mycobacterium
APLSERGCIPLAIHPAMTFTGADED

SEQ ID NO: 1296866 - protein, 21 aa, Mycobacterium
APLSRPVAVVLLGGLRELTAL

SEQ ID NO: 1296867 - protein, 17 aa, Mycobacterium
APLVPFAHDGVISSLRC

SEQ ID NO: 1296868 - protein, 27 aa, Mycobacterium
APMEPSPYLPTSRRFVNPLYLRPEAIP

SEQ ID NO: 1296869 - protein, 18 aa, Mycobacterium
APMIGGLGYLLAPGNPAY

SEQ ID NO: 1296870 - protein, 17 aa, Mycobacterium
APMIMSGREIKGWLRVD

SEQ ID NO: 1296871 - protein, 22 aa, Mycobacterium
APNVLYLVWDDTGIATWDCFGG

SEQ ID NO: 1296872 - protein, 26 aa, Mycobacterium
APPADLPPVPPPYDIPPMPAPAPEPG

SEQ ID NO: 1296873 - protein, 19 aa, Mycobacterium
APPAPRRKPIQMPGLQDVA

SEQ ID NO: 1296874 - protein, 29 aa, Mycobacterium
APPPLAQIPHPWFDLIFAGGHEKTAALSS

SEQ ID NO: 1296875 - protein, 17 aa, Mycobacterium
APQFEVMYLLGGCDADG

SEQ ID NO: 1296876 - protein, 18 aa, Mycobacterium
APQLGLTLRLQDLRMVDS

SEQ ID NO: 1296877 - protein, 22 aa, Mycobacterium
APQLWVVGTRPFGPICEFVRAT

SEQ ID NO: 1296878 - protein, 23 aa, Mycobacterium
APQPPQPWRDVADARRIGPVCPQ

SEQ ID NO: 1296879 - protein, 20 aa, Mycobacterium
APRLLVEYWAHEAALMAVDD

SEQ ID NO: 1296880 - protein, 26 aa, Mycobacterium
APTGSGFWHWAVFNLPATVTELPAGV

SEQ ID NO: 1296881 - protein, 18 aa, Mycobacterium
APTRLIEGLLGVGAVGLN

SEQ ID NO: 1296882 - protein, 18 aa, Mycobacterium
APVLDPILGLFGFNSVVT

SEQ ID NO: 1296883 - protein, 26 aa, Mycobacterium
APVLLTTLLLDRLVQCRASVLNTSSM

SEQ ID NO: 1296884 - protein, 25 aa, Mycobacterium
APVQVDTWGGWLFVNMDPDCEPLMD

SEQ ID NO: 1296885 - protein, 19 aa, Mycobacterium
APVRERLALGFGSSTFRYA

SEQ ID NO: 1296886 - protein, 29 aa, Mycobacterium
APVRNVLLALIFEWGIALHGLHSSRDRAL

SEQ ID NO: 1296887 - protein, 17 aa, Mycobacterium
APWGLFRADGDDAWVAV

SEQ ID NO: 1296888 - protein, 17 aa, Mycobacterium
APWPLIHEQTPSDACFI

SEQ ID NO: 1296889 - protein, 19 aa, Mycobacterium
APWVKHFPASGGATAVVFP

SEQ ID NO: 1296890 - protein, 19 aa, Mycobacterium
APYAALSDALGGIVRAMES

SEQ ID NO: 1296891 - protein, 20 aa, Mycobacterium
APYSDLIWMETGTPDLELAR

SEQ ID NO: 1296892 - protein, 26 aa, Mycobacterium
AQAFATMACLYPDRIFLGVGTGEALN

SEQ ID NO: 1296893 - protein, 24 aa, Mycobacterium
AQAGLRYFTVGVKNLRAIAAAFEA

SEQ ID NO: 1296894 - protein, 22 aa, Mycobacterium
AQAGPLLVVTATGREADDLTAE

SEQ ID NO: 1296895 - protein, 32 aa, Mycobacterium
AQASPPDMKLPIALALGWPDRIPGAALACDFT

SEQ ID NO: 1296896 - protein, 20 aa, Mycobacterium
AQAVALVWEATIDATGPDSD

SEQ ID NO: 1296897 - protein, 31 aa, Mycobacterium
AQAVDRLNLAGQPFLFFVDAAEGRACVLYHR

SEQ ID NO: 1296898 - protein, 18 aa, Mycobacterium
AQAYRLHTFGTVTRVAAG

SEQ ID NO: 1296899 - protein, 18 aa, Mycobacterium
AQDHGGVLRLLNSALLSA

SEQ ID NO: 1296900 - protein, 23 aa, Mycobacterium
AQDVFFSARNAATAERDAEFKAN

SEQ ID NO: 1296901 - protein, 21 aa, Mycobacterium
AQELLLELMPQAGSAMHVGIT

SEQ ID NO: 1296902 - protein, 27 aa, Mycobacterium
AQENARLERGLLPSPLLLENPGVDIVA

SEQ ID NO: 1296903 - protein, 23 aa, Mycobacterium
AQFQAAGFMRTGPTRPPYTEVPE

SEQ ID NO: 1296904 - protein, 22 aa, Mycobacterium
AQHAGFPLVVKPISGAPGEGQS

SEQ ID NO: 1296905 - protein, 24 aa, Mycobacterium
AQHGRLLLLLASVTHARRVLEIGT

SEQ ID NO: 1296906 - protein, 25 aa, Mycobacterium
AQKKKFLPAILAGEVHFAIGYSEPE

SEQ ID NO: 1296907 - protein, 23 aa, Mycobacterium
AQKLPAWVGGTWRRAAVLRYGEN

SEQ ID NO: 1296908 - protein, 30 aa, Mycobacterium
AQLDQPIAIVRYYADLLADYPMTEDLGNIE

SEQ ID NO: 1296909 - protein, 19 aa, Mycobacterium
AQLFISVHTVEWHLRKVFV

SEQ ID NO: 1296910 - protein, 27 aa, Mycobacterium
AQLLGPRGRRWLNKKLGLDNVFLDFDT

SEQ ID NO: 1296911 - protein, 25 aa, Mycobacterium
AQLLLDIIQTIPRPELFALQADELL

SEQ ID NO: 1296912 - protein, 19 aa, Mycobacterium
AQLRSDVGMVFQSFNLFAH

SEQ ID NO: 1296913 - protein, 25 aa, Mycobacterium
AQLSRWLAEWGAPAPPVATLPVNTV

SEQ ID NO: 1296914 - protein, 24 aa, Mycobacterium
AQLTRYVPALARSGYAGATVRHLL

SEQ ID NO: 1296915 - protein, 25 aa, Mycobacterium
AQMMSLITRYAPESVFPTIERWPAE

SEQ ID NO: 1296916 - protein, 32 aa, Mycobacterium; identical to SEQ ID NO: 124339

SEQ ID NO: 1296917 - protein, 24 aa, Mycobacterium
AQQGSFLGYRVTVCDARPVFATAA

SEQ ID NO: 1296918 - protein, 24 aa, Mycobacterium
AQQLLDHFVVLLGSALDRPDTTLA

SEQ ID NO: 1296919 - protein, 24 aa, Mycobacterium
AQQRYSRDLPPETLAWLYETMVVT

SEQ ID NO: 1296920 - protein, 27 aa, Mycobacterium
AQRDCVYYATLIMWIGCHADSHEYARW

SEQ ID NO: 1296921 - protein, 25 aa, Mycobacterium
AQRHAQLAMYQLAVAAGLLAEGDVP

SEQ ID NO: 1296922 - protein, 17 aa, Mycobacterium
AQRIAVVPFGGGTSVVG

SEQ ID NO: 1296923 - protein, 27 aa, Mycobacterium
AQRLVGVARLRLVCREYGITDVSSVSA

SEQ ID NO: 1296924 - protein, 24 aa, Mycobacterium
AQRQVPAILDLLATGAINLGELIT

SEQ ID NO: 1296925 - protein, 22 aa, Mycobacterium
AQSLGVFRNPLKTSLLSAADVK

SEQ ID NO: 1296926 - protein, 26 aa, Mycobacterium
AQSVPTLFPFVECQSRLLAAYAVGRY

SEQ ID NO: 1296927 - protein, 26 aa, Mycobacterium
AQTVARWLVMYLRRPGGQTQFAAPVW

SEQ ID NO: 1296928 - protein, 24 aa, Mycobacterium
AQVLAAALPWLKQLHGKIVVVKYG

SEQ ID NO: 1296929 - protein, 20 aa, Mycobacterium
AQVLVWQDMAGLTSGRTAKF

SEQ ID NO: 1296930 - protein, 24 aa, Mycobacterium
AQVPIVPHIVWGAQRIWTKGHPKK

SEQ ID NO: 1296931 - protein, 30 aa, Mycobacterium
AQVQRPDLVIGWWAAPTILEHGSPEQIEQF

SEQ ID NO: 1296932 - protein, 20 aa, Mycobacterium
AQVVMAANTPMLLKAGLVEG

SEQ ID NO: 1296933 - protein, 20 aa, Mycobacterium
AQYGVPVLSVHAPCLLISQR

SEQ ID NO: 1296934 - protein, 25 aa, Mycobacterium
ARADNPAYVSWLLSQSMLADANEIS

SEQ ID NO: 1296935 - protein, 18 aa, Mycobacterium
ARAFLLTDELVAEDFAFY

SEQ ID NO: 1296936 - protein, 23 aa, Mycobacterium
ARAITIAAFANKVTLGFTSDIKN

SEQ ID NO: 1296937 - protein, 23 aa, Mycobacterium
ARAKYGWTDVARFAALGIPAVNY

SEQ ID NO: 1296938 - protein, 27 aa, Mycobacterium
ARALAVQPRVLLLDEPLSALDAKVRAQ

SEQ ID NO: 1296939 - protein, 26 aa, Mycobacterium
ARALVRNPPVLLLDEPLSHLDASARQ

SEQ ID NO: 1296940 - protein, 22 aa, Mycobacterium
ARAMVNLHRRYRLTTTQLAAAT

SEQ ID NO: 1296941 - protein, 30 aa, Mycobacterium
ARAPRARVLFVDYLTLLPPPGEPVAPLSDA

SEQ ID NO: 1296942 - protein, 25 aa, Mycobacterium
ARARAMALVMLALPGVVFVYNGEEL

SEQ ID NO: 1296943 - protein, 32 aa, Mycobacterium
ARASETWRFPPFFHALLDAGVYPPPSAFEAWF

SEQ ID NO: 1296944 - protein, 23 aa, Mycobacterium
ARASGMTAVFWLDTERPHEAELR

SEQ ID NO: 1296945 - protein, 26 aa, Mycobacterium
ARAVNAIDWVCRAPSGLLAIEDVPPT

SEQ ID NO: 1296946 - protein, 18 aa, Mycobacterium
ARAYRLLPEKPAYTAVRW

SEQ ID NO: 1296947 - protein, 21 aa, Mycobacterium
ARCALAWSVETAKLAREHNNA

SEQ ID NO: 1296948 - protein, 24 aa, Mycobacterium
ARDHELRRRWSPHGEPIVGFVGRL

SEQ ID NO: 1296949 - protein, 23 aa, Mycobacterium
AREAGNAYLLWTAGGAPVSMAGV

SEQ ID NO: 1296950 - protein, 23 aa, Mycobacterium
AREHPEWFTVLPDGTIAYAENPP

SEQ ID NO: 1296951 - protein, 23 aa, Mycobacterium
AREQGRIDILVNNAAIIRDEMMA

SEQ ID NO: 1296952 - protein, 20 aa, Mycobacterium
ARERRAWLPTRSVSRRRWPN

SEQ ID NO: 1296953 - protein, 25 aa, Mycobacterium
AREVYQEGLILPPTKIISGGRTRHD

SEQ ID NO: 1296954 - protein, 22 aa, Mycobacterium
ARFAWLLFRHPERAAFAARDIL

SEQ ID NO: 1296955 - protein, 26 aa, Mycobacterium
ARFDSYRGFLFGSLNPDVVPLLEHLG

SEQ ID NO: 1296956 - protein, 21 aa, Mycobacterium
ARFREFYGRVLSWTFEPGRIE

SEQ ID NO: 1296957 - protein, 19 aa, Mycobacterium
ARFRRPGLEPPPPPSATRP

SEQ ID NO: 1296958 - protein, 28 aa, Mycobacterium
ARFSAWADDIFKIFNWNVAEDADDIERA

SEQ ID NO: 1296959 - protein, 19 aa, Mycobacterium
ARFVTPWPRPLDVEAMNDA

SEQ ID NO: 1296960 - protein, 32 aa, Mycobacterium
ARGADPVFMLTGPIPATRYALDKTGLSIDDID

SEQ ID NO: 1296961 - protein, 21 aa, Mycobacterium
ARGEGLYWSLPVVGETYDGVL

SEQ ID NO: 1296962 - protein, 18 aa, Mycobacterium
ARGFGRPPMPRLADAFMD

SEQ ID NO: 1296963 - protein, 21 aa, Mycobacterium
ARGHLYSFHQLMGRADLLLGE

SEQ ID NO: 1296964 - protein, 18 aa, Mycobacterium
ARGIPEEQARRLIVRGFF

SEQ ID NO: 1296965 - protein, 26 aa, Mycobacterium
ARGKAIIILNPADPPMIMRDTIFCAI

SEQ ID NO: 1296966 - protein, 18 aa, Mycobacterium
ARGRGAVRRVLLGSVSAG

SEQ ID NO: 1296967 - protein, 17 aa, Mycobacterium
ARGVIGIGWIPENILRD

SEQ ID NO: 1296968 - protein, 20 aa, Mycobacterium
ARHNYAILDTYEAGIALMGT

SEQ ID NO: 1296969 - protein, 18 aa, Mycobacterium
ARIDGAIARLAGLEILRR

SEQ ID NO: 1296970 - protein, 19 aa, Mycobacterium
ARILAVSPLIREMMIYALR

SEQ ID NO: 1296971 - protein, 24 aa, Mycobacterium
ARKPGSYFWLKGGKRRQRLAEALP

SEQ ID NO: 1296972 - protein, 27 aa, Mycobacterium
ARKRPEFGKLTPLYPNQRLRLETSPDK

SEQ ID NO: 1296973 - protein, 19 aa, Mycobacterium
ARKSIAQFKLREGMPIGAR

SEQ ID NO: 1296974 - protein, 18 aa, Mycobacterium
ARLALTPAVVSALCDRRR

SEQ ID NO: 1296975 - protein, 19 aa, Mycobacterium
ARLDGMDSLLSIVQMPAGV

SEQ ID NO: 1296976 - protein, 21 aa, Mycobacterium
ARLGVIANMQPLWAQLDPLMT

SEQ ID NO: 1296977 - protein, 19 aa, Mycobacterium
ARLNIPWNRDFNALVYVLS

SEQ ID NO: 1296978 - protein, 22 aa, Mycobacterium
ARLRDWLVTYLTTHVECSPESI

SEQ ID NO: 1296979 - protein, 21 aa, Mycobacterium
ARMSDVLRNATWCHPLCAQDH

SEQ ID NO: 1296980 - protein, 29 aa, Mycobacterium
ARPDDWARDYWIPFDRFRALDRVRTEHAT

SEQ ID NO: 1296981 - protein, 20 aa, Mycobacterium
ARPELLAELARQFGSQCIVL

SEQ ID NO: 1296982 - protein, 27 aa, Mycobacterium
ARPEQMQAFLRPWADALWDTGIEFGTV

SEQ ID NO: 1296983 - protein, 25 aa, Mycobacterium
ARPFGTPGFLFLDPPDHTRLRRLVS

SEQ ID NO: 1296984 - protein, 25 aa, Mycobacterium
ARPKVLLLDEPSMGLAPMVISQIFK

SEQ ID NO: 1296985 - protein, 20 aa, Mycobacterium
ARPWNVEVGSMLPFSPSFTR

SEQ ID NO: 1296986 - protein, 20 aa, Mycobacterium
ARQPYYRWRANPITNAELVE

SEQ ID NO: 1296987 - protein, 20 aa, Mycobacterium
ARQRLAAFVAPIPLTVRDGT

SEQ ID NO: 1296988 - protein, 27 aa, Mycobacterium
ARRDFYRYHASLMEPWDGPAAVCFTDG

SEQ ID NO: 1296989 - protein, 25 aa, Mycobacterium
ARRHLVAGLMLIHLDIDAAVAVIRG

SEQ ID NO: 1296990 - protein, 18 aa, Mycobacterium
ARRLSTLDHLTGGRIGWN

SEQ ID NO: 1296991 - protein, 20 aa, Mycobacterium
ARRLVGAPAVVLPPRGVVYG

SEQ ID NO: 1296992 - protein, 25 aa, Mycobacterium
ARRREDYVGPWLPEPLLVDDGDAAS

SEQ ID NO: 1296993 - protein, 18 aa, Mycobacterium
ARRRLIVTTARRLAEAEG

SEQ ID NO: 1296994 - protein, 24 aa, Mycobacterium
ARRRRARGLRLNHPEAVAVITDHL

SEQ ID NO: 1296995 - protein, 19 aa, Mycobacterium
ARRTLFRYYSSKSAIPWGD

SEQ ID NO: 1296996 - protein, 27 aa, Mycobacterium
ARRVRIDRFEVLAIRRVDGFVDVDVAV

SEQ ID NO: 1296997 - protein, 19 aa, Mycobacterium
ARRYAYVPTYVLRGLTDLH

SEQ ID NO: 1296998 - protein, 24 aa, Mycobacterium
ARSALMLSATRDLPALGAAAHDLQ

SEQ ID NO: 1296999 - protein, 19 aa, Mycobacterium
ARSGLSMAPPFVAPQTAWN

SEQ ID NO: 1297000 - protein, 18 aa, Mycobacterium
ARSTGIGELKFFSQIGYG

SEQ ID NO: 1297001 - protein, 25 aa, Mycobacterium
ARTAAWRLHVFSPVRAIPGVEGAGT

SEQ ID NO: 1297002 - protein, 22 aa, Mycobacterium
ARTFPVVDGVRYAVPGDRARHL

SEQ ID NO: 1297003 - protein, 28 aa, Mycobacterium
ARTGGVPVLLRCRLLRAELTPPGEQRKA

SEQ ID NO: 1297004 - protein, 20 aa, Mycobacterium
ARTLRPCHTPLDGDTVFALA

SEQ ID NO: 1297005 - protein, 19 aa, Mycobacterium
ARTPRLVEVIAAQTGLLDD

SEQ ID NO: 1297006 - protein, 23 aa, Mycobacterium
ARTRMHRRWSIVMVDEFQDTDPV

SEQ ID NO: 1297007 - protein, 18 aa, Mycobacterium
ARTVIYYVLGFTVDEQSK

SEQ ID NO: 1297008 - protein, 21 aa, Mycobacterium
ARTWGASTLIPFFGGLTSVPV

SEQ ID NO: 1297009 - protein, 22 aa, Mycobacterium
ARTYFQAYAAACALHFAEKALT

SEQ ID NO: 1297010 - protein, 21 aa, Mycobacterium
ARVAQFIPLLGEVEQKIIECF

SEQ ID NO: 1297011 - protein, 20 aa, Mycobacterium
ARVCGICPVAYQVSACNAIE

SEQ ID NO: 1297012 - protein, 23 aa, Mycobacterium
ARVCGLDFSPGLIAIARQCGADA

SEQ ID NO: 1297013 - protein, 20 aa, Mycobacterium
ARVPGRLFAGPALDQPAEAD

SEQ ID NO: 1297014 - protein, 35 aa, Mycobacterium
ARVPISIVHRAGLQFPAPTLLYGYGAYESCEDPRF

SEQ ID NO: 1297015 - protein, 24 aa, Mycobacterium
ARVQLLRDLGSAAAPFNAFLIAQG

SEQ ID NO: 1297016 - protein, 29 aa, Mycobacterium
ARVSRPTLYRWFPSKQDLLSAFVVWERSL

SEQ ID NO: 1297017 - protein, 26 aa, Mycobacterium
ARVVRRLRLPSPIRDLALGRDGLAYV

SEQ ID NO: 1297018 - protein, 18 aa, Mycobacterium
ARWEPTIVRPVVTALIDE

SEQ ID NO: 1297019 - protein, 25 aa, Mycobacterium
ARWLGPAVTAPLYRLARLHTTPAKP

SEQ ID NO: 1297020 - protein, 26 aa, Mycobacterium
ARWSSDIAAVWWQAALDAYDRLPAAS

SEQ ID NO: 1297021 - protein, 22 aa, Mycobacterium
ARWTAAMVASGQRFDFTDLRRG

SEQ ID NO: 1297022 - protein, 24 aa, Mycobacterium
ARYPLEELLPVYRPRRAALQRLLD

SEQ ID NO: 1297023 - protein, 21 aa, Mycobacterium
ARYRPSWLPIPMKSILRILGV

SEQ ID NO: 1297024 - protein, 26 aa, Mycobacterium
ARYSGYLRASLPPFWATTDPARVRAA

SEQ ID NO: 1297025 - protein, 25 aa, Mycobacterium
ASAELLIMPSLYEGAGLPPLEAMAS

SEQ ID NO: 1297026 - protein, 24 aa, Mycobacterium
ASAFALWFPVETDHARYGEMKTEM

SEQ ID NO: 1297027 - protein, 24 aa, Mycobacterium
ASAGYMLMKPLVETATAAGARALY

SEQ ID NO: 1297028 - protein, 23 aa, Mycobacterium
ASALLRDVIDARLAFLVSGGTGA

SEQ ID NO: 1297029 - protein, 24 aa, Mycobacterium
ASARQGFLLRRAIGSAVDARELQR

SEQ ID NO: 1297030 - protein, 22 aa, Mycobacterium
ASATDRGYALDRHWRNVRVHSL

SEQ ID NO: 1297031 - protein, 22 aa, Mycobacterium
ASATPLPVIGVPVPLARLDGMD

SEQ ID NO: 1297032 - protein, 27 aa, Mycobacterium
ASDAADWFAGRLPDGWFAGDPTVVVDR

SEQ ID NO: 1297033 - protein, 37 aa, Mycobacterium
ASDARRFDVSPAWFSALGAGLTLPWLAGLDRAAVEAH

SEQ ID NO: 1297034 - protein, 25 aa, Mycobacterium
ASDEWEWVPLRLPPDVTRISASIRL

SEQ ID NO: 1297035 - protein, 21 aa, Mycobacterium
ASDFLHGRWLVLRRGKRNIAG

SEQ ID NO: 1297036 - protein, 18 aa, Mycobacterium
ASDHQIFDRLLRAGTTAG

SEQ ID NO: 1297037 - protein, 25 aa, Mycobacterium
ASDSAGFKWLAPYTGSAIAQHWMYD

SEQ ID NO: 1297038 - protein, 24 aa, Mycobacterium
ASFDLLHVFALLQDDVMDDSPLRR

SEQ ID NO: 1297039 - protein, 30 aa, Mycobacterium
ASFLVKDLHLPWQWGARWFLEQLVDGDMAN

SEQ ID NO: 1297040 - protein, 32 aa, Mycobacterium; identical to SEQ ID NO: 216408

SEQ ID NO: 1297041 - protein, 27 aa, Mycobacterium
ASGLDSRAYRLPWPAGTVVFEIDQPGV

SEQ ID NO: 1297042 - protein, 34 aa, Mycobacterium
ASGTLLVRGPYGRGWPFSLLFAVVYATRGYHVVV

SEQ ID NO: 1297043 - protein, 17 aa, Mycobacterium
ASHGQIAFAVQNALTGL

SEQ ID NO: 1297044 - protein, 23 aa, Mycobacterium
ASHQSAYAPLWERALESTGTDAV

SEQ ID NO: 1297045 - protein, 28 aa, Mycobacterium
ASIAAYPRVVWIAGGLLKGVSVDALVAE

SEQ ID NO: 1297046 - protein, 17 aa, Mycobacterium
ASIIAFGAPVDTLAALP

SEQ ID NO: 1297047 - protein, 20 aa, Mycobacterium
ASKALTTAALLQAFDRDAAA

SEQ ID NO: 1297048 - protein, 18 aa, Mycobacterium
ASKFLKKALTGEGLPLMR

SEQ ID NO: 1297049 - protein, 17 aa, Mycobacterium
ASKRLFDEVPVRTPGTL

SEQ ID NO: 1297050 - protein, 29 aa, Mycobacterium
ASKTRTWQVGAMRDLLLAHRDPGTPVVIG

SEQ ID NO: 1297051 - protein, 25 aa, Mycobacterium
ASLDDLLTIPLAKELAWAPEEIREE

SEQ ID NO: 1297052 - protein, 19 aa, Mycobacterium
ASMIMDYQALRAMGSAALA

SEQ ID NO: 1297053 - protein, 19 aa, Mycobacterium
ASMLPFQYTVNAYRGCSHA

SEQ ID NO: 1297054 - protein, 17 aa, Mycobacterium
ASMPPRPGERELVPRAR

SEQ ID NO: 1297055 - protein, 17 aa, Mycobacterium
ASNPRRDRRHAIAHLVF

SEQ ID NO: 1297056 - protein, 28 aa, Mycobacterium
ASNPWSQIPIFDPNWRTNMFDPVAFAAR

SEQ ID NO: 1297057 - protein, 17 aa, Mycobacterium
ASPDIHRIALVNAPAVL

SEQ ID NO: 1297058 - protein, 24 aa, Mycobacterium
ASRHLDLAARWLRAQGRGYYTIGS

SEQ ID NO: 1297059 - protein, 23 aa, Mycobacterium
ASSALVLHYLPEIDMRTGKVLGT

SEQ ID NO: 1297060 - protein, 23 aa, Mycobacterium
ASSIPLYVHAPYLINVASANNRV

SEQ ID NO: 1297061 - protein, 24 aa, Mycobacterium
ASSKYALVIYAAKRARQINDYYNQ

SEQ ID NO: 1297062 - protein, 24 aa, Mycobacterium
ASSLWAGVFMARIGARHLYSAGSQ

SEQ ID NO: 1297063 - protein, 24 aa, Mycobacterium
ASTGDGIALALWAGVPVSDIEFVQ

SEQ ID NO: 1297064 - protein, 24 aa, Mycobacterium
ASTVFGVRFPGPLGLAAGFDKDGR

SEQ ID NO: 1297065 - protein, 21 aa, Mycobacterium
ASVAATAAPAGYALGGGDPIV

SEQ ID NO: 1297066 - protein, 21 aa, Mycobacterium
ASVHPSLWRQSQLAAKQGLYE

SEQ ID NO: 1297067 - protein, 25 aa, Mycobacterium
ASVPPILLGGIDWFRSMGSEKSPGF

SEQ ID NO: 1297068 - protein, 33 aa, Mycobacterium
ASVRLNRPSKFFVLDADAFARFMQSQFPMAVHL

SEQ ID NO: 1297069 - protein, 19 aa, Mycobacterium
ASVTFLGTERIEVLRYGPG

SEQ ID NO: 1297070 - protein, 19 aa, Mycobacterium
ASWAVYRPGRGWAPHDPGV

SEQ ID NO: 1297071 - protein, 26 aa, Mycobacterium
ASYHLPRLIGMRRAQELMLTNRTLSA

SEQ ID NO: 1297072 - protein, 25 aa, Mycobacterium
ATAIDPQHRLLLETAWEAVEHAGID

SEQ ID NO: 1297073 - protein, 24 aa, Mycobacterium
ATAMRVVNAIPYVVAAPAGLLSSL

SEQ ID NO: 1297074 - protein, 29 aa, Mycobacterium
ATARAAVVLVPINFMLTAEEISYLLGHSG

SEQ ID NO: 1297075 - protein, 25 aa, Mycobacterium
ATATYLVRMLRDIPGLTVTRIASGL

SEQ ID NO: 1297076 - protein, 28 aa, Mycobacterium
ATAVWNAVCWAIIIPAGRLRTGDASLYT

SEQ ID NO: 1297077 - protein, 24 aa, Mycobacterium
ATAWYGLHDLARIGARDKVLIHSA

SEQ ID NO: 1297078 - protein, 19 aa, Mycobacterium
ATDAAAFFDFLAGRPEVRG

SEQ ID NO: 1297079 - protein, 24 aa, Mycobacterium
ATDDDLLIDFAKVSLRRGGRTLVG

SEQ ID NO: 1297080 - protein, 27 aa, Mycobacterium
ATDGPVAFAPPYLIAGQALAVDAENHP

SEQ ID NO: 1297081 - protein, 23 aa, Mycobacterium
ATDHNLWLRRTAIISQLSAKERT

SEQ ID NO: 1297082 - protein, 22 aa, Mycobacterium
ATDLIGYGPYLDRVGLRDGQQR

SEQ ID NO: 1297083 - protein, 22 aa, Mycobacterium
ATDRFRLAVRELTWSTSSPDVE

SEQ ID NO: 1297084 - protein, 27 aa, Mycobacterium
ATDVEQTFLRRLLTGELRQGALIGVMA

SEQ ID NO: 1297085 - protein, 23 aa, Mycobacterium
ATELLVEVAGPDALPFGAGADLA

SEQ ID NO: 1297086 - protein, 24 aa, Mycobacterium
ATEQQWWERSPIFSGLNTNKKGLT

SEQ ID NO: 1297087 - protein, 22 aa, Mycobacterium
ATEVAIFIDPQQLVRGVLVNER

SEQ ID NO: 1297088 - protein, 25 aa, Mycobacterium
ATFLFDTLDGFLDTLLAAAARGVSV

SEQ ID NO: 1297089 - protein, 21 aa, Mycobacterium
ATFQHLWREVGANIERYHGYP

SEQ ID NO: 1297090 - protein, 20 aa, Mycobacterium
ATGIDIYRIFDALNNVESMR

SEQ ID NO: 1297091 - protein, 24 aa, Mycobacterium
ATGLESTMRFILSGKSAYVDGQVY

SEQ ID NO: 1297092 - protein, 17 aa, Mycobacterium
ATGLIVVPVMFDRIMDL

SEQ ID NO: 1297093 - protein, 34 aa, Mycobacterium
ATGLSYLRKLTMQLSSKMRFASAQLLTLFDDDLG

SEQ ID NO: 1297094 - protein, 27 aa, Mycobacterium
ATGMVRFIGVDGYRWMIRCVVNGVAES

SEQ ID NO: 1297095 - protein, 19 aa, Mycobacterium
ATGRLADPTDLAFDEAHVE

SEQ ID NO: 1297096 - protein, 21 aa, Mycobacterium
ATHLAAFRAFDGKPPVGVTVF

SEQ ID NO: 1297097 - protein, 26 aa, Mycobacterium
ATHLRRAVWWRGYSRGPVSPLHRACG

SEQ ID NO: 1297098 - protein, 19 aa, Mycobacterium
ATHLSRLVPQHMMRRMFFT

SEQ ID NO: 1297099 - protein, 32 aa, Mycobacterium
ATHRFLADMPGYRGWQWAVVVAAYPGAEQATI

SEQ ID NO: 1297100 - protein, 31 aa, Mycobacterium
ATIDLLRRTTPMRLFWAREYSDYHPEQPGGS

SEQ ID NO: 1297101 - protein, 19 aa, Mycobacterium
ATIRLANKVRLLAYAAGDT

SEQ ID NO: 1297102 - protein, 23 aa, Mycobacterium
ATISELVLVPGPTALLAPKWVPW

SEQ ID NO: 1297103 - protein, 29 aa, Mycobacterium
ATIYNDLRVIDNVRYFAALYGTGGQAADE

SEQ ID NO: 1297104 - protein, 18 aa, Mycobacterium
ATKTFVCQIIAGVAVTIS

SEQ ID NO: 1297105 - protein, 20 aa, Mycobacterium
ATLAQMFPGRFWAALGSGEA

SEQ ID NO: 1297106 - protein, 23 aa, Mycobacterium
ATLEALLTRLNLPDDVPIEAKMV

SEQ ID NO: 1297107 - protein, 33 aa, Mycobacterium
ATLINMEFIQFHPTGMVWPPSVKGILVTEGVRG

SEQ ID NO: 1297108 - protein, 24 aa, Mycobacterium
ATMKRLFLELGGKSATIVLEDADF

SEQ ID NO: 1297109 - protein, 20 aa, Mycobacterium
ATMVIVTHDLPYAAQLCERA

SEQ ID NO: 1297110 - protein, 18 aa, Mycobacterium
ATNLNRTLKSWADGGLQV

SEQ ID NO: 1297111 - protein, 24 aa, Mycobacterium
ATNVELRLRCLDQLHTALVEHRDE

SEQ ID NO: 1297112 - protein, 23 aa, Mycobacterium
ATPEWFYVVRFNQSELWHGYTGT

SEQ ID NO: 1297113 - protein, 26 aa, Mycobacterium
ATPLADRGCWLHMLALYRAGRVTDAL

SEQ ID NO: 1297114 - protein, 25 aa, Mycobacterium
ATPLRRLGDVADLGRLCVYLSTRDC

SEQ ID NO: 1297115 - protein, 31 aa, Mycobacterium
ATPPGMTFVSWLPFYHDMGLIKGVCAPLVSG

SEQ ID NO: 1297116 - protein, 27 aa, Mycobacterium
ATPTTALPLFAGWRAMPLAADAPARAL

SEQ ID NO: 1297117 - protein, 31 aa, Mycobacterium
ATQGVIARIDWARFLPLYQQAGRRAFLTELE

SEQ ID NO: 1297118 - protein, 23 aa, Mycobacterium
ATRHPRILLCGSGSRRGGGVSGI

SEQ ID NO: 1297119 - protein, 17 aa, Mycobacterium
ATRLQMPKARRTLPAVL

SEQ ID NO: 1297120 - protein, 29 aa, Mycobacterium
ATSASTPLFFAQAIGRFVRSRRPGETASI

SEQ ID NO: 1297121 - protein, 17 aa, Mycobacterium
ATSLVLLTATALGLATC

SEQ ID NO: 1297122 - protein, 39 aa, Mycobacterium
ATSYMSRLFDYLLMSLRSLPLVMVIGQPEVRIPTLSFAV

SEQ ID NO: 1297123 - protein, 24 aa, Mycobacterium
ATTAHIRIFTPATELPFAGHPTVG

SEQ ID NO: 1297124 - protein, 27 aa, Mycobacterium
ATTTRLLSRLPPRRQPPKSVPPLRRPE

SEQ ID NO: 1297125 - protein, 20 aa, Mycobacterium
ATVEVIIATAWDCPFDGPTP

SEQ ID NO: 1297126 - protein, 27 aa, Mycobacterium
ATVGLSYLGFTQWALLTDPPPELRAAV

SEQ ID NO: 1297127 - protein, 29 aa, Mycobacterium
ATVLARSTFHWVLAFAYKGLSTPKVFREL

SEQ ID NO: 1297128 - protein, 17 aa, Mycobacterium
ATWAPAHGDPLLEPLRA

SEQ ID NO: 1297129 - protein, 17 aa, Mycobacterium
ATWLRTTDFGDDKDRVV

SEQ ID NO: 1297130 - protein, 22 aa, Mycobacterium
ATWLSLMDHFFQIEPTGLPAEA

SEQ ID NO: 1297131 - protein, 24 aa, Mycobacterium
ATYVICEVLAWRGIWLSEERRRIG

SEQ ID NO: 1297132 - protein, 25 aa, Mycobacterium
AVAADPLVASLLLVHGMHPHSVERR

SEQ ID NO: 1297133 - protein, 22 aa, Mycobacterium
AVAAFELLKWRAAEAGVKLRTF

SEQ ID NO: 1297134 - protein, 23 aa, Mycobacterium
AVADALPQRAPLSAPLGAPAAAV

SEQ ID NO: 1297135 - protein, 23 aa, Mycobacterium
AVAEALPLLDPALRKVMAGFFEL

SEQ ID NO: 1297136 - protein, 30 aa, Mycobacterium
AVAERGAMFDPSAVFYMNKIAVGPDAVDAI

SEQ ID NO: 1297137 - protein, 20 aa, Mycobacterium
AVAFPRSPFVTAATAWELQE

SEQ ID NO: 1297138 - protein, 36 aa, Mycobacterium
AVAGEHGFRFFPAYYLHIWDLFQRIPVYERIELPGS

SEQ ID NO: 1297139 - protein, 26 aa, Mycobacterium
AVAGGLELALWCDLRVVEEDAVLGVF

SEQ ID NO: 1297140 - protein, 25 aa, Mycobacterium
AVAGGVLREWLHKQRTGKPHVTWKF

SEQ ID NO: 1297141 - protein, 25 aa, Mycobacterium
AVAKRLMRVLGTSAYVPDLLMRAPE

SEQ ID NO: 1297142 - protein, 24 aa, Mycobacterium
AVALFRESLVLVRALVPDGFSEYL

SEQ ID NO: 1297143 - protein, 28 aa, Mycobacterium
AVARHAWRPRWLKWSLTISGKGGTHRGG

SEQ ID NO: 1297144 - protein, 23 aa, Mycobacterium
AVASFFAKNFLPLLTSTRQVVEH

SEQ ID NO: 1297145 - protein, 19 aa, Mycobacterium
AVATAQRLLGGPAAVVVDC

SEQ ID NO: 1297146 - protein, 19 aa, Mycobacterium
AVAVSERTLRRLFAEELGL

SEQ ID NO: 1297147 - protein, 19 aa, Mycobacterium
AVCLYLEPIALYHTKDLYA

SEQ ID NO: 1297148 - protein, 35 aa, Mycobacterium
AVDAGVHFVLATGRPPRWVAPVVDGLGLAPMAVCA

SEQ ID NO: 1297149 - protein, 27 aa, Mycobacterium
AVDDCYDAYLWLRRKGYEPDQIVLAGD

SEQ ID NO: 1297150 - protein, 25 aa, Mycobacterium
AVDDLGLPDMLLLLATDIAAVDHHE

SEQ ID NO: 1297151 - protein, 24 aa, Mycobacterium
AVDELMRFCPVIFTTIRTAREDVE

SEQ ID NO: 1297152 - protein, 22 aa, Mycobacterium
AVDFRQKFKKDVVIDLLCYRRR

SEQ ID NO: 1297153 - protein, 20 aa, Mycobacterium
AVELFKPLAAKATRPEVRGG

SEQ ID NO: 1297154 - protein, 41 aa, Mycobacterium
AVELPFLHKDLYREYSLRPPKGVLLYGPPGCGKTLIAKAVA

SEQ ID NO: 1297155 - protein, 19 aa, Mycobacterium
AVEPSPPQARRLIVGAWHD

SEQ ID NO: 1297156 - protein, 29 aa, Mycobacterium
AVESILTVLALKNGVIPPTLNLKNLDPEI

SEQ ID NO: 1297157 - protein, 25 aa, Mycobacterium
AVESMDFGFFWATGVTKDGTILVAN

SEQ ID NO: 1297158 - protein, 19 aa, Mycobacterium
AVEVQLDQCWDLLRQRRAL

SEQ ID NO: 1297159 - protein, 18 aa, Mycobacterium
AVFGTLIHRYTHADDFLV

SEQ ID NO: 1297160 - protein, 17 aa, Mycobacterium
AVFGVVRARKVIAANSK

SEQ ID NO: 1297161 - protein, 17 aa, Mycobacterium
AVFYCVANMPGAVPRTS

SEQ ID NO: 1297162 - protein, 17 aa, Mycobacterium
AVFYRYFDDKEDLLAAL

SEQ ID NO: 1297163 - protein, 25 aa, Mycobacterium
AVGRIRAMRMALLAERISAAEAYDW

SEQ ID NO: 1297164 - protein, 24 aa, Mycobacterium
AVGVVHSLWQPMAGRFKDYIAQPR

SEQ ID NO: 1297165 - protein, 21 aa, Mycobacterium
AVHLADPWRRRRSVPLAALAE

SEQ ID NO: 1297166 - protein, 26 aa, Mycobacterium
AVHRDFAVRLVTFAAIALAAGQPYPP

SEQ ID NO: 1297167 - protein, 26 aa, Mycobacterium
AVHTIARVAPLSGDPYRLAGELGMPP

SEQ ID NO: 1297168 - protein, 18 aa, Mycobacterium
AVIATGAWISALADRWVR

SEQ ID NO: 1297169 - protein, 38 aa, Mycobacterium
AVIGTPYARMWGAYLTGMWLYRLSLAKVKWHSLTGEPL

SEQ ID NO: 1297170 - protein, 23 aa, Mycobacterium
AVKHFKFTLPERGKRRIHKTPSR

SEQ ID NO: 1297171 - protein, 20 aa, Mycobacterium
AVKRGVAAGPAKRAAKKAPA

SEQ ID NO: 1297172 - protein, 18 aa, Mycobacterium
AVLALRRGKGMVLDEPDR

SEQ ID NO: 1297173 - protein, 19 aa, Mycobacterium
AVLALTYSLAQSLADRKIR

SEQ ID NO: 1297174 - protein, 24 aa, Mycobacterium
AVLANAYHLYLQPGPDVVAAAGGL

SEQ ID NO: 1297175 - protein, 28 aa, Mycobacterium
AVLARQTLWPERLFSILAGFVEAGESFE

SEQ ID NO: 1297176 - protein, 20 aa, Mycobacterium
AVLHTLNIRLAPEQLAYIAN

SEQ ID NO: 1297177 - protein, 26 aa, Mycobacterium
AVLIGSAWQRCRVHFLRNVLAQVPKG

SEQ ID NO: 1297178 - protein, 18 aa, Mycobacterium
AVLLLHTTGAKSGQPRLS

SEQ ID NO: 1297179 - protein, 25 aa, Mycobacterium
AVLPVYDPLFDSQKLRHVLVRHEQG

SEQ ID NO: 1297180 - protein, 23 aa, Mycobacterium
AVLRFQYQIARIPLQVIEDRVVA

SEQ ID NO: 1297181 - protein, 17 aa, Mycobacterium
AVLRTLAGNPVPHPGFI

SEQ ID NO: 1297182 - protein, 26 aa, Mycobacterium
AVLSRAQLLELVWGYDFAADTNVVDV

SEQ ID NO: 1297183 - protein, 24 aa, Mycobacterium
AVLTTRIYCRPSCPVRPPFARNVR

SEQ ID NO: 1297184 - protein, 18 aa, Mycobacterium
AVLVKPRQAHAAWVFARL

SEQ ID NO: 1297185 - protein, 22 aa, Mycobacterium
AVMGDLSRRRWWPLTEALTGER

SEQ ID NO: 1297186 - protein, 20 aa, Mycobacterium
AVMRADSARFAWLLFRHPER

SEQ ID NO: 1297187 - protein, 18 aa, Mycobacterium
AVNPWMLRMAGEVADGVH

SEQ ID NO: 1297188 - protein, 18 aa, Mycobacterium
AVNPYLAFETIEDLIREG

SEQ ID NO: 1297189 - protein, 17 aa, Mycobacterium
AVNQAVQWPLVELQTEA

SEQ ID NO: 1297190 - protein, 28 aa, Mycobacterium
AVNVATLPFPGFPTDLQPMAIGLASIAD

SEQ ID NO: 1297191 - protein, 25 aa, Mycobacterium
AVPAIIAEYLGLPQLTHMRKVTVAD

SEQ ID NO: 1297192 - protein, 30 aa, Mycobacterium
AVPARDIPRFVELWRSGRLPVETLVSSTIS

SEQ ID NO: 1297193 - protein, 23 aa, Mycobacterium
AVPGPFDAYLTLRGLKTLVVRMQ

SEQ ID NO: 1297194 - protein, 20 aa, Mycobacterium
AVPGPFVPSAIAGALIAAHD

SEQ ID NO: 1297195 - protein, 23 aa, Mycobacterium
AVPPRDLAIQWDLPTELATVEGW

SEQ ID NO: 1297196 - protein, 24 aa, Mycobacterium
AVPQGLNLLRKLGRYVEYGVFGSD

SEQ ID NO: 1297197 - protein, 37 aa, Mycobacterium
AVQIMTVWVSKGLQYPVVYLPFAFNRNIQTRDCVLFH

SEQ ID NO: 1297198 - protein, 17 aa, Mycobacterium
AVRAELAAVLKITDPGG

SEQ ID NO: 1297199 - protein, 17 aa, Mycobacterium
AVRFEPGVAQRVRLVPL

SEQ ID NO: 1297200 - protein, 17 aa, Mycobacterium
AVRGLTKSAALELGPHQ

SEQ ID NO: 1297201 - protein, 19 aa, Mycobacterium
AVRIERLRHVYPDGHVALA

SEQ ID NO: 1297202 - protein, 28 aa, Mycobacterium
AVRMVAPQLMTLLFDLTIEATEEAIVNA

SEQ ID NO: 1297203 - protein, 24 aa, Mycobacterium
AVRQAARIALIERLRRLDEPLLDT

SEQ ID NO: 1297204 - protein, 25 aa, Mycobacterium
AVRRSAPFATLPRSAFEATLDLLSG

SEQ ID NO: 1297205 - protein, 30 aa, Mycobacterium
AVRSDIAVELLLRALDYLRGRLNRVVLEIM

SEQ ID NO: 1297206 - protein, 18 aa, Mycobacterium
AVRSLRPRPGAEPGTIRL

SEQ ID NO: 1297207 - protein, 21 aa, Mycobacterium
AVRVEQKLLERGCPAYVLDGD

SEQ ID NO: 1297208 - protein, 25 aa, Mycobacterium
AVSDALWPAVAFTLTTLLDDPAAAD

SEQ ID NO: 1297209 - protein, 29 aa, Mycobacterium
AVSDVNLTLFQGDLRFLIGPNGAGKTTVI

SEQ ID NO: 1297210 - protein, 27 aa, Mycobacterium
AVSEAYFAALLGLPFIAVMTSSTSASK

SEQ ID NO: 1297211 - protein, 28 aa, Mycobacterium
AVSEEILKALWALIGHDLPTPLPRITYA

SEQ ID NO: 1297212 - protein, 30 aa, Mycobacterium
AVSITPQLRGRLVLAWRASGPVSPAARVLI

SEQ ID NO: 1297213 - protein, 23 aa, Mycobacterium
AVSPLAVQMYMPNAAAAAVGLER

SEQ ID NO: 1297214 - protein, 26 aa, Mycobacterium
AVSRTTIYKWWPSAAAIVLEGLLASM

SEQ ID NO: 1297215 - protein, 31 aa, Mycobacterium
AVTDSMPALHLLPLAGVLGEVPVLATDVLRR

SEQ ID NO: 1297216 - protein, 25 aa, Mycobacterium
AVTLINPRPQFVERIRLHQLVTGSD

SEQ ID NO: 1297217 - protein, 31 aa, Mycobacterium
AVTTTLRFNFFVLKLPIRPPALVAKQAGSLA

SEQ ID NO: 1297218 - protein, 18 aa, Mycobacterium
AVTVCYMGVNGRDGSVFD

SEQ ID NO: 1297219 - protein, 24 aa, Mycobacterium
AVVDDLWLRLMDVPAALQSRTYDR

SEQ ID NO: 1297220 - protein, 25 aa, Mycobacterium
AVVISWGDPILPGAPKFDVARQTGA

SEQ ID NO: 1297221 - protein, 18 aa, Mycobacterium
AVYPLVIRAGGGSPRDTL

SEQ ID NO: 1297222 - protein, 19 aa, Mycobacterium
AVYQLRRWYQQFYVDVADV

SEQ ID NO: 1297223 - protein, 28 aa, Mycobacterium
AVYQRYMGWFDGNPGRLWAHPPEALAAR

SEQ ID NO: 1297224 - protein, 24 aa, Mycobacterium
AVYQVPCVFFVQNNQWAISVPVQR

SEQ ID NO: 1297225 - protein, 21 aa, Mycobacterium
AVYRLRLELPQVDPGELTLGR

SEQ ID NO: 1297226 - protein, 17 aa, Mycobacterium
AWARKSPQMSEVLPLLY

SEQ ID NO: 1297227 - protein, 20 aa, Mycobacterium
AWDATFLEILDEGWLSDLDG

SEQ ID NO: 1297228 - protein, 21 aa, Mycobacterium
AWFVADAVGAGSLPWVLAVTP

SEQ ID NO: 1297229 - protein, 24 aa, Mycobacterium
AWLAVRTVPHIMIRSLPGGFPSDY

SEQ ID NO: 1297230 - protein, 18 aa, Mycobacterium
AWPDTDFIQVYGLTEVCG

SEQ ID NO: 1297231 - protein, 17 aa, Mycobacterium
AWPLTELELPAGHGLLL

SEQ ID NO: 1297232 - protein, 22 aa, Mycobacterium
AWRHNEHWLAPDFLDPAADVCV

SEQ ID NO: 1297233 - protein, 17 aa, Mycobacterium
AWRICSQQQLWSVFGKK

SEQ ID NO: 1297234 - protein, 18 aa, Mycobacterium
AWRYFYHDCDEDTARWAF

SEQ ID NO: 1297235 - protein, 22 aa, Mycobacterium
AWSDVAVFPIVGPAWREYESQG

SEQ ID NO: 1297236 - protein, 20 aa, Mycobacterium
AWTRRAHWQPLADLALEPGT

SEQ ID NO: 1297237 - protein, 19 aa, Mycobacterium
AWTTDVRSGLLFVWHDHEG

SEQ ID NO: 1297238 - protein, 24 aa, Mycobacterium
AWVDGRPLIVFQASYVTAGPDRLD

SEQ ID NO: 1297239 - protein, 18 aa, Mycobacterium
AWYRNRWVRTESFEQHFP

SEQ ID NO: 1297240 - protein, 27 aa, Mycobacterium
AYALAVFVLSFHHLPPALAARAIAEGT

SEQ ID NO: 1297241 - protein, 20 aa, Mycobacterium
AYELPIILNTPTFTICAATI

SEQ ID NO: 1297242 - protein, 23 aa, Mycobacterium
AYIGAEGITLPGIYYAHTRPVFQ

SEQ ID NO: 1297243 - protein, 29 aa, Mycobacterium
AYKGMLTTVQLPLYFSDLRDARCTSAIAI

SEQ ID NO: 1297244 - protein, 19 aa, Mycobacterium
AYLAGRLAAPLKELICRGT

SEQ ID NO: 1297245 - protein, 20 aa, Mycobacterium
AYLCELKVDGLALALVYRDG

SEQ ID NO: 1297246 - protein, 30 aa, Mycobacterium
AYRRDTLGRKYPWALGRPASEVWAEIWPDI

SEQ ID NO: 1297247 - protein, 18 aa, Mycobacterium
AYSMTMYAGWRAVIAQFV

SEQ ID NO: 1297248 - protein, 18 aa, Mycobacterium
AYTLFQRTMRHDPSDVHW

SEQ ID NO: 1297249 - protein, 21 aa, Mycobacterium
AYVPDLLMRAPEVIQLYADGP

SEQ ID NO: 1297250 - protein, 33 aa, Mycobacterium
AYVPGDVTLWPNLTGLQAIDFLARLRGPDALDI

SEQ ID NO: 1297251 - protein, 21 aa, Mycobacterium
AYVVDLVLTGRLRGGHRIDRN

SEQ ID NO: 1297252 - protein, 24 aa, Mycobacterium
CAAKSGLISLVKTLGRELAPEHII

SEQ ID NO: 1297253 - protein, 24 aa, Mycobacterium
CAAQPRVPIWVGGRTRRSLRRAVE

SEQ ID NO: 1297254 - protein, 27 aa, Mycobacterium
CADAVDGMLPLPLLEVLFAADRETAER

SEQ ID NO: 1297255 - protein, 28 aa, Mycobacterium
CAELSDGTLRFLLWTAALLSPEPPSLMV

SEQ ID NO: 1297256 - protein, 24 aa, Mycobacterium
CAFGLALIAPKLPPFDVPAGHTED

SEQ ID NO: 1297257 - protein, 25 aa, Mycobacterium
CAGRYARVFVGLSEGWLADAETQPT

SEQ ID NO: 1297258 - protein, 25 aa, Mycobacterium
CALQILRTYPRRRPAHPFAPLGERS

SEQ ID NO: 1297259 - protein, 17 aa, Mycobacterium
CAPEDPAWLLFTSGSTG

SEQ ID NO: 1297260 - protein, 23 aa, Mycobacterium
CASRQLPVGNFFLGESRSPNVTK

SEQ ID NO: 1297261 - protein, 29 aa, Mycobacterium
CAWDQGKHLWMIYLMRVVDARVVLDKPGS

SEQ ID NO: 1297262 - protein, 17 aa, Mycobacterium
CAYIAAGVWHHLLITRD

SEQ ID NO: 1297263 - protein, 19 aa, Mycobacterium
CDAAAGLPGGVPPTGRFGT

SEQ ID NO: 1297264 - protein, 19 aa, Mycobacterium
CDIITITQYLRPSPRHHPV

SEQ ID NO: 1297265 - protein, 25 aa, Mycobacterium
CDITPTVYDLLGLTAPASVRGVPQK

SEQ ID NO: 1297266 - protein, 27 aa, Mycobacterium
CDNDAYCYIPLLEELDFMPSKKFADGA

SEQ ID NO: 1297267 - protein, 34 aa, Mycobacterium
CDPHVEGKPWPYAPRIILRSLIQQAADAGFEPWV

SEQ ID NO: 1297268 - protein, 20 aa, Mycobacterium
CDVTAPLLGPAGASAVFGPQ

SEQ ID NO: 1297269 - protein, 25 aa, Mycobacterium
CEPERQILFRVPWVDDSGAVQMNRG

SEQ ID NO: 1297270 - protein, 17 aa, Mycobacterium
CERIAHQAFRLARTRRR

SEQ ID NO: 1297271 - protein, 26 aa, Mycobacterium
CESSRLGVWLTTSLGFLELSLGDHRA

SEQ ID NO: 1297272 - protein, 24 aa, Mycobacterium
CEYLPGRAVVMLMLVRYVDGDLGK

SEQ ID NO: 1297273 - protein, 21 aa, Mycobacterium
CFAASDFWVSYPRVRAELLPT

SEQ ID NO: 1297274 - protein, 19 aa, Mycobacterium
CFGNQILGRALGRGTYKMV

SEQ ID NO: 1297275 - protein, 17 aa, Mycobacterium
CFGTAAGPHPFPLMVRD

SEQ ID NO: 1297276 - protein, 22 aa, Mycobacterium
CFLETDLFNQGVRPAINVGVSV

SEQ ID NO: 1297277 - protein, 25 aa, Mycobacterium
CGALRLYHDAFGLPVATLPMAVPVS

SEQ ID NO: 1297278 - protein, 25 aa, Mycobacterium
CGDVGWFQLVDKHVILLSGAEANEF

SEQ ID NO: 1297279 - protein, 18 aa, Mycobacterium
CGEVPLLPYESCNLGSVN

SEQ ID NO: 1297280 - protein, 17 aa, Mycobacterium
CGKLIAAAGWHAWRPAH

SEQ ID NO: 1297281 - protein, 25 aa, Mycobacterium
CGLEPRLAVPLLAPVLGIEPRAGYE

SEQ ID NO: 1297282 - protein, 32 aa, Mycobacterium
CGLITAYHPPTRPEVLFVWQVAVTSAARGTGL

SEQ ID NO: 1297283 - protein, 23 aa, Mycobacterium
CGMSDLNTWYRNTEPWIAAAAYP

SEQ ID NO: 1297284 - protein, 19 aa, Mycobacterium
CGNGVRVFAHYLRAADLES

SEQ ID NO: 1297285 - protein, 17 aa, Mycobacterium
CGYAPVAGAPWLTAFAQ

SEQ ID NO: 1297286 - protein, 19 aa, Mycobacterium
CHAFFQFYVADGRLSCQLY

SEQ ID NO: 1297287 - protein, 17 aa, Mycobacterium
CHGLQCGFCTPGMMITA

SEQ ID NO: 1297288 - protein, 28 aa, Mycobacterium
CHPDDLSPFAIPPFWIRSRDVIEDDPLI

SEQ ID NO: 1297289 - protein, 20 aa, Mycobacterium
CHPFYTGKQKILDSGGRVAR

SEQ ID NO: 1297290 - protein, 26 aa, Mycobacterium
CISVTGPFPGFPIPLEDFKDGDVTEL

SEQ ID NO: 1297291 - protein, 21 aa, Mycobacterium
CITVLPLQHPIVLAKALATAD

SEQ ID NO: 1297292 - protein, 23 aa, Mycobacterium
CKDIPLLLTTPHFLVEGAIIAAY

SEQ ID NO: 1297293 - protein, 19 aa, Mycobacterium
CLDHGYQLRIIEQMPLDAE

SEQ ID NO: 1297294 - protein, 19 aa, Mycobacterium
CLELLIDGGHRWLQPREQC

SEQ ID NO: 1297295 - protein, 17 aa, Mycobacterium
CLGLPGSLPVLNQQAVE

SEQ ID NO: 1297296 - protein, 38 aa, Mycobacterium
CLHDPVWYDHLPYLPFPQNWPVFAPKDKIGDWLEFYTR

SEQ ID NO: 1297297 - protein, 26 aa, Mycobacterium
CLRDMGLMLGEYWDLGALAADCAADG

SEQ ID NO: 1297298 - protein, 23 aa, Mycobacterium
CLRFRLRWRDFRLTVHARHDEVS

SEQ ID NO: 1297299 - protein, 26 aa, Mycobacterium
CLRSTFAYLGWLAGAAPDDAALRAAA

SEQ ID NO: 1297300 - protein, 28 aa, Mycobacterium
CLRVLRPGGLLLMSTPNRITFSPGRDTP

SEQ ID NO: 1297301 - protein, 23 aa, Mycobacterium
CNDEQFPTMPFAALGYDVVHCGF

SEQ ID NO: 1297302 - protein, 22 aa, Mycobacterium
CNPNKLLLDPYAKAIDGTFDWG

SEQ ID NO: 1297303 - protein, 19 aa, Mycobacterium
CPGGGGLALWVRLPTPMSS

SEQ ID NO: 1297304 - protein, 22 aa, Mycobacterium
CPLWNVYETFANPGKILVQIAQ

SEQ ID NO: 1297305 - protein, 18 aa, Mycobacterium
CPTTGELHFFGYGNLFEP

SEQ ID NO: 1297306 - protein, 22 aa, Mycobacterium
CPVAPAGRWIVDPDGAIVRAGL

SEQ ID NO: 1297307 - protein, 21 aa, Mycobacterium
CQSPRLRAVLFKAVQGVHPPD

SEQ ID NO: 1297308 - protein, 25 aa, Mycobacterium
CQTYKWETFLTSELPNWLAANRDVK

SEQ ID NO: 1297309 - protein, 18 aa, Mycobacterium
CRDDDWRPQWRVDLVPSY

SEQ ID NO: 1297310 - protein, 19 aa, Mycobacterium
CRDYAHLVIAMLRAVNVPA

SEQ ID NO: 1297311 - protein, 21 aa, Mycobacterium
CRPVSPYLALLYSQSQDIDGD

SEQ ID NO: 1297312 - protein, 20 aa, Mycobacterium
CRRRFLANGYAWVDVDVRGS

SEQ ID NO: 1297313 - protein, 23 aa, Mycobacterium
CSARLPMLTIMEMLGVPAADQPA

SEQ ID NO: 1297314 - protein, 24 aa, Mycobacterium
CSETCVGRLRYLGLVLYDVDRVLE

SEQ ID NO: 1297315 - protein, 31 aa, Mycobacterium; identical to SEQ ID NO: 798470

SEQ ID NO: 1297316 - protein, 23 aa, Mycobacterium
CSRLGFRPDVKRIPLFGLGCVAG

SEQ ID NO: 1297317 - protein, 24 aa, Mycobacterium
CSSHNSCIAFWPPAEALDEWVTMG

SEQ ID NO: 1297318 - protein, 21 aa, Mycobacterium
CSYCYVPRRKGYANPITVFAN

SEQ ID NO: 1297319 - protein, 17 aa, Mycobacterium
CTIKLLAICERLTTDDG

SEQ ID NO: 1297320 - protein, 22 aa, Mycobacterium
CTPGMMITARALLDRNPHPTEH

SEQ ID NO: 1297321 - protein, 18 aa, Mycobacterium
CVADYARRFVLAEKPFIL

SEQ ID NO: 1297322 - protein, 26 aa, Mycobacterium
CVDPGALFDLLEDPPAGVYRLKGTVA

SEQ ID NO: 1297323 - protein, 17 aa, Mycobacterium
CVGLQLLLDAPQRVSSA

SEQ ID NO: 1297324 - protein, 25 aa, Mycobacterium
CVGYGLTGVLFCDFVIASTAATFSF

SEQ ID NO: 1297325 - protein, 19 aa, Mycobacterium
CVLALGFEQMRPGALAAVW

SEQ ID NO: 1297326 - protein, 19 aa, Mycobacterium
CVSAFLLDGLVIAERQFDH

SEQ ID NO: 1297327 - protein, 18 aa, Mycobacterium
CVSAIQTWVLRSAGATIL

SEQ ID NO: 1297328 - protein, 17 aa, Mycobacterium
CVTVFARDLDTADAAMG

SEQ ID NO: 1297329 - protein, 20 aa, Mycobacterium
CVYKPVAGEAPLWDFPDGTL

SEQ ID NO: 1297330 - protein, 17 aa, Mycobacterium
CWLGGTTWQGAHVLRVS

SEQ ID NO: 1297331 - protein, 22 aa, Mycobacterium
CWRCRNPLIYRAVSSWFIKVTE

SEQ ID NO: 1297332 - protein, 17 aa, Mycobacterium
CWRLLDSVALGRLVTCA

SEQ ID NO: 1297333 - protein, 19 aa, Mycobacterium
CWYCSGLVRQFNIGAVIVG

SEQ ID NO: 1297334 - protein, 31 aa, Mycobacterium; identical to SEQ ID NO: 798608

SEQ ID NO: 1297335 - protein, 23 aa, Mycobacterium
CYGLMLRHREPRPWLVCIHGAEM

SEQ ID NO: 1297336 - protein, 18 aa, Mycobacterium
CYPTAALLALLPAVAEDL

SEQ ID NO: 1297337 - protein, 22 aa, Mycobacterium
DAAAGANVLSYGSGAQAVVDQG

SEQ ID NO: 1297338 - protein, 28 aa, Mycobacterium
DAACELIDFWRFNVAFARGILTQQPVSA

SEQ ID NO: 1297339 - protein, 26 aa, Mycobacterium
DAAIRTWLNDQRGYLPPVQLGEVIRA

SEQ ID NO: 1297340 - protein, 34 aa, Mycobacterium
DAALRRAAKFASGWWSFLTPPEKIAERLEFIKSQ

SEQ ID NO: 1297341 - protein, 23 aa, Mycobacterium
DAARAMVSLYRYGDAAADTAADQ

SEQ ID NO: 1297342 - protein, 24 aa, Mycobacterium
DAAVATLHDLGITPTAVHCDVTER

SEQ ID NO: 1297343 - protein, 22 aa, Mycobacterium
DACGLLGLDPMYVANEGKLVAF

SEQ ID NO: 1297344 - protein, 24 aa, Mycobacterium
DADASPALVLCLVDAPEPMTGRRV

SEQ ID NO: 1297345 - protein, 27 aa, Mycobacterium
DADEFLKLMLRWLNAFVPKPGQTIPGV

SEQ ID NO: 1297346 - protein, 26 aa, Mycobacterium
DADEVIDVVLLWWRDDDGDLVDALMD

SEQ ID NO: 1297347 - protein, 24 aa, Mycobacterium
DADFLGILDIRPFARGHTLVIPKR

SEQ ID NO: 1297348 - protein, 18 aa, Mycobacterium
DADRWFDAVRRSAPFATL

SEQ ID NO: 1297349 - protein, 26 aa, Mycobacterium
DADTLTELFWAALHGLVTLGRAGRLR

SEQ ID NO: 1297350 - protein, 19 aa, Mycobacterium
DAEFPKFRQLLPSEHTAVA

SEQ ID NO: 1297351 - protein, 31 aa, Mycobacterium
DAEIDLPILPQQALLYRLCGDRNPLHSDPDF

SEQ ID NO: 1297352 - protein, 24 aa, Mycobacterium
DAEPLLRRVDLTDDLPISVRRPVT

SEQ ID NO: 1297353 - protein, 23 aa, Mycobacterium
DAEPVYRNLLTLLRDRHGSAIFS

SEQ ID NO: 1297354 - protein, 23 aa, Mycobacterium
DAERRIYDALPKRGARSADEVAV

SEQ ID NO: 1297355 - protein, 34 aa, Mycobacterium
DAFMSGLIDALWTHGLLGAEKRRELRAIRLDALH

SEQ ID NO: 1297356 - protein, 26 aa, Mycobacterium
DAFQYVRDYLGFLPSNTFDDPPIVNP

SEQ ID NO: 1297357 - protein, 32 aa, Mycobacterium
DAFRTKFRKMAAEPFAFYRGSACLFYADVAAA

SEQ ID NO: 1297358 - protein, 22 aa, Mycobacterium
DAFYAALEFWSAMHGFVLLEMT

SEQ ID NO: 1297359 - protein, 24 aa, Mycobacterium
DAGDKIKMVLLGRRQRIAHGGAVD

SEQ ID NO: 1297360 - protein, 24 aa, Mycobacterium
DAGDPVFVTYLRAKGAADDAVRSR

SEQ ID NO: 1297361 - protein, 24 aa, Mycobacterium
DAGIALSILATGLAAAALASNGTP

SEQ ID NO: 1297362 - protein, 41 aa, Mycobacterium
DAGLSIDKFAPRLSFFWGIGMNFFMEVAKLRAGRLLWSELV

SEQ ID NO: 1297363 - protein, 31 aa, Mycobacterium
DAHLLDPLSATLLYQLGLTGTASLVVSVAAG

SEQ ID NO: 1297364 - protein, 21 aa, Mycobacterium
DAHNLAWKLALAVSGNAAPTL

SEQ ID NO: 1297365 - protein, 23 aa, Mycobacterium
DAHPVLEWITGTALRPVRSRLTD

SEQ ID NO: 1297366 - protein, 18 aa, Mycobacterium
DAHRWGKYLGLQAGDLYL

SEQ ID NO: 1297367 - protein, 29 aa, Mycobacterium
DAIELTVFGALRMVQAFTPALAEAKGSVV

SEQ ID NO: 1297368 - protein, 19 aa, Mycobacterium
DAIMLRMPGFGLDGPWRDN

SEQ ID NO: 1297369 - protein, 20 aa, Mycobacterium
DAIMVVLALAMRESGELASD

SEQ ID NO: 1297370 - protein, 37 aa, Mycobacterium
DAIRSKPFDYWRLHLKTMKGQWAPFQSLVDLGTDEQA

SEQ ID NO: 1297371 - protein, 34 aa, Mycobacterium
DALAAAVDALLARKPHLAARRPAGDIGQGASPSA

SEQ ID NO: 1297372 - protein, 24 aa, Mycobacterium
DALALDTLALLTERWREIAGPVTA

SEQ ID NO: 1297373 - protein, 26 aa, Mycobacterium
DALARAGFHTLRLQTYLTAGPKEARA

SEQ ID NO: 1297374 - protein, 29 aa, Mycobacterium
DALCDPPESFQLYGIVAHVLTFSAHRRGL

SEQ ID NO: 1297375 - protein, 18 aa, Mycobacterium
DALIQFDPFGFQADLMAG

SEQ ID NO: 1297376 - protein, 17 aa, Mycobacterium
DALPVRVCALRTDPWNL

SEQ ID NO: 1297377 - protein, 23 aa, Mycobacterium
DALRDRFVVLPAGFDAVLGIYVA

SEQ ID NO: 1297378 - protein, 21 aa, Mycobacterium
DALRTLILLVLSAGADIRRAL

SEQ ID NO: 1297379 - protein, 22 aa, Mycobacterium
DALRWRASTLQLARERAAQLDL

SEQ ID NO: 1297380 - protein, 21 aa, Mycobacterium
DALTRAIHKLPIKARIVTREE

SEQ ID NO: 1297381 - protein, 20 aa, Mycobacterium
DALVQRWIDAMPQYGPGHAD

SEQ ID NO: 1297382 - protein, 18 aa, Mycobacterium
DALVREGLVVRAPDENDR

SEQ ID NO: 1297383 - protein, 23 aa, Mycobacterium
DALWAATLLRRRGASATAVLLNP

SEQ ID NO: 1297384 - protein, 18 aa, Mycobacterium
DAPFALPEFGSDATFPGA

SEQ ID NO: 1297385 - protein, 17 aa, Mycobacterium
DAPILLCVHGISANLTA

SEQ ID NO: 1297386 - protein, 22 aa, Mycobacterium
DAPKRKGISYFLLDMTTPGVDV

SEQ ID NO: 1297387 - protein, 32 aa, Mycobacterium
DAPKRLGSFMDSRLWRMLLAPGRGIGKLVTGA

SEQ ID NO: 1297388 - protein, 29 aa, Mycobacterium
DAPQLLTFPDVFPNGLANKWTFGPIGELW

SEQ ID NO: 1297389 - protein, 36 aa, Mycobacterium
DAPRYAELIKRTQWWGRQMLIWGVHVHVGISSAHKV

SEQ ID NO: 1297390 - protein, 27 aa, Mycobacterium
DARALRFWEVMYPSPPPGLAGPDDTRR

SEQ ID NO: 1297391 - protein, 19 aa, Mycobacterium
DARFGWPKRNGFVQPMVDA

SEQ ID NO: 1297392 - protein, 17 aa, Mycobacterium
DARIDGVRWSDIVSRVF

SEQ ID NO: 1297393 - protein, 18 aa, Mycobacterium
DARLRRRPATPAAVPAAT

SEQ ID NO: 1297394 - protein, 28 aa, Mycobacterium
DARLSRYSYLVSLLPRRIVDDLGARIRL

SEQ ID NO: 1297395 - protein, 23 aa, Mycobacterium
DARPLARIEGWGHRTVGLGLTQK

SEQ ID NO: 1297396 - protein, 18 aa, Mycobacterium
DARPLPASAAAVEELAAL

SEQ ID NO: 1297397 - protein, 18 aa, Mycobacterium
DARPLYHAALAHAGNHVT

SEQ ID NO: 1297398 - protein, 32 aa, Mycobacterium
DARQGERLVPIPGAPPSLAALPPGCPFAPRCP

SEQ ID NO: 1297399 - protein, 33 aa, Mycobacterium
DARRPVRVRPERLGRWRFVTLTRSVDNGRDVAD

SEQ ID NO: 1297400 - protein, 21 aa, Mycobacterium
DARTALRAWADLGGPVLEDSE

SEQ ID NO: 1297401 - protein, 34 aa, Mycobacterium
DARVQPVIMGLQLALTELWRSYGVTPDAVIGHSM

SEQ ID NO: 1297402 - protein, 29 aa, Mycobacterium
DASADWVPQLWRDMDTTLAAAPLGDAGTA

SEQ ID NO: 1297403 - protein, 36 aa, Mycobacterium; identical to SEQ ID NO: 113659

SEQ ID NO: 1297404 - protein, 17 aa, Mycobacterium
DASHEPRIWPMRGAEPT

SEQ ID NO: 1297405 - protein, 21 aa, Mycobacterium
DATLRLLRRVAQAYEPPLLEA

SEQ ID NO: 1297406 - protein, 21 aa, Mycobacterium
DATMKRLLPDFFRAATDHPAG

SEQ ID NO: 1297407 - protein, 26 aa, Mycobacterium
DATPVRAILALPVFRDGRSSATLNLY

SEQ ID NO: 1297408 - protein, 29 aa, Mycobacterium
DAVAAHDLALTEWRLLTAAALVGLVEETM

SEQ ID NO: 1297409 - protein, 25 aa, Mycobacterium
DAVAEHMSPPMPLIGAGELVSTAAK

SEQ ID NO: 1297410 - protein, 17 aa, Mycobacterium
DAVALAHNSGYRTMMSH

SEQ ID NO: 1297411 - protein, 24 aa, Mycobacterium
DAVAWVARNLPTRPTVPVLAGVLL

SEQ ID NO: 1297412 - protein, 22 aa, Mycobacterium
DAVDLTGWSLGALIAMRVARDD

SEQ ID NO: 1297413 - protein, 27 aa, Mycobacterium
DAVELHLGHLYLPSSFLSPLMNRRKDE

SEQ ID NO: 1297414 - protein, 24 aa, Mycobacterium
DAVFGLPELTLGLIPGAGGTVSIT

SEQ ID NO: 1297415 - protein, 18 aa, Mycobacterium
DAVITVPAYFNDAQRQAT

SEQ ID NO: 1297416 - protein, 27 aa, Mycobacterium
DAVIVDAMFLGILPFLLGEHAARPPVL

SEQ ID NO: 1297417 - protein, 29 aa, Mycobacterium
DAVLGPAVDGGWWLLGVRTAAMADCLREV

SEQ ID NO: 1297418 - protein, 26 aa, Mycobacterium
DAVLYEGYLLYPYRATSRKNQARWQF

SEQ ID NO: 1297419 - protein, 30 aa, Mycobacterium
DAVMVRDLEYIYCPWHQWGFELATGTTAVK

SEQ ID NO: 1297420 - protein, 26 aa, Mycobacterium
DAVQADYVLALQLRRLTKLDVIELQA

SEQ ID NO: 1297421 - protein, 20 aa, Mycobacterium
DAVSLWTKLALESARARRSA

SEQ ID NO: 1297422 - protein, 20 aa, Mycobacterium
DAVVPKVRPIVEAVAERGAE

SEQ ID NO: 1297423 - protein, 30 aa, Mycobacterium
DAVWRVRGFGDFFSYCLLAEGAVDIAAEPE

SEQ ID NO: 1297424 - protein, 17 aa, Mycobacterium
DAWLSRASRRRAERWLA

SEQ ID NO: 1297425 - protein, 24 aa, Mycobacterium
DAWRPDTVWRHRLGAGLPAERVYH

SEQ ID NO: 1297426 - protein, 25 aa, Mycobacterium
DAWSETFLSALRAYPDLPADANVEA

SEQ ID NO: 1297427 - protein, 21 aa, Mycobacterium
DAYNHYAVGWAHALCAPYQWT

SEQ ID NO: 1297428 - protein, 24 aa, Mycobacterium
DAYPISMRLMLRNNLTLKSGVTLE

SEQ ID NO: 1297429 - protein, 22 aa, Mycobacterium
DAYRVDGRLVFDEPTRTAVATD

SEQ ID NO: 1297430 - protein, 19 aa, Mycobacterium
DAYTDIAFPGGIHAVWFTE

SEQ ID NO: 1297431 - protein, 19 aa, Mycobacterium
DAYTPLAWLGSSTQRMRLG

SEQ ID NO: 1297432 - protein, 17 aa, Mycobacterium
DAYVYLAESIRAWPDQA

SEQ ID NO: 1297433 - protein, 25 aa, Mycobacterium
DAYYEDGVNVWDWAAGALVAAEAGA

SEQ ID NO: 1297434 - protein, 25 aa, Mycobacterium
DCFNIPIVMLVDVPGFLPGTEQEYN

SEQ ID NO: 1297435 - protein, 17 aa, Mycobacterium
DCGFYLPLSGSLGVMFG

SEQ ID NO: 1297436 - protein, 24 aa, Mycobacterium
DCGPRFTIIASLPYDRAATSMAGF

SEQ ID NO: 1297437 - protein, 24 aa, Mycobacterium
DCPDPDRLVPFYRGLLGLEEVFAT

SEQ ID NO: 1297438 - protein, 26 aa, Mycobacterium
DCPNFDHSLAAYYLILPSEVSSNLAR

SEQ ID NO: 1297439 - protein, 19 aa, Mycobacterium
DCTDPDALAQWWAEAVGGE

SEQ ID NO: 1297440 - protein, 20 aa, Mycobacterium
DCTIALGFEKMQPGSLSGGA

SEQ ID NO: 1297441 - protein, 24 aa, Mycobacterium
DCTPHDLWPKQYPAATPRAVTTAS

SEQ ID NO: 1297442 - protein, 28 aa, Mycobacterium
DDAALARDFLLTWFVYTAWELDDAKRVS

SEQ ID NO: 1297443 - protein, 18 aa, Mycobacterium
DDAAYLCELKVDGLALAL

SEQ ID NO: 1297444 - protein, 29 aa, Mycobacterium
DDADYSLFSRLQPMLAIDGGAMFADPSAV

SEQ ID NO: 1297445 - protein, 23 aa, Mycobacterium
DDAHAWFVEQVPGNELGYRMEVK

SEQ ID NO: 1297446 - protein, 22 aa, Mycobacterium
DDAHHYLWTWTDRDAGHIRARM

SEQ ID NO: 1297447 - protein, 17 aa, Mycobacterium
DDARGFALALRPDQERP

SEQ ID NO: 1297448 - protein, 23 aa, Mycobacterium
DDDAVPGPWRLDGLPLVISADDW

SEQ ID NO: 1297449 - protein, 25 aa, Mycobacterium
DDDDLFTGFVTWTADILAARGVPAT

SEQ ID NO: 1297450 - protein, 20 aa, Mycobacterium
DDDPYPIWKRMRDEAPLYHN

SEQ ID NO: 1297451 - protein, 23 aa, Mycobacterium
DDDQFMTIAKLRAARLLWARVCE

SEQ ID NO: 1297452 - protein, 23 aa, Mycobacterium
DDDSERRIALALARMVPGAREVR

SEQ ID NO: 1297453 - protein, 28 aa, Mycobacterium
DDEMVRLWDAPTDAPAWPRLAASEPGEL

SEQ ID NO: 1297454 - protein, 24 aa, Mycobacterium
DDEQYLFQALRVGASGYLLKSISS

SEQ ID NO: 1297455 - protein, 31 aa, Mycobacterium
DDESLDYFLNLMLRAPFRLSRDVIPHMQPGS

SEQ ID NO: 1297456 - protein, 18 aa, Mycobacterium
DDFFKTCFDILPDDGRMT

SEQ ID NO: 1297457 - protein, 22 aa, Mycobacterium
DDGAVGILYRAGLDPWVIDFGS

SEQ ID NO: 1297458 - protein, 18 aa, Mycobacterium
DDGAYLPTRFAQSHWGED

SEQ ID NO: 1297459 - protein, 18 aa, Mycobacterium
DDGPLLLLGPSLGTTTAT

SEQ ID NO: 1297460 - protein, 35 aa, Mycobacterium
DDGTGTWMLSVDRTGQVRWFGLDGVEHTGGPMVDL

SEQ ID NO: 1297461 - protein, 27 aa, Mycobacterium
DDHVVHQIWMPYHWGNAGLIDGDVVND

SEQ ID NO: 1297462 - protein, 18 aa, Mycobacterium
DDILRKVLDAVPFQFSVD

SEQ ID NO: 1297463 - protein, 21 aa, Mycobacterium
DDIPGLVLIPAAASKIDIPMI

SEQ ID NO: 1297464 - protein, 22 aa, Mycobacterium
DDIQHILLTRTPAITGRYEFLT

SEQ ID NO: 1297465 - protein, 24 aa, Mycobacterium
DDIRRLSELDALREAALTARAALT

SEQ ID NO: 1297466 - protein, 20 aa, Mycobacterium
DDLDFFIVSSSVSSLFGSPG

SEQ ID NO: 1297467 - protein, 25 aa, Mycobacterium
DDLISAHLQGWTLDRLPAVDRAILR

SEQ ID NO: 1297468 - protein, 38 aa, Mycobacterium
DDLLTATLLTARCPVLFAPAMHTEMWFHPATVDNVATL

SEQ ID NO: 1297469 - protein, 24 aa, Mycobacterium
DDLNPYARIIADEAIRRGIWVEVL

SEQ ID NO: 1297470 - protein, 28 aa, Mycobacterium
DDLNWKARPYSAWLAYGQSKLANLLFTS

SEQ ID NO: 1297471 - protein, 22 aa, Mycobacterium
DDLVALRRLICERFITEPGYRF

SEQ ID NO: 1297472 - protein, 18 aa, Mycobacterium
DDMAWMRQLLDWQREAAD

SEQ ID NO: 1297473 - protein, 23 aa, Mycobacterium
DDMLWQMTHPDKTFRAVEDGATL

SEQ ID NO: 1297474 - protein, 22 aa, Mycobacterium
DDPTAVIMWMGYDAPDGFTDPR

SEQ ID NO: 1297475 - protein, 29 aa, Mycobacterium
DDPTKVAMLGLTFDDVLLLPAASDVIPAT

SEQ ID NO: 1297476 - protein, 21 aa, Mycobacterium
DDPVLHICALAYLSDLTLLGS

SEQ ID NO: 1297477 - protein, 49 aa, Mycobacterium
DDPVRIDRIRRAHLLLAMFNALQPGVFALSGWDLCGMLTLPAGQVGELL

SEQ ID NO: 1297478 - protein, 18 aa, Mycobacterium
DDPWAPDSLVWPLLEVID

SEQ ID NO: 1297479 - protein, 23 aa, Mycobacterium
DDRLRRSVVQLPTGAWFDPADPA

SEQ ID NO: 1297480 - protein, 18 aa, Mycobacterium
DDRRLQLVAAVWGAIMMA

SEQ ID NO: 1297481 - protein, 21 aa, Mycobacterium
DDRYPTYGVLATIVQIGRIPS

SEQ ID NO: 1297482 - protein, 24 aa, Mycobacterium
DDTLQLCFLCAHPSLTPASAVALT

SEQ ID NO: 1297483 - protein, 33 aa, Mycobacterium
DDTVREYLYPIAASRLRGLKLPGPLQRRNEELA

SEQ ID NO: 1297484 - protein, 27 aa, Mycobacterium
DDVAKLTVYLVDWTPEKMPAFADGLAR

SEQ ID NO: 1297485 - protein, 25 aa, Mycobacterium
DDVARAVAFLVSDDARFITGEALSV

SEQ ID NO: 1297486 - protein, 34 aa, Mycobacterium
DDVPEYRRYLGRHLPYYANWHRLKSYWATADNNY

SEQ ID NO: 1297487 - protein, 18 aa, Mycobacterium
DDVRLMSATPQRVVLASG

SEQ ID NO: 1297488 - protein, 20 aa, Mycobacterium
DDWQQYCFVPDFSGTGLIET

SEQ ID NO: 1297489 - protein, 24 aa, Mycobacterium
DDWRALFTANLETAFFMSQAVAAE

SEQ ID NO: 1297490 - protein, 23 aa, Mycobacterium
DDYRPCTGTLRTLDVPALAGVRV

SEQ ID NO: 1297491 - protein, 27 aa, Mycobacterium
DEAAELMINLFWRGLKGTPSDAAGQER

SEQ ID NO: 1297492 - protein, 23 aa, Mycobacterium
DEACLLSFPRRDLTPAEAESTRH

SEQ ID NO: 1297493 - protein, 22 aa, Mycobacterium
DEALLDIYRKLRPGEPPTKESA

SEQ ID NO: 1297494 - protein, 27 aa, Mycobacterium
DEANIAPWLRAANRYGAKIKWAEVDIE

SEQ ID NO: 1297495 - protein, 29 aa, Mycobacterium
DEAQEKFGFLLDAFTFGAPPHGGIAFGWD

SEQ ID NO: 1297496 - protein, 26 aa, Mycobacterium
DECHMAFHFPLMPRIFMAVRRESRFP

SEQ ID NO: 1297497 - protein, 24 aa, Mycobacterium
DEDTARWAFERLGPERFGDTTVTP

SEQ ID NO: 1297498 - protein, 23 aa, Mycobacterium
DEDTAYPHIAVAAARMVADGKAD

SEQ ID NO: 1297499 - protein, 25 aa, Mycobacterium
DEDVVRSYWIGGGLLHDVDAEGLLV

SEQ ID NO: 1297500 - protein, 27 aa, Mycobacterium
DEEIARVVPFIEWLRGTFPDVVISVDT

SEQ ID NO: 1297501 - protein, 22 aa, Mycobacterium
DEEIGAFLILLASAGNDTTKQT

SEQ ID NO: 1297502 - protein, 26 aa, Mycobacterium
DEELRLIDAYWRAANYLSVGQIYLLD

SEQ ID NO: 1297503 - protein, 23 aa, Mycobacterium
DEELWNESWYFDFADGAQDVGGW

SEQ ID NO: 1297504 - protein, 24 aa, Mycobacterium
DEEWRLALRRNVDSAFFVTRAALP

SEQ ID NO: 1297505 - protein, 29 aa, Mycobacterium
DEFTCSSCFLVFHRSRLARDSNGTMICAD

SEQ ID NO: 1297506 - protein, 22 aa, Mycobacterium
DEFVPLLLEQGGFQLSQPTLPR

SEQ ID NO: 1297507 - protein, 26 aa, Mycobacterium
DEGDLMAWALPCAANRFWMLSEPERA

SEQ ID NO: 1297508 - protein, 27 aa, Mycobacterium
DEHSDFISYLNLWRYLGEQRKERSGSS

SEQ ID NO: 1297509 - protein, 19 aa, Mycobacterium
DEIAALLQVEHLLDARWPE

SEQ ID NO: 1297510 - protein, 24 aa, Mycobacterium
DEIRAGVLGLLTRPEQRVVLLGGD

SEQ ID NO: 1297511 - protein, 22 aa, Mycobacterium
DEIRWALDLLRKRFAKVIWVPG

SEQ ID NO: 1297512 - protein, 17 aa, Mycobacterium
DEKGRRYLVQTSRIAYV

SEQ ID NO: 1297513 - protein, 28 aa, Mycobacterium
DEKQQDVLLFIDNIFRFTQAGSEVSTLL

SEQ ID NO: 1297514 - protein, 24 aa, Mycobacterium
DELIRLLRIAVTRLGITNVRFTGG

SEQ ID NO: 1297515 - protein, 24 aa, Mycobacterium
DELLAGLEAYPAYYAHMGVINREG

SEQ ID NO: 1297516 - protein, 18 aa, Mycobacterium
DELLVFPSTVLRGTPEDA

SEQ ID NO: 1297517 - protein, 28 aa, Mycobacterium
DELRLRTSRFETLRWRTGRRSHAQLVAM

SEQ ID NO: 1297518 - protein, 26 aa, Mycobacterium
DELRRLALLKIVHGLGLPLGTAVAVL

SEQ ID NO: 1297519 - protein, 19 aa, Mycobacterium
DELVPDRLAARYLLAEATA

SEQ ID NO: 1297520 - protein, 26 aa, Mycobacterium
DELVTLVEWGMPPAAVLRAATVVAAD

SEQ ID NO: 1297521 - protein, 25 aa, Mycobacterium
DEMPALDELAYLLGRHPDIGEVLRV

SEQ ID NO: 1297522 - protein, 26 aa, Mycobacterium
DEMPRLPTGKLYKRKLRDPYWKEVQS

SEQ ID NO: 1297523 - protein, 22 aa, Mycobacterium
DEPASILMLFAPGAPREHYFEG

SEQ ID NO: 1297524 - protein, 17 aa, Mycobacterium
DEPTLLTGVEWLDTART

SEQ ID NO: 1297525 - protein, 19 aa, Mycobacterium
DEPTWRTRWQIDHTPVAIA

SEQ ID NO: 1297526 - protein, 24 aa, Mycobacterium
DEPWAVPMLVARDGDRLLLHGSTG

SEQ ID NO: 1297527 - protein, 19 aa, Mycobacterium
DEQALFLSDAVPTGFMGAD

SEQ ID NO: 1297528 - protein, 24 aa, Mycobacterium
DEQGRILLIKRRDNTLWALPGGGH

SEQ ID NO: 1297529 - protein, 24 aa, Mycobacterium
DEQKQRWLPGMLSGSQIGAYSLSE

SEQ ID NO: 1297530 - protein, 26 aa, Mycobacterium
DEQMSALLMAIFLRGMTGPEIARWTA

SEQ ID NO: 1297531 - protein, 25 aa, Mycobacterium
DEQRKQWLDPLLNGEIRSAFAMTEP

SEQ ID NO: 1297532 - protein, 24 aa, Mycobacterium
DERERLGLPVFVKPARGGSSIGVS

SEQ ID NO: 1297533 - protein, 25 aa, Mycobacterium
DERGAVSCYWDYAPSFGRGPFRNVI

SEQ ID NO: 1297534 - protein, 19 aa, Mycobacterium
DERLLWPQYEQAYQAVLDR

SEQ ID NO: 1297535 - protein, 25 aa, Mycobacterium
DERRLGLILEVALGAGLIAAGMPEP

SEQ ID NO: 1297536 - protein, 24 aa, Mycobacterium
DERVVTWLVDKFKASSGIDLTKDK

SEQ ID NO: 1297537 - protein, 26 aa, Mycobacterium
DESERLLRGFLTPALWEAGLYCRADD

SEQ ID NO: 1297538 - protein, 28 aa, Mycobacterium
DESPIGLAFRKRTPVRVDRLTLGSAECG

SEQ ID NO: 1297539 - protein, 28 aa, Mycobacterium
DESQRPTPPCGLPFVTASAAGIAAGSDT

SEQ ID NO: 1297540 - protein, 17 aa, Mycobacterium
DETLGYLAGYRFGGDID

SEQ ID NO: 1297541 - protein, 21 aa, Mycobacterium
DEVFAGYHWYPPMAEPGAASV

SEQ ID NO: 1297542 - protein, 26 aa, Mycobacterium
DEVIFAWRSFEIYPLQVRTAGATPVQ

SEQ ID NO: 1297543 - protein, 23 aa, Mycobacterium
DEVPAGTIWVHCASGYRSSIAAS

SEQ ID NO: 1297544 - protein, 24 aa, Mycobacterium
DEVVDRILPIMNDVASVGPPIRIK

SEQ ID NO: 1297545 - protein, 23 aa, Mycobacterium
DEYLEVLYKLWEGSWEDDAVIRD

SEQ ID NO: 1297546 - protein, 18 aa, Mycobacterium
DEYMRFGDSYVKRNDGTL

SEQ ID NO: 1297547 - protein, 18 aa, Mycobacterium
DFAAIQRPDAHKLDLPTY

SEQ ID NO: 1297548 - protein, 31 aa, Mycobacterium
DFDEAYVGHFTWDLKRFAASVALMCWQKALS

SEQ ID NO: 1297549 - protein, 25 aa, Mycobacterium
DFDEWQRLYLFSRADTIYGGSNEVQ

SEQ ID NO: 1297550 - protein, 18 aa, Mycobacterium
DFEEIQIPTPPRLGNVVV

SEQ ID NO: 1297551 - protein, 21 aa, Mycobacterium
DFEILGPLPRKNIDTGMGIER

SEQ ID NO: 1297552 - protein, 23 aa, Mycobacterium
DFEPQIMPRRPGDPARIVANGDL

SEQ ID NO: 1297553 - protein, 19 aa, Mycobacterium
DFFEARNLPFLVAINEFDG

SEQ ID NO: 1297554 - protein, 20 aa, Mycobacterium
DFFEGVMMPELFLADAVGAT

SEQ ID NO: 1297555 - protein, 18 aa, Mycobacterium
DFGAWEGLTFGEASQRDP

SEQ ID NO: 1297556 - protein, 21 aa, Mycobacterium
DFGCVWINTHIPLVAEMPHGG

SEQ ID NO: 1297557 - protein, 27 aa, Mycobacterium
DFGRVDVHMLQFSGAIWYPMVYDMPAR

SEQ ID NO: 1297558 - protein, 32 aa, Mycobacterium
DFIVEYIGQTRGWFYTLHVLATALFDRPAFKT

SEQ ID NO: 1297559 - protein, 30 aa, Mycobacterium
DFPNQINNVLAFPGVFRGALDAGARRITER

SEQ ID NO: 1297560 - protein, 20 aa, Mycobacterium
DFRAQVFDLIDIAFAQRRKT

SEQ ID NO: 1297561 - protein, 28 aa, Mycobacterium
DFRGAKNVLLVFFPLAFTGICQGELDEI

SEQ ID NO: 1297562 - protein, 24 aa, Mycobacterium
DFRHTFDWCVTSAFIMSQLTARHM

SEQ ID NO: 1297563 - protein, 18 aa, Mycobacterium
DFRLFWDNAYAVHTLTPD

SEQ ID NO: 1297564 - protein, 19 aa, Mycobacterium
DFRVPELVSDQTRMLRLPL

SEQ ID NO: 1297565 - protein, 21 aa, Mycobacterium
DFTALYYEDTLPPRSVFDHLL

SEQ ID NO: 1297566 - protein, 20 aa, Mycobacterium
DFTAVVSLDLRRLDRLHWLD

SEQ ID NO: 1297567 - protein, 28 aa, Mycobacterium
DFTDEVRILRLHLLHLLQTVSPNSADLD

SEQ ID NO: 1297568 - protein, 19 aa, Mycobacterium
DFTGDTPILLGPDGPSLGG

SEQ ID NO: 1297569 - protein, 22 aa, Mycobacterium
DFTGRDPTLPRDAYVLRVASTV

SEQ ID NO: 1297570 - protein, 27 aa, Mycobacterium
DFVPPDDEFWLTLAPTNRLVTARNRQH

SEQ ID NO: 1297571 - protein, 17 aa, Mycobacterium
DFYTSVFGATLVERMDG

SEQ ID NO: 1297572 - protein, 26 aa, Mycobacterium
DGAAAVAPVLPLRFGAVMTDAESVAE

SEQ ID NO: 1297573 - protein, 23 aa, Mycobacterium
DGADIVVIRILGGYRAWQDGIDT

SEQ ID NO: 1297574 - protein, 22 aa, Mycobacterium
DGAGILLQLPVELFTEVVDFDL

SEQ ID NO: 1297575 - protein, 27 aa, Mycobacterium
DGAIPASHRLAAGGLLGLGALSALGAP

SEQ ID NO: 1297576 - protein, 18 aa, Mycobacterium
DGALYLRMDEFPARLVIV

SEQ ID NO: 1297577 - protein, 29 aa, Mycobacterium
DGAMLYPQIAARPFGMLLGFPGHHAFTHR

SEQ ID NO: 1297578 - protein, 21 aa, Mycobacterium
DGAMWVTLVHDGAIARVGADG

SEQ ID NO: 1297579 - protein, 26 aa, Mycobacterium
DGAPQVYVLPEEPLLVAPSVAELRDA

SEQ ID NO: 1297580 - protein, 22 aa, Mycobacterium
DGARALLRRAVGRLTTAPAGPY

SEQ ID NO: 1297581 - protein, 23 aa, Mycobacterium
DGARMVALHLLRSRASADLERQV

SEQ ID NO: 1297582 - protein, 27 aa, Mycobacterium
DGASMWFRSYFALPSSITAPDGRPVNA

SEQ ID NO: 1297583 - protein, 21 aa, Mycobacterium
DGAVLPILHLNSYKIANPTVL

SEQ ID NO: 1297584 - protein, 17 aa, Mycobacterium
DGAWPYLRALAAAAGDT

SEQ ID NO: 1297585 - protein, 26 aa, Mycobacterium
DGDFGTVLNRFLLQAAIGYPLTVHGT

SEQ ID NO: 1297586 - protein, 21 aa, Mycobacterium
DGDGRWDVRLSDGDGDGRADA

SEQ ID NO: 1297587 - protein, 22 aa, Mycobacterium
DGDLFTFGKVMSGGLPAAAFGG

SEQ ID NO: 1297588 - protein, 24 aa, Mycobacterium
DGDPLDALVLLPESVFPGCIVDAR

SEQ ID NO: 1297589 - protein, 20 aa, Mycobacterium
DGDQIAVFRLRDGSLRAVDA

SEQ ID NO: 1297590 - protein, 30 aa, Mycobacterium
DGDQLLSGPWNLGALYLLPELRDARLEPFW

SEQ ID NO: 1297591 - protein, 22 aa, Mycobacterium
DGDWRVVLRAYAHAYRDGIVQV

SEQ ID NO: 1297592 - protein, 32 aa, Mycobacterium; identical to SEQ ID NO: 1238501

SEQ ID NO: 1297593 - protein, 20 aa, Mycobacterium
DGERLTLRPTQLILATGMSG

SEQ ID NO: 1297594 - protein, 21 aa, Mycobacterium
DGFRIPELLESTGARIREVGT

SEQ ID NO: 1297595 - protein, 27 aa, Mycobacterium
DGFYSQFAPGLPQWNLRGSFTTGPDGA

SEQ ID NO: 1297596 - protein, 24 aa, Mycobacterium
DGGRLSKLLRIFANPKMPSIDDYY

SEQ ID NO: 1297597 - protein, 18 aa, Mycobacterium
DGHARLILRRETVDDLLS

SEQ ID NO: 1297598 - protein, 19 aa, Mycobacterium
DGHRLWVNANFNPARDPDT

SEQ ID NO: 1297599 - protein, 31 aa, Mycobacterium
DGHWDTTLMRRIGLRPSLFRELVEPGSVLGP

SEQ ID NO: 1297600 - protein, 24 aa, Mycobacterium
DGICQRLHTASLRTVVIGADPRLT

SEQ ID NO: 1297601 - protein, 18 aa, Mycobacterium
DGIINAGALIAFEKGRSW

SEQ ID NO: 1297602 - protein, 24 aa, Mycobacterium
DGKKLVFVSILRAGTGILDGMLAV

SEQ ID NO: 1297603 - protein, 17 aa, Mycobacterium
DGLAGGRWALAVKMSPV

SEQ ID NO: 1297604 - protein, 18 aa, Mycobacterium
DGLARLEQFVRDLRGGVV

SEQ ID NO: 1297605 - protein, 25 aa, Mycobacterium
DGLRKLFRQFSFPGGIPSHVASETP

SEQ ID NO: 1297606 - protein, 24 aa, Mycobacterium
DGLSDMFYSIWWPKVDGETSDVPP

SEQ ID NO: 1297607 - protein, 22 aa, Mycobacterium
DGLSLFDYWRDDYKTLHGMTSR

SEQ ID NO: 1297608 - protein, 21 aa, Mycobacterium
DGLSRFSPLTREWFAGTFVEP

SEQ ID NO: 1297609 - protein, 19 aa, Mycobacterium
DGMDLVVLGLGGRSVPAGR

SEQ ID NO: 1297610 - protein, 22 aa, Mycobacterium
DGMELTGWLYRPPAPVEPVGAM

SEQ ID NO: 1297611 - protein, 17 aa, Mycobacterium
DGMPHRVLRTGLVEKLE

SEQ ID NO: 1297612 - protein, 23 aa, Mycobacterium
DGNEIIVTFRPAPNHLGTEVTLK

SEQ ID NO: 1297613 - protein, 35 aa, Mycobacterium
DGNIALVYQYRHPLGRRLWELPAGLLDMGGEPPQV

SEQ ID NO: 1297614 - protein, 25 aa, Mycobacterium
DGNTLVLQAVRYPELWRGTGGFEAE

SEQ ID NO: 1297615 - protein, 24 aa, Mycobacterium
DGPAPAWVYIDHRIEPGPPRPGYL

SEQ ID NO: 1297616 - protein, 23 aa, Mycobacterium
DGPRDIAWTYRDPLHDGEPVRDH

SEQ ID NO: 1297617 - protein, 28 aa, Mycobacterium
DGQDFVIDLTVWLDLAPAAASDDLADTV

SEQ ID NO: 1297618 - protein, 19 aa, Mycobacterium
DGQLPNMRAIVGFAAETGD

SEQ ID NO: 1297619 - protein, 26 aa, Mycobacterium
DGQPVSAATWYLLRDDDRVLVNMDVA

SEQ ID NO: 1297620 - protein, 17 aa, Mycobacterium
DGQRYEPMFAAADLGAD

SEQ ID NO: 1297621 - protein, 24 aa, Mycobacterium
DGQVIVLTCSPQRYASVPDAHHIE

SEQ ID NO: 1297622 - protein, 18 aa, Mycobacterium
DGRILLPVLGSNGDVADL

SEQ ID NO: 1297623 - protein, 23 aa, Mycobacterium
DGRKFLAYYERDGVVAGVVGGGM

SEQ ID NO: 1297624 - protein, 20 aa, Mycobacterium
DGRRHIVPVPLPAADVGPQA

SEQ ID NO: 1297625 - protein, 23 aa, Mycobacterium
DGRVRPIIGAEFPVQEAQAAQEM

SEQ ID NO: 1297626 - protein, 20 aa, Mycobacterium
DGSDWILNGSKMWITNGSVA

SEQ ID NO: 1297627 - protein, 26 aa, Mycobacterium
DGSFGWIGIANFPSSFAAACYLPDEG

SEQ ID NO: 1297628 - protein, 29 aa, Mycobacterium
DGSGEGFVRRLWWRVTVDLPDDALLHTLI

SEQ ID NO: 1297629 - protein, 24 aa, Mycobacterium
DGSGPYVTPLVRKLAAEHDVDLAA

SEQ ID NO: 1297630 - protein, 22 aa, Mycobacterium
DGSPPYVVRWLDSDHLATVFPG

SEQ ID NO: 1297631 - protein, 24 aa, Mycobacterium
DGSTPATWAGLLDAATSAASTIFD

SEQ ID NO: 1297632 - protein, 18 aa, Mycobacterium
DGSTPWLITGHAAARELF

SEQ ID NO: 1297633 - protein, 20 aa, Mycobacterium
DGTFDWGQPLFSYNFGDPDS

SEQ ID NO: 1297634 - protein, 25 aa, Mycobacterium
DGTGPHRFLYYPSENHWVLAPQHAK

SEQ ID NO: 1297635 - protein, 25 aa, Mycobacterium
DGTIKIEMNFLPDVYVPCEVCHGAR

SEQ ID NO: 1297636 - protein, 28 aa, Mycobacterium
DGTKAGFDLPMLRAVRGAVTVPVIASGG

SEQ ID NO: 1297637 - protein, 25 aa, Mycobacterium
DGTLSPGFHGLHIHEFGRCEPNSPA

SEQ ID NO: 1297638 - protein, 29 aa, Mycobacterium
DGTPYKVFSPFFDAWRRHGWRAPAQSGPD

SEQ ID NO: 1297639 - protein, 23 aa, Mycobacterium
DGVAAARRRAAVVKPAVVVMDMR

SEQ ID NO: 1297640 - protein, 20 aa, Mycobacterium
DGVAHYLTSVGLGCHTKRDR

SEQ ID NO: 1297641 - protein, 22 aa, Mycobacterium
DGVDLGAWFFAAADRGPAVLVC

SEQ ID NO: 1297642 - protein, 24 aa, Mycobacterium
DGVLLRDVWAADGPVSYLGLQVAG

SEQ ID NO: 1297643 - protein, 24 aa, Mycobacterium
DGVNLTYAGLIPTIQKSFLSKDVD

SEQ ID NO: 1297644 - protein, 20 aa, Mycobacterium
DGVPVWISGPQFDTWKHTQL

SEQ ID NO: 1297645 - protein, 21 aa, Mycobacterium
DGVRWSDIVSRVFGRIDPLAT

SEQ ID NO: 1297646 - protein, 30 aa, Mycobacterium
DGVSLSLDNWWSYLREVQSTYPLSYGPQSD

SEQ ID NO: 1297647 - protein, 18 aa, Mycobacterium
DGVTMHVDPGFPASVGAN

SEQ ID NO: 1297648 - protein, 20 aa, Mycobacterium
DGWKLAALRLTRLIMEFENA

SEQ ID NO: 1297649 - protein, 22 aa, Mycobacterium
DGYGLHVIERVPLPVRANAENI

SEQ ID NO: 1297650 - protein, 26 aa, Mycobacterium
DHCLGVVFYPVIPLGSWVATTEFKLN

SEQ ID NO: 1297651 - protein, 26 aa, Mycobacterium
DHIDDDVLRLIFIAAHPVLSRENQIA

SEQ ID NO: 1297652 - protein, 20 aa, Mycobacterium
DHISGGRLILGLGAGWYEKD

SEQ ID NO: 1297653 - protein, 20 aa, Mycobacterium
DHLAALRLQPGYERVLEEGR

SEQ ID NO: 1297654 - protein, 17 aa, Mycobacterium
DHLFGTIWSRPGLSMRE

SEQ ID NO: 1297655 - protein, 20 aa, Mycobacterium
DHLHAVVGEWQLLADLSFAD

SEQ ID NO: 1297656 - protein, 27 aa, Mycobacterium
DHLIDAARPFIFDTGLAPAAVGAAWAA

SEQ ID NO: 1297657 - protein, 23 aa, Mycobacterium
DHNWGRFRWGGDFGWTWGTLLPR

SEQ ID NO: 1297658 - protein, 23 aa, Mycobacterium
DHSGPLVTELLGEAGFVVDGVVV

SEQ ID NO: 1297659 - protein, 17 aa, Mycobacterium
DHSVWFHRPFDPHRWHR

SEQ ID NO: 1297660 - protein, 29 aa, Mycobacterium
DHSWGVRDWWAMDWVWNALHLDDGTHLHG

SEQ ID NO: 1297661 - protein, 25 aa, Mycobacterium
DHVLRLGLHRLPITEFPRLRELAPV

SEQ ID NO: 1297662 - protein, 20 aa, Mycobacterium
DHVMYVWVDALTNYLTGVGY

SEQ ID NO: 1297663 - protein, 24 aa, Mycobacterium
DHWNGTLVALFQPAEESADGARAM

SEQ ID NO: 1297664 - protein, 22 aa, Mycobacterium
DHYFASWFERYARSFSGTIAGG

SEQ ID NO: 1297665 - protein, 26 aa, Mycobacterium
DHYHDWDMLRANLLQLLVDGTVRPHE

SEQ ID NO: 1297666 - protein, 25 aa, Mycobacterium
DIADAVAWLASDESRFVTAAAIAVD

SEQ ID NO: 1297667 - protein, 23 aa, Mycobacterium
DIAIGGRLPINPGGGLIGGGHPV

SEQ ID NO: 1297668 - protein, 35 aa, Mycobacterium
DIAMVFQNYALYPHLSVRENIAFPLRAKKIARTEA

SEQ ID NO: 1297669 - protein, 19 aa, Mycobacterium
DIAMVFQNYALYPNKTVAE

SEQ ID NO: 1297670 - protein, 25 aa, Mycobacterium
DIANGEFFVILGPSGAGKTTTLKSI

SEQ ID NO: 1297671 - protein, 24 aa, Mycobacterium
DIAQADAYYFAPQKNFAGDGGLWL

SEQ ID NO: 1297672 - protein, 18 aa, Mycobacterium
DIARRLERDGDCPAALFV

SEQ ID NO: 1297673 - protein, 17 aa, Mycobacterium
DIATLLPHYAGTLVAAE

SEQ ID NO: 1297674 - protein, 24 aa, Mycobacterium
DICAHIAAVPLDRSKPLWEMWVIE

SEQ ID NO: 1297675 - protein, 19 aa, Mycobacterium
DICIYARESHVLVARSPSE

SEQ ID NO: 1297676 - protein, 28 aa, Mycobacterium
DIDEIQAQAILDMQLRRLAALERQRIVD

SEQ ID NO: 1297677 - protein, 19 aa, Mycobacterium
DIDGVLVTSWRPIDGAAEA

SEQ ID NO: 1297678 - protein, 22 aa, Mycobacterium
DIDLSTYLRPSRYAEADKFFGF

SEQ ID NO: 1297679 - protein, 26 aa, Mycobacterium
DIDVVLDTLYGPIYHRILVPYRDADL

SEQ ID NO: 1297680 - protein, 24 aa, Mycobacterium
DIEDLKAPLLAAVGAADLALATVN

SEQ ID NO: 1297681 - protein, 17 aa, Mycobacterium
DIELAEAIPRRRADRRP

SEQ ID NO: 1297682 - protein, 19 aa, Mycobacterium
DIESTWKGLLAGESGIRVL

SEQ ID NO: 1297683 - protein, 18 aa, Mycobacterium
DIFLITGIGYYPNLGVKD

SEQ ID NO: 1297684 - protein, 30 aa, Mycobacterium
DIGPDLNLALLWASAFPYGPTFADRITRGD

SEQ ID NO: 1297685 - protein, 24 aa, Mycobacterium
DIGYRAALITLARGRVHIAALAVG

SEQ ID NO: 1297686 - protein, 18 aa, Mycobacterium
DIHRNLLSRAFTPRKINA

SEQ ID NO: 1297687 - protein, 26 aa, Mycobacterium
DIKKWTEWSLRFFYGSPAYSQIYTEL

SEQ ID NO: 1297688 - protein, 31 aa, Mycobacterium
DILHEDDLQLLWLPLAHAFGKVLISAQLACG

SEQ ID NO: 1297689 - protein, 18 aa, Mycobacterium
DINFLTLNAYFTSIGGGT

SEQ ID NO: 1297690 - protein, 24 aa, Mycobacterium
DINLKSVFFCCKAALRHMVPAQKG

SEQ ID NO: 1297691 - protein, 25 aa, Mycobacterium
DIPVAADGGLRWLPARSRPGDAVTF

SEQ ID NO: 1297692 - protein, 18 aa, Mycobacterium
DIQRLIASYGPYVDAADA

SEQ ID NO: 1297693 - protein, 22 aa, Mycobacterium
DIRESIHLRALGRQNPLDEFHR

SEQ ID NO: 1297694 - protein, 22 aa, Mycobacterium
DITRWQHLIAATGAVQWIEQLI

SEQ ID NO: 1297695 - protein, 18 aa, Mycobacterium
DIVFAAEYLTLGLGDVYL

SEQ ID NO: 1297696 - protein, 24 aa, Mycobacterium
DKAGSPMNLLRWTSARSIKENFVP

SEQ ID NO: 1297697 - protein, 22 aa, Mycobacterium
DKALRFYTDILGFTPKHDIPMG

SEQ ID NO: 1297698 - protein, 19 aa, Mycobacterium
DKCIIFWGVATDRDFRGGT

SEQ ID NO: 1297699 - protein, 28 aa, Mycobacterium
DKGDLRGRFRWWGLYTQRKPGFDGTWTG

SEQ ID NO: 1297700 - protein, 24 aa, Mycobacterium
DKGPWAAFDLSLGRAMYSGFTMGG

SEQ ID NO: 1297701 - protein, 25 aa, Mycobacterium
DKLLRTSMELGGNAPFIVFDDADVD

SEQ ID NO: 1297702 - protein, 32 aa, Mycobacterium
DKPTLMLLDGNSLAYRAFYALPAENFKTQGGL

SEQ ID NO: 1297703 - protein, 24 aa, Mycobacterium
DKSRPLWEMYLVEGLAKNRVAIYT

SEQ ID NO: 1297704 - protein, 18 aa, Mycobacterium
DKVVLWYSSANRDEDVFD

SEQ ID NO: 1297705 - protein, 27 aa, Mycobacterium
DLAAHPVIRSRYPVLSRAMLSAASGQL

SEQ ID NO: 1297706 - protein, 17 aa, Mycobacterium
DLAARLGWYDQAHFTND

SEQ ID NO: 1297707 - protein, 22 aa, Mycobacterium
DLAIDWPAPEKVPPLWKTFEHR

SEQ ID NO: 1297708 - protein, 20 aa, Mycobacterium
DLALQISNLPRHMGIHSGGM

SEQ ID NO: 1297709 - protein, 30 aa, Mycobacterium
DLAMRAAAWAMASPRRFALAEKALAAGRFA

SEQ ID NO: 1297710 - protein, 19 aa, Mycobacterium
DLARALPRIKSRLAKLNPA

SEQ ID NO: 1297711 - protein, 17 aa, Mycobacterium
DLARHLPRDAAVVHLDA

SEQ ID NO: 1297712 - protein, 22 aa, Mycobacterium
DLARMRALAKEAVEAGALGFAS

SEQ ID NO: 1297713 - protein, 19 aa, Mycobacterium
DLAYFLDKRQRGFDLCIYM

SEQ ID NO: 1297714 - protein, 18 aa, Mycobacterium
DLDAFRRVLRDGEAGRLV

SEQ ID NO: 1297715 - protein, 23 aa, Mycobacterium
DLDAYLVADKLFHQTLLEASGNE

SEQ ID NO: 1297716 - protein, 17 aa, Mycobacterium
DLDGLMELLAPDVVWTA

SEQ ID NO: 1297717 - protein, 29 aa, Mycobacterium
DLDHDAKLFRRTEVPPILLTSARTAATAR

SEQ ID NO: 1297718 - protein, 25 aa, Mycobacterium
DLDKPKLVFFFDEAHLLFADASKAF

SEQ ID NO: 1297719 - protein, 30 aa, Mycobacterium
DLDLTVVNPLVDATWRFMTLDGDGKIRMDC

SEQ ID NO: 1297720 - protein, 25 aa, Mycobacterium
DLDSMDWLNFLVGVHKQFDVEIPES

SEQ ID NO: 1297721 - protein, 23 aa, Mycobacterium
DLDSTLPMLAFSGVMNSGQACVA

SEQ ID NO: 1297722 - protein, 18 aa, Mycobacterium
DLDVLTHGLTLWDLDREF

SEQ ID NO: 1297723 - protein, 21 aa, Mycobacterium
DLELRIPKLRSGSFFPALLER

SEQ ID NO: 1297724 - protein, 28 aa, Mycobacterium
DLEQPIIDAVGLALPFVPLCTPDCAGLC

SEQ ID NO: 1297725 - protein, 37 aa, Mycobacterium
DLERGPAIRFLLIELPGPAWRLVIVAHHIVIDGWSLP

SEQ ID NO: 1297726 - protein, 19 aa, Mycobacterium
DLERVVRLDRLGFDEAWFG

SEQ ID NO: 1297727 - protein, 26 aa, Mycobacterium
DLEYHLTTLFPPVRPRRWLEIRYLDA

SEQ ID NO: 1297728 - protein, 25 aa, Mycobacterium
DLFDRWKALGARFVAARPLTQLHWT

SEQ ID NO: 1297729 - protein, 17 aa, Mycobacterium
DLFVVFARTRPADDRGA

SEQ ID NO: 1297730 - protein, 24 aa, Mycobacterium
DLGLPLIAVGLYYRSGYFRQSLTA

SEQ ID NO: 1297731 - protein, 24 aa, Mycobacterium
DLGPGDILTRLTAPVIRGLGVGIV

SEQ ID NO: 1297732 - protein, 23 aa, Mycobacterium
DLGRLLESVFLDLVPVQLDAGTE

SEQ ID NO: 1297733 - protein, 18 aa, Mycobacterium
DLHWADRDSLLLLSELLT

SEQ ID NO: 1297734 - protein, 18 aa, Mycobacterium
DLKTDRRIARFLRTSVSG

SEQ ID NO: 1297735 - protein, 17 aa, Mycobacterium
DLLAACRATLRGEPFLY

SEQ ID NO: 1297736 - protein, 17 aa, Mycobacterium
DLLAEWKAAGRAAKDVD

SEQ ID NO: 1297737 - protein, 17 aa, Mycobacterium
DLLALFAHALRLSHNPF

SEQ ID NO: 1297738 - protein, 32 aa, Mycobacterium
DLLDPDPMFVPKLLGPLLLTPGVHLVKGFYRR

SEQ ID NO: 1297739 - protein, 28 aa, Mycobacterium
DLLERLSPLLRAPALTAPLLLVHGGNDT

SEQ ID NO: 1297740 - protein, 20 aa, Mycobacterium
DLLGEYRRTGVWRRIGLMDC

SEQ ID NO: 1297741 - protein, 19 aa, Mycobacterium
DLLITRWVTTFTDQVPLQI

SEQ ID NO: 1297742 - protein, 27 aa, Mycobacterium
DLLKAHTALLSLRQFVQLNPIYATPYI

SEQ ID NO: 1297743 - protein, 24 aa, Mycobacterium
DLLPEAFAVAREAAWRVLSQRHFD

SEQ ID NO: 1297744 - protein, 19 aa, Mycobacterium
DLLRLIQVRTLAQAGVPLS

SEQ ID NO: 1297745 - protein, 19 aa, Mycobacterium
DLLTPFMWRMDCFGRPHLE

SEQ ID NO: 1297746 - protein, 25 aa, Mycobacterium
DLLWGPAMRNYPDLKFAFSEGGIGW

SEQ ID NO: 1297747 - protein, 26 aa, Mycobacterium
DLLWSAPIKEFPTLKIALSEGGTGWI

SEQ ID NO: 1297748 - protein, 17 aa, Mycobacterium
DLLYRPQAVLRSGGRIS

SEQ ID NO: 1297749 - protein, 23 aa, Mycobacterium
DLMIPMIGLLKRKAERRLTETAL

SEQ ID NO: 1297750 - protein, 27 aa, Mycobacterium
DLMRQGLNRLPFSLLGGVRNALGGAAS

SEQ ID NO: 1297751 - protein, 17 aa, Mycobacterium
DLPAAMWSTPTPAPGWT

SEQ ID NO: 1297752 - protein, 20 aa, Mycobacterium
DLPALVRTLTATTALTLSHD

SEQ ID NO: 1297753 - protein, 18 aa, Mycobacterium
DLPVIDAIATRLGAQTDG

SEQ ID NO: 1297754 - protein, 19 aa, Mycobacterium
DLPYTTGPLSRQYLQTFRT

SEQ ID NO: 1297755 - protein, 23 aa, Mycobacterium
DLQARVDMLRYALAGIAAGGRLD

SEQ ID NO: 1297756 - protein, 20 aa, Mycobacterium
DLQLWVAACLYKGAVDVYRL

SEQ ID NO: 1297757 - protein, 24 aa, Mycobacterium
DLQMWIEVPAPQEYLRWQSERSER

SEQ ID NO: 1297758 - protein, 20 aa, Mycobacterium
DLQREAIQLAYYEGLTYVQV

SEQ ID NO: 1297759 - protein, 34 aa, Mycobacterium
DLRCAQLPPELLDDVHLLRFPPGAHVHVAIDDDG

SEQ ID NO: 1297760 - protein, 20 aa, Mycobacterium
DLRCLMLTSFTSDEAMLDAI

SEQ ID NO: 1297761 - protein, 18 aa, Mycobacterium
DLRLLKSRARDPRSRLYG

SEQ ID NO: 1297762 - protein, 24 aa, Mycobacterium
DLSGTDFVYLWVDGIHLKVRLEQE

SEQ ID NO: 1297763 - protein, 18 aa, Mycobacterium
DLSRLAEDIILWSTTEFG

SEQ ID NO: 1297764 - protein, 24 aa, Mycobacterium
DLTFASLPYRIMHEFQTPIYDAIR

SEQ ID NO: 1297765 - protein, 27 aa, Mycobacterium
DLTGWLDDMFLPPDVLDWPLNVVVVRS

SEQ ID NO: 1297766 - protein, 19 aa, Mycobacterium
DLTQETFIRVFRSVQNYQP

SEQ ID NO: 1297767 - protein, 28 aa, Mycobacterium
DLTTLRIVPWHNDTALLLCDWELPADHR

SEQ ID NO: 1297768 - protein, 29 aa, Mycobacterium
DLVAGFALPIPSLVICELLGVPYADREDF

SEQ ID NO: 1297769 - protein, 30 aa, Mycobacterium
DLVARLQVLIDLGLGYLTLNRRTPTVSPGE

SEQ ID NO: 1297770 - protein, 18 aa, Mycobacterium
DLVGRFLLKGGETVWVDG

SEQ ID NO: 1297771 - protein, 18 aa, Mycobacterium
DLVLDAIEHAFFTRTQDG

SEQ ID NO: 1297772 - protein, 17 aa, Mycobacterium
DLVLRLATPQGGATILI

SEQ ID NO: 1297773 - protein, 23 aa, Mycobacterium
DLVQETYLRAWKSYKGFQGKSSV

SEQ ID NO: 1297774 - protein, 21 aa, Mycobacterium
DLVRYAGGWMFDRALAGWRVN

SEQ ID NO: 1297775 - protein, 25 aa, Mycobacterium
DLWARVLRRQPLPLSLLATHPIDVS

SEQ ID NO: 1297776 - protein, 35 aa, Mycobacterium
DLYTPPFRFFANADAVFFMFDPLRIKGIRDQLHDL

SEQ ID NO: 1297777 - protein, 22 aa, Mycobacterium
DMAALAMMITLFSAGGESTASL

SEQ ID NO: 1297778 - protein, 20 aa, Mycobacterium
DMALIPMRTIPNAELHVFPN

SEQ ID NO: 1297779 - protein, 37 aa, Mycobacterium
DMASTAPATPWLATTVRLAWRVKLMVSAAVAARVRLR

SEQ ID NO: 1297780 - protein, 23 aa, Mycobacterium
DMDPVLATLFNPLGAGIQWGATL

SEQ ID NO: 1297781 - protein, 17 aa, Mycobacterium
DMEAALGGLLDADGYRG

SEQ ID NO: 1297782 - protein, 17 aa, Mycobacterium
DMESWVCPAPLRDSPNV

SEQ ID NO: 1297783 - protein, 22 aa, Mycobacterium
DMFRSLQALAQLPGDPTVFPGH

SEQ ID NO: 1297784 - protein, 18 aa, Mycobacterium
DMGITGWVTLTIAQAGTD

SEQ ID NO: 1297785 - protein, 29 aa, Mycobacterium
DMLIGHAAELEKFQWFVRAHLENAGGDLK

SEQ ID NO: 1297786 - protein, 19 aa, Mycobacterium
DMLTGRENLVLFGRLQGLA

SEQ ID NO: 1297787 - protein, 21 aa, Mycobacterium
DMPNDVPMLRWAGHGVAMGNA

SEQ ID NO: 1297788 - protein, 23 aa, Mycobacterium
DMPRGGHFAAFEQPELFADDVTA

SEQ ID NO: 1297789 - protein, 24 aa, Mycobacterium
DMVDGKVFGYFLLGQNPAVGSAHG

SEQ ID NO: 1297790 - protein, 33 aa, Mycobacterium
DMVMTPDFDTLRLLPWLPGTALVMADLSWTDGR

SEQ ID NO: 1297791 - protein, 18 aa, Mycobacterium
DMVRPGIAVYGQTPIPAL

SEQ ID NO: 1297792 - protein, 18 aa, Mycobacterium
DNAAFFFDTLAGRDEPLG

SEQ ID NO: 1297793 - protein, 25 aa, Mycobacterium
DNAFDEGWVVPLPPDRLTGKKVAVV

SEQ ID NO: 1297794 - protein, 32 aa, Mycobacterium
DNANLDKARRLLWPIKQKYGNKISWADLIAYA

SEQ ID NO: 1297795 - protein, 18 aa, Mycobacterium
DNDPDLPTLIVDPYFRDA

SEQ ID NO: 1297796 - protein, 24 aa, Mycobacterium
DNDRKPCGYGRMLRKEDPRFVRGR

SEQ ID NO: 1297797 - protein, 29 aa, Mycobacterium
DNEALLEAHGWDLGFWTVLDEGPVEDCVA

SEQ ID NO: 1297798 - protein, 23 aa, Mycobacterium
DNFLATDVYLGATSIILPRPEPE

SEQ ID NO: 1297799 - protein, 26 aa, Mycobacterium
DNGFTLVIPPVLVRPEVMAGTGFLGA

SEQ ID NO: 1297800 - protein, 26 aa, Mycobacterium
DNGHTTFLELAPNPVALMQVGLTTMS

SEQ ID NO: 1297801 - protein, 24 aa, Mycobacterium
DNKIRYIAVYLQMQLPDPATLPDF

SEQ ID NO: 1297802 - protein, 24 aa, Mycobacterium
DNLQRLWTPHRMSYIAESPMKKGS

SEQ ID NO: 1297803 - protein, 25 aa, Mycobacterium
DNLRQLGLDPILLEAGLLAESLEIA

SEQ ID NO: 1297804 - protein, 27 aa, Mycobacterium
DNPTYRLITIILMRCGLRITDALRLRG

SEQ ID NO: 1297805 - protein, 26 aa, Mycobacterium
DNRGSQFYLAMYWAQELAGQTEDKEL

SEQ ID NO: 1297806 - protein, 24 aa, Mycobacterium
DNRVSLLLPRLPVDKADPLHQLQA

SEQ ID NO: 1297807 - protein, 23 aa, Mycobacterium
DNSPEALVVLWAALRSGLYITAI

SEQ ID NO: 1297808 - protein, 23 aa, Mycobacterium
DNSPLICRPLTFMRAAPSEHGYA

SEQ ID NO: 1297809 - protein, 25 aa, Mycobacterium
DNVEAFLAVCRKWEVLATVIGEVTD

SEQ ID NO: 1297810 - protein, 27 aa, Mycobacterium
DPADLRLRNLLKPDQFPYHSKTGWTYD

SEQ ID NO: 1297811 - protein, 23 aa, Mycobacterium
DPAEFDAYYWVDNLRHAVRFSAA

SEQ ID NO: 1297812 - protein, 26 aa, Mycobacterium
DPAFRQRYWARNHVGWRHMAATLPNA

SEQ ID NO: 1297813 - protein, 26 aa, Mycobacterium
DPAIAAFLSIHNMCAWMVDTYGSEEQ

SEQ ID NO: 1297814 - protein, 21 aa, Mycobacterium
DPALLHYRSGGFFLARAQQVD

SEQ ID NO: 1297815 - protein, 21 aa, Mycobacterium
DPALVHHYFGTKQQLFVAAIQ

SEQ ID NO: 1297816 - protein, 34 aa, Mycobacterium
DPAPLNGILPPPPPIDPFAPPPPPPAPFDALAAP

SEQ ID NO: 1297817 - protein, 18 aa, Mycobacterium
DPARMFGRMLGIDGGVNP

SEQ ID NO: 1297818 - protein, 25 aa, Mycobacterium
DPATGLHKVVLARALHLTADGPLDA

SEQ ID NO: 1297819 - protein, 20 aa, Mycobacterium
DPAWLRDLPTDRPVLVLAEG

SEQ ID NO: 1297820 - protein, 29 aa, Mycobacterium
DPDCEPLMDYLFPASKILDPFGLENMRYK

SEQ ID NO: 1297821 - protein, 23 aa, Mycobacterium
DPDEFYVHKPTYLAGHRAVLRRR

SEQ ID NO: 1297822 - protein, 20 aa, Mycobacterium
DPDGTLLWTQKRSIFARGEG

SEQ ID NO: 1297823 - protein, 24 aa, Mycobacterium
DPDRPNARRHIGFGRGVHSCIGAP

SEQ ID NO: 1297824 - protein, 24 aa, Mycobacterium
DPEFGPQWHLGVQPLIGGGAAVSL

SEQ ID NO: 1297825 - protein, 17 aa, Mycobacterium
DPEFLVRTNWQVTNRSD

SEQ ID NO: 1297826 - protein, 26 aa, Mycobacterium
DPEMTTPYAWYQYFINTADADVVNYL

SEQ ID NO: 1297827 - protein, 17 aa, Mycobacterium
DPEVVVIVLRANGKHFS

SEQ ID NO: 1297828 - protein, 23 aa, Mycobacterium
DPFVIARETAGDRPIPSWLQVVG

SEQ ID NO: 1297829 - protein, 27 aa, Mycobacterium
DPGNYICVYPFVRSLEWYLLPDDERRR

SEQ ID NO: 1297830 - protein, 30 aa, Mycobacterium
DPGPALVVRPFLKYQIITVAAPETAAGPGM

SEQ ID NO: 1297831 - protein, 21 aa, Mycobacterium
DPHAFAIPRLTGQAKASFVAV

SEQ ID NO: 1297832 - protein, 19 aa, Mycobacterium
DPHGLIGHYEETGFHAVGS

SEQ ID NO: 1297833 - protein, 17 aa, Mycobacterium
DPHRMQMFSAATEPVRD

SEQ ID NO: 1297834 - protein, 17 aa, Mycobacterium
DPIPVLPNVHWLYEYGH

SEQ ID NO: 1297835 - protein, 22 aa, Mycobacterium
DPIRQTLLRYIGVRAAVLRPKS

SEQ ID NO: 1297836 - protein, 17 aa, Mycobacterium
DPKYSLKPVAAALSEKL

SEQ ID NO: 1297837 - protein, 26 aa, Mycobacterium
DPMEAAYVSVYLWKNTVEKAQSFDVK

SEQ ID NO: 1297838 - protein, 20 aa, Mycobacterium
DPMNLIIDPGLGFAKTGQHN

SEQ ID NO: 1297839 - protein, 26 aa, Mycobacterium
DPNHPAVLLIMGLGAQLTFWREDFCR

SEQ ID NO: 1297840 - protein, 34 aa, Mycobacterium
DPNLLFVNAGMVQFVPFFLGQRTPPYQRATSIQK

SEQ ID NO: 1297841 - protein, 35 aa, Mycobacterium
DPNQKWRPANLGQPLYNFLLTVLFEWGVALHDTDV

SEQ ID NO: 1297842 - protein, 25 aa, Mycobacterium
DPPGPGEVLVRLAATGLCHSDEHLV

SEQ ID NO: 1297843 - protein, 23 aa, Mycobacterium
DPPGYLVRLRELVGPQAWIVIEK

SEQ ID NO: 1297844 - protein, 22 aa, Mycobacterium
DPQQRMALELTWEALEHARIPA

SEQ ID NO: 1297845 - protein, 22 aa, Mycobacterium
DPQWPVALAHIDCDWYDPVKLC

SEQ ID NO: 1297846 - protein, 29 aa, Mycobacterium
DPRGRLRSDRLYLVRPDQFVAASIPLRDN

SEQ ID NO: 1297847 - protein, 17 aa, Mycobacterium
DPRRYLQGLADAGAVGV

SEQ ID NO: 1297848 - protein, 23 aa, Mycobacterium
DPSARLTWATHHVPFLAAVEDGP

SEQ ID NO: 1297849 - protein, 17 aa, Mycobacterium
DPSGLDIALFSAGATMS

SEQ ID NO: 1297850 - protein, 25 aa, Mycobacterium
DPSLVQNICFLYHLLGGGTGDWDVP

SEQ ID NO: 1297851 - protein, 24 aa, Mycobacterium
DPSNVIGLSLPLVRRMLDRLDLSV

SEQ ID NO: 1297852 - protein, 26 aa, Mycobacterium
DPTGLYMEVLRVVRFWISHGVKVFRV

SEQ ID NO: 1297853 - protein, 24 aa, Mycobacterium
DPTGVFSWRPPASLIVALSDLLDA

SEQ ID NO: 1297854 - protein, 21 aa, Mycobacterium
DPTLTWLDGIAPDSPLVILHN

SEQ ID NO: 1297855 - protein, 17 aa, Mycobacterium
DPTPLWKSYVDAGWTEL

SEQ ID NO: 1297856 - protein, 23 aa, Mycobacterium
DPVFRQAEYLKTPLIVRPEPDND

SEQ ID NO: 1297857 - protein, 17 aa, Mycobacterium
DPYEAVIAAANWVHTEL

SEQ ID NO: 1297858 - protein, 25 aa, Mycobacterium
DPYLPDLLMCRTEVVDVLLAAIHSA

SEQ ID NO: 1297859 - protein, 23 aa, Mycobacterium
DPYTLTEAWGLSTAQGWQGVGHT

SEQ ID NO: 1297860 - protein, 17 aa, Mycobacterium
DQAAVVAAIEDCGYDVR

SEQ ID NO: 1297861 - protein, 20 aa, Mycobacterium
DQEIKRAYRKLARELHPDVN

SEQ ID NO: 1297862 - protein, 30 aa, Mycobacterium
DQKWGELVYDGLWFSPLKTALESFVAKTQE

SEQ ID NO: 1297863 - protein, 18 aa, Mycobacterium
DQLDFHWTQALRPRLDGL

SEQ ID NO: 1297864 - protein, 25 aa, Mycobacterium
DQLDQGVALIYLLVKPDSTPVEVTL

SEQ ID NO: 1297865 - protein, 17 aa, Mycobacterium
DQLRSRPVLARPLQAID

SEQ ID NO: 1297866 - protein, 34 aa, Mycobacterium
DQQWNDIIDVHLTAPFRILRAAQPVISGLAKKEK

SEQ ID NO: 1297867 - protein, 17 aa, Mycobacterium
DQTLQVLQLPDDRLDDL

SEQ ID NO: 1297868 - protein, 23 aa, Mycobacterium
DQVIQRLFGVGLTLQGTIPRART

SEQ ID NO: 1297869 - protein, 21 aa, Mycobacterium
DQVLDGDLDPLFDALAAADKQ

SEQ ID NO: 1297870 - protein, 21 aa, Mycobacterium
DRAFMALADPVRRAIVARLSR

SEQ ID NO: 1297871 - protein, 29 aa, Mycobacterium
DRAKAGVMAQLLPILDDLDRARSHGDLDT

SEQ ID NO: 1297872 - protein, 23 aa, Mycobacterium
DRALAGWRVNAWLLDADDLRPLQ

SEQ ID NO: 1297873 - protein, 23 aa, Mycobacterium
DRAQQLLQTRIPFVRATVVRAQQ

SEQ ID NO: 1297874 - protein, 18 aa, Mycobacterium
DRARFVQHNLWVTKYDPA

SEQ ID NO: 1297875 - protein, 29 aa, Mycobacterium
DRASTILLPHDYLTYWLTGRPVTDRSEAS

SEQ ID NO: 1297876 - protein, 35 aa, Mycobacterium
DRATAPLPVFLQRSPHFRPPRDGVTPMIMVGPGTG

SEQ ID NO: 1297877 - protein, 29 aa, Mycobacterium
DRDGSDAMRWFLMASPILRGGNLIVTEQG

SEQ ID NO: 1297878 - protein, 25 aa, Mycobacterium
DRDSLLLLSELLTTSLRNVLVLGTH

SEQ ID NO: 1297879 - protein, 19 aa, Mycobacterium
DRELLGISEALRASGLSAG

SEQ ID NO: 1297880 - protein, 18 aa, Mycobacterium
DRFGFTAHMDFYEPAELE

SEQ ID NO: 1297881 - protein, 26 aa, Mycobacterium
DRGFFDDLVTPFLGVYRDNNLRADSS

SEQ ID NO: 1297882 - protein, 21 aa, Mycobacterium
DRGFTGRLERLFVVAVNCTEP

SEQ ID NO: 1297883 - protein, 35 aa, Mycobacterium
DRGLHVLVFGPLRALRLTTALRRAAGTTERTGSAT

SEQ ID NO: 1297884 - protein, 32 aa, Mycobacterium
DRGNFPVFRKRLRQWMMRITAYSDRLLEDLEV

SEQ ID NO: 1297885 - protein, 26 aa, Mycobacterium
DRGRALRVIFWFIDHTTQRRYEILDR

SEQ ID NO: 1297886 - protein, 26 aa, Mycobacterium
DRGYRGLQFYPATGTAGLPLHDLRHV

SEQ ID NO: 1297887 - protein, 18 aa, Mycobacterium
DRHGNPMVVKLSGTVEPY

SEQ ID NO: 1297888 - protein, 17 aa, Mycobacterium
DRIAVMYLGRIVEIGPA

SEQ ID NO: 1297889 - protein, 26 aa, Mycobacterium
DRIFTWQLAMAVRPRRWVFTSVGRLG

SEQ ID NO: 1297890 - protein, 21 aa, Mycobacterium
DRILLLMELLSEQPRTGRTLA

SEQ ID NO: 1297891 - protein, 19 aa, Mycobacterium
DRIQGYLDLALQEGGRFAC

SEQ ID NO: 1297892 - protein, 25 aa, Mycobacterium
DRIRDAWEFALLDEALRRGVPVLGI

SEQ ID NO: 1297893 - protein, 19 aa, Mycobacterium
DRIVEYLAVRARRAQRGLQ

SEQ ID NO: 1297894 - protein, 22 aa, Mycobacterium
DRKNVREHLAFGRGIHTCAGAP

SEQ ID NO: 1297895 - protein, 28 aa, Mycobacterium
DRKRRQPVTVLLKALGWTNEQITERFGF

SEQ ID NO: 1297896 - protein, 22 aa, Mycobacterium
DRKTDDALWKRYSAARETFNRR

SEQ ID NO: 1297897 - protein, 24 aa, Mycobacterium
DRLDAWLLGPHDNAGYPAPFRDAL

SEQ ID NO: 1297898 - protein, 28 aa, Mycobacterium
DRLGFPVLQIRYPLPFVAISRAVAEATL

SEQ ID NO: 1297899 - protein, 30 aa, Mycobacterium
DRLIEVIGGATMLRLLLLPGSDLDEAWVDQ

SEQ ID NO: 1297900 - protein, 30 aa, Mycobacterium
DRLKLVEQFRYPLGLRRWEFPQGTAPGRAD

SEQ ID NO: 1297901 - protein, 25 aa, Mycobacterium
DRLKPGPVMIADKKLAWPADLELGP

SEQ ID NO: 1297902 - protein, 19 aa, Mycobacterium
DRLLISYAADLARRRRARG

SEQ ID NO: 1297903 - protein, 26 aa, Mycobacterium
DRLPADTVVYPTHGFGSFCSATPASG

SEQ ID NO: 1297904 - protein, 26 aa, Mycobacterium
DRLQIKYFNPVIRPLAGRVPGIALIK

SEQ ID NO: 1297905 - protein, 20 aa, Mycobacterium
DRMRVSHMLGFDSPAAMVAE

SEQ ID NO: 1297906 - protein, 35 aa, Mycobacterium
DRMSADLALLTDPWQPAVLALVAMTVRAGAAAGKP

SEQ ID NO: 1297907 - protein, 34 aa, Mycobacterium
DRMTLDLRRLIDRAARWLLNYRPQPLAVGAEINR

SEQ ID NO: 1297908 - protein, 33 aa, Mycobacterium
DRNTHGVSWLPLFHDMGLSMIGFPAVYGGHSTL

SEQ ID NO: 1297909 - protein, 28 aa, Mycobacterium
DRNYVHSLDWRWLTRPLNDGPGESWITP

SEQ ID NO: 1297910 - protein, 18 aa, Mycobacterium
DRPLAVSLPTRQCTVDKV

SEQ ID NO: 1297911 - protein, 21 aa, Mycobacterium
DRPLGVLPRPDPLPQGCIAAR

SEQ ID NO: 1297912 - protein, 17 aa, Mycobacterium
DRPLWTKLSFATAEHNF

SEQ ID NO: 1297913 - protein, 18 aa, Mycobacterium
DRPVLRDVSLTLSERRIG

SEQ ID NO: 1297914 - protein, 23 aa, Mycobacterium
DRRDGAAWLQQNRGGAGLFGSIA

SEQ ID NO: 1297915 - protein, 21 aa, Mycobacterium
DRRIRSFSAIPSPHEVLAEFP

SEQ ID NO: 1297916 - protein, 26 aa, Mycobacterium
DRRPLDRFIYSLRSVAPLVAAKDTDR

SEQ ID NO: 1297917 - protein, 31 aa, Mycobacterium
DRRRDFLVDSGYLVPHWPKPWGRAAGTLEQL

SEQ ID NO: 1297918 - protein, 34 aa, Mycobacterium
DRRWWTERIPDLPEPPALPLVPRAEQRDPRRGTR

SEQ ID NO: 1297919 - protein, 24 aa, Mycobacterium
DRSAVAWPAALRPALTTAGFATEL

SEQ ID NO: 1297920 - protein, 20 aa, Mycobacterium
DRSIGDLAPLWDDEILEQAI

SEQ ID NO: 1297921 - protein, 24 aa, Mycobacterium
DRSNLRHLGFGKGPHFCLGAPLAR

SEQ ID NO: 1297922 - protein, 23 aa, Mycobacterium
DRSWRGIGMIPQSGWRLSPAYRD

SEQ ID NO: 1297923 - protein, 24 aa, Mycobacterium
DRTGPPIVEWLTGRGVDTPDPVVV

SEQ ID NO: 1297924 - protein, 22 aa, Mycobacterium
DRTRDPVFFQNGWDLLVEGCRV

SEQ ID NO: 1297925 - protein, 28 aa, Mycobacterium
DRTRVRTRLIELFELFDPADPEVIAGRR

SEQ ID NO: 1297926 - protein, 23 aa, Mycobacterium
DRTVDIEYKFGFAGNPWGELEGV

SEQ ID NO: 1297927 - protein, 22 aa, Mycobacterium
DRVALWNIVATVDAFLSAGFTP

SEQ ID NO: 1297928 - protein, 19 aa, Mycobacterium
DRVAVLRFGKLQQFASPNE

SEQ ID NO: 1297929 - protein, 22 aa, Mycobacterium
DRVGDFYAYPDALRRCWVRGNM

SEQ ID NO: 1297930 - protein, 18 aa, Mycobacterium
DRVGLRETGFWRFVSDPA

SEQ ID NO: 1297931 - protein, 22 aa, Mycobacterium
DRVGVAWLRHTCGRCRFCERGQ

SEQ ID NO: 1297932 - protein, 21 aa, Mycobacterium
DRVLYVFLPPTEELEHFVDLV

SEQ ID NO: 1297933 - protein, 18 aa, Mycobacterium
DRVTTYALYIDPPLGRAG

SEQ ID NO: 1297934 - protein, 25 aa, Mycobacterium
DRVVIYLPMVPEALIAMLACARLGA

SEQ ID NO: 1297935 - protein, 23 aa, Mycobacterium
DRYHAFLHVAGNRALAAAARVDA

SEQ ID NO: 1297936 - protein, 25 aa, Mycobacterium
DSAAQWIGLVSFLMSAGTAARLHFS

SEQ ID NO: 1297937 - protein, 25 aa, Mycobacterium
DSAEYKVFLNLLRERFETDKTKWTK

SEQ ID NO: 1297938 - protein, 19 aa, Mycobacterium
DSAFFVTRAALPGMVERGY

SEQ ID NO: 1297939 - protein, 21 aa, Mycobacterium
DSAILTVGLLEGSMLEDAANI

SEQ ID NO: 1297940 - protein, 22 aa, Mycobacterium
DSARTYPAPAVPLIAVPTTAGT

SEQ ID NO: 1297941 - protein, 26 aa, Mycobacterium
DSAVSSWLYRIVVNACLDRLRTNRTH

SEQ ID NO: 1297942 - protein, 22 aa, Mycobacterium
DSAVVLHPGPMLRGMEISSSVA

SEQ ID NO: 1297943 - protein, 28 aa, Mycobacterium
DSDVDDILWQVPYLPIDPKDVGRTYEAV

SEQ ID NO: 1297944 - protein, 25 aa, Mycobacterium
DSFNVPLVFVVDTPGFLPGVEQEKN

SEQ ID NO: 1297945 - protein, 21 aa, Mycobacterium
DSFVFNLVQYLGQLGVDVTVW

SEQ ID NO: 1297946 - protein, 23 aa, Mycobacterium
DSFWRDLVAFTWNIKTLEGRDGI

SEQ ID NO: 1297947 - protein, 17 aa, Mycobacterium
DSFYAAFEAAVSKLENR

SEQ ID NO: 1297948 - protein, 29 aa, Mycobacterium
DSGASWLLPRLVGLARTKRMLLLGEKVSG

SEQ ID NO: 1297949 - protein, 22 aa, Mycobacterium
DSGGPFAGVPFLIKDLAQDYAG

SEQ ID NO: 1297950 - protein, 25 aa, Mycobacterium
DSGHPVLLESFLDGPEVSLFCVVDG

SEQ ID NO: 1297951 - protein, 22 aa, Mycobacterium
DSGPECAWLSVFVERVQGAVDE

SEQ ID NO: 1297952 - protein, 26 aa, Mycobacterium
DSGTGLFLLQNMFGVWPVDGVVTDEL

SEQ ID NO: 1297953 - protein, 19 aa, Mycobacterium
DSHLDGEDLYRPYLQLVMS

SEQ ID NO: 1297954 - protein, 19 aa, Mycobacterium
DSIGRLAVRLDVSRLVVVG

SEQ ID NO: 1297955 - protein, 25 aa, Mycobacterium
DSKGYCFQIDLTWRTINNGFVVVEV

SEQ ID NO: 1297956 - protein, 26 aa, Mycobacterium
DSLRRRRDLSVLLLLDVSGSTAEPGT

SEQ ID NO: 1297957 - protein, 20 aa, Mycobacterium
DSLTWKLFGDWRGLLQGPWA

SEQ ID NO: 1297958 - protein, 21 aa, Mycobacterium
DSMAVRLLGSVALARAARGVD

SEQ ID NO: 1297959 - protein, 20 aa, Mycobacterium
DSMRAGLKALAWMSRGGAAK

SEQ ID NO: 1297960 - protein, 23 aa, Mycobacterium
DSNYLHVHAWHRSFADEGLTVES

SEQ ID NO: 1297961 - protein, 29 aa, Mycobacterium
DSNYYGTLAMIRAFAPILARNGGGAILNV

SEQ ID NO: 1297962 - protein, 20 aa, Mycobacterium
DSPLVILHNSGHKAFFNSVA

SEQ ID NO: 1297963 - protein, 17 aa, Mycobacterium
DSPLWDMPGVDISPHDS

SEQ ID NO: 1297964 - protein, 18 aa, Mycobacterium
DSPQNALFAPILSQLYPD

SEQ ID NO: 1297965 - protein, 26 aa, Mycobacterium
DSREALLRRIGLAAAKYWVCKRATPH

SEQ ID NO: 1297966 - protein, 23 aa, Mycobacterium
DSSDLPWHRVIGASGRPAPHLAT

SEQ ID NO: 1297967 - protein, 21 aa, Mycobacterium
DSTMLNYPLTQYMFCAPDEGA

SEQ ID NO: 1297968 - protein, 25 aa, Mycobacterium
DSVFDLNVKALWACSLAAGAHMRER

SEQ ID NO: 1297969 - protein, 17 aa, Mycobacterium
DSVKGKAKEVVGAVTGN

SEQ ID NO: 1297970 - protein, 22 aa, Mycobacterium
DSWMFVGWCRLREGIRGFHLDR

SEQ ID NO: 1297971 - protein, 23 aa, Mycobacterium
DTADMACLAFVWSGDDLVVTEAV

SEQ ID NO: 1297972 - protein, 24 aa, Mycobacterium
DTAGQILGCRFLLDPDGGPPSWIG

SEQ ID NO: 1297973 - protein, 24 aa, Mycobacterium
DTARRWFHEFEGAGLDGVIAKPLD

SEQ ID NO: 1297974 - protein, 32 aa, Mycobacterium
DTASAMLPLRNLYRDRLLVLAALDVAPTVENE

SEQ ID NO: 1297975 - protein, 18 aa, Mycobacterium
DTCAIVHPAKLALELARA

SEQ ID NO: 1297976 - protein, 26 aa, Mycobacterium
DTDLAWSRITYWRALLTSAVDQPPYE

SEQ ID NO: 1297977 - protein, 23 aa, Mycobacterium
DTDQIIPAVYLKRVTRTGFEDGL

SEQ ID NO: 1297978 - protein, 17 aa, Mycobacterium
DTECRVYRVAGLRVVDA

SEQ ID NO: 1297979 - protein, 20 aa, Mycobacterium
DTELDKWVVYVPAENADAVR

SEQ ID NO: 1297980 - protein, 25 aa, Mycobacterium
DTELLTLDQWNAIIDINIRGVVHGV

SEQ ID NO: 1297981 - protein, 26 aa, Mycobacterium
DTELPHIPVRLHARSWHRYAEPHPDS

SEQ ID NO: 1297982 - protein, 20 aa, Mycobacterium
DTFFIASAPSYSFVSSSLAK

SEQ ID NO: 1297983 - protein, 19 aa, Mycobacterium
DTGLIALLAELDDADTRAA

SEQ ID NO: 1297984 - protein, 24 aa, Mycobacterium
DTGRPLTPAIVWQDRRAESVCAPL

SEQ ID NO: 1297985 - protein, 29 aa, Mycobacterium
DTHARVGLLPTWGLSVRLPQKVGVGMARR

SEQ ID NO: 1297986 - protein, 20 aa, Mycobacterium
DTHYYQPLWTLVGGGQAKAS

SEQ ID NO: 1297987 - protein, 20 aa, Mycobacterium
DTIGPYPQWGEPATIVSMDP

SEQ ID NO: 1297988 - protein, 21 aa, Mycobacterium
DTIGRLWDHIGDYGIGFCLDT

SEQ ID NO: 1297989 - protein, 23 aa, Mycobacterium
DTKPDLLQIITTDSGPIITRCSD

SEQ ID NO: 1297990 - protein, 24 aa, Mycobacterium
DTLFARYAFPPNELGYCGPPGSAT

SEQ ID NO: 1297991 - protein, 19 aa, Mycobacterium
DTLIIDCGADFRLTDAAAW

SEQ ID NO: 1297992 - protein, 21 aa, Mycobacterium
DTLPDLLGVYAGSALSALRLK

SEQ ID NO: 1297993 - protein, 29 aa, Mycobacterium
DTLVRMAQPWSLRYPLVDGQGNFGSPGND

SEQ ID NO: 1297994 - protein, 24 aa, Mycobacterium
DTMKRTFLELGGKSALIVLDDAKP

SEQ ID NO: 1297995 - protein, 25 aa, Mycobacterium
DTMYCCLPLYHNNALTVALSSVLNS

SEQ ID NO: 1297996 - protein, 25 aa, Mycobacterium
DTRQAMLFSATMPDPIITLARTFMN

SEQ ID NO: 1297997 - protein, 27 aa, Mycobacterium
DTRSQIMLGHWAPLSSAGLAVLRSCSP

SEQ ID NO: 1297998 - protein, 29 aa, Mycobacterium
DTSDRWVTLAFTWQGLRALGVPDTSLATF

SEQ ID NO: 1297999 - protein, 24 aa, Mycobacterium
DTSLVLVSRAPLGKLLAFRDRMGW

SEQ ID NO: 1298000 - protein, 26 aa, Mycobacterium
DTTAALPVMVWIPGGAFVYGAGQLQL

SEQ ID NO: 1298001 - protein, 24 aa, Mycobacterium
DTTAPPLRRLMSRGAAHMFRVVAK

SEQ ID NO: 1298002 - protein, 29 aa, Mycobacterium
DTTATFEWAFRWLAAHRPPPSPHRLVHGD

SEQ ID NO: 1298003 - protein, 24 aa, Mycobacterium
DTTATLLTYALWALGHHPDIQDRV

SEQ ID NO: 1298004 - protein, 19 aa, Mycobacterium
DTTLQLLLAAQRAAGINGL

SEQ ID NO: 1298005 - protein, 39 aa, Mycobacterium; identical to SEQ ID NO: 784102

SEQ ID NO: 1298006 - protein, 18 aa, Mycobacterium
DTYRPPEILQRRILKRDR

SEQ ID NO: 1298007 - protein, 25 aa, Mycobacterium
DVAAVTHRVLRHRLILGFEAANADV

SEQ ID NO: 1298008 - protein, 26 aa, Mycobacterium
DVAEMTYLQWLARYVELAIGEGDSTA

SEQ ID NO: 1298009 - protein, 24 aa, Mycobacterium
DVAFNWDHFFPLYGDPDGAHYECW

SEQ ID NO: 1298010 - protein, 20 aa, Mycobacterium
DVAIMLGLAYVLATERLADR

SEQ ID NO: 1298011 - protein, 17 aa, Mycobacterium
DVALGIGGLPRGRVIEI

SEQ ID NO: 1298012 - protein, 26 aa, Mycobacterium
DVARDMPLRRFVFTSSYVTVGRRRGR

SEQ ID NO: 1298013 - protein, 23 aa, Mycobacterium
DVARLEAALARFAAVADAAHAET

SEQ ID NO: 1298014 - protein, 23 aa, Mycobacterium
DVAVYLCGPPPMVESVRKHVAAE

SEQ ID NO: 1298015 - protein, 23 aa, Mycobacterium
DVDLRLPLVEIGVDSIMTVALRR

SEQ ID NO: 1298016 - protein, 23 aa, Mycobacterium
DVDNLIPVVTESMPMAAASTGLD

SEQ ID NO: 1298017 - protein, 24 aa, Mycobacterium
DVDPGVLVYLWRTAGMSVDEIETM

SEQ ID NO: 1298018 - protein, 23 aa, Mycobacterium
DVDSLPLHPGFAASWDRLRTVTA

SEQ ID NO: 1298019 - protein, 28 aa, Mycobacterium
DVDWLADGWVALLRRWLADAEAAGIAEP

SEQ ID NO: 1298020 - protein, 24 aa, Mycobacterium
DVEDRLQWVKPQLALYIGGMGARG

SEQ ID NO: 1298021 - protein, 18 aa, Mycobacterium
DVEGLLALLAPDAVWITD

SEQ ID NO: 1298022 - protein, 18 aa, Mycobacterium
DVELLALAQLIGAAGTLV

SEQ ID NO: 1298023 - protein, 18 aa, Mycobacterium
DVERLSGRLVERDGRVWL

SEQ ID NO: 1298024 - protein, 29 aa, Mycobacterium
DVERRARWLVRVLTSLLLFPGGDEGEERA

SEQ ID NO: 1298025 - protein, 25 aa, Mycobacterium
DVFCSVVRRVALPDAFFAIDGQTET

SEQ ID NO: 1298026 - protein, 22 aa, Mycobacterium
DVFISYLRRKLERDGLPRVIHT

SEQ ID NO: 1298027 - protein, 20 aa, Mycobacterium
DVFKEKLVRRDISMKAFDAG

SEQ ID NO: 1298028 - protein, 22 aa, Mycobacterium
DVFVPRHRFLSYKAMNDGTAGG

SEQ ID NO: 1298029 - protein, 18 aa, Mycobacterium
DVFVRFSTVLGSRGSADT

SEQ ID NO: 1298030 - protein, 28 aa, Mycobacterium
DVFVYHGYSLMFLNGAWVKATPAFNREL

SEQ ID NO: 1298031 - protein, 41 aa, Mycobacterium
DVGAYPTPYPVLTTAAIGMFFPGPYRVPKASFNYKTVFSNT

SEQ ID NO: 1298032 - protein, 28 aa, Mycobacterium
DVGDAYHHIFMRILIAARTHGIHAIDGP

SEQ ID NO: 1298033 - protein, 19 aa, Mycobacterium
DVGGTWYWNRYPGARCDIE

SEQ ID NO: 1298034 - protein, 30 aa, Mycobacterium
DVGRAQYLGLPYYGRWLLAVARVLVEKHHI

SEQ ID NO: 1298035 - protein, 26 aa, Mycobacterium
DVGSLARLPLILTDGHLRELALTGKD

SEQ ID NO: 1298036 - protein, 20 aa, Mycobacterium
DVHGTTVRILFDPAVVPDSQ

SEQ ID NO: 1298037 - protein, 24 aa, Mycobacterium
DVIVLGLARGGVPVAWEVAAALGA

SEQ ID NO: 1298038 - protein, 17 aa, Mycobacterium
DVKLRHLSAAVAGAEAG

SEQ ID NO: 1298039 - protein, 25 aa, Mycobacterium
DVKSNPYAIKILGPVARAANRLGGN

SEQ ID NO: 1298040 - protein, 28 aa, Mycobacterium
DVLGAHLGPYCWPAAIKMIESGILPMDE

SEQ ID NO: 1298041 - protein, 24 aa, Mycobacterium
DVLKPLLDELGLVGYPKTSGGRGV

SEQ ID NO: 1298042 - protein, 17 aa, Mycobacterium
DVLLLPAASDVIPATAD

SEQ ID NO: 1298043 - protein, 18 aa, Mycobacterium
DVLLMTDGRFSGGTTGLC

SEQ ID NO: 1298044 - protein, 24 aa, Mycobacterium
DVLLSRFFAVWEQDTTFLALLRAA

SEQ ID NO: 1298045 - protein, 18 aa, Mycobacterium
DVLNLMHLLYSMIQVSFP

SEQ ID NO: 1298046 - protein, 18 aa, Mycobacterium
DVLRAWGKLGYPRRAKRL

SEQ ID NO: 1298047 - protein, 18 aa, Mycobacterium
DVLSGMIGALLAAGLPAG

SEQ ID NO: 1298048 - protein, 30 aa, Mycobacterium
DVLSMCDRLTYMRLMLPALAQKVDATVSFM

SEQ ID NO: 1298049 - protein, 17 aa, Mycobacterium
DVLVANHAYMTMAPLLE

SEQ ID NO: 1298050 - protein, 17 aa, Mycobacterium
DVLVKAIRLACRAPSLH

SEQ ID NO: 1298051 - protein, 19 aa, Mycobacterium
DVLVLRSLTKTWALAGLRV

SEQ ID NO: 1298052 - protein, 19 aa, Mycobacterium
DVMTVAANRWPAVRFAVRN

SEQ ID NO: 1298053 - protein, 25 aa, Mycobacterium
DVPDYRPFWAVTKHADIMAIERDNE

SEQ ID NO: 1298054 - protein, 25 aa, Mycobacterium
DVPEPVVVMRRYPDRYRLRSMVIRG

SEQ ID NO: 1298055 - protein, 25 aa, Mycobacterium
DVPLTLVHVLPDTEVRMWLDVPPTD

SEQ ID NO: 1298056 - protein, 24 aa, Mycobacterium
DVPPVVASLLGCAVLTGGGAVLNV

SEQ ID NO: 1298057 - protein, 19 aa, Mycobacterium
DVPVQYPPIPSFSPEHFAV

SEQ ID NO: 1298058 - protein, 18 aa, Mycobacterium
DVPYGGVGTLLLKGPNIF

SEQ ID NO: 1298059 - protein, 26 aa, Mycobacterium
DVQAGLAMLAPIWGYKPILDIDDDTA

SEQ ID NO: 1298060 - protein, 23 aa, Mycobacterium
DVQWNFEKFLLAPGGEVVNRFRP

SEQ ID NO: 1298061 - protein, 21 aa, Mycobacterium
DVRLWVDRSFSVRGAGTVVTG

SEQ ID NO: 1298062 - protein, 18 aa, Mycobacterium
DVRTLLAKFGLRADHVER

SEQ ID NO: 1298063 - protein, 19 aa, Mycobacterium
DVRTVLPPVLSIRNGRRSV

SEQ ID NO: 1298064 - protein, 27 aa, Mycobacterium
DVRVDMLEMLPTPWGLVRSGVAPDHPK

SEQ ID NO: 1298065 - protein, 17 aa, Mycobacterium
DVRVLRCGADYLNPPAT

SEQ ID NO: 1298066 - protein, 26 aa, Mycobacterium
DVSGGAAFLLCRRASRLSSHAAQWAL

SEQ ID NO: 1298067 - protein, 26 aa, Mycobacterium
DVSWSELAALVFGLVLEGRETESGRG

SEQ ID NO: 1298068 - protein, 19 aa, Mycobacterium
DVTFSWFDTGNLERERTLA

SEQ ID NO: 1298069 - protein, 26 aa, Mycobacterium
DVTGFGLLGHLYKLARASGVTAVVDA

SEQ ID NO: 1298070 - protein, 26 aa, Mycobacterium
DVTLLPGLMDMELNLLIGGPGGPEGL

SEQ ID NO: 1298071 - protein, 24 aa, Mycobacterium
DVTPTRLRSALDEGQIVLVAGFQG

SEQ ID NO: 1298072 - protein, 23 aa, Mycobacterium
DVTTMGWFDREWYLGGHRAQVFD

SEQ ID NO: 1298073 - protein, 32 aa, Mycobacterium
DVTVDALFSPAYYRLVFGLPPLDETALTDLLE

SEQ ID NO: 1298074 - protein, 24 aa, Mycobacterium
DVVAFLKRWLLVDDDRARQMLRFL

SEQ ID NO: 1298075 - protein, 19 aa, Mycobacterium
DVVALIASGGLPKGDALAT

SEQ ID NO: 1298076 - protein, 22 aa, Mycobacterium
DVVLLQLEIPLHTANDAARVAR

SEQ ID NO: 1298077 - protein, 28 aa, Mycobacterium
DVVSQVAELLWYPLWDANIRLDHSVRTV

SEQ ID NO: 1298078 - protein, 23 aa, Mycobacterium
DVVVLGLARGGVPVGWEVAHGLG

SEQ ID NO: 1298079 - protein, 46 aa, Mycobacterium
DVWEGVVSVFRDYGYRRLRSKARLKFLIKDWGVEKFRQVLETEYLK

SEQ ID NO: 1298080 - protein, 18 aa, Mycobacterium
DWAAAFNTALWPITWAPL

SEQ ID NO: 1298081 - protein, 24 aa, Mycobacterium
DWEPADEYLPFKPTAFRMVSMGKR

SEQ ID NO: 1298082 - protein, 19 aa, Mycobacterium
DWIDAGFALLAEGGTNALR

SEQ ID NO: 1298083 - protein, 21 aa, Mycobacterium
DWPQADALRFAVNRLRMFAAD

SEQ ID NO: 1298084 - protein, 23 aa, Mycobacterium
DWSKVHVFFGDERYVPEADDERN

SEQ ID NO: 1298085 - protein, 19 aa, Mycobacterium
DWSTGRYWKIANPSKRNEL

SEQ ID NO: 1298086 - protein, 19 aa, Mycobacterium
DWTPVTLLEGGTPLIHAKR

SEQ ID NO: 1298087 - protein, 23 aa, Mycobacterium
DWVAMASEYRALSGLPGVENAAI

SEQ ID NO: 1298088 - protein, 19 aa, Mycobacterium
DWWDASYLMMWGSNVPVTR

SEQ ID NO: 1298089 - protein, 19 aa, Mycobacterium
DYAIWFYEPSGAEVSDGLP

SEQ ID NO: 1298090 - protein, 35 aa, Mycobacterium
DYCEGSVAHFDWLVECGVPFKAEFFGEPGWEPMGD

SEQ ID NO: 1298091 - protein, 26 aa, Mycobacterium
DYELPGLAEAIRRAGLPKVPTAVLSR

SEQ ID NO: 1298092 - protein, 26 aa, Mycobacterium
DYHAELAWWTGWLAVSDGIPHGSLVS

SEQ ID NO: 1298093 - protein, 18 aa, Mycobacterium
DYLAAHLRALALAGRKFA

SEQ ID NO: 1298094 - protein, 19 aa, Mycobacterium
DYLNWEARSWRLTESGEYD

SEQ ID NO: 1298095 - protein, 19 aa, Mycobacterium
DYLSARPITTPFGLYDCDV

SEQ ID NO: 1298096 - protein, 17 aa, Mycobacterium
DYTVVDLALIQLGAVAV

SEQ ID NO: 1298097 - protein, 28 aa, Mycobacterium
DYVAWYNQQRLMHRLGRIPPAEAEARYY

SEQ ID NO: 1298098 - protein, 26 aa, Mycobacterium
DYVINGRKWWITGAADPRCKLLIVMG

SEQ ID NO: 1298099 - protein, 21 aa, Mycobacterium
DYVKEDVAIRRLLATGLERAG

SEQ ID NO: 1298100 - protein, 19 aa, Mycobacterium
DYVLTGRKFYSTGALFADW

SEQ ID NO: 1298101 - protein, 21 aa, Mycobacterium
DYYLARGVTWVQDAWVEPGDV

SEQ ID NO: 1298102 - protein, 18 aa, Mycobacterium
DYYRNGGILQYVLRNMLK

SEQ ID NO: 1298103 - protein, 26 aa, Mycobacterium
EAAEQPVPLVPLAVSAFLTSRKKSAA

SEQ ID NO: 1298104 - protein, 23 aa, Mycobacterium
EAAFLFAITVGGAMRIEPIEIMT

SEQ ID NO: 1298105 - protein, 27 aa, Mycobacterium
EAAFYRNTLIHAFLETSIVELALGYAA

SEQ ID NO: 1298106 - protein, 39 aa, Mycobacterium
EAAHQLIDPDFSRPLRPVAPLAQLDFDAPVAAPPAPAPL

SEQ ID NO: 1298107 - protein, 23 aa, Mycobacterium
EAALRWGPLSEARLARALDAVIH

SEQ ID NO: 1298108 - protein, 23 aa, Mycobacterium
EAARAWWGNFLVQKANESGVELD

SEQ ID NO: 1298109 - protein, 35 aa, Mycobacterium
EAAWAAYRHPTRLHWYVPNSIRWLDRLKAVSPELV

SEQ ID NO: 1298110 - protein, 18 aa, Mycobacterium
EAAYAHFGRRFDDLQTEV

SEQ ID NO: 1298111 - protein, 34 aa, Mycobacterium
EADAVTKLFAAGLLPASYALQRLGYSDDEILEIR

SEQ ID NO: 1298112 - protein, 27 aa, Mycobacterium
EADEMLDLGFLPDIERILRQTPDTRQA

SEQ ID NO: 1298113 - protein, 26 aa, Mycobacterium
EADFVRDIAAPLPMAVIGDMLGVLPQ

SEQ ID NO: 1298114 - protein, 18 aa, Mycobacterium
EADHLDFFGSAEAYTAVF

SEQ ID NO: 1298115 - protein, 27 aa, Mycobacterium
EADHMADLGFLPGVTRILAATPAGGQR

SEQ ID NO: 1298116 - protein, 24 aa, Mycobacterium
EADRIPLTGTVLLVSGRASFELTQ

SEQ ID NO: 1298117 - protein, 26 aa, Mycobacterium
EAEHKAYAIPFPPLGERFDRLTEQLD

SEQ ID NO: 1298118 - protein, 24 aa, Mycobacterium
EAELKRVHLPDDGDWRVVLRAYAH

SEQ ID NO: 1298119 - protein, 24 aa, Mycobacterium
EAEREGVRINWLRTITAFDRPDLQ

SEQ ID NO: 1298120 - protein, 24 aa, Mycobacterium
EAFAPVPMAWLKDIGADESKLNPN

SEQ ID NO: 1298121 - protein, 21 aa, Mycobacterium
EAFGRYGAHLPVNVLPVYGGS

SEQ ID NO: 1298122 - protein, 19 aa, Mycobacterium
EAFKWIQRAAMDRRTTMKR

SEQ ID NO: 1298123 - protein, 19 aa, Mycobacterium
EAGLLAPHWPKPFGRAASA

SEQ ID NO: 1298124 - protein, 24 aa, Mycobacterium
EAGLLAPRQALTGASLPPVLPATA

SEQ ID NO: 1298125 - protein, 32 aa, Mycobacterium
EAGRGHWALTRYDDVFYASRHPEIFSSASGIT

SEQ ID NO: 1298126 - protein, 18 aa, Mycobacterium
EAGRVWPPDDARARLEVH

SEQ ID NO: 1298127 - protein, 19 aa, Mycobacterium
EAHTLRLLNLRRASRAIAG

SEQ ID NO: 1298128 - protein, 24 aa, Mycobacterium
EAHWRKHLDTARALLLQGLEDVKV

SEQ ID NO: 1298129 - protein, 31 aa, Mycobacterium
EAIRGGAAIKPLWLPGPDPEPHYRPSAKLAA

SEQ ID NO: 1298130 - protein, 24 aa, Mycobacterium
EAKAYSLSFPDWKPASFDYWPAEN

SEQ ID NO: 1298131 - protein, 24 aa, Mycobacterium
EALADGYRRWISVLEAAFETMKRN

SEQ ID NO: 1298132 - protein, 24 aa, Mycobacterium
EALALQYFHVAPWVAWTDAGRNAM

SEQ ID NO: 1298133 - protein, 18 aa, Mycobacterium
EALGYGSLFIPEVTGKEC

SEQ ID NO: 1298134 - protein, 23 aa, Mycobacterium
EALIAAALERRHERWRVVWERAI

SEQ ID NO: 1298135 - protein, 18 aa, Mycobacterium
EALLEHKVIFFRGQHHLD

SEQ ID NO: 1298136 - protein, 27 aa, Mycobacterium
EALRLGHNYIGTEHLLLALLESEDTDG

SEQ ID NO: 1298137 - protein, 19 aa, Mycobacterium
EALVESALWEASLFEEHGF

SEQ ID NO: 1298138 - protein, 25 aa, Mycobacterium
EALVGRPRMLILDEPLAALDMRSQH

SEQ ID NO: 1298139 - protein, 22 aa, Mycobacterium
EALYELEIAFAEIARLCGGSGP

SEQ ID NO: 1298140 - protein, 19 aa, Mycobacterium
EALYLAKRIDKVSGEGETV

SEQ ID NO: 1298141 - protein, 19 aa, Mycobacterium
EAMFYPEFSLWCGTTATAD

SEQ ID NO: 1298142 - protein, 23 aa, Mycobacterium
EANLGRVYRKLGVRGRVALARRL

SEQ ID NO: 1298143 - protein, 28 aa, Mycobacterium
EANRAWRLYRRLGFSDVIRGYHFAGDPR

SEQ ID NO: 1298144 - protein, 28 aa, Mycobacterium
EAPLYYNEKLDFWGLSRFADVESALRDV

SEQ ID NO: 1298145 - protein, 30 aa, Mycobacterium
EAPSHGWRKWLYLATFKLVNIGESPKAAQQ

SEQ ID NO: 1298146 - protein, 27 aa, Mycobacterium
EAQISKPMLYLYYGSKEDLFGACLDRE

SEQ ID NO: 1298147 - protein, 32 aa, Mycobacterium; identical to SEQ ID NO: 806086

SEQ ID NO: 1298148 - protein, 21 aa, Mycobacterium
EARELLAVAQRKRKILGDIEK

SEQ ID NO: 1298149 - protein, 27 aa, Mycobacterium
EARKGFFRVPLIGGTIVHPVQGEAAAG

SEQ ID NO: 1298150 - protein, 21 aa, Mycobacterium
EARRLITALAGLVTASAEYLG

SEQ ID NO: 1298151 - protein, 19 aa, Mycobacterium
EARWRRQPGDVPGLARLQR

SEQ ID NO: 1298152 - protein, 17 aa, Mycobacterium
EASLWMEQFRGEVTASM

SEQ ID NO: 1298153 - protein, 22 aa, Mycobacterium
EASPIRFSLFQPVDDSARQLWQ

SEQ ID NO: 1298154 - protein, 32 aa, Mycobacterium
EASWESLPAILFQSGFRQLLSPELRLVQSCSA

SEQ ID NO: 1298155 - protein, 17 aa, Mycobacterium
EATLWRREQRHLEDAER

SEQ ID NO: 1298156 - protein, 24 aa, Mycobacterium
EAVAAFARLWVADEHWAAADRVMK

SEQ ID NO: 1298157 - protein, 23 aa, Mycobacterium
EAVIKAWSGSRFAKRPALPEGIH

SEQ ID NO: 1298158 - protein, 25 aa, Mycobacterium
EAVMLAGLAMKWRWRQRLGGDAWKG

SEQ ID NO: 1298159 - protein, 23 aa, Mycobacterium
EAVMRRAPLTLAHVVAAVATSSP

SEQ ID NO: 1298160 - protein, 26 aa, Mycobacterium
EAVTGIDLPAWMFRLARGESDVLAPH

SEQ ID NO: 1298161 - protein, 23 aa, Mycobacterium
ECGGAQLILRTPAGLDGGSDFRR

SEQ ID NO: 1298162 - protein, 23 aa, Mycobacterium
ECGRRMVVQVRPDGWWAKCSRHG

SEQ ID NO: 1298163 - protein, 19 aa, Mycobacterium
ECHGLQCGFCTPGFVTSIT

SEQ ID NO: 1298164 - protein, 17 aa, Mycobacterium
ECQSLVFRHGLQLFGAM

SEQ ID NO: 1298165 - protein, 24 aa, Mycobacterium
ECTGYIVQLPLPKHLDENAALERI

SEQ ID NO: 1298166 - protein, 26 aa, Mycobacterium
ECVPPNALPWLRGVYDRYVIVGAGKT

SEQ ID NO: 1298167 - protein, 23 aa, Mycobacterium
EDAALICVPPYHIAGVGAAMSNL

SEQ ID NO: 1298168 - protein, 31 aa, Mycobacterium
EDAEPLFNLFQAMPIPYIEPEDMANLGVFLA

SEQ ID NO: 1298169 - protein, 19 aa, Mycobacterium
EDAQRWHALALATTSADIL

SEQ ID NO: 1298170 - protein, 27 aa, Mycobacterium
EDARRERMFPSWVPLPVSELAVGRAVR

SEQ ID NO: 1298171 - protein, 24 aa, Mycobacterium
EDCDFLARKLAFTNSALVVSANYR

SEQ ID NO: 1298172 - protein, 22 aa, Mycobacterium
EDDLRLLPRYVRTIHSWQLSRV

SEQ ID NO: 1298173 - protein, 25 aa, Mycobacterium
EDESPIVFLRLRKAVRKQGLQVLSV

SEQ ID NO: 1298174 - protein, 23 aa, Mycobacterium
EDFAHVMRRLWHGELIFNHDGPL

SEQ ID NO: 1298175 - protein, 34 aa, Mycobacterium
EDFDATFAVNVRGPLFVTQAFLPHLSEGASIVNV

SEQ ID NO: 1298176 - protein, 17 aa, Mycobacterium
EDGLRRIYDGFLAVAHC

SEQ ID NO: 1298177 - protein, 18 aa, Mycobacterium
EDGWIRAVGYHEAVAGPL

SEQ ID NO: 1298178 - protein, 18 aa, Mycobacterium
EDGYLFIGGRSDDTIIRG

SEQ ID NO: 1298179 - protein, 24 aa, Mycobacterium
EDIGALIRRHMLDYGLPVEACNPE

SEQ ID NO: 1298180 - protein, 27 aa, Mycobacterium
EDIRLAIVAFGPQTLALGGRAFDDVIL

SEQ ID NO: 1298181 - protein, 23 aa, Mycobacterium
EDKAWYIEHRFLSTERAKAVTRG

SEQ ID NO: 1298182 - protein, 25 aa, Mycobacterium
EDLMDYLGLHNLKLQMTCQLGGGTH

SEQ ID NO: 1298183 - protein, 18 aa, Mycobacterium
EDLMRQRIISLDSVEITV

SEQ ID NO: 1298184 - protein, 21 aa, Mycobacterium
EDLPPPRVFGPLSIDVAAREV

SEQ ID NO: 1298185 - protein, 27 aa, Mycobacterium
EDLTRPGRMWWSVPPGKQTFHTWQETT

SEQ ID NO: 1298186 - protein, 17 aa, Mycobacterium
EDLVRIESVWADPARRD

SEQ ID NO: 1298187 - protein, 24 aa, Mycobacterium
EDMENYLILGACNPPLAHRAIGVD

SEQ ID NO: 1298188 - protein, 22 aa, Mycobacterium
EDPARFVANALSPAKVVSVSVI

SEQ ID NO: 1298189 - protein, 20 aa, Mycobacterium
EDPAWLLFTSGSTGTPKGVV

SEQ ID NO: 1298190 - protein, 24 aa, Mycobacterium
EDPLGFPYEFFYDVVHVERMAWRY

SEQ ID NO: 1298191 - protein, 26 aa, Mycobacterium
EDPYNWTDGLLFALGGPIYAGTNEIQ

SEQ ID NO: 1298192 - protein, 25 aa, Mycobacterium
EDRATLRISSQLLANWLRHGVITEE

SEQ ID NO: 1298193 - protein, 19 aa, Mycobacterium
EDRAVLHTALRLPRDASLT

SEQ ID NO: 1298194 - protein, 23 aa, Mycobacterium
EDRFLVAVTFRIGRLGVPVVAEF

SEQ ID NO: 1298195 - protein, 23 aa, Mycobacterium
EDRRGFMDLVLKPLQDKKETLYV

SEQ ID NO: 1298196 - protein, 38 aa, Mycobacterium
EDSDIFRLHKYLIGLRRRHPWLHWATTSAVQLTNRQYV

SEQ ID NO: 1298197 - protein, 23 aa, Mycobacterium
EDTVGRLLETIRLGVLAPGESLP

SEQ ID NO: 1298198 - protein, 25 aa, Mycobacterium
EDVAKLTYYGLYALQHRGQEAAGIA

SEQ ID NO: 1298199 - protein, 27 aa, Mycobacterium
EDVANAVVWLAGPKARYITGTALPVDA

SEQ ID NO: 1298200 - protein, 24 aa, Mycobacterium
EDVFPLPRELVGEGSLFLLKVVGD

SEQ ID NO: 1298201 - protein, 31 aa, Mycobacterium
EDVRPLEILGATVLPLQPVLEAWTDRPHPQT

SEQ ID NO: 1298202 - protein, 30 aa, Mycobacterium
EDVVTVPQWRVLVLIYTRGPMNLASVAAEL

SEQ ID NO: 1298203 - protein, 19 aa, Mycobacterium
EEAASLLERARSAGIPVIH

SEQ ID NO: 1298204 - protein, 19 aa, Mycobacterium
EEAKRRGIAGDFTVFKCAS

SEQ ID NO: 1298205 - protein, 21 aa, Mycobacterium
EEAMDLYPMARRVLLTAYADT

SEQ ID NO: 1298206 - protein, 31 aa, Mycobacterium
EEDPALFPELNGLFHLALRGAARNAVIESTL

SEQ ID NO: 1298207 - protein, 17 aa, Mycobacterium
EEFVEFAQFAEGLGFAG

SEQ ID NO: 1298208 - protein, 28 aa, Mycobacterium
EEGAICVKLPLPPGTLPTLWGDDDRYIA

SEQ ID NO: 1298209 - protein, 24 aa, Mycobacterium
EEGDIWRMPIVKDAPIRDWVKLAV

SEQ ID NO: 1298210 - protein, 31 aa, Mycobacterium
EEGDRGVSWLPFFHDMGLITIMISPMIGHYI

SEQ ID NO: 1298211 - protein, 20 aa, Mycobacterium
EEHAAEPKGGRPGPTDQGGE

SEQ ID NO: 1298212 - protein, 26 aa, Mycobacterium
EEHHCGRMFIFIGAEPRTDWLDGIVV

SEQ ID NO: 1298213 - protein, 22 aa, Mycobacterium
EEICAWIRMRPGRPPLTAEAVR

SEQ ID NO: 1298214 - protein, 39 aa, Mycobacterium
EEIVRQLRLRDIGGIIVIDFIDMVLESNRDLVLRRLTEA

SEQ ID NO: 1298215 - protein, 24 aa, Mycobacterium
EEKVTGIFLVPAQWQAVCAAQRAK

SEQ ID NO: 1298216 - protein, 25 aa, Mycobacterium
EELADLLWRMGIRTIGQFSALSRTD

SEQ ID NO: 1298217 - protein, 26 aa, Mycobacterium
EELGIDVFLVMPFTADFMKLTPERYI

SEQ ID NO: 1298218 - protein, 17 aa, Mycobacterium
EELLRWLSIVHSGIPRI

SEQ ID NO: 1298219 - protein, 29 aa, Mycobacterium
EEMGLSNVILMLPFVRRVAEADLVLQTMA

SEQ ID NO: 1298220 - protein, 27 aa, Mycobacterium
EEMIDELLRGFLDWLFERYHQIVATEP

SEQ ID NO: 1298221 - protein, 30 aa, Mycobacterium
EEMTPPALIKAILKAPVDLLWNGGIGTYVK

SEQ ID NO: 1298222 - protein, 24 aa, Mycobacterium
EEMYKYLVAMSREPEHDKIRAYCE

SEQ ID NO: 1298223 - protein, 26 aa, Mycobacterium
EEPANQGAWPTFGLTLPEMLPDHFTG

SEQ ID NO: 1298224 - protein, 23 aa, Mycobacterium
EEPTAPREPLPPKPDQGGPDLRT

SEQ ID NO: 1298225 - protein, 25 aa, Mycobacterium
EEQMAALLEMFQYFTALTASRREHP

SEQ ID NO: 1298226 - protein, 26 aa, Mycobacterium
EERDFPATSVRFFASARSQGRKLPFR

SEQ ID NO: 1298227 - protein, 23 aa, Mycobacterium
EERHAALLLAFERATTGFGWSRP

SEQ ID NO: 1298228 - protein, 28 aa, Mycobacterium
EERHDFYVLDEFTYPLKWGWVDVDEVVE

SEQ ID NO: 1298229 - protein, 18 aa, Mycobacterium
EERRLAYVGITRARQRLY

SEQ ID NO: 1298230 - protein, 23 aa, Mycobacterium
EERRLLYVALTRAEDTLLLSGHH

SEQ ID NO: 1298231 - protein, 24 aa, Mycobacterium
EESEALVLRFSIAPRPSMRSRRRR

SEQ ID NO: 1298232 - protein, 23 aa, Mycobacterium
EETPWPIIEEAAKVGLYTPELFA

SEQ ID NO: 1298233 - protein, 28 aa, Mycobacterium
EETRKLPHTILMYPMTVASQVASIVIHF

SEQ ID NO: 1298234 - protein, 25 aa, Mycobacterium
EEVASYLFHAYGTNLQFAPGEFNFV

SEQ ID NO: 1298235 - protein, 19 aa, Mycobacterium
EEVEVLRLSALRGLFSTVT

SEQ ID NO: 1298236 - protein, 22 aa, Mycobacterium
EEVKHFFVHYKDLEPNKYVKAA

SEQ ID NO: 1298237 - protein, 25 aa, Mycobacterium
EEVVLRLRALLRRTGVSESGGAKIV

SEQ ID NO: 1298238 - protein, 23 aa, Mycobacterium
EEWGRLIVPAAPPDRARATMVLE

SEQ ID NO: 1298239 - protein, 26 aa, Mycobacterium
EEYAKTFTGPLPLPPSKHVAVVACMD

SEQ ID NO: 1298240 - protein, 26 aa, Mycobacterium
EEYILPVGGGFFFMLPGVTGEDRFLG

SEQ ID NO: 1298241 - protein, 18 aa, Mycobacterium
EEYLLSSVARRLQGKSKE

SEQ ID NO: 1298242 - protein, 18 aa, Mycobacterium
EFAVLSRQVAVGGQLLEL

SEQ ID NO: 1298243 - protein, 19 aa, Mycobacterium
EFEGFTAIRQWAKQFYPDG

SEQ ID NO: 1298244 - protein, 18 aa, Mycobacterium
EFEPNRRIAWTILGQIRP

SEQ ID NO: 1298245 - protein, 19 aa, Mycobacterium
EFFGLWQDPTRTYSSAFFE

SEQ ID NO: 1298246 - protein, 26 aa, Mycobacterium
EFFIRKAIGWALRQYARTDPTWVLRF

SEQ ID NO: 1298247 - protein, 24 aa, Mycobacterium
EFGEEALRRNLENLDWLGVKARAH

SEQ ID NO: 1298248 - protein, 20 aa, Mycobacterium
EFIELIAVGTTYDLAAAAAI

SEQ ID NO: 1298249 - protein, 17 aa, Mycobacterium
EFLPLDDDVFPAVRLAR

SEQ ID NO: 1298250 - protein, 18 aa, Mycobacterium
EFLPQLPSFTLTSESVTD

SEQ ID NO: 1298251 - protein, 24 aa, Mycobacterium
EFLRLEADWEAGYLLTVRSAWQAD

SEQ ID NO: 1298252 - protein, 27 aa, Mycobacterium
EFMTDFAKPLSMLVIADLLGVPLEDHD

SEQ ID NO: 1298253 - protein, 25 aa, Mycobacterium
EFMVFDDSFRAAWAAGYRGLTAATD

SEQ ID NO: 1298254 - protein, 20 aa, Mycobacterium
EFNVPFVPLDTLSTQFDRVR

SEQ ID NO: 1298255 - protein, 24 aa, Mycobacterium
EFPQDNPWVQKEIRWKAELAEKLA

SEQ ID NO: 1298256 - protein, 24 aa, Mycobacterium
EFREALALLAGGRHLFLTGKAGTG

SEQ ID NO: 1298257 - protein, 20 aa, Mycobacterium
EFRTYRFRAHSMFDPELYRD

SEQ ID NO: 1298258 - protein, 23 aa, Mycobacterium
EGADDRVDWSSEGGATPSGPADT

SEQ ID NO: 1298259 - protein, 22 aa, Mycobacterium
EGADLHSWFAERGISYGQAFSG

SEQ ID NO: 1298260 - protein, 18 aa, Mycobacterium
EGAGLFVLQRKSGAVRDG

SEQ ID NO: 1298261 - protein, 22 aa, Mycobacterium
EGDNVFVALSWSKHPAPQNYEE

SEQ ID NO: 1298262 - protein, 18 aa, Mycobacterium
EGDPRLFYVGRTSELIKA

SEQ ID NO: 1298263 - protein, 20 aa, Mycobacterium
EGFALLARLQPRLAALVAPS

SEQ ID NO: 1298264 - protein, 17 aa, Mycobacterium
EGFFLDRRDPNNLLAML

SEQ ID NO: 1298265 - protein, 20 aa, Mycobacterium
EGFKPIHDLGGFLTSASTFD

SEQ ID NO: 1298266 - protein, 26 aa, Mycobacterium
EGFPTPAEFFAAFNAAIAGVLPGLNA

SEQ ID NO: 1298267 - protein, 30 aa, Mycobacterium
EGGGLGLLTPPPWYPILRGTTQQALFEVAR

SEQ ID NO: 1298268 - protein, 17 aa, Mycobacterium
EGGGRLVVELTPDEAAA

SEQ ID NO: 1298269 - protein, 22 aa, Mycobacterium
EGGNFVVPVWRSMYEAMQPGGY

SEQ ID NO: 1298270 - protein, 32 aa, Mycobacterium
EGGQMPIHMRLPKLKGFRNRFRTEYAVINVGD

SEQ ID NO: 1298271 - protein, 33 aa, Mycobacterium
EGGWVLEQPIGPTPLIAPLELLAYAAACTTRLR

SEQ ID NO: 1298272 - protein, 24 aa, Mycobacterium
EGGWVVPHLPTPWGRGAGPVEQIL

SEQ ID NO: 1298273 - protein, 24 aa, Mycobacterium
EGGYELTLWARRPASLEPYADTAA

SEQ ID NO: 1298274 - protein, 22 aa, Mycobacterium
EGHAAKLLNLRSTLLTLAGGDA

SEQ ID NO: 1298275 - protein, 33 aa, Mycobacterium
EGHIGRLFATMKPYMPPPPPGASPPPLWGREEH

SEQ ID NO: 1298276 - protein, 27 aa, Mycobacterium
EGHRALFANRDLLPGALASLADPHVAG

SEQ ID NO: 1298277 - protein, 24 aa, Mycobacterium
EGHTHPFLGAFLTSGVDLQVPTLA

SEQ ID NO: 1298278 - protein, 24 aa, Mycobacterium
EGKEPVLYVVGRKALSYYSFRNWD

SEQ ID NO: 1298279 - protein, 25 aa, Mycobacterium
EGLATVIPFHRAVVSDPAFIGDENG

SEQ ID NO: 1298280 - protein, 19 aa, Mycobacterium
EGLELLLARDWSEQFVIGG

SEQ ID NO: 1298281 - protein, 18 aa, Mycobacterium
EGLGQLYVRLLTANFEEA

SEQ ID NO: 1298282 - protein, 19 aa, Mycobacterium
EGLHIRDGVLRRPAGNGLG

SEQ ID NO: 1298283 - protein, 22 aa, Mycobacterium
EGLLVALRRAFTGQVTGLLDAV

SEQ ID NO: 1298284 - protein, 25 aa, Mycobacterium
EGLPVGSALLVVKRGPNAGSRFLLD

SEQ ID NO: 1298285 - protein, 20 aa, Mycobacterium
EGLRDGQVLLRFLSAGICGS

SEQ ID NO: 1298286 - protein, 31 aa, Mycobacterium
EGNTGMPASGDLPPLLVRSDGAGKLVVTTDA

SEQ ID NO: 1298287 - protein, 19 aa, Mycobacterium
EGPAPWKAWGTGEVVLPWP

SEQ ID NO: 1298288 - protein, 19 aa, Mycobacterium
EGPDGTLLRVRARWCIGAD

SEQ ID NO: 1298289 - protein, 24 aa, Mycobacterium
EGQGFIQLMTQLPQERLIVAVGAV

SEQ ID NO: 1298290 - protein, 17 aa, Mycobacterium
EGQWRVVDATCLAPRQS

SEQ ID NO: 1298291 - protein, 17 aa, Mycobacterium
EGRFDLVSAQFFHSPLD

SEQ ID NO: 1298292 - protein, 17 aa, Mycobacterium
EGRFKEEIVPIDTPYGL

SEQ ID NO: 1298293 - protein, 33 aa, Mycobacterium
EGRINPDVKMNYLASPPLVIAYALAGSMDFDFE

SEQ ID NO: 1298294 - protein, 26 aa, Mycobacterium
EGRKRPVMLLTSDSAFLFHIAELETA

SEQ ID NO: 1298295 - protein, 21 aa, Mycobacterium
EGRVLLERLLARTTAITIDEA

SEQ ID NO: 1298296 - protein, 32 aa, Mycobacterium
EGSGFTYWPEGPLKAPQRLLPPVYNRGVVVQN

SEQ ID NO: 1298297 - protein, 24 aa, Mycobacterium
EGSRGISCFLIPGGQPGLSFGKPE

SEQ ID NO: 1298298 - protein, 30 aa, Mycobacterium
EGTLGVITAVDLRLHPPARHRITALCGFSD

SEQ ID NO: 1298299 - protein, 20 aa, Mycobacterium
EGTLRGRVLLAERLGRNIEL

SEQ ID NO: 1298300 - protein, 30 aa, Mycobacterium
EGTSPECAFWNLCLWNPFLHTYDYTYERVT

SEQ ID NO: 1298301 - protein, 20 aa, Mycobacterium
EGVHLALGAAGYLEREWKSE

SEQ ID NO: 1298302 - protein, 23 aa, Mycobacterium
EGVHLRFGYVARGGLRWSDRRED

SEQ ID NO: 1298303 - protein, 25 aa, Mycobacterium
EGVHTLPVLYALRESGPDTDRLREL

SEQ ID NO: 1298304 - protein, 18 aa, Mycobacterium
EGVKGKAKEVAGAVLGRD

SEQ ID NO: 1298305 - protein, 19 aa, Mycobacterium
EGWGHRTVGLGLTQKLRRD

SEQ ID NO: 1298306 - protein, 19 aa, Mycobacterium
EGYPEWWLSGRPVQTGVST

SEQ ID NO: 1298307 - protein, 25 aa, Mycobacterium
EGYYQLRGGIPYAIAKQLAAAPFAD

SEQ ID NO: 1298308 - protein, 24 aa, Mycobacterium
EHAAIQLAVYRLAWAQLSGCPVER

SEQ ID NO: 1298309 - protein, 32 aa, Mycobacterium
EHEQSLVERLIPDFLWISTEYTAKLSLDGLES

SEQ ID NO: 1298310 - protein, 29 aa, Mycobacterium
EHFGVQWQLVRRLVTIVEFSFAARCTVQR

SEQ ID NO: 1298311 - protein, 17 aa, Mycobacterium
EHGRIKTTEPKARALRP

SEQ ID NO: 1298312 - protein, 26 aa, Mycobacterium
EHGRTFYLATRLLAPEQRPAVHALYG

SEQ ID NO: 1298313 - protein, 25 aa, Mycobacterium
EHHPPMRTFLGVPIRIRDEVFGNLY

SEQ ID NO: 1298314 - protein, 19 aa, Mycobacterium
EHHYKKNALLRQLRSWRPD

SEQ ID NO: 1298315 - protein, 24 aa, Mycobacterium
EHIATLIPDEWLAPAATGSARQCV

SEQ ID NO: 1298316 - protein, 22 aa, Mycobacterium
EHLPDWQPCPGGGGLALWVRLP

SEQ ID NO: 1298317 - protein, 26 aa, Mycobacterium
EHLRQSLPELPWLRRNRIQQEWGISD

SEQ ID NO: 1298318 - protein, 17 aa, Mycobacterium
EHLYEMDYLKEGIGLRA

SEQ ID NO: 1298319 - protein, 24 aa, Mycobacterium
EHPEDWHMMQPQWIADLSDARRAR

SEQ ID NO: 1298320 - protein, 35 aa, Mycobacterium
EHQNRPDFPPTLMGRLLLEAGVTPWITLSCRDRNR

SEQ ID NO: 1298321 - protein, 28 aa, Mycobacterium
EHREQLDWVFETFPRLAERRSQVGGTLS

SEQ ID NO: 1298322 - protein, 23 aa, Mycobacterium
EHRRRIGELWAQFSAVAADNPHA

SEQ ID NO: 1298323 - protein, 23 aa, Mycobacterium
EHSEWGFAGYVRHFIDKPTIAAV

SEQ ID NO: 1298324 - protein, 23 aa, Mycobacterium
EHSPRIPEWPGMRSYPGEVSHSA

SEQ ID NO: 1298325 - protein, 24 aa, Mycobacterium
EHTRLRKIVSRLFTPRSVAALEEK

SEQ ID NO: 1298326 - protein, 18 aa, Mycobacterium
EHVAPMIMSGREIKGWLR

SEQ ID NO: 1298327 - protein, 28 aa, Mycobacterium
EHWEVVRIALPTALARYVVEKGSITVDG

SEQ ID NO: 1298328 - protein, 19 aa, Mycobacterium
EIAEQFQMPPALERAWHTH

SEQ ID NO: 1298329 - protein, 18 aa, Mycobacterium
EIARLLYRYARAVDSKDW

SEQ ID NO: 1298330 - protein, 23 aa, Mycobacterium
EIARRVFSTCRRLGIGTVAVYTE

SEQ ID NO: 1298331 - protein, 19 aa, Mycobacterium
EIDLDPYPVYRRLRDEAPL

SEQ ID NO: 1298332 - protein, 32 aa, Mycobacterium; identical to SEQ ID NO: 807694

SEQ ID NO: 1298333 - protein, 25 aa, Mycobacterium
EIDWDTSGLRLANKLTPWPARNGER

SEQ ID NO: 1298334 - protein, 22 aa, Mycobacterium
EIEQGILKMPGLQQLFNPDLKL

SEQ ID NO: 1298335 - protein, 18 aa, Mycobacterium
EIFVYSPRVEGVHLRFGY

SEQ ID NO: 1298336 - protein, 24 aa, Mycobacterium
EIGLAGTLNLRRTGLRLLTMLRPE

SEQ ID NO: 1298337 - protein, 23 aa, Mycobacterium
EIGNGWHQVTAELGFERSGPERI

SEQ ID NO: 1298338 - protein, 24 aa, Mycobacterium
EIGPTLHRLIRGADGRVIVACFAS

SEQ ID NO: 1298339 - protein, 24 aa, Mycobacterium
EIKAKGLPLTMSRVRFIKFIMDEI

SEQ ID NO: 1298340 - protein, 18 aa, Mycobacterium
EIKLIFNELADQIPDIAK

SEQ ID NO: 1298341 - protein, 18 aa, Mycobacterium
EILAQTRHFVRSAVVPRE

SEQ ID NO: 1298342 - protein, 24 aa, Mycobacterium
EILEYHWGRHWVVWDAEDTFQQRG

SEQ ID NO: 1298343 - protein, 19 aa, Mycobacterium
EILLRIFDDGDFLEVAGQA

SEQ ID NO: 1298344 - protein, 21 aa, Mycobacterium
EILRLLLGHPAYSDGRLTIGA

SEQ ID NO: 1298345 - protein, 23 aa, Mycobacterium
EIMRFCQSFMTELYRHIGEYTDV

SEQ ID NO: 1298346 - protein, 25 aa, Mycobacterium
EINGRPRLLCMTRMSTFGESETVTV

SEQ ID NO: 1298347 - protein, 24 aa, Mycobacterium
EINHDPFLPLLLAAEHTTRLEVGT

SEQ ID NO: 1298348 - protein, 18 aa, Mycobacterium
EIPGRLHHPMWVENQTID

SEQ ID NO: 1298349 - protein, 44 aa, Mycobacterium
EIPNGVDVAFFADAPRLDGYPRPGRTVLFLGRYDEPRKGMNVLL

SEQ ID NO: 1298350 - protein, 25 aa, Mycobacterium
EISDLGIVGDLFKVTPQLTEKVKAR

SEQ ID NO: 1298351 - protein, 21 aa, Mycobacterium
EISTGPYRFVYRKRFHKRAET

SEQ ID NO: 1298352 - protein, 28 aa, Mycobacterium
EISWGDVGLMLSVPRQGLGNAAISGVAT

SEQ ID NO: 1298353 - protein, 24 aa, Mycobacterium
EITLALNTLFDLALSPVIGPLLDS

SEQ ID NO: 1298354 - protein, 24 aa, Mycobacterium
EITSFKVMLRPFKALQTVIPKMAE

SEQ ID NO: 1298355 - protein, 18 aa, Mycobacterium
EIVFKFVAGLPVYLVAKL

SEQ ID NO: 1298356 - protein, 18 aa, Mycobacterium
EIVLMELGLDWDRIEALK

SEQ ID NO: 1298357 - protein, 19 aa, Mycobacterium
EIVPGVPAFAAAAAALGHE

SEQ ID NO: 1298358 - protein, 22 aa, Mycobacterium
EIVTWMSVAPALRDGWEDSILQ

SEQ ID NO: 1298359 - protein, 20 aa, Mycobacterium
EIYGIGGSWFRLAAVGEDES

SEQ ID NO: 1298360 - protein, 21 aa, Mycobacterium
EKFPLVMSIMSTGVTFVRAEE

SEQ ID NO: 1298361 - protein, 30 aa, Mycobacterium; identical to SEQ ID NO: 807993

SEQ ID NO: 1298362 - protein, 25 aa, Mycobacterium
EKPLTVKLHRLIGEGDTVVALTELT

SEQ ID NO: 1298363 - protein, 23 aa, Mycobacterium
EKQQKEFLLRQQLAAIRKELGEL

SEQ ID NO: 1298364 - protein, 35 aa, Mycobacterium
EKSLPYTQWIAGALNMMPRWYIGSILRNVDFLCSD

SEQ ID NO: 1298365 - protein, 32 aa, Mycobacterium; identical to SEQ ID NO: 119826

SEQ ID NO: 1298366 - protein, 24 aa, Mycobacterium
EKYKALMDARVPLYRRVATMRVNT

SEQ ID NO: 1298367 - protein, 21 aa, Mycobacterium
ELAATLVWLASDAGGYVTGQT

SEQ ID NO: 1298368 - protein, 20 aa, Mycobacterium
ELALAWLTRGDLNIAAGWMN

SEQ ID NO: 1298369 - protein, 18 aa, Mycobacterium
ELALEALYLAKRIDKVSG

SEQ ID NO: 1298370 - protein, 27 aa, Mycobacterium
ELALRQGKLLASRLLHWARSGHLTVPR

SEQ ID NO: 1298371 - protein, 23 aa, Mycobacterium
ELALRVRSVLRRSPTPVGVTPVD

SEQ ID NO: 1298372 - protein, 25 aa, Mycobacterium
ELARLYPAMLRRETNRHHGSGTPIG

SEQ ID NO: 1298373 - protein, 17 aa, Mycobacterium
ELCFPGDRPLPQHHTRV

SEQ ID NO: 1298374 - protein, 29 aa, Mycobacterium
ELDASRPFFPFLVDLLDAWVAYFAEHPRE

SEQ ID NO: 1298375 - protein, 21 aa, Mycobacterium
ELDICIMLPSDRALPAMVPTG

SEQ ID NO: 1298376 - protein, 25 aa, Mycobacterium
ELDRLQRHYSGRPSPLYEATRLSEH

SEQ ID NO: 1298377 - protein, 23 aa, Mycobacterium
ELDTELIFRPLRNTARVASNAVS

SEQ ID NO: 1298378 - protein, 24 aa, Mycobacterium
ELDVSLLSTAWWAAGASVTQGMET

SEQ ID NO: 1298379 - protein, 29 aa, Mycobacterium
ELEHHANLIPWQELARRTGATLKWYSVTD

SEQ ID NO: 1298380 - protein, 24 aa, Mycobacterium
ELEKRRHHVPWVTWGTTSMVARSV

SEQ ID NO: 1298381 - protein, 17 aa, Mycobacterium
ELEREVMDHLWSAREPQ

SEQ ID NO: 1298382 - protein, 22 aa, Mycobacterium
ELESLFYGYGYRPITVAGDDPD

SEQ ID NO: 1298383 - protein, 21 aa, Mycobacterium
ELFNLRFQMATGQLSNNRRLR

SEQ ID NO: 1298384 - protein, 18 aa, Mycobacterium
ELFTALLLSLPGSPVLYY

SEQ ID NO: 1298385 - protein, 19 aa, Mycobacterium
ELGDILDVGLRSSYVAAWY

SEQ ID NO: 1298386 - protein, 21 aa, Mycobacterium
ELGHPWTVLRADRSTDFLVLE

SEQ ID NO: 1298387 - protein, 22 aa, Mycobacterium
ELGLSYLLPRAIGSSRAFEIML

SEQ ID NO: 1298388 - protein, 25 aa, Mycobacterium
ELGPIRPPQRLAPYSYALGAEIRHP

SEQ ID NO: 1298389 - protein, 24 aa, Mycobacterium
ELGPSWVRVNGIRPGLIQTDLVGP

SEQ ID NO: 1298390 - protein, 25 aa, Mycobacterium
ELGQPLPLFIKWDDAEYGLRAAEQG

SEQ ID NO: 1298391 - protein, 27 aa, Mycobacterium
ELGRNLVPTPLLGTTLAELALLSSDEP

SEQ ID NO: 1298392 - protein, 22 aa, Mycobacterium
ELGVSHLYLSPILTAVEGSTHG

SEQ ID NO: 1298393 - protein, 19 aa, Mycobacterium
ELHLVRPLGFDLSEPKLRR

SEQ ID NO: 1298394 - protein, 24 aa, Mycobacterium
ELIAQGFDYLLYTGGTEIGRKVYE

SEQ ID NO: 1298395 - protein, 19 aa, Mycobacterium
ELIARIRAVLRRGTDVDDP

SEQ ID NO: 1298396 - protein, 26 aa, Mycobacterium
ELICRGTVWSLRREARKPGSAFWLKG

SEQ ID NO: 1298397 - protein, 17 aa, Mycobacterium
ELIELRRLLYCGEWIHS

SEQ ID NO: 1298398 - protein, 17 aa, Mycobacterium
ELITVRGRRLLAQADVV

SEQ ID NO: 1298399 - protein, 25 aa, Mycobacterium
ELKKHFRPEFLNRIDDIIVFHQLTQ

SEQ ID NO: 1298400 - protein, 19 aa, Mycobacterium
ELKRLGHVAVMPLGVELRG

SEQ ID NO: 1298401 - protein, 36 aa, Mycobacterium
ELKSRPTRPHPLFAAFIGAALDYKAAERLPVEIPEQ

SEQ ID NO: 1298402 - protein, 19 aa, Mycobacterium
ELLARMRALLRRTSPDEGP

SEQ ID NO: 1298403 - protein, 29 aa, Mycobacterium
ELLEFVRPRHKMVLITHRADGSLQSSPVT

SEQ ID NO: 1298404 - protein, 17 aa, Mycobacterium
ELLESTGARIREVGTTN

SEQ ID NO: 1298405 - protein, 17 aa, Mycobacterium
ELLTRTDYRAGCPVVAV

SEQ ID NO: 1298406 - protein, 20 aa, Mycobacterium
ELMFGIWAAEAVIVPVNYKL

SEQ ID NO: 1298407 - protein, 19 aa, Mycobacterium
ELNAFTAREHTCYYAHVLD

SEQ ID NO: 1298408 - protein, 24 aa, Mycobacterium
ELNGKPIILLTTVGAKSGKLRKTP

SEQ ID NO: 1298409 - protein, 28 aa, Mycobacterium
ELNLTYPQYLVLLVLWEEGPVTVGRLGE

SEQ ID NO: 1298410 - protein, 23 aa, Mycobacterium
ELPDRACWALQNLLTRRYISAET

SEQ ID NO: 1298411 - protein, 18 aa, Mycobacterium
ELPLMKKGLDAAERRARV

SEQ ID NO: 1298412 - protein, 18 aa, Mycobacterium
ELPPWLGDEAFHRSHRAA

SEQ ID NO: 1298413 - protein, 18 aa, Mycobacterium
ELPRDFLVETQPFTLENG

SEQ ID NO: 1298414 - protein, 32 aa, Mycobacterium
ELQRLRLATQLRAGLFGVLYVLDEPSAGLHPA

SEQ ID NO: 1298415 - protein, 17 aa, Mycobacterium
ELRAARRMGSKSPLLPL

SEQ ID NO: 1298416 - protein, 20 aa, Mycobacterium
ELRAIFGELLGIPVPNLIAG

SEQ ID NO: 1298417 - protein, 20 aa, Mycobacterium
ELRCDGLRMTVGGPDASAVT

SEQ ID NO: 1298418 - protein, 23 aa, Mycobacterium
ELRKTIVFVTHDFGEAVKLGDRI

SEQ ID NO: 1298419 - protein, 17 aa, Mycobacterium
ELRLHSVSSVFAALAPD

SEQ ID NO: 1298420 - protein, 25 aa, Mycobacterium
ELRLQRIFVLTFEVEFFARHGFAEI

SEQ ID NO: 1298421 - protein, 19 aa, Mycobacterium
ELRQLCDALMRAARAADGW

SEQ ID NO: 1298422 - protein, 18 aa, Mycobacterium
ELRRIAALCAAFDVDGMR

SEQ ID NO: 1298423 - protein, 19 aa, Mycobacterium
ELSAVIWVATTINAFNRVS

SEQ ID NO: 1298424 - protein, 25 aa, Mycobacterium
ELSGSREWGATSAAFRDLLAEWKAA

SEQ ID NO: 1298425 - protein, 25 aa, Mycobacterium
ELSNGQPWGMSPWETSKYNARLNLA

SEQ ID NO: 1298426 - protein, 17 aa, Mycobacterium
ELSPGELDGLRRSAQTL

SEQ ID NO: 1298427 - protein, 19 aa, Mycobacterium
ELSWWTAPFEISAGIPQSA

SEQ ID NO: 1298428 - protein, 21 aa, Mycobacterium
ELTFHLCYGDSKFGASPFMGD

SEQ ID NO: 1298429 - protein, 17 aa, Mycobacterium
ELTGAGMMASKNALVEA

SEQ ID NO: 1298430 - protein, 18 aa, Mycobacterium
ELVAMVAGLVLALNGKPQ

SEQ ID NO: 1298431 - protein, 18 aa, Mycobacterium
ELVARIRAMLRRPRMRPV

SEQ ID NO: 1298432 - protein, 19 aa, Mycobacterium
ELVCRLNHAFLAGALDGLG

SEQ ID NO: 1298433 - protein, 22 aa, Mycobacterium
ELVGITPHPLQIGYYSTVHEGK

SEQ ID NO: 1298434 - protein, 22 aa, Mycobacterium
ELVGPQAWIVIEKILAVDEPLD

SEQ ID NO: 1298435 - protein, 30 aa, Mycobacterium; identical to SEQ ID NO: 783119

SEQ ID NO: 1298436 - protein, 24 aa, Mycobacterium
ELVPLVRRIWNLHEGPVRHEGRFY

SEQ ID NO: 1298437 - protein, 21 aa, Mycobacterium
ELVPPHMVPSHIALVEAVPFT

SEQ ID NO: 1298438 - protein, 27 aa, Mycobacterium
ELVSLTQILAWDLPLDAKLRTAVAEHA

SEQ ID NO: 1298439 - protein, 27 aa, Mycobacterium
ELVTRPPDILITTPESLFLMLTSAARD

SEQ ID NO: 1298440 - protein, 17 aa, Mycobacterium
ELWDVLRGLVEGGTTLL

SEQ ID NO: 1298441 - protein, 19 aa, Mycobacterium
ELWQRPDIAIALAQRYSAA

SEQ ID NO: 1298442 - protein, 25 aa, Mycobacterium
ELYGKPQFWPLWEAAADAGLPVAVH

SEQ ID NO: 1298443 - protein, 30 aa, Mycobacterium
ELYRRNGIQFLPFNTVYQLAVERADGLLDS

SEQ ID NO: 1298444 - protein, 20 aa, Mycobacterium
EMAYEGKVDWAFAELLALGT

SEQ ID NO: 1298445 - protein, 24 aa, Mycobacterium
EMDEAFAKAWYKLMHRDMGPISRY

SEQ ID NO: 1298446 - protein, 17 aa, Mycobacterium
EMFALQRELLEEWVAHQ

SEQ ID NO: 1298447 - protein, 25 aa, Mycobacterium
EMKPKMDVLDFWQIIKPELPGVRGL

SEQ ID NO: 1298448 - protein, 19 aa, Mycobacterium
EMLAMNPERQRTSRLSCQM

SEQ ID NO: 1298449 - protein, 18 aa, Mycobacterium
EMNSLFTELLPRLDHIEL

SEQ ID NO: 1298450 - protein, 17 aa, Mycobacterium
EMRAFPEELGKMGFVFN

SEQ ID NO: 1298451 - protein, 22 aa, Mycobacterium
EMRDLLTALDTLAGPAADAQRA

SEQ ID NO: 1298452 - protein, 18 aa, Mycobacterium
EMRPYIAEMARIADTFVS

SEQ ID NO: 1298453 - protein, 25 aa, Mycobacterium
EMRRRADAAGWLRYGLPEQFGGRGG

SEQ ID NO: 1298454 - protein, 24 aa, Mycobacterium
EMYDMYRLLALAKYDERYVIPTAY

SEQ ID NO: 1298455 - protein, 24 aa, Mycobacterium
ENEEFMWTLADRVLDPFLAQGGGE

SEQ ID NO: 1298456 - protein, 25 aa, Mycobacterium
ENEGLRQVFMGLNPERIMGAALGNG

SEQ ID NO: 1298457 - protein, 26 aa, Mycobacterium
ENFDSREACFLALLAEAYAGQVQQIS

SEQ ID NO: 1298458 - protein, 22 aa, Mycobacterium
ENGTGPFTFLFSESAGRVLVAV

SEQ ID NO: 1298459 - protein, 26 aa, Mycobacterium
ENHEGVYRFLLKRNRRLYGVAYTLDN

SEQ ID NO: 1298460 - protein, 20 aa, Mycobacterium
ENHTSWIRREPVGVIGQVAP

SEQ ID NO: 1298461 - protein, 25 aa, Mycobacterium
ENIEKFLRIMVWDQSLITPELVEER

SEQ ID NO: 1298462 - protein, 22 aa, Mycobacterium
ENIKRQWWRSVVTGRDDVVGLD

SEQ ID NO: 1298463 - protein, 23 aa, Mycobacterium
ENLTYPYGAYFCVVDVDPGTAVV

SEQ ID NO: 1298464 - protein, 25 aa, Mycobacterium
ENRLPAYRSIRIPTLVIGFADDVLL

SEQ ID NO: 1298465 - protein, 21 aa, Mycobacterium
ENRLPPVHMFAGINLSFGFMG

SEQ ID NO: 1298466 - protein, 26 aa, Mycobacterium
ENTSYPLLLHEPYVRLYPAQVIKQAD

SEQ ID NO: 1298467 - protein, 21 aa, Mycobacterium
ENWRASFDVDLMGTVGLVDAA

SEQ ID NO: 1298468 - protein, 20 aa, Mycobacterium
ENYAAPWELLEGVWARARGR

SEQ ID NO: 1298469 - protein, 29 aa, Mycobacterium
ENYNRYMKYLTGCQYYFIDESIDVSLVTY

SEQ ID NO: 1298470 - protein, 23 aa, Mycobacterium
ENYSWVMSPRWFDGNDHLALDTG

SEQ ID NO: 1298471 - protein, 23 aa, Mycobacterium
EPADLAVLSLLGPALADTPVLDA

SEQ ID NO: 1298472 - protein, 30 aa, Mycobacterium
EPARGLTYPAQKLHGLGKRAAWGGSGSRAV

SEQ ID NO: 1298473 - protein, 26 aa, Mycobacterium
EPCVGYAFYAPPRAVPRARLFPTGPV

SEQ ID NO: 1298474 - protein, 26 aa, Mycobacterium
EPDETLALLPLTPFIPRRAVKSTADV

SEQ ID NO: 1298475 - protein, 27 aa, Mycobacterium
EPDLMLLDEPFSALDTGLRASTRKAVA

SEQ ID NO: 1298476 - protein, 24 aa, Mycobacterium
EPDTPLSPGWRTEYPRFLAELAES

SEQ ID NO: 1298477 - protein, 18 aa, Mycobacterium
EPDYMVEFTIAGSSAPYH

SEQ ID NO: 1298478 - protein, 26 aa, Mycobacterium
EPEDISNAVLWLASDESRFVTGMQLR

SEQ ID NO: 1298479 - protein, 23 aa, Mycobacterium
EPEDLVLARWHGLGPMGGTDLDA

SEQ ID NO: 1298480 - protein, 30 aa, Mycobacterium
EPELDQLVGFFINILVLRNDLRGNPTLREV

SEQ ID NO: 1298481 - protein, 27 aa, Mycobacterium
EPFTRARPLLAPLARNTLLTPAESRKE

SEQ ID NO: 1298482 - protein, 24 aa, Mycobacterium
EPGGMMRYGIPSYRLPREVVDAEV

SEQ ID NO: 1298483 - protein, 22 aa, Mycobacterium
EPGIQMGFSDAGAHLRNMAFYN

SEQ ID NO: 1298484 - protein, 24 aa, Mycobacterium
EPGLPPLRCGLPRLPQGINPVSTF

SEQ ID NO: 1298485 - protein, 20 aa, Mycobacterium
EPHEFLRLVSEHRVTFLTTV

SEQ ID NO: 1298486 - protein, 22 aa, Mycobacterium
EPINALFDRWIRQYDRGRATSA

SEQ ID NO: 1298487 - protein, 32 aa, Mycobacterium
EPIPVYAEMSAVNPVFLLDGALAAGGADLGRA

SEQ ID NO: 1298488 - protein, 17 aa, Mycobacterium
EPKGGRPGPTDQGGEGG

SEQ ID NO: 1298489 - protein, 35 aa, Mycobacterium
EPLGVVGVITPWNFPMTIAAWGFAPALAAGNAVVL

SEQ ID NO: 1298490 - protein, 17 aa, Mycobacterium
EPLRRMSQHITTEPALW

SEQ ID NO: 1298491 - protein, 20 aa, Mycobacterium
EPLRTLPFPVGASHSLELRY

SEQ ID NO: 1298492 - protein, 30 aa, Mycobacterium
EPMHSGLIGTGLLDAVCPGPVFTSPNALQI

SEQ ID NO: 1298493 - protein, 25 aa, Mycobacterium
EPNKLRLPVQWVSRPTAEQRRRYTG

SEQ ID NO: 1298494 - protein, 17 aa, Mycobacterium
EPPGTRMRVALSALTMA

SEQ ID NO: 1298495 - protein, 21 aa, Mycobacterium
EPPLTYLTRWRMTVAADLLVD

SEQ ID NO: 1298496 - protein, 21 aa, Mycobacterium
EPPRRLRMAVAYGSAAAALPG

SEQ ID NO: 1298497 - protein, 24 aa, Mycobacterium
EPRENDIWLLGAIGPRMVYSTNLD

SEQ ID NO: 1298498 - protein, 34 aa, Mycobacterium
EPRNNFALSDAPRYLFLAGGVGITPILSMIESLR

SEQ ID NO: 1298499 - protein, 19 aa, Mycobacterium
EPRPMVYSGLYPVDGSDYP

SEQ ID NO: 1298500 - protein, 25 aa, Mycobacterium
EPRVLQIRALVLGTAMDWLVDNSAN

SEQ ID NO: 1298501 - protein, 26 aa, Mycobacterium
EPSAEVDVWFPGKKGGPGWVEWGGCG

SEQ ID NO: 1298502 - protein, 25 aa, Mycobacterium
EPTTGELTLWASTQTPHELRAFTAR

SEQ ID NO: 1298503 - protein, 36 aa, Mycobacterium
EPVGVCAGIIPWNFPLLLAVWKLGPALAAGNTVVLK

SEQ ID NO: 1298504 - protein, 19 aa, Mycobacterium
EPVVDLALQISNLPRHMGI

SEQ ID NO: 1298505 - protein, 31 aa, Mycobacterium
EPWRGEPLLNYLRRMVFWADVTIEPADLAVL

SEQ ID NO: 1298506 - protein, 23 aa, Mycobacterium
EPYAPVGIVPLFETIDDLQRGSS

SEQ ID NO: 1298507 - protein, 36 aa, Mycobacterium
EPYDRLLYVADFITQRLWAEPLLADALTRAYLCAES

SEQ ID NO: 1298508 - protein, 19 aa, Mycobacterium
EPYRRLVNQGYIQAFAYTD

SEQ ID NO: 1298509 - protein, 26 aa, Mycobacterium
EQAKGALMVIYRISADQAFRVLQWRS

SEQ ID NO: 1298510 - protein, 23 aa, Mycobacterium
EQAPWMGLTLAAMLGQIGLPGGG

SEQ ID NO: 1298511 - protein, 27 aa, Mycobacterium
EQARRLIVRGFFGEIISKIAVPAVRER

SEQ ID NO: 1298512 - protein, 22 aa, Mycobacterium
EQAVDLLVPTAAKPGKRIIGER

SEQ ID NO: 1298513 - protein, 23 aa, Mycobacterium
EQERLAFVDVLQRAARKAKAQTS

SEQ ID NO: 1298514 - protein, 22 aa, Mycobacterium
EQFPIWLHTYNHHRGHTALGGQ

SEQ ID NO: 1298515 - protein, 28 aa, Mycobacterium
EQGFACMVELLLKLRHCNPRIAEVPLVL

SEQ ID NO: 1298516 - protein, 27 aa, Mycobacterium
EQGPPPVTVVALYDILKSGPLAGLRLG

SEQ ID NO: 1298517 - protein, 18 aa, Mycobacterium
EQHILRDGVIPRRLVTSC

SEQ ID NO: 1298518 - protein, 20 aa, Mycobacterium
EQIGTRLGLWPSDIDLLSKM

SEQ ID NO: 1298519 - protein, 17 aa, Mycobacterium
EQKAKIFLALLGKQYGV

SEQ ID NO: 1298520 - protein, 27 aa, Mycobacterium
EQKPYTRRPYAPFMTSTLQQEAGRKLR

SEQ ID NO: 1298521 - protein, 33 aa, Mycobacterium
EQKQRFLPPTFRGEMIWCQLFSEPGAGSDLASL

SEQ ID NO: 1298522 - protein, 20 aa, Mycobacterium
EQKRRWLPGIADGSITMAFA

SEQ ID NO: 1298523 - protein, 20 aa, Mycobacterium
EQLEIELNWIDEHIGDHPYG

SEQ ID NO: 1298524 - protein, 21 aa, Mycobacterium
EQMWRHYLPPGTEPAGIAPAR

SEQ ID NO: 1298525 - protein, 22 aa, Mycobacterium
EQNLILRRGFSYSRGFDGAGRL

SEQ ID NO: 1298526 - protein, 25 aa, Mycobacterium
EQPGIATLLLSRPPTNALTRQVYRE

SEQ ID NO: 1298527 - protein, 17 aa, Mycobacterium
EQRAEAIFGQRLMYAIP

SEQ ID NO: 1298528 - protein, 23 aa, Mycobacterium
EQRGALPFRVVASYSVRSAPVDG

SEQ ID NO: 1298529 - protein, 25 aa, Mycobacterium
EQRVRSMPWDRLVLTPGSVTRLFDV

SEQ ID NO: 1298530 - protein, 23 aa, Mycobacterium
EQSRTRDWLVTRVAVRTQRRLGR

SEQ ID NO: 1298531 - protein, 25 aa, Mycobacterium
EQTCIAWQAIPQWDIGDPGAVEVRN

SEQ ID NO: 1298532 - protein, 20 aa, Mycobacterium
EQVLFRHPAVFDAAVIGGKD

SEQ ID NO: 1298533 - protein, 26 aa, Mycobacterium
ERAAVFLRAADLLAGPWREKLAAATM

SEQ ID NO: 1298534 - protein, 25 aa, Mycobacterium
ERAKGMLMLVYRVDAVAAFELLKWR

SEQ ID NO: 1298535 - protein, 22 aa, Mycobacterium
ERALELLTAVGLPEADRRLDSY

SEQ ID NO: 1298536 - protein, 21 aa, Mycobacterium
ERAMALLRRGDLTVTEVCFAV

SEQ ID NO: 1298537 - protein, 21 aa, Mycobacterium
ERAPMPALHRLTVGALRAVAD

SEQ ID NO: 1298538 - protein, 25 aa, Mycobacterium
ERAQEFDALPYFWTDQYDVKMQMLG

SEQ ID NO: 1298539 - protein, 31 aa, Mycobacterium
ERATFYHELGHATLDLYDLPFTGREEDVADQ

SEQ ID NO: 1298540 - protein, 30 aa, Mycobacterium
ERATGWLLDAPQRPFLLTAGFFETHRPYPR

SEQ ID NO: 1298541 - protein, 17 aa, Mycobacterium
ERAWPRHRRLSRSADDA

SEQ ID NO: 1298542 - protein, 18 aa, Mycobacterium
ERDAIWMRVWQIAGRVED

SEQ ID NO: 1298543 - protein, 26 aa, Mycobacterium
ERDDALLAHFLSVMPDWIPVAVELRH

SEQ ID NO: 1298544 - protein, 31 aa, Mycobacterium
ERDLSVDLFGLSLPAPVFMAPIGVIGICAQD

SEQ ID NO: 1298545 - protein, 38 aa, Mycobacterium
ERDPMECAEILDWPAKLRLLEGFRHRENLGWSAPRLHL

SEQ ID NO: 1298546 - protein, 26 aa, Mycobacterium
EREFTQVFATLFPGGEGRLLLTDPDD

SEQ ID NO: 1298547 - protein, 22 aa, Mycobacterium
ERELLFDQFRRGEISTLVVSKV

SEQ ID NO: 1298548 - protein, 18 aa, Mycobacterium
ERELPEWLQADVAILGEP

SEQ ID NO: 1298549 - protein, 17 aa, Mycobacterium
ERFGTIGIGYRPGTTVD

SEQ ID NO: 1298550 - protein, 20 aa, Mycobacterium
ERFLALPDFPYPPGYSDIDD

SEQ ID NO: 1298551 - protein, 24 aa, Mycobacterium
ERFTLLRPLLFTIAYEILGSATES

SEQ ID NO: 1298552 - protein, 29 aa, Mycobacterium
ERGFQRIHRSYLVALRLVTGLRTSDGAVL

SEQ ID NO: 1298553 - protein, 20 aa, Mycobacterium
ERGITIKAQNVRLPWEVNGE

SEQ ID NO: 1298554 - protein, 24 aa, Mycobacterium
ERGTALVPTLINLENFPGIADQAA

SEQ ID NO: 1298555 - protein, 17 aa, Mycobacterium
ERGWRHYLMSTAGRCYL

SEQ ID NO: 1298556 - protein, 18 aa, Mycobacterium
ERGYRYVYRVRCAAPVGG

SEQ ID NO: 1298557 - protein, 18 aa, Mycobacterium
ERHLAMLTTLRSDNSPHV

SEQ ID NO: 1298558 - protein, 25 aa, Mycobacterium
ERIIRAASALFYRRGIHATGVDLLT

SEQ ID NO: 1298559 - protein, 24 aa, Mycobacterium
ERKKLLDRLLAQELPDGWDADLTY

SEQ ID NO: 1298560 - protein, 19 aa, Mycobacterium
ERLGYLRTFVRRRSALAIK

SEQ ID NO: 1298561 - protein, 25 aa, Mycobacterium
ERLPDLRLWNFYGQTEMAPLASALG

SEQ ID NO: 1298562 - protein, 20 aa, Mycobacterium
ERLREQGVRLIYDEPRRGTS

SEQ ID NO: 1298563 - protein, 19 aa, Mycobacterium
ERPGLLTTVQDLPGRIGLW

SEQ ID NO: 1298564 - protein, 22 aa, Mycobacterium
ERPRTRISWLDSKHSFSFADHY

SEQ ID NO: 1298565 - protein, 17 aa, Mycobacterium
ERQFGYLEFHGETGAVK

SEQ ID NO: 1298566 - protein, 25 aa, Mycobacterium
ERQGESGFAWAFLGAALATTDLPFG

SEQ ID NO: 1298567 - protein, 24 aa, Mycobacterium
ERQKQVLLDIYTSFCQQNEVAGSE

SEQ ID NO: 1298568 - protein, 28 aa, Mycobacterium
ERQNLTEFLAFNQNAFFAVAYGLTDEQA

SEQ ID NO: 1298569 - protein, 18 aa, Mycobacterium
ERRGAISGAVLDAGCGAG

SEQ ID NO: 1298570 - protein, 26 aa, Mycobacterium
ERRYDYIPTYILRGLTELHLEFDTTG

SEQ ID NO: 1298571 - protein, 23 aa, Mycobacterium
ERSPTFYRFDSMEQLKVWRSMDE

SEQ ID NO: 1298572 - protein, 25 aa, Mycobacterium
ERSSHTWFVLTHLLGLPGVRNYDGS

SEQ ID NO: 1298573 - protein, 19 aa, Mycobacterium
ERTPWYHRNVDYDEIAFFH

SEQ ID NO: 1298574 - protein, 18 aa, Mycobacterium
ERTRPRSIIVNRAGKRFV

SEQ ID NO: 1298575 - protein, 25 aa, Mycobacterium
ERTTDEWLALFRELEIPAAPIRTPG

SEQ ID NO: 1298576 - protein, 23 aa, Mycobacterium
ERTVISLRFFASMTQTQIAERIG

SEQ ID NO: 1298577 - protein, 24 aa, Mycobacterium
ERVDLPYNWMYTPSGHMRVGRIQN

SEQ ID NO: 1298578 - protein, 18 aa, Mycobacterium
ERVELRYTMPLGEIIFDF

SEQ ID NO: 1298579 - protein, 23 aa, Mycobacterium
ERVRLHPYLTERILRQVPGLAQV

SEQ ID NO: 1298580 - protein, 22 aa, Mycobacterium
ERVRRAVALGVLLPGDRLPSER

SEQ ID NO: 1298581 - protein, 21 aa, Mycobacterium
ERWAKVRGDKLAYRFIDFSTE

SEQ ID NO: 1298582 - protein, 20 aa, Mycobacterium
ERYRIPLTIIRICSTYGPEG

SEQ ID NO: 1298583 - protein, 17 aa, Mycobacterium
ESALRQAAALRARQGHP

SEQ ID NO: 1298584 - protein, 27 aa, Mycobacterium
ESASSWFLPRLVGLTRATDWVLSGRVF

SEQ ID NO: 1298585 - protein, 24 aa, Mycobacterium
ESAYPQLLFRVGWAPVNADPLPPT

SEQ ID NO: 1298586 - protein, 27 aa, Mycobacterium
ESDAPGLRRLIADLQTWLTGITGYDEI

SEQ ID NO: 1298587 - protein, 24 aa, Mycobacterium
ESDNLAVKGIFWARRDAERRRNRI

SEQ ID NO: 1298588 - protein, 19 aa, Mycobacterium
ESFKVLLKELQSLCLNVEV

SEQ ID NO: 1298589 - protein, 24 aa, Mycobacterium
ESFPGTISIGTAALRLLLVEFGRS

SEQ ID NO: 1298590 - protein, 19 aa, Mycobacterium
ESFVQRIQVLPDRTRLLLL

SEQ ID NO: 1298591 - protein, 29 aa, Mycobacterium
ESGGLFHGIQLWVNLPRKDKFATPRYQAI

SEQ ID NO: 1298592 - protein, 30 aa, Mycobacterium
ESIGVRSICYLPLTYDHRLIDGADAGRFLT

SEQ ID NO: 1298593 - protein, 19 aa, Mycobacterium
ESKPEWYLRQMLGTANFNA

SEQ ID NO: 1298594 - protein, 28 aa, Mycobacterium
ESKRYLEYTLRWRNTPKPSIAAVQGRCI

SEQ ID NO: 1298595 - protein, 26 aa, Mycobacterium
ESLADPLAFLLRKEGFETTVVADGPS

SEQ ID NO: 1298596 - protein, 25 aa, Mycobacterium
ESLALLDGLPLRYDLARVNFAYGQT

SEQ ID NO: 1298597 - protein, 24 aa, Mycobacterium
ESLDRYVEMLVLDRLSRPDVHLVL

SEQ ID NO: 1298598 - protein, 26 aa, Mycobacterium
ESLRPALFVVPTDTPGLTWTKIEMEL

SEQ ID NO: 1298599 - protein, 20 aa, Mycobacterium
ESLYRYASVHWARHSATFDA

SEQ ID NO: 1298600 - protein, 20 aa, Mycobacterium
ESLYTEFLERCGPGLHHVCR

SEQ ID NO: 1298601 - protein, 22 aa, Mycobacterium
ESMAMWPGAAVSGWYFSHPQSQ

SEQ ID NO: 1298602 - protein, 29 aa, Mycobacterium
ESNPFALLVGMLLDQQYPMEAAFAGPKKI

SEQ ID NO: 1298603 - protein, 28 aa, Mycobacterium
ESPKETWLRLLLIRHDFPRPRTQIPVPA

SEQ ID NO: 1298604 - protein, 25 aa, Mycobacterium
ESPLNALLLAEVIAESGLPPGVVSV

SEQ ID NO: 1298605 - protein, 35 aa, Mycobacterium
ESPNPHVLTLAPPLNMNPHWLGAHPAYTLSKYGMT

SEQ ID NO: 1298606 - protein, 24 aa, Mycobacterium
ESRAQMATLPRLKPRVFYDLVVEV

SEQ ID NO: 1298607 - protein, 27 aa, Mycobacterium
ESRHCRRQFLLTYFGQPLPGPCGNCDR

SEQ ID NO: 1298608 - protein, 28 aa, Mycobacterium
ESRHGLKSMLFAPELGLGRAWTMSARRD

SEQ ID NO: 1298609 - protein, 25 aa, Mycobacterium
ESTLTEGLLYERRLFHSTFATEDQK

SEQ ID NO: 1298610 - protein, 20 aa, Mycobacterium
ESVLPVGPPPVQVGGPPLLV

SEQ ID NO: 1298611 - protein, 30 aa, Mycobacterium
ESWLSDAELYLFFYLLFSAGAETTRNSIAG

SEQ ID NO: 1298612 - protein, 26 aa, Mycobacterium
ESYHRIEDKFPSRFLLGIGIGHPEAT

SEQ ID NO: 1298613 - protein, 17 aa, Mycobacterium
ETAVTDILLRRPPRTRS

SEQ ID NO: 1298614 - protein, 17 aa, Mycobacterium
ETAVYNVLPQWAKLAAK

SEQ ID NO: 1298615 - protein, 20 aa, Mycobacterium
ETAYAWRSILARGNGSGPVG

SEQ ID NO: 1298616 - protein, 26 aa, Mycobacterium
ETCWRDYRLGMLQAPLITVLGCAFAT

SEQ ID NO: 1298617 - protein, 21 aa, Mycobacterium
ETDGRRRLGVALATAPDVIIA

SEQ ID NO: 1298618 - protein, 24 aa, Mycobacterium
ETDRINFRIALWAAHNMGMSDGAG

SEQ ID NO: 1298619 - protein, 22 aa, Mycobacterium
ETDVFLLMCAPIHVVENLAAPT

SEQ ID NO: 1298620 - protein, 18 aa, Mycobacterium
ETEALFEWVVRQALPDEP

SEQ ID NO: 1298621 - protein, 19 aa, Mycobacterium
ETERAVGALLLRDCGSPTD

SEQ ID NO: 1298622 - protein, 20 aa, Mycobacterium
ETERGIAYTRVGYAAPLNSP

SEQ ID NO: 1298623 - protein, 27 aa, Mycobacterium
ETFADMELAWGPTWSGSLKSLWLGDGE

SEQ ID NO: 1298624 - protein, 17 aa, Mycobacterium
ETFGLAALEALACGTPA

SEQ ID NO: 1298625 - protein, 48 aa, Mycobacterium
ETGPDAVKLFGALKTFCYGASPMPLPLLRQALKAWPDTDFIQVYGLTE

SEQ ID NO: 1298626 - protein, 25 aa, Mycobacterium
ETGRRVLLLGHFIKQFVGLGVAEST

SEQ ID NO: 1298627 - protein, 28 aa, Mycobacterium
ETHDEAMALMLPNLHMMAQLRTGQPLTA

SEQ ID NO: 1298628 - protein, 17 aa, Mycobacterium
ETIAGAETLPLGDYRMM

SEQ ID NO: 1298629 - protein, 29 aa, Mycobacterium
ETIPATYGFPLPPPGYLEAVYALTQKYGS

SEQ ID NO: 1298630 - protein, 21 aa, Mycobacterium
ETIPVLLARFGDTVAIPLMRR

SEQ ID NO: 1298631 - protein, 25 aa, Mycobacterium
ETLDPRDPLLRLRTFFDDGTVELLH

SEQ ID NO: 1298632 - protein, 25 aa, Mycobacterium
ETLDVWDGHLAAHGALLMAARADLV

SEQ ID NO: 1298633 - protein, 22 aa, Mycobacterium
ETLEPMMRITLNVILRAVFGAD

SEQ ID NO: 1298634 - protein, 19 aa, Mycobacterium
ETLVRLRPTFGAVNLEDIS

SEQ ID NO: 1298635 - protein, 28 aa, Mycobacterium
ETPCAVVAFASWPEEIVLRGTLADIAAQ

SEQ ID NO: 1298636 - protein, 17 aa, Mycobacterium
ETPLLATAPVYWGGIDL

SEQ ID NO: 1298637 - protein, 17 aa, Mycobacterium
ETQPFTLENGLLTGIRK

SEQ ID NO: 1298638 - protein, 24 aa, Mycobacterium
ETQSVLALLDSPLGQLLHAAATGR

SEQ ID NO: 1298639 - protein, 18 aa, Mycobacterium
ETRLKLRSAMRLLRDKQI

SEQ ID NO: 1298640 - protein, 32 aa, Mycobacterium
ETRRILDRLYGYEVSPVLWKKVAPKLSAGRVQ

SEQ ID NO: 1298641 - protein, 27 aa, Mycobacterium
ETRSNRLILSPYWPESLGVLAVPIHYR

SEQ ID NO: 1298642 - protein, 17 aa, Mycobacterium
ETTGRLIGWLAKVLAEH

SEQ ID NO: 1298643 - protein, 31 aa, Mycobacterium
ETTLSWLSRYSQPLRRLPLGLSATRSELTRR

SEQ ID NO: 1298644 - protein, 29 aa, Mycobacterium
ETVPHFVNALRPIEWRYTNDPAWVMRDKG

SEQ ID NO: 1298645 - protein, 22 aa, Mycobacterium
ETVVGTLHRTLAIAASIGSVCD

SEQ ID NO: 1298646 - protein, 32 aa, Mycobacterium
EVADASLSHPYLDTVLFILGVTRGEIEAADAV

SEQ ID NO: 1298647 - protein, 23 aa, Mycobacterium
EVADRLFPTLRERGLIATDKSGT

SEQ ID NO: 1298648 - protein, 24 aa, Mycobacterium
EVAPALLEPFTGPWGTDTLLDLMC

SEQ ID NO: 1298649 - protein, 24 aa, Mycobacterium
EVASTRVLIAAGRLVREGLTMQEA

SEQ ID NO: 1298650 - protein, 17 aa, Mycobacterium
EVATFVVFLASDESRYA

SEQ ID NO: 1298651 - protein, 19 aa, Mycobacterium
EVAWRILQVTPINATALVS

SEQ ID NO: 1298652 - protein, 18 aa, Mycobacterium
EVDRDGERLTLRPTQLIL

SEQ ID NO: 1298653 - protein, 17 aa, Mycobacterium
EVEEVYLPLARLIHLQV

SEQ ID NO: 1298654 - protein, 27 aa, Mycobacterium
EVEFTLRSAQRLPWHPGRCAEVLIGDT

SEQ ID NO: 1298655 - protein, 24 aa, Mycobacterium
EVEREWRAHLGAETFDRLRDAMVS

SEQ ID NO: 1298656 - protein, 25 aa, Mycobacterium
EVFDRTLLLTEFVGARTSGLRGLAV

SEQ ID NO: 1298657 - protein, 21 aa, Mycobacterium
EVFGPVLAVIPFRDEDDAVRI

SEQ ID NO: 1298658 - protein, 20 aa, Mycobacterium
EVFGPWQTIWTWHRRMSAEG

SEQ ID NO: 1298659 - protein, 24 aa, Mycobacterium
EVFRGVQKWRIKSNWKFVSENFLG

SEQ ID NO: 1298660 - protein, 18 aa, Mycobacterium
EVFTLHGGHLDAFLVACG

SEQ ID NO: 1298661 - protein, 22 aa, Mycobacterium
EVGIDWWTHDPWLTGNKSALQL

SEQ ID NO: 1298662 - protein, 17 aa, Mycobacterium
EVIELVEKMLASGAAYV

SEQ ID NO: 1298663 - protein, 17 aa, Mycobacterium
EVIFCSFGDMLRVPGSE

SEQ ID NO: 1298664 - protein, 21 aa, Mycobacterium
EVINGIAGCLPDLPPYVRAER

SEQ ID NO: 1298665 - protein, 19 aa, Mycobacterium
EVKVNPVLPAPPAPVADLQ

SEQ ID NO: 1298666 - protein, 24 aa, Mycobacterium
EVKYFRNTLQLSHPAFLVLESSAT

SEQ ID NO: 1298667 - protein, 17 aa, Mycobacterium
EVMALRRAGRKAAGGTA

SEQ ID NO: 1298668 - protein, 24 aa, Mycobacterium
EVMASPTIWGPLTRLQCCPPTCGA

SEQ ID NO: 1298669 - protein, 17 aa, Mycobacterium
EVNTGRLMAGAGPAPML

SEQ ID NO: 1298670 - protein, 18 aa, Mycobacterium
EVPDSYRLLLDRLGPLVV

SEQ ID NO: 1298671 - protein, 28 aa, Mycobacterium
EVPERGLLLAHHPLLLRGVDSVAASTPK

SEQ ID NO: 1298672 - protein, 20 aa, Mycobacterium
EVPIVFFQEVHRPSGVDFGR

SEQ ID NO: 1298673 - protein, 18 aa, Mycobacterium
EVRDILGITWTDRDQRKL

SEQ ID NO: 1298674 - protein, 26 aa, Mycobacterium
EVRGEVFFRVADFEALNAGLVAEGKP

SEQ ID NO: 1298675 - protein, 17 aa, Mycobacterium
EVRLLSRFTGANPHVAI

SEQ ID NO: 1298676 - protein, 17 aa, Mycobacterium
EVRRLTGEPPAALRRRI

SEQ ID NO: 1298677 - protein, 25 aa, Mycobacterium
EVRSEFLNQLQKGAIRKGVVSSIVN

SEQ ID NO: 1298678 - protein, 17 aa, Mycobacterium
EVRSQLALTWGTETFIV

SEQ ID NO: 1298679 - protein, 25 aa, Mycobacterium
EVSALSWTVYSAPATPPAPHIDLGE

SEQ ID NO: 1298680 - protein, 18 aa, Mycobacterium
EVSITRRMFRDGGSEYEI

SEQ ID NO: 1298681 - protein, 20 aa, Mycobacterium
EVTIVLDRKTLSVAQVPGET

SEQ ID NO: 1298682 - protein, 24 aa, Mycobacterium
EVTREVLGAGIPLFGICFGNQILG

SEQ ID NO: 1298683 - protein, 22 aa, Mycobacterium
EVVALIVALRHTAEQHLAEVDR

SEQ ID NO: 1298684 - protein, 29 aa, Mycobacterium
EVVASATGDFRFFAAPGTWTLRALSKVGN

SEQ ID NO: 1298685 - protein, 19 aa, Mycobacterium
EVVFDRGGYSYGGRIAALA

SEQ ID NO: 1298686 - protein, 18 aa, Mycobacterium
EVVGQQHLLKPNSPLRRL

SEQ ID NO: 1298687 - protein, 23 aa, Mycobacterium
EVVIERACAPYLAGRAAGEGLRR

SEQ ID NO: 1298688 - protein, 21 aa, Mycobacterium
EVVKLATFLFAAGMETTTKLL

SEQ ID NO: 1298689 - protein, 18 aa, Mycobacterium
EVVLNQVLVALPGGDEAN

SEQ ID NO: 1298690 - protein, 32 aa, Mycobacterium
EVVRFLPMEELIAAFLPVLFPGLEIVEHHAFR

SEQ ID NO: 1298691 - protein, 27 aa, Mycobacterium
EVVRGMADMGLFGLPFPEEYGGMGGDY

SEQ ID NO: 1298692 - protein, 22 aa, Mycobacterium
EVYAAFLEGFRAFFTESAADPL

SEQ ID NO: 1298693 - protein, 30 aa, Mycobacterium
EVYFELRLADAWVWDMYRPARFVKQVRVIT

SEQ ID NO: 1298694 - protein, 24 aa, Mycobacterium
EVYVLRPCIVVGPKAPALAEVMPW

SEQ ID NO: 1298695 - protein, 25 aa, Mycobacterium
EVYYRAMFSGRVTSWNLRDEHMART

SEQ ID NO: 1298696 - protein, 26 aa, Mycobacterium
EWAFVCAVDMPYLTMDFVDDLAVPAA

SEQ ID NO: 1298697 - protein, 25 aa, Mycobacterium
EWAGRGWLAVRYNLPYRRRRPKGPP

SEQ ID NO: 1298698 - protein, 26 aa, Mycobacterium
EWASYNGEWLAAWLADGTAITAYGEF

SEQ ID NO: 1298699 - protein, 27 aa, Mycobacterium
EWAVSQPARWALLYGSPVPGYRAPAER

SEQ ID NO: 1298700 - protein, 19 aa, Mycobacterium
EWFGVSIAEFHQRATARAA

SEQ ID NO: 1298701 - protein, 24 aa, Mycobacterium
EWFTVDWHCAIVEKWRAAGVRMAD

SEQ ID NO: 1298702 - protein, 29 aa, Mycobacterium
EWHALPARLLAEVLRLRGWQVDFLGAQVP

SEQ ID NO: 1298703 - protein, 17 aa, Mycobacterium
EWIEAMLTGKRSMAFGL

SEQ ID NO: 1298704 - protein, 19 aa, Mycobacterium
EWIIAAFGLLTAGGVLVPV

SEQ ID NO: 1298705 - protein, 18 aa, Mycobacterium
EWKPDYLAAPVRNVLLAL

SEQ ID NO: 1298706 - protein, 24 aa, Mycobacterium
EWLEAGLFQLEELPPGDYVRMPHH

SEQ ID NO: 1298707 - protein, 33 aa, Mycobacterium
EWQPTLGVAGLLTRLWDWLVDAAAGNFDAATAM

SEQ ID NO: 1298708 - protein, 23 aa, Mycobacterium
EWRRGSLPPGRLGWRKAQELRDQ

SEQ ID NO: 1298709 - protein, 29 aa, Mycobacterium
EWTTSTLRPWPGFTPMIYDRYSQPFFDGT

SEQ ID NO: 1298710 - protein, 33 aa, Mycobacterium
EWVKDLHINFLAAVRLNAALLPALYARGKGSII

SEQ ID NO: 1298711 - protein, 18 aa, Mycobacterium
EWVRAALPVHHVPVAVVT

SEQ ID NO: 1298712 - protein, 23 aa, Mycobacterium
EYADIWHGFTDRTTYPGKAEVLD

SEQ ID NO: 1298713 - protein, 25 aa, Mycobacterium
EYCNKQVLTFDWPDGAASVVVYLAP

SEQ ID NO: 1298714 - protein, 17 aa, Mycobacterium
EYDPLSDFAAWPNPFTL

SEQ ID NO: 1298715 - protein, 22 aa, Mycobacterium
EYDPTFIMRGLSALHIEFEPLP

SEQ ID NO: 1298716 - protein, 17 aa, Mycobacterium
EYFSLRGLALLTDTVDK

SEQ ID NO: 1298717 - protein, 20 aa, Mycobacterium
EYGGLGLPIAYQRAFDQESK

SEQ ID NO: 1298718 - protein, 18 aa, Mycobacterium
EYLAVCDPLPAAELRALA

SEQ ID NO: 1298719 - protein, 19 aa, Mycobacterium
EYLKRPLIDGPAPDPVTRP

SEQ ID NO: 1298720 - protein, 18 aa, Mycobacterium
EYLLLGLRFDRVEDGYVD

SEQ ID NO: 1298721 - protein, 25 aa, Mycobacterium
EYQRIREILGRRPTDAELAMYSVMW

SEQ ID NO: 1298722 - protein, 24 aa, Mycobacterium
EYRQDMVRMFGLPESGLAETLRDA

SEQ ID NO: 1298723 - protein, 24 aa, Mycobacterium
EYRREMAELFAPFSAVAAKNPYSS

SEQ ID NO: 1298724 - protein, 17 aa, Mycobacterium
FAAKRKAQDALSLALHL

SEQ ID NO: 1298725 - protein, 27 aa, Mycobacterium
FAANVWPDEVPGLRPLVTAYTAQMRRV

SEQ ID NO: 1298726 - protein, 26 aa, Mycobacterium
FACDHWDVVPDLYLLGKALGGGVVPV

SEQ ID NO: 1298727 - protein, 27 aa, Mycobacterium
FADAPATWRRYLDQGVLIRDVGIPGYL

SEQ ID NO: 1298728 - protein, 28 aa, Mycobacterium
FADIAPATRLPWFGPTMSAVSSLTARLM

SEQ ID NO: 1298729 - protein, 25 aa, Mycobacterium
FAEAQGRWGALPPSYRSTSRDDGIS

SEQ ID NO: 1298730 - protein, 30 aa, Mycobacterium
FAEREGVNLTYLPFIARAVIDALKQHPNVN

SEQ ID NO: 1298731 - protein, 33 aa, Mycobacterium
FAERGLPLTMNKLRFFKFIMDEIFPGGDLPQAR

SEQ ID NO: 1298732 - protein, 25 aa, Mycobacterium
FAGFIRGAYVGPTPWDHPWVSPIEG

SEQ ID NO: 1298733 - protein, 21 aa, Mycobacterium
FAGLYMLHRVRALGLTARIVE

SEQ ID NO: 1298734 - protein, 20 aa, Mycobacterium
FAGMRLVIGDALHSLADLGT

SEQ ID NO: 1298735 - protein, 21 aa, Mycobacterium
FAGPLPLQIICDMMGIPEEDH

SEQ ID NO: 1298736 - protein, 27 aa, Mycobacterium
FAGYEEPIIGPLQSFRLQAGPLAAEVA

SEQ ID NO: 1298737 - protein, 19 aa, Mycobacterium
FAHGMLSMAYLGRLITSWV

SEQ ID NO: 1298738 - protein, 19 aa, Mycobacterium
FAKAYRDHPHFAVPAVVAS

SEQ ID NO: 1298739 - protein, 42 aa, Mycobacterium
FAKTSWDLRNFLWAPQLGCFGIQRIHLLRDVLILAGAGVGGG

SEQ ID NO: 1298740 - protein, 24 aa, Mycobacterium
FANQLPAQPLMRIAQFGYHADATD

SEQ ID NO: 1298741 - protein, 20 aa, Mycobacterium
FAPLNSWPDNANLDKARRLL

SEQ ID NO: 1298742 - protein, 19 aa, Mycobacterium
FAPRAERMSARRFWVRYAA

SEQ ID NO: 1298743 - protein, 26 aa, Mycobacterium
FAQAVIDAGLIWIGPSPQSIRDLGDK

SEQ ID NO: 1298744 - protein, 18 aa, Mycobacterium
FAREFGAALSAADLVFVL

SEQ ID NO: 1298745 - protein, 20 aa, Mycobacterium
FARGWHCLGLTRDFGDGKPH

SEQ ID NO: 1298746 - protein, 25 aa, Mycobacterium
FARITRMARAVFGIPMAAVALVDRD

SEQ ID NO: 1298747 - protein, 18 aa, Mycobacterium
FARRASDRVVFMSDGAIV

SEQ ID NO: 1298748 - protein, 21 aa, Mycobacterium
FASPALQQPLLLGADIVLHST

SEQ ID NO: 1298749 - protein, 18 aa, Mycobacterium
FATAFPYGPYYGDRITRG

SEQ ID NO: 1298750 - protein, 21 aa, Mycobacterium
FATLATRFLGPSLNGVRPVQR

SEQ ID NO: 1298751 - protein, 24 aa, Mycobacterium
FAVQKPVIAMLHLSALPGDPGYDS

SEQ ID NO: 1298752 - protein, 29 aa, Mycobacterium
FAYSDVDKLRPLGDYWLAGLQVAARDHGL

SEQ ID NO: 1298753 - protein, 32 aa, Mycobacterium
FCGPVPYPHVPADWLRMMLAFNRNQLQWFADP

SEQ ID NO: 1298754 - protein, 20 aa, Mycobacterium
FCPDQFLGAHVRRVTGRTNM

SEQ ID NO: 1298755 - protein, 24 aa, Mycobacterium
FDAALVDVILPMADGLPARLAAGV

SEQ ID NO: 1298756 - protein, 30 aa, Mycobacterium
FDADVKLNLFLFTMLQKTLKGNIFGGGSSH

SEQ ID NO: 1298757 - protein, 17 aa, Mycobacterium
FDAISPPPKLGRAAISR

SEQ ID NO: 1298758 - protein, 17 aa, Mycobacterium
FDAPRRAKPPRHFADLD

SEQ ID NO: 1298759 - protein, 30 aa, Mycobacterium
FDGNVETYLHKRAADLPPAVGVLVEYTGDG

SEQ ID NO: 1298760 - protein, 17 aa, Mycobacterium
FDHLNIIAGFDELPRKI

SEQ ID NO: 1298761 - protein, 24 aa, Mycobacterium
FDIHLGGPALFGPIGMVVAGALKS

SEQ ID NO: 1298762 - protein, 21 aa, Mycobacterium
FDQITRLPEYYPTRAEAAILR

SEQ ID NO: 1298763 - protein, 22 aa, Mycobacterium
FDQLVDMLEPPMALCVIVEDGE

SEQ ID NO: 1298764 - protein, 23 aa, Mycobacterium
FDSRAVTAGGLFLALPGARSDGH

SEQ ID NO: 1298765 - protein, 24 aa, Mycobacterium
FDTSGPLRIPKLTAGASVGFVAEG

SEQ ID NO: 1298766 - protein, 20 aa, Mycobacterium
FDVDTPWKKLPAKVRRAILE

SEQ ID NO: 1298767 - protein, 29 aa, Mycobacterium
FDVIEALELLYVGALVWAGMGYSSYDDMT

SEQ ID NO: 1298768 - protein, 17 aa, Mycobacterium
FDVIHPASEEVAGQATD

SEQ ID NO: 1298769 - protein, 19 aa, Mycobacterium
FDVLATTTWLGDDPGRAAA

SEQ ID NO: 1298770 - protein, 18 aa, Mycobacterium
FDVRSTVIPVAHWRYEIS

SEQ ID NO: 1298771 - protein, 28 aa, Mycobacterium
FEAAVAGAIPVIRPLTQSLAGDTVLRVA

SEQ ID NO: 1298772 - protein, 30 aa, Mycobacterium
FEAIALVQKIAFSLPDKYFDKVDVTVIPPF

SEQ ID NO: 1298773 - protein, 19 aa, Mycobacterium
FEALGDIYRYFHAEEQRHA

SEQ ID NO: 1298774 - protein, 19 aa, Mycobacterium
FEALLLDYPRRGGKALRPA

SEQ ID NO: 1298775 - protein, 17 aa, Mycobacterium
FEALLLEFLGESSVTVP

SEQ ID NO: 1298776 - protein, 18 aa, Mycobacterium
FEANLYFVPPKNTRQRLS

SEQ ID NO: 1298777 - protein, 21 aa, Mycobacterium
FEDGGWIWFDITTDSAVTLHS

SEQ ID NO: 1298778 - protein, 29 aa, Mycobacterium
FEEMLVNEGLHLTKFWFSVSPAEQRTRFA

SEQ ID NO: 1298779 - protein, 19 aa, Mycobacterium
FEGPPPWNIGEPQPELAAL

SEQ ID NO: 1298780 - protein, 17 aa, Mycobacterium
FEGQIGQVAYTASKAAI

SEQ ID NO: 1298781 - protein, 20 aa, Mycobacterium
FEGRYTLQFNRIPQPWLREP

SEQ ID NO: 1298782 - protein, 21 aa, Mycobacterium
FEHAGLDRVLQWDLRYGADVV

SEQ ID NO: 1298783 - protein, 30 aa, Mycobacterium
FELSGSFVSYFGWLYEWGAPVTLIGESQDQ

SEQ ID NO: 1298784 - protein, 20 aa, Mycobacterium
FELTQKAVMAGIPVLAAVSA

SEQ ID NO: 1298785 - protein, 19 aa, Mycobacterium
FEPGVAQRVRLVPLGGSRE

SEQ ID NO: 1298786 - protein, 34 aa, Mycobacterium
FEPIGEPAAWFYDPPWTLPFRRRNEIAVAVRQRS

SEQ ID NO: 1298787 - protein, 17 aa, Mycobacterium
FERAHFPTISLTTVFRQ

SEQ ID NO: 1298788 - protein, 21 aa, Mycobacterium
FERMPALKFVWADGAADLLTP

SEQ ID NO: 1298789 - protein, 26 aa, Mycobacterium
FEVNEAFAPVPLAWLADTGAAEERLN

SEQ ID NO: 1298790 - protein, 17 aa, Mycobacterium
FFAELLPRLRSVELAGR

SEQ ID NO: 1298791 - protein, 23 aa, Mycobacterium
FFARLKPARSYCMAYKVPGTITR

SEQ ID NO: 1298792 - protein, 17 aa, Mycobacterium
FFCTQLPTDVPNGVLSQ

SEQ ID NO: 1298793 - protein, 20 aa, Mycobacterium
FFGSYRRQLSLGEGVDSAAI

SEQ ID NO: 1298794 - protein, 19 aa, Mycobacterium
FFGVFQDPTRKYSCAFFTG

SEQ ID NO: 1298795 - protein, 17 aa, Mycobacterium
FFHHAKVEMRWVASDDC

SEQ ID NO: 1298796 - protein, 26 aa, Mycobacterium
FFTSDSLAVRCTMRIDFAFPHPQSVV

SEQ ID NO: 1298797 - protein, 25 aa, Mycobacterium
FGAGENLMLLAFGEPRAREFYVDWQ

SEQ ID NO: 1298798 - protein, 34 aa, Mycobacterium
FGALVCSVPLLDMRRFHLLLAGASWVAEYGNPDD

SEQ ID NO: 1298799 - protein, 32 aa, Mycobacterium
FGASLVCGPLFGTVYLAIPALVAASAGPARDR

SEQ ID NO: 1298800 - protein, 27 aa, Mycobacterium
FGDEFRIQLAWMRQSPPGTPNPGWLFS

SEQ ID NO: 1298801 - protein, 19 aa, Mycobacterium
FGDHDDVRLMSATPQRVVL

SEQ ID NO: 1298802 - protein, 26 aa, Mycobacterium
FGDNMALLVGDLLWSAAHDTFDDAVA

SEQ ID NO: 1298803 - protein, 24 aa, Mycobacterium
FGEISLMPSTLKSLKVLIRFTNEL

SEQ ID NO: 1298804 - protein, 20 aa, Mycobacterium
FGERDDVLALLLRSTYEDGT

SEQ ID NO: 1298805 - protein, 23 aa, Mycobacterium
FGEVAFPKPLFHGDTLYAETEVL

SEQ ID NO: 1298806 - protein, 17 aa, Mycobacterium
FGFATAPLVVAGCIMMR

SEQ ID NO: 1298807 - protein, 18 aa, Mycobacterium
FGFERYDDFFKTCFDILP

SEQ ID NO: 1298808 - protein, 19 aa, Mycobacterium
FGFQLVIVATVQNATTIQP

SEQ ID NO: 1298809 - protein, 20 aa, Mycobacterium
FGFRGPDRFGFAPAGVHCER

SEQ ID NO: 1298810 - protein, 29 aa, Mycobacterium
FGGGSMFLLVGILAALWERERSGKGQVVD

SEQ ID NO: 1298811 - protein, 19 aa, Mycobacterium
FGGTVFYFGVADDDAYPIS

SEQ ID NO: 1298812 - protein, 38 aa, Mycobacterium
FGHPTAALTIPIPGALNRFVFAMPEQLGRVYLGLTDED

SEQ ID NO: 1298813 - protein, 23 aa, Mycobacterium
FGIDFPLFAFSHCRDVVAAVTNA

SEQ ID NO: 1298814 - protein, 17 aa, Mycobacterium
FGIDKFPRMVDYVTPTG

SEQ ID NO: 1298815 - protein, 24 aa, Mycobacterium
FGIEYPIFVFTPSEKVAAAVTRAG

SEQ ID NO: 1298816 - protein, 17 aa, Mycobacterium
FGITAHLIGYLPGLEQS

SEQ ID NO: 1298817 - protein, 17 aa, Mycobacterium
FGLIDKRSLHLTYGEFS

SEQ ID NO: 1298818 - protein, 17 aa, Mycobacterium
FGLMIPEEYGGLGESLL

SEQ ID NO: 1298819 - protein, 17 aa, Mycobacterium
FGMFGVRISIAVLRAGV

SEQ ID NO: 1298820 - protein, 18 aa, Mycobacterium
FGMSESGLPVLLLAASHP

SEQ ID NO: 1298821 - protein, 31 aa, Mycobacterium
FGNPLTWDDLPWLRSLTKLPVILKGICHADD

SEQ ID NO: 1298822 - protein, 24 aa, Mycobacterium
FGPEVKRRIMIGTYALSAGYYDAY

SEQ ID NO: 1298823 - protein, 24 aa, Mycobacterium
FGPRIRWRAMLDLLAAEGFPVEPP

SEQ ID NO: 1298824 - protein, 24 aa, Mycobacterium
FGPRLFKELLALHFSPTRPTRDEW

SEQ ID NO: 1298825 - protein, 17 aa, Mycobacterium
FGPTIPVAGLIVDQQAA

SEQ ID NO: 1298826 - protein, 18 aa, Mycobacterium
FGRPLSTFQTVAAQLAEV

SEQ ID NO: 1298827 - protein, 24 aa, Mycobacterium
FGTADSWVVWNLTGGPRGGVHVTD

SEQ ID NO: 1298828 - protein, 32 aa, Mycobacterium
FGTHDAPVYRLPWQPVFALNFSAVNLGASEAL

SEQ ID NO: 1298829 - protein, 17 aa, Mycobacterium
FGYVNHWYADRSAVLEF

SEQ ID NO: 1298830 - protein, 27 aa, Mycobacterium
FHDGVPLYLELPVTVELLVASTEPGLQ

SEQ ID NO: 1298831 - protein, 19 aa, Mycobacterium
FHHNFGYGLAGRRIEPSPL

SEQ ID NO: 1298832 - protein, 20 aa, Mycobacterium
FHKQANVLAALPKSAHPSAL

SEQ ID NO: 1298833 - protein, 26 aa, Mycobacterium
FHKRAETELTILAPHREQLTGDEAHE

SEQ ID NO: 1298834 - protein, 24 aa, Mycobacterium
FHVARLALSPLRPEERRTTVVNHE

SEQ ID NO: 1298835 - protein, 22 aa, Mycobacterium
FIDERPYLLTSRTPADRGTKIL

SEQ ID NO: 1298836 - protein, 30 aa, Mycobacterium; identical to SEQ ID NO: 812591

SEQ ID NO: 1298837 - protein, 19 aa, Mycobacterium
FIHGTVFPNLSFLNVLIGR

SEQ ID NO: 1298838 - protein, 17 aa, Mycobacterium
FIKGKWDKTDASYIRPL

SEQ ID NO: 1298839 - protein, 18 aa, Mycobacterium
FINAVYYPGENQIFTLLQ

SEQ ID NO: 1298840 - protein, 27 aa, Mycobacterium
FIPGLEDRTFPYLFSPAANEAVEQSDL

SEQ ID NO: 1298841 - protein, 19 aa, Mycobacterium
FIRRNVAGDPLYKYVLKEY

SEQ ID NO: 1298842 - protein, 26 aa, Mycobacterium
FITDFGALIPMRTIGYLLGIPEQGQQ

SEQ ID NO: 1298843 - protein, 23 aa, Mycobacterium
FKDAELLGVPWIVVVGRGWGDGV

SEQ ID NO: 1298844 - protein, 34 aa, Mycobacterium
FKGGLRFHPSVYLGIIKFLGFEQIFKNSLTGMPI

SEQ ID NO: 1298845 - protein, 18 aa, Mycobacterium
FLAELAESWRDPAAWTGM

SEQ ID NO: 1298846 - protein, 17 aa, Mycobacterium
FLAIGLAVADRAPVCVA

SEQ ID NO: 1298847 - protein, 17 aa, Mycobacterium
FLDTLLAAAARGVSVRF

SEQ ID NO: 1298848 - protein, 36 aa, Mycobacterium
FLEARPQTIFLYHNFIRHWRHPLRDGLSRLRDAVAE

SEQ ID NO: 1298849 - protein, 23 aa, Mycobacterium
FLEHSRVIHFRAIDEYWIGSADM

SEQ ID NO: 1298850 - protein, 19 aa, Mycobacterium
FLGYPHVLAGQRLCIYLDP

SEQ ID NO: 1298851 - protein, 18 aa, Mycobacterium
FLIGYAIANLRYFASLAR

SEQ ID NO: 1298852 - protein, 18 aa, Mycobacterium
FLLPLNPGKDDEGNIYDY

SEQ ID NO: 1298853 - protein, 22 aa, Mycobacterium
FLNHVVTPARRFATAPLALADA

SEQ ID NO: 1298854 - protein, 31 aa, Mycobacterium
FLRAGAIDRIVAYVAPILLGGPVTAVDDVGV

SEQ ID NO: 1298855 - protein, 29 aa, Mycobacterium
FLREVQDTWTWLRPYFDERATATAARLGL

SEQ ID NO: 1298856 - protein, 18 aa, Mycobacterium
FLRNWRDALELPKERHRD

SEQ ID NO: 1298857 - protein, 23 aa, Mycobacterium
FLRQLQAILRVRSHYGIATSRQV

SEQ ID NO: 1298858 - protein, 17 aa, Mycobacterium
FLSLRDKVVLHRSEYRL

SEQ ID NO: 1298859 - protein, 20 aa, Mycobacterium
FLSTAPLYHSGPQSSVSIGL

SEQ ID NO: 1298860 - protein, 18 aa, Mycobacterium
FLTEPWWCRTVVLTAERT

SEQ ID NO: 1298861 - protein, 18 aa, Mycobacterium
FLTVGFLAPIFREALGVT

SEQ ID NO: 1298862 - protein, 18 aa, Mycobacterium
FLVLDDADLAGACSMAAF

SEQ ID NO: 1298863 - protein, 19 aa, Mycobacterium
FLVLEMSARHPGNIAALAA

SEQ ID NO: 1298864 - protein, 22 aa, Mycobacterium
FLYAGAVTALIRDYLHRARSGD

SEQ ID NO: 1298865 - protein, 18 aa, Mycobacterium
FMGLVLVEIHMMYATLVG

SEQ ID NO: 1298866 - protein, 17 aa, Mycobacterium
FMSGWMGVDLARFGLDE

SEQ ID NO: 1298867 - protein, 21 aa, Mycobacterium
FMSIFAVMIQNHFFQHVDVGL

SEQ ID NO: 1298868 - protein, 25 aa, Mycobacterium
FNERVTLMLTQYEPLFANWDQDQTA

SEQ ID NO: 1298869 - protein, 17 aa, Mycobacterium
FNGLSKAYRVAGYRSGW

SEQ ID NO: 1298870 - protein, 19 aa, Mycobacterium
FNLDFHVRRVRIPEPGNMR

SEQ ID NO: 1298871 - protein, 23 aa, Mycobacterium
FNQVSLEIMPAWGGAERLAGLVG

SEQ ID NO: 1298872 - protein, 25 aa, Mycobacterium
FNSAIFSEQVWLIADALHAGIDEVT

SEQ ID NO: 1298873 - protein, 17 aa, Mycobacterium
FNSIPFDQLTADDWRRM

SEQ ID NO: 1298874 - protein, 21 aa, Mycobacterium
FPANHPPMRTFLGVPVRIRDE

SEQ ID NO: 1298875 - protein, 18 aa, Mycobacterium
FPEWNPEIKGCWILARYD

SEQ ID NO: 1298876 - protein, 23 aa, Mycobacterium
FPGRWRMALLENLSRKCNRIRMH

SEQ ID NO: 1298877 - protein, 24 aa, Mycobacterium
FPIASVVKLFIADDLLLQESQGET

SEQ ID NO: 1298878 - protein, 18 aa, Mycobacterium
FPLIPGHDPHVWPELTQH

SEQ ID NO: 1298879 - protein, 22 aa, Mycobacterium
FPMEMDRYPGRIWVVAHKPVAV

SEQ ID NO: 1298880 - protein, 18 aa, Mycobacterium
FPPQLVSAIGRQLRTKVL

SEQ ID NO: 1298881 - protein, 18 aa, Mycobacterium
FPPSLGIRLNIPQPDLRK

SEQ ID NO: 1298882 - protein, 21 aa, Mycobacterium
FPRAQAMLPKAIAAGVRIACG

SEQ ID NO: 1298883 - protein, 27 aa, Mycobacterium
FPRLGEQFVTNLRRPILTLAADTSPGA

SEQ ID NO: 1298884 - protein, 17 aa, Mycobacterium
FPVMPVDGILVGTAAMA

SEQ ID NO: 1298885 - protein, 28 aa, Mycobacterium
FQGKSSVRTWLYRIATNTSLTALDGRAR

SEQ ID NO: 1298886 - protein, 21 aa, Mycobacterium
FQHCRRLLPGDPIAPLHLAHC

SEQ ID NO: 1298887 - protein, 17 aa, Mycobacterium
FQLIAPPLRVTGAVGAP

SEQ ID NO: 1298888 - protein, 20 aa, Mycobacterium
FQMPPALERAWHTHGYYGSV

SEQ ID NO: 1298889 - protein, 17 aa, Mycobacterium
FQRTPGWVLPRVNFRHP

SEQ ID NO: 1298890 - protein, 37 aa, Mycobacterium
FQSFRVPCLPTDRLLNLLHYVKWYLDGTLTFRRSCAH

SEQ ID NO: 1298891 - protein, 19 aa, Mycobacterium
FQVLSLGAGFRKVLAMDAN

SEQ ID NO: 1298892 - protein, 27 aa, Mycobacterium
FQVVSIPTMILFKDGEPVKRIVGAKGK

SEQ ID NO: 1298893 - protein, 17 aa, Mycobacterium
FRAVAEELHFGRAAERL

SEQ ID NO: 1298894 - protein, 27 aa, Mycobacterium
FRDELGDWRIILHSPYGLRVHGPLALA

SEQ ID NO: 1298895 - protein, 25 aa, Mycobacterium
FREDMAALRVLPPHDYVAATDAIAE

SEQ ID NO: 1298896 - protein, 22 aa, Mycobacterium
FREETRWPNYSPACVERGVLSG

SEQ ID NO: 1298897 - protein, 18 aa, Mycobacterium
FRELGPLNWAIAKAGARA

SEQ ID NO: 1298898 - protein, 23 aa, Mycobacterium
FRFNEVIHYWALDGEWDCFAEHY

SEQ ID NO: 1298899 - protein, 20 aa, Mycobacterium
FRGDFYRIHDFTLKPKPVNT

SEQ ID NO: 1298900 - protein, 19 aa, Mycobacterium
FRGPLAQVIHQLTGGLRAA

SEQ ID NO: 1298901 - protein, 24 aa, Mycobacterium
FRGSGTWIPLLRSGPGGQAESLVE

SEQ ID NO: 1298902 - protein, 25 aa, Mycobacterium
FRNGALNPNAFRRKPMTEEQILDST

SEQ ID NO: 1298903 - protein, 18 aa, Mycobacterium
FRQLLAGRDFAVGDMIAT

SEQ ID NO: 1298904 - protein, 17 aa, Mycobacterium
FRRIVDWAESRRAAERE

SEQ ID NO: 1298905 - protein, 33 aa, Mycobacterium; identical to SEQ ID NO: 784408

SEQ ID NO: 1298906 - protein, 19 aa, Mycobacterium
FRSHPDLDVLTHGLTLWDL

SEQ ID NO: 1298907 - protein, 23 aa, Mycobacterium
FRTQFVELYGREALFLGAGVEIV

SEQ ID NO: 1298908 - protein, 18 aa, Mycobacterium
FRYDVERLSAFYQVSYET

SEQ ID NO: 1298909 - protein, 28 aa, Mycobacterium
FSAAAVWRIRRAAPMLPTVLLGDTSRYL

SEQ ID NO: 1298910 - protein, 28 aa, Mycobacterium
FSEAAVKALWDTILPFAGYAFNKSHAAG

SEQ ID NO: 1298911 - protein, 19 aa, Mycobacterium
FSGIEVPPGILLWEDPPLH

SEQ ID NO: 1298912 - protein, 19 aa, Mycobacterium
FSGLLERFGTGKGCDICKP

SEQ ID NO: 1298913 - protein, 29 aa, Mycobacterium
FSGYPHLEELFWFGEGVVPILRERGLFKG

SEQ ID NO: 1298914 - protein, 32 aa, Mycobacterium
FSLFNVLGQHRLLFLAFLPYSGVLLGRLGKLS

SEQ ID NO: 1298915 - protein, 17 aa, Mycobacterium
FSLLVVADLLGVPEEDH

SEQ ID NO: 1298916 - protein, 19 aa, Mycobacterium
FSSAILPAWARKSPQMSEV

SEQ ID NO: 1298917 - protein, 25 aa, Mycobacterium
FSSKLELYLAVLQRHVDNMVSGVRQ

SEQ ID NO: 1298918 - protein, 26 aa, Mycobacterium
FSSNNQAFLPPPGPRHLLAVITGPSP

SEQ ID NO: 1298919 - protein, 20 aa, Mycobacterium
FSVLKTFDPPITALHGREVT

SEQ ID NO: 1298920 - protein, 17 aa, Mycobacterium
FTAIRQWAKQFYPDGIG

SEQ ID NO: 1298921 - protein, 21 aa, Mycobacterium
FTALIDANRGCFHAFRAVYEC

SEQ ID NO: 1298922 - protein, 21 aa, Mycobacterium
FTATQWRRRLREHAQFAVLAD

SEQ ID NO: 1298923 - protein, 26 aa, Mycobacterium
FTDDPAKLALPQWYAENGQFVTTKFF

SEQ ID NO: 1298924 - protein, 23 aa, Mycobacterium
FTEAAVPGAYLRVIESGPVRAGD

SEQ ID NO: 1298925 - protein, 21 aa, Mycobacterium
FTESMLPRMRPGSSIVSVSSL

SEQ ID NO: 1298926 - protein, 18 aa, Mycobacterium
FTFTGTPARRLGAAGWDA

SEQ ID NO: 1298927 - protein, 19 aa, Mycobacterium
FTGTNMARLKGRQVEFFAA

SEQ ID NO: 1298928 - protein, 25 aa, Mycobacterium
FTLGIGPSHDWIISGQLGLPYDRPA

SEQ ID NO: 1298929 - protein, 19 aa, Mycobacterium
FTPGRPLIEVLRDLTSRIY

SEQ ID NO: 1298930 - protein, 22 aa, Mycobacterium
FTSLRPLLFTIAYEILGSATES

SEQ ID NO: 1298931 - protein, 33 aa, Mycobacterium
FTTDKPVIFAYHGYPWLIHRLAYRHANHEQLHV

SEQ ID NO: 1298932 - protein, 26 aa, Mycobacterium
FTTSFARVYGLPPAAYRASLPPAATY

SEQ ID NO: 1298933 - protein, 17 aa, Mycobacterium
FTVRTIEERLGATPLVI

SEQ ID NO: 1298934 - protein, 26 aa, Mycobacterium
FTWEHPAHLYLRRARTGLQLFGGPRL

SEQ ID NO: 1298935 - protein, 20 aa, Mycobacterium
FTYHEIADRLTYVVGLVLGE

SEQ ID NO: 1298936 - protein, 22 aa, Mycobacterium
FVAARRFAIPAVEAKGALLLED

SEQ ID NO: 1298937 - protein, 19 aa, Mycobacterium
FVEFAQFAEGLGFAGVLSG

SEQ ID NO: 1298938 - protein, 18 aa, Mycobacterium
FVEQRWGLPPGTIRTDAG

SEQ ID NO: 1298939 - protein, 29 aa, Mycobacterium
FVERAGPLNFYSLYRAHDLHFVVYSAMFE

SEQ ID NO: 1298940 - protein, 17 aa, Mycobacterium
FVFVEQWADADALKTHS

SEQ ID NO: 1298941 - protein, 31 aa, Mycobacterium
FVGSPHYAYKLEWLAALRKTAHGWLTENPAL

SEQ ID NO: 1298942 - protein, 27 aa, Mycobacterium
FVHGHDLDMRTLFPRRSRGLAGALDYA

SEQ ID NO: 1298943 - protein, 23 aa, Mycobacterium
FVHRDFLFVDDAVEALVHAGCTP

SEQ ID NO: 1298944 - protein, 19 aa, Mycobacterium
FVNRFLPPFVRQGGSHLLL

SEQ ID NO: 1298945 - protein, 17 aa, Mycobacterium
FVPGWNRVQMRHLVRDL

SEQ ID NO: 1298946 - protein, 17 aa, Mycobacterium
FVPSAIAGALIAAHDPD

SEQ ID NO: 1298947 - protein, 19 aa, Mycobacterium
FVPTATFPIDLMWDEPTVA

SEQ ID NO: 1298948 - protein, 17 aa, Mycobacterium
FVPVAAHTPLILLGGIT

SEQ ID NO: 1298949 - protein, 17 aa, Mycobacterium
FVQSKPFRKMGIHSSRT

SEQ ID NO: 1298950 - protein, 30 aa, Mycobacterium
FVQTPRMSTYLVALIAGPYARWDDLYRDEH

SEQ ID NO: 1298951 - protein, 19 aa, Mycobacterium
FVRRRIFDGTYPAGGYIRL

SEQ ID NO: 1298952 - protein, 21 aa, Mycobacterium
FVRWCRQVLDLLDQVRNAAPT

SEQ ID NO: 1298953 - protein, 24 aa, Mycobacterium
FVSKEELFDTVWGGRFVGEAALTS

SEQ ID NO: 1298954 - protein, 26 aa, Mycobacterium
FVTQHPKWLDRAWARIVEEVRDGRQA

SEQ ID NO: 1298955 - protein, 17 aa, Mycobacterium
FVVFARTRPADDRGAGI

SEQ ID NO: 1298956 - protein, 19 aa, Mycobacterium
FVYIGEICTYLLNQPKKDT

SEQ ID NO: 1298957 - protein, 19 aa, Mycobacterium
FWDAAAFGLIDKRSLHLTY

SEQ ID NO: 1298958 - protein, 26 aa, Mycobacterium
FWFDPLCPWCWITSRWILEVEKVRDI

SEQ ID NO: 1298959 - protein, 31 aa, Mycobacterium
FWTQAARLRDLLKFDFYFADSAAFREHVVEE

SEQ ID NO: 1298960 - protein, 19 aa, Mycobacterium
FWVSYPRVRAELLPTYQQE

SEQ ID NO: 1298961 - protein, 31 aa, Mycobacterium
FYAAVLHEWPRSVWWNWNTGFDGIRVDEGAV

SEQ ID NO: 1298962 - protein, 22 aa, Mycobacterium
FYALPQSPQLFKQLLMVAGMER

SEQ ID NO: 1298963 - protein, 23 aa, Mycobacterium
FYDLDFITPQWSAGPIDAPDPRV

SEQ ID NO: 1298964 - protein, 17 aa, Mycobacterium
FYESTGCFRDMISTHLC

SEQ ID NO: 1298965 - protein, 17 aa, Mycobacterium
FYFVGQRWEWSDEVARM

SEQ ID NO: 1298966 - protein, 31 aa, Mycobacterium
FYGERGWLDDPTRFFAPPPPLTDISIQRVKS

SEQ ID NO: 1298967 - protein, 26 aa, Mycobacterium
FYREGDFLFPAPAPRFSRTTTTTPTP

SEQ ID NO: 1298968 - protein, 18 aa, Mycobacterium
FYVQPTIFEGKNSMRVFQ

SEQ ID NO: 1298969 - protein, 23 aa, Mycobacterium
GAAAALLYAARRYFRDWGTTKAE

SEQ ID NO: 1298970 - protein, 17 aa, Mycobacterium
GAAATAFVVAFGAPADT

SEQ ID NO: 1298971 - protein, 24 aa, Mycobacterium
GAADGLIVVGWSLGGAAAVGLTFG

SEQ ID NO: 1298972 - protein, 23 aa, Mycobacterium
GAADYLIKPFEFAQLRAKLEAFA

SEQ ID NO: 1298973 - protein, 29 aa, Mycobacterium
GAAFRPNGNLLLALRFPTTAAGEPILVEL

SEQ ID NO: 1298974 - protein, 17 aa, Mycobacterium
GAAFTEISGIYAAVDAA

SEQ ID NO: 1298975 - protein, 24 aa, Mycobacterium
GAAGLPFSSFSNHPLAGGSGAGGG

SEQ ID NO: 1298976 - protein, 26 aa, Mycobacterium
GAAIDLMDQSWWFPAVAALPDGDPKV

SEQ ID NO: 1298977 - protein, 17 aa, Mycobacterium
GAAIPLVTQRLSEHLRA

SEQ ID NO: 1298978 - protein, 23 aa, Mycobacterium
GAAKRRSWAVLGEMAELGDDSIS

SEQ ID NO: 1298979 - protein, 21 aa, Mycobacterium
GAALLLDGWALLGRQDLRAAE

SEQ ID NO: 1298980 - protein, 20 aa, Mycobacterium
GAALLLERAGADSGAISLAG

SEQ ID NO: 1298981 - protein, 25 aa, Mycobacterium
GAALNHCVIALSALGWRSVVHRFPN

SEQ ID NO: 1298982 - protein, 24 aa, Mycobacterium
GAALTRALARLFRGRGRSYMDLSV

SEQ ID NO: 1298983 - protein, 30 aa, Mycobacterium
GAARLSAFSVLLDMLVRPPLKTAGPEDRRR

SEQ ID NO: 1298984 - protein, 30 aa, Mycobacterium
GAASQLPFPDLLRTEFLLMVGANPLVSHGS

SEQ ID NO: 1298985 - protein, 25 aa, Mycobacterium
GAAVLLRTMPLVVHGAAVGAAVLIR

SEQ ID NO: 1298986 - protein, 18 aa, Mycobacterium
GACRLEIDRGEMARISAA

SEQ ID NO: 1298987 - protein, 30 aa, Mycobacterium
GADATTVGLFTYPVLMAADVLLYDTDLVPV

SEQ ID NO: 1298988 - protein, 25 aa, Mycobacterium
GADGNLPPWLRLVVVDAANAVFTPR

SEQ ID NO: 1298989 - protein, 24 aa, Mycobacterium
GADMVMVKPAMSYLDVVRACADIS

SEQ ID NO: 1298990 - protein, 19 aa, Mycobacterium
GADRLVLAMPPVTTLDEAT

SEQ ID NO: 1298991 - protein, 17 aa, Mycobacterium
GADWFRPKAMRDLKVRV

SEQ ID NO: 1298992 - protein, 21 aa, Mycobacterium
GADYDYGRPPGGPGRHEDGGY

SEQ ID NO: 1298993 - protein, 23 aa, Mycobacterium
GAEPLLVDRIDEEYGRYFTATGR

SEQ ID NO: 1298994 - protein, 20 aa, Mycobacterium
GAEVLKGPPPTWGRPMWEHD

SEQ ID NO: 1298995 - protein, 23 aa, Mycobacterium
GAFKPPLSWGIRMTGKKFFREYP

SEQ ID NO: 1298996 - protein, 20 aa, Mycobacterium
GAFRIPELIRWPGKIEPRSV

SEQ ID NO: 1298997 - protein, 23 aa, Mycobacterium
GAFRYVMMVLRHIPRPIFRKLPI

SEQ ID NO: 1298998 - protein, 18 aa, Mycobacterium
GAGFAGLYMLHRVRALGL

SEQ ID NO: 1298999 - protein, 23 aa, Mycobacterium
GAGKSTLLRLLLGHRTPDEGRAS

SEQ ID NO: 1299000 - protein, 18 aa, Mycobacterium
GAGLPYKIRDIPVAPDIT

SEQ ID NO: 1299001 - protein, 22 aa, Mycobacterium
GAGMHPWGKWGRDFTEYGVVAA

SEQ ID NO: 1299002 - protein, 21 aa, Mycobacterium
GAGPARIVLWAHNSHVGDARA

SEQ ID NO: 1299003 - protein, 26 aa, Mycobacterium
GAGPGKLDQWTLLARARALDTTGYLA

SEQ ID NO: 1299004 - protein, 22 aa, Mycobacterium
GAGRAMLLRVGDRFGWAGGDLV

SEQ ID NO: 1299005 - protein, 19 aa, Mycobacterium
GAGSLPWVLAVTPPYSQEA

SEQ ID NO: 1299006 - protein, 24 aa, Mycobacterium
GAGVKLLFNIVPESAVYLSDRDLA

SEQ ID NO: 1299007 - protein, 24 aa, Mycobacterium
GAGVRATWLRARPEQFDQAVAFYR

SEQ ID NO: 1299008 - protein, 29 aa, Mycobacterium
GAHGDFARAYLATGLLALGKTRLSEFGFS

SEQ ID NO: 1299009 - protein, 26 aa, Mycobacterium
GAHLRNMAFYNMGLRLLRHVYDAQQA

SEQ ID NO: 1299010 - protein, 26 aa, Mycobacterium
GAHRRPDGHWALPELSAEVASPDAAL

SEQ ID NO: 1299011 - protein, 26 aa, Mycobacterium
GAINDWGVYLPRWETLNAARNWYPKV

SEQ ID NO: 1299012 - protein, 26 aa, Mycobacterium
GAITPWNFPHQINLAKVGPALAAGNT

SEQ ID NO: 1299013 - protein, 23 aa, Mycobacterium
GAKEQLGIVARLAGAALVAKEDS

SEQ ID NO: 1299014 - protein, 24 aa, Mycobacterium
GALAAGCAVLLKPSERTPLTAELL

SEQ ID NO: 1299015 - protein, 29 aa, Mycobacterium
GALALLGANPFWVPAYPPLIANEINETPY

SEQ ID NO: 1299016 - protein, 22 aa, Mycobacterium
GALAVPLNVRLAGPEIGYILAD

SEQ ID NO: 1299017 - protein, 19 aa, Mycobacterium
GALDVPLSQVLSDAGEELA

SEQ ID NO: 1299018 - protein, 20 aa, Mycobacterium
GALEFLVRRSQLTSAGELVA

SEQ ID NO: 1299019 - protein, 18 aa, Mycobacterium
GALFAMLSGRHASAALRQ

SEQ ID NO: 1299020 - protein, 18 aa, Mycobacterium
GALIAFEKGRSWPRERTR

SEQ ID NO: 1299021 - protein, 19 aa, Mycobacterium
GALPGLPKIAVHWPLIDFE

SEQ ID NO: 1299022 - protein, 18 aa, Mycobacterium
GALQRHLEMAPGALGFHY

SEQ ID NO: 1299023 - protein, 17 aa, Mycobacterium
GALSFAYTGPEALKDRV

SEQ ID NO: 1299024 - protein, 18 aa, Mycobacterium
GALTDHLCRLFTEAGGEV

SEQ ID NO: 1299025 - protein, 30 aa, Mycobacterium
GAMGYEPEDLPWEVPLIELGLDSLMAVRIK

SEQ ID NO: 1299026 - protein, 20 aa, Mycobacterium
GAMPATVDDALWGVPASRHE

SEQ ID NO: 1299027 - protein, 26 aa, Mycobacterium
GANAQNGAFNLGFGDITLGDKTTQTA

SEQ ID NO: 1299028 - protein, 29 aa, Mycobacterium
GANPKNPRPVMLWGYQPLADNGQGRAAIA

SEQ ID NO: 1299029 - protein, 25 aa, Mycobacterium
GANQFEISLPPMPPVDAADLLVLMR

SEQ ID NO: 1299030 - protein, 24 aa, Mycobacterium
GANVLRAFSFPFDQVRVLIVGQDP

SEQ ID NO: 1299031 - protein, 28 aa, Mycobacterium
GAPDMVNIEFLWFEDLGDGRSRLRGRSI

SEQ ID NO: 1299032 - protein, 19 aa, Mycobacterium
GAPMAKRLTGWPGGLIVFD

SEQ ID NO: 1299033 - protein, 17 aa, Mycobacterium
GAPPLRVFCGEQAHATI

SEQ ID NO: 1299034 - protein, 26 aa, Mycobacterium
GAPPRPSLGYLVVGLGHHGSKELQQR

SEQ ID NO: 1299035 - protein, 22 aa, Mycobacterium
GAPRPTRLLAALGPKMIELSGT

SEQ ID NO: 1299036 - protein, 22 aa, Mycobacterium
GAQSGALLAPPVRRPEPTGRRR

SEQ ID NO: 1299037 - protein, 25 aa, Mycobacterium
GARANFSVRELPLEGIVKAVVQVEF

SEQ ID NO: 1299038 - protein, 25 aa, Mycobacterium
GAREHALLLALRRDPEVEALAVAPG

SEQ ID NO: 1299039 - protein, 17 aa, Mycobacterium
GARLGLQHNLGLGGACV

SEQ ID NO: 1299040 - protein, 19 aa, Mycobacterium
GARLNQPIRIALAGTLKAG

SEQ ID NO: 1299041 - protein, 27 aa, Mycobacterium
GARNAGLLAVRILASADRALRARMVRF

SEQ ID NO: 1299042 - protein, 23 aa, Mycobacterium
GARSREEFLFSDELRRWADSGAI

SEQ ID NO: 1299043 - protein, 34 aa, Mycobacterium
GASKQLLPVYDKPLIYYPLSTLIMAGIRDIQVIT

SEQ ID NO: 1299044 - protein, 25 aa, Mycobacterium
GASVARDMARRIDAAWFAASTAKGP

SEQ ID NO: 1299045 - protein, 22 aa, Mycobacterium
GATALLYHACFAPRVAEVLPDL

SEQ ID NO: 1299046 - protein, 23 aa, Mycobacterium
GATLPTLRSIAYGSAAIPAELLR

SEQ ID NO: 1299047 - protein, 24 aa, Mycobacterium
GATPPRFGIPMALVHAFAAVAGMS

SEQ ID NO: 1299048 - protein, 32 aa, Mycobacterium
GATSSWLGTALSLKPLLRIDVDGRLELAQRIR

SEQ ID NO: 1299049 - protein, 23 aa, Mycobacterium
GAVALLFDSVLGYTTYKLTQSRY

SEQ ID NO: 1299050 - protein, 25 aa, Mycobacterium
GAVLLQLRWLALEGRPDRVDDLEQP

SEQ ID NO: 1299051 - protein, 28 aa, Mycobacterium
GAVLNVLSVLSWFHPPTSGAYSAAKAAA

SEQ ID NO: 1299052 - protein, 17 aa, Mycobacterium
GAVLSMHFAQQAARFFE

SEQ ID NO: 1299053 - protein, 26 aa, Mycobacterium
GAVPRIRELLALLPGRLRDLENLLNE

SEQ ID NO: 1299054 - protein, 18 aa, Mycobacterium
GAVTHWTALQDDYDAYFC

SEQ ID NO: 1299055 - protein, 24 aa, Mycobacterium
GAYPSTLGYKGFPKSCCTSLNEVI

SEQ ID NO: 1299056 - protein, 25 aa, Mycobacterium
GCAGLRYNLFFDDRALDGDLTAEFG

SEQ ID NO: 1299057 - protein, 30 aa, Mycobacterium
GCASSAWTIGFYILHNWMLALFGEQAQAEA

SEQ ID NO: 1299058 - protein, 26 aa, Mycobacterium
GCRGEVPLGTLIDLLAAFHDVDAEAL

SEQ ID NO: 1299059 - protein, 23 aa, Mycobacterium
GCRNTLLCQLTADRLGRPLLAGP

SEQ ID NO: 1299060 - protein, 23 aa, Mycobacterium
GCRTVLVMCSESVWWRCHRRLVA

SEQ ID NO: 1299061 - protein, 25 aa, Mycobacterium
GCTHPGCTVPFYWAEAHHTDDYSRG

SEQ ID NO: 1299062 - protein, 26 aa, Mycobacterium
GCTTRGDLLVLLRNLHRREDVTRIVV

SEQ ID NO: 1299063 - protein, 32 aa, Mycobacterium
GCTVVIKPCELTPLTTLTLARLAGEAGLPPGV

SEQ ID NO: 1299064 - protein, 22 aa, Mycobacterium
GCWGPVVKCNVPKRGWINGVGG

SEQ ID NO: 1299065 - protein, 20 aa, Mycobacterium
GDCIFFAAGPPKSSRALLGA

SEQ ID NO: 1299066 - protein, 26 aa, Mycobacterium
GDDALNLPWLAMGAVGFISVWGHFAA

SEQ ID NO: 1299067 - protein, 27 aa, Mycobacterium
GDDDNEAKWFWFEGNFGAYEENKVQRL

SEQ ID NO: 1299068 - protein, 23 aa, Mycobacterium
GDDELDIWLISWVPERSTELHDH

SEQ ID NO: 1299069 - protein, 25 aa, Mycobacterium
GDDTIRLGQFLKLASLIDSGADAKS

SEQ ID NO: 1299070 - protein, 24 aa, Mycobacterium
GDEVLLRLFGKFVELAFVAVPDEI

SEQ ID NO: 1299071 - protein, 20 aa, Mycobacterium
GDEWPAILEKIVAADILVIA

SEQ ID NO: 1299072 - protein, 24 aa, Mycobacterium
GDFGWTWGTLLPRDPDDPWSFVFL

SEQ ID NO: 1299073 - protein, 18 aa, Mycobacterium
GDGGLWLAVVSPAALARI

SEQ ID NO: 1299074 - protein, 25 aa, Mycobacterium
GDGPYVQLWPHRHGTDAMFAAALQV

SEQ ID NO: 1299075 - protein, 25 aa, Mycobacterium
GDGQPRGWTFLTNHTHVLLCLAQSG

SEQ ID NO: 1299076 - protein, 24 aa, Mycobacterium
GDGRVRARREISVKIPAGVGDGMR

SEQ ID NO: 1299077 - protein, 24 aa, Mycobacterium
GDGSYWTGLVFADGKRWPEERTTW

SEQ ID NO: 1299078 - protein, 17 aa, Mycobacterium
GDHPQVFLTLTAPSFGA

SEQ ID NO: 1299079 - protein, 20 aa, Mycobacterium
GDIDLLRQAWLTATRARNAL

SEQ ID NO: 1299080 - protein, 22 aa, Mycobacterium
GDKYPGYWKVIAVDEPRSFSFE

SEQ ID NO: 1299081 - protein, 19 aa, Mycobacterium
GDLDVMIIALRAPADGPIG

SEQ ID NO: 1299082 - protein, 24 aa, Mycobacterium
GDLDYFMFQTIVSRTKLVIDPEAL

SEQ ID NO: 1299083 - protein, 22 aa, Mycobacterium
GDLHTELHRLSRLGEWDAMGGL

SEQ ID NO: 1299084 - protein, 28 aa, Mycobacterium
GDLTLAQLSILLTLLDCGPIRMTELAAH

SEQ ID NO: 1299085 - protein, 21 aa, Mycobacterium
GDLTVALARLPVGEWIGVQAD

SEQ ID NO: 1299086 - protein, 17 aa, Mycobacterium
GDLVAMEAYRRSLLEQA

SEQ ID NO: 1299087 - protein, 24 aa, Mycobacterium
GDLVRYYRMLLDGTGGLPSEQADV

SEQ ID NO: 1299088 - protein, 22 aa, Mycobacterium
GDLYVILEAKWKYNFRGGAPAE

SEQ ID NO: 1299089 - protein, 22 aa, Mycobacterium
GDPKLLAHYRKLAADHLEVLAG

SEQ ID NO: 1299090 - protein, 25 aa, Mycobacterium
GDPLSTILTLCRPGEMPVVVEIPGP

SEQ ID NO: 1299091 - protein, 21 aa, Mycobacterium
GDPRPVSESAWWIADLMRTRG

SEQ ID NO: 1299092 - protein, 17 aa, Mycobacterium
GDPYRLAGELGMPPWRV

SEQ ID NO: 1299093 - protein, 24 aa, Mycobacterium
GDRFAATMLILPEGLCYGRVDSTD

SEQ ID NO: 1299094 - protein, 31 aa, Mycobacterium
GDRFLQLGLRGYWPDEPVLQWMAAQGLRSYE

SEQ ID NO: 1299095 - protein, 40 aa, Mycobacterium
GDRIELRLTDRVLSFPASCAPAVLALQRGLAADAGSLPGL

SEQ ID NO: 1299096 - protein, 25 aa, Mycobacterium
GDRPLVQRHALFGCFDRETAVQIRR

SEQ ID NO: 1299097 - protein, 18 aa, Mycobacterium
GDRTTSVAWTAWRGMGMG

SEQ ID NO: 1299098 - protein, 21 aa, Mycobacterium
GDRVVIPFNISCGTCWMCDHG

SEQ ID NO: 1299099 - protein, 23 aa, Mycobacterium
GDSFRVHCREWFDGAIHNDDSAD

SEQ ID NO: 1299100 - protein, 25 aa, Mycobacterium
GDSLEHRLIRIDEPILRVPQLAIHL

SEQ ID NO: 1299101 - protein, 19 aa, Mycobacterium
GDTFLVPSPIAHIGGSIYA

SEQ ID NO: 1299102 - protein, 27 aa, Mycobacterium
GDTSDLLFPFTQLIADLSQLITLEAGD

SEQ ID NO: 1299103 - protein, 34 aa, Mycobacterium; identical to SEQ ID NO: 815439

SEQ ID NO: 1299104 - protein, 25 aa, Mycobacterium
GDTVVLLESMKMEIPVLAEVAGTVT

SEQ ID NO: 1299105 - protein, 24 aa, Mycobacterium
GDVLFHARAKFKRKGSDLLVVNAV

SEQ ID NO: 1299106 - protein, 22 aa, Mycobacterium
GDVPPALRRLVLEGRAGVERAL

SEQ ID NO: 1299107 - protein, 20 aa, Mycobacterium
GDVVLLLPGSAHRDERVFDD

SEQ ID NO: 1299108 - protein, 17 aa, Mycobacterium
GDWLVMHEGWRSELPDE

SEQ ID NO: 1299109 - protein, 18 aa, Mycobacterium
GDWRTKHHFFRDNARLRE

SEQ ID NO: 1299110 - protein, 18 aa, Mycobacterium
GDYDIGIAIGLDKHPRGA

SEQ ID NO: 1299111 - protein, 23 aa, Mycobacterium
GDYLAELTMLILARDRAKNPDRG

SEQ ID NO: 1299112 - protein, 23 aa, Mycobacterium
GDYLEELLDLLDFDGDIDLDVEG

SEQ ID NO: 1299113 - protein, 19 aa, Mycobacterium
GEALFDFLRAIAVEWGAAD

SEQ ID NO: 1299114 - protein, 19 aa, Mycobacterium
GEALYDWNYQRQLLSIRLA

SEQ ID NO: 1299115 - protein, 18 aa, Mycobacterium
GECRAAISGGAPLGARLG

SEQ ID NO: 1299116 - protein, 27 aa, Mycobacterium
GECRHNLGYWAGGEWWGVGPGAHGFLG

SEQ ID NO: 1299117 - protein, 20 aa, Mycobacterium
GEEALFARSLFDSVIYVSFQ

SEQ ID NO: 1299118 - protein, 28 aa, Mycobacterium
GEEGRGFFYILDGLNPERMLIAAEALGI

SEQ ID NO: 1299119 - protein, 23 aa, Mycobacterium
GEENGLPLHYFALEETAGAHDAV

SEQ ID NO: 1299120 - protein, 30 aa, Mycobacterium
GEESALFAADLARMYIRYAERHGWSVTILD

SEQ ID NO: 1299121 - protein, 19 aa, Mycobacterium
GEESLYLRPFVIATEPGLG

SEQ ID NO: 1299122 - protein, 18 aa, Mycobacterium
GEFAVHLALAAGGKCFYT

SEQ ID NO: 1299123 - protein, 18 aa, Mycobacterium
GEFDLSSLRWALSGAEQV

SEQ ID NO: 1299124 - protein, 19 aa, Mycobacterium
GEFDRMSRAWWDMLDPHLR

SEQ ID NO: 1299125 - protein, 31 aa, Mycobacterium
GEFRPDLTAAWLTEALYSLVAGAGWCIQVGR

SEQ ID NO: 1299126 - protein, 23 aa, Mycobacterium
GEGKRLYPLTADRAKPAVPFGGA

SEQ ID NO: 1299127 - protein, 35 aa, Mycobacterium
GEGLTRGWVPFHKLSQWLTYSLLEPFTRAGVPVEG

SEQ ID NO: 1299128 - protein, 19 aa, Mycobacterium
GEHGDSEIPLWSTLSIGGV

SEQ ID NO: 1299129 - protein, 19 aa, Mycobacterium
GEHLRVTVRAYLLSAADDV

SEQ ID NO: 1299130 - protein, 17 aa, Mycobacterium
GEHRRVNIGMLPEETFG

SEQ ID NO: 1299131 - protein, 19 aa, Mycobacterium
GEIKACWIICTNPVATMPN

SEQ ID NO: 1299132 - protein, 25 aa, Mycobacterium
GEIRVPRMLGVFSIGRAINARTLRS

SEQ ID NO: 1299133 - protein, 25 aa, Mycobacterium
GEIVSFAPVYRPPWDSFPRSEPYVV

SEQ ID NO: 1299134 - protein, 27 aa, Mycobacterium
GEKKRHEILQLSLLKPKIAILDETDSG

SEQ ID NO: 1299135 - protein, 24 aa, Mycobacterium
GEKTPEGLSWLYNYIKAQGERSYG

SEQ ID NO: 1299136 - protein, 21 aa, Mycobacterium
GEKTRLALAGLVASTANVLLL

SEQ ID NO: 1299137 - protein, 18 aa, Mycobacterium
GELAPKLALAATAELAGS

SEQ ID NO: 1299138 - protein, 17 aa, Mycobacterium
GELGLPPVPILKGDKGE

SEQ ID NO: 1299139 - protein, 19 aa, Mycobacterium
GELLAARGITTVALDDAGR

SEQ ID NO: 1299140 - protein, 18 aa, Mycobacterium
GELLGCGSAPHPPAFPPC

SEQ ID NO: 1299141 - protein, 24 aa, Mycobacterium
GEMEPYPVIRKLFSTFGIDAMAKE

SEQ ID NO: 1299142 - protein, 29 aa, Mycobacterium
GENAPAPLLLWIHGGPLASWNAWHWRWNP

SEQ ID NO: 1299143 - protein, 25 aa, Mycobacterium
GENHVESLLHRWYQHSLADPGPSDI

SEQ ID NO: 1299144 - protein, 32 aa, Mycobacterium
GENLTAAPIERILLRLPAINRVAVYPVPDEHV

SEQ ID NO: 1299145 - protein, 25 aa, Mycobacterium
GEPAPFKMIILMDPPEHRQMRSLVN

SEQ ID NO: 1299146 - protein, 35 aa, Mycobacterium; identical to SEQ ID NO: 783156

SEQ ID NO: 1299147 - protein, 23 aa, Mycobacterium
GEPILLLHPFMMSQNVWKKVAPA

SEQ ID NO: 1299148 - protein, 21 aa, Mycobacterium
GEPPPWWAAQRDPVVGDALRL

SEQ ID NO: 1299149 - protein, 24 aa, Mycobacterium
GEPTVEFIAAIPGTLYAGAALSIL

SEQ ID NO: 1299150 - protein, 26 aa, Mycobacterium
GEQALRVLDSLRVDVAFIGTNGISVR

SEQ ID NO: 1299151 - protein, 23 aa, Mycobacterium
GEQLDWGTYVFDFGRAEVRNFLV

SEQ ID NO: 1299152 - protein, 27 aa, Mycobacterium
GEQRASNFLLWQSAYAEYVFQDKLWPD

SEQ ID NO: 1299153 - protein, 20 aa, Mycobacterium
GERADWWWYTPFQPPPPTTN

SEQ ID NO: 1299154 - protein, 20 aa, Mycobacterium
GERADWWWYTPFQPPPQAAN

SEQ ID NO: 1299155 - protein, 18 aa, Mycobacterium
GEREGFWSGALHADVDGA

SEQ ID NO: 1299156 - protein, 25 aa, Mycobacterium
GERILTWRQLYDLTELPEHLVIVGS

SEQ ID NO: 1299157 - protein, 29 aa, Mycobacterium
GERRRVALCKLLLSKPDLLLLDEPTNHLD

SEQ ID NO: 1299158 - protein, 24 aa, Mycobacterium
GERRWQPFTHWPDPWVLVGALAQV

SEQ ID NO: 1299159 - protein, 33 aa, Mycobacterium
GERSRLMLDIARWRRRRRDELAALGDKVARRVL

SEQ ID NO: 1299160 - protein, 17 aa, Mycobacterium
GESGELLIAPRLDDRYP

SEQ ID NO: 1299161 - protein, 25 aa, Mycobacterium
GETAPYAWITRLPRGLRKEADDMTW

SEQ ID NO: 1299162 - protein, 18 aa, Mycobacterium
GEVMVDVTFSWFDTGNLE

SEQ ID NO: 1299163 - protein, 23 aa, Mycobacterium
GEVTKFLVYNARKRQVGGDTADQ

SEQ ID NO: 1299164 - protein, 19 aa, Mycobacterium
GEYAGLLAIKAFHDANGAP

SEQ ID NO: 1299165 - protein, 23 aa, Mycobacterium
GFANDLLPLALAGTCQRIEQIRC

SEQ ID NO: 1299166 - protein, 32 aa, Mycobacterium
GFCAQAAVRRTPLLLDGLVVTAAALVADRLAP

SEQ ID NO: 1299167 - protein, 18 aa, Mycobacterium
GFCMGGQFALLLGPGNFG

SEQ ID NO: 1299168 - protein, 23 aa, Mycobacterium
GFDARFSALRRHYTYRLGTAPYG

SEQ ID NO: 1299169 - protein, 21 aa, Mycobacterium
GFDSVFVMDHFYQLPGLGTPD

SEQ ID NO: 1299170 - protein, 26 aa, Mycobacterium
GFEGMTIPLLGVTFYGPTPTDSCEAD

SEQ ID NO: 1299171 - protein, 20 aa, Mycobacterium
GFEMTSPVGGLDTAFRASYG

SEQ ID NO: 1299172 - protein, 20 aa, Mycobacterium
GFERFYGFMGGETDQWYPEL

SEQ ID NO: 1299173 - protein, 18 aa, Mycobacterium
GFERVTLYGLPLVARRRV

SEQ ID NO: 1299174 - protein, 22 aa, Mycobacterium
GFFGTSWPREFGGQDLPPVYDV

SEQ ID NO: 1299175 - protein, 26 aa, Mycobacterium
GFGKPAGVFMLTDANWMAVMGDRPVD

SEQ ID NO: 1299176 - protein, 17 aa, Mycobacterium
GFGSSTFRYAAPAGRDW

SEQ ID NO: 1299177 - protein, 17 aa, Mycobacterium
GFHHVVWAFGDGTLFGI

SEQ ID NO: 1299178 - protein, 17 aa, Mycobacterium
GFHYHVAVLQTLAHRMG

SEQ ID NO: 1299179 - protein, 17 aa, Mycobacterium
GFKHRIADARLLLNQAL

SEQ ID NO: 1299180 - protein, 20 aa, Mycobacterium
GFLPASLVEMRRVRDLQPYI

SEQ ID NO: 1299181 - protein, 33 aa, Mycobacterium
GFNTALVRDPYLYRRFFPTVEYRPVLPGPGEPI

SEQ ID NO: 1299182 - protein, 24 aa, Mycobacterium
GFPATFIAYRDWLVAELQSIGEPV

SEQ ID NO: 1299183 - protein, 25 aa, Mycobacterium
GFPGLMEALLDLRKPLVCAVNGLAV

SEQ ID NO: 1299184 - protein, 25 aa, Mycobacterium
GFPSDYLATPLFDAPTWLADAVSRV

SEQ ID NO: 1299185 - protein, 18 aa, Mycobacterium
GFPTPEEFIAAFNAALEG

SEQ ID NO: 1299186 - protein, 27 aa, Mycobacterium
GFRLGITTDWKSRWYADKQYKDYVKED

SEQ ID NO: 1299187 - protein, 27 aa, Mycobacterium
GFTEFVPLPFVHQSSPLYLSGGARPGP

SEQ ID NO: 1299188 - protein, 17 aa, Mycobacterium
GFTFPVLSDFWPHGAVA

SEQ ID NO: 1299189 - protein, 31 aa, Mycobacterium
GFTHEHDLSLWLLRVQALRSAWGSPTWHRTR

SEQ ID NO: 1299190 - protein, 27 aa, Mycobacterium
GFVNGNFPGLSWPITLGHEIAGTVAEL

SEQ ID NO: 1299191 - protein, 28 aa, Mycobacterium
GFYGVDRLTAFLPAYAGAAPDVVCEAVE

SEQ ID NO: 1299192 - protein, 25 aa, Mycobacterium
GGAAFWPMLTPIMRSREYLFTGDRI

SEQ ID NO: 1299193 - protein, 19 aa, Mycobacterium
GGAALPYKRKLFGQIVRAA

SEQ ID NO: 1299194 - protein, 26 aa, Mycobacterium
GGADARRFWFEEYQLNSYIGGYPKPY

SEQ ID NO: 1299195 - protein, 22 aa, Mycobacterium
GGADLIIIETIFDSLNAKAAVF

SEQ ID NO: 1299196 - protein, 23 aa, Mycobacterium
GGAEYVYRFAPLVGIYGGTLEVF

SEQ ID NO: 1299197 - protein, 23 aa, Mycobacterium
GGALEIFLVPQVPAPLVRICGDT

SEQ ID NO: 1299198 - protein, 25 aa, Mycobacterium
GGARALEWIVGHPATVRSALILAVG

SEQ ID NO: 1299199 - protein, 23 aa, Mycobacterium
GGATVIFQWTYSQAKPRDVIWNQ

SEQ ID NO: 1299200 - protein, 19 aa, Mycobacterium
GGAYRLIDFVLSNLVNARY

SEQ ID NO: 1299201 - protein, 21 aa, Mycobacterium
GGDHSVALPSLRAAHSVHGPM

SEQ ID NO: 1299202 - protein, 23 aa, Mycobacterium
GGDPIVGLQRAVADHHQLASNFA

SEQ ID NO: 1299203 - protein, 29 aa, Mycobacterium
GGDRAAGLNPFALLASHGVPLAFGSDSPV

SEQ ID NO: 1299204 - protein, 25 aa, Mycobacterium
GGDRNLWFHIPKGSGKLFESEKHMW

SEQ ID NO: 1299205 - protein, 23 aa, Mycobacterium
GGEVNVRIWIHPEHRKRGYGTAT

SEQ ID NO: 1299206 - protein, 20 aa, Mycobacterium
GGFELVADDLLHPGLWVQFE

SEQ ID NO: 1299207 - protein, 24 aa, Mycobacterium
GGFFSFGIMHYYLTGMHTPGRTGV

SEQ ID NO: 1299208 - protein, 26 aa, Mycobacterium
GGFPRAVQRFLLGWRASSSRDVELPV

SEQ ID NO: 1299209 - protein, 19 aa, Mycobacterium
GGFRNAMTFVLTGLDIEAK

SEQ ID NO: 1299210 - protein, 26 aa, Mycobacterium
GGGLLRLPRRIPYQKALELALTGESF

SEQ ID NO: 1299211 - protein, 28 aa, Mycobacterium
GGGNPHFDIPQLLSMYKAGKLNLDDMIT

SEQ ID NO: 1299212 - protein, 25 aa, Mycobacterium
GGGTPPEPALLDLIARFVRATQGER

SEQ ID NO: 1299213 - protein, 34 aa, Mycobacterium
GGGVLLPIHWGTFRLAPHPWAEPVQRLLAAADPA

SEQ ID NO: 1299214 - protein, 24 aa, Mycobacterium
GGHFAHEVADLYFFGTVVRLHRAG

SEQ ID NO: 1299215 - protein, 20 aa, Mycobacterium
GGIEVLFFPQTYSVFGAEIA

SEQ ID NO: 1299216 - protein, 23 aa, Mycobacterium
GGKTAMLAALAPGPLTAVEPAPR

SEQ ID NO: 1299217 - protein, 23 aa, Mycobacterium
GGLALWVRLPTPMSSALSAAASR

SEQ ID NO: 1299218 - protein, 25 aa, Mycobacterium
GGLDLDASLKLWERGEELARCCEEH

SEQ ID NO: 1299219 - protein, 25 aa, Mycobacterium
GGLFNGILARYLALVATTLPGDTAD

SEQ ID NO: 1299220 - protein, 26 aa, Mycobacterium
GGLGGFAGLFALRGGYREPVLASSTD

SEQ ID NO: 1299221 - protein, 25 aa, Mycobacterium
GGLHEPLLTVAWPGAHLGPMGLEGA

SEQ ID NO: 1299222 - protein, 17 aa, Mycobacterium
GGLLLGRRYAAGGQALA

SEQ ID NO: 1299223 - protein, 18 aa, Mycobacterium
GGLLLRDLDLPDFRDYAV

SEQ ID NO: 1299224 - protein, 24 aa, Mycobacterium
GGLQLSGPLPVHGCSLHLAPIAFT

SEQ ID NO: 1299225 - protein, 20 aa, Mycobacterium
GGLRTLIHMDDPLHRDIRKI

SEQ ID NO: 1299226 - protein, 23 aa, Mycobacterium
GGLSRDMYALYEPPAPAGLGDDP

SEQ ID NO: 1299227 - protein, 17 aa, Mycobacterium
GGLVAPAIHDVPDRSLD

SEQ ID NO: 1299228 - protein, 25 aa, Mycobacterium
GGMAEYMLVPAARLLVPLGDLDPVE

SEQ ID NO: 1299229 - protein, 30 aa, Mycobacterium
GGMLTPDVLIFAPAFYKKFGYDRPVYTLAH

SEQ ID NO: 1299230 - protein, 18 aa, Mycobacterium
GGMPHGLRAAPDGSVIVV

SEQ ID NO: 1299231 - protein, 28 aa, Mycobacterium
GGMRRRLDLAVSLLAAPPVLFLDEPTTG

SEQ ID NO: 1299232 - protein, 17 aa, Mycobacterium
GGNPLFQSHMWDGSAVP

SEQ ID NO: 1299233 - protein, 26 aa, Mycobacterium
GGNRLPIRDLIRMAAHSRHYLAVFDD

SEQ ID NO: 1299234 - protein, 28 aa, Mycobacterium
GGPATIVPMFLLYDYSFLPPGTASKAEG

SEQ ID NO: 1299235 - protein, 17 aa, Mycobacterium
GGPDLVRGIFPTAVLIT

SEQ ID NO: 1299236 - protein, 22 aa, Mycobacterium
GGPLAHPFQPLLNPRLREFALR

SEQ ID NO: 1299237 - protein, 21 aa, Mycobacterium
GGPPHLLGGRLPTPTANALRE

SEQ ID NO: 1299238 - protein, 25 aa, Mycobacterium
GGPQRPIVLAPRRTPTTVAAAVAPG

SEQ ID NO: 1299239 - protein, 33 aa, Mycobacterium
GGPTAAVPPGAWLAYGQWLRTPVHGIHWAGTET

SEQ ID NO: 1299240 - protein, 23 aa, Mycobacterium
GGQLATYLAAWQAGASAVDGAAA

SEQ ID NO: 1299241 - protein, 23 aa, Mycobacterium
GGQRQRVGIARALALGPSVLLSD

SEQ ID NO: 1299242 - protein, 25 aa, Mycobacterium
GGRAWLGIGAAWFEREHRGLGVPYP

SEQ ID NO: 1299243 - protein, 27 aa, Mycobacterium
GGRDATLLQWIAFEEEYFRAGAPGRAS

SEQ ID NO: 1299244 - protein, 25 aa, Mycobacterium
GGRGLGRAYALLLASRGAKVVVNDL

SEQ ID NO: 1299245 - protein, 17 aa, Mycobacterium
GGRLVVELTPDEAAALG

SEQ ID NO: 1299246 - protein, 17 aa, Mycobacterium
GGRMDWADAFASWSPHE

SEQ ID NO: 1299247 - protein, 17 aa, Mycobacterium
GGRPVKLALTRQQMFAL

SEQ ID NO: 1299248 - protein, 22 aa, Mycobacterium
GGRTALIVAGRVPERVAAAGSF

SEQ ID NO: 1299249 - protein, 17 aa, Mycobacterium
GGRVKDLPGVRYKIIRG

SEQ ID NO: 1299250 - protein, 25 aa, Mycobacterium
GGSKVALPLVRRALELLPGVGFVNA

SEQ ID NO: 1299251 - protein, 23 aa, Mycobacterium
GGTMRWITVGPPNQPGTSIVLHP

SEQ ID NO: 1299252 - protein, 17 aa, Mycobacterium
GGTVRLPRLIGQSRAMD

SEQ ID NO: 1299253 - protein, 24 aa, Mycobacterium
GGTWGELFNIPLTAHFLGGAAIGD

SEQ ID NO: 1299254 - protein, 28 aa, Mycobacterium
GGVFRIVEQLPRKVALELIYTGEPISAA

SEQ ID NO: 1299255 - protein, 32 aa, Mycobacterium
GGVLVITHYTRILRYIQPQFVHVFVGGRIVES

SEQ ID NO: 1299256 - protein, 25 aa, Mycobacterium
GGVPKTLIQHLIRWVILSKQFDDTV

SEQ ID NO: 1299257 - protein, 17 aa, Mycobacterium
GGVPTFESVREKIEGRY

SEQ ID NO: 1299258 - protein, 32 aa, Mycobacterium
GGVRIDHIIGLFRLWWIPRGAAPTEGTYVRYD

SEQ ID NO: 1299259 - protein, 27 aa, Mycobacterium
GGVSVPLGFLISWLRFVHTRPERFDAA

SEQ ID NO: 1299260 - protein, 28 aa, Mycobacterium
GGYATHVELPWDAMLLPIAEDMDPVLAT

SEQ ID NO: 1299261 - protein, 20 aa, Mycobacterium
GGYGYMMEYPIARLYNDARV

SEQ ID NO: 1299262 - protein, 21 aa, Mycobacterium
GGYRDNEIVRWLFTPDESLVI

SEQ ID NO: 1299263 - protein, 28 aa, Mycobacterium
GHAFWDTEGFVLPVLTYTKPSAAADALR

SEQ ID NO: 1299264 - protein, 24 aa, Mycobacterium
GHARALCAALLQWGARGGATHAYV

SEQ ID NO: 1299265 - protein, 17 aa, Mycobacterium
GHCAAIHLNMPIAYPPA

SEQ ID NO: 1299266 - protein, 18 aa, Mycobacterium
GHDQRRFLELFKRDLEPR

SEQ ID NO: 1299267 - protein, 23 aa, Mycobacterium
GHDYAVISLSDRLKPWEIIEARL

SEQ ID NO: 1299268 - protein, 18 aa, Mycobacterium
GHELLTAQLYFPGDPHND

SEQ ID NO: 1299269 - protein, 26 aa, Mycobacterium
GHEVGWSMLPVARTALRRIGDDTDVV

SEQ ID NO: 1299270 - protein, 24 aa, Mycobacterium
GHGDLLVTVKVAVPPNLEGEAAEA

SEQ ID NO: 1299271 - protein, 18 aa, Mycobacterium
GHKGGRTLDPWFREHIAA

SEQ ID NO: 1299272 - protein, 25 aa, Mycobacterium
GHLDPTMFAAFMPGALELTVEEGIA

SEQ ID NO: 1299273 - protein, 19 aa, Mycobacterium
GHLDPTVFQRLAPGIMPLS

SEQ ID NO: 1299274 - protein, 17 aa, Mycobacterium
GHLGAMPATVDDALWGV

SEQ ID NO: 1299275 - protein, 18 aa, Mycobacterium
GHNAHIRYSFAMAAQKAG

SEQ ID NO: 1299276 - protein, 28 aa, Mycobacterium
GHNYIGTEHILLGLIREGEGVAAQVLVK

SEQ ID NO: 1299277 - protein, 21 aa, Mycobacterium
GHRGALFLAAINEILQQPQKL

SEQ ID NO: 1299278 - protein, 19 aa, Mycobacterium
GHRMLANWLGYCGSAPDEA

SEQ ID NO: 1299279 - protein, 27 aa, Mycobacterium
GHSSLTLYIQLYLGGFGLELEDIQALR

SEQ ID NO: 1299280 - protein, 24 aa, Mycobacterium
GHYSFLNVFKLFGPGNKAPLSFPI

SEQ ID NO: 1299281 - protein, 26 aa, Mycobacterium
GIAADGLRRFVTRPLQLTRVIPETTS

SEQ ID NO: 1299282 - protein, 34 aa, Mycobacterium
GIAAGDRVAIWSPNTWHWVVAALATTYAGGVVVP

SEQ ID NO: 1299283 - protein, 17 aa, Mycobacterium
GIAPLREAIAAQRKRVH

SEQ ID NO: 1299284 - protein, 19 aa, Mycobacterium
GIAVAVDWSVLPRTEWETP

SEQ ID NO: 1299285 - protein, 32 aa, Mycobacterium
GIDDVATFDLYSCFPFPVFAVCDEFGLDADDP

SEQ ID NO: 1299286 - protein, 21 aa, Mycobacterium
GIDLLTLRALMGHVSPETTAR

SEQ ID NO: 1299287 - protein, 22 aa, Mycobacterium
GIDQPVQRFWRDAHAGRVHAAN

SEQ ID NO: 1299288 - protein, 23 aa, Mycobacterium
GIEARGRQLAVTALALCPGGSIT

SEQ ID NO: 1299289 - protein, 17 aa, Mycobacterium
GIEGRVPFRGPLAQVIH

SEQ ID NO: 1299290 - protein, 25 aa, Mycobacterium
GIEMSGLPSWMWLEVDDVVGDCLTA

SEQ ID NO: 1299291 - protein, 26 aa, Mycobacterium
GIGCSSRFPYYLETYGFHSIHGRAPT

SEQ ID NO: 1299292 - protein, 25 aa, Mycobacterium
GIGFVFQHYAAFKHLSVRENVAFGL

SEQ ID NO: 1299293 - protein, 18 aa, Mycobacterium
GIGGGWYEHEWRAYGYGF

SEQ ID NO: 1299294 - protein, 26 aa, Mycobacterium
GIGPPITDGFYYDFDVPRAFTPEDLE

SEQ ID NO: 1299295 - protein, 31 aa, Mycobacterium
GIGVLYGRRELLAEMPPFLTGGSMIETVTME

SEQ ID NO: 1299296 - protein, 20 aa, Mycobacterium
GIIARRLRKDIYDLYGYNAV

SEQ ID NO: 1299297 - protein, 22 aa, Mycobacterium
GILGSRWLAHYTATTTYLDAFA

SEQ ID NO: 1299298 - protein, 20 aa, Mycobacterium
GILRAQLIRMAAHHLGVEVD

SEQ ID NO: 1299299 - protein, 25 aa, Mycobacterium
GIPAVTFWAAVPHYVSQPPNPKATV

SEQ ID NO: 1299300 - protein, 18 aa, Mycobacterium
GIPIVDHWWQTETGWAIA

SEQ ID NO: 1299301 - protein, 18 aa, Mycobacterium
GIPSPLEWACFTFGIIQN

SEQ ID NO: 1299302 - protein, 31 aa, Mycobacterium
GIPSYPHPRLMPDFWEFPTVSMGLGPMNAIY

SEQ ID NO: 1299303 - protein, 19 aa, Mycobacterium
GIQFKDLTPLLADAEGLMA

SEQ ID NO: 1299304 - protein, 19 aa, Mycobacterium
GIQIPRFCDHPLLDPVGAC

SEQ ID NO: 1299305 - protein, 22 aa, Mycobacterium
GIRNPVAPPLVIHRDENDRVST

SEQ ID NO: 1299306 - protein, 25 aa, Mycobacterium
GISDDAWVLDELRQLAAVLGVARDA

SEQ ID NO: 1299307 - protein, 24 aa, Mycobacterium
GISRPTFYFYFGSKEAVLLTLWER

SEQ ID NO: 1299308 - protein, 23 aa, Mycobacterium
GISRREIEFPDRGVVVISGANEI

SEQ ID NO: 1299309 - protein, 25 aa, Mycobacterium
GISVSDVLLAPTLREVWAVIAPMLA

SEQ ID NO: 1299310 - protein, 17 aa, Mycobacterium
GIWLSEERRRIGNVDVG

SEQ ID NO: 1299311 - protein, 27 aa, Mycobacterium
GKAKEVAGAVLGRDDLYREGQAQQDKA

SEQ ID NO: 1299312 - protein, 19 aa, Mycobacterium
GKAKEVVGAVTGNDSLTAE

SEQ ID NO: 1299313 - protein, 25 aa, Mycobacterium
GKARLSPLAYLTVDGRMLIVGSYAG

SEQ ID NO: 1299314 - protein, 19 aa, Mycobacterium
GKAWLFAPNGLADGPLPTH

SEQ ID NO: 1299315 - protein, 31 aa, Mycobacterium
GKDDPLVLKPWTMPEPLLPIAVQPRAKTDED

SEQ ID NO: 1299316 - protein, 24 aa, Mycobacterium
GKDRVGKLTWYLGGRSASLSQLLP

SEQ ID NO: 1299317 - protein, 39 aa, Mycobacterium
GKGVRVGLFFPNGVDWIVWWLAVSRIGALAVPLSTMYTP

SEQ ID NO: 1299318 - protein, 17 aa, Mycobacterium
GKKYTAQEISARTLMKL

SEQ ID NO: 1299319 - protein, 18 aa, Mycobacterium
GKLLAFRDRMGWDLPWVS

SEQ ID NO: 1299320 - protein, 23 aa, Mycobacterium
GKLLDLDMLIFAGGRERTRAEFS

SEQ ID NO: 1299321 - protein, 20 aa, Mycobacterium
GKMGFVFNFITYGGHQVDGV

SEQ ID NO: 1299322 - protein, 26 aa, Mycobacterium
GKNVVTPVGWFYPGEKEAAPLRAAAL

SEQ ID NO: 1299323 - protein, 22 aa, Mycobacterium
GKPLHHFPTRRLCNLASVTSFY

SEQ ID NO: 1299324 - protein, 20 aa, Mycobacterium
GKSFVFFRTPQPDAADPVTG

SEQ ID NO: 1299325 - protein, 24 aa, Mycobacterium
GKSLYIGVLVKQLELLCEHLGVSM

SEQ ID NO: 1299326 - protein, 23 aa, Mycobacterium
GKSTFLQTLILSAAATHSPRDVQ

SEQ ID NO: 1299327 - protein, 17 aa, Mycobacterium
GKSTFMRLLLAEDTPTS

SEQ ID NO: 1299328 - protein, 21 aa, Mycobacterium
GKSTLLRLLSGIYEPTRGSAT

SEQ ID NO: 1299329 - protein, 27 aa, Mycobacterium
GKSVLGFSLLGLLPDNATVSGTVRVAG

SEQ ID NO: 1299330 - protein, 22 aa, Mycobacterium
GKTALLGYLLDEAPGWRCVHVA

SEQ ID NO: 1299331 - protein, 20 aa, Mycobacterium
GKTMVVTGLHLLGGARADPN

SEQ ID NO: 1299332 - protein, 23 aa, Mycobacterium
GKTSLLNHVLRAPDARVGVVIND

SEQ ID NO: 1299333 - protein, 19 aa, Mycobacterium
GKVDWAFAELLALGTMISE

SEQ ID NO: 1299334 - protein, 26 aa, Mycobacterium
GKVRTFPLGPGFLLDGRPVILTAPRR

SEQ ID NO: 1299335 - protein, 18 aa, Mycobacterium
GKVTPALIKALSAVRGRI

SEQ ID NO: 1299336 - protein, 20 aa, Mycobacterium
GLAAFIDLRDQTCRTPYCNA

SEQ ID NO: 1299337 - protein, 21 aa, Mycobacterium
GLADIEWTVQLMQLRFAHKVP

SEQ ID NO: 1299338 - protein, 18 aa, Mycobacterium
GLAEIQLPDLQPGSSIMP

SEQ ID NO: 1299339 - protein, 18 aa, Mycobacterium
GLASLHDLALLSAMYVMF

SEQ ID NO: 1299340 - protein, 23 aa, Mycobacterium
GLASTDQLYFASGLLDCPGAMFT

SEQ ID NO: 1299341 - protein, 27 aa, Mycobacterium
GLDCSGLTQWAYREAGLDLPRLAQEQD

SEQ ID NO: 1299342 - protein, 21 aa, Mycobacterium
GLDGRLVWMHQVHSDRVVRVT

SEQ ID NO: 1299343 - protein, 20 aa, Mycobacterium
GLDHSALIKALERLSGADAS

SEQ ID NO: 1299344 - protein, 21 aa, Mycobacterium
GLDRFIPAMFAYELPPKRVTT

SEQ ID NO: 1299345 - protein, 25 aa, Mycobacterium
GLDRVRPFRPFQVNTGLLDRAHAEA

SEQ ID NO: 1299346 - protein, 26 aa, Mycobacterium
GLDYVDLYLIHWPAGDHGKYIDSWGG

SEQ ID NO: 1299347 - protein, 18 aa, Mycobacterium
GLELHPSIAKLVAGLGLR

SEQ ID NO: 1299348 - protein, 18 aa, Mycobacterium
GLELIETHLLFGIDYDRI

SEQ ID NO: 1299349 - protein, 21 aa, Mycobacterium
GLELPRKVFAHGWLLNRGEKM

SEQ ID NO: 1299350 - protein, 29 aa, Mycobacterium
GLEQRLRALHYPKIVLGLSGGLDSTHALI

SEQ ID NO: 1299351 - protein, 20 aa, Mycobacterium
GLFGYAIPQEWGGLGLDLTQ

SEQ ID NO: 1299352 - protein, 22 aa, Mycobacterium
GLFTLVLHTHLPWLAHHGRWPV

SEQ ID NO: 1299353 - protein, 29 aa, Mycobacterium
GLGAPLDVFLVRKLGVPQWEELAMGAIAS

SEQ ID NO: 1299354 - protein, 18 aa, Mycobacterium
GLGDELHHFGWNACSSAL

SEQ ID NO: 1299355 - protein, 19 aa, Mycobacterium
GLGGVYPEIFLPLHGEHQA

SEQ ID NO: 1299356 - protein, 18 aa, Mycobacterium
GLGGWFLDGVDGDPSNVI

SEQ ID NO: 1299357 - protein, 22 aa, Mycobacterium
GLGHRDIGLLTMRLGLDRPDGD

SEQ ID NO: 1299358 - protein, 25 aa, Mycobacterium
GLGLEFLRHIERCAVLVHVVDCATM

SEQ ID NO: 1299359 - protein, 20 aa, Mycobacterium
GLGRLYALELARRGAAVVVN

SEQ ID NO: 1299360 - protein, 25 aa, Mycobacterium
GLGTAKVWGLYMAGSRLGFETNIVQ

SEQ ID NO: 1299361 - protein, 19 aa, Mycobacterium
GLGVMGLAEMLARLGIPYD

SEQ ID NO: 1299362 - protein, 19 aa, Mycobacterium
GLHEVLPADLLAHSLRELV

SEQ ID NO: 1299363 - protein, 24 aa, Mycobacterium
GLHQLCGPLMDYLDDLPPPQRDAL

SEQ ID NO: 1299364 - protein, 39 aa, Mycobacterium
GLHWDRILFCAKEATYKAWFPLTHRWLGFEDAHITFDVD

SEQ ID NO: 1299365 - protein, 20 aa, Mycobacterium
GLIPGLLGDLPITGAGLNII

SEQ ID NO: 1299366 - protein, 21 aa, Mycobacterium
GLIVVPVMFDRIMDLPDEVRA

SEQ ID NO: 1299367 - protein, 27 aa, Mycobacterium
GLLADGPVVLFFYPAAMTPGCTKEACH

SEQ ID NO: 1299368 - protein, 18 aa, Mycobacterium
GLLAGAYLKKAGVTGIRV

SEQ ID NO: 1299369 - protein, 24 aa, Mycobacterium
GLLEQSRRHAFLASLLGVQHIVLA

SEQ ID NO: 1299370 - protein, 18 aa, Mycobacterium
GLLFLGSSRLGGLVTVTV

SEQ ID NO: 1299371 - protein, 17 aa, Mycobacterium
GLLGARQGTLQTTARSG

SEQ ID NO: 1299372 - protein, 29 aa, Mycobacterium
GLLGDPDFLLTIGLLPLQTAYALNTAVGG

SEQ ID NO: 1299373 - protein, 21 aa, Mycobacterium
GLLGIIVPERFGGPDLPRSTA

SEQ ID NO: 1299374 - protein, 17 aa, Mycobacterium
GLLIADVHITYKGQLRL

SEQ ID NO: 1299375 - protein, 22 aa, Mycobacterium
GLLLAMAENEAMRRRLWAEFSG

SEQ ID NO: 1299376 - protein, 27 aa, Mycobacterium
GLLLPAISLGLWYNFGDNRPFDVQREV

SEQ ID NO: 1299377 - protein, 20 aa, Mycobacterium
GLLPPNNWISVFGGPAWTRI

SEQ ID NO: 1299378 - protein, 20 aa, Mycobacterium
GLLRTRLFEHATTVLTSATL

SEQ ID NO: 1299379 - protein, 31 aa, Mycobacterium
GLMGPYLMHPIHWAYVDRWFDPECPDMIVRD

SEQ ID NO: 1299380 - protein, 33 aa, Mycobacterium
GLMNPNHYLAVAIDYLFTHRPDWPSATAVGKTA

SEQ ID NO: 1299381 - protein, 17 aa, Mycobacterium
GLPLLDLKDLRSVIHFL

SEQ ID NO: 1299382 - protein, 20 aa, Mycobacterium
GLPVILGPDHPVTGGYPVIA

SEQ ID NO: 1299383 - protein, 19 aa, Mycobacterium
GLPWDCVLSAELFRHYKPD

SEQ ID NO: 1299384 - protein, 24 aa, Mycobacterium
GLQARLMSQALRKITGALSNSGTT

SEQ ID NO: 1299385 - protein, 21 aa, Mycobacterium
GLRELLLRYDGRADRPLLASV

SEQ ID NO: 1299386 - protein, 17 aa, Mycobacterium
GLRFTLRDVADALEVPV

SEQ ID NO: 1299387 - protein, 18 aa, Mycobacterium
GLRLAGRKVVIVGGGTVA

SEQ ID NO: 1299388 - protein, 31 aa, Mycobacterium
GLRSSYVATVYAAPLMVPHRSGLVVFTSSSG

SEQ ID NO: 1299389 - protein, 27 aa, Mycobacterium
GLRTARQLLLDIIDIGLPVGCEFLEPT

SEQ ID NO: 1299390 - protein, 18 aa, Mycobacterium
GLSGLYVGPADLAISMGY

SEQ ID NO: 1299391 - protein, 20 aa, Mycobacterium
GLSLLRHVEELVKTGWPVLM

SEQ ID NO: 1299392 - protein, 18 aa, Mycobacterium
GLSSRLFQEIRETRGLAY

SEQ ID NO: 1299393 - protein, 20 aa, Mycobacterium
GLTLPCWTLLGMLDRAIELT

SEQ ID NO: 1299394 - protein, 21 aa, Mycobacterium
GLTLRIPRPRLCTDNGAMIAS

SEQ ID NO: 1299395 - protein, 27 aa, Mycobacterium
GLTTNDYSLLFAGKLRREDIDPYVPFG

SEQ ID NO: 1299396 - protein, 18 aa, Mycobacterium
GLTYPGIGFVVWRNAEQL

SEQ ID NO: 1299397 - protein, 23 aa, Mycobacterium
GLVDIAVWADPARGLAVGVVSSG

SEQ ID NO: 1299398 - protein, 24 aa, Mycobacterium
GLVHGGFLGVFFDCVTQHQSCAAG

SEQ ID NO: 1299399 - protein, 24 aa, Mycobacterium
GLVLDTDLRWRIVTALAASGDIDA

SEQ ID NO: 1299400 - protein, 26 aa, Mycobacterium
GLVVLEADPYRRLAFTFPAAVPSTVD

SEQ ID NO: 1299401 - protein, 20 aa, Mycobacterium
GLVVSDLIPRLPLPTKIVIE

SEQ ID NO: 1299402 - protein, 19 aa, Mycobacterium
GLWLAVVSPAALARIEAIG

SEQ ID NO: 1299403 - protein, 18 aa, Mycobacterium
GLWPGLRETFGVGSADIP

SEQ ID NO: 1299404 - protein, 19 aa, Mycobacterium
GLYAAFPHLRNTPGSVVVN

SEQ ID NO: 1299405 - protein, 29 aa, Mycobacterium
GMALAAGLHLPLVLVIDTAGPALTVEAEQ

SEQ ID NO: 1299406 - protein, 20 aa, Mycobacterium
GMATVKWELEDLSFAILHPK

SEQ ID NO: 1299407 - protein, 32 aa, Mycobacterium
GMAVVISDFLGPIDWMRPLRAIAGRHEVLGIE

SEQ ID NO: 1299408 - protein, 18 aa, Mycobacterium
GMGSTEELVFSYDGMRAK

SEQ ID NO: 1299409 - protein, 19 aa, Mycobacterium
GMLLGFPGHHAFTHRPTYR

SEQ ID NO: 1299410 - protein, 19 aa, Mycobacterium
GMPGVFGMGLLHGGVLAQR

SEQ ID NO: 1299411 - protein, 32 aa, Mycobacterium
GMPKASVMTHYRWLRALAGFGGLGVRLSSKDT

SEQ ID NO: 1299412 - protein, 26 aa, Mycobacterium
GMQMRLTFARSLLNDPDLLFLDEPTS

SEQ ID NO: 1299413 - protein, 24 aa, Mycobacterium
GMRPDALRWHPNGLAIDVMIPNPG

SEQ ID NO: 1299414 - protein, 19 aa, Mycobacterium
GMYELEFPAPQLSAADGRG

SEQ ID NO: 1299415 - protein, 27 aa, Mycobacterium
GNALRMDKPLQRYWRDAHAGVAHAIHT

SEQ ID NO: 1299416 - protein, 18 aa, Mycobacterium
GNDWVQVRLAARGVLSFA

SEQ ID NO: 1299417 - protein, 30 aa, Mycobacterium
GNGHLWRRHRLAPHRLAYYSARKLVGAGLH

SEQ ID NO: 1299418 - protein, 26 aa, Mycobacterium
GNGYRRTPYRIVLARVARLANALRSL

SEQ ID NO: 1299419 - protein, 24 aa, Mycobacterium
GNLTLVPLSLYFTGGKVKVELALA

SEQ ID NO: 1299420 - protein, 20 aa, Mycobacterium
GNPVVGIRNPVAPPLVIHRD

SEQ ID NO: 1299421 - protein, 22 aa, Mycobacterium
GNRIPVLEVLHARLKELHGGAE

SEQ ID NO: 1299422 - protein, 22 aa, Mycobacterium
GNRPCEAALNRDFRAFEAGCHP

SEQ ID NO: 1299423 - protein, 32 aa, Mycobacterium
GNSDWVRINGFGTPWWADDLAALAGTSVGGVM

SEQ ID NO: 1299424 - protein, 25 aa, Mycobacterium
GNSTRARIVLFRKPIERRAKDSDEL

SEQ ID NO: 1299425 - protein, 31 aa, Mycobacterium
GNTIVGLLLGRPTVLYPLGAFDPGALLDVLA

SEQ ID NO: 1299426 - protein, 22 aa, Mycobacterium
GPAAPCWALSLTSGAGRAMLLR

SEQ ID NO: 1299427 - protein, 24 aa, Mycobacterium
GPAKKVLELTFREALRLGHNYIGT

SEQ ID NO: 1299428 - protein, 23 aa, Mycobacterium
GPALLLGARGRRLDPRQARTVVH

SEQ ID NO: 1299429 - protein, 17 aa, Mycobacterium
GPALYRHFRKKHDILAQ

SEQ ID NO: 1299430 - protein, 26 aa, Mycobacterium
GPANYVNLLSRTALMQGFNALDQWGR

SEQ ID NO: 1299431 - protein, 26 aa, Mycobacterium
GPARDYILELLLAHSTAGLTYEDSVG

SEQ ID NO: 1299432 - protein, 25 aa, Mycobacterium
GPASARLLVTAALAQAGPLLVVTAT

SEQ ID NO: 1299433 - protein, 25 aa, Mycobacterium
GPATHRLVKKWLAQGEFDVLHLHEP

SEQ ID NO: 1299434 - protein, 17 aa, Mycobacterium
GPAVKRGVAAGPAKRAA

SEQ ID NO: 1299435 - protein, 21 aa, Mycobacterium
GPDALIRLIDACHSRGLGVLI

SEQ ID NO: 1299436 - protein, 26 aa, Mycobacterium
GPDEFAIVHKLRRVLSGLDSHQAIDL

SEQ ID NO: 1299437 - protein, 19 aa, Mycobacterium
GPDLRQLLVGSEGAFGVIT

SEQ ID NO: 1299438 - protein, 25 aa, Mycobacterium
GPDVGWVLRLLAAPGAEVLLPVVAP

SEQ ID NO: 1299439 - protein, 20 aa, Mycobacterium
GPDVLFVPTATFPIDLMWDE

SEQ ID NO: 1299440 - protein, 24 aa, Mycobacterium
GPDYVIAMLAVLKAGGMIVPLDPG

SEQ ID NO: 1299441 - protein, 21 aa, Mycobacterium
GPEGKDLAMLLLRLGRGRLGH

SEQ ID NO: 1299442 - protein, 25 aa, Mycobacterium
GPERAYVTSLIRPEHLYDGDVAVYL

SEQ ID NO: 1299443 - protein, 21 aa, Mycobacterium
GPFEGATLLLLHTVGAKTGKA

SEQ ID NO: 1299444 - protein, 20 aa, Mycobacterium
GPFPALQTDYVYLLMPVRLP

SEQ ID NO: 1299445 - protein, 26 aa, Mycobacterium
GPFRNRTALLDVPRLGPKAFEQCAGF

SEQ ID NO: 1299446 - protein, 23 aa, Mycobacterium
GPGATILLRLDRDVPAELRSALA

SEQ ID NO: 1299447 - protein, 24 aa, Mycobacterium
GPGEITLRTWVGQSCPAHATSSGK

SEQ ID NO: 1299448 - protein, 17 aa, Mycobacterium
GPHFCLGAPLARLEAAV

SEQ ID NO: 1299449 - protein, 29 aa, Mycobacterium
GPHKQFRTWHYWWQAHLLDCLVDAQLREP

SEQ ID NO: 1299450 - protein, 19 aa, Mycobacterium
GPHRVLRGDLGFAGLPGVV

SEQ ID NO: 1299451 - protein, 18 aa, Mycobacterium
GPKIALATLAVYDAPTLR

SEQ ID NO: 1299452 - protein, 24 aa, Mycobacterium
GPLGKYPVLFLDPDFKEDIRLAIV

SEQ ID NO: 1299453 - protein, 21 aa, Mycobacterium
GPLKGILKYYDAPIVSSDIVT

SEQ ID NO: 1299454 - protein, 22 aa, Mycobacterium
GPLRDVPVERLGYVLPTILLPI

SEQ ID NO: 1299455 - protein, 18 aa, Mycobacterium
GPLSRQYLQTFRTIHRYA

SEQ ID NO: 1299456 - protein, 21 aa, Mycobacterium
GPLTWPLHISLLLAKEFAMTG

SEQ ID NO: 1299457 - protein, 24 aa, Mycobacterium
GPMGPTRMVLSKPVIAAVSGYAVA

SEQ ID NO: 1299458 - protein, 20 aa, Mycobacterium
GPNHQHFFNFRLDMSIDGAG

SEQ ID NO: 1299459 - protein, 25 aa, Mycobacterium
GPPASHHLRWLASANCLLEIPEDVS

SEQ ID NO: 1299460 - protein, 21 aa, Mycobacterium
GPPDWNPRQGALVALAAFGKM

SEQ ID NO: 1299461 - protein, 24 aa, Mycobacterium
GPPLRLDRLSFPDLDPVRKALLDE

SEQ ID NO: 1299462 - protein, 19 aa, Mycobacterium
GPPPTHKIWATQSGFTFPV

SEQ ID NO: 1299463 - protein, 21 aa, Mycobacterium
GPPYRLNPPVLRTPQPAPRLG

SEQ ID NO: 1299464 - protein, 30 aa, Mycobacterium
GPQGGTRFRPHFFPFTEPSAEVDVWFPGKK

SEQ ID NO: 1299465 - protein, 23 aa, Mycobacterium
GPQHFHYDAWWHLNQNVLISSEW

SEQ ID NO: 1299466 - protein, 23 aa, Mycobacterium
GPQLVVPVLNARFALNAANARWG

SEQ ID NO: 1299467 - protein, 22 aa, Mycobacterium
GPQVDKGARWDPAELGPVVADL

SEQ ID NO: 1299468 - protein, 27 aa, Mycobacterium
GPRNAFPLTLPGYGSPARLLHFVAGGI

SEQ ID NO: 1299469 - protein, 35 aa, Mycobacterium
GPRPLDTAALRDALLDLYEFWLGTKANEIGITATS

SEQ ID NO: 1299470 - protein, 18 aa, Mycobacterium
GPSRLCVCPIDPTARGRS

SEQ ID NO: 1299471 - protein, 35 aa, Mycobacterium
GPSSTTTFVSWLPFYHDMGLVLGICVPILSGHPAA

SEQ ID NO: 1299472 - protein, 26 aa, Mycobacterium
GPTAARLFYVYADTLLALGRTQDALQ

SEQ ID NO: 1299473 - protein, 22 aa, Mycobacterium
GPTIAVLYYRAQQLAGNTAYIE

SEQ ID NO: 1299474 - protein, 25 aa, Mycobacterium
GPTVWQRLLRPLFGAKFGDAFGEVP

SEQ ID NO: 1299475 - protein, 24 aa, Mycobacterium
GPVQYNVRYTLKEAVLPNGTVPAH

SEQ ID NO: 1299476 - protein, 23 aa, Mycobacterium
GPVRFPGVPTWFSRTPGHVRGPA

SEQ ID NO: 1299477 - protein, 20 aa, Mycobacterium
GPVTGYPGWSHYGASKSAQL

SEQ ID NO: 1299478 - protein, 26 aa, Mycobacterium
GPVTNGPVWVLAGFGAQHRKMGKSLY

SEQ ID NO: 1299479 - protein, 17 aa, Mycobacterium
GPYTPGFRAVPFGDTDA

SEQ ID NO: 1299480 - protein, 26 aa, Mycobacterium
GQAELDGHHFFWTVHARNKKAITLDL

SEQ ID NO: 1299481 - protein, 20 aa, Mycobacterium
GQAGGWRRDLSLRHAEILLA

SEQ ID NO: 1299482 - protein, 23 aa, Mycobacterium
GQALDAPVLLHPADDMLWQMTHP

SEQ ID NO: 1299483 - protein, 21 aa, Mycobacterium
GQAMTFLFTNGVDLNHDVGFI

SEQ ID NO: 1299484 - protein, 22 aa, Mycobacterium
GQATIPIVYAVTRAVTEQGGTV

SEQ ID NO: 1299485 - protein, 19 aa, Mycobacterium
GQAVIAYEPVWAIGTGRVA

SEQ ID NO: 1299486 - protein, 22 aa, Mycobacterium
GQERPLPLDLVPRVISAAEWTR

SEQ ID NO: 1299487 - protein, 25 aa, Mycobacterium
GQHNWALLHALPELVATEIPVLVGA

SEQ ID NO: 1299488 - protein, 20 aa, Mycobacterium
GQIPADLQGWYLRNGPNPRQ

SEQ ID NO: 1299489 - protein, 27 aa, Mycobacterium
GQKIWSSRAVFGDRAFGLFRSDPEAQR

SEQ ID NO: 1299490 - protein, 18 aa, Mycobacterium
GQLVAARLAAFGTHVVAY

SEQ ID NO: 1299491 - protein, 25 aa, Mycobacterium
GQNARLAARLTGWRIDIRSDAAPPD

SEQ ID NO: 1299492 - protein, 28 aa, Mycobacterium
GQPEDLVGMCLFLLSDQAKWITGQIFNV

SEQ ID NO: 1299493 - protein, 25 aa, Mycobacterium
GQPGQWYLHLFDPEQPDLNWDNPEV

SEQ ID NO: 1299494 - protein, 28 aa, Mycobacterium
GQRAKNMFALGLLSWMYGRELHQSEAFI

SEQ ID NO: 1299495 - protein, 31 aa, Mycobacterium
GQRCTTVPGSWLFFPGWDTTTAELPPMAQPP

SEQ ID NO: 1299496 - protein, 23 aa, Mycobacterium
GQRRRATFFSRNLDVPAMVVGMG

SEQ ID NO: 1299497 - protein, 22 aa, Mycobacterium
GQRRRVELARILFAASDTGSGS

SEQ ID NO: 1299498 - protein, 22 aa, Mycobacterium
GQRSFSLDDLSLRYLRRELRAD

SEQ ID NO: 1299499 - protein, 26 aa, Mycobacterium
GQRVTDDSFLLCFNAHHEPLEFAMPA

SEQ ID NO: 1299500 - protein, 24 aa, Mycobacterium
GQSKHLVYQYLPSRYGMNPDDLRK

SEQ ID NO: 1299501 - protein, 28 aa, Mycobacterium
GQSKLSNLLFTYELQRRLDTRDAIAVAA

SEQ ID NO: 1299502 - protein, 20 aa, Mycobacterium
GQTHRLVVSALPVASVLTIG

SEQ ID NO: 1299503 - protein, 21 aa, Mycobacterium
GQTVILYDKPTLDAAAVLTTA

SEQ ID NO: 1299504 - protein, 19 aa, Mycobacterium
GQVLRTTEGWLLIDFEGEP

SEQ ID NO: 1299505 - protein, 23 aa, Mycobacterium
GQVTEAFWNAIRHAKPIAVGLNC

SEQ ID NO: 1299506 - protein, 27 aa, Mycobacterium
GQVTKILNNLLFTANLGSALSTLELGE

SEQ ID NO: 1299507 - protein, 19 aa, Mycobacterium
GRATTLLFAEYGMCVVAED

SEQ ID NO: 1299508 - protein, 18 aa, Mycobacterium
GRCFPSYALRRGAKALGA

SEQ ID NO: 1299509 - protein, 27 aa, Mycobacterium
GRCISGGLMLCWPCDLILAADDALFSD

SEQ ID NO: 1299510 - protein, 18 aa, Mycobacterium
GRCPSCQAGLRNLCDLGA

SEQ ID NO: 1299511 - protein, 18 aa, Mycobacterium
GRDAGRRRPPILSEAEFL

SEQ ID NO: 1299512 - protein, 28 aa, Mycobacterium
GRDGAQVFFDYPPHPRTIAHTVRGFDEV

SEQ ID NO: 1299513 - protein, 39 aa, Mycobacterium
GRDNPHILTLSPPIRLEPQWLTPTAYMMAKFGMTLCALG

SEQ ID NO: 1299514 - protein, 25 aa, Mycobacterium
GRDNTGVIVLLTFGTGIGSAVIHNG

SEQ ID NO: 1299515 - protein, 23 aa, Mycobacterium
GRDPYAVKIFNLSTVITADTDDE

SEQ ID NO: 1299516 - protein, 25 aa, Mycobacterium
GRDTPLRLLYAIEPADHDVAAAARE

SEQ ID NO: 1299517 - protein, 23 aa, Mycobacterium
GRGGWARVLVESLGPRHIGLENL

SEQ ID NO: 1299518 - protein, 20 aa, Mycobacterium
GRGIVLYMRGHEGRGIGLMH

SEQ ID NO: 1299519 - protein, 21 aa, Mycobacterium
GRGPARLQIHLSWAASDDEAM

SEQ ID NO: 1299520 - protein, 18 aa, Mycobacterium
GRGPGFEFGFDPRGGFGF

SEQ ID NO: 1299521 - protein, 24 aa, Mycobacterium
GRGPVATVLIQRGTLRVGDSIVAG

SEQ ID NO: 1299522 - protein, 23 aa, Mycobacterium
GRHERLWEVLGAHPRTFETPDGV

SEQ ID NO: 1299523 - protein, 34 aa, Mycobacterium
GRHLLEVNPTFDRLARDRGFYRDELITEIAERGG

SEQ ID NO: 1299524 - protein, 24 aa, Mycobacterium
GRIDRRGRMLWSLPKGHIEMGETA

SEQ ID NO: 1299525 - protein, 20 aa, Mycobacterium
GRINHAYLFSGPRGCGKTSS

SEQ ID NO: 1299526 - protein, 24 aa, Mycobacterium
GRITGTARQVPWPRDATIVAAVRT

SEQ ID NO: 1299527 - protein, 20 aa, Mycobacterium
GRIVSIPRRVSGELYGSFLP

SEQ ID NO: 1299528 - protein, 19 aa, Mycobacterium
GRKIGDLVKEPLWAVVQQQ

SEQ ID NO: 1299529 - protein, 28 aa, Mycobacterium
GRKPARVPVWFMRQAGRSLPEYRALRAR

SEQ ID NO: 1299530 - protein, 39 aa, Mycobacterium
GRKVGRLLPIPPIALQLRTGIAILSYADKLFFGIISDYD

SEQ ID NO: 1299531 - protein, 25 aa, Mycobacterium
GRLAAPLLPLVTEVIWRGVTGGRSV

SEQ ID NO: 1299532 - protein, 17 aa, Mycobacterium
GRLALDILGAIPVAPVL

SEQ ID NO: 1299533 - protein, 20 aa, Mycobacterium
GRLCVYLSTRDCYATNAIFH

SEQ ID NO: 1299534 - protein, 17 aa, Mycobacterium
GRLILLTRNAQPVTEGD

SEQ ID NO: 1299535 - protein, 17 aa, Mycobacterium
GRLKAERALLATALEDV

SEQ ID NO: 1299536 - protein, 23 aa, Mycobacterium
GRLQPGKMLLIDTAAGRIVSDDE

SEQ ID NO: 1299537 - protein, 24 aa, Mycobacterium
GRLWATIIQHRFGGSGALAGHPIG

SEQ ID NO: 1299538 - protein, 17 aa, Mycobacterium
GRMQFERLVGRAAGYLR

SEQ ID NO: 1299539 - protein, 18 aa, Mycobacterium
GRPIGSFQAVKHACADML

SEQ ID NO: 1299540 - protein, 25 aa, Mycobacterium
GRPRGFVMFRCERDVWLVAAGTLGP

SEQ ID NO: 1299541 - protein, 19 aa, Mycobacterium
GRPYREHRHPLRTVGALLD

SEQ ID NO: 1299542 - protein, 17 aa, Mycobacterium
GRRLYVATTGLAGSALL

SEQ ID NO: 1299543 - protein, 25 aa, Mycobacterium
GRRNEYVVGWIKRGPSGVIGSNKKD

SEQ ID NO: 1299544 - protein, 25 aa, Mycobacterium
GRRRAVPGLRWPWHARLGTAAVCWR

SEQ ID NO: 1299545 - protein, 24 aa, Mycobacterium
GRSQMALGFFTHLAGDAAVAWSGG

SEQ ID NO: 1299546 - protein, 18 aa, Mycobacterium
GRSQWAPIVFGCQAPDTG

SEQ ID NO: 1299547 - protein, 27 aa, Mycobacterium
GRSRERGYAYFLYPPEQPLTETAYDRL

SEQ ID NO: 1299548 - protein, 24 aa, Mycobacterium
GRTDLIAPLALALRDGLAHLGAWG

SEQ ID NO: 1299549 - protein, 19 aa, Mycobacterium
GRTKVPWREGMRRMVAARH

SEQ ID NO: 1299550 - protein, 25 aa, Mycobacterium
GRTKYEELFVVWGEVARLLRDRGYE

SEQ ID NO: 1299551 - protein, 23 aa, Mycobacterium
GRTLIARALIGEPHLLILDEPAT

SEQ ID NO: 1299552 - protein, 33 aa, Mycobacterium
GRTLREVPVGFKWFVDGLIGGTIGFGGEESAGA

SEQ ID NO: 1299553 - protein, 21 aa, Mycobacterium
GRTQDALQWFLNAAAADVEGV

SEQ ID NO: 1299554 - protein, 28 aa, Mycobacterium
GRTRHDVWNLILAASRLPANLGLDLKAM

SEQ ID NO: 1299555 - protein, 19 aa, Mycobacterium
GRTTAPHRILDPAAGPLIG

SEQ ID NO: 1299556 - protein, 28 aa, Mycobacterium
GRTVGVLANNPLRLGGCLNSESAEKAAR

SEQ ID NO: 1299557 - protein, 26 aa, Mycobacterium
GRVDPDGTVWLITGSGERVIGSWQAG

SEQ ID NO: 1299558 - protein, 24 aa, Mycobacterium
GRVELGLGAGWFEAEHKAYAIPFP

SEQ ID NO: 1299559 - protein, 25 aa, Mycobacterium
GRVKQMLLKIGWPAEDLAGYVDGER

SEQ ID NO: 1299560 - protein, 27 aa, Mycobacterium
GRVKRPQMGIAAWLIPSIVAFGTDEQK

SEQ ID NO: 1299561 - protein, 22 aa, Mycobacterium
GRVLATARTPWPAAPGRVYRAP

SEQ ID NO: 1299562 - protein, 17 aa, Mycobacterium
GRVLLAERLGRNIELTV

SEQ ID NO: 1299563 - protein, 18 aa, Mycobacterium
GRVRLAVGTGWLAEEINA

SEQ ID NO: 1299564 - protein, 24 aa, Mycobacterium
GRVWTNCYHMYPAHAAFGGYKQSG

SEQ ID NO: 1299565 - protein, 31 aa, Mycobacterium
GRWNAPRVRQLLLRPRYAGLRVYRGKVVGKG

SEQ ID NO: 1299566 - protein, 23 aa, Mycobacterium
GRYGGTFLAEELPRHTRAERGLT

SEQ ID NO: 1299567 - protein, 20 aa, Mycobacterium
GRYRPAAGLALLGSSFDNNV

SEQ ID NO: 1299568 - protein, 32 aa, Mycobacterium
GSAGPVRILCAMPFFWIGGLLAATGALHEPVT

SEQ ID NO: 1299569 - protein, 26 aa, Mycobacterium
GSALALALRLLRPQGTVIDLAFYQDG

SEQ ID NO: 1299570 - protein, 20 aa, Mycobacterium
GSAMLLLFGAANRDPRRYPD

SEQ ID NO: 1299571 - protein, 24 aa, Mycobacterium
GSAPPPLPITPPRTQAAPAPPPRH

SEQ ID NO: 1299572 - protein, 42 aa, Mycobacterium
GSCSPPPYLPPVFTGLARAWTAVIRKLLAQYGEFDRSTAAAV

SEQ ID NO: 1299573 - protein, 22 aa, Mycobacterium
GSDPLYMLTGVIPATEKVLAKA

SEQ ID NO: 1299574 - protein, 33 aa, Mycobacterium
GSEELRLPVLRAQLRWMEAVLAVWRGDFAEAER

SEQ ID NO: 1299575 - protein, 29 aa, Mycobacterium
GSELLGTRYLPPFPYFTDKPEAQNAWQVL

SEQ ID NO: 1299576 - protein, 17 aa, Mycobacterium
GSFITTFRFNEVIHYWA

SEQ ID NO: 1299577 - protein, 17 aa, Mycobacterium
GSFRRSFRLPQHVTGDA

SEQ ID NO: 1299578 - protein, 28 aa, Mycobacterium
GSGKSTLLGLLAGVLRPAGGVVATGTAD

SEQ ID NO: 1299579 - protein, 22 aa, Mycobacterium
GSHAQFVRVPFGDTNCFPIPGD

SEQ ID NO: 1299580 - protein, 17 aa, Mycobacterium
GSIAELVKVRPGHEVAV

SEQ ID NO: 1299581 - protein, 24 aa, Mycobacterium
GSLMRQYWQTLRTIHRLALPDGDD

SEQ ID NO: 1299582 - protein, 28 aa, Mycobacterium
GSLRDMVLFIGHPIRWADWGNLEHSVRT

SEQ ID NO: 1299583 - protein, 29 aa, Mycobacterium
GSMEKLRRVPGWIHLYRAAEALGAAGPKR

SEQ ID NO: 1299584 - protein, 32 aa, Mycobacterium
GSMTIALPSTPANYFHLLRRHSLDGIQRPLIV

SEQ ID NO: 1299585 - protein, 24 aa, Mycobacterium
GSNAALLIRVSHTTPILATDGRYR

SEQ ID NO: 1299586 - protein, 24 aa, Mycobacterium
GSNAELRPFPGRRGAPRKPGRAVA

SEQ ID NO: 1299587 - protein, 22 aa, Mycobacterium
GSPARLLHFVAGGIGITPILPM

SEQ ID NO: 1299588 - protein, 30 aa, Mycobacterium; identical to SEQ ID NO: 783196

SEQ ID NO: 1299589 - protein, 21 aa, Mycobacterium
GSQVLVFKDLGLVSQVFDEPT

SEQ ID NO: 1299590 - protein, 18 aa, Mycobacterium
GSRFLLDQPTTSAGRHPD

SEQ ID NO: 1299591 - protein, 34 aa, Mycobacterium
GSRGFHIYARIEPRWPFKFVRLAAQTIAREVERR

SEQ ID NO: 1299592 - protein, 24 aa, Mycobacterium
GSRIDPVLARSWLLVNGAHGDRFE

SEQ ID NO: 1299593 - protein, 23 aa, Mycobacterium
GSRLTDFDLGALRFALNGGEPVD

SEQ ID NO: 1299594 - protein, 20 aa, Mycobacterium
GSRQVILDRDLQLVVNSLWV

SEQ ID NO: 1299595 - protein, 21 aa, Mycobacterium
GSRRRTLLFLRADSLAHFIAA

SEQ ID NO: 1299596 - protein, 26 aa, Mycobacterium
GSRRTAWPPYPNMDPLANVAGMMRAV

SEQ ID NO: 1299597 - protein, 26 aa, Mycobacterium
GSRSFFPPITGLWADDKTLADGVFGF

SEQ ID NO: 1299598 - protein, 27 aa, Mycobacterium
GSTDVPTLFNLLPGYLAMPHAGQETLA

SEQ ID NO: 1299599 - protein, 25 aa, Mycobacterium
GSTQTIFPGMRLMESCVLNIKNKSH

SEQ ID NO: 1299600 - protein, 29 aa, Mycobacterium
GSTSLVKFHWKPRLGVHSLVWEEAQIAAG

SEQ ID NO: 1299601 - protein, 21 aa, Mycobacterium
GSVEEAAGAVYLLCAPESSYI

SEQ ID NO: 1299602 - protein, 46 aa, Mycobacterium
GTAAYGIALLSRFPAETWQVVRLPRIPVPFPMYLPGPNRVQIVNEE

SEQ ID NO: 1299603 - protein, 23 aa, Mycobacterium
GTAFAYDALVLATGSYAFVPPVP

SEQ ID NO: 1299604 - protein, 32 aa, Mycobacterium
GTALLCPFDPLIFFRPRVERLFGFHYRIEIYV

SEQ ID NO: 1299605 - protein, 22 aa, Mycobacterium
GTALRLLERKIAQTPPKKHGNI

SEQ ID NO: 1299606 - protein, 25 aa, Mycobacterium
GTCHGFDSLLPDWEISRQLFDLQGT

SEQ ID NO: 1299607 - protein, 24 aa, Mycobacterium
GTDRCRLLIRSRLGLRHPGEVMLA

SEQ ID NO: 1299608 - protein, 26 aa, Mycobacterium
GTDRGRLMFADLPPDFGIRFADLVSA

SEQ ID NO: 1299609 - protein, 23 aa, Mycobacterium
GTDRVQLFKLAFDASISGFSSRQ

SEQ ID NO: 1299610 - protein, 25 aa, Mycobacterium
GTEAPAEMHFYFPRYRALCMAENAT

SEQ ID NO: 1299611 - protein, 27 aa, Mycobacterium
GTEIVPAAVLLNTFLAAAGTDLADVRL

SEQ ID NO: 1299612 - protein, 19 aa, Mycobacterium
GTGAALFGFSKLYGEVAGG

SEQ ID NO: 1299613 - protein, 24 aa, Mycobacterium
GTGKTAAFAIPILSKIDPNSRATQ

SEQ ID NO: 1299614 - protein, 26 aa, Mycobacterium
GTGMGIDRLLMALTGLSIRETILFPI

SEQ ID NO: 1299615 - protein, 28 aa, Mycobacterium
GTIAHGLLTLSLLPHFSHQLYTVGNIAM

SEQ ID NO: 1299616 - protein, 23 aa, Mycobacterium
GTIRNWPRRRYALSKTANTYARV

SEQ ID NO: 1299617 - protein, 26 aa, Mycobacterium
GTIVLLMAVERIELFTKVLIEGGRPA

SEQ ID NO: 1299618 - protein, 23 aa, Mycobacterium
GTKATVADLQWLRTAGLAEPIAA

SEQ ID NO: 1299619 - protein, 24 aa, Mycobacterium
GTKGISLFVVPKYLVAEDGSVGER

SEQ ID NO: 1299620 - protein, 25 aa, Mycobacterium
GTKGLSLFFVPKFLVDFETGELGER

SEQ ID NO: 1299621 - protein, 19 aa, Mycobacterium
GTLPTLWGDDDRYIASYLR

SEQ ID NO: 1299622 - protein, 24 aa, Mycobacterium
GTNIEFIVAQLLRLGRLGSFDFNS

SEQ ID NO: 1299623 - protein, 26 aa, Mycobacterium
GTPAQTRIWWGAYLGTADELLVSGTV

SEQ ID NO: 1299624 - protein, 18 aa, Mycobacterium
GTPAVYLPAMDALHGGMG

SEQ ID NO: 1299625 - protein, 19 aa, Mycobacterium
GTPFFVWMNMTHMHFRTHT

SEQ ID NO: 1299626 - protein, 34 aa, Mycobacterium
GTRFHNHLYEVLGLDFLYKAFTTTDIGAAIGGVR

SEQ ID NO: 1299627 - protein, 21 aa, Mycobacterium
GTRPFTIARLRVFAGPGLTGV

SEQ ID NO: 1299628 - protein, 21 aa, Mycobacterium
GTRVVAIRRAAFGPLRGTLSV

SEQ ID NO: 1299629 - protein, 19 aa, Mycobacterium
GTSDGRILRVRGRGVPKRG

SEQ ID NO: 1299630 - protein, 23 aa, Mycobacterium
GTTLDIIAGVRLGPGKISVHPTK

SEQ ID NO: 1299631 - protein, 24 aa, Mycobacterium
GTTLDYDYLIYAVGSTGAALTVPG

SEQ ID NO: 1299632 - protein, 17 aa, Mycobacterium
GTVAATHRLLTSGGATV

SEQ ID NO: 1299633 - protein, 23 aa, Mycobacterium
GTVARAFLRQALGVEVVSHVISI

SEQ ID NO: 1299634 - protein, 19 aa, Mycobacterium
GTVEYLDAWELQRGLVDAR

SEQ ID NO: 1299635 - protein, 21 aa, Mycobacterium
GTVFRFPAWSVERVLQPWIVR

SEQ ID NO: 1299636 - protein, 18 aa, Mycobacterium
GTVMRRGYKVGDQVVRHA

SEQ ID NO: 1299637 - protein, 20 aa, Mycobacterium
GTVPGFPNLFITSAPNYSPG

SEQ ID NO: 1299638 - protein, 27 aa, Mycobacterium
GTVRRDPMAMLPFLGYNVGDYFQHWID

SEQ ID NO: 1299639 - protein, 40 aa, Mycobacterium
GTYGDTAYYLIPTYPLPLLMPLTWIPVIGPIAVDMLDPVL

SEQ ID NO: 1299640 - protein, 19 aa, Mycobacterium
GVADLTGGYLPLVSTLNAA

SEQ ID NO: 1299641 - protein, 23 aa, Mycobacterium
GVARDRWVFPWSAATCNDVYFPV

SEQ ID NO: 1299642 - protein, 21 aa, Mycobacterium
GVARISFGPFLQAALATRANE

SEQ ID NO: 1299643 - protein, 23 aa, Mycobacterium
GVCAALRAGAVETLIIGDIGDAT

SEQ ID NO: 1299644 - protein, 20 aa, Mycobacterium
GVCAAVCPSVFVITDGGYAE

SEQ ID NO: 1299645 - protein, 34 aa, Mycobacterium
GVCFPDLLLLRGEYQLKLEPPFIPGMEVAGTVRS

SEQ ID NO: 1299646 - protein, 23 aa, Mycobacterium
GVCSLILDHLLGATAHRPDRPAF

SEQ ID NO: 1299647 - protein, 23 aa, Mycobacterium
GVCSPREAALSRWPMTKPRVVTV

SEQ ID NO: 1299648 - protein, 32 aa, Mycobacterium
GVDALRVGVLPTPAVAYLTSAYDADFGVMISA

SEQ ID NO: 1299649 - protein, 27 aa, Mycobacterium
GVDGSLERFIRIPYTLPPEQMTEAVTL

SEQ ID NO: 1299650 - protein, 19 aa, Mycobacterium
GVDKLVRRFLREPVTHSVD

SEQ ID NO: 1299651 - protein, 23 aa, Mycobacterium
GVEIRYYSVIYQAIDEIESALKG

SEQ ID NO: 1299652 - protein, 25 aa, Mycobacterium
GVERRWVYLHYFKDGQPSINWLDPS

SEQ ID NO: 1299653 - protein, 19 aa, Mycobacterium
GVFARDLRLRLMREHLDRA

SEQ ID NO: 1299654 - protein, 26 aa, Mycobacterium
GVFAVTLPFTGLIDYRLEVGYDHGGD

SEQ ID NO: 1299655 - protein, 17 aa, Mycobacterium
GVFDAVALDLDGDGRVD

SEQ ID NO: 1299656 - protein, 18 aa, Mycobacterium
GVFGFRTLDDCLGMIHEA

SEQ ID NO: 1299657 - protein, 18 aa, Mycobacterium
GVFITPFHPVGQSPTVAL

SEQ ID NO: 1299658 - protein, 19 aa, Mycobacterium
GVFVAIQCAVPHLGDGGRI

SEQ ID NO: 1299659 - protein, 23 aa, Mycobacterium
GVGEPNVGAMRKSLAAQRAVGVQ

SEQ ID NO: 1299660 - protein, 23 aa, Mycobacterium
GVGHEFRWLTVDLPPIVELRTKL

SEQ ID NO: 1299661 - protein, 27 aa, Mycobacterium
GVGLTEMGLLKYLIGQLLLSEADRVET

SEQ ID NO: 1299662 - protein, 26 aa, Mycobacterium
GVGPDASMLLMFNRILPAAGMHHMSR

SEQ ID NO: 1299663 - protein, 24 aa, Mycobacterium
GVGTLRIEERPVPSPGPHEVLVEV

SEQ ID NO: 1299664 - protein, 25 aa, Mycobacterium
GVHNYPSYFRFLQSKLRNGGLLLNH

SEQ ID NO: 1299665 - protein, 20 aa, Mycobacterium
GVHTLPLLYVGGTSVIMPSF

SEQ ID NO: 1299666 - protein, 24 aa, Mycobacterium
GVIDPYHRVYNYPTLYVTDGAAIS

SEQ ID NO: 1299667 - protein, 17 aa, Mycobacterium
GVIYRAMGFPTRMFTVL

SEQ ID NO: 1299668 - protein, 25 aa, Mycobacterium
GVKGRVLPMCPIALQIEADVAGLES

SEQ ID NO: 1299669 - protein, 26 aa, Mycobacterium
GVKQALVYYYFPTMDDLYVEVLRAGA

SEQ ID NO: 1299670 - protein, 18 aa, Mycobacterium
GVLATIVQIGRIPSGAAA

SEQ ID NO: 1299671 - protein, 23 aa, Mycobacterium
GVLAVPIHYRGLHLHLRVSGKGV

SEQ ID NO: 1299672 - protein, 17 aa, Mycobacterium
GVLTVTIPMAERAKPRK

SEQ ID NO: 1299673 - protein, 28 aa, Mycobacterium
GVNPELLFSAGYAACFLGALRLQAKNND

SEQ ID NO: 1299674 - protein, 21 aa, Mycobacterium
GVNQLLDVLAQLAPPPRGQLD

SEQ ID NO: 1299675 - protein, 22 aa, Mycobacterium
GVPDYLGWDWKSKAGIPIVCVP

SEQ ID NO: 1299676 - protein, 21 aa, Mycobacterium
GVPISAILFGGRRKTTVPLIT

SEQ ID NO: 1299677 - protein, 17 aa, Mycobacterium
GVPKIFIAAVGEAMTRM

SEQ ID NO: 1299678 - protein, 17 aa, Mycobacterium
GVPLTDRRAERRALLID

SEQ ID NO: 1299679 - protein, 18 aa, Mycobacterium
GVPMRCVFALTAMGFLPQ

SEQ ID NO: 1299680 - protein, 23 aa, Mycobacterium
GVPPGLRVLPAENISAALRVLDR

SEQ ID NO: 1299681 - protein, 19 aa, Mycobacterium
GVPVPLARLDGMDSLLSIV

SEQ ID NO: 1299682 - protein, 26 aa, Mycobacterium
GVPYDKPTLMRHIRELRLHSVSSVFA

SEQ ID NO: 1299683 - protein, 18 aa, Mycobacterium
GVPYVINPRMVRGLDYYT

SEQ ID NO: 1299684 - protein, 17 aa, Mycobacterium
GVQGITDLITTPGLINV

SEQ ID NO: 1299685 - protein, 26 aa, Mycobacterium
GVQLGDLHWFYVYSAVIWACVFMRTS

SEQ ID NO: 1299686 - protein, 21 aa, Mycobacterium
GVRAAPGYAAYAAAKAGVVNY

SEQ ID NO: 1299687 - protein, 24 aa, Mycobacterium
GVRQLLAYQWAHPGKQLLFQGQEF

SEQ ID NO: 1299688 - protein, 21 aa, Mycobacterium
GVRRIILLTLGWEELPKSVSV

SEQ ID NO: 1299689 - protein, 24 aa, Mycobacterium
GVRVPHGFAITAAAYRHMLDEADA

SEQ ID NO: 1299690 - protein, 25 aa, Mycobacterium
GVRVSLPRNLMRENYILKATPAATT

SEQ ID NO: 1299691 - protein, 23 aa, Mycobacterium
GVSAGLDFALWLSAQLAGEAQAK

SEQ ID NO: 1299692 - protein, 25 aa, Mycobacterium
GVSDMLHVILYGMAFYSGFTNGPAE

SEQ ID NO: 1299693 - protein, 26 aa, Mycobacterium
GVSLHDSAIALLRRFAKNDYLRTICE

SEQ ID NO: 1299694 - protein, 26 aa, Mycobacterium
GVSRGWLYRHFPDKVSLLGAAIVRLN

SEQ ID NO: 1299695 - protein, 25 aa, Mycobacterium
GVSYTLPRIIGAGHAFDLILTARQV

SEQ ID NO: 1299696 - protein, 20 aa, Mycobacterium
GVTEKWDLYVRKFELATGYS

SEQ ID NO: 1299697 - protein, 20 aa, Mycobacterium
GVTIYYTAPTLVRTFMKLGR

SEQ ID NO: 1299698 - protein, 20 aa, Mycobacterium
GVTNGFWRRPGYRSSDEVAA

SEQ ID NO: 1299699 - protein, 23 aa, Mycobacterium
GVTRELVWPSMRISHCRPPGADR

SEQ ID NO: 1299700 - protein, 25 aa, Mycobacterium
GVTRQTVYRYFPSTEALLVEAAVHA

SEQ ID NO: 1299701 - protein, 25 aa, Mycobacterium
GVTSDRLYPLRLQQELAELLPGCTG

SEQ ID NO: 1299702 - protein, 18 aa, Mycobacterium
GVTYWPLTRQGSPSGLHA

SEQ ID NO: 1299703 - protein, 27 aa, Mycobacterium
GVVFQQPRLFPWRTVGGNVDLALKYAR

SEQ ID NO: 1299704 - protein, 29 aa, Mycobacterium
GVVGEEVAPWLDLVRKLGLLAGTLATEPT

SEQ ID NO: 1299705 - protein, 21 aa, Mycobacterium
GVVPDALTVLVRLLASLHDDD

SEQ ID NO: 1299706 - protein, 18 aa, Mycobacterium
GVVPIYVRTPSLLAMTAA

SEQ ID NO: 1299707 - protein, 19 aa, Mycobacterium
GVWHSYADHRMAMAGAIVG

SEQ ID NO: 1299708 - protein, 20 aa, Mycobacterium
GWAPIVRFGVAPRLRGGMQM

SEQ ID NO: 1299709 - protein, 20 aa, Mycobacterium
GWEARLRPLGIPAAAVRGLP

SEQ ID NO: 1299710 - protein, 32 aa, Mycobacterium
GWEPVDLGPWLRGEIELPTPSLGIARSDGLRL

SEQ ID NO: 1299711 - protein, 31 aa, Mycobacterium
GWGAKRALPHFDDLLFLGASMSRYPLEGYRE

SEQ ID NO: 1299712 - protein, 31 aa, Mycobacterium
GWHDLADWPPPMPEYVLFLRTTGQLSAAPPD

SEQ ID NO: 1299713 - protein, 18 aa, Mycobacterium
GWIQPRLSPVARAALPPH

SEQ ID NO: 1299714 - protein, 20 aa, Mycobacterium
GWLEGYLLTGRHGLFNCYEA

SEQ ID NO: 1299715 - protein, 19 aa, Mycobacterium
GWMFDRALAGWRVNAWLLD

SEQ ID NO: 1299716 - protein, 19 aa, Mycobacterium
GWPSRLRPGALEGATVLVA

SEQ ID NO: 1299717 - protein, 30 aa, Mycobacterium
GWRANPEKVWAWYLWRHYMMDAVQPNNGHH

SEQ ID NO: 1299718 - protein, 18 aa, Mycobacterium
GWSAGRIINIDIGGGSLE

SEQ ID NO: 1299719 - protein, 22 aa, Mycobacterium
GWSVGAVALVAGWAARTLPDSS

SEQ ID NO: 1299720 - protein, 24 aa, Mycobacterium
GWTVSRPRWTLRDDWLGAGDDARA

SEQ ID NO: 1299721 - protein, 24 aa, Mycobacterium
GYAEDILELLRELDLRDVVFVGHS

SEQ ID NO: 1299722 - protein, 17 aa, Mycobacterium
GYALGWQGRGREADEVL

SEQ ID NO: 1299723 - protein, 20 aa, Mycobacterium
GYERLDALLPSLHSSRSPNS

SEQ ID NO: 1299724 - protein, 17 aa, Mycobacterium
GYGAVWVGGSPPAELDW

SEQ ID NO: 1299725 - protein, 24 aa, Mycobacterium
GYGRLIRSVALPGGSPRPYGGHFD

SEQ ID NO: 1299726 - protein, 20 aa, Mycobacterium
GYIRICLLAKRQWHGMFEWM

SEQ ID NO: 1299727 - protein, 35 aa, Mycobacterium
GYKYGLPMDADIVMDVRFLPNPHWVDALRPHTGQH

SEQ ID NO: 1299728 - protein, 37 aa, Mycobacterium
GYLLSQPGLRKLLPQEWVRFGWYFLVSRRDPAGLREW

SEQ ID NO: 1299729 - protein, 19 aa, Mycobacterium
GYNEYYPALLAAGITVFTP

SEQ ID NO: 1299730 - protein, 22 aa, Mycobacterium
GYPEAVLARELEMCYAAIALVT

SEQ ID NO: 1299731 - protein, 24 aa, Mycobacterium
GYPEGELFFPGSPVLSVHGTFAEC

SEQ ID NO: 1299732 - protein, 27 aa, Mycobacterium
GYRLAKEALILYTMRSAGPLGARGIRI

SEQ ID NO: 1299733 - protein, 32 aa, Mycobacterium
GYSEYHRDGLSDRLPRMLGTQAAGAAPLVTGE

SEQ ID NO: 1299734 - protein, 22 aa, Mycobacterium
GYSGVVPQFTLPGGAVLVGEGV

SEQ ID NO: 1299735 - protein, 23 aa, Mycobacterium
GYTSLTPFLVIDGAAAAIDFYTS

SEQ ID NO: 1299736 - protein, 23 aa, Mycobacterium
GYTVYVPHYLSQTAYPPAAESLL

SEQ ID NO: 1299737 - protein, 35 aa, Mycobacterium
GYVDFPSIGALPYLLTLPGHGFYWFQLRAPDPEPE

SEQ ID NO: 1299738 - protein, 23 aa, Mycobacterium
GYVGEIWLHGENLGRGYWGRPDE

SEQ ID NO: 1299739 - protein, 24 aa, Mycobacterium
GYWSHLPGQPIPRRYGRWPKRDDM

SEQ ID NO: 1299740 - protein, 23 aa, Mycobacterium
GYWSYPNGHLCLWTWAANPEDRP

SEQ ID NO: 1299741 - protein, 33 aa, Mycobacterium
GYYDIVHSHYWLSGQVGWLARDRWAVPLVHTAH

SEQ ID NO: 1299742 - protein, 25 aa, Mycobacterium
HAAAAPLIGTVLPPAADAVSLQTAA

SEQ ID NO: 1299743 - protein, 26 aa, Mycobacterium
HAAALAWPGLHREWVDGWLLRASDGY

SEQ ID NO: 1299744 - protein, 28 aa, Mycobacterium
HAACGRHPFIDLPYRPGHEAVGVVDAVG

SEQ ID NO: 1299745 - protein, 24 aa, Mycobacterium
HAAEANWMFALVRTTRAPKKQQGI

SEQ ID NO: 1299746 - protein, 17 aa, Mycobacterium
HAALPPMLDAHAGTVIN

SEQ ID NO: 1299747 - protein, 30 aa, Mycobacterium
HAALQMVRRHRLMETFLVNELGYSWDEVHD

SEQ ID NO: 1299748 - protein, 20 aa, Mycobacterium
HAALVRRVLFDGMPTARRKA

SEQ ID NO: 1299749 - protein, 23 aa, Mycobacterium
HADHPAHLLSGGQKQLLALAAVL

SEQ ID NO: 1299750 - protein, 27 aa, Mycobacterium
HAEAAQRTWFRLSALAERVNATVRIAD

SEQ ID NO: 1299751 - protein, 38 aa, Mycobacterium
HAEAYRAISLLLRRPPGREAFPGDVFYLHSRLLERCAK

SEQ ID NO: 1299752 - protein, 19 aa, Mycobacterium
HAFEVKWLCAGVEVARSSF

SEQ ID NO: 1299753 - protein, 18 aa, Mycobacterium
HAGALWPLAAMAARQGVD

SEQ ID NO: 1299754 - protein, 30 aa, Mycobacterium
HAHEDHIGAVPFLLKLRPDIPVVGSRFTLA

SEQ ID NO: 1299755 - protein, 20 aa, Mycobacterium
HAHFWMSGIATQLAARHLDL

SEQ ID NO: 1299756 - protein, 23 aa, Mycobacterium
HAHLRHLNPFPANLGDVLARYPK

SEQ ID NO: 1299757 - protein, 23 aa, Mycobacterium
HAHRFLSDLPGLHLIGLDRDPQA

SEQ ID NO: 1299758 - protein, 22 aa, Mycobacterium
HALRRNINITILLFNNRIYGLT

SEQ ID NO: 1299759 - protein, 34 aa, Mycobacterium
HAPEPHPLLPATPWHHAHHWIKVDPTAGIDRTPA

SEQ ID NO: 1299760 - protein, 19 aa, Mycobacterium
HARAILGLAVDTIMISPGA

SEQ ID NO: 1299761 - protein, 18 aa, Mycobacterium
HARLGTAAVCWRLRRRHG

SEQ ID NO: 1299762 - protein, 22 aa, Mycobacterium
HARRYDHVAQRFGEAGLIVYAL

SEQ ID NO: 1299763 - protein, 18 aa, Mycobacterium
HARSWHRYAEPHPDSAAL

SEQ ID NO: 1299764 - protein, 18 aa, Mycobacterium
HARVLFSAGLLTEDQRDG

SEQ ID NO: 1299765 - protein, 17 aa, Mycobacterium
HATFDALLHNFYGPTET

SEQ ID NO: 1299766 - protein, 18 aa, Mycobacterium
HATLVDHLIPPMARAETY

SEQ ID NO: 1299767 - protein, 18 aa, Mycobacterium
HAVALQIAALKAKYLTRE

SEQ ID NO: 1299768 - protein, 19 aa, Mycobacterium
HAVQDLSFQIRRGNTLGLV

SEQ ID NO: 1299769 - protein, 25 aa, Mycobacterium
HAVWALMDYGFRVVISSRFADIFRG

SEQ ID NO: 1299770 - protein, 24 aa, Mycobacterium
HAWVQAWTGGWWHYDPTNDSDINE

SEQ ID NO: 1299771 - protein, 25 aa, Mycobacterium
HAYAGELLFLYNGVKPRNVMPVHGT

SEQ ID NO: 1299772 - protein, 22 aa, Mycobacterium
HCGWPSFFDPADSDAVILRPDD

SEQ ID NO: 1299773 - protein, 27 aa, Mycobacterium
HCIPCDPHYLLWQLKATRLPSPVTEAA

SEQ ID NO: 1299774 - protein, 17 aa, Mycobacterium
HCRRARLMAYRVVSLQS

SEQ ID NO: 1299775 - protein, 22 aa, Mycobacterium
HDAGARWILDLGPGDILTRLTA

SEQ ID NO: 1299776 - protein, 24 aa, Mycobacterium
HDEELDGPLPRRARTFVLTTEAER

SEQ ID NO: 1299777 - protein, 23 aa, Mycobacterium
HDFEPLYIISPDKKSTVADLKDK

SEQ ID NO: 1299778 - protein, 19 aa, Mycobacterium
HDFRDVDIAAVSIWMGSLL

SEQ ID NO: 1299779 - protein, 22 aa, Mycobacterium
HDGDLYITGRVKDLVIIDGRNH

SEQ ID NO: 1299780 - protein, 21 aa, Mycobacterium
HDGHRHLFRLAGLAPRLDVAK

SEQ ID NO: 1299781 - protein, 24 aa, Mycobacterium
HDGLGWLAQRGYVPLGYKGDAAKT

SEQ ID NO: 1299782 - protein, 17 aa, Mycobacterium
HDHLVDVLLDAAAMGRV

SEQ ID NO: 1299783 - protein, 23 aa, Mycobacterium
HDHTGDLFATHGLPWCDGARELL

SEQ ID NO: 1299784 - protein, 25 aa, Mycobacterium
HDHVIQRLFAVGLSLQGTLARVRDA

SEQ ID NO: 1299785 - protein, 18 aa, Mycobacterium
HDILTVLLTELSSIWLSG

SEQ ID NO: 1299786 - protein, 31 aa, Mycobacterium
HDIYYHDELRWWTEPSRPYRGVPPSALVSEE

SEQ ID NO: 1299787 - protein, 21 aa, Mycobacterium
HDLKDWFTFLAGRGPDWTAVQ

SEQ ID NO: 1299788 - protein, 23 aa, Mycobacterium
HDNFLYDMFLHTRGLAEKDLGLA

SEQ ID NO: 1299789 - protein, 30 aa, Mycobacterium
HDPDLPPSHHYLAAYRWIDSGYPTGFGAHA

SEQ ID NO: 1299790 - protein, 25 aa, Mycobacterium
HDVHRKLLARMFTPRKINALEPKIR

SEQ ID NO: 1299791 - protein, 24 aa, Mycobacterium
HDVRHRIAFLPDYDMSMARQLYYG

SEQ ID NO: 1299792 - protein, 24 aa, Mycobacterium
HDWPDADALTILRNIRSAAGTGAT

SEQ ID NO: 1299793 - protein, 38 aa, Mycobacterium; identical to SEQ ID NO: 784682

SEQ ID NO: 1299794 - protein, 18 aa, Mycobacterium
HECEAIQALPFSNTQQLV

SEQ ID NO: 1299795 - protein, 24 aa, Mycobacterium
HEFRTPLTLILGPLAEMLRTSELD

SEQ ID NO: 1299796 - protein, 26 aa, Mycobacterium
HEGKPFFGSLLEFITSGPVVAAIVEG

SEQ ID NO: 1299797 - protein, 29 aa, Mycobacterium
HEGRLKYCYNFLGIEYYYVTAEAPLSAGD

SEQ ID NO: 1299798 - protein, 20 aa, Mycobacterium
HEIYKLGVVPIPTNRDMIRQ

SEQ ID NO: 1299799 - protein, 27 aa, Mycobacterium
HELRAFTARLLGIPAQKVRVIMRDTGG

SEQ ID NO: 1299800 - protein, 24 aa, Mycobacterium
HEPLEFAMPAAEFARAWLPVINTA

SEQ ID NO: 1299801 - protein, 36 aa, Mycobacterium; identical to SEQ ID NO: 822806

SEQ ID NO: 1299802 - protein, 21 aa, Mycobacterium
HEQLRMLCVFNPPVTGQEVHD

SEQ ID NO: 1299803 - protein, 18 aa, Mycobacterium
HERFVANMLAGVGPVPAV

SEQ ID NO: 1299804 - protein, 17 aa, Mycobacterium
HERIRFIRTDMADLAGV

SEQ ID NO: 1299805 - protein, 30 aa, Mycobacterium; identical to SEQ ID NO: 822843

SEQ ID NO: 1299806 - protein, 19 aa, Mycobacterium
HEVMAGLKRRFSAVSGGVV

SEQ ID NO: 1299807 - protein, 17 aa, Mycobacterium
HEVTVYAPAWKNAADYD

SEQ ID NO: 1299808 - protein, 18 aa, Mycobacterium
HFAVVRASHNAVLTELYR

SEQ ID NO: 1299809 - protein, 21 aa, Mycobacterium
HFDSMLVKLTCRGRDFSTAVS

SEQ ID NO: 1299810 - protein, 26 aa, Mycobacterium
HFDTSWLDPFTEFRFPRIGAAVFDGV

SEQ ID NO: 1299811 - protein, 18 aa, Mycobacterium
HFMPATLLASQFETLEPL

SEQ ID NO: 1299812 - protein, 26 aa, Mycobacterium
HFSDTPDYRVSWPRHCVVGTDGAEFH

SEQ ID NO: 1299813 - protein, 18 aa, Mycobacterium
HFSLLRDGVPLFSDGSGA

SEQ ID NO: 1299814 - protein, 27 aa, Mycobacterium
HGAGGPFYRYLFTNPAVYRRAGLDPRE

SEQ ID NO: 1299815 - protein, 26 aa, Mycobacterium
HGALAERALMPVLPSVEEFPYAIRQV

SEQ ID NO: 1299816 - protein, 47 aa, Mycobacterium
HGEAYRGHIFWDELFIFPVLNLRLPMITRSLLAYRYRRLPEARHAAR

SEQ ID NO: 1299817 - protein, 24 aa, Mycobacterium
HGESVVLDGTWRDPGHRRAARDCA

SEQ ID NO: 1299818 - protein, 25 aa, Mycobacterium
HGESWSMALSLRLAAYELLRTDGSD

SEQ ID NO: 1299819 - protein, 25 aa, Mycobacterium
HGFRLTEFFAGYPDASLIWLHRDPV

SEQ ID NO: 1299820 - protein, 21 aa, Mycobacterium
HGGGLPYSAYPRFHTLMAEES

SEQ ID NO: 1299821 - protein, 17 aa, Mycobacterium
HGGIAFGWDRITALLAR

SEQ ID NO: 1299822 - protein, 21 aa, Mycobacterium
HGGLGWVYLAFDHNVNERPVV

SEQ ID NO: 1299823 - protein, 18 aa, Mycobacterium
HGGLQWPFAEADDPLDTA

SEQ ID NO: 1299824 - protein, 17 aa, Mycobacterium
HGGVINALLHRVLRTER

SEQ ID NO: 1299825 - protein, 25 aa, Mycobacterium
HGGVLPLMFDSMFGMVIHATGRPIS

SEQ ID NO: 1299826 - protein, 18 aa, Mycobacterium
HGIKLRYSDPMLLDDVAA

SEQ ID NO: 1299827 - protein, 25 aa, Mycobacterium
HGLDESCWPLLKHAGLRGLQTRIGL

SEQ ID NO: 1299828 - protein, 23 aa, Mycobacterium
HGLGLGFDPPVVSPALRATAEAD

SEQ ID NO: 1299829 - protein, 21 aa, Mycobacterium
HGLHVFGTLLAAAENQRVPGR

SEQ ID NO: 1299830 - protein, 19 aa, Mycobacterium
HGQIAFAVQNALTGLLGAR

SEQ ID NO: 1299831 - protein, 17 aa, Mycobacterium
HGREFIELIAVGTTYDL

SEQ ID NO: 1299832 - protein, 19 aa, Mycobacterium
HGRGGFAGMLLGSVSAAVA

SEQ ID NO: 1299833 - protein, 21 aa, Mycobacterium
HGRGGFAGMLLGSVSSAVAQA

SEQ ID NO: 1299834 - protein, 22 aa, Mycobacterium
HGRLRALYRELIALRHNEPDLA

SEQ ID NO: 1299835 - protein, 28 aa, Mycobacterium
HGRRTDTPRWRWFIARAVVGGEALYAGE

SEQ ID NO: 1299836 - protein, 18 aa, Mycobacterium
HGRRTVFLSCSELSESIV

SEQ ID NO: 1299837 - protein, 35 aa, Mycobacterium
HGSRTATIIDPFGHRWMLSGPVPLAGALIQHGDVG

SEQ ID NO: 1299838 - protein, 24 aa, Mycobacterium
HGTELPGTLSLTPALLAGIVEQYV

SEQ ID NO: 1299839 - protein, 25 aa, Mycobacterium
HGTVMLRMPLHPVAIELLREVGPMA

SEQ ID NO: 1299840 - protein, 23 aa, Mycobacterium
HGVGRLKRPWLAGQIGPEAMELN

SEQ ID NO: 1299841 - protein, 17 aa, Mycobacterium
HGVLIPQRRSASVTAVA

SEQ ID NO: 1299842 - protein, 24 aa, Mycobacterium
HHAFTHRPTYRALKSELPREELAE

SEQ ID NO: 1299843 - protein, 23 aa, Mycobacterium
HHDAEQYFVLAVPHPAGGPPHLL

SEQ ID NO: 1299844 - protein, 24 aa, Mycobacterium
HHEMTFSMLYAFSENYVLPISHDE

SEQ ID NO: 1299845 - protein, 30 aa, Mycobacterium
HHGLPHRWVEFLRRWDPMHWPHRPHHADTK

SEQ ID NO: 1299846 - protein, 25 aa, Mycobacterium
HHGSPSLAPFVFTSALGLGDLFAGD

SEQ ID NO: 1299847 - protein, 17 aa, Mycobacterium
HHIVTRAGGRLCVLVTR

SEQ ID NO: 1299848 - protein, 18 aa, Mycobacterium
HHLDAEPINALFDRWIRQ

SEQ ID NO: 1299849 - protein, 17 aa, Mycobacterium
HHPWTCAGAPIKDPRTG

SEQ ID NO: 1299850 - protein, 23 aa, Mycobacterium
HHTAAWRAARLLVLDAFTTAESA

SEQ ID NO: 1299851 - protein, 19 aa, Mycobacterium
HHTLFGGPPEGRRTWMADV

SEQ ID NO: 1299852 - protein, 19 aa, Mycobacterium
HHVQLLLNRSGLGAPEFAS

SEQ ID NO: 1299853 - protein, 17 aa, Mycobacterium
HHVVWAFGDGTLFGIHQ

SEQ ID NO: 1299854 - protein, 20 aa, Mycobacterium
HICPISMTYAVVPALRFNPD

SEQ ID NO: 1299855 - protein, 25 aa, Mycobacterium
HKANGFMERLNWFGKTFHSATDAKP

SEQ ID NO: 1299856 - protein, 21 aa, Mycobacterium
HKLGAVLDRLAAYQARSIDID

SEQ ID NO: 1299857 - protein, 24 aa, Mycobacterium
HKTVHHYLMRFLGGELSDEDVEVT

SEQ ID NO: 1299858 - protein, 18 aa, Mycobacterium
HKVPRRLLKAARLGLIDL

SEQ ID NO: 1299859 - protein, 27 aa, Mycobacterium
HLAHSDLAPPVFYLTAAPDLSGPMISD

SEQ ID NO: 1299860 - protein, 17 aa, Mycobacterium
HLASYKGAILAVTHDRY

SEQ ID NO: 1299861 - protein, 19 aa, Mycobacterium
HLAVQALRSGDCDLALTGG

SEQ ID NO: 1299862 - protein, 34 aa, Mycobacterium
HLCGPDIIVWSGIELLCLPLLALGGTGFLSATAN

SEQ ID NO: 1299863 - protein, 18 aa, Mycobacterium
HLDRLGWNTDRHVELLWS

SEQ ID NO: 1299864 - protein, 31 aa, Mycobacterium
HLFQAGGKRFRPLFTVLSARLGPEPDAWQVT

SEQ ID NO: 1299865 - protein, 40 aa, Mycobacterium
HLGGDLLAVVARLNRLATQRTRLPLPWAQARLLSTIEDQG

SEQ ID NO: 1299866 - protein, 25 aa, Mycobacterium
HLGHFALTGLLLENVLAAPNSRVVT

SEQ ID NO: 1299867 - protein, 27 aa, Mycobacterium
HLGVGVTSIYWYFRKKDDLLNAMADRA

SEQ ID NO: 1299868 - protein, 17 aa, Mycobacterium
HLGYDIESPVWRHWVRD

SEQ ID NO: 1299869 - protein, 20 aa, Mycobacterium
HLHGVDLRIPEIGPMSIGYV

SEQ ID NO: 1299870 - protein, 18 aa, Mycobacterium
HLHLAAIDFSPMSYVTDG

SEQ ID NO: 1299871 - protein, 21 aa, Mycobacterium
HLHMHVVPRWGGDANFITIIG

SEQ ID NO: 1299872 - protein, 24 aa, Mycobacterium
HLIAEVYLDLIRQVPYFTDVNDSM

SEQ ID NO: 1299873 - protein, 25 aa, Mycobacterium
HLKGTWNGLKSAAAIMRENKRGAMV

SEQ ID NO: 1299874 - protein, 23 aa, Mycobacterium
HLKRTHLELGGKAPVIVFDDADI

SEQ ID NO: 1299875 - protein, 17 aa, Mycobacterium
HLLYSMIQVSFPVECWK

SEQ ID NO: 1299876 - protein, 19 aa, Mycobacterium
HLMPVWQGQGYNSGIRDAA

SEQ ID NO: 1299877 - protein, 17 aa, Mycobacterium
HLNNAVYYALFDTAING

SEQ ID NO: 1299878 - protein, 17 aa, Mycobacterium
HLPVLEKDWSFGNPANL

SEQ ID NO: 1299879 - protein, 17 aa, Mycobacterium
HLPWLAHHGRWPVGEEW

SEQ ID NO: 1299880 - protein, 21 aa, Mycobacterium
HLTDRLPIMTAPKWVHNKIQP

SEQ ID NO: 1299881 - protein, 27 aa, Mycobacterium
HLTKSLDQLLFQFYAQNDRLRITDLHQ

SEQ ID NO: 1299882 - protein, 23 aa, Mycobacterium
HLVAEVFWRRLSAAPPAAHVSDD

SEQ ID NO: 1299883 - protein, 17 aa, Mycobacterium
HLVAGLIATGAIDIGIA

SEQ ID NO: 1299884 - protein, 21 aa, Mycobacterium
HLVVPTPRLFGIPAIADNLDV

SEQ ID NO: 1299885 - protein, 27 aa, Mycobacterium
HLYGGYNVIRAAWPHFREQSFGRVVVA

SEQ ID NO: 1299886 - protein, 17 aa, Mycobacterium
HMASLAGAWTALVGGFG

SEQ ID NO: 1299887 - protein, 26 aa, Mycobacterium
HMDGARLWNAAAALGVPFGDFTTDAG

SEQ ID NO: 1299888 - protein, 19 aa, Mycobacterium
HMLRLKAMMQPWEAAVTGA

SEQ ID NO: 1299889 - protein, 19 aa, Mycobacterium
HMNEGHAGFLGVERIRELI

SEQ ID NO: 1299890 - protein, 17 aa, Mycobacterium
HMVLCNQFRHPALLAKM

SEQ ID NO: 1299891 - protein, 18 aa, Mycobacterium
HNAILALAAVEAFFGAGA

SEQ ID NO: 1299892 - protein, 23 aa, Mycobacterium
HNGLTAAALLQRSGLRTVCLEAK

SEQ ID NO: 1299893 - protein, 25 aa, Mycobacterium
HNLRRGPDMSGMLEPLFGADGLRGV

SEQ ID NO: 1299894 - protein, 25 aa, Mycobacterium
HNMRKTFLASPILCDLVLIRGALST

SEQ ID NO: 1299895 - protein, 19 aa, Mycobacterium
HNSQPWRWIVGETVVDLFA

SEQ ID NO: 1299896 - protein, 32 aa, Mycobacterium
HNVGGLPADLKFKLVEPLRLLFKDEVRAVGRE

SEQ ID NO: 1299897 - protein, 18 aa, Mycobacterium
HNYREFMGGFTDWAQTVA

SEQ ID NO: 1299898 - protein, 22 aa, Mycobacterium
HPAARALRVDKLTLAALEATLV

SEQ ID NO: 1299899 - protein, 26 aa, Mycobacterium
HPATEEFLRFFTPAPGDGRTFADDVE

SEQ ID NO: 1299900 - protein, 21 aa, Mycobacterium
HPCTTFDKWPMIPVLDDGNRV

SEQ ID NO: 1299901 - protein, 24 aa, Mycobacterium
HPDGRSAFALWFTGGIFVDQRGER

SEQ ID NO: 1299902 - protein, 31 aa, Mycobacterium
HPDKRMVGRARTLRFVPLREDLFKARGGGYN

SEQ ID NO: 1299903 - protein, 33 aa, Mycobacterium
HPDLDRGFVLPWRKDIALFLSDLYVGGEPFEAS

SEQ ID NO: 1299904 - protein, 18 aa, Mycobacterium
HPGFIRTPMTKHFPDNML

SEQ ID NO: 1299905 - protein, 25 aa, Mycobacterium
HPHALQLIMDSLRYWVTEMHVDGFR

SEQ ID NO: 1299906 - protein, 17 aa, Mycobacterium
HPPFRWQRRYAEGFSEQ

SEQ ID NO: 1299907 - protein, 29 aa, Mycobacterium
HPPQALLNVINPALRTALRTPLGTALKQF

SEQ ID NO: 1299908 - protein, 21 aa, Mycobacterium
HPQLLQVLHINPRTARYRFFE

SEQ ID NO: 1299909 - protein, 17 aa, Mycobacterium
HPQRLHRAIDDLLDGVV

SEQ ID NO: 1299910 - protein, 18 aa, Mycobacterium
HPQYCRRLILISSGGLGP

SEQ ID NO: 1299911 - protein, 20 aa, Mycobacterium
HQALYSAGFFGTSWPREFGG

SEQ ID NO: 1299912 - protein, 24 aa, Mycobacterium
HQGLELWLAEFPQPRPPRETWSDN

SEQ ID NO: 1299913 - protein, 17 aa, Mycobacterium
HQLPSPEPLLPLTTPSD

SEQ ID NO: 1299914 - protein, 20 aa, Mycobacterium
HQRATARAAMWPHAMTTLTT

SEQ ID NO: 1299915 - protein, 19 aa, Mycobacterium
HRAAAKTIRIAWQTAVGSD

SEQ ID NO: 1299916 - protein, 23 aa, Mycobacterium
HRAGGQPLILPPSAHADTDLLLH

SEQ ID NO: 1299917 - protein, 17 aa, Mycobacterium
HRCVSVRWGLWRSDSGE

SEQ ID NO: 1299918 - protein, 18 aa, Mycobacterium
HRERALLRLLEGPRFCGH

SEQ ID NO: 1299919 - protein, 25 aa, Mycobacterium
HRFRTVTERLWPTLTAPLMTREQIR

SEQ ID NO: 1299920 - protein, 24 aa, Mycobacterium
HRGRPFFDLLARVGADAPRRVVDL

SEQ ID NO: 1299921 - protein, 23 aa, Mycobacterium
HRHLRRYMNWIPGEYVDAMAPAT

SEQ ID NO: 1299922 - protein, 18 aa, Mycobacterium
HRHWLSAPVLPTLYLHGH

SEQ ID NO: 1299923 - protein, 20 aa, Mycobacterium
HRLEILLSLHRAPGICVSDL

SEQ ID NO: 1299924 - protein, 18 aa, Mycobacterium
HRLPDLLRDAGAQRVLVL

SEQ ID NO: 1299925 - protein, 24 aa, Mycobacterium
HRLRRIVDWLDHAIALGASGLALG

SEQ ID NO: 1299926 - protein, 26 aa, Mycobacterium
HRPNGSARAWLFTVARNLVIDERRSA

SEQ ID NO: 1299927 - protein, 34 aa, Mycobacterium
HRPVPLWQHVLVGKRLFDLFDYRAHSPARSGREL

SEQ ID NO: 1299928 - protein, 25 aa, Mycobacterium
HRQSRHFHIGMARPSGMLRLVHMLE

SEQ ID NO: 1299929 - protein, 25 aa, Mycobacterium
HRRDALWAAALQTAIARRSGDSGAM

SEQ ID NO: 1299930 - protein, 21 aa, Mycobacterium
HRRGLAGHPAILAGAGRPHPH

SEQ ID NO: 1299931 - protein, 17 aa, Mycobacterium
HRRVNIGMLPEETFGPG

SEQ ID NO: 1299932 - protein, 19 aa, Mycobacterium
HRVCRYLEDLAGDYHRFYD

SEQ ID NO: 1299933 - protein, 20 aa, Mycobacterium
HSAAKRFLTLGSAGNRLILG

SEQ ID NO: 1299934 - protein, 27 aa, Mycobacterium
HSASRTRLIRLFPTVFKGTHVNLDDVT

SEQ ID NO: 1299935 - protein, 26 aa, Mycobacterium
HSATVDWLTTVLAEDALGGPAALRRT

SEQ ID NO: 1299936 - protein, 21 aa, Mycobacterium
HSDPWFARELAGFPRPILHGL

SEQ ID NO: 1299937 - protein, 25 aa, Mycobacterium
HSDRLVEWLVSRQPKLVTDDHWKLI

SEQ ID NO: 1299938 - protein, 28 aa, Mycobacterium
HSEVDTLRRVELLRQLRLGEYDVLVGIN

SEQ ID NO: 1299939 - protein, 23 aa, Mycobacterium
HSFRQLLHEISALMAYEVLRDIP

SEQ ID NO: 1299940 - protein, 23 aa, Mycobacterium
HSGSLVRYLEPFAHTVGVMQTAE

SEQ ID NO: 1299941 - protein, 23 aa, Mycobacterium
HSGWWDHIAPFFTRTHTVVAPDL

SEQ ID NO: 1299942 - protein, 26 aa, Mycobacterium
HSHHAHALHSPFWWLKCAVGTSNNDH

SEQ ID NO: 1299943 - protein, 18 aa, Mycobacterium
HSLDEACLLSFPRRDLTP

SEQ ID NO: 1299944 - protein, 21 aa, Mycobacterium
HSLLQLAEVDAGLARIEHRVR

SEQ ID NO: 1299945 - protein, 34 aa, Mycobacterium
HSNALDVDLYLRIAPELFLKRALVGGFEKVFELN

SEQ ID NO: 1299946 - protein, 24 aa, Mycobacterium
HSRRIPDFVKLAEALGCVGLRCER

SEQ ID NO: 1299947 - protein, 17 aa, Mycobacterium
HSWGPREWASYNGEWLA

SEQ ID NO: 1299948 - protein, 17 aa, Mycobacterium
HTDAMFMGLVLVEIHMM

SEQ ID NO: 1299949 - protein, 17 aa, Mycobacterium
HTDYECFTLLKPTAPGL

SEQ ID NO: 1299950 - protein, 27 aa, Mycobacterium
HTEDSWLRHLVMLGARNRYGPPERAPQ

SEQ ID NO: 1299951 - protein, 20 aa, Mycobacterium
HTEVKRWFTDGLVDGIRIDH

SEQ ID NO: 1299952 - protein, 27 aa, Mycobacterium
HTFRDHYLDLDLDLSDVVFLATANVIE

SEQ ID NO: 1299953 - protein, 25 aa, Mycobacterium
HTGTDFTWELLLVCGDPAAADTYFA

SEQ ID NO: 1299954 - protein, 24 aa, Mycobacterium
HTHGGQLCLPFYGALVTNCELDRS

SEQ ID NO: 1299955 - protein, 20 aa, Mycobacterium
HTIVVLGRPITAEAFGVVAR

SEQ ID NO: 1299956 - protein, 18 aa, Mycobacterium
HTMLRGLMSRVFTPRRMA

SEQ ID NO: 1299957 - protein, 23 aa, Mycobacterium
HTNQRVPFMLLAGDKDVAAGAVS

SEQ ID NO: 1299958 - protein, 22 aa, Mycobacterium
HTQVFRMWLDAVGMTDDLQCYL

SEQ ID NO: 1299959 - protein, 19 aa, Mycobacterium
HTRAPIPSLLAVSAVHHHL

SEQ ID NO: 1299960 - protein, 25 aa, Mycobacterium
HTRRLKYLVAFRPGVLSPTLAAQQV

SEQ ID NO: 1299961 - protein, 30 aa, Mycobacterium
HTSSSPLALVSFGLLLVLTGDRSGSQRFGE

SEQ ID NO: 1299962 - protein, 24 aa, Mycobacterium
HTSYFDFTFAGLPAYRQGLGRKVR

SEQ ID NO: 1299963 - protein, 18 aa, Mycobacterium
HTVPNQILRFFDGNRRLL

SEQ ID NO: 1299964 - protein, 24 aa, Mycobacterium
HTVSIWMGILLTEKLRGAFDGNPD

SEQ ID NO: 1299965 - protein, 19 aa, Mycobacterium
HVDIPLQAYFRINTENMGQ

SEQ ID NO: 1299966 - protein, 17 aa, Mycobacterium
HVEELVKTGWPVLMALS

SEQ ID NO: 1299967 - protein, 17 aa, Mycobacterium
HVEICEDMWVPVPPSAE

SEQ ID NO: 1299968 - protein, 17 aa, Mycobacterium
HVIAEKYPITVALHTDH

SEQ ID NO: 1299969 - protein, 20 aa, Mycobacterium
HVILAFIPACGQCQPCLKGY

SEQ ID NO: 1299970 - protein, 17 aa, Mycobacterium
HVILLSGAEANEFFFRS

SEQ ID NO: 1299971 - protein, 22 aa, Mycobacterium
HVKFAYWVPNVSGGLVTSTIEQ

SEQ ID NO: 1299972 - protein, 19 aa, Mycobacterium
HVLAGQRLCIYLDPSREWQ

SEQ ID NO: 1299973 - protein, 17 aa, Mycobacterium
HVLDDQLPLALSMRPDL

SEQ ID NO: 1299974 - protein, 20 aa, Mycobacterium
HVLDRYILAKLAQLRDDLTE

SEQ ID NO: 1299975 - protein, 18 aa, Mycobacterium
HVLLQRDVHYIVRDDAVH

SEQ ID NO: 1299976 - protein, 18 aa, Mycobacterium
HVLPLSARSPEALVALAR

SEQ ID NO: 1299977 - protein, 19 aa, Mycobacterium
HVLPRRSGDKLSFAKNMVL

SEQ ID NO: 1299978 - protein, 23 aa, Mycobacterium
HVPLQPDTTPPLRRTARTGSVPT

SEQ ID NO: 1299979 - protein, 18 aa, Mycobacterium
HVRRVRIPEPGNMRQLID

SEQ ID NO: 1299980 - protein, 18 aa, Mycobacterium
HVRSRSLLAAKAYGRMAL

SEQ ID NO: 1299981 - protein, 17 aa, Mycobacterium
HVTLLAPGPVRETLPDE

SEQ ID NO: 1299982 - protein, 32 aa, Mycobacterium
HVVAAFDTELFGHWWYEGPEWLARVLRALPEA

SEQ ID NO: 1299983 - protein, 18 aa, Mycobacterium
HVVLMSPDLKRTVAALAA

SEQ ID NO: 1299984 - protein, 18 aa, Mycobacterium
HVYEASVRLNRPSKFFVL

SEQ ID NO: 1299985 - protein, 19 aa, Mycobacterium
HVYLERRKLARNLGVLILI

SEQ ID NO: 1299986 - protein, 18 aa, Mycobacterium
HWALGTLQLEALAACNAP

SEQ ID NO: 1299987 - protein, 25 aa, Mycobacterium
HWDERFGDRHIALTLLACGADPQTV

SEQ ID NO: 1299988 - protein, 20 aa, Mycobacterium
HWEGSAGDLIVIPKTRHDLA

SEQ ID NO: 1299989 - protein, 18 aa, Mycobacterium
HWRADDDMFGALGLDLRR

SEQ ID NO: 1299990 - protein, 20 aa, Mycobacterium
HYAAYEKTALLRLAGRYGVG

SEQ ID NO: 1299991 - protein, 25 aa, Mycobacterium
HYAGAFPAWLAPVQVVGIPVADAHI

SEQ ID NO: 1299992 - protein, 26 aa, Mycobacterium
HYDLSDEFFALFLDATRTYSCAYFER

SEQ ID NO: 1299993 - protein, 31 aa, Mycobacterium
HYGMCGRAYDPRFLFAWPSAKAAVMGGTQLA

SEQ ID NO: 1299994 - protein, 18 aa, Mycobacterium
HYGRIRALHGVSLKVHEG

SEQ ID NO: 1299995 - protein, 20 aa, Mycobacterium
HYHKIHLYDAFGFRESRTVA

SEQ ID NO: 1299996 - protein, 19 aa, Mycobacterium
HYHVAVLQTLAHRMGLDGP

SEQ ID NO: 1299997 - protein, 19 aa, Mycobacterium
HYQPDRLLYPMRRVGPKGS

SEQ ID NO: 1299998 - protein, 23 aa, Mycobacterium
HYSDDWGQLWWVRADGVAAVHHS

SEQ ID NO: 1299999 - protein, 20 aa, Mycobacterium
HYYDSLLAKVIAWAPTRDEA

SEQ ID NO: 1300000 - protein, 34 aa, Mycobacterium
HYYRGIFGSNVALVLRRLLRLCARYSADPGGPTV

SEQ ID NO: 1300001 - protein, 25 aa, Mycobacterium
IAADGTVLDTWYPAPELGADLGESG

SEQ ID NO: 1300002 - protein, 27 aa, Mycobacterium
IAADPAIRYLPYWESLEPVPAPGEDDP

SEQ ID NO: 1300003 - protein, 18 aa, Mycobacterium
IAALLHGFSTFDPQTRIA

SEQ ID NO: 1300004 - protein, 18 aa, Mycobacterium
IAASRKPVLYVGGGIIRG

SEQ ID NO: 1300005 - protein, 24 aa, Mycobacterium
IAATLLLEVPIVDGSWVAKARTGP

SEQ ID NO: 1300006 - protein, 19 aa, Mycobacterium
IAAVRRIVAPPPDGFGISA

SEQ ID NO: 1300007 - protein, 24 aa, Mycobacterium
IAAYRRYAALIQPEADRFGLTLPP

SEQ ID NO: 1300008 - protein, 21 aa, Mycobacterium
IACSRWGMLAPDGQCKTFDAG

SEQ ID NO: 1300009 - protein, 18 aa, Mycobacterium
IACTLIELALGPHQPILA

SEQ ID NO: 1300010 - protein, 21 aa, Mycobacterium
IADAARRWAVSLDDGGLEFVD

SEQ ID NO: 1300011 - protein, 20 aa, Mycobacterium
IADLCALVREAALRAAARAS

SEQ ID NO: 1300012 - protein, 24 aa, Mycobacterium
IADLESREVLLAKLAGAMKGNLAK

SEQ ID NO: 1300013 - protein, 22 aa, Mycobacterium
IADLIGAFRFSTAFGSTLSRLV

SEQ ID NO: 1300014 - protein, 22 aa, Mycobacterium
IADVHITYKGQLRLIDSPLQVT

SEQ ID NO: 1300015 - protein, 17 aa, Mycobacterium
IAEFHQRATARAAMWPH

SEQ ID NO: 1300016 - protein, 22 aa, Mycobacterium
IAEIFGMLACGARIVIHRPGGL

SEQ ID NO: 1300017 - protein, 17 aa, Mycobacterium
IAEVPERGLLLAHHPLL

SEQ ID NO: 1300018 - protein, 29 aa, Mycobacterium
IAEYGISWILPRLVGFGAAMDLLLSGRTF

SEQ ID NO: 1300019 - protein, 24 aa, Mycobacterium
IAFFHGGTLYGIPMPPGLISHAPQ

SEQ ID NO: 1300020 - protein, 19 aa, Mycobacterium
IAGDPFIELLERGALQQVG

SEQ ID NO: 1300021 - protein, 26 aa, Mycobacterium
IAGPNALFDPRFQKLGIHPGGGATWM

SEQ ID NO: 1300022 - protein, 24 aa, Mycobacterium
IAGQWTYLPMNGAAFMMQGMHPVI

SEQ ID NO: 1300023 - protein, 18 aa, Mycobacterium
IAHAMSLPRPGWAEADAE

SEQ ID NO: 1300024 - protein, 26 aa, Mycobacterium
IAIELDGLRLITWRGASRAEQGLPYA

SEQ ID NO: 1300025 - protein, 17 aa, Mycobacterium
IAKLLGIKHFVAAVNKI

SEQ ID NO: 1300026 - protein, 23 aa, Mycobacterium
IALERLLDFMPRYEVLWDECRRV

SEQ ID NO: 1300027 - protein, 19 aa, Mycobacterium
IALMHQVVTAQLAAKRQGT

SEQ ID NO: 1300028 - protein, 20 aa, Mycobacterium
IAMAINYGYNKVRFINPVKV

SEQ ID NO: 1300029 - protein, 21 aa, Mycobacterium
IAMNFSLDGAWGQWVNRWTAE

SEQ ID NO: 1300030 - protein, 22 aa, Mycobacterium
IAMRVCIVIIVRADGLISRIDE

SEQ ID NO: 1300031 - protein, 20 aa, Mycobacterium
IANVLLGSTAVTVSMQAQCC

SEQ ID NO: 1300032 - protein, 17 aa, Mycobacterium
IAPSNIYRTADGSWVVI

SEQ ID NO: 1300033 - protein, 26 aa, Mycobacterium
IAQLSRIIPLMRARLEKLLSGPNASV

SEQ ID NO: 1300034 - protein, 32 aa, Mycobacterium
IAQRDTTVALLPIGYADGVYRSLSGRLQVLIN

SEQ ID NO: 1300035 - protein, 18 aa, Mycobacterium
IAQSLVLEIGGEPFRVRE

SEQ ID NO: 1300036 - protein, 17 aa, Mycobacterium
IARKLAEKLWQLRILDG

SEQ ID NO: 1300037 - protein, 27 aa, Mycobacterium
IARRLGTPLVIHQPSYSLLNRWIEGDL

SEQ ID NO: 1300038 - protein, 25 aa, Mycobacterium
IARRYTDRLPFGPPPDWDSLELLLR

SEQ ID NO: 1300039 - protein, 20 aa, Mycobacterium
IASKRIAPIVILTAFSQRDL

SEQ ID NO: 1300040 - protein, 18 aa, Mycobacterium
IATFYQYFTGKAELLQAV

SEQ ID NO: 1300041 - protein, 22 aa, Mycobacterium
IATVYRALLLRVRPGTDEATVR

SEQ ID NO: 1300042 - protein, 18 aa, Mycobacterium
IAVPDLMFTEPITTLAGV

SEQ ID NO: 1300043 - protein, 28 aa, Mycobacterium
IAVPTPDHFIPWLYLAGLASTAADSVDI

SEQ ID NO: 1300044 - protein, 20 aa, Mycobacterium
IAVWVAAPPNVVYDLAADPA

SEQ ID NO: 1300045 - protein, 21 aa, Mycobacterium
IAWSLFRHPVKSREFPAKHER

SEQ ID NO: 1300046 - protein, 20 aa, Mycobacterium
IAYILVLRTEFPNGFVATVR

SEQ ID NO: 1300047 - protein, 19 aa, Mycobacterium
ICDRLGLLPMYAVNQDKHG

SEQ ID NO: 1300048 - protein, 23 aa, Mycobacterium
ICRAVLPAMRRRGSGRIVGIASE

SEQ ID NO: 1300049 - protein, 17 aa, Mycobacterium
ICWGTENREAAVRFLQG

SEQ ID NO: 1300050 - protein, 25 aa, Mycobacterium
ICWHTDRLYRSLKDLVRLLEVAVGI

SEQ ID NO: 1300051 - protein, 21 aa, Mycobacterium
IDAALTVRLAVAPDIDIRFGI

SEQ ID NO: 1300052 - protein, 22 aa, Mycobacterium
IDADGFIFVEDRLKDMIISGGE

SEQ ID NO: 1300053 - protein, 28 aa, Mycobacterium
IDALLALRPDACCYNPLWPDIDELTRLL

SEQ ID NO: 1300054 - protein, 18 aa, Mycobacterium
IDAPFGSVLRRRGDPAVV

SEQ ID NO: 1300055 - protein, 24 aa, Mycobacterium
IDASGYVFIARGTGLPYAAEGALK

SEQ ID NO: 1300056 - protein, 27 aa, Mycobacterium
IDATRMLVWRAGWMHRNNKAFTSAEGS

SEQ ID NO: 1300057 - protein, 18 aa, Mycobacterium
IDAVAALRHSGVDARLVV

SEQ ID NO: 1300058 - protein, 17 aa, Mycobacterium
IDDDVPVELIWRNARTP

SEQ ID NO: 1300059 - protein, 24 aa, Mycobacterium
IDDHAVVPVLRREQPELPAVAAAV

SEQ ID NO: 1300060 - protein, 28 aa, Mycobacterium
IDDIRRYLSYFPSSAWSYPPTRLADDTA

SEQ ID NO: 1300061 - protein, 24 aa, Mycobacterium
IDDVRTRHWRFGAMPLGDGMHRVM

SEQ ID NO: 1300062 - protein, 26 aa, Mycobacterium
IDEQLDLFPALKELLTRRAGLLSGGQ

SEQ ID NO: 1300063 - protein, 25 aa, Mycobacterium
IDGLRRFHCNLGHGLLGRLVERSPL

SEQ ID NO: 1300064 - protein, 18 aa, Mycobacterium
IDGLWAAVLARTAERRGQ

SEQ ID NO: 1300065 - protein, 17 aa, Mycobacterium
IDGQLWQIVEFQHVKPG

SEQ ID NO: 1300066 - protein, 17 aa, Mycobacterium
IDGQWVDPLRPNALEVD

SEQ ID NO: 1300067 - protein, 18 aa, Mycobacterium
IDKGEFVFLIGPSGSGKS

SEQ ID NO: 1300068 - protein, 20 aa, Mycobacterium
IDLRMIPAPLRWSSRHLLQF

SEQ ID NO: 1300069 - protein, 26 aa, Mycobacterium
IDNVVDMAHFFYIHGSLPTHFKNIFE

SEQ ID NO: 1300070 - protein, 41 aa, Mycobacterium
IDPDQVALPGWYRPNPGLARDLAFIAFSTLGGELVARQITN

SEQ ID NO: 1300071 - protein, 17 aa, Mycobacterium
IDPKLWQQIGCDPVALL

SEQ ID NO: 1300072 - protein, 23 aa, Mycobacterium
IDQLPDLPPLPDELRHRLDSALA

SEQ ID NO: 1300073 - protein, 22 aa, Mycobacterium
IDRATKLLGLLTATDKSYEATI

SEQ ID NO: 1300074 - protein, 30 aa, Mycobacterium
IDRGQLLETLAALLVGRKPRLPAKTVCTEC

SEQ ID NO: 1300075 - protein, 25 aa, Mycobacterium
IDRLGGALLIPPMTLAQVLVATSDS

SEQ ID NO: 1300076 - protein, 23 aa, Mycobacterium
IDRPVMWTIAALLGQHPIPVDSG

SEQ ID NO: 1300077 - protein, 24 aa, Mycobacterium
IDRREDYFLWDMGGRRLIDMHLNG

SEQ ID NO: 1300078 - protein, 17 aa, Mycobacterium
IDRWRHFAFQVLGFAEG

SEQ ID NO: 1300079 - protein, 26 aa, Mycobacterium
IDTERWQGVPFYLRTGKALGATRRTV

SEQ ID NO: 1300080 - protein, 17 aa, Mycobacterium
IDTPKLLMLSGIGPTAH

SEQ ID NO: 1300081 - protein, 27 aa, Mycobacterium
IDTRRWAGVPFYLRTGKRLGRRVTEIA

SEQ ID NO: 1300082 - protein, 21 aa, Mycobacterium
IDWQAYFHLRNRLVVAALHWD

SEQ ID NO: 1300083 - protein, 23 aa, Mycobacterium
IEAADVRARWPRPGPKDDKYTQG

SEQ ID NO: 1300084 - protein, 34 aa, Mycobacterium
IEAGGTDNWFWIKVPVGYLYTIANPRTDWCFTTE

SEQ ID NO: 1300085 - protein, 24 aa, Mycobacterium
IEAGRALVLAFNKWDLVDEDRRYL

SEQ ID NO: 1300086 - protein, 23 aa, Mycobacterium
IEAQLRFLAAEGVDLIVTSGGLG

SEQ ID NO: 1300087 - protein, 23 aa, Mycobacterium
IEDDPLIRACMLTYMSDLGPVPA

SEQ ID NO: 1300088 - protein, 23 aa, Mycobacterium
IEDLEFAVRLGVDLVALSFVRSP

SEQ ID NO: 1300089 - protein, 23 aa, Mycobacterium
IEEALRMHAPTKVDFRLVRKTTT

SEQ ID NO: 1300090 - protein, 19 aa, Mycobacterium
IEEIALGALPGLPKIAVHW

SEQ ID NO: 1300091 - protein, 25 aa, Mycobacterium
IEERLGATPLVIQLPIGAENDFIGI

SEQ ID NO: 1300092 - protein, 20 aa, Mycobacterium
IEFPARIGVWWASETWSITD

SEQ ID NO: 1300093 - protein, 27 aa, Mycobacterium
IEGFPTPADFFAAFNAAIAGLVPGFNA

SEQ ID NO: 1300094 - protein, 22 aa, Mycobacterium
IEGSPLFHVISGNLGYQVEHHL

SEQ ID NO: 1300095 - protein, 26 aa, Mycobacterium
IEGTTIRFAHPLLARGVYSEAGPARR

SEQ ID NO: 1300096 - protein, 18 aa, Mycobacterium
IEHAFFTRTQDGTSLRGL

SEQ ID NO: 1300097 - protein, 26 aa, Mycobacterium
IEHELRVIEKLSFPGYFLVVHDITRF

SEQ ID NO: 1300098 - protein, 19 aa, Mycobacterium
IEHHAVLDAVQWLVEHEGA

SEQ ID NO: 1300099 - protein, 26 aa, Mycobacterium
IEIVGRFLALLELYRARTVAFDQAEP

SEQ ID NO: 1300100 - protein, 21 aa, Mycobacterium
IEKVLRRMPAPAREGLADALA

SEQ ID NO: 1300101 - protein, 28 aa, Mycobacterium
IELCDKRVIPLLFLQNIAGFMVGRDYEA

SEQ ID NO: 1300102 - protein, 29 aa, Mycobacterium
IELELRRHILTLWQTALIRLSRLKIQDEI

SEQ ID NO: 1300103 - protein, 18 aa, Mycobacterium
IELWQKMFATHVMGPVAL

SEQ ID NO: 1300104 - protein, 26 aa, Mycobacterium
IENYAQRPLLDLPWDIAESAPGRIVG

SEQ ID NO: 1300105 - protein, 23 aa, Mycobacterium
IEPMFAIAYTRAILGRHLLEVNP

SEQ ID NO: 1300106 - protein, 21 aa, Mycobacterium
IEPSPLPFGRHRWVSSLGPPS

SEQ ID NO: 1300107 - protein, 37 aa, Mycobacterium
IERDAMMEIFAKHPSYLHSFAPMPLHRVDSGGKKGLQ

SEQ ID NO: 1300108 - protein, 24 aa, Mycobacterium
IERGEGVVYWQVPKSATLDTTIGK

SEQ ID NO: 1300109 - protein, 21 aa, Mycobacterium
IERKRMLLGMERQFHSAVPTL

SEQ ID NO: 1300110 - protein, 24 aa, Mycobacterium
IERRQLLELYGARIIFSPAEGGSN

SEQ ID NO: 1300111 - protein, 27 aa, Mycobacterium
IESPTAVRWHLLASTWLDLPARPGLTG

SEQ ID NO: 1300112 - protein, 18 aa, Mycobacterium
IETKGYVAALAAADAMVK

SEQ ID NO: 1300113 - protein, 17 aa, Mycobacterium
IEVRVHRLVAEGDTVVA

SEQ ID NO: 1300114 - protein, 17 aa, Mycobacterium
IEVSYLLIYGELPTADQ

SEQ ID NO: 1300115 - protein, 31 aa, Mycobacterium
IEYLFDLGVTCLWLMPFYPTARKDDGYDIID

SEQ ID NO: 1300116 - protein, 18 aa, Mycobacterium
IFDIAPIPGDVGIGRIAS

SEQ ID NO: 1300117 - protein, 26 aa, Mycobacterium
IFDQDAILKVFRRITPGINPDIELNR

SEQ ID NO: 1300118 - protein, 19 aa, Mycobacterium
IFDQGLGDMFVVRTAGHVI

SEQ ID NO: 1300119 - protein, 32 aa, Mycobacterium
IFEAQAHPQMLLRIGWLPRDAVALPATPRRPL

SEQ ID NO: 1300120 - protein, 29 aa, Mycobacterium
IFEIPATTTLYQPLLSTIPLQVFAAEVAR

SEQ ID NO: 1300121 - protein, 24 aa, Mycobacterium
IFRVGDVWRQIRAANLPVAVSDRM

SEQ ID NO: 1300122 - protein, 17 aa, Mycobacterium
IFVPSVPTLLDLASQME

SEQ ID NO: 1300123 - protein, 18 aa, Mycobacterium
IFVTGLPRTGTTAVHRLL

SEQ ID NO: 1300124 - protein, 23 aa, Mycobacterium
IGAEIVRRLAFEGAAVAFTYGSS

SEQ ID NO: 1300125 - protein, 31 aa, Mycobacterium; identical to SEQ ID NO: 825899

SEQ ID NO: 1300126 - protein, 17 aa, Mycobacterium
IGAWCFVDHYGPDDVGH

SEQ ID NO: 1300127 - protein, 24 aa, Mycobacterium
IGDLFGGLFGRGASPRPSRPRRGN

SEQ ID NO: 1300128 - protein, 20 aa, Mycobacterium
IGDMVRLALATPYVGGLTIQ

SEQ ID NO: 1300129 - protein, 25 aa, Mycobacterium
IGDPPLVVRINFLGTRHFTESMLPR

SEQ ID NO: 1300130 - protein, 25 aa, Mycobacterium
IGDWIEMFTMWPTKYTPGLRTQGSV

SEQ ID NO: 1300131 - protein, 18 aa, Mycobacterium
IGEKYSGIRPAPGYPACP

SEQ ID NO: 1300132 - protein, 29 aa, Mycobacterium
IGEPGGIRFYAGYPLYGPGGHPVGTFCIY

SEQ ID NO: 1300133 - protein, 24 aa, Mycobacterium
IGERTLLKVIVESAALLELGGRDV

SEQ ID NO: 1300134 - protein, 25 aa, Mycobacterium
IGGDHTIALPNLRALHAVHGPVALV

SEQ ID NO: 1300135 - protein, 18 aa, Mycobacterium
IGHLRRKLGDDAANPRFI

SEQ ID NO: 1300136 - protein, 19 aa, Mycobacterium
IGHMSAFMAQAGRLVVRGD

SEQ ID NO: 1300137 - protein, 25 aa, Mycobacterium
IGITPILPMLALAQRFEVPWTMSYA

SEQ ID NO: 1300138 - protein, 31 aa, Mycobacterium
IGKDIIRFHTVYWPAFLMSAGLELPRKVFAH

SEQ ID NO: 1300139 - protein, 24 aa, Mycobacterium
IGKRIERGLGLTGLLRATLVEART

SEQ ID NO: 1300140 - protein, 27 aa, Mycobacterium
IGLGPTDRLCIPVPFYHCFGMVMGNLG

SEQ ID NO: 1300141 - protein, 17 aa, Mycobacterium
IGPVRTRDLMFTGRTLS

SEQ ID NO: 1300142 - protein, 24 aa, Mycobacterium
IGRAHTPWFHWGTTAMVAHTVERF

SEQ ID NO: 1300143 - protein, 25 aa, Mycobacterium
IGRGCLGRPWLFAELSAKFTGRPLP

SEQ ID NO: 1300144 - protein, 20 aa, Mycobacterium
IGRIGIFDRDNDFEPLLLDW

SEQ ID NO: 1300145 - protein, 24 aa, Mycobacterium
IGSDRLRLEAYRRLAAAQDDAGVD

SEQ ID NO: 1300146 - protein, 30 aa, Mycobacterium
IGSVYQYFPNKQALLYALAERHVRQAREHL

SEQ ID NO: 1300147 - protein, 22 aa, Mycobacterium
IGTLSFPLGRQQRPAPSVVAGD

SEQ ID NO: 1300148 - protein, 24 aa, Mycobacterium
IGTPEDIWRRPADTFVARALGQPE

SEQ ID NO: 1300149 - protein, 28 aa, Mycobacterium
IGVDRQIGLLLPCNVVVRSDPDDPQTTL

SEQ ID NO: 1300150 - protein, 27 aa, Mycobacterium
IHAKGQPVFPMTLLGTFSPYMVVHKSS

SEQ ID NO: 1300151 - protein, 28 aa, Mycobacterium
IHDFYGFPQELFDVQYPAPGLPGLADEV

SEQ ID NO: 1300152 - protein, 25 aa, Mycobacterium
IHEGELFIVGRIKDLLIIRGRNHHP

SEQ ID NO: 1300153 - protein, 24 aa, Mycobacterium
IHERWDDFVVPGLGIRCVDDRPWV

SEQ ID NO: 1300154 - protein, 25 aa, Mycobacterium
IHSLRRRGRHLQVGLLPDVTGHPAV

SEQ ID NO: 1300155 - protein, 19 aa, Mycobacterium
IIAAAIVERPWPPRGDPVE

SEQ ID NO: 1300156 - protein, 17 aa, Mycobacterium
IIAIAMTEPGAGSDLAG

SEQ ID NO: 1300157 - protein, 24 aa, Mycobacterium
IIEEMLRFPLPVIAAVNGPAVGLG

SEQ ID NO: 1300158 - protein, 18 aa, Mycobacterium
IIHYTQGLAYRLAAQGIR

SEQ ID NO: 1300159 - protein, 32 aa, Mycobacterium
IIRQSYFEDPAYVPLLLRAYDLWDRLATDSAR

SEQ ID NO: 1300160 - protein, 18 aa, Mycobacterium
IIRRLRRPDPYKGKGVRY

SEQ ID NO: 1300161 - protein, 20 aa, Mycobacterium
IISEPTDLVAVRTALQDAGI

SEQ ID NO: 1300162 - protein, 20 aa, Mycobacterium
IISSIKYFRDEYLAHLGNGC

SEQ ID NO: 1300163 - protein, 18 aa, Mycobacterium
IIVERRDALLRTPTAREE

SEQ ID NO: 1300164 - protein, 25 aa, Mycobacterium
IKQLPGLLVVLRDGGYRDNEIVRWL

SEQ ID NO: 1300165 - protein, 21 aa, Mycobacterium
ILAAVKRLYLLGKNDRPTGTF

SEQ ID NO: 1300166 - protein, 18 aa, Mycobacterium
ILALAAVEAFFGAGAERQ

SEQ ID NO: 1300167 - protein, 20 aa, Mycobacterium
ILARLIHSFVTVPAAAPVLA

SEQ ID NO: 1300168 - protein, 24 aa, Mycobacterium
ILDAPLVKAFLLQVSAQTLRAFGH

SEQ ID NO: 1300169 - protein, 25 aa, Mycobacterium
ILDLDTLPEHLVIVGGSYIALEFAQ

SEQ ID NO: 1300170 - protein, 17 aa, Mycobacterium
ILDLTELLDRKPGQLSG

SEQ ID NO: 1300171 - protein, 33 aa, Mycobacterium
ILDPFGLENMRYKWRKWLYFDCNWKVAMEAFNE

SEQ ID NO: 1300172 - protein, 25 aa, Mycobacterium
ILDRHPSLKIGWFEGGIAWVPTALQ

SEQ ID NO: 1300173 - protein, 25 aa, Mycobacterium
ILDVLDNYAFVRTSGYLPGPNDVYV

SEQ ID NO: 1300174 - protein, 18 aa, Mycobacterium
ILEEVWGFDFPTSGNALE

SEQ ID NO: 1300175 - protein, 42 aa, Mycobacterium
ILERSLVHLGLKHYFLVDFPQEPGALRRFLDEVLGPNDDITL

SEQ ID NO: 1300176 - protein, 18 aa, Mycobacterium
ILFGGRRKTTVPLITQAR

SEQ ID NO: 1300177 - protein, 18 aa, Mycobacterium
ILGLDIKGHVVKKLLVAE

SEQ ID NO: 1300178 - protein, 17 aa, Mycobacterium
ILHFTKCAAIELAHYDI

SEQ ID NO: 1300179 - protein, 17 aa, Mycobacterium
ILLAPLTVVPGQVGHRW

SEQ ID NO: 1300180 - protein, 18 aa, Mycobacterium
ILLKLIQAADYDVKRAET

SEQ ID NO: 1300181 - protein, 31 aa, Mycobacterium; identical to SEQ ID NO: 784826

SEQ ID NO: 1300182 - protein, 20 aa, Mycobacterium
ILRTNLAAVILQMAALGLGD

SEQ ID NO: 1300183 - protein, 23 aa, Mycobacterium
ILSLAHTLLRTHPELDRLAELVA

SEQ ID NO: 1300184 - protein, 33 aa, Mycobacterium
ILSLPDPKILVLGRLRIAIPADFAPIIDLKAEI

SEQ ID NO: 1300185 - protein, 35 aa, Mycobacterium
ILTGPILSGARRWCPMRRWIDIGAFDDGAPTRLPG

SEQ ID NO: 1300186 - protein, 20 aa, Mycobacterium
ILVLADWMHLLDSGYDWDYP

SEQ ID NO: 1300187 - protein, 28 aa, Mycobacterium
IMAAKRTSDLIPLCHQLALTGVDVDFEI

SEQ ID NO: 1300188 - protein, 19 aa, Mycobacterium
IMAERLAHLLSVCGTPAVY

SEQ ID NO: 1300189 - protein, 31 aa, Mycobacterium
INAFVRWGRHLLFTRTPTDLVRPEWLARAVR

SEQ ID NO: 1300190 - protein, 23 aa, Mycobacterium
INEAFAPVVIAWLKELKADPEKV

SEQ ID NO: 1300191 - protein, 21 aa, Mycobacterium
INFTNICYTGCRFCAFAQRKG

SEQ ID NO: 1300192 - protein, 31 aa, Mycobacterium
INGAAAHLVHPGDLVILIAYGTMEDAEARAY

SEQ ID NO: 1300193 - protein, 18 aa, Mycobacterium
INMPVLDGVSVVTALRAM

SEQ ID NO: 1300194 - protein, 17 aa, Mycobacterium
INPFDFFIEEYAERIGF

SEQ ID NO: 1300195 - protein, 19 aa, Mycobacterium
INPGSFTAAPNFAFELAVR

SEQ ID NO: 1300196 - protein, 17 aa, Mycobacterium
INPYFDWGTDRPPNHEY

SEQ ID NO: 1300197 - protein, 18 aa, Mycobacterium
INQLLRRGFSSAHIAEFF

SEQ ID NO: 1300198 - protein, 25 aa, Mycobacterium
INSRPAPLVAYWFGPDDQDFRTFVR

SEQ ID NO: 1300199 - protein, 25 aa, Mycobacterium
INVPIPVPMAYYSFGGWKNSLFGDS

SEQ ID NO: 1300200 - protein, 41 aa, Mycobacterium
INVSGVFHGVRAFLPMMIEARTPAWVWNLSSIGGVAVVPLQ

SEQ ID NO: 1300201 - protein, 25 aa, Mycobacterium
INVVGTSMVWLVTPRQADDWLRVPL

SEQ ID NO: 1300202 - protein, 28 aa, Mycobacterium
IPADPNGAWYTSGIRFGTPALTTRGFGA

SEQ ID NO: 1300203 - protein, 17 aa, Mycobacterium
IPAIPRREDPRDALVAR

SEQ ID NO: 1300204 - protein, 29 aa, Mycobacterium
IPAVLKNAIDWLSRPWGDGALKDKPLAVV

SEQ ID NO: 1300205 - protein, 27 aa, Mycobacterium
IPAVNKLGTMGLILRGSEELKQKVLPD

SEQ ID NO: 1300206 - protein, 24 aa, Mycobacterium
IPDDAYGGTFRLIDKVFSQWGISY

SEQ ID NO: 1300207 - protein, 25 aa, Mycobacterium
IPDEWFLAGHLVVGWPRGSHGPVRR

SEQ ID NO: 1300208 - protein, 18 aa, Mycobacterium
IPDLYFSVSATTRAPRPG

SEQ ID NO: 1300209 - protein, 17 aa, Mycobacterium
IPERPNPLMVMSDEEWR

SEQ ID NO: 1300210 - protein, 21 aa, Mycobacterium
IPFAIPYTKPLKFASGEVTDA

SEQ ID NO: 1300211 - protein, 30 aa, Mycobacterium
IPHYYLADEVLMDPALAWLAERNAARSITE

SEQ ID NO: 1300212 - protein, 23 aa, Mycobacterium
IPILDRGGFFARLKPARSYCMAY

SEQ ID NO: 1300213 - protein, 23 aa, Mycobacterium
IPNREDLAFLPGQYVNVAVPGTD

SEQ ID NO: 1300214 - protein, 23 aa, Mycobacterium
IPPHNLRELADAVYWCLENFEAD

SEQ ID NO: 1300215 - protein, 17 aa, Mycobacterium
IPRLPLPTKIVIEVQEP

SEQ ID NO: 1300216 - protein, 25 aa, Mycobacterium
IPSYKSCFLAMMRSFHDAGVTALNG

SEQ ID NO: 1300217 - protein, 18 aa, Mycobacterium
IPVATRLSGLEPLNITDD

SEQ ID NO: 1300218 - protein, 27 aa, Mycobacterium
IPVLPNVHWLYEYGHPRRLAQTEAIPL

SEQ ID NO: 1300219 - protein, 23 aa, Mycobacterium
IQAQDFFFRKIVRDKGQALAYVA

SEQ ID NO: 1300220 - protein, 25 aa, Mycobacterium
IQIMPQVWAMRYTLERVTRGQDTIA

SEQ ID NO: 1300221 - protein, 26 aa, Mycobacterium
IQLTDIALRRPSLDDVFLALTADSES

SEQ ID NO: 1300222 - protein, 22 aa, Mycobacterium
IQRVIPLEKLRWISFGHLEADE

SEQ ID NO: 1300223 - protein, 20 aa, Mycobacterium
IQRVLHLWPHARCALMGVGA

SEQ ID NO: 1300224 - protein, 31 aa, Mycobacterium; identical to SEQ ID NO: 827206

SEQ ID NO: 1300225 - protein, 19 aa, Mycobacterium
IQTDLILAVRDQGYMFVTG

SEQ ID NO: 1300226 - protein, 26 aa, Mycobacterium
IQVLPDRTRLLLLLAAAEPVGDSSLF

SEQ ID NO: 1300227 - protein, 18 aa, Mycobacterium
IRAMLRRPRMRPVAGADT

SEQ ID NO: 1300228 - protein, 21 aa, Mycobacterium
IRAMPAIRRRVPGATLVIVGG

SEQ ID NO: 1300229 - protein, 19 aa, Mycobacterium
IRDIGYYVAPTVFADVDPD

SEQ ID NO: 1300230 - protein, 19 aa, Mycobacterium
IRDSLATVLALRELNRLNN

SEQ ID NO: 1300231 - protein, 19 aa, Mycobacterium
IRETVDLLTRVFPARTCSA

SEQ ID NO: 1300232 - protein, 25 aa, Mycobacterium
IREVALMRAVLWRRCDYLWDHHVVL

SEQ ID NO: 1300233 - protein, 19 aa, Mycobacterium
IRGEECSAYWPAGTAGWHV

SEQ ID NO: 1300234 - protein, 19 aa, Mycobacterium
IRHFRPIAPDKTEVTIYCI

SEQ ID NO: 1300235 - protein, 18 aa, Mycobacterium
IRIAWQTAVGSDLALPEV

SEQ ID NO: 1300236 - protein, 24 aa, Mycobacterium
IRKRSLIRRLGVTEVPFRELRDAA

SEQ ID NO: 1300237 - protein, 32 aa, Mycobacterium
IRLEDFWLIDHDVPNWLPCPNGTFAPGHQKFI

SEQ ID NO: 1300238 - protein, 17 aa, Mycobacterium
IRLMALVEYSADEIKTV

SEQ ID NO: 1300239 - protein, 18 aa, Mycobacterium
IRLRGVSHRYGRGGQEVT

SEQ ID NO: 1300240 - protein, 23 aa, Mycobacterium
IRLYKRMFLPGVDDVVFIGFAQS

SEQ ID NO: 1300241 - protein, 26 aa, Mycobacterium
IRMSQRLGIPLARIRAALATLPTDRV

SEQ ID NO: 1300242 - protein, 17 aa, Mycobacterium
IRPYTWPYPEISTAAMI

SEQ ID NO: 1300243 - protein, 17 aa, Mycobacterium
IRQTTAWMVLRDPAADM

SEQ ID NO: 1300244 - protein, 28 aa, Mycobacterium
IRRSFRRYRWVLPMARLIGNAARMSADQ

SEQ ID NO: 1300245 - protein, 30 aa, Mycobacterium
IRVNAICPGFIETPLFDAVVGMPGMERPRE

SEQ ID NO: 1300246 - protein, 27 aa, Mycobacterium
IRVNLLDIELLTIKLRLVIASLDTARE

SEQ ID NO: 1300247 - protein, 23 aa, Mycobacterium
IRVNSVAPGYIWGETLKSYFNHQ

SEQ ID NO: 1300248 - protein, 19 aa, Mycobacterium
IRVVREQIVLIDPGVELGP

SEQ ID NO: 1300249 - protein, 24 aa, Mycobacterium
IRYDVMMQLCRPLTVFEIDALIVH

SEQ ID NO: 1300250 - protein, 19 aa, Mycobacterium
ISAPWLTRRGEKLLDPLIG

SEQ ID NO: 1300251 - protein, 26 aa, Mycobacterium
ISATNIIPFPLTAWAVRAMTRLPQRS

SEQ ID NO: 1300252 - protein, 26 aa, Mycobacterium
ISELPRAVDLFFRGITDWIIGGIRGG

SEQ ID NO: 1300253 - protein, 19 aa, Mycobacterium
ISFTHLIGYAIVAAVKKFP

SEQ ID NO: 1300254 - protein, 26 aa, Mycobacterium
ISGGRSWPMYVPLVVPDARTAESLSG

SEQ ID NO: 1300255 - protein, 26 aa, Mycobacterium
ISGYGLPMALTLFRRDLDVWAPGEHN

SEQ ID NO: 1300256 - protein, 19 aa, Mycobacterium
ISPATLRQALLGKVMTVGD

SEQ ID NO: 1300257 - protein, 26 aa, Mycobacterium
ISPENKAYFIAAAFPSACGKTNLAML

SEQ ID NO: 1300258 - protein, 19 aa, Mycobacterium
ISQMHVSRLLAKSLTRLRD

SEQ ID NO: 1300259 - protein, 27 aa, Mycobacterium
ISRNVPLGRLAKPDDIGWATAFLASDA

SEQ ID NO: 1300260 - protein, 23 aa, Mycobacterium
ISVAEQDAIITQNLEGSATAISN

SEQ ID NO: 1300261 - protein, 32 aa, Mycobacterium
ISVAMLPGWARKPLRLPYFPPLEATAVRVSGR

SEQ ID NO: 1300262 - protein, 17 aa, Mycobacterium
ISVKLIQPVAMDEGLRF

SEQ ID NO: 1300263 - protein, 30 aa, Mycobacterium
ISVLPAKYLNRLSDLLFILSRAANPDGDVL

SEQ ID NO: 1300264 - protein, 23 aa, Mycobacterium
ITAPRGWELVRHAGPLPSHTDDD

SEQ ID NO: 1300265 - protein, 22 aa, Mycobacterium
ITDELPLLQARTVRVAGHLLEI

SEQ ID NO: 1300266 - protein, 17 aa, Mycobacterium
ITEAVYFVERLVDCLAY

SEQ ID NO: 1300267 - protein, 18 aa, Mycobacterium
ITEEEWRAHWPTRSAEDP

SEQ ID NO: 1300268 - protein, 29 aa, Mycobacterium
ITEVGGPHRFRLPDLIRTALTARGDGREV

SEQ ID NO: 1300269 - protein, 20 aa, Mycobacterium
ITGLLRSGVLPDGAHLALVT

SEQ ID NO: 1300270 - protein, 19 aa, Mycobacterium
ITHDLPLEQGVRAYDMFKN

SEQ ID NO: 1300271 - protein, 18 aa, Mycobacterium
ITMSAPYLSQLRSGNRTN

SEQ ID NO: 1300272 - protein, 22 aa, Mycobacterium
ITPGYDLRYLVGSRAQTFERLT

SEQ ID NO: 1300273 - protein, 18 aa, Mycobacterium
ITPPPLSKQIKLLERELG

SEQ ID NO: 1300274 - protein, 26 aa, Mycobacterium
ITQRHLRRLWGLPGTQLGVVAWPAAG

SEQ ID NO: 1300275 - protein, 25 aa, Mycobacterium
ITRARVHLTLSWALARAPGGRQGRR

SEQ ID NO: 1300276 - protein, 17 aa, Mycobacterium
ITRQALLDYVRNYNGQG

SEQ ID NO: 1300277 - protein, 29 aa, Mycobacterium
ITSNTYWDWVIDRIYLVLYGSAIATQFLE

SEQ ID NO: 1300278 - protein, 21 aa, Mycobacterium
ITVEYLKTRIQFGRPIGSFQA

SEQ ID NO: 1300279 - protein, 19 aa, Mycobacterium
ITVGLPRPDARISVSPLGF

SEQ ID NO: 1300280 - protein, 25 aa, Mycobacterium
ITVRGQRLLGRCPVCLYAGSIMPED

SEQ ID NO: 1300281 - protein, 25 aa, Mycobacterium
IVADLFQALNDIGFTIAAQGCTYWN

SEQ ID NO: 1300282 - protein, 18 aa, Mycobacterium
IVATDLFGRTLDVVETPT

SEQ ID NO: 1300283 - protein, 20 aa, Mycobacterium
IVDPDHRPQPPKDMLRNLFG

SEQ ID NO: 1300284 - protein, 27 aa, Mycobacterium
IVDSGLTLSWLLRNLATRQPRSLRVCT

SEQ ID NO: 1300285 - protein, 18 aa, Mycobacterium
IVEFLTDKWARELEYRLI

SEQ ID NO: 1300286 - protein, 17 aa, Mycobacterium
IVEPKYWGGVCLNVGCI

SEQ ID NO: 1300287 - protein, 18 aa, Mycobacterium
IVGAALFLMSNASSFTTG

SEQ ID NO: 1300288 - protein, 27 aa, Mycobacterium
IVGERHPHFLTALRKPVIAAINGSCVG

SEQ ID NO: 1300289 - protein, 20 aa, Mycobacterium
IVGPPMHHTLRSLGLGEQVD

SEQ ID NO: 1300290 - protein, 17 aa, Mycobacterium
IVGWIMRTDSSDLPWHR

SEQ ID NO: 1300291 - protein, 17 aa, Mycobacterium
IVILASGLDSRAYRLDW

SEQ ID NO: 1300292 - protein, 18 aa, Mycobacterium
IVIVATDAPLLPHQCTRL

SEQ ID NO: 1300293 - protein, 22 aa, Mycobacterium
IVKPTPEVPLIVNLPATVEMAT

SEQ ID NO: 1300294 - protein, 18 aa, Mycobacterium
IVNIWTAAAGPVADSFHR

SEQ ID NO: 1300295 - protein, 17 aa, Mycobacterium
IVPVFTRHDFSAPVSYV

SEQ ID NO: 1300296 - protein, 17 aa, Mycobacterium
IVPYLRDLTTAEQRDRW

SEQ ID NO: 1300297 - protein, 24 aa, Mycobacterium
IVQRERERMAFRTAGYWDVSAELD

SEQ ID NO: 1300298 - protein, 20 aa, Mycobacterium
IVRRLLGLEDALSIGFCGPT

SEQ ID NO: 1300299 - protein, 21 aa, Mycobacterium
IVSRIELAYAQFLDVTADVKQ

SEQ ID NO: 1300300 - protein, 19 aa, Mycobacterium
IWFTEILADKLGRIPLDGA

SEQ ID NO: 1300301 - protein, 17 aa, Mycobacterium
IWLAGHGWQVVGVDVSH

SEQ ID NO: 1300302 - protein, 27 aa, Mycobacterium
IWSPEAKIVAERRLWLAVLRAQIELGM

SEQ ID NO: 1300303 - protein, 18 aa, Mycobacterium
IWYRIRINLRHVPEEQRP

SEQ ID NO: 1300304 - protein, 21 aa, Mycobacterium
IYEPPRFFEAFLRGRAYTEPP

SEQ ID NO: 1300305 - protein, 21 aa, Mycobacterium
IYLNPLDWYTGNGIDLRAGVR

SEQ ID NO: 1300306 - protein, 19 aa, Mycobacterium
IYQQMYVPVPIETRGMVVE

SEQ ID NO: 1300307 - protein, 25 aa, Mycobacterium
IYRDVRLLRLYEGTSEIQRLIIGGA

SEQ ID NO: 1300308 - protein, 35 aa, Mycobacterium
IYTLTDEAPLLATYGFLPIIRTFAGAAGINVETSD

SEQ ID NO: 1300309 - protein, 33 aa, Mycobacterium
IYYSSAPIYHAAPLRWCSMVHALGGTVVLAKRF

SEQ ID NO: 1300310 - protein, 30 aa, Mycobacterium
KAAAESAGLPLFRYLGGPNAHILPVPMMNI

SEQ ID NO: 1300311 - protein, 31 aa, Mycobacterium
KAAELGLEPLVRLVSWGLAGVPPKVMGIGPV

SEQ ID NO: 1300312 - protein, 21 aa, Mycobacterium
KAAGAQLFSWTATTKQHFVRI

SEQ ID NO: 1300313 - protein, 23 aa, Mycobacterium
KAAGLFNAPASQVARLAAALQEK

SEQ ID NO: 1300314 - protein, 33 aa, Mycobacterium
KAAHFITVADSFHLPIVFLADNPGMLPGSRSER

SEQ ID NO: 1300315 - protein, 22 aa, Mycobacterium
KADFPRIDLLINNAGVMYPPKQ

SEQ ID NO: 1300316 - protein, 17 aa, Mycobacterium
KADLTFASLPYRIMHEF

SEQ ID NO: 1300317 - protein, 23 aa, Mycobacterium
KADVVFASHHWPTWGRDRITEYL

SEQ ID NO: 1300318 - protein, 24 aa, Mycobacterium
KAEELGLTWLAEIGAHGVVAGPDS

SEQ ID NO: 1300319 - protein, 24 aa, Mycobacterium
KAGSILCDPWVNPAYFASWVPFPD

SEQ ID NO: 1300320 - protein, 25 aa, Mycobacterium
KAGVSNPYLSQIERGLRKPSADVLN

SEQ ID NO: 1300321 - protein, 21 aa, Mycobacterium
KAKIFLALLGKQYGVTPQGWR

SEQ ID NO: 1300322 - protein, 24 aa, Mycobacterium
KALEALTRSLALELGPRGIRVNSI

SEQ ID NO: 1300323 - protein, 17 aa, Mycobacterium
KALLRRSGRVLQSAPDI

SEQ ID NO: 1300324 - protein, 18 aa, Mycobacterium
KALRERVFRIYNEHIADL

SEQ ID NO: 1300325 - protein, 26 aa, Mycobacterium
KAPFFGDRRKAFLDDLAVVTGGQVIN

SEQ ID NO: 1300326 - protein, 24 aa, Mycobacterium
KAQDALSLALHLRGFNEDEKRSIV

SEQ ID NO: 1300327 - protein, 27 aa, Mycobacterium
KAQQQAFLFGPPPLGPGAPPLERLLAY

SEQ ID NO: 1300328 - protein, 24 aa, Mycobacterium
KAQRGVMELLLINHPLDCPVCDKG

SEQ ID NO: 1300329 - protein, 23 aa, Mycobacterium
KARDLGLTPLARIVATGVSGLSP

SEQ ID NO: 1300330 - protein, 31 aa, Mycobacterium
KARKAGRRFAQLAPIVATYRKLEAARGDLEA

SEQ ID NO: 1300331 - protein, 17 aa, Mycobacterium
KARTFMPYVAGCGEYRR

SEQ ID NO: 1300332 - protein, 26 aa, Mycobacterium
KAVAEYGLWYPPDPSSYEICSIGGNV

SEQ ID NO: 1300333 - protein, 20 aa, Mycobacterium
KAVKTQLLMDALADQLEVQV

SEQ ID NO: 1300334 - protein, 43 aa, Mycobacterium
KAVTRAYHLYAIPRFVNRWAVSLAYLTDVFFARSVVSIGLSSA

SEQ ID NO: 1300335 - protein, 29 aa, Mycobacterium
KAWEHGRFGAPYLRDSLLSAGALCETLET

SEQ ID NO: 1300336 - protein, 25 aa, Mycobacterium
KAYDAEPFIHLLPEGQLPKTGSVIG

SEQ ID NO: 1300337 - protein, 27 aa, Mycobacterium
KAYSAAWQVPFYGVNHLGGHLAADVYD

SEQ ID NO: 1300338 - protein, 23 aa, Mycobacterium
KDAADLTLFLLDQDGPEPDDTER

SEQ ID NO: 1300339 - protein, 25 aa, Mycobacterium
KDAEVWDRLTGNFWLPEKVPVSNDI

SEQ ID NO: 1300340 - protein, 22 aa, Mycobacterium
KDARFDGWFVTAVLTTRIYCRP

SEQ ID NO: 1300341 - protein, 30 aa, Mycobacterium
KDDCAAIGLVKFDMLGLGMLSALHYCIDLV

SEQ ID NO: 1300342 - protein, 19 aa, Mycobacterium
KDDLLVASLHRWLSACETD

SEQ ID NO: 1300343 - protein, 27 aa, Mycobacterium
KDECLDYALAHDERFGIWGGLSERERR

SEQ ID NO: 1300344 - protein, 23 aa, Mycobacterium
KDEIRAYLGKLAEKPLTVKLHRL

SEQ ID NO: 1300345 - protein, 26 aa, Mycobacterium
KDGDRLVFDYGRTAEQLPGFFNCTMS

SEQ ID NO: 1300346 - protein, 34 aa, Mycobacterium
KDGHSRYYLDDRGLLRLLPGARALLERIKELGLQ

SEQ ID NO: 1300347 - protein, 24 aa, Mycobacterium
KDLDEIGFFKLLQPQQWGGMQCDP

SEQ ID NO: 1300348 - protein, 22 aa, Mycobacterium
KDLGLVLSYLTGRKLTLDEVLA

SEQ ID NO: 1300349 - protein, 26 aa, Mycobacterium
KDLIDRPMEFLGNLVLLIVGGNDTTR

SEQ ID NO: 1300350 - protein, 18 aa, Mycobacterium
KDLRRNFVPAPDTARAVL

SEQ ID NO: 1300351 - protein, 27 aa, Mycobacterium
KDPSASLWLARLWKEAGLPDGVFNVLQ

SEQ ID NO: 1300352 - protein, 25 aa, Mycobacterium
KDRDAVLRRAPWVDVVFGTHNIGSL

SEQ ID NO: 1300353 - protein, 24 aa, Mycobacterium
KDRDRWQFIPFAGGPRACIGQHFA

SEQ ID NO: 1300354 - protein, 21 aa, Mycobacterium
KDRIPVWKHQFFGDGSDEWVN

SEQ ID NO: 1300355 - protein, 27 aa, Mycobacterium
KDRLFDLIERMRLPTVFFAEGGGGRPG

SEQ ID NO: 1300356 - protein, 24 aa, Mycobacterium
KDRRGFLKERLFSKGAPGPVEAFK

SEQ ID NO: 1300357 - protein, 24 aa, Mycobacterium
KDRSVQLWQNIFGDGFKAPATTTA

SEQ ID NO: 1300358 - protein, 17 aa, Mycobacterium
KDTPELMPLPIALAHRL

SEQ ID NO: 1300359 - protein, 22 aa, Mycobacterium
KDVDLGWYQLPKGSLGGNYIKY

SEQ ID NO: 1300360 - protein, 23 aa, Mycobacterium
KDWTPVQHQIWLDEMQLACVPEP

SEQ ID NO: 1300361 - protein, 17 aa, Mycobacterium
KEAAFQYAWVLATADPE

SEQ ID NO: 1300362 - protein, 25 aa, Mycobacterium
KEAMLVELLVGISTRLLAGAREVLT

SEQ ID NO: 1300363 - protein, 23 aa, Mycobacterium
KEGRGIVMRVPLEGGGRLVVELT

SEQ ID NO: 1300364 - protein, 27 aa, Mycobacterium
KEIGDLPILFQPGVLSIAWGTAIRQLA

SEQ ID NO: 1300365 - protein, 20 aa, Mycobacterium
KEIGQFQLIQLKLASMEVAR

SEQ ID NO: 1300366 - protein, 29 aa, Mycobacterium
KEIQSRLGFLLDVGLDYLSLSRAAATLSG

SEQ ID NO: 1300367 - protein, 26 aa, Mycobacterium
KELCATFDGFYTLLVSNRDSFAVVRD

SEQ ID NO: 1300368 - protein, 29 aa, Mycobacterium
KELGAMGFKFQFITLAGFHALNYSMFDLA

SEQ ID NO: 1300369 - protein, 24 aa, Mycobacterium
KELLTRRAGLLSGGQRQQLAIARA

SEQ ID NO: 1300370 - protein, 26 aa, Mycobacterium
KEMAIFLTHYLGFPLGSKLDGVVTKV

SEQ ID NO: 1300371 - protein, 25 aa, Mycobacterium
KESDPRYMPFQSLRGKDFTSMVSVP

SEQ ID NO: 1300372 - protein, 32 aa, Mycobacterium
KEWAAKAGGTSGVLWGALLSALGTRLGDTGRP

SEQ ID NO: 1300373 - protein, 23 aa, Mycobacterium
KEYVGYVVQKRFNLSWSIEGTRS

SEQ ID NO: 1300374 - protein, 20 aa, Mycobacterium
KFATSFARRGLIAEYGISWI

SEQ ID NO: 1300375 - protein, 21 aa, Mycobacterium
KFAVFAGLLGGCAYPDAALAK

SEQ ID NO: 1300376 - protein, 34 aa, Mycobacterium
KFFSPGRIRRTLTVARLLAPIAVPLVYRASVAAR

SEQ ID NO: 1300377 - protein, 18 aa, Mycobacterium
KFHGGLTQWMEPTMSSAV

SEQ ID NO: 1300378 - protein, 24 aa, Mycobacterium
KGAIYKYFATKEELFLAASDRYWR

SEQ ID NO: 1300379 - protein, 26 aa, Mycobacterium
KGANRTFLVPAVLAKVLETGPDAVKL

SEQ ID NO: 1300380 - protein, 29 aa, Mycobacterium
KGAPHAHDVLALLAAQRSGGRPVKLALTR

SEQ ID NO: 1300381 - protein, 22 aa, Mycobacterium
KGFEGRTLIKDLSFTLPRNGIV

SEQ ID NO: 1300382 - protein, 18 aa, Mycobacterium
KGFKSFAAPTTLRFEPGI

SEQ ID NO: 1300383 - protein, 23 aa, Mycobacterium
KGFYSNGIPPRVAVEAAIEVVEA

SEQ ID NO: 1300384 - protein, 22 aa, Mycobacterium
KGHDGKPVVLFLCTHNAGRSQM

SEQ ID NO: 1300385 - protein, 20 aa, Mycobacterium
KGIDIMRTVRSFDPCLPCGV

SEQ ID NO: 1300386 - protein, 17 aa, Mycobacterium
KGKRYALPHARILMHQP

SEQ ID NO: 1300387 - protein, 29 aa, Mycobacterium
KGMLTTPQLRAFYLDLQDERLTSALGIVH

SEQ ID NO: 1300388 - protein, 18 aa, Mycobacterium
KGNRHFSFGLGVHRCIGS

SEQ ID NO: 1300389 - protein, 25 aa, Mycobacterium
KGPNGISYSPRPPAAGASDIALNLT

SEQ ID NO: 1300390 - protein, 22 aa, Mycobacterium
KGRAKVLARYAVWLGEHRAEIE

SEQ ID NO: 1300391 - protein, 23 aa, Mycobacterium
KGRHYTMLLTPGGEFHTHRGMIA

SEQ ID NO: 1300392 - protein, 26 aa, Mycobacterium
KGRLTLPAKFRDALAGGLMVTKSQDH

SEQ ID NO: 1300393 - protein, 20 aa, Mycobacterium
KGRQVEFFAAALGGPEPYTG

SEQ ID NO: 1300394 - protein, 20 aa, Mycobacterium
KGRRYLVQTSRIAYVEIGAA

SEQ ID NO: 1300395 - protein, 36 aa, Mycobacterium
KGSALVPSWVAFAVIGLLEQHFGRLVDYGFTAAMED

SEQ ID NO: 1300396 - protein, 36 aa, Mycobacterium; identical to SEQ ID NO: 828922

SEQ ID NO: 1300397 - protein, 22 aa, Mycobacterium
KGTVAVRYRDRARRYVVNVVGP

SEQ ID NO: 1300398 - protein, 18 aa, Mycobacterium
KGTWSTFLPPGRGDAEAL

SEQ ID NO: 1300399 - protein, 20 aa, Mycobacterium
KGYFPVPALTHLEGPYLDMV

SEQ ID NO: 1300400 - protein, 19 aa, Mycobacterium
KGYILVVSSLAAFAAAPGM

SEQ ID NO: 1300401 - protein, 21 aa, Mycobacterium
KHAPEYFSLDDWGYASLIGNG

SEQ ID NO: 1300402 - protein, 26 aa, Mycobacterium
KHDVEFFNEFYALDITLTETPGGPVA

SEQ ID NO: 1300403 - protein, 27 aa, Mycobacterium
KHSVGVWSATPPPAGWRLLDTAVEQAQ

SEQ ID NO: 1300404 - protein, 21 aa, Mycobacterium
KHVAGVDTFFIASAPSYSFVS

SEQ ID NO: 1300405 - protein, 18 aa, Mycobacterium
KHYWSIYQKMIVKGRDFD

SEQ ID NO: 1300406 - protein, 24 aa, Mycobacterium
KIADYPFTTLVPNLGVVSAGDHTF

SEQ ID NO: 1300407 - protein, 23 aa, Mycobacterium
KIAVASRVPGLNAKGACIGPMGQ

SEQ ID NO: 1300408 - protein, 24 aa, Mycobacterium
KIAVSRWVRRHAIRPEWAGAGIRL

SEQ ID NO: 1300409 - protein, 22 aa, Mycobacterium
KIDLSLGKLGLKPGMTLLDIGC

SEQ ID NO: 1300410 - protein, 17 aa, Mycobacterium
KIGLGVGLSLAGASSPP

SEQ ID NO: 1300411 - protein, 19 aa, Mycobacterium
KITGLTDFIELFSTLDAAL

SEQ ID NO: 1300412 - protein, 26 aa, Mycobacterium
KIVAADILVIATPTWVGHMSSVAQRV

SEQ ID NO: 1300413 - protein, 18 aa, Mycobacterium
KIVPAPVTFVDIAGIVKG

SEQ ID NO: 1300414 - protein, 21 aa, Mycobacterium
KIVRALLTGYLLHELTGDKAY

SEQ ID NO: 1300415 - protein, 25 aa, Mycobacterium
KIYLQEWHYFFENTRRWRDLRKITI

SEQ ID NO: 1300416 - protein, 21 aa, Mycobacterium
KIYVRFPEAVSMRQYLGEPGG

SEQ ID NO: 1300417 - protein, 29 aa, Mycobacterium
KKTIEFYLTAVFNVMRLTAAAIAKSEPLE

SEQ ID NO: 1300418 - protein, 19 aa, Mycobacterium
KLAEKLWQLRILDGERSAA

SEQ ID NO: 1300419 - protein, 26 aa, Mycobacterium
KLAELQRLWLIEAVKYDVLPIDDRSY

SEQ ID NO: 1300420 - protein, 17 aa, Mycobacterium
KLALLATALADALRARD

SEQ ID NO: 1300421 - protein, 25 aa, Mycobacterium
KLDKFTPKIGYPVRWKDYSQLVIRR

SEQ ID NO: 1300422 - protein, 27 aa, Mycobacterium
KLDPGLIDELPLPRPKFEIFVYSPRVE

SEQ ID NO: 1300423 - protein, 22 aa, Mycobacterium
KLDPRQWTFLNTDLVVHVHRIP

SEQ ID NO: 1300424 - protein, 34 aa, Mycobacterium
KLEKTWRFIRTAYRLLPERISYTPLAYHARRHHE

SEQ ID NO: 1300425 - protein, 30 aa, Mycobacterium
KLFDAVFNLNVKGPFRLAALIGERMVADGG

SEQ ID NO: 1300426 - protein, 25 aa, Mycobacterium
KLGEALQIILPMLEGERPTVEGKYY

SEQ ID NO: 1300427 - protein, 19 aa, Mycobacterium
KLGFGTYGFGLEGAGPMYG

SEQ ID NO: 1300428 - protein, 26 aa, Mycobacterium
KLIAAAGWHAWRPAHLHVKVSAPGHE

SEQ ID NO: 1300429 - protein, 19 aa, Mycobacterium
KLLDIRVNVGRTGRVTPFA

SEQ ID NO: 1300430 - protein, 17 aa, Mycobacterium
KLLLDPYGKSFYGDFRF

SEQ ID NO: 1300431 - protein, 20 aa, Mycobacterium
KLMDTFAAYTAFTMDVIAKR

SEQ ID NO: 1300432 - protein, 20 aa, Mycobacterium
KLPDLVVCRPELAEAVLAVT

SEQ ID NO: 1300433 - protein, 17 aa, Mycobacterium
KLPFLEVYVSTPVEECE

SEQ ID NO: 1300434 - protein, 34 aa, Mycobacterium
KLRKKRLMTLVHLWLVHRFKADAVYYVTPTDDNV

SEQ ID NO: 1300435 - protein, 21 aa, Mycobacterium
KLSTKFTRLTGRSPILLAGMT

SEQ ID NO: 1300436 - protein, 22 aa, Mycobacterium
KLTFELARFVKFMITEIFPGGR

SEQ ID NO: 1300437 - protein, 19 aa, Mycobacterium
KLTPGRELGWPYCNIDGGP

SEQ ID NO: 1300438 - protein, 25 aa, Mycobacterium
KLVDVGLLRFRFLQPAEARVGRPPK

SEQ ID NO: 1300439 - protein, 18 aa, Mycobacterium
KLVPYAKRTPRLARTRAW

SEQ ID NO: 1300440 - protein, 20 aa, Mycobacterium
KMARKRMRALKYSKQMVDDV

SEQ ID NO: 1300441 - protein, 19 aa, Mycobacterium
KMNLNHFEAIALVQKIAFS

SEQ ID NO: 1300442 - protein, 26 aa, Mycobacterium
KMPAVFFVNWFRRGDDGRFLWPGFGE

SEQ ID NO: 1300443 - protein, 21 aa, Mycobacterium
KMPRRFYCRAKWHHSELDSET

SEQ ID NO: 1300444 - protein, 31 aa, Mycobacterium
KMPSQRGWRHVLYLLTRINLGLSPDEMYEMD

SEQ ID NO: 1300445 - protein, 23 aa, Mycobacterium
KMRHKLAMLASGKFSPEALRVLV

SEQ ID NO: 1300446 - protein, 23 aa, Mycobacterium
KMRRLRGRFYDGMRQRHGITGEV

SEQ ID NO: 1300447 - protein, 25 aa, Mycobacterium
KNAERFGMQDAIWRGVYYTPNGPRG

SEQ ID NO: 1300448 - protein, 17 aa, Mycobacterium
KNDPVLMAMPKLVEPYA

SEQ ID NO: 1300449 - protein, 26 aa, Mycobacterium
KNEDPDVLFLAEAFTRPARLYGLAKL

SEQ ID NO: 1300450 - protein, 30 aa, Mycobacterium
KNEPEWMLDIRLRALRTFDKKPMPNWGSNL

SEQ ID NO: 1300451 - protein, 19 aa, Mycobacterium
KNYLYLAERAGTEVHPLTT

SEQ ID NO: 1300452 - protein, 21 aa, Mycobacterium
KPAGALYAFPRLDPEVYEIHD

SEQ ID NO: 1300453 - protein, 18 aa, Mycobacterium
KPEEMAELLAFCAGDRAG

SEQ ID NO: 1300454 - protein, 25 aa, Mycobacterium
KPERLRSGWLNGIKHWQVDYTGSAA

SEQ ID NO: 1300455 - protein, 19 aa, Mycobacterium
KPFALEELLARMRALLRRT

SEQ ID NO: 1300456 - protein, 20 aa, Mycobacterium
KPGNNLPLRNIPAGTVIHAV

SEQ ID NO: 1300457 - protein, 19 aa, Mycobacterium
KPLVVPRALEVEDIPRIVA

SEQ ID NO: 1300458 - protein, 21 aa, Mycobacterium
KPRELRRLKALLRRSGRVLQS

SEQ ID NO: 1300459 - protein, 21 aa, Mycobacterium
KPRPHLATSFWFALGDRDEAR

SEQ ID NO: 1300460 - protein, 27 aa, Mycobacterium
KPSAAFLWEDKGVVPFLKIDKGLAEAS

SEQ ID NO: 1300461 - protein, 36 aa, Mycobacterium
KPSVDEPFSALAFKIAVHPFFGKLTYVRVYSGTVES

SEQ ID NO: 1300462 - protein, 23 aa, Mycobacterium
KPVHTPDAGAFWRVAAEYGVKAL

SEQ ID NO: 1300463 - protein, 19 aa, Mycobacterium
KPVIIPAITAFIDAKHWDS

SEQ ID NO: 1300464 - protein, 28 aa, Mycobacterium
KQAETLSFFPLWSYATPPAIELAERIAN

SEQ ID NO: 1300465 - protein, 25 aa, Mycobacterium
KQLAAAPFADILWMETKTADLADAR

SEQ ID NO: 1300466 - protein, 18 aa, Mycobacterium
KQMELIIPVFSSNDAKEG

SEQ ID NO: 1300467 - protein, 18 aa, Mycobacterium
KQQWLPGIASGETIMAFA

SEQ ID NO: 1300468 - protein, 19 aa, Mycobacterium
KQRDTVRIAALRSALAAVD

SEQ ID NO: 1300469 - protein, 20 aa, Mycobacterium
KQVFFVDTLPKNPSGKLLKR

SEQ ID NO: 1300470 - protein, 18 aa, Mycobacterium
KRAFKDRLYTEFARIGKA

SEQ ID NO: 1300471 - protein, 26 aa, Mycobacterium
KRDDLQTVISLLKQADLEVALQFVNY

SEQ ID NO: 1300472 - protein, 25 aa, Mycobacterium
KRFSMPWSHPVGRMREFVAALREIW

SEQ ID NO: 1300473 - protein, 26 aa, Mycobacterium
KRGGKVWINIFPDRPLTKKPAETRMG

SEQ ID NO: 1300474 - protein, 21 aa, Mycobacterium
KRGWPVLRFSSRSGSSPLSQL

SEQ ID NO: 1300475 - protein, 20 aa, Mycobacterium
KRIAVVFSAYPTKHARIGNA

SEQ ID NO: 1300476 - protein, 17 aa, Mycobacterium
KRIKLDAHIRLANPRTA

SEQ ID NO: 1300477 - protein, 22 aa, Mycobacterium
KRIRVPVLVQIADFDRFVPAES

SEQ ID NO: 1300478 - protein, 21 aa, Mycobacterium
KRLLRGLRAVGRGVLRPDLTV

SEQ ID NO: 1300479 - protein, 24 aa, Mycobacterium
KRLPDALTRFPIARLVSSPQRRAV

SEQ ID NO: 1300480 - protein, 19 aa, Mycobacterium
KRMLLAQKSYVEGALALAL

SEQ ID NO: 1300481 - protein, 26 aa, Mycobacterium
KRRVETLRMRIDIGRTVCATLRSETE

SEQ ID NO: 1300482 - protein, 26 aa, Mycobacterium
KRSRGQVWLMPHNPAFEPIPGNDAAV

SEQ ID NO: 1300483 - protein, 22 aa, Mycobacterium
KRYALPHARILMHQPLGGITGG

SEQ ID NO: 1300484 - protein, 23 aa, Mycobacterium
KSATFAVHAPYAYGTLSVEQGTH

SEQ ID NO: 1300485 - protein, 23 aa, Mycobacterium
KSDILAGAFRRSADRWSAEMSAI

SEQ ID NO: 1300486 - protein, 26 aa, Mycobacterium
KSFHGVPVLKGITLNLQPGTVTALAG

SEQ ID NO: 1300487 - protein, 18 aa, Mycobacterium
KSFTAPTTPGTYPFHCKY

SEQ ID NO: 1300488 - protein, 23 aa, Mycobacterium
KSGTLRHKLLGRGDRLPDSHPAA

SEQ ID NO: 1300489 - protein, 20 aa, Mycobacterium
KSLAYLVPAIAHAIAVDEPV

SEQ ID NO: 1300490 - protein, 35 aa, Mycobacterium
KSMPVPMLTFRLWRPLSHDTMEVWSWFLVEKDADE

SEQ ID NO: 1300491 - protein, 17 aa, Mycobacterium
KSNILMLGPTGCGKTYL

SEQ ID NO: 1300492 - protein, 20 aa, Mycobacterium
KSQWYFQRYVQHLPTAGEMV

SEQ ID NO: 1300493 - protein, 25 aa, Mycobacterium
KSRTYPLFQHPGTEFIYMLEGVMDY

SEQ ID NO: 1300494 - protein, 26 aa, Mycobacterium
KSSLLDAISLGFLPFNRRNFNASGDN

SEQ ID NO: 1300495 - protein, 21 aa, Mycobacterium
KSTHFDWVLAPYDIAASKAHA

SEQ ID NO: 1300496 - protein, 22 aa, Mycobacterium
KSTLLRVIAGLEPPTSGFVDLA

SEQ ID NO: 1300497 - protein, 23 aa, Mycobacterium
KSVRALLRHPDRPDRLLACRNGD

SEQ ID NO: 1300498 - protein, 35 aa, Mycobacterium; identical to SEQ ID NO: 783263

SEQ ID NO: 1300499 - protein, 23 aa, Mycobacterium
KTGEWYLHHFYKHQPDLNIANPK

SEQ ID NO: 1300500 - protein, 27 aa, Mycobacterium
KTHPLWIVRRTMIDLIRPIEFQDMLRL

SEQ ID NO: 1300501 - protein, 34 aa, Mycobacterium
KTIDRINSLVIPPAWKKVWICPYPNGHIQAVGTD

SEQ ID NO: 1300502 - protein, 35 aa, Mycobacterium
KTLDLSFMESVIWAFKQLWDKGLAYQGVRVLPYCW

SEQ ID NO: 1300503 - protein, 20 aa, Mycobacterium
KTLGVPLFQEQLMQLAVDCA

SEQ ID NO: 1300504 - protein, 21 aa, Mycobacterium
KTLHSVKVIPGRGAWLEFDVD

SEQ ID NO: 1300505 - protein, 19 aa, Mycobacterium
KTLPGLRALQKYAVRVGGG

SEQ ID NO: 1300506 - protein, 22 aa, Mycobacterium
KTLPPKWFYDSVGSDLFDQITR

SEQ ID NO: 1300507 - protein, 23 aa, Mycobacterium
KTLTCVLPAYLNALSGKGVHVVT

SEQ ID NO: 1300508 - protein, 19 aa, Mycobacterium
KTLVAVEYYFKMPADLEER

SEQ ID NO: 1300509 - protein, 28 aa, Mycobacterium
KTTLAGKLAKWLRGQGHTPLLVACDLQR

SEQ ID NO: 1300510 - protein, 25 aa, Mycobacterium
KTTLLQVVLGLLPPSTGRVEVFGRP

SEQ ID NO: 1300511 - protein, 18 aa, Mycobacterium
KTTLLRLIAGFETPDSGT

SEQ ID NO: 1300512 - protein, 24 aa, Mycobacterium
KTTTTERILYYTGVNYKIGETHDG

SEQ ID NO: 1300513 - protein, 24 aa, Mycobacterium
KTVPPQWLPGPRELRAWTLASGTR

SEQ ID NO: 1300514 - protein, 24 aa, Mycobacterium
KVAIARDFLLPRQRERAALTTDEV

SEQ ID NO: 1300515 - protein, 23 aa, Mycobacterium
KVAKIRFPTPAVCGRTPLVGKGL

SEQ ID NO: 1300516 - protein, 24 aa, Mycobacterium
KVDEIANTLPQPIKDRGSLIVGVN

SEQ ID NO: 1300517 - protein, 17 aa, Mycobacterium
KVDIWGRRRLAYEIAKH

SEQ ID NO: 1300518 - protein, 23 aa, Mycobacterium
KVDNRVSLMLPYLPVDKADPEEQ

SEQ ID NO: 1300519 - protein, 20 aa, Mycobacterium
KVELIAVHAWSDPTIYAFPN

SEQ ID NO: 1300520 - protein, 22 aa, Mycobacterium
KVGQISAIIRRLRRPDPYKGKG

SEQ ID NO: 1300521 - protein, 22 aa, Mycobacterium
KVGTRFPGFPDASITSSYAGCY

SEQ ID NO: 1300522 - protein, 23 aa, Mycobacterium
KVIDRTALILDIFAQHATSREGK

SEQ ID NO: 1300523 - protein, 19 aa, Mycobacterium
KVIFFRGQHHLDDDGQLAF

SEQ ID NO: 1300524 - protein, 17 aa, Mycobacterium
KVMPIISSLLNQYPHLL

SEQ ID NO: 1300525 - protein, 21 aa, Mycobacterium
KVNYALDAPIPWRSKNLNEVG

SEQ ID NO: 1300526 - protein, 23 aa, Mycobacterium
KVPDLLKRDFTAPAPNEKYVGDI

SEQ ID NO: 1300527 - protein, 34 aa, Mycobacterium; identical to SEQ ID NO: 830272

SEQ ID NO: 1300528 - protein, 19 aa, Mycobacterium
KVRAQLRDEIRRVQLEVGT

SEQ ID NO: 1300529 - protein, 23 aa, Mycobacterium
KVRPGVDVLFLDTGYHFAETIGT

SEQ ID NO: 1300530 - protein, 20 aa, Mycobacterium
KVRTEPPHEGARYTQIAVLE

SEQ ID NO: 1300531 - protein, 28 aa, Mycobacterium
KVSSLPDLLPLLEKVAEAGKPLLIIAED

SEQ ID NO: 1300532 - protein, 19 aa, Mycobacterium
KVTRILLTSGKIYYELVAR

SEQ ID NO: 1300533 - protein, 23 aa, Mycobacterium
KVVKGGRRFSFTALVIVGDGNGM

SEQ ID NO: 1300534 - protein, 24 aa, Mycobacterium
KVVSWYDNEWGYSNRLVDLVALVG

SEQ ID NO: 1300535 - protein, 18 aa, Mycobacterium
KWELEDLSFAILHPKKYD

SEQ ID NO: 1300536 - protein, 32 aa, Mycobacterium
KWYSRLAITELLIEALKRLNMSWPPPDFDVKA

SEQ ID NO: 1300537 - protein, 28 aa, Mycobacterium
KYAKLPVSPIGFIPTRYYVNMNVADRPG

SEQ ID NO: 1300538 - protein, 24 aa, Mycobacterium
KYPEWDGKRKAYRPDWCTVREVEA

SEQ ID NO: 1300539 - protein, 18 aa, Mycobacterium
KYVHLGNHTLRGTLPPRL

SEQ ID NO: 1300540 - protein, 20 aa, Mycobacterium
LAAAHRDLIPLLTGDPGVVA

SEQ ID NO: 1300541 - protein, 24 aa, Mycobacterium
LAAELVGRNVLYGRWTFQIVEDFD

SEQ ID NO: 1300542 - protein, 25 aa, Mycobacterium
LAAGHLTLVPALRDALAAVGRPDIM

SEQ ID NO: 1300543 - protein, 28 aa, Mycobacterium
LAAHGARWRPWRAYATQHLWTALDHPVN

SEQ ID NO: 1300544 - protein, 21 aa, Mycobacterium
LAAIKRPGSFLARQVPQFLRL

SEQ ID NO: 1300545 - protein, 20 aa, Mycobacterium
LAALKAGPAVALRKTKQAIN

SEQ ID NO: 1300546 - protein, 20 aa, Mycobacterium
LAALPPGCPFAPRCPLAIDE

SEQ ID NO: 1300547 - protein, 24 aa, Mycobacterium
LAALRAHFTLVPDSKPRGSAPAQL

SEQ ID NO: 1300548 - protein, 20 aa, Mycobacterium
LAARPVGVPAVVVPPAAGPE

SEQ ID NO: 1300549 - protein, 21 aa, Mycobacterium
LAAWLSEHSLGNRFGLAVVGT

SEQ ID NO: 1300550 - protein, 18 aa, Mycobacterium
LACLRGCGLVVAVPEGRR

SEQ ID NO: 1300551 - protein, 24 aa, Mycobacterium
LADHALAWRRALDTTVLSAVLTVQ

SEQ ID NO: 1300552 - protein, 21 aa, Mycobacterium
LADQPLDWRYKGLPAEWWGAT

SEQ ID NO: 1300553 - protein, 18 aa, Mycobacterium
LADRFGFQVIGAIVPSGT

SEQ ID NO: 1300554 - protein, 22 aa, Mycobacterium
LADSAAFRAPLPMGGDPADRDE

SEQ ID NO: 1300555 - protein, 19 aa, Mycobacterium
LADVTYLCRAVADEDWLSR

SEQ ID NO: 1300556 - protein, 24 aa, Mycobacterium
LAEAGLDWRQIQLVAGADTIRNGY

SEQ ID NO: 1300557 - protein, 20 aa, Mycobacterium
LAEAIPRRRADRRPYRAQPL

SEQ ID NO: 1300558 - protein, 25 aa, Mycobacterium
LAEAKALFQMKFYAVALLRSRGVLP

SEQ ID NO: 1300559 - protein, 19 aa, Mycobacterium
LAEALRLLRRSPGMEQAKA

SEQ ID NO: 1300560 - protein, 25 aa, Mycobacterium
LAEILGHIASLPLDRSRPLWEKWII

SEQ ID NO: 1300561 - protein, 25 aa, Mycobacterium
LAELQLRILWEELLPRFENIEVVGE

SEQ ID NO: 1300562 - protein, 31 aa, Mycobacterium
LAELREYIDWQPFFNAWEMKGRFPDILNNPV

SEQ ID NO: 1300563 - protein, 17 aa, Mycobacterium
LAESIRAWPDQAGLARR

SEQ ID NO: 1300564 - protein, 29 aa, Mycobacterium
LAFGQFEFVSRQWFRRGWQVEREVLLETL

SEQ ID NO: 1300565 - protein, 24 aa, Mycobacterium
LAGENLILLDLPPSGRHTLDLLSA

SEQ ID NO: 1300566 - protein, 17 aa, Mycobacterium
LAGGCFWGMQDLIRKQP

SEQ ID NO: 1300567 - protein, 19 aa, Mycobacterium
LAGHPIGNLMLAGLSEVLA

SEQ ID NO: 1300568 - protein, 17 aa, Mycobacterium
LAGLSDMLAECTELSFL

SEQ ID NO: 1300569 - protein, 25 aa, Mycobacterium
LAGQAQFDPMPLLDSLIVELDERGG

SEQ ID NO: 1300570 - protein, 25 aa, Mycobacterium
LAGRPLTVLRVLRGQAPFMQKNAPK

SEQ ID NO: 1300571 - protein, 17 aa, Mycobacterium
LAHFGLDGFFEVIAGAS

SEQ ID NO: 1300572 - protein, 29 aa, Mycobacterium
LAHHSFHVFVVYPWARFLDRDPTTPIRIM

SEQ ID NO: 1300573 - protein, 19 aa, Mycobacterium
LAHRDVVYVVASPLERAQE

SEQ ID NO: 1300574 - protein, 20 aa, Mycobacterium
LAICERYLRDAPARIVLAAL

SEQ ID NO: 1300575 - protein, 23 aa, Mycobacterium
LAIGHYFKRLTALQYEFGSTDHH

SEQ ID NO: 1300576 - protein, 24 aa, Mycobacterium
LAIPELPEELFLESLRQLIAIDEQ

SEQ ID NO: 1300577 - protein, 20 aa, Mycobacterium
LAIVDAFLATPWSKAERHQR

SEQ ID NO: 1300578 - protein, 21 aa, Mycobacterium
LAKCGPWHRGGWDPIPERPDA

SEQ ID NO: 1300579 - protein, 19 aa, Mycobacterium
LAKRLGLERFRSDILPISV

SEQ ID NO: 1300580 - protein, 25 aa, Mycobacterium
LAKRQPLLIVSSDLRRALDTAVALG

SEQ ID NO: 1300581 - protein, 26 aa, Mycobacterium
LALAAGVNLLLSPAVFHGFDQAGALS

SEQ ID NO: 1300582 - protein, 18 aa, Mycobacterium
LALCQATRQVIANGLAIL

SEQ ID NO: 1300583 - protein, 19 aa, Mycobacterium
LALDILGAIPVAPVLVRSE

SEQ ID NO: 1300584 - protein, 21 aa, Mycobacterium
LALPNARILIHQPALSGVIQG

SEQ ID NO: 1300585 - protein, 30 aa, Mycobacterium
LALRADGITAPVLAWLHGPGTDFAPAVQAD

SEQ ID NO: 1300586 - protein, 25 aa, Mycobacterium
LALRDRLIVEMLYATGIRVSELCGL

SEQ ID NO: 1300587 - protein, 37 aa, Mycobacterium
LALTKSLEIHPIRRNIQHADLLVVRRGEKVTVEVNVV

SEQ ID NO: 1300588 - protein, 20 aa, Mycobacterium
LALTTRIKPFTYVSTIGVGA

SEQ ID NO: 1300589 - protein, 19 aa, Mycobacterium
LAMDYTRDFDAPVAALFRA

SEQ ID NO: 1300590 - protein, 19 aa, Mycobacterium
LANIALLRRPEHLDEPTWR

SEQ ID NO: 1300591 - protein, 30 aa, Mycobacterium
LAPELFAGFLAQVPFVDPLTTILDPSLPLT

SEQ ID NO: 1300592 - protein, 24 aa, Mycobacterium
LAPGDALYLPRGWVHSAHALDTTS

SEQ ID NO: 1300593 - protein, 22 aa, Mycobacterium
LAPNSSAFAIAFHGILRAGATA

SEQ ID NO: 1300594 - protein, 26 aa, Mycobacterium
LAPPERSAMFLSELADLVLEREEVLL

SEQ ID NO: 1300595 - protein, 23 aa, Mycobacterium
LAQDRAWLGAAEKRIAGGTPAVR

SEQ ID NO: 1300596 - protein, 18 aa, Mycobacterium
LAQILGAPRIAERFADLT

SEQ ID NO: 1300597 - protein, 20 aa, Mycobacterium
LAQNPQLLKHRRGVGTGYYN

SEQ ID NO: 1300598 - protein, 18 aa, Mycobacterium
LAQSRFGQRLRPDGIRLT

SEQ ID NO: 1300599 - protein, 18 aa, Mycobacterium
LAREPDLMLLDEPFSALD

SEQ ID NO: 1300600 - protein, 23 aa, Mycobacterium
LARFGSWYEFFPRSTGGWDSQGH

SEQ ID NO: 1300601 - protein, 20 aa, Mycobacterium
LARHAGRIPKRFWAQASSPA

SEQ ID NO: 1300602 - protein, 24 aa, Mycobacterium
LARLELRLMLTKVLDRLPDLRLAD

SEQ ID NO: 1300603 - protein, 19 aa, Mycobacterium
LARLERWSVVLRGRGACGT

SEQ ID NO: 1300604 - protein, 26 aa, Mycobacterium
LARLKSVPILLAPPWGLVVSDLIPRL

SEQ ID NO: 1300605 - protein, 17 aa, Mycobacterium
LARLPVGEWIGVQADSH

SEQ ID NO: 1300606 - protein, 17 aa, Mycobacterium
LARLWSTALANLVDIGY

SEQ ID NO: 1300607 - protein, 17 aa, Mycobacterium
LARMTIDLMFNAIADHM

SEQ ID NO: 1300608 - protein, 25 aa, Mycobacterium
LARRDLVPLGYLGDAAKTAKTFPTI

SEQ ID NO: 1300609 - protein, 24 aa, Mycobacterium
LARTAAPLLITAGKFLGADRSADL

SEQ ID NO: 1300610 - protein, 17 aa, Mycobacterium
LARTLFGADHPVPWDWF

SEQ ID NO: 1300611 - protein, 23 aa, Mycobacterium
LARTLKQYFKLLVRESFTPAPYR

SEQ ID NO: 1300612 - protein, 30 aa, Mycobacterium
LASDDPGQLLRWLVPAFPILQEAAAHELWD

SEQ ID NO: 1300613 - protein, 18 aa, Mycobacterium
LASEIISRVAPVERLRMV

SEQ ID NO: 1300614 - protein, 17 aa, Mycobacterium
LASGAAMAAVRRVFETD

SEQ ID NO: 1300615 - protein, 19 aa, Mycobacterium
LASMCFPTFTGFSARHLNM

SEQ ID NO: 1300616 - protein, 25 aa, Mycobacterium
LASNINWFMNVPVDPDGALGIVDGL

SEQ ID NO: 1300617 - protein, 27 aa, Mycobacterium
LASTPYASATFPWFALGRQVHVRGPVT

SEQ ID NO: 1300618 - protein, 18 aa, Mycobacterium
LASVLRRCIVTDAALRGS

SEQ ID NO: 1300619 - protein, 34 aa, Mycobacterium
LASYKRPSRVVFVPAIPRLPSGKVLRRVLKEQHG

SEQ ID NO: 1300620 - protein, 23 aa, Mycobacterium
LASYQALKHRFADLRIGLEACRA

SEQ ID NO: 1300621 - protein, 18 aa, Mycobacterium
LATAEWVVWFNTERPHEY

SEQ ID NO: 1300622 - protein, 26 aa, Mycobacterium
LATHHDLHLWLPHPSDDLWTTLEPHR

SEQ ID NO: 1300623 - protein, 17 aa, Mycobacterium
LATIRPVDTATAPLAPA

SEQ ID NO: 1300624 - protein, 18 aa, Mycobacterium
LATLSWVYWHNTSRLHSY

SEQ ID NO: 1300625 - protein, 23 aa, Mycobacterium
LATMHPSRYLSLIEGVTQVFITG

SEQ ID NO: 1300626 - protein, 20 aa, Mycobacterium
LATVKLDNGCSPMLALLADE

SEQ ID NO: 1300627 - protein, 34 aa, Mycobacterium
LAVAAQFMHVLPVGWVEPIDISNAVLFLASDESR

SEQ ID NO: 1300628 - protein, 17 aa, Mycobacterium
LAVDEACTRLIRSAVPH

SEQ ID NO: 1300629 - protein, 19 aa, Mycobacterium
LAVDRCGVRLGRGAGFYDR

SEQ ID NO: 1300630 - protein, 18 aa, Mycobacterium
LAVGFWDGADDLRRNWQE

SEQ ID NO: 1300631 - protein, 18 aa, Mycobacterium
LAVKACFAAFRTGTLDHH

SEQ ID NO: 1300632 - protein, 24 aa, Mycobacterium
LAVNGLPAVVPPAPPLPAGPAGEQ

SEQ ID NO: 1300633 - protein, 18 aa, Mycobacterium
LAVRLDVSRLVVVGTGRS

SEQ ID NO: 1300634 - protein, 17 aa, Mycobacterium
LAWLDEVADQRRAAGLR

SEQ ID NO: 1300635 - protein, 25 aa, Mycobacterium
LCEAGLLPGALTRNIGLHFICRDTW

SEQ ID NO: 1300636 - protein, 25 aa, Mycobacterium
LCPQNLDYLVAFFGTLYSGRIAVPL

SEQ ID NO: 1300637 - protein, 26 aa, Mycobacterium
LCRDTCHYCTFVTVPGRLRAQGAGMY

SEQ ID NO: 1300638 - protein, 31 aa, Mycobacterium
LCRGPHIPTTKYIPAFKLTRSSAAYWRGDQT

SEQ ID NO: 1300639 - protein, 21 aa, Mycobacterium
LCRRRIYHSFNPQGVNIVAAS

SEQ ID NO: 1300640 - protein, 25 aa, Mycobacterium
LCRSAGYWALPYPVAERLARPADLD

SEQ ID NO: 1300641 - protein, 17 aa, Mycobacterium
LCSCYPRPILGNSPEWY

SEQ ID NO: 1300642 - protein, 17 aa, Mycobacterium
LCTFRETARTLAGLADP

SEQ ID NO: 1300643 - protein, 19 aa, Mycobacterium
LCTGVAFPAFPALLAAEQG

SEQ ID NO: 1300644 - protein, 24 aa, Mycobacterium
LCVFDVKPRLWGTGHVRILSDLAQ

SEQ ID NO: 1300645 - protein, 19 aa, Mycobacterium
LDAALARRVAEARALVPSV

SEQ ID NO: 1300646 - protein, 19 aa, Mycobacterium
LDACLALADRLGWAVVTRY

SEQ ID NO: 1300647 - protein, 25 aa, Mycobacterium
LDAHLLERIARFKRPKRYEFIDELP

SEQ ID NO: 1300648 - protein, 19 aa, Mycobacterium
LDALRHRARIHWAQVGVER

SEQ ID NO: 1300649 - protein, 17 aa, Mycobacterium
LDALRRAAAGATVLTFD

SEQ ID NO: 1300650 - protein, 26 aa, Mycobacterium
LDASAFLGRLALIRIYKGRIRKGQQV

SEQ ID NO: 1300651 - protein, 18 aa, Mycobacterium
LDAVAINAGIGRAGRFVD

SEQ ID NO: 1300652 - protein, 18 aa, Mycobacterium
LDAVQWLVEHEGAEVTWL

SEQ ID NO: 1300653 - protein, 22 aa, Mycobacterium
LDAVTKYPWQRGDRTKFGFYGD

SEQ ID NO: 1300654 - protein, 24 aa, Mycobacterium
LDDAFDVYRWVTVNAELVGGDATR

SEQ ID NO: 1300655 - protein, 39 aa, Mycobacterium
LDDDAVVFAALPLFHVNALIVTILAQLLRGRHVVWAGPL

SEQ ID NO: 1300656 - protein, 18 aa, Mycobacterium
LDDDVFPAVRLAREAGRR

SEQ ID NO: 1300657 - protein, 18 aa, Mycobacterium
LDDIRWRLDVWNASAQVG

SEQ ID NO: 1300658 - protein, 24 aa, Mycobacterium
LDDSNPPFYRWFPDGELNTCANAL

SEQ ID NO: 1300659 - protein, 23 aa, Mycobacterium
LDDVERAMTALRATWHGEASDAQ

SEQ ID NO: 1300660 - protein, 34 aa, Mycobacterium; identical to SEQ ID NO: 831771

SEQ ID NO: 1300661 - protein, 24 aa, Mycobacterium
LDEAIRWYHDHLGMIVLHEEVNEE

SEQ ID NO: 1300662 - protein, 25 aa, Mycobacterium
LDEAWWFPAMCWPDGRLQFMLNERM

SEQ ID NO: 1300663 - protein, 25 aa, Mycobacterium
LDEGYSPPERPYAPGAFGPGETLDQ

SEQ ID NO: 1300664 - protein, 24 aa, Mycobacterium
LDELARPRFTLHAAGGEVPVNLAV

SEQ ID NO: 1300665 - protein, 27 aa, Mycobacterium
LDELRRIIPPWVTLGSRLAVIPSPPTT

SEQ ID NO: 1300666 - protein, 18 aa, Mycobacterium
LDEPLLDTLLVASLSPEL

SEQ ID NO: 1300667 - protein, 17 aa, Mycobacterium
LDESAVAFVRDFVRSGK

SEQ ID NO: 1300668 - protein, 25 aa, Mycobacterium
LDFHGLAVLDLYAGSGALGLEALSR

SEQ ID NO: 1300669 - protein, 25 aa, Mycobacterium
LDGGPMRDLLRRMQPTEFNDIVAVL

SEQ ID NO: 1300670 - protein, 17 aa, Mycobacterium
LDGIAPDSPLVILHNSG

SEQ ID NO: 1300671 - protein, 22 aa, Mycobacterium
LDGIQRPLIVFTPKSMLRNKAA

SEQ ID NO: 1300672 - protein, 18 aa, Mycobacterium
LDGLAWRLREQGIAATSV

SEQ ID NO: 1300673 - protein, 28 aa, Mycobacterium
LDGLGYRGFWMGYFAARSAPLGRVPADV

SEQ ID NO: 1300674 - protein, 17 aa, Mycobacterium
LDGLRRSAQTLADVRRS

SEQ ID NO: 1300675 - protein, 21 aa, Mycobacterium
LDGNEIMRLLDIPAGPQVGEA

SEQ ID NO: 1300676 - protein, 20 aa, Mycobacterium
LDHDWLEELGEQLPVYRPPL

SEQ ID NO: 1300677 - protein, 26 aa, Mycobacterium
LDHGESWRRLFGPLVEHVDGVLGFFL

SEQ ID NO: 1300678 - protein, 17 aa, Mycobacterium
LDHLDTAIGDVALVLVP

SEQ ID NO: 1300679 - protein, 19 aa, Mycobacterium
LDHVAALGLPPGRRGERRD

SEQ ID NO: 1300680 - protein, 18 aa, Mycobacterium
LDIIHALNQWMYETWQFD

SEQ ID NO: 1300681 - protein, 18 aa, Mycobacterium
LDIRIAFSAVEIFQTPVG

SEQ ID NO: 1300682 - protein, 31 aa, Mycobacterium
LDKAGYIIGRLQRVIFYAEGIKETNWSVTRP

SEQ ID NO: 1300683 - protein, 17 aa, Mycobacterium
LDKLVDVGLLRFRFLQP

SEQ ID NO: 1300684 - protein, 31 aa, Mycobacterium
LDLEWNRYGIRVIAMWPLYVQTAMTDNIKTG

SEQ ID NO: 1300685 - protein, 26 aa, Mycobacterium
LDLGLRNYWGYNTFGFFAPHNEYAAN

SEQ ID NO: 1300686 - protein, 31 aa, Mycobacterium
LDLTLFRTRWLHHDLGLNVVLPVLPMHGPRA

SEQ ID NO: 1300687 - protein, 23 aa, Mycobacterium
LDMDAFFASVEQLTRPTLRGRPV

SEQ ID NO: 1300688 - protein, 31 aa, Mycobacterium
LDMIDPDAWAFTWVVDWPLFEMAEDATAAGD

SEQ ID NO: 1300689 - protein, 17 aa, Mycobacterium
LDMVRRRGRIRMEALPE

SEQ ID NO: 1300690 - protein, 23 aa, Mycobacterium
LDNQIWQCPVVLLADVRSVGVQG

SEQ ID NO: 1300691 - protein, 27 aa, Mycobacterium
LDPDTAFLELCPFAAWGSKFPVGGSVV

SEQ ID NO: 1300692 - protein, 25 aa, Mycobacterium
LDPSVRFNPVLLKPGSDRTSQLVVR

SEQ ID NO: 1300693 - protein, 17 aa, Mycobacterium
LDPTKYFIIVPNMLGNG

SEQ ID NO: 1300694 - protein, 19 aa, Mycobacterium
LDRDLPRILAMQPTSRALR

SEQ ID NO: 1300695 - protein, 25 aa, Mycobacterium
LDRDRPLWEFYFAEGMADNRFALIG

SEQ ID NO: 1300696 - protein, 22 aa, Mycobacterium
LDRGTWTPAPVFQMIAQRGRIE

SEQ ID NO: 1300697 - protein, 25 aa, Mycobacterium
LDRLDEIWTTFTKLAPKQLIVDEVL

SEQ ID NO: 1300698 - protein, 24 aa, Mycobacterium
LDRLDRAVLSALIRSFGGGPVGVS

SEQ ID NO: 1300699 - protein, 26 aa, Mycobacterium
LDRMRFQEAMAALPQALRALPQPVVA

SEQ ID NO: 1300700 - protein, 25 aa, Mycobacterium
LDRSRPLWEMYFIEGLADGRIAVLG

SEQ ID NO: 1300701 - protein, 19 aa, Mycobacterium
LDRTIVLGFTPDAVALFRE

SEQ ID NO: 1300702 - protein, 25 aa, Mycobacterium
LDRVDIPILLFGGWQDLFLEQTLHQ

SEQ ID NO: 1300703 - protein, 19 aa, Mycobacterium
LDRYVPVLTQLRMRYLDVD

SEQ ID NO: 1300704 - protein, 17 aa, Mycobacterium
LDSFVPAIPDRVDVVWL

SEQ ID NO: 1300705 - protein, 25 aa, Mycobacterium
LDSIITTHGLSWGFDRIFAATMNHS

SEQ ID NO: 1300706 - protein, 24 aa, Mycobacterium
LDSPTYEGFAIRPLYTSLDELPEP

SEQ ID NO: 1300707 - protein, 24 aa, Mycobacterium
LDSRLRVLARRDFAGLITVAVDSP

SEQ ID NO: 1300708 - protein, 19 aa, Mycobacterium
LDTAFRASYGSGSLVVGVC

SEQ ID NO: 1300709 - protein, 25 aa, Mycobacterium
LDTAHGYILGIRQPVTDRLLAERTA

SEQ ID NO: 1300710 - protein, 26 aa, Mycobacterium
LDTDEFRLYELIWQRTVASQMADARG

SEQ ID NO: 1300711 - protein, 24 aa, Mycobacterium
LDTLLEFYHYPAEHWIHLRTTNPI

SEQ ID NO: 1300712 - protein, 20 aa, Mycobacterium
LDTWLQANPIKPSIADPSGS

SEQ ID NO: 1300713 - protein, 18 aa, Mycobacterium
LDVALDVYAGRDLVVKCA

SEQ ID NO: 1300714 - protein, 21 aa, Mycobacterium
LDVATAWLRARRPLDFIPGLM

SEQ ID NO: 1300715 - protein, 17 aa, Mycobacterium
LDVIFDAHGPEAAETLR

SEQ ID NO: 1300716 - protein, 29 aa, Mycobacterium
LDVLAKLREQIPGLPLLLLTAKDSVEDRI

SEQ ID NO: 1300717 - protein, 25 aa, Mycobacterium
LDVLTDVLAGKLPPGPAFYPDGELT

SEQ ID NO: 1300718 - protein, 23 aa, Mycobacterium
LDVQTVAMAKWWTTERAMKVLDD

SEQ ID NO: 1300719 - protein, 18 aa, Mycobacterium
LDVVRTQGPWKLIIAQHF

SEQ ID NO: 1300720 - protein, 20 aa, Mycobacterium
LDYHLRRSALPSPGRVRELL

SEQ ID NO: 1300721 - protein, 19 aa, Mycobacterium
LEAGSWFPTGDLGYFVDSG

SEQ ID NO: 1300722 - protein, 17 aa, Mycobacterium
LEAKLGGIDLYSEEHVG

SEQ ID NO: 1300723 - protein, 28 aa, Mycobacterium
LEANAPALLGLIGLWYSNFFGAQSRAVL

SEQ ID NO: 1300724 - protein, 17 aa, Mycobacterium
LECGALSEWRATLIVRE

SEQ ID NO: 1300725 - protein, 17 aa, Mycobacterium
LECWYAHIPGIKVVAPA

SEQ ID NO: 1300726 - protein, 28 aa, Mycobacterium
LEDFFVLGHIMTAMPPIHAIPAVVAAEP

SEQ ID NO: 1300727 - protein, 26 aa, Mycobacterium
LEDGAGSMLMLPFFNYADGNHDAIHE

SEQ ID NO: 1300728 - protein, 33 aa, Mycobacterium
LEDGNALFFGHGLNIHFGLIKPPANVTVGMVAP

SEQ ID NO: 1300729 - protein, 25 aa, Mycobacterium
LEDIEGWYISRFLTMRSTAFADPAS

SEQ ID NO: 1300730 - protein, 18 aa, Mycobacterium
LEDQYLWSVDVARIFAAA

SEQ ID NO: 1300731 - protein, 26 aa, Mycobacterium
LEELGEQLPVYRPPLDMARLFGEPAV

SEQ ID NO: 1300732 - protein, 20 aa, Mycobacterium
LEELIRPTGFYRNKANSLIR

SEQ ID NO: 1300733 - protein, 21 aa, Mycobacterium
LEEVLRCEPPFRGHYRHVVHD

SEQ ID NO: 1300734 - protein, 17 aa, Mycobacterium
LEFLVHAWDYATAIGHT

SEQ ID NO: 1300735 - protein, 21 aa, Mycobacterium
LEFYTRVMEVPYWSKTTCLSA

SEQ ID NO: 1300736 - protein, 23 aa, Mycobacterium
LEGAETVIPAMDAVIDQCAEHAL

SEQ ID NO: 1300737 - protein, 18 aa, Mycobacterium
LEGAFNWATDWFDVIARD

SEQ ID NO: 1300738 - protein, 20 aa, Mycobacterium
LEGRWWRRDLGGKMVRFVVC

SEQ ID NO: 1300739 - protein, 19 aa, Mycobacterium
LEHLGLRTRLFAAPGWTVS

SEQ ID NO: 1300740 - protein, 19 aa, Mycobacterium
LEHLLDIRIAFSAVEIFQT

SEQ ID NO: 1300741 - protein, 21 aa, Mycobacterium
LEHRIREHMVWWPVDVEAEAL

SEQ ID NO: 1300742 - protein, 23 aa, Mycobacterium
LEIGLDGYGYRWLRLVRPGDDPI

SEQ ID NO: 1300743 - protein, 17 aa, Mycobacterium
LEKLWLPGVDRLLDCVQ

SEQ ID NO: 1300744 - protein, 25 aa, Mycobacterium
LEKPCYAVPMLLDNFGWLQELVDYM

SEQ ID NO: 1300745 - protein, 20 aa, Mycobacterium
LELQLRQWTGAELDGTGIGH

SEQ ID NO: 1300746 - protein, 30 aa, Mycobacterium
LELVTIADRWRSWQDPRFVVLVLHNADLTE

SEQ ID NO: 1300747 - protein, 21 aa, Mycobacterium
LENYHRLTTPSTWLEALVKTY

SEQ ID NO: 1300748 - protein, 21 aa, Mycobacterium
LEPFRYPTDFANLFTGGAFGF

SEQ ID NO: 1300749 - protein, 27 aa, Mycobacterium
LEPLWGKSVFQCPFCHGWEMRDKRIAS

SEQ ID NO: 1300750 - protein, 26 aa, Mycobacterium
LEPSLDGVILHYFLHAEPAGFSARQL

SEQ ID NO: 1300751 - protein, 18 aa, Mycobacterium
LERELGGPLFERNYHEVR

SEQ ID NO: 1300752 - protein, 38 aa, Mycobacterium
LERGHDVGCSWLPLYHDMGLSFLLTGALAGVETWQAPT

SEQ ID NO: 1300753 - protein, 17 aa, Mycobacterium
LERIDRLAASQPLTVWV

SEQ ID NO: 1300754 - protein, 17 aa, Mycobacterium
LERVSSWVGARLDYVPG

SEQ ID NO: 1300755 - protein, 24 aa, Mycobacterium
LESALPQLDLFVSLDLYVNETNRL

SEQ ID NO: 1300756 - protein, 18 aa, Mycobacterium
LESPALFERISLEAFQSG

SEQ ID NO: 1300757 - protein, 32 aa, Mycobacterium
LETAGEIFDAAPYGWPVAKGSPLGQSLQQALE

SEQ ID NO: 1300758 - protein, 36 aa, Mycobacterium
LETDRLLAGPILGPFEAWLVLRSLGSAGLRFERQCQ

SEQ ID NO: 1300759 - protein, 17 aa, Mycobacterium
LETQLSDLLAPRDPHDA

SEQ ID NO: 1300760 - protein, 18 aa, Mycobacterium
LEVFVELGLNLDATALGE

SEQ ID NO: 1300761 - protein, 18 aa, Mycobacterium
LEVGDRLVPGRPSNFEDG

SEQ ID NO: 1300762 - protein, 24 aa, Mycobacterium
LEVGQRLLWAFAIALGEDPDVFTR

SEQ ID NO: 1300763 - protein, 21 aa, Mycobacterium
LEVHVPQWRFVGSGGDLTPGP

SEQ ID NO: 1300764 - protein, 25 aa, Mycobacterium
LEVLRRLYRRAGDRLVLISVGGIET

SEQ ID NO: 1300765 - protein, 18 aa, Mycobacterium
LEWAEIHGGLHRSGTPAR

SEQ ID NO: 1300766 - protein, 19 aa, Mycobacterium
LEWQVVAVPHLSGRIFPST

SEQ ID NO: 1300767 - protein, 17 aa, Mycobacterium
LFATAMSRFGFSAGALA

SEQ ID NO: 1300768 - protein, 30 aa, Mycobacterium
LFDGTDTVMLVWLGQRRIAGIESGRTLRVH

SEQ ID NO: 1300769 - protein, 37 aa, Mycobacterium
LFGHPSFRYYGWGPRMWTWIQMMGLRAFQEMVFTGRP

SEQ ID NO: 1300770 - protein, 20 aa, Mycobacterium
LFGTLSLWQGVDVPGPSLSL

SEQ ID NO: 1300771 - protein, 18 aa, Mycobacterium
LFIDGRWATPDGGDAIEV

SEQ ID NO: 1300772 - protein, 19 aa, Mycobacterium
LFIPDVLEPPRKKALRDLM

SEQ ID NO: 1300773 - protein, 22 aa, Mycobacterium
LFLERFVLNPRHIEVQVLADGF

SEQ ID NO: 1300774 - protein, 17 aa, Mycobacterium
LFNGVLEGFPTPEEFIA

SEQ ID NO: 1300775 - protein, 25 aa, Mycobacterium
LFPEATMCRFGVPLAPVAEPLDGPW

SEQ ID NO: 1300776 - protein, 17 aa, Mycobacterium
LFPGCPPERAEAIAIHA

SEQ ID NO: 1300777 - protein, 17 aa, Mycobacterium
LFQEIRETRGLAYSVYS

SEQ ID NO: 1300778 - protein, 27 aa, Mycobacterium
LFTAEAVWEMPPFDGWYQGPHDIVLLS

SEQ ID NO: 1300779 - protein, 24 aa, Mycobacterium
LFTRVHGSASWLPVPGLAEILPGE

SEQ ID NO: 1300780 - protein, 17 aa, Mycobacterium
LFYGQKVVPGSFRPGRA

SEQ ID NO: 1300781 - protein, 25 aa, Mycobacterium
LGAAARLRLSHPLPLRVGDVGLLRD

SEQ ID NO: 1300782 - protein, 17 aa, Mycobacterium
LGAAGYLEREWKSEADG

SEQ ID NO: 1300783 - protein, 27 aa, Mycobacterium
LGAALQGFVALPLLAGFDLDDPDPQAA

SEQ ID NO: 1300784 - protein, 23 aa, Mycobacterium
LGAAYLAGFAWGLGRGYTVLVEM

SEQ ID NO: 1300785 - protein, 21 aa, Mycobacterium
LGAFMNWPGPTFTDSGGFQVL

SEQ ID NO: 1300786 - protein, 17 aa, Mycobacterium
LGALAAVWGGSGSEAYQ

SEQ ID NO: 1300787 - protein, 26 aa, Mycobacterium
LGAPDVLRRLTAQRAHWALGTLQLEA

SEQ ID NO: 1300788 - protein, 26 aa, Mycobacterium
LGAQVTIFRLGTDPGLARFIDQVARR

SEQ ID NO: 1300789 - protein, 26 aa, Mycobacterium
LGASRPPLLDLVLPSAAGEVTGDSEL

SEQ ID NO: 1300790 - protein, 26 aa, Mycobacterium
LGATFAEFGGWLMPVSYAGTVTEHTA

SEQ ID NO: 1300791 - protein, 23 aa, Mycobacterium
LGAVEFVALPRFPDPESAVAQGS

SEQ ID NO: 1300792 - protein, 24 aa, Mycobacterium
LGCELRHAHRLVYSEGLDLSGENA

SEQ ID NO: 1300793 - protein, 17 aa, Mycobacterium
LGDDLRKTLLGLRRAKS

SEQ ID NO: 1300794 - protein, 25 aa, Mycobacterium
LGDVPLIGFAGAPFTLASYLVEGGP

SEQ ID NO: 1300795 - protein, 26 aa, Mycobacterium
LGEALRELVTLIDRGRLTVAVSRTYP

SEQ ID NO: 1300796 - protein, 17 aa, Mycobacterium
LGERSVARGYAKALRRA

SEQ ID NO: 1300797 - protein, 23 aa, Mycobacterium
LGFPFTEYGLQLGVEASLRALAR

SEQ ID NO: 1300798 - protein, 19 aa, Mycobacterium
LGFWKAMREVFPATREQRC

SEQ ID NO: 1300799 - protein, 20 aa, Mycobacterium
LGFWTQFDTYIPAALAELEH

SEQ ID NO: 1300800 - protein, 26 aa, Mycobacterium
LGGDHTIALPLLRSLHREHGPIAVLH

SEQ ID NO: 1300801 - protein, 19 aa, Mycobacterium
LGGGGWILGHLIDGTQAEY

SEQ ID NO: 1300802 - protein, 33 aa, Mycobacterium
LGGLAAAVPAAIRLLAALAFDLIILETVGVGQS

SEQ ID NO: 1300803 - protein, 21 aa, Mycobacterium
LGGPAALRRTPLQAAAGVAVR

SEQ ID NO: 1300804 - protein, 24 aa, Mycobacterium
LGHERTMLWLSYADRLQDLIDDFP

SEQ ID NO: 1300805 - protein, 21 aa, Mycobacterium
LGHFALTNLLLPKITDRVVTV

SEQ ID NO: 1300806 - protein, 17 aa, Mycobacterium
LGHRPDFAAIQRPDAHK

SEQ ID NO: 1300807 - protein, 22 aa, Mycobacterium
LGIELLSLEDLLARSDFISVHL

SEQ ID NO: 1300808 - protein, 19 aa, Mycobacterium
LGIKLDPDLPLHEGVRRNE

SEQ ID NO: 1300809 - protein, 20 aa, Mycobacterium
LGKYDIGIAIGLDKHPRGAF

SEQ ID NO: 1300810 - protein, 26 aa, Mycobacterium
LGLGVDGFPNLFIVSGPGAPAVLANM

SEQ ID NO: 1300811 - protein, 17 aa, Mycobacterium
LGLKPRARIVAQANVGA

SEQ ID NO: 1300812 - protein, 22 aa, Mycobacterium
LGLLAGHYREDRFWSDDVLSDA

SEQ ID NO: 1300813 - protein, 20 aa, Mycobacterium
LGLLELRGFEMPPHFQMAMV

SEQ ID NO: 1300814 - protein, 20 aa, Mycobacterium
LGLLVTGVTYRHPGLLAKTV

SEQ ID NO: 1300815 - protein, 29 aa, Mycobacterium
LGLPEDIVARQPFPGPGLGIRIVGEVTRG

SEQ ID NO: 1300816 - protein, 23 aa, Mycobacterium
LGLRDPLMVVGNFDRPNLTLEVE

SEQ ID NO: 1300817 - protein, 18 aa, Mycobacterium
LGMPHLLRHLAHSDLAPP

SEQ ID NO: 1300818 - protein, 18 aa, Mycobacterium
LGQDRFWRRETCAALGIG

SEQ ID NO: 1300819 - protein, 19 aa, Mycobacterium
LGQLARQRFGDDCRLIGLT

SEQ ID NO: 1300820 - protein, 18 aa, Mycobacterium
LGQRLLTFQLFDQQANVP

SEQ ID NO: 1300821 - protein, 21 aa, Mycobacterium
LGRHGTLVSFLLDALTLVTGN

SEQ ID NO: 1300822 - protein, 24 aa, Mycobacterium
LGRHRFPLVLSDTVQQFLTAVAEE

SEQ ID NO: 1300823 - protein, 19 aa, Mycobacterium
LGRIDGPYRYDNTSAARAV

SEQ ID NO: 1300824 - protein, 31 aa, Mycobacterium
LGRIQDPDFVREPYVLVLPTYGGGHANGPDP

SEQ ID NO: 1300825 - protein, 17 aa, Mycobacterium
LGRLAPGTPLRDGLERI

SEQ ID NO: 1300826 - protein, 22 aa, Mycobacterium
LGRLIDLGTLQYRPGRRPVTAA

SEQ ID NO: 1300827 - protein, 24 aa, Mycobacterium
LGRLVLDFHRCAMLPLRDGAADTG

SEQ ID NO: 1300828 - protein, 17 aa, Mycobacterium
LGRRGACLNLKMAMLGR

SEQ ID NO: 1300829 - protein, 18 aa, Mycobacterium
LGRRHVPWDVDIAVACGG

SEQ ID NO: 1300830 - protein, 26 aa, Mycobacterium
LGRRVTEIALVFRRAPHLPFDATMTE

SEQ ID NO: 1300831 - protein, 26 aa, Mycobacterium
LGRVLVRPADIYLLDEPLSHLDAKLR

SEQ ID NO: 1300832 - protein, 30 aa, Mycobacterium
LGSLHMFFHRLGPVLARRLLLTGDIVDAGS

SEQ ID NO: 1300833 - protein, 26 aa, Mycobacterium
LGSPQWSILLRNNGLHIEILIDPDSP

SEQ ID NO: 1300834 - protein, 20 aa, Mycobacterium
LGSPTLLYLAAAGVGTIGIV

SEQ ID NO: 1300835 - protein, 31 aa, Mycobacterium
LGTAPPFLVHRIWLDRPVAPDRPAFLGTGGL

SEQ ID NO: 1300836 - protein, 21 aa, Mycobacterium
LGTMGFLAHPALGAPGDVGNY

SEQ ID NO: 1300837 - protein, 20 aa, Mycobacterium
LGVDCEFGRIALLHARAFTA

SEQ ID NO: 1300838 - protein, 24 aa, Mycobacterium
LGVGDPAWDLARPAGFWAAGHVPD

SEQ ID NO: 1300839 - protein, 25 aa, Mycobacterium
LGVKPKSALLLITRVTYDSDGTPCE

SEQ ID NO: 1300840 - protein, 29 aa, Mycobacterium
LGVLRPRGRLMVVAIWEAPAGIDINRSVM

SEQ ID NO: 1300841 - protein, 24 aa, Mycobacterium
LGVPPGRLRMLRSFDPRSAAHPLD

SEQ ID NO: 1300842 - protein, 21 aa, Mycobacterium
LGVVGVLAVELFETVDGRLLV

SEQ ID NO: 1300843 - protein, 18 aa, Mycobacterium
LGVVSGRIAYTLDLAGPA

SEQ ID NO: 1300844 - protein, 18 aa, Mycobacterium
LGWAAEYAEAGIAFNCLW

SEQ ID NO: 1300845 - protein, 17 aa, Mycobacterium
LGWDLELIGRIGWTCRD

SEQ ID NO: 1300846 - protein, 27 aa, Mycobacterium
LGWSSYAIQWLSRVPAPVPDHLQVAHT

SEQ ID NO: 1300847 - protein, 29 aa, Mycobacterium
LGYGPEGLPYQPVQPWWPDPDTDPEGYRQ

SEQ ID NO: 1300848 - protein, 29 aa, Mycobacterium
LHDALENPIPNPPPFWRAAAEQGLQGVHL

SEQ ID NO: 1300849 - protein, 31 aa, Mycobacterium
LHDLALLSAMYVMFAGFFHGAAMVATAGTSA

SEQ ID NO: 1300850 - protein, 24 aa, Mycobacterium
LHDQYGRPAPLCPRSLLARVEQRA

SEQ ID NO: 1300851 - protein, 26 aa, Mycobacterium
LHDRGLFGTSILWFEQDRDGQDATGG

SEQ ID NO: 1300852 - protein, 25 aa, Mycobacterium
LHEAYGALRAWGLPVSDHTTRVQGM

SEQ ID NO: 1300853 - protein, 38 aa, Mycobacterium; identical to SEQ ID NO: 833598

SEQ ID NO: 1300854 - protein, 18 aa, Mycobacterium
LHEPVTVLVLPRLDAQTA

SEQ ID NO: 1300855 - protein, 17 aa, Mycobacterium
LHGFALNCDCDLSAFSA

SEQ ID NO: 1300856 - protein, 19 aa, Mycobacterium
LHGGYGYLREYGIEKIVRD

SEQ ID NO: 1300857 - protein, 19 aa, Mycobacterium
LHGRPFFEYLETDPEFAAV

SEQ ID NO: 1300858 - protein, 26 aa, Mycobacterium
LHGSRAIRLLATHNLGLYATLMERHL

SEQ ID NO: 1300859 - protein, 24 aa, Mycobacterium
LHGVQLWVALPEHARHLPRRFDHA

SEQ ID NO: 1300860 - protein, 25 aa, Mycobacterium
LHHLASFSRLILTDLLGTGSSDAVP

SEQ ID NO: 1300861 - protein, 26 aa, Mycobacterium
LHHYLSFHSVVPPPLTILRGVKKVPP

SEQ ID NO: 1300862 - protein, 31 aa, Mycobacterium
LHIGARIVDLRWLAPLPVEDMLREAQATGRV

SEQ ID NO: 1300863 - protein, 29 aa, Mycobacterium
LHIGNLRTAVLAWLFARSTGRRFLMRVED

SEQ ID NO: 1300864 - protein, 28 aa, Mycobacterium
LHILEVQRLIRFMPKVVICLVNGWAAGG

SEQ ID NO: 1300865 - protein, 27 aa, Mycobacterium
LHLLHDFAPGMMPWNPPFTLGHENAGW

SEQ ID NO: 1300866 - protein, 22 aa, Mycobacterium
LHMSRPALYKRLAAIGRTLGVD

SEQ ID NO: 1300867 - protein, 18 aa, Mycobacterium
LHNGGCAAFILGLQLART

SEQ ID NO: 1300868 - protein, 30 aa, Mycobacterium
LHPEYRTMPMVWYIPPLSPIVDAVARDGHD

SEQ ID NO: 1300869 - protein, 17 aa, Mycobacterium
LHPFGRFDKTAMEMGAE

SEQ ID NO: 1300870 - protein, 18 aa, Mycobacterium
LHPYPESLALVSKVGGRR

SEQ ID NO: 1300871 - protein, 23 aa, Mycobacterium
LHQKWFNLYDEATRVPFVIARTG

SEQ ID NO: 1300872 - protein, 19 aa, Mycobacterium
LHQNWDADLGLFLAGEPNA

SEQ ID NO: 1300873 - protein, 23 aa, Mycobacterium
LHRDELLMFMNVVAVAGAETTTR

SEQ ID NO: 1300874 - protein, 29 aa, Mycobacterium
LHSHDSLHALLAQLGRYWNIDPGDTFLVP

SEQ ID NO: 1300875 - protein, 17 aa, Mycobacterium
LHTFGTVTRVAAGGELG

SEQ ID NO: 1300876 - protein, 19 aa, Mycobacterium
LHTKSREQIPEALWPVLKH

SEQ ID NO: 1300877 - protein, 23 aa, Mycobacterium
LHVDGEPIPGLFAAGRSTAGLAA

SEQ ID NO: 1300878 - protein, 25 aa, Mycobacterium
LIAHAAVVQRRLLYRDAALRCGYIE

SEQ ID NO: 1300879 - protein, 17 aa, Mycobacterium
LICSHGVLIAHAAVVQR

SEQ ID NO: 1300880 - protein, 17 aa, Mycobacterium
LIDAAQARWRAVNAPHL

SEQ ID NO: 1300881 - protein, 19 aa, Mycobacterium
LIDEGLPVIVVMPSPKGAS

SEQ ID NO: 1300882 - protein, 20 aa, Mycobacterium
LIDFVLSNLVNARYLRICVL

SEQ ID NO: 1300883 - protein, 17 aa, Mycobacterium
LIDGADAGRFLTTIKRR

SEQ ID NO: 1300884 - protein, 18 aa, Mycobacterium
LIDTARLWMALGHHDRHG

SEQ ID NO: 1300885 - protein, 19 aa, Mycobacterium
LIEMVLPERANAFIGLLLD

SEQ ID NO: 1300886 - protein, 25 aa, Mycobacterium
LIENTVDAPLWIADPALYGLRDALP

SEQ ID NO: 1300887 - protein, 25 aa, Mycobacterium
LIETATELAVRWSARLRIASFSVRP

SEQ ID NO: 1300888 - protein, 18 aa, Mycobacterium
LIGADSWRQRATARGDVN

SEQ ID NO: 1300889 - protein, 18 aa, Mycobacterium
LIGMGVIPLQFPEGESAA

SEQ ID NO: 1300890 - protein, 18 aa, Mycobacterium
LIGRYFRAMGVLPAAPDS

SEQ ID NO: 1300891 - protein, 19 aa, Mycobacterium
LIGTGLSYDPGRRRRQVRE

SEQ ID NO: 1300892 - protein, 18 aa, Mycobacterium
LIHGHKIWTSYSDIADWC

SEQ ID NO: 1300893 - protein, 18 aa, Mycobacterium
LIHVAALEALDNLTFVVN

SEQ ID NO: 1300894 - protein, 17 aa, Mycobacterium
LIKAYRGPTGTLLRAVI

SEQ ID NO: 1300895 - protein, 19 aa, Mycobacterium
LIKELWAFGDDRIAVRFAY

SEQ ID NO: 1300896 - protein, 26 aa, Mycobacterium
LIQVMRDLLAAPDQFDWLATRLEIAR

SEQ ID NO: 1300897 - protein, 20 aa, Mycobacterium
LIRLLELRPDLTQPPPGTIA

SEQ ID NO: 1300898 - protein, 22 aa, Mycobacterium
LIRRICDRLPNPAPLLELDVQN

SEQ ID NO: 1300899 - protein, 24 aa, Mycobacterium
LIVRPYDVAAIAPFARSAAHRPEP

SEQ ID NO: 1300900 - protein, 25 aa, Mycobacterium
LIVSPATLPVPPRLGARRSWGLATQ

SEQ ID NO: 1300901 - protein, 18 aa, Mycobacterium
LIWGKDKLLAPLQDGMLA

SEQ ID NO: 1300902 - protein, 22 aa, Mycobacterium
LKAFGLMSRVPLAVLALGGEAV

SEQ ID NO: 1300903 - protein, 29 aa, Mycobacterium
LKARFAADVWPLVDVLLRGARRLTHNDAD

SEQ ID NO: 1300904 - protein, 25 aa, Mycobacterium
LKAWPHGNLPVPALYKRSPGEAVEP

SEQ ID NO: 1300905 - protein, 27 aa, Mycobacterium
LKDAQTPTLLFPFAAPRVAGDMSEVGS

SEQ ID NO: 1300906 - protein, 25 aa, Mycobacterium
LKDRFRLRLIDFQILKQLQSTDTGT

SEQ ID NO: 1300907 - protein, 23 aa, Mycobacterium
LKEHPDLFKQYFGTVIPAGDNKF

SEQ ID NO: 1300908 - protein, 18 aa, Mycobacterium
LKEVIRGKRLIVVDDSIV

SEQ ID NO: 1300909 - protein, 29 aa, Mycobacterium
LKEYASRGTWIWPPEPSLRLIADTIEFCA

SEQ ID NO: 1300910 - protein, 19 aa, Mycobacterium
LKGKLDGYALRVPIPTGSC

SEQ ID NO: 1300911 - protein, 25 aa, Mycobacterium
LKGPDGSSILLHQGADMPGATEGVD

SEQ ID NO: 1300912 - protein, 24 aa, Mycobacterium
LKGTFLMCQAVGRRMLADGGGSIV

SEQ ID NO: 1300913 - protein, 18 aa, Mycobacterium
LKILRRRSLAALRAQVEP

SEQ ID NO: 1300914 - protein, 26 aa, Mycobacterium
LKKLIPIGRFAYPPEIAAAAVYLASD

SEQ ID NO: 1300915 - protein, 20 aa, Mycobacterium
LKLFLDYATNSPLYPRLHEY

SEQ ID NO: 1300916 - protein, 22 aa, Mycobacterium
LKLHVTLRKAFGFGSMVMSLLG

SEQ ID NO: 1300917 - protein, 32 aa, Mycobacterium
LKMSPEVLTKPRWLWDFGKTFSPPDLRVPNQA

SEQ ID NO: 1300918 - protein, 24 aa, Mycobacterium
LKPSFRQRFVTLPMRYLPPEQESA

SEQ ID NO: 1300919 - protein, 18 aa, Mycobacterium
LKQFMVVTFTGRKTGRRF

SEQ ID NO: 1300920 - protein, 24 aa, Mycobacterium
LKQRGLVADILPTPTFALPRKDFE

SEQ ID NO: 1300921 - protein, 17 aa, Mycobacterium
LKRLGIGGGFFSFGIMH

SEQ ID NO: 1300922 - protein, 20 aa, Mycobacterium
LKTKPPLCIDTESADFYVDA

SEQ ID NO: 1300923 - protein, 17 aa, Mycobacterium
LLADCGRGEVIGSLARE

SEQ ID NO: 1300924 - protein, 24 aa, Mycobacterium
LLADPSVPVYALTTGPRWPDVSGN

SEQ ID NO: 1300925 - protein, 17 aa, Mycobacterium
LLAGRRVAVLTGAGMST

SEQ ID NO: 1300926 - protein, 20 aa, Mycobacterium
LLAHSAGYIELFYGHPRNQS

SEQ ID NO: 1300927 - protein, 20 aa, Mycobacterium
LLALLDLRRVDDDTFAGSHP

SEQ ID NO: 1300928 - protein, 28 aa, Mycobacterium
LLALQRVEELIARYPLRGIKGPMGTAQD

SEQ ID NO: 1300929 - protein, 18 aa, Mycobacterium
LLALSRYPDQRRIWFSAY

SEQ ID NO: 1300930 - protein, 25 aa, Mycobacterium
LLARDSLVKTALFGSDPNWGRVLAA

SEQ ID NO: 1300931 - protein, 25 aa, Mycobacterium
LLAVELSSFQLHWAPSLRPDAGVVL

SEQ ID NO: 1300932 - protein, 21 aa, Mycobacterium
LLCGYAALAAAHRDLIPLLTG

SEQ ID NO: 1300933 - protein, 20 aa, Mycobacterium
LLDADYWVANVRRPVRLSQA

SEQ ID NO: 1300934 - protein, 25 aa, Mycobacterium
LLDALAEHPILIERPFVVTDKGTRL

SEQ ID NO: 1300935 - protein, 26 aa, Mycobacterium
LLDEADFARHPFLVKGYVGPKALLDN

SEQ ID NO: 1300936 - protein, 19 aa, Mycobacterium
LLDGYRLTFSLLRVAVDAY

SEQ ID NO: 1300937 - protein, 24 aa, Mycobacterium
LLDQWLLPRRSAVTAVLLDGIATG

SEQ ID NO: 1300938 - protein, 18 aa, Mycobacterium
LLDRCVELLTPALTRRNP

SEQ ID NO: 1300939 - protein, 29 aa, Mycobacterium
LLDSFTEIGLGYLSLDRPAGTLSGGEAQR

SEQ ID NO: 1300940 - protein, 19 aa, Mycobacterium
LLDVHANTWRYNQLTAQQR

SEQ ID NO: 1300941 - protein, 17 aa, Mycobacterium
LLEDPPPVKVYQPGTWG

SEQ ID NO: 1300942 - protein, 23 aa, Mycobacterium
LLEGEVLELALTLLPDGRTRLHV

SEQ ID NO: 1300943 - protein, 17 aa, Mycobacterium
LLEMNGWTEGRSGVPFI

SEQ ID NO: 1300944 - protein, 34 aa, Mycobacterium
LLEPVARELVVVRPIGFEPLRWVRALAAEEPVPT

SEQ ID NO: 1300945 - protein, 25 aa, Mycobacterium
LLETPDILVFAWGATVPMIAQAAGI

SEQ ID NO: 1300946 - protein, 18 aa, Mycobacterium
LLGFLRLVGFRFGLPTFE

SEQ ID NO: 1300947 - protein, 27 aa, Mycobacterium
LLGLQTAGFPNLFMVTGPGSPSVLSNM

SEQ ID NO: 1300948 - protein, 34 aa, Mycobacterium
LLGMLEVTEVCRALTALWVAVLQAALDAVMRANE

SEQ ID NO: 1300949 - protein, 25 aa, Mycobacterium
LLGSSYVIVWADRFGRPLVTVESAK

SEQ ID NO: 1300950 - protein, 39 aa, Mycobacterium
LLGTDPPVTPFVLTLRLLTLALRHQPALNATWIETAEGP

SEQ ID NO: 1300951 - protein, 26 aa, Mycobacterium
LLGWQREMLALIEVPYRVIDVAAGDL

SEQ ID NO: 1300952 - protein, 28 aa, Mycobacterium
LLHAADDVLLFKYIIKNTAWQEGKTVTF

SEQ ID NO: 1300953 - protein, 19 aa, Mycobacterium
LLHVVQDLDTWLQANPIKP

SEQ ID NO: 1300954 - protein, 20 aa, Mycobacterium
LLIAPRLDDRYPTYGVLATI

SEQ ID NO: 1300955 - protein, 18 aa, Mycobacterium
LLIDAALRLFGTGGEAAL

SEQ ID NO: 1300956 - protein, 20 aa, Mycobacterium
LLIEWQRDFFDFGHVAKGYA

SEQ ID NO: 1300957 - protein, 17 aa, Mycobacterium
LLIKPSHLAGGYAQNAF

SEQ ID NO: 1300958 - protein, 18 aa, Mycobacterium
LLILHDDADREFAYTAGA

SEQ ID NO: 1300959 - protein, 18 aa, Mycobacterium
LLKHRRGVGTGYYNTVKA

SEQ ID NO: 1300960 - protein, 17 aa, Mycobacterium
LLLGPSLGTTTATLWTG

SEQ ID NO: 1300961 - protein, 20 aa, Mycobacterium
LLLGRRTYDIFAAYWPHQQG

SEQ ID NO: 1300962 - protein, 18 aa, Mycobacterium
LLLRVGISVWERYTGPYS

SEQ ID NO: 1300963 - protein, 36 aa, Mycobacterium
LLNEHLIRPIEIPVVRVSSLPYLVPVVEHGDQHSTY

SEQ ID NO: 1300964 - protein, 23 aa, Mycobacterium
LLNGIAAALPHFHRLGGGHFVTV

SEQ ID NO: 1300965 - protein, 17 aa, Mycobacterium
LLNRLGISPLPNTAGCR

SEQ ID NO: 1300966 - protein, 20 aa, Mycobacterium
LLPHRRGVRVYPRTGAPLTA

SEQ ID NO: 1300967 - protein, 43 aa, Mycobacterium
LLPIEGQRNRFLLVTNFEYVDPVFMFPGYNPDAPTREHFDVEI

SEQ ID NO: 1300968 - protein, 29 aa, Mycobacterium
LLPSGRPHLVAMWYAVLDGEIWFETKAKS

SEQ ID NO: 1300969 - protein, 20 aa, Mycobacterium
LLPVGIFDSGVGGLTVARAI

SEQ ID NO: 1300970 - protein, 20 aa, Mycobacterium
LLPVHCWFDGDGWGMRVFAP

SEQ ID NO: 1300971 - protein, 23 aa, Mycobacterium
LLQNEGMYGVFRPDLKAEGKTPT

SEQ ID NO: 1300972 - protein, 26 aa, Mycobacterium
LLREKLFDRLDLWVHPIVLGVGKKVF

SEQ ID NO: 1300973 - protein, 28 aa, Mycobacterium
LLRESNGDRYLPIWIGQSEAAAIALEQQ

SEQ ID NO: 1300974 - protein, 24 aa, Mycobacterium
LLRGRHVVWAGPLGYRDPELLAGF

SEQ ID NO: 1300975 - protein, 25 aa, Mycobacterium
LLRGRVERMHRSCLILTFGGGTNEI

SEQ ID NO: 1300976 - protein, 23 aa, Mycobacterium
LLRLAEKAFRPSPLPFPVMHVDT

SEQ ID NO: 1300977 - protein, 18 aa, Mycobacterium
LLRMLRRLHGLNIVGGDV

SEQ ID NO: 1300978 - protein, 17 aa, Mycobacterium
LLRQFPTLVPTGVDFMK

SEQ ID NO: 1300979 - protein, 23 aa, Mycobacterium
LLSAPAVKLLIRKSGASSAEMAA

SEQ ID NO: 1300980 - protein, 24 aa, Mycobacterium
LLSDVVLPAATWYEKADLNTTDMH

SEQ ID NO: 1300981 - protein, 17 aa, Mycobacterium
LLSWRDVARVMSEAPAR

SEQ ID NO: 1300982 - protein, 18 aa, Mycobacterium
LLSYRRISEALAEQRWYL

SEQ ID NO: 1300983 - protein, 17 aa, Mycobacterium
LLTDRVAVVTGGGAGIG

SEQ ID NO: 1300984 - protein, 24 aa, Mycobacterium
LLTSGLGWAVWTDGRVKFTTGAGL

SEQ ID NO: 1300985 - protein, 17 aa, Mycobacterium
LLTTVQDLPGRIGLWHI

SEQ ID NO: 1300986 - protein, 18 aa, Mycobacterium
LLVDGVAPAQRRGRIGMV

SEQ ID NO: 1300987 - protein, 18 aa, Mycobacterium
LLVDPMDRLRLLAATTDQ

SEQ ID NO: 1300988 - protein, 26 aa, Mycobacterium
LLVETGMAPFFPLVVVVWADEETRVT

SEQ ID NO: 1300989 - protein, 18 aa, Mycobacterium
LLVFADSLAYYGPTGGLP

SEQ ID NO: 1300990 - protein, 17 aa, Mycobacterium
LLYRFRAIDRLPEPQST

SEQ ID NO: 1300991 - protein, 18 aa, Mycobacterium
LMAGPFLTDVSKAWDFSG

SEQ ID NO: 1300992 - protein, 18 aa, Mycobacterium
LMAMTGRPAALADLDGPA

SEQ ID NO: 1300993 - protein, 20 aa, Mycobacterium
LMARMVSLRQLSISVARELT

SEQ ID NO: 1300994 - protein, 25 aa, Mycobacterium
LMAVDDWPLLRWRMREYTHGRWGTH

SEQ ID NO: 1300995 - protein, 32 aa, Mycobacterium; identical to SEQ ID NO: 121126

SEQ ID NO: 1300996 - protein, 18 aa, Mycobacterium
LMEHKPTKRTRRLAGRTQ

SEQ ID NO: 1300997 - protein, 18 aa, Mycobacterium
LMELLAPDVVWTADSAGK

SEQ ID NO: 1300998 - protein, 19 aa, Mycobacterium
LMEWVAMVGCPIIGINDSG

SEQ ID NO: 1300999 - protein, 18 aa, Mycobacterium
LMFGYAIKDTPELMPLPI

SEQ ID NO: 1301000 - protein, 26 aa, Mycobacterium
LMGEGEAMLFGEYIRLMALVEYSADE

SEQ ID NO: 1301001 - protein, 19 aa, Mycobacterium
LMGIMLTQYPELFGALVCS

SEQ ID NO: 1301002 - protein, 17 aa, Mycobacterium
LMPGIIAALRDSGTPFS

SEQ ID NO: 1301003 - protein, 20 aa, Mycobacterium
LMPRFEPHEFLRLVSEHRVT

SEQ ID NO: 1301004 - protein, 17 aa, Mycobacterium
LMRECVLGSALSSYTPA

SEQ ID NO: 1301005 - protein, 17 aa, Mycobacterium
LMRFDVPVGIADPAERI

SEQ ID NO: 1301006 - protein, 25 aa, Mycobacterium
LMTDYMTRLMRYVEFMKKVVPMHDD

SEQ ID NO: 1301007 - protein, 23 aa, Mycobacterium
LMTNNRVRHVPVLDNGRLAGIVS

SEQ ID NO: 1301008 - protein, 21 aa, Mycobacterium
LMTTLYACRAALPSMVSRGAG

SEQ ID NO: 1301009 - protein, 21 aa, Mycobacterium
LNADPYPMFKRLREEAPLYYN

SEQ ID NO: 1301010 - protein, 17 aa, Mycobacterium
LNAMADRALRQIAFEAP

SEQ ID NO: 1301011 - protein, 27 aa, Mycobacterium
LNASHQALCYFGYLAGYRLVHDAAADP

SEQ ID NO: 1301012 - protein, 24 aa, Mycobacterium
LNCFGLHEWAMVYRSPDTRHDAVP

SEQ ID NO: 1301013 - protein, 32 aa, Mycobacterium
LNDPVRQALIPPLQQIVKERGLWATHLGPHLG

SEQ ID NO: 1301014 - protein, 25 aa, Mycobacterium
LNDREKRWVLKNPSHLFALDALFAT

SEQ ID NO: 1301015 - protein, 19 aa, Mycobacterium
LNGFFAAIRQHRWSPDLPA

SEQ ID NO: 1301016 - protein, 20 aa, Mycobacterium
LNGLPVSIIIRTTLEDLESR

SEQ ID NO: 1301017 - protein, 27 aa, Mycobacterium
LNGWDPLLQDGLPDPTLTWLDGIAPDS

SEQ ID NO: 1301018 - protein, 20 aa, Mycobacterium
LNLALAFATAFPYGPYYGDR

SEQ ID NO: 1301019 - protein, 17 aa, Mycobacterium
LNLSIRDGWWDEWFDGE

SEQ ID NO: 1301020 - protein, 32 aa, Mycobacterium
LNLYAMHDTVGTPFLLLAGMEPDLRWERFITA

SEQ ID NO: 1301021 - protein, 23 aa, Mycobacterium
LNMADDLVKTQYEFIRSVVGNAS

SEQ ID NO: 1301022 - protein, 17 aa, Mycobacterium
LNPHDVILKVTLTTTCG

SEQ ID NO: 1301023 - protein, 25 aa, Mycobacterium
LNQHGPHSILFYTKTKTVTQRWPSG

SEQ ID NO: 1301024 - protein, 27 aa, Mycobacterium
LNRDIAEWFHAAGLLILEGYGLTETAA

SEQ ID NO: 1301025 - protein, 18 aa, Mycobacterium
LNRWETIKKWAILDHDLS

SEQ ID NO: 1301026 - protein, 18 aa, Mycobacterium
LNRWRRLGCWVSGHGEGW

SEQ ID NO: 1301027 - protein, 23 aa, Mycobacterium
LNSPKLLQLSGIGPREVLSAAGV

SEQ ID NO: 1301028 - protein, 29 aa, Mycobacterium
LNSRLVRYFVKRYTLKRSALAFGKVLPVG

SEQ ID NO: 1301029 - protein, 18 aa, Mycobacterium
LNTARFQLDIMGVPGIIV

SEQ ID NO: 1301030 - protein, 25 aa, Mycobacterium
LNVSPGALYWHFANKQQLLGAIADR

SEQ ID NO: 1301031 - protein, 18 aa, Mycobacterium
LPADGLELDLLVPRAQVA

SEQ ID NO: 1301032 - protein, 24 aa, Mycobacterium
LPADHRPVPIAPRSVLRRVVERAD

SEQ ID NO: 1301033 - protein, 19 aa, Mycobacterium
LPAEIYPLTEARAAFRRMQ

SEQ ID NO: 1301034 - protein, 24 aa, Mycobacterium
LPANGRIPPKAAIKAYPVIERFGH

SEQ ID NO: 1301035 - protein, 24 aa, Mycobacterium
LPATAINWGFWKSLADNESDEYRQ

SEQ ID NO: 1301036 - protein, 26 aa, Mycobacterium
LPDQEAFAARLPRYFPSTLRDQFAAD

SEQ ID NO: 1301037 - protein, 23 aa, Mycobacterium
LPDVRNFINPIPHVSFVSGARNV

SEQ ID NO: 1301038 - protein, 33 aa, Mycobacterium
LPDWARRWQRLLFDNGWLLPGHPPEFGGRNATI

SEQ ID NO: 1301039 - protein, 27 aa, Mycobacterium
LPEFAHLRAHVFSRIREMVRNDAALAS

SEQ ID NO: 1301040 - protein, 18 aa, Mycobacterium
LPELIRRAVAVKAEVVAA

SEQ ID NO: 1301041 - protein, 26 aa, Mycobacterium
LPEPGSYATGIAFLPQSSKDAATACE

SEQ ID NO: 1301042 - protein, 28 aa, Mycobacterium
LPERANAFIGLLLDLEMLVAAGGRERTR

SEQ ID NO: 1301043 - protein, 30 aa, Mycobacterium
LPERDFPTLISLYLQGRLPLDKFVSERIGL

SEQ ID NO: 1301044 - protein, 24 aa, Mycobacterium
LPEVVAPLAAYVPAVRTGNLVYTA

SEQ ID NO: 1301045 - protein, 19 aa, Mycobacterium
LPGLGRWQTALLADGNIGL

SEQ ID NO: 1301046 - protein, 20 aa, Mycobacterium
LPGNAHFTFRGCEGDSLLML

SEQ ID NO: 1301047 - protein, 27 aa, Mycobacterium
LPGPSLTVLPLILLRNPGRADGGIAAR

SEQ ID NO: 1301048 - protein, 25 aa, Mycobacterium
LPHDRIPVLYCKTGVRSAEALAAVK

SEQ ID NO: 1301049 - protein, 18 aa, Mycobacterium
LPHILSENGWHTALFGMQ

SEQ ID NO: 1301050 - protein, 20 aa, Mycobacterium
LPKYRRLVEQLAQAGLLKVI

SEQ ID NO: 1301051 - protein, 18 aa, Mycobacterium
LPMHMLCLRDMGLMLGEY

SEQ ID NO: 1301052 - protein, 25 aa, Mycobacterium
LPNDPWIPRRRALQPVFTKPSVRGF

SEQ ID NO: 1301053 - protein, 29 aa, Mycobacterium
LPQRQIGVGWAALRSLPAPAAAPTLTVTA

SEQ ID NO: 1301054 - protein, 20 aa, Mycobacterium
LPRIKSRLAKLNPAPTREIP

SEQ ID NO: 1301055 - protein, 21 aa, Mycobacterium
LPRMRAWVHSMERWCAAAGSD

SEQ ID NO: 1301056 - protein, 17 aa, Mycobacterium
LPSRVLLAGHIDTVPAA

SEQ ID NO: 1301057 - protein, 27 aa, Mycobacterium
LPTGDFPMPDIWWQFRNAIQTVDDLDV

SEQ ID NO: 1301058 - protein, 26 aa, Mycobacterium
LPVEDLRRWNIRQVPLHVLVDEHDLR

SEQ ID NO: 1301059 - protein, 25 aa, Mycobacterium
LPVETLRRAVTGKPLHHFPTRRLCN

SEQ ID NO: 1301060 - protein, 19 aa, Mycobacterium
LPVIVYYHGGGFTVGVSED

SEQ ID NO: 1301061 - protein, 18 aa, Mycobacterium
LPVLQQRWREPGVTPLFA

SEQ ID NO: 1301062 - protein, 17 aa, Mycobacterium
LPVMYDIPSRDDVAKVV

SEQ ID NO: 1301063 - protein, 20 aa, Mycobacterium
LQAHAHLLDGAAAVAPVLPL

SEQ ID NO: 1301064 - protein, 24 aa, Mycobacterium
LQAIGAFKVRGAFNAIARLDPAVR

SEQ ID NO: 1301065 - protein, 24 aa, Mycobacterium
LQDNHIDFTSFFRALGLAARGDNE

SEQ ID NO: 1301066 - protein, 18 aa, Mycobacterium
LQEDVAVVGLSILSGAHL

SEQ ID NO: 1301067 - protein, 17 aa, Mycobacterium
LQFDDTAQVLAWTDAVR

SEQ ID NO: 1301068 - protein, 28 aa, Mycobacterium
LQGWIAAGVGPWFVIRGLRQHGSYRGAP

SEQ ID NO: 1301069 - protein, 29 aa, Mycobacterium
LQHPRGVLVLWIELLEQRPFTPEDRTLLT

SEQ ID NO: 1301070 - protein, 27 aa, Mycobacterium
LQNPSAPLIFLTTDDLPAFAPGSLLID

SEQ ID NO: 1301071 - protein, 23 aa, Mycobacterium
LQNSDLVPYRTLTAQAPVGVMVG

SEQ ID NO: 1301072 - protein, 25 aa, Mycobacterium
LQPLATLQRMFIPPSGFHVVPVLAY

SEQ ID NO: 1301073 - protein, 18 aa, Mycobacterium
LQRTAPWVEQLGLDHLRE

SEQ ID NO: 1301074 - protein, 23 aa, Mycobacterium
LQSALGWLKYTIDTELRMSEIAE

SEQ ID NO: 1301075 - protein, 21 aa, Mycobacterium
LQSEPMYRSFRPDLEKPTRAD

SEQ ID NO: 1301076 - protein, 26 aa, Mycobacterium
LQSHGDLPLFVALIVRVMVSAHFGRE

SEQ ID NO: 1301077 - protein, 24 aa, Mycobacterium
LQSQYAQLMFLTTALNDLQRADID

SEQ ID NO: 1301078 - protein, 25 aa, Mycobacterium
LQSVHSGVFLLKASVRELRERVGRD

SEQ ID NO: 1301079 - protein, 21 aa, Mycobacterium
LQTLGPIDTPPYYAVPVGIGA

SEQ ID NO: 1301080 - protein, 27 aa, Mycobacterium
LQVGIDNWRWAGVPIYLRTGKKMAEGQ

SEQ ID NO: 1301081 - protein, 19 aa, Mycobacterium
LQVLINGRLRPGVGRICMD

SEQ ID NO: 1301082 - protein, 18 aa, Mycobacterium
LRAAELLGVTPDQAAVFE

SEQ ID NO: 1301083 - protein, 25 aa, Mycobacterium
LRADPHAAALFLPAGRAPRVGDVFR

SEQ ID NO: 1301084 - protein, 22 aa, Mycobacterium
LRAILESPVPVIAAIDGHVRAG

SEQ ID NO: 1301085 - protein, 22 aa, Mycobacterium
LRARLALGYALGWQGRGREADE

SEQ ID NO: 1301086 - protein, 24 aa, Mycobacterium
LRAVSPLAVQMYMPNAPAAAVGLD

SEQ ID NO: 1301087 - protein, 21 aa, Mycobacterium
LRAWDYHTVWCNSVALQRAGI

SEQ ID NO: 1301088 - protein, 18 aa, Mycobacterium
LRAWRHRPNGSARAWLFT

SEQ ID NO: 1301089 - protein, 34 aa, Mycobacterium
LRDILITLGYDIDRPWHKLPKRQRNWILFTDEQP

SEQ ID NO: 1301090 - protein, 23 aa, Mycobacterium
LRDLMAKVAQWSGYRFDDFRVPE

SEQ ID NO: 1301091 - protein, 17 aa, Mycobacterium
LRDSILDGMRDLLRSRD

SEQ ID NO: 1301092 - protein, 22 aa, Mycobacterium
LRDVVLPLRRLSVVTGANGSGK

SEQ ID NO: 1301093 - protein, 25 aa, Mycobacterium
LREGQRLWLSWAMANRDPAVFTEPD

SEQ ID NO: 1301094 - protein, 31 aa, Mycobacterium
LREQAPLYYNERYDFWALSRHADVEKALLDW

SEQ ID NO: 1301095 - protein, 18 aa, Mycobacterium
LRFTAQAAQLLGPRGRRW

SEQ ID NO: 1301096 - protein, 19 aa, Mycobacterium
LRFVAPSRALADAEWLAAL

SEQ ID NO: 1301097 - protein, 24 aa, Mycobacterium
LRGELLRLIGLVETLIRADPSLNV

SEQ ID NO: 1301098 - protein, 19 aa, Mycobacterium
LRGRVLHPTMVDLLTRHTE

SEQ ID NO: 1301099 - protein, 25 aa, Mycobacterium
LRHGELITAVELPAPPPGAVSEYRK

SEQ ID NO: 1301100 - protein, 17 aa, Mycobacterium
LRIGRLPDEMRAQSEAE

SEQ ID NO: 1301101 - protein, 21 aa, Mycobacterium
LRKTLLGLRRAKSNVDRLKLV

SEQ ID NO: 1301102 - protein, 20 aa, Mycobacterium
LRLAVLDALLVLHADTTAVP

SEQ ID NO: 1301103 - protein, 18 aa, Mycobacterium
LRLLRRLRDEIGCSIVLI

SEQ ID NO: 1301104 - protein, 18 aa, Mycobacterium
LRLVDPRFYHLDTALTVL

SEQ ID NO: 1301105 - protein, 27 aa, Mycobacterium
LRMRHAPFRIGYIERDAWLRCMHTAVA

SEQ ID NO: 1301106 - protein, 17 aa, Mycobacterium
LRMRTICDRIAEFPGPV

SEQ ID NO: 1301107 - protein, 18 aa, Mycobacterium
LRNLFKLSSLASFEGQLG

SEQ ID NO: 1301108 - protein, 27 aa, Mycobacterium
LRPDGRPHRFQVTASRFGRAAARATQP

SEQ ID NO: 1301109 - protein, 20 aa, Mycobacterium
LRPDLRVHLAAREAEFWTAP

SEQ ID NO: 1301110 - protein, 22 aa, Mycobacterium
LRPDNLMNWARIAYNSAPGVAM

SEQ ID NO: 1301111 - protein, 17 aa, Mycobacterium
LRPLRCAELSDGTLRFL

SEQ ID NO: 1301112 - protein, 36 aa, Mycobacterium
LRPLTLSAPKPMLPTAGLAFLTHLLSRIAAAGIEHV

SEQ ID NO: 1301113 - protein, 23 aa, Mycobacterium
LRPPPPVCYPLAEGPAALQALAD

SEQ ID NO: 1301114 - protein, 29 aa, Mycobacterium
LRQALDGAARLPRLLIACDYDGTLAPIVS

SEQ ID NO: 1301115 - protein, 24 aa, Mycobacterium
LRQNLIVRMFEPGRPRGFVMFRCE

SEQ ID NO: 1301116 - protein, 17 aa, Mycobacterium
LRRALEHRDRTCVVPGC

SEQ ID NO: 1301117 - protein, 18 aa, Mycobacterium
LRRDVFGALPGLGRWQTA

SEQ ID NO: 1301118 - protein, 20 aa, Mycobacterium
LRREAILDALDRWLQQSSVE

SEQ ID NO: 1301119 - protein, 32 aa, Mycobacterium
LRREVIGTFTQLPFKLAWAITIHKSQGQTLER

SEQ ID NO: 1301120 - protein, 20 aa, Mycobacterium
LRRLLYCGEWIHSHALHIYL

SEQ ID NO: 1301121 - protein, 25 aa, Mycobacterium
LRRLSYLQKMSTVLGRRVWANAGSP

SEQ ID NO: 1301122 - protein, 17 aa, Mycobacterium
LRRLVRAAHRTSTSAPW

SEQ ID NO: 1301123 - protein, 35 aa, Mycobacterium
LRRPDLLVSMLTYWQRHPALSYLFAGRFIGTTSQA

SEQ ID NO: 1301124 - protein, 28 aa, Mycobacterium
LRRQVKDSWLRRQLTPHFRPGCKRMLMT

SEQ ID NO: 1301125 - protein, 19 aa, Mycobacterium
LRRQVLAHDVDRWARAFLD

SEQ ID NO: 1301126 - protein, 24 aa, Mycobacterium
LRRRATMYLTYWTAGDTRNRGNAM

SEQ ID NO: 1301127 - protein, 17 aa, Mycobacterium
LRRRRATGGPAEQTFAT

SEQ ID NO: 1301128 - protein, 17 aa, Mycobacterium
LRRWMAAAALVRSRADG

SEQ ID NO: 1301129 - protein, 37 aa, Mycobacterium
LRRYTLPAFIEPRWLRFLPVLPLDRGLVVPIIHADDV

SEQ ID NO: 1301130 - protein, 31 aa, Mycobacterium
LRSADVVACTPWYEPFGIVPLEAMASGVPVV

SEQ ID NO: 1301131 - protein, 18 aa, Mycobacterium
LRSPESLYRYASVHWARH

SEQ ID NO: 1301132 - protein, 26 aa, Mycobacterium
LRSPTGDRLPAWAPGAHVAVTLPSGL

SEQ ID NO: 1301133 - protein, 19 aa, Mycobacterium
LRTRLFAAPGWTVSQGTVM

SEQ ID NO: 1301134 - protein, 19 aa, Mycobacterium
LRTRRALMLSLLDEHLPDW

SEQ ID NO: 1301135 - protein, 33 aa, Mycobacterium
LRTVNHLLPRFIRQFPFNVLLKDLDRRIRTGRP

SEQ ID NO: 1301136 - protein, 19 aa, Mycobacterium
LRVRGRGVPKRGGGHGDLL

SEQ ID NO: 1301137 - protein, 39 aa, Mycobacterium
LRVVAPEAYFQFPVAKYGIALDNWSIRRLTSLVGAGRAR

SEQ ID NO: 1301138 - protein, 25 aa, Mycobacterium
LRVVDPALLDALLSGTRKPSPEVLT

SEQ ID NO: 1301139 - protein, 21 aa, Mycobacterium
LRYCINSAALRFIHLDDLEAQ

SEQ ID NO: 1301140 - protein, 17 aa, Mycobacterium
LRYNFPAAGLTDDALRT

SEQ ID NO: 1301141 - protein, 17 aa, Mycobacterium
LSAALGPGALIAEVGSD

SEQ ID NO: 1301142 - protein, 19 aa, Mycobacterium
LSAGDFVRWCRQVLDLLDQ

SEQ ID NO: 1301143 - protein, 19 aa, Mycobacterium
LSAGFTPTELMRWVHPSLV

SEQ ID NO: 1301144 - protein, 17 aa, Mycobacterium
LSALTMAEYFRDEKQQD

SEQ ID NO: 1301145 - protein, 26 aa, Mycobacterium
LSANRAVVLTVWSPTLRGSEPPAVDL

SEQ ID NO: 1301146 - protein, 22 aa, Mycobacterium
LSARANLKWTPQPAMPGQLRAV

SEQ ID NO: 1301147 - protein, 17 aa, Mycobacterium
LSAVLSVIYLIYNEGYS

SEQ ID NO: 1301148 - protein, 26 aa, Mycobacterium
LSDDEFGFFVILLAVAGNETTRNSIT

SEQ ID NO: 1301149 - protein, 19 aa, Mycobacterium
LSDFAAWPNPFTLANNAAA

SEQ ID NO: 1301150 - protein, 24 aa, Mycobacterium
LSDGWDIMDFVDQLQKLAAGNVAF

SEQ ID NO: 1301151 - protein, 22 aa, Mycobacterium
LSDLLAEQLAAWDIALLGAHVV

SEQ ID NO: 1301152 - protein, 28 aa, Mycobacterium
LSDNELLDFTTLARVFGYPSTLEAQDSA

SEQ ID NO: 1301153 - protein, 24 aa, Mycobacterium
LSEAEFLARREAVERVMVVRDKVR

SEQ ID NO: 1301154 - protein, 23 aa, Mycobacterium
LSEEPVALPTLRNLAYGGSKVAL

SEQ ID NO: 1301155 - protein, 40 aa, Mycobacterium
LSEERLERICRLIMLYHLDRGWCEHLAYLADIRESIHLRA

SEQ ID NO: 1301156 - protein, 17 aa, Mycobacterium
LSEFAAVGFEYGYSVGN

SEQ ID NO: 1301157 - protein, 20 aa, Mycobacterium
LSEFGGIDYLVNNAAIFGGM

SEQ ID NO: 1301158 - protein, 28 aa, Mycobacterium
LSEKIDPYLRPLYDALHDMMDPELIPKL

SEQ ID NO: 1301159 - protein, 24 aa, Mycobacterium
LSERLGRSFPRPTLIRIAETSGGN

SEQ ID NO: 1301160 - protein, 25 aa, Mycobacterium
LSERSRPLYDYFVELFAQVTNPPLD

SEQ ID NO: 1301161 - protein, 31 aa, Mycobacterium
LSFAEVFTSDFFALWGKFAATRTPTIAAVAG

SEQ ID NO: 1301162 - protein, 28 aa, Mycobacterium
LSFVDQRTFGGWLLADLVTVDGTDVPVP

SEQ ID NO: 1301163 - protein, 18 aa, Mycobacterium
LSGLRMQPGHWSGAYICW

SEQ ID NO: 1301164 - protein, 21 aa, Mycobacterium
LSGLSFKLYTADRTAGALNLF

SEQ ID NO: 1301165 - protein, 25 aa, Mycobacterium
LSGTWIDIRFTLTDVIRTGGAPLVT

SEQ ID NO: 1301166 - protein, 30 aa, Mycobacterium
LSGVDVLVFVYAIAQAWQLSPKGLTGLEEN

SEQ ID NO: 1301167 - protein, 17 aa, Mycobacterium
LSIAWGTAIRQLAAGLG

SEQ ID NO: 1301168 - protein, 20 aa, Mycobacterium
LSIRDGWWDEWFDGENGWEI

SEQ ID NO: 1301169 - protein, 17 aa, Mycobacterium
LSLITRPNESFLKALAD

SEQ ID NO: 1301170 - protein, 24 aa, Mycobacterium
LSNDFFVNLLDMNTAWKPSENTEN

SEQ ID NO: 1301171 - protein, 25 aa, Mycobacterium
LSNWTELDVWRYIQLENLELPSIYF

SEQ ID NO: 1301172 - protein, 19 aa, Mycobacterium
LSNYLPTRTFELAVHGLDI

SEQ ID NO: 1301173 - protein, 26 aa, Mycobacterium
LSPEPVSRFLVGGLLEVLRSWMEDPD

SEQ ID NO: 1301174 - protein, 17 aa, Mycobacterium
LSPFFNETAYCLGVEKL

SEQ ID NO: 1301175 - protein, 19 aa, Mycobacterium
LSPLGIRVCTIAPGTINTP

SEQ ID NO: 1301176 - protein, 25 aa, Mycobacterium
LSQAIRVLMGCPFLNGLQARRLERP

SEQ ID NO: 1301177 - protein, 27 aa, Mycobacterium
LSQIPHSHFVFLEALRLQGTADQQAYF

SEQ ID NO: 1301178 - protein, 20 aa, Mycobacterium
LSQPTLPRDVPIPASTTVTI

SEQ ID NO: 1301179 - protein, 25 aa, Mycobacterium
LSRGAIFHHFRDKDTLFFELAREDA

SEQ ID NO: 1301180 - protein, 20 aa, Mycobacterium
LSRILPLVPGNPRLGAGRRI

SEQ ID NO: 1301181 - protein, 32 aa, Mycobacterium
LSRKKLMPAIYDLANRGLLPASFSLVGFARRD

SEQ ID NO: 1301182 - protein, 24 aa, Mycobacterium
LSRRAKRLIVFDVDSTLIQGEVIE

SEQ ID NO: 1301183 - protein, 27 aa, Mycobacterium
LSRSVFSKGIFPAVDPLASSSTILDPS

SEQ ID NO: 1301184 - protein, 26 aa, Mycobacterium
LSRYVDAIVWRTFAQERLTSMAAGAT

SEQ ID NO: 1301185 - protein, 17 aa, Mycobacterium
LSSTFVDYLLPTATEVP

SEQ ID NO: 1301186 - protein, 24 aa, Mycobacterium
LSTEMLIEHCAGFLGILGLYTLGQ

SEQ ID NO: 1301187 - protein, 26 aa, Mycobacterium
LSTKGWPRYVWIAADLPSTATNKILK

SEQ ID NO: 1301188 - protein, 30 aa, Mycobacterium
LSTVRTQLEVILPYFLHYANDEQRKRWFPG

SEQ ID NO: 1301189 - protein, 22 aa, Mycobacterium
LSVGDYHLAKTVGWSLLGHPID

SEQ ID NO: 1301190 - protein, 21 aa, Mycobacterium
LSYLRPRAVVFHRSLGAKFAD

SEQ ID NO: 1301191 - protein, 24 aa, Mycobacterium
LTAMKRRGALRADADPRHLAVSLV

SEQ ID NO: 1301192 - protein, 18 aa, Mycobacterium
LTAMLTSGGHRVIRLVRG

SEQ ID NO: 1301193 - protein, 18 aa, Mycobacterium
LTATGLRQLIAFISRMTA

SEQ ID NO: 1301194 - protein, 23 aa, Mycobacterium
LTCPFHGWTFRNDGTLLKVKDPE

SEQ ID NO: 1301195 - protein, 21 aa, Mycobacterium
LTCRLIDRPLRPTFVSGLRNE

SEQ ID NO: 1301196 - protein, 18 aa, Mycobacterium
LTDADWMHRVLSASWERI

SEQ ID NO: 1301197 - protein, 25 aa, Mycobacterium
LTDEEVLGFMFLMVIAGNETTTKLL

SEQ ID NO: 1301198 - protein, 23 aa, Mycobacterium
LTDHLAELGNPSWYARFAAQVMT

SEQ ID NO: 1301199 - protein, 29 aa, Mycobacterium
LTDKPFGVNLTILPTINPPPYDEYRQVIV

SEQ ID NO: 1301200 - protein, 27 aa, Mycobacterium
LTDLEFDLLMLVAPVLRKLALNDAKAG

SEQ ID NO: 1301201 - protein, 22 aa, Mycobacterium
LTDLIYAHHPRFLGVRRAYESR

SEQ ID NO: 1301202 - protein, 31 aa, Mycobacterium
LTDNATLAHLLKFDSILGRLPYEVSLEGDDT

SEQ ID NO: 1301203 - protein, 21 aa, Mycobacterium
LTEGISWGWESYPEYLDVIGS

SEQ ID NO: 1301204 - protein, 18 aa, Mycobacterium
LTELTGSAPLGWYTGRDS

SEQ ID NO: 1301205 - protein, 17 aa, Mycobacterium
LTFLAAREAAHHRLFSH

SEQ ID NO: 1301206 - protein, 25 aa, Mycobacterium
LTGDALFIGDVGRPDLLASIGFTRE

SEQ ID NO: 1301207 - protein, 26 aa, Mycobacterium
LTGFKRPRHVLFVDALPLTTNGKIDK

SEQ ID NO: 1301208 - protein, 28 aa, Mycobacterium
LTGGRALIGRFLAALARFPHARTHLGAP

SEQ ID NO: 1301209 - protein, 17 aa, Mycobacterium
LTGLLGARQGTLQTTAR

SEQ ID NO: 1301210 - protein, 30 aa, Mycobacterium
LTGRPAISLPLHWTADGLPLGVQFVAPLAG

SEQ ID NO: 1301211 - protein, 21 aa, Mycobacterium
LTGSAPLGWYTGRDSPQTRRL

SEQ ID NO: 1301212 - protein, 20 aa, Mycobacterium
LTGVIPATEKVLAKAGLTLA

SEQ ID NO: 1301213 - protein, 24 aa, Mycobacterium
LTHPQYLVMLVLWDHRKSADSPLS

SEQ ID NO: 1301214 - protein, 19 aa, Mycobacterium
LTIRVGGNEAAFLFAITVG

SEQ ID NO: 1301215 - protein, 21 aa, Mycobacterium
LTLHPRFGRWLQLGGHCEPDD

SEQ ID NO: 1301216 - protein, 26 aa, Mycobacterium
LTLTNPDILRRLLETVYQQIADGVLP

SEQ ID NO: 1301217 - protein, 32 aa, Mycobacterium
LTLVHKNNVLTFAGALWWRTVQEVGAEYPDVE

SEQ ID NO: 1301218 - protein, 19 aa, Mycobacterium
LTMLASMLARFHATADRRA

SEQ ID NO: 1301219 - protein, 17 aa, Mycobacterium
LTNMRTLFDGEQRFTAE

SEQ ID NO: 1301220 - protein, 20 aa, Mycobacterium
LTNPDKPYFPKLGKDGTKGK

SEQ ID NO: 1301221 - protein, 19 aa, Mycobacterium
LTPEERLLRAIFGEKAREV

SEQ ID NO: 1301222 - protein, 20 aa, Mycobacterium
LTPLHHQSGLLVSLGGAVVG

SEQ ID NO: 1301223 - protein, 29 aa, Mycobacterium
LTPPVLRRNILENPAWYTAYTPYQPEISQ

SEQ ID NO: 1301224 - protein, 24 aa, Mycobacterium
LTPQALIDLVASRSYCITSPADVR

SEQ ID NO: 1301225 - protein, 17 aa, Mycobacterium
LTQLIIDPQFELTGVWV

SEQ ID NO: 1301226 - protein, 21 aa, Mycobacterium
LTRFARSVTVIHRREEFRASR

SEQ ID NO: 1301227 - protein, 19 aa, Mycobacterium
LTSKPWVKTTMAPGSQVVT

SEQ ID NO: 1301228 - protein, 32 aa, Mycobacterium
LTSSDRYLCINPFFHNFGYKAGILTCLQTGAT

SEQ ID NO: 1301229 - protein, 28 aa, Mycobacterium
LTSTFGPTTGLWILLLAKGGGDDTVSAA

SEQ ID NO: 1301230 - protein, 22 aa, Mycobacterium
LTTAVWPGTTPRLLHVPAGRED

SEQ ID NO: 1301231 - protein, 27 aa, Mycobacterium
LTTDDIRWFDLYSCFPSAIEMAAEALD

SEQ ID NO: 1301232 - protein, 18 aa, Mycobacterium
LTVLLTELSSIWLSGNDI

SEQ ID NO: 1301233 - protein, 17 aa, Mycobacterium
LTVPGYGWRHHPAAAMW

SEQ ID NO: 1301234 - protein, 17 aa, Mycobacterium
LTVTIPMAERAKPRKIE

SEQ ID NO: 1301235 - protein, 23 aa, Mycobacterium
LTYQMMYELRDFGFSTAIGIGGD

SEQ ID NO: 1301236 - protein, 17 aa, Mycobacterium
LTYRTPVIILSDGAIAN

SEQ ID NO: 1301237 - protein, 26 aa, Mycobacterium
LVAAGVRPWQRDLVVPVLTAALAPST

SEQ ID NO: 1301238 - protein, 22 aa, Mycobacterium
LVAAHLQWHLERQLRTLPLVER

SEQ ID NO: 1301239 - protein, 26 aa, Mycobacterium
LVADIMERRLDRARPLWECWVIEGLS

SEQ ID NO: 1301240 - protein, 23 aa, Mycobacterium
LVAELLDAWHKPIDLGVAHCLYA

SEQ ID NO: 1301241 - protein, 19 aa, Mycobacterium
LVAGGPLVLRAAAPGQIVP

SEQ ID NO: 1301242 - protein, 22 aa, Mycobacterium
LVAIENAIWPDLFIAGGGISRK

SEQ ID NO: 1301243 - protein, 29 aa, Mycobacterium
LVAPEMNMGQLALLLRGRYLADVQSVTKV

SEQ ID NO: 1301244 - protein, 24 aa, Mycobacterium
LVARPLLASLRPELTCLLQPLGGE

SEQ ID NO: 1301245 - protein, 23 aa, Mycobacterium
LVARQITNYRWALSAFGTASAAN

SEQ ID NO: 1301246 - protein, 20 aa, Mycobacterium
LVARRRGITVLGDRPPMVSV

SEQ ID NO: 1301247 - protein, 25 aa, Mycobacterium
LVCGSVLGPYLSTAGRRTAAKRFAR

SEQ ID NO: 1301248 - protein, 21 aa, Mycobacterium
LVDAALPHLLAAGGGSIVTIS

SEQ ID NO: 1301249 - protein, 26 aa, Mycobacterium
LVDEVGPRRAAWAAALYLPKNYGATT

SEQ ID NO: 1301250 - protein, 24 aa, Mycobacterium
LVDFAPFLEITPQAWQKLIDVNLT

SEQ ID NO: 1301251 - protein, 23 aa, Mycobacterium
LVDMRPDDLAAQMVRAALDKVPS

SEQ ID NO: 1301252 - protein, 32 aa, Mycobacterium; identical to SEQ ID NO: 785201

SEQ ID NO: 1301253 - protein, 23 aa, Mycobacterium
LVDQWDAMIDVNVRGLLNGIAAA

SEQ ID NO: 1301254 - protein, 17 aa, Mycobacterium
LVEGWRLHPGSDPVAAQ

SEQ ID NO: 1301255 - protein, 17 aa, Mycobacterium
LVELRPDIDWDKGTTLR

SEQ ID NO: 1301256 - protein, 24 aa, Mycobacterium
LVERERPFLVLTNNSIFTPRDLAA

SEQ ID NO: 1301257 - protein, 30 aa, Mycobacterium; identical to SEQ ID NO: 837599

SEQ ID NO: 1301258 - protein, 28 aa, Mycobacterium
LVGAVRRLLSDLQFPVLSDLGLGAEHLD

SEQ ID NO: 1301259 - protein, 18 aa, Mycobacterium
LVGEHLIGALYAHGTAGA

SEQ ID NO: 1301260 - protein, 30 aa, Mycobacterium
LVGELIERRPGWPQARWLRVAIHHRTQRWS

SEQ ID NO: 1301261 - protein, 17 aa, Mycobacterium
LVGKQRTGRFLRAAHRA

SEQ ID NO: 1301262 - protein, 27 aa, Mycobacterium
LVGMGRALIAPLRIALREAGVPVLLNT

SEQ ID NO: 1301263 - protein, 25 aa, Mycobacterium
LVGNNIPVFFIQDGIKFPDVVHAAK

SEQ ID NO: 1301264 - protein, 24 aa, Mycobacterium
LVGSPIRIAGYRPDYRPPPQLPEA

SEQ ID NO: 1301265 - protein, 19 aa, Mycobacterium
LVGVDYYRPTGRGAEREIG

SEQ ID NO: 1301266 - protein, 18 aa, Mycobacterium
LVGVPRDLPGLSPAWRQA

SEQ ID NO: 1301267 - protein, 18 aa, Mycobacterium
LVIGWLLQQQAAVAIGAL

SEQ ID NO: 1301268 - protein, 18 aa, Mycobacterium
LVIIPTYNERENLPLIVK

SEQ ID NO: 1301269 - protein, 26 aa, Mycobacterium
LVIKEALRLLAPVPLVMRKTVRDVAI

SEQ ID NO: 1301270 - protein, 20 aa, Mycobacterium
LVINESLRLVTPLPFNVRQT

SEQ ID NO: 1301271 - protein, 19 aa, Mycobacterium
LVISSPRLRALDTAKLAGL

SEQ ID NO: 1301272 - protein, 27 aa, Mycobacterium
LVKDIKINWVWNPPWGPDKITEDGREQ

SEQ ID NO: 1301273 - protein, 25 aa, Mycobacterium
LVKVTPMDFLHDTLLWAKLIHKYRG

SEQ ID NO: 1301274 - protein, 17 aa, Mycobacterium
LVLDFGGGVLGALQRHA

SEQ ID NO: 1301275 - protein, 24 aa, Mycobacterium
LVLDQLMYPAMMFGAAGAWSIDVC

SEQ ID NO: 1301276 - protein, 21 aa, Mycobacterium
LVLRADLLRPWANWVTPEEER

SEQ ID NO: 1301277 - protein, 19 aa, Mycobacterium
LVLSGFVDRVGDPVPLVAS

SEQ ID NO: 1301278 - protein, 29 aa, Mycobacterium
LVNNAGIMPLSRLDALLVDQWDAMIDVNV

SEQ ID NO: 1301279 - protein, 23 aa, Mycobacterium
LVNNAGVGLFAPLGAITVEDFDA

SEQ ID NO: 1301280 - protein, 17 aa, Mycobacterium
LVNPLYLFHGDAPVKEF

SEQ ID NO: 1301281 - protein, 19 aa, Mycobacterium
LVPGHTILDETVAARAPWS

SEQ ID NO: 1301282 - protein, 29 aa, Mycobacterium
LVPPDRELAFLHPLPVRRLWGVGEKTAAK

SEQ ID NO: 1301283 - protein, 19 aa, Mycobacterium
LVPRHLVRAMTRTVGRGRG

SEQ ID NO: 1301284 - protein, 21 aa, Mycobacterium
LVPVYPTCHYVMGGIPTTVHG

SEQ ID NO: 1301285 - protein, 18 aa, Mycobacterium
LVQMYREAKERLGDPVLA

SEQ ID NO: 1301286 - protein, 19 aa, Mycobacterium
LVRAALPIMRAQGGGTIVQ

SEQ ID NO: 1301287 - protein, 19 aa, Mycobacterium
LVRAIFFEGFRRLGRDLAS

SEQ ID NO: 1301288 - protein, 20 aa, Mycobacterium
LVREDFADAVAWVARNLPTR

SEQ ID NO: 1301289 - protein, 25 aa, Mycobacterium
LVREFTLEFPTRVIARLLGLPEEDL

SEQ ID NO: 1301290 - protein, 17 aa, Mycobacterium
LVRICGDTPIAEALAQV

SEQ ID NO: 1301291 - protein, 19 aa, Mycobacterium
LVRLVEVLLVEAMRLRAAP

SEQ ID NO: 1301292 - protein, 25 aa, Mycobacterium
LVRPTQLSFVPRIWDMLFQEFVGEV

SEQ ID NO: 1301293 - protein, 17 aa, Mycobacterium
LVRSRWAHDLVAPRPVV

SEQ ID NO: 1301294 - protein, 26 aa, Mycobacterium
LVRTVHSYAFAVLRLAAQRNGDAPPR

SEQ ID NO: 1301295 - protein, 17 aa, Mycobacterium
LVSVFLDKDFSFVVSSE

SEQ ID NO: 1301296 - protein, 26 aa, Mycobacterium
LVSVHPIFNLYNKRWPIRGESENLAP

SEQ ID NO: 1301297 - protein, 18 aa, Mycobacterium
LVTGQLPFAALRSLVASA

SEQ ID NO: 1301298 - protein, 27 aa, Mycobacterium
LVTKAAVEPVWWLPGVAQRFGCSETDL

SEQ ID NO: 1301299 - protein, 18 aa, Mycobacterium
LVTSWRPIDGAAEALRVL

SEQ ID NO: 1301300 - protein, 24 aa, Mycobacterium
LVVASVRLGDMISLGIVSYEPGRT

SEQ ID NO: 1301301 - protein, 18 aa, Mycobacterium
LVVDFVRARGYSAIVKGL

SEQ ID NO: 1301302 - protein, 23 aa, Mycobacterium
LVVTAHVLAIDPASWRVVIGELD

SEQ ID NO: 1301303 - protein, 18 aa, Mycobacterium
LWPDYDRRDLWAACEEYV

SEQ ID NO: 1301304 - protein, 19 aa, Mycobacterium
LWQIVEFQHVKPGKGPAFV

SEQ ID NO: 1301305 - protein, 17 aa, Mycobacterium
LWTQKRSIFARGEGGFG

SEQ ID NO: 1301306 - protein, 21 aa, Mycobacterium
LWVTDLTFVPTWAGVAYVCFI

SEQ ID NO: 1301307 - protein, 23 aa, Mycobacterium
LYAERLMAELGWLDDDGARMGML

SEQ ID NO: 1301308 - protein, 17 aa, Mycobacterium
LYAVRRRANLTISETAQ

SEQ ID NO: 1301309 - protein, 26 aa, Mycobacterium
LYDDLYGTWLELYPATRSQVHRLAAA

SEQ ID NO: 1301310 - protein, 22 aa, Mycobacterium
LYEQWITRLWAGEPVAAELVTD

SEQ ID NO: 1301311 - protein, 25 aa, Mycobacterium
LYGEPAPQLLLLDEPTNNLDLVSVG

SEQ ID NO: 1301312 - protein, 19 aa, Mycobacterium
LYKKSAVLFGLDLAKRDIA

SEQ ID NO: 1301313 - protein, 21 aa, Mycobacterium
LYLGRAKRCATTAQRLALFAR

SEQ ID NO: 1301314 - protein, 20 aa, Mycobacterium
LYPFVLPPPVLDKMRFIHHV

SEQ ID NO: 1301315 - protein, 17 aa, Mycobacterium
LYSLFEEQLRREAADNA

SEQ ID NO: 1301316 - protein, 22 aa, Mycobacterium
LYYDPFDFVIDDDPYPVWKRMR

SEQ ID NO: 1301317 - protein, 37 aa, Mycobacterium
MAALVSFWMHPDAVYLSPAPLYHTAPSVWSMQTQAGG

SEQ ID NO: 1301318 - protein, 25 aa, Mycobacterium
MADDVVLELGWGRLIFGQTFADPEK

SEQ ID NO: 1301319 - protein, 19 aa, Mycobacterium
MADLHMRWMDLPGPTDVMS

SEQ ID NO: 1301320 - protein, 40 aa, Mycobacterium
MAEAMLHSDYPLQALLYCVVLHRFLRWRQPGYDPAKHLGG

SEQ ID NO: 1301321 - protein, 25 aa, Mycobacterium
MAEDVLDRAIALRGLTAGPCRTRDL

SEQ ID NO: 1301322 - protein, 19 aa, Mycobacterium
MAEFYASLLDAYPLVSIED

SEQ ID NO: 1301323 - protein, 25 aa, Mycobacterium
MAGAELLLGARRPTVAPSSTSLYVY

SEQ ID NO: 1301324 - protein, 29 aa, Mycobacterium
MAIDGRGMFLCCKFAIEAMLPTGGGAIVC

SEQ ID NO: 1301325 - protein, 24 aa, Mycobacterium
MAKGTYAMIVLATKDLDAAFERLQ

SEQ ID NO: 1301326 - protein, 41 aa, Mycobacterium
MAKVPYYRVLELAPWLNWPQPNFPVSNFFHAGAAPLNAVLA

SEQ ID NO: 1301327 - protein, 18 aa, Mycobacterium
MALGARLGAHLHAGDVVV

SEQ ID NO: 1301328 - protein, 26 aa, Mycobacterium
MALGKNLLVAIMPWEGHNYEDAIILS

SEQ ID NO: 1301329 - protein, 20 aa, Mycobacterium
MANRRMALYALPRTPADAPP

SEQ ID NO: 1301330 - protein, 25 aa, Mycobacterium
MAPADLIAEYGPHIALPPTDLEMAE

SEQ ID NO: 1301331 - protein, 27 aa, Mycobacterium
MAPENVSPLVVWLGSTESRDITGQVFE

SEQ ID NO: 1301332 - protein, 19 aa, Mycobacterium
MAPQLPMLVDALAPTVDLW

SEQ ID NO: 1301333 - protein, 17 aa, Mycobacterium
MAPSLATMLCVLTTDAV

SEQ ID NO: 1301334 - protein, 22 aa, Mycobacterium
MARHVLCFRTLWEATFGQLLKE

SEQ ID NO: 1301335 - protein, 27 aa, Mycobacterium
MARPMYRARGWVPWRGPTSVLSPGGRI

SEQ ID NO: 1301336 - protein, 23 aa, Mycobacterium
MARPVIPVFINSVATPLGPLRRT

SEQ ID NO: 1301337 - protein, 32 aa, Mycobacterium
MARRSGVMRMTWWPLGVLVFLEVSLGNYSQAL

SEQ ID NO: 1301338 - protein, 26 aa, Mycobacterium
MATALQTSRTLLWRAAGALDENHPDK

SEQ ID NO: 1301339 - protein, 19 aa, Mycobacterium
MATIMVAELTRRGVLAGDG

SEQ ID NO: 1301340 - protein, 17 aa, Mycobacterium
MAVNPAMTAFLENYPDG

SEQ ID NO: 1301341 - protein, 28 aa, Mycobacterium
MAVRTRFFDDFFLSSGLPQAVILASGLD

SEQ ID NO: 1301342 - protein, 29 aa, Mycobacterium
MAVVDGKWKPLILWELQDGPKRFNALHRS

SEQ ID NO: 1301343 - protein, 20 aa, Mycobacterium
MCGWLKDRFGVSWQIVPDRL

SEQ ID NO: 1301344 - protein, 26 aa, Mycobacterium
MDADAVIYSPLLPDPNEVAALLRSGK

SEQ ID NO: 1301345 - protein, 22 aa, Mycobacterium
MDAFSLLCRTEGIIPAIESAHA

SEQ ID NO: 1301346 - protein, 28 aa, Mycobacterium
MDAPQHTRLRKIISRGFTPRAVGRLEDE

SEQ ID NO: 1301347 - protein, 20 aa, Mycobacterium
MDPEGILNVALRDLAKDLGE

SEQ ID NO: 1301348 - protein, 22 aa, Mycobacterium
MDSLLSIVQMPAGVPVATVSIG

SEQ ID NO: 1301349 - protein, 24 aa, Mycobacterium
MDTSDFRLLVNPTGKFVLGGPMGD

SEQ ID NO: 1301350 - protein, 19 aa, Mycobacterium
MDYLKEGIGLRAMAQRDPL

SEQ ID NO: 1301351 - protein, 18 aa, Mycobacterium
MEAGPMIRKGAMKSQPWI

SEQ ID NO: 1301352 - protein, 19 aa, Mycobacterium
MEFGYVMKNYGVDVTIVEF

SEQ ID NO: 1301353 - protein, 18 aa, Mycobacterium
MEGILAVLAEHVGDVRGG

SEQ ID NO: 1301354 - protein, 17 aa, Mycobacterium
MELAPKRITINAVLPGN

SEQ ID NO: 1301355 - protein, 18 aa, Mycobacterium
MELVGFPRPVNPRPRLAT

SEQ ID NO: 1301356 - protein, 29 aa, Mycobacterium
MEMPIWEFPTRFDKICMPEWIPEGTRVVN

SEQ ID NO: 1301357 - protein, 19 aa, Mycobacterium
MEREGLEIPLLIGGATTSR

SEQ ID NO: 1301358 - protein, 18 aa, Mycobacterium
MERLAPLGPVYQAGTLSG

SEQ ID NO: 1301359 - protein, 17 aa, Mycobacterium
METVGVDKIVFSSSAAT

SEQ ID NO: 1301360 - protein, 23 aa, Mycobacterium
MEVFARYSGTLLAADDAPRVIEG

SEQ ID NO: 1301361 - protein, 24 aa, Mycobacterium
MFGALGLDLRRVLHGECGWEYFAP

SEQ ID NO: 1301362 - protein, 25 aa, Mycobacterium
MFMISHFHYDPVWWNTQGAYTSVWT

SEQ ID NO: 1301363 - protein, 17 aa, Mycobacterium
MFQQLPTAGLPFQFQSW

SEQ ID NO: 1301364 - protein, 17 aa, Mycobacterium
MFRMMNEARLGVGMGAV

SEQ ID NO: 1301365 - protein, 32 aa, Mycobacterium
MFSEHMLLHPMSAPMTLRWLRDRFAGRPLSEH

SEQ ID NO: 1301366 - protein, 21 aa, Mycobacterium
MFSLHVKATMMKVSHPIVFGH

SEQ ID NO: 1301367 - protein, 17 aa, Mycobacterium
MGAAAWAAGAAGLAAGA

SEQ ID NO: 1301368 - protein, 36 aa, Mycobacterium
MGAGICQWFHGDATYRAVLSLLLLTGSMGRNGGGWA

SEQ ID NO: 1301369 - protein, 23 aa, Mycobacterium
MGAPLAEIAASAGPLPLAVSVDE

SEQ ID NO: 1301370 - protein, 30 aa, Mycobacterium
MGAQFIRAGAIIQLLLGNIGRPGGGVFALR

SEQ ID NO: 1301371 - protein, 25 aa, Mycobacterium
MGCVFQDFRLLQQKTVFENVAFALE

SEQ ID NO: 1301372 - protein, 21 aa, Mycobacterium
MGEAWWVPIVQIPGDTIDGHP

SEQ ID NO: 1301373 - protein, 25 aa, Mycobacterium
MGEVRVPKDALWRAQTQRAVENFPI

SEQ ID NO: 1301374 - protein, 22 aa, Mycobacterium
MGGLHAWCLAATRPDLVNAVVV

SEQ ID NO: 1301375 - protein, 25 aa, Mycobacterium
MGGRPVVAVNLLGWPRDVLPFELAA

SEQ ID NO: 1301376 - protein, 17 aa, Mycobacterium
MGINPFFDAPYEDVAKG

SEQ ID NO: 1301377 - protein, 17 aa, Mycobacterium
MGIPARYVSGYLHPRKD

SEQ ID NO: 1301378 - protein, 27 aa, Mycobacterium
MGMGGSIPFIAEFAAAFPQATILVTGV

SEQ ID NO: 1301379 - protein, 18 aa, Mycobacterium
MGPYTLPPYNVGEPVSIQ

SEQ ID NO: 1301380 - protein, 20 aa, Mycobacterium
MGRAIVRNPKAFLMDEPLSN

SEQ ID NO: 1301381 - protein, 20 aa, Mycobacterium
MGRHAGWIALNAGLASGAHM

SEQ ID NO: 1301382 - protein, 27 aa, Mycobacterium
MGRIDPRTRWLLRELVYALLVKKDHAA

SEQ ID NO: 1301383 - protein, 39 aa, Mycobacterium
MGSAYLFNGQFLSLPWFYRSGYDVLLYTLPFHGRRAEKY

SEQ ID NO: 1301384 - protein, 24 aa, Mycobacterium
MGTDGFFVKALHSLGAPLEPGEKD

SEQ ID NO: 1301385 - protein, 24 aa, Mycobacterium
MGVEHGFIRKSGSWFTYEGEQLGQ

SEQ ID NO: 1301386 - protein, 26 aa, Mycobacterium
MGVFFNSMDYLYRPVSYTPSRTVTDG

SEQ ID NO: 1301387 - protein, 17 aa, Mycobacterium
MGWDLPWVSSGASTFNE

SEQ ID NO: 1301388 - protein, 27 aa, Mycobacterium
MHALRDGVIPLQFLFSGTLFTRGERGF

SEQ ID NO: 1301389 - protein, 17 aa, Mycobacterium
MHDTVVFSLLHGGVDSP

SEQ ID NO: 1301390 - protein, 18 aa, Mycobacterium
MHGGIGFTWEHPAHLYLR

SEQ ID NO: 1301391 - protein, 25 aa, Mycobacterium
MHGLERRYLLVPGLRSSRVHVFDTR

SEQ ID NO: 1301392 - protein, 18 aa, Mycobacterium
MHHTLRSLGLGEQVDAAI

SEQ ID NO: 1301393 - protein, 30 aa, Mycobacterium
MHTSICSTVFLRRTALPSAAPFDEWIGTGS

SEQ ID NO: 1301394 - protein, 39 aa, Mycobacterium
MIAATERGLLLTTLWYIREVDPTVLLLTGLTRDGVYLIE

SEQ ID NO: 1301395 - protein, 23 aa, Mycobacterium
MIASFAAHLIAAGAPPSPLEAAS

SEQ ID NO: 1301396 - protein, 31 aa, Mycobacterium
MICTVGNYEYGFFWYFYNDASMEVEVKLSGV

SEQ ID NO: 1301397 - protein, 25 aa, Mycobacterium
MIENGIVPELLLGQKYGHAIHFWDL

SEQ ID NO: 1301398 - protein, 17 aa, Mycobacterium
MIIALRAPADGPIGDSG

SEQ ID NO: 1301399 - protein, 22 aa, Mycobacterium
MIKRYFGGSHLLPGVPLDRIVA

SEQ ID NO: 1301400 - protein, 26 aa, Mycobacterium
MILPGQSLLVYEMTPALFAAVAANEA

SEQ ID NO: 1301401 - protein, 34 aa, Mycobacterium
MISPMIGHYISFMTPAAFVRRPGRWIREMARKEG

SEQ ID NO: 1301402 - protein, 29 aa, Mycobacterium
MIVAGGHSLLPMMKLRIANPEYLVDINDL

SEQ ID NO: 1301403 - protein, 19 aa, Mycobacterium
MIWVETPTNPLLSIADIAG

SEQ ID NO: 1301404 - protein, 22 aa, Mycobacterium
MKADHGLVLPRRLQIEFSQAIQ

SEQ ID NO: 1301405 - protein, 17 aa, Mycobacterium
MKANRYLHDHQISHATL

SEQ ID NO: 1301406 - protein, 25 aa, Mycobacterium
MKLTPERYIHELLVERLHVVEVVVG

SEQ ID NO: 1301407 - protein, 22 aa, Mycobacterium
MKTWVETLLDMHLVEGYGSTEA

SEQ ID NO: 1301408 - protein, 25 aa, Mycobacterium
MLAEHAPHPTQWVRVWFADGDKQHQ

SEQ ID NO: 1301409 - protein, 18 aa, Mycobacterium
MLDLFGGDTAKLADLERR

SEQ ID NO: 1301410 - protein, 17 aa, Mycobacterium
MLDLYQNEGIIAEPAGA

SEQ ID NO: 1301411 - protein, 23 aa, Mycobacterium
MLDTLIKEKWLTANGVIGFFPAN

SEQ ID NO: 1301412 - protein, 25 aa, Mycobacterium
MLDTYVPGRWVYRPLSVNYRTPAEI

SEQ ID NO: 1301413 - protein, 24 aa, Mycobacterium
MLETQILGLTYYPVTYHQMLGRPW

SEQ ID NO: 1301414 - protein, 33 aa, Mycobacterium
MLHGEPSWSFLYRKMIPILAGAGFRVVCPDLVG

SEQ ID NO: 1301415 - protein, 17 aa, Mycobacterium
MLIRAMPAIRRRVPGAT

SEQ ID NO: 1301416 - protein, 25 aa, Mycobacterium
MLLSALREHGTLRRFVPFDVDASVL

SEQ ID NO: 1301417 - protein, 17 aa, Mycobacterium
MLMFVAHRAAETRIHEA

SEQ ID NO: 1301418 - protein, 18 aa, Mycobacterium
MLRARAAPLLARHGLAGG

SEQ ID NO: 1301419 - protein, 21 aa, Mycobacterium
MLRLVEAFGYGWSDLARFTIN

SEQ ID NO: 1301420 - protein, 25 aa, Mycobacterium
MLRRQAPHLLPFRGDASLTPTDAVP

SEQ ID NO: 1301421 - protein, 18 aa, Mycobacterium
MLSGKPFKKQAAIAKLVA

SEQ ID NO: 1301422 - protein, 28 aa, Mycobacterium
MLSMAYLGRLITSWVPQSQLRSLSTRFS

SEQ ID NO: 1301423 - protein, 29 aa, Mycobacterium
MLSTRLPRYLVPHHIAVLDELPLTAHGKI

SEQ ID NO: 1301424 - protein, 17 aa, Mycobacterium
MLTELGVPPGRLRMLRS

SEQ ID NO: 1301425 - protein, 26 aa, Mycobacterium
MLVAGEDPRFIARRLMILASEDIGMA

SEQ ID NO: 1301426 - protein, 17 aa, Mycobacterium
MLWLSDITEHYTGEGKL

SEQ ID NO: 1301427 - protein, 21 aa, Mycobacterium
MMEYPIARLYNDARVARIYAG

SEQ ID NO: 1301428 - protein, 18 aa, Mycobacterium
MMVRLLLSRVGDSGSSPA

SEQ ID NO: 1301429 - protein, 23 aa, Mycobacterium
MNFEYGLNCILDHAARLIEQQDT

SEQ ID NO: 1301430 - protein, 19 aa, Mycobacterium
MNMSMDGAWGQWVNRWTAE

SEQ ID NO: 1301431 - protein, 29 aa, Mycobacterium
MNQPRPVRRRYLSLMFDALNPAAAEPLTT

SEQ ID NO: 1301432 - protein, 17 aa, Mycobacterium
MNRTFDGIPALLADLRA

SEQ ID NO: 1301433 - protein, 19 aa, Mycobacterium
MPDEVAIQALWSITAPGTP

SEQ ID NO: 1301434 - protein, 24 aa, Mycobacterium
MPDGRNYMWVARTVERRASRYGQP

SEQ ID NO: 1301435 - protein, 26 aa, Mycobacterium
MPEALSVFLAPPSWEVLERRLVGRGT

SEQ ID NO: 1301436 - protein, 25 aa, Mycobacterium
MPGFTTISMYPRMWAASGVDYPTLL

SEQ ID NO: 1301437 - protein, 23 aa, Mycobacterium
MPGLTIPGKLDKLGYKGIDTTEL

SEQ ID NO: 1301438 - protein, 26 aa, Mycobacterium
MPGRLKAVAALFPTVSRPPAEQPAAS

SEQ ID NO: 1301439 - protein, 20 aa, Mycobacterium
MPGVEYYAHPWEFGPRKAKE

SEQ ID NO: 1301440 - protein, 24 aa, Mycobacterium
MPKGVLWRQHDIFMTAFGGRSLYG

SEQ ID NO: 1301441 - protein, 33 aa, Mycobacterium
MPKHPSLQWIPDWMWRLNLKVLGPFAVWVTVGL

SEQ ID NO: 1301442 - protein, 22 aa, Mycobacterium
MPMPRALQWALIEHVLGANPAA

SEQ ID NO: 1301443 - protein, 34 aa, Mycobacterium
MPPAPAVVAARRLWAMGFPFHARRRFTGVQLEAT

SEQ ID NO: 1301444 - protein, 34 aa, Mycobacterium
MPQWARDWQRLLFDNGWLLPAQPPEFGGRNASVL

SEQ ID NO: 1301445 - protein, 23 aa, Mycobacterium
MPREYAMVLTPLHTLIADIIRRG

SEQ ID NO: 1301446 - protein, 27 aa, Mycobacterium
MPVEEQFWGDRYGVLRDPFGHLWSMGQ

SEQ ID NO: 1301447 - protein, 23 aa, Mycobacterium
MQIKAIFSVLLREYEFEMAQPPE

SEQ ID NO: 1301448 - protein, 19 aa, Mycobacterium
MRAAVIRCLYPVNRGGQGL

SEQ ID NO: 1301449 - protein, 28 aa, Mycobacterium
MRAVSEVRALVRWLLPQSTTVVVSGVSM

SEQ ID NO: 1301450 - protein, 27 aa, Mycobacterium
MRDAQPNYFLPLDKAGIDPFVTAYPVR

SEQ ID NO: 1301451 - protein, 20 aa, Mycobacterium
MRDLGCEYAILYFPEAAYDR

SEQ ID NO: 1301452 - protein, 24 aa, Mycobacterium
MRDLRRFMSGPAYARRLTAQALDA

SEQ ID NO: 1301453 - protein, 20 aa, Mycobacterium
MRDTFGIRTFKVKVGRRPVS

SEQ ID NO: 1301454 - protein, 18 aa, Mycobacterium
MREGQTLFTYLHLAASQP

SEQ ID NO: 1301455 - protein, 19 aa, Mycobacterium
MREIGYLFGQYKRITNRYE

SEQ ID NO: 1301456 - protein, 30 aa, Mycobacterium
MRFQELMPDVLHWFGIRKIHRLVSMSNMKY

SEQ ID NO: 1301457 - protein, 25 aa, Mycobacterium
MRGHTAFLISARRLAPGAIAPIPLR

SEQ ID NO: 1301458 - protein, 23 aa, Mycobacterium
MRLNAMLDQIPLLTRNIAHSDDQ

SEQ ID NO: 1301459 - protein, 25 aa, Mycobacterium
MRLPELPEHIIIAGGGYVAAEFAHI

SEQ ID NO: 1301460 - protein, 17 aa, Mycobacterium
MRRFNGATLEALLTRLN

SEQ ID NO: 1301461 - protein, 19 aa, Mycobacterium
MRRILDKFGAHWERDDLGV

SEQ ID NO: 1301462 - protein, 19 aa, Mycobacterium
MRRVADDLLALFAHALRLS

SEQ ID NO: 1301463 - protein, 25 aa, Mycobacterium
MRSCTGWPSGTWIDPPRRTAPDGSN

SEQ ID NO: 1301464 - protein, 18 aa, Mycobacterium
MRTLAFDVLDLRGVTLVG

SEQ ID NO: 1301465 - protein, 25 aa, Mycobacterium
MSAGVIEVAPLAYMRGRTISDAFII

SEQ ID NO: 1301466 - protein, 21 aa, Mycobacterium
MSAMFYGFREREEILSVFEMI

SEQ ID NO: 1301467 - protein, 20 aa, Mycobacterium
MSARHPGNIAALAAIAPPSI

SEQ ID NO: 1301468 - protein, 27 aa, Mycobacterium
MSIDKFAPQISFFFYTHGDFFEEIAKY

SEQ ID NO: 1301469 - protein, 18 aa, Mycobacterium
MSMFGLHRALRGAAVGHF

SEQ ID NO: 1301470 - protein, 19 aa, Mycobacterium
MSPALLSKRLKSLIRAGVV

SEQ ID NO: 1301471 - protein, 26 aa, Mycobacterium
MSQHITTEPALWPWADVLANAMVLDG

SEQ ID NO: 1301472 - protein, 19 aa, Mycobacterium
MSRVFTPRRMAAIEDQIRR

SEQ ID NO: 1301473 - protein, 19 aa, Mycobacterium
MSRVRFIKFIMDEIYPGGR

SEQ ID NO: 1301474 - protein, 26 aa, Mycobacterium
MSSEPLIDAIPLWRRPQDGAVITGWD

SEQ ID NO: 1301475 - protein, 26 aa, Mycobacterium
MTAAPNFAYALLAKRLRRQAKPGDFD

SEQ ID NO: 1301476 - protein, 27 aa, Mycobacterium
MTAAPNFAYTLFAKRLRRLATPGEFDL

SEQ ID NO: 1301477 - protein, 33 aa, Mycobacterium
MTADDRILAVLPFFHIYGMTVLLNAALHARAAL

SEQ ID NO: 1301478 - protein, 19 aa, Mycobacterium
MTDEIFGPILPIVTVQSLD

SEQ ID NO: 1301479 - protein, 17 aa, Mycobacterium
MTESMLELLLRELDVDP

SEQ ID NO: 1301480 - protein, 23 aa, Mycobacterium
MTFENWDAVLKVHLYGGYNVIRA

SEQ ID NO: 1301481 - protein, 22 aa, Mycobacterium
MTGYLTVPMYFGAELVKVTPMD

SEQ ID NO: 1301482 - protein, 17 aa, Mycobacterium
MTHLGYDIESPVWRHWV

SEQ ID NO: 1301483 - protein, 19 aa, Mycobacterium
MTINLIFNAIADKMPDLKP

SEQ ID NO: 1301484 - protein, 18 aa, Mycobacterium
MTRRLRFVAPSRALADAE

SEQ ID NO: 1301485 - protein, 17 aa, Mycobacterium
MTRTFVLGRAGKIEDWQ

SEQ ID NO: 1301486 - protein, 26 aa, Mycobacterium
MTSGHVVFMDLPIVFDMGIALEGKGD

SEQ ID NO: 1301487 - protein, 27 aa, Mycobacterium
MTVFEHLGRLLIIDCGVLFPGHDEPGV

SEQ ID NO: 1301488 - protein, 19 aa, Mycobacterium
MTYAAPLFVTAEFINNNTG

SEQ ID NO: 1301489 - protein, 18 aa, Mycobacterium
MVAAARWITAASLAREET

SEQ ID NO: 1301490 - protein, 27 aa, Mycobacterium
MVAECALIFGCDWLNIPIDAPGSSLVT

SEQ ID NO: 1301491 - protein, 26 aa, Mycobacterium
MVDELERRGARRALITLCVGGGMGVA

SEQ ID NO: 1301492 - protein, 31 aa, Mycobacterium
MVGKRVLGTFPYRDLYMLDAARQFVPVAAHT

SEQ ID NO: 1301493 - protein, 29 aa, Mycobacterium
MVGSGPVFLQYPWQVLPEELIAPIEEATR

SEQ ID NO: 1301494 - protein, 17 aa, Mycobacterium
MVHPYVASKWAVRGLTK

SEQ ID NO: 1301495 - protein, 21 aa, Mycobacterium
MVKDYLIFPALSRSRWRRTLG

SEQ ID NO: 1301496 - protein, 18 aa, Mycobacterium
MVLAPHRGAKTRAKAAEQ

SEQ ID NO: 1301497 - protein, 18 aa, Mycobacterium
MVLFDRSWYNRAGVEKVM

SEQ ID NO: 1301498 - protein, 18 aa, Mycobacterium
MVLVKDIPMYSTCEHHLV

SEQ ID NO: 1301499 - protein, 26 aa, Mycobacterium
MVQDFSALFPIEIISRMIGVPAEDRQ

SEQ ID NO: 1301500 - protein, 31 aa, Mycobacterium
MVQSLLVRALVAWFWDEPLRAPLIRHGANLH

SEQ ID NO: 1301501 - protein, 23 aa, Mycobacterium
MVTVVLFRDGKPMRYFPIAAKGS

SEQ ID NO: 1301502 - protein, 18 aa, Mycobacterium
MVWKYPDTFVVGREQIRQ

SEQ ID NO: 1301503 - protein, 25 aa, Mycobacterium
MWAARRSGLYYVPINTHLTAAEVAY

SEQ ID NO: 1301504 - protein, 21 aa, Mycobacterium
MWFADFDGAWRYFYHDCDEDT

SEQ ID NO: 1301505 - protein, 17 aa, Mycobacterium
MWRYPVKSLGGEALEQA

SEQ ID NO: 1301506 - protein, 18 aa, Mycobacterium
MYVDALLEKGLAAEWGIC

SEQ ID NO: 1301507 - protein, 26 aa, Mycobacterium
MYVDSLKKALAAFGPIFVQLYGQGEA

SEQ ID NO: 1301508 - protein, 23 aa, Mycobacterium
NAAAFAFPTYILRGADLAGFLPQ

SEQ ID NO: 1301509 - protein, 18 aa, Mycobacterium
NADPLPPTPRRPLREVVS

SEQ ID NO: 1301510 - protein, 22 aa, Mycobacterium
NADPYLQEALRWLPASDPESDS

SEQ ID NO: 1301511 - protein, 24 aa, Mycobacterium
NAGCVWINDHIPIISEMPHGGVGA

SEQ ID NO: 1301512 - protein, 23 aa, Mycobacterium
NAGVEQFGYLWDTPVENWQRVVD

SEQ ID NO: 1301513 - protein, 26 aa, Mycobacterium
NAGVYAFDITALRSALRRLRSDNAQH

SEQ ID NO: 1301514 - protein, 23 aa, Mycobacterium
NAHILPVPMMNILNGGAHADTGV

SEQ ID NO: 1301515 - protein, 22 aa, Mycobacterium
NALFAPILSQLYPDVAAQLPGL

SEQ ID NO: 1301516 - protein, 27 aa, Mycobacterium
NALHQGLGLQVPPYDYAHPDDLLATAK

SEQ ID NO: 1301517 - protein, 17 aa, Mycobacterium
NAMMLQQKIAERTKLLS

SEQ ID NO: 1301518 - protein, 24 aa, Mycobacterium
NAMTPAMYFGIKYAVNHVGTDPDL

SEQ ID NO: 1301519 - protein, 20 aa, Mycobacterium
NAPALKLFLGDSFEGIVTVE

SEQ ID NO: 1301520 - protein, 29 aa, Mycobacterium
NAPAVLGWERWREIGAHYGLGVIEAMLAQ

SEQ ID NO: 1301521 - protein, 21 aa, Mycobacterium
NARIFQEEIFGPVVALSRFQT

SEQ ID NO: 1301522 - protein, 17 aa, Mycobacterium
NARYRMEQGFTFELNLA

SEQ ID NO: 1301523 - protein, 24 aa, Mycobacterium
NATVTSVAFLGSISRVYCTLSDGT

SEQ ID NO: 1301524 - protein, 25 aa, Mycobacterium
NAVAPGLVRTPLTSGALGVPGVEDE

SEQ ID NO: 1301525 - protein, 26 aa, Mycobacterium
NAVYGFTAMLINLLRDEQPSHVAAAF

SEQ ID NO: 1301526 - protein, 24 aa, Mycobacterium
NCPDILDVPLMAEVLRGLGATVEL

SEQ ID NO: 1301527 - protein, 24 aa, Mycobacterium
NCQSILGYVVRWIDAGVGCSKVPD

SEQ ID NO: 1301528 - protein, 17 aa, Mycobacterium
NCVFRRASLWHSTFRNC

SEQ ID NO: 1301529 - protein, 23 aa, Mycobacterium
NDDIVRALRVSPQQLRDIAEREG

SEQ ID NO: 1301530 - protein, 25 aa, Mycobacterium
NDEQRKRWFPGLADGTLLTAIAMTE

SEQ ID NO: 1301531 - protein, 25 aa, Mycobacterium
NDEVDELIWLPVREAMARLGYPHDR

SEQ ID NO: 1301532 - protein, 20 aa, Mycobacterium
NDFAGLLPIEGQRNRFLLVT

SEQ ID NO: 1301533 - protein, 20 aa, Mycobacterium
NDFIGIIDLVEMKAKVWRGE

SEQ ID NO: 1301534 - protein, 18 aa, Mycobacterium
NDHPFLYPRLVCPVCHDG

SEQ ID NO: 1301535 - protein, 24 aa, Mycobacterium
NDPAWIVFDSLHLKKYGFLAVEPD

SEQ ID NO: 1301536 - protein, 23 aa, Mycobacterium
NDPDWQRFHLIGATNTVYFAMLA

SEQ ID NO: 1301537 - protein, 27 aa, Mycobacterium
NDQVATLFRAWLRDAIRRVADGVLGVV

SEQ ID NO: 1301538 - protein, 23 aa, Mycobacterium
NDRVQLAALGAELNRRIVTAHQR

SEQ ID NO: 1301539 - protein, 38 aa, Mycobacterium
NDVMVSWLPCFHDMGMVGFLTIPMYFGAELVKVTPMDF

SEQ ID NO: 1301540 - protein, 24 aa, Mycobacterium
NDWFEVSLIPTTRELTILGTAPIG

SEQ ID NO: 1301541 - protein, 23 aa, Mycobacterium
NEAAFLYQLLVRSFGTNNLPDCS

SEQ ID NO: 1301542 - protein, 27 aa, Mycobacterium
NEDDLGRLNGYLLPLLGTDGRGGLTAR

SEQ ID NO: 1301543 - protein, 24 aa, Mycobacterium
NEENYLIKKLFTALGALQIENQAR

SEQ ID NO: 1301544 - protein, 23 aa, Mycobacterium
NEFDYFVRMWNQAAGAMDVYQAE

SEQ ID NO: 1301545 - protein, 21 aa, Mycobacterium
NEHIHAVMWAARRSGLYYVPI

SEQ ID NO: 1301546 - protein, 20 aa, Mycobacterium
NEILLEVRIPVRPNTSSAYT

SEQ ID NO: 1301547 - protein, 22 aa, Mycobacterium
NEMQMTPHLLIFGAPKSGKTTI

SEQ ID NO: 1301548 - protein, 17 aa, Mycobacterium
NERRRLRNQSVKSSLRT

SEQ ID NO: 1301549 - protein, 23 aa, Mycobacterium
NEYRYLVIGSPAGAYFPRGIKPV

SEQ ID NO: 1301550 - protein, 28 aa, Mycobacterium
NFASPFSPQTSFAPTTEFASRNDTDLLS

SEQ ID NO: 1301551 - protein, 27 aa, Mycobacterium
NFAVNPLEWVPVPPGRLVLQTLRSHDQ

SEQ ID NO: 1301552 - protein, 25 aa, Mycobacterium
NFEAMARAWGLADTKWHGLDVGSPF

SEQ ID NO: 1301553 - protein, 19 aa, Mycobacterium
NFRDVLNVLGLYPGDPGPI

SEQ ID NO: 1301554 - protein, 19 aa, Mycobacterium
NFTGGWLLRFMSGNLCHQI

SEQ ID NO: 1301555 - protein, 25 aa, Mycobacterium
NGAIKFATRPLKLANALPATVNTVL

SEQ ID NO: 1301556 - protein, 19 aa, Mycobacterium
NGAPALRRDVFGALPGLGR

SEQ ID NO: 1301557 - protein, 17 aa, Mycobacterium
NGCSPMLALLADELPAF

SEQ ID NO: 1301558 - protein, 18 aa, Mycobacterium
NGGTLPHFPLPLGDPAEP

SEQ ID NO: 1301559 - protein, 26 aa, Mycobacterium
NGHFYGVGLINWWDPKGTRSTLEELK

SEQ ID NO: 1301560 - protein, 19 aa, Mycobacterium
NGIDPLRFPGSLHAAEHAA

SEQ ID NO: 1301561 - protein, 18 aa, Mycobacterium
NGIHPQLLQVLHINPRTA

SEQ ID NO: 1301562 - protein, 27 aa, Mycobacterium
NGLDPEGIRWIRTLMRDLAGEGRTVFV

SEQ ID NO: 1301563 - protein, 23 aa, Mycobacterium
NGLQAPRSLWRSAGIPTTAPDGY

SEQ ID NO: 1301564 - protein, 17 aa, Mycobacterium
NGPLAVQAILRSIRETE

SEQ ID NO: 1301565 - protein, 18 aa, Mycobacterium
NGPWIADRLLELGVELAH

SEQ ID NO: 1301566 - protein, 30 aa, Mycobacterium; identical to SEQ ID NO: 840592

SEQ ID NO: 1301567 - protein, 26 aa, Mycobacterium
NGRDGLLMAPTYAVPRLLARNGLTLQ

SEQ ID NO: 1301568 - protein, 29 aa, Mycobacterium
NGSLPRLSAFSVAGWLRAKARTTAVSDVM

SEQ ID NO: 1301569 - protein, 22 aa, Mycobacterium
NGTAAILLAFYVAAAEKSGVPR

SEQ ID NO: 1301570 - protein, 17 aa, Mycobacterium
NGTLRSVGRGRHQLRTA

SEQ ID NO: 1301571 - protein, 27 aa, Mycobacterium
NGTVVRSWLQQLLAKALREDPGLAEIS

SEQ ID NO: 1301572 - protein, 25 aa, Mycobacterium
NHCAVALTALGWPPKIRRLPNPDDP

SEQ ID NO: 1301573 - protein, 21 aa, Mycobacterium
NHFVPNLTLGLPVVESLLKVT

SEQ ID NO: 1301574 - protein, 19 aa, Mycobacterium
NHNYIGTEHILLGLIHEGE

SEQ ID NO: 1301575 - protein, 17 aa, Mycobacterium
NHTHVLLCLAQSGSLTA

SEQ ID NO: 1301576 - protein, 32 aa, Mycobacterium
NHYPTGWAMAFNTPYKLFKRYASHEGGIADTA

SEQ ID NO: 1301577 - protein, 18 aa, Mycobacterium
NIAAGWMNRARRLLDGVP

SEQ ID NO: 1301578 - protein, 24 aa, Mycobacterium
NIADRIPLPGRRLGRRTPTTPTTA

SEQ ID NO: 1301579 - protein, 17 aa, Mycobacterium
NIEWIHPGASAISGTYH

SEQ ID NO: 1301580 - protein, 29 aa, Mycobacterium
NIGSYACFQAFPTISAYAASKGALAQLTR

SEQ ID NO: 1301581 - protein, 28 aa, Mycobacterium
NIPPTRFRRKPHWLDVRFSGDNAGVMPG

SEQ ID NO: 1301582 - protein, 21 aa, Mycobacterium
NIPVVDTWWQTETGAIMISPL

SEQ ID NO: 1301583 - protein, 22 aa, Mycobacterium
NIRLVIEWLDRYAEALPLTVIG

SEQ ID NO: 1301584 - protein, 30 aa, Mycobacterium
NKADAQWRWLAHTLTVDLLRELLPETADLP

SEQ ID NO: 1301585 - protein, 24 aa, Mycobacterium
NKGPQYAAMFGWPEPFADGADKKD

SEQ ID NO: 1301586 - protein, 25 aa, Mycobacterium
NKGWGWDEILPIFKGFENNEFGPSA

SEQ ID NO: 1301587 - protein, 28 aa, Mycobacterium
NKHEAALFRWMKSPLMPITPQAISSMFA

SEQ ID NO: 1301588 - protein, 21 aa, Mycobacterium
NKLEDLGGKAKETLGKATGDE

SEQ ID NO: 1301589 - protein, 26 aa, Mycobacterium
NKVPIYPGYVCAIVGSLLLGKPVKWM

SEQ ID NO: 1301590 - protein, 29 aa, Mycobacterium
NLEEGRLFSRFLPLLPMSEPMIETLLADS

SEQ ID NO: 1301591 - protein, 23 aa, Mycobacterium
NLERRKEICGRAYRILTEEVGFP

SEQ ID NO: 1301592 - protein, 18 aa, Mycobacterium
NLFATFDITYPRLKKTLL

SEQ ID NO: 1301593 - protein, 30 aa, Mycobacterium
NLFATFDITYPRLKKTLLLGTRWGDENAKL

SEQ ID NO: 1301594 - protein, 28 aa, Mycobacterium
NLGWHPKGEELLWRPDLQQLKRSQSGQW

SEQ ID NO: 1301595 - protein, 20 aa, Mycobacterium
NLHHALALATRHLRRHPNAQ

SEQ ID NO: 1301596 - protein, 17 aa, Mycobacterium
NLLLDRLPNLRMDPDGD

SEQ ID NO: 1301597 - protein, 27 aa, Mycobacterium
NLRAHVRAATLLVPQWQARGRGHFVSV

SEQ ID NO: 1301598 - protein, 18 aa, Mycobacterium
NLRITDRLKDMYICGGFN

SEQ ID NO: 1301599 - protein, 24 aa, Mycobacterium
NLRRFDEWLTIFGGWRSEVPAEIE

SEQ ID NO: 1301600 - protein, 18 aa, Mycobacterium
NLSGVWKTVKAAVPHLLS

SEQ ID NO: 1301601 - protein, 21 aa, Mycobacterium
NLSRVYRRLGIRSRGELARVL

SEQ ID NO: 1301602 - protein, 24 aa, Mycobacterium
NLTQFYHPLDMFGEWNRAYGSNGF

SEQ ID NO: 1301603 - protein, 23 aa, Mycobacterium
NLVNARYLRICVLTQYKSHSLDR

SEQ ID NO: 1301604 - protein, 20 aa, Mycobacterium
NLVSRDECLALIAAGVDDWG

SEQ ID NO: 1301605 - protein, 23 aa, Mycobacterium
NMGAVPPEPGFNAALRRITEEHG

SEQ ID NO: 1301606 - protein, 21 aa, Mycobacterium
NMKPSVIRRLGLTYEALRKHN

SEQ ID NO: 1301607 - protein, 32 aa, Mycobacterium
NMQPLWAQLDPLMTVLTVPRLGPERADRQYRM

SEQ ID NO: 1301608 - protein, 18 aa, Mycobacterium
NMTGYPEAVLARELEMCY

SEQ ID NO: 1301609 - protein, 26 aa, Mycobacterium
NMTSTNLHGWPFLLEARKNNGAKIVV

SEQ ID NO: 1301610 - protein, 26 aa, Mycobacterium
NNEFRPEILLSFGFVPKVESRVGLIN

SEQ ID NO: 1301611 - protein, 24 aa, Mycobacterium
NNKYAYRHSGYPGGLRRRTIGELL

SEQ ID NO: 1301612 - protein, 23 aa, Mycobacterium
NNVAYVEWAIKLGRPGTVIVVDN

SEQ ID NO: 1301613 - protein, 23 aa, Mycobacterium
NPDAMVLWEAQFGDFINGAQSII

SEQ ID NO: 1301614 - protein, 24 aa, Mycobacterium
NPDRRVHMLVMLAFIEFNAGRADR

SEQ ID NO: 1301615 - protein, 20 aa, Mycobacterium
NPEAWRWYRNVFGDNNIPVV

SEQ ID NO: 1301616 - protein, 23 aa, Mycobacterium
NPEGWLVAMRQELALAARTLGTP

SEQ ID NO: 1301617 - protein, 19 aa, Mycobacterium
NPELAFKTSFLPNDGVGLA

SEQ ID NO: 1301618 - protein, 25 aa, Mycobacterium
NPELAQRFPLSIISPKPHAFLNSQY

SEQ ID NO: 1301619 - protein, 23 aa, Mycobacterium
NPELFATALALNPTGRMATPQEV

SEQ ID NO: 1301620 - protein, 25 aa, Mycobacterium
NPENVYFYLTIYNEPYVQPAEPENL

SEQ ID NO: 1301621 - protein, 18 aa, Mycobacterium
NPESPVLVLSHYVEQRYA

SEQ ID NO: 1301622 - protein, 27 aa, Mycobacterium
NPFDQVAALKRAGFGALRLPESLGGAG

SEQ ID NO: 1301623 - protein, 20 aa, Mycobacterium
NPGAWLTTVAKRKAIDHWRR

SEQ ID NO: 1301624 - protein, 17 aa, Mycobacterium
NPGLRALRLDCADMTFC

SEQ ID NO: 1301625 - protein, 24 aa, Mycobacterium
NPGLRDVLAALRWVQNNIAAFGGD

SEQ ID NO: 1301626 - protein, 20 aa, Mycobacterium
NPGWLFSKRVRQMRSLLAEG

SEQ ID NO: 1301627 - protein, 19 aa, Mycobacterium
NPIAWLYEQRRWEVPSNRI

SEQ ID NO: 1301628 - protein, 20 aa, Mycobacterium
NPLPYRQLLPLVRHFHTGQE

SEQ ID NO: 1301629 - protein, 21 aa, Mycobacterium
NPRFVDVIGPYLKWGGDNSDA

SEQ ID NO: 1301630 - protein, 23 aa, Mycobacterium
NPRNAFWRIAGALYGFDADDPYA

SEQ ID NO: 1301631 - protein, 24 aa, Mycobacterium
NPTGGKFLVYDSPLSEFAAVGFEY

SEQ ID NO: 1301632 - protein, 25 aa, Mycobacterium
NPTGPVRGFGWRVDMFGPDGPDRAE

SEQ ID NO: 1301633 - protein, 20 aa, Mycobacterium
NPVLEPLVAVHREFYPKADL

SEQ ID NO: 1301634 - protein, 28 aa, Mycobacterium
NPVREAIHSVFLFHAIKAGLDMGIVNAG

SEQ ID NO: 1301635 - protein, 19 aa, Mycobacterium
NQILRFFDGNRRLLAEMAP

SEQ ID NO: 1301636 - protein, 24 aa, Mycobacterium
NQLPAMFADVRRGLTIAAVVHGAT

SEQ ID NO: 1301637 - protein, 17 aa, Mycobacterium
NQLVDRFFEARKMMSQM

SEQ ID NO: 1301638 - protein, 26 aa, Mycobacterium
NQQKVVLARWLTGKVNVLLLDEPTRG

SEQ ID NO: 1301639 - protein, 25 aa, Mycobacterium
NQRIYQWCMDFLGPEGTLYHSYAMD

SEQ ID NO: 1301640 - protein, 24 aa, Mycobacterium
NQSSGVIPIMKLLEDSFSYANQLG

SEQ ID NO: 1301641 - protein, 17 aa, Mycobacterium
NQWMYETWQFDYEGRIF

SEQ ID NO: 1301642 - protein, 22 aa, Mycobacterium
NRAGRLPFAALQAAGDMVSLTT

SEQ ID NO: 1301643 - protein, 24 aa, Mycobacterium
NRAKLSEMPALWGYARDLFQTPGF

SEQ ID NO: 1301644 - protein, 23 aa, Mycobacterium
NRDFNALVYVLSGRGAVGPVGHP

SEQ ID NO: 1301645 - protein, 24 aa, Mycobacterium
NRDLLVNVLRHPAFLDGATDTAFF

SEQ ID NO: 1301646 - protein, 22 aa, Mycobacterium
NRGCFHAFRAVYECEVPVIAAV

SEQ ID NO: 1301647 - protein, 17 aa, Mycobacterium
NRHLWGHFARHGEGITP

SEQ ID NO: 1301648 - protein, 17 aa, Mycobacterium
NRLLLNNVDVVGVGWGA

SEQ ID NO: 1301649 - protein, 17 aa, Mycobacterium
NRLNLALTLKEGGNLIL

SEQ ID NO: 1301650 - protein, 21 aa, Mycobacterium
NRLTSSMFAAKRKAQDALSLA

SEQ ID NO: 1301651 - protein, 19 aa, Mycobacterium
NRMICDPYPRLLVARDTVN

SEQ ID NO: 1301652 - protein, 45 aa, Mycobacterium
NRPANLFVAGFIGSPAMNFFPASLTDVGVRLPFGEVTLTQEAYDL

SEQ ID NO: 1301653 - protein, 24 aa, Mycobacterium
NRPRRAFRRITGSALEALLPQRDA

SEQ ID NO: 1301654 - protein, 25 aa, Mycobacterium
NRPTYFERVLDITGILEYIAGRRAT

SEQ ID NO: 1301655 - protein, 21 aa, Mycobacterium
NRRPPRAPEVSFYPWRDGGLG

SEQ ID NO: 1301656 - protein, 24 aa, Mycobacterium
NRRRARVHGFRLRMRTRAGRAIVT

SEQ ID NO: 1301657 - protein, 20 aa, Mycobacterium
NRSCMLRLPGNRPAIENRSV

SEQ ID NO: 1301658 - protein, 36 aa, Mycobacterium
NRTANIALLHYLDGEKRYIIAPYGLKQGAIVESGAN

SEQ ID NO: 1301659 - protein, 23 aa, Mycobacterium
NRTLQTSLFFLGNSTYLPSGFAP

SEQ ID NO: 1301660 - protein, 17 aa, Mycobacterium
NSAIALVRRGGTVSLSG

SEQ ID NO: 1301661 - protein, 28 aa, Mycobacterium
NSAVDLLRFTPLRFTQRIRFGAVSLLLR

SEQ ID NO: 1301662 - protein, 23 aa, Mycobacterium
NSDEPMFVAPAPADGLAGRMVIA

SEQ ID NO: 1301663 - protein, 17 aa, Mycobacterium
NSDLAAHPVIRSRYPVL

SEQ ID NO: 1301664 - protein, 29 aa, Mycobacterium
NSGRVLGLHFFNPVPVLPLVELVSTLTTT

SEQ ID NO: 1301665 - protein, 20 aa, Mycobacterium
NSIRLLIADAADGRLTDVHR

SEQ ID NO: 1301666 - protein, 26 aa, Mycobacterium
NSRATRVNLPLLPPTDARAYCRTVRD

SEQ ID NO: 1301667 - protein, 19 aa, Mycobacterium
NSRFVASKLLYGAASQLPF

SEQ ID NO: 1301668 - protein, 23 aa, Mycobacterium
NSTEFIEVLLGCAKIGALAVPLN

SEQ ID NO: 1301669 - protein, 17 aa, Mycobacterium
NSWYLGANIPGKARTFM

SEQ ID NO: 1301670 - protein, 22 aa, Mycobacterium
NTAALIPVLRRDGMSGGDVDRV

SEQ ID NO: 1301671 - protein, 19 aa, Mycobacterium
NTAYAAWFPDRLPSRTCVG

SEQ ID NO: 1301672 - protein, 25 aa, Mycobacterium
NTFAAGICFLPQDPVARAEACRQVE

SEQ ID NO: 1301673 - protein, 23 aa, Mycobacterium
NTFHLRHRLFEPLEGTLPEPEIW

SEQ ID NO: 1301674 - protein, 28 aa, Mycobacterium
NTGGMGAYAPLPWLPADITTSIVDDIVK

SEQ ID NO: 1301675 - protein, 24 aa, Mycobacterium
NTIATPYLIQPLSHGADIVVHSAT

SEQ ID NO: 1301676 - protein, 22 aa, Mycobacterium
NTLVNGLQLRQQRVPLGVVGIV

SEQ ID NO: 1301677 - protein, 25 aa, Mycobacterium
NTLYVPREPFFNDPQWKHITDWNEE

SEQ ID NO: 1301678 - protein, 20 aa, Mycobacterium
NTVALISTPSLLADRGRQAL

SEQ ID NO: 1301679 - protein, 35 aa, Mycobacterium
NTVSPPTKWHLIVPFLNVLPGGMFAGAALTWPSGN

SEQ ID NO: 1301680 - protein, 18 aa, Mycobacterium
NTWGLRPAVVERTREIAP

SEQ ID NO: 1301681 - protein, 23 aa, Mycobacterium
NVDAVMRTLLARGLITEAGTDPD

SEQ ID NO: 1301682 - protein, 27 aa, Mycobacterium
NVETVPRIFKRIRPAFRYERSLAVLTA

SEQ ID NO: 1301683 - protein, 17 aa, Mycobacterium
NVGPLAKFYSVAPADVI

SEQ ID NO: 1301684 - protein, 26 aa, Mycobacterium
NVHSRTPLLLLPIRIETRLTPGRTQL

SEQ ID NO: 1301685 - protein, 17 aa, Mycobacterium
NVIAWASSGHVGFKGSR

SEQ ID NO: 1301686 - protein, 26 aa, Mycobacterium
NVMAVWVIMRALDALDLLPLPNRLDL

SEQ ID NO: 1301687 - protein, 24 aa, Mycobacterium
NVPEARMVVIKPYEANQLRNIEDA

SEQ ID NO: 1301688 - protein, 25 aa, Mycobacterium
NVPGPQMPLYYLGNEVKAMYPIGPV

SEQ ID NO: 1301689 - protein, 22 aa, Mycobacterium
NVRSDAMFPQRAFHALVELIEH

SEQ ID NO: 1301690 - protein, 22 aa, Mycobacterium
NVTLAPRKLKRLPADQARELGL

SEQ ID NO: 1301691 - protein, 20 aa, Mycobacterium
NVTYRHMLAGKPAVLHTRLV

SEQ ID NO: 1301692 - protein, 22 aa, Mycobacterium
NVVLQTCFFAISGVLPRDQAIA

SEQ ID NO: 1301693 - protein, 22 aa, Mycobacterium
NYAFFTELPDLTHPGFPLAEIH

SEQ ID NO: 1301694 - protein, 23 aa, Mycobacterium
NYHTPALPAWPGMEGYTGDLLHS

SEQ ID NO: 1301695 - protein, 30 aa, Mycobacterium
NYRGQLVARAVDLVQLFPAAAYGKNGADIR

SEQ ID NO: 1301696 - protein, 28 aa, Mycobacterium
PAADHTWLSTVPLLLDAAYGLPDLPQRR

SEQ ID NO: 1301697 - protein, 27 aa, Mycobacterium
PAADLHDWYGRYLYFAPDEVEPLNDGS

SEQ ID NO: 1301698 - protein, 17 aa, Mycobacterium
PAAFLRTTLPLDLTGLA

SEQ ID NO: 1301699 - protein, 34 aa, Mycobacterium
PAALTSPVAFLERPARWIRALAENPHAFSAAPNF

SEQ ID NO: 1301700 - protein, 20 aa, Mycobacterium
PAAPGLWFAGYEEPIIGPLQ

SEQ ID NO: 1301701 - protein, 18 aa, Mycobacterium
PAARLVARAWLDPDFKDL

SEQ ID NO: 1301702 - protein, 21 aa, Mycobacterium
PAAVPVIKVPPHPAGEHPMFK

SEQ ID NO: 1301703 - protein, 28 aa, Mycobacterium
PADAAPQPLIRLAAALELLHAAILVHDD

SEQ ID NO: 1301704 - protein, 23 aa, Mycobacterium
PADERGYLLSTHIRALVASSMGL

SEQ ID NO: 1301705 - protein, 21 aa, Mycobacterium
PADFDIVLPVAPLDPSGDRDR

SEQ ID NO: 1301706 - protein, 24 aa, Mycobacterium
PADGPLPVMFFIHGGGYAFGSSAT

SEQ ID NO: 1301707 - protein, 33 aa, Mycobacterium
PADGYDAYLRLHLLSHRLIQPRGANLDGVFGVL

SEQ ID NO: 1301708 - protein, 18 aa, Mycobacterium
PADGYYQVRRYAAEYLAP

SEQ ID NO: 1301709 - protein, 29 aa, Mycobacterium
PADPDILPPALKPFAAVPPLISDIDLSVD

SEQ ID NO: 1301710 - protein, 26 aa, Mycobacterium
PADPTVWTTAAWWRRVRDTQRSDIIT

SEQ ID NO: 1301711 - protein, 34 aa, Mycobacterium
PADTGCSWLPLYHDMGLAFLLTNALGGAELWQAP

SEQ ID NO: 1301712 - protein, 30 aa, Mycobacterium; identical to SEQ ID NO: 116398

SEQ ID NO: 1301713 - protein, 19 aa, Mycobacterium
PAEFLDLCEHHPGCSAFLA

SEQ ID NO: 1301714 - protein, 18 aa, Mycobacterium
PAEFSWTSSDVQLYHLGL

SEQ ID NO: 1301715 - protein, 29 aa, Mycobacterium
PAEQTPASILYLMSLIADLLPAGVVNVVN

SEQ ID NO: 1301716 - protein, 24 aa, Mycobacterium
PAERATCAPWLDAEWRLVSGDVRV

SEQ ID NO: 1301717 - protein, 20 aa, Mycobacterium
PAERSAVLAKLAKLADEHTD

SEQ ID NO: 1301718 - protein, 27 aa, Mycobacterium
PAFTGTLQLRYVRPTPLGPLRAEAWVE

SEQ ID NO: 1301719 - protein, 22 aa, Mycobacterium
PAGAYFPRGIKPVSVWLSHEYV

SEQ ID NO: 1301720 - protein, 18 aa, Mycobacterium
PAGLREWIRLRRLGREER

SEQ ID NO: 1301721 - protein, 19 aa, Mycobacterium
PAGTGLDDVWGAALDDVQP

SEQ ID NO: 1301722 - protein, 17 aa, Mycobacterium
PAGVFNVVVSNANEVGA

SEQ ID NO: 1301723 - protein, 25 aa, Mycobacterium
PAHFRAILELFLHTDVRPTLESIQA

SEQ ID NO: 1301724 - protein, 18 aa, Mycobacterium
PAHGDPLLEPLRAKFEPI

SEQ ID NO: 1301725 - protein, 26 aa, Mycobacterium
PAHRAALEILALGRWPFDRITRESTG

SEQ ID NO: 1301726 - protein, 21 aa, Mycobacterium
PAIDTVLYPGLPSHPGHDVAA

SEQ ID NO: 1301727 - protein, 24 aa, Mycobacterium
PAIGTLVLLADQLDWLNGNGGLDW

SEQ ID NO: 1301728 - protein, 23 aa, Mycobacterium
PAIKGMWCVPVFGNPTGVTYSWE

SEQ ID NO: 1301729 - protein, 20 aa, Mycobacterium
PAILRSAFVHGIKRLPVAWT

SEQ ID NO: 1301730 - protein, 24 aa, Mycobacterium
PAISAFNAWTLLKGLETLAVRVDY

SEQ ID NO: 1301731 - protein, 18 aa, Mycobacterium
PAKRLAQALGIKDLGNTP

SEQ ID NO: 1301732 - protein, 17 aa, Mycobacterium
PAKSIIFMDPPEHRHMR

SEQ ID NO: 1301733 - protein, 27 aa, Mycobacterium
PALAAGNTLILKPAPDTPWCAAAVGEI

SEQ ID NO: 1301734 - protein, 22 aa, Mycobacterium
PALGRSVWLTLCGLTVGEVLRQ

SEQ ID NO: 1301735 - protein, 23 aa, Mycobacterium
PALKDQLLELLPNRIITDSIGSS

SEQ ID NO: 1301736 - protein, 17 aa, Mycobacterium
PALLARSAREFGDQAYV

SEQ ID NO: 1301737 - protein, 20 aa, Mycobacterium
PALRDVDAVLRRAPLMLVAG

SEQ ID NO: 1301738 - protein, 18 aa, Mycobacterium
PALRFVATHPEPADLCAR

SEQ ID NO: 1301739 - protein, 17 aa, Mycobacterium
PALTFLDLTLDPVTREV

SEQ ID NO: 1301740 - protein, 24 aa, Mycobacterium
PAMKPQPWHPLPDGDVRPFVPRNQ

SEQ ID NO: 1301741 - protein, 17 aa, Mycobacterium
PAMLAAFHRAHPAVEIT

SEQ ID NO: 1301742 - protein, 18 aa, Mycobacterium
PAMMSYWSELARPVTVPR

SEQ ID NO: 1301743 - protein, 25 aa, Mycobacterium
PAMPAECLLDRNALIMGYSGVYSSF

SEQ ID NO: 1301744 - protein, 38 aa, Mycobacterium
PANFAVVFQDYARSLFPWITVAKNVELPLMKKGLDAAE

SEQ ID NO: 1301745 - protein, 21 aa, Mycobacterium
PAPDGVKLAAGWLVEHAGFGK

SEQ ID NO: 1301746 - protein, 31 aa, Mycobacterium
PAPDLLSGALAFKLLYRCRALLQTGEVPTIR

SEQ ID NO: 1301747 - protein, 28 aa, Mycobacterium
PAPDLVLDTLTMFGAIGFTWEHDLHLYW

SEQ ID NO: 1301748 - protein, 25 aa, Mycobacterium
PAPGRRRVFRPAPTPTGQTLGAIVA

SEQ ID NO: 1301749 - protein, 27 aa, Mycobacterium
PAPLRWSSRHLLQFLTVGFLAPIFREA

SEQ ID NO: 1301750 - protein, 24 aa, Mycobacterium
PAPNKYVAPIAFNVVPLAGSLVDD

SEQ ID NO: 1301751 - protein, 21 aa, Mycobacterium
PAPSYFVYDAILNRKERELLD

SEQ ID NO: 1301752 - protein, 20 aa, Mycobacterium
PAPVDPAAWAAPAPAPVGAP

SEQ ID NO: 1301753 - protein, 21 aa, Mycobacterium
PAPVTFVDIAGIVKGASEGAG

SEQ ID NO: 1301754 - protein, 21 aa, Mycobacterium
PAQAIAQVCELTWQLKGQATG

SEQ ID NO: 1301755 - protein, 29 aa, Mycobacterium
PAQDMARGQYWIHPALPEVVENALLALCG

SEQ ID NO: 1301756 - protein, 18 aa, Mycobacterium
PARHFSGRLFSRNTTLWA

SEQ ID NO: 1301757 - protein, 18 aa, Mycobacterium
PARLPFWRGDGVGRPAEL

SEQ ID NO: 1301758 - protein, 29 aa, Mycobacterium
PARNVIPKPLQSPHPPVWVACTRPSSVQM

SEQ ID NO: 1301759 - protein, 23 aa, Mycobacterium
PARPRLMPLHLDGPAPLSSSQLR

SEQ ID NO: 1301760 - protein, 34 aa, Mycobacterium
PARVMLLGGTPFPEPVLMWWNFVGRSHEEIAAFR

SEQ ID NO: 1301761 - protein, 24 aa, Mycobacterium
PASDDYYMHFSDGSLIVGIGSPPR

SEQ ID NO: 1301762 - protein, 23 aa, Mycobacterium
PATAVNWGLWKSLADNYSEHERQ

SEQ ID NO: 1301763 - protein, 25 aa, Mycobacterium
PATEEFLRYFTPAPGDGRTIAEDMA

SEQ ID NO: 1301764 - protein, 26 aa, Mycobacterium
PATLHLEDIWIKNLTITTGLVDTHST

SEQ ID NO: 1301765 - protein, 18 aa, Mycobacterium
PATMFPNMSFSAGFPRTI

SEQ ID NO: 1301766 - protein, 18 aa, Mycobacterium
PATRLLRDRVRLAELTAA

SEQ ID NO: 1301767 - protein, 29 aa, Mycobacterium
PATSRPLKLLGIADIIPLYASVDEALAAL

SEQ ID NO: 1301768 - protein, 20 aa, Mycobacterium
PATVFVANFIGQANLWSGRQ

SEQ ID NO: 1301769 - protein, 18 aa, Mycobacterium
PATYFSAGKVQWILDNVD

SEQ ID NO: 1301770 - protein, 29 aa, Mycobacterium
PAVDVALGQHVFPIPAGIIGTHSGPFLAS

SEQ ID NO: 1301771 - protein, 17 aa, Mycobacterium
PAVIARHPAPPGAPTVL

SEQ ID NO: 1301772 - protein, 21 aa, Mycobacterium
PAVPLKAPVPLAPGAAACGQG

SEQ ID NO: 1301773 - protein, 17 aa, Mycobacterium
PAVPPYEGRQTTAKPDS

SEQ ID NO: 1301774 - protein, 20 aa, Mycobacterium
PAVTISTPGLVSNGPVVGPD

SEQ ID NO: 1301775 - protein, 18 aa, Mycobacterium
PAWAYGRVALQWAERYYA

SEQ ID NO: 1301776 - protein, 18 aa, Mycobacterium
PAYTLSKYGMTLLSLGWA

SEQ ID NO: 1301777 - protein, 24 aa, Mycobacterium
PCDLYDLMTLWQIASTNPWLSVTP

SEQ ID NO: 1301778 - protein, 25 aa, Mycobacterium
PCIYNKHMIFPKPGVDLSDPASFAS

SEQ ID NO: 1301779 - protein, 25 aa, Mycobacterium
PCVAVDRHWNILSANAAAAVLLDGV

SEQ ID NO: 1301780 - protein, 24 aa, Mycobacterium
PDAASVTVNFRFAPDRTVDQALAH

SEQ ID NO: 1301781 - protein, 23 aa, Mycobacterium
PDADLLAEPILRPGSWIGGDRDG

SEQ ID NO: 1301782 - protein, 19 aa, Mycobacterium
PDAMRFCFELATEGTAADG

SEQ ID NO: 1301783 - protein, 22 aa, Mycobacterium
PDAPFPLAPIQHALWVGRNELT

SEQ ID NO: 1301784 - protein, 20 aa, Mycobacterium
PDDAMWVRTGDLGAFHDGDL

SEQ ID NO: 1301785 - protein, 22 aa, Mycobacterium
PDDIGWATAFLASDAASYISGA

SEQ ID NO: 1301786 - protein, 21 aa, Mycobacterium
PDDNCWYPPRTLRAVVETLAE

SEQ ID NO: 1301787 - protein, 25 aa, Mycobacterium
PDDRLSYLDQALFLGLRATGQAAVM

SEQ ID NO: 1301788 - protein, 21 aa, Mycobacterium
PDDVWMVFDGQVTLHASTDGA

SEQ ID NO: 1301789 - protein, 24 aa, Mycobacterium
PDEFRAVVDVNLNGAYWAAQACGR

SEQ ID NO: 1301790 - protein, 30 aa, Mycobacterium
PDEIHLPGIFVQRIVALTPIQALRKDIEKR

SEQ ID NO: 1301791 - protein, 25 aa, Mycobacterium
PDELRDVVLAIVRDRPLAPVARIST

SEQ ID NO: 1301792 - protein, 28 aa, Mycobacterium
PDERATPPWWPMRQLVRALGADPDDVLE

SEQ ID NO: 1301793 - protein, 17 aa, Mycobacterium
PDEVAIQALWSTIGPDS

SEQ ID NO: 1301794 - protein, 25 aa, Mycobacterium
PDEVARYLFRRVVSWGRSSNVFLRN

SEQ ID NO: 1301795 - protein, 27 aa, Mycobacterium
PDEWRAGDLTLPLSYRFEPGAADDGIT

SEQ ID NO: 1301796 - protein, 24 aa, Mycobacterium
PDGAFRIRTIRPAPYQIPTDGSCG

SEQ ID NO: 1301797 - protein, 25 aa, Mycobacterium
PDGEDLSWLWDVRFEHFEQVQVVAA

SEQ ID NO: 1301798 - protein, 33 aa, Mycobacterium
PDGGRGYLSKIFNDSWMSSYGFLRNRLDGSIEQ

SEQ ID NO: 1301799 - protein, 21 aa, Mycobacterium
PDGLPPLDDPALKPAAASGGG

SEQ ID NO: 1301800 - protein, 21 aa, Mycobacterium
PDGRMGVIDFGAVAPLPGGLP

SEQ ID NO: 1301801 - protein, 23 aa, Mycobacterium
PDGTPIELIELPGGLTSTVQMWR

SEQ ID NO: 1301802 - protein, 27 aa, Mycobacterium
PDGVTYLFRRHLGVGPLDHLRRIRLDH

SEQ ID NO: 1301803 - protein, 21 aa, Mycobacterium
PDIDIRFGIGWGQVTVLDTET

SEQ ID NO: 1301804 - protein, 22 aa, Mycobacterium
PDIHRIALVNAPAVLGWERWRE

SEQ ID NO: 1301805 - protein, 30 aa, Mycobacterium
PDKGRILTAMSVFFFDLIDAPNHLAGPPDD

SEQ ID NO: 1301806 - protein, 33 aa, Mycobacterium
PDKRVRLMLEMHLLAPLHLSQLAIPAMRERGRG

SEQ ID NO: 1301807 - protein, 22 aa, Mycobacterium
PDLCLMVMTHPLDLTDDLSLPS

SEQ ID NO: 1301808 - protein, 22 aa, Mycobacterium
PDLERRILLSRVPELPEHLASE

SEQ ID NO: 1301809 - protein, 23 aa, Mycobacterium
PDLPTLIVDPYFRDAIENAIDSW

SEQ ID NO: 1301810 - protein, 28 aa, Mycobacterium
PDLRWERFITAVRLLAEQLGVRQTIGLG

SEQ ID NO: 1301811 - protein, 18 aa, Mycobacterium
PDLVLRWAALLHDIGKPA

SEQ ID NO: 1301812 - protein, 17 aa, Mycobacterium
PDPYRRAAALLDLDPGH

SEQ ID NO: 1301813 - protein, 25 aa, Mycobacterium
PDQLAGVVGPLFRSALRSAEVRRRV

SEQ ID NO: 1301814 - protein, 20 aa, Mycobacterium
PDQWRRLLDDPGKVPAAVEE

SEQ ID NO: 1301815 - protein, 34 aa, Mycobacterium
PDRAELDRILPDRPAFFFAIDGHSLWANSTALEM

SEQ ID NO: 1301816 - protein, 18 aa, Mycobacterium
PDRLAALERLSINLRWSW

SEQ ID NO: 1301817 - protein, 22 aa, Mycobacterium
PDRLRALFTERGVARHLANSDE

SEQ ID NO: 1301818 - protein, 19 aa, Mycobacterium
PDRQVVFFGIGFETTAPAN

SEQ ID NO: 1301819 - protein, 26 aa, Mycobacterium
PDRSASWVVPWLWRQWSPGYHAAEDL

SEQ ID NO: 1301820 - protein, 26 aa, Mycobacterium
PDTAEALKPYYRFMCKRPTSSEHYLA

SEQ ID NO: 1301821 - protein, 26 aa, Mycobacterium
PDTEVRMWLDVPPTDEFWRTVEHQNR

SEQ ID NO: 1301822 - protein, 22 aa, Mycobacterium
PDTRRLHYLSVPPKAAKAVITM

SEQ ID NO: 1301823 - protein, 24 aa, Mycobacterium
PDVAKLIALALELGRLGSAGIGVG

SEQ ID NO: 1301824 - protein, 31 aa, Mycobacterium
PDVGGTYLLSRAPGLLGLHAALTGAPFSGAD

SEQ ID NO: 1301825 - protein, 24 aa, Mycobacterium
PDVIAHGMLTMGLGAGFASAWTGD

SEQ ID NO: 1301826 - protein, 24 aa, Mycobacterium
PDVVHLASPALLGYGGLHAARHLG

SEQ ID NO: 1301827 - protein, 23 aa, Mycobacterium
PDYPSLEAWTLATALLARTERLR

SEQ ID NO: 1301828 - protein, 27 aa, Mycobacterium
PEAAALIAGRYVLHALMRCRGAEIVQW

SEQ ID NO: 1301829 - protein, 24 aa, Mycobacterium
PEAHTPLWPDVTYMHDVLGRTKVP

SEQ ID NO: 1301830 - protein, 24 aa, Mycobacterium
PEAPGYGYVPWDSVDTWFEEGREL

SEQ ID NO: 1301831 - protein, 25 aa, Mycobacterium
PEAQRDRFLFKLNIDYPTPEEEREI

SEQ ID NO: 1301832 - protein, 22 aa, Mycobacterium
PEDPGVMWQFSQAVRGLADGCA

SEQ ID NO: 1301833 - protein, 23 aa, Mycobacterium
PEDPLMHELFRALISAATAPLFN

SEQ ID NO: 1301834 - protein, 25 aa, Mycobacterium
PEEDHQRVFHWTNVILGFGDPDLTT

SEQ ID NO: 1301835 - protein, 26 aa, Mycobacterium
PEFVENFFRFIAEDIRRYLAEMGFRS

SEQ ID NO: 1301836 - protein, 28 aa, Mycobacterium
PEGAEILVPFVTAIVPRVSLADGLVEID

SEQ ID NO: 1301837 - protein, 23 aa, Mycobacterium
PEGDFFGVIVQLPGASGALVDWA

SEQ ID NO: 1301838 - protein, 31 aa, Mycobacterium
PEGFEPSLDLFLTPTFRGYLANYGTVLYPEL

SEQ ID NO: 1301839 - protein, 17 aa, Mycobacterium
PEGLYAEPVAVKQGWFC

SEQ ID NO: 1301840 - protein, 24 aa, Mycobacterium
PEGRGLALFISGDNLRKGAALNTI

SEQ ID NO: 1301841 - protein, 24 aa, Mycobacterium
PEHQRLRRMLTPEFTLRRINRLEP

SEQ ID NO: 1301842 - protein, 25 aa, Mycobacterium
PEIARAYVTALRDLLRALGVSDVRM

SEQ ID NO: 1301843 - protein, 19 aa, Mycobacterium
PEIFLPLHGEHQAHNAILA

SEQ ID NO: 1301844 - protein, 18 aa, Mycobacterium
PEILASTKFRAGLEKIPG

SEQ ID NO: 1301845 - protein, 19 aa, Mycobacterium
PEILLLDEGIGAVDADFLK

SEQ ID NO: 1301846 - protein, 22 aa, Mycobacterium
PEIMGLGPIEAVKKALGNAGMG

SEQ ID NO: 1301847 - protein, 19 aa, Mycobacterium
PELHGEVFPYVFTAARLTE

SEQ ID NO: 1301848 - protein, 17 aa, Mycobacterium
PELLLTRRRGALALGAL

SEQ ID NO: 1301849 - protein, 26 aa, Mycobacterium
PELMPLPIALAHRLARRLTEVRKNGV

SEQ ID NO: 1301850 - protein, 21 aa, Mycobacterium
PELTGHVIWALSQDPDVMAVS

SEQ ID NO: 1301851 - protein, 18 aa, Mycobacterium
PELVIPDPDLTLAEGAIA

SEQ ID NO: 1301852 - protein, 25 aa, Mycobacterium
PEMGRAILALYRSARQPALADAGRA

SEQ ID NO: 1301853 - protein, 17 aa, Mycobacterium
PENLDVEGLLRGIYRYR

SEQ ID NO: 1301854 - protein, 21 aa, Mycobacterium
PEPFKKSMRALFDAGWDKAGM

SEQ ID NO: 1301855 - protein, 32 aa, Mycobacterium
PEPGHTLALDSLGLTPILDLGMRLGEGTGAAV

SEQ ID NO: 1301856 - protein, 17 aa, Mycobacterium
PEPHYRPSAKLAAFVRA

SEQ ID NO: 1301857 - protein, 26 aa, Mycobacterium
PEPTPPPQPVYEAPPAAPAPTAQQSE

SEQ ID NO: 1301858 - protein, 27 aa, Mycobacterium
PEQLFAVGYAACFHSALRLVARQEKVD

SEQ ID NO: 1301859 - protein, 21 aa, Mycobacterium
PEQLPISPLDLINSGLSVTGH

SEQ ID NO: 1301860 - protein, 30 aa, Mycobacterium
PERRDPPTRLLKLALDIGCVFSIDTDSHAP

SEQ ID NO: 1301861 - protein, 23 aa, Mycobacterium
PERRTLAVLRRLTPRARITVGTD

SEQ ID NO: 1301862 - protein, 27 aa, Mycobacterium
PERTRQYSLLPLLHNYQRPAHPINGAM

SEQ ID NO: 1301863 - protein, 19 aa, Mycobacterium
PERVDTDVLAALRAAERDP

SEQ ID NO: 1301864 - protein, 17 aa, Mycobacterium
PERVIRAATLPDAIETA

SEQ ID NO: 1301865 - protein, 27 aa, Mycobacterium
PESDAVILALHRYLGRTPSKLLSLSLA

SEQ ID NO: 1301866 - protein, 27 aa, Mycobacterium
PESYVDFMLASFPPLIAMRAQLGDELV

SEQ ID NO: 1301867 - protein, 23 aa, Mycobacterium
PETMAIFGNRWASAIIGAAFLGT

SEQ ID NO: 1301868 - protein, 24 aa, Mycobacterium
PETNYRIGFVPQGIGADLIATIEG

SEQ ID NO: 1301869 - protein, 25 aa, Mycobacterium
PETTVRLMLIAARFPRPETQIVVRD

SEQ ID NO: 1301870 - protein, 24 aa, Mycobacterium
PEVAGLLALFLLHHARRPARIRAD

SEQ ID NO: 1301871 - protein, 27 aa, Mycobacterium
PEVDAFYSATFFLLGLYGALTTTEHGE

SEQ ID NO: 1301872 - protein, 19 aa, Mycobacterium
PEVLLLDEPLAGLDVAVAG

SEQ ID NO: 1301873 - protein, 18 aa, Mycobacterium
PEVRVACTPYRGALRVAG

SEQ ID NO: 1301874 - protein, 25 aa, Mycobacterium
PEVVRRLCWDWQPVTDIAAAVEEFL

SEQ ID NO: 1301875 - protein, 21 aa, Mycobacterium
PEWFGVIKPSRLMAAPAGPGG

SEQ ID NO: 1301876 - protein, 18 aa, Mycobacterium
PEWHLHLASIHDPLWQRM

SEQ ID NO: 1301877 - protein, 19 aa, Mycobacterium
PEWMDRLQIKYFNPVIRPL

SEQ ID NO: 1301878 - protein, 19 aa, Mycobacterium
PFEALAAERWVVSTATGTC

SEQ ID NO: 1301879 - protein, 30 aa, Mycobacterium; identical to SEQ ID NO: 844000

SEQ ID NO: 1301880 - protein, 21 aa, Mycobacterium
PFGAFRRLIDIPATGKTAAIV

SEQ ID NO: 1301881 - protein, 24 aa, Mycobacterium
PFGGVQVVLVGDLYQLPPVVGDGE

SEQ ID NO: 1301882 - protein, 23 aa, Mycobacterium
PFGLSAIFPPNLPLPAKVVTRVL

SEQ ID NO: 1301883 - protein, 21 aa, Mycobacterium
PFGQRWAVMTRVEDVSAAERD

SEQ ID NO: 1301884 - protein, 23 aa, Mycobacterium
PFNQRLVNSMFTLSTLVGLSVAQ

SEQ ID NO: 1301885 - protein, 20 aa, Mycobacterium
PFPRSNIFLVFNSVENRLSE

SEQ ID NO: 1301886 - protein, 32 aa, Mycobacterium
PFQIVQSVPMYRLRRYFPPDVRPGAKPPGPPV

SEQ ID NO: 1301887 - protein, 17 aa, Mycobacterium
PFSPRELVARIRAMLRR

SEQ ID NO: 1301888 - protein, 18 aa, Mycobacterium
PFVLFAVPDAELVRKRLE

SEQ ID NO: 1301889 - protein, 19 aa, Mycobacterium
PFVTEVLWKTLTGGASLVV

SEQ ID NO: 1301890 - protein, 17 aa, Mycobacterium
PFWKQTFSEFSTLLKTE

SEQ ID NO: 1301891 - protein, 21 aa, Mycobacterium
PFYDGAVFHRVIDGFMIQGGD

SEQ ID NO: 1301892 - protein, 17 aa, Mycobacterium
PFYVMDVWLAAAERQRT

SEQ ID NO: 1301893 - protein, 18 aa, Mycobacterium
PGAACDIPSLLYSYSFEP

SEQ ID NO: 1301894 - protein, 27 aa, Mycobacterium
PGDARSELWFFYHLGRILREKLAGSTD

SEQ ID NO: 1301895 - protein, 18 aa, Mycobacterium
PGDDPWPARAFLAELSAP

SEQ ID NO: 1301896 - protein, 24 aa, Mycobacterium
PGDEVYVCWSPDASLVLPAADIPT

SEQ ID NO: 1301897 - protein, 24 aa, Mycobacterium
PGDGGTWFLPRAVGYARAAEMTLT

SEQ ID NO: 1301898 - protein, 19 aa, Mycobacterium
PGDPFYRAGAALAADVTAL

SEQ ID NO: 1301899 - protein, 19 aa, Mycobacterium
PGDTRFIVCLPLVAPAPTE

SEQ ID NO: 1301900 - protein, 23 aa, Mycobacterium
PGDVRGLPAGTQFQRDAIAVGEA

SEQ ID NO: 1301901 - protein, 17 aa, Mycobacterium
PGETLLESARRAGMSPP

SEQ ID NO: 1301902 - protein, 22 aa, Mycobacterium
PGFIDTPMLRAAAERGYLGDID

SEQ ID NO: 1301903 - protein, 17 aa, Mycobacterium
PGFVVKKGAKGLMETAT

SEQ ID NO: 1301904 - protein, 20 aa, Mycobacterium
PGGGMLHHIVTRAGGRLCVL

SEQ ID NO: 1301905 - protein, 26 aa, Mycobacterium
PGGKLAITVPRWLPERICWLLSDEYH

SEQ ID NO: 1301906 - protein, 24 aa, Mycobacterium
PGGRGSGAAYLLRRKRQLHSQERA

SEQ ID NO: 1301907 - protein, 29 aa, Mycobacterium
PGGTIRKRYGLYANIRPARRLSGAIPAVC

SEQ ID NO: 1301908 - protein, 33 aa, Mycobacterium
PGHFAGVLTVVCKLLHIVRPDRAFFGEKDYQQL

SEQ ID NO: 1301909 - protein, 19 aa, Mycobacterium
PGIATILYDFGPETGKRYL

SEQ ID NO: 1301910 - protein, 28 aa, Mycobacterium
PGIAVYGQTPIPALGDMGLRPAMTLRCP

SEQ ID NO: 1301911 - protein, 17 aa, Mycobacterium
PGIDIELSKVLHASEAV

SEQ ID NO: 1301912 - protein, 19 aa, Mycobacterium
PGIRTTLDLPLLTGKGLYA

SEQ ID NO: 1301913 - protein, 25 aa, Mycobacterium
PGKQRDMFLMQIANRGLGQLSEVVQ

SEQ ID NO: 1301914 - protein, 25 aa, Mycobacterium
PGKRTFAAVFPLGPGGHVRLLGLAA

SEQ ID NO: 1301915 - protein, 18 aa, Mycobacterium
PGLGEWDLRALVGHTSRS

SEQ ID NO: 1301916 - protein, 23 aa, Mycobacterium
PGLHRLMHRLAPRHPAELASVQD

SEQ ID NO: 1301917 - protein, 22 aa, Mycobacterium
PGLKRSSLIGGIRYFDTVVDDA

SEQ ID NO: 1301918 - protein, 26 aa, Mycobacterium
PGLLDLSALWQIYAVDRPALKDRPFV

SEQ ID NO: 1301919 - protein, 21 aa, Mycobacterium
PGLMALRREYAEVAPLKGARI

SEQ ID NO: 1301920 - protein, 23 aa, Mycobacterium
PGLPLGVTTGFWALPDAGRRHRA

SEQ ID NO: 1301921 - protein, 20 aa, Mycobacterium
PGLSQFRGRWYHTGRWPHDP

SEQ ID NO: 1301922 - protein, 19 aa, Mycobacterium
PGLVRLIASRFRRARIPIA

SEQ ID NO: 1301923 - protein, 31 aa, Mycobacterium
PGNDGRGYVLRRLLRRVIRSAKLLGIDDAVV

SEQ ID NO: 1301924 - protein, 24 aa, Mycobacterium
PGNFDPIPQAYLRGLPEMQTQHTC

SEQ ID NO: 1301925 - protein, 33 aa, Mycobacterium
PGNPDLGVLLAYSPLHTLLFGLPGDEPGPQVLV

SEQ ID NO: 1301926 - protein, 24 aa, Mycobacterium
PGPDRVPLLALLRRRLTDEEVTAV

SEQ ID NO: 1301927 - protein, 28 aa, Mycobacterium
PGPGENIPAWLIFDQQYRDRYIFAGLQP

SEQ ID NO: 1301928 - protein, 24 aa, Mycobacterium
PGQDNISKLLWANWHRELGEIAMD

SEQ ID NO: 1301929 - protein, 26 aa, Mycobacterium
PGQRLRIVKYLAYGWSSLRSRPALRD

SEQ ID NO: 1301930 - protein, 21 aa, Mycobacterium
PGRAHAYLRLGGQEPVVETVS

SEQ ID NO: 1301931 - protein, 32 aa, Mycobacterium
PGRAIQFNSLFLDPYLWKLQLGGKRLVQKARQ

SEQ ID NO: 1301932 - protein, 23 aa, Mycobacterium
PGRIGLWHIGVPPSGPMDDLSFR

SEQ ID NO: 1301933 - protein, 32 aa, Mycobacterium
PGRLQVSFLPELLRWVPFTKGDYWVLKIDDAY

SEQ ID NO: 1301934 - protein, 21 aa, Mycobacterium
PGRLSGKFWKLLGAATEKNQG

SEQ ID NO: 1301935 - protein, 17 aa, Mycobacterium
PGRRDICIYARESHVLV

SEQ ID NO: 1301936 - protein, 18 aa, Mycobacterium
PGSLILETTWQTHTGWLI

SEQ ID NO: 1301937 - protein, 18 aa, Mycobacterium
PGSYVAGWIKRGPTGFIG

SEQ ID NO: 1301938 - protein, 37 aa, Mycobacterium
PGTDRISIPFFLNPALDALIPILPLPPELAVRSRGVE

SEQ ID NO: 1301939 - protein, 25 aa, Mycobacterium
PGTKGLSLFLVPKFHFDPDTGELTG

SEQ ID NO: 1301940 - protein, 17 aa, Mycobacterium
PGTPVSFPLDWSELSAV

SEQ ID NO: 1301941 - protein, 17 aa, Mycobacterium
PGTRMRVALSALTMAEY

SEQ ID NO: 1301942 - protein, 27 aa, Mycobacterium
PGTYLNSFFEIRPLPYAEAGYGYPEAG

SEQ ID NO: 1301943 - protein, 29 aa, Mycobacterium
PGVAMPSFAGIDPWRSPAGPVPEYPRASN

SEQ ID NO: 1301944 - protein, 18 aa, Mycobacterium
PGVDPVRVALWGSSFSGS

SEQ ID NO: 1301945 - protein, 27 aa, Mycobacterium
PGVEPKPLRGMPPFSGPQGPFAGIAAA

SEQ ID NO: 1301946 - protein, 19 aa, Mycobacterium
PGVGLRFEFDNRDGDRIGV

SEQ ID NO: 1301947 - protein, 27 aa, Mycobacterium
PGVLGRPFYLMGFVDGWSPMDTHARWP

SEQ ID NO: 1301948 - protein, 36 aa, Mycobacterium
PGVPDHVSLWGLLIPIRRAFRQYVNLRPIRVFDGVA

SEQ ID NO: 1301949 - protein, 24 aa, Mycobacterium
PGVPVFSLGRYAGPRRRAILGLKE

SEQ ID NO: 1301950 - protein, 23 aa, Mycobacterium
PGWSLRIDPVGWMSSAVRTSLGL

SEQ ID NO: 1301951 - protein, 21 aa, Mycobacterium
PGWVLPRVNFRHPAWARSTFT

SEQ ID NO: 1301952 - protein, 17 aa, Mycobacterium
PHARYWGVAIDEHTLVP

SEQ ID NO: 1301953 - protein, 17 aa, Mycobacterium
PHIERWAQTILGSAREI

SEQ ID NO: 1301954 - protein, 20 aa, Mycobacterium
PHLAAALLLAAGLEGVREQL

SEQ ID NO: 1301955 - protein, 20 aa, Mycobacterium
PHLIAHLHRTGPVAVALSCS

SEQ ID NO: 1301956 - protein, 20 aa, Mycobacterium
PHPRTGVLTDFLFTRHGRRL

SEQ ID NO: 1301957 - protein, 21 aa, Mycobacterium
PHRVRAWLIAERRIVTTACDA

SEQ ID NO: 1301958 - protein, 27 aa, Mycobacterium
PHTARELIRAFWPGALSLVVRQAPSLP

SEQ ID NO: 1301959 - protein, 26 aa, Mycobacterium
PHTKPPNFWAWLIGEIKNEDPDVLFL

SEQ ID NO: 1301960 - protein, 28 aa, Mycobacterium
PHVGLIRTALFNWAYARHTGGTFVFRIE

SEQ ID NO: 1301961 - protein, 26 aa, Mycobacterium
PIAIAVPAHWGPGTVGALRGALRNRP

SEQ ID NO: 1301962 - protein, 20 aa, Mycobacterium
PIALLVLDAWSEVIPSPSGR

SEQ ID NO: 1301963 - protein, 21 aa, Mycobacterium
PIASELILPIALAVQNRISVT

SEQ ID NO: 1301964 - protein, 17 aa, Mycobacterium
PIDLMWDEPTVAGHLHH

SEQ ID NO: 1301965 - protein, 28 aa, Mycobacterium
PIDSNLFLRDLVMALRWVRDNIAVFGGD

SEQ ID NO: 1301966 - protein, 28 aa, Mycobacterium
PIENPNRRFFTMLGTLIRGRVTVGGSGA

SEQ ID NO: 1301967 - protein, 19 aa, Mycobacterium
PIERLKVAVQLLFETSRPD

SEQ ID NO: 1301968 - protein, 20 aa, Mycobacterium
PIFIADYVLIGYGTGAIMAV

SEQ ID NO: 1301969 - protein, 26 aa, Mycobacterium
PIGEALRLWYELLTRSRLPAADDGTG

SEQ ID NO: 1301970 - protein, 26 aa, Mycobacterium
PIKVGYLMDFKLPPGFPEELMASFTR

SEQ ID NO: 1301971 - protein, 17 aa, Mycobacterium
PILHGLCTYGIACKAIV

SEQ ID NO: 1301972 - protein, 17 aa, Mycobacterium
PIMLGAEGPKNVALAAE

SEQ ID NO: 1301973 - protein, 22 aa, Mycobacterium
PIQAFCDLLEVRWLLSERAGRD

SEQ ID NO: 1301974 - protein, 19 aa, Mycobacterium
PISRYLGPWVAEPEIWQDP

SEQ ID NO: 1301975 - protein, 28 aa, Mycobacterium
PITMTDLRFMRFIAKEIFPGGSVPCDED

SEQ ID NO: 1301976 - protein, 24 aa, Mycobacterium
PITPYPPGIPLVMPGERLSAEVVD

SEQ ID NO: 1301977 - protein, 23 aa, Mycobacterium
PIVHAFCTPLRKLGGDSADFTYH

SEQ ID NO: 1301978 - protein, 23 aa, Mycobacterium
PIVQGGMQWVGRAELVAAVANAG

SEQ ID NO: 1301979 - protein, 20 aa, Mycobacterium
PIYALIHTYRVALPLHPEYR

SEQ ID NO: 1301980 - protein, 17 aa, Mycobacterium
PIYHRILVPYRDADLTE

SEQ ID NO: 1301981 - protein, 25 aa, Mycobacterium
PKDHFDFFPLTIDVEERMYAAGRIP

SEQ ID NO: 1301982 - protein, 28 aa, Mycobacterium
PKDILQGQCRFSWPPQIDLPGYKPNTKP

SEQ ID NO: 1301983 - protein, 28 aa, Mycobacterium
PKDKLDTYVRPLLAISADRVAAGGNPLF

SEQ ID NO: 1301984 - protein, 31 aa, Mycobacterium
PKDRDIAMVFQSYALYPHMSVRQNIGFPLTL

SEQ ID NO: 1301985 - protein, 24 aa, Mycobacterium
PKEHPLPEVFTPQGAPRPNPGCDP

SEQ ID NO: 1301986 - protein, 39 aa, Mycobacterium
PKELCRKIVIELLAWQFASPVRWIETQDLLFIEEAAGGL

SEQ ID NO: 1301987 - protein, 24 aa, Mycobacterium
PKEMWDVFAEEYLSPVRPLERMRQ

SEQ ID NO: 1301988 - protein, 18 aa, Mycobacterium
PKGALVHSLIRTGRSLFT

SEQ ID NO: 1301989 - protein, 18 aa, Mycobacterium
PKHNGITYFLLDMNSEGV

SEQ ID NO: 1301990 - protein, 20 aa, Mycobacterium
PKIVEGRVTGFYKDVVLLDQ

SEQ ID NO: 1301991 - protein, 17 aa, Mycobacterium
PKLRHWIKEVKGAMTDL

SEQ ID NO: 1301992 - protein, 30 aa, Mycobacterium
PKMLARDFAPGFRIDLHYKDLKIALAAAEQ

SEQ ID NO: 1301993 - protein, 17 aa, Mycobacterium
PKMSPALLSKRLKSLIR

SEQ ID NO: 1301994 - protein, 21 aa, Mycobacterium
PLAALWEDDLLARIDLQPPGH

SEQ ID NO: 1301995 - protein, 18 aa, Mycobacterium
PLAGIRLSHRRGGALVLG

SEQ ID NO: 1301996 - protein, 32 aa, Mycobacterium
PLARMEMRIAFPALLRRFPTLTLAEPFEDVEF

SEQ ID NO: 1301997 - protein, 30 aa, Mycobacterium
PLASWNAWHWRWNPWLMVAQGYAVLLPDPA

SEQ ID NO: 1301998 - protein, 28 aa, Mycobacterium
PLAVDPAHPFPFVSGLSLNLAITVRHPD

SEQ ID NO: 1301999 - protein, 17 aa, Mycobacterium
PLAYMRRVAKKDIMLNG

SEQ ID NO: 1302000 - protein, 18 aa, Mycobacterium
PLCIDTESADFYVDALDR

SEQ ID NO: 1302001 - protein, 24 aa, Mycobacterium
PLCYGYHPYLQIPDVARAQWQLQS

SEQ ID NO: 1302002 - protein, 19 aa, Mycobacterium
PLDAFIVRKLGAPGHEEFA

SEQ ID NO: 1302003 - protein, 24 aa, Mycobacterium
PLEDTDIVLWYTVGAHHVVRPEDW

SEQ ID NO: 1302004 - protein, 24 aa, Mycobacterium
PLEGTLPEPEIWARLTRALGVVDD

SEQ ID NO: 1302005 - protein, 20 aa, Mycobacterium
PLFEALRRFVERDQAPFYSP

SEQ ID NO: 1302006 - protein, 19 aa, Mycobacterium
PLFIGRDTHALSEPAWTSA

SEQ ID NO: 1302007 - protein, 37 aa, Mycobacterium
PLGAATPLFRLHLDPDILLLGFSLPGAPPKPAERLQN

SEQ ID NO: 1302008 - protein, 22 aa, Mycobacterium
PLGALDLKLRHAMQFELKRIQR

SEQ ID NO: 1302009 - protein, 25 aa, Mycobacterium
PLGIIPLLQVDMWEHAYYLQYKNVK

SEQ ID NO: 1302010 - protein, 21 aa, Mycobacterium
PLGNPFAVFTPSRPTPRPALN

SEQ ID NO: 1302011 - protein, 25 aa, Mycobacterium
PLGPVAVFGASNFPLAFSVAGGDTA

SEQ ID NO: 1302012 - protein, 22 aa, Mycobacterium
PLHEPRLWPEYHENYYGAFVRD

SEQ ID NO: 1302013 - protein, 18 aa, Mycobacterium
PLHLAAEIARCTFDRIIA

SEQ ID NO: 1302014 - protein, 19 aa, Mycobacterium
PLIEVIGGLGIRLSNYLPT

SEQ ID NO: 1302015 - protein, 17 aa, Mycobacterium
PLIFLRDGERVILVASR

SEQ ID NO: 1302016 - protein, 31 aa, Mycobacterium
PLLAALPERERMVLLLRFFENLTQTQIAERV

SEQ ID NO: 1302017 - protein, 31 aa, Mycobacterium
PLLCAGIIGYRSLLRADLPPGGRLGIYGFGG

SEQ ID NO: 1302018 - protein, 26 aa, Mycobacterium
PLLRAAGRAPFLLDSHRPRIPLGDYR

SEQ ID NO: 1302019 - protein, 20 aa, Mycobacterium
PLLVACDLQRPGAVNQLQIV

SEQ ID NO: 1302020 - protein, 24 aa, Mycobacterium
PLNTTGELVELLYDAIPAPARRTG

SEQ ID NO: 1302021 - protein, 23 aa, Mycobacterium
PLPEATLAELDRLDAWLLGPHDN

SEQ ID NO: 1302022 - protein, 18 aa, Mycobacterium
PLPTALRELIRYVRPPWL

SEQ ID NO: 1302023 - protein, 18 aa, Mycobacterium
PLPVIEIADVWKLHKLGD

SEQ ID NO: 1302024 - protein, 19 aa, Mycobacterium
PLQHPDTFERLGIEPPRGV

SEQ ID NO: 1302025 - protein, 21 aa, Mycobacterium
PLRAAKLWNDTTGAPALRALA

SEQ ID NO: 1302026 - protein, 19 aa, Mycobacterium
PLRDLMPALRQGGVAAVSE

SEQ ID NO: 1302027 - protein, 18 aa, Mycobacterium
PLRMLRAARFASQLGFGV

SEQ ID NO: 1302028 - protein, 25 aa, Mycobacterium
PLRPRFQGLLPAQTRRRKAADPRHH

SEQ ID NO: 1302029 - protein, 18 aa, Mycobacterium
PLRRVRLTALATKRAKEV

SEQ ID NO: 1302030 - protein, 26 aa, Mycobacterium
PLRYKLVEIPGRLHHPMWLENCSVDL

SEQ ID NO: 1302031 - protein, 24 aa, Mycobacterium
PLSFPIPGWNVCVDFPIKPGLGEF

SEQ ID NO: 1302032 - protein, 19 aa, Mycobacterium
PLSVFEFVEALDEAGLPPG

SEQ ID NO: 1302033 - protein, 20 aa, Mycobacterium
PLTTEKHYRRARGRKVELTL

SEQ ID NO: 1302034 - protein, 22 aa, Mycobacterium
PLTTILDPSLPLTVTEWDEWGN

SEQ ID NO: 1302035 - protein, 17 aa, Mycobacterium
PLTVAVLLRITEVFGVD

SEQ ID NO: 1302036 - protein, 17 aa, Mycobacterium
PLVTQRLSEHLRAPVVT

SEQ ID NO: 1302037 - protein, 17 aa, Mycobacterium
PLWEMYVVEGLVGDRVA

SEQ ID NO: 1302038 - protein, 17 aa, Mycobacterium
PLWLFADQLGPAVHGGE

SEQ ID NO: 1302039 - protein, 17 aa, Mycobacterium
PMAWWFTLSEHVGEPRF

SEQ ID NO: 1302040 - protein, 23 aa, Mycobacterium
PMDEGWLDMAFSVPLLDTGRAQS

SEQ ID NO: 1302041 - protein, 31 aa, Mycobacterium
PMGGSAVRLVRQIPYTIACDLLLTGRHITAA

SEQ ID NO: 1302042 - protein, 33 aa, Mycobacterium
PMGPWGPLQSALPLQILARTSALLLGRDVDKPR

SEQ ID NO: 1302043 - protein, 31 aa, Mycobacterium
PMGSEALALLRLPLVLPTLQVAGRLAGTVLG

SEQ ID NO: 1302044 - protein, 23 aa, Mycobacterium
PMNQVLLGQLWAGFADRYGDAIA

SEQ ID NO: 1302045 - protein, 30 aa, Mycobacterium
PMPRGRGLLFEKLYPAFWEFKPTKQMRGAY

SEQ ID NO: 1302046 - protein, 17 aa, Mycobacterium
PMPTVRLKPRLSPPAGG

SEQ ID NO: 1302047 - protein, 20 aa, Mycobacterium
PMQLAGMAMQIPQGIMQGVQ

SEQ ID NO: 1302048 - protein, 20 aa, Mycobacterium
PMRTFLGVPVRIRDEVYGNL

SEQ ID NO: 1302049 - protein, 19 aa, Mycobacterium
PMTPFERKIVHDAVAAVAG

SEQ ID NO: 1302050 - protein, 24 aa, Mycobacterium
PNARTRFVLVGRPAPPPARTGADR

SEQ ID NO: 1302051 - protein, 25 aa, Mycobacterium
PNAVSVRLTYWLVTRAETLRRPEVD

SEQ ID NO: 1302052 - protein, 24 aa, Mycobacterium
PNAVTTSWWKEERGRRLFIDYNQN

SEQ ID NO: 1302053 - protein, 17 aa, Mycobacterium
PNGEPPPWWAAQRDPVV

SEQ ID NO: 1302054 - protein, 26 aa, Mycobacterium
PNGRSGWRISIPAMMSYWSELARPVT

SEQ ID NO: 1302055 - protein, 33 aa, Mycobacterium
PNKVARFPKFDWPRIDAPFIRPGADMAALEAES

SEQ ID NO: 1302056 - protein, 18 aa, Mycobacterium
PNLDKRTVALPKAHIKSL

SEQ ID NO: 1302057 - protein, 30 aa, Mycobacterium
PNPNLHPLGKPPYYAFQIILGDLGTSGGLR

SEQ ID NO: 1302058 - protein, 38 aa, Mycobacterium
PNRGRPGRGLVLRPGLTLALEPWFARGTDRIVYDPDGW

SEQ ID NO: 1302059 - protein, 23 aa, Mycobacterium
PNRVNWTIVHYKPPQAMTLNGDG

SEQ ID NO: 1302060 - protein, 17 aa, Mycobacterium
PNVGFIRADAQRLPLRD

SEQ ID NO: 1302061 - protein, 26 aa, Mycobacterium
PPAAGLLRQQFMLALDGELDVLAAVE

SEQ ID NO: 1302062 - protein, 27 aa, Mycobacterium
PPAALRRRIMLERAAWRLRRGEPVAAV

SEQ ID NO: 1302063 - protein, 19 aa, Mycobacterium
PPAAPLDAPLPPPPAPVDP

SEQ ID NO: 1302064 - protein, 21 aa, Mycobacterium
PPAMPFLQALAQPPAPQRIAL

SEQ ID NO: 1302065 - protein, 17 aa, Mycobacterium
PPDARFGWPKRNGFVQP

SEQ ID NO: 1302066 - protein, 28 aa, Mycobacterium
PPDDARARLEVHLGWEPGTIAAVRAGSP

SEQ ID NO: 1302067 - protein, 31 aa, Mycobacterium
PPDEPKGWLITTAWRRFLDLSRSDTARRRRE

SEQ ID NO: 1302068 - protein, 21 aa, Mycobacterium
PPDWDSLELLLRDAVDESVAM

SEQ ID NO: 1302069 - protein, 26 aa, Mycobacterium
PPEDVARLLVFLYLGVRQASDLDDAA

SEQ ID NO: 1302070 - protein, 20 aa, Mycobacterium
PPELSYWPFGGIGVCQLIAG

SEQ ID NO: 1302071 - protein, 37 aa, Mycobacterium
PPEPHPVLPATPWQHNRYWMDLTPLRRTATDAAPQGD

SEQ ID NO: 1302072 - protein, 28 aa, Mycobacterium
PPGELRARALQLLGLVRLYANSSSEAVP

SEQ ID NO: 1302073 - protein, 27 aa, Mycobacterium
PPGRLGWNWAKFAFGSWTTLSWVDANV

SEQ ID NO: 1302074 - protein, 26 aa, Mycobacterium
PPGSEGLLMLPYLAGERTPVFDPRAR

SEQ ID NO: 1302075 - protein, 23 aa, Mycobacterium
PPGVPGTIWFRGGNSSFEYLNDP

SEQ ID NO: 1302076 - protein, 39 aa, Mycobacterium
PPHLALAHTLFDRLVFSKVRAVFGGRIRFMISGSAPLNR

SEQ ID NO: 1302077 - protein, 19 aa, Mycobacterium
PPIGITRRHRPGRRGRVRR

SEQ ID NO: 1302078 - protein, 21 aa, Mycobacterium
PPLPGQWPYVRGGDALRDVKS

SEQ ID NO: 1302079 - protein, 18 aa, Mycobacterium
PPMADWLEAFVPLRVHVL

SEQ ID NO: 1302080 - protein, 24 aa, Mycobacterium
PPNGPPPPSRWARRKPEAAARLEA

SEQ ID NO: 1302081 - protein, 17 aa, Mycobacterium
PPPPPAPFDALAAPAPA

SEQ ID NO: 1302082 - protein, 18 aa, Mycobacterium
PPQCPCGGLIRPNVVWFG

SEQ ID NO: 1302083 - protein, 20 aa, Mycobacterium
PPRRLVFAADVPKLDQPLPR

SEQ ID NO: 1302084 - protein, 32 aa, Mycobacterium
PPRRTPPAHGWRRWVYRLSFGRINPGQSPEEL

SEQ ID NO: 1302085 - protein, 17 aa, Mycobacterium
PPRVLWSSGPSPSEVVV

SEQ ID NO: 1302086 - protein, 24 aa, Mycobacterium
PPSDAVYYPLYTKCAELGLPLCIN

SEQ ID NO: 1302087 - protein, 23 aa, Mycobacterium
PPTGCAFHPRCPLAIDACDDTGL

SEQ ID NO: 1302088 - protein, 18 aa, Mycobacterium
PPTWTALPPEVNTGRLMA

SEQ ID NO: 1302089 - protein, 20 aa, Mycobacterium
PPVELDAAILFAPVGDLVLP

SEQ ID NO: 1302090 - protein, 23 aa, Mycobacterium
PPYQRYSMFVLPGGTPGVNVLRD

SEQ ID NO: 1302091 - protein, 28 aa, Mycobacterium
PQAQTWFDRGLIWAYAFNHEEAIRCFER

SEQ ID NO: 1302092 - protein, 27 aa, Mycobacterium
PQEGTPPFRRMAKPVLAAINGICCGAG

SEQ ID NO: 1302093 - protein, 27 aa, Mycobacterium
PQFAQQALSAFRKFGFQLVIVATVQNA

SEQ ID NO: 1302094 - protein, 23 aa, Mycobacterium
PQFTKPVRLVWGMRDRCFTPALG

SEQ ID NO: 1302095 - protein, 19 aa, Mycobacterium
PQGAIGEMFKRLGAISPAP

SEQ ID NO: 1302096 - protein, 24 aa, Mycobacterium
PQGARTVALWEPALLTDLVGENGA

SEQ ID NO: 1302097 - protein, 21 aa, Mycobacterium
PQGEFWVPHRLGGGAPTLAEA

SEQ ID NO: 1302098 - protein, 24 aa, Mycobacterium
PQGTQVHLYFDRCQRRAPVQAEAA

SEQ ID NO: 1302099 - protein, 27 aa, Mycobacterium
PQHAKLWYQVVFAFLARHVLGRDVELP

SEQ ID NO: 1302100 - protein, 20 aa, Mycobacterium
PQHLQLVLHKLHDAGATVTQ

SEQ ID NO: 1302101 - protein, 24 aa, Mycobacterium
PQLFKQLLMVAGMERYYQIARCYR

SEQ ID NO: 1302102 - protein, 17 aa, Mycobacterium
PQLIASEAAFGAKAALM

SEQ ID NO: 1302103 - protein, 32 aa, Mycobacterium
PQMMEFLENLSPWFEFVWKPGYADYYPELPGG

SEQ ID NO: 1302104 - protein, 27 aa, Mycobacterium
PQMMKLFEKLFGPYPLASGYTVVVTDD

SEQ ID NO: 1302105 - protein, 17 aa, Mycobacterium
PQRIALSTGSPFPGPAT

SEQ ID NO: 1302106 - protein, 23 aa, Mycobacterium
PQRKDYPLGGIPVEYHGARIPPP

SEQ ID NO: 1302107 - protein, 17 aa, Mycobacterium
PQRSITSGVLPPQLLFA

SEQ ID NO: 1302108 - protein, 24 aa, Mycobacterium
PQVLARTFGRYYANPRFAAEEVRH

SEQ ID NO: 1302109 - protein, 24 aa, Mycobacterium
PQVPIIEHADVKRMLLAQKSYVEG

SEQ ID NO: 1302110 - protein, 20 aa, Mycobacterium
PQWLKDLRKNGPHPKNLVAA

SEQ ID NO: 1302111 - protein, 26 aa, Mycobacterium
PRDADPELLIGKYIPNLVPRPFTLDR

SEQ ID NO: 1302112 - protein, 28 aa, Mycobacterium
PREIDVLMALCRPLVSDDLFPEPASVRR

SEQ ID NO: 1302113 - protein, 26 aa, Mycobacterium
PRELVLDAYLLRAMGIAGWAPALTEC

SEQ ID NO: 1302114 - protein, 21 aa, Mycobacterium
PREPEFEMFGRFPLTDNDPGA

SEQ ID NO: 1302115 - protein, 20 aa, Mycobacterium
PRERLPLVDVAFAGAWGRPS

SEQ ID NO: 1302116 - protein, 17 aa, Mycobacterium
PRERLSIAVAAVASARH

SEQ ID NO: 1302117 - protein, 21 aa, Mycobacterium
PRFDALGRWLLGRTADLSAGR

SEQ ID NO: 1302118 - protein, 23 aa, Mycobacterium
PRGSAFIVVHRLDNLRRSGRIGA

SEQ ID NO: 1302119 - protein, 20 aa, Mycobacterium
PRGTMRLLNVRRWSERTLIA

SEQ ID NO: 1302120 - protein, 24 aa, Mycobacterium
PRGYRDLIMLRGLTETALLPYDPG

SEQ ID NO: 1302121 - protein, 25 aa, Mycobacterium
PRHTLWQAWHRSGLQRRWLAASERG

SEQ ID NO: 1302122 - protein, 18 aa, Mycobacterium
PRIAPQSPAFLTALLASA

SEQ ID NO: 1302123 - protein, 17 aa, Mycobacterium
PRILAMQPTSRALRIRQ

SEQ ID NO: 1302124 - protein, 17 aa, Mycobacterium
PRISALIEVDRVHGWGA

SEQ ID NO: 1302125 - protein, 18 aa, Mycobacterium
PRLRVNAVAPGLVRTPLT

SEQ ID NO: 1302126 - protein, 32 aa, Mycobacterium
PRLTRAFLRFNVHLLFRSTLPARLRELAILRV

SEQ ID NO: 1302127 - protein, 26 aa, Mycobacterium
PRPVRYLVRHIVPRIDPPLLRVSRGR

SEQ ID NO: 1302128 - protein, 23 aa, Mycobacterium
PRRCGPSPHRPDLALTGRECQLH

SEQ ID NO: 1302129 - protein, 17 aa, Mycobacterium
PRRLLKAARLGLIDLDR

SEQ ID NO: 1302130 - protein, 18 aa, Mycobacterium
PRRSGPVVWVKDASRSVP

SEQ ID NO: 1302131 - protein, 18 aa, Mycobacterium
PRRWLEIRYLDAVSDALW

SEQ ID NO: 1302132 - protein, 17 aa, Mycobacterium
PRSAWLASARRALTNAP

SEQ ID NO: 1302133 - protein, 18 aa, Mycobacterium
PRSFIRCLQDQSMPRWLA

SEQ ID NO: 1302134 - protein, 37 aa, Mycobacterium
PRSVEPVPVNPTLPPSVPPIEFPATVPAVPGGQTDAG

SEQ ID NO: 1302135 - protein, 18 aa, Mycobacterium
PRTLAWSAAWEMTREAEL

SEQ ID NO: 1302136 - protein, 27 aa, Mycobacterium
PRTTDPASLAWLFYTSGTTGRSKGAML

SEQ ID NO: 1302137 - protein, 18 aa, Mycobacterium
PRVSPFPAVFQDVSLIVD

SEQ ID NO: 1302138 - protein, 35 aa, Mycobacterium
PSAPGHPLMFMVQAWNWIFPLGENPDYEPAASTSI

SEQ ID NO: 1302139 - protein, 24 aa, Mycobacterium
PSASLMIRMGRLSERFAKIRAQRA

SEQ ID NO: 1302140 - protein, 17 aa, Mycobacterium
PSATFPMEMDRYPGRIW

SEQ ID NO: 1302141 - protein, 24 aa, Mycobacterium
PSDTVLVFMHPIGGGAYLPMMNAL

SEQ ID NO: 1302142 - protein, 18 aa, Mycobacterium
PSGRLEELTPEDIEQVLS

SEQ ID NO: 1302143 - protein, 21 aa, Mycobacterium
PSGWDKLTKHLLRKGFEFKEL

SEQ ID NO: 1302144 - protein, 41 aa, Mycobacterium
PSHKLLIRAGYVRPVGPGLYTWLPLGLRVFRKIEQIVRDEM

SEQ ID NO: 1302145 - protein, 25 aa, Mycobacterium
PSHLYSYSFALNPDWTRSFSTQPEI

SEQ ID NO: 1302146 - protein, 21 aa, Mycobacterium
PSHTRGYIGTALRLLERKIAQ

SEQ ID NO: 1302147 - protein, 21 aa, Mycobacterium
PSLDLYREPDPFRVPRPSEIR

SEQ ID NO: 1302148 - protein, 22 aa, Mycobacterium
PSLEPRWFAWVDNMHDWCISRQ

SEQ ID NO: 1302149 - protein, 26 aa, Mycobacterium
PSQSNFVWLPLAERTLDFVRRAAENR

SEQ ID NO: 1302150 - protein, 18 aa, Mycobacterium
PSQWLLRMLATQTERTEL

SEQ ID NO: 1302151 - protein, 18 aa, Mycobacterium
PSTARLTGRWLRGRLPVV

SEQ ID NO: 1302152 - protein, 18 aa, Mycobacterium
PSTRTQVLRRLRAHLAPA

SEQ ID NO: 1302153 - protein, 19 aa, Mycobacterium
PSVNLQLLGGRVRGLTQAA

SEQ ID NO: 1302154 - protein, 20 aa, Mycobacterium
PSYLAAQYYAQRASAGIVIT

SEQ ID NO: 1302155 - protein, 18 aa, Mycobacterium
PSYRFRPSDVRKACSALT

SEQ ID NO: 1302156 - protein, 27 aa, Mycobacterium
PTAASCRQILLKWPVLDNDELNKIVHI

SEQ ID NO: 1302157 - protein, 23 aa, Mycobacterium
PTALLAPKWVPWQDRVRPGDLGP

SEQ ID NO: 1302158 - protein, 21 aa, Mycobacterium
PTAQRILAHFGLDGFFEVIAG

SEQ ID NO: 1302159 - protein, 17 aa, Mycobacterium
PTDFRLWVCLHEVTHRV

SEQ ID NO: 1302160 - protein, 23 aa, Mycobacterium
PTDKAMLFPLSATSAEELRRTAA

SEQ ID NO: 1302161 - protein, 17 aa, Mycobacterium
PTEDLVALLAPTVTRYL

SEQ ID NO: 1302162 - protein, 25 aa, Mycobacterium
PTGDAELLLIGWGSSYGPIGEACRR

SEQ ID NO: 1302163 - protein, 22 aa, Mycobacterium
PTGLWERVIDIFAPAHVVEFFA

SEQ ID NO: 1302164 - protein, 34 aa, Mycobacterium
PTHRRRVGLLLQDPLLFPHLQVAANVAFGARSTG

SEQ ID NO: 1302165 - protein, 20 aa, Mycobacterium
PTIYRRWRDTDAVLAALLTA

SEQ ID NO: 1302166 - protein, 17 aa, Mycobacterium
PTKYFIIVPNMLGNGLS

SEQ ID NO: 1302167 - protein, 20 aa, Mycobacterium
PTLLTGVEWLDTARTAGVPA

SEQ ID NO: 1302168 - protein, 31 aa, Mycobacterium
PTLPAPARWALRKALRPVFAATYLTTVGVME

SEQ ID NO: 1302169 - protein, 23 aa, Mycobacterium
PTLPNPVPPLYFGGSSAAAGPVA

SEQ ID NO: 1302170 - protein, 19 aa, Mycobacterium
PTLQLINRDAEQTHLSMGV

SEQ ID NO: 1302171 - protein, 30 aa, Mycobacterium
PTNHLDADSIGWLRTFLQNHSGGLVVISHD

SEQ ID NO: 1302172 - protein, 19 aa, Mycobacterium
PTNLGRLVLNEPAPLPCTP

SEQ ID NO: 1302173 - protein, 27 aa, Mycobacterium
PTNVNTPLFMNEGTMKLFRPDLENPGP

SEQ ID NO: 1302174 - protein, 29 aa, Mycobacterium
PTPDMRLEMPLVDFFSRGGSLKSSWYGDC

SEQ ID NO: 1302175 - protein, 19 aa, Mycobacterium
PTPEAFLDALVNAFAAIDV

SEQ ID NO: 1302176 - protein, 18 aa, Mycobacterium
PTPFITFRVWHPLSHDRM

SEQ ID NO: 1302177 - protein, 29 aa, Mycobacterium
PTPKAEHLPGLSALLRISRDVGAVLLGAS

SEQ ID NO: 1302178 - protein, 26 aa, Mycobacterium
PTREDQALLYRLSGDRNPLHSDPWFA

SEQ ID NO: 1302179 - protein, 27 aa, Mycobacterium
PTRGLLNPLTGLPTAAPLAMLLDHVGG

SEQ ID NO: 1302180 - protein, 17 aa, Mycobacterium
PTRRDRWRRTSGIHKVR

SEQ ID NO: 1302181 - protein, 19 aa, Mycobacterium
PTRVLPKPRRVRFPMPTST

SEQ ID NO: 1302182 - protein, 17 aa, Mycobacterium
PTSMWIDVVTTAHEVGL

SEQ ID NO: 1302183 - protein, 23 aa, Mycobacterium
PTSRDFPVHWPVSTRWTDNDMFG

SEQ ID NO: 1302184 - protein, 19 aa, Mycobacterium
PTTPGTYPFHCKYHANMHG

SEQ ID NO: 1302185 - protein, 25 aa, Mycobacterium
PTTPWHHTRHWFDSARPQRTTQHSG

SEQ ID NO: 1302186 - protein, 19 aa, Mycobacterium
PTVLLGDTSRYLGGGAATT

SEQ ID NO: 1302187 - protein, 19 aa, Mycobacterium
PTVLVLPGPPRELQPMWRT

SEQ ID NO: 1302188 - protein, 22 aa, Mycobacterium
PTVRPDFWELVDYATAHHVGVK

SEQ ID NO: 1302189 - protein, 17 aa, Mycobacterium
PTVVSKLALPPAGLRVI

SEQ ID NO: 1302190 - protein, 24 aa, Mycobacterium
PTVVTPQMFTYQLLDQARSDRKRI

SEQ ID NO: 1302191 - protein, 22 aa, Mycobacterium
PTVVYVHSPARWAWDKAMRREE

SEQ ID NO: 1302192 - protein, 21 aa, Mycobacterium
PTYVYRYDYAPRTLKWTGLGA

SEQ ID NO: 1302193 - protein, 20 aa, Mycobacterium
PVAAICHGPWTLVEADVVRD

SEQ ID NO: 1302194 - protein, 24 aa, Mycobacterium
PVAEHATVVQRWLEAGLAIFGKTN

SEQ ID NO: 1302195 - protein, 25 aa, Mycobacterium
PVAGAPWLTAFAQTSKFAEAFASIG

SEQ ID NO: 1302196 - protein, 18 aa, Mycobacterium
PVAGIYPVTLDKSKNSSA

SEQ ID NO: 1302197 - protein, 22 aa, Mycobacterium
PVALALVKRGLPADTPLTTGGD

SEQ ID NO: 1302198 - protein, 22 aa, Mycobacterium
PVARLALDHDIPVLRPPKPNSE

SEQ ID NO: 1302199 - protein, 25 aa, Mycobacterium
PVARVEPIWLSWIERWPTPSATAAA

SEQ ID NO: 1302200 - protein, 20 aa, Mycobacterium
PVDAFLDLVLEYGRELRWRT

SEQ ID NO: 1302201 - protein, 30 aa, Mycobacterium
PVDEPALPEPLPPGPTRRAPLGLVAGARSG

SEQ ID NO: 1302202 - protein, 22 aa, Mycobacterium
PVDFGSFLIPRSEYRIDDVWNV

SEQ ID NO: 1302203 - protein, 27 aa, Mycobacterium
PVDGMEALLPLLRPTDLAMLSDHLPDG

SEQ ID NO: 1302204 - protein, 18 aa, Mycobacterium
PVDLTPPAPVDPAELRRR

SEQ ID NO: 1302205 - protein, 28 aa, Mycobacterium
PVDRIDPVLLDLLRLGTYQLLRTRVEPH

SEQ ID NO: 1302206 - protein, 27 aa, Mycobacterium
PVDRRRNLLHRHVSVLIAAVMGLPSPE

SEQ ID NO: 1302207 - protein, 17 aa, Mycobacterium
PVEAGRRLANYLRVLTM

SEQ ID NO: 1302208 - protein, 32 aa, Mycobacterium
PVEITIISPVDYMLYTPLLPDVAGGLVDARFV

SEQ ID NO: 1302209 - protein, 26 aa, Mycobacterium
PVEQANAILFLLSDMSSYITGQTLLV

SEQ ID NO: 1302210 - protein, 19 aa, Mycobacterium
PVFATYADPIVHLGPLGSG

SEQ ID NO: 1302211 - protein, 24 aa, Mycobacterium
PVFSDLVSLQYIRPEPDGTVLFGN

SEQ ID NO: 1302212 - protein, 41 aa, Mycobacterium
PVGDGVRWALRHLPFYGRWYRFLLFWPGCDKGLAAARVDPD

SEQ ID NO: 1302213 - protein, 20 aa, Mycobacterium
PVGDPARPLTVTGGLTFAGG

SEQ ID NO: 1302214 - protein, 19 aa, Mycobacterium
PVGTVFLGLAGPVDTKVVE

SEQ ID NO: 1302215 - protein, 19 aa, Mycobacterium
PVGWMSSAVRTSLGLTTAA

SEQ ID NO: 1302216 - protein, 17 aa, Mycobacterium
PVHPHPLPSQPWTQHRD

SEQ ID NO: 1302217 - protein, 24 aa, Mycobacterium
PVHSIRLAGLVAHQEVLFGTQGET

SEQ ID NO: 1302218 - protein, 17 aa, Mycobacterium
PVIEYWVRPRDAAPDVL

SEQ ID NO: 1302219 - protein, 19 aa, Mycobacterium
PVLKIPRLQDAYFKRFTDY

SEQ ID NO: 1302220 - protein, 22 aa, Mycobacterium
PVLLAALGPVMLRLAGERAGGT

SEQ ID NO: 1302221 - protein, 20 aa, Mycobacterium
PVLVAALGPVMLQLAGELTD

SEQ ID NO: 1302222 - protein, 24 aa, Mycobacterium
PVLVAIDDLQWLDPPTAAVLASVA

SEQ ID NO: 1302223 - protein, 18 aa, Mycobacterium
PVLYQHFSSKLELYLAVL

SEQ ID NO: 1302224 - protein, 20 aa, Mycobacterium
PVMPCAYTGFHLKPVGFFDG

SEQ ID NO: 1302225 - protein, 26 aa, Mycobacterium
PVMPPQILHMILPRSDYEIVDDSWDV

SEQ ID NO: 1302226 - protein, 21 aa, Mycobacterium
PVMRITPPTVLTLWTEDAYGG

SEQ ID NO: 1302227 - protein, 18 aa, Mycobacterium
PVPAVMFVVAATEGWMPQ

SEQ ID NO: 1302228 - protein, 26 aa, Mycobacterium
PVPDPLDLLTFLAAHTERLGLATGVL

SEQ ID NO: 1302229 - protein, 24 aa, Mycobacterium
PVPYTIVRATQFFEFLTTIADSAT

SEQ ID NO: 1302230 - protein, 20 aa, Mycobacterium
PVRLKEAIRRFGPIFAQYYG

SEQ ID NO: 1302231 - protein, 18 aa, Mycobacterium
PVRQIFFRLGEVILEVVG

SEQ ID NO: 1302232 - protein, 25 aa, Mycobacterium
PVRRQFYWHRFFSHQPDLNYDNPAV

SEQ ID NO: 1302233 - protein, 19 aa, Mycobacterium
PVRSPREVLGVLRAVLFAP

SEQ ID NO: 1302234 - protein, 26 aa, Mycobacterium
PVSALVSFEVFLRAPLRAAMGADRPE

SEQ ID NO: 1302235 - protein, 25 aa, Mycobacterium
PVSVPTFWAADLPRSFIRCLQDQSM

SEQ ID NO: 1302236 - protein, 21 aa, Mycobacterium
PVTARLPHGWPARLRRVVERH

SEQ ID NO: 1302237 - protein, 18 aa, Mycobacterium
PVTDGAVLPILHLNSYKI

SEQ ID NO: 1302238 - protein, 23 aa, Mycobacterium
PVTGAPVELLWVKGSGGDLGTLT

SEQ ID NO: 1302239 - protein, 23 aa, Mycobacterium
PVTGELLFFSYSKEAPHLRYGVV

SEQ ID NO: 1302240 - protein, 34 aa, Mycobacterium; identical to SEQ ID NO: 847736

SEQ ID NO: 1302241 - protein, 23 aa, Mycobacterium
PVTSPTFVLARVHRARQPGRPAM

SEQ ID NO: 1302242 - protein, 20 aa, Mycobacterium
PVTVLVLPRLDAQTALDLIE

SEQ ID NO: 1302243 - protein, 31 aa, Mycobacterium
PVVEDLKKLAKERGLWNLFLPSESGLSNLEY

SEQ ID NO: 1302244 - protein, 29 aa, Mycobacterium
PVVMLDPIGHYEGLLAWLHGLVDSGYVAR

SEQ ID NO: 1302245 - protein, 24 aa, Mycobacterium
PVVPDKFFLPPRVVSLYGTRMWTE

SEQ ID NO: 1302246 - protein, 19 aa, Mycobacterium
PVVRAALPGLIADVADDAD

SEQ ID NO: 1302247 - protein, 25 aa, Mycobacterium
PVVVQFDEPLLPAALAGRLTGVTAF

SEQ ID NO: 1302248 - protein, 26 aa, Mycobacterium
PVYDDEFFVVLPRDHRFAAAVEVPFE

SEQ ID NO: 1302249 - protein, 20 aa, Mycobacterium
PVYTLAHYGVFVPPLGSLLR

SEQ ID NO: 1302250 - protein, 26 aa, Mycobacterium
PWGGSYYVEWLTHQLATAARMHIGEV

SEQ ID NO: 1302251 - protein, 41 aa, Mycobacterium; identical to SEQ ID NO: 847824

SEQ ID NO: 1302252 - protein, 26 aa, Mycobacterium
PWRDHEWQGWWGDEPPFHTPVFVMTH

SEQ ID NO: 1302253 - protein, 21 aa, Mycobacterium
PWWLKPLNKVVIASTKLGLPI

SEQ ID NO: 1302254 - protein, 18 aa, Mycobacterium
PYARGLLVQMYREAKERL

SEQ ID NO: 1302255 - protein, 18 aa, Mycobacterium
PYGVRPLSLGRLDRGWVV

SEQ ID NO: 1302256 - protein, 19 aa, Mycobacterium
PYLVPIIGDWPNRPGGDPW

SEQ ID NO: 1302257 - protein, 21 aa, Mycobacterium
PYPSPDPFEPFAVAAVELADE

SEQ ID NO: 1302258 - protein, 32 aa, Mycobacterium
PYRLAGELGMPPWRVQKAQKQARRWSRASVAE

SEQ ID NO: 1302259 - protein, 46 aa, Mycobacterium
PYSFEVFRRTIARRLHLLDPLRYRLIDIPFRFHHPMWLENCDVDLD

SEQ ID NO: 1302260 - protein, 24 aa, Mycobacterium
PYSGPTAALTDVWRALRASMRSVL

SEQ ID NO: 1302261 - protein, 18 aa, Mycobacterium
PYSYLMTRRIERAMALLR

SEQ ID NO: 1302262 - protein, 45 aa, Mycobacterium
PYVLQDFSLFQVLRYGFRPSKVAFLAWHAWRDADSGNWPTGFPDS

SEQ ID NO: 1302263 - protein, 19 aa, Mycobacterium
PYYNAIVWQDTRTDRIATA

SEQ ID NO: 1302264 - protein, 18 aa, Mycobacterium
QAAAALNEILFSLGRAVR

SEQ ID NO: 1302265 - protein, 24 aa, Mycobacterium
QAADGRFYLLTQPEYVGNAMAERA

SEQ ID NO: 1302266 - protein, 23 aa, Mycobacterium
QAAGWKLLNLDWADVTVASVYKW

SEQ ID NO: 1302267 - protein, 21 aa, Mycobacterium
QAALMRLGRLREQLQEVERRL

SEQ ID NO: 1302268 - protein, 37 aa, Mycobacterium
QAAMFDGRFAGFADFLILEGDRYLLRDTKLARSVKVE

SEQ ID NO: 1302269 - protein, 23 aa, Mycobacterium
QAAVETLFIFPHAGGSAAGYKPF

SEQ ID NO: 1302270 - protein, 24 aa, Mycobacterium
QADLTGALTVIRPLSRSATEEVSV

SEQ ID NO: 1302271 - protein, 24 aa, Mycobacterium
QADVVNRWTWIPFGAGRHRCVGAA

SEQ ID NO: 1302272 - protein, 20 aa, Mycobacterium
QAEALGDMLAARNLSLDAVI

SEQ ID NO: 1302273 - protein, 24 aa, Mycobacterium
QAEAYPFMTPIFGKGVVFDASPER

SEQ ID NO: 1302274 - protein, 25 aa, Mycobacterium
QAELAAQGWVIIRVSRDILRHRRDV

SEQ ID NO: 1302275 - protein, 18 aa, Mycobacterium
QAEQLDIMVTWGHLYISL

SEQ ID NO: 1302276 - protein, 24 aa, Mycobacterium
QAESLVGQLLAFGADRLYAADRTR

SEQ ID NO: 1302277 - protein, 20 aa, Mycobacterium
QAFYRTALALGAEPLHEPRL

SEQ ID NO: 1302278 - protein, 18 aa, Mycobacterium
QALGVPYVINPRMVRGLD

SEQ ID NO: 1302279 - protein, 27 aa, Mycobacterium
QALTPDKPFFMYFAPGATHAPHHVPRE

SEQ ID NO: 1302280 - protein, 31 aa, Mycobacterium
QANGYLVLDQPWPAMLRGIWGDPQRFKETYW

SEQ ID NO: 1302281 - protein, 24 aa, Mycobacterium
QAPFHIYQRALATGAFREVAATGS

SEQ ID NO: 1302282 - protein, 28 aa, Mycobacterium
QAPGGLSCFFLPRILPDGTRNRMLLQRL

SEQ ID NO: 1302283 - protein, 30 aa, Mycobacterium
QAPTSAFQASPFRWLNWLSDSRATITAAPN

SEQ ID NO: 1302284 - protein, 23 aa, Mycobacterium
QAQGTLYFGVPTVWSRIAADDDA

SEQ ID NO: 1302285 - protein, 24 aa, Mycobacterium
QAQSAPWLPLAHAEALDASADWVP

SEQ ID NO: 1302286 - protein, 26 aa, Mycobacterium
QARRWSRASVAEAMRLVAALNADVKG

SEQ ID NO: 1302287 - protein, 24 aa, Mycobacterium
QASRLLKPYHPALDVSPFAAAQVV

SEQ ID NO: 1302288 - protein, 37 aa, Mycobacterium
QATARPPTFVLFTSGFLEAGYRRFLERRLRETFGFEG

SEQ ID NO: 1302289 - protein, 27 aa, Mycobacterium
QATMAALANFFRIKPAYFTDDEYYEKL

SEQ ID NO: 1302290 - protein, 23 aa, Mycobacterium
QATRTASLAAVTERRRLRADIDE

SEQ ID NO: 1302291 - protein, 19 aa, Mycobacterium
QAVFAAAGWDVERDGLIGA

SEQ ID NO: 1302292 - protein, 21 aa, Mycobacterium
QAVPRYAGIATFARLPQRHEV

SEQ ID NO: 1302293 - protein, 20 aa, Mycobacterium
QAVRFGLFHVLQASARAERR

SEQ ID NO: 1302294 - protein, 27 aa, Mycobacterium
QDAFDYVRDLLSYLPPNNYADPPRYPS

SEQ ID NO: 1302295 - protein, 27 aa, Mycobacterium
QDATTLCDVFLMLQRLRMTHQVEQLSA

SEQ ID NO: 1302296 - protein, 27 aa, Mycobacterium
QDDVALLLYRQPAPLDLVFPARNEYLA

SEQ ID NO: 1302297 - protein, 23 aa, Mycobacterium
QDEPTPVFDVHLLGMGPEGHVNS

SEQ ID NO: 1302298 - protein, 17 aa, Mycobacterium
QDFPFWDVHEYDLARMY

SEQ ID NO: 1302299 - protein, 28 aa, Mycobacterium
QDKLVMRRRLEAMGAPIPRYTAVDTVDD

SEQ ID NO: 1302300 - protein, 21 aa, Mycobacterium
QDLLDILTPVAKSWPSQWCLE

SEQ ID NO: 1302301 - protein, 21 aa, Mycobacterium
QDMAFGYRTSVLKHSDHAVVL

SEQ ID NO: 1302302 - protein, 17 aa, Mycobacterium
QDMLRLRRWCSGTSNRW

SEQ ID NO: 1302303 - protein, 17 aa, Mycobacterium
QDNLLMLSLSRGGPTMW

SEQ ID NO: 1302304 - protein, 19 aa, Mycobacterium
QDTAYAWAYNVEKGQKTRI

SEQ ID NO: 1302305 - protein, 24 aa, Mycobacterium
QDTTRYLGGRPPYGYQLVDAGPHP

SEQ ID NO: 1302306 - protein, 26 aa, Mycobacterium
QDVPAARLMVLPAMSHIGIAAAYDVV

SEQ ID NO: 1302307 - protein, 25 aa, Mycobacterium
QDVPGVVSVPYFWSDQYDVKIQCLG

SEQ ID NO: 1302308 - protein, 18 aa, Mycobacterium
QDYQLQLVPKMLRMLRPD

SEQ ID NO: 1302309 - protein, 24 aa, Mycobacterium
QDYSPADELPYVGPILPGQDKIYV

SEQ ID NO: 1302310 - protein, 25 aa, Mycobacterium
QEDADALPIIAKKSKIPVIADIHFQ

SEQ ID NO: 1302311 - protein, 26 aa, Mycobacterium
QEEIFGPVLVVIPFRDDDEAVRIAND

SEQ ID NO: 1302312 - protein, 23 aa, Mycobacterium
QEGLDKVFQVLRAPHTEEPTNWS

SEQ ID NO: 1302313 - protein, 21 aa, Mycobacterium
QEISRLIGRSLRACIDLNALG

SEQ ID NO: 1302314 - protein, 17 aa, Mycobacterium
QELALAARTLGTPPPVR

SEQ ID NO: 1302315 - protein, 18 aa, Mycobacterium
QELFETFADMELAWGPTW

SEQ ID NO: 1302316 - protein, 22 aa, Mycobacterium
QEPTVLPSRFPNLLANGSGGIA

SEQ ID NO: 1302317 - protein, 28 aa, Mycobacterium
QEVDPGHLWWIRSQLRRALVDDVRARLR

SEQ ID NO: 1302318 - protein, 20 aa, Mycobacterium
QEVWHYVESAPFTVATVADA

SEQ ID NO: 1302319 - protein, 21 aa, Mycobacterium
QFAAPVWMPRAKRAPIRDVQE

SEQ ID NO: 1302320 - protein, 17 aa, Mycobacterium
QFALARRGGLTPGETVL

SEQ ID NO: 1302321 - protein, 18 aa, Mycobacterium
QFDGMFALVQHSLHRIYA

SEQ ID NO: 1302322 - protein, 22 aa, Mycobacterium
QFDQVIAVHLKGTWNGLKSAAA

SEQ ID NO: 1302323 - protein, 19 aa, Mycobacterium
QFGARTWADVLAQRLRISP

SEQ ID NO: 1302324 - protein, 21 aa, Mycobacterium
QFKQAYGESPYSYLMTRRIER

SEQ ID NO: 1302325 - protein, 17 aa, Mycobacterium
QFKQFTLFFIPVARWKR

SEQ ID NO: 1302326 - protein, 17 aa, Mycobacterium
QFMDFRYTVHDRWHGEF

SEQ ID NO: 1302327 - protein, 17 aa, Mycobacterium
QFMQWFLKEQVEEVAQM

SEQ ID NO: 1302328 - protein, 22 aa, Mycobacterium
QFPQLTVLSIAPLLANTIRAVF

SEQ ID NO: 1302329 - protein, 22 aa, Mycobacterium
QFQVFLDDVRLPADALVGSEDA

SEQ ID NO: 1302330 - protein, 20 aa, Mycobacterium
QFVPVMFTRMLKLPEDVRKS

SEQ ID NO: 1302331 - protein, 22 aa, Mycobacterium
QFVQLNPIYATPYIIADIDPLL

SEQ ID NO: 1302332 - protein, 24 aa, Mycobacterium
QFYSMLGTRGIWHQGWFANTVHAA

SEQ ID NO: 1302333 - protein, 25 aa, Mycobacterium
QGAVLKWVSLFGNPLTWDDLPWLRS

SEQ ID NO: 1302334 - protein, 22 aa, Mycobacterium
QGDADAWRRAYSGLAELGIFGV

SEQ ID NO: 1302335 - protein, 20 aa, Mycobacterium
QGDWDLVIAHTLHPAADHTW

SEQ ID NO: 1302336 - protein, 26 aa, Mycobacterium
QGEGFVSVELLFLPGTYATCPTCHGA

SEQ ID NO: 1302337 - protein, 20 aa, Mycobacterium
QGFDIAVFQFVKSAKWKVGE

SEQ ID NO: 1302338 - protein, 24 aa, Mycobacterium
QGGRTRMFAGPDLDLPMYAPHQLE

SEQ ID NO: 1302339 - protein, 20 aa, Mycobacterium
QGIPAQFLVDILSDLRTDRL

SEQ ID NO: 1302340 - protein, 23 aa, Mycobacterium
QGISAELIAAKWGLSRTALDEFS

SEQ ID NO: 1302341 - protein, 21 aa, Mycobacterium
QGITDLITTPGLINVDFADVK

SEQ ID NO: 1302342 - protein, 25 aa, Mycobacterium
QGKCLIRLVPTRWGPVATGGFPPPR

SEQ ID NO: 1302343 - protein, 23 aa, Mycobacterium
QGKTRLLRALTGLLDEWTPVIEG

SEQ ID NO: 1302344 - protein, 20 aa, Mycobacterium
QGLARPAALAEMLRLYCQRM

SEQ ID NO: 1302345 - protein, 21 aa, Mycobacterium
QGLLSPVIKNAGDLSLAGLAR

SEQ ID NO: 1302346 - protein, 17 aa, Mycobacterium
QGLPASAIAWGAWAEIG

SEQ ID NO: 1302347 - protein, 19 aa, Mycobacterium
QGPWKLIIAQHFASAEELM

SEQ ID NO: 1302348 - protein, 23 aa, Mycobacterium
QGRDLTPGPFLPSVAASVVLDRC

SEQ ID NO: 1302349 - protein, 20 aa, Mycobacterium
QGTLDMVLVHRIPAGCTFDT

SEQ ID NO: 1302350 - protein, 18 aa, Mycobacterium
QGVLCGSLLSGLRMQPGH

SEQ ID NO: 1302351 - protein, 27 aa, Mycobacterium
QGVPPKDYFPLLALLKRSLTEEEVVRA

SEQ ID NO: 1302352 - protein, 25 aa, Mycobacterium
QGVRPRVWFGERWITSIFDLFEENV

SEQ ID NO: 1302353 - protein, 33 aa, Mycobacterium
QGVSMPYFPNYLSLASPYAFLGLNFFNTMEYQM

SEQ ID NO: 1302354 - protein, 24 aa, Mycobacterium
QGYPDILAVPDLTTLRIVPWHNDT

SEQ ID NO: 1302355 - protein, 24 aa, Mycobacterium
QHDRNYWQRSLPPTILARTGSTSS

SEQ ID NO: 1302356 - protein, 18 aa, Mycobacterium
QHELYLTDVIAIFRQDGL

SEQ ID NO: 1302357 - protein, 29 aa, Mycobacterium
QHETGHLDGFLYLDRLIGRHARAAKRAVK

SEQ ID NO: 1302358 - protein, 24 aa, Mycobacterium
QHGPFDLTLLPVGAYHPAWPDIHM

SEQ ID NO: 1302359 - protein, 17 aa, Mycobacterium
QHGSPPLALLTRAVEDL

SEQ ID NO: 1302360 - protein, 19 aa, Mycobacterium
QHHRGVGTILLDALGRIAR

SEQ ID NO: 1302361 - protein, 18 aa, Mycobacterium
QHITCRYKCGDACWKPVP

SEQ ID NO: 1302362 - protein, 25 aa, Mycobacterium
QHQDERNFYALDRLWRDCPTVPVDL

SEQ ID NO: 1302363 - protein, 23 aa, Mycobacterium
QHQDHLPLDRLAAAHYPLDHINE

SEQ ID NO: 1302364 - protein, 25 aa, Mycobacterium
QHQMWAAQFISYEKPKTWLNSGGLG

SEQ ID NO: 1302365 - protein, 24 aa, Mycobacterium
QHSLWPTFADVPAGWRVVFGEATR

SEQ ID NO: 1302366 - protein, 22 aa, Mycobacterium
QHVDWIADCLLHLRKLGHDRIE

SEQ ID NO: 1302367 - protein, 19 aa, Mycobacterium
QIAALQRRLGTTTVYVTHD

SEQ ID NO: 1302368 - protein, 18 aa, Mycobacterium
QIAPTPHLSATAAVWHLS

SEQ ID NO: 1302369 - protein, 19 aa, Mycobacterium
QIDLSHLDSPYPFVLVTPQ

SEQ ID NO: 1302370 - protein, 27 aa, Mycobacterium
QIDPNSFFFAAPLEWQERLWPTEEFEL

SEQ ID NO: 1302371 - protein, 18 aa, Mycobacterium
QIEHHLFPDLPSNRYAQI

SEQ ID NO: 1302372 - protein, 24 aa, Mycobacterium
QIEPEVGLACRVVWYGDTVVRLDP

SEQ ID NO: 1302373 - protein, 30 aa, Mycobacterium
QIFGDRVVWVPWRRPGFQLGLDIAEIKRAN

SEQ ID NO: 1302374 - protein, 21 aa, Mycobacterium
QIGIKIWVDGSPWIGNVDLTF

SEQ ID NO: 1302375 - protein, 18 aa, Mycobacterium
QIGNTEWPKWETVMAADP

SEQ ID NO: 1302376 - protein, 17 aa, Mycobacterium
QIGRRLARLARTHQVIV

SEQ ID NO: 1302377 - protein, 26 aa, Mycobacterium
QIIDRLVDWVAFTPLQNATGDPAISL

SEQ ID NO: 1302378 - protein, 28 aa, Mycobacterium
QIIKDYVGWPLISAGAFALAQLALRGRI

SEQ ID NO: 1302379 - protein, 29 aa, Mycobacterium
QILGRALGRGTYKMVFGHRGINVPVMDHA

SEQ ID NO: 1302380 - protein, 21 aa, Mycobacterium
QILSNHLACLRGCGLVVAVPE

SEQ ID NO: 1302381 - protein, 22 aa, Mycobacterium
QIRHYVMTPPTFFAVEYAINPW

SEQ ID NO: 1302382 - protein, 21 aa, Mycobacterium
QIRLGGDMALFAGLGRLLLEA

SEQ ID NO: 1302383 - protein, 22 aa, Mycobacterium
QIVPGKVTKLVPFGAFVRVEEG

SEQ ID NO: 1302384 - protein, 27 aa, Mycobacterium
QKAGPDALVVVLLPDGGRGYLSKIFND

SEQ ID NO: 1302385 - protein, 20 aa, Mycobacterium
QKHRFMVMPMRPEGTDGWTE

SEQ ID NO: 1302386 - protein, 23 aa, Mycobacterium
QKITFHRPIVAGDKLFFDSYLDS

SEQ ID NO: 1302387 - protein, 17 aa, Mycobacterium
QKPVELGDILDVGLRSS

SEQ ID NO: 1302388 - protein, 21 aa, Mycobacterium
QKQRFLPRMATGETRGAFSMS

SEQ ID NO: 1302389 - protein, 17 aa, Mycobacterium
QKQRWMPGITSGELIIA

SEQ ID NO: 1302390 - protein, 25 aa, Mycobacterium
QKRPQGHPPLVLWAVGPVGMDEVAE

SEQ ID NO: 1302391 - protein, 23 aa, Mycobacterium
QLARARTGVFWVREMLPIGKIRE

SEQ ID NO: 1302392 - protein, 17 aa, Mycobacterium
QLCSAALITWFNDHFDD

SEQ ID NO: 1302393 - protein, 17 aa, Mycobacterium
QLDIMGVPGIIVARTDA

SEQ ID NO: 1302394 - protein, 17 aa, Mycobacterium
QLDLSLPIPERLDLARQ

SEQ ID NO: 1302395 - protein, 25 aa, Mycobacterium
QLEENPYLPPYYHPGPEAPEIRYML

SEQ ID NO: 1302396 - protein, 27 aa, Mycobacterium
QLFEAGPWDRLGPLDLFGHCMGAVVAF

SEQ ID NO: 1302397 - protein, 24 aa, Mycobacterium
QLGRLTRLWAAPVYRMVYDPDGRS

SEQ ID NO: 1302398 - protein, 26 aa, Mycobacterium
QLHKQAHLPYLVYLRHPTTGGVFASW

SEQ ID NO: 1302399 - protein, 19 aa, Mycobacterium
QLIALYEHQVFTEGVVWGV

SEQ ID NO: 1302400 - protein, 36 aa, Mycobacterium
QLNPIVELAHRFADKPTILFLGRHVGYPVALEGALK

SEQ ID NO: 1302401 - protein, 22 aa, Mycobacterium
QLPFVELNAAFYPPRPPDEKVP

SEQ ID NO: 1302402 - protein, 23 aa, Mycobacterium
QLPGYGWVFPMGDGIFNIGLGYV

SEQ ID NO: 1302403 - protein, 25 aa, Mycobacterium
QLQTTPLTWPVGIAGDFKGVLDRRS

SEQ ID NO: 1302404 - protein, 28 aa, Mycobacterium
QLRAADGLTWHHPLSSLFPMEEDGFWAL

SEQ ID NO: 1302405 - protein, 20 aa, Mycobacterium
QLRIRELLNRIGERVDGVDV

SEQ ID NO: 1302406 - protein, 17 aa, Mycobacterium
QLRLFAAVLREGSWNGV

SEQ ID NO: 1302407 - protein, 17 aa, Mycobacterium
QLRPGDTVRFVPIRVAD

SEQ ID NO: 1302408 - protein, 34 aa, Mycobacterium; identical to SEQ ID NO: 785585

SEQ ID NO: 1302409 - protein, 17 aa, Mycobacterium
QLRSRSWWSGPDVVLLV

SEQ ID NO: 1302410 - protein, 17 aa, Mycobacterium
QLSAADPAIAAFLSIHN

SEQ ID NO: 1302411 - protein, 24 aa, Mycobacterium
QLSEKILFEEIGPGQLITVDVENW

SEQ ID NO: 1302412 - protein, 18 aa, Mycobacterium
QLSRWTSFEAHPLDAMDL

SEQ ID NO: 1302413 - protein, 26 aa, Mycobacterium
QLSTYFHEQVFPVLTPLAVDPAHPFP

SEQ ID NO: 1302414 - protein, 17 aa, Mycobacterium
QLSVRLSELDLILRIVD

SEQ ID NO: 1302415 - protein, 30 aa, Mycobacterium
QLTEHPHQAGWWMHFFLADGGAVLVGSGGF

SEQ ID NO: 1302416 - protein, 25 aa, Mycobacterium
QLTQRELELLVYLIERHGRVASSDE

SEQ ID NO: 1302417 - protein, 19 aa, Mycobacterium
QLVSLAHSLLARGVIDEAE

SEQ ID NO: 1302418 - protein, 26 aa, Mycobacterium
QMARTCVDAGWLLSLSGTVSFRNAHA

SEQ ID NO: 1302419 - protein, 27 aa, Mycobacterium
QMDIPPKLAIPMRVIASVVAISCQLDA

SEQ ID NO: 1302420 - protein, 18 aa, Mycobacterium
QMFAGDAARLLLLGNALH

SEQ ID NO: 1302421 - protein, 20 aa, Mycobacterium
QMFRPMVGAQRWIAAGLFDP

SEQ ID NO: 1302422 - protein, 17 aa, Mycobacterium
QMGMSGAAITYLVERMI

SEQ ID NO: 1302423 - protein, 17 aa, Mycobacterium
QMPMKVISSLLGIPEDD

SEQ ID NO: 1302424 - protein, 18 aa, Mycobacterium
QMVPTMFVRLLKLDADVR

SEQ ID NO: 1302425 - protein, 24 aa, Mycobacterium
QNTTWAEMLPIWQAADDIDVYESG

SEQ ID NO: 1302426 - protein, 18 aa, Mycobacterium
QNVRLPWEVNGEKFVLHL

SEQ ID NO: 1302427 - protein, 21 aa, Mycobacterium
QNWEEMFSIARFVGVSRPGYE

SEQ ID NO: 1302428 - protein, 19 aa, Mycobacterium
QNWSLGVPAPLQPAPAPPA

SEQ ID NO: 1302429 - protein, 20 aa, Mycobacterium
QPARWLIRESEHAQLVVVGV

SEQ ID NO: 1302430 - protein, 28 aa, Mycobacterium
QPDEIAPSYVFFAAGRMSSYYSGEVLAP

SEQ ID NO: 1302431 - protein, 19 aa, Mycobacterium
QPDPAWLAVYEREVPIEVL

SEQ ID NO: 1302432 - protein, 20 aa, Mycobacterium
QPEFKVCAVALRPVQTVAAP

SEQ ID NO: 1302433 - protein, 24 aa, Mycobacterium
QPERLKSGWLNGIKHWQVDYTGAG

SEQ ID NO: 1302434 - protein, 22 aa, Mycobacterium
QPGEAMLRCRLGQSQAAWADLR

SEQ ID NO: 1302435 - protein, 26 aa, Mycobacterium
QPGNPVVLPTVWDAWSANLAVGAGFA

SEQ ID NO: 1302436 - protein, 27 aa, Mycobacterium
QPGTFEGWLHRITTNLFLDMVRRRGRI

SEQ ID NO: 1302437 - protein, 28 aa, Mycobacterium
QPGTNLQAWLFRIQYNQWVSAYRWKERR

SEQ ID NO: 1302438 - protein, 29 aa, Mycobacterium
QPHHRLELPTYPFQRRRFWPKTSSITVDG

SEQ ID NO: 1302439 - protein, 22 aa, Mycobacterium
QPLRPPVSFGFASAPAAPQLVA

SEQ ID NO: 1302440 - protein, 20 aa, Mycobacterium
QPLSVFMFDLLHVDGADLLD

SEQ ID NO: 1302441 - protein, 20 aa, Mycobacterium
QPNRVFLRNWRDALELPKER

SEQ ID NO: 1302442 - protein, 20 aa, Mycobacterium
QPQARYILPSFIEHSSFGVK

SEQ ID NO: 1302443 - protein, 30 aa, Mycobacterium; identical to SEQ ID NO: 849929

SEQ ID NO: 1302444 - protein, 32 aa, Mycobacterium
QPTVHPLPELLLATAFAHYLYDRLAVGGPLET

SEQ ID NO: 1302445 - protein, 17 aa, Mycobacterium
QPVLLLRESNGDRYLPI

SEQ ID NO: 1302446 - protein, 23 aa, Mycobacterium
QQALLAPYTEKYFAAIAGVWERR

SEQ ID NO: 1302447 - protein, 27 aa, Mycobacterium
QQFKKYERLWLSWAMANRDPSVFTAPN

SEQ ID NO: 1302448 - protein, 18 aa, Mycobacterium
QQGHAVGALHIPMGDVPS

SEQ ID NO: 1302449 - protein, 24 aa, Mycobacterium
QQGRLTHPVVLRPGATHYEPIAWD

SEQ ID NO: 1302450 - protein, 21 aa, Mycobacterium
QQHLLKPNSPLRRLVEGSGAA

SEQ ID NO: 1302451 - protein, 20 aa, Mycobacterium
QQIQQLVVARRLLGLTSAQL

SEQ ID NO: 1302452 - protein, 19 aa, Mycobacterium
QQLAIARALITSPKCLILD

SEQ ID NO: 1302453 - protein, 30 aa, Mycobacterium
QQLARAELQIVFHTLLRRIPTMRLGIPFDE

SEQ ID NO: 1302454 - protein, 27 aa, Mycobacterium
QQLPTAGLPFQFQSWPEFERFVHDQKK

SEQ ID NO: 1302455 - protein, 21 aa, Mycobacterium
QQMMQPLQQLSQPLQQLTSMF

SEQ ID NO: 1302456 - protein, 28 aa, Mycobacterium
QQPGDGFVPFIIPINDRTLEDTRANAVK

SEQ ID NO: 1302457 - protein, 19 aa, Mycobacterium
QQPLLLDEYSRNAATGSFI

SEQ ID NO: 1302458 - protein, 17 aa, Mycobacterium
QQRFVAMHLPHVGALQT

SEQ ID NO: 1302459 - protein, 20 aa, Mycobacterium
QQRHLADNAAFFTEVLPGRD

SEQ ID NO: 1302460 - protein, 23 aa, Mycobacterium
QQRNFLTTLLLSQGVPMIAHGDE

SEQ ID NO: 1302461 - protein, 21 aa, Mycobacterium
QQRRDMQWICRDGDRAKNHLL

SEQ ID NO: 1302462 - protein, 24 aa, Mycobacterium
QQSQLFLTRGTWLAKRLGLERFRS

SEQ ID NO: 1302463 - protein, 26 aa, Mycobacterium
QQVLSRFLHEFAGIGAKWTPANIADA

SEQ ID NO: 1302464 - protein, 25 aa, Mycobacterium
QQYRDRYIFAGLQPGQRIPSKWLES

SEQ ID NO: 1302465 - protein, 18 aa, Mycobacterium
QRAAQVCHWLLTSRLEFF

SEQ ID NO: 1302466 - protein, 19 aa, Mycobacterium
QRAGLELLSFGGRFVEIGK

SEQ ID NO: 1302467 - protein, 18 aa, Mycobacterium
QRAGLSTVFIPQRNEPDL

SEQ ID NO: 1302468 - protein, 30 aa, Mycobacterium
QRCQGTLQIWFEPFTPLRAPKLFNLRTDPY

SEQ ID NO: 1302469 - protein, 23 aa, Mycobacterium
QRDGICVVVLAPAPELSDDLGSS

SEQ ID NO: 1302470 - protein, 20 aa, Mycobacterium
QRDGTCWLGGTTWQGAHVLR

SEQ ID NO: 1302471 - protein, 23 aa, Mycobacterium
QRDSALIFLRAAADAVHEDRPDL

SEQ ID NO: 1302472 - protein, 23 aa, Mycobacterium
QRESLDWLVSRFAREVSGVSHAV

SEQ ID NO: 1302473 - protein, 18 aa, Mycobacterium
QRFGDDCRLIGLTTYTGT

SEQ ID NO: 1302474 - protein, 42 aa, Mycobacterium
QRFSSAILPAWARKSPQISEVLPLLYLHGLSSGDFGPALEQF

SEQ ID NO: 1302475 - protein, 23 aa, Mycobacterium
QRGATIWFTGLPASGKSTVAVAV

SEQ ID NO: 1302476 - protein, 20 aa, Mycobacterium
QRGSSFSGLLYAGLAITSRG

SEQ ID NO: 1302477 - protein, 21 aa, Mycobacterium
QRHEWTAWVDGRPLIVFQASY

SEQ ID NO: 1302478 - protein, 22 aa, Mycobacterium
QRHRFRLASVTKPLAARAAQIA

SEQ ID NO: 1302479 - protein, 20 aa, Mycobacterium
QRIERQLLGVRLHSTPDTNL

SEQ ID NO: 1302480 - protein, 33 aa, Mycobacterium
QRIGMVFQQFNLFPHRSVLDNVTLAPRKLKRLP

SEQ ID NO: 1302481 - protein, 23 aa, Mycobacterium
QRKNARQHLAFGRGIHSCPGAPL

SEQ ID NO: 1302482 - protein, 17 aa, Mycobacterium
QRLALDRLLIRGDADGP

SEQ ID NO: 1302483 - protein, 40 aa, Mycobacterium
QRLPVAQAIGYMLEILPALGYLHSLGLTYNDLKPENIMLT

SEQ ID NO: 1302484 - protein, 21 aa, Mycobacterium
QRLRDMLWSAIFPSIDLSVDS

SEQ ID NO: 1302485 - protein, 19 aa, Mycobacterium
QRLRLIDEVLDRTGRLDIL

SEQ ID NO: 1302486 - protein, 29 aa, Mycobacterium
QRLYSFKDILVLKIVKRLLDTGISLHNIR

SEQ ID NO: 1302487 - protein, 18 aa, Mycobacterium
QRQLDACLALADRLGWAV

SEQ ID NO: 1302488 - protein, 26 aa, Mycobacterium
QRRDKAAALAPFLRGLVSTDKPQVGH

SEQ ID NO: 1302489 - protein, 18 aa, Mycobacterium
QRRHSALGGLPPISRLTP

SEQ ID NO: 1302490 - protein, 23 aa, Mycobacterium
QRRLKYAYRRYAGHLEIDGVYGP

SEQ ID NO: 1302491 - protein, 18 aa, Mycobacterium
QRRLTSELPLPVNAIGIP

SEQ ID NO: 1302492 - protein, 22 aa, Mycobacterium
QRSWQNFLDAALRLYATLNKTL

SEQ ID NO: 1302493 - protein, 18 aa, Mycobacterium
QRVALAEALVGRPRMLIL

SEQ ID NO: 1302494 - protein, 18 aa, Mycobacterium
QRVALARALAVQPRVLLL

SEQ ID NO: 1302495 - protein, 18 aa, Mycobacterium
QRVKRFTAFGTLEQSRGV

SEQ ID NO: 1302496 - protein, 23 aa, Mycobacterium
QRVLLAQVFAQQATLLLLDEPTT

SEQ ID NO: 1302497 - protein, 19 aa, Mycobacterium
QRVPVLAVKRKNAINEPLF

SEQ ID NO: 1302498 - protein, 28 aa, Mycobacterium
QRVSARVYPALVPLDHPLASVNGAFNAV

SEQ ID NO: 1302499 - protein, 21 aa, Mycobacterium
QRWAKTWEFQALMKARPAAGD

SEQ ID NO: 1302500 - protein, 17 aa, Mycobacterium
QRYEPMFAAADLGADTM

SEQ ID NO: 1302501 - protein, 21 aa, Mycobacterium
QSARQLGPLATFLVVNVSSPN

SEQ ID NO: 1302502 - protein, 22 aa, Mycobacterium
QSATWMALFAGQTVVLVPEFDP

SEQ ID NO: 1302503 - protein, 24 aa, Mycobacterium
QSDLRDLQRRLAGLGLSSLGRSEP

SEQ ID NO: 1302504 - protein, 31 aa, Mycobacterium
QSFNLFAHKTILDNVTLAPMKVRGLGKDAAR

SEQ ID NO: 1302505 - protein, 25 aa, Mycobacterium
QSGARPIWLTPQWDADFGVAHGLPV

SEQ ID NO: 1302506 - protein, 31 aa, Mycobacterium
QSGGKRLRPRFAYWAWRVGAPADAAPQPLIR

SEQ ID NO: 1302507 - protein, 26 aa, Mycobacterium
QSGLSWLIILRKRENFRRAFDGFDID

SEQ ID NO: 1302508 - protein, 31 aa, Mycobacterium
QSGYAYALSKNFVKWYSSAQAERFNARGLRI

SEQ ID NO: 1302509 - protein, 25 aa, Mycobacterium
QSNNITRVSWLTAGLPEHVGATTID

SEQ ID NO: 1302510 - protein, 24 aa, Mycobacterium
QSQVVAWWAPSWDEPNGGLSRLLR

SEQ ID NO: 1302511 - protein, 20 aa, Mycobacterium
QSRHYSLYLALQLKARFEGI

SEQ ID NO: 1302512 - protein, 29 aa, Mycobacterium
QSRRREDYIGPWLPEPLLVQSKDAEADVV

SEQ ID NO: 1302513 - protein, 18 aa, Mycobacterium
QSSRQWVWGELDEARCGP

SEQ ID NO: 1302514 - protein, 20 aa, Mycobacterium
QSVLLRVLPDGDVHFPDAPG

SEQ ID NO: 1302515 - protein, 31 aa, Mycobacterium; identical to SEQ ID NO: 850537

SEQ ID NO: 1302516 - protein, 24 aa, Mycobacterium
QTCMAWTRMLVPESRYGEALELVE

SEQ ID NO: 1302517 - protein, 27 aa, Mycobacterium
QTGLSLPPTLLWEYPTAAAVTDRITEL

SEQ ID NO: 1302518 - protein, 26 aa, Mycobacterium
QTGQKFAREIFFLGRAYDAETMYQMG

SEQ ID NO: 1302519 - protein, 17 aa, Mycobacterium
QTGWALARALGAIEGTE

SEQ ID NO: 1302520 - protein, 18 aa, Mycobacterium
QTKMIWVETPTNPLLSIA

SEQ ID NO: 1302521 - protein, 33 aa, Mycobacterium; identical to SEQ ID NO: 850591

SEQ ID NO: 1302522 - protein, 18 aa, Mycobacterium
QTLTPQLLEHSPDAVVIF

SEQ ID NO: 1302523 - protein, 27 aa, Mycobacterium
QTLYDRLPSYAVPLFVRVVGELEHTST

SEQ ID NO: 1302524 - protein, 18 aa, Mycobacterium
QTPRRLDDVLADGDLLIA

SEQ ID NO: 1302525 - protein, 24 aa, Mycobacterium
QTPSDACFILLSGSASVYLGRDRV

SEQ ID NO: 1302526 - protein, 27 aa, Mycobacterium
QTREHVLLARQVGVPYILVALNKADAV

SEQ ID NO: 1302527 - protein, 38 aa, Mycobacterium
QTSQDWWPADYGNYAGLFIRMSWHAAGTYRIFDGRGGA

SEQ ID NO: 1302528 - protein, 19 aa, Mycobacterium
QVAAILRFAAAEVVPRLAG

SEQ ID NO: 1302529 - protein, 20 aa, Mycobacterium
QVCPVCLGLPGSLPVLNQQA

SEQ ID NO: 1302530 - protein, 17 aa, Mycobacterium
QVFDSWAGTLSLADYRA

SEQ ID NO: 1302531 - protein, 22 aa, Mycobacterium
QVGARLLKLHDLLYKKTNGRIG

SEQ ID NO: 1302532 - protein, 17 aa, Mycobacterium
QVGFTVVSPHRYFPRLR

SEQ ID NO: 1302533 - protein, 18 aa, Mycobacterium
QVHSLHGYFLRPGDARAP

SEQ ID NO: 1302534 - protein, 24 aa, Mycobacterium
QVKLGRLAAILRDKRIPLELCPSS

SEQ ID NO: 1302535 - protein, 24 aa, Mycobacterium
QVKQQMLDWWGPVIYEYYGGTEAN

SEQ ID NO: 1302536 - protein, 17 aa, Mycobacterium
QVLLRFLSAGICGSDLP

SEQ ID NO: 1302537 - protein, 19 aa, Mycobacterium
QVLTQCRPELITRTFEACK

SEQ ID NO: 1302538 - protein, 26 aa, Mycobacterium
QVNLVGTFNVLRLSAERIAKTEPING

SEQ ID NO: 1302539 - protein, 25 aa, Mycobacterium
QVPQWPRRWRYFSPAIPADPDGYVE

SEQ ID NO: 1302540 - protein, 17 aa, Mycobacterium
QVRLAARGVLSFAELDT

SEQ ID NO: 1302541 - protein, 28 aa, Mycobacterium
QVSGRGKYRLGFAIARLARASSGHLDLG

SEQ ID NO: 1302542 - protein, 24 aa, Mycobacterium
QVTEQCILYTALDAYVRHFPVVVP

SEQ ID NO: 1302543 - protein, 25 aa, Mycobacterium
QVVRELLQMRRPLTDLPPVTVADGV

SEQ ID NO: 1302544 - protein, 22 aa, Mycobacterium
QVVTRTVAKTEFFLGLASEIGA

SEQ ID NO: 1302545 - protein, 24 aa, Mycobacterium
QVYAVLNLYPYNPGHLMVVPYRRV

SEQ ID NO: 1302546 - protein, 18 aa, Mycobacterium
QWAQPWEVQALLRAHRVA

SEQ ID NO: 1302547 - protein, 23 aa, Mycobacterium
QWEVLDRVLQLFGGYGYMEEYPI

SEQ ID NO: 1302548 - protein, 21 aa, Mycobacterium
QWKYHADCLAQRGLLDGAGEL

SEQ ID NO: 1302549 - protein, 18 aa, Mycobacterium
QWLDPPTAAVLASVARRS

SEQ ID NO: 1302550 - protein, 20 aa, Mycobacterium
QWQLLLDDRSLIPAAVEELL

SEQ ID NO: 1302551 - protein, 18 aa, Mycobacterium
QWVHRRHWRTPAAPPGGR

SEQ ID NO: 1302552 - protein, 28 aa, Mycobacterium
QWVPEHPELLTRWAGALAAGSWLAMQVP

SEQ ID NO: 1302553 - protein, 24 aa, Mycobacterium
QYGKTWRTIAKLSLPDKYLRDTPD

SEQ ID NO: 1302554 - protein, 20 aa, Mycobacterium
QYHLTRIYAKLGVRSRTELA

SEQ ID NO: 1302555 - protein, 29 aa, Mycobacterium
QYLAALDELWPVLTPQTLLADLYESRERL

SEQ ID NO: 1302556 - protein, 18 aa, Mycobacterium
QYLDPKHGYVNDPAWIVF

SEQ ID NO: 1302557 - protein, 28 aa, Mycobacterium
QYMYRRHLGVTPLEYLRRVRLDLAHRDL

SEQ ID NO: 1302558 - protein, 30 aa, Mycobacterium
QYRAVNSGHWPLMRYDPLLRAAGRAPFLLD

SEQ ID NO: 1302559 - protein, 18 aa, Mycobacterium
QYRFVLPGPCLTAQEQAK

SEQ ID NO: 1302560 - protein, 19 aa, Mycobacterium
QYVTKRRLYLPEPTPELRT

SEQ ID NO: 1302561 - protein, 20 aa, Mycobacterium
RAAETLGVSTLLIAGGVAAN

SEQ ID NO: 1302562 - protein, 18 aa, Mycobacterium
RAAEVPIVFFQEVHRPSG

SEQ ID NO: 1302563 - protein, 26 aa, Mycobacterium
RAAGHPDLLAPPTFVFGLDLEHSDTL

SEQ ID NO: 1302564 - protein, 21 aa, Mycobacterium
RAAIPVIRAFTHFALLANVAE

SEQ ID NO: 1302565 - protein, 24 aa, Mycobacterium
RAAISGLRPPVLDDLGLAGGLASL

SEQ ID NO: 1302566 - protein, 23 aa, Mycobacterium
RAALDRFAAVDKPLRRYRAARDE

SEQ ID NO: 1302567 - protein, 18 aa, Mycobacterium
RAALGGECRAAISGGAPL

SEQ ID NO: 1302568 - protein, 26 aa, Mycobacterium
RAALGYELTLFLLRHPDARESVATQR

SEQ ID NO: 1302569 - protein, 25 aa, Mycobacterium
RAAQLDLRGAAFPWRTIRGEECSAY

SEQ ID NO: 1302570 - protein, 22 aa, Mycobacterium
RAARRMGSKSPLLPLIADCERG

SEQ ID NO: 1302571 - protein, 26 aa, Mycobacterium
RAARVVVPDFQLSLAIGKEGQNARLA

SEQ ID NO: 1302572 - protein, 29 aa, Mycobacterium
RAAVGPDYPIIFRFSQWKGLDYTASIADD

SEQ ID NO: 1302573 - protein, 35 aa, Mycobacterium
RAAVSHGALAYLLKPFTFAAFRDRLERYRRYRDAL

SEQ ID NO: 1302574 - protein, 25 aa, Mycobacterium
RACAAADLVFIGPPPGAIDAMGSKL

SEQ ID NO: 1302575 - protein, 25 aa, Mycobacterium
RADDRFFVPAYLGPSGWLGLDFDRA

SEQ ID NO: 1302576 - protein, 27 aa, Mycobacterium
RADGRPGRWRGWDWARGTPAGWHTVDP

SEQ ID NO: 1302577 - protein, 23 aa, Mycobacterium
RADLAHRYTSKPVYLRAVEVRTR

SEQ ID NO: 1302578 - protein, 23 aa, Mycobacterium
RADLKRFVFLSTIGTIAVGADGA

SEQ ID NO: 1302579 - protein, 23 aa, Mycobacterium
RADPELRWRTDVLAMLVRSAGED

SEQ ID NO: 1302580 - protein, 24 aa, Mycobacterium
RADPYPLYADFRAAGPLALPEANL

SEQ ID NO: 1302581 - protein, 25 aa, Mycobacterium
RAEADGFSSLWYASAVGGDPLVAMA

SEQ ID NO: 1302582 - protein, 22 aa, Mycobacterium
RAEAIFGQRLMYAIPEARGLIY

SEQ ID NO: 1302583 - protein, 19 aa, Mycobacterium
RAEFQRITQDLLDRTRQPF

SEQ ID NO: 1302584 - protein, 20 aa, Mycobacterium
RAEQLRWDQAAAALNEILFS

SEQ ID NO: 1302585 - protein, 18 aa, Mycobacterium
RAEYGDRLPVVLLDGAEH

SEQ ID NO: 1302586 - protein, 26 aa, Mycobacterium
RAFAAVGRLLPRHTGPIFPLIEDLFG

SEQ ID NO: 1302587 - protein, 19 aa, Mycobacterium
RAFAPIIERNGGGAVLNVL

SEQ ID NO: 1302588 - protein, 27 aa, Mycobacterium
RAFDGAPGLRLALALPPIEVAVTARLT

SEQ ID NO: 1302589 - protein, 25 aa, Mycobacterium
RAFDQLMMDVALHKLPVTLVLDRSG

SEQ ID NO: 1302590 - protein, 37 aa, Mycobacterium
RAFEAARPRAVWLPHYPYPLARFLPGNRRTALYVTVH

SEQ ID NO: 1302591 - protein, 25 aa, Mycobacterium
RAFYRRWAEFTDNLSWPQLIELAKS

SEQ ID NO: 1302592 - protein, 21 aa, Mycobacterium
RAGGHPWWTLSQLSDEKAIEL

SEQ ID NO: 1302593 - protein, 23 aa, Mycobacterium
RAGLLRRVHGGAVPARTLHLVEA

SEQ ID NO: 1302594 - protein, 25 aa, Mycobacterium
RAGLTERTFFRYFADKREALFGGQT

SEQ ID NO: 1302595 - protein, 26 aa, Mycobacterium
RAGRSGTALLFVTPRERHLLNSIERV

SEQ ID NO: 1302596 - protein, 27 aa, Mycobacterium
RAGVARSGFYFYFDSKYAVLAVIVADA

SEQ ID NO: 1302597 - protein, 25 aa, Mycobacterium
RAGVGILVLTHYLPPIAPGQEADWR

SEQ ID NO: 1302598 - protein, 17 aa, Mycobacterium
RAGVRTLPHILSENGWH

SEQ ID NO: 1302599 - protein, 18 aa, Mycobacterium
RAHGTGTPFFVWMNMTHM

SEQ ID NO: 1302600 - protein, 24 aa, Mycobacterium
RAHPQYWRRLPARIEWADAEWLAR

SEQ ID NO: 1302601 - protein, 19 aa, Mycobacterium
RAILLTHAHIDHFGSAIWF

SEQ ID NO: 1302602 - protein, 22 aa, Mycobacterium
RAILVISAHWYINATAVTAMPR

SEQ ID NO: 1302603 - protein, 22 aa, Mycobacterium
RAIVRSPLLRCRSTVEPLAAAL

SEQ ID NO: 1302604 - protein, 17 aa, Mycobacterium
RAKAFWNPDKTQFWTDA

SEQ ID NO: 1302605 - protein, 30 aa, Mycobacterium
RAKLPAGQIRPLLAELVVALVPAEFPDLPD

SEQ ID NO: 1302606 - protein, 23 aa, Mycobacterium
RAKNPMHVIALDLAPDKLELAEK

SEQ ID NO: 1302607 - protein, 24 aa, Mycobacterium
RALARAWPRYDAMRTELAVGQFAD

SEQ ID NO: 1302608 - protein, 17 aa, Mycobacterium
RALDLGGLPLDVLRSAL

SEQ ID NO: 1302609 - protein, 21 aa, Mycobacterium
RALDRAGFKIVATGLRECVAG

SEQ ID NO: 1302610 - protein, 28 aa, Mycobacterium
RALELGCGTGFFLLNLIQAGVARRGSVT

SEQ ID NO: 1302611 - protein, 18 aa, Mycobacterium
RALIAAGWRVYLTGRTVD

SEQ ID NO: 1302612 - protein, 21 aa, Mycobacterium
RALLADLLDRATQPELVYSHT

SEQ ID NO: 1302613 - protein, 19 aa, Mycobacterium
RALLRLLEGPRFCGHPDLR

SEQ ID NO: 1302614 - protein, 24 aa, Mycobacterium
RALLTVSRRYDVKLRHLSAAVAGA

SEQ ID NO: 1302615 - protein, 28 aa, Mycobacterium
RALSLTTVFLSHPLPHPGPGRGIVDVMG

SEQ ID NO: 1302616 - protein, 31 aa, Mycobacterium
RALVDLDNWKLLKWLDPPAPFYDWRANEVHP

SEQ ID NO: 1302617 - protein, 26 aa, Mycobacterium
RALVRTPAVFLFDEPLSNLDAKLRVE

SEQ ID NO: 1302618 - protein, 18 aa, Mycobacterium
RALWDSQVPGACDSTLLI

SEQ ID NO: 1302619 - protein, 19 aa, Mycobacterium
RAMAELFDYLRTFVTREVE

SEQ ID NO: 1302620 - protein, 31 aa, Mycobacterium
RAMGFPTRMFTVLFALGRLPGWIAHWREMHS

SEQ ID NO: 1302621 - protein, 27 aa, Mycobacterium
RAPDCTLPPPMRLLLDGRMPGVPERVE

SEQ ID NO: 1302622 - protein, 19 aa, Mycobacterium
RAPSLMPLAARPGQPGALA

SEQ ID NO: 1302623 - protein, 26 aa, Mycobacterium
RAQLTIHDKLLQPWGIVHGGVYCAIV

SEQ ID NO: 1302624 - protein, 17 aa, Mycobacterium
RAQWLPKMASGEMIGAI

SEQ ID NO: 1302625 - protein, 21 aa, Mycobacterium
RARALAYFAALTIAADDPRRR

SEQ ID NO: 1302626 - protein, 19 aa, Mycobacterium
RARIRPGEWVTVVGAGGVG

SEQ ID NO: 1302627 - protein, 19 aa, Mycobacterium
RARPLWECWVIEGLSRHRW

SEQ ID NO: 1302628 - protein, 31 aa, Mycobacterium
RARPPARHRWLTIPAYRIVLDPDGRPLGMRL

SEQ ID NO: 1302629 - protein, 18 aa, Mycobacterium
RARQAWIAATRDIATEML

SEQ ID NO: 1302630 - protein, 28 aa, Mycobacterium
RARQKGCTLLVTNGDWPGATARLEARVC

SEQ ID NO: 1302631 - protein, 32 aa, Mycobacterium
RARRLIYLEDQYLWSKRVAALFARALRANPDL

SEQ ID NO: 1302632 - protein, 21 aa, Mycobacterium
RARTGLQLFGGPRLHRERYLQ

SEQ ID NO: 1302633 - protein, 24 aa, Mycobacterium
RARVLHCAALRRLADKTQVVGPRE

SEQ ID NO: 1302634 - protein, 28 aa, Mycobacterium
RASALAAHPLLLILDVKKPRPSDISIHV

SEQ ID NO: 1302635 - protein, 26 aa, Mycobacterium
RASCRYMKMITPAALLRCLTYGTDEV

SEQ ID NO: 1302636 - protein, 24 aa, Mycobacterium
RASGGWPWLAPGHDPGGVLALLEG

SEQ ID NO: 1302637 - protein, 18 aa, Mycobacterium
RASKAAILHFTKCAAIEL

SEQ ID NO: 1302638 - protein, 32 aa, Mycobacterium
RASYLVDWSGLPYQRFLLANIAHGEPLLQRLR

SEQ ID NO: 1302639 - protein, 31 aa, Mycobacterium
RATALARTLKRSLLPPALSPPAGLEACAHLH

SEQ ID NO: 1302640 - protein, 23 aa, Mycobacterium
RATEKPWFAIGGIDEARLPEVLD

SEQ ID NO: 1302641 - protein, 28 aa, Mycobacterium
RATGFDTPYPPARLEKLWLPGVDRLLDC

SEQ ID NO: 1302642 - protein, 24 aa, Mycobacterium
RATKLARNHPWLLSRELVPAESDG

SEQ ID NO: 1302643 - protein, 34 aa, Mycobacterium
RATRCEALGIGSLWLYDHLYGPGAPDYPSLEAWT

SEQ ID NO: 1302644 - protein, 18 aa, Mycobacterium
RATRRRVFGWAADTNTLV

SEQ ID NO: 1302645 - protein, 25 aa, Mycobacterium
RAVAATMPMVLWLRTTSAQAMKRAL

SEQ ID NO: 1302646 - protein, 32 aa, Mycobacterium
RAVFDRFGADLPPLAGIYLAAFGGGPVMLAEM

SEQ ID NO: 1302647 - protein, 28 aa, Mycobacterium
RAVGADVPLLGQVPLDPALVAAGDSGVP

SEQ ID NO: 1302648 - protein, 22 aa, Mycobacterium
RAVGCQFVLVDPLPTTERPTGL

SEQ ID NO: 1302649 - protein, 17 aa, Mycobacterium
RAVIARRYYLEGRTRIQ

SEQ ID NO: 1302650 - protein, 19 aa, Mycobacterium
RAVNPNIVYARGSALGPRG

SEQ ID NO: 1302651 - protein, 23 aa, Mycobacterium
RAVSSWFIKVTEFRDRMVELNQE

SEQ ID NO: 1302652 - protein, 29 aa, Mycobacterium
RAYEKAYDRLFTALDWLEDRLAGQRYLVG

SEQ ID NO: 1302653 - protein, 22 aa, Mycobacterium
RAYKPLNWMSPPCRLSEESGDP

SEQ ID NO: 1302654 - protein, 20 aa, Mycobacterium
RAYNPLFIWGESGLGKTHLL

SEQ ID NO: 1302655 - protein, 25 aa, Mycobacterium
RCNLRCTYCMPAEGLDWLPGEQLLS

SEQ ID NO: 1302656 - protein, 20 aa, Mycobacterium
RCRPWRYGFGEARRGDPVAI

SEQ ID NO: 1302657 - protein, 25 aa, Mycobacterium
RCRTCDTDFELTDLILLCPCGSADV

SEQ ID NO: 1302658 - protein, 17 aa, Mycobacterium
RCVYWAGGNPFHHHQNI

SEQ ID NO: 1302659 - protein, 18 aa, Mycobacterium
RDADALRAELRRIASMTG

SEQ ID NO: 1302660 - protein, 24 aa, Mycobacterium
RDAEGWIYLAGRTGDWMRVDGENL

SEQ ID NO: 1302661 - protein, 27 aa, Mycobacterium
RDAEWMGPLIEALGLTVGWITAESTAE

SEQ ID NO: 1302662 - protein, 21 aa, Mycobacterium
RDAGRAVYVYGIVPADVAVEE

SEQ ID NO: 1302663 - protein, 18 aa, Mycobacterium
RDATYLYRDGSDFVFMDS

SEQ ID NO: 1302664 - protein, 24 aa, Mycobacterium
RDAVRFAGGWLYDRSMAGWDVTVL

SEQ ID NO: 1302665 - protein, 19 aa, Mycobacterium
RDAWFWAHEVMAVGMVWNT

SEQ ID NO: 1302666 - protein, 25 aa, Mycobacterium
RDAWVEFPIFDAKTRSLKKAFLGKA

SEQ ID NO: 1302667 - protein, 19 aa, Mycobacterium
RDDLRPDWARPAQPGGSYR

SEQ ID NO: 1302668 - protein, 29 aa, Mycobacterium
RDDPFGEVRWFDIDPCYVFHVANAYEDGN

SEQ ID NO: 1302669 - protein, 19 aa, Mycobacterium
RDDPRVQQFAETELRALLL

SEQ ID NO: 1302670 - protein, 27 aa, Mycobacterium
RDDTSIPALIGLCLFGDGAAAVVATGA

SEQ ID NO: 1302671 - protein, 23 aa, Mycobacterium
RDDWAVHVALWQSGELVAGAVAL

SEQ ID NO: 1302672 - protein, 24 aa, Mycobacterium
RDEAVHGYYIGYKFQKGLALQDPA

SEQ ID NO: 1302673 - protein, 24 aa, Mycobacterium
RDEFQIILVDTPGLHRPRTLLGQR

SEQ ID NO: 1302674 - protein, 22 aa, Mycobacterium
RDEFTLFVAMRYLQHDDRYTPE

SEQ ID NO: 1302675 - protein, 27 aa, Mycobacterium
RDELTSLLQFVLDLLSDYGLDEYYLEL

SEQ ID NO: 1302676 - protein, 32 aa, Mycobacterium
RDERLRPMFEAWYTAMVPALSRLFRELGSRQP

SEQ ID NO: 1302677 - protein, 27 aa, Mycobacterium
RDFADGRSFLLPPTWTQLDALAGRTVA

SEQ ID NO: 1302678 - protein, 17 aa, Mycobacterium
RDFALNQPLSTFALAAI

SEQ ID NO: 1302679 - protein, 25 aa, Mycobacterium
RDFDGWARWVEPGGALIIHDVFPNP

SEQ ID NO: 1302680 - protein, 17 aa, Mycobacterium
RDFLVETQPFTLENGLL

SEQ ID NO: 1302681 - protein, 30 aa, Mycobacterium
RDFSERDVELLLVIGRLIAGALHQARLHRQ

SEQ ID NO: 1302682 - protein, 26 aa, Mycobacterium
RDGGDARVLLFYRAEDLGLARFFTTH

SEQ ID NO: 1302683 - protein, 25 aa, Mycobacterium
RDGLQIEQPIPLSAKLELLEAVVAT

SEQ ID NO: 1302684 - protein, 18 aa, Mycobacterium
RDHALLQRLLATEPETVL

SEQ ID NO: 1302685 - protein, 26 aa, Mycobacterium
RDIQVRGYTLRLPLDVLVVASANPED

SEQ ID NO: 1302686 - protein, 21 aa, Mycobacterium
RDKGFQLLAMTPDPAADTLAT

SEQ ID NO: 1302687 - protein, 18 aa, Mycobacterium
RDKLKHHLEECPACLRHY

SEQ ID NO: 1302688 - protein, 36 aa, Mycobacterium
RDKVLDVAAARWWRKPLVRRWYGFAEMQKQVARQIP

SEQ ID NO: 1302689 - protein, 26 aa, Mycobacterium
RDLGSLGIRVLAIAPSLFATGLTEGI

SEQ ID NO: 1302690 - protein, 17 aa, Mycobacterium
RDLHDALRRRCLYHWID

SEQ ID NO: 1302691 - protein, 18 aa, Mycobacterium
RDLPLIAEAARRVPVSVA

SEQ ID NO: 1302692 - protein, 18 aa, Mycobacterium
RDLPTDRPVLVLAEGVSM

SEQ ID NO: 1302693 - protein, 17 aa, Mycobacterium
RDLQLVVNSLWVSGAEA

SEQ ID NO: 1302694 - protein, 23 aa, Mycobacterium
RDLSGTDYVYLWVDGIHLKVRLE

SEQ ID NO: 1302695 - protein, 18 aa, Mycobacterium
RDLSSLRSWPLGGAPVSP

SEQ ID NO: 1302696 - protein, 25 aa, Mycobacterium
RDPDDPWSFVFLQMTDRARLRCLSQ

SEQ ID NO: 1302697 - protein, 24 aa, Mycobacterium
RDPNNLLAMLWTWQNGNVGATPGR

SEQ ID NO: 1302698 - protein, 20 aa, Mycobacterium
RDPVIYLEPKRRYWARGAVD

SEQ ID NO: 1302699 - protein, 27 aa, Mycobacterium
RDQGRALLPSLLRYQTPMWPERALTRH

SEQ ID NO: 1302700 - protein, 17 aa, Mycobacterium
RDRLSASYLIALSARAV

SEQ ID NO: 1302701 - protein, 22 aa, Mycobacterium
RDRLVVIIAGYRKDLDMFLDAN

SEQ ID NO: 1302702 - protein, 28 aa, Mycobacterium
RDRPALVHLTPLGSHRGLAQPLGPFAEV

SEQ ID NO: 1302703 - protein, 22 aa, Mycobacterium
RDTAALLRRAGINVAPQQVGAD

SEQ ID NO: 1302704 - protein, 31 aa, Mycobacterium
RDTARLLHHVAWQPVAWPDADLPAEVVLVGG

SEQ ID NO: 1302705 - protein, 23 aa, Mycobacterium
RDTATLFGLTDRGTIEVGKRADL

SEQ ID NO: 1302706 - protein, 17 aa, Mycobacterium
RDTDAVLAALLTARIAG

SEQ ID NO: 1302707 - protein, 22 aa, Mycobacterium
RDVEFPRRDEVGGRRAGRLLAP

SEQ ID NO: 1302708 - protein, 24 aa, Mycobacterium
RDVLTDYGAFLRSLVEIPGRRPLR

SEQ ID NO: 1302709 - protein, 35 aa, Mycobacterium; identical to SEQ ID NO: 117051

SEQ ID NO: 1302710 - protein, 17 aa, Mycobacterium
RDWVKLAVTRARASGMT

SEQ ID NO: 1302711 - protein, 20 aa, Mycobacterium
REAAVRFIAATPGNPHGANA

SEQ ID NO: 1302712 - protein, 18 aa, Mycobacterium
REAGLVGADLREAVLQRA

SEQ ID NO: 1302713 - protein, 25 aa, Mycobacterium
REAGRVLADLLTAYRGRDDVIVLGL

SEQ ID NO: 1302714 - protein, 20 aa, Mycobacterium
REARKPGSAFWLKGGPRPRV

SEQ ID NO: 1302715 - protein, 42 aa, Mycobacterium
REARQMRPLYVMPTKGVWTSGFGYRWGVLHGGIDIAGPIGTP

SEQ ID NO: 1302716 - protein, 25 aa, Mycobacterium
REASVDFVTYFSAGIQWAQKAGAGI

SEQ ID NO: 1302717 - protein, 22 aa, Mycobacterium
REDQEVWRYFASVAFPSEAMVR

SEQ ID NO: 1302718 - protein, 19 aa, Mycobacterium
REDVAAVLLAVLDTPGTVG

SEQ ID NO: 1302719 - protein, 32 aa, Mycobacterium
REELDAYVVRRLNLPFRDVDWTQWNDLLKRVH

SEQ ID NO: 1302720 - protein, 26 aa, Mycobacterium
REELGLPEMGLVGRQLWEQSGLSPTD

SEQ ID NO: 1302721 - protein, 19 aa, Mycobacterium
REEVEPLDLVWPHQQFVPL

SEQ ID NO: 1302722 - protein, 27 aa, Mycobacterium
REEWQIFTDLALAMGLPLFGVRGMNGF

SEQ ID NO: 1302723 - protein, 17 aa, Mycobacterium
REFCARTGIFILAESLG

SEQ ID NO: 1302724 - protein, 19 aa, Mycobacterium
REFCLAHLARFKCPKSFDF

SEQ ID NO: 1302725 - protein, 21 aa, Mycobacterium
REFPEIDRVAWFPVEEARAKL

SEQ ID NO: 1302726 - protein, 31 aa, Mycobacterium
REGGPNVVYLRTGLPTFKPAHRAGSAGDGLL

SEQ ID NO: 1302727 - protein, 20 aa, Mycobacterium
REGMTFLSTAPLYHSGPQSS

SEQ ID NO: 1302728 - protein, 24 aa, Mycobacterium
REGPSRLWGITYVVADIDATASFF

SEQ ID NO: 1302729 - protein, 26 aa, Mycobacterium
REGVKVASFALAPKPDLIAKLKEAGV

SEQ ID NO: 1302730 - protein, 36 aa, Mycobacterium
REGVRQVLLPLWNAYTFLALYAPKKGTWRTDSSHVL

SEQ ID NO: 1302731 - protein, 22 aa, Mycobacterium
REGYDMFVGMLEALKEESVGFL

SEQ ID NO: 1302732 - protein, 23 aa, Mycobacterium
REHFNLPALRDWLRTQREERSGA

SEQ ID NO: 1302733 - protein, 17 aa, Mycobacterium
REIASELVALYAKRQAA

SEQ ID NO: 1302734 - protein, 18 aa, Mycobacterium
REIGIDLYAVRDIADRRF

SEQ ID NO: 1302735 - protein, 26 aa, Mycobacterium
RELAPHLILLDVYLPDMTGLEVLQRL

SEQ ID NO: 1302736 - protein, 26 aa, Mycobacterium
RELDATVCWFADAPLRAGDRLALKQG

SEQ ID NO: 1302737 - protein, 19 aa, Mycobacterium
RELEMCYAAIALVTDLDAG

SEQ ID NO: 1302738 - protein, 18 aa, Mycobacterium
RELGVTEFMLLQAAVAVV

SEQ ID NO: 1302739 - protein, 17 aa, Mycobacterium
RELGWPYCNIDGGPADV

SEQ ID NO: 1302740 - protein, 17 aa, Mycobacterium
RELGYITVDARAVRIGA

SEQ ID NO: 1302741 - protein, 17 aa, Mycobacterium
RELLRMLRRLHGLNIVG

SEQ ID NO: 1302742 - protein, 35 aa, Mycobacterium
RELTAALRLIYPRETLWRPPVLTMSALHGDGLREL

SEQ ID NO: 1302743 - protein, 17 aa, Mycobacterium
RELVDDFSLIPRAIEEV

SEQ ID NO: 1302744 - protein, 25 aa, Mycobacterium
RELVRSVAAPRLQALRPLRQQLVEI

SEQ ID NO: 1302745 - protein, 34 aa, Mycobacterium
REPTFVGTRRYVRRQRSWFRRDHRVCWLDGGSPD

SEQ ID NO: 1302746 - protein, 34 aa, Mycobacterium
REPYGVVGAITPWNYPLYQVVAKVVPAIAAGCTV

SEQ ID NO: 1302747 - protein, 26 aa, Mycobacterium
REQLREIVGAYFPLGWQMACHVHGDA

SEQ ID NO: 1302748 - protein, 25 aa, Mycobacterium
REQRDLPWRRPGVTPWQILVSEFML

SEQ ID NO: 1302749 - protein, 30 aa, Mycobacterium
REQSRPELGFRLLQRLGADVAEYGFVETSA

SEQ ID NO: 1302750 - protein, 25 aa, Mycobacterium
RERELGAILRWFVAGTLGVGPVESA

SEQ ID NO: 1302751 - protein, 29 aa, Mycobacterium
REREVAELLLLGMPYRDIGAQLFISAKTV

SEQ ID NO: 1302752 - protein, 23 aa, Mycobacterium
RERLLNERLLTIDWRTQDRPEAD

SEQ ID NO: 1302753 - protein, 17 aa, Mycobacterium
RESHRHAHWLLPAAHWL

SEQ ID NO: 1302754 - protein, 22 aa, Mycobacterium
RESIGVALLRRLTHREPAAAGE

SEQ ID NO: 1302755 - protein, 23 aa, Mycobacterium
RESLGFEVIPLSGGERPPYELLR

SEQ ID NO: 1302756 - protein, 24 aa, Mycobacterium
RESRLIDDVGLDSVAFAVGMVAIE

SEQ ID NO: 1302757 - protein, 24 aa, Mycobacterium
RETLRMGEKFPLKAGLVTSLGFGH

SEQ ID NO: 1302758 - protein, 20 aa, Mycobacterium
REVFGEEKAEWWDRAVEVWP

SEQ ID NO: 1302759 - protein, 18 aa, Mycobacterium
REVLFCPDQFLGAHVRRV

SEQ ID NO: 1302760 - protein, 31 aa, Mycobacterium
REVPDETFALLPLNPFVPKRAVKRAADIMFG

SEQ ID NO: 1302761 - protein, 26 aa, Mycobacterium
REVQNFLRLAQPPAASSRFLDLGTDS

SEQ ID NO: 1302762 - protein, 24 aa, Mycobacterium
REVRSLVGPGWPDGSGGAPAAALA

SEQ ID NO: 1302763 - protein, 24 aa, Mycobacterium
REVYKLRQRVLLIWGREDRVNPLD

SEQ ID NO: 1302764 - protein, 17 aa, Mycobacterium
REYGVHVLVIRPGQVRT

SEQ ID NO: 1302765 - protein, 18 aa, Mycobacterium
RFAHPVLLERSRAAELAT

SEQ ID NO: 1302766 - protein, 21 aa, Mycobacterium
RFAIRLVDPLRHWKFSDMDIE

SEQ ID NO: 1302767 - protein, 46 aa, Mycobacterium
RFARERSRWIFSNPDMIHLSLLRNHARWAVFLRHLKFIVVDECHYY

SEQ ID NO: 1302768 - protein, 17 aa, Mycobacterium
RFCAFAQRKGDADAYSL

SEQ ID NO: 1302769 - protein, 26 aa, Mycobacterium
RFDDEQMFYLQARGIPEEQARRLIVR

SEQ ID NO: 1302770 - protein, 19 aa, Mycobacterium
RFEPDLLVYKELHVVGALG

SEQ ID NO: 1302771 - protein, 23 aa, Mycobacterium
RFEPGYVDALRLAALAKGKPHVS

SEQ ID NO: 1302772 - protein, 26 aa, Mycobacterium
RFERENAPLLAPLLPRIVLVRHDEPR

SEQ ID NO: 1302773 - protein, 19 aa, Mycobacterium
RFERTLTAIWRAILAAGAT

SEQ ID NO: 1302774 - protein, 17 aa, Mycobacterium
RFEVVSPYQPAGDQPAA

SEQ ID NO: 1302775 - protein, 19 aa, Mycobacterium
RFGSIVDPFGQRWAVMTRV

SEQ ID NO: 1302776 - protein, 21 aa, Mycobacterium
RFGTEVEALWWDDDRQEWQIH

SEQ ID NO: 1302777 - protein, 27 aa, Mycobacterium
RFIRDTTWVSVRWYQPGGPLTAEEVGR

SEQ ID NO: 1302778 - protein, 21 aa, Mycobacterium
RFKEEIVPIDTPYGLFDTDEH

SEQ ID NO: 1302779 - protein, 20 aa, Mycobacterium
RFLAQIGVDRWLRLADGVLV

SEQ ID NO: 1302780 - protein, 18 aa, Mycobacterium
RFLDITDEDFRHTFDWCV

SEQ ID NO: 1302781 - protein, 28 aa, Mycobacterium
RFLEGSWQYRRLFRRLPPEEPKHRARLF

SEQ ID NO: 1302782 - protein, 25 aa, Mycobacterium
RFLERRLRETFGFEGSPIRINVRVR

SEQ ID NO: 1302783 - protein, 20 aa, Mycobacterium
RFLIEGWIEGGEGRPAIVIE

SEQ ID NO: 1302784 - protein, 19 aa, Mycobacterium
RFLQLCDAFDIPVLSLVDC

SEQ ID NO: 1302785 - protein, 18 aa, Mycobacterium
RFLVSIPTPFNAVNSFAE

SEQ ID NO: 1302786 - protein, 18 aa, Mycobacterium
RFNDDMIIMPLQAATQWD

SEQ ID NO: 1302787 - protein, 18 aa, Mycobacterium
RFPRQLIEHLGRTGVFTQ

SEQ ID NO: 1302788 - protein, 18 aa, Mycobacterium
RFRARPFDLVSTPSVCEH

SEQ ID NO: 1302789 - protein, 24 aa, Mycobacterium
RFRRMLSKPFTFKRVEGLRPVIQQ

SEQ ID NO: 1302790 - protein, 24 aa, Mycobacterium
RFSVAYRRMYGTPPSATLRTTRQR

SEQ ID NO: 1302791 - protein, 22 aa, Mycobacterium
RFTDLEVFMQLLPRSSTAERMN

SEQ ID NO: 1302792 - protein, 19 aa, Mycobacterium
RFTEDMLVGFLDANSRYVA

SEQ ID NO: 1302793 - protein, 18 aa, Mycobacterium
RFYATFIAPRDIAFHVRS

SEQ ID NO: 1302794 - protein, 20 aa, Mycobacterium
RGAAEFLIGLGGSATNDGGA

SEQ ID NO: 1302795 - protein, 23 aa, Mycobacterium
RGAFDIEGLGYEAAIALLQAGVI

SEQ ID NO: 1302796 - protein, 20 aa, Mycobacterium
RGAFRVPVPPEFGPVRVRFL

SEQ ID NO: 1302797 - protein, 19 aa, Mycobacterium
RGAGWLKVKPVHTLDLVVL

SEQ ID NO: 1302798 - protein, 18 aa, Mycobacterium
RGAGWNVIKVVWGREWDA

SEQ ID NO: 1302799 - protein, 42 aa, Mycobacterium
RGAKVAGSRFYFLTGRGALLQLGLMQLAVRLATDNGFTLVIP

SEQ ID NO: 1302800 - protein, 29 aa, Mycobacterium
RGALAEESLALLRLLLRGDPIDLGGRLVH

SEQ ID NO: 1302801 - protein, 24 aa, Mycobacterium
RGALVRGLMWRAHLGTFGYHLEQN

SEQ ID NO: 1302802 - protein, 19 aa, Mycobacterium
RGATLLAHNYQLPAIQDVA

SEQ ID NO: 1302803 - protein, 25 aa, Mycobacterium
RGATRGWFMAWLARAHPELVGEYRT

SEQ ID NO: 1302804 - protein, 25 aa, Mycobacterium
RGDDGRFLWPGFGENSRVLKWAIER

SEQ ID NO: 1302805 - protein, 31 aa, Mycobacterium
RGDRMWEFLDRLVAIALPRIRDFRGLNPKQF

SEQ ID NO: 1302806 - protein, 26 aa, Mycobacterium
RGDVIRRKAGLPPATYFSAGKVQWIL

SEQ ID NO: 1302807 - protein, 25 aa, Mycobacterium
RGEADVYNMGWQKYLDARATDEQRR

SEQ ID NO: 1302808 - protein, 26 aa, Mycobacterium
RGEDPLLHKKPQWLRPVGSPVGAIDL

SEQ ID NO: 1302809 - protein, 17 aa, Mycobacterium
RGEGIGLTTVYRTLQSM

SEQ ID NO: 1302810 - protein, 19 aa, Mycobacterium
RGEHTVPVILLTALGEEDD

SEQ ID NO: 1302811 - protein, 23 aa, Mycobacterium
RGEPTRFLLLRHGQTELSVERRY

SEQ ID NO: 1302812 - protein, 21 aa, Mycobacterium
RGETKQFLTVPLGAETCGPIV

SEQ ID NO: 1302813 - protein, 17 aa, Mycobacterium
RGGALEFLVRRSQLTSA

SEQ ID NO: 1302814 - protein, 25 aa, Mycobacterium
RGGMHAVVGPFWKSNPWTAAYRQDR

SEQ ID NO: 1302815 - protein, 26 aa, Mycobacterium
RGGPSILCQVLLYPGLDRDMTCESIQ

SEQ ID NO: 1302816 - protein, 17 aa, Mycobacterium
RGHGVCAAVCPSVFVIT

SEQ ID NO: 1302817 - protein, 19 aa, Mycobacterium
RGHRRLAFAYSDVDKLRPL

SEQ ID NO: 1302818 - protein, 17 aa, Mycobacterium
RGHSLLKSGYGAYLLEL

SEQ ID NO: 1302819 - protein, 21 aa, Mycobacterium
RGHTPGSIALALHGPAAGDAV

SEQ ID NO: 1302820 - protein, 25 aa, Mycobacterium
RGIDTAWRRTSYSGLLRAAEGSPAV

SEQ ID NO: 1302821 - protein, 20 aa, Mycobacterium
RGIGFTERPPRKPLISAVEG

SEQ ID NO: 1302822 - protein, 30 aa, Mycobacterium
RGINERCRSLRPYAELLVDGFGIPEQLRYA

SEQ ID NO: 1302823 - protein, 34 aa, Mycobacterium
RGIPLTFSVARFIKFILTEIFPGGYLPTIDLVGE

SEQ ID NO: 1302824 - protein, 18 aa, Mycobacterium
RGITVLGDRPPMVSVTNA

SEQ ID NO: 1302825 - protein, 24 aa, Mycobacterium
RGKAVLVKLIWRMVRARVFGDRMA

SEQ ID NO: 1302826 - protein, 18 aa, Mycobacterium
RGKKLTFELARFVKFMIT

SEQ ID NO: 1302827 - protein, 18 aa, Mycobacterium
RGLALAAALRRGTGVLSA

SEQ ID NO: 1302828 - protein, 22 aa, Mycobacterium
RGLDPELAPLYAQALVGSVSMT

SEQ ID NO: 1302829 - protein, 31 aa, Mycobacterium
RGLGGDATRLLYTLGWHEVPLPAVDPAAPNG

SEQ ID NO: 1302830 - protein, 22 aa, Mycobacterium
RGLLATGRLHAPLFTLRGGTNE

SEQ ID NO: 1302831 - protein, 19 aa, Mycobacterium
RGLVRIDIVVPPDLQDDLH

SEQ ID NO: 1302832 - protein, 23 aa, Mycobacterium
RGMAFSGVVWRAAAPKPDESSAD

SEQ ID NO: 1302833 - protein, 28 aa, Mycobacterium
RGMRIASVILFGELILQTALSMAADRAS

SEQ ID NO: 1302834 - protein, 21 aa, Mycobacterium
RGMTLPFWMVYDDREGEVPPV

SEQ ID NO: 1302835 - protein, 18 aa, Mycobacterium
RGNDYTDLALVTDGLRSE

SEQ ID NO: 1302836 - protein, 33 aa, Mycobacterium
RGPEMLTFVLEHSPLKLCWVPGYSDYYPETPGG

SEQ ID NO: 1302837 - protein, 26 aa, Mycobacterium
RGPRKKGVRYFGPYSHAWAIRETVDL

SEQ ID NO: 1302838 - protein, 23 aa, Mycobacterium
RGQGALIVLVARDDPLDTYLVHH

SEQ ID NO: 1302839 - protein, 22 aa, Mycobacterium
RGRDQRPYAVRPAPTHTDHVPA

SEQ ID NO: 1302840 - protein, 18 aa, Mycobacterium
RGRGGFASTWLGSVSSAV

SEQ ID NO: 1302841 - protein, 21 aa, Mycobacterium
RGRGIPLMRALSDRVDIDKTP

SEQ ID NO: 1302842 - protein, 21 aa, Mycobacterium
RGRIAQLQRWPDGLQAAVEAK

SEQ ID NO: 1302843 - protein, 23 aa, Mycobacterium
RGRINAMRFLLSKFDYDDKDPDV

SEQ ID NO: 1302844 - protein, 18 aa, Mycobacterium
RGRMSIDKFAPQISFFFY

SEQ ID NO: 1302845 - protein, 18 aa, Mycobacterium
RGRRPALPTVLGPHDVAG

SEQ ID NO: 1302846 - protein, 21 aa, Mycobacterium
RGRSLLVDHVLSGLGGRTAAQ

SEQ ID NO: 1302847 - protein, 26 aa, Mycobacterium
RGRTDPPPWRLVYGGRDRAAMAFLDR

SEQ ID NO: 1302848 - protein, 18 aa, Mycobacterium
RGRWYHTGRWPHDPVDFT

SEQ ID NO: 1302849 - protein, 20 aa, Mycobacterium
RGSAYHHFPGGRTQLLCEAV

SEQ ID NO: 1302850 - protein, 25 aa, Mycobacterium
RGSDGKWRLSPKAMRQLGQAALRDV

SEQ ID NO: 1302851 - protein, 17 aa, Mycobacterium
RGSGIFAGGWGAKRAAV

SEQ ID NO: 1302852 - protein, 24 aa, Mycobacterium
RGSTWGRQLPWLTGLATVYTYDAP

SEQ ID NO: 1302853 - protein, 19 aa, Mycobacterium
RGTALTSFYMCGDLYQVDP

SEQ ID NO: 1302854 - protein, 27 aa, Mycobacterium
RGTEQLSHTFALIDLLPWGRQEEWQDS

SEQ ID NO: 1302855 - protein, 25 aa, Mycobacterium
RGTGQVLMVAWMDDIALDRTMRTRN

SEQ ID NO: 1302856 - protein, 24 aa, Mycobacterium
RGVEVLLLADLLTEALTSGAARMH

SEQ ID NO: 1302857 - protein, 17 aa, Mycobacterium
RGVGDAPVVYYTDPMRM

SEQ ID NO: 1302858 - protein, 17 aa, Mycobacterium
RGVLHRAAPYPENSPRE

SEQ ID NO: 1302859 - protein, 20 aa, Mycobacterium
RGVLVASDECYLGLAWDAEP

SEQ ID NO: 1302860 - protein, 26 aa, Mycobacterium
RGVPLTLVHVIAPKDLQMWIEVPAPQ

SEQ ID NO: 1302861 - protein, 24 aa, Mycobacterium
RGVWRFGEFVLDTARYELRCGHNV

SEQ ID NO: 1302862 - protein, 26 aa, Mycobacterium
RGYHRREDKPFWWSHFDRLNNPVDEW

SEQ ID NO: 1302863 - protein, 20 aa, Mycobacterium
RGYLPPVQLGEVIRAAGIGE

SEQ ID NO: 1302864 - protein, 19 aa, Mycobacterium
RGYPLFVENLKSLGAEIER

SEQ ID NO: 1302865 - protein, 18 aa, Mycobacterium
RHAILIEPLATPVHTVRR

SEQ ID NO: 1302866 - protein, 24 aa, Mycobacterium
RHAKYPLHLDIPVTIAGMSFGALS

SEQ ID NO: 1302867 - protein, 27 aa, Mycobacterium
RHAVDEALLRRVPLRVLTPGSESARAP

SEQ ID NO: 1302868 - protein, 27 aa, Mycobacterium
RHDHQSFWWFIRDLIYTYRQQPEIGWS

SEQ ID NO: 1302869 - protein, 27 aa, Mycobacterium
RHDTIGFIFQSYNLIPFLSAVENVELP

SEQ ID NO: 1302870 - protein, 27 aa, Mycobacterium
RHFEQLLIHGFLLAQPHYQAMALAADQ

SEQ ID NO: 1302871 - protein, 26 aa, Mycobacterium
RHGEWIVPTRLALHRRMGSIDLDLTR

SEQ ID NO: 1302872 - protein, 18 aa, Mycobacterium
RHGMPVLTVVFNNAVWGM

SEQ ID NO: 1302873 - protein, 23 aa, Mycobacterium
RHKDRPVLFLGDTTMTGGELADR

SEQ ID NO: 1302874 - protein, 21 aa, Mycobacterium
RHLLRGELLTARKQRDTVRIA

SEQ ID NO: 1302875 - protein, 18 aa, Mycobacterium
RHNVGFVVADLLAGRIGS

SEQ ID NO: 1302876 - protein, 26 aa, Mycobacterium
RHPHTLQLIMDSLRYWVLEMHVDGFR

SEQ ID NO: 1302877 - protein, 28 aa, Mycobacterium
RHPNLRAGFFRGDLPRPVQVVPARVDLP

SEQ ID NO: 1302878 - protein, 35 aa, Mycobacterium
RHPNLRIVFVEHAFSWILPLMWRMDALYEARKSWL

SEQ ID NO: 1302879 - protein, 24 aa, Mycobacterium
RHQDALLELLPQITLINGYGSSET

SEQ ID NO: 1302880 - protein, 20 aa, Mycobacterium
RHQQAPGPTLLGGYGGFEVA

SEQ ID NO: 1302881 - protein, 26 aa, Mycobacterium
RHRADWGILHLGQRRRRRIPGHERTR

SEQ ID NO: 1302882 - protein, 18 aa, Mycobacterium
RHRAVRLLLASGLARNPR

SEQ ID NO: 1302883 - protein, 19 aa, Mycobacterium
RHRDALTGLFTVWFSAHTA

SEQ ID NO: 1302884 - protein, 18 aa, Mycobacterium
RHRWFDTHSWNRPTWTIA

SEQ ID NO: 1302885 - protein, 29 aa, Mycobacterium
RHSAFYATSLAYLLNQLRPERVVLTGQVT

SEQ ID NO: 1302886 - protein, 21 aa, Mycobacterium
RHTMAALRFAIQGGPGLVTVV

SEQ ID NO: 1302887 - protein, 26 aa, Mycobacterium
RHVAPGRVIVLPWDKHIAAGTEIQLD

SEQ ID NO: 1302888 - protein, 21 aa, Mycobacterium
RHVEWTNYLTPQALIDLVASR

SEQ ID NO: 1302889 - protein, 19 aa, Mycobacterium
RHVGEMITFAIRIPLEIDM

SEQ ID NO: 1302890 - protein, 25 aa, Mycobacterium
RHVGRRRAARFLAEGPNLVEAALRR

SEQ ID NO: 1302891 - protein, 35 aa, Mycobacterium
RIAERSGFGTATLLRHHFRRIIGVTPTDYRRRFCC

SEQ ID NO: 1302892 - protein, 25 aa, Mycobacterium
RIAKGTVAAVRFLIEGWIEGGEGRP

SEQ ID NO: 1302893 - protein, 25 aa, Mycobacterium
RIANPVMRRLPFQTLLETTGRKSGQ

SEQ ID NO: 1302894 - protein, 18 aa, Mycobacterium
RIAPEMTGLPAYGGRRRV

SEQ ID NO: 1302895 - protein, 30 aa, Mycobacterium; identical to SEQ ID NO: 854235

SEQ ID NO: 1302896 - protein, 28 aa, Mycobacterium
RIASPPVRWPCFYGIDFATPAELIANGA

SEQ ID NO: 1302897 - protein, 18 aa, Mycobacterium
RIAVLYAGRIAEIGPSAE

SEQ ID NO: 1302898 - protein, 17 aa, Mycobacterium
RIDGVAAGLRQVASLPD

SEQ ID NO: 1302899 - protein, 28 aa, Mycobacterium
RIDVDYNGWWMCMIPRQVAEELGQPLPL

SEQ ID NO: 1302900 - protein, 19 aa, Mycobacterium
RIEAAHPGRFLLGIGVGHP

SEQ ID NO: 1302901 - protein, 25 aa, Mycobacterium
RIEAAPWQWVGRELPQFSSAPTVHR

SEQ ID NO: 1302902 - protein, 17 aa, Mycobacterium
RIERFELPNLRALNVVV

SEQ ID NO: 1302903 - protein, 21 aa, Mycobacterium
RIERFLQLWAEGSMTIALPST

SEQ ID NO: 1302904 - protein, 26 aa, Mycobacterium
RIGGRVWRVPVTAFWQAHRDAARRYS

SEQ ID NO: 1302905 - protein, 17 aa, Mycobacterium
RIGIARALATQPKILAL

SEQ ID NO: 1302906 - protein, 21 aa, Mycobacterium
RIGRRIVGRLNWRKQGPAPAP

SEQ ID NO: 1302907 - protein, 17 aa, Mycobacterium
RIGVLSQVPSLWAQYVE

SEQ ID NO: 1302908 - protein, 17 aa, Mycobacterium
RIILTRPAVEAGERLGF

SEQ ID NO: 1302909 - protein, 17 aa, Mycobacterium
RILIHQPALSGVIQGQF

SEQ ID NO: 1302910 - protein, 18 aa, Mycobacterium
RINEFYARETMLLDDGRL

SEQ ID NO: 1302911 - protein, 25 aa, Mycobacterium
RIPETDFRLSRFAEGDLLRTPYPYV

SEQ ID NO: 1302912 - protein, 17 aa, Mycobacterium
RIPMLAGRRSLNLSNAA

SEQ ID NO: 1302913 - protein, 23 aa, Mycobacterium
RIQAIALLIGPLILGRLSTLADF

SEQ ID NO: 1302914 - protein, 18 aa, Mycobacterium
RIRALHGVSLKVHEGELV

SEQ ID NO: 1302915 - protein, 25 aa, Mycobacterium
RIRALQILARRRPAGLEAGLAGLLD

SEQ ID NO: 1302916 - protein, 23 aa, Mycobacterium
RIRARVILMPAVTDTYFTVTENH

SEQ ID NO: 1302917 - protein, 18 aa, Mycobacterium
RIRFGAVSLLLRRLGRGK

SEQ ID NO: 1302918 - protein, 22 aa, Mycobacterium
RIRIDLGALRILGDGLAWAPGG

SEQ ID NO: 1302919 - protein, 17 aa, Mycobacterium
RIRLRVPLVSSAMDTVT

SEQ ID NO: 1302920 - protein, 19 aa, Mycobacterium
RIRTLIAELGQDIPVLATT

SEQ ID NO: 1302921 - protein, 25 aa, Mycobacterium
RISGKKGERIVYIRTLVTGKSSSAN

SEQ ID NO: 1302922 - protein, 29 aa, Mycobacterium
RITALLQPRVFGYAFKPLSLYWCHDARGV

SEQ ID NO: 1302923 - protein, 31 aa, Mycobacterium
RITAMHFVPSLLGLFLSLPGVNQWRTLQRVP

SEQ ID NO: 1302924 - protein, 23 aa, Mycobacterium
RITDLAAPLPMTFAGVSRHIGVL

SEQ ID NO: 1302925 - protein, 40 aa, Mycobacterium
RITLADDLVLYLFGTPGQRRFWFMWDDLIRGAIGAIILVD

SEQ ID NO: 1302926 - protein, 21 aa, Mycobacterium
RITMLPGPPTLYHSLLSVADK

SEQ ID NO: 1302927 - protein, 20 aa, Mycobacterium
RIVEFFGTQLTLPPEARFAS

SEQ ID NO: 1302928 - protein, 18 aa, Mycobacterium
RIVVELKRDAVAKVVLNN

SEQ ID NO: 1302929 - protein, 30 aa, Mycobacterium
RIWRRARPSYLPVPLARRGRRFPTSNSLPS

SEQ ID NO: 1302930 - protein, 33 aa, Mycobacterium
RKADHLLAELGWTLRHVPLPPKGQHWRLLSTVK

SEQ ID NO: 1302931 - protein, 24 aa, Mycobacterium
RKADKWVPLLKNRTPVVAAALQNS

SEQ ID NO: 1302932 - protein, 25 aa, Mycobacterium
RKAKKLRVRLPLPKLTVAVTDPAQL

SEQ ID NO: 1302933 - protein, 25 aa, Mycobacterium
RKETSAGFWLRANAWFAECGITVRK

SEQ ID NO: 1302934 - protein, 24 aa, Mycobacterium
RKGMNVLLGALPAVVARYPDVEIL

SEQ ID NO: 1302935 - protein, 22 aa, Mycobacterium
RKHQLLLLADEIYDKILYDDAK

SEQ ID NO: 1302936 - protein, 19 aa, Mycobacterium
RKHVLPKLPSPASKSWRSR

SEQ ID NO: 1302937 - protein, 17 aa, Mycobacterium
RKLFIRQGFDRWDDRPA

SEQ ID NO: 1302938 - protein, 21 aa, Mycobacterium
RKNVREHIAFSRGIHSCPGAP

SEQ ID NO: 1302939 - protein, 36 aa, Mycobacterium
RKPKGVAGLITPWNTPFMLESWKLAPALASGCTVVL

SEQ ID NO: 1302940 - protein, 20 aa, Mycobacterium
RKRALRDQQLTADRAKAGVM

SEQ ID NO: 1302941 - protein, 21 aa, Mycobacterium
RKRFLGALLADAYGAVRPPDG

SEQ ID NO: 1302942 - protein, 19 aa, Mycobacterium
RKRRMFDLLVRMGYKEIEV

SEQ ID NO: 1302943 - protein, 28 aa, Mycobacterium
RKSPQMSEVLPLLYLHGLSTSDFTPALE

SEQ ID NO: 1302944 - protein, 19 aa, Mycobacterium
RKVFDLLEHAPVDVAVLTE

SEQ ID NO: 1302945 - protein, 19 aa, Mycobacterium
RKVSRLMEWVAMVGCPIIG

SEQ ID NO: 1302946 - protein, 30 aa, Mycobacterium
RLAAFGHAVLLPDVYYRRGEWEPFDMSTVF

SEQ ID NO: 1302947 - protein, 19 aa, Mycobacterium
RLADGLPHRPGVYLFRGPG

SEQ ID NO: 1302948 - protein, 22 aa, Mycobacterium
RLAKLVNTLLDFSRIQAGRMRA

SEQ ID NO: 1302949 - protein, 19 aa, Mycobacterium
RLAMKQENIPLWLDAPMTE

SEQ ID NO: 1302950 - protein, 19 aa, Mycobacterium
RLARTTLANERIAMAGGTA

SEQ ID NO: 1302951 - protein, 17 aa, Mycobacterium
RLASLRQLLFETAVIDT

SEQ ID NO: 1302952 - protein, 21 aa, Mycobacterium
RLAVWLVSDPSAVPGIAALGP

SEQ ID NO: 1302953 - protein, 27 aa, Mycobacterium
RLDDARLAFYKTLYRDNARYDAKLWVV

SEQ ID NO: 1302954 - protein, 32 aa, Mycobacterium
RLDKMLRLKVFPLAVSLPWGIAPAALPQLPLP

SEQ ID NO: 1302955 - protein, 19 aa, Mycobacterium
RLDLALVALHRQIKFVAVT

SEQ ID NO: 1302956 - protein, 18 aa, Mycobacterium
RLDLDVRPGLARCRTCDT

SEQ ID NO: 1302957 - protein, 30 aa, Mycobacterium
RLDPERGRLWSALWLRPAHGPGVLVVTAHV

SEQ ID NO: 1302958 - protein, 24 aa, Mycobacterium
RLDQGLAFVSYQRSLEKGFLTVQR

SEQ ID NO: 1302959 - protein, 24 aa, Mycobacterium
RLDRAMVARLRPGGLLAVAALSEV

SEQ ID NO: 1302960 - protein, 24 aa, Mycobacterium
RLDRLTAGVLLFTTRREIRGAYQT

SEQ ID NO: 1302961 - protein, 20 aa, Mycobacterium
RLEADDVLGFTWGPEQVAVA

SEQ ID NO: 1302962 - protein, 26 aa, Mycobacterium
RLEGRRLRFTLSGPPTLVLRALSSVD

SEQ ID NO: 1302963 - protein, 34 aa, Mycobacterium
RLELFSTDRRLVLDELALLRLNALLARACGDAAS

SEQ ID NO: 1302964 - protein, 22 aa, Mycobacterium
RLELRVLFEELLARFASVRLVE

SEQ ID NO: 1302965 - protein, 18 aa, Mycobacterium
RLFYQVRQNWRGKAVLVK

SEQ ID NO: 1302966 - protein, 19 aa, Mycobacterium
RLFYVGRTSELIKAAGANV

SEQ ID NO: 1302967 - protein, 20 aa, Mycobacterium
RLGALLEWRQRLIDSGAVSA

SEQ ID NO: 1302968 - protein, 28 aa, Mycobacterium
RLGATSRAPRWAVAYKYPPEEAQTKLLD

SEQ ID NO: 1302969 - protein, 22 aa, Mycobacterium
RLGDVLAKARARPLRSRADVED

SEQ ID NO: 1302970 - protein, 25 aa, Mycobacterium
RLGIAHCGPLPPALAALVDIPVDRE

SEQ ID NO: 1302971 - protein, 24 aa, Mycobacterium
RLGIEPPRGVLLYGPPGCGKTFVV

SEQ ID NO: 1302972 - protein, 24 aa, Mycobacterium
RLGKAGWLNVYVPSAEILHDKGHS

SEQ ID NO: 1302973 - protein, 28 aa, Mycobacterium
RLGLTKGDLYTLWAPRWRDAGDEWEAFL

SEQ ID NO: 1302974 - protein, 17 aa, Mycobacterium
RLGRFLPADVRIRDIIR

SEQ ID NO: 1302975 - protein, 24 aa, Mycobacterium
RLGRRLMVPPLSLTIEACEAAVAD

SEQ ID NO: 1302976 - protein, 17 aa, Mycobacterium
RLGTYQLLRTRVEPHAA

SEQ ID NO: 1302977 - protein, 31 aa, Mycobacterium
RLGVLQDLYRRWPFFRTVLSNMAQVLAKSDL

SEQ ID NO: 1302978 - protein, 29 aa, Mycobacterium
RLHDAPTYRWPMVPALALLAAMPALGSAE

SEQ ID NO: 1302979 - protein, 21 aa, Mycobacterium
RLHLDGRPMVLRRPPVHPRPT

SEQ ID NO: 1302980 - protein, 28 aa, Mycobacterium
RLHVTKGSFYWHFSDIQAYRAALVEAWG

SEQ ID NO: 1302981 - protein, 20 aa, Mycobacterium
RLIDTLVRLRELGNTLIVVE

SEQ ID NO: 1302982 - protein, 23 aa, Mycobacterium
RLKLDRYLYTSMAYPTDYGFIEN

SEQ ID NO: 1302983 - protein, 25 aa, Mycobacterium
RLKPRVFYDLVVEVALIRPGPIQGG

SEQ ID NO: 1302984 - protein, 22 aa, Mycobacterium
RLKVIAAVHPGLWQPAVLAKLG

SEQ ID NO: 1302985 - protein, 20 aa, Mycobacterium
RLLRDRVRLAELTAAAMAEL

SEQ ID NO: 1302986 - protein, 21 aa, Mycobacterium
RLLTIRRMKPLGFTLEEMRDL

SEQ ID NO: 1302987 - protein, 19 aa, Mycobacterium
RLLVAGAALQVPLIAVVLR

SEQ ID NO: 1302988 - protein, 20 aa, Mycobacterium
RLLWAERQQPTPAVQLALAL

SEQ ID NO: 1302989 - protein, 21 aa, Mycobacterium
RLNEVCCIYPITPSSPMAELA

SEQ ID NO: 1302990 - protein, 30 aa, Mycobacterium
RLNNFEGPFDLLLQLIFAHRLDVTEVALHQ

SEQ ID NO: 1302991 - protein, 17 aa, Mycobacterium
RLNTFFKEIVAATPPPV

SEQ ID NO: 1302992 - protein, 19 aa, Mycobacterium
RLPAPPMPTVRLKPRLSPP

SEQ ID NO: 1302993 - protein, 22 aa, Mycobacterium
RLPDLRCLMLTSFTSDEAMIDA

SEQ ID NO: 1302994 - protein, 26 aa, Mycobacterium
RLQGKMMEYLPPFAPTAFRWQSEHAT

SEQ ID NO: 1302995 - protein, 18 aa, Mycobacterium
RLQLVKSPVHGLVLVSLD

SEQ ID NO: 1302996 - protein, 19 aa, Mycobacterium
RLQRWRRATSLPTGPDATD

SEQ ID NO: 1302997 - protein, 24 aa, Mycobacterium
RLQVINWGVFDGYHSIPFSAGGAL

SEQ ID NO: 1302998 - protein, 17 aa, Mycobacterium
RLRDELGLLTRPAAEEL

SEQ ID NO: 1302999 - protein, 21 aa, Mycobacterium
RLRKDIYDLYGYNAVVHMLSA

SEQ ID NO: 1303000 - protein, 17 aa, Mycobacterium
RLRLVGVAGYEAACGQD

SEQ ID NO: 1303001 - protein, 24 aa, Mycobacterium
RLRRVAGDWQLCRRRLLLDQTVLL

SEQ ID NO: 1303002 - protein, 22 aa, Mycobacterium
RLRTLAATLRQPVMLKEVGHGI

SEQ ID NO: 1303003 - protein, 21 aa, Mycobacterium
RLRVKLADRALTQTNPLLGVA

SEQ ID NO: 1303004 - protein, 17 aa, Mycobacterium
RLRVRTWVNGRLAQDGD

SEQ ID NO: 1303005 - protein, 18 aa, Mycobacterium
RLSAFFDLVQQDPVVSQV

SEQ ID NO: 1303006 - protein, 20 aa, Mycobacterium
RLSAPRRLFLGSTAAKMLRV

SEQ ID NO: 1303007 - protein, 25 aa, Mycobacterium
RLSARHDIMWLMTSDLSPLGGPEDA

SEQ ID NO: 1303008 - protein, 20 aa, Mycobacterium
RLSELDLILRIVDGTDVAFV

SEQ ID NO: 1303009 - protein, 23 aa, Mycobacterium
RLSKFEVLTAMAFAAFADAPVDV

SEQ ID NO: 1303010 - protein, 25 aa, Mycobacterium
RLSPPGFGAPLPGGFPATFIAYRDW

SEQ ID NO: 1303011 - protein, 25 aa, Mycobacterium
RLTDDPYPFYAALRDKCPVTREDHY

SEQ ID NO: 1303012 - protein, 19 aa, Mycobacterium
RLTEQLDILTGMWATPVGE

SEQ ID NO: 1303013 - protein, 21 aa, Mycobacterium
RLVARVAGGWELTDLGREALA

SEQ ID NO: 1303014 - protein, 22 aa, Mycobacterium
RLVDAPLPTWTHVHLMLTRDGQ

SEQ ID NO: 1303015 - protein, 19 aa, Mycobacterium
RLVEQLAQAGLLKVICGTD

SEQ ID NO: 1303016 - protein, 17 aa, Mycobacterium
RLVLAFVGIHHAASTLL

SEQ ID NO: 1303017 - protein, 18 aa, Mycobacterium
RLVVELTPDEAAALGDEL

SEQ ID NO: 1303018 - protein, 25 aa, Mycobacterium
RLVVIDLSEVTYFGSAALNAVLSCH

SEQ ID NO: 1303019 - protein, 18 aa, Mycobacterium
RLYIGRIGIFDRDNDFEP

SEQ ID NO: 1303020 - protein, 18 aa, Mycobacterium
RLYTYRSHGIHVCANVAC

SEQ ID NO: 1303021 - protein, 20 aa, Mycobacterium
RMDIPRTAAPILRQLVDTLQ

SEQ ID NO: 1303022 - protein, 17 aa, Mycobacterium
RMEILPVSFGFPFGLSA

SEQ ID NO: 1303023 - protein, 19 aa, Mycobacterium
RMETRVALECLLDRVRDIR

SEQ ID NO: 1303024 - protein, 18 aa, Mycobacterium
RMMRLVTEQAPDAILTLH

SEQ ID NO: 1303025 - protein, 28 aa, Mycobacterium
RMNDHCEVEWIPPPRLDTGQARLNHYHR

SEQ ID NO: 1303026 - protein, 28 aa, Mycobacterium
RMNDQCEVEWIPPPRLDTGQARLNHYHR

SEQ ID NO: 1303027 - protein, 25 aa, Mycobacterium
RMNSRPLPMFVTDAALLADRFIAPT

SEQ ID NO: 1303028 - protein, 20 aa, Mycobacterium
RMPRHWCEDSYHLTHWTDMP

SEQ ID NO: 1303029 - protein, 24 aa, Mycobacterium
RMRHGMYWSGDLAYRDAEGWIYLA

SEQ ID NO: 1303030 - protein, 22 aa, Mycobacterium
RMRKDWNPHDFIPWSDGKNYYA

SEQ ID NO: 1303031 - protein, 17 aa, Mycobacterium
RMRQAVTQCPAAALRLT

SEQ ID NO: 1303032 - protein, 17 aa, Mycobacterium
RMRVPGPIATHPLESVT

SEQ ID NO: 1303033 - protein, 19 aa, Mycobacterium
RMTDPGRLILLTRNAQPVT

SEQ ID NO: 1303034 - protein, 18 aa, Mycobacterium
RMVDALLTALSRRTGRTT

SEQ ID NO: 1303035 - protein, 24 aa, Mycobacterium
RMVGVLRGFDPDVVHLASPALLGY

SEQ ID NO: 1303036 - protein, 32 aa, Mycobacterium
RNADSGYASWRRMLWARWPSAGPPPHFDSADE

SEQ ID NO: 1303037 - protein, 18 aa, Mycobacterium
RNALLWNDTRSAGAAADL

SEQ ID NO: 1303038 - protein, 28 aa, Mycobacterium
RNAPLAVRGTRLAILKGLDLPLHEAEML

SEQ ID NO: 1303039 - protein, 19 aa, Mycobacterium
RNCLLGRRGACLNLKMAML

SEQ ID NO: 1303040 - protein, 18 aa, Mycobacterium
RNFARRGIRSHVLPARAT

SEQ ID NO: 1303041 - protein, 26 aa, Mycobacterium
RNFNEAFGPFGFKPQAIKPSYGLAEA

SEQ ID NO: 1303042 - protein, 40 aa, Mycobacterium; identical to SEQ ID NO: 222402

SEQ ID NO: 1303043 - protein, 26 aa, Mycobacterium
RNGLRPGRWWRTIDDRIILASESGVL

SEQ ID NO: 1303044 - protein, 21 aa, Mycobacterium
RNLHRLPVAIARLARTRRISA

SEQ ID NO: 1303045 - protein, 17 aa, Mycobacterium
RNRGYLLSQPGLRKLLP

SEQ ID NO: 1303046 - protein, 30 aa, Mycobacterium
RNRVLALALHLLDLGYFRAGGDQYAEENNS

SEQ ID NO: 1303047 - protein, 37 aa, Mycobacterium
RNRYLVYTSPDIRALYLFKRTMWWPYSVAMRQVNVLF

SEQ ID NO: 1303048 - protein, 26 aa, Mycobacterium
RNVIHPRFGNFILLATVLVDAEISEY

SEQ ID NO: 1303049 - protein, 31 aa, Mycobacterium
RNWITRAGMGLQYLLLRSGPMTMPPSTLGAF

SEQ ID NO: 1303050 - protein, 26 aa, Mycobacterium
RPADSGVLLLFSALELLHACALVHDD

SEQ ID NO: 1303051 - protein, 18 aa, Mycobacterium
RPAFRYERSLAVLTAARD

SEQ ID NO: 1303052 - protein, 19 aa, Mycobacterium
RPALIFLNSPSNPTGRVLG

SEQ ID NO: 1303053 - protein, 26 aa, Mycobacterium
RPAMVHVDMYRLLDHPGTDLLAELDS

SEQ ID NO: 1303054 - protein, 23 aa, Mycobacterium
RPAWDLDRWVRDFFGPAAANDGF

SEQ ID NO: 1303055 - protein, 26 aa, Mycobacterium
RPDEPEFLPLVRRLGRFLPADVRIRD

SEQ ID NO: 1303056 - protein, 26 aa, Mycobacterium
RPDGDAWLLLSMLQVIFAEGLEDTTA

SEQ ID NO: 1303057 - protein, 23 aa, Mycobacterium
RPDGLIYTIWESPGPIEPDPYLK

SEQ ID NO: 1303058 - protein, 27 aa, Mycobacterium
RPDLIDPALLRPGRLERLVFVEPPDAE

SEQ ID NO: 1303059 - protein, 30 aa, Mycobacterium
RPDLITQAKPIRALLRFLLGEGFDEAELDG

SEQ ID NO: 1303060 - protein, 17 aa, Mycobacterium
RPDLQQLKRSQSGQWNV

SEQ ID NO: 1303061 - protein, 26 aa, Mycobacterium
RPDLVSHIVYLAAALPREGRTYPEAM

SEQ ID NO: 1303062 - protein, 22 aa, Mycobacterium
RPDPALVTLFGQVADALRTGSR

SEQ ID NO: 1303063 - protein, 27 aa, Mycobacterium
RPDPSPRIRLWWRPAEPMPDDPILNSC

SEQ ID NO: 1303064 - protein, 29 aa, Mycobacterium
RPDRAPLAVPIWYGYQPGGEVLLWTESDS

SEQ ID NO: 1303065 - protein, 20 aa, Mycobacterium
RPEFRAMFLDDLLNGSRKQL

SEQ ID NO: 1303066 - protein, 28 aa, Mycobacterium
RPEFVAALRGIWNLGAAAVLISPAWKHA

SEQ ID NO: 1303067 - protein, 25 aa, Mycobacterium
RPEHRRLVICDLGMPRDVEPAIAGL

SEQ ID NO: 1303068 - protein, 17 aa, Mycobacterium
RPELFALQADELLDMAM

SEQ ID NO: 1303069 - protein, 25 aa, Mycobacterium
RPEMLLHAIIKLHEKIQQMPLGVNR

SEQ ID NO: 1303070 - protein, 18 aa, Mycobacterium
RPFLAQHGIDVPIRVVRE

SEQ ID NO: 1303071 - protein, 17 aa, Mycobacterium
RPGGFAARFDRDASALT

SEQ ID NO: 1303072 - protein, 23 aa, Mycobacterium
RPGIPYPEWNAWTKSFMPDHVAV

SEQ ID NO: 1303073 - protein, 18 aa, Mycobacterium
RPGMLHACFVRSPFARAK

SEQ ID NO: 1303074 - protein, 17 aa, Mycobacterium
RPGNRPVNGLLRGERVV

SEQ ID NO: 1303075 - protein, 18 aa, Mycobacterium
RPGPTADAIRRAARSYVE

SEQ ID NO: 1303076 - protein, 21 aa, Mycobacterium
RPGSDSLLRMRLDLAECATGV

SEQ ID NO: 1303077 - protein, 18 aa, Mycobacterium
RPGTLERWDLGYDVLRER

SEQ ID NO: 1303078 - protein, 23 aa, Mycobacterium
RPHLATTLLPGLLEALARNVSRG

SEQ ID NO: 1303079 - protein, 19 aa, Mycobacterium
RPIRPAVLRVPDGVVLSVV

SEQ ID NO: 1303080 - protein, 22 aa, Mycobacterium
RPITTPFGLYDCDVPCDGAVAV

SEQ ID NO: 1303081 - protein, 17 aa, Mycobacterium
RPLACVSELRYPEPSFA

SEQ ID NO: 1303082 - protein, 27 aa, Mycobacterium
RPLGEQRFPYVFLDATYCKARVNHRVV

SEQ ID NO: 1303083 - protein, 19 aa, Mycobacterium
RPLRPTFVSGLRNEIQVVV

SEQ ID NO: 1303084 - protein, 29 aa, Mycobacterium
RPLVEAGMVYVTLPPLFVVKDGTQRIYCQ

SEQ ID NO: 1303085 - protein, 32 aa, Mycobacterium
RPLVRAPILLYRCGLGFMLGDRFLMLEHVGRS

SEQ ID NO: 1303086 - protein, 17 aa, Mycobacterium
RPMTRYFPELVEAARAE

SEQ ID NO: 1303087 - protein, 22 aa, Mycobacterium
RPNTPVWHRLQTDYLDNLAAAG

SEQ ID NO: 1303088 - protein, 18 aa, Mycobacterium
RPPDLVDRQFGVAAPNVL

SEQ ID NO: 1303089 - protein, 25 aa, Mycobacterium
RPPTTPPPTVPLYRGPSGERADWWW

SEQ ID NO: 1303090 - protein, 25 aa, Mycobacterium
RPQLSEDVARFVRRRIFDGTYPAGG

SEQ ID NO: 1303091 - protein, 25 aa, Mycobacterium
RPQVLIRIGLAPAIEQVPPPTPRRA

SEQ ID NO: 1303092 - protein, 27 aa, Mycobacterium
RPQYRELLQDFLFKLDLDEETRRRAEI

SEQ ID NO: 1303093 - protein, 22 aa, Mycobacterium
RPRAVEWGWQLAAALTVATVFG

SEQ ID NO: 1303094 - protein, 35 aa, Mycobacterium
RPREYWRGPVWPVMTWLFAWCFARRGWAERARVLR

SEQ ID NO: 1303095 - protein, 21 aa, Mycobacterium
RPRKYLRVTLGRRNPVVTATF

SEQ ID NO: 1303096 - protein, 21 aa, Mycobacterium
RPRPVRAWQLPSDALPTWVGA

SEQ ID NO: 1303097 - protein, 18 aa, Mycobacterium
RPRRWVFTSVGRLGHDRD

SEQ ID NO: 1303098 - protein, 22 aa, Mycobacterium
RPSALTIWTGGFGVPGLAAQSG

SEQ ID NO: 1303099 - protein, 25 aa, Mycobacterium
RPSAWLAEGLLMYLPATAQEALFSG

SEQ ID NO: 1303100 - protein, 20 aa, Mycobacterium
RPSRIWVTEDGLVVMASEAG

SEQ ID NO: 1303101 - protein, 27 aa, Mycobacterium
RPTATANSIAWLLWHSARVQDAQVCDI

SEQ ID NO: 1303102 - protein, 17 aa, Mycobacterium
RPTDPALLHYRSGGFFL

SEQ ID NO: 1303103 - protein, 20 aa, Mycobacterium
RPTLHRPVSALLADPSVPVY

SEQ ID NO: 1303104 - protein, 19 aa, Mycobacterium
RPTVYRRWPSKAHVVFDAA

SEQ ID NO: 1303105 - protein, 29 aa, Mycobacterium
RPVDLMTALALPVPTIAICALLGVPYEDH

SEQ ID NO: 1303106 - protein, 29 aa, Mycobacterium
RPVKLALTRQQMFALVGYRTPTIQRIRLG

SEQ ID NO: 1303107 - protein, 24 aa, Mycobacterium
RPVQRLLAAGLLRQVDDDTVILPR

SEQ ID NO: 1303108 - protein, 18 aa, Mycobacterium
RPVSTPHPPIWIGGNTAA

SEQ ID NO: 1303109 - protein, 21 aa, Mycobacterium
RPYLVEGVGEDFWPSAYDPAV

SEQ ID NO: 1303110 - protein, 18 aa, Mycobacterium
RQAHAAWVFARLAPGLMQ

SEQ ID NO: 1303111 - protein, 27 aa, Mycobacterium
RQAIVDRALRFPAALGRPLLTDLARWD

SEQ ID NO: 1303112 - protein, 29 aa, Mycobacterium
RQEAVLEDPYILLVSSKISTVKDLLPLLE

SEQ ID NO: 1303113 - protein, 21 aa, Mycobacterium
RQELPLIEEWFEFVGEKLPTG

SEQ ID NO: 1303114 - protein, 17 aa, Mycobacterium
RQFAIKPYGLVNLDDIL

SEQ ID NO: 1303115 - protein, 30 aa, Mycobacterium
RQGDRYLMVNPYFHTFGYKAGLIASFIRGA

SEQ ID NO: 1303116 - protein, 19 aa, Mycobacterium
RQGRYGLMTMCIGGGQGLA

SEQ ID NO: 1303117 - protein, 24 aa, Mycobacterium
RQIVLPQPILRNAELSKLICVDPD

SEQ ID NO: 1303118 - protein, 20 aa, Mycobacterium
RQKFNPLVRLDSVNGGPVED

SEQ ID NO: 1303119 - protein, 21 aa, Mycobacterium
RQLAFYGSTPAYRRVLELHGW

SEQ ID NO: 1303120 - protein, 24 aa, Mycobacterium
RQLAGIGWMHNRVRMIVASFLVKD

SEQ ID NO: 1303121 - protein, 23 aa, Mycobacterium
RQLGSYYDLDLARRGLTNAIVTY

SEQ ID NO: 1303122 - protein, 21 aa, Mycobacterium
RQLRTKVLFGTDYPYIQLDRW

SEQ ID NO: 1303123 - protein, 26 aa, Mycobacterium
RQMPGTSYWYVHADQWRYDGYRADAL

SEQ ID NO: 1303124 - protein, 25 aa, Mycobacterium
RQRPVLIHRALFGSIERFFGVLTEH

SEQ ID NO: 1303125 - protein, 21 aa, Mycobacterium
RQTVDRLARLGILAAPGEFYG

SEQ ID NO: 1303126 - protein, 19 aa, Mycobacterium
RQVVTLLGSGRRVLAHCFA

SEQ ID NO: 1303127 - protein, 20 aa, Mycobacterium
RQYVEIWVEVLRAVDPSLDE

SEQ ID NO: 1303128 - protein, 19 aa, Mycobacterium
RRAGLPKVPTAVLSRGICG

SEQ ID NO: 1303129 - protein, 18 aa, Mycobacterium
RRAHPFTIADLAAAVLVI

SEQ ID NO: 1303130 - protein, 20 aa, Mycobacterium
RRAQELMLTNRTLSAGEALD

SEQ ID NO: 1303131 - protein, 22 aa, Mycobacterium
RRARREGKVPAVLYGHGTDPQH

SEQ ID NO: 1303132 - protein, 20 aa, Mycobacterium
RRARSVPVYAAIRSLGRTGV

SEQ ID NO: 1303133 - protein, 22 aa, Mycobacterium
RRASLWHSTFRNCSMLGSVFTE

SEQ ID NO: 1303134 - protein, 25 aa, Mycobacterium
RRATSHWMAVPLLKPFGVTPVGDER

SEQ ID NO: 1303135 - protein, 28 aa, Mycobacterium
RRDLAPLANLELFSVAPLLTAKMYRELG

SEQ ID NO: 1303136 - protein, 27 aa, Mycobacterium
RRDLAYTTIMTVLQRLAKKNLVVQHRD

SEQ ID NO: 1303137 - protein, 35 aa, Mycobacterium
RRDLLLTIGSMSKSFWGGLRIGWIRADPSTLASIA

SEQ ID NO: 1303138 - protein, 17 aa, Mycobacterium
RREEFRASRIMLDRARA

SEQ ID NO: 1303139 - protein, 24 aa, Mycobacterium
RREFDILAFERQWWKYAGSKEDAI

SEQ ID NO: 1303140 - protein, 26 aa, Mycobacterium
RREKTTLKWRFPYGFLDQGQSTPIRM

SEQ ID NO: 1303141 - protein, 18 aa, Mycobacterium
RRELLKRNNLDGTLQEIK

SEQ ID NO: 1303142 - protein, 25 aa, Mycobacterium
RRFDNPWLFDVTRDPNPQIGFGAGG

SEQ ID NO: 1303143 - protein, 23 aa, Mycobacterium
RRGLPMHYVPRRKTLLDKAGSLV

SEQ ID NO: 1303144 - protein, 24 aa, Mycobacterium
RRGLTIDLGFAWADIGGREMAFVD

SEQ ID NO: 1303145 - protein, 25 aa, Mycobacterium
RRGNWSLDLGYFLQGALTIEDRRRS

SEQ ID NO: 1303146 - protein, 29 aa, Mycobacterium
RRGRVQRVLLPTLLDWLSDTPDPDAGLLS

SEQ ID NO: 1303147 - protein, 20 aa, Mycobacterium
RRGVDCFVVDPLPDPPQYAK

SEQ ID NO: 1303148 - protein, 23 aa, Mycobacterium
RRGVPVLGICRGAQILNVALGGT

SEQ ID NO: 1303149 - protein, 18 aa, Mycobacterium
RRHELLSGLVPQISIILG

SEQ ID NO: 1303150 - protein, 20 aa, Mycobacterium
RRISMIRSIYPGQTATLSGK

SEQ ID NO: 1303151 - protein, 24 aa, Mycobacterium
RRLALRYLDGRDALFAGRIADRRI

SEQ ID NO: 1303152 - protein, 27 aa, Mycobacterium
RRLAQLAVPLMPAGARIVFVTSHQAHF

SEQ ID NO: 1303153 - protein, 19 aa, Mycobacterium
RRLDRERPLWECWIVEGLP

SEQ ID NO: 1303154 - protein, 25 aa, Mycobacterium
RRLGLERQWLHARSLAFAHPADGRR

SEQ ID NO: 1303155 - protein, 34 aa, Mycobacterium
RRLRPDLATGLMPLRWGTGYMLGSKRFGPFGRNA

SEQ ID NO: 1303156 - protein, 22 aa, Mycobacterium
RRLRRTTWNSGCSSWYLTEDGY

SEQ ID NO: 1303157 - protein, 31 aa, Mycobacterium
RRLTTFFESYDLLLTPTLATPPPRIGEFDLP

SEQ ID NO: 1303158 - protein, 20 aa, Mycobacterium
RRLVFLTRMRLSGMAIRDLQ

SEQ ID NO: 1303159 - protein, 32 aa, Mycobacterium
RRMCREEFLHYLRIREWQDLTGQLRSIARDLG

SEQ ID NO: 1303160 - protein, 21 aa, Mycobacterium
RRMRMVYSLAFSLPGTPVLYY

SEQ ID NO: 1303161 - protein, 17 aa, Mycobacterium
RRPSLVPVEAIGLLAGD

SEQ ID NO: 1303162 - protein, 21 aa, Mycobacterium
RRPWLVWVHGAGQGQPLDLMF

SEQ ID NO: 1303163 - protein, 23 aa, Mycobacterium
RRQSFFGVMMAIVSSMLVARTER

SEQ ID NO: 1303164 - protein, 25 aa, Mycobacterium
RRQYDPLMSPLVWDLAHIGQQEEFW

SEQ ID NO: 1303165 - protein, 30 aa, Mycobacterium
RRRERIYCPGWVGLIRWAKPILTTRIGQAS

SEQ ID NO: 1303166 - protein, 26 aa, Mycobacterium
RRRKPYRWLRQILPEPRYPTGYLNEF

SEQ ID NO: 1303167 - protein, 19 aa, Mycobacterium
RRRSPVFDPVLHVADVSFD

SEQ ID NO: 1303168 - protein, 20 aa, Mycobacterium
RRRVKGLRREEVALLAGVSV

SEQ ID NO: 1303169 - protein, 18 aa, Mycobacterium
RRSARPRAKPPVRKLAAE

SEQ ID NO: 1303170 - protein, 25 aa, Mycobacterium
RRTMARVFPNLFATHRVRAVDDYAS

SEQ ID NO: 1303171 - protein, 30 aa, Mycobacterium
RRTPRLTGTITMRYLRTTRLGRLHAEAQIA

SEQ ID NO: 1303172 - protein, 25 aa, Mycobacterium
RRTRSHLVLRWMVDGYARGIGAGPA

SEQ ID NO: 1303173 - protein, 31 aa, Mycobacterium; identical to SEQ ID NO: 857271

SEQ ID NO: 1303174 - protein, 23 aa, Mycobacterium
RRVWEALLTIPYGETRSYGDIAR

SEQ ID NO: 1303175 - protein, 23 aa, Mycobacterium
RRWSMADAFLHPVSHRPNLTVYT

SEQ ID NO: 1303176 - protein, 27 aa, Mycobacterium
RRYEGVLDHIVLYSPSIGLAPERIAEN

SEQ ID NO: 1303177 - protein, 24 aa, Mycobacterium
RRYRLTVDLPRDFALNQPLSTFAL

SEQ ID NO: 1303178 - protein, 23 aa, Mycobacterium
RSAAYAMRWVAKNVVAAGLADRV

SEQ ID NO: 1303179 - protein, 24 aa, Mycobacterium
RSADLFLGVPFNIASYALLTHMMA

SEQ ID NO: 1303180 - protein, 18 aa, Mycobacterium
RSAHRSRPTIYRPPARPD

SEQ ID NO: 1303181 - protein, 27 aa, Mycobacterium
RSAKGMAFAVPLWFVVYDGCLHAATSA

SEQ ID NO: 1303182 - protein, 20 aa, Mycobacterium
RSALIATRLADRLGLTRAQR

SEQ ID NO: 1303183 - protein, 18 aa, Mycobacterium
RSARLYRAAADAGATALS

SEQ ID NO: 1303184 - protein, 20 aa, Mycobacterium
RSCMPYMAQLFVAAPEVDGA

SEQ ID NO: 1303185 - protein, 17 aa, Mycobacterium
RSDATVFAAAPSGWRNL

SEQ ID NO: 1303186 - protein, 30 aa, Mycobacterium
RSDESLDLRWWPLDALPPDTDFGLAQLAAE

SEQ ID NO: 1303187 - protein, 18 aa, Mycobacterium
RSDGLRLLYPGHEHAVIG

SEQ ID NO: 1303188 - protein, 18 aa, Mycobacterium
RSDIPFRCPEHRLNAALT

SEQ ID NO: 1303189 - protein, 23 aa, Mycobacterium
RSEFDWLGTVLQAYLRRTQADCA

SEQ ID NO: 1303190 - protein, 28 aa, Mycobacterium
RSEMEMKVLLWAVQRLIGGLSSIGAERD

SEQ ID NO: 1303191 - protein, 26 aa, Mycobacterium
RSFDGAHIFVRYQSDRQLYAVSVDRR

SEQ ID NO: 1303192 - protein, 20 aa, Mycobacterium
RSFSDFPTILDSISGRLGTL

SEQ ID NO: 1303193 - protein, 25 aa, Mycobacterium
RSGDFLFAALHRAGLANQSLCVDAA

SEQ ID NO: 1303194 - protein, 29 aa, Mycobacterium
RSGFVVNALLVPYLLSAIRMVEAGFATVE

SEQ ID NO: 1303195 - protein, 23 aa, Mycobacterium
RSGKIMRRLLRDVAEGRELGDTS

SEQ ID NO: 1303196 - protein, 25 aa, Mycobacterium
RSHDDPRFPLLAIGIREMRSQNSWM

SEQ ID NO: 1303197 - protein, 19 aa, Mycobacterium
RSHDLIRGVPFTVNVLGAE

SEQ ID NO: 1303198 - protein, 29 aa, Mycobacterium
RSITSGVLPPQLLFAHPGYLRAARGIEIP

SEQ ID NO: 1303199 - protein, 17 aa, Mycobacterium
RSLAADGIINAGALIAF

SEQ ID NO: 1303200 - protein, 17 aa, Mycobacterium
RSLEWYLLPDDERRRML

SEQ ID NO: 1303201 - protein, 17 aa, Mycobacterium
RSLRFYRDGLGLAIARE

SEQ ID NO: 1303202 - protein, 22 aa, Mycobacterium
RSLRRGGRFVTVGFASGVIPRI

SEQ ID NO: 1303203 - protein, 26 aa, Mycobacterium
RSLTKTWALAGLRVGYALGAPDVLRR

SEQ ID NO: 1303204 - protein, 23 aa, Mycobacterium
RSLTVRYRRPTPVLTELAFDVAR

SEQ ID NO: 1303205 - protein, 22 aa, Mycobacterium
RSLVTMGILIALRATDEFKAHV

SEQ ID NO: 1303206 - protein, 30 aa, Mycobacterium
RSPVVARGWRTPLRLLFIDGGHTEEAAQRD

SEQ ID NO: 1303207 - protein, 17 aa, Mycobacterium
RSQFGRPIGSFQAVKHA

SEQ ID NO: 1303208 - protein, 17 aa, Mycobacterium
RSQGYFFSSTGGSPLSC

SEQ ID NO: 1303209 - protein, 24 aa, Mycobacterium
RSREPVKHVLVWVSTLGSTDGRNQ

SEQ ID NO: 1303210 - protein, 20 aa, Mycobacterium
RSRPTIYRPPARPDVIAALD

SEQ ID NO: 1303211 - protein, 26 aa, Mycobacterium
RSRRALAEFKVEGLATVIPFHRAVVS

SEQ ID NO: 1303212 - protein, 18 aa, Mycobacterium
RSRRFPLDDYEYSPRIVV

SEQ ID NO: 1303213 - protein, 20 aa, Mycobacterium
RSSAPHVWAIGDVASWLDTI

SEQ ID NO: 1303214 - protein, 25 aa, Mycobacterium
RSSGNLLYLLLTHPDQFAAVQADRG

SEQ ID NO: 1303215 - protein, 18 aa, Mycobacterium
RSSHTWFVLQELLGHKNV

SEQ ID NO: 1303216 - protein, 21 aa, Mycobacterium
RSTWVVFMTDHGPALPRAKST

SEQ ID NO: 1303217 - protein, 20 aa, Mycobacterium
RSVEFSWRQSASAMREVFDA

SEQ ID NO: 1303218 - protein, 18 aa, Mycobacterium
RSVLQWDKDDCAAIGLVK

SEQ ID NO: 1303219 - protein, 18 aa, Mycobacterium
RSWFAYRVDGPSVVNNIP

SEQ ID NO: 1303220 - protein, 17 aa, Mycobacterium
RSWMTTHPEATLADVCF

SEQ ID NO: 1303221 - protein, 25 aa, Mycobacterium
RSYYTAPIKALVSEKFFALCGVFGA

SEQ ID NO: 1303222 - protein, 24 aa, Mycobacterium
RTAEQVFIPLTVGGGVRAVADVDA

SEQ ID NO: 1303223 - protein, 18 aa, Mycobacterium
RTAFQHCRRLLPGDPIAP

SEQ ID NO: 1303224 - protein, 25 aa, Mycobacterium
RTAGALNLFSFRPRVWDSEAETTGT

SEQ ID NO: 1303225 - protein, 19 aa, Mycobacterium
RTAGFLAIGLAVADRAPVC

SEQ ID NO: 1303226 - protein, 17 aa, Mycobacterium
RTAPRLADTVRLHKNPD

SEQ ID NO: 1303227 - protein, 24 aa, Mycobacterium
RTDIRVYLLVEDLQRQFAAYLGTP

SEQ ID NO: 1303228 - protein, 17 aa, Mycobacterium
RTDLYLRGDTRVRVIWR

SEQ ID NO: 1303229 - protein, 27 aa, Mycobacterium
RTDSPFPGLTTHAYLWTGGPTGNVLFY

SEQ ID NO: 1303230 - protein, 17 aa, Mycobacterium
RTEFALLEMLIANPRRV

SEQ ID NO: 1303231 - protein, 23 aa, Mycobacterium
RTELGTYVFFLDCVGHLEDDAVA

SEQ ID NO: 1303232 - protein, 18 aa, Mycobacterium
RTEVVACRPWLLAELDAV

SEQ ID NO: 1303233 - protein, 24 aa, Mycobacterium
RTEYAVINVGDLGRLFPNGGDIGV

SEQ ID NO: 1303234 - protein, 26 aa, Mycobacterium
RTFDGIPALLADLRAAGIRLAVATSK

SEQ ID NO: 1303235 - protein, 25 aa, Mycobacterium
RTGDPWFPQTPPLDPVLRQAVVGLS

SEQ ID NO: 1303236 - protein, 21 aa, Mycobacterium
RTGEPYVPFDAGADYQRFVDG

SEQ ID NO: 1303237 - protein, 23 aa, Mycobacterium
RTGLPWPDLNGTGAVSLLQTLRT

SEQ ID NO: 1303238 - protein, 29 aa, Mycobacterium
RTGLRLLTMLRPELADWTALVLPDNRTGG

SEQ ID NO: 1303239 - protein, 24 aa, Mycobacterium
RTGTRPWVMAPMIATAGEAKDFAA

SEQ ID NO: 1303240 - protein, 24 aa, Mycobacterium
RTGYTWLDIPQEPDFTRLRSEVGA

SEQ ID NO: 1303241 - protein, 25 aa, Mycobacterium
RTHGRTWDLLRLTRMPTVQVDVGYI

SEQ ID NO: 1303242 - protein, 25 aa, Mycobacterium
RTHPDGVLWGHGWDESGWPERTAPT

SEQ ID NO: 1303243 - protein, 27 aa, Mycobacterium
RTIYLSTLFFHGFIDRGLNEWAGPDAL

SEQ ID NO: 1303244 - protein, 25 aa, Mycobacterium
RTKRLFARVPLLQRTVRLITDTIYE

SEQ ID NO: 1303245 - protein, 28 aa, Mycobacterium
RTKVRFELTVDPTVPLPGFVVKKGAKGL

SEQ ID NO: 1303246 - protein, 17 aa, Mycobacterium
RTLAPPTARGWEVVAGD

SEQ ID NO: 1303247 - protein, 24 aa, Mycobacterium
RTLDVPALAGVRVDSGFRAGSVIS

SEQ ID NO: 1303248 - protein, 19 aa, Mycobacterium
RTLLALYDDALPTVYGYFV

SEQ ID NO: 1303249 - protein, 30 aa, Mycobacterium
RTLLDTHPFAWLPMLSRVLASARLLPDAVD

SEQ ID NO: 1303250 - protein, 23 aa, Mycobacterium
RTLNSLRMVAAPILARIGSPALA

SEQ ID NO: 1303251 - protein, 23 aa, Mycobacterium
RTLVGPLTWAVELDERWVVIGPN

SEQ ID NO: 1303252 - protein, 27 aa, Mycobacterium
RTMTLNYYSPLRLIRGLAPGMIARGEG

SEQ ID NO: 1303253 - protein, 25 aa, Mycobacterium
RTNLTMALTAKVMPYKHGFGPFAPE

SEQ ID NO: 1303254 - protein, 19 aa, Mycobacterium
RTNRGLPSRVLLAGHIDTV

SEQ ID NO: 1303255 - protein, 20 aa, Mycobacterium
RTPEDWLFKACVGDDFVIDV

SEQ ID NO: 1303256 - protein, 29 aa, Mycobacterium
RTPGYDGVLGRLWLSRGGTYVLANIRGGG

SEQ ID NO: 1303257 - protein, 18 aa, Mycobacterium
RTPLPDWWADLDADAVTA

SEQ ID NO: 1303258 - protein, 17 aa, Mycobacterium
RTPLPRPDLRQRAVPLG

SEQ ID NO: 1303259 - protein, 18 aa, Mycobacterium
RTQVLRRLRAHLAPAGRA

SEQ ID NO: 1303260 - protein, 26 aa, Mycobacterium
RTRIHEVALILWGQAPSSLDPLFAPE

SEQ ID NO: 1303261 - protein, 19 aa, Mycobacterium
RTRQAWIEATRDIATELLG

SEQ ID NO: 1303262 - protein, 19 aa, Mycobacterium
RTRVAALLADLPEPDHAGD

SEQ ID NO: 1303263 - protein, 18 aa, Mycobacterium
RTSWRNPPSTLHLANAVS

SEQ ID NO: 1303264 - protein, 24 aa, Mycobacterium
RTTGPWEPWLHALPVEFETEQQVF

SEQ ID NO: 1303265 - protein, 17 aa, Mycobacterium
RTTLAPKAFGAYHLDHL

SEQ ID NO: 1303266 - protein, 25 aa, Mycobacterium
RTTPEPLLSGFLPLQSQYAQLMFLT

SEQ ID NO: 1303267 - protein, 19 aa, Mycobacterium
RTTPLRDVNAALHAGDLAG

SEQ ID NO: 1303268 - protein, 25 aa, Mycobacterium
RTVDEIHADLFWHGPGRLTVGDCLP

SEQ ID NO: 1303269 - protein, 21 aa, Mycobacterium
RTVDTPVGTLLLAATPAGLVR

SEQ ID NO: 1303270 - protein, 19 aa, Mycobacterium
RTVGPLRPIDVLGDQLKPG

SEQ ID NO: 1303271 - protein, 31 aa, Mycobacterium
RTVHQLLLSDDFFDEIFRELGIPYEPVRWRT

SEQ ID NO: 1303272 - protein, 30 aa, Mycobacterium
RTVQRVFRRYVGVPVKWVLCRYRLQQAALE

SEQ ID NO: 1303273 - protein, 20 aa, Mycobacterium
RTVRMFGIQKAFMEVLSQGT

SEQ ID NO: 1303274 - protein, 28 aa, Mycobacterium
RTVRPPGRIALLAFVSREPLLTKQPEGN

SEQ ID NO: 1303275 - protein, 27 aa, Mycobacterium
RTVRQFNDLLRVLPPIPQTDSVQAVAR

SEQ ID NO: 1303276 - protein, 25 aa, Mycobacterium
RTVVPVRVFWVPAGLPTRSKVVALI

SEQ ID NO: 1303277 - protein, 19 aa, Mycobacterium
RTWHGTVLAAVAFVDADPP

SEQ ID NO: 1303278 - protein, 20 aa, Mycobacterium
RTWLTDPADLPPLLRGDRAT

SEQ ID NO: 1303279 - protein, 42 aa, Mycobacterium
RVADKLLIVDLPRPPAPLHVVRLLAMLPLAPLVPFAHDGVIS

SEQ ID NO: 1303280 - protein, 32 aa, Mycobacterium
RVADVHLDVPLYWQCWKLDSPLVARLTGAVRS

SEQ ID NO: 1303281 - protein, 28 aa, Mycobacterium
RVAEARLAVGWWLVGSARAMLRLACTHA

SEQ ID NO: 1303282 - protein, 29 aa, Mycobacterium
RVAILAPQGLDWVTGFFAAIKAGTIAVPL

SEQ ID NO: 1303283 - protein, 19 aa, Mycobacterium
RVALYAYYSQGRTAVTMVP

SEQ ID NO: 1303284 - protein, 24 aa, Mycobacterium
RVARMGFDVVYLPPIHPIGKVHRK

SEQ ID NO: 1303285 - protein, 18 aa, Mycobacterium
RVDADRFVLFPTVAHSHA

SEQ ID NO: 1303286 - protein, 23 aa, Mycobacterium
RVDALRFLTQNLGQAFDLALETA

SEQ ID NO: 1303287 - protein, 17 aa, Mycobacterium
RVDGVAHYLTSVGLGCH

SEQ ID NO: 1303288 - protein, 25 aa, Mycobacterium
RVDPIDDDLFGGPLALPCDAQRAGA

SEQ ID NO: 1303289 - protein, 17 aa, Mycobacterium
RVEIAFMFAHPLGGLIE

SEQ ID NO: 1303290 - protein, 18 aa, Mycobacterium
RVELLHRLGDALTAEAFG

SEQ ID NO: 1303291 - protein, 24 aa, Mycobacterium
RVFDTLLDEQAILGLALGAGVSGL

SEQ ID NO: 1303292 - protein, 17 aa, Mycobacterium
RVFLDYCIDLHLAGQLD

SEQ ID NO: 1303293 - protein, 19 aa, Mycobacterium
RVFPLPDAVSFEAGAGLLF

SEQ ID NO: 1303294 - protein, 20 aa, Mycobacterium
RVGVADFRRSLERVMPRDAD

SEQ ID NO: 1303295 - protein, 19 aa, Mycobacterium
RVHGPLALAVGRRLRERYG

SEQ ID NO: 1303296 - protein, 28 aa, Mycobacterium
RVHKVSERLPLPAPLRRIHDPSINISRR

SEQ ID NO: 1303297 - protein, 31 aa, Mycobacterium
RVHRVPSRMFPKVTSLPLGVPRPRMVGVLRG

SEQ ID NO: 1303298 - protein, 19 aa, Mycobacterium
RVHTPVGLPIGARTAAEIA

SEQ ID NO: 1303299 - protein, 19 aa, Mycobacterium
RVIAPLARASLENALQRGQ

SEQ ID NO: 1303300 - protein, 17 aa, Mycobacterium
RVIARLLGLPEEDLPMF

SEQ ID NO: 1303301 - protein, 17 aa, Mycobacterium
RVIFPAGFAERIGPRAV

SEQ ID NO: 1303302 - protein, 30 aa, Mycobacterium
RVINGKSWLLFGPFAGWSPKFLKQGKVTDL

SEQ ID NO: 1303303 - protein, 17 aa, Mycobacterium
RVITRLRHEYPTTGIEL

SEQ ID NO: 1303304 - protein, 20 aa, Mycobacterium
RVKATLPRLGELAIGGTAVG

SEQ ID NO: 1303305 - protein, 18 aa, Mycobacterium
RVKDLPGVRYKIIRGSLD

SEQ ID NO: 1303306 - protein, 17 aa, Mycobacterium
RVLAPEGRLLVIGFAAG

SEQ ID NO: 1303307 - protein, 25 aa, Mycobacterium
RVLEVAQFTFVPAAGAILADWGADV

SEQ ID NO: 1303308 - protein, 32 aa, Mycobacterium
RVLFLISPERIHTWVFALLRAVTTPDLLRRAL

SEQ ID NO: 1303309 - protein, 20 aa, Mycobacterium
RVLPAVLQIKAVAAAADRFP

SEQ ID NO: 1303310 - protein, 17 aa, Mycobacterium
RVLRDRLFETLAAVEPE

SEQ ID NO: 1303311 - protein, 17 aa, Mycobacterium
RVLYDDHIGKVSLIGAG

SEQ ID NO: 1303312 - protein, 20 aa, Mycobacterium
RVNIGMLPEETFGPGDWVII

SEQ ID NO: 1303313 - protein, 25 aa, Mycobacterium
RVNRLFVNNLISAAILLAEWQVRRT

SEQ ID NO: 1303314 - protein, 22 aa, Mycobacterium
RVPTRVEAWPRRDDVARRAAVC

SEQ ID NO: 1303315 - protein, 26 aa, Mycobacterium
RVQHRSGVLWTLNSAGLTRLGLSGHP

SEQ ID NO: 1303316 - protein, 19 aa, Mycobacterium
RVQMGIGGGWYEHEWRAYG

SEQ ID NO: 1303317 - protein, 17 aa, Mycobacterium
RVQQFAETELRALLLDD

SEQ ID NO: 1303318 - protein, 23 aa, Mycobacterium
RVRELPVLFYTRTPEYTRGATGV

SEQ ID NO: 1303319 - protein, 21 aa, Mycobacterium
RVRFLRNVMGTWLLSETVRQY

SEQ ID NO: 1303320 - protein, 17 aa, Mycobacterium
RVRLANEALRRGAVTIA

SEQ ID NO: 1303321 - protein, 29 aa, Mycobacterium
RVRLDTRFLGKPLSAPVLIGAMTGGAELS

SEQ ID NO: 1303322 - protein, 17 aa, Mycobacterium
RVRLLVGPDAEGAPVLE

SEQ ID NO: 1303323 - protein, 18 aa, Mycobacterium
RVRQQVIQLLSGYQGKES

SEQ ID NO: 1303324 - protein, 18 aa, Mycobacterium
RVRTAMPGVAWPDQWSRA

SEQ ID NO: 1303325 - protein, 19 aa, Mycobacterium
RVRTRLARLSGAGLVPGIG

SEQ ID NO: 1303326 - protein, 17 aa, Mycobacterium
RVSADLLAGYYSAVHKM

SEQ ID NO: 1303327 - protein, 25 aa, Mycobacterium
RVSESLRYVAAWNSAFLPSKDLGEA

SEQ ID NO: 1303328 - protein, 30 aa, Mycobacterium
RVSTNLFVPQEITPWPRGEQPRRAAVSSYG

SEQ ID NO: 1303329 - protein, 21 aa, Mycobacterium
RVTPFAYMEPVKVAGSTVGLA

SEQ ID NO: 1303330 - protein, 19 aa, Mycobacterium
RVTPRRTVAWDYGALRDDP

SEQ ID NO: 1303331 - protein, 18 aa, Mycobacterium
RVTPRYRRGARSRLVAAV

SEQ ID NO: 1303332 - protein, 24 aa, Mycobacterium
RVVDKLLHAPTVRVKQLASAPGGD

SEQ ID NO: 1303333 - protein, 25 aa, Mycobacterium
RVVIALGGFAWKAALHMLRRGGASV

SEQ ID NO: 1303334 - protein, 18 aa, Mycobacterium
RVVMLLGGLRELTAITVE

SEQ ID NO: 1303335 - protein, 20 aa, Mycobacterium
RVVPAWQIDRGFDAGAADLR

SEQ ID NO: 1303336 - protein, 17 aa, Mycobacterium
RVYLQHAFDVGAYNPCF

SEQ ID NO: 1303337 - protein, 18 aa, Mycobacterium
RWAAGLARGGLRQGPQGW

SEQ ID NO: 1303338 - protein, 20 aa, Mycobacterium
RWKAETSWAQRVSLAHALIG

SEQ ID NO: 1303339 - protein, 22 aa, Mycobacterium
RWQHLPVPFEVYADGIDLVVFE

SEQ ID NO: 1303340 - protein, 19 aa, Mycobacterium
RWRHFAFQVLGFAEGSGPD

SEQ ID NO: 1303341 - protein, 20 aa, Mycobacterium
RWRNLPTPSGDTFEWADDST

SEQ ID NO: 1303342 - protein, 17 aa, Mycobacterium
RWRQRLGGDAWKGRTPN

SEQ ID NO: 1303343 - protein, 27 aa, Mycobacterium
RWSTSRHFLLNLPMFGREPFHPDVDKL

SEQ ID NO: 1303344 - protein, 18 aa, Mycobacterium
RWVAQAFTDALGARAGEL

SEQ ID NO: 1303345 - protein, 17 aa, Mycobacterium
RYAGTLDGLAGLIADIE

SEQ ID NO: 1303346 - protein, 24 aa, Mycobacterium
RYDDHLLPKVMSFAVEDVFVSAIF

SEQ ID NO: 1303347 - protein, 23 aa, Mycobacterium
RYDSMPYRRVGDSGLLLPAISLG

SEQ ID NO: 1303348 - protein, 20 aa, Mycobacterium
RYGMRLARSTAVLESIVLDD

SEQ ID NO: 1303349 - protein, 23 aa, Mycobacterium
RYGYIPKHLNFTRLTPHAGPCAS

SEQ ID NO: 1303350 - protein, 29 aa, Mycobacterium
RYHSIWLPDHMVSFWPDSIWTPEFTDLAD

SEQ ID NO: 1303351 - protein, 24 aa, Mycobacterium
RYKAFFDLCHRIMPADGRMVLQTI

SEQ ID NO: 1303352 - protein, 19 aa, Mycobacterium
RYKCGDACWKPVPNTSDNE

SEQ ID NO: 1303353 - protein, 25 aa, Mycobacterium
RYKGLPAEWWGATPAQICGDSPELF

SEQ ID NO: 1303354 - protein, 33 aa, Mycobacterium; identical to SEQ ID NO: 859102

SEQ ID NO: 1303355 - protein, 17 aa, Mycobacterium
RYLGSWPTGTAAGAPPP

SEQ ID NO: 1303356 - protein, 18 aa, Mycobacterium
RYLRDAPARIVLAALPDD

SEQ ID NO: 1303357 - protein, 21 aa, Mycobacterium
RYLTGPLARYSLSSAALSPTA

SEQ ID NO: 1303358 - protein, 19 aa, Mycobacterium
RYPEFLPESLRHLIADHVA

SEQ ID NO: 1303359 - protein, 22 aa, Mycobacterium
RYPGGMALRFARVLRYRDDKSP

SEQ ID NO: 1303360 - protein, 26 aa, Mycobacterium
RYQRFAAFWRSRPVNWVWDRLPMSVR

SEQ ID NO: 1303361 - protein, 36 aa, Mycobacterium
RYQSGWKRSLIAMRSQRYFRLLDALDGLVAAEPPGT

SEQ ID NO: 1303362 - protein, 25 aa, Mycobacterium
RYRAGDWVYIPKACTFRQIPDTEST

SEQ ID NO: 1303363 - protein, 24 aa, Mycobacterium
RYRDDYGTWPRSVGLSVWGTSAMR

SEQ ID NO: 1303364 - protein, 19 aa, Mycobacterium
RYRLPYNALTQTSLSRVRL

SEQ ID NO: 1303365 - protein, 24 aa, Mycobacterium
RYRRTGEFLRIVRGIWSEPDFSFH

SEQ ID NO: 1303366 - protein, 25 aa, Mycobacterium
RYSQAGLFPIAYTKGTDFKKAKRLP

SEQ ID NO: 1303367 - protein, 18 aa, Mycobacterium
RYVDLVCSWGPMILGHAH

SEQ ID NO: 1303368 - protein, 19 aa, Mycobacterium
RYVDTLRAWLAAQGDLHEA

SEQ ID NO: 1303369 - protein, 20 aa, Mycobacterium
RYVMGFGDTPEKALSGPMQK

SEQ ID NO: 1303370 - protein, 17 aa, Mycobacterium
RYWREAFRLPTMDHRKL

SEQ ID NO: 1303371 - protein, 25 aa, Mycobacterium
SAAAPFNAFLIAQGLETLSLRVERH

SEQ ID NO: 1303372 - protein, 22 aa, Mycobacterium
SAAAPLAYRAAGANVLTINADP

SEQ ID NO: 1303373 - protein, 20 aa, Mycobacterium
SAADALRWGLINDVVPDGTV

SEQ ID NO: 1303374 - protein, 25 aa, Mycobacterium
SAAETYLDIHRIIAAASLTGADAVH

SEQ ID NO: 1303375 - protein, 20 aa, Mycobacterium
SAAFRDLLAEWKAAGRAAKD

SEQ ID NO: 1303376 - protein, 24 aa, Mycobacterium
SAAKMFNVTGWKIGWACGAADLIA

SEQ ID NO: 1303377 - protein, 24 aa, Mycobacterium
SAARALIAVRGLHRFATAEGLTDV

SEQ ID NO: 1303378 - protein, 25 aa, Mycobacterium
SACGPVPFVGLFDAAAQVVSLGGRR

SEQ ID NO: 1303379 - protein, 26 aa, Mycobacterium
SACNPYLTFAVLLAAGLRGVEKGYVL

SEQ ID NO: 1303380 - protein, 23 aa, Mycobacterium
SADFFTELFGLPAAREFGPFLAV

SEQ ID NO: 1303381 - protein, 21 aa, Mycobacterium
SADFLQLWERLRTTVIFVTHD

SEQ ID NO: 1303382 - protein, 25 aa, Mycobacterium
SADGPALDLVPFSGPAKKVLELTFR

SEQ ID NO: 1303383 - protein, 24 aa, Mycobacterium
SAECGAALVLPLRAADTVAGVLVA

SEQ ID NO: 1303384 - protein, 23 aa, Mycobacterium
SAEIVLIPYFVHRELGVRVRGLA

SEQ ID NO: 1303385 - protein, 29 aa, Mycobacterium
SAETLFDALLPRYVSTRIFAAMLEAAASE

SEQ ID NO: 1303386 - protein, 26 aa, Mycobacterium
SAEWELLTSALAPWTDRYPGVQVATL

SEQ ID NO: 1303387 - protein, 22 aa, Mycobacterium
SAFDLLLGARRAVLGNPAAARA

SEQ ID NO: 1303388 - protein, 27 aa, Mycobacterium
SAFGPTGPWAQRLGYGPLVRAAAGFTK

SEQ ID NO: 1303389 - protein, 19 aa, Mycobacterium
SAGAVVRNALLWNDTRSAG

SEQ ID NO: 1303390 - protein, 17 aa, Mycobacterium
SAGIQWAQKAGAGIDPA

SEQ ID NO: 1303391 - protein, 23 aa, Mycobacterium
SAGSPAPVLLHGLDESCWPLLKH

SEQ ID NO: 1303392 - protein, 24 aa, Mycobacterium
SAHRDWLLIELRSDWDGYRAGSLL

SEQ ID NO: 1303393 - protein, 25 aa, Mycobacterium
SAIELMRMRLTPAAFQRGASMAATF

SEQ ID NO: 1303394 - protein, 25 aa, Mycobacterium
SAITRTLMRDLVPPQLRRLHGFELA

SEQ ID NO: 1303395 - protein, 25 aa, Mycobacterium
SAKFSRKIVELNLLGALSVSTHANA

SEQ ID NO: 1303396 - protein, 22 aa, Mycobacterium
SAKIIGYSPIIAGKPLRGMADE

SEQ ID NO: 1303397 - protein, 22 aa, Mycobacterium
SAKLNFAVGPFASMIDRARDVI

SEQ ID NO: 1303398 - protein, 24 aa, Mycobacterium
SALEPGREYLIKHTTRVTRARVAS

SEQ ID NO: 1303399 - protein, 27 aa, Mycobacterium
SALNNGYSLLELLLESANINSLHRVSQ

SEQ ID NO: 1303400 - protein, 21 aa, Mycobacterium
SALRLAPRFVDPSTLNPPGSL

SEQ ID NO: 1303401 - protein, 19 aa, Mycobacterium
SALRQACYLPQDGSRPSLA

SEQ ID NO: 1303402 - protein, 19 aa, Mycobacterium
SALYLAGEGAFPADRVKIL

SEQ ID NO: 1303403 - protein, 25 aa, Mycobacterium
SAMARLYDFVFAEVWQRPVLSRRDR

SEQ ID NO: 1303404 - protein, 18 aa, Mycobacterium
SANQFFYGLRHGDEHRVV

SEQ ID NO: 1303405 - protein, 23 aa, Mycobacterium
SAPQPDVFPLERAAEAIAALENR

SEQ ID NO: 1303406 - protein, 26 aa, Mycobacterium
SAPRSLVDFYIAYRAVVRAKVDCIKV

SEQ ID NO: 1303407 - protein, 21 aa, Mycobacterium
SAPVRLRALEKVAGRPTTARR

SEQ ID NO: 1303408 - protein, 23 aa, Mycobacterium
SARARDVFAIKLDPGLIDELPLP

SEQ ID NO: 1303409 - protein, 19 aa, Mycobacterium
SARPGVVLSRRQLLDIVRE

SEQ ID NO: 1303410 - protein, 23 aa, Mycobacterium
SARRAYDVHPLITALLDDGVPFE

SEQ ID NO: 1303411 - protein, 24 aa, Mycobacterium
SASGRTITFAGFLKAYVESIDELA

SEQ ID NO: 1303412 - protein, 26 aa, Mycobacterium
SASRAMIWRRPRWAVRLQPEPVGGLL

SEQ ID NO: 1303413 - protein, 19 aa, Mycobacterium
SATFLRERFAREMVTALIR

SEQ ID NO: 1303414 - protein, 28 aa, Mycobacterium
SATRYEWPIIDFAILAVGALTVPIYETS

SEQ ID NO: 1303415 - protein, 29 aa, Mycobacterium
SATTAWLIERLQRPTLLMAPNKTLAAQLA

SEQ ID NO: 1303416 - protein, 20 aa, Mycobacterium
SAVAWLTPLVPLIDNEPTTA

SEQ ID NO: 1303417 - protein, 26 aa, Mycobacterium
SAVGQLLLAHFVLNAAIGGLGDTEPA

SEQ ID NO: 1303418 - protein, 24 aa, Mycobacterium
SAVKTFTAWAVRRGLMASDPATRL

SEQ ID NO: 1303419 - protein, 37 aa, Mycobacterium
SAVLMSPMAFLQRPARWIQQIAINPGSFTAAPNFAFE

SEQ ID NO: 1303420 - protein, 20 aa, Mycobacterium
SAVNVRRPLARLGMGLHRRH

SEQ ID NO: 1303421 - protein, 22 aa, Mycobacterium
SAVRWAIDLGLVPAADHLDTVA

SEQ ID NO: 1303422 - protein, 17 aa, Mycobacterium
SCDLGMSTLLTLASSAL

SEQ ID NO: 1303423 - protein, 24 aa, Mycobacterium
SCDRLRDRFLLAVLYDTGMRVGEA

SEQ ID NO: 1303424 - protein, 22 aa, Mycobacterium
SCEDPRFSIARLSLLDRGMVFA

SEQ ID NO: 1303425 - protein, 18 aa, Mycobacterium
SCGAEVKALYPLGPIFHG

SEQ ID NO: 1303426 - protein, 19 aa, Mycobacterium
SCIGVMFAPYHQRAADELL

SEQ ID NO: 1303427 - protein, 18 aa, Mycobacterium
SCLLLRRAAFAEIGGFDE

SEQ ID NO: 1303428 - protein, 18 aa, Mycobacterium
SCPGPEAALALVGAARRL

SEQ ID NO: 1303429 - protein, 20 aa, Mycobacterium
SCRRRGMIAPVLAVGDGALG

SEQ ID NO: 1303430 - protein, 19 aa, Mycobacterium
SCVPLLKQLLEAEGVEQSK

SEQ ID NO: 1303431 - protein, 27 aa, Mycobacterium
SCYVHPEIEFFLLKPGPNDGTPPVPAD

SEQ ID NO: 1303432 - protein, 23 aa, Mycobacterium
SDADLATVLTRLMRTERLGVELA

SEQ ID NO: 1303433 - protein, 22 aa, Mycobacterium
SDAQPFDFVFHGGSGSLKSEIE

SEQ ID NO: 1303434 - protein, 24 aa, Mycobacterium
SDDGPQWFRLRSLTVRGVASAAGH

SEQ ID NO: 1303435 - protein, 24 aa, Mycobacterium
SDDNALQLLGWTEATATPQVEIAL

SEQ ID NO: 1303436 - protein, 18 aa, Mycobacterium
SDDSPIPFVNYVPDAEGL

SEQ ID NO: 1303437 - protein, 24 aa, Mycobacterium
SDDWMARFVLGFGSAVRVLEPQEL

SEQ ID NO: 1303438 - protein, 31 aa, Mycobacterium
SDEDFWLKVGIDPVRLMTRSGTFYTLRCYLG

SEQ ID NO: 1303439 - protein, 23 aa, Mycobacterium
SDEQYTYWRIALPHEEAATFDTA

SEQ ID NO: 1303440 - protein, 20 aa, Mycobacterium
SDFGHIAIKPEYSLVELPAD

SEQ ID NO: 1303441 - protein, 20 aa, Mycobacterium
SDFLVALRRGDPDTGAQALS

SEQ ID NO: 1303442 - protein, 25 aa, Mycobacterium
SDGAHIVMIGILPTLMPEHLASNWM

SEQ ID NO: 1303443 - protein, 24 aa, Mycobacterium
SDGKRFMFDYIPDVFKGQYAESED

SEQ ID NO: 1303444 - protein, 28 aa, Mycobacterium
SDGRPLVAPVWFIVEGNQLVFNTDRDTA

SEQ ID NO: 1303445 - protein, 23 aa, Mycobacterium
SDKPAYSIVLPPPNVTGSLHMGH

SEQ ID NO: 1303446 - protein, 29 aa, Mycobacterium
SDLDRSLTFYRDLLGLLPVAELPGSEHWP

SEQ ID NO: 1303447 - protein, 22 aa, Mycobacterium
SDLFLPLRYGQVTVQEKMPRRF

SEQ ID NO: 1303448 - protein, 25 aa, Mycobacterium
SDLFSWVLEYRRQLSVRLSELDLIL

SEQ ID NO: 1303449 - protein, 23 aa, Mycobacterium
SDLPEPWRWITGGELLMTNGLSF

SEQ ID NO: 1303450 - protein, 21 aa, Mycobacterium
SDLSLAAKYLTAGDRKLSVVS

SEQ ID NO: 1303451 - protein, 22 aa, Mycobacterium
SDLSLMVKAGVQWGLFGGAVEN

SEQ ID NO: 1303452 - protein, 20 aa, Mycobacterium
SDMPWPRRLWESGFNHNEPT

SEQ ID NO: 1303453 - protein, 35 aa, Mycobacterium
SDPPTQIWRKTFGDHFFYILYFQEPGVADADLGRD

SEQ ID NO: 1303454 - protein, 23 aa, Mycobacterium
SDPTIYAFPNEEWMTFKPQADEV

SEQ ID NO: 1303455 - protein, 22 aa, Mycobacterium
SDPYGEGWLVDLQLDADDMEAA

SEQ ID NO: 1303456 - protein, 22 aa, Mycobacterium
SDRIPVFVFHPAGGSTVVYEPL

SEQ ID NO: 1303457 - protein, 19 aa, Mycobacterium
SDRTPWYDGPTLLEYLEGV

SEQ ID NO: 1303458 - protein, 30 aa, Mycobacterium
SDTDTDPVLAWLYVVDAWEGGLPSARYLGV

SEQ ID NO: 1303459 - protein, 21 aa, Mycobacterium
SDTPKFFHYVKKDKIAESAVM

SEQ ID NO: 1303460 - protein, 26 aa, Mycobacterium
SDVVRTRIYVTDIARWRDVGAVHAEV

SEQ ID NO: 1303461 - protein, 27 aa, Mycobacterium
SDYKGRKVIVYFYPAASTPGCTKQACD

SEQ ID NO: 1303462 - protein, 17 aa, Mycobacterium
SEAFIQEKFARKPDVAA

SEQ ID NO: 1303463 - protein, 39 aa, Mycobacterium
SEALRGFPPVPSRWLDPAALPEWLVPSTFDGPVGSVLIT

SEQ ID NO: 1303464 - protein, 26 aa, Mycobacterium
SEAVDPLLPEVAWSWLVEALDSKSDQ

SEQ ID NO: 1303465 - protein, 23 aa, Mycobacterium
SEAVPVLGVCRGLQALNVAAGGT

SEQ ID NO: 1303466 - protein, 27 aa, Mycobacterium
SEDGAFWTAFLRSLKSRGLAGVQLVIS

SEQ ID NO: 1303467 - protein, 25 aa, Mycobacterium
SEFVIRRAMSQLGVPYSWGGGNANG

SEQ ID NO: 1303468 - protein, 24 aa, Mycobacterium
SEGDSVILTFLPSCGRCSYCARGM

SEQ ID NO: 1303469 - protein, 24 aa, Mycobacterium
SEGGIPIGAALFSAGGTLLGSGHN

SEQ ID NO: 1303470 - protein, 28 aa, Mycobacterium
SEGWIRFRRASLLDDYLARTLADAGLSP

SEQ ID NO: 1303471 - protein, 23 aa, Mycobacterium
SEHWPAMVFLRSPAPSSNHHDLA

SEQ ID NO: 1303472 - protein, 25 aa, Mycobacterium
SEITPDHLLLGLLVDTESLGVALLT

SEQ ID NO: 1303473 - protein, 18 aa, Mycobacterium
SELSPLNRSLLNEGLREI

SEQ ID NO: 1303474 - protein, 17 aa, Mycobacterium
SENDWFEVSLIPTTREL

SEQ ID NO: 1303475 - protein, 22 aa, Mycobacterium
SEPLTELLHRYAGQVPVTLELL

SEQ ID NO: 1303476 - protein, 29 aa, Mycobacterium
SEPTILGLGMPFFAQSMYMIADGLGVTIE

SEQ ID NO: 1303477 - protein, 18 aa, Mycobacterium
SEPVLYEWTDRETLLYAL

SEQ ID NO: 1303478 - protein, 25 aa, Mycobacterium
SEQHPLDWVSAFVAATRTALADCAR

SEQ ID NO: 1303479 - protein, 25 aa, Mycobacterium
SEQWRAVVDVNLIGTWNTCAAAIPH

SEQ ID NO: 1303480 - protein, 24 aa, Mycobacterium
SERAELIEWLLGRGFTMAEVHEAI

SEQ ID NO: 1303481 - protein, 26 aa, Mycobacterium
SEREWHALPAMIIDCALRADGWDSTL

SEQ ID NO: 1303482 - protein, 22 aa, Mycobacterium
SERKKLVWWDTEKQEWTGYDVP

SEQ ID NO: 1303483 - protein, 23 aa, Mycobacterium
SERRPAVPPVWGTLMLVDPDADI

SEQ ID NO: 1303484 - protein, 18 aa, Mycobacterium
SESAWWIADLMRTRGIDV

SEQ ID NO: 1303485 - protein, 25 aa, Mycobacterium
SETARFCTQFIKLGLGGCDIGVSYT

SEQ ID NO: 1303486 - protein, 23 aa, Mycobacterium
SETEMFDLIHKMRSRIITSPVFT

SEQ ID NO: 1303487 - protein, 22 aa, Mycobacterium
SETLKKVFLELGGKSAAIVLDD

SEQ ID NO: 1303488 - protein, 31 aa, Mycobacterium
SEVEHVLATQTLPLRPFRTMAVNVDGELPPG

SEQ ID NO: 1303489 - protein, 22 aa, Mycobacterium
SEVFRDHFLTCFISDPVGVKNR

SEQ ID NO: 1303490 - protein, 26 aa, Mycobacterium
SEVGLDLFWRNIRTHSLHDPVDYKKL

SEQ ID NO: 1303491 - protein, 25 aa, Mycobacterium
SEVLQTYLDLVLDGLVARLASGDDP

SEQ ID NO: 1303492 - protein, 26 aa, Mycobacterium
SEWSNRYLEILYGNEWELTKSPAGAW

SEQ ID NO: 1303493 - protein, 18 aa, Mycobacterium
SFAAVDFFEARNLPFLVA

SEQ ID NO: 1303494 - protein, 17 aa, Mycobacterium
SFALYDEIPFGFAKEEF

SEQ ID NO: 1303495 - protein, 21 aa, Mycobacterium
SFAPVQEHYYRRPPQIERGWR

SEQ ID NO: 1303496 - protein, 37 aa, Mycobacterium
SFEDWGTREFGRHWYTLFFAGYVRKTWLAEPADLTSD

SEQ ID NO: 1303497 - protein, 20 aa, Mycobacterium
SFGDDPLRMLRAARFASQLG

SEQ ID NO: 1303498 - protein, 18 aa, Mycobacterium
SFGFMGPLLRRSGVIFIR

SEQ ID NO: 1303499 - protein, 22 aa, Mycobacterium
SFHVRRYVPERMVLAVAGNIEH

SEQ ID NO: 1303500 - protein, 18 aa, Mycobacterium
SFILFDAPAVVLATGGIG

SEQ ID NO: 1303501 - protein, 19 aa, Mycobacterium
SFIPSCGRCPSCQAGLRNL

SEQ ID NO: 1303502 - protein, 22 aa, Mycobacterium
SFLAKQLGIPQPETLRRYKPGE

SEQ ID NO: 1303503 - protein, 33 aa, Mycobacterium
SFSTTDVDFYTWTQWIFLQIYNAWFDRDANRAR

SEQ ID NO: 1303504 - protein, 17 aa, Mycobacterium
SFTPIPFVKDGLAIVHC

SEQ ID NO: 1303505 - protein, 19 aa, Mycobacterium
SFVLGSYYIVPSILAVRGA

SEQ ID NO: 1303506 - protein, 25 aa, Mycobacterium
SFVNPHDIVLFPQWVRRSPVKPSPL

SEQ ID NO: 1303507 - protein, 25 aa, Mycobacterium
SGAATAAFDAFADPAPASAVIDTTS

SEQ ID NO: 1303508 - protein, 23 aa, Mycobacterium
SGAGTPFPMPAPPGTANAPAPAP

SEQ ID NO: 1303509 - protein, 22 aa, Mycobacterium
SGALYTWARPPGYTGPPPPLSE

SEQ ID NO: 1303510 - protein, 20 aa, Mycobacterium
SGANNLLFRRNSVSGAVEVV

SEQ ID NO: 1303511 - protein, 23 aa, Mycobacterium
SGAPVEFLVQGTLYPDVVESGGG

SEQ ID NO: 1303512 - protein, 23 aa, Mycobacterium
SGARITLHAALELARRGSGYAVA

SEQ ID NO: 1303513 - protein, 18 aa, Mycobacterium
SGAWNFRDVSSHTGVAPG

SEQ ID NO: 1303514 - protein, 19 aa, Mycobacterium
SGAWRRHPWSEVLARSMNV

SEQ ID NO: 1303515 - protein, 20 aa, Mycobacterium
SGCFVLPVEDSLRSIFATLA

SEQ ID NO: 1303516 - protein, 25 aa, Mycobacterium
SGDQFLVLRPLLVDYVMSMPRGAQV

SEQ ID NO: 1303517 - protein, 24 aa, Mycobacterium
SGDRQFDFWFTPTTRRCQRRVNRS

SEQ ID NO: 1303518 - protein, 17 aa, Mycobacterium
SGELPQRQIGVGWAALR

SEQ ID NO: 1303519 - protein, 45 aa, Mycobacterium
SGEQRLSGFLLWQSAYSEMWFTEAYWPAFRRVDFLRALRDYTRRD

SEQ ID NO: 1303520 - protein, 20 aa, Mycobacterium
SGERAGWGALIDELGRFGRP

SEQ ID NO: 1303521 - protein, 27 aa, Mycobacterium
SGFDTIIEMWLPLSWALNMVNRSMGKD

SEQ ID NO: 1303522 - protein, 29 aa, Mycobacterium
SGFMRAIRAELVVPLVVFLASRACESTHR

SEQ ID NO: 1303523 - protein, 18 aa, Mycobacterium
SGFRDAVFLTGAYGLGEN

SEQ ID NO: 1303524 - protein, 27 aa, Mycobacterium
SGGSFIYVPPGVHVDIPLQAYFRINTE

SEQ ID NO: 1303525 - protein, 23 aa, Mycobacterium
SGHTEVVLWGGRRPELLGGRAEP

SEQ ID NO: 1303526 - protein, 26 aa, Mycobacterium
SGICGYRRFFSITSLAGLRQEDPAVF

SEQ ID NO: 1303527 - protein, 27 aa, Mycobacterium
SGIDANLVAFWAILATRVEAPGLAELG

SEQ ID NO: 1303528 - protein, 20 aa, Mycobacterium
SGIIMMSQAIRRSGRVALPV

SEQ ID NO: 1303529 - protein, 30 aa, Mycobacterium
SGKPLAMPRLDMVTGLYFLTTMIEGDKGEY

SEQ ID NO: 1303530 - protein, 26 aa, Mycobacterium
SGKSHIIGLMAERWILAGYGVLVVDP

SEQ ID NO: 1303531 - protein, 18 aa, Mycobacterium
SGLCSYPLRQCSDGDLYG

SEQ ID NO: 1303532 - protein, 22 aa, Mycobacterium
SGLELALHLLDRSYGPQIAAAV

SEQ ID NO: 1303533 - protein, 21 aa, Mycobacterium
SGLFHEPRLFTCGVDLPLEHP

SEQ ID NO: 1303534 - protein, 17 aa, Mycobacterium
SGLGFPGTPYLHAYTRS

SEQ ID NO: 1303535 - protein, 35 aa, Mycobacterium
SGLRGGVFSAILPVLAHDIPWNSGVMRAIEVTAPE

SEQ ID NO: 1303536 - protein, 26 aa, Mycobacterium
SGLRHLNGFPGGPPPRLALSLGDSLA

SEQ ID NO: 1303537 - protein, 20 aa, Mycobacterium
SGLRPMAPLPAIEASLCDHT

SEQ ID NO: 1303538 - protein, 25 aa, Mycobacterium
SGMATFGHRPFLTETAQLDSWRPDV

SEQ ID NO: 1303539 - protein, 17 aa, Mycobacterium
SGNAVYYRLAHPKIREL

SEQ ID NO: 1303540 - protein, 17 aa, Mycobacterium
SGNLAVLRTPPGAAHYL

SEQ ID NO: 1303541 - protein, 24 aa, Mycobacterium
SGNLRKVIRLMKYLRDHKNSFTGT

SEQ ID NO: 1303542 - protein, 21 aa, Mycobacterium
SGNPYLAFAAMLMAGIDGIKR

SEQ ID NO: 1303543 - protein, 18 aa, Mycobacterium
SGPAHRLFGGLIAAQALG

SEQ ID NO: 1303544 - protein, 24 aa, Mycobacterium
SGPELFDALLAAGYTRVSLGMQST

SEQ ID NO: 1303545 - protein, 25 aa, Mycobacterium
SGPLRLYSLLGRNHTALFYADGDAT

SEQ ID NO: 1303546 - protein, 19 aa, Mycobacterium
SGPLTRLTVYVRRGQRISG

SEQ ID NO: 1303547 - protein, 20 aa, Mycobacterium
SGPVVWVKDASRSVPVAAAL

SEQ ID NO: 1303548 - protein, 24 aa, Mycobacterium
SGQDLLLVTVLKGAVMFVTDLARS

SEQ ID NO: 1303549 - protein, 23 aa, Mycobacterium
SGQSCILPSRILLPRSRYDEGLE

SEQ ID NO: 1303550 - protein, 21 aa, Mycobacterium
SGRFFCAGGDLKAFATAPSRG

SEQ ID NO: 1303551 - protein, 29 aa, Mycobacterium
SGRFGKQWFSVHRTIFRLAFPGGKPRPKP

SEQ ID NO: 1303552 - protein, 18 aa, Mycobacterium
SGRLVERDGRVWLERGCR

SEQ ID NO: 1303553 - protein, 23 aa, Mycobacterium
SGRRFRRIPVSQAVFRGMSRIGD

SEQ ID NO: 1303554 - protein, 20 aa, Mycobacterium
SGRWVPDFLSLPIAVENSLK

SEQ ID NO: 1303555 - protein, 36 aa, Mycobacterium
SGSRDLLREWLSRKFDQWPAIRPYMLVVHDAEFSEP

SEQ ID NO: 1303556 - protein, 19 aa, Mycobacterium
SGSTIHHSIGVWPVLLNDE

SEQ ID NO: 1303557 - protein, 22 aa, Mycobacterium
SGSVVQRLWAKPAITVIGIDTT

SEQ ID NO: 1303558 - protein, 25 aa, Mycobacterium
SGTAWQIFPNFQIGQGLTSALCYSA

SEQ ID NO: 1303559 - protein, 18 aa, Mycobacterium
SGTDLLALLAGGRCDRLI

SEQ ID NO: 1303560 - protein, 26 aa, Mycobacterium
SGTERRTNWLKNFYFGGEHGVGDSIA

SEQ ID NO: 1303561 - protein, 29 aa, Mycobacterium
SGTFYTLRCYLGDDPVFLGRNGRISVFGS

SEQ ID NO: 1303562 - protein, 25 aa, Mycobacterium
SGVAFDVLRRWLTAKGLDVAFIRNV

SEQ ID NO: 1303563 - protein, 31 aa, Mycobacterium
SGVHVYLKRAALNRSLFGSPAAHRRQLAQRY

SEQ ID NO: 1303564 - protein, 26 aa, Mycobacterium
SGVIPRIPLNLVLIKGVTVQGFQFGD

SEQ ID NO: 1303565 - protein, 17 aa, Mycobacterium
SGVLTRTAAIRAGIYSP

SEQ ID NO: 1303566 - protein, 24 aa, Mycobacterium
SGVMGFMLIMMAQDGGWPVPVGGA

SEQ ID NO: 1303567 - protein, 26 aa, Mycobacterium
SGVRVRLFRPTGVPVPAPALLWIHGG

SEQ ID NO: 1303568 - protein, 22 aa, Mycobacterium
SGWTFDHFYPIFSDSTGPCLEG

SEQ ID NO: 1303569 - protein, 26 aa, Mycobacterium
SGYENIIIRGLFLGQTRKQMLAKVDE

SEQ ID NO: 1303570 - protein, 24 aa, Mycobacterium
SGYRGHVIYRPELYSRETAQRFVG

SEQ ID NO: 1303571 - protein, 24 aa, Mycobacterium
SGYRGKLWTFRQYSGFGTAEESNR

SEQ ID NO: 1303572 - protein, 23 aa, Mycobacterium
SGYRRFTAYDCARLRFILTAQRD

SEQ ID NO: 1303573 - protein, 26 aa, Mycobacterium
SHAEYKWVTVLFADVVRSMAIAAAVG

SEQ ID NO: 1303574 - protein, 18 aa, Mycobacterium
SHAWAIRETVDLLTRVFP

SEQ ID NO: 1303575 - protein, 19 aa, Mycobacterium
SHDTPKTAWLFTGQGSQYP

SEQ ID NO: 1303576 - protein, 21 aa, Mycobacterium
SHEMPFVQYLTESFVLGLADG

SEQ ID NO: 1303577 - protein, 23 aa, Mycobacterium
SHETIYQALYFQARGGLKKEVQQ

SEQ ID NO: 1303578 - protein, 38 aa, Mycobacterium
SHEVGLAILGPLRDLDEVAYLRFASVYRSFESAADFER

SEQ ID NO: 1303579 - protein, 30 aa, Mycobacterium
SHGEIYTLSPWRLVDYWTWTRRPEPRDFEF

SEQ ID NO: 1303580 - protein, 21 aa, Mycobacterium
SHMFRHLIPALADRFHVIAPD

SEQ ID NO: 1303581 - protein, 26 aa, Mycobacterium
SHMSSTRRALLMLVQSLRATGWQVAD

SEQ ID NO: 1303582 - protein, 30 aa, Mycobacterium; identical to SEQ ID NO: 861234

SEQ ID NO: 1303583 - protein, 26 aa, Mycobacterium
SHRHAHWLLPAAHWLERDDLLAFTSS

SEQ ID NO: 1303584 - protein, 26 aa, Mycobacterium
SHRPALEVLILGGRPIREPVFHYGPF

SEQ ID NO: 1303585 - protein, 31 aa, Mycobacterium
SHVLALGYIGMTLGAYRWLRPQGRRTAQEIA

SEQ ID NO: 1303586 - protein, 17 aa, Mycobacterium
SHWRFTLTADEPADGAV

SEQ ID NO: 1303587 - protein, 31 aa, Mycobacterium
SIAGMRVCDPPWYRPLLGVRRAATAAACTEL

SEQ ID NO: 1303588 - protein, 19 aa, Mycobacterium
SIALLAYELSLKGEPAPVI

SEQ ID NO: 1303589 - protein, 26 aa, Mycobacterium
SIENGSYFVYRLIKRLKKSANAAPYH

SEQ ID NO: 1303590 - protein, 23 aa, Mycobacterium
SIGGKTFPLPQPFLVMATQNPIE

SEQ ID NO: 1303591 - protein, 24 aa, Mycobacterium
SIGSILAIPGIRGALRSTSAKIIG

SEQ ID NO: 1303592 - protein, 18 aa, Mycobacterium
SIHDKTGQRYRWVSELDG

SEQ ID NO: 1303593 - protein, 27 aa, Mycobacterium
SILALLSHLREDFGLSIILITHEMEVV

SEQ ID NO: 1303594 - protein, 21 aa, Mycobacterium
SIMTVALRRRLEKQTGLSLPP

SEQ ID NO: 1303595 - protein, 23 aa, Mycobacterium
SINLPYITVDADKNPLFLDEQLT

SEQ ID NO: 1303596 - protein, 37 aa, Mycobacterium
SIPAGWTMAVWARVPKARFARWAPDGALLVSVPSTGE

SEQ ID NO: 1303597 - protein, 27 aa, Mycobacterium
SIPLGNVRLPIVIAFGLGSLATGMAYP

SEQ ID NO: 1303598 - protein, 17 aa, Mycobacterium
SIPLPTQLEFMAVSSYG

SEQ ID NO: 1303599 - protein, 23 aa, Mycobacterium
SIRPDPHMLPYAAAKAGLNAMTE

SEQ ID NO: 1303600 - protein, 29 aa, Mycobacterium
SISALADDIYPLLRPKITGSRVAFFGHSM

SEQ ID NO: 1303601 - protein, 37 aa, Mycobacterium
SISDLRAIPWVLSWSQSRVMLPGWYGTGSAFEQYIAE

SEQ ID NO: 1303602 - protein, 22 aa, Mycobacterium
SIYAFFNGVLAAPYAVSKAGVE

SEQ ID NO: 1303603 - protein, 30 aa, Mycobacterium
SKAADRPWRLWLAGRPEVSAYRRSPRAPAP

SEQ ID NO: 1303604 - protein, 30 aa, Mycobacterium
SKAGLGLLGFDVGLPRLPQIPPTPDELTAL

SEQ ID NO: 1303605 - protein, 24 aa, Mycobacterium
SKDKVPYVLRILDASALSSRMAAS

SEQ ID NO: 1303606 - protein, 17 aa, Mycobacterium
SKEELFNLRFQMATGQL

SEQ ID NO: 1303607 - protein, 18 aa, Mycobacterium
SKLLYGAASQLPFPDLLR

SEQ ID NO: 1303608 - protein, 25 aa, Mycobacterium
SKQADVLMLLYLMSVPELGEILNRL

SEQ ID NO: 1303609 - protein, 23 aa, Mycobacterium
SKQAPFEPLPGYVTHVPFGDIDE

SEQ ID NO: 1303610 - protein, 26 aa, Mycobacterium
SKQKLVELGPEGFARWMRDSPAVGLT

SEQ ID NO: 1303611 - protein, 28 aa, Mycobacterium
SKQLTSDFNFLWPTARIAVIGAEGAAQL

SEQ ID NO: 1303612 - protein, 27 aa, Mycobacterium
SKSAQLGFIRTAAMELAPKRITINAVL

SEQ ID NO: 1303613 - protein, 22 aa, Mycobacterium
SLAFYTGVLGMDIVFDVELAGA

SEQ ID NO: 1303614 - protein, 26 aa, Mycobacterium
SLAKRTSVLFNFRELLNARKHELAAI

SEQ ID NO: 1303615 - protein, 18 aa, Mycobacterium
SLAPTWFNAIVKRQQFQP

SEQ ID NO: 1303616 - protein, 19 aa, Mycobacterium
SLAVYPRAEFEKLARRASQ

SEQ ID NO: 1303617 - protein, 18 aa, Mycobacterium
SLAWMTAVGERTKRLQLG

SEQ ID NO: 1303618 - protein, 23 aa, Mycobacterium
SLDVNRHLLKEIQLRMVFGYDMF

SEQ ID NO: 1303619 - protein, 22 aa, Mycobacterium
SLEFKWVEYLLGSRATTIYGGT

SEQ ID NO: 1303620 - protein, 22 aa, Mycobacterium
SLELRYLFDVGGAPPLSPAQQT

SEQ ID NO: 1303621 - protein, 23 aa, Mycobacterium
SLERNVLLTVLSRLGAGSRVVLT

SEQ ID NO: 1303622 - protein, 18 aa, Mycobacterium
SLEYVLRKQCRDTATLFG

SEQ ID NO: 1303623 - protein, 21 aa, Mycobacterium
SLFGTPMKPPLGPGALPVLLK

SEQ ID NO: 1303624 - protein, 28 aa, Mycobacterium
SLFPHHLDTLVNVPAPQYPPADPRTFSL

SEQ ID NO: 1303625 - protein, 18 aa, Mycobacterium
SLGDELMRRFNGATLEAL

SEQ ID NO: 1303626 - protein, 27 aa, Mycobacterium
SLGDVEFAFFVILLAVAGNETTRNAMT

SEQ ID NO: 1303627 - protein, 19 aa, Mycobacterium
SLGEFLALGACFEDLGRKT

SEQ ID NO: 1303628 - protein, 18 aa, Mycobacterium
SLGEIWLRYRASVAHGLT

SEQ ID NO: 1303629 - protein, 26 aa, Mycobacterium
SLGLVQLTRKRLGTGLIEAFSTPCPH

SEQ ID NO: 1303630 - protein, 27 aa, Mycobacterium
SLHAGHLVPLLTLRRFQQAGHRPIVLA

SEQ ID NO: 1303631 - protein, 19 aa, Mycobacterium
SLHGYFLRPGDARAPSVYI

SEQ ID NO: 1303632 - protein, 19 aa, Mycobacterium
SLIHAFANFFPLGGDSATA

SEQ ID NO: 1303633 - protein, 24 aa, Mycobacterium
SLLNQYPHLLALSASSPYWDGSDT

SEQ ID NO: 1303634 - protein, 25 aa, Mycobacterium
SLNDTRVYYVEPAKWIAALRHTKTD

SEQ ID NO: 1303635 - protein, 20 aa, Mycobacterium
SLPHAVLMMIPEAWENNTSM

SEQ ID NO: 1303636 - protein, 19 aa, Mycobacterium
SLPRRPQFALLKGRGNYLC

SEQ ID NO: 1303637 - protein, 26 aa, Mycobacterium
SLPYDEPWGWMQPTRHAYGALLLEQG

SEQ ID NO: 1303638 - protein, 18 aa, Mycobacterium
SLQPLLDNVERIGLGPAL

SEQ ID NO: 1303639 - protein, 19 aa, Mycobacterium
SLRGAPLIAVHAWADHSMS

SEQ ID NO: 1303640 - protein, 17 aa, Mycobacterium
SLRPLLERIDRLAASQP

SEQ ID NO: 1303641 - protein, 27 aa, Mycobacterium
SLRSFYQRFSTKDELLLALIERIMAES

SEQ ID NO: 1303642 - protein, 34 aa, Mycobacterium
SLRTAVNILLSSRFPMWMAWGPELTFFCNAAYRR

SEQ ID NO: 1303643 - protein, 29 aa, Mycobacterium
SLSRAEVVNLVRLTELPAGMPVAVVVRQL

SEQ ID NO: 1303644 - protein, 29 aa, Mycobacterium
SLSYIVAPNLFPLIVRRQLELTLAHGHTS

SEQ ID NO: 1303645 - protein, 30 aa, Mycobacterium; identical to SEQ ID NO: 861931

SEQ ID NO: 1303646 - protein, 35 aa, Mycobacterium; identical to SEQ ID NO: 861966

SEQ ID NO: 1303647 - protein, 23 aa, Mycobacterium
SLVDLAHRLGVTARWCDLDDPDL

SEQ ID NO: 1303648 - protein, 18 aa, Mycobacterium
SLVFKAGADIPAERLRYS

SEQ ID NO: 1303649 - protein, 24 aa, Mycobacterium
SLYGAWDDQFYPDGVGAWMVKLDA

SEQ ID NO: 1303650 - protein, 22 aa, Mycobacterium
SMGNYIFTTKVLIDAIRADADD

SEQ ID NO: 1303651 - protein, 18 aa, Mycobacterium
SMLAHALHTVAKVAPQHL

SEQ ID NO: 1303652 - protein, 28 aa, Mycobacterium
SMMYVQALLDDWAFPATDPAVRARWEQR

SEQ ID NO: 1303653 - protein, 28 aa, Mycobacterium
SMQRKRFGRIILIGSVSGMWGIGNQANY

SEQ ID NO: 1303654 - protein, 28 aa, Mycobacterium
SMRAALALALRRMGLSVLLFDYRGYGGN

SEQ ID NO: 1303655 - protein, 25 aa, Mycobacterium
SMSGRLVARYLAKYVTKSLVDLGIS

SEQ ID NO: 1303656 - protein, 20 aa, Mycobacterium
SMSSRYNLIGRPAVVAVRDG

SEQ ID NO: 1303657 - protein, 18 aa, Mycobacterium
SMTAQWWLDTREPKKEVV

SEQ ID NO: 1303658 - protein, 25 aa, Mycobacterium
SMTSLHVAVLILDAQRRAAPAVLTR

SEQ ID NO: 1303659 - protein, 17 aa, Mycobacterium
SMVLPELRALARQIGVE

SEQ ID NO: 1303660 - protein, 27 aa, Mycobacterium
SMVVAGLCRLLARKGVRVAPFKAQNMS

SEQ ID NO: 1303661 - protein, 17 aa, Mycobacterium
SMWASGDYPRLAAELVA

SEQ ID NO: 1303662 - protein, 25 aa, Mycobacterium
SNAHRAAALAPWLKHYNTQRRHSAL

SEQ ID NO: 1303663 - protein, 20 aa, Mycobacterium
SNLAELGDWLVMHEGWRSEL

SEQ ID NO: 1303664 - protein, 26 aa, Mycobacterium
SNMVDTFVFLTLARTGDQLQGIKKGV

SEQ ID NO: 1303665 - protein, 27 aa, Mycobacterium
SNPAENLYTLDYYLRLAEQIVEAGAHV

SEQ ID NO: 1303666 - protein, 23 aa, Mycobacterium
SNPGRFIPMAIPAIWDPELCAQE

SEQ ID NO: 1303667 - protein, 23 aa, Mycobacterium
SNRNAPWRMFSVSAPGSATGAID

SEQ ID NO: 1303668 - protein, 17 aa, Mycobacterium
SNSLLAGFAARLGLLLG

SEQ ID NO: 1303669 - protein, 33 aa, Mycobacterium
SPADVLALGLTARGATLGVLLLARVGDRSWGGD

SEQ ID NO: 1303670 - protein, 17 aa, Mycobacterium
SPALAEWGIPTAQALLE

SEQ ID NO: 1303671 - protein, 24 aa, Mycobacterium
SPATFARRMVGYAAAVFASNNPIM

SEQ ID NO: 1303672 - protein, 22 aa, Mycobacterium
SPAYLSVWHRTPDGVWTFYATT

SEQ ID NO: 1303673 - protein, 29 aa, Mycobacterium
SPDALAPLRLHYLRWQLFDVGSGLHFQYQ

SEQ ID NO: 1303674 - protein, 22 aa, Mycobacterium
SPEEFAVLRRAGTERPFTGEYT

SEQ ID NO: 1303675 - protein, 28 aa, Mycobacterium
SPEGGWIRTWLDTVLDLPWNVRTEDSTD

SEQ ID NO: 1303676 - protein, 17 aa, Mycobacterium
SPEWWVANVKPGRVLFE

SEQ ID NO: 1303677 - protein, 35 aa, Mycobacterium
SPEWYRTPNYRRRLVRWPRQVLAEFGLYLPDDVEV

SEQ ID NO: 1303678 - protein, 21 aa, Mycobacterium
SPFRRAYEEGLLLDRNMHVGV

SEQ ID NO: 1303679 - protein, 25 aa, Mycobacterium
SPGDLRTVCRVLYLIFNEGYSGDVD

SEQ ID NO: 1303680 - protein, 18 aa, Mycobacterium
SPLIYNREDPKLPDLVVC

SEQ ID NO: 1303681 - protein, 27 aa, Mycobacterium
SPLQARCGWAVGWRKDAFWGRDALLAE

SEQ ID NO: 1303682 - protein, 18 aa, Mycobacterium
SPLQPRPDRSYLITGGLG

SEQ ID NO: 1303683 - protein, 19 aa, Mycobacterium
SPMLKRLETLGLITRTRST

SEQ ID NO: 1303684 - protein, 21 aa, Mycobacterium
SPMVAIEQPPFHAAAFGVSDL

SEQ ID NO: 1303685 - protein, 18 aa, Mycobacterium
SPNPHIPFDQLRLKVVDH

SEQ ID NO: 1303686 - protein, 32 aa, Mycobacterium
SPNSTVCSYLNKLLWILTGNFAKRGAQHLHST

SEQ ID NO: 1303687 - protein, 22 aa, Mycobacterium
SPPIGLGLALLAGLVGLSRVAT

SEQ ID NO: 1303688 - protein, 25 aa, Mycobacterium
SPQAVRMLKFSFNLIDDGLVGQQVF

SEQ ID NO: 1303689 - protein, 24 aa, Mycobacterium
SPQSVFFSGYYAEAAPFVQQLKDG

SEQ ID NO: 1303690 - protein, 22 aa, Mycobacterium
SPTGKFMSIWRASKPVIAQVHG

SEQ ID NO: 1303691 - protein, 26 aa, Mycobacterium
SPTQTFAAYLTMQLLEAAGLPDGVIN

SEQ ID NO: 1303692 - protein, 28 aa, Mycobacterium
SPTYGLPPDFLMRALHDCLAAWQAGTLD

SEQ ID NO: 1303693 - protein, 25 aa, Mycobacterium
SPVGLARFCTLRSWLSQWSYDDANG

SEQ ID NO: 1303694 - protein, 18 aa, Mycobacterium
SPVLADPRRPANTARFVY

SEQ ID NO: 1303695 - protein, 17 aa, Mycobacterium
SPVLVLSHYVEQRYAAE

SEQ ID NO: 1303696 - protein, 18 aa, Mycobacterium
SPVRSAWLDVPSLVEAAK

SEQ ID NO: 1303697 - protein, 27 aa, Mycobacterium
SQADQVVLFPFAAGVATWWRTVGPKVA

SEQ ID NO: 1303698 - protein, 25 aa, Mycobacterium
SQGGTRVLLQWTGVAARPAPSHDLS

SEQ ID NO: 1303699 - protein, 25 aa, Mycobacterium
SQRYRRWLSVLRGGARFVIGTRSAV

SEQ ID NO: 1303700 - protein, 21 aa, Mycobacterium
SQRYYILEAGRITSSGTGGSA

SEQ ID NO: 1303701 - protein, 27 aa, Mycobacterium
SQYQMARIFPTMFRKALRKMAERRLPE

SEQ ID NO: 1303702 - protein, 18 aa, Mycobacterium
SRADYLVIACPLTADTRG

SEQ ID NO: 1303703 - protein, 25 aa, Mycobacterium
SRAWRALLSVLYREVSRPESIVQHP

SEQ ID NO: 1303704 - protein, 29 aa, Mycobacterium
SRDALDRALIDLATYFRDALLVSSGAGHV

SEQ ID NO: 1303705 - protein, 18 aa, Mycobacterium
SRDIDVAAYLPHSPLRVY

SEQ ID NO: 1303706 - protein, 24 aa, Mycobacterium
SRFTFEMGDPKHLGYLLRVVRNVE

SEQ ID NO: 1303707 - protein, 18 aa, Mycobacterium
SRGKHLFIRVGPASIHSH

SEQ ID NO: 1303708 - protein, 24 aa, Mycobacterium
SRGLRDLEFLPNSPTLMNAGTDLG

SEQ ID NO: 1303709 - protein, 20 aa, Mycobacterium
SRGYRAMAGIPRLQFAHVDL

SEQ ID NO: 1303710 - protein, 19 aa, Mycobacterium
SRILVQRNVYDRFMELLEP

SEQ ID NO: 1303711 - protein, 20 aa, Mycobacterium
SRKALHYYVGNRQGLLTLVV

SEQ ID NO: 1303712 - protein, 19 aa, Mycobacterium
SRKLDFEEIQIPTPPRLGN

SEQ ID NO: 1303713 - protein, 27 aa, Mycobacterium
SRKNQARWQFGVLGPPGAAAAGIGEDD

SEQ ID NO: 1303714 - protein, 26 aa, Mycobacterium
SRLHGTLLDRHRPLWEAHLVEGLSDG

SEQ ID NO: 1303715 - protein, 23 aa, Mycobacterium
SRLPSTLWAQYGLAGVLEYEGFV

SEQ ID NO: 1303716 - protein, 20 aa, Mycobacterium
SRLVPQHMMRRMFFTAATVS

SEQ ID NO: 1303717 - protein, 25 aa, Mycobacterium
SRNLCLYPNVYLMDQFSTQIRHFRP

SEQ ID NO: 1303718 - protein, 26 aa, Mycobacterium
SRPIAGPFHFYHCSIPCEGGGALVLG

SEQ ID NO: 1303719 - protein, 17 aa, Mycobacterium
SRPSLDDVFLSLTGHRT

SEQ ID NO: 1303720 - protein, 31 aa, Mycobacterium
SRPSPLSLDDVVKFLLPPAAAKKPGKAASTA

SEQ ID NO: 1303721 - protein, 28 aa, Mycobacterium
SRPTAWLAEGLLMYLPADAQDRLFEQIT

SEQ ID NO: 1303722 - protein, 18 aa, Mycobacterium
SRPVLARPLQAIDARADE

SEQ ID NO: 1303723 - protein, 30 aa, Mycobacterium
SRQGLASWYMYFFQLPYVPELLLTRRRGAL

SEQ ID NO: 1303724 - protein, 20 aa, Mycobacterium
SRRIVGWRAARSMTTDLVLD

SEQ ID NO: 1303725 - protein, 17 aa, Mycobacterium
SRRLLLMIGKDMGLDTK

SEQ ID NO: 1303726 - protein, 25 aa, Mycobacterium
SRTMGMPPMQYLAQWRMALAKEMLR

SEQ ID NO: 1303727 - protein, 20 aa, Mycobacterium
SRVGLINWLIQDPGNAAVAA

SEQ ID NO: 1303728 - protein, 17 aa, Mycobacterium
SRYPDLAIPFHSRWRHF

SEQ ID NO: 1303729 - protein, 20 aa, Mycobacterium
SSAARHLAARWAAKEAVIKA

SEQ ID NO: 1303730 - protein, 29 aa, Mycobacterium
SSAHRMLERLVQLRWLRRNGRDYELGMRL

SEQ ID NO: 1303731 - protein, 36 aa, Mycobacterium
SSAYRAARYRTYAPLLPLVPSWMKRLDFGAAEAVLI

SEQ ID NO: 1303732 - protein, 24 aa, Mycobacterium
SSFALVYDAIVTRGGQAVALPAAV

SEQ ID NO: 1303733 - protein, 18 aa, Mycobacterium
SSGAMFDVIHPASEEVAG

SEQ ID NO: 1303734 - protein, 21 aa, Mycobacterium
SSIHMSIFGMHPVVKHGSDEL

SEQ ID NO: 1303735 - protein, 23 aa, Mycobacterium
SSMIEALDLLFAAKDRSTKKEVK

SEQ ID NO: 1303736 - protein, 31 aa, Mycobacterium
SSPRLYGGTYNLFHYTLPKLGIDVSFVENPD

SEQ ID NO: 1303737 - protein, 21 aa, Mycobacterium
SSPRRALSELLRRGTKNMRGA

SEQ ID NO: 1303738 - protein, 26 aa, Mycobacterium
SSRPLLLFETNLPMRCYLPPGDVTEL

SEQ ID NO: 1303739 - protein, 27 aa, Mycobacterium
SSRQALYEYFFFGDPVRMAGALVNGYD

SEQ ID NO: 1303740 - protein, 24 aa, Mycobacterium
SSSKLANILFTKELHRRYHGAGIS

SEQ ID NO: 1303741 - protein, 19 aa, Mycobacterium
SSSQLRSWFAYRVDGPSVV

SEQ ID NO: 1303742 - protein, 24 aa, Mycobacterium
SSSTGVLPLLPTSASLLQLCSAAL

SEQ ID NO: 1303743 - protein, 22 aa, Mycobacterium
SSTSLVYPPAYYSPDWRDQMEE

SEQ ID NO: 1303744 - protein, 22 aa, Mycobacterium
SSVALVVHLGMSGQMLLGPIPK

SEQ ID NO: 1303745 - protein, 21 aa, Mycobacterium
SSVFKPMYLFRGDTPVDEFAA

SEQ ID NO: 1303746 - protein, 21 aa, Mycobacterium
SSYGARFAGVVFPGETLRANV

SEQ ID NO: 1303747 - protein, 24 aa, Mycobacterium
SSYKDFPLILFQIQTKYRDEARPR

SEQ ID NO: 1303748 - protein, 25 aa, Mycobacterium
SSYLLPQLMGRQNAAWMLMSSEWVS

SEQ ID NO: 1303749 - protein, 31 aa, Mycobacterium
STADALRMLTLPGTLALYLERAWPRHRRLSR

SEQ ID NO: 1303750 - protein, 29 aa, Mycobacterium
STAMSHLLREFELLEPLRARLAEGMPAYG

SEQ ID NO: 1303751 - protein, 24 aa, Mycobacterium
STCHGRVRRLQELGVIRGFYTDIN

SEQ ID NO: 1303752 - protein, 19 aa, Mycobacterium
STDSFVVKPMVFPGGTIGE

SEQ ID NO: 1303753 - protein, 25 aa, Mycobacterium
STGALFADWLVVRASLDDGSVPTAS

SEQ ID NO: 1303754 - protein, 24 aa, Mycobacterium
STGMRLPHRYFAVSALGAPPSGNR

SEQ ID NO: 1303755 - protein, 20 aa, Mycobacterium
STIAAIFPDGPQRYFDTVYN

SEQ ID NO: 1303756 - protein, 22 aa, Mycobacterium
STIALGLLDRLTATAPRVGVFR

SEQ ID NO: 1303757 - protein, 25 aa, Mycobacterium
STKMRMFGVPYRITSTVTALNPDRL

SEQ ID NO: 1303758 - protein, 18 aa, Mycobacterium
STLLRILAGDLEPLDGIV

SEQ ID NO: 1303759 - protein, 20 aa, Mycobacterium
STLLSLFGAVAHPTSGTVDV

SEQ ID NO: 1303760 - protein, 26 aa, Mycobacterium
STLMSPTAFLRRPQRWIRALSEGSRQ

SEQ ID NO: 1303761 - protein, 28 aa, Mycobacterium
STLQALTDCPLRWLLERHGGRDGRDVRS

SEQ ID NO: 1303762 - protein, 19 aa, Mycobacterium
STLVDALVREGLVVRAPDE

SEQ ID NO: 1303763 - protein, 17 aa, Mycobacterium
STPLRWDEVPGCRPEAF

SEQ ID NO: 1303764 - protein, 24 aa, Mycobacterium
STQSVYLYSLWLDPDARGHGLARP

SEQ ID NO: 1303765 - protein, 24 aa, Mycobacterium
STRSSAWIVPKYIAGRPGDQFFRT

SEQ ID NO: 1303766 - protein, 19 aa, Mycobacterium
STRTFPLRSSFAPSYNMTI

SEQ ID NO: 1303767 - protein, 25 aa, Mycobacterium
STSLRPFDVQLLGALRMLAGDVVEM

SEQ ID NO: 1303768 - protein, 24 aa, Mycobacterium
STTMRMILGLDRPSAGTATVMGRP

SEQ ID NO: 1303769 - protein, 17 aa, Mycobacterium
STVLLACTAAGLGTCAL

SEQ ID NO: 1303770 - protein, 20 aa, Mycobacterium
STVVAADWPRLAAAYRTRAA

SEQ ID NO: 1303771 - protein, 23 aa, Mycobacterium
STVVRRGRRLWLADAELVQAGTV

SEQ ID NO: 1303772 - protein, 28 aa, Mycobacterium
STVVYEPLMKRLPPDTPIYGIERVEGSV

SEQ ID NO: 1303773 - protein, 17 aa, Mycobacterium
STYQRFTGGRLALNVVT

SEQ ID NO: 1303774 - protein, 23 aa, Mycobacterium
SVAPGRLVAMTYGHRSCYRADAL

SEQ ID NO: 1303775 - protein, 21 aa, Mycobacterium
SVAPLLARALPAMASVHTVIV

SEQ ID NO: 1303776 - protein, 20 aa, Mycobacterium
SVATAMIPFLEHDDANRALM

SEQ ID NO: 1303777 - protein, 18 aa, Mycobacterium
SVCWYAPDLGAVFSGDTL

SEQ ID NO: 1303778 - protein, 18 aa, Mycobacterium
SVDDRFLYVSCWGTGELK

SEQ ID NO: 1303779 - protein, 20 aa, Mycobacterium
SVDHLIAERPRYSPAARRSV

SEQ ID NO: 1303780 - protein, 24 aa, Mycobacterium
SVDMMANMYLASAFTLAAGLEGIE

SEQ ID NO: 1303781 - protein, 35 aa, Mycobacterium
SVEKLLVEKAYLLDLTAPEMTALLGGLRVLNVNHG

SEQ ID NO: 1303782 - protein, 35 aa, Mycobacterium
SVELDIIPNMWVNARYQFLVLYTVGDDALANARED

SEQ ID NO: 1303783 - protein, 22 aa, Mycobacterium
SVGAKTLWLQQGLWDEQIARDG

SEQ ID NO: 1303784 - protein, 27 aa, Mycobacterium
SVHTRAWKAMFDAYLQSRAQRTGEPYV

SEQ ID NO: 1303785 - protein, 33 aa, Mycobacterium
SVIGGYAERMLLSAPLLLPVPNGLDPRHAALTE

SEQ ID NO: 1303786 - protein, 23 aa, Mycobacterium
SVKRFTNLLSNARTVFWNGPMGV

SEQ ID NO: 1303787 - protein, 34 aa, Mycobacterium
SVLITPLPGLGVPAGALVLLRRASEPVFGEDDEL

SEQ ID NO: 1303788 - protein, 18 aa, Mycobacterium
SVLTKRPPRWIVVADLVE

SEQ ID NO: 1303789 - protein, 35 aa, Mycobacterium
SVLWKQILADVLDTPLFPVIGHPGASLGAAVIAAI

SEQ ID NO: 1303790 - protein, 20 aa, Mycobacterium
SVLWLEQHLASYKGAILAVT

SEQ ID NO: 1303791 - protein, 25 aa, Mycobacterium
SVMTQELLEFPGGVLGVALNLDEHS

SEQ ID NO: 1303792 - protein, 25 aa, Mycobacterium
SVPARTLMLPLNTNARAKMSLLRHG

SEQ ID NO: 1303793 - protein, 24 aa, Mycobacterium
SVPNFLPLLAERFAHQQLRALAKV

SEQ ID NO: 1303794 - protein, 17 aa, Mycobacterium
SVPPALRFTAQAAQLLG

SEQ ID NO: 1303795 - protein, 21 aa, Mycobacterium
SVPVRLAELFIEAGLPAGVFQ

SEQ ID NO: 1303796 - protein, 20 aa, Mycobacterium
SVREVTGVPILFASSGEKLE

SEQ ID NO: 1303797 - protein, 24 aa, Mycobacterium
SVRFLMSVGDLVIGWLLQQQAAVA

SEQ ID NO: 1303798 - protein, 25 aa, Mycobacterium
SVRHLEVVALTPARLLLVVITDTGR

SEQ ID NO: 1303799 - protein, 19 aa, Mycobacterium
SVRLAFIAALQHLSPRQRA

SEQ ID NO: 1303800 - protein, 24 aa, Mycobacterium
SVSALILDPPYGLLVQSYAPRRQK

SEQ ID NO: 1303801 - protein, 21 aa, Mycobacterium
SVSARRPTPGTVAYGAAKAGV

SEQ ID NO: 1303802 - protein, 24 aa, Mycobacterium
SVSDAIALIHKRAHGAAVVVFEGR

SEQ ID NO: 1303803 - protein, 23 aa, Mycobacterium
SVSVAGYPNLFFTFGPNSGPGHN

SEQ ID NO: 1303804 - protein, 25 aa, Mycobacterium
SVVSTVPIPLLRSLSAEPLRAELPE

SEQ ID NO: 1303805 - protein, 25 aa, Mycobacterium
SVYARVNPFGFIETPYRKVENGVVT

SEQ ID NO: 1303806 - protein, 17 aa, Mycobacterium
SWIGMPGDLPAEVLNRT

SEQ ID NO: 1303807 - protein, 20 aa, Mycobacterium
SWTRNMFVPHLWGNLRGVSS

SEQ ID NO: 1303808 - protein, 20 aa, Mycobacterium
SYAGTLARWSTSRHFLLNLP

SEQ ID NO: 1303809 - protein, 17 aa, Mycobacterium
SYALRRGAKALGALAQF

SEQ ID NO: 1303810 - protein, 30 aa, Mycobacterium
SYDPSRIDGLLKGRRLTKPLIAAVEGPAIA

SEQ ID NO: 1303811 - protein, 18 aa, Mycobacterium
SYHVVAEKPGFDLDEFVV

SEQ ID NO: 1303812 - protein, 21 aa, Mycobacterium
SYLLVPLDQPGVEVRPIIQLT

SEQ ID NO: 1303813 - protein, 18 aa, Mycobacterium
SYPDLQIRFGLMSRQEVW

SEQ ID NO: 1303814 - protein, 22 aa, Mycobacterium
SYPVGHLSTMGWIGVRPGDVHL

SEQ ID NO: 1303815 - protein, 19 aa, Mycobacterium
SYRLGARTLMHQFGAPMYG

SEQ ID NO: 1303816 - protein, 20 aa, Mycobacterium
SYRLLLDRLGPLVVELDVDG

SEQ ID NO: 1303817 - protein, 18 aa, Mycobacterium
SYRNFMADLAALYRGAQL

SEQ ID NO: 1303818 - protein, 25 aa, Mycobacterium
SYRTGRPRTYVYRRALEPCRICGTP

SEQ ID NO: 1303819 - protein, 24 aa, Mycobacterium
SYRTREPVRVVGELTDWVGHAPEQ

SEQ ID NO: 1303820 - protein, 25 aa, Mycobacterium
TAAAYGHALGIPVYGVCSLDAIGVA

SEQ ID NO: 1303821 - protein, 22 aa, Mycobacterium
TAAGGNNLWLIPPGPRREESVR

SEQ ID NO: 1303822 - protein, 18 aa, Mycobacterium
TAALILERAPRSGGHWLA

SEQ ID NO: 1303823 - protein, 22 aa, Mycobacterium
TAALRLLLVEFGRSATNWASRV

SEQ ID NO: 1303824 - protein, 20 aa, Mycobacterium
TAALRPYPRAVPSPGWSLRI

SEQ ID NO: 1303825 - protein, 26 aa, Mycobacterium
TAAQALIRWHMQLGNIVIPKSVNPQR

SEQ ID NO: 1303826 - protein, 23 aa, Mycobacterium
TAAQQYIAIAVYFDGADLPQLAK

SEQ ID NO: 1303827 - protein, 33 aa, Mycobacterium
TACLRKTDWLFPQYREIGAFLLRGIAPAQMAAV

SEQ ID NO: 1303828 - protein, 17 aa, Mycobacterium
TADAVLHVLARDMRHLE

SEQ ID NO: 1303829 - protein, 23 aa, Mycobacterium
TADDWRRMLSVHLDGGFYLSQPA

SEQ ID NO: 1303830 - protein, 24 aa, Mycobacterium
TADEPLHTLWTMNSDLRLTGLNTE

SEQ ID NO: 1303831 - protein, 27 aa, Mycobacterium
TADPQDHLWYYKSLLEVYRGRSSSWLV

SEQ ID NO: 1303832 - protein, 26 aa, Mycobacterium
TADQQAYFYRQVLDGALLANAQSERG

SEQ ID NO: 1303833 - protein, 28 aa, Mycobacterium
TADRLGYTRYWIAEHHNMPAVAATSPPV

SEQ ID NO: 1303834 - protein, 21 aa, Mycobacterium
TADVLVDLLLGDAPGTRGGEE

SEQ ID NO: 1303835 - protein, 20 aa, Mycobacterium
TADVMERRLDRERPLWECWI

SEQ ID NO: 1303836 - protein, 24 aa, Mycobacterium
TADYPLFPEYGEDVYYAVASVATD

SEQ ID NO: 1303837 - protein, 26 aa, Mycobacterium
TAEFLGHLLGQLRPIDRAVLGSLTCF

SEQ ID NO: 1303838 - protein, 28 aa, Mycobacterium
TAERGVFDFFFIGDRLVGLPSSQFANPN

SEQ ID NO: 1303839 - protein, 33 aa, Mycobacterium
TAESAILNFLLGPILTELPPQVLLPNVLTEDAL

SEQ ID NO: 1303840 - protein, 23 aa, Mycobacterium
TAESIYAHLGVEPATVCGRPPGG

SEQ ID NO: 1303841 - protein, 20 aa, Mycobacterium
TAFDAFVAGLLDAGGELAAA

SEQ ID NO: 1303842 - protein, 18 aa, Mycobacterium
TAFDLGRRGPLTAAVARL

SEQ ID NO: 1303843 - protein, 29 aa, Mycobacterium
TAFGDKVVPLYFLADAGVIGLLTGRHYEY

SEQ ID NO: 1303844 - protein, 24 aa, Mycobacterium
TAFGVYRPAYVPRSALTHVLVDAD

SEQ ID NO: 1303845 - protein, 18 aa, Mycobacterium
TAFLFHPHRARTADRERL

SEQ ID NO: 1303846 - protein, 26 aa, Mycobacterium
TAFYGRGFIMWQPRGPRLTEVWEWCL

SEQ ID NO: 1303847 - protein, 19 aa, Mycobacterium
TAGLLRRMRAIFEQSPIAG

SEQ ID NO: 1303848 - protein, 23 aa, Mycobacterium
TAGLNWYRAMPFMDPRATGGKIT

SEQ ID NO: 1303849 - protein, 18 aa, Mycobacterium
TAGQRWKWSGRRDGETLV

SEQ ID NO: 1303850 - protein, 21 aa, Mycobacterium
TAGSRLQAAGLRPAIALFEQA

SEQ ID NO: 1303851 - protein, 19 aa, Mycobacterium
TAHALDHNLFRQALRHTRE

SEQ ID NO: 1303852 - protein, 34 aa, Mycobacterium
TAHKFGGPTGIGALLLRRDTACVPLLHGGGQERD

SEQ ID NO: 1303853 - protein, 17 aa, Mycobacterium
TAIANFSSALTAAIEAG

SEQ ID NO: 1303854 - protein, 22 aa, Mycobacterium
TAIFYNFAPERVAKALPAAWAV

SEQ ID NO: 1303855 - protein, 19 aa, Mycobacterium
TAIGDVALVLVPHLPGEPI

SEQ ID NO: 1303856 - protein, 24 aa, Mycobacterium
TAIQAQDLFFRKIVRNRSVALTHL

SEQ ID NO: 1303857 - protein, 19 aa, Mycobacterium
TAIRTLSPVRRLGGGLVEI

SEQ ID NO: 1303858 - protein, 23 aa, Mycobacterium
TAIVVLAALMGAARVLGRDAATL

SEQ ID NO: 1303859 - protein, 25 aa, Mycobacterium
TAKDLLRVLTELDLLRPHPADPGAT

SEQ ID NO: 1303860 - protein, 24 aa, Mycobacterium
TALDGRARRPLPTGLGAPSSDPVD

SEQ ID NO: 1303861 - protein, 21 aa, Mycobacterium
TALDLLAARGLLRVLTEGGPG

SEQ ID NO: 1303862 - protein, 19 aa, Mycobacterium
TALLWETFDPRFDLTKTPN

SEQ ID NO: 1303863 - protein, 17 aa, Mycobacterium
TALPFGAASTFALLLAL

SEQ ID NO: 1303864 - protein, 26 aa, Mycobacterium
TALTLQHAILGPARLPGGFAVRYHPA

SEQ ID NO: 1303865 - protein, 35 aa, Mycobacterium
TALVANLPYNVAVPALLHLLAEFPTIRSVMVMVQA

SEQ ID NO: 1303866 - protein, 26 aa, Mycobacterium
TALVDVWQRAPLQALARLHSLAAADL

SEQ ID NO: 1303867 - protein, 18 aa, Mycobacterium
TALYLAAQTIRGGLADCT

SEQ ID NO: 1303868 - protein, 20 aa, Mycobacterium
TAMSRFGFSAGALAPSYGLA

SEQ ID NO: 1303869 - protein, 25 aa, Mycobacterium
TAPATLIDYFPEDFLLVIDESHVTV

SEQ ID NO: 1303870 - protein, 25 aa, Mycobacterium
TAPEGRGYWFAPTVLTPQRTDRTVT

SEQ ID NO: 1303871 - protein, 22 aa, Mycobacterium
TAPERWKPLTGISGPATLPLAF

SEQ ID NO: 1303872 - protein, 32 aa, Mycobacterium
TAPRLPDGTPFPTLYYLTHPVLTAAASRLESS

SEQ ID NO: 1303873 - protein, 28 aa, Mycobacterium
TAPTAWIAEGLLIYLPPDAQDRLFDNIT

SEQ ID NO: 1303874 - protein, 22 aa, Mycobacterium
TAPTTLEFQIALAAHPGADITE

SEQ ID NO: 1303875 - protein, 29 aa, Mycobacterium
TAPVERADYLPLFVAPQPVRFEPADEDDD

SEQ ID NO: 1303876 - protein, 19 aa, Mycobacterium
TAQEISARTLMKLKRDAES

SEQ ID NO: 1303877 - protein, 19 aa, Mycobacterium
TAQVRIPMLAGRRSLNLSN

SEQ ID NO: 1303878 - protein, 25 aa, Mycobacterium
TARERIELLLDPDSPFLELSPLAAW

SEQ ID NO: 1303879 - protein, 24 aa, Mycobacterium
TARFTSMAMIHWANATHACTCEVD

SEQ ID NO: 1303880 - protein, 20 aa, Mycobacterium
TARLLGMRITGTGRRGKYLW

SEQ ID NO: 1303881 - protein, 17 aa, Mycobacterium
TARLPQVVGAAMARRLS

SEQ ID NO: 1303882 - protein, 28 aa, Mycobacterium
TARQWLAHLYEKWSAELDFAVPTFEQFW

SEQ ID NO: 1303883 - protein, 24 aa, Mycobacterium
TASAWTHLGLTPPSGITGLGQTGL

SEQ ID NO: 1303884 - protein, 30 aa, Mycobacterium
TASDRQRHRLALWSRRLLGEAITQAQYVLA

SEQ ID NO: 1303885 - protein, 26 aa, Mycobacterium
TASSRYRHWLTHKLGSWHDQFGSSGC

SEQ ID NO: 1303886 - protein, 34 aa, Mycobacterium
TATALDVLALFDLDRPIRLLGVRLELAMPEAPKP

SEQ ID NO: 1303887 - protein, 27 aa, Mycobacterium
TATDAHAMLRILFSRLGEPHIGSPQAF

SEQ ID NO: 1303888 - protein, 23 aa, Mycobacterium
TATTFSMEPSPQAPPPPVTTVTI

SEQ ID NO: 1303889 - protein, 22 aa, Mycobacterium
TAVAHLCRAGERRPWLVWVHGA

SEQ ID NO: 1303890 - protein, 25 aa, Mycobacterium
TAVATFYSMYRRTPTGDYLVGVCTN

SEQ ID NO: 1303891 - protein, 29 aa, Mycobacterium
TAVHAVDPGLLVLGLPGSAFLDEARELGL

SEQ ID NO: 1303892 - protein, 20 aa, Mycobacterium
TAVLLNPDRAHPKGLAAFRG

SEQ ID NO: 1303893 - protein, 19 aa, Mycobacterium
TAWVAPNAAVIGRVKLSAK

SEQ ID NO: 1303894 - protein, 22 aa, Mycobacterium
TCGSDLHFIDGYLPGMREGDIF

SEQ ID NO: 1303895 - protein, 17 aa, Mycobacterium
TCKYHAWRYALNGDLTF

SEQ ID NO: 1303896 - protein, 19 aa, Mycobacterium
TCMPQPVPGVLRSVAARFL

SEQ ID NO: 1303897 - protein, 17 aa, Mycobacterium
TCRYKCGDACWKPVPNT

SEQ ID NO: 1303898 - protein, 27 aa, Mycobacterium
TCSDMAFDPVFRPMLDGLRDELTIRLR

SEQ ID NO: 1303899 - protein, 19 aa, Mycobacterium
TCVRILRNQASLLPGLNSN

SEQ ID NO: 1303900 - protein, 18 aa, Mycobacterium
TDADFRAQVFDLIDIAFA

SEQ ID NO: 1303901 - protein, 20 aa, Mycobacterium
TDAPFLTPHPYRGAPNEPYC

SEQ ID NO: 1303902 - protein, 27 aa, Mycobacterium
TDDPLLQARLFSYLDTQLTRLGGPNFG

SEQ ID NO: 1303903 - protein, 26 aa, Mycobacterium
TDEMLDLFRALWQPGWTEFDGEFYPT

SEQ ID NO: 1303904 - protein, 31 aa, Mycobacterium
TDERRAIHFQEWWVRYRAKVPTHSFAFVGAD

SEQ ID NO: 1303905 - protein, 28 aa, Mycobacterium
TDFERVLRINLVGTFLVTREAISALRNG

SEQ ID NO: 1303906 - protein, 17 aa, Mycobacterium
TDFGAQMPMKVISSLLG

SEQ ID NO: 1303907 - protein, 20 aa, Mycobacterium
TDFRSWARADLELEPGRTVF

SEQ ID NO: 1303908 - protein, 25 aa, Mycobacterium
TDGWQIWMRPEAIPGLRRLTDAVHA

SEQ ID NO: 1303909 - protein, 25 aa, Mycobacterium
TDIANLSVFLLSDASSWITGQIINV

SEQ ID NO: 1303910 - protein, 18 aa, Mycobacterium
TDIILNLKSLVVSSEEDE

SEQ ID NO: 1303911 - protein, 20 aa, Mycobacterium
TDITPYWRPASWAAGVVVVD

SEQ ID NO: 1303912 - protein, 20 aa, Mycobacterium
TDKLPYSLKVLAENLLRTED

SEQ ID NO: 1303913 - protein, 23 aa, Mycobacterium
TDKPWSGFNYYLGNYRSTVAVNA

SEQ ID NO: 1303914 - protein, 18 aa, Mycobacterium
TDLALVTDGLRSEREQGI

SEQ ID NO: 1303915 - protein, 17 aa, Mycobacterium
TDLGRPIDVAIQDQQLG

SEQ ID NO: 1303916 - protein, 26 aa, Mycobacterium
TDLLYKLQRSEYLEPRWMIGIDPESE

SEQ ID NO: 1303917 - protein, 23 aa, Mycobacterium
TDMGPVLAIHLGAGAVGVCVSLS

SEQ ID NO: 1303918 - protein, 27 aa, Mycobacterium
TDMPDTAVPLVFRLLGETGSHASALVD

SEQ ID NO: 1303919 - protein, 18 aa, Mycobacterium
TDPALGIEWPFDGELVLS

SEQ ID NO: 1303920 - protein, 19 aa, Mycobacterium
TDPLCYVDPYLPIESFQRR

SEQ ID NO: 1303921 - protein, 24 aa, Mycobacterium
TDPTRKVRFLPYGIAVSVLDANTP

SEQ ID NO: 1303922 - protein, 24 aa, Mycobacterium
TDRASRIIAAPLTRVFSALVDPDA

SEQ ID NO: 1303923 - protein, 20 aa, Mycobacterium
TDRFLKEILVAFADGPVVVG

SEQ ID NO: 1303924 - protein, 17 aa, Mycobacterium
TDRPALTVSLRGLADCV

SEQ ID NO: 1303925 - protein, 19 aa, Mycobacterium
TDRRGLFTALAAQGWRMLA

SEQ ID NO: 1303926 - protein, 20 aa, Mycobacterium
TDRRGWIDWVVRGSRQLFAR

SEQ ID NO: 1303927 - protein, 27 aa, Mycobacterium
TDSPDAPPRLFLSRYARATAPGGGPSI

SEQ ID NO: 1303928 - protein, 31 aa, Mycobacterium
TDTPGFEVPYYWWTFNMPTDHGEVVLTDVRV

SEQ ID NO: 1303929 - protein, 23 aa, Mycobacterium
TDTVQFALRQLMRRTRSHLVLRW

SEQ ID NO: 1303930 - protein, 19 aa, Mycobacterium
TDVIAIFRQDGLSVRARHV

SEQ ID NO: 1303931 - protein, 22 aa, Mycobacterium
TDVIVSWLPCFHDMGMTGYLTV

SEQ ID NO: 1303932 - protein, 19 aa, Mycobacterium
TDVKWWFGHTLTWARRTLQ

SEQ ID NO: 1303933 - protein, 17 aa, Mycobacterium
TDVTFVDRIPKASLLRA

SEQ ID NO: 1303934 - protein, 23 aa, Mycobacterium
TDWRRIVTIYDALLQITPSAVVE

SEQ ID NO: 1303935 - protein, 25 aa, Mycobacterium
TDYRALLEFFFQIHDPTTKNRQGND

SEQ ID NO: 1303936 - protein, 24 aa, Mycobacterium
TEAAVRHLIPALEVLHESLAGKAR

SEQ ID NO: 1303937 - protein, 23 aa, Mycobacterium
TEADWPLMVRLDATNFGQVVPES

SEQ ID NO: 1303938 - protein, 24 aa, Mycobacterium
TEAKELFNGFWILDVSSKEEAKQW

SEQ ID NO: 1303939 - protein, 24 aa, Mycobacterium
TEANIVNFRRQLGRLGLGHDTRRS

SEQ ID NO: 1303940 - protein, 19 aa, Mycobacterium
TEAQMVRLLVYYAATELDR

SEQ ID NO: 1303941 - protein, 22 aa, Mycobacterium
TEATRIVTWFRHGPTPKVTANH

SEQ ID NO: 1303942 - protein, 25 aa, Mycobacterium
TEAVAGVVVLLRRAGRPAFTAEQLE

SEQ ID NO: 1303943 - protein, 24 aa, Mycobacterium
TEAYRLLMEVLGTAATLRTNSPGA

SEQ ID NO: 1303944 - protein, 28 aa, Mycobacterium
TEDIAHIVDFLATALYLDDDDLFTGFVT

SEQ ID NO: 1303945 - protein, 24 aa, Mycobacterium
TEDVMLRVRLRSGLPLDMLTADER

SEQ ID NO: 1303946 - protein, 24 aa, Mycobacterium
TEEMPIKVPWSLPAARPCFAGDPE

SEQ ID NO: 1303947 - protein, 23 aa, Mycobacterium
TEEQTYFFKLSAYTDRLLAHYEA

SEQ ID NO: 1303948 - protein, 25 aa, Mycobacterium
TEFDIVLRGLNASTLILIGGLTDVC

SEQ ID NO: 1303949 - protein, 22 aa, Mycobacterium
TEFNDIVAVLALYRPGPMGMNA

SEQ ID NO: 1303950 - protein, 23 aa, Mycobacterium
TEFYLFRTSALPELTPRFASSVI

SEQ ID NO: 1303951 - protein, 27 aa, Mycobacterium
TEGIVNWDPIWPNHAIRILPGPSSMWF

SEQ ID NO: 1303952 - protein, 21 aa, Mycobacterium
TEHSVLRSRFGFLAIHGGGLE

SEQ ID NO: 1303953 - protein, 19 aa, Mycobacterium
TEKATGYAAVLYRGGETGY

SEQ ID NO: 1303954 - protein, 18 aa, Mycobacterium
TELAPKGIHVAALHVGYM

SEQ ID NO: 1303955 - protein, 39 aa, Mycobacterium
TELEPDFDRAFKELAKQVRLPGFRPGKAPRKLLEARVGR

SEQ ID NO: 1303956 - protein, 32 aa, Mycobacterium
TELGGSARIALWALGWLARVQFLTGDWDQALS

SEQ ID NO: 1303957 - protein, 19 aa, Mycobacterium
TELMRWVHPSLVASTQGTG

SEQ ID NO: 1303958 - protein, 24 aa, Mycobacterium
TELRVRCLRQLKDALREHVEEMRD

SEQ ID NO: 1303959 - protein, 25 aa, Mycobacterium
TELVKALLFSLFEGGLRHGLFHGDL

SEQ ID NO: 1303960 - protein, 25 aa, Mycobacterium
TEMIETWIEMAWQDGSFGWIGIANF

SEQ ID NO: 1303961 - protein, 22 aa, Mycobacterium
TENLGLLAWLKETSADVVCLQE

SEQ ID NO: 1303962 - protein, 29 aa, Mycobacterium
TENYVILNDFPLFWEPSLLKQDIHAPVFH

SEQ ID NO: 1303963 - protein, 26 aa, Mycobacterium
TEPARTWYMAMKPIANYFGPVAMPPT

SEQ ID NO: 1303964 - protein, 21 aa, Mycobacterium
TEPIFSAIMAHPFISGLTDGT

SEQ ID NO: 1303965 - protein, 23 aa, Mycobacterium
TEPKARALRPYAEKLITHAKKGE

SEQ ID NO: 1303966 - protein, 18 aa, Mycobacterium
TEQNVDLVLPFVPQAAEE

SEQ ID NO: 1303967 - protein, 17 aa, Mycobacterium
TEQRLALVAAWEEAGDL

SEQ ID NO: 1303968 - protein, 17 aa, Mycobacterium
TERERYLRFFTTHPTHM

SEQ ID NO: 1303969 - protein, 33 aa, Mycobacterium
TERLDYLQWLGVDCLWLPPFYDSPLRDGGYDIR

SEQ ID NO: 1303970 - protein, 20 aa, Mycobacterium
TERRMPYTVGLLGSVPRLDA

SEQ ID NO: 1303971 - protein, 24 aa, Mycobacterium
TERTDVLVLGPVRLQFWVCGVFEV

SEQ ID NO: 1303972 - protein, 28 aa, Mycobacterium
TESFHLEDSALMRVFAVAGGQLRRRRNL

SEQ ID NO: 1303973 - protein, 27 aa, Mycobacterium
TESTWDRRPGWFRKPAGWATGVSDRDT

SEQ ID NO: 1303974 - protein, 26 aa, Mycobacterium
TESWFDHWYRHLTALGVRFVRAVANR

SEQ ID NO: 1303975 - protein, 23 aa, Mycobacterium
TETLEPVQMLPAPAQGALAVECR

SEQ ID NO: 1303976 - protein, 20 aa, Mycobacterium
TFARRIARNTQLLLLEESHI

SEQ ID NO: 1303977 - protein, 24 aa, Mycobacterium
TFATEYWGRRPLLSRSGALPRDFA

SEQ ID NO: 1303978 - protein, 19 aa, Mycobacterium
TFDRIIAAAIVERPWPPRG

SEQ ID NO: 1303979 - protein, 20 aa, Mycobacterium
TFETMRTLAPPTARGWEVVA

SEQ ID NO: 1303980 - protein, 18 aa, Mycobacterium
TFGLLVNVMSRTPLTHTA

SEQ ID NO: 1303981 - protein, 23 aa, Mycobacterium
TFGPIGELWYRKSGTYRGKIQNL

SEQ ID NO: 1303982 - protein, 19 aa, Mycobacterium
TFLSDRYPRRWQAPLRGAM

SEQ ID NO: 1303983 - protein, 18 aa, Mycobacterium
TFMGAAPRIFEKAHAKVV

SEQ ID NO: 1303984 - protein, 23 aa, Mycobacterium
TFNRRRGSHFAELDRGRAGARQA

SEQ ID NO: 1303985 - protein, 29 aa, Mycobacterium
TFQAAFPLKGKPPNVYGFALNKARAKDEF

SEQ ID NO: 1303986 - protein, 26 aa, Mycobacterium
TFRGCEGDSLLMLLDAKGIECSTGSA

SEQ ID NO: 1303987 - protein, 26 aa, Mycobacterium
TFRGREATLLLPPTTSVYIASRRLSR

SEQ ID NO: 1303988 - protein, 22 aa, Mycobacterium
TFTICSFWLVSALVEIGEISRA

SEQ ID NO: 1303989 - protein, 17 aa, Mycobacterium
TFTNRFLAHLQAATAAR

SEQ ID NO: 1303990 - protein, 27 aa, Mycobacterium
TFTSSQGLLLMIPNMYKIAGELTSAVI

SEQ ID NO: 1303991 - protein, 29 aa, Mycobacterium
TFVELSAHPQLLFAMGDLLGDTTATLVGS

SEQ ID NO: 1303992 - protein, 23 aa, Mycobacterium
TFVSRLLRYLVTSPHRRARELQN

SEQ ID NO: 1303993 - protein, 18 aa, Mycobacterium
TFVVFLASDESRYATGAE

SEQ ID NO: 1303994 - protein, 20 aa, Mycobacterium
TFVVSSAHWRADDDMFGALG

SEQ ID NO: 1303995 - protein, 21 aa, Mycobacterium
TFYEWVLGPSMTYTCACYPQP

SEQ ID NO: 1303996 - protein, 21 aa, Mycobacterium
TFYGDLFPHAVRWQGVIYLED

SEQ ID NO: 1303997 - protein, 27 aa, Mycobacterium
TGAADGFMIFPPRVPYGIGAFVDLVVP

SEQ ID NO: 1303998 - protein, 24 aa, Mycobacterium
TGAGTVIRRNVPPGALAVSAGSQR

SEQ ID NO: 1303999 - protein, 26 aa, Mycobacterium
TGAIEGWMPFGRVFETLTWGRRHVVM

SEQ ID NO: 1304000 - protein, 32 aa, Mycobacterium; identical to SEQ ID NO: 117833

SEQ ID NO: 1304001 - protein, 21 aa, Mycobacterium
TGATRPWQFGDTEPWNVTRTL

SEQ ID NO: 1304002 - protein, 26 aa, Mycobacterium
TGAVPPAGIAPPAKLPAPSGPTRLAP

SEQ ID NO: 1304003 - protein, 23 aa, Mycobacterium
TGAWPLICHTIGTGRLRLDVELA

SEQ ID NO: 1304004 - protein, 25 aa, Mycobacterium
TGDEPFLFHCGQRQLFPLVSAAIQR

SEQ ID NO: 1304005 - protein, 24 aa, Mycobacterium
TGDEPMTGPQRSYLNTLAQEAGEQ

SEQ ID NO: 1304006 - protein, 24 aa, Mycobacterium
TGDIVLIRTGWWDRFLEAGDGTEP

SEQ ID NO: 1304007 - protein, 17 aa, Mycobacterium
TGDIWLFRGASGPDRAI

SEQ ID NO: 1304008 - protein, 25 aa, Mycobacterium
TGDLLRDIQFLPVPHRLSATRVRAA

SEQ ID NO: 1304009 - protein, 22 aa, Mycobacterium
TGDLVAARMWRLGWQKARDEHR

SEQ ID NO: 1304010 - protein, 25 aa, Mycobacterium
TGDPDIDRIWFAANVWPDEVPGLRP

SEQ ID NO: 1304011 - protein, 18 aa, Mycobacterium
TGDRFGSIVDPFGQRWAV

SEQ ID NO: 1304012 - protein, 25 aa, Mycobacterium
TGEHPIDLVLLDLGLPDATGISLAS

SEQ ID NO: 1304013 - protein, 26 aa, Mycobacterium
TGEIRAYRMWLPPLTDPTPVDELVER

SEQ ID NO: 1304014 - protein, 26 aa, Mycobacterium
TGELPAWQWEGLITGPTRLVAITSAS

SEQ ID NO: 1304015 - protein, 25 aa, Mycobacterium
TGETPVGYAVWRAAANHFHLRRVGG

SEQ ID NO: 1304016 - protein, 20 aa, Mycobacterium
TGFEHPYPFARRLSTLDHLT

SEQ ID NO: 1304017 - protein, 32 aa, Mycobacterium
TGFLGRYLALDWLERMALVDGKVICLVRAKDD

SEQ ID NO: 1304018 - protein, 19 aa, Mycobacterium
TGFRLTHVTGTVTPLSILE

SEQ ID NO: 1304019 - protein, 22 aa, Mycobacterium
TGGLELALYCDILIASEQARFA

SEQ ID NO: 1304020 - protein, 23 aa, Mycobacterium
TGGLHGAALFTADGGMLVVREDV

SEQ ID NO: 1304021 - protein, 24 aa, Mycobacterium
TGHLDHPRLGWSHAPVGPVLAESL

SEQ ID NO: 1304022 - protein, 28 aa, Mycobacterium
TGHYLGCVHLQRLLREPPATLVSGILDT

SEQ ID NO: 1304023 - protein, 26 aa, Mycobacterium
TGIGELKFFSQIGYGGGAAAATVQQA

SEQ ID NO: 1304024 - protein, 20 aa, Mycobacterium
TGIKLLARLGTHDDRIDWSK

SEQ ID NO: 1304025 - protein, 18 aa, Mycobacterium
TGIPVFKLTEEETTRLLR

SEQ ID NO: 1304026 - protein, 28 aa, Mycobacterium
TGKREIGPYYLRLSFTAGGMLAEHAPHP

SEQ ID NO: 1304027 - protein, 19 aa, Mycobacterium
TGLITVKDFVKTEQFPLAT

SEQ ID NO: 1304028 - protein, 24 aa, Mycobacterium
TGLMAALALHRRGVPAVLVDRKAG

SEQ ID NO: 1304029 - protein, 24 aa, Mycobacterium
TGLTGRPYRSIPEPAPRSTHGPAK

SEQ ID NO: 1304030 - protein, 25 aa, Mycobacterium
TGLVPKRIPSFPDLTGIHVLRNFDE

SEQ ID NO: 1304031 - protein, 19 aa, Mycobacterium
TGMHSWLANWQLRALEAAT

SEQ ID NO: 1304032 - protein, 24 aa, Mycobacterium
TGPFDGIFAAYLLRNLADPDTQLR

SEQ ID NO: 1304033 - protein, 17 aa, Mycobacterium
TGPLRLGQWMCTDTERP

SEQ ID NO: 1304034 - protein, 26 aa, Mycobacterium
TGQQGELWFRTPQLMKGYHNKPEATA

SEQ ID NO: 1304035 - protein, 24 aa, Mycobacterium
TGQTPLDAQYWRRHSRQPVQFAES

SEQ ID NO: 1304036 - protein, 20 aa, Mycobacterium
TGRHVLDILGKRRGDLTADD

SEQ ID NO: 1304037 - protein, 17 aa, Mycobacterium
TGRLKLDRYLYTSMAYP

SEQ ID NO: 1304038 - protein, 26 aa, Mycobacterium
TGRQWLSWIGLDDLLDVYYHALWDER

SEQ ID NO: 1304039 - protein, 26 aa, Mycobacterium
TGRVELVELLGPRYVLIVRAGAHRLT

SEQ ID NO: 1304040 - protein, 20 aa, Mycobacterium
TGSAIAQHWMYDGKHVLIVF

SEQ ID NO: 1304041 - protein, 19 aa, Mycobacterium
TGSARFRNLIKAEDYDTAL

SEQ ID NO: 1304042 - protein, 25 aa, Mycobacterium
TGSGKTLAFSLPLVSRLADAKRRSS

SEQ ID NO: 1304043 - protein, 23 aa, Mycobacterium
TGTFTFAELLAHELSVEQAGRLS

SEQ ID NO: 1304044 - protein, 24 aa, Mycobacterium
TGTLGHLPQTLPLAADLTVADVLG

SEQ ID NO: 1304045 - protein, 25 aa, Mycobacterium
TGTSALFAFGVPLDPRFGPDSAERH

SEQ ID NO: 1304046 - protein, 29 aa, Mycobacterium
TGTVDMCRAFLPVLLARPEANLTNMSSLS

SEQ ID NO: 1304047 - protein, 23 aa, Mycobacterium
TGTYAVNMYAFDPGAPFGGYKNS

SEQ ID NO: 1304048 - protein, 19 aa, Mycobacterium
TGVNFFTSTWSRLLLTTAG

SEQ ID NO: 1304049 - protein, 21 aa, Mycobacterium
TGVQPWRRQVTPDELPSAIGE

SEQ ID NO: 1304050 - protein, 27 aa, Mycobacterium
TGVQRVFFGWAQVWRTKYRSAEAIRRL

SEQ ID NO: 1304051 - protein, 32 aa, Mycobacterium
TGVTRITLPARLIPFTGGYRAVLPGPVTALLH

SEQ ID NO: 1304052 - protein, 29 aa, Mycobacterium
TGVTVLNNWIRQGVVRRGLVVSGEYISQL

SEQ ID NO: 1304053 - protein, 27 aa, Mycobacterium
TGVWELFWPDFPVDGLYKFRIHGADGV

SEQ ID NO: 1304054 - protein, 19 aa, Mycobacterium
TGWLIVRDTLVMGPWHDLE

SEQ ID NO: 1304055 - protein, 25 aa, Mycobacterium
TGWPGGLIVFDVRPDAMAPLVEAGA

SEQ ID NO: 1304056 - protein, 17 aa, Mycobacterium
TGYDALYDPAAAHFLMT

SEQ ID NO: 1304057 - protein, 18 aa, Mycobacterium
THAAGGWYRHPRTGAATL

SEQ ID NO: 1304058 - protein, 22 aa, Mycobacterium
THASLRRYLLEETYELFDAVRS

SEQ ID NO: 1304059 - protein, 20 aa, Mycobacterium
THDNLLWNAINVLGTDIGLR

SEQ ID NO: 1304060 - protein, 25 aa, Mycobacterium
THFYRDVLGFKLRDSMRLPPQLVGR

SEQ ID NO: 1304061 - protein, 21 aa, Mycobacterium
THGSTLRFAPPLVITADEIDW

SEQ ID NO: 1304062 - protein, 20 aa, Mycobacterium
THGTIFRRAFEEGLLVEDHS

SEQ ID NO: 1304063 - protein, 17 aa, Mycobacterium
THIAAHLTSLPPCDVVQ

SEQ ID NO: 1304064 - protein, 28 aa, Mycobacterium
THITGSLKHRLARSLFLYGLCNGWICEG

SEQ ID NO: 1304065 - protein, 20 aa, Mycobacterium
THKIWATQSGFTFPVLSDFW

SEQ ID NO: 1304066 - protein, 22 aa, Mycobacterium
THLGYGEWLRRMNRRGDARRQL

SEQ ID NO: 1304067 - protein, 17 aa, Mycobacterium
THLWERLSIEFDDFTDE

SEQ ID NO: 1304068 - protein, 17 aa, Mycobacterium
THPVVGTVMRRGYKVGD

SEQ ID NO: 1304069 - protein, 25 aa, Mycobacterium
THRDRAMVLVMLLGGLRSAEARGLL

SEQ ID NO: 1304070 - protein, 24 aa, Mycobacterium
THRSGLAYFFSVSGPLARAYGRIS

SEQ ID NO: 1304071 - protein, 18 aa, Mycobacterium
THTKGRMLQWASFYDEHG

SEQ ID NO: 1304072 - protein, 17 aa, Mycobacterium
THTLALEFAKDGIRFNC

SEQ ID NO: 1304073 - protein, 26 aa, Mycobacterium
THTLHDPVRWKLQHIGRYTLSGTRPP

SEQ ID NO: 1304074 - protein, 26 aa, Mycobacterium
THTTFGVIRALWPGVLVLNTGRETDT

SEQ ID NO: 1304075 - protein, 24 aa, Mycobacterium
THYLRVYLAQLRRKLEDDPSRPRH

SEQ ID NO: 1304076 - protein, 24 aa, Mycobacterium
TIDELIPLVRGVVRGAPHALVVAD

SEQ ID NO: 1304077 - protein, 17 aa, Mycobacterium
TIDLPPAPDPHIHVLKG

SEQ ID NO: 1304078 - protein, 24 aa, Mycobacterium
TIDVAYRFFSTANRSYILADTPGH

SEQ ID NO: 1304079 - protein, 26 aa, Mycobacterium
TIDVAYRYFATAKRKFIIADTPGHLQ

SEQ ID NO: 1304080 - protein, 30 aa, Mycobacterium
TIEAVARPEVWIFLRPFADALTDAEAVDSA

SEQ ID NO: 1304081 - protein, 21 aa, Mycobacterium
TIEMAVAPIALALAAHPKLES

SEQ ID NO: 1304082 - protein, 21 aa, Mycobacterium
TILDEGTLYVAKLTSDIPADE

SEQ ID NO: 1304083 - protein, 21 aa, Mycobacterium
TINLGASLAEYGRRVLLVDLD

SEQ ID NO: 1304084 - protein, 18 aa, Mycobacterium
TIPVVREDGWSDDGMQSV

SEQ ID NO: 1304085 - protein, 19 aa, Mycobacterium
TIRIPVHMVEVINKLGRIQ

SEQ ID NO: 1304086 - protein, 17 aa, Mycobacterium
TIRLPVHLVEQVNKLAR

SEQ ID NO: 1304087 - protein, 21 aa, Mycobacterium
TIRNFVYGTGFQRSVLGASPA

SEQ ID NO: 1304088 - protein, 28 aa, Mycobacterium
TIRQNVGLVPGLLRWDRKRIASRVDELL

SEQ ID NO: 1304089 - protein, 20 aa, Mycobacterium
TIRYLMFSVFSVRPGELGYD

SEQ ID NO: 1304090 - protein, 18 aa, Mycobacterium
TISPALATVGLGLVPLLD

SEQ ID NO: 1304091 - protein, 25 aa, Mycobacterium
TISVSFHEPVRWDGWLLYSHESTQV

SEQ ID NO: 1304092 - protein, 27 aa, Mycobacterium
TITEVYDYLRLLYARAGTPHCPVCGER

SEQ ID NO: 1304093 - protein, 18 aa, Mycobacterium
TITLDEALKIYAEPKRRG

SEQ ID NO: 1304094 - protein, 17 aa, Mycobacterium
TIVFCGVHFMAETAKIL

SEQ ID NO: 1304095 - protein, 18 aa, Mycobacterium
TIYSFTGATPRYLLDFSR

SEQ ID NO: 1304096 - protein, 35 aa, Mycobacterium
TKDSVVRFALDPDAWRLATLFGLLDAVAAALDGGP

SEQ ID NO: 1304097 - protein, 33 aa, Mycobacterium
TKLDVFSEEFLLSRPLLTAIRRTDPTVLLVDET

SEQ ID NO: 1304098 - protein, 24 aa, Mycobacterium
TKQALTEAVLWPLQHPDTFERLGI

SEQ ID NO: 1304099 - protein, 22 aa, Mycobacterium
TKRKFREALERKKAHSTDSAGQ

SEQ ID NO: 1304100 - protein, 26 aa, Mycobacterium
TKSRVEDIYLPYKPKRRTKAQIAREA

SEQ ID NO: 1304101 - protein, 34 aa, Mycobacterium
TKVRFDIKVDLSVPLPGFVLKRAMKGAMETATDG

SEQ ID NO: 1304102 - protein, 21 aa, Mycobacterium
TLAAVLHRPAVLPVPSAGPRL

SEQ ID NO: 1304103 - protein, 28 aa, Mycobacterium
TLATITLQNYFRLYDKLAGMTGTAQTEA

SEQ ID NO: 1304104 - protein, 17 aa, Mycobacterium
TLDAARPPRWPAGDVRG

SEQ ID NO: 1304105 - protein, 34 aa, Mycobacterium
TLDEIRHWLQVFAQRFYSFSQFKRSALPNGPKVS

SEQ ID NO: 1304106 - protein, 19 aa, Mycobacterium
TLDKLLDLALASCDQLFVV

SEQ ID NO: 1304107 - protein, 22 aa, Mycobacterium
TLDWDDELLSFFGIPRQMMPEI

SEQ ID NO: 1304108 - protein, 20 aa, Mycobacterium
TLEAYWRSRRFPLDDYEYSP

SEQ ID NO: 1304109 - protein, 27 aa, Mycobacterium
TLEELKSLGLKTFLLPLNPGKDDEGNI

SEQ ID NO: 1304110 - protein, 29 aa, Mycobacterium
TLERLVELVLDWHRPVKLFIETKHPVRYG

SEQ ID NO: 1304111 - protein, 20 aa, Mycobacterium
TLEVKAILHRMLRSFTWKVP

SEQ ID NO: 1304112 - protein, 19 aa, Mycobacterium
TLHTVWPGEAYPLGATYDG

SEQ ID NO: 1304113 - protein, 18 aa, Mycobacterium
TLHVLRTRIGDEKFFALL

SEQ ID NO: 1304114 - protein, 19 aa, Mycobacterium
TLIADIIRRGIADGDFRDD

SEQ ID NO: 1304115 - protein, 28 aa, Mycobacterium
TLIDSVTVLLHRLGVAYRAIMNPVLRVR

SEQ ID NO: 1304116 - protein, 17 aa, Mycobacterium
TLILTELRTAVATPGVA

SEQ ID NO: 1304117 - protein, 19 aa, Mycobacterium
TLIVSAALPDGGAGLFLAD

SEQ ID NO: 1304118 - protein, 19 aa, Mycobacterium
TLLGIVRSAGSPAPVLLHG

SEQ ID NO: 1304119 - protein, 17 aa, Mycobacterium
TLLPHYAGTLVAAEVKV

SEQ ID NO: 1304120 - protein, 18 aa, Mycobacterium
TLMHEHVFIMTTEILLNY

SEQ ID NO: 1304121 - protein, 17 aa, Mycobacterium
TLPHFPLPLGDPAEPCS

SEQ ID NO: 1304122 - protein, 17 aa, Mycobacterium
TLQVLQLPDDRLDDLLA

SEQ ID NO: 1304123 - protein, 25 aa, Mycobacterium
TLRARVWVAQVGRIPLLLLDSDIPE

SEQ ID NO: 1304124 - protein, 36 aa, Mycobacterium
TLRRLFAEELGLSWRTYLLHARMLRAMALLAAPGQS

SEQ ID NO: 1304125 - protein, 18 aa, Mycobacterium
TLSDLRMDPATLAYQAVV

SEQ ID NO: 1304126 - protein, 18 aa, Mycobacterium
TLSILKFRGHRILNGMLA

SEQ ID NO: 1304127 - protein, 24 aa, Mycobacterium
TLSNLLRMLFSRAGTYPRGATERL

SEQ ID NO: 1304128 - protein, 17 aa, Mycobacterium
TLSPCWYCSGLVRQFNI

SEQ ID NO: 1304129 - protein, 23 aa, Mycobacterium
TLSPPWALHFVDGAPLTLCTVLG

SEQ ID NO: 1304130 - protein, 26 aa, Mycobacterium
TLSRTHPNLVRKLFSLEVPEINDGSV

SEQ ID NO: 1304131 - protein, 25 aa, Mycobacterium
TLTALEGAFVLCRTLRSVEPIVCAG

SEQ ID NO: 1304132 - protein, 19 aa, Mycobacterium
TLTMAMLAACVTACRSCAD

SEQ ID NO: 1304133 - protein, 20 aa, Mycobacterium
TLTPDFMRQIDVLGLAAAAG

SEQ ID NO: 1304134 - protein, 21 aa, Mycobacterium
TLTSYPSIRTDLRNAGATVVD

SEQ ID NO: 1304135 - protein, 18 aa, Mycobacterium
TLVFMAFFERSHAVFTRN

SEQ ID NO: 1304136 - protein, 23 aa, Mycobacterium
TLVIVGGGPYRTALQRLAHEHGV

SEQ ID NO: 1304137 - protein, 24 aa, Mycobacterium
TLVNPRPRFVERIRLHQLVAGTGE

SEQ ID NO: 1304138 - protein, 29 aa, Mycobacterium
TLWCEKPMYIQLDFIVRRLAERASAESTL

SEQ ID NO: 1304139 - protein, 17 aa, Mycobacterium
TLWGKEIGQFQLIQLKL

SEQ ID NO: 1304140 - protein, 18 aa, Mycobacterium
TLYVAKLTSDIPADEIDG

SEQ ID NO: 1304141 - protein, 21 aa, Mycobacterium
TMEDFPHEILMMSQSFIAMDA

SEQ ID NO: 1304142 - protein, 18 aa, Mycobacterium
TMFLVQVIDEYFSDPTLW

SEQ ID NO: 1304143 - protein, 20 aa, Mycobacterium
TMMEGFPVGDPWTPGIMQGP

SEQ ID NO: 1304144 - protein, 25 aa, Mycobacterium
TMNHSVWFHRPVRFDEWVLYSTSSP

SEQ ID NO: 1304145 - protein, 27 aa, Mycobacterium
TMPATVLVGILSLEFLVHAWDYATAIG

SEQ ID NO: 1304146 - protein, 25 aa, Mycobacterium
TMPTTRPRRILFVAGGSGITPVLSM

SEQ ID NO: 1304147 - protein, 28 aa, Mycobacterium
TNDLHDATLYYTVLGRSLDEEPDYAGAA

SEQ ID NO: 1304148 - protein, 19 aa, Mycobacterium
TNGAAAALALSSSILGGRM

SEQ ID NO: 1304149 - protein, 20 aa, Mycobacterium
TNLHRPFIDELTRPNPDDPT

SEQ ID NO: 1304150 - protein, 24 aa, Mycobacterium
TNLNGVWHTIAATAPSIISKGRGG

SEQ ID NO: 1304151 - protein, 25 aa, Mycobacterium
TNMSSLSALLPFASQTLYSASKGAV

SEQ ID NO: 1304152 - protein, 26 aa, Mycobacterium
TNPAVSAWNWLETVPGGWRRALERQK

SEQ ID NO: 1304153 - protein, 21 aa, Mycobacterium
TNQKWLRRDFGDKLPSDVFRE

SEQ ID NO: 1304154 - protein, 25 aa, Mycobacterium
TNREFDLLLFFITHADTVFTREELL

SEQ ID NO: 1304155 - protein, 23 aa, Mycobacterium
TNTDTIILIRIPNNGQSATAISI

SEQ ID NO: 1304156 - protein, 24 aa, Mycobacterium
TNVYYRRALVLAAAFGRRADYPQH

SEQ ID NO: 1304157 - protein, 18 aa, Mycobacterium
TNWSRRYKANLEKLASGD

SEQ ID NO: 1304158 - protein, 27 aa, Mycobacterium
TNYFAPPTVWISLLRCPVFDEVDLSSL

SEQ ID NO: 1304159 - protein, 18 aa, Mycobacterium
TPALASLAFVARPPTATP

SEQ ID NO: 1304160 - protein, 17 aa, Mycobacterium
TPALQTLGPIDTPPYYA

SEQ ID NO: 1304161 - protein, 17 aa, Mycobacterium
TPALWEAGLYCRADDRG

SEQ ID NO: 1304162 - protein, 25 aa, Mycobacterium
TPANAFVMSFLGAVSSLNGTLVRPH

SEQ ID NO: 1304163 - protein, 31 aa, Mycobacterium
TPAQVALAWTLNVAPNVLLIPGTSSVAHLEE

SEQ ID NO: 1304164 - protein, 31 aa, Mycobacterium
TPAVLGPIEAITLLPLFFELDGTFPNHEANP

SEQ ID NO: 1304165 - protein, 20 aa, Mycobacterium
TPAYLGFNLFSHAIARAIIH

SEQ ID NO: 1304166 - protein, 25 aa, Mycobacterium
TPDDHADLFWGLRGGKATLGIVTSV

SEQ ID NO: 1304167 - protein, 24 aa, Mycobacterium
TPDPSPELLARWRSRPTHEHPLVW

SEQ ID NO: 1304168 - protein, 26 aa, Mycobacterium
TPDRIPLYRRLIIAGDWWDTVDEIAG

SEQ ID NO: 1304169 - protein, 24 aa, Mycobacterium
TPEAWAVWEAIFAKFAAPGMCNPD

SEQ ID NO: 1304170 - protein, 21 aa, Mycobacterium
TPEEFMTTGWFTGLVPVTVSV

SEQ ID NO: 1304171 - protein, 25 aa, Mycobacterium
TPEQKDYFLPRILTGEVFFCQGYSE

SEQ ID NO: 1304172 - protein, 24 aa, Mycobacterium
TPEYKQVALFSATMPPGIKKITKK

SEQ ID NO: 1304173 - protein, 19 aa, Mycobacterium
TPGMATCRAVVQLDGAMSS

SEQ ID NO: 1304174 - protein, 21 aa, Mycobacterium
TPIDPYLEILREFDTLLVMSV

SEQ ID NO: 1304175 - protein, 20 aa, Mycobacterium
TPKHDIPMGPARWLTVVSPE

SEQ ID NO: 1304176 - protein, 25 aa, Mycobacterium
TPKSCVFEYVYLARPDSTLAGRSVH

SEQ ID NO: 1304177 - protein, 27 aa, Mycobacterium
TPLDRRYPLWEFYFADGLADGRWALIG

SEQ ID NO: 1304178 - protein, 21 aa, Mycobacterium
TPLPGCAFVPRCALATDECTT

SEQ ID NO: 1304179 - protein, 26 aa, Mycobacterium
TPNSYRRFVPYSWAGTTATWGVDNRS

SEQ ID NO: 1304180 - protein, 24 aa, Mycobacterium
TPPAELLADWRTTRGLLHDALLTV

SEQ ID NO: 1304181 - protein, 31 aa, Mycobacterium
TPPPTWEDIAWLRERWDGPFMLKGIVRVDDA

SEQ ID NO: 1304182 - protein, 26 aa, Mycobacterium
TPRLHSEMFSELRWPGDPAPDSGIDV

SEQ ID NO: 1304183 - protein, 25 aa, Mycobacterium
TPSNYPIEVILNKLGPALATGNTVV

SEQ ID NO: 1304184 - protein, 24 aa, Mycobacterium
TPSPFAASLLFGYVGAFMYEGDSP

SEQ ID NO: 1304185 - protein, 29 aa, Mycobacterium
TPSSPTDAYWLLRHAIAARDPVIYLEPKR

SEQ ID NO: 1304186 - protein, 18 aa, Mycobacterium
TPTAYPVEFLTLGTGGVG

SEQ ID NO: 1304187 - protein, 28 aa, Mycobacterium
TPVLLDAIYDPWPTPLAAAVQAAGGRVI

SEQ ID NO: 1304188 - protein, 26 aa, Mycobacterium
TPVPVPHDVPWFPKDVDHWSVRWVAL

SEQ ID NO: 1304189 - protein, 19 aa, Mycobacterium
TPVVSFPLVRAAGGIHLTG

SEQ ID NO: 1304190 - protein, 45 aa, Mycobacterium; identical to SEQ ID NO: 867973

SEQ ID NO: 1304191 - protein, 18 aa, Mycobacterium
TPYAVLLAVFGTLIHRYT

SEQ ID NO: 1304192 - protein, 28 aa, Mycobacterium
TQDAIRRLLDRISLGGAWDMVKGVFTGE

SEQ ID NO: 1304193 - protein, 24 aa, Mycobacterium
TQDLLREAVLVEGWRLHPGSDPVA

SEQ ID NO: 1304194 - protein, 24 aa, Mycobacterium
TQEADYPALRLVLDSAPRPDEGQF

SEQ ID NO: 1304195 - protein, 25 aa, Mycobacterium
TQEKLDALLRVLEPYGVRELVQSGV

SEQ ID NO: 1304196 - protein, 27 aa, Mycobacterium
TQESTLGLIFHWADQKGLPLLDLKDLR

SEQ ID NO: 1304197 - protein, 29 aa, Mycobacterium
TQLTKGERMLVFLPLAHVLARAITIAAFA

SEQ ID NO: 1304198 - protein, 26 aa, Mycobacterium
TQNDFVLLPDLDARLALTPAVVSALC

SEQ ID NO: 1304199 - protein, 19 aa, Mycobacterium
TQPVFVLDPMLATGGSLAH

SEQ ID NO: 1304200 - protein, 19 aa, Mycobacterium
TQRAAIADWVYWQHVSVMS

SEQ ID NO: 1304201 - protein, 23 aa, Mycobacterium
TQRFDLLSDPHRLEILLSLHRAP

SEQ ID NO: 1304202 - protein, 20 aa, Mycobacterium
TQRRHSALGGLPPISRLTPT

SEQ ID NO: 1304203 - protein, 34 aa, Mycobacterium
TQRVRANLFYRGLAFHRYPVLGDSLFTRTEVVGL

SEQ ID NO: 1304204 - protein, 23 aa, Mycobacterium
TQVDSMILPPIAHEVKVISIAMF

SEQ ID NO: 1304205 - protein, 26 aa, Mycobacterium
TQVTLNLAMLTLLQKNLQGTIFGGGN

SEQ ID NO: 1304206 - protein, 26 aa, Mycobacterium
TRAADHSKLWFAIAAGLMASGGPRTR

SEQ ID NO: 1304207 - protein, 25 aa, Mycobacterium
TRADGERRPGWVGLPLAGVETRLVG

SEQ ID NO: 1304208 - protein, 20 aa, Mycobacterium
TRAILGRHLLEVNPTFDRLA

SEQ ID NO: 1304209 - protein, 22 aa, Mycobacterium
TRAMPAYNWMTVAKSALESVNR

SEQ ID NO: 1304210 - protein, 21 aa, Mycobacterium
TRCGTPLKWVRLDSAPFTDRL

SEQ ID NO: 1304211 - protein, 30 aa, Mycobacterium
TRDDTRTPWPMWPLVLRTRLSPAHAEGGQR

SEQ ID NO: 1304212 - protein, 23 aa, Mycobacterium
TREELLKQVWRWDFGDLSTVTVH

SEQ ID NO: 1304213 - protein, 22 aa, Mycobacterium
TREGRWTLLDYVDIVVHIQHQD

SEQ ID NO: 1304214 - protein, 25 aa, Mycobacterium
TREVILRLFAGLLDTAPTLGAGLDW

SEQ ID NO: 1304215 - protein, 17 aa, Mycobacterium
TRGALYHQFADKSALFE

SEQ ID NO: 1304216 - protein, 18 aa, Mycobacterium
TRGAWYLRQMLGSANFHA

SEQ ID NO: 1304217 - protein, 32 aa, Mycobacterium
TRGGPPIAFQLLWYPVTMWDMSLPSVTENAGA

SEQ ID NO: 1304218 - protein, 26 aa, Mycobacterium
TRHRVSYALIRLPDGGFGIFTDRDLR

SEQ ID NO: 1304219 - protein, 26 aa, Mycobacterium
TRIGDEKFFALLRDWTARHRHSTAFT

SEQ ID NO: 1304220 - protein, 23 aa, Mycobacterium
TRILRLFDFAADHRAMYRNVVGS

SEQ ID NO: 1304221 - protein, 22 aa, Mycobacterium
TRLDRFIGLVVIDRGHPRVPDP

SEQ ID NO: 1304222 - protein, 27 aa, Mycobacterium
TRLDRPWMLALGARCRALLLAARGDLT

SEQ ID NO: 1304223 - protein, 25 aa, Mycobacterium
TRLLEMRDFYAFLLDEMPAVLDRWR

SEQ ID NO: 1304224 - protein, 20 aa, Mycobacterium
TRLRSIAHIGVRTRDFAFAV

SEQ ID NO: 1304225 - protein, 20 aa, Mycobacterium
TRMPALMSELLWSRIGAQTD

SEQ ID NO: 1304226 - protein, 21 aa, Mycobacterium
TRMRVALSALTMAEYFRDEKQ

SEQ ID NO: 1304227 - protein, 19 aa, Mycobacterium
TRNDIRWHPSSLDRTHRWT

SEQ ID NO: 1304228 - protein, 19 aa, Mycobacterium
TRNKVLVEGVNRIKKHTAV

SEQ ID NO: 1304229 - protein, 18 aa, Mycobacterium
TRQALLELAGVVADGFAG

SEQ ID NO: 1304230 - protein, 23 aa, Mycobacterium
TRQPRSLRVCTLLRKPDAVRADV

SEQ ID NO: 1304231 - protein, 17 aa, Mycobacterium
TRQRAAIADLLDGLDEF

SEQ ID NO: 1304232 - protein, 24 aa, Mycobacterium
TRRFELDRYLGWPGQAPSYAVGQR

SEQ ID NO: 1304233 - protein, 29 aa, Mycobacterium
TRRPPGLRQLLWEPADLYPPAVLTGITNS

SEQ ID NO: 1304234 - protein, 30 aa, Mycobacterium
TRRVLGRLPRLVDWPEWLPPDWFDDRRVEP

SEQ ID NO: 1304235 - protein, 26 aa, Mycobacterium
TRRWNPKMKRFIFTDRNGIYIIDLQQ

SEQ ID NO: 1304236 - protein, 22 aa, Mycobacterium
TRSGVLRFVVLDGLAKPGRLEG

SEQ ID NO: 1304237 - protein, 19 aa, Mycobacterium
TRSWVGLRTMRSYALATMD

SEQ ID NO: 1304238 - protein, 18 aa, Mycobacterium
TRTEDWLRGVYGPTVWQR

SEQ ID NO: 1304239 - protein, 26 aa, Mycobacterium
TRVGTVIARYPLAFTATAMTISPDGK

SEQ ID NO: 1304240 - protein, 17 aa, Mycobacterium
TRVSLRYRLPAGSVPPL

SEQ ID NO: 1304241 - protein, 17 aa, Mycobacterium
TRWQIDHTPVAIATQAT

SEQ ID NO: 1304242 - protein, 24 aa, Mycobacterium
TRYEAWSFPDFATGATALRAVTQT

SEQ ID NO: 1304243 - protein, 25 aa, Mycobacterium
TRYLQVMMSWYLRVADGGAAGPLAG

SEQ ID NO: 1304244 - protein, 24 aa, Mycobacterium
TSAESYLVFEKLLDAAEKSGANAI

SEQ ID NO: 1304245 - protein, 23 aa, Mycobacterium
TSAPISVPWLIGVARHKLADHYR

SEQ ID NO: 1304246 - protein, 22 aa, Mycobacterium
TSCSLSTLALLAKGFDVPVTTL

SEQ ID NO: 1304247 - protein, 23 aa, Mycobacterium
TSDLYSAFYPLSVASPVLAGLHL

SEQ ID NO: 1304248 - protein, 24 aa, Mycobacterium
TSDQEVRWCPGCGDYVILNTIRNF

SEQ ID NO: 1304249 - protein, 28 aa, Mycobacterium
TSEVVARLPFVPSLLEWLHAGRTSVVMD

SEQ ID NO: 1304250 - protein, 29 aa, Mycobacterium
TSFSMVMENRWLPMKRTALALNHLVSTRF

SEQ ID NO: 1304251 - protein, 18 aa, Mycobacterium
TSFYDWYADLPVASPQVF

SEQ ID NO: 1304252 - protein, 27 aa, Mycobacterium
TSGKTMGIPLLYPWANRLSSSKYAIDG

SEQ ID NO: 1304253 - protein, 24 aa, Mycobacterium
TSGQRALYELGMTGIPVVNVNNNC

SEQ ID NO: 1304254 - protein, 18 aa, Mycobacterium
TSILATKLTPSVVGQLIA

SEQ ID NO: 1304255 - protein, 29 aa, Mycobacterium
TSMGQALTGMKYLATRKGPLAAPSFDVVG

SEQ ID NO: 1304256 - protein, 25 aa, Mycobacterium
TSPAALLDGNLLNVNVNVDLDADLA

SEQ ID NO: 1304257 - protein, 20 aa, Mycobacterium
TSRPLKITGLTDFIELFSTL

SEQ ID NO: 1304258 - protein, 25 aa, Mycobacterium
TSRTAMMIRPQWRFRRGRAAAGGPG

SEQ ID NO: 1304259 - protein, 17 aa, Mycobacterium
TSSLAAASLLDLGLHRA

SEQ ID NO: 1304260 - protein, 18 aa, Mycobacterium
TSSTFARRIARNTQLLLL

SEQ ID NO: 1304261 - protein, 25 aa, Mycobacterium
TSSTPVLVDFWATWCGPCKMVAPVL

SEQ ID NO: 1304262 - protein, 22 aa, Mycobacterium
TSSWTLIELIRHPEVYAAVQQE

SEQ ID NO: 1304263 - protein, 17 aa, Mycobacterium
TSVFPLTGAALAAADAA

SEQ ID NO: 1304264 - protein, 21 aa, Mycobacterium
TSVLPRWGAVIAASTAHIHTD

SEQ ID NO: 1304265 - protein, 22 aa, Mycobacterium
TTAAAPVRVGFRLGPPGAGELG

SEQ ID NO: 1304266 - protein, 27 aa, Mycobacterium
TTADRVITLRYLLSMIAAERGMVATFM

SEQ ID NO: 1304267 - protein, 21 aa, Mycobacterium
TTAERLYRLAALTAPAGVPGT

SEQ ID NO: 1304268 - protein, 27 aa, Mycobacterium
TTAFSASPFSWLQWMTESTATLTAAPN

SEQ ID NO: 1304269 - protein, 24 aa, Mycobacterium
TTAVSRVLGIPRALAERVKRTPAL

SEQ ID NO: 1304270 - protein, 20 aa, Mycobacterium
TTCFNAITGVYRPSSGSVTF

SEQ ID NO: 1304271 - protein, 26 aa, Mycobacterium
TTCGDWTLRQLFRHVGRGNRWAAQIV

SEQ ID NO: 1304272 - protein, 25 aa, Mycobacterium
TTCYDIRFPELYVELARRGAQLITV

SEQ ID NO: 1304273 - protein, 24 aa, Mycobacterium
TTEARILGIFVDGRRVPVVGHDTA

SEQ ID NO: 1304274 - protein, 17 aa, Mycobacterium
TTEFFGPSGGAQAEAEG

SEQ ID NO: 1304275 - protein, 24 aa, Mycobacterium
TTEQAWKFIGLAYPTYCPAHQALL

SEQ ID NO: 1304276 - protein, 20 aa, Mycobacterium
TTFGRIGVKVWIYKGDIVGG

SEQ ID NO: 1304277 - protein, 24 aa, Mycobacterium
TTGDGILTGLRLMSRMAQTRKSLA

SEQ ID NO: 1304278 - protein, 19 aa, Mycobacterium
TTGIGLRGWIAAADGWGVA

SEQ ID NO: 1304279 - protein, 28 aa, Mycobacterium
TTGMPKGVLWRQHDIFLSSMGGRPFGSD

SEQ ID NO: 1304280 - protein, 29 aa, Mycobacterium
TTGSRLARPPLLVPVLRAGLGMVDQAHAL

SEQ ID NO: 1304281 - protein, 21 aa, Mycobacterium
TTHWMYADLLARMYPTARVDR

SEQ ID NO: 1304282 - protein, 27 aa, Mycobacterium
TTIAGQVYPLPEPFLVVATQNPVDQEG

SEQ ID NO: 1304283 - protein, 23 aa, Mycobacterium
TTLAGGLNWPLDLAVGDDGRLYV

SEQ ID NO: 1304284 - protein, 32 aa, Mycobacterium
TTLAYDIVGLPRWLRHFNNRWTLRADGSATAV

SEQ ID NO: 1304285 - protein, 18 aa, Mycobacterium
TTLGLDPGFRTGVKVAVV

SEQ ID NO: 1304286 - protein, 31 aa, Mycobacterium
TTLGRVMFNELLPISYPFINEQMHKKVQARI

SEQ ID NO: 1304287 - protein, 19 aa, Mycobacterium
TTLRVGPVARRLITATSTE

SEQ ID NO: 1304288 - protein, 18 aa, Mycobacterium
TTLRWIRDRIDAAGSLMP

SEQ ID NO: 1304289 - protein, 22 aa, Mycobacterium
TTPWGTFLDDLAGFDAEFFGVS

SEQ ID NO: 1304290 - protein, 18 aa, Mycobacterium
TTQDIYLQVWRSAGSYDP

SEQ ID NO: 1304291 - protein, 18 aa, Mycobacterium
TTQFFGMKANRYLHDHQI

SEQ ID NO: 1304292 - protein, 30 aa, Mycobacterium
TTRAPAGDVTIPFLIDWEALEAAEWAALTE

SEQ ID NO: 1304293 - protein, 21 aa, Mycobacterium
TTRAYTSYLLATVYGGSFADG

SEQ ID NO: 1304294 - protein, 27 aa, Mycobacterium
TTRPDTLFGATYLVLAPEHPLVEQLAA

SEQ ID NO: 1304295 - protein, 20 aa, Mycobacterium
TTSMLIVALQHCGFDPSFAV

SEQ ID NO: 1304296 - protein, 20 aa, Mycobacterium
TTSVAWRLRGQTSYCADGQV

SEQ ID NO: 1304297 - protein, 26 aa, Mycobacterium
TTTGLRTPIWLITRGAQRVTATDTVA

SEQ ID NO: 1304298 - protein, 17 aa, Mycobacterium
TTTSPPLPVIEIADVWK

SEQ ID NO: 1304299 - protein, 21 aa, Mycobacterium
TTVLRMHQMICAAVGTTRPCL

SEQ ID NO: 1304300 - protein, 23 aa, Mycobacterium
TTVMLAELAAKHLPPGVLNVVTG

SEQ ID NO: 1304301 - protein, 25 aa, Mycobacterium
TTYLDAFAYARRAAGLPATAVNWGL

SEQ ID NO: 1304302 - protein, 22 aa, Mycobacterium
TTYSYFFEPNPKWSRLFSTGAE

SEQ ID NO: 1304303 - protein, 17 aa, Mycobacterium
TVADMMIYLTWTMDGRG

SEQ ID NO: 1304304 - protein, 25 aa, Mycobacterium
TVAHYDRHLTLDGLRLVFERNRDGQ

SEQ ID NO: 1304305 - protein, 26 aa, Mycobacterium
TVAQIALNWLLRRPTVASVIIGARNE

SEQ ID NO: 1304306 - protein, 26 aa, Mycobacterium
TVAQVAIGLLRQQLAPGQMVHGIVTD

SEQ ID NO: 1304307 - protein, 25 aa, Mycobacterium
TVARRGGLVVLPQDLPISAVQQTVD

SEQ ID NO: 1304308 - protein, 18 aa, Mycobacterium
TVAWTMLGVALSAYEQWL

SEQ ID NO: 1304309 - protein, 27 aa, Mycobacterium
TVAYKGMMLSGIPNMAFTFGYTNASWT

SEQ ID NO: 1304310 - protein, 19 aa, Mycobacterium
TVCALLSDWLPATTGTVVY

SEQ ID NO: 1304311 - protein, 19 aa, Mycobacterium
TVDANLKLGLPADARDYGI

SEQ ID NO: 1304312 - protein, 22 aa, Mycobacterium
TVEFARRIAALPTMAALLVKDS

SEQ ID NO: 1304313 - protein, 19 aa, Mycobacterium
TVEGWFDNPYGGLEPIFAA

SEQ ID NO: 1304314 - protein, 39 aa, Mycobacterium
TVEKAGYDLLFFADVFGLRAPWNGNWRKAVEGGIQVPVN

SEQ ID NO: 1304315 - protein, 18 aa, Mycobacterium
TVELVELLGPRAIVTVRA

SEQ ID NO: 1304316 - protein, 18 aa, Mycobacterium
TVERIYRMYADGAGLRFI

SEQ ID NO: 1304317 - protein, 18 aa, Mycobacterium
TVEWHLRKVFVKVGITSR

SEQ ID NO: 1304318 - protein, 18 aa, Mycobacterium
TVFAAAPSGWRNLASGYQ

SEQ ID NO: 1304319 - protein, 17 aa, Mycobacterium
TVFQRLAPGIMPLSVAE

SEQ ID NO: 1304320 - protein, 32 aa, Mycobacterium
TVFQRSPAYTLPWRVRPFAPGELDDLKARYGE

SEQ ID NO: 1304321 - protein, 21 aa, Mycobacterium
TVFRGVWGFQAGEAALSDSLL

SEQ ID NO: 1304322 - protein, 30 aa, Mycobacterium
TVGDPLLDLGWMLICWPHDPNPIDAGSELA

SEQ ID NO: 1304323 - protein, 22 aa, Mycobacterium
TVGEDLWAPTFVRDFPVETTPL

SEQ ID NO: 1304324 - protein, 24 aa, Mycobacterium
TVGFDCSGLMLYAFAGVGIKLDHY

SEQ ID NO: 1304325 - protein, 22 aa, Mycobacterium
TVGLRTYVLVAGGLDIPEYLGS

SEQ ID NO: 1304326 - protein, 32 aa, Mycobacterium; identical to SEQ ID NO: 869252

SEQ ID NO: 1304327 - protein, 20 aa, Mycobacterium
TVIDMLANSAFYYGVLRTMS

SEQ ID NO: 1304328 - protein, 30 aa, Mycobacterium
TVIVAPMFHAWGFSQLLFAGLLACTIVTRR

SEQ ID NO: 1304329 - protein, 27 aa, Mycobacterium
TVKDLLPLLEKVIQSGKPLLIIAEDVE

SEQ ID NO: 1304330 - protein, 21 aa, Mycobacterium
TVKNYVSRLLAKLGVERRTQA

SEQ ID NO: 1304331 - protein, 19 aa, Mycobacterium
TVLAVARAIKGRGLGLTVI

SEQ ID NO: 1304332 - protein, 25 aa, Mycobacterium
TVLDGQIAWWLVEDAGRELWDTKQA

SEQ ID NO: 1304333 - protein, 20 aa, Mycobacterium
TVLLVPDLVNYWLTGRAAAE

SEQ ID NO: 1304334 - protein, 22 aa, Mycobacterium
TVLPAQWPVLLCNGAVGIAEGW

SEQ ID NO: 1304335 - protein, 24 aa, Mycobacterium
TVLQADTPMPVLVAALGPVMLQLA

SEQ ID NO: 1304336 - protein, 18 aa, Mycobacterium
TVLRADRSTDFLVLEMSA

SEQ ID NO: 1304337 - protein, 25 aa, Mycobacterium
TVLRDGRRVTTCLTFAVAADGAHIT

SEQ ID NO: 1304338 - protein, 20 aa, Mycobacterium
TVLRPGQPAVTISTPGLVSN

SEQ ID NO: 1304339 - protein, 29 aa, Mycobacterium
TVLVTGYDILFFWVARMMMFGTFVADDPA

SEQ ID NO: 1304340 - protein, 20 aa, Mycobacterium
TVMCILNGQLRPVLVRDHSV

SEQ ID NO: 1304341 - protein, 20 aa, Mycobacterium
TVMFADLVGFTRLGEAVPPE

SEQ ID NO: 1304342 - protein, 19 aa, Mycobacterium
TVPAGSAMLLLFGAANRDP

SEQ ID NO: 1304343 - protein, 25 aa, Mycobacterium
TVPHLHWAFQHLAEFLPTARISRGT

SEQ ID NO: 1304344 - protein, 19 aa, Mycobacterium
TVPPGISAVYVYRMPAGEA

SEQ ID NO: 1304345 - protein, 27 aa, Mycobacterium
TVPVDRPVPGPIYLPEVRVACTPYRGA

SEQ ID NO: 1304346 - protein, 18 aa, Mycobacterium
TVQLTLPGGKIALRAGRQ

SEQ ID NO: 1304347 - protein, 26 aa, Mycobacterium
TVRAICRRAGVTVRYFYECFTDKDDF

SEQ ID NO: 1304348 - protein, 25 aa, Mycobacterium
TVREALRVLQGERLLITKRGNGGTV

SEQ ID NO: 1304349 - protein, 25 aa, Mycobacterium
TVRLLGGDPWRDAVDLHRRIAYVPG

SEQ ID NO: 1304350 - protein, 18 aa, Mycobacterium
TVRTGLRVLAQGSPLWGS

SEQ ID NO: 1304351 - protein, 18 aa, Mycobacterium
TVRVIPKQADEFTCSSCF

SEQ ID NO: 1304352 - protein, 19 aa, Mycobacterium
TVRYRLRKMAEVTDLDLTD

SEQ ID NO: 1304353 - protein, 20 aa, Mycobacterium
TVSFTPVLIPTSRGILATCT

SEQ ID NO: 1304354 - protein, 24 aa, Mycobacterium
TVSVPVSFHELALGTTLSVPTLEG

SEQ ID NO: 1304355 - protein, 24 aa, Mycobacterium
TVTAMLAAFGRDIGYRIAHHPDLT

SEQ ID NO: 1304356 - protein, 25 aa, Mycobacterium
TVTAWRRRRGQPTPPPLLALETHGR

SEQ ID NO: 1304357 - protein, 17 aa, Mycobacterium
TVTERWVPLERVGLYVP

SEQ ID NO: 1304358 - protein, 39 aa, Mycobacterium
TVTPGAWHLARMLEALDTWPLNVVLLGKGNTVSAEAMWE

SEQ ID NO: 1304359 - protein, 18 aa, Mycobacterium
TVTPLRAFPVIRDLVTDV

SEQ ID NO: 1304360 - protein, 20 aa, Mycobacterium
TVTVAAWRPGGENTKDALRD

SEQ ID NO: 1304361 - protein, 25 aa, Mycobacterium
TVVADNMRLFDEHPWLADLESERAV

SEQ ID NO: 1304362 - protein, 27 aa, Mycobacterium
TVVALHRVAYLLYTQRARIERHGVLVI

SEQ ID NO: 1304363 - protein, 24 aa, Mycobacterium
TVVARASALLLRRGPEPPDDAWTS

SEQ ID NO: 1304364 - protein, 26 aa, Mycobacterium
TVVLKPAEFTPLSAGLWADIFRDAGV

SEQ ID NO: 1304365 - protein, 24 aa, Mycobacterium
TVVQTCVIHLIRGTFRYAGRQHRD

SEQ ID NO: 1304366 - protein, 28 aa, Mycobacterium
TVVRRGDTPLPVRTPLAVQLPEPMAAQL

SEQ ID NO: 1304367 - protein, 26 aa, Mycobacterium
TVVSPHRYFPRLRLELEQGLGWKADV

SEQ ID NO: 1304368 - protein, 23 aa, Mycobacterium
TVYIPTAIFDFPVTPSAAGPVKI

SEQ ID NO: 1304369 - protein, 29 aa, Mycobacterium
TWEHDLHLYLRRATLYRSLYGTPEDHNLR

SEQ ID NO: 1304370 - protein, 24 aa, Mycobacterium
TWHRTARLVGSYDWVLMALGAGPH

SEQ ID NO: 1304371 - protein, 18 aa, Mycobacterium
TWMFGVRICPDLDTCMYT

SEQ ID NO: 1304372 - protein, 20 aa, Mycobacterium
TWQGRFPYRNDGALGWVGTS

SEQ ID NO: 1304373 - protein, 17 aa, Mycobacterium
TWTHVHLMLTRDGQEQT

SEQ ID NO: 1304374 - protein, 18 aa, Mycobacterium
TYAKPRELRRLKALLRRS

SEQ ID NO: 1304375 - protein, 24 aa, Mycobacterium
TYDEYLHPARPRALRFRPRVKSPF

SEQ ID NO: 1304376 - protein, 21 aa, Mycobacterium
TYDSEAIHLSRVGFRSLLEVC

SEQ ID NO: 1304377 - protein, 18 aa, Mycobacterium
TYERAFSAAYDALGVLPP

SEQ ID NO: 1304378 - protein, 23 aa, Mycobacterium
TYGDSRMRWLRPGEVPTLGNWFR

SEQ ID NO: 1304379 - protein, 26 aa, Mycobacterium
TYLAFDLVHRLWLDAGHRVHYVQNIT

SEQ ID NO: 1304380 - protein, 18 aa, Mycobacterium
TYNLYGWTIHSDGFRTRI

SEQ ID NO: 1304381 - protein, 20 aa, Mycobacterium
TYPDIRCVYWAGGNPFHHHQ

SEQ ID NO: 1304382 - protein, 18 aa, Mycobacterium
TYSLLAGFAARLAERTGR

SEQ ID NO: 1304383 - protein, 21 aa, Mycobacterium
TYVVLLANAIHPRGNYPISEL

SEQ ID NO: 1304384 - protein, 19 aa, Mycobacterium
TYWDYTRLAFQKRRGMRID

SEQ ID NO: 1304385 - protein, 18 aa, Mycobacterium
VAAAHHFAPEVQLVLCAG

SEQ ID NO: 1304386 - protein, 29 aa, Mycobacterium
VAAECACDVSDLWIVGAPAAVAALVGNAT

SEQ ID NO: 1304387 - protein, 23 aa, Mycobacterium
VAAGVAWHAGAGRYRWLPANTGN

SEQ ID NO: 1304388 - protein, 19 aa, Mycobacterium
VAALAPSTFGLARAALLEQ

SEQ ID NO: 1304389 - protein, 23 aa, Mycobacterium
VAALIAGFFRAAPKQVPDLRLET

SEQ ID NO: 1304390 - protein, 22 aa, Mycobacterium
VAALRSIGIQPDALILRCDRDV

SEQ ID NO: 1304391 - protein, 19 aa, Mycobacterium
VAAPRPLDGPPRIVVSRTR

SEQ ID NO: 1304392 - protein, 17 aa, Mycobacterium
VAAPSLFGTPMKPPLGP

SEQ ID NO: 1304393 - protein, 30 aa, Mycobacterium
VAASGMVPPMAPLAPLLPAAADIGLHIIVT

SEQ ID NO: 1304394 - protein, 24 aa, Mycobacterium
VAATLENLAVLRTLVAAVGTFEDL

SEQ ID NO: 1304395 - protein, 18 aa, Mycobacterium
VAAWPGAWQGQNLRDILI

SEQ ID NO: 1304396 - protein, 17 aa, Mycobacterium
VAAYLPHSPLRVYTMGQ

SEQ ID NO: 1304397 - protein, 32 aa, Mycobacterium
VADDPCAILDAWAGARLAVVIDAAVATPSTPG

SEQ ID NO: 1304398 - protein, 30 aa, Mycobacterium
VADIARPYPIPIICALLGAPARDWARFSAW

SEQ ID NO: 1304399 - protein, 21 aa, Mycobacterium
VADIFFLVCDGLKGLPQSVGA

SEQ ID NO: 1304400 - protein, 25 aa, Mycobacterium
VADLSFISLATVLPALTACASPDAD

SEQ ID NO: 1304401 - protein, 18 aa, Mycobacterium
VADLVRRGVPALGVDQSA

SEQ ID NO: 1304402 - protein, 26 aa, Mycobacterium
VADNLPPELIARMVELGLAAGSRITQ

SEQ ID NO: 1304403 - protein, 23 aa, Mycobacterium
VAELERPVLLFSAGKDSIVLLRL

SEQ ID NO: 1304404 - protein, 25 aa, Mycobacterium
VAEVQTYVPGYRLLNDPQFDDPSIN

SEQ ID NO: 1304405 - protein, 22 aa, Mycobacterium
VAFFGHSMGGLLAFDIARRLER

SEQ ID NO: 1304406 - protein, 30 aa, Mycobacterium
VAFVGRIQPLKAPDILLRAAAKLPDVRVLV

SEQ ID NO: 1304407 - protein, 25 aa, Mycobacterium
VAFVNALPVFIASDPVWAKKFEDAG

SEQ ID NO: 1304408 - protein, 27 aa, Mycobacterium
VAGAAHFLEHLLFKSTPTRTAVDIAQA

SEQ ID NO: 1304409 - protein, 26 aa, Mycobacterium
VAGDRYAFAELFVRHQRQLERLARIT

SEQ ID NO: 1304410 - protein, 23 aa, Mycobacterium
VAGERFDLIVSNPPFVVGAGARD

SEQ ID NO: 1304411 - protein, 18 aa, Mycobacterium
VAGLIATGAIDIGIACGI

SEQ ID NO: 1304412 - protein, 38 aa, Mycobacterium
VAGLNTLHELFPPGELDWMVLFSSCGYLAGFPGQGAYA

SEQ ID NO: 1304413 - protein, 17 aa, Mycobacterium
VAGLPAGIAQRTSRAFR

SEQ ID NO: 1304414 - protein, 23 aa, Mycobacterium
VAGQFGMLLRLGADPTFVLSAGG

SEQ ID NO: 1304415 - protein, 18 aa, Mycobacterium
VAGTALIAGLLKGLLDAG

SEQ ID NO: 1304416 - protein, 27 aa, Mycobacterium
VAGYALGGGCELAMMCDILIAADTAKF

SEQ ID NO: 1304417 - protein, 18 aa, Mycobacterium
VAHGLWELFRRPEQLAQV

SEQ ID NO: 1304418 - protein, 18 aa, Mycobacterium
VAIAFPRNPIHLAHQAID

SEQ ID NO: 1304419 - protein, 18 aa, Mycobacterium
VAIAPRSYPPSREPIRRL

SEQ ID NO: 1304420 - protein, 35 aa, Mycobacterium
VAIDAASPIDLAAAANLNVAAPIDAAAGANVLSYG

SEQ ID NO: 1304421 - protein, 23 aa, Mycobacterium
VAIHPTQVAVIRDGYRPTDEQVD

SEQ ID NO: 1304422 - protein, 18 aa, Mycobacterium
VAIVCQLARTLFGADHPV

SEQ ID NO: 1304423 - protein, 18 aa, Mycobacterium
VAKPVDGGYLFNGRWQFS

SEQ ID NO: 1304424 - protein, 26 aa, Mycobacterium
VAKWVKIRDLGGFSGDFWEGGVGSIK

SEQ ID NO: 1304425 - protein, 19 aa, Mycobacterium
VALAHNSGYRTMMSHRSGE

SEQ ID NO: 1304426 - protein, 20 aa, Mycobacterium
VALAHVWRSYGVLPDITVGH

SEQ ID NO: 1304427 - protein, 30 aa, Mycobacterium
VALHSCAVGLPWKLLLRSRLQAVAVDAVTL

SEQ ID NO: 1304428 - protein, 17 aa, Mycobacterium
VALPLHPEYRTMPMVWY

SEQ ID NO: 1304429 - protein, 25 aa, Mycobacterium
VALRDGAVHVPRLVRRTGQPSGAPL

SEQ ID NO: 1304430 - protein, 18 aa, Mycobacterium
VALRDLMIQPVRSGYIGD

SEQ ID NO: 1304431 - protein, 17 aa, Mycobacterium
VALSWRARLQPMDEGWL

SEQ ID NO: 1304432 - protein, 19 aa, Mycobacterium
VALYGLLDALLFRGSLDAR

SEQ ID NO: 1304433 - protein, 26 aa, Mycobacterium
VAMDPQQRVALRLAWRALENSGINPD

SEQ ID NO: 1304434 - protein, 18 aa, Mycobacterium
VAMHLPHVGALQTKIVAE

SEQ ID NO: 1304435 - protein, 28 aa, Mycobacterium
VAMQFAYQFPQFVDRLILVGAGGVTKDV

SEQ ID NO: 1304436 - protein, 17 aa, Mycobacterium
VANVRRPVRLSQALATA

SEQ ID NO: 1304437 - protein, 25 aa, Mycobacterium
VAPLLTAKMYRELGRNAARHAKGMA

SEQ ID NO: 1304438 - protein, 18 aa, Mycobacterium
VAQDYLKTIWTAQEWSHE

SEQ ID NO: 1304439 - protein, 18 aa, Mycobacterium
VAQFAPLLCGGLPHHRER

SEQ ID NO: 1304440 - protein, 24 aa, Mycobacterium
VARAHEQFRWFAGGWAVNADLPTT

SEQ ID NO: 1304441 - protein, 17 aa, Mycobacterium
VARAWLDPDFKDLALRE

SEQ ID NO: 1304442 - protein, 18 aa, Mycobacterium
VARDNLRLLLNSPGGGGG

SEQ ID NO: 1304443 - protein, 28 aa, Mycobacterium
VAREGLRPFIFALWDMVRTYREAQPPVV

SEQ ID NO: 1304444 - protein, 21 aa, Mycobacterium
VARGSFFPVIPVCSSSGVGTM

SEQ ID NO: 1304445 - protein, 23 aa, Mycobacterium
VARIFAAALRRSPDLHLIAVVPR

SEQ ID NO: 1304446 - protein, 17 aa, Mycobacterium
VARIGVQPLLDELALVD

SEQ ID NO: 1304447 - protein, 24 aa, Mycobacterium
VARSNVLLLHTLGAEVVLVAPPTL

SEQ ID NO: 1304448 - protein, 24 aa, Mycobacterium
VARYSRHLIIPDLGLDGQKRLKNA

SEQ ID NO: 1304449 - protein, 23 aa, Mycobacterium
VASLFSRRGFNIQSLAVGATEQK

SEQ ID NO: 1304450 - protein, 26 aa, Mycobacterium
VASMQDRLPFFAGLEASQRASVHLVV

SEQ ID NO: 1304451 - protein, 27 aa, Mycobacterium
VATIGEATNLLLMRGMIGKPGAGLCPV

SEQ ID NO: 1304452 - protein, 24 aa, Mycobacterium
VATLQATLPAGWRNNPSQPQTTTW

SEQ ID NO: 1304453 - protein, 17 aa, Mycobacterium
VATVLGTVPRGLGKKLR

SEQ ID NO: 1304454 - protein, 17 aa, Mycobacterium
VAVEREIWSGKATFVFT

SEQ ID NO: 1304455 - protein, 24 aa, Mycobacterium
VAVFARNLKDLLLAAPAGSRTTLG

SEQ ID NO: 1304456 - protein, 24 aa, Mycobacterium
VAVGETGLDLYWPGKLDGCAEPEV

SEQ ID NO: 1304457 - protein, 31 aa, Mycobacterium
VAVLSQRPRMLFDYFQQLFAQVTNPPLDAIR

SEQ ID NO: 1304458 - protein, 32 aa, Mycobacterium
VAVRVGHHCAWPLHRRFGITATARASFAVYNT

SEQ ID NO: 1304459 - protein, 21 aa, Mycobacterium
VAVVIAVKRLADAKTRLAPIF

SEQ ID NO: 1304460 - protein, 17 aa, Mycobacterium
VAWADRIGVVPVAAITA

SEQ ID NO: 1304461 - protein, 26 aa, Mycobacterium
VAYAATKAFDMVFAEALWAELHDTGV

SEQ ID NO: 1304462 - protein, 19 aa, Mycobacterium
VAYSAWKFYQATGDLAYLI

SEQ ID NO: 1304463 - protein, 24 aa, Mycobacterium
VCGEKLWQSFIDYKRSEWTSYATA

SEQ ID NO: 1304464 - protein, 19 aa, Mycobacterium
VCPAPPARELDMLLTAGER

SEQ ID NO: 1304465 - protein, 25 aa, Mycobacterium
VCQDFAHLSLVLLRSMGIPARYVSG

SEQ ID NO: 1304466 - protein, 18 aa, Mycobacterium
VCRAIDCEVPPRGPQPVR

SEQ ID NO: 1304467 - protein, 17 aa, Mycobacterium
VCWMADASALEPGREYL

SEQ ID NO: 1304468 - protein, 26 aa, Mycobacterium
VCYLAMPLFHSNAVYAGWSVAVGAGA

SEQ ID NO: 1304469 - protein, 24 aa, Mycobacterium
VDAAAPGARLAWREDARWAPHGGE

SEQ ID NO: 1304470 - protein, 25 aa, Mycobacterium
VDAADLLVLMRIIVGRVARRHGLRV

SEQ ID NO: 1304471 - protein, 28 aa, Mycobacterium
VDAADWAEMLMRMYIRWAEQHDYPVEVF

SEQ ID NO: 1304472 - protein, 29 aa, Mycobacterium
VDAAFFTELAAYLRWERPPGLATPQCFVV

SEQ ID NO: 1304473 - protein, 27 aa, Mycobacterium
VDAENPPLRVFFGEVPLGIAKADYENR

SEQ ID NO: 1304474 - protein, 23 aa, Mycobacterium
VDAGSALMIMTLGAGNGAEVTVE

SEQ ID NO: 1304475 - protein, 22 aa, Mycobacterium
VDAILEHPVIQAVGFVGSSDIA

SEQ ID NO: 1304476 - protein, 23 aa, Mycobacterium
VDAIRAMRDGRAKVFIGMGGNFS

SEQ ID NO: 1304477 - protein, 29 aa, Mycobacterium
VDALREIGFFRAFVPAKYDGLSVLPSEFG

SEQ ID NO: 1304478 - protein, 20 aa, Mycobacterium
VDALVWTPSAIPVEVARGVR

SEQ ID NO: 1304479 - protein, 22 aa, Mycobacterium
VDAPLVFDWIDWQGVRRTDQPT

SEQ ID NO: 1304480 - protein, 28 aa, Mycobacterium
VDARSLEVYPGLWAGPSLLRDGAGTAAT

SEQ ID NO: 1304481 - protein, 26 aa, Mycobacterium
VDAVRVVNLLSWRYRDPGLLLAQRIG

SEQ ID NO: 1304482 - protein, 31 aa, Mycobacterium
VDDDRARQMLRFLSSPLWRAYTSTYVEGYRL

SEQ ID NO: 1304483 - protein, 27 aa, Mycobacterium
VDDPRQNRWWWDLLTHGRDSAYADYFD

SEQ ID NO: 1304484 - protein, 19 aa, Mycobacterium
VDDSFLLCFNAHDHVQDFV

SEQ ID NO: 1304485 - protein, 27 aa, Mycobacterium
VDDVSQLVFLHLRFHGYGDAKGPGKWT

SEQ ID NO: 1304486 - protein, 19 aa, Mycobacterium
VDECHYYRGIFGSNVALVL

SEQ ID NO: 1304487 - protein, 24 aa, Mycobacterium
VDEDGYLYLADRKSFMIISGGVNI

SEQ ID NO: 1304488 - protein, 26 aa, Mycobacterium
VDELLTGRENIRMIGGLYGIRRRELA

SEQ ID NO: 1304489 - protein, 30 aa, Mycobacterium; identical to SEQ ID NO: 1283028

SEQ ID NO: 1304490 - protein, 26 aa, Mycobacterium
VDFNDALLALLPLVGVWRGEGEGRGP

SEQ ID NO: 1304491 - protein, 18 aa, Mycobacterium
VDGAPLLRHRVELGTGSV

SEQ ID NO: 1304492 - protein, 32 aa, Mycobacterium
VDGDRFLRSRRPWIWGPRMLTGLDVSAGATLG

SEQ ID NO: 1304493 - protein, 23 aa, Mycobacterium
VDGETVVPLLPAQDFKRVGDGDT

SEQ ID NO: 1304494 - protein, 52 aa, Mycobacterium
VDGQHISTLLLTLLFRFMKPLIENGHVFLAQPPLYKLKWQRSTPEFAYSDRE

SEQ ID NO: 1304495 - protein, 29 aa, Mycobacterium
VDHYAEIGLLGFALITDALGGVDVCLKEP

SEQ ID NO: 1304496 - protein, 26 aa, Mycobacterium
VDIAAVSIWMGSLLTDRVRGIIASNQ

SEQ ID NO: 1304497 - protein, 25 aa, Mycobacterium
VDICPWALREGLILRKLDSEADGSA

SEQ ID NO: 1304498 - protein, 17 aa, Mycobacterium
VDILAKYALWSIATGRP

SEQ ID NO: 1304499 - protein, 24 aa, Mycobacterium
VDKQANLHIVIGKASFDEKKLAEN

SEQ ID NO: 1304500 - protein, 29 aa, Mycobacterium
VDLASVVSLLPPWAIRMGARAYRKLGMSR

SEQ ID NO: 1304501 - protein, 25 aa, Mycobacterium
VDLDLPRDALIVFTGLSGSGKSSLA

SEQ ID NO: 1304502 - protein, 26 aa, Mycobacterium
VDLLRADPVPIVSFTFGLPASDVIRA

SEQ ID NO: 1304503 - protein, 22 aa, Mycobacterium
VDLQLDFFISTSSIASVWGGFG

SEQ ID NO: 1304504 - protein, 17 aa, Mycobacterium
VDLTPARTWGASTLIPF

SEQ ID NO: 1304505 - protein, 18 aa, Mycobacterium
VDMKDMCGMMIAVARHFK

SEQ ID NO: 1304506 - protein, 33 aa, Mycobacterium
VDMLDNAYLGHVIVLWSWALKQPNDGRPASTTV

SEQ ID NO: 1304507 - protein, 23 aa, Mycobacterium
VDMTVQWAFDRHSFGRPLASYQA

SEQ ID NO: 1304508 - protein, 22 aa, Mycobacterium
VDNALRLLLLLGERSEIRLTDA

SEQ ID NO: 1304509 - protein, 26 aa, Mycobacterium
VDNQPGFLGFQLLRPVKGENRYFVVT

SEQ ID NO: 1304510 - protein, 18 aa, Mycobacterium
VDPGALVISWLFEAAADR

SEQ ID NO: 1304511 - protein, 22 aa, Mycobacterium
VDPSRPLLHGLLGDIDSAALSG

SEQ ID NO: 1304512 - protein, 24 aa, Mycobacterium
VDQPRHWVGHLRVLREIQDRTGGF

SEQ ID NO: 1304513 - protein, 29 aa, Mycobacterium
VDRLHVVALPMRVRFRGITVRELALIEGP

SEQ ID NO: 1304514 - protein, 19 aa, Mycobacterium
VDRLKLVGKLPAAVGIQIP

SEQ ID NO: 1304515 - protein, 26 aa, Mycobacterium
VDRPPESLLPTPAWYALDRGLIMADG

SEQ ID NO: 1304516 - protein, 17 aa, Mycobacterium
VDRQFGVAAPNVLLVAD

SEQ ID NO: 1304517 - protein, 22 aa, Mycobacterium
VDRWGAACSLIQSIYDGFGSGV

SEQ ID NO: 1304518 - protein, 24 aa, Mycobacterium
VDRYAEAYSLWRTLGGVLTPVSHQ

SEQ ID NO: 1304519 - protein, 25 aa, Mycobacterium
VDSEKLWDVSLAALYDRLGGVITDE

SEQ ID NO: 1304520 - protein, 21 aa, Mycobacterium
VDSLIELGGKTWRFVDTAGLR

SEQ ID NO: 1304521 - protein, 27 aa, Mycobacterium
VDSPDLPPLWQVFGAHRRPDGHWALPE

SEQ ID NO: 1304522 - protein, 23 aa, Mycobacterium
VDSPLLGYSYYGEVLLDWVVERL

SEQ ID NO: 1304523 - protein, 19 aa, Mycobacterium
VDTAWFTGNYPPEVSVEAA

SEQ ID NO: 1304524 - protein, 24 aa, Mycobacterium
VDTKVVELHLSGTRWDIRKAAVDE

SEQ ID NO: 1304525 - protein, 17 aa, Mycobacterium
VDTLVCQFGRSHQGFIP

SEQ ID NO: 1304526 - protein, 18 aa, Mycobacterium
VDTRIACGVISPASAETS

SEQ ID NO: 1304527 - protein, 22 aa, Mycobacterium
VDTRILLESWALREAAHRRPRP

SEQ ID NO: 1304528 - protein, 22 aa, Mycobacterium
VDTVFGVIYPPQVALVGFGKPV

SEQ ID NO: 1304529 - protein, 24 aa, Mycobacterium
VDVAQAYALLVKLAKQQNDSIEAV

SEQ ID NO: 1304530 - protein, 19 aa, Mycobacterium
VDVLRRELRRPSWTGETVA

SEQ ID NO: 1304531 - protein, 17 aa, Mycobacterium
VDVVRTATFLFAAGQET

SEQ ID NO: 1304532 - protein, 25 aa, Mycobacterium
VDWDELPRWSMIDKALGLNTPDPAE

SEQ ID NO: 1304533 - protein, 23 aa, Mycobacterium
VDYFCVGPCWPTPTKPGREAPGL

SEQ ID NO: 1304534 - protein, 23 aa, Mycobacterium
VEALGLERFPLMGVSQGGAVAVA

SEQ ID NO: 1304535 - protein, 17 aa, Mycobacterium
VEALWYSATLGSHRVAS

SEQ ID NO: 1304536 - protein, 21 aa, Mycobacterium
VEALYYMHPLTGDVVRRVDSL

SEQ ID NO: 1304537 - protein, 30 aa, Mycobacterium
VEARRRAIPIVLRPVVLAKLMAGHTTLMVT

SEQ ID NO: 1304538 - protein, 26 aa, Mycobacterium
VEATRAAAGLGLLPCFMADRHDDLVR

SEQ ID NO: 1304539 - protein, 23 aa, Mycobacterium
VECSQIEWSLMIDAGAEPGRAHA

SEQ ID NO: 1304540 - protein, 23 aa, Mycobacterium
VEDYLYNHPELLTAPLRVTIEHD

SEQ ID NO: 1304541 - protein, 27 aa, Mycobacterium
VEEIDALWPMVVLRTAVLIVSGAQQAE

SEQ ID NO: 1304542 - protein, 26 aa, Mycobacterium
VEEMGGMNLFFVFGSGGSARLVTPEL

SEQ ID NO: 1304543 - protein, 25 aa, Mycobacterium
VEFDRTQWRALRMSTPLKLTEDELK

SEQ ID NO: 1304544 - protein, 23 aa, Mycobacterium
VEFTLRTMLSFFVAPNPPSRSRD

SEQ ID NO: 1304545 - protein, 26 aa, Mycobacterium
VEGEEAVFPLLYLNRSANTDGGGAGR

SEQ ID NO: 1304546 - protein, 23 aa, Mycobacterium
VEHRTAVWLPVVDRVVVLGTRGE

SEQ ID NO: 1304547 - protein, 18 aa, Mycobacterium
VELALASYPGFHVTAPPG

SEQ ID NO: 1304548 - protein, 26 aa, Mycobacterium
VELEVVRILAPCRLLDDDIGAGAAAA

SEQ ID NO: 1304549 - protein, 21 aa, Mycobacterium
VELHRRLVRSGLPFGTCLRAT

SEQ ID NO: 1304550 - protein, 18 aa, Mycobacterium
VELKENIKRQWWRSVVTG

SEQ ID NO: 1304551 - protein, 25 aa, Mycobacterium
VELLAAVVNRVWFLDAVRGEADVYN

SEQ ID NO: 1304552 - protein, 27 aa, Mycobacterium
VELPQAPYLHLFVPRGEVTLEGAGALT

SEQ ID NO: 1304553 - protein, 18 aa, Mycobacterium
VELPVSWALDDWQQYCFV

SEQ ID NO: 1304554 - protein, 25 aa, Mycobacterium
VELQVVFDTLLRRIPDLRLATSLDE

SEQ ID NO: 1304555 - protein, 25 aa, Mycobacterium
VELVRRVLEELPFQTLATGYGLTEA

SEQ ID NO: 1304556 - protein, 28 aa, Mycobacterium
VELVSVKLPGRIFGSFFGLPPGEIHEKT

SEQ ID NO: 1304557 - protein, 26 aa, Mycobacterium
VEMENGYLLLMRVGDGSNLATLATRS

SEQ ID NO: 1304558 - protein, 26 aa, Mycobacterium
VEMGLARLWQSWGVTPDVVLGHSVGQ

SEQ ID NO: 1304559 - protein, 18 aa, Mycobacterium
VEMPHLGLGVLSGAAGLD

SEQ ID NO: 1304560 - protein, 19 aa, Mycobacterium
VEMYAVCDRLIDGIAGRFA

SEQ ID NO: 1304561 - protein, 25 aa, Mycobacterium
VEPNMRWRTFCAELLNIADKLNVQT

SEQ ID NO: 1304562 - protein, 32 aa, Mycobacterium
VEQMAGRWRVKHPDLIPLYQRARELAEGFDRV

SEQ ID NO: 1304563 - protein, 18 aa, Mycobacterium
VERIIDPLAKLISDARSR

SEQ ID NO: 1304564 - protein, 36 aa, Mycobacterium
VERLDVFQRTPIWCFPKFDVPLPRALRGAMRLPGGK

SEQ ID NO: 1304565 - protein, 23 aa, Mycobacterium
VERPRVRWKILDAWQAAAAQVGI

SEQ ID NO: 1304566 - protein, 25 aa, Mycobacterium
VERRYRAWIRWNAAIMVHRAQRPGV

SEQ ID NO: 1304567 - protein, 23 aa, Mycobacterium
VERTPGMRAKLFDAARLAAEAIG

SEQ ID NO: 1304568 - protein, 25 aa, Mycobacterium
VERVWQIYADPRQLEKIWGPPDYPA

SEQ ID NO: 1304569 - protein, 18 aa, Mycobacterium
VESVAPDLMPRLTKYEPA

SEQ ID NO: 1304570 - protein, 27 aa, Mycobacterium
VETASVWFTAYPLSLITRPNESFLKAL

SEQ ID NO: 1304571 - protein, 24 aa, Mycobacterium
VETHLEWQMTPYTDPSWDIKGCYI

SEQ ID NO: 1304572 - protein, 23 aa, Mycobacterium
VETPRLVGLYKSGLLKVDEMVTN

SEQ ID NO: 1304573 - protein, 26 aa, Mycobacterium
VETRTELLRLQRRLGITSLYVTHDQE

SEQ ID NO: 1304574 - protein, 22 aa, Mycobacterium
VEVDLLGQWRTVRATLPAVIAA

SEQ ID NO: 1304575 - protein, 30 aa, Mycobacterium
VEVFNSALSAPLYWIATNAGLDGSVVVNKV

SEQ ID NO: 1304576 - protein, 34 aa, Mycobacterium; identical to SEQ ID NO: 871657

SEQ ID NO: 1304577 - protein, 24 aa, Mycobacterium
VEVIPDVLRHRLVLTYDALADEVS

SEQ ID NO: 1304578 - protein, 34 aa, Mycobacterium
VEYEPFGTVLIIGAWNFPFALTLGPAVGAIAAGN

SEQ ID NO: 1304579 - protein, 25 aa, Mycobacterium
VEYLRARYDALVPNPLFATMEYIDD

SEQ ID NO: 1304580 - protein, 28 aa, Mycobacterium
VFAGVLAVHWRSGHENALRRACVAGALA

SEQ ID NO: 1304581 - protein, 19 aa, Mycobacterium
VFCRRWGVPLIDGGTVRLP

SEQ ID NO: 1304582 - protein, 24 aa, Mycobacterium
VFENPYQFDILRNPNPHVGFGGTG

SEQ ID NO: 1304583 - protein, 23 aa, Mycobacterium
VFGELAPHPLLTHAVDQTGRSLD

SEQ ID NO: 1304584 - protein, 24 aa, Mycobacterium
VFHTIQAVLPDMLEAGWGRIVNIS

SEQ ID NO: 1304585 - protein, 22 aa, Mycobacterium
VFHYTRKWLQRMTAVNMDRSVA

SEQ ID NO: 1304586 - protein, 17 aa, Mycobacterium
VFLMNAAANRDPRAFDN

SEQ ID NO: 1304587 - protein, 18 aa, Mycobacterium
VFLVQHALPHLKASAHAA

SEQ ID NO: 1304588 - protein, 20 aa, Mycobacterium
VFPNLSFLNVLIGRDKKSMP

SEQ ID NO: 1304589 - protein, 22 aa, Mycobacterium
VFQRTAQWMFPNPNYHAPVGDG

SEQ ID NO: 1304590 - protein, 27 aa, Mycobacterium
VFTECRLRPLTLVEVDLTLAVLGGCDL

SEQ ID NO: 1304591 - protein, 17 aa, Mycobacterium
VFTLTTLRDHALLQRLL

SEQ ID NO: 1304592 - protein, 19 aa, Mycobacterium
VFVIRPDGYLGFAAHRLDT

SEQ ID NO: 1304593 - protein, 17 aa, Mycobacterium
VFVLAATSNPEGASVQR

SEQ ID NO: 1304594 - protein, 26 aa, Mycobacterium
VFVPAERTFPLFARRPLRGDSPAARM

SEQ ID NO: 1304595 - protein, 17 aa, Mycobacterium
VFWVTTHDPRTLKEKDM

SEQ ID NO: 1304596 - protein, 22 aa, Mycobacterium
VGAFLAWGDPSLYDSTLRILDR

SEQ ID NO: 1304597 - protein, 18 aa, Mycobacterium
VGAFTRLGLLSTNNDDPA

SEQ ID NO: 1304598 - protein, 27 aa, Mycobacterium
VGAIANWRLFSILLRSLNIPLESGTDG

SEQ ID NO: 1304599 - protein, 26 aa, Mycobacterium
VGAITPWNVPFYLNVAETVPALMAGN

SEQ ID NO: 1304600 - protein, 17 aa, Mycobacterium
VGARFRPGGFAARFDRD

SEQ ID NO: 1304601 - protein, 35 aa, Mycobacterium
VGASVGLMQTLWRSRLIAPMRPDRYLKMGAAVRRV

SEQ ID NO: 1304602 - protein, 34 aa, Mycobacterium
VGATKGLIYYHFRSKFDIFLAVYQDGMRRVRERV

SEQ ID NO: 1304603 - protein, 23 aa, Mycobacterium
VGATRTPFPPSIVYVGKTDYLMT

SEQ ID NO: 1304604 - protein, 28 aa, Mycobacterium
VGAVHYPWLPVRRLLLDRYPSIERIAGI

SEQ ID NO: 1304605 - protein, 23 aa, Mycobacterium
VGCIPTKMFVYSAGIAQNVGDSA

SEQ ID NO: 1304606 - protein, 18 aa, Mycobacterium
VGCYNCSGLRNAVGLRDV

SEQ ID NO: 1304607 - protein, 34 aa, Mycobacterium
VGDPEAMRRLPVTPYGFRLRPVADIVAALERAGL

SEQ ID NO: 1304608 - protein, 24 aa, Mycobacterium
VGDRWTLLIVRELLDRPRRYGDLL

SEQ ID NO: 1304609 - protein, 20 aa, Mycobacterium
VGDVRGEGFFYGIELVKDKA

SEQ ID NO: 1304610 - protein, 24 aa, Mycobacterium
VGEIPIRIYHPAGAGPLPVLVYAH

SEQ ID NO: 1304611 - protein, 27 aa, Mycobacterium
VGEIYEDLAWFCIRAWRFGASERLGAG

SEQ ID NO: 1304612 - protein, 26 aa, Mycobacterium
VGETMPQRAGALTAPLLVVHGEKDRL

SEQ ID NO: 1304613 - protein, 23 aa, Mycobacterium
VGETTLGERLVLSSGFVAVTVVV

SEQ ID NO: 1304614 - protein, 23 aa, Mycobacterium
VGFTAMNFLYHLMNMIAEGVFER

SEQ ID NO: 1304615 - protein, 20 aa, Mycobacterium
VGGDWYDVVDLDGDCIALVV

SEQ ID NO: 1304616 - protein, 30 aa, Mycobacterium
VGGFGLAGIPWFLIEALLDQGADDLTIVSN

SEQ ID NO: 1304617 - protein, 26 aa, Mycobacterium
VGGGTPFFPTLPSWISLRLLENRTFP

SEQ ID NO: 1304618 - protein, 24 aa, Mycobacterium
VGGGWFGYLSYPDPGADGAGPRIP

SEQ ID NO: 1304619 - protein, 25 aa, Mycobacterium
VGGHLTLLRRTRVGRFGLDEAYPLD

SEQ ID NO: 1304620 - protein, 23 aa, Mycobacterium
VGGLFEILRRWIDGQLNLSTEML

SEQ ID NO: 1304621 - protein, 38 aa, Mycobacterium
VGGQLLPQAHAWVAQLWTPPFASEPLRRRLRSTVGSAS

SEQ ID NO: 1304622 - protein, 18 aa, Mycobacterium
VGGTWWQNTYPGARVDVG

SEQ ID NO: 1304623 - protein, 21 aa, Mycobacterium
VGHGTPMRRLIESGALRGDRF

SEQ ID NO: 1304624 - protein, 17 aa, Mycobacterium
VGHMVLCNQFRHPALLA

SEQ ID NO: 1304625 - protein, 20 aa, Mycobacterium
VGHPYMAQILIKAEPRPSWG

SEQ ID NO: 1304626 - protein, 28 aa, Mycobacterium
VGIVGPWNFPVNLVVLPAAAAFAAGNRV

SEQ ID NO: 1304627 - protein, 29 aa, Mycobacterium
VGKGTLFRRFGSRAGLMVVLLDEDEKAQQ

SEQ ID NO: 1304628 - protein, 23 aa, Mycobacterium
VGKSTLFNALTRNNVLAANYPFA

SEQ ID NO: 1304629 - protein, 29 aa, Mycobacterium
VGKSTLLLEVAHRWAVSGRRALYLTGEES

SEQ ID NO: 1304630 - protein, 28 aa, Mycobacterium
VGKTTVYRRWPNVWALVVDAFLEDVSAV

SEQ ID NO: 1304631 - protein, 22 aa, Mycobacterium
VGLALAPLLHDGVKINLIDTPG

SEQ ID NO: 1304632 - protein, 19 aa, Mycobacterium
VGLAQRWLRSGGRVAVEHD

SEQ ID NO: 1304633 - protein, 34 aa, Mycobacterium
VGLARMEFVISEYIRFHPLALLHPEKVDDPAIRR

SEQ ID NO: 1304634 - protein, 21 aa, Mycobacterium
VGLHPFGRFEGKSAMQMGVDA

SEQ ID NO: 1304635 - protein, 34 aa, Mycobacterium
VGLRSSYVAAWYAAPLLLRGPRGLIAFTSSPGSV

SEQ ID NO: 1304636 - protein, 17 aa, Mycobacterium
VGLWGYSGGGLASAWAA

SEQ ID NO: 1304637 - protein, 17 aa, Mycobacterium
VGMVGLSGIPFTNVFNA

SEQ ID NO: 1304638 - protein, 18 aa, Mycobacterium
VGPLCLPTLSIHGYEVIS

SEQ ID NO: 1304639 - protein, 27 aa, Mycobacterium
VGPPELYAWLHYDPIPQRDDLAKALIA

SEQ ID NO: 1304640 - protein, 25 aa, Mycobacterium
VGPPPERFLVGLAVLSLVAAAVHEQ

SEQ ID NO: 1304641 - protein, 17 aa, Mycobacterium
VGPWFRWASVGVDCAAA

SEQ ID NO: 1304642 - protein, 21 aa, Mycobacterium
VGQIYLLDNPLLREELRAEHV

SEQ ID NO: 1304643 - protein, 25 aa, Mycobacterium
VGQSYPFAPPVGLMFVLWDEEAERD

SEQ ID NO: 1304644 - protein, 21 aa, Mycobacterium
VGQYYNFLRLGRGGYAQVMQS

SEQ ID NO: 1304645 - protein, 35 aa, Mycobacterium
VGRGSPWAAPLSWLVPPRVAMQILLTGDPITAERA

SEQ ID NO: 1304646 - protein, 25 aa, Mycobacterium
VGRLTAHLPSARRLLLIKSDGSVSV

SEQ ID NO: 1304647 - protein, 25 aa, Mycobacterium
VGSALPEFALLMRDQICAAIGVDAG

SEQ ID NO: 1304648 - protein, 26 aa, Mycobacterium
VGSATYSLLPALVRALREALPGVDVN

SEQ ID NO: 1304649 - protein, 18 aa, Mycobacterium
VGSDEPFWKQTFSEFSTL

SEQ ID NO: 1304650 - protein, 35 aa, Mycobacterium
VGSFNFSMLLHGSQQIRLFAPLKPAGRLSVVSEVA

SEQ ID NO: 1304651 - protein, 27 aa, Mycobacterium
VGVLQLRMYRPFPVEALAAALPETVRT

SEQ ID NO: 1304652 - protein, 21 aa, Mycobacterium
VGVPLSFLDPVVDPLGELIGR

SEQ ID NO: 1304653 - protein, 33 aa, Mycobacterium
VGVVFEKRPLFLKLLLMLVLERGDGDPGVLRIA

SEQ ID NO: 1304654 - protein, 25 aa, Mycobacterium
VGYGRLGHWFWGFEQQGVVPDIVSM

SEQ ID NO: 1304655 - protein, 28 aa, Mycobacterium
VGYKVMATPSTLATLRRGTESRLVTAMI

SEQ ID NO: 1304656 - protein, 22 aa, Mycobacterium
VHAALRQVLGPNAVQAGSLNRP

SEQ ID NO: 1304657 - protein, 35 aa, Mycobacterium
VHADQVPQMRLVANPYLIPVLRISGIDQLATVEPA

SEQ ID NO: 1304658 - protein, 20 aa, Mycobacterium
VHAQFTSEDYWRELTDVYRA

SEQ ID NO: 1304659 - protein, 23 aa, Mycobacterium
VHDQVRFRTVLYTTLETVRIAAL

SEQ ID NO: 1304660 - protein, 25 aa, Mycobacterium
VHEGQDWMYVLSGRLRLILGDRDFI

SEQ ID NO: 1304661 - protein, 38 aa, Mycobacterium
VHEPIGVCVLIAPWNYPLLQMSWKVAPALAAGCTMVMK

SEQ ID NO: 1304662 - protein, 23 aa, Mycobacterium
VHGDLYGTVLFAGAAAPGITDIT

SEQ ID NO: 1304663 - protein, 25 aa, Mycobacterium
VHGHRTQLELGGKAPFVVFDDADLD

SEQ ID NO: 1304664 - protein, 19 aa, Mycobacterium
VHIALWQRTGGPGGGLTDA

SEQ ID NO: 1304665 - protein, 26 aa, Mycobacterium
VHKVDAANGVLLIKGAIPGRNGGLVM

SEQ ID NO: 1304666 - protein, 19 aa, Mycobacterium
VHMLESAWNITEPVQLMVH

SEQ ID NO: 1304667 - protein, 25 aa, Mycobacterium
VHNSQPWHWVADRSGLQLLLDTDRL

SEQ ID NO: 1304668 - protein, 17 aa, Mycobacterium
VHQAFARALATRDRGLV

SEQ ID NO: 1304669 - protein, 18 aa, Mycobacterium
VHVRIASPPVRWPCFYGI

SEQ ID NO: 1304670 - protein, 24 aa, Mycobacterium
VHYASRPTLVAPAPMLADEYDALA

SEQ ID NO: 1304671 - protein, 17 aa, Mycobacterium
VHYTRTPDEFSWRAGEV

SEQ ID NO: 1304672 - protein, 23 aa, Mycobacterium
VHYYTMGEGRWKSSRSWPPPAEP

SEQ ID NO: 1304673 - protein, 28 aa, Mycobacterium
VIAANPKLFFQIYWLGGREAILERAQRA

SEQ ID NO: 1304674 - protein, 20 aa, Mycobacterium
VIAVPVRRPRRRAAARPAGP

SEQ ID NO: 1304675 - protein, 23 aa, Mycobacterium
VIDDDPYPVWKRMRAEAPLYRNS

SEQ ID NO: 1304676 - protein, 18 aa, Mycobacterium
VIDFGAVAPLPGGLPVEL

SEQ ID NO: 1304677 - protein, 26 aa, Mycobacterium
VIDPLPNLLFTRDSSFWIGPRVAITS

SEQ ID NO: 1304678 - protein, 28 aa, Mycobacterium
VIEGMMALTGYYAWHRICVDRKVLPGMQ

SEQ ID NO: 1304679 - protein, 21 aa, Mycobacterium
VIERSIIGFGARIGPRALIRD

SEQ ID NO: 1304680 - protein, 19 aa, Mycobacterium
VIFMNAWLDAVGTHNRYFV

SEQ ID NO: 1304681 - protein, 21 aa, Mycobacterium
VIFPDGRLVDAPLPTWTHVHL

SEQ ID NO: 1304682 - protein, 26 aa, Mycobacterium
VIGIGWIPENILRDLGTRRALIHVRD

SEQ ID NO: 1304683 - protein, 30 aa, Mycobacterium; identical to SEQ ID NO: 1249239

SEQ ID NO: 1304684 - protein, 26 aa, Mycobacterium
VIGQGSIGLLFSYLAKAAGAQHVTGV

SEQ ID NO: 1304685 - protein, 21 aa, Mycobacterium
VIGTHRLLQTGVVWKDLGLII

SEQ ID NO: 1304686 - protein, 21 aa, Mycobacterium
VIHTVWSPDGWVSIAGRVVAD

SEQ ID NO: 1304687 - protein, 21 aa, Mycobacterium
VIKPGWGFTFDYQPGQYIGIG

SEQ ID NO: 1304688 - protein, 18 aa, Mycobacterium
VILDRKGNRHFSFGIGVH

SEQ ID NO: 1304689 - protein, 17 aa, Mycobacterium
VIMPRFDLTEFLANIAD

SEQ ID NO: 1304690 - protein, 17 aa, Mycobacterium
VIPCHRVVRSDGTAGQY

SEQ ID NO: 1304691 - protein, 20 aa, Mycobacterium
VIPVAHWRYEISPTASGCRV

SEQ ID NO: 1304692 - protein, 28 aa, Mycobacterium
VIQRELDRYLPFLATTRILIAAVRAGVG

SEQ ID NO: 1304693 - protein, 23 aa, Mycobacterium
VIRGRLTLGVLVAAAPEVADGDG

SEQ ID NO: 1304694 - protein, 31 aa, Mycobacterium
VIRRVSAAWQLPLEWLNVPVGGVALDVGSGP

SEQ ID NO: 1304695 - protein, 25 aa, Mycobacterium
VISDGELFIIGRIKDLLIVDGSNHY

SEQ ID NO: 1304696 - protein, 25 aa, Mycobacterium
VITEVTLRLLPPQPSPCTVVATFDS

SEQ ID NO: 1304697 - protein, 18 aa, Mycobacterium
VITINDYLARRDAEWMGP

SEQ ID NO: 1304698 - protein, 22 aa, Mycobacterium
VIVGHCYPSMEAPAIGRVIALD

SEQ ID NO: 1304699 - protein, 17 aa, Mycobacterium
VIVLRANGKHFSAGHDL

SEQ ID NO: 1304700 - protein, 19 aa, Mycobacterium
VIYVIQLYRHMISPLRYPS

SEQ ID NO: 1304701 - protein, 25 aa, Mycobacterium
VKAANFPYRYPWRDVERQLQRMAGL

SEQ ID NO: 1304702 - protein, 23 aa, Mycobacterium
VKARMGWDIPWFTITDDFDADFG

SEQ ID NO: 1304703 - protein, 23 aa, Mycobacterium
VKAYAAGLAAWWTVLEHTGTDWR

SEQ ID NO: 1304704 - protein, 30 aa, Mycobacterium
VKDGYGRNYLLPRGLAIVASRGAQRQADDI

SEQ ID NO: 1304705 - protein, 41 aa, Mycobacterium
VKEPVGVCGLITPWNWPINQIACKVFPALATGCTMVLKPSE

SEQ ID NO: 1304706 - protein, 24 aa, Mycobacterium
VKGEWGRTQYPIVPGHEIAGVVTE

SEQ ID NO: 1304707 - protein, 17 aa, Mycobacterium
VKLVDVPTPLAAAGIDE

SEQ ID NO: 1304708 - protein, 24 aa, Mycobacterium
VKMDPQQRLLLEVAWEALEHAGIP

SEQ ID NO: 1304709 - protein, 26 aa, Mycobacterium
VKNNLQTVAALLRLQARRTNNAEGRE

SEQ ID NO: 1304710 - protein, 29 aa, Mycobacterium
VKPAQETPLTMLYLAKLMAEAGLPKGVLS

SEQ ID NO: 1304711 - protein, 28 aa, Mycobacterium
VKPFVLAELVARVKALLRRRGSSATFSS

SEQ ID NO: 1304712 - protein, 21 aa, Mycobacterium
VKQGWFCCWNGANQLHVSTGV

SEQ ID NO: 1304713 - protein, 26 aa, Mycobacterium
VKRKSFVDQPYWGRPAPGWGDTHPRI

SEQ ID NO: 1304714 - protein, 27 aa, Mycobacterium
VKRQAALNRLLFPGPTKEFEAHRETYG

SEQ ID NO: 1304715 - protein, 23 aa, Mycobacterium
VKRRDRALLSKDATIREIHHRVK

SEQ ID NO: 1304716 - protein, 24 aa, Mycobacterium
VKVAHAPLLVLLAELMEEASAAGQ

SEQ ID NO: 1304717 - protein, 34 aa, Mycobacterium
VKVKPTSVPAFRPGAQFKAIVSGAQKLASEGPAV

SEQ ID NO: 1304718 - protein, 24 aa, Mycobacterium
VKVNRLLLRNVSVVGVGWGEFVRR

SEQ ID NO: 1304719 - protein, 18 aa, Mycobacterium
VKVTVRWWHGDVDHIIPF

SEQ ID NO: 1304720 - protein, 17 aa, Mycobacterium
VKVWIYKGDIVGGKREL

SEQ ID NO: 1304721 - protein, 17 aa, Mycobacterium
VLAALPKSAHPSALAAL

SEQ ID NO: 1304722 - protein, 21 aa, Mycobacterium
VLAARYELLDARLGEAGFDWY

SEQ ID NO: 1304723 - protein, 32 aa, Mycobacterium
VLAAVLDTLLKLLHPVMPFVTEVLWKTLTGGA

SEQ ID NO: 1304724 - protein, 17 aa, Mycobacterium
VLADRLNRWRRLGCWVS

SEQ ID NO: 1304725 - protein, 25 aa, Mycobacterium
VLAEDIELVLLDNFPVWQTQIAVQR

SEQ ID NO: 1304726 - protein, 24 aa, Mycobacterium
VLAIERVEYRLLGPEYKSPRLVKP

SEQ ID NO: 1304727 - protein, 24 aa, Mycobacterium
VLAIRMRVLPPTHVLTEKLNSLNE

SEQ ID NO: 1304728 - protein, 18 aa, Mycobacterium
VLAMIGVDLSRLAEDIIL

SEQ ID NO: 1304729 - protein, 26 aa, Mycobacterium
VLARVPLHSMLLLEAQFAVATAAAYV

SEQ ID NO: 1304730 - protein, 24 aa, Mycobacterium
VLATMNFPSFPGFAARLFATEDPD

SEQ ID NO: 1304731 - protein, 18 aa, Mycobacterium
VLATWKLGAVPQPLSARL

SEQ ID NO: 1304732 - protein, 19 aa, Mycobacterium
VLATWRRMFPSITGSEDYC

SEQ ID NO: 1304733 - protein, 36 aa, Mycobacterium
VLCFGQRVIGLELARRLAREWLNYEFDPASKSADKV

SEQ ID NO: 1304734 - protein, 25 aa, Mycobacterium
VLCQLWGPMTALPPAIPRFTRELRQ

SEQ ID NO: 1304735 - protein, 19 aa, Mycobacterium
VLDDADFNSALPLAAMMAC

SEQ ID NO: 1304736 - protein, 24 aa, Mycobacterium
VLDRYDYVLIDCQPSLGLLTVNGL

SEQ ID NO: 1304737 - protein, 19 aa, Mycobacterium
VLDTADGFHPLWAHDRPQE

SEQ ID NO: 1304738 - protein, 22 aa, Mycobacterium
VLEAIAFGFRHHTDVFTSIGVP

SEQ ID NO: 1304739 - protein, 28 aa, Mycobacterium
VLESRPDLVPLFLNALPVVMADAVDISN

SEQ ID NO: 1304740 - protein, 22 aa, Mycobacterium
VLFSSISGILGSRWLAHYTATT

SEQ ID NO: 1304741 - protein, 33 aa, Mycobacterium
VLGLVVELLTRRRIFVPILRVTAIEPSAVTLTT

SEQ ID NO: 1304742 - protein, 17 aa, Mycobacterium
VLGQSAHLWTRTSLRPS

SEQ ID NO: 1304743 - protein, 26 aa, Mycobacterium
VLGVHDLVLAVLPGMVARRSGGILIS

SEQ ID NO: 1304744 - protein, 28 aa, Mycobacterium
VLHEVRLMLEQYWPSVPHVMIEPGVRTG

SEQ ID NO: 1304745 - protein, 18 aa, Mycobacterium
VLIRFTNELLRQSVIGLD

SEQ ID NO: 1304746 - protein, 18 aa, Mycobacterium
VLIVHWHDLGRYLGAYGH

SEQ ID NO: 1304747 - protein, 28 aa, Mycobacterium
VLKPDPHTPWNATRLGRLIAERTDIPPG

SEQ ID NO: 1304748 - protein, 17 aa, Mycobacterium
VLLFSHRSYLDGGVVPV

SEQ ID NO: 1304749 - protein, 17 aa, Mycobacterium
VLLLRESNGDRYLPIWI

SEQ ID NO: 1304750 - protein, 19 aa, Mycobacterium
VLLTVRTTQSGIPIAMAAR

SEQ ID NO: 1304751 - protein, 19 aa, Mycobacterium
VLLVEPFYDSYSPVLAMAG

SEQ ID NO: 1304752 - protein, 17 aa, Mycobacterium
VLMALGAGPHVELNWAI

SEQ ID NO: 1304753 - protein, 18 aa, Mycobacterium
VLNLPPFDRGSVLVAGPD

SEQ ID NO: 1304754 - protein, 18 aa, Mycobacterium
VLNRLRRAQGQLGGVISM

SEQ ID NO: 1304755 - protein, 22 aa, Mycobacterium
VLPAEWNCELTWPSRPVAGGER

SEQ ID NO: 1304756 - protein, 20 aa, Mycobacterium
VLPDAMFTERTLAEVRRRGW

SEQ ID NO: 1304757 - protein, 18 aa, Mycobacterium
VLPELRALARQIGVEGAS

SEQ ID NO: 1304758 - protein, 27 aa, Mycobacterium
VLPIAQQYGLGVLVWGPLGQGMLTGRV

SEQ ID NO: 1304759 - protein, 22 aa, Mycobacterium
VLPTILLPIWDSELGHGFIATL

SEQ ID NO: 1304760 - protein, 31 aa, Mycobacterium
VLPTIRSRTHHYPFRLLAPKTMRTLLERICA

SEQ ID NO: 1304761 - protein, 17 aa, Mycobacterium
VLPYGPIELDPSAVVLH

SEQ ID NO: 1304762 - protein, 32 aa, Mycobacterium
VLQARPDGPGWWWQTWHLYPGGPRVPGGTAVH

SEQ ID NO: 1304763 - protein, 23 aa, Mycobacterium
VLQPGRFDVVVGSNLFGDILSDL

SEQ ID NO: 1304764 - protein, 26 aa, Mycobacterium
VLQRFPQIAQYYRRRFRHILVDEYQD

SEQ ID NO: 1304765 - protein, 18 aa, Mycobacterium
VLRFGKLQQFASPNELYD

SEQ ID NO: 1304766 - protein, 26 aa, Mycobacterium
VLRGAGLRLLVPDQHWTKVLKFVNET

SEQ ID NO: 1304767 - protein, 19 aa, Mycobacterium
VLRGLHFAAVPPGQAKYVT

SEQ ID NO: 1304768 - protein, 17 aa, Mycobacterium
VLRLSALRGLFSTVTDQ

SEQ ID NO: 1304769 - protein, 20 aa, Mycobacterium
VLRNLWAYVVIFCGHFPDGA

SEQ ID NO: 1304770 - protein, 24 aa, Mycobacterium
VLRPGLLVMAVRGAARYFGSEQAA

SEQ ID NO: 1304771 - protein, 17 aa, Mycobacterium
VLRQVVAAIHRAADDDR

SEQ ID NO: 1304772 - protein, 22 aa, Mycobacterium
VLRRHFSDALPVRVCALRTDPW

SEQ ID NO: 1304773 - protein, 17 aa, Mycobacterium
VLRWIGMDMGKLVDRPL

SEQ ID NO: 1304774 - protein, 28 aa, Mycobacterium
VLSIAHAQRWRFDGITPIGPDVLLSLVP

SEQ ID NO: 1304775 - protein, 17 aa, Mycobacterium
VLSLVDCPGYMVGPAAE

SEQ ID NO: 1304776 - protein, 31 aa, Mycobacterium
VLTCGTYGNVLRFLPPLAISDELLDEGLDVV

SEQ ID NO: 1304777 - protein, 18 aa, Mycobacterium
VLTELYRGLTEVVTASVA

SEQ ID NO: 1304778 - protein, 18 aa, Mycobacterium
VLTILPGTLPADELERRL

SEQ ID NO: 1304779 - protein, 17 aa, Mycobacterium
VLTVRFDQTGDEETFLL

SEQ ID NO: 1304780 - protein, 17 aa, Mycobacterium
VLVAMNHLWEIGVPRRD

SEQ ID NO: 1304781 - protein, 19 aa, Mycobacterium
VLVAQAWHWFDPERAVKEV

SEQ ID NO: 1304782 - protein, 23 aa, Mycobacterium
VLVDLYPLVRKSFRIGTENYSLK

SEQ ID NO: 1304783 - protein, 24 aa, Mycobacterium
VLVDPPYPVIIGTGLLGELGRLLE

SEQ ID NO: 1304784 - protein, 32 aa, Mycobacterium
VLVGQPTLRHRLRLGVLAALDQRIAVRYTLPG

SEQ ID NO: 1304785 - protein, 21 aa, Mycobacterium
VLVIGPNPAFLDHISRVLPSL

SEQ ID NO: 1304786 - protein, 17 aa, Mycobacterium
VLVLSHYVEQRYAAELI

SEQ ID NO: 1304787 - protein, 18 aa, Mycobacterium
VLVMAAAVADFRPVHAAT

SEQ ID NO: 1304788 - protein, 18 aa, Mycobacterium
VLVPHLPGEPIGPKALGE

SEQ ID NO: 1304789 - protein, 18 aa, Mycobacterium
VLVSGRLLSDITKALPAK

SEQ ID NO: 1304790 - protein, 26 aa, Mycobacterium
VLVTEPLAYPVLVGALAASTLVLSDS

SEQ ID NO: 1304791 - protein, 28 aa, Mycobacterium
VMGEQVYFVGIWYVDEFVRTAEGWRMTR

SEQ ID NO: 1304792 - protein, 20 aa, Mycobacterium
VMGPFTPMPFTPEGDDICAQ

SEQ ID NO: 1304793 - protein, 20 aa, Mycobacterium
VMIGSWFAGTYESPGDLMHD

SEQ ID NO: 1304794 - protein, 19 aa, Mycobacterium
VMLLVAHHIAWDDGSWEVF

SEQ ID NO: 1304795 - protein, 18 aa, Mycobacterium
VMLPDNELRRIAALCAAF

SEQ ID NO: 1304796 - protein, 41 aa, Mycobacterium
VMMNGMGFGRPLDFEPLLKTPGFIEIAWRAPIHLMAAGLGV

SEQ ID NO: 1304797 - protein, 17 aa, Mycobacterium
VMPMRVVGMLFGIPEDY

SEQ ID NO: 1304798 - protein, 18 aa, Mycobacterium
VMRDWPDYPFTYGGVDAA

SEQ ID NO: 1304799 - protein, 25 aa, Mycobacterium
VMSLPPRVIGWWRHTHDFADAGAGR

SEQ ID NO: 1304800 - protein, 25 aa, Mycobacterium
VMVLPPLSALWFEPVAAEAPVVQEP

SEQ ID NO: 1304801 - protein, 17 aa, Mycobacterium
VMYLGRIVEIGPADQVI

SEQ ID NO: 1304802 - protein, 19 aa, Mycobacterium
VNARPKPLAAYLFTKTKAI

SEQ ID NO: 1304803 - protein, 19 aa, Mycobacterium
VNCLAAYHRFGTAAIVVDF

SEQ ID NO: 1304804 - protein, 23 aa, Mycobacterium
VNDFGLLNVLVNNAGIVALGQIG

SEQ ID NO: 1304805 - protein, 19 aa, Mycobacterium
VNDGWRLARTTLANERIAM

SEQ ID NO: 1304806 - protein, 26 aa, Mycobacterium
VNDQPWRADLLGKRLHGALGPLVHVN

SEQ ID NO: 1304807 - protein, 23 aa, Mycobacterium
VNDVILAMCAGALRFYLTEQNAL

SEQ ID NO: 1304808 - protein, 40 aa, Mycobacterium
VNEELIGILGGETRPLVFAKTPPTVIMLAGLQGSGKTTLA

SEQ ID NO: 1304809 - protein, 19 aa, Mycobacterium
VNFGAFVDLGGVDGLVHVS

SEQ ID NO: 1304810 - protein, 28 aa, Mycobacterium
VNGALARYASLPTKALFRIPDEISLAEA

SEQ ID NO: 1304811 - protein, 19 aa, Mycobacterium
VNGQKRFITNAPTADLFVV

SEQ ID NO: 1304812 - protein, 25 aa, Mycobacterium
VNGRPNYLFAPALPGPELYPSLLND

SEQ ID NO: 1304813 - protein, 24 aa, Mycobacterium
VNHEPFLTLGIHIGAKTTSIVATD

SEQ ID NO: 1304814 - protein, 21 aa, Mycobacterium
VNHVLPAWDVSCGLYAALAVT

SEQ ID NO: 1304815 - protein, 24 aa, Mycobacterium
VNIAGVIHRFAPFIDLPPETADRI

SEQ ID NO: 1304816 - protein, 19 aa, Mycobacterium
VNLIVNYIDQPGALGKIGT

SEQ ID NO: 1304817 - protein, 27 aa, Mycobacterium
VNNTVFAAQIGLLREAVRLGGALGVAE

SEQ ID NO: 1304818 - protein, 23 aa, Mycobacterium
VNQGYTMDPFAPFGGVKSSGYGR

SEQ ID NO: 1304819 - protein, 24 aa, Mycobacterium
VNQIELHPLLPQRELRELHAQLGI

SEQ ID NO: 1304820 - protein, 23 aa, Mycobacterium
VNQYLAVSALIAGGLYGIENELE

SEQ ID NO: 1304821 - protein, 21 aa, Mycobacterium
VNRTTLYRRIGTKDDLVIAAM

SEQ ID NO: 1304822 - protein, 33 aa, Mycobacterium
VNSFSKYYAMTGWRLGWLLVPQELRRAVDRLTG

SEQ ID NO: 1304823 - protein, 20 aa, Mycobacterium
VNTFCAPPTVWRMLIQSDLG

SEQ ID NO: 1304824 - protein, 29 aa, Mycobacterium
VNTVFQHYALFPHMSVWDNVAYGPRSMKK

SEQ ID NO: 1304825 - protein, 21 aa, Mycobacterium
VNVARLLSLPDLTVATLIADA

SEQ ID NO: 1304826 - protein, 19 aa, Mycobacterium
VNVFMDIPVAADGGLRWLP

SEQ ID NO: 1304827 - protein, 30 aa, Mycobacterium
VNYAGLPSSPWYELGQRLAPKGTGAVLAFE

SEQ ID NO: 1304828 - protein, 23 aa, Mycobacterium
VNYPLYVIMSLLGVPEADFPLML

SEQ ID NO: 1304829 - protein, 29 aa, Mycobacterium
VPADRVLAALHGWLAPLPPEGASAIVYRD

SEQ ID NO: 1304830 - protein, 23 aa, Mycobacterium
VPAQEVTLPYIADPIARQSVRHT

SEQ ID NO: 1304831 - protein, 19 aa, Mycobacterium
VPDALVGRCWPAVFAAIGS

SEQ ID NO: 1304832 - protein, 19 aa, Mycobacterium
VPEFPNFFCMYGPGTNLAH

SEQ ID NO: 1304833 - protein, 24 aa, Mycobacterium
VPELVCVLCPWKPSRVADDGKSVG

SEQ ID NO: 1304834 - protein, 20 aa, Mycobacterium
VPEPLPPNRYRLVNQGAGER

SEQ ID NO: 1304835 - protein, 17 aa, Mycobacterium
VPETEFRRELRACPADE

SEQ ID NO: 1304836 - protein, 17 aa, Mycobacterium
VPFPLDTVLERLQSVAD

SEQ ID NO: 1304837 - protein, 24 aa, Mycobacterium
VPGDFVILNWRAVCGQCRACKRGR

SEQ ID NO: 1304838 - protein, 18 aa, Mycobacterium
VPGRRLAVIEMAAAAGLE

SEQ ID NO: 1304839 - protein, 28 aa, Mycobacterium
VPGYLARADMMFALSVPLPGHHIINAST

SEQ ID NO: 1304840 - protein, 21 aa, Mycobacterium
VPHDHIWTEPVFAGAHRLNGS

SEQ ID NO: 1304841 - protein, 25 aa, Mycobacterium
VPIERPIIICGLPRTGTTHLHNMIA

SEQ ID NO: 1304842 - protein, 17 aa, Mycobacterium
VPIGIAAYRRYAALIQP

SEQ ID NO: 1304843 - protein, 36 aa, Mycobacterium
VPIVPAAVIFDLPVGGWACRPTAEFGYAAAASAGVD

SEQ ID NO: 1304844 - protein, 27 aa, Mycobacterium
VPKVRLVPFVHRLLVPLVDHDKGNNSY

SEQ ID NO: 1304845 - protein, 18 aa, Mycobacterium
VPLFINTGDKLKVDSRDG

SEQ ID NO: 1304846 - protein, 18 aa, Mycobacterium
VPLLEVALRLPQVAYIGA

SEQ ID NO: 1304847 - protein, 33 aa, Mycobacterium
VPMAGGPAMPPPPMPLGPPPTPSPAAPVVPTSA

SEQ ID NO: 1304848 - protein, 26 aa, Mycobacterium
VPMFHANAWGLIYAALMSGADLVLPD

SEQ ID NO: 1304849 - protein, 27 aa, Mycobacterium
VPMLRRSALDLIITYRINLPVGVQEAV

SEQ ID NO: 1304850 - protein, 29 aa, Mycobacterium
VPPARLVGWTARFLGMVLPGDEIDFRVDR

SEQ ID NO: 1304851 - protein, 17 aa, Mycobacterium
VPPDQYRFPALATDLTG

SEQ ID NO: 1304852 - protein, 18 aa, Mycobacterium
VPPNGLPVILGPDHPVTG

SEQ ID NO: 1304853 - protein, 28 aa, Mycobacterium
VPQAFAALDPLRPLTFISGPSATSDIEL

SEQ ID NO: 1304854 - protein, 31 aa, Mycobacterium
VPSGVLERGLLLRIRFALDHHINLRPAKLYS

SEQ ID NO: 1304855 - protein, 18 aa, Mycobacterium
VPSLPRPGQTVLASSMTT

SEQ ID NO: 1304856 - protein, 19 aa, Mycobacterium
VPSWHYPGGYAESVVVPAT

SEQ ID NO: 1304857 - protein, 25 aa, Mycobacterium
VPTPDGWRMLSGDETGWLLGDYILD

SEQ ID NO: 1304858 - protein, 17 aa, Mycobacterium
VPTTLLHVVQDLDTWLQ

SEQ ID NO: 1304859 - protein, 17 aa, Mycobacterium
VPTVRRALQLVQTTSPH

SEQ ID NO: 1304860 - protein, 26 aa, Mycobacterium
VPVDFDHPLWVLYSSGTTGLPKGIVH

SEQ ID NO: 1304861 - protein, 24 aa, Mycobacterium
VPVEGDWLLLVELAADVDPTDVLA

SEQ ID NO: 1304862 - protein, 22 aa, Mycobacterium
VPVLTQLRMRYLDVDTWHDDIV

SEQ ID NO: 1304863 - protein, 42 aa, Mycobacterium
VPVSDIEFVQFHPTMLFDGFTNGRRPLITEALRGEGARLVDA

SEQ ID NO: 1304864 - protein, 22 aa, Mycobacterium
VPWIEHVVAARLLAALDGLGSG

SEQ ID NO: 1304865 - protein, 25 aa, Mycobacterium
VPYRANMWALRALGVRRIFGPCAVG

SEQ ID NO: 1304866 - protein, 21 aa, Mycobacterium
VQAFALLRKLSQDSNVPLIAI

SEQ ID NO: 1304867 - protein, 27 aa, Mycobacterium
VQEEVLWLCEAAHLPVIWATQVLESLA

SEQ ID NO: 1304868 - protein, 24 aa, Mycobacterium
VQEFAAFFPVEVITRMLGVPEDRR

SEQ ID NO: 1304869 - protein, 24 aa, Mycobacterium
VQFMVPAMWTALTQVPDFDSFNLS

SEQ ID NO: 1304870 - protein, 22 aa, Mycobacterium
VQGSLAMFAIHKHGSEEQRKQW

SEQ ID NO: 1304871 - protein, 23 aa, Mycobacterium
VQHHDWLPTFLAAAGDPDIVDKL

SEQ ID NO: 1304872 - protein, 30 aa, Mycobacterium
VQHVTFFEAEAYARWAGARLPTEIEWEKAC

SEQ ID NO: 1304873 - protein, 33 aa, Mycobacterium
VQIGGGLLLASGKLPRLASAALAFSVVPGSLGG

SEQ ID NO: 1304874 - protein, 25 aa, Mycobacterium
VQKRKPLLPTPAQPPGREPLRRRLT

SEQ ID NO: 1304875 - protein, 22 aa, Mycobacterium
VQQLDAVYFDTPGLDLAAHRIT

SEQ ID NO: 1304876 - protein, 17 aa, Mycobacterium
VQTLILRAVAVLDLADA

SEQ ID NO: 1304877 - protein, 18 aa, Mycobacterium
VQTVVILGALLADTPHTR

SEQ ID NO: 1304878 - protein, 17 aa, Mycobacterium
VQVLYRLDGRQTSMSFE

SEQ ID NO: 1304879 - protein, 18 aa, Mycobacterium
VQVPHAMVLFAGGALVER

SEQ ID NO: 1304880 - protein, 21 aa, Mycobacterium
VQWQKWSMRVGFNPREGIVLH

SEQ ID NO: 1304881 - protein, 24 aa, Mycobacterium
VRAEVAVLKMLALQFIMSDHGHLG

SEQ ID NO: 1304882 - protein, 21 aa, Mycobacterium
VRAHLAPYLPGHPLADELGDD

SEQ ID NO: 1304883 - protein, 20 aa, Mycobacterium
VRAKIKVRLTQLRPPAALEA

SEQ ID NO: 1304884 - protein, 19 aa, Mycobacterium
VRAPQWVISVTVLGDLAGR

SEQ ID NO: 1304885 - protein, 18 aa, Mycobacterium
VRAQLLVAMGRPLPEEMH

SEQ ID NO: 1304886 - protein, 23 aa, Mycobacterium
VRARLVDLQRRLADGSGSVVVEG

SEQ ID NO: 1304887 - protein, 21 aa, Mycobacterium
VRARPFPPDAPLAAPAVPLVG

SEQ ID NO: 1304888 - protein, 21 aa, Mycobacterium
VRATIGALAFGVFPLVTRTSL

SEQ ID NO: 1304889 - protein, 19 aa, Mycobacterium
VRDGYGWIQPRLSPVARAA

SEQ ID NO: 1304890 - protein, 17 aa, Mycobacterium
VRDIDLSTYLRPSRYAE

SEQ ID NO: 1304891 - protein, 25 aa, Mycobacterium
VRDNCDPELCRYDRILFASDADPDG

SEQ ID NO: 1304892 - protein, 25 aa, Mycobacterium
VRDTDRPFLMPVEDVFTITGRGTVV

SEQ ID NO: 1304893 - protein, 22 aa, Mycobacterium
VRDWLRRYYMRYSGPGGMTEQD

SEQ ID NO: 1304894 - protein, 22 aa, Mycobacterium
VRDYAAPSFTPGRPLIEVLRDL

SEQ ID NO: 1304895 - protein, 33 aa, Mycobacterium
VRELAPMLGPMVEDMLLLQLRHAMETEAVSATE

SEQ ID NO: 1304896 - protein, 23 aa, Mycobacterium
VRELTAHWDRWPTSVTWSRDGAK

SEQ ID NO: 1304897 - protein, 25 aa, Mycobacterium
VRGERPFVLISLTADPTAGPVLDWV

SEQ ID NO: 1304898 - protein, 26 aa, Mycobacterium
VRGGKQPRILFATQATARPPTFVLFT

SEQ ID NO: 1304899 - protein, 17 aa, Mycobacterium
VRGIFPTAVLITADGAE

SEQ ID NO: 1304900 - protein, 18 aa, Mycobacterium
VRGIWSEPDFSFHGEFYA

SEQ ID NO: 1304901 - protein, 21 aa, Mycobacterium
VRHHRSLALLVVLAMRNPDFA

SEQ ID NO: 1304902 - protein, 18 aa, Mycobacterium
VRHTLRVLGPKVLASRMV

SEQ ID NO: 1304903 - protein, 21 aa, Mycobacterium
VRIHGRGPLSDLLVAGLRCSG

SEQ ID NO: 1304904 - protein, 19 aa, Mycobacterium
VRIRPLTVTGRRFIFGPGL

SEQ ID NO: 1304905 - protein, 26 aa, Mycobacterium
VRLEFEQTFMFFLPRICEHCLNPSCM

SEQ ID NO: 1304906 - protein, 23 aa, Mycobacterium
VRLLNMVPYFQANPRITYAEAAA

SEQ ID NO: 1304907 - protein, 25 aa, Mycobacterium
VRLMDPQHRLLLETAWRAVEHSGTA

SEQ ID NO: 1304908 - protein, 22 aa, Mycobacterium
VRLPHGNGETIRLARGASLSDF

SEQ ID NO: 1304909 - protein, 25 aa, Mycobacterium
VRLVRSARLLGLRTVAVFSDADRGA

SEQ ID NO: 1304910 - protein, 19 aa, Mycobacterium
VRNAHLQPLTPLSAQTWQA

SEQ ID NO: 1304911 - protein, 18 aa, Mycobacterium
VRNIRRKAMEELARIKKD

SEQ ID NO: 1304912 - protein, 18 aa, Mycobacterium
VRNLWAYVVIFCGHFPDG

SEQ ID NO: 1304913 - protein, 25 aa, Mycobacterium
VRPHDIRVGRNPELPIYESESIQAT

SEQ ID NO: 1304914 - protein, 19 aa, Mycobacterium
VRPHGGRLLLRLDGVADRT

SEQ ID NO: 1304915 - protein, 17 aa, Mycobacterium
VRPLSLGRLDRGWVVAS

SEQ ID NO: 1304916 - protein, 22 aa, Mycobacterium
VRQFRASVCVLGPLVGRCKRAR

SEQ ID NO: 1304917 - protein, 28 aa, Mycobacterium
VRRFGELTARLYALEALLAAGTARIDEA

SEQ ID NO: 1304918 - protein, 23 aa, Mycobacterium
VRRLRHLVAATPVPDAALADQVD

SEQ ID NO: 1304919 - protein, 30 aa, Mycobacterium
VRRRGEYLYNFWRDAANPRGLWRRTTLESY

SEQ ID NO: 1304920 - protein, 25 aa, Mycobacterium
VRRSRRLVISMICTVGNYEYGFFWY

SEQ ID NO: 1304921 - protein, 29 aa, Mycobacterium
VRRYGMVSPTVFWPIPRVYSGLVRIDRYE

SEQ ID NO: 1304922 - protein, 18 aa, Mycobacterium
VRSRWDLPILIGSTTADD

SEQ ID NO: 1304923 - protein, 19 aa, Mycobacterium
VRTCVRYQIRHGAKLIKVS

SEQ ID NO: 1304924 - protein, 24 aa, Mycobacterium
VRTHRRPAFLHLSTVRLMGHAGSD

SEQ ID NO: 1304925 - protein, 21 aa, Mycobacterium
VRTIFKKLYDAGLIYQAERLV

SEQ ID NO: 1304926 - protein, 24 aa, Mycobacterium
VRTKWPTLLNPSTYRGMLRLAVIS

SEQ ID NO: 1304927 - protein, 26 aa, Mycobacterium
VRTPGRHWDHRWALAVLNTALGGGLS

SEQ ID NO: 1304928 - protein, 18 aa, Mycobacterium
VRVAAVADLLLLDAENPR

SEQ ID NO: 1304929 - protein, 27 aa, Mycobacterium
VRVALIDGTWVAFPTVEQLERAVFDMV

SEQ ID NO: 1304930 - protein, 20 aa, Mycobacterium
VRVDEVVLATIRPVDTATAP

SEQ ID NO: 1304931 - protein, 17 aa, Mycobacterium
VRVGVRVRFATRVKDKN

SEQ ID NO: 1304932 - protein, 24 aa, Mycobacterium
VSAAPVQVYLSPDDAMVVSADQGS

SEQ ID NO: 1304933 - protein, 18 aa, Mycobacterium
VSAARRAFATWSQTTREE

SEQ ID NO: 1304934 - protein, 24 aa, Mycobacterium
VSAATLYRGFRSKEALIAAALERR

SEQ ID NO: 1304935 - protein, 25 aa, Mycobacterium
VSAEAALGLLRRHKIEKLPIVDGHG

SEQ ID NO: 1304936 - protein, 24 aa, Mycobacterium
VSAGEPLFTLYTDTPDRLGPARAE

SEQ ID NO: 1304937 - protein, 20 aa, Mycobacterium
VSALEMTFFGALVNAGSGVF

SEQ ID NO: 1304938 - protein, 20 aa, Mycobacterium
VSAPIRDIVLALSGRNSPVL

SEQ ID NO: 1304939 - protein, 25 aa, Mycobacterium
VSARELLPERALLGDATAIAALETE

SEQ ID NO: 1304940 - protein, 29 aa, Mycobacterium
VSARIGVLAALSLLLRRERTGLGGSASIA

SEQ ID NO: 1304941 - protein, 27 aa, Mycobacterium
VSDDFPLARLYAWHRAMRLFDGPDEVH

SEQ ID NO: 1304942 - protein, 24 aa, Mycobacterium
VSDGLPVTSLWLDAAEDGEVVRVV

SEQ ID NO: 1304943 - protein, 20 aa, Mycobacterium
VSEVSALMRIGNRPTLGYSE

SEQ ID NO: 1304944 - protein, 24 aa, Mycobacterium
VSEYLLFRHFGSKAGLFREALVVP

SEQ ID NO: 1304945 - protein, 24 aa, Mycobacterium
VSGEIDLALLRPPVQHPAVQVETI

SEQ ID NO: 1304946 - protein, 29 aa, Mycobacterium
VSGEPWQAVAPLRYFNDRAGSIYAGSNEI

SEQ ID NO: 1304947 - protein, 24 aa, Mycobacterium
VSGLVIALLCRGHVLLEGVPGVAK

SEQ ID NO: 1304948 - protein, 40 aa, Mycobacterium
VSHLRFGPHPIRAPYLVTRAGFIGCHHWRFLETADVLGRA

SEQ ID NO: 1304949 - protein, 27 aa, Mycobacterium
VSHRPVAEYFVWFKADYQVDAKDRLLQ

SEQ ID NO: 1304950 - protein, 17 aa, Mycobacterium
VSIIIRTTLEDLESRAG

SEQ ID NO: 1304951 - protein, 35 aa, Mycobacterium
VSIQAGIINLLLDLQERFGLSYLFVSHDLSVVRHL

SEQ ID NO: 1304952 - protein, 25 aa, Mycobacterium
VSLDSPPFYDPWFSKARTSGSIEAR

SEQ ID NO: 1304953 - protein, 18 aa, Mycobacterium
VSLPVVRAFVARIKERAK

SEQ ID NO: 1304954 - protein, 23 aa, Mycobacterium
VSLRTFYRHFTSKHDLLFADYDA

SEQ ID NO: 1304955 - protein, 26 aa, Mycobacterium
VSLTKIANDIRWMGSGPLTGLAEIQL

SEQ ID NO: 1304956 - protein, 19 aa, Mycobacterium
VSLVPSLAAWAARGDVAVR

SEQ ID NO: 1304957 - protein, 22 aa, Mycobacterium
VSPDLMDILGAASTLPIGTDGA

SEQ ID NO: 1304958 - protein, 19 aa, Mycobacterium
VSPQLYIALGISGAIQHRA

SEQ ID NO: 1304959 - protein, 23 aa, Mycobacterium
VSPTLGFIPSLLGAQPALTAAEH

SEQ ID NO: 1304960 - protein, 23 aa, Mycobacterium
VSPVDFWQHPTINSLIEFLSAPV

SEQ ID NO: 1304961 - protein, 28 aa, Mycobacterium
VSQPLPVPPTPYLDLSTVALLGRPKEAP

SEQ ID NO: 1304962 - protein, 25 aa, Mycobacterium
VSRATLHRHFAGKPALMAALDDLAI

SEQ ID NO: 1304963 - protein, 17 aa, Mycobacterium
VSRKCGVPYLYRFELMG

SEQ ID NO: 1304964 - protein, 26 aa, Mycobacterium
VSRLHAKLFYQPLLESVGQPALGIEP

SEQ ID NO: 1304965 - protein, 28 aa, Mycobacterium
VSRMRKQFIGLLAAQPYRITDTVHLDVQ

SEQ ID NO: 1304966 - protein, 19 aa, Mycobacterium
VSRPRVVMLLGGLRELTAI

SEQ ID NO: 1304967 - protein, 24 aa, Mycobacterium
VSRPTLYRWFASKQELLDAFGRYE

SEQ ID NO: 1304968 - protein, 23 aa, Mycobacterium
VSRYYNLVLADCGAGLFQPASRA

SEQ ID NO: 1304969 - protein, 22 aa, Mycobacterium
VSSNYRFDLAPRTWEFIRDLRS

SEQ ID NO: 1304970 - protein, 25 aa, Mycobacterium
VSSPRVLSDLFWLGRYAERAEYTAR

SEQ ID NO: 1304971 - protein, 18 aa, Mycobacterium
VSSREPYRRLVNQGYIQA

SEQ ID NO: 1304972 - protein, 25 aa, Mycobacterium
VSTCATCDGFFFRDQDIAVIGGGDS

SEQ ID NO: 1304973 - protein, 17 aa, Mycobacterium
VSTPIHRGRRQQLWMIT

SEQ ID NO: 1304974 - protein, 23 aa, Mycobacterium
VSTPRSKLLAEIERLQPVRSADA

SEQ ID NO: 1304975 - protein, 25 aa, Mycobacterium
VSVDTFAGFLFLNPDPDAEPLREYL

SEQ ID NO: 1304976 - protein, 17 aa, Mycobacterium
VSWVDVDGYRPFWAVTK

SEQ ID NO: 1304977 - protein, 28 aa, Mycobacterium
VTAFDDEWPLLNFLKFTGVDTQKRPQGH

SEQ ID NO: 1304978 - protein, 25 aa, Mycobacterium
VTAGPTYRLFGIPVTVTNKLAEGKA

SEQ ID NO: 1304979 - protein, 26 aa, Mycobacterium
VTALNGHLLYWLPDGEYETARAWLER

SEQ ID NO: 1304980 - protein, 26 aa, Mycobacterium
VTANVVVPGWIATAAQLPSEVVAGNA

SEQ ID NO: 1304981 - protein, 18 aa, Mycobacterium
VTAVAWLARKVESFGVRL

SEQ ID NO: 1304982 - protein, 24 aa, Mycobacterium
VTDFSLAMIDPWPAGYYGRQDHYD

SEQ ID NO: 1304983 - protein, 25 aa, Mycobacterium
VTDGRWSCVQWGSRTPPFYPEPDAD

SEQ ID NO: 1304984 - protein, 25 aa, Mycobacterium
VTDIKPAILALGRDAPRAAFIDALA

SEQ ID NO: 1304985 - protein, 27 aa, Mycobacterium
VTDNIVIPWVFDGLSFDAPLEKKKDSM

SEQ ID NO: 1304986 - protein, 24 aa, Mycobacterium
VTDPGRFDVIVTDNLFGDIVTDLA

SEQ ID NO: 1304987 - protein, 27 aa, Mycobacterium
VTDVRYLGSQPWPFPRSLMVGFHAVAD

SEQ ID NO: 1304988 - protein, 19 aa, Mycobacterium
VTEFAPVPGMGWMFVADPD

SEQ ID NO: 1304989 - protein, 17 aa, Mycobacterium
VTEFMLLQAAVAVVLHK

SEQ ID NO: 1304990 - protein, 24 aa, Mycobacterium
VTELNRRGLLDDVSLQGALDAAPP

SEQ ID NO: 1304991 - protein, 26 aa, Mycobacterium
VTEPLPADDPLWKAPGAMVFPHDSHA

SEQ ID NO: 1304992 - protein, 23 aa, Mycobacterium
VTGFDAPFFGMSTREVRLMDPQH

SEQ ID NO: 1304993 - protein, 18 aa, Mycobacterium
VTGFLPHGPVLDRAVCAI

SEQ ID NO: 1304994 - protein, 26 aa, Mycobacterium
VTGLAHLADLWPLHPDARIVLCSSVS

SEQ ID NO: 1304995 - protein, 25 aa, Mycobacterium
VTGTPDIPWLDRVDLPDGATLDGLS

SEQ ID NO: 1304996 - protein, 18 aa, Mycobacterium
VTGWFMVGWSAEFVSGET

SEQ ID NO: 1304997 - protein, 29 aa, Mycobacterium
VTHCAAYYQLLVKALLMPGLMELTETGVP

SEQ ID NO: 1304998 - protein, 17 aa, Mycobacterium
VTHLGSVMPMRVVGMLF

SEQ ID NO: 1304999 - protein, 29 aa, Mycobacterium
VTHRVLALLPPVITLSNFWPQTARSEMHP

SEQ ID NO: 1305000 - protein, 18 aa, Mycobacterium
VTILLPNSIAWVEAVLAT

SEQ ID NO: 1305001 - protein, 37 aa, Mycobacterium
VTKQPVGPCYAITPWNFPLAMGTRKMGPAFAAGCTMI

SEQ ID NO: 1305002 - protein, 25 aa, Mycobacterium
VTLDDALKLLSLPRVVGVDPNTGEE

SEQ ID NO: 1305003 - protein, 21 aa, Mycobacterium
VTLPREWGDWATRAAMPTLRI

SEQ ID NO: 1305004 - protein, 26 aa, Mycobacterium
VTLRTRVPVLHFFDGFRTSHELNTVE

SEQ ID NO: 1305005 - protein, 29 aa, Mycobacterium
VTLSEKGWRTFFRGLANDGVQGPSVANYL

SEQ ID NO: 1305006 - protein, 29 aa, Mycobacterium
VTLTSVMRATRAALRYFRDAEHGGVIVNN

SEQ ID NO: 1305007 - protein, 19 aa, Mycobacterium
VTLVRSLYRFSRTPMFTAD

SEQ ID NO: 1305008 - protein, 24 aa, Mycobacterium
VTLYVRPAAWGVWAFYEMSDEERR

SEQ ID NO: 1305009 - protein, 18 aa, Mycobacterium
VTPEAFQQLIDDGALLEW

SEQ ID NO: 1305010 - protein, 25 aa, Mycobacterium
VTPEKQFTLFFDDVRVPAANLIGAE

SEQ ID NO: 1305011 - protein, 21 aa, Mycobacterium
VTPFAMIQLSDRGQFFVEPGD

SEQ ID NO: 1305012 - protein, 19 aa, Mycobacterium
VTPHHLLLDDSRLATYDGR

SEQ ID NO: 1305013 - protein, 26 aa, Mycobacterium
VTPIKTMLRLALNAGEGILYRLHLDL

SEQ ID NO: 1305014 - protein, 22 aa, Mycobacterium
VTPNFRIGCKRMLISNDWYPTL

SEQ ID NO: 1305015 - protein, 32 aa, Mycobacterium
VTPQKVRRLRRLAGLWLAGRDERWAAVRIDVI

SEQ ID NO: 1305016 - protein, 23 aa, Mycobacterium
VTPSLVQYYFPTLDDVFIAAIRR

SEQ ID NO: 1305017 - protein, 25 aa, Mycobacterium
VTQADLVIGAVLIPGAKAPKLVTNS

SEQ ID NO: 1305018 - protein, 26 aa, Mycobacterium
VTRARFYIFVNQIANYVPFAVSSGVA

SEQ ID NO: 1305019 - protein, 31 aa, Mycobacterium
VTRDQPWEPRYLLQPLRNIALAIGFEWGIAL

SEQ ID NO: 1305020 - protein, 26 aa, Mycobacterium
VTRIVVQLAPWLEPEPVCWAIENIAV

SEQ ID NO: 1305021 - protein, 19 aa, Mycobacterium
VTRMDYLSPFFNETAYCLG

SEQ ID NO: 1305022 - protein, 23 aa, Mycobacterium
VTRQGNHHLAFGFGPHGCIGQQL

SEQ ID NO: 1305023 - protein, 28 aa, Mycobacterium
VTRSRHLLAQFLFRGDRIHLPVSVLSGG

SEQ ID NO: 1305024 - protein, 17 aa, Mycobacterium
VTRTVRMFGIQKAFMEV

SEQ ID NO: 1305025 - protein, 17 aa, Mycobacterium
VTRVVKVVGFVASAPGF

SEQ ID NO: 1305026 - protein, 24 aa, Mycobacterium
VTTSTQWWEIGLFTTLDEGVTQPD

SEQ ID NO: 1305027 - protein, 24 aa, Mycobacterium
VTTTLGINHLLKRYPRELSNGQRQ

SEQ ID NO: 1305028 - protein, 26 aa, Mycobacterium
VTVDYPPVNAIPSRGWFELGDTITAA

SEQ ID NO: 1305029 - protein, 17 aa, Mycobacterium
VTVGFEMAAVIASAALL

SEQ ID NO: 1305030 - protein, 26 aa, Mycobacterium
VTVRDLEVSTPWYRALIGTEPVLDEH

SEQ ID NO: 1305031 - protein, 27 aa, Mycobacterium
VTVRDPDKVIWLSQTTLSVDETMETVR

SEQ ID NO: 1305032 - protein, 22 aa, Mycobacterium
VTVRLEHIDALAALLVARPAEF

SEQ ID NO: 1305033 - protein, 30 aa, Mycobacterium
VTVRRWRDIWLHEGFACYAEWLWSENSGGR

SEQ ID NO: 1305034 - protein, 18 aa, Mycobacterium
VTVVDPRWVLPVPEVLTE

SEQ ID NO: 1305035 - protein, 24 aa, Mycobacterium
VTVWRDLIALHYPNTGWLRLSHDT

SEQ ID NO: 1305036 - protein, 19 aa, Mycobacterium
VTWGPAFTDVAYFLGCALP

SEQ ID NO: 1305037 - protein, 17 aa, Mycobacterium
VVAAHTGTLWRVGFGGF

SEQ ID NO: 1305038 - protein, 26 aa, Mycobacterium
VVAGLHSLPWDGLKLSRGEPAIPTRM

SEQ ID NO: 1305039 - protein, 24 aa, Mycobacterium
VVAHALWSALELRLIEAVDGGGRR

SEQ ID NO: 1305040 - protein, 25 aa, Mycobacterium
VVALGNRLRPVLGALGLGSPQAAQT

SEQ ID NO: 1305041 - protein, 34 aa, Mycobacterium
VVARLDAEAPARLFYERSLGMLDLAVGNALSAPE

SEQ ID NO: 1305042 - protein, 20 aa, Mycobacterium
VVASYLLADGLFQDRLRASG

SEQ ID NO: 1305043 - protein, 31 aa, Mycobacterium
VVATITPWNYPLQMAVWKVLPALAAGCTVVI

SEQ ID NO: 1305044 - protein, 17 aa, Mycobacterium
VVAVRAYLTDWAEYAAF

SEQ ID NO: 1305045 - protein, 17 aa, Mycobacterium
VVCAYVALFATRRPADV

SEQ ID NO: 1305046 - protein, 27 aa, Mycobacterium
VVCRAEQWLDLRFVSGRGALLRGVVAR

SEQ ID NO: 1305047 - protein, 28 aa, Mycobacterium
VVDPANNVEFFFLRPKDIAIYVGSGQLD

SEQ ID NO: 1305048 - protein, 20 aa, Mycobacterium
VVDVCLAGAFLVIQHAGRHL

SEQ ID NO: 1305049 - protein, 27 aa, Mycobacterium
VVDVFIGYLRRKLEAGGAPRLLHTVRG

SEQ ID NO: 1305050 - protein, 29 aa, Mycobacterium
VVEFMMLDRLFPRSIFYSLRLAEHNLDEL

SEQ ID NO: 1305051 - protein, 24 aa, Mycobacterium
VVEFWREPVVYAATLGILAERHRS

SEQ ID NO: 1305052 - protein, 34 aa, Mycobacterium
VVENLAAPTPLLWQRYLAIIFDGLRPEGAHPLPQ

SEQ ID NO: 1305053 - protein, 23 aa, Mycobacterium
VVFNGHYLTWFDEACTAFFDHIG

SEQ ID NO: 1305054 - protein, 27 aa, Mycobacterium
VVFQNPRLLPWRRALANVTFALADAGP

SEQ ID NO: 1305055 - protein, 18 aa, Mycobacterium
VVFVPPKFAKDAIIEAID

SEQ ID NO: 1305056 - protein, 24 aa, Mycobacterium
VVGAGFSGLYALHRLRELGVNARV

SEQ ID NO: 1305057 - protein, 31 aa, Mycobacterium
VVGAITAWNVPFFLAANKLGPALLAGCTVVL

SEQ ID NO: 1305058 - protein, 33 aa, Mycobacterium
VVGEWQLLADLSFADYLMWVRRDDGVLVCVAQV

SEQ ID NO: 1305059 - protein, 17 aa, Mycobacterium
VVGFKLTGERRAGVTAT

SEQ ID NO: 1305060 - protein, 35 aa, Mycobacterium
VVGIISPFNFPAMVPMWFFPVAIATGNTVVLKPSE

SEQ ID NO: 1305061 - protein, 42 aa, Mycobacterium
VVGMTLPIARDLSREFIRVCTIAPGLFKTPLLGSLPEEAQKS

SEQ ID NO: 1305062 - protein, 25 aa, Mycobacterium
VVGPAAWWHAWARADWDRLAGAVVA

SEQ ID NO: 1305063 - protein, 25 aa, Mycobacterium
VVGQAFFLDLQLTVPGGAVLPVAGI

SEQ ID NO: 1305064 - protein, 25 aa, Mycobacterium
VVHAGIEHWLIGSVPPIKIVGHFSD

SEQ ID NO: 1305065 - protein, 25 aa, Mycobacterium
VVHDGRTWYRTGDLVRYLPDGQIDF

SEQ ID NO: 1305066 - protein, 29 aa, Mycobacterium
VVIASEKAFFMLAFTKIGLMPDGGASALF

SEQ ID NO: 1305067 - protein, 26 aa, Mycobacterium
VVIGAGPIGLFTLLAARHAGARVVVA

SEQ ID NO: 1305068 - protein, 20 aa, Mycobacterium
VVINPFFQWGSDRAPRTPYH

SEQ ID NO: 1305069 - protein, 25 aa, Mycobacterium
VVKGRYDQQTFLRDLLEESEQARAL

SEQ ID NO: 1305070 - protein, 18 aa, Mycobacterium
VVLEHLLRRATADTAQRL

SEQ ID NO: 1305071 - protein, 18 aa, Mycobacterium
VVLGGDHSITWPAATAVA

SEQ ID NO: 1305072 - protein, 17 aa, Mycobacterium
VVLHFEGDRNSTLRMVR

SEQ ID NO: 1305073 - protein, 18 aa, Mycobacterium
VVLLVDDWHMIVAASGMV

SEQ ID NO: 1305074 - protein, 24 aa, Mycobacterium
VVLSLQHGVLPQSLHFDNPSPHIP

SEQ ID NO: 1305075 - protein, 26 aa, Mycobacterium
VVLSRQRLLELVWGYDFDVDTNVADV

SEQ ID NO: 1305076 - protein, 23 aa, Mycobacterium
VVLTGELAMRLRDARRRRSTVGR

SEQ ID NO: 1305077 - protein, 18 aa, Mycobacterium
VVMALVSGVLRKFLQDRG

SEQ ID NO: 1305078 - protein, 27 aa, Mycobacterium
VVMVDGLPWDWETFPEYLDAVDSRSRD

SEQ ID NO: 1305079 - protein, 19 aa, Mycobacterium
VVMVHRRGHPLSYAFRPEA

SEQ ID NO: 1305080 - protein, 17 aa, Mycobacterium
VVNAVVDALAPFGIRHA

SEQ ID NO: 1305081 - protein, 18 aa, Mycobacterium
VVNKFRGDPTLLAPGLDQ

SEQ ID NO: 1305082 - protein, 24 aa, Mycobacterium
VVNNIPFAARLRGPCDVDALVTAI

SEQ ID NO: 1305083 - protein, 32 aa, Mycobacterium
VVNQAEAGEWHWPVPHLVITRGARGASYLGDG

SEQ ID NO: 1305084 - protein, 17 aa, Mycobacterium
VVPFLKIDKGLAEASDD

SEQ ID NO: 1305085 - protein, 23 aa, Mycobacterium
VVPMREDMVIMLAARKVPGALKW

SEQ ID NO: 1305086 - protein, 20 aa, Mycobacterium
VVPTLKRYVLEMRFKPMPRY

SEQ ID NO: 1305087 - protein, 19 aa, Mycobacterium
VVQLARPTLRETLGRLAPG

SEQ ID NO: 1305088 - protein, 17 aa, Mycobacterium
VVQWAALGPGQTAWDLY

SEQ ID NO: 1305089 - protein, 32 aa, Mycobacterium
VVRALHPDVAGPYSWWSWRGRAFDNDAGWRID

SEQ ID NO: 1305090 - protein, 24 aa, Mycobacterium
VVRGLQTMSQWLTVAAKEYAKTDE

SEQ ID NO: 1305091 - protein, 22 aa, Mycobacterium
VVRGVWRGAITRAPRGEGGFGY

SEQ ID NO: 1305092 - protein, 18 aa, Mycobacterium
VVRHLAHRVAVMHKGAIV

SEQ ID NO: 1305093 - protein, 22 aa, Mycobacterium
VVRIRGRAWLASRPDAVVWIES

SEQ ID NO: 1305094 - protein, 28 aa, Mycobacterium
VVRLWEHWGRPEIVWYRGGHTGFFQARP

SEQ ID NO: 1305095 - protein, 18 aa, Mycobacterium
VVRRQISFGYTEEELRIL

SEQ ID NO: 1305096 - protein, 18 aa, Mycobacterium
VVSHVTPIKTMLRLALNA

SEQ ID NO: 1305097 - protein, 26 aa, Mycobacterium
VVSQAPWPVRAGLSATPLLVVGAHLR

SEQ ID NO: 1305098 - protein, 23 aa, Mycobacterium
VVTGYWNIFKQNIGIMIAVAQLA

SEQ ID NO: 1305099 - protein, 24 aa, Mycobacterium
VVTSFYDWSQIDDKWREAGIFPVI

SEQ ID NO: 1305100 - protein, 19 aa, Mycobacterium
VVVFQPHLYSRTETFAREF

SEQ ID NO: 1305101 - protein, 18 aa, Mycobacterium
VVVGENFTFGKKAAGNVE

SEQ ID NO: 1305102 - protein, 31 aa, Mycobacterium; identical to SEQ ID NO: 227128

SEQ ID NO: 1305103 - protein, 24 aa, Mycobacterium
VVVRTMVEPGLLSWRDVARVMSEA

SEQ ID NO: 1305104 - protein, 21 aa, Mycobacterium
VVVVSIFVNPLQFGAGEDLDA

SEQ ID NO: 1305105 - protein, 17 aa, Mycobacterium
VVWGDRALHTVPTAYRR

SEQ ID NO: 1305106 - protein, 18 aa, Mycobacterium
VWDVRRLLSWIRSQDPDA

SEQ ID NO: 1305107 - protein, 19 aa, Mycobacterium
VWELETYGALFDRTKDGRI

SEQ ID NO: 1305108 - protein, 17 aa, Mycobacterium
VWRWFRDGDEWKAEKVI

SEQ ID NO: 1305109 - protein, 24 aa, Mycobacterium
VWVNDWHMVNAMYPFGGVKQSGLG

SEQ ID NO: 1305110 - protein, 33 aa, Mycobacterium
VYAEVAAFSRHRTWWSRLAGPVTSRLQRVVTRR

SEQ ID NO: 1305111 - protein, 18 aa, Mycobacterium
VYEALLAHKGIRGLVVCC

SEQ ID NO: 1305112 - protein, 19 aa, Mycobacterium
VYEWMALAHRALGDHATAD

SEQ ID NO: 1305113 - protein, 31 aa, Mycobacterium
VYGTHWHGLFDNDGFRRAWLADAAAAAGRSG

SEQ ID NO: 1305114 - protein, 19 aa, Mycobacterium
VYNRRDPYLPDLLMCRTEV

SEQ ID NO: 1305115 - protein, 22 aa, Mycobacterium
VYRGAEYSVDFVPKVRVEVIVD

SEQ ID NO: 1305116 - protein, 18 aa, Mycobacterium
VYTAWGGFAYGRGLDGRP

SEQ ID NO: 1305117 - protein, 20 aa, Mycobacterium
VYTPPWIWHRHYADDGLDVA

SEQ ID NO: 1305118 - protein, 17 aa, Mycobacterium
VYWHNTSRLHSYLGDLP

SEQ ID NO: 1305119 - protein, 17 aa, Mycobacterium
VYWHNTSRLHSYLNDIP

SEQ ID NO: 1305120 - protein, 17 aa, Mycobacterium
VYWHSLTVLRQAIDLED

SEQ ID NO: 1305121 - protein, 21 aa, Mycobacterium
WAAALYLPKNYGATTGQPVFP

SEQ ID NO: 1305122 - protein, 35 aa, Mycobacterium
WAASTGALIAAFPRYHPRWAWWTNAVPGLREFVVS

SEQ ID NO: 1305123 - protein, 18 aa, Mycobacterium
WAAWNPQRRARVMMRFIE

SEQ ID NO: 1305124 - protein, 18 aa, Mycobacterium
WADAMELLLTGKPMTAQR

SEQ ID NO: 1305125 - protein, 26 aa, Mycobacterium
WADLAEAALALRAGALWVAANVDLTL

SEQ ID NO: 1305126 - protein, 18 aa, Mycobacterium
WAMQDRVMWENGPALTGY

SEQ ID NO: 1305127 - protein, 22 aa, Mycobacterium
WAPEEFEWCGVPFARRGKRVDE

SEQ ID NO: 1305128 - protein, 18 aa, Mycobacterium
WAPTVQLTAYLRARPADG

SEQ ID NO: 1305129 - protein, 17 aa, Mycobacterium
WAQEIAGFAPLALQHAK

SEQ ID NO: 1305130 - protein, 20 aa, Mycobacterium
WAQRVSLAHALIGWTKGTGL

SEQ ID NO: 1305131 - protein, 19 aa, Mycobacterium
WAREYLSVERLRTLLGPET

SEQ ID NO: 1305132 - protein, 28 aa, Mycobacterium
WARRICAHLPLPRLVWPSDVVGTVTAEA

SEQ ID NO: 1305133 - protein, 17 aa, Mycobacterium
WCRTVVLTAERTARRAG

SEQ ID NO: 1305134 - protein, 21 aa, Mycobacterium
WDEYVEFLTNWAKSSDWDCSF

SEQ ID NO: 1305135 - protein, 17 aa, Mycobacterium
WDGTMRLVAYIQADLDS

SEQ ID NO: 1305136 - protein, 19 aa, Mycobacterium
WDHIGDYGIGFCLDTCHAW

SEQ ID NO: 1305137 - protein, 27 aa, Mycobacterium
WDLELIGRIGWTCRDVWWAATQDPRAW

SEQ ID NO: 1305138 - protein, 19 aa, Mycobacterium
WDLVRDGIFVGYQLDRVFA

SEQ ID NO: 1305139 - protein, 17 aa, Mycobacterium
WDLYVRKFELATGYSEL

SEQ ID NO: 1305140 - protein, 19 aa, Mycobacterium
WDPFPEFLDELRAAGADVV

SEQ ID NO: 1305141 - protein, 17 aa, Mycobacterium
WDQFLDEYAPTTGPLRL

SEQ ID NO: 1305142 - protein, 17 aa, Mycobacterium
WDRALVEAFLRGPMRGP

SEQ ID NO: 1305143 - protein, 19 aa, Mycobacterium
WDRFRAELIPLLDEAYPVR

SEQ ID NO: 1305144 - protein, 27 aa, Mycobacterium
WDVHASFLPAIYFQGVNLAGGVAVLLP

SEQ ID NO: 1305145 - protein, 21 aa, Mycobacterium
WEHWERCAFHWFPGNHLLHVS

SEQ ID NO: 1305146 - protein, 20 aa, Mycobacterium
WEMNWHTPKLLAEYGFTYDS

SEQ ID NO: 1305147 - protein, 23 aa, Mycobacterium
WENSCRFFGWDPFALTPKDQATV

SEQ ID NO: 1305148 - protein, 25 aa, Mycobacterium
WEPGNSLFVSVSCWGKLVTGVGASL

SEQ ID NO: 1305149 - protein, 30 aa, Mycobacterium
WEQDPDVLDTWFSSALWPFSTMGWPDRTPE

SEQ ID NO: 1305150 - protein, 26 aa, Mycobacterium
WEQHPGMLTAYYRARSSPSGQTLLQR

SEQ ID NO: 1305151 - protein, 21 aa, Mycobacterium
WESDIQLYFKRAHASAQLLGP

SEQ ID NO: 1305152 - protein, 27 aa, Mycobacterium
WESGSWVLDFIGSWEWTIPGGSSEIQR

SEQ ID NO: 1305153 - protein, 19 aa, Mycobacterium
WETVQARIKWLMADKSKAY

SEQ ID NO: 1305154 - protein, 17 aa, Mycobacterium
WEVPSNRIANTMKLAII

SEQ ID NO: 1305155 - protein, 17 aa, Mycobacterium
WFDTHSWNRPTWTIAEL

SEQ ID NO: 1305156 - protein, 18 aa, Mycobacterium
WFDVDFPDVIALRERFYP

SEQ ID NO: 1305157 - protein, 17 aa, Mycobacterium
WFFQRTSRGRSPLACKL

SEQ ID NO: 1305158 - protein, 18 aa, Mycobacterium
WGATPVDMGMGGSIPFIA

SEQ ID NO: 1305159 - protein, 24 aa, Mycobacterium
WGDDGSGLFMKYLRRGSGYYIDVG

SEQ ID NO: 1305160 - protein, 27 aa, Mycobacterium
WGDLSLPALQLLISSLPKFLNLEKGVG

SEQ ID NO: 1305161 - protein, 17 aa, Mycobacterium
WGDWKASLIGDLVRRCR

SEQ ID NO: 1305162 - protein, 33 aa, Mycobacterium
WGEFGPFLEYAPPEAATWLASAIEAAYSAPPAV

SEQ ID NO: 1305163 - protein, 20 aa, Mycobacterium
WGEPLDRVLNAVALLLEKYS

SEQ ID NO: 1305164 - protein, 20 aa, Mycobacterium
WGGTRNGTIVHWPAGIDAVG

SEQ ID NO: 1305165 - protein, 26 aa, Mycobacterium
WGKSAVYFISAKLLRAAGRGPTVIVS

SEQ ID NO: 1305166 - protein, 22 aa, Mycobacterium
WGNQMRSYVLHPYQMVKDLRTE

SEQ ID NO: 1305167 - protein, 18 aa, Mycobacterium
WGPAWHMGVLPMTDGSTA

SEQ ID NO: 1305168 - protein, 36 aa, Mycobacterium
WGQDSFEFFPNFTLLLWVPGWYLTYNYWPTGVDTHI

SEQ ID NO: 1305169 - protein, 17 aa, Mycobacterium
WGRGAVDMKDMCGMMIA

SEQ ID NO: 1305170 - protein, 17 aa, Mycobacterium
WGRTVLALGMDTIDDAM

SEQ ID NO: 1305171 - protein, 17 aa, Mycobacterium
WGVAIDEHTLVPGDGAT

SEQ ID NO: 1305172 - protein, 18 aa, Mycobacterium
WIADPALYGLRDALPEDA

SEQ ID NO: 1305173 - protein, 23 aa, Mycobacterium
WIAEGLFGYLPPEAQDRLLDQIT

SEQ ID NO: 1305174 - protein, 17 aa, Mycobacterium
WIALNAGLASGAHMTLI

SEQ ID NO: 1305175 - protein, 17 aa, Mycobacterium
WIDVVTTAHEVGLRSSS

SEQ ID NO: 1305176 - protein, 24 aa, Mycobacterium
WIGNVDLTFPYLDTAATRTIGVVP

SEQ ID NO: 1305177 - protein, 25 aa, Mycobacterium
WIVRDMLGLPYEKPAAYTRDYLEVL

SEQ ID NO: 1305178 - protein, 28 aa, Mycobacterium
WKAWGTGEVVLPWPLPDISIDVGPVTWG

SEQ ID NO: 1305179 - protein, 18 aa, Mycobacterium
WLANWQLRALEAATLRAS

SEQ ID NO: 1305180 - protein, 17 aa, Mycobacterium
WLFADQLGPAVHGGEHA

SEQ ID NO: 1305181 - protein, 19 aa, Mycobacterium
WLFRRRTVTVLFGEPPKLP

SEQ ID NO: 1305182 - protein, 18 aa, Mycobacterium
WLKQLHGKIVVVKYGGNA

SEQ ID NO: 1305183 - protein, 19 aa, Mycobacterium
WLLKQAFYFSLTTVNEAVS

SEQ ID NO: 1305184 - protein, 19 aa, Mycobacterium
WLRGVYGPTVWQRLLRPLF

SEQ ID NO: 1305185 - protein, 20 aa, Mycobacterium
WLVAIVSGPISPTDRFLKEI

SEQ ID NO: 1305186 - protein, 20 aa, Mycobacterium
WLVGTAMLGDFLAALPSPMM

SEQ ID NO: 1305187 - protein, 17 aa, Mycobacterium
WNDLVRRGRWDAASERL

SEQ ID NO: 1305188 - protein, 25 aa, Mycobacterium
WNGPMGVFEFPAFAAGTKGVAEAII

SEQ ID NO: 1305189 - protein, 30 aa, Mycobacterium
WNMVTKRYWWHAWWWVPHAIIRGGVDKLHS

SEQ ID NO: 1305190 - protein, 24 aa, Mycobacterium
WNNNPRALLGADLFDRWKALGARF

SEQ ID NO: 1305191 - protein, 17 aa, Mycobacterium
WNTDRHVELLWSLSRAP

SEQ ID NO: 1305192 - protein, 20 aa, Mycobacterium
WPGPTFTDSGGFQVLSLGAG

SEQ ID NO: 1305193 - protein, 19 aa, Mycobacterium
WPQAMNLVEKFNAAGGSIT

SEQ ID NO: 1305194 - protein, 22 aa, Mycobacterium
WPSMLPTVLAPCEPAGALRPAA

SEQ ID NO: 1305195 - protein, 28 aa, Mycobacterium
WPVTDAGDSIYWAGLNKGKRSVAVDMRT

SEQ ID NO: 1305196 - protein, 20 aa, Mycobacterium
WQLPSDALPTWVGAPFRGKP

SEQ ID NO: 1305197 - protein, 25 aa, Mycobacterium
WQPAVDCWLAAWDPEFSVRLAAAGF

SEQ ID NO: 1305198 - protein, 25 aa, Mycobacterium
WQPTACILCECNCGIVVEVEGRSLA

SEQ ID NO: 1305199 - protein, 20 aa, Mycobacterium
WQTIWTWHRRMSAEGTWDLV

SEQ ID NO: 1305200 - protein, 27 aa, Mycobacterium
WQVRRTPHIPIPYVYNVNLRALVEPPV

SEQ ID NO: 1305201 - protein, 29 aa, Mycobacterium
WRAEINAKPWWRDRIRAGLASYWVYQHMG

SEQ ID NO: 1305202 - protein, 21 aa, Mycobacterium
WREAGIFPVISEGALRATLGI

SEQ ID NO: 1305203 - protein, 29 aa, Mycobacterium
WRMYTRSRYAPYVERLLLDGARSKLTRAA

SEQ ID NO: 1305204 - protein, 18 aa, Mycobacterium
WRPQWRVDLVPSYKAHRV

SEQ ID NO: 1305205 - protein, 26 aa, Mycobacterium
WRRRRSVPLAALAERTLIALPVGTGI

SEQ ID NO: 1305206 - protein, 19 aa, Mycobacterium
WRRTFAVNIDSFFRVTKAA

SEQ ID NO: 1305207 - protein, 23 aa, Mycobacterium
WSAKLDGTYWRRHARQPVEFAKS

SEQ ID NO: 1305208 - protein, 22 aa, Mycobacterium
WSGRHLVECLRLGAERFGWSSR

SEQ ID NO: 1305209 - protein, 18 aa, Mycobacterium
WSIHRKPPAFDELEPRTE

SEQ ID NO: 1305210 - protein, 18 aa, Mycobacterium
WSKRPRGSQLGAWASQQS

SEQ ID NO: 1305211 - protein, 32 aa, Mycobacterium
WSSEPLEDWKHWVRWRLIHARAFLLTDELVAE

SEQ ID NO: 1305212 - protein, 19 aa, Mycobacterium
WSTFLPPGRGDAEALRSSV

SEQ ID NO: 1305213 - protein, 17 aa, Mycobacterium
WTFDPVRRQFYWHRFFS

SEQ ID NO: 1305214 - protein, 17 aa, Mycobacterium
WTLPPHAGGTRYRDDLA

SEQ ID NO: 1305215 - protein, 21 aa, Mycobacterium
WTPAVTLAEGVARTVEWLRAT

SEQ ID NO: 1305216 - protein, 18 aa, Mycobacterium
WTPQQLLGIAFAHPQNFP

SEQ ID NO: 1305217 - protein, 23 aa, Mycobacterium
WTRRRYRMLELSQLPGLGWVEYE

SEQ ID NO: 1305218 - protein, 19 aa, Mycobacterium
WTSLAHLCQWGLATVRTDP

SEQ ID NO: 1305219 - protein, 24 aa, Mycobacterium
WTSSFSEALIDYGAKRRDIVAITA

SEQ ID NO: 1305220 - protein, 24 aa, Mycobacterium
WTTGPGLPWPGRPAPLHPNAAGMR

SEQ ID NO: 1305221 - protein, 25 aa, Mycobacterium
WTTLEQDGMLFVWNDPERKPPPDDV

SEQ ID NO: 1305222 - protein, 28 aa, Mycobacterium
WTVACRYDYLIPCRGVGVLLPDGAQAAL

SEQ ID NO: 1305223 - protein, 19 aa, Mycobacterium
WVANVRRPVRLHQAVSAAA

SEQ ID NO: 1305224 - protein, 27 aa, Mycobacterium
WVDVDGYRPFWAVTKHADIMAIERANT

SEQ ID NO: 1305225 - protein, 24 aa, Mycobacterium
WVENDARFLFYPAVKELTLDIASV

SEQ ID NO: 1305226 - protein, 28 aa, Mycobacterium
WVEPVLRGEVMWCQLFSEPGAGSDAAAV

SEQ ID NO: 1305227 - protein, 19 aa, Mycobacterium
WVQRYFGAERLFDLDDLPG

SEQ ID NO: 1305228 - protein, 26 aa, Mycobacterium
WVRDSTFALWGLYTLGLDREADDFFA

SEQ ID NO: 1305229 - protein, 19 aa, Mycobacterium
WVRLDSAPFTDRLVRKFRL

SEQ ID NO: 1305230 - protein, 18 aa, Mycobacterium
WVRRDDGVLVCVAQVRPN

SEQ ID NO: 1305231 - protein, 27 aa, Mycobacterium
WVSPALTIPLNQPSVLGYGLRSLANPA

SEQ ID NO: 1305232 - protein, 24 aa, Mycobacterium
WVSSEYLFRRDADGDYWLVDNRGA

SEQ ID NO: 1305233 - protein, 19 aa, Mycobacterium
WVVDTDGLQLFLDPARLMF

SEQ ID NO: 1305234 - protein, 18 aa, Mycobacterium
WVVPHFEKMLYDNALLLR

SEQ ID NO: 1305235 - protein, 25 aa, Mycobacterium
WVVTPNGRFTIAAYAAPKSAGLWRE

SEQ ID NO: 1305236 - protein, 17 aa, Mycobacterium
WWLSGRPVQTGVSTDHQ

SEQ ID NO: 1305237 - protein, 19 aa, Mycobacterium
WYAELGRRHELLSGLVPQI

SEQ ID NO: 1305238 - protein, 24 aa, Mycobacterium
WYATAYVDGFRWVMPTNVVGMSQH

SEQ ID NO: 1305239 - protein, 19 aa, Mycobacterium
WYDGPTLLEYLEGVELVPP

SEQ ID NO: 1305240 - protein, 17 aa, Mycobacterium
WYLPTHGDTTTIADNRG

SEQ ID NO: 1305241 - protein, 18 aa, Mycobacterium
WYVPGVPYDKPTLMRHIR

SEQ ID NO: 1305242 - protein, 24 aa, Mycobacterium
YAADIERLEFLAARGWLIVRVSAT

SEQ ID NO: 1305243 - protein, 17 aa, Mycobacterium
YAAVLYRGGETGYRVAL

SEQ ID NO: 1305244 - protein, 22 aa, Mycobacterium
YACAPVYSHLLYDIVPGEKQVI

SEQ ID NO: 1305245 - protein, 18 aa, Mycobacterium
YACPFAIHDKFLAGNILS

SEQ ID NO: 1305246 - protein, 20 aa, Mycobacterium
YADYFDVDWTADPDGRILLP

SEQ ID NO: 1305247 - protein, 26 aa, Mycobacterium
YAEAGIAFNCLWPETYIATSAVANIG

SEQ ID NO: 1305248 - protein, 29 aa, Mycobacterium
YAEDWDLEQLWTALKQLYPVGIDYHDLVD

SEQ ID NO: 1305249 - protein, 21 aa, Mycobacterium
YAEMIAIAPTTLWAVTADRHR

SEQ ID NO: 1305250 - protein, 18 aa, Mycobacterium
YAEPVAVKQGWFCCWNGA

SEQ ID NO: 1305251 - protein, 29 aa, Mycobacterium
YAGAPVALNALPLTALQAAVAAAVSSGAA

SEQ ID NO: 1305252 - protein, 26 aa, Mycobacterium
YAGFLAAALLSQSFWIGRPLSEIDAL

SEQ ID NO: 1305253 - protein, 17 aa, Mycobacterium
YAGPRLHAAIRASQCFA

SEQ ID NO: 1305254 - protein, 19 aa, Mycobacterium
YAGWDGLAWAVDHLRESLL

SEQ ID NO: 1305255 - protein, 25 aa, Mycobacterium
YAMTKAAVAGLTRGLARELGPRGIT

SEQ ID NO: 1305256 - protein, 17 aa, Mycobacterium
YAQRLHTELVRATGRLA

SEQ ID NO: 1305257 - protein, 17 aa, Mycobacterium
YARETVGFALSIDGRVH

SEQ ID NO: 1305258 - protein, 18 aa, Mycobacterium
YASLFNGALFRASTIEAV

SEQ ID NO: 1305259 - protein, 23 aa, Mycobacterium
YASPAVLLTMGTWLSDKYAEGTI

SEQ ID NO: 1305260 - protein, 31 aa, Mycobacterium; identical to SEQ ID NO: 224561

SEQ ID NO: 1305261 - protein, 23 aa, Mycobacterium
YATMAQWCFLLARTSRGERKQQG

SEQ ID NO: 1305262 - protein, 28 aa, Mycobacterium
YATNSPLYPRLHEYFRTSRVPLLAVWGR

SEQ ID NO: 1305263 - protein, 27 aa, Mycobacterium
YATPTLKFVMISLAEPAKTPALTFDGL

SEQ ID NO: 1305264 - protein, 17 aa, Mycobacterium
YAVPHWPAEWGGGLSVA

SEQ ID NO: 1305265 - protein, 19 aa, Mycobacterium
YAVPRLLARNGLTLQDFDF

SEQ ID NO: 1305266 - protein, 20 aa, Mycobacterium
YAYRAFSPALHEAGAVVVTP

SEQ ID NO: 1305267 - protein, 34 aa, Mycobacterium
YCGEWIHSHALHIYLLHAPDFLGYPDAISFAKDH

SEQ ID NO: 1305268 - protein, 18 aa, Mycobacterium
YCIVLHICHKVADLPRMR

SEQ ID NO: 1305269 - protein, 25 aa, Mycobacterium
YCVVDARGWLRDPAPLFRTNVEGTR

SEQ ID NO: 1305270 - protein, 27 aa, Mycobacterium
YDAAVAWARRFTDYPPQVLAAAKAAFA

SEQ ID NO: 1305271 - protein, 26 aa, Mycobacterium
YDADDPDWLRWNYATVVWGIATAHEL

SEQ ID NO: 1305272 - protein, 32 aa, Mycobacterium
YDADPFPEFKEGLGLMLELPAPTTLGSVEVDL

SEQ ID NO: 1305273 - protein, 23 aa, Mycobacterium
YDALGNRYGLLGKTFNVFSKLRG

SEQ ID NO: 1305274 - protein, 18 aa, Mycobacterium
YDALYDPAAAHFLMTLID

SEQ ID NO: 1305275 - protein, 25 aa, Mycobacterium
YDCARLRFILTAQRDQYLPLKVIKA

SEQ ID NO: 1305276 - protein, 19 aa, Mycobacterium
YDEGVALLKALYENMRAAD

SEQ ID NO: 1305277 - protein, 20 aa, Mycobacterium
YDERIMLTGVKLARSIAEQA

SEQ ID NO: 1305278 - protein, 25 aa, Mycobacterium
YDESLWTLLCEQVGAAALVVPEELG

SEQ ID NO: 1305279 - protein, 19 aa, Mycobacterium
YDFAFTPGGWLPPDVDDRL

SEQ ID NO: 1305280 - protein, 19 aa, Mycobacterium
YDFFGIIFDGHPSLTRIEM

SEQ ID NO: 1305281 - protein, 25 aa, Mycobacterium
YDGALLLVTHDRRMLQNVRLDRTWR

SEQ ID NO: 1305282 - protein, 24 aa, Mycobacterium
YDGFTFNCLSWIEALGFCGIGEAK

SEQ ID NO: 1305283 - protein, 24 aa, Mycobacterium
YDGKHVLIVFDDLTKHAEAYRAIS

SEQ ID NO: 1305284 - protein, 17 aa, Mycobacterium
YDHPSVVWVAAGGSWAN

SEQ ID NO: 1305285 - protein, 19 aa, Mycobacterium
YDIAILGVPFDGGTSYRPG

SEQ ID NO: 1305286 - protein, 23 aa, Mycobacterium
YDIESPVWRHWVRDLSRGHTLIR

SEQ ID NO: 1305287 - protein, 25 aa, Mycobacterium
YDIPPRSVVPIAWDTIRTLAEHPNI

SEQ ID NO: 1305288 - protein, 18 aa, Mycobacterium
YDISNEFFGLWQDPTRTY

SEQ ID NO: 1305289 - protein, 18 aa, Mycobacterium
YDLINRRGKPKNIIVGVR

SEQ ID NO: 1305290 - protein, 25 aa, Mycobacterium
YDLSDDFFRLFLDPSQMYSCAYFER

SEQ ID NO: 1305291 - protein, 21 aa, Mycobacterium
YDMTAFWCRAGTAATITPPGI

SEQ ID NO: 1305292 - protein, 20 aa, Mycobacterium
YDRRYGLDEIHLRAIADLNY

SEQ ID NO: 1305293 - protein, 24 aa, Mycobacterium
YDRYMKYLLGCADFFNRNVSYVEQ

SEQ ID NO: 1305294 - protein, 19 aa, Mycobacterium
YDVDRLSAFFDLVQQDPVV

SEQ ID NO: 1305295 - protein, 18 aa, Mycobacterium
YEAVMRRQLLPTGRVTYL

SEQ ID NO: 1305296 - protein, 18 aa, Mycobacterium
YEGQIGQLPYSAAKGGVL

SEQ ID NO: 1305297 - protein, 30 aa, Mycobacterium
YEIKVICDKGFPSYFLIVADLINYAKSVDI

SEQ ID NO: 1305298 - protein, 19 aa, Mycobacterium
YELEALLEVVFHRGSKMHD

SEQ ID NO: 1305299 - protein, 28 aa, Mycobacterium
YENAPRPDLILLDLNLPKYDGRQLLETV

SEQ ID NO: 1305300 - protein, 25 aa, Mycobacterium
YENEWGWTWPMNRRVLYNRASADPQ

SEQ ID NO: 1305301 - protein, 17 aa, Mycobacterium
YEPMFAAADLGADTMPE

SEQ ID NO: 1305302 - protein, 26 aa, Mycobacterium
YEVADPQPLMLLPEPDKGDLFFDFEG

SEQ ID NO: 1305303 - protein, 17 aa, Mycobacterium
YEWWCWHDEYGQSEERG

SEQ ID NO: 1305304 - protein, 18 aa, Mycobacterium
YEYGSRAGLWRVLRVFER

SEQ ID NO: 1305305 - protein, 25 aa, Mycobacterium
YEYSNTNYVLLGLVIEKVTGTTAAA

SEQ ID NO: 1305306 - protein, 17 aa, Mycobacterium
YFAHRREVFARDGILLA

SEQ ID NO: 1305307 - protein, 22 aa, Mycobacterium
YFGPSFMINWLHNNYGGYKAES

SEQ ID NO: 1305308 - protein, 17 aa, Mycobacterium
YFLNYSYSPMSIGVAPP

SEQ ID NO: 1305309 - protein, 26 aa, Mycobacterium
YFPPAPAEALFRWLANKDGQNKVLNL

SEQ ID NO: 1305310 - protein, 17 aa, Mycobacterium
YFPRYRALCMAENATHN

SEQ ID NO: 1305311 - protein, 20 aa, Mycobacterium
YFRTSRVPLLAVWGRGDEIF

SEQ ID NO: 1305312 - protein, 29 aa, Mycobacterium
YFSSVYETPYFFSARKFERAHFPTISLTT

SEQ ID NO: 1305313 - protein, 31 aa, Mycobacterium
YFTDMSLVPDPYPYFDYLRAKCPVQRATPYG

SEQ ID NO: 1305314 - protein, 42 aa, Mycobacterium
YGALLSERLLAVPPHGWINLHFSLLPAWRGAAPVQAAIAAGD

SEQ ID NO: 1305315 - protein, 18 aa, Mycobacterium
YGATLRITRLRPSGRGAD

SEQ ID NO: 1305316 - protein, 36 aa, Mycobacterium
YGDPDRGWAWQVPLLELPHAQFLLMSATLGDVTFLR

SEQ ID NO: 1305317 - protein, 34 aa, Mycobacterium
YGDSKMGLFPFRRNLAFYAVDLALLTLTNPDILR

SEQ ID NO: 1305318 - protein, 23 aa, Mycobacterium
YGDTGVLAGLAPGAMIAIHSTVH

SEQ ID NO: 1305319 - protein, 23 aa, Mycobacterium
YGEWLHAGLLELGTLPDRARVQP

SEQ ID NO: 1305320 - protein, 17 aa, Mycobacterium
YGFMGGETDQWYPELVY

SEQ ID NO: 1305321 - protein, 25 aa, Mycobacterium
YGHFGQSGTFLWVDPDADLALVTFA

SEQ ID NO: 1305322 - protein, 29 aa, Mycobacterium
YGIDFIEACAWIKENLPGVHISGGISNVS

SEQ ID NO: 1305323 - protein, 38 aa, Mycobacterium
YGLDLQLALYVCYELHYRGFAGVDPHWEWNAGLLHLRG

SEQ ID NO: 1305324 - protein, 18 aa, Mycobacterium
YGLLRPVTETASVLLCNN

SEQ ID NO: 1305325 - protein, 20 aa, Mycobacterium
YGMICDASFPTFMLTHWTRD

SEQ ID NO: 1305326 - protein, 19 aa, Mycobacterium
YGPLVRAAAGFTKQWVYPS

SEQ ID NO: 1305327 - protein, 19 aa, Mycobacterium
YGPVYPRTPACYGFSIIAK

SEQ ID NO: 1305328 - protein, 26 aa, Mycobacterium
YGQSKLANLLFTYELNRRLSAKGAPT

SEQ ID NO: 1305329 - protein, 26 aa, Mycobacterium
YGRDGFLPTRLTVDLFKAARGVPTTT

SEQ ID NO: 1305330 - protein, 20 aa, Mycobacterium
YGRVDVLINNAFRVPSMKPF

SEQ ID NO: 1305331 - protein, 22 aa, Mycobacterium
YGRWTFQIVEDFDDNYWSVFRD

SEQ ID NO: 1305332 - protein, 30 aa, Mycobacterium
YGSASILPITWMYIRMMGAPGLRAASLTAI

SEQ ID NO: 1305333 - protein, 23 aa, Mycobacterium
YGTMPHSRKCRCARLVYANSMHV

SEQ ID NO: 1305334 - protein, 25 aa, Mycobacterium
YGVDFVQNTWRFGLDRVLAGVAMSD

SEQ ID NO: 1305335 - protein, 17 aa, Mycobacterium
YGVHVLVIRPGQVRTRM

SEQ ID NO: 1305336 - protein, 25 aa, Mycobacterium
YGVTVPAARRYLPGSLILETTWQTH

SEQ ID NO: 1305337 - protein, 17 aa, Mycobacterium
YHAALAHAGNHVTTVIL

SEQ ID NO: 1305338 - protein, 24 aa, Mycobacterium
YHDDAIYFEPRYATRQPDGGWGEY

SEQ ID NO: 1305339 - protein, 17 aa, Mycobacterium
YHHFRTRDELLSAVMEP

SEQ ID NO: 1305340 - protein, 19 aa, Mycobacterium
YHTFGGWKRSGFGDLNQHG

SEQ ID NO: 1305341 - protein, 20 aa, Mycobacterium
YHVLAPDMLGFGRSAKVVDF

SEQ ID NO: 1305342 - protein, 23 aa, Mycobacterium
YIAGAKILRQYGIGPLPGVAMMV

SEQ ID NO: 1305343 - protein, 22 aa, Mycobacterium
YIALEFAQMYRRFGARVTVLEH

SEQ ID NO: 1305344 - protein, 20 aa, Mycobacterium
YIASYLRAFPGYYLTGDGGY

SEQ ID NO: 1305345 - protein, 17 aa, Mycobacterium
YIELFYGHPRNQSSWEL

SEQ ID NO: 1305346 - protein, 17 aa, Mycobacterium
YIGQYRIRYRYTANQTE

SEQ ID NO: 1305347 - protein, 25 aa, Mycobacterium
YIREQLPGTWLLASLYFRADVRGLD

SEQ ID NO: 1305348 - protein, 20 aa, Mycobacterium
YIRTTPERLWQALTGPSFSG

SEQ ID NO: 1305349 - protein, 36 aa, Mycobacterium
YITGQTLLVDGGLDLKWTHLGADNTSLFLKDENFRS

SEQ ID NO: 1305350 - protein, 19 aa, Mycobacterium
YIVYRRDRADLRAAKALLG

SEQ ID NO: 1305351 - protein, 25 aa, Mycobacterium
YKAFGDKHSMFLRSLELYCTEALDG

SEQ ID NO: 1305352 - protein, 23 aa, Mycobacterium
YKANLRHVLLCTQRVAQQMVAAG

SEQ ID NO: 1305353 - protein, 20 aa, Mycobacterium
YLAELTMLILAKAQAKDPSG

SEQ ID NO: 1305354 - protein, 29 aa, Mycobacterium
YLAKRDAEWMGRVHRFLGLDVGVILSGLT

SEQ ID NO: 1305355 - protein, 31 aa, Mycobacterium
YLAVFDDHTEEILYFGRARRTASTAQRLALF

SEQ ID NO: 1305356 - protein, 18 aa, Mycobacterium
YLDLALQEGGRFACGGGR

SEQ ID NO: 1305357 - protein, 21 aa, Mycobacterium
YLDRTWTWAQWDDRVRRLAGA

SEQ ID NO: 1305358 - protein, 26 aa, Mycobacterium
YLEAFAQRMAPVLAAEKATWAPAHGD

SEQ ID NO: 1305359 - protein, 30 aa, Mycobacterium
YLEAFGHVVIAWMWLEQFLAAEGRTGDFYD

SEQ ID NO: 1305360 - protein, 27 aa, Mycobacterium
YLERMPWGYTCHFPRPDWKLPKRADAK

SEQ ID NO: 1305361 - protein, 20 aa, Mycobacterium
YLEYLTPLVARRRAERRGDD

SEQ ID NO: 1305362 - protein, 18 aa, Mycobacterium
YLGLQAGDLYLITHLSRA

SEQ ID NO: 1305363 - protein, 17 aa, Mycobacterium
YLKAWKAKVKGVTVYRY

SEQ ID NO: 1305364 - protein, 32 aa, Mycobacterium
YLNIASLDHAMWFMRPFRADEWLLYDQSSPSA

SEQ ID NO: 1305365 - protein, 21 aa, Mycobacterium
YLNRPRWPDIPGRDTFAGISV

SEQ ID NO: 1305366 - protein, 17 aa, Mycobacterium
YLPALACARCRAIARCR

SEQ ID NO: 1305367 - protein, 18 aa, Mycobacterium
YLQGLADAGAVGVVVELG

SEQ ID NO: 1305368 - protein, 18 aa, Mycobacterium
YLQMLDMADLDHLALVAG

SEQ ID NO: 1305369 - protein, 17 aa, Mycobacterium
YLRELAFRDFYAAVLHE

SEQ ID NO: 1305370 - protein, 18 aa, Mycobacterium
YLRGDTRVRVIWRGTDAI

SEQ ID NO: 1305371 - protein, 20 aa, Mycobacterium
YLTRPSLVHYTRTPDEFSWR

SEQ ID NO: 1305372 - protein, 20 aa, Mycobacterium
YLVDFPSPVSYDKCIIFWGV

SEQ ID NO: 1305373 - protein, 19 aa, Mycobacterium
YLVPPQQAAWLPMGLEHQA

SEQ ID NO: 1305374 - protein, 28 aa, Mycobacterium
YLVRPDTLDPIWLAPLQDELARISTVAD

SEQ ID NO: 1305375 - protein, 18 aa, Mycobacterium
YMGHAMVSTWQRGAPYTW

SEQ ID NO: 1305376 - protein, 18 aa, Mycobacterium
YMTMAPLLEHDDADWWKV

SEQ ID NO: 1305377 - protein, 20 aa, Mycobacterium
YNDAMVAQYAPRIAGRPAAS

SEQ ID NO: 1305378 - protein, 17 aa, Mycobacterium
YNDLHLTLKHVHWNVVG

SEQ ID NO: 1305379 - protein, 20 aa, Mycobacterium
YNFQFTGQRFFRIRDGRLDG

SEQ ID NO: 1305380 - protein, 19 aa, Mycobacterium
YNLPYRRRRPKGPPSGSAT

SEQ ID NO: 1305381 - protein, 17 aa, Mycobacterium
YNNAPALKLFLGDSFEG

SEQ ID NO: 1305382 - protein, 21 aa, Mycobacterium
YPDLAIPFHSRWRHFEAGNVN

SEQ ID NO: 1305383 - protein, 24 aa, Mycobacterium
YPEDRLAFILGDCDAKLVLREPVS

SEQ ID NO: 1305384 - protein, 31 aa, Mycobacterium
YPFSAIVGHDRLLLALLLCAVRPEIGGVLIR

SEQ ID NO: 1305385 - protein, 18 aa, Mycobacterium
YPGEKEAAPLRAAALEGG

SEQ ID NO: 1305386 - protein, 26 aa, Mycobacterium
YPGRFIPIAIMPTWNPEAMCAEIRRV

SEQ ID NO: 1305387 - protein, 19 aa, Mycobacterium
YPGRIWVVAHKPVAVAAGL

SEQ ID NO: 1305388 - protein, 22 aa, Mycobacterium
YPIARMWRDARIQRIYGGANEV

SEQ ID NO: 1305389 - protein, 26 aa, Mycobacterium
YPLDRGAAGIALLASMPPRPGERELV

SEQ ID NO: 1305390 - protein, 31 aa, Mycobacterium
YPLDSFPGAPPFLRGPYPTMYVNQPWTIRQY

SEQ ID NO: 1305391 - protein, 17 aa, Mycobacterium
YPLVKTPMIAPTREYDR

SEQ ID NO: 1305392 - protein, 19 aa, Mycobacterium
YPRVEVEVGFILADDLPGA

SEQ ID NO: 1305393 - protein, 19 aa, Mycobacterium
YPRVRAELLPTYQQEATAI

SEQ ID NO: 1305394 - protein, 23 aa, Mycobacterium
YPVIERFGHVWTCLGDPVFDLPD

SEQ ID NO: 1305395 - protein, 25 aa, Mycobacterium
YQAVRIIRMFVEFWDRTRLAEQEAI

SEQ ID NO: 1305396 - protein, 20 aa, Mycobacterium
YQAVRTHFFDAFFTAAAEAG

SEQ ID NO: 1305397 - protein, 17 aa, Mycobacterium
YQREYGLYPDGICGPET

SEQ ID NO: 1305398 - protein, 26 aa, Mycobacterium
YQVHIDGELVWPLPDSPFPPSVIRTR

SEQ ID NO: 1305399 - protein, 23 aa, Mycobacterium
YRAEKYLGIIDRVRAAIPDAAIT

SEQ ID NO: 1305400 - protein, 20 aa, Mycobacterium
YRALGLLADCGRGEVIGSLA

SEQ ID NO: 1305401 - protein, 29 aa, Mycobacterium
YREAQPPVVPRRPIIRPIAVDETGFSVHP

SEQ ID NO: 1305402 - protein, 17 aa, Mycobacterium
YREDWPQADALRFAVNR

SEQ ID NO: 1305403 - protein, 18 aa, Mycobacterium
YREYYHRIDYVLEAVERG

SEQ ID NO: 1305404 - protein, 19 aa, Mycobacterium
YRFSRTPMFTADALRRFRS

SEQ ID NO: 1305405 - protein, 20 aa, Mycobacterium
YRFVYRKRFHKRAETELTIL

SEQ ID NO: 1305406 - protein, 26 aa, Mycobacterium
YRGDLAWWAGPWPVDERWWDPDRAKG

SEQ ID NO: 1305407 - protein, 25 aa, Mycobacterium
YRGTWPDFFEFLRGGARFELLELHV

SEQ ID NO: 1305408 - protein, 17 aa, Mycobacterium
YRLHTFGTVTRVAAGGE

SEQ ID NO: 1305409 - protein, 18 aa, Mycobacterium
YRNLPEHPAFDWYAERIS

SEQ ID NO: 1305410 - protein, 30 aa, Mycobacterium
YRNSYVFAAELFPRMAVPKAWYDAGIAHRS

SEQ ID NO: 1305411 - protein, 26 aa, Mycobacterium
YRPGLVHIYHALTWGPLVREIVSAAT

SEQ ID NO: 1305412 - protein, 18 aa, Mycobacterium
YRPRLRGPVPTEDDVVAT

SEQ ID NO: 1305413 - protein, 25 aa, Mycobacterium
YRQGPGGYAPPPPPGGQPGYGAPGA

SEQ ID NO: 1305414 - protein, 26 aa, Mycobacterium
YRQMPAADLLAWFDTSRAALVAAFAD

SEQ ID NO: 1305415 - protein, 18 aa, Mycobacterium
YRQPGFVTAMRDIMALQD

SEQ ID NO: 1305416 - protein, 20 aa, Mycobacterium
YRTRWRIPLGVRESDLSVAY

SEQ ID NO: 1305417 - protein, 19 aa, Mycobacterium
YRVHHRVSARFRVGSIFLA

SEQ ID NO: 1305418 - protein, 25 aa, Mycobacterium
YRYSDINYILLGALIEKVTGEAEDT

SEQ ID NO: 1305419 - protein, 23 aa, Mycobacterium
YSANALLNLFDHLGIERAALVGN

SEQ ID NO: 1305420 - protein, 25 aa, Mycobacterium
YSAVIWACVFMRTSARRVHFGEIEP

SEQ ID NO: 1305421 - protein, 19 aa, Mycobacterium
YSELVVQWAALGPGQTAWD

SEQ ID NO: 1305422 - protein, 26 aa, Mycobacterium
YSKEYEIERLMRDAPFLLIGEGTSEI

SEQ ID NO: 1305423 - protein, 24 aa, Mycobacterium
YSLKPVAAALSEKLGRHVQLAGDV

SEQ ID NO: 1305424 - protein, 24 aa, Mycobacterium
YSPEQAYLLLGAAPIEGRLSGVVD

SEQ ID NO: 1305425 - protein, 17 aa, Mycobacterium
YSRRVVGWSIADHLRTE

SEQ ID NO: 1305426 - protein, 20 aa, Mycobacterium
YSSLFPPPDGIIGPDTPPAN

SEQ ID NO: 1305427 - protein, 27 aa, Mycobacterium
YSTAAPLDRRLLLAVLADLPAGSGVDA

SEQ ID NO: 1305428 - protein, 26 aa, Mycobacterium
YSTEYDVERYFRDAPLMIVGEGTNEI

SEQ ID NO: 1305429 - protein, 28 aa, Mycobacterium
YSTGYNITFPFFDPALISAPDNQIRLYK

SEQ ID NO: 1305430 - protein, 22 aa, Mycobacterium
YSVATGLYQFSLLDVIDIADID

SEQ ID NO: 1305431 - protein, 26 aa, Mycobacterium
YTAVFDAFVERLTPGGALIACVDDPG

SEQ ID NO: 1305432 - protein, 21 aa, Mycobacterium
YTGFHLKPVGFFDGNPALDLP

SEQ ID NO: 1305433 - protein, 24 aa, Mycobacterium
YTGPDHYRWTLHAGPVETTWESRI

SEQ ID NO: 1305434 - protein, 28 aa, Mycobacterium
YTHKIMTPMFVPEPQPHGVPKIFIAAVG

SEQ ID NO: 1305435 - protein, 26 aa, Mycobacterium
YTKGFKFSTYATWWIRQAITRGMADQ

SEQ ID NO: 1305436 - protein, 23 aa, Mycobacterium
YTRGYIHHLFKAKEMLASTLCTI

SEQ ID NO: 1305437 - protein, 24 aa, Mycobacterium
YTRTLEVLERFYSLVLTDCGTGLM

SEQ ID NO: 1305438 - protein, 21 aa, Mycobacterium
YTYSSAWFDAISPPPKLGRAA

SEQ ID NO: 1305439 - protein, 19 aa, Mycobacterium
YVASKWAVRGLTKSAALEL

SEQ ID NO: 1305440 - protein, 29 aa, Mycobacterium
YVDDVTLPGMLHLAILRSPYAHARIANID

SEQ ID NO: 1305441 - protein, 28 aa, Mycobacterium
YVDSKLAEFEDFLNGTLRSVGRGRHQLR

SEQ ID NO: 1305442 - protein, 26 aa, Mycobacterium
YVEPYRREVERLGRLVFGDSFEVEVD

SEQ ID NO: 1305443 - protein, 17 aa, Mycobacterium
YVERYLPDGFTAVAAAH

SEQ ID NO: 1305444 - protein, 39 aa, Mycobacterium
YVGTGGVLLPLLLFASARAAIPFTPLNYRLSREGLHELI

SEQ ID NO: 1305445 - protein, 24 aa, Mycobacterium
YVHNLIHGFILAAEHLVPGGTAPG

SEQ ID NO: 1305446 - protein, 20 aa, Mycobacterium
YVLRIPDALPLDAAAPLLCA

SEQ ID NO: 1305447 - protein, 32 aa, Mycobacterium
YVPMLMAAGLPRVVRWLPPVSTLFDPTARDRA

SEQ ID NO: 1305448 - protein, 31 aa, Mycobacterium
YVPQHKRQYGYYVWPFLLDGRLVGRVDLKAE

SEQ ID NO: 1305449 - protein, 32 aa, Mycobacterium
YVPTDRCWALWPVLVSIWHWERTWVPGHTSSL

SEQ ID NO: 1305450 - protein, 24 aa, Mycobacterium
YVRPPWLRRWVRDGYGWIQPRLSP

SEQ ID NO: 1305451 - protein, 17 aa, Mycobacterium
YVTALLPVAQGVAVYAA

SEQ ID NO: 1305452 - protein, 26 aa, Mycobacterium
YVVRHPEQYPHHLPSARYLAAESARL

SEQ ID NO: 1305453 - protein, 17 aa, Mycobacterium
YVWHAYLPTVTPGQRYG

SEQ ID NO: 1305454 - protein, 25 aa, Mycobacterium
YYAEAAPFVQQLKDGGFEGTFVSAD

SEQ ID NO: 1305455 - protein, 18 aa, Mycobacterium
YYDPFDFDIDDDPYPIWK

SEQ ID NO: 1305456 - protein, 18 aa, Mycobacterium
YYFNDHGAQIDRFVSSLI

SEQ ID NO: 1305457 - protein, 20 aa, Mycobacterium
YYHLSFHEGSRYPLDRGAAG

SEQ ID NO: 1305458 - protein, 18 aa, Mycobacterium
YYIHGFLRDRMQTLQDEF

SEQ ID NO: 1305459 - protein, 19 aa, Mycobacterium
YYQVRRYAAEYLAPQGVTV

SEQ ID NO: 1305460 - protein, 21 aa, Mycobacterium
YYVEAFTLSILKFRGHRILNG

SEQ ID NO: 1305461 - protein, 18 aa, Mycobacterium
YYVQYAHARLSALARNAA

SEQ ID NO: 1305462 - protein, 17 aa, Mycobacterium
AAAAMPTAPMPTAGALP

SEQ ID NO: 1305463 - protein, 26 aa, Mycobacterium
AAADEALAWWRGPLLADLSDESWVAD

SEQ ID NO: 1305464 - protein, 34 aa, Mycobacterium
AAADLGYDALLAPLTFISIFGYQAQLAMFKANGI

SEQ ID NO: 1305465 - protein, 32 aa, Mycobacterium
AAADLIWSPMLRRFPDLKFALSEGGIGWVPYF

SEQ ID NO: 1305466 - protein, 26 aa, Mycobacterium
AAAFTALPFDHLFFTGSPAVGVHVQR

SEQ ID NO: 1305467 - protein, 30 aa, Mycobacterium
AAAHAIPLAALHYFPVRPSTKSLPVPVPSA

SEQ ID NO: 1305468 - protein, 20 aa, Mycobacterium
AAAIRLLQQLHSAPLDPDLL

SEQ ID NO: 1305469 - protein, 19 aa, Mycobacterium
AAAKRWRTLTNRHGRDRGR

SEQ ID NO: 1305470 - protein, 34 aa, Mycobacterium
AAALSHRVWLRPFRNLVYVMPPYICTPEEIAQIT

SEQ ID NO: 1305471 - protein, 17 aa, Mycobacterium
AAAPFLDKDAVREIEAA

SEQ ID NO: 1305472 - protein, 24 aa, Mycobacterium
AAAPLRVHPDIHLFPAIPQQRSST

SEQ ID NO: 1305473 - protein, 32 aa, Mycobacterium
AAARDAARFLLLTPPLPLPARAPYGVLAAISV

SEQ ID NO: 1305474 - protein, 18 aa, Mycobacterium
AAARMRGPIARDAIARVT

SEQ ID NO: 1305475 - protein, 24 aa, Mycobacterium
AAARRLGVPEGKWVYLRGHADQTE

SEQ ID NO: 1305476 - protein, 22 aa, Mycobacterium
AAARVRAKLPSGAELLFCQHHA

SEQ ID NO: 1305477 - protein, 30 aa, Mycobacterium
AAAVNFPDVLLIAGRYQVSVPTPFVPGSEF

SEQ ID NO: 1305478 - protein, 25 aa, Mycobacterium
AAAVTRLILIGKAGLRLHEEVFLAG

SEQ ID NO: 1305479 - protein, 23 aa, Mycobacterium
AAAYVLNRWLSSGGVLAAKIPAT

SEQ ID NO: 1305480 - protein, 20 aa, Mycobacterium
AADDVVLPAFRLPAAEVRGN

SEQ ID NO: 1305481 - protein, 19 aa, Mycobacterium
AADLQILKRGARLVEFAKL

SEQ ID NO: 1305482 - protein, 17 aa, Mycobacterium
AADMVFLRNCGVHPVVV

SEQ ID NO: 1305483 - protein, 20 aa, Mycobacterium
AADRADFVRREFRSHKVKVT

SEQ ID NO: 1305484 - protein, 23 aa, Mycobacterium
AADRVNLILVARRTERLEELRSR

SEQ ID NO: 1305485 - protein, 28 aa, Mycobacterium
AAEALGGGWFWPAAAAHPSLPRGALLQV

SEQ ID NO: 1305486 - protein, 26 aa, Mycobacterium
AAEKSNLPAMLPLPHPQMRPDQPTQA

SEQ ID NO: 1305487 - protein, 20 aa, Mycobacterium
AAELLTTPIIEALIAVRRHE

SEQ ID NO: 1305488 - protein, 21 aa, Mycobacterium
AAELMVPFYAVRYEGVVSSFL

SEQ ID NO: 1305489 - protein, 24 aa, Mycobacterium
AAELRPWVPVVSLVKGLEQGTNMR

SEQ ID NO: 1305490 - protein, 24 aa, Mycobacterium
AAERLRLKLIQRQDRWHDKAEETQ

SEQ ID NO: 1305491 - protein, 30 aa, Mycobacterium
AAEVLRARNLLPVPWVDPVDVANAVVFLAS

SEQ ID NO: 1305492 - protein, 33 aa, Mycobacterium
AAEVTPNRWFLNGADFIALRKLKETTGSAKYLI

SEQ ID NO: 1305493 - protein, 23 aa, Mycobacterium
AAEYLSGRWSQVYGFPVMPVDGI

SEQ ID NO: 1305494 - protein, 18 aa, Mycobacterium
AAFGKLPFVMSGIELEAV

SEQ ID NO: 1305495 - protein, 18 aa, Mycobacterium
AAGFTKQWVYPSDPDEFC

SEQ ID NO: 1305496 - protein, 25 aa, Mycobacterium
AAGGLNWNSMPLKLFAGGNAKFWDP

SEQ ID NO: 1305497 - protein, 32 aa, Mycobacterium
AAGIPWDVPALTINKMCLSGIDAIALADQLIR

SEQ ID NO: 1305498 - protein, 25 aa, Mycobacterium
AAGRYVLDRAIFDALRRVKRGAGNE

SEQ ID NO: 1305499 - protein, 18 aa, Mycobacterium
AAGWLVEHAGFGKGYPGD

SEQ ID NO: 1305500 - protein, 21 aa, Mycobacterium
AAIAAIMPPGSDIPSVKVSET

SEQ ID NO: 1305501 - protein, 24 aa, Mycobacterium
AAIACLEQGLRVGCFRPPTVPAGT

SEQ ID NO: 1305502 - protein, 19 aa, Mycobacterium
AAIEAMWEWVTASSDTLKT

SEQ ID NO: 1305503 - protein, 33 aa, Mycobacterium
AAITALPRYKDQGRPFLAFVYGIAAHKIADAHR

SEQ ID NO: 1305504 - protein, 24 aa, Mycobacterium
AAIYGTPDWFTQVGPDTLIVVDEA

SEQ ID NO: 1305505 - protein, 17 aa, Mycobacterium
AAKQYLTYVGGAPFQPA

SEQ ID NO: 1305506 - protein, 21 aa, Mycobacterium
AALATALRRVLTQPRLAGEMA

SEQ ID NO: 1305507 - protein, 27 aa, Mycobacterium
AALERAAALWPDRLAVTALPGGTNLEQ

SEQ ID NO: 1305508 - protein, 18 aa, Mycobacterium
AALLDRFGMFGVRISIAV

SEQ ID NO: 1305509 - protein, 19 aa, Mycobacterium
AALLRYQEAAQAQIQTLTE

SEQ ID NO: 1305510 - protein, 30 aa, Mycobacterium
AALSAAVADPLWMLMRQWQFGEFRGEDAGT

SEQ ID NO: 1305511 - protein, 20 aa, Mycobacterium
AALTLLWNTLAWGSGDKRRN

SEQ ID NO: 1305512 - protein, 18 aa, Mycobacterium
AALTTYLRAHTDTRWFTC

SEQ ID NO: 1305513 - protein, 25 aa, Mycobacterium
AALVELLEQMWWTPTLMTVDEWLDG

SEQ ID NO: 1305514 - protein, 26 aa, Mycobacterium
AAMAGPTLRLDPWTTPIPGAYLCSSA

SEQ ID NO: 1305515 - protein, 29 aa, Mycobacterium
AANPLIRVLEDALRFYFEFHFDQGEGYLA

SEQ ID NO: 1305516 - protein, 26 aa, Mycobacterium
AANQWFASTLGLLALPREEVKSVPDL

SEQ ID NO: 1305517 - protein, 30 aa, Mycobacterium
AANRSEFYRALPSGPFYGFNRPGVEPSEAI

SEQ ID NO: 1305518 - protein, 23 aa, Mycobacterium
AAPHHLIADGALLTHRRTRAGDA

SEQ ID NO: 1305519 - protein, 26 aa, Mycobacterium
AAPPVGALRWRPPEPAPAWDGERQAT

SEQ ID NO: 1305520 - protein, 19 aa, Mycobacterium
AAPRPVGLVLGDHLVRPAS

SEQ ID NO: 1305521 - protein, 17 aa, Mycobacterium
AARALHALGPQWALVKG

SEQ ID NO: 1305522 - protein, 17 aa, Mycobacterium
AARALLAELLAAGQRAG

SEQ ID NO: 1305523 - protein, 18 aa, Mycobacterium
AARERMARLLRDAAAAPP

SEQ ID NO: 1305524 - protein, 21 aa, Mycobacterium
AARFFYRYELPKVGPQLDLLD

SEQ ID NO: 1305525 - protein, 17 aa, Mycobacterium
AARGHSLLKSGYGAYLL

SEQ ID NO: 1305526 - protein, 21 aa, Mycobacterium
AARQPAAAKTAMRRSSRATAD

SEQ ID NO: 1305527 - protein, 30 aa, Mycobacterium
AARTEGVRATLSIPLILASPTDRQDSELVG

SEQ ID NO: 1305528 - protein, 31 aa, Mycobacterium
AARTTQLAILLAAVPITFWDPVRLAEEISVL

SEQ ID NO: 1305529 - protein, 24 aa, Mycobacterium
AASAIFRPAFVNGCIADPGDTLQE

SEQ ID NO: 1305530 - protein, 23 aa, Mycobacterium
AATAAVTALVPAGADEVSAMAAA

SEQ ID NO: 1305531 - protein, 24 aa, Mycobacterium
AATERSYWRTVIRPQALARDNHQC

SEQ ID NO: 1305532 - protein, 29 aa, Mycobacterium
AATLLAAADLWIFLTTAARYADAVPWNML

SEQ ID NO: 1305533 - protein, 39 aa, Mycobacterium
AATRLGRPLRIAHAWSFTFDAAWQPLVALFEGHSVHIIG

SEQ ID NO: 1305534 - protein, 25 aa, Mycobacterium
AATSGRVAFLIRFGSGVLPDAKTVI

SEQ ID NO: 1305535 - protein, 33 aa, Mycobacterium
AATTEPRLWLLGSSMYSARLAAAKGLPYVFAHH

SEQ ID NO: 1305536 - protein, 34 aa, Mycobacterium
AATYEWIVKNQPGEWMYSQPTWVVTHRPDIVAAG

SEQ ID NO: 1305537 - protein, 29 aa, Mycobacterium
AAVGRFVIGGWAEVLLLAGRRDGAHRVVV

SEQ ID NO: 1305538 - protein, 25 aa, Mycobacterium
AAVPAPLMRWGVVAFDPTVRSPTAI

SEQ ID NO: 1305539 - protein, 31 aa, Mycobacterium
AAVSIRPLLLMLSHPFYWQHFGRLTDVVRTG

SEQ ID NO: 1305540 - protein, 24 aa, Mycobacterium
AAVTVMMRVVFLLFAEERGMLPTE

SEQ ID NO: 1305541 - protein, 20 aa, Mycobacterium
AAVVVTRFGEPRLGLAPALS

SEQ ID NO: 1305542 - protein, 23 aa, Mycobacterium
AAYDQLPAPLRALVENLWAVHTN

SEQ ID NO: 1305543 - protein, 22 aa, Mycobacterium
AAYIERLDPSIFWMGMHHSRLV

SEQ ID NO: 1305544 - protein, 21 aa, Mycobacterium
AAYLPACLASHLPLDLVVIML

SEQ ID NO: 1305545 - protein, 21 aa, Mycobacterium
ACARHRVEWFWVKGHSGVADN

SEQ ID NO: 1305546 - protein, 18 aa, Mycobacterium
ACGRIDGLERVRFTSPHP

SEQ ID NO: 1305547 - protein, 21 aa, Mycobacterium
ACMTAHMKARPRLFDELDASH

SEQ ID NO: 1305548 - protein, 18 aa, Mycobacterium
ACRILTSGTIRIGDAVTI

SEQ ID NO: 1305549 - protein, 30 aa, Mycobacterium
ACTEYRAQWLICRALEVVLGWIADGNSGAV

SEQ ID NO: 1305550 - protein, 18 aa, Mycobacterium
ACWPDAATCRREVFRWLT

SEQ ID NO: 1305551 - protein, 21 aa, Mycobacterium
ADAALVFYLTKADPLLVLRDL

SEQ ID NO: 1305552 - protein, 24 aa, Mycobacterium
ADAASNWYSEFARLAPLMEKDVHY

SEQ ID NO: 1305553 - protein, 23 aa, Mycobacterium
ADADGLVRWMADLNTRTVPEHPF

SEQ ID NO: 1305554 - protein, 19 aa, Mycobacterium
ADAEFHFAVVRASHNAVLT

SEQ ID NO: 1305555 - protein, 27 aa, Mycobacterium
ADAGDILWAVFSPYTPFLNSPGMPPVG

SEQ ID NO: 1305556 - protein, 17 aa, Mycobacterium
ADALMRKLDPRGVIVVM

SEQ ID NO: 1305557 - protein, 26 aa, Mycobacterium
ADARQTYVEKLQAVGNQRHTAVQLRC

SEQ ID NO: 1305558 - protein, 20 aa, Mycobacterium
ADATRVQILWALVSHEKSVN

SEQ ID NO: 1305559 - protein, 24 aa, Mycobacterium
ADAVAYLVNVTVRPGYNFANADAA

SEQ ID NO: 1305560 - protein, 23 aa, Mycobacterium
ADDGLGAAALWDPPGRWKQTRLE

SEQ ID NO: 1305561 - protein, 26 aa, Mycobacterium
ADDHRLFAGIPYAAPPVGALRWRPPE

SEQ ID NO: 1305562 - protein, 28 aa, Mycobacterium
ADELAVVHPSWWSRRRVQAVLDAAGDIC

SEQ ID NO: 1305563 - protein, 25 aa, Mycobacterium
ADERAFWQFHASLMEPWDGPACVTF

SEQ ID NO: 1305564 - protein, 25 aa, Mycobacterium
ADERRLLDSLAVRKLWGIGPVAEDK

SEQ ID NO: 1305565 - protein, 21 aa, Mycobacterium
ADFLALPRQHLADAALSAALA

SEQ ID NO: 1305566 - protein, 31 aa, Mycobacterium
ADFQHMITQYAWGSIWTRPGLDFRSRSMITL

SEQ ID NO: 1305567 - protein, 35 aa, Mycobacterium
ADFQSLLNVHALGPIHLIQRVLPDMRAAGRGDVIM

SEQ ID NO: 1305568 - protein, 25 aa, Mycobacterium
ADGLKELFVTCAQAAFAHRYDPLLD

SEQ ID NO: 1305569 - protein, 19 aa, Mycobacterium
ADHAGVSRSWLYTQPDLKD

SEQ ID NO: 1305570 - protein, 19 aa, Mycobacterium
ADHRGGLPGHLRWAGHGVR

SEQ ID NO: 1305571 - protein, 23 aa, Mycobacterium
ADIEAWMDQGWSPKLISQVLARD

SEQ ID NO: 1305572 - protein, 18 aa, Mycobacterium
ADIRICSSAATFGNAAIL

SEQ ID NO: 1305573 - protein, 17 aa, Mycobacterium
ADIRLRWAESMADAARE

SEQ ID NO: 1305574 - protein, 21 aa, Mycobacterium
ADIRYHALLAELPIQQVHSVL

SEQ ID NO: 1305575 - protein, 33 aa, Mycobacterium
ADLAGLRPRRFVVLPWLTPTLASHWVGLVTPIS

SEQ ID NO: 1305576 - protein, 22 aa, Mycobacterium
ADLLQAAGKYPPPKGASDIMGL

SEQ ID NO: 1305577 - protein, 17 aa, Mycobacterium
ADLPERAGVAAIPMSAF

SEQ ID NO: 1305578 - protein, 17 aa, Mycobacterium
ADLQAYLTHLCSLATQG

SEQ ID NO: 1305579 - protein, 23 aa, Mycobacterium
ADLRGVRALPVLILAGDVDAVVS

SEQ ID NO: 1305580 - protein, 21 aa, Mycobacterium
ADLVLAIYNPASKTRTWQVGA

SEQ ID NO: 1305581 - protein, 18 aa, Mycobacterium
ADMMIYLTWTMDGRGAQE

SEQ ID NO: 1305582 - protein, 23 aa, Mycobacterium
ADNILHLVLARPVGVDGVGGPGT

SEQ ID NO: 1305583 - protein, 33 aa, Mycobacterium
ADNYRSRLIAPGQRVLFWVSAHPLRGFWGAGRI

SEQ ID NO: 1305584 - protein, 17 aa, Mycobacterium
ADPSLRIAILEARFAGF

SEQ ID NO: 1305585 - protein, 22 aa, Mycobacterium
ADPTGLLLLPAGDAVVLVDATA

SEQ ID NO: 1305586 - protein, 26 aa, Mycobacterium
ADQPYVMQPIQITGLHRVLETHPTIE

SEQ ID NO: 1305587 - protein, 25 aa, Mycobacterium
ADSCAQWLRWYDGEVMPTLVDAVNE

SEQ ID NO: 1305588 - protein, 20 aa, Mycobacterium
ADSIRTIFGFGRAAAESQVS

SEQ ID NO: 1305589 - protein, 25 aa, Mycobacterium
ADTVLVHPFDVAIPNGFPGTSSTFA

SEQ ID NO: 1305590 - protein, 31 aa, Mycobacterium
ADVAAILRRFDIIVLPLVNPDGRWVSVTAPK

SEQ ID NO: 1305591 - protein, 24 aa, Mycobacterium
ADVANLLRVTLPWWPRGLRERDAM

SEQ ID NO: 1305592 - protein, 39 aa, Mycobacterium
ADVKLLARLLGLPYFPVTPLFPVAGPLGLVPLPSKWHIQ

SEQ ID NO: 1305593 - protein, 25 aa, Mycobacterium
ADVSDYHALWRWSVEDLAGFWGALW

SEQ ID NO: 1305594 - protein, 26 aa, Mycobacterium
ADWYSTGIDFKRPTPQWWYDDTHLHG

SEQ ID NO: 1305595 - protein, 23 aa, Mycobacterium
ADYKGFRRIAALEYVPLAGGDVS

SEQ ID NO: 1305596 - protein, 26 aa, Mycobacterium
AEAAAFAGVLPYGPARRWQKKKDPDQ

SEQ ID NO: 1305597 - protein, 25 aa, Mycobacterium
AEAALRWGPLSEARLARAIDAVIHR

SEQ ID NO: 1305598 - protein, 22 aa, Mycobacterium
AEAGLHWRQIQLVAGADTIRNG

SEQ ID NO: 1305599 - protein, 28 aa, Mycobacterium
AEAITDRILLLDGLPNYQRLFSLRVGQT

SEQ ID NO: 1305600 - protein, 24 aa, Mycobacterium
AEAIVHLGFGFGIVFINPALEAVN

SEQ ID NO: 1305601 - protein, 19 aa, Mycobacterium
AEALAAELMVPFYAVRYEG

SEQ ID NO: 1305602 - protein, 20 aa, Mycobacterium
AEALRWYWDQYVPNDFDRTH

SEQ ID NO: 1305603 - protein, 17 aa, Mycobacterium
AEAMVAAWVAGVDREIV

SEQ ID NO: 1305604 - protein, 25 aa, Mycobacterium
AEAQGFASFWFPQVPGYLDAMTAVA

SEQ ID NO: 1305605 - protein, 27 aa, Mycobacterium
AEAWDAVYWMMARTLIELERHLYAEAG

SEQ ID NO: 1305606 - protein, 24 aa, Mycobacterium
AECWAEWFDQLAAAFDTLRQTNPD

SEQ ID NO: 1305607 - protein, 23 aa, Mycobacterium
AEDPAFIHRMLGLLVPHPERVEV

SEQ ID NO: 1305608 - protein, 24 aa, Mycobacterium
AEEALIHVLWINAGLSCDGDSVAL

SEQ ID NO: 1305609 - protein, 19 aa, Mycobacterium
AEELSALLRRRGATVTSAA

SEQ ID NO: 1305610 - protein, 25 aa, Mycobacterium
AEEYPDLPILAYNVPVRTAVDLAPE

SEQ ID NO: 1305611 - protein, 17 aa, Mycobacterium
AEGAAVPRASWAAAASG

SEQ ID NO: 1305612 - protein, 36 aa, Mycobacterium
AEGIPAIMQAFLQPILFPSLALLMPVQGIITQTAQN

SEQ ID NO: 1305613 - protein, 35 aa, Mycobacterium
AEGLAPRTPVLRKLLWLLPDRFAPQLKPEVWAVAF

SEQ ID NO: 1305614 - protein, 25 aa, Mycobacterium
AEGQPGPVSVLFLDLDRLKTVNDYL

SEQ ID NO: 1305615 - protein, 23 aa, Mycobacterium
AEGTWALAVLERGTGRIVVAANG

SEQ ID NO: 1305616 - protein, 22 aa, Mycobacterium
AEGVADLLRLLGPLTSEEIAER

SEQ ID NO: 1305617 - protein, 39 aa, Mycobacterium
AEHAGIYQLLLNGAPPVLPPFLPPELAPLIAFTTTSLSG

SEQ ID NO: 1305618 - protein, 26 aa, Mycobacterium
AEHDHSWFILTQRIIEKEFALSGSEQ

SEQ ID NO: 1305619 - protein, 19 aa, Mycobacterium
AEIDGVPLHLPQLWQRADP

SEQ ID NO: 1305620 - protein, 30 aa, Mycobacterium
AELDRRGLLRRIGGAPYLHTLIATVPTAAN

SEQ ID NO: 1305621 - protein, 22 aa, Mycobacterium
AELDSIFATRPLAEWAETFAAE

SEQ ID NO: 1305622 - protein, 19 aa, Mycobacterium
AELLKMLVRQYLSGVAARS

SEQ ID NO: 1305623 - protein, 23 aa, Mycobacterium
AELLRCPVSEIMTSVLVTCTPAD

SEQ ID NO: 1305624 - protein, 26 aa, Mycobacterium
AELLVIGLRHRSPVGKLLLGSVSQQV

SEQ ID NO: 1305625 - protein, 18 aa, Mycobacterium
AELPSLLAEKVKAPGVTA

SEQ ID NO: 1305626 - protein, 17 aa, Mycobacterium
AELTRILMSWRREVRRT

SEQ ID NO: 1305627 - protein, 20 aa, Mycobacterium
AELTVRLHRLRQPVIAAVNG

SEQ ID NO: 1305628 - protein, 18 aa, Mycobacterium
AEMRRVAPIWWNEQPIGA

SEQ ID NO: 1305629 - protein, 17 aa, Mycobacterium
AEMVFAEPPKKTSPKKT

SEQ ID NO: 1305630 - protein, 23 aa, Mycobacterium
AEPDALVPLYLRRPDATPRAEQT

SEQ ID NO: 1305631 - protein, 25 aa, Mycobacterium
AEPDSMLHFFRRALRLRRDRCGVDG

SEQ ID NO: 1305632 - protein, 23 aa, Mycobacterium
AEPTPFRLVAGKTALIVIDMQRD

SEQ ID NO: 1305633 - protein, 28 aa, Mycobacterium
AEQLWSQLVPVLPQPFRSEALVLKSHAA

SEQ ID NO: 1305634 - protein, 19 aa, Mycobacterium
AEQRGDLTVRRLAVGLLKE

SEQ ID NO: 1305635 - protein, 17 aa, Mycobacterium
AEQRLGDHKDIIGDSWQ

SEQ ID NO: 1305636 - protein, 23 aa, Mycobacterium
AERTAWRICSQNRLWSVFGKKRG

SEQ ID NO: 1305637 - protein, 17 aa, Mycobacterium
AERWFAPGFVDREPGTA

SEQ ID NO: 1305638 - protein, 28 aa, Mycobacterium
AESPRETWLRLLAIRNGFPPPTTQIPVY

SEQ ID NO: 1305639 - protein, 24 aa, Mycobacterium
AETDLLAAWLAGRAGLEVPDSGPL

SEQ ID NO: 1305640 - protein, 25 aa, Mycobacterium
AEVDRLARSMLLLHGGHDDDHDHPA

SEQ ID NO: 1305641 - protein, 31 aa, Mycobacterium
AEVTTVDGLLVRLLRYLPGGTLIDADHLGPA

SEQ ID NO: 1305642 - protein, 18 aa, Mycobacterium
AEWGLRDYWQQWEQVRVP

SEQ ID NO: 1305643 - protein, 19 aa, Mycobacterium
AEWLAVTYGDDGIGVTCVC

SEQ ID NO: 1305644 - protein, 20 aa, Mycobacterium
AEYHPVLTKALLVHAATWGP

SEQ ID NO: 1305645 - protein, 18 aa, Mycobacterium
AFARRHRVPIAEQPHFSA

SEQ ID NO: 1305646 - protein, 37 aa, Mycobacterium
AFASGPYFKVMLVNLAPYWILQPYVDAAFKKRGIDPQ

SEQ ID NO: 1305647 - protein, 25 aa, Mycobacterium
AFCETLRGRMYLLEPLRYELVDVPL

SEQ ID NO: 1305648 - protein, 21 aa, Mycobacterium
AFDNYVALLEQAAAAREDYEE

SEQ ID NO: 1305649 - protein, 17 aa, Mycobacterium
AFFRHPPRVPPTRPGVV

SEQ ID NO: 1305650 - protein, 17 aa, Mycobacterium
AFRTSPALRIAVTVDMI

SEQ ID NO: 1305651 - protein, 18 aa, Mycobacterium
AFSNYHYYEGRLASFPAP

SEQ ID NO: 1305652 - protein, 19 aa, Mycobacterium
AFTDVAYFLGCALPVEDRR

SEQ ID NO: 1305653 - protein, 26 aa, Mycobacterium
AFTWEHDAHLYLRRARSLAALLADGT

SEQ ID NO: 1305654 - protein, 20 aa, Mycobacterium
AFVVWERSLYERAVAEAAAN

SEQ ID NO: 1305655 - protein, 18 aa, Mycobacterium
AFYQADIRRQVTADQLAF

SEQ ID NO: 1305656 - protein, 27 aa, Mycobacterium
AGADINWILVPSAAVSRLLRICDPDAT

SEQ ID NO: 1305657 - protein, 25 aa, Mycobacterium
AGADPVIMLTAPIPATQKALKKSGL

SEQ ID NO: 1305658 - protein, 22 aa, Mycobacterium
AGAPDPHFWMDPQRMITAVDVI

SEQ ID NO: 1305659 - protein, 23 aa, Mycobacterium
AGAVLAWLRRYPAAEFTPPDGAM

SEQ ID NO: 1305660 - protein, 30 aa, Mycobacterium
AGAYKTWMDAEWWRLRVLPELGGTDAPNSL

SEQ ID NO: 1305661 - protein, 23 aa, Mycobacterium
AGDDWLCLLEAFDQPHRSGLVRA

SEQ ID NO: 1305662 - protein, 22 aa, Mycobacterium
AGDITVFWRLAATSGGSVGSLR

SEQ ID NO: 1305663 - protein, 20 aa, Mycobacterium
AGDMYLLHPFTAHAADEHRG

SEQ ID NO: 1305664 - protein, 21 aa, Mycobacterium
AGEGPWHLLPKGPVVTSSANP

SEQ ID NO: 1305665 - protein, 25 aa, Mycobacterium
AGEPWNVSKLYYIHGFLRDRMQTLQ

SEQ ID NO: 1305666 - protein, 25 aa, Mycobacterium
AGFTQFMTGWLPHLRERIEATLGVV

SEQ ID NO: 1305667 - protein, 17 aa, Mycobacterium
AGFTTRVLLDLTAGVAE

SEQ ID NO: 1305668 - protein, 27 aa, Mycobacterium
AGFTVNHRFGFPDLPPPYVVAQVAIDE

SEQ ID NO: 1305669 - protein, 37 aa, Mycobacterium
AGGRAVVMTYWNPVLRWGIDAFARDLAAAGGLGLITP

SEQ ID NO: 1305670 - protein, 17 aa, Mycobacterium
AGGSPSRLLLPGSISIA

SEQ ID NO: 1305671 - protein, 24 aa, Mycobacterium
AGGTQIAPVPLQGSPIRAVGADGA

SEQ ID NO: 1305672 - protein, 25 aa, Mycobacterium
AGGVGLILTQWATSLTAKVITTVST

SEQ ID NO: 1305673 - protein, 29 aa, Mycobacterium
AGGVRPDAWGWLPLLTGVAVRDAVAEVSA

SEQ ID NO: 1305674 - protein, 20 aa, Mycobacterium
AGGYRSSVAASLLRAHGFAD

SEQ ID NO: 1305675 - protein, 25 aa, Mycobacterium
AGHPTVGAAWWLRENGLPVHTLQVP

SEQ ID NO: 1305676 - protein, 18 aa, Mycobacterium
AGHQDYWRDLLAAGKVVV

SEQ ID NO: 1305677 - protein, 18 aa, Mycobacterium
AGILDLTMGFAVAQAIYA

SEQ ID NO: 1305678 - protein, 27 aa, Mycobacterium
AGIRGGYLSEVFPITFPHTPGIDVAGT

SEQ ID NO: 1305679 - protein, 24 aa, Mycobacterium
AGITHILTMPWMFYTGADATLAEK

SEQ ID NO: 1305680 - protein, 35 aa, Mycobacterium
AGIVEQYVHWAALSGLRRLLFVNGHMGNTAALNTA

SEQ ID NO: 1305681 - protein, 26 aa, Mycobacterium
AGKPEPEWGIKPFDFVLATSMLQVGV

SEQ ID NO: 1305682 - protein, 23 aa, Mycobacterium
AGKTVRYLAGRAVWQASATYRGG

SEQ ID NO: 1305683 - protein, 17 aa, Mycobacterium
AGLAAPWWDSAATASFT

SEQ ID NO: 1305684 - protein, 17 aa, Mycobacterium
AGLAVGFWDGADDLRRN

SEQ ID NO: 1305685 - protein, 29 aa, Mycobacterium
AGLDAEVIAWQWIPFGPVLNARAEWLEET

SEQ ID NO: 1305686 - protein, 20 aa, Mycobacterium
AGLGAYPTLFVGKLAHVMAV

SEQ ID NO: 1305687 - protein, 32 aa, Mycobacterium
AGLGPTFPSYGWFRPLITIDHVLTRNAAASSI

SEQ ID NO: 1305688 - protein, 33 aa, Mycobacterium
AGLHAYRGPWQYETLAREIMFDIAARKLGIDPV

SEQ ID NO: 1305689 - protein, 27 aa, Mycobacterium
AGLIERRPPVRLPIAATLGLTLAEDIV

SEQ ID NO: 1305690 - protein, 19 aa, Mycobacterium
AGLVVMLAVFSQTAGLTGA

SEQ ID NO: 1305691 - protein, 19 aa, Mycobacterium
AGLVWLAREMAADPEFRMV

SEQ ID NO: 1305692 - protein, 27 aa, Mycobacterium
AGMLPLAKQTLIIQGGLKAVLAMQYEC

SEQ ID NO: 1305693 - protein, 24 aa, Mycobacterium
AGNVPTWWDDLVSAGFHAVHLPER

SEQ ID NO: 1305694 - protein, 18 aa, Mycobacterium
AGPDATITLFDPADRLGG

SEQ ID NO: 1305695 - protein, 32 aa, Mycobacterium
AGPVDLRHLNQWWYWTPGASWRHPIGPGSSIV

SEQ ID NO: 1305696 - protein, 22 aa, Mycobacterium
AGQLLLHVAGPYTRRGTWLEQA

SEQ ID NO: 1305697 - protein, 23 aa, Mycobacterium
AGQRIKPPYVAAYVLLDGADIPF

SEQ ID NO: 1305698 - protein, 22 aa, Mycobacterium
AGQSIGAFLPPGITIELTGDAN

SEQ ID NO: 1305699 - protein, 17 aa, Mycobacterium
AGRDRARARYSWDRIAE

SEQ ID NO: 1305700 - protein, 31 aa, Mycobacterium
AGRPGACWPLADIPLDWVLDGAVRAGVRLRG

SEQ ID NO: 1305701 - protein, 20 aa, Mycobacterium
AGRPTLLTWGQIGPGKGIER

SEQ ID NO: 1305702 - protein, 18 aa, Mycobacterium
AGRRIRGLRLRATDVDWT

SEQ ID NO: 1305703 - protein, 19 aa, Mycobacterium
AGRYLLYLDFQVDDTVHTA

SEQ ID NO: 1305704 - protein, 25 aa, Mycobacterium
AGSDRIRFTPYQKLIVLDVPDEKLE

SEQ ID NO: 1305705 - protein, 20 aa, Mycobacterium
AGSKLHLVGQRPAGPTPAFA

SEQ ID NO: 1305706 - protein, 18 aa, Mycobacterium
AGSWGLITCTKPAGKESE

SEQ ID NO: 1305707 - protein, 28 aa, Mycobacterium
AGTKLVFYPFLPWPWPRVVGAHFVAGDS

SEQ ID NO: 1305708 - protein, 18 aa, Mycobacterium
AGVDRTAFYGNRPYTHLR

SEQ ID NO: 1305709 - protein, 17 aa, Mycobacterium
AGVLDRVRGGDAGVYCG

SEQ ID NO: 1305710 - protein, 25 aa, Mycobacterium
AGVLHIVKNYTGDVMNFCIARDIVQ

SEQ ID NO: 1305711 - protein, 20 aa, Mycobacterium
AGVMQVDWWFDGDRFDHATV

SEQ ID NO: 1305712 - protein, 20 aa, Mycobacterium
AGVPAPLRWGEYRPGRLADA

SEQ ID NO: 1305713 - protein, 24 aa, Mycobacterium
AGVRAGVPTLVLWVGAEQPIWGSR

SEQ ID NO: 1305714 - protein, 33 aa, Mycobacterium
AGVSKYPARVKCALLGWMAFKDAVAQASHDSEE

SEQ ID NO: 1305715 - protein, 24 aa, Mycobacterium
AGVSVRVLDITLLAITLRLHLEGP

SEQ ID NO: 1305716 - protein, 25 aa, Mycobacterium
AGWQPDIWRGFAEELGILGATLPED

SEQ ID NO: 1305717 - protein, 17 aa, Mycobacterium
AGWRLAAAATTWSEVAA

SEQ ID NO: 1305718 - protein, 33 aa, Mycobacterium
AGYGEEPGPLPWYKRPPVLFGAAAAAALAALSG

SEQ ID NO: 1305719 - protein, 24 aa, Mycobacterium
AGYVRAGSLWPATFGLACCAIEMM

SEQ ID NO: 1305720 - protein, 34 aa, Mycobacterium
AHATHARLGGPGRWLLALPAHHIAGLQVLVRSVV

SEQ ID NO: 1305721 - protein, 23 aa, Mycobacterium
AHAVGVPTFLNFEFRCRESWAKV

SEQ ID NO: 1305722 - protein, 17 aa, Mycobacterium
AHCVRALLADGHRVRLL

SEQ ID NO: 1305723 - protein, 31 aa, Mycobacterium
AHDIDTVWFGAAAPLALLTPIARRAGAARVI

SEQ ID NO: 1305724 - protein, 22 aa, Mycobacterium
AHDNHLPAPLLLASAIAARTTQ

SEQ ID NO: 1305725 - protein, 19 aa, Mycobacterium
AHEDGSWISLVSPAADLPL

SEQ ID NO: 1305726 - protein, 19 aa, Mycobacterium
AHEPLIAVGGDFARTDLEF

SEQ ID NO: 1305727 - protein, 29 aa, Mycobacterium
AHGFGCDQNLWRLVTARLAPEFRVVLFDH

SEQ ID NO: 1305728 - protein, 18 aa, Mycobacterium
AHGRGVFVLAATSNPEGA

SEQ ID NO: 1305729 - protein, 28 aa, Mycobacterium
AHGVARVWVPAATPLRDAWVPDADLRGV

SEQ ID NO: 1305730 - protein, 17 aa, Mycobacterium
AHHFAPEVQLVLCAGAP

SEQ ID NO: 1305731 - protein, 20 aa, Mycobacterium
AHHVETLTGFKWLSRADDDL

SEQ ID NO: 1305732 - protein, 21 aa, Mycobacterium
AHLELLIERVGYQPTDWETRQ

SEQ ID NO: 1305733 - protein, 28 aa, Mycobacterium
AHPLPRDVRMRLLRTLGLRGVEHSVRAL

SEQ ID NO: 1305734 - protein, 21 aa, Mycobacterium
AHPVFRRRRFFSGRPVRQRGA

SEQ ID NO: 1305735 - protein, 17 aa, Mycobacterium
AHPVGFQWVVEAKARGT

SEQ ID NO: 1305736 - protein, 24 aa, Mycobacterium
AHQHRREAAWFRRLAGGDLAGQDV

SEQ ID NO: 1305737 - protein, 19 aa, Mycobacterium
AHRVIATYPGAIAVRFDDP

SEQ ID NO: 1305738 - protein, 25 aa, Mycobacterium
AHSHQPLRWGPPEAPLRYVLVFNGE

SEQ ID NO: 1305739 - protein, 35 aa, Mycobacterium
AHVAKGTVYLYWPTKEDLLIGLIGRGFLHVLDDLV

SEQ ID NO: 1305740 - protein, 26 aa, Mycobacterium
AHVDPSMVLYLFGSKLDLFRESLRLI

SEQ ID NO: 1305741 - protein, 21 aa, Mycobacterium
AHVPTYSQWLARQDWTKPYQR

SEQ ID NO: 1305742 - protein, 31 aa, Mycobacterium
AHVRIIQDFVKKLPAWVSWDRREDYERDLVG

SEQ ID NO: 1305743 - protein, 17 aa, Mycobacterium
AHWRAELAAYADTPVRF

SEQ ID NO: 1305744 - protein, 23 aa, Mycobacterium
AHYTRLAALDLCPRIRVNAIAPG

SEQ ID NO: 1305745 - protein, 17 aa, Mycobacterium
AIAEPRPLFDPTALKTT

SEQ ID NO: 1305746 - protein, 23 aa, Mycobacterium
AIALQIPSAHDPTLALPGKHAAS

SEQ ID NO: 1305747 - protein, 25 aa, Mycobacterium
AIGTPNHLSWNWFGNRLRGRRYGWI

SEQ ID NO: 1305748 - protein, 25 aa, Mycobacterium
AIIREMAPQIYLTISSELAPVLGEY

SEQ ID NO: 1305749 - protein, 24 aa, Mycobacterium
AIRLGDYCLGLYGSRDYLAEHGTP

SEQ ID NO: 1305750 - protein, 26 aa, Mycobacterium
AIRRRIAELQRNRLSLALGGGSSQES

SEQ ID NO: 1305751 - protein, 17 aa, Mycobacterium
AITLCEIGIAIEPRLRC

SEQ ID NO: 1305752 - protein, 19 aa, Mycobacterium
AIVWLHGGGYLIGSAHGYR

SEQ ID NO: 1305753 - protein, 23 aa, Mycobacterium
AKAATICSLLPWPDDPAEQQELQ

SEQ ID NO: 1305754 - protein, 18 aa, Mycobacterium
AKAPKMLARDFAPGFRID

SEQ ID NO: 1305755 - protein, 28 aa, Mycobacterium
AKAVIVSEPFMPAAPLLSGLGMLVLTVA

SEQ ID NO: 1305756 - protein, 17 aa, Mycobacterium
AKHLGGVLYLFVRGMCG

SEQ ID NO: 1305757 - protein, 17 aa, Mycobacterium
AKLLRFRDDLDRLLAED

SEQ ID NO: 1305758 - protein, 24 aa, Mycobacterium
AKQVTILAHDRLGPLAGGMGGLGI

SEQ ID NO: 1305759 - protein, 17 aa, Mycobacterium
AKQWAFEGKWDGYRLLV

SEQ ID NO: 1305760 - protein, 17 aa, Mycobacterium
AKRYDAVLIGAGVRMVA

SEQ ID NO: 1305761 - protein, 36 aa, Mycobacterium
AKSFQRLGIRCFGFIPLRLPPELDFAALFHGIDERV

SEQ ID NO: 1305762 - protein, 19 aa, Mycobacterium
AKSWKEVLAVRWRISTSEA

SEQ ID NO: 1305763 - protein, 20 aa, Mycobacterium
AKSWKEVLAVRWRISTSEAH

SEQ ID NO: 1305764 - protein, 17 aa, Mycobacterium
AKVFLPWAAFSEERSAA

SEQ ID NO: 1305765 - protein, 22 aa, Mycobacterium
AKWASSISGYWRRGRTEETFRQ

SEQ ID NO: 1305766 - protein, 22 aa, Mycobacterium
AKWMRRTTLLRPARLAGLRAEV

SEQ ID NO: 1305767 - protein, 26 aa, Mycobacterium
ALADALLPMHDTPLGPLAPNVTLRQI

SEQ ID NO: 1305768 - protein, 18 aa, Mycobacterium
ALADLVHLYAAAVDDRRF

SEQ ID NO: 1305769 - protein, 30 aa, Mycobacterium
ALAEEISQLLYWTQVLMIARGLSPDDVYRK

SEQ ID NO: 1305770 - protein, 41 aa, Mycobacterium
ALAELKQYDFDYVFIDCPPSLGLLTINALVAAPEVLIPIQC

SEQ ID NO: 1305771 - protein, 28 aa, Mycobacterium
ALAGEWDLVVVAGLQEGLWPNTIPRGGV

SEQ ID NO: 1305772 - protein, 18 aa, Mycobacterium
ALAPLTTLRVGPVARRLI

SEQ ID NO: 1305773 - protein, 24 aa, Mycobacterium
ALAQLAQRIPLDAALLADGRPATA

SEQ ID NO: 1305774 - protein, 19 aa, Mycobacterium
ALAQPPAPQRIALSTGSPF

SEQ ID NO: 1305775 - protein, 24 aa, Mycobacterium
ALASRLWFGDLTSVGLPAPRRGIY

SEQ ID NO: 1305776 - protein, 26 aa, Mycobacterium
ALASSQPLWALWRFSNQPEATRLTME

SEQ ID NO: 1305777 - protein, 22 aa, Mycobacterium
ALAVFGVNIPPTARMGSLPVGL

SEQ ID NO: 1305778 - protein, 19 aa, Mycobacterium
ALCYLDETAGLLARAAEEV

SEQ ID NO: 1305779 - protein, 26 aa, Mycobacterium
ALDRSRPLWELYYAEGLANGRVAVIG

SEQ ID NO: 1305780 - protein, 33 aa, Mycobacterium; identical to SEQ ID NO: 792558

SEQ ID NO: 1305781 - protein, 17 aa, Mycobacterium
ALEHDTLRALYLNSDVF

SEQ ID NO: 1305782 - protein, 18 aa, Mycobacterium
ALELMEDAWWGPTVPLVG

SEQ ID NO: 1305783 - protein, 26 aa, Mycobacterium
ALGGPERRMLFLVSATDAYPERLIGT

SEQ ID NO: 1305784 - protein, 21 aa, Mycobacterium
ALHALGPQWALVKGGHLRSSA

SEQ ID NO: 1305785 - protein, 21 aa, Mycobacterium
ALHSRFDGLIAQWKRDHGDHG

SEQ ID NO: 1305786 - protein, 17 aa, Mycobacterium
ALHVAKIARRRHPQHVL

SEQ ID NO: 1305787 - protein, 21 aa, Mycobacterium
ALLGEFVPAVARLRALDPLTT

SEQ ID NO: 1305788 - protein, 19 aa, Mycobacterium
ALLGSRWIPPDAPVEIAHT

SEQ ID NO: 1305789 - protein, 19 aa, Mycobacterium
ALLIRRLKQRVAPDSNIQC

SEQ ID NO: 1305790 - protein, 18 aa, Mycobacterium
ALLQVALGERPSLEQVLT

SEQ ID NO: 1305791 - protein, 19 aa, Mycobacterium
ALMERLHLTDLADANPYTL

SEQ ID NO: 1305792 - protein, 18 aa, Mycobacterium
ALNGLVRTLRQENRHLSG

SEQ ID NO: 1305793 - protein, 20 aa, Mycobacterium
ALPVGTGIRRRLEEAFTAAG

SEQ ID NO: 1305794 - protein, 20 aa, Mycobacterium
ALPVPRPAGYVIVGDTASLP

SEQ ID NO: 1305795 - protein, 17 aa, Mycobacterium
ALRDQIAALRWVRENIA

SEQ ID NO: 1305796 - protein, 33 aa, Mycobacterium
ALRNRPNLAPHWVPAALIPDSTAALAALQAAPG

SEQ ID NO: 1305797 - protein, 25 aa, Mycobacterium
ALRNRWILDLADRVPAALLLQLADV

SEQ ID NO: 1305798 - protein, 17 aa, Mycobacterium
ALRPCDKPVPTAGLRRL

SEQ ID NO: 1305799 - protein, 23 aa, Mycobacterium
ALRTRFFDDYFLASTAGGIRQVV

SEQ ID NO: 1305800 - protein, 18 aa, Mycobacterium
ALRVLWTEDEACHHGEFY

SEQ ID NO: 1305801 - protein, 17 aa, Mycobacterium
ALRYVDALVWTPSAIPV

SEQ ID NO: 1305802 - protein, 37 aa, Mycobacterium
ALSFDVRPPRWLPPGRWWALIRVAAAGRLVYSPAVEV

SEQ ID NO: 1305803 - protein, 19 aa, Mycobacterium
ALSLRHHDFHIGAGGTPWI

SEQ ID NO: 1305804 - protein, 27 aa, Mycobacterium
ALSRLRGMFAFALWDTVTGELFCARDP

SEQ ID NO: 1305805 - protein, 28 aa, Mycobacterium
ALTDEPLLRLPGVVILVGERLATAPGAL

SEQ ID NO: 1305806 - protein, 18 aa, Mycobacterium
ALTEAWPVPVSDIALVGH

SEQ ID NO: 1305807 - protein, 24 aa, Mycobacterium
ALTFAMQVGLAAVLRERGLRPAAV

SEQ ID NO: 1305808 - protein, 18 aa, Mycobacterium
ALTKALLPSMRAAGRGRI

SEQ ID NO: 1305809 - protein, 20 aa, Mycobacterium
ALTLGGLLPPRAGRVEARNG

SEQ ID NO: 1305810 - protein, 20 aa, Mycobacterium
ALVARDGLVLGELPAGSTVG

SEQ ID NO: 1305811 - protein, 23 aa, Mycobacterium
ALVARLYARRYLDDPGPLRGIDD

SEQ ID NO: 1305812 - protein, 30 aa, Mycobacterium
ALVENSPVIFLGGQRARITERRVRRGRIQF

SEQ ID NO: 1305813 - protein, 19 aa, Mycobacterium
ALVGLAFQYGYFSAKFKSS

SEQ ID NO: 1305814 - protein, 18 aa, Mycobacterium
ALVGLLDRLVLDFERGVR

SEQ ID NO: 1305815 - protein, 18 aa, Mycobacterium
ALVIPDPFLPGVEPLDGS

SEQ ID NO: 1305816 - protein, 17 aa, Mycobacterium
ALYHQFADKSALFEAVY

SEQ ID NO: 1305817 - protein, 23 aa, Mycobacterium
AMANSLAAYYYLHGSVPAKSLDD

SEQ ID NO: 1305818 - protein, 29 aa, Mycobacterium
AMASHEQRWPEFVAAARTEGVRATLSIPL

SEQ ID NO: 1305819 - protein, 23 aa, Mycobacterium
AMDPQQRLLLEVAWEALEHAGIT

SEQ ID NO: 1305820 - protein, 17 aa, Mycobacterium
AMITLTALEGAFVLCRT

SEQ ID NO: 1305821 - protein, 19 aa, Mycobacterium
AMLAVAKLGAVIMPTTGAL

SEQ ID NO: 1305822 - protein, 27 aa, Mycobacterium
AMLDGRLPPPPIANLLQMGLTAVEPGR

SEQ ID NO: 1305823 - protein, 20 aa, Mycobacterium
AMQAAFLRDVLAEFAVRGHL

SEQ ID NO: 1305824 - protein, 21 aa, Mycobacterium
AMQLHGGIGYTWESGVHVYLK

SEQ ID NO: 1305825 - protein, 29 aa, Mycobacterium
AMREARLRRLPVLLLGRQPRHGNGGDELD

SEQ ID NO: 1305826 - protein, 24 aa, Mycobacterium
AMSIPPVLAAYDFSRFRTIIDVGG

SEQ ID NO: 1305827 - protein, 26 aa, Mycobacterium
AMSPIRPNVIWAMDFQFDTTADGHTL

SEQ ID NO: 1305828 - protein, 19 aa, Mycobacterium
AMVAAWVAGVDREIVATQS

SEQ ID NO: 1305829 - protein, 32 aa, Mycobacterium
ANAYIEIHYAVSLIWERGGTVSAWLATSEGAS

SEQ ID NO: 1305830 - protein, 19 aa, Mycobacterium
ANDERLLDCASLQALEKVG

SEQ ID NO: 1305831 - protein, 27 aa, Mycobacterium
ANGISPMELLPHAQGIVGILPPVVDEL

SEQ ID NO: 1305832 - protein, 21 aa, Mycobacterium
ANHYLAVFDRATGSALDLFRT

SEQ ID NO: 1305833 - protein, 26 aa, Mycobacterium
ANLEITVTGVFRYTDTWSAAIHLVNS

SEQ ID NO: 1305834 - protein, 20 aa, Mycobacterium
ANLHYTLQQPYGVVARIVPF

SEQ ID NO: 1305835 - protein, 28 aa, Mycobacterium
ANPALDDFLHRDALYALLPPKTREATFR

SEQ ID NO: 1305836 - protein, 24 aa, Mycobacterium
ANPIGDRYMALLDGPGSAKRLTTD

SEQ ID NO: 1305837 - protein, 19 aa, Mycobacterium
ANPWILMSVESLTLALLAR

SEQ ID NO: 1305838 - protein, 22 aa, Mycobacterium
ANRWPAVRFAVRNTIVQGPNAV

SEQ ID NO: 1305839 - protein, 17 aa, Mycobacterium
ANRYPEFLPESLRHLIA

SEQ ID NO: 1305840 - protein, 26 aa, Mycobacterium
ANSQELPVFPFKRQCPFAPADDYADG

SEQ ID NO: 1305841 - protein, 21 aa, Mycobacterium
ANVPCLIGVLYQLTGDPRWLG

SEQ ID NO: 1305842 - protein, 34 aa, Mycobacterium
APAEWLARGGVMLPIYQREAMWLSFDATEPAGLQ

SEQ ID NO: 1305843 - protein, 23 aa, Mycobacterium
APALAEVMPWNQLPGPVRRVTQA

SEQ ID NO: 1305844 - protein, 26 aa, Mycobacterium
APAMPAECLLDRNALIMGYSGVYSSF

SEQ ID NO: 1305845 - protein, 24 aa, Mycobacterium
APARALQVMFVLRELRAGLHFNAL

SEQ ID NO: 1305846 - protein, 18 aa, Mycobacterium
APARDWARFSAWADDIFK

SEQ ID NO: 1305847 - protein, 27 aa, Mycobacterium
APASAIGRIFSPPEFRLIPIDESTWPP

SEQ ID NO: 1305848 - protein, 26 aa, Mycobacterium
APATRPRIRLAYRLTPRRVTGATRAD

SEQ ID NO: 1305849 - protein, 19 aa, Mycobacterium
APAWLLDAVRSPGAPSAYE

SEQ ID NO: 1305850 - protein, 18 aa, Mycobacterium
APERLDVFGRVYAGWAYC

SEQ ID NO: 1305851 - protein, 28 aa, Mycobacterium
APGDKTMLDALWPFVEELERRVSDGERW

SEQ ID NO: 1305852 - protein, 24 aa, Mycobacterium
APGDKVTLTYLDPSGKPQSVQVTL

SEQ ID NO: 1305853 - protein, 29 aa, Mycobacterium
APGTAQGYHMVTFGFILGEVVRRVTGRTI

SEQ ID NO: 1305854 - protein, 17 aa, Mycobacterium
APHLVSAMPQLVPLLPE

SEQ ID NO: 1305855 - protein, 21 aa, Mycobacterium
APIIKNRQYNFPPIGVNPFVG

SEQ ID NO: 1305856 - protein, 29 aa, Mycobacterium
APLEGQPLDRPFAWALIKLDGADTPMLHT

SEQ ID NO: 1305857 - protein, 27 aa, Mycobacterium
APLLDANYWVANVRRPVRLHQAVSAAA

SEQ ID NO: 1305858 - protein, 18 aa, Mycobacterium
APLMLVAGGEPFEYPHPG

SEQ ID NO: 1305859 - protein, 30 aa, Mycobacterium
APLPDGQYHPLLVRALLAHASSWGEWDARL

SEQ ID NO: 1305860 - protein, 20 aa, Mycobacterium
APLVPPGEQLPYHVAAAQAG

SEQ ID NO: 1305861 - protein, 24 aa, Mycobacterium
APMCDIFLVLAQAPGGLSCFFLPR

SEQ ID NO: 1305862 - protein, 17 aa, Mycobacterium
APNFAFELAVRRTTDED

SEQ ID NO: 1305863 - protein, 22 aa, Mycobacterium
APPEYVAPTYAYLVSDRAHGVT

SEQ ID NO: 1305864 - protein, 18 aa, Mycobacterium
APRIGCTLPEVFDHARPG

SEQ ID NO: 1305865 - protein, 17 aa, Mycobacterium
APRIPLLSNVTGTWMTD

SEQ ID NO: 1305866 - protein, 22 aa, Mycobacterium
APRKWIFSPTRSRNSSAAAIAP

SEQ ID NO: 1305867 - protein, 23 aa, Mycobacterium
APRVVLLGIPTRGVTLAARLAER

SEQ ID NO: 1305868 - protein, 23 aa, Mycobacterium
APSSPRGLDGPPGPPNPPGPTGT

SEQ ID NO: 1305869 - protein, 23 aa, Mycobacterium
APTELVTAPFLPDAAEALIGIGR

SEQ ID NO: 1305870 - protein, 28 aa, Mycobacterium
APTGSGKTLAAFLWAIDRLASSEPRPSG

SEQ ID NO: 1305871 - protein, 24 aa, Mycobacterium
APVAAHWIADRQVAPGLLTYGTEE

SEQ ID NO: 1305872 - protein, 24 aa, Mycobacterium
APVRAPRVLAPSALVGRLRAVVCA

SEQ ID NO: 1305873 - protein, 24 aa, Mycobacterium
APVSWRIFLRPPDGAPPQVRARIE

SEQ ID NO: 1305874 - protein, 20 aa, Mycobacterium
APVTSWWYGQGRAVDVVRRL

SEQ ID NO: 1305875 - protein, 20 aa, Mycobacterium
APWRLKQNYLIDLRVIRNAK

SEQ ID NO: 1305876 - protein, 17 aa, Mycobacterium
APYAYAQPHSGIDANLV

SEQ ID NO: 1305877 - protein, 18 aa, Mycobacterium
APYGIRVNALAPGPVDTD

SEQ ID NO: 1305878 - protein, 25 aa, Mycobacterium
AQEIAATRRHWAKQAAAPASVVTGN

SEQ ID NO: 1305879 - protein, 17 aa, Mycobacterium
AQFDIWVHQFLAVHERA

SEQ ID NO: 1305880 - protein, 23 aa, Mycobacterium
AQFYDLDYFALIKDPISVVEDIY

SEQ ID NO: 1305881 - protein, 24 aa, Mycobacterium
AQGRAEAQLLRRSIRRFSADPVAP

SEQ ID NO: 1305882 - protein, 18 aa, Mycobacterium
AQGWQWVFVTDPEKKKAL

SEQ ID NO: 1305883 - protein, 24 aa, Mycobacterium
AQHRYSFINVRRLVTAGTPQISGG

SEQ ID NO: 1305884 - protein, 26 aa, Mycobacterium
AQLDEVFRPLYWWAQDLRAGGDVLQC

SEQ ID NO: 1305885 - protein, 23 aa, Mycobacterium
AQLLNFAIRYSSGLIHAAMRSDR

SEQ ID NO: 1305886 - protein, 25 aa, Mycobacterium
AQMGKDGWLTLSWPKEFGGQARPPM

SEQ ID NO: 1305887 - protein, 31 aa, Mycobacterium
AQRGRLPGHPSYFLKPPTSLALSGRPVERPA

SEQ ID NO: 1305888 - protein, 25 aa, Mycobacterium
AQRQVPAILDLLATGAINLGELITD

SEQ ID NO: 1305889 - protein, 26 aa, Mycobacterium
AQSGSIGLGFAIPVDQAKRIADELIQ

SEQ ID NO: 1305890 - protein, 28 aa, Mycobacterium
AQSPRETWLRLLLIDAGFPRPTTQIPVL

SEQ ID NO: 1305891 - protein, 24 aa, Mycobacterium
AQSQVHRFLKLLGGYTYSRHSYSL

SEQ ID NO: 1305892 - protein, 19 aa, Mycobacterium
AQVVLRWHVQRGDIIFPKS

SEQ ID NO: 1305893 - protein, 19 aa, Mycobacterium
ARAAGMPGVFGMGLLHGGV

SEQ ID NO: 1305894 - protein, 25 aa, Mycobacterium
ARAANLPVMLIGDGWNPLIPDHAAE

SEQ ID NO: 1305895 - protein, 23 aa, Mycobacterium
ARADIGLWSFLTRFAANCRRSSW

SEQ ID NO: 1305896 - protein, 27 aa, Mycobacterium
ARAEEAAFVLLALQAPVAGDLRAVVSS

SEQ ID NO: 1305897 - protein, 52 aa, Mycobacterium
ARAEVDRLRATVETFQRAEVERLAALKLIDGRDVWAAGAKLADLLADDGTVD

SEQ ID NO: 1305898 - protein, 21 aa, Mycobacterium
ARAGVWVPGADLPAVERRGVP

SEQ ID NO: 1305899 - protein, 27 aa, Mycobacterium
ARAIDELLRLFTLWQQDPSVSFERGLG

SEQ ID NO: 1305900 - protein, 25 aa, Mycobacterium
ARALAADPPVLLMDEPFGAVDPITR

SEQ ID NO: 1305901 - protein, 34 aa, Mycobacterium
ARALGARYLDTGAMYRIVTLAVLRAGIDPSDGDA

SEQ ID NO: 1305902 - protein, 22 aa, Mycobacterium
ARAMSGIARRLPGPRPEFVGNE

SEQ ID NO: 1305903 - protein, 24 aa, Mycobacterium
ARARKLIDAQLTQAGWVVQDKQDL

SEQ ID NO: 1305904 - protein, 21 aa, Mycobacterium
ARAVLAFPATLPDGTPHTDLR

SEQ ID NO: 1305905 - protein, 22 aa, Mycobacterium
ARAYREMFAGLYTDPDDVLNTT

SEQ ID NO: 1305906 - protein, 25 aa, Mycobacterium
ARDHLLALPQCSGAIGIAGFCMGGQ

SEQ ID NO: 1305907 - protein, 24 aa, Mycobacterium
AREISRMHPHVRILILSMHDNEQY

SEQ ID NO: 1305908 - protein, 17 aa, Mycobacterium
ARELDMLLTAGERISNA

SEQ ID NO: 1305909 - protein, 18 aa, Mycobacterium
ARFKAPKEFIFVDELRRL

SEQ ID NO: 1305910 - protein, 20 aa, Mycobacterium
ARGKLLSILQRNGATRVSVL

SEQ ID NO: 1305911 - protein, 25 aa, Mycobacterium
ARGRARALTLTTTGRRRLAAAHGAV

SEQ ID NO: 1305912 - protein, 18 aa, Mycobacterium
ARHWTIEPDLSNAVPFLS

SEQ ID NO: 1305913 - protein, 24 aa, Mycobacterium
ARIDLRGRTLSTAQLRSALPRGGV

SEQ ID NO: 1305914 - protein, 20 aa, Mycobacterium
ARIDVLEHYLVGLFADDIRE

SEQ ID NO: 1305915 - protein, 18 aa, Mycobacterium
ARLAIANDYPIVPVGLVG

SEQ ID NO: 1305916 - protein, 31 aa, Mycobacterium
ARLCYGSSDRIPKWLLPVVRENLRTGAPIRL

SEQ ID NO: 1305917 - protein, 19 aa, Mycobacterium
ARLLKTKWTEAWDAPEAPE

SEQ ID NO: 1305918 - protein, 19 aa, Mycobacterium
ARLLRPRPVRYLVRHIVPR

SEQ ID NO: 1305919 - protein, 26 aa, Mycobacterium
ARNERHTYELPLPPSLRARAEWHRFT

SEQ ID NO: 1305920 - protein, 21 aa, Mycobacterium
ARPDLLERALSARPALLSVSF

SEQ ID NO: 1305921 - protein, 18 aa, Mycobacterium
ARPLTVTGGLTFAGGPWN

SEQ ID NO: 1305922 - protein, 24 aa, Mycobacterium
ARRELAQQIAFYSSVKSYETVLDV

SEQ ID NO: 1305923 - protein, 19 aa, Mycobacterium
ARRFVLAEKPFILDLSGVS

SEQ ID NO: 1305924 - protein, 24 aa, Mycobacterium
ARRGGEWLDWFAAERITAIGMGMI

SEQ ID NO: 1305925 - protein, 25 aa, Mycobacterium
ARRLRSMRWGLIPPWVKSTDDGAPD

SEQ ID NO: 1305926 - protein, 26 aa, Mycobacterium
ARRVTFGDVWALLVDGRFGDGLPPAE

SEQ ID NO: 1305927 - protein, 18 aa, Mycobacterium
ARRYCAIGMLTVGDEGRM

SEQ ID NO: 1305928 - protein, 24 aa, Mycobacterium
ARTLRDLVPYPMSLQHVAVGRVAA

SEQ ID NO: 1305929 - protein, 23 aa, Mycobacterium
ARTREQVMFLSALEDLDRRHENL

SEQ ID NO: 1305930 - protein, 22 aa, Mycobacterium
ARTRRCVLFFDELDTIAKERSD

SEQ ID NO: 1305931 - protein, 27 aa, Mycobacterium
ARVISDVWLSNLLAWLTRRASATDVSK

SEQ ID NO: 1305932 - protein, 35 aa, Mycobacterium
ARVQPVIVGLQLALTKLWRSYGVTPDAVIGHSMGE

SEQ ID NO: 1305933 - protein, 29 aa, Mycobacterium
ARYASLFTPPYFPGAAWAVPAPAAVINGQ

SEQ ID NO: 1305934 - protein, 23 aa, Mycobacterium
ARYKAPRTVDFVDSLPLTAAAKV

SEQ ID NO: 1305935 - protein, 23 aa, Mycobacterium
ASANLMARAMEWPDLVPGSGAVA

SEQ ID NO: 1305936 - protein, 17 aa, Mycobacterium
ASAQAMPTLLTLAAART

SEQ ID NO: 1305937 - protein, 17 aa, Mycobacterium
ASDRYWRRYFDNFAEVM

SEQ ID NO: 1305938 - protein, 20 aa, Mycobacterium
ASEPMREDIRLLGAILGDTV

SEQ ID NO: 1305939 - protein, 25 aa, Mycobacterium
ASGDYPGMMRLIEAGTLRPQAIVER

SEQ ID NO: 1305940 - protein, 25 aa, Mycobacterium
ASGHPVVVPDYRRAPENPYPAALQD

SEQ ID NO: 1305941 - protein, 23 aa, Mycobacterium
ASGPASNWDRAPGAPAPAAGNWD

SEQ ID NO: 1305942 - protein, 24 aa, Mycobacterium
ASGSPAERLAALIVETVQAAGREV

SEQ ID NO: 1305943 - protein, 17 aa, Mycobacterium
ASGWGHPVQPGLALLRL

SEQ ID NO: 1305944 - protein, 22 aa, Mycobacterium
ASIRSLTIWLNDAGLAPAVAKS

SEQ ID NO: 1305945 - protein, 21 aa, Mycobacterium
ASIVKLYYSELLQRLTDFGAE

SEQ ID NO: 1305946 - protein, 21 aa, Mycobacterium
ASKRPLAAAPPRITHQRHVVA

SEQ ID NO: 1305947 - protein, 24 aa, Mycobacterium
ASLDVNRHLLKEIQLRMVFGYDMF

SEQ ID NO: 1305948 - protein, 17 aa, Mycobacterium
ASLFSWTHDAAAGHEAG

SEQ ID NO: 1305949 - protein, 25 aa, Mycobacterium
ASPKETWLRLLLIDNGYDSLTTQIP

SEQ ID NO: 1305950 - protein, 27 aa, Mycobacterium
ASRDKFPRAVLPRTFDFGFATGLMVKD

SEQ ID NO: 1305951 - protein, 17 aa, Mycobacterium
ASRRVVLDHAVVGTHNL

SEQ ID NO: 1305952 - protein, 24 aa, Mycobacterium
ASSIGRLIAEYFPAVSVLTTNFDL

SEQ ID NO: 1305953 - protein, 35 aa, Mycobacterium
ASTAQRLALFAREKWTRILIPWRHESSHLHPHQQG

SEQ ID NO: 1305954 - protein, 21 aa, Mycobacterium
ASTAWAFMATSWSTAEVLGYL

SEQ ID NO: 1305955 - protein, 21 aa, Mycobacterium
ASYVPMDGFHLSNAQLDRLGR

SEQ ID NO: 1305956 - protein, 17 aa, Mycobacterium
ATAAALSHRVWLRPFRN

SEQ ID NO: 1305957 - protein, 28 aa, Mycobacterium
ATAETWTNPWPMYAALRDHDPVHHVLPP

SEQ ID NO: 1305958 - protein, 38 aa, Mycobacterium
ATAGRAVVLAPRLWVPDDFGLSRYLAAGLAVLQVVAPG

SEQ ID NO: 1305959 - protein, 23 aa, Mycobacterium
ATAIAAALRRIGVTVTPAATQVV

SEQ ID NO: 1305960 - protein, 19 aa, Mycobacterium
ATALLMRALRIGLEKDDAD

SEQ ID NO: 1305961 - protein, 18 aa, Mycobacterium
ATALLRYEDRDVAWCPCI

SEQ ID NO: 1305962 - protein, 17 aa, Mycobacterium
ATAWDCPFDGPTPPQRV

SEQ ID NO: 1305963 - protein, 25 aa, Mycobacterium
ATDASNLWIIDERLAFHDYLASDKT

SEQ ID NO: 1305964 - protein, 18 aa, Mycobacterium
ATDPQFWARQIRATVRFA

SEQ ID NO: 1305965 - protein, 17 aa, Mycobacterium
ATFLFDTLDGFLDTLLG

SEQ ID NO: 1305966 - protein, 23 aa, Mycobacterium
ATHHFRILREAGVTERLVIDGLI

SEQ ID NO: 1305967 - protein, 28 aa, Mycobacterium
ATKITTPLLPDDYLQLANPLWSARELRG

SEQ ID NO: 1305968 - protein, 24 aa, Mycobacterium
ATLADLVEKFGDALLPIALDVTDR

SEQ ID NO: 1305969 - protein, 17 aa, Mycobacterium
ATLGMLERFPMADHRPD

SEQ ID NO: 1305970 - protein, 17 aa, Mycobacterium
ATLIDIAAGRLAERHVG

SEQ ID NO: 1305971 - protein, 29 aa, Mycobacterium
ATLVLLNVQSWLPTGAVPLDFDPCPKLRK

SEQ ID NO: 1305972 - protein, 20 aa, Mycobacterium
ATMPGTAIWHMAWSDKDDAI

SEQ ID NO: 1305973 - protein, 28 aa, Mycobacterium
ATPHRGKEWLFRHLLHLVDPAIYPDPGS

SEQ ID NO: 1305974 - protein, 17 aa, Mycobacterium
ATQLLVRRKAHGVSLTA

SEQ ID NO: 1305975 - protein, 23 aa, Mycobacterium
ATQPLAHNAPLRALVTALERENP

SEQ ID NO: 1305976 - protein, 20 aa, Mycobacterium
ATRFLERLAIRLGGDLGFAP

SEQ ID NO: 1305977 - protein, 18 aa, Mycobacterium
ATRHQLWLRLNKPGGTEI

SEQ ID NO: 1305978 - protein, 19 aa, Mycobacterium
ATTLAARGWRIIVTDVNLT

SEQ ID NO: 1305979 - protein, 19 aa, Mycobacterium
ATTRTVWLAIALHTTPEIP

SEQ ID NO: 1305980 - protein, 27 aa, Mycobacterium
ATTSMNAWANLRLARQMFARVPDPVAR

SEQ ID NO: 1305981 - protein, 24 aa, Mycobacterium
ATYANYVGKPLSYILATPPRDDDA

SEQ ID NO: 1305982 - protein, 24 aa, Mycobacterium
AVAEARLFPLAQFMADVYAGALLT

SEQ ID NO: 1305983 - protein, 22 aa, Mycobacterium
AVAGSALTALSFAISACLACVG

SEQ ID NO: 1305984 - protein, 24 aa, Mycobacterium
AVAGTPVLVCRLDDTLYAYRDRCG

SEQ ID NO: 1305985 - protein, 19 aa, Mycobacterium
AVAHFLEYGIQDAGRWRVP

SEQ ID NO: 1305986 - protein, 18 aa, Mycobacterium
AVALTRMLRTRSAIGTAA

SEQ ID NO: 1305987 - protein, 30 aa, Mycobacterium
AVAPVYLYRFDFATPMLRLLRLGAAHATEL

SEQ ID NO: 1305988 - protein, 17 aa, Mycobacterium
AVARTLIGYFGGPAAPG

SEQ ID NO: 1305989 - protein, 23 aa, Mycobacterium
AVEARPIWYLVPDGVVQYVTKRR

SEQ ID NO: 1305990 - protein, 31 aa, Mycobacterium
AVERARPVLAAYGDPILHVGPLGAGQSVKLV

SEQ ID NO: 1305991 - protein, 20 aa, Mycobacterium
AVERYQITDMFLAPTMIQMF

SEQ ID NO: 1305992 - protein, 19 aa, Mycobacterium
AVGELPFFEPGLPEVLRSN

SEQ ID NO: 1305993 - protein, 24 aa, Mycobacterium
AVGTDNFALFRREKIITPSGEVTQ

SEQ ID NO: 1305994 - protein, 24 aa, Mycobacterium
AVIALGVVIRGQTPHFDYVCDAVT

SEQ ID NO: 1305995 - protein, 17 aa, Mycobacterium
AVIICPIGFVADHIEVV

SEQ ID NO: 1305996 - protein, 18 aa, Mycobacterium
AVKTLLLASLKNGLEEQM

SEQ ID NO: 1305997 - protein, 25 aa, Mycobacterium
AVLDYPLGDTSLLAPATVMANVLGA

SEQ ID NO: 1305998 - protein, 25 aa, Mycobacterium
AVLEAVIPLWRRNGLARTDWDIADQ

SEQ ID NO: 1305999 - protein, 21 aa, Mycobacterium
AVLINPLRISVHERPLLNLAG

SEQ ID NO: 1306000 - protein, 25 aa, Mycobacterium
AVLKDTMVLAYQWPADRTSVTWTLV

SEQ ID NO: 1306001 - protein, 17 aa, Mycobacterium
AVLVDRGHRELPLRADY

SEQ ID NO: 1306002 - protein, 20 aa, Mycobacterium
AVMAHADWIIDLGPGAGHDG

SEQ ID NO: 1306003 - protein, 19 aa, Mycobacterium
AVPGVWPPVTIGPRRFMDG

SEQ ID NO: 1306004 - protein, 19 aa, Mycobacterium
AVPPLDARIAARVGLRPDV

SEQ ID NO: 1306005 - protein, 18 aa, Mycobacterium
AVPPLPPVPAVPASAPAP

SEQ ID NO: 1306006 - protein, 20 aa, Mycobacterium
AVPVNFRMTPPEIAFLVSDC

SEQ ID NO: 1306007 - protein, 25 aa, Mycobacterium
AVPVNQLIMVKLAMNSALLQQGVAT

SEQ ID NO: 1306008 - protein, 23 aa, Mycobacterium
AVQDAWLRWDALGEDWSGIADLR

SEQ ID NO: 1306009 - protein, 23 aa, Mycobacterium
AVQQQWFSIGMVQPGWDDEPTGS

SEQ ID NO: 1306010 - protein, 24 aa, Mycobacterium
AVRGPVADLLLAVTRRRTLADSGL

SEQ ID NO: 1306011 - protein, 17 aa, Mycobacterium
AVRVPTVLPPSLRARPD

SEQ ID NO: 1306012 - protein, 27 aa, Mycobacterium
AVSGRPHTLLLLTLLSDVGPDDAPTRI

SEQ ID NO: 1306013 - protein, 23 aa, Mycobacterium
AVTARRPLRMVCHGIGYTEGFSP

SEQ ID NO: 1306014 - protein, 19 aa, Mycobacterium
AVTPTPRQSACPAPAFVIG

SEQ ID NO: 1306015 - protein, 18 aa, Mycobacterium
AVTRTRKALADHGFGVLT

SEQ ID NO: 1306016 - protein, 19 aa, Mycobacterium
AVVALAGALLCGCVRVTDG

SEQ ID NO: 1306017 - protein, 25 aa, Mycobacterium
AVVASPWYRMRVAPSVFAHVWAALK

SEQ ID NO: 1306018 - protein, 22 aa, Mycobacterium
AVVDLLALFERWQENRQTAMPF

SEQ ID NO: 1306019 - protein, 26 aa, Mycobacterium
AVVPDTPIPFGVWQRVSVAVRNRPDG

SEQ ID NO: 1306020 - protein, 19 aa, Mycobacterium
AVVTALRALGNDIPICVLS

SEQ ID NO: 1306021 - protein, 19 aa, Mycobacterium
AVVVPPRMAAYSQASAAVF

SEQ ID NO: 1306022 - protein, 27 aa, Mycobacterium
AVYEALLDRIAPLGIAYLHVLIDPTHT

SEQ ID NO: 1306023 - protein, 20 aa, Mycobacterium
AWAAQFVRYKVLIETSPDGS

SEQ ID NO: 1306024 - protein, 19 aa, Mycobacterium
AWLGAFANPGAMDLDLPAI

SEQ ID NO: 1306025 - protein, 32 aa, Mycobacterium
AWNLHAATLDQPLDWFCSFSSAAAMVGSPGQG

SEQ ID NO: 1306026 - protein, 20 aa, Mycobacterium
AWPAGRFLIVTREDLHGDAR

SEQ ID NO: 1306027 - protein, 36 aa, Mycobacterium; identical to SEQ ID NO: 797688

SEQ ID NO: 1306028 - protein, 24 aa, Mycobacterium
AYAEGLRALYLYTATFQDTAVAKA

SEQ ID NO: 1306029 - protein, 17 aa, Mycobacterium
AYEIAKHAEGIYAVIDV

SEQ ID NO: 1306030 - protein, 24 aa, Mycobacterium
AYEPPHRVVFTWDIGPTWHVESDL

SEQ ID NO: 1306031 - protein, 21 aa, Mycobacterium
AYIDQASFLGLRALGRGPLIQ

SEQ ID NO: 1306032 - protein, 22 aa, Mycobacterium
AYLARLLGYPEPTYAHVPLVLN

SEQ ID NO: 1306033 - protein, 24 aa, Mycobacterium
AYLEQVQWFRQVDDDSSFSLNLDT

SEQ ID NO: 1306034 - protein, 26 aa, Mycobacterium
AYLGLAAYTFAIRRLQGKIGIDGGVL

SEQ ID NO: 1306035 - protein, 25 aa, Mycobacterium
AYLKRTLQALQWQGGGTRWVLKSPQ

SEQ ID NO: 1306036 - protein, 33 aa, Mycobacterium
AYLPARWRAPIEPESTWWTWRGRRVHIARAVRP

SEQ ID NO: 1306037 - protein, 19 aa, Mycobacterium
AYRLLGTLTQFRYVAKGED

SEQ ID NO: 1306038 - protein, 20 aa, Mycobacterium
AYRPGGMLAAKWHLKHIAVA

SEQ ID NO: 1306039 - protein, 29 aa, Mycobacterium
CAAPRIESVLPAFLEFARGSVLVAHNAGF

SEQ ID NO: 1306040 - protein, 18 aa, Mycobacterium
CAFIDASPSPFHVCGTVA

SEQ ID NO: 1306041 - protein, 25 aa, Mycobacterium
CARDPFGIKPLYIATGPGGTAVGSE

SEQ ID NO: 1306042 - protein, 21 aa, Mycobacterium
CATGRRRIAFVSGPTELRQVR

SEQ ID NO: 1306043 - protein, 17 aa, Mycobacterium
CDQIASVPYPLATPDDL

SEQ ID NO: 1306044 - protein, 17 aa, Mycobacterium
CDQPARWLIRESEHAQL

SEQ ID NO: 1306045 - protein, 25 aa, Mycobacterium
CDVWNGFIFINLDPEPRWSLREFLG

SEQ ID NO: 1306046 - protein, 29 aa, Mycobacterium
CFGEGPRWFEGLLWFSDMFGEAVHTVDLS

SEQ ID NO: 1306047 - protein, 21 aa, Mycobacterium
CFHDMGMTGYLTVPMYFGAEL

SEQ ID NO: 1306048 - protein, 30 aa, Mycobacterium
CGKHSAIAALPWFWSDQYDLKLQIAGLNTG

SEQ ID NO: 1306049 - protein, 20 aa, Mycobacterium
CGTCHVIVAPEWSDTVGLCG

SEQ ID NO: 1306050 - protein, 17 aa, Mycobacterium
CGTDLHILKGDVPEVQP

SEQ ID NO: 1306051 - protein, 17 aa, Mycobacterium
CLWTWAANPEDRPLWDR

SEQ ID NO: 1306052 - protein, 18 aa, Mycobacterium
CMTEETFGPTLPIMKVKS

SEQ ID NO: 1306053 - protein, 26 aa, Mycobacterium
CPARPWVCLLCPLAVFAPRHAANLLR

SEQ ID NO: 1306054 - protein, 22 aa, Mycobacterium
CPCGGLIRPNVVWFGEALPEAA

SEQ ID NO: 1306055 - protein, 28 aa, Mycobacterium
CPPGLLMSLGFAPQWVPGYLARADMMFA

SEQ ID NO: 1306056 - protein, 34 aa, Mycobacterium
CPQCSGRLRKLFGKVGVVFKGSGFYRTDSRESTK

SEQ ID NO: 1306057 - protein, 23 aa, Mycobacterium
CPSKSFTIVGDLAQRRSAAGARS

SEQ ID NO: 1306058 - protein, 25 aa, Mycobacterium
CQECSRPFPLIGRLNLRQPSTRRNR

SEQ ID NO: 1306059 - protein, 18 aa, Mycobacterium
CRALLLDQPSPGAALAGL

SEQ ID NO: 1306060 - protein, 22 aa, Mycobacterium
CRMPIGATWAATPPAKCGSNAT

SEQ ID NO: 1306061 - protein, 22 aa, Mycobacterium
CRREVFRWLTRYNTQRRHSHCR

SEQ ID NO: 1306062 - protein, 25 aa, Mycobacterium
CSAQAQLIARWMLVGFVHGVMNTDN

SEQ ID NO: 1306063 - protein, 19 aa, Mycobacterium
CSIKHQLPSVIFSLEMSKS

SEQ ID NO: 1306064 - protein, 20 aa, Mycobacterium
CTHCFPSAPVEWTTKAPKPA

SEQ ID NO: 1306065 - protein, 24 aa, Mycobacterium
CTHPGCTVPFYWTEAHHTHDYSRG

SEQ ID NO: 1306066 - protein, 24 aa, Mycobacterium
CTHPHCTVPFYWTEAHHTRDYAQG

SEQ ID NO: 1306067 - protein, 17 aa, Mycobacterium
CTLPEVFDHARPGEKIR

SEQ ID NO: 1306068 - protein, 23 aa, Mycobacterium
CTRGYSVMLGYWNDPDKTAQAID

SEQ ID NO: 1306069 - protein, 18 aa, Mycobacterium
CVAVLRRGARPAPNGSVA

SEQ ID NO: 1306070 - protein, 26 aa, Mycobacterium
CVERNIAFVPFFPLGSGFVADNPVLG

SEQ ID NO: 1306071 - protein, 19 aa, Mycobacterium
CVRALLADGHRVRLLVGPD

SEQ ID NO: 1306072 - protein, 23 aa, Mycobacterium
CVRSPAILPPAQAMTTPILAEPS

SEQ ID NO: 1306073 - protein, 18 aa, Mycobacterium
CVVSAPCSVLLALAAHYD

SEQ ID NO: 1306074 - protein, 24 aa, Mycobacterium
CYLSMPLFHSNAVMAGWSVGVAAG

SEQ ID NO: 1306075 - protein, 23 aa, Mycobacterium
DAAARFYEAIGLALYCIEEPEHP

SEQ ID NO: 1306076 - protein, 32 aa, Mycobacterium
DAAASWRPFQLAFILLQIPSLTDPAHPFRSGD

SEQ ID NO: 1306077 - protein, 25 aa, Mycobacterium
DAALHGHVRLTYPPGWAVEPAELPF

SEQ ID NO: 1306078 - protein, 24 aa, Mycobacterium
DAAQWTAMQDWLLGQHAKFRDALE

SEQ ID NO: 1306079 - protein, 17 aa, Mycobacterium
DAATRAALLDRFGMFGV

SEQ ID NO: 1306080 - protein, 17 aa, Mycobacterium
DADIERVMPIFDTLRPP

SEQ ID NO: 1306081 - protein, 23 aa, Mycobacterium
DADPLAPYGFSGWVGPEPHGAAL

SEQ ID NO: 1306082 - protein, 24 aa, Mycobacterium
DADRLRPLLPENTAYLIYTSGTTG

SEQ ID NO: 1306083 - protein, 27 aa, Mycobacterium
DADVERLHLVLVYRSVGLPLEEIRTLL

SEQ ID NO: 1306084 - protein, 23 aa, Mycobacterium
DAELSALLALRPPALLVGRADPN

SEQ ID NO: 1306085 - protein, 25 aa, Mycobacterium
DAGGRGLLVLLDALTRTLGGHAPRR

SEQ ID NO: 1306086 - protein, 18 aa, Mycobacterium
DAGRWLLVATSTDAQPEA

SEQ ID NO: 1306087 - protein, 18 aa, Mycobacterium
DAHPWFKSARRSKDDPYR

SEQ ID NO: 1306088 - protein, 20 aa, Mycobacterium
DAIFLDINMPGLSGIELAGV

SEQ ID NO: 1306089 - protein, 18 aa, Mycobacterium
DAIVALAPVLTEYAKGRS

SEQ ID NO: 1306090 - protein, 18 aa, Mycobacterium
DAKALAALKPGGWVANVA

SEQ ID NO: 1306091 - protein, 19 aa, Mycobacterium
DAKAMASLLLVVLRGMEAL

SEQ ID NO: 1306092 - protein, 32 aa, Mycobacterium
DAKQADRLTLLAKPMPGLLRAVTGLAKTASDQ

SEQ ID NO: 1306093 - protein, 30 aa, Mycobacterium
DAKSRRWAGPAFLLNEMLVWGFTGQVISAI

SEQ ID NO: 1306094 - protein, 23 aa, Mycobacterium
DALAYFHRVVGDRTPLDLQRAYV

SEQ ID NO: 1306095 - protein, 19 aa, Mycobacterium
DALGALQLLAAQPAELRSA

SEQ ID NO: 1306096 - protein, 18 aa, Mycobacterium
DALGQWIAAGLPRSARFR

SEQ ID NO: 1306097 - protein, 24 aa, Mycobacterium
DALGWLDAHWPSDVAAGDPVLVWG

SEQ ID NO: 1306098 - protein, 25 aa, Mycobacterium
DALLPATPEPVGTLILTELRTAVAT

SEQ ID NO: 1306099 - protein, 20 aa, Mycobacterium
DAMPTFRQVFMAGASGMDLE

SEQ ID NO: 1306100 - protein, 26 aa, Mycobacterium
DANHEWPWSARFNPGGLRQPVLGQRE

SEQ ID NO: 1306101 - protein, 25 aa, Mycobacterium
DAPAIPSPALYPGAPIPAPPNVLSN

SEQ ID NO: 1306102 - protein, 19 aa, Mycobacterium
DAPARIVLAALPDDPGRDA

SEQ ID NO: 1306103 - protein, 32 aa, Mycobacterium; identical to SEQ ID NO: 799216

SEQ ID NO: 1306104 - protein, 28 aa, Mycobacterium
DAQLRDLMDLHFFGPAALVRAALPIMRA

SEQ ID NO: 1306105 - protein, 22 aa, Mycobacterium
DARLRELVIMRIGWITGSEYEW

SEQ ID NO: 1306106 - protein, 29 aa, Mycobacterium
DARTVICVLTHDPKFDVPLLEVALRLPQV

SEQ ID NO: 1306107 - protein, 18 aa, Mycobacterium
DASLFDLGVDSLLALDLG

SEQ ID NO: 1306108 - protein, 17 aa, Mycobacterium
DASMAWQKILHERGWAA

SEQ ID NO: 1306109 - protein, 17 aa, Mycobacterium
DASWIARLLEFDRDGDT

SEQ ID NO: 1306110 - protein, 20 aa, Mycobacterium
DATITLFDPADRLGGVLRTE

SEQ ID NO: 1306111 - protein, 17 aa, Mycobacterium
DATRRLKLVPQSRYDDA

SEQ ID NO: 1306112 - protein, 31 aa, Mycobacterium
DAVEPRLWNMWTVLPILQDTTIVAAGPSVRN

SEQ ID NO: 1306113 - protein, 22 aa, Mycobacterium
DAVHIHAVLRAVLPPADRAEPA

SEQ ID NO: 1306114 - protein, 18 aa, Mycobacterium
DAVRQSWIDATPLARLQT

SEQ ID NO: 1306115 - protein, 23 aa, Mycobacterium
DAVRSLREKLWPDNPRSAEYLDA

SEQ ID NO: 1306116 - protein, 30 aa, Mycobacterium
DAVTWGEEPLLRDAFLTLIDQQLLRAKNAD

SEQ ID NO: 1306117 - protein, 19 aa, Mycobacterium
DAYKTLRTQYLAAVPGSER

SEQ ID NO: 1306118 - protein, 28 aa, Mycobacterium
DCDWYDPVKLCLERLTPWLSPGARVILD

SEQ ID NO: 1306119 - protein, 37 aa, Mycobacterium
DCPGHPRLSLLRLGARLGFTMIALDRPGYGSSAPYPD

SEQ ID NO: 1306120 - protein, 17 aa, Mycobacterium
DCYEALTWMARLPAVDP

SEQ ID NO: 1306121 - protein, 19 aa, Mycobacterium
DDCIYADMPLGPALAARGP

SEQ ID NO: 1306122 - protein, 25 aa, Mycobacterium
DDDDGLPPFLLFNDDYESLKLRIAR

SEQ ID NO: 1306123 - protein, 24 aa, Mycobacterium
DDDLHWQPHLWRHLVERVPADPPH

SEQ ID NO: 1306124 - protein, 24 aa, Mycobacterium
DDDPEFIALFRQILVDQRAEIEAV

SEQ ID NO: 1306125 - protein, 23 aa, Mycobacterium
DDERFDYMYKFVSSKKMQPGAGA

SEQ ID NO: 1306126 - protein, 32 aa, Mycobacterium
DDETLIRYVDRFLMFYIRTADRLQRTAPWVEQ

SEQ ID NO: 1306127 - protein, 29 aa, Mycobacterium
DDFLATVATTRLVLGPKVRIQAPPNLVSR

SEQ ID NO: 1306128 - protein, 20 aa, Mycobacterium
DDFLGALPGVLDAAAAGGGE

SEQ ID NO: 1306129 - protein, 30 aa, Mycobacterium
DDGADIRVLPPLDPPPPGVYAAFRNFGPDE

SEQ ID NO: 1306130 - protein, 22 aa, Mycobacterium
DDGALTLALPMADQPLAGIAVD

SEQ ID NO: 1306131 - protein, 21 aa, Mycobacterium
DDGHSIVLLSEGRLLNLGNAT

SEQ ID NO: 1306132 - protein, 24 aa, Mycobacterium
DDGRRFTELYNVNKLSSAGLLGST

SEQ ID NO: 1306133 - protein, 20 aa, Mycobacterium
DDGSAEFQPEDGGAAPPSPR

SEQ ID NO: 1306134 - protein, 27 aa, Mycobacterium
DDHDTFLLALGQMWAAGVDLDWSRLSK

SEQ ID NO: 1306135 - protein, 23 aa, Mycobacterium
DDHREFLAACLPIGEGWPNWREA

SEQ ID NO: 1306136 - protein, 20 aa, Mycobacterium
DDIALDRTMRTRNATYWSRS

SEQ ID NO: 1306137 - protein, 24 aa, Mycobacterium
DDIRPEHLLVGVLRSAGPSLSRVL

SEQ ID NO: 1306138 - protein, 21 aa, Mycobacterium
DDIWKPYIRSLTKAPQTLLHG

SEQ ID NO: 1306139 - protein, 26 aa, Mycobacterium
DDLGRAWADWLPAVGRWTPASAQMPP

SEQ ID NO: 1306140 - protein, 20 aa, Mycobacterium
DDLHPLRMVAARLPCAYLNP

SEQ ID NO: 1306141 - protein, 18 aa, Mycobacterium
DDLIALLTPRRSSLGEQR

SEQ ID NO: 1306142 - protein, 34 aa, Mycobacterium
DDLLFGHSRRSYLWGMLHARRRRLEPDPELLYVA

SEQ ID NO: 1306143 - protein, 27 aa, Mycobacterium
DDNWYRGELIFVFDGDAAGQAAALKAF

SEQ ID NO: 1306144 - protein, 23 aa, Mycobacterium
DDPDALVTVWGKILGCDAAVLAA

SEQ ID NO: 1306145 - protein, 22 aa, Mycobacterium
DDPDDRLVLALGLRATESAQPL

SEQ ID NO: 1306146 - protein, 19 aa, Mycobacterium
DDRIPAVLDLSLMTKTKAR

SEQ ID NO: 1306147 - protein, 24 aa, Mycobacterium
DDRRTLLWLANQRAVEYHPTLGLA

SEQ ID NO: 1306148 - protein, 23 aa, Mycobacterium
DDSEPFQPFSLTLYAPQDDEESP

SEQ ID NO: 1306149 - protein, 23 aa, Mycobacterium
DDTALTLLVAEYLRDRGAVVEEA

SEQ ID NO: 1306150 - protein, 19 aa, Mycobacterium
DDYLVKPFVLAELVARVKA

SEQ ID NO: 1306151 - protein, 23 aa, Mycobacterium
DDYPDWFIGIRQNGVVIGLEFDH

SEQ ID NO: 1306152 - protein, 34 aa, Mycobacterium
DEAFALLTALGDPVLWSVPLHWAGVHAGILANSP

SEQ ID NO: 1306153 - protein, 25 aa, Mycobacterium
DEAHRSIYGVWRGVLEYFDAHVVGL

SEQ ID NO: 1306154 - protein, 19 aa, Mycobacterium
DEALIAFSNYHYYEGRLAS

SEQ ID NO: 1306155 - protein, 17 aa, Mycobacterium
DEALIIEFDAHEGLWML

SEQ ID NO: 1306156 - protein, 20 aa, Mycobacterium
DEALIRDPYARLLVTGAGTG

SEQ ID NO: 1306157 - protein, 24 aa, Mycobacterium
DEAYTNYRPVPLYGYRAKDVNGDY

SEQ ID NO: 1306158 - protein, 26 aa, Mycobacterium
DEEERLLKALIPQIAVFGGAASGRIM

SEQ ID NO: 1306159 - protein, 24 aa, Mycobacterium
DEEVLGFCALLLVAGYETTTNLLG

SEQ ID NO: 1306160 - protein, 18 aa, Mycobacterium
DEGLGSPWDGPTGRHAAE

SEQ ID NO: 1306161 - protein, 24 aa, Mycobacterium
DEGLYPVQHGYWLQTMRAALAQNE

SEQ ID NO: 1306162 - protein, 26 aa, Mycobacterium
DEGRWDSVIAVNLLAPLRLTEGLVDS

SEQ ID NO: 1306163 - protein, 20 aa, Mycobacterium
DEHPLHYVDKWDTYALSRFE

SEQ ID NO: 1306164 - protein, 23 aa, Mycobacterium
DEIGYGVLFFASDASSYCSGQTL

SEQ ID NO: 1306165 - protein, 23 aa, Mycobacterium
DEITDALLRLRRARNWSFLSMPH

SEQ ID NO: 1306166 - protein, 27 aa, Mycobacterium
DEIYTFMDLWFYHCNPRHHSIALTRMP

SEQ ID NO: 1306167 - protein, 18 aa, Mycobacterium
DELDAVVFVNMWGDSDDT

SEQ ID NO: 1306168 - protein, 30 aa, Mycobacterium
DELLTRIHILRQRPEWRRQLLDDIAPVATV

SEQ ID NO: 1306169 - protein, 37 aa, Mycobacterium
DEPSMTPLFQRFGTDLPPLGGIYLAAFGGGPVTLLDL

SEQ ID NO: 1306170 - protein, 26 aa, Mycobacterium
DEQARARPIAPLLAGLQALGVRIDGD

SEQ ID NO: 1306171 - protein, 23 aa, Mycobacterium
DEQRVFGLLVSPIGDDLSRLRAS

SEQ ID NO: 1306172 - protein, 22 aa, Mycobacterium
DEQYTYWRIALPHAEAATFDAA

SEQ ID NO: 1306173 - protein, 19 aa, Mycobacterium
DERFLALGGWKDKDEVHHS

SEQ ID NO: 1306174 - protein, 22 aa, Mycobacterium
DERLIDTYVRPTLHGELIGSLA

SEQ ID NO: 1306175 - protein, 17 aa, Mycobacterium
DERQAGIIFGIARRMVE

SEQ ID NO: 1306176 - protein, 21 aa, Mycobacterium
DERRLPVHPAHLTRIAPELRD

SEQ ID NO: 1306177 - protein, 17 aa, Mycobacterium
DERSVIFAAELRDLTAR

SEQ ID NO: 1306178 - protein, 23 aa, Mycobacterium
DESDRVVFLFPGQGAQHADMARG

SEQ ID NO: 1306179 - protein, 19 aa, Mycobacterium
DETFLIPASDGLIHHIRAR

SEQ ID NO: 1306180 - protein, 31 aa, Mycobacterium
DETTELPIEKVQLVIFAIQVALGELLKHHGA

SEQ ID NO: 1306181 - protein, 20 aa, Mycobacterium
DEWLNRLLEDCARDAGEDVV

SEQ ID NO: 1306182 - protein, 24 aa, Mycobacterium
DEWVRFIVRHVLQGGGPLGNEEEA

SEQ ID NO: 1306183 - protein, 17 aa, Mycobacterium
DFALGESDLIRIQDRDL

SEQ ID NO: 1306184 - protein, 27 aa, Mycobacterium
DFDHLPEQAFFLIGGLEDLQRKAESLG

SEQ ID NO: 1306185 - protein, 22 aa, Mycobacterium
DFEHFTWDTPVLKVNYALDAPI

SEQ ID NO: 1306186 - protein, 17 aa, Mycobacterium
DFFAGAGALNYGHNNPA

SEQ ID NO: 1306187 - protein, 19 aa, Mycobacterium
DFGVAPLRRTIAHLESTNI

SEQ ID NO: 1306188 - protein, 24 aa, Mycobacterium
DFPLDGVVPGFQKAIAGQKVGSTV

SEQ ID NO: 1306189 - protein, 18 aa, Mycobacterium
DFQHMITQYAWGSIWTRP

SEQ ID NO: 1306190 - protein, 21 aa, Mycobacterium
DFRLWVCLHEVTHRVQFGANP

SEQ ID NO: 1306191 - protein, 18 aa, Mycobacterium
DFTFRFRNQTRRFDLDAY

SEQ ID NO: 1306192 - protein, 31 aa, Mycobacterium
DGAAVIRHLSAPLYYQFLTTTTPLSTRDADR

SEQ ID NO: 1306193 - protein, 26 aa, Mycobacterium
DGDNAVLLFTYYTGDDLSYQPWIGPG

SEQ ID NO: 1306194 - protein, 27 aa, Mycobacterium
DGDNWMRLFDLWQQVKDPLLSSLFSPF

SEQ ID NO: 1306195 - protein, 29 aa, Mycobacterium
DGDPCQLCRWWWRQGRTWPKAHPFQRHKG

SEQ ID NO: 1306196 - protein, 25 aa, Mycobacterium
DGEPVAGLTWLPFMSQRYTAVVGKP

SEQ ID NO: 1306197 - protein, 20 aa, Mycobacterium
DGFSMTFWRYLDAVSDAEPD

SEQ ID NO: 1306198 - protein, 31 aa, Mycobacterium
DGGFCYGYHGDLDLLGHLYGPGSTAWRLQLR

SEQ ID NO: 1306199 - protein, 17 aa, Mycobacterium
DGIEFAGDWDALGQRLS

SEQ ID NO: 1306200 - protein, 25 aa, Mycobacterium
DGIHQAMEFLPWANRVQLGDPVTGE

SEQ ID NO: 1306201 - protein, 18 aa, Mycobacterium
DGLDFLRLAVLDALLVLH

SEQ ID NO: 1306202 - protein, 21 aa, Mycobacterium
DGLDRGWYVKPTVFDRADNSM

SEQ ID NO: 1306203 - protein, 23 aa, Mycobacterium
DGLGHWWMVEDPTAGAAALTRFW

SEQ ID NO: 1306204 - protein, 17 aa, Mycobacterium
DGLIAQWKRDHGDHGDT

SEQ ID NO: 1306205 - protein, 18 aa, Mycobacterium
DGLLSRREALRRLSLIGI

SEQ ID NO: 1306206 - protein, 35 aa, Mycobacterium
DGLQVPLPIASLLRDRFLTLLATGGGHLDWSAIGA

SEQ ID NO: 1306207 - protein, 25 aa, Mycobacterium
DGLSLAHLRRALPEAVFVSARTGQG

SEQ ID NO: 1306208 - protein, 23 aa, Mycobacterium
DGNPNDFLYVPPGGIHGFRNESD

SEQ ID NO: 1306209 - protein, 24 aa, Mycobacterium
DGQCEFLAAYAKPFSLLVVADLLG

SEQ ID NO: 1306210 - protein, 18 aa, Mycobacterium
DGRIPVLLSAHAGDLVAE

SEQ ID NO: 1306211 - protein, 18 aa, Mycobacterium
DGSLLITSVERRQVLRYD

SEQ ID NO: 1306212 - protein, 24 aa, Mycobacterium
DGSVSWAPVWARYGTNNRSCMLRL

SEQ ID NO: 1306213 - protein, 17 aa, Mycobacterium
DGTGYVQVLYRLDGRQT

SEQ ID NO: 1306214 - protein, 21 aa, Mycobacterium
DGVGRFFGAYEDPATLFSTDM

SEQ ID NO: 1306215 - protein, 24 aa, Mycobacterium
DGVLQWRGTAGPGTTVDLLLHVDT

SEQ ID NO: 1306216 - protein, 34 aa, Mycobacterium
DGWRLAMDLLPYERSTCFWQRIAYLYSRFDALVE

SEQ ID NO: 1306217 - protein, 17 aa, Mycobacterium
DGYAGRLWLPMLEAERD

SEQ ID NO: 1306218 - protein, 30 aa, Mycobacterium
DHAPLPLREPVRSLVWIGGRVQAVPSADVS

SEQ ID NO: 1306219 - protein, 25 aa, Mycobacterium
DHCLGVVFYPVIPAGSWVATTEFKL

SEQ ID NO: 1306220 - protein, 26 aa, Mycobacterium
DHDPSSLALPLALYRAVTAFGRVAAE

SEQ ID NO: 1306221 - protein, 26 aa, Mycobacterium
DHETGEEFPLLPGTMYLLDGHERHRV

SEQ ID NO: 1306222 - protein, 17 aa, Mycobacterium
DHLHAFEVKWLCAGVEV

SEQ ID NO: 1306223 - protein, 29 aa, Mycobacterium
DHLIAADMTWLLSRWTCVFGTPACQGTVE

SEQ ID NO: 1306224 - protein, 26 aa, Mycobacterium
DHNGVRRWLALDGQPLHRVIVAASEM

SEQ ID NO: 1306225 - protein, 18 aa, Mycobacterium
DHRALRWVAVHELDDLPW

SEQ ID NO: 1306226 - protein, 17 aa, Mycobacterium
DHRDTFEVKWLCAVVEV

SEQ ID NO: 1306227 - protein, 21 aa, Mycobacterium
DIALQAIAYGSVYVARVAMGA

SEQ ID NO: 1306228 - protein, 25 aa, Mycobacterium
DIDDVTSVFRYYARLIAVQSDRVVD

SEQ ID NO: 1306229 - protein, 26 aa, Mycobacterium
DIDLYAPVARYWPEFGRAGKEDITLA

SEQ ID NO: 1306230 - protein, 25 aa, Mycobacterium
DIDPDSRFPAPRYWAIHTLSHLLIR

SEQ ID NO: 1306231 - protein, 24 aa, Mycobacterium
DIELLDISLRRPSLDEVFLHLTTP

SEQ ID NO: 1306232 - protein, 26 aa, Mycobacterium
DIERVMPIFDTLRPPGDRADGFVHAG

SEQ ID NO: 1306233 - protein, 17 aa, Mycobacterium
DIFAARRVGALARRLVD

SEQ ID NO: 1306234 - protein, 17 aa, Mycobacterium
DIGAPPQFMDFRYTVHD

SEQ ID NO: 1306235 - protein, 24 aa, Mycobacterium
DIGFSFCYEAQRQVPAILDLLATG

SEQ ID NO: 1306236 - protein, 18 aa, Mycobacterium
DILTGMWATPVGETFDYS

SEQ ID NO: 1306237 - protein, 20 aa, Mycobacterium
DILVELGLDWDRIIELKTAG

SEQ ID NO: 1306238 - protein, 23 aa, Mycobacterium
DIPDDVLAVLPTRSLRISVPPEW

SEQ ID NO: 1306239 - protein, 23 aa, Mycobacterium
DIRGPIFALNLSGRRNQPVHLEW

SEQ ID NO: 1306240 - protein, 19 aa, Mycobacterium
DIVARYCSLLPVSVISDVL

SEQ ID NO: 1306241 - protein, 29 aa, Mycobacterium
DKAALDDCLLKYSRLFAALTEWERSTDIA

SEQ ID NO: 1306242 - protein, 25 aa, Mycobacterium
DKAVRAVRLFGPVGSALIYAASKIA

SEQ ID NO: 1306243 - protein, 28 aa, Mycobacterium
DKGLRRWRAVVRSAARQSRRAHIPPVDG

SEQ ID NO: 1306244 - protein, 21 aa, Mycobacterium
DKIAAGPPLYSPFKLLDPVAN

SEQ ID NO: 1306245 - protein, 18 aa, Mycobacterium
DKLFIGGQWVAPSTSDVI

SEQ ID NO: 1306246 - protein, 27 aa, Mycobacterium
DKPELLKRYLDRWYWEVKGHVGGLTPQ

SEQ ID NO: 1306247 - protein, 17 aa, Mycobacterium
DKVTSMFRHADLSSALA

SEQ ID NO: 1306248 - protein, 25 aa, Mycobacterium
DLAKRKLFPGLYRLAAAGRLPEEYA

SEQ ID NO: 1306249 - protein, 17 aa, Mycobacterium
DLAPLFASGLIAQEVAT

SEQ ID NO: 1306250 - protein, 21 aa, Mycobacterium
DLAQLLWSFAPARRGRPAGLS

SEQ ID NO: 1306251 - protein, 37 aa, Mycobacterium
DLARPSWMPVGPGTYGRFLAIRVFDFWVHERDITTPL

SEQ ID NO: 1306252 - protein, 18 aa, Mycobacterium
DLAWFFQRTSRGRSPLAC

SEQ ID NO: 1306253 - protein, 19 aa, Mycobacterium
DLDALIVVSSPWVDGAAAA

SEQ ID NO: 1306254 - protein, 28 aa, Mycobacterium
DLDRLPDVLYTSLLRRAITTANIALDKA

SEQ ID NO: 1306255 - protein, 25 aa, Mycobacterium
DLERERCLLFVACTRAREELLVTWH

SEQ ID NO: 1306256 - protein, 27 aa, Mycobacterium
DLFPCLDTVIAYKLLFGIYSGIVPDGI

SEQ ID NO: 1306257 - protein, 21 aa, Mycobacterium
DLFRSPAAAASFVVDPDGALR

SEQ ID NO: 1306258 - protein, 19 aa, Mycobacterium
DLFTGLWETSLAADEILTA

SEQ ID NO: 1306259 - protein, 25 aa, Mycobacterium
DLGSLTLPVLRAWLSAQAAAGTART

SEQ ID NO: 1306260 - protein, 31 aa, Mycobacterium
DLHRTDPLLLLPLLRAMTPVPVLLLHCYPFQ

SEQ ID NO: 1306261 - protein, 27 aa, Mycobacterium
DLKNRGAVFAFFREVKPKYVILAAAKV

SEQ ID NO: 1306262 - protein, 18 aa, Mycobacterium
DLLMWCHTTKRTDTRVRN

SEQ ID NO: 1306263 - protein, 17 aa, Mycobacterium
DLLRSCRRRGMIAPVLA

SEQ ID NO: 1306264 - protein, 20 aa, Mycobacterium
DLLSLIRRTSAFGVNILGSG

SEQ ID NO: 1306265 - protein, 19 aa, Mycobacterium
DLLWSRPIKEYPDLKIALS

SEQ ID NO: 1306266 - protein, 17 aa, Mycobacterium
DLPFLDLPYGTEDLADG

SEQ ID NO: 1306267 - protein, 23 aa, Mycobacterium
DLPTALGHIDAVQPSLVVVDSVQ

SEQ ID NO: 1306268 - protein, 23 aa, Mycobacterium
DLPTPLPRITYAEAMHRFGTDKP

SEQ ID NO: 1306269 - protein, 19 aa, Mycobacterium
DLQWFTDDRILPQLPRSAG

SEQ ID NO: 1306270 - protein, 21 aa, Mycobacterium
DLRAWLTTVVSRIGLDRLRSA

SEQ ID NO: 1306271 - protein, 26 aa, Mycobacterium
DLRERVTRLFGLVLPAIVTDESREYF

SEQ ID NO: 1306272 - protein, 21 aa, Mycobacterium
DLSALYEQYATHIRPIVTQTD

SEQ ID NO: 1306273 - protein, 26 aa, Mycobacterium
DLTERLVLMSRQYGLEPQQLLQILQQ

SEQ ID NO: 1306274 - protein, 27 aa, Mycobacterium
DLTTCTAWPVLRRSLAMRALSGADPGR

SEQ ID NO: 1306275 - protein, 20 aa, Mycobacterium
DLTVRRLAVGLLKEETARLL

SEQ ID NO: 1306276 - protein, 35 aa, Mycobacterium
DLVHPKYGFISKRVFGQMFPNLWEWAEEWTERTGR

SEQ ID NO: 1306277 - protein, 20 aa, Mycobacterium
DLVVKLKKLATNVEIAVLVG

SEQ ID NO: 1306278 - protein, 17 aa, Mycobacterium
DLVVTLRPEWTAGQARF

SEQ ID NO: 1306279 - protein, 26 aa, Mycobacterium
DMGRNFLTKLGILSPATAAADPGITN

SEQ ID NO: 1306280 - protein, 18 aa, Mycobacterium
DMLFWGPNASQHVALYLG

SEQ ID NO: 1306281 - protein, 18 aa, Mycobacterium
DMRDWVACLVRPLTDHLA

SEQ ID NO: 1306282 - protein, 17 aa, Mycobacterium
DNEGQHLYWVVGDNTQG

SEQ ID NO: 1306283 - protein, 28 aa, Mycobacterium
DNEIVLVDFWASWCGPCRAFAPTFAASS

SEQ ID NO: 1306284 - protein, 22 aa, Mycobacterium
DNFVFPAGMLLVFEPVVWEDGT

SEQ ID NO: 1306285 - protein, 25 aa, Mycobacterium
DNGDKRIELIRYIDLRDKLNNDLLA

SEQ ID NO: 1306286 - protein, 26 aa, Mycobacterium
DNGRWSRFFMVPGGHIHRSTACHSLH

SEQ ID NO: 1306287 - protein, 17 aa, Mycobacterium
DNHQCQLRFPGICTGHA

SEQ ID NO: 1306288 - protein, 20 aa, Mycobacterium
DNMLLICGDGRKVALDPNLV

SEQ ID NO: 1306289 - protein, 34 aa, Mycobacterium
DNPIPGHFMDDFLLYWAFLSFALVRGGRRTFGAS

SEQ ID NO: 1306290 - protein, 26 aa, Mycobacterium
DNWYRGELIFVFDGDAAGQAAALKAF

SEQ ID NO: 1306291 - protein, 20 aa, Mycobacterium
DPALGPLVGPYATMASLPAS

SEQ ID NO: 1306292 - protein, 23 aa, Mycobacterium
DPANLLDLFESFVAYMERPGGLV

SEQ ID NO: 1306293 - protein, 22 aa, Mycobacterium
DPDALVTVWGKILGCDAAVLAA

SEQ ID NO: 1306294 - protein, 18 aa, Mycobacterium
DPDAMFLLTEECRTLGLP

SEQ ID NO: 1306295 - protein, 24 aa, Mycobacterium
DPDPDDLFMLIFTSGTSGEPKAVR

SEQ ID NO: 1306296 - protein, 25 aa, Mycobacterium
DPDQLRTVFLDYLDYLRSPQAATHS

SEQ ID NO: 1306297 - protein, 27 aa, Mycobacterium
DPDVVYMHLGSPLLQRATRRLRSALWG

SEQ ID NO: 1306298 - protein, 37 aa, Mycobacterium
DPDWQRFHLIGATNTVYFALLARRRMDLYGATVDDFA

SEQ ID NO: 1306299 - protein, 32 aa, Mycobacterium
DPGQRLELAFDYRVLWAEPLPGKVRRRGAEAV

SEQ ID NO: 1306300 - protein, 19 aa, Mycobacterium
DPGRWTGVERIGVVAGTGG

SEQ ID NO: 1306301 - protein, 20 aa, Mycobacterium
DPLIMRRALEYASGLGVLIA

SEQ ID NO: 1306302 - protein, 30 aa, Mycobacterium
DPLVDDHFRQLWFGWGDPARVLIEYAQLRV

SEQ ID NO: 1306303 - protein, 17 aa, Mycobacterium
DPMALIAPAGSGGADGG

SEQ ID NO: 1306304 - protein, 20 aa, Mycobacterium
DPQAARIWLLQALTGRRASE

SEQ ID NO: 1306305 - protein, 21 aa, Mycobacterium
DPRGGFGFGPGPRGRRGGGRG

SEQ ID NO: 1306306 - protein, 23 aa, Mycobacterium
DPRGLTLTGGLPYFGGPGNSYSL

SEQ ID NO: 1306307 - protein, 20 aa, Mycobacterium
DPRPLIVFGASMGGLLGYEV

SEQ ID NO: 1306308 - protein, 19 aa, Mycobacterium
DPRQEEQLLRRFVAPAFSA

SEQ ID NO: 1306309 - protein, 27 aa, Mycobacterium
DPRSSLPIEWVNEILSLTVRLRGVDAP

SEQ ID NO: 1306310 - protein, 23 aa, Mycobacterium
DPSGGVWVSLWGADRLARVSADG

SEQ ID NO: 1306311 - protein, 18 aa, Mycobacterium
DPTLIVALATTLGGPTSH

SEQ ID NO: 1306312 - protein, 23 aa, Mycobacterium
DPTVFPGHWYSAEPSDALSNVKR

SEQ ID NO: 1306313 - protein, 22 aa, Mycobacterium
DPTVSAPRYPDLLPNGAIDSRS

SEQ ID NO: 1306314 - protein, 24 aa, Mycobacterium
DPVGPLPQWLFAFDAAGIAQLRAL

SEQ ID NO: 1306315 - protein, 20 aa, Mycobacterium
DPYNAAPPAMPFLQALAQPP

SEQ ID NO: 1306316 - protein, 24 aa, Mycobacterium
DQAPKGIFPWYAPGVDGQLGEFPL

SEQ ID NO: 1306317 - protein, 24 aa, Mycobacterium
DQFFRTTPHLPLSWQRKAIQLVAP

SEQ ID NO: 1306318 - protein, 28 aa, Mycobacterium
DQIETNVFGALWITQAALPYLREQRGGH

SEQ ID NO: 1306319 - protein, 31 aa, Mycobacterium
DQITPAPAALVLVFVASFRAPLQGTPAPPAL

SEQ ID NO: 1306320 - protein, 28 aa, Mycobacterium
DQKRHPFLGMPFWLGRGFGLNLSVVTDP

SEQ ID NO: 1306321 - protein, 17 aa, Mycobacterium
DQQQRLRLIDEVLDRTG

SEQ ID NO: 1306322 - protein, 23 aa, Mycobacterium
DQVFYGHVLGFKGLERRCVVLIV

SEQ ID NO: 1306323 - protein, 17 aa, Mycobacterium
DQVLRELPADRTRHLVA

SEQ ID NO: 1306324 - protein, 20 aa, Mycobacterium
DQVYLDLLTGWRDAWDIGTT

SEQ ID NO: 1306325 - protein, 20 aa, Mycobacterium
DQWRQFGFDLDFSELVYTGE

SEQ ID NO: 1306326 - protein, 35 aa, Mycobacterium
DRAAALLPILELKAGRILFNGWPTGVEVTHAMVHG

SEQ ID NO: 1306327 - protein, 24 aa, Mycobacterium
DRADGTVLIRRLLREAVVTPVPAT

SEQ ID NO: 1306328 - protein, 33 aa, Mycobacterium
DRADLYLPIRPGTDVALLNGLLHLLVERGDIDE

SEQ ID NO: 1306329 - protein, 17 aa, Mycobacterium
DRAMRLHISGRLAASIK

SEQ ID NO: 1306330 - protein, 22 aa, Mycobacterium
DRCGQLWRADFAWPAAKVVAEY

SEQ ID NO: 1306331 - protein, 24 aa, Mycobacterium
DRCYAILRAIGRPVGQARGRGERA

SEQ ID NO: 1306332 - protein, 17 aa, Mycobacterium
DRDEYVLVRLPAGLRTA

SEQ ID NO: 1306333 - protein, 32 aa, Mycobacterium
DRDNDFEPLLLDWRAPLSRAFYVATAAHPEGM

SEQ ID NO: 1306334 - protein, 20 aa, Mycobacterium
DREFEKWLGCYADDVVYWMP

SEQ ID NO: 1306335 - protein, 19 aa, Mycobacterium
DREPVGGVHFAFVSNSSPW

SEQ ID NO: 1306336 - protein, 17 aa, Mycobacterium
DRFARLGVIANMQPLWA

SEQ ID NO: 1306337 - protein, 39 aa, Mycobacterium
DRFVSGWRIVALQPYGGAWLNSWLDRDLGISGRLSIRAG

SEQ ID NO: 1306338 - protein, 25 aa, Mycobacterium
DRLRLRPFLRACVLESVRLWPTTPT

SEQ ID NO: 1306339 - protein, 18 aa, Mycobacterium
DRLRRFGADRLIDYIDYT

SEQ ID NO: 1306340 - protein, 26 aa, Mycobacterium
DRLRRSVAGDWQLCRRRLLLDQAVLL

SEQ ID NO: 1306341 - protein, 30 aa, Mycobacterium
DRLTIHDYLWRWDTDWFWCSRAFGAQNPKI

SEQ ID NO: 1306342 - protein, 23 aa, Mycobacterium
DRLVRFKQGFTAWLRAYDQQSLE

SEQ ID NO: 1306343 - protein, 20 aa, Mycobacterium
DRMAALLRQAGVPIGLVTDG

SEQ ID NO: 1306344 - protein, 20 aa, Mycobacterium
DRRLLTYTSAPLNRAVEVTG

SEQ ID NO: 1306345 - protein, 26 aa, Mycobacterium
DRTALAAALLRNLGTRIARWRRAAGA

SEQ ID NO: 1306346 - protein, 32 aa, Mycobacterium
DRVIAPDFNFMLIGAAFYRDRYRRTPEGWKIC

SEQ ID NO: 1306347 - protein, 21 aa, Mycobacterium
DRVLILASLIDSRIGFFTVAG

SEQ ID NO: 1306348 - protein, 27 aa, Mycobacterium
DRVRAHLDLAVTWPHSLPGVGAAVQRN

SEQ ID NO: 1306349 - protein, 24 aa, Mycobacterium
DRVVRVALWWASALHQRGWRLAAC

SEQ ID NO: 1306350 - protein, 21 aa, Mycobacterium
DRWASLWWLRVSGSERFEEVA

SEQ ID NO: 1306351 - protein, 27 aa, Mycobacterium
DSGDASLAPILLRRVNKRPIPATSAGT

SEQ ID NO: 1306352 - protein, 24 aa, Mycobacterium
DSIAFRLMYNTLRATYEPALPALA

SEQ ID NO: 1306353 - protein, 17 aa, Mycobacterium
DSLAEWVAATIPGITVP

SEQ ID NO: 1306354 - protein, 20 aa, Mycobacterium
DSMMSVVLQRALLATLGVEV

SEQ ID NO: 1306355 - protein, 21 aa, Mycobacterium
DSQHDVILTHRLRLAMRNLNA

SEQ ID NO: 1306356 - protein, 22 aa, Mycobacterium
DSRPAALPFLSIKKITVHYRPR

SEQ ID NO: 1306357 - protein, 19 aa, Mycobacterium
DSRRYLPDVLAMVAAGRID

SEQ ID NO: 1306358 - protein, 18 aa, Mycobacterium
DSTHWWKHICTRTDVAIG

SEQ ID NO: 1306359 - protein, 23 aa, Mycobacterium
DSVLRALALNRFAKSPMLVGGQM

SEQ ID NO: 1306360 - protein, 25 aa, Mycobacterium
DTAIVIERALLRLPVEQRAAIVAVD

SEQ ID NO: 1306361 - protein, 22 aa, Mycobacterium
DTCAELMRKGETLLVFPGGGRD

SEQ ID NO: 1306362 - protein, 27 aa, Mycobacterium
DTDHPIHRYFLSAKQTEFAVGGATGQL

SEQ ID NO: 1306363 - protein, 23 aa, Mycobacterium
DTEVLLPGHGPLWRGPIREAAQA

SEQ ID NO: 1306364 - protein, 17 aa, Mycobacterium
DTFEVKWLCAVVEVARS

SEQ ID NO: 1306365 - protein, 17 aa, Mycobacterium
DTGVFKADGWRFTTKVE

SEQ ID NO: 1306366 - protein, 21 aa, Mycobacterium
DTHGTVLQRGAFASSLAGGGV

SEQ ID NO: 1306367 - protein, 31 aa, Mycobacterium
DTHLHGPDGLSLPMTLALPGAVNRGNAAQAV

SEQ ID NO: 1306368 - protein, 18 aa, Mycobacterium
DTLLRLPDVKALLDRHLA

SEQ ID NO: 1306369 - protein, 28 aa, Mycobacterium
DTLVNCVGIFDFYRRIQDIPAERIDQAF

SEQ ID NO: 1306370 - protein, 22 aa, Mycobacterium
DTNVRGAYFLVAEVARGMVARG

SEQ ID NO: 1306371 - protein, 19 aa, Mycobacterium
DTRVLRGWSTLPITLGTAR

SEQ ID NO: 1306372 - protein, 26 aa, Mycobacterium
DTVPLTYPFALTFPTVMALVTGFDFP

SEQ ID NO: 1306373 - protein, 24 aa, Mycobacterium
DTYCRFHQYSLANQLLLWSQGVTE

SEQ ID NO: 1306374 - protein, 23 aa, Mycobacterium
DVAALREFLLGRGVAKFKVPEQV

SEQ ID NO: 1306375 - protein, 18 aa, Mycobacterium
DVAAWREYGLNVLGMVEG

SEQ ID NO: 1306376 - protein, 21 aa, Mycobacterium
DVAFIQYQYGIYGGAAGEHVL

SEQ ID NO: 1306377 - protein, 35 aa, Mycobacterium
DVDDLPIQPKPIQRPHPPIWFGANAPAALARAARH

SEQ ID NO: 1306378 - protein, 26 aa, Mycobacterium
DVDLPAGSRLLLLWGAANRDPSHFDE

SEQ ID NO: 1306379 - protein, 17 aa, Mycobacterium
DVDPWSGGLDLLLGVET

SEQ ID NO: 1306380 - protein, 23 aa, Mycobacterium
DVEETMHFAVLSGVRARVEEKPL

SEQ ID NO: 1306381 - protein, 30 aa, Mycobacterium
DVELAWRLDRAGWFGPPRRWLVVTGTNGKT

SEQ ID NO: 1306382 - protein, 18 aa, Mycobacterium
DVFGRVYAGWAYCERFFA

SEQ ID NO: 1306383 - protein, 21 aa, Mycobacterium
DVFLTSFLPGHRQKFGIDVDD

SEQ ID NO: 1306384 - protein, 18 aa, Mycobacterium
DVGAALRWSLVGAKSRVA

SEQ ID NO: 1306385 - protein, 24 aa, Mycobacterium
DVGAFVSWLRLPMALRQSGIVMLP

SEQ ID NO: 1306386 - protein, 23 aa, Mycobacterium
DVGIYAQALLDRLAGRPSNFPLK

SEQ ID NO: 1306387 - protein, 29 aa, Mycobacterium
DVHMGPVQWRVVDWAGYEAALTLLRNVHR

SEQ ID NO: 1306388 - protein, 29 aa, Mycobacterium
DVKGALRVLELHPLLNPAAYVWADVDPGF

SEQ ID NO: 1306389 - protein, 17 aa, Mycobacterium
DVKGKAKEGIGTVTGRD

SEQ ID NO: 1306390 - protein, 17 aa, Mycobacterium
DVLDRHRFGCTVSRAAW

SEQ ID NO: 1306391 - protein, 31 aa, Mycobacterium
DVLSALPDRPAVLVPAFLSRGYHVRSDIPAH

SEQ ID NO: 1306392 - protein, 17 aa, Mycobacterium
DVNAFEVPGGRDEVWRF

SEQ ID NO: 1306393 - protein, 20 aa, Mycobacterium
DVNAYGVDFGDGLFGQDDVT

SEQ ID NO: 1306394 - protein, 17 aa, Mycobacterium
DVPLNYGRYSLDDSWYE

SEQ ID NO: 1306395 - protein, 22 aa, Mycobacterium
DVPRWKQLFHNAKADPRGTMRL

SEQ ID NO: 1306396 - protein, 17 aa, Mycobacterium
DVRLKGRALIRDLLSRQ

SEQ ID NO: 1306397 - protein, 20 aa, Mycobacterium
DVRLPFPRPVDDVTGLSQAI

SEQ ID NO: 1306398 - protein, 17 aa, Mycobacterium
DVRRRPRHGLDPIRFGL

SEQ ID NO: 1306399 - protein, 29 aa, Mycobacterium
DVRRVHRLLAYVPADVALWPALTGAETLE

SEQ ID NO: 1306400 - protein, 18 aa, Mycobacterium
DVRRVPMFGLGCVAGAAG

SEQ ID NO: 1306401 - protein, 17 aa, Mycobacterium
DVSIVLMAVPGRPVMDE

SEQ ID NO: 1306402 - protein, 34 aa, Mycobacterium
DVSLLRELNLMTTKPFLYVFNADESVLTDEARKA

SEQ ID NO: 1306403 - protein, 19 aa, Mycobacterium
DVTRRPRNILTFSHGAHFC

SEQ ID NO: 1306404 - protein, 17 aa, Mycobacterium
DVVILDIGLPGIDGLEV

SEQ ID NO: 1306405 - protein, 22 aa, Mycobacterium
DVVNYLRWFTFLEAGELAELEE

SEQ ID NO: 1306406 - protein, 24 aa, Mycobacterium
DVVPIRVYRWRPAPRDGDFDQLVA

SEQ ID NO: 1306407 - protein, 28 aa, Mycobacterium
DVVPTGVRLWPAQPLTLVAPWDGEVGSD

SEQ ID NO: 1306408 - protein, 26 aa, Mycobacterium
DVYIHRLRKYIGAYLALLGSTDVIVF

SEQ ID NO: 1306409 - protein, 21 aa, Mycobacterium
DWIDHTLDTWKRLCDPVAEQI

SEQ ID NO: 1306410 - protein, 27 aa, Mycobacterium
DWTDKPRLLATFPFPHVLTMSVTLADR

SEQ ID NO: 1306411 - protein, 20 aa, Mycobacterium
DWTRLARRMSEISEAPLYID

SEQ ID NO: 1306412 - protein, 24 aa, Mycobacterium
DWTRLARRMSEISEAPLYIDDSPN

SEQ ID NO: 1306413 - protein, 20 aa, Mycobacterium
DWVIKRKLFQRYQDRYNMEL

SEQ ID NO: 1306414 - protein, 25 aa, Mycobacterium
DYAGLELRVLRLDTEYAWAEDPPSR

SEQ ID NO: 1306415 - protein, 18 aa, Mycobacterium
DYDLNLEPSFPLLDPTKP

SEQ ID NO: 1306416 - protein, 29 aa, Mycobacterium
DYEKLMRSYRRLLQLMRSGDGAAAEAHWR

SEQ ID NO: 1306417 - protein, 19 aa, Mycobacterium
DYHPEWWPGVVAAVEEALP

SEQ ID NO: 1306418 - protein, 19 aa, Mycobacterium
DYRVDPFIVPAADKIAVLG

SEQ ID NO: 1306419 - protein, 19 aa, Mycobacterium
DYVFVNLWGRPHGHPWTYA

SEQ ID NO: 1306420 - protein, 19 aa, Mycobacterium
DYVGALWQANTGAPGTVSA

SEQ ID NO: 1306421 - protein, 30 aa, Mycobacterium
DYVQDTADPDLWWPDKRPYAPGSVLPASAQ

SEQ ID NO: 1306422 - protein, 17 aa, Mycobacterium
EAAGRAWPSRRSWEAMA

SEQ ID NO: 1306423 - protein, 22 aa, Mycobacterium
EAAPDVGGTWYFNRYPGARCDV

SEQ ID NO: 1306424 - protein, 26 aa, Mycobacterium
EAARTLPMRVLVLGGGDIRDLHVPDD

SEQ ID NO: 1306425 - protein, 20 aa, Mycobacterium
EAAVRELLIAIGEDPDRHGL

SEQ ID NO: 1306426 - protein, 24 aa, Mycobacterium
EADIFKIEFARMEALLHAVRLSFY

SEQ ID NO: 1306427 - protein, 25 aa, Mycobacterium
EADRPAVLRALLDCPVHAIIEMHEG

SEQ ID NO: 1306428 - protein, 17 aa, Mycobacterium
EAEIRGHRRTYVGALPG

SEQ ID NO: 1306429 - protein, 23 aa, Mycobacterium
EAERDWLRRQPTIPLRTDTDRLR

SEQ ID NO: 1306430 - protein, 19 aa, Mycobacterium
EAFSEVHWVAPEDAVWACR

SEQ ID NO: 1306431 - protein, 29 aa, Mycobacterium
EAGRRGVELVVVRAWWSPGAFELPGANAD

SEQ ID NO: 1306432 - protein, 24 aa, Mycobacterium
EAGSKWMFPLLDSMAEVWKKAPEA

SEQ ID NO: 1306433 - protein, 24 aa, Mycobacterium
EAGSKWMFPLLDSMAEVYKKAPEA

SEQ ID NO: 1306434 - protein, 24 aa, Mycobacterium
EAIPAQAIAQVCELTWQLKGQATG

SEQ ID NO: 1306435 - protein, 41 aa, Mycobacterium
EAIRDAEAPLLQRLPDGALMRRAALGLATAIARELTARTGG

SEQ ID NO: 1306436 - protein, 31 aa, Mycobacterium
EAIRGGAAIKPLWLPGPDPEPHYRPSATLAA

SEQ ID NO: 1306437 - protein, 17 aa, Mycobacterium
EALGAVGGLNRGALHSQ

SEQ ID NO: 1306438 - protein, 21 aa, Mycobacterium
EALGHALVVEPFVDSVVVAGG

SEQ ID NO: 1306439 - protein, 19 aa, Mycobacterium
EALHPYPADLALVSKVGGT

SEQ ID NO: 1306440 - protein, 24 aa, Mycobacterium
EALRARRVLAQWRDAAATDAEDFG

SEQ ID NO: 1306441 - protein, 24 aa, Mycobacterium
EALVPVFRRFCLDSPRLAQVMFSR

SEQ ID NO: 1306442 - protein, 17 aa, Mycobacterium
EALYYHRQRHPHTEEAL

SEQ ID NO: 1306443 - protein, 22 aa, Mycobacterium
EAMLDVLRFWLDLGIDGFRLDA

SEQ ID NO: 1306444 - protein, 22 aa, Mycobacterium
EAMYLGDGMMIEAPYTGSVVKI

SEQ ID NO: 1306445 - protein, 17 aa, Mycobacterium
EAPRGTEWIAPGDFEVP

SEQ ID NO: 1306446 - protein, 24 aa, Mycobacterium
EAPYLWSDLLARRNALSLRVEDLV

SEQ ID NO: 1306447 - protein, 27 aa, Mycobacterium
EAQDFADAWWDPLLAALRDPVDGGLYV

SEQ ID NO: 1306448 - protein, 18 aa, Mycobacterium
EASSLPGRLALDVLSRLA

SEQ ID NO: 1306449 - protein, 28 aa, Mycobacterium
EAVCELEPYWEALRKVYAPFDVAASGPP

SEQ ID NO: 1306450 - protein, 23 aa, Mycobacterium
EAVEVVVGLPRTLADRTGPAAHD

SEQ ID NO: 1306451 - protein, 27 aa, Mycobacterium
EAVNGQLFIVYGPKVTLVAAPVAEAHF

SEQ ID NO: 1306452 - protein, 27 aa, Mycobacterium
EAVQRFLVEWLGFKYSSHDLVASATLV

SEQ ID NO: 1306453 - protein, 24 aa, Mycobacterium
EAYERLILDVLLGEPSLFPVNAEV

SEQ ID NO: 1306454 - protein, 25 aa, Mycobacterium
EAYERLILDVLLGEPSLFPVNAEVE

SEQ ID NO: 1306455 - protein, 25 aa, Mycobacterium
EAYPQVLIRLGWAPADGTALPVLER

SEQ ID NO: 1306456 - protein, 25 aa, Mycobacterium
EDAAARFAALLAGADVHLVTERAAK

SEQ ID NO: 1306457 - protein, 24 aa, Mycobacterium
EDGLPTIFVYDGYPGGAGFAARGF

SEQ ID NO: 1306458 - protein, 18 aa, Mycobacterium
EDLDLPFLDLPYGTEDLA

SEQ ID NO: 1306459 - protein, 24 aa, Mycobacterium
EDLEKTLRFWLDRGVDGFRIDVAH

SEQ ID NO: 1306460 - protein, 19 aa, Mycobacterium
EDLKPLCDGLAKVLTDMMV

SEQ ID NO: 1306461 - protein, 25 aa, Mycobacterium
EDPDAEVPLPFRARAIAGLIDSWTG

SEQ ID NO: 1306462 - protein, 23 aa, Mycobacterium
EDPDGAIQWLREGARLLIHAVDS

SEQ ID NO: 1306463 - protein, 21 aa, Mycobacterium
EDPDVKPRPLGKARWAGAVDC

SEQ ID NO: 1306464 - protein, 25 aa, Mycobacterium
EDPGPLRRLIATLPALEVPRPDWPA

SEQ ID NO: 1306465 - protein, 23 aa, Mycobacterium
EDVHLWAAIQFLADRLPDNDPDA

SEQ ID NO: 1306466 - protein, 18 aa, Mycobacterium
EDWNAAISVNLWGVIYGC

SEQ ID NO: 1306467 - protein, 18 aa, Mycobacterium
EDWPVARLLRDAQVNTIW

SEQ ID NO: 1306468 - protein, 20 aa, Mycobacterium
EEELAIFDLLTQPDPVLTAE

SEQ ID NO: 1306469 - protein, 18 aa, Mycobacterium
EEERYCIDILTQADALTK

SEQ ID NO: 1306470 - protein, 18 aa, Mycobacterium
EEERYCIDILTQTDALTK

SEQ ID NO: 1306471 - protein, 18 aa, Mycobacterium
EEFRASRIMLDRARANEK

SEQ ID NO: 1306472 - protein, 29 aa, Mycobacterium
EEKPARAVLPPWLQPGDYAPAFGAKKTGV

SEQ ID NO: 1306473 - protein, 18 aa, Mycobacterium
EELGFVFNLGVETEFFVL

SEQ ID NO: 1306474 - protein, 25 aa, Mycobacterium
EENPWSFVELLAPLVQDKSLLVANL

SEQ ID NO: 1306475 - protein, 23 aa, Mycobacterium
EENQRLRRQLAKALGQLRDDNVN

SEQ ID NO: 1306476 - protein, 25 aa, Mycobacterium
EEQAHAYCLRLLTARARTRAELAGK

SEQ ID NO: 1306477 - protein, 25 aa, Mycobacterium
EEQKKFFLPKIASGDLHFSIGYSEP

SEQ ID NO: 1306478 - protein, 25 aa, Mycobacterium
EEQMAVLTDFFNYFGALTASRRENP

SEQ ID NO: 1306479 - protein, 21 aa, Mycobacterium
EETFGPTLPIMKVKSVEEAVR

SEQ ID NO: 1306480 - protein, 26 aa, Mycobacterium
EETGAALLPSPFISSAVLTAALVQAA

SEQ ID NO: 1306481 - protein, 28 aa, Mycobacterium
EETLNDLHAHPWFGCMVELADLPSLHNR

SEQ ID NO: 1306482 - protein, 22 aa, Mycobacterium
EETPAHFIGFDALASGDTSLMK

SEQ ID NO: 1306483 - protein, 25 aa, Mycobacterium
EFARTRRCVLFFDEFDTIAKERADA

SEQ ID NO: 1306484 - protein, 17 aa, Mycobacterium
EFDGRIITVPFSFKEID

SEQ ID NO: 1306485 - protein, 17 aa, Mycobacterium
EFERPVLLFSGGKDSIV

SEQ ID NO: 1306486 - protein, 20 aa, Mycobacterium
EFERPVLLFSGGKDSIVMLH

SEQ ID NO: 1306487 - protein, 17 aa, Mycobacterium
EFESLRPYLLSVGYRLT

SEQ ID NO: 1306488 - protein, 24 aa, Mycobacterium
EFGGWTWRYDLVSLGPARTEVTLT

SEQ ID NO: 1306489 - protein, 20 aa, Mycobacterium
EFGWKPLPAFDDGVLAWVRL

SEQ ID NO: 1306490 - protein, 20 aa, Mycobacterium
EFHRALAEPLLGAAIDRVYL

SEQ ID NO: 1306491 - protein, 23 aa, Mycobacterium
EFKKGPFRIAMSARIPIVPIVIR

SEQ ID NO: 1306492 - protein, 17 aa, Mycobacterium
EFLATFVPLTFVGNHDV

SEQ ID NO: 1306493 - protein, 17 aa, Mycobacterium
EFLGSRVVPLDEILASA

SEQ ID NO: 1306494 - protein, 20 aa, Mycobacterium
EFLNRFPGRVVNTHPALLPA

SEQ ID NO: 1306495 - protein, 28 aa, Mycobacterium
EFSDPRIVRVWWRLTPREQEILRVKAQP

SEQ ID NO: 1306496 - protein, 24 aa, Mycobacterium
EGDLMLGVATYIDSPRPDCAEVAI

SEQ ID NO: 1306497 - protein, 17 aa, Mycobacterium
EGGIGWVPYFLERIDRT

SEQ ID NO: 1306498 - protein, 17 aa, Mycobacterium
EGGLFDARWLDAAVPDR

SEQ ID NO: 1306499 - protein, 26 aa, Mycobacterium
EGHLALLRRLMMDDNWYRGELIFVFD

SEQ ID NO: 1306500 - protein, 22 aa, Mycobacterium
EGKLPPAEYLTQAIPAGRVGAP

SEQ ID NO: 1306501 - protein, 33 aa, Mycobacterium
EGLKKNLRHRDGRWYWHWDPAFLTKPGDDPFVR

SEQ ID NO: 1306502 - protein, 17 aa, Mycobacterium
EGLPISILEADAAGLPV

SEQ ID NO: 1306503 - protein, 24 aa, Mycobacterium
EGRAAPLIGLPLPGTGHGGLRTRR

SEQ ID NO: 1306504 - protein, 22 aa, Mycobacterium
EGRGLDLDRVAGLLGLADREDA

SEQ ID NO: 1306505 - protein, 27 aa, Mycobacterium
EGRKRIVRRLLAAVGFPVQELVRTDIG

SEQ ID NO: 1306506 - protein, 27 aa, Mycobacterium
EGRSGVPFILAGWSLGGVLAYACAIGL

SEQ ID NO: 1306507 - protein, 25 aa, Mycobacterium
EGSYKRYLKTLLAPRDEALATAFDT

SEQ ID NO: 1306508 - protein, 17 aa, Mycobacterium
EGWITLTALAQATKRLR

SEQ ID NO: 1306509 - protein, 22 aa, Mycobacterium
EHADALWRYALKLTGDAATAED

SEQ ID NO: 1306510 - protein, 23 aa, Mycobacterium
EHAHWIIVGMMMPGSSEAPEPHF

SEQ ID NO: 1306511 - protein, 23 aa, Mycobacterium
EHAHYWPKLTAMYPDFDNYRSWT

SEQ ID NO: 1306512 - protein, 18 aa, Mycobacterium
EHDGHWVRPQPLDLRYVD

SEQ ID NO: 1306513 - protein, 17 aa, Mycobacterium
EHKRWFADRLAQVSTEA

SEQ ID NO: 1306514 - protein, 29 aa, Mycobacterium
EHLPVMCDFWETVLFRAGLYRRNALHVHR

SEQ ID NO: 1306515 - protein, 19 aa, Mycobacterium
EHMISYQAVRTHFFDAFFT

SEQ ID NO: 1306516 - protein, 19 aa, Mycobacterium
EHPPQRLRALLGKPVRNPH

SEQ ID NO: 1306517 - protein, 21 aa, Mycobacterium
EHPTIRRVLFNGAAAERNFRR

SEQ ID NO: 1306518 - protein, 17 aa, Mycobacterium
EHQAIILDAIRLLNRVE

SEQ ID NO: 1306519 - protein, 22 aa, Mycobacterium
EHSLPPLNLTVPESLAVLAGLG

SEQ ID NO: 1306520 - protein, 18 aa, Mycobacterium
EHTVYRRLISSAFTPRNV

SEQ ID NO: 1306521 - protein, 24 aa, Mycobacterium
EHVWPEMLDALRRAGWHNYSLFVH

SEQ ID NO: 1306522 - protein, 17 aa, Mycobacterium
EIAPMLWNRWDELAGDV

SEQ ID NO: 1306523 - protein, 17 aa, Mycobacterium
EIDGLRRAFGVSDTPRP

SEQ ID NO: 1306524 - protein, 23 aa, Mycobacterium
EIDWVIKRKLFQRYQDRYNMELS

SEQ ID NO: 1306525 - protein, 23 aa, Mycobacterium
EIEEFALDVMRRYVLSLPDGRVE

SEQ ID NO: 1306526 - protein, 23 aa, Mycobacterium
EIEIYGFCACLRMLASHRPSRLH

SEQ ID NO: 1306527 - protein, 26 aa, Mycobacterium
EIESYAPLMAYLVRSLQSGGDLARAF

SEQ ID NO: 1306528 - protein, 19 aa, Mycobacterium
EIETLWTVGGEYPRDWPRP

SEQ ID NO: 1306529 - protein, 17 aa, Mycobacterium
EIFGPVLVVIPYEDEDD

SEQ ID NO: 1306530 - protein, 26 aa, Mycobacterium
EIGVDSIFGRLWTRECLSRRDRSLVT

SEQ ID NO: 1306531 - protein, 26 aa, Mycobacterium
EIITAVAETWRRLRPAPLVVDPVCAS

SEQ ID NO: 1306532 - protein, 21 aa, Mycobacterium
EILDYVDLLHAYTHRELDALV

SEQ ID NO: 1306533 - protein, 22 aa, Mycobacterium
EILGCRLPTMSHRLLARLQSEA

SEQ ID NO: 1306534 - protein, 21 aa, Mycobacterium
EILGCRLPTMSHRLLARLRSE

SEQ ID NO: 1306535 - protein, 18 aa, Mycobacterium
EILLARNDRYWSAPAKPD

SEQ ID NO: 1306536 - protein, 17 aa, Mycobacterium
EILRLRTAAPSANVARL

SEQ ID NO: 1306537 - protein, 19 aa, Mycobacterium
EIQAYDRVFFPGLAEEWGP

SEQ ID NO: 1306538 - protein, 24 aa, Mycobacterium
EIRARNLLGPEQYGAITAPTLVVW

SEQ ID NO: 1306539 - protein, 21 aa, Mycobacterium
EIRGHRRTYVGALPGRIVRAI

SEQ ID NO: 1306540 - protein, 21 aa, Mycobacterium
EIVQRLHVLAPGKRILHDDAL

SEQ ID NO: 1306541 - protein, 17 aa, Mycobacterium
EIWPLLHDGTPITKAQR

SEQ ID NO: 1306542 - protein, 22 aa, Mycobacterium
EKEEVLTPATPGAEALPLPEGE

SEQ ID NO: 1306543 - protein, 30 aa, Mycobacterium
EKLADEEIYSFLRLLLPAGVETTYRSLGSL

SEQ ID NO: 1306544 - protein, 25 aa, Mycobacterium
EKLTDLPLTLYSDPAAPGLACLPFV

SEQ ID NO: 1306545 - protein, 25 aa, Mycobacterium
EKLVWKAQIFLSHRSWESTITEQVP

SEQ ID NO: 1306546 - protein, 25 aa, Mycobacterium
EKLYPVIDALIEAWRATGDRAIPHT

SEQ ID NO: 1306547 - protein, 18 aa, Mycobacterium
EKVARRFRLLGDRSLQDH

SEQ ID NO: 1306548 - protein, 17 aa, Mycobacterium
EKVLEGCWRLLESGGFL

SEQ ID NO: 1306549 - protein, 27 aa, Mycobacterium
ELADAWEPIFFYPEKLQDVWGEALARG

SEQ ID NO: 1306550 - protein, 21 aa, Mycobacterium
ELALQGSLFEHAERRTLGNGA

SEQ ID NO: 1306551 - protein, 25 aa, Mycobacterium
ELATLSWVYWHNTSRLHSYLGDLPP

SEQ ID NO: 1306552 - protein, 17 aa, Mycobacterium
ELAVFWTARTVGCSWCV

SEQ ID NO: 1306553 - protein, 23 aa, Mycobacterium
ELAVPLPIRPPWTLPPLTFPAAA

SEQ ID NO: 1306554 - protein, 30 aa, Mycobacterium
ELDPRRTVGAFATLYPLALACAGTQATPAV

SEQ ID NO: 1306555 - protein, 27 aa, Mycobacterium
ELDRRGLLRRIGGAPYLHTLISTVPTA

SEQ ID NO: 1306556 - protein, 18 aa, Mycobacterium
ELEYRLIKELWAFGDDRI

SEQ ID NO: 1306557 - protein, 26 aa, Mycobacterium
ELGATSLKRLLADRLRISDKTAGERL

SEQ ID NO: 1306558 - protein, 24 aa, Mycobacterium
ELGLAFTPVFLSEEWRQVVLARRI

SEQ ID NO: 1306559 - protein, 18 aa, Mycobacterium
ELGVWVAAPATGGILADW

SEQ ID NO: 1306560 - protein, 23 aa, Mycobacterium
ELHHQWHALGLTPLSILDSQLSD

SEQ ID NO: 1306561 - protein, 23 aa, Mycobacterium
ELHLFTPEVVFLLQHSTRTGRED

SEQ ID NO: 1306562 - protein, 17 aa, Mycobacterium
ELLDARLGEAGFDWYEV

SEQ ID NO: 1306563 - protein, 22 aa, Mycobacterium
ELLDVLRNEIWPLLHDGTPITK

SEQ ID NO: 1306564 - protein, 18 aa, Mycobacterium
ELLIAIGEDPDRHGLVDT

SEQ ID NO: 1306565 - protein, 24 aa, Mycobacterium
ELLTDLIRWGNLIRRDLRGIPLVV

SEQ ID NO: 1306566 - protein, 20 aa, Mycobacterium
ELLTEARRALREAIGIVEEL

SEQ ID NO: 1306567 - protein, 19 aa, Mycobacterium
ELNEAFASVVLKFQKDLGI

SEQ ID NO: 1306568 - protein, 17 aa, Mycobacterium
ELPDLVAALRIRLGPVA

SEQ ID NO: 1306569 - protein, 26 aa, Mycobacterium
ELPHGLPPVRLIAGAQLDGWQSYPDC

SEQ ID NO: 1306570 - protein, 26 aa, Mycobacterium
ELQSLRARFGTLTGVDRPAKDGDFVS

SEQ ID NO: 1306571 - protein, 21 aa, Mycobacterium
ELRRLGNGKADYRWAKSQVAQ

SEQ ID NO: 1306572 - protein, 21 aa, Mycobacterium
ELRTYPHPHFAFYQADIRRQV

SEQ ID NO: 1306573 - protein, 22 aa, Mycobacterium
ELSAYLRTLAAAPLAHVLVAGM

SEQ ID NO: 1306574 - protein, 17 aa, Mycobacterium
ELSIQFVFAYDVGEFAE

SEQ ID NO: 1306575 - protein, 25 aa, Mycobacterium
ELSRELALAFQRLGAFVVAVDRYAD

SEQ ID NO: 1306576 - protein, 18 aa, Mycobacterium
ELVDWWSDPGGVDTSRPG

SEQ ID NO: 1306577 - protein, 28 aa, Mycobacterium
ELVGDGYLRFMRSFFESMFVPSSDPAIR

SEQ ID NO: 1306578 - protein, 19 aa, Mycobacterium
ELWEAMLAVAKLGAVIMPT

SEQ ID NO: 1306579 - protein, 17 aa, Mycobacterium
EMEVEILKRASAYFARE

SEQ ID NO: 1306580 - protein, 26 aa, Mycobacterium
EMLAALDLIFPADLLADILAGQRGAS

SEQ ID NO: 1306581 - protein, 17 aa, Mycobacterium
EMRRTVRPPGRIALLAF

SEQ ID NO: 1306582 - protein, 26 aa, Mycobacterium
ENAPMVRYPIPPMIHGATQSATWMAL

SEQ ID NO: 1306583 - protein, 25 aa, Mycobacterium
ENDDDVWLLIVTATGRAFCTGADVK

SEQ ID NO: 1306584 - protein, 26 aa, Mycobacterium
ENFIGNGLVDLIIAEQRFTTVWITEN

SEQ ID NO: 1306585 - protein, 24 aa, Mycobacterium
ENGRSWSRWSFIGAGAPSALTVRD

SEQ ID NO: 1306586 - protein, 30 aa, Mycobacterium
ENGVWAIFSTLDPRVLQFKPGLLLGRDLCE

SEQ ID NO: 1306587 - protein, 17 aa, Mycobacterium
ENHPLLCLVDVGGVPTL

SEQ ID NO: 1306588 - protein, 20 aa, Mycobacterium
ENLDPLLGTPVADLSAAALT

SEQ ID NO: 1306589 - protein, 30 aa, Mycobacterium
ENNQRELLRLWADYLDMPPLRVDPATVLTD

SEQ ID NO: 1306590 - protein, 34 aa, Mycobacterium
ENPSFSVVAPLLSRSLILQLQPLAPDSITEVVRR

SEQ ID NO: 1306591 - protein, 26 aa, Mycobacterium
ENTNGLLRQYFPKGTDLSIYGPENLE

SEQ ID NO: 1306592 - protein, 25 aa, Mycobacterium
ENTRALDLLAKWGDVPTAPPVAPVD

SEQ ID NO: 1306593 - protein, 29 aa, Mycobacterium
EPASIKDRWLLRHRPHLVLDGLRLAARVV

SEQ ID NO: 1306594 - protein, 22 aa, Mycobacterium
EPAVAIFRPAAVAVYRQRPHGS

SEQ ID NO: 1306595 - protein, 25 aa, Mycobacterium
EPDEGFVAAIYRWATTGDLTTALAA

SEQ ID NO: 1306596 - protein, 20 aa, Mycobacterium
EPDRPVVLVAHGGLIAALTA

SEQ ID NO: 1306597 - protein, 24 aa, Mycobacterium
EPEDIANAVLFLASDEARYITGVT

SEQ ID NO: 1306598 - protein, 25 aa, Mycobacterium
EPELTEELLRRGAWARCVQTIGAFD

SEQ ID NO: 1306599 - protein, 24 aa, Mycobacterium
EPEPEPLFTVTNPPGTVTVTSYLD

SEQ ID NO: 1306600 - protein, 18 aa, Mycobacterium
EPEPWAALLPGLDVTTMG

SEQ ID NO: 1306601 - protein, 23 aa, Mycobacterium
EPGKPLVAVLLDGTDWFRRRTVA

SEQ ID NO: 1306602 - protein, 19 aa, Mycobacterium
EPGRPCRLLGLHFDGEDGC

SEQ ID NO: 1306603 - protein, 18 aa, Mycobacterium
EPIILPRNSEGLYLLQRV

SEQ ID NO: 1306604 - protein, 25 aa, Mycobacterium
EPIRRLKKLAADKGFPLIPGHDPHV

SEQ ID NO: 1306605 - protein, 22 aa, Mycobacterium
EPIWLCPLRLRDESSWPLYPIR

SEQ ID NO: 1306606 - protein, 31 aa, Mycobacterium
EPMPSPPVPEPPAPTPPPAPAAPLAEPIAPP

SEQ ID NO: 1306607 - protein, 21 aa, Mycobacterium
EPPFRGHYRHVVHDTTLCDVD

SEQ ID NO: 1306608 - protein, 23 aa, Mycobacterium
EPPGVPWTVVWSFHLMPRGTDRC

SEQ ID NO: 1306609 - protein, 30 aa, Mycobacterium; identical to SEQ ID NO: 944499

SEQ ID NO: 1306610 - protein, 19 aa, Mycobacterium
EPRVGTLALLTDLLDRVDV

SEQ ID NO: 1306611 - protein, 19 aa, Mycobacterium
EPVLLMLAAVKCGAISGML

SEQ ID NO: 1306612 - protein, 34 aa, Mycobacterium
EPVTRLDLSLPANVPFRFLCIPQYETERILREEF

SEQ ID NO: 1306613 - protein, 24 aa, Mycobacterium
EPYQLEPLRRALSAPRANLLLADD

SEQ ID NO: 1306614 - protein, 24 aa, Mycobacterium
EQALSALLGARRWVRMPGVHFGPD

SEQ ID NO: 1306615 - protein, 27 aa, Mycobacterium
EQFVATHLPMLAWMTEVVAKATVAAAA

SEQ ID NO: 1306616 - protein, 23 aa, Mycobacterium
EQGRALFEQALTQGIDTLDDPPQ

SEQ ID NO: 1306617 - protein, 20 aa, Mycobacterium
EQHRRWDKVLFDAGLSVISW

SEQ ID NO: 1306618 - protein, 22 aa, Mycobacterium
EQLRLLSARFGATAALSAVVDD

SEQ ID NO: 1306619 - protein, 24 aa, Mycobacterium
EQMKALFGLGLHPNADRISDHLSP

SEQ ID NO: 1306620 - protein, 17 aa, Mycobacterium
EQQLPLLRPGDEVYVCW

SEQ ID NO: 1306621 - protein, 23 aa, Mycobacterium
EQQVLALPVWDAFRRAHRLNFLR

SEQ ID NO: 1306622 - protein, 20 aa, Mycobacterium
EQRRRLLPRIAAGRLSSAIG

SEQ ID NO: 1306623 - protein, 24 aa, Mycobacterium
EQVEDAAMKLFWERGFDGVSISDV

SEQ ID NO: 1306624 - protein, 31 aa, Mycobacterium
ERALIAAYAGGLRPILCLTKSDLAPAEPFAA

SEQ ID NO: 1306625 - protein, 26 aa, Mycobacterium
ERARYRAHWLVARTAEHIGGWSSRPL

SEQ ID NO: 1306626 - protein, 18 aa, Mycobacterium
ERDLVGHALQLRPDQLKK

SEQ ID NO: 1306627 - protein, 22 aa, Mycobacterium
EREAVPPRRFGALIIDVAAREV

SEQ ID NO: 1306628 - protein, 24 aa, Mycobacterium
ERFGYDAWVLAYDAATVAAVSAAY

SEQ ID NO: 1306629 - protein, 18 aa, Mycobacterium
ERFLGDLATQNRWEFAPP

SEQ ID NO: 1306630 - protein, 19 aa, Mycobacterium
ERFRVLTRQLAAGGSRWLL

SEQ ID NO: 1306631 - protein, 21 aa, Mycobacterium
ERGMLPTERLYWDSYAIRELL

SEQ ID NO: 1306632 - protein, 23 aa, Mycobacterium
ERIQAGALDFIPAKRVGTAEEVA

SEQ ID NO: 1306633 - protein, 18 aa, Mycobacterium
ERKGYLRRDPNRPRAVDV

SEQ ID NO: 1306634 - protein, 17 aa, Mycobacterium
ERLLTALQRQRSAFRAE

SEQ ID NO: 1306635 - protein, 26 aa, Mycobacterium
ERLTDTLLGVVPLALRTQAAALGDTL

SEQ ID NO: 1306636 - protein, 21 aa, Mycobacterium
ERMARLLRDAAAAPPPTRRPT

SEQ ID NO: 1306637 - protein, 22 aa, Mycobacterium
ERMIRLPIGRLMPSKPAYGRQA

SEQ ID NO: 1306638 - protein, 20 aa, Mycobacterium
ERMPRLLRSLYPIGGVVFDG

SEQ ID NO: 1306639 - protein, 21 aa, Mycobacterium
ERPLWECWIVEGLPDDQWAMI

SEQ ID NO: 1306640 - protein, 35 aa, Mycobacterium
ERPNLARMMFLDPHTRELYLDWPRKARAVVGNLRH

SEQ ID NO: 1306641 - protein, 17 aa, Mycobacterium
ERPYVAAGIFLYDQLGG

SEQ ID NO: 1306642 - protein, 19 aa, Mycobacterium
ERQVLYWLDPVGGTEPFVD

SEQ ID NO: 1306643 - protein, 24 aa, Mycobacterium
ERQYRDMRILGIGGGTTEILTALA

SEQ ID NO: 1306644 - protein, 25 aa, Mycobacterium
ERRAEAWFDPAGLFMAFDDASGKLL

SEQ ID NO: 1306645 - protein, 21 aa, Mycobacterium
ERRGQLAPALFARTLIGRSST

SEQ ID NO: 1306646 - protein, 17 aa, Mycobacterium
ERRLLIAALGRARRRVL

SEQ ID NO: 1306647 - protein, 21 aa, Mycobacterium
ERRQVPLGEFSRALARRGVTG

SEQ ID NO: 1306648 - protein, 19 aa, Mycobacterium
ERRRLFGMIGSVTPDKMAT

SEQ ID NO: 1306649 - protein, 19 aa, Mycobacterium
ERVLATQLLVRRKAHGVSL

SEQ ID NO: 1306650 - protein, 20 aa, Mycobacterium
ERVSRRFHWSLHAGALGPRS

SEQ ID NO: 1306651 - protein, 21 aa, Mycobacterium
ERYGLFVPRLYGDDFTPTEYA

SEQ ID NO: 1306652 - protein, 21 aa, Mycobacterium
ERYLRFFTTHPTHMDEWVTSV

SEQ ID NO: 1306653 - protein, 24 aa, Mycobacterium
ESASSFYPGRGGLLYVASKFAVRG

SEQ ID NO: 1306654 - protein, 17 aa, Mycobacterium
ESGYFKAKLAQETLIAG

SEQ ID NO: 1306655 - protein, 25 aa, Mycobacterium
ESKVLALLHRFGIATPASADLSRAV

SEQ ID NO: 1306656 - protein, 27 aa, Mycobacterium
ESPKETWLRLLIVRAGFPRPETQLPVY

SEQ ID NO: 1306657 - protein, 17 aa, Mycobacterium
ESRARCFPKGLAAFIDL

SEQ ID NO: 1306658 - protein, 23 aa, Mycobacterium
ESTWHRWVAQYGGMKANEAKRLK

SEQ ID NO: 1306659 - protein, 21 aa, Mycobacterium
ESYALYPPMSVRENLLYGLKA

SEQ ID NO: 1306660 - protein, 18 aa, Mycobacterium
ETAQRFVGWLGRVVTAFA

SEQ ID NO: 1306661 - protein, 27 aa, Mycobacterium
ETDPRTWLLIATGLLSFDEAAASGGLH

SEQ ID NO: 1306662 - protein, 19 aa, Mycobacterium
ETELWQWAHRVVCEHPGPL

SEQ ID NO: 1306663 - protein, 23 aa, Mycobacterium
ETFAPNRVFMAPLTRSRAQADGT

SEQ ID NO: 1306664 - protein, 26 aa, Mycobacterium
ETFRDRLFTEIFPGRSTVPKTLIFAK

SEQ ID NO: 1306665 - protein, 28 aa, Mycobacterium
ETGLITRWLTSPGVRIVRCEPGYATPIG

SEQ ID NO: 1306666 - protein, 27 aa, Mycobacterium
ETGLPFSRVRVLRRLGRQPMTVKQVAQ

SEQ ID NO: 1306667 - protein, 21 aa, Mycobacterium
ETHYFGTLQVLRAFAPIIERN

SEQ ID NO: 1306668 - protein, 18 aa, Mycobacterium
ETKDGYIAALIYNDKHWN

SEQ ID NO: 1306669 - protein, 17 aa, Mycobacterium
ETLAAHWGVPQLKPHDA

SEQ ID NO: 1306670 - protein, 21 aa, Mycobacterium
ETLREAVGICTDWLHRHGFSL

SEQ ID NO: 1306671 - protein, 28 aa, Mycobacterium
ETLRRYKPGEPPLPGALLIAGEGRVVEP

SEQ ID NO: 1306672 - protein, 22 aa, Mycobacterium
ETNPDYPTWRAKVRKLPALDTA

SEQ ID NO: 1306673 - protein, 17 aa, Mycobacterium
ETRLLGETELWQWAHRV

SEQ ID NO: 1306674 - protein, 19 aa, Mycobacterium
ETRPLSATKRWRLVEVLEK

SEQ ID NO: 1306675 - protein, 22 aa, Mycobacterium
ETTAPFSAFVFKVQAGMDSAHR

SEQ ID NO: 1306676 - protein, 23 aa, Mycobacterium
ETVEDVIWTYGQPYPAVGAIAGH

SEQ ID NO: 1306677 - protein, 32 aa, Mycobacterium
EVAIRVSNRLRPWLPVLLALTANSAIYRNADS

SEQ ID NO: 1306678 - protein, 17 aa, Mycobacterium
EVARRYAVLQRAQLAAV

SEQ ID NO: 1306679 - protein, 24 aa, Mycobacterium
EVCLQMHLLVLSFNLAVAARAKDD

SEQ ID NO: 1306680 - protein, 17 aa, Mycobacterium
EVCTRHFSLPHPPQYHL

SEQ ID NO: 1306681 - protein, 18 aa, Mycobacterium
EVELAKRIEAGLFATQKL

SEQ ID NO: 1306682 - protein, 23 aa, Mycobacterium
EVFREHFLTCFIADPVGVATRHQ

SEQ ID NO: 1306683 - protein, 18 aa, Mycobacterium
EVGFVTEPLRRLPVRPGR

SEQ ID NO: 1306684 - protein, 24 aa, Mycobacterium
EVGIMTWFAKRPTAQAKAATICSL

SEQ ID NO: 1306685 - protein, 20 aa, Mycobacterium
EVGLRTFFDRFPDAKLAGTA

SEQ ID NO: 1306686 - protein, 18 aa, Mycobacterium
EVGRLLLQRGIRSVPVVD

SEQ ID NO: 1306687 - protein, 23 aa, Mycobacterium
EVGTYLPGRRITGVRMADGVTEV

SEQ ID NO: 1306688 - protein, 25 aa, Mycobacterium
EVKALYPLGPIFHGSGLNITVMSLG

SEQ ID NO: 1306689 - protein, 17 aa, Mycobacterium
EVLGVLRAVLFAPEDLA

SEQ ID NO: 1306690 - protein, 22 aa, Mycobacterium
EVLPLYARLPTAEQQKVFAPHT

SEQ ID NO: 1306691 - protein, 25 aa, Mycobacterium
EVLPNQLFTDLLHRAVRRIVEGESG

SEQ ID NO: 1306692 - protein, 20 aa, Mycobacterium
EVLVRGVLDRLAEYGYGTVQ

SEQ ID NO: 1306693 - protein, 28 aa, Mycobacterium
EVPGGRDEVWRFTPLRRLRGLHDGSAVA

SEQ ID NO: 1306694 - protein, 26 aa, Mycobacterium
EVPHLHVHVFPAYNLTDFGFANVDNN

SEQ ID NO: 1306695 - protein, 25 aa, Mycobacterium
EVPRHMLETWAFRTFTVHPRENRFD

SEQ ID NO: 1306696 - protein, 25 aa, Mycobacterium
EVSGNPFIMYPSYQEIADLPLAERV

SEQ ID NO: 1306697 - protein, 24 aa, Mycobacterium
EVSGSLLRRKFGLATKAMEPLRSA

SEQ ID NO: 1306698 - protein, 17 aa, Mycobacterium
EVSNLRPTHDGLGYFGF

SEQ ID NO: 1306699 - protein, 18 aa, Mycobacterium
EVVPQYPEWEKAGRMPRE

SEQ ID NO: 1306700 - protein, 28 aa, Mycobacterium
EVWGALTALVFDNRDSWRRAVVEETGLP

SEQ ID NO: 1306701 - protein, 23 aa, Mycobacterium
EWAQLLTVAVRVASLPGLLSTTT

SEQ ID NO: 1306702 - protein, 17 aa, Mycobacterium
EWGLDEILLPGTGPAEI

SEQ ID NO: 1306703 - protein, 17 aa, Mycobacterium
EWRRRKPYRWLRQILPE

SEQ ID NO: 1306704 - protein, 22 aa, Mycobacterium
EWSPVCRACWWDDPDAGPVAGA

SEQ ID NO: 1306705 - protein, 18 aa, Mycobacterium
EYAAFNTAYAAWFPDRLP

SEQ ID NO: 1306706 - protein, 20 aa, Mycobacterium
EYAQLRVETGWRLVAAATTG

SEQ ID NO: 1306707 - protein, 17 aa, Mycobacterium
EYAYYQAALDMVEQFFP

SEQ ID NO: 1306708 - protein, 32 aa, Mycobacterium
EYDGPAVNLYERFLWRLFSKDYSLFERYQPFW

SEQ ID NO: 1306709 - protein, 22 aa, Mycobacterium
EYIQVLQLLWDSWEDDARVADA

SEQ ID NO: 1306710 - protein, 24 aa, Mycobacterium
EYLRRELLDLSAWAWDEFLTANGD

SEQ ID NO: 1306711 - protein, 17 aa, Mycobacterium
EYLYSRAATIYGGTAEV

SEQ ID NO: 1306712 - protein, 24 aa, Mycobacterium
EYNAAHYRISVFYDLVKCAVNRLA

SEQ ID NO: 1306713 - protein, 17 aa, Mycobacterium
EYRNLDPVALRSTVRTQ

SEQ ID NO: 1306714 - protein, 22 aa, Mycobacterium
FAACCVYILVGYEQATIPPDNV

SEQ ID NO: 1306715 - protein, 23 aa, Mycobacterium
FAALPLEPVIRRFMPADYSQQYK

SEQ ID NO: 1306716 - protein, 20 aa, Mycobacterium
FAEFYEVDPYTTVTPRDPIV

SEQ ID NO: 1306717 - protein, 17 aa, Mycobacterium
FAEGMRSLVLYTASWQD

SEQ ID NO: 1306718 - protein, 31 aa, Mycobacterium
FAELSLPPDSAAKPYFRYVVDDPTALPPGWR

SEQ ID NO: 1306719 - protein, 19 aa, Mycobacterium
FAEVARRWGGALNILVNTV

SEQ ID NO: 1306720 - protein, 27 aa, Mycobacterium
FAGIHGAFVVTNYWAPLPPDAQRSRAQ

SEQ ID NO: 1306721 - protein, 19 aa, Mycobacterium
FAMLGPYSATKFAVRALTQ

SEQ ID NO: 1306722 - protein, 23 aa, Mycobacterium
FAQAYEQIMLLRSAVGMAAPQAT

SEQ ID NO: 1306723 - protein, 19 aa, Mycobacterium
FARHRHWVEPNRNLEWSQG

SEQ ID NO: 1306724 - protein, 25 aa, Mycobacterium
FASGTPDGLTAWLLLSCRALHEGAR

SEQ ID NO: 1306725 - protein, 17 aa, Mycobacterium
FASLYDGPTLDPAELLS

SEQ ID NO: 1306726 - protein, 33 aa, Mycobacterium
FATIPTTYLRTTLFFENFANAFPPVRGDDGALT

SEQ ID NO: 1306727 - protein, 26 aa, Mycobacterium
FATTGLFLERLGLSSLADLPDIAPLL

SEQ ID NO: 1306728 - protein, 25 aa, Mycobacterium
FDDGRPFVLTDTVGFVRHLPTQLIE

SEQ ID NO: 1306729 - protein, 17 aa, Mycobacterium
FDDLRLEHGRLDQPIPV

SEQ ID NO: 1306730 - protein, 21 aa, Mycobacterium
FDGLRLANRPVRRPDLTIATE

SEQ ID NO: 1306731 - protein, 36 aa, Mycobacterium
FDIGADDTFFWFTSPSWMMWNFQVAGLLVGATIVCY

SEQ ID NO: 1306732 - protein, 19 aa, Mycobacterium
FDIIVDPSAPIPQFLVKRA

SEQ ID NO: 1306733 - protein, 23 aa, Mycobacterium
FDKFPPFPFNVVFAMLRGQVSIK

SEQ ID NO: 1306734 - protein, 21 aa, Mycobacterium
FDMLNLRLKPSARTSVPRLHW

SEQ ID NO: 1306735 - protein, 17 aa, Mycobacterium
FDNDFFGFPPQMARMMD

SEQ ID NO: 1306736 - protein, 18 aa, Mycobacterium
FDNPYGGLEPIFAATARL

SEQ ID NO: 1306737 - protein, 18 aa, Mycobacterium
FDQAYLASVLGFPLVESA

SEQ ID NO: 1306738 - protein, 18 aa, Mycobacterium
FDSLLVYENFPPGGLVGG

SEQ ID NO: 1306739 - protein, 22 aa, Mycobacterium
FDSVAQLELLLPAVAGLVSTLS

SEQ ID NO: 1306740 - protein, 18 aa, Mycobacterium
FDVDGPFLSLPVVKEFWA

SEQ ID NO: 1306741 - protein, 25 aa, Mycobacterium
FEAVYLRNGGVVLQLLTFSGHPAPE

SEQ ID NO: 1306742 - protein, 19 aa, Mycobacterium
FEFDPSRFVFGNKTMVGVS

SEQ ID NO: 1306743 - protein, 17 aa, Mycobacterium
FEICARLTTKHGLGSSR

SEQ ID NO: 1306744 - protein, 20 aa, Mycobacterium
FELGMDSMMSVVLQRALLAT

SEQ ID NO: 1306745 - protein, 17 aa, Mycobacterium
FEMPYGPSVPALYGLIA

SEQ ID NO: 1306746 - protein, 25 aa, Mycobacterium
FETARTALLLGQLQRRQRRKEAAAA

SEQ ID NO: 1306747 - protein, 18 aa, Mycobacterium
FFARLWTVMSGHETEEMR

SEQ ID NO: 1306748 - protein, 19 aa, Mycobacterium
FFGFPPQMARMMDPQHRLF

SEQ ID NO: 1306749 - protein, 24 aa, Mycobacterium
FFTPGEVDDLMRAAYRLRALSDEF

SEQ ID NO: 1306750 - protein, 22 aa, Mycobacterium
FFTRSEAVLGIWRSLLPAEEWV

SEQ ID NO: 1306751 - protein, 17 aa, Mycobacterium
FFVPEGDTFIPTGIARG

SEQ ID NO: 1306752 - protein, 20 aa, Mycobacterium
FGDLTFPLPADELPYLHPVT

SEQ ID NO: 1306753 - protein, 20 aa, Mycobacterium
FGETLPFLVKVLAADEPLSL

SEQ ID NO: 1306754 - protein, 26 aa, Mycobacterium
FGGCTSWVDLPVHPAWEPPVHDDATL

SEQ ID NO: 1306755 - protein, 23 aa, Mycobacterium
FGGQKFIPEVLPKVGIVRRLVDS

SEQ ID NO: 1306756 - protein, 19 aa, Mycobacterium
FGIPKPDNANYLWIQQFYA

SEQ ID NO: 1306757 - protein, 19 aa, Mycobacterium
FGLLRRLRADGIDAPALFL

SEQ ID NO: 1306758 - protein, 17 aa, Mycobacterium
FGRIDILINCAGTPEPP

SEQ ID NO: 1306759 - protein, 17 aa, Mycobacterium
FGRLLRRAIDPDPRRRF

SEQ ID NO: 1306760 - protein, 30 aa, Mycobacterium
FGSSNPRLDIPRMLELFGSGRLMLDELITR

SEQ ID NO: 1306761 - protein, 35 aa, Mycobacterium
FGYNSPEWIVALFALLLQGAVPVLGNRWWSPAEVA

SEQ ID NO: 1306762 - protein, 17 aa, Mycobacterium
FHDLGLTARYRTSDQRF

SEQ ID NO: 1306763 - protein, 20 aa, Mycobacterium
FHIHLHVLPRRSGDKLSFAK

SEQ ID NO: 1306764 - protein, 19 aa, Mycobacterium
FHLVLLDNGRTSVLADEVG

SEQ ID NO: 1306765 - protein, 24 aa, Mycobacterium
FHPPPTFLNHKLSPARSFAGATLS

SEQ ID NO: 1306766 - protein, 20 aa, Mycobacterium
FIANLGLTHVRYAVTSHTGG

SEQ ID NO: 1306767 - protein, 20 aa, Mycobacterium
FIEHDSQGYRLIFENDYTTE

SEQ ID NO: 1306768 - protein, 18 aa, Mycobacterium
FIKTVLSVRYGYIPKHLN

SEQ ID NO: 1306769 - protein, 25 aa, Mycobacterium
FIRDAKVIAPDKPWFSYVCPGAGHA

SEQ ID NO: 1306770 - protein, 21 aa, Mycobacterium
FKDAFQQLTAIRRWGPEDRIR

SEQ ID NO: 1306771 - protein, 22 aa, Mycobacterium
FKRHNQIDRPCLLGYIDKCSAP

SEQ ID NO: 1306772 - protein, 20 aa, Mycobacterium
FKVALARRTLIAELRALTGR

SEQ ID NO: 1306773 - protein, 22 aa, Mycobacterium
FLDRIRSARRAITGLKVTVACP

SEQ ID NO: 1306774 - protein, 18 aa, Mycobacterium
FLDRRLLLGLMTDQDVRT

SEQ ID NO: 1306775 - protein, 20 aa, Mycobacterium
FLDSTGKMWPLPYPQSTANT

SEQ ID NO: 1306776 - protein, 21 aa, Mycobacterium
FLFDTLDGFLDTLLGAAARGV

SEQ ID NO: 1306777 - protein, 18 aa, Mycobacterium
FLGTERIEVLRYGPGDDG

SEQ ID NO: 1306778 - protein, 25 aa, Mycobacterium
FLLDGRPVILTAPRRASAAPARTAS

SEQ ID NO: 1306779 - protein, 19 aa, Mycobacterium
FLPGASYHFVATSAAPRPV

SEQ ID NO: 1306780 - protein, 25 aa, Mycobacterium
FLQAFQELILEPRGLDYKVQFPGPT

SEQ ID NO: 1306781 - protein, 24 aa, Mycobacterium
FLTLRQMIADALKPDLPALRVADV

SEQ ID NO: 1306782 - protein, 17 aa, Mycobacterium
FLVDGSPGSLTTAEITN

SEQ ID NO: 1306783 - protein, 17 aa, Mycobacterium
FLYRRNGYENAPRPDLI

SEQ ID NO: 1306784 - protein, 20 aa, Mycobacterium
FMGLGMIYTAMPVTNAVPAV

SEQ ID NO: 1306785 - protein, 28 aa, Mycobacterium
FMTEFLPGHYDFLQRLFAGINPRHRQQL

SEQ ID NO: 1306786 - protein, 21 aa, Mycobacterium
FNAPIALEPLPYTVARVADPD

SEQ ID NO: 1306787 - protein, 27 aa, Mycobacterium
FNDAPLHVTTLAWLSLGPTGAKDETDD

SEQ ID NO: 1306788 - protein, 17 aa, Mycobacterium
FNDLTVHCALRTRGRLA

SEQ ID NO: 1306789 - protein, 23 aa, Mycobacterium
FNDRYKPDWCRVINFPLTVAADV

SEQ ID NO: 1306790 - protein, 26 aa, Mycobacterium
FPASVLAVLRRLEGHFTLVFANADEP

SEQ ID NO: 1306791 - protein, 18 aa, Mycobacterium
FPGGIHAVWFTETWGRYN

SEQ ID NO: 1306792 - protein, 27 aa, Mycobacterium
FPGGMYRNKCWLPYPGDDVLLCLGIHG

SEQ ID NO: 1306793 - protein, 17 aa, Mycobacterium
FPRLKVYRGPRKKGVRY

SEQ ID NO: 1306794 - protein, 23 aa, Mycobacterium
FPSPAEFVAAFEAALEGVIPGLT

SEQ ID NO: 1306795 - protein, 20 aa, Mycobacterium
FPVWQTQIAVQRRDSRSPAT

SEQ ID NO: 1306796 - protein, 17 aa, Mycobacterium
FQCWIYGADPAGNAFIV

SEQ ID NO: 1306797 - protein, 24 aa, Mycobacterium
FQNAWVNPIMWNAFLGWTGVDQYD

SEQ ID NO: 1306798 - protein, 18 aa, Mycobacterium
FQRWSISLLSWIMNPERG

SEQ ID NO: 1306799 - protein, 30 aa, Mycobacterium
FQVRLLAKRPGPDLGLMPLDLSLGVADEDS

SEQ ID NO: 1306800 - protein, 17 aa, Mycobacterium
FQWVVFTSTNAVRAVWE

SEQ ID NO: 1306801 - protein, 18 aa, Mycobacterium
FRASYGSGSLVVGVCAEY

SEQ ID NO: 1306802 - protein, 33 aa, Mycobacterium
FRATRMTPRRMMALLLRFGPYGDRFGLRRGGLN

SEQ ID NO: 1306803 - protein, 18 aa, Mycobacterium
FRGSEPWHLDQLADTLVG

SEQ ID NO: 1306804 - protein, 19 aa, Mycobacterium
FRLPQLSPDPRQWVGTLWR

SEQ ID NO: 1306805 - protein, 23 aa, Mycobacterium
FRRAFSWLPAQFASQSNAPVGAP

SEQ ID NO: 1306806 - protein, 20 aa, Mycobacterium
FRTDDWPKPVPARRLVSYLK

SEQ ID NO: 1306807 - protein, 23 aa, Mycobacterium
FRTGYARKWNFYASGDAAGVNPL

SEQ ID NO: 1306808 - protein, 35 aa, Mycobacterium
FRVEETVHLSILQFAKFPLWKDLDESWKQLSRNAL

SEQ ID NO: 1306809 - protein, 18 aa, Mycobacterium
FSGDRVLILASLIDSRIG

SEQ ID NO: 1306810 - protein, 18 aa, Mycobacterium
FSGDWYVGLGVASATYPA

SEQ ID NO: 1306811 - protein, 18 aa, Mycobacterium
FSGTLFRLEEDESWFTGI

SEQ ID NO: 1306812 - protein, 19 aa, Mycobacterium
FSLTVPRRDGGERRLYLIE

SEQ ID NO: 1306813 - protein, 20 aa, Mycobacterium
FTCSTLHLHAWPAATELDLL

SEQ ID NO: 1306814 - protein, 27 aa, Mycobacterium
FTDLSKAYWDFWRQFLDRIAAEHPTWT

SEQ ID NO: 1306815 - protein, 28 aa, Mycobacterium
FTDLVPRRPEAYPLLERTLRTGQPHRVR

SEQ ID NO: 1306816 - protein, 24 aa, Mycobacterium
FTEPKWVTTPTLERAFALGYNPAI

SEQ ID NO: 1306817 - protein, 28 aa, Mycobacterium
FTFVTDPLTLGIQLLSVVGPVINAAAAA

SEQ ID NO: 1306818 - protein, 19 aa, Mycobacterium
FTGQVWPGDLLSFGGRVTG

SEQ ID NO: 1306819 - protein, 18 aa, Mycobacterium
FTIGLWVGTAVSPKRFED

SEQ ID NO: 1306820 - protein, 17 aa, Mycobacterium
FTKSWRLYNAGTVPWVG

SEQ ID NO: 1306821 - protein, 23 aa, Mycobacterium
FTQMMAFMRKSEAPLPWAQMHRV

SEQ ID NO: 1306822 - protein, 19 aa, Mycobacterium
FTRETLGFSVLHVVRDNPT

SEQ ID NO: 1306823 - protein, 24 aa, Mycobacterium
FTRPARLYGLAKLGYTQSYTYFTW

SEQ ID NO: 1306824 - protein, 20 aa, Mycobacterium
FTVRLHAVLPPVAAAGTCLS

SEQ ID NO: 1306825 - protein, 27 aa, Mycobacterium
FTYVKLVTGVFVYVAFVIDAYAGSIVG

SEQ ID NO: 1306826 - protein, 18 aa, Mycobacterium
FVALWADHRVKRCEADTY

SEQ ID NO: 1306827 - protein, 20 aa, Mycobacterium
FVGPLPHVPVVLGIATRALE

SEQ ID NO: 1306828 - protein, 24 aa, Mycobacterium
FVGYQLDRVFAPRLGVARSNGCAY

SEQ ID NO: 1306829 - protein, 18 aa, Mycobacterium
FVIQNPYGPRGDAIKGCF

SEQ ID NO: 1306830 - protein, 18 aa, Mycobacterium
FVLHFPGLGQVVFHGTSP

SEQ ID NO: 1306831 - protein, 17 aa, Mycobacterium
FVNTPPSHLYPDEFAKR

SEQ ID NO: 1306832 - protein, 21 aa, Mycobacterium
FVPESVPFVRGTLLDGALVEQ

SEQ ID NO: 1306833 - protein, 20 aa, Mycobacterium
FVTTKFFGMKANHYLHKHGI

SEQ ID NO: 1306834 - protein, 24 aa, Mycobacterium
FVWDRRIERLLAFGRGQHFCLGVH

SEQ ID NO: 1306835 - protein, 17 aa, Mycobacterium
FVWTPASNRFGWTAYLG

SEQ ID NO: 1306836 - protein, 17 aa, Mycobacterium
FWDPVRLAEEISVLDII

SEQ ID NO: 1306837 - protein, 17 aa, Mycobacterium
FWRTQPWVPVPEVADVR

SEQ ID NO: 1306838 - protein, 17 aa, Mycobacterium
FYAGIVAEKALLRRLVE

SEQ ID NO: 1306839 - protein, 18 aa, Mycobacterium
FYEQCVIETGPDSAPWQA

SEQ ID NO: 1306840 - protein, 18 aa, Mycobacterium
FYEYVDGKRTGLWPGLRE

SEQ ID NO: 1306841 - protein, 17 aa, Mycobacterium
FYFEFHFDQGEGYLAHL

SEQ ID NO: 1306842 - protein, 23 aa, Mycobacterium
FYGRRLYELMSAYWPTADKTPDA

SEQ ID NO: 1306843 - protein, 26 aa, Mycobacterium
FYSRHFDFDVLMKPGPGFAMVARDNL

SEQ ID NO: 1306844 - protein, 26 aa, Mycobacterium
GAAARGDLLFWVDEYRRLPKLRAVQD

SEQ ID NO: 1306845 - protein, 27 aa, Mycobacterium
GAADPFQLFRIMFEVIRGGGLDPQSGV

SEQ ID NO: 1306846 - protein, 17 aa, Mycobacterium
GAALRRLTPQALEFHLE

SEQ ID NO: 1306847 - protein, 17 aa, Mycobacterium
GAAPLLAAAHRPGRRFV

SEQ ID NO: 1306848 - protein, 25 aa, Mycobacterium
GAASISLAVRFLQLQHRRAETSTAE

SEQ ID NO: 1306849 - protein, 24 aa, Mycobacterium
GADFPAGWQKLNGPQALSFVRQRH

SEQ ID NO: 1306850 - protein, 23 aa, Mycobacterium
GADHPVPWDWFVADYDRIRDAIA

SEQ ID NO: 1306851 - protein, 17 aa, Mycobacterium
GADRLRRFGADRLIDYI

SEQ ID NO: 1306852 - protein, 25 aa, Mycobacterium
GAEAEDFYLRYNCDTYVMGIAGVDG

SEQ ID NO: 1306853 - protein, 26 aa, Mycobacterium
GAEGLDLAIVYLPSPYDTAVLEPLAE

SEQ ID NO: 1306854 - protein, 21 aa, Mycobacterium
GAFEMAATVDYLFGYDATAHV

SEQ ID NO: 1306855 - protein, 21 aa, Mycobacterium
GAFLDWEGRLRSFGPALPSNA

SEQ ID NO: 1306856 - protein, 24 aa, Mycobacterium
GAGILNFVFGEVWLRPGLGMRERR

SEQ ID NO: 1306857 - protein, 24 aa, Mycobacterium
GAGMAPWPGFVGRVRDAGVRAVVQ

SEQ ID NO: 1306858 - protein, 24 aa, Mycobacterium
GAGPIGLALVQFSLAKGATQVIVN

SEQ ID NO: 1306859 - protein, 23 aa, Mycobacterium
GAHGLLVVTPYYSRPPQAGLLAH

SEQ ID NO: 1306860 - protein, 21 aa, Mycobacterium
GAIARLAGLEILRRSRDDEDS

SEQ ID NO: 1306861 - protein, 23 aa, Mycobacterium
GAKEPWFAEVYPKASAWAEASDW

SEQ ID NO: 1306862 - protein, 17 aa, Mycobacterium
GAKLIVTTAYFPQSEDQ

SEQ ID NO: 1306863 - protein, 17 aa, Mycobacterium
GALALGALRRTGQSEAA

SEQ ID NO: 1306864 - protein, 31 aa, Mycobacterium
GALDVDVVLSPFFNTLPIRRAGLHEHSESIT

SEQ ID NO: 1306865 - protein, 17 aa, Mycobacterium
GALPKAEFLAFFVAAIK

SEQ ID NO: 1306866 - protein, 22 aa, Mycobacterium
GANRLVALIRYPHGADPEQVTR

SEQ ID NO: 1306867 - protein, 17 aa, Mycobacterium
GANWKLFYGGRSTESMA

SEQ ID NO: 1306868 - protein, 19 aa, Mycobacterium
GAPAWELTGEAWRQALDVN

SEQ ID NO: 1306869 - protein, 21 aa, Mycobacterium
GAPKHPVWYHNIKKNPRVELQ

SEQ ID NO: 1306870 - protein, 21 aa, Mycobacterium
GAPLWTDASLLADPWGAETHT

SEQ ID NO: 1306871 - protein, 22 aa, Mycobacterium
GAPPQWPLPDLFEKFPQFPTDP

SEQ ID NO: 1306872 - protein, 22 aa, Mycobacterium
GAPYLRYFNHKMKRDALVPIDP

SEQ ID NO: 1306873 - protein, 17 aa, Mycobacterium
GAQFSDLRFTNSSTLGL

SEQ ID NO: 1306874 - protein, 29 aa, Mycobacterium
GAQLPFEGLRVLDLTTFWAGPSCTHILAL

SEQ ID NO: 1306875 - protein, 26 aa, Mycobacterium
GARPKVLLLPLGPLAEHNIRATFATN

SEQ ID NO: 1306876 - protein, 26 aa, Mycobacterium
GASTQRRLYVRPVMQPHPFNGDEETV

SEQ ID NO: 1306877 - protein, 18 aa, Mycobacterium
GASYIPRGVGVPQDVRLA

SEQ ID NO: 1306878 - protein, 28 aa, Mycobacterium
GATIVLQGLHRLWPPVIDLVRHLVDDLG

SEQ ID NO: 1306879 - protein, 29 aa, Mycobacterium
GATRGSRFYPLLYLLTRVDGARDFGSGLE

SEQ ID NO: 1306880 - protein, 17 aa, Mycobacterium
GATVIAGIRRHGANRRS

SEQ ID NO: 1306881 - protein, 19 aa, Mycobacterium
GAVAMHYITGLYALDLHAD

SEQ ID NO: 1306882 - protein, 23 aa, Mycobacterium
GCADLLYATRLVGVPLNPAAAVA

SEQ ID NO: 1306883 - protein, 24 aa, Mycobacterium
GCGETPYLKLLSQLFGDRMMIANA

SEQ ID NO: 1306884 - protein, 25 aa, Mycobacterium
GCLHAAMDLYKWSYKLSPLVASDLV

SEQ ID NO: 1306885 - protein, 19 aa, Mycobacterium
GCLYALLAKCWPEDVSEPA

SEQ ID NO: 1306886 - protein, 17 aa, Mycobacterium
GCWVLTNHPFLTGRTSR

SEQ ID NO: 1306887 - protein, 21 aa, Mycobacterium
GDAANVELLFFPTGGGKTEAY

SEQ ID NO: 1306888 - protein, 22 aa, Mycobacterium
GDAPITRALILRTALAILDRDG

SEQ ID NO: 1306889 - protein, 19 aa, Mycobacterium
GDAVHLFTGDCLFPGGVGK

SEQ ID NO: 1306890 - protein, 30 aa, Mycobacterium
GDDLLAAFERDFFPIYPASAKVQSWDIYAC

SEQ ID NO: 1306891 - protein, 23 aa, Mycobacterium
GDEASRLFLTQMIEHHKGAITMA

SEQ ID NO: 1306892 - protein, 23 aa, Mycobacterium
GDEEAGTYVGRTGSDDALDDEQT

SEQ ID NO: 1306893 - protein, 24 aa, Mycobacterium
GDEFDLSNLFLLASTAALFSPALK

SEQ ID NO: 1306894 - protein, 24 aa, Mycobacterium
GDFADILRRRLFDSEPAAEVVSAT

SEQ ID NO: 1306895 - protein, 24 aa, Mycobacterium
GDFEVLFRLYGPTAPLFDGTWLLP

SEQ ID NO: 1306896 - protein, 25 aa, Mycobacterium
GDGGFHQLAWWVDDYDAALRSAGAA

SEQ ID NO: 1306897 - protein, 22 aa, Mycobacterium
GDGLGIVFRKGLPLEDMEFHQF

SEQ ID NO: 1306898 - protein, 18 aa, Mycobacterium
GDGPVLYRRTVADAPVAP

SEQ ID NO: 1306899 - protein, 29 aa, Mycobacterium
GDGRGSGPLRWLPAIPTVLADNPHWGDYL

SEQ ID NO: 1306900 - protein, 24 aa, Mycobacterium
GDGRRFWIVGLEGDRHWPALCRSV

SEQ ID NO: 1306901 - protein, 25 aa, Mycobacterium
GDGTVLVLHRDGTLAALDVATGTET

SEQ ID NO: 1306902 - protein, 24 aa, Mycobacterium
GDHDPLVTGLRRLGHRVDLADQSS

SEQ ID NO: 1306903 - protein, 18 aa, Mycobacterium
GDILPLTLARVMSRIDTI

SEQ ID NO: 1306904 - protein, 19 aa, Mycobacterium
GDIPPPPGWNQPPGPPGLY

SEQ ID NO: 1306905 - protein, 28 aa, Mycobacterium
GDLDFLRRPLLGFLSMAAGPTPLQPRPV

SEQ ID NO: 1306906 - protein, 37 aa, Mycobacterium
GDPIQMFVRRVSPLAKLLDWLAHTYNVLILVSAGNHA

SEQ ID NO: 1306907 - protein, 33 aa, Mycobacterium
GDRADRPIQWWRSDGWLCPYGPLAVGAAALPGT

SEQ ID NO: 1306908 - protein, 19 aa, Mycobacterium
GDRAVILAPQGLEYVLAFL

SEQ ID NO: 1306909 - protein, 24 aa, Mycobacterium
GDSDFLSEAVLRIALLAQSGDALG

SEQ ID NO: 1306910 - protein, 17 aa, Mycobacterium
GDTPMILGALPFDLTAP

SEQ ID NO: 1306911 - protein, 26 aa, Mycobacterium
GDVNRGWLVARATLGNERISIGGGSG

SEQ ID NO: 1306912 - protein, 35 aa, Mycobacterium
GDVSVLRPYRMALAHLWAAGLPWAGDLPPVQACPE

SEQ ID NO: 1306913 - protein, 23 aa, Mycobacterium
GDVYTLLKVLPHDDAYAWAQRSN

SEQ ID NO: 1306914 - protein, 25 aa, Mycobacterium
GEAAFNIGSLFVPGGALSKTGTLAK

SEQ ID NO: 1306915 - protein, 25 aa, Mycobacterium
GEASRFGFVFTRRGVVPESASSWFL

SEQ ID NO: 1306916 - protein, 18 aa, Mycobacterium
GEATWAHLRMCLTCGHVG

SEQ ID NO: 1306917 - protein, 17 aa, Mycobacterium
GEFYRHTLMTPNFTPRG

SEQ ID NO: 1306918 - protein, 23 aa, Mycobacterium
GEGFYWPREIDPGTWLSVRCPVE

SEQ ID NO: 1306919 - protein, 26 aa, Mycobacterium
GEGGLLPGLIKLALERGLAAELTDHL

SEQ ID NO: 1306920 - protein, 31 aa, Mycobacterium
GEGHPALHVLLWQRALDPERGRWSLPGGRLG

SEQ ID NO: 1306921 - protein, 22 aa, Mycobacterium
GEGIDFGLLRYLRADTAERLCA

SEQ ID NO: 1306922 - protein, 25 aa, Mycobacterium
GEGRRFMRLMKRPLVVPMLHLRGDS

SEQ ID NO: 1306923 - protein, 31 aa, Mycobacterium
GEIATLIFDLIPTSHLFRPGHRIRLALAGAD

SEQ ID NO: 1306924 - protein, 30 aa, Mycobacterium
GEIEGVFTLPEPLPAKMLFISAGSGITPII

SEQ ID NO: 1306925 - protein, 27 aa, Mycobacterium
GEILIGTAARWLYVDPNLAGADVLLVD

SEQ ID NO: 1306926 - protein, 23 aa, Mycobacterium
GEILRYINWVADKLDLRSGITFN

SEQ ID NO: 1306927 - protein, 27 aa, Mycobacterium
GELDGSKVPLLLIPGAFMATDSMQAWA

SEQ ID NO: 1306928 - protein, 20 aa, Mycobacterium
GELHFFGYGNLFEPYVTYHR

SEQ ID NO: 1306929 - protein, 20 aa, Mycobacterium
GELITQILPCTLMSPDSVAR

SEQ ID NO: 1306930 - protein, 18 aa, Mycobacterium
GELLLALDRTMVTLQQAP

SEQ ID NO: 1306931 - protein, 17 aa, Mycobacterium
GELLPDAFGPDDLARRA

SEQ ID NO: 1306932 - protein, 25 aa, Mycobacterium
GEPPPDIELIGMLNLLIGGGFDTTT

SEQ ID NO: 1306933 - protein, 21 aa, Mycobacterium
GEPVSCFLLRIEDNMESIGRS

SEQ ID NO: 1306934 - protein, 20 aa, Mycobacterium
GEQWREDWPRYDAVRRRTRV

SEQ ID NO: 1306935 - protein, 27 aa, Mycobacterium
GERGRGYANFLRILDEGRIAIAALSVG

SEQ ID NO: 1306936 - protein, 20 aa, Mycobacterium
GERIALNAGFLWACSGYYNY

SEQ ID NO: 1306937 - protein, 27 aa, Mycobacterium
GERRRLQFLRMLLDEPNVLLLDEPTND

SEQ ID NO: 1306938 - protein, 26 aa, Mycobacterium
GERVVKFVRFVLRRSTFPYSNTVGPE

SEQ ID NO: 1306939 - protein, 26 aa, Mycobacterium
GESARFALNALIAQDVPLNYGRYSLD

SEQ ID NO: 1306940 - protein, 17 aa, Mycobacterium
GESAVAFQSAHARFIEA

SEQ ID NO: 1306941 - protein, 18 aa, Mycobacterium
GETKLIGEWLLRDMGRAS

SEQ ID NO: 1306942 - protein, 28 aa, Mycobacterium
GETPYDPRMMVAVLLYGYTVGVCSSRQL

SEQ ID NO: 1306943 - protein, 18 aa, Mycobacterium
GEVSLPRLVQAVSAERGR

SEQ ID NO: 1306944 - protein, 35 aa, Mycobacterium
GEWGDTHYYLIPAERLPLLMPFEQAGVPAPILAVL

SEQ ID NO: 1306945 - protein, 21 aa, Mycobacterium
GFAALFRAFYMALDERQISYL

SEQ ID NO: 1306946 - protein, 23 aa, Mycobacterium
GFDAVIGNPPFLGGKKLGGAVGP

SEQ ID NO: 1306947 - protein, 20 aa, Mycobacterium
GFDRQLLLPGFVERVLEAWP

SEQ ID NO: 1306948 - protein, 19 aa, Mycobacterium
GFEAEGVLWSWTLDLVTGT

SEQ ID NO: 1306949 - protein, 18 aa, Mycobacterium
GFGLLSRPHPELTASWLE

SEQ ID NO: 1306950 - protein, 17 aa, Mycobacterium
GFIEMPSAAKRADGWGA

SEQ ID NO: 1306951 - protein, 18 aa, Mycobacterium
GFIRQFVAVPLGSGATVE

SEQ ID NO: 1306952 - protein, 24 aa, Mycobacterium
GFNHNEPTIWLAEGLLPLPDATQD

SEQ ID NO: 1306953 - protein, 28 aa, Mycobacterium
GFTWEHDLHLYWRRATALAASLGPATRW

SEQ ID NO: 1306954 - protein, 19 aa, Mycobacterium
GFWFNADAYMVSLLKEYWG

SEQ ID NO: 1306955 - protein, 27 aa, Mycobacterium
GGAAHPADLWRAAADLGWHGLAVAEQF

SEQ ID NO: 1306956 - protein, 25 aa, Mycobacterium
GGAARDALILRHGFVIEVQGGGGDD

SEQ ID NO: 1306957 - protein, 25 aa, Mycobacterium
GGAASAFGTEWEKWHSGAGQVVRGL

SEQ ID NO: 1306958 - protein, 21 aa, Mycobacterium
GGCVGLQLLLDAPQRVSSATL

SEQ ID NO: 1306959 - protein, 22 aa, Mycobacterium
GGDFYDLFALAPGRSAFFLGDS

SEQ ID NO: 1306960 - protein, 23 aa, Mycobacterium
GGDLARAFWRRMIDNVEQYLDEG

SEQ ID NO: 1306961 - protein, 24 aa, Mycobacterium
GGEAYLCGPAPFMAAVQAALAEAG

SEQ ID NO: 1306962 - protein, 22 aa, Mycobacterium
GGELSRVMLAIEVVLAASAEGT

SEQ ID NO: 1306963 - protein, 19 aa, Mycobacterium
GGETNGWTLARPADLSVSM

SEQ ID NO: 1306964 - protein, 21 aa, Mycobacterium
GGGFLLYYDAASGAVQAYDGR

SEQ ID NO: 1306965 - protein, 24 aa, Mycobacterium
GGGRPVLAIARFAQFLAAAGIDRI

SEQ ID NO: 1306966 - protein, 25 aa, Mycobacterium
GGHFPDPVIFLKPNTSIIGPNIPIQ

SEQ ID NO: 1306967 - protein, 17 aa, Mycobacterium
GGIGRTTLYELIKRGEL

SEQ ID NO: 1306968 - protein, 22 aa, Mycobacterium
GGKALKFYASVRMDVRRIETLK

SEQ ID NO: 1306969 - protein, 20 aa, Mycobacterium
GGLGTFSWPGAYGTWWQADP

SEQ ID NO: 1306970 - protein, 24 aa, Mycobacterium
GGLIYPDDSLPSKPYAIPGTVVDN

SEQ ID NO: 1306971 - protein, 18 aa, Mycobacterium
GGMHADWCLLLARTDPDA

SEQ ID NO: 1306972 - protein, 24 aa, Mycobacterium
GGNHAFYLSIPPKAFPVVCEQLRR

SEQ ID NO: 1306973 - protein, 17 aa, Mycobacterium
GGNLYLATVIDCCSRRV

SEQ ID NO: 1306974 - protein, 18 aa, Mycobacterium
GGPDLRRRPRGHTNGTAG

SEQ ID NO: 1306975 - protein, 32 aa, Mycobacterium
GGPDYLLQVYKTYGPLHYAYSPALPAVVALGP

SEQ ID NO: 1306976 - protein, 21 aa, Mycobacterium
GGPLWAGFIEMPSAAKRADGW

SEQ ID NO: 1306977 - protein, 29 aa, Mycobacterium
GGQAGYPAPPLQLLDELNLELLQKISIAS

SEQ ID NO: 1306978 - protein, 18 aa, Mycobacterium
GGQQAWGYLWAVTIPCQE

SEQ ID NO: 1306979 - protein, 19 aa, Mycobacterium
GGQRLLFSATLDNGVDKLV

SEQ ID NO: 1306980 - protein, 21 aa, Mycobacterium
GGSHLLFNPLITIAQVLADLQ

SEQ ID NO: 1306981 - protein, 24 aa, Mycobacterium
GGSIGKWLKKLLSSARKSGGSGGG

SEQ ID NO: 1306982 - protein, 25 aa, Mycobacterium
GGVPVVMKALLDAGLLHGDCLTITG

SEQ ID NO: 1306983 - protein, 32 aa, Mycobacterium
GGWRERIALHQLYPLLAHVVLFGGGYIRQTES

SEQ ID NO: 1306984 - protein, 19 aa, Mycobacterium
GGWSFRHELLREVAAELAP

SEQ ID NO: 1306985 - protein, 18 aa, Mycobacterium
GHDALIAPPTFMSIFAVM

SEQ ID NO: 1306986 - protein, 17 aa, Mycobacterium
GHDVVFLGLPHGHSAAL

SEQ ID NO: 1306987 - protein, 19 aa, Mycobacterium
GHGISFLPTVGWAERGDLT

SEQ ID NO: 1306988 - protein, 17 aa, Mycobacterium
GHKWFTSAPMCDIFLVL

SEQ ID NO: 1306989 - protein, 19 aa, Mycobacterium
GHLSARLTTLGPAATLARG

SEQ ID NO: 1306990 - protein, 18 aa, Mycobacterium
GHPIIRSFEPGEDWFWNY

SEQ ID NO: 1306991 - protein, 17 aa, Mycobacterium
GHQLSAFVAITPLDPSQ

SEQ ID NO: 1306992 - protein, 24 aa, Mycobacterium
GHRCPGWLTRSWTSSTPPGTPRPP

SEQ ID NO: 1306993 - protein, 22 aa, Mycobacterium
GIAKTTIYRRHSDRRDMLAVAL

SEQ ID NO: 1306994 - protein, 18 aa, Mycobacterium
GIALFAVGNARRALVESL

SEQ ID NO: 1306995 - protein, 19 aa, Mycobacterium
GIARYARCERLLAAAPTVL

SEQ ID NO: 1306996 - protein, 25 aa, Mycobacterium
GIDPQKFWRDAGLPAYQFPDPNGVR

SEQ ID NO: 1306997 - protein, 24 aa, Mycobacterium
GIDVTPENMAWFAKSKPGHNIGLR

SEQ ID NO: 1306998 - protein, 23 aa, Mycobacterium
GIGSACVLLIDGLGAELLARHAD

SEQ ID NO: 1306999 - protein, 19 aa, Mycobacterium
GIGWVPYFLERIDRTYKMH

SEQ ID NO: 1307000 - protein, 19 aa, Mycobacterium
GIKLHILTRKTLGGIQTDL

SEQ ID NO: 1307001 - protein, 21 aa, Mycobacterium
GILQSWLDQRRAALAAPGEGG

SEQ ID NO: 1307002 - protein, 25 aa, Mycobacterium
GINVAIMFSIPPYPCGGTVSHGPAL

SEQ ID NO: 1307003 - protein, 26 aa, Mycobacterium
GIPEHIVDRIFTPFFTTKPVGEGTGL

SEQ ID NO: 1307004 - protein, 19 aa, Mycobacterium
GIPLVHTTPMPYDNYFGGV

SEQ ID NO: 1307005 - protein, 24 aa, Mycobacterium
GIPNFSLLVSHVLVPPAISAIMES

SEQ ID NO: 1307006 - protein, 24 aa, Mycobacterium
GIPWHLPEDLARFKEITLGHPVVM

SEQ ID NO: 1307007 - protein, 28 aa, Mycobacterium
GIRLADKPMPLFQLLVLCMLASKPIDAT

SEQ ID NO: 1307008 - protein, 19 aa, Mycobacterium
GIRLRLFHGRGGTVGRGGG

SEQ ID NO: 1307009 - protein, 19 aa, Mycobacterium
GISSPLRRGLFTEDLEEFD

SEQ ID NO: 1307010 - protein, 24 aa, Mycobacterium
GITGFIKTVLSLRYGYIPKHLNFT

SEQ ID NO: 1307011 - protein, 29 aa, Mycobacterium
GIVTSVEFDLLPIPEFYGGTVYFDGADAP

SEQ ID NO: 1307012 - protein, 35 aa, Mycobacterium
GIYAPYIHPWSKGRDLYFTLSRWSDYSTLLMHTSL

SEQ ID NO: 1307013 - protein, 31 aa, Mycobacterium
GIYPDGRFSYQLTIYIFRYGEGTVMAIMHPD

SEQ ID NO: 1307014 - protein, 28 aa, Mycobacterium
GKAALLSFTRSMAAAYAPYGIRVNALAP

SEQ ID NO: 1307015 - protein, 17 aa, Mycobacterium
GKAKEGIGTVTGRDDMV

SEQ ID NO: 1307016 - protein, 27 aa, Mycobacterium
GKHIDGLPRIALLDGLPFSNHAVLAGR

SEQ ID NO: 1307017 - protein, 24 aa, Mycobacterium
GKQTFAFFRQNLVSDYTYPESVAD

SEQ ID NO: 1307018 - protein, 27 aa, Mycobacterium
GKSVEEALDILRWAPQQASEPVAKVIA

SEQ ID NO: 1307019 - protein, 33 aa, Mycobacterium
GKTLADIRAAFYSAPRLPLLYEADRDLQQAIYD

SEQ ID NO: 1307020 - protein, 23 aa, Mycobacterium
GKTTLLQILTGTRPPDSGRVTHT

SEQ ID NO: 1307021 - protein, 19 aa, Mycobacterium
GLAAFIDLRDQTCRTPYCD

SEQ ID NO: 1307022 - protein, 25 aa, Mycobacterium
GLAAHRRGRRVIVLSKAPEQAGSTA

SEQ ID NO: 1307023 - protein, 27 aa, Mycobacterium
GLAEENYWFRRHEVVYARLADQCAGRD

SEQ ID NO: 1307024 - protein, 23 aa, Mycobacterium
GLAGANLGLWEPAFEQLSTQGAG

SEQ ID NO: 1307025 - protein, 24 aa, Mycobacterium
GLAGTVLRFLPPVAALSTETVEFD

SEQ ID NO: 1307026 - protein, 23 aa, Mycobacterium
GLAIRRWCAPVLDLEPLAGADEY

SEQ ID NO: 1307027 - protein, 21 aa, Mycobacterium
GLAPMVISQIFKIIADINSQG

SEQ ID NO: 1307028 - protein, 21 aa, Mycobacterium
GLAPVLSMLRTLRAAGSPRKA

SEQ ID NO: 1307029 - protein, 29 aa, Mycobacterium
GLDADAVAIPYLIDWEALESAEWELLTSA

SEQ ID NO: 1307030 - protein, 24 aa, Mycobacterium
GLDARTYRLPWPSGSVVYEIDQPE

SEQ ID NO: 1307031 - protein, 25 aa, Mycobacterium
GLDRPFGIGLVHWVAEARPDLLERA

SEQ ID NO: 1307032 - protein, 19 aa, Mycobacterium
GLDYVDIFYSHRIDPTTPL

SEQ ID NO: 1307033 - protein, 24 aa, Mycobacterium
GLEAKLVRGIAWTEAVSGHATALA

SEQ ID NO: 1307034 - protein, 19 aa, Mycobacterium
GLELRNPLLAAASPLSRTL

SEQ ID NO: 1307035 - protein, 28 aa, Mycobacterium
GLEQEYELIVYWWPTPDKASVAGAILAA

SEQ ID NO: 1307036 - protein, 18 aa, Mycobacterium
GLGDWNIPWQQWKAGNAN

SEQ ID NO: 1307037 - protein, 25 aa, Mycobacterium
GLGGDPRRVLRRAAELLRPGGRCVV

SEQ ID NO: 1307038 - protein, 18 aa, Mycobacterium
GLGKPLHLINHPVRERIP

SEQ ID NO: 1307039 - protein, 24 aa, Mycobacterium
GLHHFDLLNHPEIYDRLVHWLGGR

SEQ ID NO: 1307040 - protein, 21 aa, Mycobacterium
GLIAAGRAWARFERGEVVFKA

SEQ ID NO: 1307041 - protein, 26 aa, Mycobacterium
GLKPQLVHYYFRTMEDLFRAVFRRMA

SEQ ID NO: 1307042 - protein, 27 aa, Mycobacterium
GLLAPRQALTGPSLPPVLPATAAAQAH

SEQ ID NO: 1307043 - protein, 19 aa, Mycobacterium
GLLGLGALSALGAPTPDVV

SEQ ID NO: 1307044 - protein, 17 aa, Mycobacterium
GLLHGGVLAQRLTAWVG

SEQ ID NO: 1307045 - protein, 17 aa, Mycobacterium
GLLLPESFIGVAESINL

SEQ ID NO: 1307046 - protein, 25 aa, Mycobacterium
GLMGALRRAGHVVAPFKVGPDFIDP

SEQ ID NO: 1307047 - protein, 17 aa, Mycobacterium
GLMLSGALFRDGLTIVH

SEQ ID NO: 1307048 - protein, 26 aa, Mycobacterium
GLMRSLYRGYPVGGLLMWETTSEDIT

SEQ ID NO: 1307049 - protein, 27 aa, Mycobacterium
GLNKVLPYVLYETLGPALPEGLAGAAA

SEQ ID NO: 1307050 - protein, 19 aa, Mycobacterium
GLNLAAFQRIRFDGDTATA

SEQ ID NO: 1307051 - protein, 26 aa, Mycobacterium
GLRYYLGVVLMATTGLRRGEVAGLLW

SEQ ID NO: 1307052 - protein, 25 aa, Mycobacterium
GLTAELWAMQLPFGMGSTGLVAVAA

SEQ ID NO: 1307053 - protein, 31 aa, Mycobacterium
GLVPFSHRLAAEEWRSLRLAIKQQTVAANIA

SEQ ID NO: 1307054 - protein, 28 aa, Mycobacterium
GLVPVALTEWLGYAWVCLADVPPSFEET

SEQ ID NO: 1307055 - protein, 17 aa, Mycobacterium
GLVRRIAKLAPTSRSDV

SEQ ID NO: 1307056 - protein, 18 aa, Mycobacterium
GLWKALSARDWDAVKTHL

SEQ ID NO: 1307057 - protein, 22 aa, Mycobacterium
GLWVSALAAAGYRVWAINPMAA

SEQ ID NO: 1307058 - protein, 38 aa, Mycobacterium
GMFAGAALTWPSGNSGMMRLTATQWRNLGNGLSIFDDA

SEQ ID NO: 1307059 - protein, 17 aa, Mycobacterium
GMGFDRDVLLRAGIEEA

SEQ ID NO: 1307060 - protein, 26 aa, Mycobacterium
GMGGTSLMDILGQLLGAGGSGMSGMN

SEQ ID NO: 1307061 - protein, 34 aa, Mycobacterium
GMQFQARTALPSRLIRLPAALVRSQLASPAGLAF

SEQ ID NO: 1307062 - protein, 25 aa, Mycobacterium
GMVVNHLLFHFATSKLPFGGVGPSG

SEQ ID NO: 1307063 - protein, 17 aa, Mycobacterium
GMWTAFAALLNGQTVIL

SEQ ID NO: 1307064 - protein, 18 aa, Mycobacterium
GNAWAYDVSFRQVGIQLA

SEQ ID NO: 1307065 - protein, 22 aa, Mycobacterium
GNLGLIRAVEKFDYTKGYKFST

SEQ ID NO: 1307066 - protein, 28 aa, Mycobacterium
GNRHFNPGWHLAIDLRNMLLVSECVAKA

SEQ ID NO: 1307067 - protein, 24 aa, Mycobacterium
GNRLPIRDLIRMAAESRHYLAVFD

SEQ ID NO: 1307068 - protein, 18 aa, Mycobacterium
GNRWRPAFTPADPERFTA

SEQ ID NO: 1307069 - protein, 25 aa, Mycobacterium
GNYAGDVMNFGLAVTALRGEGVDAH

SEQ ID NO: 1307070 - protein, 30 aa, Mycobacterium
GPDELMDVFAYPFATWRVYLHPTQRAVVQA

SEQ ID NO: 1307071 - protein, 20 aa, Mycobacterium
GPFAPEIYRAPLSYPFRDAE

SEQ ID NO: 1307072 - protein, 24 aa, Mycobacterium
GPGAPPLERLLAYGRARHTFVHDH

SEQ ID NO: 1307073 - protein, 20 aa, Mycobacterium
GPHAVFLLDAFNAAPDVSNW

SEQ ID NO: 1307074 - protein, 24 aa, Mycobacterium
GPLDVTVLFAYPRRLASGVQLHED

SEQ ID NO: 1307075 - protein, 25 aa, Mycobacterium
GPLLPPTVPGWRSRAERFDMAVLEA

SEQ ID NO: 1307076 - protein, 26 aa, Mycobacterium
GPLPSQLLDVWRPKELPTEPAPVLVF

SEQ ID NO: 1307077 - protein, 18 aa, Mycobacterium
GPLSAKLLQNGTLKTYAG

SEQ ID NO: 1307078 - protein, 27 aa, Mycobacterium
GPNAIHQLIAPNAWRLPFEREWREKTP

SEQ ID NO: 1307079 - protein, 22 aa, Mycobacterium
GPNILFLAVPDEKVVKNRLHVD

SEQ ID NO: 1307080 - protein, 30 aa, Mycobacterium
GPPELHLLGSILWRRAMGLVLGDWVRTGDC

SEQ ID NO: 1307081 - protein, 23 aa, Mycobacterium
GPQLVPAWMIDVGWKRLCAKGSM

SEQ ID NO: 1307082 - protein, 24 aa, Mycobacterium
GPQSPLLEEFIGIVRGRKPGSSRG

SEQ ID NO: 1307083 - protein, 24 aa, Mycobacterium
GPRCRDIWLVTAGAERVRAGEPQA

SEQ ID NO: 1307084 - protein, 20 aa, Mycobacterium
GPRHFGFVVGGALPAALAAD

SEQ ID NO: 1307085 - protein, 22 aa, Mycobacterium
GPRPRIALLDGLPMAGHIALSE

SEQ ID NO: 1307086 - protein, 29 aa, Mycobacterium
GPSGNVEYFLWLRARTDRGLRGDDLEQAV

SEQ ID NO: 1307087 - protein, 23 aa, Mycobacterium
GPTSHTAIIARQLGIPCVVAVDG

SEQ ID NO: 1307088 - protein, 32 aa, Mycobacterium
GPVDLVQALALPLPSLVICELLGIPYDRHDWF

SEQ ID NO: 1307089 - protein, 23 aa, Mycobacterium
GPVRVRAVMTDLLRSAVGPGADE

SEQ ID NO: 1307090 - protein, 22 aa, Mycobacterium
GQAHLALGFKTPQAYLQDVFRI

SEQ ID NO: 1307091 - protein, 24 aa, Mycobacterium
GQDRRYFAITVRPSVFVNLVPDHV

SEQ ID NO: 1307092 - protein, 21 aa, Mycobacterium
GQFALLLGPGNFGASAPFYGT

SEQ ID NO: 1307093 - protein, 21 aa, Mycobacterium
GQHFRVGPKRVWLVCDSTATV

SEQ ID NO: 1307094 - protein, 24 aa, Mycobacterium
GQHMSILSLFYRWALEEGLAQTEP

SEQ ID NO: 1307095 - protein, 25 aa, Mycobacterium
GQLADWIRFMLSDAADFLCGSVIFV

SEQ ID NO: 1307096 - protein, 18 aa, Mycobacterium
GQLLPRYPAKQVEGGLIV

SEQ ID NO: 1307097 - protein, 19 aa, Mycobacterium
GQMGQMMGMPMQLAQQAAQ

SEQ ID NO: 1307098 - protein, 26 aa, Mycobacterium
GQPRLSPLAYSLVGGRMLVTGSYAGA

SEQ ID NO: 1307099 - protein, 22 aa, Mycobacterium
GQQDTWERLWPELGTEARDDDG

SEQ ID NO: 1307100 - protein, 19 aa, Mycobacterium
GQRALVFRGLNLGDSTIKT

SEQ ID NO: 1307101 - protein, 18 aa, Mycobacterium
GQRPPILDPFDPMTVWAY

SEQ ID NO: 1307102 - protein, 19 aa, Mycobacterium
GQSVLWHRLLVTGDPITDD

SEQ ID NO: 1307103 - protein, 19 aa, Mycobacterium
GQVPTFPLMLGGSLAHALA

SEQ ID NO: 1307104 - protein, 29 aa, Mycobacterium
GRAAAFDMALLDLFWTSVSGVLHAVNVAR

SEQ ID NO: 1307105 - protein, 24 aa, Mycobacterium
GRAADPMLYIRAIVRIVASTRRDV

SEQ ID NO: 1307106 - protein, 25 aa, Mycobacterium
GRATLEVCFAILQSAHEAREVVLSH

SEQ ID NO: 1307107 - protein, 18 aa, Mycobacterium
GRATWDSALLLFLERSGY

SEQ ID NO: 1307108 - protein, 27 aa, Mycobacterium
GRDAAEILCLPYFLGEKSPLHDPDLRG

SEQ ID NO: 1307109 - protein, 17 aa, Mycobacterium
GRDFMPVVWAMFEWGRR

SEQ ID NO: 1307110 - protein, 27 aa, Mycobacterium
GRENLVLFGRLRGLRRAAARARADELI

SEQ ID NO: 1307111 - protein, 23 aa, Mycobacterium
GRGLLSLLVVPTDVPGLTKSLIP

SEQ ID NO: 1307112 - protein, 17 aa, Mycobacterium
GRGLMRAFSLPSQAQRD

SEQ ID NO: 1307113 - protein, 24 aa, Mycobacterium
GRGTRLPVWLTQWGFERPPEDTVD

SEQ ID NO: 1307114 - protein, 23 aa, Mycobacterium
GRHAEWPMVLASLPHLADPSRID

SEQ ID NO: 1307115 - protein, 17 aa, Mycobacterium
GRIVCFCERVTAGEIRD

SEQ ID NO: 1307116 - protein, 20 aa, Mycobacterium
GRIVLPKQLRDALGLTPGSK

SEQ ID NO: 1307117 - protein, 18 aa, Mycobacterium
GRLALHHVRARVYGAEPV

SEQ ID NO: 1307118 - protein, 27 aa, Mycobacterium
GRLLHSAPMFHLADGSGWLARNLVGGT

SEQ ID NO: 1307119 - protein, 28 aa, Mycobacterium
GRLPGARRPAGLGRRHPLRRQRPQRLQR

SEQ ID NO: 1307120 - protein, 33 aa, Mycobacterium
GRLTVVTIHFAAQTPLPLLEMYTRGITVHTSRA

SEQ ID NO: 1307121 - protein, 34 aa, Mycobacterium
GRPADPPFEGMWWLYVPMAFDDFAIVLIIQEDPT

SEQ ID NO: 1307122 - protein, 20 aa, Mycobacterium
GRPEELLLFAVGREARVEFE

SEQ ID NO: 1307123 - protein, 17 aa, Mycobacterium
GRPPMPALADAFAALVE

SEQ ID NO: 1307124 - protein, 17 aa, Mycobacterium
GRQLSAVPYLESVVLAA

SEQ ID NO: 1307125 - protein, 24 aa, Mycobacterium
GRQQAVLARLALLALQALQALQAQ

SEQ ID NO: 1307126 - protein, 22 aa, Mycobacterium
GRRFLNAGIGFGGGCLPKDIRA

SEQ ID NO: 1307127 - protein, 30 aa, Mycobacterium
GRRLEQIEALRLVLERGWTAQRAAERVAAE

SEQ ID NO: 1307128 - protein, 17 aa, Mycobacterium
GRRWSWQVAGIPATAHG

SEQ ID NO: 1307129 - protein, 18 aa, Mycobacterium
GRSTVYRHWKNKGALIVD

SEQ ID NO: 1307130 - protein, 45 aa, Mycobacterium
GRTTQVWRTYRHTAPFEAGSPWLLRFFDRISWYPVSAEELLDLRA

SEQ ID NO: 1307131 - protein, 26 aa, Mycobacterium
GRYSLDDSWYEYASVDPARPELGEAR

SEQ ID NO: 1307132 - protein, 22 aa, Mycobacterium
GSAALLIMSADKAKDLGLKPLA

SEQ ID NO: 1307133 - protein, 29 aa, Mycobacterium
GSAAQAFDLFRWLGPSPDALLSAAGTVAA

SEQ ID NO: 1307134 - protein, 22 aa, Mycobacterium
GSADCIIAFDLLVAADSKNLGY

SEQ ID NO: 1307135 - protein, 21 aa, Mycobacterium
GSDIPYIGHLLSVAGLVIEGG

SEQ ID NO: 1307136 - protein, 17 aa, Mycobacterium
GSDTLKRELLRDFLTER

SEQ ID NO: 1307137 - protein, 19 aa, Mycobacterium
GSFMHRFRMWGSSDLRRWL

SEQ ID NO: 1307138 - protein, 18 aa, Mycobacterium
GSFRGDMLAVLRGWAVLF

SEQ ID NO: 1307139 - protein, 18 aa, Mycobacterium
GSFRWASARAHRLAARLV

SEQ ID NO: 1307140 - protein, 23 aa, Mycobacterium
GSGAFLVAAARFLAKRVTEAWTK

SEQ ID NO: 1307141 - protein, 22 aa, Mycobacterium
GSGIILTSDGLILTNNHVVAAA

SEQ ID NO: 1307142 - protein, 24 aa, Mycobacterium
GSGITPIMSLIRTALATSARSIRL

SEQ ID NO: 1307143 - protein, 18 aa, Mycobacterium
GSGITPMLAILKSALVEG

SEQ ID NO: 1307144 - protein, 23 aa, Mycobacterium
GSGITPVMSILKSALAVGSGRVV

SEQ ID NO: 1307145 - protein, 28 aa, Mycobacterium
GSGKSLSMLWFTQKVLRHVRGKWTFVMV

SEQ ID NO: 1307146 - protein, 21 aa, Mycobacterium
GSHLLVWTTTPWTLPSNQAVA

SEQ ID NO: 1307147 - protein, 26 aa, Mycobacterium
GSKGTPQIDLLARVMRILETPIEQVV

SEQ ID NO: 1307148 - protein, 25 aa, Mycobacterium
GSKMQRFFVRNALVARLVSEAAFKQ

SEQ ID NO: 1307149 - protein, 18 aa, Mycobacterium
GSLLMPPWRVIKFESDGV

SEQ ID NO: 1307150 - protein, 26 aa, Mycobacterium
GSNLAGLSFPFLREKVHGRSNPRIVA

SEQ ID NO: 1307151 - protein, 20 aa, Mycobacterium
GSPSRLLLPGSISIAREIIE

SEQ ID NO: 1307152 - protein, 22 aa, Mycobacterium
GSRATHIVVWATLDKSLGRAAI

SEQ ID NO: 1307153 - protein, 22 aa, Mycobacterium
GSRLFFPEWDNTTAPLPPLEQP

SEQ ID NO: 1307154 - protein, 32 aa, Mycobacterium
GSRQWETFLATELPDWLAANKGLAPGGHGIVG

SEQ ID NO: 1307155 - protein, 21 aa, Mycobacterium
GSRVVPLDEILASAPGPDPNG

SEQ ID NO: 1307156 - protein, 23 aa, Mycobacterium
GSSTWHGLPLTLILDHIDGNSTN

SEQ ID NO: 1307157 - protein, 27 aa, Mycobacterium
GSSVLAQMMWAFRAMGMWSDERGVNML

SEQ ID NO: 1307158 - protein, 27 aa, Mycobacterium
GSTNAVLHLLAIAWEANVKLTLEDFTR

SEQ ID NO: 1307159 - protein, 24 aa, Mycobacterium
GSTSILSRFPRGATVYPLIETLGA

SEQ ID NO: 1307160 - protein, 25 aa, Mycobacterium
GSTYAPWDFFSDWKVIDAFGARSEI

SEQ ID NO: 1307161 - protein, 25 aa, Mycobacterium
GSVGHFEWLENLGFQFERSYYPGKV

SEQ ID NO: 1307162 - protein, 23 aa, Mycobacterium
GSVYPTLQLLVDEGLIVGTESEG

SEQ ID NO: 1307163 - protein, 20 aa, Mycobacterium
GTAKVLAFGPAVENLEGQWH

SEQ ID NO: 1307164 - protein, 25 aa, Mycobacterium
GTDALTPTFAKLLPMAFPNAELVDA

SEQ ID NO: 1307165 - protein, 25 aa, Mycobacterium
GTDKPLKYPHMFAAAGLIIVNKTDL

SEQ ID NO: 1307166 - protein, 33 aa, Mycobacterium
GTELRYLLATSVPAWWAPYVPRLMRTPQLDGTP

SEQ ID NO: 1307167 - protein, 21 aa, Mycobacterium
GTFDWTNGRFPGFTTPDPSYH

SEQ ID NO: 1307168 - protein, 24 aa, Mycobacterium
GTGKTIMAGLYLREMQRLGLVKRA

SEQ ID NO: 1307169 - protein, 24 aa, Mycobacterium
GTIDAPIGRHRGHDWKFAVTEGGR

SEQ ID NO: 1307170 - protein, 24 aa, Mycobacterium
GTLQVPVHIPLFAEPVTAAGVSSV

SEQ ID NO: 1307171 - protein, 17 aa, Mycobacterium
GTNHLGHFALTGQLLDN

SEQ ID NO: 1307172 - protein, 22 aa, Mycobacterium
GTNMLFTMRSAWSRAQDCVGDV

SEQ ID NO: 1307173 - protein, 18 aa, Mycobacterium
GTPFAIAAAVERLTGSLP

SEQ ID NO: 1307174 - protein, 30 aa, Mycobacterium
GTPTFTGRSWPLADVRLLAPILASKVVCIG

SEQ ID NO: 1307175 - protein, 17 aa, Mycobacterium
GTQVVLVTGRIGRELQA

SEQ ID NO: 1307176 - protein, 23 aa, Mycobacterium
GTTNGRITLLRKVFESLSNKTPV

SEQ ID NO: 1307177 - protein, 17 aa, Mycobacterium
GTTYEKISQLKPVFRPN

SEQ ID NO: 1307178 - protein, 19 aa, Mycobacterium
GTVLCTHCFPSAPVEWTTK

SEQ ID NO: 1307179 - protein, 23 aa, Mycobacterium
GTVRGAQFLEPLFEFPGACAGCG

SEQ ID NO: 1307180 - protein, 29 aa, Mycobacterium
GVALLPGVKLLPIAALAEAIRGGAAIKPL

SEQ ID NO: 1307181 - protein, 20 aa, Mycobacterium
GVAPFTRISIFDSPCVSFHV

SEQ ID NO: 1307182 - protein, 27 aa, Mycobacterium
GVAPSIISLTLLPKMTPRAAGRYFVTG

SEQ ID NO: 1307183 - protein, 19 aa, Mycobacterium
GVCMGIIPEVFDLDDEDYL

SEQ ID NO: 1307184 - protein, 26 aa, Mycobacterium
GVDTNIEFLRFLLTDPDVAAGRLDTG

SEQ ID NO: 1307185 - protein, 21 aa, Mycobacterium
GVDVLPVLAFTFTMVTGGNDT

SEQ ID NO: 1307186 - protein, 34 aa, Mycobacterium; identical to SEQ ID NO: 1139206

SEQ ID NO: 1307187 - protein, 20 aa, Mycobacterium
GVGFRPFVYTTATALGLTGS

SEQ ID NO: 1307188 - protein, 20 aa, Mycobacterium
GVKAFGRMFAESLWLELREQ

SEQ ID NO: 1307189 - protein, 18 aa, Mycobacterium
GVLALLEGAAVLAESDPA

SEQ ID NO: 1307190 - protein, 18 aa, Mycobacterium
GVLEKLAAELRPWVPVVS

SEQ ID NO: 1307191 - protein, 19 aa, Mycobacterium
GVLVIRPEGRLNMVAAPAL

SEQ ID NO: 1307192 - protein, 19 aa, Mycobacterium
GVLVYRQAGALPPAALEDL

SEQ ID NO: 1307193 - protein, 18 aa, Mycobacterium
GVNRFGWAPTVQLTAYLR

SEQ ID NO: 1307194 - protein, 18 aa, Mycobacterium
GVPPSIPTPGVPPTVPGQ

SEQ ID NO: 1307195 - protein, 18 aa, Mycobacterium
GVPQWLLDQFRATSPGAI

SEQ ID NO: 1307196 - protein, 22 aa, Mycobacterium
GVPTMFIAMLGHPDFAGTDLSS

SEQ ID NO: 1307197 - protein, 25 aa, Mycobacterium
GVPTPANFLYLPDPVTLGSSLLHAI

SEQ ID NO: 1307198 - protein, 23 aa, Mycobacterium
GVPWSEMAVIVRSLPRAGAPLAR

SEQ ID NO: 1307199 - protein, 26 aa, Mycobacterium
GVQGLVPDLAAFWSRYLLAARERGEI

SEQ ID NO: 1307200 - protein, 20 aa, Mycobacterium
GVQRLRLVAGWSLGGMQSLE

SEQ ID NO: 1307201 - protein, 19 aa, Mycobacterium
GVRLLRHWAVSLGAAEDTF

SEQ ID NO: 1307202 - protein, 25 aa, Mycobacterium
GVRMAITIMVLYNKNRRVPGRPVLV

SEQ ID NO: 1307203 - protein, 18 aa, Mycobacterium
GVRTAIVMPPGGSPAKWI

SEQ ID NO: 1307204 - protein, 20 aa, Mycobacterium
GVRWEPPLLTITRVATRDTE

SEQ ID NO: 1307205 - protein, 26 aa, Mycobacterium
GVTEKRMFGGLAFLLDGNMAVAASGH

SEQ ID NO: 1307206 - protein, 27 aa, Mycobacterium
GVTNPTVLAAFLHRARLRTIQHPGNAP

SEQ ID NO: 1307207 - protein, 28 aa, Mycobacterium
GVTNPTVLAAFLHRARLRTIQHPGNAPS

SEQ ID NO: 1307208 - protein, 26 aa, Mycobacterium
GVTNPTVLANFLHRARLRTIQHPGNA

SEQ ID NO: 1307209 - protein, 23 aa, Mycobacterium
GVTRSAFYFYFENKAAAVAALTE

SEQ ID NO: 1307210 - protein, 24 aa, Mycobacterium
GVVAALGLDWRRAAGALASSREVT

SEQ ID NO: 1307211 - protein, 26 aa, Mycobacterium
GVVELLAPLLTRPAVIFGKSTVPAGT

SEQ ID NO: 1307212 - protein, 24 aa, Mycobacterium
GVVLYIVPRIALGELPMEVGSRLT

SEQ ID NO: 1307213 - protein, 18 aa, Mycobacterium
GWEFYAQRRAFREELHPH

SEQ ID NO: 1307214 - protein, 18 aa, Mycobacterium
GWHGLAVAEQFGGAGFGL

SEQ ID NO: 1307215 - protein, 18 aa, Mycobacterium
GYADLVFMATTARLKCPF

SEQ ID NO: 1307216 - protein, 29 aa, Mycobacterium
GYFLTARDIAWFMDLYLEGASVDRTDPDV

SEQ ID NO: 1307217 - protein, 21 aa, Mycobacterium
GYGLATAQRFHREGWNVVATM

SEQ ID NO: 1307218 - protein, 20 aa, Mycobacterium
GYIAALIYNDKHWNAFVEAV

SEQ ID NO: 1307219 - protein, 36 aa, Mycobacterium
GYNPAILEAWTWPQHGRVLLGWYERFRDASGALDTD

SEQ ID NO: 1307220 - protein, 18 aa, Mycobacterium
GYPHDRKVLRRFTKLPPD

SEQ ID NO: 1307221 - protein, 25 aa, Mycobacterium
GYRIQPRDCEFLGISPDQVEAWAER

SEQ ID NO: 1307222 - protein, 21 aa, Mycobacterium
GYWRESGSFILFDAPAVVLAT

SEQ ID NO: 1307223 - protein, 28 aa, Mycobacterium
HAANLLRLKAFFGRQWQQMPAAQFMAVF

SEQ ID NO: 1307224 - protein, 25 aa, Mycobacterium
HADDVRLRRMAVFDVLINNADRKGG

SEQ ID NO: 1307225 - protein, 28 aa, Mycobacterium
HAERYGLDMWLRVGATWLSAVDALAALA

SEQ ID NO: 1307226 - protein, 18 aa, Mycobacterium
HAFAGTLLRDHGLLLPIE

SEQ ID NO: 1307227 - protein, 17 aa, Mycobacterium
HALICSHGVLIAHAAVV

SEQ ID NO: 1307228 - protein, 17 aa, Mycobacterium
HALLRRAHHSDRPSDTM

SEQ ID NO: 1307229 - protein, 23 aa, Mycobacterium
HANTIRLPAPLYADPSTVASMRS

SEQ ID NO: 1307230 - protein, 17 aa, Mycobacterium
HAPRRPSYRPAAPPARR

SEQ ID NO: 1307231 - protein, 17 aa, Mycobacterium
HAQFAVLADGRPVGLIS

SEQ ID NO: 1307232 - protein, 17 aa, Mycobacterium
HARIAKLLGIKHFVAAV

SEQ ID NO: 1307233 - protein, 26 aa, Mycobacterium
HARSWTTEIAPPWARPLIAANANPTL

SEQ ID NO: 1307234 - protein, 23 aa, Mycobacterium
HASMMVDLCAMQRFAGPEEIAAP

SEQ ID NO: 1307235 - protein, 23 aa, Mycobacterium
HATRIRLLDRMKDRWRDDLLADG

SEQ ID NO: 1307236 - protein, 23 aa, Mycobacterium
HAVSDWCRFNSAGPLFIDPGSPC

SEQ ID NO: 1307237 - protein, 18 aa, Mycobacterium
HAVWFTETWGRYNAALDR

SEQ ID NO: 1307238 - protein, 25 aa, Mycobacterium
HAYGRAIDLNPLLNPYIGGSGAVEP

SEQ ID NO: 1307239 - protein, 25 aa, Mycobacterium
HDDELLVLDLLLQEKILVVQGTGFN

SEQ ID NO: 1307240 - protein, 23 aa, Mycobacterium
HDDLFDFFYEALPGYDQVGLRRT

SEQ ID NO: 1307241 - protein, 18 aa, Mycobacterium
HDEAGVPAPLRWGEYRPG

SEQ ID NO: 1307242 - protein, 24 aa, Mycobacterium
HDGLKALLRRLLGSGRLGSHNGLP

SEQ ID NO: 1307243 - protein, 24 aa, Mycobacterium
HDGLRRFGDRWVRWGDTIADKIEA

SEQ ID NO: 1307244 - protein, 22 aa, Mycobacterium
HDLDFAAVLGDRRIDIGTPTVT

SEQ ID NO: 1307245 - protein, 23 aa, Mycobacterium
HDLDRIFLVAPASTPERLAKTVQ

SEQ ID NO: 1307246 - protein, 23 aa, Mycobacterium
HDPLVEIPIQWALDDWEQYCFLP

SEQ ID NO: 1307247 - protein, 17 aa, Mycobacterium
HDPSVMVYAPLRTLIYE

SEQ ID NO: 1307248 - protein, 18 aa, Mycobacterium
HDRYFLERVSDVTYALTG

SEQ ID NO: 1307249 - protein, 26 aa, Mycobacterium
HDTDDLIPLRLAIPAQFRAEGDPDTP

SEQ ID NO: 1307250 - protein, 28 aa, Mycobacterium
HDVDYWKKGLRHSVYFTHGIRNAVDNGH

SEQ ID NO: 1307251 - protein, 26 aa, Mycobacterium
HEEDTYRFYFCSTACLRQFADRVGDM

SEQ ID NO: 1307252 - protein, 26 aa, Mycobacterium
HEIGHYYFYRLIGPSPTYLEGFNELF

SEQ ID NO: 1307253 - protein, 19 aa, Mycobacterium
HELEPVVEKLLNRHLTMHK

SEQ ID NO: 1307254 - protein, 32 aa, Mycobacterium
HEPVGVVGAIVPWNFPFEVTVNKLGPALAAGN

SEQ ID NO: 1307255 - protein, 24 aa, Mycobacterium
HFDNPSPHIPWDSLPVRVVDEAVP

SEQ ID NO: 1307256 - protein, 24 aa, Mycobacterium
HFDVMCPFAYQTSRWIRSVRDQTG

SEQ ID NO: 1307257 - protein, 19 aa, Mycobacterium
HFPTREALLAELYRDDVDA

SEQ ID NO: 1307258 - protein, 28 aa, Mycobacterium
HGAIGVTVEHPLWLSTMRARSCVDEFGT

SEQ ID NO: 1307259 - protein, 31 aa, Mycobacterium
HGDGAALTILTFGNGLWMSLRVARRLERLHI

SEQ ID NO: 1307260 - protein, 17 aa, Mycobacterium
HGELLDRAAWRRFQVRL

SEQ ID NO: 1307261 - protein, 18 aa, Mycobacterium
HGELLTLAPFGTADGVVA

SEQ ID NO: 1307262 - protein, 18 aa, Mycobacterium
HGGAWKAELRALRSAVQA

SEQ ID NO: 1307263 - protein, 19 aa, Mycobacterium
HGGMFGEVGTYLPGRRITG

SEQ ID NO: 1307264 - protein, 25 aa, Mycobacterium
HGGPQEIFLDLAPNKPTILRNVELK

SEQ ID NO: 1307265 - protein, 19 aa, Mycobacterium
HGQRYMARLFDYVEQGDLD

SEQ ID NO: 1307266 - protein, 26 aa, Mycobacterium
HGRIDGRYLDRGLLRTWSRMAKLCPT

SEQ ID NO: 1307267 - protein, 24 aa, Mycobacterium
HGVSNAFYLYLRDPDGHRVEIYTQ

SEQ ID NO: 1307268 - protein, 26 aa, Mycobacterium
HHELGWFARQALRLFDDLRLEHGRLD

SEQ ID NO: 1307269 - protein, 17 aa, Mycobacterium
HHFGMEEFDLAYDVFSR

SEQ ID NO: 1307270 - protein, 33 aa, Mycobacterium
HHMQIMGRKVVRMFPIPPIALGLRTGIAIVTYA

SEQ ID NO: 1307271 - protein, 20 aa, Mycobacterium
HHTYAGTPGVIFDHSPRRGS

SEQ ID NO: 1307272 - protein, 19 aa, Mycobacterium
HHVLGYLADRFGFQVIGAI

SEQ ID NO: 1307273 - protein, 26 aa, Mycobacterium
HIAARPAITLSWIRELPALGARATPM

SEQ ID NO: 1307274 - protein, 19 aa, Mycobacterium
HIFVLFGATGDLAKRKLFP

SEQ ID NO: 1307275 - protein, 17 aa, Mycobacterium
HIRPIVTQTDDQKWRAQ

SEQ ID NO: 1307276 - protein, 17 aa, Mycobacterium
HISLLLAKEFAMTGTRI

SEQ ID NO: 1307277 - protein, 20 aa, Mycobacterium
HKPSPASWPDLVNRQFRAEA

SEQ ID NO: 1307278 - protein, 18 aa, Mycobacterium
HKPVFLMNAAANRDPRAF

SEQ ID NO: 1307279 - protein, 24 aa, Mycobacterium
HKSLTMFLDPLDSPGVEIQPLRTV

SEQ ID NO: 1307280 - protein, 24 aa, Mycobacterium
HKTRTVWPTMFNPSTYLGMVKLGV

SEQ ID NO: 1307281 - protein, 20 aa, Mycobacterium
HKVNLLFFTGDAMARPLLDA

SEQ ID NO: 1307282 - protein, 28 aa, Mycobacterium
HLAQAPTPAKLWILTRNAQPIDEGDRAN

SEQ ID NO: 1307283 - protein, 20 aa, Mycobacterium
HLAVPRSRQATVRSLIAALA

SEQ ID NO: 1307284 - protein, 23 aa, Mycobacterium
HLCERLLSFASPLHLYAEEIEPR

SEQ ID NO: 1307285 - protein, 18 aa, Mycobacterium
HLDDRAMRLHISGRLAAS

SEQ ID NO: 1307286 - protein, 29 aa, Mycobacterium
HLELASLAIALKRRVLVLQAVEHAQLEGA

SEQ ID NO: 1307287 - protein, 17 aa, Mycobacterium
HLFDALGVDWEQAVASA

SEQ ID NO: 1307288 - protein, 21 aa, Mycobacterium
HLGGVLYLFVRGMCGASTPVV

SEQ ID NO: 1307289 - protein, 27 aa, Mycobacterium
HLKSVVYELLWFLRGESNVRWLQEHGV

SEQ ID NO: 1307290 - protein, 17 aa, Mycobacterium
HLLPNMVATGPLRVADL

SEQ ID NO: 1307291 - protein, 23 aa, Mycobacterium
HLLVDPKFLADAATDLLPIYAAA

SEQ ID NO: 1307292 - protein, 33 aa, Mycobacterium
HLRVDGWPNQRFALLFPAWLAAHPEVRDEYLQV

SEQ ID NO: 1307293 - protein, 26 aa, Mycobacterium
HLSSLLYGIPHVLTAHSLEPMRPWKA

SEQ ID NO: 1307294 - protein, 20 aa, Mycobacterium
HLVAILTYAPASAIGRIFSP

SEQ ID NO: 1307295 - protein, 17 aa, Mycobacterium
HLVGQRPAGPTPAFAEH

SEQ ID NO: 1307296 - protein, 20 aa, Mycobacterium
HLVKFVACDGALWAVKELPP

SEQ ID NO: 1307297 - protein, 24 aa, Mycobacterium
HLVVPTPRLFGIPAIADNLDKVAA

SEQ ID NO: 1307298 - protein, 26 aa, Mycobacterium
HMITQYAWGSIWTRPGLDFRSRSMIT

SEQ ID NO: 1307299 - protein, 18 aa, Mycobacterium
HMLARLIGPVRTRDLMFT

SEQ ID NO: 1307300 - protein, 24 aa, Mycobacterium
HMVRLLRHVYNVSGIPRLTSDADT

SEQ ID NO: 1307301 - protein, 18 aa, Mycobacterium
HNCDFSALLPAARAVRES

SEQ ID NO: 1307302 - protein, 24 aa, Mycobacterium
HNGPVRYHSLLVAAWRGEPAEAMR

SEQ ID NO: 1307303 - protein, 18 aa, Mycobacterium
HNPIGIIVPCHRVIGANG

SEQ ID NO: 1307304 - protein, 18 aa, Mycobacterium
HPAGLPFIGAGLALAAAG

SEQ ID NO: 1307305 - protein, 20 aa, Mycobacterium
HPDARIVLCSSVSGLWGGHG

SEQ ID NO: 1307306 - protein, 20 aa, Mycobacterium
HPDLTALAPLLGTWSGKGSG

SEQ ID NO: 1307307 - protein, 19 aa, Mycobacterium
HPEIYDRLVHWLGGRAQRL

SEQ ID NO: 1307308 - protein, 23 aa, Mycobacterium
HPGRLVPNFLRRAIAYMEDNATA

SEQ ID NO: 1307309 - protein, 26 aa, Mycobacterium
HPHEALFGLLAILHGVSSRELRLLQV

SEQ ID NO: 1307310 - protein, 18 aa, Mycobacterium
HPIVHYLHRPIPRDELIA

SEQ ID NO: 1307311 - protein, 18 aa, Mycobacterium
HPKHCARESRRGPPSTPR

SEQ ID NO: 1307312 - protein, 20 aa, Mycobacterium
HPLRSDIPIMLGAEGPKNVA

SEQ ID NO: 1307313 - protein, 17 aa, Mycobacterium
HPMRFLGGEGPAVTFVA

SEQ ID NO: 1307314 - protein, 18 aa, Mycobacterium
HPNGAHSFYVPAQLFPTA

SEQ ID NO: 1307315 - protein, 18 aa, Mycobacterium
HPVPLDPVSWNALQRSLD

SEQ ID NO: 1307316 - protein, 35 aa, Mycobacterium
HRAIARFRRRHLAALTPLFVQALAWCRGAGVDRLG

SEQ ID NO: 1307317 - protein, 17 aa, Mycobacterium
HRARAVILAMGAAARHL

SEQ ID NO: 1307318 - protein, 20 aa, Mycobacterium
HRASIERFYDCDDAMQLCLV

SEQ ID NO: 1307319 - protein, 18 aa, Mycobacterium
HRFTITLAYMAPTVGQLT

SEQ ID NO: 1307320 - protein, 18 aa, Mycobacterium
HRGDPFDLHLMIFGDSTA

SEQ ID NO: 1307321 - protein, 25 aa, Mycobacterium
HRGSYLQMHFALDAAPTFAAPYEML

SEQ ID NO: 1307322 - protein, 18 aa, Mycobacterium
HRILDPAAGPLIGIKLHI

SEQ ID NO: 1307323 - protein, 18 aa, Mycobacterium
HRLTGSRTLVPFGPVADA

SEQ ID NO: 1307324 - protein, 20 aa, Mycobacterium
HRMEVAWNPEFLREGKAIED

SEQ ID NO: 1307325 - protein, 24 aa, Mycobacterium
HRMLSHLRRRLTHGVLTVTASEHR

SEQ ID NO: 1307326 - protein, 24 aa, Mycobacterium
HRNGDPLRLPAPQPDPVAPALTAP

SEQ ID NO: 1307327 - protein, 17 aa, Mycobacterium
HRPQPPKDMLRNLFGLT

SEQ ID NO: 1307328 - protein, 23 aa, Mycobacterium
HRRWPGLIEAYRDRLPVGDDWTP

SEQ ID NO: 1307329 - protein, 17 aa, Mycobacterium
HRSMWASGDYPRLAAEL

SEQ ID NO: 1307330 - protein, 22 aa, Mycobacterium
HSAHYYFRDFWGADSGMLAALH

SEQ ID NO: 1307331 - protein, 30 aa, Mycobacterium
HSGDRHALLMAAVLMRHPLRRIAEMADPDG

SEQ ID NO: 1307332 - protein, 18 aa, Mycobacterium
HSIGVWPVLLNDETVVEE

SEQ ID NO: 1307333 - protein, 22 aa, Mycobacterium
HSRRLDVALFVNGVPLAVLEFK

SEQ ID NO: 1307334 - protein, 24 aa, Mycobacterium
HTARRYGIPWELFDDFLASMRMDL

SEQ ID NO: 1307335 - protein, 25 aa, Mycobacterium
HTDHGLMLEAFLDRDVDALLATSRD

SEQ ID NO: 1307336 - protein, 19 aa, Mycobacterium
HTFALILAVTRRVVDGDRF

SEQ ID NO: 1307337 - protein, 17 aa, Mycobacterium
HTLFAHRSMVELGMAPG

SEQ ID NO: 1307338 - protein, 27 aa, Mycobacterium
HTLHLDNRVTLLDALREHLGVTAPKKG

SEQ ID NO: 1307339 - protein, 17 aa, Mycobacterium
HTLISTVPTAANAGFYA

SEQ ID NO: 1307340 - protein, 21 aa, Mycobacterium
HTLSHLLIRQAAMSSGYGSAS

SEQ ID NO: 1307341 - protein, 23 aa, Mycobacterium
HTRPGAMPRLVPPWQPMTVVAET

SEQ ID NO: 1307342 - protein, 19 aa, Mycobacterium
HTSLRYFNVVGSGSTALFD

SEQ ID NO: 1307343 - protein, 23 aa, Mycobacterium
HVALYLGNGQMLEAPYTGSVVKV

SEQ ID NO: 1307344 - protein, 21 aa, Mycobacterium
HVEVALKHPIKLIANALGSPP

SEQ ID NO: 1307345 - protein, 17 aa, Mycobacterium
HVGPLIAKGLPVVTVAA

SEQ ID NO: 1307346 - protein, 17 aa, Mycobacterium
HVGWLDDRKWAYVRLEG

SEQ ID NO: 1307347 - protein, 17 aa, Mycobacterium
HVIPWPYGPTHASNLNC

SEQ ID NO: 1307348 - protein, 20 aa, Mycobacterium
HVLAAFGLVGVRPVPLGSSW

SEQ ID NO: 1307349 - protein, 32 aa, Mycobacterium
HVLESLIRGEWRPLYLFADRPQPLIDLEVGSW

SEQ ID NO: 1307350 - protein, 19 aa, Mycobacterium
HVNPRHRVDAPLTAREVVL

SEQ ID NO: 1307351 - protein, 17 aa, Mycobacterium
HVPARADIGLWSFLTRF

SEQ ID NO: 1307352 - protein, 19 aa, Mycobacterium
HVPCAGLVIGAWPAQPGAA

SEQ ID NO: 1307353 - protein, 26 aa, Mycobacterium
HVRGRGLLIGIALRAAAAKPAETAAR

SEQ ID NO: 1307354 - protein, 26 aa, Mycobacterium
HVRIIQEFVKKLPAWVSWERRDHYER

SEQ ID NO: 1307355 - protein, 26 aa, Mycobacterium
HVRIIQEFVRKLPAWVSWERRDHYER

SEQ ID NO: 1307356 - protein, 24 aa, Mycobacterium
HVSPIFGTFDRMPPTLIMASDREV

SEQ ID NO: 1307357 - protein, 17 aa, Mycobacterium
HVVPYPYGPTHPSNLNC

SEQ ID NO: 1307358 - protein, 26 aa, Mycobacterium
HVVRDELRRAIPADLLARRRFDADAL

SEQ ID NO: 1307359 - protein, 25 aa, Mycobacterium
HWPAFVKSFLRLTTMIRKAATYPNG

SEQ ID NO: 1307360 - protein, 21 aa, Mycobacterium
HWSVRWVALHLTEELTRHAGH

SEQ ID NO: 1307361 - protein, 19 aa, Mycobacterium
HYEPVGVVGAITPWNVPFY

SEQ ID NO: 1307362 - protein, 23 aa, Mycobacterium
HYLDTTPLEPIIERWLDKTRRDK

SEQ ID NO: 1307363 - protein, 28 aa, Mycobacterium
HYLKQAVVLFPYREKAAAFYEASVHQWP

SEQ ID NO: 1307364 - protein, 23 aa, Mycobacterium
HYRPLFPDVPDDLPYVWPASDRE

SEQ ID NO: 1307365 - protein, 17 aa, Mycobacterium
IAAALGFYEVEQEVCTR

SEQ ID NO: 1307366 - protein, 18 aa, Mycobacterium
IAAGQVWVLDSRQQKWVL

SEQ ID NO: 1307367 - protein, 20 aa, Mycobacterium
IAAKLFGFPTVIAHGMFSAA

SEQ ID NO: 1307368 - protein, 22 aa, Mycobacterium
IAARLPGFLMDVPTILGGVVTG

SEQ ID NO: 1307369 - protein, 25 aa, Mycobacterium
IADFPDRPLNLLATANAVMGVAYLH

SEQ ID NO: 1307370 - protein, 23 aa, Mycobacterium
IADHRWRVVAKEQILAMLAPRHD

SEQ ID NO: 1307371 - protein, 25 aa, Mycobacterium
IAEGWQPVFFYPEKADAVWGDALRA

SEQ ID NO: 1307372 - protein, 25 aa, Mycobacterium
IAESTWHRWLAQYGGMKANDAKRLK

SEQ ID NO: 1307373 - protein, 21 aa, Mycobacterium
IAGIGPWAKLLRFRDDLDRLL

SEQ ID NO: 1307374 - protein, 17 aa, Mycobacterium
IAHIGGSIYAFEAPLLL

SEQ ID NO: 1307375 - protein, 22 aa, Mycobacterium
IANPLGVVPVVRLLNSDRILDE

SEQ ID NO: 1307376 - protein, 29 aa, Mycobacterium
IAREVLEHCIWYFLRPGGAPVVVVADDDE

SEQ ID NO: 1307377 - protein, 24 aa, Mycobacterium
IARPYPTPIICALLGAPREDWHLF

SEQ ID NO: 1307378 - protein, 28 aa, Mycobacterium
IARRLQLLADALHFPWKINAGVTAVDLM

SEQ ID NO: 1307379 - protein, 24 aa, Mycobacterium
IASGPTPGFGMWVKIRAADGTVTL

SEQ ID NO: 1307380 - protein, 25 aa, Mycobacterium
IASSTRYDWILADLAIMCAGGATTT

SEQ ID NO: 1307381 - protein, 24 aa, Mycobacterium
IATDHLMRFPGRFADQLLAEHLQK

SEQ ID NO: 1307382 - protein, 24 aa, Mycobacterium
IATEDLVYLLRDSGIDCDVDLQGA

SEQ ID NO: 1307383 - protein, 26 aa, Mycobacterium
IATQHRRSYWLYVIDQCADGVGRFFG

SEQ ID NO: 1307384 - protein, 25 aa, Mycobacterium
IAWCGHCQLGPLLLCRDGPVVGYDV

SEQ ID NO: 1307385 - protein, 18 aa, Mycobacterium
IDALIRQGAADLTIVSNN

SEQ ID NO: 1307386 - protein, 26 aa, Mycobacterium
IDATLADAAWLPSKWRRLTEDCLAKH

SEQ ID NO: 1307387 - protein, 17 aa, Mycobacterium
IDAVDLIQRFPNVLVLR

SEQ ID NO: 1307388 - protein, 23 aa, Mycobacterium
IDCPPSLGVLTLNGLTAAHEVIV

SEQ ID NO: 1307389 - protein, 20 aa, Mycobacterium
IDDAKILHAVEEAGYSAVPV

SEQ ID NO: 1307390 - protein, 22 aa, Mycobacterium
IDDEAVMKFYEALRPHRSTAAE

SEQ ID NO: 1307391 - protein, 18 aa, Mycobacterium
IDDVPLPGPLPAVTVFSA

SEQ ID NO: 1307392 - protein, 17 aa, Mycobacterium
IDDVRVWRLDPDRIARA

SEQ ID NO: 1307393 - protein, 19 aa, Mycobacterium
IDEWCGTYPGRMIPQALPP

SEQ ID NO: 1307394 - protein, 19 aa, Mycobacterium
IDGCDAIVALAPVLTEYAK

SEQ ID NO: 1307395 - protein, 17 aa, Mycobacterium
IDGDAIMVVLALAMRES

SEQ ID NO: 1307396 - protein, 26 aa, Mycobacterium
IDGWSLPLFVGEMLTLYRAGGDPGAL

SEQ ID NO: 1307397 - protein, 19 aa, Mycobacterium
IDHLVLGSSVPWLMPPALS

SEQ ID NO: 1307398 - protein, 32 aa, Mycobacterium
IDLGIPCRIFPQWLRCTGCGLLAPVSHNRFIY

SEQ ID NO: 1307399 - protein, 17 aa, Mycobacterium
IDNLTIVPAARSTLDRL

SEQ ID NO: 1307400 - protein, 20 aa, Mycobacterium
IDPRRLMVSIGLALGSTEEI

SEQ ID NO: 1307401 - protein, 28 aa, Mycobacterium
IDPRVRADEYWPTLAAQLAEAAPTNNIP

SEQ ID NO: 1307402 - protein, 19 aa, Mycobacterium
IDQALLNHVLVGIADAGSA

SEQ ID NO: 1307403 - protein, 19 aa, Mycobacterium
IDSPLVWVLDPIDGTFNYA

SEQ ID NO: 1307404 - protein, 34 aa, Mycobacterium
IDVMGFGKPLDDLPMLLQPGVLSLAWGSVVRQLA

SEQ ID NO: 1307405 - protein, 27 aa, Mycobacterium
IDWKIVAGFMREQIPLQLPAGTGSDVA

SEQ ID NO: 1307406 - protein, 20 aa, Mycobacterium
IEDLLQVFGVPKRPTKNFNT

SEQ ID NO: 1307407 - protein, 17 aa, Mycobacterium
IEPACRAAQLLEQLHEH

SEQ ID NO: 1307408 - protein, 17 aa, Mycobacterium
IEQLTRAALEVSGVGSP

SEQ ID NO: 1307409 - protein, 17 aa, Mycobacterium
IERFANPGVRDTIARLC

SEQ ID NO: 1307410 - protein, 21 aa, Mycobacterium
IERHYRDCRILGIGGGTNEIM

SEQ ID NO: 1307411 - protein, 22 aa, Mycobacterium
IGAPRWDTAIIGLDWETTVLDE

SEQ ID NO: 1307412 - protein, 17 aa, Mycobacterium
IGCTLPEVFDHARPGEK

SEQ ID NO: 1307413 - protein, 23 aa, Mycobacterium
IGEADRLFGWNRSGPRPQDHPGL

SEQ ID NO: 1307414 - protein, 24 aa, Mycobacterium
IGELAAETLYPQANSWYLGANIPG

SEQ ID NO: 1307415 - protein, 38 aa, Mycobacterium
IGGPAPLDRLLRLVPARLATAPWWLRAVDPVASRLVRG

SEQ ID NO: 1307416 - protein, 17 aa, Mycobacterium
IGGSWRRAGDGGTRQII

SEQ ID NO: 1307417 - protein, 24 aa, Mycobacterium
IGGVHAREWVPPDALLSFAEKLVE

SEQ ID NO: 1307418 - protein, 21 aa, Mycobacterium
IGHTQPRRLAARTVAQRIADE

SEQ ID NO: 1307419 - protein, 18 aa, Mycobacterium
IGLGNMGAPMAKRLTGWP

SEQ ID NO: 1307420 - protein, 25 aa, Mycobacterium
IGMVFQHFNLFPHRTALGNIIEAPV

SEQ ID NO: 1307421 - protein, 21 aa, Mycobacterium
IGQALAVRVFTRFVFGFGLDD

SEQ ID NO: 1307422 - protein, 21 aa, Mycobacterium
IGSRWLAHYTATTTFLDTFAY

SEQ ID NO: 1307423 - protein, 24 aa, Mycobacterium
IGTVYFERDRLPFRYLNDPEKTAA

SEQ ID NO: 1307424 - protein, 25 aa, Mycobacterium
IGVGEDGEWPLFLDVWVEHAVEDVA

SEQ ID NO: 1307425 - protein, 18 aa, Mycobacterium
IGWLASHLSTKRPRALVV

SEQ ID NO: 1307426 - protein, 17 aa, Mycobacterium
IGYPAWTGGSAQYIVGY

SEQ ID NO: 1307427 - protein, 29 aa, Mycobacterium
IHDVDYWKKGLRHSVYFTHGIRNAVDNGH

SEQ ID NO: 1307428 - protein, 18 aa, Mycobacterium
IHNSLTRLLIKPSHLAGG

SEQ ID NO: 1307429 - protein, 31 aa, Mycobacterium
IHRDWNARYTWPRFVCGLPREFFAAVRAEMS

SEQ ID NO: 1307430 - protein, 18 aa, Mycobacterium
IHYYMPVRITTAAGAGFD

SEQ ID NO: 1307431 - protein, 23 aa, Mycobacterium
IIDAALDGVLFLDEAYALVSTGA

SEQ ID NO: 1307432 - protein, 18 aa, Mycobacterium
IIDRPAKAAALREFAHQA

SEQ ID NO: 1307433 - protein, 34 aa, Mycobacterium
IIELFEERKPIDESLWAGVRQQKYAALIQYQMSM

SEQ ID NO: 1307434 - protein, 17 aa, Mycobacterium
IIGVHNWHLALFDQKAQ

SEQ ID NO: 1307435 - protein, 17 aa, Mycobacterium
IIRSFEPGEDWFWNYET

SEQ ID NO: 1307436 - protein, 17 aa, Mycobacterium
IITHGWPGSVVEFDKVI

SEQ ID NO: 1307437 - protein, 29 aa, Mycobacterium
IKATKLVAEWPIRDYIPDPDPIGTIYFAE

SEQ ID NO: 1307438 - protein, 23 aa, Mycobacterium
IKGFAAPFTLRVIADLLGVPDED

SEQ ID NO: 1307439 - protein, 17 aa, Mycobacterium
IKTVLSVRYGYIPKHLN

SEQ ID NO: 1307440 - protein, 35 aa, Mycobacterium
ILAPQGLEYVLAFLGAMQAGLVAVPLPLPHRGSGH

SEQ ID NO: 1307441 - protein, 19 aa, Mycobacterium
ILCDLVLIRGALSTKALRL

SEQ ID NO: 1307442 - protein, 20 aa, Mycobacterium
ILCRDQPLILAIDDVQWVDV

SEQ ID NO: 1307443 - protein, 27 aa, Mycobacterium
ILDCGTSITSPLFPAIAKHVNCLVVVA

SEQ ID NO: 1307444 - protein, 23 aa, Mycobacterium
ILDGERGALLFFAAEAASAQLLN

SEQ ID NO: 1307445 - protein, 19 aa, Mycobacterium
ILDRAVTLVPAPTRRIAAR

SEQ ID NO: 1307446 - protein, 19 aa, Mycobacterium
ILDVTVAVGADFRSARTAF

SEQ ID NO: 1307447 - protein, 20 aa, Mycobacterium
ILGLAVDTIMISPGAAEVRY

SEQ ID NO: 1307448 - protein, 18 aa, Mycobacterium
ILIALRATDEFKAHVKIG

SEQ ID NO: 1307449 - protein, 17 aa, Mycobacterium
ILRTHTGGEKRVSASGG

SEQ ID NO: 1307450 - protein, 25 aa, Mycobacterium
ILRVAPLSVAGLLRTRLFEHATTVL

SEQ ID NO: 1307451 - protein, 19 aa, Mycobacterium
ILSSVIHQLWAITYGSTLE

SEQ ID NO: 1307452 - protein, 18 aa, Mycobacterium
ILVGERLATAPGALTAAA

SEQ ID NO: 1307453 - protein, 17 aa, Mycobacterium
IMPARRAVFTRYELVDG

SEQ ID NO: 1307454 - protein, 19 aa, Mycobacterium
IMQRLLPVYRADPGAYDLS

SEQ ID NO: 1307455 - protein, 39 aa, Mycobacterium
IMTPPSHILGLLNIVMALETGTWIRLHPRFDIDTMLHHV

SEQ ID NO: 1307456 - protein, 19 aa, Mycobacterium
INAKMPKWLHSHPYNDMLG

SEQ ID NO: 1307457 - protein, 28 aa, Mycobacterium
INNHVVHGILVTTNFFGVNTIPIGLNEA

SEQ ID NO: 1307458 - protein, 18 aa, Mycobacterium
IPALLAGCTVVVKPAPES

SEQ ID NO: 1307459 - protein, 19 aa, Mycobacterium
IPEVAGMAAFLLMAGHETT

SEQ ID NO: 1307460 - protein, 22 aa, Mycobacterium
IPGVYALDRELFLHLRANAGVT

SEQ ID NO: 1307461 - protein, 27 aa, Mycobacterium
IPHENLYGFAWNPMTLVGILQNIKGAD

SEQ ID NO: 1307462 - protein, 33 aa, Mycobacterium; identical to SEQ ID NO: 1242238

SEQ ID NO: 1307463 - protein, 21 aa, Mycobacterium
IPRLRRVLVAPCTTTVRGLAS

SEQ ID NO: 1307464 - protein, 32 aa, Mycobacterium
IPTDPDLWRVDRYLDFLAARRELLAASAQRFL

SEQ ID NO: 1307465 - protein, 26 aa, Mycobacterium
IPVIADIHFQPKYIFAAIDAGCAAVR

SEQ ID NO: 1307466 - protein, 17 aa, Mycobacterium
IPVLSLVDCPGYMVGPA

SEQ ID NO: 1307467 - protein, 18 aa, Mycobacterium
IPVRFPVSPPGDDRGWHI

SEQ ID NO: 1307468 - protein, 19 aa, Mycobacterium
IQFVFAYDVGEFAETLRAI

SEQ ID NO: 1307469 - protein, 24 aa, Mycobacterium
IRALTVQFGQRFAPLPEGPPSGDP

SEQ ID NO: 1307470 - protein, 17 aa, Mycobacterium
IREGAVAAWPGAWQGQN

SEQ ID NO: 1307471 - protein, 17 aa, Mycobacterium
IREMVARYLAGASIRSL

SEQ ID NO: 1307472 - protein, 19 aa, Mycobacterium
IRGLGADVVLPLTDGWRQA

SEQ ID NO: 1307473 - protein, 34 aa, Mycobacterium
IRGMHLAYDLLEPWELLVLVDALPDRGAPGTLHV

SEQ ID NO: 1307474 - protein, 31 aa, Mycobacterium
IRGPRNHFQLAPSPNYLFIAGGIGITPIRAM

SEQ ID NO: 1307475 - protein, 26 aa, Mycobacterium
IRKNLFDLLDKFSLARFPRIEEASTF

SEQ ID NO: 1307476 - protein, 27 aa, Mycobacterium
IRPEPPAPPVAPPPAPAPPPSPPPVRP

SEQ ID NO: 1307477 - protein, 27 aa, Mycobacterium
IRPGYEWPGHKPGQYVRLGLVIDGRYH

SEQ ID NO: 1307478 - protein, 20 aa, Mycobacterium
IRPHIGEVYALEDVTAALRQ

SEQ ID NO: 1307479 - protein, 17 aa, Mycobacterium
IRRVVYDPSSWTSAPSR

SEQ ID NO: 1307480 - protein, 24 aa, Mycobacterium
IRSIGLRLGVPWYAYDTITFTGEV

SEQ ID NO: 1307481 - protein, 33 aa, Mycobacterium
IRVEEVFFHCAKAFLRSGAWNPESWTPDAVPSV

SEQ ID NO: 1307482 - protein, 18 aa, Mycobacterium
IRVRGLTYAYLKAAEPAV

SEQ ID NO: 1307483 - protein, 26 aa, Mycobacterium
ISDLGPAFFTKYLYFAGAGHPDHPCC

SEQ ID NO: 1307484 - protein, 34 aa, Mycobacterium
ISEEVLVWQRRPLDPIYPVIYLDAIVVKVKDGGH

SEQ ID NO: 1307485 - protein, 29 aa, Mycobacterium
ISEVEYRQLRLERVVLVGVWTDGSAADAE

SEQ ID NO: 1307486 - protein, 27 aa, Mycobacterium
ISLTPLEFDLLVALARKPRQVFTRDVL

SEQ ID NO: 1307487 - protein, 23 aa, Mycobacterium
ISPPVELGLLFTLNGVGGIVGAN

SEQ ID NO: 1307488 - protein, 19 aa, Mycobacterium
ISSDCVAAVFGGWTSSSRK

SEQ ID NO: 1307489 - protein, 22 aa, Mycobacterium
ISVGCNNTCTFCIVPSLRGKEV

SEQ ID NO: 1307490 - protein, 20 aa, Mycobacterium
ISVRGNWPLVPTMDVVVPHT

SEQ ID NO: 1307491 - protein, 21 aa, Mycobacterium
ITAIPQPLRTVARAKGLRLAR

SEQ ID NO: 1307492 - protein, 17 aa, Mycobacterium
ITAPQAWNTITPADFRD

SEQ ID NO: 1307493 - protein, 24 aa, Mycobacterium
ITDAPTCPVALAFPDGPQSPLLEE

SEQ ID NO: 1307494 - protein, 24 aa, Mycobacterium
ITDIRSFHRYVVGGHLPIPKVPFA

SEQ ID NO: 1307495 - protein, 18 aa, Mycobacterium
ITGWPAVSTQPAGAIMAI

SEQ ID NO: 1307496 - protein, 37 aa, Mycobacterium
ITLAMTLRQFGLANRPALIVPLHLIEQATRQCYQAWP

SEQ ID NO: 1307497 - protein, 21 aa, Mycobacterium
ITLLAITLRLHLEGPAPWKAW

SEQ ID NO: 1307498 - protein, 25 aa, Mycobacterium
ITRRIGRWRTGYLVLSGRTIDPSTA

SEQ ID NO: 1307499 - protein, 34 aa, Mycobacterium
ITTYVRQALGVYGRIMHILATDLLYLPEEEQSAL

SEQ ID NO: 1307500 - protein, 17 aa, Mycobacterium
ITVLEPPAGRTVAYTDR

SEQ ID NO: 1307501 - protein, 24 aa, Mycobacterium
ITVRDFLEIAFAHVGLRWEDHVRF

SEQ ID NO: 1307502 - protein, 22 aa, Mycobacterium
IVADLAAFDERITERGWTFDEQ

SEQ ID NO: 1307503 - protein, 17 aa, Mycobacterium
IVDRCGQLWRADFAWPA

SEQ ID NO: 1307504 - protein, 23 aa, Mycobacterium
IVEMMRSWWPAADRGFHAARVAL

SEQ ID NO: 1307505 - protein, 17 aa, Mycobacterium
IVFLFADPAILRDIPAE

SEQ ID NO: 1307506 - protein, 17 aa, Mycobacterium
IVHAPAVILATGGLGHL

SEQ ID NO: 1307507 - protein, 18 aa, Mycobacterium
IVLDVPDEKLEELRAGLD

SEQ ID NO: 1307508 - protein, 21 aa, Mycobacterium
IVLLERFSVDDWVRAVRTHRI

SEQ ID NO: 1307509 - protein, 17 aa, Mycobacterium
IVPLGDGLSYEAALLLT

SEQ ID NO: 1307510 - protein, 20 aa, Mycobacterium
IVQIASRRPGTGRWQIVVVE

SEQ ID NO: 1307511 - protein, 24 aa, Mycobacterium
IVRELFKPLPSMVVAHYLGVPEAD

SEQ ID NO: 1307512 - protein, 20 aa, Mycobacterium
IVTQTDDQKWRAQYPGLDWH

SEQ ID NO: 1307513 - protein, 23 aa, Mycobacterium
IVVVCLFDHESVRRVLDPVADRL

SEQ ID NO: 1307514 - protein, 17 aa, Mycobacterium
IVVYPHWSGARNYQWAT

SEQ ID NO: 1307515 - protein, 22 aa, Mycobacterium
IWGRRRLAYEIAKHAEGIYAVI

SEQ ID NO: 1307516 - protein, 18 aa, Mycobacterium
IWPDLFIAGGGISRKADK

SEQ ID NO: 1307517 - protein, 26 aa, Mycobacterium
IWVHQFLAVHERAVVLHLGCGLDSRV

SEQ ID NO: 1307518 - protein, 17 aa, Mycobacterium
IYAILREARDRAKAAGA

SEQ ID NO: 1307519 - protein, 31 aa, Mycobacterium
IYLRAFEEFIHHNLVLRRGPVAAVAAFAFRV

SEQ ID NO: 1307520 - protein, 30 aa, Mycobacterium
IYPDGRFSYQLTIYIFRYGEGTVMAIMHPD

SEQ ID NO: 1307521 - protein, 41 aa, Mycobacterium
KAAKTPFFMYGADGEPLFMAGLWTTWRPKDAPKEAPPLLSC

SEQ ID NO: 1307522 - protein, 22 aa, Mycobacterium
KAALASLTRTWAAEFGANGVRV

SEQ ID NO: 1307523 - protein, 23 aa, Mycobacterium
KAARFVRTCDCFNIPIVMLVDVP

SEQ ID NO: 1307524 - protein, 21 aa, Mycobacterium
KAASPPLKPAALAKPNAAAGK

SEQ ID NO: 1307525 - protein, 32 aa, Mycobacterium
KAEIRRRYPDWERWGLAPADMLMAAAGPAMEV

SEQ ID NO: 1307526 - protein, 20 aa, Mycobacterium
KALLRRLVEAGTRVVQYGYA

SEQ ID NO: 1307527 - protein, 17 aa, Mycobacterium
KALTRRGPHRVLRGDLG

SEQ ID NO: 1307528 - protein, 21 aa, Mycobacterium
KAPLLRDAAVGGGLVDRIGFR

SEQ ID NO: 1307529 - protein, 17 aa, Mycobacterium
KARVPVALAAGLRDFAT

SEQ ID NO: 1307530 - protein, 21 aa, Mycobacterium
KATLRRLYRRPRSGALVAMES

SEQ ID NO: 1307531 - protein, 20 aa, Mycobacterium
KAVAFVKKRLEPQALVLPHC

SEQ ID NO: 1307532 - protein, 20 aa, Mycobacterium
KAVMELAGSIAQYYPARQPQ

SEQ ID NO: 1307533 - protein, 20 aa, Mycobacterium
KAYEEAIDLIFLATDPHPFD

SEQ ID NO: 1307534 - protein, 23 aa, Mycobacterium
KCLCRKHHLLKTFWTGEDGWRDE

SEQ ID NO: 1307535 - protein, 26 aa, Mycobacterium
KCLCRKHHLLKTFWTGENGWCDQQFT

SEQ ID NO: 1307536 - protein, 28 aa, Mycobacterium
KCLCRKHHLLKTFWTGENGWRDQQFTDG

SEQ ID NO: 1307537 - protein, 24 aa, Mycobacterium
KDAADLTLFLLDQDGPEPDDTERA

SEQ ID NO: 1307538 - protein, 31 aa, Mycobacterium
KDARFRDALFPVWRYHPFFTNTDLPTADADI

SEQ ID NO: 1307539 - protein, 23 aa, Mycobacterium
KDGQWVPTLIGPGDFPLSDSAVR

SEQ ID NO: 1307540 - protein, 27 aa, Mycobacterium
KDKPGLITLPGFQFARHRHWVEPNRNL

SEQ ID NO: 1307541 - protein, 18 aa, Mycobacterium
KDLPAFCQAITDQFANTP

SEQ ID NO: 1307542 - protein, 22 aa, Mycobacterium
KDPMIVLEDADVELAAHAAVWG

SEQ ID NO: 1307543 - protein, 20 aa, Mycobacterium
KDTQFFWDGVNAHELRIQKR

SEQ ID NO: 1307544 - protein, 20 aa, Mycobacterium
KEFFALPLEEKMRTYIGLSR

SEQ ID NO: 1307545 - protein, 25 aa, Mycobacterium
KEFMVRNTYIYPPKASMRIISDIFG

SEQ ID NO: 1307546 - protein, 18 aa, Mycobacterium
KEKAIAPIRAWLGGLTAD

SEQ ID NO: 1307547 - protein, 24 aa, Mycobacterium
KEPQNYVVLPEQPWLDGINAGDGF

SEQ ID NO: 1307548 - protein, 26 aa, Mycobacterium
KERERLFPVIRRYALAYHVVFIPSEE

SEQ ID NO: 1307549 - protein, 27 aa, Mycobacterium
KESLFDRALRRYLAGPSAYTAEALTRP

SEQ ID NO: 1307550 - protein, 19 aa, Mycobacterium
KEVLANHLRISRKTAGDRL

SEQ ID NO: 1307551 - protein, 17 aa, Mycobacterium
KFDYTKGFKFSTYATWW

SEQ ID NO: 1307552 - protein, 23 aa, Mycobacterium
KGLEFRCMCVAGVTAKWVPALNA

SEQ ID NO: 1307553 - protein, 23 aa, Mycobacterium
KGNEYFLRHLLGTASNLQATPTR

SEQ ID NO: 1307554 - protein, 25 aa, Mycobacterium
KGREVDWPVLVDAGWVGLEVPEHLG

SEQ ID NO: 1307555 - protein, 25 aa, Mycobacterium
KGSYYLPTIFDRCDRSMRIVTDETF

SEQ ID NO: 1307556 - protein, 26 aa, Mycobacterium
KGTKDAWMTAWGPLVEAATHGAPDVA

SEQ ID NO: 1307557 - protein, 25 aa, Mycobacterium
KGVADLIAYFFLRAHSLVRNDGLLG

SEQ ID NO: 1307558 - protein, 18 aa, Mycobacterium
KGWLATAYQRYATLLGRW

SEQ ID NO: 1307559 - protein, 19 aa, Mycobacterium
KHNGWGVPGLSWTPGEDPD

SEQ ID NO: 1307560 - protein, 23 aa, Mycobacterium
KHSLRWPRQATLVDAMIAAGLDV

SEQ ID NO: 1307561 - protein, 23 aa, Mycobacterium
KIAQAWETLMLRLGYQRYGAQGG

SEQ ID NO: 1307562 - protein, 36 aa, Mycobacterium
KIETRRAFEHLPQLLLTAMRWPRVGVMIARGDLAVE

SEQ ID NO: 1307563 - protein, 22 aa, Mycobacterium
KIPIRDLIRMAAHSRHYLAVFD

SEQ ID NO: 1307564 - protein, 30 aa, Mycobacterium
KIRRFWPHRYRRSSFYWKLIGYDQRFDIAD

SEQ ID NO: 1307565 - protein, 19 aa, Mycobacterium
KIVMRVYFEKPRTTIGWKG

SEQ ID NO: 1307566 - protein, 22 aa, Mycobacterium
KLARQPYYRWRAHPVTDAEIVE

SEQ ID NO: 1307567 - protein, 18 aa, Mycobacterium
KLEKTFPVSLGKKGYETP

SEQ ID NO: 1307568 - protein, 29 aa, Mycobacterium
KLEQAAVELTIPILLIRGKLSDVVSSEGV

SEQ ID NO: 1307569 - protein, 26 aa, Mycobacterium
KLEQQAIFRKLWLHVGRVERLPKTGS

SEQ ID NO: 1307570 - protein, 17 aa, Mycobacterium
KLFGDWRGLLQGPWAGS

SEQ ID NO: 1307571 - protein, 19 aa, Mycobacterium
KLFYGGRSTESMAFLDELA

SEQ ID NO: 1307572 - protein, 20 aa, Mycobacterium
KLIGEWLLRDMGRASGLRHT

SEQ ID NO: 1307573 - protein, 17 aa, Mycobacterium
KLKRLPADQARELGLAQ

SEQ ID NO: 1307574 - protein, 19 aa, Mycobacterium
KLRYVLVRQELDRPLLTKE

SEQ ID NO: 1307575 - protein, 29 aa, Mycobacterium
KLTSLQVHHIFPKALLRKHGLDRNEINAI

SEQ ID NO: 1307576 - protein, 22 aa, Mycobacterium
KMADFHLRVRPGTDAWCLAAMA

SEQ ID NO: 1307577 - protein, 25 aa, Mycobacterium
KNLDQLFITAAAYPPEILLTGVIVN

SEQ ID NO: 1307578 - protein, 23 aa, Mycobacterium
KNLVPTFGVFKPTLVVSVPRVFE

SEQ ID NO: 1307579 - protein, 21 aa, Mycobacterium
KNMIQAFFLDLQTINGGGSRP

SEQ ID NO: 1307580 - protein, 17 aa, Mycobacterium
KPARLDIPAWPRVPRGT

SEQ ID NO: 1307581 - protein, 28 aa, Mycobacterium
KPDPDTGLPRLGWRTPPLGGFRADPDAP

SEQ ID NO: 1307582 - protein, 21 aa, Mycobacterium
KPLHLINHPVRERIPITIAAL

SEQ ID NO: 1307583 - protein, 26 aa, Mycobacterium
KPPPQRITLTLPAVQRSREVWLVVSG

SEQ ID NO: 1307584 - protein, 19 aa, Mycobacterium
KPSDVELLIVQLRGKNLSD

SEQ ID NO: 1307585 - protein, 30 aa, Mycobacterium
KPSGPFLQKYAMPPVVTGPLYAARTIELCA

SEQ ID NO: 1307586 - protein, 18 aa, Mycobacterium
KQLNKLINVIKIVEQDED

SEQ ID NO: 1307587 - protein, 42 aa, Mycobacterium
KQPASRHWLFRHVPFYRAWFRFRLYWIYTERNYPALRVDPKA

SEQ ID NO: 1307588 - protein, 18 aa, Mycobacterium
KQQGITFVLIDMTTPGIE

SEQ ID NO: 1307589 - protein, 22 aa, Mycobacterium
KRFDTFAAATYVSGPSSSYVTA

SEQ ID NO: 1307590 - protein, 30 aa, Mycobacterium
KRGPMDRFHRRLLWPIRAAGGEVIGFGARR

SEQ ID NO: 1307591 - protein, 18 aa, Mycobacterium
KRHHHELGWFARQALRLF

SEQ ID NO: 1307592 - protein, 22 aa, Mycobacterium
KRHPMLATYRECGPLIGGDVDV

SEQ ID NO: 1307593 - protein, 22 aa, Mycobacterium
KRPLILLPAVDVVEGRAVRLVQ

SEQ ID NO: 1307594 - protein, 24 aa, Mycobacterium
KRVVSTLLLQIDRLPSHVVAVCAT

SEQ ID NO: 1307595 - protein, 33 aa, Mycobacterium
KSAYEYYTPFGWLRGFPFLAVQVVWAPGSEMSV

SEQ ID NO: 1307596 - protein, 17 aa, Mycobacterium
KTAMRRSSRATADDVPA

SEQ ID NO: 1307597 - protein, 33 aa, Mycobacterium
KTDVLAFTAFPRAHWQKIWSNNPIVIWSPAVGV

SEQ ID NO: 1307598 - protein, 22 aa, Mycobacterium
KTELIDHQPLYPGATELSLATA

SEQ ID NO: 1307599 - protein, 24 aa, Mycobacterium
KTNGRIGHHFPGAPPSLLLHTVGA

SEQ ID NO: 1307600 - protein, 17 aa, Mycobacterium
KTPGYWLAEIPEASDWR

SEQ ID NO: 1307601 - protein, 23 aa, Mycobacterium
KVARFVFGLARRYGPRFFEAGEL

SEQ ID NO: 1307602 - protein, 24 aa, Mycobacterium
KVATTLRLTRRTLRRLKAQEQRWN

SEQ ID NO: 1307603 - protein, 18 aa, Mycobacterium
KVKRRLAGMLARRGYSQS

SEQ ID NO: 1307604 - protein, 17 aa, Mycobacterium
KVPRKIWWADEIQRTPA

SEQ ID NO: 1307605 - protein, 19 aa, Mycobacterium
KVPYFSLAMIPGGGRRRAV

SEQ ID NO: 1307606 - protein, 25 aa, Mycobacterium
KVSQRFPQIIRKFSASGLMALPGEA

SEQ ID NO: 1307607 - protein, 26 aa, Mycobacterium
KVVVFRPLYAVGGQDLGYLPGSESDK

SEQ ID NO: 1307608 - protein, 17 aa, Mycobacterium
KVVVLGGGSWGTTVASI

SEQ ID NO: 1307609 - protein, 18 aa, Mycobacterium
KWGDVPTAPPVAPVDHTS

SEQ ID NO: 1307610 - protein, 20 aa, Mycobacterium
KWGGLKERLLVATASSYVVA

SEQ ID NO: 1307611 - protein, 27 aa, Mycobacterium
KWNAFDPVLIRWRLDVGDRTALLVSLS

SEQ ID NO: 1307612 - protein, 18 aa, Mycobacterium
KYHAWRYALNGDLTFIQQ

SEQ ID NO: 1307613 - protein, 25 aa, Mycobacterium
KYVGDITYLPLATGSNLYMATVIDC

SEQ ID NO: 1307614 - protein, 18 aa, Mycobacterium
LAAALRPAPARLTADSFD

SEQ ID NO: 1307615 - protein, 17 aa, Mycobacterium
LAAARFRRPGLEPPPPP

SEQ ID NO: 1307616 - protein, 17 aa, Mycobacterium
LAAFIDIRDQTCRTPYC

SEQ ID NO: 1307617 - protein, 19 aa, Mycobacterium
LAARLAPPPVAPPADLPPV

SEQ ID NO: 1307618 - protein, 19 aa, Mycobacterium
LAARYTWANRLVAVVSDGS

SEQ ID NO: 1307619 - protein, 22 aa, Mycobacterium
LAASMQPFMLPRGGGAMKATIG

SEQ ID NO: 1307620 - protein, 33 aa, Mycobacterium
LAAVGFCMGGGMVWRLLAAGEPRLAAAVPFYGP

SEQ ID NO: 1307621 - protein, 21 aa, Mycobacterium
LAAWTWQQRPVAVLAMDSETH

SEQ ID NO: 1307622 - protein, 22 aa, Mycobacterium
LAAYNAMPIRRAVHAVYECCCS

SEQ ID NO: 1307623 - protein, 23 aa, Mycobacterium
LACQPANLLIEKTGWTTQRPGNG

SEQ ID NO: 1307624 - protein, 17 aa, Mycobacterium
LADAIGYDARIGRRFLN

SEQ ID NO: 1307625 - protein, 27 aa, Mycobacterium
LADALLEPSRFPPAYRAAVLDPQATGE

SEQ ID NO: 1307626 - protein, 23 aa, Mycobacterium
LADAVLPLRWTDGGANRVRVLRG

SEQ ID NO: 1307627 - protein, 20 aa, Mycobacterium
LADTAFALACNRSAGVMGVT

SEQ ID NO: 1307628 - protein, 24 aa, Mycobacterium
LADVDLAYFTYPIADGVVPAAANY

SEQ ID NO: 1307629 - protein, 25 aa, Mycobacterium
LADVSAPVRWWHGDVDHIVPLADAQ

SEQ ID NO: 1307630 - protein, 17 aa, Mycobacterium
LAELRPGTPYLVSATAS

SEQ ID NO: 1307631 - protein, 18 aa, Mycobacterium
LAERAYDVHLLKLTNSGL

SEQ ID NO: 1307632 - protein, 17 aa, Mycobacterium
LAERRLPDHIELALYRI

SEQ ID NO: 1307633 - protein, 30 aa, Mycobacterium
LAEYSVDLFALLPLGELWVAAARLRQVERL

SEQ ID NO: 1307634 - protein, 21 aa, Mycobacterium
LAGFDAWLDSWRALGPDGAAM

SEQ ID NO: 1307635 - protein, 24 aa, Mycobacterium
LAGNQWKASPLQLALEMLAAHVQP

SEQ ID NO: 1307636 - protein, 22 aa, Mycobacterium
LAHHYLWRIRKALPTPGHIGVF

SEQ ID NO: 1307637 - protein, 19 aa, Mycobacterium
LAHPRMRTGWPGAGALTVR

SEQ ID NO: 1307638 - protein, 24 aa, Mycobacterium
LAIARRFAHLTYRGEVELDDRFGN

SEQ ID NO: 1307639 - protein, 20 aa, Mycobacterium
LAKLRCERCSWVVALNRGTV

SEQ ID NO: 1307640 - protein, 18 aa, Mycobacterium
LALDTPLPTPDGWTTMGE

SEQ ID NO: 1307641 - protein, 19 aa, Mycobacterium
LALLTDLLDRVDVPVLAAG

SEQ ID NO: 1307642 - protein, 17 aa, Mycobacterium
LALPDLASRAAGAAVVW

SEQ ID NO: 1307643 - protein, 18 aa, Mycobacterium
LAMITLTALEGAFVLCRT

SEQ ID NO: 1307644 - protein, 20 aa, Mycobacterium
LAMRRTLWVVGSGALPVIQS

SEQ ID NO: 1307645 - protein, 20 aa, Mycobacterium
LANPFYIRRAPIVDGIDEFD

SEQ ID NO: 1307646 - protein, 25 aa, Mycobacterium
LANYWHGEFPWRPDRGYGRTAPVGS

SEQ ID NO: 1307647 - protein, 19 aa, Mycobacterium
LAPFGIRHADLPLTPSRVW

SEQ ID NO: 1307648 - protein, 17 aa, Mycobacterium
LAPLWDDEILEQAIAAA

SEQ ID NO: 1307649 - protein, 27 aa, Mycobacterium
LAPQGLDYIVAFFGALQAGLIAAPLSV

SEQ ID NO: 1307650 - protein, 18 aa, Mycobacterium
LAPQLLARQFDAGAVAVT

SEQ ID NO: 1307651 - protein, 17 aa, Mycobacterium
LAPSYPAIEGQNLRGFG

SEQ ID NO: 1307652 - protein, 18 aa, Mycobacterium
LARDIVYPRFESGGVPYE

SEQ ID NO: 1307653 - protein, 25 aa, Mycobacterium
LAREALDDGLLTFRELRRFHRADFP

SEQ ID NO: 1307654 - protein, 25 aa, Mycobacterium
LARGMLEVLPLTHIRGRSLHDSFVI

SEQ ID NO: 1307655 - protein, 31 aa, Mycobacterium
LARGQILYDAPELVIPFLVPDGAHDYPDDTR

SEQ ID NO: 1307656 - protein, 24 aa, Mycobacterium
LARNRLYYTWFRADEAKGRQLLEA

SEQ ID NO: 1307657 - protein, 27 aa, Mycobacterium
LARPSVGHPWRFLDAVPSDGAVAAQIH

SEQ ID NO: 1307658 - protein, 17 aa, Mycobacterium
LARQMFARVPDPVARHL

SEQ ID NO: 1307659 - protein, 21 aa, Mycobacterium
LARRRTNVLYALIRDNRTWQP

SEQ ID NO: 1307660 - protein, 22 aa, Mycobacterium
LARYFPEVLDFVRDELAPRCVL

SEQ ID NO: 1307661 - protein, 27 aa, Mycobacterium
LASDELGLPTAPFWFAGSAEELGTVAQ

SEQ ID NO: 1307662 - protein, 21 aa, Mycobacterium
LASFETMFDTNVRGAYFLVAE

SEQ ID NO: 1307663 - protein, 26 aa, Mycobacterium
LASPVFADLGALPPSLFLVGSGEVLL

SEQ ID NO: 1307664 - protein, 23 aa, Mycobacterium
LAVDPRFALERLGNSMIPAGDKM

SEQ ID NO: 1307665 - protein, 20 aa, Mycobacterium
LAVGLLKEETARLLGIDPKR

SEQ ID NO: 1307666 - protein, 28 aa, Mycobacterium
LAVPLDDILGIPLTLQIPGQGPGAIGSL

SEQ ID NO: 1307667 - protein, 18 aa, Mycobacterium
LAVRADPGRFAKLVLLTP

SEQ ID NO: 1307668 - protein, 21 aa, Mycobacterium
LAYLQAAPVSWRIFLRPPDGA

SEQ ID NO: 1307669 - protein, 18 aa, Mycobacterium
LCEAGVPFGLKPEAIIPA

SEQ ID NO: 1307670 - protein, 22 aa, Mycobacterium
LCERLLSFSSPLHLYAEEIEPR

SEQ ID NO: 1307671 - protein, 19 aa, Mycobacterium
LCMIHGADPWWDVAIRLMI

SEQ ID NO: 1307672 - protein, 17 aa, Mycobacterium
LCTLREGLLYALVPDRS

SEQ ID NO: 1307673 - protein, 21 aa, Mycobacterium
LDAALGWQRDGAEWIHLVDLD

SEQ ID NO: 1307674 - protein, 25 aa, Mycobacterium
LDADLVILRATWDYIDRLDEFKVWT

SEQ ID NO: 1307675 - protein, 33 aa, Mycobacterium
LDDETLIRYIDRFLMFYIRTADRLQRTAPWVEQ

SEQ ID NO: 1307676 - protein, 31 aa, Mycobacterium
LDDLATRVGWRWRLVWFRAVAELLSADYESA

SEQ ID NO: 1307677 - protein, 19 aa, Mycobacterium
LDDLGVQRLRLVAGWSLGG

SEQ ID NO: 1307678 - protein, 37 aa, Mycobacterium
LDDLIGFFKDPVKGFFRALDFTLPWDVDAVQDAMPVE

SEQ ID NO: 1307679 - protein, 23 aa, Mycobacterium
LDDNGYLFIVDRIKDMIVTGGEN

SEQ ID NO: 1307680 - protein, 17 aa, Mycobacterium
LDDVLADGDLLIAVCDN

SEQ ID NO: 1307681 - protein, 25 aa, Mycobacterium
LDEFVTQLATLWLITGNGAAEIARA

SEQ ID NO: 1307682 - protein, 20 aa, Mycobacterium
LDELPQLPLGLRSLARFDAR

SEQ ID NO: 1307683 - protein, 26 aa, Mycobacterium
LDEPYAGFDWDTYLKFWDLVARRRDD

SEQ ID NO: 1307684 - protein, 27 aa, Mycobacterium
LDESLISDLILGVVSPLGDQGAVLART

SEQ ID NO: 1307685 - protein, 23 aa, Mycobacterium
LDEWNRYLAVNLTGTFLSIRSAL

SEQ ID NO: 1307686 - protein, 27 aa, Mycobacterium
LDFAVPTFEQFWRDGSLRLPTEPGLTL

SEQ ID NO: 1307687 - protein, 21 aa, Mycobacterium
LDFDLLGRLPAPLTTTVLEAS

SEQ ID NO: 1307688 - protein, 35 aa, Mycobacterium
LDGETHEIRWPRNAKLLDVLLDKGLDAPFSCREGH

SEQ ID NO: 1307689 - protein, 33 aa, Mycobacterium
LDGMHEHRLAVLWPDVYPRLLRVMTADPIFQDR

SEQ ID NO: 1307690 - protein, 29 aa, Mycobacterium
LDGRTVYNTRPWVLLPPSQTDPAPEWLVR

SEQ ID NO: 1307691 - protein, 35 aa, Mycobacterium
LDGVPHHGIGYGLLRFLYGPTARTLSPVPPPDILL

SEQ ID NO: 1307692 - protein, 18 aa, Mycobacterium
LDGWRPALASAGNAKVVV

SEQ ID NO: 1307693 - protein, 25 aa, Mycobacterium
LDILVANAGVLSWGRLWEMSEDQWS

SEQ ID NO: 1307694 - protein, 26 aa, Mycobacterium
LDKARKFRAELTMPLILLGGITNRET

SEQ ID NO: 1307695 - protein, 18 aa, Mycobacterium
LDLALRARVHALHTRLAE

SEQ ID NO: 1307696 - protein, 17 aa, Mycobacterium
LDLDGTVFRGHEPTTGA

SEQ ID NO: 1307697 - protein, 17 aa, Mycobacterium
LDLNPVDLLIRYGRIAP

SEQ ID NO: 1307698 - protein, 25 aa, Mycobacterium
LDLPAGSILRQVDYFGLGTTVATNA

SEQ ID NO: 1307699 - protein, 21 aa, Mycobacterium
LDLVWPHQQFVPLDGERRRAI

SEQ ID NO: 1307700 - protein, 39 aa, Mycobacterium
LDMAGCSLTVMWLDDELERYWRAPADTPAYRKGGAAVDN

SEQ ID NO: 1307701 - protein, 22 aa, Mycobacterium
LDPMPGVDWQQIVAVAMVAREV

SEQ ID NO: 1307702 - protein, 17 aa, Mycobacterium
LDPPVVAVLSLWTQQSY

SEQ ID NO: 1307703 - protein, 21 aa, Mycobacterium
LDPWHGAWFHPYSFTRLEVLS

SEQ ID NO: 1307704 - protein, 25 aa, Mycobacterium
LDRAAWRRFQVRLTLSAPSRAQATE

SEQ ID NO: 1307705 - protein, 30 aa, Mycobacterium
LDRAGELGLVPLHWALASLLADIGSAAYTP

SEQ ID NO: 1307706 - protein, 17 aa, Mycobacterium
LDRDFVPGLARFIRQHS

SEQ ID NO: 1307707 - protein, 26 aa, Mycobacterium
LDRTPTLFIVGGPPLRESATNPLQGG

SEQ ID NO: 1307708 - protein, 17 aa, Mycobacterium
LDRVSGGRLTLGVGVGS

SEQ ID NO: 1307709 - protein, 17 aa, Mycobacterium
LDSAWFPAAVAASHAIR

SEQ ID NO: 1307710 - protein, 22 aa, Mycobacterium
LDTAFTTRLIVLDPAQFSLRNG

SEQ ID NO: 1307711 - protein, 21 aa, Mycobacterium
LDTFAYARRAAGLPATAINWG

SEQ ID NO: 1307712 - protein, 25 aa, Mycobacterium
LDVRAFKLWAGLSGLAPRIAVVKGR

SEQ ID NO: 1307713 - protein, 17 aa, Mycobacterium
LDVSWRMHPAVCAAVSR

SEQ ID NO: 1307714 - protein, 49 aa, Mycobacterium
LDVYQRTAPWLLPRFDRPFTRAEKWAFRNVPGFLRLARAGIYTSREVQV

SEQ ID NO: 1307715 - protein, 30 aa, Mycobacterium
LDWADVTVASVYKWLLAPRGTAFLSVSERT

SEQ ID NO: 1307716 - protein, 31 aa, Mycobacterium
LEAAIEGLILGSYRFTEFRSAKTAPKDGGLR

SEQ ID NO: 1307717 - protein, 18 aa, Mycobacterium
LECVFFMRDVRSAQYFEQ

SEQ ID NO: 1307718 - protein, 32 aa, Mycobacterium
LEERDIRFVRLWFTDVLGYLKSVAIAPAELEG

SEQ ID NO: 1307719 - protein, 23 aa, Mycobacterium
LEEVLRWPTGTIAKLRRGEPTAA

SEQ ID NO: 1307720 - protein, 26 aa, Mycobacterium
LEHGDRGWYIGRTIPLSMAGGQRRRD

SEQ ID NO: 1307721 - protein, 20 aa, Mycobacterium
LEHLLDFMPRYEVDFDGLER

SEQ ID NO: 1307722 - protein, 19 aa, Mycobacterium
LELAGRLHLDLASLSLAAL

SEQ ID NO: 1307723 - protein, 20 aa, Mycobacterium
LELALCQLVGPLAFARMTGI

SEQ ID NO: 1307724 - protein, 21 aa, Mycobacterium
LELAPLTRKDLEELLAVVCGR

SEQ ID NO: 1307725 - protein, 21 aa, Mycobacterium
LELEFYLLREKAGTTHRKRAD

SEQ ID NO: 1307726 - protein, 24 aa, Mycobacterium
LELMETVILLRMTGPRSIKAAADW

SEQ ID NO: 1307727 - protein, 18 aa, Mycobacterium
LELPHLWGGLADLPTGPG

SEQ ID NO: 1307728 - protein, 18 aa, Mycobacterium
LEPLLRKRHGAWIGWAGI

SEQ ID NO: 1307729 - protein, 19 aa, Mycobacterium
LEPVMGAVGPLMQSLGKAN

SEQ ID NO: 1307730 - protein, 17 aa, Mycobacterium
LEQAGINSTLWVLEGHG

SEQ ID NO: 1307731 - protein, 27 aa, Mycobacterium
LEQTPIRSIMAFQLFIADETIGAINVY

SEQ ID NO: 1307732 - protein, 25 aa, Mycobacterium
LERDDLPIMFAACSPTLFVQSTEAV

SEQ ID NO: 1307733 - protein, 17 aa, Mycobacterium
LERFITGQIARELGATV

SEQ ID NO: 1307734 - protein, 24 aa, Mycobacterium
LERLEPVPVLRRQGVWAVAIAESV

SEQ ID NO: 1307735 - protein, 30 aa, Mycobacterium
LERWRKAGFRFSLDWLLRNATAVATGRALF

SEQ ID NO: 1307736 - protein, 23 aa, Mycobacterium
LESNYLGWSRAMAPTIMGAPEQP

SEQ ID NO: 1307737 - protein, 18 aa, Mycobacterium
LETLASGGGLIVQPLLDG

SEQ ID NO: 1307738 - protein, 24 aa, Mycobacterium
LETPLWEQSPFTAFLLGDSEIDDV

SEQ ID NO: 1307739 - protein, 18 aa, Mycobacterium
LEVYSPASPLGAALIDAK

SEQ ID NO: 1307740 - protein, 18 aa, Mycobacterium
LEWKDIQFGFGGSYEVSN

SEQ ID NO: 1307741 - protein, 31 aa, Mycobacterium
LEYGIQDAGRWRVPLLLAIRPEVGVDDVRAV

SEQ ID NO: 1307742 - protein, 27 aa, Mycobacterium
LFASYARQRPGLLVDWLAGNPADLDDD

SEQ ID NO: 1307743 - protein, 17 aa, Mycobacterium
LFAVPRLHLRHIDPDGR

SEQ ID NO: 1307744 - protein, 18 aa, Mycobacterium
LFDEVPVRTPGTLAFAPI

SEQ ID NO: 1307745 - protein, 17 aa, Mycobacterium
LFEEVPRHMLETWAFRT

SEQ ID NO: 1307746 - protein, 19 aa, Mycobacterium
LFGGRRLTPAIRSRLGLAL

SEQ ID NO: 1307747 - protein, 17 aa, Mycobacterium
LFGYVNEWCPRHGYRHP

SEQ ID NO: 1307748 - protein, 26 aa, Mycobacterium
LFIDDPWVLIEPPPMPPASAFVVEQV

SEQ ID NO: 1307749 - protein, 19 aa, Mycobacterium
LFMNEGTKKLFRPDLENPG

SEQ ID NO: 1307750 - protein, 19 aa, Mycobacterium
LFTELRSVALTRNVLLPVG

SEQ ID NO: 1307751 - protein, 30 aa, Mycobacterium
LFTEQVEIPLRRYVLWTRLRIAITRVQAGD

SEQ ID NO: 1307752 - protein, 29 aa, Mycobacterium
LGAGKTWAIMTLLFHLVDIGGQFLAIDRT

SEQ ID NO: 1307753 - protein, 19 aa, Mycobacterium
LGALRARWAQLSASPLLEN

SEQ ID NO: 1307754 - protein, 25 aa, Mycobacterium
LGATSLKRLLADRLRISDKAAGDRL

SEQ ID NO: 1307755 - protein, 19 aa, Mycobacterium
LGCRLPSVSHRLLARLQAE

SEQ ID NO: 1307756 - protein, 17 aa, Mycobacterium
LGEGSWKKVLITALRVS

SEQ ID NO: 1307757 - protein, 32 aa, Mycobacterium; identical to SEQ ID NO: 785046

SEQ ID NO: 1307758 - protein, 18 aa, Mycobacterium
LGELLRPELGVRSIPDML

SEQ ID NO: 1307759 - protein, 20 aa, Mycobacterium
LGEWAGPEWVTPIRARFRGV

SEQ ID NO: 1307760 - protein, 25 aa, Mycobacterium
LGFPGTPYLHAYTRSMTAWLCIESG

SEQ ID NO: 1307761 - protein, 18 aa, Mycobacterium
LGFTLWIASTPAVTRTLT

SEQ ID NO: 1307762 - protein, 24 aa, Mycobacterium
LGIAYLHVLIDPTHTTFGVIRALW

SEQ ID NO: 1307763 - protein, 17 aa, Mycobacterium
LGIPTVATVPWTTDRLL

SEQ ID NO: 1307764 - protein, 17 aa, Mycobacterium
LGKIPCVSYWNDERRCA

SEQ ID NO: 1307765 - protein, 19 aa, Mycobacterium
LGLERRLGAVLFKDFLALH

SEQ ID NO: 1307766 - protein, 29 aa, Mycobacterium
LGMTAPGFPNLFFLYGPNTNPPGGSWLTI

SEQ ID NO: 1307767 - protein, 31 aa, Mycobacterium
LGMVRCVRAALPLLRSASWARIVNFSAQSTQ

SEQ ID NO: 1307768 - protein, 18 aa, Mycobacterium
LGPLLSDADRRFLGCDAT

SEQ ID NO: 1307769 - protein, 19 aa, Mycobacterium
LGRAGPPEHLAWIGQWGIF

SEQ ID NO: 1307770 - protein, 20 aa, Mycobacterium
LGRGSFYKAFGDKHSMFLRS

SEQ ID NO: 1307771 - protein, 26 aa, Mycobacterium
LGRTRRLFHAVTTTGLRTPIWLITRG

SEQ ID NO: 1307772 - protein, 18 aa, Mycobacterium
LGSPWDGPTGRHAAEMLP

SEQ ID NO: 1307773 - protein, 21 aa, Mycobacterium
LGTRIARWRRAAGADEGLIAD

SEQ ID NO: 1307774 - protein, 24 aa, Mycobacterium
LGVSDDTVRRWLDDGSLAASADAS

SEQ ID NO: 1307775 - protein, 28 aa, Mycobacterium
LGWSRRLAPLMRRWALRHGSPELTVNWT

SEQ ID NO: 1307776 - protein, 26 aa, Mycobacterium
LGYRDPELLAGFWSLVEQLQISAMSA

SEQ ID NO: 1307777 - protein, 19 aa, Mycobacterium
LHLPVVCSVQGWAVGLGCN

SEQ ID NO: 1307778 - protein, 19 aa, Mycobacterium
LHPAWPLAMSVAHRDEFAD

SEQ ID NO: 1307779 - protein, 23 aa, Mycobacterium
LHPYRVRHLLDRYGSLITEVLAF

SEQ ID NO: 1307780 - protein, 19 aa, Mycobacterium
LHRRLLIISDTVEHWMDTH

SEQ ID NO: 1307781 - protein, 18 aa, Mycobacterium
LHSLTYAYRDRRARKGEF

SEQ ID NO: 1307782 - protein, 26 aa, Mycobacterium
LHSSFHAKNGPMWLLDAFRKRHAADV

SEQ ID NO: 1307783 - protein, 19 aa, Mycobacterium
LHSVACTGLMTWYPALEAV

SEQ ID NO: 1307784 - protein, 18 aa, Mycobacterium
LIDFHLDFALGESDLIRI

SEQ ID NO: 1307785 - protein, 19 aa, Mycobacterium
LIDQNGVDALWNLAADSAE

SEQ ID NO: 1307786 - protein, 18 aa, Mycobacterium
LIETFTRAYLEQVQWFRQ

SEQ ID NO: 1307787 - protein, 17 aa, Mycobacterium
LILAIDDVQWVDVCSRE

SEQ ID NO: 1307788 - protein, 17 aa, Mycobacterium
LIPERMPVLLDDDLLFE

SEQ ID NO: 1307789 - protein, 17 aa, Mycobacterium
LIPGVLAALVHRGADFA

SEQ ID NO: 1307790 - protein, 17 aa, Mycobacterium
LIREALHPYPESLALVS

SEQ ID NO: 1307791 - protein, 39 aa, Mycobacterium
LIRRRPIGPVAAITPWNFPVVLAFMKLAPALVAGNTVVL

SEQ ID NO: 1307792 - protein, 21 aa, Mycobacterium
LISEFGLAVAEPKLYRRNGPK

SEQ ID NO: 1307793 - protein, 21 aa, Mycobacterium
LISPWGTWEWMGPAAIGADLP

SEQ ID NO: 1307794 - protein, 31 aa, Mycobacterium
LITGQFLEIDRPQLLRFTWSNSNWADPTIVS

SEQ ID NO: 1307795 - protein, 20 aa, Mycobacterium
LITRPPFVAPHPTSSVAALV

SEQ ID NO: 1307796 - protein, 36 aa, Mycobacterium
LKDRPLTANLWRPGSPKWFTPLHQAAWHGAPLSVVS

SEQ ID NO: 1307797 - protein, 25 aa, Mycobacterium
LKDTADLTLFLLDQDGPEPDDTERA

SEQ ID NO: 1307798 - protein, 21 aa, Mycobacterium
LKGHPLFAHITLQRSERSPIA

SEQ ID NO: 1307799 - protein, 25 aa, Mycobacterium
LKITGPTAPSWRKGRYHIAGRGPRD

SEQ ID NO: 1307800 - protein, 20 aa, Mycobacterium
LKIVMRVYFEKPRTTIGWKG

SEQ ID NO: 1307801 - protein, 29 aa, Mycobacterium
LKKELRLKPGDWYVIHSYAGYENKVKANL

SEQ ID NO: 1307802 - protein, 25 aa, Mycobacterium
LKLINHPVRERIPISIASLGPRMVE

SEQ ID NO: 1307803 - protein, 18 aa, Mycobacterium
LKPITHPLRSDIPIMLGA

SEQ ID NO: 1307804 - protein, 26 aa, Mycobacterium
LKQRTDLRLIVVDYLQLMTSGKRVES

SEQ ID NO: 1307805 - protein, 18 aa, Mycobacterium
LKQRVATLAGLDASALHE

SEQ ID NO: 1307806 - protein, 18 aa, Mycobacterium
LKVAVVCKSLFGKAHTVM

SEQ ID NO: 1307807 - protein, 18 aa, Mycobacterium
LLADRFIAPTVPEFDYPR

SEQ ID NO: 1307808 - protein, 20 aa, Mycobacterium
LLAEAVWRLGALGWACDLVA

SEQ ID NO: 1307809 - protein, 19 aa, Mycobacterium
LLAGFAARLGLLLGRTDDA

SEQ ID NO: 1307810 - protein, 17 aa, Mycobacterium
LLAICERLTTDDGQQRV

SEQ ID NO: 1307811 - protein, 17 aa, Mycobacterium
LLAQLRAILDLTNTEIQ

SEQ ID NO: 1307812 - protein, 30 aa, Mycobacterium
LLCLVDVGGVPTLLWKLVEEIRPGDTVVLQ

SEQ ID NO: 1307813 - protein, 20 aa, Mycobacterium
LLDAAKGLRYYLGVVLMATT

SEQ ID NO: 1307814 - protein, 19 aa, Mycobacterium
LLDAPNLVLTPHIASAGEA

SEQ ID NO: 1307815 - protein, 23 aa, Mycobacterium
LLDEGATVPFIARYRKEVTGSLD

SEQ ID NO: 1307816 - protein, 17 aa, Mycobacterium
LLDKIAAGPPLYSPFKL

SEQ ID NO: 1307817 - protein, 20 aa, Mycobacterium
LLDRNPVLKAVPPLPESRLP

SEQ ID NO: 1307818 - protein, 25 aa, Mycobacterium
LLDTVERLIALWDRPLRDVRMLSGD

SEQ ID NO: 1307819 - protein, 21 aa, Mycobacterium
LLDVAMSHPIKLIANALGVPP

SEQ ID NO: 1307820 - protein, 17 aa, Mycobacterium
LLDVARRLDISGRSTMS

SEQ ID NO: 1307821 - protein, 27 aa, Mycobacterium
LLEADHRYVFTLIQKFQPAKGERQMPV

SEQ ID NO: 1307822 - protein, 18 aa, Mycobacterium
LLEGTVDMDLWQAQRVWQ

SEQ ID NO: 1307823 - protein, 27 aa, Mycobacterium
LLFALGDVFVGWLLLRSAHIALTALAE

SEQ ID NO: 1307824 - protein, 18 aa, Mycobacterium
LLFDPVRAALAEYAGLSF

SEQ ID NO: 1307825 - protein, 27 aa, Mycobacterium
LLGQSRPRTRWRWRAIVTDLAAPQRVD

SEQ ID NO: 1307826 - protein, 17 aa, Mycobacterium
LLHPIEPPSLLSIEPPD

SEQ ID NO: 1307827 - protein, 26 aa, Mycobacterium
LLNDPCWKQLLSLVPPMTCDPAFTDL

SEQ ID NO: 1307828 - protein, 19 aa, Mycobacterium
LLNRYDVAFIQYQYGIYGG

SEQ ID NO: 1307829 - protein, 20 aa, Mycobacterium
LLNTLPDAYKKLARLGSRGD

SEQ ID NO: 1307830 - protein, 17 aa, Mycobacterium
LLRQRRALRDSGRDPRE

SEQ ID NO: 1307831 - protein, 23 aa, Mycobacterium
LLRSHVFFDWFDAVGVADLPAVF

SEQ ID NO: 1307832 - protein, 17 aa, Mycobacterium
LLSAYLYSRAQSVMGGT

SEQ ID NO: 1307833 - protein, 17 aa, Mycobacterium
LLSCGAVLHHCAVALGA

SEQ ID NO: 1307834 - protein, 18 aa, Mycobacterium
LLSDRLMSAQPVLAGWVS

SEQ ID NO: 1307835 - protein, 18 aa, Mycobacterium
LLTHYMPAHYSAGWWMDS

SEQ ID NO: 1307836 - protein, 20 aa, Mycobacterium
LLTSTLFDAPAYRTYGGLLA

SEQ ID NO: 1307837 - protein, 20 aa, Mycobacterium
LLTTDTIMYVSPARPMTIPA

SEQ ID NO: 1307838 - protein, 19 aa, Mycobacterium
LLVCLLLSKMSSDTMLAAL

SEQ ID NO: 1307839 - protein, 19 aa, Mycobacterium
LLVKSGGFGTLLLLGHDWA

SEQ ID NO: 1307840 - protein, 19 aa, Mycobacterium
LLVRERIELMLDPDTAFLE

SEQ ID NO: 1307841 - protein, 19 aa, Mycobacterium
LLVVLRGMEALRKGGASAT

SEQ ID NO: 1307842 - protein, 20 aa, Mycobacterium
LLWTVQRIPVFDAVRPVWTL

SEQ ID NO: 1307843 - protein, 20 aa, Mycobacterium
LLYLDRYWREEQQVCDDVLA

SEQ ID NO: 1307844 - protein, 22 aa, Mycobacterium
LMNLVIALLSTRTFITADRIRQ

SEQ ID NO: 1307845 - protein, 17 aa, Mycobacterium
LMRIGNRPTLGYSEATV

SEQ ID NO: 1307846 - protein, 17 aa, Mycobacterium
LMTPHAANWYAGNQPWE

SEQ ID NO: 1307847 - protein, 17 aa, Mycobacterium
LMVTGRAKDIIIRNGEN

SEQ ID NO: 1307848 - protein, 18 aa, Mycobacterium
LMVYDALDMTYRTIKIRK

SEQ ID NO: 1307849 - protein, 19 aa, Mycobacterium
LNADYWVANVRRPVRLHQA

SEQ ID NO: 1307850 - protein, 22 aa, Mycobacterium
LNDFGYYTAAAEWGGYGKSGNG

SEQ ID NO: 1307851 - protein, 23 aa, Mycobacterium
LNDRTHRVYVAVKLPDNHRDVAK

SEQ ID NO: 1307852 - protein, 19 aa, Mycobacterium
LNGLPVSVIIRTTLQDLES

SEQ ID NO: 1307853 - protein, 18 aa, Mycobacterium
LNLEYKLEVWDSPNSAGV

SEQ ID NO: 1307854 - protein, 19 aa, Mycobacterium
LNLEYKLEVWDSPNSAGVI

SEQ ID NO: 1307855 - protein, 17 aa, Mycobacterium
LNLFGGRRLTPAIRSRL

SEQ ID NO: 1307856 - protein, 23 aa, Mycobacterium
LNPAEPPLIMRDTVLALVTDPDQ

SEQ ID NO: 1307857 - protein, 17 aa, Mycobacterium
LNPYLSPAAVKRWEPFV

SEQ ID NO: 1307858 - protein, 26 aa, Mycobacterium
LNRPKLGFPVPIRHWLRAGELLEWAY

SEQ ID NO: 1307859 - protein, 27 aa, Mycobacterium
LNSAVFLPILRVLFNSWFRVEVSGTEN

SEQ ID NO: 1307860 - protein, 18 aa, Mycobacterium
LNTDLRGLDSLDLGARRL

SEQ ID NO: 1307861 - protein, 25 aa, Mycobacterium
LNVKRSAFVCALLAQFPDVSVSQTR

SEQ ID NO: 1307862 - protein, 22 aa, Mycobacterium
LNVNPANARWFYDNTRRGDIVE

SEQ ID NO: 1307863 - protein, 17 aa, Mycobacterium
LNYGRYSLDDSWYEYAS

SEQ ID NO: 1307864 - protein, 17 aa, Mycobacterium
LPAWVSWERRDHYERDL

SEQ ID NO: 1307865 - protein, 18 aa, Mycobacterium
LPDAARSLGKSMRIFKSE

SEQ ID NO: 1307866 - protein, 25 aa, Mycobacterium
LPDRPFHGYDVFAMIPPPGPNDPAK

SEQ ID NO: 1307867 - protein, 26 aa, Mycobacterium
LPDTMYGFLLTLRQKGPHGGPFDYRS

SEQ ID NO: 1307868 - protein, 18 aa, Mycobacterium
LPDWAQTLLDAKGGYLLL

SEQ ID NO: 1307869 - protein, 17 aa, Mycobacterium
LPEVTLGLLPGGGGVAR

SEQ ID NO: 1307870 - protein, 38 aa, Mycobacterium
LPFDLTAPTALFRPQRVRFLDALPDWPAVGLPRVRIAE

SEQ ID NO: 1307871 - protein, 19 aa, Mycobacterium
LPGAAWQRCRTHYTTNLMA

SEQ ID NO: 1307872 - protein, 17 aa, Mycobacterium
LPGGVPPTGRFGTVEQV

SEQ ID NO: 1307873 - protein, 17 aa, Mycobacterium
LPGLQDKALRNGYAECE

SEQ ID NO: 1307874 - protein, 20 aa, Mycobacterium
LPGVAMMVVLVSRSGFCTVT

SEQ ID NO: 1307875 - protein, 18 aa, Mycobacterium
LPIPLPVVGGHEGAGTVV

SEQ ID NO: 1307876 - protein, 20 aa, Mycobacterium
LPLAAIGQLRRFAPPRGPAT

SEQ ID NO: 1307877 - protein, 19 aa, Mycobacterium
LPLLVRRYRYAATAGGLWL

SEQ ID NO: 1307878 - protein, 27 aa, Mycobacterium
LPNMRTVLHCLPPRDWTEPGFMGLGMI

SEQ ID NO: 1307879 - protein, 17 aa, Mycobacterium
LPNMVATGPLRVADLAP

SEQ ID NO: 1307880 - protein, 19 aa, Mycobacterium
LPPLDSLAEWVAATIPGIT

SEQ ID NO: 1307881 - protein, 28 aa, Mycobacterium
LPRDQANVWMFSPNRLLAHAKPADLVRD

SEQ ID NO: 1307882 - protein, 21 aa, Mycobacterium
LPRFATDFPLSDGTPARVLEL

SEQ ID NO: 1307883 - protein, 20 aa, Mycobacterium
LPRFDTITYRELLDRVRALT

SEQ ID NO: 1307884 - protein, 23 aa, Mycobacterium
LPRLVDHIAPRTAAAARRIPVAS

SEQ ID NO: 1307885 - protein, 19 aa, Mycobacterium
LPSIYFAHRREVFARDGIL

SEQ ID NO: 1307886 - protein, 22 aa, Mycobacterium
LPTLLRRLVIMGGAFDYRGNTT

SEQ ID NO: 1307887 - protein, 18 aa, Mycobacterium
LPVASAGYVERYLPDGFT

SEQ ID NO: 1307888 - protein, 21 aa, Mycobacterium
LPVLVYAHGGGFVFCDLDSHD

SEQ ID NO: 1307889 - protein, 24 aa, Mycobacterium
LPVRNKSLHLVLKGPPGTGKTTIA

SEQ ID NO: 1307890 - protein, 20 aa, Mycobacterium
LPVTSACRTVFDLGRRLRLG

SEQ ID NO: 1307891 - protein, 35 aa, Mycobacterium
LPVTTMPLLRLPIHGSYLMQLYSLSPRVARLYFAT

SEQ ID NO: 1307892 - protein, 21 aa, Mycobacterium
LQAAPGFQLVISYNPGYQSVL

SEQ ID NO: 1307893 - protein, 28 aa, Mycobacterium
LQADVTGTLMLPLGVRRLSAHASMRNAH

SEQ ID NO: 1307894 - protein, 25 aa, Mycobacterium
LQALRLYQRFAPYSDHHLVESIKAA

SEQ ID NO: 1307895 - protein, 26 aa, Mycobacterium
LQFNRIPQPWLREPAKRWIRLRLSRG

SEQ ID NO: 1307896 - protein, 17 aa, Mycobacterium
LQGVRYTGGGCTTQSIV

SEQ ID NO: 1307897 - protein, 24 aa, Mycobacterium
LQISAMLKRLGIPGDFRGGFRVTT

SEQ ID NO: 1307898 - protein, 29 aa, Mycobacterium
LQIVQVDQKFLFHRPIVAGDSLTGTMYIE

SEQ ID NO: 1307899 - protein, 26 aa, Mycobacterium
LQMVKRLAWELLYATETCRSFALWAV

SEQ ID NO: 1307900 - protein, 21 aa, Mycobacterium
LQPLRPAILYGIDTRATAEIH

SEQ ID NO: 1307901 - protein, 18 aa, Mycobacterium
LQQLGYYCGVVTGGFGQV

SEQ ID NO: 1307902 - protein, 18 aa, Mycobacterium
LQQRIAHLFTTDPQFAAA

SEQ ID NO: 1307903 - protein, 26 aa, Mycobacterium
LQTLRAARWSGYIRSDVDLPVLADRM

SEQ ID NO: 1307904 - protein, 27 aa, Mycobacterium
LRADLDRFIFLLWQRRRTTLRTRIARS

SEQ ID NO: 1307905 - protein, 18 aa, Mycobacterium
LRAVLPPADRAEPAWRSR

SEQ ID NO: 1307906 - protein, 18 aa, Mycobacterium
LRAWPTPLGVAINSADPI

SEQ ID NO: 1307907 - protein, 19 aa, Mycobacterium
LRDRCAEAPFLPGASYHFV

SEQ ID NO: 1307908 - protein, 25 aa, Mycobacterium
LRDRLPKVAALYLQGRLSARLISEI

SEQ ID NO: 1307909 - protein, 26 aa, Mycobacterium
LRDWRQWWTWSPGACWRHPLGPESSW

SEQ ID NO: 1307910 - protein, 24 aa, Mycobacterium
LRDYLESLHRLQGLGRRTVLPGHG

SEQ ID NO: 1307911 - protein, 20 aa, Mycobacterium
LRDYWQQWEQVRVPALLLEA

SEQ ID NO: 1307912 - protein, 18 aa, Mycobacterium
LREIDPFRNLNPLAWRRA

SEQ ID NO: 1307913 - protein, 23 aa, Mycobacterium
LRGSRLTLVYAAPASLAAWSAVP

SEQ ID NO: 1307914 - protein, 25 aa, Mycobacterium
LRKIEPSLLAWLVRTLPAAISEHTT

SEQ ID NO: 1307915 - protein, 27 aa, Mycobacterium
LRLIPNIVVLPYRNPFVVAKSGATLDL

SEQ ID NO: 1307916 - protein, 26 aa, Mycobacterium
LRMVHRARDMLWLNRSRWNRTTTGDT

SEQ ID NO: 1307917 - protein, 19 aa, Mycobacterium
LRNAELAHIFTKEAKTFGI

SEQ ID NO: 1307918 - protein, 18 aa, Mycobacterium
LRPAVALSWRARLQPMDE

SEQ ID NO: 1307919 - protein, 17 aa, Mycobacterium
LRPFLLVASFVNPHDIV

SEQ ID NO: 1307920 - protein, 18 aa, Mycobacterium
LRPYLLSVGYRLTGSVAD

SEQ ID NO: 1307921 - protein, 18 aa, Mycobacterium
LRQQAIGAAMRNPTRYEL

SEQ ID NO: 1307922 - protein, 18 aa, Mycobacterium
LRRALEHRNRTCVVPGCE

SEQ ID NO: 1307923 - protein, 18 aa, Mycobacterium
LRRARRALPGDPDFGDPL

SEQ ID NO: 1307924 - protein, 22 aa, Mycobacterium
LRRRLARVGLGPKVLRGRADGD

SEQ ID NO: 1307925 - protein, 22 aa, Mycobacterium
LRRWLPLDMRRPFKSTLVTLDV

SEQ ID NO: 1307926 - protein, 30 aa, Mycobacterium
LRSLGVYMYTTIFDAIIGRLLIAAGEPESA

SEQ ID NO: 1307927 - protein, 18 aa, Mycobacterium
LRSPLVLVPVRLSTANRG

SEQ ID NO: 1307928 - protein, 31 aa, Mycobacterium
LRSRSHVPARPRPMVLRWPAVRRTARSAGTD

SEQ ID NO: 1307929 - protein, 20 aa, Mycobacterium
LRSVALTRNVLLPVGTDYTP

SEQ ID NO: 1307930 - protein, 30 aa, Mycobacterium
LRTAKLRLDELTRFFAWITDRGVTSLAAVT

SEQ ID NO: 1307931 - protein, 23 aa, Mycobacterium
LRTFGKRLIDLTPAAVGPYVVPA

SEQ ID NO: 1307932 - protein, 23 aa, Mycobacterium
LRTRGLHARWLAWDDPAVLDADL

SEQ ID NO: 1307933 - protein, 19 aa, Mycobacterium
LRTRIAPQNAWIVDRYLAN

SEQ ID NO: 1307934 - protein, 20 aa, Mycobacterium
LRVRPTVSWSWNLGGEPLNH

SEQ ID NO: 1307935 - protein, 27 aa, Mycobacterium
LRVTRPGGLAVLSYTVWLGPFGGHETG

SEQ ID NO: 1307936 - protein, 25 aa, Mycobacterium
LRYPAALVDDFDWARTLSGGGLFGE

SEQ ID NO: 1307937 - protein, 20 aa, Mycobacterium
LRYRTLVTAAQYLALGIDPA

SEQ ID NO: 1307938 - protein, 29 aa, Mycobacterium
LRYTMPLGEIIFDFFDSLKSRTRGYASLD

SEQ ID NO: 1307939 - protein, 18 aa, Mycobacterium
LSALELEFYLLREKAGTT

SEQ ID NO: 1307940 - protein, 25 aa, Mycobacterium
LSALRPGPIHFLRRMKEDLVDYDGK

SEQ ID NO: 1307941 - protein, 24 aa, Mycobacterium
LSARPGIVLSRRQLLEIVRDGPWV

SEQ ID NO: 1307942 - protein, 18 aa, Mycobacterium
LSAVPYLESVVLAAGAIS

SEQ ID NO: 1307943 - protein, 24 aa, Mycobacterium
LSDPEIGLLLPCNVVVRADTTHGN

SEQ ID NO: 1307944 - protein, 26 aa, Mycobacterium
LSDQLRGELLGAARAAALAAATNQVN

SEQ ID NO: 1307945 - protein, 24 aa, Mycobacterium
LSEALGYDSRIGRRFLNAGLGFGG

SEQ ID NO: 1307946 - protein, 33 aa, Mycobacterium
LSELGFDYVDLFLIHWPLPTLYDGDFVSTWQTL

SEQ ID NO: 1307947 - protein, 24 aa, Mycobacterium
LSFDGIPVARIIRPLRPVKPTDAV

SEQ ID NO: 1307948 - protein, 30 aa, Mycobacterium
LSGAEFLRRKLHLRPIFMKSYSQLTQLISE

SEQ ID NO: 1307949 - protein, 22 aa, Mycobacterium
LSGFTGWVPFAALPTADVPTGP

SEQ ID NO: 1307950 - protein, 25 aa, Mycobacterium
LSGHIPLPLPSQIGGRLPLTCTAVG

SEQ ID NO: 1307951 - protein, 24 aa, Mycobacterium
LSGIPRALIVVPTRELCLQVHSDL

SEQ ID NO: 1307952 - protein, 24 aa, Mycobacterium
LSGLLNRRALMAHLGLRLAEGQPG

SEQ ID NO: 1307953 - protein, 30 aa, Mycobacterium
LSGVDLEVGQLLGSGWKGGAASAFGTEWEK

SEQ ID NO: 1307954 - protein, 25 aa, Mycobacterium
LSIDPELRFRKRPLLSLEQPVKVTD

SEQ ID NO: 1307955 - protein, 18 aa, Mycobacterium
LSILQRNGATRVSVLARK

SEQ ID NO: 1307956 - protein, 24 aa, Mycobacterium
LSKLLLRHGIVYYGGQAWTGAHDQ

SEQ ID NO: 1307957 - protein, 27 aa, Mycobacterium
LSLAHPVRQFVLFTSISGLIGSRWLAH

SEQ ID NO: 1307958 - protein, 18 aa, Mycobacterium
LSLMLRAMTERLGDVGYP

SEQ ID NO: 1307959 - protein, 25 aa, Mycobacterium
LSLRLPVRRPFAYEGVFGHLAASAV

SEQ ID NO: 1307960 - protein, 23 aa, Mycobacterium
LSPHRFADYLADPDRIVLAARDG

SEQ ID NO: 1307961 - protein, 26 aa, Mycobacterium
LSPSQLSGYRLLAESTLAYVDGDRFV

SEQ ID NO: 1307962 - protein, 18 aa, Mycobacterium
LSQLGFRVVPSDANFILF

SEQ ID NO: 1307963 - protein, 18 aa, Mycobacterium
LSRHRAHLTILTDSATAP

SEQ ID NO: 1307964 - protein, 17 aa, Mycobacterium
LSRHRWAVLMKVHHCLA

SEQ ID NO: 1307965 - protein, 22 aa, Mycobacterium
LSRIRDALAAAPPPPVSVPREY

SEQ ID NO: 1307966 - protein, 24 aa, Mycobacterium
LSSFGINLPPMPTGMLNGTPSAPT

SEQ ID NO: 1307967 - protein, 26 aa, Mycobacterium
LSSSAHLSWRRPIASLNYLLTSHVWR

SEQ ID NO: 1307968 - protein, 26 aa, Mycobacterium
LSTDHVVTLVRFLASPASEAVNGQLF

SEQ ID NO: 1307969 - protein, 18 aa, Mycobacterium
LSTIAFTRLLEEAGVPAG

SEQ ID NO: 1307970 - protein, 26 aa, Mycobacterium
LSVPAEARLPRTWIALLRGRIDASLA

SEQ ID NO: 1307971 - protein, 25 aa, Mycobacterium
LSWQQVMVLRAYAKYLRQAGFPYSQ

SEQ ID NO: 1307972 - protein, 27 aa, Mycobacterium
LTCGRALRLLPLPVEVDLFDGKSDAES

SEQ ID NO: 1307973 - protein, 18 aa, Mycobacterium
LTDLGWGARLRKVLDEPD

SEQ ID NO: 1307974 - protein, 26 aa, Mycobacterium
LTDRLPQVAALFTAGLITDLLVRAIV

SEQ ID NO: 1307975 - protein, 37 aa, Mycobacterium
LTEADDRLWDILGAISADHRPAWTSTLVAESVGKLAT

SEQ ID NO: 1307976 - protein, 18 aa, Mycobacterium
LTEAGFAHLGGRPAPMAA

SEQ ID NO: 1307977 - protein, 23 aa, Mycobacterium
LTELMRVRVLRQSPLGFGLLSRP

SEQ ID NO: 1307978 - protein, 18 aa, Mycobacterium
LTFGKGLHYCLGANLARL

SEQ ID NO: 1307979 - protein, 20 aa, Mycobacterium
LTGGPQYRIIVATTDRTFRV

SEQ ID NO: 1307980 - protein, 21 aa, Mycobacterium
LTGVRVFFPDPWPKARHHKRR

SEQ ID NO: 1307981 - protein, 23 aa, Mycobacterium
LTLPGRSLLFVRNVGHLMTNDAI

SEQ ID NO: 1307982 - protein, 29 aa, Mycobacterium
LTMQDYLDAPPISTPFRLFDCSLETDGAA

SEQ ID NO: 1307983 - protein, 19 aa, Mycobacterium
LTNTPDFVPRWSPTSGQIR

SEQ ID NO: 1307984 - protein, 35 aa, Mycobacterium
LTPDGRPFFCGTYYPKPNFLQLLAAVAETWRERRG

SEQ ID NO: 1307985 - protein, 21 aa, Mycobacterium
LTPEELSAESAIALPDKEVVS

SEQ ID NO: 1307986 - protein, 19 aa, Mycobacterium
LTPQDLYEYPTVSALAGAL

SEQ ID NO: 1307987 - protein, 21 aa, Mycobacterium
LTPTTWLPFGGGNRRCLGATF

SEQ ID NO: 1307988 - protein, 20 aa, Mycobacterium
LTRAALLRKAGLDERPAAAA

SEQ ID NO: 1307989 - protein, 23 aa, Mycobacterium
LTRLKMYRLLHDLWARRHMAVLH

SEQ ID NO: 1307990 - protein, 21 aa, Mycobacterium
LTRNLNWLKSWYEFAVPDIGR

SEQ ID NO: 1307991 - protein, 23 aa, Mycobacterium
LTRRLPAPRRVGPAPWKSVLGMT

SEQ ID NO: 1307992 - protein, 27 aa, Mycobacterium
LTSQMGRSFLQKIGLLPTPTGYTNAAI

SEQ ID NO: 1307993 - protein, 21 aa, Mycobacterium
LTSRYLYGQTLKRVLKARPDA

SEQ ID NO: 1307994 - protein, 25 aa, Mycobacterium
LTTDEVMFVSPFIPMSVTPPTLDPV

SEQ ID NO: 1307995 - protein, 19 aa, Mycobacterium
LTVFAVGAIAVLTPVFSGF

SEQ ID NO: 1307996 - protein, 17 aa, Mycobacterium
LTVLKRAERPITMGALA

SEQ ID NO: 1307997 - protein, 25 aa, Mycobacterium
LTVWQHFPIVSRVASLTGLPVRLGG

SEQ ID NO: 1307998 - protein, 21 aa, Mycobacterium
LTWAGACRPGDGLGISGDEVL

SEQ ID NO: 1307999 - protein, 22 aa, Mycobacterium
LVAHIWEALGSVGFAGGSVLDL

SEQ ID NO: 1308000 - protein, 25 aa, Mycobacterium
LVAHPLVRRIGFIGSPGTGRHIQRL

SEQ ID NO: 1308001 - protein, 24 aa, Mycobacterium
LVAQVRPRIGDLPLGAHFHNTRGA

SEQ ID NO: 1308002 - protein, 19 aa, Mycobacterium
LVARATLGNERISIGGGSG

SEQ ID NO: 1308003 - protein, 18 aa, Mycobacterium
LVCPALFDLGEHGKVVVI

SEQ ID NO: 1308004 - protein, 29 aa, Mycobacterium
LVDMVLPREGFAEGWRTIARSLAGRPAGE

SEQ ID NO: 1308005 - protein, 25 aa, Mycobacterium
LVDYLMNFFQYHLPGVQAYHLDVTP

SEQ ID NO: 1308006 - protein, 28 aa, Mycobacterium
LVEKARQLWFDRILPLAENIRAGEVVRV

SEQ ID NO: 1308007 - protein, 26 aa, Mycobacterium
LVGFATSALFLRDALDKAGIQAQFTA

SEQ ID NO: 1308008 - protein, 31 aa, Mycobacterium
LVGQPTLRHRLRLGVLAALDQRIAVRYTLPG

SEQ ID NO: 1308009 - protein, 25 aa, Mycobacterium
LVKGYAHGLTPYMSDLSGLASADPN

SEQ ID NO: 1308010 - protein, 18 aa, Mycobacterium
LVLALSAGALRQLSLRYD

SEQ ID NO: 1308011 - protein, 30 aa, Mycobacterium
LVLSYREEALPKIQLWPLGADGSYGRAEDI

SEQ ID NO: 1308012 - protein, 28 aa, Mycobacterium
LVNKLVAMSATFRRDGWYPVVGEAIGGL

SEQ ID NO: 1308013 - protein, 17 aa, Mycobacterium
LVPDGRVLLASGAALVT

SEQ ID NO: 1308014 - protein, 26 aa, Mycobacterium
LVPELLLIGQLIDRSGMAWCISNFGR

SEQ ID NO: 1308015 - protein, 23 aa, Mycobacterium
LVPGGPASLLWQLLRRGNDGMGR

SEQ ID NO: 1308016 - protein, 18 aa, Mycobacterium
LVRKLYFGPNTITAYFPT

SEQ ID NO: 1308017 - protein, 24 aa, Mycobacterium
LVSALPLFPYMDIHVTPLARHPSD

SEQ ID NO: 1308018 - protein, 19 aa, Mycobacterium
LVSFTPATIATVGQLLAEL

SEQ ID NO: 1308019 - protein, 17 aa, Mycobacterium
LVSLLRPKTVESKIISG

SEQ ID NO: 1308020 - protein, 21 aa, Mycobacterium
LVSRWVLELVSTHPDITIGVT

SEQ ID NO: 1308021 - protein, 26 aa, Mycobacterium
LVSTGPWFQWHFDRWTVPPGAVEIAR

SEQ ID NO: 1308022 - protein, 18 aa, Mycobacterium
LVTPTWTLGEARARVVAV

SEQ ID NO: 1308023 - protein, 21 aa, Mycobacterium
LVVRAIEAGLRATGCIAPGLV

SEQ ID NO: 1308024 - protein, 17 aa, Mycobacterium
LVVWAREDRMMPPAHAD

SEQ ID NO: 1308025 - protein, 17 aa, Mycobacterium
LWARHRVFGARQLDMVG

SEQ ID NO: 1308026 - protein, 24 aa, Mycobacterium
LWGATGARSIPALVAWKLGLSSKN

SEQ ID NO: 1308027 - protein, 20 aa, Mycobacterium
LWGGLATELGLAFTPVFLSE

SEQ ID NO: 1308028 - protein, 19 aa, Mycobacterium
LYGGVLGYLDFAGNADFAI

SEQ ID NO: 1308029 - protein, 17 aa, Mycobacterium
LYGLAARVPMGQADKYA

SEQ ID NO: 1308030 - protein, 22 aa, Mycobacterium
LYITLLGALRNGSVVSPLFSAF

SEQ ID NO: 1308031 - protein, 18 aa, Mycobacterium
LYPVRALLECRCDIVRET

SEQ ID NO: 1308032 - protein, 17 aa, Mycobacterium
LYRHPTSGQLVAMESRA

SEQ ID NO: 1308033 - protein, 28 aa, Mycobacterium
LYTYNDVPFFFHFTGPGTALGGPEVMVD

SEQ ID NO: 1308034 - protein, 26 aa, Mycobacterium
MAALDHRVPVLLSALSPRMLRIAAEF

SEQ ID NO: 1308035 - protein, 25 aa, Mycobacterium
MADHVFSRIDIPGWLARTGFQMLDP

SEQ ID NO: 1308036 - protein, 20 aa, Mycobacterium
MAGATPFLDGLLAAAQRADT

SEQ ID NO: 1308037 - protein, 19 aa, Mycobacterium
MAGFGIFPGPYPVGHEIAG

SEQ ID NO: 1308038 - protein, 23 aa, Mycobacterium
MARFVDTFARVLGDPALPHLFFV

SEQ ID NO: 1308039 - protein, 26 aa, Mycobacterium
MARLPVSEWPDLLILLGDQVYADELT

SEQ ID NO: 1308040 - protein, 26 aa, Mycobacterium
MARMMDPQHRLFLQTAWHAMEDAGCD

SEQ ID NO: 1308041 - protein, 26 aa, Mycobacterium
MARRDPAYKFVLAEVDYLKPYWDTHP

SEQ ID NO: 1308042 - protein, 20 aa, Mycobacterium
MAWQKILHERGWAAPAWPVE

SEQ ID NO: 1308043 - protein, 19 aa, Mycobacterium
MCEQGYWWGLVTYDIAYGA

SEQ ID NO: 1308044 - protein, 28 aa, Mycobacterium
MCGRSYSPRFLFAWPNSKSAVMGPAQLA

SEQ ID NO: 1308045 - protein, 23 aa, Mycobacterium
MCLTLCPDVFEMTDDGWAVADPE

SEQ ID NO: 1308046 - protein, 35 aa, Mycobacterium
MDACVFLLRHGVDAQRLTWIKPREAWLMDRATVQP

SEQ ID NO: 1308047 - protein, 26 aa, Mycobacterium
MDAITEHFGHPAHLPRAGLPSEIGPV

SEQ ID NO: 1308048 - protein, 25 aa, Mycobacterium
MDDLHRHLFTVLMDREWKHGVTAAV

SEQ ID NO: 1308049 - protein, 23 aa, Mycobacterium
MDNGLLYYAVDHSPSYLWNSATW

SEQ ID NO: 1308050 - protein, 24 aa, Mycobacterium
MEEFQAMQSAWWKIAIDTAGYGRA

SEQ ID NO: 1308051 - protein, 17 aa, Mycobacterium
MEFERLVEILPETTPTP

SEQ ID NO: 1308052 - protein, 26 aa, Mycobacterium
MENLNVAPEVIWPRARRALAAVGLNL

SEQ ID NO: 1308053 - protein, 18 aa, Mycobacterium
MEPEIPYYSATLYDPRDP

SEQ ID NO: 1308054 - protein, 22 aa, Mycobacterium
MERFNTVWSGPETLPLPTEVDE

SEQ ID NO: 1308055 - protein, 37 aa, Mycobacterium
METWHPLGVVGVITAFNFPVAVWSWNTAVALVCGDTV

SEQ ID NO: 1308056 - protein, 28 aa, Mycobacterium
MEWAGLDLLILRIAALFHENLLVLHAPS

SEQ ID NO: 1308057 - protein, 18 aa, Mycobacterium
MFCGCANAFGAEPNTQVC

SEQ ID NO: 1308058 - protein, 18 aa, Mycobacterium
MGLPLFGVRGMNGFVRAT

SEQ ID NO: 1308059 - protein, 20 aa, Mycobacterium
MGLRLASRRVVLDHAVVGTH

SEQ ID NO: 1308060 - protein, 24 aa, Mycobacterium
MGRLAGRGFAAYGTAKAALAHYTR

SEQ ID NO: 1308061 - protein, 21 aa, Mycobacterium
MHKDWNPHDFIPWSDGKNYYA

SEQ ID NO: 1308062 - protein, 18 aa, Mycobacterium
MHRCAPQVYRWGPGAALS

SEQ ID NO: 1308063 - protein, 23 aa, Mycobacterium
MIDICQFAVGLSRQLYGRTIASE

SEQ ID NO: 1308064 - protein, 19 aa, Mycobacterium
MIDWWGPIVDEYYASSEAH

SEQ ID NO: 1308065 - protein, 17 aa, Mycobacterium
MKAAEELGFVFNLGVET

SEQ ID NO: 1308066 - protein, 22 aa, Mycobacterium
MKKAVAYLLPYIEAEKEQNGTT

SEQ ID NO: 1308067 - protein, 20 aa, Mycobacterium
MLAASSRRSAWWAGTATLGV

SEQ ID NO: 1308068 - protein, 27 aa, Mycobacterium
MLDELQPGHRLVIRALPGAASATSARL

SEQ ID NO: 1308069 - protein, 18 aa, Mycobacterium
MLEGQAHLALGFKTPQAY

SEQ ID NO: 1308070 - protein, 20 aa, Mycobacterium
MLGDLRPLYRPGLVHIYHAL

SEQ ID NO: 1308071 - protein, 17 aa, Mycobacterium
MLGEIRRHFRDNGWAMH

SEQ ID NO: 1308072 - protein, 17 aa, Mycobacterium
MLQQKIAERTKLLSQLE

SEQ ID NO: 1308073 - protein, 24 aa, Mycobacterium
MLQSFIGRVTSVPPSVWGGVAAVR

SEQ ID NO: 1308074 - protein, 24 aa, Mycobacterium
MLRQAPELSAWPRSPEWTGAGAVA

SEQ ID NO: 1308075 - protein, 22 aa, Mycobacterium
MLTDIEGLYTDWPDRNSLVSQI

SEQ ID NO: 1308076 - protein, 17 aa, Mycobacterium
MLVTDLVNVRYLSGFTG

SEQ ID NO: 1308077 - protein, 17 aa, Mycobacterium
MMHTLPIGWVEPEDIAN

SEQ ID NO: 1308078 - protein, 28 aa, Mycobacterium
MNRGFHAFFRQYYNLRDLLRRVDPQLSM

SEQ ID NO: 1308079 - protein, 17 aa, Mycobacterium
MPALADAFAALVEAGWD

SEQ ID NO: 1308080 - protein, 26 aa, Mycobacterium
MPASAEFLRVLRGCGVAAVLSGAGPA

SEQ ID NO: 1308081 - protein, 21 aa, Mycobacterium
MPDPAAWMRDLYSPAASIVEM

SEQ ID NO: 1308082 - protein, 26 aa, Mycobacterium
MPGLQQLFNPDLKLLQSMSAGAEHLV

SEQ ID NO: 1308083 - protein, 19 aa, Mycobacterium
MPVLLDDDLLFEDGPGAPR

SEQ ID NO: 1308084 - protein, 17 aa, Mycobacterium
MPVNWKLLAENFGGDQY

SEQ ID NO: 1308085 - protein, 24 aa, Mycobacterium
MPVSALDGFYTTWDNARQTFGQGT

SEQ ID NO: 1308086 - protein, 18 aa, Mycobacterium
MPYFARYVDGDLLSFVHT

SEQ ID NO: 1308087 - protein, 27 aa, Mycobacterium
MPYKHGFGPFAPEIYRAPLSYPFRDAE

SEQ ID NO: 1308088 - protein, 27 aa, Mycobacterium
MQARKKALLQRLPLVTAPYDGPVANAF

SEQ ID NO: 1308089 - protein, 26 aa, Mycobacterium
MQMPEMPLIKFIDGWETVAEMEAALG

SEQ ID NO: 1308090 - protein, 17 aa, Mycobacterium
MQSMLEPVMGAVGPLMQ

SEQ ID NO: 1308091 - protein, 18 aa, Mycobacterium
MRFAFAEAPVPFCWNEDN

SEQ ID NO: 1308092 - protein, 18 aa, Mycobacterium
MRRGDMLFWGPNASQHVA

SEQ ID NO: 1308093 - protein, 35 aa, Mycobacterium
MRSSPPHLLLTNYAMLEYLLLRPLDIDLFDGPHAG

SEQ ID NO: 1308094 - protein, 20 aa, Mycobacterium
MRYDLAAGFPLITTKKVHLK

SEQ ID NO: 1308095 - protein, 29 aa, Mycobacterium
MSADLVVLGPGSWFTSVIPHVLVPELAAA

SEQ ID NO: 1308096 - protein, 30 aa, Mycobacterium
MSAQPVLAGWVSAVVFFRSSRWHDVRRVLA

SEQ ID NO: 1308097 - protein, 18 aa, Mycobacterium
MSCVTAMSIPPVLAAYDF

SEQ ID NO: 1308098 - protein, 21 aa, Mycobacterium
MSFLERRPAVFPPLDDHPADH

SEQ ID NO: 1308099 - protein, 18 aa, Mycobacterium
MTAAQRWGTEWATCSGMS

SEQ ID NO: 1308100 - protein, 29 aa, Mycobacterium
MTEFLPGHYDFLQRLFAGIKPRHRQQLLA

SEQ ID NO: 1308101 - protein, 26 aa, Mycobacterium
MTEFLPGHYDFLQRLFAGINPRHRQQ

SEQ ID NO: 1308102 - protein, 17 aa, Mycobacterium
MTLLPGDLILTGTPEGV

SEQ ID NO: 1308103 - protein, 17 aa, Mycobacterium
MTLLSLGWAAEYAEAGI

SEQ ID NO: 1308104 - protein, 17 aa, Mycobacterium
MTRGDIEDIFWLQATIA

SEQ ID NO: 1308105 - protein, 22 aa, Mycobacterium
MTRPRWSMDPLRIFPADIGVDK

SEQ ID NO: 1308106 - protein, 27 aa, Mycobacterium
MTRSLSLLSTLPWPKENIDKIVRGDYL

SEQ ID NO: 1308107 - protein, 26 aa, Mycobacterium
MVDELERRGAKRALITLCIGGGMGVA

SEQ ID NO: 1308108 - protein, 18 aa, Mycobacterium
MVFPHLYGPLPAEAVRDV

SEQ ID NO: 1308109 - protein, 18 aa, Mycobacterium
MVGAQRWIAAGLFDPAVR

SEQ ID NO: 1308110 - protein, 20 aa, Mycobacterium
MVTLAPPVILTVKGADAPVV

SEQ ID NO: 1308111 - protein, 17 aa, Mycobacterium
MWVGMGRVLRTLDIGQS

SEQ ID NO: 1308112 - protein, 22 aa, Mycobacterium
NAAIAALVLPSSFRPIPDPNTP

SEQ ID NO: 1308113 - protein, 20 aa, Mycobacterium
NAAVTFLRPLDGFPDKRVRL

SEQ ID NO: 1308114 - protein, 25 aa, Mycobacterium
NADAYMVSLLKEYWGEHARADNDFC

SEQ ID NO: 1308115 - protein, 21 aa, Mycobacterium
NADLFFLLGVPSDDAVRWLAA

SEQ ID NO: 1308116 - protein, 19 aa, Mycobacterium
NADTPWVDPLIAAAAMGAV

SEQ ID NO: 1308117 - protein, 27 aa, Mycobacterium
NAETLRPVLREWAPNPRLVVGMSLGGL

SEQ ID NO: 1308118 - protein, 19 aa, Mycobacterium
NAGFLWACSGYYNYDKGYS

SEQ ID NO: 1308119 - protein, 22 aa, Mycobacterium
NAKLFLHYGDLSDGARLVTLLA

SEQ ID NO: 1308120 - protein, 18 aa, Mycobacterium
NALKAWLIGVGEDGEWPL

SEQ ID NO: 1308121 - protein, 22 aa, Mycobacterium
NALPRRGFAALRRPVRRPLDEG

SEQ ID NO: 1308122 - protein, 17 aa, Mycobacterium
NALTRNLNWLKSWYEFA

SEQ ID NO: 1308123 - protein, 29 aa, Mycobacterium
NAMEVGPDGLLYYPLMTANEIWRVDPNGG

SEQ ID NO: 1308124 - protein, 28 aa, Mycobacterium
NAPLISWDRAFGLVKINPIAAWSDDDMQ

SEQ ID NO: 1308125 - protein, 18 aa, Mycobacterium
NAQNFRILTRLEPKVLDA

SEQ ID NO: 1308126 - protein, 23 aa, Mycobacterium
NARAILRDLRRFGPPLWERFSTA

SEQ ID NO: 1308127 - protein, 22 aa, Mycobacterium
NARNPRFRSIRIDQSWRGIVLA

SEQ ID NO: 1308128 - protein, 20 aa, Mycobacterium
NARQMFPTLQYASSIREACA

SEQ ID NO: 1308129 - protein, 18 aa, Mycobacterium
NASYYRSMLAQLGPIETA

SEQ ID NO: 1308130 - protein, 20 aa, Mycobacterium
NATTWLGYPNIEGATIADVL

SEQ ID NO: 1308131 - protein, 27 aa, Mycobacterium
NCDAYHDFLFAVPWADGVAVPVNTRWS

SEQ ID NO: 1308132 - protein, 24 aa, Mycobacterium
NCLGGSLMDYLIPTALEVPELETG

SEQ ID NO: 1308133 - protein, 25 aa, Mycobacterium
NCVAPMRLCHHFAPAMAARGRGGLV

SEQ ID NO: 1308134 - protein, 25 aa, Mycobacterium
NDDSFRRWRVYAPGTWLQVESDQAP

SEQ ID NO: 1308135 - protein, 17 aa, Mycobacterium
NDEIVIAVLHSAPELAM

SEQ ID NO: 1308136 - protein, 19 aa, Mycobacterium
NDHLLAFQDECLAALPGVQ

SEQ ID NO: 1308137 - protein, 20 aa, Mycobacterium
NDLLLPIVKGYGSERSWVVL

SEQ ID NO: 1308138 - protein, 22 aa, Mycobacterium
NDRRFYPIYEAIAEAGVPALFH

SEQ ID NO: 1308139 - protein, 19 aa, Mycobacterium
NDSSPMHIVTGPPAPQPDN

SEQ ID NO: 1308140 - protein, 27 aa, Mycobacterium
NDTQLRWRPIDFWPANTTVNIDASGTK

SEQ ID NO: 1308141 - protein, 21 aa, Mycobacterium
NEKRLFCRMAEVFAGFLSYTD

SEQ ID NO: 1308142 - protein, 23 aa, Mycobacterium
NENTNRLLRFWFEKGTDLSGYTP

SEQ ID NO: 1308143 - protein, 24 aa, Mycobacterium
NEPLPALTSFVLPGGTPLSAQLHV

SEQ ID NO: 1308144 - protein, 27 aa, Mycobacterium
NEVVISRPLLLTLPAAGRFPTEAVLIN

SEQ ID NO: 1308145 - protein, 27 aa, Mycobacterium
NFAVANPPLKLVLIENPGRGGTLNHLG

SEQ ID NO: 1308146 - protein, 27 aa, Mycobacterium
NFMTQGWFTGLIPITVPIGAGSFADAA

SEQ ID NO: 1308147 - protein, 33 aa, Mycobacterium
NFSFGDYFKKGAIEFAWTLLTNPVDQGGYGFDP

SEQ ID NO: 1308148 - protein, 25 aa, Mycobacterium
NFVRGVPIWATLISLLNDGVPVVGV

SEQ ID NO: 1308149 - protein, 17 aa, Mycobacterium
NGAMFDPPLGPAVYPRT

SEQ ID NO: 1308150 - protein, 26 aa, Mycobacterium
NGANCEWYRCDTCRLLTAFSIRDVCP

SEQ ID NO: 1308151 - protein, 28 aa, Mycobacterium
NGGDGVAVLMRYTLRLLTSQQFQRATAL

SEQ ID NO: 1308152 - protein, 19 aa, Mycobacterium
NGGFFPSAREYSVRYGLSD

SEQ ID NO: 1308153 - protein, 23 aa, Mycobacterium
NGITKWVLGWERNGWLTAAKQPV

SEQ ID NO: 1308154 - protein, 22 aa, Mycobacterium
NGNWLIAGFDELAASVPGCIPF

SEQ ID NO: 1308155 - protein, 17 aa, Mycobacterium
NGQTLFEICARLTTKHG

SEQ ID NO: 1308156 - protein, 23 aa, Mycobacterium
NGRSWSRWSFIGAGAPSALTVRD

SEQ ID NO: 1308157 - protein, 17 aa, Mycobacterium
NGSFFAGLAALMISALT

SEQ ID NO: 1308158 - protein, 26 aa, Mycobacterium
NGSKTWISNARRSGLIALLCKTDPSA

SEQ ID NO: 1308159 - protein, 25 aa, Mycobacterium
NGTFRGHNPAFVTATAALKTYWRDG

SEQ ID NO: 1308160 - protein, 19 aa, Mycobacterium
NHFLGELPIPQQHSPRIHG

SEQ ID NO: 1308161 - protein, 40 aa, Mycobacterium
NHHLLGPTLIASWLNYLPPRLVPPVFRHQARRRDSSMIMN

SEQ ID NO: 1308162 - protein, 21 aa, Mycobacterium
NHYDKAFTVTWADGRSATFDS

SEQ ID NO: 1308163 - protein, 17 aa, Mycobacterium
NHYHRPERLLRPPDDPS

SEQ ID NO: 1308164 - protein, 18 aa, Mycobacterium
NICRELLVFGCQTAGALA

SEQ ID NO: 1308165 - protein, 24 aa, Mycobacterium
NIGFSFCYEAQRQVPAILDLLATG

SEQ ID NO: 1308166 - protein, 24 aa, Mycobacterium
NIGQILETHLGWVAKAGWNINVAG

SEQ ID NO: 1308167 - protein, 20 aa, Mycobacterium
NILDEFSVPATFFVPGYTAH

SEQ ID NO: 1308168 - protein, 22 aa, Mycobacterium
NIRSFRIRFTGQVWPGDLLSFG

SEQ ID NO: 1308169 - protein, 26 aa, Mycobacterium
NKQRWGYKFRFGVFRIDDHDFETIRS

SEQ ID NO: 1308170 - protein, 22 aa, Mycobacterium
NKYRLVFEKLRLQPGARLLDLG

SEQ ID NO: 1308171 - protein, 23 aa, Mycobacterium
NLARFAETLLPLFDDDIDRAITL

SEQ ID NO: 1308172 - protein, 23 aa, Mycobacterium
NLGGVWKTVKAGVPHILAGGRGG

SEQ ID NO: 1308173 - protein, 23 aa, Mycobacterium
NLPDMFTRMMLSLVTTGIAPKSF

SEQ ID NO: 1308174 - protein, 32 aa, Mycobacterium
NLRQLHAFLCDTLLMTGFGFAPPAATPTWGVL

SEQ ID NO: 1308175 - protein, 21 aa, Mycobacterium
NLVAERFVALTPAYRTGDGPK

SEQ ID NO: 1308176 - protein, 22 aa, Mycobacterium
NMGMLFRKHLVMFGPREVLLTS

SEQ ID NO: 1308177 - protein, 23 aa, Mycobacterium
NNAAVAHIAPFDEFPAEQFDRLV

SEQ ID NO: 1308178 - protein, 18 aa, Mycobacterium
NNAGVFPAAPTLDQDLAS

SEQ ID NO: 1308179 - protein, 38 aa, Mycobacterium
NPAAGPEFGFSLAGPIGALLLWRAGLADSIRTIFGFGR

SEQ ID NO: 1308180 - protein, 26 aa, Mycobacterium
NPATYTGLLDPIRKAFAKANGVKPAL

SEQ ID NO: 1308181 - protein, 21 aa, Mycobacterium
NPDLKMLGALPTLYDSRTTHS

SEQ ID NO: 1308182 - protein, 23 aa, Mycobacterium
NPDRFRFLATYIAGRSVDVTEAA

SEQ ID NO: 1308183 - protein, 23 aa, Mycobacterium
NPESRFLREIPQELIDWRRTDPE

SEQ ID NO: 1308184 - protein, 24 aa, Mycobacterium
NPGLQRLPLWRSLRERIEEADRLL

SEQ ID NO: 1308185 - protein, 23 aa, Mycobacterium
NPMPTLLEWQVRPGGWVQVFSDA

SEQ ID NO: 1308186 - protein, 28 aa, Mycobacterium
NPPDGIVVVDYPASFWPFSDGYFVDPTY

SEQ ID NO: 1308187 - protein, 25 aa, Mycobacterium
NPRVHLFFGGRFPCDLYDLMTLWQI

SEQ ID NO: 1308188 - protein, 28 aa, Mycobacterium
NPVSTVYFKVLLALMTRNAVVVAPHPRA

SEQ ID NO: 1308189 - protein, 25 aa, Mycobacterium
NQIDTPLIFLQNTTGFMVGAEYEQG

SEQ ID NO: 1308190 - protein, 22 aa, Mycobacterium
NQTRYYRAMELRQPLRAAFAGR

SEQ ID NO: 1308191 - protein, 18 aa, Mycobacterium
NRDLTAELALALGSAAAR

SEQ ID NO: 1308192 - protein, 20 aa, Mycobacterium
NRGHCAAIHLNMPIAYPPAG

SEQ ID NO: 1308193 - protein, 25 aa, Mycobacterium
NRHAFGSALIDKPLMRRKLAEMIVD

SEQ ID NO: 1308194 - protein, 17 aa, Mycobacterium
NRHLTMHKDWNPHDFIP

SEQ ID NO: 1308195 - protein, 19 aa, Mycobacterium
NRIALPREVTPGRLLVPAL

SEQ ID NO: 1308196 - protein, 19 aa, Mycobacterium
NRLAVLPEVFDLVDAYGAD

SEQ ID NO: 1308197 - protein, 22 aa, Mycobacterium
NRLLLLEAARRLIAERGAGAVS

SEQ ID NO: 1308198 - protein, 17 aa, Mycobacterium
NRRLRRALEHRNRTCVV

SEQ ID NO: 1308199 - protein, 28 aa, Mycobacterium
NRVGSPPVPLVPLILDHNLRNTRQIANA

SEQ ID NO: 1308200 - protein, 18 aa, Mycobacterium
NSADALVAAVRSKAPGDK

SEQ ID NO: 1308201 - protein, 24 aa, Mycobacterium
NSLNWALAEFVLGANPALWTYVGM

SEQ ID NO: 1308202 - protein, 18 aa, Mycobacterium
NSRVLVHPGTDHEKRGVV

SEQ ID NO: 1308203 - protein, 22 aa, Mycobacterium
NSRYLGEDVVLSESLRATTDFA

SEQ ID NO: 1308204 - protein, 17 aa, Mycobacterium
NSTAYVEGLLGAFRARV

SEQ ID NO: 1308205 - protein, 26 aa, Mycobacterium
NTAPLMLLPALRRDIAGIGPWAKLLR

SEQ ID NO: 1308206 - protein, 23 aa, Mycobacterium
NTEFNALIWMPPTGHRSGDVVLI

SEQ ID NO: 1308207 - protein, 20 aa, Mycobacterium
NTHPALLPAFPGAHAVADSL

SEQ ID NO: 1308208 - protein, 25 aa, Mycobacterium
NTKSFRFSFLVAYAGRIGERLTATN

SEQ ID NO: 1308209 - protein, 34 aa, Mycobacterium
NTNARAKMSLLRHGFVKIFCRPATGVVIGGVVVA

SEQ ID NO: 1308210 - protein, 23 aa, Mycobacterium
NTREYLRIVSGLLAGVEVDFDGT

SEQ ID NO: 1308211 - protein, 28 aa, Mycobacterium
NTRYVGDITYLPLATGGNLYLATVIDCC

SEQ ID NO: 1308212 - protein, 24 aa, Mycobacterium
NTVGFFHIGAHLPAIEAALFAKSG

SEQ ID NO: 1308213 - protein, 31 aa, Mycobacterium
NTVIDLNLKSPFWLVQALLPALRSAGTADDP

SEQ ID NO: 1308214 - protein, 20 aa, Mycobacterium
NTVSVGAFNFAPNVSMYAAG

SEQ ID NO: 1308215 - protein, 18 aa, Mycobacterium
NVALVYDTVLHRAAVLLA

SEQ ID NO: 1308216 - protein, 23 aa, Mycobacterium
NVGGGRKLLMFSDSRQAAAFAAP

SEQ ID NO: 1308217 - protein, 22 aa, Mycobacterium
NVIPAHAVLRYSMRAAESVSLR

SEQ ID NO: 1308218 - protein, 27 aa, Mycobacterium
NVPGKPRVFMLFIGGFGVYLDICAEVA

SEQ ID NO: 1308219 - protein, 21 aa, Mycobacterium
NVVDAYRYWTREAIIADIDRR

SEQ ID NO: 1308220 - protein, 31 aa, Mycobacterium
NVVKETLRLHPPLIILMRVAQGEFEVAGFPI

SEQ ID NO: 1308221 - protein, 24 aa, Mycobacterium
NWDTAWDPTLPAIPSAFVSGDPIA

SEQ ID NO: 1308222 - protein, 26 aa, Mycobacterium
NWFGNRLRGRRYGWINDAELGGGWIG

SEQ ID NO: 1308223 - protein, 18 aa, Mycobacterium
NWIVAVERKGVWVETERS

SEQ ID NO: 1308224 - protein, 17 aa, Mycobacterium
NWKLFYGGRSTESMAFL

SEQ ID NO: 1308225 - protein, 21 aa, Mycobacterium
NWLERTYAFVPRVGIEKIRDA

SEQ ID NO: 1308226 - protein, 17 aa, Mycobacterium
NWPLVPTMDVVVPHTRT

SEQ ID NO: 1308227 - protein, 19 aa, Mycobacterium
NYLIVRAGEFSRISDVLLP

SEQ ID NO: 1308228 - protein, 20 aa, Mycobacterium
NYYTMQFALARRGGLTPGET

SEQ ID NO: 1308229 - protein, 21 aa, Mycobacterium
PAAAVFISPLLDFTASGASVD

SEQ ID NO: 1308230 - protein, 21 aa, Mycobacterium
PAADFFIKWMSRGNTLVYKLS

SEQ ID NO: 1308231 - protein, 21 aa, Mycobacterium
PADGIMLLAAHISRHGTLTEW

SEQ ID NO: 1308232 - protein, 34 aa, Mycobacterium
PADGPWTVTVPGATWGWSALLERYGTLGRDRVVA

SEQ ID NO: 1308233 - protein, 17 aa, Mycobacterium
PADLLARRRFDADALTG

SEQ ID NO: 1308234 - protein, 25 aa, Mycobacterium
PAERLQNPPPGKPMAWWFTLSEHVG

SEQ ID NO: 1308235 - protein, 17 aa, Mycobacterium
PAFFVPEGDTFIPTGIA

SEQ ID NO: 1308236 - protein, 23 aa, Mycobacterium
PAFKAPFEPLTPGGFRAPNTNFY

SEQ ID NO: 1308237 - protein, 24 aa, Mycobacterium
PAFQGTIKSAVAFGALLSKGIGDT

SEQ ID NO: 1308238 - protein, 31 aa, Mycobacterium
PAGAMFGDYWYANLRTMVRFDRAFESARRCG

SEQ ID NO: 1308239 - protein, 23 aa, Mycobacterium
PAGGAPMAMMPPGGGMGGGGPVS

SEQ ID NO: 1308240 - protein, 20 aa, Mycobacterium
PAGMPTLSAVPDLSGMEGET

SEQ ID NO: 1308241 - protein, 17 aa, Mycobacterium
PAIFSASANFTDQSAMM

SEQ ID NO: 1308242 - protein, 19 aa, Mycobacterium
PAITAHRALTVAEGWPSRL

SEQ ID NO: 1308243 - protein, 20 aa, Mycobacterium
PALDVFGRVFFIGEKAGSAQ

SEQ ID NO: 1308244 - protein, 17 aa, Mycobacterium
PALLAERGFLYDSSLMD

SEQ ID NO: 1308245 - protein, 17 aa, Mycobacterium
PALLDRFTETLIPGRAA

SEQ ID NO: 1308246 - protein, 19 aa, Mycobacterium
PALLMLHPPSETTPSLPEC

SEQ ID NO: 1308247 - protein, 49 aa, Mycobacterium
PALNTTVMPFILRGAALLGIDSVLLPIGPRRELWARLGGALKPPHLADL

SEQ ID NO: 1308248 - protein, 17 aa, Mycobacterium
PALWTYVGMPTAARVVW

SEQ ID NO: 1308249 - protein, 21 aa, Mycobacterium
PAPSYFVYDAILNRKDRELLD

SEQ ID NO: 1308250 - protein, 25 aa, Mycobacterium
PARARYLLLRLLERSGEQRVAIPAL

SEQ ID NO: 1308251 - protein, 25 aa, Mycobacterium
PARRRVLDPAIYREAASRLDRYFSI

SEQ ID NO: 1308252 - protein, 20 aa, Mycobacterium
PARSFWRIDVAPVSRTVLHF

SEQ ID NO: 1308253 - protein, 25 aa, Mycobacterium
PARTQTFTPPPWWGALDGERPVVHV

SEQ ID NO: 1308254 - protein, 24 aa, Mycobacterium
PASESLLPLPESLAEQLPRSLPRG

SEQ ID NO: 1308255 - protein, 31 aa, Mycobacterium
PASPGLAAILPSFPATLKKQLKGAPVPAPRA

SEQ ID NO: 1308256 - protein, 23 aa, Mycobacterium
PATPYLTLWARVAGFDPTHLDTA

SEQ ID NO: 1308257 - protein, 26 aa, Mycobacterium
PATVGRWLEYVPPTVLRTVFGWTSRR

SEQ ID NO: 1308258 - protein, 20 aa, Mycobacterium
PAVAAMSPLGQAFPAVGQAV

SEQ ID NO: 1308259 - protein, 19 aa, Mycobacterium
PAVALLHVRRREAGTVTDV

SEQ ID NO: 1308260 - protein, 17 aa, Mycobacterium
PAVKPFKEALVADGIPF

SEQ ID NO: 1308261 - protein, 20 aa, Mycobacterium
PAVQYIPLHDVNDSALVCSD

SEQ ID NO: 1308262 - protein, 24 aa, Mycobacterium
PAWAPLPLQYADFGAWQTALLADD

SEQ ID NO: 1308263 - protein, 24 aa, Mycobacterium
PAWGSLLEISPPGSAALAALKVTG

SEQ ID NO: 1308264 - protein, 20 aa, Mycobacterium
PAWVTLLRSAGAHDTYLRTY

SEQ ID NO: 1308265 - protein, 21 aa, Mycobacterium
PCDKPVPTAGLRRLQRYRRLS

SEQ ID NO: 1308266 - protein, 17 aa, Mycobacterium
PCRQTVDRLARLGILAA

SEQ ID NO: 1308267 - protein, 17 aa, Mycobacterium
PCVYLVDSGGAFLPRQD

SEQ ID NO: 1308268 - protein, 21 aa, Mycobacterium
PDAFPLIITHGWPGSVVEFDK

SEQ ID NO: 1308269 - protein, 30 aa, Mycobacterium
PDAGFGAFRRSLERRLPLLEPLRYKLVEIP

SEQ ID NO: 1308270 - protein, 24 aa, Mycobacterium
PDALAESFVPPTWDAPAEASGGQV

SEQ ID NO: 1308271 - protein, 20 aa, Mycobacterium
PDALARLMRALIGEGVFTQR

SEQ ID NO: 1308272 - protein, 17 aa, Mycobacterium
PDALPLDAAAPLLCAGI

SEQ ID NO: 1308273 - protein, 22 aa, Mycobacterium
PDAVRVFLTPESARQFATRSNR

SEQ ID NO: 1308274 - protein, 24 aa, Mycobacterium
PDDNLYQLTIYPGELSMISPSGGN

SEQ ID NO: 1308275 - protein, 20 aa, Mycobacterium
PDEALLMEVPLSLPAGDPAE

SEQ ID NO: 1308276 - protein, 26 aa, Mycobacterium
PDELLAARLAVFRRWPSSSTAGRLYR

SEQ ID NO: 1308277 - protein, 19 aa, Mycobacterium
PDFAALFLNGLRGLAPDGV

SEQ ID NO: 1308278 - protein, 24 aa, Mycobacterium
PDGRHEFRWWDGQRWTDQVSSRGQ

SEQ ID NO: 1308279 - protein, 23 aa, Mycobacterium
PDGTPLPGTAYKWTVVFHHNEHT

SEQ ID NO: 1308280 - protein, 27 aa, Mycobacterium
PDGVLRELFSLLRPGGELRYLEHIAET

SEQ ID NO: 1308281 - protein, 18 aa, Mycobacterium
PDHLLGQLGIHDVLESDD

SEQ ID NO: 1308282 - protein, 21 aa, Mycobacterium
PDLAVLLRMLPKTDLDDLEGV

SEQ ID NO: 1308283 - protein, 18 aa, Mycobacterium
PDLLLLDEPFGALDALTR

SEQ ID NO: 1308284 - protein, 22 aa, Mycobacterium
PDLVAALRIRLGPVARVRYGLS

SEQ ID NO: 1308285 - protein, 25 aa, Mycobacterium
PDPDRPVYLVVFGTTDDGGLIGLNL

SEQ ID NO: 1308286 - protein, 24 aa, Mycobacterium
PDPRQWVGTLWRTSTGLVGAAARG

SEQ ID NO: 1308287 - protein, 22 aa, Mycobacterium
PDPRTLTWWAVQSLTKTAIGCL

SEQ ID NO: 1308288 - protein, 17 aa, Mycobacterium
PDRGMFTVYLATDSEKP

SEQ ID NO: 1308289 - protein, 28 aa, Mycobacterium
PDSDVTVGLVFRALFGQPDLLSRLHDVE

SEQ ID NO: 1308290 - protein, 21 aa, Mycobacterium
PDSVARFFPAKPDLFDIVVFD

SEQ ID NO: 1308291 - protein, 21 aa, Mycobacterium
PDTIYFMPFFDTRDGPVVIEI

SEQ ID NO: 1308292 - protein, 32 aa, Mycobacterium
PDTLRVQPWDRDQLHRLFDDLEFRVLRDRLFE

SEQ ID NO: 1308293 - protein, 17 aa, Mycobacterium
PDVPPPFGFKRSGQWLW

SEQ ID NO: 1308294 - protein, 26 aa, Mycobacterium
PDVRSCDLQLRQFGRRPEFAGRVTTV

SEQ ID NO: 1308295 - protein, 25 aa, Mycobacterium
PDVVDGLALFLPQATPAAKPGVQLF

SEQ ID NO: 1308296 - protein, 32 aa, Mycobacterium
PDYDMSMARQLYYGCDVWLNNPLRPLEACGTS

SEQ ID NO: 1308297 - protein, 25 aa, Mycobacterium
PEATRLAPVARPGRLPYDHADIIVG

SEQ ID NO: 1308298 - protein, 24 aa, Mycobacterium
PEDLASLQFLISASGPLDPATRDE

SEQ ID NO: 1308299 - protein, 18 aa, Mycobacterium
PEFFVAMRALCDEFDALL

SEQ ID NO: 1308300 - protein, 23 aa, Mycobacterium
PEGIPAERLVWSEAVAPGGYTAA

SEQ ID NO: 1308301 - protein, 19 aa, Mycobacterium
PEGLAPRIKNLGQWRHHLI

SEQ ID NO: 1308302 - protein, 18 aa, Mycobacterium
PEGLRWLDSCQEALRASS

SEQ ID NO: 1308303 - protein, 27 aa, Mycobacterium
PEIAELAHLLPRPPRSATLPAVLGVAE

SEQ ID NO: 1308304 - protein, 26 aa, Mycobacterium
PEIEQMQGWLQEWGASSTPAPTSTGM

SEQ ID NO: 1308305 - protein, 17 aa, Mycobacterium
PELLRVLDFTPTPDLVL

SEQ ID NO: 1308306 - protein, 24 aa, Mycobacterium
PELRARLDEMMLAPGLPDGTAVTE

SEQ ID NO: 1308307 - protein, 22 aa, Mycobacterium
PELRTPWPREALKDLLVMLGAG

SEQ ID NO: 1308308 - protein, 18 aa, Mycobacterium
PEPGVPLPMVPSVLCAED

SEQ ID NO: 1308309 - protein, 21 aa, Mycobacterium
PEPHYRPSAKLAAFVRARDLF

SEQ ID NO: 1308310 - protein, 22 aa, Mycobacterium
PERLWEALLRGDDFVTEVPLDR

SEQ ID NO: 1308311 - protein, 24 aa, Mycobacterium
PEVFARFRRAVTDTGLYKDSDRLA

SEQ ID NO: 1308312 - protein, 26 aa, Mycobacterium
PFGEVMALLERFGIPTAPHLVLGDGD

SEQ ID NO: 1308313 - protein, 19 aa, Mycobacterium
PFGFFSVPYEASLATTYWG

SEQ ID NO: 1308314 - protein, 22 aa, Mycobacterium
PFGGRVPPIWIGASGPRMLDLV

SEQ ID NO: 1308315 - protein, 19 aa, Mycobacterium
PFGKRLLVDNGWFATLRRP

SEQ ID NO: 1308316 - protein, 20 aa, Mycobacterium
PFGLTVLQLQRCPWCGTKID

SEQ ID NO: 1308317 - protein, 17 aa, Mycobacterium
PFIARYRKEVTGSLDDA

SEQ ID NO: 1308318 - protein, 19 aa, Mycobacterium
PFIMQADGKAWLFAPNGLA

SEQ ID NO: 1308319 - protein, 17 aa, Mycobacterium
PFRKMGIHSSRTGELFF

SEQ ID NO: 1308320 - protein, 26 aa, Mycobacterium
PFTLENGLLTGIRKLARPKLKARYGD

SEQ ID NO: 1308321 - protein, 25 aa, Mycobacterium
PGAGPTIAPYLPPADAKQLAGGETV

SEQ ID NO: 1308322 - protein, 27 aa, Mycobacterium
PGAHYVGPGWQDGRRLWNVRSLMTGET

SEQ ID NO: 1308323 - protein, 24 aa, Mycobacterium
PGAPLLGRFSFDVRCTWLRNWVNG

SEQ ID NO: 1308324 - protein, 29 aa, Mycobacterium
PGAQMMFDLPPSWFAWWARQGMRTSLRYK

SEQ ID NO: 1308325 - protein, 19 aa, Mycobacterium
PGAVSEYRKVRDRASFAFA

SEQ ID NO: 1308326 - protein, 20 aa, Mycobacterium
PGDFDLSTLRFALSGAEPVE

SEQ ID NO: 1308327 - protein, 24 aa, Mycobacterium
PGDLAIVRAILALADAFELEVVAE

SEQ ID NO: 1308328 - protein, 26 aa, Mycobacterium
PGDRDLMLISPIILYDHPEIAEQSKG

SEQ ID NO: 1308329 - protein, 17 aa, Mycobacterium
PGDRWIHEQIRAVAPRT

SEQ ID NO: 1308330 - protein, 17 aa, Mycobacterium
PGDVWRAFLAQETTLDD

SEQ ID NO: 1308331 - protein, 21 aa, Mycobacterium
PGDWRVIKGLTQPELAAAAKI

SEQ ID NO: 1308332 - protein, 28 aa, Mycobacterium
PGEHVQFRLLPIGDPFRFLVNLAKSVPV

SEQ ID NO: 1308333 - protein, 18 aa, Mycobacterium
PGFDSLGLALSLYDEIVV

SEQ ID NO: 1308334 - protein, 19 aa, Mycobacterium
PGFRRLSLAGQRLPDSLGG

SEQ ID NO: 1308335 - protein, 24 aa, Mycobacterium
PGGGTQYRIIAPPGLEPSVSGYVN

SEQ ID NO: 1308336 - protein, 27 aa, Mycobacterium
PGHRVHGHPLPWQDLRAAFTERGWLDM

SEQ ID NO: 1308337 - protein, 26 aa, Mycobacterium
PGITNGRIPRLYGRQASEFVIRRAMS

SEQ ID NO: 1308338 - protein, 29 aa, Mycobacterium
PGKRKYAMTTLVDLAPRPALPDIADKDMA

SEQ ID NO: 1308339 - protein, 20 aa, Mycobacterium
PGLDALITHALSAGASVRLV

SEQ ID NO: 1308340 - protein, 32 aa, Mycobacterium
PGLQTGEAWVWSPAFLRLLQRVRITMSDTFDS

SEQ ID NO: 1308341 - protein, 20 aa, Mycobacterium
PGNRTFYLQAVHDKRVVSVV

SEQ ID NO: 1308342 - protein, 28 aa, Mycobacterium
PGQYIGIGLLIDGRWRWRSYSLTSSPRS

SEQ ID NO: 1308343 - protein, 17 aa, Mycobacterium
PGRGPRRYVCGGELITF

SEQ ID NO: 1308344 - protein, 18 aa, Mycobacterium
PGRMLAARFGLGPSDTCY

SEQ ID NO: 1308345 - protein, 17 aa, Mycobacterium
PGTPVPLPPAPPGARNE

SEQ ID NO: 1308346 - protein, 18 aa, Mycobacterium
PGVGPWPGDLPDDPRYDP

SEQ ID NO: 1308347 - protein, 24 aa, Mycobacterium
PGWDARLPEQPRLLIKWVEACYGA

SEQ ID NO: 1308348 - protein, 19 aa, Mycobacterium
PGYANFAVANPPLKLVLIE

SEQ ID NO: 1308349 - protein, 20 aa, Mycobacterium
PGYSWTPIILSDGAHHTNAS

SEQ ID NO: 1308350 - protein, 22 aa, Mycobacterium
PGYSWTPIILSDGAHHTNASYY

SEQ ID NO: 1308351 - protein, 24 aa, Mycobacterium
PHAFSAAPNFAFDLAARKTSDSDL

SEQ ID NO: 1308352 - protein, 17 aa, Mycobacterium
PHDFIPWSDGKNYYALG

SEQ ID NO: 1308353 - protein, 19 aa, Mycobacterium
PHDIAAGAVTLFVGGSEAA

SEQ ID NO: 1308354 - protein, 18 aa, Mycobacterium
PHEESLPMFIVYRHEEIQ

SEQ ID NO: 1308355 - protein, 31 aa, Mycobacterium
PHFEKMLYDNALLLRAYAHWARRTGDPLARR

SEQ ID NO: 1308356 - protein, 18 aa, Mycobacterium
PHLADVKPFGRHVMKHVD

SEQ ID NO: 1308357 - protein, 27 aa, Mycobacterium
PHRFDPDRFLSRRPTPFEYAPFGGGYR

SEQ ID NO: 1308358 - protein, 19 aa, Mycobacterium
PHYRPSAKLAAFVRARDLF

SEQ ID NO: 1308359 - protein, 25 aa, Mycobacterium
PIAVEAYGLFIFRDAIRALGGSTVP

SEQ ID NO: 1308360 - protein, 25 aa, Mycobacterium
PIGADDYWYLWRQMVSQPGVVDPAG

SEQ ID NO: 1308361 - protein, 20 aa, Mycobacterium
PIGHLGPLLNLARGLVDRGD

SEQ ID NO: 1308362 - protein, 19 aa, Mycobacterium
PIHRLLAAADRAWASVAGH

SEQ ID NO: 1308363 - protein, 19 aa, Mycobacterium
PITVERQVLYWLDPVGGTE

SEQ ID NO: 1308364 - protein, 27 aa, Mycobacterium
PKAGSPMAWLLTLAHRRAVDRVRSEEA

SEQ ID NO: 1308365 - protein, 17 aa, Mycobacterium
PKEFIFVDELRRLGNGK

SEQ ID NO: 1308366 - protein, 26 aa, Mycobacterium
PKHQSLTMFLVPLDSAGIEIQGIRTV

SEQ ID NO: 1308367 - protein, 26 aa, Mycobacterium
PKLRAGSFFPSLLERRRRIDKALHAV

SEQ ID NO: 1308368 - protein, 23 aa, Mycobacterium
PKNTWPAVLTWRAHDVARMESVR

SEQ ID NO: 1308369 - protein, 25 aa, Mycobacterium
PLAAQWIVRVVVSLAYWPDPDPRQE

SEQ ID NO: 1308370 - protein, 24 aa, Mycobacterium
PLAEYLQRVRAITPLIRAEAEGME

SEQ ID NO: 1308371 - protein, 29 aa, Mycobacterium
PLAPQRASLLTKLFYRMAKRRFGEVPEPF

SEQ ID NO: 1308372 - protein, 31 aa, Mycobacterium
PLDSFDARTRFALWWVRLYGRGVQAKSELRW

SEQ ID NO: 1308373 - protein, 20 aa, Mycobacterium
PLDVYRMLRVTNPSPYMYLL

SEQ ID NO: 1308374 - protein, 24 aa, Mycobacterium
PLEDGLKYPARLIDEFTWETDLGD

SEQ ID NO: 1308375 - protein, 19 aa, Mycobacterium
PLEWACFTFGIIQNDGHFT

SEQ ID NO: 1308376 - protein, 20 aa, Mycobacterium
PLFSRTSAGLAFTPGGLRLA

SEQ ID NO: 1308377 - protein, 31 aa, Mycobacterium
PLGLIQDRELALVGNLMYVREDFTAAMDLLA

SEQ ID NO: 1308378 - protein, 24 aa, Mycobacterium
PLHTYESPFATRLPTQDAKGVTFV

SEQ ID NO: 1308379 - protein, 19 aa, Mycobacterium
PLIGRDLLTQLGFRSGIHG

SEQ ID NO: 1308380 - protein, 19 aa, Mycobacterium
PLISPLRAAGVPRPSRRNS

SEQ ID NO: 1308381 - protein, 20 aa, Mycobacterium
PLLLFAPHPSWIARQPRPDQ

SEQ ID NO: 1308382 - protein, 19 aa, Mycobacterium
PLPGPLPAVTVFSATPITP

SEQ ID NO: 1308383 - protein, 18 aa, Mycobacterium
PLPWAQMHRVAAPTLLTW

SEQ ID NO: 1308384 - protein, 21 aa, Mycobacterium
PLQDAIDRLLFSEALETQKCF

SEQ ID NO: 1308385 - protein, 31 aa, Mycobacterium
PLRCNAPERLAMALLGTGFAYAPERRRRQAE

SEQ ID NO: 1308386 - protein, 18 aa, Mycobacterium
PLTELPAPAISPALEDAH

SEQ ID NO: 1308387 - protein, 19 aa, Mycobacterium
PLTPPLLSDGVTVTHAPAA

SEQ ID NO: 1308388 - protein, 23 aa, Mycobacterium
PLTVPVWYQYSPGGQPWVLTGAG

SEQ ID NO: 1308389 - protein, 20 aa, Mycobacterium
PLVIAELLRAMTNESGKLMV

SEQ ID NO: 1308390 - protein, 22 aa, Mycobacterium
PLVLGHAARLLAAVTLAAFPSA

SEQ ID NO: 1308391 - protein, 20 aa, Mycobacterium
PLVLIGVMPSIHPSAEEYQR

SEQ ID NO: 1308392 - protein, 17 aa, Mycobacterium
PLVLQQIWDTPLPMVVN

SEQ ID NO: 1308393 - protein, 17 aa, Mycobacterium
PLVLVPVRLSTANRGER

SEQ ID NO: 1308394 - protein, 40 aa, Mycobacterium
PLYGEVWGDPRWRQLSKTAQWLYLMLMSSPSRNAAGIVQM

SEQ ID NO: 1308395 - protein, 27 aa, Mycobacterium
PMADPPPPPPLPPDSPLFDGYDPIPPG

SEQ ID NO: 1308396 - protein, 29 aa, Mycobacterium
PMAVEMCKLSLWLVSLDKTKPFSFVDDKI

SEQ ID NO: 1308397 - protein, 20 aa, Mycobacterium
PMIGILEHLASVAPATSVQV

SEQ ID NO: 1308398 - protein, 20 aa, Mycobacterium
PMILGALPFDLTAPTALFRP

SEQ ID NO: 1308399 - protein, 23 aa, Mycobacterium
PMLARVLLAAWGGDAAICVPACP

SEQ ID NO: 1308400 - protein, 18 aa, Mycobacterium
PMLTSDALALLFGVTPED

SEQ ID NO: 1308401 - protein, 24 aa, Mycobacterium
PMTKHAYAALLRRALRAGGITADN

SEQ ID NO: 1308402 - protein, 27 aa, Mycobacterium
PNAMIAGRMRIPWVPVDNARIARRHAH

SEQ ID NO: 1308403 - protein, 25 aa, Mycobacterium
PNCAEWTILQYATAKIGAILVNINP

SEQ ID NO: 1308404 - protein, 27 aa, Mycobacterium
PNDPLRLVFVCAMWMTGFDAPSVSTIY

SEQ ID NO: 1308405 - protein, 32 aa, Mycobacterium
PNGCMATSGSLIRWFQTLIGGVDLLQLDDEAA

SEQ ID NO: 1308406 - protein, 30 aa, Mycobacterium
PNHYQKLTGLENLRFFASLYDGPTLDPAEL

SEQ ID NO: 1308407 - protein, 25 aa, Mycobacterium
PNKAIARFIVRYTEAFKRYGITDDT

SEQ ID NO: 1308408 - protein, 28 aa, Mycobacterium
PNTPFNATRLGRLIAEKTDFPAGVVNVV

SEQ ID NO: 1308409 - protein, 20 aa, Mycobacterium
PPAKSIPLPVSYVLATLGSV

SEQ ID NO: 1308410 - protein, 22 aa, Mycobacterium
PPAVKEAWIGLLGPQVLWELYG

SEQ ID NO: 1308411 - protein, 22 aa, Mycobacterium
PPEHLAWIGQWGIFDALRAGRD

SEQ ID NO: 1308412 - protein, 18 aa, Mycobacterium
PPFGFKRSGQWLWWDNTT

SEQ ID NO: 1308413 - protein, 33 aa, Mycobacterium
PPGILLWEDPPLHDLHRRLLSRVFTPRRMLAVE

SEQ ID NO: 1308414 - protein, 33 aa, Mycobacterium
PPGLNGAWRTLTWLQAHGWSRLLPRTVVALNRT

SEQ ID NO: 1308415 - protein, 30 aa, Mycobacterium
PPGSDFIGSFLPMMIVMDPPRHDQLRALVS

SEQ ID NO: 1308416 - protein, 19 aa, Mycobacterium
PPILDPFDPMTVWAYDECD

SEQ ID NO: 1308417 - protein, 21 aa, Mycobacterium
PPIRSLFVYNSNPVSQGPAQE

SEQ ID NO: 1308418 - protein, 25 aa, Mycobacterium
PPLEDAVLRPLLAAATYLVDVIGPH

SEQ ID NO: 1308419 - protein, 23 aa, Mycobacterium
PPMIMRDTIFCAIPEDVDRDAIA

SEQ ID NO: 1308420 - protein, 17 aa, Mycobacterium
PPPGAVSEYRKVRDRAS

SEQ ID NO: 1308421 - protein, 19 aa, Mycobacterium
PPPPPPVEAPPPPPPPVEA

SEQ ID NO: 1308422 - protein, 19 aa, Mycobacterium
PPPQKPPKLGPPNALLNIT

SEQ ID NO: 1308423 - protein, 40 aa, Mycobacterium
PPPQNEETPFYPRSPYAAAKLYSYWITKNYREAYGLFAVN

SEQ ID NO: 1308424 - protein, 22 aa, Mycobacterium
PPPSQLLTQRDWIDECYAGDTV

SEQ ID NO: 1308425 - protein, 23 aa, Mycobacterium
PPRSSNPLVPIRDPASGSSADGD

SEQ ID NO: 1308426 - protein, 18 aa, Mycobacterium
PPVEAPPPPPPPVEAPPP

SEQ ID NO: 1308427 - protein, 19 aa, Mycobacterium
PQAWQKLIDVNLTGTFHCC

SEQ ID NO: 1308428 - protein, 20 aa, Mycobacterium
PQEEWPGRLRKLVADQIGLI

SEQ ID NO: 1308429 - protein, 25 aa, Mycobacterium
PQETRLRLLIIRSGLPRPVTQIPVH

SEQ ID NO: 1308430 - protein, 30 aa, Mycobacterium
PQEVREIYTMWRPSPLIRARRFEKALNTSA

SEQ ID NO: 1308431 - protein, 34 aa, Mycobacterium
PQGDPIELLARRFEPVLFFHPDEVFFPSDAKRFV

SEQ ID NO: 1308432 - protein, 30 aa, Mycobacterium
PQLVKLRHYFDHPLLVEMFAESISVAAQSL

SEQ ID NO: 1308433 - protein, 23 aa, Mycobacterium
PQNRVRRYVCLKGPDHGGCGRLT

SEQ ID NO: 1308434 - protein, 19 aa, Mycobacterium
PQPVIAQLVPRTDTAAGIL

SEQ ID NO: 1308435 - protein, 35 aa, Mycobacterium
PQRRPILHLPSHWPWTEHWLTLWRNTIGYSPPATA

SEQ ID NO: 1308436 - protein, 19 aa, Mycobacterium
PQTCALVSAHFYPQMPFTS

SEQ ID NO: 1308437 - protein, 26 aa, Mycobacterium
PRAGPVRLRYPVYVDLLPPCNDACPA

SEQ ID NO: 1308438 - protein, 20 aa, Mycobacterium
PRAYRRLQDLLADPAHAAVG

SEQ ID NO: 1308439 - protein, 19 aa, Mycobacterium
PRDRVHLERFQVAQVPAGA

SEQ ID NO: 1308440 - protein, 25 aa, Mycobacterium
PRELVARIRAMLRRPRIQQSAAAAT

SEQ ID NO: 1308441 - protein, 17 aa, Mycobacterium
PREVLGVLRAVLFAPED

SEQ ID NO: 1308442 - protein, 29 aa, Mycobacterium
PRFAEEIAWWVWWCWDQQLRKIEPSLLAW

SEQ ID NO: 1308443 - protein, 25 aa, Mycobacterium
PRGGVYLLPFPMCHIAGYNMLVQHA

SEQ ID NO: 1308444 - protein, 18 aa, Mycobacterium
PRGVGVPQDVRLAITDPV

SEQ ID NO: 1308445 - protein, 20 aa, Mycobacterium
PRIAGPCGVVIFGVTGDLSR

SEQ ID NO: 1308446 - protein, 22 aa, Mycobacterium
PRPQRMYLRFAPPIDTARPARV

SEQ ID NO: 1308447 - protein, 19 aa, Mycobacterium
PRPWIAEPVVKFLCPAPGY

SEQ ID NO: 1308448 - protein, 25 aa, Mycobacterium
PRQWQEVLVRLTPRQFSISSSPLVS

SEQ ID NO: 1308449 - protein, 18 aa, Mycobacterium
PRRAMLVRPPAGLTASAL

SEQ ID NO: 1308450 - protein, 18 aa, Mycobacterium
PRRGVGDSVLIVPVVTRD

SEQ ID NO: 1308451 - protein, 17 aa, Mycobacterium
PRRHPGKRSPLWHQRQR

SEQ ID NO: 1308452 - protein, 29 aa, Mycobacterium
PRSAGTAILFLLMPGQQSAWHTVRSAELW

SEQ ID NO: 1308453 - protein, 17 aa, Mycobacterium
PRSARPDEPEFLPLVRR

SEQ ID NO: 1308454 - protein, 22 aa, Mycobacterium
PRSRLFYRAFPYNEAALLLTRV

SEQ ID NO: 1308455 - protein, 17 aa, Mycobacterium
PRTAAAARRIPVASAAV

SEQ ID NO: 1308456 - protein, 18 aa, Mycobacterium
PRTNPDWDQLLRGAVHDT

SEQ ID NO: 1308457 - protein, 34 aa, Mycobacterium
PRVKVGADVLPWWPVRGVYLLLERGASTSTDLLG

SEQ ID NO: 1308458 - protein, 18 aa, Mycobacterium
PRVRDVRRIGSCALDLCM

SEQ ID NO: 1308459 - protein, 24 aa, Mycobacterium
PSANPYLAAAAFLGSALHGIDRRL

SEQ ID NO: 1308460 - protein, 23 aa, Mycobacterium
PSASPGYSTPPPEGIRDAEDQGD

SEQ ID NO: 1308461 - protein, 32 aa, Mycobacterium
PSATLLIDRSASWMFDYYPLRVVRELPDGACE

SEQ ID NO: 1308462 - protein, 21 aa, Mycobacterium
PSDRWTHFFAEQPELQAYFQE

SEQ ID NO: 1308463 - protein, 23 aa, Mycobacterium
PSDTMTVGPLTIDTARRLVFVDG

SEQ ID NO: 1308464 - protein, 17 aa, Mycobacterium
PSFPLLDPTKPHRAYWY

SEQ ID NO: 1308465 - protein, 29 aa, Mycobacterium
PSIAKLVAGLGLRLPIVATGYGTFETASR

SEQ ID NO: 1308466 - protein, 24 aa, Mycobacterium
PSIVEMLVAVMWGMGFYAGYVGGQ

SEQ ID NO: 1308467 - protein, 19 aa, Mycobacterium
PSKWRRLTEDCLAKHSILP

SEQ ID NO: 1308468 - protein, 29 aa, Mycobacterium
PSLRENDEYFIVTHQLALLGSIYDPDGTY

SEQ ID NO: 1308469 - protein, 21 aa, Mycobacterium
PSLRIAILEARFAGFGASGRN

SEQ ID NO: 1308470 - protein, 25 aa, Mycobacterium
PSPENRMISWPYPKLMNSNNMVDQG

SEQ ID NO: 1308471 - protein, 18 aa, Mycobacterium
PSQRTLVIIPTYNERENL

SEQ ID NO: 1308472 - protein, 17 aa, Mycobacterium
PSRHLVKFVACDGALWA

SEQ ID NO: 1308473 - protein, 32 aa, Mycobacterium
PSTAKEWHQYWIDTRLQWYVDLGIDRDNLRLY

SEQ ID NO: 1308474 - protein, 22 aa, Mycobacterium
PSTAVLRRLGFIRVAEIEDSDD

SEQ ID NO: 1308475 - protein, 38 aa, Mycobacterium
PSVAWAETYPGTLSYYLASAFREVWMQPSGTVGLVGFA

SEQ ID NO: 1308476 - protein, 27 aa, Mycobacterium
PSVGLMQPWRFIRITDPALRRDIHALV

SEQ ID NO: 1308477 - protein, 20 aa, Mycobacterium
PTALPPGWRIEQSQSAPWFY

SEQ ID NO: 1308478 - protein, 23 aa, Mycobacterium
PTETEVWRWYLVDKNAPDDVRDW

SEQ ID NO: 1308479 - protein, 19 aa, Mycobacterium
PTGFHPAAWRVPGAFSNGN

SEQ ID NO: 1308480 - protein, 27 aa, Mycobacterium
PTLPGLRRRWLPMNSSMIATAPIPDER

SEQ ID NO: 1308481 - protein, 25 aa, Mycobacterium
PTLSLLTLVPLSHYLGWPVPELKRA

SEQ ID NO: 1308482 - protein, 19 aa, Mycobacterium
PTLWPQREALKSALQYPAL

SEQ ID NO: 1308483 - protein, 30 aa, Mycobacterium
PTPADAADALALAICHCWRAPMIARMAAAE

SEQ ID NO: 1308484 - protein, 24 aa, Mycobacterium
PTPNLVAAMDLVTGPPLGGIAPKE

SEQ ID NO: 1308485 - protein, 22 aa, Mycobacterium
PTPTPEIIYPQGPPGGFDYGDG

SEQ ID NO: 1308486 - protein, 17 aa, Mycobacterium
PTQFLRENLDAMGVVPA

SEQ ID NO: 1308487 - protein, 22 aa, Mycobacterium
PTQNSRWFLLSKYDGVTVTTAD

SEQ ID NO: 1308488 - protein, 20 aa, Mycobacterium
PTRFMRTAASVPWLAEGVHE

SEQ ID NO: 1308489 - protein, 20 aa, Mycobacterium
PTRHSGPVTGIQYAGSVLLA

SEQ ID NO: 1308490 - protein, 25 aa, Mycobacterium
PTRKTFHLGPALVPLGQAAADALDV

SEQ ID NO: 1308491 - protein, 22 aa, Mycobacterium
PTTLIDALIRQGAADLTIVSNN

SEQ ID NO: 1308492 - protein, 20 aa, Mycobacterium
PTVVRVLGAIEIPVVAQALA

SEQ ID NO: 1308493 - protein, 26 aa, Mycobacterium
PVAFDDLHLWYFGDAPQRPQPHLDAE

SEQ ID NO: 1308494 - protein, 18 aa, Mycobacterium
PVAPALTAPYVVTTLAAD

SEQ ID NO: 1308495 - protein, 19 aa, Mycobacterium
PVARRIIGPSPLIGRSTHD

SEQ ID NO: 1308496 - protein, 21 aa, Mycobacterium
PVDIYTFLPLARAAVQEAMAV

SEQ ID NO: 1308497 - protein, 33 aa, Mycobacterium
PVDVLGNLMKWPAVERVWLPEWLNHRDEVLARL

SEQ ID NO: 1308498 - protein, 17 aa, Mycobacterium
PVEAPPPQPPPPNVFEI

SEQ ID NO: 1308499 - protein, 17 aa, Mycobacterium
PVGDRIVFLFADPAILR

SEQ ID NO: 1308500 - protein, 34 aa, Mycobacterium
PVGEEWLYQSWSASYLPLMRVLRRLAGEGRDHLL

SEQ ID NO: 1308501 - protein, 19 aa, Mycobacterium
PVGLAFFFRNSALGRVVAF

SEQ ID NO: 1308502 - protein, 25 aa, Mycobacterium
PVHDGGFVIGPMVKLGWGRPVSFVT

SEQ ID NO: 1308503 - protein, 21 aa, Mycobacterium
PVHFVQMWVVPDESGIAPGYQ

SEQ ID NO: 1308504 - protein, 18 aa, Mycobacterium
PVHQIPQPIAWPGSSDRN

SEQ ID NO: 1308505 - protein, 18 aa, Mycobacterium
PVHWRQWTPAALAEAAER

SEQ ID NO: 1308506 - protein, 28 aa, Mycobacterium
PVIGSKELIAWLPTLLGAGSDDLVVVPE

SEQ ID NO: 1308507 - protein, 17 aa, Mycobacterium
PVIMLTGPTPATKKVLD

SEQ ID NO: 1308508 - protein, 25 aa, Mycobacterium
PVKVAMANMAVLGAGLRLLGQVDGL

SEQ ID NO: 1308509 - protein, 20 aa, Mycobacterium
PVLELDRWALGRPLAEFVTE

SEQ ID NO: 1308510 - protein, 18 aa, Mycobacterium
PVLTLSPLRRGRGDPCFH

SEQ ID NO: 1308511 - protein, 17 aa, Mycobacterium
PVMLRLAGERAGGTILW

SEQ ID NO: 1308512 - protein, 31 aa, Mycobacterium
PVRRVTQALPLLKPPFPDPGTPLQLVHHDDV

SEQ ID NO: 1308513 - protein, 23 aa, Mycobacterium
PVRRWEDIPGWFGWRQAQEEAVA

SEQ ID NO: 1308514 - protein, 22 aa, Mycobacterium
PVRWQPPPVDGLPPLPSPSVTV

SEQ ID NO: 1308515 - protein, 44 aa, Mycobacterium
PVSALVVFEVMVRPLIRLSLGKRAPMRRIVEARALSPITSVAGR

SEQ ID NO: 1308516 - protein, 35 aa, Mycobacterium
PVSGPLLPVSPPPPAAPWLPQAPVSTSAQIFAGPY

SEQ ID NO: 1308517 - protein, 23 aa, Mycobacterium
PVSGYVDGAWWPHSGDLPSELPD

SEQ ID NO: 1308518 - protein, 33 aa, Mycobacterium; identical to SEQ ID NO: 847729

SEQ ID NO: 1308519 - protein, 17 aa, Mycobacterium
PVTRDTVVLLDPARRRG

SEQ ID NO: 1308520 - protein, 23 aa, Mycobacterium
PVVATIWNRILGQVALDPPHATQ

SEQ ID NO: 1308521 - protein, 19 aa, Mycobacterium
PVVAWRQIGQPGTAPVVVG

SEQ ID NO: 1308522 - protein, 18 aa, Mycobacterium
PVVLYDIPPRSVVPIAWD

SEQ ID NO: 1308523 - protein, 20 aa, Mycobacterium
PVVMVNWEFFDNQTPASARD

SEQ ID NO: 1308524 - protein, 17 aa, Mycobacterium
PWEWDGIRRAGVSSFGV

SEQ ID NO: 1308525 - protein, 21 aa, Mycobacterium
PYHAIKRSLPLLTPGATAVAI

SEQ ID NO: 1308526 - protein, 18 aa, Mycobacterium
PYLATAAVLGLALDGVER

SEQ ID NO: 1308527 - protein, 19 aa, Mycobacterium
QAALFYRSLSPVEQTHVAE

SEQ ID NO: 1308528 - protein, 19 aa, Mycobacterium
QAARLVRVLAAGADLTVFA

SEQ ID NO: 1308529 - protein, 35 aa, Mycobacterium
QADGMSRVQGWLTPEARAYWDVIAAKYAAPGTSVP

SEQ ID NO: 1308530 - protein, 29 aa, Mycobacterium
QAHGKTPAQVLLRWSIQLGNVVIARSANP

SEQ ID NO: 1308531 - protein, 18 aa, Mycobacterium
QALPPIWDPNLMAEEVRR

SEQ ID NO: 1308532 - protein, 25 aa, Mycobacterium
QANEQPWTSKLWVYDLRTNQHFTLK

SEQ ID NO: 1308533 - protein, 34 aa, Mycobacterium
QAPSVPLVALWDDTTWVPGSPWLAGVDPAVVGDP

SEQ ID NO: 1308534 - protein, 30 aa, Mycobacterium
QAPTRELLVPPYTLGAWLGDGTSAAAQITT

SEQ ID NO: 1308535 - protein, 24 aa, Mycobacterium
QAQCNVRMIYAYYGGKSGLFDATV

SEQ ID NO: 1308536 - protein, 19 aa, Mycobacterium
QATIPSYVRYGANPYVVVI

SEQ ID NO: 1308537 - protein, 19 aa, Mycobacterium
QATLYHLGLSGIPVVNVNN

SEQ ID NO: 1308538 - protein, 27 aa, Mycobacterium
QAVGHAAWFLHVQGVLVPAAGGIGLVI

SEQ ID NO: 1308539 - protein, 20 aa, Mycobacterium
QAVGQLPVDFAASGLSAMSV

SEQ ID NO: 1308540 - protein, 21 aa, Mycobacterium
QAVMAHADWIIDLGPGAGHDG

SEQ ID NO: 1308541 - protein, 25 aa, Mycobacterium
QCALTWPRPPVLCTVKLARRVLTRD

SEQ ID NO: 1308542 - protein, 19 aa, Mycobacterium
QCDGWLGLAASGAGDRHVL

SEQ ID NO: 1308543 - protein, 19 aa, Mycobacterium
QDDLPLPVARRIIGPSPLI

SEQ ID NO: 1308544 - protein, 24 aa, Mycobacterium
QDHAWRIAAKLNWPDTYQAEYIAL

SEQ ID NO: 1308545 - protein, 21 aa, Mycobacterium
QDKLRLLLEFADDLPALPSEL

SEQ ID NO: 1308546 - protein, 22 aa, Mycobacterium
QDLSPDQWRLLRAAVAEAPDDI

SEQ ID NO: 1308547 - protein, 27 aa, Mycobacterium
QDQRGLLDLKYILGAPQADTLVYCCGP

SEQ ID NO: 1308548 - protein, 17 aa, Mycobacterium
QEEQLTRRTASGEPPPV

SEQ ID NO: 1308549 - protein, 19 aa, Mycobacterium
QFELHARAILGLAVDTIMI

SEQ ID NO: 1308550 - protein, 24 aa, Mycobacterium
QFGRALSRFQAVQHALAGMAGEIE

SEQ ID NO: 1308551 - protein, 24 aa, Mycobacterium
QFVVKTVVGMLDWGLDPQQAVGMV

SEQ ID NO: 1308552 - protein, 35 aa, Mycobacterium
QGALFYERVPKNATAWPLLISPESSLLKPADQVFV

SEQ ID NO: 1308553 - protein, 30 aa, Mycobacterium
QGLNLGIQDAFNLGWKLAAQIDGWAPEGLL

SEQ ID NO: 1308554 - protein, 18 aa, Mycobacterium
QGLPVPRLLPGSEVTRLN

SEQ ID NO: 1308555 - protein, 31 aa, Mycobacterium
QGPLPDEMPAAALWWRITETLAPTAAVPEPQ

SEQ ID NO: 1308556 - protein, 18 aa, Mycobacterium
QHTFLWQHSATMVPGFSG

SEQ ID NO: 1308557 - protein, 25 aa, Mycobacterium
QHTGRGRPAKRYRLTAAGRAKLGHT

SEQ ID NO: 1308558 - protein, 17 aa, Mycobacterium
QHYRLIGWKPRASEAPG

SEQ ID NO: 1308559 - protein, 19 aa, Mycobacterium
QIASVPYPLATPDDLAATV

SEQ ID NO: 1308560 - protein, 28 aa, Mycobacterium
QIAVLQPHDDGCVRVVPAWQIDRGFDAG

SEQ ID NO: 1308561 - protein, 25 aa, Mycobacterium
QIIRNRGALMVLPAGVTKGTGLCGV

SEQ ID NO: 1308562 - protein, 17 aa, Mycobacterium
QILLPGFVDLHTHLREP

SEQ ID NO: 1308563 - protein, 17 aa, Mycobacterium
QILPCTLMSPDSVARFF

SEQ ID NO: 1308564 - protein, 24 aa, Mycobacterium
QINEALRRAGLDPADWDVTGITAR

SEQ ID NO: 1308565 - protein, 17 aa, Mycobacterium
QIVAYVIKNAERFGMQD

SEQ ID NO: 1308566 - protein, 37 aa, Mycobacterium; identical to SEQ ID NO: 849192

SEQ ID NO: 1308567 - protein, 31 aa, Mycobacterium
QKLERSTLIELLRLFAPLPTQLEGDAFGFIY

SEQ ID NO: 1308568 - protein, 21 aa, Mycobacterium
QKWRAQYPGLDWHVTADSEQA

SEQ ID NO: 1308569 - protein, 24 aa, Mycobacterium
QLAHAAWLWSGRKAVVAGLAASAL

SEQ ID NO: 1308570 - protein, 18 aa, Mycobacterium
QLARLLTRTIDHAALALE

SEQ ID NO: 1308571 - protein, 20 aa, Mycobacterium
QLDSPLLPKIFKYVGKAHVW

SEQ ID NO: 1308572 - protein, 21 aa, Mycobacterium
QLEQMGYKKTTKLPAPPARSA

SEQ ID NO: 1308573 - protein, 28 aa, Mycobacterium
QLGRDRVPVFLLPANPVSALVVFEVMVR

SEQ ID NO: 1308574 - protein, 17 aa, Mycobacterium
QLGWTPRYSGAEALSSL

SEQ ID NO: 1308575 - protein, 20 aa, Mycobacterium
QLIELLSRQAALFNDAPLHV

SEQ ID NO: 1308576 - protein, 21 aa, Mycobacterium
QLILGVWDLRADAYDAPIVHA

SEQ ID NO: 1308577 - protein, 17 aa, Mycobacterium
QLIRDGLPVSGVMLESF

SEQ ID NO: 1308578 - protein, 27 aa, Mycobacterium
QLPEAQLDRFLLKLTVPLPPRDQEIAI

SEQ ID NO: 1308579 - protein, 23 aa, Mycobacterium
QLPLAIPTYREALGRWLHACDIC

SEQ ID NO: 1308580 - protein, 20 aa, Mycobacterium
QLQQQLIFRPTPGFGRAETP

SEQ ID NO: 1308581 - protein, 22 aa, Mycobacterium
QLRRWIDSLLEATAGKLAGSGD

SEQ ID NO: 1308582 - protein, 22 aa, Mycobacterium
QLRTYFALTEAVSVLQYAVQEQ

SEQ ID NO: 1308583 - protein, 17 aa, Mycobacterium
QLTAWDYYQTIDTPVNN

SEQ ID NO: 1308584 - protein, 21 aa, Mycobacterium
QLVDLAALGLTWDGPAEYQSA

SEQ ID NO: 1308585 - protein, 29 aa, Mycobacterium
QLVQRVKTWLQFPQWFYNDSPPNTMVAPR

SEQ ID NO: 1308586 - protein, 18 aa, Mycobacterium
QLVVTIAALSIAGARPGD

SEQ ID NO: 1308587 - protein, 22 aa, Mycobacterium
QMDTYDLVLTPRWTWHDHENAT

SEQ ID NO: 1308588 - protein, 17 aa, Mycobacterium
QMGAYLRYKGYVYAYGT

SEQ ID NO: 1308589 - protein, 24 aa, Mycobacterium
QMGKDGWLTLSWPKEFGGQARPPM

SEQ ID NO: 1308590 - protein, 21 aa, Mycobacterium
QMLAYNCSPSFNWKKHLDDAT

SEQ ID NO: 1308591 - protein, 21 aa, Mycobacterium
QMLLGPIPKEDHLRIAALFDD

SEQ ID NO: 1308592 - protein, 24 aa, Mycobacterium
QNAQPWSWRVTPGGVDLFADWSRR

SEQ ID NO: 1308593 - protein, 24 aa, Mycobacterium
QNDDIKRAWLRPLATTEHIWCQLF

SEQ ID NO: 1308594 - protein, 26 aa, Mycobacterium
QNENRIRAAIDRLLRGEIPPDGSCDI

SEQ ID NO: 1308595 - protein, 25 aa, Mycobacterium
QNKVAAMRVLQAKLLARKKQEERAE

SEQ ID NO: 1308596 - protein, 32 aa, Mycobacterium
QNLWMSAKMPDDQFLVYGFAGLPGDLPGTIAA

SEQ ID NO: 1308597 - protein, 25 aa, Mycobacterium
QNMMRKELAWLRRGPPARTSKPKFR

SEQ ID NO: 1308598 - protein, 23 aa, Mycobacterium
QPAMLDELLASGEILWSGAGQIG

SEQ ID NO: 1308599 - protein, 21 aa, Mycobacterium
QPDGGYWMPLFVTLTEGAELT

SEQ ID NO: 1308600 - protein, 23 aa, Mycobacterium
QPLGLGMLFYEDGNWNITTFGVG

SEQ ID NO: 1308601 - protein, 17 aa, Mycobacterium
QPLVDHPMRFLGGEGPA

SEQ ID NO: 1308602 - protein, 18 aa, Mycobacterium
QPRVAVALYGLLDALLFR

SEQ ID NO: 1308603 - protein, 30 aa, Mycobacterium
QPTGEPLPMLLLVTAFMHSLYDGVVDRGPF

SEQ ID NO: 1308604 - protein, 23 aa, Mycobacterium
QPVAQLIPATYDPWTALIASKEV

SEQ ID NO: 1308605 - protein, 25 aa, Mycobacterium
QQCQYRRPPKRWVLKGFHGFRLTEF

SEQ ID NO: 1308606 - protein, 17 aa, Mycobacterium
QQDRPSFGSSITGAAPS

SEQ ID NO: 1308607 - protein, 19 aa, Mycobacterium
QQLERLTALLQPTEPGEVS

SEQ ID NO: 1308608 - protein, 20 aa, Mycobacterium
QQMLLEFGIVSRRYRHAVGE

SEQ ID NO: 1308609 - protein, 17 aa, Mycobacterium
QQRFLRSRANTIEGGTS

SEQ ID NO: 1308610 - protein, 21 aa, Mycobacterium
QQRFSLWVWENADRERRIVEQ

SEQ ID NO: 1308611 - protein, 20 aa, Mycobacterium
QQRMWFVQAADPSGALLNVC

SEQ ID NO: 1308612 - protein, 18 aa, Mycobacterium
QQVELLLGHLATALSDSA

SEQ ID NO: 1308613 - protein, 21 aa, Mycobacterium
QRLQQIWCECLGVASIDPAEN

SEQ ID NO: 1308614 - protein, 18 aa, Mycobacterium
QRLRALLGKPVRNPHADL

SEQ ID NO: 1308615 - protein, 21 aa, Mycobacterium
QRMWDPLLSLLVAAQATSTLR

SEQ ID NO: 1308616 - protein, 33 aa, Mycobacterium
QRTGLVLDPYFSAPKMAWLRAALTRSGVVTTTD

SEQ ID NO: 1308617 - protein, 18 aa, Mycobacterium
QRTVLCKDPFRSVDERVK

SEQ ID NO: 1308618 - protein, 19 aa, Mycobacterium
QRVALARALVRNPPVLLLD

SEQ ID NO: 1308619 - protein, 22 aa, Mycobacterium
QRWLTTKYPQLQSKYLFLGLKN

SEQ ID NO: 1308620 - protein, 26 aa, Mycobacterium
QRWPDGTPLLFPRPTKNLNGQLPLAI

SEQ ID NO: 1308621 - protein, 29 aa, Mycobacterium
QSAQPVLLAHHLLAHAHPLLRDVDRLADF

SEQ ID NO: 1308622 - protein, 17 aa, Mycobacterium
QSARFVTPWPRPLDVEA

SEQ ID NO: 1308623 - protein, 22 aa, Mycobacterium
QSFEWPRLEGAFNWATDWFDVI

SEQ ID NO: 1308624 - protein, 17 aa, Mycobacterium
QSGGDLARAFWRRMIDN

SEQ ID NO: 1308625 - protein, 21 aa, Mycobacterium
QSPFEFDILRDPNPHLGFGGN

SEQ ID NO: 1308626 - protein, 20 aa, Mycobacterium
QTDWVVLVDDTLRIGIGCQS

SEQ ID NO: 1308627 - protein, 21 aa, Mycobacterium
QTIIKAVLDHAVIAAGTPGAR

SEQ ID NO: 1308628 - protein, 17 aa, Mycobacterium
QTLLLNGLRDRIVVQVD

SEQ ID NO: 1308629 - protein, 21 aa, Mycobacterium
QTPPFNAVAFALRSPTFRLRD

SEQ ID NO: 1308630 - protein, 18 aa, Mycobacterium
QTRLRKMLSREFTPRRME

SEQ ID NO: 1308631 - protein, 26 aa, Mycobacterium
QTTAVYGAMLPQPQLRFLLADEPGTG

SEQ ID NO: 1308632 - protein, 20 aa, Mycobacterium
QTWALHRWNIDEYHGVFSEI

SEQ ID NO: 1308633 - protein, 17 aa, Mycobacterium
QVADALMRKLDPRGVIV

SEQ ID NO: 1308634 - protein, 22 aa, Mycobacterium
QVADDWLRRYGPTSDIDPATVQ

SEQ ID NO: 1308635 - protein, 30 aa, Mycobacterium
QVGVSRRTGWSWWRHARGMKLRKGGDGLGG

SEQ ID NO: 1308636 - protein, 24 aa, Mycobacterium
QVIHSRLYKLDPFRYELVDIPFKF

SEQ ID NO: 1308637 - protein, 21 aa, Mycobacterium
QVKDPLLSSLFSPFPPVRGAA

SEQ ID NO: 1308638 - protein, 23 aa, Mycobacterium
QVLIPAPDYPLWTACTSLAGGTP

SEQ ID NO: 1308639 - protein, 18 aa, Mycobacterium
QVLKTFGAGASLYAVARG

SEQ ID NO: 1308640 - protein, 19 aa, Mycobacterium
QVNALNDRIGGVTSAVDTE

SEQ ID NO: 1308641 - protein, 17 aa, Mycobacterium
QVNHLAPVLLTTLLLDR

SEQ ID NO: 1308642 - protein, 17 aa, Mycobacterium
QVPGACDSTLLIAERVQ

SEQ ID NO: 1308643 - protein, 23 aa, Mycobacterium
QVRRDALMRAVAVKWHGLRALEE

SEQ ID NO: 1308644 - protein, 17 aa, Mycobacterium
QVWRDNGRWSRFFMVPG

SEQ ID NO: 1308645 - protein, 19 aa, Mycobacterium
QVYTVLRQALDVAVRDGLL

SEQ ID NO: 1308646 - protein, 31 aa, Mycobacterium
QWAPDGTMSFPFAPPGWPELAGRDAVREYLA

SEQ ID NO: 1308647 - protein, 17 aa, Mycobacterium
QWEQVRVPALLLEAGNS

SEQ ID NO: 1308648 - protein, 17 aa, Mycobacterium
QWSALKAAWDGCAYCGA

SEQ ID NO: 1308649 - protein, 34 aa, Mycobacterium
QYLGPALRLLNFNNIPLPINAYLRPAVNPERIIY

SEQ ID NO: 1308650 - protein, 25 aa, Mycobacterium
QYSGRPGAAALRLLILHDDADREFA

SEQ ID NO: 1308651 - protein, 24 aa, Mycobacterium
QYVRLGLVIDGRYHWRAYSLTSDP

SEQ ID NO: 1308652 - protein, 18 aa, Mycobacterium
RAAAVRHGRTLRYGVRLH

SEQ ID NO: 1308653 - protein, 25 aa, Mycobacterium
RAAFERRWELGGVLFSKTFRDQMID

SEQ ID NO: 1308654 - protein, 18 aa, Mycobacterium
RAAGWPNWAQVRVDPRIS

SEQ ID NO: 1308655 - protein, 17 aa, Mycobacterium
RAALPLGLWVPVLPGTR

SEQ ID NO: 1308656 - protein, 25 aa, Mycobacterium
RAALVLGDWPETPAGDLPALPAGAV

SEQ ID NO: 1308657 - protein, 28 aa, Mycobacterium
RAARTRFCVWSPPWLGWLSTGCESPLPP

SEQ ID NO: 1308658 - protein, 24 aa, Mycobacterium
RAATFIFMASIVGTLRPGRGRGAS

SEQ ID NO: 1308659 - protein, 27 aa, Mycobacterium
RAAVERQGLPYGWALTSSGRLSGVTEP

SEQ ID NO: 1308660 - protein, 24 aa, Mycobacterium
RACESLYHFAWDEFCDWYVELAKV

SEQ ID NO: 1308661 - protein, 19 aa, Mycobacterium
RACGRIDGLERVRFTSPHP

SEQ ID NO: 1308662 - protein, 19 aa, Mycobacterium
RACWGALRSTILGDALFRT

SEQ ID NO: 1308663 - protein, 19 aa, Mycobacterium
RADDLTAWLGGTRVSPRFP

SEQ ID NO: 1308664 - protein, 31 aa, Mycobacterium
RADLLAFTAFPKQIWRQIWSNNPLSVNRPSG

SEQ ID NO: 1308665 - protein, 27 aa, Mycobacterium
RADPGRFAKLVLLTPSPCYVDDGDYRG

SEQ ID NO: 1308666 - protein, 19 aa, Mycobacterium
RADRLGVPLSQLGQFSGHG

SEQ ID NO: 1308667 - protein, 27 aa, Mycobacterium
RADSLAHFIAALVYLPRDRYTTAVRLE

SEQ ID NO: 1308668 - protein, 22 aa, Mycobacterium
RADYPRIDLLINNAGVMMTEKG

SEQ ID NO: 1308669 - protein, 39 aa, Mycobacterium
RAEALWVTLARILPTPWRTEALVLLAFSAYARGDGPLAG

SEQ ID NO: 1308670 - protein, 18 aa, Mycobacterium
RAEFGPVGILVTSAAIGG

SEQ ID NO: 1308671 - protein, 23 aa, Mycobacterium
RAEGVDCYKLFISGLLDITDNVD

SEQ ID NO: 1308672 - protein, 17 aa, Mycobacterium
RAEHLMLVDLGRNDLGR

SEQ ID NO: 1308673 - protein, 25 aa, Mycobacterium
RAFATLYKEYLMKALPRMARAVASN

SEQ ID NO: 1308674 - protein, 29 aa, Mycobacterium
RAGLGQSSLYYWFRSKDAILRGIMNQNRV

SEQ ID NO: 1308675 - protein, 30 aa, Mycobacterium
RAGRKRTHWIWFIFPQLRGLGRSPTAQHYG

SEQ ID NO: 1308676 - protein, 23 aa, Mycobacterium
RAGVVVPALWTVRRITDGGGSAR

SEQ ID NO: 1308677 - protein, 17 aa, Mycobacterium
RAHSMFDPELYRDKAEV

SEQ ID NO: 1308678 - protein, 19 aa, Mycobacterium
RAHWDVIAAKYAAPGANLP

SEQ ID NO: 1308679 - protein, 26 aa, Mycobacterium
RAIMPKLLQVTPWTTPALANPGLQRL

SEQ ID NO: 1308680 - protein, 20 aa, Mycobacterium
RAKRRLGKWHKSLSGIIGPV

SEQ ID NO: 1308681 - protein, 29 aa, Mycobacterium
RALGEIRAVWRINELLNWQVAAAGETIAV

SEQ ID NO: 1308682 - protein, 19 aa, Mycobacterium
RALGRDVLARLAVRGQPRA

SEQ ID NO: 1308683 - protein, 27 aa, Mycobacterium
RALGRGPLIQFTWIYDRAVDIDGLRRF

SEQ ID NO: 1308684 - protein, 18 aa, Mycobacterium
RALWDDLPSEIRGQYYPT

SEQ ID NO: 1308685 - protein, 34 aa, Mycobacterium
RAQGRGLARLARRVWPGHDWTALGRAPHLPVASG

SEQ ID NO: 1308686 - protein, 17 aa, Mycobacterium
RAQILIETFFTDNDHLL

SEQ ID NO: 1308687 - protein, 37 aa, Mycobacterium
RAQVALPWSMINAFCDLAQTYPWREARPGRYGSDIQV

SEQ ID NO: 1308688 - protein, 17 aa, Mycobacterium
RARAAWLWSGRRATLTG

SEQ ID NO: 1308689 - protein, 19 aa, Mycobacterium
RARCFPKGLAAFIDLRDQT

SEQ ID NO: 1308690 - protein, 23 aa, Mycobacterium
RAREELLVTWHGEPSPFIADLAH

SEQ ID NO: 1308691 - protein, 18 aa, Mycobacterium
RARFEPRFPHVHPHRLRH

SEQ ID NO: 1308692 - protein, 17 aa, Mycobacterium
RARFLERLYDYVEDPQI

SEQ ID NO: 1308693 - protein, 17 aa, Mycobacterium
RARILAAARARIVASDD

SEQ ID NO: 1308694 - protein, 17 aa, Mycobacterium
RARPPRLSSYSIAHAQT

SEQ ID NO: 1308695 - protein, 21 aa, Mycobacterium
RARREVVLYASFDPSELRAEE

SEQ ID NO: 1308696 - protein, 28 aa, Mycobacterium
RARRLTVLGQFFRFARNRRVVLVDPTHG

SEQ ID NO: 1308697 - protein, 39 aa, Mycobacterium
RARSTRVEFWAFDILRLDGRWLLKAKYRDRRKLLETLAS

SEQ ID NO: 1308698 - protein, 32 aa, Mycobacterium
RARVEYKLRDWLFARQRYWGEPFPIVYDSDGR

SEQ ID NO: 1308699 - protein, 17 aa, Mycobacterium
RARVTVRMLLTHTSGEE

SEQ ID NO: 1308700 - protein, 30 aa, Mycobacterium
RASDWLGDPVRPVSPGLPIAHRFAELHQRL

SEQ ID NO: 1308701 - protein, 21 aa, Mycobacterium
RASHNAVLTELYRGLTEVVTA

SEQ ID NO: 1308702 - protein, 22 aa, Mycobacterium
RASPWLTRHPEMPEWHLHLASI

SEQ ID NO: 1308703 - protein, 18 aa, Mycobacterium
RAVFTPGLAGLVLGEYRR

SEQ ID NO: 1308704 - protein, 19 aa, Mycobacterium
RAVPLLRADALRPVTRDTV

SEQ ID NO: 1308705 - protein, 17 aa, Mycobacterium
RAWARFERGEVVFKAEV

SEQ ID NO: 1308706 - protein, 18 aa, Mycobacterium
RAWPVGEKGPTAMALCEF

SEQ ID NO: 1308707 - protein, 21 aa, Mycobacterium
RAWWLTTPQFRRTLAWFIARR

SEQ ID NO: 1308708 - protein, 21 aa, Mycobacterium
RAYLGDLRSLFAFCNERTPGA

SEQ ID NO: 1308709 - protein, 18 aa, Mycobacterium
RCADIESIPYPLATKDDL

SEQ ID NO: 1308710 - protein, 18 aa, Mycobacterium
RCAIGLLGLGSTPLRGVD

SEQ ID NO: 1308711 - protein, 17 aa, Mycobacterium
RCEVSNLRPTHDGLGYF

SEQ ID NO: 1308712 - protein, 19 aa, Mycobacterium
RCTSWPAGALRLERFSSST

SEQ ID NO: 1308713 - protein, 22 aa, Mycobacterium
RDALLYVIGAHVPPPAARTVLD

SEQ ID NO: 1308714 - protein, 17 aa, Mycobacterium
RDAVLALRRGKGMVLDE

SEQ ID NO: 1308715 - protein, 18 aa, Mycobacterium
RDEHFQFAELPWPDYFGA

SEQ ID NO: 1308716 - protein, 17 aa, Mycobacterium
RDEILLARNDRYWSAPA

SEQ ID NO: 1308717 - protein, 24 aa, Mycobacterium
RDENGFIYFAGRLGDWMRVDGENL

SEQ ID NO: 1308718 - protein, 22 aa, Mycobacterium
RDEVRTWIWKTMTSFPGSYMTA

SEQ ID NO: 1308719 - protein, 17 aa, Mycobacterium
RDFFGPAAANDGFGGTA

SEQ ID NO: 1308720 - protein, 24 aa, Mycobacterium
RDGAEWIHLVDLDAAFGRGSNREL

SEQ ID NO: 1308721 - protein, 23 aa, Mycobacterium
RDGGRTVARIFEALAAMLADAED

SEQ ID NO: 1308722 - protein, 20 aa, Mycobacterium
RDGRLLICDSPRGLLALDPE

SEQ ID NO: 1308723 - protein, 17 aa, Mycobacterium
RDGYPQGVPPKDYFPLL

SEQ ID NO: 1308724 - protein, 23 aa, Mycobacterium
RDHDPVHHVLPPAAPERDYYVLS

SEQ ID NO: 1308725 - protein, 23 aa, Mycobacterium
RDIGFRMPSVWFAEGHNAVAPVY

SEQ ID NO: 1308726 - protein, 21 aa, Mycobacterium
RDKALELLLEQTEVPLPEKIV

SEQ ID NO: 1308727 - protein, 23 aa, Mycobacterium
RDLALVLHDLSWRLARFGPAQVG

SEQ ID NO: 1308728 - protein, 23 aa, Mycobacterium
RDLDFLLFEWLRVDELTQRPRFA

SEQ ID NO: 1308729 - protein, 20 aa, Mycobacterium
RDMGMVFQAYSLFPHLTVLD

SEQ ID NO: 1308730 - protein, 19 aa, Mycobacterium
RDQIAALRWVRENIAAFGG

SEQ ID NO: 1308731 - protein, 19 aa, Mycobacterium
RDRARARYSWDRIAEDTLR

SEQ ID NO: 1308732 - protein, 29 aa, Mycobacterium
RDRGFIPEGLLNYLALLGWGIADDRDVFS

SEQ ID NO: 1308733 - protein, 22 aa, Mycobacterium
RDRGITFPSIYDPPMRTMIAFG

SEQ ID NO: 1308734 - protein, 20 aa, Mycobacterium
RDRRKLLETLASGGGLIVQP

SEQ ID NO: 1308735 - protein, 20 aa, Mycobacterium
RDTVVLLDPARRRGGRRTFD

SEQ ID NO: 1308736 - protein, 21 aa, Mycobacterium
RDVILLLGYLTRLDDAEWNVR

SEQ ID NO: 1308737 - protein, 19 aa, Mycobacterium
RDWARALDVNAEPGRLYIR

SEQ ID NO: 1308738 - protein, 37 aa, Mycobacterium
RDWYTLAPTLPQWLRRRLALLLDLCYGAGARPPDFKV

SEQ ID NO: 1308739 - protein, 18 aa, Mycobacterium
RDYLTGHGISFLPTVGWA

SEQ ID NO: 1308740 - protein, 29 aa, Mycobacterium
REAAHHRLFSHVPWLSSQLLSAVEAFARG

SEQ ID NO: 1308741 - protein, 18 aa, Mycobacterium
REAFGRPVFGFQNTKFTL

SEQ ID NO: 1308742 - protein, 17 aa, Mycobacterium
REALLAELYRDDVDALV

SEQ ID NO: 1308743 - protein, 25 aa, Mycobacterium
REDAWRHHFQPAWAAAIAAHIRFRG

SEQ ID NO: 1308744 - protein, 24 aa, Mycobacterium
REDGKWRCAPMRRASLNSLTVAEK

SEQ ID NO: 1308745 - protein, 21 aa, Mycobacterium
REGETLLRLLDNFVTAANELH

SEQ ID NO: 1308746 - protein, 17 aa, Mycobacterium
REGWIDLRVVAEHSRRF

SEQ ID NO: 1308747 - protein, 19 aa, Mycobacterium
RELAALLVCLLLSKMSSDT

SEQ ID NO: 1308748 - protein, 24 aa, Mycobacterium
RELAGWLAEALTATAGIASAEVAG

SEQ ID NO: 1308749 - protein, 19 aa, Mycobacterium
RELFMAMGVDLFANLMEIR

SEQ ID NO: 1308750 - protein, 17 aa, Mycobacterium
RELHRKAGAAGLLGAGM

SEQ ID NO: 1308751 - protein, 20 aa, Mycobacterium
RELISRHTGIPHGYVAIWSR

SEQ ID NO: 1308752 - protein, 18 aa, Mycobacterium
RELLRIDFPGRTILSSLV

SEQ ID NO: 1308753 - protein, 23 aa, Mycobacterium
RENLVLFGRLQGLAKKAAEARAD

SEQ ID NO: 1308754 - protein, 23 aa, Mycobacterium
REPAKRWIRLRLSRGLGLEAGGG

SEQ ID NO: 1308755 - protein, 17 aa, Mycobacterium
RERADYVGALWQANTGA

SEQ ID NO: 1308756 - protein, 18 aa, Mycobacterium
RERGLLDPPRRQGRSAYY

SEQ ID NO: 1308757 - protein, 19 aa, Mycobacterium
REVFKQMGALGMLGMAIPE

SEQ ID NO: 1308758 - protein, 18 aa, Mycobacterium
REVKPKYVILAAAKVGGI

SEQ ID NO: 1308759 - protein, 29 aa, Mycobacterium
REVTPGRLLVPALGLCDVDPLPGGWLVRL

SEQ ID NO: 1308760 - protein, 18 aa, Mycobacterium
REVVAAGAPGWDVSAEEL

SEQ ID NO: 1308761 - protein, 21 aa, Mycobacterium
REVYDLLRDGYQAEWEDDNGD

SEQ ID NO: 1308762 - protein, 26 aa, Mycobacterium
RFAAPEPHPPWPGIRDATMPGPTAPQ

SEQ ID NO: 1308763 - protein, 21 aa, Mycobacterium
RFADQLLAEHLQKVSLSFLVD

SEQ ID NO: 1308764 - protein, 28 aa, Mycobacterium
RFDPPERLAAFIDALRWGAVTSADVKTV

SEQ ID NO: 1308765 - protein, 20 aa, Mycobacterium
RFDQVEFSALVASPNGAKRA

SEQ ID NO: 1308766 - protein, 20 aa, Mycobacterium
RFEALAGFRPVARTVDLMRA

SEQ ID NO: 1308767 - protein, 18 aa, Mycobacterium
RFEFPRLRFVASVGEPLN

SEQ ID NO: 1308768 - protein, 22 aa, Mycobacterium
RFHRADFPGVWMLRGSDLSMDQ

SEQ ID NO: 1308769 - protein, 23 aa, Mycobacterium
RFPEVLRLCMWAQLERPEATDEP

SEQ ID NO: 1308770 - protein, 30 aa, Mycobacterium
RFQRMIINALPLFFQKSVLWIAALVGEEIF

SEQ ID NO: 1308771 - protein, 17 aa, Mycobacterium
RFRLLGDRSLQDHAWRI

SEQ ID NO: 1308772 - protein, 41 aa, Mycobacterium
RFSSAILPAWARKSPQMTEVLPLLYLHGLSTSDFGPALEQF

SEQ ID NO: 1308773 - protein, 18 aa, Mycobacterium
RFVYLSDVLPTAWQGVEY

SEQ ID NO: 1308774 - protein, 27 aa, Mycobacterium
RGAKDMATLLLKKRFFSSPVAFARTVD

SEQ ID NO: 1308775 - protein, 27 aa, Mycobacterium
RGARHRIVSVGRLLPRKGFDVVVRALT

SEQ ID NO: 1308776 - protein, 18 aa, Mycobacterium
RGARVVVVAPYEGPLRDA

SEQ ID NO: 1308777 - protein, 21 aa, Mycobacterium
RGDFIPEYLCSLSLKVNGKGG

SEQ ID NO: 1308778 - protein, 25 aa, Mycobacterium
RGDGWVKLVGDWIDRSIGDLAPLWD

SEQ ID NO: 1308779 - protein, 28 aa, Mycobacterium
RGDMLAVLRGWAVLFTGPDAAVMKAAVA

SEQ ID NO: 1308780 - protein, 34 aa, Mycobacterium
RGDRRPLPLPLQNMLAEPLLRRIDVLAAQGHPGA

SEQ ID NO: 1308781 - protein, 21 aa, Mycobacterium
RGDVARFRMLVEAIIAEERGN

SEQ ID NO: 1308782 - protein, 26 aa, Mycobacterium
RGDYLNTDVIFDLTLSRLGDGLLNGT

SEQ ID NO: 1308783 - protein, 22 aa, Mycobacterium
RGEEDLWEQLFEYTGDGHGDGR

SEQ ID NO: 1308784 - protein, 17 aa, Mycobacterium
RGELWWCETAEAEPRPV

SEQ ID NO: 1308785 - protein, 20 aa, Mycobacterium
RGETLPVYFGNRNWDPYVED

SEQ ID NO: 1308786 - protein, 18 aa, Mycobacterium
RGFLCQYHLWSYDLEGRL

SEQ ID NO: 1308787 - protein, 18 aa, Mycobacterium
RGFLNKRAELPDKPMIAM

SEQ ID NO: 1308788 - protein, 19 aa, Mycobacterium
RGIGGCLYALLAKCWPEDV

SEQ ID NO: 1308789 - protein, 24 aa, Mycobacterium
RGIGHYFAVQLLQRGAKVYATARR

SEQ ID NO: 1308790 - protein, 17 aa, Mycobacterium
RGKLGAGSLIPLAAGAS

SEQ ID NO: 1308791 - protein, 32 aa, Mycobacterium
RGLQFGFISDAAGFMTVWARMYAPDGAAFEQR

SEQ ID NO: 1308792 - protein, 17 aa, Mycobacterium
RGLRLRATDVDWTHGDG

SEQ ID NO: 1308793 - protein, 20 aa, Mycobacterium
RGPALLEYIAMYRDRARITV

SEQ ID NO: 1308794 - protein, 18 aa, Mycobacterium
RGPQALSLTLIDPPPSLS

SEQ ID NO: 1308795 - protein, 18 aa, Mycobacterium
RGPRRYVCGGELITFDGM

SEQ ID NO: 1308796 - protein, 24 aa, Mycobacterium
RGPVIVCHPADLQWFTDDRILPQL

SEQ ID NO: 1308797 - protein, 21 aa, Mycobacterium
RGQLLPWTSTTKQHYVRIRPL

SEQ ID NO: 1308798 - protein, 21 aa, Mycobacterium
RGRIAAALQRGLRPPVLPEVE

SEQ ID NO: 1308799 - protein, 24 aa, Mycobacterium
RGRRRREPGQLGHRHGRGGGAEGV

SEQ ID NO: 1308800 - protein, 24 aa, Mycobacterium
RGSAGPLGWFYSANHSPSVVEFLR

SEQ ID NO: 1308801 - protein, 22 aa, Mycobacterium
RGSYPSLCLLATRLPETSKAGA

SEQ ID NO: 1308802 - protein, 17 aa, Mycobacterium
RGTAIFDEAMLAVTTGE

SEQ ID NO: 1308803 - protein, 22 aa, Mycobacterium
RGTGYWANDVAAGRGGMPVSAL

SEQ ID NO: 1308804 - protein, 31 aa, Mycobacterium
RGTLGPGVRALLLYPMNALANDQLKRLRGML

SEQ ID NO: 1308805 - protein, 25 aa, Mycobacterium
RGTQYTSWLFGHRLREAGLLGSMGK

SEQ ID NO: 1308806 - protein, 20 aa, Mycobacterium
RGWTAGRFSFNVAEGRCPTC

SEQ ID NO: 1308807 - protein, 17 aa, Mycobacterium
RGYLANYGTVLYPELHD

SEQ ID NO: 1308808 - protein, 18 aa, Mycobacterium
RHARAYVLDAWLRPVPDG

SEQ ID NO: 1308809 - protein, 19 aa, Mycobacterium
RHFGYWIDRDGGRARCYGC

SEQ ID NO: 1308810 - protein, 17 aa, Mycobacterium
RHHLPRPAVVPPAEAND

SEQ ID NO: 1308811 - protein, 19 aa, Mycobacterium
RHHRRALAKGTLVWHRDRL

SEQ ID NO: 1308812 - protein, 24 aa, Mycobacterium
RHKRVLVSEWPLELLKGCVGCTTR

SEQ ID NO: 1308813 - protein, 19 aa, Mycobacterium
RHLEQALVLLFTIGGVPSV

SEQ ID NO: 1308814 - protein, 17 aa, Mycobacterium
RHLGFARVLVHEMPHTL

SEQ ID NO: 1308815 - protein, 17 aa, Mycobacterium
RHPGLIVTAITPFGLDG

SEQ ID NO: 1308816 - protein, 17 aa, Mycobacterium
RHPRACWGALRSTILGD

SEQ ID NO: 1308817 - protein, 32 aa, Mycobacterium
RHPRAHGWTAENLRWLLARIGPVGIVAFGEHL

SEQ ID NO: 1308818 - protein, 17 aa, Mycobacterium
RHRPTAHTVLIVGSAGF

SEQ ID NO: 1308819 - protein, 20 aa, Mycobacterium
RHRRLAALIFAIAVVAGCTA

SEQ ID NO: 1308820 - protein, 31 aa, Mycobacterium
RHRYVYAATGKPGWFLFDGLVKHDLRDGTEE

SEQ ID NO: 1308821 - protein, 21 aa, Mycobacterium
RHYRTVLNPYLSPAAVKRWEP

SEQ ID NO: 1308822 - protein, 17 aa, Mycobacterium
RIAFAEHVFYRFTDRRI

SEQ ID NO: 1308823 - protein, 24 aa, Mycobacterium
RIATDWDFIAVRRAGIALAREVER

SEQ ID NO: 1308824 - protein, 17 aa, Mycobacterium
RIDVDWVIVPGGEVRRL

SEQ ID NO: 1308825 - protein, 26 aa, Mycobacterium
RIEEASTFRYVMTLTLHAGIPVHCLG

SEQ ID NO: 1308826 - protein, 24 aa, Mycobacterium
RIGFDRVIGYLERPFEAMLDHQDE

SEQ ID NO: 1308827 - protein, 18 aa, Mycobacterium
RIGGLLRYGIPEFKMEKR

SEQ ID NO: 1308828 - protein, 20 aa, Mycobacterium
RIGLDLIGIAEGAPLTMDLR

SEQ ID NO: 1308829 - protein, 25 aa, Mycobacterium
RIGRRFLNAGLGFGGGCLPKDIRAF

SEQ ID NO: 1308830 - protein, 24 aa, Mycobacterium
RIGRRIMARLNWRKNGPGPTTPPH

SEQ ID NO: 1308831 - protein, 19 aa, Mycobacterium
RIISVNETLVRWLGRSRDE

SEQ ID NO: 1308832 - protein, 18 aa, Mycobacterium
RIITVPFSFKEIDSEGLI

SEQ ID NO: 1308833 - protein, 25 aa, Mycobacterium
RILPGPSSMWFDALGRRLPAPCLPG

SEQ ID NO: 1308834 - protein, 18 aa, Mycobacterium
RIQKRPDGTLQHPPVPAV

SEQ ID NO: 1308835 - protein, 35 aa, Mycobacterium
RIRDDVLRTPLIPAAWAGTLWLKPENLQAIGAFKV

SEQ ID NO: 1308836 - protein, 17 aa, Mycobacterium
RIRFIRTDMADLAGVES

SEQ ID NO: 1308837 - protein, 18 aa, Mycobacterium
RIRLGPVARVRYGLSEWA

SEQ ID NO: 1308838 - protein, 20 aa, Mycobacterium
RIRPIRWRKVDAFAARDVFR

SEQ ID NO: 1308839 - protein, 31 aa, Mycobacterium
RIVARLSNPTLLCYYLFFPAHEESVGAGACP

SEQ ID NO: 1308840 - protein, 31 aa, Mycobacterium
RIVEWHRLGIETFMLAFQPFEAEMQRFAAEI

SEQ ID NO: 1308841 - protein, 19 aa, Mycobacterium
RIVLDRKGNRHFSFGLGVH

SEQ ID NO: 1308842 - protein, 24 aa, Mycobacterium
RIVPTYAVPLDALIAHLVPAGAES

SEQ ID NO: 1308843 - protein, 17 aa, Mycobacterium
RKALADHGFGVLTEIDV

SEQ ID NO: 1308844 - protein, 24 aa, Mycobacterium
RKDHESNWLSALYAILEGASYALE

SEQ ID NO: 1308845 - protein, 28 aa, Mycobacterium
RKEYEEERPTIVMPGTGGTVAGTAVNDW

SEQ ID NO: 1308846 - protein, 33 aa, Mycobacterium; identical to SEQ ID NO: 854657

SEQ ID NO: 1308847 - protein, 18 aa, Mycobacterium
RKRHGAWIGWAGIPDSAE

SEQ ID NO: 1308848 - protein, 22 aa, Mycobacterium
RKTVHIWGCGGLGSWIAEFIAR

SEQ ID NO: 1308849 - protein, 21 aa, Mycobacterium
RLAAAVPFYGPTPENPDFSGS

SEQ ID NO: 1308850 - protein, 25 aa, Mycobacterium
RLADAQFGLREPAPPWLTADAVAEA

SEQ ID NO: 1308851 - protein, 29 aa, Mycobacterium
RLADGYIDIKGLRLTLTQAAWRTSEGLPA

SEQ ID NO: 1308852 - protein, 30 aa, Mycobacterium
RLAELPAAIRRRVIRSWLLAGGARGLTDTQ

SEQ ID NO: 1308853 - protein, 17 aa, Mycobacterium
RLAFHDYLASDKTLKSM

SEQ ID NO: 1308854 - protein, 30 aa, Mycobacterium
RLAGVDALHPGWRYPDPLAPVAAAERAGAA

SEQ ID NO: 1308855 - protein, 20 aa, Mycobacterium
RLARMLVCDVDCARWLLDHG

SEQ ID NO: 1308856 - protein, 20 aa, Mycobacterium
RLCPAPCEASCVLGINQDAV

SEQ ID NO: 1308857 - protein, 17 aa, Mycobacterium
RLDALLDLADRLGPAEK

SEQ ID NO: 1308858 - protein, 18 aa, Mycobacterium
RLDLQYRHRLEFAVGRTT

SEQ ID NO: 1308859 - protein, 31 aa, Mycobacterium
RLDSEPGRPLWPMIILRTPKGWTGPREVDGK

SEQ ID NO: 1308860 - protein, 19 aa, Mycobacterium
RLEMETHYFGTLQVLRAFA

SEQ ID NO: 1308861 - protein, 26 aa, Mycobacterium
RLEPDPELLYVAAMFHDLGLTARYRT

SEQ ID NO: 1308862 - protein, 23 aa, Mycobacterium
RLERFDRTIYLFDVELDHEKNRR

SEQ ID NO: 1308863 - protein, 31 aa, Mycobacterium
RLEVGDPPRVILDRIDWSIGPGARIGLVGVN

SEQ ID NO: 1308864 - protein, 26 aa, Mycobacterium
RLGLPAADWQILLDVPTALAAERAER

SEQ ID NO: 1308865 - protein, 34 aa, Mycobacterium
RLGVDYLDLYLIHWPVPEKNLFVDTFKAFARLRE

SEQ ID NO: 1308866 - protein, 17 aa, Mycobacterium
RLHALLRRAHHSDRPSD

SEQ ID NO: 1308867 - protein, 27 aa, Mycobacterium
RLHQKAGLRLIVIDYLQLMTSGKKVES

SEQ ID NO: 1308868 - protein, 20 aa, Mycobacterium
RLIGPIRRVVYDPSSWTSAP

SEQ ID NO: 1308869 - protein, 17 aa, Mycobacterium
RLLGLHFDGEDGCAGHS

SEQ ID NO: 1308870 - protein, 19 aa, Mycobacterium
RLLLLLHYSIDWEASWVAE

SEQ ID NO: 1308871 - protein, 29 aa, Mycobacterium
RLLSQAFVEFTFPLAAQYFTINPLAKRMD

SEQ ID NO: 1308872 - protein, 30 aa, Mycobacterium
RLLTAVTAGLPFLLRPALAAVGDGAAAVRQ

SEQ ID NO: 1308873 - protein, 18 aa, Mycobacterium
RLMAYLFEVDYADHFVWV

SEQ ID NO: 1308874 - protein, 18 aa, Mycobacterium
RLMVLRDERQRVLAELRN

SEQ ID NO: 1308875 - protein, 22 aa, Mycobacterium
RLNLDELRMLVAGFLMAGTDTT

SEQ ID NO: 1308876 - protein, 18 aa, Mycobacterium
RLPSVFDFTPLTSSQMVW

SEQ ID NO: 1308877 - protein, 17 aa, Mycobacterium
RLQDLLADPAHAAVGDY

SEQ ID NO: 1308878 - protein, 20 aa, Mycobacterium
RLQPGRMFLVDTAQGRIVSD

SEQ ID NO: 1308879 - protein, 26 aa, Mycobacterium
RLRDESSWPLYPIRPGHTYVNVGFWS

SEQ ID NO: 1308880 - protein, 35 aa, Mycobacterium; identical to SEQ ID NO: 855349

SEQ ID NO: 1308881 - protein, 18 aa, Mycobacterium
RLRQHRRRAVVPDGGLPH

SEQ ID NO: 1308882 - protein, 18 aa, Mycobacterium
RLRRALEHRDRTCVVPGC

SEQ ID NO: 1308883 - protein, 17 aa, Mycobacterium
RLRRKAADKLPGTADWL

SEQ ID NO: 1308884 - protein, 26 aa, Mycobacterium
RLRTPGAELLALPWDRPLAEWAVPDV

SEQ ID NO: 1308885 - protein, 19 aa, Mycobacterium
RLRTVMADLGMPLPPAYPR

SEQ ID NO: 1308886 - protein, 18 aa, Mycobacterium
RLSDLDIELLDISLRRPS

SEQ ID NO: 1308887 - protein, 20 aa, Mycobacterium
RLSELLRTPGFVLIRERGAA

SEQ ID NO: 1308888 - protein, 20 aa, Mycobacterium
RLTWAVLDWNENAIALYDAV

SEQ ID NO: 1308889 - protein, 24 aa, Mycobacterium
RLVAINIGGMYWTTRTAIKHLGEG

SEQ ID NO: 1308890 - protein, 17 aa, Mycobacterium
RLVEVIAAQTGLLDDAG

SEQ ID NO: 1308891 - protein, 20 aa, Mycobacterium
RMAQLLRQQAIGAAMRNPTR

SEQ ID NO: 1308892 - protein, 17 aa, Mycobacterium
RMDAIDLLQIGLNGAAP

SEQ ID NO: 1308893 - protein, 18 aa, Mycobacterium
RMGALALHVAKIARRRHP

SEQ ID NO: 1308894 - protein, 19 aa, Mycobacterium
RMINGLVLPDRGAVRVHGL

SEQ ID NO: 1308895 - protein, 22 aa, Mycobacterium
RMKLARNMLTFTGFAAACEAMT

SEQ ID NO: 1308896 - protein, 17 aa, Mycobacterium
RMPAYGGSLLDPARFPW

SEQ ID NO: 1308897 - protein, 27 aa, Mycobacterium
RMPGTGVVNPLRWRPHPWGEDLRESMP

SEQ ID NO: 1308898 - protein, 18 aa, Mycobacterium
RMRTGWPGAGALTVRPRR

SEQ ID NO: 1308899 - protein, 28 aa, Mycobacterium
RMSPVGRLLDWLAHTYNLLFVVSAGNHL

SEQ ID NO: 1308900 - protein, 25 aa, Mycobacterium
RMVAARLPCAYLNPGRYIAGRPLVK

SEQ ID NO: 1308901 - protein, 25 aa, Mycobacterium
RMYQYTLDELLLAALSRTVGDTLGD

SEQ ID NO: 1308902 - protein, 25 aa, Mycobacterium
RNAVRLLEQWLAHSALLRSHADPAT

SEQ ID NO: 1308903 - protein, 19 aa, Mycobacterium
RNGGRYADWYFSNGKDFDG

SEQ ID NO: 1308904 - protein, 20 aa, Mycobacterium
RNKFHLHRLINDALDASHVV

SEQ ID NO: 1308905 - protein, 21 aa, Mycobacterium
RNVDALATGGRLAIIGMQGGV

SEQ ID NO: 1308906 - protein, 20 aa, Mycobacterium
RPEPFGALLYHFGTRKLSFL

SEQ ID NO: 1308907 - protein, 18 aa, Mycobacterium
RPGGRLGLVWNTRDERLG

SEQ ID NO: 1308908 - protein, 17 aa, Mycobacterium
RPGPRVIKLRPTRDALG

SEQ ID NO: 1308909 - protein, 26 aa, Mycobacterium
RPGVELSPRKQWPSGLTKLGLDLSGR

SEQ ID NO: 1308910 - protein, 17 aa, Mycobacterium
RPKLPGIPGIKDFTGHV

SEQ ID NO: 1308911 - protein, 18 aa, Mycobacterium
RPLPPPIAAAFRTAVGGT

SEQ ID NO: 1308912 - protein, 21 aa, Mycobacterium
RPLRRPFDSMHRLGLDEEPSD

SEQ ID NO: 1308913 - protein, 23 aa, Mycobacterium
RPNVVWFGEALPEAAWQRSVHAV

SEQ ID NO: 1308914 - protein, 22 aa, Mycobacterium
RPPDLIIQDELHLITGALGTSV

SEQ ID NO: 1308915 - protein, 20 aa, Mycobacterium
RPPELAGLWELPGGKVARGE

SEQ ID NO: 1308916 - protein, 19 aa, Mycobacterium
RPPFARNVRFYPTAAAAQA

SEQ ID NO: 1308917 - protein, 21 aa, Mycobacterium
RPPLAPPRRPPGRRERILSTA

SEQ ID NO: 1308918 - protein, 19 aa, Mycobacterium
RPPVLAYSTTPLLISSRDT

SEQ ID NO: 1308919 - protein, 32 aa, Mycobacterium
RPREVVLFAQLYLKDIPFAWSLAHSLGLDDDR

SEQ ID NO: 1308920 - protein, 17 aa, Mycobacterium
RPRMAVGIHLRSGARRT

SEQ ID NO: 1308921 - protein, 24 aa, Mycobacterium
RPSLGIAEWIVPSLISAAGQEVRD

SEQ ID NO: 1308922 - protein, 24 aa, Mycobacterium
RPTPQWWYDDTHLHGPDGLSLPMT

SEQ ID NO: 1308923 - protein, 17 aa, Mycobacterium
RPVLLFSGGKDSIVMLH

SEQ ID NO: 1308924 - protein, 21 aa, Mycobacterium
RPVPATYGYVPGRRLAVIEMA

SEQ ID NO: 1308925 - protein, 26 aa, Mycobacterium
RPVVHLKPLLAPPLLDTVGALCRVRY

SEQ ID NO: 1308926 - protein, 30 aa, Mycobacterium
RPYDLSFSRFELLRLLAFSRSGALPITKAS

SEQ ID NO: 1308927 - protein, 24 aa, Mycobacterium
RQAAAFAAPYLDRTYSRMLERRYI

SEQ ID NO: 1308928 - protein, 26 aa, Mycobacterium
RQEDFIGIHFFSPVDKMPLVEIIKGE

SEQ ID NO: 1308929 - protein, 29 aa, Mycobacterium
RQFARVQRALYDAGWMRYGWPESAGGLGG

SEQ ID NO: 1308930 - protein, 30 aa, Mycobacterium
RQNAITLLGWQVLRFTWLDLTEYPDRVIAV

SEQ ID NO: 1308931 - protein, 19 aa, Mycobacterium
RQPALAEAGLLAPHWPKPF

SEQ ID NO: 1308932 - protein, 22 aa, Mycobacterium
RQPDLGPLEIIARAPLAVTDGD

SEQ ID NO: 1308933 - protein, 17 aa, Mycobacterium
RQQRVPLGVVGIVYEGR

SEQ ID NO: 1308934 - protein, 26 aa, Mycobacterium
RQRALQCRAFLLSRAGAEWASGLPGE

SEQ ID NO: 1308935 - protein, 18 aa, Mycobacterium
RQRKLIEQLTRAALEVSG

SEQ ID NO: 1308936 - protein, 17 aa, Mycobacterium
RQRLDLQYRHRLEFAVG

SEQ ID NO: 1308937 - protein, 17 aa, Mycobacterium
RQRLVLGANPDGSLAAL

SEQ ID NO: 1308938 - protein, 24 aa, Mycobacterium
RQSLEGLGLMRVALRREPSVPLRG

SEQ ID NO: 1308939 - protein, 19 aa, Mycobacterium
RQSPLGFGLLSRPHPELTA

SEQ ID NO: 1308940 - protein, 30 aa, Mycobacterium; identical to SEQ ID NO: 856594

SEQ ID NO: 1308941 - protein, 17 aa, Mycobacterium
RRAGSACRILTSGTIRI

SEQ ID NO: 1308942 - protein, 19 aa, Mycobacterium
RRAHPFTIADLAAAVLVIA

SEQ ID NO: 1308943 - protein, 21 aa, Mycobacterium
RRARAAYLVDELLGAYARAVD

SEQ ID NO: 1308944 - protein, 17 aa, Mycobacterium
RRAVVEETGLPFSRVRV

SEQ ID NO: 1308945 - protein, 24 aa, Mycobacterium
RRDQTDSRALHRLPRRNRATSRGT

SEQ ID NO: 1308946 - protein, 22 aa, Mycobacterium
RRDWPLFRTVFTDDCTLDYGDI

SEQ ID NO: 1308947 - protein, 23 aa, Mycobacterium
RREIMLRRNLGLTKLYNIVHDAE

SEQ ID NO: 1308948 - protein, 23 aa, Mycobacterium
RRGDAWRLDGFKWFASNCDGEAF

SEQ ID NO: 1308949 - protein, 23 aa, Mycobacterium
RRGKYLWLTLDDGDEPLARRAES

SEQ ID NO: 1308950 - protein, 25 aa, Mycobacterium
RRGLTPWLAVPDRLVQLPLRDVHLE

SEQ ID NO: 1308951 - protein, 20 aa, Mycobacterium
RRGPFRLMPAVSVAEAAWAA

SEQ ID NO: 1308952 - protein, 18 aa, Mycobacterium
RRGWLHIRVISEDRPYDI

SEQ ID NO: 1308953 - protein, 20 aa, Mycobacterium
RRGYKGISIPTMIEAENFRG

SEQ ID NO: 1308954 - protein, 23 aa, Mycobacterium
RRIDGFPLLRAGICAGAVVKRRG

SEQ ID NO: 1308955 - protein, 21 aa, Mycobacterium
RRIEALTEQGWLVIRVTALDT

SEQ ID NO: 1308956 - protein, 17 aa, Mycobacterium
RRLAQLVTELEAVEVVV

SEQ ID NO: 1308957 - protein, 28 aa, Mycobacterium
RRLAYMQKMSTVLGRRLWEAAGTPDIDP

SEQ ID NO: 1308958 - protein, 18 aa, Mycobacterium
RRLLDGMGLPWSENSRPT

SEQ ID NO: 1308959 - protein, 21 aa, Mycobacterium
RRLRSLGLLTGRKAYEEAIDL

SEQ ID NO: 1308960 - protein, 17 aa, Mycobacterium
RRLWEAAGTPDIDPRRL

SEQ ID NO: 1308961 - protein, 17 aa, Mycobacterium
RRNGIENVWIFRALDDP

SEQ ID NO: 1308962 - protein, 22 aa, Mycobacterium
RRPRHGLDPIRFGLAAFVVTAP

SEQ ID NO: 1308963 - protein, 22 aa, Mycobacterium
RRQAGKRWRPSSFAPLVKVTQP

SEQ ID NO: 1308964 - protein, 31 aa, Mycobacterium
RRRDGRRRISIYWTWSYPWEAQRNPAEVYNR

SEQ ID NO: 1308965 - protein, 18 aa, Mycobacterium
RRRFDPEATLALVDEHKA

SEQ ID NO: 1308966 - protein, 17 aa, Mycobacterium
RRRPAHPFAPLGERSVA

SEQ ID NO: 1308967 - protein, 26 aa, Mycobacterium
RRRTVIDLLVAVHIMPTSKGPRFNPD

SEQ ID NO: 1308968 - protein, 18 aa, Mycobacterium
RRRTVLDLLARLIRADTD

SEQ ID NO: 1308969 - protein, 19 aa, Mycobacterium
RRRVAMLREWLANELSDAS

SEQ ID NO: 1308970 - protein, 25 aa, Mycobacterium
RRSADTHLLRYPLPSAWGEDCDVAL

SEQ ID NO: 1308971 - protein, 24 aa, Mycobacterium
RRSAHTLPVLLAGADFIFSGFGSI

SEQ ID NO: 1308972 - protein, 18 aa, Mycobacterium
RRSLLLPGDLAEAEQCRT

SEQ ID NO: 1308973 - protein, 28 aa, Mycobacterium
RRSRGYAPLPVALPLAVPPTLAVGADLK

SEQ ID NO: 1308974 - protein, 18 aa, Mycobacterium
RRSTFGAEWTLVEPTLPG

SEQ ID NO: 1308975 - protein, 28 aa, Mycobacterium
RRTDALSWYLAMACFKLAVVIEGTWSRY

SEQ ID NO: 1308976 - protein, 25 aa, Mycobacterium
RRTLETLLRLPVDGILFAVEWKQFC

SEQ ID NO: 1308977 - protein, 23 aa, Mycobacterium
RRTPTFAGTIWLQQGSAPFADDA

SEQ ID NO: 1308978 - protein, 24 aa, Mycobacterium
RRVDPQLSMLFPVEDYPLIDGQGR

SEQ ID NO: 1308979 - protein, 19 aa, Mycobacterium
RRVESFRQLWAVSVDVSRA

SEQ ID NO: 1308980 - protein, 18 aa, Mycobacterium
RRVGFGAMQLPGPGVFGP

SEQ ID NO: 1308981 - protein, 24 aa, Mycobacterium
RRVGKAFRAHNIAAGLPGAATIDD

SEQ ID NO: 1308982 - protein, 24 aa, Mycobacterium
RRVRRRHLLAHRPPVSQPQGLGAA

SEQ ID NO: 1308983 - protein, 21 aa, Mycobacterium
RRVVYRRDEVLRWISQRESAT

SEQ ID NO: 1308984 - protein, 27 aa, Mycobacterium
RRWRVAEIIADPFRWTRTLQALEAEKL

SEQ ID NO: 1308985 - protein, 19 aa, Mycobacterium
RRYAVLQRAQLAAVEAVRP

SEQ ID NO: 1308986 - protein, 20 aa, Mycobacterium
RRYHELFGTSPVRGDGLRDL

SEQ ID NO: 1308987 - protein, 17 aa, Mycobacterium
RRYQMQSGFVFQSHNLF

SEQ ID NO: 1308988 - protein, 30 aa, Mycobacterium
RSADKFVPEWIWQSPAAVKRVFLQALFEGD

SEQ ID NO: 1308989 - protein, 23 aa, Mycobacterium
RSALPNITRLLPVARAAGVRVVH

SEQ ID NO: 1308990 - protein, 19 aa, Mycobacterium
RSDWAVHIALWQRTGGPGG

SEQ ID NO: 1308991 - protein, 25 aa, Mycobacterium
RSEPRHAWFPIDRSMVLYYCSLVED

SEQ ID NO: 1308992 - protein, 18 aa, Mycobacterium
RSFVAVSAIFRVGDVWRQ

SEQ ID NO: 1308993 - protein, 24 aa, Mycobacterium
RSGPPRIPWLEPDIGDHVTALAER

SEQ ID NO: 1308994 - protein, 24 aa, Mycobacterium
RSKPQVMDVYFLAGADDFILHVAA

SEQ ID NO: 1308995 - protein, 25 aa, Mycobacterium
RSKTYPLCDTSHRRRRRGDADAAES

SEQ ID NO: 1308996 - protein, 18 aa, Mycobacterium
RSLAEQRDTWRHQAVEVL

SEQ ID NO: 1308997 - protein, 27 aa, Mycobacterium
RSLAGDGFNLVLIARKPGPLDETAESC

SEQ ID NO: 1308998 - protein, 19 aa, Mycobacterium
RSLAPMTTWTRAAIGALGE

SEQ ID NO: 1308999 - protein, 27 aa, Mycobacterium
RSLDAPADDLRVGPHPGWRIEVDGADV

SEQ ID NO: 1309000 - protein, 21 aa, Mycobacterium
RSLGSLLFGLLSDPAQLDAIR

SEQ ID NO: 1309001 - protein, 19 aa, Mycobacterium
RSLPHRMEVAWNPEFLREG

SEQ ID NO: 1309002 - protein, 18 aa, Mycobacterium
RSLQSGGDLARAFWRRMI

SEQ ID NO: 1309003 - protein, 22 aa, Mycobacterium
RSNTPLLFLHNTTGYMVGRQYE

SEQ ID NO: 1309004 - protein, 21 aa, Mycobacterium
RSNVREHVAFGRGPHSCPGAP

SEQ ID NO: 1309005 - protein, 24 aa, Mycobacterium
RSQLGWRTLGVYAVNYPASGAFTS

SEQ ID NO: 1309006 - protein, 18 aa, Mycobacterium
RSRPLWEKWIIEGIDGTD

SEQ ID NO: 1309007 - protein, 25 aa, Mycobacterium
RSSGELHLDWWYDTRRVPQETVEVF

SEQ ID NO: 1309008 - protein, 25 aa, Mycobacterium
RSSQVPVVVLLWSPRSDSSVALGQT

SEQ ID NO: 1309009 - protein, 18 aa, Mycobacterium
RSTIRIFAATVYAQQERG

SEQ ID NO: 1309010 - protein, 23 aa, Mycobacterium
RSTMAPTLVFDASTGPPGTRGPL

SEQ ID NO: 1309011 - protein, 18 aa, Mycobacterium
RSYFTKLMTPERAEALAS

SEQ ID NO: 1309012 - protein, 25 aa, Mycobacterium
RSYRLHVPPHVPVTLYWSATAYDRN

SEQ ID NO: 1309013 - protein, 22 aa, Mycobacterium
RTAFAEAMTWLFGELIAQRAEE

SEQ ID NO: 1309014 - protein, 25 aa, Mycobacterium
RTAPLRQPILGVAVFLGGDRDSSAG

SEQ ID NO: 1309015 - protein, 26 aa, Mycobacterium
RTCADDPCFRWLAAGQVPHHRAIARF

SEQ ID NO: 1309016 - protein, 23 aa, Mycobacterium
RTDAEWRFVGVPDLSPLSRDAVF

SEQ ID NO: 1309017 - protein, 25 aa, Mycobacterium
RTDHWPAYPLCENRALLPTRLSELG

SEQ ID NO: 1309018 - protein, 21 aa, Mycobacterium
RTDVPVFRLPALGSSWEQVTR

SEQ ID NO: 1309019 - protein, 34 aa, Mycobacterium
RTEPALDLDTLLGGFRPLFRALDPEQVNTLSSAL

SEQ ID NO: 1309020 - protein, 21 aa, Mycobacterium
RTEQGWDRLALGGAALVTFHV

SEQ ID NO: 1309021 - protein, 23 aa, Mycobacterium
RTEVLPLLEDVLAGGVAAALART

SEQ ID NO: 1309022 - protein, 24 aa, Mycobacterium
RTGERYLDMFTFFASSSLGMNHPA

SEQ ID NO: 1309023 - protein, 30 aa, Mycobacterium
RTGLVAFSLHYPWSQGLPVHTLDGSAVLPP

SEQ ID NO: 1309024 - protein, 18 aa, Mycobacterium
RTIAYRLLGTLTQFRYVA

SEQ ID NO: 1309025 - protein, 21 aa, Mycobacterium
RTIPADRLSRILPLVPGNPRL

SEQ ID NO: 1309026 - protein, 17 aa, Mycobacterium
RTKHHFFRDNARLREEL

SEQ ID NO: 1309027 - protein, 19 aa, Mycobacterium
RTLDPWFREHIAAVDLNNL

SEQ ID NO: 1309028 - protein, 18 aa, Mycobacterium
RTLFGFPVVQAVGSALPL

SEQ ID NO: 1309029 - protein, 17 aa, Mycobacterium
RTLIHMDDPHHRKIRAI

SEQ ID NO: 1309030 - protein, 20 aa, Mycobacterium
RTLTPAVDWASSGLRVPTRV

SEQ ID NO: 1309031 - protein, 23 aa, Mycobacterium
RTPKQIARAWLQLGPSIVAVTEG

SEQ ID NO: 1309032 - protein, 27 aa, Mycobacterium
RTQRALFGMLMTWDIPPWLDARGCVRT

SEQ ID NO: 1309033 - protein, 17 aa, Mycobacterium
RTTLRPVLARNPNLAVS

SEQ ID NO: 1309034 - protein, 24 aa, Mycobacterium
RTVALWRKRFDDVHIYPVAFHGDV

SEQ ID NO: 1309035 - protein, 31 aa, Mycobacterium
RTVEPWGVVTHRGRWYLVGHDRDRDAPRTFR

SEQ ID NO: 1309036 - protein, 18 aa, Mycobacterium
RTYPDAHFAYDFAPHGER

SEQ ID NO: 1309037 - protein, 24 aa, Mycobacterium
RVADGIRMLVVPGSMRVRAQAESE

SEQ ID NO: 1309038 - protein, 22 aa, Mycobacterium
RVAGVHFLMKKNKITEVHGYGK

SEQ ID NO: 1309039 - protein, 19 aa, Mycobacterium
RVAPIWWNEQPIGAGGFDD

SEQ ID NO: 1309040 - protein, 30 aa, Mycobacterium
RVFERAWEQFIPFLAFPPELRRVIYTTNSI

SEQ ID NO: 1309041 - protein, 19 aa, Mycobacterium
RVFTRFVFGFGLDDRDMQR

SEQ ID NO: 1309042 - protein, 17 aa, Mycobacterium
RVGFGAMQLPGPGVFGP

SEQ ID NO: 1309043 - protein, 19 aa, Mycobacterium
RVHDFVSTRAPRYRPVLAR

SEQ ID NO: 1309044 - protein, 17 aa, Mycobacterium
RVHMSSLGLPLLGDPLY

SEQ ID NO: 1309045 - protein, 18 aa, Mycobacterium
RVIEVGTLISGPFAGRLL

SEQ ID NO: 1309046 - protein, 21 aa, Mycobacterium
RVKAFVTLKDGFTAEEELRSA

SEQ ID NO: 1309047 - protein, 26 aa, Mycobacterium
RVKDVFFYEPIILPEKSSREVQLTLH

SEQ ID NO: 1309048 - protein, 27 aa, Mycobacterium
RVLKLSRQPYYRWLADPVTDAELVEAY

SEQ ID NO: 1309049 - protein, 18 aa, Mycobacterium
RVLLGQVMAVSALPAHYV

SEQ ID NO: 1309050 - protein, 24 aa, Mycobacterium
RVLQWDLRYGADVVAALIGHVADP

SEQ ID NO: 1309051 - protein, 19 aa, Mycobacterium
RVLSKVFSVLRRGDVNRGA

SEQ ID NO: 1309052 - protein, 28 aa, Mycobacterium
RVLVAVPRTEESRFRAMCEARGLPITRI

SEQ ID NO: 1309053 - protein, 19 aa, Mycobacterium
RVNFRHPAWARSTFTHLPV

SEQ ID NO: 1309054 - protein, 18 aa, Mycobacterium
RVPELYRGIADTYYSHML

SEQ ID NO: 1309055 - protein, 22 aa, Mycobacterium
RVPRKGIPLVAKRLGQGIGGLL

SEQ ID NO: 1309056 - protein, 23 aa, Mycobacterium
RVQSLGVMRYLPVASAGYVERYL

SEQ ID NO: 1309057 - protein, 19 aa, Mycobacterium
RVRAMRKAIFAIADGLGPV

SEQ ID NO: 1309058 - protein, 22 aa, Mycobacterium
RVRELFIDVIGPDRLEVLREIA

SEQ ID NO: 1309059 - protein, 17 aa, Mycobacterium
RVRPFSTKIAAVVGFPS

SEQ ID NO: 1309060 - protein, 20 aa, Mycobacterium
RVRQQLIRAVRDRYLDDRGA

SEQ ID NO: 1309061 - protein, 23 aa, Mycobacterium
RVRRLDGFQLPHPPRDAREFHTH

SEQ ID NO: 1309062 - protein, 17 aa, Mycobacterium
RVRRPGATRCRPGGVRT

SEQ ID NO: 1309063 - protein, 25 aa, Mycobacterium
RVRYGLGERPVVVCLSRLVPRKGQD

SEQ ID NO: 1309064 - protein, 22 aa, Mycobacterium
RVSAFFEFLKTRIATARKYGPA

SEQ ID NO: 1309065 - protein, 17 aa, Mycobacterium
RVSDVPSLGWRAYRRCP

SEQ ID NO: 1309066 - protein, 25 aa, Mycobacterium
RVTNPSPYMYLLNVPDETGGLDFSV

SEQ ID NO: 1309067 - protein, 22 aa, Mycobacterium
RVTTRRVLLATGMEYCPPELPG

SEQ ID NO: 1309068 - protein, 23 aa, Mycobacterium
RVVNMTSRELLDWLRTRSAGEGS

SEQ ID NO: 1309069 - protein, 17 aa, Mycobacterium
RVWPLLERRRAELAAIG

SEQ ID NO: 1309070 - protein, 20 aa, Mycobacterium
RWASARAHRLAARLVEIGVD

SEQ ID NO: 1309071 - protein, 17 aa, Mycobacterium
RWCVALSGGADSLALTA

SEQ ID NO: 1309072 - protein, 28 aa, Mycobacterium
RWHFLDTDIRDRLFAAARARGITPAMAF

SEQ ID NO: 1309073 - protein, 20 aa, Mycobacterium
RYAPPPPYPSPDPFEPFAVA

SEQ ID NO: 1309074 - protein, 18 aa, Mycobacterium
RYAVWLGEHRAEIEDLLI

SEQ ID NO: 1309075 - protein, 20 aa, Mycobacterium
RYCIDILTQADALTKALQGV

SEQ ID NO: 1309076 - protein, 20 aa, Mycobacterium
RYCIDILTQTDALTKALQGV

SEQ ID NO: 1309077 - protein, 26 aa, Mycobacterium
RYCVTGDALVRLPLGQSVRIDGVVPG

SEQ ID NO: 1309078 - protein, 19 aa, Mycobacterium
RYFLSTRLTHRMLVNNIRR

SEQ ID NO: 1309079 - protein, 20 aa, Mycobacterium
RYISGAPQLWVVGTRPFGPI

SEQ ID NO: 1309080 - protein, 18 aa, Mycobacterium
RYREHFGFGFVMYVNGYC

SEQ ID NO: 1309081 - protein, 17 aa, Mycobacterium
RYRLPAGSVPPLNDVVG

SEQ ID NO: 1309082 - protein, 20 aa, Mycobacterium
RYRPNIVIETPAGCPPFIEN

SEQ ID NO: 1309083 - protein, 18 aa, Mycobacterium
RYWAIHTLSHLLIRQAAM

SEQ ID NO: 1309084 - protein, 17 aa, Mycobacterium
RYWNIDPGDTFLVPSPI

SEQ ID NO: 1309085 - protein, 17 aa, Mycobacterium
SAAYPFEREVEGHHSYV

SEQ ID NO: 1309086 - protein, 23 aa, Mycobacterium
SAEPAAPHRWLGVRDGSPPVDPV

SEQ ID NO: 1309087 - protein, 30 aa, Mycobacterium
SAEVDNPMFGVIYRSPLRHLALIGTEQGSD

SEQ ID NO: 1309088 - protein, 25 aa, Mycobacterium
SAGFMKILGPEFLNRFPGRVVNTHP

SEQ ID NO: 1309089 - protein, 25 aa, Mycobacterium
SAGPRLRTLITYDPDLSRAAADHHI

SEQ ID NO: 1309090 - protein, 24 aa, Mycobacterium
SAGTYFLCADPRPLGYDDSTTFCA

SEQ ID NO: 1309091 - protein, 21 aa, Mycobacterium
SAILSVVIDSLVRRALEIALA

SEQ ID NO: 1309092 - protein, 23 aa, Mycobacterium
SAKLCVQYLAPIIKNRQYNFPPI

SEQ ID NO: 1309093 - protein, 19 aa, Mycobacterium
SALAFDLRTTPLRDVNAAL

SEQ ID NO: 1309094 - protein, 27 aa, Mycobacterium
SALDLFRTRRIASPAQRIMLIARDGGC

SEQ ID NO: 1309095 - protein, 19 aa, Mycobacterium
SALLRASGGWPWLAPGHDP

SEQ ID NO: 1309096 - protein, 17 aa, Mycobacterium
SANQFHYYRLSADNRIV

SEQ ID NO: 1309097 - protein, 25 aa, Mycobacterium
SAPAKPDLVLFRRGGAPAALADSIR

SEQ ID NO: 1309098 - protein, 23 aa, Mycobacterium
SAPGARVLAVASTLPMAQVIDWA

SEQ ID NO: 1309099 - protein, 25 aa, Mycobacterium
SAPMCDIFLVLAQAPGGLSCFFLPR

SEQ ID NO: 1309100 - protein, 17 aa, Mycobacterium
SAPPGHLPDPGLDPNGD

SEQ ID NO: 1309101 - protein, 25 aa, Mycobacterium
SAQSLPELAIYGLPGPVAHSLLNEV

SEQ ID NO: 1309102 - protein, 25 aa, Mycobacterium
SAREAPYPYFPYRRQEGFALLDPPV

SEQ ID NO: 1309103 - protein, 17 aa, Mycobacterium
SARRFWVRYAAESTGAL

SEQ ID NO: 1309104 - protein, 25 aa, Mycobacterium
SASFWGSLLPAAWSFMLALRSRGLG

SEQ ID NO: 1309105 - protein, 29 aa, Mycobacterium
SATADTLTVFHPQSFRAFASPLSSGVFVD

SEQ ID NO: 1309106 - protein, 28 aa, Mycobacterium
SATISAVLPTLAAPLMANVAALQAKEGM

SEQ ID NO: 1309107 - protein, 25 aa, Mycobacterium
SATRPPAVLWWIRDHLDIEMVRIGS

SEQ ID NO: 1309108 - protein, 21 aa, Mycobacterium
SAVAFQSAHARFIEASAKINQ

SEQ ID NO: 1309109 - protein, 25 aa, Mycobacterium
SDALPEPTFVPVLGRIAAGGPILAE

SEQ ID NO: 1309110 - protein, 40 aa, Mycobacterium
SDEDLIAAGAYLWLRAWPVPGGDLWAVPTGWRVGDHAPTT

SEQ ID NO: 1309111 - protein, 23 aa, Mycobacterium
SDGFRVPGLPMPSLPVVGGDAAA

SEQ ID NO: 1309112 - protein, 23 aa, Mycobacterium
SDGPSMIFTVSNSGFYAAGGGPL

SEQ ID NO: 1309113 - protein, 27 aa, Mycobacterium
SDHTPVWVLLAKLVAGGLLGAIFQGYT

SEQ ID NO: 1309114 - protein, 21 aa, Mycobacterium
SDKHPMWYLNLRANPTVQVQI

SEQ ID NO: 1309115 - protein, 30 aa, Mycobacterium
SDLGCRGVGRLLWLKAFDRVSVRSTYEDET

SEQ ID NO: 1309116 - protein, 19 aa, Mycobacterium
SDLPPRLTPREIDVLMALC

SEQ ID NO: 1309117 - protein, 21 aa, Mycobacterium
SDLSLAVVRLARQLRFRRAES

SEQ ID NO: 1309118 - protein, 19 aa, Mycobacterium
SDPAIYPDKYVTCVHNHAT

SEQ ID NO: 1309119 - protein, 22 aa, Mycobacterium
SDPEWLVWTHGCPGGESVEAVS

SEQ ID NO: 1309120 - protein, 23 aa, Mycobacterium
SDSALQAARWAGAVAAACGAPLH

SEQ ID NO: 1309121 - protein, 28 aa, Mycobacterium
SDVDDLARYPLVYFIDSMLQVDDLDSAT

SEQ ID NO: 1309122 - protein, 23 aa, Mycobacterium
SEAERLFVRLLDQAGITGWRTNH

SEQ ID NO: 1309123 - protein, 24 aa, Mycobacterium
SEDWMRPDYVPPQPTLPAATGADP

SEQ ID NO: 1309124 - protein, 23 aa, Mycobacterium
SEEGFDFLLSKGKALMPKLFDEE

SEQ ID NO: 1309125 - protein, 17 aa, Mycobacterium
SEEWRQVVLARRISTAD

SEQ ID NO: 1309126 - protein, 17 aa, Mycobacterium
SEFFVRQRVPFFVDYVR

SEQ ID NO: 1309127 - protein, 18 aa, Mycobacterium
SEGCGILVLKRLSDAVRD

SEQ ID NO: 1309128 - protein, 24 aa, Mycobacterium
SEGLDRIFIDAGAEWRQAGCSMCL

SEQ ID NO: 1309129 - protein, 24 aa, Mycobacterium
SELLERHPPFDALALWFDRVADYA

SEQ ID NO: 1309130 - protein, 24 aa, Mycobacterium
SELVFHAILGERPDLAPFAGTDRR

SEQ ID NO: 1309131 - protein, 17 aa, Mycobacterium
SEPTVVRVLGAIEIPVV

SEQ ID NO: 1309132 - protein, 26 aa, Mycobacterium
SEQAALFLDVPLSSLSQIVLHLGNGA

SEQ ID NO: 1309133 - protein, 24 aa, Mycobacterium
SERQWLTDLLGTGWVDVVRALHPD

SEQ ID NO: 1309134 - protein, 30 aa, Mycobacterium
SERTPLTAELLLRGWQDSGAPEVLALAQGA

SEQ ID NO: 1309135 - protein, 29 aa, Mycobacterium
SERTRVWGMRIASLLLFSELVIQTTRSLA

SEQ ID NO: 1309136 - protein, 24 aa, Mycobacterium
SESFEFWREFLASLRARGLSGVHL

SEQ ID NO: 1309137 - protein, 27 aa, Mycobacterium
SETLPYDMLHLVPPFRGVRWLEGSGLT

SEQ ID NO: 1309138 - protein, 20 aa, Mycobacterium
SEVAALMTAAQRWGTEWATC

SEQ ID NO: 1309139 - protein, 28 aa, Mycobacterium
SFATYFNAFPASYWRRWSTLTSVVLQVE

SEQ ID NO: 1309140 - protein, 19 aa, Mycobacterium
SFGAPLAGPIPTGAPRFPG

SEQ ID NO: 1309141 - protein, 18 aa, Mycobacterium
SFNAASAIFRPAFVNGCI

SEQ ID NO: 1309142 - protein, 23 aa, Mycobacterium
SFNVDYASVTRLLWSSRANQLAV

SEQ ID NO: 1309143 - protein, 25 aa, Mycobacterium
SGALKHFFDTVYYPSLDHVAGRPYG

SEQ ID NO: 1309144 - protein, 28 aa, Mycobacterium
SGDAIFVTYRHRLLLGWTHMQDGQLQAA

SEQ ID NO: 1309145 - protein, 20 aa, Mycobacterium
SGDPVLWFHGTPGGRRQLPL

SEQ ID NO: 1309146 - protein, 19 aa, Mycobacterium
SGDRAYVAHAFPFPNREGE

SEQ ID NO: 1309147 - protein, 27 aa, Mycobacterium
SGGELTWPPGWSRWPSRRYGDTRLDIA

SEQ ID NO: 1309148 - protein, 23 aa, Mycobacterium
SGGGAPMMLPPGSMGPPAGAVPP

SEQ ID NO: 1309149 - protein, 24 aa, Mycobacterium
SGGRRIWQLADHADLLVGWRVTDD

SEQ ID NO: 1309150 - protein, 21 aa, Mycobacterium
SGIGAALCRALVAAGAEVLCT

SEQ ID NO: 1309151 - protein, 24 aa, Mycobacterium
SGIVLVTPLLEWTATQIHALRGDF

SEQ ID NO: 1309152 - protein, 25 aa, Mycobacterium
SGLDSRAYRLPWPDGTVVYEIDQPA

SEQ ID NO: 1309153 - protein, 27 aa, Mycobacterium
SGLHNRILALGYRIAPRPVLAMVSEQL

SEQ ID NO: 1309154 - protein, 18 aa, Mycobacterium
SGPADAASNWYSEFARLA

SEQ ID NO: 1309155 - protein, 22 aa, Mycobacterium
SGPMPKWYAPVGSLFDQFLGAA

SEQ ID NO: 1309156 - protein, 36 aa, Mycobacterium; identical to SEQ ID NO: 860961

SEQ ID NO: 1309157 - protein, 17 aa, Mycobacterium
SGQATLYHLGLSGIPVV

SEQ ID NO: 1309158 - protein, 40 aa, Mycobacterium
SGRYNLCPEMKFYATPPIDGAFCRYVVIDDDFAHPVPESM

SEQ ID NO: 1309159 - protein, 25 aa, Mycobacterium
SGSKGLHLYVPLKEPISSQGASVLA

SEQ ID NO: 1309160 - protein, 24 aa, Mycobacterium
SGSQLAHYFADKQTLLRALVERQM

SEQ ID NO: 1309161 - protein, 35 aa, Mycobacterium
SGTKVWTFLGTRPAGWWIRRRVHEVAVHRADAALA

SEQ ID NO: 1309162 - protein, 23 aa, Mycobacterium
SGVWGAPWCSVPPIDNAERKEGQ

SEQ ID NO: 1309163 - protein, 24 aa, Mycobacterium
SHAPGQLDFLGYGAQRALDAGVPV

SEQ ID NO: 1309164 - protein, 31 aa, Mycobacterium
SHEAFGFLRREFDALWSAIRFDEPARPAAAR

SEQ ID NO: 1309165 - protein, 26 aa, Mycobacterium
SHLDSPYPFVLVTPQTNVDRTLLDYA

SEQ ID NO: 1309166 - protein, 17 aa, Mycobacterium
SHLLDPCGLPPKMLRST

SEQ ID NO: 1309167 - protein, 26 aa, Mycobacterium
SHRDKVLYWYVHSALWGRFSGSTETV

SEQ ID NO: 1309168 - protein, 19 aa, Mycobacterium
SHWFDGQPAYRAPLPGDRD

SEQ ID NO: 1309169 - protein, 22 aa, Mycobacterium
SIAARWVFPHLPSFEELYCGSY

SEQ ID NO: 1309170 - protein, 19 aa, Mycobacterium
SIFDPRRLAGLLGMPDGAE

SEQ ID NO: 1309171 - protein, 22 aa, Mycobacterium
SIIENLLGVLGFRPVESLVTVT

SEQ ID NO: 1309172 - protein, 25 aa, Mycobacterium
SIRIPKPWFVLMPTPVWDQMFRPMV

SEQ ID NO: 1309173 - protein, 31 aa, Mycobacterium
SIVFFGERARWERWFTASAQGSWLWGDAVNP

SEQ ID NO: 1309174 - protein, 18 aa, Mycobacterium
SIYAFEAPLLLGSRAVLM

SEQ ID NO: 1309175 - protein, 26 aa, Mycobacterium
SIYDPPMRTMIAFGGKYPTTVIPSTV

SEQ ID NO: 1309176 - protein, 17 aa, Mycobacterium
SIYLLHNLLTHHDPNTI

SEQ ID NO: 1309177 - protein, 21 aa, Mycobacterium
SKFLDPWTFDVRRHPNPHVGF

SEQ ID NO: 1309178 - protein, 22 aa, Mycobacterium
SKLDLIEYYLAVADGALRGVAD

SEQ ID NO: 1309179 - protein, 24 aa, Mycobacterium
SKMQRFFVRNALVARLVSEAAFKQ

SEQ ID NO: 1309180 - protein, 24 aa, Mycobacterium
SKMVRYHLLLPDTATRRDLQDPKT

SEQ ID NO: 1309181 - protein, 22 aa, Mycobacterium
SKPVLYRRWPDRASLLRDTLMQ

SEQ ID NO: 1309182 - protein, 29 aa, Mycobacterium
SKRALDLFLKVSLLRRANPDRPHACLLTG

SEQ ID NO: 1309183 - protein, 28 aa, Mycobacterium
SKSLAPALRLGWMALPDALVEPVLAAAG

SEQ ID NO: 1309184 - protein, 23 aa, Mycobacterium
SLAFPVLHMQGILVPAAGGVGLV

SEQ ID NO: 1309185 - protein, 20 aa, Mycobacterium
SLALLDGLFAGYRELLTRTD

SEQ ID NO: 1309186 - protein, 24 aa, Mycobacterium
SLAQLALAWVLRDPTVASTLVGAS

SEQ ID NO: 1309187 - protein, 18 aa, Mycobacterium
SLDMLNPLAWLRDKFGGA

SEQ ID NO: 1309188 - protein, 22 aa, Mycobacterium
SLDRSLAVARRLRAGFIGLNGT

SEQ ID NO: 1309189 - protein, 25 aa, Mycobacterium
SLDRTSFVPGVLLAVRKVSERPGLT

SEQ ID NO: 1309190 - protein, 20 aa, Mycobacterium
SLFTELLPRLDHIELAGTPE

SEQ ID NO: 1309191 - protein, 18 aa, Mycobacterium
SLGIARSDGLRLLYPGHE

SEQ ID NO: 1309192 - protein, 22 aa, Mycobacterium
SLHCGLAQLWPRLNEDLDARAA

SEQ ID NO: 1309193 - protein, 19 aa, Mycobacterium
SLHYGFRFKEALSAAYTAV

SEQ ID NO: 1309194 - protein, 18 aa, Mycobacterium
SLKHLIYGASPISQAVLE

SEQ ID NO: 1309195 - protein, 33 aa, Mycobacterium
SLLALDLGKRFRRVLGRTVPLATLLGGVTGAEL

SEQ ID NO: 1309196 - protein, 17 aa, Mycobacterium
SLLSWIMNPERGLAASA

SEQ ID NO: 1309197 - protein, 24 aa, Mycobacterium
SLRPGDLAVWDGHVAMIVGDGVMV

SEQ ID NO: 1309198 - protein, 19 aa, Mycobacterium
SLRYGYIPKHLNFTQLTPH

SEQ ID NO: 1309199 - protein, 19 aa, Mycobacterium
SLSDYPLARGLIDRHFTAG

SEQ ID NO: 1309200 - protein, 26 aa, Mycobacterium
SLTPLEFDLLVALARKPRQVFTRDVL

SEQ ID NO: 1309201 - protein, 25 aa, Mycobacterium
SMEILDDVILGLRKMHQPVIAAVNG

SEQ ID NO: 1309202 - protein, 25 aa, Mycobacterium
SMGHALLVPFARAAAWPDELNTLRD

SEQ ID NO: 1309203 - protein, 23 aa, Mycobacterium
SMTYAVVPALRFNPDLAAVYEPL

SEQ ID NO: 1309204 - protein, 19 aa, Mycobacterium
SMVPAAVRVRPFSTKIAAV

SEQ ID NO: 1309205 - protein, 20 aa, Mycobacterium
SNARRALVGAVLAALMCAGG

SEQ ID NO: 1309206 - protein, 30 aa, Mycobacterium
SNATLWPLYHDLIVKPIYHRKWWDRYVEVN

SEQ ID NO: 1309207 - protein, 19 aa, Mycobacterium
SNLPERMSLFGHTRLPSTE

SEQ ID NO: 1309208 - protein, 20 aa, Mycobacterium
SNYWGYNTIGFLAPDPKYSS

SEQ ID NO: 1309209 - protein, 23 aa, Mycobacterium
SPAALDWLIEQLALTAEDSLLDC

SEQ ID NO: 1309210 - protein, 26 aa, Mycobacterium
SPAGQAAIMAIIEKYQAKSGGTVEGS

SEQ ID NO: 1309211 - protein, 25 aa, Mycobacterium
SPASDDYYMHFSDGSLIVGIGSPPR

SEQ ID NO: 1309212 - protein, 25 aa, Mycobacterium
SPDHYNGFFYKVMPPFCVGTSAQGV

SEQ ID NO: 1309213 - protein, 22 aa, Mycobacterium
SPKQLQAVLFDELEMPKTKRTK

SEQ ID NO: 1309214 - protein, 25 aa, Mycobacterium
SPKQRAVLAVLLLAAGRVVSVDRLI

SEQ ID NO: 1309215 - protein, 20 aa, Mycobacterium
SPKRLPDSLLHYMRTRGKDK

SEQ ID NO: 1309216 - protein, 26 aa, Mycobacterium
SPLIREMMIYALRWPIDRRAGAVRDE

SEQ ID NO: 1309217 - protein, 19 aa, Mycobacterium
SPLSCAIGLTVLDVLRAED

SEQ ID NO: 1309218 - protein, 24 aa, Mycobacterium
SPSAGHLFPMLALLGELAGRGHRV

SEQ ID NO: 1309219 - protein, 27 aa, Mycobacterium
SPTFKATYTGLLKLFLDQFGQGELGQV

SEQ ID NO: 1309220 - protein, 18 aa, Mycobacterium
SPTFRLRDLARLNARAAA

SEQ ID NO: 1309221 - protein, 25 aa, Mycobacterium
SPTSVALARRLLGRSWGHPTPRSAA

SEQ ID NO: 1309222 - protein, 25 aa, Mycobacterium
SPVAASLLPPGPLGPPPSASAAIAP

SEQ ID NO: 1309223 - protein, 23 aa, Mycobacterium
SPVLNYPLRQYMFCAPDEGAAAV

SEQ ID NO: 1309224 - protein, 25 aa, Mycobacterium
SPVQIRALLERDLPVYIISIGRTFR

SEQ ID NO: 1309225 - protein, 25 aa, Mycobacterium
SQDKLRTATLRMLLAAIQTEEVSGK

SEQ ID NO: 1309226 - protein, 20 aa, Mycobacterium
SQFGSFHMVDGFLLNNQLTD

SEQ ID NO: 1309227 - protein, 18 aa, Mycobacterium
SQVPGACDSTLLIAERVQ

SEQ ID NO: 1309228 - protein, 21 aa, Mycobacterium
SQVRILRAFGVRDVLLANEVV

SEQ ID NO: 1309229 - protein, 32 aa, Mycobacterium
SRAAGLPAEPRFRPVPPPTPPPPPPAHTGIVG

SEQ ID NO: 1309230 - protein, 17 aa, Mycobacterium
SRAFYVATAAHPEGMRR

SEQ ID NO: 1309231 - protein, 23 aa, Mycobacterium
SRARLIFNVPRPETLARYLREAE

SEQ ID NO: 1309232 - protein, 22 aa, Mycobacterium
SRDPFVQRVFGELLSRTAAVEA

SEQ ID NO: 1309233 - protein, 26 aa, Mycobacterium
SREYRSWPVWAHDAAMIYTPGRDDTT

SEQ ID NO: 1309234 - protein, 17 aa, Mycobacterium
SRFPDLDESLISDLILG

SEQ ID NO: 1309235 - protein, 34 aa, Mycobacterium
SRGWEPEPLRWLGVRGLYLAYRLADRHEARGRST

SEQ ID NO: 1309236 - protein, 23 aa, Mycobacterium
SRLGRLAKAEHWSGFGDAEMVFA

SEQ ID NO: 1309237 - protein, 17 aa, Mycobacterium
SRLLYRAFPYNEAALLL

SEQ ID NO: 1309238 - protein, 24 aa, Mycobacterium
SRLVALLAGALAHRVGLRVAVAAQ

SEQ ID NO: 1309239 - protein, 23 aa, Mycobacterium
SRRDEWLHRLFGRVVNLTFKMLP

SEQ ID NO: 1309240 - protein, 18 aa, Mycobacterium
SRRRERVSRRFHWSLHAG

SEQ ID NO: 1309241 - protein, 18 aa, Mycobacterium
SRSWLYTQPDLKDEIRRL

SEQ ID NO: 1309242 - protein, 17 aa, Mycobacterium
SRTLVPFGPVADAFLVP

SEQ ID NO: 1309243 - protein, 25 aa, Mycobacterium
SRYAFLPYYRTGAVSALRQAFRPTA

SEQ ID NO: 1309244 - protein, 17 aa, Mycobacterium
SSAHPWFQAALAAGPGS

SEQ ID NO: 1309245 - protein, 24 aa, Mycobacterium
SSDGVLCVPALAGLAAPWWDSAAT

SEQ ID NO: 1309246 - protein, 21 aa, Mycobacterium
SSFAVPTRWLIRTEPLPTLAG

SEQ ID NO: 1309247 - protein, 25 aa, Mycobacterium
SSIPMFAANYLLNQADIGLGCALGT

SEQ ID NO: 1309248 - protein, 28 aa, Mycobacterium
SSLEAAVDIWLRRIARRKVSPTVRNRLV

SEQ ID NO: 1309249 - protein, 25 aa, Mycobacterium
SSLLKGMTAHYLIKSTYPVQQGDTV

SEQ ID NO: 1309250 - protein, 28 aa, Mycobacterium
SSMGLRFQVPFDCGVLAVKASWGRYETF

SEQ ID NO: 1309251 - protein, 20 aa, Mycobacterium
SSQFVSGLMLSGALFRDGLT

SEQ ID NO: 1309252 - protein, 28 aa, Mycobacterium
SSRGWPRELLGRRTIGRLIYSGTPMPRS

SEQ ID NO: 1309253 - protein, 33 aa, Mycobacterium; identical to SEQ ID NO: 950640

SEQ ID NO: 1309254 - protein, 18 aa, Mycobacterium
SSRPLPLPDMCYAAAATG

SEQ ID NO: 1309255 - protein, 25 aa, Mycobacterium
SSRPPRLVRLSHKGAVRTRTRGARP

SEQ ID NO: 1309256 - protein, 17 aa, Mycobacterium
SSVAASLLRAHGFADVS

SEQ ID NO: 1309257 - protein, 21 aa, Mycobacterium
SSWAAPWTLDANTDALASLLD

SEQ ID NO: 1309258 - protein, 28 aa, Mycobacterium
STAMTPWVWPTMHLNPPEWIMPVTEACE

SEQ ID NO: 1309259 - protein, 19 aa, Mycobacterium
STDLLEVTPFIVLGTSSTS

SEQ ID NO: 1309260 - protein, 26 aa, Mycobacterium
STEHGIAFVPFFPLGSAFTADNPILG

SEQ ID NO: 1309261 - protein, 32 aa, Mycobacterium
STGLQSGWDLFLPHLHPLIANLVREALPRSDA

SEQ ID NO: 1309262 - protein, 23 aa, Mycobacterium
STLLAAYGLYDFFTGDEGAVVCV

SEQ ID NO: 1309263 - protein, 25 aa, Mycobacterium
STLWVLEGHGFLGYWRTDAALDTVS

SEQ ID NO: 1309264 - protein, 24 aa, Mycobacterium
STPDHIDLPFGGRVPLPHIDSDIP

SEQ ID NO: 1309265 - protein, 25 aa, Mycobacterium
STPRPEYRFPGLNPGDRWCVTATNW

SEQ ID NO: 1309266 - protein, 32 aa, Mycobacterium
STVKLSPMELPDSALLRLKRMYPGATYRATTG

SEQ ID NO: 1309267 - protein, 24 aa, Mycobacterium
SVARYIPRQVITPVTLPVVRMVTR

SEQ ID NO: 1309268 - protein, 18 aa, Mycobacterium
SVDLLSALGYHVVASTGK

SEQ ID NO: 1309269 - protein, 28 aa, Mycobacterium
SVEDLAGFWGALWEYFDLGTAPAEVLAD

SEQ ID NO: 1309270 - protein, 17 aa, Mycobacterium
SVHAFNQWLDEDWGFDR

SEQ ID NO: 1309271 - protein, 25 aa, Mycobacterium
SVHRKALLPHLAVKRIREFEPFIDD

SEQ ID NO: 1309272 - protein, 18 aa, Mycobacterium
SVIFAAELRDLTARHPDR

SEQ ID NO: 1309273 - protein, 17 aa, Mycobacterium
SVLALFDGARRDLEAAG

SEQ ID NO: 1309274 - protein, 24 aa, Mycobacterium
SVMAWSGYSMQFKAAANSLFQQLD

SEQ ID NO: 1309275 - protein, 24 aa, Mycobacterium
SVNSLARLLNPKTIAIVGLSDKSP

SEQ ID NO: 1309276 - protein, 17 aa, Mycobacterium
SVPLRGFTSLGLTEEEA

SEQ ID NO: 1309277 - protein, 23 aa, Mycobacterium
SVPTRRGNWWYYGRSFEGKQYGV

SEQ ID NO: 1309278 - protein, 23 aa, Mycobacterium
SVRRAILGLLDVDLLASVGAGDD

SEQ ID NO: 1309279 - protein, 19 aa, Mycobacterium
SVSHRLLARLQAEATPPQM

SEQ ID NO: 1309280 - protein, 23 aa, Mycobacterium
SVVAALRAVRAAAPGLPCEVEVD

SEQ ID NO: 1309281 - protein, 34 aa, Mycobacterium
SVVRLAVASWLDRVPPVAWWCRRDLSGGQIVEQA

SEQ ID NO: 1309282 - protein, 30 aa, Mycobacterium
SVYDDMVHVWPLFSSILPEGVDAANEAGAF

SEQ ID NO: 1309283 - protein, 19 aa, Mycobacterium
SWETYLVAAAWDSGKHSAS

SEQ ID NO: 1309284 - protein, 18 aa, Mycobacterium
SWIDATPLARLQTPDDVA

SEQ ID NO: 1309285 - protein, 19 aa, Mycobacterium
SWPHDASWIARLLEFDRDG

SEQ ID NO: 1309286 - protein, 24 aa, Mycobacterium
SWQTLLAVESLPLEGLQFPGSEFF

SEQ ID NO: 1309287 - protein, 20 aa, Mycobacterium
SWVLLELPGGWGPSAFLQSP

SEQ ID NO: 1309288 - protein, 17 aa, Mycobacterium
SYALWVFGGPEPVHDVD

SEQ ID NO: 1309289 - protein, 26 aa, Mycobacterium
SYDLSSLRYIMWCATPVTKSVADDVT

SEQ ID NO: 1309290 - protein, 19 aa, Mycobacterium
SYRMMEGFGVHTFRLTGPD

SEQ ID NO: 1309291 - protein, 25 aa, Mycobacterium
TAAALWILHPTYFGTTADIAALTAV

SEQ ID NO: 1309292 - protein, 27 aa, Mycobacterium
TAAGPHPFPLMVRDFQRIIGLEARVQI

SEQ ID NO: 1309293 - protein, 24 aa, Mycobacterium
TAAVDVTLLSRFYERFADHAVEVA

SEQ ID NO: 1309294 - protein, 17 aa, Mycobacterium
TADFMKLTPERYIHELL

SEQ ID NO: 1309295 - protein, 31 aa, Mycobacterium
TADGYLALFITHDGFWRLFASEAGIEGYPTM

SEQ ID NO: 1309296 - protein, 25 aa, Mycobacterium
TADIRYRWAVCEPTTGELLAEVALR

SEQ ID NO: 1309297 - protein, 29 aa, Mycobacterium
TAEDGAGWLTFWRSLTARGLSGVKLVTSD

SEQ ID NO: 1309298 - protein, 17 aa, Mycobacterium
TAETAAALWILHPTYFG

SEQ ID NO: 1309299 - protein, 25 aa, Mycobacterium
TAGAELGRLGWWDGPRPHCAHEAPA

SEQ ID NO: 1309300 - protein, 17 aa, Mycobacterium
TAGDLRRQMGMSGAAIT

SEQ ID NO: 1309301 - protein, 26 aa, Mycobacterium
TAGEWTIRFFMPSKWTMDTLPTPNDD

SEQ ID NO: 1309302 - protein, 21 aa, Mycobacterium
TAGLRWPDLALRAGRVGYPAL

SEQ ID NO: 1309303 - protein, 24 aa, Mycobacterium
TAHRLRGFPNAPMRATPLWAQPEP

SEQ ID NO: 1309304 - protein, 17 aa, Mycobacterium
TAIKLEPPPQPQPAPEP

SEQ ID NO: 1309305 - protein, 24 aa, Mycobacterium
TAIRDAGLVLTGAWPAKTEPGGKV

SEQ ID NO: 1309306 - protein, 26 aa, Mycobacterium
TAKNPRLWRRLLQCSSATGADGVVVT

SEQ ID NO: 1309307 - protein, 17 aa, Mycobacterium
TALALFCGSADSPTTPR

SEQ ID NO: 1309308 - protein, 17 aa, Mycobacterium
TALLRWACAFEATGARR

SEQ ID NO: 1309309 - protein, 18 aa, Mycobacterium
TALVPHFQQALRTEKHLA

SEQ ID NO: 1309310 - protein, 19 aa, Mycobacterium
TAMPFGLAPLRDVFELLRE

SEQ ID NO: 1309311 - protein, 23 aa, Mycobacterium
TAMSVVTPWLLSEPDRFAVLHGD

SEQ ID NO: 1309312 - protein, 23 aa, Mycobacterium
TAPAMFPKLTEEAFRLTFDVHVM

SEQ ID NO: 1309313 - protein, 22 aa, Mycobacterium
TAPFQEVFLRNQFYLRGNRAGA

SEQ ID NO: 1309314 - protein, 20 aa, Mycobacterium
TAPPLPGPPVYARSIIEGGL

SEQ ID NO: 1309315 - protein, 24 aa, Mycobacterium
TAPRLLLEVVCARLLLPSASDTES

SEQ ID NO: 1309316 - protein, 27 aa, Mycobacterium
TAQARFPELSTWRCNLRELREWPPEIA

SEQ ID NO: 1309317 - protein, 18 aa, Mycobacterium
TAQYPDQCDGWLGLAASG

SEQ ID NO: 1309318 - protein, 19 aa, Mycobacterium
TARAGKLGVPCRWPADAVT

SEQ ID NO: 1309319 - protein, 24 aa, Mycobacterium
TARDVGDIRFYCSQMIAPITVEMS

SEQ ID NO: 1309320 - protein, 20 aa, Mycobacterium
TARKGLWYDNARQDLWQIGM

SEQ ID NO: 1309321 - protein, 29 aa, Mycobacterium
TARQLKIPSERWIFPYAGTDSHDTYAIGE

SEQ ID NO: 1309322 - protein, 23 aa, Mycobacterium
TASLALELEFFGVRAKLVQPGYG

SEQ ID NO: 1309323 - protein, 35 aa, Mycobacterium
TASPADYIYAYGFRNPFRLTFTPDGKLLVADVGES

SEQ ID NO: 1309324 - protein, 24 aa, Mycobacterium
TATAPAVRRLLDAGALYVGKTNLD

SEQ ID NO: 1309325 - protein, 19 aa, Mycobacterium
TATAPRVGVFRPITRSGPA

SEQ ID NO: 1309326 - protein, 23 aa, Mycobacterium
TATARRVPALLKATARYCAPPPP

SEQ ID NO: 1309327 - protein, 22 aa, Mycobacterium
TAVLRYVMKIPPLATIPTEDLV

SEQ ID NO: 1309328 - protein, 23 aa, Mycobacterium
TAWATQLRMVQSQLLAKIAAAVG

SEQ ID NO: 1309329 - protein, 17 aa, Mycobacterium
TAWAVRAMTRLPQRSVV

SEQ ID NO: 1309330 - protein, 27 aa, Mycobacterium
TAWCAEGLLIYLPPEAQDLLFDNVTAL

SEQ ID NO: 1309331 - protein, 24 aa, Mycobacterium
TAYDELLLQFELPAGVEPVSGEIG

SEQ ID NO: 1309332 - protein, 24 aa, Mycobacterium
TCRRQVFRWLVRYNLRRRHSRCRY

SEQ ID NO: 1309333 - protein, 26 aa, Mycobacterium
TDADVVLGIIDPTYFLGGSMGLDKEG

SEQ ID NO: 1309334 - protein, 22 aa, Mycobacterium
TDAFRAIDTAELLLRAIGAETQ

SEQ ID NO: 1309335 - protein, 20 aa, Mycobacterium
TDDGYLMVTGRAKDIIIRNG

SEQ ID NO: 1309336 - protein, 24 aa, Mycobacterium
TDDLLVCIPLPGRNRYRMSMLVPD

SEQ ID NO: 1309337 - protein, 19 aa, Mycobacterium
TDDWLGEWTFAFPQGSMTD

SEQ ID NO: 1309338 - protein, 25 aa, Mycobacterium
TDEHGRILLIKRRDNTLWALPGGGH

SEQ ID NO: 1309339 - protein, 23 aa, Mycobacterium
TDERMVVRLLAFGLRAHRLGDVD

SEQ ID NO: 1309340 - protein, 23 aa, Mycobacterium
TDERNRPLLELSWDYVMDGDEPS

SEQ ID NO: 1309341 - protein, 26 aa, Mycobacterium
TDERRLRKLMASSDPAIYPDKYVTCV

SEQ ID NO: 1309342 - protein, 20 aa, Mycobacterium
TDGTLGLMLAMGPGFGFELL

SEQ ID NO: 1309343 - protein, 21 aa, Mycobacterium
TDHQAVFTRLAELDRRIAQQV

SEQ ID NO: 1309344 - protein, 20 aa, Mycobacterium
TDLRRGGRPLALVDKHSTGG

SEQ ID NO: 1309345 - protein, 21 aa, Mycobacterium
TDNGVYIIGDRYSFLVMDSST

SEQ ID NO: 1309346 - protein, 25 aa, Mycobacterium
TDPRSRVPALPRLEPGVALPCCRQT

SEQ ID NO: 1309347 - protein, 33 aa, Mycobacterium
TDPVLAEWFLRRFSLLDSLYMVPSPRLVGRTIG

SEQ ID NO: 1309348 - protein, 24 aa, Mycobacterium
TDQTLAALSLLLNGGGVGQLQDIT

SEQ ID NO: 1309349 - protein, 25 aa, Mycobacterium
TDSADFYRSLIAMSSWEGQGAQAAR

SEQ ID NO: 1309350 - protein, 24 aa, Mycobacterium
TDTHAALRYRAVPDRYLVFEDFAL

SEQ ID NO: 1309351 - protein, 20 aa, Mycobacterium
TDVPDMFRLLSVLSPGTPDH

SEQ ID NO: 1309352 - protein, 24 aa, Mycobacterium
TDWRRLTVTLAWLSPVNTATRRHR

SEQ ID NO: 1309353 - protein, 23 aa, Mycobacterium
TDYLAVQRLIDQYGLDSGCSVMV

SEQ ID NO: 1309354 - protein, 23 aa, Mycobacterium
TEADGVALLRRLVGRFPSGELQF

SEQ ID NO: 1309355 - protein, 25 aa, Mycobacterium
TEASYQRKLRYLAYKAKTIVEETGA

SEQ ID NO: 1309356 - protein, 17 aa, Mycobacterium
TEAYLGLAAYTFAIRRL

SEQ ID NO: 1309357 - protein, 17 aa, Mycobacterium
TEFLAFNSAIFSEQVWL

SEQ ID NO: 1309358 - protein, 19 aa, Mycobacterium
TEFPYVFCDATFCKVRIGA

SEQ ID NO: 1309359 - protein, 29 aa, Mycobacterium
TEISVEWIELAFFALLLRGCREAARGLVP

SEQ ID NO: 1309360 - protein, 24 aa, Mycobacterium
TELQTAFMLSPWAARTPIDVEVPF

SEQ ID NO: 1309361 - protein, 25 aa, Mycobacterium
TELRHLFRELLTRLSHVEFGEPDLL

SEQ ID NO: 1309362 - protein, 27 aa, Mycobacterium
TELTRNLWPVARRPVELVWGLVAQTPE

SEQ ID NO: 1309363 - protein, 24 aa, Mycobacterium
TEPAPVLVFVPGGAWVHGSRLLQG

SEQ ID NO: 1309364 - protein, 30 aa, Mycobacterium
TEPEGLKGLFEFFTPLLRNVTPNARLVVIG

SEQ ID NO: 1309365 - protein, 18 aa, Mycobacterium
TEQFRPELLAPAVRTGAL

SEQ ID NO: 1309366 - protein, 19 aa, Mycobacterium
TERWVPLERVGLYVPGGNA

SEQ ID NO: 1309367 - protein, 25 aa, Mycobacterium
TESASSFYPGRGGLLYVASKFAVRG

SEQ ID NO: 1309368 - protein, 23 aa, Mycobacterium
TETPHEMPYGIDSGFRDPSGNSV

SEQ ID NO: 1309369 - protein, 24 aa, Mycobacterium
TETVGGVLRLGYLGTLGVGPGFAI

SEQ ID NO: 1309370 - protein, 25 aa, Mycobacterium
TEVGIGIVRTMLRHAPKDEKTTPSD

SEQ ID NO: 1309371 - protein, 18 aa, Mycobacterium
TFAAEPDLFWSPINSLED

SEQ ID NO: 1309372 - protein, 17 aa, Mycobacterium
TFERFGIERFVRLMAAP

SEQ ID NO: 1309373 - protein, 20 aa, Mycobacterium
TFGAEWTLVEPTLPGVRNGG

SEQ ID NO: 1309374 - protein, 28 aa, Mycobacterium
TFKTALWELIWAGWVTGDTFAPVRAMLS

SEQ ID NO: 1309375 - protein, 28 aa, Mycobacterium
TFPGLADGIALWPWQRDFVDRAVSTPAV

SEQ ID NO: 1309376 - protein, 18 aa, Mycobacterium
TFTIEPMINLGGLDYEIW

SEQ ID NO: 1309377 - protein, 18 aa, Mycobacterium
TFTPAFKLMLDNDATLFA

SEQ ID NO: 1309378 - protein, 25 aa, Mycobacterium
TGADKLLRLRWPCPVPGARPLSEVG

SEQ ID NO: 1309379 - protein, 23 aa, Mycobacterium
TGAGQRWPRFVPAAREAGFASVH

SEQ ID NO: 1309380 - protein, 28 aa, Mycobacterium
TGANNLYLAFGMLNWRFGDRELRSPLVL

SEQ ID NO: 1309381 - protein, 25 aa, Mycobacterium
TGAVILDHWGIIKADIGIRDGRIVA

SEQ ID NO: 1309382 - protein, 19 aa, Mycobacterium
TGAYVALPYLKRAPDSLMF

SEQ ID NO: 1309383 - protein, 23 aa, Mycobacterium
TGDALFIGDVGRPDLLASIGFTR

SEQ ID NO: 1309384 - protein, 19 aa, Mycobacterium
TGGMLSARLTDRAGSSAYV

SEQ ID NO: 1309385 - protein, 18 aa, Mycobacterium
TGGTAGIGLACAHLLAGA

SEQ ID NO: 1309386 - protein, 20 aa, Mycobacterium
TGLPAAELVTPLLAGTTLEV

SEQ ID NO: 1309387 - protein, 20 aa, Mycobacterium
TGMDAFRAWRLLVTEYGTPA

SEQ ID NO: 1309388 - protein, 19 aa, Mycobacterium
TGMFISLMFAGHHTSSGTS

SEQ ID NO: 1309389 - protein, 26 aa, Mycobacterium
TGNVGRLALAALLGNPAYELTAVGVS

SEQ ID NO: 1309390 - protein, 25 aa, Mycobacterium
TGPSKPLMPSTWGAAPTTAADSLAN

SEQ ID NO: 1309391 - protein, 28 aa, Mycobacterium
TGQLADYLIPRLRSIDAPLLAVVGGSTG

SEQ ID NO: 1309392 - protein, 23 aa, Mycobacterium
TGSFYHYFANWSAYTRELVEYWR

SEQ ID NO: 1309393 - protein, 25 aa, Mycobacterium
TGSSTYWYARHLRLPPGVPAHHSGY

SEQ ID NO: 1309394 - protein, 19 aa, Mycobacterium
TGTPWAYQQLGITPDVVAF

SEQ ID NO: 1309395 - protein, 28 aa, Mycobacterium
TGVGDEEFVRFQKAWFAELHSAGYAVPH

SEQ ID NO: 1309396 - protein, 24 aa, Mycobacterium
TGVGLALVAQQRGYKCIFVCPDKV

SEQ ID NO: 1309397 - protein, 22 aa, Mycobacterium
TGVLRLYQFEAAGELPFPAINV

SEQ ID NO: 1309398 - protein, 20 aa, Mycobacterium
TGVRVFFPDPWPKARHHKRR

SEQ ID NO: 1309399 - protein, 26 aa, Mycobacterium
THLITSHALLPLLTARAGGLLVEITD

SEQ ID NO: 1309400 - protein, 17 aa, Mycobacterium
THQVIVVTHLPQVAAYA

SEQ ID NO: 1309401 - protein, 23 aa, Mycobacterium
TIAVEPFRKWWQPGPGEGCIGFT

SEQ ID NO: 1309402 - protein, 17 aa, Mycobacterium
TIDRVGLLARLTAVFER

SEQ ID NO: 1309403 - protein, 17 aa, Mycobacterium
TIGQLPSPYTARNPLIV

SEQ ID NO: 1309404 - protein, 31 aa, Mycobacterium
TIKPTLTIGSLAPKMPWPWGAVDFACRALRP

SEQ ID NO: 1309405 - protein, 19 aa, Mycobacterium
TIPAGRKVLLLYGSANRDE

SEQ ID NO: 1309406 - protein, 17 aa, Mycobacterium
TIPGDVWRAFLAQETTL

SEQ ID NO: 1309407 - protein, 27 aa, Mycobacterium
TKARQVRRLYKALLPNPKAAAQQRNVA

SEQ ID NO: 1309408 - protein, 17 aa, Mycobacterium
TKGALYYHFDSKEALAA

SEQ ID NO: 1309409 - protein, 34 aa, Mycobacterium
TKLTSGQQDWHRWLWEAWTIDGLAGGRWALAVKM

SEQ ID NO: 1309410 - protein, 23 aa, Mycobacterium
TKRDGWPAVLPLNAIRGAFHNGG

SEQ ID NO: 1309411 - protein, 22 aa, Mycobacterium
TKTNRWTVRPGPVAARHWTIEP

SEQ ID NO: 1309412 - protein, 26 aa, Mycobacterium
TKTRAPRTYLLSGLLRCGRCGNRLFS

SEQ ID NO: 1309413 - protein, 23 aa, Mycobacterium
TLAEIRIAEVLLLAGQKLLDEAG

SEQ ID NO: 1309414 - protein, 31 aa, Mycobacterium
TLARHPDLTARFLPFSTYLTEQSTLPARLRE

SEQ ID NO: 1309415 - protein, 26 aa, Mycobacterium
TLEHRFDRDLWRKLIDADVLSTTAPE

SEQ ID NO: 1309416 - protein, 23 aa, Mycobacterium
TLGDRFDLVAAERGRMLAMASTK

SEQ ID NO: 1309417 - protein, 26 aa, Mycobacterium
TLGEVGPSATWRTLKTGYQTSVEKNI

SEQ ID NO: 1309418 - protein, 17 aa, Mycobacterium
TLGILGYGRIGRAVARR

SEQ ID NO: 1309419 - protein, 19 aa, Mycobacterium
TLHRASGPMPKWYAPVGSL

SEQ ID NO: 1309420 - protein, 18 aa, Mycobacterium
TLIPRPQRMYLRFAPPID

SEQ ID NO: 1309421 - protein, 26 aa, Mycobacterium
TLLRDHGLLLPIEPETRLLGETELWQ

SEQ ID NO: 1309422 - protein, 18 aa, Mycobacterium
TLLVRTLAATLQLEFKRV

SEQ ID NO: 1309423 - protein, 17 aa, Mycobacterium
TLNFLPMSHVMGRGLLC

SEQ ID NO: 1309424 - protein, 17 aa, Mycobacterium
TLPEFPQMWADMLAGQT

SEQ ID NO: 1309425 - protein, 25 aa, Mycobacterium
TLPEVDGALFAAALRHAVDLVEAAL

SEQ ID NO: 1309426 - protein, 20 aa, Mycobacterium
TLPGAGSLLMPPWRVIKFES

SEQ ID NO: 1309427 - protein, 21 aa, Mycobacterium
TLPIGWVEPEDIANAVLFLAS

SEQ ID NO: 1309428 - protein, 24 aa, Mycobacterium
TLRCPYHAWTYALDGKLVAAPNIA

SEQ ID NO: 1309429 - protein, 21 aa, Mycobacterium
TLRMHPPVPIVLRRLTEPLTV

SEQ ID NO: 1309430 - protein, 20 aa, Mycobacterium
TLRRLIVHRSVADDLVERIV

SEQ ID NO: 1309431 - protein, 19 aa, Mycobacterium
TLRRLYRRPRSGALVAMES

SEQ ID NO: 1309432 - protein, 17 aa, Mycobacterium
TLSAPPGHLPDPGLDPN

SEQ ID NO: 1309433 - protein, 19 aa, Mycobacterium
TLTPILHSPLGIAALRNII

SEQ ID NO: 1309434 - protein, 17 aa, Mycobacterium
TLTRCDVRVPRYATVDL

SEQ ID NO: 1309435 - protein, 21 aa, Mycobacterium
TLTVEYLQPVPLHQPHRITAH

SEQ ID NO: 1309436 - protein, 28 aa, Mycobacterium
TLVSLLLMILPHLALAPYVRGLDPILGL

SEQ ID NO: 1309437 - protein, 23 aa, Mycobacterium
TLYRRYPNREALITELGRQTFDF

SEQ ID NO: 1309438 - protein, 26 aa, Mycobacterium
TMDANQFMAAWWRIVRRIALGDRARD

SEQ ID NO: 1309439 - protein, 17 aa, Mycobacterium
TMGTAKVLAFGPAVENL

SEQ ID NO: 1309440 - protein, 18 aa, Mycobacterium
TMLSMTRMGDLLGPDPVL

SEQ ID NO: 1309441 - protein, 25 aa, Mycobacterium
TMRRVELTPTFRTTLALAVGQHAAD

SEQ ID NO: 1309442 - protein, 22 aa, Mycobacterium
TNALLDAGCRTTVWNRTAARAD

SEQ ID NO: 1309443 - protein, 26 aa, Mycobacterium
TNATMPYVLKLADKGWRAACQADPAL

SEQ ID NO: 1309444 - protein, 25 aa, Mycobacterium
TNDERILVFTALPPAIRPKTAAEEQ

SEQ ID NO: 1309445 - protein, 21 aa, Mycobacterium
TNHLDVEVIGWLASHLSTKRP

SEQ ID NO: 1309446 - protein, 17 aa, Mycobacterium
TNPLVLQQIWDTPLPMV

SEQ ID NO: 1309447 - protein, 23 aa, Mycobacterium
TNYTRLIPYFATSVAVRRTTDGV

SEQ ID NO: 1309448 - protein, 21 aa, Mycobacterium
TPADFWTFLLDGGSRVREVPA

SEQ ID NO: 1309449 - protein, 22 aa, Mycobacterium
TPALGDALMAYVGLPRRARAFE

SEQ ID NO: 1309450 - protein, 31 aa, Mycobacterium
TPAQIALAWTLTVAPNVLLIPGTSSVAHLGE

SEQ ID NO: 1309451 - protein, 20 aa, Mycobacterium
TPASFIAFDLLALGDTDYTS

SEQ ID NO: 1309452 - protein, 17 aa, Mycobacterium
TPAWLGAFANPGAMDLD

SEQ ID NO: 1309453 - protein, 22 aa, Mycobacterium
TPDHLRIVTLPWARDLANAIER

SEQ ID NO: 1309454 - protein, 25 aa, Mycobacterium
TPEPGERFSLLPLSARTPAALVRIA

SEQ ID NO: 1309455 - protein, 19 aa, Mycobacterium
TPFERAAITDMLFGSVSDV

SEQ ID NO: 1309456 - protein, 25 aa, Mycobacterium
TPGELDWPATWLDRAGRDRAPTVPG

SEQ ID NO: 1309457 - protein, 31 aa, Mycobacterium
TPGRAQFHYLESWLLPSLNLRASVFHFNPGF

SEQ ID NO: 1309458 - protein, 17 aa, Mycobacterium
TPIILSDGAHHTNASYY

SEQ ID NO: 1309459 - protein, 24 aa, Mycobacterium
TPIVNLARWGGLTAGLTTATTPAR

SEQ ID NO: 1309460 - protein, 24 aa, Mycobacterium
TPKALIALDAWCTEALDGGGSDVT

SEQ ID NO: 1309461 - protein, 26 aa, Mycobacterium
TPLRTGSLRVNFLRRLVAGGECRYSA

SEQ ID NO: 1309462 - protein, 18 aa, Mycobacterium
TPLTVTAPVPYAPTGGLR

SEQ ID NO: 1309463 - protein, 28 aa, Mycobacterium
TPPADNSLMLWFEVMKPLMSTSAERGAA

SEQ ID NO: 1309464 - protein, 32 aa, Mycobacterium
TPPHVGVLLGNTPFFSRVLVAAALAGLVPVGL

SEQ ID NO: 1309465 - protein, 19 aa, Mycobacterium
TPPSHLYPDEFAKRAKALG

SEQ ID NO: 1309466 - protein, 19 aa, Mycobacterium
TPRDGGVFDQLPFALAPGQ

SEQ ID NO: 1309467 - protein, 25 aa, Mycobacterium
TPRHPLEGLDLLHGGAWKAELRALR

SEQ ID NO: 1309468 - protein, 34 aa, Mycobacterium
TPRRGELLVFDKLARPMVPLIVLAVPSSRGKGVL

SEQ ID NO: 1309469 - protein, 34 aa, Mycobacterium; identical to SEQ ID NO: 867897

SEQ ID NO: 1309470 - protein, 24 aa, Mycobacterium
TPTATAIPFPPDAPTPRPAAMSHR

SEQ ID NO: 1309471 - protein, 23 aa, Mycobacterium
TPTDIGLALITPLVGQEFLDRYN

SEQ ID NO: 1309472 - protein, 27 aa, Mycobacterium
TPTEITVPGLLTARVVPGTPAAQTQAR

SEQ ID NO: 1309473 - protein, 17 aa, Mycobacterium
TPVLIPLGDGLLAAARD

SEQ ID NO: 1309474 - protein, 30 aa, Mycobacterium
TQAANLKCLCRLHHLLKTFGGWKDQQLPDG

SEQ ID NO: 1309475 - protein, 24 aa, Mycobacterium
TQDPPAFCYIVADLTDKMIERCEV

SEQ ID NO: 1309476 - protein, 24 aa, Mycobacterium
TQMADLDLLFAEELCPADDVLGRR

SEQ ID NO: 1309477 - protein, 20 aa, Mycobacterium
TQRQSVTLPAYTAAKAMLTS

SEQ ID NO: 1309478 - protein, 21 aa, Mycobacterium
TQVEPVVPRPLIREVTERIDY

SEQ ID NO: 1309479 - protein, 19 aa, Mycobacterium
TRAPLLAEERRLLIAALGR

SEQ ID NO: 1309480 - protein, 21 aa, Mycobacterium
TRAYLEFNAYLLRESTLTPRI

SEQ ID NO: 1309481 - protein, 18 aa, Mycobacterium
TRETLGFSVLHVVRDNPT

SEQ ID NO: 1309482 - protein, 18 aa, Mycobacterium
TRFRIGKRVYLMVDDDAT

SEQ ID NO: 1309483 - protein, 25 aa, Mycobacterium
TRGDGRIVFWFTPSTHSSHMQLNKQ

SEQ ID NO: 1309484 - protein, 19 aa, Mycobacterium
TRGDLNIAAGWMNRARRLL

SEQ ID NO: 1309485 - protein, 18 aa, Mycobacterium
TRGPLYAVLGSPGGAVII

SEQ ID NO: 1309486 - protein, 19 aa, Mycobacterium
TRIAGLRRTVAALEADTIG

SEQ ID NO: 1309487 - protein, 27 aa, Mycobacterium
TRIVVLGDAWGLLKFLDEGAFVLDEKA

SEQ ID NO: 1309488 - protein, 22 aa, Mycobacterium
TRLAEHWQLLPSGVAGFHERYG

SEQ ID NO: 1309489 - protein, 19 aa, Mycobacterium
TRLLAWVPVFESDAFSRLS

SEQ ID NO: 1309490 - protein, 34 aa, Mycobacterium
TRLLQTSPACERLLWLPDLVAAAYRRTITHHDRT

SEQ ID NO: 1309491 - protein, 19 aa, Mycobacterium
TRNGRLPHLLNADSPQAVS

SEQ ID NO: 1309492 - protein, 20 aa, Mycobacterium
TRSRFLTRNRLVAALSGATV

SEQ ID NO: 1309493 - protein, 28 aa, Mycobacterium
TRSVGPLLGQFFTALREKRIVGVRGSDG

SEQ ID NO: 1309494 - protein, 17 aa, Mycobacterium
TRTLTVEYLQPVPLHQP

SEQ ID NO: 1309495 - protein, 18 aa, Mycobacterium
TRVKARVPVALAAGLRDF

SEQ ID NO: 1309496 - protein, 22 aa, Mycobacterium
TRWIASNWPGLISELHRLVPDL

SEQ ID NO: 1309497 - protein, 23 aa, Mycobacterium
TSCYGCLRSFRNARFHEQLSRGA

SEQ ID NO: 1309498 - protein, 27 aa, Mycobacterium
TSDHPEWVIPVRWTPTHDLPPLEAVLT

SEQ ID NO: 1309499 - protein, 24 aa, Mycobacterium
TSEELPRQLLARLHAIFPETAQAD

SEQ ID NO: 1309500 - protein, 24 aa, Mycobacterium
TSFDPQWWQRAAELGWASLLVPEE

SEQ ID NO: 1309501 - protein, 27 aa, Mycobacterium
TSGMAIAEHLMGLLGGTDLDLEPRADL

SEQ ID NO: 1309502 - protein, 23 aa, Mycobacterium
TSIKEVLANHLRISRKAAGDRLA

SEQ ID NO: 1309503 - protein, 24 aa, Mycobacterium
TSLFGQFLAYLRTGDLPGTARIGA

SEQ ID NO: 1309504 - protein, 25 aa, Mycobacterium
TSLQDEIGFTRVLYDDHIGKVSLIG

SEQ ID NO: 1309505 - protein, 21 aa, Mycobacterium
TSLVTGWASIHGFPVGILANA

SEQ ID NO: 1309506 - protein, 19 aa, Mycobacterium
TSMFRHADLSSALAATELG

SEQ ID NO: 1309507 - protein, 20 aa, Mycobacterium
TSMYGVIRGTPPPFFEGDAG

SEQ ID NO: 1309508 - protein, 19 aa, Mycobacterium
TSNPWTLRKILRANQIALQ

SEQ ID NO: 1309509 - protein, 31 aa, Mycobacterium
TSQALRRFIDLYEALPGRYRRVESFRQLWAV

SEQ ID NO: 1309510 - protein, 23 aa, Mycobacterium
TSRDEWILDWRFTRDARAQRRAA

SEQ ID NO: 1309511 - protein, 19 aa, Mycobacterium
TSREILLTDIITAFGQRLA

SEQ ID NO: 1309512 - protein, 17 aa, Mycobacterium
TSRGWWTDVVEARHLPE

SEQ ID NO: 1309513 - protein, 44 aa, Mycobacterium
TSRKMYAAPNRRTAHRLAALDVPVPFWFRAPGECPGAYAAEVAM

SEQ ID NO: 1309514 - protein, 20 aa, Mycobacterium
TSSQMVWLWNHAVSRGGAPD

SEQ ID NO: 1309515 - protein, 26 aa, Mycobacterium
TSSYGRGFLTPRDSLRQRCLTHELLI

SEQ ID NO: 1309516 - protein, 25 aa, Mycobacterium
TSYLVPTNDLPLTKPLRQLGVDRRI

SEQ ID NO: 1309517 - protein, 22 aa, Mycobacterium
TTAHHWLVIGSADLAAPLTGAG

SEQ ID NO: 1309518 - protein, 26 aa, Mycobacterium
TTDPTLQFTLAYYVPPDQLPVAETHL

SEQ ID NO: 1309519 - protein, 22 aa, Mycobacterium
TTGGLPPQARRLLDLPWSEHQE

SEQ ID NO: 1309520 - protein, 18 aa, Mycobacterium
TTISRLLDRLTAYDHGLL

SEQ ID NO: 1309521 - protein, 28 aa, Mycobacterium
TTLQPYLGAFGHLVALRDGDLAYLHVHP

SEQ ID NO: 1309522 - protein, 29 aa, Mycobacterium
TTLSWVDANVWRRIVPKGWFYNVMVTGVK

SEQ ID NO: 1309523 - protein, 25 aa, Mycobacterium
TTLWASWVIAGPEHRVFFGGDTGYT

SEQ ID NO: 1309524 - protein, 20 aa, Mycobacterium
TTLWPDFTFRFRNQTRRFDL

SEQ ID NO: 1309525 - protein, 17 aa, Mycobacterium
TTMVKAYIRGNGFDWEP

SEQ ID NO: 1309526 - protein, 17 aa, Mycobacterium
TTPDHLLGQLGIHDVLE

SEQ ID NO: 1309527 - protein, 30 aa, Mycobacterium
TTQVIVFTHDIFFATTLLTLMEETKRCSYF

SEQ ID NO: 1309528 - protein, 20 aa, Mycobacterium
TTRFEDFWRRVGVTKAAAAA

SEQ ID NO: 1309529 - protein, 24 aa, Mycobacterium
TTRGFRDAILMQRATGHWAGRELH

SEQ ID NO: 1309530 - protein, 23 aa, Mycobacterium
TTTTSMLYAILRAADRRAMLCGN

SEQ ID NO: 1309531 - protein, 18 aa, Mycobacterium
TTVRILSTLLRPSSGQAI

SEQ ID NO: 1309532 - protein, 24 aa, Mycobacterium
TVAEAPPWIGALDVIVLAGDDPAD

SEQ ID NO: 1309533 - protein, 22 aa, Mycobacterium
TVATVPWTTDRLLNVLTRETET

SEQ ID NO: 1309534 - protein, 19 aa, Mycobacterium
TVAYTDRRLLPLDKKQYTS

SEQ ID NO: 1309535 - protein, 29 aa, Mycobacterium
TVDAVRGLLRLPPAYIKAVGGPGELAVMA

SEQ ID NO: 1309536 - protein, 24 aa, Mycobacterium
TVELNASFYRWPRDATFEGWRQRL

SEQ ID NO: 1309537 - protein, 18 aa, Mycobacterium
TVFDGAGFPEEYRNRVFI

SEQ ID NO: 1309538 - protein, 20 aa, Mycobacterium
TVFEELFWGDAGIALSILAT

SEQ ID NO: 1309539 - protein, 23 aa, Mycobacterium
TVFKAAYRQGLSLVLKGPTGCGK

SEQ ID NO: 1309540 - protein, 22 aa, Mycobacterium
TVGAWLWSKRRAVITGKAAAAL

SEQ ID NO: 1309541 - protein, 25 aa, Mycobacterium
TVGFDCSGLMLYAFAGVGIKLDHYS

SEQ ID NO: 1309542 - protein, 25 aa, Mycobacterium
TVGPFLNRRAMIAEAGDALAVFGVN

SEQ ID NO: 1309543 - protein, 19 aa, Mycobacterium
TVHMHTLKLAVIQLDDLGG

SEQ ID NO: 1309544 - protein, 23 aa, Mycobacterium
TVHTATFVLDAPRGAPAGPAAPA

SEQ ID NO: 1309545 - protein, 21 aa, Mycobacterium
TVIPRPFTVRCARVGALPGLT

SEQ ID NO: 1309546 - protein, 25 aa, Mycobacterium
TVLYPELHDCFYNEQFLAHAKSYWN

SEQ ID NO: 1309547 - protein, 28 aa, Mycobacterium
TVMDNLNARRRWLMQHVRAGVVQTSDAA

SEQ ID NO: 1309548 - protein, 24 aa, Mycobacterium
TVPAIRDWYARRGLTPWLAVPDRL

SEQ ID NO: 1309549 - protein, 29 aa, Mycobacterium
TVPARITQWKNALLDLSLRNRLINYTDRA

SEQ ID NO: 1309550 - protein, 17 aa, Mycobacterium
TVPLKKLLEKAANLTIA

SEQ ID NO: 1309551 - protein, 17 aa, Mycobacterium
TVRAGSLVAWRAGENPH

SEQ ID NO: 1309552 - protein, 17 aa, Mycobacterium
TVRWWHGDVDHIIPFAH

SEQ ID NO: 1309553 - protein, 34 aa, Mycobacterium
TVSGPLLPVSPPPPAAPWLPQAPVSTSGQIFAGP

SEQ ID NO: 1309554 - protein, 34 aa, Mycobacterium
TVSHTDARFNLSRAALLVVALTERPDLLMAATED

SEQ ID NO: 1309555 - protein, 20 aa, Mycobacterium
TVTAPVPYAPTGGLRNPFPP

SEQ ID NO: 1309556 - protein, 23 aa, Mycobacterium
TVTTGIISALNRPVAAGGDTRNQ

SEQ ID NO: 1309557 - protein, 23 aa, Mycobacterium
TVTVPELLAVRPAPGVWHLVSTV

SEQ ID NO: 1309558 - protein, 19 aa, Mycobacterium
TVVGLGRYIPRIARIAAAT

SEQ ID NO: 1309559 - protein, 20 aa, Mycobacterium
TVYRHWKNKGALIVDALRTL

SEQ ID NO: 1309560 - protein, 20 aa, Mycobacterium
TWQVPQYPPYIPESQFDASQ

SEQ ID NO: 1309561 - protein, 26 aa, Mycobacterium
TWRAKVRKLPALDTAALRPAQIEAVN

SEQ ID NO: 1309562 - protein, 19 aa, Mycobacterium
TWRRWLEDANTLPSLREND

SEQ ID NO: 1309563 - protein, 17 aa, Mycobacterium
TYDDLAAAAMRQLREIG

SEQ ID NO: 1309564 - protein, 26 aa, Mycobacterium
TYEKISQLKPVFRPNGTITAGNACPL

SEQ ID NO: 1309565 - protein, 25 aa, Mycobacterium
TYRIDIPLLAIVPCAVPASGTVYRQ

SEQ ID NO: 1309566 - protein, 19 aa, Mycobacterium
VAAAGFLLVDPMDRLRLLA

SEQ ID NO: 1309567 - protein, 25 aa, Mycobacterium
VAACYPFHPMLMALAKDEWSKVTGF

SEQ ID NO: 1309568 - protein, 29 aa, Mycobacterium
VAAEGIEPFGFYYEKFALAAPAAATSAAA

SEQ ID NO: 1309569 - protein, 23 aa, Mycobacterium
VAAGAARWLVLSGPAGIGKTRLA

SEQ ID NO: 1309570 - protein, 25 aa, Mycobacterium
VAAGWVLDLLGLPATASVGFVTGGQ

SEQ ID NO: 1309571 - protein, 28 aa, Mycobacterium
VAALERLETLLALIEGWVQTVVTSALGD

SEQ ID NO: 1309572 - protein, 25 aa, Mycobacterium
VAALTLLQRDLFARINPAIVEAYLD

SEQ ID NO: 1309573 - protein, 26 aa, Mycobacterium
VAAMRDGRFLVLPHPAVRDMLAGKVA

SEQ ID NO: 1309574 - protein, 23 aa, Mycobacterium
VAAPLMDTVGVLPYAAVGAVHAD

SEQ ID NO: 1309575 - protein, 32 aa, Mycobacterium
VAARVGRPPVIRRAILTLFADRAPEVGVPSEW

SEQ ID NO: 1309576 - protein, 24 aa, Mycobacterium
VAASDAFFPFPDGLETLTEAGVKA

SEQ ID NO: 1309577 - protein, 19 aa, Mycobacterium
VAAVFLRELLAEDLQPVVE

SEQ ID NO: 1309578 - protein, 18 aa, Mycobacterium
VAAVRSKAPGDKVTLTYL

SEQ ID NO: 1309579 - protein, 22 aa, Mycobacterium
VACRPWLLAELDAVRPEVVVLL

SEQ ID NO: 1309580 - protein, 18 aa, Mycobacterium
VADFTYVKLVTGVFVYVA

SEQ ID NO: 1309581 - protein, 21 aa, Mycobacterium
VAEFAKILARLIPAGATVATD

SEQ ID NO: 1309582 - protein, 24 aa, Mycobacterium
VAEGGLPWRYHPDGSVALASPPKE

SEQ ID NO: 1309583 - protein, 29 aa, Mycobacterium
VAEGRAYRALADPIALSAALQLGHDRLLD

SEQ ID NO: 1309584 - protein, 24 aa, Mycobacterium
VAELAYIHRIGYQLTPKYTEAAQI

SEQ ID NO: 1309585 - protein, 18 aa, Mycobacterium
VAELLDLVGLPTDFASRY

SEQ ID NO: 1309586 - protein, 17 aa, Mycobacterium
VAELMDLRPNQTRWRIA

SEQ ID NO: 1309587 - protein, 24 aa, Mycobacterium
VAEMNWRIMKFKPTADDRPAVPED

SEQ ID NO: 1309588 - protein, 23 aa, Mycobacterium
VAERLLARNGWRNTSLAQIAREA

SEQ ID NO: 1309589 - protein, 28 aa, Mycobacterium
VAESKALVRLYLALVALLRGDFDRAEDE

SEQ ID NO: 1309590 - protein, 19 aa, Mycobacterium
VAFDPPCVIAWEPGQRVNG

SEQ ID NO: 1309591 - protein, 17 aa, Mycobacterium
VAFSTARAGKLGVPCRW

SEQ ID NO: 1309592 - protein, 26 aa, Mycobacterium
VAGAPALVFVSWPDSGPLIGADAQGT

SEQ ID NO: 1309593 - protein, 26 aa, Mycobacterium
VAHDLNPLLPILTGAIYLLDGHPHYD

SEQ ID NO: 1309594 - protein, 19 aa, Mycobacterium
VAHLARLARLALSDDELDS

SEQ ID NO: 1309595 - protein, 29 aa, Mycobacterium
VAHTMPNWHYLHIHNDVLPALRARGVTDE

SEQ ID NO: 1309596 - protein, 18 aa, Mycobacterium
VAKLVKRTLDGWLRELTA

SEQ ID NO: 1309597 - protein, 22 aa, Mycobacterium
VAKTLTLWAGLIGAISLEVFGQ

SEQ ID NO: 1309598 - protein, 23 aa, Mycobacterium
VALGFGFRCGFLGLLHMEITRER

SEQ ID NO: 1309599 - protein, 25 aa, Mycobacterium
VALPGGGFIRRLPADGLELDLLVPR

SEQ ID NO: 1309600 - protein, 18 aa, Mycobacterium
VALPYLKRAPDSLMFSTS

SEQ ID NO: 1309601 - protein, 20 aa, Mycobacterium
VALSRWGMLAPDGQCKTFDA

SEQ ID NO: 1309602 - protein, 26 aa, Mycobacterium
VAMILSTAMLLEWLAERHHRGALAGA

SEQ ID NO: 1309603 - protein, 31 aa, Mycobacterium
VANRAVLGVYRPLLEPLGLTHPQYLVMLVLW

SEQ ID NO: 1309604 - protein, 17 aa, Mycobacterium
VAPIRRGVVVAGRIGID

SEQ ID NO: 1309605 - protein, 23 aa, Mycobacterium
VAPSAVDYVIMGQVLTAGAGQMP

SEQ ID NO: 1309606 - protein, 17 aa, Mycobacterium
VAQLIRDGLPVSGVMLE

SEQ ID NO: 1309607 - protein, 24 aa, Mycobacterium
VARALTLARLDAVALLPAADGDPM

SEQ ID NO: 1309608 - protein, 22 aa, Mycobacterium
VARIVPFNHPVLFAGSKIAAPL

SEQ ID NO: 1309609 - protein, 23 aa, Mycobacterium
VARKYPDFPIVLEAVRECLQDVY

SEQ ID NO: 1309610 - protein, 19 aa, Mycobacterium
VARLDEVLVLALVSKFVMP

SEQ ID NO: 1309611 - protein, 17 aa, Mycobacterium
VARLHALLRRAHHSDRP

SEQ ID NO: 1309612 - protein, 25 aa, Mycobacterium
VARRIPMFEFAIRSLIPAGDVLDND

SEQ ID NO: 1309613 - protein, 17 aa, Mycobacterium
VARSSFYAWLAAADGRA

SEQ ID NO: 1309614 - protein, 17 aa, Mycobacterium
VASAAVVALALPGGTPL

SEQ ID NO: 1309615 - protein, 40 aa, Mycobacterium
VASARWVLANRAYTPWYLVRYWRLLKFKLTNPHVITRGMV

SEQ ID NO: 1309616 - protein, 18 aa, Mycobacterium
VATILGRQAPDRLRALFT

SEQ ID NO: 1309617 - protein, 18 aa, Mycobacterium
VATWWRTVGPKVAGLPNL

SEQ ID NO: 1309618 - protein, 24 aa, Mycobacterium
VAVETNVAAFRWGRAAIADPIRFH

SEQ ID NO: 1309619 - protein, 23 aa, Mycobacterium
VAVLLRITEVFGVDATFFASQDD

SEQ ID NO: 1309620 - protein, 24 aa, Mycobacterium
VAVLLRITEVFGVDATFFASQDDT

SEQ ID NO: 1309621 - protein, 17 aa, Mycobacterium
VAVRYFAAARAAAGTES

SEQ ID NO: 1309622 - protein, 20 aa, Mycobacterium
VAVVTALRALGNDIPICVLS

SEQ ID NO: 1309623 - protein, 17 aa, Mycobacterium
VAYAVVGPSFWGDGMYP

SEQ ID NO: 1309624 - protein, 18 aa, Mycobacterium
VAYVIKNAERFGMQDAIW

SEQ ID NO: 1309625 - protein, 23 aa, Mycobacterium
VCHAWTMFASYMPRARRAVDEIS

SEQ ID NO: 1309626 - protein, 17 aa, Mycobacterium
VCTGGLPGRAPVHRATR

SEQ ID NO: 1309627 - protein, 23 aa, Mycobacterium
VDAADIHALGGWWAEVLGYAQEV

SEQ ID NO: 1309628 - protein, 26 aa, Mycobacterium
VDAALPQVLTYAPAKVFLPWAAFSEE

SEQ ID NO: 1309629 - protein, 28 aa, Mycobacterium
VDALAALVFWRLIALGKPVSARHLDRVA

SEQ ID NO: 1309630 - protein, 17 aa, Mycobacterium
VDALAPFGIRHADLPLT

SEQ ID NO: 1309631 - protein, 29 aa, Mycobacterium
VDAMNSAVFFLLGLYALLTTTHGWPTQGA

SEQ ID NO: 1309632 - protein, 19 aa, Mycobacterium
VDARWTITCGPDRLGQISS

SEQ ID NO: 1309633 - protein, 30 aa, Mycobacterium
VDASLAHRCAVAMPWEWRQANAFSEQERLK

SEQ ID NO: 1309634 - protein, 22 aa, Mycobacterium
VDEMLARFPEWEKQLSAAAPPD

SEQ ID NO: 1309635 - protein, 18 aa, Mycobacterium
VDFVGWYNAHPHFEQMGP

SEQ ID NO: 1309636 - protein, 23 aa, Mycobacterium
VDGKRAGLWPGLKETFNSGSTEI

SEQ ID NO: 1309637 - protein, 24 aa, Mycobacterium
VDHWAMFDTVRFGLNLVVAGDDGE

SEQ ID NO: 1309638 - protein, 17 aa, Mycobacterium
VDIYYRDVDPENWAAYS

SEQ ID NO: 1309639 - protein, 17 aa, Mycobacterium
VDKLRPLGADGLKELFV

SEQ ID NO: 1309640 - protein, 28 aa, Mycobacterium
VDLEYVYVPTVLALFNHVIAGIKAVQAQ

SEQ ID NO: 1309641 - protein, 26 aa, Mycobacterium
VDLIQRFPNVLVLRTFSKAYGLAGLR

SEQ ID NO: 1309642 - protein, 28 aa, Mycobacterium
VDLNHDVGFIGVPLFHIAGIGNTIVGLL

SEQ ID NO: 1309643 - protein, 23 aa, Mycobacterium
VDLPVAVKLSPFFSATAEMALRL

SEQ ID NO: 1309644 - protein, 22 aa, Mycobacterium
VDMADYLILGACNPPLAHQAVL

SEQ ID NO: 1309645 - protein, 19 aa, Mycobacterium
VDMEPFFDAYRAVKPYLMT

SEQ ID NO: 1309646 - protein, 23 aa, Mycobacterium
VDNNLPAMPPGRREAELLIAGDD

SEQ ID NO: 1309647 - protein, 22 aa, Mycobacterium
VDPDALLEWLPPRGMRGEFERF

SEQ ID NO: 1309648 - protein, 22 aa, Mycobacterium
VDPHARWERLYRLVNQFFDHRG

SEQ ID NO: 1309649 - protein, 19 aa, Mycobacterium
VDQADRWASLWWLRVSGSE

SEQ ID NO: 1309650 - protein, 21 aa, Mycobacterium
VDQGLSLTLFFKDTATTRDVN

SEQ ID NO: 1309651 - protein, 23 aa, Mycobacterium
VDQNFYVCIAVDAQFLETLTDHG

SEQ ID NO: 1309652 - protein, 23 aa, Mycobacterium
VDQQPWQMPQWQYATKRSRINQR

SEQ ID NO: 1309653 - protein, 17 aa, Mycobacterium
VDSLLALDLGKRFRRVL

SEQ ID NO: 1309654 - protein, 25 aa, Mycobacterium
VDTRNMWGLPQLGRWKWHDPDVHIQ

SEQ ID NO: 1309655 - protein, 26 aa, Mycobacterium
VDTVGARMMLLRRLAHPDDARLGPPL

SEQ ID NO: 1309656 - protein, 24 aa, Mycobacterium
VDWFAANFGVLPWSMHYITNIESD

SEQ ID NO: 1309657 - protein, 25 aa, Mycobacterium
VEAMGLLRGGDSWMFVGWCRLREGI

SEQ ID NO: 1309658 - protein, 24 aa, Mycobacterium
VEELLRFLDIIGNLPRYLTEDIEL

SEQ ID NO: 1309659 - protein, 25 aa, Mycobacterium
VEGDPLAFKITTPLDLVLAEAILAG

SEQ ID NO: 1309660 - protein, 17 aa, Mycobacterium
VEGIRRPAEFFRAARRC

SEQ ID NO: 1309661 - protein, 17 aa, Mycobacterium
VEGLLGAFRARVAPFNV

SEQ ID NO: 1309662 - protein, 17 aa, Mycobacterium
VEHMGSLLGRPVVTISC

SEQ ID NO: 1309663 - protein, 20 aa, Mycobacterium
VEHMPLLDGLGLSLNNRGAL

SEQ ID NO: 1309664 - protein, 24 aa, Mycobacterium
VEICPACHFILPDDWRNGHAVCIA

SEQ ID NO: 1309665 - protein, 18 aa, Mycobacterium
VEILPVPGLPEFRPGDDL

SEQ ID NO: 1309666 - protein, 29 aa, Mycobacterium
VEIQSFDWRTLPLVRQQAPSVPLVALWDD

SEQ ID NO: 1309667 - protein, 27 aa, Mycobacterium
VEKPRAEGRFYLPGGRRLGYAEFGDPS

SEQ ID NO: 1309668 - protein, 23 aa, Mycobacterium
VERLLFLGSSCIYPKFAEQPIRE

SEQ ID NO: 1309669 - protein, 25 aa, Mycobacterium
VERSTRFTILLHLPGDHTAETVAAA

SEQ ID NO: 1309670 - protein, 18 aa, Mycobacterium
VERVAARVFPHMRQIVVS

SEQ ID NO: 1309671 - protein, 18 aa, Mycobacterium
VETGWRLVAAATTGVVNV

SEQ ID NO: 1309672 - protein, 26 aa, Mycobacterium
VETVPRIFKRIRPGFRYERSLSVLTM

SEQ ID NO: 1309673 - protein, 25 aa, Mycobacterium
VFDEADPLRLLIYTSGSAGAPKGAM

SEQ ID NO: 1309674 - protein, 29 aa, Mycobacterium
VFDVNVKGVFLLTRALVPLLEAAATEQDP

SEQ ID NO: 1309675 - protein, 33 aa, Mycobacterium
VFEIPGLPPIMLPWPPPPPPPPPAPPPPPPPPA

SEQ ID NO: 1309676 - protein, 18 aa, Mycobacterium
VFEKPLTPPLLSDGVTVT

SEQ ID NO: 1309677 - protein, 19 aa, Mycobacterium
VFIDPYEWLRDKSDPEVLA

SEQ ID NO: 1309678 - protein, 21 aa, Mycobacterium
VFNMALFNLRQVERRLMVTAA

SEQ ID NO: 1309679 - protein, 30 aa, Mycobacterium
VFNRPVIAMYRLAPPVYDVLMGVFLRTFGF

SEQ ID NO: 1309680 - protein, 20 aa, Mycobacterium
VFQNALLLRMTLRALTERGV

SEQ ID NO: 1309681 - protein, 27 aa, Mycobacterium
VFQQADDVWLPLFRPVAGDPGELPADE

SEQ ID NO: 1309682 - protein, 24 aa, Mycobacterium
VFTDPYSFDILRDPNPHVGFGGTG

SEQ ID NO: 1309683 - protein, 27 aa, Mycobacterium
VGAGYTGLWTAYYLKRADPSLRIAILE

SEQ ID NO: 1309684 - protein, 22 aa, Mycobacterium
VGDALMALISGLSPFVERVLSP

SEQ ID NO: 1309685 - protein, 25 aa, Mycobacterium
VGDAYAAPLIAELRRRPYDLSSLFA

SEQ ID NO: 1309686 - protein, 26 aa, Mycobacterium
VGDGTMCWLFVPRLRADGWVQIGGRE

SEQ ID NO: 1309687 - protein, 19 aa, Mycobacterium
VGEGRWWRRWAARHAPRTL

SEQ ID NO: 1309688 - protein, 19 aa, Mycobacterium
VGFSSWALTAGDDATLRLL

SEQ ID NO: 1309689 - protein, 23 aa, Mycobacterium
VGGDLFALYWESGGTEPVGLAAA

SEQ ID NO: 1309690 - protein, 24 aa, Mycobacterium
VGGEYPRDWPRPQHGWTLTIEGDP

SEQ ID NO: 1309691 - protein, 19 aa, Mycobacterium
VGHHWRYSAAVGLVRDMLG

SEQ ID NO: 1309692 - protein, 24 aa, Mycobacterium
VGKVRRVRLLPGDPPATRQAVDAI

SEQ ID NO: 1309693 - protein, 22 aa, Mycobacterium
VGLDPVLRVDLWHQFDELARGG

SEQ ID NO: 1309694 - protein, 22 aa, Mycobacterium
VGLPLLAAMRPQPGVAAALERG

SEQ ID NO: 1309695 - protein, 18 aa, Mycobacterium
VGLRPDVRRVPMFGLGCV

SEQ ID NO: 1309696 - protein, 21 aa, Mycobacterium
VGQLLKVVPPLAALVAAARAA

SEQ ID NO: 1309697 - protein, 24 aa, Mycobacterium
VGRFRLRCLMGERIRVRQWLDDAP

SEQ ID NO: 1309698 - protein, 33 aa, Mycobacterium
VGSYPKVVLVTGACRFLGGYLIARLAQNPLINH

SEQ ID NO: 1309699 - protein, 19 aa, Mycobacterium
VGWYNAHPHFEQMGPDLST

SEQ ID NO: 1309700 - protein, 18 aa, Mycobacterium
VGYLVKRVQQSLRRRCDA

SEQ ID NO: 1309701 - protein, 24 aa, Mycobacterium
VGYRAPMWDLSWRTPALLAERGFL

SEQ ID NO: 1309702 - protein, 25 aa, Mycobacterium
VHAARKALAPLFGLEPDQLRVIAPH

SEQ ID NO: 1309703 - protein, 25 aa, Mycobacterium
VHAQVPRQWLSWHYRSQDEALIAFS

SEQ ID NO: 1309704 - protein, 18 aa, Mycobacterium
VHDKPPAVALLHVRRREA

SEQ ID NO: 1309705 - protein, 26 aa, Mycobacterium
VHELDDLPWVPADRAWLAALGHALRN

SEQ ID NO: 1309706 - protein, 24 aa, Mycobacterium
VHHKNLFRALPNNTVIAGLIAAMS

SEQ ID NO: 1309707 - protein, 18 aa, Mycobacterium
VHIYPVAFHGDVAHFVRE

SEQ ID NO: 1309708 - protein, 26 aa, Mycobacterium
VHKMLAGLFGLCERHRHLFQAMLEVR

SEQ ID NO: 1309709 - protein, 24 aa, Mycobacterium
VHNSLWRNDIPYLCTLREGLLYAL

SEQ ID NO: 1309710 - protein, 31 aa, Mycobacterium
VHNSQPWRWHVGADRLDLFAVPRLHLRHIDP

SEQ ID NO: 1309711 - protein, 18 aa, Mycobacterium
VHPAGAPAWELTGEAWRQ

SEQ ID NO: 1309712 - protein, 18 aa, Mycobacterium
VHPGLWQPAVLAKLGATA

SEQ ID NO: 1309713 - protein, 19 aa, Mycobacterium
VHRRFQQPLRMLRPELDSR

SEQ ID NO: 1309714 - protein, 23 aa, Mycobacterium
VHVTIVLRESALENWGIRGGQAA

SEQ ID NO: 1309715 - protein, 20 aa, Mycobacterium
VHYYQPLWTLVGGGQAKAST

SEQ ID NO: 1309716 - protein, 26 aa, Mycobacterium
VIAELASMMPMRVIGMLLGIPESEQV

SEQ ID NO: 1309717 - protein, 28 aa, Mycobacterium
VIAVHLRGHFLLTRNAATYWRAKAKAGD

SEQ ID NO: 1309718 - protein, 18 aa, Mycobacterium
VIDFKTSILAGIGAEPTA

SEQ ID NO: 1309719 - protein, 24 aa, Mycobacterium
VIGAFPMARRRALFAELQPLVATF

SEQ ID NO: 1309720 - protein, 17 aa, Mycobacterium
VIGLMRTFAVELGQHSI

SEQ ID NO: 1309721 - protein, 17 aa, Mycobacterium
VIGSADLAAPLTGAGHS

SEQ ID NO: 1309722 - protein, 26 aa, Mycobacterium
VIGSDRRYVMAISSLDPDDDASARET

SEQ ID NO: 1309723 - protein, 19 aa, Mycobacterium
VIIGLGVTPSVDWLSGSDL

SEQ ID NO: 1309724 - protein, 34 aa, Mycobacterium
VIMDYLVHQRRLLPLIARSYALQFAQNELVAKCH

SEQ ID NO: 1309725 - protein, 18 aa, Mycobacterium
VIPLPYGTDVDWLRNVVT

SEQ ID NO: 1309726 - protein, 23 aa, Mycobacterium
VIQVARIGLIKTVDRYDPDKGHF

SEQ ID NO: 1309727 - protein, 20 aa, Mycobacterium
VIRGTPPPFFEGDAGAFTGL

SEQ ID NO: 1309728 - protein, 23 aa, Mycobacterium
VISDIWLANLVAFISGRVSAADT

SEQ ID NO: 1309729 - protein, 21 aa, Mycobacterium
VITADRRPLVWHDPRIESTKC

SEQ ID NO: 1309730 - protein, 19 aa, Mycobacterium
VITPEQFFPAFGSMTFDDS

SEQ ID NO: 1309731 - protein, 22 aa, Mycobacterium
VKATLRRLYRHPTSGQLVAMES

SEQ ID NO: 1309732 - protein, 25 aa, Mycobacterium
VKDNLTKWWRGDYANITTIVDLTLS

SEQ ID NO: 1309733 - protein, 24 aa, Mycobacterium
VKEERYSFPLFFNVDYHTEVKPLP

SEQ ID NO: 1309734 - protein, 19 aa, Mycobacterium
VKRPNWIVAVERKGVWVET

SEQ ID NO: 1309735 - protein, 29 aa, Mycobacterium
VLAAQGFEVLLLLAAVPTPVVAFTVRHMH

SEQ ID NO: 1309736 - protein, 17 aa, Mycobacterium
VLAGADPVIMLTAPIPA

SEQ ID NO: 1309737 - protein, 27 aa, Mycobacterium
VLAGADPVIMLTAPIPATQKALKKSGL

SEQ ID NO: 1309738 - protein, 18 aa, Mycobacterium
VLAGGWVLRALQGTPASL

SEQ ID NO: 1309739 - protein, 17 aa, Mycobacterium
VLASRLLTDFPFRNWED

SEQ ID NO: 1309740 - protein, 18 aa, Mycobacterium
VLAWHDALNARDIDTLLE

SEQ ID NO: 1309741 - protein, 17 aa, Mycobacterium
VLDWPLNVVVVRSGDRT

SEQ ID NO: 1309742 - protein, 19 aa, Mycobacterium
VLEAWPRHDLGYAITDLIA

SEQ ID NO: 1309743 - protein, 25 aa, Mycobacterium
VLERAMRLLPQVKLLQAYGMTELSP

SEQ ID NO: 1309744 - protein, 22 aa, Mycobacterium
VLFKDFLALHFSQTRPPVEESM

SEQ ID NO: 1309745 - protein, 24 aa, Mycobacterium
VLGDPALPHLFFVDGGALAVENAL

SEQ ID NO: 1309746 - protein, 27 aa, Mycobacterium
VLGGGALPFGIFAGGLLTGPELINPAA

SEQ ID NO: 1309747 - protein, 17 aa, Mycobacterium
VLGIWRSLLPAEEWVAV

SEQ ID NO: 1309748 - protein, 28 aa, Mycobacterium
VLHEAPGQSMWFAIPGMYGGFHVTLRQG

SEQ ID NO: 1309749 - protein, 20 aa, Mycobacterium
VLIEPRVDLWARVLRRQPLP

SEQ ID NO: 1309750 - protein, 20 aa, Mycobacterium
VLIVLIDDVGFGASSAFGGP

SEQ ID NO: 1309751 - protein, 18 aa, Mycobacterium
VLKTYPALDPARVHVVRN

SEQ ID NO: 1309752 - protein, 21 aa, Mycobacterium
VLLDLVRELAPTVTLILTSHQ

SEQ ID NO: 1309753 - protein, 19 aa, Mycobacterium
VLLLHCYPFQRQAGYLAQA

SEQ ID NO: 1309754 - protein, 18 aa, Mycobacterium
VLLTLWERVIREADAALE

SEQ ID NO: 1309755 - protein, 17 aa, Mycobacterium
VLPDYRRAPENKFPAAV

SEQ ID NO: 1309756 - protein, 17 aa, Mycobacterium
VLPSMEAAFVDIGRGRN

SEQ ID NO: 1309757 - protein, 25 aa, Mycobacterium
VLQHSWVHVLPSRKEGWGLAVTEAG

SEQ ID NO: 1309758 - protein, 18 aa, Mycobacterium
VLQLQRCPWCGTKIDPKR

SEQ ID NO: 1309759 - protein, 18 aa, Mycobacterium
VLQQIWDTPLPMVVNAYD

SEQ ID NO: 1309760 - protein, 22 aa, Mycobacterium
VLQTYPCHPLLQANRVAAAANA

SEQ ID NO: 1309761 - protein, 21 aa, Mycobacterium
VLRDPFGHLWSMGQPVREVSQ

SEQ ID NO: 1309762 - protein, 18 aa, Mycobacterium
VLVDLIELHLQGKHAHWN

SEQ ID NO: 1309763 - protein, 30 aa, Mycobacterium
VLVFGHGLLMDGRQWRKVIPLLPGYRCITP

SEQ ID NO: 1309764 - protein, 17 aa, Mycobacterium
VLVFPGLHLDPQAQVEF

SEQ ID NO: 1309765 - protein, 21 aa, Mycobacterium
VLVIHENKGLNDYIRSVAGRF

SEQ ID NO: 1309766 - protein, 18 aa, Mycobacterium
VMASWTIPAGHVAGVYAS

SEQ ID NO: 1309767 - protein, 21 aa, Mycobacterium
VMFGPAGRLYTYRSHGIHVCA

SEQ ID NO: 1309768 - protein, 22 aa, Mycobacterium
VMGRLTWESLPPKVRPLPGRKN

SEQ ID NO: 1309769 - protein, 20 aa, Mycobacterium
VMLHLAIKAFAPARLPFPVM

SEQ ID NO: 1309770 - protein, 17 aa, Mycobacterium
VMRPRIARRYAAVEGHR

SEQ ID NO: 1309771 - protein, 19 aa, Mycobacterium
VMRTAGIAGYRRRRRVKTT

SEQ ID NO: 1309772 - protein, 18 aa, Mycobacterium
VMTYFFTDPGGMEPFLAL

SEQ ID NO: 1309773 - protein, 17 aa, Mycobacterium
VMVFVHGGGFVAGSTRT

SEQ ID NO: 1309774 - protein, 19 aa, Mycobacterium
VNHTIWWKNLSPNGGDKPT

SEQ ID NO: 1309775 - protein, 23 aa, Mycobacterium
VNNVPPPPALPGPPPPPGPGQQL

SEQ ID NO: 1309776 - protein, 17 aa, Mycobacterium
VNYDIPWSLVRLEQRMG

SEQ ID NO: 1309777 - protein, 19 aa, Mycobacterium
VPAELLTTAPVAEWVRRRG

SEQ ID NO: 1309778 - protein, 24 aa, Mycobacterium
VPESELPIIVRRNKFHLHRLINDA

SEQ ID NO: 1309779 - protein, 24 aa, Mycobacterium
VPGEPLDRPLYVRPIMCPHELAAG

SEQ ID NO: 1309780 - protein, 17 aa, Mycobacterium
VPGLARFIRQHSGGRWA

SEQ ID NO: 1309781 - protein, 17 aa, Mycobacterium
VPGLPEFRPGDDLAAAL

SEQ ID NO: 1309782 - protein, 25 aa, Mycobacterium
VPGSRLFFPAWDTTTAELPPMTAPP

SEQ ID NO: 1309783 - protein, 32 aa, Mycobacterium
VPICRTAEFLAWFLENVPIEPIWLCPLRLRDE

SEQ ID NO: 1309784 - protein, 27 aa, Mycobacterium
VPMRAAGIVLGALGLFGSRPGALNEAD

SEQ ID NO: 1309785 - protein, 17 aa, Mycobacterium
VPPEFGPVRVRFLGIND

SEQ ID NO: 1309786 - protein, 34 aa, Mycobacterium
VPPHQKMFSKPPLPEPWALPIKWDHWGQLFESKT

SEQ ID NO: 1309787 - protein, 20 aa, Mycobacterium
VPPSLIRRAAAYFERALVTR

SEQ ID NO: 1309788 - protein, 19 aa, Mycobacterium
VPSWIRRTGSAPTAAFTIA

SEQ ID NO: 1309789 - protein, 24 aa, Mycobacterium
VPSYVKPVFKLGWSRRLAPLMRRW

SEQ ID NO: 1309790 - protein, 17 aa, Mycobacterium
VPTMFSRILKLPNEIRD

SEQ ID NO: 1309791 - protein, 18 aa, Mycobacterium
VPVVEVILPAVRRAVATT

SEQ ID NO: 1309792 - protein, 27 aa, Mycobacterium
VQAVRRQYGLPWISAMPTNLYGPNDNF

SEQ ID NO: 1309793 - protein, 24 aa, Mycobacterium
VQDFSGPFPVEVITRMAGVPEAFR

SEQ ID NO: 1309794 - protein, 22 aa, Mycobacterium
VQGWAVGLGCNLALAADFTVAG

SEQ ID NO: 1309795 - protein, 18 aa, Mycobacterium
VQISRLLNDALARIRQRV

SEQ ID NO: 1309796 - protein, 23 aa, Mycobacterium
VQKPKLVARWWRYERDAKAMREA

SEQ ID NO: 1309797 - protein, 37 aa, Mycobacterium
VQRGQGKWYPGEPLPRWQIGLYWRADGAPLWTDASLL

SEQ ID NO: 1309798 - protein, 21 aa, Mycobacterium
VQRRWRAFSRTGTPGDAWAPY

SEQ ID NO: 1309799 - protein, 35 aa, Mycobacterium
VQSKVLDLLARLQRDLGLTYLFIGHDLAVIQRMSH

SEQ ID NO: 1309800 - protein, 24 aa, Mycobacterium
VQTPIAGLIELALRDPCLADLSAR

SEQ ID NO: 1309801 - protein, 27 aa, Mycobacterium
VQVGLRGYWPPQDTFEWMLEQGMTWHT

SEQ ID NO: 1309802 - protein, 35 aa, Mycobacterium
VQVPTPPVAAPPPRRSGRRAIPVLAGALVAAAGVG

SEQ ID NO: 1309803 - protein, 32 aa, Mycobacterium
VRAALAEYAGLSFLRGLRVLPAELGGEAGLVG

SEQ ID NO: 1309804 - protein, 32 aa, Mycobacterium
VRDFRRTAGLDLLPRLLIRGGELDLTVVRSIL

SEQ ID NO: 1309805 - protein, 25 aa, Mycobacterium
VRDKPLPFPPEPLASIGINATRWSL

SEQ ID NO: 1309806 - protein, 18 aa, Mycobacterium
VRDRLIPPTLRGETAWCQ

SEQ ID NO: 1309807 - protein, 17 aa, Mycobacterium
VRDRPLAPVARISTRRT

SEQ ID NO: 1309808 - protein, 25 aa, Mycobacterium
VRFNWHTMYFRYKTIDPYYGTSFYT

SEQ ID NO: 1309809 - protein, 26 aa, Mycobacterium
VRGTGKGLRSARRLGRRRPAPEEAVD

SEQ ID NO: 1309810 - protein, 24 aa, Mycobacterium
VRHDPFLFQAMSVANGLAGANLGL

SEQ ID NO: 1309811 - protein, 17 aa, Mycobacterium
VRILARHDASIAQILSY

SEQ ID NO: 1309812 - protein, 23 aa, Mycobacterium
VRLAQLLVHITPPGLDTVFFSDS

SEQ ID NO: 1309813 - protein, 17 aa, Mycobacterium
VRLARQLRFRRAESPIS

SEQ ID NO: 1309814 - protein, 26 aa, Mycobacterium
VRLHHRRRIRPAAGRFNRILAAEEVP

SEQ ID NO: 1309815 - protein, 17 aa, Mycobacterium
VRLTLDEFVTQLATLWL

SEQ ID NO: 1309816 - protein, 17 aa, Mycobacterium
VRLYIVLYQDVVQMCTA

SEQ ID NO: 1309817 - protein, 21 aa, Mycobacterium
VRMIEAYHRLSKLNEYSAVDF

SEQ ID NO: 1309818 - protein, 17 aa, Mycobacterium
VRNGYRAINVSGGILAW

SEQ ID NO: 1309819 - protein, 17 aa, Mycobacterium
VRQYTDLPFLVKLEERD

SEQ ID NO: 1309820 - protein, 23 aa, Mycobacterium
VRRGGYVLSSFVAAALPADEIDA

SEQ ID NO: 1309821 - protein, 18 aa, Mycobacterium
VRRRIYTGKPARLLKTKW

SEQ ID NO: 1309822 - protein, 19 aa, Mycobacterium
VRSWTTRAPAGDVTIPFLI

SEQ ID NO: 1309823 - protein, 22 aa, Mycobacterium
VRTLGHLRRWLAGKADLEPRIA

SEQ ID NO: 1309824 - protein, 21 aa, Mycobacterium
VRTWLLDHERTWVAVDFTKTR

SEQ ID NO: 1309825 - protein, 21 aa, Mycobacterium
VRVTMFERLPTPYGLVRAGVA

SEQ ID NO: 1309826 - protein, 20 aa, Mycobacterium
VRWRHPTRGLLLPESFIGVA

SEQ ID NO: 1309827 - protein, 26 aa, Mycobacterium
VSAPALHRRWWAADGLGAFVTVSGES

SEQ ID NO: 1309828 - protein, 29 aa, Mycobacterium
VSCTATTLKPLFLAAAHWKRTGRFPGVDI

SEQ ID NO: 1309829 - protein, 22 aa, Mycobacterium
VSDALDLIPPKLAAAIDNVVVL

SEQ ID NO: 1309830 - protein, 17 aa, Mycobacterium
VSGATVAPALRADLDRH

SEQ ID NO: 1309831 - protein, 18 aa, Mycobacterium
VSGEPAVAIFRPAAVAVY

SEQ ID NO: 1309832 - protein, 20 aa, Mycobacterium
VSGLTPITLGSSSDLRVGQD

SEQ ID NO: 1309833 - protein, 22 aa, Mycobacterium
VSHLLDLRGPSVALDAACAASL

SEQ ID NO: 1309834 - protein, 18 aa, Mycobacterium
VSKVDLRQRYWKGASRSV

SEQ ID NO: 1309835 - protein, 29 aa, Mycobacterium
VSLEENFGIFLWLRSLDSPPEKKYALKLL

SEQ ID NO: 1309836 - protein, 26 aa, Mycobacterium
VSLRALRRTLAIELAYRPGGMLAAKW

SEQ ID NO: 1309837 - protein, 30 aa, Mycobacterium
VSLSPTEFTLLRYFIINAGTVLSKPKILDH

SEQ ID NO: 1309838 - protein, 28 aa, Mycobacterium
VSMTMNGAVLPILALYVVAAEEQGVPPE

SEQ ID NO: 1309839 - protein, 28 aa, Mycobacterium
VSMTMNGAVLPILALYVVAAEEQRVPPE

SEQ ID NO: 1309840 - protein, 18 aa, Mycobacterium
VSNAPFYRAVRDEVEVFR

SEQ ID NO: 1309841 - protein, 30 aa, Mycobacterium
VSNTELMRHLHLPPVFNPLVGVLTQSPTMG

SEQ ID NO: 1309842 - protein, 19 aa, Mycobacterium
VSQLRTAIKLEPPPQPQPA

SEQ ID NO: 1309843 - protein, 34 aa, Mycobacterium
VSRGGGRYSVYPWALLVMALARIGLGPLRGARPD

SEQ ID NO: 1309844 - protein, 32 aa, Mycobacterium
VSRIQWRFERLCKQIPLAAPWTAPAAHRLDDL

SEQ ID NO: 1309845 - protein, 30 aa, Mycobacterium
VSSNYRFDLAPRTWEFIRTLRSGSAVFAMP

SEQ ID NO: 1309846 - protein, 25 aa, Mycobacterium
VSTKAGWDMWPGPYGQLGGRAYLLA

SEQ ID NO: 1309847 - protein, 24 aa, Mycobacterium
VSTLLLQIDGLPAHVLFVGATNHS

SEQ ID NO: 1309848 - protein, 19 aa, Mycobacterium
VTAPAWVGPVLAARSLTTA

SEQ ID NO: 1309849 - protein, 23 aa, Mycobacterium
VTASPYLGFGSLQPLLDTATAHG

SEQ ID NO: 1309850 - protein, 32 aa, Mycobacterium; identical to SEQ ID NO: 875603

SEQ ID NO: 1309851 - protein, 17 aa, Mycobacterium
VTDGRWWGIVWAEEGTA

SEQ ID NO: 1309852 - protein, 17 aa, Mycobacterium
VTDIFAARRVGALARRL

SEQ ID NO: 1309853 - protein, 22 aa, Mycobacterium
VTDLVNVRYLSGFTGSNAALLI

SEQ ID NO: 1309854 - protein, 28 aa, Mycobacterium
VTDYRDTIPQLFIPNCLVLLSNGSEAKV

SEQ ID NO: 1309855 - protein, 17 aa, Mycobacterium
VTERIVVQRFADVRFRM

SEQ ID NO: 1309856 - protein, 34 aa, Mycobacterium
VTERPLVILLHGFASFWWSWRHQLRGLGGARVVA

SEQ ID NO: 1309857 - protein, 39 aa, Mycobacterium
VTEYYEKAGLWPYLEKLGFFLVGYGCTTCIGNSGPLPEE

SEQ ID NO: 1309858 - protein, 23 aa, Mycobacterium
VTFARFPDQWQKLLDDRSKIPAA

SEQ ID NO: 1309859 - protein, 29 aa, Mycobacterium
VTFSQPYPAWRELFNNILPAHIVKDVPGG

SEQ ID NO: 1309860 - protein, 25 aa, Mycobacterium
VTFVAGLKSPLPHPWRPADSSNEAR

SEQ ID NO: 1309861 - protein, 35 aa, Mycobacterium
VTGMAGHDVLLAPTLLTPPPPYALLDQPRGTTRAF

SEQ ID NO: 1309862 - protein, 22 aa, Mycobacterium
VTGMSYGVIAPLLHGITSVVDE

SEQ ID NO: 1309863 - protein, 33 aa, Mycobacterium
VTGNPIVLVDFWAPWCGPCRAFAPVFERSSQTH

SEQ ID NO: 1309864 - protein, 22 aa, Mycobacterium
VTGRIFIAAGGFVGEFARQSPG

SEQ ID NO: 1309865 - protein, 19 aa, Mycobacterium
VTGWEDGMFPHMRALGDPN

SEQ ID NO: 1309866 - protein, 32 aa, Mycobacterium
VTKGSFYWHFDDMPAYRAALVAAWGRLRDEDC

SEQ ID NO: 1309867 - protein, 26 aa, Mycobacterium
VTLGIALARLGMFAPAMSYLAEPAGP

SEQ ID NO: 1309868 - protein, 18 aa, Mycobacterium
VTQPLVVAATLLAHEEAA

SEQ ID NO: 1309869 - protein, 27 aa, Mycobacterium
VTQSYRLLKHGGFERILFLVDRNNLAD

SEQ ID NO: 1309870 - protein, 24 aa, Mycobacterium
VTRAKGAWLWSGRDAVAVGLSASA

SEQ ID NO: 1309871 - protein, 34 aa, Mycobacterium
VTRDAKWKPFNLGNLLYNAILAIGFEWGVGLQHV

SEQ ID NO: 1309872 - protein, 24 aa, Mycobacterium
VTRQTVYRYFPNADALLMASAMRA

SEQ ID NO: 1309873 - protein, 36 aa, Mycobacterium
VTTTPAVEGAFYWLSNREVRWRPAEYWKPGTTVEVD

SEQ ID NO: 1309874 - protein, 19 aa, Mycobacterium
VTVLFDDYGYRTLAMAAVT

SEQ ID NO: 1309875 - protein, 20 aa, Mycobacterium
VVAANRWLRLLPASGAPSPN

SEQ ID NO: 1309876 - protein, 18 aa, Mycobacterium
VVALLRIRADWGAVVERQ

SEQ ID NO: 1309877 - protein, 23 aa, Mycobacterium
VVAVSDWMRAVPEQIRPWVPGTY

SEQ ID NO: 1309878 - protein, 17 aa, Mycobacterium
VVCLSRLVPRKGQDMLI

SEQ ID NO: 1309879 - protein, 18 aa, Mycobacterium
VVDDPTALPPGWRIEQSQ

SEQ ID NO: 1309880 - protein, 27 aa, Mycobacterium
VVDRYELPVLAPPIPRTVRFAEASASG

SEQ ID NO: 1309881 - protein, 26 aa, Mycobacterium
VVEEPPPSTVFLLCAPSVDPEDIAIT

SEQ ID NO: 1309882 - protein, 19 aa, Mycobacterium
VVFVNMWGDSDDTPMYRRL

SEQ ID NO: 1309883 - protein, 34 aa, Mycobacterium
VVGAVVPWNMPQFLIVTKLIPALLAGCTVVVKPA

SEQ ID NO: 1309884 - protein, 26 aa, Mycobacterium
VVGGADVLAWLTARHALARAAFQLGV

SEQ ID NO: 1309885 - protein, 24 aa, Mycobacterium
VVGHPYIDIWEAVKPARLDIPAWP

SEQ ID NO: 1309886 - protein, 25 aa, Mycobacterium
VVGKPLYVNGLEQPALQPGALSDCV

SEQ ID NO: 1309887 - protein, 26 aa, Mycobacterium
VVHAETFAPILYVLTYDDLDEAIALN

SEQ ID NO: 1309888 - protein, 17 aa, Mycobacterium
VVHAYRVLSDGARWITT

SEQ ID NO: 1309889 - protein, 20 aa, Mycobacterium
VVIAGIINRANAAATAVADS

SEQ ID NO: 1309890 - protein, 17 aa, Mycobacterium
VVKLLPPLTTSTADLEA

SEQ ID NO: 1309891 - protein, 27 aa, Mycobacterium
VVLDNVFATPLLQQGFPLGVDVVVYSG

SEQ ID NO: 1309892 - protein, 17 aa, Mycobacterium
VVLEILAKAGQAGVTEI

SEQ ID NO: 1309893 - protein, 22 aa, Mycobacterium
VVLPELVQWLPTAALDEPIGNI

SEQ ID NO: 1309894 - protein, 23 aa, Mycobacterium
VVLVAPPTLLPVGVRQWPVTVSH

SEQ ID NO: 1309895 - protein, 18 aa, Mycobacterium
VVMALCAGALRGFLNKRA

SEQ ID NO: 1309896 - protein, 18 aa, Mycobacterium
VVMDWVWYHQEPVTVRDV

SEQ ID NO: 1309897 - protein, 17 aa, Mycobacterium
VVPIPFPVPSGITKGRK

SEQ ID NO: 1309898 - protein, 17 aa, Mycobacterium
VVPKRALLVLNTVAEYC

SEQ ID NO: 1309899 - protein, 24 aa, Mycobacterium
VVPLNFGPLSRPGGERRLNVAVTR

SEQ ID NO: 1309900 - protein, 17 aa, Mycobacterium
VVPLPDGVGFEVGASLG

SEQ ID NO: 1309901 - protein, 30 aa, Mycobacterium
VVQTLLLTSHLLFVGFSLTDKNFLAMAEAV

SEQ ID NO: 1309902 - protein, 25 aa, Mycobacterium
VVRDDHGFILAGPDLRDVSGWMLDR

SEQ ID NO: 1309903 - protein, 24 aa, Mycobacterium
VVRNRLPHAAAIAGSLAGGRWVSM

SEQ ID NO: 1309904 - protein, 27 aa, Mycobacterium
VVRRLESLYTLSPPPTAPAGLVTARRD

SEQ ID NO: 1309905 - protein, 17 aa, Mycobacterium
VVSLMSTSAVRELGLEP

SEQ ID NO: 1309906 - protein, 24 aa, Mycobacterium
VVTRYFTPRFDAVPFRAASAPGSA

SEQ ID NO: 1309907 - protein, 25 aa, Mycobacterium
VVVDVKGDWWGIRSSADGAGPGLPF

SEQ ID NO: 1309908 - protein, 25 aa, Mycobacterium
VVVSHDRWFLDAVCTRTWEVHGGAV

SEQ ID NO: 1309909 - protein, 30 aa, Mycobacterium
VVYNAGGPDLLVWVAPPPAAPAGSGAGATR

SEQ ID NO: 1309910 - protein, 26 aa, Mycobacterium
VVYPENAAGPVWWDPQMRTTSDYPPT

SEQ ID NO: 1309911 - protein, 20 aa, Mycobacterium
VWNTFGRHWDDLRPDRYAAE

SEQ ID NO: 1309912 - protein, 18 aa, Mycobacterium
VWQCASLLLSYPDHSRFD

SEQ ID NO: 1309913 - protein, 27 aa, Mycobacterium
VWVLDSRQQKWVLIPAPDAVATNTAGD

SEQ ID NO: 1309914 - protein, 17 aa, Mycobacterium
VWYGDTVVRLDPFALGA

SEQ ID NO: 1309915 - protein, 20 aa, Mycobacterium
VYAPLRTLIYEDPAGRTRPD

SEQ ID NO: 1309916 - protein, 19 aa, Mycobacterium
VYDVLMGVFLRTFGFTSES

SEQ ID NO: 1309917 - protein, 22 aa, Mycobacterium
VYTAGDAFYWAAGHAPEAITDC

SEQ ID NO: 1309918 - protein, 24 aa, Mycobacterium
WAAMRAAVHRLTPSGAPLGTTERV

SEQ ID NO: 1309919 - protein, 22 aa, Mycobacterium
WAQMHRVAAPTLLTWGRDDRVS

SEQ ID NO: 1309920 - protein, 28 aa, Mycobacterium
WASLPEWPQMLLRALMFRLAVHALHPRS

SEQ ID NO: 1309921 - protein, 18 aa, Mycobacterium
WCGRWIVAGPDVDAAALA

SEQ ID NO: 1309922 - protein, 19 aa, Mycobacterium
WDDFFTTAYRVLPDSGVML

SEQ ID NO: 1309923 - protein, 20 aa, Mycobacterium
WDVHEYDLARMYNFQCWIYG

SEQ ID NO: 1309924 - protein, 31 aa, Mycobacterium
WDVPKHEGLTMFLMPLDAPGITMRRIKQVDG

SEQ ID NO: 1309925 - protein, 19 aa, Mycobacterium
WGFSRMPFGRDLAPSMLHR

SEQ ID NO: 1309926 - protein, 23 aa, Mycobacterium
WGGKLMWNQTPLLLDRAKDLPDR

SEQ ID NO: 1309927 - protein, 24 aa, Mycobacterium
WGGPGFFGPLQKPLPMSLTAHPTW

SEQ ID NO: 1309928 - protein, 25 aa, Mycobacterium
WGHPVQPGLALLRLAQGRVDDALAA

SEQ ID NO: 1309929 - protein, 40 aa, Mycobacterium
WGLDSFQLFPNFVVLFWGQGWYLTYHYWPTSHNTHIFEGT

SEQ ID NO: 1309930 - protein, 26 aa, Mycobacterium
WGSRRKPMALIRALLRTDVTDLTVVT

SEQ ID NO: 1309931 - protein, 17 aa, Mycobacterium
WHRLDPWPDSVAGLTRL

SEQ ID NO: 1309932 - protein, 19 aa, Mycobacterium
WHTPPRARKPQRRIRLSGV

SEQ ID NO: 1309933 - protein, 27 aa, Mycobacterium
WIGAFGSHLIDFTRWLFGSEIVDCGGV

SEQ ID NO: 1309934 - protein, 19 aa, Mycobacterium
WIGYWVASERIGGGVATAA

SEQ ID NO: 1309935 - protein, 17 aa, Mycobacterium
WISAVMTLLPGDLILTG

SEQ ID NO: 1309936 - protein, 18 aa, Mycobacterium
WKALKLRQEILSASGQID

SEQ ID NO: 1309937 - protein, 27 aa, Mycobacterium
WKVVDTNLGGTFFLVQAVLPHMRAAGA

SEQ ID NO: 1309938 - protein, 26 aa, Mycobacterium
WLDDRAALLVRLLADRHGLTLSHDVA

SEQ ID NO: 1309939 - protein, 17 aa, Mycobacterium
WLDSWRALGPDGAAMDR

SEQ ID NO: 1309940 - protein, 17 aa, Mycobacterium
WLRLLPASGAPSPNTWE

SEQ ID NO: 1309941 - protein, 21 aa, Mycobacterium
WLYTQPDLKDEIRRLRSMRQR

SEQ ID NO: 1309942 - protein, 37 aa, Mycobacterium
WPGAYGTWWQADPTNDLILIYLIQNLPNFGADAAAAV

SEQ ID NO: 1309943 - protein, 18 aa, Mycobacterium
WPGDLPDDPRYDPELLRD

SEQ ID NO: 1309944 - protein, 25 aa, Mycobacterium
WPIDRRLDAFLLHHGHRWLHDDGSA

SEQ ID NO: 1309945 - protein, 17 aa, Mycobacterium
WQVCQPVLDAPPPALTY

SEQ ID NO: 1309946 - protein, 17 aa, Mycobacterium
WRAVQTRVWRGRPDPNR

SEQ ID NO: 1309947 - protein, 20 aa, Mycobacterium
WRGPIQQRFLRSRANTIEGG

SEQ ID NO: 1309948 - protein, 18 aa, Mycobacterium
WRVRGGFEQLPTSVQDAL

SEQ ID NO: 1309949 - protein, 24 aa, Mycobacterium
WSAPYANHVMPLSGDLPTGGELPK

SEQ ID NO: 1309950 - protein, 31 aa, Mycobacterium
WSAREQRWFERLFLFVAFVNRFLPPFVRQGG

SEQ ID NO: 1309951 - protein, 24 aa, Mycobacterium
WSPEDPLTPIALGTLARQAGFTQF

SEQ ID NO: 1309952 - protein, 20 aa, Mycobacterium
WSPSFEGELPPYWMNDYVQD

SEQ ID NO: 1309953 - protein, 20 aa, Mycobacterium
WSPTRYTRWLGDSLIRQLSG

SEQ ID NO: 1309954 - protein, 20 aa, Mycobacterium
WSSLPLKGWLATAYQRYATL

SEQ ID NO: 1309955 - protein, 19 aa, Mycobacterium
WTAELAELPSLLAEKVKAP

SEQ ID NO: 1309956 - protein, 21 aa, Mycobacterium
WTPLTVEQLIQLSSAFEGHPD

SEQ ID NO: 1309957 - protein, 25 aa, Mycobacterium
WTVPRTSIRPSWFNTVPGVQFVWGD

SEQ ID NO: 1309958 - protein, 18 aa, Mycobacterium
WVAELDDELIGCGALHVL

SEQ ID NO: 1309959 - protein, 17 aa, Mycobacterium
WVAVHELDDLPWVPADR

SEQ ID NO: 1309960 - protein, 26 aa, Mycobacterium
WVDSLRAALPERAAILAGISSTATVL

SEQ ID NO: 1309961 - protein, 32 aa, Mycobacterium
WVHGRVQGVGFRWWTRSRALELGLTGFAANKP

SEQ ID NO: 1309962 - protein, 25 aa, Mycobacterium
WVIHGALFRFPKLKVGIVEAGSKWM

SEQ ID NO: 1309963 - protein, 25 aa, Mycobacterium
WVIHGALFRFPTLKVGIVEAGSKWM

SEQ ID NO: 1309964 - protein, 19 aa, Mycobacterium
WVLFPNYFMTVRAGECHVI

SEQ ID NO: 1309965 - protein, 17 aa, Mycobacterium
WVRAHLTTKLDGPGLSL

SEQ ID NO: 1309966 - protein, 20 aa, Mycobacterium
WVRPQPLDLRYVDPPARLAL

SEQ ID NO: 1309967 - protein, 17 aa, Mycobacterium
WVVDLLDVSALEGLALD

SEQ ID NO: 1309968 - protein, 18 aa, Mycobacterium
WWRRWAARHAPRTLQQCC

SEQ ID NO: 1309969 - protein, 19 aa, Mycobacterium
WYHAELIDTARLTRLAAGV

SEQ ID NO: 1309970 - protein, 19 aa, Mycobacterium
WYMAYVYDPQRDGSDLVIL

SEQ ID NO: 1309971 - protein, 17 aa, Mycobacterium
YAAGLAVGFWDGADDLR

SEQ ID NO: 1309972 - protein, 28 aa, Mycobacterium
YAAGLPTAAILLGLLRDGEPVAGLTWLP

SEQ ID NO: 1309973 - protein, 19 aa, Mycobacterium
YAALIQYQMSMQSAGLGGA

SEQ ID NO: 1309974 - protein, 33 aa, Mycobacterium
YAEELRRRWGGLLSYRYIGRLYASMDPRAVDDT

SEQ ID NO: 1309975 - protein, 27 aa, Mycobacterium
YAGNQPWESIYGLPLRLASDARRFDVS

SEQ ID NO: 1309976 - protein, 19 aa, Mycobacterium
YAKPFSLLVVADLLGVPEE

SEQ ID NO: 1309977 - protein, 19 aa, Mycobacterium
YAPGTLRNKLLGRGDRLPD

SEQ ID NO: 1309978 - protein, 28 aa, Mycobacterium
YAQSAVKPWLVTVAKLLGRIAPGVPVEQ

SEQ ID NO: 1309979 - protein, 21 aa, Mycobacterium
YARRREVLLPALKAAGYTVDH

SEQ ID NO: 1309980 - protein, 30 aa, Mycobacterium
YATETCRSFALWAVGLMYSATGDRLIVALT

SEQ ID NO: 1309981 - protein, 24 aa, Mycobacterium
YDAGLSWVHFPEGLGGLGVSRGLQ

SEQ ID NO: 1309982 - protein, 19 aa, Mycobacterium
YDATILRGILPPGDALNVL

SEQ ID NO: 1309983 - protein, 18 aa, Mycobacterium
YDDREPGLARYLHDVVVA

SEQ ID NO: 1309984 - protein, 30 aa, Mycobacterium
YDHGLLSARVWALNPLTIPVTAHQLGATQV

SEQ ID NO: 1309985 - protein, 22 aa, Mycobacterium
YDLARMYNFQCWIYGADPAGNA

SEQ ID NO: 1309986 - protein, 21 aa, Mycobacterium
YDVHDVFLLQTAGEKRWVVHE

SEQ ID NO: 1309987 - protein, 42 aa, Mycobacterium
YDVKLPRELVLIGKQFLYVERYMKLLAPKWQMMSDPQLTGYF

SEQ ID NO: 1309988 - protein, 28 aa, Mycobacterium
YEDRSFTFALKTPPAAKLLLKAAGVQKG

SEQ ID NO: 1309989 - protein, 26 aa, Mycobacterium
YEIRGPGGVVWRVDFAWPDRRVVAEY

SEQ ID NO: 1309990 - protein, 25 aa, Mycobacterium
YEMPPPGQGLAVLQALRLYQRFAPY

SEQ ID NO: 1309991 - protein, 19 aa, Mycobacterium
YERWQPLHWVIEVPDVMER

SEQ ID NO: 1309992 - protein, 23 aa, Mycobacterium
YETPEVLAWRDRTLPCRKWFDDH

SEQ ID NO: 1309993 - protein, 19 aa, Mycobacterium
YFENFDTVNKLAVGLGGKP

SEQ ID NO: 1309994 - protein, 19 aa, Mycobacterium
YFGPNTITAYFPTATAIYP

SEQ ID NO: 1309995 - protein, 25 aa, Mycobacterium
YFTPYSIVRLIVEILEPFHGRVFDP

SEQ ID NO: 1309996 - protein, 41 aa, Mycobacterium
YGAAARQLFLRGVPYRKFIRRYPALTLLVLVGHAALEYDQG

SEQ ID NO: 1309997 - protein, 24 aa, Mycobacterium
YGEEQFMAWRRSYDTPPPPIEAGS

SEQ ID NO: 1309998 - protein, 27 aa, Mycobacterium
YGLEPQQLLQILQQNNQLPAMFADVRR

SEQ ID NO: 1309999 - protein, 22 aa, Mycobacterium
YGLIVYQEQIMFIAQKVASYTM

SEQ ID NO: 1310000 - protein, 17 aa, Mycobacterium
YGLPELPGAREKLTGAK

SEQ ID NO: 1310001 - protein, 25 aa, Mycobacterium
YGMTKGAVASFTRGLARDLGASGIT

SEQ ID NO: 1310002 - protein, 17 aa, Mycobacterium
YGRLDILIHNAGNVRRA

SEQ ID NO: 1310003 - protein, 19 aa, Mycobacterium
YGVPTLFFPDGQCLFGPVL

SEQ ID NO: 1310004 - protein, 18 aa, Mycobacterium
YHGRRHATWGLNLDEAIA

SEQ ID NO: 1310005 - protein, 35 aa, Mycobacterium
YHRDRFCGHLLLHPLSAPMTLRWLRDRFTDRPVYE

SEQ ID NO: 1310006 - protein, 20 aa, Mycobacterium
YHRIDYVLEAVERGPVGLIH

SEQ ID NO: 1310007 - protein, 18 aa, Mycobacterium
YIRRTIAFQRALDVGARL

SEQ ID NO: 1310008 - protein, 28 aa, Mycobacterium
YITTPGSALLFPGLCAPTTPAAAAPTTG

SEQ ID NO: 1310009 - protein, 25 aa, Mycobacterium
YKDLQYWTELAKLLERGRFDGLFIA

SEQ ID NO: 1310010 - protein, 23 aa, Mycobacterium
YKGACIFLNRPGFAGGIGCALHT

SEQ ID NO: 1310011 - protein, 20 aa, Mycobacterium
YKKTTKLPAPPARSAAEKAQ

SEQ ID NO: 1310012 - protein, 18 aa, Mycobacterium
YLASMGCALPYGVAAKLD

SEQ ID NO: 1310013 - protein, 18 aa, Mycobacterium
YLDGWPGTLIVVTHDRYF

SEQ ID NO: 1310014 - protein, 18 aa, Mycobacterium
YLDLLTSTLFDAPAYRTY

SEQ ID NO: 1310015 - protein, 26 aa, Mycobacterium
YLFTNDYEWDLLLQKSGWSEAEVMRQ

SEQ ID NO: 1310016 - protein, 30 aa, Mycobacterium
YLGLWEGVPALLDRLYYLDTEPAVRRARLL

SEQ ID NO: 1310017 - protein, 19 aa, Mycobacterium
YLHRPIPRDELIAFFVAAD

SEQ ID NO: 1310018 - protein, 19 aa, Mycobacterium
YLHTLIATVPTAANAGYYA

SEQ ID NO: 1310019 - protein, 17 aa, Mycobacterium
YLIVRAGEFSRISDVLL

SEQ ID NO: 1310020 - protein, 19 aa, Mycobacterium
YLKFWDLVARRRDDGRSVL

SEQ ID NO: 1310021 - protein, 18 aa, Mycobacterium
YLQVWRSAGSYDPKAGSP

SEQ ID NO: 1310022 - protein, 19 aa, Mycobacterium
YLRALRADALMDDRPALAD

SEQ ID NO: 1310023 - protein, 25 aa, Mycobacterium
YLREMQRLGLVKRAVIVCPANLASK

SEQ ID NO: 1310024 - protein, 26 aa, Mycobacterium
YLTSLGWTMAGLPRTDLFAKHGVPMV

SEQ ID NO: 1310025 - protein, 18 aa, Mycobacterium
YMYGTLLARGPRGQVGCG

SEQ ID NO: 1310026 - protein, 17 aa, Mycobacterium
YNGSIMPGVAKLTDGSE

SEQ ID NO: 1310027 - protein, 17 aa, Mycobacterium
YNLRDPLNRGLKYGVKQ

SEQ ID NO: 1310028 - protein, 22 aa, Mycobacterium
YNRAYDVLAANPLAQALFGDFG

SEQ ID NO: 1310029 - protein, 17 aa, Mycobacterium
YNRPKLPGIPGIKDFTG

SEQ ID NO: 1310030 - protein, 20 aa, Mycobacterium
YPPGYKYIDGAPDGWPFEDG

SEQ ID NO: 1310031 - protein, 19 aa, Mycobacterium
YPQLQSKYLFLGLKNQHRG

SEQ ID NO: 1310032 - protein, 24 aa, Mycobacterium
YPSLHDPHWDPFWQACSETNTVVN

SEQ ID NO: 1310033 - protein, 19 aa, Mycobacterium
YPSPDPFEPFAVAAVELAD

SEQ ID NO: 1310034 - protein, 17 aa, Mycobacterium
YPSQIIAGLLGLPREDY

SEQ ID NO: 1310035 - protein, 18 aa, Mycobacterium
YPWPDHLPERVLTDGAGR

SEQ ID NO: 1310036 - protein, 30 aa, Mycobacterium
YQAETQMNLLFEPIPPMTPIVIPGVGESTG

SEQ ID NO: 1310037 - protein, 21 aa, Mycobacterium
YQGMPMPLLFVCEDNGIGIST

SEQ ID NO: 1310038 - protein, 17 aa, Mycobacterium
YQINYLRCIGCGLCIEA

SEQ ID NO: 1310039 - protein, 19 aa, Mycobacterium
YQKLIVLDVPDEKLEELRA

SEQ ID NO: 1310040 - protein, 24 aa, Mycobacterium
YQNAMRWYHWDPFTHIPKEQATVG

SEQ ID NO: 1310041 - protein, 26 aa, Mycobacterium
YQRCTYVPMVELLRYLEDNDFTCYIV

SEQ ID NO: 1310042 - protein, 18 aa, Mycobacterium
YRAMLWDRHHQVPDHVPA

SEQ ID NO: 1310043 - protein, 23 aa, Mycobacterium
YRHPPTFLLATVDKFARLAREGE

SEQ ID NO: 1310044 - protein, 25 aa, Mycobacterium
YRIDRIDYYAAWLQRFETALRALPE

SEQ ID NO: 1310045 - protein, 27 aa, Mycobacterium
YRRLAAHFFLTFPQLHDVRFDYRWAGA

SEQ ID NO: 1310046 - protein, 22 aa, Mycobacterium
YRTTAEILGWSLGLMRGEPIDD

SEQ ID NO: 1310047 - protein, 29 aa, Mycobacterium
YSDASDLFYVWIKRALAGSWPEIGFTAHE

SEQ ID NO: 1310048 - protein, 25 aa, Mycobacterium
YSDLERYYTGTQPLAFLSPEAKEAL

SEQ ID NO: 1310049 - protein, 21 aa, Mycobacterium
YSDQWRTWPGYSPAERIAAEF

SEQ ID NO: 1310050 - protein, 30 aa, Mycobacterium
YSKLDGRHLLASWIQLAALTAQLPGTDWAA

SEQ ID NO: 1310051 - protein, 19 aa, Mycobacterium
YSPFKLLDPVANLAEMFIH

SEQ ID NO: 1310052 - protein, 20 aa, Mycobacterium
YSPLRHWNAGPGSRVAVIGL

SEQ ID NO: 1310053 - protein, 26 aa, Mycobacterium
YSSLMPLRYEGVWWVRAHLTTKLDGP

SEQ ID NO: 1310054 - protein, 19 aa, Mycobacterium
YSVDAVQAFALLRKLSQDS

SEQ ID NO: 1310055 - protein, 25 aa, Mycobacterium
YTLDGALRSLPPRTYALAGAADEQA

SEQ ID NO: 1310056 - protein, 20 aa, Mycobacterium
YTSRDILTAERRILAAAHQL

SEQ ID NO: 1310057 - protein, 17 aa, Mycobacterium
YTTDQITPAPAALVLVF

SEQ ID NO: 1310058 - protein, 28 aa, Mycobacterium
YTTRPGSALLFPTLCTPTAEAPIQPTKN

SEQ ID NO: 1310059 - protein, 19 aa, Mycobacterium
YVAHAFPFPNREGEPRAIV

SEQ ID NO: 1310060 - protein, 18 aa, Mycobacterium
YVTALLPVAQGVAVYAAL

SEQ ID NO: 1310061 - protein, 20 aa, Mycobacterium
YVVTGGMGGLGLFLAEKMAA

SEQ ID NO: 1310062 - protein, 17 aa, Mycobacterium
YWAPLPPDAQRSRAQRE

SEQ ID NO: 1310063 - protein, 21 aa, Mycobacterium
YWARQGEWHQALYSAGFFGTS

SEQ ID NO: 1310064 - protein, 24 aa, Mycobacterium
YWRLQGPNLWPAQPPGFRAAFEEW

SEQ ID NO: 1310065 - protein, 20 aa, Mycobacterium
YWVANLRGRVRFAEAVTAAA

SEQ ID NO: 1310066 - protein, 17 aa, Mycobacterium
YYEGRLASFPAPLRANA

SEQ ID NO: 1310067 - protein, 26 aa, Mycobacterium
AAAADARLILLDPGTRRGPSSSAVQL

SEQ ID NO: 1310068 - protein, 29 aa, Mycobacterium
AAAAFARWHDLLAQRLIADGLAQPAATAL

SEQ ID NO: 1310069 - protein, 19 aa, Mycobacterium
AAAAFIAWATAAPQNLKVS

SEQ ID NO: 1310070 - protein, 21 aa, Mycobacterium
AAAAGIRRLGFESHVVTVDAF

SEQ ID NO: 1310071 - protein, 25 aa, Mycobacterium
AAAALWILHPTYFGTTADIAALTAV

SEQ ID NO: 1310072 - protein, 26 aa, Mycobacterium
AAAANLKRFVFLSTIGTIAVGENGET

SEQ ID NO: 1310073 - protein, 25 aa, Mycobacterium
AAACDDVLGFTLWIAGTPAVTRTLT

SEQ ID NO: 1310074 - protein, 28 aa, Mycobacterium
AAADEALAWWRGPLLADLSDEPWVADEA

SEQ ID NO: 1310075 - protein, 24 aa, Mycobacterium
AAADGMEFPLFVKAVSGGGGRGMR

SEQ ID NO: 1310076 - protein, 19 aa, Mycobacterium
AAADLPDGTLLVVVHSGGG

SEQ ID NO: 1310077 - protein, 28 aa, Mycobacterium
AAAERHQLPWPKPPVLCTVTLARRVLTR

SEQ ID NO: 1310078 - protein, 18 aa, Mycobacterium
AAAFHRLSTPYDAALALV

SEQ ID NO: 1310079 - protein, 20 aa, Mycobacterium
AAAFPAWRDASLAKRTSVLF

SEQ ID NO: 1310080 - protein, 21 aa, Mycobacterium
AAAGIPLPVRAEAKVCSNCGA

SEQ ID NO: 1310081 - protein, 22 aa, Mycobacterium
AAAGLLFADPFGKLSLLAATSE

SEQ ID NO: 1310082 - protein, 24 aa, Mycobacterium
AAAGRRILGLLEALDLSGVTLVAN

SEQ ID NO: 1310083 - protein, 35 aa, Mycobacterium
AAAGSPNYLGTTGFPYTNVVVDNAITGNAGGRGKD

SEQ ID NO: 1310084 - protein, 17 aa, Mycobacterium
AAAHLVHPGDLVILIAY

SEQ ID NO: 1310085 - protein, 24 aa, Mycobacterium
AAAHRMGLPLGEVTRALIAVADAH

SEQ ID NO: 1310086 - protein, 17 aa, Mycobacterium
AAAIFPNLGFVGPNIFA

SEQ ID NO: 1310087 - protein, 22 aa, Mycobacterium
AAAIGRISYRLGLQGPAVAVDT

SEQ ID NO: 1310088 - protein, 24 aa, Mycobacterium
AAAKELVWKLQHASYMAGNYLTGW

SEQ ID NO: 1310089 - protein, 25 aa, Mycobacterium
AAAKSGLISLVKTLGRELAREHIIV

SEQ ID NO: 1310090 - protein, 20 aa, Mycobacterium
AAALKLLYLAIRNINQKRGS

SEQ ID NO: 1310091 - protein, 18 aa, Mycobacterium
AAALLPDVQVLIAGGPSG

SEQ ID NO: 1310092 - protein, 23 aa, Mycobacterium
AAALMALRSYGDPSSVVAFLSDP

SEQ ID NO: 1310093 - protein, 22 aa, Mycobacterium
AAALRNCQYLWIGVFQATSVPV

SEQ ID NO: 1310094 - protein, 24 aa, Mycobacterium
AAALRWVAIAINAFNRIAISSRYT

SEQ ID NO: 1310095 - protein, 33 aa, Mycobacterium
AAALSHRVWLRPFRNLVYVMPPYICTPEEIAQI

SEQ ID NO: 1310096 - protein, 23 aa, Mycobacterium
AAALYAAPMDLDQMRRFAGELVD

SEQ ID NO: 1310097 - protein, 27 aa, Mycobacterium
AAANDPLLHALQIAAVPYRAVTTTEPA

SEQ ID NO: 1310098 - protein, 20 aa, Mycobacterium
AAAPDLILGSQALTPELFDA

SEQ ID NO: 1310099 - protein, 35 aa, Mycobacterium
AAAPRSWLYGKPAYHALTFGWLLSGLARSITGKGM

SEQ ID NO: 1310100 - protein, 26 aa, Mycobacterium
AAAPYASATFPWYLVGRQVHVHGAVT

SEQ ID NO: 1310101 - protein, 24 aa, Mycobacterium
AAARALHALGPQWALVKGGHLRSS

SEQ ID NO: 1310102 - protein, 19 aa, Mycobacterium
AAARALLAELLAAGQRAGT

SEQ ID NO: 1310103 - protein, 30 aa, Mycobacterium
AAARDAARFLLLTPPLPLSARAPYGVLAAI

SEQ ID NO: 1310104 - protein, 18 aa, Mycobacterium
AAARDFDRLIIDLLLHGV

SEQ ID NO: 1310105 - protein, 19 aa, Mycobacterium
AAARIGLGPMRRIRPDIVV

SEQ ID NO: 1310106 - protein, 17 aa, Mycobacterium
AAARPNGDRDRAGADSA

SEQ ID NO: 1310107 - protein, 24 aa, Mycobacterium
AAARRHKLHLRPHTPRYLGDVLGP

SEQ ID NO: 1310108 - protein, 21 aa, Mycobacterium
AAARRLFAMADLLEAKLADKD

SEQ ID NO: 1310109 - protein, 25 aa, Mycobacterium
AAARRLGVPEAKWVYLRGHADQTEQ

SEQ ID NO: 1310110 - protein, 25 aa, Mycobacterium
AAARTWLDDQPGYLPPVGLGEVIRA

SEQ ID NO: 1310111 - protein, 24 aa, Mycobacterium
AAAVDVTLLGRYYERFSDHAVEVA

SEQ ID NO: 1310112 - protein, 18 aa, Mycobacterium
AAAVNFPDVLLVADSYQV

SEQ ID NO: 1310113 - protein, 35 aa, Mycobacterium
AAAVRVLTGPRWRLGARDVAALWRRAVALVEPGAS

SEQ ID NO: 1310114 - protein, 25 aa, Mycobacterium
AAAVSIRLTYWLVTRAETLRRPEVA

SEQ ID NO: 1310115 - protein, 19 aa, Mycobacterium
AAAVVYRAWELGAVVYYVG

SEQ ID NO: 1310116 - protein, 18 aa, Mycobacterium
AAAVWASGIARRPIRGHD

SEQ ID NO: 1310117 - protein, 17 aa, Mycobacterium
AAAWAIIDCDLPAPAEG

SEQ ID NO: 1310118 - protein, 18 aa, Mycobacterium
AAAWAIIDCDLPAPAEGA

SEQ ID NO: 1310119 - protein, 27 aa, Mycobacterium
AAAWDRVYWIMADTLIALEHDLYRDAG

SEQ ID NO: 1310120 - protein, 17 aa, Mycobacterium
AAAWTSIRLALAGGDRL

SEQ ID NO: 1310121 - protein, 25 aa, Mycobacterium
AACGRKMIVQVRPDGWWAKCSRHGS

SEQ ID NO: 1310122 - protein, 18 aa, Mycobacterium
AACGWTVIAVFPTAQDQG

SEQ ID NO: 1310123 - protein, 18 aa, Mycobacterium
AACLGATWIGGGVAGTVE

SEQ ID NO: 1310124 - protein, 30 aa, Mycobacterium
AACLRKTDWLFPQYRELGAFLVRAIAPAQL

SEQ ID NO: 1310125 - protein, 18 aa, Mycobacterium
AACRFVRNTGRPASIGAL

SEQ ID NO: 1310126 - protein, 18 aa, Mycobacterium
AACRRRYGSAFTLRVASM

SEQ ID NO: 1310127 - protein, 27 aa, Mycobacterium
AADAADWFAGRLPEGWFAGDPEVIVDR

SEQ ID NO: 1310128 - protein, 18 aa, Mycobacterium
AADCEAAMVLVPSGRSSP

SEQ ID NO: 1310129 - protein, 20 aa, Mycobacterium
AADCILAFDLLTAVDAKNVG

SEQ ID NO: 1310130 - protein, 23 aa, Mycobacterium
AADDWMCLLEAFDQPHRSGLVRA

SEQ ID NO: 1310131 - protein, 25 aa, Mycobacterium
AADGDALTRWNAFTATPAVAMDITR

SEQ ID NO: 1310132 - protein, 26 aa, Mycobacterium
AADGRRFWLVGLQGERHWPALCAAVE

SEQ ID NO: 1310133 - protein, 26 aa, Mycobacterium
AADGYLRLRTWLTRLYQAEFNGFIAS

SEQ ID NO: 1310134 - protein, 28 aa, Mycobacterium
AADIECIYRGYRFAVVWPSTNPDAGGAT

SEQ ID NO: 1310135 - protein, 20 aa, Mycobacterium
AADIGGVWRDNTYPGAACDV

SEQ ID NO: 1310136 - protein, 36 aa, Mycobacterium; identical to SEQ ID NO: 786849

SEQ ID NO: 1310137 - protein, 24 aa, Mycobacterium
AADLDDYLTRPLWYQQLGGEQSGA

SEQ ID NO: 1310138 - protein, 25 aa, Mycobacterium
AADLHDWYGRYLYFAPDEVEPLVER

SEQ ID NO: 1310139 - protein, 30 aa, Mycobacterium
AADLIWSPMLRRFPDLKFALSEGGIGWVPY

SEQ ID NO: 1310140 - protein, 18 aa, Mycobacterium
AADLMAGPWREKIAAATM

SEQ ID NO: 1310141 - protein, 18 aa, Mycobacterium
AADLQILKRGARLVEFAK

SEQ ID NO: 1310142 - protein, 28 aa, Mycobacterium
AADPLDPQWLLDTLGLTDAARTTYRRLS

SEQ ID NO: 1310143 - protein, 25 aa, Mycobacterium
AADPLLACVLTGFGVTSLSAAAAAV

SEQ ID NO: 1310144 - protein, 17 aa, Mycobacterium
AADQWPLNLGSERDWGF

SEQ ID NO: 1310145 - protein, 31 aa, Mycobacterium
AADVRIAGPAALFDPRFQKLGIHPGGGATWM

SEQ ID NO: 1310146 - protein, 23 aa, Mycobacterium
AAEAAGLFRDYRGQRYWFCCKGC

SEQ ID NO: 1310147 - protein, 21 aa, Mycobacterium
AAEAFLNGRIRFPAIVRTVAR

SEQ ID NO: 1310148 - protein, 27 aa, Mycobacterium
AAEALGFSSFWFPQVPGYLDAMTALAL

SEQ ID NO: 1310149 - protein, 26 aa, Mycobacterium
AAEALGGGWFWPAAAAHPSLPRGALL

SEQ ID NO: 1310150 - protein, 26 aa, Mycobacterium
AAEAQGFASFWFPQVPGYLDAMTAVA

SEQ ID NO: 1310151 - protein, 20 aa, Mycobacterium
AAEDGVGLHLPTLWQPAAPW

SEQ ID NO: 1310152 - protein, 26 aa, Mycobacterium
AAEFDIYVLDFPGYGLSGKPPSPYVY

SEQ ID NO: 1310153 - protein, 26 aa, Mycobacterium
AAEICDGWLPIFYSPRIAAMYNEWLD

SEQ ID NO: 1310154 - protein, 25 aa, Mycobacterium
AAEISRLSLFLTTPAARHITGQTLH

SEQ ID NO: 1310155 - protein, 30 aa, Mycobacterium
AAELIKMGVYPFVVPFRPHPGTLAVDVDGA

SEQ ID NO: 1310156 - protein, 24 aa, Mycobacterium
AAELRTPIWVVTRRAQHVTATDTV

SEQ ID NO: 1310157 - protein, 25 aa, Mycobacterium
AAELVRRGSAFSGLLYAGLAITSNG

SEQ ID NO: 1310158 - protein, 28 aa, Mycobacterium
AAENAPMIRYPIPPMIHGATQSATWMAL

SEQ ID NO: 1310159 - protein, 26 aa, Mycobacterium
AAEQFAVYGTLPSYRAMLDREGYAGP

SEQ ID NO: 1310160 - protein, 24 aa, Mycobacterium
AAEQITVLHLAPVMLKALLDDISD

SEQ ID NO: 1310161 - protein, 25 aa, Mycobacterium
AAERSPLLTAIRRAGLGSVSDLQVD

SEQ ID NO: 1310162 - protein, 18 aa, Mycobacterium
AAETLLWVVEYRTGPEGQ

SEQ ID NO: 1310163 - protein, 22 aa, Mycobacterium
AAETPWLPLERAEALDATADWV

SEQ ID NO: 1310164 - protein, 32 aa, Mycobacterium
AAETVKTWPVRLMKFVLSVGWLATAHREYSEI

SEQ ID NO: 1310165 - protein, 24 aa, Mycobacterium
AAEVFQSWLTGLAAWFGRLALTEP

SEQ ID NO: 1310166 - protein, 18 aa, Mycobacterium
AAEVLDWNVLRALCDAEA

SEQ ID NO: 1310167 - protein, 29 aa, Mycobacterium
AAEVRRLLKLRGATLLAHNYQLPAIQDVA

SEQ ID NO: 1310168 - protein, 29 aa, Mycobacterium
AAEVTPNRWFINGADFIALRKLKEAPTGS

SEQ ID NO: 1310169 - protein, 20 aa, Mycobacterium
AAEVYYRHLVPPGSPRSDTG

SEQ ID NO: 1310170 - protein, 20 aa, Mycobacterium
AAEWEFFPGVFSKDGPIDAL

SEQ ID NO: 1310171 - protein, 29 aa, Mycobacterium
AAEWHRYWIETRLQWYVDLGINRDNLRLY

SEQ ID NO: 1310172 - protein, 20 aa, Mycobacterium
AAEYLSGRWSQAYGFPVMPV

SEQ ID NO: 1310173 - protein, 24 aa, Mycobacterium
AAFAADMVFLRNCGIHPVVVHGGG

SEQ ID NO: 1310174 - protein, 21 aa, Mycobacterium
AAFGHALGVPVRGVCSLDAIA

SEQ ID NO: 1310175 - protein, 20 aa, Mycobacterium
AAFGRFLPAWQMLGGDAVSG

SEQ ID NO: 1310176 - protein, 23 aa, Mycobacterium
AAFGVAHRTAYHALRSTARLSAG

SEQ ID NO: 1310177 - protein, 25 aa, Mycobacterium
AAFIERLDPSIYWMGIHHSRLVKPE

SEQ ID NO: 1310178 - protein, 20 aa, Mycobacterium
AAFLERAAALTSDPALRGAR

SEQ ID NO: 1310179 - protein, 17 aa, Mycobacterium
AAFLPHSPLRVYVMGRR

SEQ ID NO: 1310180 - protein, 26 aa, Mycobacterium
AAFQYVRDYLSFLPGNAFDDAPIVNP

SEQ ID NO: 1310181 - protein, 20 aa, Mycobacterium
AAFVPRVTAILADLRQLDAV

SEQ ID NO: 1310182 - protein, 29 aa, Mycobacterium
AAGADRFRYFRPAVFFLTDGQPTDRHWRE

SEQ ID NO: 1310183 - protein, 24 aa, Mycobacterium
AAGAFLIGYAIAHLRYFAGLARTY

SEQ ID NO: 1310184 - protein, 22 aa, Mycobacterium
AAGAGWGLAMACDIRVAAASAR

SEQ ID NO: 1310185 - protein, 29 aa, Mycobacterium
AAGAIVVLSLWEPGADKPVLVGLRYRPGQ

SEQ ID NO: 1310186 - protein, 18 aa, Mycobacterium
AAGARRIVVGLGGSSCTD

SEQ ID NO: 1310187 - protein, 17 aa, Mycobacterium
AAGDLFLVPGAVDLHLD

SEQ ID NO: 1310188 - protein, 25 aa, Mycobacterium
AAGDRAFFCDYALDYLARAGISKDQ

SEQ ID NO: 1310189 - protein, 19 aa, Mycobacterium
AAGEKGWIDLPAVVLESLE

SEQ ID NO: 1310190 - protein, 26 aa, Mycobacterium
AAGELPLWWDQFVANGFHAVHLPEEV

SEQ ID NO: 1310191 - protein, 18 aa, Mycobacterium
AAGEWMHWQLLKPAESRQ

SEQ ID NO: 1310192 - protein, 26 aa, Mycobacterium
AAGEWTIRFFMPSKWTMDTLPTPNDD

SEQ ID NO: 1310193 - protein, 31 aa, Mycobacterium
AAGFGLLMETVLPWFNLGNAAVSLGLAGSAY

SEQ ID NO: 1310194 - protein, 19 aa, Mycobacterium
AAGFPRPILHGLCTYGMTC

SEQ ID NO: 1310195 - protein, 25 aa, Mycobacterium
AAGGLNWDSMPLKLFAGGNAKFWDP

SEQ ID NO: 1310196 - protein, 25 aa, Mycobacterium
AAGGTLHLLRPLFAAGLGGRLGSGR

SEQ ID NO: 1310197 - protein, 22 aa, Mycobacterium
AAGKGVVFLYSGQGAQWAGMGK

SEQ ID NO: 1310198 - protein, 28 aa, Mycobacterium
AAGKPVMGWLFQRFLHNLRRYTDERFAT

SEQ ID NO: 1310199 - protein, 24 aa, Mycobacterium
AAGKRLPVPLYPGFDTLGTLEYIA

SEQ ID NO: 1310200 - protein, 25 aa, Mycobacterium
AAGLKLPLVLVIDTAGPALSTEAEE

SEQ ID NO: 1310201 - protein, 23 aa, Mycobacterium
AAGLNFRDVLNALGLYPGDPGPI

SEQ ID NO: 1310202 - protein, 17 aa, Mycobacterium
AAGLPAEPLRRAATFTV

SEQ ID NO: 1310203 - protein, 26 aa, Mycobacterium
AAGLPALAVNWGQWADVGLASTLRFS

SEQ ID NO: 1310204 - protein, 19 aa, Mycobacterium
AAGLTYDVYRKGEGPGVVL

SEQ ID NO: 1310205 - protein, 29 aa, Mycobacterium
AAGNRTHTKWRLKLVLSGANPVTGTFGAI

SEQ ID NO: 1310206 - protein, 17 aa, Mycobacterium
AAGPFASVLDRARDALG

SEQ ID NO: 1310207 - protein, 24 aa, Mycobacterium
AAGPHPFPMMVRDFQRVIGLEARA

SEQ ID NO: 1310208 - protein, 28 aa, Mycobacterium
AAGQGALRMRFNLALYADPRHFDAQVTQ

SEQ ID NO: 1310209 - protein, 24 aa, Mycobacterium
AAGRPIFGICRGSQLLNVARGGTI

SEQ ID NO: 1310210 - protein, 24 aa, Mycobacterium
AAGRTFVLENWTWESHWLRLEENF

SEQ ID NO: 1310211 - protein, 24 aa, Mycobacterium
AAGRWVPEFLSLPIAIENSLKNQT

SEQ ID NO: 1310212 - protein, 25 aa, Mycobacterium
AAGSDRIRFTPYQKLIILDVADENV

SEQ ID NO: 1310213 - protein, 25 aa, Mycobacterium
AAGSPIDLVLLDLGLPDASGIALAS

SEQ ID NO: 1310214 - protein, 17 aa, Mycobacterium
AAGTPPVYFGFGSMPVK

SEQ ID NO: 1310215 - protein, 24 aa, Mycobacterium
AAGVAFPDALQSRGLYQYKPAMPY

SEQ ID NO: 1310216 - protein, 29 aa, Mycobacterium
AAGVSKALFYFYFPRKEDVLFEVGVLSTQ

SEQ ID NO: 1310217 - protein, 31 aa, Mycobacterium
AAGVVRPDLVIGWWAVPTILEHGSPEQVEQF

SEQ ID NO: 1310218 - protein, 24 aa, Mycobacterium
AAGWDLLGHGYRFTKHYLLSPQQE

SEQ ID NO: 1310219 - protein, 20 aa, Mycobacterium
AAGWGLHPTVIPNGVRADRF

SEQ ID NO: 1310220 - protein, 21 aa, Mycobacterium
AAGWRGLFARNDVDPGAVDDV

SEQ ID NO: 1310221 - protein, 29 aa, Mycobacterium
AAHAAWVSALLTKLFHHVAALTSRPIGHQ

SEQ ID NO: 1310222 - protein, 18 aa, Mycobacterium
AAHGYRFDIPAGTAIRFE

SEQ ID NO: 1310223 - protein, 17 aa, Mycobacterium
AAHLGVRGWIKTFTEAA

SEQ ID NO: 1310224 - protein, 18 aa, Mycobacterium
AAHLGVRGWIKTFTEAAV

SEQ ID NO: 1310225 - protein, 27 aa, Mycobacterium
AAHPKSPWIFRGYRPGMHLAPTHLRNH

SEQ ID NO: 1310226 - protein, 18 aa, Mycobacterium
AAHPPTPLVGPGCPTVLI

SEQ ID NO: 1310227 - protein, 22 aa, Mycobacterium
AAHPVFRRRRFFSGRPVRQRGA

SEQ ID NO: 1310228 - protein, 21 aa, Mycobacterium
AAHSLRHFCIAYRAVVRAKVD

SEQ ID NO: 1310229 - protein, 24 aa, Mycobacterium
AAHVGIRLSPMIKFGGLDDADGME

SEQ ID NO: 1310230 - protein, 22 aa, Mycobacterium
AAHWATEFPWCNQAAELLRHHF

SEQ ID NO: 1310231 - protein, 28 aa, Mycobacterium
AAHWIADRQIVPSLLKYGTEFQKTEFLP

SEQ ID NO: 1310232 - protein, 18 aa, Mycobacterium
AAIAHRRADRRPYTGSLP

SEQ ID NO: 1310233 - protein, 24 aa, Mycobacterium
AAIALYEKLGFTRVPVMAVKRKNA

SEQ ID NO: 1310234 - protein, 24 aa, Mycobacterium
AAIARLAGLDILRKSRDDEDSYTI

SEQ ID NO: 1310235 - protein, 18 aa, Mycobacterium
AAIIAYSAALLAPAGGQI

SEQ ID NO: 1310236 - protein, 17 aa, Mycobacterium
AAIILESIPGTAGIMVP

SEQ ID NO: 1310237 - protein, 26 aa, Mycobacterium
AAIIREMAPQIYLTISSELAPVLGEY

SEQ ID NO: 1310238 - protein, 24 aa, Mycobacterium
AAILQASRRLFLERGYSGTPINAI

SEQ ID NO: 1310239 - protein, 20 aa, Mycobacterium
AAIRAAWERGWSPTDLHEVA

SEQ ID NO: 1310240 - protein, 22 aa, Mycobacterium
AAIRLREYMFPDGALNTEVVGR

SEQ ID NO: 1310241 - protein, 25 aa, Mycobacterium
AAISSLVLPSSFRPIPDSRTPTGSR

SEQ ID NO: 1310242 - protein, 25 aa, Mycobacterium
AAITFPRGMTGPRDDPYAFSFSGLK

SEQ ID NO: 1310243 - protein, 27 aa, Mycobacterium
AAIWRSRPVNWIWDRLPMRVRYSGYAV

SEQ ID NO: 1310244 - protein, 17 aa, Mycobacterium
AAKAGVIGLTIAAARDL

SEQ ID NO: 1310245 - protein, 24 aa, Mycobacterium
AAKHGVVGLMRSLAHDLAPHGIRV

SEQ ID NO: 1310246 - protein, 23 aa, Mycobacterium
AAKHGVVGLMRSLANELARHRIR

SEQ ID NO: 1310247 - protein, 28 aa, Mycobacterium
AAKIGVTGLVRAYAQRLAAKNIRVMAIA

SEQ ID NO: 1310248 - protein, 28 aa, Mycobacterium
AAKITTPLLPDDYLQLANPLWSARELRG

SEQ ID NO: 1310249 - protein, 26 aa, Mycobacterium
AAKMVPEWLWNSAAAVKRAFLQALFE

SEQ ID NO: 1310250 - protein, 25 aa, Mycobacterium
AAKQVTILAHDRLGPLAGGMGGLGI

SEQ ID NO: 1310251 - protein, 25 aa, Mycobacterium
AAKQVTILAHDRLGPLAGGMGGLGL

SEQ ID NO: 1310252 - protein, 19 aa, Mycobacterium
AAKQYLTYVGGAPFQPAVA

SEQ ID NO: 1310253 - protein, 24 aa, Mycobacterium
AAKRPLFTDFAPRLLVSHPSEVKV

SEQ ID NO: 1310254 - protein, 18 aa, Mycobacterium
AAKRPRLIPIWDSFVEQA

SEQ ID NO: 1310255 - protein, 17 aa, Mycobacterium
AALAHLRAKGEQNFLVV

SEQ ID NO: 1310256 - protein, 20 aa, Mycobacterium
AALASLTRTWAAEFGANGVR

SEQ ID NO: 1310257 - protein, 23 aa, Mycobacterium
AALELAAAAPFDYYPRVVSRSLA

SEQ ID NO: 1310258 - protein, 19 aa, Mycobacterium
AALERLSVNLRWSWDKPTQ

SEQ ID NO: 1310259 - protein, 18 aa, Mycobacterium
AALERWGRIDFLVNNAGI

SEQ ID NO: 1310260 - protein, 26 aa, Mycobacterium
AALESKAWKQWLRLSNWLGISDHSRV

SEQ ID NO: 1310261 - protein, 30 aa, Mycobacterium
AALFLDRGQWLARLLMVDKIARLKSVPILL

SEQ ID NO: 1310262 - protein, 25 aa, Mycobacterium
AALGDPYRWPGPRQIYRASGLSPMQ

SEQ ID NO: 1310263 - protein, 23 aa, Mycobacterium
AALGHELTLYLLRNPEARESVAG

SEQ ID NO: 1310264 - protein, 19 aa, Mycobacterium
AALGKLPFYVKGVGAEVVG

SEQ ID NO: 1310265 - protein, 20 aa, Mycobacterium
AALGNPTWYARFAAQVMTDP

SEQ ID NO: 1310266 - protein, 18 aa, Mycobacterium
AALGVTWDGPAIWQSEHP

SEQ ID NO: 1310267 - protein, 26 aa, Mycobacterium
AALHQLCIPLFERIEQIPGPQRAALL

SEQ ID NO: 1310268 - protein, 17 aa, Mycobacterium
AALLAGMYAASNGAAAT

SEQ ID NO: 1310269 - protein, 17 aa, Mycobacterium
AALLLAGRDTGVRLPLG

SEQ ID NO: 1310270 - protein, 24 aa, Mycobacterium
AALPLRAFGAGRAYRRLVRDTDAG

SEQ ID NO: 1310271 - protein, 28 aa, Mycobacterium
AALPRLHALAPLRYQLVDIPLKFHHPMW

SEQ ID NO: 1310272 - protein, 20 aa, Mycobacterium
AALQLLDGLGIEKAAFVGNS

SEQ ID NO: 1310273 - protein, 18 aa, Mycobacterium
AALRAEYGDRLPVVLLDG

SEQ ID NO: 1310274 - protein, 20 aa, Mycobacterium
AALRDRLDPDRPAHVGVLLG

SEQ ID NO: 1310275 - protein, 20 aa, Mycobacterium
AALREYWTAALAGIPDLRFT

SEQ ID NO: 1310276 - protein, 23 aa, Mycobacterium
AALRRRVMLERAAWRLQRGEAVS

SEQ ID NO: 1310277 - protein, 23 aa, Mycobacterium
AALRYVDALIWSPSRIDAAVADG

SEQ ID NO: 1310278 - protein, 18 aa, Mycobacterium
AALSDHPDLILTSGGTGI

SEQ ID NO: 1310279 - protein, 28 aa, Mycobacterium
AALSSHYRRAYAMALPSYGLPDTHLDDA

SEQ ID NO: 1310280 - protein, 17 aa, Mycobacterium
AALTEFVSFWRAVGLYV

SEQ ID NO: 1310281 - protein, 18 aa, Mycobacterium
AALTRRGPHRVLRGDLAF

SEQ ID NO: 1310282 - protein, 33 aa, Mycobacterium
AALTVPIPGSLNRFVFAMPEQLGRVYLGLTDED

SEQ ID NO: 1310283 - protein, 20 aa, Mycobacterium
AALVATFRDVPPDAPTLCEG

SEQ ID NO: 1310284 - protein, 17 aa, Mycobacterium
AALVCHGAFTRNPDLRI

SEQ ID NO: 1310285 - protein, 18 aa, Mycobacterium
AALVPHFQQALRTEKHLA

SEQ ID NO: 1310286 - protein, 17 aa, Mycobacterium
AAMCLLITQSTIQSAQM

SEQ ID NO: 1310287 - protein, 25 aa, Mycobacterium
AAMDPQQRLLLEVAWEALEHAGITP

SEQ ID NO: 1310288 - protein, 19 aa, Mycobacterium
AAMGSPWKWCRTGTSRAKP

SEQ ID NO: 1310289 - protein, 22 aa, Mycobacterium
AAMLRRDLLLSSMSVRLMHIMS

SEQ ID NO: 1310290 - protein, 17 aa, Mycobacterium
AAMMRFAGLDESGMRRI

SEQ ID NO: 1310291 - protein, 19 aa, Mycobacterium
AAMSPRHFTRVFTEEVGEA

SEQ ID NO: 1310292 - protein, 23 aa, Mycobacterium
AAMSVVTPWLLSEPDRFAVLHGD

SEQ ID NO: 1310293 - protein, 22 aa, Mycobacterium
AAMVIDLLLKRAADLGVQIRYE

SEQ ID NO: 1310294 - protein, 23 aa, Mycobacterium
AANAIINFRLAADELDYVLNDSG

SEQ ID NO: 1310295 - protein, 26 aa, Mycobacterium
AANLDQLFITAAAYPPEILLTGVIVN

SEQ ID NO: 1310296 - protein, 23 aa, Mycobacterium
AANLVARAWLDPDFKQLALTEPM

SEQ ID NO: 1310297 - protein, 24 aa, Mycobacterium
AANPGLRALLDAAARRSVRVRALD

SEQ ID NO: 1310298 - protein, 22 aa, Mycobacterium
AANPLKAPPFTFPAHLHELING

SEQ ID NO: 1310299 - protein, 25 aa, Mycobacterium
AANPQTFFQMYWTGGRDKLVGRMER

SEQ ID NO: 1310300 - protein, 27 aa, Mycobacterium
AANRSEFYRALPSGPFYGFNRQGVEPS

SEQ ID NO: 1310301 - protein, 29 aa, Mycobacterium
AANRSVFYRSLPAGPFYGFNRPGVEPQEA

SEQ ID NO: 1310302 - protein, 24 aa, Mycobacterium
AANRWPAVRFAVRNPIVQGPNAVP

SEQ ID NO: 1310303 - protein, 18 aa, Mycobacterium
AANVLRIVERELLGATSE

SEQ ID NO: 1310304 - protein, 25 aa, Mycobacterium
AANWPGDLELLRDQGFRLLAMTPDP

SEQ ID NO: 1310305 - protein, 27 aa, Mycobacterium
AAPAVIDAMLLVRLPYHLSSVTQAAAR

SEQ ID NO: 1310306 - protein, 28 aa, Mycobacterium
AAPDDPAWSLQCDIARQVLALDGIPADE

SEQ ID NO: 1310307 - protein, 25 aa, Mycobacterium
AAPEGVVFYQLPGIALALFGRDDLA

SEQ ID NO: 1310308 - protein, 25 aa, Mycobacterium
AAPGAGYFVLVFAKGAFPAEMEGGP

SEQ ID NO: 1310309 - protein, 18 aa, Mycobacterium
AAPGFQLVISYNPGYQSI

SEQ ID NO: 1310310 - protein, 20 aa, Mycobacterium
AAPGPPPPPPTAITLPDGST

SEQ ID NO: 1310311 - protein, 24 aa, Mycobacterium
AAPHHLIADGALLTHRRTRAGDAH

SEQ ID NO: 1310312 - protein, 21 aa, Mycobacterium
AAPLGALLEAGARLLRRPEPP

SEQ ID NO: 1310313 - protein, 17 aa, Mycobacterium
AAPLHGGVWHSYADHRM

SEQ ID NO: 1310314 - protein, 19 aa, Mycobacterium
AAPPDRRQWWIARVRECFP

SEQ ID NO: 1310315 - protein, 20 aa, Mycobacterium
AAPQWPLPDLFEKFPQFPTD

SEQ ID NO: 1310316 - protein, 19 aa, Mycobacterium
AAPVHRVPILIGGNGTRVL

SEQ ID NO: 1310317 - protein, 24 aa, Mycobacterium
AAPVLWSQQVLTTGRLRAVILNSG

SEQ ID NO: 1310318 - protein, 30 aa, Mycobacterium
AAPVNFPDVLLIAGRYQVSVPTPFVPGSEF

SEQ ID NO: 1310319 - protein, 25 aa, Mycobacterium
AAQAAVMTLSLFLDRLRTGEGDLID

SEQ ID NO: 1310320 - protein, 17 aa, Mycobacterium
AAQGRVQAARRLLAALR

SEQ ID NO: 1310321 - protein, 19 aa, Mycobacterium
AAQLLVKRFPDPTAPEVQK

SEQ ID NO: 1310322 - protein, 21 aa, Mycobacterium
AAQLVVTIAALRIAGAQPGDR

SEQ ID NO: 1310323 - protein, 24 aa, Mycobacterium
AAQRIMLIARDGGCTKPGCTVGAY

SEQ ID NO: 1310324 - protein, 17 aa, Mycobacterium
AAQRLIRRIGRVSAREL

SEQ ID NO: 1310325 - protein, 22 aa, Mycobacterium
AAQRLLRPLFDESLPVPDIATT

SEQ ID NO: 1310326 - protein, 17 aa, Mycobacterium
AAQRRLAMATAAAADAH

SEQ ID NO: 1310327 - protein, 19 aa, Mycobacterium
AAQRYVLVGGIRSTGLTSG

SEQ ID NO: 1310328 - protein, 28 aa, Mycobacterium
AAQSAELPLFRYVGGPNAHILPVPMMNI

SEQ ID NO: 1310329 - protein, 27 aa, Mycobacterium
AAQSPLDISRPLWTATLIEGVENGRAA

SEQ ID NO: 1310330 - protein, 25 aa, Mycobacterium
AAQTPLHPLALRMIRPEQVIMLGRP

SEQ ID NO: 1310331 - protein, 24 aa, Mycobacterium
AAQWSRIRLADRAHLEPWEPVTGV

SEQ ID NO: 1310332 - protein, 21 aa, Mycobacterium
AAQYRIRLGGSWKKPGTGDIQ

SEQ ID NO: 1310333 - protein, 25 aa, Mycobacterium
AARAEGHCWFTAGTLWREAAQLAGV

SEQ ID NO: 1310334 - protein, 24 aa, Mycobacterium
AARALHALGPQWALVKGGHLRSSA

SEQ ID NO: 1310335 - protein, 22 aa, Mycobacterium
AARAMLAAPTLPTAVLAGNDRC

SEQ ID NO: 1310336 - protein, 22 aa, Mycobacterium
AARAQLNPLVFEGSQFGGALMT

SEQ ID NO: 1310337 - protein, 25 aa, Mycobacterium
AARDRLEIRPRLERGFLAAAMEGYQ

SEQ ID NO: 1310338 - protein, 18 aa, Mycobacterium
AARFRRPGLDPPATPSSA

SEQ ID NO: 1310339 - protein, 25 aa, Mycobacterium
AARGKAIIILNPADPPVIMRDTVLC

SEQ ID NO: 1310340 - protein, 21 aa, Mycobacterium
AARGVQLLRAVDAAYRSAIAD

SEQ ID NO: 1310341 - protein, 26 aa, Mycobacterium
AARHRFFEALPLRRKVDAAVVVSLPL

SEQ ID NO: 1310342 - protein, 27 aa, Mycobacterium
AARIGALAAMALLLRRERTGAGGSASI

SEQ ID NO: 1310343 - protein, 19 aa, Mycobacterium
AARKAIWNRYLGVSADYVE

SEQ ID NO: 1310344 - protein, 26 aa, Mycobacterium
AARLALWRTCLRPPVPVRDDLELSYY

SEQ ID NO: 1310345 - protein, 23 aa, Mycobacterium
AARLIRHYLPGMVDRGWGRVLQI

SEQ ID NO: 1310346 - protein, 17 aa, Mycobacterium
AARLQVPKARRTLPSVL

SEQ ID NO: 1310347 - protein, 21 aa, Mycobacterium
AARLVVPHWQSRGSGYFVSVA

SEQ ID NO: 1310348 - protein, 23 aa, Mycobacterium
AARMEVWSWFFVERNAPEEFKQQ

SEQ ID NO: 1310349 - protein, 26 aa, Mycobacterium
AARMLDPQHRLFLQTVFHAMEDAGYD

SEQ ID NO: 1310350 - protein, 18 aa, Mycobacterium
AARNLQPRIILLDGDLRG

SEQ ID NO: 1310351 - protein, 20 aa, Mycobacterium
AARPLLFDLVDDPVVRMLLT

SEQ ID NO: 1310352 - protein, 29 aa, Mycobacterium
AARPVMFSTFLMWVLADLFTTLPEVGDVD

SEQ ID NO: 1310353 - protein, 26 aa, Mycobacterium
AARRGGEWLDWFAAARITAIGMGMIA

SEQ ID NO: 1310354 - protein, 20 aa, Mycobacterium
AARRTWLRSLSAEPRTCVFF

SEQ ID NO: 1310355 - protein, 21 aa, Mycobacterium
AARTFPLACPPSVTAENIAAF

SEQ ID NO: 1310356 - protein, 22 aa, Mycobacterium
AARTFPLACPPSVTAENIAAFV

SEQ ID NO: 1310357 - protein, 20 aa, Mycobacterium
AARTPLMSNLVGSGLQPTVS

SEQ ID NO: 1310358 - protein, 18 aa, Mycobacterium
AARTSPAIRLLIHNDEAA

SEQ ID NO: 1310359 - protein, 18 aa, Mycobacterium
AARYFYESFADKDVFVGA

SEQ ID NO: 1310360 - protein, 21 aa, Mycobacterium
AARYRISVFYDLVKCAVNRLA

SEQ ID NO: 1310361 - protein, 18 aa, Mycobacterium
AASDRYWRRYFDNFAEVM

SEQ ID NO: 1310362 - protein, 24 aa, Mycobacterium
AASESPLPFAAAASLVRSCMNFSG

SEQ ID NO: 1310363 - protein, 25 aa, Mycobacterium
AASGRPAVHLATRQLERLRAEGVLA

SEQ ID NO: 1310364 - protein, 26 aa, Mycobacterium
AASKHGIVGLMRALANALAPHNIRVN

SEQ ID NO: 1310365 - protein, 17 aa, Mycobacterium
AASLLVRCARPVLQQLQ

SEQ ID NO: 1310366 - protein, 29 aa, Mycobacterium
AASLSGFLNLSEGWWPMLVGMSMGDAGGY

SEQ ID NO: 1310367 - protein, 24 aa, Mycobacterium
AASPFNAFLIAQGLETLSLRIERH

SEQ ID NO: 1310368 - protein, 28 aa, Mycobacterium
AASRDMVTSLRWTLTGVRSRFAVRRGGR

SEQ ID NO: 1310369 - protein, 27 aa, Mycobacterium
AASRDRARRWLPDTPILPVDEVARRAE

SEQ ID NO: 1310370 - protein, 24 aa, Mycobacterium
AASRFSSAFTFQYSKRPGTPAAEL

SEQ ID NO: 1310371 - protein, 23 aa, Mycobacterium
AASTPLGELLLPSQQGPTPPTGP

SEQ ID NO: 1310372 - protein, 17 aa, Mycobacterium
AASYHDVAPYPLDVLGA

SEQ ID NO: 1310373 - protein, 17 aa, Mycobacterium
AATAAVTALVPAGADEV

SEQ ID NO: 1310374 - protein, 24 aa, Mycobacterium
AATACLEQGLRVGCFRPPTVPAGT

SEQ ID NO: 1310375 - protein, 30 aa, Mycobacterium
AATDDLRKVTGFGRLLLFGGTRDKANQGAR

SEQ ID NO: 1310376 - protein, 29 aa, Mycobacterium
AATEAVTAFWGPQWRRDITIVLAGSAEQF

SEQ ID NO: 1310377 - protein, 24 aa, Mycobacterium
AATELGWTGLALPEDVGGSGFGLE

SEQ ID NO: 1310378 - protein, 20 aa, Mycobacterium
AATFDRITGELQAVRAQIEA

SEQ ID NO: 1310379 - protein, 26 aa, Mycobacterium
AATIEGWMPFGRVFETLAWGRRHVVM

SEQ ID NO: 1310380 - protein, 25 aa, Mycobacterium
AATIEVRVPLLGGKIENFIGRQLAD

SEQ ID NO: 1310381 - protein, 26 aa, Mycobacterium
AATKTLWLPGPDPEPHYRPSAKLAAF

SEQ ID NO: 1310382 - protein, 23 aa, Mycobacterium
AATLFDSLGPFGTGLTTAIANPA

SEQ ID NO: 1310383 - protein, 25 aa, Mycobacterium
AATLKKVFLELGGKSAFLVIDDADL

SEQ ID NO: 1310384 - protein, 27 aa, Mycobacterium
AATLRTPYTLPPDVLAAALPIVMTVPD

SEQ ID NO: 1310385 - protein, 32 aa, Mycobacterium
AATNRAVLAIYRPLLEPLGLTHPQYLVMLSLW

SEQ ID NO: 1310386 - protein, 29 aa, Mycobacterium
AATQDLLREAVLTEGWRLHPDSDPTAAMV

SEQ ID NO: 1310387 - protein, 23 aa, Mycobacterium
AATRATLVLHLAITRIRELMAEI

SEQ ID NO: 1310388 - protein, 27 aa, Mycobacterium
AATRLGRPLRIAHAWSFTFDAAWQPLV

SEQ ID NO: 1310389 - protein, 25 aa, Mycobacterium
AATSGRVAFLIRFGSGVLPDAKTVV

SEQ ID NO: 1310390 - protein, 34 aa, Mycobacterium
AATTEPRLWLLGSSMYSAHLAAAKGLPYVFAHHF

SEQ ID NO: 1310391 - protein, 17 aa, Mycobacterium
AATTPRLLKFHAPEIVF

SEQ ID NO: 1310392 - protein, 21 aa, Mycobacterium
AATTTPERIMFSPAAAGMNTA

SEQ ID NO: 1310393 - protein, 24 aa, Mycobacterium
AATWLRPGGHLLYLGHALENFVYG

SEQ ID NO: 1310394 - protein, 19 aa, Mycobacterium
AAVAAARRIWIGNPYVAAK

SEQ ID NO: 1310395 - protein, 26 aa, Mycobacterium
AAVAGWPDALLLRVDRRNQVLISGGR

SEQ ID NO: 1310396 - protein, 26 aa, Mycobacterium
AAVARVGALPFAALSAAGDMVSITTV

SEQ ID NO: 1310397 - protein, 27 aa, Mycobacterium
AAVCLPHDWLTWRLSGSTDIADLCTDR

SEQ ID NO: 1310398 - protein, 26 aa, Mycobacterium
AAVEELPRNPALKVSLPAVAALYSGH

SEQ ID NO: 1310399 - protein, 38 aa, Mycobacterium
AAVEGFIRQILGWREYMWHLYWHFGPEYAAKNELAAHT

SEQ ID NO: 1310400 - protein, 22 aa, Mycobacterium
AAVGLPAPRLVVEPGRAIAGPG

SEQ ID NO: 1310401 - protein, 25 aa, Mycobacterium
AAVGVVHSLWQPIAGRFKDYIAQPR

SEQ ID NO: 1310402 - protein, 31 aa, Mycobacterium
AAVIATVLLAARRRLPIDVVAYVPMAENMPS

SEQ ID NO: 1310403 - protein, 19 aa, Mycobacterium
AAVLAARIAALLKGICDND

SEQ ID NO: 1310404 - protein, 28 aa, Mycobacterium
AAVLDSGMLWITTLGREGEFWDWPAVTL

SEQ ID NO: 1310405 - protein, 18 aa, Mycobacterium
AAVLLAGLGLDPELEVDE

SEQ ID NO: 1310406 - protein, 17 aa, Mycobacterium
AAVLLDGLRHWMSRKGY

SEQ ID NO: 1310407 - protein, 17 aa, Mycobacterium
AAVLTAKLFSPSHIVVI

SEQ ID NO: 1310408 - protein, 19 aa, Mycobacterium
AAVLVAMNSLWELGVPRRD

SEQ ID NO: 1310409 - protein, 23 aa, Mycobacterium
AAVLYETFRPQPAGRDWPAEAMW

SEQ ID NO: 1310410 - protein, 24 aa, Mycobacterium
AAVMADPLPFYRTLRDEHPLHYVD

SEQ ID NO: 1310411 - protein, 38 aa, Mycobacterium
AAVMADPLPFYRTLRDEHPLYYVDKWDTYALSRFEDIW

SEQ ID NO: 1310412 - protein, 25 aa, Mycobacterium
AAVMLRRDFLTQDARLRDGVWASSV

SEQ ID NO: 1310413 - protein, 18 aa, Mycobacterium
AAVMSVSLLLAHMAEVDA

SEQ ID NO: 1310414 - protein, 20 aa, Mycobacterium
AAVNPWMLRMAGEVADGVHV

SEQ ID NO: 1310415 - protein, 28 aa, Mycobacterium
AAVPGFAVLPLDPPPLPFQLADRELFRS

SEQ ID NO: 1310416 - protein, 30 aa, Mycobacterium
AAVPGFAVLPLDPPPLPFQLADRELFRSKL

SEQ ID NO: 1310417 - protein, 39 aa, Mycobacterium
AAVPIPRHVPWFPKDVPAWSVRWVFFHMIEELARHAGQG

SEQ ID NO: 1310418 - protein, 26 aa, Mycobacterium
AAVQDAGLRWIGPPVAAVAAMGSKIE

SEQ ID NO: 1310419 - protein, 25 aa, Mycobacterium
AAVRDGRFLVLPHPAVRDMLAGKVA

SEQ ID NO: 1310420 - protein, 29 aa, Mycobacterium
AAVRERLLARLDRFGLAHAVLACADGATA

SEQ ID NO: 1310421 - protein, 36 aa, Mycobacterium
AAVSAAKYYIDYRDFTVWVLRVRRVRWVGGYGRMDS

SEQ ID NO: 1310422 - protein, 26 aa, Mycobacterium
AAVSALRRRYGITHLAPGSVLPAIGT

SEQ ID NO: 1310423 - protein, 34 aa, Mycobacterium
AAVSGWAPPSPPIPPDARPVLAAPPAAPAEIISN

SEQ ID NO: 1310424 - protein, 30 aa, Mycobacterium
AAVSIRPLLLMLSHPFYWEHFGRLTDVVRT

SEQ ID NO: 1310425 - protein, 27 aa, Mycobacterium
AAVTDWFTVDWHRTIVDKWRAAGVRMA

SEQ ID NO: 1310426 - protein, 19 aa, Mycobacterium
AAVTFLRPLDGFPDKRVRL

SEQ ID NO: 1310427 - protein, 27 aa, Mycobacterium
AAVTPHAYIALWRALLGLDLMATVDID

SEQ ID NO: 1310428 - protein, 17 aa, Mycobacterium
AAVVLFGKPSTRFLDAI

SEQ ID NO: 1310429 - protein, 26 aa, Mycobacterium
AAVVRFIGVDGYRWMVRCVVNGPYER

SEQ ID NO: 1310430 - protein, 22 aa, Mycobacterium
AAWARYRKLFPHASFHEFTDSP

SEQ ID NO: 1310431 - protein, 18 aa, Mycobacterium
AAWLLLSSEWVDAAEAER

SEQ ID NO: 1310432 - protein, 22 aa, Mycobacterium
AAYDQLPAPLRALVENLWAVHT

SEQ ID NO: 1310433 - protein, 23 aa, Mycobacterium
AAYFANIKREEFFAYHSTVGAWE

SEQ ID NO: 1310434 - protein, 19 aa, Mycobacterium
AAYLARLRWPGGFRCPSCD

SEQ ID NO: 1310435 - protein, 22 aa, Mycobacterium
AAYLPACLASHLPLDLVVIMLG

SEQ ID NO: 1310436 - protein, 17 aa, Mycobacterium
ACAQYLGPALRLMNFNY

SEQ ID NO: 1310437 - protein, 33 aa, Mycobacterium
ACARKLFVHPNTVRYRLKRIADFTGRDPTVPRD

SEQ ID NO: 1310438 - protein, 19 aa, Mycobacterium
ACATVIAGIRRHGANRRST

SEQ ID NO: 1310439 - protein, 30 aa, Mycobacterium
ACLGDPLEALLWLARTARQYGRPLRGGQVV

SEQ ID NO: 1310440 - protein, 20 aa, Mycobacterium
ACLHWGAMWGPASRADYVDP

SEQ ID NO: 1310441 - protein, 18 aa, Mycobacterium
ACLNERRWDDLRQFVADD

SEQ ID NO: 1310442 - protein, 19 aa, Mycobacterium
ACLRPMLAGLPPDQKAALE

SEQ ID NO: 1310443 - protein, 19 aa, Mycobacterium
ACRALLLDQPSPGAALAGL

SEQ ID NO: 1310444 - protein, 23 aa, Mycobacterium
ACRREIELNRRLASSSYLGVGHF

SEQ ID NO: 1310445 - protein, 18 aa, Mycobacterium
ACSAALYRACNEQKYLAC

SEQ ID NO: 1310446 - protein, 21 aa, Mycobacterium
ACTAYVRNFPALQGVMPALAP

SEQ ID NO: 1310447 - protein, 24 aa, Mycobacterium
ACTGYIVQLPLPKHLNENAALERI

SEQ ID NO: 1310448 - protein, 23 aa, Mycobacterium
ACTRCRFLRVDPAQLGRINEMTE

SEQ ID NO: 1310449 - protein, 18 aa, Mycobacterium
ACTRLIRSAVPDSTLLVV

SEQ ID NO: 1310450 - protein, 18 aa, Mycobacterium
ACVRQMLAVLDPVPETLP

SEQ ID NO: 1310451 - protein, 24 aa, Mycobacterium
ADADELIRWAGGFVTAPRQVFVVH

SEQ ID NO: 1310452 - protein, 24 aa, Mycobacterium
ADADGLVRWMADLNTRTVPEHPFM

SEQ ID NO: 1310453 - protein, 18 aa, Mycobacterium
ADAEFHFAVVRASHNAVL

SEQ ID NO: 1310454 - protein, 23 aa, Mycobacterium
ADAFTEMFGIPVLTSYAATEFGG

SEQ ID NO: 1310455 - protein, 29 aa, Mycobacterium
ADAGAAFSRGLWWSALRATDRADAGHQRL

SEQ ID NO: 1310456 - protein, 26 aa, Mycobacterium
ADAGIGFSCLWPETYIATSAVSNLAD

SEQ ID NO: 1310457 - protein, 26 aa, Mycobacterium
ADAGRPWWEWAATYERAFTAAYDALG

SEQ ID NO: 1310458 - protein, 26 aa, Mycobacterium
ADAGVPWVLMHWRSVGSDRPHEVPPY

SEQ ID NO: 1310459 - protein, 18 aa, Mycobacterium
ADAIFVTSIRPLAPDETD

SEQ ID NO: 1310460 - protein, 18 aa, Mycobacterium
ADAIWTYREPHPAVAQIA

SEQ ID NO: 1310461 - protein, 21 aa, Mycobacterium
ADANPYLALAACLAGVLHGIE

SEQ ID NO: 1310462 - protein, 17 aa, Mycobacterium
ADAPWPAELLADIESVT

SEQ ID NO: 1310463 - protein, 26 aa, Mycobacterium
ADARGAFHADWFLRRILAAEERIVAQ

SEQ ID NO: 1310464 - protein, 26 aa, Mycobacterium
ADARGAFHADWFLRRILAAEERIVSQ

SEQ ID NO: 1310465 - protein, 17 aa, Mycobacterium
ADARQWVLGGGEDHALV

SEQ ID NO: 1310466 - protein, 25 aa, Mycobacterium
ADARRRMWLPVGAIFGRLEPNANDY

SEQ ID NO: 1310467 - protein, 26 aa, Mycobacterium
ADASTWADPWPMYRALRDHDPVHHVV

SEQ ID NO: 1310468 - protein, 18 aa, Mycobacterium
ADATRRLKLVPQSRYDDA

SEQ ID NO: 1310469 - protein, 24 aa, Mycobacterium
ADAVILARIVLGRVAARHGLRISF

SEQ ID NO: 1310470 - protein, 24 aa, Mycobacterium
ADAVKDILPRPLLEVLFAADRESG

SEQ ID NO: 1310471 - protein, 21 aa, Mycobacterium
ADAVLPLRWTDGGANRVRVLR

SEQ ID NO: 1310472 - protein, 23 aa, Mycobacterium
ADAVLWAIGRVRPNTGWLPTELL

SEQ ID NO: 1310473 - protein, 17 aa, Mycobacterium
ADAVVLGTPLAVSAESL

SEQ ID NO: 1310474 - protein, 24 aa, Mycobacterium
ADAYMVSLLKEYWGEHARADNDFC

SEQ ID NO: 1310475 - protein, 26 aa, Mycobacterium
ADCLGSPWEALAWLAATSLEYGAPLR

SEQ ID NO: 1310476 - protein, 22 aa, Mycobacterium
ADDDVYYPRTWLSRLVAAHRDG

SEQ ID NO: 1310477 - protein, 28 aa, Mycobacterium
ADDFATLSALLPLLAPWTRHVAEADLQL

SEQ ID NO: 1310478 - protein, 17 aa, Mycobacterium
ADDFILHVAARDTEDLR

SEQ ID NO: 1310479 - protein, 25 aa, Mycobacterium
ADDIAYGFALFASAGVLLDHPSGRT

SEQ ID NO: 1310480 - protein, 26 aa, Mycobacterium
ADDIRPEHLLVGVLRSAGPSLSRMLN

SEQ ID NO: 1310481 - protein, 24 aa, Mycobacterium
ADDKTLFREFGFTPEAVVAAAERT

SEQ ID NO: 1310482 - protein, 24 aa, Mycobacterium
ADDLLTATLLTARCPVLYAPAMHT

SEQ ID NO: 1310483 - protein, 26 aa, Mycobacterium
ADDLPPGWLRLLTDERLRPAVTSMHD

SEQ ID NO: 1310484 - protein, 21 aa, Mycobacterium
ADDPQWGAYLARREKLVEDLA

SEQ ID NO: 1310485 - protein, 29 aa, Mycobacterium
ADDQLYSSLWLYLAGVRPIVFGVSAAAGL

SEQ ID NO: 1310486 - protein, 30 aa, Mycobacterium
ADDQLYSSLWLYLAGVRPIVFGVSAAAGLQ

SEQ ID NO: 1310487 - protein, 28 aa, Mycobacterium
ADDQLYSSLWLYLAGVRPVVFGVSAAAG

SEQ ID NO: 1310488 - protein, 25 aa, Mycobacterium
ADDRYISFVMMQPTKFWADVCSHMD

SEQ ID NO: 1310489 - protein, 24 aa, Mycobacterium
ADDSEPFQPFSLTLYAPQDDEESP

SEQ ID NO: 1310490 - protein, 27 aa, Mycobacterium
ADDVARAVAFLLSDDARFITGEALAVN

SEQ ID NO: 1310491 - protein, 23 aa, Mycobacterium
ADDVKLLRLAQAYSLVVSAEVTA

SEQ ID NO: 1310492 - protein, 25 aa, Mycobacterium
ADDVRAIYLSAWKAKVKGITVYRYG

SEQ ID NO: 1310493 - protein, 25 aa, Mycobacterium
ADDWFSPVFLRNATAFGFSPRLRAD

SEQ ID NO: 1310494 - protein, 22 aa, Mycobacterium
ADEERIVWLAEPLVAAEHLPEG

SEQ ID NO: 1310495 - protein, 28 aa, Mycobacterium
ADELAVVHPGWWSRRRVQAVLDAAGDIC

SEQ ID NO: 1310496 - protein, 25 aa, Mycobacterium
ADELGLPTAPFWFAGSVEELTAIVA

SEQ ID NO: 1310497 - protein, 23 aa, Mycobacterium
ADEPASILILFAPGAPREHYFEG

SEQ ID NO: 1310498 - protein, 26 aa, Mycobacterium
ADERAFWQFHASLMEPWDGPACITFT

SEQ ID NO: 1310499 - protein, 26 aa, Mycobacterium
ADERFRARVLPRVPVRRWGAAEDVGG

SEQ ID NO: 1310500 - protein, 18 aa, Mycobacterium
ADERLATTVFLQTRLDKP

SEQ ID NO: 1310501 - protein, 26 aa, Mycobacterium
ADERRLLDSLAVRKLWGIGPVAEDRL

SEQ ID NO: 1310502 - protein, 23 aa, Mycobacterium
ADETLLLEFTPPDTRYWNVTLEN

SEQ ID NO: 1310503 - protein, 26 aa, Mycobacterium
ADEVVDVVLLWWRDGDGDLVDTLMDA

SEQ ID NO: 1310504 - protein, 25 aa, Mycobacterium
ADFAALPFDHLFFTGSPGVGALVQQ

SEQ ID NO: 1310505 - protein, 30 aa, Mycobacterium
ADFQHMITQYAWGTIWTRPGLDLRSRSMIT

SEQ ID NO: 1310506 - protein, 35 aa, Mycobacterium
ADFQSLLDVHALGPIHLIQRVLPDMRAAGRGDVIM

SEQ ID NO: 1310507 - protein, 19 aa, Mycobacterium
ADFTLLVKVPGQPAAIKAF

SEQ ID NO: 1310508 - protein, 25 aa, Mycobacterium
ADGAPPFPGALWLQVRDIAAAQEQL

SEQ ID NO: 1310509 - protein, 24 aa, Mycobacterium
ADGDLSWVLGNLGAIPAVTLDYRT

SEQ ID NO: 1310510 - protein, 27 aa, Mycobacterium
ADGDNWMRLFDLWQQVRDPLLSSLFSP

SEQ ID NO: 1310511 - protein, 27 aa, Mycobacterium
ADGDPWASFVTYGLLDGAPVLCVSNLA

SEQ ID NO: 1310512 - protein, 21 aa, Mycobacterium
ADGGMPWRYAADGSVAIASPP

SEQ ID NO: 1310513 - protein, 25 aa, Mycobacterium
ADGGSNWYTEFARLAPLMKPDVHYE

SEQ ID NO: 1310514 - protein, 20 aa, Mycobacterium
ADGHWLACQVAPEGGSRSQI

SEQ ID NO: 1310515 - protein, 26 aa, Mycobacterium
ADGLSLAHLRRALPEAVFVSARTGQG

SEQ ID NO: 1310516 - protein, 25 aa, Mycobacterium
ADGQYVVGRLIWNAGLLAPVEGQLR

SEQ ID NO: 1310517 - protein, 23 aa, Mycobacterium
ADGRIWCAMVTPANPLADRLAAG

SEQ ID NO: 1310518 - protein, 33 aa, Mycobacterium
ADGRLTWVLDPIDGTVNFLYGIPAYAVSVGVRR

SEQ ID NO: 1310519 - protein, 20 aa, Mycobacterium
ADGTFEWRFTPKVPSQLVIR

SEQ ID NO: 1310520 - protein, 25 aa, Mycobacterium
ADGVTLAQLRRALPGAVFVSAHTGD

SEQ ID NO: 1310521 - protein, 23 aa, Mycobacterium
ADGVYAAWFTVLGHSPVVGTVTP

SEQ ID NO: 1310522 - protein, 21 aa, Mycobacterium
ADGWQLRRLTAPSRLFGANGL

SEQ ID NO: 1310523 - protein, 30 aa, Mycobacterium
ADHCLDMPGLFVWRRYHPTPAPERGVVYGP

SEQ ID NO: 1310524 - protein, 17 aa, Mycobacterium
ADHLDFFGSVEAYTEVF

SEQ ID NO: 1310525 - protein, 17 aa, Mycobacterium
ADHLPIVLGLNLTENVA

SEQ ID NO: 1310526 - protein, 25 aa, Mycobacterium
ADHRKIISRFLRWNLEKRLQSMSPV

SEQ ID NO: 1310527 - protein, 23 aa, Mycobacterium
ADHSKLWFAIAAGLAALGSSSAK

SEQ ID NO: 1310528 - protein, 24 aa, Mycobacterium
ADHVKFAYWVPNVSGGLVTSDIEQ

SEQ ID NO: 1310529 - protein, 18 aa, Mycobacterium
ADILAARDVPAASLIPAL

SEQ ID NO: 1310530 - protein, 24 aa, Mycobacterium
ADIRYRWAVCEPTTGELLAEVALR

SEQ ID NO: 1310531 - protein, 21 aa, Mycobacterium
ADKFRVVFELTERGLLANPQA

SEQ ID NO: 1310532 - protein, 24 aa, Mycobacterium
ADKVYSHHWAVGDTVIWDNRGVLH

SEQ ID NO: 1310533 - protein, 19 aa, Mycobacterium
ADKYRRLHVIIGDANLAET

SEQ ID NO: 1310534 - protein, 20 aa, Mycobacterium
ADLAFAWRTCRAVKSNAIVL

SEQ ID NO: 1310535 - protein, 19 aa, Mycobacterium
ADLAGACSMAAFTASMHAG

SEQ ID NO: 1310536 - protein, 34 aa, Mycobacterium
ADLAGLRPRRFVVLPWLTPTLASHWVGLVTPISS

SEQ ID NO: 1310537 - protein, 24 aa, Mycobacterium
ADLAVPELPLVFLGAPLKNPTDER

SEQ ID NO: 1310538 - protein, 19 aa, Mycobacterium
ADLAWFFQRTSRGRSPLAC

SEQ ID NO: 1310539 - protein, 26 aa, Mycobacterium
ADLAYIRLREHLAATGLVVVGVEFRN

SEQ ID NO: 1310540 - protein, 21 aa, Mycobacterium
ADLDLMDQAWWSPGMTHPDGR

SEQ ID NO: 1310541 - protein, 20 aa, Mycobacterium
ADLDMPSGYAYGKSFRTVKT

SEQ ID NO: 1310542 - protein, 25 aa, Mycobacterium
ADLDSTLPMLVFSGLMNSGQACVGQ

SEQ ID NO: 1310543 - protein, 23 aa, Mycobacterium
ADLDVAGLRQLDPDLPVRLMSET

SEQ ID NO: 1310544 - protein, 29 aa, Mycobacterium
ADLDYHLTTLFPPVRPRGFLEVRYLDSVP

SEQ ID NO: 1310545 - protein, 27 aa, Mycobacterium
ADLEELVVLLAWRVLTGVELAGTNPAE

SEQ ID NO: 1310546 - protein, 20 aa, Mycobacterium
ADLFTGLWETSLAADEILTA

SEQ ID NO: 1310547 - protein, 28 aa, Mycobacterium
ADLGAVLWHTTFPLPAPSAWPAERDRRE

SEQ ID NO: 1310548 - protein, 29 aa, Mycobacterium
ADLGAVLWHTTFPLPAPSAWPAERDRREL

SEQ ID NO: 1310549 - protein, 25 aa, Mycobacterium
ADLGCRLLMEIGPQPVLTAAAMRTW

SEQ ID NO: 1310550 - protein, 23 aa, Mycobacterium
ADLHKWCFELPRAPILHVQGKQD

SEQ ID NO: 1310551 - protein, 19 aa, Mycobacterium
ADLIAWLKEALSDHVKEVR

SEQ ID NO: 1310552 - protein, 21 aa, Mycobacterium
ADLLAGELWNIFPNVTIPCNA

SEQ ID NO: 1310553 - protein, 19 aa, Mycobacterium
ADLLFRLVRHFEAAYPDVT

SEQ ID NO: 1310554 - protein, 18 aa, Mycobacterium
ADLPHIRHRPAPAPPEVL

SEQ ID NO: 1310555 - protein, 22 aa, Mycobacterium
ADLPSPVVPPRSGAPNPAALRR

SEQ ID NO: 1310556 - protein, 23 aa, Mycobacterium
ADLQLDFFLGTSSIASVWGGYGQ

SEQ ID NO: 1310557 - protein, 23 aa, Mycobacterium
ADLRGVRALPVLILAGDVDAVVC

SEQ ID NO: 1310558 - protein, 17 aa, Mycobacterium
ADLRYLQQWVAEHHGVE

SEQ ID NO: 1310559 - protein, 23 aa, Mycobacterium
ADLSFISLATVLPALTACASPDA

SEQ ID NO: 1310560 - protein, 24 aa, Mycobacterium
ADLTEAFLWSEFRIVTKTATVSLH

SEQ ID NO: 1310561 - protein, 27 aa, Mycobacterium
ADMGRKFLTKLGILSPASAAADPGITN

SEQ ID NO: 1310562 - protein, 26 aa, Mycobacterium
ADMGRKFLTKLGILSPVTAAADPGIT

SEQ ID NO: 1310563 - protein, 24 aa, Mycobacterium
ADMHAANPHIWYSPAAVTAVADAV

SEQ ID NO: 1310564 - protein, 19 aa, Mycobacterium
ADMMIYLTWTMDGRGAQEG

SEQ ID NO: 1310565 - protein, 24 aa, Mycobacterium
ADMREYLTRLLRSDGYRVDAVADG

SEQ ID NO: 1310566 - protein, 24 aa, Mycobacterium
ADNGFKAVFLPTTPHPSAPDWHRK

SEQ ID NO: 1310567 - protein, 18 aa, Mycobacterium
ADPAHPPRFITGASAFCS

SEQ ID NO: 1310568 - protein, 30 aa, Mycobacterium
ADPCAEAFRAEWLLAFLAADLRGGIPEGLA

SEQ ID NO: 1310569 - protein, 24 aa, Mycobacterium
ADPETLLCSPFVLLGTHEQMAEQL

SEQ ID NO: 1310570 - protein, 18 aa, Mycobacterium
ADPGLGASPVWHVFAIDQ

SEQ ID NO: 1310571 - protein, 23 aa, Mycobacterium
ADPGSVAYLFTRKGVITLEKNDL

SEQ ID NO: 1310572 - protein, 22 aa, Mycobacterium
ADPGVHALIVTGAGKAFCAGAD

SEQ ID NO: 1310573 - protein, 23 aa, Mycobacterium
ADPPPVPLDAAILFAPVGDLVLP

SEQ ID NO: 1310574 - protein, 19 aa, Mycobacterium
ADPQKWTPRDLLHVAAEQL

SEQ ID NO: 1310575 - protein, 27 aa, Mycobacterium
ADPQLWQEVLVRLTPRQYSISSSPLVS

SEQ ID NO: 1310576 - protein, 25 aa, Mycobacterium
ADPSADVILIYLIQNMPNLTADAAA

SEQ ID NO: 1310577 - protein, 22 aa, Mycobacterium
ADPSRLAIVDHLLLADASPSEL

SEQ ID NO: 1310578 - protein, 19 aa, Mycobacterium
ADPVIMLTGPTPATQKVLD

SEQ ID NO: 1310579 - protein, 30 aa, Mycobacterium
ADPYDVACALDWLLYDWLMAHRDGPDSAEI

SEQ ID NO: 1310580 - protein, 29 aa, Mycobacterium
ADQDLRNVWAETILRFAYGSFRHANLMHA

SEQ ID NO: 1310581 - protein, 19 aa, Mycobacterium
ADQHRLTHGVLLAEPAGGV

SEQ ID NO: 1310582 - protein, 25 aa, Mycobacterium
ADQIGSRLGLWPSDIRVLSTLVRHH

SEQ ID NO: 1310583 - protein, 34 aa, Mycobacterium
ADQLLIVVALADPPPRTGFVERALIAAYAGGLRP

SEQ ID NO: 1310584 - protein, 24 aa, Mycobacterium
ADQPAVLRALLDCPVHAIIEMHEG

SEQ ID NO: 1310585 - protein, 25 aa, Mycobacterium
ADQPYVMQPIQITGLHRVLETHPTI

SEQ ID NO: 1310586 - protein, 25 aa, Mycobacterium
ADQRQTFALPLPTSLAATTDWRRLT

SEQ ID NO: 1310587 - protein, 21 aa, Mycobacterium
ADQVTLMRIIIGRIARKYGMR

SEQ ID NO: 1310588 - protein, 19 aa, Mycobacterium
ADQWPLNLGTSRDWNFVAE

SEQ ID NO: 1310589 - protein, 19 aa, Mycobacterium
ADRADFVRREFRSHKVKVT

SEQ ID NO: 1310590 - protein, 23 aa, Mycobacterium
ADRAVVLTVWSPLDRGSDPGSYS

SEQ ID NO: 1310591 - protein, 23 aa, Mycobacterium
ADRELRVPLHYYRDPKITEIEES

SEQ ID NO: 1310592 - protein, 20 aa, Mycobacterium
ADRLGLRPDVRRVPLFGLGC

SEQ ID NO: 1310593 - protein, 25 aa, Mycobacterium
ADRLQIVVDVMLRFWLENPATVQIG

SEQ ID NO: 1310594 - protein, 19 aa, Mycobacterium
ADRPTILATAALALREIEH

SEQ ID NO: 1310595 - protein, 18 aa, Mycobacterium
ADRRLRDLLADPAHVAVL

SEQ ID NO: 1310596 - protein, 18 aa, Mycobacterium
ADRRRGTAAAVIGWRFHR

SEQ ID NO: 1310597 - protein, 24 aa, Mycobacterium
ADRVATVLRRMFIRGEITEGTMLP

SEQ ID NO: 1310598 - protein, 21 aa, Mycobacterium
ADRVNLILVARRTERLEELRG

SEQ ID NO: 1310599 - protein, 24 aa, Mycobacterium
ADSCAQWLRWYDSEVMPTLVDAVH

SEQ ID NO: 1310600 - protein, 30 aa, Mycobacterium
ADSIELVVNPILLPVLTVSGLTKVTTVKPA

SEQ ID NO: 1310601 - protein, 26 aa, Mycobacterium
ADSLAHFIAALVYLPRDRYTTAVRLE

SEQ ID NO: 1310602 - protein, 20 aa, Mycobacterium
ADSLIYVAGIRKPDIATLVE

SEQ ID NO: 1310603 - protein, 24 aa, Mycobacterium
ADSTPWPTYPLMYRVTSAHEEGGD

SEQ ID NO: 1310604 - protein, 25 aa, Mycobacterium
ADTAAWLRDQPWFTGTFATMGLSYL

SEQ ID NO: 1310605 - protein, 32 aa, Mycobacterium
ADTDALLSLLLMILPHLALAPYVRGMDPVLGL

SEQ ID NO: 1310606 - protein, 34 aa, Mycobacterium
ADTERGLLLSTLWYIREVDPSVLLLTGLTRDGVY

SEQ ID NO: 1310607 - protein, 17 aa, Mycobacterium
ADTIGVDKILFGSDWPH

SEQ ID NO: 1310608 - protein, 28 aa, Mycobacterium
ADTPELMPLPIALAHRLSRKLTEVRKNG

SEQ ID NO: 1310609 - protein, 18 aa, Mycobacterium
ADVATQLHRYRTARDSWL

SEQ ID NO: 1310610 - protein, 22 aa, Mycobacterium
ADVDLAYFTYPIADSVVPAAAN

SEQ ID NO: 1310611 - protein, 20 aa, Mycobacterium
ADVDMRCLLIVGSSRTRWHT

SEQ ID NO: 1310612 - protein, 24 aa, Mycobacterium
ADVGLGYLTLGQPLTTLSGGERQR

SEQ ID NO: 1310613 - protein, 17 aa, Mycobacterium
ADVHVRLMRPGRGPRRY

SEQ ID NO: 1310614 - protein, 20 aa, Mycobacterium
ADVKQWWDSLSEQQRRELID

SEQ ID NO: 1310615 - protein, 19 aa, Mycobacterium
ADVLALLPRTSLAFDPPPE

SEQ ID NO: 1310616 - protein, 19 aa, Mycobacterium
ADVLVLTPTPFRDERGLFT

SEQ ID NO: 1310617 - protein, 18 aa, Mycobacterium
ADVPAYRHGGRSITHGRL

SEQ ID NO: 1310618 - protein, 25 aa, Mycobacterium
ADVQNLIPVVAESLSMVAPAHGLDA

SEQ ID NO: 1310619 - protein, 26 aa, Mycobacterium
ADVREILDRLPPRPVLVGASLGGITS

SEQ ID NO: 1310620 - protein, 18 aa, Mycobacterium
ADVRLKGRALIRDLLSRQ

SEQ ID NO: 1310621 - protein, 24 aa, Mycobacterium
ADVSIAFVPPAFSKDAIIEAIDAE

SEQ ID NO: 1310622 - protein, 23 aa, Mycobacterium
ADVVFASHHWPTWGKDRIVEFLS

SEQ ID NO: 1310623 - protein, 22 aa, Mycobacterium
ADVVLPLTEGWLDAVKAETGGR

SEQ ID NO: 1310624 - protein, 18 aa, Mycobacterium
ADWIAAMFDIIVDPQQRL

SEQ ID NO: 1310625 - protein, 19 aa, Mycobacterium
ADWPIDRRWLHDDGSAYSA

SEQ ID NO: 1310626 - protein, 51 aa, Mycobacterium
ADWYSTGIDFKRPTPQWWYDDTHLHGPDGLSLPMTLALPGAVNRGNAAQAV

SEQ ID NO: 1310627 - protein, 21 aa, Mycobacterium
ADYALLLARTDWDVPKHKGLS

SEQ ID NO: 1310628 - protein, 29 aa, Mycobacterium
ADYANHIDKWRFTVPFVCGATNLGEALRR

SEQ ID NO: 1310629 - protein, 28 aa, Mycobacterium
ADYIREQLPGLWLLASLYFRADVRGLDR

SEQ ID NO: 1310630 - protein, 26 aa, Mycobacterium
ADYKGRKVIVYFYPAASTPGCTKEAC

SEQ ID NO: 1310631 - protein, 20 aa, Mycobacterium
ADYLAACDIALVQGGLTTCM

SEQ ID NO: 1310632 - protein, 32 aa, Mycobacterium
ADYLTMVELKTSWYSFITPLQAGAIAAGVDPD

SEQ ID NO: 1310633 - protein, 32 aa, Mycobacterium
ADYLTMVELKTSWYSFITPLQAGAIAAGVDPN

SEQ ID NO: 1310634 - protein, 34 aa, Mycobacterium
ADYMATRGIGFLGWNTRYRGFESSFLLDHALVDI

SEQ ID NO: 1310635 - protein, 21 aa, Mycobacterium
ADYRWLNLMARAPRKSWPRIM

SEQ ID NO: 1310636 - protein, 30 aa, Mycobacterium
ADYVAWYNQQRLMHRLGRIPPAEAEARYYS

SEQ ID NO: 1310637 - protein, 25 aa, Mycobacterium
AEAALRWGPLSEARLTRALDALIHR

SEQ ID NO: 1310638 - protein, 30 aa, Mycobacterium
AEAAYIKFKSFGGWLQTLAGKWTQLAAEAE

SEQ ID NO: 1310639 - protein, 26 aa, Mycobacterium
AEADPPIRFLGNYLAPQDFIDRYPVA

SEQ ID NO: 1310640 - protein, 24 aa, Mycobacterium
AEAEDFYLRYNCDTYVMGIAGVDG

SEQ ID NO: 1310641 - protein, 22 aa, Mycobacterium
AEAEILRTVQVGLVPASVVIRG

SEQ ID NO: 1310642 - protein, 22 aa, Mycobacterium
AEAGWVQPHLPVPWGRASSPIE

SEQ ID NO: 1310643 - protein, 22 aa, Mycobacterium
AEAIALRPDGRPHRFQITASRF

SEQ ID NO: 1310644 - protein, 33 aa, Mycobacterium
AEAIRAGAAIKILWLPGPDPEPHYRPSAKLAAF

SEQ ID NO: 1310645 - protein, 32 aa, Mycobacterium
AEAIRGGAAIKPLWLPGPDPEPHYRPSATLAA

SEQ ID NO: 1310646 - protein, 24 aa, Mycobacterium
AEAIRKFRILPVDFTVFTGELTPT

SEQ ID NO: 1310647 - protein, 24 aa, Mycobacterium
AEAKRRRVPARVLIPARTHPDARS

SEQ ID NO: 1310648 - protein, 28 aa, Mycobacterium
AEALAYGDMGLALPILAPGGVASALTHW

SEQ ID NO: 1310649 - protein, 17 aa, Mycobacterium
AEALMAHNLIFPADLMA

SEQ ID NO: 1310650 - protein, 21 aa, Mycobacterium
AEALRWAMMAGEPHVVLADAL

SEQ ID NO: 1310651 - protein, 19 aa, Mycobacterium
AEALRWYWDQYVPNDFDRT

SEQ ID NO: 1310652 - protein, 19 aa, Mycobacterium
AEAMLLMRAGREHALKRAM

SEQ ID NO: 1310653 - protein, 20 aa, Mycobacterium
AEAMLLMRAGREYALKRALA

SEQ ID NO: 1310654 - protein, 33 aa, Mycobacterium
AEAMNPFDYFKFRYYEKWLGGITQFFIDKGYVS

SEQ ID NO: 1310655 - protein, 25 aa, Mycobacterium
AEAPARAYNPLFIWGESGLGKTHLL

SEQ ID NO: 1310656 - protein, 31 aa, Mycobacterium
AEAQRWPLIGTFTASLWVTWAPHTRRTFEGA

SEQ ID NO: 1310657 - protein, 38 aa, Mycobacterium
AEASRLLGYMYLSRVWHAALRRTRPERPFTVVIDEAHT

SEQ ID NO: 1310658 - protein, 23 aa, Mycobacterium
AEAVLAWLRRYPAAEFTPPDGAM

SEQ ID NO: 1310659 - protein, 19 aa, Mycobacterium
AEAVLRLSFDRLTKVSRRR

SEQ ID NO: 1310660 - protein, 19 aa, Mycobacterium
AEAVWRTIHEHKVNLLFFT

SEQ ID NO: 1310661 - protein, 25 aa, Mycobacterium
AECKKLGLLPFANYNRIHVVPPCTI

SEQ ID NO: 1310662 - protein, 20 aa, Mycobacterium
AEDFEREIQALRAHREVPAQ

SEQ ID NO: 1310663 - protein, 19 aa, Mycobacterium
AEDIALIRRFTRVALNTLI

SEQ ID NO: 1310664 - protein, 28 aa, Mycobacterium
AEDLARLWAINVDGVLWGIQAAAAKFKE

SEQ ID NO: 1310665 - protein, 29 aa, Mycobacterium
AEDLARLWAINVDGVLWGIQAAAAKFKEL

SEQ ID NO: 1310666 - protein, 32 aa, Mycobacterium
AEDLARLWAINVDGVLWGIQAAAAKFKELGNH

SEQ ID NO: 1310667 - protein, 21 aa, Mycobacterium
AEDLPLLERSTLAPGDVIDDV

SEQ ID NO: 1310668 - protein, 24 aa, Mycobacterium
AEDPAFIHRMLGLLVPHPERVEVI

SEQ ID NO: 1310669 - protein, 24 aa, Mycobacterium
AEDPDLCRAVFVLTFEAAKTTSQA

SEQ ID NO: 1310670 - protein, 18 aa, Mycobacterium
AEDQADYVMWWIDQLRSG

SEQ ID NO: 1310671 - protein, 25 aa, Mycobacterium
AEDRVLFFDITFAPLVAQLAGELGT

SEQ ID NO: 1310672 - protein, 27 aa, Mycobacterium
AEDSWEGFAWFVWQLCEMTATDRGLRE

SEQ ID NO: 1310673 - protein, 27 aa, Mycobacterium
AEEAAALPLTVYYHGGGWLLGSIDSHD

SEQ ID NO: 1310674 - protein, 24 aa, Mycobacterium
AEEEAFVLLALQAPVAGDLRAIVS

SEQ ID NO: 1310675 - protein, 27 aa, Mycobacterium
AEEITDRILLLDGLPNYQRLFSLRVGQ

SEQ ID NO: 1310676 - protein, 25 aa, Mycobacterium
AEEITTLAQLLLARNDALPYDLAGV

SEQ ID NO: 1310677 - protein, 24 aa, Mycobacterium
AEELGVPGIISAALAWSVHVNIQC

SEQ ID NO: 1310678 - protein, 24 aa, Mycobacterium
AEELGYSMVFLPEHFFTPTSHVEL

SEQ ID NO: 1310679 - protein, 26 aa, Mycobacterium
AEELIDYLTMLSWSALCGIVEVNGSL

SEQ ID NO: 1310680 - protein, 24 aa, Mycobacterium
AEEVDKMVWATRWGADTIMDLSTG

SEQ ID NO: 1310681 - protein, 32 aa, Mycobacterium
AEFAAAARPMNLLAIPWIDPVDVANASLFLAS

SEQ ID NO: 1310682 - protein, 25 aa, Mycobacterium
AEFEKDYFPIYGATAKVQTWDIYAC

SEQ ID NO: 1310683 - protein, 18 aa, Mycobacterium
AEFGWAISPWAAEQVPLL

SEQ ID NO: 1310684 - protein, 19 aa, Mycobacterium
AEFLSMDIALAIVDGVDGA

SEQ ID NO: 1310685 - protein, 17 aa, Mycobacterium
AEFLTYETFGRRFFEIA

SEQ ID NO: 1310686 - protein, 19 aa, Mycobacterium
AEFNVEGLATVIPFHRAVV

SEQ ID NO: 1310687 - protein, 19 aa, Mycobacterium
AEFPKFRQLLPTEHTAIAT

SEQ ID NO: 1310688 - protein, 18 aa, Mycobacterium
AEGAFFLPDGRRIGYAEY

SEQ ID NO: 1310689 - protein, 24 aa, Mycobacterium
AEGFLPTLLEWCHANGVVFIADEV

SEQ ID NO: 1310690 - protein, 25 aa, Mycobacterium
AEGHKWAMLTAYDYSTAAVFDEAEI

SEQ ID NO: 1310691 - protein, 34 aa, Mycobacterium
AEGLAPRAPVLRKLLWLLPDRFAPQLTPEVWAVA

SEQ ID NO: 1310692 - protein, 18 aa, Mycobacterium
AEGLIAWCRDRMAGFKVP

SEQ ID NO: 1310693 - protein, 32 aa, Mycobacterium
AEGLPHVPVRLHARSWHRYPEPSPDAAALIIY

SEQ ID NO: 1310694 - protein, 26 aa, Mycobacterium
AEGLPRLAGVPGWFACDVIQLVEAAD

SEQ ID NO: 1310695 - protein, 19 aa, Mycobacterium
AEGLWPSEWIPAKREAARA

SEQ ID NO: 1310696 - protein, 18 aa, Mycobacterium
AEGPLPPGTFVCPPFAFM

SEQ ID NO: 1310697 - protein, 26 aa, Mycobacterium
AEGQPGPVSVLFLDLDRLKTVNDYLG

SEQ ID NO: 1310698 - protein, 28 aa, Mycobacterium
AEGTFEYQALLFIPSHAPFDLFNQNAAV

SEQ ID NO: 1310699 - protein, 25 aa, Mycobacterium
AEGTLGVITALDLRLHPTPRQRVTA

SEQ ID NO: 1310700 - protein, 27 aa, Mycobacterium
AEGTLLLMLAALRRLPVLDRATREGRG

SEQ ID NO: 1310701 - protein, 20 aa, Mycobacterium
AEGTWALAVLERGTGRIVVA

SEQ ID NO: 1310702 - protein, 25 aa, Mycobacterium
AEHARRYDHVAARFAEAGLGIYALD

SEQ ID NO: 1310703 - protein, 23 aa, Mycobacterium
AEHEPFQRFIDRLYSAMLGNETG

SEQ ID NO: 1310704 - protein, 24 aa, Mycobacterium
AEHLIRIMRAVGMPNGLAGVGYSE

SEQ ID NO: 1310705 - protein, 17 aa, Mycobacterium
AEHLKQRWARGSGGLLV

SEQ ID NO: 1310706 - protein, 23 aa, Mycobacterium
AEHPRFYVALGSHSLYTTPGQHA

SEQ ID NO: 1310707 - protein, 29 aa, Mycobacterium
AEIADQAIPYAWLPGRARTFYGTDFSTWS

SEQ ID NO: 1310708 - protein, 17 aa, Mycobacterium
AEICGHIASLPLDRTRP

SEQ ID NO: 1310709 - protein, 18 aa, Mycobacterium
AEIDGVPLHLPQLWQRAD

SEQ ID NO: 1310710 - protein, 18 aa, Mycobacterium
AEIPLLVVITEGIPVQDT

SEQ ID NO: 1310711 - protein, 22 aa, Mycobacterium
AEIQVPLFINTGDKLKVDSRDG

SEQ ID NO: 1310712 - protein, 23 aa, Mycobacterium
AEIVTWMSVAPALRDGWEDSILA

SEQ ID NO: 1310713 - protein, 20 aa, Mycobacterium
AEKAIKTQLLMDSIADKLEI

SEQ ID NO: 1310714 - protein, 17 aa, Mycobacterium
AEKALDLPTLYASGRAG

SEQ ID NO: 1310715 - protein, 17 aa, Mycobacterium
AEKALLRRLVEAGTRVV

SEQ ID NO: 1310716 - protein, 24 aa, Mycobacterium
AEKVTGIFLVPAQWQAVCAAQKAR

SEQ ID NO: 1310717 - protein, 23 aa, Mycobacterium
AEKYEIPMIKLTGGQRIDLLGVR

SEQ ID NO: 1310718 - protein, 24 aa, Mycobacterium
AELAGIPLLDLLDTDLRAAVDEPG

SEQ ID NO: 1310719 - protein, 28 aa, Mycobacterium
AELAGWLDDMFLPPDVLDWPLNVVVVRT

SEQ ID NO: 1310720 - protein, 30 aa, Mycobacterium
AELALRDRVPLVMLLEGAGFRPSGEHYGRT

SEQ ID NO: 1310721 - protein, 17 aa, Mycobacterium
AELASTPTWTMNINHYP

SEQ ID NO: 1310722 - protein, 30 aa, Mycobacterium
AELATLTDPWQPAVLALVAMTVNAGAAAGK

SEQ ID NO: 1310723 - protein, 26 aa, Mycobacterium
AELCARCHVTLIGLVHFGKRESRDPG

SEQ ID NO: 1310724 - protein, 22 aa, Mycobacterium
AELCFIAVRPRRWLSTYGIGMS

SEQ ID NO: 1310725 - protein, 18 aa, Mycobacterium
AELCRMARRVFGWDELHP

SEQ ID NO: 1310726 - protein, 24 aa, Mycobacterium
AELDLEPVLGFEYEFWLFQDREDP

SEQ ID NO: 1310727 - protein, 24 aa, Mycobacterium
AELDRWLDWYLAEASATSPQSDGG

SEQ ID NO: 1310728 - protein, 18 aa, Mycobacterium
AELFATFVDPPLSHLTTM

SEQ ID NO: 1310729 - protein, 28 aa, Mycobacterium
AELFSWGQSWLQICHNAFAGLGVDPDRV

SEQ ID NO: 1310730 - protein, 19 aa, Mycobacterium
AELLTTPIIEALIAVRRHE

SEQ ID NO: 1310731 - protein, 26 aa, Mycobacterium
AELLVIGVRHRSPVGKLLLGSVSQQV

SEQ ID NO: 1310732 - protein, 17 aa, Mycobacterium
AELLYFGRLEYEKGVHD

SEQ ID NO: 1310733 - protein, 42 aa, Mycobacterium
AELMLEPLARELVVVRPIGFEPMKWIRALAADEPLPAAKDLT

SEQ ID NO: 1310734 - protein, 23 aa, Mycobacterium
AELNQVWTHLIANALDALAGQPA

SEQ ID NO: 1310735 - protein, 23 aa, Mycobacterium
AELPDVPDLERFGWRARSSLETV

SEQ ID NO: 1310736 - protein, 27 aa, Mycobacterium
AELPRGLPPVRLIAGAQLDGWQSYPDC

SEQ ID NO: 1310737 - protein, 18 aa, Mycobacterium
AELQRRLRYAYASYAGGL

SEQ ID NO: 1310738 - protein, 24 aa, Mycobacterium
AELRARDFVALVIGGLHAESEVGV

SEQ ID NO: 1310739 - protein, 28 aa, Mycobacterium
AELREYIDWQPFFNAWEMKGRFPDILNN

SEQ ID NO: 1310740 - protein, 24 aa, Mycobacterium
AELRPEHRALRQMIPEVYQGFNAI

SEQ ID NO: 1310741 - protein, 22 aa, Mycobacterium
AELRTLIGLRDAAVALVEAEAN

SEQ ID NO: 1310742 - protein, 18 aa, Mycobacterium
AELWESLHQLGLVRLTGA

SEQ ID NO: 1310743 - protein, 18 aa, Mycobacterium
AEMIAEQWGFSRTQLDEF

SEQ ID NO: 1310744 - protein, 23 aa, Mycobacterium
AEMNWRIMKFKPKADDRPAVPED

SEQ ID NO: 1310745 - protein, 22 aa, Mycobacterium
AEMTPMERLHLVPPPGMSPDMV

SEQ ID NO: 1310746 - protein, 23 aa, Mycobacterium
AEMVFTDLPILDRVRRIDELGFA

SEQ ID NO: 1310747 - protein, 25 aa, Mycobacterium
AENDLLASWVLDAAGIGYDAALRTV

SEQ ID NO: 1310748 - protein, 24 aa, Mycobacterium
AENDLLGIQLLGNTLIALGTEEQK

SEQ ID NO: 1310749 - protein, 31 aa, Mycobacterium
AENIARFGLPEFGWTLFAGVVRPKSRGHLAL

SEQ ID NO: 1310750 - protein, 27 aa, Mycobacterium
AENITQRYFLVSYPRKMDALTRLLEVE

SEQ ID NO: 1310751 - protein, 23 aa, Mycobacterium
AENPSWVMLYQYGNPSNAAAHYD

SEQ ID NO: 1310752 - protein, 28 aa, Mycobacterium
AENQLRFRAPRMLDLSLLVAALPEAYRA

SEQ ID NO: 1310753 - protein, 20 aa, Mycobacterium
AENRILLDRPSYVYPMFEQA

SEQ ID NO: 1310754 - protein, 41 aa, Mycobacterium; identical to SEQ ID NO: 789614

SEQ ID NO: 1310755 - protein, 23 aa, Mycobacterium
AENRYLALLDAVSAAQAKLVAQW

SEQ ID NO: 1310756 - protein, 29 aa, Mycobacterium
AENSMPWRLVARLLLVRAYAALGDTKNAE

SEQ ID NO: 1310757 - protein, 24 aa, Mycobacterium
AEPAPVLVFVPGGAWVHGSRLLQG

SEQ ID NO: 1310758 - protein, 24 aa, Mycobacterium
AEPDALVPLYLRRPDATPRAEQTR

SEQ ID NO: 1310759 - protein, 25 aa, Mycobacterium
AEPPEDLPLFPFQVGRIGAGANFAV

SEQ ID NO: 1310760 - protein, 25 aa, Mycobacterium
AEQIREQLLALTPLESTFAASLVAL

SEQ ID NO: 1310761 - protein, 20 aa, Mycobacterium
AEQKLPLNVTWVNLTTGKSG

SEQ ID NO: 1310762 - protein, 22 aa, Mycobacterium
AEQLHMGRDWVVRLEKGHPRLE

SEQ ID NO: 1310763 - protein, 29 aa, Mycobacterium
AEQLLARRREFGIGYWTVFDELPGRESAL

SEQ ID NO: 1310764 - protein, 19 aa, Mycobacterium
AEQMGRVHRFLGLDVDVIL

SEQ ID NO: 1310765 - protein, 18 aa, Mycobacterium
AEQMGRVHRFLGLTVGVI

SEQ ID NO: 1310766 - protein, 22 aa, Mycobacterium
AEQMKMFLTRLGFGSKIVVTGD

SEQ ID NO: 1310767 - protein, 20 aa, Mycobacterium
AEQMVLRYSAEKGLPAVAMC

SEQ ID NO: 1310768 - protein, 27 aa, Mycobacterium
AEQPDGGYWMPLFVVLADGVELTDEVR

SEQ ID NO: 1310769 - protein, 20 aa, Mycobacterium
AEQRWGIAESRRLAETLRLV

SEQ ID NO: 1310770 - protein, 33 aa, Mycobacterium
AEQSGFGTATLLRHHFRRIIGVTPSDYRRRFNS

SEQ ID NO: 1310771 - protein, 26 aa, Mycobacterium
AERAPMYHILSLLDLRILRDSGALAP

SEQ ID NO: 1310772 - protein, 28 aa, Mycobacterium
AERDAEFPWRREVGNARAGRLVAPDLGF

SEQ ID NO: 1310773 - protein, 24 aa, Mycobacterium
AERDFPATGVRFFASARSAGKKLG

SEQ ID NO: 1310774 - protein, 30 aa, Mycobacterium
AEREARLQRPLYVMPTRGILTSGYGYRWGA

SEQ ID NO: 1310775 - protein, 17 aa, Mycobacterium
AERFAAQLKGPVKRCDR

SEQ ID NO: 1310776 - protein, 19 aa, Mycobacterium
AERFAAQLKGPVKRCDRLD

SEQ ID NO: 1310777 - protein, 20 aa, Mycobacterium
AERFAAQLKGPVKRCDRLDI

SEQ ID NO: 1310778 - protein, 19 aa, Mycobacterium
AERGAQSCYWDYAPSFGRG

SEQ ID NO: 1310779 - protein, 22 aa, Mycobacterium
AERGRLFANLPSGGRMLAVFAD

SEQ ID NO: 1310780 - protein, 32 aa, Mycobacterium
AERHWRELGKPLHIHRILLQRSWVDILRGDFS

SEQ ID NO: 1310781 - protein, 17 aa, Mycobacterium
AERLGVPLSQLGQFSGH

SEQ ID NO: 1310782 - protein, 18 aa, Mycobacterium
AERLRMIATVNYLGVVEL

SEQ ID NO: 1310783 - protein, 23 aa, Mycobacterium
AERPVPLYFSYATTPMHETIQDL

SEQ ID NO: 1310784 - protein, 19 aa, Mycobacterium
AERQPPALLMLHPPSETTP

SEQ ID NO: 1310785 - protein, 25 aa, Mycobacterium
AERRAAALSLDPTLLAELLGRVELR

SEQ ID NO: 1310786 - protein, 22 aa, Mycobacterium
AERRGQLAPALFARTLIGRSST

SEQ ID NO: 1310787 - protein, 26 aa, Mycobacterium
AERRRAIELADLRKLLVGMEAALDAA

SEQ ID NO: 1310788 - protein, 25 aa, Mycobacterium
AERTIDHLLPQLGLSPLSRGAQRLW

SEQ ID NO: 1310789 - protein, 24 aa, Mycobacterium
AERVWNADFPFHARKRLAGTRLVA

SEQ ID NO: 1310790 - protein, 24 aa, Mycobacterium
AESEYILLTTFTKDGRPKPTAIWA

SEQ ID NO: 1310791 - protein, 38 aa, Mycobacterium
AESIRSKPFDYWRQHLKTMKGQWAPFQSLVDLGTDEQA

SEQ ID NO: 1310792 - protein, 23 aa, Mycobacterium
AESKRFCWNCGRPVGRSTKDGRA

SEQ ID NO: 1310793 - protein, 30 aa, Mycobacterium
AESLRLDIEFHLLLAQAAQNPLLTALQTLA

SEQ ID NO: 1310794 - protein, 27 aa, Mycobacterium
AESMDTDWPLPLYDLARIASDRGDVER

SEQ ID NO: 1310795 - protein, 25 aa, Mycobacterium
AESPRESWWRKLVIDSGFPTPATQI

SEQ ID NO: 1310796 - protein, 29 aa, Mycobacterium
AESPRETWLRLLVIRNGFPPPTTQIPVYD

SEQ ID NO: 1310797 - protein, 32 aa, Mycobacterium
AESTLEFSGLHQLLRPALHLIDRLPAPQCDAL

SEQ ID NO: 1310798 - protein, 23 aa, Mycobacterium
AETDLLAAWLAGRAGLEVPDSGP

SEQ ID NO: 1310799 - protein, 19 aa, Mycobacterium
AETFLRDINFPEAARHLAF

SEQ ID NO: 1310800 - protein, 20 aa, Mycobacterium
AETLGNFSFAYLVTVGDDYR

SEQ ID NO: 1310801 - protein, 27 aa, Mycobacterium
AETLLGETPLLATAPLYWGGSDIERSH

SEQ ID NO: 1310802 - protein, 25 aa, Mycobacterium
AETLRLWGHFEGDPQLYRADLDGVA

SEQ ID NO: 1310803 - protein, 20 aa, Mycobacterium
AETLRRPQQWRGAMEIDRLT

SEQ ID NO: 1310804 - protein, 22 aa, Mycobacterium
AETMKRMFLELGGKSAAIVLDD

SEQ ID NO: 1310805 - protein, 17 aa, Mycobacterium
AETPIERKPPWIKTRAK

SEQ ID NO: 1310806 - protein, 26 aa, Mycobacterium
AETPIRSIMAFQLFIAGETLGALNVY

SEQ ID NO: 1310807 - protein, 31 aa, Mycobacterium
AETQWLRYTFQRFPFVRLGDGRLLLVKSQFG

SEQ ID NO: 1310808 - protein, 30 aa, Mycobacterium; identical to SEQ ID NO: 789860

SEQ ID NO: 1310809 - protein, 29 aa, Mycobacterium
AEVDNPMFGVIYRSPLRHLALIGTEQGSD

SEQ ID NO: 1310810 - protein, 25 aa, Mycobacterium
AEVDRLARSMLLLHGGHDDDGHDHP

SEQ ID NO: 1310811 - protein, 20 aa, Mycobacterium
AEVEAIREWLHREGTCLLLA

SEQ ID NO: 1310812 - protein, 20 aa, Mycobacterium
AEVFFNDVRVPAGALLGPLN

SEQ ID NO: 1310813 - protein, 18 aa, Mycobacterium
AEVLGIHYEIPWPNREMK

SEQ ID NO: 1310814 - protein, 28 aa, Mycobacterium
AEVLGVYGPPLKFDVSLPLSAIRGFAED

SEQ ID NO: 1310815 - protein, 23 aa, Mycobacterium
AEVLQLAPNVWPQNAVRGADGVV

SEQ ID NO: 1310816 - protein, 23 aa, Mycobacterium
AEVLVDRALELAALVAGLSPFGV

SEQ ID NO: 1310817 - protein, 18 aa, Mycobacterium
AEVVLVLVGVLVALGRVA

SEQ ID NO: 1310818 - protein, 18 aa, Mycobacterium
AEWDAAVAVWRQLRTDEG

SEQ ID NO: 1310819 - protein, 17 aa, Mycobacterium
AEWHLRKVFVKLGITSR

SEQ ID NO: 1310820 - protein, 21 aa, Mycobacterium
AEWIIAAFGLLTAGGVLVPVN

SEQ ID NO: 1310821 - protein, 19 aa, Mycobacterium
AEWLAITYGDDGIGVSCVC

SEQ ID NO: 1310822 - protein, 29 aa, Mycobacterium
AEWLSQQLTALWDLLLNSAGTPGKSEVPD

SEQ ID NO: 1310823 - protein, 34 aa, Mycobacterium
AEWVNDLNINFLAAVRLNAALLPALYARGKGSII

SEQ ID NO: 1310824 - protein, 24 aa, Mycobacterium
AEWVPLPAEIYPLTEARAAFRRMQ

SEQ ID NO: 1310825 - protein, 20 aa, Mycobacterium
AEYHAFLHVAGDQALAAAAT

SEQ ID NO: 1310826 - protein, 18 aa, Mycobacterium
AEYPLFPDYGDDVYYSVA

SEQ ID NO: 1310827 - protein, 26 aa, Mycobacterium
AEYQLALDEWRLLTGAALVGLVEETM

SEQ ID NO: 1310828 - protein, 27 aa, Mycobacterium
AEYSIDVFTVLPLGELWVAAARMRQVE

SEQ ID NO: 1310829 - protein, 19 aa, Mycobacterium
AFADIRWRLDVWNASAQVA

SEQ ID NO: 1310830 - protein, 17 aa, Mycobacterium
AFAELGERWNGELNILV

SEQ ID NO: 1310831 - protein, 29 aa, Mycobacterium
AFAHGLLRDHLIAGIPPLRRQRLHAKIAD

SEQ ID NO: 1310832 - protein, 17 aa, Mycobacterium
AFALLRAKPLRPDAAIK

SEQ ID NO: 1310833 - protein, 23 aa, Mycobacterium
AFAMDADLLAAERSRIGLLLVDD

SEQ ID NO: 1310834 - protein, 20 aa, Mycobacterium
AFAPFESLTPQLPGGPRYPG

SEQ ID NO: 1310835 - protein, 18 aa, Mycobacterium
AFAVFRPVRNPKPAGRIR

SEQ ID NO: 1310836 - protein, 31 aa, Mycobacterium
AFAVGRAQALLYYLWRLHSAGRLPGIPIYLD

SEQ ID NO: 1310837 - protein, 19 aa, Mycobacterium
AFCELALLRMRGLLSLRRG

SEQ ID NO: 1310838 - protein, 19 aa, Mycobacterium
AFCLTTDVCAQFLAGDDHV

SEQ ID NO: 1310839 - protein, 19 aa, Mycobacterium
AFDGSWFLRRILATERRIV

SEQ ID NO: 1310840 - protein, 19 aa, Mycobacterium
AFDQAYLASVLGFPLVESA

SEQ ID NO: 1310841 - protein, 18 aa, Mycobacterium
AFDQAYLASVLGLPLVES

SEQ ID NO: 1310842 - protein, 18 aa, Mycobacterium
AFDQSYYQLLDSTRGRPF

SEQ ID NO: 1310843 - protein, 27 aa, Mycobacterium
AFDTELFGHWWYEGPVWLERVLRALPA

SEQ ID NO: 1310844 - protein, 20 aa, Mycobacterium
AFDVILIDCPPSLGVLTLNG

SEQ ID NO: 1310845 - protein, 22 aa, Mycobacterium
AFEKRWELGGVLFSKTFSDQMI

SEQ ID NO: 1310846 - protein, 34 aa, Mycobacterium
AFELNVYIPMMARNLLESFTLLANVSKLFAAKCI

SEQ ID NO: 1310847 - protein, 19 aa, Mycobacterium
AFFDVAELHSWVAEDGGRR

SEQ ID NO: 1310848 - protein, 17 aa, Mycobacterium
AFFELKQAGSKYADLPG

SEQ ID NO: 1310849 - protein, 18 aa, Mycobacterium
AFFRHPPRVPPTRPGVVV

SEQ ID NO: 1310850 - protein, 25 aa, Mycobacterium
AFGEHLGRLPRPLTGLELREHVVAY

SEQ ID NO: 1310851 - protein, 18 aa, Mycobacterium
AFGNFLARLVFPTRTRSL

SEQ ID NO: 1310852 - protein, 25 aa, Mycobacterium
AFGRRITALPDSTRLALLLAVVADG

SEQ ID NO: 1310853 - protein, 18 aa, Mycobacterium
AFGYGDFRRVHRTGLIAC

SEQ ID NO: 1310854 - protein, 18 aa, Mycobacterium
AFHAVRPLSVAEADALWP

SEQ ID NO: 1310855 - protein, 27 aa, Mycobacterium
AFHDGSPLYLELPVTVELVVASTEPGL

SEQ ID NO: 1310856 - protein, 27 aa, Mycobacterium
AFINGMEIQWLLDPSIPLTEVYQGYAE

SEQ ID NO: 1310857 - protein, 21 aa, Mycobacterium
AFIVPLHDGGWITGGAELPEW

SEQ ID NO: 1310858 - protein, 25 aa, Mycobacterium
AFKAERYPLFFERAYDILPADGRML

SEQ ID NO: 1310859 - protein, 32 aa, Mycobacterium
AFKPLSRYFDRVWRPEQLPAALLGAMRVLTDP

SEQ ID NO: 1310860 - protein, 17 aa, Mycobacterium
AFKWIQRAAMDRRTTMK

SEQ ID NO: 1310861 - protein, 26 aa, Mycobacterium
AFLADIRESIHLRALGRQNPLDEFHR

SEQ ID NO: 1310862 - protein, 18 aa, Mycobacterium
AFLAFHAWSDASHGDWPP

SEQ ID NO: 1310863 - protein, 35 aa, Mycobacterium
AFLDAAHPLPRDVRTRLLRTLGLRGVAHSVRALRD

SEQ ID NO: 1310864 - protein, 19 aa, Mycobacterium
AFLHVDYRKVTPIDTVLTA

SEQ ID NO: 1310865 - protein, 17 aa, Mycobacterium
AFLNVPLESLSQIVLHL

SEQ ID NO: 1310866 - protein, 28 aa, Mycobacterium
AFLVRAIAPAQLGALWRGRWHGGLGFTD

SEQ ID NO: 1310867 - protein, 19 aa, Mycobacterium
AFMYPRIVGHLRQRLQVED

SEQ ID NO: 1310868 - protein, 23 aa, Mycobacterium
AFNARIALHVRTLYGRDPHHITE

SEQ ID NO: 1310869 - protein, 17 aa, Mycobacterium
AFNEVHWVAPSEAVWAC

SEQ ID NO: 1310870 - protein, 35 aa, Mycobacterium
AFNHASGRIKLAWFLLHVARYLPPLLYATDPSWGT

SEQ ID NO: 1310871 - protein, 37 aa, Mycobacterium
AFNHASGRIKLAWFLLHVARYLPPLLYATDPSWGTDA

SEQ ID NO: 1310872 - protein, 19 aa, Mycobacterium
AFNTLINIPAAMADAFLNG

SEQ ID NO: 1310873 - protein, 26 aa, Mycobacterium
AFPAGPPHHFFMDRFTEAFRAELRAF

SEQ ID NO: 1310874 - protein, 21 aa, Mycobacterium
AFPAMQAMPIPYIEPRDVSNA

SEQ ID NO: 1310875 - protein, 18 aa, Mycobacterium
AFPELDWTSRSKFEQAEC

SEQ ID NO: 1310876 - protein, 21 aa, Mycobacterium
AFPGLTLALPDVLATKIGRLI

SEQ ID NO: 1310877 - protein, 21 aa, Mycobacterium
AFPGLTLALPDVLGTKIGRLV

SEQ ID NO: 1310878 - protein, 19 aa, Mycobacterium
AFPLSNWTEFDIWSYIGAE

SEQ ID NO: 1310879 - protein, 17 aa, Mycobacterium
AFQAAHARFIEVSAKIN

SEQ ID NO: 1310880 - protein, 27 aa, Mycobacterium
AFQGVSMPLWLSRLVSVLIPTHDDRTD

SEQ ID NO: 1310881 - protein, 23 aa, Mycobacterium
AFQNLPQLLLTAMRRPRTGVMIA

SEQ ID NO: 1310882 - protein, 17 aa, Mycobacterium
AFRDGVLVYRQAGALPP

SEQ ID NO: 1310883 - protein, 18 aa, Mycobacterium
AFRDGVLVYRQAGALPPA

SEQ ID NO: 1310884 - protein, 18 aa, Mycobacterium
AFRDGVLVYRQPGAMHPA

SEQ ID NO: 1310885 - protein, 22 aa, Mycobacterium
AFRDVLLATTRSVQAALPHLAA

SEQ ID NO: 1310886 - protein, 24 aa, Mycobacterium
AFSGIELINRWYHDPVDFAVMSDC

SEQ ID NO: 1310887 - protein, 21 aa, Mycobacterium
AFTALAARFLGPTLDGVRPVQ

SEQ ID NO: 1310888 - protein, 21 aa, Mycobacterium
AFTDPVRADWLWRVVGESAHS

SEQ ID NO: 1310889 - protein, 18 aa, Mycobacterium
AFTDVAYFLGCALPVEDR

SEQ ID NO: 1310890 - protein, 25 aa, Mycobacterium
AFTEKFGIPVLTSYAATEFGGGVAG

SEQ ID NO: 1310891 - protein, 25 aa, Mycobacterium
AFTRPARLFGLAKLGYTQSYTYFTW

SEQ ID NO: 1310892 - protein, 18 aa, Mycobacterium
AFTRPIVGHMFTNYDGVL

SEQ ID NO: 1310893 - protein, 25 aa, Mycobacterium
AFTSARWHVSTWPDVPIVLVCAQEE

SEQ ID NO: 1310894 - protein, 19 aa, Mycobacterium
AFTVFRPVREPRPSGRIRV

SEQ ID NO: 1310895 - protein, 27 aa, Mycobacterium
AFTWEHDAHLYLRRARSLAALLADGTD

SEQ ID NO: 1310896 - protein, 24 aa, Mycobacterium
AFVAARRFAIPAVEARGALLLEDV

SEQ ID NO: 1310897 - protein, 24 aa, Mycobacterium
AFVNALPVFIASDPVWAKKFEDAG

SEQ ID NO: 1310898 - protein, 19 aa, Mycobacterium
AFVRPPLFEDLSCGLVSTA

SEQ ID NO: 1310899 - protein, 21 aa, Mycobacterium
AFVSWLRLPMALRQSGIVMLP

SEQ ID NO: 1310900 - protein, 18 aa, Mycobacterium
AFVTGAAFEQFLVEQDNR

SEQ ID NO: 1310901 - protein, 18 aa, Mycobacterium
AFVVVAYLTGMRGEECRA

SEQ ID NO: 1310902 - protein, 21 aa, Mycobacterium
AFVVWERSLYERAVAEAAANL

SEQ ID NO: 1310903 - protein, 18 aa, Mycobacterium
AFYRRWAEFTDNLSWPQL

SEQ ID NO: 1310904 - protein, 23 aa, Mycobacterium
AFYRRWAEFTDNLSWPQLIELAK

SEQ ID NO: 1310905 - protein, 17 aa, Mycobacterium
AGAAAVRVLTGPRWRLG

SEQ ID NO: 1310906 - protein, 17 aa, Mycobacterium
AGAAPCGMVGLAVNAIC

SEQ ID NO: 1310907 - protein, 23 aa, Mycobacterium
AGAARVWVPAARALREVWVPGAD

SEQ ID NO: 1310908 - protein, 36 aa, Mycobacterium
AGADGVTPFVLVLRLLVVALRRHPVLNATWVDTVDG

SEQ ID NO: 1310909 - protein, 28 aa, Mycobacterium
AGADINWILVPSAAVSRLLRICDPDATL

SEQ ID NO: 1310910 - protein, 24 aa, Mycobacterium
AGAETLALGDYRMLPRATFCQPQV

SEQ ID NO: 1310911 - protein, 24 aa, Mycobacterium
AGAFHTRYMAPALDGYATVADRID

SEQ ID NO: 1310912 - protein, 29 aa, Mycobacterium
AGAHCRAEVLLLGQPRKTQSRFAVRPLGQ

SEQ ID NO: 1310913 - protein, 28 aa, Mycobacterium
AGAKRTHWIWFVFPQLRGLGHSATAYRY

SEQ ID NO: 1310914 - protein, 26 aa, Mycobacterium
AGALDLRPTAQLPPKNLRRLLEVNVE

SEQ ID NO: 1310915 - protein, 23 aa, Mycobacterium
AGAPDPHFWMDPQRMITAVDVIE

SEQ ID NO: 1310916 - protein, 28 aa, Mycobacterium
AGAPPHPCPLSFIVAPTLIAHGTPQQKD

SEQ ID NO: 1310917 - protein, 25 aa, Mycobacterium
AGAPTSAIALTKRLLNDSPDTDRSG

SEQ ID NO: 1310918 - protein, 18 aa, Mycobacterium
AGARAPVLIAIDDVQWLD

SEQ ID NO: 1310919 - protein, 34 aa, Mycobacterium
AGASPTMTIAATSLYLVCLRIVTSGHARALSSVV

SEQ ID NO: 1310920 - protein, 29 aa, Mycobacterium
AGATIVMQGLHRLWPPVIDLVRHLVDDLG

SEQ ID NO: 1310921 - protein, 24 aa, Mycobacterium
AGATLAMTTLLRLRDRGIDAFAGA

SEQ ID NO: 1310922 - protein, 19 aa, Mycobacterium
AGATVLLARVPRSAGHWLA

SEQ ID NO: 1310923 - protein, 23 aa, Mycobacterium
AGAVLTPQLRLVAESGLLGISVP

SEQ ID NO: 1310924 - protein, 32 aa, Mycobacterium
AGAVRREIGVPTVFNLLGPLTNPASPRAGLIG

SEQ ID NO: 1310925 - protein, 17 aa, Mycobacterium
AGAYVTGWIKRGARGVI

SEQ ID NO: 1310926 - protein, 17 aa, Mycobacterium
AGCVLPFQPASFRDFML

SEQ ID NO: 1310927 - protein, 27 aa, Mycobacterium
AGCYYRADHFPGTARLLLTSTGQGLKP

SEQ ID NO: 1310928 - protein, 25 aa, Mycobacterium
AGDAPILLVRLITDTPDRVDLSRLD

SEQ ID NO: 1310929 - protein, 20 aa, Mycobacterium
AGDAVHLFTGDCLFPGGVGK

SEQ ID NO: 1310930 - protein, 25 aa, Mycobacterium
AGDDHVLDRIWPDVLDNLRWLEHET

SEQ ID NO: 1310931 - protein, 23 aa, Mycobacterium
AGDDWLCLLEAFDQPHRPGLVRA

SEQ ID NO: 1310932 - protein, 31 aa, Mycobacterium; identical to SEQ ID NO: 790324

SEQ ID NO: 1310933 - protein, 33 aa, Mycobacterium
AGDELCVCDMAWVVGLPQGLVSHHLRQLKNASL

SEQ ID NO: 1310934 - protein, 19 aa, Mycobacterium
AGDILPLTLARVMSRIDTI

SEQ ID NO: 1310935 - protein, 21 aa, Mycobacterium
AGDKVVLWYSSANRDEDIFED

SEQ ID NO: 1310936 - protein, 19 aa, Mycobacterium
AGDLLPLTLARVMSRIDSI

SEQ ID NO: 1310937 - protein, 24 aa, Mycobacterium
AGDQAAFPLGWVHDVVWARESIRG

SEQ ID NO: 1310938 - protein, 25 aa, Mycobacterium
AGDRAFFCEYALRYLARAGLSREDL

SEQ ID NO: 1310939 - protein, 22 aa, Mycobacterium
AGDRIPAYRLSAGSKLPGRPTL

SEQ ID NO: 1310940 - protein, 26 aa, Mycobacterium
AGDRLGEYLAAPLPIVRAVADNQYEA

SEQ ID NO: 1310941 - protein, 18 aa, Mycobacterium
AGDTLFLEGCGRTDFPGG

SEQ ID NO: 1310942 - protein, 23 aa, Mycobacterium
AGDTLYCDVWVDSIRKAHGTDII

SEQ ID NO: 1310943 - protein, 28 aa, Mycobacterium
AGDVQWNFEKFLLAPGGKVVKRIRPRTA

SEQ ID NO: 1310944 - protein, 23 aa, Mycobacterium
AGDVYAAFLQGFRDFFVESAADP

SEQ ID NO: 1310945 - protein, 17 aa, Mycobacterium
AGDWPLSGGYAEHILLP

SEQ ID NO: 1310946 - protein, 21 aa, Mycobacterium
AGDYFTQIKRLLRANPPANPR

SEQ ID NO: 1310947 - protein, 28 aa, Mycobacterium
AGEAVMMGRWRRLGLLRRPKADDRAVVE

SEQ ID NO: 1310948 - protein, 17 aa, Mycobacterium
AGEFLADSTPYLDKVRG

SEQ ID NO: 1310949 - protein, 25 aa, Mycobacterium
AGEGWLNHELYVRAIPSVSVKVFAG

SEQ ID NO: 1310950 - protein, 37 aa, Mycobacterium
AGELHAVIVAPLYLTLPVWSRATLALAYASALIRAEQ

SEQ ID NO: 1310951 - protein, 38 aa, Mycobacterium
AGERLGFLPGTLYEKIDPYLRPLYDALHDMMDPELIPK

SEQ ID NO: 1310952 - protein, 41 aa, Mycobacterium
AGETTWFTRPLIDSYHTVWFELHEELILAAGLTRDQEAKAG

SEQ ID NO: 1310953 - protein, 21 aa, Mycobacterium
AGETYCATAFLYDGRGGRGGC

SEQ ID NO: 1310954 - protein, 25 aa, Mycobacterium
AGEVIAELHSLRLLNLRRATRAIAG

SEQ ID NO: 1310955 - protein, 19 aa, Mycobacterium
AGFDLEMLRAVRGAVTVPV

SEQ ID NO: 1310956 - protein, 34 aa, Mycobacterium
AGFDPTRPTAWIAEGLLIYLPPDAQDRLLDHITA

SEQ ID NO: 1310957 - protein, 17 aa, Mycobacterium
AGFGIRVTIVEPGYFRT

SEQ ID NO: 1310958 - protein, 18 aa, Mycobacterium
AGFGLRTLIHMDDPHHRK

SEQ ID NO: 1310959 - protein, 22 aa, Mycobacterium
AGFIGSPAMNFFPAALTEIGVR

SEQ ID NO: 1310960 - protein, 23 aa, Mycobacterium
AGFMKILGPEFLNRFPGRVVNTH

SEQ ID NO: 1310961 - protein, 22 aa, Mycobacterium
AGFPCFSAMPTPGDALLIGLDK

SEQ ID NO: 1310962 - protein, 18 aa, Mycobacterium
AGFQPLPGAAVYSATKAY

SEQ ID NO: 1310963 - protein, 18 aa, Mycobacterium
AGFQWARHNICVNAIAPI

SEQ ID NO: 1310964 - protein, 17 aa, Mycobacterium
AGFSQRAIAERLGIDQA

SEQ ID NO: 1310965 - protein, 17 aa, Mycobacterium
AGFTTIALDRPGYGTSA

SEQ ID NO: 1310966 - protein, 17 aa, Mycobacterium
AGFYHDRYRRTPDGWRI

SEQ ID NO: 1310967 - protein, 25 aa, Mycobacterium
AGGATTPAWSPTGAPGAGGPALPAA

SEQ ID NO: 1310968 - protein, 25 aa, Mycobacterium
AGGEALLFREPVTLIYAVAPTVVSW

SEQ ID NO: 1310969 - protein, 26 aa, Mycobacterium
AGGEKPWLPHFYLGHGIGTSAAEMPM

SEQ ID NO: 1310970 - protein, 25 aa, Mycobacterium
AGGGRPVLAIARFAQFLAAAGIDRI

SEQ ID NO: 1310971 - protein, 19 aa, Mycobacterium
AGGIPAILGELWRGGHLHE

SEQ ID NO: 1310972 - protein, 17 aa, Mycobacterium
AGGLFNTTLRGTGWVAL

SEQ ID NO: 1310973 - protein, 24 aa, Mycobacterium
AGGLLALIENPDAYRALRADPGLL

SEQ ID NO: 1310974 - protein, 17 aa, Mycobacterium
AGGPFTEAGARTWRVVP

SEQ ID NO: 1310975 - protein, 26 aa, Mycobacterium
AGGPLGTGFPQGLPGLGGQAYPAQGG

SEQ ID NO: 1310976 - protein, 26 aa, Mycobacterium
AGGRALVGRFLAALDKLPNVTCWRNA

SEQ ID NO: 1310977 - protein, 29 aa, Mycobacterium
AGGRHTYWLGERLAAIATDLLYFVEPGHE

SEQ ID NO: 1310978 - protein, 22 aa, Mycobacterium
AGGRISLQLWHVGRLTHETLQG

SEQ ID NO: 1310979 - protein, 18 aa, Mycobacterium
AGGRRRRIRRRSGPGTRR

SEQ ID NO: 1310980 - protein, 20 aa, Mycobacterium
AGGRTTGGAGCPGLVNDRAV

SEQ ID NO: 1310981 - protein, 23 aa, Mycobacterium
AGGSASYYFPLSSALTPEFDVFG

SEQ ID NO: 1310982 - protein, 22 aa, Mycobacterium
AGGSPSRLLLPGSISIAREIIE

SEQ ID NO: 1310983 - protein, 31 aa, Mycobacterium
AGGTGQGVTGFLALPHRYNISGDGGDGGNGA

SEQ ID NO: 1310984 - protein, 25 aa, Mycobacterium
AGGVGLILTQWATSLAAKVITTVST

SEQ ID NO: 1310985 - protein, 24 aa, Mycobacterium
AGGVGLILTQWATSLAASVITTVS

SEQ ID NO: 1310986 - protein, 25 aa, Mycobacterium
AGGVLGKVRFLYFSPREYLVVFGSP

SEQ ID NO: 1310987 - protein, 26 aa, Mycobacterium
AGHGLHMFATLLNAAGRRRGPGAVRP

SEQ ID NO: 1310988 - protein, 24 aa, Mycobacterium
AGHLDVYQWLTVLQEYLVVCLMGN

SEQ ID NO: 1310989 - protein, 19 aa, Mycobacterium
AGHPYMAQILIKAEPRPSW

SEQ ID NO: 1310990 - protein, 19 aa, Mycobacterium
AGHVFIYGPVRLDDRAVAH

SEQ ID NO: 1310991 - protein, 24 aa, Mycobacterium
AGIADGPFAGVPFLIKDLAQDYAG

SEQ ID NO: 1310992 - protein, 17 aa, Mycobacterium
AGILDLTMGFAVAQTIY

SEQ ID NO: 1310993 - protein, 19 aa, Mycobacterium
AGILITSHPALRDAMLHLA

SEQ ID NO: 1310994 - protein, 17 aa, Mycobacterium
AGILRDVISARLAFVVS

SEQ ID NO: 1310995 - protein, 30 aa, Mycobacterium
AGIMLRNRPVHVAALLGVLRGGGTVVVINP

SEQ ID NO: 1310996 - protein, 27 aa, Mycobacterium
AGIPAVTFWAAVPHYVSQPPSPKATVA

SEQ ID NO: 1310997 - protein, 26 aa, Mycobacterium
AGIQADMRTFALLGLHGLVAVTAVTV

SEQ ID NO: 1310998 - protein, 26 aa, Mycobacterium
AGISRPTFYFYFASKDAVLLTLLERV

SEQ ID NO: 1310999 - protein, 23 aa, Mycobacterium
AGITHILTMPWMFYTGADATLAE

SEQ ID NO: 1311000 - protein, 26 aa, Mycobacterium
AGITRGALYFYFGSKQEVLTALVART

SEQ ID NO: 1311001 - protein, 17 aa, Mycobacterium
AGKKIQAIKLLREQTGL

SEQ ID NO: 1311002 - protein, 19 aa, Mycobacterium
AGKLAKWLKGQGHTPLLVA

SEQ ID NO: 1311003 - protein, 19 aa, Mycobacterium
AGKLRAGSLIPLTSAGAYP

SEQ ID NO: 1311004 - protein, 26 aa, Mycobacterium
AGKSTLVQWLLERIGQLRGAGWVAHV

SEQ ID NO: 1311005 - protein, 19 aa, Mycobacterium
AGLAAPWWDSAATASFSGM

SEQ ID NO: 1311006 - protein, 20 aa, Mycobacterium
AGLAFDWAALRAGDRVLIHA

SEQ ID NO: 1311007 - protein, 18 aa, Mycobacterium
AGLARRSAAVPAAETDLL

SEQ ID NO: 1311008 - protein, 30 aa, Mycobacterium
AGLDADAVAIPYLIDWEALESAEWELLTSA

SEQ ID NO: 1311009 - protein, 26 aa, Mycobacterium
AGLDRPFGIGLVHWVVEARPDLLERA

SEQ ID NO: 1311010 - protein, 17 aa, Mycobacterium
AGLEPRRARARTANKAA

SEQ ID NO: 1311011 - protein, 24 aa, Mycobacterium
AGLGDTWFEGPPPIHQGKLFAGHT

SEQ ID NO: 1311012 - protein, 25 aa, Mycobacterium
AGLGRPVRRVPLSPKVLLAVGRLSD

SEQ ID NO: 1311013 - protein, 25 aa, Mycobacterium
AGLGWGMYPIQLLDASFVPITDQHL

SEQ ID NO: 1311014 - protein, 32 aa, Mycobacterium
AGLHAYRGPWQYETLAREIMFDIAARKLDIDP

SEQ ID NO: 1311015 - protein, 21 aa, Mycobacterium
AGLIDELGILTWRQIDQRADA

SEQ ID NO: 1311016 - protein, 29 aa, Mycobacterium
AGLIKVVLSLQHNLLPQSLHFENPSPHIP

SEQ ID NO: 1311017 - protein, 19 aa, Mycobacterium
AGLKDFLQWRDLTCRFPGC

SEQ ID NO: 1311018 - protein, 22 aa, Mycobacterium
AGLKTPIVHGMWLSAAAQHAVT

SEQ ID NO: 1311019 - protein, 17 aa, Mycobacterium
AGLLAGAYLKKAGVEGI

SEQ ID NO: 1311020 - protein, 30 aa, Mycobacterium
AGLLAPRQALTGPSLPPLLPATAAAQAHGL

SEQ ID NO: 1311021 - protein, 28 aa, Mycobacterium
AGLLAPRQALTGPSLPPVLPATAAAQAH

SEQ ID NO: 1311022 - protein, 27 aa, Mycobacterium
AGLLAPRQALTGPSLPPVLPATAVAQA

SEQ ID NO: 1311023 - protein, 18 aa, Mycobacterium
AGLLGSVPRLDAHQGSRL

SEQ ID NO: 1311024 - protein, 24 aa, Mycobacterium
AGLPHRRVTRNRGTQLQRARAGEI

SEQ ID NO: 1311025 - protein, 18 aa, Mycobacterium
AGLPLSINGAYPAAVPAP

SEQ ID NO: 1311026 - protein, 26 aa, Mycobacterium
AGLPSSPWYDLGKKLAPKGTGAVLAF

SEQ ID NO: 1311027 - protein, 33 aa, Mycobacterium
AGLPVSDLEFIQFHPTMLYAGHGGGRRPLITEA

SEQ ID NO: 1311028 - protein, 25 aa, Mycobacterium
AGLPYRPMHPWWPSADNDPDAHRQV

SEQ ID NO: 1311029 - protein, 19 aa, Mycobacterium
AGLQVYWEPAAERLADEGF

SEQ ID NO: 1311030 - protein, 25 aa, Mycobacterium
AGLRAGVPTLVLWVAAEQPLWGKQV

SEQ ID NO: 1311031 - protein, 18 aa, Mycobacterium
AGLRGTLYRNGPGRWEDH

SEQ ID NO: 1311032 - protein, 33 aa, Mycobacterium
AGLRPAFYNEAIGARFPQIGWNITPGNSSPLSD

SEQ ID NO: 1311033 - protein, 23 aa, Mycobacterium
AGLTPLLKMHTLGMDFVPDPIHA

SEQ ID NO: 1311034 - protein, 17 aa, Mycobacterium
AGLVAHQEVLFGTMGET

SEQ ID NO: 1311035 - protein, 19 aa, Mycobacterium
AGLVMTLDQPYPAAVARLS

SEQ ID NO: 1311036 - protein, 26 aa, Mycobacterium
AGLVPFSHRLAAEEWRSLRLAIKQET

SEQ ID NO: 1311037 - protein, 29 aa, Mycobacterium
AGLVRMVRPWNEWLIVWGYDINDEPPALD

SEQ ID NO: 1311038 - protein, 19 aa, Mycobacterium
AGLVWLAREMAADPEFRVV

SEQ ID NO: 1311039 - protein, 19 aa, Mycobacterium
AGLWAITGVKSLEGLLAWK

SEQ ID NO: 1311040 - protein, 20 aa, Mycobacterium
AGMDAFRAWRLLVTEYGTPA

SEQ ID NO: 1311041 - protein, 21 aa, Mycobacterium
AGMHPWGKWGRDFTEYGVVAA

SEQ ID NO: 1311042 - protein, 23 aa, Mycobacterium
AGMLLIAGGLFDRAYVSPATVDY

SEQ ID NO: 1311043 - protein, 20 aa, Mycobacterium
AGMLPVFRHTVEELFTAGLV

SEQ ID NO: 1311044 - protein, 22 aa, Mycobacterium
AGMRIHVLAPSGTFVPRSLDTD

SEQ ID NO: 1311045 - protein, 36 aa, Mycobacterium
AGNHIRVYVPFGTQWYGYFVRRLAERPANLTFFLRA

SEQ ID NO: 1311046 - protein, 22 aa, Mycobacterium
AGNKIILFGARTGLDGIGGVSV

SEQ ID NO: 1311047 - protein, 21 aa, Mycobacterium
AGNLKPLFKAWKDEGQIYPDL

SEQ ID NO: 1311048 - protein, 31 aa, Mycobacterium
AGNSDLINRLLPILAPIVLAYIGRKLSGGQA

SEQ ID NO: 1311049 - protein, 20 aa, Mycobacterium
AGNTLVLKPAPDTPWAAAVL

SEQ ID NO: 1311050 - protein, 28 aa, Mycobacterium
AGNVPILVQVLLRLSFALNSIGDLDDAA

SEQ ID NO: 1311051 - protein, 28 aa, Mycobacterium
AGPEYSHLTLSWVYDWMAQGVPVVAMHR

SEQ ID NO: 1311052 - protein, 20 aa, Mycobacterium
AGPGLYRSFSSKQAILDALI

SEQ ID NO: 1311053 - protein, 22 aa, Mycobacterium
AGPGWWLPSLLVRRLDELPLTM

SEQ ID NO: 1311054 - protein, 20 aa, Mycobacterium
AGPKIWEKTGLSPADMDLAC

SEQ ID NO: 1311055 - protein, 29 aa, Mycobacterium
AGPKRQAALNRLLFPAPTKEFEAHREIYG

SEQ ID NO: 1311056 - protein, 20 aa, Mycobacterium
AGPLLRARLFGVGDQRHVLV

SEQ ID NO: 1311057 - protein, 23 aa, Mycobacterium
AGPNILFLAVPDGKVVKNRLHVD

SEQ ID NO: 1311058 - protein, 21 aa, Mycobacterium
AGPWLTVPPHGYGGIENMIAT

SEQ ID NO: 1311059 - protein, 33 aa, Mycobacterium
AGQACSAGTFYWPFGFAILGDRFWVADTGNRRV

SEQ ID NO: 1311060 - protein, 21 aa, Mycobacterium
AGQFLTLRVSVGGRDLRRCYS

SEQ ID NO: 1311061 - protein, 18 aa, Mycobacterium
AGQLLERARFAAAAYADY

SEQ ID NO: 1311062 - protein, 27 aa, Mycobacterium
AGQLLRRVRARLARLAGAGLMIPTGGA

SEQ ID NO: 1311063 - protein, 17 aa, Mycobacterium
AGQLVRLAAAAPRAATA

SEQ ID NO: 1311064 - protein, 23 aa, Mycobacterium
AGQPFFPEFRRNEAGQYVPVNAQ

SEQ ID NO: 1311065 - protein, 33 aa, Mycobacterium
AGQPLDHWDFYMALAYFKLAIIGAGIAYRAREA

SEQ ID NO: 1311066 - protein, 20 aa, Mycobacterium
AGQPPLQWRDGAAVTVVVAA

SEQ ID NO: 1311067 - protein, 23 aa, Mycobacterium
AGQRAHVLLSHLAQALTDSPVSA

SEQ ID NO: 1311068 - protein, 18 aa, Mycobacterium
AGQRIKPPYVAAYVLLDG

SEQ ID NO: 1311069 - protein, 21 aa, Mycobacterium
AGQRIKPPYVAAYVLLDGADI

SEQ ID NO: 1311070 - protein, 24 aa, Mycobacterium
AGQRWPRFVPAAREAGIVLGALGL

SEQ ID NO: 1311071 - protein, 17 aa, Mycobacterium
AGQSIGAFLPPGITIEL

SEQ ID NO: 1311072 - protein, 24 aa, Mycobacterium
AGQSIGAFLPPGITLELVGDANDY

SEQ ID NO: 1311073 - protein, 31 aa, Mycobacterium
AGQSIRVIGSRRVVLAFDPTADDPDLLRTVL

SEQ ID NO: 1311074 - protein, 24 aa, Mycobacterium
AGRAAAWLQALLPALAEYAEFIDG

SEQ ID NO: 1311075 - protein, 25 aa, Mycobacterium
AGRAAAWLQALLPALAEYAEFIDGG

SEQ ID NO: 1311076 - protein, 24 aa, Mycobacterium
AGRATAWLQALLPALAEYAEFIDG

SEQ ID NO: 1311077 - protein, 20 aa, Mycobacterium
AGRGFAAYGTAKAALAHYTR

SEQ ID NO: 1311078 - protein, 29 aa, Mycobacterium
AGRGKRLWSSQRRPGVRTLQFLRSEQPKH

SEQ ID NO: 1311079 - protein, 26 aa, Mycobacterium
AGRGLGRAYALMLAADGAKVVVNDSG

SEQ ID NO: 1311080 - protein, 27 aa, Mycobacterium
AGRHFDGVLLHPFLTPAAVGRSVQIVR

SEQ ID NO: 1311081 - protein, 21 aa, Mycobacterium
AGRIVFNGWPTGVEVTHAMVH

SEQ ID NO: 1311082 - protein, 19 aa, Mycobacterium
AGRKMVYLTQFDAGRWVDL

SEQ ID NO: 1311083 - protein, 23 aa, Mycobacterium
AGRLAAPIRYALAATLEVAPTIR

SEQ ID NO: 1311084 - protein, 17 aa, Mycobacterium
AGRMRRHLPHHRARHHR

SEQ ID NO: 1311085 - protein, 19 aa, Mycobacterium
AGRNRPGGVAALVGPPGNA

SEQ ID NO: 1311086 - protein, 30 aa, Mycobacterium
AGRPGACWPLADIPLDWVLDGAVRAGVRLR

SEQ ID NO: 1311087 - protein, 19 aa, Mycobacterium
AGRQLFDPGLIASAHLIAA

SEQ ID NO: 1311088 - protein, 24 aa, Mycobacterium
AGRRRLMTDLYKRVIDGVADLGFP

SEQ ID NO: 1311089 - protein, 24 aa, Mycobacterium
AGRRRLSEVGLLRRSSDGSVRVST

SEQ ID NO: 1311090 - protein, 42 aa, Mycobacterium
AGRRTLETLLRLPVDGILFAVEWKQFWDASWGRRPARMKDAL

SEQ ID NO: 1311091 - protein, 21 aa, Mycobacterium
AGRTRYRLLETVRQYAQEKLG

SEQ ID NO: 1311092 - protein, 32 aa, Mycobacterium
AGRVVEFMLLDRLFPRSIFYSLRLAEHSLDEL

SEQ ID NO: 1311093 - protein, 31 aa, Mycobacterium
AGRYNLCPEMKFYATPPIDGAFCRYVVIDDD

SEQ ID NO: 1311094 - protein, 28 aa, Mycobacterium
AGRYVLDRAIFDALRRIPRGAGGELQLT

SEQ ID NO: 1311095 - protein, 24 aa, Mycobacterium
AGRYVLDRAIFDALRRVKRGAGNE

SEQ ID NO: 1311096 - protein, 26 aa, Mycobacterium
AGSAALTLAIYYPQQFQYAASLSGFL

SEQ ID NO: 1311097 - protein, 29 aa, Mycobacterium
AGSADKMRAGLLALLSYARSGDVVVVVAL

SEQ ID NO: 1311098 - protein, 27 aa, Mycobacterium
AGSAPATLLDYFPEDFLLVIDESHVTV

SEQ ID NO: 1311099 - protein, 32 aa, Mycobacterium
AGSDRIRFTPYQKLIVLDVPDEKLDELRAGLD

SEQ ID NO: 1311100 - protein, 23 aa, Mycobacterium
AGSKPFDFVFHGGSGSLKSEIED

SEQ ID NO: 1311101 - protein, 27 aa, Mycobacterium
AGSLNRPGYLRFDFNWQGALTDDQRSQ

SEQ ID NO: 1311102 - protein, 18 aa, Mycobacterium
AGSLPAEWWGADAPGSPP

SEQ ID NO: 1311103 - protein, 25 aa, Mycobacterium
AGSPAPFYRAAGPEVEIFRAAARRG

SEQ ID NO: 1311104 - protein, 23 aa, Mycobacterium
AGSPAPVLLHGLDESCWPLLEHA

SEQ ID NO: 1311105 - protein, 25 aa, Mycobacterium
AGSSLLNPMFLFRGGAPVKEFAGAF

SEQ ID NO: 1311106 - protein, 19 aa, Mycobacterium
AGSVFFTAATELGLRTVPE

SEQ ID NO: 1311107 - protein, 25 aa, Mycobacterium
AGSVVPPIPPPPPTATSQLDAALAL

SEQ ID NO: 1311108 - protein, 28 aa, Mycobacterium
AGSYPDRFIPIAILPTWNVEAMCAEIRR

SEQ ID NO: 1311109 - protein, 22 aa, Mycobacterium
AGTAILFLLMPGQQSAWHTVRS

SEQ ID NO: 1311110 - protein, 35 aa, Mycobacterium
AGTELRYLLATSVPAWWVPYVPRLMRTPQLDGTPD

SEQ ID NO: 1311111 - protein, 21 aa, Mycobacterium
AGTHVLVLMASLDGPAAGLIH

SEQ ID NO: 1311112 - protein, 18 aa, Mycobacterium
AGTLAPTGALPGGERDLT

SEQ ID NO: 1311113 - protein, 32 aa, Mycobacterium
AGTLLVRGPYGRGFPISVLFGSIYAARGYHVV

SEQ ID NO: 1311114 - protein, 17 aa, Mycobacterium
AGTLRYVGTPTGLAGLI

SEQ ID NO: 1311115 - protein, 18 aa, Mycobacterium
AGTPMRQIPVDTVFVGSC

SEQ ID NO: 1311116 - protein, 23 aa, Mycobacterium
AGTYFLCADPRPLGYDDSTTFCA

SEQ ID NO: 1311117 - protein, 28 aa, Mycobacterium
AGVAAPVQGAWQLLIELAGETDLTDRLA

SEQ ID NO: 1311118 - protein, 20 aa, Mycobacterium
AGVATWWRTVGPKVAGLPNL

SEQ ID NO: 1311119 - protein, 19 aa, Mycobacterium
AGVAVPIPEGYRIQLDPSI

SEQ ID NO: 1311120 - protein, 26 aa, Mycobacterium
AGVDFMPVVWAMFEWGRSHLPNNGRL

SEQ ID NO: 1311121 - protein, 26 aa, Mycobacterium
AGVGKQTIYRWWPSRHALVADVTLED

SEQ ID NO: 1311122 - protein, 33 aa, Mycobacterium
AGVIDLITIGNRKIWFFTPAPLPDAMVNHVVAV

SEQ ID NO: 1311123 - protein, 18 aa, Mycobacterium
AGVLLAMINPDGAQPCDK

SEQ ID NO: 1311124 - protein, 18 aa, Mycobacterium
AGVLTGRRVLICGAGMLG

SEQ ID NO: 1311125 - protein, 20 aa, Mycobacterium
AGVPIVGTLPEAIDLAEDRG

SEQ ID NO: 1311126 - protein, 18 aa, Mycobacterium
AGVPLLRLAAQTALLQAE

SEQ ID NO: 1311127 - protein, 25 aa, Mycobacterium
AGVRAGVPTLVLWVGAEQPIWGSRV

SEQ ID NO: 1311128 - protein, 20 aa, Mycobacterium
AGVRIFDTLFAVGVARWQQR

SEQ ID NO: 1311129 - protein, 33 aa, Mycobacterium
AGVSKYPARVKCALLGWMAFKDAVAQASHDSQE

SEQ ID NO: 1311130 - protein, 33 aa, Mycobacterium
AGVSKYPARVKCALLGWTAFKAALAQAHGPEIS

SEQ ID NO: 1311131 - protein, 28 aa, Mycobacterium
AGVSRPTLYRWFADKPALLEAFGIYERE

SEQ ID NO: 1311132 - protein, 30 aa, Mycobacterium
AGVSVRVLDITLLAITLRLHLEGPAPWKAW

SEQ ID NO: 1311133 - protein, 24 aa, Mycobacterium
AGVTRWLPRPIHEGALLLDDAASH

SEQ ID NO: 1311134 - protein, 28 aa, Mycobacterium
AGVVFQQPRLFPWRTVGGNVDMALRYAK

SEQ ID NO: 1311135 - protein, 26 aa, Mycobacterium
AGVVLVPINFMLTAEEISFILGHSQV

SEQ ID NO: 1311136 - protein, 28 aa, Mycobacterium
AGWSRTDHYAWIAGLLLDLGIESIDAVD

SEQ ID NO: 1311137 - protein, 22 aa, Mycobacterium
AGYACAIEAHYGRPMDMEWAKD

SEQ ID NO: 1311138 - protein, 26 aa, Mycobacterium
AGYALGGGCELAMMCDILIAADTAKF

SEQ ID NO: 1311139 - protein, 24 aa, Mycobacterium
AGYHRELVEHFILERKWGRWMGRW

SEQ ID NO: 1311140 - protein, 26 aa, Mycobacterium
AGYPGKLPFLAPFNDGLPDLLARLQT

SEQ ID NO: 1311141 - protein, 20 aa, Mycobacterium
AGYRFPRLRFVASVGEPLNA

SEQ ID NO: 1311142 - protein, 17 aa, Mycobacterium
AGYRRYPNWPAMDMTSF

SEQ ID NO: 1311143 - protein, 37 aa, Mycobacterium
AGYVPMLFAAGLPRPVRRVPLLGARLRELLDPSARYL

SEQ ID NO: 1311144 - protein, 17 aa, Mycobacterium
AHAFAALTRIVRAGGRA

SEQ ID NO: 1311145 - protein, 23 aa, Mycobacterium
AHAKLIVATAYFPQTEDARAADV

SEQ ID NO: 1311146 - protein, 24 aa, Mycobacterium
AHAPDLDRRFTLAAGLLELADREF

SEQ ID NO: 1311147 - protein, 35 aa, Mycobacterium
AHAPPYNRRSKFPHRWWWVTLTDEAFPRFSTVRTP

SEQ ID NO: 1311148 - protein, 20 aa, Mycobacterium
AHATLVDHLIPPMARAETYG

SEQ ID NO: 1311149 - protein, 21 aa, Mycobacterium
AHCVRALLADGHRVRLLVGPD

SEQ ID NO: 1311150 - protein, 25 aa, Mycobacterium
AHDEGWLAEHMLILKLISPENKAYY

SEQ ID NO: 1311151 - protein, 23 aa, Mycobacterium
AHDIDHDLLRAITDRLRAIASDK

SEQ ID NO: 1311152 - protein, 28 aa, Mycobacterium
AHDKTPAQVLLRWSIQLGNVVIARSANP

SEQ ID NO: 1311153 - protein, 27 aa, Mycobacterium
AHDRIALEWLTPRFGARVGWLAGAHVA

SEQ ID NO: 1311154 - protein, 19 aa, Mycobacterium
AHDVTLVSWGALALLRAAG

SEQ ID NO: 1311155 - protein, 34 aa, Mycobacterium; identical to SEQ ID NO: 791414

SEQ ID NO: 1311156 - protein, 34 aa, Mycobacterium
AHERSLNIDFLLGYLRQLLPRRPDLKVIVTSATI

SEQ ID NO: 1311157 - protein, 27 aa, Mycobacterium
AHESDFTLELPLAPMLGTVGVAPALRE

SEQ ID NO: 1311158 - protein, 19 aa, Mycobacterium
AHFVPYTLQWCPIRATTVA

SEQ ID NO: 1311159 - protein, 28 aa, Mycobacterium
AHGAARVWVPAATPLRDAWVPDADLRGV

SEQ ID NO: 1311160 - protein, 19 aa, Mycobacterium
AHGDRVFARLLPTSIELAE

SEQ ID NO: 1311161 - protein, 20 aa, Mycobacterium
AHGELLTLAPFGTADGVVAR

SEQ ID NO: 1311162 - protein, 25 aa, Mycobacterium
AHGFRRLIDNLIDFPKPLVCAVNGI

SEQ ID NO: 1311163 - protein, 23 aa, Mycobacterium
AHGGLGWVYLAFDKNVNDRPVVL

SEQ ID NO: 1311164 - protein, 25 aa, Mycobacterium
AHGHRTQLELGGKAPFVVFDDADLD

SEQ ID NO: 1311165 - protein, 24 aa, Mycobacterium
AHGYHSLALIGGLIQEVFLIDNLR

SEQ ID NO: 1311166 - protein, 24 aa, Mycobacterium
AHHVAAWRAARLLVLDAFGTAEAA

SEQ ID NO: 1311167 - protein, 21 aa, Mycobacterium
AHHYLAVFDRATGSALDLFRT

SEQ ID NO: 1311168 - protein, 19 aa, Mycobacterium
AHHYLWRIRNALPTPGHIG

SEQ ID NO: 1311169 - protein, 18 aa, Mycobacterium
AHIPNLREFTRALRGLMC

SEQ ID NO: 1311170 - protein, 20 aa, Mycobacterium
AHLMPVWQGQGYNSGIRDAA

SEQ ID NO: 1311171 - protein, 18 aa, Mycobacterium
AHLVVWPADSGESAVEDR

SEQ ID NO: 1311172 - protein, 30 aa, Mycobacterium
AHLYVYGHDLDMRTLFPLPADRPVDPATDY

SEQ ID NO: 1311173 - protein, 29 aa, Mycobacterium
AHMLTPTIATAYSTVLRKLLHTFEAVDEA

SEQ ID NO: 1311174 - protein, 18 aa, Mycobacterium
AHNAPLRALVTALERENP

SEQ ID NO: 1311175 - protein, 26 aa, Mycobacterium
AHPDVTLVWPPREPGGYTLIIDGRAE

SEQ ID NO: 1311176 - protein, 21 aa, Mycobacterium
AHPGNLYFRDGRAGLLDWQAV

SEQ ID NO: 1311177 - protein, 24 aa, Mycobacterium
AHPKLGLLVLTTFLDEDLVVRAVH

SEQ ID NO: 1311178 - protein, 19 aa, Mycobacterium
AHPVGFQWVVEAKARGTEV

SEQ ID NO: 1311179 - protein, 24 aa, Mycobacterium
AHPYAPVGIVPLFETIDDLQHGAS

SEQ ID NO: 1311180 - protein, 17 aa, Mycobacterium
AHQLLHRAGQRKLIGGQ

SEQ ID NO: 1311181 - protein, 17 aa, Mycobacterium
AHQYASRIHRHATRGEP

SEQ ID NO: 1311182 - protein, 24 aa, Mycobacterium
AHRAHAFIVLARTAPADPAHRHDG

SEQ ID NO: 1311183 - protein, 27 aa, Mycobacterium
AHREAYQRIFDLLKVRYVIVSAVSGAM

SEQ ID NO: 1311184 - protein, 17 aa, Mycobacterium
AHREHLATLPFDDTRDF

SEQ ID NO: 1311185 - protein, 23 aa, Mycobacterium
AHRKALAAFRRAGGRIVEMVPHT

SEQ ID NO: 1311186 - protein, 23 aa, Mycobacterium
AHRPRFDALGRWLLARTADLSAE

SEQ ID NO: 1311187 - protein, 17 aa, Mycobacterium
AHRRATFEVFARRLPDG

SEQ ID NO: 1311188 - protein, 25 aa, Mycobacterium
AHRSHRALGPIFDKLAAVSAGAVAV

SEQ ID NO: 1311189 - protein, 27 aa, Mycobacterium
AHSSVSPVMVLLAKVLGRLSPGLPVEN

SEQ ID NO: 1311190 - protein, 18 aa, Mycobacterium
AHTGQWRYDGYRADALAS

SEQ ID NO: 1311191 - protein, 54 aa, Mycobacterium
AHTHSWEALFRARLDNLPLEHWMLLSYPVLGLAPLSPDLIRLRSALVAIESLRN

SEQ ID NO: 1311192 - protein, 23 aa, Mycobacterium
AHTLAMQGLCGELRLADFDDLEL

SEQ ID NO: 1311193 - protein, 17 aa, Mycobacterium
AHTVAVDPVLSGGGVRI

SEQ ID NO: 1311194 - protein, 36 aa, Mycobacterium
AHVAKGTVYLYWPTKEDLLIGLIGRGFLHVLDDLVQ

SEQ ID NO: 1311195 - protein, 18 aa, Mycobacterium
AHVDLYFEAAVAGAIPVI

SEQ ID NO: 1311196 - protein, 27 aa, Mycobacterium
AHVDPSMVLYLFGSKLDLFRESLRLIL

SEQ ID NO: 1311197 - protein, 17 aa, Mycobacterium
AHVILAVRNLELGAQRA

SEQ ID NO: 1311198 - protein, 31 aa, Mycobacterium
AHVITLAPPLNMNPHWLGAHPTYTLSKYGMT

SEQ ID NO: 1311199 - protein, 17 aa, Mycobacterium
AHVLDPKAVKRPGAPYA

SEQ ID NO: 1311200 - protein, 22 aa, Mycobacterium
AHVPTYSQWLARQDWTKPYQRH

SEQ ID NO: 1311201 - protein, 18 aa, Mycobacterium
AHVPTYSQWLARQDWTKS

SEQ ID NO: 1311202 - protein, 24 aa, Mycobacterium
AHVRFVDFGWPDFLVAFEYDGDHH

SEQ ID NO: 1311203 - protein, 32 aa, Mycobacterium
AHVRIIQEFVKKLPAWVSWERREHYERDLVGH

SEQ ID NO: 1311204 - protein, 25 aa, Mycobacterium
AIAATLLQDWTQFAAPAVFGAAMRV

SEQ ID NO: 1311205 - protein, 20 aa, Mycobacterium
AIAHPLFRDELLAAADRAAP

SEQ ID NO: 1311206 - protein, 24 aa, Mycobacterium
AIAIRLFDALATFLNKAAAGKHPW

SEQ ID NO: 1311207 - protein, 18 aa, Mycobacterium
AIAMDLAGPKLRTGPIRP

SEQ ID NO: 1311208 - protein, 22 aa, Mycobacterium
AIARALAMDPKLMLFDEPTSAL

SEQ ID NO: 1311209 - protein, 19 aa, Mycobacterium
AIARLAGLEILRRSRDDDD

SEQ ID NO: 1311210 - protein, 20 aa, Mycobacterium
AIARPDCILLDLHLHDTDGI

SEQ ID NO: 1311211 - protein, 23 aa, Mycobacterium
AIARRFAHLTYRGEVELDDRFGN

SEQ ID NO: 1311212 - protein, 26 aa, Mycobacterium
AIASVVKLFIADDLLLSGKPLSPEDV

SEQ ID NO: 1311213 - protein, 23 aa, Mycobacterium
AIAVPVNFRMTPAEIAFLVSDCE

SEQ ID NO: 1311214 - protein, 30 aa, Mycobacterium
AIAVSNRLRPWLPLLLALTANSAIYRNADT

SEQ ID NO: 1311215 - protein, 34 aa, Mycobacterium
AIDAASPIDLAAAANLNVAAPIDAAAGANVLTYG

SEQ ID NO: 1311216 - protein, 19 aa, Mycobacterium
AIDADLVEQLRLKCALVRA

SEQ ID NO: 1311217 - protein, 18 aa, Mycobacterium
AIDFIKRQHEADTPFFVW

SEQ ID NO: 1311218 - protein, 26 aa, Mycobacterium
AIDPRLRSDAYWPQLADQLVKAARIT

SEQ ID NO: 1311219 - protein, 20 aa, Mycobacterium
AIDQALLNHVLVGIADAGSA

SEQ ID NO: 1311220 - protein, 22 aa, Mycobacterium
AIDQLWPKLTPEVLLAELYSSP

SEQ ID NO: 1311221 - protein, 19 aa, Mycobacterium
AIDRLLNLSPTRKIDLRAN

SEQ ID NO: 1311222 - protein, 34 aa, Mycobacterium; identical to SEQ ID NO: 791728

SEQ ID NO: 1311223 - protein, 30 aa, Mycobacterium
AIEEGFILDVLKNYTPYKTAFRLTHNGQAY

SEQ ID NO: 1311224 - protein, 32 aa, Mycobacterium
AIEELRSLHFALEWLRMCELIRVTSTEPGKVM

SEQ ID NO: 1311225 - protein, 23 aa, Mycobacterium
AIEGRGIGFTERPPRKPVIAAVE

SEQ ID NO: 1311226 - protein, 28 aa, Mycobacterium
AIEMSDMLLGKQGIDPRVLDLAKQIKAA

SEQ ID NO: 1311227 - protein, 25 aa, Mycobacterium
AIEMSDMLLGKQGIDPRVVDLAKQI

SEQ ID NO: 1311228 - protein, 17 aa, Mycobacterium
AIENLCYIGLTNNLWGD

SEQ ID NO: 1311229 - protein, 29 aa, Mycobacterium
AIEPAGVMRWPFKLLAPVVKSGFGRMAAD

SEQ ID NO: 1311230 - protein, 17 aa, Mycobacterium
AIEPGELVALLGPSGCG

SEQ ID NO: 1311231 - protein, 17 aa, Mycobacterium
AIEPLIDLYRPYVDGLE

SEQ ID NO: 1311232 - protein, 17 aa, Mycobacterium
AIERPIFVTGLPRTGTT

SEQ ID NO: 1311233 - protein, 31 aa, Mycobacterium
AIEVHPIRRNIQHADLLVVRRGEKVTVEVNI

SEQ ID NO: 1311234 - protein, 18 aa, Mycobacterium
AIEVYPHPATVVLFDLEK

SEQ ID NO: 1311235 - protein, 29 aa, Mycobacterium
AIEVYWRPGCPFCRRLMRALRGSGLTLRE

SEQ ID NO: 1311236 - protein, 17 aa, Mycobacterium
AIFPNLGFVGPNIFAAA

SEQ ID NO: 1311237 - protein, 18 aa, Mycobacterium
AIFVAKRVFAERDLLPVA

SEQ ID NO: 1311238 - protein, 21 aa, Mycobacterium
AIGAVLSMHFAQQAAKYFESV

SEQ ID NO: 1311239 - protein, 24 aa, Mycobacterium
AIGDLILHRASGPMPKWYAPVGSL

SEQ ID NO: 1311240 - protein, 22 aa, Mycobacterium
AIGFYGPLHEYFVARAVAAVRP

SEQ ID NO: 1311241 - protein, 20 aa, Mycobacterium
AIGLHARPAAIIAEAVVEAG

SEQ ID NO: 1311242 - protein, 19 aa, Mycobacterium
AIGRRLERLPHAPAADRER

SEQ ID NO: 1311243 - protein, 28 aa, Mycobacterium
AIGTAPPFVVLRLWLDRPVRHDRAAFVG

SEQ ID NO: 1311244 - protein, 26 aa, Mycobacterium
AIGVNFIDTYFRSGLYPREVPFVVGT

SEQ ID NO: 1311245 - protein, 18 aa, Mycobacterium
AIGYLLRPDSEGSVAITS

SEQ ID NO: 1311246 - protein, 17 aa, Mycobacterium
AIHEYIRRNSSKVLLLT

SEQ ID NO: 1311247 - protein, 28 aa, Mycobacterium
AIHHATGKWLRQLPITLEALLGPRDDDR

SEQ ID NO: 1311248 - protein, 22 aa, Mycobacterium
AIHVIIHALNEWLHEVWGFNYQ

SEQ ID NO: 1311249 - protein, 17 aa, Mycobacterium
AIIAATRELLWQRGFDG

SEQ ID NO: 1311250 - protein, 28 aa, Mycobacterium
AIIAYNYPNQLALAKLAPALAAGCTVVL

SEQ ID NO: 1311251 - protein, 24 aa, Mycobacterium
AIIHSLNQWMLEHWGFSHQNRIYS

SEQ ID NO: 1311252 - protein, 19 aa, Mycobacterium
AIIHYTQGLAFKLAAQGVR

SEQ ID NO: 1311253 - protein, 17 aa, Mycobacterium
AIIMYPSGTVVTFGELE

SEQ ID NO: 1311254 - protein, 31 aa, Mycobacterium; identical to SEQ ID NO: 942599

SEQ ID NO: 1311255 - protein, 17 aa, Mycobacterium
AIKAAARPLPLTPRERE

SEQ ID NO: 1311256 - protein, 19 aa, Mycobacterium
AIKWMSKFNTWAYKATGGR

SEQ ID NO: 1311257 - protein, 27 aa, Mycobacterium
AILDALITRLDEWWSLACIRVLRTDTE

SEQ ID NO: 1311258 - protein, 21 aa, Mycobacterium
AILDEGTLYVAKLSSDIPANE

SEQ ID NO: 1311259 - protein, 25 aa, Mycobacterium
AILDSPMLNYPLTQYMFCSPDEGAA

SEQ ID NO: 1311260 - protein, 17 aa, Mycobacterium
AILLTHAHIDHFGSAMW

SEQ ID NO: 1311261 - protein, 18 aa, Mycobacterium
AILPAWREQGWLDQHTVV

SEQ ID NO: 1311262 - protein, 26 aa, Mycobacterium
AILRVAPLSVAGLLRTRLFEHATTVL

SEQ ID NO: 1311263 - protein, 24 aa, Mycobacterium
AIMPKLLQVTPWTTPALANPGLQR

SEQ ID NO: 1311264 - protein, 31 aa, Mycobacterium
AINDYLGHTAGDWFIRVLAERLRRGADCPNI

SEQ ID NO: 1311265 - protein, 17 aa, Mycobacterium
AINSGFFAREISPVTLP

SEQ ID NO: 1311266 - protein, 18 aa, Mycobacterium
AIPFSADALYFESVLPAD

SEQ ID NO: 1311267 - protein, 22 aa, Mycobacterium
AIQEIILDEFPPHELGAIPVLL

SEQ ID NO: 1311268 - protein, 17 aa, Mycobacterium
AIQNFYLAARAQGLGAC

SEQ ID NO: 1311269 - protein, 20 aa, Mycobacterium
AIRAITCLPALVGAWRHVGG

SEQ ID NO: 1311270 - protein, 40 aa, Mycobacterium
AIRDAEAPLLQRLPDGALMRRAALGLATAIARELTARTGG

SEQ ID NO: 1311271 - protein, 17 aa, Mycobacterium
AIRFEPGVAQHVRLIPL

SEQ ID NO: 1311272 - protein, 17 aa, Mycobacterium
AIRIGLALNCEIVPWCR

SEQ ID NO: 1311273 - protein, 18 aa, Mycobacterium
AIRIGLALNCEIVPWCRF

SEQ ID NO: 1311274 - protein, 19 aa, Mycobacterium
AIRLLIKAGPELAARFEFP

SEQ ID NO: 1311275 - protein, 17 aa, Mycobacterium
AIRLLQQLHAAPLDPEL

SEQ ID NO: 1311276 - protein, 20 aa, Mycobacterium
AIRPVIAELTRRFGVSAAET

SEQ ID NO: 1311277 - protein, 33 aa, Mycobacterium
AIRTDRFLVLPHPELLEMYRNKGGDYDRWIGGM

SEQ ID NO: 1311278 - protein, 27 aa, Mycobacterium
AISAIQPGFYRLHTFISAGEAVDRLAD

SEQ ID NO: 1311279 - protein, 25 aa, Mycobacterium
AITALYPLGPIFHGSGLNITVMSLG

SEQ ID NO: 1311280 - protein, 18 aa, Mycobacterium
AITLAEFFDVPLVSTMHA

SEQ ID NO: 1311281 - protein, 25 aa, Mycobacterium
AITLCWIREAPGLGAAARPLHRLVM

SEQ ID NO: 1311282 - protein, 19 aa, Mycobacterium
AITMARIIGELLPDISVPF

SEQ ID NO: 1311283 - protein, 24 aa, Mycobacterium
AITRNFFKLIAYKDEYEVARMLTD

SEQ ID NO: 1311284 - protein, 24 aa, Mycobacterium
AITRSREVWLVVSGAAKADAVAAA

SEQ ID NO: 1311285 - protein, 20 aa, Mycobacterium
AIVAEIYLGLLRDAPLTVDI

SEQ ID NO: 1311286 - protein, 19 aa, Mycobacterium
AIVATNLSANAIAELAASE

SEQ ID NO: 1311287 - protein, 20 aa, Mycobacterium
AIVDAFLTTKWSEAPRHQRR

SEQ ID NO: 1311288 - protein, 18 aa, Mycobacterium
AIVEALVAVRRYESKTFG

SEQ ID NO: 1311289 - protein, 27 aa, Mycobacterium
AIVFQDALTALNPLYTVGTQLAEPFRI

SEQ ID NO: 1311290 - protein, 25 aa, Mycobacterium
AIVNALVGRVNFARGLLAAACDALS

SEQ ID NO: 1311291 - protein, 19 aa, Mycobacterium
AIVNAPLVHIGGVFRVLQC

SEQ ID NO: 1311292 - protein, 21 aa, Mycobacterium
AIVQIASRRPGTGRWQIVVIE

SEQ ID NO: 1311293 - protein, 18 aa, Mycobacterium
AIVTLFRLLDGAARYRAA

SEQ ID NO: 1311294 - protein, 25 aa, Mycobacterium
AKAELRNLFRELLTRLKTVEFGEPD

SEQ ID NO: 1311295 - protein, 24 aa, Mycobacterium
AKAGALLFDPLRQALTMYAGLEFL

SEQ ID NO: 1311296 - protein, 17 aa, Mycobacterium
AKAKIRQWFAKERREEA

SEQ ID NO: 1311297 - protein, 17 aa, Mycobacterium
AKAMASLLLVVLRGMEA

SEQ ID NO: 1311298 - protein, 17 aa, Mycobacterium
AKAPKMLARDFAPGFRI

SEQ ID NO: 1311299 - protein, 25 aa, Mycobacterium
AKATLRRLYRHPASGQLVAMESKAR

SEQ ID NO: 1311300 - protein, 29 aa, Mycobacterium
AKAYSAAWQVPFYAVNHLGGHLAADVFDH

SEQ ID NO: 1311301 - protein, 24 aa, Mycobacterium
AKDTLPLRQLFTVRIGLRLTEATQ

SEQ ID NO: 1311302 - protein, 18 aa, Mycobacterium
AKEILRNYAIRRPGVPDD

SEQ ID NO: 1311303 - protein, 40 aa, Mycobacterium
AKENPGWHLLRTIAGRITTPLLPDDYLKLANPLWSARELR

SEQ ID NO: 1311304 - protein, 22 aa, Mycobacterium
AKEQLGIVARLAGAALVAKEDS

SEQ ID NO: 1311305 - protein, 22 aa, Mycobacterium
AKEWIACLVPVFRAGQEAGLTG

SEQ ID NO: 1311306 - protein, 18 aa, Mycobacterium
AKEYVACRHDLGGALVLS

SEQ ID NO: 1311307 - protein, 18 aa, Mycobacterium
AKFHKDLPAWVDVDTRAE

SEQ ID NO: 1311308 - protein, 22 aa, Mycobacterium
AKGALIHSLIRTGRALFTAHTN

SEQ ID NO: 1311309 - protein, 22 aa, Mycobacterium
AKGIKLLRREPLGTYDSILALH

SEQ ID NO: 1311310 - protein, 17 aa, Mycobacterium
AKGLEWDAVFLVGLADG

SEQ ID NO: 1311311 - protein, 23 aa, Mycobacterium
AKGRRYTMLLKPGGEFHTHRGII

SEQ ID NO: 1311312 - protein, 27 aa, Mycobacterium
AKGYEPMNFFAPLSRLKELDALPTADA

SEQ ID NO: 1311313 - protein, 23 aa, Mycobacterium
AKIGMYIALRLLRDGAHTTITTR

SEQ ID NO: 1311314 - protein, 21 aa, Mycobacterium
AKIYVHFMPATGLKAGESAPT

SEQ ID NO: 1311315 - protein, 24 aa, Mycobacterium
AKKAAKKAPAKKASPAAAAKTSAA

SEQ ID NO: 1311316 - protein, 25 aa, Mycobacterium
AKKLGLERQWLHARSLAFVHPADGR

SEQ ID NO: 1311317 - protein, 23 aa, Mycobacterium
AKKQKFVLVAPFELWRGEGTQRR

SEQ ID NO: 1311318 - protein, 25 aa, Mycobacterium
AKLDDPFIPVYQIAAPPQPWNSSGA

SEQ ID NO: 1311319 - protein, 26 aa, Mycobacterium
AKLEVVLDLRPALASFTFGLPTVEER

SEQ ID NO: 1311320 - protein, 22 aa, Mycobacterium
AKLGLRDRLALTRYAIRVGLIE

SEQ ID NO: 1311321 - protein, 17 aa, Mycobacterium
AKLIAASRKPVLYVGGG

SEQ ID NO: 1311322 - protein, 21 aa, Mycobacterium
AKLIEDPGAIFVPADSPFQTV

SEQ ID NO: 1311323 - protein, 22 aa, Mycobacterium
AKLISPLRLRGMSAMLARIKNR

SEQ ID NO: 1311324 - protein, 17 aa, Mycobacterium
AKLLDRKPKDLSGGQQQ

SEQ ID NO: 1311325 - protein, 25 aa, Mycobacterium
AKLSHLSHYYVPFPGFDTSVGYRSA

SEQ ID NO: 1311326 - protein, 22 aa, Mycobacterium
AKNMIQAFFLDLQTINGGGSRP

SEQ ID NO: 1311327 - protein, 24 aa, Mycobacterium
AKPEWFYIVKFAMSDLWHGYTGTS

SEQ ID NO: 1311328 - protein, 21 aa, Mycobacterium
AKPFSLLVIADMLGVPEADHE

SEQ ID NO: 1311329 - protein, 18 aa, Mycobacterium
AKPFSLLVVADLLGVPEE

SEQ ID NO: 1311330 - protein, 38 aa, Mycobacterium
AKPGDAPQPPFLWALLSFARRELDNLFAARSTTNAPRT

SEQ ID NO: 1311331 - protein, 24 aa, Mycobacterium
AKPVTNRITVWPRGADIQERVNEG

SEQ ID NO: 1311332 - protein, 29 aa, Mycobacterium
AKQAEQLAFFPLWSYATPTAIELADRLAH

SEQ ID NO: 1311333 - protein, 25 aa, Mycobacterium
AKQVRRLVGFVFTDPDRQILMPTVA

SEQ ID NO: 1311334 - protein, 18 aa, Mycobacterium
AKRAALETLYLVGRSAGR

SEQ ID NO: 1311335 - protein, 22 aa, Mycobacterium
AKRGDLLFWGPGGSQHVAMYLG

SEQ ID NO: 1311336 - protein, 19 aa, Mycobacterium
AKRTPRLARTRAWHTDVRG

SEQ ID NO: 1311337 - protein, 17 aa, Mycobacterium
AKRVLTVSFAGQKWWVA

SEQ ID NO: 1311338 - protein, 24 aa, Mycobacterium
AKRVYTVELDWSGPLPAGSCTCLH

SEQ ID NO: 1311339 - protein, 33 aa, Mycobacterium
AKSFQRLGIRCFGFIPLRLPPELDFAALFHGID

SEQ ID NO: 1311340 - protein, 26 aa, Mycobacterium
AKSLAAAPFADILWMETKTADLADAK

SEQ ID NO: 1311341 - protein, 18 aa, Mycobacterium
AKSNILMLGPTGCGKTYL

SEQ ID NO: 1311342 - protein, 19 aa, Mycobacterium
AKTAMRRSSRATADDVPAT

SEQ ID NO: 1311343 - protein, 24 aa, Mycobacterium
AKTDVLAFTAFPKAHWQKIWSNNP

SEQ ID NO: 1311344 - protein, 27 aa, Mycobacterium
AKTELRHLFRELLTRLNHVEFGEPDLL

SEQ ID NO: 1311345 - protein, 26 aa, Mycobacterium
AKVGRIARILGPRGLMPNPKTGTVTP

SEQ ID NO: 1311346 - protein, 32 aa, Mycobacterium
AKVNFGFDPYFPRIDLRWALRGVSGAERRRRL

SEQ ID NO: 1311347 - protein, 31 aa, Mycobacterium
AKVTTVDGLLVRLLRYLPGGTLIDADHLGPA

SEQ ID NO: 1311348 - protein, 23 aa, Mycobacterium
AKWASSISGYWRRGRTEETFRQW

SEQ ID NO: 1311349 - protein, 17 aa, Mycobacterium
ALAADIESTWKGLLAGE

SEQ ID NO: 1311350 - protein, 25 aa, Mycobacterium
ALAAEPHLLLLDEPMAALDVTTAPA

SEQ ID NO: 1311351 - protein, 26 aa, Mycobacterium
ALAAGVNLLLSPAPTRSFDRAKAMSP

SEQ ID NO: 1311352 - protein, 20 aa, Mycobacterium
ALAAHRRGRRVVLLSKASET

SEQ ID NO: 1311353 - protein, 23 aa, Mycobacterium
ALAALGAIEWPVAAAIGVGQVVV

SEQ ID NO: 1311354 - protein, 20 aa, Mycobacterium
ALAARYTWANRLVAVVSDGS

SEQ ID NO: 1311355 - protein, 26 aa, Mycobacterium
ALAAVPAPLLRWGVGKFNPEARSSTV

SEQ ID NO: 1311356 - protein, 24 aa, Mycobacterium
ALAAYVCGAPMALLSFVDATRQWI

SEQ ID NO: 1311357 - protein, 29 aa, Mycobacterium
ALACRAPSLFNSQPWRWVSEGAVVSLFLD

SEQ ID NO: 1311358 - protein, 29 aa, Mycobacterium
ALADALAPTHTLFLAGRPSPRLDAVAERL

SEQ ID NO: 1311359 - protein, 26 aa, Mycobacterium
ALADGAWPQQRLLNNAPIDVDKAWLA

SEQ ID NO: 1311360 - protein, 22 aa, Mycobacterium
ALADVDVPVLLLTGWQDLFVEQ

SEQ ID NO: 1311361 - protein, 17 aa, Mycobacterium
ALADWMCPRPSRCVAIT

SEQ ID NO: 1311362 - protein, 24 aa, Mycobacterium
ALAEARLLAPHWPPPHGRAAGPAE

SEQ ID NO: 1311363 - protein, 27 aa, Mycobacterium
ALAEFKAMFQMKFYAVALLRSRGVLPS

SEQ ID NO: 1311364 - protein, 19 aa, Mycobacterium
ALAEHFAPLAKTLAENEST

SEQ ID NO: 1311365 - protein, 19 aa, Mycobacterium
ALAELRRVLKPNGQLRFFE

SEQ ID NO: 1311366 - protein, 29 aa, Mycobacterium
ALAEVNGLPWLARLAHGLQQLVLARSGDA

SEQ ID NO: 1311367 - protein, 22 aa, Mycobacterium
ALAGLPIQTWFDVIADNAGKEI

SEQ ID NO: 1311368 - protein, 20 aa, Mycobacterium
ALALDTPLPTPTGWTTMADV

SEQ ID NO: 1311369 - protein, 19 aa, Mycobacterium
ALALFTRHGYAGTSLQMIA

SEQ ID NO: 1311370 - protein, 26 aa, Mycobacterium
ALALKLINNLLFAANAQLLAAATELG

SEQ ID NO: 1311371 - protein, 21 aa, Mycobacterium
ALALQYFHSAPWVAWTDAGRN

SEQ ID NO: 1311372 - protein, 17 aa, Mycobacterium
ALALRGLRKVVADGVVR

SEQ ID NO: 1311373 - protein, 17 aa, Mycobacterium
ALAMLVLTSFEGAIVVA

SEQ ID NO: 1311374 - protein, 24 aa, Mycobacterium
ALAQPGLLLVVTATGREADDLTAE

SEQ ID NO: 1311375 - protein, 27 aa, Mycobacterium
ALASPQPLWALWRFSTAPEATRLTMEF

SEQ ID NO: 1311376 - protein, 24 aa, Mycobacterium
ALASRLWFGDLTSAGLPAPRRGIY

SEQ ID NO: 1311377 - protein, 20 aa, Mycobacterium
ALATALRRVLTQPRLAGEMA

SEQ ID NO: 1311378 - protein, 30 aa, Mycobacterium
ALATLREIPPGNIPLLLIAAVRDQVGAWRG

SEQ ID NO: 1311379 - protein, 25 aa, Mycobacterium
ALATRHLRRHPNAQPVVLVVTDGEP

SEQ ID NO: 1311380 - protein, 18 aa, Mycobacterium
ALAVLERGTGRIVVAANG

SEQ ID NO: 1311381 - protein, 30 aa, Mycobacterium
ALAYAMRCTACWWLGRPGWRRDFDRAVEMA

SEQ ID NO: 1311382 - protein, 25 aa, Mycobacterium
ALCEEWARRGWLAVRYNLPYRRRRP

SEQ ID NO: 1311383 - protein, 19 aa, Mycobacterium
ALCSCYPRPILGNSPEWYR

SEQ ID NO: 1311384 - protein, 22 aa, Mycobacterium
ALDAALGWQRDGAEWIHLVDLD

SEQ ID NO: 1311385 - protein, 19 aa, Mycobacterium
ALDELAYLLGKHPCVAEVF

SEQ ID NO: 1311386 - protein, 25 aa, Mycobacterium
ALDGFTLHIEPGELVALLGPSGCGK

SEQ ID NO: 1311387 - protein, 25 aa, Mycobacterium
ALDITLYRDDLMTKPPRALAATSIP

SEQ ID NO: 1311388 - protein, 25 aa, Mycobacterium
ALDKAGVIPAIVAPAGGILKSGRRT

SEQ ID NO: 1311389 - protein, 23 aa, Mycobacterium
ALDLDSPLFDLGVDSLLALDLRK

SEQ ID NO: 1311390 - protein, 23 aa, Mycobacterium
ALDLFRAKRIASPAQRIMLVARD

SEQ ID NO: 1311391 - protein, 25 aa, Mycobacterium
ALDPKLWNWIAVSGIFLVLNSFTPC

SEQ ID NO: 1311392 - protein, 21 aa, Mycobacterium
ALDQLMRFDFDGRTGWGVFEL

SEQ ID NO: 1311393 - protein, 17 aa, Mycobacterium
ALDRADARDEIAHLAAA

SEQ ID NO: 1311394 - protein, 25 aa, Mycobacterium
ALDTLALLSERWRSIAGPLAARFPE

SEQ ID NO: 1311395 - protein, 28 aa, Mycobacterium
ALDTRAFALWARLSGVVPRIAIVKGRCF

SEQ ID NO: 1311396 - protein, 30 aa, Mycobacterium
ALDVDVIFSPFFNALPIRRTGVYKDGGSVT

SEQ ID NO: 1311397 - protein, 17 aa, Mycobacterium
ALDVLISERPRLTAALD

SEQ ID NO: 1311398 - protein, 26 aa, Mycobacterium
ALDVTTAPALRRLLREVLRDSGRTAI

SEQ ID NO: 1311399 - protein, 20 aa, Mycobacterium
ALDYTLPWDVEAVEDAMPVE

SEQ ID NO: 1311400 - protein, 20 aa, Mycobacterium
ALEALPQVLAYRAGAHLLAG

SEQ ID NO: 1311401 - protein, 23 aa, Mycobacterium
ALEDIVGFPPEFGLRRLMEGAFR

SEQ ID NO: 1311402 - protein, 23 aa, Mycobacterium
ALEGQLLDRSRYVKALAVAAKDQ

SEQ ID NO: 1311403 - protein, 19 aa, Mycobacterium
ALEHPEFWGGIIDVDETLP

SEQ ID NO: 1311404 - protein, 18 aa, Mycobacterium
ALEIARVNRLPVVYLVES

SEQ ID NO: 1311405 - protein, 26 aa, Mycobacterium
ALELGCGTGFFLLNLIQAGVARRGSV

SEQ ID NO: 1311406 - protein, 18 aa, Mycobacterium
ALEMTFFGALVNAGSGAF

SEQ ID NO: 1311407 - protein, 26 aa, Mycobacterium
ALENPVPNPPPYWKPAAEQGLQGVHL

SEQ ID NO: 1311408 - protein, 24 aa, Mycobacterium
ALEPLLRRRHGAWIGWPGVPEDAD

SEQ ID NO: 1311409 - protein, 20 aa, Mycobacterium
ALEPQFYAELLRLLDIDPET

SEQ ID NO: 1311410 - protein, 25 aa, Mycobacterium
ALERALVEDFGFDAALKRPGQPDEI

SEQ ID NO: 1311411 - protein, 27 aa, Mycobacterium
ALERPSQLALTLRLVSGLTVAEIARAL

SEQ ID NO: 1311412 - protein, 20 aa, Mycobacterium
ALESAAARPGLALLATDDPF

SEQ ID NO: 1311413 - protein, 27 aa, Mycobacterium
ALESALTVLALRDGVIPPTLNYETPDP

SEQ ID NO: 1311414 - protein, 25 aa, Mycobacterium
ALESYRRALDLPDLNLRGHLKVRLG

SEQ ID NO: 1311415 - protein, 26 aa, Mycobacterium
ALFAVEMGMARLWRSWGVEPDVVLGH

SEQ ID NO: 1311416 - protein, 19 aa, Mycobacterium
ALFEYRLRQRFWAGRVSHT

SEQ ID NO: 1311417 - protein, 35 aa, Mycobacterium; identical to SEQ ID NO: 124117

SEQ ID NO: 1311418 - protein, 26 aa, Mycobacterium
ALFPSGRAFGYIAYPPRPDGQPTFNE

SEQ ID NO: 1311419 - protein, 23 aa, Mycobacterium
ALGAPEMRPYLAEMSRIADTFVS

SEQ ID NO: 1311420 - protein, 27 aa, Mycobacterium
ALGASTMVLLPLIADRVDLPIICAGGV

SEQ ID NO: 1311421 - protein, 17 aa, Mycobacterium
ALGATLRGGWPAVAVTG

SEQ ID NO: 1311422 - protein, 26 aa, Mycobacterium
ALGATSLKRLLADRLRISDKTAGERL

SEQ ID NO: 1311423 - protein, 24 aa, Mycobacterium
ALGDLPLVYPFLVNDPGEGTQAKR

SEQ ID NO: 1311424 - protein, 24 aa, Mycobacterium
ALGDYEWLLAFEAPELHRIVDLMR

SEQ ID NO: 1311425 - protein, 27 aa, Mycobacterium
ALGGPQAWQLPMSPLGLGYVRTPDGAS

SEQ ID NO: 1311426 - protein, 18 aa, Mycobacterium
ALGGRYLLAAQRAGGDFL

SEQ ID NO: 1311427 - protein, 17 aa, Mycobacterium
ALGGRYLVSAQREDGSF

SEQ ID NO: 1311428 - protein, 25 aa, Mycobacterium
ALGKNLLVAIMPWEGHNYEDAIILS

SEQ ID NO: 1311429 - protein, 22 aa, Mycobacterium
ALGLEFTLYLLRNPDARERVAA

SEQ ID NO: 1311430 - protein, 18 aa, Mycobacterium
ALGLKPRARIVAQANVGA

SEQ ID NO: 1311431 - protein, 17 aa, Mycobacterium
ALGLKPTLAALATGARL

SEQ ID NO: 1311432 - protein, 17 aa, Mycobacterium
ALGLLDEHLGHCVTQAV

SEQ ID NO: 1311433 - protein, 17 aa, Mycobacterium
ALGLYALHHDPALWPDP

SEQ ID NO: 1311434 - protein, 20 aa, Mycobacterium
ALGPSSTWLVAGLDALADDV

SEQ ID NO: 1311435 - protein, 22 aa, Mycobacterium
ALGRAGWSTLFDEFSRGARPRT

SEQ ID NO: 1311436 - protein, 26 aa, Mycobacterium
ALGREAEALQWFLHAAAADVEGVTDA

SEQ ID NO: 1311437 - protein, 19 aa, Mycobacterium
ALGRLTPIEFELLRTSVAT

SEQ ID NO: 1311438 - protein, 25 aa, Mycobacterium
ALGSFAQFEFLLVAAALAEGWAVSV

SEQ ID NO: 1311439 - protein, 19 aa, Mycobacterium
ALGSIDYWFVTEGRRVHKT

SEQ ID NO: 1311440 - protein, 18 aa, Mycobacterium
ALGWGTHSLAPLSFRGAA

SEQ ID NO: 1311441 - protein, 19 aa, Mycobacterium
ALHDVLPADLLAHSLREVV

SEQ ID NO: 1311442 - protein, 25 aa, Mycobacterium
ALHEAKLAMHDLQGRGWTLAGVTSD

SEQ ID NO: 1311443 - protein, 17 aa, Mycobacterium
ALHLTMPISLRASSDAP

SEQ ID NO: 1311444 - protein, 25 aa, Mycobacterium
ALHQLYPLLAHVVLFGGGYIRQTES

SEQ ID NO: 1311445 - protein, 18 aa, Mycobacterium
ALHVAKIARRRHPQHALP

SEQ ID NO: 1311446 - protein, 17 aa, Mycobacterium
ALHVMRYLHESPATKEH

SEQ ID NO: 1311447 - protein, 17 aa, Mycobacterium
ALIDANRGCYEAFRAVY

SEQ ID NO: 1311448 - protein, 18 aa, Mycobacterium
ALIDERRPRYVVADAATV

SEQ ID NO: 1311449 - protein, 21 aa, Mycobacterium
ALIDLGLGLWLTEPAAKAYAG

SEQ ID NO: 1311450 - protein, 19 aa, Mycobacterium
ALIDRLELKPRKAFGPVRV

SEQ ID NO: 1311451 - protein, 22 aa, Mycobacterium
ALIDRRWLGPVSYDELRLDFHM

SEQ ID NO: 1311452 - protein, 17 aa, Mycobacterium
ALILDIFAQHATSREGK

SEQ ID NO: 1311453 - protein, 21 aa, Mycobacterium
ALINRYPRVCGMTGTALAAGE

SEQ ID NO: 1311454 - protein, 33 aa, Mycobacterium
ALINSPPRRWLQRLYEVPVLLRFGGRLPPGSRA

SEQ ID NO: 1311455 - protein, 21 aa, Mycobacterium
ALIRAVFERLRENGARGAVVV

SEQ ID NO: 1311456 - protein, 18 aa, Mycobacterium
ALKDFLALVRKRKRRYPG

SEQ ID NO: 1311457 - protein, 30 aa, Mycobacterium; identical to SEQ ID NO: 792805

SEQ ID NO: 1311458 - protein, 17 aa, Mycobacterium
ALKRELLNGMEAAGFLA

SEQ ID NO: 1311459 - protein, 25 aa, Mycobacterium
ALLADPAVPVFALTTGPRWPDVSGN

SEQ ID NO: 1311460 - protein, 17 aa, Mycobacterium
ALLAGIVEQYVHWAALS

SEQ ID NO: 1311461 - protein, 32 aa, Mycobacterium
ALLASAYVDFSLRLPDTFMLRFRDPGRIVVDK

SEQ ID NO: 1311462 - protein, 20 aa, Mycobacterium
ALLDAPNLVLTPHIASAGEA

SEQ ID NO: 1311463 - protein, 20 aa, Mycobacterium
ALLDGNLLNVNVNVDLDSDL

SEQ ID NO: 1311464 - protein, 27 aa, Mycobacterium
ALLEVRDLLFARLLQYRAFKHVAEMFA

SEQ ID NO: 1311465 - protein, 23 aa, Mycobacterium
ALLHVVSQLRRFLDDLSAREELA

SEQ ID NO: 1311466 - protein, 20 aa, Mycobacterium
ALLIGARPRTKGMERADLLG

SEQ ID NO: 1311467 - protein, 18 aa, Mycobacterium
ALLLAQGAGRLLRRVDDR

SEQ ID NO: 1311468 - protein, 24 aa, Mycobacterium
ALLNGPRYWLMSGIEKPGGTESER

SEQ ID NO: 1311469 - protein, 18 aa, Mycobacterium
ALLRASGGWPWLAPGHDP

SEQ ID NO: 1311470 - protein, 26 aa, Mycobacterium
ALLRGRIERMHRSCLILTFGGGTNEI

SEQ ID NO: 1311471 - protein, 21 aa, Mycobacterium
ALLRLAEHAPPQGLPFLPPGS

SEQ ID NO: 1311472 - protein, 18 aa, Mycobacterium
ALLRRLVEAGTRVVQYGY

SEQ ID NO: 1311473 - protein, 29 aa, Mycobacterium
ALLRSRGVLPSRLRLLYLADGQVLDYSPD

SEQ ID NO: 1311474 - protein, 26 aa, Mycobacterium
ALLRVAPLSVAGLLRSRLFGHTTAVL

SEQ ID NO: 1311475 - protein, 20 aa, Mycobacterium
ALLSCFLRHEALPPDVLTGS

SEQ ID NO: 1311476 - protein, 21 aa, Mycobacterium
ALLSFVDATRQWIKSRHGVDV

SEQ ID NO: 1311477 - protein, 18 aa, Mycobacterium
ALLTKHADKLESSDRDKS

SEQ ID NO: 1311478 - protein, 18 aa, Mycobacterium
ALLVCPMCGHEWSADEVS

SEQ ID NO: 1311479 - protein, 17 aa, Mycobacterium
ALLWLNGAVNTTGDPMA

SEQ ID NO: 1311480 - protein, 21 aa, Mycobacterium
ALMAHNLIFPADLMADVLAGQ

SEQ ID NO: 1311481 - protein, 18 aa, Mycobacterium
ALMLCTRDVLIRIGDEFA

SEQ ID NO: 1311482 - protein, 22 aa, Mycobacterium
ALMPSLFDEEITAGYAGLRAAT

SEQ ID NO: 1311483 - protein, 18 aa, Mycobacterium
ALMRIGNRPTLGYSEATV

SEQ ID NO: 1311484 - protein, 18 aa, Mycobacterium
ALMTTLVRIADRAGADLF

SEQ ID NO: 1311485 - protein, 24 aa, Mycobacterium
ALMTVRWGCLRGANLFFGCGHSDG

SEQ ID NO: 1311486 - protein, 25 aa, Mycobacterium
ALNALRDKLFPLATLVTPNLDEVRL

SEQ ID NO: 1311487 - protein, 28 aa, Mycobacterium
ALNEIDAMQFPVAPWMFGAAGREHMKKY

SEQ ID NO: 1311488 - protein, 19 aa, Mycobacterium
ALNHCVVALAALGWQSKVH

SEQ ID NO: 1311489 - protein, 24 aa, Mycobacterium
ALNLFRTKRIASPAQRIMLIARDG

SEQ ID NO: 1311490 - protein, 32 aa, Mycobacterium; identical to SEQ ID NO: 783755

SEQ ID NO: 1311491 - protein, 22 aa, Mycobacterium
ALNPYLSPAAIKRWEPFIHEIT

SEQ ID NO: 1311492 - protein, 31 aa, Mycobacterium
ALNRLHLTSDLPLLVIWGDEDRIIPVEHGYA

SEQ ID NO: 1311493 - protein, 19 aa, Mycobacterium
ALNWLIDRVIALIQAGDAP

SEQ ID NO: 1311494 - protein, 17 aa, Mycobacterium
ALPANLTVRLLVRAITV

SEQ ID NO: 1311495 - protein, 20 aa, Mycobacterium
ALPAVFFPKPATVEQIWWHW

SEQ ID NO: 1311496 - protein, 19 aa, Mycobacterium
ALPDGLRPVVVIAVGRLGD

SEQ ID NO: 1311497 - protein, 25 aa, Mycobacterium
ALPDHPLELLGIGSVIIEATRPDPL

SEQ ID NO: 1311498 - protein, 20 aa, Mycobacterium
ALPFSAGFGAIYLPGVKALV

SEQ ID NO: 1311499 - protein, 25 aa, Mycobacterium
ALPGVSMFALFTCALHEAFSGVGFD

SEQ ID NO: 1311500 - protein, 21 aa, Mycobacterium
ALPGVWTLESWTHLDVVKESY

SEQ ID NO: 1311501 - protein, 17 aa, Mycobacterium
ALPLGLWVPVLPGTRQV

SEQ ID NO: 1311502 - protein, 19 aa, Mycobacterium
ALPQPFTVAEAKRALRTTR

SEQ ID NO: 1311503 - protein, 20 aa, Mycobacterium
ALPRRGLAVLRRPVRRPLDE

SEQ ID NO: 1311504 - protein, 23 aa, Mycobacterium
ALPVGTGIRRRLEEAFTAAGLTP

SEQ ID NO: 1311505 - protein, 20 aa, Mycobacterium
ALPVLLRPDGAVQIGWDPRR

SEQ ID NO: 1311506 - protein, 19 aa, Mycobacterium
ALQFPYITQAGNTCVINLL

SEQ ID NO: 1311507 - protein, 24 aa, Mycobacterium
ALRAAARAWILAHRDARQCWDDGD

SEQ ID NO: 1311508 - protein, 29 aa, Mycobacterium
ALRAGAAWLRTMFAILPLAVGVKNADVHR

SEQ ID NO: 1311509 - protein, 26 aa, Mycobacterium
ALRAVVPLTRTPIAPRRTRLVEAIVH

SEQ ID NO: 1311510 - protein, 19 aa, Mycobacterium
ALRAWPTPLGVAINSADPI

SEQ ID NO: 1311511 - protein, 17 aa, Mycobacterium
ALRDQIAALRWVRDNIS

SEQ ID NO: 1311512 - protein, 21 aa, Mycobacterium
ALREFGVRVLVIRPGQVRTTT

SEQ ID NO: 1311513 - protein, 17 aa, Mycobacterium
ALREHLGVTAPKKGCDH

SEQ ID NO: 1311514 - protein, 19 aa, Mycobacterium
ALREHLGVTAPKKGCDHGQ

SEQ ID NO: 1311515 - protein, 17 aa, Mycobacterium
ALRFLVTMICAPGVPML

SEQ ID NO: 1311516 - protein, 20 aa, Mycobacterium
ALRGQTHHRWCRECLRAYTV

SEQ ID NO: 1311517 - protein, 23 aa, Mycobacterium
ALRHGHFAYYSLTSLRSLLATVG

SEQ ID NO: 1311518 - protein, 24 aa, Mycobacterium
ALRKTLGVPLFQEQLMQLAVDCAG

SEQ ID NO: 1311519 - protein, 17 aa, Mycobacterium
ALRPTHFAGVLTVVLKL

SEQ ID NO: 1311520 - protein, 33 aa, Mycobacterium; identical to SEQ ID NO: 793070

SEQ ID NO: 1311521 - protein, 33 aa, Mycobacterium; identical to SEQ ID NO: 793071

SEQ ID NO: 1311522 - protein, 23 aa, Mycobacterium
ALRQPPVRVLGWAQAHPGRAGIR

SEQ ID NO: 1311523 - protein, 19 aa, Mycobacterium
ALRQVLGPNAVQAGSLNRP

SEQ ID NO: 1311524 - protein, 18 aa, Mycobacterium
ALRRAALASFAARGFANV

SEQ ID NO: 1311525 - protein, 25 aa, Mycobacterium
ALRRATRSLGLPPGGWYVGVVAISV

SEQ ID NO: 1311526 - protein, 32 aa, Mycobacterium
ALRRDGVTARVLAWLHPPGTDFAPALLADVDV

SEQ ID NO: 1311527 - protein, 17 aa, Mycobacterium
ALRRKFSASQFIPDVRR

SEQ ID NO: 1311528 - protein, 19 aa, Mycobacterium
ALRSFIENDPRWSQGRLRW

SEQ ID NO: 1311529 - protein, 34 aa, Mycobacterium
ALRSTLALLETAPLPGLPPLSSGLVGFFAYDMVR

SEQ ID NO: 1311530 - protein, 20 aa, Mycobacterium
ALRVLWTEDEACHHGEFYDF

SEQ ID NO: 1311531 - protein, 20 aa, Mycobacterium
ALRVRSVLRRSPATGGVLPV

SEQ ID NO: 1311532 - protein, 18 aa, Mycobacterium
ALRYVDALVWTPSAIPVE

SEQ ID NO: 1311533 - protein, 29 aa, Mycobacterium
ALSAAVADPLWMFMRQWQFGEFRGEDAGT

SEQ ID NO: 1311534 - protein, 24 aa, Mycobacterium
ALSALKVLALYEPLDLDSLCELVG

SEQ ID NO: 1311535 - protein, 17 aa, Mycobacterium
ALSAQRLLQILRIIVSS

SEQ ID NO: 1311536 - protein, 25 aa, Mycobacterium
ALSARPGIVLSRRQLLEIIRDEPWV

SEQ ID NO: 1311537 - protein, 25 aa, Mycobacterium
ALSAVRVVALTPGWYDVAFKTPLMD

SEQ ID NO: 1311538 - protein, 28 aa, Mycobacterium
ALSDEEAIGLCFLFILAGLDTVMDSLGF

SEQ ID NO: 1311539 - protein, 25 aa, Mycobacterium
ALSDSELLDFTTLARVFGYPSTAEA

SEQ ID NO: 1311540 - protein, 37 aa, Mycobacterium
ALSGDFLVYLLDTAVARNYFFMTAKKTTNLASTNSTT

SEQ ID NO: 1311541 - protein, 23 aa, Mycobacterium
ALSGIALDWILDGAVRAGAAVCE

SEQ ID NO: 1311542 - protein, 17 aa, Mycobacterium
ALSLLVPQRHYDAVTAW

SEQ ID NO: 1311543 - protein, 18 aa, Mycobacterium
ALSLPSVRGLIVGRTLLY

SEQ ID NO: 1311544 - protein, 19 aa, Mycobacterium
ALSQARTGVFWVREMLPTP

SEQ ID NO: 1311545 - protein, 31 aa, Mycobacterium
ALTAARVIARDSLVKTALFGSDPNWGRVLAA

SEQ ID NO: 1311546 - protein, 25 aa, Mycobacterium
ALTANYVVFMDLPIVFNVDIAVSGR

SEQ ID NO: 1311547 - protein, 17 aa, Mycobacterium
ALTFAMQVGLAAVLRER

SEQ ID NO: 1311548 - protein, 30 aa, Mycobacterium
ALTIPGFSMEGWYGRIFNGCGFFDPDKPIR

SEQ ID NO: 1311549 - protein, 19 aa, Mycobacterium
ALTKALLPAMRAAGRGRIV

SEQ ID NO: 1311550 - protein, 19 aa, Mycobacterium
ALTLGGLLPPRAGRVEARD

SEQ ID NO: 1311551 - protein, 25 aa, Mycobacterium
ALTPYQVLIVASLVQREAAAADFAK

SEQ ID NO: 1311552 - protein, 24 aa, Mycobacterium
ALTRQLRQLLEKRIQPIRLTHHTT

SEQ ID NO: 1311553 - protein, 17 aa, Mycobacterium
ALTRRLPQISSLTVADM

SEQ ID NO: 1311554 - protein, 26 aa, Mycobacterium
ALTRRYAIFVVSPMRINPWALTGHAS

SEQ ID NO: 1311555 - protein, 18 aa, Mycobacterium
ALTSPPAIMLRRCETCPS

SEQ ID NO: 1311556 - protein, 29 aa, Mycobacterium
ALTTDSYVVQPLFFPGGNIGDLAVNGTIN

SEQ ID NO: 1311557 - protein, 25 aa, Mycobacterium
ALTTVLLGHFEAPNGVRRLVVSPDG

SEQ ID NO: 1311558 - protein, 22 aa, Mycobacterium
ALTWAGACRPGDGLGISGDEVL

SEQ ID NO: 1311559 - protein, 20 aa, Mycobacterium
ALTYPRRLGFGLGETVVSLA

SEQ ID NO: 1311560 - protein, 20 aa, Mycobacterium
ALVARDGLVLGELPAGSVIG

SEQ ID NO: 1311561 - protein, 24 aa, Mycobacterium
ALVARPRMLILDEPLASLDLRNQH

SEQ ID NO: 1311562 - protein, 30 aa, Mycobacterium
ALVDGNMPMAWAAAWIFLHINGISLGEFDV

SEQ ID NO: 1311563 - protein, 28 aa, Mycobacterium
ALVDPRNWTLLKWLDEPVPFLDRHANRE

SEQ ID NO: 1311564 - protein, 19 aa, Mycobacterium
ALVEALRDEFDFRYLVGVV

SEQ ID NO: 1311565 - protein, 29 aa, Mycobacterium
ALVENSPVIFLGGQRARITERRVRRGRIQ

SEQ ID NO: 1311566 - protein, 17 aa, Mycobacterium
ALVESALWEASLFEEHG

SEQ ID NO: 1311567 - protein, 27 aa, Mycobacterium
ALVGSVSMAAQWWLDVREPKKEVVAAH

SEQ ID NO: 1311568 - protein, 18 aa, Mycobacterium
ALVLERWGSDGWRFRHEL

SEQ ID NO: 1311569 - protein, 19 aa, Mycobacterium
ALVLGDWPETPVDDPPALP

SEQ ID NO: 1311570 - protein, 20 aa, Mycobacterium
ALVNYPSALLLDEPLGALDL

SEQ ID NO: 1311571 - protein, 18 aa, Mycobacterium
ALVRRKAAIEARSGLRVM

SEQ ID NO: 1311572 - protein, 18 aa, Mycobacterium
ALVSFYLSSGVRASELLG

SEQ ID NO: 1311573 - protein, 27 aa, Mycobacterium
ALVTDIGRWVYTSGFRKLVIVNAHATN

SEQ ID NO: 1311574 - protein, 28 aa, Mycobacterium
ALVVGPPHTLIWPNLFLAEMNVMFVEPQ

SEQ ID NO: 1311575 - protein, 21 aa, Mycobacterium
ALVVGVGAWWHNWQPTDYDAL

SEQ ID NO: 1311576 - protein, 20 aa, Mycobacterium
ALVVHLGMSGQMLLGDVPNA

SEQ ID NO: 1311577 - protein, 18 aa, Mycobacterium
ALWEASLFEEHGFGDIKI

SEQ ID NO: 1311578 - protein, 19 aa, Mycobacterium
ALWEASLFEEHGFGDIKIS

SEQ ID NO: 1311579 - protein, 19 aa, Mycobacterium
ALWEASLFEEHGFGNIKIS

SEQ ID NO: 1311580 - protein, 17 aa, Mycobacterium
ALWFAEAAKYNGLPLGD

SEQ ID NO: 1311581 - protein, 19 aa, Mycobacterium
ALWGVGPKTAKKLAAMGIT

SEQ ID NO: 1311582 - protein, 32 aa, Mycobacterium
ALYAALAAPHRFRRLALLIPPVAWESGPDQRR

SEQ ID NO: 1311583 - protein, 19 aa, Mycobacterium
AMAALRRRMPWTLVEREYR

SEQ ID NO: 1311584 - protein, 20 aa, Mycobacterium
AMAKARFVRISATKARRVID

SEQ ID NO: 1311585 - protein, 24 aa, Mycobacterium
AMANSLAAYYYLHGSVPAKSLDDP

SEQ ID NO: 1311586 - protein, 18 aa, Mycobacterium
AMARIRSEFGWLDSCFAN

SEQ ID NO: 1311587 - protein, 21 aa, Mycobacterium
AMDKLLAALARNLVVRLRMSI

SEQ ID NO: 1311588 - protein, 25 aa, Mycobacterium
AMDPDPINSFLQPSGLFGPGQLMSV

SEQ ID NO: 1311589 - protein, 22 aa, Mycobacterium
AMDPQQRLLLEVAWEALEDAGI

SEQ ID NO: 1311590 - protein, 18 aa, Mycobacterium
AMDTALSRYLAGPVVPTV

SEQ ID NO: 1311591 - protein, 35 aa, Mycobacterium
AMEALGLSLYNLDTGQFVGFREMFRQLDEARARLR

SEQ ID NO: 1311592 - protein, 25 aa, Mycobacterium
AMFDPSAVFYMHKIAVGPDAADVID

SEQ ID NO: 1311593 - protein, 21 aa, Mycobacterium
AMGEVARLLGIGTAETVRKWV

SEQ ID NO: 1311594 - protein, 30 aa, Mycobacterium; identical to SEQ ID NO: 793401

SEQ ID NO: 1311595 - protein, 25 aa, Mycobacterium
AMGHRLTIAMAWQATVRWADEPVSM

SEQ ID NO: 1311596 - protein, 18 aa, Mycobacterium
AMGPGCRRLLLTAGPSVT

SEQ ID NO: 1311597 - protein, 29 aa, Mycobacterium
AMGYEPEDLPWEVPLIELGLDSLMAVRIK

SEQ ID NO: 1311598 - protein, 19 aa, Mycobacterium
AMHKMAFEVAWRILQVTPV

SEQ ID NO: 1311599 - protein, 18 aa, Mycobacterium
AMIARRYMHEYGATSADF

SEQ ID NO: 1311600 - protein, 24 aa, Mycobacterium
AMIGDVMMAARWLDYHAAVAFSIT

SEQ ID NO: 1311601 - protein, 24 aa, Mycobacterium
AMKEMGLFGLMIPEEYGGLGESLL

SEQ ID NO: 1311602 - protein, 23 aa, Mycobacterium
AMLAMAFDTWRLPPPAGSASLPE

SEQ ID NO: 1311603 - protein, 18 aa, Mycobacterium
AMLGPYSATKFAVRALTQ

SEQ ID NO: 1311604 - protein, 26 aa, Mycobacterium
AMLGQPVSMLIPRVVGFKLTGEIKPG

SEQ ID NO: 1311605 - protein, 17 aa, Mycobacterium
AMLIDRFADQPSVQIVN

SEQ ID NO: 1311606 - protein, 25 aa, Mycobacterium
AMLRQAPELAAWPRSPEWTGAGAVA

SEQ ID NO: 1311607 - protein, 26 aa, Mycobacterium
AMMSGLDIHYDLGDGHPLLGLRMPDL

SEQ ID NO: 1311608 - protein, 19 aa, Mycobacterium
AMMSGMMDGGMMGPGMGHG

SEQ ID NO: 1311609 - protein, 18 aa, Mycobacterium
AMMSGMMGGGMMGPPGMG

SEQ ID NO: 1311610 - protein, 23 aa, Mycobacterium
AMMTRLRAAPPDTIAGVAVTVAD

SEQ ID NO: 1311611 - protein, 30 aa, Mycobacterium
AMNFFPAALTEIGVRLPFGEIPLTGQVYER

SEQ ID NO: 1311612 - protein, 32 aa, Mycobacterium
AMNRGFHAFFRQYYNLRALLRRSDPGLSALTP

SEQ ID NO: 1311613 - protein, 21 aa, Mycobacterium
AMPEFGDIGIVFDATPAGAPR

SEQ ID NO: 1311614 - protein, 18 aa, Mycobacterium
AMPGSRVAVLLPAHWQTA

SEQ ID NO: 1311615 - protein, 19 aa, Mycobacterium
AMPIPYIEPRDVSNAVVFL

SEQ ID NO: 1311616 - protein, 18 aa, Mycobacterium
AMPLARLDEAFDTCVFAH

SEQ ID NO: 1311617 - protein, 26 aa, Mycobacterium
AMQFAYQFPQLVNRLILVGAGGVTKD

SEQ ID NO: 1311618 - protein, 22 aa, Mycobacterium
AMQLHGGIGYTWESGIHVYLKR

SEQ ID NO: 1311619 - protein, 19 aa, Mycobacterium
AMRDGKATVFMAMGGNFVS

SEQ ID NO: 1311620 - protein, 32 aa, Mycobacterium
AMRRWTWLNSFGYWFWGGFVRSIFGVAPVRPG

SEQ ID NO: 1311621 - protein, 20 aa, Mycobacterium
AMSFAYHYLATNPAERDRLI

SEQ ID NO: 1311622 - protein, 27 aa, Mycobacterium
AMSGELIEHLFLPAFGPAADAAMGDAA

SEQ ID NO: 1311623 - protein, 33 aa, Mycobacterium
AMSGIPRLQFAHVDLLVRNFGSLQGLLAATATD

SEQ ID NO: 1311624 - protein, 24 aa, Mycobacterium
AMSIPPVLAVYDFSRFRTIIDVGG

SEQ ID NO: 1311625 - protein, 19 aa, Mycobacterium
AMSLAPLAYTLFQRQMRHD

SEQ ID NO: 1311626 - protein, 26 aa, Mycobacterium
AMSPIRPNVIWAMDFQFDTAADGRTL

SEQ ID NO: 1311627 - protein, 19 aa, Mycobacterium
AMTNQWLFDRHSFGRPLAS

SEQ ID NO: 1311628 - protein, 20 aa, Mycobacterium
AMTPAMYFGIKYAVKHVESD

SEQ ID NO: 1311629 - protein, 32 aa, Mycobacterium
AMVQSLLVRALVAWFWEEPLRAPLIRHGANLH

SEQ ID NO: 1311630 - protein, 18 aa, Mycobacterium
AMVVFDRVLVPWSSVFAA

SEQ ID NO: 1311631 - protein, 17 aa, Mycobacterium
AMWVGMGRMLRTLDIGQ

SEQ ID NO: 1311632 - protein, 27 aa, Mycobacterium
AMYDSGLLSYVPWATTILASALIERGT

SEQ ID NO: 1311633 - protein, 26 aa, Mycobacterium
AMYPQHLVANSWRRLARSFWGDLGVF

SEQ ID NO: 1311634 - protein, 26 aa, Mycobacterium
AMYRTIHHTLLTLADHVTVLPAHGAG

SEQ ID NO: 1311635 - protein, 21 aa, Mycobacterium
ANAIGLFRYQLICPALEDGLS

SEQ ID NO: 1311636 - protein, 21 aa, Mycobacterium
ANAIGLFRYQVICPALEEGLS

SEQ ID NO: 1311637 - protein, 25 aa, Mycobacterium
ANAIVKLWVSSPTVAPIAGTRWAAY

SEQ ID NO: 1311638 - protein, 18 aa, Mycobacterium
ANARRILLEPETGGRWWT

SEQ ID NO: 1311639 - protein, 31 aa, Mycobacterium
ANASIPTPQPVLPRPMFGAAPAAAAATSVHF

SEQ ID NO: 1311640 - protein, 30 aa, Mycobacterium
ANAYWVSKAAVERLYLGLAADLKPDNIAVN

SEQ ID NO: 1311641 - protein, 24 aa, Mycobacterium
ANCGPLVWTTYGAALAEPIGPIHW

SEQ ID NO: 1311642 - protein, 17 aa, Mycobacterium
ANDLGYLGKQLYIGFNF

SEQ ID NO: 1311643 - protein, 22 aa, Mycobacterium
ANDLQLLTEGRFILGLGTQVRA

SEQ ID NO: 1311644 - protein, 17 aa, Mycobacterium
ANDPFEIPLAPQRPQDQ

SEQ ID NO: 1311645 - protein, 34 aa, Mycobacterium
ANDPVAWVDHPPYRPFWAITKHADIMAIERANDL

SEQ ID NO: 1311646 - protein, 19 aa, Mycobacterium
ANDRIWNAAQKLALHDPRV

SEQ ID NO: 1311647 - protein, 25 aa, Mycobacterium
ANFAAYPLEWVPVPEGRLVLQTLRS

SEQ ID NO: 1311648 - protein, 25 aa, Mycobacterium
ANFDVALWNPLRRYLEGRGVVFHTG

SEQ ID NO: 1311649 - protein, 22 aa, Mycobacterium
ANFLKRWLLVNDERARQMLRFL

SEQ ID NO: 1311650 - protein, 25 aa, Mycobacterium
ANGIDAPTLWPGLPVRPVKGEVLRL

SEQ ID NO: 1311651 - protein, 29 aa, Mycobacterium
ANGISPMELLPHAQGIVGILPPIVDELLE

SEQ ID NO: 1311652 - protein, 22 aa, Mycobacterium
ANGRRFRHAVKFLRWRPDRDPA

SEQ ID NO: 1311653 - protein, 23 aa, Mycobacterium
ANKGLALFPRRIGGRYAAMSRSD

SEQ ID NO: 1311654 - protein, 24 aa, Mycobacterium
ANLAIALKRRILVLQAVEHSQLEG

SEQ ID NO: 1311655 - protein, 25 aa, Mycobacterium
ANLDDALLALLPLVGVWRGEGEGRA

SEQ ID NO: 1311656 - protein, 28 aa, Mycobacterium
ANLEITVTGVFRYTDTWPAAIHLVNSGA

SEQ ID NO: 1311657 - protein, 19 aa, Mycobacterium
ANLLAKLGLRDRLALTRYA

SEQ ID NO: 1311658 - protein, 17 aa, Mycobacterium
ANLRRWLHEWADVYDAH

SEQ ID NO: 1311659 - protein, 26 aa, Mycobacterium
ANMVDTFVFLTLARTGDQLQGIKKGV

SEQ ID NO: 1311660 - protein, 30 aa, Mycobacterium
ANNSGGRPEWLWTAAGIPFNRATSLKVQGP

SEQ ID NO: 1311661 - protein, 25 aa, Mycobacterium
ANPALDDFLHRDALHALLPPKTREA

SEQ ID NO: 1311662 - protein, 24 aa, Mycobacterium
ANPANRFHSWIYRARPDVNCIVHT

SEQ ID NO: 1311663 - protein, 24 aa, Mycobacterium
ANPDGWLSALRTELRLAAAHLGEP

SEQ ID NO: 1311664 - protein, 26 aa, Mycobacterium
ANPDLPRRLFEELPLAEVDFDTVYGS

SEQ ID NO: 1311665 - protein, 32 aa, Mycobacterium
ANPHPALYPDAPIPPGVPPPPPARPAPSSIGD

SEQ ID NO: 1311666 - protein, 28 aa, Mycobacterium
ANPLIRVLEDALRFYFEFHFDQGEGYLA

SEQ ID NO: 1311667 - protein, 19 aa, Mycobacterium
ANQNSKLLRVRLGEPFMAR

SEQ ID NO: 1311668 - protein, 24 aa, Mycobacterium
ANQTGIMGSLRFLGQAKVVGPGGD

SEQ ID NO: 1311669 - protein, 17 aa, Mycobacterium
ANRDPDAIIFAAALREL

SEQ ID NO: 1311670 - protein, 18 aa, Mycobacterium
ANRPLPLPDMCYAAAATG

SEQ ID NO: 1311671 - protein, 19 aa, Mycobacterium
ANRTIIVRRLLGLEDVLSI

SEQ ID NO: 1311672 - protein, 19 aa, Mycobacterium
ANRTLLLDGLSALGIDRLA

SEQ ID NO: 1311673 - protein, 19 aa, Mycobacterium
ANRVMRQMPFQTLLETTGR

SEQ ID NO: 1311674 - protein, 23 aa, Mycobacterium
ANSFALLAPGLKRIRKRIAQYHE

SEQ ID NO: 1311675 - protein, 23 aa, Mycobacterium
ANSLLLVAAKLGMDVRIGAPPDL

SEQ ID NO: 1311676 - protein, 24 aa, Mycobacterium
ANSLWFMDHFFQIEPTGLPAEANM

SEQ ID NO: 1311677 - protein, 25 aa, Mycobacterium
ANSWGLPYAALLTGAGVVLPGPNMS

SEQ ID NO: 1311678 - protein, 22 aa, Mycobacterium
ANTIRLPAPLYADPSTVASMRS

SEQ ID NO: 1311679 - protein, 22 aa, Mycobacterium
ANVATAMQVLNAVPAVCEAPPG

SEQ ID NO: 1311680 - protein, 23 aa, Mycobacterium
ANWGGPWVVVPPDVDAAALADRL

SEQ ID NO: 1311681 - protein, 22 aa, Mycobacterium
ANWLERTYAFVPRVGIEKIRDA

SEQ ID NO: 1311682 - protein, 17 aa, Mycobacterium
ANYFAAAAVLPYGQFHE

SEQ ID NO: 1311683 - protein, 36 aa, Mycobacterium
ANYVSLELGPWLINWIPFGYLISDQIYIWYPDFVLP

SEQ ID NO: 1311684 - protein, 18 aa, Mycobacterium
APAAPLPGPAPTGPAPGP

SEQ ID NO: 1311685 - protein, 18 aa, Mycobacterium
APAAYVISVLRAGTSGEA

SEQ ID NO: 1311686 - protein, 18 aa, Mycobacterium
APAFNELKSNWLRGELFA

SEQ ID NO: 1311687 - protein, 23 aa, Mycobacterium
APAKKRRNLLKSLGIERVDYKDT

SEQ ID NO: 1311688 - protein, 17 aa, Mycobacterium
APALGRRWWAGEGQGAF

SEQ ID NO: 1311689 - protein, 21 aa, Mycobacterium
APAMLRARFHLWESGSTAQMV

SEQ ID NO: 1311690 - protein, 25 aa, Mycobacterium
APANAFVMSFLGAVSSLNGVLVRPH

SEQ ID NO: 1311691 - protein, 23 aa, Mycobacterium
APARALQVMFVLRELRAGLHFNA

SEQ ID NO: 1311692 - protein, 19 aa, Mycobacterium
APARDWARFSAWADDIFKI

SEQ ID NO: 1311693 - protein, 20 aa, Mycobacterium
APARPSLGYLVVGLSHHGSE

SEQ ID NO: 1311694 - protein, 23 aa, Mycobacterium
APASFLGFNRAAPARLRAAATFN

SEQ ID NO: 1311695 - protein, 27 aa, Mycobacterium
APATAAIASVFDRPLRRVDITSGSSMV

SEQ ID NO: 1311696 - protein, 27 aa, Mycobacterium
APATLHLEQIWIKNLTITTGLVDTHST

SEQ ID NO: 1311697 - protein, 26 aa, Mycobacterium
APATRPRIRLAYRLTPRRVTGAARAD

SEQ ID NO: 1311698 - protein, 27 aa, Mycobacterium
APCELVDFWRFNVAFARQILAQQPLNS

SEQ ID NO: 1311699 - protein, 23 aa, Mycobacterium
APDAAWAFTSWITSPAVDAQRVA

SEQ ID NO: 1311700 - protein, 25 aa, Mycobacterium
APDEFKALSYKAYLMCFGSTGMFEQ

SEQ ID NO: 1311701 - protein, 17 aa, Mycobacterium
APDELMLVAAHRSDLRA

SEQ ID NO: 1311702 - protein, 26 aa, Mycobacterium
APDGSPLFPGLPPAPPPGAPREPGPT

SEQ ID NO: 1311703 - protein, 17 aa, Mycobacterium
APDLTMTEGLQKLAFGD

SEQ ID NO: 1311704 - protein, 23 aa, Mycobacterium
APDMQSTLWIGPLGGRAAQALEG

SEQ ID NO: 1311705 - protein, 18 aa, Mycobacterium
APDQLPFVELNAAFYPKR

SEQ ID NO: 1311706 - protein, 31 aa, Mycobacterium
APDSPWRAPEYLQTLPLRRLTTPAEVARCVE

SEQ ID NO: 1311707 - protein, 24 aa, Mycobacterium
APDSVFFSGYYAEAAPFVQQLRDG

SEQ ID NO: 1311708 - protein, 25 aa, Mycobacterium
APDTVYDAALAWAGRFADYPPEVLA

SEQ ID NO: 1311709 - protein, 24 aa, Mycobacterium
APDVPLGWWEFYSISDDDPANPDG

SEQ ID NO: 1311710 - protein, 21 aa, Mycobacterium
APDVPVLVHPDPRAVLGELAS

SEQ ID NO: 1311711 - protein, 24 aa, Mycobacterium
APDVRPLPRSLDNIFREYREDLGY

SEQ ID NO: 1311712 - protein, 26 aa, Mycobacterium
APDYATLRKLLAVPLLLGAESRSGVP

SEQ ID NO: 1311713 - protein, 24 aa, Mycobacterium
APEAFKAASYKAYLMCFGSTGMFE

SEQ ID NO: 1311714 - protein, 21 aa, Mycobacterium
APEALVVLWAAQRSGLYVTAI

SEQ ID NO: 1311715 - protein, 39 aa, Mycobacterium
APEDTTVVTWLPFYHDMGLIVGVFIPMMLGRPAVQMSPV

SEQ ID NO: 1311716 - protein, 27 aa, Mycobacterium
APEDVEEVLAWFARYDALAVARDIEAM

SEQ ID NO: 1311717 - protein, 25 aa, Mycobacterium
APEEDLVSLIYFYEANHDALVTPLD

SEQ ID NO: 1311718 - protein, 25 aa, Mycobacterium
APEGELPLTMPLRQLGVSDDVVVAL

SEQ ID NO: 1311719 - protein, 26 aa, Mycobacterium
APEHVHTYRITPLALWNARAAGHDAE

SEQ ID NO: 1311720 - protein, 19 aa, Mycobacterium
APEIRYMLDRRRALGGFLP

SEQ ID NO: 1311721 - protein, 24 aa, Mycobacterium
APEKLSLFLVPTDAPGLVAHRLPV

SEQ ID NO: 1311722 - protein, 23 aa, Mycobacterium
APELRTPWPREALKDLLVMLGAG

SEQ ID NO: 1311723 - protein, 25 aa, Mycobacterium
APEPVLHAALGPGALIAEVGTEAQR

SEQ ID NO: 1311724 - protein, 23 aa, Mycobacterium
APERLDVFGRVYAGWAYCERFFA

SEQ ID NO: 1311725 - protein, 26 aa, Mycobacterium
APERLRVHSLARVLGTTSRRIIDALV

SEQ ID NO: 1311726 - protein, 24 aa, Mycobacterium
APERPFTAVQWHPEVNWATCRHSH

SEQ ID NO: 1311727 - protein, 17 aa, Mycobacterium
APFAKWFVGGKINVAYN

SEQ ID NO: 1311728 - protein, 18 aa, Mycobacterium
APFNVNYRYVKSELHYLL

SEQ ID NO: 1311729 - protein, 19 aa, Mycobacterium
APFPVLQQVIVNQLGYFSE

SEQ ID NO: 1311730 - protein, 21 aa, Mycobacterium
APFVRIDMLRGERELFFGEFT

SEQ ID NO: 1311731 - protein, 22 aa, Mycobacterium
APGALGFRYDTGLYLRFRATTR

SEQ ID NO: 1311732 - protein, 21 aa, Mycobacterium
APGAPAPPPGPPGAATPEAPS

SEQ ID NO: 1311733 - protein, 20 aa, Mycobacterium
APGDFIELVQGIPGGPHGVD

SEQ ID NO: 1311734 - protein, 27 aa, Mycobacterium
APGDKTMLDALLPFVEELERRVADGER

SEQ ID NO: 1311735 - protein, 25 aa, Mycobacterium
APGFGDRRKAMLQDIAILTGGQVVS

SEQ ID NO: 1311736 - protein, 34 aa, Mycobacterium
APGLVTVGVWPALALPPLVTPVPGLGYTLADDPV

SEQ ID NO: 1311737 - protein, 17 aa, Mycobacterium
APGTLRNKLLGRGDRLP

SEQ ID NO: 1311738 - protein, 21 aa, Mycobacterium
APGTMAYVTALLPVAQGVAVY

SEQ ID NO: 1311739 - protein, 19 aa, Mycobacterium
APGTTVRVDARFYGVKFGE

SEQ ID NO: 1311740 - protein, 18 aa, Mycobacterium
APGVWHLVSTVSARVPED

SEQ ID NO: 1311741 - protein, 25 aa, Mycobacterium
APHATVLFVDYLTLLPATGPAPPLR

SEQ ID NO: 1311742 - protein, 18 aa, Mycobacterium
APHFYKTPELLFSPDMFH

SEQ ID NO: 1311743 - protein, 17 aa, Mycobacterium
APHGVPAALIPDSTAAL

SEQ ID NO: 1311744 - protein, 20 aa, Mycobacterium
APIFDAIIAHPFVTGLTDGS

SEQ ID NO: 1311745 - protein, 26 aa, Mycobacterium
APIGADDYWYLWRQMVSQPGAADPAG

SEQ ID NO: 1311746 - protein, 17 aa, Mycobacterium
APILGPRGLMPNPKTGT

SEQ ID NO: 1311747 - protein, 23 aa, Mycobacterium
APKEFDKGFWVSPTLFTDVDNSM

SEQ ID NO: 1311748 - protein, 24 aa, Mycobacterium
APKHKGLSLLLVPIDQPGVVVRPI

SEQ ID NO: 1311749 - protein, 27 aa, Mycobacterium
APKHKSLTMFLVPLDSPGVEIQGIRTV

SEQ ID NO: 1311750 - protein, 28 aa, Mycobacterium
APKHKSLTMFLVPLDSPGVEIQPLRTVD

SEQ ID NO: 1311751 - protein, 20 aa, Mycobacterium
APKHPVWYHNIKKNPRVELQ

SEQ ID NO: 1311752 - protein, 18 aa, Mycobacterium
APKVWIGDTGFSTDHARH

SEQ ID NO: 1311753 - protein, 21 aa, Mycobacterium
APLDAFIVRKLGAPGHEEFAM

SEQ ID NO: 1311754 - protein, 22 aa, Mycobacterium
APLFGQCCAALLASFKILGSAT

SEQ ID NO: 1311755 - protein, 27 aa, Mycobacterium
APLISWDRAFGLVKINPIAAWSDDDMQ

SEQ ID NO: 1311756 - protein, 18 aa, Mycobacterium
APLITPFMRHAATKLWRD

SEQ ID NO: 1311757 - protein, 25 aa, Mycobacterium
APLNPDWDRAFLDLLDNGRLAEVDS

SEQ ID NO: 1311758 - protein, 17 aa, Mycobacterium
APLNSWPDNANLDKARR

SEQ ID NO: 1311759 - protein, 20 aa, Mycobacterium
APLRPFAKREVMPGNLRGPD

SEQ ID NO: 1311760 - protein, 18 aa, Mycobacterium
APLRYVLVFNGEIYNYLE

SEQ ID NO: 1311761 - protein, 19 aa, Mycobacterium
APLRYVLVFNGEIYNYLEL

SEQ ID NO: 1311762 - protein, 17 aa, Mycobacterium
APLSRRLYVARRSAELT

SEQ ID NO: 1311763 - protein, 19 aa, Mycobacterium
APLTAGTWRDYWLAMDVRG

SEQ ID NO: 1311764 - protein, 17 aa, Mycobacterium
APLYAPDGSPLFPGLPP

SEQ ID NO: 1311765 - protein, 21 aa, Mycobacterium
APMQLWQIDIMGGVFLVDGRE

SEQ ID NO: 1311766 - protein, 21 aa, Mycobacterium
APNPTTPLRAPMEWNLLGWMR

SEQ ID NO: 1311767 - protein, 18 aa, Mycobacterium
APNRLWVADLTYVSTWSG

SEQ ID NO: 1311768 - protein, 21 aa, Mycobacterium
APPAKSIPLPVSYALATLGSV

SEQ ID NO: 1311769 - protein, 23 aa, Mycobacterium
APPDARFGWPKRNGFVQPLVDAE

SEQ ID NO: 1311770 - protein, 24 aa, Mycobacterium
APPDRQRYLVQFTVTGFADKAAED

SEQ ID NO: 1311771 - protein, 27 aa, Mycobacterium
APPEYVAPTYAYLVSDRARGVTGRIFI

SEQ ID NO: 1311772 - protein, 25 aa, Mycobacterium
APPGIATYLDLPLISGKAAPAKARA

SEQ ID NO: 1311773 - protein, 25 aa, Mycobacterium
APPGRDLLYVLAPAPNKAVGHVDWS

SEQ ID NO: 1311774 - protein, 18 aa, Mycobacterium
APPPGAVSEYRKVRDRAS

SEQ ID NO: 1311775 - protein, 24 aa, Mycobacterium
APPSAPPYPPRPQADAPWTAPQPT

SEQ ID NO: 1311776 - protein, 25 aa, Mycobacterium
APPVGALRWRPPEPAPAWDGERQAT

SEQ ID NO: 1311777 - protein, 28 aa, Mycobacterium
APQFGMYGIQRIHLLRNVMILAGAGVGG

SEQ ID NO: 1311778 - protein, 19 aa, Mycobacterium
APQFHPSYRHAGAVRREIG

SEQ ID NO: 1311779 - protein, 18 aa, Mycobacterium
APQFPPRLRVDNAGGLAA

SEQ ID NO: 1311780 - protein, 30 aa, Mycobacterium
APQMLSQFMQMPMGLLGPLSSSMGGLGGAP

SEQ ID NO: 1311781 - protein, 27 aa, Mycobacterium
APQRVGWFRFYFADERWEWSEQVQILH

SEQ ID NO: 1311782 - protein, 26 aa, Mycobacterium
APRDPGYWVANLRGRVRFAEAVTAAA

SEQ ID NO: 1311783 - protein, 19 aa, Mycobacterium
APREALLRGLGADATRLIY

SEQ ID NO: 1311784 - protein, 23 aa, Mycobacterium
APRGSAYHYFPGGRTQLLCEAVD

SEQ ID NO: 1311785 - protein, 22 aa, Mycobacterium
APRIGCTLPEVFDHARPGEKIR

SEQ ID NO: 1311786 - protein, 23 aa, Mycobacterium
APRLLLEVVCARLLLPSASDTES

SEQ ID NO: 1311787 - protein, 24 aa, Mycobacterium
APRQDVWPWLVQIGEDRAGFYSYS

SEQ ID NO: 1311788 - protein, 22 aa, Mycobacterium
APRQLHLVDELPRRGIGKVDRR

SEQ ID NO: 1311789 - protein, 24 aa, Mycobacterium
APRRGGPVVWVKDASRSVPVAAAL

SEQ ID NO: 1311790 - protein, 37 aa, Mycobacterium
APRRVVVRFVLVRFVLLCLLRWIRFGCGGVIGLRCRR

SEQ ID NO: 1311791 - protein, 18 aa, Mycobacterium
APRTAAAARRIPVASAAV

SEQ ID NO: 1311792 - protein, 27 aa, Mycobacterium
APRVEPEVAFLLDQPLRGPGITVQQVR

SEQ ID NO: 1311793 - protein, 18 aa, Mycobacterium
APRVLATRSRLFPDTAEV

SEQ ID NO: 1311794 - protein, 22 aa, Mycobacterium
APRVVLLGIPTRGVTLAARLAE

SEQ ID NO: 1311795 - protein, 26 aa, Mycobacterium
APSADLLVIGPPWPTADPPPEVLRIR

SEQ ID NO: 1311796 - protein, 18 aa, Mycobacterium
APSALWSEQVFTHAVADL

SEQ ID NO: 1311797 - protein, 19 aa, Mycobacterium
APSCPRYVRTVRGIGYCLA

SEQ ID NO: 1311798 - protein, 29 aa, Mycobacterium
APSLHAGHLIPLLTLRRFQQAGHRPIVLA

SEQ ID NO: 1311799 - protein, 17 aa, Mycobacterium
APSLLARPNALRVALHP

SEQ ID NO: 1311800 - protein, 26 aa, Mycobacterium
APTALFRLLELVDDGLAPPASVLGGP

SEQ ID NO: 1311801 - protein, 28 aa, Mycobacterium
APTAPAPWVPPWMAPPPAPQPSCVVFCL

SEQ ID NO: 1311802 - protein, 26 aa, Mycobacterium
APTASGFWHWAVFNLPATVTDLPAGV

SEQ ID NO: 1311803 - protein, 22 aa, Mycobacterium
APTELVTAPFLPDAAEALIGIG

SEQ ID NO: 1311804 - protein, 25 aa, Mycobacterium
APTGHTIRLLQLPGSWTDFLNEGKG

SEQ ID NO: 1311805 - protein, 29 aa, Mycobacterium
APTGSGKTLAAFLWAIDRLASSEPRPARA

SEQ ID NO: 1311806 - protein, 21 aa, Mycobacterium
APTLAPLAMLVDHAGGLINHA

SEQ ID NO: 1311807 - protein, 17 aa, Mycobacterium
APTLIRRAIMQSGNPYG

SEQ ID NO: 1311808 - protein, 18 aa, Mycobacterium
APTLIRRAIMQSGNPYGA

SEQ ID NO: 1311809 - protein, 21 aa, Mycobacterium
APTLVTHLDIALADAPPVVVV

SEQ ID NO: 1311810 - protein, 18 aa, Mycobacterium
APTRLIEGLLSVGAVGLN

SEQ ID NO: 1311811 - protein, 29 aa, Mycobacterium
APTVQLTAFLRALPADGWLRVMCTATQIG

SEQ ID NO: 1311812 - protein, 20 aa, Mycobacterium
APVAAHWIADRQVAPGLLAY

SEQ ID NO: 1311813 - protein, 26 aa, Mycobacterium
APVDEILLVMLDLEALPEWSPAHRSS

SEQ ID NO: 1311814 - protein, 33 aa, Mycobacterium
APVLHELRRPLAGFISTLLTPLLPAAHYACQAY

SEQ ID NO: 1311815 - protein, 20 aa, Mycobacterium
APVLIAIDDVQWLDASSRAV

SEQ ID NO: 1311816 - protein, 19 aa, Mycobacterium
APVLIGRDLPAQIRADDPR

SEQ ID NO: 1311817 - protein, 20 aa, Mycobacterium
APVLLYDGICGFCNSAVQTI

SEQ ID NO: 1311818 - protein, 25 aa, Mycobacterium
APVLRFKAFTRDSVGLSLAARQRNV

SEQ ID NO: 1311819 - protein, 26 aa, Mycobacterium
APVMPTGKVIGFLHADRLYSGRRVDE

SEQ ID NO: 1311820 - protein, 26 aa, Mycobacterium
APVNEILLVMLDLEALPEWSPAHRSS

SEQ ID NO: 1311821 - protein, 21 aa, Mycobacterium
APVQRWTTYTASQLWVSYRKG

SEQ ID NO: 1311822 - protein, 20 aa, Mycobacterium
APVRPGWQRWLYQTQCHWNL

SEQ ID NO: 1311823 - protein, 28 aa, Mycobacterium
APVSEPADYLPLFVAPQPVRFDEHDHDD

SEQ ID NO: 1311824 - protein, 25 aa, Mycobacterium
APVSRPLAGVLLGAAAGICRDGDDP

SEQ ID NO: 1311825 - protein, 26 aa, Mycobacterium
APVTRPRIRLAYRLTPRRVLGEERAT

SEQ ID NO: 1311826 - protein, 23 aa, Mycobacterium
APYLGFQLGSMWYISLDYINHQT

SEQ ID NO: 1311827 - protein, 27 aa, Mycobacterium
APYPELIDLLVLDAIESPYDPWDLRHY

SEQ ID NO: 1311828 - protein, 17 aa, Mycobacterium
APYPGFLVKRAKKMVLD

SEQ ID NO: 1311829 - protein, 19 aa, Mycobacterium
APYSDLIWMETGTPDLELA

SEQ ID NO: 1311830 - protein, 24 aa, Mycobacterium
AQADTLLPAFDLDAALAGYGKALS

SEQ ID NO: 1311831 - protein, 27 aa, Mycobacterium
AQALAPVRFFNPLSMRFAKKATREDIA

SEQ ID NO: 1311832 - protein, 22 aa, Mycobacterium
AQARLAALSILIGAVGATGPGV

SEQ ID NO: 1311833 - protein, 21 aa, Mycobacterium
AQASLLVLPVAIESGEEWVVL

SEQ ID NO: 1311834 - protein, 30 aa, Mycobacterium
AQASPPDMKLPIALALGWPSRVPGAAPACD

SEQ ID NO: 1311835 - protein, 18 aa, Mycobacterium
AQAYPVRSDGRTFFSFRR

SEQ ID NO: 1311836 - protein, 25 aa, Mycobacterium
AQCRLHGLPLLVAPPSVPFSVVSRF

SEQ ID NO: 1311837 - protein, 26 aa, Mycobacterium
AQDFADAWWDPLLAALRDPVDGGLYV

SEQ ID NO: 1311838 - protein, 25 aa, Mycobacterium
AQDHAWSYVFLASHRARGITGDVIH

SEQ ID NO: 1311839 - protein, 21 aa, Mycobacterium
AQDLHATHWALLRALVSEGAN

SEQ ID NO: 1311840 - protein, 18 aa, Mycobacterium
AQDPPPHRLVLGGDGFDA

SEQ ID NO: 1311841 - protein, 24 aa, Mycobacterium
AQDPPPHRLVLGGDGFDVAVAALE

SEQ ID NO: 1311842 - protein, 24 aa, Mycobacterium
AQDWPILAHAPAPLPVTLGAKTIS

SEQ ID NO: 1311843 - protein, 22 aa, Mycobacterium
AQELYFPPCYELAVTRGAPGAQ

SEQ ID NO: 1311844 - protein, 18 aa, Mycobacterium
AQERWFRQNWMSTEFNLL

SEQ ID NO: 1311845 - protein, 24 aa, Mycobacterium
AQEVPLIIMITSYYVRTMAKALAP

SEQ ID NO: 1311846 - protein, 30 aa, Mycobacterium
AQFDIWVRQFLAVHERAVVLHLGCGLDSRV

SEQ ID NO: 1311847 - protein, 22 aa, Mycobacterium
AQFQAAGFMRTGPTRPPYTEVP

SEQ ID NO: 1311848 - protein, 24 aa, Mycobacterium
AQFTAFLESIKRQLRTLETLGVPV

SEQ ID NO: 1311849 - protein, 24 aa, Mycobacterium
AQFYDLDYFALIKDPISVVEDIYR

SEQ ID NO: 1311850 - protein, 24 aa, Mycobacterium
AQFYDLDYFALIKDPVGAVGDIYR

SEQ ID NO: 1311851 - protein, 19 aa, Mycobacterium
AQGAPVARPSWQAAATGLI

SEQ ID NO: 1311852 - protein, 24 aa, Mycobacterium
AQGGGVIVYLRPPGSLRACGLPRP

SEQ ID NO: 1311853 - protein, 23 aa, Mycobacterium
AQGRAEAQLLRRSVRQFSADPVA

SEQ ID NO: 1311854 - protein, 22 aa, Mycobacterium
AQGRGLARLARRVWPGHDWTAL

SEQ ID NO: 1311855 - protein, 25 aa, Mycobacterium
AQGRRDICIYAREPHVLVARAPAEL

SEQ ID NO: 1311856 - protein, 33 aa, Mycobacterium
AQGTGALLAAFPRYHPRWAWGLTKVPGLREFLV

SEQ ID NO: 1311857 - protein, 25 aa, Mycobacterium
AQHAKLLSLLVAISGARRVLEIGTL

SEQ ID NO: 1311858 - protein, 27 aa, Mycobacterium
AQHGKTFYLATRLLAPRQRPAVHALYG

SEQ ID NO: 1311859 - protein, 25 aa, Mycobacterium
AQHLHSSFAPLFRPGGVGRTPVTGA

SEQ ID NO: 1311860 - protein, 23 aa, Mycobacterium
AQHRYSFINVRRLVTAGTPQISG

SEQ ID NO: 1311861 - protein, 18 aa, Mycobacterium
AQIESELLPRHLARITRD

SEQ ID NO: 1311862 - protein, 22 aa, Mycobacterium
AQIGPLVWAAVGGAPAVLVYRA

SEQ ID NO: 1311863 - protein, 22 aa, Mycobacterium
AQIMALLRDLRTEYRMAVVLIT

SEQ ID NO: 1311864 - protein, 25 aa, Mycobacterium
AQKERWLPELMTLEKIAAWAITEPD

SEQ ID NO: 1311865 - protein, 23 aa, Mycobacterium
AQLAAAHGIPVLKPARPNSGEFV

SEQ ID NO: 1311866 - protein, 20 aa, Mycobacterium
AQLAAHLKALIAPGTVVCAF

SEQ ID NO: 1311867 - protein, 19 aa, Mycobacterium
AQLAANLRREGWSGEVVLI

SEQ ID NO: 1311868 - protein, 17 aa, Mycobacterium
AQLAIVGELMKETSGRA

SEQ ID NO: 1311869 - protein, 18 aa, Mycobacterium
AQLAQWLREWGVPAPPVA

SEQ ID NO: 1311870 - protein, 18 aa, Mycobacterium
AQLDTINQLLRRGFSSAH

SEQ ID NO: 1311871 - protein, 17 aa, Mycobacterium
AQLIARRVREARVFSEV

SEQ ID NO: 1311872 - protein, 17 aa, Mycobacterium
AQLIPGEQLLVETDAPF

SEQ ID NO: 1311873 - protein, 19 aa, Mycobacterium
AQLLGRITDLYFGGDMEAS

SEQ ID NO: 1311874 - protein, 19 aa, Mycobacterium
AQLQRSYQLLIEDADLIST

SEQ ID NO: 1311875 - protein, 17 aa, Mycobacterium
AQLRAIFELAAGCLAPG

SEQ ID NO: 1311876 - protein, 20 aa, Mycobacterium
AQLSLPWKRDFNALVYVLSG

SEQ ID NO: 1311877 - protein, 19 aa, Mycobacterium
AQMEYLRRLRNAKNLRDVV

SEQ ID NO: 1311878 - protein, 25 aa, Mycobacterium
AQNAQPWSWRVTPGGVDLFADWSRR

SEQ ID NO: 1311879 - protein, 21 aa, Mycobacterium
AQNFLILARRLIGATTSRGNV

SEQ ID NO: 1311880 - protein, 18 aa, Mycobacterium
AQPDLCLAHLTLRGRPPQ

SEQ ID NO: 1311881 - protein, 35 aa, Mycobacterium
AQPGMRKLLLQEWLRFGWYFLISRRDPAGFGEWIR

SEQ ID NO: 1311882 - protein, 21 aa, Mycobacterium
AQPKIALFRDTKSGRFGIPRD

SEQ ID NO: 1311883 - protein, 24 aa, Mycobacterium
AQPRYSASRRAAVAALGPLAADVG

SEQ ID NO: 1311884 - protein, 24 aa, Mycobacterium
AQPVPPTEFLIAKVLCADTFGVNA

SEQ ID NO: 1311885 - protein, 24 aa, Mycobacterium
AQQDAARKEAEAESARGGAKAAEE

SEQ ID NO: 1311886 - protein, 19 aa, Mycobacterium
AQQLWCPDLHDGPLRVSAV

SEQ ID NO: 1311887 - protein, 20 aa, Mycobacterium
AQQPMLADALVRKAVLGLLD

SEQ ID NO: 1311888 - protein, 26 aa, Mycobacterium
AQRAEGVACYKLFISGLLDITDNVDK

SEQ ID NO: 1311889 - protein, 24 aa, Mycobacterium
AQRCRPVFATYADPIVHLGPLGSG

SEQ ID NO: 1311890 - protein, 32 aa, Mycobacterium
AQRFSRFPMHRVWPEFFGMLPAQTLQRTGDIR

SEQ ID NO: 1311891 - protein, 19 aa, Mycobacterium
AQRGLVKVLGTAASAPGSS

SEQ ID NO: 1311892 - protein, 31 aa, Mycobacterium
AQRGRFPGHPSYFLKPPTSLALSGRPVERPA

SEQ ID NO: 1311893 - protein, 32 aa, Mycobacterium
AQRIKELVIPPAWKDVWISPKPSGHIQAVGTD

SEQ ID NO: 1311894 - protein, 29 aa, Mycobacterium
AQRSITERVLPAALLLKAVGVAAQRFQEL

SEQ ID NO: 1311895 - protein, 19 aa, Mycobacterium
AQRVKRFTAFGTLEQSRGV

SEQ ID NO: 1311896 - protein, 18 aa, Mycobacterium
AQRVRAFHVTDHDITALA

SEQ ID NO: 1311897 - protein, 20 aa, Mycobacterium
AQRVVLVTRDFPLLEGGNGA

SEQ ID NO: 1311898 - protein, 24 aa, Mycobacterium
AQRWRPDALLQLAEGWDSAARALG

SEQ ID NO: 1311899 - protein, 26 aa, Mycobacterium
AQRYRHVPVVLLTPGGRRLCTLDYGN

SEQ ID NO: 1311900 - protein, 19 aa, Mycobacterium
AQRYTPWVDKLLAMDWDNP

SEQ ID NO: 1311901 - protein, 21 aa, Mycobacterium
AQSCYWDYAPSFGRGPFRNVI

SEQ ID NO: 1311902 - protein, 26 aa, Mycobacterium
AQSHAQLAMYQLAVAAGLLADGDEPG

SEQ ID NO: 1311903 - protein, 22 aa, Mycobacterium
AQSMLPFAKQTLIIEGGLKMIS

SEQ ID NO: 1311904 - protein, 28 aa, Mycobacterium
AQSPRETWLRLLLMKDFPRPTTQIPLFN

SEQ ID NO: 1311905 - protein, 18 aa, Mycobacterium
AQSRYRIFIVDEAHMVTT

SEQ ID NO: 1311906 - protein, 27 aa, Mycobacterium
AQSVPTLFPFVECQSRLLAAYAVGRYA

SEQ ID NO: 1311907 - protein, 22 aa, Mycobacterium
AQTDRFLLKEIVRYPSPEQEVE

SEQ ID NO: 1311908 - protein, 27 aa, Mycobacterium
AQTDYRALLEFFFQIHDPTTKNRQGND

SEQ ID NO: 1311909 - protein, 18 aa, Mycobacterium
AQTLQFGSALVPVRNVRP

SEQ ID NO: 1311910 - protein, 21 aa, Mycobacterium
AQTVVIGLYPSWDISGEALDA

SEQ ID NO: 1311911 - protein, 27 aa, Mycobacterium
AQVELAVRLLLGQFPTMPATVLAQRVG

SEQ ID NO: 1311912 - protein, 17 aa, Mycobacterium
AQVFAARHRARTGALGV

SEQ ID NO: 1311913 - protein, 25 aa, Mycobacterium
AQVGIPLRRYVLWSRLRIAITLVQG

SEQ ID NO: 1311914 - protein, 21 aa, Mycobacterium
AQVKASLLKLTVGNRRYRAPS

SEQ ID NO: 1311915 - protein, 25 aa, Mycobacterium
AQVNYFGVVELLTALRPAFARTAAA

SEQ ID NO: 1311916 - protein, 19 aa, Mycobacterium
AQVPILRFSATLAAEAICE

SEQ ID NO: 1311917 - protein, 25 aa, Mycobacterium
AQVQTYVPGYRLLNEPQFDPPSVNS

SEQ ID NO: 1311918 - protein, 27 aa, Mycobacterium
AQVSASLRYVAAWNSAFLPSKDLTEGI

SEQ ID NO: 1311919 - protein, 23 aa, Mycobacterium
AQWSRIRLADRAHLEPWEPVTGV

SEQ ID NO: 1311920 - protein, 22 aa, Mycobacterium
AQWSRIRLADRGHLEPWEPSTD

SEQ ID NO: 1311921 - protein, 17 aa, Mycobacterium
AQYAIRVNTIAPGGIPT

SEQ ID NO: 1311922 - protein, 35 aa, Mycobacterium
AQYLGPALRLMNFNYLPLPFNAYLGPAPQNVIYSE

SEQ ID NO: 1311923 - protein, 23 aa, Mycobacterium
AQYSKLMRSYVRLAVLVSERKGA

SEQ ID NO: 1311924 - protein, 25 aa, Mycobacterium
ARAAERLGLRTVWLSERWGTKDLGV

SEQ ID NO: 1311925 - protein, 18 aa, Mycobacterium
ARAAGMPGVFGMGLLHGG

SEQ ID NO: 1311926 - protein, 25 aa, Mycobacterium
ARAAKAWPFEFLPAASWSAQPPTYQ

SEQ ID NO: 1311927 - protein, 17 aa, Mycobacterium
ARAARLTFADRLALCAS

SEQ ID NO: 1311928 - protein, 32 aa, Mycobacterium
ARADLLAFTAFPKQIWRQIWSNNPLSVNRPSG

SEQ ID NO: 1311929 - protein, 23 aa, Mycobacterium
ARAELVRRWLHAFGPATVDDLKW

SEQ ID NO: 1311930 - protein, 18 aa, Mycobacterium
ARAGALNALLIGGVELAD

SEQ ID NO: 1311931 - protein, 26 aa, Mycobacterium
ARAHLDADWVLLALADGALPEASVRH

SEQ ID NO: 1311932 - protein, 28 aa, Mycobacterium
ARAHLRYGEWLRRALRRNDAREQLTLAS

SEQ ID NO: 1311933 - protein, 21 aa, Mycobacterium
ARAHWDLIAAKYAAPGTNLPH

SEQ ID NO: 1311934 - protein, 24 aa, Mycobacterium
ARALAPARLLVSGSAALPVPVFDG

SEQ ID NO: 1311935 - protein, 22 aa, Mycobacterium
ARAMFDPLLARLRDLGAMGLMM

SEQ ID NO: 1311936 - protein, 25 aa, Mycobacterium
ARANRLAHLFRRAGLREGDTVAAIL

SEQ ID NO: 1311937 - protein, 31 aa, Mycobacterium
ARAQPRYEKPWLQVGYFYGHMFLNLTEGTAL

SEQ ID NO: 1311938 - protein, 29 aa, Mycobacterium
ARAQSFWEPLARWQPPLLVVRSPNATVVD

SEQ ID NO: 1311939 - protein, 25 aa, Mycobacterium
ARARCRRLEALPGWSWEYRARPTWE

SEQ ID NO: 1311940 - protein, 25 aa, Mycobacterium
ARARQRGCTLLVTGGDWQGASARLD

SEQ ID NO: 1311941 - protein, 23 aa, Mycobacterium
ARARRFYEEVLGLEVIQPSSRSM

SEQ ID NO: 1311942 - protein, 24 aa, Mycobacterium
ARARYGFADFKLKGGVLPAADEAK

SEQ ID NO: 1311943 - protein, 31 aa, Mycobacterium
ARATETWRFPAFFHGLLDAGVYPPPSAYECW

SEQ ID NO: 1311944 - protein, 24 aa, Mycobacterium
ARATNLTRALKQWADAGLQVVGLD

SEQ ID NO: 1311945 - protein, 23 aa, Mycobacterium
ARAVEIVERLWLSSLWGGDSLET

SEQ ID NO: 1311946 - protein, 22 aa, Mycobacterium
ARAVLGLPVDTIMISPGAVEVS

SEQ ID NO: 1311947 - protein, 19 aa, Mycobacterium
ARAWWVLTAAGIGGVRILD

SEQ ID NO: 1311948 - protein, 21 aa, Mycobacterium
ARAYREMFAGLYTDPDDVLNT

SEQ ID NO: 1311949 - protein, 21 aa, Mycobacterium
ARCALAWSPETASLAREHNNA

SEQ ID NO: 1311950 - protein, 24 aa, Mycobacterium
ARDAWARIAPLDDALPRQAAHIDL

SEQ ID NO: 1311951 - protein, 28 aa, Mycobacterium
ARDDPRGTLRLLNPRRWSERTMIALVMQ

SEQ ID NO: 1311952 - protein, 24 aa, Mycobacterium
ARDMAWDYPLGLVAPAGFALHVRR

SEQ ID NO: 1311953 - protein, 23 aa, Mycobacterium
AREAMFMDPQHRLVLETAWSAVE

SEQ ID NO: 1311954 - protein, 23 aa, Mycobacterium
AREANWMFALVRTTRSEKKQRGI

SEQ ID NO: 1311955 - protein, 20 aa, Mycobacterium
AREDLLRALVGPLIEQLRAI

SEQ ID NO: 1311956 - protein, 17 aa, Mycobacterium
AREILGVLRAVLFAPED

SEQ ID NO: 1311957 - protein, 19 aa, Mycobacterium
ARELARCQGAPLFELRAAL

SEQ ID NO: 1311958 - protein, 20 aa, Mycobacterium
ARELEMCYAAIALVTDVDAG

SEQ ID NO: 1311959 - protein, 28 aa, Mycobacterium
ARENARLERGLLPSPLLLDDPGVEIVAQ

SEQ ID NO: 1311960 - protein, 19 aa, Mycobacterium
AREQVMWAATLAGIAFGNA

SEQ ID NO: 1311961 - protein, 25 aa, Mycobacterium
ARERKAAFLPPYVISGQGLAVDTTR

SEQ ID NO: 1311962 - protein, 21 aa, Mycobacterium
ARERLLALPGIGPWSAEMIAM

SEQ ID NO: 1311963 - protein, 29 aa, Mycobacterium
AREVGIDWLRSYLALPNYANNLLRLGFSE

SEQ ID NO: 1311964 - protein, 25 aa, Mycobacterium
AREVILRLFSSLLDTAPTLGAGLDW

SEQ ID NO: 1311965 - protein, 25 aa, Mycobacterium
ARFGAKLWVLPANMASYNDIDALVE

SEQ ID NO: 1311966 - protein, 21 aa, Mycobacterium
ARFHPKYAVAPLAALATVMPM

SEQ ID NO: 1311967 - protein, 20 aa, Mycobacterium
ARFIRWAIKSRLIPADLEVT

SEQ ID NO: 1311968 - protein, 28 aa, Mycobacterium
ARFLADAELVLYPGTYLDAAVLAHCSPD

SEQ ID NO: 1311969 - protein, 27 aa, Mycobacterium
ARFLTDYHRWFLTSGIGPAIEQARPID

SEQ ID NO: 1311970 - protein, 18 aa, Mycobacterium
ARFPRLAQQWAGDTSLFD

SEQ ID NO: 1311971 - protein, 19 aa, Mycobacterium
ARFVDTFARVLGDPDLLHL

SEQ ID NO: 1311972 - protein, 20 aa, Mycobacterium
ARGDVWGAALLTLAVGLSKK

SEQ ID NO: 1311973 - protein, 25 aa, Mycobacterium
ARGEDPLLHKKAQWLRPIGSPVGAI

SEQ ID NO: 1311974 - protein, 19 aa, Mycobacterium
ARGFGRPPMPRLADAFMDI

SEQ ID NO: 1311975 - protein, 19 aa, Mycobacterium
ARGKLLSILQRNGATRVSV

SEQ ID NO: 1311976 - protein, 22 aa, Mycobacterium
ARGLPRRPRVLLISGDAPGPDE

SEQ ID NO: 1311977 - protein, 26 aa, Mycobacterium
ARGLRTYVQLFVVIAAANDVKCDVAS

SEQ ID NO: 1311978 - protein, 20 aa, Mycobacterium
ARGMLFYRLLQQSVNTDPHP

SEQ ID NO: 1311979 - protein, 25 aa, Mycobacterium
ARGPALLIFDRRRDVWRVRQILDDP

SEQ ID NO: 1311980 - protein, 25 aa, Mycobacterium
ARGRARALTLTATGRRRLAAAHSAV

SEQ ID NO: 1311981 - protein, 20 aa, Mycobacterium
ARGRSVIALAYADGVLFVAE

SEQ ID NO: 1311982 - protein, 19 aa, Mycobacterium
ARGRWLRAVSRFFREHLLP

SEQ ID NO: 1311983 - protein, 26 aa, Mycobacterium
ARGVLGFLTLLDPSGLRHELFYGQKV

SEQ ID NO: 1311984 - protein, 17 aa, Mycobacterium
ARHGIALDPKFSNSNSQ

SEQ ID NO: 1311985 - protein, 18 aa, Mycobacterium
ARHREPLAAALAAGLADG

SEQ ID NO: 1311986 - protein, 24 aa, Mycobacterium
ARHRITLRRRTGGTDAGWHLKLPA

SEQ ID NO: 1311987 - protein, 23 aa, Mycobacterium
ARHRPIGMVFQHYALFPNMSVAE

SEQ ID NO: 1311988 - protein, 22 aa, Mycobacterium
ARIADWIPYSALLPHVDVMITN

SEQ ID NO: 1311989 - protein, 22 aa, Mycobacterium
ARIDTALPDRTPLPRPDLRQRH

SEQ ID NO: 1311990 - protein, 18 aa, Mycobacterium
ARIERLRRLLDTEGLFDP

SEQ ID NO: 1311991 - protein, 17 aa, Mycobacterium
ARIGWGVKRFTPTVFTR

SEQ ID NO: 1311992 - protein, 25 aa, Mycobacterium
ARILDAALELLRARGPRAVTMQAIV

SEQ ID NO: 1311993 - protein, 21 aa, Mycobacterium
ARILGIFVDGKRVPVVAHTGR

SEQ ID NO: 1311994 - protein, 19 aa, Mycobacterium
ARILLAQHVGSSPLQDRRA

SEQ ID NO: 1311995 - protein, 25 aa, Mycobacterium
ARIPGIDALERLAAACGKRLHIAIT

SEQ ID NO: 1311996 - protein, 24 aa, Mycobacterium
ARIRAVRRRVLPPATAYAVRPYSE

SEQ ID NO: 1311997 - protein, 26 aa, Mycobacterium
ARISPAYRTLLAWVSPGLTHRSFLAD

SEQ ID NO: 1311998 - protein, 19 aa, Mycobacterium
ARKAVVAGVTRWLPRPIHE

SEQ ID NO: 1311999 - protein, 23 aa, Mycobacterium
ARKHQLLLLADEIYDKILYDDAK

SEQ ID NO: 1312000 - protein, 19 aa, Mycobacterium
ARKLAVMAELFIRRTTLAP

SEQ ID NO: 1312001 - protein, 20 aa, Mycobacterium
ARKSIAQFKLREGMPIGARV

SEQ ID NO: 1312002 - protein, 24 aa, Mycobacterium
ARKTFHLGPALVPLGQAAADALDV

SEQ ID NO: 1312003 - protein, 31 aa, Mycobacterium
ARLCYGSSDRIPKWLLPVVRENLRTGAPIQL

SEQ ID NO: 1312004 - protein, 27 aa, Mycobacterium
ARLDGLDSLLSIVQMPAGVPVATVSIG

SEQ ID NO: 1312005 - protein, 28 aa, Mycobacterium
ARLELNVAFRMLYARYPDITAAGEPVML

SEQ ID NO: 1312006 - protein, 18 aa, Mycobacterium
ARLFAIWETTPYNGHWPQ

SEQ ID NO: 1312007 - protein, 17 aa, Mycobacterium
ARLHRWRSATALAGAPD

SEQ ID NO: 1312008 - protein, 23 aa, Mycobacterium
ARLKSLLRKSLTPRSIRTGGADR

SEQ ID NO: 1312009 - protein, 30 aa, Mycobacterium
ARLLPKQVITPLTLPFIRAASRLMWRRNDS

SEQ ID NO: 1312010 - protein, 17 aa, Mycobacterium
ARLPVRLQWVSAELAMV

SEQ ID NO: 1312011 - protein, 40 aa, Mycobacterium
ARLTKPQFAMPTTGVWTSGFGYRWGVLHAGIDIANAIGTP

SEQ ID NO: 1312012 - protein, 19 aa, Mycobacterium
ARLTVGYSLAWQGRGREAD

SEQ ID NO: 1312013 - protein, 27 aa, Mycobacterium
ARMEFIISEYIKVHPLALLHPERVADS

SEQ ID NO: 1312014 - protein, 17 aa, Mycobacterium
ARMFAHCPEVVTAAAEL

SEQ ID NO: 1312015 - protein, 20 aa, Mycobacterium
ARMINGLLLPDRGAVRVHGL

SEQ ID NO: 1312016 - protein, 20 aa, Mycobacterium
ARMPVDVYPSLHATALGAAA

SEQ ID NO: 1312017 - protein, 19 aa, Mycobacterium
ARMRASLDALCRFVEDARS

SEQ ID NO: 1312018 - protein, 17 aa, Mycobacterium
ARNALSRDLIRALYASL

SEQ ID NO: 1312019 - protein, 19 aa, Mycobacterium
ARNALSRDLIRALYASLSE

SEQ ID NO: 1312020 - protein, 21 aa, Mycobacterium
ARNELFLHAIDNELPIPIGSF

SEQ ID NO: 1312021 - protein, 20 aa, Mycobacterium
ARNGLTMAPPFAAPKTAFNA

SEQ ID NO: 1312022 - protein, 29 aa, Mycobacterium
ARNNDHRVARWMVPAFPIMQETAALELWD

SEQ ID NO: 1312023 - protein, 24 aa, Mycobacterium
ARNPFRVFTSMLASADIRFFTADL

SEQ ID NO: 1312024 - protein, 19 aa, Mycobacterium
ARNRPVWIKGFGEQVPYKT

SEQ ID NO: 1312025 - protein, 17 aa, Mycobacterium
ARNRWRAVATAGGTVNA

SEQ ID NO: 1312026 - protein, 22 aa, Mycobacterium
ARNVLQLLALAPGVDHHREFLE

SEQ ID NO: 1312027 - protein, 25 aa, Mycobacterium
ARPARAYAPDTLHWLAALADRYDPS

SEQ ID NO: 1312028 - protein, 28 aa, Mycobacterium
ARPDLFHPRIVLAGCPALPEGDGDDDGL

SEQ ID NO: 1312029 - protein, 27 aa, Mycobacterium
ARPDLVHHIVYLAAALPREGRTYPEAM

SEQ ID NO: 1312030 - protein, 29 aa, Mycobacterium
ARPDVHVILIEPLLRRSEFLRETIEEIGI

SEQ ID NO: 1312031 - protein, 27 aa, Mycobacterium
ARPEEVAQAVLFLTSPRSSFVTGSTLY

SEQ ID NO: 1312032 - protein, 29 aa, Mycobacterium
ARPFGPPGFLFLDPPDHTRLRWLVSKAFV

SEQ ID NO: 1312033 - protein, 17 aa, Mycobacterium
ARPGVVLSRRQLLETVR

SEQ ID NO: 1312034 - protein, 25 aa, Mycobacterium
ARPRDLKLRFLSWGAAPASDTLLRE

SEQ ID NO: 1312035 - protein, 22 aa, Mycobacterium
ARPVWLEPRWDAEFGVAHGLDA

SEQ ID NO: 1312036 - protein, 23 aa, Mycobacterium
ARPYPIPIICALLGAPREDWQLF

SEQ ID NO: 1312037 - protein, 24 aa, Mycobacterium
ARQATFLGYRVTVCDARPVFATAA

SEQ ID NO: 1312038 - protein, 25 aa, Mycobacterium
ARQEWRIFVDLALAMNRPLFGVPGL

SEQ ID NO: 1312039 - protein, 23 aa, Mycobacterium
ARQGVVTLMSLDFNKAQEDVKRI

SEQ ID NO: 1312040 - protein, 24 aa, Mycobacterium
ARQLIDRGIGAVLATLGAAGAVLV

SEQ ID NO: 1312041 - protein, 19 aa, Mycobacterium
ARQPYYRWLANPTTDAEMI

SEQ ID NO: 1312042 - protein, 20 aa, Mycobacterium
ARQRKLIEQLTRAALEVSGV

SEQ ID NO: 1312043 - protein, 23 aa, Mycobacterium
ARQRPQLLIDWIDGRTGALDEDL

SEQ ID NO: 1312044 - protein, 18 aa, Mycobacterium
ARQRVAIAGALLGDPAAV

SEQ ID NO: 1312045 - protein, 18 aa, Mycobacterium
ARQSYLSVEALLAAVRRT

SEQ ID NO: 1312046 - protein, 19 aa, Mycobacterium
ARQTANWALDAIAGSCCNS

SEQ ID NO: 1312047 - protein, 19 aa, Mycobacterium
ARQTYVEKLQAVGNQRHTA

SEQ ID NO: 1312048 - protein, 22 aa, Mycobacterium
ARRADELVALLRAAGFTGVHES

SEQ ID NO: 1312049 - protein, 35 aa, Mycobacterium
ARRARSIFIINPADPPILMRNTVYCLVDGDVPRGD

SEQ ID NO: 1312050 - protein, 31 aa, Mycobacterium
ARRAWPELADRPGALLRQLILVGQKMLAHNE

SEQ ID NO: 1312051 - protein, 17 aa, Mycobacterium
ARRAYDVHPLIEALLDE

SEQ ID NO: 1312052 - protein, 19 aa, Mycobacterium
ARRCRAVCQVPFDPHLEEG

SEQ ID NO: 1312053 - protein, 25 aa, Mycobacterium
ARRDPVYKFVLAEVDYLKPYWDTHP

SEQ ID NO: 1312054 - protein, 23 aa, Mycobacterium
ARREAELECPLIQVGFMRRFDDE

SEQ ID NO: 1312055 - protein, 24 aa, Mycobacterium
ARRFEPVLFFHPDEAFFPSDAKRF

SEQ ID NO: 1312056 - protein, 18 aa, Mycobacterium
ARRFVLAEKPFILDLSGV

SEQ ID NO: 1312057 - protein, 24 aa, Mycobacterium
ARRGALTSLVLPELRAMAKEIGVE

SEQ ID NO: 1312058 - protein, 19 aa, Mycobacterium
ARRHTLLPDGRDLILGNWA

SEQ ID NO: 1312059 - protein, 23 aa, Mycobacterium
ARRKFIEVVAALAAFFPASVTRS

SEQ ID NO: 1312060 - protein, 18 aa, Mycobacterium
ARRLFPDRKVILAAVRDD

SEQ ID NO: 1312061 - protein, 20 aa, Mycobacterium
ARRLPADGALPEIARARDLL

SEQ ID NO: 1312062 - protein, 19 aa, Mycobacterium
ARRLQFVGCLTLVPQLPVL

SEQ ID NO: 1312063 - protein, 26 aa, Mycobacterium
ARRLRSMRWGLIPPWVKSTDDGAPDN

SEQ ID NO: 1312064 - protein, 19 aa, Mycobacterium
ARRLVHVPVGRFAEPEELA

SEQ ID NO: 1312065 - protein, 24 aa, Mycobacterium
ARRLVVRGFFNEIIAKIAVPAVRE

SEQ ID NO: 1312066 - protein, 18 aa, Mycobacterium
ARRMSEISEAPLYIDDSP

SEQ ID NO: 1312067 - protein, 19 aa, Mycobacterium
ARRMSEISEAPLYIDDSPN

SEQ ID NO: 1312068 - protein, 24 aa, Mycobacterium
ARRPGLPLSTLRRRLHARLTRHGI

SEQ ID NO: 1312069 - protein, 18 aa, Mycobacterium
ARRPSYRPAAPPARRAAG

SEQ ID NO: 1312070 - protein, 24 aa, Mycobacterium
ARRQAEKLTLRTYAKTWLDNKTKL

SEQ ID NO: 1312071 - protein, 20 aa, Mycobacterium
ARRRTNVLYALIRDNRTWQP

SEQ ID NO: 1312072 - protein, 17 aa, Mycobacterium
ARRRVIVAVPFEDQPRE

SEQ ID NO: 1312073 - protein, 20 aa, Mycobacterium
ARRRVLDPAIYREATTRLDR

SEQ ID NO: 1312074 - protein, 17 aa, Mycobacterium
ARRRYHFLAGRGADGEL

SEQ ID NO: 1312075 - protein, 20 aa, Mycobacterium
ARRSLAALLPLAAPKALRKS

SEQ ID NO: 1312076 - protein, 19 aa, Mycobacterium
ARRSVLGRTWPVICDELLG

SEQ ID NO: 1312077 - protein, 21 aa, Mycobacterium
ARRVFATCRRLGIGTVAVYTD

SEQ ID NO: 1312078 - protein, 25 aa, Mycobacterium
ARRVTFGDVWALLVDGRFGDGLPPA

SEQ ID NO: 1312079 - protein, 17 aa, Mycobacterium
ARRWSRDSVAQALRLVA

SEQ ID NO: 1312080 - protein, 24 aa, Mycobacterium
ARRYNYEPTFILRGLTDLNITFTP

SEQ ID NO: 1312081 - protein, 19 aa, Mycobacterium
ARSDFLTAPGLQMLVPCQQ

SEQ ID NO: 1312082 - protein, 25 aa, Mycobacterium
ARSFALLERFELQRWADAVRRHRPA

SEQ ID NO: 1312083 - protein, 20 aa, Mycobacterium
ARSHTLPRWLTELSDVEVYR

SEQ ID NO: 1312084 - protein, 18 aa, Mycobacterium
ARSLLRHWEPKRRGIYCG

SEQ ID NO: 1312085 - protein, 28 aa, Mycobacterium
ARSPLDRARIAHMAARIDKAAFTRADMV

SEQ ID NO: 1312086 - protein, 19 aa, Mycobacterium
ARSQERAAAAWAGGYFAKS

SEQ ID NO: 1312087 - protein, 26 aa, Mycobacterium
ARSVLYRRWPSRLDLLKAVIRHRGEV

SEQ ID NO: 1312088 - protein, 17 aa, Mycobacterium
ARSVPFALAAPLGALLE

SEQ ID NO: 1312089 - protein, 19 aa, Mycobacterium
ARSWAASTTIPLFGALTGT

SEQ ID NO: 1312090 - protein, 17 aa, Mycobacterium
ARSYAPAGFRAGPWAAA

SEQ ID NO: 1312091 - protein, 35 aa, Mycobacterium
ARTDWTVPKHEGLTMFLVPLNAPGITMRRIKEVNG

SEQ ID NO: 1312092 - protein, 26 aa, Mycobacterium
ARTFGMDSWFPSLKIYNRNGQLYTAV

SEQ ID NO: 1312093 - protein, 18 aa, Mycobacterium
ARTFHGAVLFALSPKDIE

SEQ ID NO: 1312094 - protein, 21 aa, Mycobacterium
ARTFPLACPPSVGPDDVAAFI

SEQ ID NO: 1312095 - protein, 21 aa, Mycobacterium
ARTGVFWVREMLPTPKIREIL

SEQ ID NO: 1312096 - protein, 17 aa, Mycobacterium
ARTIFAIDPVEWKRDQA

SEQ ID NO: 1312097 - protein, 20 aa, Mycobacterium
ARTINPCHTPLDGDTVFALA

SEQ ID NO: 1312098 - protein, 17 aa, Mycobacterium
ARTLLAERGAQSCYWDY

SEQ ID NO: 1312099 - protein, 17 aa, Mycobacterium
ARTLMQAPALLLADEPV

SEQ ID NO: 1312100 - protein, 19 aa, Mycobacterium
ARTLRPGRRPLDRLLRRER

SEQ ID NO: 1312101 - protein, 24 aa, Mycobacterium
ARTREQVMFLSALEDLDRRHENLR

SEQ ID NO: 1312102 - protein, 24 aa, Mycobacterium
ARTRILDLFEFAGAHPAMCRNIVP

SEQ ID NO: 1312103 - protein, 19 aa, Mycobacterium
ARVAAVHKIIGSTPRMWHL

SEQ ID NO: 1312104 - protein, 26 aa, Mycobacterium
ARVDASMVLYLFGSKEQLFREALRLI

SEQ ID NO: 1312105 - protein, 18 aa, Mycobacterium
ARVEDTLYVALPPSYFQG

SEQ ID NO: 1312106 - protein, 31 aa, Mycobacterium
ARVEYKLRDWLFARQRYWGEPFPIVYDSDGR

SEQ ID NO: 1312107 - protein, 18 aa, Mycobacterium
ARVGLAALLLSRFDIVLL

SEQ ID NO: 1312108 - protein, 27 aa, Mycobacterium
ARVISDVWLSNLLAWLTRRASATDVAK

SEQ ID NO: 1312109 - protein, 26 aa, Mycobacterium
ARVISDVWLSNLLAWLTRRASATDVS

SEQ ID NO: 1312110 - protein, 28 aa, Mycobacterium
ARVQRALYDAGWSRYGWPEHAGGLGGPA

SEQ ID NO: 1312111 - protein, 24 aa, Mycobacterium
ARVQRGPLPALERLHAALRDSMPA

SEQ ID NO: 1312112 - protein, 24 aa, Mycobacterium
ARVRELFVDVLGPERLAALGEASR

SEQ ID NO: 1312113 - protein, 23 aa, Mycobacterium
ARVRHQIAFYGATPAYRAVLELH

SEQ ID NO: 1312114 - protein, 25 aa, Mycobacterium
ARVRVRLLRELAATGEALVATHLPF

SEQ ID NO: 1312115 - protein, 33 aa, Mycobacterium
ARVSRPTIYRRWPDIRWVIAELLTVRITGVLEA

SEQ ID NO: 1312116 - protein, 29 aa, Mycobacterium
ARVTLTWGRILFTFFNTQAAQGVLEAFGA

SEQ ID NO: 1312117 - protein, 24 aa, Mycobacterium
ARWGDGWVKLVGDWIDRDTGDLAP

SEQ ID NO: 1312118 - protein, 25 aa, Mycobacterium
ARYAEIVLNERILTTSTLRAEDRLS

SEQ ID NO: 1312119 - protein, 24 aa, Mycobacterium
ARYTHTCFLATPYEPYIEVAETLN

SEQ ID NO: 1312120 - protein, 25 aa, Mycobacterium
ASAAVPAPLMRWGVAAFDPTVRSPT

SEQ ID NO: 1312121 - protein, 26 aa, Mycobacterium
ASAEFRMWWAEHRVFQRTYGTKRLRH

SEQ ID NO: 1312122 - protein, 23 aa, Mycobacterium
ASAGFMLMKPLVETATAAGARAV

SEQ ID NO: 1312123 - protein, 17 aa, Mycobacterium
ASALLYNGLGRYQEAFQ

SEQ ID NO: 1312124 - protein, 28 aa, Mycobacterium
ASANFLTELFDLPSPKPFGHFLVVSVGS

SEQ ID NO: 1312125 - protein, 26 aa, Mycobacterium
ASANPYLAAAAFLGSALRGIGRHLEL

SEQ ID NO: 1312126 - protein, 33 aa, Mycobacterium
ASAPPLPGYPRPGGTVLFLGRFDEPRKGMSVLL

SEQ ID NO: 1312127 - protein, 26 aa, Mycobacterium
ASAPQDFLAILRPFLTRTLGTTAGSP

SEQ ID NO: 1312128 - protein, 20 aa, Mycobacterium
ASAPTYRYEFGWRSTGVGGE

SEQ ID NO: 1312129 - protein, 29 aa, Mycobacterium
ASARANVPFTPLNYRLSPEALGQLIDRLP

SEQ ID NO: 1312130 - protein, 26 aa, Mycobacterium
ASARPARFAYPPNLFVVDGGAPQVNA

SEQ ID NO: 1312131 - protein, 20 aa, Mycobacterium
ASATDWWLGAEQDSPRRLPS

SEQ ID NO: 1312132 - protein, 20 aa, Mycobacterium
ASATFDIPPGAVPSAIECHD

SEQ ID NO: 1312133 - protein, 26 aa, Mycobacterium
ASATRPPAVLWWIRDHLDIEMVRIGS

SEQ ID NO: 1312134 - protein, 27 aa, Mycobacterium
ASATRYRSTILAIWRRIASSSTRRTSS

SEQ ID NO: 1312135 - protein, 21 aa, Mycobacterium
ASAVRWAVELGLVPAADQIDS

SEQ ID NO: 1312136 - protein, 25 aa, Mycobacterium
ASDAAGFKWLAPYTGSAIGQHWMYD

SEQ ID NO: 1312137 - protein, 33 aa, Mycobacterium
ASDEDMLASFILLRRLLLLAWMGTHSHSKESQA

SEQ ID NO: 1312138 - protein, 26 aa, Mycobacterium
ASDELGLPTAPFWFAGSAEELGTVAQ

SEQ ID NO: 1312139 - protein, 17 aa, Mycobacterium
ASDGLIHHIRARIRPAI

SEQ ID NO: 1312140 - protein, 23 aa, Mycobacterium
ASDIVFDGLRLPSTALLGAEGGA

SEQ ID NO: 1312141 - protein, 35 aa, Mycobacterium
ASDKAARFLQLCDAFGFPVVSLIDCPGYMVGPAAE

SEQ ID NO: 1312142 - protein, 25 aa, Mycobacterium
ASDRAGIPAMKWTTQLTYAADGLTA

SEQ ID NO: 1312143 - protein, 23 aa, Mycobacterium
ASDRFMADLDAFAPAREIYERNT

SEQ ID NO: 1312144 - protein, 19 aa, Mycobacterium
ASDRLAALQLALADIDAQV

SEQ ID NO: 1312145 - protein, 28 aa, Mycobacterium
ASDRQRHRLALWSRRLLGEAITQAQFVL

SEQ ID NO: 1312146 - protein, 27 aa, Mycobacterium
ASDRYKLALFILRVLTPGPHASQTVDP

SEQ ID NO: 1312147 - protein, 28 aa, Mycobacterium
ASDRYVRAGRWPVDGMYPLTRQVSKTNV

SEQ ID NO: 1312148 - protein, 26 aa, Mycobacterium
ASDSGRLLIAPRLDDRYPTYGVLASI

SEQ ID NO: 1312149 - protein, 24 aa, Mycobacterium
ASDWIWSGLCLPAVRIGSRLHRET

SEQ ID NO: 1312150 - protein, 27 aa, Mycobacterium
ASEAMLWRRPRWSVRLQTGPIGDMLTE

SEQ ID NO: 1312151 - protein, 21 aa, Mycobacterium
ASEATYFWKSDPQLPTPDLQT

SEQ ID NO: 1312152 - protein, 26 aa, Mycobacterium
ASEIFGVYQPLIGWSSKRQLTRIKRG

SEQ ID NO: 1312153 - protein, 18 aa, Mycobacterium
ASELLFRAQGRTLAHTDC

SEQ ID NO: 1312154 - protein, 25 aa, Mycobacterium
ASELSLLFCLYQMAAAGGPSFVLGV

SEQ ID NO: 1312155 - protein, 26 aa, Mycobacterium
ASELVIRRAMSQLGVPYSWGGGNANG

SEQ ID NO: 1312156 - protein, 21 aa, Mycobacterium
ASEPMREDIRLLGAILGDTVR

SEQ ID NO: 1312157 - protein, 17 aa, Mycobacterium
ASEWPDRPGKFLRPHDD

SEQ ID NO: 1312158 - protein, 24 aa, Mycobacterium
ASEYRYLVIGSPAGAYFPRGIKPV

SEQ ID NO: 1312159 - protein, 24 aa, Mycobacterium
ASFAPVQEFYYRTPPQIERGRRHY

SEQ ID NO: 1312160 - protein, 34 aa, Mycobacterium
ASFDFSGPPLKLDDVRLLPPITPTSTVVGVGMNY

SEQ ID NO: 1312161 - protein, 19 aa, Mycobacterium
ASFETMFDTNVRGAYFLVA

SEQ ID NO: 1312162 - protein, 18 aa, Mycobacterium
ASFLRQLGGHRPAAGWDG

SEQ ID NO: 1312163 - protein, 31 aa, Mycobacterium
ASFLVKDLHLPWQWGARWFLEQLVDGDIANN

SEQ ID NO: 1312164 - protein, 25 aa, Mycobacterium
ASGDEWLIDTYVRPTLHGELIGSLA

SEQ ID NO: 1312165 - protein, 18 aa, Mycobacterium
ASGDPMLYGIGGSAVRIF

SEQ ID NO: 1312166 - protein, 25 aa, Mycobacterium
ASGDYPGMMRLIEAGTLRPQAFVER

SEQ ID NO: 1312167 - protein, 29 aa, Mycobacterium
ASGIDLYRNPLFPVRRTGSVLYIVGEGGV

SEQ ID NO: 1312168 - protein, 24 aa, Mycobacterium
ASGKLDLALVFNEGPDYAAAGVFT

SEQ ID NO: 1312169 - protein, 23 aa, Mycobacterium
ASGLDARAYRLGWPAGTVVYELD

SEQ ID NO: 1312170 - protein, 28 aa, Mycobacterium
ASGLDARAYRLSWPQDMVLFEIDQPEVL

SEQ ID NO: 1312171 - protein, 27 aa, Mycobacterium
ASGLDSRAFRLPWPAGTTVFEIDQPLV

SEQ ID NO: 1312172 - protein, 26 aa, Mycobacterium
ASGLDTRAYRLPWPAGTVVYEIDQPT

SEQ ID NO: 1312173 - protein, 27 aa, Mycobacterium
ASGLRHMNGFPGGPPPRLALSLGDSLA

SEQ ID NO: 1312174 - protein, 26 aa, Mycobacterium
ASGPGIAWPEGWSVWKSRRYGDTRLE

SEQ ID NO: 1312175 - protein, 27 aa, Mycobacterium
ASGQGFRSYPLFVPFGIGDADAATLAE

SEQ ID NO: 1312176 - protein, 24 aa, Mycobacterium
ASGQMRIAIALRDRLPRLAERYLQ

SEQ ID NO: 1312177 - protein, 19 aa, Mycobacterium
ASGQYWVIDARTHRPVGNR

SEQ ID NO: 1312178 - protein, 27 aa, Mycobacterium
ASGRTYAFSLMLTFLKGRLQVIDHLKR

SEQ ID NO: 1312179 - protein, 23 aa, Mycobacterium
ASGSGEMLCRWARDYLVTGTGVD

SEQ ID NO: 1312180 - protein, 23 aa, Mycobacterium
ASGVIMMSQAIRRSGRLALPVPR

SEQ ID NO: 1312181 - protein, 32 aa, Mycobacterium
ASGVIPRIPLNLVLIKGVHVLGFQFQDVPADE

SEQ ID NO: 1312182 - protein, 18 aa, Mycobacterium
ASGWGHPVQPGLALLRLA

SEQ ID NO: 1312183 - protein, 23 aa, Mycobacterium
ASGYKISVPHAVRISPDGIYLHE

SEQ ID NO: 1312184 - protein, 28 aa, Mycobacterium
ASGYMVPPQWFAMWARRHQHEYGSTCED

SEQ ID NO: 1312185 - protein, 26 aa, Mycobacterium
ASHRQHTLVAKWAKARPLGLSGHALA

SEQ ID NO: 1312186 - protein, 21 aa, Mycobacterium
ASIADLTVALPAGVLADAEEA

SEQ ID NO: 1312187 - protein, 29 aa, Mycobacterium
ASIAKHKVVIIPGLQYKALTTGGRMVPRN

SEQ ID NO: 1312188 - protein, 23 aa, Mycobacterium
ASIGVVCTPLPPLAAEPPDEVLD

SEQ ID NO: 1312189 - protein, 22 aa, Mycobacterium
ASIKVLAHLLAAAEATTMTPAR

SEQ ID NO: 1312190 - protein, 38 aa, Mycobacterium
ASISIHRQWLLIELRTDWSYRFQNYPAGSLLAADYEEF

SEQ ID NO: 1312191 - protein, 19 aa, Mycobacterium
ASIVKLYYSELLQRLTDFG

SEQ ID NO: 1312192 - protein, 18 aa, Mycobacterium
ASKFIKKALTGEGLPLMR

SEQ ID NO: 1312193 - protein, 20 aa, Mycobacterium
ASKFVVFMPCAPEVPMMTFL

SEQ ID NO: 1312194 - protein, 20 aa, Mycobacterium
ASKRIAPIVILTAFSQRELV

SEQ ID NO: 1312195 - protein, 18 aa, Mycobacterium
ASKTPRFAGPATFARLPR

SEQ ID NO: 1312196 - protein, 18 aa, Mycobacterium
ASLAVAVRHWRAALGLTS

SEQ ID NO: 1312197 - protein, 17 aa, Mycobacterium
ASLIGDLVRRCRLVMAG

SEQ ID NO: 1312198 - protein, 23 aa, Mycobacterium
ASLITLPLWNLTSARRVLKLPTE

SEQ ID NO: 1312199 - protein, 24 aa, Mycobacterium
ASLLAMPQAPVYAAAKAGLNNLTG

SEQ ID NO: 1312200 - protein, 20 aa, Mycobacterium
ASLLPLLHNYQHPETPIRGS

SEQ ID NO: 1312201 - protein, 18 aa, Mycobacterium
ASLREPHRVSRYLEDLAG

SEQ ID NO: 1312202 - protein, 21 aa, Mycobacterium
ASLTINKMCLSGIDAIALADQ

SEQ ID NO: 1312203 - protein, 26 aa, Mycobacterium
ASLVLFPEATICRFGVPPAEIAEPFD

SEQ ID NO: 1312204 - protein, 27 aa, Mycobacterium
ASMDPWTVPLYQLTAGHPPVPAPITPL

SEQ ID NO: 1312205 - protein, 20 aa, Mycobacterium
ASMRQAARFGLIERLRGFDE

SEQ ID NO: 1312206 - protein, 20 aa, Mycobacterium
ASNGAFGPQFMPGAGRGSSY

SEQ ID NO: 1312207 - protein, 35 aa, Mycobacterium
ASPAARLWQLRTVLALDLAIHILKTSWTVTDTPVA

SEQ ID NO: 1312208 - protein, 23 aa, Mycobacterium
ASPPTFVAKLNTVDGRRVATGRD

SEQ ID NO: 1312209 - protein, 18 aa, Mycobacterium
ASPRAGLIGCAWADLAEV

SEQ ID NO: 1312210 - protein, 26 aa, Mycobacterium
ASPSARFCTQFIKLGLGGCDIGVSYT

SEQ ID NO: 1312211 - protein, 20 aa, Mycobacterium
ASPVPIYVHAPYLINVASAN

SEQ ID NO: 1312212 - protein, 22 aa, Mycobacterium
ASPVRWPERLRPALSTVGFATE

SEQ ID NO: 1312213 - protein, 17 aa, Mycobacterium
ASQAPPAMRLCHHLHGG

SEQ ID NO: 1312214 - protein, 30 aa, Mycobacterium
ASQLSLRDRTIAAWLWSGRGAVVAGAAAAA

SEQ ID NO: 1312215 - protein, 24 aa, Mycobacterium
ASQQRIGWIFNLADVVLAPTTALP

SEQ ID NO: 1312216 - protein, 25 aa, Mycobacterium
ASQSGLTLVAFLRGDSMNVYTRPDR

SEQ ID NO: 1312217 - protein, 23 aa, Mycobacterium
ASQTVLFLGRHVGYPVALEGALK

SEQ ID NO: 1312218 - protein, 26 aa, Mycobacterium
ASQYKDVILGLVFLKYVSDAYDERRE

SEQ ID NO: 1312219 - protein, 19 aa, Mycobacterium
ASRALVRFGFAAGDGLRRL

SEQ ID NO: 1312220 - protein, 18 aa, Mycobacterium
ASRARKAPGFALLGEKGE

SEQ ID NO: 1312221 - protein, 31 aa, Mycobacterium
ASRDKFPRAVLPRTFDYGFATGLMTKDVLLY

SEQ ID NO: 1312222 - protein, 24 aa, Mycobacterium
ASRDPVIFLEPKRRYWAKEVVDTG

SEQ ID NO: 1312223 - protein, 21 aa, Mycobacterium
ASRLLKPYHPALEVSPFATAQ

SEQ ID NO: 1312224 - protein, 21 aa, Mycobacterium
ASRPIEWRYTNDPAWIMRDKG

SEQ ID NO: 1312225 - protein, 23 aa, Mycobacterium
ASRPLHLHGGRFSHLLAVYLAAH

SEQ ID NO: 1312226 - protein, 29 aa, Mycobacterium
ASRPTAWLAEGLLIYLPPEAQDQLFDRIT

SEQ ID NO: 1312227 - protein, 23 aa, Mycobacterium
ASRSLTVLWQREARYLDAAERAE

SEQ ID NO: 1312228 - protein, 25 aa, Mycobacterium
ASSKYALVIYAAKRARQINDYYNQL

SEQ ID NO: 1312229 - protein, 24 aa, Mycobacterium
ASSLPIADLAIAAWVLDSVGMPHA

SEQ ID NO: 1312230 - protein, 20 aa, Mycobacterium
ASTPAVTLADRLGRKRLSEP

SEQ ID NO: 1312231 - protein, 26 aa, Mycobacterium
ASTTLAYGSLLLDLRTRRAHVGDYAV

SEQ ID NO: 1312232 - protein, 17 aa, Mycobacterium
ASTTYYFSSLDDLIAKA

SEQ ID NO: 1312233 - protein, 20 aa, Mycobacterium
ASVDDLLRHQLRLPTPDEAR

SEQ ID NO: 1312234 - protein, 21 aa, Mycobacterium
ASVPGWLVPESFPGPVGSVVI

SEQ ID NO: 1312235 - protein, 19 aa, Mycobacterium
ASVPIAVNSLWPATTIAST

SEQ ID NO: 1312236 - protein, 24 aa, Mycobacterium
ASVPLAFLSSWMNYRHAAPEHFDA

SEQ ID NO: 1312237 - protein, 19 aa, Mycobacterium
ASVRIALDDWLVHGGSLPD

SEQ ID NO: 1312238 - protein, 20 aa, Mycobacterium
ASVRNFWWQGIAMMEAAATR

SEQ ID NO: 1312239 - protein, 22 aa, Mycobacterium
ASVRVGLLDKMKDRWRADLLGD

SEQ ID NO: 1312240 - protein, 17 aa, Mycobacterium
ASYAATGFTPLYPSWPL

SEQ ID NO: 1312241 - protein, 30 aa, Mycobacterium
ATAAIPPLRTLYRDRLLVLAALDVASTVEN

SEQ ID NO: 1312242 - protein, 17 aa, Mycobacterium
ATAATWLRPGGHLLYLG

SEQ ID NO: 1312243 - protein, 34 aa, Mycobacterium
ATADKADLYLPIRPGTDLALLNGILHLLVENGAV

SEQ ID NO: 1312244 - protein, 38 aa, Mycobacterium
ATAGRAVALAPRLWVPDDFGLSRYLAAGLAVLQVVAPG

SEQ ID NO: 1312245 - protein, 24 aa, Mycobacterium
ATAGRVAFIIRFGAGLLPDAKTVI

SEQ ID NO: 1312246 - protein, 27 aa, Mycobacterium
ATAKAAEPLLLILDVQKPRPADIAIHV

SEQ ID NO: 1312247 - protein, 19 aa, Mycobacterium
ATALALFCGSADSPTTPRA

SEQ ID NO: 1312248 - protein, 24 aa, Mycobacterium
ATALWALHPTYYGTTGDLAALADL

SEQ ID NO: 1312249 - protein, 19 aa, Mycobacterium
ATARAGVVLVPINFMLTAE

SEQ ID NO: 1312250 - protein, 22 aa, Mycobacterium
ATARELPWLADAEDRATSWIIT

SEQ ID NO: 1312251 - protein, 24 aa, Mycobacterium
ATARGKLLWRLGEIIARDAEQLAE

SEQ ID NO: 1312252 - protein, 17 aa, Mycobacterium
ATARYSGYLRASLPPFW

SEQ ID NO: 1312253 - protein, 22 aa, Mycobacterium
ATASIFHWWTYADMARDTGATV

SEQ ID NO: 1312254 - protein, 21 aa, Mycobacterium
ATATYLVRMLRDIPGLTVTRI

SEQ ID NO: 1312255 - protein, 29 aa, Mycobacterium
ATAVEQVFLRRLLTGELRQGALGGVMADA

SEQ ID NO: 1312256 - protein, 19 aa, Mycobacterium
ATAVLLAQMFGAGCRRLVL

SEQ ID NO: 1312257 - protein, 19 aa, Mycobacterium
ATAYPVEFLSLGTSGIGVP

SEQ ID NO: 1312258 - protein, 18 aa, Mycobacterium
ATCEVWFQRHGRPLGTGR

SEQ ID NO: 1312259 - protein, 25 aa, Mycobacterium
ATDCDMGIHLLARPGTSGDPRFTDF

SEQ ID NO: 1312260 - protein, 33 aa, Mycobacterium
ATDDELIAAAAYRWLRSWPVAPSSPWEVPSGWR

SEQ ID NO: 1312261 - protein, 23 aa, Mycobacterium
ATDEDHLIPPGDYARLITYTVDA

SEQ ID NO: 1312262 - protein, 29 aa, Mycobacterium
ATDLLDEAWWFPAICWPDGRLQFMLNERM

SEQ ID NO: 1312263 - protein, 18 aa, Mycobacterium
ATDPSSHRVWTGASAVLL

SEQ ID NO: 1312264 - protein, 24 aa, Mycobacterium
ATDRAGLLAVLTRVLERAGVDIAW

SEQ ID NO: 1312265 - protein, 24 aa, Mycobacterium
ATDTELRIRCLEQFHAALVEHRDE

SEQ ID NO: 1312266 - protein, 21 aa, Mycobacterium
ATEALLIDGDPWGGGLDLVLG

SEQ ID NO: 1312267 - protein, 24 aa, Mycobacterium
ATEATRIVTWFRHGPTPKVTANHR

SEQ ID NO: 1312268 - protein, 21 aa, Mycobacterium
ATEEFLRYFTPAPGDGRTVAE

SEQ ID NO: 1312269 - protein, 17 aa, Mycobacterium
ATEPMREDIRLLGAILG

SEQ ID NO: 1312270 - protein, 19 aa, Mycobacterium
ATFAFVDLSGFTALTEICG

SEQ ID NO: 1312271 - protein, 20 aa, Mycobacterium
ATFEWTFRRLADARPEPSPM

SEQ ID NO: 1312272 - protein, 33 aa, Mycobacterium; identical to SEQ ID NO: 796296

SEQ ID NO: 1312273 - protein, 19 aa, Mycobacterium
ATGDAEWPWPEKRLSYANA

SEQ ID NO: 1312274 - protein, 17 aa, Mycobacterium
ATGDPKQQVRCVYVAIG

SEQ ID NO: 1312275 - protein, 23 aa, Mycobacterium
ATGGQFLIRLAGAPELRAYHRLR

SEQ ID NO: 1312276 - protein, 33 aa, Mycobacterium
ATGGRYPHALLHHIVAPALRVPEAAAAAVLAAA

SEQ ID NO: 1312277 - protein, 26 aa, Mycobacterium
ATGGYPIPVLPSFAGALAPSVTQIHS

SEQ ID NO: 1312278 - protein, 28 aa, Mycobacterium
ATGLLKPSRLHILPTRDFHDQALEPVTL

SEQ ID NO: 1312279 - protein, 26 aa, Mycobacterium
ATGLVPKRIPSFPDLPGIHVLRNFDE

SEQ ID NO: 1312280 - protein, 31 aa, Mycobacterium
ATGPDAFDCSGLIKWAFLQNGKSLPRSSQAL

SEQ ID NO: 1312281 - protein, 32 aa, Mycobacterium
ATGRFDDEQLFYLRARGIPENQARRLVVRGFF

SEQ ID NO: 1312282 - protein, 27 aa, Mycobacterium
ATGTMTHAWLITGPPGSGRSIAALCFA

SEQ ID NO: 1312283 - protein, 25 aa, Mycobacterium
ATGVFDRLPELWVIVGHMGEMIPFA

SEQ ID NO: 1312284 - protein, 24 aa, Mycobacterium
ATGYNITFPFFDPEFISAPDNSIR

SEQ ID NO: 1312285 - protein, 19 aa, Mycobacterium
ATHFVRWLSLWSATIDDMY

SEQ ID NO: 1312286 - protein, 18 aa, Mycobacterium
ATHFVRWLSLWSSTIDDM

SEQ ID NO: 1312287 - protein, 19 aa, Mycobacterium
ATHKLPFGGVGPSGLGAYH

SEQ ID NO: 1312288 - protein, 29 aa, Mycobacterium
ATHLSRLVPQHMMRRLFFTAATVTADTLH

SEQ ID NO: 1312289 - protein, 18 aa, Mycobacterium
ATHQAIIGDRMRLPLDGE

SEQ ID NO: 1312290 - protein, 28 aa, Mycobacterium
ATHSRLLYDVLGTVYDWLGFDVVDDAVF

SEQ ID NO: 1312291 - protein, 17 aa, Mycobacterium
ATIEILLARTLGGGEPT

SEQ ID NO: 1312292 - protein, 19 aa, Mycobacterium
ATIPMVHAVSRVVGVPYAE

SEQ ID NO: 1312293 - protein, 30 aa, Mycobacterium
ATITSWSIFGLGELGWPLEPVFKIPGEIAR

SEQ ID NO: 1312294 - protein, 24 aa, Mycobacterium
ATKKWRETYWAQYWDRKLDDTPSL

SEQ ID NO: 1312295 - protein, 18 aa, Mycobacterium
ATKMFCGCANRFGAEPNT

SEQ ID NO: 1312296 - protein, 17 aa, Mycobacterium
ATKVVVITGAGRFFCAG

SEQ ID NO: 1312297 - protein, 25 aa, Mycobacterium
ATLADLVEKFGDALLPIALDVTDRE

SEQ ID NO: 1312298 - protein, 26 aa, Mycobacterium
ATLATRVPFVHFFDGFRTSHEINTIE

SEQ ID NO: 1312299 - protein, 23 aa, Mycobacterium
ATLDGVDLLARRAREILGDIDII

SEQ ID NO: 1312300 - protein, 17 aa, Mycobacterium
ATLFGLFADVRQLLIAS

SEQ ID NO: 1312301 - protein, 19 aa, Mycobacterium
ATLGLFNGALLLGVRMLGV

SEQ ID NO: 1312302 - protein, 19 aa, Mycobacterium
ATLIQYRPSSAPPGDLWQS

SEQ ID NO: 1312303 - protein, 18 aa, Mycobacterium
ATLPARYAVSVGDAGLIR

SEQ ID NO: 1312304 - protein, 20 aa, Mycobacterium
ATLSLLSRYAEDSALLVLVD

SEQ ID NO: 1312305 - protein, 25 aa, Mycobacterium
ATMANWTFPALQQAGARYTWDGETT

SEQ ID NO: 1312306 - protein, 29 aa, Mycobacterium
ATMGLSYLGFTQWALLTDPPPELKAAVIT

SEQ ID NO: 1312307 - protein, 22 aa, Mycobacterium
ATMHPSRYLTLIEGVSQVFVTG

SEQ ID NO: 1312308 - protein, 19 aa, Mycobacterium
ATMPGTAIWHMAWSDKDDA

SEQ ID NO: 1312309 - protein, 24 aa, Mycobacterium
ATNPVPRQVLVPVLPDTTEELETW

SEQ ID NO: 1312310 - protein, 22 aa, Mycobacterium
ATPADFWTFLLDGGSRVREVPA

SEQ ID NO: 1312311 - protein, 29 aa, Mycobacterium
ATPDRFLVGLAVLSLMAAASTGGPLLCVI

SEQ ID NO: 1312312 - protein, 20 aa, Mycobacterium
ATPFERAAITDMLFGSVSDV

SEQ ID NO: 1312313 - protein, 23 aa, Mycobacterium
ATPFFWRQRYRMVLSADGALHDT

SEQ ID NO: 1312314 - protein, 25 aa, Mycobacterium
ATPGEIAQAVLFLASPRAGFVTGSV

SEQ ID NO: 1312315 - protein, 28 aa, Mycobacterium
ATPPARLVGWTSRFLGMVLPGDEIEFRV

SEQ ID NO: 1312316 - protein, 22 aa, Mycobacterium
ATPRAIPSLRKGPDARRQLAEA

SEQ ID NO: 1312317 - protein, 18 aa, Mycobacterium
ATQLLLESARPMTLRFLD

SEQ ID NO: 1312318 - protein, 20 aa, Mycobacterium
ATQPLAHNAPLRALVTALER

SEQ ID NO: 1312319 - protein, 21 aa, Mycobacterium
ATQRLGVLHRDPLPQALTGLN

SEQ ID NO: 1312320 - protein, 25 aa, Mycobacterium
ATQSWIQVPLPAAFFEDEKLEAERI

SEQ ID NO: 1312321 - protein, 24 aa, Mycobacterium
ATRATIRRRWRAESRRRSMSESGT

SEQ ID NO: 1312322 - protein, 19 aa, Mycobacterium
ATRLIYRVGWRETSPPVRD

SEQ ID NO: 1312323 - protein, 18 aa, Mycobacterium
ATRLLPNLVTVLGWESCD

SEQ ID NO: 1312324 - protein, 22 aa, Mycobacterium
ATRNIVPRVLFLEASDDILVRR

SEQ ID NO: 1312325 - protein, 26 aa, Mycobacterium
ATRTPRPPSGWLRLGGISSHNLRGLD

SEQ ID NO: 1312326 - protein, 28 aa, Mycobacterium
ATSASTPLFFAQAIGRFVRSRRPGETAS

SEQ ID NO: 1312327 - protein, 24 aa, Mycobacterium
ATSAYLFTHPPVNDFFSGLKGRPQ

SEQ ID NO: 1312328 - protein, 27 aa, Mycobacterium
ATSDILDDLLLLGALEDKVVFSSFNRG

SEQ ID NO: 1312329 - protein, 23 aa, Mycobacterium
ATSDVVLERRITLGRGPVGDIAA

SEQ ID NO: 1312330 - protein, 22 aa, Mycobacterium
ATSFSARLFNLLITNAPGAQNQ

SEQ ID NO: 1312331 - protein, 24 aa, Mycobacterium
ATSGDLPPWLGATFRRAAVLRYGE

SEQ ID NO: 1312332 - protein, 21 aa, Mycobacterium
ATTAWLIERLQRPTLVMAPNK

SEQ ID NO: 1312333 - protein, 27 aa, Mycobacterium
ATTDWRRLTITLAWLSPVNTATRRHRM

SEQ ID NO: 1312334 - protein, 24 aa, Mycobacterium
ATTEATTLIGTARRLLLDPVEIGP

SEQ ID NO: 1312335 - protein, 17 aa, Mycobacterium
ATTFLIEPALDSGPVYG

SEQ ID NO: 1312336 - protein, 17 aa, Mycobacterium
ATTQFVASLLADAGLNP

SEQ ID NO: 1312337 - protein, 25 aa, Mycobacterium
ATVDDLKWWFGATLGWARQALSDVD

SEQ ID NO: 1312338 - protein, 37 aa, Mycobacterium
ATVKPFLTVGSYAPKLPWPWGLLDFAARVLKPAPGTV

SEQ ID NO: 1312339 - protein, 28 aa, Mycobacterium
ATVLTRNTFHWVLAFSPGGLSTAKVFAE

SEQ ID NO: 1312340 - protein, 23 aa, Mycobacterium
ATVPPHRPIQPLAARPRSTLVHL

SEQ ID NO: 1312341 - protein, 32 aa, Mycobacterium
ATVRQRVRWLALHGFVRGMSRLGMRRGDPQAR

SEQ ID NO: 1312342 - protein, 17 aa, Mycobacterium
ATVRRFNEAFGPFGFQP

SEQ ID NO: 1312343 - protein, 25 aa, Mycobacterium
ATVVSQLLPVLDDLDRARSHGDLES

SEQ ID NO: 1312344 - protein, 19 aa, Mycobacterium
ATVYRYFPSREAVMSGVII

SEQ ID NO: 1312345 - protein, 22 aa, Mycobacterium
ATWGMALLYRETGDLAYRAALD

SEQ ID NO: 1312346 - protein, 33 aa, Mycobacterium
ATWRAALAGIESYAPLMAYLVRSIEDGQSLADG

SEQ ID NO: 1312347 - protein, 17 aa, Mycobacterium
ATYDESFGLPGLAAYCR

SEQ ID NO: 1312348 - protein, 17 aa, Mycobacterium
ATYGRIWATWPTNGESA

SEQ ID NO: 1312349 - protein, 28 aa, Mycobacterium
ATYLFTNDYEWDLLLQKSGWSEAEVMRQ

SEQ ID NO: 1312350 - protein, 21 aa, Mycobacterium
ATYMYGTLLARGPRGQLGCGL

SEQ ID NO: 1312351 - protein, 18 aa, Mycobacterium
ATYVEFYDRYSGCIEAWA

SEQ ID NO: 1312352 - protein, 35 aa, Mycobacterium
AVAAAKYYIDYSDFSLWLLRVSRVRWVGGYGRMDS

SEQ ID NO: 1312353 - protein, 18 aa, Mycobacterium
AVAAFARLWASDEHWAAA

SEQ ID NO: 1312354 - protein, 19 aa, Mycobacterium
AVAAIPHLAILLSAPSEAA

SEQ ID NO: 1312355 - protein, 27 aa, Mycobacterium
AVAAKRGWPILRFSSRSGASPASQVRT

SEQ ID NO: 1312356 - protein, 18 aa, Mycobacterium
AVAALELGLPLVAGNVVS

SEQ ID NO: 1312357 - protein, 22 aa, Mycobacterium
AVAALFRSRKCDYAEAGFLHTD

SEQ ID NO: 1312358 - protein, 26 aa, Mycobacterium
AVACALALQRAPLAPIRLRIGVHTGE

SEQ ID NO: 1312359 - protein, 29 aa, Mycobacterium
AVADLLGALFWGLVFHAGFISGADGAPEI

SEQ ID NO: 1312360 - protein, 28 aa, Mycobacterium
AVADQVGLPDLPWPDPEAWLTAVRASPL

SEQ ID NO: 1312361 - protein, 35 aa, Mycobacterium
AVADRILPVLAGRPLTVLRALRGRAPFMQKNVPKY

SEQ ID NO: 1312362 - protein, 24 aa, Mycobacterium
AVAEPGWAHALMRHYRDPRVAAVG

SEQ ID NO: 1312363 - protein, 24 aa, Mycobacterium
AVAERLLARNGWRNTSLAQIAREA

SEQ ID NO: 1312364 - protein, 20 aa, Mycobacterium
AVAFPRSPFVTAASAWELQE

SEQ ID NO: 1312365 - protein, 30 aa, Mycobacterium
AVAGRIRRLRPWLDVRAAFLEKCAPSLHDV

SEQ ID NO: 1312366 - protein, 21 aa, Mycobacterium
AVAGSALTALSFAISACLACV

SEQ ID NO: 1312367 - protein, 19 aa, Mycobacterium
AVAGYYYQAINKDAPHPAA

SEQ ID NO: 1312368 - protein, 25 aa, Mycobacterium
AVAKRLMHVLGTSAYVPELLMRAPE

SEQ ID NO: 1312369 - protein, 19 aa, Mycobacterium
AVALFPSWETLPHERLSPG

SEQ ID NO: 1312370 - protein, 17 aa, Mycobacterium
AVALLMRDGPAPERFAV

SEQ ID NO: 1312371 - protein, 18 aa, Mycobacterium
AVANADRLMAAPAPARPP

SEQ ID NO: 1312372 - protein, 28 aa, Mycobacterium
AVAPVYLYRFDFATPMLRLLRLGAAHAT

SEQ ID NO: 1312373 - protein, 28 aa, Mycobacterium
AVARIIPYNHPILFAAAKVGAPLITGNT

SEQ ID NO: 1312374 - protein, 20 aa, Mycobacterium
AVARQLLTKPFGAAVLGPVH

SEQ ID NO: 1312375 - protein, 27 aa, Mycobacterium
AVASFFAKNFLPLLTSTRSIVENLDNE

SEQ ID NO: 1312376 - protein, 26 aa, Mycobacterium
AVASGLAAAWWHGLTRFAPEQVEVTM

SEQ ID NO: 1312377 - protein, 19 aa, Mycobacterium
AVATRLWRITRATGGAVAV

SEQ ID NO: 1312378 - protein, 17 aa, Mycobacterium
AVAVEWALANPGSAVAV

SEQ ID NO: 1312379 - protein, 17 aa, Mycobacterium
AVAWFEEAVVQATAIVD

SEQ ID NO: 1312380 - protein, 30 aa, Mycobacterium
AVAWRQPGIVFFKYLLGMPVDDVPLCVELT

SEQ ID NO: 1312381 - protein, 22 aa, Mycobacterium
AVAYSAWKFYQVTGDLAYLIDY

SEQ ID NO: 1312382 - protein, 24 aa, Mycobacterium
AVCAHCPVLAQCRTWGLTKGRDEC

SEQ ID NO: 1312383 - protein, 25 aa, Mycobacterium
AVCAHIAAADPWWAPGTAQGYHMVT

SEQ ID NO: 1312384 - protein, 19 aa, Mycobacterium
AVCFLASDQARYITGTQLV

SEQ ID NO: 1312385 - protein, 19 aa, Mycobacterium
AVCMGIIPEVFQVDEQDYL

SEQ ID NO: 1312386 - protein, 20 aa, Mycobacterium
AVCVGIAPDLFDLDDDDYAV

SEQ ID NO: 1312387 - protein, 19 aa, Mycobacterium
AVDAGHRWLLHAGDSFYHP

SEQ ID NO: 1312388 - protein, 19 aa, Mycobacterium
AVDAPPLPRPVLFDQFWAD

SEQ ID NO: 1312389 - protein, 33 aa, Mycobacterium
AVDAYDAYLRLHLLSHRLVAPHGLNADGLFGVL

SEQ ID NO: 1312390 - protein, 20 aa, Mycobacterium
AVDDAVDALIWAAGPASGLG

SEQ ID NO: 1312391 - protein, 21 aa, Mycobacterium
AVDDWPLLRWRMQEYRHGRWG

SEQ ID NO: 1312392 - protein, 23 aa, Mycobacterium
AVDEMLARFPEWEKQLSAAAPPD

SEQ ID NO: 1312393 - protein, 21 aa, Mycobacterium
AVDFDMPFPELGLDSMMAMNL

SEQ ID NO: 1312394 - protein, 23 aa, Mycobacterium
AVDGRFYSMMVPVIDARLAEQAL

SEQ ID NO: 1312395 - protein, 18 aa, Mycobacterium
AVDLIHSLGPRLVEACRV

SEQ ID NO: 1312396 - protein, 18 aa, Mycobacterium
AVDLTPFPGAMAAPLREV

SEQ ID NO: 1312397 - protein, 22 aa, Mycobacterium
AVDPAATPVLSWVREQLRVAQA

SEQ ID NO: 1312398 - protein, 29 aa, Mycobacterium
AVDPELVAHPWWHDALRLRRYDDAAKDPA

SEQ ID NO: 1312399 - protein, 18 aa, Mycobacterium
AVDPETVVRRWLTLTGVH

SEQ ID NO: 1312400 - protein, 25 aa, Mycobacterium
AVDPRARWEHLYRLVNYALEHHGDR

SEQ ID NO: 1312401 - protein, 26 aa, Mycobacterium
AVDQADRWASLWWLRVSGSERFEEVA

SEQ ID NO: 1312402 - protein, 17 aa, Mycobacterium
AVDRTRKALADQGFGVL

SEQ ID NO: 1312403 - protein, 17 aa, Mycobacterium
AVDSWLRTGGDEGVLRL

SEQ ID NO: 1312404 - protein, 27 aa, Mycobacterium
AVDTLSVFLQLALFPDTPPSVLTSLRL

SEQ ID NO: 1312405 - protein, 24 aa, Mycobacterium
AVEARPIWYLVPDGVVQYVTKRRL

SEQ ID NO: 1312406 - protein, 20 aa, Mycobacterium
AVEHLFSVAGGLDSAVIGEQ

SEQ ID NO: 1312407 - protein, 25 aa, Mycobacterium
AVEIDLPPIPEFYGGAVYFDGADTA

SEQ ID NO: 1312408 - protein, 21 aa, Mycobacterium
AVEILPVPGLPEFRPGDDLAA

SEQ ID NO: 1312409 - protein, 27 aa, Mycobacterium
AVEKGKVRVIIPARWNFLNVVRPLGVQ

SEQ ID NO: 1312410 - protein, 18 aa, Mycobacterium
AVELAVEMCPTRALTIIE

SEQ ID NO: 1312411 - protein, 18 aa, Mycobacterium
AVELFWGLQEHRDRFVSP

SEQ ID NO: 1312412 - protein, 25 aa, Mycobacterium
AVELHFGHLYLPSSFLSPLINRRRD

SEQ ID NO: 1312413 - protein, 20 aa, Mycobacterium
AVENMFPFRADRFFGAGQTS

SEQ ID NO: 1312414 - protein, 27 aa, Mycobacterium
AVETFQWPRITGTFNWATDWFDAVARD

SEQ ID NO: 1312415 - protein, 22 aa, Mycobacterium
AVEVVVGLPRTLADRTGPAAHD

SEQ ID NO: 1312416 - protein, 23 aa, Mycobacterium
AVFGAPCVFFVQNNQWAISVPVE

SEQ ID NO: 1312417 - protein, 17 aa, Mycobacterium
AVFHRRAEEGLAVLSTA

SEQ ID NO: 1312418 - protein, 17 aa, Mycobacterium
AVFLATLGRMTEPTDRD

SEQ ID NO: 1312419 - protein, 17 aa, Mycobacterium
AVFRLRDGSLRAVDAVC

SEQ ID NO: 1312420 - protein, 19 aa, Mycobacterium
AVFSASNFPLAFSVAGGDT

SEQ ID NO: 1312421 - protein, 17 aa, Mycobacterium
AVFTPGLAGLVLGEYRR

SEQ ID NO: 1312422 - protein, 28 aa, Mycobacterium
AVGEEVAPWLDLVRKLGLLVGVLSSEPP

SEQ ID NO: 1312423 - protein, 18 aa, Mycobacterium
AVGGTWLFNRYPGARCDI

SEQ ID NO: 1312424 - protein, 21 aa, Mycobacterium
AVGHHWRYSAAVGLVRDMLGD

SEQ ID NO: 1312425 - protein, 19 aa, Mycobacterium
AVGLWAGIVLPEGGRNRQF

SEQ ID NO: 1312426 - protein, 26 aa, Mycobacterium
AVGPAGPLPSFIPGGAAGGPLGTGFP

SEQ ID NO: 1312427 - protein, 27 aa, Mycobacterium
AVGPASFRWPHAIAGTSELLLVADAGD

SEQ ID NO: 1312428 - protein, 29 aa, Mycobacterium
AVGPGSVDLFFLLGVADVDALRWLEHHAD

SEQ ID NO: 1312429 - protein, 18 aa, Mycobacterium
AVGQLPVDFATSGLSAMS

SEQ ID NO: 1312430 - protein, 27 aa, Mycobacterium
AVGRPRLTYELAPRLDYADIVALFATH

SEQ ID NO: 1312431 - protein, 23 aa, Mycobacterium
AVGRTLQLALNPDNVLLFDPRTG

SEQ ID NO: 1312432 - protein, 19 aa, Mycobacterium
AVGRYADTFARDAGGWYFT

SEQ ID NO: 1312433 - protein, 22 aa, Mycobacterium
AVHAGLLLRGWSDDIVVLAGDV

SEQ ID NO: 1312434 - protein, 18 aa, Mycobacterium
AVHASVACFLRAHPSYWH

SEQ ID NO: 1312435 - protein, 23 aa, Mycobacterium
AVHDRAYCLLALQAPVARDLRVV

SEQ ID NO: 1312436 - protein, 22 aa, Mycobacterium
AVHMLTKHLATELAPKILVNAI

SEQ ID NO: 1312437 - protein, 19 aa, Mycobacterium
AVHQYLKACLGEEAALVVA

SEQ ID NO: 1312438 - protein, 18 aa, Mycobacterium
AVHSARLFWATVTGLSEE

SEQ ID NO: 1312439 - protein, 25 aa, Mycobacterium
AVHSYKDLPTAPDPRFMIAATPVRE

SEQ ID NO: 1312440 - protein, 25 aa, Mycobacterium
AVIALGVVIRGQTPHFDYVCDAVTQ

SEQ ID NO: 1312441 - protein, 19 aa, Mycobacterium
AVIALWLGHADIRSTGIYL

SEQ ID NO: 1312442 - protein, 19 aa, Mycobacterium
AVIAPHLRTGVLKEAISYL

SEQ ID NO: 1312443 - protein, 29 aa, Mycobacterium
AVIAVHLRGHFLLTRNAATYWRAKAKAGD

SEQ ID NO: 1312444 - protein, 18 aa, Mycobacterium
AVIDCRVLPGRLADFERE

SEQ ID NO: 1312445 - protein, 24 aa, Mycobacterium
AVIDTLVPLLTRPAVIVGKSTVPV

SEQ ID NO: 1312446 - protein, 24 aa, Mycobacterium
AVIDVCLTGAFIVTKHAGRHLREG

SEQ ID NO: 1312447 - protein, 25 aa, Mycobacterium
AVIERSFANWLTVWQLPDDVMARDR

SEQ ID NO: 1312448 - protein, 37 aa, Mycobacterium
AVIGTPYARMWGAYLTGMWIYRLSLAKVKWHSLTGEP

SEQ ID NO: 1312449 - protein, 22 aa, Mycobacterium
AVKHAWIELLGPDAVWELYGGT

SEQ ID NO: 1312450 - protein, 21 aa, Mycobacterium
AVKMMHAMVLLAGAALMGRYE

SEQ ID NO: 1312451 - protein, 17 aa, Mycobacterium
AVKTLLLASLKNGLEEQ

SEQ ID NO: 1312452 - protein, 20 aa, Mycobacterium
AVLAALARLASAVAAELVAG

SEQ ID NO: 1312453 - protein, 17 aa, Mycobacterium
AVLACDLVVALRGRGRT

SEQ ID NO: 1312454 - protein, 26 aa, Mycobacterium
AVLADALPWLTALNDKIVVVKYGGNA

SEQ ID NO: 1312455 - protein, 33 aa, Mycobacterium
AVLAFALDVLLKLLHPVMPFVTEVLWKALTGGE

SEQ ID NO: 1312456 - protein, 27 aa, Mycobacterium
AVLAGARALLAESWRYGGRLSALTAKI

SEQ ID NO: 1312457 - protein, 20 aa, Mycobacterium
AVLANAYHLYLQPGADVVDE

SEQ ID NO: 1312458 - protein, 28 aa, Mycobacterium
AVLARQTAWPPRLFSILAGFVEAGESFE

SEQ ID NO: 1312459 - protein, 17 aa, Mycobacterium
AVLDGLVAHRKARGLPA

SEQ ID NO: 1312460 - protein, 23 aa, Mycobacterium
AVLDYPLGDTSLLAPATVMANVL

SEQ ID NO: 1312461 - protein, 25 aa, Mycobacterium
AVLELSLGSWFTAALYATVRLGIAD

SEQ ID NO: 1312462 - protein, 26 aa, Mycobacterium
AVLESMIPLWRRNGLARTDWDIADQT

SEQ ID NO: 1312463 - protein, 17 aa, Mycobacterium
AVLGRLAHKARVVLCGV

SEQ ID NO: 1312464 - protein, 24 aa, Mycobacterium
AVLKDTMVLAYQWAADRTSVTWTL

SEQ ID NO: 1312465 - protein, 18 aa, Mycobacterium
AVLLDATFPPASVTGTPK

SEQ ID NO: 1312466 - protein, 20 aa, Mycobacterium
AVLLQLRWLGLEGRSDPVDE

SEQ ID NO: 1312467 - protein, 25 aa, Mycobacterium
AVLMSILARHPLDMLGPAPLEGELD

SEQ ID NO: 1312468 - protein, 19 aa, Mycobacterium
AVLNRLRRAQGQLAGVISM

SEQ ID NO: 1312469 - protein, 17 aa, Mycobacterium
AVLPAMIERRRGIIVAT

SEQ ID NO: 1312470 - protein, 17 aa, Mycobacterium
AVLPFHRFRKADGSQID

SEQ ID NO: 1312471 - protein, 20 aa, Mycobacterium
AVLPSHYEPFGIVALEAAAT

SEQ ID NO: 1312472 - protein, 23 aa, Mycobacterium
AVLPSHYEPFGIVALEAAATGTP

SEQ ID NO: 1312473 - protein, 25 aa, Mycobacterium
AVLPVYDPLFDSKKLRHVLVRHEQG

SEQ ID NO: 1312474 - protein, 26 aa, Mycobacterium
AVLQRGWVHVLPSRKEGWGLSVVEAA

SEQ ID NO: 1312475 - protein, 24 aa, Mycobacterium
AVLQTYPCHPLLQANRVAAAANAM

SEQ ID NO: 1312476 - protein, 29 aa, Mycobacterium
AVLRFQYRLARTPLQLIERRFLTRVDTEA

SEQ ID NO: 1312477 - protein, 37 aa, Mycobacterium
AVLRNEAIIVVPRWWKALWYLERLSPALSMRTAAAAL

SEQ ID NO: 1312478 - protein, 18 aa, Mycobacterium
AVLRRPVRRPLDEGVIEF

SEQ ID NO: 1312479 - protein, 20 aa, Mycobacterium
AVLVALFDRVIDELLRDEQE

SEQ ID NO: 1312480 - protein, 21 aa, Mycobacterium
AVLVAQAWHWFDPERAVKEVA

SEQ ID NO: 1312481 - protein, 17 aa, Mycobacterium
AVLVPPFDHPDIIAGQG

SEQ ID NO: 1312482 - protein, 18 aa, Mycobacterium
AVMAELFIRRTTLAPQDR

SEQ ID NO: 1312483 - protein, 23 aa, Mycobacterium
AVMLAGLAMKWRWRDRVGDGWKG

SEQ ID NO: 1312484 - protein, 18 aa, Mycobacterium
AVMMNNYGTPPLALAGGD

SEQ ID NO: 1312485 - protein, 17 aa, Mycobacterium
AVMPPLTKAADHSKLWF

SEQ ID NO: 1312486 - protein, 19 aa, Mycobacterium
AVMTLLPGDLILTGTPEGV

SEQ ID NO: 1312487 - protein, 29 aa, Mycobacterium
AVMVRDMEFIFCPWHQWGFELATGTTAVK

SEQ ID NO: 1312488 - protein, 25 aa, Mycobacterium
AVNAERFFKALTYNVLIGGTDAHAK

SEQ ID NO: 1312489 - protein, 21 aa, Mycobacterium
AVNFPLYVIMSLLGIPESDFQ

SEQ ID NO: 1312490 - protein, 19 aa, Mycobacterium
AVNIVNAWWVPDLERSGIG

SEQ ID NO: 1312491 - protein, 41 aa, Mycobacterium
AVNMLNPGLIVLGGFLRVFPTFAAPMLRDELARRCMAAPRA

SEQ ID NO: 1312492 - protein, 18 aa, Mycobacterium
AVNPYLAFESIEDLIREG

SEQ ID NO: 1312493 - protein, 28 aa, Mycobacterium
AVNVATLPFPGFPTDLQPMAIGLAAVAD

SEQ ID NO: 1312494 - protein, 27 aa, Mycobacterium
AVPADPNGAWYTSGIRFGSPALTTRGF

SEQ ID NO: 1312495 - protein, 27 aa, Mycobacterium
AVPGFAVPPLDPPPLPFQLADRELFRS

SEQ ID NO: 1312496 - protein, 28 aa, Mycobacterium
AVPGPFDAYLTIRGLKTLPLRMQRHSEN

SEQ ID NO: 1312497 - protein, 28 aa, Mycobacterium
AVPLVDESWVWLPALLAGRIFTHRVTAQ

SEQ ID NO: 1312498 - protein, 18 aa, Mycobacterium
AVPPLDARIAARVGLRPD

SEQ ID NO: 1312499 - protein, 28 aa, Mycobacterium
AVPPPDQLAFFGVLGALAALGAIEWPVA

SEQ ID NO: 1312500 - protein, 23 aa, Mycobacterium
AVPRLRESILATVRERAVDAPEI

SEQ ID NO: 1312501 - protein, 18 aa, Mycobacterium
AVPTRPALPRAELQRAMT

SEQ ID NO: 1312502 - protein, 26 aa, Mycobacterium
AVPVNQLIMVKLAMNSALLQQGVATS

SEQ ID NO: 1312503 - protein, 25 aa, Mycobacterium
AVPVNQLIMVKLAMNSALYNQGVAT

SEQ ID NO: 1312504 - protein, 25 aa, Mycobacterium
AVPVTPLNYRLSADGLRALLDRLPD

SEQ ID NO: 1312505 - protein, 26 aa, Mycobacterium
AVPYGLLDGLAFFNPTKPPAGANDPS

SEQ ID NO: 1312506 - protein, 24 aa, Mycobacterium
AVQADLMCQTLMPALGVAAPADID

SEQ ID NO: 1312507 - protein, 24 aa, Mycobacterium
AVQDRWPAAAPLRVRPRRGAAAAH

SEQ ID NO: 1312508 - protein, 37 aa, Mycobacterium
AVQIMTVWVSKGLQFPVVYLPFAFNRNIQTRDVVTFH

SEQ ID NO: 1312509 - protein, 24 aa, Mycobacterium
AVQPLAAMFGIWALVIGHGDLGDV

SEQ ID NO: 1312510 - protein, 24 aa, Mycobacterium
AVQQQWFSIGMVQPGWEDERTDTV

SEQ ID NO: 1312511 - protein, 23 aa, Mycobacterium
AVQRDLTAITLTDALLADIETAA

SEQ ID NO: 1312512 - protein, 28 aa, Mycobacterium
AVQRLLEVFTVPLAGEHFLRRPLSHIRS

SEQ ID NO: 1312513 - protein, 26 aa, Mycobacterium
AVRCSFWHALTLMLRGEHARGSGWLV

SEQ ID NO: 1312514 - protein, 27 aa, Mycobacterium
AVREHASLYTVLLAGFAAALGGYAGRR

SEQ ID NO: 1312515 - protein, 17 aa, Mycobacterium
AVRFADVPAYRHGGRSI

SEQ ID NO: 1312516 - protein, 19 aa, Mycobacterium
AVRFGLFHVLQASARAERR

SEQ ID NO: 1312517 - protein, 17 aa, Mycobacterium
AVRGLTKSAALELGSHN

SEQ ID NO: 1312518 - protein, 23 aa, Mycobacterium
AVRGPVADLLLAVTRRRTLTDSG

SEQ ID NO: 1312519 - protein, 24 aa, Mycobacterium
AVRHTLPGLPLGVTTGYWALPDAE

SEQ ID NO: 1312520 - protein, 18 aa, Mycobacterium
AVRILARHDASIAQILSY

SEQ ID NO: 1312521 - protein, 39 aa, Mycobacterium
AVRPAALDSLRRLALGHWMRRWWPASVRDGIPELGAAVL

SEQ ID NO: 1312522 - protein, 17 aa, Mycobacterium
AVRPIMYRAALSEMVVP

SEQ ID NO: 1312523 - protein, 27 aa, Mycobacterium
AVRQGKLLASRLLPWARSGHLTVPRSA

SEQ ID NO: 1312524 - protein, 18 aa, Mycobacterium
AVRQIFFRLGEVILEVIG

SEQ ID NO: 1312525 - protein, 31 aa, Mycobacterium
AVRRVTQALPLLKPPFPDPGTPLQLVHHDDV

SEQ ID NO: 1312526 - protein, 22 aa, Mycobacterium
AVRSHLAPYLPGHPLADELSDE

SEQ ID NO: 1312527 - protein, 22 aa, Mycobacterium
AVRVPWEVTPGVPAYAAAAARV

SEQ ID NO: 1312528 - protein, 23 aa, Mycobacterium
AVSEVRALVRWLRPQAASIAVAG

SEQ ID NO: 1312529 - protein, 17 aa, Mycobacterium
AVSFLLIGSGRAEVVHG

SEQ ID NO: 1312530 - protein, 28 aa, Mycobacterium
AVSGRPHTLLLLTLLSDVGPDDAPTRIR

SEQ ID NO: 1312531 - protein, 28 aa, Mycobacterium
AVSGSGPAYFFLMVEALVDAAVASGLSR

SEQ ID NO: 1312532 - protein, 19 aa, Mycobacterium
AVSLAPTVRRRGLDGALLA

SEQ ID NO: 1312533 - protein, 20 aa, Mycobacterium
AVSLYPFDGIDARLSRYSYL

SEQ ID NO: 1312534 - protein, 23 aa, Mycobacterium
AVSNLTVEAWACAFGPGGEAATI

SEQ ID NO: 1312535 - protein, 18 aa, Mycobacterium
AVSSWFIKVTQFRDRMVE

SEQ ID NO: 1312536 - protein, 23 aa, Mycobacterium
AVSSWLYRIVVNACLDRLRRNRS

SEQ ID NO: 1312537 - protein, 23 aa, Mycobacterium
AVSWADIVLPTRVLAQLQELTVR

SEQ ID NO: 1312538 - protein, 18 aa, Mycobacterium
AVSWLSPLVPLVDAEPTT

SEQ ID NO: 1312539 - protein, 20 aa, Mycobacterium
AVSWVLHPEPWYLERKLIDA

SEQ ID NO: 1312540 - protein, 18 aa, Mycobacterium
AVTAVLMRLLPPAQVTKV

SEQ ID NO: 1312541 - protein, 17 aa, Mycobacterium
AVTCRVLKLSRQPYYRW

SEQ ID NO: 1312542 - protein, 21 aa, Mycobacterium
AVTCYLDRTPPAPKTTEIPLA

SEQ ID NO: 1312543 - protein, 27 aa, Mycobacterium
AVTEGMWGIPWDRPVRRLNEYLDGLLP

SEQ ID NO: 1312544 - protein, 21 aa, Mycobacterium
AVTEPPLKLVLLENPGNGGSI

SEQ ID NO: 1312545 - protein, 17 aa, Mycobacterium
AVTILRLANMIGPAMDT

SEQ ID NO: 1312546 - protein, 18 aa, Mycobacterium
AVTINALMYLVTENHLDE

SEQ ID NO: 1312547 - protein, 28 aa, Mycobacterium
AVTMPNFAGLSPWRSPAGPVPAYPRASN

SEQ ID NO: 1312548 - protein, 17 aa, Mycobacterium
AVTNLPARIVDGLLNGR

SEQ ID NO: 1312549 - protein, 29 aa, Mycobacterium
AVTPPVARPFLGLIGFVPGPVAAAVRTGL

SEQ ID NO: 1312550 - protein, 22 aa, Mycobacterium
AVTQIEMLAMSDLSLMVKAGVQ

SEQ ID NO: 1312551 - protein, 25 aa, Mycobacterium
AVTVNWPKALMMCRRMIGAGTTVAD

SEQ ID NO: 1312552 - protein, 19 aa, Mycobacterium
AVVADRLPMTVVCKLIGVP

SEQ ID NO: 1312553 - protein, 19 aa, Mycobacterium
AVVALAGVLLCGCVRVTDG

SEQ ID NO: 1312554 - protein, 18 aa, Mycobacterium
AVVALRPEQLRFGTGLSG

SEQ ID NO: 1312555 - protein, 26 aa, Mycobacterium
AVVARLAERAALYRDLVMAGRSHNVA

SEQ ID NO: 1312556 - protein, 22 aa, Mycobacterium
AVVASPWYRMRVAPSVFAHVWA

SEQ ID NO: 1312557 - protein, 23 aa, Mycobacterium
AVVELLTLFARWQENRDAAMPFG

SEQ ID NO: 1312558 - protein, 17 aa, Mycobacterium
AVVFLAGDDSRYITGTQ

SEQ ID NO: 1312559 - protein, 27 aa, Mycobacterium
AVVPDTPIPFGVWQRVSVAVRNRPDGT

SEQ ID NO: 1312560 - protein, 20 aa, Mycobacterium
AVVPTIIYLLLDHAGRDRFD

SEQ ID NO: 1312561 - protein, 19 aa, Mycobacterium
AVVTADWADGLSASVRAGV

SEQ ID NO: 1312562 - protein, 18 aa, Mycobacterium
AVVTAFHLKLHRRPRVCG

SEQ ID NO: 1312563 - protein, 22 aa, Mycobacterium
AVWDIRALLGWIRAEQPGAAIG

SEQ ID NO: 1312564 - protein, 17 aa, Mycobacterium
AVWLRTTDFGDDKDRVV

SEQ ID NO: 1312565 - protein, 17 aa, Mycobacterium
AVYAHHPGLMLTGAVHE

SEQ ID NO: 1312566 - protein, 22 aa, Mycobacterium
AVYDYYAYFRDASGQYWVIDAR

SEQ ID NO: 1312567 - protein, 19 aa, Mycobacterium
AVYEALLAHKGIRGLVVCC

SEQ ID NO: 1312568 - protein, 37 aa, Mycobacterium
AVYEALLDRIAPLGIAYLHVLIDPTHTTFGVIRALWP

SEQ ID NO: 1312569 - protein, 18 aa, Mycobacterium
AVYGPLTRLQCCPPTCGA

SEQ ID NO: 1312570 - protein, 24 aa, Mycobacterium
AVYNSAPALVLYLGDNLEGVVTFE

SEQ ID NO: 1312571 - protein, 28 aa, Mycobacterium
AVYQRYMGWFDGNPARLWPHPPEAIGPR

SEQ ID NO: 1312572 - protein, 19 aa, Mycobacterium
AWAPGYLPVLAIALRRIEA

SEQ ID NO: 1312573 - protein, 22 aa, Mycobacterium
AWATQLRMVQSQLLAKIAAAVG

SEQ ID NO: 1312574 - protein, 28 aa, Mycobacterium
AWDLDRLHRRPIELERFMDLADAHRLAL

SEQ ID NO: 1312575 - protein, 29 aa, Mycobacterium
AWDQGKHLWMIYLMRIVDAQVVFDKPGSV

SEQ ID NO: 1312576 - protein, 18 aa, Mycobacterium
AWELDEFGLPTPVIPSFG

SEQ ID NO: 1312577 - protein, 18 aa, Mycobacterium
AWELYGMRHGYMACLPQG

SEQ ID NO: 1312578 - protein, 18 aa, Mycobacterium
AWELYGMRHGYMACLPRG

SEQ ID NO: 1312579 - protein, 21 aa, Mycobacterium
AWERYRQAIIPLLAQAYPVRS

SEQ ID NO: 1312580 - protein, 25 aa, Mycobacterium
AWGFKPSHLRLPRAGMHLLADVLDD

SEQ ID NO: 1312581 - protein, 22 aa, Mycobacterium
AWGILDRPVTLVPAPTRRIAAR

SEQ ID NO: 1312582 - protein, 17 aa, Mycobacterium
AWHVPALREELVTALIR

SEQ ID NO: 1312583 - protein, 18 aa, Mycobacterium
AWHVPALREELVTALIRS

SEQ ID NO: 1312584 - protein, 27 aa, Mycobacterium
AWHVPALREELVTALIRSLPKDLRRNF

SEQ ID NO: 1312585 - protein, 27 aa, Mycobacterium
AWIADRIGLRVTPKTRVLIAPFTDVIG

SEQ ID NO: 1312586 - protein, 20 aa, Mycobacterium
AWIGYWVASERIGGGVATAA

SEQ ID NO: 1312587 - protein, 19 aa, Mycobacterium
AWILMSSEWISAEEALAMG

SEQ ID NO: 1312588 - protein, 31 aa, Mycobacterium
AWNLHAATLDQPLDWFCSFSSAAAMVGSPGQ

SEQ ID NO: 1312589 - protein, 34 aa, Mycobacterium
AWNTVIDLNLKSPFWLVQALLPALRSAGTADDPA

SEQ ID NO: 1312590 - protein, 21 aa, Mycobacterium
AWQWMIERPLAEAITSAVGDD

SEQ ID NO: 1312591 - protein, 19 aa, Mycobacterium
AWRCSQVEMVGWMTELYGL

SEQ ID NO: 1312592 - protein, 18 aa, Mycobacterium
AWRICSQQGLWSVFGKKR

SEQ ID NO: 1312593 - protein, 17 aa, Mycobacterium
AWRQIVLGEVEMAICGG

SEQ ID NO: 1312594 - protein, 18 aa, Mycobacterium
AWRQIVLGEVEMAICGGV

SEQ ID NO: 1312595 - protein, 26 aa, Mycobacterium
AWSGTPWTTLPSLPIPGRPAPLHPNA

SEQ ID NO: 1312596 - protein, 20 aa, Mycobacterium
AWSIDVCMGPWPALSLRDAC

SEQ ID NO: 1312597 - protein, 32 aa, Mycobacterium
AWTGRKIVELVKEPLWAVIQQQPSAAVFPEGE

SEQ ID NO: 1312598 - protein, 25 aa, Mycobacterium
AWVSNAGISFMHRFLDAPIERYEQT

SEQ ID NO: 1312599 - protein, 17 aa, Mycobacterium
AWVSRFAEFVRTKHGLA

SEQ ID NO: 1312600 - protein, 19 aa, Mycobacterium
AWVTLLRSAGAHDTYLRTY

SEQ ID NO: 1312601 - protein, 23 aa, Mycobacterium
AYAEGLRALYLYTAAHQDPAAAD

SEQ ID NO: 1312602 - protein, 24 aa, Mycobacterium
AYAEGLRALYLYTATHQDAEVAKA

SEQ ID NO: 1312603 - protein, 23 aa, Mycobacterium
AYANLALPALLRDRGITGRDAAF

SEQ ID NO: 1312604 - protein, 17 aa, Mycobacterium
AYDVHPLIEALLDEGVP

SEQ ID NO: 1312605 - protein, 21 aa, Mycobacterium
AYEHLPVRPDSDAWLLLSMLH

SEQ ID NO: 1312606 - protein, 28 aa, Mycobacterium
AYEKAYDRLFTALDWLSERLSRQRFLVG

SEQ ID NO: 1312607 - protein, 20 aa, Mycobacterium
AYFQMPLVPGLGFAGGETMI

SEQ ID NO: 1312608 - protein, 20 aa, Mycobacterium
AYFVAIGGNGGNGGRALLTG

SEQ ID NO: 1312609 - protein, 31 aa, Mycobacterium
AYGASAVPWHWRLTLKGWPGLNTRGLVKLAN

SEQ ID NO: 1312610 - protein, 29 aa, Mycobacterium
AYGGTFRLIDKVFSLWGISYTAVALGDLD

SEQ ID NO: 1312611 - protein, 22 aa, Mycobacterium
AYGKVDVLINNAFRVPSMKPFA

SEQ ID NO: 1312612 - protein, 23 aa, Mycobacterium
AYHRARLLSMLRYFLRAEGMDDL

SEQ ID NO: 1312613 - protein, 18 aa, Mycobacterium
AYIIYRNRHAELRSAKAL

SEQ ID NO: 1312614 - protein, 17 aa, Mycobacterium
AYLACLNERRWDDLRQF

SEQ ID NO: 1312615 - protein, 18 aa, Mycobacterium
AYLARYLQRQLQELRDDG

SEQ ID NO: 1312616 - protein, 18 aa, Mycobacterium
AYLDRNIETLADGGRLVI

SEQ ID NO: 1312617 - protein, 18 aa, Mycobacterium
AYLGVRVNAIQPGLIRSA

SEQ ID NO: 1312618 - protein, 18 aa, Mycobacterium
AYLKLYPDDPITTRYVVI

SEQ ID NO: 1312619 - protein, 26 aa, Mycobacterium
AYLKRTLQALQWQGGGTRWVLKSPQH

SEQ ID NO: 1312620 - protein, 19 aa, Mycobacterium
AYLTYDYASGRVLRRPSFH

SEQ ID NO: 1312621 - protein, 20 aa, Mycobacterium
AYLVYGVAHALPQAMRSAAR

SEQ ID NO: 1312622 - protein, 28 aa, Mycobacterium
AYNPVRLLRSLRAFRHNPLFSSAAIERF

SEQ ID NO: 1312623 - protein, 19 aa, Mycobacterium
AYPDPPFNSMPGRSGLDID

SEQ ID NO: 1312624 - protein, 17 aa, Mycobacterium
AYPQIPGGQWLGFAPEL

SEQ ID NO: 1312625 - protein, 19 aa, Mycobacterium
AYPRARLVIASRAAGLPAP

SEQ ID NO: 1312626 - protein, 17 aa, Mycobacterium
AYPWAAVVSDPVGLADV

SEQ ID NO: 1312627 - protein, 22 aa, Mycobacterium
AYQGMPMPLLFVCEDNGIGIST

SEQ ID NO: 1312628 - protein, 21 aa, Mycobacterium
AYRERGLLDPPRRVGRSALYD

SEQ ID NO: 1312629 - protein, 26 aa, Mycobacterium
AYRGYRPLPPFNYVPELLGAGAPHFR

SEQ ID NO: 1312630 - protein, 18 aa, Mycobacterium
AYRLLGTLTQFRYVAKGE

SEQ ID NO: 1312631 - protein, 30 aa, Mycobacterium
AYRRDTLGRKYPWALGRPASEVWAEIWDDI

SEQ ID NO: 1312632 - protein, 22 aa, Mycobacterium
AYTEGFTPFWDRLFAHAKDRGA

SEQ ID NO: 1312633 - protein, 27 aa, Mycobacterium
AYTSPSAGHLFPMLALLGELAGRGHRV

SEQ ID NO: 1312634 - protein, 19 aa, Mycobacterium
AYVLREAFDYPYGLIAETI

SEQ ID NO: 1312635 - protein, 21 aa, Mycobacterium
AYVPELLMRAPEVIQLYADGP

SEQ ID NO: 1312636 - protein, 33 aa, Mycobacterium
AYVPGDVTLWPNLTGMQAIDFLAALRGDGTVDT

SEQ ID NO: 1312637 - protein, 17 aa, Mycobacterium
AYWDSFWDADQVFYGHV

SEQ ID NO: 1312638 - protein, 25 aa, Mycobacterium
AYYDAAALMLAGKPFKKAAAVAKLV

SEQ ID NO: 1312639 - protein, 18 aa, Mycobacterium
AYYTQWAQAWEVQALLRA

SEQ ID NO: 1312640 - protein, 23 aa, Mycobacterium
CAAYIERLDPSIFWMGMHHSRLV

SEQ ID NO: 1312641 - protein, 27 aa, Mycobacterium
CAAYYQLLVKALLLPGLMELADTRIPT

SEQ ID NO: 1312642 - protein, 18 aa, Mycobacterium
CADLPERAGVAAIPMSAF

SEQ ID NO: 1312643 - protein, 33 aa, Mycobacterium
CAGSVSHFDWLVGCGVPFKAEFFGEPGWEPMGD

SEQ ID NO: 1312644 - protein, 23 aa, Mycobacterium
CAHIAAAEPWWAPGTAQGYHMVT

SEQ ID NO: 1312645 - protein, 22 aa, Mycobacterium
CAHNPLPVVIPCHRVVRSDGTI

SEQ ID NO: 1312646 - protein, 27 aa, Mycobacterium
CALGGPERRMLFLVSATDAYPERLIGT

SEQ ID NO: 1312647 - protein, 34 aa, Mycobacterium
CALPGLAAHDLSRLRRVWWGAAPASTTLLRTMID

SEQ ID NO: 1312648 - protein, 25 aa, Mycobacterium
CALRKGEVFALRRCDIAADGSTVRI

SEQ ID NO: 1312649 - protein, 27 aa, Mycobacterium
CALTHYGNLFPLFARLRLDRAKLEYEL

SEQ ID NO: 1312650 - protein, 31 aa, Mycobacterium; identical to SEQ ID NO: 797932

SEQ ID NO: 1312651 - protein, 28 aa, Mycobacterium
CANAWLDGLVAWRTAAGLPALAVNWGQW

SEQ ID NO: 1312652 - protein, 20 aa, Mycobacterium
CAPIWWNEQTSGGAGPFGDG

SEQ ID NO: 1312653 - protein, 25 aa, Mycobacterium
CAQAARLIFDALPRAYRDPEDLAAR

SEQ ID NO: 1312654 - protein, 19 aa, Mycobacterium
CARHRVEWFWVKGHSGVAD

SEQ ID NO: 1312655 - protein, 20 aa, Mycobacterium
CASMPTPFRAVGESFWDFTQ

SEQ ID NO: 1312656 - protein, 24 aa, Mycobacterium
CATLIDALLGACPALAMLATSREP

SEQ ID NO: 1312657 - protein, 17 aa, Mycobacterium
CATPGRVFKGTRMSGRM

SEQ ID NO: 1312658 - protein, 17 aa, Mycobacterium
CAVLVPQGKIAMGKLAQ

SEQ ID NO: 1312659 - protein, 18 aa, Mycobacterium
CCPCRPGPWRAARPAADR

SEQ ID NO: 1312660 - protein, 26 aa, Mycobacterium
CDALTLNNWLWWEDRRRELHFLKAGR

SEQ ID NO: 1312661 - protein, 26 aa, Mycobacterium
CDDFPLARLYSWHRAMRLFDGPDEVH

SEQ ID NO: 1312662 - protein, 27 aa, Mycobacterium
CDELGRLCCWILLDAAAPVSLTLACDP

SEQ ID NO: 1312663 - protein, 24 aa, Mycobacterium
CDENGFIYFAGRLGDWMRVDGENL

SEQ ID NO: 1312664 - protein, 25 aa, Mycobacterium
CDGDSPCPLLAGCRLRRAMAAAKEA

SEQ ID NO: 1312665 - protein, 24 aa, Mycobacterium
CDHLLDQYLRCGGAIRYRAKVDGI

SEQ ID NO: 1312666 - protein, 19 aa, Mycobacterium
CDKPVPTAGLRRLQRYRRL

SEQ ID NO: 1312667 - protein, 21 aa, Mycobacterium
CDQIASVPYPLATPDDLAATV

SEQ ID NO: 1312668 - protein, 17 aa, Mycobacterium
CDRLGLLPMYAVNQDKH

SEQ ID NO: 1312669 - protein, 21 aa, Mycobacterium
CDRMLDLGVIIQPTGDHQNIL

SEQ ID NO: 1312670 - protein, 26 aa, Mycobacterium
CDSFNTPLVFVVDTPGFMPGVEQEKG

SEQ ID NO: 1312671 - protein, 25 aa, Mycobacterium
CDTTMRMLCVFNPPVTGREIHDENG

SEQ ID NO: 1312672 - protein, 22 aa, Mycobacterium
CDVGMGFSWARPTSFARPVVTL

SEQ ID NO: 1312673 - protein, 26 aa, Mycobacterium
CDVWNGFIFINLDPEPRWSLREFLGP

SEQ ID NO: 1312674 - protein, 23 aa, Mycobacterium
CEASWTHSPSRPPRLHLSGTEAG

SEQ ID NO: 1312675 - protein, 17 aa, Mycobacterium
CEDDDHLLQLLNTQIRA

SEQ ID NO: 1312676 - protein, 19 aa, Mycobacterium
CEFIDASPSPFHVCRTAAE

SEQ ID NO: 1312677 - protein, 18 aa, Mycobacterium
CEFMEFPSGILQVCGDSF

SEQ ID NO: 1312678 - protein, 17 aa, Mycobacterium
CEIFLDDVRIPAANLIG

SEQ ID NO: 1312679 - protein, 25 aa, Mycobacterium
CEIPNNVILIDQFAKRFDGFSIGSN

SEQ ID NO: 1312680 - protein, 18 aa, Mycobacterium
CELRRTYPRWGAQRIAHE

SEQ ID NO: 1312681 - protein, 23 aa, Mycobacterium
CELVFDDCRVPVTAILGGEPGRG

SEQ ID NO: 1312682 - protein, 26 aa, Mycobacterium
CEPERQIIFRVPWLDDGGVVQINRGF

SEQ ID NO: 1312683 - protein, 24 aa, Mycobacterium
CEPTAWEHWINAVEAILGHSADGD

SEQ ID NO: 1312684 - protein, 24 aa, Mycobacterium
CERLPLVGGLFTRGRLEAKAVLSL

SEQ ID NO: 1312685 - protein, 17 aa, Mycobacterium
CFFVNIATEFRDPDHRA

SEQ ID NO: 1312686 - protein, 28 aa, Mycobacterium
CFGEGPRWFEGLVWFSDMLGEAVHTVTL

SEQ ID NO: 1312687 - protein, 20 aa, Mycobacterium
CFHDMGMTGYLTVPMYFGAE

SEQ ID NO: 1312688 - protein, 22 aa, Mycobacterium
CFLESDLFNQGVRPAINVGVSV

SEQ ID NO: 1312689 - protein, 17 aa, Mycobacterium
CFLVHHRSRLASEKNGV

SEQ ID NO: 1312690 - protein, 22 aa, Mycobacterium
CGDPPKTAWLFTGQGSQYPGMA

SEQ ID NO: 1312691 - protein, 22 aa, Mycobacterium
CGDPPKTAWLFTGQGSQYPGMG

SEQ ID NO: 1312692 - protein, 23 aa, Mycobacterium
CGDVGWFQLADKQVILLSGAEAN

SEQ ID NO: 1312693 - protein, 24 aa, Mycobacterium
CGELARSPVLAAALDGICGPGGWV

SEQ ID NO: 1312694 - protein, 26 aa, Mycobacterium
CGETPYVKLLSQLFGDRLMVANATGC

SEQ ID NO: 1312695 - protein, 24 aa, Mycobacterium
CGIVLDHFRVAMAAAGWKCNVDRF

SEQ ID NO: 1312696 - protein, 23 aa, Mycobacterium
CGKSTLCRAILQLTPPTSGSVKF

SEQ ID NO: 1312697 - protein, 25 aa, Mycobacterium
CGLAGTVLRFLPPVAALSTETVEFD

SEQ ID NO: 1312698 - protein, 25 aa, Mycobacterium
CGLARDWITPRFGPRVGWLAGAHVS

SEQ ID NO: 1312699 - protein, 28 aa, Mycobacterium
CGLICDASYPTFLLTHWARDRHRGPKFS

SEQ ID NO: 1312700 - protein, 19 aa, Mycobacterium
CGPIRVRVAHRSRCSCVGV

SEQ ID NO: 1312701 - protein, 19 aa, Mycobacterium
CGPLAHPAQWWVTLSCGCP

SEQ ID NO: 1312702 - protein, 17 aa, Mycobacterium
CGTDLHILKGDVPEVEP

SEQ ID NO: 1312703 - protein, 21 aa, Mycobacterium
CGVRLPARRLSAPRLRAAVQS

SEQ ID NO: 1312704 - protein, 20 aa, Mycobacterium
CGYHFLNGELLAYCEGQNFP

SEQ ID NO: 1312705 - protein, 24 aa, Mycobacterium
CHDRGFLFFTTHVSDPLAAAVACT

SEQ ID NO: 1312706 - protein, 23 aa, Mycobacterium
CHFSWVEMLQGKPYGKIAAGHGS

SEQ ID NO: 1312707 - protein, 34 aa, Mycobacterium
CHGVIAFSAILHHPIRYIMKYWKDEPTVGINPGD

SEQ ID NO: 1312708 - protein, 19 aa, Mycobacterium
CHRLDGMPLAIELAAARVR

SEQ ID NO: 1312709 - protein, 19 aa, Mycobacterium
CIAAVARMRTPVVGAINGA

SEQ ID NO: 1312710 - protein, 26 aa, Mycobacterium
CIARHDGRVVFVRYALPGETVRARLV

SEQ ID NO: 1312711 - protein, 17 aa, Mycobacterium
CIDVLTQISAVNSALQS

SEQ ID NO: 1312712 - protein, 18 aa, Mycobacterium
CIECPFHGWRWGPEGDNT

SEQ ID NO: 1312713 - protein, 25 aa, Mycobacterium
CILRYAAMVLLLPSAQPLETADDVR

SEQ ID NO: 1312714 - protein, 17 aa, Mycobacterium
CIRCLRPTLDARIAFCE

SEQ ID NO: 1312715 - protein, 22 aa, Mycobacterium
CKDIPLMLTTPHFLVEGAIIAA

SEQ ID NO: 1312716 - protein, 21 aa, Mycobacterium
CKPGSAMRALPGISAKIVDDD

SEQ ID NO: 1312717 - protein, 18 aa, Mycobacterium
CKRMLISSDYYPALQRDN

SEQ ID NO: 1312718 - protein, 25 aa, Mycobacterium
CLAHIYLRRVLAATETWPAKLEELT

SEQ ID NO: 1312719 - protein, 24 aa, Mycobacterium
CLAQSVFAFFQNGGGKAYIVAIGD

SEQ ID NO: 1312720 - protein, 26 aa, Mycobacterium
CLARETLLQFFLVDPHEIDPRKARLT

SEQ ID NO: 1312721 - protein, 24 aa, Mycobacterium
CLCRKHHLLKTFWTGENGWRDEQF

SEQ ID NO: 1312722 - protein, 28 aa, Mycobacterium
CLCRKHHLLKTFWTGENGWYEQQFTDGA

SEQ ID NO: 1312723 - protein, 18 aa, Mycobacterium
CLDVGRWQQAGWQVFALG

SEQ ID NO: 1312724 - protein, 26 aa, Mycobacterium
CLEHGVAFVPFFPLGSGFVPDNPVLN

SEQ ID NO: 1312725 - protein, 37 aa, Mycobacterium
CLHDPVWYDHLPYLPFPQNWPVFAPKDKIGDWLEFYT

SEQ ID NO: 1312726 - protein, 18 aa, Mycobacterium
CLIRVTPRRWGPVATGGF

SEQ ID NO: 1312727 - protein, 17 aa, Mycobacterium
CLLIVGSSRTRWHTTTD

SEQ ID NO: 1312728 - protein, 25 aa, Mycobacterium
CLTEALGLALPGNGSVLATHTARRA

SEQ ID NO: 1312729 - protein, 22 aa, Mycobacterium
CLTPLHHQSGLLVSLGGAVVGG

SEQ ID NO: 1312730 - protein, 36 aa, Mycobacterium
CLTPTFSASRFLPDVRYFGATFFTYVGKALGYLMAT

SEQ ID NO: 1312731 - protein, 18 aa, Mycobacterium
CLVLAVLLVVGLSPQQAV

SEQ ID NO: 1312732 - protein, 17 aa, Mycobacterium
CMIHGADPWWDVAIRLM

SEQ ID NO: 1312733 - protein, 17 aa, Mycobacterium
CMPTYLAAQAAGVARAK

SEQ ID NO: 1312734 - protein, 20 aa, Mycobacterium
CNPFCPYTTSPSGDCLIAPR

SEQ ID NO: 1312735 - protein, 24 aa, Mycobacterium
CNSKSMWVASPPLVGVRTLRSPCG

SEQ ID NO: 1312736 - protein, 29 aa, Mycobacterium
CNTDMLQSPPMYKSFRPDLENPTRADAEP

SEQ ID NO: 1312737 - protein, 17 aa, Mycobacterium
CNWLVQKGPIAKLCVSC

SEQ ID NO: 1312738 - protein, 25 aa, Mycobacterium
CPAHPDWITQILVALATGRAGDITL

SEQ ID NO: 1312739 - protein, 29 aa, Mycobacterium
CPCGGLIRPNVVWFGEALPEAAWQHSVHA

SEQ ID NO: 1312740 - protein, 19 aa, Mycobacterium
CPDTQLVLGGFSQGAAVAA

SEQ ID NO: 1312741 - protein, 21 aa, Mycobacterium
CPEWTIVQYATAKIGAILVNI

SEQ ID NO: 1312742 - protein, 22 aa, Mycobacterium
CPEWTMLQYATAKIGAILVTIN

SEQ ID NO: 1312743 - protein, 17 aa, Mycobacterium
CPLALACDLVVAAPSAF

SEQ ID NO: 1312744 - protein, 17 aa, Mycobacterium
CPPRQFERARVVVFAGD

SEQ ID NO: 1312745 - protein, 18 aa, Mycobacterium
CPRRLTEAKEWIACLVPV

SEQ ID NO: 1312746 - protein, 18 aa, Mycobacterium
CPVAIIHSAGTNSKPGWV

SEQ ID NO: 1312747 - protein, 20 aa, Mycobacterium
CPVVAWRQIGQPGTAPVVVG

SEQ ID NO: 1312748 - protein, 24 aa, Mycobacterium
CQCPHWGYMLSGQLRMHTRERQHV

SEQ ID NO: 1312749 - protein, 19 aa, Mycobacterium
CQFAVGLSRQLYGRTIASE

SEQ ID NO: 1312750 - protein, 23 aa, Mycobacterium
CQIAGITYRQLDYWARTSLVVPS

SEQ ID NO: 1312751 - protein, 21 aa, Mycobacterium
CQPANLLIEKTGWTTHRPGNG

SEQ ID NO: 1312752 - protein, 23 aa, Mycobacterium
CQSILGYVVRWIDAGVGCSKVPD

SEQ ID NO: 1312753 - protein, 25 aa, Mycobacterium
CRAEELLLSALRPVDTATAPIPPAY

SEQ ID NO: 1312754 - protein, 17 aa, Mycobacterium
CRAVDVLERFYSVVLTD

SEQ ID NO: 1312755 - protein, 19 aa, Mycobacterium
CRCGRWGRSTRWCRRGIGG

SEQ ID NO: 1312756 - protein, 23 aa, Mycobacterium
CRELGITEFMLLQAAVAVTLAKV

SEQ ID NO: 1312757 - protein, 17 aa, Mycobacterium
CRILARLGVAEEFARIS

SEQ ID NO: 1312758 - protein, 25 aa, Mycobacterium
CRKAGLHWVGLRKVPAKGKRGATAD

SEQ ID NO: 1312759 - protein, 17 aa, Mycobacterium
CRLYWVQIGPTAAAPDS

SEQ ID NO: 1312760 - protein, 20 aa, Mycobacterium
CRMGAFFPALGAFGGNPPNI

SEQ ID NO: 1312761 - protein, 29 aa, Mycobacterium
CRPAPDNMLYVTVLLPMTHGVAVYAACNR

SEQ ID NO: 1312762 - protein, 20 aa, Mycobacterium
CRQLDGLPLAIELAAARIRV

SEQ ID NO: 1312763 - protein, 20 aa, Mycobacterium
CRRQVFRWLVRYNLRRLGFP

SEQ ID NO: 1312764 - protein, 29 aa, Mycobacterium
CRVPAAVRFLSCEPLLGPLPGLPLDGIGW

SEQ ID NO: 1312765 - protein, 19 aa, Mycobacterium
CRYRRWLAMAARDGNEMVV

SEQ ID NO: 1312766 - protein, 24 aa, Mycobacterium
CSDDQFPTMPFAALGYEIVHCGFN

SEQ ID NO: 1312767 - protein, 40 aa, Mycobacterium
CSDGRYIQLSMLQPTRYWAPLCRLFGLFGAADDERFGSLE

SEQ ID NO: 1312768 - protein, 24 aa, Mycobacterium
CSETCVGRLRYLGLVLYDVDRVTA

SEQ ID NO: 1312769 - protein, 25 aa, Mycobacterium
CSFDWCRCRWRSESGHWWIEYVAAT

SEQ ID NO: 1312770 - protein, 18 aa, Mycobacterium
CSHAPRPKMLVFGAIDFA

SEQ ID NO: 1312771 - protein, 20 aa, Mycobacterium
CSIKHHLPSIVFSLEMSKTE

SEQ ID NO: 1312772 - protein, 35 aa, Mycobacterium
CSRRGGLLRYRRAGLGAGPALRRGRLDRRTGSTIA

SEQ ID NO: 1312773 - protein, 29 aa, Mycobacterium
CSTAMTPWVWPTMHLNPPEWIMPVTEACE

SEQ ID NO: 1312774 - protein, 20 aa, Mycobacterium
CSTTPLLRKRKPFTTGKSPE

SEQ ID NO: 1312775 - protein, 32 aa, Mycobacterium
CSVKSMMMQAILAFWWPDLPRCTAAMSCIDII

SEQ ID NO: 1312776 - protein, 21 aa, Mycobacterium
CSWNHLVKSYVLGAIPPPKGS

SEQ ID NO: 1312777 - protein, 20 aa, Mycobacterium
CTAGMLAARLTERAGSSAYV

SEQ ID NO: 1312778 - protein, 20 aa, Mycobacterium
CTFCIVPALRGREVDRRPGD

SEQ ID NO: 1312779 - protein, 24 aa, Mycobacterium
CTHPQCTVPFYWTEVHHTHDYSQG

SEQ ID NO: 1312780 - protein, 25 aa, Mycobacterium
CTIRSDLLVLLRRLHRRDDVSRIVV

SEQ ID NO: 1312781 - protein, 17 aa, Mycobacterium
CTIWGLKNKIVSPEAGR

SEQ ID NO: 1312782 - protein, 26 aa, Mycobacterium
CTKDVDLGWYRLPKGSLGGNYIKYQG

SEQ ID NO: 1312783 - protein, 24 aa, Mycobacterium
CTLRNWLGMWSLRHAQTRAEPHLA

SEQ ID NO: 1312784 - protein, 25 aa, Mycobacterium
CTRCAAIAIRRRIRLVSAAGSVRTG

SEQ ID NO: 1312785 - protein, 20 aa, Mycobacterium
CTRGYSVMLGYWNDPDKTAQ

SEQ ID NO: 1312786 - protein, 22 aa, Mycobacterium
CTRIWKDGRVEQLGWPRVKIHY

SEQ ID NO: 1312787 - protein, 22 aa, Mycobacterium
CTVERLMAELGLRGAVRGKATT

SEQ ID NO: 1312788 - protein, 24 aa, Mycobacterium
CVAPATELASWLRRGRVTTAMIRP

SEQ ID NO: 1312789 - protein, 19 aa, Mycobacterium
CVDPAAVIDLLEAPPDGVY

SEQ ID NO: 1312790 - protein, 18 aa, Mycobacterium
CVELRYLRTPEGEAATDE

SEQ ID NO: 1312791 - protein, 19 aa, Mycobacterium
CVELTFAAASLGAANAIIN

SEQ ID NO: 1312792 - protein, 27 aa, Mycobacterium
CVERNIAFVPFFPLGSGFVADNPVLGN

SEQ ID NO: 1312793 - protein, 24 aa, Mycobacterium
CVGDLLDVTVPFGDLPAPDGSAPV

SEQ ID NO: 1312794 - protein, 18 aa, Mycobacterium
CVGVPGMIDGIIGAAPLA

SEQ ID NO: 1312795 - protein, 27 aa, Mycobacterium
CVIDELRGLFLFDGLTDAQLTALCADG

SEQ ID NO: 1312796 - protein, 26 aa, Mycobacterium
CVLCPPRRMWSVPRIYAAAPPDGLRG

SEQ ID NO: 1312797 - protein, 18 aa, Mycobacterium
CVPLLKQLLEAEGVEQSK

SEQ ID NO: 1312798 - protein, 18 aa, Mycobacterium
CVRIGGFALWGSVAVKRK

SEQ ID NO: 1312799 - protein, 25 aa, Mycobacterium
CVSGVYELPALLEVVFHRGSKMHDI

SEQ ID NO: 1312800 - protein, 17 aa, Mycobacterium
CVVALAALGWQSKVHRF

SEQ ID NO: 1312801 - protein, 22 aa, Mycobacterium
CVVDLPTALLLRGQHPPDPAAR

SEQ ID NO: 1312802 - protein, 20 aa, Mycobacterium
CVVPLGWPRGRYGPTTRRPV

SEQ ID NO: 1312803 - protein, 17 aa, Mycobacterium
CVVPVMFDRIMDLPDEV

SEQ ID NO: 1312804 - protein, 17 aa, Mycobacterium
CVVVAPSKLQKPAGDRV

SEQ ID NO: 1312805 - protein, 17 aa, Mycobacterium
CVYILVGYEQATIPPDN

SEQ ID NO: 1312806 - protein, 21 aa, Mycobacterium
CWMAVAPLFHTAGVSGMLPMF

SEQ ID NO: 1312807 - protein, 20 aa, Mycobacterium
CWRCRNPLIYRAVSSWFIKV

SEQ ID NO: 1312808 - protein, 17 aa, Mycobacterium
CWRDLLCWERLSGDLLC

SEQ ID NO: 1312809 - protein, 20 aa, Mycobacterium
CYIPMLEELGFIPSKKFADG

SEQ ID NO: 1312810 - protein, 25 aa, Mycobacterium
CYLSMPLFHSNAVLAGWSVAVNSGA

SEQ ID NO: 1312811 - protein, 24 aa, Mycobacterium
CYLSMPLFHSNAVMAGWAVGVAAG

SEQ ID NO: 1312812 - protein, 22 aa, Mycobacterium
DAAAGANVLTYGSGSQATVDQG

SEQ ID NO: 1312813 - protein, 21 aa, Mycobacterium
DAAAGFILDGYPRSVEQAKAL

SEQ ID NO: 1312814 - protein, 17 aa, Mycobacterium
DAAALEALTAWIDGYRL

SEQ ID NO: 1312815 - protein, 24 aa, Mycobacterium
DAAARFAALLVGADVHLVTERAAK

SEQ ID NO: 1312816 - protein, 26 aa, Mycobacterium
DAAAWDLLNLLTCAPGAIGDHLLTGL

SEQ ID NO: 1312817 - protein, 27 aa, Mycobacterium
DAADDLAILGYWLASQAPPAMRLCHHL

SEQ ID NO: 1312818 - protein, 25 aa, Mycobacterium
DAADRRRVLIYLSARGKTKVRKLVK

SEQ ID NO: 1312819 - protein, 20 aa, Mycobacterium
DAAGFPFRTLHDAYRALQAW

SEQ ID NO: 1312820 - protein, 25 aa, Mycobacterium
DAAKAKWWCTELAKRVVDACLQLHG

SEQ ID NO: 1312821 - protein, 24 aa, Mycobacterium
DAALLRAVLLFASDAPSLTLATLT

SEQ ID NO: 1312822 - protein, 25 aa, Mycobacterium
DAALRPLMSHYTALRREEWGFDGEP

SEQ ID NO: 1312823 - protein, 23 aa, Mycobacterium
DAALVCVPPYHIAGVGAALSNLY

SEQ ID NO: 1312824 - protein, 17 aa, Mycobacterium
DAALVVGVGAWWHNWQP

SEQ ID NO: 1312825 - protein, 22 aa, Mycobacterium
DAAMRRIPLTLAHVLPSAATQS

SEQ ID NO: 1312826 - protein, 24 aa, Mycobacterium
DAAPLSHNGFKLPLARNAVMRALV

SEQ ID NO: 1312827 - protein, 23 aa, Mycobacterium
DAAQQFMALVTGPQGREVLSAAG

SEQ ID NO: 1312828 - protein, 19 aa, Mycobacterium
DAASVTVNFRFAPDRSVEQ

SEQ ID NO: 1312829 - protein, 26 aa, Mycobacterium
DAATGLAWALLTRPIAVMSVLATVTS

SEQ ID NO: 1312830 - protein, 29 aa, Mycobacterium
DAATRTRDPTWSPPLKPVSPEFSNRCDDS

SEQ ID NO: 1312831 - protein, 34 aa, Mycobacterium
DAAVARWIRLVCRPTQWLELRFVGARGAMLRGII

SEQ ID NO: 1312832 - protein, 19 aa, Mycobacterium
DAAVGWITEVLGFDVVREF

SEQ ID NO: 1312833 - protein, 25 aa, Mycobacterium
DAAVMADPLPFYRTLRDEHPLHYVD

SEQ ID NO: 1312834 - protein, 21 aa, Mycobacterium
DAAVSTKLLFGSPAAALAEEA

SEQ ID NO: 1312835 - protein, 30 aa, Mycobacterium
DACEADGIAFIPWFPLAAGPLAAADGPLHR

SEQ ID NO: 1312836 - protein, 29 aa, Mycobacterium
DADAIHLSRIPFDDLLPVCADLLAMTRQQ

SEQ ID NO: 1312837 - protein, 25 aa, Mycobacterium
DADDPEWLRWNYATVVWGIATAHEL

SEQ ID NO: 1312838 - protein, 24 aa, Mycobacterium
DADEMNRVYVRCGMVPAPTDVIWD

SEQ ID NO: 1312839 - protein, 18 aa, Mycobacterium
DADFYICGPGPFMDTVEG

SEQ ID NO: 1312840 - protein, 22 aa, Mycobacterium
DADFYICGPGPFMDTVEGALAT

SEQ ID NO: 1312841 - protein, 25 aa, Mycobacterium
DADFYVCGPTPFMDTVETALLGAGV

SEQ ID NO: 1312842 - protein, 24 aa, Mycobacterium
DADGFWAAVLHRTAERRADVFASV

SEQ ID NO: 1312843 - protein, 23 aa, Mycobacterium
DADGYFWFMGRADDVIKSAGHLI

SEQ ID NO: 1312844 - protein, 28 aa, Mycobacterium
DADIERVMPIFDTLRPPGDRADGFVHAG

SEQ ID NO: 1312845 - protein, 25 aa, Mycobacterium
DADNEAKWFWFEGNFGGYEENKIER

SEQ ID NO: 1312846 - protein, 26 aa, Mycobacterium
DADRFVWNRPMPRLLAFGRGQHFCLG

SEQ ID NO: 1312847 - protein, 28 aa, Mycobacterium
DADVERLHLVLVFRSVGLPLEEIRTLLD

SEQ ID NO: 1312848 - protein, 25 aa, Mycobacterium
DADVVALNALAWGGPPIGALVFRDP

SEQ ID NO: 1312849 - protein, 33 aa, Mycobacterium
DADYLTMVELKTSWYSFITPLQAGAIAAGVDPD

SEQ ID NO: 1312850 - protein, 17 aa, Mycobacterium
DAEAARRSVIGLALHGL

SEQ ID NO: 1312851 - protein, 25 aa, Mycobacterium
DAEAPPLFSLWTPENGRQGYEPGVA

SEQ ID NO: 1312852 - protein, 23 aa, Mycobacterium
DAEARWMLAFELIFTQFGDPLAG

SEQ ID NO: 1312853 - protein, 25 aa, Mycobacterium
DAEGVADLLRLLGPLTAEEIAQRST

SEQ ID NO: 1312854 - protein, 26 aa, Mycobacterium
DAEGVADLLRLLGPLTTEEIAARCVV

SEQ ID NO: 1312855 - protein, 24 aa, Mycobacterium
DAEILFDGIPLDKISTSFTINGTA

SEQ ID NO: 1312856 - protein, 23 aa, Mycobacterium
DAEKFLLSWLGFDLERAEARPVD

SEQ ID NO: 1312857 - protein, 17 aa, Mycobacterium
DAELLGLYYADAGQHFE

SEQ ID NO: 1312858 - protein, 23 aa, Mycobacterium
DAELSALLALRPPALLVGRVDPN

SEQ ID NO: 1312859 - protein, 26 aa, Mycobacterium
DAENLAFKLALVTRGLAADPFVDTYE

SEQ ID NO: 1312860 - protein, 27 aa, Mycobacterium
DAEQADYVLALQLRRLTKLDVIELQAE

SEQ ID NO: 1312861 - protein, 25 aa, Mycobacterium
DAERAFWQFHASLMEPWDGPACVTF

SEQ ID NO: 1312862 - protein, 24 aa, Mycobacterium
DAEREGVRINWLRTITAFDGPDIQ

SEQ ID NO: 1312863 - protein, 25 aa, Mycobacterium
DAEVWERLTGNFWLPEKVPVSNDIP

SEQ ID NO: 1312864 - protein, 19 aa, Mycobacterium
DAEWRFVGVPDLSSLDRDV

SEQ ID NO: 1312865 - protein, 27 aa, Mycobacterium
DAFADNDLAWGPAWCSSLRSLWVGTGE

SEQ ID NO: 1312866 - protein, 26 aa, Mycobacterium
DAFFDRYGIPILVVYGATEFSGAVAG

SEQ ID NO: 1312867 - protein, 17 aa, Mycobacterium
DAFKKVVEVNLIGTFNV

SEQ ID NO: 1312868 - protein, 22 aa, Mycobacterium
DAFNALPMRRAVHAVFECCYSV

SEQ ID NO: 1312869 - protein, 17 aa, Mycobacterium
DAFPLIITHGWPGSVVE

SEQ ID NO: 1312870 - protein, 26 aa, Mycobacterium
DAFWRRNPVLAPLRRVLNTPKVHHRF

SEQ ID NO: 1312871 - protein, 32 aa, Mycobacterium
DAGADGLFVGRPMWLPLDDAGVVRFYRDVTEA

SEQ ID NO: 1312872 - protein, 34 aa, Mycobacterium
DAGALMVPTLRPAQARVLLMAALAADVPAAEVLA

SEQ ID NO: 1312873 - protein, 29 aa, Mycobacterium
DAGAMAYLVKPFSITDLIPAIEVAVSRFS

SEQ ID NO: 1312874 - protein, 23 aa, Mycobacterium
DAGDACVLWCSAIRHAVLTGEID

SEQ ID NO: 1312875 - protein, 26 aa, Mycobacterium
DAGDIPWAVFSPYTPFLNSPGMPPVG

SEQ ID NO: 1312876 - protein, 26 aa, Mycobacterium
DAGEPWNVSKLYYIHGFLRDRMQTLQ

SEQ ID NO: 1312877 - protein, 25 aa, Mycobacterium
DAGERTLWFVIDPQGPGIDVVGRRG

SEQ ID NO: 1312878 - protein, 17 aa, Mycobacterium
DAGFERWVKALASLKSD

SEQ ID NO: 1312879 - protein, 25 aa, Mycobacterium
DAGGRGLLVLLDALTRTLGGHAARR

SEQ ID NO: 1312880 - protein, 45 aa, Mycobacterium
DAGHAIAPPFPPLLTQFEPGFTALIRRLLRLFDEIDAGTAAGISG

SEQ ID NO: 1312881 - protein, 25 aa, Mycobacterium
DAGHPVLLESFLDGPEVSLFCVVDG

SEQ ID NO: 1312882 - protein, 31 aa, Mycobacterium
DAGHQRLATLVRLFLLGTDEPRERVGHAMPG

SEQ ID NO: 1312883 - protein, 24 aa, Mycobacterium
DAGIALAILGTGLAAASLAANGTP

SEQ ID NO: 1312884 - protein, 24 aa, Mycobacterium
DAGKTVRYLAGRAVWQASATYRGG

SEQ ID NO: 1312885 - protein, 18 aa, Mycobacterium
DAGLFHLDELPQGDYVRM

SEQ ID NO: 1312886 - protein, 19 aa, Mycobacterium
DAGLIFAAYQRDPARQFVP

SEQ ID NO: 1312887 - protein, 26 aa, Mycobacterium
DAGPAILYRLHLDLASLSIAEFYPDG

SEQ ID NO: 1312888 - protein, 19 aa, Mycobacterium
DAGPLVGRPWPITYRSDEN

SEQ ID NO: 1312889 - protein, 32 aa, Mycobacterium
DAGPSLTRSLSLIPTFPFPNETIENWQRGDYA

SEQ ID NO: 1312890 - protein, 25 aa, Mycobacterium
DAGRCAPIPLPLKTSYAWAETEYHR

SEQ ID NO: 1312891 - protein, 29 aa, Mycobacterium
DAGTQRLSVFFFDLLHADGVDLLDLPTGE

SEQ ID NO: 1312892 - protein, 26 aa, Mycobacterium
DAGTWPAYRPLLNWLIGLMPEGGASY

SEQ ID NO: 1312893 - protein, 26 aa, Mycobacterium
DAGVLCSMLLNRLSLAPGEALYLPAG

SEQ ID NO: 1312894 - protein, 25 aa, Mycobacterium
DAGVPFIEFAYIPPEIRAFFDHIKQ

SEQ ID NO: 1312895 - protein, 19 aa, Mycobacterium
DAGVYIPTLCYLRDKPCLG

SEQ ID NO: 1312896 - protein, 18 aa, Mycobacterium
DAGWRQLIGNVGAEYRLL

SEQ ID NO: 1312897 - protein, 25 aa, Mycobacterium
DAHAMPIAFRALSRLLRAMFSADDL

SEQ ID NO: 1312898 - protein, 17 aa, Mycobacterium
DAHPWFKSARRSKDDPY

SEQ ID NO: 1312899 - protein, 20 aa, Mycobacterium
DAHQGSRLVPIPGAPPSVTA

SEQ ID NO: 1312900 - protein, 27 aa, Mycobacterium
DAIELTVFGALRMVQAFSPALAEANGA

SEQ ID NO: 1312901 - protein, 19 aa, Mycobacterium
DAIMVVLALAMQEAGELAS

SEQ ID NO: 1312902 - protein, 22 aa, Mycobacterium
DAINTLLKYMEDFRDRLVVIVA

SEQ ID NO: 1312903 - protein, 17 aa, Mycobacterium
DAIPYPFEFQLLDEDWE

SEQ ID NO: 1312904 - protein, 25 aa, Mycobacterium
DAITDLFLDAMLTQGATKAQKLAKI

SEQ ID NO: 1312905 - protein, 17 aa, Mycobacterium
DAKALAALKPGGWVANV

SEQ ID NO: 1312906 - protein, 36 aa, Mycobacterium; identical to SEQ ID NO: 799040

SEQ ID NO: 1312907 - protein, 24 aa, Mycobacterium
DAKRLVDFAAGLAFALRGSFDKVA

SEQ ID NO: 1312908 - protein, 29 aa, Mycobacterium
DALAEGILAAVKRLYLLGKNDRPTGTFTF

SEQ ID NO: 1312909 - protein, 18 aa, Mycobacterium
DALAEPLARQRNGAHHRS

SEQ ID NO: 1312910 - protein, 18 aa, Mycobacterium
DALAGLDRPFGIGLVHWV

SEQ ID NO: 1312911 - protein, 28 aa, Mycobacterium
DALALQLGWRLFGPFLRAATGLDDPHAG

SEQ ID NO: 1312912 - protein, 20 aa, Mycobacterium
DALDLIPPKLAAAIDNVVVL

SEQ ID NO: 1312913 - protein, 27 aa, Mycobacterium
DALDYVRDLLSYLPPNNYAEPPRYPAP

SEQ ID NO: 1312914 - protein, 19 aa, Mycobacterium
DALELEALTWQNPATLAAM

SEQ ID NO: 1312915 - protein, 23 aa, Mycobacterium
DALEMLYSGALVRAGMGYTSYPE

SEQ ID NO: 1312916 - protein, 17 aa, Mycobacterium
DALFGVASALRQWSRAA

SEQ ID NO: 1312917 - protein, 17 aa, Mycobacterium
DALFHALADRTRRDIMR

SEQ ID NO: 1312918 - protein, 19 aa, Mycobacterium
DALFPTLFGAAREIECDSG

SEQ ID NO: 1312919 - protein, 28 aa, Mycobacterium
DALGRRYGLLGKTFNFFSKLRGGMEKNV

SEQ ID NO: 1312920 - protein, 24 aa, Mycobacterium
DALLPATPEPVGTLILTELRTAVA

SEQ ID NO: 1312921 - protein, 18 aa, Mycobacterium
DALLRSALDLIADGGIDG

SEQ ID NO: 1312922 - protein, 19 aa, Mycobacterium
DALLVDVDPWSGGLDLLLG

SEQ ID NO: 1312923 - protein, 23 aa, Mycobacterium
DALNLLPLPNRLDLLEALGLHNE

SEQ ID NO: 1312924 - protein, 23 aa, Mycobacterium
DALPEPTFVPVLGRIAAGGPILA

SEQ ID NO: 1312925 - protein, 18 aa, Mycobacterium
DALRLLPDLVAAGPVIGT

SEQ ID NO: 1312926 - protein, 20 aa, Mycobacterium
DALRRWMAAAALVRSRADGG

SEQ ID NO: 1312927 - protein, 31 aa, Mycobacterium
DALSALPDRPAVLVPAFLSRGYHVRSDIPAH

SEQ ID NO: 1312928 - protein, 21 aa, Mycobacterium
DALTDEPLLRLPGAVILVGER

SEQ ID NO: 1312929 - protein, 31 aa, Mycobacterium
DALTRLSMRTLLLDLWREHGFGVLLVTHDVD

SEQ ID NO: 1312930 - protein, 22 aa, Mycobacterium
DALVAEIRRLSELDALREAVQT

SEQ ID NO: 1312931 - protein, 21 aa, Mycobacterium
DALVARDGLVLGELPAGSTVG

SEQ ID NO: 1312932 - protein, 30 aa, Mycobacterium
DALVDLEMPLWEGAPFTAFLLGRSDIEDVV

SEQ ID NO: 1312933 - protein, 26 aa, Mycobacterium
DALVSPPYYRLVLGMPPLAAEAVDRL

SEQ ID NO: 1312934 - protein, 23 aa, Mycobacterium
DALWAATFLRRRGAGASAVLLDP

SEQ ID NO: 1312935 - protein, 17 aa, Mycobacterium
DAMCARFRISGLPVVDD

SEQ ID NO: 1312936 - protein, 18 aa, Mycobacterium
DAMFYPEFSLWCGTTATA

SEQ ID NO: 1312937 - protein, 17 aa, Mycobacterium
DAMLHVLARDMRHLEEA

SEQ ID NO: 1312938 - protein, 27 aa, Mycobacterium
DAMNSAVFFLLGLYALLTTTHGWPTQG

SEQ ID NO: 1312939 - protein, 28 aa, Mycobacterium
DAMQYGVLAGYPLVNVKVTLLDGAFHEV

SEQ ID NO: 1312940 - protein, 28 aa, Mycobacterium
DAMRMLTLPATFSLYLERAWPRHRRLSG

SEQ ID NO: 1312941 - protein, 20 aa, Mycobacterium
DAMRPFLLVASFVNPHDIVL

SEQ ID NO: 1312942 - protein, 18 aa, Mycobacterium
DAMVWPLLDVIDGCITEP

SEQ ID NO: 1312943 - protein, 26 aa, Mycobacterium
DANGVRRWLALDGQPLHRVTVAASEL

SEQ ID NO: 1312944 - protein, 27 aa, Mycobacterium
DAPAALAFLRRLGVAAGLAMGFPMLCA

SEQ ID NO: 1312945 - protein, 21 aa, Mycobacterium
DAPAFIMYTSGTTGFPKGAVL

SEQ ID NO: 1312946 - protein, 26 aa, Mycobacterium
DAPALARALCWMIERSFYQASKVSAA

SEQ ID NO: 1312947 - protein, 27 aa, Mycobacterium
DAPARALQVMFVLPELRAGLHFNALSL

SEQ ID NO: 1312948 - protein, 18 aa, Mycobacterium
DAPFLTPHPFRGAPNEPY

SEQ ID NO: 1312949 - protein, 30 aa, Mycobacterium
DAPIAFGDDLRRVLLGLRRAKSNVERLKLV

SEQ ID NO: 1312950 - protein, 22 aa, Mycobacterium
DAPIGWRRPLSPQPGRDLVVPV

SEQ ID NO: 1312951 - protein, 30 aa, Mycobacterium
DAPKRLGSFMDSRLWRMLLAPGRGIGRLVT

SEQ ID NO: 1312952 - protein, 29 aa, Mycobacterium
DAPKVHSLGLFQPLPGRYLDIITKRVEAD

SEQ ID NO: 1312953 - protein, 23 aa, Mycobacterium
DAPPKSFWRIDIAPVSRTVMHFR

SEQ ID NO: 1312954 - protein, 35 aa, Mycobacterium; identical to SEQ ID NO: 799209

SEQ ID NO: 1312955 - protein, 27 aa, Mycobacterium
DAPSGPGFWFPPTVLTPQRDDRTVVEE

SEQ ID NO: 1312956 - protein, 21 aa, Mycobacterium
DAPVLIGRDLLAQIRADDPRV

SEQ ID NO: 1312957 - protein, 18 aa, Mycobacterium
DAPWTAPQPTSYAEWIRP

SEQ ID NO: 1312958 - protein, 28 aa, Mycobacterium
DAQLRDLMDLHLFGPAALVRAALPIMRA

SEQ ID NO: 1312959 - protein, 25 aa, Mycobacterium
DAQQATWDRLWPELGRQVRDGDAPA

SEQ ID NO: 1312960 - protein, 31 aa, Mycobacterium; identical to SEQ ID NO: 1138037

SEQ ID NO: 1312961 - protein, 25 aa, Mycobacterium
DARAVLAFPATLPDGAPHTDLRGIG

SEQ ID NO: 1312962 - protein, 24 aa, Mycobacterium
DARAVLIRITPDGVAALRQARADR

SEQ ID NO: 1312963 - protein, 22 aa, Mycobacterium
DARAWLSLQQADIIRKAWTPPE

SEQ ID NO: 1312964 - protein, 20 aa, Mycobacterium
DARFDGWFVTAVLTTRIYCR

SEQ ID NO: 1312965 - protein, 24 aa, Mycobacterium
DARGHFGVYGGRYVPEALMAVIEE

SEQ ID NO: 1312966 - protein, 19 aa, Mycobacterium
DARIADRLGLRPDVRRVPL

SEQ ID NO: 1312967 - protein, 21 aa, Mycobacterium
DARLDVYRILGLKDGEAHVIR

SEQ ID NO: 1312968 - protein, 21 aa, Mycobacterium
DARLRELVIMRIGWITGSEYE

SEQ ID NO: 1312969 - protein, 17 aa, Mycobacterium
DARRLRLLDWQHPLERA

SEQ ID NO: 1312970 - protein, 28 aa, Mycobacterium
DARRRLRLPVEEILLAALGRAVAATVGE

SEQ ID NO: 1312971 - protein, 17 aa, Mycobacterium
DARRVFVHLCSAAQWTA

SEQ ID NO: 1312972 - protein, 24 aa, Mycobacterium
DARRYKYLPTFILRGLTRLHIEFS

SEQ ID NO: 1312973 - protein, 28 aa, Mycobacterium
DARTVICVLTHDPKFDVPLLEVALRLPQ

SEQ ID NO: 1312974 - protein, 26 aa, Mycobacterium
DARTWLGRPGLVDGAPADLVCYDQDP

SEQ ID NO: 1312975 - protein, 27 aa, Mycobacterium
DARVGWRLMIAGPAAWCLKLRAEATAA

SEQ ID NO: 1312976 - protein, 21 aa, Mycobacterium
DARVWRMSHGLAPELPVAVVS

SEQ ID NO: 1312977 - protein, 18 aa, Mycobacterium
DASAVPLTPSQPGGLMTP

SEQ ID NO: 1312978 - protein, 31 aa, Mycobacterium
DASEALRLGLDIMLIGVWNAFQVAIPHMKER

SEQ ID NO: 1312979 - protein, 40 aa, Mycobacterium
DASEGPLPQTRFVLRKALAAHLPVILVVNKTDRPDARIAE

SEQ ID NO: 1312980 - protein, 26 aa, Mycobacterium
DASFKSFVALDWALCLASGTPWQGKA

SEQ ID NO: 1312981 - protein, 23 aa, Mycobacterium
DASILGTPFYLMRRVWGRTPSDV

SEQ ID NO: 1312982 - protein, 25 aa, Mycobacterium
DASKRWVTVAFTWTGLRALGVPPHA

SEQ ID NO: 1312983 - protein, 27 aa, Mycobacterium
DASLLLAVLTRFLPPDDPRIRATVLAI

SEQ ID NO: 1312984 - protein, 23 aa, Mycobacterium
DASMAWQKILHERGWAAPAWPVE

SEQ ID NO: 1312985 - protein, 25 aa, Mycobacterium
DASPYLVATALLAAGFLGLQENLTL

SEQ ID NO: 1312986 - protein, 17 aa, Mycobacterium
DASSRAVLAFAARRLKG

SEQ ID NO: 1312987 - protein, 28 aa, Mycobacterium
DASVLGRPFYLMGFVDGWSPMDTHGKWP

SEQ ID NO: 1312988 - protein, 25 aa, Mycobacterium
DATANSLLPQWRGQAGEAAQAALLR

SEQ ID NO: 1312989 - protein, 25 aa, Mycobacterium
DATDGLVTTVPRLALAVVTADCVPV

SEQ ID NO: 1312990 - protein, 25 aa, Mycobacterium
DATEEFGHELLKWLRDRLAHYKCPR

SEQ ID NO: 1312991 - protein, 29 aa, Mycobacterium
DATEFDRLATLLRFPAAFFTTAPVSRVFA

SEQ ID NO: 1312992 - protein, 24 aa, Mycobacterium
DATHAWASVWTPQNLWLGLDPTNN

SEQ ID NO: 1312993 - protein, 20 aa, Mycobacterium
DATHFVRWLSLWSATIDDMY

SEQ ID NO: 1312994 - protein, 28 aa, Mycobacterium
DATLAMAALTWLTLPGQCGIGGDAFAVV

SEQ ID NO: 1312995 - protein, 23 aa, Mycobacterium
DATLREHSWKRSSFSGTEIFGKT

SEQ ID NO: 1312996 - protein, 25 aa, Mycobacterium
DATLRLLRRVAQVVEPPLLEAGGHI

SEQ ID NO: 1312997 - protein, 34 aa, Mycobacterium
DATRLRIAADGLWRFVTLPWQLTRVIPETTAVIA

SEQ ID NO: 1312998 - protein, 26 aa, Mycobacterium
DATVIEYLATRELLLVIDNCEHLLDA

SEQ ID NO: 1312999 - protein, 28 aa, Mycobacterium
DAVADHMGPPLPLIGVGELVSTAAKALR

SEQ ID NO: 1313000 - protein, 18 aa, Mycobacterium
DAVAWVARNLPSRPTVPV

SEQ ID NO: 1313001 - protein, 24 aa, Mycobacterium
DAVLGLPELTLGLIPGAGGTVSVT

SEQ ID NO: 1313002 - protein, 24 aa, Mycobacterium
DAVLLGLTGRRWGFGRTSTADRRR

SEQ ID NO: 1313003 - protein, 26 aa, Mycobacterium
DAVLQYKNHRLPKGEPLLAFGSRAVV

SEQ ID NO: 1313004 - protein, 23 aa, Mycobacterium
DAVRQSWIDATPLARLQTPDDVA

SEQ ID NO: 1313005 - protein, 21 aa, Mycobacterium
DAVRVFLTPESARQFATRSNR

SEQ ID NO: 1313006 - protein, 20 aa, Mycobacterium
DAVSLWTKLALEAARARRSA

SEQ ID NO: 1313007 - protein, 40 aa, Mycobacterium
DAVTPTGLIGRLLVPPVVPAGPPTPTPLALADLEPHGSSV

SEQ ID NO: 1313008 - protein, 23 aa, Mycobacterium
DAVTSLWKDGYLRRIELQPFSKE

SEQ ID NO: 1313009 - protein, 28 aa, Mycobacterium
DAVTVFAKNLKDLLLAAPAGNRTTMGLD

SEQ ID NO: 1313010 - protein, 23 aa, Mycobacterium
DAVVLAARIAALLKGICADDPRS

SEQ ID NO: 1313011 - protein, 21 aa, Mycobacterium
DAVVLRFGFFYGPGAGHSETM

SEQ ID NO: 1313012 - protein, 17 aa, Mycobacterium
DAVYPGYGFLSENPELA

SEQ ID NO: 1313013 - protein, 20 aa, Mycobacterium
DAVYPLVIRAGGGSPRDTLS

SEQ ID NO: 1313014 - protein, 19 aa, Mycobacterium
DAWFYLDELEAIIREWIAV

SEQ ID NO: 1313015 - protein, 21 aa, Mycobacterium
DAWLLLSMLHVIFEEDLADTA

SEQ ID NO: 1313016 - protein, 20 aa, Mycobacterium
DAWPGPGVVYFTRVIAEKAR

SEQ ID NO: 1313017 - protein, 19 aa, Mycobacterium
DAYFALMDHLGTDGLLTAV

SEQ ID NO: 1313018 - protein, 21 aa, Mycobacterium
DAYNHYAVGWAHALCGPYQWT

SEQ ID NO: 1313019 - protein, 21 aa, Mycobacterium
DAYPRLWDKAGALLQSLARNH

SEQ ID NO: 1313020 - protein, 19 aa, Mycobacterium
DAYSAVWQQDLAALVVTVC

SEQ ID NO: 1313021 - protein, 19 aa, Mycobacterium
DAYVYLAESIRAWPDQAEL

SEQ ID NO: 1313022 - protein, 26 aa, Mycobacterium
DCAPVIEKFWRTSLGPGLSADEAADA

SEQ ID NO: 1313023 - protein, 24 aa, Mycobacterium
DCCAVVAYGALLGDALLAVPAHGW

SEQ ID NO: 1313024 - protein, 22 aa, Mycobacterium
DCNRLAGLPPPVPPAPGYGDDL

SEQ ID NO: 1313025 - protein, 38 aa, Mycobacterium
DCPGHPRLSLLRLGARLGFTMIALDRPGYGSSAPYPDA

SEQ ID NO: 1313026 - protein, 26 aa, Mycobacterium
DCPHFDHSLAAYYLILPSEVSSNLAK

SEQ ID NO: 1313027 - protein, 18 aa, Mycobacterium
DCQQAVRFGLFHVLQASA

SEQ ID NO: 1313028 - protein, 17 aa, Mycobacterium
DCRASISGGAPLGARLG

SEQ ID NO: 1313029 - protein, 29 aa, Mycobacterium
DCRVHGRTWDLLRLTRMPTVQVDVGYITN

SEQ ID NO: 1313030 - protein, 17 aa, Mycobacterium
DCTGTACNGGRGGLLWG

SEQ ID NO: 1313031 - protein, 19 aa, Mycobacterium
DCTLALGFEKMQPGSLGAG

SEQ ID NO: 1313032 - protein, 17 aa, Mycobacterium
DCVGHPAWFEPAEWLGG

SEQ ID NO: 1313033 - protein, 20 aa, Mycobacterium
DCVWEYSEPLAPRNNASEAT

SEQ ID NO: 1313034 - protein, 25 aa, Mycobacterium
DDAALICVPPYHIAGVSAALSNLYA

SEQ ID NO: 1313035 - protein, 34 aa, Mycobacterium
DDAGRLLPLLELKAGRILFGGWPTGVEVCHAMVH

SEQ ID NO: 1313036 - protein, 28 aa, Mycobacterium
DDAKPELLRRYLDRWYWQVKGHVGGLTP

SEQ ID NO: 1313037 - protein, 27 aa, Mycobacterium
DDALTRNLNWLKAWYEFAVPDIGRSSL

SEQ ID NO: 1313038 - protein, 21 aa, Mycobacterium
DDALYEMELVGHDFFLFHDKE

SEQ ID NO: 1313039 - protein, 23 aa, Mycobacterium
DDAMQLCLVQMYLADERFTRHYD

SEQ ID NO: 1313040 - protein, 20 aa, Mycobacterium
DDARILLCSSVTGVWGGKGV

SEQ ID NO: 1313041 - protein, 21 aa, Mycobacterium
DDARLPVRLQWVSAELAMVQG

SEQ ID NO: 1313042 - protein, 17 aa, Mycobacterium
DDCPPVLVLTRRADDAW

SEQ ID NO: 1313043 - protein, 26 aa, Mycobacterium
DDDDGLPPFLLFNDDYESLKLRIARL

SEQ ID NO: 1313044 - protein, 25 aa, Mycobacterium
DDDDLFTGFITWTADILAARDVPAA

SEQ ID NO: 1313045 - protein, 22 aa, Mycobacterium
DDDGYLFLHDRIKDMIVSGGEN

SEQ ID NO: 1313046 - protein, 24 aa, Mycobacterium
DDDLHWQPHLWRHLVDRVPADPPH

SEQ ID NO: 1313047 - protein, 27 aa, Mycobacterium
DDDLIRHLRAFQWFLDRAADGGIALTA

SEQ ID NO: 1313048 - protein, 21 aa, Mycobacterium
DDDLLLLDDLLGIADPSAPLP

SEQ ID NO: 1313049 - protein, 18 aa, Mycobacterium
DDDRVPARGYRRPREDRF

SEQ ID NO: 1313050 - protein, 26 aa, Mycobacterium
DDDSVFAVPPFWIRTRDEIEDDPLVR

SEQ ID NO: 1313051 - protein, 23 aa, Mycobacterium
DDDTLTYRWDFGDGSSSTEATPV

SEQ ID NO: 1313052 - protein, 24 aa, Mycobacterium
DDDVSRLIAIRRMKPLGFTLDEMR

SEQ ID NO: 1313053 - protein, 28 aa, Mycobacterium
DDEANIAPWLRAANRFGAKVKWAEVDIE

SEQ ID NO: 1313054 - protein, 24 aa, Mycobacterium
DDELLVLDLLLQEKILVVQGTGFN

SEQ ID NO: 1313055 - protein, 40 aa, Mycobacterium
DDEQIDRIRRAHLLLAMFNALQPGVFALSGWDVCGMLTLP

SEQ ID NO: 1313056 - protein, 24 aa, Mycobacterium
DDERFDYMYKFVSSKKMQPGAGAS

SEQ ID NO: 1313057 - protein, 24 aa, Mycobacterium
DDERFDYMYKFVSSRKVQPGKDPA

SEQ ID NO: 1313058 - protein, 26 aa, Mycobacterium
DDESGRWYALALAATTADIIGAARGT

SEQ ID NO: 1313059 - protein, 25 aa, Mycobacterium
DDEVPFIGPLLPMHESVLVATGFDK

SEQ ID NO: 1313060 - protein, 18 aa, Mycobacterium
DDEYAAFGALLGLPGEKV

SEQ ID NO: 1313061 - protein, 29 aa, Mycobacterium
DDEYLRTPRGWRFHGRALTINAIETRPAR

SEQ ID NO: 1313062 - protein, 39 aa, Mycobacterium
DDFRRPSWTPIGPGTYGGFLAIRVFDFWVHERDITTPLG

SEQ ID NO: 1313063 - protein, 23 aa, Mycobacterium
DDFRTEQRWPLYSAAAAELGVLS

SEQ ID NO: 1313064 - protein, 21 aa, Mycobacterium
DDGAGPQVGAWFTGRNVTPER

SEQ ID NO: 1313065 - protein, 26 aa, Mycobacterium
DDGASEYIYRFAPLVGIYGGTLEVFR

SEQ ID NO: 1313066 - protein, 17 aa, Mycobacterium
DDGFFVKALHSIGAPLE

SEQ ID NO: 1313067 - protein, 20 aa, Mycobacterium
DDGFLNRLDLAFSRDQARRV

SEQ ID NO: 1313068 - protein, 18 aa, Mycobacterium
DDGQLRVLEERLAYLREL

SEQ ID NO: 1313069 - protein, 20 aa, Mycobacterium
DDGRIWLGGPTVAAGYRNPV

SEQ ID NO: 1313070 - protein, 23 aa, Mycobacterium
DDGRTLVLQAVRYPELWRENGGF

SEQ ID NO: 1313071 - protein, 24 aa, Mycobacterium
DDGRWQDEWLYARAYTIAGGSSEI

SEQ ID NO: 1313072 - protein, 25 aa, Mycobacterium
DDGSRRRIAFYRSLLGEIDDPAGGG

SEQ ID NO: 1313073 - protein, 24 aa, Mycobacterium
DDGSYWTGLVYADGKRWPVERTTW

SEQ ID NO: 1313074 - protein, 22 aa, Mycobacterium
DDGTWLSTVPRDQLIAAAEAIE

SEQ ID NO: 1313075 - protein, 19 aa, Mycobacterium
DDGYLVVTGRAKDLIIRNG

SEQ ID NO: 1313076 - protein, 27 aa, Mycobacterium
DDHEPLLLDWRAPAARAFYVATGANPE

SEQ ID NO: 1313077 - protein, 20 aa, Mycobacterium
DDHLLQLLNTQIRALPGVIS

SEQ ID NO: 1313078 - protein, 19 aa, Mycobacterium
DDHTAHWRPRQYHAPGTTV

SEQ ID NO: 1313079 - protein, 25 aa, Mycobacterium
DDHVGLGLRHAIRTWLVELPADRLA

SEQ ID NO: 1313080 - protein, 28 aa, Mycobacterium
DDIAMARIYVVDLTPERLGEAFPALGEF

SEQ ID NO: 1313081 - protein, 23 aa, Mycobacterium
DDIAPVVAFLASEEARFITGATI

SEQ ID NO: 1313082 - protein, 33 aa, Mycobacterium
DDIATFDLYSCFPFPVFVICEALGLSADDPRGL

SEQ ID NO: 1313083 - protein, 30 aa, Mycobacterium
DDIFYSPQHPYTWGLLGSLARLDRPRTERL

SEQ ID NO: 1313084 - protein, 21 aa, Mycobacterium
DDILVELGLDWDRIIELKTAG

SEQ ID NO: 1313085 - protein, 19 aa, Mycobacterium
DDIVPVIAFLASDAAQWIN

SEQ ID NO: 1313086 - protein, 24 aa, Mycobacterium
DDIVWQVPYLPIDPKDVGRTYEAV

SEQ ID NO: 1313087 - protein, 20 aa, Mycobacterium
DDIWKPYIRSLTKAPQTLLH

SEQ ID NO: 1313088 - protein, 20 aa, Mycobacterium
DDLAAIVADFRPGPGRRLGV

SEQ ID NO: 1313089 - protein, 27 aa, Mycobacterium
DDLANAELLATFLRFLAASTSGVKRDV

SEQ ID NO: 1313090 - protein, 30 aa, Mycobacterium
DDLATRVGWRWRLVWFRAVAELLSADYESA

SEQ ID NO: 1313091 - protein, 23 aa, Mycobacterium
DDLDFLHLAVLDALLTLHAETTA

SEQ ID NO: 1313092 - protein, 18 aa, Mycobacterium
DDLFLALLRQECEAVIAQ

SEQ ID NO: 1313093 - protein, 22 aa, Mycobacterium
DDLGELLWSFAPPDRVTRVRPA

SEQ ID NO: 1313094 - protein, 24 aa, Mycobacterium
DDLGYRGFWMGYVAARSAPLGAVP

SEQ ID NO: 1313095 - protein, 31 aa, Mycobacterium
DDLHPLRMVAARLPCAYLNPGRFIAGRPLVK

SEQ ID NO: 1313096 - protein, 17 aa, Mycobacterium
DDLHVQSIPLWEKVFDD

SEQ ID NO: 1313097 - protein, 22 aa, Mycobacterium
DDLIGFFKDPVRGFFRALDFTL

SEQ ID NO: 1313098 - protein, 25 aa, Mycobacterium
DDLLALFAHALKLPANPFAELASTP

SEQ ID NO: 1313099 - protein, 24 aa, Mycobacterium
DDLNYPKVVLVTGACRFLGGYLTA

SEQ ID NO: 1313100 - protein, 26 aa, Mycobacterium
DDLWLDTMVRHPLRDSWWQERNLVPL

SEQ ID NO: 1313101 - protein, 33 aa, Mycobacterium
DDMHIHRLAVLWPEVYPRLLRIMDADPLCQDRI

SEQ ID NO: 1313102 - protein, 18 aa, Mycobacterium
DDMLLHVDGWLCEIKDVQ

SEQ ID NO: 1313103 - protein, 27 aa, Mycobacterium
DDMLPLAPEHFLYDMFVHTRGLGEKDL

SEQ ID NO: 1313104 - protein, 24 aa, Mycobacterium
DDMRTAILALYRSAAQPAMAEAGR

SEQ ID NO: 1313105 - protein, 23 aa, Mycobacterium
DDPDLAIDWPLAGAIVSAQDRRA

SEQ ID NO: 1313106 - protein, 28 aa, Mycobacterium
DDPDRPFVALPIFPSRLFRHSSVYVGAD

SEQ ID NO: 1313107 - protein, 28 aa, Mycobacterium
DDPFGQVRWFDIDPCYIFHVANAHDDGR

SEQ ID NO: 1313108 - protein, 24 aa, Mycobacterium
DDPRGLTLTGGLPYFGGPGNSYSL

SEQ ID NO: 1313109 - protein, 17 aa, Mycobacterium
DDPSEGPYVGRAGGDDD

SEQ ID NO: 1313110 - protein, 31 aa, Mycobacterium
DDPTKVAMLGLTFDDVLLLPAASDVIPATAD

SEQ ID NO: 1313111 - protein, 17 aa, Mycobacterium
DDPTVVRVLGAIEIPVV

SEQ ID NO: 1313112 - protein, 25 aa, Mycobacterium
DDPVRWGVWVAPCPVPRALSRAAAK

SEQ ID NO: 1313113 - protein, 27 aa, Mycobacterium
DDPVVRMLLTLHGIIRPDPVTLAERAL

SEQ ID NO: 1313114 - protein, 17 aa, Mycobacterium
DDPWYRMRVAPSIFKHV

SEQ ID NO: 1313115 - protein, 22 aa, Mycobacterium
DDPYRELNPLAWRNALEPGSPA

SEQ ID NO: 1313116 - protein, 18 aa, Mycobacterium
DDPYTFYEALRNKCPVSR

SEQ ID NO: 1313117 - protein, 27 aa, Mycobacterium
DDRAYKPLNWMSPPCWIVEPTDGDATV

SEQ ID NO: 1313118 - protein, 17 aa, Mycobacterium
DDRDGWQALRDSAGLTA

SEQ ID NO: 1313119 - protein, 24 aa, Mycobacterium
DDRGLFDMVWALEGELTEGGELLL

SEQ ID NO: 1313120 - protein, 26 aa, Mycobacterium
DDRLQALALLPATLALYAGSISAVQG

SEQ ID NO: 1313121 - protein, 26 aa, Mycobacterium
DDRNLVFPFYVIPDEPPPLTGSTQPV

SEQ ID NO: 1313122 - protein, 22 aa, Mycobacterium
DDRQKLWARSGYLQPHWPKPYG

SEQ ID NO: 1313123 - protein, 25 aa, Mycobacterium
DDRRTLLWLANQRAIEYHPALGPAD

SEQ ID NO: 1313124 - protein, 23 aa, Mycobacterium
DDRRTLLWLANQRAVEYHPTLGL

SEQ ID NO: 1313125 - protein, 18 aa, Mycobacterium
DDRYMRTLDPWVSLGTAA

SEQ ID NO: 1313126 - protein, 24 aa, Mycobacterium
DDSARMLEMLYGSGNPFLIAIDHH

SEQ ID NO: 1313127 - protein, 18 aa, Mycobacterium
DDTAAAALRRWSLLTAVI

SEQ ID NO: 1313128 - protein, 23 aa, Mycobacterium
DDTALTLLVAEYLRDRGAVVDEA

SEQ ID NO: 1313129 - protein, 23 aa, Mycobacterium
DDTGKWIHPPLERSRYTGGPVHF

SEQ ID NO: 1313130 - protein, 18 aa, Mycobacterium
DDTILRIYSKRTERGLGF

SEQ ID NO: 1313131 - protein, 18 aa, Mycobacterium
DDTLVARFRKACASAGVG

SEQ ID NO: 1313132 - protein, 23 aa, Mycobacterium
DDVGHHLLLMRVSGVDSIRDRYA

SEQ ID NO: 1313133 - protein, 17 aa, Mycobacterium
DDVGLDSVAFAVGMVAI

SEQ ID NO: 1313134 - protein, 21 aa, Mycobacterium
DDVILHTYFTPETLQRAVRTV

SEQ ID NO: 1313135 - protein, 18 aa, Mycobacterium
DDVIWLQQARRDHFDFVA

SEQ ID NO: 1313136 - protein, 18 aa, Mycobacterium
DDVMRNWRFLQQNGVQIL

SEQ ID NO: 1313137 - protein, 19 aa, Mycobacterium
DDVPFRSFHFIYGLKSLEV

SEQ ID NO: 1313138 - protein, 32 aa, Mycobacterium
DDVRAKLRSSIKRLLVKYKYPPDKQPEAIKLV

SEQ ID NO: 1313139 - protein, 23 aa, Mycobacterium
DDVRRRWMPGKATVPLAQYRAAW

SEQ ID NO: 1313140 - protein, 19 aa, Mycobacterium
DDVSIVLMAVPGRPVMDEA

SEQ ID NO: 1313141 - protein, 31 aa, Mycobacterium
DDVSRIVVHLPPWLEPEPLCWDINNVDVVVG

SEQ ID NO: 1313142 - protein, 17 aa, Mycobacterium
DDWLGEWTFAFPQGSMT

SEQ ID NO: 1313143 - protein, 27 aa, Mycobacterium
DDYLNARPITTPFGLYDCDVPCDGAVA

SEQ ID NO: 1313144 - protein, 18 aa, Mycobacterium
DDYLPKPFALEELLARMR

SEQ ID NO: 1313145 - protein, 32 aa, Mycobacterium
DDYLVKPFVLAELVARVKALLRRRGSTATFSS

SEQ ID NO: 1313146 - protein, 25 aa, Mycobacterium
DDYNEIVISCPLLLTLPAVGTYPIE

SEQ ID NO: 1313147 - protein, 17 aa, Mycobacterium
DDYRAHTVAVDPVLSGG

SEQ ID NO: 1313148 - protein, 26 aa, Mycobacterium
DDYWNQYQLTFALYSVSDRAIPSAFD

SEQ ID NO: 1313149 - protein, 24 aa, Mycobacterium
DEADGVALLRRLVGRFPSGELQFD

SEQ ID NO: 1313150 - protein, 34 aa, Mycobacterium
DEAFALLTALGDPLLWSVPLHWAGVHAGILANSP

SEQ ID NO: 1313151 - protein, 23 aa, Mycobacterium
DEAKLDLMFQVNIAGMARVTDAV

SEQ ID NO: 1313152 - protein, 21 aa, Mycobacterium
DEALLDIYRKLRPGEPPTKES

SEQ ID NO: 1313153 - protein, 23 aa, Mycobacterium
DEALVITHRPPGCRFWNLVVWNQ

SEQ ID NO: 1313154 - protein, 24 aa, Mycobacterium
DEATRVPFVIARVGARPTTARTVT

SEQ ID NO: 1313155 - protein, 22 aa, Mycobacterium
DEDFIAFRQALRTDFTPFANDL

SEQ ID NO: 1313156 - protein, 24 aa, Mycobacterium
DEDKYCIDILTQISAVNSALQSVA

SEQ ID NO: 1313157 - protein, 27 aa, Mycobacterium
DEDYREAIALSRLGWAALAVGTSHAVL

SEQ ID NO: 1313158 - protein, 28 aa, Mycobacterium
DEDYREAIALSRLGWAALAVGTSHAVLD

SEQ ID NO: 1313159 - protein, 21 aa, Mycobacterium
DEEIGAFLILLASAGNDTTKQ

SEQ ID NO: 1313160 - protein, 25 aa, Mycobacterium
DEENRKLLADWWTETWNAGGGDFVK

SEQ ID NO: 1313161 - protein, 23 aa, Mycobacterium
DEEWHEVLELNLSSAWYLSRAAA

SEQ ID NO: 1313162 - protein, 24 aa, Mycobacterium
DEEWHEVLELNLSSAWYLSRAAAK

SEQ ID NO: 1313163 - protein, 22 aa, Mycobacterium
DEFLHYLRIREWQDLVGQLRGI

SEQ ID NO: 1313164 - protein, 21 aa, Mycobacterium
DEFQIVLVDTPGLHRPRTLLG

SEQ ID NO: 1313165 - protein, 20 aa, Mycobacterium
DEFTVPFEFPRALELRYQPE

SEQ ID NO: 1313166 - protein, 23 aa, Mycobacterium
DEGLYPVQHGYWLQTMRAALAHN

SEQ ID NO: 1313167 - protein, 18 aa, Mycobacterium
DEGRWEVRWSATGLHPRL

SEQ ID NO: 1313168 - protein, 24 aa, Mycobacterium
DEGSGLMGILASNGAFGPQFMPGA

SEQ ID NO: 1313169 - protein, 18 aa, Mycobacterium
DEHPNVVRFLMQGRFAEQ

SEQ ID NO: 1313170 - protein, 25 aa, Mycobacterium
DEHRRRIGELWAQFSAVAADNPHAW

SEQ ID NO: 1313171 - protein, 18 aa, Mycobacterium
DEIALRMDTLIAVGGFVE

SEQ ID NO: 1313172 - protein, 26 aa, Mycobacterium
DEIEELYYLHPLTGDIIRKVDSLRIF

SEQ ID NO: 1313173 - protein, 22 aa, Mycobacterium
DEILAFAMANAARLGLQDVIWR

SEQ ID NO: 1313174 - protein, 23 aa, Mycobacterium
DEIRWALDLLRKRFAKVIWVPGN

SEQ ID NO: 1313175 - protein, 21 aa, Mycobacterium
DEITMLCMPDLMTAYQRSAID

SEQ ID NO: 1313176 - protein, 23 aa, Mycobacterium
DEIVLRLFGKLVELAFLAVPDEI

SEQ ID NO: 1313177 - protein, 28 aa, Mycobacterium
DEIYTFMDLWFYHCNPRHHSVALTPMPG

SEQ ID NO: 1313178 - protein, 25 aa, Mycobacterium
DEKAAIYRWTWQAPTATAFVGVPTN

SEQ ID NO: 1313179 - protein, 17 aa, Mycobacterium
DEKGRRFLVQSARIAYV

SEQ ID NO: 1313180 - protein, 26 aa, Mycobacterium
DEKLVWKAQIFLSHRSWESTITEQVP

SEQ ID NO: 1313181 - protein, 21 aa, Mycobacterium
DEKMLARIAALLRQAEGTDNP

SEQ ID NO: 1313182 - protein, 29 aa, Mycobacterium
DELAAFCRPYLSRLWARLHGRDVWQEPCS

SEQ ID NO: 1313183 - protein, 17 aa, Mycobacterium
DELAALMRAIVVPSGPT

SEQ ID NO: 1313184 - protein, 31 aa, Mycobacterium
DELAALRRRQAVVVPLLLADAYHARVDIPEM

SEQ ID NO: 1313185 - protein, 29 aa, Mycobacterium
DELCTNSQDWWPADFGHYGPLFIRMSWHA

SEQ ID NO: 1313186 - protein, 21 aa, Mycobacterium
DELCVCDMAWVIGLSQGLVSH

SEQ ID NO: 1313187 - protein, 17 aa, Mycobacterium
DELGCVAVEFRTHYFNF

SEQ ID NO: 1313188 - protein, 31 aa, Mycobacterium
DELGIALPEVVAPLAAYVPAVRTGNLVYTAG

SEQ ID NO: 1313189 - protein, 27 aa, Mycobacterium
DELGSITFLPWGRMDDLYAAVVQCVEE

SEQ ID NO: 1313190 - protein, 30 aa, Mycobacterium
DELGYDSLLAPLTFISVFGYQAQRAMFEAN

SEQ ID NO: 1313191 - protein, 25 aa, Mycobacterium
DELHTAFQFDFLRTPWRAQMLREVI

SEQ ID NO: 1313192 - protein, 22 aa, Mycobacterium
DELIGFFKDPVKGFFRALDYTL

SEQ ID NO: 1313193 - protein, 22 aa, Mycobacterium
DELLRDGVLVDLYPLVRKSIRV

SEQ ID NO: 1313194 - protein, 33 aa, Mycobacterium
DELLTRIHILRQRPEWRRQLLADIVPVATVSTL

SEQ ID NO: 1313195 - protein, 23 aa, Mycobacterium
DELPMAFQPGVVASLFGGLVRSL

SEQ ID NO: 1313196 - protein, 17 aa, Mycobacterium
DELPRLPLGLRSLARFD

SEQ ID NO: 1313197 - protein, 17 aa, Mycobacterium
DELPYLDDQWRVAFDAA

SEQ ID NO: 1313198 - protein, 24 aa, Mycobacterium
DELRPAHPLFLDAIRDALGGPDLR

SEQ ID NO: 1313199 - protein, 31 aa, Mycobacterium
DELRRRGATRLVIAPWFLAHGRITDRVADFA

SEQ ID NO: 1313200 - protein, 26 aa, Mycobacterium
DELRTLADILALPPPEVDTAAVEAFQ

SEQ ID NO: 1313201 - protein, 19 aa, Mycobacterium
DELVAWMKDRHDGGTPVAV

SEQ ID NO: 1313202 - protein, 19 aa, Mycobacterium
DELVSRRLTYFLSSNVAGW

SEQ ID NO: 1313203 - protein, 26 aa, Mycobacterium
DELVTLVDWGMPPAAVLRAATVVAAD

SEQ ID NO: 1313204 - protein, 19 aa, Mycobacterium
DEMMPGVVSLPHGWGHGVP

SEQ ID NO: 1313205 - protein, 20 aa, Mycobacterium
DEMRGLLDALDTLASPDTGA

SEQ ID NO: 1313206 - protein, 28 aa, Mycobacterium
DEMRRRADAAGWLRYGLPSQFGGRDGSN

SEQ ID NO: 1313207 - protein, 22 aa, Mycobacterium
DENLHMIFYRDVSEAGFEIAPD

SEQ ID NO: 1313208 - protein, 21 aa, Mycobacterium
DENRLRWKPYLRAGSREDAEH

SEQ ID NO: 1313209 - protein, 18 aa, Mycobacterium
DEPIFDEIFEAFFSLVRV

SEQ ID NO: 1313210 - protein, 18 aa, Mycobacterium
DEPPGTRMRVALSALTMA

SEQ ID NO: 1313211 - protein, 24 aa, Mycobacterium
DEPPTLAAMLLAALESGIEPALIR

SEQ ID NO: 1313212 - protein, 37 aa, Mycobacterium
DEPSMTPLFQRFGTDLPPLGGIYLAAFGGGPVTLLDM

SEQ ID NO: 1313213 - protein, 19 aa, Mycobacterium
DEPWGWMQPTRHALGALLL

SEQ ID NO: 1313214 - protein, 23 aa, Mycobacterium
DEPYGNYNRILLSNVLAGVDDPT

SEQ ID NO: 1313215 - protein, 26 aa, Mycobacterium
DEQARARPIAPLLAGLQSLGVRIDGD

SEQ ID NO: 1313216 - protein, 27 aa, Mycobacterium
DEQARARPIAPLLDGLRALGVAIDGDG

SEQ ID NO: 1313217 - protein, 28 aa, Mycobacterium
DEQGQDVLLFIDNIFRFTQAGSEVSTLL

SEQ ID NO: 1313218 - protein, 24 aa, Mycobacterium
DEQKNYFLPRILTGEVFFCQGYSE

SEQ ID NO: 1313219 - protein, 23 aa, Mycobacterium
DEQYTYWRIALPHDEAATFDTAL

SEQ ID NO: 1313220 - protein, 22 aa, Mycobacterium
DERDRPLLELSWDYVMDGDEPS

SEQ ID NO: 1313221 - protein, 26 aa, Mycobacterium
DERETLLRRIGLAAAKYWVCKRATPH

SEQ ID NO: 1313222 - protein, 23 aa, Mycobacterium
DEREYVMYPPVLKSPYHERRATF

SEQ ID NO: 1313223 - protein, 20 aa, Mycobacterium
DERFSRSLTFGTAGLRGPLR

SEQ ID NO: 1313224 - protein, 21 aa, Mycobacterium
DERFSRSLTFGTAGLRGPLRA

SEQ ID NO: 1313225 - protein, 23 aa, Mycobacterium
DERLYLDAHPIPGHWLPNGCMAT

SEQ ID NO: 1313226 - protein, 25 aa, Mycobacterium
DERMRHGMFWSGDLAYRDADGWIYL

SEQ ID NO: 1313227 - protein, 24 aa, Mycobacterium
DERQHWWELAVAAYPPYAEYQTKT

SEQ ID NO: 1313228 - protein, 24 aa, Mycobacterium
DERQVLDLIFTVGCYQLLGAAVNT

SEQ ID NO: 1313229 - protein, 25 aa, Mycobacterium
DERRAFVTDISLIGGLIIAAVDTEG

SEQ ID NO: 1313230 - protein, 23 aa, Mycobacterium
DERRLALILEVAAAAGLIAPGMP

SEQ ID NO: 1313231 - protein, 21 aa, Mycobacterium
DERRLPVHPAHLSRIAPELRD

SEQ ID NO: 1313232 - protein, 20 aa, Mycobacterium
DERRRVFGVSYWTVSDEWAG

SEQ ID NO: 1313233 - protein, 21 aa, Mycobacterium
DERYWSARLGQFAGGTAAVES

SEQ ID NO: 1313234 - protein, 31 aa, Mycobacterium
DESELRAMFELNFFAVLSVLRAALPGMRARR

SEQ ID NO: 1313235 - protein, 22 aa, Mycobacterium
DESFARLRAGDGLSWHAPFPSL

SEQ ID NO: 1313236 - protein, 31 aa, Mycobacterium
DESLEDWKNWLRWRVIHARAFLLTDELIAED

SEQ ID NO: 1313237 - protein, 29 aa, Mycobacterium
DESTRRIRLMRWGLVPPWAKAGDDGSPDT

SEQ ID NO: 1313238 - protein, 24 aa, Mycobacterium
DESWDDLLLRRLRAAARSGRTPPR

SEQ ID NO: 1313239 - protein, 18 aa, Mycobacterium
DESYRRRFRKDYDARFGM

SEQ ID NO: 1313240 - protein, 20 aa, Mycobacterium
DETFLIPASDGLIHHIRARI

SEQ ID NO: 1313241 - protein, 24 aa, Mycobacterium
DETGMVNVLCSQGVWARHRKLAQT

SEQ ID NO: 1313242 - protein, 25 aa, Mycobacterium
DETKALYEWDYGKQLLYTQILREKI

SEQ ID NO: 1313243 - protein, 30 aa, Mycobacterium
DETLDRFLDIMLRAPFRLARDVIVHMQPGS

SEQ ID NO: 1313244 - protein, 23 aa, Mycobacterium
DETLSFPEILALAAEALRIKSET

SEQ ID NO: 1313245 - protein, 25 aa, Mycobacterium
DETPMLLQPGVLSLAWGSVVRQLAA

SEQ ID NO: 1313246 - protein, 30 aa, Mycobacterium
DETTYRGLARSVVYRWFTDPTSRSVYPAED

SEQ ID NO: 1313247 - protein, 24 aa, Mycobacterium
DETVRDFPPLFPTLEAEDPDVAVD

SEQ ID NO: 1313248 - protein, 21 aa, Mycobacterium
DEVADLPLHPGFAASWERLRE

SEQ ID NO: 1313249 - protein, 21 aa, Mycobacterium
DEVAHLARLARLALTDSELDS

SEQ ID NO: 1313250 - protein, 19 aa, Mycobacterium
DEVDPVRRLIGAAAAWGGN

SEQ ID NO: 1313251 - protein, 22 aa, Mycobacterium
DEVFAGYHWYPPMGEPAAASVE

SEQ ID NO: 1313252 - protein, 26 aa, Mycobacterium
DEVLFGWRSFEIYPLQVRTAGATPVQ

SEQ ID NO: 1313253 - protein, 31 aa, Mycobacterium
DEVRPDVPALQRVLFIGTDDWDRLRSRADVI

SEQ ID NO: 1313254 - protein, 25 aa, Mycobacterium
DEVRRRFRHFVIPGLAASDGGSGER

SEQ ID NO: 1313255 - protein, 32 aa, Mycobacterium
DEVRRYILECALRWMRDFHADGLRLDAVHALV

SEQ ID NO: 1313256 - protein, 26 aa, Mycobacterium
DEVSDMFYSIWWPKLPGETSDVPPPE

SEQ ID NO: 1313257 - protein, 24 aa, Mycobacterium
DEVVHLILDVMTAKLPYTAISRTM

SEQ ID NO: 1313258 - protein, 20 aa, Mycobacterium
DEWPRYTLHLGADIAAIIQT

SEQ ID NO: 1313259 - protein, 21 aa, Mycobacterium
DEYKQFLTEIGYLEPDPGDFT

SEQ ID NO: 1313260 - protein, 22 aa, Mycobacterium
DEYKQFLTEIGYLEPDPGDFTI

SEQ ID NO: 1313261 - protein, 30 aa, Mycobacterium
DEYRKLDEEFIWYGRIPRAKLAGYVADLES

SEQ ID NO: 1313262 - protein, 19 aa, Mycobacterium
DFADAWWDPLLAALKDDET

SEQ ID NO: 1313263 - protein, 19 aa, Mycobacterium
DFADFDRVMRVDLLGVMLG

SEQ ID NO: 1313264 - protein, 26 aa, Mycobacterium
DFADGRSFLLPPTWTQLDALNGRTVA

SEQ ID NO: 1313265 - protein, 25 aa, Mycobacterium
DFADLAVRLGWYDQAHFINDFRAML

SEQ ID NO: 1313266 - protein, 24 aa, Mycobacterium
DFANYRKRALRDQQLMADRAKATV

SEQ ID NO: 1313267 - protein, 18 aa, Mycobacterium
DFAQVMRKLWHGELIFNH

SEQ ID NO: 1313268 - protein, 23 aa, Mycobacterium
DFAYLAAQYRRGYAAALPDYTSA

SEQ ID NO: 1313269 - protein, 17 aa, Mycobacterium
DFDAAIATPDQMAKVGR

SEQ ID NO: 1313270 - protein, 24 aa, Mycobacterium
DFDGGPFFQRCNPAFCAMTGYTEE

SEQ ID NO: 1313271 - protein, 22 aa, Mycobacterium
DFDGWARWVDVGGVLVIHDVFP

SEQ ID NO: 1313272 - protein, 27 aa, Mycobacterium
DFDHLPEQAFFLIGGLDDLAKKAESLG

SEQ ID NO: 1313273 - protein, 27 aa, Mycobacterium
DFDHLPEQAFFLIGGLEDLQRKAESMG

SEQ ID NO: 1313274 - protein, 20 aa, Mycobacterium
DFEEHFLLRRVALGECHRPY

SEQ ID NO: 1313275 - protein, 26 aa, Mycobacterium
DFEQVLRINLIGTFLVTREAVTALHQ

SEQ ID NO: 1313276 - protein, 18 aa, Mycobacterium
DFESLMLRHTTFTPKHMG

SEQ ID NO: 1313277 - protein, 29 aa, Mycobacterium
DFEVSSDHYFPWLASQGHAPYAWSVLGAV

SEQ ID NO: 1313278 - protein, 19 aa, Mycobacterium
DFFEARGLPFLVAVNEFDG

SEQ ID NO: 1313279 - protein, 22 aa, Mycobacterium
DFGARYTVLLASPTGGAVGTTA

SEQ ID NO: 1313280 - protein, 25 aa, Mycobacterium
DFGLKQQLLYRILPRGNFTARCTHD

SEQ ID NO: 1313281 - protein, 24 aa, Mycobacterium
DFGPGDRLCIPVPFYHCFGMVMGN

SEQ ID NO: 1313282 - protein, 26 aa, Mycobacterium
DFGQIDVHMLQYSGAIWYPMVYDMPA

SEQ ID NO: 1313283 - protein, 21 aa, Mycobacterium
DFGSFLIPRTEYRIDDVWNVV

SEQ ID NO: 1313284 - protein, 29 aa, Mycobacterium
DFGVEPPVALLLQGATLADLALDLIRQLG

SEQ ID NO: 1313285 - protein, 17 aa, Mycobacterium
DFILHVAARDTEDLRAF

SEQ ID NO: 1313286 - protein, 23 aa, Mycobacterium
DFLALPRHALADAALTAAVQAGA

SEQ ID NO: 1313287 - protein, 17 aa, Mycobacterium
DFLDFVRRERLFATFLT

SEQ ID NO: 1313288 - protein, 17 aa, Mycobacterium
DFLHDRWLVLRRGKRNI

SEQ ID NO: 1313289 - protein, 20 aa, Mycobacterium
DFLPGLRELCDATGALLIVD

SEQ ID NO: 1313290 - protein, 18 aa, Mycobacterium
DFLRSDRAEFGWEPAVDS

SEQ ID NO: 1313291 - protein, 17 aa, Mycobacterium
DFLVERARTCLLYSEPG

SEQ ID NO: 1313292 - protein, 19 aa, Mycobacterium
DFLVLPELIERFGDLGFDV

SEQ ID NO: 1313293 - protein, 28 aa, Mycobacterium
DFMADHVFSRIDIPGWLARTGFQMLDPV

SEQ ID NO: 1313294 - protein, 19 aa, Mycobacterium
DFMPAVGIVARPFNRRLLA

SEQ ID NO: 1313295 - protein, 29 aa, Mycobacterium
DFNALNITLPMPRGWAYIPDPNVPEAFAV

SEQ ID NO: 1313296 - protein, 25 aa, Mycobacterium
DFPLDGVVPGFQKAIAGQKVGSTVA

SEQ ID NO: 1313297 - protein, 30 aa, Mycobacterium; identical to SEQ ID NO: 783976

SEQ ID NO: 1313298 - protein, 24 aa, Mycobacterium
DFQPRQGMFVQLAALGKLPFYVKG

SEQ ID NO: 1313299 - protein, 28 aa, Mycobacterium
DFQVVSIPTMILFKDGKPVKRIVGAKGK

SEQ ID NO: 1313300 - protein, 25 aa, Mycobacterium
DFRHTFDWCVTSAFIMSQLAAPHML

SEQ ID NO: 1313301 - protein, 21 aa, Mycobacterium
DFSEIPRALGVPYTYWGVGCV

SEQ ID NO: 1313302 - protein, 22 aa, Mycobacterium
DFSGPFPVEVITRMAGVPEAFR

SEQ ID NO: 1313303 - protein, 27 aa, Mycobacterium
DFSQRAWDPVIGPFFEGGLMLLDFDEH

SEQ ID NO: 1313304 - protein, 29 aa, Mycobacterium
DFTDELRILRLHLLHLLQTVSLNTADLDA

SEQ ID NO: 1313305 - protein, 25 aa, Mycobacterium
DFTGLDDWTIWWGANLGAPGERLVT

SEQ ID NO: 1313306 - protein, 18 aa, Mycobacterium
DFTLLVKVPGQPAAIKAF

SEQ ID NO: 1313307 - protein, 24 aa, Mycobacterium
DFTTGADVIMFWSAAPPGEMERRR

SEQ ID NO: 1313308 - protein, 21 aa, Mycobacterium
DFVAAMRRKALGADTVDVVAD

SEQ ID NO: 1313309 - protein, 24 aa, Mycobacterium
DFVFSGFGSIPRYDNAFALSNFNS

SEQ ID NO: 1313310 - protein, 21 aa, Mycobacterium
DFVYRAFAPALHEAGAIVVTP

SEQ ID NO: 1313311 - protein, 22 aa, Mycobacterium
DFVYTTYIRTTPERLWQAVTDP

SEQ ID NO: 1313312 - protein, 20 aa, Mycobacterium
DFWVPRGYVHVIANLRGTGG

SEQ ID NO: 1313313 - protein, 17 aa, Mycobacterium
DFYTDLGLAKLISPLRL

SEQ ID NO: 1313314 - protein, 24 aa, Mycobacterium
DGAAQLAADLGLPPGTPGADGKVA

SEQ ID NO: 1313315 - protein, 32 aa, Mycobacterium
DGAAVIRHLSAPLYYQFLTTTTPLSTRDADRA

SEQ ID NO: 1313316 - protein, 29 aa, Mycobacterium
DGADLTILTFGNGLWMSLRVARRLERLHI

SEQ ID NO: 1313317 - protein, 32 aa, Mycobacterium
DGADRPIQWWRSDGWLCPYGPLAVGAAALPGT

SEQ ID NO: 1313318 - protein, 20 aa, Mycobacterium
DGAFATLRREAPISFHEAYV

SEQ ID NO: 1313319 - protein, 17 aa, Mycobacterium
DGAFFIVSVEMLAAGPG

SEQ ID NO: 1313320 - protein, 19 aa, Mycobacterium
DGAIQWLRDGARLLIHAVD

SEQ ID NO: 1313321 - protein, 27 aa, Mycobacterium
DGAIVAPRPLQQAGIPLWIAGGGEKVT

SEQ ID NO: 1313322 - protein, 32 aa, Mycobacterium
DGALDVDVVLSPFFNTLPIRRAGLHEHSESIT

SEQ ID NO: 1313323 - protein, 17 aa, Mycobacterium
DGALGPSSTWLVAGLDA

SEQ ID NO: 1313324 - protein, 22 aa, Mycobacterium
DGALRIITLNRPDDLNAVNDNL

SEQ ID NO: 1313325 - protein, 26 aa, Mycobacterium
DGALRRSVKFPAFLDGIEAVRRVAER

SEQ ID NO: 1313326 - protein, 22 aa, Mycobacterium
DGAPAWLRFLGVNPRHHSLAFM

SEQ ID NO: 1313327 - protein, 26 aa, Mycobacterium
DGAPNQELLWAWVQTEMLRLHVRRRL

SEQ ID NO: 1313328 - protein, 23 aa, Mycobacterium
DGAPRVLGAGPLAFTCVREFDTW

SEQ ID NO: 1313329 - protein, 23 aa, Mycobacterium
DGAPYLRYFNHKMKRDALVPIDP

SEQ ID NO: 1313330 - protein, 24 aa, Mycobacterium
DGARRRAHFFSRNAEVPLSVVGVG

SEQ ID NO: 1313331 - protein, 20 aa, Mycobacterium
DGARRRTFALLQVQEGLSKL

SEQ ID NO: 1313332 - protein, 19 aa, Mycobacterium
DGASWRRLLGPLADDCDGV

SEQ ID NO: 1313333 - protein, 22 aa, Mycobacterium
DGATLLIGGFGLAGMPFDLIDA

SEQ ID NO: 1313334 - protein, 23 aa, Mycobacterium
DGATQLYRAYLAYGLNQHDFAHK

SEQ ID NO: 1313335 - protein, 23 aa, Mycobacterium
DGAVARRWRSAAPLWGDASFASV

SEQ ID NO: 1313336 - protein, 17 aa, Mycobacterium
DGAWWPHSAAMAMELPD

SEQ ID NO: 1313337 - protein, 25 aa, Mycobacterium
DGCVATTHWAYAPQLAAEFPSVTVD

SEQ ID NO: 1313338 - protein, 19 aa, Mycobacterium
DGCVGQSFIRSYAILTHET

SEQ ID NO: 1313339 - protein, 24 aa, Mycobacterium
DGDDWVINGWKFFSSNAATASFLI

SEQ ID NO: 1313340 - protein, 28 aa, Mycobacterium
DGDFGTVLNRFLMQAAIGYPLTVHGTGG

SEQ ID NO: 1313341 - protein, 20 aa, Mycobacterium
DGDGRWDVRLADGDGDGAAD

SEQ ID NO: 1313342 - protein, 27 aa, Mycobacterium
DGDNAVLLFTYYTGDDLSYQPWIGPGR

SEQ ID NO: 1313343 - protein, 30 aa, Mycobacterium
DGDPCQLCRWWWRQGRVWPKAHPFQRHKGC

SEQ ID NO: 1313344 - protein, 24 aa, Mycobacterium
DGDRGVQLPPWPSAGEAFMELVEA

SEQ ID NO: 1313345 - protein, 38 aa, Mycobacterium
DGDSVGRLAYLLGEVGGNIPIVALFVRNGSAEDPNAGL

SEQ ID NO: 1313346 - protein, 28 aa, Mycobacterium
DGDTVVVWKLDRLGRNMLHILQTVKELA

SEQ ID NO: 1313347 - protein, 23 aa, Mycobacterium
DGEAVWLGVIPQDAPSGGDPLQA

SEQ ID NO: 1313348 - protein, 26 aa, Mycobacterium
DGEDLSWLWDVRFEHFESVPVVAAGE

SEQ ID NO: 1313349 - protein, 29 aa, Mycobacterium
DGEFVKFGPSWAWPKPVQAHIPVLVGAAG

SEQ ID NO: 1313350 - protein, 26 aa, Mycobacterium
DGEPVAGLTWLPFMSQRYTAVVGKPL

SEQ ID NO: 1313351 - protein, 19 aa, Mycobacterium
DGERLTLHPTQLVLATGMS

SEQ ID NO: 1313352 - protein, 25 aa, Mycobacterium
DGETERILFTHLAVPVMTRLRQPER

SEQ ID NO: 1313353 - protein, 18 aa, Mycobacterium
DGEVAGCRRGGGVGREGR

SEQ ID NO: 1313354 - protein, 18 aa, Mycobacterium
DGEWFNGNMFGGAPLDGP

SEQ ID NO: 1313355 - protein, 20 aa, Mycobacterium
DGFCGWPTALHLSDAGHDVL

SEQ ID NO: 1313356 - protein, 21 aa, Mycobacterium
DGFRALVFRDGGPGRDNVVLL

SEQ ID NO: 1313357 - protein, 18 aa, Mycobacterium
DGFSHLYERAVLLERLRA

SEQ ID NO: 1313358 - protein, 26 aa, Mycobacterium
DGFTQPAPPYRMSPATLRPPTPAPRL

SEQ ID NO: 1313359 - protein, 20 aa, Mycobacterium
DGFVQSKPFRKMGIHSSRTG

SEQ ID NO: 1313360 - protein, 31 aa, Mycobacterium
DGFVTKDRWSMEWYYPVLGGALRGPRARARI

SEQ ID NO: 1313361 - protein, 17 aa, Mycobacterium
DGGALVLPPGTLRGLGV

SEQ ID NO: 1313362 - protein, 24 aa, Mycobacterium
DGGATVIFQWTYSQAKPRDVIWNQ

SEQ ID NO: 1313363 - protein, 24 aa, Mycobacterium
DGGFGYDPVFLPTGSARTAAELSP

SEQ ID NO: 1313364 - protein, 30 aa, Mycobacterium
DGGGFFFVVELLDAASFWESVRSGMLESLG

SEQ ID NO: 1313365 - protein, 31 aa, Mycobacterium
DGGILERFVGAYIPLLGITFNGSTPTFSPQP

SEQ ID NO: 1313366 - protein, 28 aa, Mycobacterium
DGGLFNGILARYLALVATALPGGSPADD

SEQ ID NO: 1313367 - protein, 17 aa, Mycobacterium
DGGLVVPPDGFLARLHE

SEQ ID NO: 1313368 - protein, 23 aa, Mycobacterium
DGGNAGLIGFGGAGGAGGDHMTS

SEQ ID NO: 1313369 - protein, 35 aa, Mycobacterium
DGGPHRRLPLPTYPFQHRSYWPKTAGIRSDGSSGS

SEQ ID NO: 1313370 - protein, 23 aa, Mycobacterium
DGGRLMELPLDGGAPRILLENLP

SEQ ID NO: 1313371 - protein, 18 aa, Mycobacterium
DGGRTVARIFEALAAMLA

SEQ ID NO: 1313372 - protein, 24 aa, Mycobacterium
DGGSRLRGRWPRGHALYGDGGRRR

SEQ ID NO: 1313373 - protein, 19 aa, Mycobacterium
DGHEWGLEYLWGVLSVADD

SEQ ID NO: 1313374 - protein, 21 aa, Mycobacterium
DGHGYPVHKPVSAGWQGYDDH

SEQ ID NO: 1313375 - protein, 26 aa, Mycobacterium
DGHPATAMYLLALPRNELLGARDVSD

SEQ ID NO: 1313376 - protein, 22 aa, Mycobacterium
DGHPHTVQLTELPWSHTETTTL

SEQ ID NO: 1313377 - protein, 22 aa, Mycobacterium
DGHPLLGLRMPDLDLETAHGPT

SEQ ID NO: 1313378 - protein, 34 aa, Mycobacterium
DGHRAVAPVYLYRFDFHTPLLRLVRLHAAHATEL

SEQ ID NO: 1313379 - protein, 26 aa, Mycobacterium
DGIGTRYVMLVLRVLVDPTDPADLAT

SEQ ID NO: 1313380 - protein, 24 aa, Mycobacterium
DGIHQAMEFLPWANRFAAGDLKNE

SEQ ID NO: 1313381 - protein, 25 aa, Mycobacterium
DGIHQAMEYLPWANRVQLGDPVVDA

SEQ ID NO: 1313382 - protein, 20 aa, Mycobacterium
DGIVVVDYPASFWPFSDGYF

SEQ ID NO: 1313383 - protein, 24 aa, Mycobacterium
DGKCEFLAAYAKPFSLLVVADLLG

SEQ ID NO: 1313384 - protein, 30 aa, Mycobacterium
DGKDKLWAPELRFPYLGLAKTFIAGNVMHM

SEQ ID NO: 1313385 - protein, 23 aa, Mycobacterium
DGKKLVFVSILRAGTGILEGLLE

SEQ ID NO: 1313386 - protein, 17 aa, Mycobacterium
DGKLYIAGIRPGAFEDA

SEQ ID NO: 1313387 - protein, 22 aa, Mycobacterium
DGKWRCTPMRPATLTSLTAAET

SEQ ID NO: 1313388 - protein, 27 aa, Mycobacterium
DGLADFPDRWWNLTAVANALAGAAVRH

SEQ ID NO: 1313389 - protein, 17 aa, Mycobacterium
DGLALAAALRRATAVQS

SEQ ID NO: 1313390 - protein, 23 aa, Mycobacterium
DGLALVTYFEAEPTFDPAAHTFS

SEQ ID NO: 1313391 - protein, 27 aa, Mycobacterium
DGLESFLRTAWPLVLARMPDAHLTVIG

SEQ ID NO: 1313392 - protein, 18 aa, Mycobacterium
DGLIKRIAKPHQYFAVTK

SEQ ID NO: 1313393 - protein, 17 aa, Mycobacterium
DGLIRLVDACHARGLGV

SEQ ID NO: 1313394 - protein, 22 aa, Mycobacterium
DGLLMAPTYAVPRLLARNGLTL

SEQ ID NO: 1313395 - protein, 20 aa, Mycobacterium
DGLLRRRPSGFFPAPGLDPH

SEQ ID NO: 1313396 - protein, 23 aa, Mycobacterium
DGLMMNFDLVPMLTKAEVERSLL

SEQ ID NO: 1313397 - protein, 25 aa, Mycobacterium
DGLQIEDPIPLSAKLELLAAIAATG

SEQ ID NO: 1313398 - protein, 22 aa, Mycobacterium
DGLRLFYDFHEKHRRQVDGFAK

SEQ ID NO: 1313399 - protein, 26 aa, Mycobacterium
DGLRVDVLTLFSYPLHPPGKPERART

SEQ ID NO: 1313400 - protein, 36 aa, Mycobacterium
DGLSDPAGYLAWLRKLTGPQAWIVIEKILAVDEALD

SEQ ID NO: 1313401 - protein, 17 aa, Mycobacterium
DGLSYFAEFRSQSCIAA

SEQ ID NO: 1313402 - protein, 18 aa, Mycobacterium
DGLTYRDAARLGRRLRNA

SEQ ID NO: 1313403 - protein, 19 aa, Mycobacterium
DGMSRVSGWLTPEARGHWD

SEQ ID NO: 1313404 - protein, 23 aa, Mycobacterium
DGNEDIALMTLVGRPRPVNPRRE

SEQ ID NO: 1313405 - protein, 23 aa, Mycobacterium
DGNEIMRILDIPPGPQVGQAWNH

SEQ ID NO: 1313406 - protein, 22 aa, Mycobacterium
DGNIFHGALSWPFVEDDEPLAT

SEQ ID NO: 1313407 - protein, 25 aa, Mycobacterium
DGNLTLVPLSLYFTGGKVKVELALA

SEQ ID NO: 1313408 - protein, 23 aa, Mycobacterium
DGNPNDFLYVPPGGIHGFRNDSD

SEQ ID NO: 1313409 - protein, 29 aa, Mycobacterium
DGNRIFTWHLAIAMRPKLWMFNSVGNLGH

SEQ ID NO: 1313410 - protein, 20 aa, Mycobacterium
DGNWWEIVAVRENGYAADFA

SEQ ID NO: 1313411 - protein, 27 aa, Mycobacterium
DGPAHPADLWRAAADLGWHGLAVAEQF

SEQ ID NO: 1313412 - protein, 27 aa, Mycobacterium
DGPDLTKLDLIPADGIMLLAAHISRHG

SEQ ID NO: 1313413 - protein, 24 aa, Mycobacterium
DGPIDALFVQLPKAIAAALAALSE

SEQ ID NO: 1313414 - protein, 23 aa, Mycobacterium
DGPPPPGYFDPPPPPAPGPPPAP

SEQ ID NO: 1313415 - protein, 24 aa, Mycobacterium
DGPRVILLGIPTRGVTLATRLARN

SEQ ID NO: 1313416 - protein, 17 aa, Mycobacterium
DGPSTLWGITYVVGDID

SEQ ID NO: 1313417 - protein, 30 aa, Mycobacterium
DGPTQARPIINRPSWLPNSVTLIPTAGVSL

SEQ ID NO: 1313418 - protein, 24 aa, Mycobacterium
DGPVRVRAVMTDLLRSAVGPGADE

SEQ ID NO: 1313419 - protein, 24 aa, Mycobacterium
DGQDFIVDLTVWMELAAAAASDDL

SEQ ID NO: 1313420 - protein, 25 aa, Mycobacterium
DGQVQWNMQLLSHVLDHGLDPAEAV

SEQ ID NO: 1313421 - protein, 17 aa, Mycobacterium
DGRAGLLDWQAVRRGHP

SEQ ID NO: 1313422 - protein, 25 aa, Mycobacterium
DGRAQVITLALVLGALEARTGKDAW

SEQ ID NO: 1313423 - protein, 26 aa, Mycobacterium
DGRARAMLYGAYRSGAPFGGRVTELV

SEQ ID NO: 1313424 - protein, 30 aa, Mycobacterium
DGRESVLPDEFFTDPLPTLAAGALSGLESK

SEQ ID NO: 1313425 - protein, 17 aa, Mycobacterium
DGRLLERIARFHTTSLA

SEQ ID NO: 1313426 - protein, 17 aa, Mycobacterium
DGRLLICDSPRGLLALD

SEQ ID NO: 1313427 - protein, 17 aa, Mycobacterium
DGRLRHLPGGIDEYLRL

SEQ ID NO: 1313428 - protein, 20 aa, Mycobacterium
DGRLSLVDGLFLDIIKKAES

SEQ ID NO: 1313429 - protein, 21 aa, Mycobacterium
DGRLSLVDGLFLDIIKKAESN

SEQ ID NO: 1313430 - protein, 27 aa, Mycobacterium
DGRPDIALINWPITAPGLVDLATLTIL

SEQ ID NO: 1313431 - protein, 29 aa, Mycobacterium
DGRPGQQFALLFVAWLNANPAVRAEYLDV

SEQ ID NO: 1313432 - protein, 21 aa, Mycobacterium
DGRPLAIWTPSGEAADLEPLK

SEQ ID NO: 1313433 - protein, 22 aa, Mycobacterium
DGRPLIVFHAIYVSAGPDLLDP

SEQ ID NO: 1313434 - protein, 19 aa, Mycobacterium
DGRPWSYRQRICSAPPDSL

SEQ ID NO: 1313435 - protein, 20 aa, Mycobacterium
DGRRRRVRLCANRSRPSAHE

SEQ ID NO: 1313436 - protein, 23 aa, Mycobacterium
DGRTELEFIIRLLPDGVMSNYLR

SEQ ID NO: 1313437 - protein, 22 aa, Mycobacterium
DGRTFLVVQGFQSWVEAFEMQR

SEQ ID NO: 1313438 - protein, 18 aa, Mycobacterium
DGRVRVVPAWQIDRGFDA

SEQ ID NO: 1313439 - protein, 17 aa, Mycobacterium
DGSAVCLLGNYYTMHFA

SEQ ID NO: 1313440 - protein, 21 aa, Mycobacterium
DGSFLIQVQMPDVSNIEPNSR

SEQ ID NO: 1313441 - protein, 18 aa, Mycobacterium
DGSLLIVSTERRQILGYD

SEQ ID NO: 1313442 - protein, 20 aa, Mycobacterium
DGSPLRDLAGWPALLRGKRS

SEQ ID NO: 1313443 - protein, 33 aa, Mycobacterium
DGSPLVYNRRDPLLPDLIVCRPELAEAVLAVTA

SEQ ID NO: 1313444 - protein, 24 aa, Mycobacterium
DGSSKFRFLVTPVRIVCANTQSAA

SEQ ID NO: 1313445 - protein, 28 aa, Mycobacterium
DGSSVLAQMMWAFRAMGMWSDERGVNML

SEQ ID NO: 1313446 - protein, 28 aa, Mycobacterium
DGSSVLSMMMWAFRGMGMWSDERGTNML

SEQ ID NO: 1313447 - protein, 27 aa, Mycobacterium
DGSTLAARLRPVIERLALATGETVDLS

SEQ ID NO: 1313448 - protein, 19 aa, Mycobacterium
DGSWGPWYEAEPLEGVGAD

SEQ ID NO: 1313449 - protein, 18 aa, Mycobacterium
DGTCWSEFTLGPAYEGPP

SEQ ID NO: 1313450 - protein, 29 aa, Mycobacterium
DGTFHKMEFANWDAVLKVHLYGGYNVIRA

SEQ ID NO: 1313451 - protein, 19 aa, Mycobacterium
DGTGYVQVLYRLDGRQTSM

SEQ ID NO: 1313452 - protein, 25 aa, Mycobacterium
DGTIKIEMNFLPDVYVPCEVCQGAR

SEQ ID NO: 1313453 - protein, 23 aa, Mycobacterium
DGTNRMVVYLGGTNPRNWLVGEQ

SEQ ID NO: 1313454 - protein, 27 aa, Mycobacterium
DGTNVRAWLLRIMTNTWIKSYRRAQCR

SEQ ID NO: 1313455 - protein, 26 aa, Mycobacterium
DGTPFPTLFYLTHPALTAAASRLESS

SEQ ID NO: 1313456 - protein, 24 aa, Mycobacterium
DGTPVIPMTLLGTFSPYMVVHKSS

SEQ ID NO: 1313457 - protein, 28 aa, Mycobacterium
DGTPYKVFTPFFAAWRTHGWRPPAGSGP

SEQ ID NO: 1313458 - protein, 23 aa, Mycobacterium
DGTSLYSTHRWAPNTAICSSSEY

SEQ ID NO: 1313459 - protein, 25 aa, Mycobacterium
DGVDDTYYGLLTPAIEAPVVDQLTG

SEQ ID NO: 1313460 - protein, 24 aa, Mycobacterium
DGVGRLILDFYRCAMLPLSDDTAQ

SEQ ID NO: 1313461 - protein, 28 aa, Mycobacterium
DGVINIGGPDKISFADLARAVLARRGAD

SEQ ID NO: 1313462 - protein, 17 aa, Mycobacterium
DGVIWGHGWDETRWPER

SEQ ID NO: 1313463 - protein, 28 aa, Mycobacterium
DGVLEGTALVRLLQFLPGGTVSESGYLT

SEQ ID NO: 1313464 - protein, 29 aa, Mycobacterium
DGVLQTVGMLFSPGYPGFLRGVTAVGAAE

SEQ ID NO: 1313465 - protein, 26 aa, Mycobacterium
DGVLRELFSLLRPGGELRYLEHIAET

SEQ ID NO: 1313466 - protein, 22 aa, Mycobacterium
DGVPRTLRLDQLIRLYVNHQLD

SEQ ID NO: 1313467 - protein, 31 aa, Mycobacterium
DGVRGRPYPDLILTALLRTGADRVQAVAALG

SEQ ID NO: 1313468 - protein, 26 aa, Mycobacterium
DGVVLVTVTYRLGIAGFLDIAGAPRN

SEQ ID NO: 1313469 - protein, 27 aa, Mycobacterium
DGVVLVTVTYRLGIAGFLDIAGAPRNR

SEQ ID NO: 1313470 - protein, 26 aa, Mycobacterium
DGVVRPVMFMAYSGEARWRDSAGEEH

SEQ ID NO: 1313471 - protein, 17 aa, Mycobacterium
DGWRQAYPSRLAALAQA

SEQ ID NO: 1313472 - protein, 22 aa, Mycobacterium
DGWVKLVGDWIDRSIGDLAPLW

SEQ ID NO: 1313473 - protein, 18 aa, Mycobacterium
DGWWRDRHRAMVTLVESL

SEQ ID NO: 1313474 - protein, 30 aa, Mycobacterium
DGYFLTARDIAWFMDLYLEGASVDRTDPDV

SEQ ID NO: 1313475 - protein, 24 aa, Mycobacterium
DGYLALFITHDGFWAAFAAEAGIE

SEQ ID NO: 1313476 - protein, 17 aa, Mycobacterium
DGYLFVMGRIDDVINVA

SEQ ID NO: 1313477 - protein, 28 aa, Mycobacterium
DGYPQPQGAFWLPRRLGGGAPTPEEARR

SEQ ID NO: 1313478 - protein, 17 aa, Mycobacterium
DGYVPNVVYSCGALVHA

SEQ ID NO: 1313479 - protein, 20 aa, Mycobacterium
DGYVYVYGTPNGRQGAAYVA

SEQ ID NO: 1313480 - protein, 31 aa, Mycobacterium
DHAGALLELNRLFMAWVETEYHRRIHTETGQ

SEQ ID NO: 1313481 - protein, 20 aa, Mycobacterium
DHAKWRQVLAEYFSPGRVKG

SEQ ID NO: 1313482 - protein, 28 aa, Mycobacterium
DHEISIVLARLLFLMFGDDTEMWQDQQG

SEQ ID NO: 1313483 - protein, 18 aa, Mycobacterium
DHELFAEGLELLLRRDWG

SEQ ID NO: 1313484 - protein, 26 aa, Mycobacterium
DHETGDEFPLLPGTMYLLDGHERHRV

SEQ ID NO: 1313485 - protein, 18 aa, Mycobacterium
DHGLVAWPKTSGSRGFHI

SEQ ID NO: 1313486 - protein, 26 aa, Mycobacterium
DHGSPLLVSVFLDKDFRFVVSSEADA

SEQ ID NO: 1313487 - protein, 25 aa, Mycobacterium
DHHREFLEDALWPGAPHAVACHRLQ

SEQ ID NO: 1313488 - protein, 18 aa, Mycobacterium
DHIRYSFAMASRAAAMSA

SEQ ID NO: 1313489 - protein, 21 aa, Mycobacterium
DHISGGRLILGLGAGWYEKDY

SEQ ID NO: 1313490 - protein, 24 aa, Mycobacterium
DHKIPAAHRLFFTATPKVHARGSS

SEQ ID NO: 1313491 - protein, 26 aa, Mycobacterium
DHKSLRYFFESALSPNTFWVDLKNLD

SEQ ID NO: 1313492 - protein, 21 aa, Mycobacterium
DHLARHFKVSALAAAVRLRRL

SEQ ID NO: 1313493 - protein, 39 aa, Mycobacterium
DHLHAVVGEWQLLADLSFADYLMWVRRDDGMLVCVAQVR

SEQ ID NO: 1313494 - protein, 18 aa, Mycobacterium
DHLLSGLATLLVGGRREG

SEQ ID NO: 1313495 - protein, 19 aa, Mycobacterium
DHLRQLRRLPRLVNDTAAG

SEQ ID NO: 1313496 - protein, 18 aa, Mycobacterium
DHLVLGSSVPWLMPPALS

SEQ ID NO: 1313497 - protein, 19 aa, Mycobacterium
DHMSPPTPFITFRVWHPLS

SEQ ID NO: 1313498 - protein, 21 aa, Mycobacterium
DHMSPPTPFITFRVWHPLSHD

SEQ ID NO: 1313499 - protein, 24 aa, Mycobacterium
DHPQRTRVTLRRRRRQHRGDDIGS

SEQ ID NO: 1313500 - protein, 20 aa, Mycobacterium
DHPTLLTGTKWLDTARREGV

SEQ ID NO: 1313501 - protein, 19 aa, Mycobacterium
DHRAFLAVGLPVGASWPNW

SEQ ID NO: 1313502 - protein, 22 aa, Mycobacterium
DHREFLAACLPVGEGWPNWREA

SEQ ID NO: 1313503 - protein, 26 aa, Mycobacterium
DHRSVMHFEWTDDPRWLIYLQDTNGD

SEQ ID NO: 1313504 - protein, 24 aa, Mycobacterium
DHSDRWRPWRSYATQHLWTALDHS

SEQ ID NO: 1313505 - protein, 24 aa, Mycobacterium
DHSGPLVTELLGEAGFVVDGVVVV

SEQ ID NO: 1313506 - protein, 24 aa, Mycobacterium
DHSIGFPTIRGLAPYMDGNIGIIH

SEQ ID NO: 1313507 - protein, 36 aa, Mycobacterium
DHSMVMPLSFHLGYHGLPFPGVLPGFGHVGLGGSLG

SEQ ID NO: 1313508 - protein, 28 aa, Mycobacterium
DHSRRLWTVLIFMLWHAIFVEGSVTPRI

SEQ ID NO: 1313509 - protein, 28 aa, Mycobacterium
DHTSGRIERFLLLWAEGSMTIAMPSTPA

SEQ ID NO: 1313510 - protein, 21 aa, Mycobacterium
DHVLHICALAYMSDLTLLGSA

SEQ ID NO: 1313511 - protein, 30 aa, Mycobacterium
DHVPALLRSCGRPYPWVQIRIVDETGADAV

SEQ ID NO: 1313512 - protein, 19 aa, Mycobacterium
DHWLALEDVVAATGAPTAA

SEQ ID NO: 1313513 - protein, 22 aa, Mycobacterium
DHWSVRWVALHLIEELTRHAGH

SEQ ID NO: 1313514 - protein, 18 aa, Mycobacterium
DIAAGGTGGWWGTSNVPQ

SEQ ID NO: 1313515 - protein, 41 aa, Mycobacterium
DIAHLRRRVMVVLPFLTPTIASLWVGLVTPIPSGLARPLVE

SEQ ID NO: 1313516 - protein, 17 aa, Mycobacterium
DIAKLFDGVDVHLALPV

SEQ ID NO: 1313517 - protein, 19 aa, Mycobacterium
DIALRFLVTMLCAPGQPML

SEQ ID NO: 1313518 - protein, 25 aa, Mycobacterium
DIAMVFQNYALYPHLTVAENIAFPL

SEQ ID NO: 1313519 - protein, 20 aa, Mycobacterium
DIANAIRFLLSDEASFITAT

SEQ ID NO: 1313520 - protein, 21 aa, Mycobacterium
DIATGATLAVGGFGLCGIPDA

SEQ ID NO: 1313521 - protein, 26 aa, Mycobacterium
DIDDLEFALRLGVDLVALSFVRSPAD

SEQ ID NO: 1313522 - protein, 24 aa, Mycobacterium
DIDDLKAPLLAAVGAADLALERVN

SEQ ID NO: 1313523 - protein, 29 aa, Mycobacterium
DIDEIQAQAILDMQLRRLAALERQRIIDD

SEQ ID NO: 1313524 - protein, 22 aa, Mycobacterium
DIDGVLVTSWKPIPGAAETLRT

SEQ ID NO: 1313525 - protein, 30 aa, Mycobacterium
DIDHFTVLELLFAPINMRALYTGEPIDDRY

SEQ ID NO: 1313526 - protein, 21 aa, Mycobacterium
DIDPAWFDGVTTVGVTSGASV

SEQ ID NO: 1313527 - protein, 21 aa, Mycobacterium
DIDPRRLMVSIGLALGSTEEI

SEQ ID NO: 1313528 - protein, 24 aa, Mycobacterium
DIDRGGVFAAFFGTVALLSPEDQA

SEQ ID NO: 1313529 - protein, 20 aa, Mycobacterium
DIDSPLVWVLDPIDGTFNYA

SEQ ID NO: 1313530 - protein, 25 aa, Mycobacterium
DIDTHGFAILDRLRAWLPETRSVLM

SEQ ID NO: 1313531 - protein, 22 aa, Mycobacterium
DIEAQLRFLAGQGVDLIITSGG

SEQ ID NO: 1313532 - protein, 23 aa, Mycobacterium
DIEKLPIDSAEFSKALIHLQAAV

SEQ ID NO: 1313533 - protein, 19 aa, Mycobacterium
DIELLREAWLTATRARNAL

SEQ ID NO: 1313534 - protein, 21 aa, Mycobacterium
DIELSASYRPLINPLRAAGVP

SEQ ID NO: 1313535 - protein, 18 aa, Mycobacterium
DIEPMEPELPYYSATLYD

SEQ ID NO: 1313536 - protein, 17 aa, Mycobacterium
DIESIFVRPLPHQFSAL

SEQ ID NO: 1313537 - protein, 20 aa, Mycobacterium
DIESTWKGLLAGESGIRILE

SEQ ID NO: 1313538 - protein, 20 aa, Mycobacterium
DIFDCTPNDLFEPYVEMQAA

SEQ ID NO: 1313539 - protein, 20 aa, Mycobacterium
DIFREWYRLRNPMTVLREAR

SEQ ID NO: 1313540 - protein, 36 aa, Mycobacterium
DIGADDTFFWFTSPSWMMWNFQVAGLLVGATIVCYD

SEQ ID NO: 1313541 - protein, 21 aa, Mycobacterium
DIGFRMPSVWFAEGHNAVAPV

SEQ ID NO: 1313542 - protein, 26 aa, Mycobacterium
DIGGRPILWHIMKIYETAGITDFIVL

SEQ ID NO: 1313543 - protein, 17 aa, Mycobacterium
DIGMWLHLGTVADMWEM

SEQ ID NO: 1313544 - protein, 35 aa, Mycobacterium
DIGRDDTFFWYTSPSWMMWNFQVAGLLVGATIVCY

SEQ ID NO: 1313545 - protein, 19 aa, Mycobacterium
DIGRLLLRCADRPGLIAAV

SEQ ID NO: 1313546 - protein, 21 aa, Mycobacterium
DIGTELVAQLALKSALTRAIQ

SEQ ID NO: 1313547 - protein, 18 aa, Mycobacterium
DIGWATAFLASDAASYIS

SEQ ID NO: 1313548 - protein, 23 aa, Mycobacterium
DIGYLTALLRDEGITAMHFVPSL

SEQ ID NO: 1313549 - protein, 17 aa, Mycobacterium
DIHLAISSPGWAKHAWS

SEQ ID NO: 1313550 - protein, 18 aa, Mycobacterium
DIIVDPSAPIPQFLVKRA

SEQ ID NO: 1313551 - protein, 20 aa, Mycobacterium
DILAFERQWWKYAGSKEDAI

SEQ ID NO: 1313552 - protein, 18 aa, Mycobacterium
DILDVWRTYPVDRRRNLL

SEQ ID NO: 1313553 - protein, 23 aa, Mycobacterium
DILFTPRVWQRPKQDRRTLLMPP

SEQ ID NO: 1313554 - protein, 24 aa, Mycobacterium
DILGGPLELIIAAGTQPGAVSTLR

SEQ ID NO: 1313555 - protein, 29 aa, Mycobacterium
DILLATTAINRFMLLPTTSWDNTTYSSLM

SEQ ID NO: 1313556 - protein, 18 aa, Mycobacterium
DILVELGLDWDRIIELKT

SEQ ID NO: 1313557 - protein, 20 aa, Mycobacterium
DILVQLLASLSRIWPSRNVI

SEQ ID NO: 1313558 - protein, 36 aa, Mycobacterium
DINVSGVFHGVKAFLPRMIAAGAPAWVWNLSSIGGV

SEQ ID NO: 1313559 - protein, 17 aa, Mycobacterium
DIPDLALALQQVGGIAQ

SEQ ID NO: 1313560 - protein, 24 aa, Mycobacterium
DIPKTKMTPAPTKPIPILIGGHAD

SEQ ID NO: 1313561 - protein, 18 aa, Mycobacterium
DIPLKFHHPMWVQNAEID

SEQ ID NO: 1313562 - protein, 22 aa, Mycobacterium
DIPQTYLEPILVRNATSRGTQT

SEQ ID NO: 1313563 - protein, 18 aa, Mycobacterium
DIPVLSLVDCPGYMVGPA

SEQ ID NO: 1313564 - protein, 20 aa, Mycobacterium
DIRAQRLVVASDGRVVGLVA

SEQ ID NO: 1313565 - protein, 28 aa, Mycobacterium
DIRFVRLWFTDVLGYLKSVAIAPAELEG

SEQ ID NO: 1313566 - protein, 17 aa, Mycobacterium
DIRICSSAATFGNAAIL

SEQ ID NO: 1313567 - protein, 24 aa, Mycobacterium
DIRKAVPNWLVWTHGCPGGETSAQ

SEQ ID NO: 1313568 - protein, 30 aa, Mycobacterium
DISEVEYRQLRLERVVLVGVWTDGSAADAE

SEQ ID NO: 1313569 - protein, 22 aa, Mycobacterium
DISGVLSILAFTFTMVTGGNDT

SEQ ID NO: 1313570 - protein, 17 aa, Mycobacterium
DISLWRRLCTELELPGL

SEQ ID NO: 1313571 - protein, 25 aa, Mycobacterium
DISPKWPPMDKPVIGAINGAAVTGG

SEQ ID NO: 1313572 - protein, 18 aa, Mycobacterium
DISSLLRGYGWQVPAYTM

SEQ ID NO: 1313573 - protein, 17 aa, Mycobacterium
DITPTVFDLLDITPPAT

SEQ ID NO: 1313574 - protein, 18 aa, Mycobacterium
DIVARLRRRWDDGSLLTG

SEQ ID NO: 1313575 - protein, 18 aa, Mycobacterium
DIVARYCSLLPVSVISDV

SEQ ID NO: 1313576 - protein, 18 aa, Mycobacterium
DIVLLDEPTNDLDLDGLA

SEQ ID NO: 1313577 - protein, 32 aa, Mycobacterium
DIVNHFFVCSTHDWILFFTTQGRVYRAKAYEL

SEQ ID NO: 1313578 - protein, 17 aa, Mycobacterium
DIVTITQYLRPSARHHP

SEQ ID NO: 1313579 - protein, 25 aa, Mycobacterium
DIWGRRRLAYEIAKHAEGIYAIVDV

SEQ ID NO: 1313580 - protein, 23 aa, Mycobacterium
DIYAWVLEYRNQLSVRLSELDLI

SEQ ID NO: 1313581 - protein, 19 aa, Mycobacterium
DIYGELLARTLQSDPEPVL

SEQ ID NO: 1313582 - protein, 23 aa, Mycobacterium
DIYPEIVNELIRLGIPAVHVTIV

SEQ ID NO: 1313583 - protein, 24 aa, Mycobacterium
DIYPEIVNELIRLGIPAVHVTIVL

SEQ ID NO: 1313584 - protein, 34 aa, Mycobacterium
DKAALDACLDRYARLFAALVPWDNQTDIAVMPAD

SEQ ID NO: 1313585 - protein, 29 aa, Mycobacterium
DKAALDDCLLKYSRLFAALTEWERGTDIA

SEQ ID NO: 1313586 - protein, 25 aa, Mycobacterium
DKACWSRWWPDLRLVVVEDRGEAGH

SEQ ID NO: 1313587 - protein, 19 aa, Mycobacterium
DKAIWNMTVDDFDLVMRVH

SEQ ID NO: 1313588 - protein, 25 aa, Mycobacterium
DKARKFRAELTMPLILLGGITNRET

SEQ ID NO: 1313589 - protein, 27 aa, Mycobacterium
DKARWGYKFRFGVFRIDDHDLEVIRSA

SEQ ID NO: 1313590 - protein, 24 aa, Mycobacterium
DKAVRAVRLFGPVGSALIYAASKI

SEQ ID NO: 1313591 - protein, 34 aa, Mycobacterium
DKDDCAAIGLVKFDLLGLGMLSALHYAIDLVAEH

SEQ ID NO: 1313592 - protein, 21 aa, Mycobacterium
DKEVVPHYPQWEKGGRMPREV

SEQ ID NO: 1313593 - protein, 19 aa, Mycobacterium
DKEWIACLVPVFRAGQEAG

SEQ ID NO: 1313594 - protein, 21 aa, Mycobacterium
DKEWIACLVPVFRAGQEAGLT

SEQ ID NO: 1313595 - protein, 28 aa, Mycobacterium
DKGDLRGRFRWWGLYTQRKPGYDGTWTG

SEQ ID NO: 1313596 - protein, 24 aa, Mycobacterium
DKGFGGRQLIKDLSFTLPRNGIVG

SEQ ID NO: 1313597 - protein, 24 aa, Mycobacterium
DKGLRFSFRWDLGRSRLVMVDSRN

SEQ ID NO: 1313598 - protein, 23 aa, Mycobacterium
DKGLRRWRAVARSAARQSRRPYI

SEQ ID NO: 1313599 - protein, 24 aa, Mycobacterium
DKGPWAVFDLSLGRAMYSGFTMGG

SEQ ID NO: 1313600 - protein, 28 aa, Mycobacterium
DKGRLTLPAKFRDALAGGLMVTKSQDHS

SEQ ID NO: 1313601 - protein, 27 aa, Mycobacterium
DKGVSRRSVFRLFDKLANAGMAESVEG

SEQ ID NO: 1313602 - protein, 20 aa, Mycobacterium
DKGVVRIHVVWQGDAAISGG

SEQ ID NO: 1313603 - protein, 17 aa, Mycobacterium
DKIWAPKAAGALRLHEV

SEQ ID NO: 1313604 - protein, 17 aa, Mycobacterium
DKLFIGGKWVEPATSDV

SEQ ID NO: 1313605 - protein, 26 aa, Mycobacterium
DKLLRTSMELGGNAPFIVFDDADIDA

SEQ ID NO: 1313606 - protein, 21 aa, Mycobacterium
DKLVQRFLNDPVLHSVNEAAE

SEQ ID NO: 1313607 - protein, 23 aa, Mycobacterium
DKNWTRRVTDVRNWFVFSASERD

SEQ ID NO: 1313608 - protein, 34 aa, Mycobacterium
DKPLKYPVMFRAVDVVLLNKIDLAPYLDADVATY

SEQ ID NO: 1313609 - protein, 25 aa, Mycobacterium
DKPRAEGRFYLPDGRRLGFAEFGDP

SEQ ID NO: 1313610 - protein, 21 aa, Mycobacterium
DKRVALVFSAYPTKHARIGNA

SEQ ID NO: 1313611 - protein, 24 aa, Mycobacterium
DKSGTLRHKLLGRGDRLPDTHPAA

SEQ ID NO: 1313612 - protein, 22 aa, Mycobacterium
DKVLAGLRPFPVAVTTIDNGFA

SEQ ID NO: 1313613 - protein, 20 aa, Mycobacterium
DKVNLDITWLRDESLEDADN

SEQ ID NO: 1313614 - protein, 23 aa, Mycobacterium
DKVTSMFRHADLSSALAATELGE

SEQ ID NO: 1313615 - protein, 21 aa, Mycobacterium
DKWMLAETLAWQAYAALMGGG

SEQ ID NO: 1313616 - protein, 24 aa, Mycobacterium
DLAAALVPLHDTPLGPLAPGVTLR

SEQ ID NO: 1313617 - protein, 25 aa, Mycobacterium
DLAASLAGLAWLQARMGRFAECRVN

SEQ ID NO: 1313618 - protein, 27 aa, Mycobacterium
DLADVKIDNGCSPMLALLADELPGLSD

SEQ ID NO: 1313619 - protein, 18 aa, Mycobacterium
DLAERRLPDHIELALYRI

SEQ ID NO: 1313620 - protein, 19 aa, Mycobacterium
DLAFPHQQFVPLDGERRRA

SEQ ID NO: 1313621 - protein, 28 aa, Mycobacterium
DLAGVGVGTLYRHFPRRSDLILAVIERE

SEQ ID NO: 1313622 - protein, 22 aa, Mycobacterium
DLALFRAWYLHEELGLNVVLPV

SEQ ID NO: 1313623 - protein, 22 aa, Mycobacterium
DLAMARWGIAYAIGPNYNKGRE

SEQ ID NO: 1313624 - protein, 17 aa, Mycobacterium
DLAPLFASALIAQEVAS

SEQ ID NO: 1313625 - protein, 18 aa, Mycobacterium
DLAPRMRRLAADGVLRSE

SEQ ID NO: 1313626 - protein, 18 aa, Mycobacterium
DLAPRYRVRPGLTDRQGP

SEQ ID NO: 1313627 - protein, 28 aa, Mycobacterium
DLARIDADGFLWILGRADQAIIRGGFKV

SEQ ID NO: 1313628 - protein, 37 aa, Mycobacterium; identical to SEQ ID NO: 802024

SEQ ID NO: 1313629 - protein, 38 aa, Mycobacterium
DLARPSWMPVGPGTYGRFLAIRVFDFWVHERDITTPLG

SEQ ID NO: 1313630 - protein, 23 aa, Mycobacterium
DLARYFPEVLDFVRDELAPRCVL

SEQ ID NO: 1313631 - protein, 20 aa, Mycobacterium
DLATFTPGDRLAARAALGLD

SEQ ID NO: 1313632 - protein, 18 aa, Mycobacterium
DLAVWDGHVAMVVGDGVM

SEQ ID NO: 1313633 - protein, 20 aa, Mycobacterium
DLAWLRSRGLDRAVLAHAAA

SEQ ID NO: 1313634 - protein, 24 aa, Mycobacterium
DLAYRQWTQFADFPKYMKKVEQVE

SEQ ID NO: 1313635 - protein, 25 aa, Mycobacterium
DLAYTTIMTVLQRLAKKNLVVQHRD

SEQ ID NO: 1313636 - protein, 32 aa, Mycobacterium; identical to SEQ ID NO: 802053

SEQ ID NO: 1313637 - protein, 26 aa, Mycobacterium
DLDAHLLERIARFKRPKRYEFVDELP

SEQ ID NO: 1313638 - protein, 23 aa, Mycobacterium
DLDALIVVSSMWVDGASAAAQTM

SEQ ID NO: 1313639 - protein, 21 aa, Mycobacterium
DLDALIVVSSPWVDGAAAAGQ

SEQ ID NO: 1313640 - protein, 26 aa, Mycobacterium
DLDAVPLTERLPAPGVSPFPAVFQDV

SEQ ID NO: 1313641 - protein, 18 aa, Mycobacterium
DLDDRLTDLLAPRDPHDA

SEQ ID NO: 1313642 - protein, 20 aa, Mycobacterium
DLDFVLVVGHLFTLVVYGQL

SEQ ID NO: 1313643 - protein, 28 aa, Mycobacterium
DLDILETITRWRPYLTGERNSYAYYPGT

SEQ ID NO: 1313644 - protein, 20 aa, Mycobacterium
DLDLLIETIRRESGHLDVVV

SEQ ID NO: 1313645 - protein, 18 aa, Mycobacterium
DLDLPMYAPHELERTPRA

SEQ ID NO: 1313646 - protein, 19 aa, Mycobacterium
DLDSAWFPAAVAASHAIRA

SEQ ID NO: 1313647 - protein, 26 aa, Mycobacterium
DLDTLLEFYHYPAEHWIHLRTTNPIE

SEQ ID NO: 1313648 - protein, 23 aa, Mycobacterium
DLEDHLLTHPAIYAAAAVALPDD

SEQ ID NO: 1313649 - protein, 24 aa, Mycobacterium
DLEFNLFEVLALEKVLATGEFGDL

SEQ ID NO: 1313650 - protein, 21 aa, Mycobacterium
DLEGRLLAGLLAPYGDEPTPT

SEQ ID NO: 1313651 - protein, 23 aa, Mycobacterium
DLEKTLRFWLDRGVDGFRIDVAH

SEQ ID NO: 1313652 - protein, 25 aa, Mycobacterium
DLEMYGTAKLLNPVIKLVCEKRAGD

SEQ ID NO: 1313653 - protein, 26 aa, Mycobacterium
DLEPVIALRRRLLPDSPRITTLAQSA

SEQ ID NO: 1313654 - protein, 20 aa, Mycobacterium
DLERRILLSRVPELPERLAE

SEQ ID NO: 1313655 - protein, 21 aa, Mycobacterium
DLERRVAGFLGFTDIFTSVGQ

SEQ ID NO: 1313656 - protein, 24 aa, Mycobacterium
DLEVRIGLPHIPSGRRDTWAARVA

SEQ ID NO: 1313657 - protein, 18 aa, Mycobacterium
DLFAALPGSRAHGGRYAA

SEQ ID NO: 1313658 - protein, 21 aa, Mycobacterium
DLFAGILATVPFVDPLTTILD

SEQ ID NO: 1313659 - protein, 20 aa, Mycobacterium
DLFGGLFGRGAQQPRPSRPR

SEQ ID NO: 1313660 - protein, 28 aa, Mycobacterium
DLFMDIMTTLAMWKFRQLRPINTAAAKI

SEQ ID NO: 1313661 - protein, 21 aa, Mycobacterium
DLFRSPASAASFVVDPDGALR

SEQ ID NO: 1313662 - protein, 25 aa, Mycobacterium
DLGDGGYFIHFRWDSDDAGQLAETE

SEQ ID NO: 1313663 - protein, 20 aa, Mycobacterium
DLGDYLESLRRLHGLGHRRV

SEQ ID NO: 1313664 - protein, 17 aa, Mycobacterium
DLGGLIAMFAKILDADP

SEQ ID NO: 1313665 - protein, 18 aa, Mycobacterium
DLGGLPLDVLQSALLEAA

SEQ ID NO: 1313666 - protein, 18 aa, Mycobacterium
DLGKIPCVSYWNDERRCA

SEQ ID NO: 1313667 - protein, 18 aa, Mycobacterium
DLGSLEALRLLGRYLERA

SEQ ID NO: 1313668 - protein, 24 aa, Mycobacterium
DLGSLGIRALAIAPSLFATGLTEG

SEQ ID NO: 1313669 - protein, 24 aa, Mycobacterium
DLGSLTLPVLRAWLSAQAAAGTAR

SEQ ID NO: 1313670 - protein, 17 aa, Mycobacterium
DLGWLLMESPGGTTHVG

SEQ ID NO: 1313671 - protein, 28 aa, Mycobacterium
DLGYLDGAGFLYFAGRRGDWLRVDGENI

SEQ ID NO: 1313672 - protein, 29 aa, Mycobacterium
DLHNGGCAAFLLGLKLARNLLASGEGRTA

SEQ ID NO: 1313673 - protein, 42 aa, Mycobacterium
DLHRSDPLLLLPLLRTMPPVPVLLLHCYPFHRQAGYLAQAFD

SEQ ID NO: 1313674 - protein, 30 aa, Mycobacterium
DLHRTDPLLLLPLLRAMTPVPVLLLHCYPF

SEQ ID NO: 1313675 - protein, 24 aa, Mycobacterium
DLHYADYAIWERSWLTGAALQRRI

SEQ ID NO: 1313676 - protein, 30 aa, Mycobacterium
DLIDPSAWAFTWVVDWPLFEPADDATASGD

SEQ ID NO: 1313677 - protein, 18 aa, Mycobacterium
DLIEPTVVYFHRRAYQRA

SEQ ID NO: 1313678 - protein, 18 aa, Mycobacterium
DLIGLRQAVYRREDTRNT

SEQ ID NO: 1313679 - protein, 24 aa, Mycobacterium
DLIIAMQEWAGDLILADLRIAVAA

SEQ ID NO: 1313680 - protein, 23 aa, Mycobacterium
DLIIPMIGLLKRKAERRLTDTAL

SEQ ID NO: 1313681 - protein, 18 aa, Mycobacterium
DLIPGVLAALVHRGADFA

SEQ ID NO: 1313682 - protein, 25 aa, Mycobacterium
DLIQRFPNVLVLRTFSKAYGLAGLR

SEQ ID NO: 1313683 - protein, 23 aa, Mycobacterium
DLISAHLQGWTLDRLPAVDRAIL

SEQ ID NO: 1313684 - protein, 27 aa, Mycobacterium
DLITEQLRWDADWYKLIRRAGEDDVAR

SEQ ID NO: 1313685 - protein, 23 aa, Mycobacterium
DLITGIGLTAYPLTSGSKGLHLY

SEQ ID NO: 1313686 - protein, 18 aa, Mycobacterium
DLKALLPESARRAYDVHP

SEQ ID NO: 1313687 - protein, 20 aa, Mycobacterium
DLKFMRFIGTEIFPGGQLPA

SEQ ID NO: 1313688 - protein, 25 aa, Mycobacterium
DLKRFDEWLTIFGGWKSAVPSEIDV

SEQ ID NO: 1313689 - protein, 26 aa, Mycobacterium
DLLADIGLRTFPLTSGSKGLHLYVPL

SEQ ID NO: 1313690 - protein, 20 aa, Mycobacterium
DLLADVVNRVWFLDAVRGEA

SEQ ID NO: 1313691 - protein, 18 aa, Mycobacterium
DLLCWERLSGDLLCGRVM

SEQ ID NO: 1313692 - protein, 24 aa, Mycobacterium
DLLDELCLTVAPLLLGGGSARIVT

SEQ ID NO: 1313693 - protein, 25 aa, Mycobacterium
DLLDKIAAGPPLYSPFKLLDPVANL

SEQ ID NO: 1313694 - protein, 19 aa, Mycobacterium
DLLDLVGLPTEFADRYPHE

SEQ ID NO: 1313695 - protein, 27 aa, Mycobacterium
DLLDPDPMFVPKLLGPLLTAEDVHLVK

SEQ ID NO: 1313696 - protein, 17 aa, Mycobacterium
DLLGAYRQGRTWRRIGL

SEQ ID NO: 1313697 - protein, 18 aa, Mycobacterium
DLLGFNEQPSRLAPAPML

SEQ ID NO: 1313698 - protein, 17 aa, Mycobacterium
DLLGWDDVVQLADDEWM

SEQ ID NO: 1313699 - protein, 18 aa, Mycobacterium
DLLKMWLAADRDGDVIAA

SEQ ID NO: 1313700 - protein, 17 aa, Mycobacterium
DLLLLDEPFGALDALTR

SEQ ID NO: 1313701 - protein, 20 aa, Mycobacterium
DLLMCRPEVAGVLLEGIWSA

SEQ ID NO: 1313702 - protein, 23 aa, Mycobacterium
DLLMLRGEYQMKVPAPFVPGLEV

SEQ ID NO: 1313703 - protein, 19 aa, Mycobacterium
DLLTFLQHSVRDPKLQLAD

SEQ ID NO: 1313704 - protein, 20 aa, Mycobacterium
DLLVGILREQEFLAGAIDTG

SEQ ID NO: 1313705 - protein, 20 aa, Mycobacterium
DLLVLDIMLPDMDGLGVLAR

SEQ ID NO: 1313706 - protein, 21 aa, Mycobacterium
DLLVNVLRHPAFGDGATDTAF

SEQ ID NO: 1313707 - protein, 24 aa, Mycobacterium
DLLWGPAMRNYPDLKFAFSEGGIG

SEQ ID NO: 1313708 - protein, 24 aa, Mycobacterium
DLMVLGLARGGVPVAWEVAHALHA

SEQ ID NO: 1313709 - protein, 27 aa, Mycobacterium
DLNHDVGFIGVPLFHIAGIGNTIVGLL

SEQ ID NO: 1313710 - protein, 17 aa, Mycobacterium
DLNLRGHLKVRLGIALV

SEQ ID NO: 1313711 - protein, 19 aa, Mycobacterium
DLNVNGTMYVLKHSAREMV

SEQ ID NO: 1313712 - protein, 19 aa, Mycobacterium
DLPIPLPVVGGHEGAGTVV

SEQ ID NO: 1313713 - protein, 17 aa, Mycobacterium
DLPLRYTFDVISVISGG

SEQ ID NO: 1313714 - protein, 20 aa, Mycobacterium
DLPPRPGQPESWPQWAHPDV

SEQ ID NO: 1313715 - protein, 28 aa, Mycobacterium
DLPPSQANFVWLPLVGRAQQFAADAANS

SEQ ID NO: 1313716 - protein, 26 aa, Mycobacterium
DLPQRGQRLRQLAAHAVGAVAQRRPA

SEQ ID NO: 1313717 - protein, 25 aa, Mycobacterium
DLPRIARATKILDLARAYGIEPSDF

SEQ ID NO: 1313718 - protein, 23 aa, Mycobacterium
DLPTPLPRITYAEAMRRFGTDKP

SEQ ID NO: 1313719 - protein, 22 aa, Mycobacterium
DLQDYCHRLVNFDIPFNPNRLE

SEQ ID NO: 1313720 - protein, 23 aa, Mycobacterium
DLQDYCHRLVNFDIPFNPNRLEQ

SEQ ID NO: 1313721 - protein, 20 aa, Mycobacterium
DLQLWVGACLYKGVVDVHRL

SEQ ID NO: 1313722 - protein, 27 aa, Mycobacterium
DLQRLAMDWYLHDTAMRSQRLAECAAG

SEQ ID NO: 1313723 - protein, 22 aa, Mycobacterium
DLQRLPGLVAIAYQHETSRCGD

SEQ ID NO: 1313724 - protein, 17 aa, Mycobacterium
DLRCLMLTSFTSDEAML

SEQ ID NO: 1313725 - protein, 21 aa, Mycobacterium
DLRDIMVLAGYLTADSDLTAD

SEQ ID NO: 1313726 - protein, 17 aa, Mycobacterium
DLRDLQRRLADFGLSSL

SEQ ID NO: 1313727 - protein, 20 aa, Mycobacterium
DLRGLDSLDLGARRLDAAPD

SEQ ID NO: 1313728 - protein, 18 aa, Mycobacterium
DLRHATSLRHCLDLLTQH

SEQ ID NO: 1313729 - protein, 19 aa, Mycobacterium
DLRHATSLRHCLDLLTQHA

SEQ ID NO: 1313730 - protein, 18 aa, Mycobacterium
DLRHGRLSFRLAGTERGG

SEQ ID NO: 1313731 - protein, 23 aa, Mycobacterium
DLRKRLKRLTGHTVPLATLLGGI

SEQ ID NO: 1313732 - protein, 24 aa, Mycobacterium
DLRQRMALFFDVVCGWIAAEPDVH

SEQ ID NO: 1313733 - protein, 23 aa, Mycobacterium
DLRRWLPLDMRRPFKSTLVTLDV

SEQ ID NO: 1313734 - protein, 21 aa, Mycobacterium
DLRVAVKLSPFFSATAEMALR

SEQ ID NO: 1313735 - protein, 19 aa, Mycobacterium
DLRVYGALLAVGTELFSRP

SEQ ID NO: 1313736 - protein, 20 aa, Mycobacterium
DLSDWLLYEQSSPSSADTLA

SEQ ID NO: 1313737 - protein, 20 aa, Mycobacterium
DLSGRFWTVIAVGDAGAQVA

SEQ ID NO: 1313738 - protein, 19 aa, Mycobacterium
DLSIPIPERIELAREGRAY

SEQ ID NO: 1313739 - protein, 25 aa, Mycobacterium
DLSRDGAFLVTTWQGPAPGAALRTT

SEQ ID NO: 1313740 - protein, 35 aa, Mycobacterium
DLSRELIRVCTIAPGLFKTPLLGSLPEEAQASLGK

SEQ ID NO: 1313741 - protein, 25 aa, Mycobacterium
DLSRPGRMWWSVPRGVTTFHTWQET

SEQ ID NO: 1313742 - protein, 19 aa, Mycobacterium
DLSSLLIGGARRQWRTGIA

SEQ ID NO: 1313743 - protein, 23 aa, Mycobacterium
DLSSLRYIMWCATPVTQTVAEAV

SEQ ID NO: 1313744 - protein, 25 aa, Mycobacterium
DLSTLRPVPWEPGHAFVLCDVVNTD

SEQ ID NO: 1313745 - protein, 24 aa, Mycobacterium
DLTDELVALRWALYQSEESRSALT

SEQ ID NO: 1313746 - protein, 31 aa, Mycobacterium; identical to SEQ ID NO: 802516

SEQ ID NO: 1313747 - protein, 25 aa, Mycobacterium
DLTERLVLMSRQYGLEPQQLLQMLQ

SEQ ID NO: 1313748 - protein, 26 aa, Mycobacterium
DLTFASLPYRIMHEFQIPLYDQMRER

SEQ ID NO: 1313749 - protein, 26 aa, Mycobacterium
DLTHEPWLPRRRALQPIFTKQHVREF

SEQ ID NO: 1313750 - protein, 41 aa, Mycobacterium
DLTRLPLPTLLLPAPVRRALTPPWLLLRPVAGRVVKVCSFG

SEQ ID NO: 1313751 - protein, 19 aa, Mycobacterium
DLTYCSLRLDPESLQTVLT

SEQ ID NO: 1313752 - protein, 26 aa, Mycobacterium
DLVADLLPDGGWLSDLGTHRLRDLPR

SEQ ID NO: 1313753 - protein, 18 aa, Mycobacterium
DLVAGGCDAVMKLAPVLA

SEQ ID NO: 1313754 - protein, 18 aa, Mycobacterium
DLVALMKVGVRRGKIVVV

SEQ ID NO: 1313755 - protein, 20 aa, Mycobacterium
DLVDSAPKPLLEKVNKEAAE

SEQ ID NO: 1313756 - protein, 27 aa, Mycobacterium
DLVDVKLKWRISLGALILHLRESKLID

SEQ ID NO: 1313757 - protein, 17 aa, Mycobacterium
DLVELHLQGKQAHWNVV

SEQ ID NO: 1313758 - protein, 20 aa, Mycobacterium
DLVGRFLLKGGETVWVDGPL

SEQ ID NO: 1313759 - protein, 20 aa, Mycobacterium
DLVLAIYNPASKTRTWQVGA

SEQ ID NO: 1313760 - protein, 18 aa, Mycobacterium
DLVLGWLLQQQAAVAIEK

SEQ ID NO: 1313761 - protein, 26 aa, Mycobacterium
DLVQETYLRAWKSFKGFQGKSSVRTW

SEQ ID NO: 1313762 - protein, 29 aa, Mycobacterium
DLVQHFALPIPSLVICELLGVPYADRDDF

SEQ ID NO: 1313763 - protein, 25 aa, Mycobacterium
DLVRDFTFEFPTRVISRLLGLPEED

SEQ ID NO: 1313764 - protein, 18 aa, Mycobacterium
DLVRYYDMLLSGAGGLPR

SEQ ID NO: 1313765 - protein, 21 aa, Mycobacterium
DLVSEFFCRIINYMDANSYDR

SEQ ID NO: 1313766 - protein, 26 aa, Mycobacterium
DLVSLTQVLAWDLPLDSKIRAKVAKH

SEQ ID NO: 1313767 - protein, 27 aa, Mycobacterium
DLVSTGPWFQWHFDRWTVPPGAVEIAR

SEQ ID NO: 1313768 - protein, 25 aa, Mycobacterium
DLVVISFLHLPIDELVAVIATAATW

SEQ ID NO: 1313769 - protein, 18 aa, Mycobacterium
DLVVTLRPEWTAGQARFA

SEQ ID NO: 1313770 - protein, 19 aa, Mycobacterium
DLYFFDTVVRLHRAGEGAP

SEQ ID NO: 1313771 - protein, 18 aa, Mycobacterium
DLYRPYVDGLENLPRDGR

SEQ ID NO: 1313772 - protein, 22 aa, Mycobacterium
DMAGTASFLWLEVDDVVRETMA

SEQ ID NO: 1313773 - protein, 21 aa, Mycobacterium
DMAKWQKVIDVNLTGTFLGMQ

SEQ ID NO: 1313774 - protein, 27 aa, Mycobacterium
DMAQLYDGFSFLTVMWLEAMGFCEHGK

SEQ ID NO: 1313775 - protein, 25 aa, Mycobacterium
DMDDRVVWLPLNSPGCHVHRALGVT

SEQ ID NO: 1313776 - protein, 24 aa, Mycobacterium
DMDTLLTLLGVAGAAFVITVPGAD

SEQ ID NO: 1313777 - protein, 18 aa, Mycobacterium
DMEAHRFRIIYNTIRPHQ

SEQ ID NO: 1313778 - protein, 23 aa, Mycobacterium
DMEDYLILGACNPPLAHRAVTAD

SEQ ID NO: 1313779 - protein, 26 aa, Mycobacterium
DMFDDFPAVLALIADGKLALAPQITA

SEQ ID NO: 1313780 - protein, 28 aa, Mycobacterium
DMGAAAWRRLWADAAPLPIFAEHPQAKF

SEQ ID NO: 1313781 - protein, 21 aa, Mycobacterium
DMGLDFFLATSSIASVWGSHG

SEQ ID NO: 1313782 - protein, 30 aa, Mycobacterium; identical to SEQ ID NO: 802686

SEQ ID NO: 1313783 - protein, 25 aa, Mycobacterium
DMITSLICHGTLTRFPKLRIASVEN

SEQ ID NO: 1313784 - protein, 20 aa, Mycobacterium
DMLTPFIWRMDCFGRPHLEQ

SEQ ID NO: 1313785 - protein, 25 aa, Mycobacterium
DMLTSLICHGTLTRFPKLRIASVEN

SEQ ID NO: 1313786 - protein, 21 aa, Mycobacterium
DMLVSRFPYRFPQRERDHASA

SEQ ID NO: 1313787 - protein, 19 aa, Mycobacterium
DMRDWVACLVRPLTDHLAE

SEQ ID NO: 1313788 - protein, 18 aa, Mycobacterium
DMSDAHLRRLYTDVKKLG

SEQ ID NO: 1313789 - protein, 19 aa, Mycobacterium
DMTEGMLELLLRELDVAPG

SEQ ID NO: 1313790 - protein, 18 aa, Mycobacterium
DMTIHYLSPVLDGPARAE

SEQ ID NO: 1313791 - protein, 17 aa, Mycobacterium
DMTLTATFRPLAGPLQK

SEQ ID NO: 1313792 - protein, 18 aa, Mycobacterium
DMVDDGFLNRLDLAFSRD

SEQ ID NO: 1313793 - protein, 17 aa, Mycobacterium
DMVFLRNCGVHPVVVHG

SEQ ID NO: 1313794 - protein, 30 aa, Mycobacterium
DMVLAMSAGALRKLLLRYDGRADHALLASV

SEQ ID NO: 1313795 - protein, 22 aa, Mycobacterium
DMVSIYDCYTITVLLSLEDAGF

SEQ ID NO: 1313796 - protein, 24 aa, Mycobacterium
DMWEKVIFNLLSNALKFTFEGAVS

SEQ ID NO: 1313797 - protein, 19 aa, Mycobacterium
DNAAWYFDTVGVGDPIIVQ

SEQ ID NO: 1313798 - protein, 23 aa, Mycobacterium
DNALQIVMLLATRNELRLTDVSA

SEQ ID NO: 1313799 - protein, 33 aa, Mycobacterium
DNANLDKARRLLWPIKRKYGNKISWADLIAYAG

SEQ ID NO: 1313800 - protein, 21 aa, Mycobacterium
DNANYLWIQQFYAALGPKGRA

SEQ ID NO: 1313801 - protein, 25 aa, Mycobacterium
DNCKLIDWPIATLSPAGIRTSDGVE

SEQ ID NO: 1313802 - protein, 17 aa, Mycobacterium
DNDFVYTTYIRTTPERL

SEQ ID NO: 1313803 - protein, 20 aa, Mycobacterium
DNDHLLAFQDECLAALPGVQ

SEQ ID NO: 1313804 - protein, 26 aa, Mycobacterium
DNDIVLVDFWASWCGPCKAFAPTFAA

SEQ ID NO: 1313805 - protein, 24 aa, Mycobacterium
DNDLGLPMWDPRTGAGFDGLHADR

SEQ ID NO: 1313806 - protein, 28 aa, Mycobacterium
DNDPDLPTLIVDPYFRDAIEAAVDSWRR

SEQ ID NO: 1313807 - protein, 17 aa, Mycobacterium
DNDPLRQLLESTVAEHL

SEQ ID NO: 1313808 - protein, 24 aa, Mycobacterium
DNEILGLCFMFVLAGLDTVTSAVG

SEQ ID NO: 1313809 - protein, 26 aa, Mycobacterium
DNFARVAQFIPLLGEVEQKVIGCFHN

SEQ ID NO: 1313810 - protein, 29 aa, Mycobacterium
DNFMTQGWFTGLIPITVPIGAGSFADAAW

SEQ ID NO: 1313811 - protein, 26 aa, Mycobacterium
DNFSKYAKALGFYCDCAVLRDSPLEP

SEQ ID NO: 1313812 - protein, 29 aa, Mycobacterium
DNFSKYAKALGFYCDCAVLRDSPLEPGIL

SEQ ID NO: 1313813 - protein, 27 aa, Mycobacterium
DNFVFPAGMLLVFEPVVWQDGTGGYRG

SEQ ID NO: 1313814 - protein, 26 aa, Mycobacterium
DNFVFPSGMLLVFEPVVWEDGTGGYR

SEQ ID NO: 1313815 - protein, 26 aa, Mycobacterium
DNGHTTFLELAPNPVALMQVGLTTAA

SEQ ID NO: 1313816 - protein, 20 aa, Mycobacterium
DNGKLHRFVNIYVNDEDVRF

SEQ ID NO: 1313817 - protein, 18 aa, Mycobacterium
DNGLLYYAVDHSPSYLWN

SEQ ID NO: 1313818 - protein, 21 aa, Mycobacterium
DNGVLVFPGLHLEPEVQVEFC

SEQ ID NO: 1313819 - protein, 25 aa, Mycobacterium
DNIEQLLVLLPQGTAIMGGGVVPNL

SEQ ID NO: 1313820 - protein, 43 aa, Mycobacterium
DNITVTIPVTIDPLVQLPPTVVTAGLPIFKLGDSPVKVLSSAI

SEQ ID NO: 1313821 - protein, 26 aa, Mycobacterium
DNKIRYIAVYLQMQLPDPAALPNFQN

SEQ ID NO: 1313822 - protein, 17 aa, Mycobacterium
DNLLQRRRPRATVSLDH

SEQ ID NO: 1313823 - protein, 25 aa, Mycobacterium
DNLNWWLGEWSWVFEKYSTMFVQWT

SEQ ID NO: 1313824 - protein, 28 aa, Mycobacterium
DNLPVGPDAALWRILRDVASLGSAGGEI

SEQ ID NO: 1313825 - protein, 20 aa, Mycobacterium
DNPARPLLVLNVRGIGYRLA

SEQ ID NO: 1313826 - protein, 21 aa, Mycobacterium
DNPDLPLMAIGMREVRSQNSW

SEQ ID NO: 1313827 - protein, 24 aa, Mycobacterium
DNPDTLYFGTWLQGGHEYVLTGRR

SEQ ID NO: 1313828 - protein, 20 aa, Mycobacterium
DNPIKLVWEKDPSLPELQCY

SEQ ID NO: 1313829 - protein, 34 aa, Mycobacterium
DNPIPGHFMDDFLLYWAFLSYALVRGGRRTFGAS

SEQ ID NO: 1313830 - protein, 22 aa, Mycobacterium
DNPLLRLPNVVLTPHVTWYTAD

SEQ ID NO: 1313831 - protein, 35 aa, Mycobacterium
DNPVPQRFMDDFLLYWSFLAFALVRGGRRTFGPSF

SEQ ID NO: 1313832 - protein, 26 aa, Mycobacterium
DNPVVYMFHKGIMGLSWMSKTSRALG

SEQ ID NO: 1313833 - protein, 17 aa, Mycobacterium
DNPYGGLEPIFAATARL

SEQ ID NO: 1313834 - protein, 24 aa, Mycobacterium
DNQGGFLVPMQLDPTIILTANGSF

SEQ ID NO: 1313835 - protein, 24 aa, Mycobacterium
DNQPGFLGFQLLRPVKGDNRYFVV

SEQ ID NO: 1313836 - protein, 28 aa, Mycobacterium
DNRLAFYRQLYRDSARFGAKLWVLPANM

SEQ ID NO: 1313837 - protein, 32 aa, Mycobacterium
DNSSWIFGGVTLNPMYWPARRQETLLTTAVYK

SEQ ID NO: 1313838 - protein, 24 aa, Mycobacterium
DPAAACTVLRRSWAAWQELDAPYE

SEQ ID NO: 1313839 - protein, 28 aa, Mycobacterium
DPAAAVAWLANALAPFGVALQPGQFVMS

SEQ ID NO: 1313840 - protein, 24 aa, Mycobacterium
DPAEWKVFLSLVREGFEKDKTKWT

SEQ ID NO: 1313841 - protein, 24 aa, Mycobacterium
DPAEWRTEIGWPVFRLAAGEPSAQ

SEQ ID NO: 1313842 - protein, 22 aa, Mycobacterium
DPAKLIIDPGLGFAKTAQHNWA

SEQ ID NO: 1313843 - protein, 17 aa, Mycobacterium
DPAKLRLMLRMAEATDV

SEQ ID NO: 1313844 - protein, 23 aa, Mycobacterium
DPAKRLAQALGIRDLGNTPQRVP

SEQ ID NO: 1313845 - protein, 18 aa, Mycobacterium
DPALLRFAAARTDLSADT

SEQ ID NO: 1313846 - protein, 18 aa, Mycobacterium
DPALLRFAAARTDLSAET

SEQ ID NO: 1313847 - protein, 17 aa, Mycobacterium
DPALYPGAAPQDLVPGA

SEQ ID NO: 1313848 - protein, 25 aa, Mycobacterium
DPARSSPVVAWLQSAQSSWLTGQIL

SEQ ID NO: 1313849 - protein, 17 aa, Mycobacterium
DPARVLSLVAFDAADTG

SEQ ID NO: 1313850 - protein, 18 aa, Mycobacterium
DPARVLSLVAFDAADTGI

SEQ ID NO: 1313851 - protein, 17 aa, Mycobacterium
DPASLTAAPLVLRAAWT

SEQ ID NO: 1313852 - protein, 22 aa, Mycobacterium
DPATAEALKPYYRFMCKRPCSS

SEQ ID NO: 1313853 - protein, 17 aa, Mycobacterium
DPAVIRAAILAGAAGAR

SEQ ID NO: 1313854 - protein, 19 aa, Mycobacterium
DPAWIVFDSIHLKHYGFLG

SEQ ID NO: 1313855 - protein, 25 aa, Mycobacterium
DPAYRWGDLLTGEPEPLFGFPGAPM

SEQ ID NO: 1313856 - protein, 24 aa, Mycobacterium
DPCKLTLEMFFDATLKHTDSVVDA

SEQ ID NO: 1313857 - protein, 26 aa, Mycobacterium
DPDAAVALMLRHRCTHMAGATPFLDG

SEQ ID NO: 1313858 - protein, 23 aa, Mycobacterium
DPDALVMVWGKILGCDAAVLAAR

SEQ ID NO: 1313859 - protein, 20 aa, Mycobacterium
DPDAMFLLTEECRTLGLPFA

SEQ ID NO: 1313860 - protein, 22 aa, Mycobacterium
DPDAWRAPYAGLAELGIFGVAL

SEQ ID NO: 1313861 - protein, 20 aa, Mycobacterium
DPDDPGFWAVVRHADIRQVS

SEQ ID NO: 1313862 - protein, 35 aa, Mycobacterium
DPDEFYVHKPTYLAGHRAVLRRLLGDKAVKMILVE

SEQ ID NO: 1313863 - protein, 18 aa, Mycobacterium
DPDLAAMLIDRFADQPSV

SEQ ID NO: 1313864 - protein, 26 aa, Mycobacterium
DPDNYANGYIKLNPKRSLFAIEEELC

SEQ ID NO: 1313865 - protein, 25 aa, Mycobacterium
DPDPDDLFMLIFTSGTSGHPKAVRC

SEQ ID NO: 1313866 - protein, 17 aa, Mycobacterium
DPDRIQLLLADLADSLA

SEQ ID NO: 1313867 - protein, 25 aa, Mycobacterium
DPDRPPHVGVLLGNTPFFSSVLVAA

SEQ ID NO: 1313868 - protein, 18 aa, Mycobacterium
DPEIAYAGPWAQAKFRAG

SEQ ID NO: 1313869 - protein, 19 aa, Mycobacterium
DPEKLMGFVLRSVEEAGAA

SEQ ID NO: 1313870 - protein, 20 aa, Mycobacterium
DPELCRYDRILFASDADPDG

SEQ ID NO: 1313871 - protein, 24 aa, Mycobacterium
DPELFATALALNPTGRMATPQEVA

SEQ ID NO: 1313872 - protein, 27 aa, Mycobacterium
DPERKKLFRGLFRGTGKYYSGVKWTWY

SEQ ID NO: 1313873 - protein, 25 aa, Mycobacterium
DPERLKSGWLNGIKHWQVDYTGQCP

SEQ ID NO: 1313874 - protein, 24 aa, Mycobacterium
DPESEWRDLWGKPLDQRRLAKELK

SEQ ID NO: 1313875 - protein, 17 aa, Mycobacterium
DPFGVRWTVMTRVEDLS

SEQ ID NO: 1313876 - protein, 31 aa, Mycobacterium
DPGAWPLPPATEPLQWWLRAVAAGGQGRYAS

SEQ ID NO: 1313877 - protein, 24 aa, Mycobacterium
DPGEYEWIPLRLPPDVTRVSASIR

SEQ ID NO: 1313878 - protein, 17 aa, Mycobacterium
DPGLIASAHLIAAAGGC

SEQ ID NO: 1313879 - protein, 18 aa, Mycobacterium
DPGRARILLAQHVGSSPL

SEQ ID NO: 1313880 - protein, 24 aa, Mycobacterium
DPHDSSLHLIELTGSAPASACKAA

SEQ ID NO: 1313881 - protein, 24 aa, Mycobacterium
DPHTGAFDLLLADAAPALVGDEIR

SEQ ID NO: 1313882 - protein, 19 aa, Mycobacterium
DPHVIVLFGATGDLAKRKL

SEQ ID NO: 1313883 - protein, 33 aa, Mycobacterium
DPIGHLAFVHAHPRWVAQAFADALGARAGELGA

SEQ ID NO: 1313884 - protein, 25 aa, Mycobacterium
DPIPRRCGPTFPEYWKMFLTALADG

SEQ ID NO: 1313885 - protein, 24 aa, Mycobacterium
DPKTIPFVPFIGGSGPNPLILLKG

SEQ ID NO: 1313886 - protein, 27 aa, Mycobacterium
DPLAAQWIVRVVVSLAYWPDPDPRQEE

SEQ ID NO: 1313887 - protein, 21 aa, Mycobacterium
DPLDVYRMLRVTNPSPYMYLL

SEQ ID NO: 1313888 - protein, 19 aa, Mycobacterium
DPLRIATHERPLLNLAGAV

SEQ ID NO: 1313889 - protein, 20 aa, Mycobacterium
DPLTAARLLLGAKLVGRGVT

SEQ ID NO: 1313890 - protein, 23 aa, Mycobacterium
DPLTTILDPSLPLTVTEWDEWGN

SEQ ID NO: 1313891 - protein, 22 aa, Mycobacterium
DPLVEIPIQWALDDWEQYCFLP

SEQ ID NO: 1313892 - protein, 27 aa, Mycobacterium
DPMECADLLDWPAKLRILEGFRHRENL

SEQ ID NO: 1313893 - protein, 17 aa, Mycobacterium
DPMFFHEYIPVECVLDV

SEQ ID NO: 1313894 - protein, 17 aa, Mycobacterium
DPMLVKRLRRLRASRQK

SEQ ID NO: 1313895 - protein, 26 aa, Mycobacterium
DPNKAIARFIVRYTEAFKKYGITDDT

SEQ ID NO: 1313896 - protein, 30 aa, Mycobacterium
DPNLLVGRYIPNLVPRPFTLDRDFIQEIRD

SEQ ID NO: 1313897 - protein, 23 aa, Mycobacterium
DPNSFFFSTPMEWQQRLWPTEEF

SEQ ID NO: 1313898 - protein, 32 aa, Mycobacterium
DPPAPVREWYFYTSRLTVWRVKPTDWKTKNLI

SEQ ID NO: 1313899 - protein, 26 aa, Mycobacterium
DPPIELVGSFLRPSEYFSKYPTATDQ

SEQ ID NO: 1313900 - protein, 20 aa, Mycobacterium
DPPLSPMPFHANYDAPLYTD

SEQ ID NO: 1313901 - protein, 24 aa, Mycobacterium
DPPSRLRHFITNVRTFLSDDADHL

SEQ ID NO: 1313902 - protein, 31 aa, Mycobacterium
DPQAAQWIVRVVLALLFWPVEDPAAEREMLQ

SEQ ID NO: 1313903 - protein, 33 aa, Mycobacterium; identical to SEQ ID NO: 803224

SEQ ID NO: 1313904 - protein, 18 aa, Mycobacterium
DPQGNVIAWASSGHVGFK

SEQ ID NO: 1313905 - protein, 27 aa, Mycobacterium
DPQPTDLVLYRWHGLGPMGGTDLDAVL

SEQ ID NO: 1313906 - protein, 22 aa, Mycobacterium
DPQQRMALELTWEALEDARIPA

SEQ ID NO: 1313907 - protein, 21 aa, Mycobacterium
DPQQRVALRVSWRALESAQIN

SEQ ID NO: 1313908 - protein, 22 aa, Mycobacterium
DPQSGLTLIKSWASQGWLHRIV

SEQ ID NO: 1313909 - protein, 24 aa, Mycobacterium
DPQTGPLQLIVNLALELADAEQAI

SEQ ID NO: 1313910 - protein, 24 aa, Mycobacterium
DPQVAATGLLTRALRIGLEKEDVE

SEQ ID NO: 1313911 - protein, 17 aa, Mycobacterium
DPRAALFEPATRSLVVL

SEQ ID NO: 1313912 - protein, 26 aa, Mycobacterium
DPRDPLLRLATFFDDGTVELLHERDK

SEQ ID NO: 1313913 - protein, 26 aa, Mycobacterium
DPRDRPRFWIAIEPFGNPRIQYTDGT

SEQ ID NO: 1313914 - protein, 18 aa, Mycobacterium
DPREVLARRFEPVLFFHP

SEQ ID NO: 1313915 - protein, 20 aa, Mycobacterium
DPREVQFYGLDLGGGALAAM

SEQ ID NO: 1313916 - protein, 22 aa, Mycobacterium
DPRGGFGFGPGPRGRRGGGRGR

SEQ ID NO: 1313917 - protein, 22 aa, Mycobacterium
DPRGLTLTGGLPYFGGPGNSYS

SEQ ID NO: 1313918 - protein, 26 aa, Mycobacterium
DPRHTLWQAWHRSGLQKRWLAASERG

SEQ ID NO: 1313919 - protein, 24 aa, Mycobacterium
DPRIPTPVLATYLGNRFPDAGWSR

SEQ ID NO: 1313920 - protein, 18 aa, Mycobacterium
DPRLINRFDYDGDFGTVL

SEQ ID NO: 1313921 - protein, 17 aa, Mycobacterium
DPRLMLTGPIPATEKVL

SEQ ID NO: 1313922 - protein, 19 aa, Mycobacterium
DPRPLIVFGASMGGLLGYE

SEQ ID NO: 1313923 - protein, 50 aa, Mycobacterium
DPRQADFLTLASLKWVIANRAYTPWYLVRYWRLLKFKLANPHIITRGMVF

SEQ ID NO: 1313924 - protein, 17 aa, Mycobacterium
DPRQEEQLLRRFVAPAF

SEQ ID NO: 1313925 - protein, 20 aa, Mycobacterium
DPRRAVVVHPPAGLPAAVLA

SEQ ID NO: 1313926 - protein, 20 aa, Mycobacterium
DPRRGHPVALFGGAAAALER

SEQ ID NO: 1313927 - protein, 17 aa, Mycobacterium
DPRRWVLGWVNERKIAA

SEQ ID NO: 1313928 - protein, 21 aa, Mycobacterium
DPRWDLSQIDLFRGWMRCHEQ

SEQ ID NO: 1313929 - protein, 23 aa, Mycobacterium
DPRYLSVVLIGRVVERLGGIEDV

SEQ ID NO: 1313930 - protein, 22 aa, Mycobacterium
DPSADRYLVFSDGTRVPTDGSL

SEQ ID NO: 1313931 - protein, 26 aa, Mycobacterium
DPSASLWLAALWKEAGLPDGVFNVLQ

SEQ ID NO: 1313932 - protein, 25 aa, Mycobacterium
DPSKIEGLLKGRRLKKPLIAAVEGP

SEQ ID NO: 1313933 - protein, 18 aa, Mycobacterium
DPSLFLRAAEKLGIAVDE

SEQ ID NO: 1313934 - protein, 27 aa, Mycobacterium
DPSLRIVVLEARFAGFGASGRNGGWLS

SEQ ID NO: 1313935 - protein, 26 aa, Mycobacterium
DPSPADLDAFLRLLGDRGVDVLIYNV

SEQ ID NO: 1313936 - protein, 23 aa, Mycobacterium
DPSTFQVLPWTTSAGNHYSARMF

SEQ ID NO: 1313937 - protein, 18 aa, Mycobacterium
DPTEYYVLAAGSAGARDE

SEQ ID NO: 1313938 - protein, 17 aa, Mycobacterium
DPTLIVALATTLGGPTS

SEQ ID NO: 1313939 - protein, 17 aa, Mycobacterium
DPTPFLATLTQFAPLVG

SEQ ID NO: 1313940 - protein, 25 aa, Mycobacterium
DPTVAAFLSIHNMCAWMVDSFGTEE

SEQ ID NO: 1313941 - protein, 24 aa, Mycobacterium
DPTVFPGHWYSAEPSDALSNVKRS

SEQ ID NO: 1313942 - protein, 21 aa, Mycobacterium
DPVHHVLPPAAPERDYYVLSR

SEQ ID NO: 1313943 - protein, 18 aa, Mycobacterium
DPVIMLTGPTPATKKVLD

SEQ ID NO: 1313944 - protein, 17 aa, Mycobacterium
DPVKRRILDAAAAWPLR

SEQ ID NO: 1313945 - protein, 25 aa, Mycobacterium
DPVLAPPMSPFPPPPGAVPPPPPPP

SEQ ID NO: 1313946 - protein, 23 aa, Mycobacterium
DPVLTERVMGLLKPFLKGWHRAE

SEQ ID NO: 1313947 - protein, 35 aa, Mycobacterium
DPVPVPTIAWLTWHIDYWWSAALASMRARPLRAPT

SEQ ID NO: 1313948 - protein, 29 aa, Mycobacterium
DPVRGFFRALDFTLPWDVDAVEDAMPVEI

SEQ ID NO: 1313949 - protein, 20 aa, Mycobacterium
DPWVNMLRTTVAAFAAGVGG

SEQ ID NO: 1313950 - protein, 20 aa, Mycobacterium
DPYIPFGNAPNFAAGRLSYF

SEQ ID NO: 1313951 - protein, 26 aa, Mycobacterium
DPYLTKTGGYPFPLPVADQLQRIADG

SEQ ID NO: 1313952 - protein, 26 aa, Mycobacterium
DQAAALLPILELKAGRIVFNGWPTGV

SEQ ID NO: 1313953 - protein, 18 aa, Mycobacterium
DQARRIAAEIGYPVLVRP

SEQ ID NO: 1313954 - protein, 18 aa, Mycobacterium
DQASFLGLRALGRGPLIQ

SEQ ID NO: 1313955 - protein, 28 aa, Mycobacterium
DQATVSRRLALLLLAPEVRAAVDGGQLP

SEQ ID NO: 1313956 - protein, 17 aa, Mycobacterium
DQELFKFRVASNSRRRT

SEQ ID NO: 1313957 - protein, 23 aa, Mycobacterium
DQFFRTTPHLPLSWQRKAIQLVA

SEQ ID NO: 1313958 - protein, 20 aa, Mycobacterium
DQGAFFFLEMNTRLQVEHPV

SEQ ID NO: 1313959 - protein, 19 aa, Mycobacterium
DQGLPVPRLLPGSEVTRLN

SEQ ID NO: 1313960 - protein, 20 aa, Mycobacterium
DQGLSLTLFFKDTATTRDVN

SEQ ID NO: 1313961 - protein, 30 aa, Mycobacterium; identical to SEQ ID NO: 119584

SEQ ID NO: 1313962 - protein, 26 aa, Mycobacterium
DQKERYLKPIRLGDAVWTQLFSEPGA

SEQ ID NO: 1313963 - protein, 22 aa, Mycobacterium
DQKKRWLPGIISGELIVAVAMT

SEQ ID NO: 1313964 - protein, 29 aa, Mycobacterium
DQKRHPFLGMPFWLGRGFGLNLSVVTDPA

SEQ ID NO: 1313965 - protein, 30 aa, Mycobacterium
DQKWGELVYDGLWFSPLKTALESFVANTQE

SEQ ID NO: 1313966 - protein, 24 aa, Mycobacterium
DQLGFDVNTPWKKLPAKARRAILE

SEQ ID NO: 1313967 - protein, 29 aa, Mycobacterium
DQLGRALPSLLLPLWDSELGKGFIATLRS

SEQ ID NO: 1313968 - protein, 21 aa, Mycobacterium
DQLGWRPNFSAAETLSALASS

SEQ ID NO: 1313969 - protein, 19 aa, Mycobacterium
DQLLAEHLQKVSLSFLVDD

SEQ ID NO: 1313970 - protein, 22 aa, Mycobacterium
DQLPEIWAGWDFEFWEDRYEEQ

SEQ ID NO: 1313971 - protein, 24 aa, Mycobacterium
DQLWDRYRQGAMYPYVATLITAGM

SEQ ID NO: 1313972 - protein, 22 aa, Mycobacterium
DQMLAYNCSPSFNWKKHLDDAT

SEQ ID NO: 1313973 - protein, 26 aa, Mycobacterium
DQNTKYPLLLHEPYVRLYPAQVVKQA

SEQ ID NO: 1313974 - protein, 20 aa, Mycobacterium
DQPALRFLGNTTTWGELDRR

SEQ ID NO: 1313975 - protein, 29 aa, Mycobacterium
DQQYRAVASGHWPLLRFDPVMRAAGKNPF

SEQ ID NO: 1313976 - protein, 25 aa, Mycobacterium
DQRDRLLNVVRKDAPWRLIIAQHFS

SEQ ID NO: 1313977 - protein, 19 aa, Mycobacterium
DQREAFAWHIDLAKRTGKP

SEQ ID NO: 1313978 - protein, 20 aa, Mycobacterium
DQRGPERVPIPRIGQRFDQG

SEQ ID NO: 1313979 - protein, 17 aa, Mycobacterium
DQRIAVRYTLPGMTPAD

SEQ ID NO: 1313980 - protein, 17 aa, Mycobacterium
DQRVHGLRLPRHVHRIG

SEQ ID NO: 1313981 - protein, 25 aa, Mycobacterium
DQRYRDRYIFAGLQPGQRIPKKWLE

SEQ ID NO: 1313982 - protein, 37 aa, Mycobacterium
DQRYRNSYLLAAELFPRMPIPQAWFDAGIAYRSTDLP

SEQ ID NO: 1313983 - protein, 22 aa, Mycobacterium
DQSTRVALPWRPGTDAVIADMV

SEQ ID NO: 1313984 - protein, 20 aa, Mycobacterium
DQSVFGFRGADPALLHMEEG

SEQ ID NO: 1313985 - protein, 28 aa, Mycobacterium
DQSVPYFALTMLPGGRRAASVTGSVAVV

SEQ ID NO: 1313986 - protein, 18 aa, Mycobacterium
DQSWRYKDLQYWTDLAKL

SEQ ID NO: 1313987 - protein, 24 aa, Mycobacterium
DQTRPLFLHGGRFSVLLAHHLGAH

SEQ ID NO: 1313988 - protein, 25 aa, Mycobacterium
DQTRWRIAVEKVLRGAGLRLLVPDQ

SEQ ID NO: 1313989 - protein, 25 aa, Mycobacterium
DQVEDVAMKLFWERGFGGVSISDVT

SEQ ID NO: 1313990 - protein, 20 aa, Mycobacterium
DQVFYGHVLGFKGLERRAVV

SEQ ID NO: 1313991 - protein, 21 aa, Mycobacterium
DQVFYGHVLGFKGLERRCVVL

SEQ ID NO: 1313992 - protein, 27 aa, Mycobacterium
DQVGIPLRRYVLWSRLRLAVMRVQAGD

SEQ ID NO: 1313993 - protein, 23 aa, Mycobacterium
DQVVLFPFAAGVATWWRTVGPKV

SEQ ID NO: 1313994 - protein, 32 aa, Mycobacterium
DQWAPDGTMSFPFAPPGWPELAGRDAVREYLA

SEQ ID NO: 1313995 - protein, 18 aa, Mycobacterium
DQWATVRTNPITGALDVL

SEQ ID NO: 1313996 - protein, 22 aa, Mycobacterium
DQWPLNLGSERDWGFSAVATSH

SEQ ID NO: 1313997 - protein, 21 aa, Mycobacterium
DQWRQFGFDLDFSELVYTGER

SEQ ID NO: 1313998 - protein, 23 aa, Mycobacterium
DQYDITGYWRRDSEAWDVRFARA

SEQ ID NO: 1313999 - protein, 18 aa, Mycobacterium
DQYDWKIQIAGRPHRAVL

SEQ ID NO: 1314000 - protein, 26 aa, Mycobacterium
DQYRDLALVLHDLSWRLARFGPAQVG

SEQ ID NO: 1314001 - protein, 29 aa, Mycobacterium
DRAAWRRFQVRLTLPPPSRIQATAFLEQL

SEQ ID NO: 1314002 - protein, 34 aa, Mycobacterium
DRADLYLPIRPGTDVALLNGLLHLLVERGDIDEE

SEQ ID NO: 1314003 - protein, 25 aa, Mycobacterium
DRADNTWRVVRYDAPYYWCLADTNG

SEQ ID NO: 1314004 - protein, 20 aa, Mycobacterium
DRAEFGWEPAVDSWLGEWDE

SEQ ID NO: 1314005 - protein, 26 aa, Mycobacterium
DRALRPVRAPRWLLTPARQRARSAVN

SEQ ID NO: 1314006 - protein, 19 aa, Mycobacterium
DRAQLLERLVIAVSTAAGM

SEQ ID NO: 1314007 - protein, 20 aa, Mycobacterium
DRARARYSWDRIAADTLRIY

SEQ ID NO: 1314008 - protein, 32 aa, Mycobacterium
DRAREMTRLLRRILELPLPVIAAVDGHVRAGG

SEQ ID NO: 1314009 - protein, 24 aa, Mycobacterium
DRATLRISSQLLANWLRHGVITEE

SEQ ID NO: 1314010 - protein, 23 aa, Mycobacterium
DRAVSFVVPISAPGLKLLCRRPY

SEQ ID NO: 1314011 - protein, 24 aa, Mycobacterium
DRAYAMNLALIRRAADLTQVELAR

SEQ ID NO: 1314012 - protein, 25 aa, Mycobacterium
DRDAKLFHLTDVPPLILTSSDAVED

SEQ ID NO: 1314013 - protein, 24 aa, Mycobacterium
DRDAYVNAGLPWFDYYDADARDLA

SEQ ID NO: 1314014 - protein, 28 aa, Mycobacterium
DRDEEATLLAGLPVRRLWGIGPVAEDRL

SEQ ID NO: 1314015 - protein, 27 aa, Mycobacterium
DRDEHIERLAALGPIPLVLISHRHADH

SEQ ID NO: 1314016 - protein, 28 aa, Mycobacterium
DRDGSDAMRWFLMASPILRGGNLIVTEQ

SEQ ID NO: 1314017 - protein, 18 aa, Mycobacterium
DRDHPLWEMYIAEGLADN

SEQ ID NO: 1314018 - protein, 34 aa, Mycobacterium
DRDNDFEPLLLDWRAPLSRAFYVATAAHPEGMQR

SEQ ID NO: 1314019 - protein, 17 aa, Mycobacterium
DRDSVLRKAPWVDVVFG

SEQ ID NO: 1314020 - protein, 22 aa, Mycobacterium
DREAVWIELIGKLVPQTAPAEA

SEQ ID NO: 1314021 - protein, 26 aa, Mycobacterium
DREAWNTLVLPWFRGINSVVGVQRTG

SEQ ID NO: 1314022 - protein, 21 aa, Mycobacterium
DREFEKWLGCYADDVVYWMPS

SEQ ID NO: 1314023 - protein, 29 aa, Mycobacterium
DREFRAGHFPGLQWPITLGHEIAGTVAEL

SEQ ID NO: 1314024 - protein, 19 aa, Mycobacterium
DREGLPSIQTWSATAPFVN

SEQ ID NO: 1314025 - protein, 27 aa, Mycobacterium
DREGPLATMGLFPPGSTFKIVTAGAAI

SEQ ID NO: 1314026 - protein, 28 aa, Mycobacterium
DRELRRHILTLWQTALIRLSRLKIQDEI

SEQ ID NO: 1314027 - protein, 22 aa, Mycobacterium
DRERALLRLLEGPRFCGHPDLA

SEQ ID NO: 1314028 - protein, 21 aa, Mycobacterium
DRERLGLPVFVKPSRGGSSIG

SEQ ID NO: 1314029 - protein, 18 aa, Mycobacterium
DRERLRLHYLALSRAVVE

SEQ ID NO: 1314030 - protein, 20 aa, Mycobacterium
DRFAARGFAFYALDLHKCGR

SEQ ID NO: 1314031 - protein, 34 aa, Mycobacterium
DRFDAVIADALFLGTLPLLLGDPAKRPPILSYST

SEQ ID NO: 1314032 - protein, 23 aa, Mycobacterium
DRFFGDPSWRRLFFEARTSDDGT

SEQ ID NO: 1314033 - protein, 26 aa, Mycobacterium
DRFGGVGAIVLTIPIAPTNTSPVGSA

SEQ ID NO: 1314034 - protein, 22 aa, Mycobacterium
DRFHLVEQFRYPIGMRRWEFPQ

SEQ ID NO: 1314035 - protein, 23 aa, Mycobacterium
DRFRFLAGFLAGRPVGVAEVPAG

SEQ ID NO: 1314036 - protein, 25 aa, Mycobacterium
DRFRRWMLDYVRFHRSYRGVIRAWF

SEQ ID NO: 1314037 - protein, 22 aa, Mycobacterium
DRFTDRPVWITGVGLGLDSVMH

SEQ ID NO: 1314038 - protein, 25 aa, Mycobacterium
DRFTPLNLKYRIFHKVLTAGAQVDG

SEQ ID NO: 1314039 - protein, 25 aa, Mycobacterium
DRGALAPSRRTAWVDLIAADSAMAD

SEQ ID NO: 1314040 - protein, 23 aa, Mycobacterium
DRGELDRWLVNRNGLDLVREFSV

SEQ ID NO: 1314041 - protein, 28 aa, Mycobacterium
DRGFFDDLVTPFLGLYRDNNLRADSSVE

SEQ ID NO: 1314042 - protein, 32 aa, Mycobacterium
DRGLEPWMVWLSEAGLPLPYRTWEAIFSTAND

SEQ ID NO: 1314043 - protein, 34 aa, Mycobacterium
DRGLHVLVFGPFRALRLATALRCAAGTTERSRCA

SEQ ID NO: 1314044 - protein, 40 aa, Mycobacterium
DRGQIYVVPQLDAKVLWQLKRALPGPFTRTLGLVERMASW

SEQ ID NO: 1314045 - protein, 17 aa, Mycobacterium
DRHISLTALICGADPEA

SEQ ID NO: 1314046 - protein, 24 aa, Mycobacterium
DRHLAPRPGTDAALLFAVAHVLFD

SEQ ID NO: 1314047 - protein, 19 aa, Mycobacterium
DRHRLQLVAVPTTSGTGSE

SEQ ID NO: 1314048 - protein, 19 aa, Mycobacterium
DRHVPVPEPVWKKLKAELP

SEQ ID NO: 1314049 - protein, 20 aa, Mycobacterium
DRIDAKPPLLRRATAYIEGN

SEQ ID NO: 1314050 - protein, 19 aa, Mycobacterium
DRIDIGDRMAIACALGGPE

SEQ ID NO: 1314051 - protein, 17 aa, Mycobacterium
DRILPIMNDVAAVDSPI

SEQ ID NO: 1314052 - protein, 23 aa, Mycobacterium
DRIVEWLVDKFKGTSGIDLTKDK

SEQ ID NO: 1314053 - protein, 18 aa, Mycobacterium
DRIWSGRVNRWLAEVAAS

SEQ ID NO: 1314054 - protein, 22 aa, Mycobacterium
DRIYAAWLWSRRRAVIGGLSAA

SEQ ID NO: 1314055 - protein, 20 aa, Mycobacterium
DRKAIFVYDAGTPVFELVDP

SEQ ID NO: 1314056 - protein, 19 aa, Mycobacterium
DRLAAEEWRSLRLAIKQET

SEQ ID NO: 1314057 - protein, 22 aa, Mycobacterium
DRLESLPIRAIVRSPLLRCERT

SEQ ID NO: 1314058 - protein, 27 aa, Mycobacterium
DRLFELIERMQLPTVFFAEGGGGRPGD

SEQ ID NO: 1314059 - protein, 19 aa, Mycobacterium
DRLFLFGAGRGAACARALA

SEQ ID NO: 1314060 - protein, 33 aa, Mycobacterium
DRLHVVALPMRVRFRGITTRELALIDGPAGWGE

SEQ ID NO: 1314061 - protein, 18 aa, Mycobacterium
DRLLAKGGTMLGTARVNP

SEQ ID NO: 1314062 - protein, 18 aa, Mycobacterium
DRLLDHITALSAPGSRLA

SEQ ID NO: 1314063 - protein, 19 aa, Mycobacterium
DRLLGEEFTILQLRRAHEQ

SEQ ID NO: 1314064 - protein, 27 aa, Mycobacterium
DRLLGGSDAWLAMWLATSSSVPDGWKR

SEQ ID NO: 1314065 - protein, 22 aa, Mycobacterium
DRLLVDLIHEAFRRMFERHGQH

SEQ ID NO: 1314066 - protein, 19 aa, Mycobacterium
DRLWQVCQPVLDAPPQALT

SEQ ID NO: 1314067 - protein, 18 aa, Mycobacterium
DRLYFEPLTFEDVLEIYY

SEQ ID NO: 1314068 - protein, 19 aa, Mycobacterium
DRMEVLSWFLVERDAPEWL

SEQ ID NO: 1314069 - protein, 21 aa, Mycobacterium
DRMPLTISAPDWDRWLDPDAP

SEQ ID NO: 1314070 - protein, 17 aa, Mycobacterium
DRMVLLDHLTRGRVMLG

SEQ ID NO: 1314071 - protein, 33 aa, Mycobacterium; identical to SEQ ID NO: 113957

SEQ ID NO: 1314072 - protein, 24 aa, Mycobacterium
DRPAEWELLLRLAGAMFGTQVPDV

SEQ ID NO: 1314073 - protein, 26 aa, Mycobacterium
DRPELLKRYLDRWYWEVKGHVGGLTP

SEQ ID NO: 1314074 - protein, 18 aa, Mycobacterium
DRPLRDVRILFGDDPAVP

SEQ ID NO: 1314075 - protein, 18 aa, Mycobacterium
DRPVVLVAHGGLIAALTA

SEQ ID NO: 1314076 - protein, 18 aa, Mycobacterium
DRQAFGGALLDEPTIRFT

SEQ ID NO: 1314077 - protein, 24 aa, Mycobacterium
DRQRELLRLMTLIEGLDDATPRLR

SEQ ID NO: 1314078 - protein, 24 aa, Mycobacterium
DRQRSRLLPALLSGERIATLAAAR

SEQ ID NO: 1314079 - protein, 26 aa, Mycobacterium
DRRDWPLFRTVFTDDCALDYGDIGTF

SEQ ID NO: 1314080 - protein, 22 aa, Mycobacterium
DRRHWHTPCWTHRATRGPTRRW

SEQ ID NO: 1314081 - protein, 19 aa, Mycobacterium
DRRLLTYTSAPLDRAVEVT

SEQ ID NO: 1314082 - protein, 28 aa, Mycobacterium
DRSGFVVNALLVPYLLSAIRMAEAGVAT

SEQ ID NO: 1314083 - protein, 20 aa, Mycobacterium
DRSLAVARRLRAGFIGLNGT

SEQ ID NO: 1314084 - protein, 20 aa, Mycobacterium
DRSLFKGTLLHGKVICPGHQ

SEQ ID NO: 1314085 - protein, 19 aa, Mycobacterium
DRSLICLPSTFQKDGRLQS

SEQ ID NO: 1314086 - protein, 19 aa, Mycobacterium
DRSRPLWEKWIIEGIDGTD

SEQ ID NO: 1314087 - protein, 27 aa, Mycobacterium
DRSVVPVRVFWIPGGLPTRSKVVAVLS

SEQ ID NO: 1314088 - protein, 23 aa, Mycobacterium
DRTANLLVVRYLDGSLVMGSVAE

SEQ ID NO: 1314089 - protein, 17 aa, Mycobacterium
DRTFALFTREPRRGSSP

SEQ ID NO: 1314090 - protein, 25 aa, Mycobacterium
DRTGALRTLKIPTLVIHGRADRMCD

SEQ ID NO: 1314091 - protein, 24 aa, Mycobacterium
DRTGKMIFSIDECLDYVVARMPLA

SEQ ID NO: 1314092 - protein, 28 aa, Mycobacterium
DRTKVRTRLIELFDLFDPADPEVVAGRR

SEQ ID NO: 1314093 - protein, 25 aa, Mycobacterium
DRTVALWRKRFDDVHIYPVAFHGDV

SEQ ID NO: 1314094 - protein, 21 aa, Mycobacterium
DRTWLRTGDLGFYLDGELYVT

SEQ ID NO: 1314095 - protein, 20 aa, Mycobacterium
DRVAPGDLISLPLPDAPDAE

SEQ ID NO: 1314096 - protein, 18 aa, Mycobacterium
DRVDPVGWLAKRGLTPGG

SEQ ID NO: 1314097 - protein, 20 aa, Mycobacterium
DRVGIAWLRHTCGTCRYCLR

SEQ ID NO: 1314098 - protein, 32 aa, Mycobacterium
DRVIAPDFDFMLIGAAFYRDRYRRTPDGWKIC

SEQ ID NO: 1314099 - protein, 27 aa, Mycobacterium
DRVIAPDFNFMLIGAGFYHDRYRRTPD

SEQ ID NO: 1314100 - protein, 19 aa, Mycobacterium
DRVMRVNLLGVMAGTRDAG

SEQ ID NO: 1314101 - protein, 26 aa, Mycobacterium
DRVRAHLDLAVTWPHSLPGVGAAVQR

SEQ ID NO: 1314102 - protein, 22 aa, Mycobacterium
DRVTRVLGWAEEDYDMFVAKPL

SEQ ID NO: 1314103 - protein, 19 aa, Mycobacterium
DRVTTYALYIDPPLGRAGM

SEQ ID NO: 1314104 - protein, 19 aa, Mycobacterium
DRWGQEVVAVVALADGAQA

SEQ ID NO: 1314105 - protein, 23 aa, Mycobacterium
DRWRSHGFDVDFSELVFLGERAD

SEQ ID NO: 1314106 - protein, 28 aa, Mycobacterium
DRWVNPDFLQFGYRTSILKKSSAWVVLE

SEQ ID NO: 1314107 - protein, 25 aa, Mycobacterium
DRYTITDLAAPALPLVFLGAPVKNP

SEQ ID NO: 1314108 - protein, 17 aa, Mycobacterium
DSAERVAFLFPGQGAQH

SEQ ID NO: 1314109 - protein, 19 aa, Mycobacterium
DSAFGLVKINPLAAWSDDD

SEQ ID NO: 1314110 - protein, 17 aa, Mycobacterium
DSAILTVGLLEGSMLEE

SEQ ID NO: 1314111 - protein, 22 aa, Mycobacterium
DSALLAAARRLAPGGAVVVGGE

SEQ ID NO: 1314112 - protein, 22 aa, Mycobacterium
DSALQAARWAGAVAATCGAPLH

SEQ ID NO: 1314113 - protein, 24 aa, Mycobacterium
DSARHVVFEVVTSRGMYLGRSDSV

SEQ ID NO: 1314114 - protein, 23 aa, Mycobacterium
DSARLWFEVAKPLMSTNPQRSGP

SEQ ID NO: 1314115 - protein, 24 aa, Mycobacterium
DSASLLTAPLLRTSARRLAERTPL

SEQ ID NO: 1314116 - protein, 24 aa, Mycobacterium
DSATGRWTFTPTASTLVSAWSSDT

SEQ ID NO: 1314117 - protein, 24 aa, Mycobacterium
DSAVLLELIERYAPKLSLIVTSHQ

SEQ ID NO: 1314118 - protein, 17 aa, Mycobacterium
DSDAGLISLLDDPAKTA

SEQ ID NO: 1314119 - protein, 24 aa, Mycobacterium
DSDDVLPFITLRQWQPISEDETEV

SEQ ID NO: 1314120 - protein, 23 aa, Mycobacterium
DSDPHIPSLFRVYPTTDWHERET

SEQ ID NO: 1314121 - protein, 21 aa, Mycobacterium
DSDQLLDIDLLISATKDAIYL

SEQ ID NO: 1314122 - protein, 28 aa, Mycobacterium
DSDRLRGELPAREEFREALSGRQRKIRS

SEQ ID NO: 1314123 - protein, 30 aa, Mycobacterium
DSDRLRGELPAREEFREALSGRQRKIRSTV

SEQ ID NO: 1314124 - protein, 20 aa, Mycobacterium
DSEIKRAYRKLARELHPDVN

SEQ ID NO: 1314125 - protein, 21 aa, Mycobacterium
DSEKLIKWISAALGGIKPTTA

SEQ ID NO: 1314126 - protein, 25 aa, Mycobacterium
DSEQPIFVGWALGIDELAWANAMYG

SEQ ID NO: 1314127 - protein, 26 aa, Mycobacterium
DSESFEFWREFLASLKARGLSGVHLV

SEQ ID NO: 1314128 - protein, 27 aa, Mycobacterium
DSGAITRPALLDFVRNYKGQGVAREYQ

SEQ ID NO: 1314129 - protein, 26 aa, Mycobacterium
DSHAPGQLEFLGYGAQRALDVGLEAE

SEQ ID NO: 1314130 - protein, 28 aa, Mycobacterium
DSHIVVNYDLPWAIIRLIQRAGRVDRVG

SEQ ID NO: 1314131 - protein, 19 aa, Mycobacterium
DSHLPADRRPARGIAARAV

SEQ ID NO: 1314132 - protein, 24 aa, Mycobacterium
DSHLPGISPMAAVSIFIDGTKDIL

SEQ ID NO: 1314133 - protein, 17 aa, Mycobacterium
DSHPFWTGSRRIVDAAG

SEQ ID NO: 1314134 - protein, 27 aa, Mycobacterium
DSHRPALEVLLLGGRPIREPVFQYGPF

SEQ ID NO: 1314135 - protein, 24 aa, Mycobacterium
DSIAFRLMFNTLRATYEPALPALA

SEQ ID NO: 1314136 - protein, 25 aa, Mycobacterium
DSIAFRLMYNTLRATYEPALPALAA

SEQ ID NO: 1314137 - protein, 24 aa, Mycobacterium
DSILRALALNRFAKVPTLVGGQML

SEQ ID NO: 1314138 - protein, 20 aa, Mycobacterium
DSIRLAFSLLAAEGAVASVG

SEQ ID NO: 1314139 - protein, 22 aa, Mycobacterium
DSKISTVWTWPDRPGVAGCAAL

SEQ ID NO: 1314140 - protein, 23 aa, Mycobacterium
DSKIVEIPRPAGVVLALTPTTNP

SEQ ID NO: 1314141 - protein, 27 aa, Mycobacterium
DSLADKFTGFLQKMLQLFTDLDENTAA

SEQ ID NO: 1314142 - protein, 19 aa, Mycobacterium
DSLANLVKVRPGHEAAIAA

SEQ ID NO: 1314143 - protein, 19 aa, Mycobacterium
DSLIYSAAFVLCVGRDETE

SEQ ID NO: 1314144 - protein, 20 aa, Mycobacterium
DSMILPPVAHDVRVISIAMF

SEQ ID NO: 1314145 - protein, 26 aa, Mycobacterium
DSMRAGLKALAWMSRGGASKGRSWAV

SEQ ID NO: 1314146 - protein, 24 aa, Mycobacterium
DSNNPWLNQLYPTVKVPHVDTSVR

SEQ ID NO: 1314147 - protein, 27 aa, Mycobacterium
DSPELLEKLQPLLEKFSAELDAKSSAS

SEQ ID NO: 1314148 - protein, 35 aa, Mycobacterium
DSPFPGLTTHAYLWTPANILFYSPATDAQFNELTE

SEQ ID NO: 1314149 - protein, 29 aa, Mycobacterium
DSPKPPPRRITLTLPAITRSREVWLVVSG

SEQ ID NO: 1314150 - protein, 25 aa, Mycobacterium
DSPKTGRLSGRFWKLLGASTDKDQA

SEQ ID NO: 1314151 - protein, 19 aa, Mycobacterium
DSPLMRAMCSEVVDVDTLT

SEQ ID NO: 1314152 - protein, 17 aa, Mycobacterium
DSPQAKEILRNYAIRRP

SEQ ID NO: 1314153 - protein, 24 aa, Mycobacterium
DSRAVTPGGLFLALPGARSDGHDF

SEQ ID NO: 1314154 - protein, 17 aa, Mycobacterium
DSRLRWLRRGEVPTLGN

SEQ ID NO: 1314155 - protein, 17 aa, Mycobacterium
DSRPWDILLATTAINRF

SEQ ID NO: 1314156 - protein, 19 aa, Mycobacterium
DSRQHDWGIDPPAGPAPLG

SEQ ID NO: 1314157 - protein, 19 aa, Mycobacterium
DSRRLLLMIGKDMGLDTKR

SEQ ID NO: 1314158 - protein, 29 aa, Mycobacterium
DSRTLVPVDGFLPAAPMPAGPDPGRLARF

SEQ ID NO: 1314159 - protein, 25 aa, Mycobacterium
DSRVVRWIDALPQYGPGHAALVAEL

SEQ ID NO: 1314160 - protein, 26 aa, Mycobacterium
DSSDAAFPYSWNPRYPARVGVMPREG

SEQ ID NO: 1314161 - protein, 22 aa, Mycobacterium
DSSDLPWHRVIAASGRPAVHLA

SEQ ID NO: 1314162 - protein, 21 aa, Mycobacterium
DSSIRFLVGRTRCLPTGCESS

SEQ ID NO: 1314163 - protein, 23 aa, Mycobacterium
DSSPYVTPLVRKLAGEHSVDLAS

SEQ ID NO: 1314164 - protein, 25 aa, Mycobacterium
DSSRAAVLADWWSAVLGGTVDGFED

SEQ ID NO: 1314165 - protein, 23 aa, Mycobacterium
DSTFYGDLFPHAVKWRGNVYLED

SEQ ID NO: 1314166 - protein, 29 aa, Mycobacterium
DSTGRRFISLPIAGIMRLADKPEADAVEV

SEQ ID NO: 1314167 - protein, 21 aa, Mycobacterium
DSVAQLELLLPAMAGLVGTLR

SEQ ID NO: 1314168 - protein, 22 aa, Mycobacterium
DSVLHFFRRALRLRRDRCGVDG

SEQ ID NO: 1314169 - protein, 23 aa, Mycobacterium
DSVVKVVKVVGFVASAPGFDGQP

SEQ ID NO: 1314170 - protein, 17 aa, Mycobacterium
DSVVVAGGLLQRAGGET

SEQ ID NO: 1314171 - protein, 18 aa, Mycobacterium
DSVVVAGGLLQRAGGETA

SEQ ID NO: 1314172 - protein, 29 aa, Mycobacterium
DSWDRYQAAQWFNLRRWLDDNPDDELAAE

SEQ ID NO: 1314173 - protein, 17 aa, Mycobacterium
DSWRRAVVEETGLPFSR

SEQ ID NO: 1314174 - protein, 17 aa, Mycobacterium
DSWVRRYPDVHVELVAA

SEQ ID NO: 1314175 - protein, 22 aa, Mycobacterium
DSYLQCLRILMAGRGYPMVASH

SEQ ID NO: 1314176 - protein, 19 aa, Mycobacterium
DSYRIQLSTDRLGGAGTAG

SEQ ID NO: 1314177 - protein, 26 aa, Mycobacterium
DTAASLPVMVWIPGGAFVYGAGQFQL

SEQ ID NO: 1314178 - protein, 24 aa, Mycobacterium
DTAELLAHLAIPIPTVVTPQMFTH

SEQ ID NO: 1314179 - protein, 25 aa, Mycobacterium
DTAIVIERALLRLPVEQRAAVVAVD

SEQ ID NO: 1314180 - protein, 18 aa, Mycobacterium
DTAVVAAGLLLRAGGDTA

SEQ ID NO: 1314181 - protein, 18 aa, Mycobacterium
DTAYAWAYNVDKGQKTRI

SEQ ID NO: 1314182 - protein, 26 aa, Mycobacterium
DTCYLSMPLFHSNAIMAGWAPGVAAG

SEQ ID NO: 1314183 - protein, 20 aa, Mycobacterium
DTDAIRALARADAAHSADLA

SEQ ID NO: 1314184 - protein, 26 aa, Mycobacterium
DTDDLTPLQLAVPSEFRAAPRADRRP

SEQ ID NO: 1314185 - protein, 26 aa, Mycobacterium
DTDISWSRITYWRALLASAIDDPPHE

SEQ ID NO: 1314186 - protein, 23 aa, Mycobacterium
DTDLAAYRWPIQSEVDWVLTTAA

SEQ ID NO: 1314187 - protein, 26 aa, Mycobacterium
DTDLMDQAWWSPGLTHPDGTSAFALW

SEQ ID NO: 1314188 - protein, 23 aa, Mycobacterium
DTDSELFTRYWPADLHMVGKDII

SEQ ID NO: 1314189 - protein, 22 aa, Mycobacterium
DTEALRIAPHPGWRVEVDNVAV

SEQ ID NO: 1314190 - protein, 33 aa, Mycobacterium
DTEGLFDPRLKRPIPFLPGTIGLITGRASAAEH

SEQ ID NO: 1314191 - protein, 23 aa, Mycobacterium
DTELEFFIVYSSGSSVLGSPGQA

SEQ ID NO: 1314192 - protein, 29 aa, Mycobacterium
DTEPWRGEPLLSFLRKMVFWADVVVEPAD

SEQ ID NO: 1314193 - protein, 32 aa, Mycobacterium
DTETSLVHRVLPIGAPIRDIAYAGGAVYVLTS

SEQ ID NO: 1314194 - protein, 22 aa, Mycobacterium
DTEVLLPGHGPLWRGPIREAAQ

SEQ ID NO: 1314195 - protein, 22 aa, Mycobacterium
DTEVMILPLAGGGTVECHGEVF

SEQ ID NO: 1314196 - protein, 32 aa, Mycobacterium
DTEVPVDLAVFPAFLFIPISAGGTMVVPPIDF

SEQ ID NO: 1314197 - protein, 23 aa, Mycobacterium
DTEWRTEYLYSRAATIYGGTAEV

SEQ ID NO: 1314198 - protein, 20 aa, Mycobacterium
DTFAYARRAAGLPATAINWG

SEQ ID NO: 1314199 - protein, 18 aa, Mycobacterium
DTFIPGRVAELRPSSRRE

SEQ ID NO: 1314200 - protein, 17 aa, Mycobacterium
DTFLAADLVIDASGRNS

SEQ ID NO: 1314201 - protein, 18 aa, Mycobacterium
DTFLVPSPIAHIGGSIYA

SEQ ID NO: 1314202 - protein, 24 aa, Mycobacterium
DTGGTVVPLPLPPPDGYAAGADGN

SEQ ID NO: 1314203 - protein, 28 aa, Mycobacterium
DTGKRIERALALTALLRATLTTVRTPGA

SEQ ID NO: 1314204 - protein, 19 aa, Mycobacterium
DTGLWAPYRHSVSPLLAAA

SEQ ID NO: 1314205 - protein, 23 aa, Mycobacterium
DTGSWKVPQPGRDSRRGRGIALM

SEQ ID NO: 1314206 - protein, 17 aa, Mycobacterium
DTGTEWGLGALAGAKAL

SEQ ID NO: 1314207 - protein, 23 aa, Mycobacterium
DTHAALRYRAVPDRYLVFEDFAL

SEQ ID NO: 1314208 - protein, 23 aa, Mycobacterium
DTHDIHALNPPRHQLRNSDGLIV

SEQ ID NO: 1314209 - protein, 20 aa, Mycobacterium
DTHDRLFRFADTLLFGLSEE

SEQ ID NO: 1314210 - protein, 24 aa, Mycobacterium
DTHGSTLRFAPPLVITADEIDWAI

SEQ ID NO: 1314211 - protein, 23 aa, Mycobacterium
DTHGTVLQRGAFASSLAGGGVVP

SEQ ID NO: 1314212 - protein, 23 aa, Mycobacterium
DTIINMPAPTWTVGDPRTYTLAD

SEQ ID NO: 1314213 - protein, 31 aa, Mycobacterium
DTIRRKTRIAGLLTLLFAQPLSRIVALRSSQ

SEQ ID NO: 1314214 - protein, 38 aa, Mycobacterium
DTKAGSILCDPWLNPAYFASWFPFPDNSDLDWAALGDV

SEQ ID NO: 1314215 - protein, 27 aa, Mycobacterium
DTKARVEDIYLPFKPKRRTKAQIAREA

SEQ ID NO: 1314216 - protein, 23 aa, Mycobacterium
DTLAALPMNLPASVAPLAADFMA

SEQ ID NO: 1314217 - protein, 30 aa, Mycobacterium
DTLEHLLIGTSLPWLLPPALGDLQTINEFA

SEQ ID NO: 1314218 - protein, 18 aa, Mycobacterium
DTLPVRQLFTVRIGLRLT

SEQ ID NO: 1314219 - protein, 22 aa, Mycobacterium
DTLSVRLIRRLAGLGILTQTVD

SEQ ID NO: 1314220 - protein, 19 aa, Mycobacterium
DTMLTPLNIRLMHIMSPMD

SEQ ID NO: 1314221 - protein, 24 aa, Mycobacterium
DTNVYYRRALVLAASFGRASDYPQ

SEQ ID NO: 1314222 - protein, 19 aa, Mycobacterium
DTPGQLELRIAPRTLLCAN

SEQ ID NO: 1314223 - protein, 18 aa, Mycobacterium
DTPIPFRASAMQGLALAV

SEQ ID NO: 1314224 - protein, 25 aa, Mycobacterium
DTPKALIALDAWCTEALDGGGSDVT

SEQ ID NO: 1314225 - protein, 19 aa, Mycobacterium
DTPKFFHYVKKDKIAESAV

SEQ ID NO: 1314226 - protein, 35 aa, Mycobacterium
DTPRTVRFLPMEELIAAFLPVLFPGLEVVEHHAFR

SEQ ID NO: 1314227 - protein, 26 aa, Mycobacterium
DTPVGLLHMAVLASPVPHARIRSIDT

SEQ ID NO: 1314228 - protein, 18 aa, Mycobacterium
DTPVGRLGMLIDYDKTFP

SEQ ID NO: 1314229 - protein, 24 aa, Mycobacterium
DTPYSGVAAIFRSALEAGDVPRVF

SEQ ID NO: 1314230 - protein, 25 aa, Mycobacterium
DTRAKKALELTFRQALRLGHNYVGT

SEQ ID NO: 1314231 - protein, 19 aa, Mycobacterium
DTRDDILALLLRSTYEDGS

SEQ ID NO: 1314232 - protein, 17 aa, Mycobacterium
DTRFYFVHSYAAQQWEG

SEQ ID NO: 1314233 - protein, 18 aa, Mycobacterium
DTRLLGETELWQLAFRVV

SEQ ID NO: 1314234 - protein, 18 aa, Mycobacterium
DTRVLRGWSTLPITLGTA

SEQ ID NO: 1314235 - protein, 26 aa, Mycobacterium
DTSEAPLLRPVARTGPPPLSYAQELM

SEQ ID NO: 1314236 - protein, 17 aa, Mycobacterium
DTSLLAPATVMANVLGA

SEQ ID NO: 1314237 - protein, 25 aa, Mycobacterium
DTSQIKWFETAPTYVLHFPNAYEDG

SEQ ID NO: 1314238 - protein, 18 aa, Mycobacterium
DTSVLLGRLDLKLFAGAE

SEQ ID NO: 1314239 - protein, 21 aa, Mycobacterium
DTTALPPLLPGGHTCLDRGHA

SEQ ID NO: 1314240 - protein, 24 aa, Mycobacterium
DTTDLPPALAPRVPAGRFAEPADI

SEQ ID NO: 1314241 - protein, 19 aa, Mycobacterium
DTTELIFDGYRAGATDILG

SEQ ID NO: 1314242 - protein, 18 aa, Mycobacterium
DTTMLDALAEPLARQRNG

SEQ ID NO: 1314243 - protein, 26 aa, Mycobacterium
DTVELNASFYRWPRGATFEGWRQRLP

SEQ ID NO: 1314244 - protein, 25 aa, Mycobacterium
DTVGARMMLLRRLAHPDDARLGPPL

SEQ ID NO: 1314245 - protein, 17 aa, Mycobacterium
DTVGFLMMSHMSSPSAL

SEQ ID NO: 1314246 - protein, 23 aa, Mycobacterium
DTVLVHPFDVAIPNGFPGTSSTF

SEQ ID NO: 1314247 - protein, 18 aa, Mycobacterium
DTVRKFLFALAEQDFDTF

SEQ ID NO: 1314248 - protein, 23 aa, Mycobacterium
DTVRLALHLGRRQRLSGAPGYLA

SEQ ID NO: 1314249 - protein, 33 aa, Mycobacterium
DTVRRLARLHTPLPVLAFTALPEVRSQLALTWG

SEQ ID NO: 1314250 - protein, 26 aa, Mycobacterium
DTVTAGQPLLWLEAMKMEHTITAPTD

SEQ ID NO: 1314251 - protein, 20 aa, Mycobacterium
DTVVDVNLNGTWRTVRAAVP

SEQ ID NO: 1314252 - protein, 38 aa, Mycobacterium
DTVVIYGDKSNWWAAYALWVFTLFGHPDVRLLDGGRNL

SEQ ID NO: 1314253 - protein, 17 aa, Mycobacterium
DTVVVAGGLLQRAGGET

SEQ ID NO: 1314254 - protein, 25 aa, Mycobacterium
DTWHCVYKPVRGEAPLWDFPDGTLA

SEQ ID NO: 1314255 - protein, 20 aa, Mycobacterium
DTWKRLCDPVAQQISTVWAQ

SEQ ID NO: 1314256 - protein, 18 aa, Mycobacterium
DTYKSGTLVYDRDPREIH

SEQ ID NO: 1314257 - protein, 25 aa, Mycobacterium
DTYPTAMLMVFELDGDFDVAEALTH

SEQ ID NO: 1314258 - protein, 22 aa, Mycobacterium
DVAAILRFAATEVVPRLAGTAG

SEQ ID NO: 1314259 - protein, 18 aa, Mycobacterium
DVAAWREYGLKVLGMVEG

SEQ ID NO: 1314260 - protein, 25 aa, Mycobacterium
DVAFLDEEGYLFIGGRSDDTIIRGG

SEQ ID NO: 1314261 - protein, 25 aa, Mycobacterium
DVAFTGVLPVLLQDSPRPPVVVCGV

SEQ ID NO: 1314262 - protein, 17 aa, Mycobacterium
DVAGFVSYLAGPDADYM

SEQ ID NO: 1314263 - protein, 24 aa, Mycobacterium
DVAILRLEQLAPLPKRRLAATLDE

SEQ ID NO: 1314264 - protein, 33 aa, Mycobacterium
DVAIRWGGEEFLVFLPNTPLDDAVPLTERIRNH

SEQ ID NO: 1314265 - protein, 17 aa, Mycobacterium
DVALARLAAIGDALTGV

SEQ ID NO: 1314266 - protein, 24 aa, Mycobacterium
DVALLYDHFSPMVLMQLEDYGFCG

SEQ ID NO: 1314267 - protein, 20 aa, Mycobacterium
DVALPRERRFYFQAEDGQPV

SEQ ID NO: 1314268 - protein, 27 aa, Mycobacterium
DVARAMPIFETLRPPGPLEDGFVHVGP

SEQ ID NO: 1314269 - protein, 18 aa, Mycobacterium
DVARAYIIYRNRHAELRS

SEQ ID NO: 1314270 - protein, 18 aa, Mycobacterium
DVARFRMLVEAIIAEERN

SEQ ID NO: 1314271 - protein, 24 aa, Mycobacterium
DVAVILDITVAVAADFRSAQQVSG

SEQ ID NO: 1314272 - protein, 20 aa, Mycobacterium
DVDAAIALGGRYLVSAQRED

SEQ ID NO: 1314273 - protein, 24 aa, Mycobacterium
DVDALNVVAVRYLPDDRQLQVLPD

SEQ ID NO: 1314274 - protein, 24 aa, Mycobacterium
DVDDLNVMAVRYLPDVRVLGTLPD

SEQ ID NO: 1314275 - protein, 35 aa, Mycobacterium
DVDDLPIQPKPIQRPHPPIWFGANAPAALARAVRH

SEQ ID NO: 1314276 - protein, 24 aa, Mycobacterium
DVDETLPPELLAQYLRAEASALPA

SEQ ID NO: 1314277 - protein, 39 aa, Mycobacterium
DVDFAAARGWWVLRWAGLDDVRILDGGWPAWARAGHPGG

SEQ ID NO: 1314278 - protein, 25 aa, Mycobacterium
DVDGDIPLLLDMPMAYTARALEDST

SEQ ID NO: 1314279 - protein, 26 aa, Mycobacterium
DVDGVHGPRFAVARGLIAMYAADQLS

SEQ ID NO: 1314280 - protein, 28 aa, Mycobacterium
DVDKKRPFYFRALTWYMDRVMELVHDDP

SEQ ID NO: 1314281 - protein, 18 aa, Mycobacterium
DVDLLDQPNLLAALDDLE

SEQ ID NO: 1314282 - protein, 26 aa, Mycobacterium
DVDLPAGSRLLLLWGAANRDPSHFDD

SEQ ID NO: 1314283 - protein, 25 aa, Mycobacterium
DVDPELWRRYVELLLEGMRCRPDQK

SEQ ID NO: 1314284 - protein, 18 aa, Mycobacterium
DVDPLIPHPAQAPVVVGV

SEQ ID NO: 1314285 - protein, 25 aa, Mycobacterium
DVDTTLIWGLHDTVAPLRVANHVWE

SEQ ID NO: 1314286 - protein, 19 aa, Mycobacterium
DVDVKRILDSATGTFYDEF

SEQ ID NO: 1314287 - protein, 23 aa, Mycobacterium
DVDWDEFFGGLGKLGFYDRDDTV

SEQ ID NO: 1314288 - protein, 22 aa, Mycobacterium
DVEAVSPWMAPGRWGWTGGSGT

SEQ ID NO: 1314289 - protein, 18 aa, Mycobacterium
DVEFALRFPEFFDEPPTS

SEQ ID NO: 1314290 - protein, 17 aa, Mycobacterium
DVEGLLRGIYRYRAAAE

SEQ ID NO: 1314291 - protein, 23 aa, Mycobacterium
DVEGRRYLDCLAAYSAVNFGHRN

SEQ ID NO: 1314292 - protein, 20 aa, Mycobacterium
DVEHPLLGPTGAAAVFGPQK

SEQ ID NO: 1314293 - protein, 25 aa, Mycobacterium
DVEHWRWMWEANVLGTLHVTRALLP

SEQ ID NO: 1314294 - protein, 21 aa, Mycobacterium
DVELALHAELLPALGLSADSV

SEQ ID NO: 1314295 - protein, 31 aa, Mycobacterium
DVELAWRLDRAGWFGPPRRWLVVTGTNGKTT

SEQ ID NO: 1314296 - protein, 26 aa, Mycobacterium
DVERRYRAWIRWNAAIMVHRAQRPGV

SEQ ID NO: 1314297 - protein, 22 aa, Mycobacterium
DVFAKFMQKWIDFTAATIEAER

SEQ ID NO: 1314298 - protein, 18 aa, Mycobacterium
DVFCRFSTVLGSRGSADT

SEQ ID NO: 1314299 - protein, 26 aa, Mycobacterium
DVFCSVVRRVALPDAFFALDGQTETF

SEQ ID NO: 1314300 - protein, 21 aa, Mycobacterium
DVFDRLALITLGRAAGFSLDE

SEQ ID NO: 1314301 - protein, 22 aa, Mycobacterium
DVFLTSFLPGHRQKFGIDVDDI

SEQ ID NO: 1314302 - protein, 22 aa, Mycobacterium
DVFSMTLPVFGPTVMVADPALA

SEQ ID NO: 1314303 - protein, 22 aa, Mycobacterium
DVFVSYLRRKLEREGLPRVIHT

SEQ ID NO: 1314304 - protein, 18 aa, Mycobacterium
DVFYWAHATFFKSTLLAA

SEQ ID NO: 1314305 - protein, 19 aa, Mycobacterium
DVGAALRWSLVGAKSRVAV

SEQ ID NO: 1314306 - protein, 18 aa, Mycobacterium
DVGAFVSWLRLPMALRQS

SEQ ID NO: 1314307 - protein, 25 aa, Mycobacterium
DVGALLIEAYTLAALNLRQAARAVF

SEQ ID NO: 1314308 - protein, 18 aa, Mycobacterium
DVGGLPLQGDEWRGHRQQ

SEQ ID NO: 1314309 - protein, 23 aa, Mycobacterium
DVGGTFILSRTPGLLGVHAALTG

SEQ ID NO: 1314310 - protein, 22 aa, Mycobacterium
DVGIYAQALLDRLAGRPSNFPL

SEQ ID NO: 1314311 - protein, 41 aa, Mycobacterium
DVGSYPTPYPVLTTAAIGMFFPGPYRVPKASFNYKTVFSNT

SEQ ID NO: 1314312 - protein, 19 aa, Mycobacterium
DVHIYPVAFHGDVAHFVRE

SEQ ID NO: 1314313 - protein, 34 aa, Mycobacterium
DVHRAYKCRVRTPWWRVPYLRPADLFLTYMNADT

SEQ ID NO: 1314314 - protein, 27 aa, Mycobacterium
DVIAELAAMMPMRVIGMLLGIPESEQV

SEQ ID NO: 1314315 - protein, 24 aa, Mycobacterium
DVIAVLNPILRGWGNYFRTGNAAD

SEQ ID NO: 1314316 - protein, 24 aa, Mycobacterium
DVIGGLLGDLAWDAVLGTLSGGQR

SEQ ID NO: 1314317 - protein, 23 aa, Mycobacterium
DVIGGLVADIPFGALVGTLSGGQ

SEQ ID NO: 1314318 - protein, 23 aa, Mycobacterium
DVIGVAVMGLLDRAWHTVNRQTV

SEQ ID NO: 1314319 - protein, 17 aa, Mycobacterium
DVIHLRGHTPGSIALAL

SEQ ID NO: 1314320 - protein, 22 aa, Mycobacterium
DVILSALRRHFTLTPDPRPRGS

SEQ ID NO: 1314321 - protein, 39 aa, Mycobacterium
DVKLLARLLGLPYFPVTPLFPLAGPLGVVPLPSKWYIQF

SEQ ID NO: 1314322 - protein, 35 aa, Mycobacterium
DVKLLARLLGLPYFPVTPLFPVAGPLGLVPLPSKW

SEQ ID NO: 1314323 - protein, 35 aa, Mycobacterium; identical to SEQ ID NO: 784109

SEQ ID NO: 1314324 - protein, 42 aa, Mycobacterium; identical to SEQ ID NO: 804947

SEQ ID NO: 1314325 - protein, 17 aa, Mycobacterium
DVLAPAWQQATGGALDV

SEQ ID NO: 1314326 - protein, 24 aa, Mycobacterium
DVLKPLLDELGLVGFPKTSGGRGV

SEQ ID NO: 1314327 - protein, 17 aa, Mycobacterium
DVLLLDEPLAALDAAIR

SEQ ID NO: 1314328 - protein, 17 aa, Mycobacterium
DVLLRAAALLPDVQVLI

SEQ ID NO: 1314329 - protein, 18 aa, Mycobacterium
DVLNALRLLALCEPLDIH

SEQ ID NO: 1314330 - protein, 18 aa, Mycobacterium
DVLNSDPRFTRATRLTWA

SEQ ID NO: 1314331 - protein, 27 aa, Mycobacterium
DVLPKPADLPLLPDAWIDHLTQGRMSA

SEQ ID NO: 1314332 - protein, 19 aa, Mycobacterium
DVLPRNPSGKLLKRALREP

SEQ ID NO: 1314333 - protein, 21 aa, Mycobacterium
DVLRALNRLLHPLTGGPDGTG

SEQ ID NO: 1314334 - protein, 23 aa, Mycobacterium
DVLRTYLELVLDGLVARLASGDD

SEQ ID NO: 1314335 - protein, 18 aa, Mycobacterium
DVLSGRPVLGPAAVDPRV

SEQ ID NO: 1314336 - protein, 27 aa, Mycobacterium
DVLSGVIGALLAAGLPPGEAAAAAAFV

SEQ ID NO: 1314337 - protein, 24 aa, Mycobacterium
DVLSRYFTLLNGDTAHLFIVMSAA

SEQ ID NO: 1314338 - protein, 23 aa, Mycobacterium
DVLTGLASALFPDGRTPPVIDVV

SEQ ID NO: 1314339 - protein, 25 aa, Mycobacterium
DVMLQLSLIGGYRFGGPTDLLVETG

SEQ ID NO: 1314340 - protein, 25 aa, Mycobacterium
DVNYFCVGPCWPTPTKPGRPAPGLD

SEQ ID NO: 1314341 - protein, 25 aa, Mycobacterium
DVPDYRPFWAVTKHSDIMAIERDNE

SEQ ID NO: 1314342 - protein, 17 aa, Mycobacterium
DVPFLSLTSGPHGLVAE

SEQ ID NO: 1314343 - protein, 28 aa, Mycobacterium
DVPGYLKSIYDPYTLLDGRRYGLPYDGD

SEQ ID NO: 1314344 - protein, 21 aa, Mycobacterium
DVPIPTPYEDLLRLVFERGTP

SEQ ID NO: 1314345 - protein, 29 aa, Mycobacterium
DVPKYVMNPLAWANAALGFIYVHNGYYND

SEQ ID NO: 1314346 - protein, 29 aa, Mycobacterium
DVPQGWGLGFHLYLIDLPGMRSAGSADWS

SEQ ID NO: 1314347 - protein, 19 aa, Mycobacterium
DVPRHCSGRFRYQAGQFLT

SEQ ID NO: 1314348 - protein, 19 aa, Mycobacterium
DVPRRAFLTMYDAAAKLIC

SEQ ID NO: 1314349 - protein, 21 aa, Mycobacterium
DVPRWKQLFHNAKADPRGTMR

SEQ ID NO: 1314350 - protein, 23 aa, Mycobacterium
DVPSALYSLSYKPNPRWSRRYAE

SEQ ID NO: 1314351 - protein, 24 aa, Mycobacterium
DVPSALYSLSYKPNPRWSRRYAEQ

SEQ ID NO: 1314352 - protein, 20 aa, Mycobacterium
DVPTLTALMGRIAQRRVRLL

SEQ ID NO: 1314353 - protein, 19 aa, Mycobacterium
DVPVDVLNVVLPHVAAFAE

SEQ ID NO: 1314354 - protein, 22 aa, Mycobacterium
DVPVEFLVQGTLYPDVVESGGG

SEQ ID NO: 1314355 - protein, 17 aa, Mycobacterium
DVPVLSVHAPCLLITQR

SEQ ID NO: 1314356 - protein, 19 aa, Mycobacterium
DVPWLSWSTATAQDPIVAR

SEQ ID NO: 1314357 - protein, 26 aa, Mycobacterium
DVQAGLAMLAPIWGYPPILDIEDETA

SEQ ID NO: 1314358 - protein, 20 aa, Mycobacterium
DVQLVVQRMWLPDLQRAIGD

SEQ ID NO: 1314359 - protein, 25 aa, Mycobacterium
DVQQMLLEFGVISRRYLHATGEHKV

SEQ ID NO: 1314360 - protein, 17 aa, Mycobacterium
DVQTESFEWLIGAEDWF

SEQ ID NO: 1314361 - protein, 21 aa, Mycobacterium
DVRADMEGRFGHDFGDVRVHT

SEQ ID NO: 1314362 - protein, 35 aa, Mycobacterium
DVRGELALRPGWPSMFRGYLRQDQRYRDSFAGGLY

SEQ ID NO: 1314363 - protein, 26 aa, Mycobacterium
DVRGMFELNFFSVVSVIRAVLPGMRA

SEQ ID NO: 1314364 - protein, 19 aa, Mycobacterium
DVRHRIAFLPDYDMSMARK

SEQ ID NO: 1314365 - protein, 17 aa, Mycobacterium
DVRPSIALQLLTCPLHT

SEQ ID NO: 1314366 - protein, 23 aa, Mycobacterium
DVRRWRADLMAPRPRPAHARPKG

SEQ ID NO: 1314367 - protein, 20 aa, Mycobacterium
DVRTVLPPALSIRNGRRSVV

SEQ ID NO: 1314368 - protein, 24 aa, Mycobacterium
DVSETVLFLVSDSGKYYTGTTLML

SEQ ID NO: 1314369 - protein, 26 aa, Mycobacterium
DVSGGAAFFLCRRASRLSSHSAQWAL

SEQ ID NO: 1314370 - protein, 34 aa, Mycobacterium
DVSLLRELNLMTTKPFLYVFNADESVLTDEARKV

SEQ ID NO: 1314371 - protein, 26 aa, Mycobacterium
DVSLPDVDGIFRWLTVGPPGQDDVSI

SEQ ID NO: 1314372 - protein, 24 aa, Mycobacterium
DVSLPVVRAFISRIKERAKGAEVS

SEQ ID NO: 1314373 - protein, 23 aa, Mycobacterium
DVSNEFFALFLGPTMGYTCSYFE

SEQ ID NO: 1314374 - protein, 23 aa, Mycobacterium
DVSPRTFFRYFPTKESVLFSDDL

SEQ ID NO: 1314375 - protein, 24 aa, Mycobacterium
DVSPRTFYRYFGVKERLLISDDKI

SEQ ID NO: 1314376 - protein, 25 aa, Mycobacterium
DVSQLVYLHLRFHGYGDGRWTDSAV

SEQ ID NO: 1314377 - protein, 37 aa, Mycobacterium
DVSTRYALDLFATLGLQLLIVTPLQKVHVIEPYVKSI

SEQ ID NO: 1314378 - protein, 18 aa, Mycobacterium
DVTALMTAAQRWGTEWAT

SEQ ID NO: 1314379 - protein, 21 aa, Mycobacterium
DVTDIILNLKGLVVSSEEDEP

SEQ ID NO: 1314380 - protein, 25 aa, Mycobacterium
DVTLLPGLMDMELNLLIGGPGGPEG

SEQ ID NO: 1314381 - protein, 26 aa, Mycobacterium
DVTPDWNPIISVAPLDGLVIAAGFSG

SEQ ID NO: 1314382 - protein, 27 aa, Mycobacterium
DVTPMNSAIYFLLGLYALLITTDDSTG

SEQ ID NO: 1314383 - protein, 24 aa, Mycobacterium
DVTPTRLRAALDEGQIVLVAGFQG

SEQ ID NO: 1314384 - protein, 18 aa, Mycobacterium
DVTQALCRRWSPGARLLP

SEQ ID NO: 1314385 - protein, 19 aa, Mycobacterium
DVTRRRASIGLSLELAGMS

SEQ ID NO: 1314386 - protein, 32 aa, Mycobacterium
DVTRYQALVNVLVPFPALSVPLGNMLAAVAAS

SEQ ID NO: 1314387 - protein, 26 aa, Mycobacterium
DVTTGLFLWQNMFGVWPTDGVVTDEL

SEQ ID NO: 1314388 - protein, 17 aa, Mycobacterium
DVTVAVGADFRSARTAF

SEQ ID NO: 1314389 - protein, 24 aa, Mycobacterium
DVTWTVIPGPAVSRLLALCDPEGV

SEQ ID NO: 1314390 - protein, 17 aa, Mycobacterium
DVTYRIPLVPNARRFEA

SEQ ID NO: 1314391 - protein, 19 aa, Mycobacterium
DVVDLHRLAMTCRAQRTLL

SEQ ID NO: 1314392 - protein, 18 aa, Mycobacterium
DVVDLLLRLRAAGNPISA

SEQ ID NO: 1314393 - protein, 23 aa, Mycobacterium
DVVFTSPVAFKPYPGKPITAAIL

SEQ ID NO: 1314394 - protein, 24 aa, Mycobacterium
DVVHLASPALLGWGGVHAARRLGI

SEQ ID NO: 1314395 - protein, 22 aa, Mycobacterium
DVVHVLFAEIGPFFADRSGGYT

SEQ ID NO: 1314396 - protein, 18 aa, Mycobacterium
DVVILDLGLPGIDGLEVC

SEQ ID NO: 1314397 - protein, 19 aa, Mycobacterium
DVVILDLGLPGIDGLEVCR

SEQ ID NO: 1314398 - protein, 19 aa, Mycobacterium
DVVLLLPGSAHRDERVFEN

SEQ ID NO: 1314399 - protein, 17 aa, Mycobacterium
DVVLLVDDWHMITAAGG

SEQ ID NO: 1314400 - protein, 18 aa, Mycobacterium
DVVLWYTVGAHHVVCPED

SEQ ID NO: 1314401 - protein, 19 aa, Mycobacterium
DVVMALVSGVLRTFLLERG

SEQ ID NO: 1314402 - protein, 23 aa, Mycobacterium
DVVNYLRWFTFLEAGELGELEEA

SEQ ID NO: 1314403 - protein, 25 aa, Mycobacterium
DVVPIRVYRWRPAPRDGDFDQLVAG

SEQ ID NO: 1314404 - protein, 21 aa, Mycobacterium
DVVRIPFGPLVAGAAFGHKPD

SEQ ID NO: 1314405 - protein, 26 aa, Mycobacterium
DVVTRRLRLRLLNGSVGRIYNLGFSD

SEQ ID NO: 1314406 - protein, 19 aa, Mycobacterium
DVVVSGPLTWAARIGGDGN

SEQ ID NO: 1314407 - protein, 17 aa, Mycobacterium
DVVYYLVHGIGQPGFRE

SEQ ID NO: 1314408 - protein, 44 aa, Mycobacterium
DVWEGVVSVFRDYGYRRLRSKARLKFLIKDWGAQKFREVLETEY

SEQ ID NO: 1314409 - protein, 19 aa, Mycobacterium
DVWNGFVFINFDREPRQTL

SEQ ID NO: 1314410 - protein, 17 aa, Mycobacterium
DVWQTMMDVNLTGVWKT

SEQ ID NO: 1314411 - protein, 23 aa, Mycobacterium
DVYACPFAIHDKFLAGNVLSDGG

SEQ ID NO: 1314412 - protein, 19 aa, Mycobacterium
DVYFIVIESPFNVDSHGES

SEQ ID NO: 1314413 - protein, 19 aa, Mycobacterium
DVYIAALGPQLLRVAGRRT

SEQ ID NO: 1314414 - protein, 27 aa, Mycobacterium
DVYIHRLRKYIGAYLALLGSTDVIVFT

SEQ ID NO: 1314415 - protein, 23 aa, Mycobacterium
DVYTLWAPRWRADGDEWEAFLGK

SEQ ID NO: 1314416 - protein, 19 aa, Mycobacterium
DVYVRYLRRKLGANRFATL

SEQ ID NO: 1314417 - protein, 27 aa, Mycobacterium
DWADKPRLLATFPFPHVLTMSVTLADR

SEQ ID NO: 1314418 - protein, 24 aa, Mycobacterium
DWAEGPALDSAFRSGLRNAFSGII

SEQ ID NO: 1314419 - protein, 19 aa, Mycobacterium
DWAGELAELPSLLAEKVKA

SEQ ID NO: 1314420 - protein, 23 aa, Mycobacterium
DWDELPRWSMIDKALGLDTPDPA

SEQ ID NO: 1314421 - protein, 19 aa, Mycobacterium
DWDFATEFGLPIIEVVRPV

SEQ ID NO: 1314422 - protein, 26 aa, Mycobacterium
DWDRNYVHSLDWRWLTTPMTEGPGES

SEQ ID NO: 1314423 - protein, 20 aa, Mycobacterium
DWDSFLRVNLYGVLHCTRAV

SEQ ID NO: 1314424 - protein, 25 aa, Mycobacterium
DWENTGLRLAAKLTPWPAVNGARTG

SEQ ID NO: 1314425 - protein, 25 aa, Mycobacterium
DWEPADEFLPFRPTAFRMVAMGKRP

SEQ ID NO: 1314426 - protein, 25 aa, Mycobacterium
DWGADGSGLFMKYLRRGSGYYIDVG

SEQ ID NO: 1314427 - protein, 19 aa, Mycobacterium
DWGADLILDVDPPGGDLGR

SEQ ID NO: 1314428 - protein, 25 aa, Mycobacterium
DWIRGQGNWRLLRESALRANDAPES

SEQ ID NO: 1314429 - protein, 28 aa, Mycobacterium
DWIRHAMHALGWMVPGELKLFGIAELDE

SEQ ID NO: 1314430 - protein, 17 aa, Mycobacterium
DWKIQIAGRPHRAVLDR

SEQ ID NO: 1314431 - protein, 26 aa, Mycobacterium
DWKIVAGFMREQIPLQLPAGTGSDVA

SEQ ID NO: 1314432 - protein, 18 aa, Mycobacterium
DWLALLLEPAEQVTTPCT

SEQ ID NO: 1314433 - protein, 30 aa, Mycobacterium
DWLEAFVPLRVHVLVRFGRWDELIATPLPD

SEQ ID NO: 1314434 - protein, 19 aa, Mycobacterium
DWLETHRPAYRAAVATVRA

SEQ ID NO: 1314435 - protein, 18 aa, Mycobacterium
DWLRRYYMRYSGPGGMTE

SEQ ID NO: 1314436 - protein, 21 aa, Mycobacterium
DWPDPWVMIGAIALATTRLRF

SEQ ID NO: 1314437 - protein, 22 aa, Mycobacterium
DWPGGLIVFDVRTEAMTPLVEM

SEQ ID NO: 1314438 - protein, 20 aa, Mycobacterium
DWQAYFHLRNRLVVAALHWD

SEQ ID NO: 1314439 - protein, 31 aa, Mycobacterium
DWRDALTDWAVGLWDVYHRHPWILHATVIGP

SEQ ID NO: 1314440 - protein, 31 aa, Mycobacterium
DWREATEIVSRYYNLVLADCGAGLFQPGARG

SEQ ID NO: 1314441 - protein, 20 aa, Mycobacterium
DWTAELAELPSLLAEKVKAP

SEQ ID NO: 1314442 - protein, 27 aa, Mycobacterium
DWVANDPRFLFHPAIKELTLDIASEVF

SEQ ID NO: 1314443 - protein, 25 aa, Mycobacterium
DWWDASYLMMWGSNVPVTRTPDAHW

SEQ ID NO: 1314444 - protein, 26 aa, Mycobacterium
DWYDPVKLCLKRLTPWLSPGARVILD

SEQ ID NO: 1314445 - protein, 28 aa, Mycobacterium
DWYEHAQRDLPWRRPGVSAWQILVSEFM

SEQ ID NO: 1314446 - protein, 17 aa, Mycobacterium
DYAKRKGWTLAEAERWL

SEQ ID NO: 1314447 - protein, 34 aa, Mycobacterium
DYAPLPLREPVRSLVWIQGRLRDVPIGEVPALLD

SEQ ID NO: 1314448 - protein, 23 aa, Mycobacterium
DYDLSALRYILCGGSAVPKALSE

SEQ ID NO: 1314449 - protein, 17 aa, Mycobacterium
DYDLSGLKYLFLAGERL

SEQ ID NO: 1314450 - protein, 25 aa, Mycobacterium
DYDSWQETVYLLRSPENARRLMEAV

SEQ ID NO: 1314451 - protein, 26 aa, Mycobacterium
DYDSWQETVYLLRSPENARRLMEAVA

SEQ ID NO: 1314452 - protein, 25 aa, Mycobacterium
DYDTLLRSYRKLMQFLRAGDAVGAE

SEQ ID NO: 1314453 - protein, 19 aa, Mycobacterium
DYEIPGLADAIRRSGLPKV

SEQ ID NO: 1314454 - protein, 28 aa, Mycobacterium
DYEKLMRSYRRLLQLMRSGDGAAAEAHW

SEQ ID NO: 1314455 - protein, 17 aa, Mycobacterium
DYELVPLPRTGTVYTET

SEQ ID NO: 1314456 - protein, 20 aa, Mycobacterium
DYFMDTPFRVFQAPYVGAVV

SEQ ID NO: 1314457 - protein, 17 aa, Mycobacterium
DYGEFLRSLVDISAARP

SEQ ID NO: 1314458 - protein, 18 aa, Mycobacterium
DYHTVIAWARHLDGVDPN

SEQ ID NO: 1314459 - protein, 18 aa, Mycobacterium
DYKRTLIERFANPGVRDT

SEQ ID NO: 1314460 - protein, 28 aa, Mycobacterium
DYLDSTYYAHWLFSVEKLLNDKGYITHE

SEQ ID NO: 1314461 - protein, 17 aa, Mycobacterium
DYLTGHGISFLPTVGWA

SEQ ID NO: 1314462 - protein, 18 aa, Mycobacterium
DYLVKPFVLAELVARVKA

SEQ ID NO: 1314463 - protein, 32 aa, Mycobacterium
DYNGLRLHYPDIRLVYWAGGNPFHHHQNIPRL

SEQ ID NO: 1314464 - protein, 25 aa, Mycobacterium
DYRQGDWIYIPKACTWRQVPSEETT

SEQ ID NO: 1314465 - protein, 22 aa, Mycobacterium
DYSGTLFRLEEDESWFAGMELD

SEQ ID NO: 1314466 - protein, 35 aa, Mycobacterium
DYVSRGWAMNQPFTGIPALLADLQAAGVRMAVATS

SEQ ID NO: 1314467 - protein, 23 aa, Mycobacterium
DYVVKPFRFEDLLARVRLRLTAG

SEQ ID NO: 1314468 - protein, 19 aa, Mycobacterium
DYVWRTWYPRTRPATITLD

SEQ ID NO: 1314469 - protein, 21 aa, Mycobacterium
DYYLSRGVTWVQDAWVEPADV

SEQ ID NO: 1314470 - protein, 17 aa, Mycobacterium
EAAALLDRARTAGIPVV

SEQ ID NO: 1314471 - protein, 23 aa, Mycobacterium
EAAAPFSAFVFKVQAGMDSAHRD

SEQ ID NO: 1314472 - protein, 23 aa, Mycobacterium
EAAEFFAPISSIHRYLKTLVDVG

SEQ ID NO: 1314473 - protein, 21 aa, Mycobacterium
EAAFLATLGELLAAAQRAGTV

SEQ ID NO: 1314474 - protein, 24 aa, Mycobacterium
EAAFNIGSLFVPGGALSKTGTLAK

SEQ ID NO: 1314475 - protein, 17 aa, Mycobacterium
EAAGAVYLLCTPESDYI

SEQ ID NO: 1314476 - protein, 22 aa, Mycobacterium
EAAIALLAEQGAEAPLPAAGYQ

SEQ ID NO: 1314477 - protein, 19 aa, Mycobacterium
EAAIAPLRGPIDQIPSAVS

SEQ ID NO: 1314478 - protein, 23 aa, Mycobacterium
EAAKPFIAVLCDAQAALAGAAGK

SEQ ID NO: 1314479 - protein, 18 aa, Mycobacterium
EAALAKRGYPDDIAAAVL

SEQ ID NO: 1314480 - protein, 20 aa, Mycobacterium
EAALVYTTRELPSDPSISAL

SEQ ID NO: 1314481 - protein, 23 aa, Mycobacterium
EAAPDVGGTWYFNRYPGARCDVE

SEQ ID NO: 1314482 - protein, 22 aa, Mycobacterium
EAAPEVGGTWYFNRYPGARCDV

SEQ ID NO: 1314483 - protein, 23 aa, Mycobacterium
EAAPFVQQLRDGGFEGTFASADG

SEQ ID NO: 1314484 - protein, 28 aa, Mycobacterium
EAARAARVIVPDFQLSLAIGKEGQNARL

SEQ ID NO: 1314485 - protein, 19 aa, Mycobacterium
EAARDLLRRHGAASAAVAA

SEQ ID NO: 1314486 - protein, 26 aa, Mycobacterium
EAARTLPMRVLVLGGGDIRDLHVTDD

SEQ ID NO: 1314487 - protein, 23 aa, Mycobacterium
EAARWAPTWGRRQPVRFVVGLRG

SEQ ID NO: 1314488 - protein, 21 aa, Mycobacterium
EAASFATPFVADPALRSQVVG

SEQ ID NO: 1314489 - protein, 27 aa, Mycobacterium
EAAVAGAIPVIRPLTQSLAGDTVLRVA

SEQ ID NO: 1314490 - protein, 19 aa, Mycobacterium
EAAVRELLIAIGEDPDRHG

SEQ ID NO: 1314491 - protein, 21 aa, Mycobacterium
EAAVRHLIPALEVLHESLDAK

SEQ ID NO: 1314492 - protein, 28 aa, Mycobacterium
EAAWELGIGVLLTGVWNTLQIASAHMVE

SEQ ID NO: 1314493 - protein, 31 aa, Mycobacterium
EAAWFLADTLGAGTFPWVLAITPPYSDRSQR

SEQ ID NO: 1314494 - protein, 26 aa, Mycobacterium
EACARLRYPRPALVLSLHAAALVDPE

SEQ ID NO: 1314495 - protein, 24 aa, Mycobacterium
EACARLRYPRPALVLSLHAAALVE

SEQ ID NO: 1314496 - protein, 24 aa, Mycobacterium
EACEDPRFSIARLSLLDRGMIFAV

SEQ ID NO: 1314497 - protein, 17 aa, Mycobacterium
EACSLAMLVERGAKLQL

SEQ ID NO: 1314498 - protein, 27 aa, Mycobacterium
EADAGAMLMLPFFNYAEGDHRAIYEMM

SEQ ID NO: 1314499 - protein, 32 aa, Mycobacterium
EADELIAGLLERRPQWLEARWVRAVLHYRTAR

SEQ ID NO: 1314500 - protein, 47 aa, Mycobacterium; identical to SEQ ID NO: 805669

SEQ ID NO: 1314501 - protein, 19 aa, Mycobacterium
EADFLEMGLDSIVALTLVQ

SEQ ID NO: 1314502 - protein, 27 aa, Mycobacterium
EADHMADLGFLPGVTRILAATPRGGQR

SEQ ID NO: 1314503 - protein, 40 aa, Mycobacterium
EADIEHWRWMWESNVLGTLLVTRALLPKLIDSGDGLIVTV

SEQ ID NO: 1314504 - protein, 41 aa, Mycobacterium
EADIEHWRWMWESNVLGTLLVTRALLPKLIDSGDGLIVTVT

SEQ ID NO: 1314505 - protein, 42 aa, Mycobacterium
EADIEHWRWMWESNVLGTLLVTRALLPKLIDSGDGLIVTVTS

SEQ ID NO: 1314506 - protein, 23 aa, Mycobacterium
EADLLYFPQWSDYLKHRADAGDR

SEQ ID NO: 1314507 - protein, 23 aa, Mycobacterium
EADLVLQTMADLGLKRGENGLKV

SEQ ID NO: 1314508 - protein, 28 aa, Mycobacterium
EADLVSCMIALPTQLFRSTGIPVCVWFF

SEQ ID NO: 1314509 - protein, 23 aa, Mycobacterium
EADPRAVVWLLVRPMANSIANGE

SEQ ID NO: 1314510 - protein, 28 aa, Mycobacterium
EADPYRRLAFTFHTFTRQLTTVGLSEDV

SEQ ID NO: 1314511 - protein, 23 aa, Mycobacterium
EADRLAFWAKQANRLSWQTPFTE

SEQ ID NO: 1314512 - protein, 23 aa, Mycobacterium
EADTALDRILLSTALSQLSDEHR

SEQ ID NO: 1314513 - protein, 21 aa, Mycobacterium
EADVQREAQRATAERRGRVAD

SEQ ID NO: 1314514 - protein, 26 aa, Mycobacterium
EAEHKAYAIPFPPLGERFDRLTEQLE

SEQ ID NO: 1314515 - protein, 25 aa, Mycobacterium
EAEILSRIALVLYGIGYDADPALVD

SEQ ID NO: 1314516 - protein, 23 aa, Mycobacterium
EAEIRGHRRTYVGALPGRIVRAI

SEQ ID NO: 1314517 - protein, 23 aa, Mycobacterium
EAEIRGHRRTYVGALPGRIVRAV

SEQ ID NO: 1314518 - protein, 23 aa, Mycobacterium
EAEKFSVRLPIVGRIAVPPPDQL

SEQ ID NO: 1314519 - protein, 28 aa, Mycobacterium
EAEPVQPLYARYWLHNRGPAPLGGLPAA

SEQ ID NO: 1314520 - protein, 22 aa, Mycobacterium
EAERDWLRRQPTIPLRTDTDRL

SEQ ID NO: 1314521 - protein, 22 aa, Mycobacterium
EAERLFVRLLDQAGITGWRTNH

SEQ ID NO: 1314522 - protein, 17 aa, Mycobacterium
EAFAEGYHFPFVHGESV

SEQ ID NO: 1314523 - protein, 23 aa, Mycobacterium
EAFAPNRVFMAPLTRSRAQADGT

SEQ ID NO: 1314524 - protein, 24 aa, Mycobacterium
EAFAPVPMAWLKDIGADEKKLNPN

SEQ ID NO: 1314525 - protein, 17 aa, Mycobacterium
EAFGRPVFGFQNTKFTL

SEQ ID NO: 1314526 - protein, 23 aa, Mycobacterium
EAGAILRRQIIAIGAQILGVEES

SEQ ID NO: 1314527 - protein, 23 aa, Mycobacterium
EAGDWLSCWTMGLNQSTHGTWNT

SEQ ID NO: 1314528 - protein, 19 aa, Mycobacterium
EAGEEIPFSLRAAARRDQV

SEQ ID NO: 1314529 - protein, 33 aa, Mycobacterium
EAGGKDDWFWIKVPVGYLYTIANPRTDWCFTTE

SEQ ID NO: 1314530 - protein, 23 aa, Mycobacterium
EAGIVLGALGLFGSRPGALNEAD

SEQ ID NO: 1314531 - protein, 30 aa, Mycobacterium
EAGKRLRLLQQYFFVTCSLQDILNIHLKRA

SEQ ID NO: 1314532 - protein, 20 aa, Mycobacterium
EAGLLPGALTRNAGLHFICR

SEQ ID NO: 1314533 - protein, 33 aa, Mycobacterium
EAGMTETLYLMPWSTMFPLGISSATIGIAEGAL

SEQ ID NO: 1314534 - protein, 30 aa, Mycobacterium
EAGRRGVELVVVRAWWSPGAFELPGANADE

SEQ ID NO: 1314535 - protein, 34 aa, Mycobacterium
EAGTPLGMTYIAQLDWPLADAIRWPAQHISEFAW

SEQ ID NO: 1314536 - protein, 31 aa, Mycobacterium
EAHPDADIYRFLPGLGVILGARVLGEFGDDP

SEQ ID NO: 1314537 - protein, 21 aa, Mycobacterium
EAHRFLVNEAYLLDAQDYDRW

SEQ ID NO: 1314538 - protein, 22 aa, Mycobacterium
EAHRFLVNEAYLLDAQDYDRWL

SEQ ID NO: 1314539 - protein, 25 aa, Mycobacterium
EAIAKFAANIPFPKRLGAPDEFADA

SEQ ID NO: 1314540 - protein, 24 aa, Mycobacterium
EAIDRPLVWTISALLGQHPVPVES

SEQ ID NO: 1314541 - protein, 42 aa, Mycobacterium
EAIGYWQEVAGLPLERIQRRGMADNYWSMGIPGPCGPSSEIY

SEQ ID NO: 1314542 - protein, 17 aa, Mycobacterium
EAILLPDGALNRPALAA

SEQ ID NO: 1314543 - protein, 18 aa, Mycobacterium
EAIREWVVAAAASVPRNR

SEQ ID NO: 1314544 - protein, 24 aa, Mycobacterium
EAIRLRVPVPGIAASLFARFLSRQ

SEQ ID NO: 1314545 - protein, 18 aa, Mycobacterium
EAIRRRWPDPESLVLDAL

SEQ ID NO: 1314546 - protein, 22 aa, Mycobacterium
EAITRYGLRITGRRGDLVITDN

SEQ ID NO: 1314547 - protein, 23 aa, Mycobacterium
EAIVHLGFGFGIVFINPALEAVN

SEQ ID NO: 1314548 - protein, 34 aa, Mycobacterium
EAKGWVRQYAGRTYWLCCAGCVPKFDADPAKYAV

SEQ ID NO: 1314549 - protein, 28 aa, Mycobacterium
EAKKRPEFQKLTPLYPNTRLRLETSSDK

SEQ ID NO: 1314550 - protein, 17 aa, Mycobacterium
EAKLARIWSQCLGLSDI

SEQ ID NO: 1314551 - protein, 34 aa, Mycobacterium
EAKLRNIPLVILYATTLPIGAWPVVPVPTGFLDW

SEQ ID NO: 1314552 - protein, 28 aa, Mycobacterium
EAKRYLEYTLRWRNVPKPSIAAVQGRCI

SEQ ID NO: 1314553 - protein, 26 aa, Mycobacterium
EALAAAFTAMAWTIVKLATLHRTVKP

SEQ ID NO: 1314554 - protein, 17 aa, Mycobacterium
EALAALGGLDRAALHSQ

SEQ ID NO: 1314555 - protein, 25 aa, Mycobacterium
EALDPQRVLLLPDGTEDFWSDEYRD

SEQ ID NO: 1314556 - protein, 21 aa, Mycobacterium
EALEPVQMLPAPAQGALAVEC

SEQ ID NO: 1314557 - protein, 18 aa, Mycobacterium
EALGLPVSLASHVDAMAG

SEQ ID NO: 1314558 - protein, 17 aa, Mycobacterium
EALGRLYVERHFPPHAK

SEQ ID NO: 1314559 - protein, 19 aa, Mycobacterium
EALGVDHAIWRQATYYGPG

SEQ ID NO: 1314560 - protein, 21 aa, Mycobacterium
EALHPLRDRFPLRAIIGAPMV

SEQ ID NO: 1314561 - protein, 20 aa, Mycobacterium
EALHPYPADLALVSKVGGKR

SEQ ID NO: 1314562 - protein, 18 aa, Mycobacterium
EALLDPDSPFLELSPLAA

SEQ ID NO: 1314563 - protein, 21 aa, Mycobacterium
EALLELLPQITLINGYGSSET

SEQ ID NO: 1314564 - protein, 17 aa, Mycobacterium
EALLGWADSVGVDGSDP

SEQ ID NO: 1314565 - protein, 17 aa, Mycobacterium
EALPNIARLLPVARAAG

SEQ ID NO: 1314566 - protein, 21 aa, Mycobacterium
EALPRLVRRRALTYNVSLLLV

SEQ ID NO: 1314567 - protein, 18 aa, Mycobacterium
EALRLLGRYLERAVTDAA

SEQ ID NO: 1314568 - protein, 18 aa, Mycobacterium
EALRQFLLRHGHRGYREL

SEQ ID NO: 1314569 - protein, 25 aa, Mycobacterium
EALSEPLGEQVSWWAKANLPMNAGC

SEQ ID NO: 1314570 - protein, 20 aa, Mycobacterium
EALTRAIHKLPIKARIVTRE

SEQ ID NO: 1314571 - protein, 18 aa, Mycobacterium
EALVFAYDGLRERGLRSV

SEQ ID NO: 1314572 - protein, 25 aa, Mycobacterium
EALVPVFRRFCLDSPRLAQVMFSRP

SEQ ID NO: 1314573 - protein, 17 aa, Mycobacterium
EALWQEVLVTDGHRLIM

SEQ ID NO: 1314574 - protein, 21 aa, Mycobacterium
EAMLDVLRFWLDLGIDGFRLD

SEQ ID NO: 1314575 - protein, 30 aa, Mycobacterium
EANSRRWAGPAFLLNEMLVWGFTGQVISAI

SEQ ID NO: 1314576 - protein, 23 aa, Mycobacterium
EAPADVLITLSRTVFRGEGEREV

SEQ ID NO: 1314577 - protein, 18 aa, Mycobacterium
EAPALDELAYLLGKHPCV

SEQ ID NO: 1314578 - protein, 18 aa, Mycobacterium
EAPAPRMPDDRSAGKADG

SEQ ID NO: 1314579 - protein, 21 aa, Mycobacterium
EAPARLLYERAIGAADAAAGS

SEQ ID NO: 1314580 - protein, 22 aa, Mycobacterium
EAPFALPEFGPGVSVPGSTAMG

SEQ ID NO: 1314581 - protein, 28 aa, Mycobacterium
EAPHRRYHLLPLSARTPEALVRLASRHL

SEQ ID NO: 1314582 - protein, 17 aa, Mycobacterium
EAPLLLGSRAVLMERWD

SEQ ID NO: 1314583 - protein, 21 aa, Mycobacterium
EAPLPSFTPGSHLVVECGARN

SEQ ID NO: 1314584 - protein, 17 aa, Mycobacterium
EAPLWDFPDGTLAGREV

SEQ ID NO: 1314585 - protein, 19 aa, Mycobacterium
EAPVYYNATYDFYALSRHA

SEQ ID NO: 1314586 - protein, 26 aa, Mycobacterium
EAQISKPMLYLYYGSKEELFGACLNR

SEQ ID NO: 1314587 - protein, 17 aa, Mycobacterium
EAQLFVVCHAGGRSQRV

SEQ ID NO: 1314588 - protein, 26 aa, Mycobacterium
EAQMSALLMAIFLRGMTNGEIARWTA

SEQ ID NO: 1314589 - protein, 24 aa, Mycobacterium
EAQRVIARYSWPRNISQLREALVH

SEQ ID NO: 1314590 - protein, 21 aa, Mycobacterium
EAQRYGVAVNAISPLAMSRMT

SEQ ID NO: 1314591 - protein, 25 aa, Mycobacterium
EAQVPIVPLVVWGAHRLWTKDHPKA

SEQ ID NO: 1314592 - protein, 28 aa, Mycobacterium
EAQWARVPAPWRRPVYRIATAPFDEVFV

SEQ ID NO: 1314593 - protein, 25 aa, Mycobacterium
EARAEITKWLIEEKGFCAVAAEADW

SEQ ID NO: 1314594 - protein, 28 aa, Mycobacterium
EARDKFGFLLDAFTFGAPPHGGIAFGWD

SEQ ID NO: 1314595 - protein, 22 aa, Mycobacterium
EARIPFLREPFGEEITTIGLLI

SEQ ID NO: 1314596 - protein, 24 aa, Mycobacterium
EARKPGSYFWLKGGKRQQKLAAQP

SEQ ID NO: 1314597 - protein, 18 aa, Mycobacterium
EARLKYRGWGVPYDHARL

SEQ ID NO: 1314598 - protein, 27 aa, Mycobacterium
EARLRRPQFAFPSRGILTSGFGARWGT

SEQ ID NO: 1314599 - protein, 22 aa, Mycobacterium
EARRLLNDPYTLTPDRAAEPEL

SEQ ID NO: 1314600 - protein, 28 aa, Mycobacterium
EARSALMLSWIRDVPALGAAARGLQREA

SEQ ID NO: 1314601 - protein, 19 aa, Mycobacterium
EARWRRQPGDVPPLAKLQR

SEQ ID NO: 1314602 - protein, 26 aa, Mycobacterium
EASEKRLKRWASRRYPVSILDGRTEP

SEQ ID NO: 1314603 - protein, 22 aa, Mycobacterium
EASMFAWGRPPMLPTTPAGVDS

SEQ ID NO: 1314604 - protein, 23 aa, Mycobacterium
EASMFAWGRPPMLPTTPAGVDSW

SEQ ID NO: 1314605 - protein, 22 aa, Mycobacterium
EASRLLRPYHPALDVSPFEIAQ

SEQ ID NO: 1314606 - protein, 23 aa, Mycobacterium
EATALILRLTSAPPPSVRSRRRP

SEQ ID NO: 1314607 - protein, 23 aa, Mycobacterium
EATARWAFERLGPERFGDTTVTP

SEQ ID NO: 1314608 - protein, 22 aa, Mycobacterium
EATFPVSIPIHGMALNITLQSY

SEQ ID NO: 1314609 - protein, 42 aa, Mycobacterium
EATHARLGGPGRWLLALPAYHVAGFQVLVRSVIAGAAPTAVP

SEQ ID NO: 1314610 - protein, 25 aa, Mycobacterium
EATIEGLVLGAYRFSEFRSEKTAPK

SEQ ID NO: 1314611 - protein, 28 aa, Mycobacterium
EATMVSVHAFNLWLDEDWGFNRPDHRIL

SEQ ID NO: 1314612 - protein, 27 aa, Mycobacterium
EATPHRGIALHPVMLDAALQGLAAAMS

SEQ ID NO: 1314613 - protein, 18 aa, Mycobacterium
EATPLHRLGDVEDLGRLC

SEQ ID NO: 1314614 - protein, 21 aa, Mycobacterium
EATRAAAGIGLLPCFMADRHP

SEQ ID NO: 1314615 - protein, 26 aa, Mycobacterium
EATRTIGVPVYLLPGNHDPLDASSVY

SEQ ID NO: 1314616 - protein, 22 aa, Mycobacterium
EATSIVLLTATALGLACCPITE

SEQ ID NO: 1314617 - protein, 21 aa, Mycobacterium
EATTVFLAPPSWEVLESRLVG

SEQ ID NO: 1314618 - protein, 24 aa, Mycobacterium
EAVARAIVFAIEQPPEVEIGDLTI

SEQ ID NO: 1314619 - protein, 22 aa, Mycobacterium
EAVATALEWLPREKYIGLIMVP

SEQ ID NO: 1314620 - protein, 27 aa, Mycobacterium
EAVAYYAYVLAVLYGALLPDATILRDT

SEQ ID NO: 1314621 - protein, 32 aa, Mycobacterium
EAVCELEPYWEALRKVYAPFESGLPAPTGRVY

SEQ ID NO: 1314622 - protein, 19 aa, Mycobacterium
EAVIFFFGQGELLPEAAGA

SEQ ID NO: 1314623 - protein, 27 aa, Mycobacterium
EAVPTIRELLAILSWAIVGTASCDHVR

SEQ ID NO: 1314624 - protein, 30 aa, Mycobacterium
EAVRTVCQATQWLEWMTLVAPEQVLRGVLA

SEQ ID NO: 1314625 - protein, 22 aa, Mycobacterium
EAVTRFLVGGFMEVLRSWMEDP

SEQ ID NO: 1314626 - protein, 20 aa, Mycobacterium
EAVVIFVTNPVDVVTFAATR

SEQ ID NO: 1314627 - protein, 27 aa, Mycobacterium
EAVWWGKRVLGLPIHDNWWQTETGGIM

SEQ ID NO: 1314628 - protein, 18 aa, Mycobacterium
EAWAKPVLLAWGDADKMF

SEQ ID NO: 1314629 - protein, 21 aa, Mycobacterium
EAWAVWEAIFAKYAAPGMCNP

SEQ ID NO: 1314630 - protein, 22 aa, Mycobacterium
EAWAVWEVIFAKYAAPGMCNPD

SEQ ID NO: 1314631 - protein, 25 aa, Mycobacterium
EAWRPDTVWRHRLGSGLPAERVHHE

SEQ ID NO: 1314632 - protein, 26 aa, Mycobacterium
EAWSVLLRHRPTAHTLLIVGSAGFVP

SEQ ID NO: 1314633 - protein, 25 aa, Mycobacterium
EAYPQVLIRLGWAPADGSALPVLER

SEQ ID NO: 1314634 - protein, 19 aa, Mycobacterium
EAYRLLPVYRAEADRLTEA

SEQ ID NO: 1314635 - protein, 19 aa, Mycobacterium
ECHYIVSGAFYYDNYDNGV

SEQ ID NO: 1314636 - protein, 17 aa, Mycobacterium
ECQSLVFRHGVQLFGAM

SEQ ID NO: 1314637 - protein, 19 aa, Mycobacterium
ECVLDVPDLLRAFIPFAHA

SEQ ID NO: 1314638 - protein, 24 aa, Mycobacterium
EDADALPIIAKKSKIPVIADIHFQ

SEQ ID NO: 1314639 - protein, 26 aa, Mycobacterium
EDADLSVPTAWLFGPEAHGLPADVAG

SEQ ID NO: 1314640 - protein, 25 aa, Mycobacterium
EDADRIWPPGLEPSLRRVGVGIART

SEQ ID NO: 1314641 - protein, 26 aa, Mycobacterium
EDADYTLFAKVAPMLPLDGGAIFAAP

SEQ ID NO: 1314642 - protein, 25 aa, Mycobacterium
EDAKTYRFNPFDLTKVWPHGDYPLH

SEQ ID NO: 1314643 - protein, 25 aa, Mycobacterium
EDALGWLDAHWPSDVAAGDPVLVWG

SEQ ID NO: 1314644 - protein, 17 aa, Mycobacterium
EDCAELGEATWAHLRMC

SEQ ID NO: 1314645 - protein, 22 aa, Mycobacterium
EDCYSALHWLTQLPSVDPARVA

SEQ ID NO: 1314646 - protein, 26 aa, Mycobacterium
EDDEQLVLDLLLQEKILLTQGTGFNW

SEQ ID NO: 1314647 - protein, 20 aa, Mycobacterium
EDDLTFGSYGLDQCLDLAEA

SEQ ID NO: 1314648 - protein, 29 aa, Mycobacterium
EDEKALQQAFLFGPPPLGPEAPPLQRLLA

SEQ ID NO: 1314649 - protein, 24 aa, Mycobacterium
EDELMAWALPTAANQFWMLSEPER

SEQ ID NO: 1314650 - protein, 25 aa, Mycobacterium
EDEVYLALYGVWRDAADDEKYGDWA

SEQ ID NO: 1314651 - protein, 23 aa, Mycobacterium
EDFEHFTWDTPVLKVNYALDAPI

SEQ ID NO: 1314652 - protein, 27 aa, Mycobacterium
EDGEVLVCKFVDPGWTALVSLAGALVT

SEQ ID NO: 1314653 - protein, 25 aa, Mycobacterium
EDGGRPIIRVTPRRVISFGIDDQET

SEQ ID NO: 1314654 - protein, 24 aa, Mycobacterium
EDGLPTIFVYDGYPGGAGFAARGY

SEQ ID NO: 1314655 - protein, 28 aa, Mycobacterium
EDGLRALFTTWITFPQPDLDVLVPAVID

SEQ ID NO: 1314656 - protein, 24 aa, Mycobacterium
EDGVPFYRMADSFKGGYSGPEYIE

SEQ ID NO: 1314657 - protein, 18 aa, Mycobacterium
EDGWVIDRFLGANEPLVL

SEQ ID NO: 1314658 - protein, 24 aa, Mycobacterium
EDHDRLCAFAADWNKRTWNPKAVV

SEQ ID NO: 1314659 - protein, 22 aa, Mycobacterium
EDHQKIFHWTNVILGFGDPDIA

SEQ ID NO: 1314660 - protein, 25 aa, Mycobacterium
EDIRLAIVAFGPQTLALGGREFDDV

SEQ ID NO: 1314661 - protein, 19 aa, Mycobacterium
EDIYNPLRFVSATVKWCRK

SEQ ID NO: 1314662 - protein, 22 aa, Mycobacterium
EDKAWFVEHRFLSTERAKAVTR

SEQ ID NO: 1314663 - protein, 23 aa, Mycobacterium
EDLASLQFLISASGPLDPATRDE

SEQ ID NO: 1314664 - protein, 20 aa, Mycobacterium
EDLKPLVDGLNKTLADMMVT

SEQ ID NO: 1314665 - protein, 27 aa, Mycobacterium
EDLLPPVTFQRDPWLALANARRLARDG

SEQ ID NO: 1314666 - protein, 20 aa, Mycobacterium
EDLLRFARPVIHQLLLDPLT

SEQ ID NO: 1314667 - protein, 26 aa, Mycobacterium
EDLLSLVTAMEVSLAFFSGDVPVAVR

SEQ ID NO: 1314668 - protein, 19 aa, Mycobacterium
EDLPLPPGGFDLVTAHYPA

SEQ ID NO: 1314669 - protein, 26 aa, Mycobacterium
EDLPPTPGALLDGLFALAQYSTDRIY

SEQ ID NO: 1314670 - protein, 24 aa, Mycobacterium
EDLRKWFLGLTYTVSGDAVAAAIA

SEQ ID NO: 1314671 - protein, 24 aa, Mycobacterium
EDMIAFTRRAAMPTLPQIAIAHAQ

SEQ ID NO: 1314672 - protein, 17 aa, Mycobacterium
EDPARFVANALSPAKVV

SEQ ID NO: 1314673 - protein, 26 aa, Mycobacterium
EDPGPLRRLIATLPALEVPRPDWPAE

SEQ ID NO: 1314674 - protein, 25 aa, Mycobacterium
EDPNATIYLLTPFDGTVAAQAITLM

SEQ ID NO: 1314675 - protein, 17 aa, Mycobacterium
EDPVYRTAFEWMTDYRR

SEQ ID NO: 1314676 - protein, 25 aa, Mycobacterium
EDQKKFFLPKIASGDLHFSIGYSEP

SEQ ID NO: 1314677 - protein, 18 aa, Mycobacterium
EDQLVYRAGIRRVARLVH

SEQ ID NO: 1314678 - protein, 24 aa, Mycobacterium
EDRELDGYGWLRRAHELEDAAGRV

SEQ ID NO: 1314679 - protein, 22 aa, Mycobacterium
EDRTLFMLTAADAYPERLRGTT

SEQ ID NO: 1314680 - protein, 23 aa, Mycobacterium
EDRTLITLPGYPFAKQRHWVEHN

SEQ ID NO: 1314681 - protein, 23 aa, Mycobacterium
EDRYPWLESIGEWLARHPQGGVM

SEQ ID NO: 1314682 - protein, 29 aa, Mycobacterium
EDSKTFAILPNAIAVIRRAAAEEALLRRS

SEQ ID NO: 1314683 - protein, 24 aa, Mycobacterium
EDSRWTVQLAWKAGLSDNVAHFRY

SEQ ID NO: 1314684 - protein, 19 aa, Mycobacterium
EDSWTTITLREGGTPLLPA

SEQ ID NO: 1314685 - protein, 26 aa, Mycobacterium
EDSYLALLDALRWLGMDWDEGPEIGG

SEQ ID NO: 1314686 - protein, 23 aa, Mycobacterium
EDTEFWRYPVWAPREAGADQIVV

SEQ ID NO: 1314687 - protein, 31 aa, Mycobacterium
EDTRPFMGTEVSLRWIFIHMIGEYARHNGHA

SEQ ID NO: 1314688 - protein, 24 aa, Mycobacterium
EDVFPLPRELVGEGSLFLLKVVGE

SEQ ID NO: 1314689 - protein, 23 aa, Mycobacterium
EDVKFRLELDMRYGNQLLTQAVA

SEQ ID NO: 1314690 - protein, 23 aa, Mycobacterium
EDVNGHLFPFCALLTEMAGRGHE

SEQ ID NO: 1314691 - protein, 27 aa, Mycobacterium
EDWDLEKLWEGLRQLYPVGIDHHDLID

SEQ ID NO: 1314692 - protein, 19 aa, Mycobacterium
EDWNAAISVNLWGVIYGCE

SEQ ID NO: 1314693 - protein, 21 aa, Mycobacterium
EDYKQFLTDIGYLEPEPADFS

SEQ ID NO: 1314694 - protein, 31 aa, Mycobacterium
EEAELRAWLRRFSTDRPRWGWRRAAKMARKA

SEQ ID NO: 1314695 - protein, 26 aa, Mycobacterium
EEALPSRPVQVIGFTSVPGAGDNFLV

SEQ ID NO: 1314696 - protein, 17 aa, Mycobacterium
EEALRFESPIRGDFRLS

SEQ ID NO: 1314697 - protein, 24 aa, Mycobacterium
EEARALAALLTKHADKLESSDRDK

SEQ ID NO: 1314698 - protein, 26 aa, Mycobacterium
EEARKNFFRVPLIGGTVTHPVQGEAA

SEQ ID NO: 1314699 - protein, 19 aa, Mycobacterium
EEASSLPGRLALDVLSRLA

SEQ ID NO: 1314700 - protein, 18 aa, Mycobacterium
EEAVSVGDLVRLMEFRKG

SEQ ID NO: 1314701 - protein, 18 aa, Mycobacterium
EECGRWTMTAGPTTGAVR

SEQ ID NO: 1314702 - protein, 24 aa, Mycobacterium
EEDLRGWLWGLTYTVSGDGMIAAT

SEQ ID NO: 1314703 - protein, 24 aa, Mycobacterium
EEDPSPTVFAAKAAYEAAGIGPED

SEQ ID NO: 1314704 - protein, 25 aa, Mycobacterium
EEESPILYLRLRKAVRRHGLQVLSV

SEQ ID NO: 1314705 - protein, 20 aa, Mycobacterium
EEFLMMPAFVRAFGKRVAIG

SEQ ID NO: 1314706 - protein, 17 aa, Mycobacterium
EEFRASRIMLDRARANE

SEQ ID NO: 1314707 - protein, 23 aa, Mycobacterium
EEFRCGRMFIFIGAEPRTEWLDG

SEQ ID NO: 1314708 - protein, 17 aa, Mycobacterium
EEFVLRGGKRLRPAFAY

SEQ ID NO: 1314709 - protein, 26 aa, Mycobacterium
EEFYDYAAQWRTWPGYSDAERIAMEF

SEQ ID NO: 1314710 - protein, 37 aa, Mycobacterium
EEGDRGVSWLPFFHDMGLITVLLPTVIGHYVEFMTPA

SEQ ID NO: 1314711 - protein, 28 aa, Mycobacterium
EEGFVRRIRSLPVKTRRLLLVAAAEPVG

SEQ ID NO: 1314712 - protein, 22 aa, Mycobacterium
EEGILRNLLAASLAPRTSAGTS

SEQ ID NO: 1314713 - protein, 18 aa, Mycobacterium
EEGLPGVPVLPASAPVGP

SEQ ID NO: 1314714 - protein, 18 aa, Mycobacterium
EEGPLSYLGLAVAGFPNL

SEQ ID NO: 1314715 - protein, 21 aa, Mycobacterium
EEGRALLSELLDRATTADKVY

SEQ ID NO: 1314716 - protein, 25 aa, Mycobacterium
EEGRAYRAMADPIALSAALHLPAGS

SEQ ID NO: 1314717 - protein, 17 aa, Mycobacterium
EEGRLWLLQTRVAKRSA

SEQ ID NO: 1314718 - protein, 18 aa, Mycobacterium
EEHPRPRLFTAVRQEPDH

SEQ ID NO: 1314719 - protein, 28 aa, Mycobacterium
EEHTRFRRMLSKPFTFRRVEALRPVIQQ

SEQ ID NO: 1314720 - protein, 24 aa, Mycobacterium
EEIFGPVLSVLRFTDLDAAVAQAN

SEQ ID NO: 1314721 - protein, 18 aa, Mycobacterium
EEIGPVLRAILQTAAHEA

SEQ ID NO: 1314722 - protein, 26 aa, Mycobacterium
EEIGRSLAPVPWIDHICAARLLARLG

SEQ ID NO: 1314723 - protein, 24 aa, Mycobacterium
EEIKSGLRKLTITSAGYPVLCGSA

SEQ ID NO: 1314724 - protein, 18 aa, Mycobacterium
EEILLAALGRTFGRTRGE

SEQ ID NO: 1314725 - protein, 26 aa, Mycobacterium
EEIRARWDRYALFAQRTFNVEIPAIP

SEQ ID NO: 1314726 - protein, 26 aa, Mycobacterium
EEKLYPVIDALIEAWRATGDRAIPHT

SEQ ID NO: 1314727 - protein, 18 aa, Mycobacterium
EELAKFGFLTPALSVHND

SEQ ID NO: 1314728 - protein, 22 aa, Mycobacterium
EELASYLAALRDAAHAARTAVD

SEQ ID NO: 1314729 - protein, 19 aa, Mycobacterium
EELGFTRRRLSAEGVIDPQ

SEQ ID NO: 1314730 - protein, 26 aa, Mycobacterium
EELGIDVFLVMPFTSDFMKLTPERYI

SEQ ID NO: 1314731 - protein, 22 aa, Mycobacterium
EELGLTWLCEIGAHGVVAGPDS

SEQ ID NO: 1314732 - protein, 18 aa, Mycobacterium
EELLAESALALPDKEVVS

SEQ ID NO: 1314733 - protein, 18 aa, Mycobacterium
EELLRWLSIVHTAIPRIT

SEQ ID NO: 1314734 - protein, 21 aa, Mycobacterium
EELLTEARRALREAIGIVEEL

SEQ ID NO: 1314735 - protein, 24 aa, Mycobacterium
EELQAAFALSPWAARTPIDVEVPF

SEQ ID NO: 1314736 - protein, 18 aa, Mycobacterium
EELSAESAIALPDKEVVS

SEQ ID NO: 1314737 - protein, 18 aa, Mycobacterium
EELSALLRRRGATVTSAA

SEQ ID NO: 1314738 - protein, 24 aa, Mycobacterium
EENILKTLNPLFLDELRAEFDRAR

SEQ ID NO: 1314739 - protein, 25 aa, Mycobacterium
EENLRFELDRYLGWPGQAPSYAIGQ

SEQ ID NO: 1314740 - protein, 25 aa, Mycobacterium
EENWELSYVQRMAVVLGRRVWENAG

SEQ ID NO: 1314741 - protein, 26 aa, Mycobacterium
EEPANQGAWPTLGLTLPEVLPEKLAG

SEQ ID NO: 1314742 - protein, 21 aa, Mycobacterium
EEPPPSTVFLLCAPSVDPEDI

SEQ ID NO: 1314743 - protein, 23 aa, Mycobacterium
EEPRKEWTLQFTIGEAPRSSAVV

SEQ ID NO: 1314744 - protein, 27 aa, Mycobacterium
EEQAGAILFLLSDLSSYITGQTLLVDG

SEQ ID NO: 1314745 - protein, 25 aa, Mycobacterium
EEQAHAYCLRLLTARARTRAELSGK

SEQ ID NO: 1314746 - protein, 25 aa, Mycobacterium
EEQKKFFLPKIAAGDLHFSIGYSEP

SEQ ID NO: 1314747 - protein, 25 aa, Mycobacterium
EEQKKRWIPGIADGSLTMAFAITEP

SEQ ID NO: 1314748 - protein, 22 aa, Mycobacterium
EEQKQRWLPKFCSGEIISAIAM

SEQ ID NO: 1314749 - protein, 24 aa, Mycobacterium
EEQMAVLTDFFNYFGALTASRREN

SEQ ID NO: 1314750 - protein, 23 aa, Mycobacterium
EEQRERLLPRIAAGRFYSSIGMS

SEQ ID NO: 1314751 - protein, 31 aa, Mycobacterium
EERDIRFVRLWFTDVLGYLKSVAIAPAELEG

SEQ ID NO: 1314752 - protein, 32 aa, Mycobacterium
EERHDFYVLDEFTYPLKWGWLDVDDVVSTLTA

SEQ ID NO: 1314753 - protein, 21 aa, Mycobacterium
EERKRLFELPRSSWEDYDTSL

SEQ ID NO: 1314754 - protein, 23 aa, Mycobacterium
EERRLLIAAFGRARRRVLVTAVD

SEQ ID NO: 1314755 - protein, 17 aa, Mycobacterium
EERRLLYVGVTRARVHL

SEQ ID NO: 1314756 - protein, 22 aa, Mycobacterium
EESRLLTRELFYTAVTRAKAKV

SEQ ID NO: 1314757 - protein, 32 aa, Mycobacterium
EESTQWLANERFFGSYRRQLSLGDGVDTAAIS

SEQ ID NO: 1314758 - protein, 19 aa, Mycobacterium
EESVGFLFNVTVEAAPPAP

SEQ ID NO: 1314759 - protein, 26 aa, Mycobacterium
EETGAALLPSPFISSAVLTAALIQAA

SEQ ID NO: 1314760 - protein, 20 aa, Mycobacterium
EETGYRAHLGRRLPTVTYPV

SEQ ID NO: 1314761 - protein, 22 aa, Mycobacterium
EETLLRLSLVDYGLPRPTTDIV

SEQ ID NO: 1314762 - protein, 23 aa, Mycobacterium
EETPAHFIGFDALASGDTSLMKE

SEQ ID NO: 1314763 - protein, 25 aa, Mycobacterium
EEVAKLTYYGLYALQHRGQEAAGIA

SEQ ID NO: 1314764 - protein, 24 aa, Mycobacterium
EEVFGPLLAFQRAGSLTEAIELAN

SEQ ID NO: 1314765 - protein, 19 aa, Mycobacterium
EEVLTPATPGAEALPLPEG

SEQ ID NO: 1314766 - protein, 20 aa, Mycobacterium
EEVVARLRVILRRSGRGHEE

SEQ ID NO: 1314767 - protein, 24 aa, Mycobacterium
EEVVLRLRALLRRTGVSTDTSGAK

SEQ ID NO: 1314768 - protein, 25 aa, Mycobacterium
EEYAKTFSGPLPLPPSRHVAVVACM

SEQ ID NO: 1314769 - protein, 24 aa, Mycobacterium
EEYPDLPILAYNVPVRTAVDLAPE

SEQ ID NO: 1314770 - protein, 25 aa, Mycobacterium
EFAALYPALFEVMYTKEVFVGGNAR

SEQ ID NO: 1314771 - protein, 17 aa, Mycobacterium
EFALPDPACRPHAITAG

SEQ ID NO: 1314772 - protein, 25 aa, Mycobacterium
EFAYGVLRGWLHTLRDRLTVEAAAH

SEQ ID NO: 1314773 - protein, 18 aa, Mycobacterium
EFDAEITMLARRLNAMES

SEQ ID NO: 1314774 - protein, 24 aa, Mycobacterium
EFDEWQRLYLFSRSDTIYGGSNEI

SEQ ID NO: 1314775 - protein, 17 aa, Mycobacterium
EFDILRDPNPHLGFGGN

SEQ ID NO: 1314776 - protein, 19 aa, Mycobacterium
EFDPSRFVFGHKTMVGVSL

SEQ ID NO: 1314777 - protein, 20 aa, Mycobacterium
EFDSMIGLFTPDAVFDRAGI

SEQ ID NO: 1314778 - protein, 31 aa, Mycobacterium
EFEFEAELIGLSWTVYSFSSAPPAGHFDLGE

SEQ ID NO: 1314779 - protein, 23 aa, Mycobacterium
EFEGLTLCAKLSAAHPKLGLLVL

SEQ ID NO: 1314780 - protein, 23 aa, Mycobacterium
EFESLRPYLLSVAYRLTGSVTDA

SEQ ID NO: 1314781 - protein, 19 aa, Mycobacterium
EFGAALRDWSRQVLALVVE

SEQ ID NO: 1314782 - protein, 21 aa, Mycobacterium
EFGGYLFPVGTFVLANTFAAN

SEQ ID NO: 1314783 - protein, 19 aa, Mycobacterium
EFGLPTPVIPSFGGGGAGA

SEQ ID NO: 1314784 - protein, 28 aa, Mycobacterium
EFGPADWYETMEALLLGAFISEGFVSES

SEQ ID NO: 1314785 - protein, 18 aa, Mycobacterium
EFGRGLVDVPFLGPVLAD

SEQ ID NO: 1314786 - protein, 26 aa, Mycobacterium
EFGTLATWLVFVLNTALGSLDRLGGA

SEQ ID NO: 1314787 - protein, 26 aa, Mycobacterium
EFIRDAKVIAPDKPWFSYVCPGAGHA

SEQ ID NO: 1314788 - protein, 17 aa, Mycobacterium
EFKAMFLDDLLNGSRRQ

SEQ ID NO: 1314789 - protein, 21 aa, Mycobacterium
EFKVALARRTLIAELRALTGR

SEQ ID NO: 1314790 - protein, 17 aa, Mycobacterium
EFLIGGVIGRFHRVGDI

SEQ ID NO: 1314791 - protein, 19 aa, Mycobacterium
EFLNRFPGRVVNTHPALLP

SEQ ID NO: 1314792 - protein, 19 aa, Mycobacterium
EFLSLQRDLYAYLHDQTLR

SEQ ID NO: 1314793 - protein, 24 aa, Mycobacterium
EFNDRLMERHTLGGRLGRDELLAG

SEQ ID NO: 1314794 - protein, 17 aa, Mycobacterium
EFNVPPRRLPGRAALDL

SEQ ID NO: 1314795 - protein, 18 aa, Mycobacterium
EFPDADRFVWNRPMPRLL

SEQ ID NO: 1314796 - protein, 24 aa, Mycobacterium
EFPSLRTCFASLYDITPQARSGYF

SEQ ID NO: 1314797 - protein, 36 aa, Mycobacterium
EFPTPVTFCEIFPPDDFPLYFYRKPSAPDLQIKPEE

SEQ ID NO: 1314798 - protein, 22 aa, Mycobacterium
EFPVVQAPMTYIARAELAAAVS

SEQ ID NO: 1314799 - protein, 31 aa, Mycobacterium
EFQVRLLAKRPGPDLGLMPLDLSLGVADEDS

SEQ ID NO: 1314800 - protein, 17 aa, Mycobacterium
EFRQDGMNLLPLASLNS

SEQ ID NO: 1314801 - protein, 32 aa, Mycobacterium
EFRRHSVGFVFQFFNLLPTMTAWENVAVPKLL

SEQ ID NO: 1314802 - protein, 17 aa, Mycobacterium
EFSERLAALLPDPLDTV

SEQ ID NO: 1314803 - protein, 21 aa, Mycobacterium
EFTVAPCRHPFRVEVTVAAGR

SEQ ID NO: 1314804 - protein, 26 aa, Mycobacterium
EFTVVTVQPHRIPADGRPSVMFGCRP

SEQ ID NO: 1314805 - protein, 17 aa, Mycobacterium
EFVCKNFGALQVLKGVT

SEQ ID NO: 1314806 - protein, 18 aa, Mycobacterium
EFVCLLDELLAPALNMTR

SEQ ID NO: 1314807 - protein, 25 aa, Mycobacterium
EFVEALPAIVWYLDEPVADPALVPL

SEQ ID NO: 1314808 - protein, 24 aa, Mycobacterium
EFVENYFRFIAEDIRKYLAELGFR

SEQ ID NO: 1314809 - protein, 28 aa, Mycobacterium
EFYTHKLMTPMFVPPRHPYGDPRVFVAA

SEQ ID NO: 1314810 - protein, 20 aa, Mycobacterium
EFYTRVMEVPYWSKTTCLSA

SEQ ID NO: 1314811 - protein, 25 aa, Mycobacterium
EGAAPKGIFPWYAPGSDTFLGEFPL

SEQ ID NO: 1314812 - protein, 17 aa, Mycobacterium
EGAGCPVAIIRTRADGA

SEQ ID NO: 1314813 - protein, 18 aa, Mycobacterium
EGAGYRRAGEGADADIVV

SEQ ID NO: 1314814 - protein, 26 aa, Mycobacterium
EGALLPTALMLSNAFLIERELLGTDK

SEQ ID NO: 1314815 - protein, 28 aa, Mycobacterium
EGAPAMVHVDLYRLLDQASVDLLAELDS

SEQ ID NO: 1314816 - protein, 23 aa, Mycobacterium
EGAPLRPRSLYAASKVAQEHYAL

SEQ ID NO: 1314817 - protein, 21 aa, Mycobacterium
EGAQHPFERFMRTLQSDERGV

SEQ ID NO: 1314818 - protein, 23 aa, Mycobacterium
EGAVTLVANDKWWGAKPVTNRIT

SEQ ID NO: 1314819 - protein, 24 aa, Mycobacterium
EGDDLMPNLRFLQDSGIAFEHLDT

SEQ ID NO: 1314820 - protein, 25 aa, Mycobacterium
EGDEEAGTYVGRTGSDDALDDEQTG

SEQ ID NO: 1314821 - protein, 28 aa, Mycobacterium
EGDFDAERWYRILESQGVTVWYTAPTAI

SEQ ID NO: 1314822 - protein, 23 aa, Mycobacterium
EGDLMLGVATYIDSPRPDCAEVA

SEQ ID NO: 1314823 - protein, 19 aa, Mycobacterium
EGDLYCRVPQDSPLSVRGA

SEQ ID NO: 1314824 - protein, 22 aa, Mycobacterium
EGDNVFVALSWSKHPAPQNYQE

SEQ ID NO: 1314825 - protein, 24 aa, Mycobacterium
EGDPARYFYVLLDGEIALSKRSGD

SEQ ID NO: 1314826 - protein, 26 aa, Mycobacterium
EGDVIPLRYFGVELVAFRDLQGAVHV

SEQ ID NO: 1314827 - protein, 22 aa, Mycobacterium
EGDWLGTPYLHFTREGPFGVCR

SEQ ID NO: 1314828 - protein, 23 aa, Mycobacterium
EGEFDAERWYRILQSQQVTVWYT

SEQ ID NO: 1314829 - protein, 28 aa, Mycobacterium
EGEFDAERWYRILQSQQVTVWYTAPTAI

SEQ ID NO: 1314830 - protein, 22 aa, Mycobacterium
EGEIRWCQLFSEPGAGSDAAAV

SEQ ID NO: 1314831 - protein, 21 aa, Mycobacterium
EGELYFPGSPVLSVHGTFGEC

SEQ ID NO: 1314832 - protein, 19 aa, Mycobacterium
EGEREVGFRSALRNCGRTI

SEQ ID NO: 1314833 - protein, 23 aa, Mycobacterium
EGFAPLRIRRVVRETADAVSLVL

SEQ ID NO: 1314834 - protein, 18 aa, Mycobacterium
EGFDFVAMGRALLAEPDL

SEQ ID NO: 1314835 - protein, 30 aa, Mycobacterium
EGFEGGWPGFFAVLRLYLRDFAGQPAAPVR

SEQ ID NO: 1314836 - protein, 22 aa, Mycobacterium
EGFRSRWIGNLDPAATLIAFAE

SEQ ID NO: 1314837 - protein, 26 aa, Mycobacterium
EGFSFHDLRHYLASLLIASGADIKTV

SEQ ID NO: 1314838 - protein, 17 aa, Mycobacterium
EGGGRLVVELTPEEAAA

SEQ ID NO: 1314839 - protein, 26 aa, Mycobacterium
EGGLIQALFVTLPKALAAAIAPEEAV

SEQ ID NO: 1314840 - protein, 17 aa, Mycobacterium
EGGPLLRFMSGNLSQQI

SEQ ID NO: 1314841 - protein, 32 aa, Mycobacterium
EGGQMPIHMRLPKLKGFRNRFRTEYAPVNVGD

SEQ ID NO: 1314842 - protein, 20 aa, Mycobacterium
EGGQYALTYPRRLGFGLGET

SEQ ID NO: 1314843 - protein, 21 aa, Mycobacterium
EGGQYLLHIRPTAPNPDIVTA

SEQ ID NO: 1314844 - protein, 27 aa, Mycobacterium
EGGRIFNPGWHLAIDMRNMLLVSECVA

SEQ ID NO: 1314845 - protein, 23 aa, Mycobacterium
EGGRWIVTLLGWQGDFAGGDIAG

SEQ ID NO: 1314846 - protein, 23 aa, Mycobacterium
EGGSFTKFPFGASPTLPTIFTHR

SEQ ID NO: 1314847 - protein, 31 aa, Mycobacterium
EGGVKHYDFLPTIDRWLVSVPMVHLDTLGAG

SEQ ID NO: 1314848 - protein, 25 aa, Mycobacterium
EGHDDWVRINGFGTEWWAGDLEMLA

SEQ ID NO: 1314849 - protein, 25 aa, Mycobacterium
EGIAQAWRHIIFGEADIAICGGVEA

SEQ ID NO: 1314850 - protein, 22 aa, Mycobacterium
EGIPAERLVWSEAVAPGGYTAA

SEQ ID NO: 1314851 - protein, 23 aa, Mycobacterium
EGIRSVLAVPVLVDGRARAMLYG

SEQ ID NO: 1314852 - protein, 20 aa, Mycobacterium
EGIVPAWEWARRTGNEDTAR

SEQ ID NO: 1314853 - protein, 27 aa, Mycobacterium
EGKAVKRYKITAAWPKSLEISSLKAGD

SEQ ID NO: 1314854 - protein, 27 aa, Mycobacterium
EGKGFKYILDGLNPERMLIAAEALGIG

SEQ ID NO: 1314855 - protein, 17 aa, Mycobacterium
EGKLPPAEYLTQAIPAG

SEQ ID NO: 1314856 - protein, 18 aa, Mycobacterium
EGLAPRIKNLGQWRHHLI

SEQ ID NO: 1314857 - protein, 24 aa, Mycobacterium
EGLDFLYRRGAYTDAPRPDLVLLD

SEQ ID NO: 1314858 - protein, 25 aa, Mycobacterium
EGLELAIVYLPLPHDPAVLEPLADK

SEQ ID NO: 1314859 - protein, 20 aa, Mycobacterium
EGLGQLYIRLLTSNFEEAVA

SEQ ID NO: 1314860 - protein, 20 aa, Mycobacterium
EGLHYRVLQGRDREAGPFVV

SEQ ID NO: 1314861 - protein, 18 aa, Mycobacterium
EGLKKNLRHRDGRWYWHW

SEQ ID NO: 1314862 - protein, 18 aa, Mycobacterium
EGLLFALGGPIYAGTNEI

SEQ ID NO: 1314863 - protein, 17 aa, Mycobacterium
EGLPISILEADAAGLPI

SEQ ID NO: 1314864 - protein, 25 aa, Mycobacterium
EGLPRLAGVPGWFACDVIQLVEAAD

SEQ ID NO: 1314865 - protein, 27 aa, Mycobacterium
EGLRQLTFALWDMVAAYRAAQPAAVSR

SEQ ID NO: 1314866 - protein, 25 aa, Mycobacterium
EGLRRWVRPHLDGYEPLFAAVEEQG

SEQ ID NO: 1314867 - protein, 23 aa, Mycobacterium
EGLVGILRIVGNLITRGAARRRV

SEQ ID NO: 1314868 - protein, 24 aa, Mycobacterium
EGMRRLFRQFSFPGGIPSHVAPET

SEQ ID NO: 1314869 - protein, 17 aa, Mycobacterium
EGNAVCVGIAPDLFDLD

SEQ ID NO: 1314870 - protein, 17 aa, Mycobacterium
EGNAVCVGIAPDLFELD

SEQ ID NO: 1314871 - protein, 29 aa, Mycobacterium
EGNRHFNPGWHLAIDLRNMLLVSECVAKA

SEQ ID NO: 1314872 - protein, 27 aa, Mycobacterium
EGPDPVDLVAFLSLRFAPPTLTNTEGD

SEQ ID NO: 1314873 - protein, 28 aa, Mycobacterium
EGPFFTARVLPGWSFRLTAAGDLLLNDK

SEQ ID NO: 1314874 - protein, 22 aa, Mycobacterium
EGPFRREWLTAGIGDHYMADAG

SEQ ID NO: 1314875 - protein, 25 aa, Mycobacterium
EGPGEALFVFLRDMVRSAAADYGLV

SEQ ID NO: 1314876 - protein, 20 aa, Mycobacterium
EGPGFNVCIVKDGKLASPSR

SEQ ID NO: 1314877 - protein, 22 aa, Mycobacterium
EGPLKGILKYYDAPIVSSDIVT

SEQ ID NO: 1314878 - protein, 25 aa, Mycobacterium
EGPPGPVPGPPVLLGAVFGEWDEAI

SEQ ID NO: 1314879 - protein, 22 aa, Mycobacterium
EGQPRHPLYLRADTPLQCLTAG

SEQ ID NO: 1314880 - protein, 28 aa, Mycobacterium
EGQRFKKFERLWLSWAMANRDASVFDRP

SEQ ID NO: 1314881 - protein, 17 aa, Mycobacterium
EGQRVQPLPAGNGDGWG

SEQ ID NO: 1314882 - protein, 27 aa, Mycobacterium
EGQSHAWIQAWTGEWWHYDPTNDADIN

SEQ ID NO: 1314883 - protein, 17 aa, Mycobacterium
EGQWLGCSVDRWLENKT

SEQ ID NO: 1314884 - protein, 20 aa, Mycobacterium
EGRDVSHIISWLSTLDAVQK

SEQ ID NO: 1314885 - protein, 23 aa, Mycobacterium
EGRFVAGAVLRGRPARGGAEREF

SEQ ID NO: 1314886 - protein, 29 aa, Mycobacterium
EGRGFYHLMHNLPSERLSIAISAIAGARE

SEQ ID NO: 1314887 - protein, 22 aa, Mycobacterium
EGRGIVMRVPLEGGGRLVVELT

SEQ ID NO: 1314888 - protein, 22 aa, Mycobacterium
EGRKFREIALLTNVPIGTVMSR

SEQ ID NO: 1314889 - protein, 24 aa, Mycobacterium
EGRKHIVRRLLAEVGFPVQELVRT

SEQ ID NO: 1314890 - protein, 26 aa, Mycobacterium
EGRKRIVRRLLAAVGFPVQELVRTDI

SEQ ID NO: 1314891 - protein, 26 aa, Mycobacterium
EGRPGPVSALFFDLDRLKAINDYLGH

SEQ ID NO: 1314892 - protein, 29 aa, Mycobacterium
EGRRLAPTMAWPVVSASYLRLAQKMLTGR

SEQ ID NO: 1314893 - protein, 32 aa, Mycobacterium
EGRRLAPTMAWPVVSASYLRLAQKMLTGRSAL

SEQ ID NO: 1314894 - protein, 31 aa, Mycobacterium
EGRTRPVMLLTSDSAFLFHIAELETAARENV

SEQ ID NO: 1314895 - protein, 23 aa, Mycobacterium
EGRYKFHHINTAPLAEIGERWLK

SEQ ID NO: 1314896 - protein, 25 aa, Mycobacterium
EGSFPLRSHVLHEGIRFPLGVASAG

SEQ ID NO: 1314897 - protein, 17 aa, Mycobacterium
EGSGLMGILASNGAFGP

SEQ ID NO: 1314898 - protein, 26 aa, Mycobacterium
EGSVDHFEWLENLGFQFERSYYPGKV

SEQ ID NO: 1314899 - protein, 30 aa, Mycobacterium
EGSVEHFNWLEALGFQFERSYYPGKVVVPP

SEQ ID NO: 1314900 - protein, 18 aa, Mycobacterium
EGTGLGLDLAWRIVVEKH

SEQ ID NO: 1314901 - protein, 23 aa, Mycobacterium
EGTLPDMLTFDPAKPAQYPNGRV

SEQ ID NO: 1314902 - protein, 24 aa, Mycobacterium
EGTVTFGRYFLGGGGAVHGGAIPL

SEQ ID NO: 1314903 - protein, 22 aa, Mycobacterium
EGVDAMPWLLAGAKTLSYAVNM

SEQ ID NO: 1314904 - protein, 18 aa, Mycobacterium
EGVDWLLARDELPDMVFE

SEQ ID NO: 1314905 - protein, 25 aa, Mycobacterium
EGVHTLPVLYALRETGPDADRLREL

SEQ ID NO: 1314906 - protein, 17 aa, Mycobacterium
EGVKGKAKEVVGVVTGR

SEQ ID NO: 1314907 - protein, 27 aa, Mycobacterium
EGVNGQLFIVYGPKVTLVAAPVAEAHF

SEQ ID NO: 1314908 - protein, 27 aa, Mycobacterium
EGVNGQLFIVYGPTVTLMAAPTAERQF

SEQ ID NO: 1314909 - protein, 25 aa, Mycobacterium
EGVTAIVWAIGYRPDYRWIEASAFD

SEQ ID NO: 1314910 - protein, 25 aa, Mycobacterium
EGWFPTRDIATLDDDGYLFIGGRSD

SEQ ID NO: 1314911 - protein, 25 aa, Mycobacterium
EGYDFDLFRRAALPRLHALAPLRYQ

SEQ ID NO: 1314912 - protein, 21 aa, Mycobacterium
EGYDMFIAMLDGMKEESVGFL

SEQ ID NO: 1314913 - protein, 19 aa, Mycobacterium
EGYTLLGYLAGHTSRISLG

SEQ ID NO: 1314914 - protein, 22 aa, Mycobacterium
EHADALWRYALQLTGDAATAED

SEQ ID NO: 1314915 - protein, 24 aa, Mycobacterium
EHAHWIIVGMMMPGSSEAPEPHFA

SEQ ID NO: 1314916 - protein, 22 aa, Mycobacterium
EHAHYWPKLTAMYPDFDSYRSW

SEQ ID NO: 1314917 - protein, 20 aa, Mycobacterium
EHALERFVSLRPRRLRVILG

SEQ ID NO: 1314918 - protein, 27 aa, Mycobacterium
EHAVWALMDFGFRVVISSRFADIFRGN

SEQ ID NO: 1314919 - protein, 17 aa, Mycobacterium
EHAYLVTHARILCAVAL

SEQ ID NO: 1314920 - protein, 26 aa, Mycobacterium
EHDAQLYLKRLLSFSRFMGGPGTYLQ

SEQ ID NO: 1314921 - protein, 28 aa, Mycobacterium
EHDERLDWVLETFPRLAERRNQVGGTLS

SEQ ID NO: 1314922 - protein, 24 aa, Mycobacterium
EHDHSWFVLNQRIIEKEFALSGSE

SEQ ID NO: 1314923 - protein, 30 aa, Mycobacterium
EHDRRFDIVLYLNGMPIAFFELKQAGSKYA

SEQ ID NO: 1314924 - protein, 27 aa, Mycobacterium
EHEGKPFFASLLEFITSGPVVAAILEG

SEQ ID NO: 1314925 - protein, 19 aa, Mycobacterium
EHELAVIEQLNFPGYFLVV

SEQ ID NO: 1314926 - protein, 23 aa, Mycobacterium
EHEPFQRFIERLYSAMLGNETGT

SEQ ID NO: 1314927 - protein, 28 aa, Mycobacterium
EHFGYDRPLYTLAHYGVLIGPLGDLLRR

SEQ ID NO: 1314928 - protein, 25 aa, Mycobacterium
EHFSVKWQLVRRLVTFVEFSRGAFC

SEQ ID NO: 1314929 - protein, 31 aa, Mycobacterium
EHGTRPRALYSFQDLVALRTFARLRSKVSLQ

SEQ ID NO: 1314930 - protein, 24 aa, Mycobacterium
EHHGDVFIDPYEWLRDRSDPEVLA

SEQ ID NO: 1314931 - protein, 25 aa, Mycobacterium
EHHRLRRLMNPAFSNKLIGGLVPRF

SEQ ID NO: 1314932 - protein, 17 aa, Mycobacterium
EHIHVLLWAASRPTSPY

SEQ ID NO: 1314933 - protein, 18 aa, Mycobacterium
EHIRRGWIAMGRAAIEGR

SEQ ID NO: 1314934 - protein, 18 aa, Mycobacterium
EHKRWFADRLAQVSTEAG

SEQ ID NO: 1314935 - protein, 20 aa, Mycobacterium
EHLAGLRLQPGYERVLEEGR

SEQ ID NO: 1314936 - protein, 17 aa, Mycobacterium
EHLCVRYILDQPSIERE

SEQ ID NO: 1314937 - protein, 26 aa, Mycobacterium
EHLDQLELLWIPRAEPTRLFRIGEQP

SEQ ID NO: 1314938 - protein, 29 aa, Mycobacterium
EHLIAADMTWLLSRWTCVFGTPACKGTVE

SEQ ID NO: 1314939 - protein, 29 aa, Mycobacterium
EHLIAADMTWLLSRWTCVFGTPACQGTVE

SEQ ID NO: 1314940 - protein, 18 aa, Mycobacterium
EHLLDFMPRYEVDFDGLE

SEQ ID NO: 1314941 - protein, 19 aa, Mycobacterium
EHNCDFSALLPAARAVRES

SEQ ID NO: 1314942 - protein, 29 aa, Mycobacterium
EHNLGDLLRYWLDEWRAYIAPKKVKLAAD

SEQ ID NO: 1314943 - protein, 24 aa, Mycobacterium
EHPGRLVPNFLRRAIAYMEDNATA

SEQ ID NO: 1314944 - protein, 23 aa, Mycobacterium
EHPRLRLVIAHMGGPEYSEFLDL

SEQ ID NO: 1314945 - protein, 19 aa, Mycobacterium
EHPTIRRVLFNGAAAERNF

SEQ ID NO: 1314946 - protein, 18 aa, Mycobacterium
EHPVFRRRRFFSGKPVGR

SEQ ID NO: 1314947 - protein, 17 aa, Mycobacterium
EHQLASPAVRRALGLAE

SEQ ID NO: 1314948 - protein, 17 aa, Mycobacterium
EHRPAVAGLPPAAIRSV

SEQ ID NO: 1314949 - protein, 26 aa, Mycobacterium
EHRSPHFSDWRKVRRNKAFRRGPTIL

SEQ ID NO: 1314950 - protein, 24 aa, Mycobacterium
EHSAHYYFRDFWGADSGMLAALHV

SEQ ID NO: 1314951 - protein, 18 aa, Mycobacterium
EHTPLLIPDAALSGLEPQ

SEQ ID NO: 1314952 - protein, 25 aa, Mycobacterium
EHTRLRKIVSRLFTPRAIAGMEDRL

SEQ ID NO: 1314953 - protein, 35 aa, Mycobacterium
EHVAGYVRAALTSPRRFVRGAGQLVRLAAAAPRAA

SEQ ID NO: 1314954 - protein, 19 aa, Mycobacterium
EHVPFKTPTYARDLLQTPI

SEQ ID NO: 1314955 - protein, 30 aa, Mycobacterium
EHVTGYLVLDKPWPAMLRGIWGDEERFRET

SEQ ID NO: 1314956 - protein, 20 aa, Mycobacterium
EHWRRLFALADERRAPVAGV

SEQ ID NO: 1314957 - protein, 20 aa, Mycobacterium
EHWSIHRKPPAFADLEPRTE

SEQ ID NO: 1314958 - protein, 27 aa, Mycobacterium
EHWTVVRIALPAALARYVVQKGSITVD

SEQ ID NO: 1314959 - protein, 17 aa, Mycobacterium
EHYLGLVKGLLDEAGIN

SEQ ID NO: 1314960 - protein, 21 aa, Mycobacterium
EHYLWTWLDEAADTIRSRMFA

SEQ ID NO: 1314961 - protein, 19 aa, Mycobacterium
EHYVRTPFVLTQKAVPHMR

SEQ ID NO: 1314962 - protein, 25 aa, Mycobacterium
EIAARAHALGLRKVPRYLPMVVRVD

SEQ ID NO: 1314963 - protein, 20 aa, Mycobacterium
EIADLRKALVELLFAEGNHN

SEQ ID NO: 1314964 - protein, 28 aa, Mycobacterium
EIADQAIPYAWLPGRARTFYGTDFSTWS

SEQ ID NO: 1314965 - protein, 26 aa, Mycobacterium
EIAEAFAMPPALERAWHARGYYGSVS

SEQ ID NO: 1314966 - protein, 21 aa, Mycobacterium
EIARQLLRMVGFGLLDTPEPA

SEQ ID NO: 1314967 - protein, 23 aa, Mycobacterium
EIASVAEFFLPRAKQTPIIAAGL

SEQ ID NO: 1314968 - protein, 17 aa, Mycobacterium
EIAYTARHIAKEAELWP

SEQ ID NO: 1314969 - protein, 21 aa, Mycobacterium
EIDRRLAADAALRQQQRMLEA

SEQ ID NO: 1314970 - protein, 25 aa, Mycobacterium
EIEESQVLRRVPLAIVPSAQIPAVN

SEQ ID NO: 1314971 - protein, 25 aa, Mycobacterium
EIEQMQGWLTQWGMSTMPMMPGMDD

SEQ ID NO: 1314972 - protein, 19 aa, Mycobacterium
EIETLWTVGGDYPRDWPRP

SEQ ID NO: 1314973 - protein, 19 aa, Mycobacterium
EIFAAEPDLFWSPINSLED

SEQ ID NO: 1314974 - protein, 17 aa, Mycobacterium
EIFEAFFSLVRVGGDGH

SEQ ID NO: 1314975 - protein, 18 aa, Mycobacterium
EIFGPVLAVIPYEDEDDA

SEQ ID NO: 1314976 - protein, 18 aa, Mycobacterium
EIFGPVLAVIPYETEDDA

SEQ ID NO: 1314977 - protein, 18 aa, Mycobacterium
EIFGPVLVVLTYGDDDEA

SEQ ID NO: 1314978 - protein, 18 aa, Mycobacterium
EIFVYSPRVEGVHLRFGF

SEQ ID NO: 1314979 - protein, 25 aa, Mycobacterium
EIGHYYFYRLIGPSATYLEGFNELF

SEQ ID NO: 1314980 - protein, 18 aa, Mycobacterium
EIGLVWRLVEPDRLQSEA

SEQ ID NO: 1314981 - protein, 22 aa, Mycobacterium
EIGPSWHLGVLPMDDGSVAISL

SEQ ID NO: 1314982 - protein, 23 aa, Mycobacterium
EIGPSWHLGVLPMDDGSVAISLA

SEQ ID NO: 1314983 - protein, 17 aa, Mycobacterium
EIIAPVRGESLYTEFLE

SEQ ID NO: 1314984 - protein, 27 aa, Mycobacterium
EIITAVAETWRRLRPAPLVVDPVCASM

SEQ ID NO: 1314985 - protein, 18 aa, Mycobacterium
EIKTVMHRLLRRYRLEPP

SEQ ID NO: 1314986 - protein, 19 aa, Mycobacterium
EILAAVNTFGPIMHQFKSA

SEQ ID NO: 1314987 - protein, 24 aa, Mycobacterium
EILACEALVRWQHPTRGLLSPESF

SEQ ID NO: 1314988 - protein, 20 aa, Mycobacterium
EILEYIKWVADKLDLRSGIT

SEQ ID NO: 1314989 - protein, 17 aa, Mycobacterium
EILLARNDRYWGTPATP

SEQ ID NO: 1314990 - protein, 17 aa, Mycobacterium
EILLLDEGIGAVDAEFL

SEQ ID NO: 1314991 - protein, 24 aa, Mycobacterium
EILRSRRALLLALLAEHLPDWRPA

SEQ ID NO: 1314992 - protein, 17 aa, Mycobacterium
EILSFLYLEARLADEGR

SEQ ID NO: 1314993 - protein, 19 aa, Mycobacterium
EILTPLGFRWTNYGVAAQD

SEQ ID NO: 1314994 - protein, 25 aa, Mycobacterium
EINGRPRLLCMTRMSTFGEDEVVTV

SEQ ID NO: 1314995 - protein, 18 aa, Mycobacterium
EINRENWMMVTTTKDLRP

SEQ ID NO: 1314996 - protein, 28 aa, Mycobacterium
EIPHENLYGFAWNPMTLVGILQNIKGAD

SEQ ID NO: 1314997 - protein, 20 aa, Mycobacterium
EIPNALRHIWVARGGDREPS

SEQ ID NO: 1314998 - protein, 18 aa, Mycobacterium
EIPRDFLLETTPFTLENG

SEQ ID NO: 1314999 - protein, 21 aa, Mycobacterium
EIRALLARRDALDARDEFVRA

SEQ ID NO: 1315000 - protein, 18 aa, Mycobacterium
EIRGPGGVVWRVDLAWPD

SEQ ID NO: 1315001 - protein, 22 aa, Mycobacterium
EIRGVEHFIRFPGPNGLLQELY

SEQ ID NO: 1315002 - protein, 34 aa, Mycobacterium
EIRVEEVFFHCAKAFLRSGAWNPESWTPDAVPSV

SEQ ID NO: 1315003 - protein, 21 aa, Mycobacterium
EISAGPYRFVYRKRFHKRPET

SEQ ID NO: 1315004 - protein, 26 aa, Mycobacterium
EISEALLPHLRPLLEGPATWAVTPTI

SEQ ID NO: 1315005 - protein, 17 aa, Mycobacterium
EITLWKDYWDMGALADH

SEQ ID NO: 1315006 - protein, 24 aa, Mycobacterium
EITPLTTLTLARLAAEAGLPAGVF

SEQ ID NO: 1315007 - protein, 22 aa, Mycobacterium
EITSRDAYRRSMGGDQGTDDDS

SEQ ID NO: 1315008 - protein, 18 aa, Mycobacterium
EIVAPRSGLISLLVAEDQ

SEQ ID NO: 1315009 - protein, 25 aa, Mycobacterium
EIVDRCGQLWRADFAWPAAKVVAEY

SEQ ID NO: 1315010 - protein, 20 aa, Mycobacterium
EIVLAPVPASWREWSQRCAG

SEQ ID NO: 1315011 - protein, 19 aa, Mycobacterium
EIVLYLKTPPTRAELAAMI

SEQ ID NO: 1315012 - protein, 22 aa, Mycobacterium
EIVQRLHVLAPGKRILHDDALD

SEQ ID NO: 1315013 - protein, 19 aa, Mycobacterium
EIVRMLLERILGSLEAPAG

SEQ ID NO: 1315014 - protein, 26 aa, Mycobacterium
EIVRPALLSALTLLRSITEHADDSSG

SEQ ID NO: 1315015 - protein, 37 aa, Mycobacterium; identical to SEQ ID NO: 125850

SEQ ID NO: 1315016 - protein, 24 aa, Mycobacterium
EIVVVCLFDHESVRRVLDPVADRL

SEQ ID NO: 1315017 - protein, 26 aa, Mycobacterium
EIYGIGGSWFRLNDQLLIEWQRDFFD

SEQ ID NO: 1315018 - protein, 22 aa, Mycobacterium
EKAGVRRLVYLGGLHPQGKTDL

SEQ ID NO: 1315019 - protein, 26 aa, Mycobacterium
EKAGVSNPYLSQIERGLRKPSADVLN

SEQ ID NO: 1315020 - protein, 19 aa, Mycobacterium
EKAIAWYTMTARTIAQTKA

SEQ ID NO: 1315021 - protein, 21 aa, Mycobacterium
EKALQFYTRILGFQVKHDVPM

SEQ ID NO: 1315022 - protein, 22 aa, Mycobacterium
EKALRWEALSDDKLTAALDAVI

SEQ ID NO: 1315023 - protein, 27 aa, Mycobacterium
EKAPRPALQLLLYPVTHYDAETRSRTL

SEQ ID NO: 1315024 - protein, 26 aa, Mycobacterium
EKAVKALWDTILPFAGYAFNKSHAAG

SEQ ID NO: 1315025 - protein, 25 aa, Mycobacterium
EKENLPAGHWPPTGWYAEWVSGQDI

SEQ ID NO: 1315026 - protein, 23 aa, Mycobacterium
EKERFMAAVAARMAVLLARSVED

SEQ ID NO: 1315027 - protein, 17 aa, Mycobacterium
EKIIAFCRANKLGLNSL

SEQ ID NO: 1315028 - protein, 28 aa, Mycobacterium
EKISSLPDLLPLLEKVAEAGKPLLIIAE

SEQ ID NO: 1315029 - protein, 19 aa, Mycobacterium
EKLAQIALAAAWSVTALGA

SEQ ID NO: 1315030 - protein, 32 aa, Mycobacterium
EKPTLMLLDGNSLAFRAFYALPAENFKTKSGL

SEQ ID NO: 1315031 - protein, 23 aa, Mycobacterium
EKRAIHFQEWWVRHRAQIPTESF

SEQ ID NO: 1315032 - protein, 23 aa, Mycobacterium
EKRFSPKMRLAVTAALEHYTATF

SEQ ID NO: 1315033 - protein, 22 aa, Mycobacterium
EKRGFFLLVGGDYSAALESYRR

SEQ ID NO: 1315034 - protein, 18 aa, Mycobacterium
EKTRLALAGLVASTANVL

SEQ ID NO: 1315035 - protein, 33 aa, Mycobacterium; identical to SEQ ID NO: 808028

SEQ ID NO: 1315036 - protein, 25 aa, Mycobacterium
EKVLPAPIDHFLLQADLTVIVPGPL

SEQ ID NO: 1315037 - protein, 17 aa, Mycobacterium
ELAALVTVLAGAGGGAA

SEQ ID NO: 1315038 - protein, 24 aa, Mycobacterium
ELAARLVCLLLSKMSSDTMLAALA

SEQ ID NO: 1315039 - protein, 25 aa, Mycobacterium
ELAARNRLNWFLRDLSSGRLGAEEL

SEQ ID NO: 1315040 - protein, 22 aa, Mycobacterium
ELAIDLARFPGLNTWSAEDLNI

SEQ ID NO: 1315041 - protein, 22 aa, Mycobacterium
ELALASYPGFTSTAPPGDGQVY

SEQ ID NO: 1315042 - protein, 26 aa, Mycobacterium
ELANYRAHWLVARAAEHIGGWANRPL

SEQ ID NO: 1315043 - protein, 20 aa, Mycobacterium
ELAPKILVNAIAPGLFPSRM

SEQ ID NO: 1315044 - protein, 20 aa, Mycobacterium
ELAPMLCCDWRIHARVELTD

SEQ ID NO: 1315045 - protein, 20 aa, Mycobacterium
ELAPWIKRFPGEQGTSTIVF

SEQ ID NO: 1315046 - protein, 24 aa, Mycobacterium
ELAQRYGMQRFCLGIHACEIPVLD

SEQ ID NO: 1315047 - protein, 25 aa, Mycobacterium
ELARRLIPGYVVTPAIKLLSDELVR

SEQ ID NO: 1315048 - protein, 26 aa, Mycobacterium
ELATKNILVNALAPLAATPMTETIRT

SEQ ID NO: 1315049 - protein, 18 aa, Mycobacterium
ELATLVPELLLIGQLIDR

SEQ ID NO: 1315050 - protein, 19 aa, Mycobacterium
ELAVQLVRPGGHVANIGVH

SEQ ID NO: 1315051 - protein, 17 aa, Mycobacterium
ELAWRRISKSRRPIGAL

SEQ ID NO: 1315052 - protein, 22 aa, Mycobacterium
ELAYVLPARNTACLRCMMGAVG

SEQ ID NO: 1315053 - protein, 25 aa, Mycobacterium
ELCATFDGFYTLLVSNRDSFAVVRD

SEQ ID NO: 1315054 - protein, 26 aa, Mycobacterium
ELCDKRVVPLLFLQNISGFMVGRDYE

SEQ ID NO: 1315055 - protein, 25 aa, Mycobacterium
ELCEEAPFYTLGPLATDIAPAYDHI

SEQ ID NO: 1315056 - protein, 21 aa, Mycobacterium
ELCMAGLWYRACDGYVIADLD

SEQ ID NO: 1315057 - protein, 24 aa, Mycobacterium
ELDAFVRALLKLFENPKSRADLKA

SEQ ID NO: 1315058 - protein, 30 aa, Mycobacterium
ELDAYVVRRLNLPFRDVDWTQWNDLLRRVH

SEQ ID NO: 1315059 - protein, 27 aa, Mycobacterium
ELDDARLIRLLRLRPDLTQPPPGSIAA

SEQ ID NO: 1315060 - protein, 30 aa, Mycobacterium
ELDFALAPPPVPPFHISIPGQGPGAIGSLI

SEQ ID NO: 1315061 - protein, 25 aa, Mycobacterium
ELDGSKVPLLLIPGAFMATDSMQAW

SEQ ID NO: 1315062 - protein, 25 aa, Mycobacterium
ELDLFAPANISPLVGYLASEKCPVT

SEQ ID NO: 1315063 - protein, 21 aa, Mycobacterium
ELDLRGAAFPWRTIHGEECSA

SEQ ID NO: 1315064 - protein, 25 aa, Mycobacterium
ELDPVAWTFPAGSRIRLLIAGGSHP

SEQ ID NO: 1315065 - protein, 23 aa, Mycobacterium
ELDRLQKHYTGRPSPVFEAERLS

SEQ ID NO: 1315066 - protein, 26 aa, Mycobacterium
ELDRRGLLRRIGGAPYLHTLISTVPT

SEQ ID NO: 1315067 - protein, 19 aa, Mycobacterium
ELDTWVRTHGDRVLVVPLD

SEQ ID NO: 1315068 - protein, 17 aa, Mycobacterium
ELEIPAAPIRTPGALFD

SEQ ID NO: 1315069 - protein, 23 aa, Mycobacterium
ELELRLRTLGARRISGLLPREAT

SEQ ID NO: 1315070 - protein, 17 aa, Mycobacterium
ELFGAPYAYAQPHSGID

SEQ ID NO: 1315071 - protein, 18 aa, Mycobacterium
ELFKFRVASNSRRRTADG

SEQ ID NO: 1315072 - protein, 19 aa, Mycobacterium
ELFVSVTRIVLQPLRSIVL

SEQ ID NO: 1315073 - protein, 24 aa, Mycobacterium
ELGAALHPGPWLSSAVAAPRALGR

SEQ ID NO: 1315074 - protein, 25 aa, Mycobacterium
ELGFAAEIWSWHDKDLAALATTGAT

SEQ ID NO: 1315075 - protein, 26 aa, Mycobacterium
ELGHREIGLLTMRLGRDRPHGGSTPV

SEQ ID NO: 1315076 - protein, 19 aa, Mycobacterium
ELGIPLRTVVIGPGREVTD

SEQ ID NO: 1315077 - protein, 18 aa, Mycobacterium
ELGITYPQYLVLLVLGEE

SEQ ID NO: 1315078 - protein, 27 aa, Mycobacterium
ELGKGLVPTPLLGTTLAELALLSVAEP

SEQ ID NO: 1315079 - protein, 23 aa, Mycobacterium
ELGLDSMMAMNLLRDAKALVRTD

SEQ ID NO: 1315080 - protein, 19 aa, Mycobacterium
ELGLGAGWLAADYAALGVP

SEQ ID NO: 1315081 - protein, 31 aa, Mycobacterium
ELGLPEEIVARQPFPGPGLGIRIVGEVTAER

SEQ ID NO: 1315082 - protein, 25 aa, Mycobacterium
ELGPIRPPQRLAPFSYALGAEVKHA

SEQ ID NO: 1315083 - protein, 18 aa, Mycobacterium
ELGPLVHVNLIPLNPTPG

SEQ ID NO: 1315084 - protein, 25 aa, Mycobacterium
ELGQPLPLFIKWDDADYGLRAGEHG

SEQ ID NO: 1315085 - protein, 25 aa, Mycobacterium
ELGQSVLWHRLLISGDPIDDEVVTR

SEQ ID NO: 1315086 - protein, 26 aa, Mycobacterium
ELGVLSGLSFKLYTSARTAGALNLFA

SEQ ID NO: 1315087 - protein, 17 aa, Mycobacterium
ELGVWVAAPATGGILAD

SEQ ID NO: 1315088 - protein, 26 aa, Mycobacterium
ELHFFGYGNLFEPYVTYHRADADGEL

SEQ ID NO: 1315089 - protein, 32 aa, Mycobacterium
ELHGGRILAPNDYVITLSVPDYRKVSADPDIT

SEQ ID NO: 1315090 - protein, 23 aa, Mycobacterium
ELHHQWHALGLTRLSILDSQLSD

SEQ ID NO: 1315091 - protein, 26 aa, Mycobacterium
ELHKKAHLPYLVYLRHPTTGGVFASW

SEQ ID NO: 1315092 - protein, 22 aa, Mycobacterium
ELHLFTPEVVFLLQHSTRTGRE

SEQ ID NO: 1315093 - protein, 17 aa, Mycobacterium
ELHRLGIAPVQHLPGVG

SEQ ID NO: 1315094 - protein, 21 aa, Mycobacterium
ELHTRPLTWISGPSATSDIEL

SEQ ID NO: 1315095 - protein, 23 aa, Mycobacterium
ELIATLAALFRTGSRVAAAESLR

SEQ ID NO: 1315096 - protein, 25 aa, Mycobacterium
ELIDPNFARPLRPVAAVAQLALGEP

SEQ ID NO: 1315097 - protein, 27 aa, Mycobacterium
ELIGLGAAIENMWLAANALGIGATFMG

SEQ ID NO: 1315098 - protein, 17 aa, Mycobacterium
ELILDRSPFYAESGGQI

SEQ ID NO: 1315099 - protein, 18 aa, Mycobacterium
ELIREALHPYPESLALVS

SEQ ID NO: 1315100 - protein, 24 aa, Mycobacterium
ELIRYRRGAYQKVLRWIESTAKKS

SEQ ID NO: 1315101 - protein, 22 aa, Mycobacterium
ELKLADEVFTPDSSRYWRADDY

SEQ ID NO: 1315102 - protein, 17 aa, Mycobacterium
ELKPGMTLLDIGCGWGS

SEQ ID NO: 1315103 - protein, 24 aa, Mycobacterium
ELKPNIEGWFESSTLPRELGRRFG

SEQ ID NO: 1315104 - protein, 26 aa, Mycobacterium
ELKPSFRQRFVTLPMCYLPPDREAEV

SEQ ID NO: 1315105 - protein, 22 aa, Mycobacterium
ELKVALGRRIVVIDGAMGTAIQ

SEQ ID NO: 1315106 - protein, 18 aa, Mycobacterium
ELLAFVDRLQAFDQHAEA

SEQ ID NO: 1315107 - protein, 35 aa, Mycobacterium
ELLDGTVTAPRRAWPTPLLPALGTLLDGGDADVHV

SEQ ID NO: 1315108 - protein, 23 aa, Mycobacterium
ELLDSWPRRSWLQHARLDDHLGS

SEQ ID NO: 1315109 - protein, 22 aa, Mycobacterium
ELLDVALTHPVKLIANALGVPP

SEQ ID NO: 1315110 - protein, 20 aa, Mycobacterium
ELLERDRLFGAQPYGDIDLD

SEQ ID NO: 1315111 - protein, 18 aa, Mycobacterium
ELLHELLVAQVATYLGVE

SEQ ID NO: 1315112 - protein, 35 aa, Mycobacterium
ELLNSIFDIDKMLYFVSPEWWRPRMHASHQALGKA

SEQ ID NO: 1315113 - protein, 22 aa, Mycobacterium
ELLQPLPSLRLQIGAASVLRKV

SEQ ID NO: 1315114 - protein, 19 aa, Mycobacterium
ELLRHYRRLAADHLEVIAG

SEQ ID NO: 1315115 - protein, 17 aa, Mycobacterium
ELLRQQLILAIDGELDV

SEQ ID NO: 1315116 - protein, 27 aa, Mycobacterium
ELLRRAPRMLVATGKPFEYPRTDWGDR

SEQ ID NO: 1315117 - protein, 25 aa, Mycobacterium
ELMDIALRRPSLDEVFLALTGDHPR

SEQ ID NO: 1315118 - protein, 32 aa, Mycobacterium
ELMDLRPNQTRWRIAVEKVLRGAGLRLLVPDQ

SEQ ID NO: 1315119 - protein, 33 aa, Mycobacterium
ELMDLRPNQTRWRIAVEKVLRGAGLRLLVPDQH

SEQ ID NO: 1315120 - protein, 17 aa, Mycobacterium
ELMIRQHRFTISVARDE

SEQ ID NO: 1315121 - protein, 23 aa, Mycobacterium
ELMPGITRILETMPPHPAHFLWL

SEQ ID NO: 1315122 - protein, 18 aa, Mycobacterium
ELMRWVHPSLVASTQGTG

SEQ ID NO: 1315123 - protein, 17 aa, Mycobacterium
ELMVAPIVRQGLSQLAE

SEQ ID NO: 1315124 - protein, 26 aa, Mycobacterium
ELNRAWHRLDPWPDAVAGLTRLKRRF

SEQ ID NO: 1315125 - protein, 18 aa, Mycobacterium
ELPDISPKWPPMDKPVIG

SEQ ID NO: 1315126 - protein, 17 aa, Mycobacterium
ELPDRPMIAMVPSSVRD

SEQ ID NO: 1315127 - protein, 25 aa, Mycobacterium
ELPGHGPRFVALTRGAERADAEEIE

SEQ ID NO: 1315128 - protein, 18 aa, Mycobacterium
ELPGWWEDISGCRTFDEL

SEQ ID NO: 1315129 - protein, 17 aa, Mycobacterium
ELPLLQTRTVRVAGHLL

SEQ ID NO: 1315130 - protein, 17 aa, Mycobacterium
ELPLMFEPYDRKALRTR

SEQ ID NO: 1315131 - protein, 23 aa, Mycobacterium
ELPRRYFRRIAKMADTAWFVIRE

SEQ ID NO: 1315132 - protein, 17 aa, Mycobacterium
ELPSLLAEKVKAPGVTA

SEQ ID NO: 1315133 - protein, 23 aa, Mycobacterium
ELPTWQWEGLVTRPTRLVAITSA

SEQ ID NO: 1315134 - protein, 18 aa, Mycobacterium
ELQAFYDAITARAEEAIA

SEQ ID NO: 1315135 - protein, 24 aa, Mycobacterium
ELQAYDPVFFPALAQEWGARRPLI

SEQ ID NO: 1315136 - protein, 28 aa, Mycobacterium
ELQEEILWLCEAAHLPVIWATQVLDQLA

SEQ ID NO: 1315137 - protein, 21 aa, Mycobacterium
ELQGRVTPLAQWGYGENWSAQ

SEQ ID NO: 1315138 - protein, 18 aa, Mycobacterium
ELQLVRWGTPRASHLFWA

SEQ ID NO: 1315139 - protein, 27 aa, Mycobacterium
ELQSLRARFGTLTGVDRPAKDGDFVSI

SEQ ID NO: 1315140 - protein, 19 aa, Mycobacterium
ELRAALPDALFGIAPTRVC

SEQ ID NO: 1315141 - protein, 17 aa, Mycobacterium
ELRAEVRRFLAEQLAAG

SEQ ID NO: 1315142 - protein, 26 aa, Mycobacterium
ELRAHYRRIFPDVYGPRYRALTLADR

SEQ ID NO: 1315143 - protein, 27 aa, Mycobacterium
ELRARYGLGERPVVVCLSRLVPRKGQD

SEQ ID NO: 1315144 - protein, 25 aa, Mycobacterium
ELRAWLRRFSTDRPRWGWRRAAKMA

SEQ ID NO: 1315145 - protein, 18 aa, Mycobacterium
ELRDRIFLETGYGSDFGV

SEQ ID NO: 1315146 - protein, 26 aa, Mycobacterium
ELREALAYLTPAAPKIPLVSTVGYAG

SEQ ID NO: 1315147 - protein, 26 aa, Mycobacterium
ELREAVSRYWIIDDIRPALIDTNVPK

SEQ ID NO: 1315148 - protein, 17 aa, Mycobacterium
ELREKKFMKIVSLAPEV

SEQ ID NO: 1315149 - protein, 20 aa, Mycobacterium
ELRGRFDLILNTVSANLNLE

SEQ ID NO: 1315150 - protein, 26 aa, Mycobacterium
ELRLRPGDWYVIHSYAGYENKVKANL

SEQ ID NO: 1315151 - protein, 17 aa, Mycobacterium
ELRPDVDITWAAINGLV

SEQ ID NO: 1315152 - protein, 20 aa, Mycobacterium
ELRPQLLDRFGLTVDVAASR

SEQ ID NO: 1315153 - protein, 18 aa, Mycobacterium
ELRQGDFLLLPQTPEFTL

SEQ ID NO: 1315154 - protein, 19 aa, Mycobacterium
ELRRIAALCAAFDVDGMRA

SEQ ID NO: 1315155 - protein, 22 aa, Mycobacterium
ELRTEFPFTLPRGYVDGNREIH

SEQ ID NO: 1315156 - protein, 20 aa, Mycobacterium
ELRTEWWDMMIERVGSRTLA

SEQ ID NO: 1315157 - protein, 20 aa, Mycobacterium
ELRTIFSELLGIPVPNLIAG

SEQ ID NO: 1315158 - protein, 21 aa, Mycobacterium
ELRTLFLFEALTDEQLATLCE

SEQ ID NO: 1315159 - protein, 21 aa, Mycobacterium
ELRTLIGLRDAAVALVEAEAN

SEQ ID NO: 1315160 - protein, 26 aa, Mycobacterium
ELRTQRQYRFVLPGPTLTAAEQTECL

SEQ ID NO: 1315161 - protein, 30 aa, Mycobacterium
ELRVYRAAGVLHLDWWYDNRRLGPTDVESF

SEQ ID NO: 1315162 - protein, 20 aa, Mycobacterium
ELRWAMPDEPLSQVELRAVA

SEQ ID NO: 1315163 - protein, 22 aa, Mycobacterium
ELSARKQWPSGLAKLGLDLSGR

SEQ ID NO: 1315164 - protein, 20 aa, Mycobacterium
ELSGLWLTTALAMSGNRAAA

SEQ ID NO: 1315165 - protein, 20 aa, Mycobacterium
ELSGYWTAAFAMAGPNTRIV

SEQ ID NO: 1315166 - protein, 23 aa, Mycobacterium
ELSPARFFEVMLTIVLDNSNITQ

SEQ ID NO: 1315167 - protein, 24 aa, Mycobacterium
ELSPLAPLHNPPAILGIEVARKAL

SEQ ID NO: 1315168 - protein, 24 aa, Mycobacterium
ELSWTRRWFAVAPWVALLRRHLPE

SEQ ID NO: 1315169 - protein, 24 aa, Mycobacterium
ELTAPLLDQLITACAWPNADHERI

SEQ ID NO: 1315170 - protein, 17 aa, Mycobacterium
ELTAPRQGGFRRAGVMA

SEQ ID NO: 1315171 - protein, 19 aa, Mycobacterium
ELTDRAKSLLAKRGFDPVL

SEQ ID NO: 1315172 - protein, 30 aa, Mycobacterium
ELTESRIINAWFGPGLQGSAVFTSCRVWQL

SEQ ID NO: 1315173 - protein, 32 aa, Mycobacterium
ELTLPHPYAHLRAFVLMPWLAAEPEATLTVAD

SEQ ID NO: 1315174 - protein, 32 aa, Mycobacterium
ELTLPHPYAHLRGFVLMPWLAAEPEATLTVAD

SEQ ID NO: 1315175 - protein, 20 aa, Mycobacterium
ELTMPDRILAAAVAFQAACE

SEQ ID NO: 1315176 - protein, 20 aa, Mycobacterium
ELTPEERLLRAIFGEKAREV

SEQ ID NO: 1315177 - protein, 17 aa, Mycobacterium
ELTTGVLGFIKFGDREW

SEQ ID NO: 1315178 - protein, 26 aa, Mycobacterium
ELTTRLEFYFRRWKAPALVSEEFTGS

SEQ ID NO: 1315179 - protein, 25 aa, Mycobacterium
ELVAAFLPHVFQWTRAMNPVQPVTS

SEQ ID NO: 1315180 - protein, 25 aa, Mycobacterium
ELVARQITNFRWALSAFGTASAANL

SEQ ID NO: 1315181 - protein, 25 aa, Mycobacterium
ELVCEGGSFDFLLSATRPAPETLGS

SEQ ID NO: 1315182 - protein, 17 aa, Mycobacterium
ELVCKDFGALKVLKGIT

SEQ ID NO: 1315183 - protein, 17 aa, Mycobacterium
ELVDWWSDPGGVDTSRP

SEQ ID NO: 1315184 - protein, 23 aa, Mycobacterium
ELVKALLFSVFEGGLRHGLFHGD

SEQ ID NO: 1315185 - protein, 30 aa, Mycobacterium
ELVKVTPLDFLRDTLLWAKLIDKYKGTMTA

SEQ ID NO: 1315186 - protein, 17 aa, Mycobacterium
ELVLRKATWLYDNGKPC

SEQ ID NO: 1315187 - protein, 22 aa, Mycobacterium
ELVMPMWQRLERTWGPARDVRD

SEQ ID NO: 1315188 - protein, 18 aa, Mycobacterium
ELVMSSLLHLQPSNYHAD

SEQ ID NO: 1315189 - protein, 20 aa, Mycobacterium
ELVNLINAYGPYAVGITGED

SEQ ID NO: 1315190 - protein, 21 aa, Mycobacterium
ELVTHIYPAAERLGYEVLLSA

SEQ ID NO: 1315191 - protein, 20 aa, Mycobacterium
ELVTVLTGDGVGPEIGEALA

SEQ ID NO: 1315192 - protein, 21 aa, Mycobacterium
ELVTVRGRRLLAHADVVVADR

SEQ ID NO: 1315193 - protein, 28 aa, Mycobacterium
ELVVRLTYRRWFALAPHDRARIGDPRNW

SEQ ID NO: 1315194 - protein, 19 aa, Mycobacterium
ELVWPWLVQMGQDRGGLYS

SEQ ID NO: 1315195 - protein, 17 aa, Mycobacterium
ELWDVLRGLVAQGTTLL

SEQ ID NO: 1315196 - protein, 23 aa, Mycobacterium
ELWEAMLAVAKLGAVIMPTTGAL

SEQ ID NO: 1315197 - protein, 18 aa, Mycobacterium
ELWESMLAVAKLGAVIMP

SEQ ID NO: 1315198 - protein, 23 aa, Mycobacterium
ELYDLRTLWEIASTNPWLSVTPV

SEQ ID NO: 1315199 - protein, 25 aa, Mycobacterium
ELYGKPQYWPLWEAAVDAGWPVAVH

SEQ ID NO: 1315200 - protein, 25 aa, Mycobacterium
EMAVFLTHYLGFPLGSKLDGVVSKV

SEQ ID NO: 1315201 - protein, 22 aa, Mycobacterium
EMELYTHLVAQQPKLKNPTVVV

SEQ ID NO: 1315202 - protein, 24 aa, Mycobacterium
EMERGFIPVVARRLRLPEDDLTVR

SEQ ID NO: 1315203 - protein, 23 aa, Mycobacterium
EMERVMESTTMPTLLLGGDPTDP

SEQ ID NO: 1315204 - protein, 18 aa, Mycobacterium
EMFGLPPSVLSRHVSWDL

SEQ ID NO: 1315205 - protein, 19 aa, Mycobacterium
EMGIRVRYLHSEVDTLRRV

SEQ ID NO: 1315206 - protein, 17 aa, Mycobacterium
EMGLYMAAALHERGVGY

SEQ ID NO: 1315207 - protein, 17 aa, Mycobacterium
EMINEVLAVMAGLATDG

SEQ ID NO: 1315208 - protein, 25 aa, Mycobacterium
EMKPKLDVLDFWNMIRPELPGIKGL

SEQ ID NO: 1315209 - protein, 35 aa, Mycobacterium
EMLEQTMKVGLWSVWWGMQTAFPLMKARGGGRIIN

SEQ ID NO: 1315210 - protein, 19 aa, Mycobacterium
EMLGRMKPVYPPGLVHMYH

SEQ ID NO: 1315211 - protein, 20 aa, Mycobacterium
EMLRRTLAVLSTPAARAALP

SEQ ID NO: 1315212 - protein, 19 aa, Mycobacterium
EMLTTLFGDQPRLQAPGAI

SEQ ID NO: 1315213 - protein, 25 aa, Mycobacterium
EMMCNALAGARIWRLAEPEDGEWAI

SEQ ID NO: 1315214 - protein, 31 aa, Mycobacterium
EMMEFLEKLSPWLEFVWKPGYADYYPELPGG

SEQ ID NO: 1315215 - protein, 25 aa, Mycobacterium
EMNCKLLVEIGPRPVLTAAALGAWP

SEQ ID NO: 1315216 - protein, 19 aa, Mycobacterium
EMPLIKFVDGFETIAEIES

SEQ ID NO: 1315217 - protein, 17 aa, Mycobacterium
EMPRRLARFDGVLLPGG

SEQ ID NO: 1315218 - protein, 30 aa, Mycobacterium
EMRDELARLLQFVLDLLADYGLDDFYLELS

SEQ ID NO: 1315219 - protein, 17 aa, Mycobacterium
EMRRLDRWALPADLTDD

SEQ ID NO: 1315220 - protein, 18 aa, Mycobacterium
EMRRLLGANLFDLTHEPW

SEQ ID NO: 1315221 - protein, 18 aa, Mycobacterium
EMRRTVRPPGRIALLAFV

SEQ ID NO: 1315222 - protein, 17 aa, Mycobacterium
EMRTFPEEIGKMGFVFN

SEQ ID NO: 1315223 - protein, 28 aa, Mycobacterium
EMSEEPDFRLILLTHNFDFFRTLESRAV

SEQ ID NO: 1315224 - protein, 17 aa, Mycobacterium
EMSPVTCMLLGDDAIRK

SEQ ID NO: 1315225 - protein, 19 aa, Mycobacterium
ENAEWYYEFANPGDVVEVR

SEQ ID NO: 1315226 - protein, 20 aa, Mycobacterium
ENAEWYYEFANPGDVVEVRN

SEQ ID NO: 1315227 - protein, 23 aa, Mycobacterium
ENAPTWLVSVMGKSGLFQDYLIK

SEQ ID NO: 1315228 - protein, 27 aa, Mycobacterium
ENAQFLVFCAAIIRAVHKFGGLLRVSV

SEQ ID NO: 1315229 - protein, 24 aa, Mycobacterium
ENDDDIWLMIVTGTGRAFCTGADV

SEQ ID NO: 1315230 - protein, 25 aa, Mycobacterium
ENDDDVWLLIVTATGRAFCTGADVR

SEQ ID NO: 1315231 - protein, 25 aa, Mycobacterium
ENDMHLYLKRAHVFRHLFGEPTDVL

SEQ ID NO: 1315232 - protein, 25 aa, Mycobacterium
ENFIGNGLVDLIIAEQRFTTVWITE

SEQ ID NO: 1315233 - protein, 21 aa, Mycobacterium
ENGGLLFGNGADGAPGQNGGR

SEQ ID NO: 1315234 - protein, 24 aa, Mycobacterium
ENGPATIAMLRRTTPMKFQWAKGY

SEQ ID NO: 1315235 - protein, 23 aa, Mycobacterium
ENGSLYPAPAPRFSRSAPSAPKP

SEQ ID NO: 1315236 - protein, 27 aa, Mycobacterium
ENHPGEWMYPQPTWVLTHRPGIIADGH

SEQ ID NO: 1315237 - protein, 28 aa, Mycobacterium
ENIGTDEWHFLIFFDQPFPADIGYRASA

SEQ ID NO: 1315238 - protein, 22 aa, Mycobacterium
ENIKRQWWRAVVTSRDDVVGLD

SEQ ID NO: 1315239 - protein, 22 aa, Mycobacterium
ENKAYYIAAAFPSACGKTNLAM

SEQ ID NO: 1315240 - protein, 26 aa, Mycobacterium
ENLANLHAFLSDTLLMTGFGFAEPTA

SEQ ID NO: 1315241 - protein, 22 aa, Mycobacterium
ENLDVTTVIFGNGAYDILRIEL

SEQ ID NO: 1315242 - protein, 18 aa, Mycobacterium
ENLFASDLAFLQDLYRRV

SEQ ID NO: 1315243 - protein, 26 aa, Mycobacterium
ENLFDRALRRYLAGPSAYTAEALTCP

SEQ ID NO: 1315244 - protein, 22 aa, Mycobacterium
ENLHMVFYRNLMAAALDICPDA

SEQ ID NO: 1315245 - protein, 28 aa, Mycobacterium
ENLRWAASFAAPWAVRRLRRITPGAGVA

SEQ ID NO: 1315246 - protein, 18 aa, Mycobacterium
ENLSLQLEYYRDGQFRKG

SEQ ID NO: 1315247 - protein, 33 aa, Mycobacterium
ENLTRLPLPTLVLPPALRLALTPGWMALRPLAG

SEQ ID NO: 1315248 - protein, 23 aa, Mycobacterium
ENMPEIWRRLDAVGLQTTEACGD

SEQ ID NO: 1315249 - protein, 25 aa, Mycobacterium
ENMVQGVFVGGALGALRGAVLGVLG

SEQ ID NO: 1315250 - protein, 30 aa, Mycobacterium
ENNQRQLLRLWADYLDMPPLRVDPATVLTD

SEQ ID NO: 1315251 - protein, 30 aa, Mycobacterium
ENNQRQLLRLWADYLDMPPLRVNPATVLSD

SEQ ID NO: 1315252 - protein, 24 aa, Mycobacterium
ENPPLGLGLALLAGLVGMSRVATG

SEQ ID NO: 1315253 - protein, 23 aa, Mycobacterium
ENPQQRAWLMADFDGRIGAAVEE

SEQ ID NO: 1315254 - protein, 34 aa, Mycobacterium
ENPSFSVVAPLLSRSLILQLQPLAPDSIAEVVRR

SEQ ID NO: 1315255 - protein, 30 aa, Mycobacterium
ENPSFSVVAPLLSRSLILQLQPLTPEDVTT

SEQ ID NO: 1315256 - protein, 19 aa, Mycobacterium
ENQRRLAYVASILADSGQV

SEQ ID NO: 1315257 - protein, 25 aa, Mycobacterium
ENQSSGVIPIMKLLEDSFSYANQLG

SEQ ID NO: 1315258 - protein, 23 aa, Mycobacterium
ENQVNEVLFTIATGLGDEYSDTR

SEQ ID NO: 1315259 - protein, 23 aa, Mycobacterium
ENRPGARTLPLYGVPFGVKDSID

SEQ ID NO: 1315260 - protein, 22 aa, Mycobacterium
ENRVGLINWLIQDPGNEAVARE

SEQ ID NO: 1315261 - protein, 24 aa, Mycobacterium
ENTRALDLLTKWGDAPTAPPVQPV

SEQ ID NO: 1315262 - protein, 17 aa, Mycobacterium
ENVISERAFVGVPGRSV

SEQ ID NO: 1315263 - protein, 17 aa, Mycobacterium
ENVRYFPSLLPQLSDED

SEQ ID NO: 1315264 - protein, 21 aa, Mycobacterium
ENVTLIRAWGERQKRILAWLQ

SEQ ID NO: 1315265 - protein, 37 aa, Mycobacterium
ENWHPLGVVGVITAFNFPVAVWAWNTAIALVCGDTVV

SEQ ID NO: 1315266 - protein, 19 aa, Mycobacterium
ENYHRLTTPSTWLEALVKT

SEQ ID NO: 1315267 - protein, 33 aa, Mycobacterium
ENYRRYMRYLKGCQYYFIDEAIDVSLVTYLKPG

SEQ ID NO: 1315268 - protein, 23 aa, Mycobacterium
ENYSWVMSPRWFDGKDHLALDTG

SEQ ID NO: 1315269 - protein, 25 aa, Mycobacterium
EPAEARFVTPWPRPLDVAAMAAAAR

SEQ ID NO: 1315270 - protein, 30 aa, Mycobacterium
EPASIKDRWLLRHRPHLVLDGLRLAARVVE

SEQ ID NO: 1315271 - protein, 24 aa, Mycobacterium
EPASPIYNFRYPNMLRLHYEKKRN

SEQ ID NO: 1315272 - protein, 22 aa, Mycobacterium
EPAVVHDYLFSRCLTIAGGTSE

SEQ ID NO: 1315273 - protein, 23 aa, Mycobacterium
EPCRDTVTWLAQKGILVAPGEFY

SEQ ID NO: 1315274 - protein, 25 aa, Mycobacterium
EPDELLNYLQKRLARYEIPGELVIT

SEQ ID NO: 1315275 - protein, 25 aa, Mycobacterium
EPDKLPESLLTLPGGHLLVAPQDMR

SEQ ID NO: 1315276 - protein, 27 aa, Mycobacterium
EPDLRWERFITAVRLLSERLGVRRVIG

SEQ ID NO: 1315277 - protein, 17 aa, Mycobacterium
EPDLWRGHIAHAIAGLP

SEQ ID NO: 1315278 - protein, 33 aa, Mycobacterium
EPDPALTKGYFQWSAMSWFALADAGFAPEVWGR

SEQ ID NO: 1315279 - protein, 17 aa, Mycobacterium
EPDRPVVLVAHGGLIAA

SEQ ID NO: 1315280 - protein, 23 aa, Mycobacterium
EPDWDDMIGVNLSGVWKTVKAGV

SEQ ID NO: 1315281 - protein, 17 aa, Mycobacterium
EPDWQLDGDGWKITIDG

SEQ ID NO: 1315282 - protein, 19 aa, Mycobacterium
EPDYMVEFTIAGSAAPYHT

SEQ ID NO: 1315283 - protein, 29 aa, Mycobacterium
EPEDIANAVFWLVSDAARYVTGITLPVDA

SEQ ID NO: 1315284 - protein, 25 aa, Mycobacterium
EPEDIANAVLFLASDEARFITGVTL

SEQ ID NO: 1315285 - protein, 25 aa, Mycobacterium
EPEDIANAVLFLASDEARYITGVTL

SEQ ID NO: 1315286 - protein, 27 aa, Mycobacterium
EPEDISNAILWLVSDEARYVTGMQLRV

SEQ ID NO: 1315287 - protein, 29 aa, Mycobacterium
EPEGLKGLFEFFTPLLRNVTPNARLVVIG

SEQ ID NO: 1315288 - protein, 29 aa, Mycobacterium
EPEGLKGLYQFFTPLMRNLGHSGRVVVIG

SEQ ID NO: 1315289 - protein, 24 aa, Mycobacterium
EPELAEELLRRGAWARCVQTIGAF

SEQ ID NO: 1315290 - protein, 32 aa, Mycobacterium
EPEPLFGFPGAPMRAEHLWAEPEPLPVAPGLT

SEQ ID NO: 1315291 - protein, 19 aa, Mycobacterium
EPEPWAALLPGLDVTTMGW

SEQ ID NO: 1315292 - protein, 18 aa, Mycobacterium
EPEWTFSGATGSVSVTGS

SEQ ID NO: 1315293 - protein, 21 aa, Mycobacterium
EPEYKFVLAEVDYLKPFWDTH

SEQ ID NO: 1315294 - protein, 18 aa, Mycobacterium
EPFWVHVTHGDPARLWLR

SEQ ID NO: 1315295 - protein, 26 aa, Mycobacterium
EPGAYICVYPFVRSLEWYLLPDEERR

SEQ ID NO: 1315296 - protein, 30 aa, Mycobacterium
EPGDQRLAIADWVYWQHLEVLLTDAVSTDA

SEQ ID NO: 1315297 - protein, 46 aa, Mycobacterium
EPGEYLVIDWAQAAPGLFLFCAVLAFSRWRFVRFAANERASTTLAL

SEQ ID NO: 1315298 - protein, 23 aa, Mycobacterium
EPGGTWYWNTYPGIAVDIPSFSY

SEQ ID NO: 1315299 - protein, 18 aa, Mycobacterium
EPGRARMVLERAATALAL

SEQ ID NO: 1315300 - protein, 23 aa, Mycobacterium
EPGRPCRLLGLHFDGADGCAGHS

SEQ ID NO: 1315301 - protein, 17 aa, Mycobacterium
EPGVPLPMVPSVLCAED

SEQ ID NO: 1315302 - protein, 26 aa, Mycobacterium
EPGVRQFERLLAKALRKATTKLAADP

SEQ ID NO: 1315303 - protein, 20 aa, Mycobacterium
EPHEFLRLVTEHRVTFLTTV

SEQ ID NO: 1315304 - protein, 18 aa, Mycobacterium
EPHLARITCPALVINAEQ

SEQ ID NO: 1315305 - protein, 26 aa, Mycobacterium
EPIRRLKKLAADKGFPLIPGHDPHVW

SEQ ID NO: 1315306 - protein, 19 aa, Mycobacterium
EPKKKPRSAWRRFVYPAPN

SEQ ID NO: 1315307 - protein, 25 aa, Mycobacterium
EPKPDWTHMWSFQPEIQDYLLGVTA

SEQ ID NO: 1315308 - protein, 36 aa, Mycobacterium
EPLGVVGQIIPWNFPILMAVWKLAPALAAGNAIVLK

SEQ ID NO: 1315309 - protein, 36 aa, Mycobacterium
EPLGVVGVITPWNFPMTIAAWGFAPALAAGNAVLVK

SEQ ID NO: 1315310 - protein, 21 aa, Mycobacterium
EPLLGTWQSLVLVDLNRDNPR

SEQ ID NO: 1315311 - protein, 24 aa, Mycobacterium
EPLPAFVSRVRRALPATSWGVRAS

SEQ ID NO: 1315312 - protein, 20 aa, Mycobacterium
EPMGVVGAITPWNFPVEIVA

SEQ ID NO: 1315313 - protein, 26 aa, Mycobacterium
EPMLDRHRPMFRCWLIDGVPGGRFAI

SEQ ID NO: 1315314 - protein, 18 aa, Mycobacterium
EPMREDIRLLGAILGDTV

SEQ ID NO: 1315315 - protein, 17 aa, Mycobacterium
EPMRPWKAEQLGGGYRV

SEQ ID NO: 1315316 - protein, 18 aa, Mycobacterium
EPMYRLYELRLRQGLTAS

SEQ ID NO: 1315317 - protein, 17 aa, Mycobacterium
EPPYFVGGYADYFVLPA

SEQ ID NO: 1315318 - protein, 18 aa, Mycobacterium
EPPYRGLVEMSAQLPPGT

SEQ ID NO: 1315319 - protein, 23 aa, Mycobacterium
EPQQLLQMLQQNNQLPAMFADVR

SEQ ID NO: 1315320 - protein, 20 aa, Mycobacterium
EPQWRNAFGYLPDGSRVPDP

SEQ ID NO: 1315321 - protein, 32 aa, Mycobacterium
EPREIFTMSYGTFVVFFRACAPCYFDFFEQCT

SEQ ID NO: 1315322 - protein, 20 aa, Mycobacterium
EPRLPYASLKAAVATFTRGI

SEQ ID NO: 1315323 - protein, 28 aa, Mycobacterium
EPRLWEMSTVLPILQDTTIVAAGPSVQH

SEQ ID NO: 1315324 - protein, 17 aa, Mycobacterium
EPRLWLLGSSMYSAQLA

SEQ ID NO: 1315325 - protein, 20 aa, Mycobacterium
EPRVGTLALLTDLLERFDVP

SEQ ID NO: 1315326 - protein, 22 aa, Mycobacterium
EPRVLQIRALVLGTAMDWLADN

SEQ ID NO: 1315327 - protein, 22 aa, Mycobacterium
EPTFVGTRRYVRRQRSWFRRDH

SEQ ID NO: 1315328 - protein, 25 aa, Mycobacterium
EPTIDHLLLQLDDPARLRDFASAVL

SEQ ID NO: 1315329 - protein, 19 aa, Mycobacterium
EPTPVPWGGNRQGLYRCAL

SEQ ID NO: 1315330 - protein, 25 aa, Mycobacterium
EPTVRRRAPPAPRPGHTVGDRRQRT

SEQ ID NO: 1315331 - protein, 25 aa, Mycobacterium
EPVADVWVMVFDPSGHRAVKQQFTI

SEQ ID NO: 1315332 - protein, 20 aa, Mycobacterium
EPVDISNAVLFLASDEARYI

SEQ ID NO: 1315333 - protein, 23 aa, Mycobacterium
EPVGLMRRIGLGDTLRMALMGND

SEQ ID NO: 1315334 - protein, 26 aa, Mycobacterium
EPVPGLFTLVLHTHLPWLAHHGRWPV

SEQ ID NO: 1315335 - protein, 24 aa, Mycobacterium
EPVPVRVLYLGRGLARATTYGPVE

SEQ ID NO: 1315336 - protein, 18 aa, Mycobacterium
EPVSPYLALLYTQSQEID

SEQ ID NO: 1315337 - protein, 22 aa, Mycobacterium
EPVYAHVPLVLNGDGARLAKRD

SEQ ID NO: 1315338 - protein, 17 aa, Mycobacterium
EPWPTFRVSGRLVWFAM

SEQ ID NO: 1315339 - protein, 19 aa, Mycobacterium
EPYRRLSPIAPVRPVVPAE

SEQ ID NO: 1315340 - protein, 23 aa, Mycobacterium
EQAAMLIFLGSRAAGYLTGQVVW

SEQ ID NO: 1315341 - protein, 26 aa, Mycobacterium
EQAARRGGQWLDWFDAEGIAGVGMGM

SEQ ID NO: 1315342 - protein, 17 aa, Mycobacterium
EQALRERFGYDAWVLAY

SEQ ID NO: 1315343 - protein, 25 aa, Mycobacterium
EQALSALLGARRWVRMPGVHFGPDS

SEQ ID NO: 1315344 - protein, 28 aa, Mycobacterium
EQDPGFEFMVLPWPDYYGSAPGARDDGY

SEQ ID NO: 1315345 - protein, 24 aa, Mycobacterium
EQERYPLLEEVLEIDLSGLSDEDR

SEQ ID NO: 1315346 - protein, 18 aa, Mycobacterium
EQFAPWLLVQKRGNVHVV

SEQ ID NO: 1315347 - protein, 24 aa, Mycobacterium
EQGELWFRSPQLMKGYHNKPEATA

SEQ ID NO: 1315348 - protein, 24 aa, Mycobacterium
EQGYVQLPFAPGDTVTANAGGFRS

SEQ ID NO: 1315349 - protein, 41 aa, Mycobacterium
EQHLLAPLALAPRGIWFAPKDLRLFYQVRQSWRGKAVLLKL

SEQ ID NO: 1315350 - protein, 23 aa, Mycobacterium
EQHLRAVLDYPLGDTSALAPTAM

SEQ ID NO: 1315351 - protein, 28 aa, Mycobacterium
EQHRLHVNRWFYDCPPAFHRKLGDMYVS

SEQ ID NO: 1315352 - protein, 21 aa, Mycobacterium
EQHRRWDKVLFDAGLSVITWP

SEQ ID NO: 1315353 - protein, 24 aa, Mycobacterium
EQIEKLWAINVNGVLWGTQAAVAK

SEQ ID NO: 1315354 - protein, 25 aa, Mycobacterium
EQIERLMWPSLEGEIRWCQLFSEPG

SEQ ID NO: 1315355 - protein, 25 aa, Mycobacterium
EQIGQDMGLIPRARILATAVSGSDP

SEQ ID NO: 1315356 - protein, 26 aa, Mycobacterium
EQIHEIALWVATLDRYATRDSLEQAL

SEQ ID NO: 1315357 - protein, 22 aa, Mycobacterium
EQKDRYLPRMATGDIRATMALT

SEQ ID NO: 1315358 - protein, 24 aa, Mycobacterium
EQKKKFLPGILSGDIHFAIGYSEP

SEQ ID NO: 1315359 - protein, 34 aa, Mycobacterium; identical to SEQ ID NO: 809469

SEQ ID NO: 1315360 - protein, 23 aa, Mycobacterium
EQKQRYLPPMATGELRATMALTE

SEQ ID NO: 1315361 - protein, 28 aa, Mycobacterium
EQKRHDFLGAPFWIGRGFGLNLSVVTDP

SEQ ID NO: 1315362 - protein, 25 aa, Mycobacterium
EQKRRADAILLRHSDRLPLAAPPDW

SEQ ID NO: 1315363 - protein, 18 aa, Mycobacterium
EQLLAGVRMRAGAVLIGP

SEQ ID NO: 1315364 - protein, 21 aa, Mycobacterium
EQLRLLSARFGATAALSAVVD

SEQ ID NO: 1315365 - protein, 22 aa, Mycobacterium
EQLRPHLLSVAYRLTGTLADAE

SEQ ID NO: 1315366 - protein, 18 aa, Mycobacterium
EQLRRFLDDQVWLENRRV

SEQ ID NO: 1315367 - protein, 26 aa, Mycobacterium
EQLVGFFVNFVVLRNDLRGNPTLREV

SEQ ID NO: 1315368 - protein, 25 aa, Mycobacterium
EQMLVNDGVSLTKLWFSVTASEQRT

SEQ ID NO: 1315369 - protein, 24 aa, Mycobacterium
EQPELWRVASLLRAGVPVALSTDA

SEQ ID NO: 1315370 - protein, 20 aa, Mycobacterium
EQPWLAIAPVAKAVAVMEAL

SEQ ID NO: 1315371 - protein, 23 aa, Mycobacterium
EQQLIWRNYLAMVSRLHTAMHRQ

SEQ ID NO: 1315372 - protein, 17 aa, Mycobacterium
EQQPRVVTARRGPAVPA

SEQ ID NO: 1315373 - protein, 24 aa, Mycobacterium
EQQQPPPGWAPQAPPSAPPYPPRP

SEQ ID NO: 1315374 - protein, 23 aa, Mycobacterium
EQQYGIPIRLAYGATEFAGSLCA

SEQ ID NO: 1315375 - protein, 27 aa, Mycobacterium
EQSGLPFSRIRILKRLSKTPMSVKQLA

SEQ ID NO: 1315376 - protein, 20 aa, Mycobacterium
EQSGYFRAKALQERLIRQSP

SEQ ID NO: 1315377 - protein, 23 aa, Mycobacterium
EQTPAHFIGFDALAVGDSSLMKE

SEQ ID NO: 1315378 - protein, 27 aa, Mycobacterium
EQTPASILYLMELIADLLPAGVINVVN

SEQ ID NO: 1315379 - protein, 25 aa, Mycobacterium
EQTPIRSIMAFQLFIADETIGAINV

SEQ ID NO: 1315380 - protein, 25 aa, Mycobacterium
EQVGIPLRRYVLWSRLRAAITRVQG

SEQ ID NO: 1315381 - protein, 19 aa, Mycobacterium
EQVKRFALLDRELSIAAGD

SEQ ID NO: 1315382 - protein, 20 aa, Mycobacterium
EQVLEQAATTFERFRDHVRT

SEQ ID NO: 1315383 - protein, 17 aa, Mycobacterium
EQVSCELPLQAIAGLMG

SEQ ID NO: 1315384 - protein, 23 aa, Mycobacterium
EQWFDPDGFFLAFDEDSGRLLGF

SEQ ID NO: 1315385 - protein, 25 aa, Mycobacterium
EQWRTVVDVNLIGTWNTCAAALPHL

SEQ ID NO: 1315386 - protein, 20 aa, Mycobacterium
EQWSALTHGFIGRGPDHVAG

SEQ ID NO: 1315387 - protein, 23 aa, Mycobacterium
EQWVRSRRLNAGKGKRALAAELR

SEQ ID NO: 1315388 - protein, 29 aa, Mycobacterium
ERAIRNIAVSPFLVQPLQAPAGAGKTHSL

SEQ ID NO: 1315389 - protein, 19 aa, Mycobacterium
ERALSARPALLSVSFGEDW

SEQ ID NO: 1315390 - protein, 20 aa, Mycobacterium
ERALTWWAVQSLTKTAIGCL

SEQ ID NO: 1315391 - protein, 29 aa, Mycobacterium
ERARPGLAAYGDPILHVGPLGAGQSVKLV

SEQ ID NO: 1315392 - protein, 25 aa, Mycobacterium
ERARRRLWAPHRVFGARQLDMVGDA

SEQ ID NO: 1315393 - protein, 26 aa, Mycobacterium
ERASQLNRFALLASRGVPLAFGSDTP

SEQ ID NO: 1315394 - protein, 31 aa, Mycobacterium
ERAVMATMPMVMWLRMLSLQAQKRAAQASAQ

SEQ ID NO: 1315395 - protein, 25 aa, Mycobacterium
ERDAMPLIADLYRHAIRLTRDHADA

SEQ ID NO: 1315396 - protein, 27 aa, Mycobacterium
ERDDFPLTFQPFQATPFRQATEAVIEP

SEQ ID NO: 1315397 - protein, 17 aa, Mycobacterium
ERDEDLTPNFYLPSSPL

SEQ ID NO: 1315398 - protein, 25 aa, Mycobacterium
ERDGQDLRWLSLAFPIVHECCAAEL

SEQ ID NO: 1315399 - protein, 28 aa, Mycobacterium
ERDIQVRGYTLRLPLDVLVVASANPEDY

SEQ ID NO: 1315400 - protein, 19 aa, Mycobacterium
ERDLLPQPVSDLLIAQEQR

SEQ ID NO: 1315401 - protein, 25 aa, Mycobacterium
EREFTQVFSTLFPGGEGRLLLTDPS

SEQ ID NO: 1315402 - protein, 17 aa, Mycobacterium
EREGLEIPLLIGGATTS

SEQ ID NO: 1315403 - protein, 20 aa, Mycobacterium
EREHVGLGVPYPPLAERFER

SEQ ID NO: 1315404 - protein, 27 aa, Mycobacterium
ERELAAQRPVPPLPLQLSVSAMVELGR

SEQ ID NO: 1315405 - protein, 29 aa, Mycobacterium
ERELQHVFGRSWLFLAHDSQLPKPGSFLQ

SEQ ID NO: 1315406 - protein, 17 aa, Mycobacterium
EREQPWLAIAPVAKAVA

SEQ ID NO: 1315407 - protein, 19 aa, Mycobacterium
ERERVCAFAADWNQRTWNP

SEQ ID NO: 1315408 - protein, 23 aa, Mycobacterium
ERERWRRHIITACVPIADHIAYR

SEQ ID NO: 1315409 - protein, 24 aa, Mycobacterium
ERFPDMRIPWHSRWRHFEAGGVDR

SEQ ID NO: 1315410 - protein, 17 aa, Mycobacterium
ERFTIPAIPRREDPRDA

SEQ ID NO: 1315411 - protein, 19 aa, Mycobacterium
ERFVYLSDVLPTAWQGVEY

SEQ ID NO: 1315412 - protein, 23 aa, Mycobacterium
ERGLGDLPYPPSYPKMPGEPPRV

SEQ ID NO: 1315413 - protein, 25 aa, Mycobacterium
ERGLPALVSAPDRLLRLPDGVPTDA

SEQ ID NO: 1315414 - protein, 24 aa, Mycobacterium
ERGLTPELLSNWSHAWTATVNEQH

SEQ ID NO: 1315415 - protein, 32 aa, Mycobacterium
ERGNFPVFRKRLRQWMMRITAYSDRLLEDLDV

SEQ ID NO: 1315416 - protein, 26 aa, Mycobacterium
ERGRGYANFLRILDEGRIAIAALSVG

SEQ ID NO: 1315417 - protein, 23 aa, Mycobacterium
ERHGFIWAVLTAGATIDVDAHLG

SEQ ID NO: 1315418 - protein, 24 aa, Mycobacterium
ERHPAMLAAYFRARTGPSGKRLLR

SEQ ID NO: 1315419 - protein, 17 aa, Mycobacterium
ERHQDWFVGERFDVLRA

SEQ ID NO: 1315420 - protein, 24 aa, Mycobacterium
ERIIGPLARAALDNALRRGQAALT

SEQ ID NO: 1315421 - protein, 19 aa, Mycobacterium
ERIVEYLAVRARRAQRGMA

SEQ ID NO: 1315422 - protein, 27 aa, Mycobacterium
ERIYRDVRLLRLYEGTSEIQRLIIGGG

SEQ ID NO: 1315423 - protein, 23 aa, Mycobacterium
ERKALLDRLLAQELPEGWDADLT

SEQ ID NO: 1315424 - protein, 26 aa, Mycobacterium
ERLAAKLAPPPPVTPAPPASPPPVYI

SEQ ID NO: 1315425 - protein, 17 aa, Mycobacterium
ERLAVITAATRASKAQL

SEQ ID NO: 1315426 - protein, 25 aa, Mycobacterium
ERLDIKMVVLLHEMLRHCKPLGAWG

SEQ ID NO: 1315427 - protein, 29 aa, Mycobacterium
ERLGLDYVDLYLIHWPAGSQGTYVDSWGG

SEQ ID NO: 1315428 - protein, 23 aa, Mycobacterium
ERLGNAGFRWLVQSAPVDDPIVA

SEQ ID NO: 1315429 - protein, 17 aa, Mycobacterium
ERLGRWLPRVVAAFVDT

SEQ ID NO: 1315430 - protein, 19 aa, Mycobacterium
ERLIPVPAPPPNPAPEIPA

SEQ ID NO: 1315431 - protein, 23 aa, Mycobacterium
ERLLLSYAAELARRRQARGLKLN

SEQ ID NO: 1315432 - protein, 25 aa, Mycobacterium
ERLPNLRLWNFYGQTEMAPLASALG

SEQ ID NO: 1315433 - protein, 24 aa, Mycobacterium
ERLREQGVRLLYDTPRRGTADSRI

SEQ ID NO: 1315434 - protein, 24 aa, Mycobacterium
ERLSGSGLRVLRYGSTGTGALDAT

SEQ ID NO: 1315435 - protein, 30 aa, Mycobacterium
ERLTDEAIFSFLRLLLPAGLETTFRSSGNL

SEQ ID NO: 1315436 - protein, 21 aa, Mycobacterium
ERLWEALLRGDDFVTEVPLDR

SEQ ID NO: 1315437 - protein, 19 aa, Mycobacterium
ERMPRLLRSLYPIGGVVFD

SEQ ID NO: 1315438 - protein, 17 aa, Mycobacterium
ERNLRRLPVAEQALIAS

SEQ ID NO: 1315439 - protein, 23 aa, Mycobacterium
ERNPLRFSSFRHKVGGWRRAPGP

SEQ ID NO: 1315440 - protein, 22 aa, Mycobacterium
ERNWFRRILGGEPAPPIYDPTA

SEQ ID NO: 1315441 - protein, 24 aa, Mycobacterium
ERPKSTLGFLKPRAAIIGHGDVLA

SEQ ID NO: 1315442 - protein, 21 aa, Mycobacterium
ERPNLARMMFLDPHTRELYLD

SEQ ID NO: 1315443 - protein, 17 aa, Mycobacterium
ERPSRLLVPLARQTRRH

SEQ ID NO: 1315444 - protein, 28 aa, Mycobacterium
ERQGPLNFYSLYRAHNLHFVVYSAMFEG

SEQ ID NO: 1315445 - protein, 25 aa, Mycobacterium
ERQKQVLLDIYTSFCQQNEAVLAEA

SEQ ID NO: 1315446 - protein, 17 aa, Mycobacterium
ERQPPALLMLHPPSETT

SEQ ID NO: 1315447 - protein, 23 aa, Mycobacterium
ERQRWRRHIITACVPIADHIAYR

SEQ ID NO: 1315448 - protein, 21 aa, Mycobacterium
ERRAALIGYLPTGFPDVPASI

SEQ ID NO: 1315449 - protein, 26 aa, Mycobacterium
ERRAEAWFDPAGLFMAFDDASGKLLG

SEQ ID NO: 1315450 - protein, 17 aa, Mycobacterium
ERRAELKAIIKSPSTTP

SEQ ID NO: 1315451 - protein, 17 aa, Mycobacterium
ERRAIALALLDAAILAD

SEQ ID NO: 1315452 - protein, 21 aa, Mycobacterium
ERRALLVDAAFRLFGDGGEQA

SEQ ID NO: 1315453 - protein, 29 aa, Mycobacterium
ERRDKNWRPTMLWAYDPQAFDGKGRAAVS

SEQ ID NO: 1315454 - protein, 29 aa, Mycobacterium
ERREYRHIFGDPWVLVQTLLGHASLETTR

SEQ ID NO: 1315455 - protein, 18 aa, Mycobacterium
ERRFLTRYIEIRSALTRA

SEQ ID NO: 1315456 - protein, 19 aa, Mycobacterium
ERRGPMIGILTTIGGLDAG

SEQ ID NO: 1315457 - protein, 17 aa, Mycobacterium
ERRILLRALREGVDTGT

SEQ ID NO: 1315458 - protein, 21 aa, Mycobacterium
ERRIPIDEFYRLPGDEPHRDT

SEQ ID NO: 1315459 - protein, 17 aa, Mycobacterium
ERRLARGQILYDAPELV

SEQ ID NO: 1315460 - protein, 22 aa, Mycobacterium
ERRQVPLGEFSRALARRGVTGI

SEQ ID NO: 1315461 - protein, 18 aa, Mycobacterium
ERRRLFGMIGSVTPDKMA

SEQ ID NO: 1315462 - protein, 18 aa, Mycobacterium
ERRYLTHAELLMLAKAAD

SEQ ID NO: 1315463 - protein, 18 aa, Mycobacterium
ERSAPFPPPPPGFDRPVL

SEQ ID NO: 1315464 - protein, 25 aa, Mycobacterium
ERSLAEQWLLVDRSLFEVGQVRPGH

SEQ ID NO: 1315465 - protein, 18 aa, Mycobacterium
ERSMTVIRINRKVLRIAA

SEQ ID NO: 1315466 - protein, 22 aa, Mycobacterium
ERSPTFYRFDSGEQLKVWREMD

SEQ ID NO: 1315467 - protein, 26 aa, Mycobacterium
ERSRLMLDIAQWRRRRRDELAALGDK

SEQ ID NO: 1315468 - protein, 23 aa, Mycobacterium
ERTAGFLAIGLAVAERAPVCVAM

SEQ ID NO: 1315469 - protein, 25 aa, Mycobacterium
ERTDALVFGKLRLQFWVCGTFELND

SEQ ID NO: 1315470 - protein, 37 aa, Mycobacterium
ERTLRRLFAETLGLPWRTYLLHARMLRAMALLTAPTQ

SEQ ID NO: 1315471 - protein, 29 aa, Mycobacterium
ERTPLTAELLLRGWLDSGGPDVLALAQGA

SEQ ID NO: 1315472 - protein, 38 aa, Mycobacterium
ERTVEFLQWFLDTVPIEPIWLCPLRLRDDRDWPLYPIR

SEQ ID NO: 1315473 - protein, 27 aa, Mycobacterium
ERTYLQEWHYFFNNTSRWRDLRKITIA

SEQ ID NO: 1315474 - protein, 18 aa, Mycobacterium
ERVADALFPTLFGAAREI

SEQ ID NO: 1315475 - protein, 31 aa, Mycobacterium
ERVEYKLRDWLFARQRYWGEPFPIVYDADDR

SEQ ID NO: 1315476 - protein, 20 aa, Mycobacterium
ERVLRGFALSLLVPQRHYDA

SEQ ID NO: 1315477 - protein, 17 aa, Mycobacterium
ERVPIPRIGQRFDQGAS

SEQ ID NO: 1315478 - protein, 30 aa, Mycobacterium
ERVPPPDRNLLWLVFMDPAIRELLPDWDAD

SEQ ID NO: 1315479 - protein, 19 aa, Mycobacterium
ERVRAILAESVDLDLWQAQ

SEQ ID NO: 1315480 - protein, 17 aa, Mycobacterium
ERVRSRLFPVMHDIVLA

SEQ ID NO: 1315481 - protein, 25 aa, Mycobacterium
ERVWQVYADPRQLEKIWGPPECPAT

SEQ ID NO: 1315482 - protein, 23 aa, Mycobacterium
ERWVRRGGYVLSSFAPATLPADE

SEQ ID NO: 1315483 - protein, 20 aa, Mycobacterium
ERYAPFFQMCSRALPRGGRM

SEQ ID NO: 1315484 - protein, 21 aa, Mycobacterium
ERYGVPAHQLLHRAGQRKLIG

SEQ ID NO: 1315485 - protein, 21 aa, Mycobacterium
ERYLRFFTTHPTHMDEWVTSL

SEQ ID NO: 1315486 - protein, 17 aa, Mycobacterium
ERYPLLEESLEIDLTGL

SEQ ID NO: 1315487 - protein, 18 aa, Mycobacterium
ERYPLLEESLEIDLTGLS

SEQ ID NO: 1315488 - protein, 23 aa, Mycobacterium
ESAAIWARLADFGSLSAWADGID

SEQ ID NO: 1315489 - protein, 24 aa, Mycobacterium
ESAARRWGLRRGVPTVVYDDWNRA

SEQ ID NO: 1315490 - protein, 18 aa, Mycobacterium
ESAIYFYGPGAINCLATR

SEQ ID NO: 1315491 - protein, 21 aa, Mycobacterium
ESARLLGPLAAYLVVNVSSPN

SEQ ID NO: 1315492 - protein, 24 aa, Mycobacterium
ESDIEALLVRLLESPPVVVVRSHR

SEQ ID NO: 1315493 - protein, 25 aa, Mycobacterium
ESDNLVVKGIYWARRASSPKRRRII

SEQ ID NO: 1315494 - protein, 22 aa, Mycobacterium
ESDVLLAILGPMSVRTALRPGE

SEQ ID NO: 1315495 - protein, 18 aa, Mycobacterium
ESEAFWININRETQGPAR

SEQ ID NO: 1315496 - protein, 17 aa, Mycobacterium
ESELLPRHLARITRDVP

SEQ ID NO: 1315497 - protein, 18 aa, Mycobacterium
ESELMERFGVSRPTLREA

SEQ ID NO: 1315498 - protein, 22 aa, Mycobacterium
ESELPIIVRRNKFHLHRLINDA

SEQ ID NO: 1315499 - protein, 22 aa, Mycobacterium
ESERLLRGFLTSALFEGGLYCR

SEQ ID NO: 1315500 - protein, 19 aa, Mycobacterium
ESEVRHGFSPAARRARSSG

SEQ ID NO: 1315501 - protein, 21 aa, Mycobacterium
ESFGLPGLAAYCREAIHANAD

SEQ ID NO: 1315502 - protein, 18 aa, Mycobacterium
ESFKVLLKELQSLCLNVE

SEQ ID NO: 1315503 - protein, 23 aa, Mycobacterium
ESFTLVYDAIVTRGGQQTALPTA

SEQ ID NO: 1315504 - protein, 22 aa, Mycobacterium
ESGAHVGMALWRDGRLVFSRNP

SEQ ID NO: 1315505 - protein, 24 aa, Mycobacterium
ESGAPPLALMPLEYLTPAAEDRAV

SEQ ID NO: 1315506 - protein, 27 aa, Mycobacterium
ESGARRLVIVPWFLAHGRITDRVADYA

SEQ ID NO: 1315507 - protein, 23 aa, Mycobacterium
ESGEQVFLCPLELASFTLATPED

SEQ ID NO: 1315508 - protein, 29 aa, Mycobacterium
ESGGLFHGIQLWVNLPRKDKFAAPRYQAI

SEQ ID NO: 1315509 - protein, 26 aa, Mycobacterium
ESGSWVLDFVGSWEWTIPGGASEIQR

SEQ ID NO: 1315510 - protein, 23 aa, Mycobacterium
ESGYEWIELGPYGYLPTDPAKLS

SEQ ID NO: 1315511 - protein, 28 aa, Mycobacterium
ESHAWQLTGFLLTEVVPSVLRLVGCDEH

SEQ ID NO: 1315512 - protein, 17 aa, Mycobacterium
ESHIAGVLYLFVRGMCG

SEQ ID NO: 1315513 - protein, 27 aa, Mycobacterium
ESHWLRLEENFYAALPPLEGARVNNGG

SEQ ID NO: 1315514 - protein, 26 aa, Mycobacterium
ESILTLLALRDGVIPATRNLKNLDPE

SEQ ID NO: 1315515 - protein, 20 aa, Mycobacterium
ESIRLGQFLKLANLIDTGAD

SEQ ID NO: 1315516 - protein, 23 aa, Mycobacterium
ESKCSYLAPVAYPDELRAGLRVD

SEQ ID NO: 1315517 - protein, 25 aa, Mycobacterium
ESKVLALLHRFGIAAPASADLSRAV

SEQ ID NO: 1315518 - protein, 26 aa, Mycobacterium
ESLADPLAFLLRKEGFEATVVADGPS

SEQ ID NO: 1315519 - protein, 26 aa, Mycobacterium
ESLEDYLGDFRFYLDFYTRQGPNGLE

SEQ ID NO: 1315520 - protein, 25 aa, Mycobacterium
ESLHAPRLWPEYHPGYYGAFVRDPD

SEQ ID NO: 1315521 - protein, 28 aa, Mycobacterium
ESLKEALWQLIWAGYVGGDTFAPVRALL

SEQ ID NO: 1315522 - protein, 31 aa, Mycobacterium
ESLLEQLPLAQLAPFKQLLIAPLAELDSQRG

SEQ ID NO: 1315523 - protein, 17 aa, Mycobacterium
ESLLGAIAWYSRTDSES

SEQ ID NO: 1315524 - protein, 27 aa, Mycobacterium
ESLPSGWVMLVAAWLAQAEAARGNADG

SEQ ID NO: 1315525 - protein, 28 aa, Mycobacterium
ESLRDLFAYPDGLQRPWLRANFIASIDG

SEQ ID NO: 1315526 - protein, 21 aa, Mycobacterium
ESLRPMMRLVVTNGTAEDLQG

SEQ ID NO: 1315527 - protein, 19 aa, Mycobacterium
ESLRRLHGLGHRRVLPGHG

SEQ ID NO: 1315528 - protein, 24 aa, Mycobacterium
ESLTDFQYVLDVNLVGAFRLTQLV

SEQ ID NO: 1315529 - protein, 21 aa, Mycobacterium
ESMAMWPGAAVSGWYFSHPQS

SEQ ID NO: 1315530 - protein, 22 aa, Mycobacterium
ESMEALGLVLIDESFRALREML

SEQ ID NO: 1315531 - protein, 35 aa, Mycobacterium
ESMLCDFLAVMPQTPSLVLITFRPEYRGALTRVSG

SEQ ID NO: 1315532 - protein, 17 aa, Mycobacterium
ESPAVHLALVTGLTEGG

SEQ ID NO: 1315533 - protein, 19 aa, Mycobacterium
ESPFEFDILRDPNPHLGFG

SEQ ID NO: 1315534 - protein, 27 aa, Mycobacterium
ESPKETWLRLVIIRAGFPRPETQVPVY

SEQ ID NO: 1315535 - protein, 36 aa, Mycobacterium; identical to SEQ ID NO: 944589

SEQ ID NO: 1315536 - protein, 27 aa, Mycobacterium
ESPPERPLVGPLLWDLTAGTATDTTES

SEQ ID NO: 1315537 - protein, 22 aa, Mycobacterium
ESPRQYFFYVSDDGDLTALRYD

SEQ ID NO: 1315538 - protein, 24 aa, Mycobacterium
ESPSDLPERLSLFGHTRLPSTEVE

SEQ ID NO: 1315539 - protein, 17 aa, Mycobacterium
ESPYDPWDLRHYRDRLP

SEQ ID NO: 1315540 - protein, 23 aa, Mycobacterium
ESQAHGYLIYLDAVVAAISQDLD

SEQ ID NO: 1315541 - protein, 26 aa, Mycobacterium
ESQVAELLARIRAELPPLAGVAHLAG

SEQ ID NO: 1315542 - protein, 21 aa, Mycobacterium
ESRARCFPKGLAAFIDLRDQT

SEQ ID NO: 1315543 - protein, 24 aa, Mycobacterium
ESRDYILELLLDHTTAGLPYEDCV

SEQ ID NO: 1315544 - protein, 28 aa, Mycobacterium
ESRHGLKSMLFAPELALARAWTTAARHD

SEQ ID NO: 1315545 - protein, 19 aa, Mycobacterium
ESRLILETPVAPVSEPADY

SEQ ID NO: 1315546 - protein, 25 aa, Mycobacterium
ESRPSWPMIVFRTPKGWTGPAYIDG

SEQ ID NO: 1315547 - protein, 22 aa, Mycobacterium
ESRRLLAALIDWFEQRGKVRLL

SEQ ID NO: 1315548 - protein, 28 aa, Mycobacterium
ESSDRYQLVMGERRWRAAQLAGVATIPA

SEQ ID NO: 1315549 - protein, 23 aa, Mycobacterium
ESSIALRAALSGRLAAAGPRGVA

SEQ ID NO: 1315550 - protein, 17 aa, Mycobacterium
ESSTLPRELGRRFGELG

SEQ ID NO: 1315551 - protein, 25 aa, Mycobacterium
ESTSPRFFDGLRRAGYTRVSLGMQS

SEQ ID NO: 1315552 - protein, 30 aa, Mycobacterium
ESTYLTVRRFGWLRESFDPTTSLYAAIRAS

SEQ ID NO: 1315553 - protein, 27 aa, Mycobacterium
ESVDNALRLILLLGDRSEIRLTDASEY

SEQ ID NO: 1315554 - protein, 27 aa, Mycobacterium
ESVFFSDRFLAPRPLLEAVRSPEPVVL

SEQ ID NO: 1315555 - protein, 26 aa, Mycobacterium
ESVFRSYTYPYLDRPNLTVLTGAVVT

SEQ ID NO: 1315556 - protein, 31 aa, Mycobacterium
ESVPFLLAVGDLLLGWLLLHQAETALTALEG

SEQ ID NO: 1315557 - protein, 22 aa, Mycobacterium
ESVPPELLFATTLADLGHRDGI

SEQ ID NO: 1315558 - protein, 23 aa, Mycobacterium
ESYAKVDGYWLITASTLTRLRED

SEQ ID NO: 1315559 - protein, 18 aa, Mycobacterium
ESYAWTTDLGIASPMGIK

SEQ ID NO: 1315560 - protein, 18 aa, Mycobacterium
ESYPRYSRRRSAVSRYSA

SEQ ID NO: 1315561 - protein, 25 aa, Mycobacterium
ETAAHGCPLLLLLVSSAISGELIAR

SEQ ID NO: 1315562 - protein, 28 aa, Mycobacterium
ETACRWHLRAADWLRMRDLLAARNQWEI

SEQ ID NO: 1315563 - protein, 24 aa, Mycobacterium
ETAKDLLRVLTKRELLKPHPGDPA

SEQ ID NO: 1315564 - protein, 17 aa, Mycobacterium
ETAQRFVGWLGRVVTAF

SEQ ID NO: 1315565 - protein, 21 aa, Mycobacterium
ETARFLIHDLGADAMFTSSLD

SEQ ID NO: 1315566 - protein, 22 aa, Mycobacterium
ETARRYVQTFVLPAILADPPAP

SEQ ID NO: 1315567 - protein, 25 aa, Mycobacterium
ETASVWFTAYPLSLITRSNESFLKA

SEQ ID NO: 1315568 - protein, 18 aa, Mycobacterium
ETATHWIPTGMDADLDEA

SEQ ID NO: 1315569 - protein, 25 aa, Mycobacterium
ETDARTWLLLSTGLLTVADAAADGA

SEQ ID NO: 1315570 - protein, 30 aa, Mycobacterium
ETDGYQYDLLALALRGRIPLAPRVLGPRES

SEQ ID NO: 1315571 - protein, 23 aa, Mycobacterium
ETDKPFLMPVEDVFTITGRGTVV

SEQ ID NO: 1315572 - protein, 22 aa, Mycobacterium
ETDLNLVELLTTSLLVQATRAM

SEQ ID NO: 1315573 - protein, 23 aa, Mycobacterium
ETDPEGSGEYRDSTDRRARHRDL

SEQ ID NO: 1315574 - protein, 26 aa, Mycobacterium
ETDPRTWLLIATGLLSFDEAAASGGL

SEQ ID NO: 1315575 - protein, 24 aa, Mycobacterium
ETDRGWLLLTHGVGPMRTYSIGAI

SEQ ID NO: 1315576 - protein, 24 aa, Mycobacterium
ETDSAHYLLPPQQAAWIPAGLEHQ

SEQ ID NO: 1315577 - protein, 26 aa, Mycobacterium
ETDVRSTLLDLLREGLALTGTKKGCD

SEQ ID NO: 1315578 - protein, 30 aa, Mycobacterium
ETEFRNRHKPWSGSKWAVGLAVTLDDDRRL

SEQ ID NO: 1315579 - protein, 24 aa, Mycobacterium
ETERLLRDRLAELRPGDAILGEEE

SEQ ID NO: 1315580 - protein, 27 aa, Mycobacterium
ETFADMELAWGPTWSGSLKSLWLGEGE

SEQ ID NO: 1315581 - protein, 20 aa, Mycobacterium
ETFGPTLPIMKVKSVEEAVR

SEQ ID NO: 1315582 - protein, 18 aa, Mycobacterium
ETFPFPFAADEYRYSTNV

SEQ ID NO: 1315583 - protein, 33 aa, Mycobacterium
ETGEAKLETICRLIMLYHLDRAWADHLAFLADI

SEQ ID NO: 1315584 - protein, 30 aa, Mycobacterium
ETGGRWWTDDGLWKEIVSTGWLGLHVDEQF

SEQ ID NO: 1315585 - protein, 21 aa, Mycobacterium
ETGLPDALLGLIRRVDPGLPN

SEQ ID NO: 1315586 - protein, 28 aa, Mycobacterium
ETGLPFSRVRVLRRLGRQPMTVKQVAQA

SEQ ID NO: 1315587 - protein, 20 aa, Mycobacterium
ETGLRPDFARPPVPSGRAGA

SEQ ID NO: 1315588 - protein, 17 aa, Mycobacterium
ETGLRYYAAAFFEVIPQ

SEQ ID NO: 1315589 - protein, 24 aa, Mycobacterium
ETGNATVVPFLLADAYHARVDIPA

SEQ ID NO: 1315590 - protein, 18 aa, Mycobacterium
ETGRRPHLPLPSFWSGQF

SEQ ID NO: 1315591 - protein, 24 aa, Mycobacterium
ETHDDAMRLILPNLQMMARLRTGQ

SEQ ID NO: 1315592 - protein, 19 aa, Mycobacterium
ETHGERFLLGIGVSHAPLI

SEQ ID NO: 1315593 - protein, 26 aa, Mycobacterium
ETHLITSHALLPLLTARPGGLLVEIT

SEQ ID NO: 1315594 - protein, 18 aa, Mycobacterium
ETHRAIMDTLAAGGAYFF

SEQ ID NO: 1315595 - protein, 24 aa, Mycobacterium
ETKDGYIAALIYNDKHWNAFVEAV

SEQ ID NO: 1315596 - protein, 17 aa, Mycobacterium
ETKIAEQGLLTTPPWDW

SEQ ID NO: 1315597 - protein, 18 aa, Mycobacterium
ETLDLLLDLARTAGLPAK

SEQ ID NO: 1315598 - protein, 23 aa, Mycobacterium
ETLEPMMRITLNAILRAVFGADG

SEQ ID NO: 1315599 - protein, 34 aa, Mycobacterium
ETLKAVPHYGIGYGLLRYLYAPTARVLGASRPAD

SEQ ID NO: 1315600 - protein, 25 aa, Mycobacterium
ETLNRSLLPAFDRQYRQVMSRAVPV

SEQ ID NO: 1315601 - protein, 32 aa, Mycobacterium
ETLPDVLCGYHLSVVRPLPGLDGRFVKRLFDS

SEQ ID NO: 1315602 - protein, 32 aa, Mycobacterium
ETLPVHLHLRRPSPHIPWERLPVRVVAEATPW

SEQ ID NO: 1315603 - protein, 26 aa, Mycobacterium
ETLPWVPADRAWLPDLTRLLAGADHA

SEQ ID NO: 1315604 - protein, 29 aa, Mycobacterium
ETLQSIPRYFYALFAIDLTNKNYAKSALY

SEQ ID NO: 1315605 - protein, 23 aa, Mycobacterium
ETLRGRMHLLEPLRYELVDVPLH

SEQ ID NO: 1315606 - protein, 30 aa, Mycobacterium
ETNTVLGHYTHFGNLLDLLAVAVPVGSTAD

SEQ ID NO: 1315607 - protein, 17 aa, Mycobacterium
ETPRPEYLAARTSQPFS

SEQ ID NO: 1315608 - protein, 26 aa, Mycobacterium
ETQAVLALLESPLGQLLRAAAIGELA

SEQ ID NO: 1315609 - protein, 17 aa, Mycobacterium
ETQGPVLVPFLDGERKP

SEQ ID NO: 1315610 - protein, 22 aa, Mycobacterium
ETRAYAVARALDPLLVNTVVGF

SEQ ID NO: 1315611 - protein, 28 aa, Mycobacterium
ETRKLPQTILMYPMTIASQLAQLVMKMQ

SEQ ID NO: 1315612 - protein, 17 aa, Mycobacterium
ETRLLGETELWQLAHRV

SEQ ID NO: 1315613 - protein, 18 aa, Mycobacterium
ETRLLIDGRLRDASTGRT

SEQ ID NO: 1315614 - protein, 18 aa, Mycobacterium
ETRLVPQRGYHLELITLV

SEQ ID NO: 1315615 - protein, 27 aa, Mycobacterium
ETRNAWVEFPIFDAKTRSLKKAFLGKA

SEQ ID NO: 1315616 - protein, 27 aa, Mycobacterium
ETRSNRIILSPYWPESLGVLAIPIHYR

SEQ ID NO: 1315617 - protein, 23 aa, Mycobacterium
ETRTGDIWLFRGRSGPDRAIQSM

SEQ ID NO: 1315618 - protein, 23 aa, Mycobacterium
ETSPAFVGGLFQLAYGTLRDATH

SEQ ID NO: 1315619 - protein, 17 aa, Mycobacterium
ETSPLCVVGRLLPKHEG

SEQ ID NO: 1315620 - protein, 24 aa, Mycobacterium
ETSRFGFVFTRRGVVPESASSWFL

SEQ ID NO: 1315621 - protein, 18 aa, Mycobacterium
ETSWLLDPSIPLAEVFKD

SEQ ID NO: 1315622 - protein, 19 aa, Mycobacterium
ETSWLLDPSIPLAEVFKDY

SEQ ID NO: 1315623 - protein, 23 aa, Mycobacterium
ETTAPFSAFVFKVQAGMDSAHRD

SEQ ID NO: 1315624 - protein, 25 aa, Mycobacterium
ETTDRLAVLPAWRETDYFTPAERAA

SEQ ID NO: 1315625 - protein, 30 aa, Mycobacterium
ETTELPIEKVQLVIFAIQVALGELLKAHGA

SEQ ID NO: 1315626 - protein, 30 aa, Mycobacterium
ETTELPIEKVQLVIFAIQVALGELLKHHGA

SEQ ID NO: 1315627 - protein, 31 aa, Mycobacterium
ETTLSWLSRYSLPLRRLPFGLSSTRDHLTRV

SEQ ID NO: 1315628 - protein, 26 aa, Mycobacterium
ETTLTEGLLYERRLFHSAFATDDQTE

SEQ ID NO: 1315629 - protein, 17 aa, Mycobacterium
ETTPFTLENGLLTGIRK

SEQ ID NO: 1315630 - protein, 25 aa, Mycobacterium
ETTRNTMIVLLIKIVIEEYINHITP

SEQ ID NO: 1315631 - protein, 17 aa, Mycobacterium
ETVAINPALAFSGIELI

SEQ ID NO: 1315632 - protein, 24 aa, Mycobacterium
ETVEDVIWTYGQPYPAVGAIAGHV

SEQ ID NO: 1315633 - protein, 20 aa, Mycobacterium
ETVFITLPREGTHSASAHIH

SEQ ID NO: 1315634 - protein, 24 aa, Mycobacterium
ETVFKAAYRQGLSLVLKGPTGCGK

SEQ ID NO: 1315635 - protein, 30 aa, Mycobacterium
ETVGCRLPALSYRLLARLQAETTPPQMGAK

SEQ ID NO: 1315636 - protein, 22 aa, Mycobacterium
ETVHLALGAAGYLERDWRAGQD

SEQ ID NO: 1315637 - protein, 28 aa, Mycobacterium
ETWAHGLWAVYHRHRWILATASFGPPLD

SEQ ID NO: 1315638 - protein, 21 aa, Mycobacterium
ETWEPGDRLFLFGAGRGAACA

SEQ ID NO: 1315639 - protein, 23 aa, Mycobacterium
ETWGRRLIEQALWMVDVHRTLSR

SEQ ID NO: 1315640 - protein, 26 aa, Mycobacterium
EVAAFSRHATWWSRLGAPVTSLMQRV

SEQ ID NO: 1315641 - protein, 28 aa, Mycobacterium
EVAGAWDAVYWMMARTLIELERNLYAEA

SEQ ID NO: 1315642 - protein, 29 aa, Mycobacterium
EVAGVSRGWLYRHFPDKAELLGAAIVRLN

SEQ ID NO: 1315643 - protein, 23 aa, Mycobacterium
EVAIFGVPLDAGATYRPGTRFGP

SEQ ID NO: 1315644 - protein, 29 aa, Mycobacterium
EVASLMRVSKMTVYRLVHNGELPAVRVGR

SEQ ID NO: 1315645 - protein, 23 aa, Mycobacterium
EVASYLFHAYGTNLQFAEGEFNF

SEQ ID NO: 1315646 - protein, 18 aa, Mycobacterium
EVATDWLRAHKPLDFIPG

SEQ ID NO: 1315647 - protein, 31 aa, Mycobacterium
EVAVLVALGRQLAAVPYLESVMLAAGALATF

SEQ ID NO: 1315648 - protein, 19 aa, Mycobacterium
EVDEAEVIYWGICPACSTA

SEQ ID NO: 1315649 - protein, 24 aa, Mycobacterium
EVDPELYHWFTGDGMVHGIRIRDG

SEQ ID NO: 1315650 - protein, 18 aa, Mycobacterium
EVDRDGERLTLHPTQLVL

SEQ ID NO: 1315651 - protein, 30 aa, Mycobacterium
EVDTRRWAGVPFFLRTGKRLPRRVTEVALV

SEQ ID NO: 1315652 - protein, 23 aa, Mycobacterium
EVERSLLDELARHLGRRPDSATC

SEQ ID NO: 1315653 - protein, 17 aa, Mycobacterium
EVFAAWHRSGADHLPIV

SEQ ID NO: 1315654 - protein, 29 aa, Mycobacterium
EVFFHCAKAFLRSDAWQPETWNPTAVPSA

SEQ ID NO: 1315655 - protein, 18 aa, Mycobacterium
EVFFYEPIILGDKDSREV

SEQ ID NO: 1315656 - protein, 18 aa, Mycobacterium
EVFGTGLPQWRGVSGADM

SEQ ID NO: 1315657 - protein, 26 aa, Mycobacterium
EVFSAKPNPFTVFGIGEHVAGYGELS

SEQ ID NO: 1315658 - protein, 18 aa, Mycobacterium
EVGALCALVPDSMQFCFG

SEQ ID NO: 1315659 - protein, 17 aa, Mycobacterium
EVGFVTEPLRRLPVRPG

SEQ ID NO: 1315660 - protein, 20 aa, Mycobacterium
EVGLAPRLSLDPPMNQLVIG

SEQ ID NO: 1315661 - protein, 18 aa, Mycobacterium
EVGLLGAGFPESVGGGGG

SEQ ID NO: 1315662 - protein, 21 aa, Mycobacterium
EVGLRTFFDRFPDAKLAGTAS

SEQ ID NO: 1315663 - protein, 18 aa, Mycobacterium
EVGNGWHQVTAELSFERS

SEQ ID NO: 1315664 - protein, 31 aa, Mycobacterium
EVGPFKKGPFRIAMSVGIPIVPIVIRNAEVI

SEQ ID NO: 1315665 - protein, 28 aa, Mycobacterium
EVGPPELYAWLHYDPIPSRDDLAKALIA

SEQ ID NO: 1315666 - protein, 27 aa, Mycobacterium
EVHGMVLSAGLMLAWCCDLIVAAEDTV

SEQ ID NO: 1315667 - protein, 28 aa, Mycobacterium
EVHQRLLDRILTGYYPVGSRLPSCRALA

SEQ ID NO: 1315668 - protein, 17 aa, Mycobacterium
EVHSADELLRRAPRMLV

SEQ ID NO: 1315669 - protein, 20 aa, Mycobacterium
EVIDIPTPGAAPVGITWGGD

SEQ ID NO: 1315670 - protein, 17 aa, Mycobacterium
EVIDLRVLRPLDTATFV

SEQ ID NO: 1315671 - protein, 17 aa, Mycobacterium
EVIEFAIGIPHLLKGEF

SEQ ID NO: 1315672 - protein, 18 aa, Mycobacterium
EVISTYPAALIAEEILTP

SEQ ID NO: 1315673 - protein, 26 aa, Mycobacterium
EVKALYPLGPIFHGSGLNITVMSLGD

SEQ ID NO: 1315674 - protein, 31 aa, Mycobacterium
EVKDGYGRNYLLPRGLAIVATRGAQRQADDI

SEQ ID NO: 1315675 - protein, 17 aa, Mycobacterium
EVKVAHAPLLALLTELM

SEQ ID NO: 1315676 - protein, 17 aa, Mycobacterium
EVLAIVKKAGFSDAMHV

SEQ ID NO: 1315677 - protein, 19 aa, Mycobacterium
EVLARFRVDRPIRVTGWPP

SEQ ID NO: 1315678 - protein, 19 aa, Mycobacterium
EVLMRIGPYGDRFGLRRNG

SEQ ID NO: 1315679 - protein, 17 aa, Mycobacterium
EVLRVVKFWVSHGVKVF

SEQ ID NO: 1315680 - protein, 19 aa, Mycobacterium
EVLVRGVLDRLAEYGYGTV

SEQ ID NO: 1315681 - protein, 19 aa, Mycobacterium
EVNAPVRWWHGDADHIVPL

SEQ ID NO: 1315682 - protein, 26 aa, Mycobacterium
EVNLIGTFNVIRLAAERIAKQEPING

SEQ ID NO: 1315683 - protein, 17 aa, Mycobacterium
EVNLLHDHLVDVLLDAA

SEQ ID NO: 1315684 - protein, 21 aa, Mycobacterium
EVNRFGYIVELNPWDPTSTPV

SEQ ID NO: 1315685 - protein, 21 aa, Mycobacterium
EVPARVYIPHRPNPQFQPTRH

SEQ ID NO: 1315686 - protein, 23 aa, Mycobacterium
EVPATLAAMTWLASGPDLGPWAE

SEQ ID NO: 1315687 - protein, 25 aa, Mycobacterium
EVPEVEQFLTLRPGDRLRLTRDCSP

SEQ ID NO: 1315688 - protein, 28 aa, Mycobacterium
EVPGGRDEIWRFTPLRRLRGLHDGSAVA

SEQ ID NO: 1315689 - protein, 17 aa, Mycobacterium
EVPGLLDLSALWQIYAV

SEQ ID NO: 1315690 - protein, 26 aa, Mycobacterium
EVPHLHVHVFPAYNLTDFGFANVDNE

SEQ ID NO: 1315691 - protein, 23 aa, Mycobacterium
EVPMQMICILLGVPESERHWLFE

SEQ ID NO: 1315692 - protein, 26 aa, Mycobacterium
EVPVSPPLSWLPRSAALAAVFPRNRE

SEQ ID NO: 1315693 - protein, 26 aa, Mycobacterium
EVQEFLARFWYHYDQGKFDVLATFIA

SEQ ID NO: 1315694 - protein, 26 aa, Mycobacterium
EVRDFLLTALTLTLASWRIERGQPAH

SEQ ID NO: 1315695 - protein, 17 aa, Mycobacterium
EVRDRFDIIARAVPMLG

SEQ ID NO: 1315696 - protein, 26 aa, Mycobacterium
EVRERMPRRFYCRARWQTGGIDSETQ

SEQ ID NO: 1315697 - protein, 17 aa, Mycobacterium
EVRKFEPGELDELKARY

SEQ ID NO: 1315698 - protein, 20 aa, Mycobacterium
EVRPILLWHALEECEHKAVA

SEQ ID NO: 1315699 - protein, 21 aa, Mycobacterium
EVRPILLWHALEECEHKAVAF

SEQ ID NO: 1315700 - protein, 25 aa, Mycobacterium
EVRQLFERVRPTIPIVLANLVTVGD

SEQ ID NO: 1315701 - protein, 25 aa, Mycobacterium
EVRSEFLNQLTKGAIRKGVVSSIVN

SEQ ID NO: 1315702 - protein, 20 aa, Mycobacterium
EVRTWIWKTMTSFPGSYMTA

SEQ ID NO: 1315703 - protein, 19 aa, Mycobacterium
EVRWALLVGDRLGGELAWE

SEQ ID NO: 1315704 - protein, 27 aa, Mycobacterium
EVSADLWRRYVAILLQGMRSQQGLEQL

SEQ ID NO: 1315705 - protein, 17 aa, Mycobacterium
EVSLPRLVQAVSAERGR

SEQ ID NO: 1315706 - protein, 24 aa, Mycobacterium
EVSPFGIRVLAVEPGAFRTRAYAG

SEQ ID NO: 1315707 - protein, 25 aa, Mycobacterium
EVSPRTFYRYFGVKEALLLSDDQRS

SEQ ID NO: 1315708 - protein, 24 aa, Mycobacterium
EVSRYVLHQWTYLDLPAGPSASPV

SEQ ID NO: 1315709 - protein, 17 aa, Mycobacterium
EVTFRRFYLGRNGAAHG

SEQ ID NO: 1315710 - protein, 18 aa, Mycobacterium
EVTGFVVEGMPAMMSGMM

SEQ ID NO: 1315711 - protein, 24 aa, Mycobacterium
EVTGIAIFDLLAMAAKTGIASPAL

SEQ ID NO: 1315712 - protein, 25 aa, Mycobacterium
EVTGNPFIMYPSYQEIADLPLAERV

SEQ ID NO: 1315713 - protein, 26 aa, Mycobacterium
EVTKGQWASLRWFERRIVDAAADPPA

SEQ ID NO: 1315714 - protein, 20 aa, Mycobacterium
EVTLPREWGDWATRARMPSL

SEQ ID NO: 1315715 - protein, 25 aa, Mycobacterium
EVTMNLSMLTLLQKNLQGTIFGGGN

SEQ ID NO: 1315716 - protein, 22 aa, Mycobacterium
EVTMPVLTPGSTPLRVLHLSDL

SEQ ID NO: 1315717 - protein, 29 aa, Mycobacterium
EVTNYFAPPTVWISLLRSPVFDQVDLSSL

SEQ ID NO: 1315718 - protein, 19 aa, Mycobacterium
EVTVDPIMPLPGFLSRRAA

SEQ ID NO: 1315719 - protein, 20 aa, Mycobacterium
EVTVDPIMPLPGFLSRRAAK

SEQ ID NO: 1315720 - protein, 19 aa, Mycobacterium
EVTVLLPPQDSRLLTRELF

SEQ ID NO: 1315721 - protein, 40 aa, Mycobacterium
EVVAQQLIPFGPVMSVRAPWLMRAGLLPRGSRQERIVVIR

SEQ ID NO: 1315722 - protein, 29 aa, Mycobacterium
EVVASATGDFRFFAAPGTWTLRALSPAGN

SEQ ID NO: 1315723 - protein, 20 aa, Mycobacterium
EVVFDRGGYTYGGRIAALAD

SEQ ID NO: 1315724 - protein, 19 aa, Mycobacterium
EVVLDRKGNRHFSFGIGVH

SEQ ID NO: 1315725 - protein, 20 aa, Mycobacterium
EVVQLALAGKKIQAIKLLRE

SEQ ID NO: 1315726 - protein, 22 aa, Mycobacterium
EVWGRRLVEQALWMVDVHRTLT

SEQ ID NO: 1315727 - protein, 23 aa, Mycobacterium
EVYGPSLLDMLPRRARPKLSLRI

SEQ ID NO: 1315728 - protein, 19 aa, Mycobacterium
EWAAAQPWCDGNVGMIGIS

SEQ ID NO: 1315729 - protein, 19 aa, Mycobacterium
EWAAWNPQRRARVMMKFIE

SEQ ID NO: 1315730 - protein, 17 aa, Mycobacterium
EWDLALLGPDAVAEYDH

SEQ ID NO: 1315731 - protein, 25 aa, Mycobacterium
EWFATAYVDGFRWVMPTNVIGMSQH

SEQ ID NO: 1315732 - protein, 25 aa, Mycobacterium
EWFCTLTPAYFYSYDGRKESRFTAS

SEQ ID NO: 1315733 - protein, 19 aa, Mycobacterium
EWFNGHGLHRLRGTIRYPK

SEQ ID NO: 1315734 - protein, 18 aa, Mycobacterium
EWIETVATAVKRARVATL

SEQ ID NO: 1315735 - protein, 20 aa, Mycobacterium
EWIGQWGIFDALRAGPDVVR

SEQ ID NO: 1315736 - protein, 17 aa, Mycobacterium
EWITYRVSGPRLSELAA

SEQ ID NO: 1315737 - protein, 25 aa, Mycobacterium
EWLITDPNLLPPRPMHLCLQLDYFG

SEQ ID NO: 1315738 - protein, 17 aa, Mycobacterium
EWLLDGHRAWVRISAAA

SEQ ID NO: 1315739 - protein, 26 aa, Mycobacterium
EWMAELVEFVKARGIKLIVFDTQRKA

SEQ ID NO: 1315740 - protein, 26 aa, Mycobacterium
EWMGPLIEAMGLTIGWITADSTAAER

SEQ ID NO: 1315741 - protein, 25 aa, Mycobacterium
EWNAGLLYLRGRLEELFLEDIRKGV

SEQ ID NO: 1315742 - protein, 17 aa, Mycobacterium
EWPTGVPAICFACGYPT

SEQ ID NO: 1315743 - protein, 19 aa, Mycobacterium
EWPWPEKRLSYANAVLVEA

SEQ ID NO: 1315744 - protein, 26 aa, Mycobacterium
EWQGYDWHWADRRILDMLIGGPELAL

SEQ ID NO: 1315745 - protein, 27 aa, Mycobacterium
EWQVVEIIADPFRFTRTLQALEAERLP

SEQ ID NO: 1315746 - protein, 20 aa, Mycobacterium
EWRRGSLPPGRLGWRKAQEI

SEQ ID NO: 1315747 - protein, 17 aa, Mycobacterium
EWTDHPVIVSLVRAIER

SEQ ID NO: 1315748 - protein, 25 aa, Mycobacterium
EWTSSPLRPWPGFTPMVYERYSQPF

SEQ ID NO: 1315749 - protein, 21 aa, Mycobacterium
EWVPQMFGSVDDPKVAAFCSS

SEQ ID NO: 1315750 - protein, 18 aa, Mycobacterium
EWWDRAVEVWPDYADYQK

SEQ ID NO: 1315751 - protein, 19 aa, Mycobacterium
EWWDRAVEVWPDYADYQKK

SEQ ID NO: 1315752 - protein, 18 aa, Mycobacterium
EYAAPTYAYLVSDLANHI

SEQ ID NO: 1315753 - protein, 48 aa, Mycobacterium
EYAKAWFKLLHRDMGPVQRYLGPLVPTQTWLWQDIVPAGKPLSDADVA

SEQ ID NO: 1315754 - protein, 25 aa, Mycobacterium
EYARDVWRLRRLGVTGVPGGWRLDF

SEQ ID NO: 1315755 - protein, 23 aa, Mycobacterium
EYATPQFMFPGYDAEAPTRDQFD

SEQ ID NO: 1315756 - protein, 27 aa, Mycobacterium
EYELYAHKLAAQLFGIPADAIAALANG

SEQ ID NO: 1315757 - protein, 34 aa, Mycobacterium
EYEPYGTVLIIGAWNFPFALTLGPAVGAIAAGNT

SEQ ID NO: 1315758 - protein, 25 aa, Mycobacterium
EYERIREILGRRPTDAELAMYSVMW

SEQ ID NO: 1315759 - protein, 24 aa, Mycobacterium
EYEVARLWRDSRVQRLYAGTTEIM

SEQ ID NO: 1315760 - protein, 20 aa, Mycobacterium
EYFGFIWTYLGESPVPELPR

SEQ ID NO: 1315761 - protein, 18 aa, Mycobacterium
EYGFSRGGFAAAPVVVVV

SEQ ID NO: 1315762 - protein, 24 aa, Mycobacterium
EYGRRVLLVDLDPQGALSAGLGVP

SEQ ID NO: 1315763 - protein, 19 aa, Mycobacterium
EYIRRNSSKVLLLTATPYN

SEQ ID NO: 1315764 - protein, 25 aa, Mycobacterium
EYKKLVLAMLQRREAWQIVDVVNKI

SEQ ID NO: 1315765 - protein, 20 aa, Mycobacterium
EYKQFLTEIGYLEPDPGDFT

SEQ ID NO: 1315766 - protein, 28 aa, Mycobacterium
EYKRQHLMVLHIIALYHRLKTNPGLSIP

SEQ ID NO: 1315767 - protein, 18 aa, Mycobacterium
EYLLLGLRFDRVEEGYVD

SEQ ID NO: 1315768 - protein, 21 aa, Mycobacterium
EYLRNFVFEKPPWGKRGYNEK

SEQ ID NO: 1315769 - protein, 23 aa, Mycobacterium
EYLRRELLDLSAWAWDEFLTANG

SEQ ID NO: 1315770 - protein, 18 aa, Mycobacterium
EYLWGVLSVADDFEPLWA

SEQ ID NO: 1315771 - protein, 23 aa, Mycobacterium
EYMADHTSWIRREPIGVIGQVAP

SEQ ID NO: 1315772 - protein, 18 aa, Mycobacterium
EYNAARYRISVFYDLVKC

SEQ ID NO: 1315773 - protein, 30 aa, Mycobacterium
EYPLRHVADLPPRRARAQAWPHWADPDVVR

SEQ ID NO: 1315774 - protein, 17 aa, Mycobacterium
EYPSMDPLANVAGMMRA

SEQ ID NO: 1315775 - protein, 22 aa, Mycobacterium
EYQDNLFMLSLSRGGPTMWMSP

SEQ ID NO: 1315776 - protein, 31 aa, Mycobacterium
EYRSAAALCRYLWLTRGLTGILEVTRSGDRY

SEQ ID NO: 1315777 - protein, 21 aa, Mycobacterium
EYVDTLEWIHGILRQRGYEAD

SEQ ID NO: 1315778 - protein, 22 aa, Mycobacterium
EYVDTLEWIHGILRQRGYEADR

SEQ ID NO: 1315779 - protein, 20 aa, Mycobacterium
EYVFPHLRQAILDAYRRAGC

SEQ ID NO: 1315780 - protein, 17 aa, Mycobacterium
EYVIRRAMSQMGVPYSW

SEQ ID NO: 1315781 - protein, 34 aa, Mycobacterium
EYVPKLMEIQGNGPYILAGWSLGGALAYACAVGL

SEQ ID NO: 1315782 - protein, 21 aa, Mycobacterium
EYWPKLDAMYPDFANYRSYTD

SEQ ID NO: 1315783 - protein, 17 aa, Mycobacterium
FAAAKVGAPLITGNTLV

SEQ ID NO: 1315784 - protein, 19 aa, Mycobacterium
FAAARITAIGMGMIALRAP

SEQ ID NO: 1315785 - protein, 19 aa, Mycobacterium
FAACCVYILVGYEQATIPP

SEQ ID NO: 1315786 - protein, 26 aa, Mycobacterium
FAADDLVASLLLVHGLHPHGTEHRVN

SEQ ID NO: 1315787 - protein, 20 aa, Mycobacterium
FAAFVGASLDYKNAERLPVE

SEQ ID NO: 1315788 - protein, 19 aa, Mycobacterium
FAAGFPHGLFALHREQAPV

SEQ ID NO: 1315789 - protein, 19 aa, Mycobacterium
FAAHLGVRGWIKTFTEAAV

SEQ ID NO: 1315790 - protein, 23 aa, Mycobacterium
FAAHPAAVTWLPQPEHWAEHSVE

SEQ ID NO: 1315791 - protein, 19 aa, Mycobacterium
FAALLIYRLGRLPSDRSSI

SEQ ID NO: 1315792 - protein, 18 aa, Mycobacterium
FAALSLDPPLVLFCPTKA

SEQ ID NO: 1315793 - protein, 18 aa, Mycobacterium
FAALTPITRKVVAAGDIP

SEQ ID NO: 1315794 - protein, 26 aa, Mycobacterium
FAARPGLLASFPFPHLLTLDVTLLDR

SEQ ID NO: 1315795 - protein, 18 aa, Mycobacterium
FAASMYMNGPSRALPLAR

SEQ ID NO: 1315796 - protein, 19 aa, Mycobacterium
FAAVGRLLQRHTGPIFPLI

SEQ ID NO: 1315797 - protein, 24 aa, Mycobacterium
FAAVWRARRVLAVTWPDGYPVDTE

SEQ ID NO: 1315798 - protein, 18 aa, Mycobacterium
FAAWHRSGADHLPIVLGL

SEQ ID NO: 1315799 - protein, 27 aa, Mycobacterium
FACDHWGVVPDIYLLGKALGGGVLPLS

SEQ ID NO: 1315800 - protein, 19 aa, Mycobacterium
FADARRYLSMLCAGDNESL

SEQ ID NO: 1315801 - protein, 17 aa, Mycobacterium
FADEFNIPFVPLDTLTE

SEQ ID NO: 1315802 - protein, 17 aa, Mycobacterium
FADLPDFPFAPHYVEVD

SEQ ID NO: 1315803 - protein, 24 aa, Mycobacterium
FAEADLYGPRWAMVRAFNAANDID

SEQ ID NO: 1315804 - protein, 18 aa, Mycobacterium
FAEGMRSLVLYTASWQDE

SEQ ID NO: 1315805 - protein, 20 aa, Mycobacterium
FAEHFELGIKDLVPMAYAEA

SEQ ID NO: 1315806 - protein, 26 aa, Mycobacterium
FAEMIETWIEMAWQDGSFGWVGIANL

SEQ ID NO: 1315807 - protein, 31 aa, Mycobacterium
FAEREGVNLTYLPFIARAVIDALKIHPNVNA

SEQ ID NO: 1315808 - protein, 18 aa, Mycobacterium
FAETMWPVVAKAIDFVLE

SEQ ID NO: 1315809 - protein, 20 aa, Mycobacterium
FAEWLAVTYGDDGIGVTCVC

SEQ ID NO: 1315810 - protein, 21 aa, Mycobacterium
FAEYWNEICSLPIALITSLVK

SEQ ID NO: 1315811 - protein, 18 aa, Mycobacterium
FAFAGVGVLLPRWSGDQY

SEQ ID NO: 1315812 - protein, 27 aa, Mycobacterium
FAGCRGEVPLGTLIELLASFHGVDADA

SEQ ID NO: 1315813 - protein, 26 aa, Mycobacterium
FAGDGGLWLAILSPAALARVDAIAAA

SEQ ID NO: 1315814 - protein, 25 aa, Mycobacterium
FAGGDIAGFLEWTKGLPVPDLYEAL

SEQ ID NO: 1315815 - protein, 18 aa, Mycobacterium
FAGGLAFYHNVDAGWEVL

SEQ ID NO: 1315816 - protein, 26 aa, Mycobacterium
FAGIHGAFVVTNYWAPLPPDAQRSRA

SEQ ID NO: 1315817 - protein, 22 aa, Mycobacterium
FAGILGMAVAWFEEAVVQATAI

SEQ ID NO: 1315818 - protein, 21 aa, Mycobacterium
FAGLHQLCAPLLTHLDELPDP

SEQ ID NO: 1315819 - protein, 25 aa, Mycobacterium
FAGLHQLCAPLLTHLDELPSPQRDA

SEQ ID NO: 1315820 - protein, 20 aa, Mycobacterium
FAGMRLVIGDALHSLTDLGT

SEQ ID NO: 1315821 - protein, 31 aa, Mycobacterium
FAGRASIVNFLPLLAERFARQRLRALAKVEG

SEQ ID NO: 1315822 - protein, 30 aa, Mycobacterium
FAGRATIVNFLPLLAERFARQRLHALARVE

SEQ ID NO: 1315823 - protein, 17 aa, Mycobacterium
FAGVVRPKSRGHLALRS

SEQ ID NO: 1315824 - protein, 27 aa, Mycobacterium
FAHGLLRDHLIAGIPPLRRQRLHAKIA

SEQ ID NO: 1315825 - protein, 28 aa, Mycobacterium
FAHGLLRDHLIAGIPPLRRQRLHAKIAD

SEQ ID NO: 1315826 - protein, 17 aa, Mycobacterium
FAIAIRTALIRNGTAYV

SEQ ID NO: 1315827 - protein, 17 aa, Mycobacterium
FAKHLEGYIHEQGWQTY

SEQ ID NO: 1315828 - protein, 26 aa, Mycobacterium
FAKTSWNLRKFLWAPQFGMYGIQRIH

SEQ ID NO: 1315829 - protein, 17 aa, Mycobacterium
FALAAPLGALLEAGARL

SEQ ID NO: 1315830 - protein, 18 aa, Mycobacterium
FALDRADARDEIAHLAAA

SEQ ID NO: 1315831 - protein, 18 aa, Mycobacterium
FALKNPVLYRIAMMGPGS

SEQ ID NO: 1315832 - protein, 21 aa, Mycobacterium
FALSREPIDRAWYDELAAVSA

SEQ ID NO: 1315833 - protein, 18 aa, Mycobacterium
FANIRLRNQLLDDVSGGY

SEQ ID NO: 1315834 - protein, 20 aa, Mycobacterium
FAPGFAYLVGGDERLAVPRR

SEQ ID NO: 1315835 - protein, 24 aa, Mycobacterium
FAPKKFRRQVAPAYLRRNQEDVLT

SEQ ID NO: 1315836 - protein, 20 aa, Mycobacterium
FAPSRLPWERIEPLAGLVEE

SEQ ID NO: 1315837 - protein, 25 aa, Mycobacterium
FAQAVLDAGLIWIGPSPQSIRDLGD

SEQ ID NO: 1315838 - protein, 22 aa, Mycobacterium
FAQAYEQIMLLRSAVGMAAPQA

SEQ ID NO: 1315839 - protein, 18 aa, Mycobacterium
FAQDVRTVLPPALSIRNG

SEQ ID NO: 1315840 - protein, 18 aa, Mycobacterium
FAQKLGWNGIPITSSYAA

SEQ ID NO: 1315841 - protein, 19 aa, Mycobacterium
FAQKLGWNGIPITSSYAAC

SEQ ID NO: 1315842 - protein, 25 aa, Mycobacterium
FAQLPGLQRLALDRVLLRAGGDGPP

SEQ ID NO: 1315843 - protein, 19 aa, Mycobacterium
FARDETDLRALLRSGADDA

SEQ ID NO: 1315844 - protein, 19 aa, Mycobacterium
FARERSRWIFSNPDMIHLS

SEQ ID NO: 1315845 - protein, 17 aa, Mycobacterium
FARLLPTSIELAEAHFD

SEQ ID NO: 1315846 - protein, 20 aa, Mycobacterium
FARRAANRVVFMSDGAIVED

SEQ ID NO: 1315847 - protein, 18 aa, Mycobacterium
FARRGVRSVVLPSSATFA

SEQ ID NO: 1315848 - protein, 17 aa, Mycobacterium
FARRHRVPIAEQPHFSA

SEQ ID NO: 1315849 - protein, 23 aa, Mycobacterium
FARTRRCVLFFDEFDTIAKERSD

SEQ ID NO: 1315850 - protein, 20 aa, Mycobacterium
FARTYGMPPAAYRASMPPAA

SEQ ID NO: 1315851 - protein, 19 aa, Mycobacterium
FASAAWRKLLVNAVVGLMV

SEQ ID NO: 1315852 - protein, 25 aa, Mycobacterium
FASGTADGLTAWLLLSCRALHEGAR

SEQ ID NO: 1315853 - protein, 42 aa, Mycobacterium
FASPDAPAQVPWFDALLAWVRRQITHTFFNKTPVYGPITVEQ

SEQ ID NO: 1315854 - protein, 32 aa, Mycobacterium
FATIPTTYLRTTLFFENFANAFPPRRGDDGAL

SEQ ID NO: 1315855 - protein, 17 aa, Mycobacterium
FATMKHAAAYWRAQSKA

SEQ ID NO: 1315856 - protein, 22 aa, Mycobacterium
FATMKPYAPPPPPGANPPPLWG

SEQ ID NO: 1315857 - protein, 27 aa, Mycobacterium
FATNHLGHFQLTNGLLPALRAADGARV

SEQ ID NO: 1315858 - protein, 25 aa, Mycobacterium
FATQEHLKEVSLLFDAVGGVLTVAE

SEQ ID NO: 1315859 - protein, 18 aa, Mycobacterium
FATRRPRIDPFAVEMLHG

SEQ ID NO: 1315860 - protein, 18 aa, Mycobacterium
FATSFRLSGRLFRIRPQE

SEQ ID NO: 1315861 - protein, 25 aa, Mycobacterium
FATSLRRLEFLPNSPTLMNAGSDLG

SEQ ID NO: 1315862 - protein, 28 aa, Mycobacterium
FATTSMNAWANLRLARQMFARVPDPVAR

SEQ ID NO: 1315863 - protein, 25 aa, Mycobacterium
FATTSMNVWANLRLVRQMISRTPRL

SEQ ID NO: 1315864 - protein, 20 aa, Mycobacterium
FAVHPGIVATSLARHMTNDD

SEQ ID NO: 1315865 - protein, 18 aa, Mycobacterium
FAVLMALHLPEQGPSVLA

SEQ ID NO: 1315866 - protein, 20 aa, Mycobacterium
FAVNIVNAWWVPDLERSGIG

SEQ ID NO: 1315867 - protein, 19 aa, Mycobacterium
FAWHIDLAKRTGKPLMIHN

SEQ ID NO: 1315868 - protein, 37 aa, Mycobacterium
FAWVDNMHDWCISRQLWWGHRIPIWHGPNGETVCVGP

SEQ ID NO: 1315869 - protein, 17 aa, Mycobacterium
FAYGSFSRSLPLPDGAD

SEQ ID NO: 1315870 - protein, 18 aa, Mycobacterium
FCAFHRRYLELLELSATG

SEQ ID NO: 1315871 - protein, 17 aa, Mycobacterium
FCAGGDLKDFASAPSRG

SEQ ID NO: 1315872 - protein, 17 aa, Mycobacterium
FCDFLAGKTDRLIREME

SEQ ID NO: 1315873 - protein, 17 aa, Mycobacterium
FCEKFLRTPKGTGAREV

SEQ ID NO: 1315874 - protein, 17 aa, Mycobacterium
FCGCANAFGAEPNTQVC

SEQ ID NO: 1315875 - protein, 24 aa, Mycobacterium
FDAALVDVILPMVDGLPARLRSGV

SEQ ID NO: 1315876 - protein, 28 aa, Mycobacterium
FDADAVSLAVMPLFHMAGSGWALAGLWQ

SEQ ID NO: 1315877 - protein, 19 aa, Mycobacterium
FDAMPPRERNYARWMFTSE

SEQ ID NO: 1315878 - protein, 24 aa, Mycobacterium
FDANLPTGILPAGGPFTEAGARTW

SEQ ID NO: 1315879 - protein, 18 aa, Mycobacterium
FDAPRRAMPPRHFADLDE

SEQ ID NO: 1315880 - protein, 25 aa, Mycobacterium
FDAPTQLAYLAARTKSLELATGVLP

SEQ ID NO: 1315881 - protein, 26 aa, Mycobacterium
FDARFSALRRHYLYRLSTAPYGVEPA

SEQ ID NO: 1315882 - protein, 26 aa, Mycobacterium
FDASRPVFGFAPYPGVQPGDPARVTL

SEQ ID NO: 1315883 - protein, 37 aa, Mycobacterium
FDATLKALDFDYVDLFLIHWPLPTLYDGDFVSTWKTL

SEQ ID NO: 1315884 - protein, 30 aa, Mycobacterium
FDDAALAREFLLTWFVYTAWELADAKRLTG

SEQ ID NO: 1315885 - protein, 20 aa, Mycobacterium
FDDDGLWFIDGREDDMVISG

SEQ ID NO: 1315886 - protein, 27 aa, Mycobacterium
FDDFNAEYVKWFKGPLPSRTCVGTTGL

SEQ ID NO: 1315887 - protein, 18 aa, Mycobacterium
FDDGLRMSPFKIVERGEL

SEQ ID NO: 1315888 - protein, 24 aa, Mycobacterium
FDDGRPFVLTDTVGFVRHLPTQLV

SEQ ID NO: 1315889 - protein, 18 aa, Mycobacterium
FDDLLAPVFAVLDGFPAY

SEQ ID NO: 1315890 - protein, 18 aa, Mycobacterium
FDDPFTFDIMRDPNPHVG

SEQ ID NO: 1315891 - protein, 18 aa, Mycobacterium
FDDRPELPRIIRAGRHLA

SEQ ID NO: 1315892 - protein, 26 aa, Mycobacterium
FDDYNEIVISCPLLLTLPAVGTYPIE

SEQ ID NO: 1315893 - protein, 28 aa, Mycobacterium
FDEIFGLNVKGYLLGARAALAELRETRG

SEQ ID NO: 1315894 - protein, 21 aa, Mycobacterium
FDEVNPIAAFGLGSEPGLVSP

SEQ ID NO: 1315895 - protein, 17 aa, Mycobacterium
FDEVPVRTPGTLAFAPI

SEQ ID NO: 1315896 - protein, 18 aa, Mycobacterium
FDFDIRIQLGAGAYICGE

SEQ ID NO: 1315897 - protein, 18 aa, Mycobacterium
FDGILAAYLIRNVEDPDS

SEQ ID NO: 1315898 - protein, 19 aa, Mycobacterium
FDGLRLAGRPVRRPDLTIA

SEQ ID NO: 1315899 - protein, 20 aa, Mycobacterium
FDGLRLANRPVRRPDLTIAT

SEQ ID NO: 1315900 - protein, 27 aa, Mycobacterium
FDGTDTVMLVWLGQRRIPGIESGRTLK

SEQ ID NO: 1315901 - protein, 17 aa, Mycobacterium
FDGVDVALLIGARPRTK

SEQ ID NO: 1315902 - protein, 19 aa, Mycobacterium
FDGYKWLRELGYEPDQIVL

SEQ ID NO: 1315903 - protein, 28 aa, Mycobacterium
FDIDLLAGRLVDVTLWLAGRPDLAVLPV

SEQ ID NO: 1315904 - protein, 42 aa, Mycobacterium
FDIDTDVIVSWLPCFHDMGMTGYLTVPMYFGAELVKVTPMDF

SEQ ID NO: 1315905 - protein, 18 aa, Mycobacterium
FDIDWTLDPDCRIVLPVL

SEQ ID NO: 1315906 - protein, 20 aa, Mycobacterium
FDIFRPDNEHFGWGSGIHTC

SEQ ID NO: 1315907 - protein, 17 aa, Mycobacterium
FDIGFLRAAAEQCGLTW

SEQ ID NO: 1315908 - protein, 21 aa, Mycobacterium
FDKFPPFPFNVVFAMLRGQVS

SEQ ID NO: 1315909 - protein, 19 aa, Mycobacterium
FDKPVPRDVLMECLDIALQ

SEQ ID NO: 1315910 - protein, 26 aa, Mycobacterium
FDLAVFALSFHHLPPQLAARAIAEGA

SEQ ID NO: 1315911 - protein, 21 aa, Mycobacterium
FDLEPERPIFHGLLGEVDAAS

SEQ ID NO: 1315912 - protein, 36 aa, Mycobacterium
FDMIFTTDRPIIFAYHGYPWLIHRLTYRRAGHANLH

SEQ ID NO: 1315913 - protein, 30 aa, Mycobacterium
FDMVTRRYWWHAWWWVPQAILRGGVEKVHA

SEQ ID NO: 1315914 - protein, 30 aa, Mycobacterium
FDNYYIENWSLLLDVKILILTVLAVVRPTE

SEQ ID NO: 1315915 - protein, 24 aa, Mycobacterium
FDPKDPSLGSPVVAWLASPEAGHI

SEQ ID NO: 1315916 - protein, 23 aa, Mycobacterium
FDPVVIRWRLEVGDRTAQLVSLS

SEQ ID NO: 1315917 - protein, 19 aa, Mycobacterium
FDQITRLPEYYPTRAEAQI

SEQ ID NO: 1315918 - protein, 18 aa, Mycobacterium
FDQVEFSALVASSNGAKR

SEQ ID NO: 1315919 - protein, 25 aa, Mycobacterium
FDRARPLWKITLIEGLPEGEAAVLC

SEQ ID NO: 1315920 - protein, 17 aa, Mycobacterium
FDRAVLFRVHEGRMVME

SEQ ID NO: 1315921 - protein, 45 aa, Mycobacterium
FDRIPAVVLRRMAWYWARIWIEVTPVRVLWWPGGNLDHRPQLWEP

SEQ ID NO: 1315922 - protein, 18 aa, Mycobacterium
FDRLEITTCLRRGELEIV

SEQ ID NO: 1315923 - protein, 33 aa, Mycobacterium
FDRLVAINIGGVYWAVRSAIRYLSEGARIINIG

SEQ ID NO: 1315924 - protein, 23 aa, Mycobacterium
FDRPFDFDILRDPNPHLAFGGNG

SEQ ID NO: 1315925 - protein, 24 aa, Mycobacterium
FDSEHPLFLLYTSGTTGKPKGIMH

SEQ ID NO: 1315926 - protein, 17 aa, Mycobacterium
FDSLLVYENFPPGGLVG

SEQ ID NO: 1315927 - protein, 21 aa, Mycobacterium
FDSPLSLVTPQLARLAAMGGF

SEQ ID NO: 1315928 - protein, 24 aa, Mycobacterium
FDSVAQLELLLPAVAGLVSTLRFD

SEQ ID NO: 1315929 - protein, 21 aa, Mycobacterium
FDSVFVMDHFYQLPGLGTPDQ

SEQ ID NO: 1315930 - protein, 26 aa, Mycobacterium
FDTIARLWDHIGDTGIGFCLDTCHAW

SEQ ID NO: 1315931 - protein, 18 aa, Mycobacterium
FDTVVLGLTLALFRTATA

SEQ ID NO: 1315932 - protein, 25 aa, Mycobacterium
FDVALWNPLRRYLEGRGVRFHTGVS

SEQ ID NO: 1315933 - protein, 20 aa, Mycobacterium
FDVDWRLHGFDDAALRELVE

SEQ ID NO: 1315934 - protein, 22 aa, Mycobacterium
FDVDWRLHGFDDAALRELVEMT

SEQ ID NO: 1315935 - protein, 20 aa, Mycobacterium
FDVDWRLHGFDDAGLRELVE

SEQ ID NO: 1315936 - protein, 19 aa, Mycobacterium
FDVMVSRFGVMFFDDPTTA

SEQ ID NO: 1315937 - protein, 26 aa, Mycobacterium
FDVNVKGVFLLTRALVPLLEAAATEQ

SEQ ID NO: 1315938 - protein, 20 aa, Mycobacterium
FDVNVRGTWLTVQKAAPLLN

SEQ ID NO: 1315939 - protein, 17 aa, Mycobacterium
FDYLSSLEWIRAQQNLA

SEQ ID NO: 1315940 - protein, 18 aa, Mycobacterium
FEAGIGFTVPLKSKSDDF

SEQ ID NO: 1315941 - protein, 18 aa, Mycobacterium
FEALAGFRPVARTVDLMR

SEQ ID NO: 1315942 - protein, 21 aa, Mycobacterium
FEDIPSGWRNLPAGFQHKSYQ

SEQ ID NO: 1315943 - protein, 18 aa, Mycobacterium
FEDPFKFDIARNPNPHIA

SEQ ID NO: 1315944 - protein, 26 aa, Mycobacterium
FEELFHRHHRQLYRLAQLTSRDPDDA

SEQ ID NO: 1315945 - protein, 26 aa, Mycobacterium
FEENDDVWLPLFRPTAETETAPLPED

SEQ ID NO: 1315946 - protein, 18 aa, Mycobacterium
FEFGFDPRGGFGFGPGPR

SEQ ID NO: 1315947 - protein, 19 aa, Mycobacterium
FEFGFDPRGGFGFGPGPRG

SEQ ID NO: 1315948 - protein, 17 aa, Mycobacterium
FEFLVSKGRALMPSLFD

SEQ ID NO: 1315949 - protein, 18 aa, Mycobacterium
FEFYADHAAALLADQRIP

SEQ ID NO: 1315950 - protein, 20 aa, Mycobacterium
FEGPFDVFTPLVLASTVKGL

SEQ ID NO: 1315951 - protein, 22 aa, Mycobacterium
FEGRDISHIISWLSTLGEVDSV

SEQ ID NO: 1315952 - protein, 19 aa, Mycobacterium
FEGSRRYLQAAAAAGLRRA

SEQ ID NO: 1315953 - protein, 21 aa, Mycobacterium
FEHGLGWFTVVDDTLIMVPMP

SEQ ID NO: 1315954 - protein, 24 aa, Mycobacterium
FEIADLGIVGDLFKVTPQLTEAVK

SEQ ID NO: 1315955 - protein, 18 aa, Mycobacterium
FEIGPIRTLVEHGTMVIC

SEQ ID NO: 1315956 - protein, 17 aa, Mycobacterium
FEILGPLPRKNIDTGMG

SEQ ID NO: 1315957 - protein, 29 aa, Mycobacterium
FEKMLYDNAQLLRVYAHWARRTGNPLAHR

SEQ ID NO: 1315958 - protein, 25 aa, Mycobacterium
FELGMDSMMSVVLQRALLATLGVEV

SEQ ID NO: 1315959 - protein, 26 aa, Mycobacterium
FELHARAILGLPVDTTLKSPGASAVI

SEQ ID NO: 1315960 - protein, 17 aa, Mycobacterium
FELLPQDDQVFGFTADE

SEQ ID NO: 1315961 - protein, 27 aa, Mycobacterium
FELRLGDAWVWDMYRPARFVKQVRVIT

SEQ ID NO: 1315962 - protein, 30 aa, Mycobacterium
FELSGSFVSYFGWLYEWGAPVTLIGESPDQ

SEQ ID NO: 1315963 - protein, 24 aa, Mycobacterium
FENSPWLPDLVGKAFCASFAATRR

SEQ ID NO: 1315964 - protein, 32 aa, Mycobacterium; identical to SEQ ID NO: 812101

SEQ ID NO: 1315965 - protein, 19 aa, Mycobacterium
FEPGVAQHVRLIPLGGARE

SEQ ID NO: 1315966 - protein, 30 aa, Mycobacterium
FEPNDDALWAKLRRTISAFLVNEWRKGALF

SEQ ID NO: 1315967 - protein, 17 aa, Mycobacterium
FEQFPNLHQLFWDGVHG

SEQ ID NO: 1315968 - protein, 23 aa, Mycobacterium
FEQHRRWDKVLFDADLSVISWPE

SEQ ID NO: 1315969 - protein, 19 aa, Mycobacterium
FEQSAQDVFYLLTQPDYVG

SEQ ID NO: 1315970 - protein, 19 aa, Mycobacterium
FERLQRELSNAPDNDRLNG

SEQ ID NO: 1315971 - protein, 21 aa, Mycobacterium
FERMPALKFVWADGAADMLTP

SEQ ID NO: 1315972 - protein, 33 aa, Mycobacterium
FERSGPERILSTGPLLFAAIRALGAGPAPDDRT

SEQ ID NO: 1315973 - protein, 26 aa, Mycobacterium
FERSGPERLLSTFPLLAATAESMAQH

SEQ ID NO: 1315974 - protein, 21 aa, Mycobacterium
FERYRLPYNALTQTDLHSVDL

SEQ ID NO: 1315975 - protein, 28 aa, Mycobacterium
FESGWTFDHFYPIFSDPSGPCLEGWVTL

SEQ ID NO: 1315976 - protein, 26 aa, Mycobacterium
FESYAAQFQFATPTLPLVCNRTGTVL

SEQ ID NO: 1315977 - protein, 23 aa, Mycobacterium
FESYALYPPMSVRENLLYGLKAR

SEQ ID NO: 1315978 - protein, 24 aa, Mycobacterium
FETARTTLLLGQLQRRQRRKEAAA

SEQ ID NO: 1315979 - protein, 24 aa, Mycobacterium
FETLEPMMRITLNTILRAVFGAEG

SEQ ID NO: 1315980 - protein, 20 aa, Mycobacterium
FEVADRICALYLGRVAAEVK

SEQ ID NO: 1315981 - protein, 17 aa, Mycobacterium
FEVELVVVLAQSVSHPG

SEQ ID NO: 1315982 - protein, 18 aa, Mycobacterium
FEVFTGASRYLAPDGRDG

SEQ ID NO: 1315983 - protein, 18 aa, Mycobacterium
FEWLIGAEDWFQRAADRG

SEQ ID NO: 1315984 - protein, 19 aa, Mycobacterium
FEYEFWLFQDREDPRRPLG

SEQ ID NO: 1315985 - protein, 21 aa, Mycobacterium
FFAAPILIENLAREALARNLT

SEQ ID NO: 1315986 - protein, 26 aa, Mycobacterium
FFAAVKAGMIAVPLFAPELPGHAERL

SEQ ID NO: 1315987 - protein, 18 aa, Mycobacterium
FFARLWTAMSGHETEEMR

SEQ ID NO: 1315988 - protein, 19 aa, Mycobacterium
FFDAFRAIKPYLITSGNQP

SEQ ID NO: 1315989 - protein, 17 aa, Mycobacterium
FFDFDGIKNLFDISGKR

SEQ ID NO: 1315990 - protein, 25 aa, Mycobacterium
FFDNPAQWELFKRERPETAIDEIIR

SEQ ID NO: 1315991 - protein, 18 aa, Mycobacterium
FFDNVLKPMLGGGAGAAG

SEQ ID NO: 1315992 - protein, 19 aa, Mycobacterium
FFEQFFALPDSDRWTYLTA

SEQ ID NO: 1315993 - protein, 17 aa, Mycobacterium
FFGHHLWAETRIELFTQ

SEQ ID NO: 1315994 - protein, 36 aa, Mycobacterium
FFGMSALYRMYPAVDGYVFLAAPLPREWPALAKALS

SEQ ID NO: 1315995 - protein, 21 aa, Mycobacterium
FFGTSWPKEYGGQDLPPVYDV

SEQ ID NO: 1315996 - protein, 30 aa, Mycobacterium
FFLAFDEDSGRLLGFHWTKVHSATLGEVYV

SEQ ID NO: 1315997 - protein, 27 aa, Mycobacterium
FFLVPPERIHTWVFAGLRAATTAEPVR

SEQ ID NO: 1315998 - protein, 18 aa, Mycobacterium
FFNYIAKRDDLLPEFTNI

SEQ ID NO: 1315999 - protein, 24 aa, Mycobacterium
FFTRSEAVLGIWRSLLPAEEWVAV

SEQ ID NO: 1316000 - protein, 17 aa, Mycobacterium
FFVDYVRTYTDLPFLVK

SEQ ID NO: 1316001 - protein, 18 aa, Mycobacterium
FGAALRRLTPQALEFHLE

SEQ ID NO: 1316002 - protein, 24 aa, Mycobacterium
FGADRLIDYIDYTTTPLAVEGQPF

SEQ ID NO: 1316003 - protein, 17 aa, Mycobacterium
FGAFAERVVADAAGLTP

SEQ ID NO: 1316004 - protein, 25 aa, Mycobacterium
FGAFVEYRPAEAAHWLAAGIEAAYR

SEQ ID NO: 1316005 - protein, 25 aa, Mycobacterium
FGAGLVAAPLIRPLMRHAAGRLWRD

SEQ ID NO: 1316006 - protein, 17 aa, Mycobacterium
FGAIYLPGVKALVQGDT

SEQ ID NO: 1316007 - protein, 19 aa, Mycobacterium
FGALPKAEFLAFFVAAIKA

SEQ ID NO: 1316008 - protein, 19 aa, Mycobacterium
FGCLPEVYVLAIRGFEFGL

SEQ ID NO: 1316009 - protein, 19 aa, Mycobacterium
FGCVWINTHIPLVAEMPHG

SEQ ID NO: 1316010 - protein, 18 aa, Mycobacterium
FGDIEGFGFLDPPDARSI

SEQ ID NO: 1316011 - protein, 18 aa, Mycobacterium
FGDLVAMEAYRRSLLEQA

SEQ ID NO: 1316012 - protein, 25 aa, Mycobacterium
FGDMPNDVPMLGWAGLGVAMGNAHP

SEQ ID NO: 1316013 - protein, 24 aa, Mycobacterium
FGDPQGRAIFWLHGTPGARRQIPV

SEQ ID NO: 1316014 - protein, 27 aa, Mycobacterium
FGDRDVGLLLVIGRLIAGAMHQARLHR

SEQ ID NO: 1316015 - protein, 17 aa, Mycobacterium
FGEAGVAAPPLPPAPGG

SEQ ID NO: 1316016 - protein, 17 aa, Mycobacterium
FGELLGGGRRPTVQDRQ

SEQ ID NO: 1316017 - protein, 20 aa, Mycobacterium
FGEPIPVTSLLGFGSGMLLG

SEQ ID NO: 1316018 - protein, 21 aa, Mycobacterium
FGETLPFLVKVLAADEPLSLQ

SEQ ID NO: 1316019 - protein, 23 aa, Mycobacterium
FGEVAFPKPLFHGDTLYAETEVV

SEQ ID NO: 1316020 - protein, 19 aa, Mycobacterium
FGEVLRRAGLPAPRFGMAT

SEQ ID NO: 1316021 - protein, 41 aa, Mycobacterium
FGFDRFRQTLARRLHLLEPLRYQLVDIPGRMHHPMWLENCD

SEQ ID NO: 1316022 - protein, 17 aa, Mycobacterium
FGFIAPDGGAPDVFVHY

SEQ ID NO: 1316023 - protein, 17 aa, Mycobacterium
FGFIEMFEHGYRVLMAI

SEQ ID NO: 1316024 - protein, 17 aa, Mycobacterium
FGFLTPALSVHNDIVGP

SEQ ID NO: 1316025 - protein, 25 aa, Mycobacterium
FGGCTSWVDLPVHPAWEPPVHDDAT

SEQ ID NO: 1316026 - protein, 21 aa, Mycobacterium
FGGIGVCQLIAGLYNGRRIAM

SEQ ID NO: 1316027 - protein, 24 aa, Mycobacterium
FGGQKFIPEVLPKVGIVRRLVDSG

SEQ ID NO: 1316028 - protein, 18 aa, Mycobacterium
FGGRGLATILVGEALEAT

SEQ ID NO: 1316029 - protein, 30 aa, Mycobacterium
FGGTIAHGLLTLSLLPYFTHQLYTVDNVAM

SEQ ID NO: 1316030 - protein, 24 aa, Mycobacterium
FGGYMANWIAGHTDRFAAIVTHAS

SEQ ID NO: 1316031 - protein, 25 aa, Mycobacterium
FGIEYPLFVFTPSEKVAAAVSKAGG

SEQ ID NO: 1316032 - protein, 27 aa, Mycobacterium
FGIMGLPFAGGHYLALRQFPATTFAPA

SEQ ID NO: 1316033 - protein, 19 aa, Mycobacterium
FGIPVDSPGLTTIWARIFA

SEQ ID NO: 1316034 - protein, 17 aa, Mycobacterium
FGKTMILPALRADTRIQ

SEQ ID NO: 1316035 - protein, 27 aa, Mycobacterium
FGLAPLREVFSLLREVRRWGPQDRVRE

SEQ ID NO: 1316036 - protein, 26 aa, Mycobacterium
FGLDAGEFMTLLSQGLEGGARDTDKV

SEQ ID NO: 1316037 - protein, 20 aa, Mycobacterium
FGLGYVLRNMIDIPVSRAQP

SEQ ID NO: 1316038 - protein, 25 aa, Mycobacterium
FGLRRGGLTFARLTRDHPHGAVIAP

SEQ ID NO: 1316039 - protein, 17 aa, Mycobacterium
FGLSVVLAHQYLEQLDA

SEQ ID NO: 1316040 - protein, 29 aa, Mycobacterium
FGNEIGDLPFLYQPGMLSAAWGVGVRQLA

SEQ ID NO: 1316041 - protein, 34 aa, Mycobacterium; identical to SEQ ID NO: 120047

SEQ ID NO: 1316042 - protein, 19 aa, Mycobacterium
FGPAYMINWLHNDLAPDFT

SEQ ID NO: 1316043 - protein, 21 aa, Mycobacterium
FGPYDVVLANPPYVPVPDADG

SEQ ID NO: 1316044 - protein, 21 aa, Mycobacterium
FGRLDSLTGERLYIGRIGVLD

SEQ ID NO: 1316045 - protein, 17 aa, Mycobacterium
FGSIVPCGIRDAGVTSL

SEQ ID NO: 1316046 - protein, 29 aa, Mycobacterium
FGSSNPRLDIPRLLDLYGSGRLKLDELIT

SEQ ID NO: 1316047 - protein, 19 aa, Mycobacterium
FGTLSLWQGVDVPGPSLSL

SEQ ID NO: 1316048 - protein, 24 aa, Mycobacterium
FGTTDTWVLWNLTGGHRGGVHVTD

SEQ ID NO: 1316049 - protein, 18 aa, Mycobacterium
FGVAKPVIAMLHLSALPG

SEQ ID NO: 1316050 - protein, 17 aa, Mycobacterium
FGVALPEEHGGADGTVS

SEQ ID NO: 1316051 - protein, 19 aa, Mycobacterium
FGVDEVMVHPVASAFRGVD

SEQ ID NO: 1316052 - protein, 18 aa, Mycobacterium
FGVFQDPTRKYSCAYFTG

SEQ ID NO: 1316053 - protein, 31 aa, Mycobacterium
FGVITAIPQPLRWVARSRGLRLARAQAAAVR

SEQ ID NO: 1316054 - protein, 19 aa, Mycobacterium
FGVNRFGWAPTVQLTAYLR

SEQ ID NO: 1316055 - protein, 19 aa, Mycobacterium
FGVPQWLLDQFRTTSPGAI

SEQ ID NO: 1316056 - protein, 19 aa, Mycobacterium
FGVVSQNLSWTHYWETGSA

SEQ ID NO: 1316057 - protein, 24 aa, Mycobacterium
FGWGPRDLRKLVLTETPLSPGGRF

SEQ ID NO: 1316058 - protein, 35 aa, Mycobacterium
FGYNSPEWIVAVFALLLQGAVPVLGNRWWSPAEVA

SEQ ID NO: 1316059 - protein, 18 aa, Mycobacterium
FGYRRFTVTPRRGELLVF

SEQ ID NO: 1316060 - protein, 31 aa, Mycobacterium
FHAAARRQLSYFWPRVVGTTDWQLMDSKFAV

SEQ ID NO: 1316061 - protein, 18 aa, Mycobacterium
FHLRDLAVTFRFGEEVTG

SEQ ID NO: 1316062 - protein, 18 aa, Mycobacterium
FHMVAPDPNGKRAGYAMS

SEQ ID NO: 1316063 - protein, 22 aa, Mycobacterium
FHPPPTFLNHRLSPARSFAGAT

SEQ ID NO: 1316064 - protein, 22 aa, Mycobacterium
FHPRIVLAGCPALPEGDGDDDG

SEQ ID NO: 1316065 - protein, 22 aa, Mycobacterium
FHPTMEDYFDAKARLFDPACAT

SEQ ID NO: 1316066 - protein, 22 aa, Mycobacterium
FHPTRLTVDLFRAARNALTTLE

SEQ ID NO: 1316067 - protein, 29 aa, Mycobacterium
FHRTRTPLSTWFAAIWLVTSQKNGASAKN

SEQ ID NO: 1316068 - protein, 23 aa, Mycobacterium
FHSDRLAPFCAALADLCGKDMVL

SEQ ID NO: 1316069 - protein, 17 aa, Mycobacterium
FHYYRLSADNRIVWGGY

SEQ ID NO: 1316070 - protein, 19 aa, Mycobacterium
FIANLGLTNVRYAVTSHTG

SEQ ID NO: 1316071 - protein, 23 aa, Mycobacterium
FIAPMPRLLDDGSAWVEELRRLE

SEQ ID NO: 1316072 - protein, 18 aa, Mycobacterium
FICGPAPFMKSARSAIEG

SEQ ID NO: 1316073 - protein, 22 aa, Mycobacterium
FIDDRPYLLTSRSPADRGTKIL

SEQ ID NO: 1316074 - protein, 27 aa, Mycobacterium
FIDEVTLMALNYLRPWPTPPEDCFGSP

SEQ ID NO: 1316075 - protein, 26 aa, Mycobacterium
FIDGGELFIVGRIKDLLIIRGRNHYP

SEQ ID NO: 1316076 - protein, 32 aa, Mycobacterium; identical to SEQ ID NO: 812590

SEQ ID NO: 1316077 - protein, 24 aa, Mycobacterium
FIDSLKWKLLGKKVSAYAVDYPAS

SEQ ID NO: 1316078 - protein, 20 aa, Mycobacterium
FIEHDGQGYRLIFENDYVTE

SEQ ID NO: 1316079 - protein, 21 aa, Mycobacterium
FIEHDSQGYRLIFENDYTSEP

SEQ ID NO: 1316080 - protein, 24 aa, Mycobacterium
FIGEGGTVFCCRFGLALHGGREED

SEQ ID NO: 1316081 - protein, 18 aa, Mycobacterium
FIGISLPEEFGGGGAGMA

SEQ ID NO: 1316082 - protein, 24 aa, Mycobacterium
FIKGFAGPFTLRVIADLLGVPEED

SEQ ID NO: 1316083 - protein, 20 aa, Mycobacterium
FIKKALTGEGLPLMRCAGQG

SEQ ID NO: 1316084 - protein, 18 aa, Mycobacterium
FILFGEFADAPATWQRYL

SEQ ID NO: 1316085 - protein, 18 aa, Mycobacterium
FILFGEFADAPATWRRYL

SEQ ID NO: 1316086 - protein, 19 aa, Mycobacterium
FILFGEFADAPATWRRYLD

SEQ ID NO: 1316087 - protein, 27 aa, Mycobacterium
FIMGDCDQLMPPYLRFVKGVVDAQDMS

SEQ ID NO: 1316088 - protein, 31 aa, Mycobacterium
FINTADADVLPYLRWFTFLSADELVELEQAT

SEQ ID NO: 1316089 - protein, 19 aa, Mycobacterium
FIRDAFTEAFRQLGGRIDT

SEQ ID NO: 1316090 - protein, 19 aa, Mycobacterium
FITPLPYGTGVDWLRNVQA

SEQ ID NO: 1316091 - protein, 18 aa, Mycobacterium
FKALTRRGPHRVLRGDLG

SEQ ID NO: 1316092 - protein, 21 aa, Mycobacterium
FKDAELLGVPWIVVVGRGWAD

SEQ ID NO: 1316093 - protein, 19 aa, Mycobacterium
FKDFLALHFSQTRPPVEES

SEQ ID NO: 1316094 - protein, 18 aa, Mycobacterium
FKDRYKLQRFGRGGFVSA

SEQ ID NO: 1316095 - protein, 22 aa, Mycobacterium
FKIAMVFDEPFWRADGLSGQSF

SEQ ID NO: 1316096 - protein, 17 aa, Mycobacterium
FKLAWDLVGSEFAGRHV

SEQ ID NO: 1316097 - protein, 17 aa, Mycobacterium
FKLKPVGFFDGNPALDL

SEQ ID NO: 1316098 - protein, 23 aa, Mycobacterium
FKRHNQIDRPCLLGYIDKCSAPC

SEQ ID NO: 1316099 - protein, 31 aa, Mycobacterium
FKVGDRVLVRDLPVLFYTRTPEYVRGATGEI

SEQ ID NO: 1316100 - protein, 18 aa, Mycobacterium
FKVIEYARMMVGTKAMST

SEQ ID NO: 1316101 - protein, 27 aa, Mycobacterium
FLADYRAHWLVARTAEHIGGWSRRPLP

SEQ ID NO: 1316102 - protein, 19 aa, Mycobacterium
FLAERAYDVHLLNLTNSGL

SEQ ID NO: 1316103 - protein, 20 aa, Mycobacterium
FLAKAFSVLTTPRTPREVTA

SEQ ID NO: 1316104 - protein, 18 aa, Mycobacterium
FLAKQLGVPQPEPLRRYK

SEQ ID NO: 1316105 - protein, 26 aa, Mycobacterium
FLARNRLYYTWFRSDEPRGAQLLEAA

SEQ ID NO: 1316106 - protein, 17 aa, Mycobacterium
FLATLTQFAPLVGDRYD

SEQ ID NO: 1316107 - protein, 18 aa, Mycobacterium
FLDALRQALPGKAIEAGI

SEQ ID NO: 1316108 - protein, 17 aa, Mycobacterium
FLDLCRDFEQLHLDTTM

SEQ ID NO: 1316109 - protein, 18 aa, Mycobacterium
FLDLWEEGAPYNPLALTN

SEQ ID NO: 1316110 - protein, 18 aa, Mycobacterium
FLDMVRRRGRIRMEALPE

SEQ ID NO: 1316111 - protein, 26 aa, Mycobacterium
FLDPHTRELYLDWPRKARAVVGNLRH

SEQ ID NO: 1316112 - protein, 26 aa, Mycobacterium
FLEAAMDIFPMARRVLLTAYADTHAA

SEQ ID NO: 1316113 - protein, 24 aa, Mycobacterium
FLEHSRIIHFRAIDEYWIGSADMM

SEQ ID NO: 1316114 - protein, 25 aa, Mycobacterium
FLEKPSRWMRALAENPHAWSSAPNF

SEQ ID NO: 1316115 - protein, 21 aa, Mycobacterium
FLERFVLNPRHIEVQVLADAH

SEQ ID NO: 1316116 - protein, 24 aa, Mycobacterium
FLERRLRETFGFEGSPIRINVRVR

SEQ ID NO: 1316117 - protein, 17 aa, Mycobacterium
FLFALAEQDFDTFESLA

SEQ ID NO: 1316118 - protein, 18 aa, Mycobacterium
FLGAIQAGFIAVPLSMPQ

SEQ ID NO: 1316119 - protein, 28 aa, Mycobacterium
FLGEDRLLRLRWPCPIPGAMPVSEVGNA

SEQ ID NO: 1316120 - protein, 20 aa, Mycobacterium
FLGEVPIAHQYASRIHRHAT

SEQ ID NO: 1316121 - protein, 28 aa, Mycobacterium
FLGLGVDGFPNLFLVSGPGAPAVLANMV

SEQ ID NO: 1316122 - protein, 18 aa, Mycobacterium
FLGPFALTNLMFGRVRSK

SEQ ID NO: 1316123 - protein, 26 aa, Mycobacterium
FLGPKGHKVWKPVIAALHGIVAGGAM

SEQ ID NO: 1316124 - protein, 18 aa, Mycobacterium
FLKPGIPEWRYPFEGRMH

SEQ ID NO: 1316125 - protein, 27 aa, Mycobacterium
FLLDGRPVILTAPRRAPAAPARTASGS

SEQ ID NO: 1316126 - protein, 23 aa, Mycobacterium
FLNRAFDQMLMDVALHKLPVTVV

SEQ ID NO: 1316127 - protein, 17 aa, Mycobacterium
FLPASLVEMRRVRDLQP

SEQ ID NO: 1316128 - protein, 20 aa, Mycobacterium
FLPMHMLCLRDMGLMLGEYW

SEQ ID NO: 1316129 - protein, 17 aa, Mycobacterium
FLPTMHGFDEFFGNLYH

SEQ ID NO: 1316130 - protein, 20 aa, Mycobacterium
FLQEQWAELEPLLASGAVAA

SEQ ID NO: 1316131 - protein, 19 aa, Mycobacterium
FLQWRDLTCRFPGCDAPVE

SEQ ID NO: 1316132 - protein, 32 aa, Mycobacterium
FLQYYRESANWLERTYKWVPRVGIEHIRAVIV

SEQ ID NO: 1316133 - protein, 22 aa, Mycobacterium
FLRMEAEWESGYLLTVRSAWQA

SEQ ID NO: 1316134 - protein, 23 aa, Mycobacterium
FLRQLQAILKVRSHYGIATSRQI

SEQ ID NO: 1316135 - protein, 26 aa, Mycobacterium
FLRQYDFLSQIFNYEDLSLEKLSIYL

SEQ ID NO: 1316136 - protein, 20 aa, Mycobacterium
FLRSLRAWDAARRASASTAE

SEQ ID NO: 1316137 - protein, 25 aa, Mycobacterium
FLSELMTVFADGPVVIGPTAPTLGA

SEQ ID NO: 1316138 - protein, 17 aa, Mycobacterium
FLSLAEHLEIILAAKEL

SEQ ID NO: 1316139 - protein, 17 aa, Mycobacterium
FLTQPPIAPWGDVDVFI

SEQ ID NO: 1316140 - protein, 17 aa, Mycobacterium
FLTYETFGRRFFEIAVT

SEQ ID NO: 1316141 - protein, 20 aa, Mycobacterium
FLVEPGWRLEPTAQGAVWFL

SEQ ID NO: 1316142 - protein, 17 aa, Mycobacterium
FLVSAPNLVPILHRYRE

SEQ ID NO: 1316143 - protein, 20 aa, Mycobacterium
FLVTSGFWQKLPQMSLERYP

SEQ ID NO: 1316144 - protein, 25 aa, Mycobacterium
FLVVGLNRYRLLDDGYRGFLTLVAG

SEQ ID NO: 1316145 - protein, 39 aa, Mycobacterium
FMAADDAGRYLLIEEGPILPPDLLVGRKGLDPETVATIQ

SEQ ID NO: 1316146 - protein, 26 aa, Mycobacterium
FMADHVFSRIDIPGWLARTGFQMLDP

SEQ ID NO: 1316147 - protein, 41 aa, Mycobacterium
FMAKVPYYRVLELAPWLSWPRPNFPVSNFFHGGAAPLNAIL

SEQ ID NO: 1316148 - protein, 18 aa, Mycobacterium
FMEVLSQGTRFKPGKAKD

SEQ ID NO: 1316149 - protein, 19 aa, Mycobacterium
FMHDVVVYSLLHGGVDSPR

SEQ ID NO: 1316150 - protein, 25 aa, Mycobacterium
FMKNPEFAAAILPTLRGLKAIANYT

SEQ ID NO: 1316151 - protein, 17 aa, Mycobacterium
FNAAIAGLVPGFNAFAE

SEQ ID NO: 1316152 - protein, 20 aa, Mycobacterium
FNAIYQRWHGGELDLAMPGG

SEQ ID NO: 1316153 - protein, 17 aa, Mycobacterium
FNAKPALREVADASLSH

SEQ ID NO: 1316154 - protein, 17 aa, Mycobacterium
FNAKPALREVADASLSY

SEQ ID NO: 1316155 - protein, 20 aa, Mycobacterium
FNAPIALEPLPYTVARVADP

SEQ ID NO: 1316156 - protein, 30 aa, Mycobacterium
FNDAPLHVTTLAWLSLGPTGSNAQAEDRHT

SEQ ID NO: 1316157 - protein, 29 aa, Mycobacterium
FNEQLGGEAIRFPELRAVLTYVTPSPVSR

SEQ ID NO: 1316158 - protein, 17 aa, Mycobacterium
FNGDKGFGFIAPDGGAP

SEQ ID NO: 1316159 - protein, 28 aa, Mycobacterium
FNGLVSLVLSLPVLRQLYIGLSEAFAPA

SEQ ID NO: 1316160 - protein, 25 aa, Mycobacterium
FNGNPILCDLILIRSALSPRAAKLG

SEQ ID NO: 1316161 - protein, 34 aa, Mycobacterium
FNHASGRIKLAWFLLHVARYLPPLLYATDPSWGT

SEQ ID NO: 1316162 - protein, 23 aa, Mycobacterium
FNNELGHPWTVLRATRSTDYLVL

SEQ ID NO: 1316163 - protein, 22 aa, Mycobacterium
FNRLRLIERILERLPSKPPLLE

SEQ ID NO: 1316164 - protein, 20 aa, Mycobacterium
FNRPGRKAAKLRMPVLLCVC

SEQ ID NO: 1316165 - protein, 23 aa, Mycobacterium
FNSSIFTEQVWFLGDALNADLDE

SEQ ID NO: 1316166 - protein, 25 aa, Mycobacterium
FNTVRVFLHDLLWATDRAGFSQRLT

SEQ ID NO: 1316167 - protein, 19 aa, Mycobacterium
FNTVWSGPETLPLPTEVDE

SEQ ID NO: 1316168 - protein, 26 aa, Mycobacterium
FNVVAGTTWLFSNALMRNAPVDVLLI

SEQ ID NO: 1316169 - protein, 18 aa, Mycobacterium
FPAFLDALRQALPGKAIE

SEQ ID NO: 1316170 - protein, 26 aa, Mycobacterium
FPASVLAVLRRLEGHFTLVFAHADDP

SEQ ID NO: 1316171 - protein, 21 aa, Mycobacterium
FPDIEFSALVASPNGAKRAIA

SEQ ID NO: 1316172 - protein, 26 aa, Mycobacterium
FPDRIGRLEALPGWAWNTFDAQWDRG

SEQ ID NO: 1316173 - protein, 26 aa, Mycobacterium
FPEAGDPWTPLKLYYNHGFLRQRMQV

SEQ ID NO: 1316174 - protein, 22 aa, Mycobacterium
FPEVLRLCMWAQLERPEATDEP

SEQ ID NO: 1316175 - protein, 31 aa, Mycobacterium
FPGAQMMFDLPPSWFAWWARQGMRTSLRYKV

SEQ ID NO: 1316176 - protein, 25 aa, Mycobacterium
FPKNRGMRIDFILGSPALAERVVHA

SEQ ID NO: 1316177 - protein, 24 aa, Mycobacterium
FPLPSVLEVRGEVFFRIADFEDLN

SEQ ID NO: 1316178 - protein, 19 aa, Mycobacterium
FPLQVEPLFDVHPKVRRSA

SEQ ID NO: 1316179 - protein, 17 aa, Mycobacterium
FPLRAIIGAPMVFGGGR

SEQ ID NO: 1316180 - protein, 27 aa, Mycobacterium
FPNIELDIMMVPLPGLFDLPRLAALGL

SEQ ID NO: 1316181 - protein, 19 aa, Mycobacterium
FPNLSFLNVLIGRDKKSMP

SEQ ID NO: 1316182 - protein, 24 aa, Mycobacterium
FPPAPAEAMFRWLSNKDGQNKVMN

SEQ ID NO: 1316183 - protein, 23 aa, Mycobacterium
FPRKLIEHLGAAGVFRSKWGPAG

SEQ ID NO: 1316184 - protein, 17 aa, Mycobacterium
FPRPDPAPPDESSSAAA

SEQ ID NO: 1316185 - protein, 18 aa, Mycobacterium
FPSLNPATGEVLGYAPDA

SEQ ID NO: 1316186 - protein, 17 aa, Mycobacterium
FPTLNYATTVVEACDRA

SEQ ID NO: 1316187 - protein, 18 aa, Mycobacterium
FPTVAFPNPEEPGASDLL

SEQ ID NO: 1316188 - protein, 20 aa, Mycobacterium
FPVPALTHLEGPYLELVRDA

SEQ ID NO: 1316189 - protein, 19 aa, Mycobacterium
FPVWQTQIAVQRRDARSPK

SEQ ID NO: 1316190 - protein, 17 aa, Mycobacterium
FPVWQTQIAVQRRDSRS

SEQ ID NO: 1316191 - protein, 18 aa, Mycobacterium
FQAIAIRADLTRPAINHY

SEQ ID NO: 1316192 - protein, 20 aa, Mycobacterium
FQALGFGRQFGGLPEAPPPE

SEQ ID NO: 1316193 - protein, 19 aa, Mycobacterium
FQDLVAEGTVYRVPGRGSY

SEQ ID NO: 1316194 - protein, 23 aa, Mycobacterium
FQEPRLFPWRDVRTNVVYGLTRA

SEQ ID NO: 1316195 - protein, 25 aa, Mycobacterium
FQEYFRVHQPPLLVTWGRNDEIFGA

SEQ ID NO: 1316196 - protein, 22 aa, Mycobacterium
FQFQVFLDEVRLPADALVGSED

SEQ ID NO: 1316197 - protein, 25 aa, Mycobacterium
FQGKSSVRTWLYRIATNTCLTALDG

SEQ ID NO: 1316198 - protein, 19 aa, Mycobacterium
FQHGLRVILAGLRSCHTET

SEQ ID NO: 1316199 - protein, 17 aa, Mycobacterium
FQPKYIFAAIDAGCAAV

SEQ ID NO: 1316200 - protein, 19 aa, Mycobacterium
FQQLTQPLQQMSSLFGQMG

SEQ ID NO: 1316201 - protein, 17 aa, Mycobacterium
FQQPCYLGVTARHQRKT

SEQ ID NO: 1316202 - protein, 27 aa, Mycobacterium
FQRLGVQPPRGVLLYGPPGCGKTFVVR

SEQ ID NO: 1316203 - protein, 27 aa, Mycobacterium
FQSDQGMFMVNWPYVLAAARSAAEEGT

SEQ ID NO: 1316204 - protein, 26 aa, Mycobacterium
FQSGLSWLIILRKRDNFRAAFDGFEV

SEQ ID NO: 1316205 - protein, 19 aa, Mycobacterium
FQTGFDQPLLVAMYVDKRL

SEQ ID NO: 1316206 - protein, 32 aa, Mycobacterium
FQTIWDGVTPVKLLNWLSSDRLWFAVDGAHPT

SEQ ID NO: 1316207 - protein, 23 aa, Mycobacterium
FQYYTVFSAMLALAEGGLTLVDV

SEQ ID NO: 1316208 - protein, 31 aa, Mycobacterium
FRAASRLPFFTAWLRDHRWLPDARYRAGLLT

SEQ ID NO: 1316209 - protein, 19 aa, Mycobacterium
FRAHSMFDPELYRDKAEVE

SEQ ID NO: 1316210 - protein, 27 aa, Mycobacterium
FRAKALQERLIRQSPVPYTIVHATQFY

SEQ ID NO: 1316211 - protein, 17 aa, Mycobacterium
FRASYGSGSLVVGVCAE

SEQ ID NO: 1316212 - protein, 24 aa, Mycobacterium
FRDIYRLGVITIPPNRPVVRRDEV

SEQ ID NO: 1316213 - protein, 18 aa, Mycobacterium
FRDPWTFDVRRHPNPHVG

SEQ ID NO: 1316214 - protein, 20 aa, Mycobacterium
FRDRIRALLAEHLPPDWSGG

SEQ ID NO: 1316215 - protein, 17 aa, Mycobacterium
FRDVLAPAWQQATGGAL

SEQ ID NO: 1316216 - protein, 25 aa, Mycobacterium
FREDMAALRVLPPRDYVAATEAIAE

SEQ ID NO: 1316217 - protein, 17 aa, Mycobacterium
FREWYRLRNPMTVLREA

SEQ ID NO: 1316218 - protein, 24 aa, Mycobacterium
FRFNEVIHYWALEGDWDCFENHYP

SEQ ID NO: 1316219 - protein, 21 aa, Mycobacterium
FRGDFYRIHDFTLKPKPANTA

SEQ ID NO: 1316220 - protein, 30 aa, Mycobacterium
FRGLPQTPPLNALAFALRSPTFRLRDLVRL

SEQ ID NO: 1316221 - protein, 18 aa, Mycobacterium
FRGPLSTVIHQLVGGLRA

SEQ ID NO: 1316222 - protein, 17 aa, Mycobacterium
FRHDSAVSSWLYRIVVN

SEQ ID NO: 1316223 - protein, 18 aa, Mycobacterium
FRKRAERVLATRPSLRGK

SEQ ID NO: 1316224 - protein, 17 aa, Mycobacterium
FRLRPDAWAMLYTGQNQ

SEQ ID NO: 1316225 - protein, 25 aa, Mycobacterium
FRLSGRLFRIRPQEAKLLLANGSSL

SEQ ID NO: 1316226 - protein, 18 aa, Mycobacterium
FRMRSICDRIAGFPGPVL

SEQ ID NO: 1316227 - protein, 25 aa, Mycobacterium
FRNLVGYLRPDLILDANEFAPKKFR

SEQ ID NO: 1316228 - protein, 24 aa, Mycobacterium
FRNPDGHWWAGYIEGFHQPGDADT

SEQ ID NO: 1316229 - protein, 17 aa, Mycobacterium
FRPLAKTGIYYARSWRE

SEQ ID NO: 1316230 - protein, 18 aa, Mycobacterium
FRQLLSGRDYAAGDMIAQ

SEQ ID NO: 1316231 - protein, 33 aa, Mycobacterium
FRQNWMSTEFNLLYRWHSLIPTKVRVGGQRRPF

SEQ ID NO: 1316232 - protein, 22 aa, Mycobacterium
FRRAFSWLPAQFASQSNAPVGA

SEQ ID NO: 1316233 - protein, 22 aa, Mycobacterium
FRRAFSWLPSQLASQSDDPVGP

SEQ ID NO: 1316234 - protein, 20 aa, Mycobacterium
FRREFAPRILVCGAAFKGDP

SEQ ID NO: 1316235 - protein, 17 aa, Mycobacterium
FRRFAGCPICHLHLRSF

SEQ ID NO: 1316236 - protein, 19 aa, Mycobacterium
FRRLVAEAKALWRSENHRG

SEQ ID NO: 1316237 - protein, 17 aa, Mycobacterium
FRRVIASPKPKRIFEIG

SEQ ID NO: 1316238 - protein, 18 aa, Mycobacterium
FRRYVVGGHLPIPKVPFA

SEQ ID NO: 1316239 - protein, 25 aa, Mycobacterium
FRSESWPAPVPARMLPRYAQRFLGY

SEQ ID NO: 1316240 - protein, 21 aa, Mycobacterium
FRSVLFFPVTPMTPSGAVDLD

SEQ ID NO: 1316241 - protein, 18 aa, Mycobacterium
FRTPLTLILDPVSELRRA

SEQ ID NO: 1316242 - protein, 21 aa, Mycobacterium
FRVDQASLLLTTPPGGLKAIT

SEQ ID NO: 1316243 - protein, 30 aa, Mycobacterium
FRVVVAIFIADFVPRVWAGCEALGLGKPGW

SEQ ID NO: 1316244 - protein, 21 aa, Mycobacterium
FRWDHAIAFARWALGDACPTD

SEQ ID NO: 1316245 - protein, 19 aa, Mycobacterium
FRYDIERLSAYYSVSYETT

SEQ ID NO: 1316246 - protein, 17 aa, Mycobacterium
FRYYVRDAPIITDAEFD

SEQ ID NO: 1316247 - protein, 18 aa, Mycobacterium
FSARTREDVVLAMLVDTI

SEQ ID NO: 1316248 - protein, 22 aa, Mycobacterium
FSASALHGARWIDPGRPATVID

SEQ ID NO: 1316249 - protein, 24 aa, Mycobacterium
FSASQFIPDVRRFGATYANYVGKP

SEQ ID NO: 1316250 - protein, 27 aa, Mycobacterium
FSEAVEPWSYMKFPFLKDLGREEGSVR

SEQ ID NO: 1316251 - protein, 19 aa, Mycobacterium
FSELYRDHPFIRVPEVIAE

SEQ ID NO: 1316252 - protein, 20 aa, Mycobacterium
FSEWGTVFPDPRLVAAIVDR

SEQ ID NO: 1316253 - protein, 17 aa, Mycobacterium
FSFAGTPARRLGTAGWD

SEQ ID NO: 1316254 - protein, 23 aa, Mycobacterium
FSFEPLELPDELDWLAIQRSGLL

SEQ ID NO: 1316255 - protein, 24 aa, Mycobacterium
FSGDRVLILASLIDSRIGFFTVAG

SEQ ID NO: 1316256 - protein, 30 aa, Mycobacterium
FSGRIVLIGGDRRLPYDKPPLSKQFLAGQW

SEQ ID NO: 1316257 - protein, 29 aa, Mycobacterium
FSGYPHLEELFWFGEGVVPILRDRGLFTA

SEQ ID NO: 1316258 - protein, 34 aa, Mycobacterium
FSLMNVLGQHRLLFLTWLPLSAHLLYVGKLSRHD

SEQ ID NO: 1316259 - protein, 20 aa, Mycobacterium
FSLTVPRRDGGARRLYLIET

SEQ ID NO: 1316260 - protein, 19 aa, Mycobacterium
FSLTVPRRDGGERRLYLVE

SEQ ID NO: 1316261 - protein, 25 aa, Mycobacterium
FSRHETLLAAGARLFRAQGYPAVST

SEQ ID NO: 1316262 - protein, 25 aa, Mycobacterium
FSRPGVHYLSGFYGPLERALRDAGA

SEQ ID NO: 1316263 - protein, 40 aa, Mycobacterium
FSSAILPAWARKSPQMTEVLPLLYLHGLSTSDFGPALEQF

SEQ ID NO: 1316264 - protein, 26 aa, Mycobacterium
FSTAAPLDRRLLLEVLADLPPGCGAD

SEQ ID NO: 1316265 - protein, 22 aa, Mycobacterium
FSTQAFYKWRKAPLTQRDWDDA

SEQ ID NO: 1316266 - protein, 25 aa, Mycobacterium
FSTTELFLERLGLTSLTDLPDIAPL

SEQ ID NO: 1316267 - protein, 18 aa, Mycobacterium
FSVPPTVKVLLAALPADL

SEQ ID NO: 1316268 - protein, 19 aa, Mycobacterium
FSVTLMFAAVPTPAVAFAV

SEQ ID NO: 1316269 - protein, 20 aa, Mycobacterium
FSVYFPVDVITQMLGVPEKY

SEQ ID NO: 1316270 - protein, 25 aa, Mycobacterium
FSYSHVLSILAFIKGLGRHTHFYTA

SEQ ID NO: 1316271 - protein, 19 aa, Mycobacterium
FTALIDAMSTFRAALGADS

SEQ ID NO: 1316272 - protein, 23 aa, Mycobacterium
FTAPEIFPNGLGNKYTFGPMTEV

SEQ ID NO: 1316273 - protein, 25 aa, Mycobacterium
FTASLALELEFFGLRAKLVQPGYGP

SEQ ID NO: 1316274 - protein, 27 aa, Mycobacterium
FTDDPAKLALPQWYAENGQFVTTKFFG

SEQ ID NO: 1316275 - protein, 19 aa, Mycobacterium
FTDPDGNWWEIVAVRENGY

SEQ ID NO: 1316276 - protein, 20 aa, Mycobacterium
FTDPYSFGILRDPNPHVGFG

SEQ ID NO: 1316277 - protein, 20 aa, Mycobacterium
FTDTPIYLRSTALRSRREGA

SEQ ID NO: 1316278 - protein, 25 aa, Mycobacterium
FTECRLRPLTLVEVDFTLAVLAGVD

SEQ ID NO: 1316279 - protein, 20 aa, Mycobacterium
FTEDLVMWWNFVGRSHEDIA

SEQ ID NO: 1316280 - protein, 32 aa, Mycobacterium
FTEQVGIPLRRYVLWLRLRLAIICAHAGDDLT

SEQ ID NO: 1316281 - protein, 25 aa, Mycobacterium
FTGAEPWVMVKGFRIKIDGCVGESF

SEQ ID NO: 1316282 - protein, 24 aa, Mycobacterium
FTGGLEMALGCDFLIASHRAVFAD

SEQ ID NO: 1316283 - protein, 25 aa, Mycobacterium
FTGGLEMALGCDFLIASHRAVFADT

SEQ ID NO: 1316284 - protein, 25 aa, Mycobacterium
FTGKRATVSLFWPLSSTNGAKLASL

SEQ ID NO: 1316285 - protein, 25 aa, Mycobacterium
FTGSLALELGFFGVRAKLVEPGYGP

SEQ ID NO: 1316286 - protein, 17 aa, Mycobacterium
FTGVTLWMDPGSDTYVV

SEQ ID NO: 1316287 - protein, 21 aa, Mycobacterium
FTHLLGYAIVQAVKKFPNMNR

SEQ ID NO: 1316288 - protein, 19 aa, Mycobacterium
FTHPLLASGVYTDAGPTAR

SEQ ID NO: 1316289 - protein, 30 aa, Mycobacterium
FTLARGPVIRFLLIEAPQRWRFVVTAHHIL

SEQ ID NO: 1316290 - protein, 20 aa, Mycobacterium
FTLLGRCPELYVAILGALRN

SEQ ID NO: 1316291 - protein, 18 aa, Mycobacterium
FTNICYTGCRFCAFAQRK

SEQ ID NO: 1316292 - protein, 17 aa, Mycobacterium
FTPAFKLMLDNDATLFA

SEQ ID NO: 1316293 - protein, 28 aa, Mycobacterium
FTPGTNIQAWLFRIMQNRWINNFRRKQR

SEQ ID NO: 1316294 - protein, 25 aa, Mycobacterium
FTPRDLDADFLLWAAGSGITPVMSI

SEQ ID NO: 1316295 - protein, 17 aa, Mycobacterium
FTRIINRELPGRFVYED

SEQ ID NO: 1316296 - protein, 18 aa, Mycobacterium
FTRKTRFGFRMLDSRQGH

SEQ ID NO: 1316297 - protein, 25 aa, Mycobacterium
FTRPARLYGLAKLGYTQSYTYFTWR

SEQ ID NO: 1316298 - protein, 18 aa, Mycobacterium
FTRRITGWVGPVIRRYFR

SEQ ID NO: 1316299 - protein, 23 aa, Mycobacterium
FTRRLDLIVDFPVPDEAARLALW

SEQ ID NO: 1316300 - protein, 27 aa, Mycobacterium
FTSDPVFRQRYWARNHLGWRHMDQTQP

SEQ ID NO: 1316301 - protein, 29 aa, Mycobacterium
FTSMIFPTQYRLPDYYRWLLYDADHGPAY

SEQ ID NO: 1316302 - protein, 24 aa, Mycobacterium
FTSYVTPVLHRPNLDVLTCALVTR

SEQ ID NO: 1316303 - protein, 20 aa, Mycobacterium
FTTIALDRPGYGTSAVYAAE

SEQ ID NO: 1316304 - protein, 17 aa, Mycobacterium
FTTLAPNLGVVSAGEHT

SEQ ID NO: 1316305 - protein, 19 aa, Mycobacterium
FTVGRAVDWKLAATLGGKL

SEQ ID NO: 1316306 - protein, 21 aa, Mycobacterium
FTVIDAALPGLHGWVDERLAD

SEQ ID NO: 1316307 - protein, 26 aa, Mycobacterium
FTVNVVAPMLLTGRLASAMAARGSGS

SEQ ID NO: 1316308 - protein, 24 aa, Mycobacterium
FTVQKALPLLRTGGSIVLLGSVTA

SEQ ID NO: 1316309 - protein, 18 aa, Mycobacterium
FTVRAGSLVAWRAGENPH

SEQ ID NO: 1316310 - protein, 21 aa, Mycobacterium
FTVRLHAVLPPVAAAGTCLSL

SEQ ID NO: 1316311 - protein, 21 aa, Mycobacterium
FTVRMDLGGAPLFGPIGVAAV

SEQ ID NO: 1316312 - protein, 21 aa, Mycobacterium
FTVTGPKVRPYLGDVSAERAP

SEQ ID NO: 1316313 - protein, 20 aa, Mycobacterium
FTVVSLMSTAAVRELGLEPG

SEQ ID NO: 1316314 - protein, 27 aa, Mycobacterium
FTWEHDLHLLLRRIKVDEAFDGTVAEH

SEQ ID NO: 1316315 - protein, 27 aa, Mycobacterium
FTWEHDLHLYWRRATALAASLGPATRW

SEQ ID NO: 1316316 - protein, 25 aa, Mycobacterium
FTWEHDSHLYLRRARTLAALMADGV

SEQ ID NO: 1316317 - protein, 24 aa, Mycobacterium
FTWEHPAHLLLRRAQANAVLVGRA

SEQ ID NO: 1316318 - protein, 22 aa, Mycobacterium
FTYVRTHEPHWLLHAALAVGDS

SEQ ID NO: 1316319 - protein, 26 aa, Mycobacterium
FVAAFATLLPLRIIDNMLGVPREHEQ

SEQ ID NO: 1316320 - protein, 18 aa, Mycobacterium
FVAAPRFEFDHASLPGFT

SEQ ID NO: 1316321 - protein, 17 aa, Mycobacterium
FVAGLRETLYGNATALA

SEQ ID NO: 1316322 - protein, 21 aa, Mycobacterium
FVAGQRFCYVREPVGCTATAI

SEQ ID NO: 1316323 - protein, 26 aa, Mycobacterium
FVAGRPLIEVLLDLTQRIYTDFTYRS

SEQ ID NO: 1316324 - protein, 29 aa, Mycobacterium
FVAGRTQTYLPWDSWKKPYTEPPDPWFSD

SEQ ID NO: 1316325 - protein, 28 aa, Mycobacterium
FVDLDALPRLPRWLRPFAGFEARDHLWE

SEQ ID NO: 1316326 - protein, 29 aa, Mycobacterium
FVDLVSVKLPGRIFGSFFGLPPGELHEKT

SEQ ID NO: 1316327 - protein, 24 aa, Mycobacterium
FVEALPAIVWYLDEPVADPALVPL

SEQ ID NO: 1316328 - protein, 23 aa, Mycobacterium
FVEQIGRLVALRAELIDAPVLGE

SEQ ID NO: 1316329 - protein, 20 aa, Mycobacterium
FVERMAALVAPVFGTARQRQ

SEQ ID NO: 1316330 - protein, 26 aa, Mycobacterium
FVESDGELWALKELPPRIAGREYDVL

SEQ ID NO: 1316331 - protein, 21 aa, Mycobacterium
FVGCLTLVPQLPVLADGLAEV

SEQ ID NO: 1316332 - protein, 20 aa, Mycobacterium
FVGCRDRLPRLQRLAVYTGD

SEQ ID NO: 1316333 - protein, 19 aa, Mycobacterium
FVGYQLDRVFAPRLGVARS

SEQ ID NO: 1316334 - protein, 55 aa, Mycobacterium
FVHDVVTFGLYVLKAVLKPFGGLLAFTGLKVPFFTDGIPPFFLTPGLDVERSEFE

SEQ ID NO: 1316335 - protein, 17 aa, Mycobacterium
FVHPWQVLGSDRLQKYG

SEQ ID NO: 1316336 - protein, 20 aa, Mycobacterium
FVHQCPVFLIIDDQQWLDRA

SEQ ID NO: 1316337 - protein, 20 aa, Mycobacterium
FVHSVALAAVWRSCGIVPDL

SEQ ID NO: 1316338 - protein, 17 aa, Mycobacterium
FVHVFFDGRIIESGGPE

SEQ ID NO: 1316339 - protein, 27 aa, Mycobacterium
FVIDPLPNLLFTRDSSFWIGPRVAITS

SEQ ID NO: 1316340 - protein, 17 aa, Mycobacterium
FVIVINADKIALSGDKL

SEQ ID NO: 1316341 - protein, 25 aa, Mycobacterium
FVKEAWPVLRDVWLFRDRDSRTLVV

SEQ ID NO: 1316342 - protein, 21 aa, Mycobacterium
FVKSFLRLTTMIRKAATYPNG

SEQ ID NO: 1316343 - protein, 19 aa, Mycobacterium
FVLQPSNPLLMPREGRNPY

SEQ ID NO: 1316344 - protein, 19 aa, Mycobacterium
FVMANKEALGVDHAIWRQA

SEQ ID NO: 1316345 - protein, 18 aa, Mycobacterium
FVNLLDMGTEWKPSELTE

SEQ ID NO: 1316346 - protein, 21 aa, Mycobacterium
FVNSRPKPLAAYLFTKAKAVR

SEQ ID NO: 1316347 - protein, 26 aa, Mycobacterium
FVNTPPSHLFPVEFAKRAKALGEAAG

SEQ ID NO: 1316348 - protein, 18 aa, Mycobacterium
FVNWEGRIRPFEPALRTN

SEQ ID NO: 1316349 - protein, 22 aa, Mycobacterium
FVPESVPFVRGTLLDGALVEQA

SEQ ID NO: 1316350 - protein, 21 aa, Mycobacterium
FVPGDVALLSPPELPYSGRVC

SEQ ID NO: 1316351 - protein, 26 aa, Mycobacterium
FVPPDDEFWLTLAPTNRLVTARNRQQ

SEQ ID NO: 1316352 - protein, 18 aa, Mycobacterium
FVRALSRNGLQGSMGRVG

SEQ ID NO: 1316353 - protein, 22 aa, Mycobacterium
FVRDIAAPLPMAVIGDMLGVLP

SEQ ID NO: 1316354 - protein, 25 aa, Mycobacterium
FVRGVPVWSTLIALLVDGVPVVGVI

SEQ ID NO: 1316355 - protein, 17 aa, Mycobacterium
FVRPMLAGRFSGTMALS

SEQ ID NO: 1316356 - protein, 18 aa, Mycobacterium
FVRQRVPFFVDYVRQYTD

SEQ ID NO: 1316357 - protein, 20 aa, Mycobacterium
FVRRERLFATFLTPSEFANG

SEQ ID NO: 1316358 - protein, 18 aa, Mycobacterium
FVSQLGFAVAPRVRRALQ

SEQ ID NO: 1316359 - protein, 18 aa, Mycobacterium
FVTDLIDFGPGDRLCIPV

SEQ ID NO: 1316360 - protein, 25 aa, Mycobacterium
FVTRRHRLLQGWAYMQDGQLHAASA

SEQ ID NO: 1316361 - protein, 25 aa, Mycobacterium
FVTTKFFGMKANYYLHKHGISEETL

SEQ ID NO: 1316362 - protein, 18 aa, Mycobacterium
FVTTVYLPAMRDPYSAAK

SEQ ID NO: 1316363 - protein, 17 aa, Mycobacterium
FVTYDALPGIPVMEPPP

SEQ ID NO: 1316364 - protein, 18 aa, Mycobacterium
FVVCNEILPRWGVETVFV

SEQ ID NO: 1316365 - protein, 25 aa, Mycobacterium
FVVDEAEVVYWGLCPGCLAAEISRS

SEQ ID NO: 1316366 - protein, 27 aa, Mycobacterium
FVYVHAVPVFYGHYWRSGDPRHLHDWT

SEQ ID NO: 1316367 - protein, 17 aa, Mycobacterium
FWAKLEGFNPGGMKDRP

SEQ ID NO: 1316368 - protein, 26 aa, Mycobacterium
FWFDPLCPWAWITSRWVLEVEKVRDI

SEQ ID NO: 1316369 - protein, 20 aa, Mycobacterium
FWLWLDAGFEDRAIEAWILE

SEQ ID NO: 1316370 - protein, 17 aa, Mycobacterium
FWYNADAYMVSLLKEYW

SEQ ID NO: 1316371 - protein, 21 aa, Mycobacterium
FYALPQSPQLFKQLLMVAGME

SEQ ID NO: 1316372 - protein, 23 aa, Mycobacterium
FYDCFTITVLMQLEDYGFCARGE

SEQ ID NO: 1316373 - protein, 18 aa, Mycobacterium
FYDNFGSGDPVVVKNSIG

SEQ ID NO: 1316374 - protein, 17 aa, Mycobacterium
FYICGPGPFMDTVEGAL

SEQ ID NO: 1316375 - protein, 22 aa, Mycobacterium
FYQYHASLMEPWDGPAAVCFTD

SEQ ID NO: 1316376 - protein, 17 aa, Mycobacterium
FYTAAPIRFGTYVAKLS

SEQ ID NO: 1316377 - protein, 17 aa, Mycobacterium
FYVRTPSGFDIEYGWDA

SEQ ID NO: 1316378 - protein, 17 aa, Mycobacterium
GAAALWGLAQKTAMTYP

SEQ ID NO: 1316379 - protein, 26 aa, Mycobacterium
GAAARGDLLFWVAEYRRLPKLRAVQD

SEQ ID NO: 1316380 - protein, 25 aa, Mycobacterium
GAAARRLGLRPLARIHTTVAVGSDP

SEQ ID NO: 1316381 - protein, 30 aa, Mycobacterium
GAACWDARAWLRRPGLAHGASADLVCFADD

SEQ ID NO: 1316382 - protein, 25 aa, Mycobacterium
GAADAVTCYLDRTPPPPAAVVVPVA

SEQ ID NO: 1316383 - protein, 27 aa, Mycobacterium
GAADPFQLFRIMFEVIRGGGLDPKSGV

SEQ ID NO: 1316384 - protein, 27 aa, Mycobacterium
GAAEAVWAELARRLPEPWRVEALVLLA

SEQ ID NO: 1316385 - protein, 32 aa, Mycobacterium
GAAEFLQRLIDRERPFLVLTNNSIFTPRDLAA

SEQ ID NO: 1316386 - protein, 20 aa, Mycobacterium
GAAFGKLPFVLGGIELEAVG

SEQ ID NO: 1316387 - protein, 17 aa, Mycobacterium
GAAFQVHGGIAFTWEHD

SEQ ID NO: 1316388 - protein, 26 aa, Mycobacterium
GAAGGIYLPLLGATVSAKAARQLLSH

SEQ ID NO: 1316389 - protein, 17 aa, Mycobacterium
GAAGLGRAALGGGRLRA

SEQ ID NO: 1316390 - protein, 23 aa, Mycobacterium
GAAGLRMRMLSLVSAENLAEAGS

SEQ ID NO: 1316391 - protein, 27 aa, Mycobacterium
GAAIAPVAPLIFLAQPIQAALTQTLAN

SEQ ID NO: 1316392 - protein, 20 aa, Mycobacterium
GAAIVRLNDAFWSESRTRLD

SEQ ID NO: 1316393 - protein, 17 aa, Mycobacterium
GAAIVRLNEAYWSEAHA

SEQ ID NO: 1316394 - protein, 24 aa, Mycobacterium
GAAKAGIAALTLIAAEELERYGVR

SEQ ID NO: 1316395 - protein, 24 aa, Mycobacterium
GAAKAGITALTLSAARALGRFGVR

SEQ ID NO: 1316396 - protein, 28 aa, Mycobacterium
GAALATINRLPVLLLPSDTFATRVSSPV

SEQ ID NO: 1316397 - protein, 22 aa, Mycobacterium
GAALLLDTWALLGRQDLRAAED

SEQ ID NO: 1316398 - protein, 22 aa, Mycobacterium
GAALPGYDLLVQAVGGLMSVTG

SEQ ID NO: 1316399 - protein, 18 aa, Mycobacterium
GAAMLRVRMLDNLRVLRG

SEQ ID NO: 1316400 - protein, 18 aa, Mycobacterium
GAAPLLAAAHRPGRRFVS

SEQ ID NO: 1316401 - protein, 23 aa, Mycobacterium
GAAPWVMVSNFRIKIDGCVGQSF

SEQ ID NO: 1316402 - protein, 22 aa, Mycobacterium
GAAQLAADLGLPPGTPGADGKV

SEQ ID NO: 1316403 - protein, 25 aa, Mycobacterium
GAAREDGVLVRQGGRWRLHGRLRVG

SEQ ID NO: 1316404 - protein, 26 aa, Mycobacterium
GAASPVSFFAYPGRPSDLVPQGCEVH

SEQ ID NO: 1316405 - protein, 24 aa, Mycobacterium
GAATLPLPALSQLNSRLLRYFVKR

SEQ ID NO: 1316406 - protein, 36 aa, Mycobacterium
GAATYEWIVKNQPGEWMYSQPTWVVTHRPDIVAAGH

SEQ ID NO: 1316407 - protein, 23 aa, Mycobacterium
GAAVRHILAMFADLSQVPDENVT

SEQ ID NO: 1316408 - protein, 20 aa, Mycobacterium
GAAVVVTRFGEPRLGLTPAL

SEQ ID NO: 1316409 - protein, 21 aa, Mycobacterium
GACRFLGGYLTARLAQNPLIN

SEQ ID NO: 1316410 - protein, 28 aa, Mycobacterium
GADALMILPVSYWKLTDREIARHYASVA

SEQ ID NO: 1316411 - protein, 23 aa, Mycobacterium
GADASRLFLTQMIQHHRGAIMMA

SEQ ID NO: 1316412 - protein, 17 aa, Mycobacterium
GADAVWPGILGFEDTVI

SEQ ID NO: 1316413 - protein, 24 aa, Mycobacterium
GADELLRLRWPCPVPGARPLSEVG

SEQ ID NO: 1316414 - protein, 23 aa, Mycobacterium
GADFPAGWQKLNGPQALSFVRQR

SEQ ID NO: 1316415 - protein, 24 aa, Mycobacterium
GADGAALEFVVQAAAYAVSGIVGG

SEQ ID NO: 1316416 - protein, 17 aa, Mycobacterium
GADGLIKRIAKPHQYFA

SEQ ID NO: 1316417 - protein, 24 aa, Mycobacterium
GADGLLLMPPYLVEVPQAGLVDYT

SEQ ID NO: 1316418 - protein, 24 aa, Mycobacterium
GADHPVPWDWFVADYDRIRDAIAA

SEQ ID NO: 1316419 - protein, 17 aa, Mycobacterium
GADHRPWMRDEIGDLGV

SEQ ID NO: 1316420 - protein, 21 aa, Mycobacterium
GADIIAVDIAGPLPPCVPYDH

SEQ ID NO: 1316421 - protein, 21 aa, Mycobacterium
GADIVMVKPAMAYLDVVRAAA

SEQ ID NO: 1316422 - protein, 26 aa, Mycobacterium
GADKPLKYPHMFAAAGLVLINKSDLL

SEQ ID NO: 1316423 - protein, 18 aa, Mycobacterium
GADLQAYLTHLCSLATQG

SEQ ID NO: 1316424 - protein, 22 aa, Mycobacterium
GADLVCFPEFSPGPVRAHDTFY

SEQ ID NO: 1316425 - protein, 23 aa, Mycobacterium
GADPTGLLLLPAGDAVVLVDATA

SEQ ID NO: 1316426 - protein, 30 aa, Mycobacterium
GADRGYRGLQFFHATGLPLHDIRRVAEPEI

SEQ ID NO: 1316427 - protein, 19 aa, Mycobacterium
GADRLDLFAVPRLHLRHID

SEQ ID NO: 1316428 - protein, 22 aa, Mycobacterium
GADRLIDYIDYTTTPLAVEGQP

SEQ ID NO: 1316429 - protein, 23 aa, Mycobacterium
GADSMWFEPLFSQDARDLIELAL

SEQ ID NO: 1316430 - protein, 33 aa, Mycobacterium
GADSTTVGLFTYPVLMAADVLLYDTGLVPVGED

SEQ ID NO: 1316431 - protein, 25 aa, Mycobacterium
GADTAAVLHAWRSWSVELPETVNTS

SEQ ID NO: 1316432 - protein, 20 aa, Mycobacterium
GADVKLLFNIVPESAQYLAD

SEQ ID NO: 1316433 - protein, 22 aa, Mycobacterium
GADVLLLNTSFAGPALAEVMER

SEQ ID NO: 1316434 - protein, 18 aa, Mycobacterium
GADVPLLGQVPLDPELVA

SEQ ID NO: 1316435 - protein, 26 aa, Mycobacterium
GADVSDYHALWRWSVEDLAGFWGALW

SEQ ID NO: 1316436 - protein, 23 aa, Mycobacterium
GAEASRLFLTQMIEHHKGAIMMA

SEQ ID NO: 1316437 - protein, 21 aa, Mycobacterium
GAEAVSLWHADADLKGVDAVV

SEQ ID NO: 1316438 - protein, 26 aa, Mycobacterium
GAEFPRVDWLFATASRQTVPFAAFEP

SEQ ID NO: 1316439 - protein, 27 aa, Mycobacterium
GAEGLDLAIIYLPSPYDTAVLEPLAEA

SEQ ID NO: 1316440 - protein, 17 aa, Mycobacterium
GAEKIKLPSIYYAHQRK

SEQ ID NO: 1316441 - protein, 20 aa, Mycobacterium
GAELAAGYRFPRLRFVASVG

SEQ ID NO: 1316442 - protein, 24 aa, Mycobacterium
GAELLAALGLHRVWDRADAVMSSA

SEQ ID NO: 1316443 - protein, 24 aa, Mycobacterium
GAELLRCPVSEIMTSVLVTCTPAD

SEQ ID NO: 1316444 - protein, 35 aa, Mycobacterium
GAELVKVTPMDFLSDILLWPRLIDKYRGTMTAAPN

SEQ ID NO: 1316445 - protein, 35 aa, Mycobacterium
GAEMWLAPTAAFAASPFRWLTWLSDSRASLTAAPN

SEQ ID NO: 1316446 - protein, 24 aa, Mycobacterium
GAESPLRITVIRTAPAEYVMLLVA

SEQ ID NO: 1316447 - protein, 18 aa, Mycobacterium
GAETWRTRSRIRAAGRRP

SEQ ID NO: 1316448 - protein, 22 aa, Mycobacterium
GAFAAWTPPRRTLDATDGMVMR

SEQ ID NO: 1316449 - protein, 25 aa, Mycobacterium
GAFAVWLRDLLDLLGIARVTLVGHS

SEQ ID NO: 1316450 - protein, 22 aa, Mycobacterium
GAFDIEGLGYEAAIALLQARVI

SEQ ID NO: 1316451 - protein, 22 aa, Mycobacterium
GAFEMAATVDYLFGYDATAGVM

SEQ ID NO: 1316452 - protein, 22 aa, Mycobacterium
GAFEMAATVDYLFGYDATAHVM

SEQ ID NO: 1316453 - protein, 27 aa, Mycobacterium
GAFGSKSFLWMHVVLCAVAAREVGRPV

SEQ ID NO: 1316454 - protein, 18 aa, Mycobacterium
GAFGYWRESGSFILFDAP

SEQ ID NO: 1316455 - protein, 33 aa, Mycobacterium
GAFHESLNLAALWKLPVVFIVEDNGWGVSVSKA

SEQ ID NO: 1316456 - protein, 34 aa, Mycobacterium
GAFHESLNMAVLWRLPVLFCCENNLYAMGTALRR

SEQ ID NO: 1316457 - protein, 21 aa, Mycobacterium
GAFKPPLSWGIRMTGKKFMRE

SEQ ID NO: 1316458 - protein, 21 aa, Mycobacterium
GAFLGFEYFIAPNGDLWNADD

SEQ ID NO: 1316459 - protein, 30 aa, Mycobacterium
GAFRHQLHGLPLPTRRLLALAAAEPAGDAS

SEQ ID NO: 1316460 - protein, 18 aa, Mycobacterium
GAFRVPVPPEFGPVRVRF

SEQ ID NO: 1316461 - protein, 20 aa, Mycobacterium
GAFSEVHWVAPEDAVWACRT

SEQ ID NO: 1316462 - protein, 17 aa, Mycobacterium
GAFVLAGVTYKVDGRRS

SEQ ID NO: 1316463 - protein, 30 aa, Mycobacterium
GAGDAFMTGLIDALWSMDLLGAGRRARLAG

SEQ ID NO: 1316464 - protein, 29 aa, Mycobacterium
GAGEAIDLLKGVLMPAIMSAVKPPAPLPA

SEQ ID NO: 1316465 - protein, 39 aa, Mycobacterium
GAGFPEEYRNRVFIADYSLGWIRVLDFDDQYTSLISAKT

SEQ ID NO: 1316466 - protein, 38 aa, Mycobacterium
GAGFPEEYRNRVFIADYSLGWIRVLDFDEQYTSLISAK

SEQ ID NO: 1316467 - protein, 24 aa, Mycobacterium
GAGFRTGLKWRLCRAAPGEDKYVI

SEQ ID NO: 1316468 - protein, 31 aa, Mycobacterium
GAGGDGGLGGLGGFGGVGGTGGQGGQGGPGG

SEQ ID NO: 1316469 - protein, 25 aa, Mycobacterium
GAGGGMAHRLGMKPNWVIDLHNGGC

SEQ ID NO: 1316470 - protein, 24 aa, Mycobacterium
GAGGWRFRHELLREVAAELAPPSV

SEQ ID NO: 1316471 - protein, 34 aa, Mycobacterium
GAGHGEEPGPLPWYKRPPVLFGAAAAAALAALSG

SEQ ID NO: 1316472 - protein, 24 aa, Mycobacterium
GAGHVPLTAWARATLAFLEVSLGE

SEQ ID NO: 1316473 - protein, 24 aa, Mycobacterium
GAGKFTLVAELFHSVYPGGRAISV

SEQ ID NO: 1316474 - protein, 27 aa, Mycobacterium
GAGKSTLLRLLLGRLLPDEGRASMGAS

SEQ ID NO: 1316475 - protein, 25 aa, Mycobacterium
GAGLPLLMSGLLEVPVKMAQNFTDA

SEQ ID NO: 1316476 - protein, 17 aa, Mycobacterium
GAGPIGLALVQFSLAQG

SEQ ID NO: 1316477 - protein, 19 aa, Mycobacterium
GAGRRIRGLRLRATDVDWT

SEQ ID NO: 1316478 - protein, 30 aa, Mycobacterium
GAGRSVWTLLRRRNGVLPAIEQALHTIGLT

SEQ ID NO: 1316479 - protein, 24 aa, Mycobacterium
GAGSYLEFLAPYGLQSPGMAYALF

SEQ ID NO: 1316480 - protein, 31 aa, Mycobacterium
GAGTGLMDQAWWFPAFAPLPGGDPTVMLAER

SEQ ID NO: 1316481 - protein, 25 aa, Mycobacterium
GAGWQPDIWRGFADELGILGATLPE

SEQ ID NO: 1316482 - protein, 28 aa, Mycobacterium
GAHAQFATYLREFPMAFRFAVLNVISDG

SEQ ID NO: 1316483 - protein, 23 aa, Mycobacterium
GAHDQWLRTVAAPQLMAPATRMA

SEQ ID NO: 1316484 - protein, 24 aa, Mycobacterium
GAHDQWLRTVAAPQLMAPATRMAF

SEQ ID NO: 1316485 - protein, 19 aa, Mycobacterium
GAHGGALMAPPARRPETNG

SEQ ID NO: 1316486 - protein, 23 aa, Mycobacterium
GAHGLLVVTPYYSRPPQAGLAAH

SEQ ID NO: 1316487 - protein, 24 aa, Mycobacterium
GAHGLLVVTPYYSRPPQAGLLAHF

SEQ ID NO: 1316488 - protein, 17 aa, Mycobacterium
GAHHIADAARRWAVSLD

SEQ ID NO: 1316489 - protein, 24 aa, Mycobacterium
GAHLRNMAFYNMGLRLLRHVQDAA

SEQ ID NO: 1316490 - protein, 24 aa, Mycobacterium
GAHPQTWFKAFNYDLGARAPITFD

SEQ ID NO: 1316491 - protein, 17 aa, Mycobacterium
GAHVFITGRKKPALDAA

SEQ ID NO: 1316492 - protein, 17 aa, Mycobacterium
GAHVRVLDIVAERLRLA

SEQ ID NO: 1316493 - protein, 19 aa, Mycobacterium
GAIAVPVNFRLAAGEIGYV

SEQ ID NO: 1316494 - protein, 26 aa, Mycobacterium
GAILNVLSVLSWLHPPTSGAYSAAKA

SEQ ID NO: 1316495 - protein, 21 aa, Mycobacterium
GAIVWTKQVWLATIAGDDFPS

SEQ ID NO: 1316496 - protein, 18 aa, Mycobacterium
GAKAWITHGGIADFYSLF

SEQ ID NO: 1316497 - protein, 17 aa, Mycobacterium
GAKFSDLRFTNSSTLGL

SEQ ID NO: 1316498 - protein, 17 aa, Mycobacterium
GAKNHMIIMPDADLDQA

SEQ ID NO: 1316499 - protein, 23 aa, Mycobacterium
GAKPITLPYARSLAAAGLAIVSN

SEQ ID NO: 1316500 - protein, 25 aa, Mycobacterium
GAKQEPRAWRLAVELSREGDQIKMS

SEQ ID NO: 1316501 - protein, 20 aa, Mycobacterium
GAKSCFPTQLTKGERMLVFL

SEQ ID NO: 1316502 - protein, 19 aa, Mycobacterium
GAKVLRQYGLGPLPGVAMM

SEQ ID NO: 1316503 - protein, 23 aa, Mycobacterium
GALAAGCAVLLKPSERTPLTAEL

SEQ ID NO: 1316504 - protein, 17 aa, Mycobacterium
GALAAWLASPVAGMVTG

SEQ ID NO: 1316505 - protein, 26 aa, Mycobacterium
GALAERALVPVLPSVEEFPYAIRQVS

SEQ ID NO: 1316506 - protein, 25 aa, Mycobacterium
GALAGFWAHVLGYVLQPPPAEFDTW

SEQ ID NO: 1316507 - protein, 22 aa, Mycobacterium
GALASGFFLTSGGPLLHAAPMF

SEQ ID NO: 1316508 - protein, 25 aa, Mycobacterium
GALDEDLRWQPELYRALLAHVDTEP

SEQ ID NO: 1316509 - protein, 18 aa, Mycobacterium
GALEFIPAKRVGTADEVA

SEQ ID NO: 1316510 - protein, 23 aa, Mycobacterium
GALKHAFDCAYYQLLDATRGRPF

SEQ ID NO: 1316511 - protein, 25 aa, Mycobacterium
GALPVAAWHHDVAMHVPIEVAERAR

SEQ ID NO: 1316512 - protein, 24 aa, Mycobacterium
GALTRLQAVWTGDGQMAYDAVQNR

SEQ ID NO: 1316513 - protein, 23 aa, Mycobacterium
GALTVTIGGLRKTGYRPAAGETV

SEQ ID NO: 1316514 - protein, 33 aa, Mycobacterium
GALVCSVPLLDMKRFHLLLAGASWVAEYGDPDN

SEQ ID NO: 1316515 - protein, 17 aa, Mycobacterium
GALVLPPGTLRGLGVVD

SEQ ID NO: 1316516 - protein, 18 aa, Mycobacterium
GALYHQFADKSALFEAVY

SEQ ID NO: 1316517 - protein, 18 aa, Mycobacterium
GALYPITVSLRPLYDPTG

SEQ ID NO: 1316518 - protein, 27 aa, Mycobacterium
GAMFDPPLGPALYPRTVARNRRPYPTL

SEQ ID NO: 1316519 - protein, 17 aa, Mycobacterium
GAMRAFAAFIRAHRERV

SEQ ID NO: 1316520 - protein, 25 aa, Mycobacterium
GAMVQAVWFRHGPPVLALCVHHLST

SEQ ID NO: 1316521 - protein, 25 aa, Mycobacterium
GANAQLWRFIVLDGPEQRAAVGKAA

SEQ ID NO: 1316522 - protein, 27 aa, Mycobacterium
GANAQNGAFNLGFGDITFGDKTSNTAT

SEQ ID NO: 1316523 - protein, 26 aa, Mycobacterium
GANLHGRYLLPHFLIHDIAEVAADLR

SEQ ID NO: 1316524 - protein, 17 aa, Mycobacterium
GANLRVLARQPVDLDRP

SEQ ID NO: 1316525 - protein, 19 aa, Mycobacterium
GANNLLFRRNSVTGAVEVV

SEQ ID NO: 1316526 - protein, 23 aa, Mycobacterium
GANRLVALIRYPHGADPEQVTRE

SEQ ID NO: 1316527 - protein, 29 aa, Mycobacterium
GAPADPDAVFLPYPNPFRPGPDGVEADVA

SEQ ID NO: 1316528 - protein, 20 aa, Mycobacterium
GAPAQAWLRRCAEANRHAVD

SEQ ID NO: 1316529 - protein, 23 aa, Mycobacterium
GAPARPWPTDVKLAAPPVPVIAI

SEQ ID NO: 1316530 - protein, 18 aa, Mycobacterium
GAPAVYLLDGLRARDDFN

SEQ ID NO: 1316531 - protein, 29 aa, Mycobacterium
GAPILWADMPTLPLYRQQRTLLTSSKMYA

SEQ ID NO: 1316532 - protein, 23 aa, Mycobacterium
GAPLPGHLWAQYGLAGVLEHEGF

SEQ ID NO: 1316533 - protein, 17 aa, Mycobacterium
GAPLWTDASLLADPWGA

SEQ ID NO: 1316534 - protein, 34 aa, Mycobacterium
GAPPVEAVIAHTNLYWSYQAAPGRTAAVATAAEI

SEQ ID NO: 1316535 - protein, 22 aa, Mycobacterium
GAPRFGMWLASGSGYVTEICAG

SEQ ID NO: 1316536 - protein, 23 aa, Mycobacterium
GAPRGSVYYHFPEGRSQIVAEAL

SEQ ID NO: 1316537 - protein, 17 aa, Mycobacterium
GAPTYTIGTAPVKLIAS

SEQ ID NO: 1316538 - protein, 23 aa, Mycobacterium
GAPVRDWWQISRWATRLGDPRVR

SEQ ID NO: 1316539 - protein, 17 aa, Mycobacterium
GAPYAYAQPHSGIDANL

SEQ ID NO: 1316540 - protein, 18 aa, Mycobacterium
GAPYAYAQPHSGIDANLV

SEQ ID NO: 1316541 - protein, 26 aa, Mycobacterium
GAPYKSNTQLLWYRKSHAAAAGVDPA

SEQ ID NO: 1316542 - protein, 18 aa, Mycobacterium
GAQLLLWRNGFCEKLINQ

SEQ ID NO: 1316543 - protein, 22 aa, Mycobacterium
GAQVAAFLAELRSLIELPELAL

SEQ ID NO: 1316544 - protein, 17 aa, Mycobacterium
GARADQFAALLRGITDD

SEQ ID NO: 1316545 - protein, 26 aa, Mycobacterium
GARAPITFDTLFRPGTRPLDVVYPAV

SEQ ID NO: 1316546 - protein, 22 aa, Mycobacterium
GARDRIAAYLSAVGAALDPASD

SEQ ID NO: 1316547 - protein, 25 aa, Mycobacterium
GAREHALLLALRRDPEVEALSVAPG

SEQ ID NO: 1316548 - protein, 23 aa, Mycobacterium
GARKLILDLQTVEFFAASGFAAL

SEQ ID NO: 1316549 - protein, 20 aa, Mycobacterium
GARLGHFFRGVGLTIYEGYG

SEQ ID NO: 1316550 - protein, 20 aa, Mycobacterium
GARLLAVGLPPTLPHEFPVT

SEQ ID NO: 1316551 - protein, 24 aa, Mycobacterium
GARNAGLLAVRILGAADGALRDRM

SEQ ID NO: 1316552 - protein, 18 aa, Mycobacterium
GARNPLPPLVTPFGGRSY

SEQ ID NO: 1316553 - protein, 26 aa, Mycobacterium
GARPKTLLLPLGPLAEHNIRTTFTAN

SEQ ID NO: 1316554 - protein, 23 aa, Mycobacterium
GARRIVLLSRRGAGPAPLDNLGA

SEQ ID NO: 1316555 - protein, 27 aa, Mycobacterium
GARRTRVRVRRGWRARARPGRRGDCAQ

SEQ ID NO: 1316556 - protein, 19 aa, Mycobacterium
GARRYCAIGMLTVGDEGRM

SEQ ID NO: 1316557 - protein, 24 aa, Mycobacterium
GARSAMPMLQAKRLVGAAAVVLPP

SEQ ID NO: 1316558 - protein, 26 aa, Mycobacterium
GARSPWPTWRAHPLLSPFLHGHHDGI

SEQ ID NO: 1316559 - protein, 18 aa, Mycobacterium
GARVLPLVREIENSGRVS

SEQ ID NO: 1316560 - protein, 37 aa, Mycobacterium
GARWAMEHLPYYARWYRFLLMWPGADKGLDAARVDPA

SEQ ID NO: 1316561 - protein, 29 aa, Mycobacterium
GARYLDTGAMYRIVTLGVLRAGVDPADAA

SEQ ID NO: 1316562 - protein, 36 aa, Mycobacterium
GASAALFLSTLGIPNIMITKYRWTADTPRAHITNQR

SEQ ID NO: 1316563 - protein, 25 aa, Mycobacterium
GASAYPFVWNVLLAARNEGFGGVLT

SEQ ID NO: 1316564 - protein, 23 aa, Mycobacterium
GASIQLLGVLLFDVNTRAVKRNE

SEQ ID NO: 1316565 - protein, 24 aa, Mycobacterium
GASISPFTLLLIRDELVPELQRRG

SEQ ID NO: 1316566 - protein, 26 aa, Mycobacterium
GASLLAMPQAPVYAAAKAGLNNLTGS

SEQ ID NO: 1316567 - protein, 25 aa, Mycobacterium
GASNVMIGSWFAGTYESPGDLMRDR

SEQ ID NO: 1316568 - protein, 24 aa, Mycobacterium
GASPRVLRVVHGARIGFVFQDPGT

SEQ ID NO: 1316569 - protein, 19 aa, Mycobacterium
GATALLRYEDRDVAWCPCI

SEQ ID NO: 1316570 - protein, 18 aa, Mycobacterium
GATDLCEFMEFPSGILQV

SEQ ID NO: 1316571 - protein, 19 aa, Mycobacterium
GATGEKFSFLLLGAIVELR

SEQ ID NO: 1316572 - protein, 32 aa, Mycobacterium
GATGPNAFDCSGLIKWAFLQNGKSLPRSSQAL

SEQ ID NO: 1316573 - protein, 21 aa, Mycobacterium
GATLLALLQAPDDLTAPAWVD

SEQ ID NO: 1316574 - protein, 24 aa, Mycobacterium
GATRPPILDHVLPSAVAAGPGDSA

SEQ ID NO: 1316575 - protein, 22 aa, Mycobacterium
GATVLLRTLPLGVHGVAMGAAV

SEQ ID NO: 1316576 - protein, 18 aa, Mycobacterium
GATVLRAIWGFRGTERPH

SEQ ID NO: 1316577 - protein, 23 aa, Mycobacterium
GATWGMALLYRETGDLAYRAALD

SEQ ID NO: 1316578 - protein, 22 aa, Mycobacterium
GATYMNYVGKPLAYILAGPERP

SEQ ID NO: 1316579 - protein, 25 aa, Mycobacterium
GAVAHLFDSLLGFTAYKLSGSKAQR

SEQ ID NO: 1316580 - protein, 17 aa, Mycobacterium
GAVFAKGVLLWPRDRLD

SEQ ID NO: 1316581 - protein, 20 aa, Mycobacterium
GAVFIHGTSVWLESSIEQLV

SEQ ID NO: 1316582 - protein, 18 aa, Mycobacterium
GAVGLAVYRRAEVVAVLA

SEQ ID NO: 1316583 - protein, 19 aa, Mycobacterium
GAVIGERWRVGAGGLLLEV

SEQ ID NO: 1316584 - protein, 27 aa, Mycobacterium
GAVLVDHNGAWMATPPPIVPRSTVGAG

SEQ ID NO: 1316585 - protein, 18 aa, Mycobacterium
GAVLWRPKEFTGTPEIAV

SEQ ID NO: 1316586 - protein, 20 aa, Mycobacterium
GAVSTLLRTATLPPGMDPAV

SEQ ID NO: 1316587 - protein, 18 aa, Mycobacterium
GAVVAWAAPLLQPDRFSS

SEQ ID NO: 1316588 - protein, 19 aa, Mycobacterium
GAWLYSQRAGILTGLAAAA

SEQ ID NO: 1316589 - protein, 17 aa, Mycobacterium
GAWMATPPPIVPRSTVG

SEQ ID NO: 1316590 - protein, 18 aa, Mycobacterium
GAWRDHLLVAITIEELNG

SEQ ID NO: 1316591 - protein, 22 aa, Mycobacterium
GAWYLRALRADALMDDRPALAD

SEQ ID NO: 1316592 - protein, 19 aa, Mycobacterium
GAYLPMINALARAGHHVIY

SEQ ID NO: 1316593 - protein, 25 aa, Mycobacterium
GCAGLRYNLFFDDRSLDGDLTVDFG

SEQ ID NO: 1316594 - protein, 22 aa, Mycobacterium
GCAPSDLPFATLPGILMTPHTS

SEQ ID NO: 1316595 - protein, 28 aa, Mycobacterium
GCASSAWTLGFYALHNWMLALFTEQAQS

SEQ ID NO: 1316596 - protein, 25 aa, Mycobacterium
GCDKSLPGMLMAAARLDLASVFLYA

SEQ ID NO: 1316597 - protein, 17 aa, Mycobacterium
GCDSTPYPTGENFTTTV

SEQ ID NO: 1316598 - protein, 30 aa, Mycobacterium; identical to SEQ ID NO: 814980

SEQ ID NO: 1316599 - protein, 26 aa, Mycobacterium
GCGKTRLVEHMGLLLGRPVVTISCHD

SEQ ID NO: 1316600 - protein, 19 aa, Mycobacterium
GCIDILLDVAMGRSDAALS

SEQ ID NO: 1316601 - protein, 21 aa, Mycobacterium
GCIDWCVGMFKTPSGPQAWVV

SEQ ID NO: 1316602 - protein, 22 aa, Mycobacterium
GCIPTKMFVYAAGVAHDIRESS

SEQ ID NO: 1316603 - protein, 26 aa, Mycobacterium
GCLHAAMDLYKWSYKLSPLVASDLVM

SEQ ID NO: 1316604 - protein, 18 aa, Mycobacterium
GCNMSIRRSVFDDIGGFR

SEQ ID NO: 1316605 - protein, 17 aa, Mycobacterium
GCPFAPRCPLAIDECDA

SEQ ID NO: 1316606 - protein, 17 aa, Mycobacterium
GCRILVNGVVHDEQSAT

SEQ ID NO: 1316607 - protein, 26 aa, Mycobacterium
GCSTYKWETFLTQELPAYLAVERQVR

SEQ ID NO: 1316608 - protein, 25 aa, Mycobacterium
GCSTYKWETFLTQELPSYLAANKGV

SEQ ID NO: 1316609 - protein, 26 aa, Mycobacterium
GCTHPGCTVPFYWTEAHHAHDYSRGG

SEQ ID NO: 1316610 - protein, 26 aa, Mycobacterium
GCTHPGCTVPFYWTEAHHTHDYSRGG

SEQ ID NO: 1316611 - protein, 17 aa, Mycobacterium
GCTLIRGHARFENPHTL

SEQ ID NO: 1316612 - protein, 20 aa, Mycobacterium
GCVAVEFRTHYFNFASRAAI

SEQ ID NO: 1316613 - protein, 19 aa, Mycobacterium
GCVTIRAQRSARWLDVVVH

SEQ ID NO: 1316614 - protein, 18 aa, Mycobacterium
GCWGPVVKCNVPKRGWIN

SEQ ID NO: 1316615 - protein, 17 aa, Mycobacterium
GCWGSFQDPEVCNFAYK

SEQ ID NO: 1316616 - protein, 23 aa, Mycobacterium
GDADFYICGPGPFMDTVEGALAT

SEQ ID NO: 1316617 - protein, 25 aa, Mycobacterium
GDADQVPLRLLGPVVRRPAGLRHRP

SEQ ID NO: 1316618 - protein, 31 aa, Mycobacterium
GDAEVDRIWFAPNVWPREVPALQPLLTEYTA

SEQ ID NO: 1316619 - protein, 25 aa, Mycobacterium
GDAGLAQEATPTAAAFGGRGGNGGT

SEQ ID NO: 1316620 - protein, 27 aa, Mycobacterium
GDAIFVTYRHRLLLGWTHMQDGQLQAA

SEQ ID NO: 1316621 - protein, 27 aa, Mycobacterium
GDAKVAFYRGLDLFLFATTHPQEAQPN

SEQ ID NO: 1316622 - protein, 17 aa, Mycobacterium
GDALAADFYLEIADALP

SEQ ID NO: 1316623 - protein, 24 aa, Mycobacterium
GDALAVFGVSIPPTARMGSLPVGL

SEQ ID NO: 1316624 - protein, 22 aa, Mycobacterium
GDALSLLIYTSGSTGAPKGAMY

SEQ ID NO: 1316625 - protein, 19 aa, Mycobacterium
GDAPITRALILRTALAILD

SEQ ID NO: 1316626 - protein, 21 aa, Mycobacterium
GDAVFFNPALYHAAGANVSTD

SEQ ID NO: 1316627 - protein, 24 aa, Mycobacterium
GDAVPGPWHLDALPLVISAADWDR

SEQ ID NO: 1316628 - protein, 23 aa, Mycobacterium
GDDGALTLALPMADQPLAGIAVD

SEQ ID NO: 1316629 - protein, 24 aa, Mycobacterium
GDDGRFLWPGFGENSRVLKWAIER

SEQ ID NO: 1316630 - protein, 23 aa, Mycobacterium
GDDLDFFIMSSSVSSLFGSPGQA

SEQ ID NO: 1316631 - protein, 25 aa, Mycobacterium
GDDNPLPFAIALAGAAGLRMRMLSL

SEQ ID NO: 1316632 - protein, 25 aa, Mycobacterium
GDDVRWVRVPFNTALAPGAKTFDVN

SEQ ID NO: 1316633 - protein, 30 aa, Mycobacterium
GDEEGLLLSLRHRWVNMLAAKLDQAAQDDR

SEQ ID NO: 1316634 - protein, 18 aa, Mycobacterium
GDEETWVIGGERIYTLAL

SEQ ID NO: 1316635 - protein, 26 aa, Mycobacterium
GDEGGLPYHRPPLSKGYLAGKNGLDD

SEQ ID NO: 1316636 - protein, 21 aa, Mycobacterium
GDEGKNLAMLLLRLGRGRLGK

SEQ ID NO: 1316637 - protein, 19 aa, Mycobacterium
GDELAVARALSDLARQLLA

SEQ ID NO: 1316638 - protein, 19 aa, Mycobacterium
GDELFRTLLQPAETVLDAA

SEQ ID NO: 1316639 - protein, 30 aa, Mycobacterium
GDELLAAFERDFFPIYPASAKVQSWDIYAC

SEQ ID NO: 1316640 - protein, 30 aa, Mycobacterium
GDELLAMPGSLLLVGERLATSPGALSAVVR

SEQ ID NO: 1316641 - protein, 23 aa, Mycobacterium
GDEPMIFYRDPMQFMTHLAEKHG

SEQ ID NO: 1316642 - protein, 19 aa, Mycobacterium
GDFDLSTLRFALSGAEPVE

SEQ ID NO: 1316643 - protein, 17 aa, Mycobacterium
GDFHYWLDNLADAFDGT

SEQ ID NO: 1316644 - protein, 21 aa, Mycobacterium
GDFYDLFALAPGRSAFFLGDS

SEQ ID NO: 1316645 - protein, 25 aa, Mycobacterium
GDFYPPYPWATHREPMRMHPQFAAE

SEQ ID NO: 1316646 - protein, 18 aa, Mycobacterium
GDFYSPGFYAFDELIAEW

SEQ ID NO: 1316647 - protein, 27 aa, Mycobacterium
GDGFVSRICGWLLGIAHHFQGDLDAAL

SEQ ID NO: 1316648 - protein, 22 aa, Mycobacterium
GDGLLVVFGYPIAHENDVRRAV

SEQ ID NO: 1316649 - protein, 30 aa, Mycobacterium
GDGLSWHAPFPSLFPMEEPGYWAVTRRADI

SEQ ID NO: 1316650 - protein, 30 aa, Mycobacterium
GDGPVLLHDLTWPLIADATLDAVLSAVHGG

SEQ ID NO: 1316651 - protein, 19 aa, Mycobacterium
GDGPVLYRRTVADAPVAPA

SEQ ID NO: 1316652 - protein, 24 aa, Mycobacterium
GDGRCRIFIVEPQGALEDDPNVTD

SEQ ID NO: 1316653 - protein, 25 aa, Mycobacterium
GDGRVRARREISVKIPAGVGDGMRV

SEQ ID NO: 1316654 - protein, 20 aa, Mycobacterium
GDGWAPWLTKPEELPAKLDY

SEQ ID NO: 1316655 - protein, 18 aa, Mycobacterium
GDGWWAQRLVDHAARLGI

SEQ ID NO: 1316656 - protein, 25 aa, Mycobacterium
GDGYAIVGYALRFPGAADADEFWDV

SEQ ID NO: 1316657 - protein, 24 aa, Mycobacterium
GDHGLMLRGPMHDPRRHELPRVHQ

SEQ ID NO: 1316658 - protein, 22 aa, Mycobacterium
GDHRRAFRHVVPAFAVALSASI

SEQ ID NO: 1316659 - protein, 26 aa, Mycobacterium
GDIAQCDLWFPPTTIPVGYGQTRTPT

SEQ ID NO: 1316660 - protein, 18 aa, Mycobacterium
GDIITITAGRRGGLAVVL

SEQ ID NO: 1316661 - protein, 22 aa, Mycobacterium
GDIVVVHTGWWTRFLSTGDGGE

SEQ ID NO: 1316662 - protein, 29 aa, Mycobacterium
GDLAKRKLLPGMAYLVQSALAPKIRVVGT

SEQ ID NO: 1316663 - protein, 28 aa, Mycobacterium
GDLANAELLATFLRFLTAASGMKADVRT

SEQ ID NO: 1316664 - protein, 21 aa, Mycobacterium
GDLAYFLDKRKRGFDLCIYML

SEQ ID NO: 1316665 - protein, 28 aa, Mycobacterium
GDLDFLRRPLLGFLSMAAGPTPPQPRPV

SEQ ID NO: 1316666 - protein, 31 aa, Mycobacterium
GDLEYGRLRLPKPDWQVLLDVPTELAAQRAV

SEQ ID NO: 1316667 - protein, 17 aa, Mycobacterium
GDLIILSSSLIPGNEEA

SEQ ID NO: 1316668 - protein, 23 aa, Mycobacterium
GDLRAAGLLSRALLWQGRAAEAD

SEQ ID NO: 1316669 - protein, 27 aa, Mycobacterium
GDLTERLVLMSRQYGLEPQQLLQILQQ

SEQ ID NO: 1316670 - protein, 22 aa, Mycobacterium
GDLVARLISLRQLSVSVARTLA

SEQ ID NO: 1316671 - protein, 17 aa, Mycobacterium
GDMFVATIELWVAARTD

SEQ ID NO: 1316672 - protein, 24 aa, Mycobacterium
GDNARRFMGLPIANPDPAAARPPA

SEQ ID NO: 1316673 - protein, 22 aa, Mycobacterium
GDNIWLARRYGPAARQIVAAVA

SEQ ID NO: 1316674 - protein, 28 aa, Mycobacterium
GDNMRNAFLNAPWVKAVIPVRPGKERAA

SEQ ID NO: 1316675 - protein, 23 aa, Mycobacterium
GDNPAYVSWLISQSMLADANEIS

SEQ ID NO: 1316676 - protein, 25 aa, Mycobacterium
GDPAPKGIFPWYAPGVDGQLGEFPL

SEQ ID NO: 1316677 - protein, 17 aa, Mycobacterium
GDPDAMRPFLLVASFVN

SEQ ID NO: 1316678 - protein, 21 aa, Mycobacterium
GDPEIRWILSTVPTAMIFDDH

SEQ ID NO: 1316679 - protein, 21 aa, Mycobacterium
GDPIVGLQRAVADHHQLASNF

SEQ ID NO: 1316680 - protein, 17 aa, Mycobacterium
GDPKQQVRCVYVAIGQK

SEQ ID NO: 1316681 - protein, 24 aa, Mycobacterium
GDPLDALVLLPEPVFPGCIVEARP

SEQ ID NO: 1316682 - protein, 21 aa, Mycobacterium
GDPLPQVRRYAAAFEALRNRS

SEQ ID NO: 1316683 - protein, 23 aa, Mycobacterium
GDPQRPYVLGGLHNGTDLPDAAG

SEQ ID NO: 1316684 - protein, 22 aa, Mycobacterium
GDPRHPSWYFNVKANPAVTVQD

SEQ ID NO: 1316685 - protein, 25 aa, Mycobacterium
GDPSTIYPVLALLPIDGVRVEDVWH

SEQ ID NO: 1316686 - protein, 24 aa, Mycobacterium
GDPSVLKAILDRTPWRAEQPVVIV

SEQ ID NO: 1316687 - protein, 25 aa, Mycobacterium
GDPTVFPGHWYSADPSAPLSDVRQT

SEQ ID NO: 1316688 - protein, 21 aa, Mycobacterium
GDPVRTLKLLWRTPGEARTSR

SEQ ID NO: 1316689 - protein, 23 aa, Mycobacterium
GDPYDGIWLRTQAERLGLGQVWI

SEQ ID NO: 1316690 - protein, 21 aa, Mycobacterium
GDQRLQNWWATDKLERRSNEH

SEQ ID NO: 1316691 - protein, 18 aa, Mycobacterium
GDQVLRELPADRTRHLVA

SEQ ID NO: 1316692 - protein, 24 aa, Mycobacterium
GDQYDLSSLFLLASTAALFSTSLK

SEQ ID NO: 1316693 - protein, 22 aa, Mycobacterium
GDRALIMAIVNRTPDSFYDRGA

SEQ ID NO: 1316694 - protein, 23 aa, Mycobacterium
GDRATALGIFTRVTADNPAMSDA

SEQ ID NO: 1316695 - protein, 40 aa, Mycobacterium
GDRAVILAPQGLEYVLAFLGAMQAGLVAVPLPLPHRGSGH

SEQ ID NO: 1316696 - protein, 17 aa, Mycobacterium
GDRAWISMMALSDRWRD

SEQ ID NO: 1316697 - protein, 21 aa, Mycobacterium
GDRFGLRRNGINPRKLRANPH

SEQ ID NO: 1316698 - protein, 18 aa, Mycobacterium
GDRFVVSETFSVGGPLAP

SEQ ID NO: 1316699 - protein, 22 aa, Mycobacterium
GDRGLPVTVYDLRDLDLLAAAE

SEQ ID NO: 1316700 - protein, 29 aa, Mycobacterium
GDRSLTYRELWLWRNRIANALIAAGVQKG

SEQ ID NO: 1316701 - protein, 24 aa, Mycobacterium
GDRVVIPFQISCGHCFMCDRKLYT

SEQ ID NO: 1316702 - protein, 22 aa, Mycobacterium
GDRWAFALLVAAFVGVGRFTDF

SEQ ID NO: 1316703 - protein, 19 aa, Mycobacterium
GDSDWLHGVWKGEGFTERL

SEQ ID NO: 1316704 - protein, 25 aa, Mycobacterium
GDSTRARIVLFRKPIERRAKDTDEL

SEQ ID NO: 1316705 - protein, 17 aa, Mycobacterium
GDTFAPVRAILSGSRRS

SEQ ID NO: 1316706 - protein, 25 aa, Mycobacterium
GDTGLAQAWHRYLPTAYMGNKRNSR

SEQ ID NO: 1316707 - protein, 24 aa, Mycobacterium
GDTMVWLRHFNAAAAARGVPPLRF

SEQ ID NO: 1316708 - protein, 24 aa, Mycobacterium
GDVAAFDSWQPPPSPQRIPATLSP

SEQ ID NO: 1316709 - protein, 34 aa, Mycobacterium
GDVATALSIRLVRTPEIVLLARSAGFDAVFVDLE

SEQ ID NO: 1316710 - protein, 21 aa, Mycobacterium
GDVAVITYLGGPFPQVHNPAD

SEQ ID NO: 1316711 - protein, 27 aa, Mycobacterium
GDVDPGVIFYLWRTAGMSVEDIEAMLN

SEQ ID NO: 1316712 - protein, 26 aa, Mycobacterium
GDVFAGVLAANWPRGADYALARACAA

SEQ ID NO: 1316713 - protein, 22 aa, Mycobacterium
GDVFPQAPFALTPGPPISTAQL

SEQ ID NO: 1316714 - protein, 20 aa, Mycobacterium
GDVLGYYQSGRPITLRFLSL

SEQ ID NO: 1316715 - protein, 17 aa, Mycobacterium
GDVNKGWLVARATLGNE

SEQ ID NO: 1316716 - protein, 22 aa, Mycobacterium
GDVNKGWLVARATLGNERISIG

SEQ ID NO: 1316717 - protein, 24 aa, Mycobacterium
GDVPLIGFAGAPFTLASYLVEGGP

SEQ ID NO: 1316718 - protein, 17 aa, Mycobacterium
GDVQLVMVPHLSGEPIG

SEQ ID NO: 1316719 - protein, 19 aa, Mycobacterium
GDVRGEGFFYGIELVKDKA

SEQ ID NO: 1316720 - protein, 30 aa, Mycobacterium
GDVRRVHRLLAYVPADVALWPALTGAETLE

SEQ ID NO: 1316721 - protein, 33 aa, Mycobacterium
GDVSVLRPYRMALAHLWAAGLPWADDLPPVQAC

SEQ ID NO: 1316722 - protein, 35 aa, Mycobacterium
GDVSVLRPYRMALTHLWAAGLPWTPDLAPVRACPA

SEQ ID NO: 1316723 - protein, 31 aa, Mycobacterium
GDVVPTGVRLWPAQPLTLLAPWDGEVRSDGA

SEQ ID NO: 1316724 - protein, 19 aa, Mycobacterium
GDVWGLLVDGRFGRGLPPA

SEQ ID NO: 1316725 - protein, 18 aa, Mycobacterium
GDVYSHRFGASSAAPEAG

SEQ ID NO: 1316726 - protein, 34 aa, Mycobacterium
GDWAPPLRIRGFDPSLPTMWSAEGLLPYLRAEDQ

SEQ ID NO: 1316727 - protein, 17 aa, Mycobacterium
GDWSALPSLRTCVEAMY

SEQ ID NO: 1316728 - protein, 20 aa, Mycobacterium
GDYFTQIKRLLRANPPANPR

SEQ ID NO: 1316729 - protein, 24 aa, Mycobacterium
GDYLEELLDLLDFDGDIDLDVEGD

SEQ ID NO: 1316730 - protein, 35 aa, Mycobacterium
GDYVTIVLPNSLDWAYSVLACWKLGAVPQPLSARL

SEQ ID NO: 1316731 - protein, 29 aa, Mycobacterium
GEAASRLLGFMYLSRVWHAALRRRRPDRP

SEQ ID NO: 1316732 - protein, 22 aa, Mycobacterium
GEADRLFGWDRSGPRPQDHPGL

SEQ ID NO: 1316733 - protein, 24 aa, Mycobacterium
GEADVYNMGWQKYLDARATDEQRR

SEQ ID NO: 1316734 - protein, 23 aa, Mycobacterium
GEAFHRIVAPWCLSYHPSSPPSA

SEQ ID NO: 1316735 - protein, 22 aa, Mycobacterium
GEAFPALGEFFGSSLPSLTGIG

SEQ ID NO: 1316736 - protein, 19 aa, Mycobacterium
GEAFSETPLRELLLDAIRY

SEQ ID NO: 1316737 - protein, 20 aa, Mycobacterium
GEAGFDWYEVSNWARFGGEC

SEQ ID NO: 1316738 - protein, 28 aa, Mycobacterium
GEAHRRLAERYLVHQPDPGQPVVRFVCS

SEQ ID NO: 1316739 - protein, 25 aa, Mycobacterium
GEAPPDIELIGMLNLLIGGGFDTTT

SEQ ID NO: 1316740 - protein, 20 aa, Mycobacterium
GEATALCTLCVDPRPQRAEH

SEQ ID NO: 1316741 - protein, 23 aa, Mycobacterium
GEAYLCGPAPFMAAVQGALADAG

SEQ ID NO: 1316742 - protein, 35 aa, Mycobacterium
GECIDLALYESLFRGIDWQVILYDQLNFVAERQGN

SEQ ID NO: 1316743 - protein, 25 aa, Mycobacterium
GEDAPPRLFLARYARTKRPSVPGLR

SEQ ID NO: 1316744 - protein, 23 aa, Mycobacterium
GEDFPALAKRFPAPPASKGVVVT

SEQ ID NO: 1316745 - protein, 18 aa, Mycobacterium
GEDFWPAAYDPSVPDEII

SEQ ID NO: 1316746 - protein, 23 aa, Mycobacterium
GEDIDWAGWLRDGIVCPAQLGTA

SEQ ID NO: 1316747 - protein, 23 aa, Mycobacterium
GEDTFTYGLLYQQEDDLALRCEE

SEQ ID NO: 1316748 - protein, 27 aa, Mycobacterium
GEEGQGFIYLMQNLPQERISIAIMAAA

SEQ ID NO: 1316749 - protein, 24 aa, Mycobacterium
GEEICAWIRMRPGRRALDAAAVRE

SEQ ID NO: 1316750 - protein, 25 aa, Mycobacterium
GEEIPPALLEPFSGPWGTDTLLDLM

SEQ ID NO: 1316751 - protein, 23 aa, Mycobacterium
GEEQFMAWRRSYDTPPPPIEAGS

SEQ ID NO: 1316752 - protein, 31 aa, Mycobacterium
GEESALFAADLARMYIRYAERHGWTVTMLGE

SEQ ID NO: 1316753 - protein, 27 aa, Mycobacterium
GEETQWDWLDLPNPPASWGWGSMAHLF

SEQ ID NO: 1316754 - protein, 24 aa, Mycobacterium
GEEWGRLLIPSPPAEPGRARMVLE

SEQ ID NO: 1316755 - protein, 17 aa, Mycobacterium
GEFAPHQRFVDQRGPER

SEQ ID NO: 1316756 - protein, 23 aa, Mycobacterium
GEFATILAGLIPAGATIATDELT

SEQ ID NO: 1316757 - protein, 19 aa, Mycobacterium
GEFDLSTLRFALSGAEPVE

SEQ ID NO: 1316758 - protein, 24 aa, Mycobacterium
GEFGNPFAMLVIADLLGVPESDHN

SEQ ID NO: 1316759 - protein, 19 aa, Mycobacterium
GEFGVLVDVVLFALGRSDE

SEQ ID NO: 1316760 - protein, 18 aa, Mycobacterium
GEFIPRPIKSSFREGLTV

SEQ ID NO: 1316761 - protein, 24 aa, Mycobacterium
GEFKKGPFRIAMSARIPIVPIVIR

SEQ ID NO: 1316762 - protein, 30 aa, Mycobacterium
GEFRPELTAAWLTEMFYSLVGGTAWSIRAG

SEQ ID NO: 1316763 - protein, 17 aa, Mycobacterium
GEFTRQSPGFLGYRDHH

SEQ ID NO: 1316764 - protein, 17 aa, Mycobacterium
GEGCGILVLKRLSDAVR

SEQ ID NO: 1316765 - protein, 22 aa, Mycobacterium
GEGRPLVLVHGLMGRGSTWPRQ

SEQ ID NO: 1316766 - protein, 29 aa, Mycobacterium
GEGRRFMRLMKRPLVIPMLHLRGDSDPYV

SEQ ID NO: 1316767 - protein, 35 aa, Mycobacterium
GEGYVLESLIRGEWRPLYLFADRPQPLIDLEVGSW

SEQ ID NO: 1316768 - protein, 26 aa, Mycobacterium
GEHGVGRLKRPWLAGQLGPEAMELNR

SEQ ID NO: 1316769 - protein, 25 aa, Mycobacterium
GEHGYELLPPWDQAAVVFDALVEAV

SEQ ID NO: 1316770 - protein, 30 aa, Mycobacterium
GEIATLIFDLIPTSHLFRPGHRIRLALAGA

SEQ ID NO: 1316771 - protein, 17 aa, Mycobacterium
GEIFLDDVFVPGADVIG

SEQ ID NO: 1316772 - protein, 23 aa, Mycobacterium
GEKICAAVVFRGKPITLAELNAF

SEQ ID NO: 1316773 - protein, 27 aa, Mycobacterium
GEKKRHEILQLGLLKPKIAILDETDSG

SEQ ID NO: 1316774 - protein, 29 aa, Mycobacterium
GEKRRVALCKLLLSKPDLLLLDEPTNHLD

SEQ ID NO: 1316775 - protein, 18 aa, Mycobacterium
GEKYVGIRPAPGYPACPE

SEQ ID NO: 1316776 - protein, 22 aa, Mycobacterium
GELAGLIEWLEVTGPQGVRDHL

SEQ ID NO: 1316777 - protein, 30 aa, Mycobacterium; identical to SEQ ID NO: 815734

SEQ ID NO: 1316778 - protein, 21 aa, Mycobacterium
GELGMWLRRIGAADSPVSDVA

SEQ ID NO: 1316779 - protein, 24 aa, Mycobacterium
GELGRLWFTGTPKPGAAGTWVEMR

SEQ ID NO: 1316780 - protein, 23 aa, Mycobacterium
GELGYELWIHPNDAETLWDRVWE

SEQ ID NO: 1316781 - protein, 25 aa, Mycobacterium
GELHLFTPEVVFLLQHSTRTGRYEV

SEQ ID NO: 1316782 - protein, 20 aa, Mycobacterium
GELLAPLWEATAAAQAQGLL

SEQ ID NO: 1316783 - protein, 21 aa, Mycobacterium
GELNAFTAREHTCYYAHVLDS

SEQ ID NO: 1316784 - protein, 23 aa, Mycobacterium
GELQFDAFNWLGIKAQWSNAVVR

SEQ ID NO: 1316785 - protein, 17 aa, Mycobacterium
GELRRDLLTFLQHSVRD

SEQ ID NO: 1316786 - protein, 22 aa, Mycobacterium
GELSRVMLALEVVLSASTEGTT

SEQ ID NO: 1316787 - protein, 21 aa, Mycobacterium
GELTWCQLFSEPGAGSDLAAL

SEQ ID NO: 1316788 - protein, 19 aa, Mycobacterium
GELVELLYQAIPAPARRTG

SEQ ID NO: 1316789 - protein, 24 aa, Mycobacterium
GELVGCYRMLPPPGAIAAGGLYTA

SEQ ID NO: 1316790 - protein, 24 aa, Mycobacterium
GELVTMFHIYFLGSSEGLIFDVAN

SEQ ID NO: 1316791 - protein, 20 aa, Mycobacterium
GEMLSSLLLDATMAGLATCV

SEQ ID NO: 1316792 - protein, 24 aa, Mycobacterium
GEMSIAWVRLAAGTDLRPALVGLD

SEQ ID NO: 1316793 - protein, 20 aa, Mycobacterium
GEMVLFDRSWYNRAGVERVM

SEQ ID NO: 1316794 - protein, 24 aa, Mycobacterium
GENRWSLVGRDTLCWPYGVSLHGD

SEQ ID NO: 1316795 - protein, 25 aa, Mycobacterium
GENVLRAFTFPLEKVRVLIVGQDPY

SEQ ID NO: 1316796 - protein, 25 aa, Mycobacterium
GENVPPYLRPPVVLLDGHCPLPREV

SEQ ID NO: 1316797 - protein, 26 aa, Mycobacterium
GEPARWERWFTASAQGSWLWGDAVNP

SEQ ID NO: 1316798 - protein, 29 aa, Mycobacterium
GEPEDLVGMLLFLLSDQAKWITGQIFNVD

SEQ ID NO: 1316799 - protein, 24 aa, Mycobacterium
GEPFRTVAGVIARLALPVVSGALA

SEQ ID NO: 1316800 - protein, 24 aa, Mycobacterium
GEPHWGGTALLRPGVLAFTGSIGT

SEQ ID NO: 1316801 - protein, 18 aa, Mycobacterium
GEPIPVTSLLGFGSGMLL

SEQ ID NO: 1316802 - protein, 17 aa, Mycobacterium
GEPLGCITVWATTGHRF

SEQ ID NO: 1316803 - protein, 25 aa, Mycobacterium
GEPQPELAALWRDGKFRSEVLDAGC

SEQ ID NO: 1316804 - protein, 24 aa, Mycobacterium
GEPSIVDVSLLGSGLWALGHTVAL

SEQ ID NO: 1316805 - protein, 24 aa, Mycobacterium
GEPVPLMRRFGLDAGERIAKLLSD

SEQ ID NO: 1316806 - protein, 20 aa, Mycobacterium
GEPVSCFLLRIEDNMESIGR

SEQ ID NO: 1316807 - protein, 35 aa, Mycobacterium
GEPVTRLDLSLPANVPFRFLCIPQYETERILREEF

SEQ ID NO: 1316808 - protein, 19 aa, Mycobacterium
GEPWPVQDTVRPWDSLSDN

SEQ ID NO: 1316809 - protein, 26 aa, Mycobacterium
GEQALRVLDTLRVDIAFIGTNAISVR

SEQ ID NO: 1316810 - protein, 25 aa, Mycobacterium
GEQAPWLGLTLAAMLGQIGLPGGGF

SEQ ID NO: 1316811 - protein, 24 aa, Mycobacterium
GEQARALCLRLLTARARTRAELEA

SEQ ID NO: 1316812 - protein, 21 aa, Mycobacterium
GEQFMQWFLKEQVEEVALMTT

SEQ ID NO: 1316813 - protein, 25 aa, Mycobacterium
GEQKAKIFLALLGKQYGVTPKGWRA

SEQ ID NO: 1316814 - protein, 23 aa, Mycobacterium
GEQLDWGTYVFDFGRSEVRNFLV

SEQ ID NO: 1316815 - protein, 27 aa, Mycobacterium
GEQNRGFYHLMANLPSERLSIAIAAVA

SEQ ID NO: 1316816 - protein, 27 aa, Mycobacterium
GEQRASNFLLWQAAYAEYVFQDKLWPD

SEQ ID NO: 1316817 - protein, 30 aa, Mycobacterium
GEQRTRVRFDLLLDLAAPYPGFLVKRAKKM

SEQ ID NO: 1316818 - protein, 20 aa, Mycobacterium
GEQVQCDLWFPGQLVPGHGG

SEQ ID NO: 1316819 - protein, 19 aa, Mycobacterium
GEQWREDWPRYDAVRRRTR

SEQ ID NO: 1316820 - protein, 20 aa, Mycobacterium
GERADWWWYTPFQPPPQVAN

SEQ ID NO: 1316821 - protein, 25 aa, Mycobacterium
GERFTVLRPLLFTIAYEILGSATES

SEQ ID NO: 1316822 - protein, 22 aa, Mycobacterium
GERGFSLGHFPQSFCFATIGGF

SEQ ID NO: 1316823 - protein, 25 aa, Mycobacterium
GERIRFVVQVPARSTLWALRDEIAL

SEQ ID NO: 1316824 - protein, 20 aa, Mycobacterium
GERITDDSFLLCFNAHDEPL

SEQ ID NO: 1316825 - protein, 23 aa, Mycobacterium
GERLRIVLAEDAPLLRAGIVTVL

SEQ ID NO: 1316826 - protein, 21 aa, Mycobacterium
GERRPGWVGLPLQGVTTRLVA

SEQ ID NO: 1316827 - protein, 24 aa, Mycobacterium
GERYQVLWQLASPSSIPGATISQG

SEQ ID NO: 1316828 - protein, 26 aa, Mycobacterium
GESIEFPLRGLIQGWQDGIPGMKVGG

SEQ ID NO: 1316829 - protein, 24 aa, Mycobacterium
GESRLLFRPMPHLDPEQLAPMRPV

SEQ ID NO: 1316830 - protein, 23 aa, Mycobacterium
GETELWQLAFRVVCAHPAALDTE

SEQ ID NO: 1316831 - protein, 18 aa, Mycobacterium
GETLPVYFGNRNWDPYVE

SEQ ID NO: 1316832 - protein, 27 aa, Mycobacterium
GETLPYDMLHLVPPFRGVRWLEGSGLT

SEQ ID NO: 1316833 - protein, 29 aa, Mycobacterium
GETPYDPRMMVAVLLYGYAVGVCSSRQLE

SEQ ID NO: 1316834 - protein, 18 aa, Mycobacterium
GETRPMEAIAEMSRFLSA

SEQ ID NO: 1316835 - protein, 25 aa, Mycobacterium
GETSLVKFHWKPVAGVHSLVWEEAQ

SEQ ID NO: 1316836 - protein, 23 aa, Mycobacterium
GETTDLYYPVKDYGLDSTEGYVR

SEQ ID NO: 1316837 - protein, 21 aa, Mycobacterium
GEVFQRYFRPAVDAYPPLGGR

SEQ ID NO: 1316838 - protein, 17 aa, Mycobacterium
GEVIRNDRCAANRLSTG

SEQ ID NO: 1316839 - protein, 21 aa, Mycobacterium
GEVLDPLRRVPNGLGPKGFVG

SEQ ID NO: 1316840 - protein, 26 aa, Mycobacterium
GEVLRLRWRRGCLPVPQRVVRARVHG

SEQ ID NO: 1316841 - protein, 24 aa, Mycobacterium
GEVMRFCQSFMTELYRHLGEYTDV

SEQ ID NO: 1316842 - protein, 23 aa, Mycobacterium
GEVPLRAWFPGDDYVDVVGIDGY

SEQ ID NO: 1316843 - protein, 23 aa, Mycobacterium
GEVPQALVIERNVLEWRCDPTSD

SEQ ID NO: 1316844 - protein, 21 aa, Mycobacterium
GEVTKFLVYNARKRQAGGDTA

SEQ ID NO: 1316845 - protein, 26 aa, Mycobacterium
GEVVNWPRRRLVLSRTANGYSRILLG

SEQ ID NO: 1316846 - protein, 37 aa, Mycobacterium
GEVWGDPRWRQLSKTAQWLYLMLMSSPSRNAAGIVQM

SEQ ID NO: 1316847 - protein, 36 aa, Mycobacterium
GEWGDTHYYLIPAERLPLLMPFEQAGVPAPILAVLD

SEQ ID NO: 1316848 - protein, 38 aa, Mycobacterium
GEWGRRPFAYLGITVPKFPNFFMIYGPGTHLAHGGSLI

SEQ ID NO: 1316849 - protein, 22 aa, Mycobacterium
GEYLRDRGYFRSWGIGRHIQGS

SEQ ID NO: 1316850 - protein, 23 aa, Mycobacterium
GEYNDAMIIALKSALRAGESLPA

SEQ ID NO: 1316851 - protein, 19 aa, Mycobacterium
GEYVGALDLFRTEPGGLRA

SEQ ID NO: 1316852 - protein, 24 aa, Mycobacterium
GFAARGFGQIRTWWTATADAIEAC

SEQ ID NO: 1316853 - protein, 25 aa, Mycobacterium
GFAARGFGQIRTWWTATADAIEACE

SEQ ID NO: 1316854 - protein, 17 aa, Mycobacterium
GFADRLAEMLDGIRPGL

SEQ ID NO: 1316855 - protein, 21 aa, Mycobacterium
GFAGHRLAGAAGLGRAALGGG

SEQ ID NO: 1316856 - protein, 17 aa, Mycobacterium
GFAGMLLGSVSAAVAQS

SEQ ID NO: 1316857 - protein, 17 aa, Mycobacterium
GFARRYAVDGFDLVLVA

SEQ ID NO: 1316858 - protein, 19 aa, Mycobacterium
GFDERLLDTLLVSSLSFDL

SEQ ID NO: 1316859 - protein, 24 aa, Mycobacterium
GFDRDLWRQLANQGVLGMLVDGEY

SEQ ID NO: 1316860 - protein, 18 aa, Mycobacterium
GFDRKRLLHGEQEYTFHG

SEQ ID NO: 1316861 - protein, 20 aa, Mycobacterium
GFEAEGVLWSWTLDLATGTV

SEQ ID NO: 1316862 - protein, 26 aa, Mycobacterium
GFEAVYLRNGGVVLQLLTFSGHPAPG

SEQ ID NO: 1316863 - protein, 27 aa, Mycobacterium
GFEERMQAARWLRGYLRELIARRRRDP

SEQ ID NO: 1316864 - protein, 20 aa, Mycobacterium
GFEFGFDPRGGFGFGPGPRG

SEQ ID NO: 1316865 - protein, 29 aa, Mycobacterium
GFEGGWPGFFAVLRLYLRDFAGQPAAPVR

SEQ ID NO: 1316866 - protein, 18 aa, Mycobacterium
GFERFYGFMGGETDQWYP

SEQ ID NO: 1316867 - protein, 26 aa, Mycobacterium
GFGAEVKRRIMIGTYALSAGYYDAYY

SEQ ID NO: 1316868 - protein, 25 aa, Mycobacterium
GFGKTNLIEALWYSATLGSHRVASD

SEQ ID NO: 1316869 - protein, 23 aa, Mycobacterium
GFGTEWWAGDLEMLAGTSVGGVM

SEQ ID NO: 1316870 - protein, 20 aa, Mycobacterium
GFHLRPVVRPVVLVAGGTGL

SEQ ID NO: 1316871 - protein, 17 aa, Mycobacterium
GFIDTPMLRKAEQRGFL

SEQ ID NO: 1316872 - protein, 26 aa, Mycobacterium
GFKVPKQFHQISRIPLLANGKPDRSR

SEQ ID NO: 1316873 - protein, 18 aa, Mycobacterium
GFKVPRYVEFLDELPLNA

SEQ ID NO: 1316874 - protein, 18 aa, Mycobacterium
GFKWLSRADDDLPGKTMV

SEQ ID NO: 1316875 - protein, 19 aa, Mycobacterium
GFKWLSRADDDLPGKTMVY

SEQ ID NO: 1316876 - protein, 17 aa, Mycobacterium
GFLGRYLALEWLERMAL

SEQ ID NO: 1316877 - protein, 22 aa, Mycobacterium
GFLPINPIMRLFCRTLGTPQVA

SEQ ID NO: 1316878 - protein, 23 aa, Mycobacterium
GFMGLGMIYTAMPVTNAVPAVVA

SEQ ID NO: 1316879 - protein, 20 aa, Mycobacterium
GFNHNTWGVAMLGNFDVVPP

SEQ ID NO: 1316880 - protein, 25 aa, Mycobacterium
GFNQVALAIMPAWGGAERLVKLVGY

SEQ ID NO: 1316881 - protein, 19 aa, Mycobacterium
GFPEFPLPLGNPQEATRSS

SEQ ID NO: 1316882 - protein, 26 aa, Mycobacterium
GFPIAKIAAKLAIGYTLDEIVNDITK

SEQ ID NO: 1316883 - protein, 24 aa, Mycobacterium
GFPSPAEFVAAFEAALEGVIPGLT

SEQ ID NO: 1316884 - protein, 20 aa, Mycobacterium
GFPVILGPDHPVTGGYPVIG

SEQ ID NO: 1316885 - protein, 21 aa, Mycobacterium
GFQRLARLRYVPLAGGDVSVL

SEQ ID NO: 1316886 - protein, 17 aa, Mycobacterium
GFQWVVEAKARGTEVVH

SEQ ID NO: 1316887 - protein, 17 aa, Mycobacterium
GFRFSMFTLPPGAAAAS

SEQ ID NO: 1316888 - protein, 32 aa, Mycobacterium
GFRGVLTELAAHLRPWVPVVSLVKGLEQGTNY

SEQ ID NO: 1316889 - protein, 28 aa, Mycobacterium
GFRLGITTEWKSRWYADKQYADYIKEDV

SEQ ID NO: 1316890 - protein, 19 aa, Mycobacterium
GFRNPFTESPAVGPLAILV

SEQ ID NO: 1316891 - protein, 20 aa, Mycobacterium
GFRPSKVAFLAFHAWSDASH

SEQ ID NO: 1316892 - protein, 24 aa, Mycobacterium
GFRRQYLATAEEFLRIVIARGEDL

SEQ ID NO: 1316893 - protein, 34 aa, Mycobacterium; identical to SEQ ID NO: 816175

SEQ ID NO: 1316894 - protein, 26 aa, Mycobacterium
GFRTKTFDFLLSNPPFRKMSVCCGRF

SEQ ID NO: 1316895 - protein, 18 aa, Mycobacterium
GFSMTFWQYLDAVSDAEP

SEQ ID NO: 1316896 - protein, 34 aa, Mycobacterium
GFTADFPFLSDIHLWVRLLGCGDFYGIPATHASF

SEQ ID NO: 1316897 - protein, 25 aa, Mycobacterium
GFTAPLNWYRCFDLNWELTADPPAP

SEQ ID NO: 1316898 - protein, 27 aa, Mycobacterium
GFTEFVPLPFVHQSSPLYLAGGSRPGP

SEQ ID NO: 1316899 - protein, 17 aa, Mycobacterium
GFTPMVYERYSQPFFDG

SEQ ID NO: 1316900 - protein, 27 aa, Mycobacterium
GFTVNHRFGFPELPPPYVVAQVAIDED

SEQ ID NO: 1316901 - protein, 19 aa, Mycobacterium
GFTVWAPSLFGTPGAPALG

SEQ ID NO: 1316902 - protein, 22 aa, Mycobacterium
GFTWEHPAHIFLRRARTGLHLF

SEQ ID NO: 1316903 - protein, 21 aa, Mycobacterium
GFVIPLPYGTDVDWLRNVVTA

SEQ ID NO: 1316904 - protein, 19 aa, Mycobacterium
GFVLVNPLHAAAPVAPMEP

SEQ ID NO: 1316905 - protein, 26 aa, Mycobacterium
GFVVVPWAAVDAWWEEGRRLVHYPPN

SEQ ID NO: 1316906 - protein, 23 aa, Mycobacterium
GFYRHWLDMLTGKPWSEIQKWTP

SEQ ID NO: 1316907 - protein, 20 aa, Mycobacterium
GFYSYWLLERAVGAGIHNAD

SEQ ID NO: 1316908 - protein, 21 aa, Mycobacterium
GFYVEPTVIGGLRQADRLIQQ

SEQ ID NO: 1316909 - protein, 18 aa, Mycobacterium
GGAAFSKHLPIERNFRDA

SEQ ID NO: 1316910 - protein, 20 aa, Mycobacterium
GGAAGLLWGSGGDGGAGGAG

SEQ ID NO: 1316911 - protein, 24 aa, Mycobacterium
GGADWVVMSGSLPPGVPASWYGDV

SEQ ID NO: 1316912 - protein, 26 aa, Mycobacterium
GGAERLVKLVGYSRALLLAGTGRILD

SEQ ID NO: 1316913 - protein, 25 aa, Mycobacterium
GGAFLDWEGRLRSFGPALLSNAIPD

SEQ ID NO: 1316914 - protein, 32 aa, Mycobacterium
GGAGGQAGVAGKGGLFGGSGSAGTAGVTGASG

SEQ ID NO: 1316915 - protein, 25 aa, Mycobacterium
GGALAITVPRWLPERICWALSDEYH

SEQ ID NO: 1316916 - protein, 23 aa, Mycobacterium
GGALRGLFEFKTGLRPPVPLHEV

SEQ ID NO: 1316917 - protein, 18 aa, Mycobacterium
GGALTLIGLHHLADRLLS

SEQ ID NO: 1316918 - protein, 22 aa, Mycobacterium
GGALYADLPRDFPSAVKHRLGE

SEQ ID NO: 1316919 - protein, 26 aa, Mycobacterium
GGAMVAAPARILRLGRTADLGPQVLA

SEQ ID NO: 1316920 - protein, 21 aa, Mycobacterium
GGAPDFMKSLPGRALAGIAGA

SEQ ID NO: 1316921 - protein, 28 aa, Mycobacterium
GGARALEWMMLHPDSVRAALVLAVGARA

SEQ ID NO: 1316922 - protein, 20 aa, Mycobacterium
GGARRYCAIGLLTVGDEGRM

SEQ ID NO: 1316923 - protein, 25 aa, Mycobacterium
GGARTLGCAFALVDPLPTAERKDGL

SEQ ID NO: 1316924 - protein, 29 aa, Mycobacterium
GGARTRFCVWSPPWLGWLSTGCESPLPPA

SEQ ID NO: 1316925 - protein, 22 aa, Mycobacterium
GGATWMLQRAIGPQAARAALLF

SEQ ID NO: 1316926 - protein, 21 aa, Mycobacterium
GGAWQSFWAAGSYIGGTCTYN

SEQ ID NO: 1316927 - protein, 31 aa, Mycobacterium
GGAYKTWMDAEWWRLRVLPELGGTDAPNSLN

SEQ ID NO: 1316928 - protein, 24 aa, Mycobacterium
GGCHLTWIMALKPNGPAGRFGLAA

SEQ ID NO: 1316929 - protein, 18 aa, Mycobacterium
GGCYLLPRRIGMQKAKEM

SEQ ID NO: 1316930 - protein, 24 aa, Mycobacterium
GGDFAAWRTFLHPEQRKYVDLDFS

SEQ ID NO: 1316931 - protein, 27 aa, Mycobacterium
GGDGGFHQLAWWVDDYDAALRSAGAAG

SEQ ID NO: 1316932 - protein, 22 aa, Mycobacterium
GGDHLMLMDLTAPLTPGSDVEI

SEQ ID NO: 1316933 - protein, 22 aa, Mycobacterium
GGDLLLHLRFDDAADWTAVAAD

SEQ ID NO: 1316934 - protein, 25 aa, Mycobacterium
GGDPHGPLQTLCRSCNGRKNATRQN

SEQ ID NO: 1316935 - protein, 28 aa, Mycobacterium
GGDTELLTLDQWNAIIDINLRGVVHGVA

SEQ ID NO: 1316936 - protein, 23 aa, Mycobacterium
GGDTPYLAHLLGVAALVIDDGGT

SEQ ID NO: 1316937 - protein, 25 aa, Mycobacterium
GGEESLYLRPFIIATEPGLGVRPAS

SEQ ID NO: 1316938 - protein, 18 aa, Mycobacterium
GGEFQALGFGRQFGGLPE

SEQ ID NO: 1316939 - protein, 25 aa, Mycobacterium
GGEGALVGVWRRAPLQAIARLHALA

SEQ ID NO: 1316940 - protein, 24 aa, Mycobacterium
GGEGKRLYPLTADRAKPAVPFGGG

SEQ ID NO: 1316941 - protein, 23 aa, Mycobacterium
GGELSRVMLAIEVVLAASAEGTT

SEQ ID NO: 1316942 - protein, 25 aa, Mycobacterium
GGELSSFYMWGMTPLHEAVVQARGQ

SEQ ID NO: 1316943 - protein, 37 aa, Mycobacterium
GGEVLLMDYLVHQRRLFPLIARSYALQFAQNELVAKC

SEQ ID NO: 1316944 - protein, 30 aa, Mycobacterium
GGFCYGYHGDLDLLGHLYGPGSTAWRLQLR

SEQ ID NO: 1316945 - protein, 17 aa, Mycobacterium
GGFFPSSREYSVRYGLS

SEQ ID NO: 1316946 - protein, 23 aa, Mycobacterium
GGFFSFGIMHYYLTGMHTPGRTG

SEQ ID NO: 1316947 - protein, 17 aa, Mycobacterium
GGFGPGGFGPGFGGFGP

SEQ ID NO: 1316948 - protein, 18 aa, Mycobacterium
GGFHYRIEIYTPAAKRRF

SEQ ID NO: 1316949 - protein, 17 aa, Mycobacterium
GGFIRRLPGPAVEVDVV

SEQ ID NO: 1316950 - protein, 24 aa, Mycobacterium
GGFPKAFIRFEGAAPGRLSFSVRT

SEQ ID NO: 1316951 - protein, 21 aa, Mycobacterium
GGFPPIRTWHEPNLRNPGGGA

SEQ ID NO: 1316952 - protein, 17 aa, Mycobacterium
GGFTKTIDLYLNGTYNL

SEQ ID NO: 1316953 - protein, 29 aa, Mycobacterium
GGFVVPFLHPDVVWDFRLPRVVSINVSGH

SEQ ID NO: 1316954 - protein, 24 aa, Mycobacterium
GGGDLLTALLGKKITAGTSSPGEL

SEQ ID NO: 1316955 - protein, 17 aa, Mycobacterium
GGGFPEFPLPLGNPQEA

SEQ ID NO: 1316956 - protein, 23 aa, Mycobacterium
GGGGAPMMLPPGSMGPPAGAPPP

SEQ ID NO: 1316957 - protein, 18 aa, Mycobacterium
GGGGWILGHLIDGTQAEY

SEQ ID NO: 1316958 - protein, 22 aa, Mycobacterium
GGGPDWLIAPAIGYGASGEHEG

SEQ ID NO: 1316959 - protein, 27 aa, Mycobacterium
GGGPPMGPIPAPKPWHRSIDPPVKGGG

SEQ ID NO: 1316960 - protein, 38 aa, Mycobacterium
GGGRASVLFGGGKLPPHLEWVAPFGALSAANWLAMPAQ

SEQ ID NO: 1316961 - protein, 25 aa, Mycobacterium
GGGRIVTAFPFRLIEVWQSHRAPVE

SEQ ID NO: 1316962 - protein, 21 aa, Mycobacterium
GGGRRPLITEALRGEGAKLID

SEQ ID NO: 1316963 - protein, 24 aa, Mycobacterium
GGGSMFLLVGVLSALYERERSGKG

SEQ ID NO: 1316964 - protein, 18 aa, Mycobacterium
GGGSPLDALTGAAAPLAG

SEQ ID NO: 1316965 - protein, 25 aa, Mycobacterium
GGGVQYYFTQPIVDLVNAGYLREVP

SEQ ID NO: 1316966 - protein, 17 aa, Mycobacterium
GGGWFGYLSYPDGGADG

SEQ ID NO: 1316967 - protein, 21 aa, Mycobacterium
GGHAFWNEADPQRKADERRAF

SEQ ID NO: 1316968 - protein, 23 aa, Mycobacterium
GGHRMLANWLGFCGAAPDEALVR

SEQ ID NO: 1316969 - protein, 17 aa, Mycobacterium
GGHRPDFGALYRRPGRA

SEQ ID NO: 1316970 - protein, 30 aa, Mycobacterium
GGHSERFLTQFPALRLIGLDRDPDALHIAG

SEQ ID NO: 1316971 - protein, 17 aa, Mycobacterium
GGIDYPLVPGHEIAGIV

SEQ ID NO: 1316972 - protein, 18 aa, Mycobacterium
GGIPMTVPALTVNKVCLS

SEQ ID NO: 1316973 - protein, 17 aa, Mycobacterium
GGIPYAIAKSLAAAPFA

SEQ ID NO: 1316974 - protein, 26 aa, Mycobacterium
GGISRLRFRLRWRGFRVTVDADHDAV

SEQ ID NO: 1316975 - protein, 26 aa, Mycobacterium
GGITSDRLYPLRLQAELAELLPGCDG

SEQ ID NO: 1316976 - protein, 24 aa, Mycobacterium
GGIVFRVQQELGVPVKLVGLGEGP

SEQ ID NO: 1316977 - protein, 23 aa, Mycobacterium
GGKALKFYASVRMDVRRIETLKD

SEQ ID NO: 1316978 - protein, 23 aa, Mycobacterium
GGKDPMIVLEDADIDLAAHAAVW

SEQ ID NO: 1316979 - protein, 26 aa, Mycobacterium
GGKELPVVGFIWEVLGRIGLGRKDAI

SEQ ID NO: 1316980 - protein, 31 aa, Mycobacterium
GGKGGNGGNGGRGSLFGRGGNAGNGGNGGTG

SEQ ID NO: 1316981 - protein, 21 aa, Mycobacterium
GGLEMALGCDFLIASERAVFA

SEQ ID NO: 1316982 - protein, 23 aa, Mycobacterium
GGLFPMDVPIFASGFYEKFGYDR

SEQ ID NO: 1316983 - protein, 21 aa, Mycobacterium
GGLGAFMNWPGPTFTDSGGFQ

SEQ ID NO: 1316984 - protein, 20 aa, Mycobacterium
GGLGDVFEAFFGGGATSRGP

SEQ ID NO: 1316985 - protein, 26 aa, Mycobacterium
GGLGGFAGLFALRGDYREPLLASSTD

SEQ ID NO: 1316986 - protein, 29 aa, Mycobacterium
GGLGQLTFPRYGALTYPKRMRTEALAHLD

SEQ ID NO: 1316987 - protein, 21 aa, Mycobacterium
GGLGTFSWPGAYGTWWQADPT

SEQ ID NO: 1316988 - protein, 18 aa, Mycobacterium
GGLGVRGLNQPSGGTELA

SEQ ID NO: 1316989 - protein, 19 aa, Mycobacterium
GGLIRWLRRAARGDQTWAI

SEQ ID NO: 1316990 - protein, 21 aa, Mycobacterium
GGLLGLGALSALGAPTPDVVL

SEQ ID NO: 1316991 - protein, 34 aa, Mycobacterium
GGLLNPNHYLAVAIDYLFTHRPEWATGTAVGKTA

SEQ ID NO: 1316992 - protein, 20 aa, Mycobacterium
GGLPRRATVAALDDLLSRLA

SEQ ID NO: 1316993 - protein, 17 aa, Mycobacterium
GGLSACHPGQRGLFLLV

SEQ ID NO: 1316994 - protein, 27 aa, Mycobacterium
GGLTMYGGFLSSLKVRACKFPDGGTLS

SEQ ID NO: 1316995 - protein, 20 aa, Mycobacterium
GGLTVRRKAGRLANLEAALA

SEQ ID NO: 1316996 - protein, 23 aa, Mycobacterium
GGMALPDGYLKQVYAAVRAGGGL

SEQ ID NO: 1316997 - protein, 20 aa, Mycobacterium
GGMALRFARVLCYRDDKTAA

SEQ ID NO: 1316998 - protein, 18 aa, Mycobacterium
GGMLAWAGAGRPVVTDGG

SEQ ID NO: 1316999 - protein, 27 aa, Mycobacterium
GGMLSPMAPLAPLLPAAADIGLHLVVT

SEQ ID NO: 1317000 - protein, 35 aa, Mycobacterium
GGMQFQARTALPSRLIRLPAALVRSQLASPAGLAF

SEQ ID NO: 1317001 - protein, 25 aa, Mycobacterium
GGMQNKLIEYLAMGKAIVATPVANE

SEQ ID NO: 1317002 - protein, 24 aa, Mycobacterium
GGMVRTVSWLYLGQTMVIHQRFDP

SEQ ID NO: 1317003 - protein, 25 aa, Mycobacterium
GGNHAFYLSIPPKAFPVVCEQLRRS

SEQ ID NO: 1317004 - protein, 22 aa, Mycobacterium
GGNHAFYLSIPPNAFPVVCEQL

SEQ ID NO: 1317005 - protein, 37 aa, Mycobacterium
GGPAPLDRLLRLVPARLATAPWWLRAVDPVASRLVRG

SEQ ID NO: 1317006 - protein, 28 aa, Mycobacterium
GGPATIVPMFLLYDYSFLPQGAGTKAEG

SEQ ID NO: 1317007 - protein, 23 aa, Mycobacterium
GGPDLVRGIFPTAVVIGADGAHE

SEQ ID NO: 1317008 - protein, 23 aa, Mycobacterium
GGPDTLLLLQHPAVYTAGRRTLP

SEQ ID NO: 1317009 - protein, 20 aa, Mycobacterium
GGPFEGATLLLLHTTGAKSG

SEQ ID NO: 1317010 - protein, 25 aa, Mycobacterium
GGPGGATRPAWSPTGAPGAGGAGGA

SEQ ID NO: 1317011 - protein, 25 aa, Mycobacterium
GGPGIATLLLSRPPTNALTRQVHRE

SEQ ID NO: 1317012 - protein, 22 aa, Mycobacterium
GGPGMQEMLYPTSYLKGRGLAT

SEQ ID NO: 1317013 - protein, 20 aa, Mycobacterium
GGPHDIAAGQITLFVGGDAT

SEQ ID NO: 1317014 - protein, 18 aa, Mycobacterium
GGPITRIQLGPKKLMPPI

SEQ ID NO: 1317015 - protein, 20 aa, Mycobacterium
GGPLWAGFIEMPSAAKRTDG

SEQ ID NO: 1317016 - protein, 25 aa, Mycobacterium
GGPVAKFDFIPSKKAPPFWTGESVV

SEQ ID NO: 1317017 - protein, 29 aa, Mycobacterium
GGPVDLRHLNLWWTWTPGASWRHPVGPAS

SEQ ID NO: 1317018 - protein, 25 aa, Mycobacterium
GGQLLDWLQHCIFPAEAKLADRDYA

SEQ ID NO: 1317019 - protein, 20 aa, Mycobacterium
GGQRLLFSATLDNGVDKLVR

SEQ ID NO: 1317020 - protein, 27 aa, Mycobacterium
GGQRRRLQLMLVLLSEPNVLVLDEPTN

SEQ ID NO: 1317021 - protein, 24 aa, Mycobacterium
GGRAAIVLGDWPARTPATGQLPAG

SEQ ID NO: 1317022 - protein, 19 aa, Mycobacterium
GGRALLTGAGGDGGDGGTG

SEQ ID NO: 1317023 - protein, 17 aa, Mycobacterium
GGRATNVIPAHAALRYS

SEQ ID NO: 1317024 - protein, 35 aa, Mycobacterium
GGRAVVMTYWNPVLRWGIDAFARDLAAAGGLGLIT

SEQ ID NO: 1317025 - protein, 26 aa, Mycobacterium
GGRAVVMTYWNPVLSKGVDAFARDLA

SEQ ID NO: 1317026 - protein, 23 aa, Mycobacterium
GGRDRWQYLPFGAGPRSCIGDHF

SEQ ID NO: 1317027 - protein, 26 aa, Mycobacterium
GGRHRGFVVVRWLDNPAAPVVRTTVR

SEQ ID NO: 1317028 - protein, 24 aa, Mycobacterium
GGRLNKLLNIFSNPKLPSINDYYE

SEQ ID NO: 1317029 - protein, 19 aa, Mycobacterium
GGRLVIIGMQGGAKAELNI

SEQ ID NO: 1317030 - protein, 27 aa, Mycobacterium
GGRMDWAQTFASWRLHELRGVPTALQA

SEQ ID NO: 1317031 - protein, 23 aa, Mycobacterium
GGRNMKSGYWPSHAMSGAIISTL

SEQ ID NO: 1317032 - protein, 25 aa, Mycobacterium
GGRPDRWPLPPPADAHDLWLRAVAA

SEQ ID NO: 1317033 - protein, 24 aa, Mycobacterium
GGRPLTPLVYEPVPEWITGMAVAM

SEQ ID NO: 1317034 - protein, 21 aa, Mycobacterium
GGRPPGLYEIPFGTAAAELIA

SEQ ID NO: 1317035 - protein, 18 aa, Mycobacterium
GGRPPMPALADAFAALVE

SEQ ID NO: 1317036 - protein, 28 aa, Mycobacterium
GGRQWCFERLFLVVAFVNRFIPGFIRQG

SEQ ID NO: 1317037 - protein, 24 aa, Mycobacterium
GGRTLVTVSPLQPPERLSADLTAA

SEQ ID NO: 1317038 - protein, 17 aa, Mycobacterium
GGRVNMGPIVNAPLRTV

SEQ ID NO: 1317039 - protein, 24 aa, Mycobacterium
GGRYLVEHFVDFWDRVLAESDFTA

SEQ ID NO: 1317040 - protein, 28 aa, Mycobacterium
GGSAVRLPRQIPYTIACDLLLTGRHITA

SEQ ID NO: 1317041 - protein, 31 aa, Mycobacterium
GGSGPNAFDCSGLVMWAFQQEGISLPHSSQA

SEQ ID NO: 1317042 - protein, 27 aa, Mycobacterium
GGSGPNPLILLKGLVRTLVGLPSAAPA

SEQ ID NO: 1317043 - protein, 22 aa, Mycobacterium
GGSIPFIAEFAAAFPDAKILVT

SEQ ID NO: 1317044 - protein, 26 aa, Mycobacterium
GGSKVPLPLVRKALSLLPAVGFVNAY

SEQ ID NO: 1317045 - protein, 28 aa, Mycobacterium
GGSLDITAFRKLGNRFLLGVFNSLYDSD

SEQ ID NO: 1317046 - protein, 26 aa, Mycobacterium
GGSLHEPVLTVAWPGAHLGPMGLEGA

SEQ ID NO: 1317047 - protein, 24 aa, Mycobacterium
GGSLLPMPDLIRLAARAHHYLYVY

SEQ ID NO: 1317048 - protein, 25 aa, Mycobacterium
GGSLVTGWATLHGYPLGILANARGV

SEQ ID NO: 1317049 - protein, 24 aa, Mycobacterium
GGSNRDWWPNAVNLKMLQKDPEVI

SEQ ID NO: 1317050 - protein, 23 aa, Mycobacterium
GGSPIAAALLERASKRLPTASFV

SEQ ID NO: 1317051 - protein, 17 aa, Mycobacterium
GGSPRWGRWRDAIGVGA

SEQ ID NO: 1317052 - protein, 18 aa, Mycobacterium
GGSWAFGYVGSVVGEVLC

SEQ ID NO: 1317053 - protein, 22 aa, Mycobacterium
GGTAGIDLALALVGDDFGAAVA

SEQ ID NO: 1317054 - protein, 26 aa, Mycobacterium
GGTPWPERRLPVPLIVALIGTHAADT

SEQ ID NO: 1317055 - protein, 19 aa, Mycobacterium
GGTRNGTIVHWPNGIAAKG

SEQ ID NO: 1317056 - protein, 25 aa, Mycobacterium
GGTSWRRFILPMADARAVAAAILLA

SEQ ID NO: 1317057 - protein, 23 aa, Mycobacterium
GGTYKTFTVLALACSVAAGRDFT

SEQ ID NO: 1317058 - protein, 22 aa, Mycobacterium
GGVALIERLGVRGTPITPAMRF

SEQ ID NO: 1317059 - protein, 31 aa, Mycobacterium
GGVFRIVEQLPRKVALELIFTGEPMSSADAL

SEQ ID NO: 1317060 - protein, 28 aa, Mycobacterium
GGVFRIVEQLPRKVALELIYTGEPISSA

SEQ ID NO: 1317061 - protein, 26 aa, Mycobacterium
GGVNVILTPVPMINLTRARMLAPDGR

SEQ ID NO: 1317062 - protein, 24 aa, Mycobacterium
GGVPVVMKALLDAGLLHGDCLTVT

SEQ ID NO: 1317063 - protein, 23 aa, Mycobacterium
GGVPVVMKALLDAGLMHGDCLTV

SEQ ID NO: 1317064 - protein, 32 aa, Mycobacterium
GGVRIDHIIGLFRLWWIPKGALPTEGTYVRYD

SEQ ID NO: 1317065 - protein, 30 aa, Mycobacterium
GGVRLAPACAPDIGWWTGSRLVADPAARAA

SEQ ID NO: 1317066 - protein, 17 aa, Mycobacterium
GGWITGGAELPEWNGTA

SEQ ID NO: 1317067 - protein, 21 aa, Mycobacterium
GGWRERIALHQLYPLLAHVVL

SEQ ID NO: 1317068 - protein, 25 aa, Mycobacterium
GGWSRRPLPLPDMCYAAAATGDPDL

SEQ ID NO: 1317069 - protein, 23 aa, Mycobacterium
GGWSVGAVALVAGWAARNSPPAT

SEQ ID NO: 1317070 - protein, 22 aa, Mycobacterium
GGWSVGAVALVAGWAARQGDSG

SEQ ID NO: 1317071 - protein, 23 aa, Mycobacterium
GGWSVGAVALVAGWAARQGDSGT

SEQ ID NO: 1317072 - protein, 32 aa, Mycobacterium
GGYFRFDAANAPLLVALLPPLILVRADQPGAQ

SEQ ID NO: 1317073 - protein, 21 aa, Mycobacterium
GGYSGALWPAAAVAAGDGVDV

SEQ ID NO: 1317074 - protein, 30 aa, Mycobacterium; identical to SEQ ID NO: 817085

SEQ ID NO: 1317075 - protein, 23 aa, Mycobacterium
GHAVTPLVERTWPAVIRVARRLY

SEQ ID NO: 1317076 - protein, 29 aa, Mycobacterium
GHAYAGELLFLYNGVRPRNVMPVHGTWRM

SEQ ID NO: 1317077 - protein, 25 aa, Mycobacterium
GHDRLRLALVLCAVRPDIGGVLIRG

SEQ ID NO: 1317078 - protein, 30 aa, Mycobacterium
GHDWGAPVAWTFAWLHPQRCRGVVGVSVPF

SEQ ID NO: 1317079 - protein, 34 aa, Mycobacterium
GHDYAVISLSDRLKPWDIIARRLTAAAAADMVLA

SEQ ID NO: 1317080 - protein, 23 aa, Mycobacterium
GHEGFAMLGPYSATKFAVRALTQ

SEQ ID NO: 1317081 - protein, 17 aa, Mycobacterium
GHELKFWTPGGSSTPLL

SEQ ID NO: 1317082 - protein, 26 aa, Mycobacterium
GHEVGWSMLPLARTALRRIGNDTDVV

SEQ ID NO: 1317083 - protein, 22 aa, Mycobacterium
GHEWEFVVLAGVQEGLWPNVSP

SEQ ID NO: 1317084 - protein, 18 aa, Mycobacterium
GHFALTNLLLPKISDRVV

SEQ ID NO: 1317085 - protein, 27 aa, Mycobacterium
GHFGQSGTFLWVDPDAALALVVLTDRK

SEQ ID NO: 1317086 - protein, 22 aa, Mycobacterium
GHFGRTDIELPWEQLDKVDDLK

SEQ ID NO: 1317087 - protein, 24 aa, Mycobacterium
GHFPDPVIFLKPNTSIIGPNIPIQ

SEQ ID NO: 1317088 - protein, 26 aa, Mycobacterium
GHGEEFVRRLWWRATVDLPDDPLLHT

SEQ ID NO: 1317089 - protein, 24 aa, Mycobacterium
GHGRSGFLLAPWTAESIAAELEGA

SEQ ID NO: 1317090 - protein, 32 aa, Mycobacterium
GHHRLHLLNRGDIPARVLLLGGTPFTEDLVMW

SEQ ID NO: 1317091 - protein, 24 aa, Mycobacterium
GHIAVLIYNDKQWHAFIDAVKPAW

SEQ ID NO: 1317092 - protein, 21 aa, Mycobacterium
GHIAWLQKGWPELFDRLTRAL

SEQ ID NO: 1317093 - protein, 23 aa, Mycobacterium
GHICPISMTYAVVPALRHNPELA

SEQ ID NO: 1317094 - protein, 26 aa, Mycobacterium
GHIQSPRLVLLDLLGDLLTVIADFLG

SEQ ID NO: 1317095 - protein, 17 aa, Mycobacterium
GHIRPDATLHPRPAHEP

SEQ ID NO: 1317096 - protein, 25 aa, Mycobacterium
GHLALLRRLMMDDNWYRGELIFVFD

SEQ ID NO: 1317097 - protein, 26 aa, Mycobacterium
GHLDPTMFAAFMPGVLELTVEEGIAN

SEQ ID NO: 1317098 - protein, 20 aa, Mycobacterium
GHLDPTVFQRLAPGIMPLSV

SEQ ID NO: 1317099 - protein, 17 aa, Mycobacterium
GHLGPLLNLARGLVDRG

SEQ ID NO: 1317100 - protein, 27 aa, Mycobacterium
GHLRESMAFHRWLIERALSEDNPLIPT

SEQ ID NO: 1317101 - protein, 28 aa, Mycobacterium
GHLSALLYGIPHVLTAHSLEPMRPWKAE

SEQ ID NO: 1317102 - protein, 18 aa, Mycobacterium
GHLSARLTALGPAATLAR

SEQ ID NO: 1317103 - protein, 19 aa, Mycobacterium
GHNPIGIIVPCHRVIGANG

SEQ ID NO: 1317104 - protein, 25 aa, Mycobacterium
GHNYIGTEHILLGLIREGEGVAAQV

SEQ ID NO: 1317105 - protein, 18 aa, Mycobacterium
GHNYVGTEHLLLALYEEE

SEQ ID NO: 1317106 - protein, 20 aa, Mycobacterium
GHPAWFEPAEWLGGPRAERY

SEQ ID NO: 1317107 - protein, 25 aa, Mycobacterium
GHPDLPVPPTFLFSIELEAPDPFSY

SEQ ID NO: 1317108 - protein, 22 aa, Mycobacterium
GHPGIVAPPAMIQVWTMGGLGQ

SEQ ID NO: 1317109 - protein, 22 aa, Mycobacterium
GHPIPPSWFTHGVEFVMDRWQI

SEQ ID NO: 1317110 - protein, 21 aa, Mycobacterium
GHPLGIIDIRCSGGLITGITI

SEQ ID NO: 1317111 - protein, 24 aa, Mycobacterium
GHPTVGAAWWLRENGLPVHTLQVP

SEQ ID NO: 1317112 - protein, 18 aa, Mycobacterium
GHPVIRSFEPGEDWFWNF

SEQ ID NO: 1317113 - protein, 25 aa, Mycobacterium
GHQEDLLGWARVLDSLGRICDPLAH

SEQ ID NO: 1317114 - protein, 18 aa, Mycobacterium
GHQLPLVCTLNGAPVLAT

SEQ ID NO: 1317115 - protein, 27 aa, Mycobacterium
GHRARRRIYWLSLPLDYGLAGRTPSGT

SEQ ID NO: 1317116 - protein, 26 aa, Mycobacterium
GHRDPRWTYWYLSAAPELLAVAASRL

SEQ ID NO: 1317117 - protein, 18 aa, Mycobacterium
GHRIPLPGVAPSLLLHTV

SEQ ID NO: 1317118 - protein, 19 aa, Mycobacterium
GHRWASRPVSMICAAGQPM

SEQ ID NO: 1317119 - protein, 27 aa, Mycobacterium
GHSSLTLYIQLYLGGFGLELSDIESLR

SEQ ID NO: 1317120 - protein, 22 aa, Mycobacterium
GHTAFLISARRLAPGTVAPIPL

SEQ ID NO: 1317121 - protein, 19 aa, Mycobacterium
GHTARILLAKNPAGWQEAL

SEQ ID NO: 1317122 - protein, 25 aa, Mycobacterium
GHTRSAIIQMLLQGPVTASAIGERL

SEQ ID NO: 1317123 - protein, 22 aa, Mycobacterium
GHTVFLIVPGPHPERVTLPSGV

SEQ ID NO: 1317124 - protein, 22 aa, Mycobacterium
GHVALPPPLTTGGPPIWIGGNS

SEQ ID NO: 1317125 - protein, 19 aa, Mycobacterium
GHVQKAFMKLIESGDLTPT

SEQ ID NO: 1317126 - protein, 17 aa, Mycobacterium
GHVSGLIALVHPQAFLA

SEQ ID NO: 1317127 - protein, 17 aa, Mycobacterium
GHWPKPRHGWTLTIEGD

SEQ ID NO: 1317128 - protein, 23 aa, Mycobacterium
GHYSFLNVFKLFGPGNDAPLSFP

SEQ ID NO: 1317129 - protein, 18 aa, Mycobacterium
GIAFLLNRNRLNVAVSRA

SEQ ID NO: 1317130 - protein, 26 aa, Mycobacterium
GIARRTLFRYYPSKSALPWGDFDAHL

SEQ ID NO: 1317131 - protein, 18 aa, Mycobacterium
GIARYARCERLLAAAPGV

SEQ ID NO: 1317132 - protein, 18 aa, Mycobacterium
GIATYTDLPLLLPRGVLA

SEQ ID NO: 1317133 - protein, 17 aa, Mycobacterium
GIAVCWRCGGPCLTYKG

SEQ ID NO: 1317134 - protein, 18 aa, Mycobacterium
GICFGNQILGRALGLSTY

SEQ ID NO: 1317135 - protein, 30 aa, Mycobacterium
GIDARLSRYSYLVSLLPRRIVDDLGARIRL

SEQ ID NO: 1317136 - protein, 25 aa, Mycobacterium
GIDKTILLPHFGAVWGRYVYDRLDI

SEQ ID NO: 1317137 - protein, 19 aa, Mycobacterium
GIDPYFDDLFLMSAQNRLM

SEQ ID NO: 1317138 - protein, 17 aa, Mycobacterium
GIDRRDWPLFRTVFTDD

SEQ ID NO: 1317139 - protein, 23 aa, Mycobacterium
GIDVTPENMAWFAKSKPGHNIGL

SEQ ID NO: 1317140 - protein, 19 aa, Mycobacterium
GIELLTLDELLGRADFISV

SEQ ID NO: 1317141 - protein, 32 aa, Mycobacterium
GIELYAQFAARPFGMLLGFPGYHAFTHRPTFR

SEQ ID NO: 1317142 - protein, 28 aa, Mycobacterium
GIENTDVVLWYVFGIHHITRPEDWPVMP

SEQ ID NO: 1317143 - protein, 34 aa, Mycobacterium
GIEPGDRVAIWSPNTWHWVVACLAIHHAGGVLVP

SEQ ID NO: 1317144 - protein, 24 aa, Mycobacterium
GIEPNIPTLPFLSTVTGADSAPVL

SEQ ID NO: 1317145 - protein, 25 aa, Mycobacterium
GIEQVWFRDGWVDRFALDLPRDAHG

SEQ ID NO: 1317146 - protein, 17 aa, Mycobacterium
GIERVKASLPRLGELAI

SEQ ID NO: 1317147 - protein, 24 aa, Mycobacterium
GIGAIPNDGWLSSSGLLIDDGVVC

SEQ ID NO: 1317148 - protein, 26 aa, Mycobacterium
GIGDEPMWTLTIDHAPLALAYDDLHQ

SEQ ID NO: 1317149 - protein, 25 aa, Mycobacterium
GIGDLTFFSQIGYGGGAAAATVQQA

SEQ ID NO: 1317150 - protein, 25 aa, Mycobacterium
GIGEGFLTEPWWCRTLVLAAERTAR

SEQ ID NO: 1317151 - protein, 25 aa, Mycobacterium
GIGFVFQHYAAFKHLTVRDNVAFGL

SEQ ID NO: 1317152 - protein, 18 aa, Mycobacterium
GIGREHALLFAAQGAAVV

SEQ ID NO: 1317153 - protein, 21 aa, Mycobacterium
GIGRGMLSRLLDYAGDGTVFL

SEQ ID NO: 1317154 - protein, 23 aa, Mycobacterium
GIGSACVLLIDGLGAELLDRHAD

SEQ ID NO: 1317155 - protein, 19 aa, Mycobacterium
GIHNSLTRLLIKPSHLAGG

SEQ ID NO: 1317156 - protein, 18 aa, Mycobacterium
GIHPRAATLWAATRNRVG

SEQ ID NO: 1317157 - protein, 25 aa, Mycobacterium
GIHTAGAPTWKLSAQAWRDTLDVNL

SEQ ID NO: 1317158 - protein, 26 aa, Mycobacterium
GIIAHGLCTMAFTSWAVLTEVAGSDV

SEQ ID NO: 1317159 - protein, 29 aa, Mycobacterium
GIKDPLLVMRINFLGMRQFTEALIARMPE

SEQ ID NO: 1317160 - protein, 19 aa, Mycobacterium
GIKGTPLHTPYTASKHGVV

SEQ ID NO: 1317161 - protein, 17 aa, Mycobacterium
GIKLHILTRKTLGGIQT

SEQ ID NO: 1317162 - protein, 24 aa, Mycobacterium
GIKLKVFEALRRSLPVISTTVGAE

SEQ ID NO: 1317163 - protein, 19 aa, Mycobacterium
GIKLQPFMIHYTASKHAVT

SEQ ID NO: 1317164 - protein, 25 aa, Mycobacterium
GILARLGHSIAFFIGTAYGSTATAE

SEQ ID NO: 1317165 - protein, 23 aa, Mycobacterium
GILARYDVTFSLGDGLRPGSIAD

SEQ ID NO: 1317166 - protein, 26 aa, Mycobacterium
GILDRHPALKIGWFEGGIAWVPTALQ

SEQ ID NO: 1317167 - protein, 20 aa, Mycobacterium
GILQSWLDQRRAALAAPGEG

SEQ ID NO: 1317168 - protein, 25 aa, Mycobacterium
GIMGPYLMHPIHWAVVDQWFDPECP

SEQ ID NO: 1317169 - protein, 18 aa, Mycobacterium
GINYGLNKVRFLSAVTAG

SEQ ID NO: 1317170 - protein, 25 aa, Mycobacterium
GIPARGDLLLWTDEYRRLPKLRAVQ

SEQ ID NO: 1317171 - protein, 25 aa, Mycobacterium
GIPDEWFLAGHIVVGWPRGHHGPVR

SEQ ID NO: 1317172 - protein, 25 aa, Mycobacterium
GIPGREPLIPPADLPYQVAAAQAAV

SEQ ID NO: 1317173 - protein, 19 aa, Mycobacterium
GIPISMPAYARAFEPKLRW

SEQ ID NO: 1317174 - protein, 29 aa, Mycobacterium
GIPIVMSDLKFMRFIAKEIFPGGSVPSEE

SEQ ID NO: 1317175 - protein, 20 aa, Mycobacterium
GIPLVHATPMPYDNYFGGVT

SEQ ID NO: 1317176 - protein, 25 aa, Mycobacterium
GIPNFSLLVSHVLVPPAIAAIMESP

SEQ ID NO: 1317177 - protein, 30 aa, Mycobacterium
GIPNPAIKQLVFGLLPTFAPALADLQPLLD

SEQ ID NO: 1317178 - protein, 17 aa, Mycobacterium
GIPVFKLTEEETTRLLR

SEQ ID NO: 1317179 - protein, 26 aa, Mycobacterium
GIQPPEQLRRWIDSLLNAVAGKLGGT

SEQ ID NO: 1317180 - protein, 38 aa, Mycobacterium
GIRGDYMNQFIVFDFTISRLKSGIFLGTRWGEPGASMV

SEQ ID NO: 1317181 - protein, 25 aa, Mycobacterium
GIRGGYLSEVFPITFPHTPGIDVAG

SEQ ID NO: 1317182 - protein, 18 aa, Mycobacterium
GIRGVPLDPADPLAKEWI

SEQ ID NO: 1317183 - protein, 30 aa, Mycobacterium
GIRIRYLHTAIEDLFWRQGKYGEFDVAEYS

SEQ ID NO: 1317184 - protein, 29 aa, Mycobacterium
GIRLADKPMPLFQLLVLCMLASKPIDATV

SEQ ID NO: 1317185 - protein, 20 aa, Mycobacterium
GIRMLVVPGSMRVRAQAESE

SEQ ID NO: 1317186 - protein, 17 aa, Mycobacterium
GIRPNLEPMPWTEVRNL

SEQ ID NO: 1317187 - protein, 25 aa, Mycobacterium
GIRRLLDPVALPRLVKTIRQGRYDI

SEQ ID NO: 1317188 - protein, 19 aa, Mycobacterium
GIRSAEVLAIVKKAGFSDA

SEQ ID NO: 1317189 - protein, 17 aa, Mycobacterium
GIRTFVPVGYSMGSLVA

SEQ ID NO: 1317190 - protein, 26 aa, Mycobacterium
GIRVNSVLPGYIWGGTLESYFTHQAG

SEQ ID NO: 1317191 - protein, 24 aa, Mycobacterium
GISEKFPLMLSAMSTGVTFVRAEE

SEQ ID NO: 1317192 - protein, 27 aa, Mycobacterium
GISSPLVAWLTDAMTLPAGAPLPEGAL

SEQ ID NO: 1317193 - protein, 29 aa, Mycobacterium
GITEMRHWWQVPLLGHHVLIAGATGAGKG

SEQ ID NO: 1317194 - protein, 20 aa, Mycobacterium
GITSFGDLTRPGTQVVVCAP

SEQ ID NO: 1317195 - protein, 26 aa, Mycobacterium
GITVADMPNLFFLLGPNTALGHNSVV

SEQ ID NO: 1317196 - protein, 28 aa, Mycobacterium
GIVELDEGPWWWTSFPGADPAADLFGAR

SEQ ID NO: 1317197 - protein, 24 aa, Mycobacterium
GIVHFNGPFLYRSAFHAETEEQET

SEQ ID NO: 1317198 - protein, 23 aa, Mycobacterium
GIVLVTPLLEWTATQIHALRGDF

SEQ ID NO: 1317199 - protein, 26 aa, Mycobacterium
GIVNFHAQLVQWLKNRLLLTDLLARH

SEQ ID NO: 1317200 - protein, 30 aa, Mycobacterium
GIVTSVEFDLLPIPEFYGGAVYFDGADAPA

SEQ ID NO: 1317201 - protein, 19 aa, Mycobacterium
GIYAMFHTLRRDEPVRIAY

SEQ ID NO: 1317202 - protein, 18 aa, Mycobacterium
GIYLSRLGSTVSAKAAQQ

SEQ ID NO: 1317203 - protein, 30 aa, Mycobacterium
GKAALLSFTRSMAAAYAPYGIRVNALAPGP

SEQ ID NO: 1317204 - protein, 20 aa, Mycobacterium
GKAFEGWVLVVVPSAEPGGH

SEQ ID NO: 1317205 - protein, 29 aa, Mycobacterium
GKAKAQPLWRVLVALSIRHVGPTAARALA

SEQ ID NO: 1317206 - protein, 22 aa, Mycobacterium
GKAKEVVGVVTGRDDLQREGEA

SEQ ID NO: 1317207 - protein, 21 aa, Mycobacterium
GKALKFYASVRMDVRRIETLK

SEQ ID NO: 1317208 - protein, 17 aa, Mycobacterium
GKDGVVLPILHLNGYKI

SEQ ID NO: 1317209 - protein, 31 aa, Mycobacterium
GKDIIRFHTVYWPAFLMSAGIELPKKVFVHG

SEQ ID NO: 1317210 - protein, 25 aa, Mycobacterium
GKDWTPIQHQIWLDEMQLASVPEPL

SEQ ID NO: 1317211 - protein, 27 aa, Mycobacterium
GKELRVRGYLPEDFTMLAYGGNGPLHA

SEQ ID NO: 1317212 - protein, 20 aa, Mycobacterium
GKFGPGFGFGPGGRGGRRGG

SEQ ID NO: 1317213 - protein, 24 aa, Mycobacterium
GKGGLSLWVRLPAPMSSALSAAAS

SEQ ID NO: 1317214 - protein, 26 aa, Mycobacterium
GKGLTLLQQLIWYEEYAARGFPGIDA

SEQ ID NO: 1317215 - protein, 24 aa, Mycobacterium
GKGRFYPEFRVTAQRLDRVLAALD

SEQ ID NO: 1317216 - protein, 23 aa, Mycobacterium
GKGSVLWSLIAGIAPAVKTGLVR

SEQ ID NO: 1317217 - protein, 27 aa, Mycobacterium
GKHAVSAFALWFPLSEERASYGEMKAE

SEQ ID NO: 1317218 - protein, 22 aa, Mycobacterium
GKIVLQMPKPLQPRADRSYLIT

SEQ ID NO: 1317219 - protein, 17 aa, Mycobacterium
GKKDLEDDRRFGFGIVT

SEQ ID NO: 1317220 - protein, 23 aa, Mycobacterium
GKKSPHLLALRHAIDRGVMVTVV

SEQ ID NO: 1317221 - protein, 25 aa, Mycobacterium
GKNVVTPVGWLYPSERSGASMREAA

SEQ ID NO: 1317222 - protein, 18 aa, Mycobacterium
GKPESFVNRRMGVALAFA

SEQ ID NO: 1317223 - protein, 26 aa, Mycobacterium
GKPLELGTRVVFPYFFCCHTCRNCLA

SEQ ID NO: 1317224 - protein, 23 aa, Mycobacterium
GKPPSPYVYSLYDDARLLVHAVT

SEQ ID NO: 1317225 - protein, 17 aa, Mycobacterium
GKQLLYTQILREKIGQL

SEQ ID NO: 1317226 - protein, 24 aa, Mycobacterium
GKRLVVPGLVPKLTGLGGRFTPRA

SEQ ID NO: 1317227 - protein, 24 aa, Mycobacterium
GKRQATRRIVPARALSPISSVAGR

SEQ ID NO: 1317228 - protein, 21 aa, Mycobacterium
GKRQRLVANPVKFDDAEAHLN

SEQ ID NO: 1317229 - protein, 21 aa, Mycobacterium
GKSLAYLVPAIAHALDESRPV

SEQ ID NO: 1317230 - protein, 27 aa, Mycobacterium
GKSSLLDAISLGFLPFNRRNFNASGDN

SEQ ID NO: 1317231 - protein, 22 aa, Mycobacterium
GKSTLLQTFILSASASHTPRQI

SEQ ID NO: 1317232 - protein, 22 aa, Mycobacterium
GKSTLLRLLSGIYEPTRGVATV

SEQ ID NO: 1317233 - protein, 28 aa, Mycobacterium
GKSVEEALDILRWAPQQASEPVAKVIAS

SEQ ID NO: 1317234 - protein, 21 aa, Mycobacterium
GKTMVVTGLHLLGGARADATK

SEQ ID NO: 1317235 - protein, 17 aa, Mycobacterium
GKTNLVEALWYSATLGS

SEQ ID NO: 1317236 - protein, 20 aa, Mycobacterium
GKTRLWLTAIEEARRRGYRV

SEQ ID NO: 1317237 - protein, 23 aa, Mycobacterium
GKTTLLNHVLRSPDARIGVVIND

SEQ ID NO: 1317238 - protein, 26 aa, Mycobacterium
GKTTLLQVILGLLPPSSGTVRVYGRQ

SEQ ID NO: 1317239 - protein, 23 aa, Mycobacterium
GKTTLLRCLHLDLVPDSGSMVVD

SEQ ID NO: 1317240 - protein, 23 aa, Mycobacterium
GKTVLIRRLVEECALRGVSSIVL

SEQ ID NO: 1317241 - protein, 24 aa, Mycobacterium
GKVCWWGGWGGSLVVMDLDRRATF

SEQ ID NO: 1317242 - protein, 24 aa, Mycobacterium
GKVIDQLMTVTINRSPKGLRRFDP

SEQ ID NO: 1317243 - protein, 21 aa, Mycobacterium
GKVLVAYPDRNKVLVEGVNRI

SEQ ID NO: 1317244 - protein, 23 aa, Mycobacterium
GKVRRVRLLPGDPPATRQAVDAI

SEQ ID NO: 1317245 - protein, 20 aa, Mycobacterium
GKYQVLFLDPDFREDIRLAI

SEQ ID NO: 1317246 - protein, 17 aa, Mycobacterium
GLAAADFDDLVLAESLQ

SEQ ID NO: 1317247 - protein, 19 aa, Mycobacterium
GLAAAVRTLAERLGLSVNV

SEQ ID NO: 1317248 - protein, 26 aa, Mycobacterium
GLAAQWRARALSRFAGTGWVEGVATR

SEQ ID NO: 1317249 - protein, 24 aa, Mycobacterium
GLAARLPRMLGTQAAGAAPLVLGE

SEQ ID NO: 1317250 - protein, 24 aa, Mycobacterium
GLADDCVVVCPLHGHTFDMSTGSE

SEQ ID NO: 1317251 - protein, 28 aa, Mycobacterium
GLADIEWTVQLLQLRFAHKIPALHTTST

SEQ ID NO: 1317252 - protein, 25 aa, Mycobacterium
GLAEENYWFRRHEVVYARLADRCAG

SEQ ID NO: 1317253 - protein, 22 aa, Mycobacterium
GLAELGIFGVALPEEHGGADGT

SEQ ID NO: 1317254 - protein, 24 aa, Mycobacterium
GLAEPQIRRVLAEGSPYHGVVSFE

SEQ ID NO: 1317255 - protein, 18 aa, Mycobacterium
GLAGLVITPGYDLRYLVG

SEQ ID NO: 1317256 - protein, 18 aa, Mycobacterium
GLAGYASALLYNGLGRYQ

SEQ ID NO: 1317257 - protein, 20 aa, Mycobacterium
GLAIWMATLSGGDAWQRADI

SEQ ID NO: 1317258 - protein, 24 aa, Mycobacterium
GLAPGSEWFAVSGYRRADDDTAPI

SEQ ID NO: 1317259 - protein, 22 aa, Mycobacterium
GLAPMVISQIFKIIADINSRGT

SEQ ID NO: 1317260 - protein, 28 aa, Mycobacterium
GLARIVHRPILRARVRLTRSHDPAVERP

SEQ ID NO: 1317261 - protein, 23 aa, Mycobacterium
GLARRLCAGLLDWAHGRGATRAY

SEQ ID NO: 1317262 - protein, 24 aa, Mycobacterium
GLATVIPFHRAVVADPAFIGDGEK

SEQ ID NO: 1317263 - protein, 18 aa, Mycobacterium
GLAVDTIMISPGAAEVRY

SEQ ID NO: 1317264 - protein, 17 aa, Mycobacterium
GLAWAHWPDPRSVTEDA

SEQ ID NO: 1317265 - protein, 19 aa, Mycobacterium
GLAYMFSVLGPLSDAYRKL

SEQ ID NO: 1317266 - protein, 19 aa, Mycobacterium
GLCEHLLAAGFDVAACRDI

SEQ ID NO: 1317267 - protein, 28 aa, Mycobacterium
GLDAEVIAWQWIPFGPVLNARADWLEET

SEQ ID NO: 1317268 - protein, 23 aa, Mycobacterium
GLDAVYRLRLELPQLDSSALSLG

SEQ ID NO: 1317269 - protein, 22 aa, Mycobacterium
GLDEDVWKREYWPSGNRDAHGN

SEQ ID NO: 1317270 - protein, 18 aa, Mycobacterium
GLDLQLALYVCYELHYRG

SEQ ID NO: 1317271 - protein, 23 aa, Mycobacterium
GLDPVLRVDLWQQFDELARGGTT

SEQ ID NO: 1317272 - protein, 26 aa, Mycobacterium
GLDSRTYRLPWLPGATVYEIDQPGVV

SEQ ID NO: 1317273 - protein, 23 aa, Mycobacterium
GLEDGAVLLAERGRLFGSLPEGG

SEQ ID NO: 1317274 - protein, 17 aa, Mycobacterium
GLEKVWEELPFDAQWYS

SEQ ID NO: 1317275 - protein, 17 aa, Mycobacterium
GLELIETHLLFGVDYDR

SEQ ID NO: 1317276 - protein, 20 aa, Mycobacterium
GLELRNPLLAAASPLSRTLD

SEQ ID NO: 1317277 - protein, 21 aa, Mycobacterium
GLELVECTDYFMDTPFRVFQA

SEQ ID NO: 1317278 - protein, 22 aa, Mycobacterium
GLEPHAQLLLWGQQVDDELARV

SEQ ID NO: 1317279 - protein, 19 aa, Mycobacterium
GLERFFGNLSTYAATIKTG

SEQ ID NO: 1317280 - protein, 22 aa, Mycobacterium
GLERLLAAMFVYDLPPSRRAPS

SEQ ID NO: 1317281 - protein, 31 aa, Mycobacterium
GLERRLGVVLFKDFLALHFSPTRPPAEHGDD

SEQ ID NO: 1317282 - protein, 19 aa, Mycobacterium
GLEWDAVFLVGLADGTLPI

SEQ ID NO: 1317283 - protein, 21 aa, Mycobacterium
GLEYVAGFFAAVKAGMIAVPL

SEQ ID NO: 1317284 - protein, 22 aa, Mycobacterium
GLFGYAIPQEWGGLGLDLTQDV

SEQ ID NO: 1317285 - protein, 20 aa, Mycobacterium
GLFHRGAGLQLLVREVSNLA

SEQ ID NO: 1317286 - protein, 27 aa, Mycobacterium
GLFRGGWLALVRLLKCGPWHNGGWDPI

SEQ ID NO: 1317287 - protein, 25 aa, Mycobacterium
GLGAAYLAGFAWGLGRQYTVLVEMD

SEQ ID NO: 1317288 - protein, 29 aa, Mycobacterium
GLGANLHYGGSWWVYSPTNILGTDAADVT

SEQ ID NO: 1317289 - protein, 18 aa, Mycobacterium
GLGFRPDGSLLITSVERR

SEQ ID NO: 1317290 - protein, 23 aa, Mycobacterium
GLGGRFTPRALLLPALRMAAARR

SEQ ID NO: 1317291 - protein, 19 aa, Mycobacterium
GLGGVYPDIFLPLHGEHQA

SEQ ID NO: 1317292 - protein, 24 aa, Mycobacterium
GLGHDWFEVSLIPTTLGLTTLGHA

SEQ ID NO: 1317293 - protein, 22 aa, Mycobacterium
GLGHWWMVEDPTAGAAALTRFW

SEQ ID NO: 1317294 - protein, 24 aa, Mycobacterium
GLGKPLHLINHPVRERIPITIAAL

SEQ ID NO: 1317295 - protein, 20 aa, Mycobacterium
GLGKVLPFVLHETLGPTLPE

SEQ ID NO: 1317296 - protein, 27 aa, Mycobacterium
GLGLDFLRHIERCAVLVHVIDCATLEP

SEQ ID NO: 1317297 - protein, 19 aa, Mycobacterium
GLGLDLAWRIVVEKHHGHL

SEQ ID NO: 1317298 - protein, 26 aa, Mycobacterium
GLGLDSTAVLLRWLTDPSSRDFDLSD

SEQ ID NO: 1317299 - protein, 19 aa, Mycobacterium
GLGMWKVHQSSAPGPVIAV

SEQ ID NO: 1317300 - protein, 26 aa, Mycobacterium
GLGQSSLYYWFRSKDAILRGIMNQNR

SEQ ID NO: 1317301 - protein, 27 aa, Mycobacterium
GLGRQLDLLLARRDWLWRVAESVTKLV

SEQ ID NO: 1317302 - protein, 35 aa, Mycobacterium
GLGRTLVEVPVGFKWFVDGLIGGSIGFGGEESAGA

SEQ ID NO: 1317303 - protein, 25 aa, Mycobacterium
GLGSYETAWAWLHKLRRAMVRPDRE

SEQ ID NO: 1317304 - protein, 25 aa, Mycobacterium
GLGSYETAWAWLHKMRRAMVRPDRE

SEQ ID NO: 1317305 - protein, 18 aa, Mycobacterium
GLGVQFALALRSAGAEVV

SEQ ID NO: 1317306 - protein, 17 aa, Mycobacterium
GLHAFKLRVSARRRKPP

SEQ ID NO: 1317307 - protein, 28 aa, Mycobacterium
GLHAYRGPWQYETLTREMLLDSAARKIG

SEQ ID NO: 1317308 - protein, 20 aa, Mycobacterium
GLIAAGRAWARFDRGEVVFK

SEQ ID NO: 1317309 - protein, 23 aa, Mycobacterium
GLIAAGRAWARFERGEVVFKAEV

SEQ ID NO: 1317310 - protein, 17 aa, Mycobacterium
GLIDAIIGLWHAPVTEP

SEQ ID NO: 1317311 - protein, 23 aa, Mycobacterium
GLIDDFMVMVRPLSGATVLADAM

SEQ ID NO: 1317312 - protein, 20 aa, Mycobacterium
GLIDFHLDFALGESDLIRIQ

SEQ ID NO: 1317313 - protein, 17 aa, Mycobacterium
GLIFAAHSSVAWNSARR

SEQ ID NO: 1317314 - protein, 18 aa, Mycobacterium
GLIKAILCLEHKAIPATL

SEQ ID NO: 1317315 - protein, 33 aa, Mycobacterium
GLINMEFIQFHPTGMVWPLSVKGILVTEGVRGD

SEQ ID NO: 1317316 - protein, 17 aa, Mycobacterium
GLIPVPGQVVYVGAKFG

SEQ ID NO: 1317317 - protein, 27 aa, Mycobacterium
GLIRPNVVWFGEPLPDDAWQRSVDAVV

SEQ ID NO: 1317318 - protein, 19 aa, Mycobacterium
GLISLLDDPAKTAKKIRSA

SEQ ID NO: 1317319 - protein, 21 aa, Mycobacterium
GLKGRGVLAVRGRGLWAGVDI

SEQ ID NO: 1317320 - protein, 19 aa, Mycobacterium
GLKVAVVCKSLFGKAHTVM

SEQ ID NO: 1317321 - protein, 27 aa, Mycobacterium
GLLDGPILSGARRWCPPRRWVDIGVFD

SEQ ID NO: 1317322 - protein, 25 aa, Mycobacterium
GLLDPAPERPWLATYGMWSRELPAD

SEQ ID NO: 1317323 - protein, 29 aa, Mycobacterium
GLLEQSRRHAFLASLLGIRHIVLAVNKMD

SEQ ID NO: 1317324 - protein, 27 aa, Mycobacterium
GLLGAYYLPSQLLKNLFGAAIGPLLNG

SEQ ID NO: 1317325 - protein, 19 aa, Mycobacterium
GLLHPIEPPSLLSIEPPDH

SEQ ID NO: 1317326 - protein, 21 aa, Mycobacterium
GLLQELYVTPRKGLQHLRLGV

SEQ ID NO: 1317327 - protein, 32 aa, Mycobacterium
GLLQTASLRVNFLRPFFAGRESRYVGTALRVG

SEQ ID NO: 1317328 - protein, 32 aa, Mycobacterium
GLLRDRALHPTMWIRMWFTDGEKLHQRGYTLV

SEQ ID NO: 1317329 - protein, 22 aa, Mycobacterium
GLLRLQKRIPYQKALELALTGD

SEQ ID NO: 1317330 - protein, 17 aa, Mycobacterium
GLLRRLRADGIDAPALF

SEQ ID NO: 1317331 - protein, 18 aa, Mycobacterium
GLLRRLRADGIDAPALFL

SEQ ID NO: 1317332 - protein, 24 aa, Mycobacterium
GLLTHYMPAHYAAGWWMDSAPSLQ

SEQ ID NO: 1317333 - protein, 39 aa, Mycobacterium
GLMAALVSFWMHPDAVYLSPAPLYHTAPSVWSMQTQAGG

SEQ ID NO: 1317334 - protein, 20 aa, Mycobacterium
GLMQVWANELAQHWIRVNTI

SEQ ID NO: 1317335 - protein, 23 aa, Mycobacterium
GLMRRHIKPFQAPHPPIGVTGFS

SEQ ID NO: 1317336 - protein, 30 aa, Mycobacterium
GLNHEECIFDIFYLKVFPEGATIPPMEHEF

SEQ ID NO: 1317337 - protein, 25 aa, Mycobacterium
GLNKRYFYESFADLDALAAAVVDDV

SEQ ID NO: 1317338 - protein, 23 aa, Mycobacterium
GLNLSIRDGWWDEWYDGENGWEI

SEQ ID NO: 1317339 - protein, 21 aa, Mycobacterium
GLPADLFQVLPGRGSVVGERF

SEQ ID NO: 1317340 - protein, 20 aa, Mycobacterium
GLPEGPALPLVPRSEQADPK

SEQ ID NO: 1317341 - protein, 19 aa, Mycobacterium
GLPELFPWEASRYAELLRS

SEQ ID NO: 1317342 - protein, 17 aa, Mycobacterium
GLPGIPLALARPDVHVI

SEQ ID NO: 1317343 - protein, 24 aa, Mycobacterium
GLPLQSMLCEPVIRRIDVLASQGH

SEQ ID NO: 1317344 - protein, 20 aa, Mycobacterium
GLPNLLADKIFIPAPKIKSG

SEQ ID NO: 1317345 - protein, 31 aa, Mycobacterium
GLPQWADLGMYLQTVMLLLRAEGLHSCPQMA

SEQ ID NO: 1317346 - protein, 23 aa, Mycobacterium
GLPQWYGDQGMFLTTHYFGTKIM

SEQ ID NO: 1317347 - protein, 31 aa, Mycobacterium; identical to SEQ ID NO: 783177

SEQ ID NO: 1317348 - protein, 18 aa, Mycobacterium
GLPTLIPGHLSPGVRVIL

SEQ ID NO: 1317349 - protein, 24 aa, Mycobacterium
GLPVGSALLVVKRGPNAGSRFLLD

SEQ ID NO: 1317350 - protein, 24 aa, Mycobacterium
GLQARLMSQALRKMTGALNNSGTT

SEQ ID NO: 1317351 - protein, 26 aa, Mycobacterium
GLQGGVMSWWSIQPHGGVYGGRTVVG

SEQ ID NO: 1317352 - protein, 25 aa, Mycobacterium
GLQKFTVLTNRAVSAAFPQIREIGG

SEQ ID NO: 1317353 - protein, 22 aa, Mycobacterium
GLRALFTTWITAPQPDLDVLVP

SEQ ID NO: 1317354 - protein, 23 aa, Mycobacterium
GLRALFTTWITAPQPDLDVLVPA

SEQ ID NO: 1317355 - protein, 17 aa, Mycobacterium
GLRANPPRPSLVDWLLP

SEQ ID NO: 1317356 - protein, 36 aa, Mycobacterium
GLRARLPYLARLGVDAMWINPWYPSPMADAGYDVAD

SEQ ID NO: 1317357 - protein, 19 aa, Mycobacterium
GLRCFAVPLRYCRPAQDAI

SEQ ID NO: 1317358 - protein, 21 aa, Mycobacterium
GLRELLLRYDGQADRPIMATV

SEQ ID NO: 1317359 - protein, 20 aa, Mycobacterium
GLRHLKALAAFAPAARFCAS

SEQ ID NO: 1317360 - protein, 20 aa, Mycobacterium
GLRIVPVCEMVAGFIDKHPE

SEQ ID NO: 1317361 - protein, 17 aa, Mycobacterium
GLRIVVELKRDAVAKVV

SEQ ID NO: 1317362 - protein, 26 aa, Mycobacterium
GLRNSVMFGPPGRLYTYRSHGIHVCA

SEQ ID NO: 1317363 - protein, 25 aa, Mycobacterium
GLRRGPDLSAMLEPIFGADGLRGVV

SEQ ID NO: 1317364 - protein, 25 aa, Mycobacterium
GLRSFPVLVMVAAYSRFIAAIMIPS

SEQ ID NO: 1317365 - protein, 26 aa, Mycobacterium
GLRTVNDLLRYFPRKYSDAMTVRGEG

SEQ ID NO: 1317366 - protein, 17 aa, Mycobacterium
GLRVLPAELGGEAGLVG

SEQ ID NO: 1317367 - protein, 24 aa, Mycobacterium
GLSISPAALLFTATLAGARALQME

SEQ ID NO: 1317368 - protein, 24 aa, Mycobacterium
GLSQFGINLPPMPTGLLTGSGATS

SEQ ID NO: 1317369 - protein, 17 aa, Mycobacterium
GLSRLWRRSTGVPAPIV

SEQ ID NO: 1317370 - protein, 24 aa, Mycobacterium
GLSWVHFPEGFGGLGLSRGLQAVA

SEQ ID NO: 1317371 - protein, 24 aa, Mycobacterium
GLTAVPGWGLYCAGKFALNGMSEA

SEQ ID NO: 1317372 - protein, 26 aa, Mycobacterium
GLTEPHLRIRAWPLELINGKPLDPHH

SEQ ID NO: 1317373 - protein, 20 aa, Mycobacterium
GLTIHPGSWHLEYGRGAVAT

SEQ ID NO: 1317374 - protein, 20 aa, Mycobacterium
GLTKSYLSKVERGQSVPSIA

SEQ ID NO: 1317375 - protein, 22 aa, Mycobacterium
GLTQLLRPGRRYTTFVRIAPTS

SEQ ID NO: 1317376 - protein, 23 aa, Mycobacterium
GLTQLLRPGRRYTTFVRIAPTST

SEQ ID NO: 1317377 - protein, 32 aa, Mycobacterium
GLTQPRFTGTISLRYLRGTPLGPLRAEAFVER

SEQ ID NO: 1317378 - protein, 17 aa, Mycobacterium
GLTRFAFAGVGMLLPRW

SEQ ID NO: 1317379 - protein, 22 aa, Mycobacterium
GLVDLVNLASTYLGASALLNVF

SEQ ID NO: 1317380 - protein, 25 aa, Mycobacterium
GLVDVPFLGPVLADDLQRRLGRDVG

SEQ ID NO: 1317381 - protein, 24 aa, Mycobacterium
GLVLDTDLRWRIVTALARAGVIDA

SEQ ID NO: 1317382 - protein, 37 aa, Mycobacterium
GLVLGGRVFRPLDVDLRWVAALLLRNGAIEESGVAAA

SEQ ID NO: 1317383 - protein, 19 aa, Mycobacterium
GLVMDLLFRVCIEEKLTVV

SEQ ID NO: 1317384 - protein, 18 aa, Mycobacterium
GLVPRFQALAAELIDGFA

SEQ ID NO: 1317385 - protein, 19 aa, Mycobacterium
GLVRHYAARHGLWQLDPEI

SEQ ID NO: 1317386 - protein, 19 aa, Mycobacterium
GLVSQFFGRYYTPDEARAL

SEQ ID NO: 1317387 - protein, 26 aa, Mycobacterium
GLVTLPIVHIGGLWSLLQSLVAARPV

SEQ ID NO: 1317388 - protein, 28 aa, Mycobacterium
GLVVLGLARGGIPVAWEVAAALGAPLDA

SEQ ID NO: 1317389 - protein, 31 aa, Mycobacterium
GLWEGVSALLDRLYYLDSEPALRRARLLARH

SEQ ID NO: 1317390 - protein, 17 aa, Mycobacterium
GLWGRLFPEWGAVRDLP

SEQ ID NO: 1317391 - protein, 17 aa, Mycobacterium
GLYSRIFHNNIKASGVI

SEQ ID NO: 1317392 - protein, 19 aa, Mycobacterium
GLYVTAINHHLTPAEAGYI

SEQ ID NO: 1317393 - protein, 27 aa, Mycobacterium
GMADFPDRWWNFVAVANAMAGGIFVHI

SEQ ID NO: 1317394 - protein, 26 aa, Mycobacterium
GMADPMPMLTLFDKQIQVRMGQANVK

SEQ ID NO: 1317395 - protein, 23 aa, Mycobacterium
GMARHVLCFRTLWEATFNQLMKE

SEQ ID NO: 1317396 - protein, 38 aa, Mycobacterium
GMFAGAALTWPSGNSGMMRLTATQWRNLGQGLSIFDDA

SEQ ID NO: 1317397 - protein, 17 aa, Mycobacterium
GMFISLMFAGHHTSSGT

SEQ ID NO: 1317398 - protein, 18 aa, Mycobacterium
GMGFDRDVLLRAGIEEAS

SEQ ID NO: 1317399 - protein, 19 aa, Mycobacterium
GMGKALALDTPLPTPTGWT

SEQ ID NO: 1317400 - protein, 17 aa, Mycobacterium
GMHADWCLLLARTDPDA

SEQ ID NO: 1317401 - protein, 26 aa, Mycobacterium
GMHQGIALQVPPYNYAHPDDLLAEAK

SEQ ID NO: 1317402 - protein, 23 aa, Mycobacterium
GMHRDLTVLTLLSSALTECAGTN

SEQ ID NO: 1317403 - protein, 23 aa, Mycobacterium
GMIELLMLRAERFGVRLAVVPTV

SEQ ID NO: 1317404 - protein, 19 aa, Mycobacterium
GMLAALHVLAALGEQDRPL

SEQ ID NO: 1317405 - protein, 25 aa, Mycobacterium
GMLFRKKLVMFGPREVLLTSDEPVV

SEQ ID NO: 1317406 - protein, 20 aa, Mycobacterium
GMLHACFVRSPFAHATINGV

SEQ ID NO: 1317407 - protein, 19 aa, Mycobacterium
GMLLGRLVDHAFGRKLTHE

SEQ ID NO: 1317408 - protein, 17 aa, Mycobacterium
GMMSSPTGELFFDNVRL

SEQ ID NO: 1317409 - protein, 20 aa, Mycobacterium
GMNLAVVLRTTWAVAKVLKD

SEQ ID NO: 1317410 - protein, 18 aa, Mycobacterium
GMNVFHRVKPEALQALCV

SEQ ID NO: 1317411 - protein, 20 aa, Mycobacterium
GMPGVEYYAHPWEFGARKAK

SEQ ID NO: 1317412 - protein, 19 aa, Mycobacterium
GMPIGIFDSGVGGLTVARA

SEQ ID NO: 1317413 - protein, 26 aa, Mycobacterium
GMPPAPPPVLAPRRKTRQLMVRDVGV

SEQ ID NO: 1317414 - protein, 22 aa, Mycobacterium
GMREMLLTRDWSAITLSDVAKA

SEQ ID NO: 1317415 - protein, 26 aa, Mycobacterium
GMRRRLDLAVSLLASPPVLFLDEPTT

SEQ ID NO: 1317416 - protein, 21 aa, Mycobacterium
GMSDLNSWYRNTEQWIAAAAY

SEQ ID NO: 1317417 - protein, 25 aa, Mycobacterium
GMSVATLWEFDLYGGTTLVAAVHGD

SEQ ID NO: 1317418 - protein, 24 aa, Mycobacterium
GMTKGAVSSFTRGLARDLGPRGIT

SEQ ID NO: 1317419 - protein, 18 aa, Mycobacterium
GMTLCFLEESLRNHREAL

SEQ ID NO: 1317420 - protein, 18 aa, Mycobacterium
GMTLPIARDLSRELIRVC

SEQ ID NO: 1317421 - protein, 28 aa, Mycobacterium
GMTRLGASLLISPLTFAQALVATSDSVV

SEQ ID NO: 1317422 - protein, 24 aa, Mycobacterium
GMVFQHFNLFPHRTALGNIIEAPV

SEQ ID NO: 1317423 - protein, 23 aa, Mycobacterium
GMVFQHFNLFPHRTALGNVVEAP

SEQ ID NO: 1317424 - protein, 26 aa, Mycobacterium
GMVVNHLIFHFATHKLPFGGVGPSGL

SEQ ID NO: 1317425 - protein, 26 aa, Mycobacterium
GMVVNHLLFHFATHKLPFGGVGPSGM

SEQ ID NO: 1317426 - protein, 27 aa, Mycobacterium
GNAASMIGYNWNLPALNDPAGASGARA

SEQ ID NO: 1317427 - protein, 29 aa, Mycobacterium
GNAEPFKGLPHPTILAAAALLGVDEVWAV

SEQ ID NO: 1317428 - protein, 31 aa, Mycobacterium
GNALTWEDLPWLRSLTDLPLVLKGLCHPDDV

SEQ ID NO: 1317429 - protein, 26 aa, Mycobacterium
GNDVGRLLKVVPPLASLIAAARAAGV

SEQ ID NO: 1317430 - protein, 26 aa, Mycobacterium
GNEPARTWFTAMTPIATAFGDVTLPP

SEQ ID NO: 1317431 - protein, 24 aa, Mycobacterium
GNGGIGGFTGFDYGTGGKGGRGGE

SEQ ID NO: 1317432 - protein, 23 aa, Mycobacterium
GNGYSGGLQFSPSSWAAAGGTQY

SEQ ID NO: 1317433 - protein, 29 aa, Mycobacterium
GNIPFALSAWTIRLLTRLPQRSVTALATN

SEQ ID NO: 1317434 - protein, 25 aa, Mycobacterium
GNLGLNWLVNCLFGTEFSDLCYGYN

SEQ ID NO: 1317435 - protein, 25 aa, Mycobacterium
GNLKRTHLELGGKAPVIVFDDADLA

SEQ ID NO: 1317436 - protein, 17 aa, Mycobacterium
GNMLLKTLPNPFPINEC

SEQ ID NO: 1317437 - protein, 23 aa, Mycobacterium
GNPAPRLFRLPADRALLNRMGFN

SEQ ID NO: 1317438 - protein, 20 aa, Mycobacterium
GNPDLAFKTSFLPNDGVGLA

SEQ ID NO: 1317439 - protein, 21 aa, Mycobacterium
GNPDLVWPDAQAHPQGFSTPE

SEQ ID NO: 1317440 - protein, 30 aa, Mycobacterium
GNPTFTGRQWPLADVRLLAPILASKVVCMG

SEQ ID NO: 1317441 - protein, 27 aa, Mycobacterium
GNRAWRLYRRLGFTDVIRGYHFAGDPR

SEQ ID NO: 1317442 - protein, 18 aa, Mycobacterium
GNRTFYLQAVHDKRVVSV

SEQ ID NO: 1317443 - protein, 19 aa, Mycobacterium
GNRTFYLQAVHDKRVVSVV

SEQ ID NO: 1317444 - protein, 29 aa, Mycobacterium
GNRVDIPLFPLVAREYTFYGSFWGNYNDL

SEQ ID NO: 1317445 - protein, 19 aa, Mycobacterium
GNRVRFTHPLLASGIYDSA

SEQ ID NO: 1317446 - protein, 24 aa, Mycobacterium
GNTEFNALIWMPPTGHRSGDVVLI

SEQ ID NO: 1317447 - protein, 17 aa, Mycobacterium
GNTPFFSSVLVAAALSG

SEQ ID NO: 1317448 - protein, 19 aa, Mycobacterium
GNVEYFIHLRSDGAHRLQA

SEQ ID NO: 1317449 - protein, 18 aa, Mycobacterium
GNVFAHALLDRAAGDGAD

SEQ ID NO: 1317450 - protein, 24 aa, Mycobacterium
GNVKPPYELVDPQPLMVLPDVDKG

SEQ ID NO: 1317451 - protein, 23 aa, Mycobacterium
GNVPTWWDDLVSAGFHAVHLPER

SEQ ID NO: 1317452 - protein, 38 aa, Mycobacterium
GNVTDILIKNPVGQLPLTRPLLDLGVPPEIVRALDPLL

SEQ ID NO: 1317453 - protein, 17 aa, Mycobacterium
GNVTHGALRSAWIGYWV

SEQ ID NO: 1317454 - protein, 18 aa, Mycobacterium
GNVYFLSPSKLRRRRGAD

SEQ ID NO: 1317455 - protein, 20 aa, Mycobacterium
GNYAGDVMNFGLAVTALRGE

SEQ ID NO: 1317456 - protein, 18 aa, Mycobacterium
GPAAGLLRYLPNAGAHAF

SEQ ID NO: 1317457 - protein, 26 aa, Mycobacterium
GPADDATRWYAEFARLAALMTRDVHY

SEQ ID NO: 1317458 - protein, 29 aa, Mycobacterium
GPAEKSWLLRLFEVPLGAQAPANFLRTLF

SEQ ID NO: 1317459 - protein, 27 aa, Mycobacterium
GPAERYRRWLAVLRGDARFVIGTRSAV

SEQ ID NO: 1317460 - protein, 25 aa, Mycobacterium
GPAFQGTIKSAVAFGALLSKGIGDT

SEQ ID NO: 1317461 - protein, 26 aa, Mycobacterium
GPAFQGTIKSAVAFGALLSKGIGDTI

SEQ ID NO: 1317462 - protein, 18 aa, Mycobacterium
GPAGDLYVEVHEKPHPVF

SEQ ID NO: 1317463 - protein, 23 aa, Mycobacterium
GPAGRRWPVYGPAMLAMRIHGVS

SEQ ID NO: 1317464 - protein, 26 aa, Mycobacterium
GPAPDRFLVGLAVLSLMSAAARSTPL

SEQ ID NO: 1317465 - protein, 22 aa, Mycobacterium
GPAPLFSRTPAPPPAPPRARPV

SEQ ID NO: 1317466 - protein, 23 aa, Mycobacterium
GPAPRFAIVGYAARFPGAPDADA

SEQ ID NO: 1317467 - protein, 33 aa, Mycobacterium
GPAPVEPMGPLINSLWWAVPKSGGRSTNDASLT

SEQ ID NO: 1317468 - protein, 30 aa, Mycobacterium
GPATVDTTLFRLPVRLALGPTHVAVVMGIA

SEQ ID NO: 1317469 - protein, 23 aa, Mycobacterium
GPDARIVPIPLADAALTDLVRAG

SEQ ID NO: 1317470 - protein, 24 aa, Mycobacterium
GPDAVRVFLTPESARQFATRSNRV

SEQ ID NO: 1317471 - protein, 22 aa, Mycobacterium
GPDGLTLPMTLTLPGTVNRGNA

SEQ ID NO: 1317472 - protein, 22 aa, Mycobacterium
GPDLLGPDWSAPLAAANLVADP

SEQ ID NO: 1317473 - protein, 26 aa, Mycobacterium
GPEIEQMQGWLQDWGVSSSTTAPSTA

SEQ ID NO: 1317474 - protein, 20 aa, Mycobacterium
GPEQDLPLLRPGDDVFVSWA

SEQ ID NO: 1317475 - protein, 20 aa, Mycobacterium
GPERFLSTFVLLDACAETIA

SEQ ID NO: 1317476 - protein, 23 aa, Mycobacterium
GPESIPRLWHQRVPRSTSPSDPL

SEQ ID NO: 1317477 - protein, 23 aa, Mycobacterium
GPEVLDWLVTRHALGRSAYQLGV

SEQ ID NO: 1317478 - protein, 27 aa, Mycobacterium
GPEYIENFVIYPRSLGALTGWGDPTYD

SEQ ID NO: 1317479 - protein, 30 aa, Mycobacterium
GPFAPEVYRAPMAYPYRWPSGPQHCAEEAF

SEQ ID NO: 1317480 - protein, 20 aa, Mycobacterium
GPFASVLDRARDALGAVFAK

SEQ ID NO: 1317481 - protein, 18 aa, Mycobacterium
GPFPPLPFTPEGDDITEQ

SEQ ID NO: 1317482 - protein, 25 aa, Mycobacterium
GPFYDGVIFHRVIEGFMIQGGDPTG

SEQ ID NO: 1317483 - protein, 28 aa, Mycobacterium
GPGAFDCSGLVMWSFQQAGISLPHSSQA

SEQ ID NO: 1317484 - protein, 24 aa, Mycobacterium
GPGDRWIYEQIRAVAPRTTLIAIV

SEQ ID NO: 1317485 - protein, 26 aa, Mycobacterium
GPGGMMRYGIPNYRLPRNVLDDELNR

SEQ ID NO: 1317486 - protein, 18 aa, Mycobacterium
GPGKLLTAVAVAAGWPGG

SEQ ID NO: 1317487 - protein, 31 aa, Mycobacterium
GPGLTAGWLPLHKLSQWLTYSLLEPFDWAGV

SEQ ID NO: 1317488 - protein, 24 aa, Mycobacterium
GPGQPPAFLRALGARTDWTDLRVY

SEQ ID NO: 1317489 - protein, 18 aa, Mycobacterium
GPGRLVAHLVQRGVPALG

SEQ ID NO: 1317490 - protein, 23 aa, Mycobacterium
GPGTFGTPWSKLPPGRQSAVIVA

SEQ ID NO: 1317491 - protein, 26 aa, Mycobacterium
GPGTKGLSLFFVPKFHFDPETGEPGE

SEQ ID NO: 1317492 - protein, 20 aa, Mycobacterium
GPHDIAAGAVTLFVGGSDAA

SEQ ID NO: 1317493 - protein, 19 aa, Mycobacterium
GPHRPVFVMSVAEGRPFPV

SEQ ID NO: 1317494 - protein, 20 aa, Mycobacterium
GPIEPDPYLKSYPWAAGLSS

SEQ ID NO: 1317495 - protein, 22 aa, Mycobacterium
GPIGLALVQFSLAQGATQVIVS

SEQ ID NO: 1317496 - protein, 19 aa, Mycobacterium
GPIGPLMRQARLGDFRLPQ

SEQ ID NO: 1317497 - protein, 19 aa, Mycobacterium
GPKALLANGVRYLVDPRVV

SEQ ID NO: 1317498 - protein, 25 aa, Mycobacterium
GPKGFLDMPVPIDGLYLGGAGCHGG

SEQ ID NO: 1317499 - protein, 22 aa, Mycobacterium
GPLADWLDELVSRRLTYFLSSN

SEQ ID NO: 1317500 - protein, 30 aa, Mycobacterium
GPLASWNAWHWRWNPWVMAARGYAVLLPDP

SEQ ID NO: 1317501 - protein, 35 aa, Mycobacterium; identical to SEQ ID NO: 819254

SEQ ID NO: 1317502 - protein, 18 aa, Mycobacterium
GPLPLQIICDMMGIPEED

SEQ ID NO: 1317503 - protein, 20 aa, Mycobacterium
GPLPSQLLDVWRPKELPAEP

SEQ ID NO: 1317504 - protein, 20 aa, Mycobacterium
GPLTLLDLFEGRSQLIMQHF

SEQ ID NO: 1317505 - protein, 17 aa, Mycobacterium
GPLVRAAVGFTDLWVYP

SEQ ID NO: 1317506 - protein, 17 aa, Mycobacterium
GPLVRRLGRMLPEDVRV

SEQ ID NO: 1317507 - protein, 24 aa, Mycobacterium
GPMGPSRMVLSKPVIAAVSGYAVA

SEQ ID NO: 1317508 - protein, 22 aa, Mycobacterium
GPMRWTCVEPLKKWKLEVAPND

SEQ ID NO: 1317509 - protein, 23 aa, Mycobacterium
GPNLPLPLAALNWAVRDTMPPWA

SEQ ID NO: 1317510 - protein, 24 aa, Mycobacterium
GPNPTPPTLPTGGSLPPPVSPTMG

SEQ ID NO: 1317511 - protein, 22 aa, Mycobacterium
GPPASHHLRWLASANCLLELDE

SEQ ID NO: 1317512 - protein, 23 aa, Mycobacterium
GPPTLTWYILPDNGGSVARAEQC

SEQ ID NO: 1317513 - protein, 18 aa, Mycobacterium
GPQLRLYDSADRQVRPVA

SEQ ID NO: 1317514 - protein, 17 aa, Mycobacterium
GPQRWRIKANWKIGAEN

SEQ ID NO: 1317515 - protein, 26 aa, Mycobacterium
GPRAERYPLHLLANQPASRLHSQLDG

SEQ ID NO: 1317516 - protein, 24 aa, Mycobacterium
GPRARLWVDGLLAGRYSRSDTVAE

SEQ ID NO: 1317517 - protein, 24 aa, Mycobacterium
GPRCRDIWLVTAGAERVRTGEPQA

SEQ ID NO: 1317518 - protein, 23 aa, Mycobacterium
GPRGVGVLASRPGLLADDTRIRL

SEQ ID NO: 1317519 - protein, 26 aa, Mycobacterium
GPRGYRDLIMLRALTETALLPYDPGS

SEQ ID NO: 1317520 - protein, 19 aa, Mycobacterium
GPRHFGFVVGGALPAALAA

SEQ ID NO: 1317521 - protein, 17 aa, Mycobacterium
GPRLFAQVLMYPGLDRD

SEQ ID NO: 1317522 - protein, 17 aa, Mycobacterium
GPRLREWAAVCVPSPSG

SEQ ID NO: 1317523 - protein, 19 aa, Mycobacterium
GPRPVVLNALAGVGADVTV

SEQ ID NO: 1317524 - protein, 30 aa, Mycobacterium
GPRSAGTAILFLLMPGQQSAWHTVRSAELW

SEQ ID NO: 1317525 - protein, 18 aa, Mycobacterium
GPRTFLGLGVDGFPNLFL

SEQ ID NO: 1317526 - protein, 28 aa, Mycobacterium
GPSAGWRKWLYWGSGRLIDVGESPKVIR

SEQ ID NO: 1317527 - protein, 24 aa, Mycobacterium
GPSALRLLDLGSPTLDFVKIAEGM

SEQ ID NO: 1317528 - protein, 22 aa, Mycobacterium
GPSEAWVYIDHRVEPGPPRPGY

SEQ ID NO: 1317529 - protein, 28 aa, Mycobacterium
GPSGNVEYFLWLRARTDRGLRGDDLEQA

SEQ ID NO: 1317530 - protein, 25 aa, Mycobacterium
GPTRAWLICDDPNHTWLRGSWEHQE

SEQ ID NO: 1317531 - protein, 19 aa, Mycobacterium
GPTSHTAIIARQLGIPCVV

SEQ ID NO: 1317532 - protein, 24 aa, Mycobacterium
GPTSHTAIIARQLGIPCVVAVAGL

SEQ ID NO: 1317533 - protein, 26 aa, Mycobacterium
GPVDGLPTIFVYDGYPGGAGFAARGF

SEQ ID NO: 1317534 - protein, 17 aa, Mycobacterium
GPVFGTMWHGAFEGDAL

SEQ ID NO: 1317535 - protein, 20 aa, Mycobacterium
GPVKSLLPKVTRTGLAITPK

SEQ ID NO: 1317536 - protein, 33 aa, Mycobacterium
GPVKVGLTLCYDIRFPELYVELAERGAEIITAH

SEQ ID NO: 1317537 - protein, 18 aa, Mycobacterium
GPVMLRLAGERAGGTILW

SEQ ID NO: 1317538 - protein, 33 aa, Mycobacterium
GPVPTALSDHRLLHGLQLPVVILTHRVQPRQQR

SEQ ID NO: 1317539 - protein, 18 aa, Mycobacterium
GPVRMVLGPGGARDARCL

SEQ ID NO: 1317540 - protein, 25 aa, Mycobacterium
GPVTGLLLAAVRRKTAADAGLEMLG

SEQ ID NO: 1317541 - protein, 27 aa, Mycobacterium
GPVTRLKLAPKWLMPPMVVATSPQGAR

SEQ ID NO: 1317542 - protein, 27 aa, Mycobacterium
GPWRDHEWQGWWGDEPPFHTPVFVMTH

SEQ ID NO: 1317543 - protein, 18 aa, Mycobacterium
GPYTPGFRSVPFGDADAL

SEQ ID NO: 1317544 - protein, 18 aa, Mycobacterium
GPYYPYPCEYDYYCNDWG

SEQ ID NO: 1317545 - protein, 17 aa, Mycobacterium
GQAEFADVLLLSAPDRT

SEQ ID NO: 1317546 - protein, 26 aa, Mycobacterium
GQAELDGHHFFWTVHARNKKAVTLNL

SEQ ID NO: 1317547 - protein, 18 aa, Mycobacterium
GQAFYIHNRVRTIDSAAA

SEQ ID NO: 1317548 - protein, 21 aa, Mycobacterium
GQARLIALLGRPLPAQVAQLL

SEQ ID NO: 1317549 - protein, 24 aa, Mycobacterium
GQASISLAVRFLQLQHRRAEKSTA

SEQ ID NO: 1317550 - protein, 20 aa, Mycobacterium
GQAVIAYEPVWAIGTGRVAS

SEQ ID NO: 1317551 - protein, 26 aa, Mycobacterium
GQDDLPLPVARRIIGPRPLIGRSTHD

SEQ ID NO: 1317552 - protein, 18 aa, Mycobacterium
GQDPYRYPRNLPIVGAKG

SEQ ID NO: 1317553 - protein, 22 aa, Mycobacterium
GQERPFPLDLVPRVISAAEWTR

SEQ ID NO: 1317554 - protein, 20 aa, Mycobacterium
GQFALLLGPGNFGASAPFYG

SEQ ID NO: 1317555 - protein, 19 aa, Mycobacterium
GQFTYPMEFAPSDGSWQLT

SEQ ID NO: 1317556 - protein, 30 aa, Mycobacterium
GQIGTLVVHPLLMTIFDISGLSELVTVEPA

SEQ ID NO: 1317557 - protein, 25 aa, Mycobacterium
GQIPGLLCYTQTLTLWQGIDRLDCR

SEQ ID NO: 1317558 - protein, 37 aa, Mycobacterium
GQKEKLAYTILAASLAYQFGLEWGVERSRDFRFAVID

SEQ ID NO: 1317559 - protein, 27 aa, Mycobacterium
GQKIWSSRAVFGERAFGLFRSDPEAQR

SEQ ID NO: 1317560 - protein, 19 aa, Mycobacterium
GQKLLAADVLLGTSAGSAV

SEQ ID NO: 1317561 - protein, 17 aa, Mycobacterium
GQKVWTSFAQYSHRCIL

SEQ ID NO: 1317562 - protein, 28 aa, Mycobacterium
GQKVWTSLAHRAKWGLLLARTDPDVPKH

SEQ ID NO: 1317563 - protein, 24 aa, Mycobacterium
GQLADWIRFMLSDAADFLCGSVIF

SEQ ID NO: 1317564 - protein, 26 aa, Mycobacterium
GQLCAALTRILLPRSRYSEFVDALTT

SEQ ID NO: 1317565 - protein, 19 aa, Mycobacterium
GQLIGAGRTTRLINRRLRR

SEQ ID NO: 1317566 - protein, 25 aa, Mycobacterium
GQLPLAIPTYREALGRWLHACDICD

SEQ ID NO: 1317567 - protein, 36 aa, Mycobacterium
GQLRDLIDDRFWLHLGMGWQFFAPDDYIRRLTSVLD

SEQ ID NO: 1317568 - protein, 25 aa, Mycobacterium
GQLRVLHTFGLSIAALEERLRMALS

SEQ ID NO: 1317569 - protein, 27 aa, Mycobacterium
GQLVQRAVDLVQLFPAAAYGKNGADIR

SEQ ID NO: 1317570 - protein, 20 aa, Mycobacterium
GQMGQMMGMPMQLAQQAAQI

SEQ ID NO: 1317571 - protein, 22 aa, Mycobacterium
GQMLLGPIPKEDHLRIAALLDD

SEQ ID NO: 1317572 - protein, 23 aa, Mycobacterium
GQMRTEILRLQRKLGVTTVYVTH

SEQ ID NO: 1317573 - protein, 25 aa, Mycobacterium
GQNARLAARLTGWRIDIRSDDAAKE

SEQ ID NO: 1317574 - protein, 23 aa, Mycobacterium
GQNGGRGGLLFGNGGRGGDAVLP

SEQ ID NO: 1317575 - protein, 17 aa, Mycobacterium
GQNPLFQSHMWDGSAVP

SEQ ID NO: 1317576 - protein, 29 aa, Mycobacterium
GQNQPALFHLTLFYRHPAAGYKFADAAAR

SEQ ID NO: 1317577 - protein, 26 aa, Mycobacterium
GQNTKILNNLLFSANLGAAVSTLELG

SEQ ID NO: 1317578 - protein, 19 aa, Mycobacterium
GQPAASRLMRGLGSSIYPG

SEQ ID NO: 1317579 - protein, 37 aa, Mycobacterium
GQPGAILAFPRTQWIRWRKPVIGAPTTPRIMAPGQLL

SEQ ID NO: 1317580 - protein, 24 aa, Mycobacterium
GQPKLFIFPHAGGSAQYYVPFAKT

SEQ ID NO: 1317581 - protein, 23 aa, Mycobacterium
GQPLRFEVLPVMFSIQLTGDCLW

SEQ ID NO: 1317582 - protein, 19 aa, Mycobacterium
GQPMLPLGAERPAGATLDD

SEQ ID NO: 1317583 - protein, 19 aa, Mycobacterium
GQPRLSPLAYSLVGGRMLV

SEQ ID NO: 1317584 - protein, 17 aa, Mycobacterium
GQPYPVMVFVHGGGFVA

SEQ ID NO: 1317585 - protein, 18 aa, Mycobacterium
GQPYPVMVFVHGGGFVAG

SEQ ID NO: 1317586 - protein, 23 aa, Mycobacterium
GQPYPVMVFVHGGGFVAGSTRTP

SEQ ID NO: 1317587 - protein, 18 aa, Mycobacterium
GQPYRFFVTATKELSIAT

SEQ ID NO: 1317588 - protein, 25 aa, Mycobacterium
GQQAKYMWPYMFETVAAEYDRRYGL

SEQ ID NO: 1317589 - protein, 31 aa, Mycobacterium
GQQLGAPLAALAQLPQLLTQGLAQLAQSSSA

SEQ ID NO: 1317590 - protein, 28 aa, Mycobacterium
GQRAKNMFALGLLSWMYGRELEHSESFI

SEQ ID NO: 1317591 - protein, 22 aa, Mycobacterium
GQRGKQDFASFTSLPALADEVC

SEQ ID NO: 1317592 - protein, 28 aa, Mycobacterium
GQRIDPVLARSWLLVNGSHYDRFQAAAH

SEQ ID NO: 1317593 - protein, 30 aa, Mycobacterium
GQRLTDLEFNLFFMLLLNAGGDTTRNLVAA

SEQ ID NO: 1317594 - protein, 25 aa, Mycobacterium
GQRMRDMLWAAIFPSINISTDAART

SEQ ID NO: 1317595 - protein, 18 aa, Mycobacterium
GQRPLDIFVFEGTVMQAY

SEQ ID NO: 1317596 - protein, 25 aa, Mycobacterium
GQRRRVELARILFAASEAGSGSATT

SEQ ID NO: 1317597 - protein, 17 aa, Mycobacterium
GQRRWEAFTDWPDPWVM

SEQ ID NO: 1317598 - protein, 26 aa, Mycobacterium
GQRTPERWFVVWLGSATNPVDREAAV

SEQ ID NO: 1317599 - protein, 29 aa, Mycobacterium
GQSKLANLMFTYTLARRLAAKGAPTIAVA

SEQ ID NO: 1317600 - protein, 25 aa, Mycobacterium
GQSKTANVLFAVELDRRWADDGVRG

SEQ ID NO: 1317601 - protein, 18 aa, Mycobacterium
GQSLEAMRTIGVPVYLLP

SEQ ID NO: 1317602 - protein, 30 aa, Mycobacterium
GQSLEAMRTIGVPVYLLPGNHDPLDASSVY

SEQ ID NO: 1317603 - protein, 25 aa, Mycobacterium
GQTMRRNMRFDGVPFMPVTVRRAED

SEQ ID NO: 1317604 - protein, 21 aa, Mycobacterium
GQTVILYDKPTLDSATVLSTA

SEQ ID NO: 1317605 - protein, 19 aa, Mycobacterium
GQTWQPRHTLNAKPQALLA

SEQ ID NO: 1317606 - protein, 18 aa, Mycobacterium
GQVAADIECIYRGYRFAV

SEQ ID NO: 1317607 - protein, 18 aa, Mycobacterium
GQVAAQLVRTRRLRRHRA

SEQ ID NO: 1317608 - protein, 19 aa, Mycobacterium
GQVHRAPFGGAPAPQAQQQ

SEQ ID NO: 1317609 - protein, 19 aa, Mycobacterium
GQVLLRFLAAGICGSDLPG

SEQ ID NO: 1317610 - protein, 24 aa, Mycobacterium
GQWLRFGISHPCTLFDKWRLLPVL

SEQ ID NO: 1317611 - protein, 20 aa, Mycobacterium
GQWVAFPTVEQLERAVFDMV

SEQ ID NO: 1317612 - protein, 26 aa, Mycobacterium
GQYIGIGLLVEGRWRWRSYSLTSSPV

SEQ ID NO: 1317613 - protein, 23 aa, Mycobacterium
GQYVDLGIGLPTLIPGHLSPGVR

SEQ ID NO: 1317614 - protein, 24 aa, Mycobacterium
GRAAVVVPALWTVRRITDGGGSAR

SEQ ID NO: 1317615 - protein, 24 aa, Mycobacterium
GRAAYTVMSRFFLGATVDLDEAYH

SEQ ID NO: 1317616 - protein, 26 aa, Mycobacterium
GRADRRALFFMGRLSVEGDWALAMKL

SEQ ID NO: 1317617 - protein, 26 aa, Mycobacterium
GRADWAVHIALWQRAPRTGAPTITDA

SEQ ID NO: 1317618 - protein, 27 aa, Mycobacterium
GRAEFLRRDFGFVYQVRPKFLDRAISQ

SEQ ID NO: 1317619 - protein, 25 aa, Mycobacterium
GRAELVMPMWQRLERTWGPARDVRD

SEQ ID NO: 1317620 - protein, 25 aa, Mycobacterium
GRAHLLYGEWLRRRRRRVDARAQLR

SEQ ID NO: 1317621 - protein, 18 aa, Mycobacterium
GRAIVRNPKAFLMDEPLS

SEQ ID NO: 1317622 - protein, 23 aa, Mycobacterium
GRASNPMWYLNVKANPAVTFQIR

SEQ ID NO: 1317623 - protein, 28 aa, Mycobacterium
GRAVSPVDFWQYPTVDALAKFLTGGEVE

SEQ ID NO: 1317624 - protein, 26 aa, Mycobacterium
GRAYDPRFMFSWVNAKLAVMGAAQLA

SEQ ID NO: 1317625 - protein, 23 aa, Mycobacterium
GRDAFRQFWIGRRILKAYEESYR

SEQ ID NO: 1317626 - protein, 19 aa, Mycobacterium
GRDAGRRRPPILSEAEFLA

SEQ ID NO: 1317627 - protein, 24 aa, Mycobacterium
GRDEHLASLYPALAARETNRRHGT

SEQ ID NO: 1317628 - protein, 22 aa, Mycobacterium
GRDEVRPWIWKTMESFPGSYMT

SEQ ID NO: 1317629 - protein, 18 aa, Mycobacterium
GRDEVVEWFAANFGVIPW

SEQ ID NO: 1317630 - protein, 17 aa, Mycobacterium
GRDGLLMAPTYAVPRLL

SEQ ID NO: 1317631 - protein, 25 aa, Mycobacterium
GRDKTGVIVLLTFGTGIGSAVIHNG

SEQ ID NO: 1317632 - protein, 40 aa, Mycobacterium; identical to SEQ ID NO: 819785

SEQ ID NO: 1317633 - protein, 19 aa, Mycobacterium
GRDPWRDAVDLHRRIAYVP

SEQ ID NO: 1317634 - protein, 19 aa, Mycobacterium
GRDTFVETIVAFEPSRVLG

SEQ ID NO: 1317635 - protein, 26 aa, Mycobacterium
GRDVAEILCLPYFLGEKSPLHDPDLR

SEQ ID NO: 1317636 - protein, 18 aa, Mycobacterium
GRDWLFNNPWELVSITSD

SEQ ID NO: 1317637 - protein, 17 aa, Mycobacterium
GRELSLQGTYLSAAAFS

SEQ ID NO: 1317638 - protein, 24 aa, Mycobacterium
GRENLVLFGRLQGLAKKAAEARAD

SEQ ID NO: 1317639 - protein, 17 aa, Mycobacterium
GREPYFVGKPNPMMFRS

SEQ ID NO: 1317640 - protein, 29 aa, Mycobacterium
GREPYQPVGWLMLRRILPPDTVTPDDVFL

SEQ ID NO: 1317641 - protein, 32 aa, Mycobacterium
GREQSRPELGFRLLQRLGADVAEYGFIETSAK

SEQ ID NO: 1317642 - protein, 24 aa, Mycobacterium
GREVKLETEILWGSPDSELVTESH

SEQ ID NO: 1317643 - protein, 31 aa, Mycobacterium
GREVVGAYTQLPFKLAWAITIHKSQGQTLER

SEQ ID NO: 1317644 - protein, 18 aa, Mycobacterium
GRFARKNYFYPDQPKNYQ

SEQ ID NO: 1317645 - protein, 26 aa, Mycobacterium
GRFQNRRALLDVPRLGPKAFEQCAGF

SEQ ID NO: 1317646 - protein, 18 aa, Mycobacterium
GRFRRRHLVPVPKVASLA

SEQ ID NO: 1317647 - protein, 18 aa, Mycobacterium
GRFRYQAGQFLTLRVNLD

SEQ ID NO: 1317648 - protein, 22 aa, Mycobacterium
GRFRYQVGQFLTLRVNLDGQEL

SEQ ID NO: 1317649 - protein, 18 aa, Mycobacterium
GRGFAAYGTAKAALAHYT

SEQ ID NO: 1317650 - protein, 25 aa, Mycobacterium
GRGFFTSRVILARLLEAAAMLGEGI

SEQ ID NO: 1317651 - protein, 24 aa, Mycobacterium
GRGGWARVLVDHLGPRHIALKNLT

SEQ ID NO: 1317652 - protein, 17 aa, Mycobacterium
GRGLMRAFSLPSQAQRN

SEQ ID NO: 1317653 - protein, 17 aa, Mycobacterium
GRGLPPAEPFPLPIHSG

SEQ ID NO: 1317654 - protein, 28 aa, Mycobacterium
GRGPLTVPIWYQYTPGGDLWFTTGAGSR

SEQ ID NO: 1317655 - protein, 25 aa, Mycobacterium
GRGPLVQERALYDALAGGAIKAAAV

SEQ ID NO: 1317656 - protein, 23 aa, Mycobacterium
GRGPVATVLIQRGTLRVGDSVVA

SEQ ID NO: 1317657 - protein, 19 aa, Mycobacterium
GRGSFYKAFGDKHSMFLRS

SEQ ID NO: 1317658 - protein, 17 aa, Mycobacterium
GRGSFYKAFGDKHSMFV

SEQ ID NO: 1317659 - protein, 32 aa, Mycobacterium
GRGSTWPRQLPWLTRLGRVFTYDAPWHRGRDV

SEQ ID NO: 1317660 - protein, 22 aa, Mycobacterium
GRGTPGLDLRAGIATQLRALGV

SEQ ID NO: 1317661 - protein, 22 aa, Mycobacterium
GRHEQAWRRLVADNPFAAIHGR

SEQ ID NO: 1317662 - protein, 22 aa, Mycobacterium
GRHEQAWRRLVSDNPFAAIHGR

SEQ ID NO: 1317663 - protein, 24 aa, Mycobacterium
GRHGTLVCYLLDALSIVTGNLDRA

SEQ ID NO: 1317664 - protein, 21 aa, Mycobacterium
GRHIQSWRCKVGHSITARACG

SEQ ID NO: 1317665 - protein, 18 aa, Mycobacterium
GRHMALNALGALLAAREA

SEQ ID NO: 1317666 - protein, 23 aa, Mycobacterium
GRHRFPIVLTESVEQFLTAVGEE

SEQ ID NO: 1317667 - protein, 20 aa, Mycobacterium
GRIAAALQRGLRPPVLPEVE

SEQ ID NO: 1317668 - protein, 18 aa, Mycobacterium
GRIAAWRDYFDMATVTAA

SEQ ID NO: 1317669 - protein, 20 aa, Mycobacterium
GRIATLQRWPDGLQAAVEAK

SEQ ID NO: 1317670 - protein, 26 aa, Mycobacterium
GRIDPRTRWLLRELVYALLVKKDHAA

SEQ ID NO: 1317671 - protein, 25 aa, Mycobacterium
GRIDRRGRMLWSLPKGHIEMGETAE

SEQ ID NO: 1317672 - protein, 24 aa, Mycobacterium
GRIERELPEWLAADVAILGEPSGG

SEQ ID NO: 1317673 - protein, 22 aa, Mycobacterium
GRIHLLSALARCGVCDEPVRVG

SEQ ID NO: 1317674 - protein, 18 aa, Mycobacterium
GRILDLDACAPLFDGVEA

SEQ ID NO: 1317675 - protein, 22 aa, Mycobacterium
GRIPRRIIAFDPGRASLIELNG

SEQ ID NO: 1317676 - protein, 23 aa, Mycobacterium
GRIQMGIGGGWYEHEWRAYGYGF

SEQ ID NO: 1317677 - protein, 17 aa, Mycobacterium
GRIRLKAGGGVAGHNGL

SEQ ID NO: 1317678 - protein, 34 aa, Mycobacterium
GRISPDVKMNYLASPPLVIAYGLAGTMDFDFEAD

SEQ ID NO: 1317679 - protein, 18 aa, Mycobacterium
GRIVCFCERVTAGEIRDA

SEQ ID NO: 1317680 - protein, 19 aa, Mycobacterium
GRKIGEFQAVAFKLADMKA

SEQ ID NO: 1317681 - protein, 28 aa, Mycobacterium
GRKPLRVPVWMMRQAGRSLPEYRALRAK

SEQ ID NO: 1317682 - protein, 24 aa, Mycobacterium
GRLAGRPVVLAKPRVYMNESGRQV

SEQ ID NO: 1317683 - protein, 18 aa, Mycobacterium
GRLALDGSLVDAINALTR

SEQ ID NO: 1317684 - protein, 17 aa, Mycobacterium
GRLEDLPVLYELAAEEG

SEQ ID NO: 1317685 - protein, 20 aa, Mycobacterium
GRLGLVTGLLDPAPERPWLA

SEQ ID NO: 1317686 - protein, 23 aa, Mycobacterium
GRLGWPFVEIFPSRLATPDVAMP

SEQ ID NO: 1317687 - protein, 18 aa, Mycobacterium
GRLIAEKTDFPAGVVNVV

SEQ ID NO: 1317688 - protein, 18 aa, Mycobacterium
GRLKAERALLATALEDVQ

SEQ ID NO: 1317689 - protein, 27 aa, Mycobacterium
GRLSTYFHEQVFPVLTPLAVDPAHPFP

SEQ ID NO: 1317690 - protein, 24 aa, Mycobacterium
GRLTAHLPSARRLLLFKADGSVSV

SEQ ID NO: 1317691 - protein, 36 aa, Mycobacterium
GRLVIRTSSQVPFLVRDELCHIFGLDTDEVRVFTRR

SEQ ID NO: 1317692 - protein, 23 aa, Mycobacterium
GRLWATIIQHRFGGSGALAGHPI

SEQ ID NO: 1317693 - protein, 19 aa, Mycobacterium
GRLWEQDLFFPAGHCKGVC

SEQ ID NO: 1317694 - protein, 20 aa, Mycobacterium
GRLWLLQTRVAKRSAQAAVR

SEQ ID NO: 1317695 - protein, 23 aa, Mycobacterium
GRLWYHDGNLAVLTEFRRPGQRR

SEQ ID NO: 1317696 - protein, 19 aa, Mycobacterium
GRLYDIEYALRLGATVEQV

SEQ ID NO: 1317697 - protein, 18 aa, Mycobacterium
GRNLARRAAWFLDNEPGE

SEQ ID NO: 1317698 - protein, 17 aa, Mycobacterium
GRPADFVADVALSYAGD

SEQ ID NO: 1317699 - protein, 33 aa, Mycobacterium
GRPADPPFEGMWWLYVPMAFDDFAIVLIIQEDP

SEQ ID NO: 1317700 - protein, 26 aa, Mycobacterium
GRPAEFAFRHPLIRAVAYESQLRSVR

SEQ ID NO: 1317701 - protein, 19 aa, Mycobacterium
GRPAKRYRLTAAGRAKLGH

SEQ ID NO: 1317702 - protein, 29 aa, Mycobacterium
GRPAPTHLGWSRYLRWVADNIGMSVITGE

SEQ ID NO: 1317703 - protein, 33 aa, Mycobacterium
GRPDAAFGGMWWLYLPLAFDDYQLFLILQEDPD

SEQ ID NO: 1317704 - protein, 32 aa, Mycobacterium
GRPDDPPFEGMWWLYVPMAFDDFGIVIIIQED

SEQ ID NO: 1317705 - protein, 20 aa, Mycobacterium
GRPHRFQITASRFGRRGGTP

SEQ ID NO: 1317706 - protein, 22 aa, Mycobacterium
GRPHVVMRWPLDPVQRVAAATK

SEQ ID NO: 1317707 - protein, 35 aa, Mycobacterium
GRPLDLEWAIDGTGKLWWLQARPITTLPGDLNEMD

SEQ ID NO: 1317708 - protein, 21 aa, Mycobacterium
GRPLGLLLTRRSENATVTLCH

SEQ ID NO: 1317709 - protein, 17 aa, Mycobacterium
GRQARIIALLSTQSVRS

SEQ ID NO: 1317710 - protein, 20 aa, Mycobacterium
GRQEFGWLSVDLARREVFVA

SEQ ID NO: 1317711 - protein, 18 aa, Mycobacterium
GRQQAFLLDDNDFRHLYV

SEQ ID NO: 1317712 - protein, 18 aa, Mycobacterium
GRQRQKVLGLLRETKRPL

SEQ ID NO: 1317713 - protein, 21 aa, Mycobacterium
GRQVGPLAKFYSVAPADVVIV

SEQ ID NO: 1317714 - protein, 22 aa, Mycobacterium
GRQYLSWISLEDQVRALLFAIS

SEQ ID NO: 1317715 - protein, 17 aa, Mycobacterium
GRRDVAGAQSAFEADVQ

SEQ ID NO: 1317716 - protein, 18 aa, Mycobacterium
GRRFAQISPIVSTYHKLE

SEQ ID NO: 1317717 - protein, 22 aa, Mycobacterium
GRRFLNAGLGFGGGCLPKDIRA

SEQ ID NO: 1317718 - protein, 19 aa, Mycobacterium
GRRFQAEVLGYTLGGRDIA

SEQ ID NO: 1317719 - protein, 24 aa, Mycobacterium
GRRGKYLWLTLGDGADEPLARRES

SEQ ID NO: 1317720 - protein, 21 aa, Mycobacterium
GRRHELLRGLVPEISLIFGKC

SEQ ID NO: 1317721 - protein, 28 aa, Mycobacterium
GRRLAPTMAWPVVSASYLRLAQKMLTGR

SEQ ID NO: 1317722 - protein, 18 aa, Mycobacterium
GRRLKKPLIAAVEGPAIA

SEQ ID NO: 1317723 - protein, 19 aa, Mycobacterium
GRRLLREKNNFRDRLHAIQ

SEQ ID NO: 1317724 - protein, 17 aa, Mycobacterium
GRRNLLLRTLDALGLGF

SEQ ID NO: 1317725 - protein, 25 aa, Mycobacterium
GRRPEHMHIWLGSGRMETLRVSDFQ

SEQ ID NO: 1317726 - protein, 31 aa, Mycobacterium
GRRQYAASDLDWFAFLVRLRQTGMPITQMQQ

SEQ ID NO: 1317727 - protein, 20 aa, Mycobacterium
GRRRVAMLREWLANELSDAS

SEQ ID NO: 1317728 - protein, 19 aa, Mycobacterium
GRSAVLVGAGSMGALAAKQ

SEQ ID NO: 1317729 - protein, 18 aa, Mycobacterium
GRSFQAFFDFLLSEQRQT

SEQ ID NO: 1317730 - protein, 23 aa, Mycobacterium
GRSKLVRSYLARNVLGALPDERR

SEQ ID NO: 1317731 - protein, 37 aa, Mycobacterium
GRSLALPPRMPVPDHFTFARYLAAGLAVLQAVAPGYS

SEQ ID NO: 1317732 - protein, 26 aa, Mycobacterium
GRSLWPMLTSIWEWERRWVPEHAEPL

SEQ ID NO: 1317733 - protein, 24 aa, Mycobacterium
GRSTQRRVYVRPIMQPHPFSGQGE

SEQ ID NO: 1317734 - protein, 26 aa, Mycobacterium
GRSTTPDHWWAWQTKAWSAGEREPRA

SEQ ID NO: 1317735 - protein, 23 aa, Mycobacterium
GRSTVYRHWKNKGALIVDALRTL

SEQ ID NO: 1317736 - protein, 19 aa, Mycobacterium
GRTDLLRRWLELPEGRDDR

SEQ ID NO: 1317737 - protein, 19 aa, Mycobacterium
GRTIGQFPSPYTQGNPLVA

SEQ ID NO: 1317738 - protein, 20 aa, Mycobacterium
GRTLGALSVSWREEWRAPFE

SEQ ID NO: 1317739 - protein, 28 aa, Mycobacterium
GRTQRALFGMLMTWDIPPWLDARGCVRT

SEQ ID NO: 1317740 - protein, 46 aa, Mycobacterium
GRTTQVWRTYRHTAPFEAGSPWLLRFFDRISWYPVSAEELLDLRAD

SEQ ID NO: 1317741 - protein, 22 aa, Mycobacterium
GRVAGVHFLMKKNKITEIHGYG

SEQ ID NO: 1317742 - protein, 25 aa, Mycobacterium
GRVDGPLYRVVGAQGVLRDVRRVEA

SEQ ID NO: 1317743 - protein, 26 aa, Mycobacterium
GRVDPDGTVWLITSSGERTIGSWQAG

SEQ ID NO: 1317744 - protein, 24 aa, Mycobacterium
GRVEFGIGAGWFEAEHKAYAIPFP

SEQ ID NO: 1317745 - protein, 18 aa, Mycobacterium
GRVGFGAMQLPGPGVFGP

SEQ ID NO: 1317746 - protein, 25 aa, Mycobacterium
GRVKQMLLKIGWPAEDLAGYVDGEA

SEQ ID NO: 1317747 - protein, 33 aa, Mycobacterium
GRVNLKDLNWKSRPYLAWPAYGQSKLANLLFTG

SEQ ID NO: 1317748 - protein, 20 aa, Mycobacterium
GRVTGFYKDVVLLDQPAVSD

SEQ ID NO: 1317749 - protein, 19 aa, Mycobacterium
GRWAEYLLASRSTTIYGGT

SEQ ID NO: 1317750 - protein, 19 aa, Mycobacterium
GRWLPRVVAAFVDTPDRAL

SEQ ID NO: 1317751 - protein, 25 aa, Mycobacterium
GRYCRELVSPFWELHPELVAGKMEL

SEQ ID NO: 1317752 - protein, 17 aa, Mycobacterium
GRYSPYAVYLPGGDPGR

SEQ ID NO: 1317753 - protein, 20 aa, Mycobacterium
GRYVEHFWSVAWDLRGRDPF

SEQ ID NO: 1317754 - protein, 29 aa, Mycobacterium
GSAAHAFDLFRWLGPSPDALLSAAGTVAA

SEQ ID NO: 1317755 - protein, 23 aa, Mycobacterium
GSAALPVPVFDGLAALSGHRAIE

SEQ ID NO: 1317756 - protein, 19 aa, Mycobacterium
GSAGLFGRPGSGGRGGDSH

SEQ ID NO: 1317757 - protein, 23 aa, Mycobacterium
GSAGPLGWFYSANHSPSVVEFLR

SEQ ID NO: 1317758 - protein, 18 aa, Mycobacterium
GSAIGQHWMYDGKHVLIV

SEQ ID NO: 1317759 - protein, 21 aa, Mycobacterium
GSALNLLRWTSARSIKETFVP

SEQ ID NO: 1317760 - protein, 21 aa, Mycobacterium
GSALRTGFFAASGDIIVMMDA

SEQ ID NO: 1317761 - protein, 21 aa, Mycobacterium
GSALVRQIFVYGNSARSYLLA

SEQ ID NO: 1317762 - protein, 18 aa, Mycobacterium
GSANVDLTFSVTALPRPG

SEQ ID NO: 1317763 - protein, 20 aa, Mycobacterium
GSARFGIRALTAYCVAKGGL

SEQ ID NO: 1317764 - protein, 24 aa, Mycobacterium
GSATATRRRSAPAAATRGSRATAA

SEQ ID NO: 1317765 - protein, 22 aa, Mycobacterium
GSAVLSVGYRRGPESRFPTAVD

SEQ ID NO: 1317766 - protein, 24 aa, Mycobacterium
GSAVWWASRINALPFHIAQAHDDL

SEQ ID NO: 1317767 - protein, 24 aa, Mycobacterium
GSDACPLFVSDWPRLADGLLQLSV

SEQ ID NO: 1317768 - protein, 22 aa, Mycobacterium
GSDIPYIGHLLSVAGLVIEGGG

SEQ ID NO: 1317769 - protein, 33 aa, Mycobacterium
GSDPGPWDDLAFAPLTCLLLAASPQGLGLGIDW

SEQ ID NO: 1317770 - protein, 23 aa, Mycobacterium
GSDPLYMLTGVIPATEKVLARSG

SEQ ID NO: 1317771 - protein, 28 aa, Mycobacterium
GSDRRSLFLLRNSPWPSGPKTAAVIDEF

SEQ ID NO: 1317772 - protein, 24 aa, Mycobacterium
GSDVGRLRRFAVRFSKMVLPGDDL

SEQ ID NO: 1317773 - protein, 25 aa, Mycobacterium
GSDVRLYSPAYWQAVTIDTRPADER

SEQ ID NO: 1317774 - protein, 17 aa, Mycobacterium
GSFFAAPILIENLAREA

SEQ ID NO: 1317775 - protein, 23 aa, Mycobacterium
GSFRWASARAHRLAARLVEIGVD

SEQ ID NO: 1317776 - protein, 24 aa, Mycobacterium
GSGAQFPAWVRQLERIFGVSASTY

SEQ ID NO: 1317777 - protein, 22 aa, Mycobacterium
GSGGTSRLLLPGSISIAREIIE

SEQ ID NO: 1317778 - protein, 23 aa, Mycobacterium
GSGITPMLAILKSALVEGSGKVV

SEQ ID NO: 1317779 - protein, 26 aa, Mycobacterium
GSGKSHLIGLMAEQWILAGYGVLVVD

SEQ ID NO: 1317780 - protein, 25 aa, Mycobacterium
GSGKTLAFSIPLVTALTGRRSQPSR

SEQ ID NO: 1317781 - protein, 18 aa, Mycobacterium
GSGMAALTSVLRVVAEPG

SEQ ID NO: 1317782 - protein, 25 aa, Mycobacterium
GSGRRRPVPPPPWNSEDTAAQGNPG

SEQ ID NO: 1317783 - protein, 19 aa, Mycobacterium
GSHWAPTVAFDRFVESPTS

SEQ ID NO: 1317784 - protein, 20 aa, Mycobacterium
GSHWPFEQWGRFLPEQTTAV

SEQ ID NO: 1317785 - protein, 20 aa, Mycobacterium
GSIIFTVSNAGFWPGGGGPL

SEQ ID NO: 1317786 - protein, 23 aa, Mycobacterium
GSIRPHPSFVPYAASKAGLNAMT

SEQ ID NO: 1317787 - protein, 26 aa, Mycobacterium
GSIVRQYFLTLRTIHKLALPDRLLTA

SEQ ID NO: 1317788 - protein, 20 aa, Mycobacterium
GSIYAFEAPLLLGSRAVLME

SEQ ID NO: 1317789 - protein, 24 aa, Mycobacterium
GSLAGMHPVDLGAAGWRGLFARND

SEQ ID NO: 1317790 - protein, 23 aa, Mycobacterium
GSLARLPMILSDGHLRELALTGK

SEQ ID NO: 1317791 - protein, 25 aa, Mycobacterium
GSLKPALFVVPTDTPGFTYTKIPME

SEQ ID NO: 1317792 - protein, 24 aa, Mycobacterium
GSLLGIGFPLWTGGAAQFIAGYPG

SEQ ID NO: 1317793 - protein, 20 aa, Mycobacterium
GSLPAGMIELLMLRAERFGV

SEQ ID NO: 1317794 - protein, 23 aa, Mycobacterium
GSLRLELSQYRELEAFAAFASDL

SEQ ID NO: 1317795 - protein, 17 aa, Mycobacterium
GSLSGFLNLSEGWWPFL

SEQ ID NO: 1317796 - protein, 25 aa, Mycobacterium
GSLVAGLGLRLPVIETRLGTFETAS

SEQ ID NO: 1317797 - protein, 26 aa, Mycobacterium
GSMDPYNWFYEMVLERYPGAFEPMDA

SEQ ID NO: 1317798 - protein, 27 aa, Mycobacterium
GSMPSWHTYFPPIGGFRFSMFTLPPGA

SEQ ID NO: 1317799 - protein, 25 aa, Mycobacterium
GSNFVLSVLGYQNSVDYRDVHGGTY

SEQ ID NO: 1317800 - protein, 26 aa, Mycobacterium
GSNLAGLSFPFLREKIHGRSNPRIVA

SEQ ID NO: 1317801 - protein, 17 aa, Mycobacterium
GSNLQPWRIYVLTGEPL

SEQ ID NO: 1317802 - protein, 28 aa, Mycobacterium
GSPDLPATVLPFILRGVTLAGIDSVLLP

SEQ ID NO: 1317803 - protein, 39 aa, Mycobacterium
GSPMAAILLSLLWEGKPLLGLTWLPFMGQRYTSMVGAPV

SEQ ID NO: 1317804 - protein, 27 aa, Mycobacterium
GSPRIRDLELVAFVAGLLLAIDGKPGE

SEQ ID NO: 1317805 - protein, 19 aa, Mycobacterium
GSPTLLYLAAAGVGTIGIV

SEQ ID NO: 1317806 - protein, 23 aa, Mycobacterium
GSPTPALRKIATTTAHLIAGSAT

SEQ ID NO: 1317807 - protein, 29 aa, Mycobacterium
GSQIQPHITRRFSMPWSAPADRMREYIHA

SEQ ID NO: 1317808 - protein, 24 aa, Mycobacterium
GSQSIRVFAPLPPAGRLSVVSEVA

SEQ ID NO: 1317809 - protein, 21 aa, Mycobacterium
GSQVLVFKDLGLVSQVFDEQT

SEQ ID NO: 1317810 - protein, 22 aa, Mycobacterium
GSRASHIVVWATLDKSKGRAAI

SEQ ID NO: 1317811 - protein, 17 aa, Mycobacterium
GSRAWAAMYLGTPTTPE

SEQ ID NO: 1317812 - protein, 17 aa, Mycobacterium
GSRFLLDQPTTSAGRHP

SEQ ID NO: 1317813 - protein, 23 aa, Mycobacterium
GSRLDCDMLVIAAGIRPNVGLAQ

SEQ ID NO: 1317814 - protein, 23 aa, Mycobacterium
GSRMRFHHPLARSATYRTADLTE

SEQ ID NO: 1317815 - protein, 25 aa, Mycobacterium
GSRQYEWLRWELESPEFRDARFTVV

SEQ ID NO: 1317816 - protein, 24 aa, Mycobacterium
GSRRKPMALIRALLRTDVTDLTVV

SEQ ID NO: 1317817 - protein, 31 aa, Mycobacterium
GSSEPPFLPSLDKFVEFLGEGQFDQIAQNHA

SEQ ID NO: 1317818 - protein, 26 aa, Mycobacterium
GSSINLMVWARGHKADWDYFAFESGD

SEQ ID NO: 1317819 - protein, 24 aa, Mycobacterium
GSSLTWKALLPHLATRYRVIAPDL

SEQ ID NO: 1317820 - protein, 23 aa, Mycobacterium
GSTATFQHLWREVGTHIDRYDTY

SEQ ID NO: 1317821 - protein, 25 aa, Mycobacterium
GSTDLPALFAIPVAGSEAPLGAYTA

SEQ ID NO: 1317822 - protein, 24 aa, Mycobacterium
GSTEHRFLYFPSENHWVLSPQHAK

SEQ ID NO: 1317823 - protein, 24 aa, Mycobacterium
GSTLRIIHRLALPDRPAVAAIASS

SEQ ID NO: 1317824 - protein, 23 aa, Mycobacterium
GSTPLAEWAAGAAAINLLTGQVT

SEQ ID NO: 1317825 - protein, 23 aa, Mycobacterium
GSTRLPRALKAKDPGRMLPVVSM

SEQ ID NO: 1317826 - protein, 18 aa, Mycobacterium
GSVALVGLALLECLSGPT

SEQ ID NO: 1317827 - protein, 22 aa, Mycobacterium
GSVGIPMRCVFALTAMGFLPQS

SEQ ID NO: 1317828 - protein, 23 aa, Mycobacterium
GSVGKWLKKLLSSARKSGGSGGG

SEQ ID NO: 1317829 - protein, 18 aa, Mycobacterium
GSVLAEVGLDRPAAQRFT

SEQ ID NO: 1317830 - protein, 18 aa, Mycobacterium
GSVLWRRAMGLVLGEWVR

SEQ ID NO: 1317831 - protein, 52 aa, Mycobacterium
GSVMNLVTLFMGHLYGWIIALRPSGAFFPVEQLLVHAQWILDFVDTINIPAD

SEQ ID NO: 1317832 - protein, 25 aa, Mycobacterium
GSVRFLMSVGDLVLGWLLQQQAAVA

SEQ ID NO: 1317833 - protein, 28 aa, Mycobacterium
GSVTLADRPAPLLVLLAGGQEAVAVQML

SEQ ID NO: 1317834 - protein, 22 aa, Mycobacterium
GSVVLLVPRAGGKIRRIECEAV

SEQ ID NO: 1317835 - protein, 24 aa, Mycobacterium
GSVYPTLQLLVDEGLIVGTESEGS

SEQ ID NO: 1317836 - protein, 24 aa, Mycobacterium
GSWGGTLVGLFQPAEETGDGARGM

SEQ ID NO: 1317837 - protein, 17 aa, Mycobacterium
GSWGLTAELWAMQLPFG

SEQ ID NO: 1317838 - protein, 26 aa, Mycobacterium
GSWHGKAPRLWLVTQGGLVVSPEDGQ

SEQ ID NO: 1317839 - protein, 22 aa, Mycobacterium
GSWPYGLPELPGGRDRLREARR

SEQ ID NO: 1317840 - protein, 23 aa, Mycobacterium
GSYATGMAFLPQSSKDAAIACAA

SEQ ID NO: 1317841 - protein, 34 aa, Mycobacterium
GSYPYEDLYMLPAARQFVPIMRNTELILLGGITN

SEQ ID NO: 1317842 - protein, 23 aa, Mycobacterium
GSYYLPTIFDRCDRSMRIVTEET

SEQ ID NO: 1317843 - protein, 22 aa, Mycobacterium
GTAAFLVWGDPSLYDSTIRVVE

SEQ ID NO: 1317844 - protein, 26 aa, Mycobacterium
GTAALPAPFISSAVLTVALINAAGSD

SEQ ID NO: 1317845 - protein, 18 aa, Mycobacterium
GTADRPRLVVNRSARHIH

SEQ ID NO: 1317846 - protein, 23 aa, Mycobacterium
GTAIVSGRYPPGAVLTLEGVSAE

SEQ ID NO: 1317847 - protein, 25 aa, Mycobacterium
GTAPIERILMRFPGVTEAAVYPIPD

SEQ ID NO: 1317848 - protein, 25 aa, Mycobacterium
GTAPMDLWTIRIRALLASARGERQR

SEQ ID NO: 1317849 - protein, 26 aa, Mycobacterium
GTDALTPTFAKLLPMAFPHADLVDAE

SEQ ID NO: 1317850 - protein, 26 aa, Mycobacterium
GTDALTPTFAKLLPMAFPNAELVDAE

SEQ ID NO: 1317851 - protein, 24 aa, Mycobacterium
GTDHCDWIFLGAMIGDAEGKPLMP

SEQ ID NO: 1317852 - protein, 23 aa, Mycobacterium
GTDPGLLARYLMTVGNGIAVQAA

SEQ ID NO: 1317853 - protein, 24 aa, Mycobacterium
GTEAPAEMHFYFPRFRALCMAENA

SEQ ID NO: 1317854 - protein, 17 aa, Mycobacterium
GTEFPYRPYMQKELRVL

SEQ ID NO: 1317855 - protein, 24 aa, Mycobacterium
GTEIHPDRWWEALQRTIEAVGGFD

SEQ ID NO: 1317856 - protein, 21 aa, Mycobacterium
GTEKLPYSLKVLAENLLRTED

SEQ ID NO: 1317857 - protein, 25 aa, Mycobacterium
GTERIAPLVPLLDDGRIFVFASKGG

SEQ ID NO: 1317858 - protein, 25 aa, Mycobacterium
GTFEDPIIFLKPNTAIIGPNTPIQL

SEQ ID NO: 1317859 - protein, 20 aa, Mycobacterium
GTFLPDDELVRYFRGRGATE

SEQ ID NO: 1317860 - protein, 26 aa, Mycobacterium
GTFMQRTIFHLPGLPAARDGLERDFA

SEQ ID NO: 1317861 - protein, 17 aa, Mycobacterium
GTFSWPGAYGTWWQADP

SEQ ID NO: 1317862 - protein, 23 aa, Mycobacterium
GTGACGAARWSGAGAGSGGGTGA

SEQ ID NO: 1317863 - protein, 20 aa, Mycobacterium
GTGGTGGTGGFGGQGGQGGT

SEQ ID NO: 1317864 - protein, 31 aa, Mycobacterium
GTGKYYSGVKWTWYRPIYAGRPVLVENYTLD

SEQ ID NO: 1317865 - protein, 24 aa, Mycobacterium
GTGLWPLNPVLAFAGLGAAARLPA

SEQ ID NO: 1317866 - protein, 26 aa, Mycobacterium
GTGMGIDRLLMALTGLSIRETVLFPI

SEQ ID NO: 1317867 - protein, 23 aa, Mycobacterium
GTGPIPLRAFAGGVLPQTPNTEP

SEQ ID NO: 1317868 - protein, 32 aa, Mycobacterium
GTGPPDIDLGWWLMFERFLCESLGFTRPPGVP

SEQ ID NO: 1317869 - protein, 24 aa, Mycobacterium
GTGRPYLVEGVGEDFWPAAYDPSV

SEQ ID NO: 1317870 - protein, 26 aa, Mycobacterium
GTGSDLYWNLSLWSDYNVMLMKTDLT

SEQ ID NO: 1317871 - protein, 25 aa, Mycobacterium
GTGSVLPPPVAPPPAQPLSSTTGAS

SEQ ID NO: 1317872 - protein, 25 aa, Mycobacterium
GTGVKGRFLAWFYTAVGQVPIDRTD

SEQ ID NO: 1317873 - protein, 24 aa, Mycobacterium
GTGWLHGWRLTFGGADIAWEGALA

SEQ ID NO: 1317874 - protein, 26 aa, Mycobacterium
GTGYRGYLIYRPELYARRTIERLGRW

SEQ ID NO: 1317875 - protein, 24 aa, Mycobacterium
GTHSSGIGVLRWLPAVPEALADDP

SEQ ID NO: 1317876 - protein, 20 aa, Mycobacterium
GTHVLVLMASLDGPAAGLIH

SEQ ID NO: 1317877 - protein, 25 aa, Mycobacterium
GTIDAPIGRHRGHDWKFAVTEGGRH

SEQ ID NO: 1317878 - protein, 24 aa, Mycobacterium
GTIDAPIGRHRGHDWKFAVVEGGR

SEQ ID NO: 1317879 - protein, 18 aa, Mycobacterium
GTIGPAMTFGYLAALDIA

SEQ ID NO: 1317880 - protein, 25 aa, Mycobacterium
GTKGLSLFLVPKFHFDPQTGEPGER

SEQ ID NO: 1317881 - protein, 28 aa, Mycobacterium
GTKVWTSGAHLAHAFIALARTAPVDPAH

SEQ ID NO: 1317882 - protein, 26 aa, Mycobacterium
GTLIPARVVAAPWLSRLQPVGEDVSV

SEQ ID NO: 1317883 - protein, 21 aa, Mycobacterium
GTLKKVFLELGGKSAAIVLDD

SEQ ID NO: 1317884 - protein, 18 aa, Mycobacterium
GTLLGRLSAFFSAAMHAE

SEQ ID NO: 1317885 - protein, 23 aa, Mycobacterium
GTLQYRVLRAFRRAGIDAGRARG

SEQ ID NO: 1317886 - protein, 17 aa, Mycobacterium
GTLVYDRDPREIHQPII

SEQ ID NO: 1317887 - protein, 35 aa, Mycobacterium
GTMPAGLARWAAAQLAPAVVPWPKVLRAAVRRAVE

SEQ ID NO: 1317888 - protein, 30 aa, Mycobacterium
GTMPRPELRFGSFAELLLNKGLAHEQDCLA

SEQ ID NO: 1317889 - protein, 25 aa, Mycobacterium
GTNHLGHFALTCLLGDRIRDRVVSV

SEQ ID NO: 1317890 - protein, 25 aa, Mycobacterium
GTNLVGWLYRIMVNTHISAYRRQQH

SEQ ID NO: 1317891 - protein, 22 aa, Mycobacterium
GTNMLFTMRSAWSRAQDCAGDV

SEQ ID NO: 1317892 - protein, 17 aa, Mycobacterium
GTPAAFIVPLHDGGWIT

SEQ ID NO: 1317893 - protein, 25 aa, Mycobacterium
GTPAQRLPLKNRPVLPWAGTTLSVV

SEQ ID NO: 1317894 - protein, 26 aa, Mycobacterium
GTPATPDLILFRRGGAPAALADSIRN

SEQ ID NO: 1317895 - protein, 27 aa, Mycobacterium
GTPGKIEALLRVLEPYGIREIVQSGVV

SEQ ID NO: 1317896 - protein, 17 aa, Mycobacterium
GTPVLVCRLDETLYAYR

SEQ ID NO: 1317897 - protein, 18 aa, Mycobacterium
GTPWAYQQLGITPDVVAF

SEQ ID NO: 1317898 - protein, 27 aa, Mycobacterium
GTQGAFFLRVIGWSGGRQRVIVEHITR

SEQ ID NO: 1317899 - protein, 27 aa, Mycobacterium
GTQLDVLIDVLVSKLPPGPAFYPDGEL

SEQ ID NO: 1317900 - protein, 27 aa, Mycobacterium
GTQRIVRALMTGYLLYTLTGDKTYRAF

SEQ ID NO: 1317901 - protein, 28 aa, Mycobacterium
GTQRRAYLAWFYRIVDVPSTGPSLDWIR

SEQ ID NO: 1317902 - protein, 24 aa, Mycobacterium
GTQYTSWLFGHRLREAGLLGSMGK

SEQ ID NO: 1317903 - protein, 18 aa, Mycobacterium
GTRIARWRRAAGADEGLI

SEQ ID NO: 1317904 - protein, 29 aa, Mycobacterium
GTRMKLARNMLTFVGFTAACEAMRLAEAA

SEQ ID NO: 1317905 - protein, 26 aa, Mycobacterium
GTRPKVLLLPLGPLAEHNIRATFATN

SEQ ID NO: 1317906 - protein, 19 aa, Mycobacterium
GTRVLYVSPLKALAVDVER

SEQ ID NO: 1317907 - protein, 18 aa, Mycobacterium
GTSALDMMAPGAGAAAKV

SEQ ID NO: 1317908 - protein, 25 aa, Mycobacterium
GTSALFSFGAPLDPHFGLDSAQRHR

SEQ ID NO: 1317909 - protein, 18 aa, Mycobacterium
GTSDAMLHVLARDMRHLE

SEQ ID NO: 1317910 - protein, 19 aa, Mycobacterium
GTSDGRILRVRGRGVPKRS

SEQ ID NO: 1317911 - protein, 26 aa, Mycobacterium
GTSFDPQWWQRAAELGWASLLVPEEL

SEQ ID NO: 1317912 - protein, 26 aa, Mycobacterium
GTSGIRYFRVPAGLTFRGQVAADIEC

SEQ ID NO: 1317913 - protein, 24 aa, Mycobacterium
GTSKPAIYRRWRGKAHLVHEAVFP

SEQ ID NO: 1317914 - protein, 27 aa, Mycobacterium
GTSLRRYRLWMRLMQAGAAVSSGTNLT

SEQ ID NO: 1317915 - protein, 26 aa, Mycobacterium
GTSMRGMLQAVFGRGPRGGAVNARAA

SEQ ID NO: 1317916 - protein, 25 aa, Mycobacterium
GTSSWTLIELLRHPEFYAKVQQELD

SEQ ID NO: 1317917 - protein, 23 aa, Mycobacterium
GTSVQLWPHRHGTDAMFAAALRV

SEQ ID NO: 1317918 - protein, 21 aa, Mycobacterium
GTSYWYAHTGQWRYDGYRADA

SEQ ID NO: 1317919 - protein, 23 aa, Mycobacterium
GTTDIEYKFGFAGNPWGELEGIA

SEQ ID NO: 1317920 - protein, 17 aa, Mycobacterium
GTTETYLHKRAADLPPA

SEQ ID NO: 1317921 - protein, 25 aa, Mycobacterium
GTTHVGAMLLFKKPPGRGSLVREIV

SEQ ID NO: 1317922 - protein, 21 aa, Mycobacterium
GTTLSLRIAGAAPATTLGGGT

SEQ ID NO: 1317923 - protein, 23 aa, Mycobacterium
GTTWRPKVPLGYGRTYTLEAVGG

SEQ ID NO: 1317924 - protein, 28 aa, Mycobacterium
GTTYEKISQLKPVFRPNGTITAGNACPL

SEQ ID NO: 1317925 - protein, 21 aa, Mycobacterium
GTVDFYLGLSNYLNNWKRLGF

SEQ ID NO: 1317926 - protein, 24 aa, Mycobacterium
GTVGGAPMMLPPGSMGPPAGPFPP

SEQ ID NO: 1317927 - protein, 26 aa, Mycobacterium
GTVLYPELHDCFYNEQFLAHAKSYWN

SEQ ID NO: 1317928 - protein, 22 aa, Mycobacterium
GTVRGTQFLEPLFEFSGACAGC

SEQ ID NO: 1317929 - protein, 24 aa, Mycobacterium
GTVRMIEAYHRLSKLNEYSAVDFT

SEQ ID NO: 1317930 - protein, 26 aa, Mycobacterium
GTVRRDPMAMLPFLGYNVGDYFQHWI

SEQ ID NO: 1317931 - protein, 25 aa, Mycobacterium
GTVSPINLTVWQGFPIVSRVASLTG

SEQ ID NO: 1317932 - protein, 23 aa, Mycobacterium
GTVSWAPVWARYGTNNRSCMLRL

SEQ ID NO: 1317933 - protein, 25 aa, Mycobacterium
GTVTYGPIWDWQRSHVFEYLAGRGI

SEQ ID NO: 1317934 - protein, 26 aa, Mycobacterium
GTVVRSWLQQLLAKALKEDPSLSDIS

SEQ ID NO: 1317935 - protein, 18 aa, Mycobacterium
GTVYIVQAALDALTASGH

SEQ ID NO: 1317936 - protein, 17 aa, Mycobacterium
GTWEWLGPNIVGGVVPR

SEQ ID NO: 1317937 - protein, 33 aa, Mycobacterium
GTYAPYLDVPKQLIRLRILNASNARRYNFAFSD

SEQ ID NO: 1317938 - protein, 24 aa, Mycobacterium
GTYHLRGDRQVFCRNGTVACSPAS

SEQ ID NO: 1317939 - protein, 26 aa, Mycobacterium
GTYLNGFYEIRPLPYAEAGFGYPEEG

SEQ ID NO: 1317940 - protein, 23 aa, Mycobacterium
GVAAFLRWCAATDTPPAITKPAV

SEQ ID NO: 1317941 - protein, 23 aa, Mycobacterium
GVAAGLAMGFPMLCAGVSAGTVV

SEQ ID NO: 1317942 - protein, 27 aa, Mycobacterium
GVAEWHGFDIWRQRAAFLEAAVGGLAA

SEQ ID NO: 1317943 - protein, 18 aa, Mycobacterium
GVAFSTARAGKLGVPCRW

SEQ ID NO: 1317944 - protein, 24 aa, Mycobacterium
GVAGERIMPVPPLPPDEASALFAD

SEQ ID NO: 1317945 - protein, 24 aa, Mycobacterium
GVAKTLLVRTLAAALQLDFKRVQF

SEQ ID NO: 1317946 - protein, 21 aa, Mycobacterium
GVALAMWAGLPVSDLEFIQFH

SEQ ID NO: 1317947 - protein, 29 aa, Mycobacterium
GVALLPGVKILPIVALAEAIRAGAAIKTL

SEQ ID NO: 1317948 - protein, 28 aa, Mycobacterium
GVALLPGVKILPIVALAEAIRSGAAIKT

SEQ ID NO: 1317949 - protein, 28 aa, Mycobacterium
GVALLPGVKILPLVALAEAIRSGAATKT

SEQ ID NO: 1317950 - protein, 28 aa, Mycobacterium
GVALLPGVKVLPIVALAEAIRAGAAIKS

SEQ ID NO: 1317951 - protein, 28 aa, Mycobacterium
GVALLPGVKVLPIVALAEAIRAGAAIKT

SEQ ID NO: 1317952 - protein, 19 aa, Mycobacterium
GVALRRFVARWLGPAILYP

SEQ ID NO: 1317953 - protein, 23 aa, Mycobacterium
GVAPGRFFRASELSKLDDTGRAA

SEQ ID NO: 1317954 - protein, 21 aa, Mycobacterium
GVAPLVFHGSAFRRLEVAVDT

SEQ ID NO: 1317955 - protein, 26 aa, Mycobacterium
GVARISFGPFWQAALAERAREILARW

SEQ ID NO: 1317956 - protein, 25 aa, Mycobacterium
GVARTVRMFGIQKAFMEILSQGTRF

SEQ ID NO: 1317957 - protein, 17 aa, Mycobacterium
GVATLFGLFADVRQLLI

SEQ ID NO: 1317958 - protein, 19 aa, Mycobacterium
GVATWWRTVGPKVAGLPNL

SEQ ID NO: 1317959 - protein, 25 aa, Mycobacterium
GVAVPAFPNFLSLAGPYATSGLSFF

SEQ ID NO: 1317960 - protein, 23 aa, Mycobacterium
GVAWSEMAVIVRSLPRAGAPLAR

SEQ ID NO: 1317961 - protein, 27 aa, Mycobacterium
GVCQDFAHLTLMLLRGMGIPSRYVSGY

SEQ ID NO: 1317962 - protein, 31 aa, Mycobacterium
GVDDPAFTGWHRLEYLLFSQNTTEGGAQFAD

SEQ ID NO: 1317963 - protein, 21 aa, Mycobacterium
GVDFVQNTWRFGIDRVLAGVA

SEQ ID NO: 1317964 - protein, 18 aa, Mycobacterium
GVDPVDWRGWRAIDAAER

SEQ ID NO: 1317965 - protein, 25 aa, Mycobacterium
GVDRPDMGITGWVALTIAQAGTDDQ

SEQ ID NO: 1317966 - protein, 26 aa, Mycobacterium
GVDRPLTTEKHYRRARGRLAEITLTD

SEQ ID NO: 1317967 - protein, 32 aa, Mycobacterium
GVDTLRVGVLPTPAVAYLTSAYDADFGVMISA

SEQ ID NO: 1317968 - protein, 20 aa, Mycobacterium
GVDVLPVLAFTFTMVTGGND

SEQ ID NO: 1317969 - protein, 25 aa, Mycobacterium
GVDVNWVCSRLEDLPLPPGGFDLVT

SEQ ID NO: 1317970 - protein, 26 aa, Mycobacterium
GVDVPAQNRWWWDLLTHGRGSRYAEF

SEQ ID NO: 1317971 - protein, 23 aa, Mycobacterium
GVEFVPALLSRILTRTISAAEAL

SEQ ID NO: 1317972 - protein, 22 aa, Mycobacterium
GVEGELALKPGWPSMFRGYLHQ

SEQ ID NO: 1317973 - protein, 20 aa, Mycobacterium
GVEHTIEWYPAFHGFAVPDN

SEQ ID NO: 1317974 - protein, 18 aa, Mycobacterium
GVFKSMAIPLTTAAFAFT

SEQ ID NO: 1317975 - protein, 21 aa, Mycobacterium
GVFQNALLLRMTLRALTERGV

SEQ ID NO: 1317976 - protein, 19 aa, Mycobacterium
GVGDEWAMRAAPLGVVSGA

SEQ ID NO: 1317977 - protein, 35 aa, Mycobacterium
GVGDRAPFVWDGAPGVRPFLLFGDAPAGVDVPVRV

SEQ ID NO: 1317978 - protein, 24 aa, Mycobacterium
GVGFGKFDYIFVWRVEVRNHRELP

SEQ ID NO: 1317979 - protein, 17 aa, Mycobacterium
GVGFIALAAADCARSGG

SEQ ID NO: 1317980 - protein, 19 aa, Mycobacterium
GVGQHDRAHARRARRPHRV

SEQ ID NO: 1317981 - protein, 24 aa, Mycobacterium
GVGREMWMRCLDINLVGAYNTIDA

SEQ ID NO: 1317982 - protein, 23 aa, Mycobacterium
GVGSDAIWLAAQGWKSTALDVSR

SEQ ID NO: 1317983 - protein, 22 aa, Mycobacterium
GVGSKGWYVAPTVLAGVAPQAD

SEQ ID NO: 1317984 - protein, 18 aa, Mycobacterium
GVGVLVVCPAAVETPILD

SEQ ID NO: 1317985 - protein, 23 aa, Mycobacterium
GVHDLIAALPRIRRAHPGTTLTI

SEQ ID NO: 1317986 - protein, 18 aa, Mycobacterium
GVHDLIAALPRIRRTHPG

SEQ ID NO: 1317987 - protein, 39 aa, Mycobacterium
GVHGRQTLALTTLTTLTSRGPILGLFGDGVDAARDCTGT

SEQ ID NO: 1317988 - protein, 18 aa, Mycobacterium
GVHPGHRRVFTGKRATVS

SEQ ID NO: 1317989 - protein, 23 aa, Mycobacterium
GVIANNPLRLGGCLNSESAEKSA

SEQ ID NO: 1317990 - protein, 18 aa, Mycobacterium
GVILLFLEGEQARTHGHW

SEQ ID NO: 1317991 - protein, 21 aa, Mycobacterium
GVKAFGRMFAESLWLELREQG

SEQ ID NO: 1317992 - protein, 17 aa, Mycobacterium
GVKAVMVSMRRALQQMG

SEQ ID NO: 1317993 - protein, 23 aa, Mycobacterium
GVKGRVLPMCPVGLGIEADVVGL

SEQ ID NO: 1317994 - protein, 32 aa, Mycobacterium
GVKLVEFQAIRPFHPLRLHRAIDDLLDGVVRL

SEQ ID NO: 1317995 - protein, 31 aa, Mycobacterium
GVKQALVYYYFPTMDDLFVEVLRAGGESALE

SEQ ID NO: 1317996 - protein, 18 aa, Mycobacterium
GVKRFTPTVFTRAAGIAT

SEQ ID NO: 1317997 - protein, 24 aa, Mycobacterium
GVKSLEGLLAWKLGTSFRNAETIV

SEQ ID NO: 1317998 - protein, 24 aa, Mycobacterium
GVKSMEGLIAWKLGTSFRNAETIV

SEQ ID NO: 1317999 - protein, 27 aa, Mycobacterium
GVLAAPPGAMPPGDIAPPPGGATRAVA

SEQ ID NO: 1318000 - protein, 23 aa, Mycobacterium
GVLAIPIHYRGLHLHLRVSGKGV

SEQ ID NO: 1318001 - protein, 18 aa, Mycobacterium
GVLELIADLGAEGMTMVV

SEQ ID NO: 1318002 - protein, 20 aa, Mycobacterium
GVLHCTRAVLPTMIANTWGR

SEQ ID NO: 1318003 - protein, 18 aa, Mycobacterium
GVLHRTLRSELLGKPVRL

SEQ ID NO: 1318004 - protein, 27 aa, Mycobacterium
GVLLDNVPDFVFWLGGAALAGATIVGL

SEQ ID NO: 1318005 - protein, 18 aa, Mycobacterium
GVLQWRGSAGPGTTVDLL

SEQ ID NO: 1318006 - protein, 22 aa, Mycobacterium
GVLRAIALNLRAGVRIFEDDYA

SEQ ID NO: 1318007 - protein, 18 aa, Mycobacterium
GVLVFPGLHLDPQAQVEF

SEQ ID NO: 1318008 - protein, 19 aa, Mycobacterium
GVMFPLSPVAPAPRGHRPG

SEQ ID NO: 1318009 - protein, 17 aa, Mycobacterium
GVMFSLHVKATMMKVSH

SEQ ID NO: 1318010 - protein, 23 aa, Mycobacterium
GVMFSLHVKATMMKVSHPIVFGH

SEQ ID NO: 1318011 - protein, 17 aa, Mycobacterium
GVMLGMDEPIHGRLRSL

SEQ ID NO: 1318012 - protein, 17 aa, Mycobacterium
GVNITYKILYNGAVAMT

SEQ ID NO: 1318013 - protein, 28 aa, Mycobacterium
GVNPRELAGWLAEALTAAAGIASAEVAG

SEQ ID NO: 1318014 - protein, 20 aa, Mycobacterium
GVNQLLDVLAQLAPSPNGAL

SEQ ID NO: 1318015 - protein, 25 aa, Mycobacterium
GVNRSTVYYYFPTKDAILVASFVRA

SEQ ID NO: 1318016 - protein, 28 aa, Mycobacterium
GVPAEPRFRPVPPPTPPPPPPAHTGIFG

SEQ ID NO: 1318017 - protein, 23 aa, Mycobacterium
GVPAICFACGYPTMHPGLCAYCR

SEQ ID NO: 1318018 - protein, 22 aa, Mycobacterium
GVPDYLGWDWKTKAGIPIVCVP

SEQ ID NO: 1318019 - protein, 24 aa, Mycobacterium
GVPGPDRVPLLALLRSTPLTEDQT

SEQ ID NO: 1318020 - protein, 18 aa, Mycobacterium
GVPIEWSAARYRRLMVLR

SEQ ID NO: 1318021 - protein, 37 aa, Mycobacterium
GVPKATLYYYFAGKEDILAFLLEDLLKDIFDAVTAIV

SEQ ID NO: 1318022 - protein, 35 aa, Mycobacterium
GVPKATLYYYFAGKEDILAFLLEDLLKDISEAVTA

SEQ ID NO: 1318023 - protein, 19 aa, Mycobacterium
GVPPSIPTPGVPPTVPGQQ

SEQ ID NO: 1318024 - protein, 25 aa, Mycobacterium
GVPQTDYFALLALLARTLSEDEVVK

SEQ ID NO: 1318025 - protein, 17 aa, Mycobacterium
GVPTLFFPDGQCLFGPV

SEQ ID NO: 1318026 - protein, 26 aa, Mycobacterium
GVPTPANFLYLPDPVTLGSSLLHAIP

SEQ ID NO: 1318027 - protein, 26 aa, Mycobacterium
GVPVETWLTAIADLLARFHSRAERGD

SEQ ID NO: 1318028 - protein, 23 aa, Mycobacterium
GVQFDDLLAAGLLILDLAADGVV

SEQ ID NO: 1318029 - protein, 23 aa, Mycobacterium
GVQGITDLITTPGLINVDFADVK

SEQ ID NO: 1318030 - protein, 18 aa, Mycobacterium
GVQLLHRDLQPPRRQQLP

SEQ ID NO: 1318031 - protein, 23 aa, Mycobacterium
GVQLLVFPDACLGGYIGDLRRPD

SEQ ID NO: 1318032 - protein, 20 aa, Mycobacterium
GVQRLRIAVCTQSILHEASP

SEQ ID NO: 1318033 - protein, 18 aa, Mycobacterium
GVRDSRRHQQAADDHWEA

SEQ ID NO: 1318034 - protein, 28 aa, Mycobacterium
GVRDWGRAFAWMGMPDEYFASSGNAPIA

SEQ ID NO: 1318035 - protein, 30 aa, Mycobacterium
GVRGPRWGVPLKIMYALGFAGDLAAAMLRR

SEQ ID NO: 1318036 - protein, 17 aa, Mycobacterium
GVRIRTDEPFRWVAPQL

SEQ ID NO: 1318037 - protein, 26 aa, Mycobacterium
GVRKLEGFWGHCWQSALFPSGRAFGY

SEQ ID NO: 1318038 - protein, 19 aa, Mycobacterium
GVRLFRPSGVAPGRGPALL

SEQ ID NO: 1318039 - protein, 24 aa, Mycobacterium
GVRLIQVGFMRRFDDEYRALKALI

SEQ ID NO: 1318040 - protein, 27 aa, Mycobacterium
GVRPDAWGWLPLLTGVAVRDAVAEVSA

SEQ ID NO: 1318041 - protein, 24 aa, Mycobacterium
GVRSMEGLIAWKLGTSFRNAETIV

SEQ ID NO: 1318042 - protein, 27 aa, Mycobacterium
GVRTPGRHWDHRWALSVLNSALGGGLS

SEQ ID NO: 1318043 - protein, 24 aa, Mycobacterium
GVRVPHGFAITAAAYRHMLDEAGA

SEQ ID NO: 1318044 - protein, 22 aa, Mycobacterium
GVRVPLPRDLMRDNYILKATPA

SEQ ID NO: 1318045 - protein, 22 aa, Mycobacterium
GVRVTWGGVYIHSAPWSVASQG

SEQ ID NO: 1318046 - protein, 18 aa, Mycobacterium
GVRWLREVQGVETVILLG

SEQ ID NO: 1318047 - protein, 30 aa, Mycobacterium
GVSCTALCPGPVPTEWWEIAGEKPPGGKVA

SEQ ID NO: 1318048 - protein, 21 aa, Mycobacterium
GVSDDTVRRWIDDGSLAASAD

SEQ ID NO: 1318049 - protein, 24 aa, Mycobacterium
GVSDDTVRRWIDSGSLPSYKDGTG

SEQ ID NO: 1318050 - protein, 25 aa, Mycobacterium
GVSDLFLPLRYGQVTLRDKMPRRFY

SEQ ID NO: 1318051 - protein, 18 aa, Mycobacterium
GVSGLWLLSGMREDGVLT

SEQ ID NO: 1318052 - protein, 19 aa, Mycobacterium
GVSHLYLSPVLTAAEGSSH

SEQ ID NO: 1318053 - protein, 18 aa, Mycobacterium
GVSPGTVRRWAAGTQQPS

SEQ ID NO: 1318054 - protein, 26 aa, Mycobacterium
GVSPRTFFRYFPTKESVLFFGEYDFI

SEQ ID NO: 1318055 - protein, 25 aa, Mycobacterium
GVSSLPYHHPLLLADRMVLLDHLTR

SEQ ID NO: 1318056 - protein, 29 aa, Mycobacterium
GVSVPAARRYLPGSLILETTWQTPTGWVI

SEQ ID NO: 1318057 - protein, 26 aa, Mycobacterium
GVSYTLPRILGAGPAFDMILTARAVD

SEQ ID NO: 1318058 - protein, 25 aa, Mycobacterium
GVTAAYLVQQWLGEAPADVLITLSR

SEQ ID NO: 1318059 - protein, 30 aa, Mycobacterium
GVTELHSLARFPEPLAPLAAARRSGAELPT

SEQ ID NO: 1318060 - protein, 27 aa, Mycobacterium
GVTGTMTHAWLITGPPGSGRSIAALCF

SEQ ID NO: 1318061 - protein, 17 aa, Mycobacterium
GVTILRLANMIGPAMDT

SEQ ID NO: 1318062 - protein, 25 aa, Mycobacterium
GVTKGSFYWHFADMAAYRSALVHAW

SEQ ID NO: 1318063 - protein, 27 aa, Mycobacterium
GVTKGSFYWHFADMPAYRAALVAAWGR

SEQ ID NO: 1318064 - protein, 26 aa, Mycobacterium
GVTNPTVLAAFLHRARLRTIQHPGNA

SEQ ID NO: 1318065 - protein, 23 aa, Mycobacterium
GVTRELVWPSMRISHCRPPGSDR

SEQ ID NO: 1318066 - protein, 24 aa, Mycobacterium
GVTRSAFYFYFENKAAAVAALLEP

SEQ ID NO: 1318067 - protein, 24 aa, Mycobacterium
GVTRSAFYFYFENKAAAVAALTER

SEQ ID NO: 1318068 - protein, 19 aa, Mycobacterium
GVTTGYWALPDAEQRLRAV

SEQ ID NO: 1318069 - protein, 30 aa, Mycobacterium
GVTTVPGLSFIGLPWMHTWGSGRFLGVDSD

SEQ ID NO: 1318070 - protein, 20 aa, Mycobacterium
GVTVALQHNIGLGGAAVVTL

SEQ ID NO: 1318071 - protein, 27 aa, Mycobacterium
GVTVMEGFHYLFHPVTQRALSLAGDGT

SEQ ID NO: 1318072 - protein, 32 aa, Mycobacterium; identical to SEQ ID NO: 821810

SEQ ID NO: 1318073 - protein, 27 aa, Mycobacterium
GVVAETLLPWLKFRGHGLGMFIMEMPG

SEQ ID NO: 1318074 - protein, 19 aa, Mycobacterium
GVVALLRIRADWGAVVERQ

SEQ ID NO: 1318075 - protein, 31 aa, Mycobacterium
GVVGIIGPWNFPLNLVVLPAAAAFAAGNRVM

SEQ ID NO: 1318076 - protein, 23 aa, Mycobacterium
GVVGYLPQTLPLLDDRSVADVLG

SEQ ID NO: 1318077 - protein, 25 aa, Mycobacterium
GVVLVTVTYRLGIAGFLDIAGAPRN

SEQ ID NO: 1318078 - protein, 23 aa, Mycobacterium
GVVLYIVPRIALGELPMEVGSRL

SEQ ID NO: 1318079 - protein, 21 aa, Mycobacterium
GVVPDALSVLVRLLASLHDDD

SEQ ID NO: 1318080 - protein, 17 aa, Mycobacterium
GVVPLFWEHGHDDPRAI

SEQ ID NO: 1318081 - protein, 20 aa, Mycobacterium
GVWDSLWVYDHFHTVPVPTA

SEQ ID NO: 1318082 - protein, 18 aa, Mycobacterium
GVWQLRGHATLSAGMVAL

SEQ ID NO: 1318083 - protein, 19 aa, Mycobacterium
GVWRSYADHRMATAGAIVG

SEQ ID NO: 1318084 - protein, 31 aa, Mycobacterium
GVWTDTPERWDWLHAHLSVGRLRELIPEAGG

SEQ ID NO: 1318085 - protein, 19 aa, Mycobacterium
GVWTVISTAIRLGKAFEGW

SEQ ID NO: 1318086 - protein, 18 aa, Mycobacterium
GWAADNLGFLVAVARSCT

SEQ ID NO: 1318087 - protein, 26 aa, Mycobacterium
GWAANRAHLFLFLTLCRDHDVVVLSG

SEQ ID NO: 1318088 - protein, 28 aa, Mycobacterium
GWADIRLIPDLTTLRRVPWEPNVALVIC

SEQ ID NO: 1318089 - protein, 18 aa, Mycobacterium
GWALENRRIPLGDTVLLV

SEQ ID NO: 1318090 - protein, 19 aa, Mycobacterium
GWDLSGVQSLIALRPADER

SEQ ID NO: 1318091 - protein, 23 aa, Mycobacterium
GWERPYIAAGIFLYDQLGGAKSV

SEQ ID NO: 1318092 - protein, 23 aa, Mycobacterium
GWESMPEFLAGYPPDRVAAITGL

SEQ ID NO: 1318093 - protein, 19 aa, Mycobacterium
GWFPTKDVAFLDEEGYLFI

SEQ ID NO: 1318094 - protein, 19 aa, Mycobacterium
GWFSPPPSPRRLRGVRSFS

SEQ ID NO: 1318095 - protein, 19 aa, Mycobacterium
GWHCLGPVKNFLDGKPHGI

SEQ ID NO: 1318096 - protein, 24 aa, Mycobacterium
GWHDARVMPYGPIELDPSAIVLHY

SEQ ID NO: 1318097 - protein, 19 aa, Mycobacterium
GWHGLAVAEQFGGAGFGLS

SEQ ID NO: 1318098 - protein, 28 aa, Mycobacterium
GWIGAFGSHLIDFTRWLFGSEIVDCGGV

SEQ ID NO: 1318099 - protein, 27 aa, Mycobacterium
GWLDGDRPRVPHLVITRGARGATYVGE

SEQ ID NO: 1318100 - protein, 18 aa, Mycobacterium
GWLEGYLLTGRHGLFNCY

SEQ ID NO: 1318101 - protein, 20 aa, Mycobacterium
GWPASRIHFEHFGAGALDPG

SEQ ID NO: 1318102 - protein, 37 aa, Mycobacterium
GWPEAPPRRLVFRSDIPKLPRALPRYLTPDLDRRLTQ

SEQ ID NO: 1318103 - protein, 21 aa, Mycobacterium
GWPSMFRGYLHQEERYRKTFA

SEQ ID NO: 1318104 - protein, 23 aa, Mycobacterium
GWQLWMRPEAVPGLRRLTDAIHA

SEQ ID NO: 1318105 - protein, 24 aa, Mycobacterium
GWQSFRVPCLPSDRLLNLLHYVKW

SEQ ID NO: 1318106 - protein, 29 aa, Mycobacterium
GWRAHPDRVWAWYLWRHHMMSAVAPNNAH

SEQ ID NO: 1318107 - protein, 19 aa, Mycobacterium
GWRDDAGRLVIRTSSQVPF

SEQ ID NO: 1318108 - protein, 27 aa, Mycobacterium
GWREMRSLYELQLPYSGWFVDVTGAES

SEQ ID NO: 1318109 - protein, 17 aa, Mycobacterium
GWRPPGHADMRTELPWL

SEQ ID NO: 1318110 - protein, 17 aa, Mycobacterium
GWSLPLFMGELLTLYRA

SEQ ID NO: 1318111 - protein, 18 aa, Mycobacterium
GWTAGRFSFNVADGRCPT

SEQ ID NO: 1318112 - protein, 17 aa, Mycobacterium
GWTLRLLSAPGAELLMP

SEQ ID NO: 1318113 - protein, 26 aa, Mycobacterium
GWTSTFSEALIRLAGKRRDIVAITAA

SEQ ID NO: 1318114 - protein, 31 aa, Mycobacterium
GWTTQMNERCEVEWIPPPPLDTGQARINNYH

SEQ ID NO: 1318115 - protein, 25 aa, Mycobacterium
GWTTRMNERCEVEWIPPPSLDTGQA

SEQ ID NO: 1318116 - protein, 18 aa, Mycobacterium
GWVPYILERSDYVWERHR

SEQ ID NO: 1318117 - protein, 20 aa, Mycobacterium
GWYMAYVYDPQRDGSDLVIL

SEQ ID NO: 1318118 - protein, 24 aa, Mycobacterium
GYALIDEAILPLMADQVPIEWAGD

SEQ ID NO: 1318119 - protein, 25 aa, Mycobacterium
GYAVPTYPAEWFGRGYPNKLANVIG

SEQ ID NO: 1318120 - protein, 48 aa, Mycobacterium
GYDFDAFRRTVARRLPLLDPLRYRLIDIPWRLHHPMWLEDCPVDLDYH

SEQ ID NO: 1318121 - protein, 26 aa, Mycobacterium
GYFEGADWLWKPIATNPVLATNSATW

SEQ ID NO: 1318122 - protein, 27 aa, Mycobacterium
GYFTANPQEYYELRGILAPIGDTQRQC

SEQ ID NO: 1318123 - protein, 17 aa, Mycobacterium
GYFVSREQLALLGSLYD

SEQ ID NO: 1318124 - protein, 23 aa, Mycobacterium
GYGAALDFYRTVFGWTTETVSDT

SEQ ID NO: 1318125 - protein, 24 aa, Mycobacterium
GYGEAALHILINNAGIMGGDLVRD

SEQ ID NO: 1318126 - protein, 24 aa, Mycobacterium
GYGRLIRSVALPGSSPRPYGGYFD

SEQ ID NO: 1318127 - protein, 19 aa, Mycobacterium
GYHAFTHRPTFRAVSAGST

SEQ ID NO: 1318128 - protein, 21 aa, Mycobacterium
GYIAVLIYNDKHWNAFIDAVQ

SEQ ID NO: 1318129 - protein, 25 aa, Mycobacterium
GYKLLADRYWDPMWAAAQDANLSIS

SEQ ID NO: 1318130 - protein, 22 aa, Mycobacterium
GYKLVEQRIFSPQWYEGTDYAT

SEQ ID NO: 1318131 - protein, 19 aa, Mycobacterium
GYLASMGCALPYGVAAKLD

SEQ ID NO: 1318132 - protein, 17 aa, Mycobacterium
GYNEFFPALLDEGICVF

SEQ ID NO: 1318133 - protein, 26 aa, Mycobacterium
GYNVANCLLAIALLDAVGVSPEQAAP

SEQ ID NO: 1318134 - protein, 22 aa, Mycobacterium
GYPKEMRRFLAANPGLASRFNF

SEQ ID NO: 1318135 - protein, 25 aa, Mycobacterium
GYQEYLPVNYRYLIKIPGGGELSPD

SEQ ID NO: 1318136 - protein, 24 aa, Mycobacterium
GYQNLATMLALSLDMHYFADPVAP

SEQ ID NO: 1318137 - protein, 23 aa, Mycobacterium
GYRALLRAELPPGGRLGIYGFGG

SEQ ID NO: 1318138 - protein, 26 aa, Mycobacterium
GYRSLREIVLPLRRLTVITGANGTGK

SEQ ID NO: 1318139 - protein, 26 aa, Mycobacterium
GYSDVVAPLTFTSAPGMQCNRRMFEE

SEQ ID NO: 1318140 - protein, 24 aa, Mycobacterium
GYTQSYTYFTWRTAKWELTEFGQS

SEQ ID NO: 1318141 - protein, 35 aa, Mycobacterium; identical to SEQ ID NO: 1136166

SEQ ID NO: 1318142 - protein, 23 aa, Mycobacterium
GYVELPPERLNKATPAPFTLEQW

SEQ ID NO: 1318143 - protein, 30 aa, Mycobacterium
GYVWINGSSRHYWGLPFGGWKSSGVGSEES

SEQ ID NO: 1318144 - protein, 22 aa, Mycobacterium
GYWRESGSFILFDAPAVVLATG

SEQ ID NO: 1318145 - protein, 36 aa, Mycobacterium
GYYDIVHSHYWLSGQVGWLAADRWAVPLVHTAHTLA

SEQ ID NO: 1318146 - protein, 20 aa, Mycobacterium
GYYQVRGGIPYAIAKSLAAA

SEQ ID NO: 1318147 - protein, 26 aa, Mycobacterium
HAAHRKLLVPYLAAKRVRALETFAEN

SEQ ID NO: 1318148 - protein, 17 aa, Mycobacterium
HAAIARLSGNSTLQIVS

SEQ ID NO: 1318149 - protein, 17 aa, Mycobacterium
HAAITTDLIVGFPGETE

SEQ ID NO: 1318150 - protein, 23 aa, Mycobacterium
HAALLQMFERATAGFGWSRPSRS

SEQ ID NO: 1318151 - protein, 25 aa, Mycobacterium
HAATAPLLDFRYGVGTLLGQSDELL

SEQ ID NO: 1318152 - protein, 19 aa, Mycobacterium
HADAFYRSRTFTDTDMQLM

SEQ ID NO: 1318153 - protein, 24 aa, Mycobacterium
HADDVRLRRMAVFDVLINNADRKG

SEQ ID NO: 1318154 - protein, 17 aa, Mycobacterium
HADIWHAFQDLDAFRRS

SEQ ID NO: 1318155 - protein, 17 aa, Mycobacterium
HADLLAVLVTGLDGFVR

SEQ ID NO: 1318156 - protein, 17 aa, Mycobacterium
HADLSNEFPPLRAREEI

SEQ ID NO: 1318157 - protein, 23 aa, Mycobacterium
HADQPAHLLSGGQKQLLALATVL

SEQ ID NO: 1318158 - protein, 23 aa, Mycobacterium
HADRIVVVWPRGGGYLAADVVAD

SEQ ID NO: 1318159 - protein, 24 aa, Mycobacterium
HADRRPKWIAPYVKGPDGAPLKTD

SEQ ID NO: 1318160 - protein, 22 aa, Mycobacterium
HADTLVIPYGICDSAIGLATVP

SEQ ID NO: 1318161 - protein, 24 aa, Mycobacterium
HAELTARTVIYYVLGFTADEQSRL

SEQ ID NO: 1318162 - protein, 29 aa, Mycobacterium
HAERYGLDMWLRVGATWLSAVAALAALAD

SEQ ID NO: 1318163 - protein, 34 aa, Mycobacterium
HAESVVLPFLLADTPVVAWWPAAAPAIPSQDPVG

SEQ ID NO: 1318164 - protein, 24 aa, Mycobacterium
HAEVDFHRWLQWLVDEQLSTAQDR

SEQ ID NO: 1318165 - protein, 17 aa, Mycobacterium
HAGFPMVVKPVAAAPGE

SEQ ID NO: 1318166 - protein, 17 aa, Mycobacterium
HAGGLMFDRSRAGWDVV

SEQ ID NO: 1318167 - protein, 20 aa, Mycobacterium
HAGIKRVLAPPFSSVFSACG

SEQ ID NO: 1318168 - protein, 25 aa, Mycobacterium
HAGTDFTWDLLLVCGDPQAADTYYG

SEQ ID NO: 1318169 - protein, 39 aa, Mycobacterium
HAGTGCRRLPATSSLLGIPALTAPWLTVDGLPQGVQLLG

SEQ ID NO: 1318170 - protein, 18 aa, Mycobacterium
HAHDILVQLLASLSRIWP

SEQ ID NO: 1318171 - protein, 20 aa, Mycobacterium
HAHLRLSARRMRLPDQGRGL

SEQ ID NO: 1318172 - protein, 17 aa, Mycobacterium
HAHWVDEPVGAITDIAF

SEQ ID NO: 1318173 - protein, 27 aa, Mycobacterium
HAKQDYRGFYLDFNLNLNVPPACTTGF

SEQ ID NO: 1318174 - protein, 20 aa, Mycobacterium
HALALLLAAARQIPAADATL

SEQ ID NO: 1318175 - protein, 25 aa, Mycobacterium
HALDQDLEELWPLSQSRTPPPVAGT

SEQ ID NO: 1318176 - protein, 20 aa, Mycobacterium
HALFARPMVTSPDALIAIEI

SEQ ID NO: 1318177 - protein, 24 aa, Mycobacterium
HALLTLHPRIGRWLQLGGHCEPED

SEQ ID NO: 1318178 - protein, 18 aa, Mycobacterium
HALRVEELCRAALDARAD

SEQ ID NO: 1318179 - protein, 18 aa, Mycobacterium
HALSIRSMLGPLATAGEL

SEQ ID NO: 1318180 - protein, 20 aa, Mycobacterium
HAMLLVTLANFRDGSLDTVA

SEQ ID NO: 1318181 - protein, 49 aa, Mycobacterium
HAMLPIPAQHWTLETLGPALLKFSPGLAAAYLPGYLSGAEWWGQSFSEP

SEQ ID NO: 1318182 - protein, 21 aa, Mycobacterium
HAMVLITHRPDFHGALSRVPG

SEQ ID NO: 1318183 - protein, 17 aa, Mycobacterium
HAPRALLALYDEALPAV

SEQ ID NO: 1318184 - protein, 28 aa, Mycobacterium
HAQHLDDIIGLSFFTPAVNQIELHPLLN

SEQ ID NO: 1318185 - protein, 31 aa, Mycobacterium
HARALILVPTMLSRILDLPPAALNAFDTSSL

SEQ ID NO: 1318186 - protein, 23 aa, Mycobacterium
HARLLEFYRSLIALRHTEPDMAD

SEQ ID NO: 1318187 - protein, 18 aa, Mycobacterium
HARQWWDLAVRFLADQLG

SEQ ID NO: 1318188 - protein, 17 aa, Mycobacterium
HARSWYRPSAGTEWQLL

SEQ ID NO: 1318189 - protein, 21 aa, Mycobacterium
HASRVYGCIDWCVGMFKTPSG

SEQ ID NO: 1318190 - protein, 28 aa, Mycobacterium
HATPSQLALAWLLKRSPVMLPIPGTSKV

SEQ ID NO: 1318191 - protein, 24 aa, Mycobacterium
HATRIRLLDRMKDRWRDDLLADGL

SEQ ID NO: 1318192 - protein, 19 aa, Mycobacterium
HATVLIFPDLNTGNNTYKA

SEQ ID NO: 1318193 - protein, 18 aa, Mycobacterium
HAVADLALAGWPKPPHPA

SEQ ID NO: 1318194 - protein, 26 aa, Mycobacterium
HAVATPGSILNYLARHRDPIGLAIVP

SEQ ID NO: 1318195 - protein, 23 aa, Mycobacterium
HAVGLVPQWTFFAPVPGTQNLYL

SEQ ID NO: 1318196 - protein, 17 aa, Mycobacterium
HAVITIVLQLLHLLGRI

SEQ ID NO: 1318197 - protein, 23 aa, Mycobacterium
HAVQLAVQMLVEGPPHAMDVVLE

SEQ ID NO: 1318198 - protein, 17 aa, Mycobacterium
HAVSRVVGVPYAEIVAS

SEQ ID NO: 1318199 - protein, 17 aa, Mycobacterium
HAVWFTETWGRYNAALD

SEQ ID NO: 1318200 - protein, 22 aa, Mycobacterium
HAWINGLWCAPGGPTIAVLDFE

SEQ ID NO: 1318201 - protein, 25 aa, Mycobacterium
HAWSDVAVFPILGMDWHQYEQQGHE

SEQ ID NO: 1318202 - protein, 25 aa, Mycobacterium
HAWSFTFDAAWQPLAALLDGHSVHL

SEQ ID NO: 1318203 - protein, 26 aa, Mycobacterium
HAWSFTFDAAWQPLVALFEGHSVHII

SEQ ID NO: 1318204 - protein, 32 aa, Mycobacterium
HAYKAAGLQYYRPWILLLTDGKPNLDGFDEAV

SEQ ID NO: 1318205 - protein, 24 aa, Mycobacterium
HAYMTMAPLLEHADDDWWKVVDTN

SEQ ID NO: 1318206 - protein, 17 aa, Mycobacterium
HAYVDGIQRIPRALARL

SEQ ID NO: 1318207 - protein, 22 aa, Mycobacterium
HCGWPSFFDPADSDAVLLRPDD

SEQ ID NO: 1318208 - protein, 27 aa, Mycobacterium
HCRSCGDDFVLADFILLCPCGSADVEV

SEQ ID NO: 1318209 - protein, 23 aa, Mycobacterium
HDADGLATFFRTAAHSGSLVRYL

SEQ ID NO: 1318210 - protein, 18 aa, Mycobacterium
HDALDASLLLAVLTRFLP

SEQ ID NO: 1318211 - protein, 23 aa, Mycobacterium
HDDAIMFEPRYATRQPDGGWGRF

SEQ ID NO: 1318212 - protein, 22 aa, Mycobacterium
HDDLFDFFYEALPGYDQVGLRR

SEQ ID NO: 1318213 - protein, 24 aa, Mycobacterium
HDDLFDFFYEALPGYDRVGLRRTL

SEQ ID NO: 1318214 - protein, 20 aa, Mycobacterium
HDEARVPTPLRWGEYRPGRL

SEQ ID NO: 1318215 - protein, 26 aa, Mycobacterium
HDEFRPLKALAARMPCAYANPGVFVA

SEQ ID NO: 1318216 - protein, 19 aa, Mycobacterium
HDESLIANGRIADVVDAQG

SEQ ID NO: 1318217 - protein, 19 aa, Mycobacterium
HDEYLLNAYIGRYPKPYVA

SEQ ID NO: 1318218 - protein, 28 aa, Mycobacterium
HDFAITERYIVFLISPIIPDAMSVALGR

SEQ ID NO: 1318219 - protein, 22 aa, Mycobacterium
HDGELYITGRVKDLVIIDGRNH

SEQ ID NO: 1318220 - protein, 21 aa, Mycobacterium
HDGFLVIVSVNRHQRGRGHAA

SEQ ID NO: 1318221 - protein, 21 aa, Mycobacterium
HDGGLVSTYLCDHARPGMVVG

SEQ ID NO: 1318222 - protein, 17 aa, Mycobacterium
HDGGWITGGAELPEWNG

SEQ ID NO: 1318223 - protein, 24 aa, Mycobacterium
HDGIGWLAQRGYVPLGYKGDAAKT

SEQ ID NO: 1318224 - protein, 30 aa, Mycobacterium
HDIDTVWFGAAAPLALLTPIARRAGAARVI

SEQ ID NO: 1318225 - protein, 27 aa, Mycobacterium
HDIKLDPDWFVIRKSAVNVFRAGEDYA

SEQ ID NO: 1318226 - protein, 17 aa, Mycobacterium
HDLDFAAVLGDRRIDIG

SEQ ID NO: 1318227 - protein, 22 aa, Mycobacterium
HDLDRIFLVAPASTPERLAKTV

SEQ ID NO: 1318228 - protein, 22 aa, Mycobacterium
HDLHVTALLGATRLLADGRGSW

SEQ ID NO: 1318229 - protein, 24 aa, Mycobacterium
HDLPAPGYVVWRAAANHFRLRRID

SEQ ID NO: 1318230 - protein, 17 aa, Mycobacterium
HDLQPYPLPALVCLLRS

SEQ ID NO: 1318231 - protein, 17 aa, Mycobacterium
HDLRHTFAIRTLIGWYR

SEQ ID NO: 1318232 - protein, 29 aa, Mycobacterium
HDLSVAALTPKLFLPGLSGLTQGPGFPNL

SEQ ID NO: 1318233 - protein, 23 aa, Mycobacterium
HDPAQLHTLLVFTAEPGTPSHAK

SEQ ID NO: 1318234 - protein, 18 aa, Mycobacterium
HDPRDFVVFAYGGAGGAH

SEQ ID NO: 1318235 - protein, 19 aa, Mycobacterium
HDPRDFVVFAYGGAGGAHC

SEQ ID NO: 1318236 - protein, 20 aa, Mycobacterium
HDPRDFVVFAYGGAGGAHCH

SEQ ID NO: 1318237 - protein, 21 aa, Mycobacterium
HDPREDGLLPDVYIAMGQTAE

SEQ ID NO: 1318238 - protein, 23 aa, Mycobacterium
HDRAHALPLQDPDAVWYTLRAPA

SEQ ID NO: 1318239 - protein, 18 aa, Mycobacterium
HDRAHARRARRPHRVHDM

SEQ ID NO: 1318240 - protein, 18 aa, Mycobacterium
HDRDYFPVGPEARLKFAG

SEQ ID NO: 1318241 - protein, 22 aa, Mycobacterium
HDRLPKVAALFAAGRLSTRLIG

SEQ ID NO: 1318242 - protein, 31 aa, Mycobacterium
HDRLTIHDYLWRWDTDWFWCSRAFGAQNPKI

SEQ ID NO: 1318243 - protein, 32 aa, Mycobacterium
HDRLTIHDYLWRWDTDWFWCSRAFGAQNPRIR

SEQ ID NO: 1318244 - protein, 17 aa, Mycobacterium
HDRVAEVLGIHYEIPWP

SEQ ID NO: 1318245 - protein, 17 aa, Mycobacterium
HDSRPYQLRFRRNGWFD

SEQ ID NO: 1318246 - protein, 26 aa, Mycobacterium
HDTDDLIPLRLAIPAQFRAEGDADTP

SEQ ID NO: 1318247 - protein, 18 aa, Mycobacterium
HDTFLLALGQLWAADVEV

SEQ ID NO: 1318248 - protein, 19 aa, Mycobacterium
HDTFRSWFERTEEGEFLRR

SEQ ID NO: 1318249 - protein, 17 aa, Mycobacterium
HDTMGEVRVPKNALWRA

SEQ ID NO: 1318250 - protein, 21 aa, Mycobacterium
HDTVFYCVANMPGAVPRTSTW

SEQ ID NO: 1318251 - protein, 18 aa, Mycobacterium
HDVRALVLTGAGGAFCSG

SEQ ID NO: 1318252 - protein, 22 aa, Mycobacterium
HDWDHNPRWKGITRTYTPADVV

SEQ ID NO: 1318253 - protein, 27 aa, Mycobacterium
HDWGAPVAWTFAWLHPQRCAGVAGISV

SEQ ID NO: 1318254 - protein, 20 aa, Mycobacterium
HEAAFLFAITVGGAMRIEPI

SEQ ID NO: 1318255 - protein, 20 aa, Mycobacterium
HEAITAFFVDLATPGITVRP

SEQ ID NO: 1318256 - protein, 23 aa, Mycobacterium
HEAMYLGNGMMIEAPYTGSVVKI

SEQ ID NO: 1318257 - protein, 24 aa, Mycobacterium
HEARTVFLEVINFPKPLVSAVNGP

SEQ ID NO: 1318258 - protein, 24 aa, Mycobacterium
HEGGDGWLKRLYCSADPGRPTNVH

SEQ ID NO: 1318259 - protein, 24 aa, Mycobacterium
HEGVYKFLLKRNRRLYGVAYTLDN

SEQ ID NO: 1318260 - protein, 17 aa, Mycobacterium
HEHLRLALQNYTAHTVP

SEQ ID NO: 1318261 - protein, 19 aa, Mycobacterium
HEHLRLALQNYTAHTVPAL

SEQ ID NO: 1318262 - protein, 18 aa, Mycobacterium
HEHQLVVDALRSALEPLC

SEQ ID NO: 1318263 - protein, 17 aa, Mycobacterium
HELAAAIAHRRADRRPY

SEQ ID NO: 1318264 - protein, 17 aa, Mycobacterium
HELALQDWLGTAGFDRP

SEQ ID NO: 1318265 - protein, 26 aa, Mycobacterium
HELGRALAPVPFLSSTVLATGLLVAF

SEQ ID NO: 1318266 - protein, 30 aa, Mycobacterium
HELSPRALAWLFFNMAVSTTLRYIESDDPI

SEQ ID NO: 1318267 - protein, 32 aa, Mycobacterium
HENTLKYCYNFFGIEYYFVTAELPLPGGQHLV

SEQ ID NO: 1318268 - protein, 26 aa, Mycobacterium
HEPGSPELARLLLSRGLGVEVGLFHA

SEQ ID NO: 1318269 - protein, 19 aa, Mycobacterium
HEPQRLISRSWYAAAKGME

SEQ ID NO: 1318270 - protein, 18 aa, Mycobacterium
HEPVGGVHFAFVSNSSPW

SEQ ID NO: 1318271 - protein, 31 aa, Mycobacterium
HEPVGVVGAIVPWNFPFEVTVNKLGPALAAG

SEQ ID NO: 1318272 - protein, 24 aa, Mycobacterium
HERRTNWLNNFYFGGEHGADGSIA

SEQ ID NO: 1318273 - protein, 21 aa, Mycobacterium
HERTMMWLGFADRIANCIADF

SEQ ID NO: 1318274 - protein, 29 aa, Mycobacterium
HESTSFSLALLLATERLKVIAAVHPGLWQ

SEQ ID NO: 1318275 - protein, 17 aa, Mycobacterium
HEVALALWGQAPGSLDP

SEQ ID NO: 1318276 - protein, 30 aa, Mycobacterium
HEVGLAILGPLRELDEVAYLRFASVYRSFS

SEQ ID NO: 1318277 - protein, 27 aa, Mycobacterium
HEVRVMLDQYWPSVPHVLIEPGVRTGI

SEQ ID NO: 1318278 - protein, 17 aa, Mycobacterium
HEVVKMDYFIPGCPPDA

SEQ ID NO: 1318279 - protein, 18 aa, Mycobacterium
HEWGLDEILLPGTGPAEI

SEQ ID NO: 1318280 - protein, 30 aa, Mycobacterium
HFAGRAKVPNFLPLLAERYARQQLSALARV

SEQ ID NO: 1318281 - protein, 18 aa, Mycobacterium
HFATMKHAAAYWRAKSKA

SEQ ID NO: 1318282 - protein, 26 aa, Mycobacterium
HFAVRAGSLIAWRSPDGSRALPFRIV

SEQ ID NO: 1318283 - protein, 18 aa, Mycobacterium
HFDGWWRKQRHRTPGLLT

SEQ ID NO: 1318284 - protein, 23 aa, Mycobacterium
HFDIMCPYAYQTSRWIRAVRDQT

SEQ ID NO: 1318285 - protein, 19 aa, Mycobacterium
HFDLLNHPEIYDRLVHWLG

SEQ ID NO: 1318286 - protein, 25 aa, Mycobacterium
HFDNPSPHIPWDSLPVRVVDEAVPW

SEQ ID NO: 1318287 - protein, 22 aa, Mycobacterium
HFDSMLVKLTCRGRDFATAVAR

SEQ ID NO: 1318288 - protein, 23 aa, Mycobacterium
HFDVMCPFAYQTSRWIRSVRDQT

SEQ ID NO: 1318289 - protein, 31 aa, Mycobacterium
HFEAIALVQKIAFSLPDKYFDKVDVTVIPPF

SEQ ID NO: 1318290 - protein, 23 aa, Mycobacterium
HFEILMNSALLRIPALETTGIKK

SEQ ID NO: 1318291 - protein, 30 aa, Mycobacterium
HFEKMLYDNALLLRAYAHWARRTGAPLARR

SEQ ID NO: 1318292 - protein, 24 aa, Mycobacterium
HFGVDGLPFINADYTLTLSRLPET

SEQ ID NO: 1318293 - protein, 17 aa, Mycobacterium
HFLAEMLDVPAPTPKRR

SEQ ID NO: 1318294 - protein, 18 aa, Mycobacterium
HFLEPDDLWRSRLPKRLA

SEQ ID NO: 1318295 - protein, 27 aa, Mycobacterium
HFLRSHHSWTCAGAPIRDPRTSQVIGV

SEQ ID NO: 1318296 - protein, 18 aa, Mycobacterium
HFNENIMTLMLKLMRLTQ

SEQ ID NO: 1318297 - protein, 26 aa, Mycobacterium
HFNEVFLTDVFVPDELLLGGPTDGWN

SEQ ID NO: 1318298 - protein, 19 aa, Mycobacterium
HFQPKYIFAAIDAGCAAVR

SEQ ID NO: 1318299 - protein, 18 aa, Mycobacterium
HFRRIIDRLSAESTLFRS

SEQ ID NO: 1318300 - protein, 17 aa, Mycobacterium
HFRVGPKRVWLVSDTTA

SEQ ID NO: 1318301 - protein, 17 aa, Mycobacterium
HFVIARHPDSFNVTVAC

SEQ ID NO: 1318302 - protein, 25 aa, Mycobacterium
HFYRDVLGFYLRDSMKLPPQLVGRP

SEQ ID NO: 1318303 - protein, 23 aa, Mycobacterium
HGAAGLLLRAPGPGGSAAVLLQH

SEQ ID NO: 1318304 - protein, 24 aa, Mycobacterium
HGAANSWQTLPKIGPKTAKVIAQA

SEQ ID NO: 1318305 - protein, 25 aa, Mycobacterium
HGAGILNFVFGEMWLRPALGMRERR

SEQ ID NO: 1318306 - protein, 29 aa, Mycobacterium
HGAIGVTVEHPLWLSTMRARSWVDEFGTT

SEQ ID NO: 1318307 - protein, 25 aa, Mycobacterium
HGAKVLLLGIAFKNASDDLRESPNI

SEQ ID NO: 1318308 - protein, 25 aa, Mycobacterium
HGALRSAWIGYWVASGSTGGGVATA

SEQ ID NO: 1318309 - protein, 25 aa, Mycobacterium
HGATADWDPFPEFLDELRAAGAEVV

SEQ ID NO: 1318310 - protein, 19 aa, Mycobacterium
HGAVTMHYVTGRYALDLHE

SEQ ID NO: 1318311 - protein, 32 aa, Mycobacterium
HGAWHAAWCWDEHFLDFFAGRGYRALAVSLRG

SEQ ID NO: 1318312 - protein, 26 aa, Mycobacterium
HGAYPSTLGYKGFPKSCCTSLNEVIC

SEQ ID NO: 1318313 - protein, 19 aa, Mycobacterium
HGCDVWLNNPLRPLEACGT

SEQ ID NO: 1318314 - protein, 23 aa, Mycobacterium
HGDLLVTVKVAVPPSLEGEAAEA

SEQ ID NO: 1318315 - protein, 17 aa, Mycobacterium
HGDLYGTVLFAGTAAPG

SEQ ID NO: 1318316 - protein, 22 aa, Mycobacterium
HGDTGRRFPLASVTKPLVARAA

SEQ ID NO: 1318317 - protein, 18 aa, Mycobacterium
HGDYRLDNLLYDPDRTRV

SEQ ID NO: 1318318 - protein, 35 aa, Mycobacterium
HGEAYRGHIFWDELFIFPVLNLRAPMITRSLLGYR

SEQ ID NO: 1318319 - protein, 17 aa, Mycobacterium
HGEECSAYWPAGTAGFH

SEQ ID NO: 1318320 - protein, 25 aa, Mycobacterium
HGEPHIVLPTTPWHRSRHWVDVRPL

SEQ ID NO: 1318321 - protein, 25 aa, Mycobacterium
HGEQDFYFHRPIRPGDKLVSRGKMI

SEQ ID NO: 1318322 - protein, 24 aa, Mycobacterium
HGESGWPTFLYAVPLGGGRVLLEE

SEQ ID NO: 1318323 - protein, 26 aa, Mycobacterium
HGESWSMALALRLAAYELLRVEGSDP

SEQ ID NO: 1318324 - protein, 24 aa, Mycobacterium
HGGGAFLALLPRIERFWENSSTAS

SEQ ID NO: 1318325 - protein, 18 aa, Mycobacterium
HGGGGYSGALWPAAAVAA

SEQ ID NO: 1318326 - protein, 25 aa, Mycobacterium
HGGLDLDTSLKLWERGEQLAKRCEE

SEQ ID NO: 1318327 - protein, 23 aa, Mycobacterium
HGGSIRLWARPEGAARRPSERVT

SEQ ID NO: 1318328 - protein, 19 aa, Mycobacterium
HGGYGYLREYGLEKIVRDL

SEQ ID NO: 1318329 - protein, 30 aa, Mycobacterium
HGHEDHIGAIPFLLKQRADIPIVGSKFTLA

SEQ ID NO: 1318330 - protein, 19 aa, Mycobacterium
HGIKLRYSDPMLLDDVAAD

SEQ ID NO: 1318331 - protein, 18 aa, Mycobacterium
HGISFLPTVGWAERGDLT

SEQ ID NO: 1318332 - protein, 17 aa, Mycobacterium
HGIVGIMRVYANFLAQY

SEQ ID NO: 1318333 - protein, 18 aa, Mycobacterium
HGIVYPSKWGTTLGDNYA

SEQ ID NO: 1318334 - protein, 20 aa, Mycobacterium
HGLGLGFDPPVVSPNLRATM

SEQ ID NO: 1318335 - protein, 17 aa, Mycobacterium
HGLGVLLSLGRIRRVTA

SEQ ID NO: 1318336 - protein, 20 aa, Mycobacterium
HGLSLLRHVKDLVNTGWPVL

SEQ ID NO: 1318337 - protein, 17 aa, Mycobacterium
HGLSWGHDRIFAVTTNH

SEQ ID NO: 1318338 - protein, 18 aa, Mycobacterium
HGMCYALAPDVYTDDEHG

SEQ ID NO: 1318339 - protein, 17 aa, Mycobacterium
HGNLAALPLPTASVDVV

SEQ ID NO: 1318340 - protein, 24 aa, Mycobacterium
HGNRGFCNFYEGKEPRRLNYGCYD

SEQ ID NO: 1318341 - protein, 26 aa, Mycobacterium
HGNSVPRFHITWGTGPALVDIFARRL

SEQ ID NO: 1318342 - protein, 20 aa, Mycobacterium
HGPDRQWWAERFGVDVELAE

SEQ ID NO: 1318343 - protein, 20 aa, Mycobacterium
HGPPLIVVGQSKYQRPGDFA

SEQ ID NO: 1318344 - protein, 23 aa, Mycobacterium
HGPQCSMMIRWYDDAWDGTFWRR

SEQ ID NO: 1318345 - protein, 20 aa, Mycobacterium
HGPTVLRALTGRGGLPPGFS

SEQ ID NO: 1318346 - protein, 24 aa, Mycobacterium
HGQFVPVMFTRMLKLPEAVRKSYD

SEQ ID NO: 1318347 - protein, 20 aa, Mycobacterium
HGQRYMARLFDYVEQGDLDP

SEQ ID NO: 1318348 - protein, 23 aa, Mycobacterium
HGRFHAHRILGPHDRLVALGQLT

SEQ ID NO: 1318349 - protein, 27 aa, Mycobacterium
HGRGGFAGLLLGSVSWAVAQAARVPVI

SEQ ID NO: 1318350 - protein, 17 aa, Mycobacterium
HGRGVFVLAATSNPEGA

SEQ ID NO: 1318351 - protein, 20 aa, Mycobacterium
HGRPLDPNDKYLILWATMSE

SEQ ID NO: 1318352 - protein, 17 aa, Mycobacterium
HGRQVICRPFAGSAPRL

SEQ ID NO: 1318353 - protein, 25 aa, Mycobacterium
HGRRDPLFCVLPDTFDAFGGHKEAV

SEQ ID NO: 1318354 - protein, 23 aa, Mycobacterium
HGRSFLERFVVTEELLAAGAPVA

SEQ ID NO: 1318355 - protein, 36 aa, Mycobacterium
HGRWPVGEEWLYQSWSACYLPLVRVLRTLAAENRRH

SEQ ID NO: 1318356 - protein, 21 aa, Mycobacterium
HGRYAPFRWTFGARVGEQMIE

SEQ ID NO: 1318357 - protein, 25 aa, Mycobacterium
HGSDTRRYKLWHPRAHASARWADGG

SEQ ID NO: 1318358 - protein, 23 aa, Mycobacterium
HGSPQTMLATLYAKALDAGAPDS

SEQ ID NO: 1318359 - protein, 33 aa, Mycobacterium
HGTAVARAIRLLPGRGLLVCDVWVGAPAGTAMT

SEQ ID NO: 1318360 - protein, 19 aa, Mycobacterium
HGTIPMSMSPFAVANLGVV

SEQ ID NO: 1318361 - protein, 17 aa, Mycobacterium
HGTPTLAPVVYTSALGL

SEQ ID NO: 1318362 - protein, 26 aa, Mycobacterium
HGVEPNMRWRTFCAELLAIAEKLNVQ

SEQ ID NO: 1318363 - protein, 18 aa, Mycobacterium
HGVGPWQGPPPDDPRLDP

SEQ ID NO: 1318364 - protein, 23 aa, Mycobacterium
HGVPAALIPDSTAALAALQAAPG

SEQ ID NO: 1318365 - protein, 22 aa, Mycobacterium
HGVPIEWSAARYRRLMVLRDER

SEQ ID NO: 1318366 - protein, 23 aa, Mycobacterium
HGVPIEWSAARYRRLMVLRDERQ

SEQ ID NO: 1318367 - protein, 26 aa, Mycobacterium
HGVQLFGAMGFTWENDLQFALKRAKA

SEQ ID NO: 1318368 - protein, 23 aa, Mycobacterium
HGVSNAFYLYLRDPDGHRVEIYT

SEQ ID NO: 1318369 - protein, 17 aa, Mycobacterium
HGWPQHHWVYRSLLADP

SEQ ID NO: 1318370 - protein, 17 aa, Mycobacterium
HHAGWYAPMPAPGRANV

SEQ ID NO: 1318371 - protein, 32 aa, Mycobacterium
HHAYFPRLRLELEQGLGWKAGVEAALELLLQS

SEQ ID NO: 1318372 - protein, 26 aa, Mycobacterium
HHCAAPLHRRFGIAATVRASFAVYNT

SEQ ID NO: 1318373 - protein, 25 aa, Mycobacterium
HHDEVLSPVLRFWNVFQRRDFGPEG

SEQ ID NO: 1318374 - protein, 26 aa, Mycobacterium
HHDLPRRWIQFLERWDPTRWPQRPDR

SEQ ID NO: 1318375 - protein, 22 aa, Mycobacterium
HHDVVAVWRFVPNEPVTSAHIH

SEQ ID NO: 1318376 - protein, 21 aa, Mycobacterium
HHEALAWYDHWLKGADTGIMD

SEQ ID NO: 1318377 - protein, 25 aa, Mycobacterium
HHELGWFARQALRMFDDLRLEHGRL

SEQ ID NO: 1318378 - protein, 18 aa, Mycobacterium
HHEMTFSLLYAFSENFVL

SEQ ID NO: 1318379 - protein, 25 aa, Mycobacterium
HHEPIEFTLPPKKFATAWQPVVSSA

SEQ ID NO: 1318380 - protein, 17 aa, Mycobacterium
HHIAWDDASWEVFFDDL

SEQ ID NO: 1318381 - protein, 23 aa, Mycobacterium
HHKAYVKKLIDLELLGCFAMTET

SEQ ID NO: 1318382 - protein, 24 aa, Mycobacterium
HHMYYLNVMAGSGPTRAWLICDDP

SEQ ID NO: 1318383 - protein, 24 aa, Mycobacterium
HHPDIDIRWRTVTFVLVTHSEGGI

SEQ ID NO: 1318384 - protein, 21 aa, Mycobacterium
HHRIGFPFNWVTNLADDASGS

SEQ ID NO: 1318385 - protein, 26 aa, Mycobacterium
HHRTGRPHGWIHNELRRRCGGPPVAA

SEQ ID NO: 1318386 - protein, 19 aa, Mycobacterium
HHVGLPVVVVDVKGDWWGI

SEQ ID NO: 1318387 - protein, 38 aa, Mycobacterium
HHVSTYTFLADRYPRWWQAPLRWAFRGALGARASLVVR

SEQ ID NO: 1318388 - protein, 25 aa, Mycobacterium
HIAARPAITLSWIRELPALGAQATP

SEQ ID NO: 1318389 - protein, 20 aa, Mycobacterium
HIAGVLYLFVRGMCGADTPV

SEQ ID NO: 1318390 - protein, 17 aa, Mycobacterium
HIASLPLDRTRPLWEMW

SEQ ID NO: 1318391 - protein, 23 aa, Mycobacterium
HIEDVMLRVRLRTGLPAAALSAP

SEQ ID NO: 1318392 - protein, 24 aa, Mycobacterium
HIERILAEWVDELAVPVYRGREVV

SEQ ID NO: 1318393 - protein, 18 aa, Mycobacterium
HIFAPLARRLQRNGLHVI

SEQ ID NO: 1318394 - protein, 20 aa, Mycobacterium
HIFECNLYFVPPKNTRQRLS

SEQ ID NO: 1318395 - protein, 21 aa, Mycobacterium
HIGYAALFRIAAGAMLGHTTP

SEQ ID NO: 1318396 - protein, 25 aa, Mycobacterium
HIHHAHALHSPYWWLKCAVGTEKTN

SEQ ID NO: 1318397 - protein, 17 aa, Mycobacterium
HIWHPYSPIGDTALAPT

SEQ ID NO: 1318398 - protein, 22 aa, Mycobacterium
HKGISVLLIPTDLEGVVCRPFA

SEQ ID NO: 1318399 - protein, 25 aa, Mycobacterium
HKKLRDILGLLRDAYCRHIGVEYTH

SEQ ID NO: 1318400 - protein, 26 aa, Mycobacterium
HKLWRMRDRKGYHVEYGFSCMGYEIA

SEQ ID NO: 1318401 - protein, 18 aa, Mycobacterium
HKPRYRVGTVMRSRWDRA

SEQ ID NO: 1318402 - protein, 20 aa, Mycobacterium
HKPRYRVGTVMRSRWDRASA

SEQ ID NO: 1318403 - protein, 36 aa, Mycobacterium
HKTEAWVSQRRALLKLAPELQTALRRGELAIRDARQ

SEQ ID NO: 1318404 - protein, 23 aa, Mycobacterium
HKTVHHYLMRFSGGELSDEDVEV

SEQ ID NO: 1318405 - protein, 29 aa, Mycobacterium
HKVMPIITALLHQYPHLLALSASSPYWDG

SEQ ID NO: 1318406 - protein, 25 aa, Mycobacterium
HKYLGTPYPNFTGRPEIRVIVTVEA

SEQ ID NO: 1318407 - protein, 17 aa, Mycobacterium
HLAALDIPILQGLCLTS

SEQ ID NO: 1318408 - protein, 19 aa, Mycobacterium
HLAAYRALGLTDWTYERIE

SEQ ID NO: 1318409 - protein, 31 aa, Mycobacterium
HLAELEAKIRSLLRGRYKIGVLGKGGVGKTT

SEQ ID NO: 1318410 - protein, 20 aa, Mycobacterium
HLAGTQRWCVALSGGADSLA

SEQ ID NO: 1318411 - protein, 34 aa, Mycobacterium
HLAIARFRRRHLAALTPLFVQALAWCQGAGVDRL

SEQ ID NO: 1318412 - protein, 23 aa, Mycobacterium
HLAPATLYRRFYTARTAAGRPDL

SEQ ID NO: 1318413 - protein, 22 aa, Mycobacterium
HLARLRFLRRYAEDLSGPVVIH

SEQ ID NO: 1318414 - protein, 22 aa, Mycobacterium
HLDDRAMRLHIGGRLAASIKEQ

SEQ ID NO: 1318415 - protein, 19 aa, Mycobacterium
HLDFALGESDLIRIQDRDL

SEQ ID NO: 1318416 - protein, 18 aa, Mycobacterium
HLDIRLERAPDTDVRTAI

SEQ ID NO: 1318417 - protein, 23 aa, Mycobacterium
HLDNTLDQLLGWRPPGHADMRTE

SEQ ID NO: 1318418 - protein, 19 aa, Mycobacterium
HLEIVDFRRTLLGVVDSGP

SEQ ID NO: 1318419 - protein, 25 aa, Mycobacterium
HLEMLSTFLRWREGTRGELTEVGTE

SEQ ID NO: 1318420 - protein, 30 aa, Mycobacterium
HLFQAGGKRFRPLFTVLSAQLGPEPDAWQV

SEQ ID NO: 1318421 - protein, 27 aa, Mycobacterium
HLGGRGWLNLPDWPPAMPDVVLHPQPA

SEQ ID NO: 1318422 - protein, 21 aa, Mycobacterium
HLGGVLYLFVRGMCGASTPVI

SEQ ID NO: 1318423 - protein, 24 aa, Mycobacterium
HLGHFAFTGLLLDKLLDVDGARIV

SEQ ID NO: 1318424 - protein, 27 aa, Mycobacterium
HLGVGVTSIYWYFRKKDDLLNAMTDRA

SEQ ID NO: 1318425 - protein, 27 aa, Mycobacterium
HLGWSAWAIHWLTRVPCGIEGHIQVDF

SEQ ID NO: 1318426 - protein, 20 aa, Mycobacterium
HLHFMVTAPGLRRLVTHIFV

SEQ ID NO: 1318427 - protein, 17 aa, Mycobacterium
HLIDGEWLPGGGDALVS

SEQ ID NO: 1318428 - protein, 26 aa, Mycobacterium
HLIGRIAALLAVLRPDLDKDAADLMA

SEQ ID NO: 1318429 - protein, 24 aa, Mycobacterium
HLIHALRRNINVTILLFNNRIYGL

SEQ ID NO: 1318430 - protein, 17 aa, Mycobacterium
HLKVRLGIALVEYVSAV

SEQ ID NO: 1318431 - protein, 18 aa, Mycobacterium
HLLDVARRLDISGRSTMS

SEQ ID NO: 1318432 - protein, 21 aa, Mycobacterium
HLLEHKPTKRTRRLDGRTVVA

SEQ ID NO: 1318433 - protein, 18 aa, Mycobacterium
HLLGAPQLTLTYSGTGNA

SEQ ID NO: 1318434 - protein, 17 aa, Mycobacterium
HLLREKCLAGDGGGVLP

SEQ ID NO: 1318435 - protein, 33 aa, Mycobacterium
HLMVASLDHAMWFMRAFRADEWLLYDQSSPSAC

SEQ ID NO: 1318436 - protein, 19 aa, Mycobacterium
HLPAAFTPGPRLGPGLEAT

SEQ ID NO: 1318437 - protein, 26 aa, Mycobacterium
HLPSDRPIVVHCAGGWRSSVAASLMR

SEQ ID NO: 1318438 - protein, 27 aa, Mycobacterium
HLPVMCDFWETVLFRAGRYRRNALHVH

SEQ ID NO: 1318439 - protein, 18 aa, Mycobacterium
HLPVVCSVQGWAVGLGCN

SEQ ID NO: 1318440 - protein, 18 aa, Mycobacterium
HLQATYLTGRHADILVLL

SEQ ID NO: 1318441 - protein, 20 aa, Mycobacterium
HLRQAILDAYRRAGCSGPAD

SEQ ID NO: 1318442 - protein, 17 aa, Mycobacterium
HLRRLSVVIPAALRCVP

SEQ ID NO: 1318443 - protein, 17 aa, Mycobacterium
HLRSRRWSSFPAYARSK

SEQ ID NO: 1318444 - protein, 23 aa, Mycobacterium
HLRWQEHQILWGPPNPTADGPFT

SEQ ID NO: 1318445 - protein, 26 aa, Mycobacterium
HLSARVAKWWLPDAVEFIDAVPKTSV

SEQ ID NO: 1318446 - protein, 20 aa, Mycobacterium
HLSLWARLPGYTVADLNAAL

SEQ ID NO: 1318447 - protein, 36 aa, Mycobacterium
HLTGALGSFQKLLHGVARLFGLAQRDNITVTIPVTI

SEQ ID NO: 1318448 - protein, 27 aa, Mycobacterium
HLTKSLDQLLFQFYAHNDGIRVTDLHQ

SEQ ID NO: 1318449 - protein, 33 aa, Mycobacterium
HLTRRIRTWLSFPQWFYLNVPVNTLTAPRITPG

SEQ ID NO: 1318450 - protein, 21 aa, Mycobacterium
HLVAEVFWRRLAGSQRVDHGS

SEQ ID NO: 1318451 - protein, 25 aa, Mycobacterium
HLVHPGDLVILIAYGTMEDAEARAY

SEQ ID NO: 1318452 - protein, 18 aa, Mycobacterium
HLVLLDNGRTSVLADEVG

SEQ ID NO: 1318453 - protein, 25 aa, Mycobacterium
HLVTGDIPMAGFPVLGGHEGAGVVT

SEQ ID NO: 1318454 - protein, 17 aa, Mycobacterium
HLWKLVRSFDDPATWTE

SEQ ID NO: 1318455 - protein, 17 aa, Mycobacterium
HLWKLVRSFDDPGTWTE

SEQ ID NO: 1318456 - protein, 27 aa, Mycobacterium
HLYGGYNVIRAAWPHFRENGFGRVVVA

SEQ ID NO: 1318457 - protein, 21 aa, Mycobacterium
HLYQELFLHELNWSAPDSPPI

SEQ ID NO: 1318458 - protein, 29 aa, Mycobacterium
HMERQTLVVEVYRPRLRGPVPQAEDVVAT

SEQ ID NO: 1318459 - protein, 17 aa, Mycobacterium
HMIIMPDADLDQAVDAL

SEQ ID NO: 1318460 - protein, 18 aa, Mycobacterium
HMNSYQAVRTHFFDAFFT

SEQ ID NO: 1318461 - protein, 32 aa, Mycobacterium
HMQIMGRKVVRMFPIPPIALGLRTGIAIVTYA

SEQ ID NO: 1318462 - protein, 21 aa, Mycobacterium
HMSLRMFCDYLLDSRYGWIAQ

SEQ ID NO: 1318463 - protein, 23 aa, Mycobacterium
HMVRLLRHVYNVSGIPRLTSDAD

SEQ ID NO: 1318464 - protein, 24 aa, Mycobacterium
HNDVAAPYLIRLATEEQKQRWLPK

SEQ ID NO: 1318465 - protein, 23 aa, Mycobacterium
HNFEPLYIISPDKKSTVADLKDK

SEQ ID NO: 1318466 - protein, 32 aa, Mycobacterium
HNGLTAAALLQRAGLRTLCLDAKLYAGGMAST

SEQ ID NO: 1318467 - protein, 25 aa, Mycobacterium
HNGPVRYHSLLVAAWRGEPVEAMRQ

SEQ ID NO: 1318468 - protein, 19 aa, Mycobacterium
HNIHRNLLSRVFTPRKVQA

SEQ ID NO: 1318469 - protein, 23 aa, Mycobacterium
HNIWGLRPAVLPGTREPVALTTF

SEQ ID NO: 1318470 - protein, 26 aa, Mycobacterium
HNLRDLPFTLTYLFDGDGSARLAGTS

SEQ ID NO: 1318471 - protein, 21 aa, Mycobacterium
HNPEKILYGRLADYHLSERGQ

SEQ ID NO: 1318472 - protein, 18 aa, Mycobacterium
HNQVYFVGIWYVDEFVRT

SEQ ID NO: 1318473 - protein, 20 aa, Mycobacterium
HNRIALPREVTPGRLLVPAL

SEQ ID NO: 1318474 - protein, 36 aa, Mycobacterium
HNTFHLRHRLMEPLPGTLPEPEIWARLMRELDVVDG

SEQ ID NO: 1318475 - protein, 31 aa, Mycobacterium
HNVARAAELLSWWRSTTPDYVEIAYTARHIA

SEQ ID NO: 1318476 - protein, 26 aa, Mycobacterium
HPADVAAQISWAGKTFAFCSETCKQA

SEQ ID NO: 1318477 - protein, 17 aa, Mycobacterium
HPALLPAFPGAHAVADS

SEQ ID NO: 1318478 - protein, 23 aa, Mycobacterium
HPAVGWLIPQPWVVDEKGDRVRL

SEQ ID NO: 1318479 - protein, 26 aa, Mycobacterium
HPAVIRAAILVALDAPPKSFWRIDIA

SEQ ID NO: 1318480 - protein, 29 aa, Mycobacterium
HPDADIYRSLPGLGVILGARVLGEFGDDP

SEQ ID NO: 1318481 - protein, 24 aa, Mycobacterium
HPDGRSAFALWFTGGIFVNQDGHR

SEQ ID NO: 1318482 - protein, 24 aa, Mycobacterium
HPDTCAELMRKGETLLVFPGGGRD

SEQ ID NO: 1318483 - protein, 22 aa, Mycobacterium
HPDVFDIQWPLRVADVDREGRL

SEQ ID NO: 1318484 - protein, 17 aa, Mycobacterium
HPDVLRELLATFIHTLM

SEQ ID NO: 1318485 - protein, 21 aa, Mycobacterium
HPEFAIARWAVEHLSPAQRNR

SEQ ID NO: 1318486 - protein, 20 aa, Mycobacterium
HPEHGAFDKDFQVLHAREVG

SEQ ID NO: 1318487 - protein, 23 aa, Mycobacterium
HPEQWQMLLDDRNLIPDAVEELL

SEQ ID NO: 1318488 - protein, 18 aa, Mycobacterium
HPEVGVLVFSQWVETRYA

SEQ ID NO: 1318489 - protein, 25 aa, Mycobacterium
HPFTKPQCISLLQRVLRGTVEELSA

SEQ ID NO: 1318490 - protein, 17 aa, Mycobacterium
HPGFIRTPMTKHFPDNM

SEQ ID NO: 1318491 - protein, 18 aa, Mycobacterium
HPGFLQEQWAELEPLLAS

SEQ ID NO: 1318492 - protein, 35 aa, Mycobacterium
HPGFSGFTGDLFAVLFLLAGRRTAGLAAALTEVTA

SEQ ID NO: 1318493 - protein, 25 aa, Mycobacterium
HPGSRLLFPTLCQPTATLWTGEPPQ

SEQ ID NO: 1318494 - protein, 21 aa, Mycobacterium
HPGTRWRYEYSPESYTGTELE

SEQ ID NO: 1318495 - protein, 20 aa, Mycobacterium
HPHEFIAMCPVSLREDGDSA

SEQ ID NO: 1318496 - protein, 25 aa, Mycobacterium
HPHSLQLIMDSLRYWVTEMHVDGFR

SEQ ID NO: 1318497 - protein, 28 aa, Mycobacterium
HPIEAGRPCWLLCLLFDDADGCAGHSDG

SEQ ID NO: 1318498 - protein, 20 aa, Mycobacterium
HPILYLRMADRLKAGAKLIV

SEQ ID NO: 1318499 - protein, 29 aa, Mycobacterium
HPIRRVGDYPTWLQRFTVAITALPERQRQ

SEQ ID NO: 1318500 - protein, 23 aa, Mycobacterium
HPKWQERPLLIVVLRKGHHATRE

SEQ ID NO: 1318501 - protein, 20 aa, Mycobacterium
HPLWIVRRTMIDMIEPVVFK

SEQ ID NO: 1318502 - protein, 20 aa, Mycobacterium
HPPFRWQRRYAEGFSAQVAA

SEQ ID NO: 1318503 - protein, 19 aa, Mycobacterium
HPPQQFIYQPAVDKTLRAG

SEQ ID NO: 1318504 - protein, 25 aa, Mycobacterium
HPPTYYLPVDSFTPGALRPAAGSSW

SEQ ID NO: 1318505 - protein, 18 aa, Mycobacterium
HPRGVLRSLKVGIRATWA

SEQ ID NO: 1318506 - protein, 21 aa, Mycobacterium
HPRHVLSYGLGLDSTAVLLRW

SEQ ID NO: 1318507 - protein, 20 aa, Mycobacterium
HPRPVSTPHPPIWVGGNTSA

SEQ ID NO: 1318508 - protein, 19 aa, Mycobacterium
HPRWPAFDDWVASHPPVDP

SEQ ID NO: 1318509 - protein, 30 aa, Mycobacterium
HPSIAKLVAGLGLRLPIVATGYGTFETASR

SEQ ID NO: 1318510 - protein, 25 aa, Mycobacterium
HPSLEWVPDWLWKQNLKVMQRFLLF

SEQ ID NO: 1318511 - protein, 33 aa, Mycobacterium
HPSNLKCLCRFHHLLKTFWLGATGWHDRQHPDG

SEQ ID NO: 1318512 - protein, 20 aa, Mycobacterium
HPTFEQWWEPYTYGVGPAGD

SEQ ID NO: 1318513 - protein, 17 aa, Mycobacterium
HPTMRAFEQDFPSVQIP

SEQ ID NO: 1318514 - protein, 28 aa, Mycobacterium
HPTNVNTPLFMNEPTMKLFRPDLENPGP

SEQ ID NO: 1318515 - protein, 24 aa, Mycobacterium
HPVHDFLFTYYSVRPGQLRVWHPG

SEQ ID NO: 1318516 - protein, 21 aa, Mycobacterium
HPVRAYLSVAEIMRVAVEAGC

SEQ ID NO: 1318517 - protein, 25 aa, Mycobacterium
HPVVIARRHWPALLDALAGDVGAGP

SEQ ID NO: 1318518 - protein, 17 aa, Mycobacterium
HPVVLRPGDDHYRPIGW

SEQ ID NO: 1318519 - protein, 17 aa, Mycobacterium
HQEITRLLSAISLTRRN

SEQ ID NO: 1318520 - protein, 18 aa, Mycobacterium
HQGLRKLCAWQLGHPLAS

SEQ ID NO: 1318521 - protein, 25 aa, Mycobacterium
HQGRGVGRGDEISRSGRIGTDNTAG

SEQ ID NO: 1318522 - protein, 26 aa, Mycobacterium
HQIGNLQSIIRLTAKLRFVTGVASLI

SEQ ID NO: 1318523 - protein, 23 aa, Mycobacterium
HQIKPLFVLFDSCWDPMPKPGRQ

SEQ ID NO: 1318524 - protein, 22 aa, Mycobacterium
HQKVIELAPAPNLPDELRQKIC

SEQ ID NO: 1318525 - protein, 19 aa, Mycobacterium
HQNALAAGLYPRLGAASNV

SEQ ID NO: 1318526 - protein, 24 aa, Mycobacterium
HQVQAVYDCMLTGHPKRFLLADDP

SEQ ID NO: 1318527 - protein, 19 aa, Mycobacterium
HRAFSDEGYWLARLSDSGA

SEQ ID NO: 1318528 - protein, 17 aa, Mycobacterium
HRAKALRLGDYCLGLYA

SEQ ID NO: 1318529 - protein, 25 aa, Mycobacterium
HRALQCRAFLLSRAGVEWASGLPGE

SEQ ID NO: 1318530 - protein, 17 aa, Mycobacterium
HRALRWVAVHELDDLPW

SEQ ID NO: 1318531 - protein, 23 aa, Mycobacterium
HRAQGFLLSRPIDGAAMKALLAR

SEQ ID NO: 1318532 - protein, 23 aa, Mycobacterium
HRASFVQIHFALDGLPEFAPPYD

SEQ ID NO: 1318533 - protein, 17 aa, Mycobacterium
HRCAPQVYRWGPGAALS

SEQ ID NO: 1318534 - protein, 20 aa, Mycobacterium
HRDIEFPDRGVVVVSGPNEA

SEQ ID NO: 1318535 - protein, 17 aa, Mycobacterium
HRDIEVITDMWGRPRVR

SEQ ID NO: 1318536 - protein, 30 aa, Mycobacterium
HRDQKLIFHRPILAGDKLWFDSYLDSVTES

SEQ ID NO: 1318537 - protein, 24 aa, Mycobacterium
HRDRRRLMLAPFARDAVAAQAGVI

SEQ ID NO: 1318538 - protein, 23 aa, Mycobacterium
HRDVLHTVIVRRSATGLYHALLW

SEQ ID NO: 1318539 - protein, 31 aa, Mycobacterium
HRDWNARYTWPRFVCALPCEFFAAVRAELDA

SEQ ID NO: 1318540 - protein, 26 aa, Mycobacterium
HRETYDALFDLYFPAALGSRTVLDDE

SEQ ID NO: 1318541 - protein, 24 aa, Mycobacterium
HRGLGYIDLTQWSGIILGGGPYNV

SEQ ID NO: 1318542 - protein, 17 aa, Mycobacterium
HRGMSEAFFVLSGTLSL

SEQ ID NO: 1318543 - protein, 27 aa, Mycobacterium
HRGPRPHLLGRPLPAPPPADVALDELI

SEQ ID NO: 1318544 - protein, 24 aa, Mycobacterium
HRGRPFFDLLARVGADRPHRVVDL

SEQ ID NO: 1318545 - protein, 25 aa, Mycobacterium
HRGSYLQMHFALDAGPTFAAPYEML

SEQ ID NO: 1318546 - protein, 25 aa, Mycobacterium
HRGSYLQMHFALDGAPTFAEPYEML

SEQ ID NO: 1318547 - protein, 24 aa, Mycobacterium
HRHAHWLLPAVHWLERDDLLAFTS

SEQ ID NO: 1318548 - protein, 24 aa, Mycobacterium
HRHFEGWLSDDSWLGETGALEFVQ

SEQ ID NO: 1318549 - protein, 27 aa, Mycobacterium
HRHGSPPVPLVPLVLDHNLRNTRQIAN

SEQ ID NO: 1318550 - protein, 17 aa, Mycobacterium
HRHRRAPRLSRYSLSTS

SEQ ID NO: 1318551 - protein, 17 aa, Mycobacterium
HRILAAARERAPVALGA

SEQ ID NO: 1318552 - protein, 23 aa, Mycobacterium
HRKRRMRFMIKAEMQDVKIVDWL

SEQ ID NO: 1318553 - protein, 23 aa, Mycobacterium
HRLFAGIPYAAPPVGALRWRPPE

SEQ ID NO: 1318554 - protein, 18 aa, Mycobacterium
HRLLPRFVAVLDDAGLPT

SEQ ID NO: 1318555 - protein, 18 aa, Mycobacterium
HRLRIVGIDLRDPAQVVA

SEQ ID NO: 1318556 - protein, 17 aa, Mycobacterium
HRLRRPVPQPAHRGPGV

SEQ ID NO: 1318557 - protein, 17 aa, Mycobacterium
HRNARTTLLGRMLIVQR

SEQ ID NO: 1318558 - protein, 18 aa, Mycobacterium
HRPEDYGYFVPITTRWMD

SEQ ID NO: 1318559 - protein, 24 aa, Mycobacterium
HRPITLMHVVAPVVVTWPIEAVVT

SEQ ID NO: 1318560 - protein, 18 aa, Mycobacterium
HRPQPPKDMLRNLFGLTN

SEQ ID NO: 1318561 - protein, 18 aa, Mycobacterium
HRQIRCTRRWWDAVDDQQ

SEQ ID NO: 1318562 - protein, 19 aa, Mycobacterium
HRRAPRLSRYSLSTSSLSA

SEQ ID NO: 1318563 - protein, 24 aa, Mycobacterium
HRRIDTSWRRTSYSGLIRAAESEQ

SEQ ID NO: 1318564 - protein, 21 aa, Mycobacterium
HRRILELEGLRRWVRPHLDGY

SEQ ID NO: 1318565 - protein, 19 aa, Mycobacterium
HRRIPIITVVNKWDRPGRH

SEQ ID NO: 1318566 - protein, 19 aa, Mycobacterium
HRRWVSPAARRLASSLHVD

SEQ ID NO: 1318567 - protein, 27 aa, Mycobacterium
HRSADTHLLRYPLPASWSADVALYLKD

SEQ ID NO: 1318568 - protein, 24 aa, Mycobacterium
HRSAPPITQLPTLVHRHDLAAAES

SEQ ID NO: 1318569 - protein, 18 aa, Mycobacterium
HRSPRLPLDRLPALLSRR

SEQ ID NO: 1318570 - protein, 24 aa, Mycobacterium
HRSTPVMPVLLRTRMPPSFRVGES

SEQ ID NO: 1318571 - protein, 17 aa, Mycobacterium
HRTGIYGHSRACAWAIA

SEQ ID NO: 1318572 - protein, 25 aa, Mycobacterium
HRVAAVFLMALLAEDLRPLLDRLTT

SEQ ID NO: 1318573 - protein, 19 aa, Mycobacterium
HRVAGIYPVTLDKSKNSSA

SEQ ID NO: 1318574 - protein, 18 aa, Mycobacterium
HRVAYLDHLAQGRFMLGV

SEQ ID NO: 1318575 - protein, 21 aa, Mycobacterium
HRVGTWRFMSLRHAVDDKRDV

SEQ ID NO: 1318576 - protein, 20 aa, Mycobacterium
HRVINLLACLRLLHEQAPEL

SEQ ID NO: 1318577 - protein, 28 aa, Mycobacterium
HRVSRLHAKLFYQPLLESVGQASLGLSD

SEQ ID NO: 1318578 - protein, 24 aa, Mycobacterium
HRVVNMTSRELLDWLRTRSAGEGS

SEQ ID NO: 1318579 - protein, 24 aa, Mycobacterium
HRVWYRYHHLFGDVLRGRLRDLAP

SEQ ID NO: 1318580 - protein, 17 aa, Mycobacterium
HRWILATASFGPPLDPG

SEQ ID NO: 1318581 - protein, 25 aa, Mycobacterium
HSAGRLPGIPIYLDSPMAINASDLL

SEQ ID NO: 1318582 - protein, 23 aa, Mycobacterium
HSAHYYFRDFWGADSGMLAALHV

SEQ ID NO: 1318583 - protein, 18 aa, Mycobacterium
HSDALFRGYWDDHAATLV

SEQ ID NO: 1318584 - protein, 25 aa, Mycobacterium
HSDFTSYLNLWHYLTEQRKERSGSS

SEQ ID NO: 1318585 - protein, 21 aa, Mycobacterium
HSDVSLVRRLATIQFERSAAT

SEQ ID NO: 1318586 - protein, 26 aa, Mycobacterium
HSEVDTLRRVELLRQLRLGEYDVLVG

SEQ ID NO: 1318587 - protein, 21 aa, Mycobacterium
HSFVIFLREGFPVNVLNPVKA

SEQ ID NO: 1318588 - protein, 23 aa, Mycobacterium
HSGSLVRYLEPFAHTVGVMQNPD

SEQ ID NO: 1318589 - protein, 17 aa, Mycobacterium
HSIGVWPVLLNDETVVE

SEQ ID NO: 1318590 - protein, 19 aa, Mycobacterium
HSIPVLAYFVDGQTAAVDY

SEQ ID NO: 1318591 - protein, 32 aa, Mycobacterium
HSIVVAPTLTWNVLDTENYPLLLPSTHRAVAE

SEQ ID NO: 1318592 - protein, 17 aa, Mycobacterium
HSLAALRRRVTTFAQAL

SEQ ID NO: 1318593 - protein, 24 aa, Mycobacterium
HSLGRLRRWHRELTARDVFGAPEV

SEQ ID NO: 1318594 - protein, 18 aa, Mycobacterium
HSLPPLNLTVPESLAVLA

SEQ ID NO: 1318595 - protein, 17 aa, Mycobacterium
HSLTYAYRDRRARKGEF

SEQ ID NO: 1318596 - protein, 31 aa, Mycobacterium
HSPTDEALWSESWYFDFADPGQQLGGWIRLG

SEQ ID NO: 1318597 - protein, 19 aa, Mycobacterium
HSRLRPPWVTDIDVVFGTA

SEQ ID NO: 1318598 - protein, 23 aa, Mycobacterium
HSRRATIASTAWLPQLGVPQGFA

SEQ ID NO: 1318599 - protein, 19 aa, Mycobacterium
HSRRIPDFVKLSEALGCVG

SEQ ID NO: 1318600 - protein, 17 aa, Mycobacterium
HSRWFVIPERPSGTEDL

SEQ ID NO: 1318601 - protein, 17 aa, Mycobacterium
HSTICDALLDGALKVTE

SEQ ID NO: 1318602 - protein, 34 aa, Mycobacterium
HSTTTLALTTPLTFRPMPLLKNITRNAGWGRSTP

SEQ ID NO: 1318603 - protein, 17 aa, Mycobacterium
HSVIVDGTWRDAGHRQR

SEQ ID NO: 1318604 - protein, 18 aa, Mycobacterium
HSVKVIPGRGAWLEFDVD

SEQ ID NO: 1318605 - protein, 26 aa, Mycobacterium
HSVTKFARIIAEAIGAWRISKNISKG

SEQ ID NO: 1318606 - protein, 26 aa, Mycobacterium
HSVTVGRIAYLLGLKGPAVAVDTACS

SEQ ID NO: 1318607 - protein, 27 aa, Mycobacterium
HSYYVPAQLFPTADGYLALFITHDGFW

SEQ ID NO: 1318608 - protein, 19 aa, Mycobacterium
HTAIIARQLGIPCVVAVDG

SEQ ID NO: 1318609 - protein, 25 aa, Mycobacterium
HTARRYGIPWELFDDFLASMRMDLT

SEQ ID NO: 1318610 - protein, 24 aa, Mycobacterium
HTDAAFTFTMFDGGHFYLDDHLDE

SEQ ID NO: 1318611 - protein, 20 aa, Mycobacterium
HTDARIRDGLAWCYSRVQIM

SEQ ID NO: 1318612 - protein, 24 aa, Mycobacterium
HTDHGLMLEAFLDRDVDALLATSR

SEQ ID NO: 1318613 - protein, 19 aa, Mycobacterium
HTDHRALLSRMITPKRLKE

SEQ ID NO: 1318614 - protein, 25 aa, Mycobacterium
HTDHVIDLLVLAGWPRAAARARRLR

SEQ ID NO: 1318615 - protein, 23 aa, Mycobacterium
HTDRAAALLAGLKTPIVHGMWLS

SEQ ID NO: 1318616 - protein, 18 aa, Mycobacterium
HTEFLRSLRAWDAARRAS

SEQ ID NO: 1318617 - protein, 24 aa, Mycobacterium
HTERLYRTSVSPFGLVTGAWIDPP

SEQ ID NO: 1318618 - protein, 20 aa, Mycobacterium
HTFALILAVTRRVVDGDRFL

SEQ ID NO: 1318619 - protein, 24 aa, Mycobacterium
HTFRDHYLDLDLDLSDVVFVATAN

SEQ ID NO: 1318620 - protein, 25 aa, Mycobacterium
HTGKIILQMPKPLQPHGDRSYLITG

SEQ ID NO: 1318621 - protein, 25 aa, Mycobacterium
HTGRLWRVGFCGFAPGFAYLVGGDE

SEQ ID NO: 1318622 - protein, 23 aa, Mycobacterium
HTGRPKFVAFERAYHGRTLGALS

SEQ ID NO: 1318623 - protein, 24 aa, Mycobacterium
HTGRRRAARFLAEGPNLVEAALRR

SEQ ID NO: 1318624 - protein, 20 aa, Mycobacterium
HTIRLLVLPQEQDAPVIRRL

SEQ ID NO: 1318625 - protein, 28 aa, Mycobacterium
HTKSIVYELLWFLRGDSNVRWLQEHGVT

SEQ ID NO: 1318626 - protein, 17 aa, Mycobacterium
HTLDLVVLAVEWGSGRR

SEQ ID NO: 1318627 - protein, 26 aa, Mycobacterium
HTLHLDNRVTLLDALREHLGVTAPKK

SEQ ID NO: 1318628 - protein, 34 aa, Mycobacterium
HTLMTPTFVPGPNPFGPPPIYLGALGPRLTRATA

SEQ ID NO: 1318629 - protein, 17 aa, Mycobacterium
HTPPRARKPQRRVRLSG

SEQ ID NO: 1318630 - protein, 24 aa, Mycobacterium
HTRGAIVRLLLESGPVTASRIGER

SEQ ID NO: 1318631 - protein, 35 aa, Mycobacterium
HTRLRSLEVQLDQCWDLLRQRRALRASGGDPDDAQ

SEQ ID NO: 1318632 - protein, 22 aa, Mycobacterium
HTRNAFWGITGELFGFDPAAPY

SEQ ID NO: 1318633 - protein, 24 aa, Mycobacterium
HTRPGAMPRLVPPWQPMTVVAETP

SEQ ID NO: 1318634 - protein, 24 aa, Mycobacterium
HTRRLVTLGRPLQGLELRVVDEDG

SEQ ID NO: 1318635 - protein, 29 aa, Mycobacterium
HTTRCFVTFLMLAGHLRPGYDYLICRKLS

SEQ ID NO: 1318636 - protein, 28 aa, Mycobacterium
HTVAGALYPPLIIRGLGTRQVYSASTLD

SEQ ID NO: 1318637 - protein, 22 aa, Mycobacterium
HTVARHLRWLAALAGVDDGRVA

SEQ ID NO: 1318638 - protein, 27 aa, Mycobacterium
HTVDPTLPVLGLAGSVFFTAATELGLR

SEQ ID NO: 1318639 - protein, 24 aa, Mycobacterium
HTVSWPARDIPSLGWRAYRRCPGA

SEQ ID NO: 1318640 - protein, 29 aa, Mycobacterium
HVDEGVIALALLKRGLPADTALTTGGEVH

SEQ ID NO: 1318641 - protein, 22 aa, Mycobacterium
HVDVFAEIGIPLRRVMITNGGS

SEQ ID NO: 1318642 - protein, 19 aa, Mycobacterium
HVEDKLRTVLWGWAGKPVD

SEQ ID NO: 1318643 - protein, 21 aa, Mycobacterium
HVEPAYFLKPPSALTGHREPI

SEQ ID NO: 1318644 - protein, 28 aa, Mycobacterium
HVEPSQMSLWQRLWHTRCPKAASGHPGR

SEQ ID NO: 1318645 - protein, 32 aa, Mycobacterium
HVETDPMIFAPDSHSWWDVPVSQVSALESTRQ

SEQ ID NO: 1318646 - protein, 17 aa, Mycobacterium
HVFITGRKKPALDAAAA

SEQ ID NO: 1318647 - protein, 17 aa, Mycobacterium
HVFPAVEGLPEAGAGSV

SEQ ID NO: 1318648 - protein, 27 aa, Mycobacterium
HVGLIRTALFNWAYARHTGGTFVFRIE

SEQ ID NO: 1318649 - protein, 18 aa, Mycobacterium
HVGLPVVVVDVKGDWWGI

SEQ ID NO: 1318650 - protein, 18 aa, Mycobacterium
HVGWLDDRKWAYVRLEGR

SEQ ID NO: 1318651 - protein, 20 aa, Mycobacterium
HVHIGNLRRKLGDNPARPLL

SEQ ID NO: 1318652 - protein, 18 aa, Mycobacterium
HVHPLGEPGYIARHVIPK

SEQ ID NO: 1318653 - protein, 22 aa, Mycobacterium
HVILAEFFVRQRVPFFVDYVRQ

SEQ ID NO: 1318654 - protein, 19 aa, Mycobacterium
HVITINDYLARRDAEWMGP

SEQ ID NO: 1318655 - protein, 22 aa, Mycobacterium
HVIWWQIYPLGFVGAFPADPPP

SEQ ID NO: 1318656 - protein, 17 aa, Mycobacterium
HVKDLVNTGWPVLMALS

SEQ ID NO: 1318657 - protein, 17 aa, Mycobacterium
HVLGFKGLERRCVVLVV

SEQ ID NO: 1318658 - protein, 18 aa, Mycobacterium
HVLGVLDHFGMPSASFVA

SEQ ID NO: 1318659 - protein, 22 aa, Mycobacterium
HVLPFISIRVWQPISENETEVL

SEQ ID NO: 1318660 - protein, 19 aa, Mycobacterium
HVLPIVISAWWVALSATNH

SEQ ID NO: 1318661 - protein, 18 aa, Mycobacterium
HVLVIGSGPILIGQAAEF

SEQ ID NO: 1318662 - protein, 18 aa, Mycobacterium
HVLWQVYLASRPVDHLTP

SEQ ID NO: 1318663 - protein, 18 aa, Mycobacterium
HVMYVWVDALTNYLTGVG

SEQ ID NO: 1318664 - protein, 28 aa, Mycobacterium
HVNELQALLLDWGFAPMTVGSRPPAAAP

SEQ ID NO: 1318665 - protein, 20 aa, Mycobacterium
HVNHTIWWKNLSPNGGDKPT

SEQ ID NO: 1318666 - protein, 23 aa, Mycobacterium
HVNPRHQLQYSLTVRDVVMTGIT

SEQ ID NO: 1318667 - protein, 17 aa, Mycobacterium
HVRDVKFVAAFDVDAKK

SEQ ID NO: 1318668 - protein, 26 aa, Mycobacterium
HVRGRGLLIGIALRAAAAKPAEAAAR

SEQ ID NO: 1318669 - protein, 19 aa, Mycobacterium
HVRICILSRRQWHGMFALM

SEQ ID NO: 1318670 - protein, 18 aa, Mycobacterium
HVRILILSMHDNEQYFFE

SEQ ID NO: 1318671 - protein, 33 aa, Mycobacterium
HVRNKRLYDALDQWAFCTLTRSPGARAYYDQHR

SEQ ID NO: 1318672 - protein, 24 aa, Mycobacterium
HVRRLLVEAAWHHKPRYRVGTVMR

SEQ ID NO: 1318673 - protein, 25 aa, Mycobacterium
HVRRLLVEAAWHHKPRYRVGTVMRS

SEQ ID NO: 1318674 - protein, 28 aa, Mycobacterium
HVRSTKPWFALLEDALTPLWSRVGGGCH

SEQ ID NO: 1318675 - protein, 18 aa, Mycobacterium
HVRTLRVFLACNGSLSET

SEQ ID NO: 1318676 - protein, 26 aa, Mycobacterium
HVRVIVALGGFAWQVALAMIRRAGGA

SEQ ID NO: 1318677 - protein, 21 aa, Mycobacterium
HVRVLDIVAERLRLAAQFGAA

SEQ ID NO: 1318678 - protein, 19 aa, Mycobacterium
HVSARLLAGAFAVAWEWGN

SEQ ID NO: 1318679 - protein, 27 aa, Mycobacterium
HVSRPVQTLYHLPQLTIAAVNGPAAGA

SEQ ID NO: 1318680 - protein, 25 aa, Mycobacterium
HVSRTTIYKWWPSAASIVLEGLLDA

SEQ ID NO: 1318681 - protein, 17 aa, Mycobacterium
HVTHGDPARLWLRLEDG

SEQ ID NO: 1318682 - protein, 23 aa, Mycobacterium
HVTIRLANKLRLLTLAAGDTTSP

SEQ ID NO: 1318683 - protein, 27 aa, Mycobacterium
HVTVANYEYLVYWRLYQDGNIECEVRA

SEQ ID NO: 1318684 - protein, 28 aa, Mycobacterium
HVVLPALDVPAMFDFYTGVLGFKSRGAF

SEQ ID NO: 1318685 - protein, 19 aa, Mycobacterium
HVVLYIHLLGSVQLEHHLR

SEQ ID NO: 1318686 - protein, 23 aa, Mycobacterium
HVVWWQVYPLGFVGAYPADPPPP

SEQ ID NO: 1318687 - protein, 34 aa, Mycobacterium
HVWIGPPNLEPPERPLPGPLKWDLTTGIATATTQ

SEQ ID NO: 1318688 - protein, 23 aa, Mycobacterium
HVWPEMLDALRRAGWRNYSLFVH

SEQ ID NO: 1318689 - protein, 17 aa, Mycobacterium
HVWVVRSPRLRGINLAF

SEQ ID NO: 1318690 - protein, 20 aa, Mycobacterium
HVYTAGDAFYWAAGHAPEAI

SEQ ID NO: 1318691 - protein, 30 aa, Mycobacterium
HVYTTEPLGGLLFPTLATPTAPLPDVEVPE

SEQ ID NO: 1318692 - protein, 32 aa, Mycobacterium
HWADQGTIDLLRFLLRRAPQSHLLTIGILRDE

SEQ ID NO: 1318693 - protein, 19 aa, Mycobacterium
HWDHCAFHWFPGNHVLHVS

SEQ ID NO: 1318694 - protein, 19 aa, Mycobacterium
HWFLPTYGDSRLIVGGGHG

SEQ ID NO: 1318695 - protein, 17 aa, Mycobacterium
HWGDRFVDHLKGMFAFA

SEQ ID NO: 1318696 - protein, 18 aa, Mycobacterium
HWGGAFKFAASVLGLPIG

SEQ ID NO: 1318697 - protein, 19 aa, Mycobacterium
HWIADRQVAPGLLAYGTGE

SEQ ID NO: 1318698 - protein, 18 aa, Mycobacterium
HWPAFVKSFLRLTTMIRK

SEQ ID NO: 1318699 - protein, 17 aa, Mycobacterium
HWPGMGRELLSHEPAFA

SEQ ID NO: 1318700 - protein, 18 aa, Mycobacterium
HWPRQWAHAYVDFAAGEK

SEQ ID NO: 1318701 - protein, 19 aa, Mycobacterium
HWSTTLAAPGSCWAVCPPR

SEQ ID NO: 1318702 - protein, 18 aa, Mycobacterium
HWTLPHLVGGAVAADLLL

SEQ ID NO: 1318703 - protein, 17 aa, Mycobacterium
HWYADRSAVLEFVAEID

SEQ ID NO: 1318704 - protein, 25 aa, Mycobacterium
HYAGAFPAWLAPVQVVGIPVADDHI

SEQ ID NO: 1318705 - protein, 18 aa, Mycobacterium
HYAPLDLVTPTRDKPSAF

SEQ ID NO: 1318706 - protein, 32 aa, Mycobacterium
HYCRTHHVIKTFLTGVYGWRDEQRRDGTVVLT

SEQ ID NO: 1318707 - protein, 25 aa, Mycobacterium
HYDNSPLICRPLTFVRAAPSENGYA

SEQ ID NO: 1318708 - protein, 18 aa, Mycobacterium
HYEPFGIVALEAAATGTP

SEQ ID NO: 1318709 - protein, 17 aa, Mycobacterium
HYFANWSAYTRELVEYW

SEQ ID NO: 1318710 - protein, 17 aa, Mycobacterium
HYGLFRAGEDQAPQRVG

SEQ ID NO: 1318711 - protein, 30 aa, Mycobacterium
HYGMCGRAYDPRFLFAWPSAKSAVMGGTQL

SEQ ID NO: 1318712 - protein, 24 aa, Mycobacterium
HYGPLFIRMSWHAAGTYRVQDGRG

SEQ ID NO: 1318713 - protein, 24 aa, Mycobacterium
HYHRPVLDHLWPDGWEVLELNPAH

SEQ ID NO: 1318714 - protein, 19 aa, Mycobacterium
HYKLVGWRNNGCGYRRFFS

SEQ ID NO: 1318715 - protein, 18 aa, Mycobacterium
HYLDTTPLEPIVERWLDK

SEQ ID NO: 1318716 - protein, 18 aa, Mycobacterium
HYLLADSGATALLYHAAF

SEQ ID NO: 1318717 - protein, 22 aa, Mycobacterium
HYLRLSFQAGGLLRDRALHPTM

SEQ ID NO: 1318718 - protein, 24 aa, Mycobacterium
HYPSLDLAFRICEVFDLPVEAVFS

SEQ ID NO: 1318719 - protein, 18 aa, Mycobacterium
HYRPLFPDVPDDLPYVWP

SEQ ID NO: 1318720 - protein, 17 aa, Mycobacterium
HYSSKYELFRDAVLNLG

SEQ ID NO: 1318721 - protein, 18 aa, Mycobacterium
HYTHEVADLYFFDTVVRL

SEQ ID NO: 1318722 - protein, 24 aa, Mycobacterium
HYTRAYLHHLFKAKEMLSATLCTI

SEQ ID NO: 1318723 - protein, 22 aa, Mycobacterium
HYTRLAALDLCPRIRVNAIAPG

SEQ ID NO: 1318724 - protein, 23 aa, Mycobacterium
IAAAAAEFFPLSGASVLLDAGTT

SEQ ID NO: 1318725 - protein, 30 aa, Mycobacterium
IAAALNVGIMDFGFFWVTGVTMEGTIVVAN

SEQ ID NO: 1318726 - protein, 20 aa, Mycobacterium
IAACGWTVIAVFPTAQDQGP

SEQ ID NO: 1318727 - protein, 23 aa, Mycobacterium
IAADGSVLDTWFPAPELTDGGEA

SEQ ID NO: 1318728 - protein, 26 aa, Mycobacterium
IAAFEAAWNLGIPTLAICRGAQLVTA

SEQ ID NO: 1318729 - protein, 24 aa, Mycobacterium
IAAFHKRLPAWVDIETRAEADRQL

SEQ ID NO: 1318730 - protein, 25 aa, Mycobacterium
IAAGWVLDLLGLPATASVGFVTGGQ

SEQ ID NO: 1318731 - protein, 18 aa, Mycobacterium
IAAIILESVPGTAGIMVP

SEQ ID NO: 1318732 - protein, 21 aa, Mycobacterium
IAAKRPRLIPIWDSFVEQATG

SEQ ID NO: 1318733 - protein, 17 aa, Mycobacterium
IAALHLGPLLSDADRRF

SEQ ID NO: 1318734 - protein, 18 aa, Mycobacterium
IAALPRIRRTHPGTTLTI

SEQ ID NO: 1318735 - protein, 27 aa, Mycobacterium
IAALSAYWELPAMIGQFARGGLGAVPA

SEQ ID NO: 1318736 - protein, 20 aa, Mycobacterium
IAAMFVQGSVRYDEEASTFI

SEQ ID NO: 1318737 - protein, 18 aa, Mycobacterium
IAARASGAAYRWANPSRL

SEQ ID NO: 1318738 - protein, 25 aa, Mycobacterium
IAARHWAVEPDLSNAVPFLAAAVIS

SEQ ID NO: 1318739 - protein, 24 aa, Mycobacterium
IAASDAFFPFPDGLETLTEAGVKA

SEQ ID NO: 1318740 - protein, 28 aa, Mycobacterium
IAASPALGFLPKLTLSPAAVRKLLDRVS

SEQ ID NO: 1318741 - protein, 28 aa, Mycobacterium
IAATLAELPGWAPGPPPGFQPAGDVVHR

SEQ ID NO: 1318742 - protein, 26 aa, Mycobacterium
IAATRLRGLALPGPLQRQTEKLALLI

SEQ ID NO: 1318743 - protein, 19 aa, Mycobacterium
IAAWVGDPARRGANICLRL

SEQ ID NO: 1318744 - protein, 25 aa, Mycobacterium
IACAPAVCAVLLCGIQPAPGDRPGS

SEQ ID NO: 1318745 - protein, 26 aa, Mycobacterium
IADERLRRIFTFQALYAGVPPHKALA

SEQ ID NO: 1318746 - protein, 25 aa, Mycobacterium
IADFLGPHLKALAGPYLFVGSGISR

SEQ ID NO: 1318747 - protein, 28 aa, Mycobacterium
IADGTVTLPFWMIYDDSEGLVPPVKATN

SEQ ID NO: 1318748 - protein, 24 aa, Mycobacterium
IADLAHRVLQHRLILGFEAASAGI

SEQ ID NO: 1318749 - protein, 24 aa, Mycobacterium
IADLESREVLLSKLAGAMKAKQSQ

SEQ ID NO: 1318750 - protein, 18 aa, Mycobacterium
IADLLRFDRRDDVFVACP

SEQ ID NO: 1318751 - protein, 17 aa, Mycobacterium
IADRPLGGVYRTLLLSV

SEQ ID NO: 1318752 - protein, 20 aa, Mycobacterium
IADWPGMTLCFLEESLRNHR

SEQ ID NO: 1318753 - protein, 24 aa, Mycobacterium
IAEGWQPVFFYPEKADDVWGDALR

SEQ ID NO: 1318754 - protein, 19 aa, Mycobacterium
IAEHVMGLLGGTDLDLEPR

SEQ ID NO: 1318755 - protein, 23 aa, Mycobacterium
IAELAIRFRDKGVVGFDIAGAEA

SEQ ID NO: 1318756 - protein, 21 aa, Mycobacterium
IAELTVRLHRLRQPVIAAVNG

SEQ ID NO: 1318757 - protein, 27 aa, Mycobacterium
IAEMNAPWNGLLLYSNHKFFSDENVVR

SEQ ID NO: 1318758 - protein, 17 aa, Mycobacterium
IAENAFFADPHVSIGLV

SEQ ID NO: 1318759 - protein, 18 aa, Mycobacterium
IAENYRLHQYLVGGYRGI

SEQ ID NO: 1318760 - protein, 18 aa, Mycobacterium
IAEPLRLLDCARPVNGAV

SEQ ID NO: 1318761 - protein, 19 aa, Mycobacterium
IAEQWGFSRTQLDEFSLRS

SEQ ID NO: 1318762 - protein, 22 aa, Mycobacterium
IAESLGLAKLLDRKPKDLSGGQ

SEQ ID NO: 1318763 - protein, 25 aa, Mycobacterium
IAEWSHFPIVRRVADLTGLPVRLGG

SEQ ID NO: 1318764 - protein, 29 aa, Mycobacterium
IAEYGISWILPRIVGWSAAQDLLLSGRTF

SEQ ID NO: 1318765 - protein, 17 aa, Mycobacterium
IAFDPLAAFLTTGGLPP

SEQ ID NO: 1318766 - protein, 23 aa, Mycobacterium
IAFGEFGALMDMASCRSDPFAID

SEQ ID NO: 1318767 - protein, 24 aa, Mycobacterium
IAFGEFGALMDMASCRSDPFAIDF

SEQ ID NO: 1318768 - protein, 27 aa, Mycobacterium
IAFGMYGIALSRASGCWPAMKIVADVA

SEQ ID NO: 1318769 - protein, 19 aa, Mycobacterium
IAFGWDRIVALLAGLDSIR

SEQ ID NO: 1318770 - protein, 20 aa, Mycobacterium
IAFIDAGVSGGIWGLTEGYG

SEQ ID NO: 1318771 - protein, 17 aa, Mycobacterium
IAFIKDGDKIRLDVAKG

SEQ ID NO: 1318772 - protein, 18 aa, Mycobacterium
IAFPLRLAGKLSDEEIRQ

SEQ ID NO: 1318773 - protein, 19 aa, Mycobacterium
IAGIEKLRFFPLEVQSGQG

SEQ ID NO: 1318774 - protein, 32 aa, Mycobacterium
IAGIMERRLDRDRPLWECWIIEGLADGRWATL

SEQ ID NO: 1318775 - protein, 25 aa, Mycobacterium
IAGLVVKCWMFVMRLSHSGKAFHVA

SEQ ID NO: 1318776 - protein, 25 aa, Mycobacterium
IAGVVYPIPEPFLVIATQNPVDQEG

SEQ ID NO: 1318777 - protein, 30 aa, Mycobacterium
IAHGRANAIFLPHVLRYNASLPSKFMPAPG

SEQ ID NO: 1318778 - protein, 18 aa, Mycobacterium
IAHIGGSIYAFEAPLLLG

SEQ ID NO: 1318779 - protein, 26 aa, Mycobacterium
IAIELDGLRLITWRGAARADQGMSFA

SEQ ID NO: 1318780 - protein, 19 aa, Mycobacterium
IAILRKLTAFRGDSRFTTW

SEQ ID NO: 1318781 - protein, 20 aa, Mycobacterium
IAITLCEIGIAIEPRLRCDA

SEQ ID NO: 1318782 - protein, 20 aa, Mycobacterium
IALEFAQMYRRFGAAVTVIE

SEQ ID NO: 1318783 - protein, 25 aa, Mycobacterium
IALFVNRAYSCWATLPVPVIDRCVI

SEQ ID NO: 1318784 - protein, 19 aa, Mycobacterium
IALGLTGRVVLVTGGVRGV

SEQ ID NO: 1318785 - protein, 19 aa, Mycobacterium
IALLRRFIDRFGAGELQID

SEQ ID NO: 1318786 - protein, 17 aa, Mycobacterium
IALMHQVVNAQLAAKRQ

SEQ ID NO: 1318787 - protein, 17 aa, Mycobacterium
IALPGYAEYADSIRALH

SEQ ID NO: 1318788 - protein, 25 aa, Mycobacterium
IALQEDVALVGLSILSGAHVALTTR

SEQ ID NO: 1318789 - protein, 24 aa, Mycobacterium
IALQLLTCPLHTFALYTDRSVDPG

SEQ ID NO: 1318790 - protein, 24 aa, Mycobacterium
IALRRGETPPWAERFYVACPAVVA

SEQ ID NO: 1318791 - protein, 26 aa, Mycobacterium
IAMGHGGMLYSLPSRDLIADSIEYMV

SEQ ID NO: 1318792 - protein, 23 aa, Mycobacterium
IAMNFTMDGPWGFWVNRWTAEEN

SEQ ID NO: 1318793 - protein, 19 aa, Mycobacterium
IAMYLCRELTDLSLPKIGQ

SEQ ID NO: 1318794 - protein, 23 aa, Mycobacterium
IANPLGVVPVVRLLNSDRILDEG

SEQ ID NO: 1318795 - protein, 27 aa, Mycobacterium
IAPAAYHSLVLLWPDAEDWPAGGEVDF

SEQ ID NO: 1318796 - protein, 27 aa, Mycobacterium
IAPAPVYQPPPPGAPPPPPPGAPPPPP

SEQ ID NO: 1318797 - protein, 19 aa, Mycobacterium
IAPQRRPVKPNPQQGAYGT

SEQ ID NO: 1318798 - protein, 20 aa, Mycobacterium
IAQLFDVPPLPYEEVKIATA

SEQ ID NO: 1318799 - protein, 25 aa, Mycobacterium
IAQLGRYWRIDPGDTFLVPSPIAHI

SEQ ID NO: 1318800 - protein, 28 aa, Mycobacterium
IAQQRPDLGPLFLNAMPIQMAEAVDVSN

SEQ ID NO: 1318801 - protein, 29 aa, Mycobacterium
IARHRITNMLLVPAVIQFLLDTDGVAEVD

SEQ ID NO: 1318802 - protein, 17 aa, Mycobacterium
IARLAPGTPLRDGLERI

SEQ ID NO: 1318803 - protein, 23 aa, Mycobacterium
IARLRMLEALGWIVIRVIAEDRP

SEQ ID NO: 1318804 - protein, 24 aa, Mycobacterium
IARQRLLYALPEAKGALWNEHVKA

SEQ ID NO: 1318805 - protein, 24 aa, Mycobacterium
IARRTDPMLFRLTGGRVNMGPIVN

SEQ ID NO: 1318806 - protein, 17 aa, Mycobacterium
IARYARCERLLAAAPTV

SEQ ID NO: 1318807 - protein, 24 aa, Mycobacterium
IARYKLPKAVVFRPVIERSPAGKA

SEQ ID NO: 1318808 - protein, 17 aa, Mycobacterium
IASLIAYLCSEAAGYVT

SEQ ID NO: 1318809 - protein, 25 aa, Mycobacterium
IASSTRYEWILADLAIMCAGGATTT

SEQ ID NO: 1318810 - protein, 31 aa, Mycobacterium
IATANHRGCWLRVVLRFLPPGGAEPDSLRGD

SEQ ID NO: 1318811 - protein, 23 aa, Mycobacterium
IATDWDFIAVRRAGIALAREIER

SEQ ID NO: 1318812 - protein, 23 aa, Mycobacterium
IATDWDFIAVRRAGIALAREVER

SEQ ID NO: 1318813 - protein, 24 aa, Mycobacterium
IATEDLVYLLRDSGINCDVDLQGA

SEQ ID NO: 1318814 - protein, 17 aa, Mycobacterium
IATFDRFGATLKSALAE

SEQ ID NO: 1318815 - protein, 18 aa, Mycobacterium
IATFDRFGATLKSALAEA

SEQ ID NO: 1318816 - protein, 17 aa, Mycobacterium
IATIFVGGLKHLPIRYS

SEQ ID NO: 1318817 - protein, 29 aa, Mycobacterium
IATQLLPFFDGKMVETILRFEATVYAELG

SEQ ID NO: 1318818 - protein, 27 aa, Mycobacterium
IATQVGMPELPWPEPDRWLAAVGASPL

SEQ ID NO: 1318819 - protein, 36 aa, Mycobacterium
IATVYQNLAVVPLMPVWRNFFLGQELRKKSFPFSLD

SEQ ID NO: 1318820 - protein, 17 aa, Mycobacterium
IAVALRDRLPKVAELFL

SEQ ID NO: 1318821 - protein, 19 aa, Mycobacterium
IAVARRPHQPPFDNDYLEL

SEQ ID NO: 1318822 - protein, 18 aa, Mycobacterium
IAVATRAPGLNAKGACIG

SEQ ID NO: 1318823 - protein, 33 aa, Mycobacterium
IAVDELYLHVPGLPPIVVLPDRAPADAPIGWRR

SEQ ID NO: 1318824 - protein, 27 aa, Mycobacterium
IAVGTLYRYFPAKTHLLVAALTREFRR

SEQ ID NO: 1318825 - protein, 20 aa, Mycobacterium
IAVKLHILTRKSLGGLQTDL

SEQ ID NO: 1318826 - protein, 31 aa, Mycobacterium; identical to SEQ ID NO: 825224

SEQ ID NO: 1318827 - protein, 18 aa, Mycobacterium
IAVNPLPEAGLIRFKDPQ

SEQ ID NO: 1318828 - protein, 17 aa, Mycobacterium
IAVPCRELLLTAEVRDR

SEQ ID NO: 1318829 - protein, 31 aa, Mycobacterium
IAVSEQILKAIWALIGYDLPLPLPRISHADA

SEQ ID NO: 1318830 - protein, 17 aa, Mycobacterium
IAVVGRAPLVLDYQIND

SEQ ID NO: 1318831 - protein, 24 aa, Mycobacterium
IAWCGHCQLGPLLLCRDGPVVGYD

SEQ ID NO: 1318832 - protein, 17 aa, Mycobacterium
IAWTLVRHPVKSREFPA

SEQ ID NO: 1318833 - protein, 23 aa, Mycobacterium
ICAEAGLWEPAAARRALDQAHGD

SEQ ID NO: 1318834 - protein, 19 aa, Mycobacterium
ICEVLAWRGIWLSEERRRI

SEQ ID NO: 1318835 - protein, 32 aa, Mycobacterium
ICGKHSAIAALPWFWSDQYDLKLQIAGLNTGY

SEQ ID NO: 1318836 - protein, 18 aa, Mycobacterium
ICGTDLHILKGDVPEVQP

SEQ ID NO: 1318837 - protein, 17 aa, Mycobacterium
ICHCWRAPMIARMAAAE

SEQ ID NO: 1318838 - protein, 22 aa, Mycobacterium
ICKAVLVYRSLNGRSGYRFGHI

SEQ ID NO: 1318839 - protein, 19 aa, Mycobacterium
ICLPARLIPYTGGYRAVHP

SEQ ID NO: 1318840 - protein, 17 aa, Mycobacterium
ICRELLVFGCQTAGALA

SEQ ID NO: 1318841 - protein, 18 aa, Mycobacterium
IDAFLETSLVELALACAT

SEQ ID NO: 1318842 - protein, 17 aa, Mycobacterium
IDAGIALGGRYLLAAQR

SEQ ID NO: 1318843 - protein, 19 aa, Mycobacterium
IDAGPISAIRWGDDEPRVV

SEQ ID NO: 1318844 - protein, 29 aa, Mycobacterium
IDALCDPPESFQLYGIVAHVLTYSAHRRG

SEQ ID NO: 1318845 - protein, 25 aa, Mycobacterium
IDARKELLPLIGLIDQSAPVLDSQA

SEQ ID NO: 1318846 - protein, 27 aa, Mycobacterium
IDATDIRMLSAWWSQVLGWPAENTDDG

SEQ ID NO: 1318847 - protein, 17 aa, Mycobacterium
IDAWLAGLSGERAPRHP

SEQ ID NO: 1318848 - protein, 23 aa, Mycobacterium
IDCQGLARVDFFLTDAGPVINEI

SEQ ID NO: 1318849 - protein, 22 aa, Mycobacterium
IDDAHLLDPLSALLVQQAATSD

SEQ ID NO: 1318850 - protein, 19 aa, Mycobacterium
IDDEAVMKLYEALRPHRST

SEQ ID NO: 1318851 - protein, 28 aa, Mycobacterium
IDDENHMMFFLFIAAHLPPDVGARLAAG

SEQ ID NO: 1318852 - protein, 23 aa, Mycobacterium
IDDIPLPGPLPAVTVFSATPITP

SEQ ID NO: 1318853 - protein, 19 aa, Mycobacterium
IDDMAWMRQLLDWQREAAD

SEQ ID NO: 1318854 - protein, 23 aa, Mycobacterium
IDDPKPIRLDRISQHPASVGFPP

SEQ ID NO: 1318855 - protein, 17 aa, Mycobacterium
IDDRYCRTIADLVYRAV

SEQ ID NO: 1318856 - protein, 22 aa, Mycobacterium
IDDSFLLFFNAHHEPIEFTLPP

SEQ ID NO: 1318857 - protein, 26 aa, Mycobacterium
IDDTVREFLYPIAATRLRGLALPGPL

SEQ ID NO: 1318858 - protein, 24 aa, Mycobacterium
IDDVTSVFRYYARLIAVQSDRVVD

SEQ ID NO: 1318859 - protein, 17 aa, Mycobacterium
IDEALRLVWAVRGSDRE

SEQ ID NO: 1318860 - protein, 26 aa, Mycobacterium
IDEFDADFFGFTPYAARMLDPQHRLF

SEQ ID NO: 1318861 - protein, 24 aa, Mycobacterium
IDELAAETLYPQANSWYLGANIPG

SEQ ID NO: 1318862 - protein, 24 aa, Mycobacterium
IDELVNRLYDPLAARLRSELWLDR

SEQ ID NO: 1318863 - protein, 24 aa, Mycobacterium
IDERWDDFVVPGLGIRCVDDRPWV

SEQ ID NO: 1318864 - protein, 28 aa, Mycobacterium
IDFDDCGFGWYFYDFGTAVSFFEDHPSV

SEQ ID NO: 1318865 - protein, 26 aa, Mycobacterium
IDFIEACAWIKENLPGVHISGGISNV

SEQ ID NO: 1318866 - protein, 18 aa, Mycobacterium
IDFSHGLGEIPLLDMLVA

SEQ ID NO: 1318867 - protein, 23 aa, Mycobacterium
IDFTGIRVLDLYAGSGALGLEAL

SEQ ID NO: 1318868 - protein, 22 aa, Mycobacterium
IDGCDAIVALAPVLTEYAKGRS

SEQ ID NO: 1318869 - protein, 24 aa, Mycobacterium
IDGGTVRLPRLIGHSRAMDLILTG

SEQ ID NO: 1318870 - protein, 23 aa, Mycobacterium
IDGHPHTVQLTELPWSHTETTTL

SEQ ID NO: 1318871 - protein, 30 aa, Mycobacterium
IDGMLVIADLLHLVDFPLSLGIRPNIPYED

SEQ ID NO: 1318872 - protein, 28 aa, Mycobacterium
IDGRDYVLEYPIFGDVALIGAHVADQVG

SEQ ID NO: 1318873 - protein, 23 aa, Mycobacterium
IDGTPLPIRWGPHTPGAVAKAPF

SEQ ID NO: 1318874 - protein, 28 aa, Mycobacterium
IDGVRPDSKPWHPSGLAIDIMIPNPESP

SEQ ID NO: 1318875 - protein, 27 aa, Mycobacterium
IDHPVHRYFLAAKQTEFAVGGATGQLL

SEQ ID NO: 1318876 - protein, 19 aa, Mycobacterium
IDHTLDTWKRLCDPVAEQI

SEQ ID NO: 1318877 - protein, 20 aa, Mycobacterium
IDHVLPDFIVSRGIDLVVIG

SEQ ID NO: 1318878 - protein, 24 aa, Mycobacterium
IDIALPFERPLYQTPVAVAVESRI

SEQ ID NO: 1318879 - protein, 31 aa, Mycobacterium
IDKDEVAKLWPFADLTPFAAFGWEARGGYGD

SEQ ID NO: 1318880 - protein, 19 aa, Mycobacterium
IDKRLLPAAPAYQGIHAEL

SEQ ID NO: 1318881 - protein, 27 aa, Mycobacterium
IDLAAFDEWLGRWRALEPDPAVMDRVN

SEQ ID NO: 1318882 - protein, 24 aa, Mycobacterium
IDLDMPALAICRGMQILNVALGGT

SEQ ID NO: 1318883 - protein, 17 aa, Mycobacterium
IDLLASAESLLAATGNQ

SEQ ID NO: 1318884 - protein, 20 aa, Mycobacterium
IDLLLRHTSWVDAAGPGWWL

SEQ ID NO: 1318885 - protein, 23 aa, Mycobacterium
IDLTFANWRGVLAPPGISDDAKQ

SEQ ID NO: 1318886 - protein, 18 aa, Mycobacterium
IDMQRYNFQFTGQRFYRI

SEQ ID NO: 1318887 - protein, 17 aa, Mycobacterium
IDNARLLDHARATVRWT

SEQ ID NO: 1318888 - protein, 26 aa, Mycobacterium
IDNVVDMAHFFYIHGGLPTGFKNVFE

SEQ ID NO: 1318889 - protein, 25 aa, Mycobacterium
IDPDARDFMLSCGTALNHCVVALAA

SEQ ID NO: 1318890 - protein, 25 aa, Mycobacterium
IDPEIGPSWHLGVLPMDDGSVAISL

SEQ ID NO: 1318891 - protein, 17 aa, Mycobacterium
IDPGFANDLLPMALAGT

SEQ ID NO: 1318892 - protein, 22 aa, Mycobacterium
IDPIGRPIFYGRLTEMTDTDFR

SEQ ID NO: 1318893 - protein, 23 aa, Mycobacterium
IDPQLLVAVVKAAGAPVICETSD

SEQ ID NO: 1318894 - protein, 17 aa, Mycobacterium
IDPRAIVSPIIPAPLIQ

SEQ ID NO: 1318895 - protein, 22 aa, Mycobacterium
IDQLPALPPLPEDLRQRLDAAL

SEQ ID NO: 1318896 - protein, 20 aa, Mycobacterium
IDQLTIGWPAAGDGWVPVRL

SEQ ID NO: 1318897 - protein, 23 aa, Mycobacterium
IDRAHDQFRWFAGGWAVNSDLPT

SEQ ID NO: 1318898 - protein, 24 aa, Mycobacterium
IDRIQPVLVGVQLALTKLWQSYGV

SEQ ID NO: 1318899 - protein, 26 aa, Mycobacterium
IDRRRPVAQLRPLMTPVLVECVIARA

SEQ ID NO: 1318900 - protein, 28 aa, Mycobacterium
IDRTSFVPGVLLAVRKIRERPGLTIGIE

SEQ ID NO: 1318901 - protein, 37 aa, Mycobacterium
IDTATVLHKLSLRTPVRRFVLFSSITGLLGSRAVAHY

SEQ ID NO: 1318902 - protein, 32 aa, Mycobacterium
IDTLRRLRELGCEYVICYFPEAAYDRSGIELF

SEQ ID NO: 1318903 - protein, 26 aa, Mycobacterium
IDTRDWPLFRTVFTDDCELDYGEIGT

SEQ ID NO: 1318904 - protein, 17 aa, Mycobacterium
IDTVEGLAWIAQQAALE

SEQ ID NO: 1318905 - protein, 30 aa, Mycobacterium
IDVAEVYVPFSWYEPMWLESLGFAPEGGGW

SEQ ID NO: 1318906 - protein, 19 aa, Mycobacterium
IDVESWVCPAPLRDAPNIV

SEQ ID NO: 1318907 - protein, 17 aa, Mycobacterium
IDVVAPGDIIAVDRGSG

SEQ ID NO: 1318908 - protein, 17 aa, Mycobacterium
IDVVMQTPRRFSDAFRA

SEQ ID NO: 1318909 - protein, 20 aa, Mycobacterium
IDVYDYLQMDWYQLAKRGQA

SEQ ID NO: 1318910 - protein, 18 aa, Mycobacterium
IDWAGDIYCIVLHICHKV

SEQ ID NO: 1318911 - protein, 18 aa, Mycobacterium
IDWLLGNGGLDWATKRTA

SEQ ID NO: 1318912 - protein, 19 aa, Mycobacterium
IDWRARGRWVTGAEDRQRR

SEQ ID NO: 1318913 - protein, 17 aa, Mycobacterium
IDWRRTDPTPSFSAPGR

SEQ ID NO: 1318914 - protein, 18 aa, Mycobacterium
IEAAHPGRFLLGIGVGHP

SEQ ID NO: 1318915 - protein, 25 aa, Mycobacterium
IEAGFSEIFATLGPLRRGDGFVLFC

SEQ ID NO: 1318916 - protein, 24 aa, Mycobacterium
IEAKFGWPVFEISTVAREGLRQLT

SEQ ID NO: 1318917 - protein, 27 aa, Mycobacterium
IEALSRNFPGLPLRLDPNAAWTPHTAV

SEQ ID NO: 1318918 - protein, 18 aa, Mycobacterium
IEAQRWPFAQRRPRSGPA

SEQ ID NO: 1318919 - protein, 18 aa, Mycobacterium
IEAYRDRLPIEDSWTTIT

SEQ ID NO: 1318920 - protein, 17 aa, Mycobacterium
IEDDLPVIVVMPSPKNS

SEQ ID NO: 1318921 - protein, 22 aa, Mycobacterium
IEDGLADRIAVNRKLVAVGNVR

SEQ ID NO: 1318922 - protein, 25 aa, Mycobacterium
IEDIENWYISRFLSMRAGAFADPAS

SEQ ID NO: 1318923 - protein, 21 aa, Mycobacterium
IEDYLILGACNPPLAHRAIDV

SEQ ID NO: 1318924 - protein, 18 aa, Mycobacterium
IEEALELRLGLRGLTSYA

SEQ ID NO: 1318925 - protein, 17 aa, Mycobacterium
IEEFALDVMRRYVLSLP

SEQ ID NO: 1318926 - protein, 26 aa, Mycobacterium
IEEGVPVLLQAFKPLVLHVTHDLDVE

SEQ ID NO: 1318927 - protein, 19 aa, Mycobacterium
IEEIALGALPGLPRIAVHW

SEQ ID NO: 1318928 - protein, 26 aa, Mycobacterium
IEEMGGMNLFFVFGSGGTARLVTPEL

SEQ ID NO: 1318929 - protein, 26 aa, Mycobacterium
IEEYAPLMAYLVRTLQTGGELAKMLW

SEQ ID NO: 1318930 - protein, 29 aa, Mycobacterium
IEFTLRAGRYLPWHPGRCAEIVVGDVVVG

SEQ ID NO: 1318931 - protein, 17 aa, Mycobacterium
IEGFGFLDPPDARSIRD

SEQ ID NO: 1318932 - protein, 18 aa, Mycobacterium
IEGFLLEHRAVAQAAVIG

SEQ ID NO: 1318933 - protein, 19 aa, Mycobacterium
IEGLHIAFLRSPEGVVFEF

SEQ ID NO: 1318934 - protein, 18 aa, Mycobacterium
IEGRSPVNNIPFAARLTG

SEQ ID NO: 1318935 - protein, 35 aa, Mycobacterium
IEGRWATTMRFYAGPTLLVIDELGYLPLPGEAAAA

SEQ ID NO: 1318936 - protein, 18 aa, Mycobacterium
IEGSLGREILISGQPLIV

SEQ ID NO: 1318937 - protein, 18 aa, Mycobacterium
IEHELPAPGIFDGNAWNG

SEQ ID NO: 1318938 - protein, 17 aa, Mycobacterium
IEIVLDGGIRRGSDVVK

SEQ ID NO: 1318939 - protein, 25 aa, Mycobacterium
IEIVRYYADLLKTYPLTEDLGNIES

SEQ ID NO: 1318940 - protein, 28 aa, Mycobacterium
IEKRFSMPWSKPVGRMREFVLALRAIWM

SEQ ID NO: 1318941 - protein, 19 aa, Mycobacterium
IELPPPLDEPLRALAASNY

SEQ ID NO: 1318942 - protein, 28 aa, Mycobacterium
IELTDNILWLLKQAFYFSLTTVNEAISE

SEQ ID NO: 1318943 - protein, 19 aa, Mycobacterium
IELVRALDRGDRVAFEALV

SEQ ID NO: 1318944 - protein, 17 aa, Mycobacterium
IEMIREERWCWLEDGRV

SEQ ID NO: 1318945 - protein, 25 aa, Mycobacterium
IEMSDMLLGKKGIDPGVIALANEIK

SEQ ID NO: 1318946 - protein, 25 aa, Mycobacterium
IENPARLVEYVIMGQVLTAGAGQMP

SEQ ID NO: 1318947 - protein, 23 aa, Mycobacterium
IENWETAHLACAARRWTAAAEHW

SEQ ID NO: 1318948 - protein, 24 aa, Mycobacterium
IEPVRPVVEAFLTPAFEIPGVTAA

SEQ ID NO: 1318949 - protein, 18 aa, Mycobacterium
IEQLTRAALEVSGVGAPS

SEQ ID NO: 1318950 - protein, 17 aa, Mycobacterium
IERCEVSNLRPTHDGLG

SEQ ID NO: 1318951 - protein, 22 aa, Mycobacterium
IERHYRDCRILGIGGGTNEIMN

SEQ ID NO: 1318952 - protein, 18 aa, Mycobacterium
IERLKVAIQLLFESSRPD

SEQ ID NO: 1318953 - protein, 17 aa, Mycobacterium
IERLYSAMLGNETGTRA

SEQ ID NO: 1318954 - protein, 28 aa, Mycobacterium
IERNYREAIALSRLGWAALAVGTSHAVL

SEQ ID NO: 1318955 - protein, 22 aa, Mycobacterium
IERRPAARTLPLYGVPFGVKDS

SEQ ID NO: 1318956 - protein, 19 aa, Mycobacterium
IERSIIGFGARIGPRALIR

SEQ ID NO: 1318957 - protein, 18 aa, Mycobacterium
IESLLRVDLIILDELCFA

SEQ ID NO: 1318958 - protein, 21 aa, Mycobacterium
IESYAPLMAYLVRSMQSGSDL

SEQ ID NO: 1318959 - protein, 22 aa, Mycobacterium
IETFMLAFQPFEAEMQRFAAEI

SEQ ID NO: 1318960 - protein, 24 aa, Mycobacterium
IETLYSQFLATDSIALGVSRALQP

SEQ ID NO: 1318961 - protein, 20 aa, Mycobacterium
IETSLILRSIGYQGSAVEGL

SEQ ID NO: 1318962 - protein, 20 aa, Mycobacterium
IEVGRPLTASLRRVRQFAAA

SEQ ID NO: 1318963 - protein, 20 aa, Mycobacterium
IEVITDMWGRPRVRLSGAVA

SEQ ID NO: 1318964 - protein, 24 aa, Mycobacterium
IEVLGVRLVAVGMLPTLSAEQLTA

SEQ ID NO: 1318965 - protein, 17 aa, Mycobacterium
IEVMSFDGLVNAATERN

SEQ ID NO: 1318966 - protein, 19 aa, Mycobacterium
IEVVKPATFLFAAGQETVT

SEQ ID NO: 1318967 - protein, 19 aa, Mycobacterium
IEWPEISFGLAKAGLIAVP

SEQ ID NO: 1318968 - protein, 17 aa, Mycobacterium
IEWSAARYRRLMVLRDE

SEQ ID NO: 1318969 - protein, 34 aa, Mycobacterium
IEYLESDELLKFSLLPWPDYFGKAPKARADGMRH

SEQ ID NO: 1318970 - protein, 19 aa, Mycobacterium
IFDQTVSLVHLRLTIRDGQ

SEQ ID NO: 1318971 - protein, 29 aa, Mycobacterium
IFGGMKLDFLITVDWDYYKKFMSVNMDGA

SEQ ID NO: 1318972 - protein, 26 aa, Mycobacterium
IFGKDAMLKVFRRVTPGINPDIELNR

SEQ ID NO: 1318973 - protein, 30 aa, Mycobacterium
IFHRTRTPLSTWFAAIWLVTSQKNGAAKNL

SEQ ID NO: 1318974 - protein, 31 aa, Mycobacterium
IFHRTRTPLSTWFAAIWLVTSQKNGASAKNL

SEQ ID NO: 1318975 - protein, 18 aa, Mycobacterium
IFHYSDINFILVGAIIEK

SEQ ID NO: 1318976 - protein, 17 aa, Mycobacterium
IFSPTDIDMLLGGAQGL

SEQ ID NO: 1318977 - protein, 18 aa, Mycobacterium
IFSVLLREYEFEMAQPPE

SEQ ID NO: 1318978 - protein, 24 aa, Mycobacterium
IFVHIPMMFADLKDEYITEIDVNE

SEQ ID NO: 1318979 - protein, 23 aa, Mycobacterium
IGADVLLLNTSFAGPALADVVAR

SEQ ID NO: 1318980 - protein, 20 aa, Mycobacterium
IGADWFRPKAMRDLKIRVDE

SEQ ID NO: 1318981 - protein, 21 aa, Mycobacterium
IGAGLALALVLEQSGKRVQVG

SEQ ID NO: 1318982 - protein, 25 aa, Mycobacterium
IGAKSVFVMMSLFTKAGVPKVVPAC

SEQ ID NO: 1318983 - protein, 23 aa, Mycobacterium
IGALIAFLLSDVCGFVTGQTIYA

SEQ ID NO: 1318984 - protein, 25 aa, Mycobacterium
IGCSSRFPYYLETYGFHSIHGRAPT

SEQ ID NO: 1318985 - protein, 25 aa, Mycobacterium
IGCVFQDFRLLQQKTVFENVAFALE

SEQ ID NO: 1318986 - protein, 33 aa, Mycobacterium
IGDADFYTDLLFYHLRLRCFVVIELKIGDFDPS

SEQ ID NO: 1318987 - protein, 23 aa, Mycobacterium
IGDDPLVYYTDPMKLLTHLNEVH

SEQ ID NO: 1318988 - protein, 26 aa, Mycobacterium
IGDGTMCWLFVPRLRADGWVQIGGRE

SEQ ID NO: 1318989 - protein, 17 aa, Mycobacterium
IGDLFGGLFGRGAQQPR

SEQ ID NO: 1318990 - protein, 17 aa, Mycobacterium
IGDLRRPDPSDPPPALD

SEQ ID NO: 1318991 - protein, 38 aa, Mycobacterium
IGDPIQMFVRRISPLAKLLDWLAHTYNVLILVSAGNHP

SEQ ID NO: 1318992 - protein, 26 aa, Mycobacterium
IGDPTLTVGLALFPAAIKILIGEFAE

SEQ ID NO: 1318993 - protein, 18 aa, Mycobacterium
IGDRLAVPGQWDAPEGQW

SEQ ID NO: 1318994 - protein, 17 aa, Mycobacterium
IGDSPLMRAMCSEVVDV

SEQ ID NO: 1318995 - protein, 25 aa, Mycobacterium
IGEALRLWYELLSSSALPAADDGST

SEQ ID NO: 1318996 - protein, 29 aa, Mycobacterium
IGEIYEDLAWFCIRAWRFGAPETLGAGGL

SEQ ID NO: 1318997 - protein, 22 aa, Mycobacterium
IGEPVAWLIQRLQERHVLNNAQ

SEQ ID NO: 1318998 - protein, 30 aa, Mycobacterium
IGETELADWKWVLDINLWGPIHGCHVFAPI

SEQ ID NO: 1318999 - protein, 27 aa, Mycobacterium
IGFEGVEHMALLDKLGLTLSRRGTVPC

SEQ ID NO: 1319000 - protein, 24 aa, Mycobacterium
IGFPFGLSVLVPPNLPLPSKIVTQ

SEQ ID NO: 1319001 - protein, 25 aa, Mycobacterium
IGFPGWANYFPVTRAVPEPPSIRNI

SEQ ID NO: 1319002 - protein, 20 aa, Mycobacterium
IGFYGPLHEYFVARAVAAVR

SEQ ID NO: 1319003 - protein, 17 aa, Mycobacterium
IGGFRFSMFTLPPGAAA

SEQ ID NO: 1319004 - protein, 21 aa, Mycobacterium
IGGKTFPLPSPFLVMATQNPI

SEQ ID NO: 1319005 - protein, 23 aa, Mycobacterium
IGGLGALRLPRYGALTYPRAMRE

SEQ ID NO: 1319006 - protein, 17 aa, Mycobacterium
IGGLMRYGIPEYKLEKS

SEQ ID NO: 1319007 - protein, 17 aa, Mycobacterium
IGGSWRRAGDGGTREIV

SEQ ID NO: 1319008 - protein, 23 aa, Mycobacterium
IGGTTLAFWTQRGVYTVMDKSDQ

SEQ ID NO: 1319009 - protein, 21 aa, Mycobacterium
IGHALRAWPTPLGVAINSADP

SEQ ID NO: 1319010 - protein, 25 aa, Mycobacterium
IGHVNPRHRVDLPLTAREVVLTGLT

SEQ ID NO: 1319011 - protein, 18 aa, Mycobacterium
IGIPPPCLAQHRPFVTEP

SEQ ID NO: 1319012 - protein, 25 aa, Mycobacterium
IGKAAKFGGPALGLATTVFDMVMAE

SEQ ID NO: 1319013 - protein, 27 aa, Mycobacterium
IGKEIDLRFVFGYTPLEFRDTLHMLAD

SEQ ID NO: 1319014 - protein, 26 aa, Mycobacterium
IGKGDVVMLWLPSGIDYATCYAAAAM

SEQ ID NO: 1319015 - protein, 17 aa, Mycobacterium
IGKRNMMQFTAVPNALA

SEQ ID NO: 1319016 - protein, 25 aa, Mycobacterium
IGLASTDQLYFASGLLDCPGAMFTA

SEQ ID NO: 1319017 - protein, 19 aa, Mycobacterium
IGLDLIGIAEGAPLTMDLR

SEQ ID NO: 1319018 - protein, 20 aa, Mycobacterium
IGLGGLGHLAVKLAAAMGAE

SEQ ID NO: 1319019 - protein, 17 aa, Mycobacterium
IGLINWTPEGFIGNLFA

SEQ ID NO: 1319020 - protein, 22 aa, Mycobacterium
IGLPSRDLAYFTATSLLPETRA

SEQ ID NO: 1319021 - protein, 25 aa, Mycobacterium
IGLSFARFLAARGARRIVLLSRRGA

SEQ ID NO: 1319022 - protein, 17 aa, Mycobacterium
IGLVDRPFEQRRDLFTV

SEQ ID NO: 1319023 - protein, 30 aa, Mycobacterium
IGMDPKELGDFFFTILRSGVTPEVIGDPGG

SEQ ID NO: 1319024 - protein, 19 aa, Mycobacterium
IGMNQGLQFPLADSLARLD

SEQ ID NO: 1319025 - protein, 20 aa, Mycobacterium
IGMPRMFFEAARSGFRFNAV

SEQ ID NO: 1319026 - protein, 38 aa, Mycobacterium
IGMVFQHFNLFPHMTVIENITLAPLLTKKMDKAAAEKK

SEQ ID NO: 1319027 - protein, 30 aa, Mycobacterium
IGMVFQHFQLFPHRTVLDNVTLAPRKLKRL

SEQ ID NO: 1319028 - protein, 21 aa, Mycobacterium
IGNQRYTLTRFPFLTVDDNTV

SEQ ID NO: 1319029 - protein, 18 aa, Mycobacterium
IGNVTHGALRSAWIGYWV

SEQ ID NO: 1319030 - protein, 19 aa, Mycobacterium
IGNVTHGALRSAWIGYWVA

SEQ ID NO: 1319031 - protein, 27 aa, Mycobacterium
IGPPKQRAVLAVLLLAAGRVVSVDRLI

SEQ ID NO: 1319032 - protein, 24 aa, Mycobacterium
IGPQSYVLPEEPLLVAPSVSELRS

SEQ ID NO: 1319033 - protein, 24 aa, Mycobacterium
IGPSDHVAWLDDRKWAYVRLEGRA

SEQ ID NO: 1319034 - protein, 19 aa, Mycobacterium
IGPVVAFLASRRNSYMTGA

SEQ ID NO: 1319035 - protein, 20 aa, Mycobacterium
IGQALAVRVFTRFVFGFGLD

SEQ ID NO: 1319036 - protein, 28 aa, Mycobacterium
IGQIPAVEAPIATQLPLIQAQATSTAQN

SEQ ID NO: 1319037 - protein, 17 aa, Mycobacterium
IGQPIHLLYGVTGVEDL

SEQ ID NO: 1319038 - protein, 22 aa, Mycobacterium
IGQRHTCHLWNLVAADTREGDV

SEQ ID NO: 1319039 - protein, 17 aa, Mycobacterium
IGQVCANWFASTGGIRT

SEQ ID NO: 1319040 - protein, 25 aa, Mycobacterium
IGRAHTPWFHWGTTSMVARALDQFG

SEQ ID NO: 1319041 - protein, 17 aa, Mycobacterium
IGRALLADPAWVNRLRD

SEQ ID NO: 1319042 - protein, 26 aa, Mycobacterium
IGREIVDEPYPWPAMFGRIGEEYARR

SEQ ID NO: 1319043 - protein, 25 aa, Mycobacterium
IGRGCLGRPWLFAELSAAFNGTAPA

SEQ ID NO: 1319044 - protein, 26 aa, Mycobacterium
IGRHDGGLVSTYLFERARVGMVVGLD

SEQ ID NO: 1319045 - protein, 19 aa, Mycobacterium
IGRRLAPEPVLHAALGPGA

SEQ ID NO: 1319046 - protein, 17 aa, Mycobacterium
IGRTGERQGFWSGSLHA

SEQ ID NO: 1319047 - protein, 18 aa, Mycobacterium
IGRVRPGSDSLLRMRLDL

SEQ ID NO: 1319048 - protein, 19 aa, Mycobacterium
IGRVRPGSDSLLRMRLDLA

SEQ ID NO: 1319049 - protein, 31 aa, Mycobacterium
IGRYPQSRSALLPLLHLVQAEDGYLTPAGIA

SEQ ID NO: 1319050 - protein, 25 aa, Mycobacterium
IGSDRLRLEAYRRLAAAPDDAAVDA

SEQ ID NO: 1319051 - protein, 20 aa, Mycobacterium
IGSLLLGLYTDDGTLASVGV

SEQ ID NO: 1319052 - protein, 31 aa, Mycobacterium
IGSQGALFDTPILVPPQAAMLGTGAIVKRPR

SEQ ID NO: 1319053 - protein, 25 aa, Mycobacterium
IGSRAWDRLFSGPRPAELHPFIELD

SEQ ID NO: 1319054 - protein, 20 aa, Mycobacterium
IGSRWLAHYTATTTFLDTFA

SEQ ID NO: 1319055 - protein, 28 aa, Mycobacterium
IGTAVEEFIRWATPLLTFTRTAAVETEL

SEQ ID NO: 1319056 - protein, 17 aa, Mycobacterium
IGTFNISRLAAWHMSKN

SEQ ID NO: 1319057 - protein, 17 aa, Mycobacterium
IGTHRLLQTGVTWKDLG

SEQ ID NO: 1319058 - protein, 27 aa, Mycobacterium
IGVANYPSYFRFLKSKLRPGGLLLNHC

SEQ ID NO: 1319059 - protein, 25 aa, Mycobacterium
IGVDSIFGRLWTREGLSRRDRSLVT

SEQ ID NO: 1319060 - protein, 26 aa, Mycobacterium
IGVGEDGEWPLFLDAWVEHAVEDVAT

SEQ ID NO: 1319061 - protein, 18 aa, Mycobacterium
IGVGLHPFGRFDKTAMQM

SEQ ID NO: 1319062 - protein, 28 aa, Mycobacterium
IGVHSEALFPAWSLALRQVLDDTGIRPP

SEQ ID NO: 1319063 - protein, 19 aa, Mycobacterium
IGVIPTRYYVNMNVADRPG

SEQ ID NO: 1319064 - protein, 17 aa, Mycobacterium
IGVMRHFARSLAEKNIR

SEQ ID NO: 1319065 - protein, 19 aa, Mycobacterium
IGVTILRLANMIGPAMDTA

SEQ ID NO: 1319066 - protein, 18 aa, Mycobacterium
IGWDPRRAMLVRPPAGLT

SEQ ID NO: 1319067 - protein, 19 aa, Mycobacterium
IGWDPRRAMLVRPPAGLTA

SEQ ID NO: 1319068 - protein, 17 aa, Mycobacterium
IGYSPIIGGKPLRGMAD

SEQ ID NO: 1319069 - protein, 22 aa, Mycobacterium
IHAAVYCGFPKALNAIFVAKRV

SEQ ID NO: 1319070 - protein, 26 aa, Mycobacterium
IHADHLERFLGELTDLPLVVGIGARS

SEQ ID NO: 1319071 - protein, 25 aa, Mycobacterium
IHAGCVWINDHIPIISEMPHGGFGA

SEQ ID NO: 1319072 - protein, 21 aa, Mycobacterium
IHDIGAIIEWISAVMTLLPGD

SEQ ID NO: 1319073 - protein, 18 aa, Mycobacterium
IHESIRELRYYRQTAFVA

SEQ ID NO: 1319074 - protein, 17 aa, Mycobacterium
IHGEWIPINAQVANLQM

SEQ ID NO: 1319075 - protein, 18 aa, Mycobacterium
IHGTVFPNLSFLNVLIGR

SEQ ID NO: 1319076 - protein, 23 aa, Mycobacterium
IHGVEILIPGMPPLAVGYVQRDG

SEQ ID NO: 1319077 - protein, 24 aa, Mycobacterium
IHLKRAHLPLHKLPDKWAIQLNDT

SEQ ID NO: 1319078 - protein, 34 aa, Mycobacterium
IHLRVDGWPNQRFALLFLAWLAAHPEVRDEYLQV

SEQ ID NO: 1319079 - protein, 22 aa, Mycobacterium
IHQTREWILRNSPVPVGTVPMY

SEQ ID NO: 1319080 - protein, 31 aa, Mycobacterium
IHRDWNARYTWPRFVCGLPREFFAAVRAEMY

SEQ ID NO: 1319081 - protein, 17 aa, Mycobacterium
IHRLLAAADRAWAGVAG

SEQ ID NO: 1319082 - protein, 24 aa, Mycobacterium
IHSLPLYHCAQLDNFLITDVYLGA

SEQ ID NO: 1319083 - protein, 28 aa, Mycobacterium
IHYARKRGLPVLGLCLGLQCIVIEAARS

SEQ ID NO: 1319084 - protein, 19 aa, Mycobacterium
IIADPRGWIAQPVVQLSTV

SEQ ID NO: 1319085 - protein, 17 aa, Mycobacterium
IIAFCRANKLGLNSLLS

SEQ ID NO: 1319086 - protein, 27 aa, Mycobacterium
IIARDGLTFSGWLFRPPEGVETIGAML

SEQ ID NO: 1319087 - protein, 17 aa, Mycobacterium
IIARRLRKDIYDLYGYN

SEQ ID NO: 1319088 - protein, 17 aa, Mycobacterium
IIATAKIESGFRPAVSG

SEQ ID NO: 1319089 - protein, 17 aa, Mycobacterium
IIAVDYAQRRRLKIFGH

SEQ ID NO: 1319090 - protein, 24 aa, Mycobacterium
IIDAALDGVLFLDEAYALVSTGAK

SEQ ID NO: 1319091 - protein, 23 aa, Mycobacterium
IIDDQYPVVLIAGGTLAATVRRM

SEQ ID NO: 1319092 - protein, 24 aa, Mycobacterium
IIDSALDGVLFLDEAYALVSTGAK

SEQ ID NO: 1319093 - protein, 18 aa, Mycobacterium
IIENDLLDAIIALPTDMF

SEQ ID NO: 1319094 - protein, 18 aa, Mycobacterium
IIEPGFSADMVWLDRDPR

SEQ ID NO: 1319095 - protein, 20 aa, Mycobacterium
IIEWISAVMTLLPGDLILTG

SEQ ID NO: 1319096 - protein, 27 aa, Mycobacterium
IIGLEALTRTWPIRDDARILLCSSVTG

SEQ ID NO: 1319097 - protein, 26 aa, Mycobacterium
IIGPDRRYVMAISSLDPTGDAAAREN

SEQ ID NO: 1319098 - protein, 36 aa, Mycobacterium
IIGPNSLWRNEFAARLMFTFAFNRPGRKAAKLRMPV

SEQ ID NO: 1319099 - protein, 18 aa, Mycobacterium
IIKVTIRCDITISASQAA

SEQ ID NO: 1319100 - protein, 18 aa, Mycobacterium
IILLDLSKAELGAEASRL

SEQ ID NO: 1319101 - protein, 18 aa, Mycobacterium
IILTTFNATLAQGLKADL

SEQ ID NO: 1319102 - protein, 18 aa, Mycobacterium
IIQPIVQAMAFDLPAQDM

SEQ ID NO: 1319103 - protein, 19 aa, Mycobacterium
IISEPTDLVAVRTALQDAG

SEQ ID NO: 1319104 - protein, 18 aa, Mycobacterium
IITAFARVDGRPVGIIAN

SEQ ID NO: 1319105 - protein, 18 aa, Mycobacterium
IITAGFQSGLDVSGDWLD

SEQ ID NO: 1319106 - protein, 18 aa, Mycobacterium
IITMFYENSTRTRVSFEV

SEQ ID NO: 1319107 - protein, 19 aa, Mycobacterium
IIVGALPFDITKPAALIRP

SEQ ID NO: 1319108 - protein, 23 aa, Mycobacterium
IIVQRERERMAFRSAGYWDVTAE

SEQ ID NO: 1319109 - protein, 21 aa, Mycobacterium
IIVRRLLGLEDVLSIGFCGPT

SEQ ID NO: 1319110 - protein, 21 aa, Mycobacterium
IKAWPAVKQRFPTAVLALTGG

SEQ ID NO: 1319111 - protein, 28 aa, Mycobacterium
IKFYSETLGMPLKFRDGTHFAALDGGSI

SEQ ID NO: 1319112 - protein, 24 aa, Mycobacterium
IKGFAAPFTLRVIADLLGVPDEDR

SEQ ID NO: 1319113 - protein, 19 aa, Mycobacterium
IKNTWNGLTLALIIDHIDG

SEQ ID NO: 1319114 - protein, 24 aa, Mycobacterium
IKPGNNLPLRNIPAGTLVHAVELR

SEQ ID NO: 1319115 - protein, 26 aa, Mycobacterium
IKQMQGWLDQWGMPGPNAPGGDMGPH

SEQ ID NO: 1319116 - protein, 23 aa, Mycobacterium
IKRLTRVLPLMRDRLQRLCTGPD

SEQ ID NO: 1319117 - protein, 19 aa, Mycobacterium
IKRWEPFIHEITRAALDEH

SEQ ID NO: 1319118 - protein, 24 aa, Mycobacterium
IKSIGLRLGVPWYAYDTITFTGEV

SEQ ID NO: 1319119 - protein, 25 aa, Mycobacterium
IKSIGLRLGVPWYAYDTITFTGEVT

SEQ ID NO: 1319120 - protein, 23 aa, Mycobacterium
IKTELLSFRAGGHEAAFLFAITV

SEQ ID NO: 1319121 - protein, 30 aa, Mycobacterium
IKTVLSVHHGFIPKQLYFKKLTPQACEGAQ

SEQ ID NO: 1319122 - protein, 28 aa, Mycobacterium
ILAPQGLDYIVAFFGALQAGLIAAPLSV

SEQ ID NO: 1319123 - protein, 27 aa, Mycobacterium
ILAPQSLEYVIGFLGAIQAGFIAVPLS

SEQ ID NO: 1319124 - protein, 18 aa, Mycobacterium
ILCDLVLIRGALSTKALR

SEQ ID NO: 1319125 - protein, 19 aa, Mycobacterium
ILDEFSVPATFFVPGYTAH

SEQ ID NO: 1319126 - protein, 18 aa, Mycobacterium
ILDEWKTITGLDRKVDDA

SEQ ID NO: 1319127 - protein, 19 aa, Mycobacterium
ILDINVTGTWRTVRAVLPA

SEQ ID NO: 1319128 - protein, 17 aa, Mycobacterium
ILDLTEFLDRKPAKLSG

SEQ ID NO: 1319129 - protein, 21 aa, Mycobacterium
ILDRPVVLFTTTGAQSGKKRY

SEQ ID NO: 1319130 - protein, 25 aa, Mycobacterium
ILDVLDNYAFVRTSGYLAGPNDVYV

SEQ ID NO: 1319131 - protein, 17 aa, Mycobacterium
ILDVTVAVGADFRSART

SEQ ID NO: 1319132 - protein, 17 aa, Mycobacterium
ILERRFAASYAATGFTP

SEQ ID NO: 1319133 - protein, 29 aa, Mycobacterium
ILETMPPHPAHFLWLNWGPSPQRQDMAYS

SEQ ID NO: 1319134 - protein, 21 aa, Mycobacterium
ILEYRWGPDWLVWDAQPTSQQ

SEQ ID NO: 1319135 - protein, 27 aa, Mycobacterium
ILGDPKLTWHFPVRPIGPSQIVEQWVR

SEQ ID NO: 1319136 - protein, 18 aa, Mycobacterium
ILGLPYTLTLNDVTTYQI

SEQ ID NO: 1319137 - protein, 17 aa, Mycobacterium
ILHLLAAAREAELDYTL

SEQ ID NO: 1319138 - protein, 17 aa, Mycobacterium
ILHRGEATALCTLCVDP

SEQ ID NO: 1319139 - protein, 30 aa, Mycobacterium; identical to SEQ ID NO: 826671

SEQ ID NO: 1319140 - protein, 24 aa, Mycobacterium
ILKTKPPLCIDVEAADFYVDTLDR

SEQ ID NO: 1319141 - protein, 28 aa, Mycobacterium
ILLATTAINRFMLLPTTSWDNTTYSSLM

SEQ ID NO: 1319142 - protein, 27 aa, Mycobacterium
ILLSSRFPMWMAWGPELTFFCNDAYRR

SEQ ID NO: 1319143 - protein, 25 aa, Mycobacterium
ILMDSITVLLHRIGVAYTAIMNPVF

SEQ ID NO: 1319144 - protein, 20 aa, Mycobacterium
ILMPYLNHLTTDEQKARWLP

SEQ ID NO: 1319145 - protein, 23 aa, Mycobacterium
ILNDFPLFWDTGLLEHNIHFPRF

SEQ ID NO: 1319146 - protein, 43 aa, Mycobacterium
ILRADDLNFLWLPLAHAFGKVMLALPLLVGFPTAIDGRVDRIV

SEQ ID NO: 1319147 - protein, 17 aa, Mycobacterium
ILRAFAGQVDIAAADIG

SEQ ID NO: 1319148 - protein, 18 aa, Mycobacterium
ILRALRINLSVRGYEVHT

SEQ ID NO: 1319149 - protein, 19 aa, Mycobacterium
ILRDVISARLAFVVSGGTG

SEQ ID NO: 1319150 - protein, 19 aa, Mycobacterium
ILRLDRRGTLRFAALESGF

SEQ ID NO: 1319151 - protein, 19 aa, Mycobacterium
ILRLLLGHPAYTDGRLTIG

SEQ ID NO: 1319152 - protein, 18 aa, Mycobacterium
ILRTEAFKHLLNIRVIDR

SEQ ID NO: 1319153 - protein, 31 aa, Mycobacterium
ILRTEKSVLFVIPWGTHWIIGTTDTDWHLDL

SEQ ID NO: 1319154 - protein, 20 aa, Mycobacterium
ILRTNLAAVILQMAALGFGD

SEQ ID NO: 1319155 - protein, 29 aa, Mycobacterium
ILSEMFQVPIWDLITGYTFPELNNPVSDA

SEQ ID NO: 1319156 - protein, 17 aa, Mycobacterium
ILSLKRLGGLARRHTIV

SEQ ID NO: 1319157 - protein, 25 aa, Mycobacterium
ILSRKKNIRILLAAQPPTTGTELRP

SEQ ID NO: 1319158 - protein, 22 aa, Mycobacterium
ILTCRLIDRPLRPSFVSGLRNE

SEQ ID NO: 1319159 - protein, 18 aa, Mycobacterium
ILTKLNLPETGDDHRRVR

SEQ ID NO: 1319160 - protein, 23 aa, Mycobacterium
ILTSGYGYRWGALHSGVDIANAI

SEQ ID NO: 1319161 - protein, 18 aa, Mycobacterium
ILVAPVTDVGWTPYFTVI

SEQ ID NO: 1319162 - protein, 31 aa, Mycobacterium
ILVKPTVAQAQWWFARLAPGLMNRMAMRFVT

SEQ ID NO: 1319163 - protein, 17 aa, Mycobacterium
ILVPVPTPGFTAEPAYN

SEQ ID NO: 1319164 - protein, 19 aa, Mycobacterium
ILVRGVLDRLAEHGYDVVQ

SEQ ID NO: 1319165 - protein, 22 aa, Mycobacterium
ILYLRAEYAYLARYLQRQLQEL

SEQ ID NO: 1319166 - protein, 18 aa, Mycobacterium
IMDTLAAGGAYFFRQLAD

SEQ ID NO: 1319167 - protein, 19 aa, Mycobacterium
IMDYLVHQRRLLPLIARSY

SEQ ID NO: 1319168 - protein, 25 aa, Mycobacterium
IMETPPSPFTLIPGVGESGSAAATA

SEQ ID NO: 1319169 - protein, 38 aa, Mycobacterium; identical to SEQ ID NO: 826809

SEQ ID NO: 1319170 - protein, 39 aa, Mycobacterium
IMTPPSHILGLLNIVMALETGTWLRLHPRFDIDTMLHHV

SEQ ID NO: 1319171 - protein, 20 aa, Mycobacterium
INAKMPKWLHSHPYNDMLGD

SEQ ID NO: 1319172 - protein, 22 aa, Mycobacterium
INDFVRLLQRSADWHVVPKPES

SEQ ID NO: 1319173 - protein, 22 aa, Mycobacterium
INEAFASVVLRFMKDLGLPHDI

SEQ ID NO: 1319174 - protein, 24 aa, Mycobacterium
INEAFASVVLSWARVHEADMDTVN

SEQ ID NO: 1319175 - protein, 18 aa, Mycobacterium
INEALRMMTPLPFNFRQA

SEQ ID NO: 1319176 - protein, 19 aa, Mycobacterium
INGAKTWITNARRSQLIAL

SEQ ID NO: 1319177 - protein, 24 aa, Mycobacterium
INGDERWCLWFVDAHLDELESSTL

SEQ ID NO: 1319178 - protein, 26 aa, Mycobacterium
INHDIGFIGVPFFHIAGVGSSVSGLL

SEQ ID NO: 1319179 - protein, 25 aa, Mycobacterium
INLDSRLRVVARRDFAGMISVAIEN

SEQ ID NO: 1319180 - protein, 19 aa, Mycobacterium
INLGASLAEYGRRVLLVDL

SEQ ID NO: 1319181 - protein, 18 aa, Mycobacterium
INLRQRIRARLGAAAEAF

SEQ ID NO: 1319182 - protein, 17 aa, Mycobacterium
INMPVLDGVSVVTALRA

SEQ ID NO: 1319183 - protein, 28 aa, Mycobacterium
INNAGVEQFGYLWDTPVANWNRVMDINV

SEQ ID NO: 1319184 - protein, 17 aa, Mycobacterium
INPPPYDEYRQVIVDAG

SEQ ID NO: 1319185 - protein, 17 aa, Mycobacterium
INRIRLERMLGPEGGYH

SEQ ID NO: 1319186 - protein, 17 aa, Mycobacterium
INRLLSEALAALADAQA

SEQ ID NO: 1319187 - protein, 22 aa, Mycobacterium
INRRLRRALEHRDRTCAVPGCA

SEQ ID NO: 1319188 - protein, 18 aa, Mycobacterium
INTFLWGGITQHGDMVGN

SEQ ID NO: 1319189 - protein, 25 aa, Mycobacterium
INVLAQDNLLPAITFIFSRAGCDAA

SEQ ID NO: 1319190 - protein, 20 aa, Mycobacterium
INVTSFFRDPPAWDYVRDEV

SEQ ID NO: 1319191 - protein, 24 aa, Mycobacterium
INVVGTSMVWLVTPRHADGWLREP

SEQ ID NO: 1319192 - protein, 32 aa, Mycobacterium
INYRPVKYHRLHLAAWRGVPADALALIEPATK

SEQ ID NO: 1319193 - protein, 23 aa, Mycobacterium
IPAASMLPFRYTVNGYRGCSHAC

SEQ ID NO: 1319194 - protein, 22 aa, Mycobacterium
IPADGIMLLAAHISRHGTLTEW

SEQ ID NO: 1319195 - protein, 26 aa, Mycobacterium
IPADGRPSVMFGCRPRVQPPSQRYVS

SEQ ID NO: 1319196 - protein, 18 aa, Mycobacterium
IPAGVFNVVVSNANEVGA

SEQ ID NO: 1319197 - protein, 20 aa, Mycobacterium
IPAGVPFRWSWELADRALTE

SEQ ID NO: 1319198 - protein, 27 aa, Mycobacterium
IPAVNKLGTMGLILRGSDELKKKVLPS

SEQ ID NO: 1319199 - protein, 20 aa, Mycobacterium
IPAWREHMLFRGETLAFLGR

SEQ ID NO: 1319200 - protein, 17 aa, Mycobacterium
IPDDAYGGTFRLIDKVF

SEQ ID NO: 1319201 - protein, 17 aa, Mycobacterium
IPDFVKLSEALGCVGLR

SEQ ID NO: 1319202 - protein, 24 aa, Mycobacterium
IPDRGLFTVFLASSADSEKPSRVG

SEQ ID NO: 1319203 - protein, 17 aa, Mycobacterium
IPDVRRYGATYANYVGK

SEQ ID NO: 1319204 - protein, 25 aa, Mycobacterium
IPEGRRVMFLYGSGNRDERQYGDDA

SEQ ID NO: 1319205 - protein, 25 aa, Mycobacterium
IPEPTDLPPGPFSPNDPRIAAVDWV

SEQ ID NO: 1319206 - protein, 25 aa, Mycobacterium
IPEQIVDRIFTPFFTTKPVGEGTGL

SEQ ID NO: 1319207 - protein, 19 aa, Mycobacterium
IPEVHPDLTALAPLLELSP

SEQ ID NO: 1319208 - protein, 17 aa, Mycobacterium
IPEWIVVGAGTGGTSAT

SEQ ID NO: 1319209 - protein, 20 aa, Mycobacterium
IPGFVEEALRFESPIRGDFR

SEQ ID NO: 1319210 - protein, 18 aa, Mycobacterium
IPGNLINALLSIPAWEIQ

SEQ ID NO: 1319211 - protein, 20 aa, Mycobacterium
IPGPQRAALLTAFGQRRSPT

SEQ ID NO: 1319212 - protein, 17 aa, Mycobacterium
IPGRMHHPMWLENCDVD

SEQ ID NO: 1319213 - protein, 21 aa, Mycobacterium
IPHERWVERPLACVVVKQGES

SEQ ID NO: 1319214 - protein, 21 aa, Mycobacterium
IPHGWGHKGGWQLANRSGGAN

SEQ ID NO: 1319215 - protein, 18 aa, Mycobacterium
IPHPPRYTWDGRQWVFNY

SEQ ID NO: 1319216 - protein, 26 aa, Mycobacterium
IPHQNLYGFAWNPMTLVGILQSIKGA

SEQ ID NO: 1319217 - protein, 32 aa, Mycobacterium
IPIDERAKWATFPMLALHGWAQHHDVPLRAVV

SEQ ID NO: 1319218 - protein, 18 aa, Mycobacterium
IPIRIGVNAGSLDKRFLQ

SEQ ID NO: 1319219 - protein, 17 aa, Mycobacterium
IPIVTAGVRPRMCEAAG

SEQ ID NO: 1319220 - protein, 20 aa, Mycobacterium
IPLLALLRRRLTDDEVKAVV

SEQ ID NO: 1319221 - protein, 17 aa, Mycobacterium
IPLPFTITEFEPGRRWS

SEQ ID NO: 1319222 - protein, 18 aa, Mycobacterium
IPMEVAFGGPKKIADRMG

SEQ ID NO: 1319223 - protein, 19 aa, Mycobacterium
IPMGFGYPIDHPDLPAITE

SEQ ID NO: 1319224 - protein, 17 aa, Mycobacterium
IPNPTFDPIIEPGCLDL

SEQ ID NO: 1319225 - protein, 20 aa, Mycobacterium
IPPFYVMDVWLAAAERRRTH

SEQ ID NO: 1319226 - protein, 21 aa, Mycobacterium
IPPLIRRPQSVSVALAAHFER

SEQ ID NO: 1319227 - protein, 18 aa, Mycobacterium
IPPTRFKRKPHWLEAHFT

SEQ ID NO: 1319228 - protein, 17 aa, Mycobacterium
IPQLLRDTRLLLATEWD

SEQ ID NO: 1319229 - protein, 30 aa, Mycobacterium
IPRYDVLRLDRRPHPILLGAGRRARLTALP

SEQ ID NO: 1319230 - protein, 18 aa, Mycobacterium
IPSAPPPAPASPSPALSA

SEQ ID NO: 1319231 - protein, 24 aa, Mycobacterium
IPSDMTVFALYRAAERDRTGELGD

SEQ ID NO: 1319232 - protein, 27 aa, Mycobacterium
IPSEDVWAPTFDWPPYDNNLGDNRGFS

SEQ ID NO: 1319233 - protein, 26 aa, Mycobacterium
IPSIVEMLVAVMWGMGFYAGYVGGQQ

SEQ ID NO: 1319234 - protein, 24 aa, Mycobacterium
IPTVATVPWTTDRLLNVLTRETET

SEQ ID NO: 1319235 - protein, 18 aa, Mycobacterium
IPVAMEELLRLDPPAPFI

SEQ ID NO: 1319236 - protein, 17 aa, Mycobacterium
IPVFDHRGLIGVSDMGC

SEQ ID NO: 1319237 - protein, 22 aa, Mycobacterium
IPVIADIHFQPKYIFAAIDAGC

SEQ ID NO: 1319238 - protein, 17 aa, Mycobacterium
IPVPGLRTPYTLVIVEL

SEQ ID NO: 1319239 - protein, 17 aa, Mycobacterium
IPVRTWAEWDDAVPGFV

SEQ ID NO: 1319240 - protein, 23 aa, Mycobacterium
IPWHLPEDLARFKEITLGHPVVM

SEQ ID NO: 1319241 - protein, 19 aa, Mycobacterium
IQADIYDEFLALAAIRTKA

SEQ ID NO: 1319242 - protein, 22 aa, Mycobacterium
IQAQDFFFRKIVRDKGVALAHV

SEQ ID NO: 1319243 - protein, 21 aa, Mycobacterium
IQAYCDLLEVRWLLSEQTGRD

SEQ ID NO: 1319244 - protein, 19 aa, Mycobacterium
IQDVQWSRPGADPVWFEIH

SEQ ID NO: 1319245 - protein, 19 aa, Mycobacterium
IQELLLRHRARTVIIVCPA

SEQ ID NO: 1319246 - protein, 18 aa, Mycobacterium
IQELTDYKISFSTSTDLT

SEQ ID NO: 1319247 - protein, 17 aa, Mycobacterium
IQELTLPLALAGDDLIG

SEQ ID NO: 1319248 - protein, 19 aa, Mycobacterium
IQEVFLIDNLRMALNYGVN

SEQ ID NO: 1319249 - protein, 25 aa, Mycobacterium
IQHGSPPLALLTRAIEELAAGTGLR

SEQ ID NO: 1319250 - protein, 24 aa, Mycobacterium
IQKAIRMLRYPTLEDDYVQAWGEW

SEQ ID NO: 1319251 - protein, 27 aa, Mycobacterium
IQLPEAPYLHLFVPRGEVSLEGAGPLR

SEQ ID NO: 1319252 - protein, 22 aa, Mycobacterium
IQLRNTATLLGWVLGQAGVDPL

SEQ ID NO: 1319253 - protein, 24 aa, Mycobacterium
IQQSFLHFSPQYVGNPPGLPDVVM

SEQ ID NO: 1319254 - protein, 24 aa, Mycobacterium
IQRERLMDVFGDNAFRVVVAIFIA

SEQ ID NO: 1319255 - protein, 24 aa, Mycobacterium
IQRGWGSWGFAPYTDLMAATDAAC

SEQ ID NO: 1319256 - protein, 28 aa, Mycobacterium
IQRRGGPYTVYVWAGLAMAAARIGLGPM

SEQ ID NO: 1319257 - protein, 27 aa, Mycobacterium
IQSAETALALLLPRSPYATLTSVPGWA

SEQ ID NO: 1319258 - protein, 25 aa, Mycobacterium
IQSNLLAHHLGVLKTAGLVRQTRSE

SEQ ID NO: 1319259 - protein, 32 aa, Mycobacterium
IQTAILYDHFTPYTLIQLEELGFCGKGEAKDF

SEQ ID NO: 1319260 - protein, 17 aa, Mycobacterium
IQTRPDGTLQHPPVPAV

SEQ ID NO: 1319261 - protein, 19 aa, Mycobacterium
IQVGFMRRFDDEYMRLKAL

SEQ ID NO: 1319262 - protein, 25 aa, Mycobacterium
IQVMRDMLAAPDQFNWLATRLEIAR

SEQ ID NO: 1319263 - protein, 21 aa, Mycobacterium
IRADFPILKRVMRGGNTLAYL

SEQ ID NO: 1319264 - protein, 30 aa, Mycobacterium
IRAGAAIKTLWLPGPDPEPHYRPSTKLAAF

SEQ ID NO: 1319265 - protein, 23 aa, Mycobacterium
IRALAAPSLWWVAQLLLAAQRRR

SEQ ID NO: 1319266 - protein, 24 aa, Mycobacterium
IRALTVQFVQGFTPLPEGPSNGDP

SEQ ID NO: 1319267 - protein, 23 aa, Mycobacterium
IRARHLPPRHFKLSYLVAAWTQR

SEQ ID NO: 1319268 - protein, 18 aa, Mycobacterium
IRARNLLGPEQYGAISAP

SEQ ID NO: 1319269 - protein, 25 aa, Mycobacterium
IRASRLVAEWPVRPGVPDPDPLALV

SEQ ID NO: 1319270 - protein, 22 aa, Mycobacterium
IRDGAALAAALRDRLDPDRPAH

SEQ ID NO: 1319271 - protein, 18 aa, Mycobacterium
IREGAVAAWPGAWQGQNL

SEQ ID NO: 1319272 - protein, 30 aa, Mycobacterium
IRGIAGYRDSWPEFFEFIRSGAVLQLLELD

SEQ ID NO: 1319273 - protein, 19 aa, Mycobacterium
IRGLRLRNIGRWTNDYYDD

SEQ ID NO: 1319274 - protein, 30 aa, Mycobacterium
IRGMHLAYDLLEPWDLLVLVDALPDRGSPG

SEQ ID NO: 1319275 - protein, 22 aa, Mycobacterium
IRGYRDVYGISYLIVQMRHAEA

SEQ ID NO: 1319276 - protein, 20 aa, Mycobacterium
IRIDLGALRILGDGLAWAPG

SEQ ID NO: 1319277 - protein, 17 aa, Mycobacterium
IRIPVHMVEVINKLGRI

SEQ ID NO: 1319278 - protein, 20 aa, Mycobacterium
IRKIRAAFGVLDQFREHDLT

SEQ ID NO: 1319279 - protein, 26 aa, Mycobacterium
IRLELEQTFMFYLPRICEHCLNPSCV

SEQ ID NO: 1319280 - protein, 26 aa, Mycobacterium
IRLEMETHYFGTLQVLRAFAPIIERN

SEQ ID NO: 1319281 - protein, 17 aa, Mycobacterium
IRLFPEQIAYVVNHARD

SEQ ID NO: 1319282 - protein, 23 aa, Mycobacterium
IRLGDYCLGLYGSRDYLAEHGTP

SEQ ID NO: 1319283 - protein, 17 aa, Mycobacterium
IRLGLFAGHYRDDRFWS

SEQ ID NO: 1319284 - protein, 18 aa, Mycobacterium
IRLRLFHGRGGTVGRGGG

SEQ ID NO: 1319285 - protein, 18 aa, Mycobacterium
IRLRVPVPSIAASLFARF

SEQ ID NO: 1319286 - protein, 18 aa, Mycobacterium
IRLYKRMFKPGVDDLVFI

SEQ ID NO: 1319287 - protein, 18 aa, Mycobacterium
IRMEHAYFQALSASFAPL

SEQ ID NO: 1319288 - protein, 31 aa, Mycobacterium
IRMSPEVITKPRWFFSFAKHLRPPDLRVPNQ

SEQ ID NO: 1319289 - protein, 23 aa, Mycobacterium
IRPNVVRTPLLAARWGDRERPLW

SEQ ID NO: 1319290 - protein, 29 aa, Mycobacterium
IRQKVLAADILLISTPVWLGHPSSVTQRV

SEQ ID NO: 1319291 - protein, 29 aa, Mycobacterium
IRRDIGFVFQRFHLIPRLTVVHNVVHGAM

SEQ ID NO: 1319292 - protein, 24 aa, Mycobacterium
IRRDLKVLAGRRLLKRVHGGAVPL

SEQ ID NO: 1319293 - protein, 26 aa, Mycobacterium
IRRFDGLIDRFTLYTPYPLDEATRAE

SEQ ID NO: 1319294 - protein, 18 aa, Mycobacterium
IRRLWPDFRTAERAYFDV

SEQ ID NO: 1319295 - protein, 24 aa, Mycobacterium
IRRVARLVHALPPAPTGSGTLDAD

SEQ ID NO: 1319296 - protein, 24 aa, Mycobacterium
IRTGRQLWCQLFSEPGAGSDLASL

SEQ ID NO: 1319297 - protein, 30 aa, Mycobacterium
IRTNPIVLVDFWASWCGPCRSFAPVFDRSS

SEQ ID NO: 1319298 - protein, 32 aa, Mycobacterium
IRTRPRPRRTQRIQLRVLQFLSLAHRGDRRAE

SEQ ID NO: 1319299 - protein, 20 aa, Mycobacterium
IRTWLVELPADRLAEFLIGG

SEQ ID NO: 1319300 - protein, 19 aa, Mycobacterium
IRVARGLGFRVRVAATVAA

SEQ ID NO: 1319301 - protein, 25 aa, Mycobacterium
IRVAVDLRRTTPGLPVVILSQYTTV

SEQ ID NO: 1319302 - protein, 24 aa, Mycobacterium
IRVDGGLLAHQPFVPDMDSLGAAT

SEQ ID NO: 1319303 - protein, 17 aa, Mycobacterium
IRVGLPPVEQLEFFGDH

SEQ ID NO: 1319304 - protein, 19 aa, Mycobacterium
IRVIEVGTLISGPFAGRLL

SEQ ID NO: 1319305 - protein, 36 aa, Mycobacterium
IRVTRDQRWRPMNLLNLFFNTLLSVAFEWGVGLQHL

SEQ ID NO: 1319306 - protein, 19 aa, Mycobacterium
IRWLALHGVIRGLSKVAVR

SEQ ID NO: 1319307 - protein, 20 aa, Mycobacterium
ISAHLLAAARRREYRRWLDA

SEQ ID NO: 1319308 - protein, 21 aa, Mycobacterium
ISAQIFPRPIGLMLGLELSGN

SEQ ID NO: 1319309 - protein, 23 aa, Mycobacterium
ISARAAFAAVTRGAWRAGGTRDG

SEQ ID NO: 1319310 - protein, 19 aa, Mycobacterium
ISCWDAPLRSVGVLLPAEH

SEQ ID NO: 1319311 - protein, 18 aa, Mycobacterium
ISDELLLEGLDVLELILR

SEQ ID NO: 1319312 - protein, 25 aa, Mycobacterium
ISDLANFMRTLPPIARPHLANNWHA

SEQ ID NO: 1319313 - protein, 24 aa, Mycobacterium
ISEISNVLLMRGMIGKPGAGLCPV

SEQ ID NO: 1319314 - protein, 19 aa, Mycobacterium
ISFLNFYSWGNVTVEGMSV

SEQ ID NO: 1319315 - protein, 25 aa, Mycobacterium
ISGFRNKLLASGYRVSPRKVLLAVS

SEQ ID NO: 1319316 - protein, 21 aa, Mycobacterium
ISGLRPPVLDDLGLSGGLASL

SEQ ID NO: 1319317 - protein, 26 aa, Mycobacterium
ISKNVPLGRLAKPEDIGWATAFLASD

SEQ ID NO: 1319318 - protein, 33 aa, Mycobacterium
ISKQLVPVYDKPLVYYPLSTLMMAGIRDILVIT

SEQ ID NO: 1319319 - protein, 28 aa, Mycobacterium
ISLFDSIFPSILLDKPQGLILLCQQKPV

SEQ ID NO: 1319320 - protein, 18 aa, Mycobacterium
ISLRGGGLVAPAIHDVPG

SEQ ID NO: 1319321 - protein, 23 aa, Mycobacterium
ISLRQLRRALRRAAPESPGGFSD

SEQ ID NO: 1319322 - protein, 24 aa, Mycobacterium
ISLRSQVPLLLDEYSRNSATGSFI

SEQ ID NO: 1319323 - protein, 25 aa, Mycobacterium
ISLTRTEFAILRVLSDDPGEPVTCR

SEQ ID NO: 1319324 - protein, 30 aa, Mycobacterium
ISNGIAPPPPPPPPGAPPGLPPPPVGQTVI

SEQ ID NO: 1319325 - protein, 23 aa, Mycobacterium
ISNTLMPYFQLMHEMTIDHIHED

SEQ ID NO: 1319326 - protein, 18 aa, Mycobacterium
ISRAAVMIYTYGNAIASG

SEQ ID NO: 1319327 - protein, 21 aa, Mycobacterium
ISRPSIHRKCFGSRANGAGKP

SEQ ID NO: 1319328 - protein, 41 aa, Mycobacterium
ISSPGWAKHAWSCFFAPWLAEATIFVYNYGRFDAAALLQQM

SEQ ID NO: 1319329 - protein, 17 aa, Mycobacterium
ISSPLRRGLFNEDLEEF

SEQ ID NO: 1319330 - protein, 27 aa, Mycobacterium
ISSQIMGLAMMRYVWRIEPVASMDDDE

SEQ ID NO: 1319331 - protein, 31 aa, Mycobacterium
ISTDLLYKLLRSEWLEPRWMIGIDPESEGLA

SEQ ID NO: 1319332 - protein, 26 aa, Mycobacterium
ISTELPLERWFRDLRVKRLGEGATEV

SEQ ID NO: 1319333 - protein, 25 aa, Mycobacterium
ISTKAGWDMWPGPYGQLGGRAYLLA

SEQ ID NO: 1319334 - protein, 25 aa, Mycobacterium
ISTPDHIDLPFGGRVPLPHIDSDIP

SEQ ID NO: 1319335 - protein, 18 aa, Mycobacterium
ISVKLIQPVAMDEGLRFA

SEQ ID NO: 1319336 - protein, 21 aa, Mycobacterium
ISVLIDLGRVNHVNAEGSNFV

SEQ ID NO: 1319337 - protein, 18 aa, Mycobacterium
ISVVFFDVTSTRVLLDKV

SEQ ID NO: 1319338 - protein, 19 aa, Mycobacterium
ISWTVVHYRPPEAMTLNGH

SEQ ID NO: 1319339 - protein, 25 aa, Mycobacterium
ISYPVGHLTTMAWIGVRPGDIHLAI

SEQ ID NO: 1319340 - protein, 21 aa, Mycobacterium
ITAEIIQLISESWAAGLQPTP

SEQ ID NO: 1319341 - protein, 21 aa, Mycobacterium
ITAIDTHWIWQDGQAITTNPY

SEQ ID NO: 1319342 - protein, 19 aa, Mycobacterium
ITAPRGWELVRHAGPLPSH

SEQ ID NO: 1319343 - protein, 19 aa, Mycobacterium
ITAPVFYVRYPESEITKFV

SEQ ID NO: 1319344 - protein, 18 aa, Mycobacterium
ITDATSCADPLAAIQSRL

SEQ ID NO: 1319345 - protein, 25 aa, Mycobacterium
ITDIRSFHRYVVAGHLPIPKVPFAP

SEQ ID NO: 1319346 - protein, 23 aa, Mycobacterium
ITDITPYWRPPAWAAGVVVVDAL

SEQ ID NO: 1319347 - protein, 22 aa, Mycobacterium
ITDLAAPLPMTFAGVSRHIGVL

SEQ ID NO: 1319348 - protein, 28 aa, Mycobacterium
ITDRQTLSLLHRILARVLPEDAKDEDGD

SEQ ID NO: 1319349 - protein, 21 aa, Mycobacterium
ITFTTFIPTMLHRTLAILEDG

SEQ ID NO: 1319350 - protein, 25 aa, Mycobacterium
ITGALNYFSFDNPAGAWPLIEDAFT

SEQ ID NO: 1319351 - protein, 28 aa, Mycobacterium
ITGDYLAELTMLILWKARQKDPETGYAR

SEQ ID NO: 1319352 - protein, 22 aa, Mycobacterium
ITGETLFNEVFFDDVFVPDRDV

SEQ ID NO: 1319353 - protein, 19 aa, Mycobacterium
ITGICDPHIQPRIDAALHG

SEQ ID NO: 1319354 - protein, 22 aa, Mycobacterium
ITGIITMPWMFYSGPDASLPDK

SEQ ID NO: 1319355 - protein, 24 aa, Mycobacterium
ITGRAQIVAFLTAKWQRELDYALR

SEQ ID NO: 1319356 - protein, 22 aa, Mycobacterium
ITGTPWAYQQLGVRPDVVAFGK

SEQ ID NO: 1319357 - protein, 21 aa, Mycobacterium
ITGYGFELIGLGAAIENMWLA

SEQ ID NO: 1319358 - protein, 18 aa, Mycobacterium
ITHLCEFEPYARLVDGSP

SEQ ID NO: 1319359 - protein, 19 aa, Mycobacterium
ITIPTLLIQGTVDTLFTLD

SEQ ID NO: 1319360 - protein, 23 aa, Mycobacterium
ITKEFYRRMFGAHPELLRNLFNR

SEQ ID NO: 1319361 - protein, 24 aa, Mycobacterium
ITKPPDILITTPESLFLMLTSAAR

SEQ ID NO: 1319362 - protein, 21 aa, Mycobacterium
ITKWVLGWERNGWLTAAKQPV

SEQ ID NO: 1319363 - protein, 26 aa, Mycobacterium
ITLAYNMHYIMVGIAGNLMSEEQNKY

SEQ ID NO: 1319364 - protein, 19 aa, Mycobacterium
ITLDPNGGWLLADAIRTCR

SEQ ID NO: 1319365 - protein, 17 aa, Mycobacterium
ITLFDPADRLGGVLRTE

SEQ ID NO: 1319366 - protein, 20 aa, Mycobacterium
ITLGTNFLGPFALTNLMFGR

SEQ ID NO: 1319367 - protein, 19 aa, Mycobacterium
ITMGTPEHHVPPLLSVNPV

SEQ ID NO: 1319368 - protein, 20 aa, Mycobacterium
ITPMLAILKSALVEGSGKVV

SEQ ID NO: 1319369 - protein, 20 aa, Mycobacterium
ITPVMSILKSALAVGRGRVT

SEQ ID NO: 1319370 - protein, 18 aa, Mycobacterium
ITPVMSMLRTLRARRHAG

SEQ ID NO: 1319371 - protein, 26 aa, Mycobacterium
ITRQTVYRYFPTLDALLTGTALSAVG

SEQ ID NO: 1319372 - protein, 29 aa, Mycobacterium
ITSNTYFDWVLDRVFVFTPAQAFVAQMLQ

SEQ ID NO: 1319373 - protein, 23 aa, Mycobacterium
ITSRGRLVARLTPVADALVTREA

SEQ ID NO: 1319374 - protein, 22 aa, Mycobacterium
ITSRRRFPTLGNQLFQLASGTA

SEQ ID NO: 1319375 - protein, 29 aa, Mycobacterium
ITSSITGPITGFPGWSHYGASKAAQMGFL

SEQ ID NO: 1319376 - protein, 24 aa, Mycobacterium
ITTNYDSLLARVFPTYATFVGQDE

SEQ ID NO: 1319377 - protein, 23 aa, Mycobacterium
ITTRYVVINGCRRLAAAHKYGRS

SEQ ID NO: 1319378 - protein, 34 aa, Mycobacterium
ITTYVRQSLGVYGRIMHILATDLLYLPEEEQSAL

SEQ ID NO: 1319379 - protein, 17 aa, Mycobacterium
ITVGIARTKFLAKVASQ

SEQ ID NO: 1319380 - protein, 26 aa, Mycobacterium
ITVIDPRLLTTMPEWLNAATGLDALT

SEQ ID NO: 1319381 - protein, 20 aa, Mycobacterium
ITWGGVYVHGAPWSTGSQGY

SEQ ID NO: 1319382 - protein, 26 aa, Mycobacterium
ITYGTNWELGFDYLRDNMALRLEDCV

SEQ ID NO: 1319383 - protein, 23 aa, Mycobacterium
IVADLAAFDERIAERGWTFDEQE

SEQ ID NO: 1319384 - protein, 18 aa, Mycobacterium
IVAEKSLLRRLVEAGTRV

SEQ ID NO: 1319385 - protein, 20 aa, Mycobacterium
IVAELFKPLPSMVVAHYLGV

SEQ ID NO: 1319386 - protein, 24 aa, Mycobacterium
IVALDTVTLLEPERIRGLLGEVSD

SEQ ID NO: 1319387 - protein, 18 aa, Mycobacterium
IVATYLHGCCLARNPQLA

SEQ ID NO: 1319388 - protein, 26 aa, Mycobacterium
IVAVATGRWPAVRFAVRNTVVQGPNA

SEQ ID NO: 1319389 - protein, 22 aa, Mycobacterium
IVDAVGLVLPFSPVCGPDCQGL

SEQ ID NO: 1319390 - protein, 25 aa, Mycobacterium
IVDFGLDLLWHPSLGLELGENAQKV

SEQ ID NO: 1319391 - protein, 24 aa, Mycobacterium
IVDKLRQRLGDRPVYLSVDIDVLD

SEQ ID NO: 1319392 - protein, 23 aa, Mycobacterium
IVDRPFVAPFAIHSPYARSYAPA

SEQ ID NO: 1319393 - protein, 28 aa, Mycobacterium
IVDSGLTLSWLLRNLATRGPRSLRVCTL

SEQ ID NO: 1319394 - protein, 17 aa, Mycobacterium
IVEFLSLQRDLYAYLHD

SEQ ID NO: 1319395 - protein, 31 aa, Mycobacterium
IVELMFAIWAAECVFVPLNYKLHVREMEQIL

SEQ ID NO: 1319396 - protein, 18 aa, Mycobacterium
IVEMLYATGIRVSELCGL

SEQ ID NO: 1319397 - protein, 25 aa, Mycobacterium
IVENLLHHDPFLALADYRSYVDCQD

SEQ ID NO: 1319398 - protein, 17 aa, Mycobacterium
IVEPFEQGIEHPSDEDL

SEQ ID NO: 1319399 - protein, 24 aa, Mycobacterium
IVEPGIYRVLRKRQYDPVLDIHGP

SEQ ID NO: 1319400 - protein, 23 aa, Mycobacterium
IVEPGYFRTDFLTTESLALPTAA

SEQ ID NO: 1319401 - protein, 17 aa, Mycobacterium
IVEQAVHVLDMLRYLVG

SEQ ID NO: 1319402 - protein, 23 aa, Mycobacterium
IVEWHRLGIETFMLAFQPFEAEM

SEQ ID NO: 1319403 - protein, 18 aa, Mycobacterium
IVEYIGQTRGWFYTLHIL

SEQ ID NO: 1319404 - protein, 17 aa, Mycobacterium
IVFPPTGSPALWIDSIA

SEQ ID NO: 1319405 - protein, 29 aa, Mycobacterium
IVGAGYTGLWTAYYLKRADPSLRIVVLEA

SEQ ID NO: 1319406 - protein, 29 aa, Mycobacterium
IVGAITPWNFPLNIPSRKLGPALAVGDPV

SEQ ID NO: 1319407 - protein, 26 aa, Mycobacterium
IVGIMRVYANFLAQYSIRVNSVHPAA

SEQ ID NO: 1319408 - protein, 17 aa, Mycobacterium
IVKLATLHRTVKPELLT

SEQ ID NO: 1319409 - protein, 26 aa, Mycobacterium
IVKNNRWLEDALPDYNIKWTKFDSGA

SEQ ID NO: 1319410 - protein, 17 aa, Mycobacterium
IVLDFHEWREGLLRGLA

SEQ ID NO: 1319411 - protein, 22 aa, Mycobacterium
IVLLERFSVDDWVRAVRTHRIP

SEQ ID NO: 1319412 - protein, 18 aa, Mycobacterium
IVLPGSCTRAIDAPAGSH

SEQ ID NO: 1319413 - protein, 19 aa, Mycobacterium
IVLQHRYPGLLLGHLNMVT

SEQ ID NO: 1319414 - protein, 32 aa, Mycobacterium
IVLSCGTFGNVLRFLPPLAISDELLLEGLDVL

SEQ ID NO: 1319415 - protein, 24 aa, Mycobacterium
IVMDKNFIIVFANNAFGREVGRPV

SEQ ID NO: 1319416 - protein, 25 aa, Mycobacterium
IVMLHLAIKAFRPGRLPFPVMHVDT

SEQ ID NO: 1319417 - protein, 19 aa, Mycobacterium
IVNFWSCTKTLTALAALIL

SEQ ID NO: 1319418 - protein, 18 aa, Mycobacterium
IVNHAEDRVLFFDITFAP

SEQ ID NO: 1319419 - protein, 30 aa, Mycobacterium; identical to SEQ ID NO: 828030

SEQ ID NO: 1319420 - protein, 30 aa, Mycobacterium
IVNHFFVCSTHDWILFFTTQGRVYRAKAYE

SEQ ID NO: 1319421 - protein, 31 aa, Mycobacterium
IVNHFFVCSTHDWILFFTTQGRVYRAKAYEL

SEQ ID NO: 1319422 - protein, 18 aa, Mycobacterium
IVNIWTAAAGPVAESFHR

SEQ ID NO: 1319423 - protein, 25 aa, Mycobacterium
IVNRGFGPILLPRLAASLFEIEPRC

SEQ ID NO: 1319424 - protein, 17 aa, Mycobacterium
IVPALAARALGKHGKAI

SEQ ID NO: 1319425 - protein, 20 aa, Mycobacterium
IVPGKVTKLVPFGAFVRVEE

SEQ ID NO: 1319426 - protein, 17 aa, Mycobacterium
IVQFMAYMATGFSSPWN

SEQ ID NO: 1319427 - protein, 21 aa, Mycobacterium
IVQIASRRPGTGRWQIVVVED

SEQ ID NO: 1319428 - protein, 26 aa, Mycobacterium
IVRALDPLLRAIIETGYDRPTDGKYA

SEQ ID NO: 1319429 - protein, 25 aa, Mycobacterium
IVRELFKPLPSMVVAHYLGVPEADR

SEQ ID NO: 1319430 - protein, 17 aa, Mycobacterium
IVRFCAEPEVFVPGAPP

SEQ ID NO: 1319431 - protein, 18 aa, Mycobacterium
IVRKDFGPWSPGGKFARY

SEQ ID NO: 1319432 - protein, 26 aa, Mycobacterium
IVRRAMPELHFLVVTGPRIDPATLPH

SEQ ID NO: 1319433 - protein, 18 aa, Mycobacterium
IVSAFSDERYWSARLGQF

SEQ ID NO: 1319434 - protein, 23 aa, Mycobacterium
IVSDLILGGYLTRTKVGRRNHYQ

SEQ ID NO: 1319435 - protein, 23 aa, Mycobacterium
IVSDTACLFARDPGSFRPASPSL

SEQ ID NO: 1319436 - protein, 26 aa, Mycobacterium
IVSGSMFSPIDFVWCAVCITGQVVRG

SEQ ID NO: 1319437 - protein, 21 aa, Mycobacterium
IVSRKCGVPFLYRFELMGTTD

SEQ ID NO: 1319438 - protein, 23 aa, Mycobacterium
IVSRPSRWFVRRSCCPPCCVVVR

SEQ ID NO: 1319439 - protein, 21 aa, Mycobacterium
IVTGLRLMARMAQTGRSLAGL

SEQ ID NO: 1319440 - protein, 24 aa, Mycobacterium
IVTLDTWIPGWRPRDLAMSNFPQL

SEQ ID NO: 1319441 - protein, 18 aa, Mycobacterium
IVVPPRMSAYSSASAAVF

SEQ ID NO: 1319442 - protein, 26 aa, Mycobacterium
IVVRDDHGFILAGPDLRDVSGWMLDR

SEQ ID NO: 1319443 - protein, 25 aa, Mycobacterium
IVVSLPVHLADPLEWVRLAHTGATI

SEQ ID NO: 1319444 - protein, 27 aa, Mycobacterium
IVVVAEAPPWIGTLDVVILAGDDAGDA

SEQ ID NO: 1319445 - protein, 17 aa, Mycobacterium
IVVWELIDALRRDGVTV

SEQ ID NO: 1319446 - protein, 17 aa, Mycobacterium
IVWGYDINDEPPALDED

SEQ ID NO: 1319447 - protein, 18 aa, Mycobacterium
IWEPRRVFVTIGIRNARS

SEQ ID NO: 1319448 - protein, 18 aa, Mycobacterium
IWLRVDAGQFDRARALVA

SEQ ID NO: 1319449 - protein, 18 aa, Mycobacterium
IYDEFLALAAIRTKAVRQ

SEQ ID NO: 1319450 - protein, 17 aa, Mycobacterium
IYEALAAGIPVLATPRA

SEQ ID NO: 1319451 - protein, 23 aa, Mycobacterium
IYEMYRLLALAKYDERYVIPTAY

SEQ ID NO: 1319452 - protein, 24 aa, Mycobacterium
IYERFYKYLTGCADLFRDGYTDVV

SEQ ID NO: 1319453 - protein, 32 aa, Mycobacterium
IYLRAFEEFIHHNLVLRRGPVAAVAAFAFRVR

SEQ ID NO: 1319454 - protein, 17 aa, Mycobacterium
IYQVGGKSFVFFRTPRP

SEQ ID NO: 1319455 - protein, 34 aa, Mycobacterium
IYTLTDEAPLLATYAFLPVVRTFASAAGIDVKSS

SEQ ID NO: 1319456 - protein, 30 aa, Mycobacterium
IYTPAAKRRFGYYVWPFLLDGDLVGRVDLK

SEQ ID NO: 1319457 - protein, 29 aa, Mycobacterium
KAAGIRSLLAYQWAHPGKQLLFMGQEFGQ

SEQ ID NO: 1319458 - protein, 45 aa, Mycobacterium
KAAKTPFFMYGADGEPLFMAGLWTTWRPRDAPKEAPPLLSCTIIT

SEQ ID NO: 1319459 - protein, 23 aa, Mycobacterium
KAAPGYFMAKRIIKMITAVGDTV

SEQ ID NO: 1319460 - protein, 21 aa, Mycobacterium
KAAPRDGSVMNLVTLFMGHLY

SEQ ID NO: 1319461 - protein, 25 aa, Mycobacterium
KAAQMGFLRTAAIELAPKKITVNAV

SEQ ID NO: 1319462 - protein, 22 aa, Mycobacterium
KAARFVRTCDCFNIPIVMLVDV

SEQ ID NO: 1319463 - protein, 23 aa, Mycobacterium
KADLPTFAEMLSRLPFPLNQTTS

SEQ ID NO: 1319464 - protein, 24 aa, Mycobacterium
KADWQGQHVPQLRQVVTALQNASQ

SEQ ID NO: 1319465 - protein, 24 aa, Mycobacterium
KAENYGFDFWQLFGATEQCMVDAE

SEQ ID NO: 1319466 - protein, 22 aa, Mycobacterium
KAFDSIPGLLRARRPELYGELV

SEQ ID NO: 1319467 - protein, 27 aa, Mycobacterium
KAFGEVWVRGPWIASGYFRGEGGEKLD

SEQ ID NO: 1319468 - protein, 30 aa, Mycobacterium
KAGALVVLVDGALAWFVERGGRSLLSFTAD

SEQ ID NO: 1319469 - protein, 24 aa, Mycobacterium
KAGDTLYCDVYIDSIRKAHGTDII

SEQ ID NO: 1319470 - protein, 28 aa, Mycobacterium
KAGERLRLVKYLAYGWSSLRSRPALRDQ

SEQ ID NO: 1319471 - protein, 26 aa, Mycobacterium
KAGEWHQALFGAGFFGTSWPKEYGGQ

SEQ ID NO: 1319472 - protein, 24 aa, Mycobacterium
KAGKLYDAFNVNVAILGDTAAMAG

SEQ ID NO: 1319473 - protein, 18 aa, Mycobacterium
KAGLEASGFRAGCPVLAV

SEQ ID NO: 1319474 - protein, 23 aa, Mycobacterium
KAGTKVRGIRLISDGVGDHDIDA

SEQ ID NO: 1319475 - protein, 24 aa, Mycobacterium
KAHGADHWYAKLTTVGVPAGPIND

SEQ ID NO: 1319476 - protein, 21 aa, Mycobacterium
KAIDFVLELQFGTGEIAWARG

SEQ ID NO: 1319477 - protein, 24 aa, Mycobacterium
KAKEMAFFGERLTAAEAFTLGLVN

SEQ ID NO: 1319478 - protein, 25 aa, Mycobacterium
KAKKLRVRLPLLKLTVAVEDPTRLE

SEQ ID NO: 1319479 - protein, 19 aa, Mycobacterium
KAKLTQFLVRQARLAGVAA

SEQ ID NO: 1319480 - protein, 24 aa, Mycobacterium
KAKRRLLAELYELKLPIVGRDHDP

SEQ ID NO: 1319481 - protein, 20 aa, Mycobacterium
KALDRGIPVCAVPFGRDQFE

SEQ ID NO: 1319482 - protein, 22 aa, Mycobacterium
KALKRMNTMMTKLALIRPRRMA

SEQ ID NO: 1319483 - protein, 19 aa, Mycobacterium
KALNLRPAPEFEAWLARLG

SEQ ID NO: 1319484 - protein, 18 aa, Mycobacterium
KALRERVFRIYNEHIAEL

SEQ ID NO: 1319485 - protein, 25 aa, Mycobacterium
KALRLGDYCLGLYASRDYLAEHGHP

SEQ ID NO: 1319486 - protein, 17 aa, Mycobacterium
KALYLSSPIGLGHARRD

SEQ ID NO: 1319487 - protein, 23 aa, Mycobacterium
KAMKGIVPLPAQSRVRHIDIFLS

SEQ ID NO: 1319488 - protein, 19 aa, Mycobacterium
KANRHLWGHFARHGKGITP

SEQ ID NO: 1319489 - protein, 17 aa, Mycobacterium
KANRRHLLEHKPTKRTR

SEQ ID NO: 1319490 - protein, 33 aa, Mycobacterium
KANYDSKYAALYWPWVSTGNGYLPPSGFIAGIW

SEQ ID NO: 1319491 - protein, 26 aa, Mycobacterium
KAPFFGDRRKAFLDDLAVVTGGQVVN

SEQ ID NO: 1319492 - protein, 25 aa, Mycobacterium
KAPLHRTCVLLIYLSGPMLVSMGIQ

SEQ ID NO: 1319493 - protein, 21 aa, Mycobacterium
KAPTAMHLQFLRGGEAGDPVD

SEQ ID NO: 1319494 - protein, 27 aa, Mycobacterium
KAPVVPVVPPILNNTPQPPPGGITTQT

SEQ ID NO: 1319495 - protein, 21 aa, Mycobacterium
KAPWRLKQNYLIDLRVIRNGK

SEQ ID NO: 1319496 - protein, 24 aa, Mycobacterium
KAQQGVMELLLINHPLDCPVCDKG

SEQ ID NO: 1319497 - protein, 25 aa, Mycobacterium
KARDAQFFPLLRDATFGALDDARIE

SEQ ID NO: 1319498 - protein, 24 aa, Mycobacterium
KARDRWQFLPFLGGGRPCIGEHFA

SEQ ID NO: 1319499 - protein, 22 aa, Mycobacterium
KARHNYSILDTYEAGIALMGTE

SEQ ID NO: 1319500 - protein, 24 aa, Mycobacterium
KARIDAARLLVYRAGWMARNGKEF

SEQ ID NO: 1319501 - protein, 20 aa, Mycobacterium
KARPPKFLEVDTLDFDSPPK

SEQ ID NO: 1319502 - protein, 19 aa, Mycobacterium
KARWLPKFVSGEYIGSIAM

SEQ ID NO: 1319503 - protein, 25 aa, Mycobacterium
KASIGNSWLGKIMGGLAGAAPSLPN

SEQ ID NO: 1319504 - protein, 18 aa, Mycobacterium
KASLMTRLMPGASAIVVL

SEQ ID NO: 1319505 - protein, 24 aa, Mycobacterium
KASRNAWYLDPDSNRYKRLTVAVR

SEQ ID NO: 1319506 - protein, 21 aa, Mycobacterium
KASTKFTRLTGRSPILLAGMT

SEQ ID NO: 1319507 - protein, 21 aa, Mycobacterium
KATEFILLANQTDTPLIFLQN

SEQ ID NO: 1319508 - protein, 30 aa, Mycobacterium
KATEWVPIRPGTDALLLFAMLHTLDEQGWV

SEQ ID NO: 1319509 - protein, 20 aa, Mycobacterium
KATGTFAGIGGDGGAGGSIG

SEQ ID NO: 1319510 - protein, 18 aa, Mycobacterium
KATKLVAEWPIRDHIPDP

SEQ ID NO: 1319511 - protein, 21 aa, Mycobacterium
KATLRRLYRHPASGQLVAMES

SEQ ID NO: 1319512 - protein, 24 aa, Mycobacterium
KATLRRLYRHPASGQLVAMESKAR

SEQ ID NO: 1319513 - protein, 19 aa, Mycobacterium
KATLRRLYRHPKSGQLVAM

SEQ ID NO: 1319514 - protein, 20 aa, Mycobacterium
KATLRRLYRRPRSGALVAME

SEQ ID NO: 1319515 - protein, 17 aa, Mycobacterium
KATRLIGRALSPLTLTV

SEQ ID NO: 1319516 - protein, 24 aa, Mycobacterium
KATVPVFFEPRLIKVALAQGVTED

SEQ ID NO: 1319517 - protein, 26 aa, Mycobacterium
KAVAEYGLWYPPDPSSFEICSIGGNI

SEQ ID NO: 1319518 - protein, 26 aa, Mycobacterium
KAVGVRNPFIKDFKLRFFEDGMKRAA

SEQ ID NO: 1319519 - protein, 28 aa, Mycobacterium
KAVHPLVWRLVAPVFNPLAAFLTTGGLP

SEQ ID NO: 1319520 - protein, 28 aa, Mycobacterium
KAVIVSEPFMPAAPLLSGLGMLVLTVAD

SEQ ID NO: 1319521 - protein, 21 aa, Mycobacterium
KAVMVSMRRALQQMGPVRTVA

SEQ ID NO: 1319522 - protein, 24 aa, Mycobacterium
KAVTDACEILLITKDNLAGYHREL

SEQ ID NO: 1319523 - protein, 25 aa, Mycobacterium
KAVVGRLWQHMDVLVVPTIGTTFTV

SEQ ID NO: 1319524 - protein, 24 aa, Mycobacterium
KAWNLHTALYYKAGGVPWRMTRDN

SEQ ID NO: 1319525 - protein, 26 aa, Mycobacterium
KAYEEAIDLIFLAIDPHPFDVLVRQR

SEQ ID NO: 1319526 - protein, 30 aa, Mycobacterium
KAYGVTFPDWRPVDFKVWPAENGFVQRYRW

SEQ ID NO: 1319527 - protein, 22 aa, Mycobacterium
KCADDPCFRWLAAGQGPHHLAI

SEQ ID NO: 1319528 - protein, 17 aa, Mycobacterium
KCQAPPATFQTAPQSPR

SEQ ID NO: 1319529 - protein, 21 aa, Mycobacterium
KDAPWRLIIAQHFSSPEELMA

SEQ ID NO: 1319530 - protein, 21 aa, Mycobacterium
KDGAAWLKENRSGAGLFDSLA

SEQ ID NO: 1319531 - protein, 25 aa, Mycobacterium
KDGREFIAQFLISGAGGLHIPLIPE

SEQ ID NO: 1319532 - protein, 20 aa, Mycobacterium
KDHPGTEVTFNFAGSADLVA

SEQ ID NO: 1319533 - protein, 29 aa, Mycobacterium
KDILQGECTFAWPPQFELPGYKPNTKPHN

SEQ ID NO: 1319534 - protein, 35 aa, Mycobacterium
KDLSKLTHQVYIYAIPYLWAFPPAEQIFGTTAVVP

SEQ ID NO: 1319535 - protein, 18 aa, Mycobacterium
KDMLRLRRWCSGTSNRWC

SEQ ID NO: 1319536 - protein, 20 aa, Mycobacterium
KDMRRKGLTINPQTVAKHAR

SEQ ID NO: 1319537 - protein, 26 aa, Mycobacterium
KDPADHLWYYRELLTAYRGRGLDSWM

SEQ ID NO: 1319538 - protein, 24 aa, Mycobacterium
KDPDGTLLWTQKRSIFARGEGGFG

SEQ ID NO: 1319539 - protein, 17 aa, Mycobacterium
KDPWMRRQLTPDFTPGC

SEQ ID NO: 1319540 - protein, 22 aa, Mycobacterium
KDRDIAMVFQSYALYPHMTVRQ

SEQ ID NO: 1319541 - protein, 18 aa, Mycobacterium
KDRIVEFLSLQRDLYAYL

SEQ ID NO: 1319542 - protein, 24 aa, Mycobacterium
KDRTLTSYPSLRTDLRNAGATVVD

SEQ ID NO: 1319543 - protein, 23 aa, Mycobacterium
KDRVVDWSVLVDAGWTGLEVPDG

SEQ ID NO: 1319544 - protein, 19 aa, Mycobacterium
KDTLLRLPDVKALLDRHLA

SEQ ID NO: 1319545 - protein, 17 aa, Mycobacterium
KDVLLYLDEARALGTPV

SEQ ID NO: 1319546 - protein, 39 aa, Mycobacterium
KDVMVSWLPCFHDMGMVGFLTIPMYFGAELVKVTPLDFL

SEQ ID NO: 1319547 - protein, 20 aa, Mycobacterium
KDVSTAWQLDAYRFEIPVVA

SEQ ID NO: 1319548 - protein, 17 aa, Mycobacterium
KDYDARFGMRVWHRDFF

SEQ ID NO: 1319549 - protein, 27 aa, Mycobacterium
KEAICKGTLWGLRRGARKPGSAIWFKG

SEQ ID NO: 1319550 - protein, 18 aa, Mycobacterium
KEAIILYGMRRTADLGAR

SEQ ID NO: 1319551 - protein, 24 aa, Mycobacterium
KECGAVLVYEKPCPCTPDMEHREV

SEQ ID NO: 1319552 - protein, 23 aa, Mycobacterium
KEDLASLEFLISASGPLDPETRD

SEQ ID NO: 1319553 - protein, 24 aa, Mycobacterium
KEEDFQLFLTLLDRDRFEGKNTKT

SEQ ID NO: 1319554 - protein, 23 aa, Mycobacterium
KEELFRAALTRYLEGPGGYLSRA

SEQ ID NO: 1319555 - protein, 23 aa, Mycobacterium
KEERYSFPLFFNVDYHTEVKPLP

SEQ ID NO: 1319556 - protein, 19 aa, Mycobacterium
KEFFALPLEEKMRTYIGLS

SEQ ID NO: 1319557 - protein, 26 aa, Mycobacterium
KEFMVRNTYIYPPKASMRIISDIFGY

SEQ ID NO: 1319558 - protein, 27 aa, Mycobacterium
KEFMVRNTYIYPPKPSMRIISDIFGYT

SEQ ID NO: 1319559 - protein, 24 aa, Mycobacterium
KEGDPHAWAIPRLTGQAKASFVAV

SEQ ID NO: 1319560 - protein, 19 aa, Mycobacterium
KEGRGRKFALRQLRSLAAH

SEQ ID NO: 1319561 - protein, 24 aa, Mycobacterium
KEHWQDYLVWFRAATEPRMRNDVA

SEQ ID NO: 1319562 - protein, 28 aa, Mycobacterium
KEIQSRLGFLLDVGLDYLSLSRAAGTLS

SEQ ID NO: 1319563 - protein, 19 aa, Mycobacterium
KELAWLRRGPPARTSKPKF

SEQ ID NO: 1319564 - protein, 28 aa, Mycobacterium
KELGAMGFKFQFITLAGFHALNYSMFDL

SEQ ID NO: 1319565 - protein, 22 aa, Mycobacterium
KELIAWLPTVLGLGAGDTVVVP

SEQ ID NO: 1319566 - protein, 26 aa, Mycobacterium
KELLRTAVLAFLKYIDANRASWMVLY

SEQ ID NO: 1319567 - protein, 28 aa, Mycobacterium
KELRPQLILLDVYLPDMTGLDVLQRLRA

SEQ ID NO: 1319568 - protein, 25 aa, Mycobacterium
KELTAGSRLLLLWGAANRDPARFDA

SEQ ID NO: 1319569 - protein, 40 aa, Mycobacterium
KENHRLLGPTLLPSWLAYLPPATTPRIFRMQARRLESAMV

SEQ ID NO: 1319570 - protein, 24 aa, Mycobacterium
KEPNAMWVMPDLKDEVLFRAEHDV

SEQ ID NO: 1319571 - protein, 24 aa, Mycobacterium
KEPPRILRGAFAAVIMGLGLGMES

SEQ ID NO: 1319572 - protein, 28 aa, Mycobacterium
KEQLDDIALYLNFDMVGSPNPGYFTDDG

SEQ ID NO: 1319573 - protein, 18 aa, Mycobacterium
KEQPLVQGWTRAMDGDPC

SEQ ID NO: 1319574 - protein, 27 aa, Mycobacterium
KERERLFPVIRRYALAYHVVFIPSGEV

SEQ ID NO: 1319575 - protein, 25 aa, Mycobacterium
KESDPRYLPFRSLRGRDFTSMVSVP

SEQ ID NO: 1319576 - protein, 20 aa, Mycobacterium
KESPHWPAIRDALAALSDYL

SEQ ID NO: 1319577 - protein, 17 aa, Mycobacterium
KEVIRGKRLIVVDDSIV

SEQ ID NO: 1319578 - protein, 19 aa, Mycobacterium
KEVVPQYPEWEKAGRMPRD

SEQ ID NO: 1319579 - protein, 26 aa, Mycobacterium
KEWAQLLMVAVRVASMPGLLSTTTIF

SEQ ID NO: 1319580 - protein, 27 aa, Mycobacterium
KEYEEERPTIVMPGTGGTVAGTAVNDW

SEQ ID NO: 1319581 - protein, 32 aa, Mycobacterium
KFASELEFFLSATPPRQAWELGYQDLKMLSDY

SEQ ID NO: 1319582 - protein, 17 aa, Mycobacterium
KFDIIGLLARHPKMARR

SEQ ID NO: 1319583 - protein, 17 aa, Mycobacterium
KFDYAKGFKFSTYATWW

SEQ ID NO: 1319584 - protein, 42 aa, Mycobacterium
KFEQLMAQYLPLDSVYGRLFKQVWLWKDWPGRGGKIDTGIDL

SEQ ID NO: 1319585 - protein, 18 aa, Mycobacterium
KFHFPTRIARPLSHDFAD

SEQ ID NO: 1319586 - protein, 24 aa, Mycobacterium
KFKLHLVGLSLRDQPRRALPDDVA

SEQ ID NO: 1319587 - protein, 18 aa, Mycobacterium
KFLDLTFDEWQKVVDVNL

SEQ ID NO: 1319588 - protein, 17 aa, Mycobacterium
KFMGRWRSGAPLVLCPD

SEQ ID NO: 1319589 - protein, 17 aa, Mycobacterium
KFMHCLPAFHNCETKVG

SEQ ID NO: 1319590 - protein, 20 aa, Mycobacterium
KFRATFDALLHNFYGPTETV

SEQ ID NO: 1319591 - protein, 21 aa, Mycobacterium
KFRDAENLTFPLLSDPDRKVL

SEQ ID NO: 1319592 - protein, 20 aa, Mycobacterium
KFTTAFARRGLIAEYGISWI

SEQ ID NO: 1319593 - protein, 18 aa, Mycobacterium
KFVDCDGALWAVKELPPR

SEQ ID NO: 1319594 - protein, 21 aa, Mycobacterium
KFVPDLLPRMDAEVAALGRSM

SEQ ID NO: 1319595 - protein, 22 aa, Mycobacterium
KGACIFLNRPGFAGGIGCALHT

SEQ ID NO: 1319596 - protein, 20 aa, Mycobacterium
KGALISFTRSLAREYGPAGI

SEQ ID NO: 1319597 - protein, 24 aa, Mycobacterium
KGANRTFLVPAVLAKVLEAGEDAV

SEQ ID NO: 1319598 - protein, 23 aa, Mycobacterium
KGAPTRLLLLRHGQTELSVQRRY

SEQ ID NO: 1319599 - protein, 19 aa, Mycobacterium
KGARGLVQLRRALELVDPA

SEQ ID NO: 1319600 - protein, 21 aa, Mycobacterium
KGAVIALTYSLAQSLADRNIR

SEQ ID NO: 1319601 - protein, 17 aa, Mycobacterium
KGDAYFVAIGGNGGNGG

SEQ ID NO: 1319602 - protein, 18 aa, Mycobacterium
KGDDGYVYVYGTPNGRQG

SEQ ID NO: 1319603 - protein, 21 aa, Mycobacterium
KGEPDPKFSLAPVAKALGEKL

SEQ ID NO: 1319604 - protein, 24 aa, Mycobacterium
KGEPKLPTDPSLRPAAAGGGGSGG

SEQ ID NO: 1319605 - protein, 17 aa, Mycobacterium
KGFEFLVSKGRALMPSL

SEQ ID NO: 1319606 - protein, 17 aa, Mycobacterium
KGFGFIAPDGGAPDVFV

SEQ ID NO: 1319607 - protein, 18 aa, Mycobacterium
KGFKSFASPTTLRFEPGI

SEQ ID NO: 1319608 - protein, 29 aa, Mycobacterium
KGGAATAFGTEWDKWHSGAGQVVRGLQTM

SEQ ID NO: 1319609 - protein, 27 aa, Mycobacterium
KGHPEGLMSFRWFLADELPEHPATTVV

SEQ ID NO: 1319610 - protein, 17 aa, Mycobacterium
KGIAFIDAGVSGGIWGL

SEQ ID NO: 1319611 - protein, 21 aa, Mycobacterium
KGIAYFSMEFGVAAVLPNYSG

SEQ ID NO: 1319612 - protein, 18 aa, Mycobacterium
KGIRYEGEQIRRKVGKTG

SEQ ID NO: 1319613 - protein, 18 aa, Mycobacterium
KGKLDGYALRVPIPTGSC

SEQ ID NO: 1319614 - protein, 24 aa, Mycobacterium
KGKRYALPHARILMHQPLGGITGG

SEQ ID NO: 1319615 - protein, 31 aa, Mycobacterium
KGLAGIADNLVRFLGALALAGPVAKLQQISD

SEQ ID NO: 1319616 - protein, 17 aa, Mycobacterium
KGLQLDIGAPPQFMDFR

SEQ ID NO: 1319617 - protein, 27 aa, Mycobacterium
KGLRRWRAVVRSAARQSRRAHIPPVDG

SEQ ID NO: 1319618 - protein, 19 aa, Mycobacterium
KGMPAVIPVPVDPVAVVAK

SEQ ID NO: 1319619 - protein, 22 aa, Mycobacterium
KGNEYFLRHLLGTASNLQATPT

SEQ ID NO: 1319620 - protein, 19 aa, Mycobacterium
KGNRHFSFGLGVHRCIGSN

SEQ ID NO: 1319621 - protein, 23 aa, Mycobacterium
KGPGYTAMFGWPEPFADGADKKD

SEQ ID NO: 1319622 - protein, 19 aa, Mycobacterium
KGPIALRVHLGPPGESPGP

SEQ ID NO: 1319623 - protein, 25 aa, Mycobacterium
KGREVDWPVLVDAGWVGLEVPEYLG

SEQ ID NO: 1319624 - protein, 27 aa, Mycobacterium
KGSALVPSWVAFAVIGLLEQHFGRLVD

SEQ ID NO: 1319625 - protein, 20 aa, Mycobacterium
KGSILGVQLEPKAMRDNMHE

SEQ ID NO: 1319626 - protein, 17 aa, Mycobacterium
KGTLLHGKVICPGHQWQ

SEQ ID NO: 1319627 - protein, 40 aa, Mycobacterium
KGTPVFAWKGETLEEYWWAAEQMLTWEGKPANMILDDGGD

SEQ ID NO: 1319628 - protein, 29 aa, Mycobacterium
KGTRALIAILLAHRSMPAGALIAAMDRAV

SEQ ID NO: 1319629 - protein, 17 aa, Mycobacterium
KGWLVARATLGNERISI

SEQ ID NO: 1319630 - protein, 19 aa, Mycobacterium
KGWTLAEAERWLAPNLGYN

SEQ ID NO: 1319631 - protein, 18 aa, Mycobacterium
KGYFPVPALTHLEGPYLE

SEQ ID NO: 1319632 - protein, 22 aa, Mycobacterium
KGYGFQVDLTWRSINAGFTVIE

SEQ ID NO: 1319633 - protein, 26 aa, Mycobacterium
KHDVEFFNEFYALDITLTETASGPVA

SEQ ID NO: 1319634 - protein, 34 aa, Mycobacterium
KHFLALAEISEVLFPPAPWMFGAAGREHMKEYGS

SEQ ID NO: 1319635 - protein, 20 aa, Mycobacterium
KHNGWGVPGLSWTPGEDPDP

SEQ ID NO: 1319636 - protein, 27 aa, Mycobacterium
KHPKCRFWNLTLWNQYMAALDVEYGRA

SEQ ID NO: 1319637 - protein, 19 aa, Mycobacterium
KHPMWYLNLRANPTVQVQI

SEQ ID NO: 1319638 - protein, 19 aa, Mycobacterium
KHRHLTRRAAKDRALELLE

SEQ ID NO: 1319639 - protein, 18 aa, Mycobacterium
KHSMFVRGLELYCTEAVD

SEQ ID NO: 1319640 - protein, 24 aa, Mycobacterium
KHTQVFRMWLDAVGITEDLQGYLD

SEQ ID NO: 1319641 - protein, 18 aa, Mycobacterium
KHYIVRNGEVFIVDEFTG

SEQ ID NO: 1319642 - protein, 21 aa, Mycobacterium
KIADYPFTTLAPNLGVVSAGE

SEQ ID NO: 1319643 - protein, 23 aa, Mycobacterium
KIAEWFEARWTDRFSLPITAEII

SEQ ID NO: 1319644 - protein, 26 aa, Mycobacterium
KIARLKSVPILLAPPWGLAVSDMVPR

SEQ ID NO: 1319645 - protein, 17 aa, Mycobacterium
KIARLLGLGYPGGRVLD

SEQ ID NO: 1319646 - protein, 20 aa, Mycobacterium
KIAVTRWARRHAVRPEWAGA

SEQ ID NO: 1319647 - protein, 19 aa, Mycobacterium
KIDLRANWMKHLHHANWKM

SEQ ID NO: 1319648 - protein, 27 aa, Mycobacterium
KIDPDLVELPGWYRPNPGLARDLAFIG

SEQ ID NO: 1319649 - protein, 23 aa, Mycobacterium
KIDPLALAAAVPAGTPVLLTCSD

SEQ ID NO: 1319650 - protein, 32 aa, Mycobacterium
KIETRRAFEHLPQLLLTAMRRPRVGVMIARGD

SEQ ID NO: 1319651 - protein, 23 aa, Mycobacterium
KILNDHGLMVPNWPVEWGGKDWT

SEQ ID NO: 1319652 - protein, 18 aa, Mycobacterium
KILPISFGFPFGFSAVLP

SEQ ID NO: 1319653 - protein, 20 aa, Mycobacterium
KILQRLPDLRLADESMLPLR

SEQ ID NO: 1319654 - protein, 31 aa, Mycobacterium
KIRRFWPHRYRRSSFYWKLIGYDQRFDIADR

SEQ ID NO: 1319655 - protein, 23 aa, Mycobacterium
KITGPTAPSWRKGRYHIAGRGPR

SEQ ID NO: 1319656 - protein, 18 aa, Mycobacterium
KITLWKDYWDMSGLTATA

SEQ ID NO: 1319657 - protein, 21 aa, Mycobacterium
KIVKAHWHIYRLAAEGHTGWK

SEQ ID NO: 1319658 - protein, 17 aa, Mycobacterium
KIYRHFTDKSDLFQAIG

SEQ ID NO: 1319659 - protein, 18 aa, Mycobacterium
KIYVRFPEAVSMREYLGE

SEQ ID NO: 1319660 - protein, 22 aa, Mycobacterium
KKALLQRLPFVDAPYDGPFANA

SEQ ID NO: 1319661 - protein, 29 aa, Mycobacterium
KKIRTQTMLFPRYHQWDAVTRLIDRARTQ

SEQ ID NO: 1319662 - protein, 25 aa, Mycobacterium
KKMRCPLLVQIADFDQYVPAAAVAT

SEQ ID NO: 1319663 - protein, 30 aa, Mycobacterium
KKNLRHRDGRWYWHWDPAFLTKPGDDPFVR

SEQ ID NO: 1319664 - protein, 30 aa, Mycobacterium
KKNLRHRHGRWYWHWDPAFLTKPNEDPFVR

SEQ ID NO: 1319665 - protein, 19 aa, Mycobacterium
KKQQGITFVLIDMTTPGIE

SEQ ID NO: 1319666 - protein, 19 aa, Mycobacterium
KKRGFRFVGPTTAYALMQA

SEQ ID NO: 1319667 - protein, 17 aa, Mycobacterium
KKVRTRLAIRREAFRLF

SEQ ID NO: 1319668 - protein, 24 aa, Mycobacterium
KLADRMLARWTERFAQWVQVPADL

SEQ ID NO: 1319669 - protein, 24 aa, Mycobacterium
KLAMQSITAATLRQALLGKVMTVG

SEQ ID NO: 1319670 - protein, 26 aa, Mycobacterium
KLANYWHGEFPWRPDRGYGRTAPVGS

SEQ ID NO: 1319671 - protein, 17 aa, Mycobacterium
KLAQRAPVVVACRRLTG

SEQ ID NO: 1319672 - protein, 20 aa, Mycobacterium
KLARIWSQCLGLSDIDRNAN

SEQ ID NO: 1319673 - protein, 19 aa, Mycobacterium
KLARVLVADGRRVVLGAAD

SEQ ID NO: 1319674 - protein, 23 aa, Mycobacterium
KLAVDFRQKFKKDVVIDMLCYRR

SEQ ID NO: 1319675 - protein, 25 aa, Mycobacterium
KLCAWQLGHPLASSALRSAPEQFHG

SEQ ID NO: 1319676 - protein, 30 aa, Mycobacterium
KLCMIHGADPWWDVAIRLLIKYANLRIMTS

SEQ ID NO: 1319677 - protein, 25 aa, Mycobacterium
KLDAPPDWFGTIKPSKLIHAGVESG

SEQ ID NO: 1319678 - protein, 21 aa, Mycobacterium
KLDLIEYYLAVADGALRGVAD

SEQ ID NO: 1319679 - protein, 28 aa, Mycobacterium
KLEAPRRRAAFPWITPVLGTGCLSTSEF

SEQ ID NO: 1319680 - protein, 37 aa, Mycobacterium
KLEKTKRFLLGELLGRITRHLLLMTATPHSGKEEDFQ

SEQ ID NO: 1319681 - protein, 30 aa, Mycobacterium
KLEQAAVELTIPILLIRGKLSDVVSSEGVQ

SEQ ID NO: 1319682 - protein, 26 aa, Mycobacterium
KLEQQAIFRKLWLHVGRVERLLKTGS

SEQ ID NO: 1319683 - protein, 26 aa, Mycobacterium
KLEQQAIFRKLWLHVGRVERLPKAGS

SEQ ID NO: 1319684 - protein, 20 aa, Mycobacterium
KLEVYSPNSPLGGALIDAKV

SEQ ID NO: 1319685 - protein, 25 aa, Mycobacterium
KLFERATLRYLAGPGGYLTEALTQP

SEQ ID NO: 1319686 - protein, 19 aa, Mycobacterium
KLGTRWPLPYFGAFAETNV

SEQ ID NO: 1319687 - protein, 24 aa, Mycobacterium
KLHDMGADLLRRPVSEIMSTLVAT

SEQ ID NO: 1319688 - protein, 17 aa, Mycobacterium
KLIVRFCAEPEVFVPGA

SEQ ID NO: 1319689 - protein, 22 aa, Mycobacterium
KLKAFVDMLVPFKPFSSVLGEQ

SEQ ID NO: 1319690 - protein, 23 aa, Mycobacterium
KLKGHPLFAHITLQRSERSPIAA

SEQ ID NO: 1319691 - protein, 30 aa, Mycobacterium
KLKIDGVNLTYLGLIPQIKKSFLAKDVEAM

SEQ ID NO: 1319692 - protein, 18 aa, Mycobacterium
KLKRLPADQARELGLAQL

SEQ ID NO: 1319693 - protein, 21 aa, Mycobacterium
KLLANAAFWGHRNPDQLTSVY

SEQ ID NO: 1319694 - protein, 19 aa, Mycobacterium
KLLKRALREPYWDGADRHI

SEQ ID NO: 1319695 - protein, 19 aa, Mycobacterium
KLLQVFGCTAAAVTGSGRV

SEQ ID NO: 1319696 - protein, 26 aa, Mycobacterium
KLNPQLIDELPLPRPKFEIFVYSPRV

SEQ ID NO: 1319697 - protein, 20 aa, Mycobacterium
KLPANPFAELASTPTWTMNI

SEQ ID NO: 1319698 - protein, 20 aa, Mycobacterium
KLPPAEYLTQAIPAGRVGAP

SEQ ID NO: 1319699 - protein, 23 aa, Mycobacterium
KLPRCYAAIIEISKGRRYVAAPI

SEQ ID NO: 1319700 - protein, 20 aa, Mycobacterium
KLPVDLAANAASLGADVIRV

SEQ ID NO: 1319701 - protein, 18 aa, Mycobacterium
KLREAVGIVTDWLKRHDF

SEQ ID NO: 1319702 - protein, 22 aa, Mycobacterium
KLREDLLRDFLVERARTCLLYS

SEQ ID NO: 1319703 - protein, 20 aa, Mycobacterium
KLRKIPGWSHVYRVADRLGG

SEQ ID NO: 1319704 - protein, 19 aa, Mycobacterium
KLRYVLVRQELDRPLLTKD

SEQ ID NO: 1319705 - protein, 21 aa, Mycobacterium
KLSADLFRLPMRVLRAVRQTR

SEQ ID NO: 1319706 - protein, 21 aa, Mycobacterium
KLSIYLRHLAPVITAEQLQHE

SEQ ID NO: 1319707 - protein, 23 aa, Mycobacterium
KLSTPYLLILNHIAGIPRLDGAV

SEQ ID NO: 1319708 - protein, 24 aa, Mycobacterium
KLTDLPLTLYSDPAAPGLACLPFV

SEQ ID NO: 1319709 - protein, 20 aa, Mycobacterium
KLTMSIVRFSKFIMDEIFPG

SEQ ID NO: 1319710 - protein, 32 aa, Mycobacterium
KLTRKPFPLFKPKPLFYRQPIYYMSNHLSFVP

SEQ ID NO: 1319711 - protein, 33 aa, Mycobacterium
KLTSGQQDWHRWLWEAWTIDGLAGGRWALAVKM

SEQ ID NO: 1319712 - protein, 18 aa, Mycobacterium
KLVAEWPIRDHIPDPDPI

SEQ ID NO: 1319713 - protein, 17 aa, Mycobacterium
KLVEELWEFTVGDKLWA

SEQ ID NO: 1319714 - protein, 17 aa, Mycobacterium
KLVPYAKRTPRLARTRA

SEQ ID NO: 1319715 - protein, 18 aa, Mycobacterium
KLWDVSLSALYETFGGVM

SEQ ID NO: 1319716 - protein, 19 aa, Mycobacterium
KLWPDYDRRDLWAACEEYV

SEQ ID NO: 1319717 - protein, 17 aa, Mycobacterium
KLYYSELLQRLTDFGAE

SEQ ID NO: 1319718 - protein, 23 aa, Mycobacterium
KMADTAWFVIREQNLRFDWLKDV

SEQ ID NO: 1319719 - protein, 21 aa, Mycobacterium
KMFNVTGWKIGWACGPSDLIA

SEQ ID NO: 1319720 - protein, 19 aa, Mycobacterium
KMGFVFNFITYGGHQVDGV

SEQ ID NO: 1319721 - protein, 20 aa, Mycobacterium
KMNLNHFEAIALVQKIAFSL

SEQ ID NO: 1319722 - protein, 29 aa, Mycobacterium
KMPSQRGWRHWLYVMTRINLGLSADELYE

SEQ ID NO: 1319723 - protein, 27 aa, Mycobacterium
KMRTREHYAWLLAEHIYPTFGAMPVGS

SEQ ID NO: 1319724 - protein, 25 aa, Mycobacterium
KMSRGDWIVFYSPKTAYPDGEPLQA

SEQ ID NO: 1319725 - protein, 21 aa, Mycobacterium
KMYAAPNRRTAHQLASLDVPV

SEQ ID NO: 1319726 - protein, 20 aa, Mycobacterium
KNAEALGAEQRWGIAESRRL

SEQ ID NO: 1319727 - protein, 28 aa, Mycobacterium
KNEAALFRYMKSPLMPIAPASIKAMFAE

SEQ ID NO: 1319728 - protein, 25 aa, Mycobacterium
KNELGLNIGIMPYALGKSGLNQITE

SEQ ID NO: 1319729 - protein, 27 aa, Mycobacterium
KNFVRGVPIWATLISLLHDGVPVVGVV

SEQ ID NO: 1319730 - protein, 23 aa, Mycobacterium
KNLALRHPLAALGFMYSLRSTAY

SEQ ID NO: 1319731 - protein, 22 aa, Mycobacterium
KNLDQLFITAAAYPPEVLLTGV

SEQ ID NO: 1319732 - protein, 23 aa, Mycobacterium
KNLQASLYALMRGYGHAPCAADE

SEQ ID NO: 1319733 - protein, 24 aa, Mycobacterium
KNMKVREFPVFAPVALAGLAGKMP

SEQ ID NO: 1319734 - protein, 31 aa, Mycobacterium
KNPSRVLGLHFFNPVPVLPLVELVNTLVTSD

SEQ ID NO: 1319735 - protein, 21 aa, Mycobacterium
KNQSRWQFGVLGPPGAEQSGV

SEQ ID NO: 1319736 - protein, 20 aa, Mycobacterium
KNRLLLTDLLARHPEIEDIE

SEQ ID NO: 1319737 - protein, 28 aa, Mycobacterium
KNRQLDIALEPILLKLQLPMARNMREEA

SEQ ID NO: 1319738 - protein, 19 aa, Mycobacterium
KNRRLWRNGKPHAVRDAHS

SEQ ID NO: 1319739 - protein, 26 aa, Mycobacterium
KNTDPDVLFLAEAFTRPARLFGLAKL

SEQ ID NO: 1319740 - protein, 25 aa, Mycobacterium
KPAELAFTALWLFDDASEEDREVVR

SEQ ID NO: 1319741 - protein, 17 aa, Mycobacterium
KPAGRLAFSAWARDADN

SEQ ID NO: 1319742 - protein, 27 aa, Mycobacterium
KPAGVPFLWRWHDVYAKLLKSCDVMPE

SEQ ID NO: 1319743 - protein, 23 aa, Mycobacterium
KPAGVPFLWRWQDVHAKLLKSCD

SEQ ID NO: 1319744 - protein, 28 aa, Mycobacterium
KPAQETPLTMLLLAKLMAEAGLPKGVLS

SEQ ID NO: 1319745 - protein, 27 aa, Mycobacterium
KPATVEQIWWHWNYIASRGAWDAPLPT

SEQ ID NO: 1319746 - protein, 26 aa, Mycobacterium
KPEEKPPAPTPPPPPGVPAGWTARPA

SEQ ID NO: 1319747 - protein, 21 aa, Mycobacterium
KPEKLAKFRDAENLTFPLLSD

SEQ ID NO: 1319748 - protein, 21 aa, Mycobacterium
KPFVALRHLRFHSLSALIEAM

SEQ ID NO: 1319749 - protein, 22 aa, Mycobacterium
KPGRGPRRYVCGGELITFDEMI

SEQ ID NO: 1319750 - protein, 17 aa, Mycobacterium
KPGTGPTGSKGGAGGSG

SEQ ID NO: 1319751 - protein, 26 aa, Mycobacterium
KPHHDDWKHWGPGPGRGKWAGAGWDR

SEQ ID NO: 1319752 - protein, 17 aa, Mycobacterium
KPHLFALGIRRGNIHYG

SEQ ID NO: 1319753 - protein, 19 aa, Mycobacterium
KPHRKEGERYQRFTDPMVM

SEQ ID NO: 1319754 - protein, 18 aa, Mycobacterium
KPIDLVVGLLDALQQRNP

SEQ ID NO: 1319755 - protein, 17 aa, Mycobacterium
KPIGKLLTELGGLILGA

SEQ ID NO: 1319756 - protein, 17 aa, Mycobacterium
KPKGALYAFPRLDPEVY

SEQ ID NO: 1319757 - protein, 36 aa, Mycobacterium
KPLGVVGVVTPFNFPIAIPAWKIAPALVYGNTVVWK

SEQ ID NO: 1319758 - protein, 19 aa, Mycobacterium
KPLHEWLEALRTGIDQLTA

SEQ ID NO: 1319759 - protein, 18 aa, Mycobacterium
KPLLEPLGVERIYLDNHF

SEQ ID NO: 1319760 - protein, 20 aa, Mycobacterium
KPNWVIDLHNGGCAAFLLGL

SEQ ID NO: 1319761 - protein, 21 aa, Mycobacterium
KPPNFWAWLIGEVKNTDPDVL

SEQ ID NO: 1319762 - protein, 18 aa, Mycobacterium
KPPYVAAYVLLDGADIPF

SEQ ID NO: 1319763 - protein, 28 aa, Mycobacterium
KPRPGPARPGPRPAVPAAAPVVGTAPTS

SEQ ID NO: 1319764 - protein, 24 aa, Mycobacterium
KPRSAWRRFVYPAPNACWQLDATE

SEQ ID NO: 1319765 - protein, 30 aa, Mycobacterium
KPRVLADYRANYRRYVAPVFADRAVASITA

SEQ ID NO: 1319766 - protein, 26 aa, Mycobacterium
KPSLAWAETYPGTLSYYLASAFGEVW

SEQ ID NO: 1319767 - protein, 31 aa, Mycobacterium
KPSNILVGKFDFTYLIDFGIARPIDDTGLTS

SEQ ID NO: 1319768 - protein, 25 aa, Mycobacterium
KPSPPALTVPWLIGVARHKLADHYR

SEQ ID NO: 1319769 - protein, 25 aa, Mycobacterium
KPSSGFLQMIYTGAPPINVGSRYAA

SEQ ID NO: 1319770 - protein, 23 aa, Mycobacterium
KPTDIHTFAPRAYLADLFYAGEV

SEQ ID NO: 1319771 - protein, 19 aa, Mycobacterium
KPTGWFQVAWSDEIGIGDV

SEQ ID NO: 1319772 - protein, 19 aa, Mycobacterium
KPTIYRRWATKEELISAAM

SEQ ID NO: 1319773 - protein, 17 aa, Mycobacterium
KPVFLMNAAANRDPRAF

SEQ ID NO: 1319774 - protein, 27 aa, Mycobacterium
KPVGLPDWRELLAKLADKAGIPAPVGE

SEQ ID NO: 1319775 - protein, 24 aa, Mycobacterium
KPVIPVPVNCATAPLPTGRRVAEF

SEQ ID NO: 1319776 - protein, 22 aa, Mycobacterium
KPVLVGLRYRPGQTPLLAREWT

SEQ ID NO: 1319777 - protein, 24 aa, Mycobacterium
KPVLVRAQERRKWLPVHPVSRRTW

SEQ ID NO: 1319778 - protein, 30 aa, Mycobacterium
KPVLYQHFTSKVELYLAVLQRHVDNLVSGV

SEQ ID NO: 1319779 - protein, 18 aa, Mycobacterium
KPWVSPDAIPYPFEFQLL

SEQ ID NO: 1319780 - protein, 26 aa, Mycobacterium
KPYTEPPDPWFSDLLHPDGRPYDEDE

SEQ ID NO: 1319781 - protein, 25 aa, Mycobacterium
KQADALMLLYLLSADELREILDRLG

SEQ ID NO: 1319782 - protein, 18 aa, Mycobacterium
KQDRAVAGILEKGPPAAE

SEQ ID NO: 1319783 - protein, 34 aa, Mycobacterium
KQEMLAEDLVALAVLRLGAPVRYEFSRTDEFTVA

SEQ ID NO: 1319784 - protein, 23 aa, Mycobacterium
KQFAGILAAQPYRFAASIELSVR

SEQ ID NO: 1319785 - protein, 28 aa, Mycobacterium
KQGTGFVPPWRLRYRDLGPSYIGTIARA

SEQ ID NO: 1319786 - protein, 20 aa, Mycobacterium
KQHAEFIRQVPLFEQMLVND

SEQ ID NO: 1319787 - protein, 25 aa, Mycobacterium
KQKADLRLVVIDYLQLMTSGKKVES

SEQ ID NO: 1319788 - protein, 18 aa, Mycobacterium
KQLFVFQRTPSSVDERVN

SEQ ID NO: 1319789 - protein, 21 aa, Mycobacterium
KQLHLIVVRSDGQHFAHVHPR

SEQ ID NO: 1319790 - protein, 23 aa, Mycobacterium
KQLTADFNFAWPTARIAVIGAEG

SEQ ID NO: 1319791 - protein, 23 aa, Mycobacterium
KQMADLDLLFAEELCPADDVLGR

SEQ ID NO: 1319792 - protein, 17 aa, Mycobacterium
KQMIRAATLAALAPRPG

SEQ ID NO: 1319793 - protein, 25 aa, Mycobacterium
KQMQGWLDQWGMPGPNAPGGDMGPH

SEQ ID NO: 1319794 - protein, 19 aa, Mycobacterium
KQNVGYFGPTRPPAAEPRG

SEQ ID NO: 1319795 - protein, 19 aa, Mycobacterium
KQQGLTIFLVPMDDPAIQV

SEQ ID NO: 1319796 - protein, 22 aa, Mycobacterium
KQQKEFLLRQQLNAIRKELGEL

SEQ ID NO: 1319797 - protein, 25 aa, Mycobacterium
KQRIGIARALALRPKILALDEPVSA

SEQ ID NO: 1319798 - protein, 17 aa, Mycobacterium
KQRLYLEEWVHLVNESR

SEQ ID NO: 1319799 - protein, 33 aa, Mycobacterium; identical to SEQ ID NO: 829703

SEQ ID NO: 1319800 - protein, 18 aa, Mycobacterium
KQRVGIARALALGPSNLL

SEQ ID NO: 1319801 - protein, 25 aa, Mycobacterium
KQRWGYKFRFGVFRIDDHDFETIRS

SEQ ID NO: 1319802 - protein, 23 aa, Mycobacterium
KQVLVPRTAAVFSAFGISFSDIG

SEQ ID NO: 1319803 - protein, 23 aa, Mycobacterium
KQYGVTPKGWRAAAGDYGKAGSH

SEQ ID NO: 1319804 - protein, 17 aa, Mycobacterium
KQYLTYVGGAPFQPAVA

SEQ ID NO: 1319805 - protein, 25 aa, Mycobacterium
KRDDLQAVIALLKGADLDVALQFVN

SEQ ID NO: 1319806 - protein, 23 aa, Mycobacterium
KRDGGVLPDEAIDWVIDAYTRGQ

SEQ ID NO: 1319807 - protein, 21 aa, Mycobacterium
KRDMGMVFQAYSLFPHLTVLD

SEQ ID NO: 1319808 - protein, 24 aa, Mycobacterium
KREDKPYWWGHFDRVNNPVDEWAD

SEQ ID NO: 1319809 - protein, 21 aa, Mycobacterium
KREIRLLSRFTGANPTVAIVG

SEQ ID NO: 1319810 - protein, 20 aa, Mycobacterium
KRELLDVFVVWERQYYERAI

SEQ ID NO: 1319811 - protein, 19 aa, Mycobacterium
KRELTAAAPAADRPRRDRP

SEQ ID NO: 1319812 - protein, 17 aa, Mycobacterium
KRFPFGIPKPDNANYLW

SEQ ID NO: 1319813 - protein, 17 aa, Mycobacterium
KRGDLLFWGPGGSQHEA

SEQ ID NO: 1319814 - protein, 27 aa, Mycobacterium
KRHAGLSYLLVPLQQPGVEIRPIIQLT

SEQ ID NO: 1319815 - protein, 30 aa, Mycobacterium
KRHHHELGWFARQALRLFDDLRLEHGRLDQ

SEQ ID NO: 1319816 - protein, 23 aa, Mycobacterium
KRHLLAHQWLVDETYLLDAQSYS

SEQ ID NO: 1319817 - protein, 19 aa, Mycobacterium
KRHQITRLGIARTFQNIRL

SEQ ID NO: 1319818 - protein, 22 aa, Mycobacterium
KRIAVRLGPWMEPEQVCFAITR

SEQ ID NO: 1319819 - protein, 27 aa, Mycobacterium
KRIDDPMQQSLIWQQLFGTQFEDMGDA

SEQ ID NO: 1319820 - protein, 19 aa, Mycobacterium
KRKFREALERKNAKAGGGS

SEQ ID NO: 1319821 - protein, 22 aa, Mycobacterium
KRKLQRRYRLAWRVFHRTSIRD

SEQ ID NO: 1319822 - protein, 18 aa, Mycobacterium
KRLAATVTTVPFYDPDKI

SEQ ID NO: 1319823 - protein, 21 aa, Mycobacterium
KRLAVWLVTDPMAVPQIASLG

SEQ ID NO: 1319824 - protein, 19 aa, Mycobacterium
KRLLHGEQEYTFHGDLPAA

SEQ ID NO: 1319825 - protein, 25 aa, Mycobacterium
KRMEIALTYIYGIGRTRSQEILEAT

SEQ ID NO: 1319826 - protein, 17 aa, Mycobacterium
KRMFKPGVDDLVFIGFA

SEQ ID NO: 1319827 - protein, 23 aa, Mycobacterium
KRMPRIAGPCSVVIFGVTGDLAR

SEQ ID NO: 1319828 - protein, 24 aa, Mycobacterium
KRPAFNPTMRLAEDPVFQYRLGQL

SEQ ID NO: 1319829 - protein, 23 aa, Mycobacterium
KRPAIAGPLLRPFFEAYQIVADA

SEQ ID NO: 1319830 - protein, 27 aa, Mycobacterium
KRQHEADTPFFVWFNSTHMHFRTHPKP

SEQ ID NO: 1319831 - protein, 26 aa, Mycobacterium
KRRADVVEIFPNPAAFLRLATAVVIE

SEQ ID NO: 1319832 - protein, 17 aa, Mycobacterium
KRRGAWIGWAGIPDSPE

SEQ ID NO: 1319833 - protein, 19 aa, Mycobacterium
KRRMLYFTATKGLKPRRVN

SEQ ID NO: 1319834 - protein, 28 aa, Mycobacterium
KRRMSYVQRMSKLLARRLWDNAGTPEVD

SEQ ID NO: 1319835 - protein, 27 aa, Mycobacterium
KRTKGQVWLMPHNPAFDPIPGNDAAIL

SEQ ID NO: 1319836 - protein, 21 aa, Mycobacterium
KRTLYKYFDSKDDLLLAVLDS

SEQ ID NO: 1319837 - protein, 23 aa, Mycobacterium
KRTYSVILGVFRNHGHDETVTLA

SEQ ID NO: 1319838 - protein, 18 aa, Mycobacterium
KRVLIARSLMTDPELLLL

SEQ ID NO: 1319839 - protein, 24 aa, Mycobacterium
KRVTKLFESISGLPGFTLYLNVEV

SEQ ID NO: 1319840 - protein, 19 aa, Mycobacterium
KRWVLTHRHTDLQDEFRAR

SEQ ID NO: 1319841 - protein, 23 aa, Mycobacterium
KSAATPWYEGPSLLAHLEEVYIA

SEQ ID NO: 1319842 - protein, 21 aa, Mycobacterium
KSALLLITRITYDQHDTPCEF

SEQ ID NO: 1319843 - protein, 21 aa, Mycobacterium
KSATFPMPGVKPPIGPPDTSS

SEQ ID NO: 1319844 - protein, 17 aa, Mycobacterium
KSELHYLLADSGATALL

SEQ ID NO: 1319845 - protein, 29 aa, Mycobacterium
KSEPEWMLDIRLKALRTFDKKPMPNWGSN

SEQ ID NO: 1319846 - protein, 18 aa, Mycobacterium
KSETLFPGYYKRPDVTAE

SEQ ID NO: 1319847 - protein, 17 aa, Mycobacterium
KSFLPETQWDVLVGLAA

SEQ ID NO: 1319848 - protein, 27 aa, Mycobacterium
KSGKQDFGQWMFYGLGQALVGAAITVD

SEQ ID NO: 1319849 - protein, 28 aa, Mycobacterium
KSGKQDFGQWMFYGLGQALVGAAITVDT

SEQ ID NO: 1319850 - protein, 26 aa, Mycobacterium
KSHNLDQVLDGDLDPLFDALAAADKQ

SEQ ID NO: 1319851 - protein, 19 aa, Mycobacterium
KSHPLYGKIIRTTTKVKAH

SEQ ID NO: 1319852 - protein, 19 aa, Mycobacterium
KSLTFDLTGPLNRKIHVAV

SEQ ID NO: 1319853 - protein, 30 aa, Mycobacterium
KSMPVPMLTFRLWRPLSHDTMEVWSWFLVE

SEQ ID NO: 1319854 - protein, 30 aa, Mycobacterium
KSNALYMDRYPLVSALSRPLIVKHLVDAAR

SEQ ID NO: 1319855 - protein, 24 aa, Mycobacterium
KSNYTRFDALVPGGLYALDSADPK

SEQ ID NO: 1319856 - protein, 22 aa, Mycobacterium
KSPAVFYRYFADKEDLLAALAE

SEQ ID NO: 1319857 - protein, 28 aa, Mycobacterium
KSPEDYQDPWFPFSHPPTEDAPALDMSI

SEQ ID NO: 1319858 - protein, 32 aa, Mycobacterium
KSQFGIQRFFGGLLYWEVWSKLGGPQAQAAND

SEQ ID NO: 1319859 - protein, 23 aa, Mycobacterium
KSRARGLLTGWEPHRRGIYCGTV

SEQ ID NO: 1319860 - protein, 24 aa, Mycobacterium
KSRPAEERSLWQGLAQLAVGITHI

SEQ ID NO: 1319861 - protein, 23 aa, Mycobacterium
KSRPLWEMYLVEGLAKNRIAIYT

SEQ ID NO: 1319862 - protein, 22 aa, Mycobacterium
KSSPPVIDPYLPGAGNFGYRVS

SEQ ID NO: 1319863 - protein, 17 aa, Mycobacterium
KSTIGRRLAKTLQLPLL

SEQ ID NO: 1319864 - protein, 25 aa, Mycobacterium
KSTLARLFNGLVLPDSGAVRVHGLD

SEQ ID NO: 1319865 - protein, 20 aa, Mycobacterium
KSTLFNALTRNDVLAANYPF

SEQ ID NO: 1319866 - protein, 20 aa, Mycobacterium
KSTLLRILAGELEPLDGSVA

SEQ ID NO: 1319867 - protein, 26 aa, Mycobacterium
KSVEEALDILRWAPQSASEPVAKVIA

SEQ ID NO: 1319868 - protein, 26 aa, Mycobacterium
KSVMAQGLMRHLAPTQITALSAGTNA

SEQ ID NO: 1319869 - protein, 33 aa, Mycobacterium
KSVRAWRLPMGFTAWPPWRPGVLFTGDSLGAGK

SEQ ID NO: 1319870 - protein, 18 aa, Mycobacterium
KTAMGWSLPAELIGPALE

SEQ ID NO: 1319871 - protein, 24 aa, Mycobacterium
KTDEEALERLGIGGGFFSFGIMHY

SEQ ID NO: 1319872 - protein, 17 aa, Mycobacterium
KTDIAFLGRDAVERART

SEQ ID NO: 1319873 - protein, 34 aa, Mycobacterium
KTDPPVEGAFYWLSNQEVRWRPAEYWEPGTKVQV

SEQ ID NO: 1319874 - protein, 18 aa, Mycobacterium
KTFLAQIAANYLVGLALA

SEQ ID NO: 1319875 - protein, 24 aa, Mycobacterium
KTGDVLLRYNFPAAGLTDDALRTL

SEQ ID NO: 1319876 - protein, 30 aa, Mycobacterium
KTGIITTRGFRDAILMQRATGHWAGRELHE

SEQ ID NO: 1319877 - protein, 29 aa, Mycobacterium
KTKPAMILGGGMLPAPLLAATVAHTATIK

SEQ ID NO: 1319878 - protein, 17 aa, Mycobacterium
KTLFADGYFLTARDIAW

SEQ ID NO: 1319879 - protein, 27 aa, Mycobacterium
KTLTSVLPAYLNALPGKGVHIVTVNEY

SEQ ID NO: 1319880 - protein, 19 aa, Mycobacterium
KTLVAVEYYFKMPGDLHER

SEQ ID NO: 1319881 - protein, 22 aa, Mycobacterium
KTNGRIGHHFPGAPPSLLLHTV

SEQ ID NO: 1319882 - protein, 24 aa, Mycobacterium
KTQHETIKALFIETLDAADASTRR

SEQ ID NO: 1319883 - protein, 20 aa, Mycobacterium
KTRLWLTAIQEARRRGYRVL

SEQ ID NO: 1319884 - protein, 17 aa, Mycobacterium
KTSMGWSLPAELIGPAL

SEQ ID NO: 1319885 - protein, 22 aa, Mycobacterium
KTTCFNAITGVYRPTSGIVTFD

SEQ ID NO: 1319886 - protein, 20 aa, Mycobacterium
KTTLLERTIRELGAHRPIAV

SEQ ID NO: 1319887 - protein, 21 aa, Mycobacterium
KTTLLERTIRELGAHRPIAVI

SEQ ID NO: 1319888 - protein, 18 aa, Mycobacterium
KTTLLRLVAGFENPDGGT

SEQ ID NO: 1319889 - protein, 20 aa, Mycobacterium
KTTLMLHLNGVLTALQGSVE

SEQ ID NO: 1319890 - protein, 30 aa, Mycobacterium
KTTLSAAILLYIFFTRGEGANVVLFAVDER

SEQ ID NO: 1319891 - protein, 26 aa, Mycobacterium
KTTRRQLLLHLPSPGAWLGAAHEVAG

SEQ ID NO: 1319892 - protein, 26 aa, Mycobacterium
KTTTGGWVFLPRTFTITCRCGSPPPP

SEQ ID NO: 1319893 - protein, 18 aa, Mycobacterium
KTTTLRMIAGFETPTEGA

SEQ ID NO: 1319894 - protein, 22 aa, Mycobacterium
KTTWDKLFIGGQWVAPSTSDVI

SEQ ID NO: 1319895 - protein, 25 aa, Mycobacterium
KTVPPQWLPGPRELRAWTLAAGRPE

SEQ ID NO: 1319896 - protein, 20 aa, Mycobacterium
KTYPVWRLAHPYDPDIAVRL

SEQ ID NO: 1319897 - protein, 23 aa, Mycobacterium
KTYVAALLDRDWRMLIGGDRVAA

SEQ ID NO: 1319898 - protein, 18 aa, Mycobacterium
KTYYLPSEGRRVKLRVSA

SEQ ID NO: 1319899 - protein, 22 aa, Mycobacterium
KVAFPGRMLADRFGLGPSDVCY

SEQ ID NO: 1319900 - protein, 18 aa, Mycobacterium
KVALNMHLSRAALGVLEY

SEQ ID NO: 1319901 - protein, 26 aa, Mycobacterium
KVARFLLGLARRYGEQRFFGSGVLGM

SEQ ID NO: 1319902 - protein, 23 aa, Mycobacterium
KVARFVFGLARRYGPRFFEAGDL

SEQ ID NO: 1319903 - protein, 24 aa, Mycobacterium
KVARRLVGMLARRGYNQTMAFDVV

SEQ ID NO: 1319904 - protein, 20 aa, Mycobacterium
KVAVLPLDSDWVRVAKRFPA

SEQ ID NO: 1319905 - protein, 21 aa, Mycobacterium
KVAVQFRNNPKLRIGFAYGKA

SEQ ID NO: 1319906 - protein, 20 aa, Mycobacterium
KVDDALWKRYSAARETFNRR

SEQ ID NO: 1319907 - protein, 23 aa, Mycobacterium
KVDRTPVFYCKTGIRSAEVLAIV

SEQ ID NO: 1319908 - protein, 19 aa, Mycobacterium
KVEALLQMAAYVETLTAAG

SEQ ID NO: 1319909 - protein, 19 aa, Mycobacterium
KVELSERLVKWQSVYELRN

SEQ ID NO: 1319910 - protein, 27 aa, Mycobacterium
KVGGQFEGFPLLLLTSTGAKSGQPRVN

SEQ ID NO: 1319911 - protein, 17 aa, Mycobacterium
KVGRRFAQISPIVSTYH

SEQ ID NO: 1319912 - protein, 21 aa, Mycobacterium
KVGTRFPGFPDAAISGSYAGC

SEQ ID NO: 1319913 - protein, 25 aa, Mycobacterium
KVGYEIPFTRHFYRYVAPRPLEEIQ

SEQ ID NO: 1319914 - protein, 21 aa, Mycobacterium
KVIDRTALILDIFAQHATSRE

SEQ ID NO: 1319915 - protein, 21 aa, Mycobacterium
KVILDRAIGYAWDDVPVRTDT

SEQ ID NO: 1319916 - protein, 25 aa, Mycobacterium
KVKFDIAIDLSVPLPGFIIKRTIKG

SEQ ID NO: 1319917 - protein, 23 aa, Mycobacterium
KVKGFRNVIHWRVTRYDEPKEIE

SEQ ID NO: 1319918 - protein, 26 aa, Mycobacterium
KVKLDRYLFTSFGYPTDYGYIEDTLG

SEQ ID NO: 1319919 - protein, 17 aa, Mycobacterium
KVLAPLHRLVADILRRG

SEQ ID NO: 1319920 - protein, 21 aa, Mycobacterium
KVLDPGLLDRLLSSTRKPASS

SEQ ID NO: 1319921 - protein, 18 aa, Mycobacterium
KVLGGLVPAVARLHDLDP

SEQ ID NO: 1319922 - protein, 32 aa, Mycobacterium
KVLPTIRSRTHHYPFRLLAPKTMRTLIEKIVA

SEQ ID NO: 1319923 - protein, 17 aa, Mycobacterium
KVLRRFTKLPPDTQTVL

SEQ ID NO: 1319924 - protein, 18 aa, Mycobacterium
KVMPRDFQRVLQATRMAK

SEQ ID NO: 1319925 - protein, 19 aa, Mycobacterium
KVNLLFFTGDAMARPLLDA

SEQ ID NO: 1319926 - protein, 18 aa, Mycobacterium
KVPFAPVPTGWKVPRAWL

SEQ ID NO: 1319927 - protein, 25 aa, Mycobacterium
KVPQKHSVLYFCAERRHYGMGADVA

SEQ ID NO: 1319928 - protein, 18 aa, Mycobacterium
KVPRKIWWADEIQRTPAG

SEQ ID NO: 1319929 - protein, 23 aa, Mycobacterium
KVPRYLPMVVRVDGLAGGVDPVA

SEQ ID NO: 1319930 - protein, 33 aa, Mycobacterium
KVPTTQAFRRIFADRFFYILYFQDRGPADAELA

SEQ ID NO: 1319931 - protein, 20 aa, Mycobacterium
KVPYFSLAMIPGGGRRRAVT

SEQ ID NO: 1319932 - protein, 36 aa, Mycobacterium
KVQHAGPPWFAVSPLMHAAGMWTAFAALLNGQTVIL

SEQ ID NO: 1319933 - protein, 23 aa, Mycobacterium
KVRAPDGFQLPHPPRDSREFHTT

SEQ ID NO: 1319934 - protein, 17 aa, Mycobacterium
KVRDRASFAFALVSVAA

SEQ ID NO: 1319935 - protein, 21 aa, Mycobacterium
KVRFYLYVNQITNNVPFDVSS

SEQ ID NO: 1319936 - protein, 30 aa, Mycobacterium
KVRHSAFYATPLDYLLSRLGVRRIVLTGQV

SEQ ID NO: 1319937 - protein, 18 aa, Mycobacterium
KVRPGVDVLFLDTGYHFV

SEQ ID NO: 1319938 - protein, 20 aa, Mycobacterium
KVSALRRYPVKSMLGEQCDA

SEQ ID NO: 1319939 - protein, 24 aa, Mycobacterium
KVSEDQMFYLMSRGLTEDEAMAMV

SEQ ID NO: 1319940 - protein, 24 aa, Mycobacterium
KVSRWTDYFDPRGLLENLAKLPDV

SEQ ID NO: 1319941 - protein, 26 aa, Mycobacterium
KVVDTNLGGTFFLVQSVLPHMRRTGA

SEQ ID NO: 1319942 - protein, 28 aa, Mycobacterium
KVVGQLMHTLPIGWVEPEDIANAVLFLA

SEQ ID NO: 1319943 - protein, 20 aa, Mycobacterium
KVVIQEWIEGIPLSHIIRDG

SEQ ID NO: 1319944 - protein, 24 aa, Mycobacterium
KVVKGGRRFSFTALVIVGDGKGMV

SEQ ID NO: 1319945 - protein, 24 aa, Mycobacterium
KVVSWYDNEWGYSNRLVDLVGLVG

SEQ ID NO: 1319946 - protein, 25 aa, Mycobacterium
KVVVFRPLYAVGGQDLGYLPGSESE

SEQ ID NO: 1319947 - protein, 25 aa, Mycobacterium
KVYTDEPFVYLLPEGQLPKTGAVIG

SEQ ID NO: 1319948 - protein, 18 aa, Mycobacterium
KWELEDLSFAILHPKKYE

SEQ ID NO: 1319949 - protein, 24 aa, Mycobacterium
KWLTANGVIGFFPANASPGGDDIV

SEQ ID NO: 1319950 - protein, 20 aa, Mycobacterium
KWRCAPMRRASLNSLTVAEK

SEQ ID NO: 1319951 - protein, 19 aa, Mycobacterium
KWREHLYEMDYLREGIGLR

SEQ ID NO: 1319952 - protein, 20 aa, Mycobacterium
KYDGRADEPLLCGVPLSIDT

SEQ ID NO: 1319953 - protein, 21 aa, Mycobacterium
KYEALLMESMRLFNLKGYRDT

SEQ ID NO: 1319954 - protein, 18 aa, Mycobacterium
KYELFAFDLLGFGNSAKP

SEQ ID NO: 1319955 - protein, 26 aa, Mycobacterium
KYGMASLQLYLLSSGFPFLPPSHHIV

SEQ ID NO: 1319956 - protein, 25 aa, Mycobacterium
KYKGACIFLNRPGWPKGIGCALHQK

SEQ ID NO: 1319957 - protein, 18 aa, Mycobacterium
KYNPWSAYGESKLANLLF

SEQ ID NO: 1319958 - protein, 17 aa, Mycobacterium
KYPDFPVVLEAVRECLQ

SEQ ID NO: 1319959 - protein, 18 aa, Mycobacterium
KYRDTVRDFWRGEPATLD

SEQ ID NO: 1319960 - protein, 19 aa, Mycobacterium
KYSGLGRQSLAGKNIALIF

SEQ ID NO: 1319961 - protein, 17 aa, Mycobacterium
KYTHRELPPRRPVPLRL

SEQ ID NO: 1319962 - protein, 19 aa, Mycobacterium
KYVDLDFSGAFRLSGGAGT

SEQ ID NO: 1319963 - protein, 24 aa, Mycobacterium
KYVGDITYLPLATGSNLYMATVID

SEQ ID NO: 1319964 - protein, 17 aa, Mycobacterium
LAAAFQSLLQPAPMPPA

SEQ ID NO: 1319965 - protein, 18 aa, Mycobacterium
LAAAPFLDKDAVREIEAA

SEQ ID NO: 1319966 - protein, 20 aa, Mycobacterium
LAAARRREYRRWLDARCAEL

SEQ ID NO: 1319967 - protein, 23 aa, Mycobacterium
LAAAVAGRLPFYIDGYDAEVVGI

SEQ ID NO: 1319968 - protein, 24 aa, Mycobacterium
LAAAVEFMLTAAFAADARAPASAP

SEQ ID NO: 1319969 - protein, 24 aa, Mycobacterium
LAACKGFTRWYIGDTDLSEPPVTL

SEQ ID NO: 1319970 - protein, 27 aa, Mycobacterium
LAACKSGGLLPFANFNRIHAVPPCNVT

SEQ ID NO: 1319971 - protein, 23 aa, Mycobacterium
LAADAGVPVLLAAASDAAAALDG

SEQ ID NO: 1319972 - protein, 34 aa, Mycobacterium
LAADPDQFWLAIEALRLRHAAVLNPLLAVSSSNV

SEQ ID NO: 1319973 - protein, 19 aa, Mycobacterium
LAAEAAGLARWLLDTATEY

SEQ ID NO: 1319974 - protein, 24 aa, Mycobacterium
LAAELPHIDILVNNLGIFGAVPAR

SEQ ID NO: 1319975 - protein, 27 aa, Mycobacterium
LAAERLAPGARLWWQAGHRSTEPAHTL

SEQ ID NO: 1319976 - protein, 17 aa, Mycobacterium
LAAEVGLAVFRVAFERW

SEQ ID NO: 1319977 - protein, 26 aa, Mycobacterium
LAAEVPDYLLQILARFARSLRESSSI

SEQ ID NO: 1319978 - protein, 26 aa, Mycobacterium
LAAGALTRSALRWNYRRILPDVYVPA

SEQ ID NO: 1319979 - protein, 30 aa, Mycobacterium
LAAGGLNWDSLPLRLFAGGNAKFWDPADID

SEQ ID NO: 1319980 - protein, 24 aa, Mycobacterium
LAAGHLTLVPALRDALAEVGRPDI

SEQ ID NO: 1319981 - protein, 18 aa, Mycobacterium
LAAGLTSPLPFLTADTDG

SEQ ID NO: 1319982 - protein, 24 aa, Mycobacterium
LAAHRRGRRVIVLSKAPEQAGSTA

SEQ ID NO: 1319983 - protein, 21 aa, Mycobacterium
LAAHTPPPTWWTDLDADAVTA

SEQ ID NO: 1319984 - protein, 27 aa, Mycobacterium
LAALELTVPLSITITLAPETWAHEDFD

SEQ ID NO: 1319985 - protein, 25 aa, Mycobacterium
LAALRNWAGFLLGSDIDPVRLAMAR

SEQ ID NO: 1319986 - protein, 19 aa, Mycobacterium
LAALYRRSVTGDGQVVDAA

SEQ ID NO: 1319987 - protein, 17 aa, Mycobacterium
LAAMTWLASGPDLGPWA

SEQ ID NO: 1319988 - protein, 25 aa, Mycobacterium
LAAPLIRRDGVLTEATWDEAFAAVA

SEQ ID NO: 1319989 - protein, 19 aa, Mycobacterium
LAAVPTISYPDLPVSDRRD

SEQ ID NO: 1319990 - protein, 20 aa, Mycobacterium
LAAVPTISYPDLPVSDRRDE

SEQ ID NO: 1319991 - protein, 26 aa, Mycobacterium
LAAWPALQRWRIVPPLWAAARILTNP

SEQ ID NO: 1319992 - protein, 17 aa, Mycobacterium
LAAYCREAIHANADRAG

SEQ ID NO: 1319993 - protein, 23 aa, Mycobacterium
LACRVLAARDLAPGILGHISLRV

SEQ ID NO: 1319994 - protein, 26 aa, Mycobacterium
LACVGGFVPVVLYKDDHDPADDLAGP

SEQ ID NO: 1319995 - protein, 17 aa, Mycobacterium
LACVVHQGLRKLCAWQL

SEQ ID NO: 1319996 - protein, 24 aa, Mycobacterium
LADALLPMHDTPLGPLVPNVTLRQ

SEQ ID NO: 1319997 - protein, 18 aa, Mycobacterium
LADATRVQILWALVSREM

SEQ ID NO: 1319998 - protein, 20 aa, Mycobacterium
LADATRVQVLWALVDREMSV

SEQ ID NO: 1319999 - protein, 17 aa, Mycobacterium
LADCGVPYEVQQPVGVY

SEQ ID NO: 1320000 - protein, 27 aa, Mycobacterium
LADEEIYSFLRLLLPAGVETTYRSLGS

SEQ ID NO: 1320001 - protein, 30 aa, Mycobacterium
LADFTHPGLDRILQWDLRFGMHVVDELSAH

SEQ ID NO: 1320002 - protein, 17 aa, Mycobacterium
LADGRLTRYELRRYHRA

SEQ ID NO: 1320003 - protein, 28 aa, Mycobacterium
LADGYIDIKGLRLTLTQAAWRVSEGLPA

SEQ ID NO: 1320004 - protein, 17 aa, Mycobacterium
LADKQGIQWMLVDSEVE

SEQ ID NO: 1320005 - protein, 31 aa, Mycobacterium
LADKTGQPMWSQWYPGRPLLVTANDYGLGVY

SEQ ID NO: 1320006 - protein, 24 aa, Mycobacterium
LADNILHLVLARPVGVDGVGGPGT

SEQ ID NO: 1320007 - protein, 33 aa, Mycobacterium
LADRLAAGPPLLRKLVWRLPSRVQPKPEAVVWV

SEQ ID NO: 1320008 - protein, 21 aa, Mycobacterium
LADTAFALACNRSAGVMGVTV

SEQ ID NO: 1320009 - protein, 17 aa, Mycobacterium
LADTDAAVILKLGRSYP

SEQ ID NO: 1320010 - protein, 21 aa, Mycobacterium
LADWMVFMLSEAADFLCGSVI

SEQ ID NO: 1320011 - protein, 25 aa, Mycobacterium
LADYKGFRRIAALQYVPLAGGDVSV

SEQ ID NO: 1320012 - protein, 24 aa, Mycobacterium
LAEAAADVFLLPVGDDLVLVQAGD

SEQ ID NO: 1320013 - protein, 28 aa, Mycobacterium
LAEALLNAFFIPLVRLRDTVPGYAVSLV

SEQ ID NO: 1320014 - protein, 26 aa, Mycobacterium
LAEAMIPLAMWGARHQMSHADPCAEA

SEQ ID NO: 1320015 - protein, 27 aa, Mycobacterium
LAEARRAGLYPWIATQKERFVRITPQS

SEQ ID NO: 1320016 - protein, 24 aa, Mycobacterium
LAEARVAVGWWLVGSARAMLSLAR

SEQ ID NO: 1320017 - protein, 24 aa, Mycobacterium
LAEDVELVLLDNFPVWQTQIAVQR

SEQ ID NO: 1320018 - protein, 26 aa, Mycobacterium
LAEELPNGLPPLRLIAGGAESSATSA

SEQ ID NO: 1320019 - protein, 23 aa, Mycobacterium
LAEGRYIGLGFSAYIEPTGAATG

SEQ ID NO: 1320020 - protein, 18 aa, Mycobacterium
LAEGVGALVWSPLGWGRL

SEQ ID NO: 1320021 - protein, 26 aa, Mycobacterium
LAEHAVVLHPGPMLRGMEIAYSVADS

SEQ ID NO: 1320022 - protein, 24 aa, Mycobacterium
LAEHEPFQRFIDRLYSAMLGNETG

SEQ ID NO: 1320023 - protein, 18 aa, Mycobacterium
LAEHHPHLLPLADRTLEP

SEQ ID NO: 1320024 - protein, 26 aa, Mycobacterium
LAEHLKRRWSPSAGGLLVVTHDRWFL

SEQ ID NO: 1320025 - protein, 17 aa, Mycobacterium
LAEHLPDWRPAPGKGGL

SEQ ID NO: 1320026 - protein, 25 aa, Mycobacterium
LAELGIHVHLDWDRGIELISPIPGS

SEQ ID NO: 1320027 - protein, 40 aa, Mycobacterium
LAELKQYDFDYVFIDCPPSLGLLTINALVAAPEVLIPIQC

SEQ ID NO: 1320028 - protein, 32 aa, Mycobacterium
LAELRAARRMGSRSPLLALIADCERGVGRPER

SEQ ID NO: 1320029 - protein, 26 aa, Mycobacterium
LAELWGRSVFHCPFCHGWEVRDRPLA

SEQ ID NO: 1320030 - protein, 17 aa, Mycobacterium
LAEMRVHPGTFGLAGAT

SEQ ID NO: 1320031 - protein, 30 aa, Mycobacterium
LAEPTILGLGLPFFAQSMYMIADGLGLTID

SEQ ID NO: 1320032 - protein, 24 aa, Mycobacterium
LAERFAQPLTFGTAGLRGPLRAGP

SEQ ID NO: 1320033 - protein, 25 aa, Mycobacterium
LAERLMRWTGFPAARVARSALDTLD

SEQ ID NO: 1320034 - protein, 17 aa, Mycobacterium
LAEWRKIIDLNMSRMLE

SEQ ID NO: 1320035 - protein, 18 aa, Mycobacterium
LAEWSERFATLAGPWAPV

SEQ ID NO: 1320036 - protein, 23 aa, Mycobacterium
LAEYLRLNLKPAERNFFVLVEGV

SEQ ID NO: 1320037 - protein, 29 aa, Mycobacterium
LAEYSVDLFALLPLGELWVAAARLRQVER

SEQ ID NO: 1320038 - protein, 18 aa, Mycobacterium
LAFAKLFAEAGFPPGVIN

SEQ ID NO: 1320039 - protein, 26 aa, Mycobacterium
LAFARNPPTVIMLAGLQGSGKTTLAG

SEQ ID NO: 1320040 - protein, 18 aa, Mycobacterium
LAFAVPTMMGEVRRYFRD

SEQ ID NO: 1320041 - protein, 17 aa, Mycobacterium
LAFGRVKDDLRRSQTER

SEQ ID NO: 1320042 - protein, 27 aa, Mycobacterium
LAFKVATHPFFGKLTYVRVYSGKVDSG

SEQ ID NO: 1320043 - protein, 18 aa, Mycobacterium
LAFLLADMAAAVDAARAT

SEQ ID NO: 1320044 - protein, 18 aa, Mycobacterium
LAFRLGHLGSAGIGVGVS

SEQ ID NO: 1320045 - protein, 25 aa, Mycobacterium
LAFYGRRLYELMSAYWPTADKTPDA

SEQ ID NO: 1320046 - protein, 36 aa, Mycobacterium
LAGAFLRAGVIDRILAYVAPILLGGPITAVDDVGVL

SEQ ID NO: 1320047 - protein, 28 aa, Mycobacterium
LAGALDTRAWRLPWLNDTVIYEVEQPAL

SEQ ID NO: 1320048 - protein, 20 aa, Mycobacterium
LAGAPRNAPFRLRVVTRDQF

SEQ ID NO: 1320049 - protein, 33 aa, Mycobacterium
LAGETGCRIVLPEGWNPFVTLFSESAGRVLVAV

SEQ ID NO: 1320050 - protein, 28 aa, Mycobacterium
LAGEWDFVVIAGLQEGLWPNTIPRGGVL

SEQ ID NO: 1320051 - protein, 24 aa, Mycobacterium
LAGFDAWLDSWRALGRDGAAMDRV

SEQ ID NO: 1320052 - protein, 23 aa, Mycobacterium
LAGFSDICVAAFAGFAVVKPQVA

SEQ ID NO: 1320053 - protein, 19 aa, Mycobacterium
LAGIAWETGVLLGICDESP

SEQ ID NO: 1320054 - protein, 37 aa, Mycobacterium
LAGIVEQYVHWAALSGLRRLLFVNGHMGNTAALNTAT

SEQ ID NO: 1320055 - protein, 24 aa, Mycobacterium
LAGKNIALIFEKTSTRTRCAFEVA

SEQ ID NO: 1320056 - protein, 19 aa, Mycobacterium
LAGLAAPWWDSGATASFTG

SEQ ID NO: 1320057 - protein, 18 aa, Mycobacterium
LAGLGKRVLVIGSGGLSH

SEQ ID NO: 1320058 - protein, 17 aa, Mycobacterium
LAGLKVLHPEIEGFSIT

SEQ ID NO: 1320059 - protein, 17 aa, Mycobacterium
LAGLRDYFRDHAYGNAT

SEQ ID NO: 1320060 - protein, 19 aa, Mycobacterium
LAGTQRWCVALSGGADSLA

SEQ ID NO: 1320061 - protein, 28 aa, Mycobacterium
LAGVDALHPGWRYPDPLAPVAAAERAGA

SEQ ID NO: 1320062 - protein, 25 aa, Mycobacterium
LAGWKDTVFIYPQTTVRFAVRFNSY

SEQ ID NO: 1320063 - protein, 17 aa, Mycobacterium
LAGWVARRRDHGGVIFI

SEQ ID NO: 1320064 - protein, 24 aa, Mycobacterium
LAGYKVPRRLVTVDALPVLASGKV

SEQ ID NO: 1320065 - protein, 18 aa, Mycobacterium
LAGYLVSDAYGLDWNVEH

SEQ ID NO: 1320066 - protein, 22 aa, Mycobacterium
LAHHYLWRIRKALPAAGHIGVF

SEQ ID NO: 1320067 - protein, 19 aa, Mycobacterium
LAHPTQVVAVLAALPAWTG

SEQ ID NO: 1320068 - protein, 17 aa, Mycobacterium
LAHYTRLSALDLAPRIR

SEQ ID NO: 1320069 - protein, 17 aa, Mycobacterium
LAIERVELRLLGPEYKS

SEQ ID NO: 1320070 - protein, 18 aa, Mycobacterium
LAIGHYFKRLTALQFEFG

SEQ ID NO: 1320071 - protein, 21 aa, Mycobacterium
LAIRRWCAPVLDLEPLAGADE

SEQ ID NO: 1320072 - protein, 17 aa, Mycobacterium
LAISPDGRYAYLVMTPL

SEQ ID NO: 1320073 - protein, 25 aa, Mycobacterium
LAIVDFALRRRFAFADLAPQFNSSW

SEQ ID NO: 1320074 - protein, 26 aa, Mycobacterium
LAIVDFALRRRFAFADLAPQFNSSWR

SEQ ID NO: 1320075 - protein, 18 aa, Mycobacterium
LAIYNGMIFLSLNAQAPP

SEQ ID NO: 1320076 - protein, 25 aa, Mycobacterium
LAKHGLTMWGYAVLSTLDRSAFRTQ

SEQ ID NO: 1320077 - protein, 17 aa, Mycobacterium
LAKLAVRLEMTAVYLRL

SEQ ID NO: 1320078 - protein, 25 aa, Mycobacterium
LAKRKLFPGLYRLAAAGRLPEEYAI

SEQ ID NO: 1320079 - protein, 18 aa, Mycobacterium
LALALRFRAPDRTLTEDE

SEQ ID NO: 1320080 - protein, 20 aa, Mycobacterium
LALCAATRQVIANGLGILGV

SEQ ID NO: 1320081 - protein, 22 aa, Mycobacterium
LALELGTTVILPAAIRYQTELA

SEQ ID NO: 1320082 - protein, 18 aa, Mycobacterium
LALETGAALLPVHCWFEP

SEQ ID NO: 1320083 - protein, 17 aa, Mycobacterium
LALKPDVVVYNPMWIDV

SEQ ID NO: 1320084 - protein, 20 aa, Mycobacterium
LALLAHNCWQYAVLAFATAR

SEQ ID NO: 1320085 - protein, 20 aa, Mycobacterium
LALLASPLPATAPSIERLFP

SEQ ID NO: 1320086 - protein, 17 aa, Mycobacterium
LALPDLASRAAGGAVVW

SEQ ID NO: 1320087 - protein, 22 aa, Mycobacterium
LALRDRLIVEMLYATGIRVSEL

SEQ ID NO: 1320088 - protein, 30 aa, Mycobacterium
LALRDWLVGHRPPGLPWRPAVTEPNPEQPE

SEQ ID NO: 1320089 - protein, 25 aa, Mycobacterium
LALRLPVRRPFAYEGVFGHLAASAV

SEQ ID NO: 1320090 - protein, 26 aa, Mycobacterium
LALRPDCALWHGAAWDRETVARFLRS

SEQ ID NO: 1320091 - protein, 29 aa, Mycobacterium
LALRQGRLLVPRLLPWSRSGQLAIPRGTD

SEQ ID NO: 1320092 - protein, 29 aa, Mycobacterium
LALSGFVEILPTPFLPAGIFDQWGLDADD

SEQ ID NO: 1320093 - protein, 24 aa, Mycobacterium
LAMDLEFLGRRDLADFFLDEYCRR

SEQ ID NO: 1320094 - protein, 19 aa, Mycobacterium
LAMDLLPYERSTCFWQRIA

SEQ ID NO: 1320095 - protein, 20 aa, Mycobacterium
LAMRRTLWVVGSGDLPVIQS

SEQ ID NO: 1320096 - protein, 23 aa, Mycobacterium
LAMTHAWALEFAKAGIRFNCVQP

SEQ ID NO: 1320097 - protein, 30 aa, Mycobacterium
LAMVAELSKLRLLPFRLSFDGDAEFDTELT

SEQ ID NO: 1320098 - protein, 24 aa, Mycobacterium
LANQRVRMPVPFAQARLLSTIEDK

SEQ ID NO: 1320099 - protein, 17 aa, Mycobacterium
LANTIDQAFLWAREFHV

SEQ ID NO: 1320100 - protein, 24 aa, Mycobacterium
LAPAPVGVFGDLYLSGGPFAQRHR

SEQ ID NO: 1320101 - protein, 22 aa, Mycobacterium
LAPEITALLDQYPLRELITRGR

SEQ ID NO: 1320102 - protein, 21 aa, Mycobacterium
LAPGHPLHDAVLRLTVDRLQD

SEQ ID NO: 1320103 - protein, 20 aa, Mycobacterium
LAPGRFATQEHLKEVSLLFD

SEQ ID NO: 1320104 - protein, 25 aa, Mycobacterium
LAPKDLEKIIYFAAYVITAVDDEMR

SEQ ID NO: 1320105 - protein, 20 aa, Mycobacterium
LAPLHRLVADILRRGIDEGT

SEQ ID NO: 1320106 - protein, 17 aa, Mycobacterium
LAPLTTLRVGPVARRLI

SEQ ID NO: 1320107 - protein, 38 aa, Mycobacterium
LAPQGLEYIIAFYGAMTAGFIAVPLPVPALGQLDERVN

SEQ ID NO: 1320108 - protein, 25 aa, Mycobacterium
LAPQYQQRLWQLPAGEQRLVVELAR

SEQ ID NO: 1320109 - protein, 18 aa, Mycobacterium
LAPRRGEVSLPRLVQAVS

SEQ ID NO: 1320110 - protein, 17 aa, Mycobacterium
LAPRRKTRQLMVRDVGV

SEQ ID NO: 1320111 - protein, 21 aa, Mycobacterium
LAPSCDALRASIWAQLGRPQA

SEQ ID NO: 1320112 - protein, 26 aa, Mycobacterium
LAPVRVDTWGGWLFVNMDPDCEPLAD

SEQ ID NO: 1320113 - protein, 33 aa, Mycobacterium
LAPVTVCTFARFLRQWMTWLAEKDIHEFSAVTD

SEQ ID NO: 1320114 - protein, 27 aa, Mycobacterium
LAQAPTPAKLWILTRNAQPIDEGDRAN

SEQ ID NO: 1320115 - protein, 24 aa, Mycobacterium
LAQDHAGVLRLLNAALLCVDDSRF

SEQ ID NO: 1320116 - protein, 31 aa, Mycobacterium
LAQIDRQLRMNPLPPRIVSAALVMPAPTANS

SEQ ID NO: 1320117 - protein, 23 aa, Mycobacterium
LAQLALAWVLRDPTVASTLVGAS

SEQ ID NO: 1320118 - protein, 24 aa, Mycobacterium
LAQLPWYHHVALLDKLDASDLREW

SEQ ID NO: 1320119 - protein, 20 aa, Mycobacterium
LAQMFGAGCRRLVLASSMVV

SEQ ID NO: 1320120 - protein, 26 aa, Mycobacterium
LAQMWGDAVFHCPFCHGWEVRDAPVA

SEQ ID NO: 1320121 - protein, 20 aa, Mycobacterium
LAQRALRWGPLSQDRLRCAI

SEQ ID NO: 1320122 - protein, 21 aa, Mycobacterium
LARAGVWVPGADLPAVERGGV

SEQ ID NO: 1320123 - protein, 21 aa, Mycobacterium
LARCIIRIESRRYPEPVPAAV

SEQ ID NO: 1320124 - protein, 24 aa, Mycobacterium
LAREHPRIFPVAIAGVLFGHADPA

SEQ ID NO: 1320125 - protein, 17 aa, Mycobacterium
LARFEARIVIDLLLRHT

SEQ ID NO: 1320126 - protein, 26 aa, Mycobacterium
LARFKAPKEFIFVDKVRRLGNGKADY

SEQ ID NO: 1320127 - protein, 17 aa, Mycobacterium
LARFQTWAATALERITR

SEQ ID NO: 1320128 - protein, 23 aa, Mycobacterium
LARHGLGVAILPRSMARGSAGLH

SEQ ID NO: 1320129 - protein, 31 aa, Mycobacterium
LARIFGSEKILPAPVTFVDIAGIVKGASEGA

SEQ ID NO: 1320130 - protein, 19 aa, Mycobacterium
LARILPIGRVLAKRVVAIN

SEQ ID NO: 1320131 - protein, 17 aa, Mycobacterium
LARKGRTLITENAIGLI

SEQ ID NO: 1320132 - protein, 23 aa, Mycobacterium
LARLELRVIFEEILRRHPAAHLA

SEQ ID NO: 1320133 - protein, 18 aa, Mycobacterium
LARLGVLGDRLTVAHAIW

SEQ ID NO: 1320134 - protein, 18 aa, Mycobacterium
LARLLGLSRTAAAAIAEE

SEQ ID NO: 1320135 - protein, 32 aa, Mycobacterium
LARMAAVEAMPYFAKALFALSPVAAPRLKTFA

SEQ ID NO: 1320136 - protein, 31 aa, Mycobacterium
LARMHEAPKYYKWTRQWLDALELKESFYTKP

SEQ ID NO: 1320137 - protein, 17 aa, Mycobacterium
LARMLVAGEDPRFVARR

SEQ ID NO: 1320138 - protein, 19 aa, Mycobacterium
LARMRVSLTATWMRSRVLS

SEQ ID NO: 1320139 - protein, 18 aa, Mycobacterium
LARMTIDLMFNAIADHLP

SEQ ID NO: 1320140 - protein, 24 aa, Mycobacterium
LARQLLDHYAVLIRSALDDPDTTL

SEQ ID NO: 1320141 - protein, 18 aa, Mycobacterium
LARQMFARVPDPVARHLI

SEQ ID NO: 1320142 - protein, 20 aa, Mycobacterium
LARRRLHLRRVPGAAPVIYD

SEQ ID NO: 1320143 - protein, 17 aa, Mycobacterium
LARRRWDRACVDLGSAL

SEQ ID NO: 1320144 - protein, 25 aa, Mycobacterium
LARSLGLALVALRRQIKFVDVTEAV

SEQ ID NO: 1320145 - protein, 19 aa, Mycobacterium
LARTRAWHTDVRGGLLFVW

SEQ ID NO: 1320146 - protein, 23 aa, Mycobacterium
LARVSRSASYWHPSRQPQARWMY

SEQ ID NO: 1320147 - protein, 29 aa, Mycobacterium
LASLPDGALMRRAAFGLATAIARELGAVA

SEQ ID NO: 1320148 - protein, 25 aa, Mycobacterium
LASLPHPTLILAWDTDPLHPVSIAE

SEQ ID NO: 1320149 - protein, 17 aa, Mycobacterium
LASMCFPTFTGFSARHL

SEQ ID NO: 1320150 - protein, 18 aa, Mycobacterium
LASRFNFTLTFTSYTADE

SEQ ID NO: 1320151 - protein, 27 aa, Mycobacterium
LATALSYLPTYPYTQEFIDRGIRGDYM

SEQ ID NO: 1320152 - protein, 28 aa, Mycobacterium
LATGLQPMRWGTGYMLGSKRFGPFGRDA

SEQ ID NO: 1320153 - protein, 28 aa, Mycobacterium
LATGRPPRWVPPIVDQLGFAPMAVCANG

SEQ ID NO: 1320154 - protein, 24 aa, Mycobacterium
LATKKLLFESFARESDMAASAPEA

SEQ ID NO: 1320155 - protein, 26 aa, Mycobacterium
LATLSRVHAPFWDSPRLRDNGDLAWL

SEQ ID NO: 1320156 - protein, 23 aa, Mycobacterium
LATLVRHPALTRAYLHFNAHLLL

SEQ ID NO: 1320157 - protein, 22 aa, Mycobacterium
LATPAFATIAALARVLDLSLDE

SEQ ID NO: 1320158 - protein, 18 aa, Mycobacterium
LATQNRWEFAPPAARSGK

SEQ ID NO: 1320159 - protein, 23 aa, Mycobacterium
LATQYPGILTFGADQPVYPPWYM

SEQ ID NO: 1320160 - protein, 28 aa, Mycobacterium
LATVATTRLVLGPKMRIQAPPNLVSRDE

SEQ ID NO: 1320161 - protein, 17 aa, Mycobacterium
LATYRIAVGKRHKVAPG

SEQ ID NO: 1320162 - protein, 34 aa, Mycobacterium
LAVAAHAWQPRWLKWSLTLIRKGGLDRTGIPTTA

SEQ ID NO: 1320163 - protein, 30 aa, Mycobacterium
LAVAAQFMHVLPVGWVEPVDISNAVLFLAS

SEQ ID NO: 1320164 - protein, 20 aa, Mycobacterium
LAVEEFVSAALWYPTDGADL

SEQ ID NO: 1320165 - protein, 21 aa, Mycobacterium
LAVFGVLIHRYSHVDDFLVAT

SEQ ID NO: 1320166 - protein, 18 aa, Mycobacterium
LAVGAWANQFSVNLAMLY

SEQ ID NO: 1320167 - protein, 21 aa, Mycobacterium
LAVLLAGWCALRKGEVFALRR

SEQ ID NO: 1320168 - protein, 18 aa, Mycobacterium
LAVLPVGYFGASTGAGAA

SEQ ID NO: 1320169 - protein, 19 aa, Mycobacterium
LAVPRSRQSTVRSLIAALA

SEQ ID NO: 1320170 - protein, 19 aa, Mycobacterium
LAVQWARYNVRVNALAPGF

SEQ ID NO: 1320171 - protein, 21 aa, Mycobacterium
LAVRGTRLAIHKTLDLPLLEG

SEQ ID NO: 1320172 - protein, 21 aa, Mycobacterium
LAVTELLYRYAELIDAGDFDG

SEQ ID NO: 1320173 - protein, 31 aa, Mycobacterium
LAVYLAAHLEQLRPGVRLLSDPKGKDLGTMM

SEQ ID NO: 1320174 - protein, 17 aa, Mycobacterium
LAWLVRGDINIGQGWMS

SEQ ID NO: 1320175 - protein, 17 aa, Mycobacterium
LAWMTAVGERTKRLQLG

SEQ ID NO: 1320176 - protein, 18 aa, Mycobacterium
LAYAPYSGFPVGAAALVD

SEQ ID NO: 1320177 - protein, 18 aa, Mycobacterium
LAYASALIRAEQYAQAAS

SEQ ID NO: 1320178 - protein, 30 aa, Mycobacterium
LAYLQAAPVSWRIFLRPPDGAPPQVRARIE

SEQ ID NO: 1320179 - protein, 26 aa, Mycobacterium
LAYPGFELPTLYLQAAGAKLNVLYGS

SEQ ID NO: 1320180 - protein, 22 aa, Mycobacterium
LAYRQWTQFADFPKYMKKVEQV

SEQ ID NO: 1320181 - protein, 23 aa, Mycobacterium
LAYRQWTQFADFPKYMKKVEQVE

SEQ ID NO: 1320182 - protein, 17 aa, Mycobacterium
LAYYDGLTYAQVADRLA

SEQ ID NO: 1320183 - protein, 18 aa, Mycobacterium
LCADACPSITFAMPDPYL

SEQ ID NO: 1320184 - protein, 17 aa, Mycobacterium
LCALIVPALKAHGADHW

SEQ ID NO: 1320185 - protein, 17 aa, Mycobacterium
LCAQIDSVPYPLATPED

SEQ ID NO: 1320186 - protein, 25 aa, Mycobacterium
LCEDIHYLMPVRVTTALAAGYDTSP

SEQ ID NO: 1320187 - protein, 28 aa, Mycobacterium
LCGLITAYHPPVRPEVLFVWQVAVAESA

SEQ ID NO: 1320188 - protein, 23 aa, Mycobacterium
LCGSQLYFEAWASLSTRSLQNRF

SEQ ID NO: 1320189 - protein, 43 aa, Mycobacterium
LCLIHGFMGSAYLFNGLFFSLPWFYRCGYDVMLYTLPFHGRRA

SEQ ID NO: 1320190 - protein, 27 aa, Mycobacterium
LCLRDMGLMLGEYWDLGPLAADCAADG

SEQ ID NO: 1320191 - protein, 26 aa, Mycobacterium
LCNLRCTYCMPAEGLDWLPSDEKLNP

SEQ ID NO: 1320192 - protein, 17 aa, Mycobacterium
LCPQAIVVPPRMSAYSS

SEQ ID NO: 1320193 - protein, 25 aa, Mycobacterium
LCPQNLEYLVAFFGTLYSGRIAVPL

SEQ ID NO: 1320194 - protein, 20 aa, Mycobacterium
LCQLVGPLAFARMTGLRTIT

SEQ ID NO: 1320195 - protein, 19 aa, Mycobacterium
LCRDQPLILAIDDVQWVDV

SEQ ID NO: 1320196 - protein, 26 aa, Mycobacterium
LCRDTCHYCTFVTVPGRLRAEGKGMF

SEQ ID NO: 1320197 - protein, 18 aa, Mycobacterium
LCRHAAGVMLQRGASPAA

SEQ ID NO: 1320198 - protein, 19 aa, Mycobacterium
LCRRRIYHSFNPQGVNIIA

SEQ ID NO: 1320199 - protein, 18 aa, Mycobacterium
LCRRWSPGARLLPASDDR

SEQ ID NO: 1320200 - protein, 26 aa, Mycobacterium
LCRSAGYWALPYPLAERLAKPADLDV

SEQ ID NO: 1320201 - protein, 30 aa, Mycobacterium
LCRSRLVGAALMRLLTTPPGLRVFAGAVTR

SEQ ID NO: 1320202 - protein, 18 aa, Mycobacterium
LCTFRETARILAGLSNPG

SEQ ID NO: 1320203 - protein, 18 aa, Mycobacterium
LCTGVAFPAFPALLAAEQ

SEQ ID NO: 1320204 - protein, 17 aa, Mycobacterium
LCVCDVAWVVGLSQGLV

SEQ ID NO: 1320205 - protein, 17 aa, Mycobacterium
LCVLADPRWDHIQDIGD

SEQ ID NO: 1320206 - protein, 25 aa, Mycobacterium
LCVPMVAVILRRGYGLGAQAMAGGS

SEQ ID NO: 1320207 - protein, 17 aa, Mycobacterium
LDAALAEAALRWGPLSE

SEQ ID NO: 1320208 - protein, 26 aa, Mycobacterium
LDAAQRLGLVPLQWAVASLLADIGAD

SEQ ID NO: 1320209 - protein, 19 aa, Mycobacterium
LDADYWVANVRRPVRLHQA

SEQ ID NO: 1320210 - protein, 18 aa, Mycobacterium
LDAGIAEVAFAVADPDPV

SEQ ID NO: 1320211 - protein, 17 aa, Mycobacterium
LDAGQHWILRIEGWQQA

SEQ ID NO: 1320212 - protein, 20 aa, Mycobacterium
LDAGWLVTTAFFMVDDLYKS

SEQ ID NO: 1320213 - protein, 39 aa, Mycobacterium
LDAIIALPTDMFYNTGIATYIWILDNNKPAKRKGKVQLI

SEQ ID NO: 1320214 - protein, 20 aa, Mycobacterium
LDAKGPIRIWGRCSLRENGT

SEQ ID NO: 1320215 - protein, 26 aa, Mycobacterium
LDALARAGFHTLKLQTYLTAGPKEAR

SEQ ID NO: 1320216 - protein, 17 aa, Mycobacterium
LDALMTVLTIPRLGADR

SEQ ID NO: 1320217 - protein, 22 aa, Mycobacterium
LDALRARWAQLAASPLLENGIR

SEQ ID NO: 1320218 - protein, 19 aa, Mycobacterium
LDALSRRRDAELERGVCLV

SEQ ID NO: 1320219 - protein, 20 aa, Mycobacterium
LDAQFWAHPAHPIPAAAAAA

SEQ ID NO: 1320220 - protein, 17 aa, Mycobacterium
LDARLWVELADALRDLK

SEQ ID NO: 1320221 - protein, 20 aa, Mycobacterium
LDARTWQRLADTVDLIVDPA

SEQ ID NO: 1320222 - protein, 26 aa, Mycobacterium
LDASAFLGRLALIRIYKGRIKKGQQV

SEQ ID NO: 1320223 - protein, 19 aa, Mycobacterium
LDATLLEWTQQGTGAVASI

SEQ ID NO: 1320224 - protein, 18 aa, Mycobacterium
LDAVTFLRSVAAGQPPEL

SEQ ID NO: 1320225 - protein, 17 aa, Mycobacterium
LDAVWGPRWAGSTAKLH

SEQ ID NO: 1320226 - protein, 27 aa, Mycobacterium
LDAYYEDDVHLWDWAAAALIATEAGAH

SEQ ID NO: 1320227 - protein, 18 aa, Mycobacterium
LDDARLFGRDWGFRLADV

SEQ ID NO: 1320228 - protein, 23 aa, Mycobacterium
LDDDAIELFTDRARRARPDFIIS

SEQ ID NO: 1320229 - protein, 28 aa, Mycobacterium
LDDFDLHTMLRLPTGIFYAQGVKANVLF

SEQ ID NO: 1320230 - protein, 29 aa, Mycobacterium
LDDFDLHTMLRLPTGIFYAQGVKANVLFF

SEQ ID NO: 1320231 - protein, 26 aa, Mycobacterium
LDDFLATIAVTRLVMGPKVRIQAPPN

SEQ ID NO: 1320232 - protein, 17 aa, Mycobacterium
LDDGGLPRRATVAALDD

SEQ ID NO: 1320233 - protein, 31 aa, Mycobacterium; identical to SEQ ID NO: 831756

SEQ ID NO: 1320234 - protein, 25 aa, Mycobacterium
LDDLKMRALDVLSRYQQHSTELQAS

SEQ ID NO: 1320235 - protein, 24 aa, Mycobacterium
LDDNACRFLLTRGPAEDTTALGWE

SEQ ID NO: 1320236 - protein, 23 aa, Mycobacterium
LDDPHIRIGLPEVTLGLLPGAGG

SEQ ID NO: 1320237 - protein, 29 aa, Mycobacterium
LDDPTRVIGRLRRPLLTPAADDRDGYVPN

SEQ ID NO: 1320238 - protein, 21 aa, Mycobacterium
LDDRVMPLYIGGRTAASVKEA

SEQ ID NO: 1320239 - protein, 24 aa, Mycobacterium
LDDRVRPRVVQLSTGAWFDPADPA

SEQ ID NO: 1320240 - protein, 24 aa, Mycobacterium
LDDSNPPFYRWFPDAELNTCANTL

SEQ ID NO: 1320241 - protein, 26 aa, Mycobacterium
LDDVEFDGYLFPAGTFVFVNTFAANR

SEQ ID NO: 1320242 - protein, 24 aa, Mycobacterium
LDDVGLLEYRGHELSSFIGDDGTV

SEQ ID NO: 1320243 - protein, 18 aa, Mycobacterium
LDDVLADGDLLIAVCDNA

SEQ ID NO: 1320244 - protein, 28 aa, Mycobacterium
LDDVLRRAVRLLAQLTRQVAVVQYPTLT

SEQ ID NO: 1320245 - protein, 18 aa, Mycobacterium
LDDVVFTALLIAVAGHET

SEQ ID NO: 1320246 - protein, 25 aa, Mycobacterium
LDEALQIIVPMLKGERPTFTGRHYR

SEQ ID NO: 1320247 - protein, 20 aa, Mycobacterium
LDEAYRILRPGGRYAIHELG

SEQ ID NO: 1320248 - protein, 28 aa, Mycobacterium
LDEFFNPHGGFVYLLWGEDPNTPLYVGQ

SEQ ID NO: 1320249 - protein, 21 aa, Mycobacterium
LDEHGLLYLVDRKKDVIITGG

SEQ ID NO: 1320250 - protein, 30 aa, Mycobacterium
LDEHIEFFDGMPIFTVLPVVAAIVDDLMPV

SEQ ID NO: 1320251 - protein, 20 aa, Mycobacterium
LDEIDLSVLGLPLTLLSTNV

SEQ ID NO: 1320252 - protein, 24 aa, Mycobacterium
LDEIRRINPAIIYVAGSGFGSEGP

SEQ ID NO: 1320253 - protein, 25 aa, Mycobacterium
LDEIRRYLSYFPSSAWSYPPSSPAG

SEQ ID NO: 1320254 - protein, 17 aa, Mycobacterium
LDELGYVQIDPRGAELL

SEQ ID NO: 1320255 - protein, 27 aa, Mycobacterium
LDELRRIIPPWVTLGSRLAVLPTPHRT

SEQ ID NO: 1320256 - protein, 26 aa, Mycobacterium
LDENRVPRWWSVRELISAFLHLRDSV

SEQ ID NO: 1320257 - protein, 19 aa, Mycobacterium
LDEQVSVVLTYLSGLVFAF

SEQ ID NO: 1320258 - protein, 31 aa, Mycobacterium
LDESQLVLWGVPRLSILFWSMGDVERAHRLL

SEQ ID NO: 1320259 - protein, 22 aa, Mycobacterium
LDEWNRYLAVNLTGTFLSIRSA

SEQ ID NO: 1320260 - protein, 24 aa, Mycobacterium
LDEYRHWFPTKRADLLAIALDPRE

SEQ ID NO: 1320261 - protein, 20 aa, Mycobacterium
LDFAAVLGDRRIDIGTPTVT

SEQ ID NO: 1320262 - protein, 26 aa, Mycobacterium
LDFAVPTFEQFWRDGSLRLPTERGLT

SEQ ID NO: 1320263 - protein, 22 aa, Mycobacterium
LDFDLLGPLPAPLTTTVLEASA

SEQ ID NO: 1320264 - protein, 23 aa, Mycobacterium
LDFELELGFVLKAPLFNASSAEA

SEQ ID NO: 1320265 - protein, 32 aa, Mycobacterium
LDFPSLTALSDIFYPRVFLRRGAPSPAGTISL

SEQ ID NO: 1320266 - protein, 20 aa, Mycobacterium
LDFSDLRRDGKPLALVDKHS

SEQ ID NO: 1320267 - protein, 27 aa, Mycobacterium
LDGASMWFRSYFGVPSSITAPDGRPVN

SEQ ID NO: 1320268 - protein, 34 aa, Mycobacterium
LDGETHEIRWPRNAKLLDVLLDKGLDAPFSCREG

SEQ ID NO: 1320269 - protein, 17 aa, Mycobacterium
LDGEVIGAFAAWTPPRR

SEQ ID NO: 1320270 - protein, 24 aa, Mycobacterium
LDGGPMRDLLRRMQPTEFNDIVAV

SEQ ID NO: 1320271 - protein, 34 aa, Mycobacterium
LDGLRNNLRRRGERWYWHWDPQFIDGSAANPPIE

SEQ ID NO: 1320272 - protein, 34 aa, Mycobacterium
LDGQTHEVSWPRRAKLLDVLLDKGLDAPFSCREG

SEQ ID NO: 1320273 - protein, 30 aa, Mycobacterium
LDGVIRSRGRLWLANRPGHALWLETAGGGL

SEQ ID NO: 1320274 - protein, 17 aa, Mycobacterium
LDGWVQRMGRSMAVGQR

SEQ ID NO: 1320275 - protein, 23 aa, Mycobacterium
LDGYGLHIIERVPLPVRANAENI

SEQ ID NO: 1320276 - protein, 33 aa, Mycobacterium
LDHDVDDWAWHPMKPLPLHGMRRRRRIDVYEDG

SEQ ID NO: 1320277 - protein, 17 aa, Mycobacterium
LDHFGFGFVMFINGYCA

SEQ ID NO: 1320278 - protein, 23 aa, Mycobacterium
LDHQIWQCPVVLLADVRSVGVQG

SEQ ID NO: 1320279 - protein, 22 aa, Mycobacterium
LDHSVWFHRPFTPHDWHRYEVH

SEQ ID NO: 1320280 - protein, 19 aa, Mycobacterium
LDIASLDLLGWDDVVQLAD

SEQ ID NO: 1320281 - protein, 38 aa, Mycobacterium; identical to SEQ ID NO: 783276

SEQ ID NO: 1320282 - protein, 21 aa, Mycobacterium
LDIELPLARHTISSVGALSFK

SEQ ID NO: 1320283 - protein, 19 aa, Mycobacterium
LDIGAPPQFMDFRYTVHDR

SEQ ID NO: 1320284 - protein, 17 aa, Mycobacterium
LDIGCGWGATLLRALDK

SEQ ID NO: 1320285 - protein, 32 aa, Mycobacterium; identical to SEQ ID NO: 831943

SEQ ID NO: 1320286 - protein, 19 aa, Mycobacterium
LDIGIGWRPFRAAIDGLVD

SEQ ID NO: 1320287 - protein, 24 aa, Mycobacterium
LDILRRPEVMSLLTAWNAGAVLGA

SEQ ID NO: 1320288 - protein, 21 aa, Mycobacterium
LDILVANAGVLSWGRLWEMSE

SEQ ID NO: 1320289 - protein, 27 aa, Mycobacterium
LDIMVTWGHLYISLNQPAIAPPGDAIP

SEQ ID NO: 1320290 - protein, 27 aa, Mycobacterium
LDIMVTWGHLYISLNQPAIAPPGEAIP

SEQ ID NO: 1320291 - protein, 30 aa, Mycobacterium
LDISPLQARCGWAIGWKKDAFWGRDALLAE

SEQ ID NO: 1320292 - protein, 18 aa, Mycobacterium
LDIVVANAGVLSWGRIWE

SEQ ID NO: 1320293 - protein, 22 aa, Mycobacterium
LDKLTKWSSPLLRVGGRMLAIK

SEQ ID NO: 1320294 - protein, 20 aa, Mycobacterium
LDLCDLYAFQSPTDNSRTVL

SEQ ID NO: 1320295 - protein, 21 aa, Mycobacterium
LDLFRSPASAASFVMDPDGAL

SEQ ID NO: 1320296 - protein, 20 aa, Mycobacterium
LDLFRTEPGGLRAGQLAGAI

SEQ ID NO: 1320297 - protein, 29 aa, Mycobacterium
LDLGLRNYWGYNTFGFFAPHYQYAANRNA

SEQ ID NO: 1320298 - protein, 17 aa, Mycobacterium
LDLIQGQASLKGKSFAI

SEQ ID NO: 1320299 - protein, 17 aa, Mycobacterium
LDLLFRGEIPEGVDPAS

SEQ ID NO: 1320300 - protein, 26 aa, Mycobacterium
LDLPAGSILRQVDYFGLGTTVATNAL

SEQ ID NO: 1320301 - protein, 26 aa, Mycobacterium
LDLPHGVINGVLLPHVIRFNAEADPE

SEQ ID NO: 1320302 - protein, 17 aa, Mycobacterium
LDLVGLGAKAAGKYPQE

SEQ ID NO: 1320303 - protein, 20 aa, Mycobacterium
LDLVWPHQQFVPLDGERRRA

SEQ ID NO: 1320304 - protein, 25 aa, Mycobacterium
LDMADKLVTTQYEFIRSVVGSASET

SEQ ID NO: 1320305 - protein, 39 aa, Mycobacterium
LDMAGCSLTVMWLDDELERYWRAPADTPAYRKGAAAVDD

SEQ ID NO: 1320306 - protein, 23 aa, Mycobacterium
LDNFLITDVYLGATSIIVSRPDP

SEQ ID NO: 1320307 - protein, 20 aa, Mycobacterium
LDPALRHLAGARTDLSPPVL

SEQ ID NO: 1320308 - protein, 20 aa, Mycobacterium
LDPALVVALATTLGGPTSHT

SEQ ID NO: 1320309 - protein, 20 aa, Mycobacterium
LDPDALWIDVRRLLTAHTDA

SEQ ID NO: 1320310 - protein, 23 aa, Mycobacterium
LDPETLYRFIKALSSAAKETVRQ

SEQ ID NO: 1320311 - protein, 17 aa, Mycobacterium
LDPFGLENMRYKWRKWL

SEQ ID NO: 1320312 - protein, 21 aa, Mycobacterium
LDPMPGVDWQQIVAVAMVARE

SEQ ID NO: 1320313 - protein, 25 aa, Mycobacterium
LDPMSAALICQLALSRSARLLITAT

SEQ ID NO: 1320314 - protein, 17 aa, Mycobacterium
LDPPGVAVLSLWTQQSY

SEQ ID NO: 1320315 - protein, 25 aa, Mycobacterium
LDPPSGCRFAPRCAFQFDRCDQPPP

SEQ ID NO: 1320316 - protein, 22 aa, Mycobacterium
LDPTVGFFQFGMDSLMSVTLQR

SEQ ID NO: 1320317 - protein, 21 aa, Mycobacterium
LDPYPRFRAYVQQRRHGSQTL

SEQ ID NO: 1320318 - protein, 17 aa, Mycobacterium
LDPYQEGPWLLMAELHE

SEQ ID NO: 1320319 - protein, 21 aa, Mycobacterium
LDQPVQRFWRDAHAGRVHAAN

SEQ ID NO: 1320320 - protein, 20 aa, Mycobacterium
LDQVIDRILPIMNDVAAVDS

SEQ ID NO: 1320321 - protein, 25 aa, Mycobacterium
LDRADGTVLIRRLLREAVVTPVPAT

SEQ ID NO: 1320322 - protein, 30 aa, Mycobacterium
LDRAGELGLVPLRWALASLLADIGSAAYTP

SEQ ID NO: 1320323 - protein, 24 aa, Mycobacterium
LDRDDLHLFEFPKIDADAVDEVLI

SEQ ID NO: 1320324 - protein, 18 aa, Mycobacterium
LDRDVVFGIRAFDLVENR

SEQ ID NO: 1320325 - protein, 24 aa, Mycobacterium
LDRELLGIAEALRASGLSAGIIDA

SEQ ID NO: 1320326 - protein, 25 aa, Mycobacterium
LDRFAALSVIPNMQPLWAQLDALMT

SEQ ID NO: 1320327 - protein, 27 aa, Mycobacterium
LDRGGLLHWARPIAPLILNASSRGGQG

SEQ ID NO: 1320328 - protein, 26 aa, Mycobacterium
LDRLEEIWTTFTKLAPKQLIVDELLY

SEQ ID NO: 1320329 - protein, 24 aa, Mycobacterium
LDRLEPVPVLRRQGVWAVAIAESV

SEQ ID NO: 1320330 - protein, 19 aa, Mycobacterium
LDRLVTTFPFEQFDAAWSA

SEQ ID NO: 1320331 - protein, 19 aa, Mycobacterium
LDRNPVLKAVPPLPESRLP

SEQ ID NO: 1320332 - protein, 23 aa, Mycobacterium
LDRQVQVWLKLEANLFIDIHRTS

SEQ ID NO: 1320333 - protein, 20 aa, Mycobacterium
LDRRGAWLLSSVEHYSRDPF

SEQ ID NO: 1320334 - protein, 18 aa, Mycobacterium
LDRRGLLRRVGGAPYLHT

SEQ ID NO: 1320335 - protein, 23 aa, Mycobacterium
LDRSPLRTVQFPRGFDAAVLERL

SEQ ID NO: 1320336 - protein, 25 aa, Mycobacterium
LDRSRPLWEFYFVEGMADNRFAIIG

SEQ ID NO: 1320337 - protein, 25 aa, Mycobacterium
LDRSRPLWELYYAEGLANNRVAVIG

SEQ ID NO: 1320338 - protein, 25 aa, Mycobacterium
LDRTPTLFIVGGPPLRESETNPLQG

SEQ ID NO: 1320339 - protein, 19 aa, Mycobacterium
LDRVLLPGTAYRPADALQL

SEQ ID NO: 1320340 - protein, 19 aa, Mycobacterium
LDRVRPFRPFQVNADMLAH

SEQ ID NO: 1320341 - protein, 33 aa, Mycobacterium
LDRWWRAANYLSVGQIYLLDNPLLRTPLTRDDV

SEQ ID NO: 1320342 - protein, 19 aa, Mycobacterium
LDRYFDYAEGRLGWRTLDF

SEQ ID NO: 1320343 - protein, 18 aa, Mycobacterium
LDRYKVAPPTTWDEYDEV

SEQ ID NO: 1320344 - protein, 30 aa, Mycobacterium
LDRYVPVLEQLRMRYLEDGSWHGDIVVVSH

SEQ ID NO: 1320345 - protein, 29 aa, Mycobacterium
LDSAFLRPGRFDYIIPVGPPDDAARKAIW

SEQ ID NO: 1320346 - protein, 26 aa, Mycobacterium
LDSATYDGFPIRPLYTGADELAEPAL

SEQ ID NO: 1320347 - protein, 25 aa, Mycobacterium
LDSKWRAHLYEMDYLAAGIGMRALA

SEQ ID NO: 1320348 - protein, 17 aa, Mycobacterium
LDSLMTFPEFPAHQTPS

SEQ ID NO: 1320349 - protein, 18 aa, Mycobacterium
LDSPLLPTIFKYVGKAHV

SEQ ID NO: 1320350 - protein, 24 aa, Mycobacterium
LDSRDYWLQTAGASTLRIAGPEHS

SEQ ID NO: 1320351 - protein, 25 aa, Mycobacterium
LDSWVALGVGPWYVIREMPQRVTYR

SEQ ID NO: 1320352 - protein, 23 aa, Mycobacterium
LDTARAEWWYSRAATVMGGTAEV

SEQ ID NO: 1320353 - protein, 25 aa, Mycobacterium
LDTDEFRLYELIWQRTVASQMADAR

SEQ ID NO: 1320354 - protein, 26 aa, Mycobacterium
LDTINEYSTQFRKFGLDAGEFMTLLS

SEQ ID NO: 1320355 - protein, 22 aa, Mycobacterium
LDTLIKEKWLTANGVIGFFPAN

SEQ ID NO: 1320356 - protein, 24 aa, Mycobacterium
LDTLVNCVGIFDFYRRIQDIPAEL

SEQ ID NO: 1320357 - protein, 29 aa, Mycobacterium
LDTLVNCVGIFDFYRRIQDIPAERIDQAF

SEQ ID NO: 1320358 - protein, 25 aa, Mycobacterium
LDTRAVGTGGFWPYQKAMSRLQADA

SEQ ID NO: 1320359 - protein, 33 aa, Mycobacterium
LDTVIRLTCGRALRLLPLPVEVDLFDGKSDAES

SEQ ID NO: 1320360 - protein, 17 aa, Mycobacterium
LDVAPEFTLALIRDTFP

SEQ ID NO: 1320361 - protein, 20 aa, Mycobacterium
LDVDRPNRLSFTWSHSGWSD

SEQ ID NO: 1320362 - protein, 25 aa, Mycobacterium
LDVFVRNLLRLFENPKTRADLRHGR

SEQ ID NO: 1320363 - protein, 18 aa, Mycobacterium
LDVLVNNAGILRDAFIAG

SEQ ID NO: 1320364 - protein, 22 aa, Mycobacterium
LDVNRHLLKEIQLRMVFGYDMF

SEQ ID NO: 1320365 - protein, 17 aa, Mycobacterium
LDVPRMVYDLPADGRRL

SEQ ID NO: 1320366 - protein, 21 aa, Mycobacterium
LDVTRRPRNILTFSHGAHFCL

SEQ ID NO: 1320367 - protein, 49 aa, Mycobacterium
LDVYQRTAPWLLPRFDRPFTRAEKWAFRNVQGFLRLARAGIYTSREVQV

SEQ ID NO: 1320368 - protein, 19 aa, Mycobacterium
LDVYRMLRVTNPSPYMYLL

SEQ ID NO: 1320369 - protein, 20 aa, Mycobacterium
LDWGPRYYQRIGVSFELPNH

SEQ ID NO: 1320370 - protein, 20 aa, Mycobacterium
LDYTLMFPTLASLVEERLKD

SEQ ID NO: 1320371 - protein, 18 aa, Mycobacterium
LDYVDIFYSHRIDPTTPL

SEQ ID NO: 1320372 - protein, 17 aa, Mycobacterium
LDYWARTSLVVPSIRGA

SEQ ID NO: 1320373 - protein, 30 aa, Mycobacterium; identical to SEQ ID NO: 832287

SEQ ID NO: 1320374 - protein, 30 aa, Mycobacterium
LEAAIEGLILGSYRFTEFRSAKTAPKDGGL

SEQ ID NO: 1320375 - protein, 24 aa, Mycobacterium
LEAFRRGRGTLEWAGVGLVFGPNV

SEQ ID NO: 1320376 - protein, 24 aa, Mycobacterium
LEAGMTAWDLYGGAGVFAAALARG

SEQ ID NO: 1320377 - protein, 33 aa, Mycobacterium
LEAGYHRYEVVRPVPIWQGSIAPAMGQPGGGVQ

SEQ ID NO: 1320378 - protein, 21 aa, Mycobacterium
LEAKPPRPFARKLVNTVRLTS

SEQ ID NO: 1320379 - protein, 18 aa, Mycobacterium
LEALTDTFIPGRVAELRP

SEQ ID NO: 1320380 - protein, 27 aa, Mycobacterium
LEAMRTIGVPVYLLPGNHDPLDASSVY

SEQ ID NO: 1320381 - protein, 28 aa, Mycobacterium
LEANAPVLLGLIGLWYSNFFGAETRAVL

SEQ ID NO: 1320382 - protein, 27 aa, Mycobacterium
LEANMYSTFYDAVLGRLLIAVDQSEQA

SEQ ID NO: 1320383 - protein, 19 aa, Mycobacterium
LEDEDFLELLLPAVRADYQ

SEQ ID NO: 1320384 - protein, 27 aa, Mycobacterium
LEDEPRFHAWIFDMLAGVDLGPDATTD

SEQ ID NO: 1320385 - protein, 27 aa, Mycobacterium
LEDFFVLGHIMTAMPPIHAIPAVVAAA

SEQ ID NO: 1320386 - protein, 23 aa, Mycobacterium
LEDGLKYPARLIDEFTWETDLGD

SEQ ID NO: 1320387 - protein, 33 aa, Mycobacterium; identical to SEQ ID NO: 832347

SEQ ID NO: 1320388 - protein, 33 aa, Mycobacterium
LEDLGYDRRAILERLRALPLAPFRDSYAYTNFG

SEQ ID NO: 1320389 - protein, 19 aa, Mycobacterium
LEELIRPTGFYRNKANSLI

SEQ ID NO: 1320390 - protein, 17 aa, Mycobacterium
LEEVAVLVALGRQLAAV

SEQ ID NO: 1320391 - protein, 22 aa, Mycobacterium
LEEVLRWPTGTIAKLRRGEPTA

SEQ ID NO: 1320392 - protein, 32 aa, Mycobacterium
LEFGDRHRDALPHAPRLTVIGQPRAIEHQRLG

SEQ ID NO: 1320393 - protein, 25 aa, Mycobacterium
LEFGGWTWRYDLVSLGPARTEVTLT

SEQ ID NO: 1320394 - protein, 17 aa, Mycobacterium
LEFIPVQQAVWAAGAVL

SEQ ID NO: 1320395 - protein, 19 aa, Mycobacterium
LEFYLYRETPETAAAKGYR

SEQ ID NO: 1320396 - protein, 17 aa, Mycobacterium
LEGALVLERWGSDGWRF

SEQ ID NO: 1320397 - protein, 24 aa, Mycobacterium
LEGDIYVEMVCRWQGALARILTAF

SEQ ID NO: 1320398 - protein, 31 aa, Mycobacterium
LEGFEGGWPGFFAVLRLYLRDFAGQPAAPVR

SEQ ID NO: 1320399 - protein, 17 aa, Mycobacterium
LEGLARLGDPRVAELAR

SEQ ID NO: 1320400 - protein, 17 aa, Mycobacterium
LEGLGMTVLTIADLLAA

SEQ ID NO: 1320401 - protein, 18 aa, Mycobacterium
LEGLYQIGQLVAGAGIGL

SEQ ID NO: 1320402 - protein, 30 aa, Mycobacterium
LEGNPFALLVGMLLDQQIPMEVAFGGPKKI

SEQ ID NO: 1320403 - protein, 18 aa, Mycobacterium
LEHLLREGPLDPARAVMI

SEQ ID NO: 1320404 - protein, 19 aa, Mycobacterium
LEHNIHFPRFHRDMPSRFA

SEQ ID NO: 1320405 - protein, 19 aa, Mycobacterium
LEIGFLVYCAGADPAFEPF

SEQ ID NO: 1320406 - protein, 17 aa, Mycobacterium
LEITDEGSLWAVLRSRY

SEQ ID NO: 1320407 - protein, 17 aa, Mycobacterium
LEIYRKHGPVYFAESPA

SEQ ID NO: 1320408 - protein, 21 aa, Mycobacterium
LEKALGELDLLVSLDLYVNET

SEQ ID NO: 1320409 - protein, 22 aa, Mycobacterium
LEKDFRARLLTQKPLRCTDFGK

SEQ ID NO: 1320410 - protein, 24 aa, Mycobacterium
LEKRFSPRMRLAVTAALEHYTATF

SEQ ID NO: 1320411 - protein, 17 aa, Mycobacterium
LEKSGGFGTLLLLGHDW

SEQ ID NO: 1320412 - protein, 33 aa, Mycobacterium
LELAEALKILSHRFRYARRTGPVPWKPLLGLSG

SEQ ID NO: 1320413 - protein, 21 aa, Mycobacterium
LELAPLTRKNLEELLAVVCGR

SEQ ID NO: 1320414 - protein, 31 aa, Mycobacterium
LELEPRHLAPGPALVLPLRATDTVAGVLVAL

SEQ ID NO: 1320415 - protein, 28 aa, Mycobacterium
LELLRRRELPVLPVPAPLALQFVHADDV

SEQ ID NO: 1320416 - protein, 17 aa, Mycobacterium
LELMEDAWWGPTVPLVG

SEQ ID NO: 1320417 - protein, 28 aa, Mycobacterium
LELPAFVTPNRVFMAPMTRMRAAQPGDV

SEQ ID NO: 1320418 - protein, 19 aa, Mycobacterium
LELPHLWGGLADLPTGPGA

SEQ ID NO: 1320419 - protein, 18 aa, Mycobacterium
LELPQLWGGLADLADGTA

SEQ ID NO: 1320420 - protein, 17 aa, Mycobacterium
LELRLQLPTPEKAAASE

SEQ ID NO: 1320421 - protein, 24 aa, Mycobacterium
LELVGSELPPPSGPLPPVAAGAAP

SEQ ID NO: 1320422 - protein, 17 aa, Mycobacterium
LEMADRHVLFKYGVKQL

SEQ ID NO: 1320423 - protein, 32 aa, Mycobacterium
LEMDALHVRLGPFLAYWPAGLMLRCALQGDVI

SEQ ID NO: 1320424 - protein, 19 aa, Mycobacterium
LEMEVEILKRASANFAREN

SEQ ID NO: 1320425 - protein, 23 aa, Mycobacterium
LEMSARHPGNIAALARIAVPSIA

SEQ ID NO: 1320426 - protein, 17 aa, Mycobacterium
LENFMIAGLLGIPQATV

SEQ ID NO: 1320427 - protein, 21 aa, Mycobacterium
LENRRIPLGDTVLLVSGRASF

SEQ ID NO: 1320428 - protein, 17 aa, Mycobacterium
LENRRVLDLVRAVEAAA

SEQ ID NO: 1320429 - protein, 27 aa, Mycobacterium
LENRTPIISLQVLHYAPLDLVTPTRDK

SEQ ID NO: 1320430 - protein, 37 aa, Mycobacterium
LEPDIDRAFKQLAKQIRLPGFRPGKAPRKLLEARVGR

SEQ ID NO: 1320431 - protein, 18 aa, Mycobacterium
LEPLGALTAAGIWGTRHA

SEQ ID NO: 1320432 - protein, 18 aa, Mycobacterium
LEPLLRKRRGAWIGWAGI

SEQ ID NO: 1320433 - protein, 19 aa, Mycobacterium
LEPMRPWKAEQLGGGYRIS

SEQ ID NO: 1320434 - protein, 26 aa, Mycobacterium
LEPPERPLPGPLKWDLTTGIATATTQ

SEQ ID NO: 1320435 - protein, 26 aa, Mycobacterium
LEPQVPRRARVAFRWLRAVALERMGD

SEQ ID NO: 1320436 - protein, 26 aa, Mycobacterium
LEPRGLRYLVVINNWDPRDGTYDLNQ

SEQ ID NO: 1320437 - protein, 17 aa, Mycobacterium
LEQAAALARDWFVRHLG

SEQ ID NO: 1320438 - protein, 21 aa, Mycobacterium
LEQFVPIMNVFPDATFIVTHR

SEQ ID NO: 1320439 - protein, 21 aa, Mycobacterium
LEQLRPGVRLLADPSGRDLGA

SEQ ID NO: 1320440 - protein, 25 aa, Mycobacterium
LEQRFDRDLWRKLIDADALSTTAPE

SEQ ID NO: 1320441 - protein, 31 aa, Mycobacterium
LEQSYARRIKALPPQTQLLLLAAAAEPVGDA

SEQ ID NO: 1320442 - protein, 17 aa, Mycobacterium
LEQWGGGGVFVLDETLR

SEQ ID NO: 1320443 - protein, 19 aa, Mycobacterium
LERAGAHHIVWSTLEDTRG

SEQ ID NO: 1320444 - protein, 17 aa, Mycobacterium
LERAWARIAEEVKAGRQ

SEQ ID NO: 1320445 - protein, 19 aa, Mycobacterium
LERAWPRHRRLSGVDDVRS

SEQ ID NO: 1320446 - protein, 26 aa, Mycobacterium
LERDDLPIMFAACSPTLFVQSTEAVL

SEQ ID NO: 1320447 - protein, 29 aa, Mycobacterium
LERDLRATVYGWLAFTFEMCRQRLMDASL

SEQ ID NO: 1320448 - protein, 21 aa, Mycobacterium
LERFDRTIYLFDVELDHEKNR

SEQ ID NO: 1320449 - protein, 18 aa, Mycobacterium
LERFDVPVLAAGGIASGR

SEQ ID NO: 1320450 - protein, 19 aa, Mycobacterium
LERGLVDELGGLRTAIRRA

SEQ ID NO: 1320451 - protein, 23 aa, Mycobacterium
LERILRVTGLLEFLTTRPASLDS

SEQ ID NO: 1320452 - protein, 18 aa, Mycobacterium
LERNVLLNVLDRKWREHL

SEQ ID NO: 1320453 - protein, 20 aa, Mycobacterium
LERPMALPWIQGSGAEVLAS

SEQ ID NO: 1320454 - protein, 18 aa, Mycobacterium
LERRFQRVSYRWVPRAQN

SEQ ID NO: 1320455 - protein, 24 aa, Mycobacterium
LERRGHPYHIVGLPGSDADAAPAE

SEQ ID NO: 1320456 - protein, 22 aa, Mycobacterium
LERRKQICGRAYRILTEEVGFP

SEQ ID NO: 1320457 - protein, 24 aa, Mycobacterium
LERRVAALEWALRGAGAQTEAAPA

SEQ ID NO: 1320458 - protein, 40 aa, Mycobacterium; identical to SEQ ID NO: 115765

SEQ ID NO: 1320459 - protein, 23 aa, Mycobacterium
LERSPLYHELRVPEFAFRSVDGP

SEQ ID NO: 1320460 - protein, 22 aa, Mycobacterium
LERVLATQLLVRRKAHGVSLTA

SEQ ID NO: 1320461 - protein, 18 aa, Mycobacterium
LESSIALDMLLDFMPRYG

SEQ ID NO: 1320462 - protein, 17 aa, Mycobacterium
LESSNAAVLLAGLGLDP

SEQ ID NO: 1320463 - protein, 26 aa, Mycobacterium
LETARPADLLVLLDSLQQREAALNTE

SEQ ID NO: 1320464 - protein, 26 aa, Mycobacterium
LETDVVGRNVLFGRWTFQVVEEFDDS

SEQ ID NO: 1320465 - protein, 23 aa, Mycobacterium
LETEYLHRPLLDGPAPEPVTRPI

SEQ ID NO: 1320466 - protein, 24 aa, Mycobacterium
LETPLWEQSPFTAFLLGDSEIDDI

SEQ ID NO: 1320467 - protein, 20 aa, Mycobacterium
LETVVADDLWPLPTYQEMLY

SEQ ID NO: 1320468 - protein, 24 aa, Mycobacterium
LEVDFDLHGFLGLDDSVRPGAQQI

SEQ ID NO: 1320469 - protein, 18 aa, Mycobacterium
LEVFASGRLPLKFTAYDG

SEQ ID NO: 1320470 - protein, 17 aa, Mycobacterium
LEVGLLRERADLAVSGA

SEQ ID NO: 1320471 - protein, 21 aa, Mycobacterium
LEVHVPQWRFVDGSVGPATRI

SEQ ID NO: 1320472 - protein, 20 aa, Mycobacterium
LEVLAEVGLAPRLSLDPPMN

SEQ ID NO: 1320473 - protein, 17 aa, Mycobacterium
LEVLLRDVPADDLEISE

SEQ ID NO: 1320474 - protein, 29 aa, Mycobacterium
LEVLRKLREQIPGLPLLLLTAKDSVEDRI

SEQ ID NO: 1320475 - protein, 22 aa, Mycobacterium
LEVPTHALVRVIRDFKPHVITT

SEQ ID NO: 1320476 - protein, 19 aa, Mycobacterium
LEVRRGDPTYPGWETLGPT

SEQ ID NO: 1320477 - protein, 23 aa, Mycobacterium
LEVSGLAFKPRFGPRLPIPHLAD

SEQ ID NO: 1320478 - protein, 30 aa, Mycobacterium
LEVTGRLLLAGSAKRRFWWAGTATLGVAKI

SEQ ID NO: 1320479 - protein, 19 aa, Mycobacterium
LEVYSPASPLGAALIDAKV

SEQ ID NO: 1320480 - protein, 25 aa, Mycobacterium
LEVYVLRPCIVAGPKATALADAMPW

SEQ ID NO: 1320481 - protein, 19 aa, Mycobacterium
LEWAEIHGGLHRSGTPAAP

SEQ ID NO: 1320482 - protein, 27 aa, Mycobacterium
LEYLAGEVVKWWLPDDVVFVDELPHTA

SEQ ID NO: 1320483 - protein, 28 aa, Mycobacterium
LFAAMVGPTLRLDPWTTPIPGAYLCSSA

SEQ ID NO: 1320484 - protein, 20 aa, Mycobacterium
LFAQVLMYPGLDRDMAAPSI

SEQ ID NO: 1320485 - protein, 27 aa, Mycobacterium
LFASYARQRPGLLVDWLAGDPADLDDD

SEQ ID NO: 1320486 - protein, 22 aa, Mycobacterium
LFCPDQFLGAHVRRVTGRKNLH

SEQ ID NO: 1320487 - protein, 19 aa, Mycobacterium
LFDDLRLEHGRLDQPIPVG

SEQ ID NO: 1320488 - protein, 17 aa, Mycobacterium
LFDGGAIGPITRSYSDG

SEQ ID NO: 1320489 - protein, 18 aa, Mycobacterium
LFDLVDDPVVRMLLTLHG

SEQ ID NO: 1320490 - protein, 17 aa, Mycobacterium
LFDPVRAALAEYAGLSF

SEQ ID NO: 1320491 - protein, 20 aa, Mycobacterium
LFDTLLVYENFPPGGLVGQA

SEQ ID NO: 1320492 - protein, 18 aa, Mycobacterium
LFEICARLTTKHGLGSSR

SEQ ID NO: 1320493 - protein, 20 aa, Mycobacterium
LFERDKHYIVRNGEVFIVDE

SEQ ID NO: 1320494 - protein, 17 aa, Mycobacterium
LFERGYHDVRLTPLGQR

SEQ ID NO: 1320495 - protein, 31 aa, Mycobacterium
LFGGKQTLRSLPWPAGAWSGARDAPVPPAES

SEQ ID NO: 1320496 - protein, 34 aa, Mycobacterium; identical to SEQ ID NO: 785042

SEQ ID NO: 1320497 - protein, 17 aa, Mycobacterium
LFGHQMRYDLNAGFPLI

SEQ ID NO: 1320498 - protein, 17 aa, Mycobacterium
LFGLFADVRQLLIASEP

SEQ ID NO: 1320499 - protein, 18 aa, Mycobacterium
LFGLIRAGDRIPAYRLSA

SEQ ID NO: 1320500 - protein, 20 aa, Mycobacterium
LFGLVNCAGILRDSFLGELD

SEQ ID NO: 1320501 - protein, 17 aa, Mycobacterium
LFISARTVQYHLSKVFA

SEQ ID NO: 1320502 - protein, 17 aa, Mycobacterium
LFKAWKDEGQIYPDLDL

SEQ ID NO: 1320503 - protein, 17 aa, Mycobacterium
LFLPFREGAAMESGVPT

SEQ ID NO: 1320504 - protein, 26 aa, Mycobacterium
LFNDLTVHFALRTRGRLQQGETLLVH

SEQ ID NO: 1320505 - protein, 30 aa, Mycobacterium
LFNDTHLTRLRLITSLLDRGYNIAHVKEML

SEQ ID NO: 1320506 - protein, 19 aa, Mycobacterium
LFNLRFQMATGQLANNRRL

SEQ ID NO: 1320507 - protein, 18 aa, Mycobacterium
LFPGYYKRPDVTAEMFDE

SEQ ID NO: 1320508 - protein, 19 aa, Mycobacterium
LFQDYLIKMAQVITWFSHD

SEQ ID NO: 1320509 - protein, 26 aa, Mycobacterium
LFRSTGIPVCVWFFAKDKTAGKQGSV

SEQ ID NO: 1320510 - protein, 24 aa, Mycobacterium
LFSAFGMHPVGFYDLREAASPVPV

SEQ ID NO: 1320511 - protein, 34 aa, Mycobacterium
LFSPTRVRRALTVSRLLAPVVVPLVYRASISARG

SEQ ID NO: 1320512 - protein, 23 aa, Mycobacterium
LFSQLGGFAIPGLGPMVTKSPLL

SEQ ID NO: 1320513 - protein, 19 aa, Mycobacterium
LFSRTSAGLAFTPGGLRLA

SEQ ID NO: 1320514 - protein, 29 aa, Mycobacterium
LFSSISGVLGSRWLAHYAATTTFLDTFAF

SEQ ID NO: 1320515 - protein, 19 aa, Mycobacterium
LFTELLPRLDHIELAGTPE

SEQ ID NO: 1320516 - protein, 18 aa, Mycobacterium
LFTRMKTVALTRNVLLPV

SEQ ID NO: 1320517 - protein, 21 aa, Mycobacterium
LFVDIWARYIGSLTRSVPTLL

SEQ ID NO: 1320518 - protein, 18 aa, Mycobacterium
LFWRCWTRRRPPAASLRR

SEQ ID NO: 1320519 - protein, 25 aa, Mycobacterium
LGAAATGVLLLPAGDTWLLVDAAAD

SEQ ID NO: 1320520 - protein, 31 aa, Mycobacterium
LGAALACGPLFGTVYLAIPALVASSQPGDLL

SEQ ID NO: 1320521 - protein, 29 aa, Mycobacterium
LGAALQGFVALPLLAGYDLDDPNPEAAGR

SEQ ID NO: 1320522 - protein, 30 aa, Mycobacterium
LGAAVRRLIVPRLHLIPGMRGKVIDSETPA

SEQ ID NO: 1320523 - protein, 26 aa, Mycobacterium
LGADDYLIKPFAFAELVARVQALGRR

SEQ ID NO: 1320524 - protein, 27 aa, Mycobacterium
LGAGLPKPLQWINRKTHPGLLHPIEPP

SEQ ID NO: 1320525 - protein, 28 aa, Mycobacterium
LGAGQWVKLINNTLFAAQLGMLREAASF

SEQ ID NO: 1320526 - protein, 17 aa, Mycobacterium
LGAHVRRVTGRKNLHVW

SEQ ID NO: 1320527 - protein, 20 aa, Mycobacterium
LGAIYGAEAPVYADSGWTVM

SEQ ID NO: 1320528 - protein, 25 aa, Mycobacterium
LGAKTYRALGWTIASTPAGMRFTND

SEQ ID NO: 1320529 - protein, 27 aa, Mycobacterium
LGALDLKLRHVMQFELKRIQREVGITF

SEQ ID NO: 1320530 - protein, 28 aa, Mycobacterium
LGALGPALIAAWIELVTSAGGGFLPSEG

SEQ ID NO: 1320531 - protein, 17 aa, Mycobacterium
LGALPFDLTAPTALFRP

SEQ ID NO: 1320532 - protein, 23 aa, Mycobacterium
LGALPGLPRIAVHWPLIDFECGP

SEQ ID NO: 1320533 - protein, 25 aa, Mycobacterium
LGALPLAPRNPLPYRQQVRAIRTFH

SEQ ID NO: 1320534 - protein, 17 aa, Mycobacterium
LGALQLLAAQPAELRSA

SEQ ID NO: 1320535 - protein, 18 aa, Mycobacterium
LGALQRDCLALDAAVRAS

SEQ ID NO: 1320536 - protein, 18 aa, Mycobacterium
LGALTAAGIWGTRHAPDF

SEQ ID NO: 1320537 - protein, 19 aa, Mycobacterium
LGAYLDVLVADRCRVPGDD

SEQ ID NO: 1320538 - protein, 24 aa, Mycobacterium
LGCYGLHVMRRFGTPSVLAATAVQ

SEQ ID NO: 1320539 - protein, 18 aa, Mycobacterium
LGDDWPSHILVPAIHRNR

SEQ ID NO: 1320540 - protein, 22 aa, Mycobacterium
LGDPALPHLFFVDGGALAVENA

SEQ ID NO: 1320541 - protein, 18 aa, Mycobacterium
LGDRNRLDYAARFGGRPG

SEQ ID NO: 1320542 - protein, 26 aa, Mycobacterium
LGDRPAVPEVPWTYGRPVGTGGLDLV

SEQ ID NO: 1320543 - protein, 20 aa, Mycobacterium
LGDWLAMDRGRIDDLFGAGT

SEQ ID NO: 1320544 - protein, 25 aa, Mycobacterium
LGEDGWVIDRFLGGNAPLVLSEVER

SEQ ID NO: 1320545 - protein, 18 aa, Mycobacterium
LGEELLGPTLIAYGTPEQ

SEQ ID NO: 1320546 - protein, 32 aa, Mycobacterium
LGEIEGVFTLPEPLPAKMLFISAGSGITPIIS

SEQ ID NO: 1320547 - protein, 29 aa, Mycobacterium
LGEKNNRLWRMNLSYMGYLVPLFEHDARS

SEQ ID NO: 1320548 - protein, 17 aa, Mycobacterium
LGEKVMVARFDQATRRR

SEQ ID NO: 1320549 - protein, 40 aa, Mycobacterium
LGELKHYDFDYVFIDCPPSLGLLTINALVAAPEVLIPIQC

SEQ ID NO: 1320550 - protein, 19 aa, Mycobacterium
LGELLPDAFGPDDLARRAA

SEQ ID NO: 1320551 - protein, 18 aa, Mycobacterium
LGELPAGSVIGTSSPRRA

SEQ ID NO: 1320552 - protein, 20 aa, Mycobacterium
LGEWFWGFQQQDAVPDIVSV

SEQ ID NO: 1320553 - protein, 24 aa, Mycobacterium
LGFPGTPYLHAYTRSMTAWLCVES

SEQ ID NO: 1320554 - protein, 18 aa, Mycobacterium
LGFTLWIAGTPAVTRTLT

SEQ ID NO: 1320555 - protein, 24 aa, Mycobacterium
LGGAVFPTPAVWSPMFARPPDQPG

SEQ ID NO: 1320556 - protein, 24 aa, Mycobacterium
LGGDPRRVLRRAAELLRPGGRCVV

SEQ ID NO: 1320557 - protein, 29 aa, Mycobacterium
LGGGPDPVRVFWPLMSAQLWDTNGAWVAE

SEQ ID NO: 1320558 - protein, 25 aa, Mycobacterium
LGGLSIALLAYRLSLKGEPAPVIDG

SEQ ID NO: 1320559 - protein, 18 aa, Mycobacterium
LGGLWAQGKLADKVYAGF

SEQ ID NO: 1320560 - protein, 21 aa, Mycobacterium
LGGPAALRRTPMQAAAGLAVK

SEQ ID NO: 1320561 - protein, 23 aa, Mycobacterium
LGGPLAHPFQPLLNPRLREFALR

SEQ ID NO: 1320562 - protein, 27 aa, Mycobacterium
LGGSWLLPRIVGLQQAKRLVLLAEMIG

SEQ ID NO: 1320563 - protein, 17 aa, Mycobacterium
LGGTLPINPSGGLIGGG

SEQ ID NO: 1320564 - protein, 26 aa, Mycobacterium
LGGTPMPRALFWAIQEHILGANPAVY

SEQ ID NO: 1320565 - protein, 37 aa, Mycobacterium
LGGTTTKYLIPTAKLPLVQLLPFLAPMEAELKEMVDR

SEQ ID NO: 1320566 - protein, 18 aa, Mycobacterium
LGHLAVKLAAAMGAEVTV

SEQ ID NO: 1320567 - protein, 19 aa, Mycobacterium
LGHPLAPATLRAAPERFHG

SEQ ID NO: 1320568 - protein, 22 aa, Mycobacterium
LGHPQRFIIKANWKSAAEQFAG

SEQ ID NO: 1320569 - protein, 25 aa, Mycobacterium
LGHRGPNWLFFGDQHRAQNFYYRDD

SEQ ID NO: 1320570 - protein, 19 aa, Mycobacterium
LGIDEVIVFPPTGSPALWI

SEQ ID NO: 1320571 - protein, 26 aa, Mycobacterium
LGIGLIDFWRFDEFRDSRLWDHDRVH

SEQ ID NO: 1320572 - protein, 17 aa, Mycobacterium
LGKPGRLEGPDPSLLAA

SEQ ID NO: 1320573 - protein, 23 aa, Mycobacterium
LGKYDIGIAIGLDKHPRGAFTDD

SEQ ID NO: 1320574 - protein, 27 aa, Mycobacterium
LGLAGDGGWWVLGVRDAGFAECLRNVP

SEQ ID NO: 1320575 - protein, 21 aa, Mycobacterium
LGLFAGHYRDDRFWSPAVLDE

SEQ ID NO: 1320576 - protein, 24 aa, Mycobacterium
LGLGEWVVPTLLQHGSAEQIERLM

SEQ ID NO: 1320577 - protein, 26 aa, Mycobacterium
LGLGSYETAWAWLHKLRRAMVRPDRE

SEQ ID NO: 1320578 - protein, 30 aa, Mycobacterium
LGLIQDRELALVGNLMYVREDFTAAMDLLA

SEQ ID NO: 1320579 - protein, 20 aa, Mycobacterium
LGLIRAMEKFDYTKGFKFST

SEQ ID NO: 1320580 - protein, 17 aa, Mycobacterium
LGLIRRVDPGLPNPVEP

SEQ ID NO: 1320581 - protein, 17 aa, Mycobacterium
LGLLELRGFEMPPHHQM

SEQ ID NO: 1320582 - protein, 17 aa, Mycobacterium
LGLNLRNPLVASASPLS

SEQ ID NO: 1320583 - protein, 25 aa, Mycobacterium
LGLPAADWQILLDVPTALAAERAER

SEQ ID NO: 1320584 - protein, 32 aa, Mycobacterium
LGLPQWADLGMYLQTVMLLLRAEGLHSCPQMA

SEQ ID NO: 1320585 - protein, 33 aa, Mycobacterium
LGLPQWADLGMYLQTVMLLLRAEGLHSCPQMAW

SEQ ID NO: 1320586 - protein, 19 aa, Mycobacterium
LGLPVLHFESLDAATVSWC

SEQ ID NO: 1320587 - protein, 20 aa, Mycobacterium
LGLPVVVRPSFTMGGLGSGM

SEQ ID NO: 1320588 - protein, 20 aa, Mycobacterium
LGLRVGWSRPEGRLSIPAGA

SEQ ID NO: 1320589 - protein, 21 aa, Mycobacterium
LGLSYLLPRAIGASRAFEIML

SEQ ID NO: 1320590 - protein, 25 aa, Mycobacterium
LGLTIWPTGFHPAAWRVPGAFSNGN

SEQ ID NO: 1320591 - protein, 27 aa, Mycobacterium
LGLTTNVEFLRFLLADPDVAAGNLDTG

SEQ ID NO: 1320592 - protein, 32 aa, Mycobacterium
LGLVIELMTRRRIFVPILRVTAIEPGAVTLST

SEQ ID NO: 1320593 - protein, 17 aa, Mycobacterium
LGLVLPAELLSVNYAAG

SEQ ID NO: 1320594 - protein, 22 aa, Mycobacterium
LGLVVLEVRRPNRPGWALPGTF

SEQ ID NO: 1320595 - protein, 21 aa, Mycobacterium
LGMATVKWELEDLSFAILHPK

SEQ ID NO: 1320596 - protein, 18 aa, Mycobacterium
LGMKDLLPMAFSECARTV

SEQ ID NO: 1320597 - protein, 20 aa, Mycobacterium
LGMQTEVYPKAIKLLGELAG

SEQ ID NO: 1320598 - protein, 21 aa, Mycobacterium
LGMSQRLGIAAALLGDPPVLL

SEQ ID NO: 1320599 - protein, 21 aa, Mycobacterium
LGMTNVNFWAAGSWAGAAPCG

SEQ ID NO: 1320600 - protein, 19 aa, Mycobacterium
LGMTVLTIADLLAADRVDP

SEQ ID NO: 1320601 - protein, 23 aa, Mycobacterium
LGNFDVVPPTPIQLRNTATLLGW

SEQ ID NO: 1320602 - protein, 24 aa, Mycobacterium
LGNTPLVGLQRLSPDWDGSPHVRL

SEQ ID NO: 1320603 - protein, 20 aa, Mycobacterium
LGNVLPPEQPLATVLTMIEV

SEQ ID NO: 1320604 - protein, 26 aa, Mycobacterium
LGPEAPPLQRLLAYGRERLKFVDSHH

SEQ ID NO: 1320605 - protein, 24 aa, Mycobacterium
LGPHRLRRFVSRIAARIDGAAPAL

SEQ ID NO: 1320606 - protein, 23 aa, Mycobacterium
LGPLARLANRLGGNFRWQHLPVP

SEQ ID NO: 1320607 - protein, 20 aa, Mycobacterium
LGPPVGHVWLSPGSMVELVE

SEQ ID NO: 1320608 - protein, 19 aa, Mycobacterium
LGPVAVFSASNFPLAFSVA

SEQ ID NO: 1320609 - protein, 17 aa, Mycobacterium
LGPVHRKRSLPRPLQRI

SEQ ID NO: 1320610 - protein, 18 aa, Mycobacterium
LGQAHRPLPRTVLRHSRI

SEQ ID NO: 1320611 - protein, 20 aa, Mycobacterium
LGQIPTFPLMLGGSLAHALA

SEQ ID NO: 1320612 - protein, 18 aa, Mycobacterium
LGQSVPGLIRNMIRDRGD

SEQ ID NO: 1320613 - protein, 24 aa, Mycobacterium
LGRKGFPRLLRISAKLPATGSNKV

SEQ ID NO: 1320614 - protein, 33 aa, Mycobacterium
LGRKVVEILPIPPIALHLRTGIAMLSYAGRFSF

SEQ ID NO: 1320615 - protein, 24 aa, Mycobacterium
LGRPIEWVRVPWVDMIPAVQRGDA

SEQ ID NO: 1320616 - protein, 23 aa, Mycobacterium
LGRPVPATYGYVPGRRLAVIEMA

SEQ ID NO: 1320617 - protein, 21 aa, Mycobacterium
LGRQSPLTGLPWVGHRSKSWE

SEQ ID NO: 1320618 - protein, 17 aa, Mycobacterium
LGRSQAQLLRRSVRTFN

SEQ ID NO: 1320619 - protein, 19 aa, Mycobacterium
LGRTWPVICDELLGHYEAV

SEQ ID NO: 1320620 - protein, 17 aa, Mycobacterium
LGRVIAHVLDPKAVKRP

SEQ ID NO: 1320621 - protein, 30 aa, Mycobacterium
LGSDTLLAPLTFISVFGYQAQYAMFEANNI

SEQ ID NO: 1320622 - protein, 25 aa, Mycobacterium
LGSIQKLLHGVARLFGLAQADNVTV

SEQ ID NO: 1320623 - protein, 18 aa, Mycobacterium
LGSKWPDRPSPFERFDEA

SEQ ID NO: 1320624 - protein, 30 aa, Mycobacterium
LGSLHMFFHRLGPVLARRLLLTGDIIRAGE

SEQ ID NO: 1320625 - protein, 23 aa, Mycobacterium
LGSQLAPGPFLSSAAASVVIDRS

SEQ ID NO: 1320626 - protein, 29 aa, Mycobacterium
LGSTGVWELFWPNFPDGGLYKFRVHGADG

SEQ ID NO: 1320627 - protein, 26 aa, Mycobacterium
LGTAYQWIMQAYPYDIAEELAYVRAR

SEQ ID NO: 1320628 - protein, 25 aa, Mycobacterium
LGTDTIDLFQLHRIAPKFPAEDQIG

SEQ ID NO: 1320629 - protein, 20 aa, Mycobacterium
LGTHLYVCGPASFIDFVAAT

SEQ ID NO: 1320630 - protein, 25 aa, Mycobacterium
LGTPKDLHPMQRRFVEAAGFQCGFC

SEQ ID NO: 1320631 - protein, 19 aa, Mycobacterium
LGVALRIAWRALTFAGLRG

SEQ ID NO: 1320632 - protein, 37 aa, Mycobacterium
LGVDSLLALDLRKRFRRVLGRTVPLATLLGGVTGAEL

SEQ ID NO: 1320633 - protein, 27 aa, Mycobacterium
LGVDTNIEFLRFLLTDPDVAAGRLDTG

SEQ ID NO: 1320634 - protein, 20 aa, Mycobacterium
LGVDVSFLRYNDHKIRASRL

SEQ ID NO: 1320635 - protein, 21 aa, Mycobacterium
LGVLERAATAEALLLARLGGS

SEQ ID NO: 1320636 - protein, 18 aa, Mycobacterium
LGVLLSLGRIRRVTASYV

SEQ ID NO: 1320637 - protein, 18 aa, Mycobacterium
LGVLRPRGRLMVVAIWEA

SEQ ID NO: 1320638 - protein, 19 aa, Mycobacterium
LGVNWKIRCDPGTAPASAA

SEQ ID NO: 1320639 - protein, 24 aa, Mycobacterium
LGVSTLLMVIGERPGLSVADSLGI

SEQ ID NO: 1320640 - protein, 17 aa, Mycobacterium
LGVTAIVEFPPAGTLTG

SEQ ID NO: 1320641 - protein, 19 aa, Mycobacterium
LGVTWGGGRQWCFERLFLV

SEQ ID NO: 1320642 - protein, 26 aa, Mycobacterium
LGVVELLERWRPALAAAANAKVVVIG

SEQ ID NO: 1320643 - protein, 19 aa, Mycobacterium
LGVVGVLAVELFETVSGGL

SEQ ID NO: 1320644 - protein, 21 aa, Mycobacterium
LGWNTDAHVELLWSLSRAPDA

SEQ ID NO: 1320645 - protein, 27 aa, Mycobacterium
LGWSRRLAPLMRRWALRHGSPELTVNW

SEQ ID NO: 1320646 - protein, 27 aa, Mycobacterium
LGWVAATWPGLVPEFRRVLPELAPADT

SEQ ID NO: 1320647 - protein, 19 aa, Mycobacterium
LGYADLVFMATTARLKCPF

SEQ ID NO: 1320648 - protein, 20 aa, Mycobacterium
LGYAGVYSSFLRHAEAAAAR

SEQ ID NO: 1320649 - protein, 20 aa, Mycobacterium
LGYDFCAVFLPDEQGRALTI

SEQ ID NO: 1320650 - protein, 29 aa, Mycobacterium
LGYRDPELLAGFWSLVEQLRISAMSAVPT

SEQ ID NO: 1320651 - protein, 20 aa, Mycobacterium
LGYTRYWVAEHHNMPSVAAT

SEQ ID NO: 1320652 - protein, 22 aa, Mycobacterium
LHAAAEELRRLWRARRVLAVTF

SEQ ID NO: 1320653 - protein, 18 aa, Mycobacterium
LHAARLLEKLQAAQAELA

SEQ ID NO: 1320654 - protein, 29 aa, Mycobacterium
LHADVTGTLMLPLGVRLLSAHASMRNAHY

SEQ ID NO: 1320655 - protein, 19 aa, Mycobacterium
LHAFLSGELRRQLQERLDR

SEQ ID NO: 1320656 - protein, 19 aa, Mycobacterium
LHAVPIVRRAMPELHFLVV

SEQ ID NO: 1320657 - protein, 28 aa, Mycobacterium
LHDADTYRWPMVPALALLAAMPALGSAE

SEQ ID NO: 1320658 - protein, 27 aa, Mycobacterium
LHDALMRLFRVLFEPWERHPAMLAAYF

SEQ ID NO: 1320659 - protein, 24 aa, Mycobacterium
LHDATLYYTVLGRSLDEEPDYEGA

SEQ ID NO: 1320660 - protein, 31 aa, Mycobacterium
LHDCFSANELLLYEALGLCGPGEAPALIDAD

SEQ ID NO: 1320661 - protein, 26 aa, Mycobacterium
LHDHVIQRLFAVGLALQGTIPRARAP

SEQ ID NO: 1320662 - protein, 24 aa, Mycobacterium
LHDRLPKVAALFAAGRLSTRLIGQ

SEQ ID NO: 1320663 - protein, 25 aa, Mycobacterium
LHDRWQRDPWLTTAMTRAFAVADTR

SEQ ID NO: 1320664 - protein, 18 aa, Mycobacterium
LHDSAIAVLRRFGRSDHL

SEQ ID NO: 1320665 - protein, 23 aa, Mycobacterium
LHEAVRRWPTFVPAALDGGFASV

SEQ ID NO: 1320666 - protein, 23 aa, Mycobacterium
LHFESILIRGLMNYAFWVPNGSP

SEQ ID NO: 1320667 - protein, 31 aa, Mycobacterium
LHGEPSWSYLYRRMIPVLVDAGLRAVAIDLV

SEQ ID NO: 1320668 - protein, 17 aa, Mycobacterium
LHGLWRAPDAQNHRFNS

SEQ ID NO: 1320669 - protein, 20 aa, Mycobacterium
LHGMRRLTVAAVPYLRAGQG

SEQ ID NO: 1320670 - protein, 20 aa, Mycobacterium
LHGVPVVGGVQYAPVIRPGK

SEQ ID NO: 1320671 - protein, 17 aa, Mycobacterium
LHHFPTKRMCNLASVTS

SEQ ID NO: 1320672 - protein, 22 aa, Mycobacterium
LHHPQALIAKAWMVAARGGERT

SEQ ID NO: 1320673 - protein, 20 aa, Mycobacterium
LHHTLFGGPPEGRRTWMADV

SEQ ID NO: 1320674 - protein, 26 aa, Mycobacterium
LHHTPRHTVLLLSTDQARLLHGHGAT

SEQ ID NO: 1320675 - protein, 30 aa, Mycobacterium; identical to SEQ ID NO: 833645

SEQ ID NO: 1320676 - protein, 27 aa, Mycobacterium
LHILEVQRLIRFMPKPVICLVNGWAAG

SEQ ID NO: 1320677 - protein, 22 aa, Mycobacterium
LHILRGHVPTVDRGRILGHEAV

SEQ ID NO: 1320678 - protein, 18 aa, Mycobacterium
LHLAECNWLVQKGPIAKL

SEQ ID NO: 1320679 - protein, 17 aa, Mycobacterium
LHLAFSCYLFDDAGRVL

SEQ ID NO: 1320680 - protein, 18 aa, Mycobacterium
LHNALMKSAIGLYKTELI

SEQ ID NO: 1320681 - protein, 23 aa, Mycobacterium
LHPADVPFFVTLCKKPGKPVNFV

SEQ ID NO: 1320682 - protein, 25 aa, Mycobacterium
LHPALKYYHPFDGDGMLHIVGFRDG

SEQ ID NO: 1320683 - protein, 20 aa, Mycobacterium
LHPAWPLAMSVAHRDEFADA

SEQ ID NO: 1320684 - protein, 17 aa, Mycobacterium
LHPFGRFDKTAMQMGAE

SEQ ID NO: 1320685 - protein, 17 aa, Mycobacterium
LHPGFAASWERLREVTA

SEQ ID NO: 1320686 - protein, 20 aa, Mycobacterium
LHPGWPMPAGPLRVPAGVVR

SEQ ID NO: 1320687 - protein, 18 aa, Mycobacterium
LHPTVIPNGVRADRFVAA

SEQ ID NO: 1320688 - protein, 22 aa, Mycobacterium
LHPYRVRHLLDRYGSLIGEVLK

SEQ ID NO: 1320689 - protein, 22 aa, Mycobacterium
LHPYRVRHLLDRYGSLISEVLA

SEQ ID NO: 1320690 - protein, 26 aa, Mycobacterium
LHQKAGLRLIVIDYLQLMTSGKKVES

SEQ ID NO: 1320691 - protein, 22 aa, Mycobacterium
LHQKWFNLYDEATRVPFVIARV

SEQ ID NO: 1320692 - protein, 21 aa, Mycobacterium
LHRIRKRAKQLRYTAAAIGEN

SEQ ID NO: 1320693 - protein, 17 aa, Mycobacterium
LHRITGGNAFFVCEMLD

SEQ ID NO: 1320694 - protein, 21 aa, Mycobacterium
LHRKAAEVGLLGAGFPESVGG

SEQ ID NO: 1320695 - protein, 20 aa, Mycobacterium
LHRQTRELVPFIDLVNEFGV

SEQ ID NO: 1320696 - protein, 18 aa, Mycobacterium
LHRRLLIISDTVEHWMDT

SEQ ID NO: 1320697 - protein, 17 aa, Mycobacterium
LHSHKSLGALIAQLGRY

SEQ ID NO: 1320698 - protein, 19 aa, Mycobacterium
LHSLTYAYRDRRARKGEFR

SEQ ID NO: 1320699 - protein, 27 aa, Mycobacterium
LHVPARADIRLWSFLTRFAANCRRSSW

SEQ ID NO: 1320700 - protein, 20 aa, Mycobacterium
LHVQSIPLWEKVFDDLDGPG

SEQ ID NO: 1320701 - protein, 23 aa, Mycobacterium
LHVVEVLVGENFTFGKKAAGNVD

SEQ ID NO: 1320702 - protein, 19 aa, Mycobacterium
LHWLAALADRYDPSRVLAT

SEQ ID NO: 1320703 - protein, 17 aa, Mycobacterium
LIAALPSPPRPVTPAHA

SEQ ID NO: 1320704 - protein, 24 aa, Mycobacterium
LIAERGLTLIGFAVCNIDREGAQQ

SEQ ID NO: 1320705 - protein, 21 aa, Mycobacterium
LIAGRTYEVRPLRGGFTINVL

SEQ ID NO: 1320706 - protein, 17 aa, Mycobacterium
LIANGRIADVVDAQGKR

SEQ ID NO: 1320707 - protein, 20 aa, Mycobacterium
LIARIRAVLRRGSDADDAGI

SEQ ID NO: 1320708 - protein, 26 aa, Mycobacterium
LIARWLTSPGVRIVRCEPGYATPIGA

SEQ ID NO: 1320709 - protein, 28 aa, Mycobacterium
LIASTPITALPLFAGWRAMPFAEDAPAR

SEQ ID NO: 1320710 - protein, 18 aa, Mycobacterium
LICGVARHLGFGDAFDYK

SEQ ID NO: 1320711 - protein, 18 aa, Mycobacterium
LIDAAQARWRAVNAPHLV

SEQ ID NO: 1320712 - protein, 23 aa, Mycobacterium
LIDCPPSLGVLTLNGLTAADDVI

SEQ ID NO: 1320713 - protein, 25 aa, Mycobacterium
LIDCPPSLGVLTLNGLTAAHEVIVP

SEQ ID NO: 1320714 - protein, 36 aa, Mycobacterium
LIDEQLDLFPALKELLGRRAGLLSGGQRQQLAIARA

SEQ ID NO: 1320715 - protein, 30 aa, Mycobacterium; identical to SEQ ID NO: 833840

SEQ ID NO: 1320716 - protein, 25 aa, Mycobacterium
LIDGLFNPERFLQLVRNFTAFDAGA

SEQ ID NO: 1320717 - protein, 29 aa, Mycobacterium
LIDLGSCFGFFPLRLARYGIDVLATDLND

SEQ ID NO: 1320718 - protein, 18 aa, Mycobacterium
LIDQGIAPGLARWMIVEL

SEQ ID NO: 1320719 - protein, 25 aa, Mycobacterium
LIDSSLATILVLDSLRLGRPVEFGE

SEQ ID NO: 1320720 - protein, 18 aa, Mycobacterium
LIDTFEWERVLDGGGLFG

SEQ ID NO: 1320721 - protein, 18 aa, Mycobacterium
LIELLAGTGMRIGEALGL

SEQ ID NO: 1320722 - protein, 17 aa, Mycobacterium
LIELWQDGEIRTNATAV

SEQ ID NO: 1320723 - protein, 19 aa, Mycobacterium
LIEPRVDLWARVLRRQPLP

SEQ ID NO: 1320724 - protein, 18 aa, Mycobacterium
LIERFANPGVRDTIARLC

SEQ ID NO: 1320725 - protein, 17 aa, Mycobacterium
LIERPPDLTAEWLTAVI

SEQ ID NO: 1320726 - protein, 17 aa, Mycobacterium
LIETFFTDNDHLLAFQD

SEQ ID NO: 1320727 - protein, 19 aa, Mycobacterium
LIGDRLPMDKVLAGVQEIV

SEQ ID NO: 1320728 - protein, 17 aa, Mycobacterium
LIGLLRGHGGQALVWGR

SEQ ID NO: 1320729 - protein, 18 aa, Mycobacterium
LIGLSLLERLAVPEGLDD

SEQ ID NO: 1320730 - protein, 17 aa, Mycobacterium
LIGRDLLTQLGVRSGIH

SEQ ID NO: 1320731 - protein, 22 aa, Mycobacterium
LIGRTSAVMWDVHRKDPALLTP

SEQ ID NO: 1320732 - protein, 24 aa, Mycobacterium
LIHEYQVALPLHPEYRTMPMVWYI

SEQ ID NO: 1320733 - protein, 17 aa, Mycobacterium
LIHMDDPLHRDIRKIGA

SEQ ID NO: 1320734 - protein, 18 aa, Mycobacterium
LIHNAGIVRRAPLAEMTY

SEQ ID NO: 1320735 - protein, 18 aa, Mycobacterium
LIHTVRGFGYTLRRADRD

SEQ ID NO: 1320736 - protein, 17 aa, Mycobacterium
LIIDPNPMFVERALGLL

SEQ ID NO: 1320737 - protein, 19 aa, Mycobacterium
LIKDAFELETLPPAPVKGV

SEQ ID NO: 1320738 - protein, 38 aa, Mycobacterium
LILAPQGLEYILAFLGSMQAGLVAVPLPLPHPGSGHDR

SEQ ID NO: 1320739 - protein, 17 aa, Mycobacterium
LILEEVHGLRNIPVCER

SEQ ID NO: 1320740 - protein, 19 aa, Mycobacterium
LILGIGSGWKRKDYDEYGY

SEQ ID NO: 1320741 - protein, 17 aa, Mycobacterium
LILLSDVDGLYDSDPRK

SEQ ID NO: 1320742 - protein, 18 aa, Mycobacterium
LILVQPEDRPALKKAGFL

SEQ ID NO: 1320743 - protein, 17 aa, Mycobacterium
LIMLPDSQSALVAERTT

SEQ ID NO: 1320744 - protein, 18 aa, Mycobacterium
LINAWYHDADLLGVMRNC

SEQ ID NO: 1320745 - protein, 18 aa, Mycobacterium
LIPAFIEELLRVDGPVPF

SEQ ID NO: 1320746 - protein, 25 aa, Mycobacterium
LIPAFLEEVLRFEPPFRGHYRHVVR

SEQ ID NO: 1320747 - protein, 18 aa, Mycobacterium
LIPDEWLAPSATGSPQQC

SEQ ID NO: 1320748 - protein, 22 aa, Mycobacterium
LIPEIAAFWVPYIQAAVDRGEI

SEQ ID NO: 1320749 - protein, 18 aa, Mycobacterium
LIPRPQRMYLRFAEPIDT

SEQ ID NO: 1320750 - protein, 19 aa, Mycobacterium
LIRAMEKFDYAKGFKFSTY

SEQ ID NO: 1320751 - protein, 18 aa, Mycobacterium
LIRAMEKFDYTKGFKFST

SEQ ID NO: 1320752 - protein, 17 aa, Mycobacterium
LIRAVEKFDYTKGYKFS

SEQ ID NO: 1320753 - protein, 19 aa, Mycobacterium
LIRERLTRSWAGLKAMRSY

SEQ ID NO: 1320754 - protein, 18 aa, Mycobacterium
LIRPAYSRVLLKLGGEMF

SEQ ID NO: 1320755 - protein, 23 aa, Mycobacterium
LIRSSPVPVLLVGPGGASERPRV

SEQ ID NO: 1320756 - protein, 17 aa, Mycobacterium
LIRVFADATDRLADAIV

SEQ ID NO: 1320757 - protein, 24 aa, Mycobacterium
LISALPLFPYMDIHVTPLARHPSD

SEQ ID NO: 1320758 - protein, 23 aa, Mycobacterium
LISIADLIEWRRKHEKHIARVAE

SEQ ID NO: 1320759 - protein, 19 aa, Mycobacterium
LISPWGTWEWLGPNIVGGV

SEQ ID NO: 1320760 - protein, 22 aa, Mycobacterium
LISPWGTWEWMGPAAIGADLPA

SEQ ID NO: 1320761 - protein, 42 aa, Mycobacterium
LITGIGSDFTLWEWIHTLIRPVDPHLDRRKAYLGTMVAGIQM

SEQ ID NO: 1320762 - protein, 31 aa, Mycobacterium
LITGQFLEIDRPQLLRFTWSTSNWADPTIVS

SEQ ID NO: 1320763 - protein, 22 aa, Mycobacterium
LITHTQLPDMPFYGAGGGMAHR

SEQ ID NO: 1320764 - protein, 17 aa, Mycobacterium
LIVDFVKARGLTAIVKG

SEQ ID NO: 1320765 - protein, 19 aa, Mycobacterium
LIVLLDDVGFGASSAFGGP

SEQ ID NO: 1320766 - protein, 19 aa, Mycobacterium
LKAAYPQLNPRYLFLGLKN

SEQ ID NO: 1320767 - protein, 19 aa, Mycobacterium
LKAITLRPRRPAGCTAADY

SEQ ID NO: 1320768 - protein, 35 aa, Mycobacterium
LKAMLRFAPEAIRRPRWLLEFARSGRVPDLTAPNL

SEQ ID NO: 1320769 - protein, 25 aa, Mycobacterium
LKATVALPLWAAFVSALDPRWGSKT

SEQ ID NO: 1320770 - protein, 24 aa, Mycobacterium
LKDAADLTLFLLDQDGPEPDDTER

SEQ ID NO: 1320771 - protein, 25 aa, Mycobacterium
LKDAADLTLFLLDQDGPEPDDTERA

SEQ ID NO: 1320772 - protein, 22 aa, Mycobacterium
LKDFADRRFVPPGGLGLATGGY

SEQ ID NO: 1320773 - protein, 21 aa, Mycobacterium
LKDWRLRIAKEMNVPAYVVFT

SEQ ID NO: 1320774 - protein, 24 aa, Mycobacterium
LKEAADLTLFLLDQDGPEPDDTER

SEQ ID NO: 1320775 - protein, 25 aa, Mycobacterium
LKEGERLWLSWAMANRDPALFQNPD

SEQ ID NO: 1320776 - protein, 25 aa, Mycobacterium
LKEVLPNFPAYYHLVGNVDIRISGD

SEQ ID NO: 1320777 - protein, 23 aa, Mycobacterium
LKGADLLKFRRRVQMVFQDPYAS

SEQ ID NO: 1320778 - protein, 24 aa, Mycobacterium
LKGHPLFAHITLLRSERSPIAALV

SEQ ID NO: 1320779 - protein, 18 aa, Mycobacterium
LKGLAELLERVSVPIHVN

SEQ ID NO: 1320780 - protein, 24 aa, Mycobacterium
LKKHFRPEFLNRIDDIIVFHQLTQ

SEQ ID NO: 1320781 - protein, 19 aa, Mycobacterium
LKLINHPVRERIPITIAAL

SEQ ID NO: 1320782 - protein, 17 aa, Mycobacterium
LKLVLLENPGNGGSINH

SEQ ID NO: 1320783 - protein, 17 aa, Mycobacterium
LKMHTLGMDFVPDPIHA

SEQ ID NO: 1320784 - protein, 18 aa, Mycobacterium
LKNAYIAHREAYQRIFDL

SEQ ID NO: 1320785 - protein, 19 aa, Mycobacterium
LKNLFGAAIGPLLNGIAGT

SEQ ID NO: 1320786 - protein, 18 aa, Mycobacterium
LKPALGRFGVWTGAPVSP

SEQ ID NO: 1320787 - protein, 17 aa, Mycobacterium
LKPDQTRWRTAVEKVLR

SEQ ID NO: 1320788 - protein, 17 aa, Mycobacterium
LKPEVCWQLPIRRTQEW

SEQ ID NO: 1320789 - protein, 25 aa, Mycobacterium
LKPITHPLRADIPVMLGAEGPKNVA

SEQ ID NO: 1320790 - protein, 19 aa, Mycobacterium
LKPITHPLRSDIPIMLGAE

SEQ ID NO: 1320791 - protein, 25 aa, Mycobacterium
LKPQLVHYYFRTMEDLFLAVFHRRA

SEQ ID NO: 1320792 - protein, 25 aa, Mycobacterium
LKPQLVHYYFRTMEDLFRAVFRRMA

SEQ ID NO: 1320793 - protein, 18 aa, Mycobacterium
LKQFGFTVASYQSASFVR

SEQ ID NO: 1320794 - protein, 28 aa, Mycobacterium
LKRAKTLGPRRGLTGTPLPPLWESTAAA

SEQ ID NO: 1320795 - protein, 21 aa, Mycobacterium
LKRANAILKTASAFFAAELDR

SEQ ID NO: 1320796 - protein, 25 aa, Mycobacterium
LKSGLRWIRSHPWHFAKLTATGRSL

SEQ ID NO: 1320797 - protein, 18 aa, Mycobacterium
LKTDRRVARFLRTSPGEG

SEQ ID NO: 1320798 - protein, 40 aa, Mycobacterium
LKTFAYGASPMPLPLLRQALQAWPNTDFMQAYGLTELCGV

SEQ ID NO: 1320799 - protein, 17 aa, Mycobacterium
LKTLTQALSGQLNPGVN

SEQ ID NO: 1320800 - protein, 17 aa, Mycobacterium
LKTLVDVGLGYVRLGQP

SEQ ID NO: 1320801 - protein, 20 aa, Mycobacterium
LKVIAAVHPGLWQPAVLAKL

SEQ ID NO: 1320802 - protein, 27 aa, Mycobacterium
LKVLLDVPDLLRAYIPFAHERSGIREG

SEQ ID NO: 1320803 - protein, 18 aa, Mycobacterium
LLAAAFQSLLQPAPMPPA

SEQ ID NO: 1320804 - protein, 17 aa, Mycobacterium
LLAARWGDRERPLWIKP

SEQ ID NO: 1320805 - protein, 17 aa, Mycobacterium
LLADRFIAPTVPEFDYP

SEQ ID NO: 1320806 - protein, 19 aa, Mycobacterium
LLAFAHLEPGMRLPTAKVS

SEQ ID NO: 1320807 - protein, 17 aa, Mycobacterium
LLAFTISGECRNTTDHR

SEQ ID NO: 1320808 - protein, 24 aa, Mycobacterium
LLAGAFAVAWEWGNTALVSELIEY

SEQ ID NO: 1320809 - protein, 17 aa, Mycobacterium
LLAGLLRAGRQVKDLVV

SEQ ID NO: 1320810 - protein, 32 aa, Mycobacterium
LLAGLPAVRRQLFRRLLQFTGAQVRSVELTKA

SEQ ID NO: 1320811 - protein, 17 aa, Mycobacterium
LLAPLWEATAAAQAQGL

SEQ ID NO: 1320812 - protein, 18 aa, Mycobacterium
LLAQLRAILDLTSTEIQV

SEQ ID NO: 1320813 - protein, 17 aa, Mycobacterium
LLARKFTDVLRSLDVHK

SEQ ID NO: 1320814 - protein, 36 aa, Mycobacterium
LLARLAATVQYVPMPSWLRINFAAATVTAMARGQLY

SEQ ID NO: 1320815 - protein, 25 aa, Mycobacterium
LLASLRPELMCLYQPLGGEYAGTRE

SEQ ID NO: 1320816 - protein, 21 aa, Mycobacterium
LLAVFDIYRTMPGALLTLAGD

SEQ ID NO: 1320817 - protein, 20 aa, Mycobacterium
LLAVLRGMEALRKGGASAAT

SEQ ID NO: 1320818 - protein, 34 aa, Mycobacterium
LLAVPAHGWVNLHFSVLPAWRGAAPVQAALAAGD

SEQ ID NO: 1320819 - protein, 17 aa, Mycobacterium
LLAVYGRRYLELDGNSH

SEQ ID NO: 1320820 - protein, 18 aa, Mycobacterium
LLCDATCEVWFQRHGRPL

SEQ ID NO: 1320821 - protein, 17 aa, Mycobacterium
LLCSSVTGVWGGKGVGG

SEQ ID NO: 1320822 - protein, 17 aa, Mycobacterium
LLDAWAMRERLPRVAEV

SEQ ID NO: 1320823 - protein, 28 aa, Mycobacterium
LLDDNDFRHLYVPPGFLHGFQALTATAD

SEQ ID NO: 1320824 - protein, 17 aa, Mycobacterium
LLDDPHLWVRTLCDELE

SEQ ID NO: 1320825 - protein, 18 aa, Mycobacterium
LLDEIDDVLEENAEDFVR

SEQ ID NO: 1320826 - protein, 17 aa, Mycobacterium
LLDHARATVRWTDAGRE

SEQ ID NO: 1320827 - protein, 24 aa, Mycobacterium
LLDLPPEVVGILCGQPFAVVAACA

SEQ ID NO: 1320828 - protein, 27 aa, Mycobacterium
LLDLSSLWQIYGVDRPALKDPPFVPAT

SEQ ID NO: 1320829 - protein, 18 aa, Mycobacterium
LLDQLDPDVPFPAAANGP

SEQ ID NO: 1320830 - protein, 18 aa, Mycobacterium
LLDSWPGTLIVVSHDRYL

SEQ ID NO: 1320831 - protein, 25 aa, Mycobacterium
LLDTVERLIALWDRPLRDVRILFGD

SEQ ID NO: 1320832 - protein, 21 aa, Mycobacterium
LLDVAMSHPITLIANALGVPP

SEQ ID NO: 1320833 - protein, 19 aa, Mycobacterium
LLDVWRRDDLPAEPAPVLI

SEQ ID NO: 1320834 - protein, 17 aa, Mycobacterium
LLDWMTEDSQRPIGDPL

SEQ ID NO: 1320835 - protein, 30 aa, Mycobacterium
LLDWSSIAPDRLLSLALIPYWDVDAAVAEI

SEQ ID NO: 1320836 - protein, 18 aa, Mycobacterium
LLDYLLDTYVLPRTERTA

SEQ ID NO: 1320837 - protein, 19 aa, Mycobacterium
LLEESHLGRVLDPSGGSWF

SEQ ID NO: 1320838 - protein, 22 aa, Mycobacterium
LLEEWLGLWSEHYQLPERLHVQ

SEQ ID NO: 1320839 - protein, 18 aa, Mycobacterium
LLEFFAELTIYTSTACLI

SEQ ID NO: 1320840 - protein, 20 aa, Mycobacterium
LLELGRINRSLRGPYFVLRE

SEQ ID NO: 1320841 - protein, 17 aa, Mycobacterium
LLELLRRGGFLIQDVIE

SEQ ID NO: 1320842 - protein, 19 aa, Mycobacterium
LLELNRLFMAWVETEYHRR

SEQ ID NO: 1320843 - protein, 20 aa, Mycobacterium
LLENAVKGGVPFLPLNQDPS

SEQ ID NO: 1320844 - protein, 18 aa, Mycobacterium
LLENYLPEKAVAAATNGW

SEQ ID NO: 1320845 - protein, 18 aa, Mycobacterium
LLERLHLTDLADANPYTL

SEQ ID NO: 1320846 - protein, 24 aa, Mycobacterium
LLERYRTDYGRWPESVGLSVWGTS

SEQ ID NO: 1320847 - protein, 17 aa, Mycobacterium
LLFEDLLEIRDPDAALP

SEQ ID NO: 1320848 - protein, 19 aa, Mycobacterium
LLFGGMWNAPIPDLDRTDH

SEQ ID NO: 1320849 - protein, 17 aa, Mycobacterium
LLFLHNTTGYMVGRQYE

SEQ ID NO: 1320850 - protein, 18 aa, Mycobacterium
LLGGRAALLGLRSGGRVS

SEQ ID NO: 1320851 - protein, 18 aa, Mycobacterium
LLGLIREGEGVAAQVLVK

SEQ ID NO: 1320852 - protein, 17 aa, Mycobacterium
LLGLLPVQNREAKPDPY

SEQ ID NO: 1320853 - protein, 19 aa, Mycobacterium
LLGLPWAELNTHPLYHPSK

SEQ ID NO: 1320854 - protein, 26 aa, Mycobacterium
LLGNYYTMHFALQRRGALQAGETVLV

SEQ ID NO: 1320855 - protein, 25 aa, Mycobacterium
LLGPLNKGWHVATTTLSFERAGAAR

SEQ ID NO: 1320856 - protein, 18 aa, Mycobacterium
LLGPTGAAAVFGPQKGAD

SEQ ID NO: 1320857 - protein, 18 aa, Mycobacterium
LLGSLHLELAPPTDEPPQ

SEQ ID NO: 1320858 - protein, 30 aa, Mycobacterium
LLGSVPTYALLAQRWLHVTGTGAEALRSVA

SEQ ID NO: 1320859 - protein, 17 aa, Mycobacterium
LLGVLDPDTYLDGTFTL

SEQ ID NO: 1320860 - protein, 17 aa, Mycobacterium
LLGVRPIWDDASRRVVD

SEQ ID NO: 1320861 - protein, 17 aa, Mycobacterium
LLGWIRAEQPGAAIGVY

SEQ ID NO: 1320862 - protein, 21 aa, Mycobacterium
LLGYLLSRLEVVSLDLPAGSA

SEQ ID NO: 1320863 - protein, 28 aa, Mycobacterium
LLHAADDVLLFKYIIKNTAWQNGKTVTF

SEQ ID NO: 1320864 - protein, 19 aa, Mycobacterium
LLHAAPMFHLADLAIWLEQ

SEQ ID NO: 1320865 - protein, 32 aa, Mycobacterium
LLHAGRRQLIVTFRFYHCDYYRNVTIVAVRPA

SEQ ID NO: 1320866 - protein, 17 aa, Mycobacterium
LLHDLWARRHMAVLHVT

SEQ ID NO: 1320867 - protein, 18 aa, Mycobacterium
LLIGARLLDRAATGVPRQ

SEQ ID NO: 1320868 - protein, 18 aa, Mycobacterium
LLKACRATLRGEPFVYPG

SEQ ID NO: 1320869 - protein, 18 aa, Mycobacterium
LLKMHTLGMDFVPDPIHA

SEQ ID NO: 1320870 - protein, 18 aa, Mycobacterium
LLKVILSLEHQVLPKHLN

SEQ ID NO: 1320871 - protein, 21 aa, Mycobacterium
LLLAHSAGYIELFYGRPLNQS

SEQ ID NO: 1320872 - protein, 17 aa, Mycobacterium
LLLCRSKSYRGAHSQHQ

SEQ ID NO: 1320873 - protein, 36 aa, Mycobacterium
LLLESARPMTLRFLDAPPRFLFFTGKGGVGKTSIAC

SEQ ID NO: 1320874 - protein, 18 aa, Mycobacterium
LLLHCYPFQRQAGYLAQA

SEQ ID NO: 1320875 - protein, 17 aa, Mycobacterium
LLLLARTGLELGVPDRV

SEQ ID NO: 1320876 - protein, 20 aa, Mycobacterium
LLLLEAARRLIAERGAGAVS

SEQ ID NO: 1320877 - protein, 17 aa, Mycobacterium
LLLPEPTATLSAGEVAE

SEQ ID NO: 1320878 - protein, 20 aa, Mycobacterium
LLLSRFDIVLLDEPTNDLDL

SEQ ID NO: 1320879 - protein, 17 aa, Mycobacterium
LLLTATPYNLAFQDVAS

SEQ ID NO: 1320880 - protein, 18 aa, Mycobacterium
LLLTLRTDRDWIADVVRF

SEQ ID NO: 1320881 - protein, 21 aa, Mycobacterium
LLMGIMLTKYPELFGALVCSV

SEQ ID NO: 1320882 - protein, 20 aa, Mycobacterium
LLMMTNFLNLWEKSDVRAVL

SEQ ID NO: 1320883 - protein, 26 aa, Mycobacterium
LLMPSWSIVDSRFWKAQVAFLARHHR

SEQ ID NO: 1320884 - protein, 17 aa, Mycobacterium
LLMRTVLMHDRPATVLQ

SEQ ID NO: 1320885 - protein, 17 aa, Mycobacterium
LLMWCHTTKRTDTRVRN

SEQ ID NO: 1320886 - protein, 18 aa, Mycobacterium
LLNDALARIRQRVNLDAA

SEQ ID NO: 1320887 - protein, 17 aa, Mycobacterium
LLNLAPARLTGVLAVVC

SEQ ID NO: 1320888 - protein, 18 aa, Mycobacterium
LLNPMYYFRGQAPRDDFA

SEQ ID NO: 1320889 - protein, 34 aa, Mycobacterium
LLNPTTAVPLITAALGPILGPFSALGASVQDFVE

SEQ ID NO: 1320890 - protein, 18 aa, Mycobacterium
LLNRYDVAFIQYQYGIYG

SEQ ID NO: 1320891 - protein, 19 aa, Mycobacterium
LLPAPRLSEYTGCTVHLKV

SEQ ID NO: 1320892 - protein, 28 aa, Mycobacterium
LLPEALETWPLRIFGDALPRHLELIYEI

SEQ ID NO: 1320893 - protein, 17 aa, Mycobacterium
LLPGDQQFKFTAALARR

SEQ ID NO: 1320894 - protein, 21 aa, Mycobacterium
LLPRFDTITYRELLDRVRALT

SEQ ID NO: 1320895 - protein, 17 aa, Mycobacterium
LLPRLPCSVLAVKLDRL

SEQ ID NO: 1320896 - protein, 25 aa, Mycobacterium
LLPSTPRQLALYGALIRIGVADTTP

SEQ ID NO: 1320897 - protein, 20 aa, Mycobacterium
LLPTVLLGETSRYLGGSAAT

SEQ ID NO: 1320898 - protein, 19 aa, Mycobacterium
LLPVLVGGLQQNALDPGTA

SEQ ID NO: 1320899 - protein, 18 aa, Mycobacterium
LLPVYRAEADRLTEAFLA

SEQ ID NO: 1320900 - protein, 26 aa, Mycobacterium
LLPYERSTCFWQRIAYLYSRFDALVE

SEQ ID NO: 1320901 - protein, 18 aa, Mycobacterium
LLQMAAYVETLTAAGVPV

SEQ ID NO: 1320902 - protein, 23 aa, Mycobacterium
LLQRHTGPIFPLIEDLFGVSIVE

SEQ ID NO: 1320903 - protein, 26 aa, Mycobacterium
LLQTEFNVMLPWSKEVSLPAPGEGSA

SEQ ID NO: 1320904 - protein, 20 aa, Mycobacterium
LLQTIRLGVLRPGESLPPER

SEQ ID NO: 1320905 - protein, 19 aa, Mycobacterium
LLQVGRQVPVTTILIDTAT

SEQ ID NO: 1320906 - protein, 34 aa, Mycobacterium
LLREEIMLRTLDPDPLIGLLAPVLGIAPEHGYEP

SEQ ID NO: 1320907 - protein, 25 aa, Mycobacterium
LLREGRPIHLLINNAGVMNPPSRQT

SEQ ID NO: 1320908 - protein, 26 aa, Mycobacterium
LLRGAALRVVATWPSRYPDIHDDGAV

SEQ ID NO: 1320909 - protein, 17 aa, Mycobacterium
LLRIDFPGRTILSSLVL

SEQ ID NO: 1320910 - protein, 24 aa, Mycobacterium
LLRMQHRILGGTRRLFRAAAAAEL

SEQ ID NO: 1320911 - protein, 19 aa, Mycobacterium
LLRPAVALSWRARLQPMDE

SEQ ID NO: 1320912 - protein, 17 aa, Mycobacterium
LLRPGEDDLFWLGTEEA

SEQ ID NO: 1320913 - protein, 17 aa, Mycobacterium
LLRPLHLELGGNGAAIV

SEQ ID NO: 1320914 - protein, 17 aa, Mycobacterium
LLRQLRLGEYDVLVGIN

SEQ ID NO: 1320915 - protein, 18 aa, Mycobacterium
LLRQRRALRDSGRDPREA

SEQ ID NO: 1320916 - protein, 18 aa, Mycobacterium
LLRSFDARLGWGPAVSAD

SEQ ID NO: 1320917 - protein, 19 aa, Mycobacterium
LLRTHPDVIAALRGRGVTD

SEQ ID NO: 1320918 - protein, 17 aa, Mycobacterium
LLRVRLGEPFMARQGSM

SEQ ID NO: 1320919 - protein, 18 aa, Mycobacterium
LLRVTRDAKWKPFNLGNV

SEQ ID NO: 1320920 - protein, 24 aa, Mycobacterium
LLSAPAVKLLIRKAGARSADMAAV

SEQ ID NO: 1320921 - protein, 21 aa, Mycobacterium
LLSDLRHLFDALGVDWEQAVA

SEQ ID NO: 1320922 - protein, 20 aa, Mycobacterium
LLSDVVLPAATWYEKADLSS

SEQ ID NO: 1320923 - protein, 17 aa, Mycobacterium
LLSLLQVMFAEELAHTG

SEQ ID NO: 1320924 - protein, 27 aa, Mycobacterium
LLSLRQFVQRHPIYATPRILADIEPLL

SEQ ID NO: 1320925 - protein, 19 aa, Mycobacterium
LLSMLQYRGFVRQDPISRA

SEQ ID NO: 1320926 - protein, 22 aa, Mycobacterium
LLSPEIVRRLCWDWKPVEGVDA

SEQ ID NO: 1320927 - protein, 28 aa, Mycobacterium
LLSQAYVEFTFPLAAQYFTINPLAKRMD

SEQ ID NO: 1320928 - protein, 19 aa, Mycobacterium
LLTHYMPAHYSAGWWMDSA

SEQ ID NO: 1320929 - protein, 17 aa, Mycobacterium
LLTPTWRHRSPAAKRRF

SEQ ID NO: 1320930 - protein, 17 aa, Mycobacterium
LLTRLGISPLPNTAGCR

SEQ ID NO: 1320931 - protein, 24 aa, Mycobacterium
LLTSGLGWAVWTDGRVKFTTGNGL

SEQ ID NO: 1320932 - protein, 20 aa, Mycobacterium
LLVCLKTPDSFQFVSEFGGE

SEQ ID NO: 1320933 - protein, 18 aa, Mycobacterium
LLVLVDALPDRGSPGTLH

SEQ ID NO: 1320934 - protein, 19 aa, Mycobacterium
LLVRCARPVLQQLQIDTAD

SEQ ID NO: 1320935 - protein, 18 aa, Mycobacterium
LLVRERIELMLDPDTAFL

SEQ ID NO: 1320936 - protein, 17 aa, Mycobacterium
LLVSHVLVPPAISAIME

SEQ ID NO: 1320937 - protein, 18 aa, Mycobacterium
LLVVLRGMEALRKGGASA

SEQ ID NO: 1320938 - protein, 28 aa, Mycobacterium
LLVWDMMGRPWLTRTAEAALNPLIGKSV

SEQ ID NO: 1320939 - protein, 19 aa, Mycobacterium
LLWTVQRIPVFDAVRPVWT

SEQ ID NO: 1320940 - protein, 19 aa, Mycobacterium
LLYYAVDHSPSYLWNSATW

SEQ ID NO: 1320941 - protein, 19 aa, Mycobacterium
LMAALFDRTPPAPATAAII

SEQ ID NO: 1320942 - protein, 17 aa, Mycobacterium
LMAAWWHGFSRFCPEIV

SEQ ID NO: 1320943 - protein, 18 aa, Mycobacterium
LMAEWNVRRTPNIPVPYV

SEQ ID NO: 1320944 - protein, 19 aa, Mycobacterium
LMALSTTPLSAIDPAVRQV

SEQ ID NO: 1320945 - protein, 21 aa, Mycobacterium
LMCVYRHPMFNMVHADAAWAS

SEQ ID NO: 1320946 - protein, 20 aa, Mycobacterium
LMDGMDLVVLGLGGRTVPAT

SEQ ID NO: 1320947 - protein, 21 aa, Mycobacterium
LMDLRPDQTRWRIAVEKVLRG

SEQ ID NO: 1320948 - protein, 19 aa, Mycobacterium
LMERFGVSRPTLREAFRVL

SEQ ID NO: 1320949 - protein, 19 aa, Mycobacterium
LMEWVAMVGCPIIGINDSA

SEQ ID NO: 1320950 - protein, 32 aa, Mycobacterium
LMGEGEAMLFGEYIRLMALVEYSAEEIVSVFG

SEQ ID NO: 1320951 - protein, 25 aa, Mycobacterium
LMIAFEHGLGWFTVVDDTLIMVPMP

SEQ ID NO: 1320952 - protein, 19 aa, Mycobacterium
LMIKVLRVSDLLEVAAMVG

SEQ ID NO: 1320953 - protein, 18 aa, Mycobacterium
LMLAGGLPVHVVAAWHGH

SEQ ID NO: 1320954 - protein, 17 aa, Mycobacterium
LMLARRIGLNTVRVFLH

SEQ ID NO: 1320955 - protein, 19 aa, Mycobacterium
LMLIWACDLIVASDDARFS

SEQ ID NO: 1320956 - protein, 17 aa, Mycobacterium
LMMLHPPSETTPSLPEC

SEQ ID NO: 1320957 - protein, 22 aa, Mycobacterium
LMNLVIALLSTRSFITADRIRE

SEQ ID NO: 1320958 - protein, 21 aa, Mycobacterium
LMNPFAKLMWRICKIDGPPSR

SEQ ID NO: 1320959 - protein, 19 aa, Mycobacterium
LMPGPFLTDISDAWTFTDG

SEQ ID NO: 1320960 - protein, 27 aa, Mycobacterium
LMPGQQSAWHTVRSAELWLYHSGGPLQ

SEQ ID NO: 1320961 - protein, 19 aa, Mycobacterium
LMPLDHVVAWAEAPGTLVD

SEQ ID NO: 1320962 - protein, 25 aa, Mycobacterium
LMPPQMLHMILPRKDYEIVEDSWDV

SEQ ID NO: 1320963 - protein, 17 aa, Mycobacterium
LMRALRGSGLTLREVNI

SEQ ID NO: 1320964 - protein, 27 aa, Mycobacterium
LMRIPHMVNLYRHRGMFPLPSREGVSD

SEQ ID NO: 1320965 - protein, 19 aa, Mycobacterium
LMRRFNGATLETLLTRLNL

SEQ ID NO: 1320966 - protein, 25 aa, Mycobacterium
LMSPTAFVRRPSRWIEALSAGSRTG

SEQ ID NO: 1320967 - protein, 27 aa, Mycobacterium
LMSTKPPRIMTAALVLPVAMVDSELPS

SEQ ID NO: 1320968 - protein, 25 aa, Mycobacterium
LMTERTLIRRLGVLEVPRPQLREAA

SEQ ID NO: 1320969 - protein, 17 aa, Mycobacterium
LMTPHAANWYAGDQPWE

SEQ ID NO: 1320970 - protein, 24 aa, Mycobacterium
LNADIPLAVDHFRYFAGAIRAQEG

SEQ ID NO: 1320971 - protein, 25 aa, Mycobacterium
LNANLVAYGIPIYAAGRDTPTYAVA

SEQ ID NO: 1320972 - protein, 23 aa, Mycobacterium
LNCALVVMGQRLGYYRCLVEHGP

SEQ ID NO: 1320973 - protein, 20 aa, Mycobacterium
LNDEVFTDDGWFRTGDLGRV

SEQ ID NO: 1320974 - protein, 21 aa, Mycobacterium
LNDFGYYTAAAEWGGYGKSGN

SEQ ID NO: 1320975 - protein, 25 aa, Mycobacterium
LNDGTGIPQLGFGVFQIPPDDTAAA

SEQ ID NO: 1320976 - protein, 24 aa, Mycobacterium
LNDPCWKQLLSLVPPMTCDPAFTD

SEQ ID NO: 1320977 - protein, 25 aa, Mycobacterium
LNDREKRWVLKNPSHLFALDALMAT

SEQ ID NO: 1320978 - protein, 23 aa, Mycobacterium
LNDTRVYYVEPAKWVAALRHAQT

SEQ ID NO: 1320979 - protein, 18 aa, Mycobacterium
LNEAFASVVLKFQKDLNI

SEQ ID NO: 1320980 - protein, 28 aa, Mycobacterium
LNEGDLERLNAYLLPLLGTDGRGGLSAR

SEQ ID NO: 1320981 - protein, 17 aa, Mycobacterium
LNELLDESLFFSRDSFN

SEQ ID NO: 1320982 - protein, 19 aa, Mycobacterium
LNEVCCIYPITPSSPMAEL

SEQ ID NO: 1320983 - protein, 19 aa, Mycobacterium
LNFAVGPFASMLDRARDAI

SEQ ID NO: 1320984 - protein, 28 aa, Mycobacterium
LNGFRRRIFVYALDWPGESPLRPSYDRV

SEQ ID NO: 1320985 - protein, 28 aa, Mycobacterium
LNGLDVPGIVWFRGLLRQLADTGCVVVV

SEQ ID NO: 1320986 - protein, 29 aa, Mycobacterium
LNGLDVPGIVWLRELLRRLAADGRTLVVA

SEQ ID NO: 1320987 - protein, 26 aa, Mycobacterium
LNGLLPPPPVDPFAPPPAPAPVDALA

SEQ ID NO: 1320988 - protein, 19 aa, Mycobacterium
LNGLPVSIIIRTTLEDLES

SEQ ID NO: 1320989 - protein, 18 aa, Mycobacterium
LNGLPVSVIIRTTLQDLE

SEQ ID NO: 1320990 - protein, 20 aa, Mycobacterium
LNGLPVSVIIRTTLQDLESR

SEQ ID NO: 1320991 - protein, 30 aa, Mycobacterium
LNGRHARIKLPKLGWVKFRASRDLAGEVIR

SEQ ID NO: 1320992 - protein, 25 aa, Mycobacterium
LNGVFHCTQAVLPDMIEAGWGRIVN

SEQ ID NO: 1320993 - protein, 19 aa, Mycobacterium
LNHPAFDAHLLPWEGACHA

SEQ ID NO: 1320994 - protein, 23 aa, Mycobacterium
LNKRYFYESFADLDALAAAVVDD

SEQ ID NO: 1320995 - protein, 24 aa, Mycobacterium
LNLEDYLKLLKIDGTLVELGMPEH

SEQ ID NO: 1320996 - protein, 26 aa, Mycobacterium
LNLVLQDLFLQHSFAGLFVTHSVEEA

SEQ ID NO: 1320997 - protein, 18 aa, Mycobacterium
LNMHLSRAALGVLEYALA

SEQ ID NO: 1320998 - protein, 25 aa, Mycobacterium
LNNPRRSLYYLATPPSLFDPFVDQV

SEQ ID NO: 1320999 - protein, 18 aa, Mycobacterium
LNPFPANLGEVLARYRKV

SEQ ID NO: 1321000 - protein, 17 aa, Mycobacterium
LNPQVSPSTRFVSWVTG

SEQ ID NO: 1321001 - protein, 27 aa, Mycobacterium
LNPSSRLLFPIEGFSLWPCTVNNGKAV

SEQ ID NO: 1321002 - protein, 30 aa, Mycobacterium
LNRRHGRIKLPKLGWVKFRASRSLDGETIR

SEQ ID NO: 1321003 - protein, 25 aa, Mycobacterium
LNSHLDGEDLYRPYLQLVISSVQTP

SEQ ID NO: 1321004 - protein, 28 aa, Mycobacterium
LNSRLLRYFVKRYTLKRGALAFGKMLPV

SEQ ID NO: 1321005 - protein, 23 aa, Mycobacterium
LNTDLRGLDSLDLGARRLDAAPD

SEQ ID NO: 1321006 - protein, 24 aa, Mycobacterium
LNTDLRGLDSLDLGARRLDAAPDR

SEQ ID NO: 1321007 - protein, 20 aa, Mycobacterium
LNTVLRHQGVPPARARRLAT

SEQ ID NO: 1321008 - protein, 21 aa, Mycobacterium
LNTVSVGAFNFAPNVSMYAAG

SEQ ID NO: 1321009 - protein, 17 aa, Mycobacterium
LNVIRKDGGTVDKVDIW

SEQ ID NO: 1321010 - protein, 20 aa, Mycobacterium
LNVMTAMRRPAFATNTGAVA

SEQ ID NO: 1321011 - protein, 25 aa, Mycobacterium
LNVSPANAIWFYDNTKRGDIVEVVN

SEQ ID NO: 1321012 - protein, 18 aa, Mycobacterium
LNYDIYLLDTATGERRQL

SEQ ID NO: 1321013 - protein, 34 aa, Mycobacterium
LPAAGRDFFLPAYDLLVRLLGTYPLYDELVTQAE

SEQ ID NO: 1321014 - protein, 19 aa, Mycobacterium
LPAAQVHALIAQISRAVLG

SEQ ID NO: 1321015 - protein, 18 aa, Mycobacterium
LPAATWYEKADLSSTDMH

SEQ ID NO: 1321016 - protein, 24 aa, Mycobacterium
LPADDPLALVPLLSRNDASRMPGT

SEQ ID NO: 1321017 - protein, 25 aa, Mycobacterium
LPADGLTDILLRRPPRTRSGGPLPR

SEQ ID NO: 1321018 - protein, 29 aa, Mycobacterium
LPADSAVPPEWFCGLTWPAKPLVAQDGPV

SEQ ID NO: 1321019 - protein, 25 aa, Mycobacterium
LPAEHGFPVRLLIPGFYGTNSVKWL

SEQ ID NO: 1321020 - protein, 30 aa, Mycobacterium
LPAQDMARGQYWIHPALPEVVENALLALCG

SEQ ID NO: 1321021 - protein, 24 aa, Mycobacterium
LPARSAIGVLALPSGAPVEVDLSV

SEQ ID NO: 1321022 - protein, 18 aa, Mycobacterium
LPATTFLERYDVPYSFAN

SEQ ID NO: 1321023 - protein, 23 aa, Mycobacterium
LPDADLVFFFDRSELPRVVGDDD

SEQ ID NO: 1321024 - protein, 23 aa, Mycobacterium
LPDCPRWKVIDRSDLTDIAAKLR

SEQ ID NO: 1321025 - protein, 21 aa, Mycobacterium
LPDDALDLAWRSLAEVGNLSS

SEQ ID NO: 1321026 - protein, 27 aa, Mycobacterium
LPDDLKFTLVEPLRLLFKDEVRAVGRE

SEQ ID NO: 1321027 - protein, 18 aa, Mycobacterium
LPDDPDYARLWKIVNDNN

SEQ ID NO: 1321028 - protein, 24 aa, Mycobacterium
LPDELYTSLLRRAITTANIALDKA

SEQ ID NO: 1321029 - protein, 31 aa, Mycobacterium
LPDGAQLFARIWIAQVGRIPLLLLDSDIPEN

SEQ ID NO: 1321030 - protein, 26 aa, Mycobacterium
LPDGHLARLRFLRRYTEGLSGPVVVH

SEQ ID NO: 1321031 - protein, 26 aa, Mycobacterium
LPDVIAHGMLTMGLGAGFVSAWSGDP

SEQ ID NO: 1321032 - protein, 19 aa, Mycobacterium
LPEAGLIRFKDPQKLHGVL

SEQ ID NO: 1321033 - protein, 25 aa, Mycobacterium
LPEAQLDRFLLKLNVPLPPRDQEIA

SEQ ID NO: 1321034 - protein, 21 aa, Mycobacterium
LPEDLPFAVLMALHLPEQGPS

SEQ ID NO: 1321035 - protein, 21 aa, Mycobacterium
LPEDVLNLLHLIYSMIMVSMA

SEQ ID NO: 1321036 - protein, 20 aa, Mycobacterium
LPEDVLSRYSGRTLRFAAAS

SEQ ID NO: 1321037 - protein, 18 aa, Mycobacterium
LPEFAPPYDFLNEPGMQG

SEQ ID NO: 1321038 - protein, 21 aa, Mycobacterium
LPEFDPFWRDVEAAGLPIVLH

SEQ ID NO: 1321039 - protein, 20 aa, Mycobacterium
LPEFDPFWREVEAAGLPIVL

SEQ ID NO: 1321040 - protein, 17 aa, Mycobacterium
LPEGKGLVLLTDGLFEG

SEQ ID NO: 1321041 - protein, 21 aa, Mycobacterium
LPEHRMLILDSESWVACLPRD

SEQ ID NO: 1321042 - protein, 17 aa, Mycobacterium
LPEKPAYTAVRWKAILQ

SEQ ID NO: 1321043 - protein, 23 aa, Mycobacterium
LPELPTQSPLLLNTGRKTLRTNA

SEQ ID NO: 1321044 - protein, 17 aa, Mycobacterium
LPELRRLNWHVTAVVKE

SEQ ID NO: 1321045 - protein, 30 aa, Mycobacterium
LPERDFPTLISLYLQGRFPLDKFVSERIGL

SEQ ID NO: 1321046 - protein, 25 aa, Mycobacterium
LPERERTVLALRFFESMTQTQIAER

SEQ ID NO: 1321047 - protein, 32 aa, Mycobacterium
LPESGSICFLIRTYMLPFADLAAFEPWRQRAA

SEQ ID NO: 1321048 - protein, 23 aa, Mycobacterium
LPEVDGALFAAALRHAVDLVEAA

SEQ ID NO: 1321049 - protein, 17 aa, Mycobacterium
LPFPKPVDDVTGLSQAI

SEQ ID NO: 1321050 - protein, 25 aa, Mycobacterium
LPFRELLHHFEVSITIPPLRCRTDD

SEQ ID NO: 1321051 - protein, 23 aa, Mycobacterium
LPGAIGWLKYTIDNELLMNQIAE

SEQ ID NO: 1321052 - protein, 19 aa, Mycobacterium
LPGDWTIGPGCVAGIDVRW

SEQ ID NO: 1321053 - protein, 17 aa, Mycobacterium
LPGGWGPSAFLQSPAVI

SEQ ID NO: 1321054 - protein, 25 aa, Mycobacterium
LPGLAEVLFLATEDWARLGERADLV

SEQ ID NO: 1321055 - protein, 34 aa, Mycobacterium
LPGLSPLERAHADDLYWMYALSSCVKWSDPVFDP

SEQ ID NO: 1321056 - protein, 20 aa, Mycobacterium
LPGNGSMVAALRTATDADPQ

SEQ ID NO: 1321057 - protein, 18 aa, Mycobacterium
LPGPPPVPESPLADPAHP

SEQ ID NO: 1321058 - protein, 19 aa, Mycobacterium
LPGQRWVNVGMGALLRRIY

SEQ ID NO: 1321059 - protein, 22 aa, Mycobacterium
LPGRLVYHPQGLDVLACFNDEP

SEQ ID NO: 1321060 - protein, 22 aa, Mycobacterium
LPGTVDVVLFLGATSRIYLTVD

SEQ ID NO: 1321061 - protein, 22 aa, Mycobacterium
LPGVAFAHDWITSADRYRGTLE

SEQ ID NO: 1321062 - protein, 21 aa, Mycobacterium
LPGVAMMVVLISRSGYCTVTA

SEQ ID NO: 1321063 - protein, 21 aa, Mycobacterium
LPGVAMMVVLVSRSGFCTVTA

SEQ ID NO: 1321064 - protein, 22 aa, Mycobacterium
LPGYWQCTFALGPDPDGEGELE

SEQ ID NO: 1321065 - protein, 21 aa, Mycobacterium
LPHEESLPMFIVYRHEEIQQM

SEQ ID NO: 1321066 - protein, 20 aa, Mycobacterium
LPHLDPALRKVMAGFFELVG

SEQ ID NO: 1321067 - protein, 20 aa, Mycobacterium
LPIASLLRDRFLTLLATGGG

SEQ ID NO: 1321068 - protein, 19 aa, Mycobacterium
LPKYRRLVEQLAQAGLLKV

SEQ ID NO: 1321069 - protein, 18 aa, Mycobacterium
LPLEFSRPRLPSGKGDAV

SEQ ID NO: 1321070 - protein, 24 aa, Mycobacterium
LPLFVGELLTLYRAGGDPGALGDP

SEQ ID NO: 1321071 - protein, 17 aa, Mycobacterium
LPLGAHFHNTRGAGLAS

SEQ ID NO: 1321072 - protein, 17 aa, Mycobacterium
LPLPLPRISHADAMRRF

SEQ ID NO: 1321073 - protein, 25 aa, Mycobacterium
LPLVLVVHGGPWYRDSWGFDAGVQM

SEQ ID NO: 1321074 - protein, 19 aa, Mycobacterium
LPMFIVYRHEEIQQMLRDN

SEQ ID NO: 1321075 - protein, 32 aa, Mycobacterium
LPMGSEALALLRLPLVLPALQVLGRVSGTVFG

SEQ ID NO: 1321076 - protein, 17 aa, Mycobacterium
LPMYAPHELERTPRALE

SEQ ID NO: 1321077 - protein, 23 aa, Mycobacterium
LPNDATLTPLLAPFADHDVFICG

SEQ ID NO: 1321078 - protein, 19 aa, Mycobacterium
LPNEQWRPRKRALAPVFTK

SEQ ID NO: 1321079 - protein, 24 aa, Mycobacterium
LPNHYLKLTGAENLQFFASLYDSA

SEQ ID NO: 1321080 - protein, 21 aa, Mycobacterium
LPNIARLLPVARAAGASVVHC

SEQ ID NO: 1321081 - protein, 19 aa, Mycobacterium
LPNITRLLPVARAAGVRVV

SEQ ID NO: 1321082 - protein, 19 aa, Mycobacterium
LPNLLADKIFIPAPKIKSG

SEQ ID NO: 1321083 - protein, 26 aa, Mycobacterium
LPNMRTVLHCLPPKDWTEPGFMGLGM

SEQ ID NO: 1321084 - protein, 25 aa, Mycobacterium
LPNMRTVLHCLPPRDWTEPGFMDLG

SEQ ID NO: 1321085 - protein, 18 aa, Mycobacterium
LPPELDFAALFHGIDERV

SEQ ID NO: 1321086 - protein, 20 aa, Mycobacterium
LPPNAGTLIRLFHAETTELE

SEQ ID NO: 1321087 - protein, 17 aa, Mycobacterium
LPPPADAHDRWLRAVAA

SEQ ID NO: 1321088 - protein, 18 aa, Mycobacterium
LPPSAFAPLVRRGFRASL

SEQ ID NO: 1321089 - protein, 24 aa, Mycobacterium
LPPSHHYLAAYRWLDGQFEGSSPS

SEQ ID NO: 1321090 - protein, 18 aa, Mycobacterium
LPPTPRIPKLLQGLGFSF

SEQ ID NO: 1321091 - protein, 24 aa, Mycobacterium
LPPVLHTLHWDLSKHPGLYGNLAV

SEQ ID NO: 1321092 - protein, 18 aa, Mycobacterium
LPQRSSLYSGPRPTNPKS

SEQ ID NO: 1321093 - protein, 27 aa, Mycobacterium
LPRDKRMEIALTYIYGVGRTRSQEILE

SEQ ID NO: 1321094 - protein, 17 aa, Mycobacterium
LPRIIRAGRHLARPRRY

SEQ ID NO: 1321095 - protein, 17 aa, Mycobacterium
LPRLQRLAVYTGDALGE

SEQ ID NO: 1321096 - protein, 18 aa, Mycobacterium
LPRRHPGKRSPLWHQRQR

SEQ ID NO: 1321097 - protein, 24 aa, Mycobacterium
LPRRVTEVALVFKRAPHLPFDSTM

SEQ ID NO: 1321098 - protein, 17 aa, Mycobacterium
LPRVFERFYRADSARDR

SEQ ID NO: 1321099 - protein, 28 aa, Mycobacterium
LPSDRLLNLLHYVKWYLDGTLTFRRSCA

SEQ ID NO: 1321100 - protein, 19 aa, Mycobacterium
LPSDTFATRVSSPVLQELE

SEQ ID NO: 1321101 - protein, 17 aa, Mycobacterium
LPSLSVATPAGVTLIDP

SEQ ID NO: 1321102 - protein, 17 aa, Mycobacterium
LPSSFRPIPDPNTPTGS

SEQ ID NO: 1321103 - protein, 24 aa, Mycobacterium
LPSSSLLDVLRPKPSSLPAAASLQ

SEQ ID NO: 1321104 - protein, 17 aa, Mycobacterium
LPTAELRTEWWDMMIER

SEQ ID NO: 1321105 - protein, 19 aa, Mycobacterium
LPTALGHIDAVQPSLVVVD

SEQ ID NO: 1321106 - protein, 19 aa, Mycobacterium
LPTALRELIRYVRPPRVRR

SEQ ID NO: 1321107 - protein, 21 aa, Mycobacterium
LPTAYHLLRTLVYDDYLVRLD

SEQ ID NO: 1321108 - protein, 22 aa, Mycobacterium
LPTPGLKSLLGYYAGEGPSREK

SEQ ID NO: 1321109 - protein, 25 aa, Mycobacterium
LPTWGSLLEISPPGSAALAALKVTG

SEQ ID NO: 1321110 - protein, 20 aa, Mycobacterium
LPVETLRRAMTDRPLHHFPT

SEQ ID NO: 1321111 - protein, 26 aa, Mycobacterium
LPVKLCYSGPFFRYERPQAGRYRQLQ

SEQ ID NO: 1321112 - protein, 32 aa, Mycobacterium
LPVLTMVLGYSRWLSAILLPSRRAEDLFAGWW

SEQ ID NO: 1321113 - protein, 20 aa, Mycobacterium
LPVLVYAHGGGFVFCDLDSH

SEQ ID NO: 1321114 - protein, 19 aa, Mycobacterium
LPVPRPAGYVIVGDTASLP

SEQ ID NO: 1321115 - protein, 20 aa, Mycobacterium
LPVQDLIRMAAESRHYLAVF

SEQ ID NO: 1321116 - protein, 30 aa, Mycobacterium
LPVTPGWNYLVRLYRPRPEVLDGSWSFPAA

SEQ ID NO: 1321117 - protein, 18 aa, Mycobacterium
LPVWLTQWGFDRPHEDTV

SEQ ID NO: 1321118 - protein, 17 aa, Mycobacterium
LPWTSTTKQHYVRIRPL

SEQ ID NO: 1321119 - protein, 21 aa, Mycobacterium
LPYHRPPLSKGYLAGKNGLDD

SEQ ID NO: 1321120 - protein, 26 aa, Mycobacterium
LQAEAAGLVWLPIGPSLDVAAHVEEQ

SEQ ID NO: 1321121 - protein, 21 aa, Mycobacterium
LQALRLYQRFAPDSDHHLVES

SEQ ID NO: 1321122 - protein, 19 aa, Mycobacterium
LQARRKLLLPPFNGKSMRG

SEQ ID NO: 1321123 - protein, 26 aa, Mycobacterium
LQDDRWTYRFNLFDTARALDNQVFWV

SEQ ID NO: 1321124 - protein, 21 aa, Mycobacterium
LQDEFGLSYLFVAHDLGVVRH

SEQ ID NO: 1321125 - protein, 22 aa, Mycobacterium
LQDEIGFTRVLYDDHIGKVSLI

SEQ ID NO: 1321126 - protein, 25 aa, Mycobacterium
LQDPDAVWYTLRAPADVRTGFAEVL

SEQ ID NO: 1321127 - protein, 22 aa, Mycobacterium
LQDVKPMSGAERRAILQFLESG

SEQ ID NO: 1321128 - protein, 19 aa, Mycobacterium
LQEAIRLFAERRYASVGIE

SEQ ID NO: 1321129 - protein, 18 aa, Mycobacterium
LQELSRQLHRWRAGDPGL

SEQ ID NO: 1321130 - protein, 19 aa, Mycobacterium
LQERCAKDFRVVAYPTPEG

SEQ ID NO: 1321131 - protein, 17 aa, Mycobacterium
LQGLLSELLVRAIITRT

SEQ ID NO: 1321132 - protein, 28 aa, Mycobacterium
LQGSAVFTSCRVWQLFNGSTSFAVTLPD

SEQ ID NO: 1321133 - protein, 17 aa, Mycobacterium
LQHAAYVALNPAAGWAV

SEQ ID NO: 1321134 - protein, 25 aa, Mycobacterium
LQHLTGGNVYLLKPSIRELRECVRR

SEQ ID NO: 1321135 - protein, 17 aa, Mycobacterium
LQIFPLVGWAERGGYGA

SEQ ID NO: 1321136 - protein, 29 aa, Mycobacterium
LQIVQVDQKFLFHRPIVAGDALTGTMYIE

SEQ ID NO: 1321137 - protein, 19 aa, Mycobacterium
LQLPWHQHCPVSESVIIAG

SEQ ID NO: 1321138 - protein, 21 aa, Mycobacterium
LQLTSLLHWKSDTAAITHQQL

SEQ ID NO: 1321139 - protein, 24 aa, Mycobacterium
LQNRPPLRIALAAPTGKAAARLLE

SEQ ID NO: 1321140 - protein, 20 aa, Mycobacterium
LQPALNRLAPLLAQSPAAGA

SEQ ID NO: 1321141 - protein, 21 aa, Mycobacterium
LQPALVVSKAAYLKLYPDDPI

SEQ ID NO: 1321142 - protein, 25 aa, Mycobacterium
LQPLATLEKMFIPPSGFHVVPVLAY

SEQ ID NO: 1321143 - protein, 21 aa, Mycobacterium
LQPLRPAILYGIDTRATAEID

SEQ ID NO: 1321144 - protein, 26 aa, Mycobacterium
LQPYPLPALVCLLRSLTIRLTTAPVQ

SEQ ID NO: 1321145 - protein, 19 aa, Mycobacterium
LQQAALCDGVVGFSGWLSA

SEQ ID NO: 1321146 - protein, 19 aa, Mycobacterium
LQQLHSAPLDLDLLGSAVA

SEQ ID NO: 1321147 - protein, 20 aa, Mycobacterium
LQQLVLARSGDAPWRLECCA

SEQ ID NO: 1321148 - protein, 17 aa, Mycobacterium
LQRASVIGHTLWVTPNR

SEQ ID NO: 1321149 - protein, 21 aa, Mycobacterium
LQRELLASAIRLTRPGGVVLY

SEQ ID NO: 1321150 - protein, 24 aa, Mycobacterium
LQRFQYAPLRFFPSQAHILGIARP

SEQ ID NO: 1321151 - protein, 17 aa, Mycobacterium
LQRGAFASSLAGGGVVP

SEQ ID NO: 1321152 - protein, 18 aa, Mycobacterium
LQSVQFHPTLSYEDFVRG

SEQ ID NO: 1321153 - protein, 17 aa, Mycobacterium
LQTALGHIDAVQPTLVV

SEQ ID NO: 1321154 - protein, 24 aa, Mycobacterium
LQTFQELILEPRGLDYKVQFPGPT

SEQ ID NO: 1321155 - protein, 17 aa, Mycobacterium
LQTLREQCTGRLAVVFG

SEQ ID NO: 1321156 - protein, 24 aa, Mycobacterium
LQTSAIFDEKFRVLSKLTDPNDYT

SEQ ID NO: 1321157 - protein, 19 aa, Mycobacterium
LQTSFWRLTSARPDLDFSW

SEQ ID NO: 1321158 - protein, 23 aa, Mycobacterium
LQVDGRPMVLRRPPPHPRPTSDN

SEQ ID NO: 1321159 - protein, 25 aa, Mycobacterium
LQVLHLLGTIPRIDALLPLPGSRNQ

SEQ ID NO: 1321160 - protein, 26 aa, Mycobacterium
LQVLHLLGTIPRIDALLPLPGSRNQL

SEQ ID NO: 1321161 - protein, 17 aa, Mycobacterium
LRAAGVNRRIFYRHFAS

SEQ ID NO: 1321162 - protein, 20 aa, Mycobacterium
LRACGLPRPDHSPSPDLLSD

SEQ ID NO: 1321163 - protein, 17 aa, Mycobacterium
LRADGHRCVSVRWGLWR

SEQ ID NO: 1321164 - protein, 18 aa, Mycobacterium
LRADGHRCVSVRWGLWRS

SEQ ID NO: 1321165 - protein, 21 aa, Mycobacterium
LRADVRAFLAEQLAAQTFVPS

SEQ ID NO: 1321166 - protein, 26 aa, Mycobacterium
LRAEPALPRLLGRLVIMGGAFDYRGN

SEQ ID NO: 1321167 - protein, 25 aa, Mycobacterium
LRAKHALFDRLVYGKLRAATGGDCR

SEQ ID NO: 1321168 - protein, 21 aa, Mycobacterium
LRALFTTWITAPQPDLDVLVP

SEQ ID NO: 1321169 - protein, 20 aa, Mycobacterium
LRALGRDVLARLAVRGQPRA

SEQ ID NO: 1321170 - protein, 28 aa, Mycobacterium
LRALGRGPLIQFTWIYDRAVDIDGLRRF

SEQ ID NO: 1321171 - protein, 33 aa, Mycobacterium
LRAPMEWNLLGWMRRTFFNRPPTIDYDAGLNTQ

SEQ ID NO: 1321172 - protein, 25 aa, Mycobacterium
LRAPMITRSLLGYRYRRLPEARHAA

SEQ ID NO: 1321173 - protein, 18 aa, Mycobacterium
LRARRRDAAYIGAGYAVL

SEQ ID NO: 1321174 - protein, 35 aa, Mycobacterium
LRATLTLLETAPLPGLPPLSSGLVGFFAYDLVRRL

SEQ ID NO: 1321175 - protein, 20 aa, Mycobacterium
LRATYEPALPALAAMMAEEV

SEQ ID NO: 1321176 - protein, 26 aa, Mycobacterium
LRAVFDRFGADLPPLKGVYLAAMSGG

SEQ ID NO: 1321177 - protein, 20 aa, Mycobacterium
LRAWLTTVVSRIGLDRLRSA

SEQ ID NO: 1321178 - protein, 17 aa, Mycobacterium
LRCANGEPLALMTNYLP

SEQ ID NO: 1321179 - protein, 21 aa, Mycobacterium
LRCAVRDFLRSDRAEFGWEPA

SEQ ID NO: 1321180 - protein, 18 aa, Mycobacterium
LRCIGCGLCIEACPTRAL

SEQ ID NO: 1321181 - protein, 19 aa, Mycobacterium
LRCLRMTVYIVCAPGFREL

SEQ ID NO: 1321182 - protein, 18 aa, Mycobacterium
LRCRPPAPLGPDPAACRR

SEQ ID NO: 1321183 - protein, 27 aa, Mycobacterium
LRDAQPLVRLRVPFSLKRIDIDDVERG

SEQ ID NO: 1321184 - protein, 27 aa, Mycobacterium
LRDEIALLMPGVWIERPRLSDGELVRQ

SEQ ID NO: 1321185 - protein, 30 aa, Mycobacterium
LRDESRSPWPTWPIVLRTRLSPAHAEGGHR

SEQ ID NO: 1321186 - protein, 26 aa, Mycobacterium
LRDGLKAVKRIPLARALNTAQRHDYL

SEQ ID NO: 1321187 - protein, 18 aa, Mycobacterium
LRDGYPQGVPPKDYFPLL

SEQ ID NO: 1321188 - protein, 25 aa, Mycobacterium
LRDQSSWPLYPIRPGHTYVNVGFWS

SEQ ID NO: 1321189 - protein, 25 aa, Mycobacterium
LRDQVRAFRMLPNIVFAGRAISSQT

SEQ ID NO: 1321190 - protein, 25 aa, Mycobacterium
LRDRGLFGTSILWFEGDHDGDGGPL

SEQ ID NO: 1321191 - protein, 28 aa, Mycobacterium
LRDSDSRILLIDDAFLPMLPELRREFPG

SEQ ID NO: 1321192 - protein, 19 aa, Mycobacterium
LRDSILDGMREMLLTRDWS

SEQ ID NO: 1321193 - protein, 19 aa, Mycobacterium
LRDSPLEPGILLSGTISGQ

SEQ ID NO: 1321194 - protein, 17 aa, Mycobacterium
LRDVVRVAFIAYGETRH

SEQ ID NO: 1321195 - protein, 17 aa, Mycobacterium
LRDVYERWPVSTRGWIE

SEQ ID NO: 1321196 - protein, 22 aa, Mycobacterium
LRDWARALDVNAEPGRLYIRDG

SEQ ID NO: 1321197 - protein, 18 aa, Mycobacterium
LRDWLMARAIECGVPPRG

SEQ ID NO: 1321198 - protein, 26 aa, Mycobacterium
LRDWRQWWTWSPGACWRHPFGPESSW

SEQ ID NO: 1321199 - protein, 25 aa, Mycobacterium
LRDYLESLHRLQGLGRRTVLPGHGP

SEQ ID NO: 1321200 - protein, 18 aa, Mycobacterium
LREDLWKALGAKADATVA

SEQ ID NO: 1321201 - protein, 26 aa, Mycobacterium
LREILDRLGYRFLPEQVPKMVDYYLA

SEQ ID NO: 1321202 - protein, 19 aa, Mycobacterium
LRELLAGVARDRGFIRGEQ

SEQ ID NO: 1321203 - protein, 18 aa, Mycobacterium
LRELRRRNRLLNRRTRCC

SEQ ID NO: 1321204 - protein, 35 aa, Mycobacterium
LREQDALERMALLGLPFLFFIDAAQGRASLLYRRY

SEQ ID NO: 1321205 - protein, 24 aa, Mycobacterium
LREQLIELLSRQAALFNDAPLHVT

SEQ ID NO: 1321206 - protein, 17 aa, Mycobacterium
LREQYELLLADHPDIEA

SEQ ID NO: 1321207 - protein, 25 aa, Mycobacterium
LRERHPAWRLLRAGNAALVLSFLGQ

SEQ ID NO: 1321208 - protein, 23 aa, Mycobacterium
LRERVRAQILDALRAFDDPSHAA

SEQ ID NO: 1321209 - protein, 25 aa, Mycobacterium
LRERVTRLFGLVLPAIVTDESREYF

SEQ ID NO: 1321210 - protein, 35 aa, Mycobacterium
LREVADASLSYPYLDTLLFILGITRGEIEAADALD

SEQ ID NO: 1321211 - protein, 19 aa, Mycobacterium
LRFAFANHHVPFLWNEDNP

SEQ ID NO: 1321212 - protein, 26 aa, Mycobacterium
LRFAHEFNGDWYPWTPAHGATPDAYV

SEQ ID NO: 1321213 - protein, 18 aa, Mycobacterium
LRFLRCDLADRTSIESLV

SEQ ID NO: 1321214 - protein, 18 aa, Mycobacterium
LRFSLGLMEIVGLRLAGA

SEQ ID NO: 1321215 - protein, 18 aa, Mycobacterium
LRFTAQAAQMLPPRGRRW

SEQ ID NO: 1321216 - protein, 24 aa, Mycobacterium
LRGARVDPTFWTTAKLRGAKVDID

SEQ ID NO: 1321217 - protein, 26 aa, Mycobacterium
LRGAVLGVLGGPLGMLGGSVAGFVGG

SEQ ID NO: 1321218 - protein, 30 aa, Mycobacterium
LRGGKRLRPAFAYWGWRAVAGTEPGPEALR

SEQ ID NO: 1321219 - protein, 18 aa, Mycobacterium
LRGLSEVLRFDLARHRIG

SEQ ID NO: 1321220 - protein, 18 aa, Mycobacterium
LRGLVPEISLIFGKCAGG

SEQ ID NO: 1321221 - protein, 19 aa, Mycobacterium
LRGRTIITMFYENSTRTRV

SEQ ID NO: 1321222 - protein, 34 aa, Mycobacterium
LRGRWIGMLTHCRRARLLAYRVVALQSSGRITPG

SEQ ID NO: 1321223 - protein, 27 aa, Mycobacterium
LRGSTRGWFMDWLARTYPDLVGEYRRL

SEQ ID NO: 1321224 - protein, 23 aa, Mycobacterium
LRIGRRIVARLNWRKQGPAPRPV

SEQ ID NO: 1321225 - protein, 18 aa, Mycobacterium
LRILRRRSLAALRAQIEP

SEQ ID NO: 1321226 - protein, 19 aa, Mycobacterium
LRIQRRPDGTLQHPPVPAV

SEQ ID NO: 1321227 - protein, 18 aa, Mycobacterium
LRISFSPVPFEGAAGNGA

SEQ ID NO: 1321228 - protein, 22 aa, Mycobacterium
LRITQGTFYELFPDVPPVPAEK

SEQ ID NO: 1321229 - protein, 21 aa, Mycobacterium
LRKAVGWYRSHGRLHTGDPIA

SEQ ID NO: 1321230 - protein, 18 aa, Mycobacterium
LRKGLLVGLGTTGPLFES

SEQ ID NO: 1321231 - protein, 26 aa, Mycobacterium
LRKIEPSLLGWLARLLPAAIAEHTGR

SEQ ID NO: 1321232 - protein, 20 aa, Mycobacterium
LRKIVSRGFTPRMLSEMRGL

SEQ ID NO: 1321233 - protein, 23 aa, Mycobacterium
LRKRLDGLTYRDAARLGRRLRNA

SEQ ID NO: 1321234 - protein, 37 aa, Mycobacterium
LRKVIHGRLYKLDPFRYQLIDIPFKFHHPMWRENAEV

SEQ ID NO: 1321235 - protein, 21 aa, Mycobacterium
LRKVLVPHALRLREAAILGDG

SEQ ID NO: 1321236 - protein, 18 aa, Mycobacterium
LRLADESMLPLRPANFVS

SEQ ID NO: 1321237 - protein, 21 aa, Mycobacterium
LRLAGMRPVPRWPARPTVDLR

SEQ ID NO: 1321238 - protein, 25 aa, Mycobacterium
LRLIAEKEAFFAEAWLSLADSVRTG

SEQ ID NO: 1321239 - protein, 33 aa, Mycobacterium
LRLIPNIVVLPYRNPFVVAKYGATLDLLSGGRF

SEQ ID NO: 1321240 - protein, 17 aa, Mycobacterium
LRLLAAHAPPYNRRSKF

SEQ ID NO: 1321241 - protein, 17 aa, Mycobacterium
LRLLCTDLAVAADQPHL

SEQ ID NO: 1321242 - protein, 18 aa, Mycobacterium
LRLQFWVCGTFELNDAGQ

SEQ ID NO: 1321243 - protein, 18 aa, Mycobacterium
LRLVATDMDWSAGTGPEV

SEQ ID NO: 1321244 - protein, 19 aa, Mycobacterium
LRMIATVNYLGVVELLERW

SEQ ID NO: 1321245 - protein, 34 aa, Mycobacterium
LRMINPVLALPFRPLLKFLTAGFLAPVFRDALGV

SEQ ID NO: 1321246 - protein, 17 aa, Mycobacterium
LRMMLQVLSHQDGYERR

SEQ ID NO: 1321247 - protein, 24 aa, Mycobacterium
LRMMTPLPFNFRQAIRDTDLLGYY

SEQ ID NO: 1321248 - protein, 17 aa, Mycobacterium
LRMRRLIRERGIDTVWF

SEQ ID NO: 1321249 - protein, 26 aa, Mycobacterium
LRMVQRARDMLWLNRSRWNRTTTGDA

SEQ ID NO: 1321250 - protein, 17 aa, Mycobacterium
LRNCPFLDLADTRRDVV

SEQ ID NO: 1321251 - protein, 19 aa, Mycobacterium
LRNDIAFNFVFSDPSAGLS

SEQ ID NO: 1321252 - protein, 17 aa, Mycobacterium
LRNFKMPGYTIPDFRRR

SEQ ID NO: 1321253 - protein, 25 aa, Mycobacterium
LRNGALNPNAFRRKPMDEDAILDSP

SEQ ID NO: 1321254 - protein, 29 aa, Mycobacterium
LRNGGLQMGALRDALLDLVSSLERFGFAV

SEQ ID NO: 1321255 - protein, 20 aa, Mycobacterium
LRNLFKLSSLASFEGQLGKW

SEQ ID NO: 1321256 - protein, 19 aa, Mycobacterium
LRNWLATYVEFYDRYSGCI

SEQ ID NO: 1321257 - protein, 18 aa, Mycobacterium
LRPFLLVASFVNPHDIVL

SEQ ID NO: 1321258 - protein, 26 aa, Mycobacterium
LRPRGRLMVVAIWEAPAGIDINRSVM

SEQ ID NO: 1321259 - protein, 19 aa, Mycobacterium
LRPTGRLYDDVAAAGLTGV

SEQ ID NO: 1321260 - protein, 43 aa, Mycobacterium
LRPTSRVSLLSPTGAFLGLIGPGGLLIGNGVLPGQNGGLLIGN

SEQ ID NO: 1321261 - protein, 22 aa, Mycobacterium
LRPVMGRYNRRITADSPFAITG

SEQ ID NO: 1321262 - protein, 31 aa, Mycobacterium
LRQGDRYLMVNPYFHTFGYKAGLIASFIRGA

SEQ ID NO: 1321263 - protein, 18 aa, Mycobacterium
LRQILGAANFRAGRLLAF

SEQ ID NO: 1321264 - protein, 18 aa, Mycobacterium
LRQKVVTPTLPTAAPRWV

SEQ ID NO: 1321265 - protein, 17 aa, Mycobacterium
LRQLDVPLADIESILTA

SEQ ID NO: 1321266 - protein, 31 aa, Mycobacterium
LRQLHAFLCDTLLMTGFGFAPPAATPTWGVL

SEQ ID NO: 1321267 - protein, 19 aa, Mycobacterium
LRQMLGSANFTGGWLLRFM

SEQ ID NO: 1321268 - protein, 18 aa, Mycobacterium
LRQRFLPGMINGSERWCQ

SEQ ID NO: 1321269 - protein, 24 aa, Mycobacterium
LRQRGMDLLEWLLGVETADGHLSP

SEQ ID NO: 1321270 - protein, 19 aa, Mycobacterium
LRRALSRVLGPRYVERARE

SEQ ID NO: 1321271 - protein, 28 aa, Mycobacterium
LRRERVLALALQLLDRGYFRAGGEQYAE

SEQ ID NO: 1321272 - protein, 18 aa, Mycobacterium
LRRHLPDLKLRFVNVVDL

SEQ ID NO: 1321273 - protein, 17 aa, Mycobacterium
LRRHRAIVRAGDRDELA

SEQ ID NO: 1321274 - protein, 17 aa, Mycobacterium
LRRIGLEALLRMPPDEV

SEQ ID NO: 1321275 - protein, 25 aa, Mycobacterium
LRRKLGDDPVLPRYVRTVRGLGYCL

SEQ ID NO: 1321276 - protein, 25 aa, Mycobacterium
LRRKRLDERLFLERYVRIRAELVGE

SEQ ID NO: 1321277 - protein, 24 aa, Mycobacterium
LRRLWRARRVLAVTFPTHGDSVES

SEQ ID NO: 1321278 - protein, 17 aa, Mycobacterium
LRRPCGRIHWAGTESSA

SEQ ID NO: 1321279 - protein, 19 aa, Mycobacterium
LRRPEPPMLTNWITTFMGR

SEQ ID NO: 1321280 - protein, 17 aa, Mycobacterium
LRRPQFSFPARGILTSR

SEQ ID NO: 1321281 - protein, 24 aa, Mycobacterium
LRRQIPVLGICRGAQMLNVALGGT

SEQ ID NO: 1321282 - protein, 26 aa, Mycobacterium
LRRQYDPLMSPLVWDLAHIGQQEELW

SEQ ID NO: 1321283 - protein, 18 aa, Mycobacterium
LRRRGHVAVYGVDKFPRM

SEQ ID NO: 1321284 - protein, 22 aa, Mycobacterium
LRRRLARVGLGPKVLRGRANGD

SEQ ID NO: 1321285 - protein, 18 aa, Mycobacterium
LRRRLRRSVWALCASWYR

SEQ ID NO: 1321286 - protein, 18 aa, Mycobacterium
LRRRRATGGPAEQTFATL

SEQ ID NO: 1321287 - protein, 18 aa, Mycobacterium
LRRVAFIRMSQRLGIPLA

SEQ ID NO: 1321288 - protein, 23 aa, Mycobacterium
LRRVAGDWQLCRRRLLLDQTVLL

SEQ ID NO: 1321289 - protein, 18 aa, Mycobacterium
LRRWLTQVLVAEQVVAMW

SEQ ID NO: 1321290 - protein, 26 aa, Mycobacterium
LRSAHFDFWTEQFLAAHPRAVVVHLG

SEQ ID NO: 1321291 - protein, 22 aa, Mycobacterium
LRSCPPIVLKSVRLYGEGDPVD

SEQ ID NO: 1321292 - protein, 25 aa, Mycobacterium
LRSGWTVAPVLTFTRRRPLAVVVDE

SEQ ID NO: 1321293 - protein, 20 aa, Mycobacterium
LRSRLFGHTTAVLTSATLTI

SEQ ID NO: 1321294 - protein, 26 aa, Mycobacterium
LRTEARPLTMRLSVPGRHMALNALGA

SEQ ID NO: 1321295 - protein, 21 aa, Mycobacterium
LRTFRVRFAAITPVHARPTCT

SEQ ID NO: 1321296 - protein, 24 aa, Mycobacterium
LRTGQYPQALAWIQMTRGANPTAY

SEQ ID NO: 1321297 - protein, 17 aa, Mycobacterium
LRTLAYGGSKVPLPLVR

SEQ ID NO: 1321298 - protein, 19 aa, Mycobacterium
LRTLLLKYDGRADEPLLCG

SEQ ID NO: 1321299 - protein, 20 aa, Mycobacterium
LRTLWRMDLTRDKRLRRLPN

SEQ ID NO: 1321300 - protein, 21 aa, Mycobacterium
LRTPELYPRLGELLTGMLCEM

SEQ ID NO: 1321301 - protein, 18 aa, Mycobacterium
LRTRIAPQNAWIVDRYLA

SEQ ID NO: 1321302 - protein, 20 aa, Mycobacterium
LRTRLFAAPGWNVSQGALTA

SEQ ID NO: 1321303 - protein, 17 aa, Mycobacterium
LRTTWAVAKVLKDRGRA

SEQ ID NO: 1321304 - protein, 27 aa, Mycobacterium
LRVGTFVINSAFYRPALLARDVAALHD

SEQ ID NO: 1321305 - protein, 23 aa, Mycobacterium
LRVGYLIGTGADLLFRLVRHFEA

SEQ ID NO: 1321306 - protein, 17 aa, Mycobacterium
LRVLRTIRREQRKHRAA

SEQ ID NO: 1321307 - protein, 17 aa, Mycobacterium
LRVPEAAAAAVLAAARQ

SEQ ID NO: 1321308 - protein, 18 aa, Mycobacterium
LRVPRYPDILGLDTFTGP

SEQ ID NO: 1321309 - protein, 29 aa, Mycobacterium
LRVQRVDGLLQIDWWYDESRLDAYSVEEM

SEQ ID NO: 1321310 - protein, 20 aa, Mycobacterium
LRVRPHSPLARAAREVLAVL

SEQ ID NO: 1321311 - protein, 20 aa, Mycobacterium
LRVRPTVSWSWNLSGEPLNH

SEQ ID NO: 1321312 - protein, 29 aa, Mycobacterium
LRVRTDVARGARIHHASLTAAAESHLGDG

SEQ ID NO: 1321313 - protein, 19 aa, Mycobacterium
LRVTLADRALTQTNPLLGV

SEQ ID NO: 1321314 - protein, 28 aa, Mycobacterium
LRVTNPSPYMYLLNVPNADGGLDFSIVG

SEQ ID NO: 1321315 - protein, 40 aa, Mycobacterium
LRVVAPEAYFQFPVAKYGIALDNWSIRRLTSLVGAGRARG

SEQ ID NO: 1321316 - protein, 19 aa, Mycobacterium
LRWDSLGEFLALGASFEDM

SEQ ID NO: 1321317 - protein, 20 aa, Mycobacterium
LRYAPGQFLTLRVPSDRTGS

SEQ ID NO: 1321318 - protein, 21 aa, Mycobacterium
LRYCVNSAALRFIHLDDLEAQ

SEQ ID NO: 1321319 - protein, 25 aa, Mycobacterium
LRYPTALVDDFDWARTLSGGGLFGE

SEQ ID NO: 1321320 - protein, 19 aa, Mycobacterium
LRYRTLVTAAQYLALGIDP

SEQ ID NO: 1321321 - protein, 28 aa, Mycobacterium
LRYTMPLGEIIFDFFDSLKSRTRGYASL

SEQ ID NO: 1321322 - protein, 29 aa, Mycobacterium
LSAEYGLLPQWGLARLLRIAPVSREMILN

SEQ ID NO: 1321323 - protein, 25 aa, Mycobacterium
LSAKHSIMFLCAAHMWLGASAINAD

SEQ ID NO: 1321324 - protein, 17 aa, Mycobacterium
LSALDLAPRIRVNAIAP

SEQ ID NO: 1321325 - protein, 24 aa, Mycobacterium
LSALELEFYLLREKAGTTHRKRAD

SEQ ID NO: 1321326 - protein, 19 aa, Mycobacterium
LSALMTNNRVRHVPVVVDG

SEQ ID NO: 1321327 - protein, 19 aa, Mycobacterium
LSARWRPVLEPVLADIAAQ

SEQ ID NO: 1321328 - protein, 27 aa, Mycobacterium
LSATRYEWPILDYAILSVGAVTVPIYE

SEQ ID NO: 1321329 - protein, 21 aa, Mycobacterium
LSAYLRTLAAAPLAHVLVAGM

SEQ ID NO: 1321330 - protein, 27 aa, Mycobacterium
LSCPADHTLLLALRAYADVVLVGAGTA

SEQ ID NO: 1321331 - protein, 17 aa, Mycobacterium
LSDADLLAAHRLELPWG

SEQ ID NO: 1321332 - protein, 31 aa, Mycobacterium
LSDLADLLDNLPAFAALRPFFETRTIRVEDE

SEQ ID NO: 1321333 - protein, 17 aa, Mycobacterium
LSDLLAPRDPHDADDIV

SEQ ID NO: 1321334 - protein, 19 aa, Mycobacterium
LSDLRHLFDALGVDWEQAV

SEQ ID NO: 1321335 - protein, 29 aa, Mycobacterium
LSDTVAWILRDLGVYSLRLADDAPGYGLV

SEQ ID NO: 1321336 - protein, 25 aa, Mycobacterium
LSDVHGTWLVAIISGGLSPTDRFLS

SEQ ID NO: 1321337 - protein, 19 aa, Mycobacterium
LSDWPRRSAQFTKVMPRDF

SEQ ID NO: 1321338 - protein, 26 aa, Mycobacterium
LSEAEFLARREAVERMMVIRDKVRTE

SEQ ID NO: 1321339 - protein, 19 aa, Mycobacterium
LSEDPPVSVWAIDAPDRIS

SEQ ID NO: 1321340 - protein, 18 aa, Mycobacterium
LSELGFVGIGIGAALGGL

SEQ ID NO: 1321341 - protein, 27 aa, Mycobacterium
LSELGRQQLMARAWRNTKDELARLGQV

SEQ ID NO: 1321342 - protein, 19 aa, Mycobacterium
LSERLGVRRVIGLGSIPMA

SEQ ID NO: 1321343 - protein, 34 aa, Mycobacterium
LSERQRMHLLFEVCSSTIWARRVVAGSPFRDAEA

SEQ ID NO: 1321344 - protein, 29 aa, Mycobacterium
LSEVPELAVPLVFRLLGETGSHASVLVDV

SEQ ID NO: 1321345 - protein, 24 aa, Mycobacterium
LSFNVDYASVTRLLWSSRANQLAV

SEQ ID NO: 1321346 - protein, 17 aa, Mycobacterium
LSFSVAPDVRPLPRSLD

SEQ ID NO: 1321347 - protein, 24 aa, Mycobacterium
LSGADIVVVRILGGYRAWEDGIDT

SEQ ID NO: 1321348 - protein, 25 aa, Mycobacterium
LSGALGFLGGFRGLGAGGGTLFARF

SEQ ID NO: 1321349 - protein, 23 aa, Mycobacterium
LSGDDYHPEWWPGVVAAVEEALP

SEQ ID NO: 1321350 - protein, 18 aa, Mycobacterium
LSGFLEIQFDRCSVVGQS

SEQ ID NO: 1321351 - protein, 26 aa, Mycobacterium
LSGFLNLSEGWWPFLVGLSMGDAGGY

SEQ ID NO: 1321352 - protein, 25 aa, Mycobacterium
LSGIPRALIVVPTRELCLQVHSDLS

SEQ ID NO: 1321353 - protein, 24 aa, Mycobacterium
LSGIVLFPGLVSYSASKAALSHFT

SEQ ID NO: 1321354 - protein, 25 aa, Mycobacterium
LSGLGGGLLKAGGWITAGIAAGKLF

SEQ ID NO: 1321355 - protein, 25 aa, Mycobacterium
LSGLIAARTLLGAGLTPLILEADTR

SEQ ID NO: 1321356 - protein, 18 aa, Mycobacterium
LSGLLNRRALMAHLDRRL

SEQ ID NO: 1321357 - protein, 29 aa, Mycobacterium
LSGVDLEVGQLLGSGWKGGAATAFGTEWD

SEQ ID NO: 1321358 - protein, 17 aa, Mycobacterium
LSGVLFGLVGPVIGPVL

SEQ ID NO: 1321359 - protein, 17 aa, Mycobacterium
LSGVWKSVKAAVPHLLS

SEQ ID NO: 1321360 - protein, 20 aa, Mycobacterium
LSHDPPVPTLATAPPAALDR

SEQ ID NO: 1321361 - protein, 17 aa, Mycobacterium
LSHLQEHWSGQAASAAL

SEQ ID NO: 1321362 - protein, 19 aa, Mycobacterium
LSHNGLVDRAVLPSSPRAE

SEQ ID NO: 1321363 - protein, 26 aa, Mycobacterium
LSKARFEFRWEDQFNLSLDPDTAREF

SEQ ID NO: 1321364 - protein, 26 aa, Mycobacterium
LSKGLINPPQFFDPSALSPPLAEPLP

SEQ ID NO: 1321365 - protein, 20 aa, Mycobacterium
LSKPFVFEDGNRILLSVGTQ

SEQ ID NO: 1321366 - protein, 26 aa, Mycobacterium
LSKTLQQFITELFLTGGRRQREALSG

SEQ ID NO: 1321367 - protein, 24 aa, Mycobacterium
LSLADYRTYVLPHSARVFASLAGA

SEQ ID NO: 1321368 - protein, 26 aa, Mycobacterium
LSLAHPVRQFVLFTSISGLIGSRWLA

SEQ ID NO: 1321369 - protein, 39 aa, Mycobacterium
LSLEHQVLPKHLNFRSPSPHIPWNRLPVRIVDDPVPWTR

SEQ ID NO: 1321370 - protein, 17 aa, Mycobacterium
LSLLLQARYDDGSPMPD

SEQ ID NO: 1321371 - protein, 21 aa, Mycobacterium
LSLMMLTMDPPRHTALRALVS

SEQ ID NO: 1321372 - protein, 18 aa, Mycobacterium
LSLPVDMSISSGLNALAH

SEQ ID NO: 1321373 - protein, 18 aa, Mycobacterium
LSMAQAAALPLGFITSWE

SEQ ID NO: 1321374 - protein, 35 aa, Mycobacterium
LSMEAFETTIKFYLTAVFNIMRLSAAAIAKTEPLE

SEQ ID NO: 1321375 - protein, 18 aa, Mycobacterium
LSMVMLEWGSCGQLVVEH

SEQ ID NO: 1321376 - protein, 37 aa, Mycobacterium
LSNLVSPPSLTIPSIPGLPVPLPNEVPVPSDLLCVGT

SEQ ID NO: 1321377 - protein, 26 aa, Mycobacterium
LSPDHVVNLVRFLASPAAEGVNGQLF

SEQ ID NO: 1321378 - protein, 29 aa, Mycobacterium
LSPELRGRLVWAWRTDISGPAARLLNARA

SEQ ID NO: 1321379 - protein, 21 aa, Mycobacterium
LSPGLGFPSLASPGLTTPGLT

SEQ ID NO: 1321380 - protein, 26 aa, Mycobacterium
LSPKAWPRHVWIADALPSTATNKVLK

SEQ ID NO: 1321381 - protein, 22 aa, Mycobacterium
LSPLAYSLVGGRMLVTGSYAGA

SEQ ID NO: 1321382 - protein, 32 aa, Mycobacterium
LSPRREDKFSFGLWTVGWPGVDPFGVATRPAL

SEQ ID NO: 1321383 - protein, 17 aa, Mycobacterium
LSPTPGQAWWLSGQALE

SEQ ID NO: 1321384 - protein, 19 aa, Mycobacterium
LSPYGFSGWVGPEPHGAKL

SEQ ID NO: 1321385 - protein, 34 aa, Mycobacterium
LSQDERDFYLKWFWTQPLWLDLGDIRVIHACWHE

SEQ ID NO: 1321386 - protein, 29 aa, Mycobacterium
LSQREAWPVLRRNLSVLALRGADPRELLT

SEQ ID NO: 1321387 - protein, 17 aa, Mycobacterium
LSQRLSHILGRGSGQDG

SEQ ID NO: 1321388 - protein, 22 aa, Mycobacterium
LSQVIVYRRLDFSLDEIASLLD

SEQ ID NO: 1321389 - protein, 27 aa, Mycobacterium
LSRAVFSKGIFPAVDPLASSSTILDPA

SEQ ID NO: 1321390 - protein, 24 aa, Mycobacterium
LSRELALAFQRLGAFVVAVDRYAD

SEQ ID NO: 1321391 - protein, 26 aa, Mycobacterium
LSRGAIFHHFRDKDTLFFELAREDAE

SEQ ID NO: 1321392 - protein, 18 aa, Mycobacterium
LSRHRWAVLMKVHHCLAD

SEQ ID NO: 1321393 - protein, 19 aa, Mycobacterium
LSRPSLDDVFLTLTGHRTE

SEQ ID NO: 1321394 - protein, 19 aa, Mycobacterium
LSRQQRIAVWKLVEAFRRQ

SEQ ID NO: 1321395 - protein, 21 aa, Mycobacterium
LSRRQWHGMFALMGSPEEFAD

SEQ ID NO: 1321396 - protein, 31 aa, Mycobacterium
LSRSMTKLWARMWLLRFTWQRAIDSGDLTSP

SEQ ID NO: 1321397 - protein, 23 aa, Mycobacterium
LSRWESDWPGAHPIDTAGPLADS

SEQ ID NO: 1321398 - protein, 25 aa, Mycobacterium
LSSDPAWRYLNIRRLFNYLEESILE

SEQ ID NO: 1321399 - protein, 18 aa, Mycobacterium
LSSFPLACAGCWINGVPM

SEQ ID NO: 1321400 - protein, 17 aa, Mycobacterium
LSSLASFEGQLGKWARM

SEQ ID NO: 1321401 - protein, 24 aa, Mycobacterium
LSSMWAGPLCGQLLARAGATVVKV

SEQ ID NO: 1321402 - protein, 27 aa, Mycobacterium
LSSRAFYRHFLSKDDLFLALLRQECEA

SEQ ID NO: 1321403 - protein, 24 aa, Mycobacterium
LSSRPAVVFSRRQLLEAVWGDSWG

SEQ ID NO: 1321404 - protein, 25 aa, Mycobacterium
LSSRPAVVFSRRQLLEAVWGDSWGG

SEQ ID NO: 1321405 - protein, 26 aa, Mycobacterium
LSTDHVVTLVRFLASPASEGVNGQLF

SEQ ID NO: 1321406 - protein, 26 aa, Mycobacterium
LSTDVVSWYLILGALAQIDATLAAGH

SEQ ID NO: 1321407 - protein, 17 aa, Mycobacterium
LSTGGLLGAYYLPSQLL

SEQ ID NO: 1321408 - protein, 27 aa, Mycobacterium
LSTHHDLHLWLPHPSDKLWTSLRGVHG

SEQ ID NO: 1321409 - protein, 23 aa, Mycobacterium
LSTRTIWRYFRTKESCVEPVLAL

SEQ ID NO: 1321410 - protein, 30 aa, Mycobacterium
LSTVRTQLEVILPYFLHYANDEQRDRWFPG

SEQ ID NO: 1321411 - protein, 29 aa, Mycobacterium
LSVAADLHLRRIFVLTFEVEFFGRHGFQE

SEQ ID NO: 1321412 - protein, 18 aa, Mycobacterium
LSVAIRRLERDLGIVIVQ

SEQ ID NO: 1321413 - protein, 31 aa, Mycobacterium
LSVCVTDHGRWRPPGLYRRPDRRGRGVALMH

SEQ ID NO: 1321414 - protein, 28 aa, Mycobacterium
LSVPAEARLPRTWIALLRGRVDASLAAT

SEQ ID NO: 1321415 - protein, 21 aa, Mycobacterium
LSVPALMRGYLRLGAQVCGEP

SEQ ID NO: 1321416 - protein, 27 aa, Mycobacterium
LSVPLSDIWIDIRFTLPAATVDGGAPI

SEQ ID NO: 1321417 - protein, 25 aa, Mycobacterium
LSVPTRRGDWWYYGRSFQGKQYGVQ

SEQ ID NO: 1321418 - protein, 21 aa, Mycobacterium
LSVQPISPVFLYAHTADELHE

SEQ ID NO: 1321419 - protein, 19 aa, Mycobacterium
LSVSFGEDWSWVRRAHEVG

SEQ ID NO: 1321420 - protein, 18 aa, Mycobacterium
LSVSFGEDWSWVRRAQEV

SEQ ID NO: 1321421 - protein, 25 aa, Mycobacterium
LSVTDQWVVLIDPVRMPADDFAELE

SEQ ID NO: 1321422 - protein, 21 aa, Mycobacterium
LSVVLAHQYLEQLDAGLRPAV

SEQ ID NO: 1321423 - protein, 17 aa, Mycobacterium
LSVWACDASSVAIAQAE

SEQ ID NO: 1321424 - protein, 24 aa, Mycobacterium
LSWQQVMVLRAYAKYLRQAGFPYS

SEQ ID NO: 1321425 - protein, 26 aa, Mycobacterium
LSWVDANIWRRVVPKGWFYNVMVTGV

SEQ ID NO: 1321426 - protein, 30 aa, Mycobacterium
LSYADGDIWDWAVPWEEWKSMSALSDQASP

SEQ ID NO: 1321427 - protein, 22 aa, Mycobacterium
LSYLRPRAVVFHRSLGAKFADV

SEQ ID NO: 1321428 - protein, 19 aa, Mycobacterium
LSYVVQWNISPVRDADGAI

SEQ ID NO: 1321429 - protein, 17 aa, Mycobacterium
LTAASILLSSRFPMWMA

SEQ ID NO: 1321430 - protein, 18 aa, Mycobacterium
LTAEAAAALWILHPTYFG

SEQ ID NO: 1321431 - protein, 24 aa, Mycobacterium
LTAELWAMQLPFGMGSTGLVAVAA

SEQ ID NO: 1321432 - protein, 25 aa, Mycobacterium
LTAERTLLNLVCHLSGIATATAAWV

SEQ ID NO: 1321433 - protein, 22 aa, Mycobacterium
LTAEVRRIFAGDSPELLEKLQP

SEQ ID NO: 1321434 - protein, 24 aa, Mycobacterium
LTAEYAFLVWLRQSRINTTLRVTD

SEQ ID NO: 1321435 - protein, 27 aa, Mycobacterium
LTAHAAVVGLRLAVMRRAASESPLPFA

SEQ ID NO: 1321436 - protein, 17 aa, Mycobacterium
LTAICAYDRRLVDAARA

SEQ ID NO: 1321437 - protein, 26 aa, Mycobacterium
LTALEGAFVLCRTLRSIDPIIAAGHG

SEQ ID NO: 1321438 - protein, 17 aa, Mycobacterium
LTALLSRVSERPARQWL

SEQ ID NO: 1321439 - protein, 18 aa, Mycobacterium
LTALRLAVTAPELVRRLV

SEQ ID NO: 1321440 - protein, 19 aa, Mycobacterium
LTALYATTMALFHRQRTGE

SEQ ID NO: 1321441 - protein, 23 aa, Mycobacterium
LTAMSVFFFDYLSRTAAVSNHLA

SEQ ID NO: 1321442 - protein, 17 aa, Mycobacterium
LTAPLYWNGDGSRTRFG

SEQ ID NO: 1321443 - protein, 24 aa, Mycobacterium
LTAQKYVPAPWNPAERLYVSGDMV

SEQ ID NO: 1321444 - protein, 20 aa, Mycobacterium
LTARLAFDWAQLKPGDRVLI

SEQ ID NO: 1321445 - protein, 30 aa, Mycobacterium
LTASLRGYQSFAARFALVQRKVIIGDEMGL

SEQ ID NO: 1321446 - protein, 20 aa, Mycobacterium
LTATFRPLAGPLQKQGIPKA

SEQ ID NO: 1321447 - protein, 18 aa, Mycobacterium
LTCGRALSLPPLPTPTDL

SEQ ID NO: 1321448 - protein, 17 aa, Mycobacterium
LTCPWHGFCYDAESGEC

SEQ ID NO: 1321449 - protein, 19 aa, Mycobacterium
LTCWGLSEQGRWWGLVTYP

SEQ ID NO: 1321450 - protein, 25 aa, Mycobacterium
LTDDEIIGFMFLMVIAGNETTTKLL

SEQ ID NO: 1321451 - protein, 31 aa, Mycobacterium
LTDEPRRWAYYPWRRTVVSILGPRAFARVRA

SEQ ID NO: 1321452 - protein, 17 aa, Mycobacterium
LTDLGWGARLRTLLEQD

SEQ ID NO: 1321453 - protein, 19 aa, Mycobacterium
LTDLLAPRDPHDADDIVLE

SEQ ID NO: 1321454 - protein, 24 aa, Mycobacterium
LTDLQVLRAYLQLGGNKVALAKRL

SEQ ID NO: 1321455 - protein, 26 aa, Mycobacterium
LTDMPAVIFVARTLGRFDVLMTVRAF

SEQ ID NO: 1321456 - protein, 32 aa, Mycobacterium
LTDNATLAHLLKFDSILGRLPYDVSLEGEDTI

SEQ ID NO: 1321457 - protein, 26 aa, Mycobacterium
LTDPTGAFLGLWQPTGHRGYGIVGEH

SEQ ID NO: 1321458 - protein, 23 aa, Mycobacterium
LTDSRNWRLRYSTADLPGGRVPS

SEQ ID NO: 1321459 - protein, 22 aa, Mycobacterium
LTDVEGLYTRWPDRDSLVSQID

SEQ ID NO: 1321460 - protein, 26 aa, Mycobacterium
LTEAGDSIYWAGLNKGKRSLAVDMRS

SEQ ID NO: 1321461 - protein, 19 aa, Mycobacterium
LTEFAPVPGMGWMFVADPD

SEQ ID NO: 1321462 - protein, 25 aa, Mycobacterium
LTEFARSACRWAPRVVFVNGHGGNV

SEQ ID NO: 1321463 - protein, 24 aa, Mycobacterium
LTEFVSFWRAVGLYVYQTHYDCVL

SEQ ID NO: 1321464 - protein, 25 aa, Mycobacterium
LTEGQLRMWFVHNADPSGALLNVCL

SEQ ID NO: 1321465 - protein, 17 aa, Mycobacterium
LTELARIFGSEKILPAP

SEQ ID NO: 1321466 - protein, 22 aa, Mycobacterium
LTELMRVRVLRQSPLGFGLLSR

SEQ ID NO: 1321467 - protein, 24 aa, Mycobacterium
LTELRDELGDVLLQVLFHARIAEE

SEQ ID NO: 1321468 - protein, 20 aa, Mycobacterium
LTEQLEILTGLWTAAPGETF

SEQ ID NO: 1321469 - protein, 17 aa, Mycobacterium
LTEVHPGRDYDRDAILF

SEQ ID NO: 1321470 - protein, 42 aa, Mycobacterium
LTEVMLHSDYPLQALLYCVVLHRFLRWRAPGYRAESHIAGVL

SEQ ID NO: 1321471 - protein, 17 aa, Mycobacterium
LTFDNEFFWKSGADGVL

SEQ ID NO: 1321472 - protein, 26 aa, Mycobacterium
LTFGADQPVYPPWYMGDDPTNGDGFE

SEQ ID NO: 1321473 - protein, 17 aa, Mycobacterium
LTFGKGLHYCLGANLAR

SEQ ID NO: 1321474 - protein, 20 aa, Mycobacterium
LTFISGDQWLTHPGSVGVVV

SEQ ID NO: 1321475 - protein, 23 aa, Mycobacterium
LTGAYVALPYLKRAPDSLMFSTS

SEQ ID NO: 1321476 - protein, 25 aa, Mycobacterium
LTGDGLGIIFRKGLPLEDMEFHQFH

SEQ ID NO: 1321477 - protein, 28 aa, Mycobacterium
LTGHLRALSFPQWGLATPAAGWGIQDQV

SEQ ID NO: 1321478 - protein, 21 aa, Mycobacterium
LTGIPRALIVVPTRELCIQVY

SEQ ID NO: 1321479 - protein, 19 aa, Mycobacterium
LTGLLLDRLLPVEGSRVVS

SEQ ID NO: 1321480 - protein, 18 aa, Mycobacterium
LTGLMDVGVRYLSRQTGS

SEQ ID NO: 1321481 - protein, 24 aa, Mycobacterium
LTGLTDPMRRAPQPGWDPVTVEDP

SEQ ID NO: 1321482 - protein, 23 aa, Mycobacterium
LTGTPPVLRLYSGSSGDLLYLDR

SEQ ID NO: 1321483 - protein, 25 aa, Mycobacterium
LTGWLALLAPDIIYRAPVRTTRDHR

SEQ ID NO: 1321484 - protein, 22 aa, Mycobacterium
LTIAAVCYCLINDTVRAGIAAD

SEQ ID NO: 1321485 - protein, 18 aa, Mycobacterium
LTIGNPDRAALGYEFTLF

SEQ ID NO: 1321486 - protein, 18 aa, Mycobacterium
LTIPPVDFVPQFGRNIKV

SEQ ID NO: 1321487 - protein, 24 aa, Mycobacterium
LTKPGLMYHFPTKSALMEALVDHV

SEQ ID NO: 1321488 - protein, 17 aa, Mycobacterium
LTKPVRLPPARLARIVE

SEQ ID NO: 1321489 - protein, 24 aa, Mycobacterium
LTLDDLVRLVLDWNRPVKMFIETK

SEQ ID NO: 1321490 - protein, 19 aa, Mycobacterium
LTLLDGLFAGYRELLTRTD

SEQ ID NO: 1321491 - protein, 18 aa, Mycobacterium
LTLLQLRSRTRQTASEID

SEQ ID NO: 1321492 - protein, 21 aa, Mycobacterium
LTLPGRSLLFVRNVGHLMTND

SEQ ID NO: 1321493 - protein, 22 aa, Mycobacterium
LTLPGRSLLFVRNVGHLMTNDA

SEQ ID NO: 1321494 - protein, 31 aa, Mycobacterium
LTLPHPYAHLRGFVLMPWLAAEPEATLTVAD

SEQ ID NO: 1321495 - protein, 17 aa, Mycobacterium
LTLTVWSPDTAASLPVM

SEQ ID NO: 1321496 - protein, 17 aa, Mycobacterium
LTLVIVPDCEETLEDAI

SEQ ID NO: 1321497 - protein, 25 aa, Mycobacterium
LTMDDYLAARWINEPFRVLDCTSEV

SEQ ID NO: 1321498 - protein, 27 aa, Mycobacterium
LTMQDYLDAPPISSPLSLFDCSLETDG

SEQ ID NO: 1321499 - protein, 23 aa, Mycobacterium
LTNALLHAGCRTTVWNRTAARAD

SEQ ID NO: 1321500 - protein, 24 aa, Mycobacterium
LTNATAARRWLVDGLGGSAGQDAV

SEQ ID NO: 1321501 - protein, 21 aa, Mycobacterium
LTNCFVGVSFYRSIDGQSLQT

SEQ ID NO: 1321502 - protein, 24 aa, Mycobacterium
LTNIRTGALRRIGLDFPAVAAANP

SEQ ID NO: 1321503 - protein, 19 aa, Mycobacterium
LTNTPDFVPRWSPTSGQVR

SEQ ID NO: 1321504 - protein, 19 aa, Mycobacterium
LTPAVVWQDRRAESLCAAV

SEQ ID NO: 1321505 - protein, 34 aa, Mycobacterium
LTPDGRPFFCGTYYPKPNFLQLLAAVAETWRERR

SEQ ID NO: 1321506 - protein, 21 aa, Mycobacterium
LTPERAWVLASDLKRFDEWLT

SEQ ID NO: 1321507 - protein, 28 aa, Mycobacterium
LTPGDPLLLRLVGTLAPGVLLPGFSGPD

SEQ ID NO: 1321508 - protein, 17 aa, Mycobacterium
LTPGMVHGFFGLDEVFP

SEQ ID NO: 1321509 - protein, 21 aa, Mycobacterium
LTPGWMALRPLAGRVVTVCSF

SEQ ID NO: 1321510 - protein, 18 aa, Mycobacterium
LTPITAAPVYLKVEAAYA

SEQ ID NO: 1321511 - protein, 20 aa, Mycobacterium
LTPMIEPLYLENPARRTNME

SEQ ID NO: 1321512 - protein, 26 aa, Mycobacterium
LTPQELAKFFILLIGAGNETTRNALT

SEQ ID NO: 1321513 - protein, 26 aa, Mycobacterium
LTPTDGMIRFMIRYGLVIARVYSGEL

SEQ ID NO: 1321514 - protein, 20 aa, Mycobacterium
LTPTTWLPFGGGNRRCLGAT

SEQ ID NO: 1321515 - protein, 18 aa, Mycobacterium
LTQETFIRVFRSVQNYQP

SEQ ID NO: 1321516 - protein, 17 aa, Mycobacterium
LTQTLQALAGPGSFRGK

SEQ ID NO: 1321517 - protein, 20 aa, Mycobacterium
LTRAALRWNYTAIHPNIYLP

SEQ ID NO: 1321518 - protein, 24 aa, Mycobacterium
LTRHDDVFYASRHPEIFSSALGIT

SEQ ID NO: 1321519 - protein, 17 aa, Mycobacterium
LTRHPEMPEWHLHLASI

SEQ ID NO: 1321520 - protein, 22 aa, Mycobacterium
LTRLKMYRLLHDLWARRHMAVL

SEQ ID NO: 1321521 - protein, 21 aa, Mycobacterium
LTRNGRLPHLLNADSPQAVSL

SEQ ID NO: 1321522 - protein, 18 aa, Mycobacterium
LTRPFTPPPTFMNHMVDA

SEQ ID NO: 1321523 - protein, 24 aa, Mycobacterium
LTRPQATVGLFHAPARLVAGPAEA

SEQ ID NO: 1321524 - protein, 24 aa, Mycobacterium
LTRSLNLFTTIPFVKDNLTKWWRG

SEQ ID NO: 1321525 - protein, 18 aa, Mycobacterium
LTRSWLSQWPALPEAMDA

SEQ ID NO: 1321526 - protein, 17 aa, Mycobacterium
LTRTAGFQWARHNICVN

SEQ ID NO: 1321527 - protein, 23 aa, Mycobacterium
LTRTDIEDIFWLQSTIAQELAAT

SEQ ID NO: 1321528 - protein, 27 aa, Mycobacterium
LTSDLGFRMPSLWFADGHRAVAPVYLY

SEQ ID NO: 1321529 - protein, 18 aa, Mycobacterium
LTSFVLPGGTPLSAQLHV

SEQ ID NO: 1321530 - protein, 32 aa, Mycobacterium
LTSGLVLAGARWSLPPLVTPVGAPTYTLGSTP

SEQ ID NO: 1321531 - protein, 21 aa, Mycobacterium
LTSLPLTLYSDPSAPGLECAP

SEQ ID NO: 1321532 - protein, 22 aa, Mycobacterium
LTSLTRPTLVLWTSHNPSATVE

SEQ ID NO: 1321533 - protein, 25 aa, Mycobacterium
LTSMRPPILPALLNRPNRETIELKG

SEQ ID NO: 1321534 - protein, 20 aa, Mycobacterium
LTSPDKPYFPKLGKDGTKGK

SEQ ID NO: 1321535 - protein, 20 aa, Mycobacterium
LTSRFLITATGYLSQPRKPD

SEQ ID NO: 1321536 - protein, 23 aa, Mycobacterium
LTSRIHGVLTPIPSPAFDAPPTD

SEQ ID NO: 1321537 - protein, 29 aa, Mycobacterium
LTTAFGPTTGLWILLLAKGGGDTKVSAEP

SEQ ID NO: 1321538 - protein, 19 aa, Mycobacterium
LTTDTIMYVSPARPMTIPS

SEQ ID NO: 1321539 - protein, 24 aa, Mycobacterium
LTTGQLVRLPWDYKRLYGLDPDEQ

SEQ ID NO: 1321540 - protein, 37 aa, Mycobacterium
LTTPWSPLQLAYFAGYAMWTYLSEPYSLTFPGVYTEE

SEQ ID NO: 1321541 - protein, 18 aa, Mycobacterium
LTTVYRTLQQMAAAGVVD

SEQ ID NO: 1321542 - protein, 23 aa, Mycobacterium
LTVAAWPGLAPRLLRDGTDTESA

SEQ ID NO: 1321543 - protein, 17 aa, Mycobacterium
LTVAENIAFPLRATKTP

SEQ ID NO: 1321544 - protein, 25 aa, Mycobacterium
LTVAMDWYSRCVTGLRLTPVSTKSI

SEQ ID NO: 1321545 - protein, 29 aa, Mycobacterium
LTVDLFGMTLPSPLFMAPIGVIGICSQNG

SEQ ID NO: 1321546 - protein, 25 aa, Mycobacterium
LTVDPLIGRLPRAYTLPQGLSDKLR

SEQ ID NO: 1321547 - protein, 24 aa, Mycobacterium
LTVEGLGFGTLWLNGGQLDRLDRL

SEQ ID NO: 1321548 - protein, 18 aa, Mycobacterium
LTVGLLEGSMLEEAANII

SEQ ID NO: 1321549 - protein, 26 aa, Mycobacterium
LTVQSLRDGIIPPTLNLKNLDPEIDL

SEQ ID NO: 1321550 - protein, 19 aa, Mycobacterium
LTVRAARFLADAELVLYPG

SEQ ID NO: 1321551 - protein, 21 aa, Mycobacterium
LTVVGLGRYIPRIARIAAATD

SEQ ID NO: 1321552 - protein, 18 aa, Mycobacterium
LTYPGIGFVVWRNAEHLP

SEQ ID NO: 1321553 - protein, 22 aa, Mycobacterium
LTYQMMYELRDLGFSTAIGIGG

SEQ ID NO: 1321554 - protein, 18 aa, Mycobacterium
LTYTLRMAAVGQPLQHHL

SEQ ID NO: 1321555 - protein, 19 aa, Mycobacterium
LVAAAHHFAPEVQLVLCAG

SEQ ID NO: 1321556 - protein, 24 aa, Mycobacterium
LVAAHLQWHLERQLRTLPLVERVY

SEQ ID NO: 1321557 - protein, 21 aa, Mycobacterium
LVAAVWGAIMMAALADLGPGA

SEQ ID NO: 1321558 - protein, 24 aa, Mycobacterium
LVADLLDAWHKPIDLGVAHCLYAG

SEQ ID NO: 1321559 - protein, 18 aa, Mycobacterium
LVADSLPDSWDSPVATDV

SEQ ID NO: 1321560 - protein, 19 aa, Mycobacterium
LVAFEAMNHWRPDGGFSLH

SEQ ID NO: 1321561 - protein, 28 aa, Mycobacterium
LVAIENAIWPDLFIVGGGISRKADKWVP

SEQ ID NO: 1321562 - protein, 18 aa, Mycobacterium
LVAQWMLVGFVHGVMNTD

SEQ ID NO: 1321563 - protein, 17 aa, Mycobacterium
LVARIRAMLRRPRVLHT

SEQ ID NO: 1321564 - protein, 22 aa, Mycobacterium
LVARLHALLRRAHHSDPTSDTM

SEQ ID NO: 1321565 - protein, 23 aa, Mycobacterium
LVARLRGLLRRSAYLAPADDESL

SEQ ID NO: 1321566 - protein, 33 aa, Mycobacterium
LVARPQPLGVFGLPLGYLLIPAGDDTDPVRAAL

SEQ ID NO: 1321567 - protein, 18 aa, Mycobacterium
LVAVLFGCADAADTGLWA

SEQ ID NO: 1321568 - protein, 26 aa, Mycobacterium
LVAVPRTEESRFRAMCEARGLPITRI

SEQ ID NO: 1321569 - protein, 17 aa, Mycobacterium
LVAWFQTESKDLVAKRL

SEQ ID NO: 1321570 - protein, 17 aa, Mycobacterium
LVAWPKTSGSRGFHIYA

SEQ ID NO: 1321571 - protein, 20 aa, Mycobacterium
LVCNSALARFKAPKEFIFVD

SEQ ID NO: 1321572 - protein, 19 aa, Mycobacterium
LVDAFAAALGRLGADVQTG

SEQ ID NO: 1321573 - protein, 17 aa, Mycobacterium
LVDALRRLLTDSRAAGS

SEQ ID NO: 1321574 - protein, 35 aa, Mycobacterium
LVDGDAFVVPRLRPPQARVLLMAALAAGAAPGQVF

SEQ ID NO: 1321575 - protein, 19 aa, Mycobacterium
LVDGDIIWAPAIDGAIVLS

SEQ ID NO: 1321576 - protein, 18 aa, Mycobacterium
LVDGLNKTLADMMVTSEY

SEQ ID NO: 1321577 - protein, 26 aa, Mycobacterium
LVDGTARLAAMNLLLHGIGTADGPSL

SEQ ID NO: 1321578 - protein, 17 aa, Mycobacterium
LVDHITALALPPARRDE

SEQ ID NO: 1321579 - protein, 18 aa, Mycobacterium
LVDLYPLVRKSIRVGTEN

SEQ ID NO: 1321580 - protein, 18 aa, Mycobacterium
LVDQVRFGRPAEFAFRHP

SEQ ID NO: 1321581 - protein, 18 aa, Mycobacterium
LVDRLQVSILDTGSWKTP

SEQ ID NO: 1321582 - protein, 26 aa, Mycobacterium
LVDRVKERLPVWKHQFFADGSDEWVN

SEQ ID NO: 1321583 - protein, 20 aa, Mycobacterium
LVDSEKLWDVSLSALYETFG

SEQ ID NO: 1321584 - protein, 26 aa, Mycobacterium
LVDSIRLCLIVVDQQMRVVVWNRGCE

SEQ ID NO: 1321585 - protein, 18 aa, Mycobacterium
LVEAFRRQSQMDETLSFP

SEQ ID NO: 1321586 - protein, 19 aa, Mycobacterium
LVEAYLRGPMRGAVSPPNN

SEQ ID NO: 1321587 - protein, 28 aa, Mycobacterium
LVEKARQLWFDRILPLAENIRTGEVVRV

SEQ ID NO: 1321588 - protein, 18 aa, Mycobacterium
LVENDGYFVSREQLALLG

SEQ ID NO: 1321589 - protein, 21 aa, Mycobacterium
LVEQLRLKCALVRAIQVCSAL

SEQ ID NO: 1321590 - protein, 31 aa, Mycobacterium; identical to SEQ ID NO: 129244

SEQ ID NO: 1321591 - protein, 27 aa, Mycobacterium
LVESGYLVPHWPQPWGRAANVLEQLVI

SEQ ID NO: 1321592 - protein, 19 aa, Mycobacterium
LVESWLAAHRLGAIAVPVN

SEQ ID NO: 1321593 - protein, 17 aa, Mycobacterium
LVFCDSLSYYGPTGGLP

SEQ ID NO: 1321594 - protein, 18 aa, Mycobacterium
LVFEIRGAKSCFPTQLTK

SEQ ID NO: 1321595 - protein, 28 aa, Mycobacterium
LVFGTDPLIMRQRYPVPGAPYGLAGSSG

SEQ ID NO: 1321596 - protein, 21 aa, Mycobacterium
LVFLKDHLFGSPSAAGCVLVG

SEQ ID NO: 1321597 - protein, 19 aa, Mycobacterium
LVFRHGVQLFGAMGFTWEN

SEQ ID NO: 1321598 - protein, 18 aa, Mycobacterium
LVGAEHLILAGAASPVSF

SEQ ID NO: 1321599 - protein, 27 aa, Mycobacterium
LVGDGYLRFMRSFFESMFVPSSDPAIR

SEQ ID NO: 1321600 - protein, 27 aa, Mycobacterium
LVGERHPHFLTQLRKPLIAAINGACAG

SEQ ID NO: 1321601 - protein, 23 aa, Mycobacterium
LVGESLIGPLYRHGSDDADIAVV

SEQ ID NO: 1321602 - protein, 18 aa, Mycobacterium
LVGFFAYDMVRQLERLPS

SEQ ID NO: 1321603 - protein, 24 aa, Mycobacterium
LVGGDATLAPGLSAAVRIAERTGA

SEQ ID NO: 1321604 - protein, 19 aa, Mycobacterium
LVGGLRERFWESGTLRTRP

SEQ ID NO: 1321605 - protein, 20 aa, Mycobacterium
LVGGMKAWREAGRPVIRDDG

SEQ ID NO: 1321606 - protein, 19 aa, Mycobacterium
LVGHDFFLFHDKESDRPCV

SEQ ID NO: 1321607 - protein, 25 aa, Mycobacterium
LVGNNIPVFFIQDGIKFPDVIHAGK

SEQ ID NO: 1321608 - protein, 19 aa, Mycobacterium
LVGPVTWSVELDERWVIIG

SEQ ID NO: 1321609 - protein, 31 aa, Mycobacterium
LVGRAELVLPMWQRLEPVWGPARDVRAHQPL

SEQ ID NO: 1321610 - protein, 28 aa, Mycobacterium
LVGSWQYRRLFMRLPPDAPKHRARLFDA

SEQ ID NO: 1321611 - protein, 20 aa, Mycobacterium
LVGTFMVLLAENLAPDAPLH

SEQ ID NO: 1321612 - protein, 37 aa, Mycobacterium
LVGTLLRHPKLARAFLRFNFQLLYGTTLPERLREFVV

SEQ ID NO: 1321613 - protein, 17 aa, Mycobacterium
LVGVLVALGRVAVDFWD

SEQ ID NO: 1321614 - protein, 24 aa, Mycobacterium
LVHGLQDLFTQVRSFVFVADVAET

SEQ ID NO: 1321615 - protein, 18 aa, Mycobacterium
LVIAVKRLTAAKTRLAPM

SEQ ID NO: 1321616 - protein, 17 aa, Mycobacterium
LVIDDADLAGACSMAAF

SEQ ID NO: 1321617 - protein, 18 aa, Mycobacterium
LVIHGRADRMCDPSGGRA

SEQ ID NO: 1321618 - protein, 18 aa, Mycobacterium
LVIIPTYNERQNLPLIVG

SEQ ID NO: 1321619 - protein, 17 aa, Mycobacterium
LVIPRHHGLFPTLDTEL

SEQ ID NO: 1321620 - protein, 19 aa, Mycobacterium
LVIVGGGPYRTALHRLAHT

SEQ ID NO: 1321621 - protein, 38 aa, Mycobacterium
LVKDMLLTGFDAPPLHTLYLDRPLKGALLMQTLARVNR

SEQ ID NO: 1321622 - protein, 28 aa, Mycobacterium
LVKTTDGWRIDRLPNGVFLDWQQFQSTY

SEQ ID NO: 1321623 - protein, 17 aa, Mycobacterium
LVLALSAGALRQLSLRY

SEQ ID NO: 1321624 - protein, 21 aa, Mycobacterium
LVLAVLPGMVQRRAGGILISG

SEQ ID NO: 1321625 - protein, 25 aa, Mycobacterium
LVLDQLMYPAMMFGAAGAWSIDVCM

SEQ ID NO: 1321626 - protein, 21 aa, Mycobacterium
LVLDYERAMLRMNIADSADPA

SEQ ID NO: 1321627 - protein, 20 aa, Mycobacterium
LVLGHAARLLAAVTLAAFPS

SEQ ID NO: 1321628 - protein, 19 aa, Mycobacterium
LVLIGVMPSIHPSAEEYQR

SEQ ID NO: 1321629 - protein, 17 aa, Mycobacterium
LVLNLPAGRYQRDRGPS

SEQ ID NO: 1321630 - protein, 17 aa, Mycobacterium
LVLSGRPIDAGTALRWG

SEQ ID NO: 1321631 - protein, 18 aa, Mycobacterium
LVLTRRADDAWLARWSRA

SEQ ID NO: 1321632 - protein, 19 aa, Mycobacterium
LVLVCPYHHRTHHRGLITI

SEQ ID NO: 1321633 - protein, 17 aa, Mycobacterium
LVLVHHFGAKSGTERIA

SEQ ID NO: 1321634 - protein, 24 aa, Mycobacterium
LVLVPAVLDLPDAPGARLVSNIID

SEQ ID NO: 1321635 - protein, 17 aa, Mycobacterium
LVLVSWPERGPLLGVDL

SEQ ID NO: 1321636 - protein, 31 aa, Mycobacterium
LVMARAGGMLSRLRPLFSLGLGARLGNGRQY

SEQ ID NO: 1321637 - protein, 22 aa, Mycobacterium
LVMPAFARLWRGFARQSLEQLS

SEQ ID NO: 1321638 - protein, 19 aa, Mycobacterium
LVMRPRIARRYAVVEGHRA

SEQ ID NO: 1321639 - protein, 19 aa, Mycobacterium
LVMTATPIPRTVALTIYGD

SEQ ID NO: 1321640 - protein, 26 aa, Mycobacterium
LVNAIAPGLFPSRMTKVLLAAGEEAV

SEQ ID NO: 1321641 - protein, 23 aa, Mycobacterium
LVNALCVGVLRKEDLKLAFASGA

SEQ ID NO: 1321642 - protein, 32 aa, Mycobacterium
LVNDERARQMLRFLSSPLWRAYTSTYVEGYRL

SEQ ID NO: 1321643 - protein, 20 aa, Mycobacterium
LVNHVLPYRQLFAPNVLGTA

SEQ ID NO: 1321644 - protein, 24 aa, Mycobacterium
LVNLPNWLALTFRVDHGDWFDIDA

SEQ ID NO: 1321645 - protein, 22 aa, Mycobacterium
LVNPGLLTWRDVARVMSEAPAR

SEQ ID NO: 1321646 - protein, 23 aa, Mycobacterium
LVNPRPKFVERIRLHQLAAAGRD

SEQ ID NO: 1321647 - protein, 18 aa, Mycobacterium
LVNVGIGDVTILEDVNVG

SEQ ID NO: 1321648 - protein, 18 aa, Mycobacterium
LVPDGRVLLASGAALVTK

SEQ ID NO: 1321649 - protein, 27 aa, Mycobacterium
LVPELLLIGQLIDRSGMAWCISKFGRE

SEQ ID NO: 1321650 - protein, 20 aa, Mycobacterium
LVPPAIPGVGEPAPMPVTPP

SEQ ID NO: 1321651 - protein, 33 aa, Mycobacterium
LVPPDRELAFLHPLPVRRLWGVGAKTADKLRVH

SEQ ID NO: 1321652 - protein, 17 aa, Mycobacterium
LVPTMVQMLVDHPALPV

SEQ ID NO: 1321653 - protein, 18 aa, Mycobacterium
LVPVYPTCHYVMGGIPTT

SEQ ID NO: 1321654 - protein, 30 aa, Mycobacterium
LVQNVCGNGFIYDPYRWCKPTMDAIRPGTL

SEQ ID NO: 1321655 - protein, 18 aa, Mycobacterium
LVQSVLPHMRRTGAGRIV

SEQ ID NO: 1321656 - protein, 29 aa, Mycobacterium
LVRAGTEFGAYWYANLRNTIRFDQAVQTA

SEQ ID NO: 1321657 - protein, 27 aa, Mycobacterium
LVRAIERAPWLTFVPAYLVGVGVRPER

SEQ ID NO: 1321658 - protein, 26 aa, Mycobacterium
LVRDGVVLDRFVISEPLALVPYELTM

SEQ ID NO: 1321659 - protein, 19 aa, Mycobacterium
LVRELAAIAIRRNVAVFTS

SEQ ID NO: 1321660 - protein, 26 aa, Mycobacterium
LVRFQVREALLSRGYRRRQWLLTRAA

SEQ ID NO: 1321661 - protein, 18 aa, Mycobacterium
LVRTMVFDGLTPAAQREF

SEQ ID NO: 1321662 - protein, 20 aa, Mycobacterium
LVRYYDMLLDGSGGLPREQA

SEQ ID NO: 1321663 - protein, 24 aa, Mycobacterium
LVSDAGMPLISDPGYRLVAACVEH

SEQ ID NO: 1321664 - protein, 17 aa, Mycobacterium
LVTLPELTAVSLRTAQT

SEQ ID NO: 1321665 - protein, 18 aa, Mycobacterium
LVTRGWELRGRPTSALLL

SEQ ID NO: 1321666 - protein, 21 aa, Mycobacterium
LVTVPLPGARMRYGLQLPTEA

SEQ ID NO: 1321667 - protein, 19 aa, Mycobacterium
LVVADLPFGSYEAGPQQAL

SEQ ID NO: 1321668 - protein, 17 aa, Mycobacterium
LVVAGRNRPGGVAALVG

SEQ ID NO: 1321669 - protein, 28 aa, Mycobacterium
LVVDLATLRAYLTRRIRTSGLVTASLAA

SEQ ID NO: 1321670 - protein, 20 aa, Mycobacterium
LVVLARYMQILTPSFIEQVG

SEQ ID NO: 1321671 - protein, 32 aa, Mycobacterium
LVVLIHGFPESWYSWRHQIPALAAAGYRVVAI

SEQ ID NO: 1321672 - protein, 19 aa, Mycobacterium
LVVNKRPELLTRFPKELVI

SEQ ID NO: 1321673 - protein, 17 aa, Mycobacterium
LVVWAREDRMMPLQHAD

SEQ ID NO: 1321674 - protein, 23 aa, Mycobacterium
LVYAVLNLYPYNPGHLMVVPYRR

SEQ ID NO: 1321675 - protein, 20 aa, Mycobacterium
LVYDARAFFDVAELHSWVAE

SEQ ID NO: 1321676 - protein, 17 aa, Mycobacterium
LVYGNTVVWKPASTVPL

SEQ ID NO: 1321677 - protein, 17 aa, Mycobacterium
LWAGIYVPEAGRGRTFA

SEQ ID NO: 1321678 - protein, 25 aa, Mycobacterium
LWDASVIFASYPHFWELKRSRTEAP

SEQ ID NO: 1321679 - protein, 20 aa, Mycobacterium
LWDDVPRLTAPTTLIRGAHS

SEQ ID NO: 1321680 - protein, 18 aa, Mycobacterium
LWERPLVFDPDRFSAQNS

SEQ ID NO: 1321681 - protein, 19 aa, Mycobacterium
LWGATGARSIPALVAWKLG

SEQ ID NO: 1321682 - protein, 23 aa, Mycobacterium
LWGATGARSIPALVAWKLGLSSK

SEQ ID NO: 1321683 - protein, 18 aa, Mycobacterium
LWLDAGFEDRAIEAWILE

SEQ ID NO: 1321684 - protein, 20 aa, Mycobacterium
LWPAFADVPAGWRVVFGEST

SEQ ID NO: 1321685 - protein, 17 aa, Mycobacterium
LWQRFKSAQDKFFSARN

SEQ ID NO: 1321686 - protein, 23 aa, Mycobacterium
LWTEPSSPFVASFLGTTTRITGE

SEQ ID NO: 1321687 - protein, 24 aa, Mycobacterium
LYAEPAPQLLLLDEPTNNLDLVSV

SEQ ID NO: 1321688 - protein, 30 aa, Mycobacterium
LYAGRTIVYLRRFDPREWVRLVRTEKVTTA

SEQ ID NO: 1321689 - protein, 18 aa, Mycobacterium
LYAPFSHQQLILKEAIGL

SEQ ID NO: 1321690 - protein, 27 aa, Mycobacterium
LYAVEMGLARLWQSWGIEPDVVLGHSV

SEQ ID NO: 1321691 - protein, 24 aa, Mycobacterium
LYDAPELVIPFMVPDGAHSYPDAR

SEQ ID NO: 1321692 - protein, 26 aa, Mycobacterium
LYDGFTFNCLSWLEALGFCGIGEAKD

SEQ ID NO: 1321693 - protein, 31 aa, Mycobacterium
LYDPFSIVTLVLLDEYRLTGGVPAGAFVRDG

SEQ ID NO: 1321694 - protein, 26 aa, Mycobacterium
LYDTAPTALLRIYGDRLPPGYAKTLR

SEQ ID NO: 1321695 - protein, 18 aa, Mycobacterium
LYERAVLLERLRAQRESV

SEQ ID NO: 1321696 - protein, 41 aa, Mycobacterium
LYETRGATACFPGLLRKGERLLVFLPLAHVLARALSMTAFA

SEQ ID NO: 1321697 - protein, 24 aa, Mycobacterium
LYEYGSRAGLWRVLRVFERHDIPL

SEQ ID NO: 1321698 - protein, 21 aa, Mycobacterium
LYFGRAKRCATTAQRLALFAR

SEQ ID NO: 1321699 - protein, 33 aa, Mycobacterium
LYGGNNNWFAAYAYWYFKLYGHQDVKLLDGGRK

SEQ ID NO: 1321700 - protein, 18 aa, Mycobacterium
LYGIATDRILGLPDGATV

SEQ ID NO: 1321701 - protein, 17 aa, Mycobacterium
LYGPPGCGKTLIAKAVA

SEQ ID NO: 1321702 - protein, 27 aa, Mycobacterium
LYHEAKAAGIIYQATLRHELHAERGFE

SEQ ID NO: 1321703 - protein, 20 aa, Mycobacterium
LYHEPRLFSCGARLPLDHPE

SEQ ID NO: 1321704 - protein, 17 aa, Mycobacterium
LYHRKDLTYRAIADAPT

SEQ ID NO: 1321705 - protein, 18 aa, Mycobacterium
LYKKSSVLFGLDLAKRDI

SEQ ID NO: 1321706 - protein, 21 aa, Mycobacterium
LYLHLLSRLLLARVELSWTRR

SEQ ID NO: 1321707 - protein, 17 aa, Mycobacterium
LYPALRRMQADGLIVED

SEQ ID NO: 1321708 - protein, 18 aa, Mycobacterium
LYPNLSFVHNWPKVADSD

SEQ ID NO: 1321709 - protein, 19 aa, Mycobacterium
LYQRTAPWILPKWDSRYGV

SEQ ID NO: 1321710 - protein, 17 aa, Mycobacterium
LYRHPASGQLVAMESKA

SEQ ID NO: 1321711 - protein, 17 aa, Mycobacterium
LYRIDGGHLLFVATDRI

SEQ ID NO: 1321712 - protein, 20 aa, Mycobacterium
LYRRIHVPALPQLRTLTTWL

SEQ ID NO: 1321713 - protein, 18 aa, Mycobacterium
LYSAMMALIARHGGNVSS

SEQ ID NO: 1321714 - protein, 20 aa, Mycobacterium
LYSPFKLLDPVANLAEMFIH

SEQ ID NO: 1321715 - protein, 33 aa, Mycobacterium
LYSRLLQLAWRTLPDRVLLIPLARNRIEYEKLV

SEQ ID NO: 1321716 - protein, 18 aa, Mycobacterium
LYTVLGALGRYLQHTDLS

SEQ ID NO: 1321717 - protein, 27 aa, Mycobacterium
LYVAILGALRNGSVVSPLFSAFGPEPV

SEQ ID NO: 1321718 - protein, 18 aa, Mycobacterium
LYVATHYGLFRAGEDQAP

SEQ ID NO: 1321719 - protein, 19 aa, Mycobacterium
LYVNHQLDVIVRRTTYRLR

SEQ ID NO: 1321720 - protein, 20 aa, Mycobacterium
LYVQSLLDQWSFPATDPRVR

SEQ ID NO: 1321721 - protein, 27 aa, Mycobacterium
MAAARLDLASVFLYAGSILPGRVKLSD

SEQ ID NO: 1321722 - protein, 28 aa, Mycobacterium
MAAAVGVRPWLTPPGRAALLLGDRATSM

SEQ ID NO: 1321723 - protein, 24 aa, Mycobacterium
MAAGFLLTELLLPLVMEAIGEPAR

SEQ ID NO: 1321724 - protein, 25 aa, Mycobacterium
MAAIDEHFGHPAHLPRAGLPTEIGP

SEQ ID NO: 1321725 - protein, 31 aa, Mycobacterium
MAAKRTSDLVPLCHPLAITGVDIDFTIGGDD

SEQ ID NO: 1321726 - protein, 25 aa, Mycobacterium
MAALDHRVPVLLSALSPRMLGIAAE

SEQ ID NO: 1321727 - protein, 18 aa, Mycobacterium
MAAPDRPVLSLQADGSAM

SEQ ID NO: 1321728 - protein, 20 aa, Mycobacterium
MAASRRQVALLAEALSAQEN

SEQ ID NO: 1321729 - protein, 21 aa, Mycobacterium
MADYHLRVRPGTDAWCLAALA

SEQ ID NO: 1321730 - protein, 19 aa, Mycobacterium
MAEDVVDRAVRLRGLTAGA

SEQ ID NO: 1321731 - protein, 23 aa, Mycobacterium
MAEHHYKKNALLPRLRSWGPDVE

SEQ ID NO: 1321732 - protein, 18 aa, Mycobacterium
MAEKLWQLRILDDEKSAG

SEQ ID NO: 1321733 - protein, 18 aa, Mycobacterium
MAENLAHIAPPDPDGKVL

SEQ ID NO: 1321734 - protein, 24 aa, Mycobacterium
MAFRDGVLVYRQAGALPPAALEDL

SEQ ID NO: 1321735 - protein, 21 aa, Mycobacterium
MAGATPFLDGLLAAAERAGTR

SEQ ID NO: 1321736 - protein, 21 aa, Mycobacterium
MAGATPFLDGLLAAAQRADTR

SEQ ID NO: 1321737 - protein, 32 aa, Mycobacterium
MAGCDVVYYCVVDARPWLRDPAPMWRTNVDGL

SEQ ID NO: 1321738 - protein, 31 aa, Mycobacterium
MAGFGDIMDGLSPVFIFYQNHRDKALVKIRD

SEQ ID NO: 1321739 - protein, 21 aa, Mycobacterium
MAGHQDYWRDLLAAGKVVVYG

SEQ ID NO: 1321740 - protein, 32 aa, Mycobacterium
MAGQLASMLPSMIPTVLGAAGGLLGGAMSSMM

SEQ ID NO: 1321741 - protein, 23 aa, Mycobacterium
MAGSKLHLVGQRPPGPTPAFAEH

SEQ ID NO: 1321742 - protein, 17 aa, Mycobacterium
MAGYALGLVLKKCEPEQ

SEQ ID NO: 1321743 - protein, 35 aa, Mycobacterium; identical to SEQ ID NO: 838266

SEQ ID NO: 1321744 - protein, 18 aa, Mycobacterium
MAIPLTTAAFAFTAPHRS

SEQ ID NO: 1321745 - protein, 18 aa, Mycobacterium
MALGEWWRGAGRGAGFLL

SEQ ID NO: 1321746 - protein, 17 aa, Mycobacterium
MALIALSAKIRIDQIEA

SEQ ID NO: 1321747 - protein, 18 aa, Mycobacterium
MALVPMRTIPDAELHVFP

SEQ ID NO: 1321748 - protein, 26 aa, Mycobacterium
MAMLGQYGLTWPWESLHHEALAWYDH

SEQ ID NO: 1321749 - protein, 24 aa, Mycobacterium
MANIEYLWFEDLGASRSRLRGRSI

SEQ ID NO: 1321750 - protein, 27 aa, Mycobacterium
MAPTLTMHVPTYIRYDLRADGDELKIA

SEQ ID NO: 1321751 - protein, 21 aa, Mycobacterium
MAQMPMQVMGAVAAVPQGIMQ

SEQ ID NO: 1321752 - protein, 22 aa, Mycobacterium
MARFVDTFARVLGDPALPHLFF

SEQ ID NO: 1321753 - protein, 25 aa, Mycobacterium
MARLPVSEWPDLLILLGDQVYADEL

SEQ ID NO: 1321754 - protein, 21 aa, Mycobacterium
MARLRRKHGVILTRACLSGYG

SEQ ID NO: 1321755 - protein, 26 aa, Mycobacterium
MARQLYYGCDVWLNNPLRPLEACGTS

SEQ ID NO: 1321756 - protein, 20 aa, Mycobacterium
MARTRAWPTTEVNGQLLVWH

SEQ ID NO: 1321757 - protein, 24 aa, Mycobacterium
MASDFLIHGRIIYAAGPIGIAQSA

SEQ ID NO: 1321758 - protein, 17 aa, Mycobacterium
MASLRGLLKFREGVRPP

SEQ ID NO: 1321759 - protein, 26 aa, Mycobacterium
MASPVLNYPLRQYMFCAPDEGAAAVI

SEQ ID NO: 1321760 - protein, 17 aa, Mycobacterium
MASQLLYGTPTSVPIPD

SEQ ID NO: 1321761 - protein, 30 aa, Mycobacterium
MATARYSGFLRASLPPFWATTDGAAVRAAL

SEQ ID NO: 1321762 - protein, 18 aa, Mycobacterium
MATLSPLAVQIIGQLSSL

SEQ ID NO: 1321763 - protein, 27 aa, Mycobacterium
MAVTGYRTLIAIWRGRFDDAGRLAADL

SEQ ID NO: 1321764 - protein, 20 aa, Mycobacterium
MAVVRWLVDHGAGRLVLNGR

SEQ ID NO: 1321765 - protein, 29 aa, Mycobacterium
MAYEGKVDWAFAELLALGTFLAEGKTIRF

SEQ ID NO: 1321766 - protein, 20 aa, Mycobacterium
MAYERVTLYGLPLVARRRVG

SEQ ID NO: 1321767 - protein, 18 aa, Mycobacterium
MCEQGYWWGLVTYDIAYG

SEQ ID NO: 1321768 - protein, 17 aa, Mycobacterium
MCLLITQSTIQSAQMVA

SEQ ID NO: 1321769 - protein, 23 aa, Mycobacterium
MCLTLCPDMFEMTDDGWAVADPE

SEQ ID NO: 1321770 - protein, 36 aa, Mycobacterium
MDACVFLLRHGVDAQRLTWIKPREAWLMDRATVQPG

SEQ ID NO: 1321771 - protein, 19 aa, Mycobacterium
MDADLVLLAMGFTGPEREG

SEQ ID NO: 1321772 - protein, 18 aa, Mycobacterium
MDAIRPGTLYRTLSTEKI

SEQ ID NO: 1321773 - protein, 18 aa, Mycobacterium
MDDFAAAGFLEPLNDRIS

SEQ ID NO: 1321774 - protein, 17 aa, Mycobacterium
MDDGLPGSIWIDEALRT

SEQ ID NO: 1321775 - protein, 21 aa, Mycobacterium
MDDIALDRTMRTRNATYWSRS

SEQ ID NO: 1321776 - protein, 26 aa, Mycobacterium
MDDLHRHLFTVLMDREWKHGVAAAVD

SEQ ID NO: 1321777 - protein, 27 aa, Mycobacterium
MDDLQLPRALPWAVLPVFARNTVRYQV

SEQ ID NO: 1321778 - protein, 18 aa, Mycobacterium
MDEGLRFAIREGGRTVGA

SEQ ID NO: 1321779 - protein, 27 aa, Mycobacterium
MDEGRWDSVIAVNLLAPLRLTEGLVDS

SEQ ID NO: 1321780 - protein, 18 aa, Mycobacterium
MDFGMQMASAARLAAQFP

SEQ ID NO: 1321781 - protein, 24 aa, Mycobacterium
MDGPPVRYMLPGADGWHTSACWPP

SEQ ID NO: 1321782 - protein, 28 aa, Mycobacterium
MDINVRGTFLLTKAALPHLRKSTSGAHV

SEQ ID NO: 1321783 - protein, 17 aa, Mycobacterium
MDNGRIILLDLSKAELG

SEQ ID NO: 1321784 - protein, 26 aa, Mycobacterium
MDPAPPPMDYIKGSGGIFRDCAVHDF

SEQ ID NO: 1321785 - protein, 26 aa, Mycobacterium
MDRTAMVRAVYPVLRAMQAAGRPPRE

SEQ ID NO: 1321786 - protein, 30 aa, Mycobacterium
MDSNYYGTLAMIRAFAPILGRNGGGAILNV

SEQ ID NO: 1321787 - protein, 23 aa, Mycobacterium
MDSSTYGLPLDVGYRLTVNNAVR

SEQ ID NO: 1321788 - protein, 22 aa, Mycobacterium
MDVFTALERPSLIDSAAFPQIG

SEQ ID NO: 1321789 - protein, 23 aa, Mycobacterium
MDYQALRLLGSVGIAKAARGEVD

SEQ ID NO: 1321790 - protein, 19 aa, Mycobacterium
MDYVLANPPFNIKDWARNE

SEQ ID NO: 1321791 - protein, 17 aa, Mycobacterium
MEAIAEMSRFLSAGINV

SEQ ID NO: 1321792 - protein, 24 aa, Mycobacterium
MEEATFLTRFARSVTLIHRRDEFR

SEQ ID NO: 1321793 - protein, 19 aa, Mycobacterium
MEEFQAMQSAWWKMAIDTA

SEQ ID NO: 1321794 - protein, 21 aa, Mycobacterium
MEELLRLDPPAPFIPRVTTQD

SEQ ID NO: 1321795 - protein, 24 aa, Mycobacterium
MEETALWLELTYDGEVPVVLTGAQ

SEQ ID NO: 1321796 - protein, 19 aa, Mycobacterium
MEFAYVMKNYGVDVTIVEF

SEQ ID NO: 1321797 - protein, 17 aa, Mycobacterium
MELGIMHDLAVGVDPDG

SEQ ID NO: 1321798 - protein, 27 aa, Mycobacterium
MELRLKPGEWYVIHSYAGYENKVKANL

SEQ ID NO: 1321799 - protein, 27 aa, Mycobacterium
MENLNVAPEVIWPRARRALAALGLNLL

SEQ ID NO: 1321800 - protein, 20 aa, Mycobacterium
MEPITWPEFARQHPFAPASD

SEQ ID NO: 1321801 - protein, 25 aa, Mycobacterium
MEPRDALVAWVSRFAEFVRTKHGLA

SEQ ID NO: 1321802 - protein, 18 aa, Mycobacterium
MERFNTVWSGPETLPLPT

SEQ ID NO: 1321803 - protein, 17 aa, Mycobacterium
MERLVRVIVAIGADLDL

SEQ ID NO: 1321804 - protein, 21 aa, Mycobacterium
MERMPRLLRSIYPIGGVVFDG

SEQ ID NO: 1321805 - protein, 29 aa, Mycobacterium
METIPATYGFPLPPIGYLEAVKDLCVRYD

SEQ ID NO: 1321806 - protein, 21 aa, Mycobacterium
METSWLLDPSIPLAEVFKDYA

SEQ ID NO: 1321807 - protein, 27 aa, Mycobacterium
MEWAGLDLLILRVAALFHENLLVLHAP

SEQ ID NO: 1321808 - protein, 24 aa, Mycobacterium
MFDDELYIIGRIKDLLIVDGRNHY

SEQ ID NO: 1321809 - protein, 17 aa, Mycobacterium
MFDEARMFLVSAATAMA

SEQ ID NO: 1321810 - protein, 35 aa, Mycobacterium
MFDVMGFGKPLDDLPMLLQPGVLSLAWGSVVRQLA

SEQ ID NO: 1321811 - protein, 20 aa, Mycobacterium
MFEHLCGDLPWSQRLGEVWR

SEQ ID NO: 1321812 - protein, 17 aa, Mycobacterium
MFGLAPSVLSRHVSWDL

SEQ ID NO: 1321813 - protein, 20 aa, Mycobacterium
MFGPAGRLYTYRSHGIHVCA

SEQ ID NO: 1321814 - protein, 17 aa, Mycobacterium
MFGSLMQQAMQAAQQFG

SEQ ID NO: 1321815 - protein, 17 aa, Mycobacterium
MFIYAKTVPEDGFVSFF

SEQ ID NO: 1321816 - protein, 17 aa, Mycobacterium
MFMNGWLDAVGTFNRYA

SEQ ID NO: 1321817 - protein, 17 aa, Mycobacterium
MFPAMSGTRWRRTLVAN

SEQ ID NO: 1321818 - protein, 21 aa, Mycobacterium
MFPQLTVLSIAPLLANTIRAV

SEQ ID NO: 1321819 - protein, 24 aa, Mycobacterium
MFQQLPTAGLPFHFQEWREFERFV

SEQ ID NO: 1321820 - protein, 21 aa, Mycobacterium
MFRRHLSCTPKEYLRKVRLDH

SEQ ID NO: 1321821 - protein, 22 aa, Mycobacterium
MGALHSWCLAAARPELVAGVVV

SEQ ID NO: 1321822 - protein, 25 aa, Mycobacterium
MGAQVTIFRLGSDPGLARFIDQVAR

SEQ ID NO: 1321823 - protein, 22 aa, Mycobacterium
MGARVVAVARPLLAPAVESVEA

SEQ ID NO: 1321824 - protein, 18 aa, Mycobacterium
MGDLTRHRLFKEGPPLGD

SEQ ID NO: 1321825 - protein, 25 aa, Mycobacterium
MGDNARRFMGLPLANPDPEAVKPPA

SEQ ID NO: 1321826 - protein, 25 aa, Mycobacterium
MGEVRVPKNALWRAQTQRAVENFPI

SEQ ID NO: 1321827 - protein, 17 aa, Mycobacterium
MGFSDAGAHLRNMAFYN

SEQ ID NO: 1321828 - protein, 23 aa, Mycobacterium
MGIFGLAIPQPWGEANVSVPCYA

SEQ ID NO: 1321829 - protein, 17 aa, Mycobacterium
MGLDQYAEDPRFASLAA

SEQ ID NO: 1321830 - protein, 21 aa, Mycobacterium
MGLLRGGDSWMFVGWCRLREG

SEQ ID NO: 1321831 - protein, 19 aa, Mycobacterium
MGLPLFGVRGMNGFVRATR

SEQ ID NO: 1321832 - protein, 28 aa, Mycobacterium
MGMLALGVPYGEVMRWALLGSEERMTAA

SEQ ID NO: 1321833 - protein, 17 aa, Mycobacterium
MGNAIIPAVTAKAIPRI

SEQ ID NO: 1321834 - protein, 18 aa, Mycobacterium
MGPMQFLPGTWARYASDG

SEQ ID NO: 1321835 - protein, 22 aa, Mycobacterium
MGQSKIEVFRALFGSDDRAQAA

SEQ ID NO: 1321836 - protein, 23 aa, Mycobacterium
MGQSKITVFRALFGDEATAQRAN

SEQ ID NO: 1321837 - protein, 23 aa, Mycobacterium
MGRHAGWIALNAGLASGAHMTLI

SEQ ID NO: 1321838 - protein, 19 aa, Mycobacterium
MGRLAGRGFAAYGTAKAAL

SEQ ID NO: 1321839 - protein, 23 aa, Mycobacterium
MGRQLRTKVLFGTDFPYIQIDRW

SEQ ID NO: 1321840 - protein, 21 aa, Mycobacterium
MGVEHGFIRKSGSWFTYDGEQ

SEQ ID NO: 1321841 - protein, 24 aa, Mycobacterium
MGVFCRRWGVPLIDGGTVRLPRLI

SEQ ID NO: 1321842 - protein, 17 aa, Mycobacterium
MGVRRFGGELRWLGSYS

SEQ ID NO: 1321843 - protein, 18 aa, Mycobacterium
MGVSPSWSVFCVDSGIAF

SEQ ID NO: 1321844 - protein, 32 aa, Mycobacterium
MGVTGFPPRIPLPYDVAGACVLLIDGLGAELL

SEQ ID NO: 1321845 - protein, 17 aa, Mycobacterium
MGWSPDRYQEWLAHALP

SEQ ID NO: 1321846 - protein, 17 aa, Mycobacterium
MHFGQFIAAYEDIVRRA

SEQ ID NO: 1321847 - protein, 17 aa, Mycobacterium
MHLLLASQRLDEGRLRG

SEQ ID NO: 1321848 - protein, 17 aa, Mycobacterium
MHLYFRRAKTTEALFGG

SEQ ID NO: 1321849 - protein, 19 aa, Mycobacterium
MHMLYSMIQASFPVECWKQ

SEQ ID NO: 1321850 - protein, 17 aa, Mycobacterium
MHPVLVHEVLEGELGSA

SEQ ID NO: 1321851 - protein, 23 aa, Mycobacterium
MHTYDQRCWLRQLTPYATRDQED

SEQ ID NO: 1321852 - protein, 21 aa, Mycobacterium
MIAHCELMGDRMAILDSPPGM

SEQ ID NO: 1321853 - protein, 26 aa, Mycobacterium
MIASSPGFLGWLDPSAVGAPAPTPAP

SEQ ID NO: 1321854 - protein, 31 aa, Mycobacterium
MICTVGNYEYGFFWYLYNDASIEMEVKLTGV

SEQ ID NO: 1321855 - protein, 18 aa, Mycobacterium
MIDICQFAVGLSRQLYGR

SEQ ID NO: 1321856 - protein, 18 aa, Mycobacterium
MIDWWGPIVDEYYASSEA

SEQ ID NO: 1321857 - protein, 37 aa, Mycobacterium
MIEKDAMMEIFSKYPTYLHSFAPMPFKPVAREGKPGL

SEQ ID NO: 1321858 - protein, 19 aa, Mycobacterium
MIELRRKLLPASDRVQMLA

SEQ ID NO: 1321859 - protein, 23 aa, Mycobacterium
MIEPWVFMNYKRAAEYLYTAQTL

SEQ ID NO: 1321860 - protein, 20 aa, Mycobacterium
MIERRIVLPLAQPDLAARYG

SEQ ID NO: 1321861 - protein, 17 aa, Mycobacterium
MIFTVSNSGFYASGGGP

SEQ ID NO: 1321862 - protein, 18 aa, Mycobacterium
MIFTVSNSGFYASGGGPL

SEQ ID NO: 1321863 - protein, 26 aa, Mycobacterium
MIPGVRRTVLAFFRPVKGYSAAPSLV

SEQ ID NO: 1321864 - protein, 26 aa, Mycobacterium
MIRAHKDVVLVPRPALRYLEGSPGLL

SEQ ID NO: 1321865 - protein, 18 aa, Mycobacterium
MIREERWCWLEDGRVRGD

SEQ ID NO: 1321866 - protein, 19 aa, Mycobacterium
MIREERWCWLEDGRVRGDI

SEQ ID NO: 1321867 - protein, 18 aa, Mycobacterium
MIRPEQVIMLGRPTLHRP

SEQ ID NO: 1321868 - protein, 19 aa, Mycobacterium
MITTLIYELQRRGGGIGVA

SEQ ID NO: 1321869 - protein, 18 aa, Mycobacterium
MIVLEDADVELAAHAAVW

SEQ ID NO: 1321870 - protein, 18 aa, Mycobacterium
MKAAFDAGGDTDAVLAFF

SEQ ID NO: 1321871 - protein, 23 aa, Mycobacterium
MKDTARVLGRMYDAIEYRGASQS

SEQ ID NO: 1321872 - protein, 21 aa, Mycobacterium
MKKAVAYLLPYIEAEKEQNGT

SEQ ID NO: 1321873 - protein, 20 aa, Mycobacterium
MKLARNMLTFTGFAAACEAM

SEQ ID NO: 1321874 - protein, 20 aa, Mycobacterium
MKLTPERYIHELLVERLHVV

SEQ ID NO: 1321875 - protein, 23 aa, Mycobacterium
MKRAACIPFIRNILEYTKGETDA

SEQ ID NO: 1321876 - protein, 17 aa, Mycobacterium
MKRLNGMDAMLLYSETP

SEQ ID NO: 1321877 - protein, 27 aa, Mycobacterium
MLAADPALRSLPYWEAQEPLPPLGEEG

SEQ ID NO: 1321878 - protein, 21 aa, Mycobacterium
MLAASSRRSAWWAGTATLGVA

SEQ ID NO: 1321879 - protein, 23 aa, Mycobacterium
MLADATRVQILWALVSHEKSVND

SEQ ID NO: 1321880 - protein, 30 aa, Mycobacterium
MLAEIVAGSAIFRILVRRDAALDDAWVDAV

SEQ ID NO: 1321881 - protein, 28 aa, Mycobacterium
MLASAPTFRSLPYWESVEPFPLPAEAGI

SEQ ID NO: 1321882 - protein, 19 aa, Mycobacterium
MLAVAKLGAVIMPTTGALG

SEQ ID NO: 1321883 - protein, 17 aa, Mycobacterium
MLCQTRGFLELNLRQRL

SEQ ID NO: 1321884 - protein, 32 aa, Mycobacterium
MLDALGEWMMQPVYFSVYGSQPTRRTGARHAS

SEQ ID NO: 1321885 - protein, 31 aa, Mycobacterium
MLDDADFARYPFLVKGYIGPKALLANGVRYL

SEQ ID NO: 1321886 - protein, 28 aa, Mycobacterium
MLDELQPGHRLVIRALPGAASATSARLH

SEQ ID NO: 1321887 - protein, 17 aa, Mycobacterium
MLDQLIYRLNRVPDRHY

SEQ ID NO: 1321888 - protein, 26 aa, Mycobacterium
MLDTEVMLPGHGPVWRGPVRDAVAQA

SEQ ID NO: 1321889 - protein, 28 aa, Mycobacterium
MLDTLGHYDGLLAWLRGLVRTGYVAEDA

SEQ ID NO: 1321890 - protein, 25 aa, Mycobacterium
MLENPDILVFAWGATVPMIAHAAGI

SEQ ID NO: 1321891 - protein, 25 aa, Mycobacterium
MLETAILGLTYYPVSYFEMLGRPWR

SEQ ID NO: 1321892 - protein, 17 aa, Mycobacterium
MLEVFTPINDAAGALGE

SEQ ID NO: 1321893 - protein, 28 aa, Mycobacterium
MLGALDWAQLGPLRLFGHCMGALVGFEF

SEQ ID NO: 1321894 - protein, 23 aa, Mycobacterium
MLGDLRPLYRPGLVHIYHALTWG

SEQ ID NO: 1321895 - protein, 17 aa, Mycobacterium
MLGRPTLHRPVSALLAD

SEQ ID NO: 1321896 - protein, 25 aa, Mycobacterium
MLHNEGLYRVFRPDLKEPTREEAEE

SEQ ID NO: 1321897 - protein, 18 aa, Mycobacterium
MLHVLARDMRHLEEALER

SEQ ID NO: 1321898 - protein, 28 aa, Mycobacterium
MLIGHAGELEKFQWFVRAHLENSGGELV

SEQ ID NO: 1321899 - protein, 17 aa, Mycobacterium
MLIRLQGVGDRDAADAL

SEQ ID NO: 1321900 - protein, 17 aa, Mycobacterium
MLIRPDGHLAWRGDAGD

SEQ ID NO: 1321901 - protein, 18 aa, Mycobacterium
MLLDRLRSAFAGQVTGLL

SEQ ID NO: 1321902 - protein, 17 aa, Mycobacterium
MLLGRRRHRRRPGDTDP

SEQ ID NO: 1321903 - protein, 20 aa, Mycobacterium
MLNSAPMYRQFRPDLESPTR

SEQ ID NO: 1321904 - protein, 21 aa, Mycobacterium
MLQGYALMSHLAERGWVCLSI

SEQ ID NO: 1321905 - protein, 17 aa, Mycobacterium
MLQLIPDPAVALAEMVR

SEQ ID NO: 1321906 - protein, 19 aa, Mycobacterium
MLQSFIGRMTSVPPSVWGG

SEQ ID NO: 1321907 - protein, 18 aa, Mycobacterium
MLRLHYEKKRNLPRALLV

SEQ ID NO: 1321908 - protein, 27 aa, Mycobacterium
MLRNHARWAVFLRHLQYLVIDECHYYR

SEQ ID NO: 1321909 - protein, 18 aa, Mycobacterium
MLRQVVVESPPPAPPRWQ

SEQ ID NO: 1321910 - protein, 32 aa, Mycobacterium
MLSEHLLLHPMSAPMTLRWLRDRFAGRPLRTH

SEQ ID NO: 1321911 - protein, 23 aa, Mycobacterium
MLTDIEGLYTDWPDRNSLVSQIN

SEQ ID NO: 1321912 - protein, 18 aa, Mycobacterium
MLTIVLRGEGFDTAVIGD

SEQ ID NO: 1321913 - protein, 18 aa, Mycobacterium
MLTTMQLPQYFSDLRDER

SEQ ID NO: 1321914 - protein, 25 aa, Mycobacterium
MLVAGEDPRFVARRLMILASEDIGM

SEQ ID NO: 1321915 - protein, 17 aa, Mycobacterium
MLVLAAALSIPDPRERP

SEQ ID NO: 1321916 - protein, 17 aa, Mycobacterium
MLVSPEPAPLLDTLLRL

SEQ ID NO: 1321917 - protein, 17 aa, Mycobacterium
MLYADSRALQGLSYVVM

SEQ ID NO: 1321918 - protein, 17 aa, Mycobacterium
MMAAFVDQAALAWQLAT

SEQ ID NO: 1321919 - protein, 24 aa, Mycobacterium
MMHTLPIGWVEPEDIANAVLFLAS

SEQ ID NO: 1321920 - protein, 18 aa, Mycobacterium
MMLQQKIAERTKLLSQLE

SEQ ID NO: 1321921 - protein, 19 aa, Mycobacterium
MMLVQYLIDRGVPAEIPAV

SEQ ID NO: 1321922 - protein, 18 aa, Mycobacterium
MMRVGIAPTLIGTRGSRP

SEQ ID NO: 1321923 - protein, 20 aa, Mycobacterium
MMTVLVVGAPLRFGHRIYNT

SEQ ID NO: 1321924 - protein, 39 aa, Mycobacterium
MNADLVVLGPGSWFTSVIPHVLVPQLAAALKATTARRAL

SEQ ID NO: 1321925 - protein, 25 aa, Mycobacterium
MNDHCDVEWIPPPRLDTGQARLNHY

SEQ ID NO: 1321926 - protein, 17 aa, Mycobacterium
MNEAFAKAWYKLMHRDM

SEQ ID NO: 1321927 - protein, 34 aa, Mycobacterium
MNELHRQLFSRLMGPRWRHGPTVAADLVLVGRFY

SEQ ID NO: 1321928 - protein, 26 aa, Mycobacterium
MNRGFHAFFRQYYNLRDLLRRVDPQL

SEQ ID NO: 1321929 - protein, 18 aa, Mycobacterium
MNRLAPLGPVYQAGTLSG

SEQ ID NO: 1321930 - protein, 24 aa, Mycobacterium
MPDGRAYMWVARTVERRASRYGQP

SEQ ID NO: 1321931 - protein, 23 aa, Mycobacterium
MPEAFAVVREAAWRVLNQRHFDV

SEQ ID NO: 1321932 - protein, 25 aa, Mycobacterium
MPGFTTISMYPRMWAASGIDYPTLL

SEQ ID NO: 1321933 - protein, 25 aa, Mycobacterium
MPGLQQLFNPDLKLLQSMSAGAEHL

SEQ ID NO: 1321934 - protein, 19 aa, Mycobacterium
MPGSLTLPTPNAYRSPFRH

SEQ ID NO: 1321935 - protein, 30 aa, Mycobacterium
MPGVTPQMWDWWFGWHGSDTRRYKLWHPRA

SEQ ID NO: 1321936 - protein, 19 aa, Mycobacterium
MPIIRDDEIIAWVAATIHE

SEQ ID NO: 1321937 - protein, 20 aa, Mycobacterium
MPISSPRRPSADDLLVLLAV

SEQ ID NO: 1321938 - protein, 22 aa, Mycobacterium
MPKGVLWRQHDIFMTSFGGRSL

SEQ ID NO: 1321939 - protein, 18 aa, Mycobacterium
MPLRLLVDALEPAPPKHI

SEQ ID NO: 1321940 - protein, 19 aa, Mycobacterium
MPNKVFVIGVGMTKFEKPG

SEQ ID NO: 1321941 - protein, 19 aa, Mycobacterium
MPNPVASIYRTRDNRFISF

SEQ ID NO: 1321942 - protein, 23 aa, Mycobacterium
MPPHNLRELAEAVYWCLENYEAD

SEQ ID NO: 1321943 - protein, 23 aa, Mycobacterium
MPPMQYLLEWRVALAKELLRTER

SEQ ID NO: 1321944 - protein, 34 aa, Mycobacterium
MPQWAREWQRLLFDNGWLLPAQPPEFGGRNASVL

SEQ ID NO: 1321945 - protein, 25 aa, Mycobacterium
MPRKDIALQAIAYGSVYVARVAMGA

SEQ ID NO: 1321946 - protein, 20 aa, Mycobacterium
MPRRFYCRATWHTSELDSET

SEQ ID NO: 1321947 - protein, 17 aa, Mycobacterium
MPSPAPRDTDPASPAWL

SEQ ID NO: 1321948 - protein, 17 aa, Mycobacterium
MPVLKPLHDEAGLTRLI

SEQ ID NO: 1321949 - protein, 24 aa, Mycobacterium
MPVPILTLRQWRPLDAARMEVWSW

SEQ ID NO: 1321950 - protein, 19 aa, Mycobacterium
MPYFARYVDGDLLSFVHTG

SEQ ID NO: 1321951 - protein, 22 aa, Mycobacterium
MPYKHGFGPFAPEIYRAPLSYP

SEQ ID NO: 1321952 - protein, 18 aa, Mycobacterium
MQACLPYYVELYEKMKAD

SEQ ID NO: 1321953 - protein, 19 aa, Mycobacterium
MQACLPYYVELYEKMKADG

SEQ ID NO: 1321954 - protein, 26 aa, Mycobacterium
MQARKKALLQRLPLVTAPYDGPVANA

SEQ ID NO: 1321955 - protein, 25 aa, Mycobacterium
MQHPEGILVVWLDLTDQRSFTLEDQ

SEQ ID NO: 1321956 - protein, 20 aa, Mycobacterium
MQLHGGIGYTWESGVHVYLK

SEQ ID NO: 1321957 - protein, 17 aa, Mycobacterium
MQLIRVFADATDRLADA

SEQ ID NO: 1321958 - protein, 24 aa, Mycobacterium
MQMPEMPLIKFIDGWETVVEMEAA

SEQ ID NO: 1321959 - protein, 25 aa, Mycobacterium
MQNALPIQVLMPEDIAGAVAWLVSD

SEQ ID NO: 1321960 - protein, 32 aa, Mycobacterium
MQPQRGYKIFEEWANWLFAAGGSIYDADGKPT

SEQ ID NO: 1321961 - protein, 27 aa, Mycobacterium
MQPWDRDQIHRLFDDLEFRVLRDRLFD

SEQ ID NO: 1321962 - protein, 21 aa, Mycobacterium
MQQGELAVSFLLIGSGRAEVV

SEQ ID NO: 1321963 - protein, 20 aa, Mycobacterium
MQRFADYLATIPGSLEQVIW

SEQ ID NO: 1321964 - protein, 22 aa, Mycobacterium
MQRFLLFMTVGLYDPPIRELMG

SEQ ID NO: 1321965 - protein, 17 aa, Mycobacterium
MQRLLPVYRADPDAYDL

SEQ ID NO: 1321966 - protein, 20 aa, Mycobacterium
MQVMMVGFVLGPPVLRERLG

SEQ ID NO: 1321967 - protein, 22 aa, Mycobacterium
MQWGRTIGQLPSPYTARNPLVA

SEQ ID NO: 1321968 - protein, 23 aa, Mycobacterium
MQWGRTIGQLPSPYTARNPLVAP

SEQ ID NO: 1321969 - protein, 18 aa, Mycobacterium
MRAALPLGLWVPVLPGTR

SEQ ID NO: 1321970 - protein, 20 aa, Mycobacterium
MRAFAAFIRAHRERVGPRGG

SEQ ID NO: 1321971 - protein, 18 aa, Mycobacterium
MRAFVENLLDVHLIDGYG

SEQ ID NO: 1321972 - protein, 20 aa, Mycobacterium
MRAHQILLARVETALRPYDL

SEQ ID NO: 1321973 - protein, 17 aa, Mycobacterium
MRASHLHFMVTAPGLRR

SEQ ID NO: 1321974 - protein, 25 aa, Mycobacterium
MRDDVVLELGWGRLIFGQTFADPEK

SEQ ID NO: 1321975 - protein, 21 aa, Mycobacterium
MRDGRWLHFRDFMNSALTLQA

SEQ ID NO: 1321976 - protein, 24 aa, Mycobacterium
MRDSKLGLLPKYRKLFGSSTLGYF

SEQ ID NO: 1321977 - protein, 28 aa, Mycobacterium
MREARLRRLPVLLLGRQPRHGDGGDELD

SEQ ID NO: 1321978 - protein, 23 aa, Mycobacterium
MREGQTLFTYLHLAASRSCTDAL

SEQ ID NO: 1321979 - protein, 21 aa, Mycobacterium
MREIGYLFGQYKRITNRYESG

SEQ ID NO: 1321980 - protein, 17 aa, Mycobacterium
MRELERAILLDCLDSKW

SEQ ID NO: 1321981 - protein, 23 aa, Mycobacterium
MRHSWQSYLVASAQFADWVDRGR

SEQ ID NO: 1321982 - protein, 19 aa, Mycobacterium
MRIRPGTVLTLWTEDAYGG

SEQ ID NO: 1321983 - protein, 19 aa, Mycobacterium
MRISELPEHLVIVGGGFVA

SEQ ID NO: 1321984 - protein, 23 aa, Mycobacterium
MRITPRAFLCGTAFRVGGGGAET

SEQ ID NO: 1321985 - protein, 23 aa, Mycobacterium
MRKDWNPHDFIPWSDGKNYYALG

SEQ ID NO: 1321986 - protein, 18 aa, Mycobacterium
MRKFDPFGPFGEAGEMLT

SEQ ID NO: 1321987 - protein, 29 aa, Mycobacterium
MRLAAGTLIRFVRPVADPALYLYAAVSPA

SEQ ID NO: 1321988 - protein, 18 aa, Mycobacterium
MRLARRRVTFQAGKPGSY

SEQ ID NO: 1321989 - protein, 17 aa, Mycobacterium
MRLFGAFVTAAERSREN

SEQ ID NO: 1321990 - protein, 28 aa, Mycobacterium
MRLYDARYHAELHWWTASFAEREGIPRS

SEQ ID NO: 1321991 - protein, 21 aa, Mycobacterium
MRMQHRWSIVMVDEFQDTDPV

SEQ ID NO: 1321992 - protein, 28 aa, Mycobacterium
MRPSDPPWCRPLLGVRRAVTRLACAELG

SEQ ID NO: 1321993 - protein, 32 aa, Mycobacterium
MRQKRLMDLIHLWLIHRFKAEIVYYVTPTEDN

SEQ ID NO: 1321994 - protein, 22 aa, Mycobacterium
MRQRLLIAMAVALNPSVLIADE

SEQ ID NO: 1321995 - protein, 25 aa, Mycobacterium
MRQRVMIAMALALEPAVLIADEPTT

SEQ ID NO: 1321996 - protein, 17 aa, Mycobacterium
MRQRVRCLAPGKRILHD

SEQ ID NO: 1321997 - protein, 17 aa, Mycobacterium
MRRLAADGVLRSEDVLL

SEQ ID NO: 1321998 - protein, 18 aa, Mycobacterium
MRRLLRDVAEGRELGDTS

SEQ ID NO: 1321999 - protein, 29 aa, Mycobacterium
MRRPHWSLARTWLLQPDLPGFPEATTGAA

SEQ ID NO: 1322000 - protein, 17 aa, Mycobacterium
MRRRVFGSDWDSPAGEA

SEQ ID NO: 1322001 - protein, 19 aa, Mycobacterium
MRTFLGVPVRIRDEVFGNL

SEQ ID NO: 1322002 - protein, 17 aa, Mycobacterium
MRTWFGFGVAGNFAGHL

SEQ ID NO: 1322003 - protein, 18 aa, Mycobacterium
MRYAALAAVIRPGATELE

SEQ ID NO: 1322004 - protein, 28 aa, Mycobacterium
MSADLVVLGPGSWFTSVIPHVLVPELAA

SEQ ID NO: 1322005 - protein, 24 aa, Mycobacterium
MSAGFLLAELLIPLVMDAIGEPAR

SEQ ID NO: 1322006 - protein, 36 aa, Mycobacterium
MSALLNALEISWGDVALLLSVPRQGLGNAAISSVAT

SEQ ID NO: 1322007 - protein, 20 aa, Mycobacterium
MSARRFWVRYAAEASGALTL

SEQ ID NO: 1322008 - protein, 27 aa, Mycobacterium
MSATISAVLPTLAAPLMANVTALQAKE

SEQ ID NO: 1322009 - protein, 26 aa, Mycobacterium
MSDLKYGYIGLGNMGAPMAKRLTGWP

SEQ ID NO: 1322010 - protein, 24 aa, Mycobacterium
MSEGEMFIIGRIKDLLIVDGRNHY

SEQ ID NO: 1322011 - protein, 25 aa, Mycobacterium
MSETEAWLRAQLPDALLSVVDLDLT

SEQ ID NO: 1322012 - protein, 23 aa, Mycobacterium
MSEVLLPRRGTLIAWTTQGFPPG

SEQ ID NO: 1322013 - protein, 23 aa, Mycobacterium
MSFKPRYDNFIGGQWVAPNAGRY

SEQ ID NO: 1322014 - protein, 24 aa, Mycobacterium
MSGARIVLHLALELQRRGGGTGAA

SEQ ID NO: 1322015 - protein, 23 aa, Mycobacterium
MSGRWRVRHPSLAPLHQQARDLE

SEQ ID NO: 1322016 - protein, 25 aa, Mycobacterium
MSHLAERGWVCLSIDYRVAPHNPWP

SEQ ID NO: 1322017 - protein, 17 aa, Mycobacterium
MSIGVVLDLLRGDFPDV

SEQ ID NO: 1322018 - protein, 19 aa, Mycobacterium
MSIPIRRGQNQPALFHLTL

SEQ ID NO: 1322019 - protein, 22 aa, Mycobacterium
MSKFEVVTAMAFAAFADAPVDV

SEQ ID NO: 1322020 - protein, 25 aa, Mycobacterium
MSPEEARFILERLTPGMSQIFGMAE

SEQ ID NO: 1322021 - protein, 24 aa, Mycobacterium
MSPIRPNVIWAMDFQFDTTADGRI

SEQ ID NO: 1322022 - protein, 25 aa, Mycobacterium
MSPSLPNRLNVQPLISHRFAFDDAE

SEQ ID NO: 1322023 - protein, 23 aa, Mycobacterium
MSPVLLPRRGTLIAWTTQGFPPG

SEQ ID NO: 1322024 - protein, 27 aa, Mycobacterium
MSPVSFSAVSLYWGILAAMGMHVAEDL

SEQ ID NO: 1322025 - protein, 23 aa, Mycobacterium
MSQVLLPRRGTLIAWTTQGFPPG

SEQ ID NO: 1322026 - protein, 18 aa, Mycobacterium
MSRLVVLGRQRSGRIPPA

SEQ ID NO: 1322027 - protein, 26 aa, Mycobacterium
MSSEPLIDAIPLWKRPQDGAVITGWD

SEQ ID NO: 1322028 - protein, 29 aa, Mycobacterium
MSSMSRRGQWTVPARLRLVTRMCSTTLDF

SEQ ID NO: 1322029 - protein, 34 aa, Mycobacterium
MSSNRPEFVVALRAIWRLGASAVLLSPAWKQAEV

SEQ ID NO: 1322030 - protein, 18 aa, Mycobacterium
MSTFRIHRRKKALLQRLP

SEQ ID NO: 1322031 - protein, 26 aa, Mycobacterium
MSTRDAQLDWPLTESLRYPAALVDDF

SEQ ID NO: 1322032 - protein, 26 aa, Mycobacterium
MSTRDAQLDWPLTESLRYPTALVDDF

SEQ ID NO: 1322033 - protein, 22 aa, Mycobacterium
MSVADWRMFAERAPLYTAREKA

SEQ ID NO: 1322034 - protein, 17 aa, Mycobacterium
MSVLLDTLDELAGAGLL

SEQ ID NO: 1322035 - protein, 27 aa, Mycobacterium
MSVVGISLPTCFWYMSEMRAASERAAK

SEQ ID NO: 1322036 - protein, 20 aa, Mycobacterium
MSYPTLTRQIRARNLRPACQ

SEQ ID NO: 1322037 - protein, 19 aa, Mycobacterium
MTAGILRYSRDLAFAAATA

SEQ ID NO: 1322038 - protein, 25 aa, Mycobacterium
MTAGVIEVAPLAFMRGRTLNDAFII

SEQ ID NO: 1322039 - protein, 18 aa, Mycobacterium
MTAYLPQVVGAAMARRLS

SEQ ID NO: 1322040 - protein, 18 aa, Mycobacterium
MTCVTAMSIPPVLAVYDF

SEQ ID NO: 1322041 - protein, 24 aa, Mycobacterium
MTDYMTRLMRYVEFMKKVVPMHDD

SEQ ID NO: 1322042 - protein, 17 aa, Mycobacterium
MTEETFGPTLPIMKVKS

SEQ ID NO: 1322043 - protein, 27 aa, Mycobacterium
MTEFLPGHYDFLQRLFAGINPRHRQQL

SEQ ID NO: 1322044 - protein, 22 aa, Mycobacterium
MTELPLIVIDVQRGGPSTGLPT

SEQ ID NO: 1322045 - protein, 25 aa, Mycobacterium
MTFAAVVDGLLPRALREPAETKSFD

SEQ ID NO: 1322046 - protein, 23 aa, Mycobacterium
MTGAQRSYLHTLAQEAGAGVPDD

SEQ ID NO: 1322047 - protein, 17 aa, Mycobacterium
MTGLHWAEEPVSRVSHL

SEQ ID NO: 1322048 - protein, 17 aa, Mycobacterium
MTLGSYRWLRPHGRRTA

SEQ ID NO: 1322049 - protein, 20 aa, Mycobacterium
MTLRIPRPRLCTDNGAMIAS

SEQ ID NO: 1322050 - protein, 19 aa, Mycobacterium
MTRGDIEDIFWLQATIAEK

SEQ ID NO: 1322051 - protein, 18 aa, Mycobacterium
MTRLRGLDLRAGEPVAIC

SEQ ID NO: 1322052 - protein, 22 aa, Mycobacterium
MTSAPIERILIRLPAISMAAVY

SEQ ID NO: 1322053 - protein, 34 aa, Mycobacterium
MTSGGTFFTLRCYLDDQPIFLGRNGRISVFTSER

SEQ ID NO: 1322054 - protein, 19 aa, Mycobacterium
MTSRELLEILRGFVGLNVI

SEQ ID NO: 1322055 - protein, 17 aa, Mycobacterium
MTSRGFPNQFFMGFIQG

SEQ ID NO: 1322056 - protein, 36 aa, Mycobacterium
MTTESAQLDWPLAESLRYPAGLIDTFEWERVLDGGG

SEQ ID NO: 1322057 - protein, 26 aa, Mycobacterium
MTVMDNLYRKGWLSRELDGRAYSYRA

SEQ ID NO: 1322058 - protein, 22 aa, Mycobacterium
MTYAVVPALRFNPDLAAVYEPL

SEQ ID NO: 1322059 - protein, 19 aa, Mycobacterium
MVAAGWTDGPPPGKKPFGT

SEQ ID NO: 1322060 - protein, 17 aa, Mycobacterium
MVADRTLHEAVPAIGAC

SEQ ID NO: 1322061 - protein, 17 aa, Mycobacterium
MVATFGLERLESGLARN

SEQ ID NO: 1322062 - protein, 27 aa, Mycobacterium
MVDEVLRGFLDWLFDRYQQIVATEPNP

SEQ ID NO: 1322063 - protein, 19 aa, Mycobacterium
MVFGYDMFDDFPAVLALIA

SEQ ID NO: 1322064 - protein, 25 aa, Mycobacterium
MVGNNTPVFFMRDPMKFQNFIRSQK

SEQ ID NO: 1322065 - protein, 28 aa, Mycobacterium
MVHCVRAALPLLRAAEWARIVNFSAHST

SEQ ID NO: 1322066 - protein, 18 aa, Mycobacterium
MVLAPHRGAKTRAKAAHD

SEQ ID NO: 1322067 - protein, 18 aa, Mycobacterium
MVMKAPIWGAALDEICSP

SEQ ID NO: 1322068 - protein, 19 aa, Mycobacterium
MVMPGSHRVFYPCVGATPR

SEQ ID NO: 1322069 - protein, 31 aa, Mycobacterium
MVMTPDFSTLRLLPWLPGSALVMADLSWTDG

SEQ ID NO: 1322070 - protein, 25 aa, Mycobacterium
MVNASRHAHWLNPEPRHLWGSGDSA

SEQ ID NO: 1322071 - protein, 30 aa, Mycobacterium; identical to SEQ ID NO: 129502

SEQ ID NO: 1322072 - protein, 17 aa, Mycobacterium
MVPPPGYMAGVRALCDE

SEQ ID NO: 1322073 - protein, 26 aa, Mycobacterium
MVRDKPLPFPPEPLASIGINATRWSL

SEQ ID NO: 1322074 - protein, 17 aa, Mycobacterium
MVRRRITFLAKSEYFTG

SEQ ID NO: 1322075 - protein, 26 aa, Mycobacterium
MVRSKPLPFPPEPLASIGIQATRWSL

SEQ ID NO: 1322076 - protein, 21 aa, Mycobacterium
MVRWGAEMRFSYTKGLYDTYV

SEQ ID NO: 1322077 - protein, 23 aa, Mycobacterium
MVSHFHYDPVWWNTQAAYTSTWT

SEQ ID NO: 1322078 - protein, 20 aa, Mycobacterium
MVVTINAWNRINVAVRMPIP

SEQ ID NO: 1322079 - protein, 17 aa, Mycobacterium
MVYDALDMTYRTIKIRK

SEQ ID NO: 1322080 - protein, 18 aa, Mycobacterium
MVYEALRHYADAGISARF

SEQ ID NO: 1322081 - protein, 24 aa, Mycobacterium
MVYLCGPSGRYLTGATLPLDAGQT

SEQ ID NO: 1322082 - protein, 17 aa, Mycobacterium
MVYLMHTAAAVTVAAAP

SEQ ID NO: 1322083 - protein, 26 aa, Mycobacterium
MWAARRSGLYYALINTHLTAPEAAYI

SEQ ID NO: 1322084 - protein, 17 aa, Mycobacterium
MWAYHRTVPDRQPAGAN

SEQ ID NO: 1322085 - protein, 19 aa, Mycobacterium
MWGYSVLVALDRSPMRTQA

SEQ ID NO: 1322086 - protein, 22 aa, Mycobacterium
MWRLDVLHDDTCPWFSAYEARH

SEQ ID NO: 1322087 - protein, 21 aa, Mycobacterium
MWSGVHIPKEGRGRKFALRQL

SEQ ID NO: 1322088 - protein, 17 aa, Mycobacterium
MYGFVPSCGAVLGEWGA

SEQ ID NO: 1322089 - protein, 17 aa, Mycobacterium
MYIDGAWRDAADTIEVR

SEQ ID NO: 1322090 - protein, 17 aa, Mycobacterium
MYPNRDALLAALSERTA

SEQ ID NO: 1322091 - protein, 31 aa, Mycobacterium
MYSQVLWTQNMLMPWLWTHLRGKSVGEGRAP

SEQ ID NO: 1322092 - protein, 24 aa, Mycobacterium
NAAAPAIVRLAPPLVITEAQVETF

SEQ ID NO: 1322093 - protein, 18 aa, Mycobacterium
NAAAPDVIRLAPPLVVTE

SEQ ID NO: 1322094 - protein, 21 aa, Mycobacterium
NAAARLAALAAPGLIVIGRDV

SEQ ID NO: 1322095 - protein, 24 aa, Mycobacterium
NAALVLSFLGQFFVEDNRGACSAS

SEQ ID NO: 1322096 - protein, 31 aa, Mycobacterium
NAAMASLGVPYRWLTSYVAGDKVYCIHEADD

SEQ ID NO: 1322097 - protein, 27 aa, Mycobacterium
NAARLGLQDVIWRGTYYTPAGPQASGY

SEQ ID NO: 1322098 - protein, 24 aa, Mycobacterium
NAATELIMYAMQLAALRAEQPGED

SEQ ID NO: 1322099 - protein, 25 aa, Mycobacterium
NADHARWFYEFSRPGDVVEVRNTGG

SEQ ID NO: 1322100 - protein, 20 aa, Mycobacterium
NADLKLLGALPTLYDSRTTH

SEQ ID NO: 1322101 - protein, 35 aa, Mycobacterium
NADQLLIVVALADPPPRTGFVERALIAAYAGGLRP

SEQ ID NO: 1322102 - protein, 47 aa, Mycobacterium
NADQLLIVVALADPPPRTGFVERALIAAYAGGLRPVLCLTKSDLAPA

SEQ ID NO: 1322103 - protein, 45 aa, Mycobacterium; identical to SEQ ID NO: 839881

SEQ ID NO: 1322104 - protein, 24 aa, Mycobacterium
NADRPQTVLWWLRKKPGTGPQLLR

SEQ ID NO: 1322105 - protein, 18 aa, Mycobacterium
NADTPWVDPLIAAAAMGA

SEQ ID NO: 1322106 - protein, 26 aa, Mycobacterium
NAEEGRLFTRFLPLLPTTEQTIEIML

SEQ ID NO: 1322107 - protein, 22 aa, Mycobacterium
NAEFVRHDVTWTVIPGPAVSRL

SEQ ID NO: 1322108 - protein, 28 aa, Mycobacterium
NAETLRKFGKYLVDLTPAAIGPFVVPAV

SEQ ID NO: 1322109 - protein, 26 aa, Mycobacterium
NAETLRPVLREWAPNPRLVVGMSLGG

SEQ ID NO: 1322110 - protein, 31 aa, Mycobacterium
NAETSLPWQLPGRLLLARAYAALGRTDEAER

SEQ ID NO: 1322111 - protein, 39 aa, Mycobacterium
NAFADAFAYARRALGLPATVLDWGLWKSWSDAQPQMKAA

SEQ ID NO: 1322112 - protein, 25 aa, Mycobacterium
NAFAEGWVVPLPPTKLTGKTVAVVG

SEQ ID NO: 1322113 - protein, 25 aa, Mycobacterium
NAFLHPTMERFLYSAERRLQAYKVV

SEQ ID NO: 1322114 - protein, 36 aa, Mycobacterium
NAGAQLFPSAHAWIAHIWTPPFTSKRLRRRLRAAAE

SEQ ID NO: 1322115 - protein, 18 aa, Mycobacterium
NAGFLWACSGYYNYDKGY

SEQ ID NO: 1322116 - protein, 29 aa, Mycobacterium
NAGTARSLIALFEALFRPVEQGPGANRDA

SEQ ID NO: 1322117 - protein, 26 aa, Mycobacterium
NAGTVWVNCFFVRDLRAPFGGVGDSG

SEQ ID NO: 1322118 - protein, 19 aa, Mycobacterium
NAGVLSWGRLWEMSEDQWS

SEQ ID NO: 1322119 - protein, 25 aa, Mycobacterium
NAGVLWLGPIETTPLKRWQLCLDVN

SEQ ID NO: 1322120 - protein, 23 aa, Mycobacterium
NAHHAQYVFLITNTDPAAPKHQS

SEQ ID NO: 1322121 - protein, 23 aa, Mycobacterium
NAHIVNISPPLNLAPQWVGAHVG

SEQ ID NO: 1322122 - protein, 17 aa, Mycobacterium
NAIARLDPAVRARGVVA

SEQ ID NO: 1322123 - protein, 20 aa, Mycobacterium
NAILALLRNDGQWAALAADP

SEQ ID NO: 1322124 - protein, 26 aa, Mycobacterium
NAILEDPFPLLRQALENVLGYGGTLV

SEQ ID NO: 1322125 - protein, 29 aa, Mycobacterium
NAIVRKPVPPLTWWRGIKARKTLEDYFSS

SEQ ID NO: 1322126 - protein, 28 aa, Mycobacterium
NAKKPMPPLVVFKWGNVTSFPAFVTQVS

SEQ ID NO: 1322127 - protein, 23 aa, Mycobacterium
NAKLGRLASLLRDKRIPFEMCPS

SEQ ID NO: 1322128 - protein, 31 aa, Mycobacterium
NALDPVRVPFEHPLWILFSSGTTGLPKGIMH

SEQ ID NO: 1322129 - protein, 21 aa, Mycobacterium
NALFDFFAQLVAGFSPPGNTA

SEQ ID NO: 1322130 - protein, 22 aa, Mycobacterium
NALFRRVELFAREQWEELAALD

SEQ ID NO: 1322131 - protein, 19 aa, Mycobacterium
NALKAWLIGVGEDGEWPLF

SEQ ID NO: 1322132 - protein, 18 aa, Mycobacterium
NALLDGLTAHRRARGLPA

SEQ ID NO: 1322133 - protein, 18 aa, Mycobacterium
NALLDRLAPQYQQRLWQL

SEQ ID NO: 1322134 - protein, 18 aa, Mycobacterium
NALLLRTAQTLLVDNGFE

SEQ ID NO: 1322135 - protein, 21 aa, Mycobacterium
NALPRRGFAALRRPVRRPLDE

SEQ ID NO: 1322136 - protein, 24 aa, Mycobacterium
NALRAVRWFGKRSAPMTYAASKIA

SEQ ID NO: 1322137 - protein, 17 aa, Mycobacterium
NALSRDLIRALYASLSE

SEQ ID NO: 1322138 - protein, 29 aa, Mycobacterium
NAMEVGPDGLLYYPLMTANEIWRVDPDGG

SEQ ID NO: 1322139 - protein, 29 aa, Mycobacterium
NAMEVGPDGLLYYPLMTANEIWRVNPNGG

SEQ ID NO: 1322140 - protein, 23 aa, Mycobacterium
NANSIDLVFFVNGIPVATAELKT

SEQ ID NO: 1322141 - protein, 17 aa, Mycobacterium
NAPFIVFDDADIDAAVD

SEQ ID NO: 1322142 - protein, 32 aa, Mycobacterium
NAPGVPMIFPPWFEKLQIKYINPVIRPLSKRM

SEQ ID NO: 1322143 - protein, 24 aa, Mycobacterium
NAPLEVFVAAAERLDWTHGCDLHA

SEQ ID NO: 1322144 - protein, 24 aa, Mycobacterium
NAPTKVDFRLVRKTTTLGGVHLKA

SEQ ID NO: 1322145 - protein, 25 aa, Mycobacterium
NAQIPVPAQWQWPQSIITDPERLRV

SEQ ID NO: 1322146 - protein, 19 aa, Mycobacterium
NAQNFRILTRLEPKVLDAT

SEQ ID NO: 1322147 - protein, 17 aa, Mycobacterium
NAQQRLWQVREAVAEVL

SEQ ID NO: 1322148 - protein, 22 aa, Mycobacterium
NAQVVLVRRRLDAAGLTEVRAG

SEQ ID NO: 1322149 - protein, 20 aa, Mycobacterium
NAQWFYDNFGSGDPVVVKNS

SEQ ID NO: 1322150 - protein, 22 aa, Mycobacterium
NAQWFYDNFGSGDPVVVKNSVG

SEQ ID NO: 1322151 - protein, 24 aa, Mycobacterium
NARAILRDLRRFGPPLWERFSTAD

SEQ ID NO: 1322152 - protein, 22 aa, Mycobacterium
NARTRFVLVGRPGPPPKCTGAD

SEQ ID NO: 1322153 - protein, 18 aa, Mycobacterium
NARYRMEQGFTFELNLAG

SEQ ID NO: 1322154 - protein, 17 aa, Mycobacterium
NASDLLGAFPRDHRLPP

SEQ ID NO: 1322155 - protein, 26 aa, Mycobacterium
NASGRTITFPGFLKAYVESIDDLAGG

SEQ ID NO: 1322156 - protein, 32 aa, Mycobacterium
NASIAPALADRMRPWLPRVTNGRYRDVTVDPG

SEQ ID NO: 1322157 - protein, 34 aa, Mycobacterium
NASIYVAEWLGRLGSLPIALILLDARDASFAETL

SEQ ID NO: 1322158 - protein, 17 aa, Mycobacterium
NASWLAHRKIYSKIRQF

SEQ ID NO: 1322159 - protein, 29 aa, Mycobacterium
NATLWPLYHDLIVKPIYHRKWWDRYVEVN

SEQ ID NO: 1322160 - protein, 27 aa, Mycobacterium
NATLWPLYHDVIVKPIYHREWWDRYVD

SEQ ID NO: 1322161 - protein, 18 aa, Mycobacterium
NAVAADMSAFFADNPFRF

SEQ ID NO: 1322162 - protein, 24 aa, Mycobacterium
NAVANLLRNLWAYVVIFCGHFPEG

SEQ ID NO: 1322163 - protein, 23 aa, Mycobacterium
NAVAPGFVHTPLTAAAASVPGVV

SEQ ID NO: 1322164 - protein, 21 aa, Mycobacterium
NAVCVGIAPDLFELDDDDYAV

SEQ ID NO: 1322165 - protein, 19 aa, Mycobacterium
NAVLHLLAIAYEANVKLTL

SEQ ID NO: 1322166 - protein, 27 aa, Mycobacterium
NAVRDWIDMFTMWPQKPTPGMRTQLDI

SEQ ID NO: 1322167 - protein, 25 aa, Mycobacterium
NCLGGSLMDYLIPTALEVPELETGH

SEQ ID NO: 1322168 - protein, 25 aa, Mycobacterium
NCVAPMRLCHHFAPAMAARGRGGIV

SEQ ID NO: 1322169 - protein, 28 aa, Mycobacterium
NDAPLHVTTLAWLSLGPTGSNNEADDRH

SEQ ID NO: 1322170 - protein, 17 aa, Mycobacterium
NDAVIEELTIVPAKIGH

SEQ ID NO: 1322171 - protein, 23 aa, Mycobacterium
NDDIKRSWLRPLATTEHIWCQLF

SEQ ID NO: 1322172 - protein, 24 aa, Mycobacterium
NDDPLHALWLINNDASRTGLNTEF

SEQ ID NO: 1322173 - protein, 21 aa, Mycobacterium
NDEGLELALAAGLPAEPLRRA

SEQ ID NO: 1322174 - protein, 24 aa, Mycobacterium
NDEHEFWALLKYEDIRYVSTNPAL

SEQ ID NO: 1322175 - protein, 24 aa, Mycobacterium
NDELRGPMEKATPLRRLGDPLDIA

SEQ ID NO: 1322176 - protein, 20 aa, Mycobacterium
NDERFLALGGWKDKDEAHHT

SEQ ID NO: 1322177 - protein, 23 aa, Mycobacterium
NDEVTHMLAWVLAAQGDLDEMVA

SEQ ID NO: 1322178 - protein, 17 aa, Mycobacterium
NDFLLDWSSIAPDRLLS

SEQ ID NO: 1322179 - protein, 17 aa, Mycobacterium
NDGASIPQLGFGVYQVK

SEQ ID NO: 1322180 - protein, 18 aa, Mycobacterium
NDHDLWFCSDRCARRFAA

SEQ ID NO: 1322181 - protein, 21 aa, Mycobacterium
NDLLLPIVKGYGSERSWVVLG

SEQ ID NO: 1322182 - protein, 18 aa, Mycobacterium
NDLLPSLTLDSYEWALAV

SEQ ID NO: 1322183 - protein, 21 aa, Mycobacterium
NDLVLRYGPKRIGLLTGDQAI

SEQ ID NO: 1322184 - protein, 21 aa, Mycobacterium
NDMVLAISTGALRTLLLKYDG

SEQ ID NO: 1322185 - protein, 19 aa, Mycobacterium
NDRYFYESFRDCQELMLAA

SEQ ID NO: 1322186 - protein, 21 aa, Mycobacterium
NDRYKPDWCRVIDFPLTVAAD

SEQ ID NO: 1322187 - protein, 19 aa, Mycobacterium
NDTPVLQELGLPIITPEYW

SEQ ID NO: 1322188 - protein, 20 aa, Mycobacterium
NDVFLKDIWPSAAEIQETIT

SEQ ID NO: 1322189 - protein, 21 aa, Mycobacterium
NDVRLLDLLAKSPTGSARMGD

SEQ ID NO: 1322190 - protein, 24 aa, Mycobacterium
NEAAFLYQLLVRSFGTNNLPDCSN

SEQ ID NO: 1322191 - protein, 24 aa, Mycobacterium
NEAGLATLLFDLLTPAEEADRANV

SEQ ID NO: 1322192 - protein, 24 aa, Mycobacterium
NEDVLYVLRASDLILWESGVRTRV

SEQ ID NO: 1322193 - protein, 20 aa, Mycobacterium
NEEDARWRFGVPPANNANYA

SEQ ID NO: 1322194 - protein, 32 aa, Mycobacterium
NEHIHAVMWAARRAGLYYVPISTHLTAAEVAY

SEQ ID NO: 1322195 - protein, 20 aa, Mycobacterium
NEKRLFCRMAEVFAGFLSYT

SEQ ID NO: 1322196 - protein, 20 aa, Mycobacterium
NELLFDDVIWLQQARRDHFD

SEQ ID NO: 1322197 - protein, 18 aa, Mycobacterium
NELLTLHGQNDQLRLMRP

SEQ ID NO: 1322198 - protein, 29 aa, Mycobacterium
NENERERLFPLIRRYALAYHVVFIPSQEV

SEQ ID NO: 1322199 - protein, 24 aa, Mycobacterium
NEPLPALNSFILPGGTPLSALLHV

SEQ ID NO: 1322200 - protein, 21 aa, Mycobacterium
NEPLPALTSFVLPGGTPLSAQ

SEQ ID NO: 1322201 - protein, 23 aa, Mycobacterium
NEQTVALGLGAGWRQQIDEPNWT

SEQ ID NO: 1322202 - protein, 23 aa, Mycobacterium
NERGEVLAWVNSKFEPFASTAAM

SEQ ID NO: 1322203 - protein, 29 aa, Mycobacterium
NERQRALLEAFPGWGPVAALFDAEPAGPW

SEQ ID NO: 1322204 - protein, 17 aa, Mycobacterium
NERVAYLDGSDLIDDQI

SEQ ID NO: 1322205 - protein, 19 aa, Mycobacterium
NERYAGWSDLLALVGIKSG

SEQ ID NO: 1322206 - protein, 21 aa, Mycobacterium
NESKSWLHRYGDQEISQFRGA

SEQ ID NO: 1322207 - protein, 20 aa, Mycobacterium
NEYLAHHPFGVWAEDYRREL

SEQ ID NO: 1322208 - protein, 24 aa, Mycobacterium
NEYLQKYIVLYGDQFNNIVMRTSD

SEQ ID NO: 1322209 - protein, 25 aa, Mycobacterium
NFAAGRLSYFLGVRGPAVVSDTACS

SEQ ID NO: 1322210 - protein, 25 aa, Mycobacterium
NFAAGRLSYFLGVRGPAVVVDTACS

SEQ ID NO: 1322211 - protein, 20 aa, Mycobacterium
NFAKLLERAAGYLRDESLTD

SEQ ID NO: 1322212 - protein, 22 aa, Mycobacterium
NFASQWDRLGFGVQLSALVTFG

SEQ ID NO: 1322213 - protein, 17 aa, Mycobacterium
NFDIESIFVRPLPHQFS

SEQ ID NO: 1322214 - protein, 26 aa, Mycobacterium
NFDVALWNPLRRYLEGRGVRFHTGVS

SEQ ID NO: 1322215 - protein, 27 aa, Mycobacterium
NFDVALWNPLRRYLEGRGVRFHTGVSV

SEQ ID NO: 1322216 - protein, 21 aa, Mycobacterium
NFEYGLECILDHAARLIEQNA

SEQ ID NO: 1322217 - protein, 24 aa, Mycobacterium
NFGSSLKELIYSDGSFSGLIGDGK

SEQ ID NO: 1322218 - protein, 20 aa, Mycobacterium
NFILFGEFADAPATWRRYLD

SEQ ID NO: 1322219 - protein, 17 aa, Mycobacterium
NFKAVLTGAYVALPYLK

SEQ ID NO: 1322220 - protein, 20 aa, Mycobacterium
NFLAEWYLPDLAETTVDDIV

SEQ ID NO: 1322221 - protein, 18 aa, Mycobacterium
NFLPELGLRRENIAFVSG

SEQ ID NO: 1322222 - protein, 26 aa, Mycobacterium
NFMTQGWFTGLIPITVPIGATSFADA

SEQ ID NO: 1322223 - protein, 17 aa, Mycobacterium
NFRHPAWARSTFTHLPV

SEQ ID NO: 1322224 - protein, 20 aa, Mycobacterium
NFRNGVLNPNAFRRKEISVE

SEQ ID NO: 1322225 - protein, 22 aa, Mycobacterium
NFRPGTLEKWGLGYDVLRERNR

SEQ ID NO: 1322226 - protein, 28 aa, Mycobacterium
NFRRATQLLIYHSAFFAPELIPVNLVLQ

SEQ ID NO: 1322227 - protein, 33 aa, Mycobacterium
NFSFGDYFKKGAIEFAWTLLTNPVDQSGYGFDP

SEQ ID NO: 1322228 - protein, 30 aa, Mycobacterium
NFSFGDYFKKGAIEFAWTLLTNPVEAGGYG

SEQ ID NO: 1322229 - protein, 20 aa, Mycobacterium
NFSYGTPVPDLFPTVVAQAQ

SEQ ID NO: 1322230 - protein, 20 aa, Mycobacterium
NFVIADRLGTTLSYIPNLMG

SEQ ID NO: 1322231 - protein, 24 aa, Mycobacterium
NGAAALINPLRFGSGIKLKVFEAL

SEQ ID NO: 1322232 - protein, 20 aa, Mycobacterium
NGAATLLDWMTEDSQRPIGD

SEQ ID NO: 1322233 - protein, 26 aa, Mycobacterium
NGAGKSTLLMLIAGLLRPDVGRIELG

SEQ ID NO: 1322234 - protein, 25 aa, Mycobacterium
NGAKAWITHGGIADFYNLFARTGEG

SEQ ID NO: 1322235 - protein, 17 aa, Mycobacterium
NGALLLGVRMLGVRVSP

SEQ ID NO: 1322236 - protein, 30 aa, Mycobacterium
NGANKPFPIASVVKLFIADDLLLQESEGKT

SEQ ID NO: 1322237 - protein, 26 aa, Mycobacterium
NGDCVAFFWFADAPDRVPGISSPEAI

SEQ ID NO: 1322238 - protein, 23 aa, Mycobacterium
NGFASALHHGPPPRSVRSAMLAN

SEQ ID NO: 1322239 - protein, 18 aa, Mycobacterium
NGGFFPSAREYSVRYGLS

SEQ ID NO: 1322240 - protein, 28 aa, Mycobacterium
NGGFGTFLLFDHDWAPPAAKLRSYELFA

SEQ ID NO: 1322241 - protein, 24 aa, Mycobacterium
NGGKTLPFVPFIGGSGPNPAILTR

SEQ ID NO: 1322242 - protein, 34 aa, Mycobacterium
NGGVLLITHYTRILRYIQPQFVHVFFDGRIIESG

SEQ ID NO: 1322243 - protein, 40 aa, Mycobacterium
NGGYFCRGLPADFDGWRVPGWTWRDVLPHFRAIETDLDFT

SEQ ID NO: 1322244 - protein, 21 aa, Mycobacterium
NGGYYADWYFSNGKDFDGVTE

SEQ ID NO: 1322245 - protein, 25 aa, Mycobacterium
NGHFYGVGLINWWDPKGTRSTLEEL

SEQ ID NO: 1322246 - protein, 23 aa, Mycobacterium
NGITFGIMTIRHAEPVIAFQTVN

SEQ ID NO: 1322247 - protein, 17 aa, Mycobacterium
NGITKWVLGWERNGWLT

SEQ ID NO: 1322248 - protein, 24 aa, Mycobacterium
NGLDPEGIHWVRTLMRTLAGEGRT

SEQ ID NO: 1322249 - protein, 19 aa, Mycobacterium
NGMIFLSLNAQAPPLEDYL

SEQ ID NO: 1322250 - protein, 21 aa, Mycobacterium
NGMNLAVVLRTTWAVAKVLKD

SEQ ID NO: 1322251 - protein, 20 aa, Mycobacterium
NGNWLIAGFDELAAGVPGCI

SEQ ID NO: 1322252 - protein, 25 aa, Mycobacterium
NGPGKIDQWTLLARARAIDTSTVVA

SEQ ID NO: 1322253 - protein, 19 aa, Mycobacterium
NGPWLADRLLELGVELGHI

SEQ ID NO: 1322254 - protein, 25 aa, Mycobacterium
NGQAYQFPMGLGLVSQFFGRYYTPD

SEQ ID NO: 1322255 - protein, 33 aa, Mycobacterium
NGQKTWTTLGQYADWIFCLVRTDPDAPKKQAGI

SEQ ID NO: 1322256 - protein, 19 aa, Mycobacterium
NGQTLFEICARLTTKHGLG

SEQ ID NO: 1322257 - protein, 27 aa, Mycobacterium
NGRLRDELLNLWRFDSLLEARVIIEDW

SEQ ID NO: 1322258 - protein, 26 aa, Mycobacterium
NGSKTWISNARRSGLIALLCKTDPAA

SEQ ID NO: 1322259 - protein, 22 aa, Mycobacterium
NGSSWIFPLFNDFDELAKKMPQ

SEQ ID NO: 1322260 - protein, 23 aa, Mycobacterium
NGTAAILLAFYVAAAEKKGVPRE

SEQ ID NO: 1322261 - protein, 24 aa, Mycobacterium
NGTFRGHNPAFVTATAALKTYWRD

SEQ ID NO: 1322262 - protein, 25 aa, Mycobacterium
NGTVMLRMPLHPVAIELLREVGPMA

SEQ ID NO: 1322263 - protein, 21 aa, Mycobacterium
NGTYYVLEKFAYIVMDSSTYG

SEQ ID NO: 1322264 - protein, 25 aa, Mycobacterium
NGVEMLMPCFASIYADLGITMSDIG

SEQ ID NO: 1322265 - protein, 26 aa, Mycobacterium
NGVHGFDLMFAAPKSVSLLRSLTDDV

SEQ ID NO: 1322266 - protein, 17 aa, Mycobacterium
NGVRRLVVSPDGTRIYL

SEQ ID NO: 1322267 - protein, 24 aa, Mycobacterium
NGVTPRRFLALSNPGLRELLDESI

SEQ ID NO: 1322268 - protein, 29 aa, Mycobacterium
NGVWAIFSTLDPRVLQFKPGLLLGRDLCE

SEQ ID NO: 1322269 - protein, 25 aa, Mycobacterium
NGVWAIFSTLDPRVLQFKPGLLLNR

SEQ ID NO: 1322270 - protein, 20 aa, Mycobacterium
NGWHQVTAELSFERSGPERI

SEQ ID NO: 1322271 - protein, 18 aa, Mycobacterium
NGWPLANTVIRHYKLHAR

SEQ ID NO: 1322272 - protein, 34 aa, Mycobacterium
NHARDEIIFVERSLLSVLWPLADQLPEVRYFVVI

SEQ ID NO: 1322273 - protein, 30 aa, Mycobacterium
NHDWMIDDRPVWLTTPAGPILGLPYTLTLN

SEQ ID NO: 1322274 - protein, 18 aa, Mycobacterium
NHFFRAASRLPFFTAWLR

SEQ ID NO: 1322275 - protein, 20 aa, Mycobacterium
NHFVPNLTLGLPVVESLLKA

SEQ ID NO: 1322276 - protein, 39 aa, Mycobacterium
NHHLLGPTLIASWLNYLPPRLVPPVFRHQARRRDSSMIM

SEQ ID NO: 1322277 - protein, 20 aa, Mycobacterium
NHHVLGYLADRFGFQVIGAI

SEQ ID NO: 1322278 - protein, 28 aa, Mycobacterium
NHIAGVDTFFIATTPRYSFVSSSLAKEV

SEQ ID NO: 1322279 - protein, 26 aa, Mycobacterium
NHLNCILRQRIDYARSPDPVSGNAAR

SEQ ID NO: 1322280 - protein, 19 aa, Mycobacterium
NHMHSTPHHLIFGAAKSGK

SEQ ID NO: 1322281 - protein, 22 aa, Mycobacterium
NHNEPTIWLAEGLLPLPDATQD

SEQ ID NO: 1322282 - protein, 25 aa, Mycobacterium
NHQRMLQHMGVPAERLRMLRSFDPR

SEQ ID NO: 1322283 - protein, 24 aa, Mycobacterium
NHTSYFDFTFAGLPAYQQHLGRKV

SEQ ID NO: 1322284 - protein, 18 aa, Mycobacterium
NHVVTPGRRFATAPLALA

SEQ ID NO: 1322285 - protein, 20 aa, Mycobacterium
NHYLAVFDRATGSALDLFRT

SEQ ID NO: 1322286 - protein, 20 aa, Mycobacterium
NHYLAVFDRATGSALNLFRT

SEQ ID NO: 1322287 - protein, 21 aa, Mycobacterium
NIACSRWGMLAPDGKCKTFDA

SEQ ID NO: 1322288 - protein, 38 aa, Mycobacterium
NIAPGFVAVGVWPAIKLPPLVTPLPGLGYTIGDDPVKL

SEQ ID NO: 1322289 - protein, 26 aa, Mycobacterium
NIAVEDLVYLLRDSGIHVDVDLESAI

SEQ ID NO: 1322290 - protein, 23 aa, Mycobacterium
NIEKFLRIMVFDQNMITPELVEE

SEQ ID NO: 1322291 - protein, 17 aa, Mycobacterium
NIFPNVTIPCNAGNALT

SEQ ID NO: 1322292 - protein, 18 aa, Mycobacterium
NIGEFPRVLKTAASLREP

SEQ ID NO: 1322293 - protein, 33 aa, Mycobacterium
NIGFSFCYEAQRQVPAILDLLATGAISLGELIT

SEQ ID NO: 1322294 - protein, 24 aa, Mycobacterium
NIGQILETHLGWVAKAGWNIDVAA

SEQ ID NO: 1322295 - protein, 25 aa, Mycobacterium
NIGQILETHLGWVAKAGWNINVAGA

SEQ ID NO: 1322296 - protein, 19 aa, Mycobacterium
NILFGLMLSSRDHHGDDPN

SEQ ID NO: 1322297 - protein, 26 aa, Mycobacterium
NIPGLISDVLPLFLSGYTGNIRRIRA

SEQ ID NO: 1322298 - protein, 33 aa, Mycobacterium
NISTDLLYKLLRSEWLEPRWMIGIDPQSEGLAR

SEQ ID NO: 1322299 - protein, 25 aa, Mycobacterium
NISYKAQLLLVDSPLQVTMWTKRVR

SEQ ID NO: 1322300 - protein, 18 aa, Mycobacterium
NITGSRYRRDFTPIDAEC

SEQ ID NO: 1322301 - protein, 19 aa, Mycobacterium
NIVLQTCFFAISEVLPRDR

SEQ ID NO: 1322302 - protein, 17 aa, Mycobacterium
NIYLPLANLTAFQVALL

SEQ ID NO: 1322303 - protein, 22 aa, Mycobacterium
NKDQWFKNVWNFNTALGSAVRS

SEQ ID NO: 1322304 - protein, 21 aa, Mycobacterium
NKGGRHLGFARVLVHEMPHTL

SEQ ID NO: 1322305 - protein, 33 aa, Mycobacterium
NKGHGLNLMRRLGLPVPPAFCLTTDVCAQFLAG

SEQ ID NO: 1322306 - protein, 25 aa, Mycobacterium
NKHQKYPLGYVRWTEHENLREVARL

SEQ ID NO: 1322307 - protein, 26 aa, Mycobacterium
NKHVLNPVMLLLAGRRHWYAAALRHT

SEQ ID NO: 1322308 - protein, 25 aa, Mycobacterium
NKKFAYRHSGYPGGLRKRSIGELLQ

SEQ ID NO: 1322309 - protein, 24 aa, Mycobacterium
NKTLQTSLFFLGNSAYLPSGFAPS

SEQ ID NO: 1322310 - protein, 23 aa, Mycobacterium
NKVSAMRVLQAKLLERKRLEERA

SEQ ID NO: 1322311 - protein, 24 aa, Mycobacterium
NKYRLVFEKLRLKPGDRLLDVGCG

SEQ ID NO: 1322312 - protein, 22 aa, Mycobacterium
NKYRLVFEKLRLQPGDRLLDVG

SEQ ID NO: 1322313 - protein, 20 aa, Mycobacterium
NLAAMVQRLLGLQLTKGHGA

SEQ ID NO: 1322314 - protein, 32 aa, Mycobacterium
NLAKLTDPRWRLLFPLLMETGLRLNDALHLPQ

SEQ ID NO: 1322315 - protein, 17 aa, Mycobacterium
NLAPARLTGVLAVVCAP

SEQ ID NO: 1322316 - protein, 23 aa, Mycobacterium
NLAPLTDAGLTPYRGLKKLRNAG

SEQ ID NO: 1322317 - protein, 20 aa, Mycobacterium
NLARRFLTLYPLDAGVAVTG

SEQ ID NO: 1322318 - protein, 25 aa, Mycobacterium
NLDGDLPQRYAFNASWLAHRKIYSK

SEQ ID NO: 1322319 - protein, 20 aa, Mycobacterium
NLDPTLPRYTASKAYLCEKA

SEQ ID NO: 1322320 - protein, 21 aa, Mycobacterium
NLDRPGGVMFPLSPVAPAPRG

SEQ ID NO: 1322321 - protein, 31 aa, Mycobacterium
NLDWADVTVASVYKWLLAPRGTAFLSVSERT

SEQ ID NO: 1322322 - protein, 28 aa, Mycobacterium
NLEVMMILSVLNYKYFRQLNVGASYLSQ

SEQ ID NO: 1322323 - protein, 24 aa, Mycobacterium
NLFATMKPYAPPPPPGASPAPLWG

SEQ ID NO: 1322324 - protein, 18 aa, Mycobacterium
NLFELLERDRLFGAQPYG

SEQ ID NO: 1322325 - protein, 21 aa, Mycobacterium
NLGLIRAMEKFDYTKGFKFST

SEQ ID NO: 1322326 - protein, 18 aa, Mycobacterium
NLGLIRAVEKFDYTKGYK

SEQ ID NO: 1322327 - protein, 21 aa, Mycobacterium
NLGLIRAVEKFDYTKGYKFST

SEQ ID NO: 1322328 - protein, 22 aa, Mycobacterium
NLGPSFTLDDWRAMGLVDDGGQ

SEQ ID NO: 1322329 - protein, 26 aa, Mycobacterium
NLGRLARLLRLLGFDVWFSVDADDET

SEQ ID NO: 1322330 - protein, 20 aa, Mycobacterium
NLGVLALARNASAPRFQAGD

SEQ ID NO: 1322331 - protein, 28 aa, Mycobacterium
NLHPLGAPPYFAFQIILGDLGTSGGLRT

SEQ ID NO: 1322332 - protein, 21 aa, Mycobacterium
NLIGVWNTVEAALPALIDGGR

SEQ ID NO: 1322333 - protein, 18 aa, Mycobacterium
NLIPDDKWRSIKAPVMIV

SEQ ID NO: 1322334 - protein, 32 aa, Mycobacterium
NLKDATILLHAIDKLDAIGEWKKQRRAELRAQ

SEQ ID NO: 1322335 - protein, 30 aa, Mycobacterium
NLKIWNRLQHLPLGKWMFSRAVCLKAPYFR

SEQ ID NO: 1322336 - protein, 31 aa, Mycobacterium
NLLFVNAGMVQFVPYFLGQRTPPWDRAASVQ

SEQ ID NO: 1322337 - protein, 38 aa, Mycobacterium
NLLGGTTTRYLVPAQRLPLVLLNPSLAPREAELKATVD

SEQ ID NO: 1322338 - protein, 21 aa, Mycobacterium
NLLHDHLVDVLLDAAAMGRVH

SEQ ID NO: 1322339 - protein, 30 aa, Mycobacterium
NLLSAVPALRMPVVFFVGCRDHWVPPATTV

SEQ ID NO: 1322340 - protein, 23 aa, Mycobacterium
NLPGLLTPRFTRPYSSSLITLLI

SEQ ID NO: 1322341 - protein, 19 aa, Mycobacterium
NLPSERLSIAIAAVAGARE

SEQ ID NO: 1322342 - protein, 30 aa, Mycobacterium; identical to SEQ ID NO: 841052

SEQ ID NO: 1322343 - protein, 17 aa, Mycobacterium
NLQPIGAFKVRGAFNAI

SEQ ID NO: 1322344 - protein, 22 aa, Mycobacterium
NLQPWHIYVVTGAPLAQMKKLA

SEQ ID NO: 1322345 - protein, 25 aa, Mycobacterium
NLRDHHMQWDFWTLSPESAHQVTWL

SEQ ID NO: 1322346 - protein, 20 aa, Mycobacterium
NLRGLDVDLPLGVFAAVTGV

SEQ ID NO: 1322347 - protein, 17 aa, Mycobacterium
NLRGPVFLVQHALPHLK

SEQ ID NO: 1322348 - protein, 25 aa, Mycobacterium
NLRLNQWVIGLRRPGQRQRLREDQR

SEQ ID NO: 1322349 - protein, 22 aa, Mycobacterium
NLSAPQMTVLIGGLRALGITHG

SEQ ID NO: 1322350 - protein, 33 aa, Mycobacterium
NLSPIGIVHLFRQYFFEFDTFLGPPVGHVWLSP

SEQ ID NO: 1322351 - protein, 22 aa, Mycobacterium
NLTFKLHPPVLKALGRKKKISM

SEQ ID NO: 1322352 - protein, 20 aa, Mycobacterium
NLTFPLLSDPDRKVLEAWGA

SEQ ID NO: 1322353 - protein, 24 aa, Mycobacterium
NLTKFIANLAAAPLLGQLSAIKQA

SEQ ID NO: 1322354 - protein, 21 aa, Mycobacterium
NLTNWTVCWQSPKAGSTFTAK

SEQ ID NO: 1322355 - protein, 23 aa, Mycobacterium
NLTQFYHPLDMVGDWNRAYGSVG

SEQ ID NO: 1322356 - protein, 20 aa, Mycobacterium
NLVCPALFDLGEHGKVVIIS

SEQ ID NO: 1322357 - protein, 29 aa, Mycobacterium
NLVDMVLPREGFAAGWRTIARSLAGRPAG

SEQ ID NO: 1322358 - protein, 27 aa, Mycobacterium
NLVGMGRALIAPLRIGLREAGVPVRLN

SEQ ID NO: 1322359 - protein, 17 aa, Mycobacterium
NLVLEYARTRGLPAVAM

SEQ ID NO: 1322360 - protein, 22 aa, Mycobacterium
NLVPTFGVFKPTLVVSVPRVFE

SEQ ID NO: 1322361 - protein, 21 aa, Mycobacterium
NLVSRQECLALIAAGVDDWGG

SEQ ID NO: 1322362 - protein, 17 aa, Mycobacterium
NLVVWNQRDFALAEELM

SEQ ID NO: 1322363 - protein, 17 aa, Mycobacterium
NLWGAFGLLAEMKAQGR

SEQ ID NO: 1322364 - protein, 29 aa, Mycobacterium
NMDAPQHTRLRKIISRGFTPRAVGRLEDE

SEQ ID NO: 1322365 - protein, 34 aa, Mycobacterium
NMDEARWDSVLAVNLLAPLRLAEGLVASGLIGDG

SEQ ID NO: 1322366 - protein, 24 aa, Mycobacterium
NMGEAWWVPIVQIPGDTFEGQPRS

SEQ ID NO: 1322367 - protein, 23 aa, Mycobacterium
NMGMLFRKHLVMFGPREVLLTSD

SEQ ID NO: 1322368 - protein, 26 aa, Mycobacterium
NMGTVPPLPGFNAELRRITAAHGALL

SEQ ID NO: 1322369 - protein, 21 aa, Mycobacterium
NMKPSAIRRLGLTYDSLREFN

SEQ ID NO: 1322370 - protein, 29 aa, Mycobacterium
NMRRRRQFHSLGRRLLRFTDEVFGRPVAD

SEQ ID NO: 1322371 - protein, 17 aa, Mycobacterium
NNAFRVPSMKPFANTTF

SEQ ID NO: 1322372 - protein, 17 aa, Mycobacterium
NNAGVFPAAPTLDQDLA

SEQ ID NO: 1322373 - protein, 29 aa, Mycobacterium
NNAIALPRVWAFNMPVAYKRFADIAQAMG

SEQ ID NO: 1322374 - protein, 26 aa, Mycobacterium
NNANYAWIQHILYKLASGGKAGVVMA

SEQ ID NO: 1322375 - protein, 37 aa, Mycobacterium
NNDFAGLLPIDGQPGRFLLVTNFEYATPQFMFPGYDA

SEQ ID NO: 1322376 - protein, 30 aa, Mycobacterium
NNMVSALTGPALRWNPWSTPIPKAYLCSSA

SEQ ID NO: 1322377 - protein, 19 aa, Mycobacterium
NNQAALPPPGPRQLAAILQ

SEQ ID NO: 1322378 - protein, 25 aa, Mycobacterium
NNVLPYVLYETLGPALPEGLAGAAA

SEQ ID NO: 1322379 - protein, 27 aa, Mycobacterium
NNVLTNAGSLWWRTVQTVAAEYPDVEV

SEQ ID NO: 1322380 - protein, 20 aa, Mycobacterium
NNVRQLCVPTLRALADELGT

SEQ ID NO: 1322381 - protein, 19 aa, Mycobacterium
NNWPTMGALFPVVYSPKNP

SEQ ID NO: 1322382 - protein, 19 aa, Mycobacterium
NPALWTYVGMPTAARVVWR

SEQ ID NO: 1322383 - protein, 18 aa, Mycobacterium
NPAPMLLASRRVIGDDGL

SEQ ID NO: 1322384 - protein, 25 aa, Mycobacterium
NPAQRAAWLVAQLDSLPGSGIVYTL

SEQ ID NO: 1322385 - protein, 25 aa, Mycobacterium
NPAVSAWNWLESVPGGWRRALARQQ

SEQ ID NO: 1322386 - protein, 20 aa, Mycobacterium
NPAVTARRRLRMICHGLGHI

SEQ ID NO: 1322387 - protein, 23 aa, Mycobacterium
NPDLKMLGALPTLYDSRTTHSRD

SEQ ID NO: 1322388 - protein, 22 aa, Mycobacterium
NPDLLLPHIDPDARDFMLSCGT

SEQ ID NO: 1322389 - protein, 24 aa, Mycobacterium
NPDPDDLFMLIFTSGTSGEPKAVR

SEQ ID NO: 1322390 - protein, 23 aa, Mycobacterium
NPDRFRFLATYIAGRSVEVTEAA

SEQ ID NO: 1322391 - protein, 26 aa, Mycobacterium
NPEENLYTLDYYLKLAEQIVDAGAHV

SEQ ID NO: 1322392 - protein, 27 aa, Mycobacterium
NPEILPAHLILGMFADPTGLAARLVAG

SEQ ID NO: 1322393 - protein, 20 aa, Mycobacterium
NPELMRRVIMLRKWGQEVIK

SEQ ID NO: 1322394 - protein, 25 aa, Mycobacterium
NPENVYFYMTIYNEPYVQPAEPDGL

SEQ ID NO: 1322395 - protein, 27 aa, Mycobacterium
NPEQVATAWLALGPSIVVVTFGAEGSV

SEQ ID NO: 1322396 - protein, 23 aa, Mycobacterium
NPESPVLVLSHYVEERYAADLIA

SEQ ID NO: 1322397 - protein, 27 aa, Mycobacterium
NPESRFLREIPQELIDWRRTDPTPSFS

SEQ ID NO: 1322398 - protein, 23 aa, Mycobacterium
NPESRFLREIPQELIDWRRTEQP

SEQ ID NO: 1322399 - protein, 21 aa, Mycobacterium
NPFFDPVVAVLGPPPATGFSP

SEQ ID NO: 1322400 - protein, 25 aa, Mycobacterium
NPFLQLRGAIAAVFRSWHSARAGAY

SEQ ID NO: 1322401 - protein, 25 aa, Mycobacterium
NPHHDIPQLLSMYKAGRLNLDDMVT

SEQ ID NO: 1322402 - protein, 21 aa, Mycobacterium
NPIAWLYEQRRWVVPGNRIAN

SEQ ID NO: 1322403 - protein, 25 aa, Mycobacterium
NPITDSIFILGYQLGCQSDVSAGLQ

SEQ ID NO: 1322404 - protein, 18 aa, Mycobacterium
NPLALLQVPRNVSAAELA

SEQ ID NO: 1322405 - protein, 20 aa, Mycobacterium
NPLKAPPFTFPAHLHELING

SEQ ID NO: 1322406 - protein, 20 aa, Mycobacterium
NPMEPHACIAIWTADGVTMY

SEQ ID NO: 1322407 - protein, 23 aa, Mycobacterium
NPNALVLWEAQFGDFVNGAQSII

SEQ ID NO: 1322408 - protein, 19 aa, Mycobacterium
NPNARIILTTFNATLAQGL

SEQ ID NO: 1322409 - protein, 25 aa, Mycobacterium
NPPNPFAWIPFGGGMMRCIGASFAT

SEQ ID NO: 1322410 - protein, 27 aa, Mycobacterium
NPRARAKFLALSNAGGFLLYRHRHPTP

SEQ ID NO: 1322411 - protein, 21 aa, Mycobacterium
NPRRPFARRAALKLPALLTAS

SEQ ID NO: 1322412 - protein, 28 aa, Mycobacterium
NPSGILSKMFDVRHIAALFSPDGYTFPE

SEQ ID NO: 1322413 - protein, 22 aa, Mycobacterium
NPSPHIPWDSLPVRVVDKAIPW

SEQ ID NO: 1322414 - protein, 24 aa, Mycobacterium
NPSTAVLRRLGFTRVAEIEDSDDG

SEQ ID NO: 1322415 - protein, 19 aa, Mycobacterium
NPVALMQVGLTTAAAGLHD

SEQ ID NO: 1322416 - protein, 19 aa, Mycobacterium
NPVLEPLVAVHREIYPKAD

SEQ ID NO: 1322417 - protein, 17 aa, Mycobacterium
NPVLLKPGSDRRSHVVL

SEQ ID NO: 1322418 - protein, 28 aa, Mycobacterium
NPVREAIHAVFLFHAIKAGLDMGIVNAG

SEQ ID NO: 1322419 - protein, 20 aa, Mycobacterium
NPVRLAEAIRRFGPIFAQYY

SEQ ID NO: 1322420 - protein, 27 aa, Mycobacterium
NPVSTVYFKVLLALMTRNAVVVAPHPR

SEQ ID NO: 1322421 - protein, 17 aa, Mycobacterium
NPWALTGHASFWDSMRF

SEQ ID NO: 1322422 - protein, 19 aa, Mycobacterium
NPYLATAAVLGLALDGVER

SEQ ID NO: 1322423 - protein, 17 aa, Mycobacterium
NPYLLRAAKFHGKPSTV

SEQ ID NO: 1322424 - protein, 25 aa, Mycobacterium
NQAPDYPMFLTLGVFDFPDRPGPAE

SEQ ID NO: 1322425 - protein, 20 aa, Mycobacterium
NQAVPSEPIRSMRPTATAIP

SEQ ID NO: 1322426 - protein, 26 aa, Mycobacterium
NQFKYIANEFPLTVLLIGIGLHERNA

SEQ ID NO: 1322427 - protein, 17 aa, Mycobacterium
NQGLALYLDFIEAATTE

SEQ ID NO: 1322428 - protein, 24 aa, Mycobacterium
NQLPAMFADVRRGLTVAAVVHGAT

SEQ ID NO: 1322429 - protein, 18 aa, Mycobacterium
NQLVDRFFEARKMMSQMA

SEQ ID NO: 1322430 - protein, 18 aa, Mycobacterium
NQNRLRQNLRPQYDFIVC

SEQ ID NO: 1322431 - protein, 31 aa, Mycobacterium
NQPAITLWNLARFAETLLPLIHENSGAAIAL

SEQ ID NO: 1322432 - protein, 23 aa, Mycobacterium
NQQRTVLEGRLEQLRTFEREYRT

SEQ ID NO: 1322433 - protein, 23 aa, Mycobacterium
NQRADATLFPRANSWYMGANVPG

SEQ ID NO: 1322434 - protein, 22 aa, Mycobacterium
NQRLQNWWRIDKLERRSNERGE

SEQ ID NO: 1322435 - protein, 23 aa, Mycobacterium
NRADLLQAAGKYPPPKGASDIMG

SEQ ID NO: 1322436 - protein, 24 aa, Mycobacterium
NRADLLQAAGKYPPPPGASDILGL

SEQ ID NO: 1322437 - protein, 19 aa, Mycobacterium
NRAGSARAWWVLTAAGIGG

SEQ ID NO: 1322438 - protein, 18 aa, Mycobacterium
NRALLLDAARRLVDERGA

SEQ ID NO: 1322439 - protein, 18 aa, Mycobacterium
NRASTILADLRKLEALAA

SEQ ID NO: 1322440 - protein, 19 aa, Mycobacterium
NRDGIPEKAFLAVRTPEGA

SEQ ID NO: 1322441 - protein, 26 aa, Mycobacterium
NRDKRSLVFPVKRLADLGFRVLATEG

SEQ ID NO: 1322442 - protein, 23 aa, Mycobacterium
NRDRARWMGHLIDLLADTGDYTR

SEQ ID NO: 1322443 - protein, 23 aa, Mycobacterium
NRGAIQALWASRLGSMFYDNAQT

SEQ ID NO: 1322444 - protein, 19 aa, Mycobacterium
NRGHCAAIHLNMPIAYPPA

SEQ ID NO: 1322445 - protein, 24 aa, Mycobacterium
NRGSQFYLAMYWAQELAEQTDDKA

SEQ ID NO: 1322446 - protein, 20 aa, Mycobacterium
NRIEIVIAMLGIVKAGAILV

SEQ ID NO: 1322447 - protein, 17 aa, Mycobacterium
NRLARYRDLGFTRVVVG

SEQ ID NO: 1322448 - protein, 22 aa, Mycobacterium
NRLSWQTPFTEVLDWSDAPFAK

SEQ ID NO: 1322449 - protein, 20 aa, Mycobacterium
NRLTRRNLKCASSLMAVSRS

SEQ ID NO: 1322450 - protein, 25 aa, Mycobacterium
NRLVVAALHWDGKISGLLASHLKAT

SEQ ID NO: 1322451 - protein, 20 aa, Mycobacterium
NRMESVAALIAIFRGGRTLV

SEQ ID NO: 1322452 - protein, 19 aa, Mycobacterium
NRMISWPYTKLMNSNNMVD

SEQ ID NO: 1322453 - protein, 30 aa, Mycobacterium
NRPAGLRDLLWEPTDLYPAEVLTGALSAPG

SEQ ID NO: 1322454 - protein, 20 aa, Mycobacterium
NRPELIDLLASAESLLAATG

SEQ ID NO: 1322455 - protein, 20 aa, Mycobacterium
NRPGARTLPLYGVPFGVKDS

SEQ ID NO: 1322456 - protein, 18 aa, Mycobacterium
NRPGIPVVAALPSVHIAP

SEQ ID NO: 1322457 - protein, 23 aa, Mycobacterium
NRPRRAFRRITGSALEALLPEVD

SEQ ID NO: 1322458 - protein, 31 aa, Mycobacterium
NRPSVPDPLYEPLFARLLTRPNVVPVVEAAA

SEQ ID NO: 1322459 - protein, 18 aa, Mycobacterium
NRQKLAAPLVKARAKVEL

SEQ ID NO: 1322460 - protein, 21 aa, Mycobacterium
NRQRPRIVTAMQKLGDFSDTA

SEQ ID NO: 1322461 - protein, 22 aa, Mycobacterium
NRQVERWLADKTGQPMWSQWYP

SEQ ID NO: 1322462 - protein, 21 aa, Mycobacterium
NRRAPKGVLLPTLRAPKIAVD

SEQ ID NO: 1322463 - protein, 24 aa, Mycobacterium
NRRRAKVHGFRLRMRTRAGRAIVT

SEQ ID NO: 1322464 - protein, 36 aa, Mycobacterium
NRRTAHQLASLDVPVPFWFRAPGECPGTYAAEVAMD

SEQ ID NO: 1322465 - protein, 23 aa, Mycobacterium
NRRWLEHRRILALNLTSSPGSGK

SEQ ID NO: 1322466 - protein, 26 aa, Mycobacterium
NRSKLSEMPVLWAYARDLFQTPGFGD

SEQ ID NO: 1322467 - protein, 24 aa, Mycobacterium
NRSMRTIRWILYDAGRLVHPREYP

SEQ ID NO: 1322468 - protein, 25 aa, Mycobacterium
NRSMRTIRWILYDAGRLVHPREYPE

SEQ ID NO: 1322469 - protein, 24 aa, Mycobacterium
NRSVKAQWERRLAPWRLRHPELEV

SEQ ID NO: 1322470 - protein, 23 aa, Mycobacterium
NRTAFDRWGLIPRMLVGATERDL

SEQ ID NO: 1322471 - protein, 35 aa, Mycobacterium; identical to SEQ ID NO: 841625

SEQ ID NO: 1322472 - protein, 25 aa, Mycobacterium
NRTRRLFHAVTTTGLRTPIWLITRG

SEQ ID NO: 1322473 - protein, 21 aa, Mycobacterium
NRWLDQFVHLLGHTGHYTRED

SEQ ID NO: 1322474 - protein, 21 aa, Mycobacterium
NRYAGQPLYRQLSDVLETRLA

SEQ ID NO: 1322475 - protein, 21 aa, Mycobacterium
NRYAPPPPYPSPDPFEPFAVA

SEQ ID NO: 1322476 - protein, 23 aa, Mycobacterium
NRYWGTPIPVWKSDDPAYPRIDV

SEQ ID NO: 1322477 - protein, 18 aa, Mycobacterium
NRYWVVPGADHYVQCDAP

SEQ ID NO: 1322478 - protein, 28 aa, Mycobacterium
NSAAMKAFFVYDEPFWRADGLNGQLISD

SEQ ID NO: 1322479 - protein, 22 aa, Mycobacterium
NSATWVNYLAAPDKLRIANLYD

SEQ ID NO: 1322480 - protein, 25 aa, Mycobacterium
NSAVFLPILRVLFNSWFRVEVSGTE

SEQ ID NO: 1322481 - protein, 23 aa, Mycobacterium
NSDCGFFIRYCLDVGLDKYGQGV

SEQ ID NO: 1322482 - protein, 20 aa, Mycobacterium
NSDPPPLWASALRGVDAVVH

SEQ ID NO: 1322483 - protein, 21 aa, Mycobacterium
NSFFTALVRLSYEIGHQDAAP

SEQ ID NO: 1322484 - protein, 17 aa, Mycobacterium
NSGIFVMHMLSAGPDEI

SEQ ID NO: 1322485 - protein, 23 aa, Mycobacterium
NSGRINHAYLFSGPRGCGKTSSA

SEQ ID NO: 1322486 - protein, 25 aa, Mycobacterium
NSHTHNLITFWPLTGQGPAGGLHAY

SEQ ID NO: 1322487 - protein, 17 aa, Mycobacterium
NSLYATVNCWGRLVTGV

SEQ ID NO: 1322488 - protein, 26 aa, Mycobacterium
NSMAGPFHFLDPKLGYANDPAWIVFD

SEQ ID NO: 1322489 - protein, 19 aa, Mycobacterium
NSQPWRWVVVDHRLDLYVD

SEQ ID NO: 1322490 - protein, 17 aa, Mycobacterium
NSRVLVHPGTDHEKRGV

SEQ ID NO: 1322491 - protein, 23 aa, Mycobacterium
NSRYLGEDVVLSESLRATTDFAE

SEQ ID NO: 1322492 - protein, 29 aa, Mycobacterium
NSSRTFIPRAFWQTYPQHRDRLLPSYEAE

SEQ ID NO: 1322493 - protein, 17 aa, Mycobacterium
NSTAYVEGLLGAFRSRV

SEQ ID NO: 1322494 - protein, 17 aa, Mycobacterium
NSYLRGPSVLVAHGDLA

SEQ ID NO: 1322495 - protein, 24 aa, Mycobacterium
NTAHPLLAPSYPAIKGQNLRGFGW

SEQ ID NO: 1322496 - protein, 17 aa, Mycobacterium
NTASEATYFWKSDPQLP

SEQ ID NO: 1322497 - protein, 24 aa, Mycobacterium
NTDLRVRCIRQLQQAMRDHVEELR

SEQ ID NO: 1322498 - protein, 17 aa, Mycobacterium
NTELLARLAATVQYVPM

SEQ ID NO: 1322499 - protein, 25 aa, Mycobacterium
NTFAAGICFLPQDLAARESARGTVE

SEQ ID NO: 1322500 - protein, 19 aa, Mycobacterium
NTFLLTGHPIAIGQRETMG

SEQ ID NO: 1322501 - protein, 25 aa, Mycobacterium
NTHIDDLPRFPFTPADPLIVARTNP

SEQ ID NO: 1322502 - protein, 21 aa, Mycobacterium
NTKARLRFEITMEQALNAPTV

SEQ ID NO: 1322503 - protein, 23 aa, Mycobacterium
NTLYVPPEPFFNDPQWKDITDWR

SEQ ID NO: 1322504 - protein, 32 aa, Mycobacterium
NTMVLKPAIETPWSVLRWGRIIAEKTDIPPGV

SEQ ID NO: 1322505 - protein, 17 aa, Mycobacterium
NTPFNATRLGRLIAEKT

SEQ ID NO: 1322506 - protein, 25 aa, Mycobacterium
NTPMGGGDMIAALFSAIETNPTLNN

SEQ ID NO: 1322507 - protein, 47 aa, Mycobacterium
NTPVVWRGPMLHRALQQFLADVYWGDLDVLLLDLPPGTGDIAISVAQ

SEQ ID NO: 1322508 - protein, 18 aa, Mycobacterium
NTQLLLLEESHLGRVLDP

SEQ ID NO: 1322509 - protein, 20 aa, Mycobacterium
NTRFGVPRDVALAYLSAAGD

SEQ ID NO: 1322510 - protein, 28 aa, Mycobacterium
NTSTTWPKLKDVPYLGISVLGEAHDAAA

SEQ ID NO: 1322511 - protein, 17 aa, Mycobacterium
NTTFLVEPGWRLEPTAQ

SEQ ID NO: 1322512 - protein, 21 aa, Mycobacterium
NTTGYPYVIAARKVVLEQTTL

SEQ ID NO: 1322513 - protein, 17 aa, Mycobacterium
NTTYYVFGVTDWGRLVF

SEQ ID NO: 1322514 - protein, 25 aa, Mycobacterium
NTVAMRLRPHPAMTFRDLLTQTRDT

SEQ ID NO: 1322515 - protein, 26 aa, Mycobacterium
NTVGFDCSGLMLYAFAGVGIKLDHYS

SEQ ID NO: 1322516 - protein, 24 aa, Mycobacterium
NTVTKFFDNVLKPMLGGGAGAAGP

SEQ ID NO: 1322517 - protein, 21 aa, Mycobacterium
NVALSRWGMLAPDGQCKTFDA

SEQ ID NO: 1322518 - protein, 17 aa, Mycobacterium
NVALVYDTVLHRAAVLL

SEQ ID NO: 1322519 - protein, 19 aa, Mycobacterium
NVDALATGGRLAIIGMQGG

SEQ ID NO: 1322520 - protein, 23 aa, Mycobacterium
NVDDLDEAITFYTKLFGVEPAKV

SEQ ID NO: 1322521 - protein, 25 aa, Mycobacterium
NVDLTFSVTALPRPGETVLASALSS

SEQ ID NO: 1322522 - protein, 17 aa, Mycobacterium
NVDNAWFWRDGDRLSCG

SEQ ID NO: 1322523 - protein, 28 aa, Mycobacterium
NVDPKRRVRFLPYGIAVSVLDAAAGGGE

SEQ ID NO: 1322524 - protein, 19 aa, Mycobacterium
NVERLKLVGKLPAALGVEI

SEQ ID NO: 1322525 - protein, 17 aa, Mycobacterium
NVFDPVVIRWRLEVGDR

SEQ ID NO: 1322526 - protein, 20 aa, Mycobacterium
NVFINYPREFGIMTGLGSHT

SEQ ID NO: 1322527 - protein, 20 aa, Mycobacterium
NVGAPLAPYLYTVSTMHCMS

SEQ ID NO: 1322528 - protein, 17 aa, Mycobacterium
NVGKWMKRRYRLLEMSQ

SEQ ID NO: 1322529 - protein, 24 aa, Mycobacterium
NVGNLVCPALFDLGERSKVVIISV

SEQ ID NO: 1322530 - protein, 26 aa, Mycobacterium
NVGPTPLVLQVLYINPAGAPLADDAP

SEQ ID NO: 1322531 - protein, 24 aa, Mycobacterium
NVHDRGVVAFAERARLLGLPVGVL

SEQ ID NO: 1322532 - protein, 18 aa, Mycobacterium
NVIAWASSGHVGFKGSRK

SEQ ID NO: 1322533 - protein, 29 aa, Mycobacterium
NVIGLPPTVTVFGTPIFKLGGAPVKVVSS

SEQ ID NO: 1322534 - protein, 29 aa, Mycobacterium
NVIGLPPTVTVFGTPIFKLGGSPVKVVSS

SEQ ID NO: 1322535 - protein, 26 aa, Mycobacterium
NVIHPRFGNFILLGTVLVASEISSYG

SEQ ID NO: 1322536 - protein, 18 aa, Mycobacterium
NVIVPAAVTRMAAGIDTS

SEQ ID NO: 1322537 - protein, 17 aa, Mycobacterium
NVKLRLLADQLLADYTT

SEQ ID NO: 1322538 - protein, 20 aa, Mycobacterium
NVLEWRCDPTSDARLRHAVD

SEQ ID NO: 1322539 - protein, 30 aa, Mycobacterium
NVLGTAELLRIALTTRMKPFVYVSTIGVGA

SEQ ID NO: 1322540 - protein, 17 aa, Mycobacterium
NVLLIGPPVIVGSVARW

SEQ ID NO: 1322541 - protein, 17 aa, Mycobacterium
NVLPQWAKLATKPKTMF

SEQ ID NO: 1322542 - protein, 23 aa, Mycobacterium
NVLVPGYRYHFALDAQAAGAELM

SEQ ID NO: 1322543 - protein, 26 aa, Mycobacterium
NVMAVWVIMRAIDALNLLPLPNRLDL

SEQ ID NO: 1322544 - protein, 25 aa, Mycobacterium
NVMPVHGTWRMMRANAALAASTGVP

SEQ ID NO: 1322545 - protein, 24 aa, Mycobacterium
NVNTPLFMNEGTMKLFRPDLENPG

SEQ ID NO: 1322546 - protein, 30 aa, Mycobacterium; identical to SEQ ID NO: 842006

SEQ ID NO: 1322547 - protein, 25 aa, Mycobacterium
NVPEARMVVIKPYEASQLRPIEDAI

SEQ ID NO: 1322548 - protein, 28 aa, Mycobacterium
NVPGKPRVFMLFIGGFGVYLDICAEVAD

SEQ ID NO: 1322549 - protein, 27 aa, Mycobacterium
NVPGKPRVFMLFIGGFGVYLDICMEVA

SEQ ID NO: 1322550 - protein, 17 aa, Mycobacterium
NVPPRRLPGRAALDLED

SEQ ID NO: 1322551 - protein, 18 aa, Mycobacterium
NVPYRRFRDSGPIERIPL

SEQ ID NO: 1322552 - protein, 22 aa, Mycobacterium
NVPYYIQHLVAAARKSWQDTQV

SEQ ID NO: 1322553 - protein, 19 aa, Mycobacterium
NVQTVVILGALLADTPHTR

SEQ ID NO: 1322554 - protein, 22 aa, Mycobacterium
NVQWQKWSLRVGFNPREGLVLH

SEQ ID NO: 1322555 - protein, 23 aa, Mycobacterium
NVSDQWVVFIDPAGMSAERAAEL

SEQ ID NO: 1322556 - protein, 20 aa, Mycobacterium
NVSGFVRTGLFKRLSSSGHS

SEQ ID NO: 1322557 - protein, 30 aa, Mycobacterium
NVSLDKARRLLWPLKKKYGKKLSWSDLIVY

SEQ ID NO: 1322558 - protein, 20 aa, Mycobacterium
NVSPYYLRPGGAFGGSCLPK

SEQ ID NO: 1322559 - protein, 19 aa, Mycobacterium
NVSYVEWAVTLGRPGTVIV

SEQ ID NO: 1322560 - protein, 25 aa, Mycobacterium
NVVCPFAESDGIRLWRETAPEAYER

SEQ ID NO: 1322561 - protein, 23 aa, Mycobacterium
NVVDAYRYWTREAIIADIDRRRH

SEQ ID NO: 1322562 - protein, 35 aa, Mycobacterium
NVVICTLCSCFPWPVLGLPPYWYKDPVFRARAARE

SEQ ID NO: 1322563 - protein, 20 aa, Mycobacterium
NVYANELCFVFGLRPGTAVG

SEQ ID NO: 1322564 - protein, 17 aa, Mycobacterium
NVYHRPHRDAIGALCVV

SEQ ID NO: 1322565 - protein, 18 aa, Mycobacterium
NVYRESFESHTMSQILLL

SEQ ID NO: 1322566 - protein, 21 aa, Mycobacterium
NWFDPGKFWSGDTLPLAAGHR

SEQ ID NO: 1322567 - protein, 17 aa, Mycobacterium
NWFNQINTFLWGGITQH

SEQ ID NO: 1322568 - protein, 29 aa, Mycobacterium
NWITRAGMGIQYLLLRSGPMTMPPSTLGA

SEQ ID NO: 1322569 - protein, 23 aa, Mycobacterium
NWLDKPHRIAPRIAARLRGILTG

SEQ ID NO: 1322570 - protein, 22 aa, Mycobacterium
NYARVPLIVLSANRPYELLGTG

SEQ ID NO: 1322571 - protein, 22 aa, Mycobacterium
NYEREFGLLGPRFVDALGQNVF

SEQ ID NO: 1322572 - protein, 21 aa, Mycobacterium
NYFTFYLCDLLLKVNGKGGQP

SEQ ID NO: 1322573 - protein, 24 aa, Mycobacterium
NYHHRPERLLTPPGDPDLPGASAE

SEQ ID NO: 1322574 - protein, 19 aa, Mycobacterium
NYHTPVMILSDGAIANGSE

SEQ ID NO: 1322575 - protein, 18 aa, Mycobacterium
NYLGLFDRIGMQTSLFGP

SEQ ID NO: 1322576 - protein, 19 aa, Mycobacterium
NYMLLVHVESARALEGLLQ

SEQ ID NO: 1322577 - protein, 19 aa, Mycobacterium
NYPLRQYMFCAPDEGAAAV

SEQ ID NO: 1322578 - protein, 34 aa, Mycobacterium; identical to SEQ ID NO: 129774

SEQ ID NO: 1322579 - protein, 17 aa, Mycobacterium
NYREFMGGFTDWAQTIA

SEQ ID NO: 1322580 - protein, 21 aa, Mycobacterium
NYRLHQYLVGGYRGISYVDSD

SEQ ID NO: 1322581 - protein, 18 aa, Mycobacterium
NYRRILPDVYVPAASQLS

SEQ ID NO: 1322582 - protein, 24 aa, Mycobacterium
NYRRTHFAGKRRVTSLYFDLATSH

SEQ ID NO: 1322583 - protein, 21 aa, Mycobacterium
NYTAIHPNIYLPKDAPRTPNA

SEQ ID NO: 1322584 - protein, 19 aa, Mycobacterium
NYYTMQFALARRGGLTPGE

SEQ ID NO: 1322585 - protein, 17 aa, Mycobacterium
PAAAAHPSLPRGALLQV

SEQ ID NO: 1322586 - protein, 22 aa, Mycobacterium
PAAACTVLRRSWAAWQELDAPY

SEQ ID NO: 1322587 - protein, 23 aa, Mycobacterium
PAAACTVLRRSWAAWQELDAPYE

SEQ ID NO: 1322588 - protein, 24 aa, Mycobacterium
PAAAHILAFVFADVWQRPGLSRRD

SEQ ID NO: 1322589 - protein, 28 aa, Mycobacterium
PAAAKPLSPAIRALLGQALGIDGADIDE

SEQ ID NO: 1322590 - protein, 22 aa, Mycobacterium
PAAALAFLRRLHDETRRIDGFP

SEQ ID NO: 1322591 - protein, 36 aa, Mycobacterium
PAAAPALLRKLPVAVRRFWLGRAELASVFAEPLAAE

SEQ ID NO: 1322592 - protein, 20 aa, Mycobacterium
PAADFFIKWMSRGNTLVYKL

SEQ ID NO: 1322593 - protein, 24 aa, Mycobacterium
PAADVASKKLIWCDADDTVARVAT

SEQ ID NO: 1322594 - protein, 24 aa, Mycobacterium
PAAELSMLLLDTAAMADLHMRWMD

SEQ ID NO: 1322595 - protein, 24 aa, Mycobacterium
PAAERCRAWFDGLPKARRPRGVVA

SEQ ID NO: 1322596 - protein, 17 aa, Mycobacterium
PAAFIVPLHDGGWITGG

SEQ ID NO: 1322597 - protein, 18 aa, Mycobacterium
PAAFYRHFDSMEALGLVL

SEQ ID NO: 1322598 - protein, 20 aa, Mycobacterium
PAAHTFSLPELTDWSNADFT

SEQ ID NO: 1322599 - protein, 18 aa, Mycobacterium
PAAHWRLGDACELSLLES

SEQ ID NO: 1322600 - protein, 18 aa, Mycobacterium
PAAKERGLFRPDAVERLL

SEQ ID NO: 1322601 - protein, 21 aa, Mycobacterium
PAALDWLIEQLGLTAEDSLLD

SEQ ID NO: 1322602 - protein, 21 aa, Mycobacterium
PAALLDLRPIAAPYYPADLRP

SEQ ID NO: 1322603 - protein, 24 aa, Mycobacterium
PAAPGRIYRAPWSLVADADPKGGA

SEQ ID NO: 1322604 - protein, 17 aa, Mycobacterium
PAAPPPAPASPSPALSA

SEQ ID NO: 1322605 - protein, 24 aa, Mycobacterium
PAAQRGTRVLYVSPLKALAVDVER

SEQ ID NO: 1322606 - protein, 26 aa, Mycobacterium
PAARRPHLVVLGADRPRWVTTDRYGH

SEQ ID NO: 1322607 - protein, 24 aa, Mycobacterium
PAASLWYHPHPHGATLRHVYRGLA

SEQ ID NO: 1322608 - protein, 26 aa, Mycobacterium
PAATHHWPLLLDKIQQRYLEGPCLTA

SEQ ID NO: 1322609 - protein, 23 aa, Mycobacterium
PAAVAVYNAYLLAGARERTERLQ

SEQ ID NO: 1322610 - protein, 21 aa, Mycobacterium
PAAVFPGMLSKNLQASLYALM

SEQ ID NO: 1322611 - protein, 33 aa, Mycobacterium
PAAVLIMGIAAQLVNWPPEFIRALTDRGLQVIV

SEQ ID NO: 1322612 - protein, 23 aa, Mycobacterium
PAAWTHLVGIKPQRGRISTWPLT

SEQ ID NO: 1322613 - protein, 24 aa, Mycobacterium
PADDRPVEFWPTAAIRAALENDDL

SEQ ID NO: 1322614 - protein, 34 aa, Mycobacterium
PADGPWTVTVPGATWGWSALLERYGTLGRDRVLA

SEQ ID NO: 1322615 - protein, 20 aa, Mycobacterium
PADIAEMRTLLARRDECAAT

SEQ ID NO: 1322616 - protein, 21 aa, Mycobacterium
PADIETLFYHASLLKRLIGET

SEQ ID NO: 1322617 - protein, 22 aa, Mycobacterium
PADILRAWGKLGYPRRAKRLHE

SEQ ID NO: 1322618 - protein, 24 aa, Mycobacterium
PADKTVPTLLFTATNPPGTVSATA

SEQ ID NO: 1322619 - protein, 22 aa, Mycobacterium
PADLGVLSLLGPGLTDPAVLDA

SEQ ID NO: 1322620 - protein, 32 aa, Mycobacterium
PADPNALVFPSRKGGFLPLGEYRWAFDNACAD

SEQ ID NO: 1322621 - protein, 23 aa, Mycobacterium
PADRLTREVLLPAAAAGLDAWGV

SEQ ID NO: 1322622 - protein, 27 aa, Mycobacterium
PADVERPWRLALWRLRHNVVGAGPRLR

SEQ ID NO: 1322623 - protein, 18 aa, Mycobacterium
PADYLGRWVILFSHPADF

SEQ ID NO: 1322624 - protein, 29 aa, Mycobacterium
PAEHADDTLYLYFLCAHPSLTPSSAVALT

SEQ ID NO: 1322625 - protein, 18 aa, Mycobacterium
PAEIPRFVDALLGGADLA

SEQ ID NO: 1322626 - protein, 30 aa, Mycobacterium
PAEKWNAFDPVLIRWRLDVGDRTALLVSLS

SEQ ID NO: 1322627 - protein, 25 aa, Mycobacterium
PAEPAPVLIFVPGGAWVHGSRMLQG

SEQ ID NO: 1322628 - protein, 24 aa, Mycobacterium
PAERLQNPPPGKPMAWWFTLSEHV

SEQ ID NO: 1322629 - protein, 20 aa, Mycobacterium
PAERLRMLRSFDPRSGAHVL

SEQ ID NO: 1322630 - protein, 20 aa, Mycobacterium
PAERSAVLAKLAKLADEATA

SEQ ID NO: 1322631 - protein, 20 aa, Mycobacterium
PAFLLNQMMVWGFTGQVIAA

SEQ ID NO: 1322632 - protein, 25 aa, Mycobacterium
PAFRRTAHCECGWNATPRWLRASAV

SEQ ID NO: 1322633 - protein, 25 aa, Mycobacterium
PAGADGLVLVPYFAGERSPNLPQAA

SEQ ID NO: 1322634 - protein, 29 aa, Mycobacterium
PAGAMFGDYWYANLRTMVRFDHAFESARR

SEQ ID NO: 1322635 - protein, 18 aa, Mycobacterium
PAGAYFPRGIKPVSVWLS

SEQ ID NO: 1322636 - protein, 22 aa, Mycobacterium
PAGCRFHTRCPWASEVCASDEP

SEQ ID NO: 1322637 - protein, 19 aa, Mycobacterium
PAGHPLAHRLLAISDAVDH

SEQ ID NO: 1322638 - protein, 24 aa, Mycobacterium
PAGIAKHYFAPALAALGLGHVRWH

SEQ ID NO: 1322639 - protein, 25 aa, Mycobacterium
PAGLPAAVLAELLRALQGAATAPEL

SEQ ID NO: 1322640 - protein, 31 aa, Mycobacterium
PAGQGRVRLTFPWLSDEYVSDWARTVQLGAG

SEQ ID NO: 1322641 - protein, 23 aa, Mycobacterium
PAGTALWFDCNIMHGSGSNITPY

SEQ ID NO: 1322642 - protein, 27 aa, Mycobacterium
PAGWEDNSLLGYPYLGPGFEFTERDRG

SEQ ID NO: 1322643 - protein, 17 aa, Mycobacterium
PAHALRSPTAFRKLAPS

SEQ ID NO: 1322644 - protein, 24 aa, Mycobacterium
PAHARIAQWLEALIASGDLIPGDK

SEQ ID NO: 1322645 - protein, 20 aa, Mycobacterium
PAHGFLEFAGPTLGGPGGAI

SEQ ID NO: 1322646 - protein, 21 aa, Mycobacterium
PAHLQLVLHKLHDAGATVTQT

SEQ ID NO: 1322647 - protein, 22 aa, Mycobacterium
PAHRLAIPPLLEPTVVDGEKVF

SEQ ID NO: 1322648 - protein, 25 aa, Mycobacterium
PAHVRVWGPHFPLSGLVSAGLPDYS

SEQ ID NO: 1322649 - protein, 18 aa, Mycobacterium
PAIAGLLDIYAHAAGQVG

SEQ ID NO: 1322650 - protein, 24 aa, Mycobacterium
PAIALQIPSAHDPTLAPPGKHAAS

SEQ ID NO: 1322651 - protein, 29 aa, Mycobacterium
PAIFAVEMGLARLWQSWGIEPDVVLGHSV

SEQ ID NO: 1322652 - protein, 17 aa, Mycobacterium
PAIHRYTGVLYDALDVE

SEQ ID NO: 1322653 - protein, 18 aa, Mycobacterium
PAIMLRRCETCPSDIDEQ

SEQ ID NO: 1322654 - protein, 17 aa, Mycobacterium
PAITAHRALTVAEGWPS

SEQ ID NO: 1322655 - protein, 25 aa, Mycobacterium
PAIVAMPAPLPGVNGPSPAAGGFDI

SEQ ID NO: 1322656 - protein, 17 aa, Mycobacterium
PAIVEPYFHLPAELIGG

SEQ ID NO: 1322657 - protein, 20 aa, Mycobacterium
PAKKAPAKKAAKSAPAKATK

SEQ ID NO: 1322658 - protein, 21 aa, Mycobacterium
PAKLIWTEVPERPLQSGDVRI

SEQ ID NO: 1322659 - protein, 25 aa, Mycobacterium
PALADGQARALRRVCAVLTAARRSA

SEQ ID NO: 1322660 - protein, 21 aa, Mycobacterium
PALAEVMPWNQLPGAVRRVTQ

SEQ ID NO: 1322661 - protein, 20 aa, Mycobacterium
PALALHDRWGGRLYWHRGSH

SEQ ID NO: 1322662 - protein, 19 aa, Mycobacterium
PALASWFATTQRPIGAEMA

SEQ ID NO: 1322663 - protein, 23 aa, Mycobacterium
PALIAQAYLFASDGYAVRVRLQG

SEQ ID NO: 1322664 - protein, 24 aa, Mycobacterium
PALIAQVYLFASDGYAVRVRLQGP

SEQ ID NO: 1322665 - protein, 20 aa, Mycobacterium
PALNALFRSVAVSFGPRAIG

SEQ ID NO: 1322666 - protein, 47 aa, Mycobacterium
PALNTTVMPFILRGAALLGIDSVLLPIGPRRELWAKLGGSLKPTHLA

SEQ ID NO: 1322667 - protein, 23 aa, Mycobacterium
PALREELVTALIRSLPKDLRRNF

SEQ ID NO: 1322668 - protein, 24 aa, Mycobacterium
PALRHQLLVYPVTTTDLEIGFDDE

SEQ ID NO: 1322669 - protein, 17 aa, Mycobacterium
PALRRPCGRIHWAGTES

SEQ ID NO: 1322670 - protein, 19 aa, Mycobacterium
PALVDIFARRLIGNPRVRF

SEQ ID NO: 1322671 - protein, 25 aa, Mycobacterium
PALVRVLVDRLIESGWRPNDSVILA

SEQ ID NO: 1322672 - protein, 20 aa, Mycobacterium
PALWAVAAWVRRQTTQAIDG

SEQ ID NO: 1322673 - protein, 33 aa, Mycobacterium
PAMFDKTTPESFRLLFDIHVMGAFNVTQAALPF

SEQ ID NO: 1322674 - protein, 20 aa, Mycobacterium
PAMQWMMISAERTGIGPATD

SEQ ID NO: 1322675 - protein, 24 aa, Mycobacterium
PAMRTGFYGFGFNVGTSSAARVEL

SEQ ID NO: 1322676 - protein, 19 aa, Mycobacterium
PAMVFGYRAGYTAATGKSA

SEQ ID NO: 1322677 - protein, 24 aa, Mycobacterium
PANKRIVFRFLRSPVEVVGDGRAE

SEQ ID NO: 1322678 - protein, 24 aa, Mycobacterium
PANSSLVELTLWSTLPSAVEWRGV

SEQ ID NO: 1322679 - protein, 23 aa, Mycobacterium
PANYVNLLAKTALMQGFNALDEW

SEQ ID NO: 1322680 - protein, 18 aa, Mycobacterium
PAPAMLEWAINELALGAQ

SEQ ID NO: 1322681 - protein, 22 aa, Mycobacterium
PAPDTMAYVTALLPVAQGVAVY

SEQ ID NO: 1322682 - protein, 18 aa, Mycobacterium
PAPEFEAWLARLGMADGD

SEQ ID NO: 1322683 - protein, 26 aa, Mycobacterium
PAPELPPLLPGQVLRLGPAAGTGTPT

SEQ ID NO: 1322684 - protein, 20 aa, Mycobacterium
PAPEPVYEAAPTPAPAAPVT

SEQ ID NO: 1322685 - protein, 25 aa, Mycobacterium
PAPGDPWYSSYTLDPLQAPVTPVPD

SEQ ID NO: 1322686 - protein, 22 aa, Mycobacterium
PAPGTMAYVTALLPVAQGVAVY

SEQ ID NO: 1322687 - protein, 21 aa, Mycobacterium
PAPILRSAVVPYLTVADARAA

SEQ ID NO: 1322688 - protein, 18 aa, Mycobacterium
PAPLDVMAALRASGIAVI

SEQ ID NO: 1322689 - protein, 17 aa, Mycobacterium
PAPLFRTNVDGLRHILD

SEQ ID NO: 1322690 - protein, 24 aa, Mycobacterium
PAPPAPVLAPRRKTRQLMVRDVGV

SEQ ID NO: 1322691 - protein, 24 aa, Mycobacterium
PAPPARVLLVWDAPNLDMGLGSIL

SEQ ID NO: 1322692 - protein, 17 aa, Mycobacterium
PAPPLAPMFTVPEVTAI

SEQ ID NO: 1322693 - protein, 18 aa, Mycobacterium
PAPPPAEPSTLLVEGRAA

SEQ ID NO: 1322694 - protein, 26 aa, Mycobacterium
PAPSRTMPLPLSYAMAALGSLKGRLK

SEQ ID NO: 1322695 - protein, 30 aa, Mycobacterium
PAQIALAWTLSVAPNVLLIPGTSSVTHLEE

SEQ ID NO: 1322696 - protein, 29 aa, Mycobacterium
PAQIALAWTLTVAPNVLLIPGTSSVAHLE

SEQ ID NO: 1322697 - protein, 25 aa, Mycobacterium
PAQRIMLIARDGGCTKPGCAVGAYG

SEQ ID NO: 1322698 - protein, 24 aa, Mycobacterium
PAQRIMLIARDGGCTKPGCPVGAY

SEQ ID NO: 1322699 - protein, 24 aa, Mycobacterium
PAQRIMLIARDGGCTKPGCTIGAY

SEQ ID NO: 1322700 - protein, 24 aa, Mycobacterium
PAQRIMLIARDGGCTKPGCTVGAY

SEQ ID NO: 1322701 - protein, 23 aa, Mycobacterium
PAQRLRALLGKPARTPLADVARA

SEQ ID NO: 1322702 - protein, 31 aa, Mycobacterium
PAQSAMAWSLLGWVRRNFFNQAPVVDYDPDA

SEQ ID NO: 1322703 - protein, 21 aa, Mycobacterium
PAQVVLRWHVQRGDIIFPKSV

SEQ ID NO: 1322704 - protein, 19 aa, Mycobacterium
PARAADVLGFRAVVDPADG

SEQ ID NO: 1322705 - protein, 19 aa, Mycobacterium
PARADDSAPLALPSGVTVH

SEQ ID NO: 1322706 - protein, 26 aa, Mycobacterium
PARARYLLLRLLERSGEQRVAIPALT

SEQ ID NO: 1322707 - protein, 32 aa, Mycobacterium
PARAWEHGRFNAPYLRDALLSAGALCETLETA

SEQ ID NO: 1322708 - protein, 23 aa, Mycobacterium
PARDPRFLAYPGIGEERYGAIFS

SEQ ID NO: 1322709 - protein, 19 aa, Mycobacterium
PARFTPFADVFPTGGRAVE

SEQ ID NO: 1322710 - protein, 20 aa, Mycobacterium
PARFVANALSPAKVVSVTVI

SEQ ID NO: 1322711 - protein, 24 aa, Mycobacterium
PARGHAGPLGWLYSASGDSASLLT

SEQ ID NO: 1322712 - protein, 25 aa, Mycobacterium
PARGRMVPPFEGPRLREWAAVCVPS

SEQ ID NO: 1322713 - protein, 18 aa, Mycobacterium
PARIVGLPDQGRPLEVGE

SEQ ID NO: 1322714 - protein, 23 aa, Mycobacterium
PARQQVEFWLHWGPGGAKQSTKV

SEQ ID NO: 1322715 - protein, 20 aa, Mycobacterium
PARQYLLDRNFDAAAAATFG

SEQ ID NO: 1322716 - protein, 19 aa, Mycobacterium
PARSFWRIDVAPVSRTVLH

SEQ ID NO: 1322717 - protein, 25 aa, Mycobacterium
PARTQTFTPPPWWGALDGGRPVVHV

SEQ ID NO: 1322718 - protein, 32 aa, Mycobacterium
PARVLVEYAQLRAQWGWKLVAAATTAGVSVLR

SEQ ID NO: 1322719 - protein, 22 aa, Mycobacterium
PARVVSVYAPGLYPMDFHAVGE

SEQ ID NO: 1322720 - protein, 24 aa, Mycobacterium
PASAALQMFLGDPGRPATPRRVEP

SEQ ID NO: 1322721 - protein, 23 aa, Mycobacterium
PASELAVAIAFDEASRRGVELVA

SEQ ID NO: 1322722 - protein, 20 aa, Mycobacterium
PASELPLPILPIESDPPETQ

SEQ ID NO: 1322723 - protein, 19 aa, Mycobacterium
PASFIAFDLLALGDTDYTS

SEQ ID NO: 1322724 - protein, 17 aa, Mycobacterium
PASGIFRGLDLPKGLEG

SEQ ID NO: 1322725 - protein, 17 aa, Mycobacterium
PASLVEMRRVRDLQPYI

SEQ ID NO: 1322726 - protein, 25 aa, Mycobacterium
PASPPPVYIPPPVEVPPMPAPAQPD

SEQ ID NO: 1322727 - protein, 25 aa, Mycobacterium
PASVGFPPNHPPMRTFLGVPVRIRD

SEQ ID NO: 1322728 - protein, 33 aa, Mycobacterium
PASVKDRWLLRHRPHLVLDGLRLAARIIGARHT

SEQ ID NO: 1322729 - protein, 25 aa, Mycobacterium
PASVLAVLRRLEGHFTLVFANADEP

SEQ ID NO: 1322730 - protein, 25 aa, Mycobacterium
PASVRELAVYWTARQIGCSWCVDFG

SEQ ID NO: 1322731 - protein, 25 aa, Mycobacterium
PATEEFLRFFTPAPGDGRTFADDVE

SEQ ID NO: 1322732 - protein, 24 aa, Mycobacterium
PATLLDLFAGRKQLIVYRAFMDPG

SEQ ID NO: 1322733 - protein, 23 aa, Mycobacterium
PATPYLTLWARVAGFDLTHLDTA

SEQ ID NO: 1322734 - protein, 34 aa, Mycobacterium
PATQQRILDTLGWDGLADLVLAPGPGVRGRPHPD

SEQ ID NO: 1322735 - protein, 28 aa, Mycobacterium
PATSNVRRALVGAILVALMCAGGYTVAA

SEQ ID NO: 1322736 - protein, 24 aa, Mycobacterium
PATSRPLKLVGIADIVALYPNLEE

SEQ ID NO: 1322737 - protein, 22 aa, Mycobacterium
PATVFVASFIGQANLWAGRQTG

SEQ ID NO: 1322738 - protein, 20 aa, Mycobacterium
PATYTGLLDSIRKAFAKANG

SEQ ID NO: 1322739 - protein, 19 aa, Mycobacterium
PAVALLHVRRRDAGTVTDV

SEQ ID NO: 1322740 - protein, 31 aa, Mycobacterium
PAVARRVARWMVVFLQRPGGQAQFSVWAEAT

SEQ ID NO: 1322741 - protein, 20 aa, Mycobacterium
PAVARRYEALRARRVLAQWR

SEQ ID NO: 1322742 - protein, 25 aa, Mycobacterium
PAVCDAFLAAIARWGAPFEVLTDNG

SEQ ID NO: 1322743 - protein, 25 aa, Mycobacterium
PAVDTMVLARWIAAVCQGLAVQARS

SEQ ID NO: 1322744 - protein, 24 aa, Mycobacterium
PAVGALLCVLAKLTGARAVVEVGT

SEQ ID NO: 1322745 - protein, 20 aa, Mycobacterium
PAVGRRLVAFLGSTIGNLTP

SEQ ID NO: 1322746 - protein, 21 aa, Mycobacterium
PAVKEAWIGLLGPQALWELYG

SEQ ID NO: 1322747 - protein, 18 aa, Mycobacterium
PAVKFPGIDIELSKVLHA

SEQ ID NO: 1322748 - protein, 20 aa, Mycobacterium
PAVLDRVAANLPPTSLTDEQ

SEQ ID NO: 1322749 - protein, 27 aa, Mycobacterium
PAVLGPISSITLSPLYFELDGDFPNHE

SEQ ID NO: 1322750 - protein, 23 aa, Mycobacterium
PAVLWFRRDLRLADLPALLAASE

SEQ ID NO: 1322751 - protein, 22 aa, Mycobacterium
PAVRSRLVALQRELASAPDNVV

SEQ ID NO: 1322752 - protein, 17 aa, Mycobacterium
PAVSYGCSLGHTAHWPG

SEQ ID NO: 1322753 - protein, 23 aa, Mycobacterium
PAVTALAWLTPPADEFTPSAAVE

SEQ ID NO: 1322754 - protein, 17 aa, Mycobacterium
PAVTALGLIAAGIEAIL

SEQ ID NO: 1322755 - protein, 23 aa, Mycobacterium
PAVVGLLRRSGVELVLDLAAANK

SEQ ID NO: 1322756 - protein, 24 aa, Mycobacterium
PAWAPLPLQYADFGAWQSALLADD

SEQ ID NO: 1322757 - protein, 24 aa, Mycobacterium
PAWGWDHILPAFRAIENHELGPDP

SEQ ID NO: 1322758 - protein, 26 aa, Mycobacterium
PAYARSKLAVMLWGLELDRRLRTAGS

SEQ ID NO: 1322759 - protein, 22 aa, Mycobacterium
PAYDLIVVDNPWMDDFAAAGFL

SEQ ID NO: 1322760 - protein, 22 aa, Mycobacterium
PAYRYHRMFLQHLQSGVGGRWL

SEQ ID NO: 1322761 - protein, 22 aa, Mycobacterium
PAYVYPMFEQALRIAAGETPDE

SEQ ID NO: 1322762 - protein, 23 aa, Mycobacterium
PCAPEVPMMTFLDEDEIAARAHL

SEQ ID NO: 1322763 - protein, 25 aa, Mycobacterium
PCEPDAPLPIAKRTRSYLGSCGIPS

SEQ ID NO: 1322764 - protein, 28 aa, Mycobacterium
PCHVHAHYATYPALAAWVCRRLAGISYS

SEQ ID NO: 1322765 - protein, 18 aa, Mycobacterium
PCILKATAGFSYVRLHGP

SEQ ID NO: 1322766 - protein, 19 aa, Mycobacterium
PCLGYAFYAPPRSVPRAGR

SEQ ID NO: 1322767 - protein, 17 aa, Mycobacterium
PCLLGYIDKCSAPCVGR

SEQ ID NO: 1322768 - protein, 17 aa, Mycobacterium
PCLRHRVELGSGSPADD

SEQ ID NO: 1322769 - protein, 22 aa, Mycobacterium
PCTLFDKWRLLPVLDADDRVVD

SEQ ID NO: 1322770 - protein, 17 aa, Mycobacterium
PCTTHWMYADLLARMYP

SEQ ID NO: 1322771 - protein, 18 aa, Mycobacterium
PCVYLVDSGGAFLPRQDE

SEQ ID NO: 1322772 - protein, 24 aa, Mycobacterium
PDAEPVWSHSLLSGFLEIQFDRCS

SEQ ID NO: 1322773 - protein, 23 aa, Mycobacterium
PDAFPLIITHGWPGSVVEFDKVI

SEQ ID NO: 1322774 - protein, 30 aa, Mycobacterium
PDAGFGAFRRGLERRLPLLEPLRYKLVEIP

SEQ ID NO: 1322775 - protein, 25 aa, Mycobacterium
PDALAESFVPPTWDAPTEASGGQVS

SEQ ID NO: 1322776 - protein, 21 aa, Mycobacterium
PDALARLMRALIGEGVFTQRR

SEQ ID NO: 1322777 - protein, 26 aa, Mycobacterium
PDAQRHLAIALAHLRSGRVQLVVVGG

SEQ ID NO: 1322778 - protein, 19 aa, Mycobacterium
PDARIVLCSSVSGLWGGHG

SEQ ID NO: 1322779 - protein, 25 aa, Mycobacterium
PDAVTALWKEQLLMRVDLNAFDRTQ

SEQ ID NO: 1322780 - protein, 29 aa, Mycobacterium
PDCEPLADYLFPAAKILDPFGLENMRYKW

SEQ ID NO: 1322781 - protein, 22 aa, Mycobacterium
PDCPRWKVIDRTDLPKLVDKLR

SEQ ID NO: 1322782 - protein, 25 aa, Mycobacterium
PDDADRLLFTLLLSMREDAVGGVYV

SEQ ID NO: 1322783 - protein, 24 aa, Mycobacterium
PDDALQKVVLARALRLTADGRLDA

SEQ ID NO: 1322784 - protein, 24 aa, Mycobacterium
PDDLLTRVFDPFFTTKPFGEGTGL

SEQ ID NO: 1322785 - protein, 18 aa, Mycobacterium
PDDPLLTARQRAVAARGG

SEQ ID NO: 1322786 - protein, 23 aa, Mycobacterium
PDDQLFMPTLAQDVAFGPANFGI

SEQ ID NO: 1322787 - protein, 19 aa, Mycobacterium
PDEALLMEVPLSLPAGDPA

SEQ ID NO: 1322788 - protein, 36 aa, Mycobacterium
PDEFAVVHKLRRVLSGLDPHQAIDLLMSQLRKTKNN

SEQ ID NO: 1322789 - protein, 24 aa, Mycobacterium
PDEGFVAAIYRWATTGDLTTALAA

SEQ ID NO: 1322790 - protein, 18 aa, Mycobacterium
PDELFIRSLRELIAVDEK

SEQ ID NO: 1322791 - protein, 24 aa, Mycobacterium
PDENADLFWGLRGGKATLGIVTAV

SEQ ID NO: 1322792 - protein, 32 aa, Mycobacterium; identical to SEQ ID NO: 843067

SEQ ID NO: 1322793 - protein, 21 aa, Mycobacterium
PDERRLPIHPAHLGRIDRAVA

SEQ ID NO: 1322794 - protein, 25 aa, Mycobacterium
PDERRVFLLRTCTLGRLSGPACDAL

SEQ ID NO: 1322795 - protein, 28 aa, Mycobacterium
PDESLQNFPFLIARLDQFSRSSELTARA

SEQ ID NO: 1322796 - protein, 27 aa, Mycobacterium
PDEYAPLQALTTWLAEAVAAGAAVIVT

SEQ ID NO: 1322797 - protein, 19 aa, Mycobacterium
PDFARLRREVGVRLHAAMA

SEQ ID NO: 1322798 - protein, 22 aa, Mycobacterium
PDFFEGVMMPELFMADATGATG

SEQ ID NO: 1322799 - protein, 24 aa, Mycobacterium
PDFIEGITAFFEKRQPSFPPLKEE

SEQ ID NO: 1322800 - protein, 17 aa, Mycobacterium
PDFKKPFEPLTPGGFRV

SEQ ID NO: 1322801 - protein, 17 aa, Mycobacterium
PDFPVVLEAVRECLQDV

SEQ ID NO: 1322802 - protein, 25 aa, Mycobacterium
PDFTAMGWPHPRRAAQLWIGMTAEA

SEQ ID NO: 1322803 - protein, 18 aa, Mycobacterium
PDGALNRPALAAIAFSDE

SEQ ID NO: 1322804 - protein, 22 aa, Mycobacterium
PDGDFFGVIVQLPGAGGAITDW

SEQ ID NO: 1322805 - protein, 19 aa, Mycobacterium
PDGGAWLYSETVRQIKALN

SEQ ID NO: 1322806 - protein, 25 aa, Mycobacterium
PDGHLARLRFLRRYTEGLSGPVVVH

SEQ ID NO: 1322807 - protein, 19 aa, Mycobacterium
PDGKPTVLFLCTHNAGRSQ

SEQ ID NO: 1322808 - protein, 22 aa, Mycobacterium
PDGLDRGWYVKPTVFDRADNSM

SEQ ID NO: 1322809 - protein, 21 aa, Mycobacterium
PDGRHEFRWWDGQRWTDQVSS

SEQ ID NO: 1322810 - protein, 23 aa, Mycobacterium
PDGRLVLCLHGFPDSAWGWRKFA

SEQ ID NO: 1322811 - protein, 25 aa, Mycobacterium
PDGRPFFCGTYYPKASFLQLLAAVV

SEQ ID NO: 1322812 - protein, 20 aa, Mycobacterium
PDGSLLITSVERRQVLRYDG

SEQ ID NO: 1322813 - protein, 28 aa, Mycobacterium
PDGTAVPVFLQRSPHFRPPQDSHTPMIM

SEQ ID NO: 1322814 - protein, 27 aa, Mycobacterium
PDGTRMAFLAPWKDRLNVWVQGLEPDA

SEQ ID NO: 1322815 - protein, 18 aa, Mycobacterium
PDGWDTLASFSAGLDFTV

SEQ ID NO: 1322816 - protein, 20 aa, Mycobacterium
PDGYVRFTLGDDGRLLELFI

SEQ ID NO: 1322817 - protein, 20 aa, Mycobacterium
PDHLIKLLDSSPATSAMYVR

SEQ ID NO: 1322818 - protein, 32 aa, Mycobacterium
PDHRRWLNAHVPFYANWIRLKSFWGTADNNYP

SEQ ID NO: 1322819 - protein, 23 aa, Mycobacterium
PDKGLDYGLLRYTRRDETLRALP

SEQ ID NO: 1322820 - protein, 18 aa, Mycobacterium
PDLAPLYAQALVGSVSMA

SEQ ID NO: 1322821 - protein, 26 aa, Mycobacterium
PDLDAAIKWYHDHLGMIVLHEEVNEE

SEQ ID NO: 1322822 - protein, 22 aa, Mycobacterium
PDLEIYLLKSNLGLIPAFQTIW

SEQ ID NO: 1322823 - protein, 28 aa, Mycobacterium
PDLETFAVLPWDTSFARVFCRLYEPDHL

SEQ ID NO: 1322824 - protein, 22 aa, Mycobacterium
PDLLDPPWDWGDTRYEIVIDGA

SEQ ID NO: 1322825 - protein, 19 aa, Mycobacterium
PDLLSAYLYSRAQSVMGGT

SEQ ID NO: 1322826 - protein, 30 aa, Mycobacterium
PDLMAIPDPASFTPIPFIKEGLAIVHCDPH

SEQ ID NO: 1322827 - protein, 29 aa, Mycobacterium
PDLPHVAVFDTAFFHDLPPAAATYAIDAE

SEQ ID NO: 1322828 - protein, 21 aa, Mycobacterium
PDLPRTDFLFMLGANPLVSHG

SEQ ID NO: 1322829 - protein, 19 aa, Mycobacterium
PDLREMLEVRRGDPTYPGW

SEQ ID NO: 1322830 - protein, 23 aa, Mycobacterium
PDLVLDTLTMFGAIGYTWEHDLH

SEQ ID NO: 1322831 - protein, 21 aa, Mycobacterium
PDLVRGVFYAGWDPAAVPIKF

SEQ ID NO: 1322832 - protein, 17 aa, Mycobacterium
PDLWLEYLRGAEHSYRK

SEQ ID NO: 1322833 - protein, 22 aa, Mycobacterium
PDMFTRLIFSLVATGVAPESFY

SEQ ID NO: 1322834 - protein, 25 aa, Mycobacterium
PDNANYLWIQQFYAALGPKGRAGFV

SEQ ID NO: 1322835 - protein, 22 aa, Mycobacterium
PDNMLRIPLGRPGQPEEVATFV

SEQ ID NO: 1322836 - protein, 28 aa, Mycobacterium
PDPADGGQAPFFIYKRALDCGDFREVRA

SEQ ID NO: 1322837 - protein, 31 aa, Mycobacterium
PDPALTKGYFQWSAMSWFALADAGFAPEVWG

SEQ ID NO: 1322838 - protein, 23 aa, Mycobacterium
PDPDPLALVYFADADPVFAQSEH

SEQ ID NO: 1322839 - protein, 17 aa, Mycobacterium
PDPGHAFPAIALCLRFL

SEQ ID NO: 1322840 - protein, 17 aa, Mycobacterium
PDPHQWVEDFHAIAAGM

SEQ ID NO: 1322841 - protein, 18 aa, Mycobacterium
PDPRPHMRGLTRSVLRHE

SEQ ID NO: 1322842 - protein, 23 aa, Mycobacterium
PDPRQWVGTLWRTSTGLVGAAAR

SEQ ID NO: 1322843 - protein, 17 aa, Mycobacterium
PDQKNLWLLAREPRIAP

SEQ ID NO: 1322844 - protein, 41 aa, Mycobacterium
PDRDVGMTWLPLYHDMGLTFLLTGFLTGAEMWLAPTAAFAA

SEQ ID NO: 1322845 - protein, 37 aa, Mycobacterium
PDRFVAGWQVVALQPYGGAWLNSWLDRDLGVSGRLSV

SEQ ID NO: 1322846 - protein, 40 aa, Mycobacterium
PDRFVSGWRIVALQPYGGAWLNSWLDRDLGISGRLSIRAG

SEQ ID NO: 1322847 - protein, 32 aa, Mycobacterium
PDRKDVAALLRWLADGHFVLLGYQRCPVRDGE

SEQ ID NO: 1322848 - protein, 21 aa, Mycobacterium
PDRLRAVIDVLVTLTAEPVGK

SEQ ID NO: 1322849 - protein, 23 aa, Mycobacterium
PDRLREVFVDYLEYLRSPQAATH

SEQ ID NO: 1322850 - protein, 24 aa, Mycobacterium
PDRPFHGYDVFAMIPPPGPNDPAK

SEQ ID NO: 1322851 - protein, 20 aa, Mycobacterium
PDRPVIRHLGFGKGAHFCLG

SEQ ID NO: 1322852 - protein, 21 aa, Mycobacterium
PDRRFSLLPLSARTPAALTQL

SEQ ID NO: 1322853 - protein, 26 aa, Mycobacterium
PDRSLGAILAWFSLIHCEPAELTDVL

SEQ ID NO: 1322854 - protein, 19 aa, Mycobacterium
PDRSLIAFLPVNVRPKGDE

SEQ ID NO: 1322855 - protein, 18 aa, Mycobacterium
PDRWPLPPPADAHDRWLR

SEQ ID NO: 1322856 - protein, 24 aa, Mycobacterium
PDSAQLRLKRLYSGANYRATTSTV

SEQ ID NO: 1322857 - protein, 21 aa, Mycobacterium
PDSAQLRLKRMYPGATYRATT

SEQ ID NO: 1322858 - protein, 26 aa, Mycobacterium
PDSGSTWLLPRLAGVTRAKRMLLLGE

SEQ ID NO: 1322859 - protein, 19 aa, Mycobacterium
PDSIAPLGSPFWPTHRQRA

SEQ ID NO: 1322860 - protein, 24 aa, Mycobacterium
PDSKIVEIPRPAGVVLALTPTTNP

SEQ ID NO: 1322861 - protein, 25 aa, Mycobacterium
PDTEIMGMLMLLIGGGFDTTTALTA

SEQ ID NO: 1322862 - protein, 24 aa, Mycobacterium
PDTESSIVTALREQLRTQKQRYQT

SEQ ID NO: 1322863 - protein, 20 aa, Mycobacterium
PDTLRMQPWDRDQIHRLFDD

SEQ ID NO: 1322864 - protein, 25 aa, Mycobacterium
PDTMYGFLLTLRQRGPHGGPFDYRS

SEQ ID NO: 1322865 - protein, 17 aa, Mycobacterium
PDTPWRVSIISFPSREA

SEQ ID NO: 1322866 - protein, 26 aa, Mycobacterium
PDTWRDPRGFALKFYTSEGNFDMVGN

SEQ ID NO: 1322867 - protein, 28 aa, Mycobacterium
PDVDLQRTVGWFTTIHPVVLTAARQGSA

SEQ ID NO: 1322868 - protein, 35 aa, Mycobacterium
PDVEFRLRKNLIHDWFTFPFLPEAHEDRPGVYRDL

SEQ ID NO: 1322869 - protein, 29 aa, Mycobacterium
PDVGHDFRWLTVDLPPMIELRRKLLPASD

SEQ ID NO: 1322870 - protein, 18 aa, Mycobacterium
PDVLMPVRSLPTTAVGKV

SEQ ID NO: 1322871 - protein, 20 aa, Mycobacterium
PDVLTYNPSAPVRYPNGRTL

SEQ ID NO: 1322872 - protein, 22 aa, Mycobacterium
PDVPPALRRLVLEGRAGVERSL

SEQ ID NO: 1322873 - protein, 21 aa, Mycobacterium
PDVRIWARCSLLRDGTWVHAD

SEQ ID NO: 1322874 - protein, 19 aa, Mycobacterium
PDVRRVPMFGLGCVAGAAG

SEQ ID NO: 1322875 - protein, 19 aa, Mycobacterium
PDVRYYRDAVAPLVDDRRV

SEQ ID NO: 1322876 - protein, 27 aa, Mycobacterium
PDVSYWRRQLFRDGLPWRYVGVLHEYA

SEQ ID NO: 1322877 - protein, 29 aa, Mycobacterium
PDVTKGYYQWGSMTWFAFATAGHAPETWG

SEQ ID NO: 1322878 - protein, 21 aa, Mycobacterium
PDVVILDIGLPGIDGHISVVV

SEQ ID NO: 1322879 - protein, 18 aa, Mycobacterium
PDWELICGVARHLGFGDA

SEQ ID NO: 1322880 - protein, 21 aa, Mycobacterium
PDYDMSMARQLYYGCDVWLNN

SEQ ID NO: 1322881 - protein, 24 aa, Mycobacterium
PDYHLRMSWNFLSRSTSGIPEWMD

SEQ ID NO: 1322882 - protein, 17 aa, Mycobacterium
PDYLRLADAFAQFGNGA

SEQ ID NO: 1322883 - protein, 30 aa, Mycobacterium
PDYPALLRRLVTGERFPALAAALQAEAFDA

SEQ ID NO: 1322884 - protein, 25 aa, Mycobacterium
PEAGDACVLWCLAIRHAVLTGDLEV

SEQ ID NO: 1322885 - protein, 35 aa, Mycobacterium
PEAGGLPIRRYAFPNLKALNFVIVGYLGEGVASCT

SEQ ID NO: 1322886 - protein, 22 aa, Mycobacterium
PEALRLFSALELLHACALVHDD

SEQ ID NO: 1322887 - protein, 24 aa, Mycobacterium
PEAMQPLRTKLVDAAIELADKLVT

SEQ ID NO: 1322888 - protein, 19 aa, Mycobacterium
PEAPGFVVVPWAAVDAWWE

SEQ ID NO: 1322889 - protein, 17 aa, Mycobacterium
PEAPLQLRTLAAADAAA

SEQ ID NO: 1322890 - protein, 24 aa, Mycobacterium
PEAQRDRFLFKLNVDYPTPEEERE

SEQ ID NO: 1322891 - protein, 19 aa, Mycobacterium
PEAVIAFLATAAVGAVWSA

SEQ ID NO: 1322892 - protein, 22 aa, Mycobacterium
PEAWAVWEAIFAKFAAPGMCNP

SEQ ID NO: 1322893 - protein, 22 aa, Mycobacterium
PEAWAVWEAIFAKYAAPGMCNP

SEQ ID NO: 1322894 - protein, 23 aa, Mycobacterium
PEAWAVWEVIFAKYAAPGMCNPD

SEQ ID NO: 1322895 - protein, 18 aa, Mycobacterium
PEDMLDWLAAWIGLSFDG

SEQ ID NO: 1322896 - protein, 23 aa, Mycobacterium
PEDPDAKPRPLGKARWAGAVDCV

SEQ ID NO: 1322897 - protein, 17 aa, Mycobacterium
PEDPGVMWQFSQAVRGL

SEQ ID NO: 1322898 - protein, 20 aa, Mycobacterium
PEDRLRALLTDAARAVLGLD

SEQ ID NO: 1322899 - protein, 19 aa, Mycobacterium
PEDRRLLAAFGPRALAVAR

SEQ ID NO: 1322900 - protein, 26 aa, Mycobacterium
PEDVIDRIFTPFFTTKPFGEGTGLGL

SEQ ID NO: 1322901 - protein, 24 aa, Mycobacterium
PEDWPVMPCHYTGFKLKPVGFFDG

SEQ ID NO: 1322902 - protein, 25 aa, Mycobacterium
PEEARFILDLLTPGLSQIFGMAEGM

SEQ ID NO: 1322903 - protein, 24 aa, Mycobacterium
PEEARLLLGNLTASGYFGGLWLRD

SEQ ID NO: 1322904 - protein, 19 aa, Mycobacterium
PEEDLPWFRKRAVELISYA

SEQ ID NO: 1322905 - protein, 27 aa, Mycobacterium
PEEERQLRHVLLRKFPRHLLGSVPLIY

SEQ ID NO: 1322906 - protein, 21 aa, Mycobacterium
PEEFGVIACYRLKPVRFTSEE

SEQ ID NO: 1322907 - protein, 20 aa, Mycobacterium
PEEPGASDLLLALAADVDAD

SEQ ID NO: 1322908 - protein, 24 aa, Mycobacterium
PEEVATFVVFLASDESRYATGAEF

SEQ ID NO: 1322909 - protein, 19 aa, Mycobacterium
PEFALAGSYALWVYGGPEP

SEQ ID NO: 1322910 - protein, 18 aa, Mycobacterium
PEFDGRIITMPFSFKEID

SEQ ID NO: 1322911 - protein, 18 aa, Mycobacterium
PEFSYRGEFYDIDKARLA

SEQ ID NO: 1322912 - protein, 17 aa, Mycobacterium
PEFTADGDLLFLAARPT

SEQ ID NO: 1322913 - protein, 19 aa, Mycobacterium
PEFVENFFMFIAEEVRELM

SEQ ID NO: 1322914 - protein, 29 aa, Mycobacterium
PEGFTPTLDLFLTPTFRGHLANYGTVLYP

SEQ ID NO: 1322915 - protein, 19 aa, Mycobacterium
PEGIEGRVPFRGPLSTVIH

SEQ ID NO: 1322916 - protein, 20 aa, Mycobacterium
PEGLFDARWLDAAVPDRPVV

SEQ ID NO: 1322917 - protein, 17 aa, Mycobacterium
PEGLKKNLRHRHGRWYW

SEQ ID NO: 1322918 - protein, 19 aa, Mycobacterium
PEGLRWLDSCQEALRASSD

SEQ ID NO: 1322919 - protein, 23 aa, Mycobacterium
PEGQWNMYGNLWMVDLENDRAVS

SEQ ID NO: 1322920 - protein, 18 aa, Mycobacterium
PEGRQMFYSLNRPELIDL

SEQ ID NO: 1322921 - protein, 17 aa, Mycobacterium
PEGVVFEFVERPLSFFT

SEQ ID NO: 1322922 - protein, 23 aa, Mycobacterium
PEHGWVFRDLITGRFVYTPDELV

SEQ ID NO: 1322923 - protein, 24 aa, Mycobacterium
PEHQRLRRMLTPEFTLRRMRRLQP

SEQ ID NO: 1322924 - protein, 24 aa, Mycobacterium
PEHTEWGFAGYVRHFIDKPTIAAV

SEQ ID NO: 1322925 - protein, 23 aa, Mycobacterium
PEIARAYVTALRDLLRALDVSDV

SEQ ID NO: 1322926 - protein, 25 aa, Mycobacterium
PEIEQMQAWLQEWGDSTTPGPNSTG

SEQ ID NO: 1322927 - protein, 28 aa, Mycobacterium
PEIEQMQAWLTQWGMSTMPMMPGMDGMP

SEQ ID NO: 1322928 - protein, 20 aa, Mycobacterium
PEIGARLFISARTVQYHLSK

SEQ ID NO: 1322929 - protein, 20 aa, Mycobacterium
PEIMGLGPIEAVKKALANAK

SEQ ID NO: 1322930 - protein, 29 aa, Mycobacterium
PEIVSEVAELLWYPLWDANIRLDHSVRTV

SEQ ID NO: 1322931 - protein, 24 aa, Mycobacterium
PELFARFRRAVTDTGLYKDSDRLA

SEQ ID NO: 1322932 - protein, 18 aa, Mycobacterium
PELFKQYFGTVIPAGDNK

SEQ ID NO: 1322933 - protein, 19 aa, Mycobacterium
PELIGRQNAAWILMSSEWI

SEQ ID NO: 1322934 - protein, 19 aa, Mycobacterium
PELLFSPDMFHPSAAGYEL

SEQ ID NO: 1322935 - protein, 17 aa, Mycobacterium
PELPLAHPAPRVVVEIH

SEQ ID NO: 1322936 - protein, 19 aa, Mycobacterium
PELPRATVSLTKYNKSHDM

SEQ ID NO: 1322937 - protein, 20 aa, Mycobacterium
PELRRHRVRFVQVGRHQLLT

SEQ ID NO: 1322938 - protein, 25 aa, Mycobacterium
PELRTPWPGQALKDLLVMLAAGPSA

SEQ ID NO: 1322939 - protein, 29 aa, Mycobacterium
PELVKLRQYFDHPLLIEMFADAIRDAAAT

SEQ ID NO: 1322940 - protein, 23 aa, Mycobacterium
PELYQLELKHIFAKAWTAVAHED

SEQ ID NO: 1322941 - protein, 19 aa, Mycobacterium
PENLAYLVNCAGVLDNTGF

SEQ ID NO: 1322942 - protein, 20 aa, Mycobacterium
PEPALLDLIARFVRAAQGER

SEQ ID NO: 1322943 - protein, 19 aa, Mycobacterium
PEPAPAPEPVYEAAPTPAP

SEQ ID NO: 1322944 - protein, 17 aa, Mycobacterium
PEPDRWLAAVGASPLAD

SEQ ID NO: 1322945 - protein, 18 aa, Mycobacterium
PEPDSINSRLWLNRITEA

SEQ ID NO: 1322946 - protein, 23 aa, Mycobacterium
PEPEPLFTVTNPPGTVTVTSYLD

SEQ ID NO: 1322947 - protein, 21 aa, Mycobacterium
PEPHYRPSTKLAAFVRARDLF

SEQ ID NO: 1322948 - protein, 18 aa, Mycobacterium
PEPKIPGPKIPGPENFEP

SEQ ID NO: 1322949 - protein, 17 aa, Mycobacterium
PEPLIDDPYAKILVAGA

SEQ ID NO: 1322950 - protein, 30 aa, Mycobacterium
PEPPAPPVPPPPAPAPPPSPPPVRPPAEPV

SEQ ID NO: 1322951 - protein, 23 aa, Mycobacterium
PEPVNPMVWPNDGLVARRSALAV

SEQ ID NO: 1322952 - protein, 17 aa, Mycobacterium
PEPVWKKLKAELPADPN

SEQ ID NO: 1322953 - protein, 18 aa, Mycobacterium
PEPWYLERKLIDALELPL

SEQ ID NO: 1322954 - protein, 28 aa, Mycobacterium
PEQEYFLVDRHFFLARPDLVNAGRTLFG

SEQ ID NO: 1322955 - protein, 27 aa, Mycobacterium
PEQLFAVGYAACFHSALRLVGRQEKVD

SEQ ID NO: 1322956 - protein, 21 aa, Mycobacterium
PEQLILIGEIARDFGLYTKIT

SEQ ID NO: 1322957 - protein, 22 aa, Mycobacterium
PEQQLALLALRLEMAAVYQRLV

SEQ ID NO: 1322958 - protein, 23 aa, Mycobacterium
PEQWGGLQCDPTIFYEAVRRIAS

SEQ ID NO: 1322959 - protein, 24 aa, Mycobacterium
PEQYQAMILLAAWCALRFGELTEL

SEQ ID NO: 1322960 - protein, 23 aa, Mycobacterium
PERHGAGTVLAFGGRRGERIYGD

SEQ ID NO: 1322961 - protein, 21 aa, Mycobacterium
PERIDTDVLAALRSAERDPAG

SEQ ID NO: 1322962 - protein, 27 aa, Mycobacterium
PERLAALQRLWLIEAVKYNVVPLDDRS

SEQ ID NO: 1322963 - protein, 17 aa, Mycobacterium
PERLRQALDTFGPIFIQ

SEQ ID NO: 1322964 - protein, 17 aa, Mycobacterium
PERMDLKAMLRFAPEAI

SEQ ID NO: 1322965 - protein, 26 aa, Mycobacterium
PERMPGARLWMYTNFHCNLACDYCCV

SEQ ID NO: 1322966 - protein, 19 aa, Mycobacterium
PERRQIFARRLDLPGRGQT

SEQ ID NO: 1322967 - protein, 21 aa, Mycobacterium
PERVLFRRLAVFAGGFDLDGA

SEQ ID NO: 1322968 - protein, 34 aa, Mycobacterium
PESDGHPLMFAAQAWNYMFPLGEPPNYEPSPSDS

SEQ ID NO: 1322969 - protein, 24 aa, Mycobacterium
PESGMELLRLFSRNHYFGPEEHDI

SEQ ID NO: 1322970 - protein, 28 aa, Mycobacterium
PESLQFHLERGDFSRWLGHTIADTELAA

SEQ ID NO: 1322971 - protein, 24 aa, Mycobacterium
PESLWRSWRSAGVPVIAIAPPGSA

SEQ ID NO: 1322972 - protein, 43 aa, Mycobacterium
PESVKRFTALLSNAKTIFWNGPMGVFEFPAFAAGTKGVAEAII

SEQ ID NO: 1322973 - protein, 18 aa, Mycobacterium
PESVLPSLALLAHNVRTA

SEQ ID NO: 1322974 - protein, 18 aa, Mycobacterium
PETELTVLTPRREQLTGD

SEQ ID NO: 1322975 - protein, 23 aa, Mycobacterium
PETNYRIGFVPQGIGADLIATIE

SEQ ID NO: 1322976 - protein, 25 aa, Mycobacterium
PEVAESRFLLFPTVAHSHAERVRPQ

SEQ ID NO: 1322977 - protein, 32 aa, Mycobacterium
PEVAFVVPVPHRFLPAFPPRAIQFLGTATIVA

SEQ ID NO: 1322978 - protein, 25 aa, Mycobacterium
PEVFARFRRAVTDTGLYKDSDRLAI

SEQ ID NO: 1322979 - protein, 19 aa, Mycobacterium
PEVFLFDEPFGALDEITRG

SEQ ID NO: 1322980 - protein, 17 aa, Mycobacterium
PEVHYLTSPLRAAAVRA

SEQ ID NO: 1322981 - protein, 24 aa, Mycobacterium
PEVIRRIPHRLAGPCVRLKDYGIR

SEQ ID NO: 1322982 - protein, 23 aa, Mycobacterium
PEVKLWDLAPLDILVREAGGRFT

SEQ ID NO: 1322983 - protein, 18 aa, Mycobacterium
PEVLTRPGLPAPAPTGSG

SEQ ID NO: 1322984 - protein, 28 aa, Mycobacterium
PEVQATLETVFWGALLQVQSRHIDYRDM

SEQ ID NO: 1322985 - protein, 23 aa, Mycobacterium
PEVRAQWDIREVPLHVLVDGVDL

SEQ ID NO: 1322986 - protein, 24 aa, Mycobacterium
PEVSGLLALFLLHHARRPARMRGD

SEQ ID NO: 1322987 - protein, 18 aa, Mycobacterium
PEWEPITAALNTELGNGW

SEQ ID NO: 1322988 - protein, 20 aa, Mycobacterium
PEWRYPFEGRMHAVTAMAIA

SEQ ID NO: 1322989 - protein, 17 aa, Mycobacterium
PEWTFSGATGSVSVTGS

SEQ ID NO: 1322990 - protein, 21 aa, Mycobacterium
PEYREWLLSDATAAIADMGFT

SEQ ID NO: 1322991 - protein, 24 aa, Mycobacterium
PEYRLMTIRNWATTTRMLTLLDEM

SEQ ID NO: 1322992 - protein, 19 aa, Mycobacterium
PFADVPYDVLFNSKVQPIL

SEQ ID NO: 1322993 - protein, 17 aa, Mycobacterium
PFAELASTPTWTMNINH

SEQ ID NO: 1322994 - protein, 28 aa, Mycobacterium
PFAGHPTVGASWWLKDRGLPIKTLQVPA

SEQ ID NO: 1322995 - protein, 17 aa, Mycobacterium
PFALARIDTVLSPVAQL

SEQ ID NO: 1322996 - protein, 18 aa, Mycobacterium
PFALSTQAPRLTPPAAAT

SEQ ID NO: 1322997 - protein, 20 aa, Mycobacterium
PFDITKPAALIRPQSVRFTD

SEQ ID NO: 1322998 - protein, 25 aa, Mycobacterium
PFDLTAPTALFRPQHVRFLDALPDW

SEQ ID NO: 1322999 - protein, 25 aa, Mycobacterium
PFDPVVAALILRALVTRVRQAALDL

SEQ ID NO: 1323000 - protein, 19 aa, Mycobacterium
PFDRRGFGFGFGPEGRRTV

SEQ ID NO: 1323001 - protein, 17 aa, Mycobacterium
PFDTHDRLFRFADTLLF

SEQ ID NO: 1323002 - protein, 22 aa, Mycobacterium
PFDVRRYLPDGWDTLASFSAGL

SEQ ID NO: 1323003 - protein, 21 aa, Mycobacterium
PFGDLTFPLPADELPYLHPVT

SEQ ID NO: 1323004 - protein, 18 aa, Mycobacterium
PFGFFSVPYEASLATTYW

SEQ ID NO: 1323005 - protein, 23 aa, Mycobacterium
PFGGRVPPIWIGASGPRMLDIVG

SEQ ID NO: 1323006 - protein, 32 aa, Mycobacterium; identical to SEQ ID NO: 121585

SEQ ID NO: 1323007 - protein, 23 aa, Mycobacterium
PFGLVTGAWIDPPSSVRVGALTA

SEQ ID NO: 1323008 - protein, 19 aa, Mycobacterium
PFGLWRATLPAAEKSNLPA

SEQ ID NO: 1323009 - protein, 17 aa, Mycobacterium
PFGPDLLFTATDVPGFV

SEQ ID NO: 1323010 - protein, 23 aa, Mycobacterium
PFGTIQYVSFMSVSNWGSSGRWT

SEQ ID NO: 1323011 - protein, 22 aa, Mycobacterium
PFHQRLVNSMFTLSTLVGLSVA

SEQ ID NO: 1323012 - protein, 20 aa, Mycobacterium
PFIMQADGKAWLFAPNGLAD

SEQ ID NO: 1323013 - protein, 18 aa, Mycobacterium
PFITFRVWHPLSHDRMEV

SEQ ID NO: 1323014 - protein, 35 aa, Mycobacterium; identical to SEQ ID NO: 844019

SEQ ID NO: 1323015 - protein, 26 aa, Mycobacterium
PFKKSFRAWLDGEWFRVGMAEEIGGV

SEQ ID NO: 1323016 - protein, 18 aa, Mycobacterium
PFLDADLAEWRKIIDLNM

SEQ ID NO: 1323017 - protein, 22 aa, Mycobacterium
PFNATRLGRLIAEKTDFPAGVV

SEQ ID NO: 1323018 - protein, 19 aa, Mycobacterium
PFPIKEFHPFPRAMMGPGA

SEQ ID NO: 1323019 - protein, 31 aa, Mycobacterium
PFQIIESVPMYRLRRYFPPDVRPGSKPVGPP

SEQ ID NO: 1323020 - protein, 20 aa, Mycobacterium
PFSCRAYFIDGNLANTLVLF

SEQ ID NO: 1323021 - protein, 25 aa, Mycobacterium
PFSSIQDYAPAPPSPSFYGAANRSG

SEQ ID NO: 1323022 - protein, 27 aa, Mycobacterium
PFTLENGLLTGIRKLARPKLKARYGDR

SEQ ID NO: 1323023 - protein, 25 aa, Mycobacterium
PFTLENGLLTGIRKLARPRLRERYG

SEQ ID NO: 1323024 - protein, 19 aa, Mycobacterium
PFVAMGFAAAHTSTLRLIP

SEQ ID NO: 1323025 - protein, 18 aa, Mycobacterium
PFVEKLLLDGARSKLTRA

SEQ ID NO: 1323026 - protein, 19 aa, Mycobacterium
PFVVRPGRTFTTHPHPTHL

SEQ ID NO: 1323027 - protein, 18 aa, Mycobacterium
PGAAWQRCRTHYTTNLMA

SEQ ID NO: 1323028 - protein, 24 aa, Mycobacterium
PGAFRFVMMVLRHIPRPIFRKLPI

SEQ ID NO: 1323029 - protein, 22 aa, Mycobacterium
PGAHHLMLVSPIILYDHPEIAE

SEQ ID NO: 1323030 - protein, 20 aa, Mycobacterium
PGALFTEIMGALPVIEHTRS

SEQ ID NO: 1323031 - protein, 17 aa, Mycobacterium
PGALLDGNLLNVNVNVD

SEQ ID NO: 1323032 - protein, 22 aa, Mycobacterium
PGAPPLERLLAYGRARHTFVHD

SEQ ID NO: 1323033 - protein, 20 aa, Mycobacterium
PGAVSEYRKVRDRASFAFAL

SEQ ID NO: 1323034 - protein, 23 aa, Mycobacterium
PGCRFWNLVVWNQFMAVPGVSDA

SEQ ID NO: 1323035 - protein, 28 aa, Mycobacterium
PGCYPTAALLALWPALAEGLVEPAVTVV

SEQ ID NO: 1323036 - protein, 17 aa, Mycobacterium
PGDFIVEYIGQTRGWFY

SEQ ID NO: 1323037 - protein, 23 aa, Mycobacterium
PGDGGTWFLQRAIGYERAAEMTL

SEQ ID NO: 1323038 - protein, 27 aa, Mycobacterium
PGDIAQCDLWFPPTTIPVGYGQTRTPT

SEQ ID NO: 1323039 - protein, 25 aa, Mycobacterium
PGDLAIVRAILALADAFELEVVAEG

SEQ ID NO: 1323040 - protein, 20 aa, Mycobacterium
PGDMYVLHPFTVHAADEHRG

SEQ ID NO: 1323041 - protein, 26 aa, Mycobacterium
PGDRDLMLISPIILYDHPEIAEQSGG

SEQ ID NO: 1323042 - protein, 26 aa, Mycobacterium
PGDTFWRTSPYLPLSWQRKAVQLVAP

SEQ ID NO: 1323043 - protein, 25 aa, Mycobacterium
PGDVRTVLRVLYLVFNEGYSGDVDL

SEQ ID NO: 1323044 - protein, 20 aa, Mycobacterium
PGEFDLSSLRWALSGAEQVD

SEQ ID NO: 1323045 - protein, 23 aa, Mycobacterium
PGEGIDFGLLRYLRADTAERLCA

SEQ ID NO: 1323046 - protein, 28 aa, Mycobacterium
PGEHVQFRLLPVGDPFRFLVNLAKSVPV

SEQ ID NO: 1323047 - protein, 20 aa, Mycobacterium
PGELAPKLALAATAELAGSA

SEQ ID NO: 1323048 - protein, 31 aa, Mycobacterium
PGERSSLLVQDLQMRPGSSSGWHTHPGPEHS

SEQ ID NO: 1323049 - protein, 29 aa, Mycobacterium
PGETASIFLPSVPNLLLLASEMEAQRNHV

SEQ ID NO: 1323050 - protein, 25 aa, Mycobacterium
PGFDDRPFSVFYSLAVLSIGQEHAI

SEQ ID NO: 1323051 - protein, 26 aa, Mycobacterium
PGFFACEAAGLRWLAAAGGAACVPVI

SEQ ID NO: 1323052 - protein, 17 aa, Mycobacterium
PGGEWWAREIELVDQLR

SEQ ID NO: 1323053 - protein, 22 aa, Mycobacterium
PGGFGMLPLSARTPDALAATAH

SEQ ID NO: 1323054 - protein, 27 aa, Mycobacterium
PGGKSALGLWSWAIPANSAAPDAAWAF

SEQ ID NO: 1323055 - protein, 26 aa, Mycobacterium
PGGMYRNKCWLPYPGDDVLLCLGIHG

SEQ ID NO: 1323056 - protein, 19 aa, Mycobacterium
PGGPRYPGDAMPYVPGRVD

SEQ ID NO: 1323057 - protein, 23 aa, Mycobacterium
PGGQLATYLAAWQAGASAVDGAS

SEQ ID NO: 1323058 - protein, 25 aa, Mycobacterium
PGGRLVFNTFMPRPGYLSDDAVREL

SEQ ID NO: 1323059 - protein, 26 aa, Mycobacterium
PGHADMRTELPWLFLAGAGQHPGGGL

SEQ ID NO: 1323060 - protein, 26 aa, Mycobacterium
PGHAFPAIALCLRFLAAGDHPTLLTG

SEQ ID NO: 1323061 - protein, 24 aa, Mycobacterium
PGHALFAQFAYPPNELGYCGPQDA

SEQ ID NO: 1323062 - protein, 24 aa, Mycobacterium
PGHPAALALLTDYAASVTPATGDA

SEQ ID NO: 1323063 - protein, 18 aa, Mycobacterium
PGHRLMENWHPLGVVGVI

SEQ ID NO: 1323064 - protein, 19 aa, Mycobacterium
PGHRLMETWHPLGVVGVIT

SEQ ID NO: 1323065 - protein, 20 aa, Mycobacterium
PGHRLMETWHPLGVVGVITA

SEQ ID NO: 1323066 - protein, 42 aa, Mycobacterium
PGHRLMETWHPLGVVGVITAFNFPVAVWSWNTAVALVCGDTV

SEQ ID NO: 1323067 - protein, 26 aa, Mycobacterium
PGHRVHGHPLPWQDLRAAFTERGWLD

SEQ ID NO: 1323068 - protein, 25 aa, Mycobacterium
PGIEAKEIWGSRLLFDLIGCTDNDG

SEQ ID NO: 1323069 - protein, 19 aa, Mycobacterium
PGIQMGFSDAGAHLRNMAF

SEQ ID NO: 1323070 - protein, 25 aa, Mycobacterium
PGITNGRIPRLYGRQASEFVIRRAM

SEQ ID NO: 1323071 - protein, 26 aa, Mycobacterium
PGKSDPLDALLWLAERPGEPSWPSPF

SEQ ID NO: 1323072 - protein, 17 aa, Mycobacterium
PGLADAIRRSGLPKVPT

SEQ ID NO: 1323073 - protein, 29 aa, Mycobacterium
PGLDKDFHARWFGWVNPAQTMTAYGQMCM

SEQ ID NO: 1323074 - protein, 19 aa, Mycobacterium
PGLFARVAPLALGTAVGDE

SEQ ID NO: 1323075 - protein, 19 aa, Mycobacterium
PGLIEAYRDRLPVGDDWTP

SEQ ID NO: 1323076 - protein, 18 aa, Mycobacterium
PGLLLGHLNMVTSTYTWA

SEQ ID NO: 1323077 - protein, 22 aa, Mycobacterium
PGLPPITVPVLGPPPPPPPPPG

SEQ ID NO: 1323078 - protein, 23 aa, Mycobacterium
PGLQRLPLWRSLRERIEEADRLL

SEQ ID NO: 1323079 - protein, 25 aa, Mycobacterium
PGLRRVDGRWVRWGCSVAARAEAAL

SEQ ID NO: 1323080 - protein, 24 aa, Mycobacterium
PGLTQLLRPGRRYTTFVRIAPTST

SEQ ID NO: 1323081 - protein, 24 aa, Mycobacterium
PGLVTVGVWLATQLPPLVTPVGAP

SEQ ID NO: 1323082 - protein, 24 aa, Mycobacterium
PGMDNVSKLLWANWHRELGEIAMD

SEQ ID NO: 1323083 - protein, 26 aa, Mycobacterium
PGMFNRIHVDYYGAVTPITQLSSINV

SEQ ID NO: 1323084 - protein, 19 aa, Mycobacterium
PGMIDGIIGAAPLASRVVV

SEQ ID NO: 1323085 - protein, 38 aa, Mycobacterium
PGMPRLLKWLSQFIPLVAGPLPIPFFFGVLAGEEPIDH

SEQ ID NO: 1323086 - protein, 26 aa, Mycobacterium
PGMPTRPYSMRILGGSWPSTSPESWS

SEQ ID NO: 1323087 - protein, 19 aa, Mycobacterium
PGNAHFTFRGCEGDSLLML

SEQ ID NO: 1323088 - protein, 32 aa, Mycobacterium
PGNEGRGYVLRRLLRRIIRAAKLLGVDDPIMA

SEQ ID NO: 1323089 - protein, 24 aa, Mycobacterium
PGNPVILPTVWDAWSAKLATDAGF

SEQ ID NO: 1323090 - protein, 19 aa, Mycobacterium
PGNRWRPAFTPADPERFTA

SEQ ID NO: 1323091 - protein, 17 aa, Mycobacterium
PGPFLACTLAARVAAGC

SEQ ID NO: 1323092 - protein, 19 aa, Mycobacterium
PGPFLSWAALIDSGGVAPE

SEQ ID NO: 1323093 - protein, 28 aa, Mycobacterium
PGPGENIPAWLVFDQRYRDRYIFAGLQP

SEQ ID NO: 1323094 - protein, 27 aa, Mycobacterium
PGPGTFTYWDYTQLRFPKNRGMRIDFI

SEQ ID NO: 1323095 - protein, 17 aa, Mycobacterium
PGPQEWRWDKDAGITRL

SEQ ID NO: 1323096 - protein, 25 aa, Mycobacterium
PGPQGPLYMLGCEVKAMYPLGPIFH

SEQ ID NO: 1323097 - protein, 19 aa, Mycobacterium
PGPVCRLIATLPALEVPRP

SEQ ID NO: 1323098 - protein, 32 aa, Mycobacterium
PGPVRRLAHALPLLKPPFPDPGTPVQLVHHDD

SEQ ID NO: 1323099 - protein, 18 aa, Mycobacterium
PGQALANAVLLLIAGHDS

SEQ ID NO: 1323100 - protein, 25 aa, Mycobacterium
PGQDWALLLAMVKVILDGGLEHRGD

SEQ ID NO: 1323101 - protein, 19 aa, Mycobacterium
PGQSIQLPEAPYLHLFVPR

SEQ ID NO: 1323102 - protein, 23 aa, Mycobacterium
PGQYAMPWYGGGMFPWEGYGPFI

SEQ ID NO: 1323103 - protein, 17 aa, Mycobacterium
PGRAMVITLPASDAPYL

SEQ ID NO: 1323104 - protein, 25 aa, Mycobacterium
PGRAPLSVPIWYGYEPGGEVLLWTE

SEQ ID NO: 1323105 - protein, 33 aa, Mycobacterium
PGRAQFHYLESWLLPPLGLRVTVFHFNPGHERD

SEQ ID NO: 1323106 - protein, 30 aa, Mycobacterium
PGRAQFHYLESWLLPSLNLRASVFHFNPGF

SEQ ID NO: 1323107 - protein, 27 aa, Mycobacterium
PGRAVALPTYPFQRRRFWPKTSGITTD

SEQ ID NO: 1323108 - protein, 18 aa, Mycobacterium
PGRFEGRWSLAGAQPKIA

SEQ ID NO: 1323109 - protein, 30 aa, Mycobacterium
PGRHPTSTAIFIYFLGPDNLTYEYSFGVQL

SEQ ID NO: 1323110 - protein, 23 aa, Mycobacterium
PGRKTVRRHLLTGVLGCGKCGHY

SEQ ID NO: 1323111 - protein, 31 aa, Mycobacterium
PGRLQVSFLPGLLRWIPFTKGDYWVLKIDDA

SEQ ID NO: 1323112 - protein, 25 aa, Mycobacterium
PGRMIPQALPPIWDPNLMAEEVRRV

SEQ ID NO: 1323113 - protein, 17 aa, Mycobacterium
PGRPTLAARWKPALEPV

SEQ ID NO: 1323114 - protein, 21 aa, Mycobacterium
PGRRFAWEVNHGWAYWGYEMA

SEQ ID NO: 1323115 - protein, 18 aa, Mycobacterium
PGRRWSWQVAGIPATAHG

SEQ ID NO: 1323116 - protein, 23 aa, Mycobacterium
PGRSSPWLSWSELVPCDEYVRPE

SEQ ID NO: 1323117 - protein, 24 aa, Mycobacterium
PGSASEFGVYWPTLVPATTVEHTV

SEQ ID NO: 1323118 - protein, 20 aa, Mycobacterium
PGSEAVDINGGAGGAGGAGG

SEQ ID NO: 1323119 - protein, 25 aa, Mycobacterium
PGSGLPWQASHIEEFGLVRPPADEL

SEQ ID NO: 1323120 - protein, 22 aa, Mycobacterium
PGSIRIGFDRIWDPDRDGRVVL

SEQ ID NO: 1323121 - protein, 24 aa, Mycobacterium
PGSIYPTLQLLVDEGLLTAAETEG

SEQ ID NO: 1323122 - protein, 26 aa, Mycobacterium
PGTFEGWLHRITTNLFLDMVRRRGRI
